United States Patent 7,341,835 (METHODS OF ANALYSIS OF ALTERNATIVE SPLICING IN MOUSE) - sequence listing, part 12

SEQ ID NO: 438708 - DNA, 25 bp, Mus musculus
gaggataaaaaagacccgagcagcc

SEQ ID NO: 438709 - DNA, 25 bp, Mus musculus
gaggatatcactaaccctgggctca

SEQ ID NO: 438710 - DNA, 25 bp, Mus musculus
gaggatatcatgacccagctacacg

SEQ ID NO: 438711 - DNA, 25 bp, Mus musculus
gaggatatcctgagccatcttcgca

SEQ ID NO: 438712 - DNA, 25 bp, Mus musculus
gaggatatctgagcctgccatgcca

SEQ ID NO: 438713 - DNA, 25 bp, Mus musculus
gaggatcaaccacatcagctcctgg

SEQ ID NO: 438714 - DNA, 25 bp, Mus musculus
gaggatcaccttcatagacacggag

SEQ ID NO: 438715 - DNA, 25 bp, Mus musculus
gaggatcagatcaataatggaggca

SEQ ID NO: 438716 - DNA, 25 bp, Mus musculus
gaggatcagcccatctacttggcag

SEQ ID NO: 438717 - DNA, 25 bp, Mus musculus
gaggatcagtagagacgaaaccgca

SEQ ID NO: 438718 - DNA, 25 bp, Mus musculus
gaggatcatttcagcccgggagttc

SEQ ID NO: 438719 - DNA, 25 bp, Mus musculus
gaggatccacctgaaatttgggcca

SEQ ID NO: 438720 - DNA, 25 bp, Mus musculus
gaggatcccagtggcagcagctatg

SEQ ID NO: 438721 - DNA, 25 bp, Mus musculus
gaggatcccattccagctccagaag

SEQ ID NO: 438722 - DNA, 25 bp, Mus musculus
gaggatcccgatcctctgttggaga

SEQ ID NO: 438723 - DNA, 25 bp, Mus musculus
gaggatccgttttcctgtctgtggc

SEQ ID NO: 438724 - DNA, 25 bp, Mus musculus
gaggatcctccacgtcgcagaaatg

SEQ ID NO: 438725 - DNA, 25 bp, Mus musculus
gaggatcctccatagaaccagcctg

SEQ ID NO: 438726 - DNA, 25 bp, Mus musculus
gaggatcgcgcttggtcgcctttcg

SEQ ID NO: 438727 - DNA, 25 bp, Mus musculus
gaggatctcagacagttttcaaaca

SEQ ID NO: 438728 - DNA, 25 bp, Mus musculus
gaggatctgccttgcactctggaga

SEQ ID NO: 438729 - DNA, 25 bp, Mus musculus
gaggatctgcgcaacacacactgct

SEQ ID NO: 438730 - DNA, 25 bp, Mus musculus
gaggatctggccttgttcccggaaa

SEQ ID NO: 438731 - DNA, 25 bp, Mus musculus
gaggatctgttccagctcaggcagt

SEQ ID NO: 438732 - DNA, 25 bp, Mus musculus
gaggatctttacaacacgctaagca

SEQ ID NO: 438733 - DNA, 25 bp, Mus musculus
gaggatgaacccggtctgccggtct

SEQ ID NO: 438734 - DNA, 25 bp, Mus musculus
gaggatgactataccacgtggctgg

SEQ ID NO: 438735 - DNA, 25 bp, Mus musculus
gaggatgactccaaacctgccatgg

SEQ ID NO: 438736 - DNA, 25 bp, Mus musculus
gaggatgactcttaacacccagcag

SEQ ID NO: 438737 - DNA, 25 bp, Mus musculus
gaggatgactggtcgaaaccgctcc

SEQ ID NO: 438738 - DNA, 25 bp, Mus musculus
gaggatgacttcttcgaggctacgg

SEQ ID NO: 438739 - DNA, 25 bp, Mus musculus
gaggatgagctttcctgaaccagca

SEQ ID NO: 438740 - DNA, 25 bp, Mus musculus
gaggatgcactgctcagctggtcca

SEQ ID NO: 438741 - DNA, 25 bp, Mus musculus
gaggatgcacttagtcctgttggga

SEQ ID NO: 438742 - DNA, 25 bp, Mus musculus
gaggatgccaagctcacgaagatcg

SEQ ID NO: 438743 - DNA, 25 bp, Mus musculus
gaggatgccatcgacaccatgacgt

SEQ ID NO: 438744 - DNA, 25 bp, Mus musculus
gaggatgctcctgtacgctggtaca

SEQ ID NO: 438745 - DNA, 25 bp, Mus musculus
gaggatggagcccacctcaggcttt

SEQ ID NO: 438746 - DNA, 25 bp, Mus musculus
gaggatggctcagtacaaatagcag

SEQ ID NO: 438747 - DNA, 25 bp, Mus musculus
gaggatgggctcaagtactacagga

SEQ ID NO: 438748 - DNA, 25 bp, Mus musculus
gaggatgtaagctctgactccgccc

SEQ ID NO: 438749 - DNA, 25 bp, Mus musculus
gaggatgtcctgaagtcatgggcac

SEQ ID NO: 438750 - DNA, 25 bp, Mus musculus
gaggatgttcaacctaaacgaggcc

SEQ ID NO: 438751 - DNA, 25 bp, Mus musculus
gaggatgttccccatgactccagag

SEQ ID NO: 438752 - DNA, 25 bp, Mus musculus
gaggattatcccaccgaatctgtcg

SEQ ID NO: 438753 - DNA, 25 bp, Mus musculus
gaggattcacgctcccagaagtcag

SEQ ID NO: 438754 - DNA, 25 bp, Mus musculus
gaggattcagctccatcaggttcag

SEQ ID NO: 438755 - DNA, 25 bp, Mus musculus
gaggattcatagctaccccgaaggg

SEQ ID NO: 438756 - DNA, 25 bp, Mus musculus
gaggattccaaagtccgagccatcg

SEQ ID NO: 438757 - DNA, 25 bp, Mus musculus
gaggattctcatttaactctgggaa

SEQ ID NO: 438758 - DNA, 25 bp, Mus musculus
gaggattctgaaaccgtaaactttg

SEQ ID NO: 438759 - DNA, 25 bp, Mus musculus
gaggattcttctagagccctatagg

SEQ ID NO: 438760 - DNA, 25 bp, Mus musculus
gaggattctttacttcatgacgagg

SEQ ID NO: 438761 - DNA, 25 bp, Mus musculus
gaggattgcccttcgactacggcca

SEQ ID NO: 438762 - DNA, 25 bp, Mus musculus
gaggattgtccagttgttgatgcag

SEQ ID NO: 438763 - DNA, 25 bp, Mus musculus
gaggatttaaccatccatgcgggtg

SEQ ID NO: 438764 - DNA, 25 bp, Mus musculus
gaggatttcatatttgcccacgtga

SEQ ID NO: 438765 - DNA, 25 bp, Mus musculus
gaggatttcctctctgagctgccgg

SEQ ID NO: 438766 - DNA, 25 bp, Mus musculus
gaggatttcctgtcccctacggaga

SEQ ID NO: 438767 - DNA, 25 bp, Mus musculus
gaggatttctgaaccaacatatgaa

SEQ ID NO: 438768 - DNA, 25 bp, Mus musculus
gaggattttactctacggttcaatc

SEQ ID NO: 438769 - DNA, 25 bp, Mus musculus
gaggcaaactccaggtaccggtgca

SEQ ID NO: 438770 - DNA, 25 bp, Mus musculus
gaggcaaactctgcaatctgtgatg

SEQ ID NO: 438771 - DNA, 25 bp, Mus musculus
gaggcaaaggcattccaggacacac

SEQ ID NO: 438772 - DNA, 25 bp, Mus musculus
gaggcaaatattcatcggcagcaag

SEQ ID NO: 438773 - DNA, 25 bp, Mus musculus
gaggcaaatggagtgaatggacccc

SEQ ID NO: 438774 - DNA, 25 bp, Mus musculus
gaggcaacctgcagcgagttcccac

SEQ ID NO: 438775 - DNA, 25 bp, Mus musculus
gaggcaagaaaccttcccagagtgt

SEQ ID NO: 438776 - DNA, 25 bp, Mus musculus
gaggcaagatgcttacgtgaccgga

SEQ ID NO: 438777 - DNA, 25 bp, Mus musculus
gaggcaagctgtcaggacctgctca

SEQ ID NO: 438778 - DNA, 25 bp, Mus musculus
gaggcaagtcttctgctgctaaggt

SEQ ID NO: 438779 - DNA, 25 bp, Mus musculus
gaggcaattgtggacacccctacag

SEQ ID NO: 438780 - DNA, 25 bp, Mus musculus
gaggcacaaactgagatcttaccaa

SEQ ID NO: 438781 - DNA, 25 bp, Mus musculus
gaggcacacaaatctctgcgtttgg

SEQ ID NO: 438782 - DNA, 25 bp, Mus musculus
gaggcacagttcttgtccaccatga

SEQ ID NO: 438783 - DNA, 25 bp, Mus musculus
gaggcacataatagcccagtctcag

SEQ ID NO: 438784 - DNA, 25 bp, Mus musculus
gaggcacattggcttcacagggaca

SEQ ID NO: 438785 - DNA, 25 bp, Mus musculus
gaggcaccaccttcatgttcttgtg

SEQ ID NO: 438786 - DNA, 25 bp, Mus musculus
gaggcaccagcaatcagaagacttc

SEQ ID NO: 438787 - DNA, 25 bp, Mus musculus
gaggcacccagatgactcagacctg

SEQ ID NO: 438788 - DNA, 25 bp, Mus musculus
gaggcacctggtcctagacagaata

SEQ ID NO: 438789 - DNA, 25 bp, Mus musculus
gaggcacctgttcccgccaggagct

SEQ ID NO: 438790 - DNA, 25 bp, Mus musculus
gaggcaccttgctggcagagctctt

SEQ ID NO: 438791 - DNA, 25 bp, Mus musculus
gaggcacgtgaccacacctgtattg

SEQ ID NO: 438792 - DNA, 25 bp, Mus musculus
gaggcactattcctagttctctgac

SEQ ID NO: 438793 - DNA, 25 bp, Mus musculus
gaggcactcagcttagccaggtgga

SEQ ID NO: 438794 - DNA, 25 bp, Mus musculus
gaggcactgaaatgacctggatggt

SEQ ID NO: 438795 - DNA, 25 bp, Mus musculus
gaggcactgcgcttggatttcagca

SEQ ID NO: 438796 - DNA, 25 bp, Mus musculus
gaggcactgtccatgttggtttgga

SEQ ID NO: 438797 - DNA, 25 bp, Mus musculus
gaggcacttatggagtgtccacaga

SEQ ID NO: 438798 - DNA, 25 bp, Mus musculus
gaggcactttctgtttaccatgacc

SEQ ID NO: 438799 - DNA, 25 bp, Mus musculus
gaggcagaaagcgaatttgaccccg

SEQ ID NO: 438800 - DNA, 25 bp, Mus musculus
gaggcagacaattgagaccacaggt

SEQ ID NO: 438801 - DNA, 25 bp, Mus musculus
gaggcagacaggaggatctttacaa

SEQ ID NO: 438802 - DNA, 25 bp, Mus musculus
gaggcagacctttagtgagcacact

SEQ ID NO: 438803 - DNA, 25 bp, Mus musculus
gaggcagacggcctagacagtctca

SEQ ID NO: 438804 - DNA, 25 bp, Mus musculus
gaggcagagactttcagggtaatta

SEQ ID NO: 438805 - DNA, 25 bp, Mus musculus
gaggcagcactacaaaacttgcgaa

SEQ ID NO: 438806 - DNA, 25 bp, Mus musculus
gaggcagcactaggacacatacaga

SEQ ID NO: 438807 - DNA, 25 bp, Mus musculus
gaggcagcagccaaaaaccagttcc

SEQ ID NO: 438808 - DNA, 25 bp, Mus musculus
gaggcagccaaagaaaacgaacgag

SEQ ID NO: 438809 - DNA, 25 bp, Mus musculus
gaggcagccagtcctgatagcatca

SEQ ID NO: 438810 - DNA, 25 bp, Mus musculus
gaggcagcccatgcagttctcgtgg

SEQ ID NO: 438811 - DNA, 25 bp, Mus musculus
gaggcagcgactgtgtattctttct

SEQ ID NO: 438812 - DNA, 25 bp, Mus musculus
gaggcagctgccctccaggttacag

SEQ ID NO: 438813 - DNA, 25 bp, Mus musculus
gaggcaggactatgaatttaaagcc

SEQ ID NO: 438814 - DNA, 25 bp, Mus musculus
gaggcaggaggaaatttcgcagaca

SEQ ID NO: 438815 - DNA, 25 bp, Mus musculus
gaggcaggcaaagctaaggtccact

SEQ ID NO: 438816 - DNA, 25 bp, Mus musculus
gaggcaggctcttttccagctgaac

SEQ ID NO: 438817 - DNA, 25 bp, Mus musculus
gaggcagggcagcatcttatacagc

SEQ ID NO: 438818 - DNA, 25 bp, Mus musculus
gaggcagggtcaaacagatccagga

SEQ ID NO: 438819 - DNA, 25 bp, Mus musculus
gaggcaggtctctgcctggtttgaa

SEQ ID NO: 438820 - DNA, 25 bp, Mus musculus
gaggcagtgccaatttagataccag

SEQ ID NO: 438821 - DNA, 25 bp, Mus musculus
gaggcagtgctcgtaaggttaacac

SEQ ID NO: 438822 - DNA, 25 bp, Mus musculus
gaggcagtgtcaagggttctgacca

SEQ ID NO: 438823 - DNA, 25 bp, Mus musculus
gaggcagtgtgtgcttctccatcca

SEQ ID NO: 438824 - DNA, 25 bp, Mus musculus
gaggcagtttttagccgttaggaga

SEQ ID NO: 438825 - DNA, 25 bp, Mus musculus
gaggcatcccagagttcataaagac

SEQ ID NO: 438826 - DNA, 25 bp, Mus musculus
gaggcatctgtgaggcgagacttcc

SEQ ID NO: 438827 - DNA, 25 bp, Mus musculus
gaggcatgcacctttcttctccctg

SEQ ID NO: 438828 - DNA, 25 bp, Mus musculus
gaggcatgggaagggtcctactatc

SEQ ID NO: 438829 - DNA, 25 bp, Mus musculus
gaggcatgtaccgagtgagcattat

SEQ ID NO: 438830 - DNA, 25 bp, Mus musculus
gaggcattaacaggtccccagacta

SEQ ID NO: 438831 - DNA, 25 bp, Mus musculus
gaggcattctagtggtgtcacccag

SEQ ID NO: 438832 - DNA, 25 bp, Mus musculus
gaggcattctgggtcttctctgtcc

SEQ ID NO: 438833 - DNA, 25 bp, Mus musculus
gaggcatttccagtatcacaaggcg

SEQ ID NO: 438834 - DNA, 25 bp, Mus musculus
gaggcatttgccacaacacagaggg

SEQ ID NO: 438835 - DNA, 25 bp, Mus musculus
gaggcattttgtctgtttatctaac

SEQ ID NO: 438836 - DNA, 25 bp, Mus musculus
gaggccaaaaagacagtaagagacg

SEQ ID NO: 438837 - DNA, 25 bp, Mus musculus
gaggccaacgctccacgttcgcttg

SEQ ID NO: 438838 - DNA, 25 bp, Mus musculus
gaggccaactcggatacccctatgt

SEQ ID NO: 438839 - DNA, 25 bp, Mus musculus
gaggccaagacctttaacccagagg

SEQ ID NO: 438840 - DNA, 25 bp, Mus musculus
gaggccaaggactcaccgaggagtc

SEQ ID NO: 438841 - DNA, 25 bp, Mus musculus
gaggccaagggacaaactcccaagg

SEQ ID NO: 438842 - DNA, 25 bp, Mus musculus
gaggccaaggtctgtaacccactag

SEQ ID NO: 438843 - DNA, 25 bp, Mus musculus
gaggccaagtgtgaatgtctgtttg

SEQ ID NO: 438844 - DNA, 25 bp, Mus musculus
gaggccaccacacctaccatttatg

SEQ ID NO: 438845 - DNA, 25 bp, Mus musculus
gaggccacgccgacatagtgcatct

SEQ ID NO: 438846 - DNA, 25 bp, Mus musculus
gaggccactggcgtctatctcactg

SEQ ID NO: 438847 - DNA, 25 bp, Mus musculus
gaggccagacctcggtgcgtaccca

SEQ ID NO: 438848 - DNA, 25 bp, Mus musculus
gaggccagcacctgtgggtttacca

SEQ ID NO: 438849 - DNA, 25 bp, Mus musculus
gaggccagcctgtagtcagatattt

SEQ ID NO: 438850 - DNA, 25 bp, Mus musculus
gaggccagccttggttatagagcaa

SEQ ID NO: 438851 - DNA, 25 bp, Mus musculus
gaggccagctgactacaaacttttg

SEQ ID NO: 438852 - DNA, 25 bp, Mus musculus
gaggccaggcccagtttacctctct

SEQ ID NO: 438853 - DNA, 25 bp, Mus musculus
gaggccagggtcttactgacatgcc

SEQ ID NO: 438854 - DNA, 25 bp, Mus musculus
gaggccaggttgttcccggaagaat

SEQ ID NO: 438855 - DNA, 25 bp, Mus musculus
gaggccatagtcatggaaggagcaa

SEQ ID NO: 438856 - DNA, 25 bp, Mus musculus
gaggccattccgtcagtggagctga

SEQ ID NO: 438857 - DNA, 25 bp, Mus musculus
gaggcccaaaggtcccaatctgaac

SEQ ID NO: 438858 - DNA, 25 bp, Mus musculus
gaggcccagaaatagccgccttggc

SEQ ID NO: 438859 - DNA, 25 bp, Mus musculus
gaggcccatcatcccaggcatggaa

SEQ ID NO: 438860 - DNA, 25 bp, Mus musculus
gaggccccagaaagccaacagaata

SEQ ID NO: 438861 - DNA, 25 bp, Mus musculus
gaggccccagtccattgcataaacg

SEQ ID NO: 438862 - DNA, 25 bp, Mus musculus
gaggcccctgaagaaactaagatcg

SEQ ID NO: 438863 - DNA, 25 bp, Mus musculus
gaggcccgatacaaggcacagatgg

SEQ ID NO: 438864 - DNA, 25 bp, Mus musculus
gaggcccgctacttgtttcttctgg

SEQ ID NO: 438865 - DNA, 25 bp, Mus musculus
gaggcccggagttctacctcgagaa

SEQ ID NO: 438866 - DNA, 25 bp, Mus musculus
gaggcccggatccttcgcaatgaga

SEQ ID NO: 438867 - DNA, 25 bp, Mus musculus
gaggcccggcacactgaaaattcat

SEQ ID NO: 438868 - DNA, 25 bp, Mus musculus
gaggcccgtgtttgaaggactccca

SEQ ID NO: 438869 - DNA, 25 bp, Mus musculus
gaggccctagcatagctgagttcta

SEQ ID NO: 438870 - DNA, 25 bp, Mus musculus
gaggccctcacaactaacgtctgga

SEQ ID NO: 438871 - DNA, 25 bp, Mus musculus
gaggccctcccttttgtgactgctt

SEQ ID NO: 438872 - DNA, 25 bp, Mus musculus
gaggccctcctcatggaatcagagt

SEQ ID NO: 438873 - DNA, 25 bp, Mus musculus
gaggccctcgccatgcttgatatca

SEQ ID NO: 438874 - DNA, 25 bp, Mus musculus
gaggccctgatgaagtccgtgcaat

SEQ ID NO: 438875 - DNA, 25 bp, Mus musculus
gaggccctgcctggtgacaatgtcg

SEQ ID NO: 438876 - DNA, 25 bp, Mus musculus
gaggccctgcctttggttgaatgag

SEQ ID NO: 438877 - DNA, 25 bp, Mus musculus
gaggccctgctaaggctctggcgct

SEQ ID NO: 438878 - DNA, 25 bp, Mus musculus
gaggccctgggacatacaactgctt

SEQ ID NO: 438879 - DNA, 25 bp, Mus musculus
gaggccctgggatcttgcttaaata

SEQ ID NO: 438880 - DNA, 25 bp, Mus musculus
gaggccctggtagagcttcagtcca

SEQ ID NO: 438881 - DNA, 25 bp, Mus musculus
gaggcccttcaagtggctctacaag

SEQ ID NO: 438882 - DNA, 25 bp, Mus musculus
gaggcccttcctgaaacattgtgtg

SEQ ID NO: 438883 - DNA, 25 bp, Mus musculus
gaggcccttcgacaactaagatatg

SEQ ID NO: 438884 - DNA, 25 bp, Mus musculus
gaggccctttacaagacccagtgaa

SEQ ID NO: 438885 - DNA, 25 bp, Mus musculus
gaggccctttgtaaagagaatataa

SEQ ID NO: 438886 - DNA, 25 bp, Mus musculus
gaggccgaatatccagcaagcgctg

SEQ ID NO: 438887 - DNA, 25 bp, Mus musculus
gaggccgcggacaaagagcttctaa

SEQ ID NO: 438888 - DNA, 25 bp, Mus musculus
gaggccgctcgctgaagcaagagct

SEQ ID NO: 438889 - DNA, 25 bp, Mus musculus
gaggccggagaaggcgacctatatc

SEQ ID NO: 438890 - DNA, 25 bp, Mus musculus
gaggccggccctttatgaagtacca

SEQ ID NO: 438891 - DNA, 25 bp, Mus musculus
gaggccgtggctgatgtatacgacc

SEQ ID NO: 438892 - DNA, 25 bp, Mus musculus
gaggccgttacgtaccagaagttgg

SEQ ID NO: 438893 - DNA, 25 bp, Mus musculus
gaggccgttccctgtgcatccaagt

SEQ ID NO: 438894 - DNA, 25 bp, Mus musculus
gaggccgttttcaatagaaaccagg

SEQ ID NO: 438895 - DNA, 25 bp, Mus musculus
gaggcctacagagagattatccgtg

SEQ ID NO: 438896 - DNA, 25 bp, Mus musculus
gaggcctacgagagcttcacctgcc

SEQ ID NO: 438897 - DNA, 25 bp, Mus musculus
gaggcctacgtgctaaacatcatca

SEQ ID NO: 438898 - DNA, 25 bp, Mus musculus
gaggcctatgccacaatgctgagaa

SEQ ID NO: 438899 - DNA, 25 bp, Mus musculus
gaggcctatggcgatctttctgaaa

SEQ ID NO: 438900 - DNA, 25 bp, Mus musculus
gaggcctcaagaccatgctgctaat

SEQ ID NO: 438901 - DNA, 25 bp, Mus musculus
gaggcctcaagagtaccggcgcttc

SEQ ID NO: 438902 - DNA, 25 bp, Mus musculus
gaggcctcagaggttccagacaacg

SEQ ID NO: 438903 - DNA, 25 bp, Mus musculus
gaggcctccatgcaaaaatctgttt

SEQ ID NO: 438904 - DNA, 25 bp, Mus musculus
gaggcctcgaagttgcagttcatct

SEQ ID NO: 438905 - DNA, 25 bp, Mus musculus
gaggcctcgagtgctaactccgctg

SEQ ID NO: 438906 - DNA, 25 bp, Mus musculus
gaggcctgacctgctagaagggtac

SEQ ID NO: 438907 - DNA, 25 bp, Mus musculus
gaggcctggtagcatcgttatcacg

SEQ ID NO: 438908 - DNA, 25 bp, Mus musculus
gaggcctggtagtgacagcaaaaac

SEQ ID NO: 438909 - DNA, 25 bp, Mus musculus
gaggcctggtgttgactgttactgc

SEQ ID NO: 438910 - DNA, 25 bp, Mus musculus
gaggcctgtttccttcgtctggcag

SEQ ID NO: 438911 - DNA, 25 bp, Mus musculus
gaggccttccgatgctatacctgtg

SEQ ID NO: 438912 - DNA, 25 bp, Mus musculus
gaggccttcctaaagacagtaagca

SEQ ID NO: 438913 - DNA, 25 bp, Mus musculus
gaggcctttattctacgcagtcagc

SEQ ID NO: 438914 - DNA, 25 bp, Mus musculus
gaggcctttgccagatctacagacc

SEQ ID NO: 438915 - DNA, 25 bp, Mus musculus
gaggcctttgcccagagatactgct

SEQ ID NO: 438916 - DNA, 25 bp, Mus musculus
gaggcgacacccattttgattctga

SEQ ID NO: 438917 - DNA, 25 bp, Mus musculus
gaggcgagacccacaactgtcctat

SEQ ID NO: 438918 - DNA, 25 bp, Mus musculus
gaggcgagccaagaagaagcgtttc

SEQ ID NO: 438919 - DNA, 25 bp, Mus musculus
gaggcgaggccttgctaatttgtgt

SEQ ID NO: 438920 - DNA, 25 bp, Mus musculus
gaggcgaggtttcactcagtaagtt

SEQ ID NO: 438921 - DNA, 25 bp, Mus musculus
gaggcgataaaagcagtctgaccag

SEQ ID NO: 438922 - DNA, 25 bp, Mus musculus
gaggcgcaggcctgtcatctgagct

SEQ ID NO: 438923 - DNA, 25 bp, Mus musculus
gaggcgcagttcacccagtagaaga

SEQ ID NO: 438924 - DNA, 25 bp, Mus musculus
gaggcgccagcagcatattgtaccg

SEQ ID NO: 438925 - DNA, 25 bp, Mus musculus
gaggcgccgcaacttcaaagtcatg

SEQ ID NO: 438926 - DNA, 25 bp, Mus musculus
gaggcgccttctgtcggtatgcaga

SEQ ID NO: 438927 - DNA, 25 bp, Mus musculus
gaggcgcggtgcactgtgggacacg

SEQ ID NO: 438928 - DNA, 25 bp, Mus musculus
gaggcgctagcacagcttttcctag

SEQ ID NO: 438929 - DNA, 25 bp, Mus musculus
gaggcgctcgccagctgctacttgt

SEQ ID NO: 438930 - DNA, 25 bp, Mus musculus
gaggcgctgagacgtaaccgacttc

SEQ ID NO: 438931 - DNA, 25 bp, Mus musculus
gaggcgcttctaactcggctccttg

SEQ ID NO: 438932 - DNA, 25 bp, Mus musculus
gaggcgcttctttcccaaccttaag

SEQ ID NO: 438933 - DNA, 25 bp, Mus musculus
gaggcggaaacggactcacagagct

SEQ ID NO: 438934 - DNA, 25 bp, Mus musculus
gaggcggacacacaacgtcttggaa

SEQ ID NO: 438935 - DNA, 25 bp, Mus musculus
gaggcggagtccttcgtttgcagac

SEQ ID NO: 438936 - DNA, 25 bp, Mus musculus
gaggcggctgctctcaaaatccagt

SEQ ID NO: 438937 - DNA, 25 bp, Mus musculus
gaggcgggaataccatctagctgtc

SEQ ID NO: 438938 - DNA, 25 bp, Mus musculus
gaggcgtccgcctccccaaaggaga

SEQ ID NO: 438939 - DNA, 25 bp, Mus musculus
gaggcgtctgcacatctggttctca

SEQ ID NO: 438940 - DNA, 25 bp, Mus musculus
gaggcgtctgcttaacccggcttct

SEQ ID NO: 438941 - DNA, 25 bp, Mus musculus
gaggcgtgcgcttcgcaaacggaaa

SEQ ID NO: 438942 - DNA, 25 bp, Mus musculus
gaggcgtggaactgcagactccacc

SEQ ID NO: 438943 - DNA, 25 bp, Mus musculus
gaggcgtggccaactctttcagggc

SEQ ID NO: 438944 - DNA, 25 bp, Mus musculus
gaggcgttgggatatttaacaacca

SEQ ID NO: 438945 - DNA, 25 bp, Mus musculus
gaggcgttttgaagctggaaaaagc

SEQ ID NO: 438946 - DNA, 25 bp, Mus musculus
gaggctaaacttgcagctccagcag

SEQ ID NO: 438947 - DNA, 25 bp, Mus musculus
gaggctaccctaatctattgagtga

SEQ ID NO: 438948 - DNA, 25 bp, Mus musculus
gaggctaccctcagtatcagtgatg

SEQ ID NO: 438949 - DNA, 25 bp, Mus musculus
gaggctaccgacaccggcctggagt

SEQ ID NO: 438950 - DNA, 25 bp, Mus musculus
gaggctaccttcttctaaagccatt

SEQ ID NO: 438951 - DNA, 25 bp, Mus musculus
gaggctacgcgcatgtcaacggctg

SEQ ID NO: 438952 - DNA, 25 bp, Mus musculus
gaggctactaaacccaataggcagt

SEQ ID NO: 438953 - DNA, 25 bp, Mus musculus
gaggctagactacatcacagcagaa

SEQ ID NO: 438954 - DNA, 25 bp, Mus musculus
gaggctagacttgaggaccacagga

SEQ ID NO: 438955 - DNA, 25 bp, Mus musculus
gaggctagcactgttgtgtacatgg

SEQ ID NO: 438956 - DNA, 25 bp, Mus musculus
gaggctaggaccgactggctgtcat

SEQ ID NO: 438957 - DNA, 25 bp, Mus musculus
gaggctatctgtgcgatgactccca

SEQ ID NO: 438958 - DNA, 25 bp, Mus musculus
gaggctatgcccgactatctggaag

SEQ ID NO: 438959 - DNA, 25 bp, Mus musculus
gaggctcaagtagagtccctgaagg

SEQ ID NO: 438960 - DNA, 25 bp, Mus musculus
gaggctcacacatttgcacgaagga

SEQ ID NO: 438961 - DNA, 25 bp, Mus musculus
gaggctcagaagcatcccggtctta

SEQ ID NO: 438962 - DNA, 25 bp, Mus musculus
gaggctcagagtgaagagacagctc

SEQ ID NO: 438963 - DNA, 25 bp, Mus musculus
gaggctcatagctccagtgccagga

SEQ ID NO: 438964 - DNA, 25 bp, Mus musculus
gaggctccatacactacttccgggt

SEQ ID NO: 438965 - DNA, 25 bp, Mus musculus
gaggctcccctggtgtccatgacta

SEQ ID NO: 438966 - DNA, 25 bp, Mus musculus
gaggctccctacagctgaggtttga

SEQ ID NO: 438967 - DNA, 25 bp, Mus musculus
gaggctccctcgctgcgctaaactt

SEQ ID NO: 438968 - DNA, 25 bp, Mus musculus
gaggctccctggatcctgaacaagg

SEQ ID NO: 438969 - DNA, 25 bp, Mus musculus
gaggctcccttaacaggcggctttg

SEQ ID NO: 438970 - DNA, 25 bp, Mus musculus
gaggctctaccttcaccattgggaa

SEQ ID NO: 438971 - DNA, 25 bp, Mus musculus
gaggctctagtgagtttttgctaag

SEQ ID NO: 438972 - DNA, 25 bp, Mus musculus
gaggctctctgtgtcgagagtctca

SEQ ID NO: 438973 - DNA, 25 bp, Mus musculus
gaggctctgcattcagtctccagca

SEQ ID NO: 438974 - DNA, 25 bp, Mus musculus
gaggctctggaaaaccatcagggtg

SEQ ID NO: 438975 - DNA, 25 bp, Mus musculus
gaggctctgtaatctagggaaaaga

SEQ ID NO: 438976 - DNA, 25 bp, Mus musculus
gaggctcttggcgtggtagaactaa

SEQ ID NO: 438977 - DNA, 25 bp, Mus musculus
gaggctctttctcaaatcttagtgg

SEQ ID NO: 438978 - DNA, 25 bp, Mus musculus
gaggctcttttgttcgtccaagcaa

SEQ ID NO: 438979 - DNA, 25 bp, Mus musculus
gaggctgaactttatcgactggcac

SEQ ID NO: 438980 - DNA, 25 bp, Mus musculus
gaggctgacccaagcaattttgcta

SEQ ID NO: 438981 - DNA, 25 bp, Mus musculus
gaggctgaccttccaaacctagatg

SEQ ID NO: 438982 - DNA, 25 bp, Mus musculus
gaggctgacgttgctctgctgccca

SEQ ID NO: 438983 - DNA, 25 bp, Mus musculus
gaggctgactccatgctgtttgtac

SEQ ID NO: 438984 - DNA, 25 bp, Mus musculus
gaggctgactcggtacggcagtcca

SEQ ID NO: 438985 - DNA, 25 bp, Mus musculus
gaggctgagccccatagaagaaaag

SEQ ID NO: 438986 - DNA, 25 bp, Mus musculus
gaggctgagtagctgcagactaacc

SEQ ID NO: 438987 - DNA, 25 bp, Mus musculus
gaggctgagtcaggaagacttaaaa

SEQ ID NO: 438988 - DNA, 25 bp, Mus musculus
gaggctgatgctttcgaccctggaa

SEQ ID NO: 438989 - DNA, 25 bp, Mus musculus
gaggctgcacctaacagactggcga

SEQ ID NO: 438990 - DNA, 25 bp, Mus musculus
gaggctgcagccctagaatttagag

SEQ ID NO: 438991 - DNA, 25 bp, Mus musculus
gaggctgcagtgacatattctaggt

SEQ ID NO: 438992 - DNA, 25 bp, Mus musculus
gaggctgccaacgttcactgggcgc

SEQ ID NO: 438993 - DNA, 25 bp, Mus musculus
gaggctgccagattccagcctgctg

SEQ ID NO: 438994 - DNA, 25 bp, Mus musculus
gaggctgccatcttgactgggacaa

SEQ ID NO: 438995 - DNA, 25 bp, Mus musculus
gaggctgccatggtaaggtctcccg

SEQ ID NO: 438996 - DNA, 25 bp, Mus musculus
gaggctgccctgcaccagaaaatga

SEQ ID NO: 438997 - DNA, 25 bp, Mus musculus
gaggctgccggaacaacagttgctt

SEQ ID NO: 438998 - DNA, 25 bp, Mus musculus
gaggctgcctccatccttcaagagt

SEQ ID NO: 438999 - DNA, 25 bp, Mus musculus
gaggctgcgtgaaggatccgcttcc

SEQ ID NO: 439000 - DNA, 25 bp, Mus musculus
gaggctggaccgaagctggatagaa

SEQ ID NO: 439001 - DNA, 25 bp, Mus musculus
gaggctggagagaaatcgtgtttta

SEQ ID NO: 439002 - DNA, 25 bp, Mus musculus
gaggctggcgacagttaatccagaa

SEQ ID NO: 439003 - DNA, 25 bp, Mus musculus
gaggctgggcacatacagttcagtc

SEQ ID NO: 439004 - DNA, 25 bp, Mus musculus
gaggctgggcctctgtcttcctgaa

SEQ ID NO: 439005 - DNA, 25 bp, Mus musculus
gaggctgggctgagaccctcatgac

SEQ ID NO: 439006 - DNA, 25 bp, Mus musculus
gaggctgggtgatgggcgtcgctct

SEQ ID NO: 439007 - DNA, 25 bp, Mus musculus
gaggctgggttggtagtccacccca

SEQ ID NO: 439008 - DNA, 25 bp, Mus musculus
gaggctgtcagaaccaactactgca

SEQ ID NO: 439009 - DNA, 25 bp, Mus musculus
gaggctgtcgcaggcgcgttctctc

SEQ ID NO: 439010 - DNA, 25 bp, Mus musculus
gaggctgtggctatatgcctgtcca

SEQ ID NO: 439011 - DNA, 25 bp, Mus musculus
gaggctgtgtccactgaggctaaga

SEQ ID NO: 439012 - DNA, 25 bp, Mus musculus
gaggctgtgtcctcgtttcagtgaa

SEQ ID NO: 439013 - DNA, 25 bp, Mus musculus
gaggctgttgctggaccttttcgag

SEQ ID NO: 439014 - DNA, 25 bp, Mus musculus
gaggcttaacacgttctctgctggt

SEQ ID NO: 439015 - DNA, 25 bp, Mus musculus
gaggcttcaaacacttccttgtgga

SEQ ID NO: 439016 - DNA, 25 bp, Mus musculus
gaggcttcctaactcttcactgaga

SEQ ID NO: 439017 - DNA, 25 bp, Mus musculus
gaggcttcctggttcgagacaaatt

SEQ ID NO: 439018 - DNA, 25 bp, Mus musculus
gaggcttcgccttcctgtagtaaga

SEQ ID NO: 439019 - DNA, 25 bp, Mus musculus
gaggcttcggctgagcccgaaaaca

SEQ ID NO: 439020 - DNA, 25 bp, Mus musculus
gaggcttcttcccaacagcaaaggc

SEQ ID NO: 439021 - DNA, 25 bp, Mus musculus
gaggcttgacaccagggagttaccc

SEQ ID NO: 439022 - DNA, 25 bp, Mus musculus
gaggcttgatctctaccccgtggac

SEQ ID NO: 439023 - DNA, 25 bp, Mus musculus
gaggcttgctcgtcttcgtgatcaa

SEQ ID NO: 439024 - DNA, 25 bp, Mus musculus
gaggcttgggagacaatcacgttca

SEQ ID NO: 439025 - DNA, 25 bp, Mus musculus
gaggcttgggtcaaccctcacggta

SEQ ID NO: 439026 - DNA, 25 bp, Mus musculus
gaggcttggtatccccatttgcaac

SEQ ID NO: 439027 - DNA, 25 bp, Mus musculus
gaggcttgtggcgtggtttctaacc

SEQ ID NO: 439028 - DNA, 25 bp, Mus musculus
gaggcttgttctctatcggacaaaa

SEQ ID NO: 439029 - DNA, 25 bp, Mus musculus
gaggctttagcgatcgccatggcga

SEQ ID NO: 439030 - DNA, 25 bp, Mus musculus
gaggctttatctagaccgcttctgg

SEQ ID NO: 439031 - DNA, 25 bp, Mus musculus
gaggctttctgtatcgtttgccaaa

SEQ ID NO: 439032 - DNA, 25 bp, Mus musculus
gaggctttcttgaaataccccagga

SEQ ID NO: 439033 - DNA, 25 bp, Mus musculus
gaggctttgatgagacccggttcct

SEQ ID NO: 439034 - DNA, 25 bp, Mus musculus
gaggctttgcgtccctcgcagttca

SEQ ID NO: 439035 - DNA, 25 bp, Mus musculus
gaggctttggccatgcttccacagg

SEQ ID NO: 439036 - DNA, 25 bp, Mus musculus
gaggctttggtatccttgggtctca

SEQ ID NO: 439037 - DNA, 25 bp, Mus musculus
gaggctttgtgaattccagtcgtcc

SEQ ID NO: 439038 - DNA, 25 bp, Mus musculus
gaggcttttgctctctcagttgtga

SEQ ID NO: 439039 - DNA, 25 bp, Mus musculus
gagggaaccatgtcaccggaagctt

SEQ ID NO: 439040 - DNA, 25 bp, Mus musculus
gagggaacccagtgttacctagaag

SEQ ID NO: 439041 - DNA, 25 bp, Mus musculus
gagggaacccctatcaagatcacag

SEQ ID NO: 439042 - DNA, 25 bp, Mus musculus
gagggaacttcattaggctgcaggc

SEQ ID NO: 439043 - DNA, 25 bp, Mus musculus
gagggaacttccatgccacagctgg

SEQ ID NO: 439044 - DNA, 25 bp, Mus musculus
gagggaacttgcatcgaaacttggg

SEQ ID NO: 439045 - DNA, 25 bp, Mus musculus
gagggaagcccactgcaaatctgag

SEQ ID NO: 439046 - DNA, 25 bp, Mus musculus
gagggaaggcctcctgaagtactac

SEQ ID NO: 439047 - DNA, 25 bp, Mus musculus
gagggaataacgctggccacacagt

SEQ ID NO: 439048 - DNA, 25 bp, Mus musculus
gagggacaaaggacaaatatcctgg

SEQ ID NO: 439049 - DNA, 25 bp, Mus musculus
gagggacaactgcttgtcatcacag

SEQ ID NO: 439050 - DNA, 25 bp, Mus musculus
gagggacagcgctattccattcaga

SEQ ID NO: 439051 - DNA, 25 bp, Mus musculus
gagggacaggacacgtacgcctttt

SEQ ID NO: 439052 - DNA, 25 bp, Mus musculus
gagggaccaagctctttgccttatg

SEQ ID NO: 439053 - DNA, 25 bp, Mus musculus
gagggaccaccgacttgacttctgt

SEQ ID NO: 439054 - DNA, 25 bp, Mus musculus
gagggaccataacaggaagtacctg

SEQ ID NO: 439055 - DNA, 25 bp, Mus musculus
gagggaccattccactgtacactgg

SEQ ID NO: 439056 - DNA, 25 bp, Mus musculus
gagggacccgattcaaattcttagg

SEQ ID NO: 439057 - DNA, 25 bp, Mus musculus
gagggacccggagagacaccaggaa

SEQ ID NO: 439058 - DNA, 25 bp, Mus musculus
gagggacctccaaacctgacgtgct

SEQ ID NO: 439059 - DNA, 25 bp, Mus musculus
gagggacctggaagcaacacccgca

SEQ ID NO: 439060 - DNA, 25 bp, Mus musculus
gagggacgattattaaccattgctg

SEQ ID NO: 439061 - DNA, 25 bp, Mus musculus
gagggactccatctactacacgctg

SEQ ID NO: 439062 - DNA, 25 bp, Mus musculus
gagggactccctctctaataaaagg

SEQ ID NO: 439063 - DNA, 25 bp, Mus musculus
gagggactctctccggatcagatag

SEQ ID NO: 439064 - DNA, 25 bp, Mus musculus
gagggactcttctatccagctgtgg

SEQ ID NO: 439065 - DNA, 25 bp, Mus musculus
gagggactgccttactagaacttct

SEQ ID NO: 439066 - DNA, 25 bp, Mus musculus
gagggacttcaaattctggtatagg

SEQ ID NO: 439067 - DNA, 25 bp, Mus musculus
gagggacttccaaacgtaccgcctg

SEQ ID NO: 439068 - DNA, 25 bp, Mus musculus
gagggagaagcaagcctatttaaga

SEQ ID NO: 439069 - DNA, 25 bp, Mus musculus
gagggagacatcctcctggtcaact

SEQ ID NO: 439070 - DNA, 25 bp, Mus musculus
gagggagaccagcaatataccgtga

SEQ ID NO: 439071 - DNA, 25 bp, Mus musculus
gagggagaccccacctgctttctct

SEQ ID NO: 439072 - DNA, 25 bp, Mus musculus
gagggagagctctcatggctgcaat

SEQ ID NO: 439073 - DNA, 25 bp, Mus musculus
gagggagaggacatttaaaggtcca

SEQ ID NO: 439074 - DNA, 25 bp, Mus musculus
gagggagcattcactggccatgcca

SEQ ID NO: 439075 - DNA, 25 bp, Mus musculus
gagggagccaacagaacactgacca

SEQ ID NO: 439076 - DNA, 25 bp, Mus musculus
gagggagcccaggactatgtatcac

SEQ ID NO: 439077 - DNA, 25 bp, Mus musculus
gagggagcccctgttcttgtgccaa

SEQ ID NO: 439078 - DNA, 25 bp, Mus musculus
gagggagcctcagctaagctccaag

SEQ ID NO: 439079 - DNA, 25 bp, Mus musculus
gagggagcctgccacaactgctctt

SEQ ID NO: 439080 - DNA, 25 bp, Mus musculus
gagggagtcatcagctgaaacctcc

SEQ ID NO: 439081 - DNA, 25 bp, Mus musculus
gagggagtccctagcgccctggttt

SEQ ID NO: 439082 - DNA, 25 bp, Mus musculus
gagggagtctccatcaacgtcattg

SEQ ID NO: 439083 - DNA, 25 bp, Mus musculus
gagggagtgcaacaacaagctactg

SEQ ID NO: 439084 - DNA, 25 bp, Mus musculus
gagggagtgtctcaccgcaaagctt

SEQ ID NO: 439085 - DNA, 25 bp, Mus musculus
gagggataaccttcacctgggtgga

SEQ ID NO: 439086 - DNA, 25 bp, Mus musculus
gagggatctaaggaacagagagaca

SEQ ID NO: 439087 - DNA, 25 bp, Mus musculus
gagggatctgaaccacagagcgctt

SEQ ID NO: 439088 - DNA, 25 bp, Mus musculus
gagggatgacatagctcgagccttt

SEQ ID NO: 439089 - DNA, 25 bp, Mus musculus
gagggatgtttgatcaccccaccag

SEQ ID NO: 439090 - DNA, 25 bp, Mus musculus
gagggattatggaagtcactccgac

SEQ ID NO: 439091 - DNA, 25 bp, Mus musculus
gagggattgcctttgcactgaacac

SEQ ID NO: 439092 - DNA, 25 bp, Mus musculus
gagggattgtccattgatgttgcta

SEQ ID NO: 439093 - DNA, 25 bp, Mus musculus
gagggattgtcctgctcagctagag

SEQ ID NO: 439094 - DNA, 25 bp, Mus musculus
gagggcaagagcttcacctacgcag

SEQ ID NO: 439095 - DNA, 25 bp, Mus musculus
gagggcaagctccacccgtggaact

SEQ ID NO: 439096 - DNA, 25 bp, Mus musculus
gagggcaccacgtgggcttctttaa

SEQ ID NO: 439097 - DNA, 25 bp, Mus musculus
gagggcacccagcattcgtactcag

SEQ ID NO: 439098 - DNA, 25 bp, Mus musculus
gagggcacccggaggaaagctcaac

SEQ ID NO: 439099 - DNA, 25 bp, Mus musculus
gagggcacgccatttctgtagttca

SEQ ID NO: 439100 - DNA, 25 bp, Mus musculus
gagggcagatacctaactcaggaaa

SEQ ID NO: 439101 - DNA, 25 bp, Mus musculus
gagggcagcgcttggtattatcccg

SEQ ID NO: 439102 - DNA, 25 bp, Mus musculus
gagggcaggtccacttcaatgatga

SEQ ID NO: 439103 - DNA, 25 bp, Mus musculus
gagggcatctgcaaccgcaacatag

SEQ ID NO: 439104 - DNA, 25 bp, Mus musculus
gagggcatgacttctttgacagcaa

SEQ ID NO: 439105 - DNA, 25 bp, Mus musculus
gagggcatggcagacttttcaggaa

SEQ ID NO: 439106 - DNA, 25 bp, Mus musculus
gagggccattccagacagctagttc

SEQ ID NO: 439107 - DNA, 25 bp, Mus musculus
gagggccattctgttgtttaaccgg

SEQ ID NO: 439108 - DNA, 25 bp, Mus musculus
gagggcccattcatcagccgggaaa

SEQ ID NO: 439109 - DNA, 25 bp, Mus musculus
gagggccggtacttcatcgatcgag

SEQ ID NO: 439110 - DNA, 25 bp, Mus musculus
gagggccgtgaccacccgcactttt

SEQ ID NO: 439111 - DNA, 25 bp, Mus musculus
gagggcctagacttaagagctttta

SEQ ID NO: 439112 - DNA, 25 bp, Mus musculus
gagggcctgcccatgagctatgatg

SEQ ID NO: 439113 - DNA, 25 bp, Mus musculus
gagggccttcacgtccatcgaagtg

SEQ ID NO: 439114 - DNA, 25 bp, Mus musculus
gagggccttgacagtcctggaagaa

SEQ ID NO: 439115 - DNA, 25 bp, Mus musculus
gagggcctttgagtgcagcctgtta

SEQ ID NO: 439116 - DNA, 25 bp, Mus musculus
gagggcgacttctcattcggagcaa

SEQ ID NO: 439117 - DNA, 25 bp, Mus musculus
gagggcgccaccaaagacctttgag

SEQ ID NO: 439118 - DNA, 25 bp, Mus musculus
gagggcgccactttcagggatctca

SEQ ID NO: 439119 - DNA, 25 bp, Mus musculus
gagggcgctagtctctttcaaatag

SEQ ID NO: 439120 - DNA, 25 bp, Mus musculus
gagggcgctgggtaacctctatccg

SEQ ID NO: 439121 - DNA, 25 bp, Mus musculus
gagggcggcatgctcgccggtgtct

SEQ ID NO: 439122 - DNA, 25 bp, Mus musculus
gagggcggctccgtttatcacctga

SEQ ID NO: 439123 - DNA, 25 bp, Mus musculus
gagggctaaggccatcatcgtccag

SEQ ID NO: 439124 - DNA, 25 bp, Mus musculus
gagggctaccacttctcagacaggg

SEQ ID NO: 439125 - DNA, 25 bp, Mus musculus
gagggctagccacccatcccaggat

SEQ ID NO: 439126 - DNA, 25 bp, Mus musculus
gagggctaggccaacaaaagcaagg

SEQ ID NO: 439127 - DNA, 25 bp, Mus musculus
gagggctccatgtttggccacggcc

SEQ ID NO: 439128 - DNA, 25 bp, Mus musculus
gagggctcctgtgcatcgctggaat

SEQ ID NO: 439129 - DNA, 25 bp, Mus musculus
gagggctgcgcttaagtctttgaac

SEQ ID NO: 439130 - DNA, 25 bp, Mus musculus
gagggcttccctctgaataaagacg

SEQ ID NO: 439131 - DNA, 25 bp, Mus musculus
gagggctttaaatttaacatgactt

SEQ ID NO: 439132 - DNA, 25 bp, Mus musculus
gagggtaacctttccttgcgcgcag

SEQ ID NO: 439133 - DNA, 25 bp, Mus musculus
gagggtagccagtaaataaccacag

SEQ ID NO: 439134 - DNA, 25 bp, Mus musculus
gagggtagctcgctcattcggtccc

SEQ ID NO: 439135 - DNA, 25 bp, Mus musculus
gagggtagtctcataaaactctgaa

SEQ ID NO: 439136 - DNA, 25 bp, Mus musculus
gagggtatcttaataaaggctgaaa

SEQ ID NO: 439137 - DNA, 25 bp, Mus musculus
gagggtcagcacctgcacaagatga

SEQ ID NO: 439138 - DNA, 25 bp, Mus musculus
gagggtcaggaaactcccaatctct

SEQ ID NO: 439139 - DNA, 25 bp, Mus musculus
gagggtccaaacattcgtccagcgg

SEQ ID NO: 439140 - DNA, 25 bp, Mus musculus
gagggtccctagtgactccggtctt

SEQ ID NO: 439141 - DNA, 25 bp, Mus musculus
gagggtccggagtctgaacccatct

SEQ ID NO: 439142 - DNA, 25 bp, Mus musculus
gagggtcctttgtctgcttgctcaa

SEQ ID NO: 439143 - DNA, 25 bp, Mus musculus
gagggtctaaactctgggagtccca

SEQ ID NO: 439144 - DNA, 25 bp, Mus musculus
gagggtctacgttaacatcagtcac

SEQ ID NO: 439145 - DNA, 25 bp, Mus musculus
gagggtctgcacaatcaccttacga

SEQ ID NO: 439146 - DNA, 25 bp, Mus musculus
gagggtcttataatccaactgtttt

SEQ ID NO: 439147 - DNA, 25 bp, Mus musculus
gagggtcttatgtctgtttctgttc

SEQ ID NO: 439148 - DNA, 25 bp, Mus musculus
gagggtgaagattctctacaaaaag

SEQ ID NO: 439149 - DNA, 25 bp, Mus musculus
gagggtgacatctacattttacaat

SEQ ID NO: 439150 - DNA, 25 bp, Mus musculus
gagggtgacgtaccatgtatttcag

SEQ ID NO: 439151 - DNA, 25 bp, Mus musculus
gagggtgatacccagaaccatgtgt

SEQ ID NO: 439152 - DNA, 25 bp, Mus musculus
gagggtgatgtaagtttatggaaac

SEQ ID NO: 439153 - DNA, 25 bp, Mus musculus
gagggtgctataaacttccaaaggg

SEQ ID NO: 439154 - DNA, 25 bp, Mus musculus
gagggtggctgatttctaaagcaca

SEQ ID NO: 439155 - DNA, 25 bp, Mus musculus
gagggtgggtcacttgcctaataca

SEQ ID NO: 439156 - DNA, 25 bp, Mus musculus
gagggtggtccgtactgtccaaagt

SEQ ID NO: 439157 - DNA, 25 bp, Mus musculus
gagggtgtcacattcccagagacca

SEQ ID NO: 439158 - DNA, 25 bp, Mus musculus
gagggttaaggcacagggtcataca

SEQ ID NO: 439159 - DNA, 25 bp, Mus musculus
gagggttcacctcagtgatctttga

SEQ ID NO: 439160 - DNA, 25 bp, Mus musculus
gagggttcccaacaccaagacattt

SEQ ID NO: 439161 - DNA, 25 bp, Mus musculus
gagggttcccaagttcctgagcggc

SEQ ID NO: 439162 - DNA, 25 bp, Mus musculus
gaggtaaacctccaagtctgctgcc

SEQ ID NO: 439163 - DNA, 25 bp, Mus musculus
gaggtaaatgccatccgcttcggag

SEQ ID NO: 439164 - DNA, 25 bp, Mus musculus
gaggtaagaggaagcgcacgacttt

SEQ ID NO: 439165 - DNA, 25 bp, Mus musculus
gaggtaagccagtctgggagcccct

SEQ ID NO: 439166 - DNA, 25 bp, Mus musculus
gaggtaaggctgtccactctgtcct

SEQ ID NO: 439167 - DNA, 25 bp, Mus musculus
gaggtacaacatccgtcagcagacg

SEQ ID NO: 439168 - DNA, 25 bp, Mus musculus
gaggtacactattgcctggcgcaga

SEQ ID NO: 439169 - DNA, 25 bp, Mus musculus
gaggtacacttttccagacttccag

SEQ ID NO: 439170 - DNA, 25 bp, Mus musculus
gaggtacatagtgggattctgccac

SEQ ID NO: 439171 - DNA, 25 bp, Mus musculus
gaggtaccaagagagaacattcatc

SEQ ID NO: 439172 - DNA, 25 bp, Mus musculus
gaggtaccacaatgtttcccgggct

SEQ ID NO: 439173 - DNA, 25 bp, Mus musculus
gaggtaccatgctcttgccagtaaa

SEQ ID NO: 439174 - DNA, 25 bp, Mus musculus
gaggtaccctacgtggatcgcaaca

SEQ ID NO: 439175 - DNA, 25 bp, Mus musculus
gaggtacctctacacagatgacgac

SEQ ID NO: 439176 - DNA, 25 bp, Mus musculus
gaggtactaattcgtccacagaaat

SEQ ID NO: 439177 - DNA, 25 bp, Mus musculus
gaggtagaagcaagagaatctcaag

SEQ ID NO: 439178 - DNA, 25 bp, Mus musculus
gaggtagaagtatccttcctgagcc

SEQ ID NO: 439179 - DNA, 25 bp, Mus musculus
gaggtagccaatgatccagcaggcc

SEQ ID NO: 439180 - DNA, 25 bp, Mus musculus
gaggtaggacgtgctttcacagtct

SEQ ID NO: 439181 - DNA, 25 bp, Mus musculus
gaggtagttacccaagatgccgaat

SEQ ID NO: 439182 - DNA, 25 bp, Mus musculus
gaggtataagactccccacagagtg

SEQ ID NO: 439183 - DNA, 25 bp, Mus musculus
gaggtatacgccacgctgaagggcc

SEQ ID NO: 439184 - DNA, 25 bp, Mus musculus
gaggtatcctaccagattggcgaga

SEQ ID NO: 439185 - DNA, 25 bp, Mus musculus
gaggtatctccatcaaggcttctgc

SEQ ID NO: 439186 - DNA, 25 bp, Mus musculus
gaggtatgaacacttggaaacccag

SEQ ID NO: 439187 - DNA, 25 bp, Mus musculus
gaggtatgtcgctgtgtgccatgct

SEQ ID NO: 439188 - DNA, 25 bp, Mus musculus
gaggtatttcggtcagttctgctca

SEQ ID NO: 439189 - DNA, 25 bp, Mus musculus
gaggtcaacatcgatgagctattgg

SEQ ID NO: 439190 - DNA, 25 bp, Mus musculus
gaggtcaagtcaccctgtatgagca

SEQ ID NO: 439191 - DNA, 25 bp, Mus musculus
gaggtcaatgaaccatcccacagtg

SEQ ID NO: 439192 - DNA, 25 bp, Mus musculus
gaggtcacaccatttggacaaagca

SEQ ID NO: 439193 - DNA, 25 bp, Mus musculus
gaggtcacactcaacgtcttagcgg

SEQ ID NO: 439194 - DNA, 25 bp, Mus musculus
gaggtcaccccgctatgaactaagt

SEQ ID NO: 439195 - DNA, 25 bp, Mus musculus
gaggtcacgttcttagcagagcccc

SEQ ID NO: 439196 - DNA, 25 bp, Mus musculus
gaggtcactgaagactaatgtgtac

SEQ ID NO: 439197 - DNA, 25 bp, Mus musculus
gaggtcaggcccctataaagctgcg

SEQ ID NO: 439198 - DNA, 25 bp, Mus musculus
gaggtcagttcaagtcacagggccc

SEQ ID NO: 439199 - DNA, 25 bp, Mus musculus
gaggtcatagccagcccaaaggatg

SEQ ID NO: 439200 - DNA, 25 bp, Mus musculus
gaggtcatcaccaacatcaggaagg

SEQ ID NO: 439201 - DNA, 25 bp, Mus musculus
gaggtcatccctagctccttaagag

SEQ ID NO: 439202 - DNA, 25 bp, Mus musculus
gaggtcatctactccaagaacaatg

SEQ ID NO: 439203 - DNA, 25 bp, Mus musculus
gaggtcatgtccgagtacaacgcca

SEQ ID NO: 439204 - DNA, 25 bp, Mus musculus
gaggtcattggccacctttatccca

SEQ ID NO: 439205 - DNA, 25 bp, Mus musculus
gaggtccagaccttgcctcaggcag

SEQ ID NO: 439206 - DNA, 25 bp, Mus musculus
gaggtccaggccagcatgtggatct

SEQ ID NO: 439207 - DNA, 25 bp, Mus musculus
gaggtcccatcataaaggcaggtag

SEQ ID NO: 439208 - DNA, 25 bp, Mus musculus
gaggtccccttcgagcagatcatgg

SEQ ID NO: 439209 - DNA, 25 bp, Mus musculus
gaggtcccttcgtaccagaggctgg

SEQ ID NO: 439210 - DNA, 25 bp, Mus musculus
gaggtccgccagttccatttcacag

SEQ ID NO: 439211 - DNA, 25 bp, Mus musculus
gaggtcctagaaggcaggttcattg

SEQ ID NO: 439212 - DNA, 25 bp, Mus musculus
gaggtcctgcccaatgtgaactaca

SEQ ID NO: 439213 - DNA, 25 bp, Mus musculus
gaggtcctgctacgtcatccctgag

SEQ ID NO: 439214 - DNA, 25 bp, Mus musculus
gaggtccttcgctgagggcaccttg

SEQ ID NO: 439215 - DNA, 25 bp, Mus musculus
gaggtcgcagactcagtacttgctg

SEQ ID NO: 439216 - DNA, 25 bp, Mus musculus
gaggtcgcatgaggctccgcaaata

SEQ ID NO: 439217 - DNA, 25 bp, Mus musculus
gaggtcgccatctactccaaggaga

SEQ ID NO: 439218 - DNA, 25 bp, Mus musculus
gaggtcgggcacagctatccaagct

SEQ ID NO: 439219 - DNA, 25 bp, Mus musculus
gaggtcgtccatgtcccgagaagag

SEQ ID NO: 439220 - DNA, 25 bp, Mus musculus
gaggtctaatatgcccagagccgag

SEQ ID NO: 439221 - DNA, 25 bp, Mus musculus
gaggtctatcccaaaataaattgtt

SEQ ID NO: 439222 - DNA, 25 bp, Mus musculus
gaggtctcaccaactcttcaggaag

SEQ ID NO: 439223 - DNA, 25 bp, Mus musculus
gaggtctcaggagctcatcccatga

SEQ ID NO: 439224 - DNA, 25 bp, Mus musculus
gaggtctccttgagtcttccaccga

SEQ ID NO: 439225 - DNA, 25 bp, Mus musculus
gaggtctgatttgcatagccccgcc

SEQ ID NO: 439226 - DNA, 25 bp, Mus musculus
gaggtctgcttccaacaaagtgccg

SEQ ID NO: 439227 - DNA, 25 bp, Mus musculus
gaggtctgtaaggtagcctgtgtta

SEQ ID NO: 439228 - DNA, 25 bp, Mus musculus
gaggtctgtgctgatcccaaagtag

SEQ ID NO: 439229 - DNA, 25 bp, Mus musculus
gaggtcttaaagttcccaggtagag

SEQ ID NO: 439230 - DNA, 25 bp, Mus musculus
gaggtcttcatgtgctgtccagcat

SEQ ID NO: 439231 - DNA, 25 bp, Mus musculus
gaggtcttgggtttagttcttagca

SEQ ID NO: 439232 - DNA, 25 bp, Mus musculus
gaggtgacaccttttaccaagagcg

SEQ ID NO: 439233 - DNA, 25 bp, Mus musculus
gaggtgacatcactctgctagaggt

SEQ ID NO: 439234 - DNA, 25 bp, Mus musculus
gaggtgacctgctctttgccagaaa

SEQ ID NO: 439235 - DNA, 25 bp, Mus musculus
gaggtgactacaccccaagagttgg

SEQ ID NO: 439236 - DNA, 25 bp, Mus musculus
gaggtgataaagacccttctctgaa

SEQ ID NO: 439237 - DNA, 25 bp, Mus musculus
gaggtgatacctgcgccagattgtg

SEQ ID NO: 439238 - DNA, 25 bp, Mus musculus
gaggtgatcacccaagaccaggaac

SEQ ID NO: 439239 - DNA, 25 bp, Mus musculus
gaggtgatgacattaatacccgtga

SEQ ID NO: 439240 - DNA, 25 bp, Mus musculus
gaggtgattcaagcgttctcggccc

SEQ ID NO: 439241 - DNA, 25 bp, Mus musculus
gaggtgattcccatggcagcagtga

SEQ ID NO: 439242 - DNA, 25 bp, Mus musculus
gaggtgcaagcccagatttacaaga

SEQ ID NO: 439243 - DNA, 25 bp, Mus musculus
gaggtgcacctaaggctctttcttt

SEQ ID NO: 439244 - DNA, 25 bp, Mus musculus
gaggtgcagctgatgaaccggctcc

SEQ ID NO: 439245 - DNA, 25 bp, Mus musculus
gaggtgcaggagtccaagtctccca

SEQ ID NO: 439246 - DNA, 25 bp, Mus musculus
gaggtgcccaacaacaaagaggccg

SEQ ID NO: 439247 - DNA, 25 bp, Mus musculus
gaggtgcccacactgcagtctctac

SEQ ID NO: 439248 - DNA, 25 bp, Mus musculus
gaggtgccgccacagaaacttcagg

SEQ ID NO: 439249 - DNA, 25 bp, Mus musculus
gaggtgccggcataaacaaaaatat

SEQ ID NO: 439250 - DNA, 25 bp, Mus musculus
gaggtgcgtacttggtcacggcact

SEQ ID NO: 439251 - DNA, 25 bp, Mus musculus
gaggtgcgtcaaaactcaggcaaga

SEQ ID NO: 439252 - DNA, 25 bp, Mus musculus
gaggtgctaacctaacagattcagg

SEQ ID NO: 439253 - DNA, 25 bp, Mus musculus
gaggtgctaccccagtctctagcgg

SEQ ID NO: 439254 - DNA, 25 bp, Mus musculus
gaggtgctctcttcccaatttggaa

SEQ ID NO: 439255 - DNA, 25 bp, Mus musculus
gaggtgctgcgttgcctacggtcaa

SEQ ID NO: 439256 - DNA, 25 bp, Mus musculus
gaggtggacagtgctccctagacaa

SEQ ID NO: 439257 - DNA, 25 bp, Mus musculus
gaggtggacgacaaggttcttcatg

SEQ ID NO: 439258 - DNA, 25 bp, Mus musculus
gaggtggcactttttcgtataaggc

SEQ ID NO: 439259 - DNA, 25 bp, Mus musculus
gaggtggcccagatcgacctgtaca

SEQ ID NO: 439260 - DNA, 25 bp, Mus musculus
gaggtggccccagttataagctcag

SEQ ID NO: 439261 - DNA, 25 bp, Mus musculus
gaggtggcccctacattttatatga

SEQ ID NO: 439262 - DNA, 25 bp, Mus musculus
gaggtggctgctacaatttcttgaa

SEQ ID NO: 439263 - DNA, 25 bp, Mus musculus
gaggtgggcaagctcttcacacaga

SEQ ID NO: 439264 - DNA, 25 bp, Mus musculus
gaggtggtcctgtccgctgaaaatg

SEQ ID NO: 439265 - DNA, 25 bp, Mus musculus
gaggtggtccttgtttgccggcctc

SEQ ID NO: 439266 - DNA, 25 bp, Mus musculus
gaggtggtcgctgtccaagatcaca

SEQ ID NO: 439267 - DNA, 25 bp, Mus musculus
gaggtgtaccacattcgcatgggtg

SEQ ID NO: 439268 - DNA, 25 bp, Mus musculus
gaggtgtatgtaccagaggacccca

SEQ ID NO: 439269 - DNA, 25 bp, Mus musculus
gaggtgtcactcctaagtcagctta

SEQ ID NO: 439270 - DNA, 25 bp, Mus musculus
gaggtgtcccacatcacagcagagt

SEQ ID NO: 439271 - DNA, 25 bp, Mus musculus
gaggtgtccttcctggacgtgcaca

SEQ ID NO: 439272 - DNA, 25 bp, Mus musculus
gaggtgtgcgctagcatacttggct

SEQ ID NO: 439273 - DNA, 25 bp, Mus musculus
gaggtgtgtcatcaccttaacgctg

SEQ ID NO: 439274 - DNA, 25 bp, Mus musculus
gaggtgttcaccaacgtgctgctga

SEQ ID NO: 439275 - DNA, 25 bp, Mus musculus
gaggtgttgcttcattgagattgcc

SEQ ID NO: 439276 - DNA, 25 bp, Mus musculus
gaggtgtttccatagtccgagagct

SEQ ID NO: 439277 - DNA, 25 bp, Mus musculus
gaggttaaagctctccgcagctcag

SEQ ID NO: 439278 - DNA, 25 bp, Mus musculus
gaggttaacctgtcattctcaggag

SEQ ID NO: 439279 - DNA, 25 bp, Mus musculus
gaggttaaccttcaactacagagcg

SEQ ID NO: 439280 - DNA, 25 bp, Mus musculus
gaggttaagagtctgcgccttccca

SEQ ID NO: 439281 - DNA, 25 bp, Mus musculus
gaggttacagctaacatccatgtgg

SEQ ID NO: 439282 - DNA, 25 bp, Mus musculus
gaggttacgctgtgctctgaacaag

SEQ ID NO: 439283 - DNA, 25 bp, Mus musculus
gaggttacggatatggatctggcta

SEQ ID NO: 439284 - DNA, 25 bp, Mus musculus
gaggttactgatctccaagcaaaga

SEQ ID NO: 439285 - DNA, 25 bp, Mus musculus
gaggttagcatagccagccactaga

SEQ ID NO: 439286 - DNA, 25 bp, Mus musculus
gaggttatgcttatgtcttccagaa

SEQ ID NO: 439287 - DNA, 25 bp, Mus musculus
gaggttatttctctgtagtgtggac

SEQ ID NO: 439288 - DNA, 25 bp, Mus musculus
gaggttcaaagagcaactgagtttc

SEQ ID NO: 439289 - DNA, 25 bp, Mus musculus
gaggttcaagactccaagcaaaatg

SEQ ID NO: 439290 - DNA, 25 bp, Mus musculus
gaggttcaccgatcagacctgggca

SEQ ID NO: 439291 - DNA, 25 bp, Mus musculus
gaggttcaggacacatgcctgccgc

SEQ ID NO: 439292 - DNA, 25 bp, Mus musculus
gaggttccaattgggctctcggcga

SEQ ID NO: 439293 - DNA, 25 bp, Mus musculus
gaggttccagaaatggctgcaggcc

SEQ ID NO: 439294 - DNA, 25 bp, Mus musculus
gaggttcccgtaagccattcgagtt

SEQ ID NO: 439295 - DNA, 25 bp, Mus musculus
gaggttcccttaggatcctggctcc

SEQ ID NO: 439296 - DNA, 25 bp, Mus musculus
gaggttcggcttctccgaagacaga

SEQ ID NO: 439297 - DNA, 25 bp, Mus musculus
gaggttctagacagctgcacgttca

SEQ ID NO: 439298 - DNA, 25 bp, Mus musculus
gaggttctgattcacagtccgaggt

SEQ ID NO: 439299 - DNA, 25 bp, Mus musculus
gaggttctttggcacctccccgaga

SEQ ID NO: 439300 - DNA, 25 bp, Mus musculus
gaggttgaactactgcactactgga

SEQ ID NO: 439301 - DNA, 25 bp, Mus musculus
gaggttgacgtatgtctgcagagaa

SEQ ID NO: 439302 - DNA, 25 bp, Mus musculus
gaggttgccacatgttccctgcgac

SEQ ID NO: 439303 - DNA, 25 bp, Mus musculus
gaggttgccagtattagcactccaa

SEQ ID NO: 439304 - DNA, 25 bp, Mus musculus
gaggttgccttctcccactatcaga

SEQ ID NO: 439305 - DNA, 25 bp, Mus musculus
gaggttgctcatcacatcttgtcag

SEQ ID NO: 439306 - DNA, 25 bp, Mus musculus
gaggttgctctgactgcgagccccg

SEQ ID NO: 439307 - DNA, 25 bp, Mus musculus
gaggttggcgagagtcatgtattac

SEQ ID NO: 439308 - DNA, 25 bp, Mus musculus
gaggttggcttgtctcagtatttgg

SEQ ID NO: 439309 - DNA, 25 bp, Mus musculus
gaggttgtcgtcatcctggaaggca

SEQ ID NO: 439310 - DNA, 25 bp, Mus musculus
gaggtttacctctggaaggatcaac

SEQ ID NO: 439311 - DNA, 25 bp, Mus musculus
gaggtttatgatccactttccaagc

SEQ ID NO: 439312 - DNA, 25 bp, Mus musculus
gaggtttcatcatcacgctgcaacg

SEQ ID NO: 439313 - DNA, 25 bp, Mus musculus
gaggtttcccgaggaccacaatgaa

SEQ ID NO: 439314 - DNA, 25 bp, Mus musculus
gaggtttcctcagaaggctcccgga

SEQ ID NO: 439315 - DNA, 25 bp, Mus musculus
gaggtttctctcaactaaggcgagg

SEQ ID NO: 439316 - DNA, 25 bp, Mus musculus
gaggtttgatgtcagcccaagcgca

SEQ ID NO: 439317 - DNA, 25 bp, Mus musculus
gaggttttcataccgattgcccgat

SEQ ID NO: 439318 - DNA, 25 bp, Mus musculus
gaggttttccaaaggcagtggccac

SEQ ID NO: 439319 - DNA, 25 bp, Mus musculus
gaggttttccagaatcacttcgagc

SEQ ID NO: 439320 - DNA, 25 bp, Mus musculus
gaggttttcgtgtatccggtcacga

SEQ ID NO: 439321 - DNA, 25 bp, Mus musculus
gaggtttttcgactttttgacaatg

SEQ ID NO: 439322 - DNA, 25 bp, Mus musculus
gagtaaaaacgtggtctcggcagtg

SEQ ID NO: 439323 - DNA, 25 bp, Mus musculus
gagtaaaacatgtctagcctctaat

SEQ ID NO: 439324 - DNA, 25 bp, Mus musculus
gagtaaagccaagagcagacaagcc

SEQ ID NO: 439325 - DNA, 25 bp, Mus musculus
gagtaaagctgtcctcctctggaag

SEQ ID NO: 439326 - DNA, 25 bp, Mus musculus
gagtaaagtctgcagccaaagaaga

SEQ ID NO: 439327 - DNA, 25 bp, Mus musculus
gagtaaagttcatcttgcccagaca

SEQ ID NO: 439328 - DNA, 25 bp, Mus musculus
gagtaaatcacacaatgacaccatg

SEQ ID NO: 439329 - DNA, 25 bp, Mus musculus
gagtaacaatcaggacaaacccagg

SEQ ID NO: 439330 - DNA, 25 bp, Mus musculus
gagtaacacgggacacagaaacctg

SEQ ID NO: 439331 - DNA, 25 bp, Mus musculus
gagtaacagccctccggagtgtaaa

SEQ ID NO: 439332 - DNA, 25 bp, Mus musculus
gagtaaccagacttccaaaccactg

SEQ ID NO: 439333 - DNA, 25 bp, Mus musculus
gagtaaccagtctctggaccatcgc

SEQ ID NO: 439334 - DNA, 25 bp, Mus musculus
gagtaactttctagtgagtttcagg

SEQ ID NO: 439335 - DNA, 25 bp, Mus musculus
gagtaagaaagtccccatcctgctg

SEQ ID NO: 439336 - DNA, 25 bp, Mus musculus
gagtaagagccgctcccgtgctaaa

SEQ ID NO: 439337 - DNA, 25 bp, Mus musculus
gagtaagctagagaagactccgagg

SEQ ID NO: 439338 - DNA, 25 bp, Mus musculus
gagtaaggaatactgaagtctcagc

SEQ ID NO: 439339 - DNA, 25 bp, Mus musculus
gagtaaggcatatttgggctccaaa

SEQ ID NO: 439340 - DNA, 25 bp, Mus musculus
gagtaaggtctagctccctggaaca

SEQ ID NO: 439341 - DNA, 25 bp, Mus musculus
gagtaaggtgagcagtactcaccag

SEQ ID NO: 439342 - DNA, 25 bp, Mus musculus
gagtaagtatagtcacctagggtcc

SEQ ID NO: 439343 - DNA, 25 bp, Mus musculus
gagtaagtcaaatgcaattctgtct

SEQ ID NO: 439344 - DNA, 25 bp, Mus musculus
gagtaagtgacacgatgcctgccag

SEQ ID NO: 439345 - DNA, 25 bp, Mus musculus
gagtaagttggctccaaaggacatt

SEQ ID NO: 439346 - DNA, 25 bp, Mus musculus
gagtaatcctaccagtttcaaagta

SEQ ID NO: 439347 - DNA, 25 bp, Mus musculus
gagtaatccttagcaataatattgc

SEQ ID NO: 439348 - DNA, 25 bp, Mus musculus
gagtaattatagagccagcgaaggc

SEQ ID NO: 439349 - DNA, 25 bp, Mus musculus
gagtaattccaatcaccttaggcag

SEQ ID NO: 439350 - DNA, 25 bp, Mus musculus
gagtaattccctcttggtcccagac

SEQ ID NO: 439351 - DNA, 25 bp, Mus musculus
gagtaattccgacacgcagtcagta

SEQ ID NO: 439352 - DNA, 25 bp, Mus musculus
gagtaattcgcctggatcctgagac

SEQ ID NO: 439353 - DNA, 25 bp, Mus musculus
gagtaattgcagtgcctggcctaga

SEQ ID NO: 439354 - DNA, 25 bp, Mus musculus
gagtacaaactcctgaccactgatc

SEQ ID NO: 439355 - DNA, 25 bp, Mus musculus
gagtacaaactgacacaagagctgg

SEQ ID NO: 439356 - DNA, 25 bp, Mus musculus
gagtacaacctgacgctggtggccg

SEQ ID NO: 439357 - DNA, 25 bp, Mus musculus
gagtacaataacagccccgaaggca

SEQ ID NO: 439358 - DNA, 25 bp, Mus musculus
gagtacaatggatcacagtgccaac

SEQ ID NO: 439359 - DNA, 25 bp, Mus musculus
gagtacacaatggacatgcccttta

SEQ ID NO: 439360 - DNA, 25 bp, Mus musculus
gagtacacacatcacaaagatcctg

SEQ ID NO: 439361 - DNA, 25 bp, Mus musculus
gagtacacacggttctaccagaatt

SEQ ID NO: 439362 - DNA, 25 bp, Mus musculus
gagtacacagcagtacagatcagca

SEQ ID NO: 439363 - DNA, 25 bp, Mus musculus
gagtacacctgcaaggtatattcta

SEQ ID NO: 439364 - DNA, 25 bp, Mus musculus
gagtacacggtgctggacgaatcct

SEQ ID NO: 439365 - DNA, 25 bp, Mus musculus
gagtacactgatagccctggaccat

SEQ ID NO: 439366 - DNA, 25 bp, Mus musculus
gagtacagagatgtgtacacctgcc

SEQ ID NO: 439367 - DNA, 25 bp, Mus musculus
gagtacagccttgtgaatgcaggaa

SEQ ID NO: 439368 - DNA, 25 bp, Mus musculus
gagtacagctctcagaccacggtgt

SEQ ID NO: 439369 - DNA, 25 bp, Mus musculus
gagtacaggaacaacatgattgtcg

SEQ ID NO: 439370 - DNA, 25 bp, Mus musculus
gagtacaggcaggactcgggcaaaa

SEQ ID NO: 439371 - DNA, 25 bp, Mus musculus
gagtacagtgcccttaggaccagca

SEQ ID NO: 439372 - DNA, 25 bp, Mus musculus
gagtacatacacaaatcgacagcat

SEQ ID NO: 439373 - DNA, 25 bp, Mus musculus
gagtacataccgaagggaacacgct

SEQ ID NO: 439374 - DNA, 25 bp, Mus musculus
gagtacatcaactcctggagctgag

SEQ ID NO: 439375 - DNA, 25 bp, Mus musculus
gagtacatcctgatgtgctgccagt

SEQ ID NO: 439376 - DNA, 25 bp, Mus musculus
gagtacatggaaattaagcaacccg

SEQ ID NO: 439377 - DNA, 25 bp, Mus musculus
gagtacattgttgttctctcagaca

SEQ ID NO: 439378 - DNA, 25 bp, Mus musculus
gagtaccaaacttgcagggcccata

SEQ ID NO: 439379 - DNA, 25 bp, Mus musculus
gagtaccaaggagtctcagattacc

SEQ ID NO: 439380 - DNA, 25 bp, Mus musculus
gagtaccacaggcacatcatcagga

SEQ ID NO: 439381 - DNA, 25 bp, Mus musculus
gagtaccacccgtctggaaggcttt

SEQ ID NO: 439382 - DNA, 25 bp, Mus musculus
gagtaccagacatacaagcaagaag

SEQ ID NO: 439383 - DNA, 25 bp, Mus musculus
gagtaccagtcgaagctttccaagc

SEQ ID NO: 439384 - DNA, 25 bp, Mus musculus
gagtacccacgttgggactcctgga

SEQ ID NO: 439385 - DNA, 25 bp, Mus musculus
gagtacccaggaaacgcactgcatg

SEQ ID NO: 439386 - DNA, 25 bp, Mus musculus
gagtacccagtgctcttcaacactg

SEQ ID NO: 439387 - DNA, 25 bp, Mus musculus
gagtaccccagataccagcagatag

SEQ ID NO: 439388 - DNA, 25 bp, Mus musculus
gagtaccggtgccttttcaaagaca

SEQ ID NO: 439389 - DNA, 25 bp, Mus musculus
gagtacctagaagtctacgtttctg

SEQ ID NO: 439390 - DNA, 25 bp, Mus musculus
gagtacctaggtcagctggcagaaa

SEQ ID NO: 439391 - DNA, 25 bp, Mus musculus
gagtacctatcccaaaaccagctga

SEQ ID NO: 439392 - DNA, 25 bp, Mus musculus
gagtacctcacctgaaaatgacaga

SEQ ID NO: 439393 - DNA, 25 bp, Mus musculus
gagtacctgccatgacctaacgcgt

SEQ ID NO: 439394 - DNA, 25 bp, Mus musculus
gagtacctggccagtctactttgga

SEQ ID NO: 439395 - DNA, 25 bp, Mus musculus
gagtacctggctgctgctgatctta

SEQ ID NO: 439396 - DNA, 25 bp, Mus musculus
gagtacctggtaaaaggagccatcc

SEQ ID NO: 439397 - DNA, 25 bp, Mus musculus
gagtaccttcaagagaagcgggtca

SEQ ID NO: 439398 - DNA, 25 bp, Mus musculus
gagtacgcatccttgtgaccgagca

SEQ ID NO: 439399 - DNA, 25 bp, Mus musculus
gagtacgctcacacaaagctaagtg

SEQ ID NO: 439400 - DNA, 25 bp, Mus musculus
gagtacgtaaccaccctgaatgagc

SEQ ID NO: 439401 - DNA, 25 bp, Mus musculus
gagtacgtgcggaattttgaggttc

SEQ ID NO: 439402 - DNA, 25 bp, Mus musculus
gagtactactacgaggaagccgagc

SEQ ID NO: 439403 - DNA, 25 bp, Mus musculus
gagtactactctcagctgaagacgg

SEQ ID NO: 439404 - DNA, 25 bp, Mus musculus
gagtactcaagtaaggcaaggtgca

SEQ ID NO: 439405 - DNA, 25 bp, Mus musculus
gagtactcatacctaaataaatatg

SEQ ID NO: 439406 - DNA, 25 bp, Mus musculus
gagtactcgactgcatgcgtgtatg

SEQ ID NO: 439407 - DNA, 25 bp, Mus musculus
gagtactcttccctgttcaggtcag

SEQ ID NO: 439408 - DNA, 25 bp, Mus musculus
gagtactgacatccccttggctgca

SEQ ID NO: 439409 - DNA, 25 bp, Mus musculus
gagtactgccggctgctttgcctcc

SEQ ID NO: 439410 - DNA, 25 bp, Mus musculus
gagtactgctccttccgggatgagg

SEQ ID NO: 439411 - DNA, 25 bp, Mus musculus
gagtactggaatcacaggtctattc

SEQ ID NO: 439412 - DNA, 25 bp, Mus musculus
gagtactggccctgaggaatccgaa

SEQ ID NO: 439413 - DNA, 25 bp, Mus musculus
gagtactggtagtgcagactcccca

SEQ ID NO: 439414 - DNA, 25 bp, Mus musculus
gagtactggtctttgatatccccgc

SEQ ID NO: 439415 - DNA, 25 bp, Mus musculus
gagtacttaagtttggacaccgtgg

SEQ ID NO: 439416 - DNA, 25 bp, Mus musculus
gagtacttgacttggactatctgag

SEQ ID NO: 439417 - DNA, 25 bp, Mus musculus
gagtacttgcagctctgatgcccag

SEQ ID NO: 439418 - DNA, 25 bp, Mus musculus
gagtacttgttcaaagagcaaggcc

SEQ ID NO: 439419 - DNA, 25 bp, Mus musculus
gagtacttttttgatcgcaaccgcc

SEQ ID NO: 439420 - DNA, 25 bp, Mus musculus
gagtagaatattaatcaccacgtga

SEQ ID NO: 439421 - DNA, 25 bp, Mus musculus
gagtagactctagacccttgtggag

SEQ ID NO: 439422 - DNA, 25 bp, Mus musculus
gagtagagcccaacctggatgcagc

SEQ ID NO: 439423 - DNA, 25 bp, Mus musculus
gagtagagttcaacacttaaggcaa

SEQ ID NO: 439424 - DNA, 25 bp, Mus musculus
gagtagatctcttcatgctggaccc

SEQ ID NO: 439425 - DNA, 25 bp, Mus musculus
gagtagatgcaagatcggacagcgc

SEQ ID NO: 439426 - DNA, 25 bp, Mus musculus
gagtagcaccacagggcagggctac

SEQ ID NO: 439427 - DNA, 25 bp, Mus musculus
gagtagcagctgaaagaagcgttgc

SEQ ID NO: 439428 - DNA, 25 bp, Mus musculus
gagtagcagtcgacataaagacaga

SEQ ID NO: 439429 - DNA, 25 bp, Mus musculus
gagtagccagagaccatttcctgag

SEQ ID NO: 439430 - DNA, 25 bp, Mus musculus
gagtagcctcacctccatagactgg

SEQ ID NO: 439431 - DNA, 25 bp, Mus musculus
gagtagcctgccctttacaagggag

SEQ ID NO: 439432 - DNA, 25 bp, Mus musculus
gagtagcctgtaaacctccccatct

SEQ ID NO: 439433 - DNA, 25 bp, Mus musculus
gagtagcctgtgataagtcactgtc

SEQ ID NO: 439434 - DNA, 25 bp, Mus musculus
gagtagctgaccgaacctgggaaac

SEQ ID NO: 439435 - DNA, 25 bp, Mus musculus
gagtagctgccaccatcatgaccat

SEQ ID NO: 439436 - DNA, 25 bp, Mus musculus
gagtagctggccaatacagacagac

SEQ ID NO: 439437 - DNA, 25 bp, Mus musculus
gagtaggccgactatgggcttagct

SEQ ID NO: 439438 - DNA, 25 bp, Mus musculus
gagtaggctcctgcagttcacagca

SEQ ID NO: 439439 - DNA, 25 bp, Mus musculus
gagtaggtctcccagaaaggaagcc

SEQ ID NO: 439440 - DNA, 25 bp, Mus musculus
gagtaggtggtattcaagaagcccc

SEQ ID NO: 439441 - DNA, 25 bp, Mus musculus
gagtaggttctaggtcacaggttcc

SEQ ID NO: 439442 - DNA, 25 bp, Mus musculus
gagtagtaccgccttcagcatagac

SEQ ID NO: 439443 - DNA, 25 bp, Mus musculus
gagtagtagctcgtcaaggtccaga

SEQ ID NO: 439444 - DNA, 25 bp, Mus musculus
gagtagtcacagtgggaagacccag

SEQ ID NO: 439445 - DNA, 25 bp, Mus musculus
gagtagttaacacccttcctggtct

SEQ ID NO: 439446 - DNA, 25 bp, Mus musculus
gagtataatgaccagctcaccaggg

SEQ ID NO: 439447 - DNA, 25 bp, Mus musculus
gagtatacatatgaccagacgggaa

SEQ ID NO: 439448 - DNA, 25 bp, Mus musculus
gagtatacatttcttagcgggagcg

SEQ ID NO: 439449 - DNA, 25 bp, Mus musculus
gagtataccccaaaatgatgagagc

SEQ ID NO: 439450 - DNA, 25 bp, Mus musculus
gagtatagaggctgccgcatcccta

SEQ ID NO: 439451 - DNA, 25 bp, Mus musculus
gagtatagtaagtgaacagcaccag

SEQ ID NO: 439452 - DNA, 25 bp, Mus musculus
gagtatcactaatgtgagtccgtgc

SEQ ID NO: 439453 - DNA, 25 bp, Mus musculus
gagtatcagaaggtgggccagtcct

SEQ ID NO: 439454 - DNA, 25 bp, Mus musculus
gagtatccagatcaaagcccagtgc

SEQ ID NO: 439455 - DNA, 25 bp, Mus musculus
gagtatcccagtgattcagggcagg

SEQ ID NO: 439456 - DNA, 25 bp, Mus musculus
gagtatccgtatttctgtgcccagc

SEQ ID NO: 439457 - DNA, 25 bp, Mus musculus
gagtatcctagcatctttaccgagt

SEQ ID NO: 439458 - DNA, 25 bp, Mus musculus
gagtatctctacttgcaccagtgca

SEQ ID NO: 439459 - DNA, 25 bp, Mus musculus
gagtatctgccattctcccaggagc

SEQ ID NO: 439460 - DNA, 25 bp, Mus musculus
gagtatgagaagagagtttcggcca

SEQ ID NO: 439461 - DNA, 25 bp, Mus musculus
gagtatgctgaacctcagctagcat

SEQ ID NO: 439462 - DNA, 25 bp, Mus musculus
gagtatgctgagatctaaggcttgt

SEQ ID NO: 439463 - DNA, 25 bp, Mus musculus
gagtatggacgaagcgccctgtgtt

SEQ ID NO: 439464 - DNA, 25 bp, Mus musculus
gagtatggatcctgagctcccggag

SEQ ID NO: 439465 - DNA, 25 bp, Mus musculus
gagtatggcagcaacgtcacgatgg

SEQ ID NO: 439466 - DNA, 25 bp, Mus musculus
gagtatgtccagagaggcttcccgg

SEQ ID NO: 439467 - DNA, 25 bp, Mus musculus
gagtatgtgagaagccagtacccca

SEQ ID NO: 439468 - DNA, 25 bp, Mus musculus
gagtatttccgagtcactgcctcca

SEQ ID NO: 439469 - DNA, 25 bp, Mus musculus
gagtatttctactcccacctgagca

SEQ ID NO: 439470 - DNA, 25 bp, Mus musculus
gagtatttcttcgaccgacaccggc

SEQ ID NO: 439471 - DNA, 25 bp, Mus musculus
gagtattttagcaccacagctggaa

SEQ ID NO: 439472 - DNA, 25 bp, Mus musculus
gagtcaaaagaggtcattggattcc

SEQ ID NO: 439473 - DNA, 25 bp, Mus musculus
gagtcaaagataggttccctggaag

SEQ ID NO: 439474 - DNA, 25 bp, Mus musculus
gagtcaaagcttctccatgccatgg

SEQ ID NO: 439475 - DNA, 25 bp, Mus musculus
gagtcaaaggaaaaatgacgtaagt

SEQ ID NO: 439476 - DNA, 25 bp, Mus musculus
gagtcaacatagaaccccagtgctg

SEQ ID NO: 439477 - DNA, 25 bp, Mus musculus
gagtcaacgccaacaaggcctatga

SEQ ID NO: 439478 - DNA, 25 bp, Mus musculus
gagtcaactccaaagtccaccatta

SEQ ID NO: 439479 - DNA, 25 bp, Mus musculus
gagtcaactgttgctcctgaaggct

SEQ ID NO: 439480 - DNA, 25 bp, Mus musculus
gagtcaagaactgaactggctcctt

SEQ ID NO: 439481 - DNA, 25 bp, Mus musculus
gagtcaagatctgttcatgtaggag

SEQ ID NO: 439482 - DNA, 25 bp, Mus musculus
gagtcaagtccagatggtcaggctt

SEQ ID NO: 439483 - DNA, 25 bp, Mus musculus
gagtcaagtgacgacacctctacaa

SEQ ID NO: 439484 - DNA, 25 bp, Mus musculus
gagtcaatcactgagaaaacgtctt

SEQ ID NO: 439485 - DNA, 25 bp, Mus musculus
gagtcaatccctatagcccagcagt

SEQ ID NO: 439486 - DNA, 25 bp, Mus musculus
gagtcaatgcaaaactaaccctggg

SEQ ID NO: 439487 - DNA, 25 bp, Mus musculus
gagtcaatggcgctgaaccgacagt

SEQ ID NO: 439488 - DNA, 25 bp, Mus musculus
gagtcacaactcaaaccgcttcagg

SEQ ID NO: 439489 - DNA, 25 bp, Mus musculus
gagtcacaagaagtttgctccccgg

SEQ ID NO: 439490 - DNA, 25 bp, Mus musculus
gagtcacacccacagttgctcagga

SEQ ID NO: 439491 - DNA, 25 bp, Mus musculus
gagtcacaccggctattccagggtc

SEQ ID NO: 439492 - DNA, 25 bp, Mus musculus
gagtcacacgaatacaggccacgaa

SEQ ID NO: 439493 - DNA, 25 bp, Mus musculus
gagtcacactacatgaagtccagaa

SEQ ID NO: 439494 - DNA, 25 bp, Mus musculus
gagtcacagagctcgaaatggcccc

SEQ ID NO: 439495 - DNA, 25 bp, Mus musculus
gagtcacaggtatccgttcagggtc

SEQ ID NO: 439496 - DNA, 25 bp, Mus musculus
gagtcacatgcagaaagaggctggt

SEQ ID NO: 439497 - DNA, 25 bp, Mus musculus
gagtcaccacccgtgaacggaacag

SEQ ID NO: 439498 - DNA, 25 bp, Mus musculus
gagtcaccattccagcatttgatga

SEQ ID NO: 439499 - DNA, 25 bp, Mus musculus
gagtcaccccagtcggattccttgg

SEQ ID NO: 439500 - DNA, 25 bp, Mus musculus
gagtcaccctgaatactctgagtgg

SEQ ID NO: 439501 - DNA, 25 bp, Mus musculus
gagtcaccgcactggacaaagacgg

SEQ ID NO: 439502 - DNA, 25 bp, Mus musculus
gagtcaccgtgaacttatagggctg

SEQ ID NO: 439503 - DNA, 25 bp, Mus musculus
gagtcaccgtgtagatgcagggaac

SEQ ID NO: 439504 - DNA, 25 bp, Mus musculus
gagtcacctgatgaggattcctgaa

SEQ ID NO: 439505 - DNA, 25 bp, Mus musculus
gagtcacctgcaccagcacaaagtg

SEQ ID NO: 439506 - DNA, 25 bp, Mus musculus
gagtcacctgtgttctggcccaatg

SEQ ID NO: 439507 - DNA, 25 bp, Mus musculus
gagtcacgaaagtcatgtagcctgc

SEQ ID NO: 439508 - DNA, 25 bp, Mus musculus
gagtcactaagcacttaggctaaga

SEQ ID NO: 439509 - DNA, 25 bp, Mus musculus
gagtcactctactgccatgtcaaca

SEQ ID NO: 439510 - DNA, 25 bp, Mus musculus
gagtcactgaaacaccctttaattg

SEQ ID NO: 439511 - DNA, 25 bp, Mus musculus
gagtcactgcccaggagaagacagg

SEQ ID NO: 439512 - DNA, 25 bp, Mus musculus
gagtcacttcaaatgccgctcggga

SEQ ID NO: 439513 - DNA, 25 bp, Mus musculus
gagtcagacttattcttcctcctgt

SEQ ID NO: 439514 - DNA, 25 bp, Mus musculus
gagtcagagctcattttcaacaggc

SEQ ID NO: 439515 - DNA, 25 bp, Mus musculus
gagtcagagctgatccggcagagct

SEQ ID NO: 439516 - DNA, 25 bp, Mus musculus
gagtcagaggtactctgcagtcttg

SEQ ID NO: 439517 - DNA, 25 bp, Mus musculus
gagtcagagtataattgaaggttac

SEQ ID NO: 439518 - DNA, 25 bp, Mus musculus
gagtcagcacttgatttggcaaagc

SEQ ID NO: 439519 - DNA, 25 bp, Mus musculus
gagtcagccactcaacattttagca

SEQ ID NO: 439520 - DNA, 25 bp, Mus musculus
gagtcagcctgaattgatctgcccg

SEQ ID NO: 439521 - DNA, 25 bp, Mus musculus
gagtcagcctgtattatgagtccct

SEQ ID NO: 439522 - DNA, 25 bp, Mus musculus
gagtcagctacatttctacaggttc

SEQ ID NO: 439523 - DNA, 25 bp, Mus musculus
gagtcaggaccgtgttctcaaggag

SEQ ID NO: 439524 - DNA, 25 bp, Mus musculus
gagtcaggcacacaagctcttcatg

SEQ ID NO: 439525 - DNA, 25 bp, Mus musculus
gagtcaggcgctcaaatccaccctg

SEQ ID NO: 439526 - DNA, 25 bp, Mus musculus
gagtcagggaatctattctccaaca

SEQ ID NO: 439527 - DNA, 25 bp, Mus musculus
gagtcaggtctgtctaccacatgag

SEQ ID NO: 439528 - DNA, 25 bp, Mus musculus
gagtcaggttccttgtctagtggaa

SEQ ID NO: 439529 - DNA, 25 bp, Mus musculus
gagtcagtcaagaagccacaggaag

SEQ ID NO: 439530 - DNA, 25 bp, Mus musculus
gagtcagtccttaagcctgcaacag

SEQ ID NO: 439531 - DNA, 25 bp, Mus musculus
gagtcagtggacttcaggttcgcat

SEQ ID NO: 439532 - DNA, 25 bp, Mus musculus
gagtcataaaattccagccagcctg

SEQ ID NO: 439533 - DNA, 25 bp, Mus musculus
gagtcatacgcattctggaggccat

SEQ ID NO: 439534 - DNA, 25 bp, Mus musculus
gagtcatacgtgatctgcagtccag

SEQ ID NO: 439535 - DNA, 25 bp, Mus musculus
gagtcatactctaggtcagaaataa

SEQ ID NO: 439536 - DNA, 25 bp, Mus musculus
gagtcatggatttctactgaattgg

SEQ ID NO: 439537 - DNA, 25 bp, Mus musculus
gagtcatgtgactgattagcctgca

SEQ ID NO: 439538 - DNA, 25 bp, Mus musculus
gagtcattgagatgggttcttgaga

SEQ ID NO: 439539 - DNA, 25 bp, Mus musculus
gagtcattggtcctgccatcccgtt

SEQ ID NO: 439540 - DNA, 25 bp, Mus musculus
gagtcatttgggtagggaacataca

SEQ ID NO: 439541 - DNA, 25 bp, Mus musculus
gagtccaaaatcgacctccttgatc

SEQ ID NO: 439542 - DNA, 25 bp, Mus musculus
gagtccaaaccttcttcactgaaat

SEQ ID NO: 439543 - DNA, 25 bp, Mus musculus
gagtccaaaggcagtgaagtcacag

SEQ ID NO: 439544 - DNA, 25 bp, Mus musculus
gagtccaagaacatagtccgcgaga

SEQ ID NO: 439545 - DNA, 25 bp, Mus musculus
gagtccaagcgcttcattcaccggg

SEQ ID NO: 439546 - DNA, 25 bp, Mus musculus
gagtccaagtccacatcactgaaag

SEQ ID NO: 439547 - DNA, 25 bp, Mus musculus
gagtccacattcaaacggcccagga

SEQ ID NO: 439548 - DNA, 25 bp, Mus musculus
gagtccaccggatagagccatagta

SEQ ID NO: 439549 - DNA, 25 bp, Mus musculus
gagtccacgcgctgcagtgatgtaa

SEQ ID NO: 439550 - DNA, 25 bp, Mus musculus
gagtccagaaatctaatatcatcca

SEQ ID NO: 439551 - DNA, 25 bp, Mus musculus
gagtccagacaatgtgttaatcccc

SEQ ID NO: 439552 - DNA, 25 bp, Mus musculus
gagtccagccaacactgtggccagg

SEQ ID NO: 439553 - DNA, 25 bp, Mus musculus
gagtccagcctgtaatgctctgtgc

SEQ ID NO: 439554 - DNA, 25 bp, Mus musculus
gagtccagggacctagtctagctga

SEQ ID NO: 439555 - DNA, 25 bp, Mus musculus
gagtccaggtaaatgccagccagag

SEQ ID NO: 439556 - DNA, 25 bp, Mus musculus
gagtccagtgggtataaaggcagct

SEQ ID NO: 439557 - DNA, 25 bp, Mus musculus
gagtccagtgtacctgtagtgccac

SEQ ID NO: 439558 - DNA, 25 bp, Mus musculus
gagtccagttcatctaagccagtgg

SEQ ID NO: 439559 - DNA, 25 bp, Mus musculus
gagtccataccagaaccacacgggt

SEQ ID NO: 439560 - DNA, 25 bp, Mus musculus
gagtccatccatcctaagtcagcag

SEQ ID NO: 439561 - DNA, 25 bp, Mus musculus
gagtccatggtgtcaaacctgccag

SEQ ID NO: 439562 - DNA, 25 bp, Mus musculus
gagtccattgccgagcctgtgtgta

SEQ ID NO: 439563 - DNA, 25 bp, Mus musculus
gagtccatttctggatccacagagc

SEQ ID NO: 439564 - DNA, 25 bp, Mus musculus
gagtcccaaggacagttacacccag

SEQ ID NO: 439565 - DNA, 25 bp, Mus musculus
gagtcccagccgctttcaatggagg

SEQ ID NO: 439566 - DNA, 25 bp, Mus musculus
gagtcccagcctgagacacagaggt

SEQ ID NO: 439567 - DNA, 25 bp, Mus musculus
gagtcccagcttaagtatacgctca

SEQ ID NO: 439568 - DNA, 25 bp, Mus musculus
gagtccccgatgaacgattttctgg

SEQ ID NO: 439569 - DNA, 25 bp, Mus musculus
gagtcccctccaggtttctttggtg

SEQ ID NO: 439570 - DNA, 25 bp, Mus musculus
gagtcccgaggaactgctgaacagc

SEQ ID NO: 439571 - DNA, 25 bp, Mus musculus
gagtcccgcagaagctgaaatggaa

SEQ ID NO: 439572 - DNA, 25 bp, Mus musculus
gagtcccggagatagctttgagtct

SEQ ID NO: 439573 - DNA, 25 bp, Mus musculus
gagtcccgggataggccattccctt

SEQ ID NO: 439574 - DNA, 25 bp, Mus musculus
gagtccctatcgttctcatgctgag

SEQ ID NO: 439575 - DNA, 25 bp, Mus musculus
gagtccctcccagtgatgagtctga

SEQ ID NO: 439576 - DNA, 25 bp, Mus musculus
gagtccctcgtgtcagataactgtg

SEQ ID NO: 439577 - DNA, 25 bp, Mus musculus
gagtccctgataatgctgctttgtc

SEQ ID NO: 439578 - DNA, 25 bp, Mus musculus
gagtccctggatactgcagaccctg

SEQ ID NO: 439579 - DNA, 25 bp, Mus musculus
gagtcccttgctaggcatctgcaga

SEQ ID NO: 439580 - DNA, 25 bp, Mus musculus
gagtcccttgggttgcaatgtcgta

SEQ ID NO: 439581 - DNA, 25 bp, Mus musculus
gagtccgagcccagcatattgtgcc

SEQ ID NO: 439582 - DNA, 25 bp, Mus musculus
gagtccgggaggtgcgcttatttct

SEQ ID NO: 439583 - DNA, 25 bp, Mus musculus
gagtccgtagcatcaaaagcagcaa

SEQ ID NO: 439584 - DNA, 25 bp, Mus musculus
gagtccgtgcaagtgaatcatatga

SEQ ID NO: 439585 - DNA, 25 bp, Mus musculus
gagtcctatttcatttattctgtcc

SEQ ID NO: 439586 - DNA, 25 bp, Mus musculus
gagtcctcagatgttccttcattca

SEQ ID NO: 439587 - DNA, 25 bp, Mus musculus
gagtcctctgagacgctggatccag

SEQ ID NO: 439588 - DNA, 25 bp, Mus musculus
gagtcctgaggtgactgctgctcac

SEQ ID NO: 439589 - DNA, 25 bp, Mus musculus
gagtcctgattgtttccggccggaa

SEQ ID NO: 439590 - DNA, 25 bp, Mus musculus
gagtcctgcaactcatccaggctag

SEQ ID NO: 439591 - DNA, 25 bp, Mus musculus
gagtcctgcagagtacagactagcc

SEQ ID NO: 439592 - DNA, 25 bp, Mus musculus
gagtcctgcagccaataaattgcca

SEQ ID NO: 439593 - DNA, 25 bp, Mus musculus
gagtcctgccctatgaatacttatg

SEQ ID NO: 439594 - DNA, 25 bp, Mus musculus
gagtcctgctcatggttccccgagt

SEQ ID NO: 439595 - DNA, 25 bp, Mus musculus
gagtcctggagaaagcggtacgtcc

SEQ ID NO: 439596 - DNA, 25 bp, Mus musculus
gagtcctgttcttgtaccgagcgcg

SEQ ID NO: 439597 - DNA, 25 bp, Mus musculus
gagtccttcaaatgactgacgagtg

SEQ ID NO: 439598 - DNA, 25 bp, Mus musculus
gagtccttgagcgtaaacatgtcag

SEQ ID NO: 439599 - DNA, 25 bp, Mus musculus
gagtccttgttgctgttagaagaca

SEQ ID NO: 439600 - DNA, 25 bp, Mus musculus
gagtcgacagagacccttgctagta

SEQ ID NO: 439601 - DNA, 25 bp, Mus musculus
gagtcgaggcctctgcacaagaaga

SEQ ID NO: 439602 - DNA, 25 bp, Mus musculus
gagtcgagtaaagaggagtcccagc

SEQ ID NO: 439603 - DNA, 25 bp, Mus musculus
gagtcgcaaagtagcggcgctcaat

SEQ ID NO: 439604 - DNA, 25 bp, Mus musculus
gagtcgcagcgtgtcctcatttcca

SEQ ID NO: 439605 - DNA, 25 bp, Mus musculus
gagtcgcagttactccccaaggaga

SEQ ID NO: 439606 - DNA, 25 bp, Mus musculus
gagtcgcattctgcatgttcctagg

SEQ ID NO: 439607 - DNA, 25 bp, Mus musculus
gagtcgccaggtcccagagaaaatg

SEQ ID NO: 439608 - DNA, 25 bp, Mus musculus
gagtcgctcaaggtgtatcctgttc

SEQ ID NO: 439609 - DNA, 25 bp, Mus musculus
gagtcgctgaccctctctgagcctt

SEQ ID NO: 439610 - DNA, 25 bp, Mus musculus
gagtcggaggaaggattgagggacc

SEQ ID NO: 439611 - DNA, 25 bp, Mus musculus
gagtcggcatttgaaaggttgccca

SEQ ID NO: 439612 - DNA, 25 bp, Mus musculus
gagtcggctcagtccgccgaggaag

SEQ ID NO: 439613 - DNA, 25 bp, Mus musculus
gagtcggttgtttcgctcttaccct

SEQ ID NO: 439614 - DNA, 25 bp, Mus musculus
gagtcgtcaatatcctgccagggta

SEQ ID NO: 439615 - DNA, 25 bp, Mus musculus
gagtcgtctctagcagatcagctga

SEQ ID NO: 439616 - DNA, 25 bp, Mus musculus
gagtctaacaaaagaagattaccaa

SEQ ID NO: 439617 - DNA, 25 bp, Mus musculus
gagtctaccattacgatttccctgt

SEQ ID NO: 439618 - DNA, 25 bp, Mus musculus
gagtctacctgctggaatgatggga

SEQ ID NO: 439619 - DNA, 25 bp, Mus musculus
gagtctacgacaagaagcataccac

SEQ ID NO: 439620 - DNA, 25 bp, Mus musculus
gagtctacttcacactggccttgga

SEQ ID NO: 439621 - DNA, 25 bp, Mus musculus
gagtctataccccttgagctgccag

SEQ ID NO: 439622 - DNA, 25 bp, Mus musculus
gagtctatgaccaaggccaggctga

SEQ ID NO: 439623 - DNA, 25 bp, Mus musculus
gagtctatggccatgggcacgaatg

SEQ ID NO: 439624 - DNA, 25 bp, Mus musculus
gagtctatggtattcttgttgcccc

SEQ ID NO: 439625 - DNA, 25 bp, Mus musculus
gagtctcactggaagtgcctgctcc

SEQ ID NO: 439626 - DNA, 25 bp, Mus musculus
gagtctcagagaaagtgcccaccat

SEQ ID NO: 439627 - DNA, 25 bp, Mus musculus
gagtctcagccaagtgagtgccagt

SEQ ID NO: 439628 - DNA, 25 bp, Mus musculus
gagtctcagccctgttagcacgcag

SEQ ID NO: 439629 - DNA, 25 bp, Mus musculus
gagtctcagttcttaggcttcagca

SEQ ID NO: 439630 - DNA, 25 bp, Mus musculus
gagtctcattgaagtttgatcaact

SEQ ID NO: 439631 - DNA, 25 bp, Mus musculus
gagtctcccaaatcactacataagc

SEQ ID NO: 439632 - DNA, 25 bp, Mus musculus
gagtctcccgctccaaatgtctgtg

SEQ ID NO: 439633 - DNA, 25 bp, Mus musculus
gagtctccctgtcctgcaagtcaat

SEQ ID NO: 439634 - DNA, 25 bp, Mus musculus
gagtctcctcggagcagcctgaagg

SEQ ID NO: 439635 - DNA, 25 bp, Mus musculus
gagtctcgactgctgtttctacagg

SEQ ID NO: 439636 - DNA, 25 bp, Mus musculus
gagtctcggcctttagctggcacaa

SEQ ID NO: 439637 - DNA, 25 bp, Mus musculus
gagtctctaaaggtcttacacttca

SEQ ID NO: 439638 - DNA, 25 bp, Mus musculus
gagtctctccatgaagattcttgcg

SEQ ID NO: 439639 - DNA, 25 bp, Mus musculus
gagtctctcctgcatctggctgtga

SEQ ID NO: 439640 - DNA, 25 bp, Mus musculus
gagtctctctgagttcgagcaagag

SEQ ID NO: 439641 - DNA, 25 bp, Mus musculus
gagtctctgttagcgcagcgggaat

SEQ ID NO: 439642 - DNA, 25 bp, Mus musculus
gagtctgaacccagcatcgttagga

SEQ ID NO: 439643 - DNA, 25 bp, Mus musculus
gagtctgacttggaaatccgagccc

SEQ ID NO: 439644 - DNA, 25 bp, Mus musculus
gagtctgatggagctggcaccttta

SEQ ID NO: 439645 - DNA, 25 bp, Mus musculus
gagtctgatgtcaccaagaggcagc

SEQ ID NO: 439646 - DNA, 25 bp, Mus musculus
gagtctgcaggatcttctccctaga

SEQ ID NO: 439647 - DNA, 25 bp, Mus musculus
gagtctgcatcggagtcaccggagc

SEQ ID NO: 439648 - DNA, 25 bp, Mus musculus
gagtctgccaagaaactgggcccca

SEQ ID NO: 439649 - DNA, 25 bp, Mus musculus
gagtctgccacagctaatggaccag

SEQ ID NO: 439650 - DNA, 25 bp, Mus musculus
gagtctgccttccactacgaggctg

SEQ ID NO: 439651 - DNA, 25 bp, Mus musculus
gagtctgctactggaccatccgggt

SEQ ID NO: 439652 - DNA, 25 bp, Mus musculus
gagtctgctcagaaacggtgccaag

SEQ ID NO: 439653 - DNA, 25 bp, Mus musculus
gagtctggaaacacctactaccgag

SEQ ID NO: 439654 - DNA, 25 bp, Mus musculus
gagtctggagagtgttaactattca

SEQ ID NO: 439655 - DNA, 25 bp, Mus musculus
gagtctggccagaaaagtggttctt

SEQ ID NO: 439656 - DNA, 25 bp, Mus musculus
gagtctgtcatgattgccaacccta

SEQ ID NO: 439657 - DNA, 25 bp, Mus musculus
gagtctgtcccaacaatagcactgg

SEQ ID NO: 439658 - DNA, 25 bp, Mus musculus
gagtctgtcccttggccaagaggcc

SEQ ID NO: 439659 - DNA, 25 bp, Mus musculus
gagtctgtctggctcaagcttggaa

SEQ ID NO: 439660 - DNA, 25 bp, Mus musculus
gagtctgtggccatacgattgctga

SEQ ID NO: 439661 - DNA, 25 bp, Mus musculus
gagtcttacgtggtattggccttgg

SEQ ID NO: 439662 - DNA, 25 bp, Mus musculus
gagtcttactgtggtgcaaggtgtc

SEQ ID NO: 439663 - DNA, 25 bp, Mus musculus
gagtcttatcttctgtgagggtcac

SEQ ID NO: 439664 - DNA, 25 bp, Mus musculus
gagtcttccctggacaaatcgagca

SEQ ID NO: 439665 - DNA, 25 bp, Mus musculus
gagtcttctctcagcatatcttaag

SEQ ID NO: 439666 - DNA, 25 bp, Mus musculus
gagtcttgaagtctgatacgctgta

SEQ ID NO: 439667 - DNA, 25 bp, Mus musculus
gagtcttgagccacttcctgctggg

SEQ ID NO: 439668 - DNA, 25 bp, Mus musculus
gagtcttgtagaaaatagtggagca

SEQ ID NO: 439669 - DNA, 25 bp, Mus musculus
gagtcttgttctcagcggagagcac

SEQ ID NO: 439670 - DNA, 25 bp, Mus musculus
gagtctttaccctgacgccttgcca

SEQ ID NO: 439671 - DNA, 25 bp, Mus musculus
gagtctttcagaggcaactagcaat

SEQ ID NO: 439672 - DNA, 25 bp, Mus musculus
gagtctttcattacccgccagtggg

SEQ ID NO: 439673 - DNA, 25 bp, Mus musculus
gagtctttctatgagtcttagctgg

SEQ ID NO: 439674 - DNA, 25 bp, Mus musculus
gagtctttctgccacggatatcgaa

SEQ ID NO: 439675 - DNA, 25 bp, Mus musculus
gagtctttttgattacatgtccacc

SEQ ID NO: 439676 - DNA, 25 bp, Mus musculus
gagtgaaagggaaccctatctgggt

SEQ ID NO: 439677 - DNA, 25 bp, Mus musculus
gagtgaacactcgtgagcacctgct

SEQ ID NO: 439678 - DNA, 25 bp, Mus musculus
gagtgaaccctcctgcctttgtaaa

SEQ ID NO: 439679 - DNA, 25 bp, Mus musculus
gagtgaaccggagcttcatcgcgct

SEQ ID NO: 439680 - DNA, 25 bp, Mus musculus
gagtgaactttaccttgtctactaa

SEQ ID NO: 439681 - DNA, 25 bp, Mus musculus
gagtgaaggcttttccagatcatcc

SEQ ID NO: 439682 - DNA, 25 bp, Mus musculus
gagtgaagtcagagattccccaggt

SEQ ID NO: 439683 - DNA, 25 bp, Mus musculus
gagtgaatacccagtaagccagcgg

SEQ ID NO: 439684 - DNA, 25 bp, Mus musculus
gagtgaatgaatgcaggacgcctcc

SEQ ID NO: 439685 - DNA, 25 bp, Mus musculus
gagtgacaacatgctcaaaggttcc

SEQ ID NO: 439686 - DNA, 25 bp, Mus musculus
gagtgacaactccaaatgactgttt

SEQ ID NO: 439687 - DNA, 25 bp, Mus musculus
gagtgacaccgcacggcttggagaa

SEQ ID NO: 439688 - DNA, 25 bp, Mus musculus
gagtgacagagggacaatatccatg

SEQ ID NO: 439689 - DNA, 25 bp, Mus musculus
gagtgacagcaccagaattccagga

SEQ ID NO: 439690 - DNA, 25 bp, Mus musculus
gagtgacattgatttgatggcccct

SEQ ID NO: 439691 - DNA, 25 bp, Mus musculus
gagtgaccatattcgtcgccctgta

SEQ ID NO: 439692 - DNA, 25 bp, Mus musculus
gagtgacctcgcacctatatccata

SEQ ID NO: 439693 - DNA, 25 bp, Mus musculus
gagtgacctgacacgcaatgacctg

SEQ ID NO: 439694 - DNA, 25 bp, Mus musculus
gagtgacgctgacgagagccatttc

SEQ ID NO: 439695 - DNA, 25 bp, Mus musculus
gagtgactcagacatctcctctaca

SEQ ID NO: 439696 - DNA, 25 bp, Mus musculus
gagtgactggcacttcctgcagaag

SEQ ID NO: 439697 - DNA, 25 bp, Mus musculus
gagtgactgggctccctctgacatg

SEQ ID NO: 439698 - DNA, 25 bp, Mus musculus
gagtgacttaaattctccctgtccg

SEQ ID NO: 439699 - DNA, 25 bp, Mus musculus
gagtgacttcactaggcaaggactg

SEQ ID NO: 439700 - DNA, 25 bp, Mus musculus
gagtgacttggaaagtccctggagc

SEQ ID NO: 439701 - DNA, 25 bp, Mus musculus
gagtgagaactgtagagagagtccc

SEQ ID NO: 439702 - DNA, 25 bp, Mus musculus
gagtgagatgaacgcccatggtaca

SEQ ID NO: 439703 - DNA, 25 bp, Mus musculus
gagtgagccttgattatctctgaga

SEQ ID NO: 439704 - DNA, 25 bp, Mus musculus
gagtgagcgcatttctttgatcgtc

SEQ ID NO: 439705 - DNA, 25 bp, Mus musculus
gagtgagcggcattccctttggcca

SEQ ID NO: 439706 - DNA, 25 bp, Mus musculus
gagtgagcggctacctgaagttccc

SEQ ID NO: 439707 - DNA, 25 bp, Mus musculus
gagtgagctggtgctacacctgcac

SEQ ID NO: 439708 - DNA, 25 bp, Mus musculus
gagtgagcttcactcatcaggtccc

SEQ ID NO: 439709 - DNA, 25 bp, Mus musculus
gagtgaggcatccacaaagcgtgca

SEQ ID NO: 439710 - DNA, 25 bp, Mus musculus
gagtgaggcccagcatatgtctaac

SEQ ID NO: 439711 - DNA, 25 bp, Mus musculus
gagtgaggcgcttcaaagacttgtc

SEQ ID NO: 439712 - DNA, 25 bp, Mus musculus
gagtgaggtatctggcaagtttgca

SEQ ID NO: 439713 - DNA, 25 bp, Mus musculus
gagtgagtaatagcctctccacagc

SEQ ID NO: 439714 - DNA, 25 bp, Mus musculus
gagtgagtggcgagcgcccctctcc

SEQ ID NO: 439715 - DNA, 25 bp, Mus musculus
gagtgagtggttacaaaatagaccc

SEQ ID NO: 439716 - DNA, 25 bp, Mus musculus
gagtgatatcaatctcctttcggac

SEQ ID NO: 439717 - DNA, 25 bp, Mus musculus
gagtgatcctgagatatggcacccc

SEQ ID NO: 439718 - DNA, 25 bp, Mus musculus
gagtgatcctgccattctaccagtg

SEQ ID NO: 439719 - DNA, 25 bp, Mus musculus
gagtgatcgacacaggaactgcccc

SEQ ID NO: 439720 - DNA, 25 bp, Mus musculus
gagtgatcgttctccggtcatgcag

SEQ ID NO: 439721 - DNA, 25 bp, Mus musculus
gagtgatctgactcctaggtgttgg

SEQ ID NO: 439722 - DNA, 25 bp, Mus musculus
gagtgatcttccacttacgcctgaa

SEQ ID NO: 439723 - DNA, 25 bp, Mus musculus
gagtgatggatgaccttaaagacaa

SEQ ID NO: 439724 - DNA, 25 bp, Mus musculus
gagtgatggctcaagttactctgcc

SEQ ID NO: 439725 - DNA, 25 bp, Mus musculus
gagtgatggtacagcttctgcccga

SEQ ID NO: 439726 - DNA, 25 bp, Mus musculus
gagtgattcgagtgcaagctcccca

SEQ ID NO: 439727 - DNA, 25 bp, Mus musculus
gagtgattgtcataccagggcctga

SEQ ID NO: 439728 - DNA, 25 bp, Mus musculus
gagtgcaaagtcctcacagtgttgt

SEQ ID NO: 439729 - DNA, 25 bp, Mus musculus
gagtgcacaacggaggtaacgtcct

SEQ ID NO: 439730 - DNA, 25 bp, Mus musculus
gagtgcaccgtggagcccatggaaa

SEQ ID NO: 439731 - DNA, 25 bp, Mus musculus
gagtgcactcccaacgtgagcgtgt

SEQ ID NO: 439732 - DNA, 25 bp, Mus musculus
gagtgcagcccttaagtgtcagcca

SEQ ID NO: 439733 - DNA, 25 bp, Mus musculus
gagtgcagctattgttgatgccaag

SEQ ID NO: 439734 - DNA, 25 bp, Mus musculus
gagtgcagtagagaaatccttagct

SEQ ID NO: 439735 - DNA, 25 bp, Mus musculus
gagtgcatcctctgaaatgacctca

SEQ ID NO: 439736 - DNA, 25 bp, Mus musculus
gagtgcatgacaccaagcgacctgt

SEQ ID NO: 439737 - DNA, 25 bp, Mus musculus
gagtgcatggcagcacaaagtggac

SEQ ID NO: 439738 - DNA, 25 bp, Mus musculus
gagtgcattctggaaaactaccctg

SEQ ID NO: 439739 - DNA, 25 bp, Mus musculus
gagtgccaacgagaaagctgacagt

SEQ ID NO: 439740 - DNA, 25 bp, Mus musculus
gagtgccaagcacagaaagccgcta

SEQ ID NO: 439741 - DNA, 25 bp, Mus musculus
gagtgccaccataccgttctttgaa

SEQ ID NO: 439742 - DNA, 25 bp, Mus musculus
gagtgccacttctcgtaaacggaaa

SEQ ID NO: 439743 - DNA, 25 bp, Mus musculus
gagtgccagtcctcttagctgctaa

SEQ ID NO: 439744 - DNA, 25 bp, Mus musculus
gagtgccccaacgtgcctgtcttat

SEQ ID NO: 439745 - DNA, 25 bp, Mus musculus
gagtgccccagttgaaaaaggccag

SEQ ID NO: 439746 - DNA, 25 bp, Mus musculus
gagtgcccgcagagggaaagacaaa

SEQ ID NO: 439747 - DNA, 25 bp, Mus musculus
gagtgcccgcctaatgaaggtgtca

SEQ ID NO: 439748 - DNA, 25 bp, Mus musculus
gagtgccctaaagacgagttccaag

SEQ ID NO: 439749 - DNA, 25 bp, Mus musculus
gagtgccctcaacatcgaagtcgaa

SEQ ID NO: 439750 - DNA, 25 bp, Mus musculus
gagtgccgagaagtatatgtacccc

SEQ ID NO: 439751 - DNA, 25 bp, Mus musculus
gagtgccgccgtgtaaataaaaagg

SEQ ID NO: 439752 - DNA, 25 bp, Mus musculus
gagtgcctacaatcttcccgtggaa

SEQ ID NO: 439753 - DNA, 25 bp, Mus musculus
gagtgcctgctacttccgaatactg

SEQ ID NO: 439754 - DNA, 25 bp, Mus musculus
gagtgcctggagaagatccgcctct

SEQ ID NO: 439755 - DNA, 25 bp, Mus musculus
gagtgccttatgcaccccagactgg

SEQ ID NO: 439756 - DNA, 25 bp, Mus musculus
gagtgccttcttcccatagcttgta

SEQ ID NO: 439757 - DNA, 25 bp, Mus musculus
gagtgccttgaagaagttaatcagg

SEQ ID NO: 439758 - DNA, 25 bp, Mus musculus
gagtgcgaactggagaccatgactg

SEQ ID NO: 439759 - DNA, 25 bp, Mus musculus
gagtgcggcagaaggcatcctcctt

SEQ ID NO: 439760 - DNA, 25 bp, Mus musculus
gagtgcgtgcttttcatgtgcaaga

SEQ ID NO: 439761 - DNA, 25 bp, Mus musculus
gagtgctacccaagctctccggttc

SEQ ID NO: 439762 - DNA, 25 bp, Mus musculus
gagtgctccccaaaggtgtgtgccc

SEQ ID NO: 439763 - DNA, 25 bp, Mus musculus
gagtgctcccctaatgaggaccgag

SEQ ID NO: 439764 - DNA, 25 bp, Mus musculus
gagtgctcctacacatcagctgatg

SEQ ID NO: 439765 - DNA, 25 bp, Mus musculus
gagtgctcggcgtatctttcaggaa

SEQ ID NO: 439766 - DNA, 25 bp, Mus musculus
gagtgctcttgtgttctccgttgtg

SEQ ID NO: 439767 - DNA, 25 bp, Mus musculus
gagtgctgagaaggatacaccctgg

SEQ ID NO: 439768 - DNA, 25 bp, Mus musculus
gagtgctgccgccaagactaattag

SEQ ID NO: 439769 - DNA, 25 bp, Mus musculus
gagtgctgccgtccattgttaatga

SEQ ID NO: 439770 - DNA, 25 bp, Mus musculus
gagtgctgcctccaaagcgcattac

SEQ ID NO: 439771 - DNA, 25 bp, Mus musculus
gagtgctgcctgattcttctgcaag

SEQ ID NO: 439772 - DNA, 25 bp, Mus musculus
gagtgctgcttgagagtgtccctga

SEQ ID NO: 439773 - DNA, 25 bp, Mus musculus
gagtgctgggctcgttttttgtacc

SEQ ID NO: 439774 - DNA, 25 bp, Mus musculus
gagtgcttagcaaaggtaaaccctc

SEQ ID NO: 439775 - DNA, 25 bp, Mus musculus
gagtgcttattgcagcccatgggaa

SEQ ID NO: 439776 - DNA, 25 bp, Mus musculus
gagtgcttctatcatgggagttcca

SEQ ID NO: 439777 - DNA, 25 bp, Mus musculus
gagtgcttctgctgacgtactggcc

SEQ ID NO: 439778 - DNA, 25 bp, Mus musculus
gagtgctttaagctggtctctggca

SEQ ID NO: 439779 - DNA, 25 bp, Mus musculus
gagtgctttgatgcgcttgtggcta

SEQ ID NO: 439780 - DNA, 25 bp, Mus musculus
gagtgctttgccatgtctggcccga

SEQ ID NO: 439781 - DNA, 25 bp, Mus musculus
gagtgcttttgagatcccagtgcta

SEQ ID NO: 439782 - DNA, 25 bp, Mus musculus
gagtggaaaagatgacaggcgcccc

SEQ ID NO: 439783 - DNA, 25 bp, Mus musculus
gagtggaaaccacgtcaaattgaca

SEQ ID NO: 439784 - DNA, 25 bp, Mus musculus
gagtggaaagactacaaagccggct

SEQ ID NO: 439785 - DNA, 25 bp, Mus musculus
gagtggaacacccaaactgacatcc

SEQ ID NO: 439786 - DNA, 25 bp, Mus musculus
gagtggaacactgtacagctttgga

SEQ ID NO: 439787 - DNA, 25 bp, Mus musculus
gagtggaatacatcaactctcttcc

SEQ ID NO: 439788 - DNA, 25 bp, Mus musculus
gagtggaatctacagcccggaagct

SEQ ID NO: 439789 - DNA, 25 bp, Mus musculus
gagtggagaaaagacgaggccatcc

SEQ ID NO: 439790 - DNA, 25 bp, Mus musculus
gagtggagacttgtcctgttctcaa

SEQ ID NO: 439791 - DNA, 25 bp, Mus musculus
gagtggagcgcctgttctaagacct

SEQ ID NO: 439792 - DNA, 25 bp, Mus musculus
gagtggagtcgaagcgtctcttcca

SEQ ID NO: 439793 - DNA, 25 bp, Mus musculus
gagtggagttcaacattgacctgcc

SEQ ID NO: 439794 - DNA, 25 bp, Mus musculus
gagtggagttctagtcacgaactgc

SEQ ID NO: 439795 - DNA, 25 bp, Mus musculus
gagtggatcccatatggagctaaga

SEQ ID NO: 439796 - DNA, 25 bp, Mus musculus
gagtggatccgactcacaacgacac

SEQ ID NO: 439797 - DNA, 25 bp, Mus musculus
gagtggatcttcattgacccggagg

SEQ ID NO: 439798 - DNA, 25 bp, Mus musculus
gagtggccacatcgatatagtcaag

SEQ ID NO: 439799 - DNA, 25 bp, Mus musculus
gagtggccactccacagaaggcttg

SEQ ID NO: 439800 - DNA, 25 bp, Mus musculus
gagtggcccgcaaactggatcatta

SEQ ID NO: 439801 - DNA, 25 bp, Mus musculus
gagtggccgccagcaatattgtcca

SEQ ID NO: 439802 - DNA, 25 bp, Mus musculus
gagtggcctccgtgatcttaacctg

SEQ ID NO: 439803 - DNA, 25 bp, Mus musculus
gagtggccttcaccttgctggagaa

SEQ ID NO: 439804 - DNA, 25 bp, Mus musculus
gagtggccttgacgctgcactgcca

SEQ ID NO: 439805 - DNA, 25 bp, Mus musculus
gagtggcggctgcaccgcaatctat

SEQ ID NO: 439806 - DNA, 25 bp, Mus musculus
gagtggctacctccctcagagtgtg

SEQ ID NO: 439807 - DNA, 25 bp, Mus musculus
gagtggctccaacagcaaatatctt

SEQ ID NO: 439808 - DNA, 25 bp, Mus musculus
gagtggctcctgctcggatttctac

SEQ ID NO: 439809 - DNA, 25 bp, Mus musculus
gagtggctgccctaactgtgtatgg

SEQ ID NO: 439810 - DNA, 25 bp, Mus musculus
gagtggctgctgaacaacctcatga

SEQ ID NO: 439811 - DNA, 25 bp, Mus musculus
gagtggctggacacacctggttgct

SEQ ID NO: 439812 - DNA, 25 bp, Mus musculus
gagtggctgttcctaacaggagcat

SEQ ID NO: 439813 - DNA, 25 bp, Mus musculus
gagtgggaaccaccagtgattcaaa

SEQ ID NO: 439814 - DNA, 25 bp, Mus musculus
gagtgggatgacatactgacctgca

SEQ ID NO: 439815 - DNA, 25 bp, Mus musculus
gagtgggcaggcaaacatcctctgt

SEQ ID NO: 439816 - DNA, 25 bp, Mus musculus
gagtgggccacatctacaggaagta

SEQ ID NO: 439817 - DNA, 25 bp, Mus musculus
gagtgggccaggtcagacctctgcc

SEQ ID NO: 439818 - DNA, 25 bp, Mus musculus
gagtgggcgcctatgcagttttagc

SEQ ID NO: 439819 - DNA, 25 bp, Mus musculus
gagtgggttctcactacacccggag

SEQ ID NO: 439820 - DNA, 25 bp, Mus musculus
gagtggtaacagtacttgagcatag

SEQ ID NO: 439821 - DNA, 25 bp, Mus musculus
gagtggtacaagtccaagttcgcca

SEQ ID NO: 439822 - DNA, 25 bp, Mus musculus
gagtggtagccagcaaagcctagag

SEQ ID NO: 439823 - DNA, 25 bp, Mus musculus
gagtggtccagtaaaccccttggca

SEQ ID NO: 439824 - DNA, 25 bp, Mus musculus
gagtggtggcctgaagccgccattt

SEQ ID NO: 439825 - DNA, 25 bp, Mus musculus
gagtggttctcatagcggcagcaaa

SEQ ID NO: 439826 - DNA, 25 bp, Mus musculus
gagtgtaaactgtacgaagctttga

SEQ ID NO: 439827 - DNA, 25 bp, Mus musculus
gagtgtaacactcacaacacgtaca

SEQ ID NO: 439828 - DNA, 25 bp, Mus musculus
gagtgtaagtcaatatcctccacgc

SEQ ID NO: 439829 - DNA, 25 bp, Mus musculus
gagtgtaatcaggaagggcccatcc

SEQ ID NO: 439830 - DNA, 25 bp, Mus musculus
gagtgtagcctaattttctgtcatg

SEQ ID NO: 439831 - DNA, 25 bp, Mus musculus
gagtgtatctccacacaagacagga

SEQ ID NO: 439832 - DNA, 25 bp, Mus musculus
gagtgtattcccttactgtgggaag

SEQ ID NO: 439833 - DNA, 25 bp, Mus musculus
gagtgtatttcttgacccacggaag

SEQ ID NO: 439834 - DNA, 25 bp, Mus musculus
gagtgtcaacaatgcctttgccaag

SEQ ID NO: 439835 - DNA, 25 bp, Mus musculus
gagtgtcaagacaacaacggcggct

SEQ ID NO: 439836 - DNA, 25 bp, Mus musculus
gagtgtcacccttatctgaaccaga

SEQ ID NO: 439837 - DNA, 25 bp, Mus musculus
gagtgtcactgaaatcttaccattg

SEQ ID NO: 439838 - DNA, 25 bp, Mus musculus
gagtgtcagagcctttccagtcaaa

SEQ ID NO: 439839 - DNA, 25 bp, Mus musculus
gagtgtcagttctcacgagacatgg

SEQ ID NO: 439840 - DNA, 25 bp, Mus musculus
gagtgtcccaccactttctcagggc

SEQ ID NO: 439841 - DNA, 25 bp, Mus musculus
gagtgtcccttatggcatggccgca

SEQ ID NO: 439842 - DNA, 25 bp, Mus musculus
gagtgtccggcaagcatgcagcatt

SEQ ID NO: 439843 - DNA, 25 bp, Mus musculus
gagtgtctacaggaaacggacgcct

SEQ ID NO: 439844 - DNA, 25 bp, Mus musculus
gagtgtctagtctttcagggtccac

SEQ ID NO: 439845 - DNA, 25 bp, Mus musculus
gagtgtctcaaatcacccagcctga

SEQ ID NO: 439846 - DNA, 25 bp, Mus musculus
gagtgtctcagttcagtgtcaaagg

SEQ ID NO: 439847 - DNA, 25 bp, Mus musculus
gagtgtctccggcatccttggctaa

SEQ ID NO: 439848 - DNA, 25 bp, Mus musculus
gagtgtctgagtcttctgtaaacaa

SEQ ID NO: 439849 - DNA, 25 bp, Mus musculus
gagtgtgaactgttccagccccgag

SEQ ID NO: 439850 - DNA, 25 bp, Mus musculus
gagtgtgaacttgatgccagcgcca

SEQ ID NO: 439851 - DNA, 25 bp, Mus musculus
gagtgtgacagtattatgcttttca

SEQ ID NO: 439852 - DNA, 25 bp, Mus musculus
gagtgtgaccatcaccatgggcctc

SEQ ID NO: 439853 - DNA, 25 bp, Mus musculus
gagtgtgacctctgtgatccctaag

SEQ ID NO: 439854 - DNA, 25 bp, Mus musculus
gagtgtgcacctgctaatgccgaag

SEQ ID NO: 439855 - DNA, 25 bp, Mus musculus
gagtgtgcagcaaacctttatcttc

SEQ ID NO: 439856 - DNA, 25 bp, Mus musculus
gagtgtgcccagaatgccatgtgct

SEQ ID NO: 439857 - DNA, 25 bp, Mus musculus
gagtgtgcgtgtgtgagaactcatt

SEQ ID NO: 439858 - DNA, 25 bp, Mus musculus
gagtgtgctagaccttccctctgga

SEQ ID NO: 439859 - DNA, 25 bp, Mus musculus
gagtgtgctcaagggttctgtctgc

SEQ ID NO: 439860 - DNA, 25 bp, Mus musculus
gagtgtgctcgctggcttcatggcc

SEQ ID NO: 439861 - DNA, 25 bp, Mus musculus
gagtgtgctctgaatacccatccgt

SEQ ID NO: 439862 - DNA, 25 bp, Mus musculus
gagtgtgctggtcaactgtcctgcc

SEQ ID NO: 439863 - DNA, 25 bp, Mus musculus
gagtgtgggtttcaagattccagaa

SEQ ID NO: 439864 - DNA, 25 bp, Mus musculus
gagtgtgtatagtcagcatgcctgc

SEQ ID NO: 439865 - DNA, 25 bp, Mus musculus
gagtgtgtgaaaagcccatgtcgcc

SEQ ID NO: 439866 - DNA, 25 bp, Mus musculus
gagtgtgttaggtctggtgccccaa

SEQ ID NO: 439867 - DNA, 25 bp, Mus musculus
gagtgtgtttcagcccgggttcgaa

SEQ ID NO: 439868 - DNA, 25 bp, Mus musculus
gagtgttaaacctgagaatcgcgag

SEQ ID NO: 439869 - DNA, 25 bp, Mus musculus
gagtgttagtcctgctaagtgttgc

SEQ ID NO: 439870 - DNA, 25 bp, Mus musculus
gagtgttatctgtgaattccctaca

SEQ ID NO: 439871 - DNA, 25 bp, Mus musculus
gagtgttccccagggcaacttctgg

SEQ ID NO: 439872 - DNA, 25 bp, Mus musculus
gagtgttccccgatggccatgtgct

SEQ ID NO: 439873 - DNA, 25 bp, Mus musculus
gagtgttccctctttctgaacccag

SEQ ID NO: 439874 - DNA, 25 bp, Mus musculus
gagtgttcttctcctagatagcccc

SEQ ID NO: 439875 - DNA, 25 bp, Mus musculus
gagtgttgaaggaactcagcgttca

SEQ ID NO: 439876 - DNA, 25 bp, Mus musculus
gagtgttgcctgaacacacatgggc

SEQ ID NO: 439877 - DNA, 25 bp, Mus musculus
gagtgttggagatgccctcggctat

SEQ ID NO: 439878 - DNA, 25 bp, Mus musculus
gagtgtttaatgttcacagtgttcc

SEQ ID NO: 439879 - DNA, 25 bp, Mus musculus
gagtgtttcaaatgcgccgcctgtc

SEQ ID NO: 439880 - DNA, 25 bp, Mus musculus
gagtgtttccacaccgaggtaagtg

SEQ ID NO: 439881 - DNA, 25 bp, Mus musculus
gagtgtttctgtttggactgaacga

SEQ ID NO: 439882 - DNA, 25 bp, Mus musculus
gagtgtttgccttgaaccctccagc

SEQ ID NO: 439883 - DNA, 25 bp, Mus musculus
gagtgttttgcaccttcagatggaa

SEQ ID NO: 439884 - DNA, 25 bp, Mus musculus
gagtgtttttaactctcaggaaaag

SEQ ID NO: 439885 - DNA, 25 bp, Mus musculus
gagttaaacgttcaggcacccagat

SEQ ID NO: 439886 - DNA, 25 bp, Mus musculus
gagttaaagaaaagacaccattggg

SEQ ID NO: 439887 - DNA, 25 bp, Mus musculus
gagttaacagcctgaacgcagagcc

SEQ ID NO: 439888 - DNA, 25 bp, Mus musculus
gagttaaccattgaaagctaatgca

SEQ ID NO: 439889 - DNA, 25 bp, Mus musculus
gagttaaccggactgccttttgcag

SEQ ID NO: 439890 - DNA, 25 bp, Mus musculus
gagttaagagcatggcagccggatc

SEQ ID NO: 439891 - DNA, 25 bp, Mus musculus
gagttaagttctggaacagacgagg

SEQ ID NO: 439892 - DNA, 25 bp, Mus musculus
gagttacaaatcctcatgagacatg

SEQ ID NO: 439893 - DNA, 25 bp, Mus musculus
gagttacaccggatcagcaaggctt

SEQ ID NO: 439894 - DNA, 25 bp, Mus musculus
gagttacagaactagcccatgaagg

SEQ ID NO: 439895 - DNA, 25 bp, Mus musculus
gagttacatacctgacttgggcagc

SEQ ID NO: 439896 - DNA, 25 bp, Mus musculus
gagttacctctttccttagcggcag

SEQ ID NO: 439897 - DNA, 25 bp, Mus musculus
gagttacggcaactgtcacagatgc

SEQ ID NO: 439898 - DNA, 25 bp, Mus musculus
gagttactctgtacttccagggcta

SEQ ID NO: 439899 - DNA, 25 bp, Mus musculus
gagttactcttaagttagccatgga

SEQ ID NO: 439900 - DNA, 25 bp, Mus musculus
gagttactgctctaactggcactgc

SEQ ID NO: 439901 - DNA, 25 bp, Mus musculus
gagttactgttgtttccgaagtaag

SEQ ID NO: 439902 - DNA, 25 bp, Mus musculus
gagttactgtttgacttgacccagg

SEQ ID NO: 439903 - DNA, 25 bp, Mus musculus
gagttagaacagcaagccttgggca

SEQ ID NO: 439904 - DNA, 25 bp, Mus musculus
gagttagactcgaaaggatgaccac

SEQ ID NO: 439905 - DNA, 25 bp, Mus musculus
gagttagactgcctctaatcttggt

SEQ ID NO: 439906 - DNA, 25 bp, Mus musculus
gagttagagtcccatcgagatcaaa

SEQ ID NO: 439907 - DNA, 25 bp, Mus musculus
gagttagatgactctcagacacagc

SEQ ID NO: 439908 - DNA, 25 bp, Mus musculus
gagttagatggtccactgcccacag

SEQ ID NO: 439909 - DNA, 25 bp, Mus musculus
gagttagattcagttccacttagta

SEQ ID NO: 439910 - DNA, 25 bp, Mus musculus
gagttagcagcatgccagcttcgga

SEQ ID NO: 439911 - DNA, 25 bp, Mus musculus
gagttagcatatgttcccagggaag

SEQ ID NO: 439912 - DNA, 25 bp, Mus musculus
gagttaggcctattgggcctccaga

SEQ ID NO: 439913 - DNA, 25 bp, Mus musculus
gagttagggtccatcacccacacag

SEQ ID NO: 439914 - DNA, 25 bp, Mus musculus
gagttagtcagggtttcacacaaag

SEQ ID NO: 439915 - DNA, 25 bp, Mus musculus
gagttagtcccaagtcgtcggactc

SEQ ID NO: 439916 - DNA, 25 bp, Mus musculus
gagttagttagcaaagagcagaggc

SEQ ID NO: 439917 - DNA, 25 bp, Mus musculus
gagttagtttgtcatgtgccccaga

SEQ ID NO: 439918 - DNA, 25 bp, Mus musculus
gagttatcactccagacacatggaa

SEQ ID NO: 439919 - DNA, 25 bp, Mus musculus
gagttatcaggtttcgtatttggcc

SEQ ID NO: 439920 - DNA, 25 bp, Mus musculus
gagttatcattaggatcctggccac

SEQ ID NO: 439921 - DNA, 25 bp, Mus musculus
gagttatcttgaagccccgtgcctg

SEQ ID NO: 439922 - DNA, 25 bp, Mus musculus
gagttatgaatgaccccgcagtagg

SEQ ID NO: 439923 - DNA, 25 bp, Mus musculus
gagttatgcactggacctggctggc

SEQ ID NO: 439924 - DNA, 25 bp, Mus musculus
gagttatgtgagaatgaccaccccg

SEQ ID NO: 439925 - DNA, 25 bp, Mus musculus
gagttcaaaatgacggaccctgatg

SEQ ID NO: 439926 - DNA, 25 bp, Mus musculus
gagttcaagaaaagcgactcctgct

SEQ ID NO: 439927 - DNA, 25 bp, Mus musculus
gagttcaagactccacattagtgag

SEQ ID NO: 439928 - DNA, 25 bp, Mus musculus
gagttcaatccgatccgctccagga

SEQ ID NO: 439929 - DNA, 25 bp, Mus musculus
gagttcaatcctacagtcctcaagg

SEQ ID NO: 439930 - DNA, 25 bp, Mus musculus
gagttcaattgcctgagaacacggg

SEQ ID NO: 439931 - DNA, 25 bp, Mus musculus
gagttcaattgcttccagaccacag

SEQ ID NO: 439932 - DNA, 25 bp, Mus musculus
gagttcacaagaagcaacgctgtct

SEQ ID NO: 439933 - DNA, 25 bp, Mus musculus
gagttcacactcgagccagataagg

SEQ ID NO: 439934 - DNA, 25 bp, Mus musculus
gagttcacctcatccgtaacagctg

SEQ ID NO: 439935 - DNA, 25 bp, Mus musculus
gagttcagatccctccattcaggag

SEQ ID NO: 439936 - DNA, 25 bp, Mus musculus
gagttcagccaaaacctccctgtgg

SEQ ID NO: 439937 - DNA, 25 bp, Mus musculus
gagttcagccgagaattccagttag

SEQ ID NO: 439938 - DNA, 25 bp, Mus musculus
gagttcaggctctttgggttttatt

SEQ ID NO: 439939 - DNA, 25 bp, Mus musculus
gagttcaggtcaccagccaggagta

SEQ ID NO: 439940 - DNA, 25 bp, Mus musculus
gagttcaggtctactgtctcctggc

SEQ ID NO: 439941 - DNA, 25 bp, Mus musculus
gagttcaggtgattaggcttggcca

SEQ ID NO: 439942 - DNA, 25 bp, Mus musculus
gagttcagtgaaccaacgacctcca

SEQ ID NO: 439943 - DNA, 25 bp, Mus musculus
gagttcagtgccgtctcagacagga

SEQ ID NO: 439944 - DNA, 25 bp, Mus musculus
gagttcataccgactaggccctgta

SEQ ID NO: 439945 - DNA, 25 bp, Mus musculus
gagttcatcattcaagcagagccag

SEQ ID NO: 439946 - DNA, 25 bp, Mus musculus
gagttcatccacgacatccggaggc

SEQ ID NO: 439947 - DNA, 25 bp, Mus musculus
gagttcatctgagaggctgccaggc

SEQ ID NO: 439948 - DNA, 25 bp, Mus musculus
gagttcatgccctaagacacggacg

SEQ ID NO: 439949 - DNA, 25 bp, Mus musculus
gagttcattaatgtccctgcgcaga

SEQ ID NO: 439950 - DNA, 25 bp, Mus musculus
gagttcattacaaatctccaaggag

SEQ ID NO: 439951 - DNA, 25 bp, Mus musculus
gagttcattgcgtttgagcaccctg

SEQ ID NO: 439952 - DNA, 25 bp, Mus musculus
gagttccaatgtcagtgccccaaag

SEQ ID NO: 439953 - DNA, 25 bp, Mus musculus
gagttccacacaaggttgtacccat

SEQ ID NO: 439954 - DNA, 25 bp, Mus musculus
gagttccacacttgtcacagcacag

SEQ ID NO: 439955 - DNA, 25 bp, Mus musculus
gagttccacgaacagcaaatgtgag

SEQ ID NO: 439956 - DNA, 25 bp, Mus musculus
gagttccacggctgcagtcatggca

SEQ ID NO: 439957 - DNA, 25 bp, Mus musculus
gagttccagcaagtgttcattccag

SEQ ID NO: 439958 - DNA, 25 bp, Mus musculus
gagttccagtaacgcaagtcagctg

SEQ ID NO: 439959 - DNA, 25 bp, Mus musculus
gagttccagtacttgccagacacag

SEQ ID NO: 439960 - DNA, 25 bp, Mus musculus
gagttccagtataggctctgagcac

SEQ ID NO: 439961 - DNA, 25 bp, Mus musculus
gagttccagtgtgacatcaccccat

SEQ ID NO: 439962 - DNA, 25 bp, Mus musculus
gagttccatgactcgctgggcgact

SEQ ID NO: 439963 - DNA, 25 bp, Mus musculus
gagttcccaataccattatctgtaa

SEQ ID NO: 439964 - DNA, 25 bp, Mus musculus
gagttcccacagctgctagcctgaa

SEQ ID NO: 439965 - DNA, 25 bp, Mus musculus
gagttcccacgctggtagtgtggca

SEQ ID NO: 439966 - DNA, 25 bp, Mus musculus
gagttccccaactatcaccagactt

SEQ ID NO: 439967 - DNA, 25 bp, Mus musculus
gagttcccctccatgctggcgttgg

SEQ ID NO: 439968 - DNA, 25 bp, Mus musculus
gagttcccgccctgacagaaaaagg

SEQ ID NO: 439969 - DNA, 25 bp, Mus musculus
gagttcccgtcgaaagtgagcacga

SEQ ID NO: 439970 - DNA, 25 bp, Mus musculus
gagttccctgcaggtaaagggcata

SEQ ID NO: 439971 - DNA, 25 bp, Mus musculus
gagttccgcgtctacaaggactgtg

SEQ ID NO: 439972 - DNA, 25 bp, Mus musculus
gagttccggatacttgcaaagccac

SEQ ID NO: 439973 - DNA, 25 bp, Mus musculus
gagttccggcagcatctagagagca

SEQ ID NO: 439974 - DNA, 25 bp, Mus musculus
gagttccgggaagtagctagtcaac

SEQ ID NO: 439975 - DNA, 25 bp, Mus musculus
gagttccgggcgattttaatcactg

SEQ ID NO: 439976 - DNA, 25 bp, Mus musculus
gagttcctagtgcttggtaacaaga

SEQ ID NO: 439977 - DNA, 25 bp, Mus musculus
gagttcctatccagccaggcgctga

SEQ ID NO: 439978 - DNA, 25 bp, Mus musculus
gagttcctgaaaatacgcccgtagg

SEQ ID NO: 439979 - DNA, 25 bp, Mus musculus
gagttcctggaaggcagtaacctca

SEQ ID NO: 439980 - DNA, 25 bp, Mus musculus
gagttcctgtaaagcccaccaaggg

SEQ ID NO: 439981 - DNA, 25 bp, Mus musculus
gagttccttatgaagcacacagcct

SEQ ID NO: 439982 - DNA, 25 bp, Mus musculus
gagttcgacggcactgaggttctga

SEQ ID NO: 439983 - DNA, 25 bp, Mus musculus
gagttcgagattgagcagcaccagg

SEQ ID NO: 439984 - DNA, 25 bp, Mus musculus
gagttcgcctcgtgtagttttgccc

SEQ ID NO: 439985 - DNA, 25 bp, Mus musculus
gagttcggcaccctgcacatggagt

SEQ ID NO: 439986 - DNA, 25 bp, Mus musculus
gagttcggcggtcttcctgtataca

SEQ ID NO: 439987 - DNA, 25 bp, Mus musculus
gagttcgtcctggagaataccggca

SEQ ID NO: 439988 - DNA, 25 bp, Mus musculus
gagttcgtgcaaatcgtggtcatcg

SEQ ID NO: 439989 - DNA, 25 bp, Mus musculus
gagttcgtgttcaatcactggcgag

SEQ ID NO: 439990 - DNA, 25 bp, Mus musculus
gagttctaatggacaaacggttcac

SEQ ID NO: 439991 - DNA, 25 bp, Mus musculus
gagttctaccaactagaaatgttcg

SEQ ID NO: 439992 - DNA, 25 bp, Mus musculus
gagttctacgcatccactgaaggca

SEQ ID NO: 439993 - DNA, 25 bp, Mus musculus
gagttctacgcttagcagagccaca

SEQ ID NO: 439994 - DNA, 25 bp, Mus musculus
gagttctcaaggcaggcctcctcag

SEQ ID NO: 439995 - DNA, 25 bp, Mus musculus
gagttctcactcttccaggtggtcc

SEQ ID NO: 439996 - DNA, 25 bp, Mus musculus
gagttctcatgcaactgcaggcgga

SEQ ID NO: 439997 - DNA, 25 bp, Mus musculus
gagttctccgagttcatccaggcac

SEQ ID NO: 439998 - DNA, 25 bp, Mus musculus
gagttctctctgaggcaaggcccat

SEQ ID NO: 439999 - DNA, 25 bp, Mus musculus
gagttctctgacgacctgcatcaca

SEQ ID NO: 440000 - DNA, 25 bp, Mus musculus
gagttctgcccgctctcttgtagga

SEQ ID NO: 440001 - DNA, 25 bp, Mus musculus
gagttctggcctgtttgaaagaagc

SEQ ID NO: 440002 - DNA, 25 bp, Mus musculus
gagttctgtacaaataagaatcacc

SEQ ID NO: 440003 - DNA, 25 bp, Mus musculus
gagttctgtcctcctttcaccggaa

SEQ ID NO: 440004 - DNA, 25 bp, Mus musculus
gagttctgtctgtcccagggcccca

SEQ ID NO: 440005 - DNA, 25 bp, Mus musculus
gagttctgtgatacctatcctgcca

SEQ ID NO: 440006 - DNA, 25 bp, Mus musculus
gagttcttacatctacggacagcag

SEQ ID NO: 440007 - DNA, 25 bp, Mus musculus
gagttcttcagcatcgacgagcaca

SEQ ID NO: 440008 - DNA, 25 bp, Mus musculus
gagttcttccgagaccaagggaggc

SEQ ID NO: 440009 - DNA, 25 bp, Mus musculus
gagttcttgcctagcttgtcacatg

SEQ ID NO: 440010 - DNA, 25 bp, Mus musculus
gagttcttttacagcggtgagtcct

SEQ ID NO: 440011 - DNA, 25 bp, Mus musculus
gagttgaacccaaagtgccatatgg

SEQ ID NO: 440012 - DNA, 25 bp, Mus musculus
gagttgaactgagcagctccagcgg

SEQ ID NO: 440013 - DNA, 25 bp, Mus musculus
gagttgaacttcaggcatgcaccat

SEQ ID NO: 440014 - DNA, 25 bp, Mus musculus
gagttgaagtggatctactcctcag

SEQ ID NO: 440015 - DNA, 25 bp, Mus musculus
gagttgaccagcatcgatcaggtgg

SEQ ID NO: 440016 - DNA, 25 bp, Mus musculus
gagttgacccgtgacctgaagctgt

SEQ ID NO: 440017 - DNA, 25 bp, Mus musculus
gagttgacggctgtcacctgctcag

SEQ ID NO: 440018 - DNA, 25 bp, Mus musculus
gagttgactaccaccttttgcttca

SEQ ID NO: 440019 - DNA, 25 bp, Mus musculus
gagttgactatgatcctgagcacag

SEQ ID NO: 440020 - DNA, 25 bp, Mus musculus
gagttgagatcttagtgcccacatg

SEQ ID NO: 440021 - DNA, 25 bp, Mus musculus
gagttgagcatctgtttgcctgaag

SEQ ID NO: 440022 - DNA, 25 bp, Mus musculus
gagttgagccatacccttaccctgt

SEQ ID NO: 440023 - DNA, 25 bp, Mus musculus
gagttgagctcatcgagtaccagag

SEQ ID NO: 440024 - DNA, 25 bp, Mus musculus
gagttgagcttcaattacctcctga

SEQ ID NO: 440025 - DNA, 25 bp, Mus musculus
gagttgagtctcatgcaggccaaga

SEQ ID NO: 440026 - DNA, 25 bp, Mus musculus
gagttgatccaaggatgtctcgttg

SEQ ID NO: 440027 - DNA, 25 bp, Mus musculus
gagttgatggtctgtctgctgcaga

SEQ ID NO: 440028 - DNA, 25 bp, Mus musculus
gagttgatggttgtattcttcccta

SEQ ID NO: 440029 - DNA, 25 bp, Mus musculus
gagttgatgttttaggttccacgag

SEQ ID NO: 440030 - DNA, 25 bp, Mus musculus
gagttgcaagcatgaacgatcacac

SEQ ID NO: 440031 - DNA, 25 bp, Mus musculus
gagttgcaaggtacacatggccagc

SEQ ID NO: 440032 - DNA, 25 bp, Mus musculus
gagttgcagagctcattttgcccga

SEQ ID NO: 440033 - DNA, 25 bp, Mus musculus
gagttgcagttctgctccctaagaa

SEQ ID NO: 440034 - DNA, 25 bp, Mus musculus
gagttgccacacctaaacctaaagc

SEQ ID NO: 440035 - DNA, 25 bp, Mus musculus
gagttgcccagctctagaactgtca

SEQ ID NO: 440036 - DNA, 25 bp, Mus musculus
gagttgccctcgaataccctggctg

SEQ ID NO: 440037 - DNA, 25 bp, Mus musculus
gagttgccttcgcaaataccggagg

SEQ ID NO: 440038 - DNA, 25 bp, Mus musculus
gagttgctctttccagatgctagtg

SEQ ID NO: 440039 - DNA, 25 bp, Mus musculus
gagttgctgaagtatgcagttctgg

SEQ ID NO: 440040 - DNA, 25 bp, Mus musculus
gagttgctgtccaccaatggctgtc

SEQ ID NO: 440041 - DNA, 25 bp, Mus musculus
gagttggaaatttctctgctgtccc

SEQ ID NO: 440042 - DNA, 25 bp, Mus musculus
gagttggagatctcagctctaccta

SEQ ID NO: 440043 - DNA, 25 bp, Mus musculus
gagttggagccagagttagaaaatg

SEQ ID NO: 440044 - DNA, 25 bp, Mus musculus
gagttggcaacacaggatgtcctga

SEQ ID NO: 440045 - DNA, 25 bp, Mus musculus
gagttggcaatgtcacccgcatacg

SEQ ID NO: 440046 - DNA, 25 bp, Mus musculus
gagttggccggctgttaaattgaag

SEQ ID NO: 440047 - DNA, 25 bp, Mus musculus
gagttggctatctcccgtcgtcaag

SEQ ID NO: 440048 - DNA, 25 bp, Mus musculus
gagttgggtgcacacttcctggcca

SEQ ID NO: 440049 - DNA, 25 bp, Mus musculus
gagttggtaactttgcctgcagcga

SEQ ID NO: 440050 - DNA, 25 bp, Mus musculus
gagttggtccttttgcatgaggccc

SEQ ID NO: 440051 - DNA, 25 bp, Mus musculus
gagttggtgcacaaccggctacagc

SEQ ID NO: 440052 - DNA, 25 bp, Mus musculus
gagttgtacaaatacacttgccagg

SEQ ID NO: 440053 - DNA, 25 bp, Mus musculus
gagttgtaccaaaatgatgccttcc

SEQ ID NO: 440054 - DNA, 25 bp, Mus musculus
gagttgtatcctatggaataaacag

SEQ ID NO: 440055 - DNA, 25 bp, Mus musculus
gagttgtcaccagggtaatgcccag

SEQ ID NO: 440056 - DNA, 25 bp, Mus musculus
gagttgtcccggacgcgcgcgcttc

SEQ ID NO: 440057 - DNA, 25 bp, Mus musculus
gagttgtcgtcctgtagccacgagc

SEQ ID NO: 440058 - DNA, 25 bp, Mus musculus
gagttgtctaacgaagccctgagaa

SEQ ID NO: 440059 - DNA, 25 bp, Mus musculus
gagttgtcttccaatcaaggctgaa

SEQ ID NO: 440060 - DNA, 25 bp, Mus musculus
gagttgtgcaatgcttattaagggc

SEQ ID NO: 440061 - DNA, 25 bp, Mus musculus
gagttgttgccgtcaaagccatcaa

SEQ ID NO: 440062 - DNA, 25 bp, Mus musculus
gagttgttggagatggtgggaccca

SEQ ID NO: 440063 - DNA, 25 bp, Mus musculus
gagttgtttctccaaaaatccgata

SEQ ID NO: 440064 - DNA, 25 bp, Mus musculus
gagtttaaggattttgaggtcatcc

SEQ ID NO: 440065 - DNA, 25 bp, Mus musculus
gagtttaagtaggtgcctgcccaca

SEQ ID NO: 440066 - DNA, 25 bp, Mus musculus
gagtttaattcctggcttggccgaa

SEQ ID NO: 440067 - DNA, 25 bp, Mus musculus
gagtttagtccgtccatggtccgag

SEQ ID NO: 440068 - DNA, 25 bp, Mus musculus
gagtttagtgggatgagagatcacc

SEQ ID NO: 440069 - DNA, 25 bp, Mus musculus
gagtttattttccacaccgcggcat

SEQ ID NO: 440070 - DNA, 25 bp, Mus musculus
gagtttcaaagtgcgagtgtccacc

SEQ ID NO: 440071 - DNA, 25 bp, Mus musculus
gagtttcaacactatccggcaatgg

SEQ ID NO: 440072 - DNA, 25 bp, Mus musculus
gagtttcacgaaggcaccgatgagc

SEQ ID NO: 440073 - DNA, 25 bp, Mus musculus
gagtttcagccgcttcctacaggac

SEQ ID NO: 440074 - DNA, 25 bp, Mus musculus
gagtttcagtgtttgagtccccagg

SEQ ID NO: 440075 - DNA, 25 bp, Mus musculus
gagtttccagttgacctcagcacta

SEQ ID NO: 440076 - DNA, 25 bp, Mus musculus
gagtttccatgcttagtctgagggc

SEQ ID NO: 440077 - DNA, 25 bp, Mus musculus
gagtttcccagtgaacaggcggaga

SEQ ID NO: 440078 - DNA, 25 bp, Mus musculus
gagtttcccgtctcacttggtttct

SEQ ID NO: 440079 - DNA, 25 bp, Mus musculus
gagtttccctggactcagccctgga

SEQ ID NO: 440080 - DNA, 25 bp, Mus musculus
gagtttccgcatacaaccagtgagt

SEQ ID NO: 440081 - DNA, 25 bp, Mus musculus
gagtttcgaatgtcttcacccagag

SEQ ID NO: 440082 - DNA, 25 bp, Mus musculus
gagtttcgggagatcacgcctctgc

SEQ ID NO: 440083 - DNA, 25 bp, Mus musculus
gagtttcgggtttcagctagcaaca

SEQ ID NO: 440084 - DNA, 25 bp, Mus musculus
gagtttcggtttgatctgacccaga

SEQ ID NO: 440085 - DNA, 25 bp, Mus musculus
gagtttcgttctttgcccagttgag

SEQ ID NO: 440086 - DNA, 25 bp, Mus musculus
gagtttctagcttaattccctgcac

SEQ ID NO: 440087 - DNA, 25 bp, Mus musculus
gagtttctctgggaaccacctaatg

SEQ ID NO: 440088 - DNA, 25 bp, Mus musculus
gagtttctgctatccatctgctgcc

SEQ ID NO: 440089 - DNA, 25 bp, Mus musculus
gagtttctgctttgagcccctgagg

SEQ ID NO: 440090 - DNA, 25 bp, Mus musculus
gagtttcttgacatcgaggacccgt

SEQ ID NO: 440091 - DNA, 25 bp, Mus musculus
gagtttgacacataacaggcacccg

SEQ ID NO: 440092 - DNA, 25 bp, Mus musculus
gagtttgacctcagcagatatggct

SEQ ID NO: 440093 - DNA, 25 bp, Mus musculus
gagtttgacctcatgccttggcagg

SEQ ID NO: 440094 - DNA, 25 bp, Mus musculus
gagtttgacctttaccaaggctagt

SEQ ID NO: 440095 - DNA, 25 bp, Mus musculus
gagtttgagacactactgcctcagc

SEQ ID NO: 440096 - DNA, 25 bp, Mus musculus
gagtttgagcctttgttcacatcag

SEQ ID NO: 440097 - DNA, 25 bp, Mus musculus
gagtttgagttccacccatgctagc

SEQ ID NO: 440098 - DNA, 25 bp, Mus musculus
gagtttgatttagatattgacccca

SEQ ID NO: 440099 - DNA, 25 bp, Mus musculus
gagtttgcaaagacctcagcagtca

SEQ ID NO: 440100 - DNA, 25 bp, Mus musculus
gagtttgcacttagatggccccaga

SEQ ID NO: 440101 - DNA, 25 bp, Mus musculus
gagtttgccatcgatcccaatgagc

SEQ ID NO: 440102 - DNA, 25 bp, Mus musculus
gagtttgcctgataatgcctacagc

SEQ ID NO: 440103 - DNA, 25 bp, Mus musculus
gagtttgctaaattgggtccccaga

SEQ ID NO: 440104 - DNA, 25 bp, Mus musculus
gagtttggaagcctgcaacatcaca

SEQ ID NO: 440105 - DNA, 25 bp, Mus musculus
gagtttggcagtgcgtaccagtcac

SEQ ID NO: 440106 - DNA, 25 bp, Mus musculus
gagtttgggcctaccctgggctaat

SEQ ID NO: 440107 - DNA, 25 bp, Mus musculus
gagtttgggtaagacccttggcatg

SEQ ID NO: 440108 - DNA, 25 bp, Mus musculus
gagtttgggtcctccctgccaggtg

SEQ ID NO: 440109 - DNA, 25 bp, Mus musculus
gagtttgtcatttcagcattgtgag

SEQ ID NO: 440110 - DNA, 25 bp, Mus musculus
gagtttgtccctaattcattcttag

SEQ ID NO: 440111 - DNA, 25 bp, Mus musculus
gagtttgtgagacatcataaagaaa

SEQ ID NO: 440112 - DNA, 25 bp, Mus musculus
gagtttgtttctcaggacccctgac

SEQ ID NO: 440113 - DNA, 25 bp, Mus musculus
gagtttgtttcttctacagtgtagg

SEQ ID NO: 440114 - DNA, 25 bp, Mus musculus
gagttttaaacagctgtcaagtgga

SEQ ID NO: 440115 - DNA, 25 bp, Mus musculus
gagttttaaatcctgagatgcgcag

SEQ ID NO: 440116 - DNA, 25 bp, Mus musculus
gagttttaaggagagaaagccgtct

SEQ ID NO: 440117 - DNA, 25 bp, Mus musculus
gagttttactgtagccagtgccata

SEQ ID NO: 440118 - DNA, 25 bp, Mus musculus
gagttttactttgctgaggcccagg

SEQ ID NO: 440119 - DNA, 25 bp, Mus musculus
gagttttattagcacacctgctcga

SEQ ID NO: 440120 - DNA, 25 bp, Mus musculus
gagttttcaagaagtcccacccacg

SEQ ID NO: 440121 - DNA, 25 bp, Mus musculus
gagttttcaccagcgattacagcag

SEQ ID NO: 440122 - DNA, 25 bp, Mus musculus
gagttttcagatggcatttgtccaa

SEQ ID NO: 440123 - DNA, 25 bp, Mus musculus
gagttttccagcagactctccctga

SEQ ID NO: 440124 - DNA, 25 bp, Mus musculus
gagttttctctatggctcgtctgag

SEQ ID NO: 440125 - DNA, 25 bp, Mus musculus
gagttttgagacgtcccttcgtgga

SEQ ID NO: 440126 - DNA, 25 bp, Mus musculus
gagtttttcacagactccaactgag

SEQ ID NO: 440127 - DNA, 25 bp, Mus musculus
gagtttttcactgaggcaggggtca

SEQ ID NO: 440128 - DNA, 25 bp, Mus musculus
gagtttttctaatgacctcagagga

SEQ ID NO: 440129 - DNA, 25 bp, Mus musculus
gagtttttgcatggttgtaagcacc

SEQ ID NO: 440130 - DNA, 25 bp, Mus musculus
gagttttttgaaaccagcgccaagg

SEQ ID NO: 440131 - DNA, 25 bp, Mus musculus
gataaaaagccctgcaagaacttct

SEQ ID NO: 440132 - DNA, 25 bp, Mus musculus
gataaaaatatacctgaaagtaaga

SEQ ID NO: 440133 - DNA, 25 bp, Mus musculus
gataaaaatctgagggtctctccac

SEQ ID NO: 440134 - DNA, 25 bp, Mus musculus
gataaaacatgatactgccacttga

SEQ ID NO: 440135 - DNA, 25 bp, Mus musculus
gataaaacatggtggagacagcggc

SEQ ID NO: 440136 - DNA, 25 bp, Mus musculus
gataaaacgctattgcacgcgggca

SEQ ID NO: 440137 - DNA, 25 bp, Mus musculus
gataaaacggatcctcagagagcag

SEQ ID NO: 440138 - DNA, 25 bp, Mus musculus
gataaaagcaatggcaagtcctccc

SEQ ID NO: 440139 - DNA, 25 bp, Mus musculus
gataaaagctttcctaacgccacaa

SEQ ID NO: 440140 - DNA, 25 bp, Mus musculus
gataaaagggaagctctcaggagcc

SEQ ID NO: 440141 - DNA, 25 bp, Mus musculus
gataaaagtatgctgtgtcccactg

SEQ ID NO: 440142 - DNA, 25 bp, Mus musculus
gataaaagtgggtgtggcatctcac

SEQ ID NO: 440143 - DNA, 25 bp, Mus musculus
gataaaatagaagcctcagagccgt

SEQ ID NO: 440144 - DNA, 25 bp, Mus musculus
gataaaatccgtggaactgctggaa

SEQ ID NO: 440145 - DNA, 25 bp, Mus musculus
gataaaatgtcagccaggtagcctc

SEQ ID NO: 440146 - DNA, 25 bp, Mus musculus
gataaaattatctgttggaagcccc

SEQ ID NO: 440147 - DNA, 25 bp, Mus musculus
gataaaattgcatgtcctgggaaga

SEQ ID NO: 440148 - DNA, 25 bp, Mus musculus
gataaacaatagctaggacaccatt

SEQ ID NO: 440149 - DNA, 25 bp, Mus musculus
gataaacagtttcacatggtgcaga

SEQ ID NO: 440150 - DNA, 25 bp, Mus musculus
gataaaccacagttacaagggattc

SEQ ID NO: 440151 - DNA, 25 bp, Mus musculus
gataaacccatctgagaggccagcc

SEQ ID NO: 440152 - DNA, 25 bp, Mus musculus
gataaacctgtgtccccattgctga

SEQ ID NO: 440153 - DNA, 25 bp, Mus musculus
gataaacgggacaaagcagccctgg

SEQ ID NO: 440154 - DNA, 25 bp, Mus musculus
gataaacgtgttagagccagagagc

SEQ ID NO: 440155 - DNA, 25 bp, Mus musculus
gataaacgttggagcctggcattct

SEQ ID NO: 440156 - DNA, 25 bp, Mus musculus
gataaactcagggagatggcctcgt

SEQ ID NO: 440157 - DNA, 25 bp, Mus musculus
gataaactcggtggccacttgggcc

SEQ ID NO: 440158 - DNA, 25 bp, Mus musculus
gataaactgagctacccttgggatg

SEQ ID NO: 440159 - DNA, 25 bp, Mus musculus
gataaactggttagcatcactgcct

SEQ ID NO: 440160 - DNA, 25 bp, Mus musculus
gataaacttacagatagtagctgct

SEQ ID NO: 440161 - DNA, 25 bp, Mus musculus
gataaacttcctactgaaacaggca

SEQ ID NO: 440162 - DNA, 25 bp, Mus musculus
gataaacttgtaaggcagatccttg

SEQ ID NO: 440163 - DNA, 25 bp, Mus musculus
gataaacttgtcagtgagatgaccc

SEQ ID NO: 440164 - DNA, 25 bp, Mus musculus
gataaagaaggaaacccagctccgg

SEQ ID NO: 440165 - DNA, 25 bp, Mus musculus
gataaagaccttgcttagctagcag

SEQ ID NO: 440166 - DNA, 25 bp, Mus musculus
gataaagactcacattggcaccaag

SEQ ID NO: 440167 - DNA, 25 bp, Mus musculus
gataaagactcctgatactgccctt

SEQ ID NO: 440168 - DNA, 25 bp, Mus musculus
gataaagaggaaaccattgcagctt

SEQ ID NO: 440169 - DNA, 25 bp, Mus musculus
gataaagagggatccaaggcacctg

SEQ ID NO: 440170 - DNA, 25 bp, Mus musculus
gataaagagtgactacagcttctca

SEQ ID NO: 440171 - DNA, 25 bp, Mus musculus
gataaagatggtgacttcaaagcct

SEQ ID NO: 440172 - DNA, 25 bp, Mus musculus
gataaagcactttcagcccgaggtc

SEQ ID NO: 440173 - DNA, 25 bp, Mus musculus
gataaagcagcttacgtcgacgcag

SEQ ID NO: 440174 - DNA, 25 bp, Mus musculus
gataaagcatcgagtcttgtgcagc

SEQ ID NO: 440175 - DNA, 25 bp, Mus musculus
gataaagccaaacaacgcaacgtgg

SEQ ID NO: 440176 - DNA, 25 bp, Mus musculus
gataaagccttcaagcagcgagagc

SEQ ID NO: 440177 - DNA, 25 bp, Mus musculus
gataaaggagaaggaagctaaacac

SEQ ID NO: 440178 - DNA, 25 bp, Mus musculus
gataaaggctattccctggcactcc

SEQ ID NO: 440179 - DNA, 25 bp, Mus musculus
gataaaggcttcaaatcacccataa

SEQ ID NO: 440180 - DNA, 25 bp, Mus musculus
gataaagggcattcactgtgtaacc

SEQ ID NO: 440181 - DNA, 25 bp, Mus musculus
gataaagtctgtgtggcttgaccca

SEQ ID NO: 440182 - DNA, 25 bp, Mus musculus
gataaagtggagtgaagagagcccc

SEQ ID NO: 440183 - DNA, 25 bp, Mus musculus
gataaagttttgaggtaattacact

SEQ ID NO: 440184 - DNA, 25 bp, Mus musculus
gataaatccataggtgctgccagcc

SEQ ID NO: 440185 - DNA, 25 bp, Mus musculus
gataaatgactcgttggtgcctaac

SEQ ID NO: 440186 - DNA, 25 bp, Mus musculus
gataaatgagcccaacaagtgcgag

SEQ ID NO: 440187 - DNA, 25 bp, Mus musculus
gataaatgctcaagtccagatgtgg

SEQ ID NO: 440188 - DNA, 25 bp, Mus musculus
gataaatggcaaacctcgacctgct

SEQ ID NO: 440189 - DNA, 25 bp, Mus musculus
gataaatggctgttggctccaccaa

SEQ ID NO: 440190 - DNA, 25 bp, Mus musculus
gataaatggttcatgtcaggcccct

SEQ ID NO: 440191 - DNA, 25 bp, Mus musculus
gataaatggtttccctgagcgcatg

SEQ ID NO: 440192 - DNA, 25 bp, Mus musculus
gataaatgtatgataagctcctgga

SEQ ID NO: 440193 - DNA, 25 bp, Mus musculus
gataaattctgaagcttgcccaaga

SEQ ID NO: 440194 - DNA, 25 bp, Mus musculus
gataaattgcagaaccctgtctcaa

SEQ ID NO: 440195 - DNA, 25 bp, Mus musculus
gataacaccttgctttcaatgcagg

SEQ ID NO: 440196 - DNA, 25 bp, Mus musculus
gataacacttccttgctctgggccg

SEQ ID NO: 440197 - DNA, 25 bp, Mus musculus
gataacagaacagccgcctggagag

SEQ ID NO: 440198 - DNA, 25 bp, Mus musculus
gataacagacccatctcgggaggtg

SEQ ID NO: 440199 - DNA, 25 bp, Mus musculus
gataacagagctttgtagcattgac

SEQ ID NO: 440200 - DNA, 25 bp, Mus musculus
gataacagagtttcctaactcttct

SEQ ID NO: 440201 - DNA, 25 bp, Mus musculus
gataacagccaggagaacaaacgct

SEQ ID NO: 440202 - DNA, 25 bp, Mus musculus
gataacagctagtgcaaggcttctg

SEQ ID NO: 440203 - DNA, 25 bp, Mus musculus
gataacaggttctccgtctcgagca

SEQ ID NO: 440204 - DNA, 25 bp, Mus musculus
gataacatgggctttgcctgcgctc

SEQ ID NO: 440205 - DNA, 25 bp, Mus musculus
gataaccatgaaagggatgggtcaa

SEQ ID NO: 440206 - DNA, 25 bp, Mus musculus
gataaccccaagtccctgaagtctg

SEQ ID NO: 440207 - DNA, 25 bp, Mus musculus
gataacccgccaatgttcagccagg

SEQ ID NO: 440208 - DNA, 25 bp, Mus musculus
gataaccctgactgggtaacagcct

SEQ ID NO: 440209 - DNA, 25 bp, Mus musculus
gataaccgagaatttgacttccctt

SEQ ID NO: 440210 - DNA, 25 bp, Mus musculus
gataaccgcaccttcttgacactgg

SEQ ID NO: 440211 - DNA, 25 bp, Mus musculus
gataaccggataactgcgcaggcag

SEQ ID NO: 440212 - DNA, 25 bp, Mus musculus
gataacctacttaaggcggcagcca

SEQ ID NO: 440213 - DNA, 25 bp, Mus musculus
gataacctctatgagagggcgctcc

SEQ ID NO: 440214 - DNA, 25 bp, Mus musculus
gataacctgcgaatgactgcctttc

SEQ ID NO: 440215 - DNA, 25 bp, Mus musculus
gataacctgctggaggtgtctgccc

SEQ ID NO: 440216 - DNA, 25 bp, Mus musculus
gataacctggctgaggtaccatgtg

SEQ ID NO: 440217 - DNA, 25 bp, Mus musculus
gataacgacaattaccaaggaaact

SEQ ID NO: 440218 - DNA, 25 bp, Mus musculus
gataacgatccttttgactggacag

SEQ ID NO: 440219 - DNA, 25 bp, Mus musculus
gataacgcgggatattctgcacggg

SEQ ID NO: 440220 - DNA, 25 bp, Mus musculus
gataacgtggtacttcagggtagcc

SEQ ID NO: 440221 - DNA, 25 bp, Mus musculus
gataacgttgaatccattgatgccc

SEQ ID NO: 440222 - DNA, 25 bp, Mus musculus
gataactacatctcggcactcagcg

SEQ ID NO: 440223 - DNA, 25 bp, Mus musculus
gataactcaactgtgctggtgctgg

SEQ ID NO: 440224 - DNA, 25 bp, Mus musculus
gataactcagctattgacacggcta

SEQ ID NO: 440225 - DNA, 25 bp, Mus musculus
gataactcgctgctcagagactcag

SEQ ID NO: 440226 - DNA, 25 bp, Mus musculus
gataactgagagacagggcacactg

SEQ ID NO: 440227 - DNA, 25 bp, Mus musculus
gataactggattctctccatggaac

SEQ ID NO: 440228 - DNA, 25 bp, Mus musculus
gataactggcagtacctgaggcctt

SEQ ID NO: 440229 - DNA, 25 bp, Mus musculus
gataactttaacagagttgtcaggt

SEQ ID NO: 440230 - DNA, 25 bp, Mus musculus
gataactttgaacttcagactcgac

SEQ ID NO: 440231 - DNA, 25 bp, Mus musculus
gataagaaaccagctcacggccatg

SEQ ID NO: 440232 - DNA, 25 bp, Mus musculus
gataagaacatgcttgccctccgtg

SEQ ID NO: 440233 - DNA, 25 bp, Mus musculus
gataagaagtctgccaccaagttgg

SEQ ID NO: 440234 - DNA, 25 bp, Mus musculus
gataagaccgttattatgcaaatgt

SEQ ID NO: 440235 - DNA, 25 bp, Mus musculus
gataagagaagtagtgaagaccaca

SEQ ID NO: 440236 - DNA, 25 bp, Mus musculus
gataagagggcagaagtgagcttca

SEQ ID NO: 440237 - DNA, 25 bp, Mus musculus
gataagagtaatagcccagcccact

SEQ ID NO: 440238 - DNA, 25 bp, Mus musculus
gataagagtctgacaccaggccttg

SEQ ID NO: 440239 - DNA, 25 bp, Mus musculus
gataagagttccatggtcccaaggt

SEQ ID NO: 440240 - DNA, 25 bp, Mus musculus
gataagattaatgcggacccggtgc

SEQ ID NO: 440241 - DNA, 25 bp, Mus musculus
gataagatttccactgtgagtcacc

SEQ ID NO: 440242 - DNA, 25 bp, Mus musculus
gataagcaatgccactgaccgaaag

SEQ ID NO: 440243 - DNA, 25 bp, Mus musculus
gataagcacttttgcagagcgcggt

SEQ ID NO: 440244 - DNA, 25 bp, Mus musculus
gataagcagatttccctagaggcac

SEQ ID NO: 440245 - DNA, 25 bp, Mus musculus
gataagcatcccatcctgaacggtg

SEQ ID NO: 440246 - DNA, 25 bp, Mus musculus
gataagccgagctatggacccatgg

SEQ ID NO: 440247 - DNA, 25 bp, Mus musculus
gataagcctgagaagaggatcccct

SEQ ID NO: 440248 - DNA, 25 bp, Mus musculus
gataagcctgcaaagtctggccctg

SEQ ID NO: 440249 - DNA, 25 bp, Mus musculus
gataagcgaatatgaatagggaaag

SEQ ID NO: 440250 - DNA, 25 bp, Mus musculus
gataagcgcacaaacagcactgttg

SEQ ID NO: 440251 - DNA, 25 bp, Mus musculus
gataagctccagcaatgaaaacaca

SEQ ID NO: 440252 - DNA, 25 bp, Mus musculus
gataagcttgaggaatttacggcgt

SEQ ID NO: 440253 - DNA, 25 bp, Mus musculus
gataagctttacgagcgacgcggcg

SEQ ID NO: 440254 - DNA, 25 bp, Mus musculus
gataaggcaaagtctccaggcgtgg

SEQ ID NO: 440255 - DNA, 25 bp, Mus musculus
gataaggcagtggagaccaacagga

SEQ ID NO: 440256 - DNA, 25 bp, Mus musculus
gataaggcattcgaaggaaccaact

SEQ ID NO: 440257 - DNA, 25 bp, Mus musculus
gataaggctcataaggctgcgacca

SEQ ID NO: 440258 - DNA, 25 bp, Mus musculus
gataaggctgacaacaaagatgctg

SEQ ID NO: 440259 - DNA, 25 bp, Mus musculus
gataagggatcccatcagagccact

SEQ ID NO: 440260 - DNA, 25 bp, Mus musculus
gataaggtccttgaacggctgatgt

SEQ ID NO: 440261 - DNA, 25 bp, Mus musculus
gataaggttatctgtcccagtagcc

SEQ ID NO: 440262 - DNA, 25 bp, Mus musculus
gataagtacaagacccttcggcaga

SEQ ID NO: 440263 - DNA, 25 bp, Mus musculus
gataagtcactaaacgtgcgcgcca

SEQ ID NO: 440264 - DNA, 25 bp, Mus musculus
gataagtgttctcccttcacatagg

SEQ ID NO: 440265 - DNA, 25 bp, Mus musculus
gataagttcactgaagcagcctaag

SEQ ID NO: 440266 - DNA, 25 bp, Mus musculus
gataagttcatcctgaaggtcctgg

SEQ ID NO: 440267 - DNA, 25 bp, Mus musculus
gataagttggcctggagactgcccc

SEQ ID NO: 440268 - DNA, 25 bp, Mus musculus
gataagttttaggtgcaggacccca

SEQ ID NO: 440269 - DNA, 25 bp, Mus musculus
gataataaacactgccaaagagagg

SEQ ID NO: 440270 - DNA, 25 bp, Mus musculus
gataataaccgaagcactagtgtgg

SEQ ID NO: 440271 - DNA, 25 bp, Mus musculus
gataatacactcgtctctccagaac

SEQ ID NO: 440272 - DNA, 25 bp, Mus musculus
gataatagctctgcacaagtctcgg

SEQ ID NO: 440273 - DNA, 25 bp, Mus musculus
gataatagctgtcctccggttggtg

SEQ ID NO: 440274 - DNA, 25 bp, Mus musculus
gataatagggctctgagaacagaaa

SEQ ID NO: 440275 - DNA, 25 bp, Mus musculus
gataatatccgctgcaatgggctca

SEQ ID NO: 440276 - DNA, 25 bp, Mus musculus
gataatcagacatgcggagaaggct

SEQ ID NO: 440277 - DNA, 25 bp, Mus musculus
gataatcatcatgggcccagccttg

SEQ ID NO: 440278 - DNA, 25 bp, Mus musculus
gataatcatcttaatgccatagcaa

SEQ ID NO: 440279 - DNA, 25 bp, Mus musculus
gataatccaggcacatggtggcact

SEQ ID NO: 440280 - DNA, 25 bp, Mus musculus
gataatcctggaatatgcaaattga

SEQ ID NO: 440281 - DNA, 25 bp, Mus musculus
gataatcgccagtttggccgccggc

SEQ ID NO: 440282 - DNA, 25 bp, Mus musculus
gataatctagggaaacctgcccgcc

SEQ ID NO: 440283 - DNA, 25 bp, Mus musculus
gataatgacacacgtccatggtgct

SEQ ID NO: 440284 - DNA, 25 bp, Mus musculus
gataatgaccatgctgttggccaaa

SEQ ID NO: 440285 - DNA, 25 bp, Mus musculus
gataatgacccagttcgcacccata

SEQ ID NO: 440286 - DNA, 25 bp, Mus musculus
gataatgaccgacagttcaggcgca

SEQ ID NO: 440287 - DNA, 25 bp, Mus musculus
gataatgaccggcaactctccaaag

SEQ ID NO: 440288 - DNA, 25 bp, Mus musculus
gataatgacctaaagtctcgggcgt

SEQ ID NO: 440289 - DNA, 25 bp, Mus musculus
gataatgacttcatcaatgagggcc

SEQ ID NO: 440290 - DNA, 25 bp, Mus musculus
gataatgagaaggaccgtgacagcc

SEQ ID NO: 440291 - DNA, 25 bp, Mus musculus
gataatgagcttcctaactggtgtg

SEQ ID NO: 440292 - DNA, 25 bp, Mus musculus
gataatggcgactctcacctggact

SEQ ID NO: 440293 - DNA, 25 bp, Mus musculus
gataatgggtatttccaggctttga

SEQ ID NO: 440294 - DNA, 25 bp, Mus musculus
gataatgttgaaaggagtccagaga

SEQ ID NO: 440295 - DNA, 25 bp, Mus musculus
gataattagctctcaacatggaaaa

SEQ ID NO: 440296 - DNA, 25 bp, Mus musculus
gataattaggacattcttctgctgt

SEQ ID NO: 440297 - DNA, 25 bp, Mus musculus
gataattcagcatgcgtggacccct

SEQ ID NO: 440298 - DNA, 25 bp, Mus musculus
gataattcaggctccccaatcagag

SEQ ID NO: 440299 - DNA, 25 bp, Mus musculus
gataattgacgatcctctggcccca

SEQ ID NO: 440300 - DNA, 25 bp, Mus musculus
gataattgggaagagcctgtcagct

SEQ ID NO: 440301 - DNA, 25 bp, Mus musculus
gataattgtgcttcctcagcgcccg

SEQ ID NO: 440302 - DNA, 25 bp, Mus musculus
gataatttatgcgtgcacaagtgct

SEQ ID NO: 440303 - DNA, 25 bp, Mus musculus
gatacaaattctggcctggtgggcc

SEQ ID NO: 440304 - DNA, 25 bp, Mus musculus
gatacaaattgatgatggcaccgga

SEQ ID NO: 440305 - DNA, 25 bp, Mus musculus
gatacaaggagagcatcctggccca

SEQ ID NO: 440306 - DNA, 25 bp, Mus musculus
gatacaaggaggaccagcagggatt

SEQ ID NO: 440307 - DNA, 25 bp, Mus musculus
gatacaagtctcctctttgggtgcg

SEQ ID NO: 440308 - DNA, 25 bp, Mus musculus
gatacaagttacacagccagcgaag

SEQ ID NO: 440309 - DNA, 25 bp, Mus musculus
gatacaatgtccgagtgcagctgag

SEQ ID NO: 440310 - DNA, 25 bp, Mus musculus
gatacaattcattgaaccatccaaa

SEQ ID NO: 440311 - DNA, 25 bp, Mus musculus
gatacacacagaagggaactcgggc

SEQ ID NO: 440312 - DNA, 25 bp, Mus musculus
gatacacagagccagaagcaattct

SEQ ID NO: 440313 - DNA, 25 bp, Mus musculus
gatacacagaggcatgagacctacc

SEQ ID NO: 440314 - DNA, 25 bp, Mus musculus
gatacacagaggcttgagacccagg

SEQ ID NO: 440315 - DNA, 25 bp, Mus musculus
gatacacagatcttcgaggacccac

SEQ ID NO: 440316 - DNA, 25 bp, Mus musculus
gatacacagctgatatgtcctgaga

SEQ ID NO: 440317 - DNA, 25 bp, Mus musculus
gatacacagtatagcatgtgccgag

SEQ ID NO: 440318 - DNA, 25 bp, Mus musculus
gatacacagttctgcgagaaagcca

SEQ ID NO: 440319 - DNA, 25 bp, Mus musculus
gatacacagttgagttaaaggccag

SEQ ID NO: 440320 - DNA, 25 bp, Mus musculus
gatacacatgtactgccgggtctga

SEQ ID NO: 440321 - DNA, 25 bp, Mus musculus
gatacaccagcagttggcccagatg

SEQ ID NO: 440322 - DNA, 25 bp, Mus musculus
gatacaccccagtttgcctagcatg

SEQ ID NO: 440323 - DNA, 25 bp, Mus musculus
gatacacccgtgtgaaaggcctaag

SEQ ID NO: 440324 - DNA, 25 bp, Mus musculus
gatacaccgagaaacctcgtttcga

SEQ ID NO: 440325 - DNA, 25 bp, Mus musculus
gatacacgagattatgcaccaccac

SEQ ID NO: 440326 - DNA, 25 bp, Mus musculus
gatacacggcactgagatagacatg

SEQ ID NO: 440327 - DNA, 25 bp, Mus musculus
gatacacgtgtgtcttcccaaagct

SEQ ID NO: 440328 - DNA, 25 bp, Mus musculus
gatacactgaagctttgtccacgtg

SEQ ID NO: 440329 - DNA, 25 bp, Mus musculus
gatacactgtggaactattcgagca

SEQ ID NO: 440330 - DNA, 25 bp, Mus musculus
gatacagagaaagaggacagatccc

SEQ ID NO: 440331 - DNA, 25 bp, Mus musculus
gatacagagacgatgtaagcttgtc

SEQ ID NO: 440332 - DNA, 25 bp, Mus musculus
gatacagagcggagccatcatctgc

SEQ ID NO: 440333 - DNA, 25 bp, Mus musculus
gatacagcacatccttggcagagac

SEQ ID NO: 440334 - DNA, 25 bp, Mus musculus
gatacagcaccagatgtaggacact

SEQ ID NO: 440335 - DNA, 25 bp, Mus musculus
gatacagccgatctactggcagccc

SEQ ID NO: 440336 - DNA, 25 bp, Mus musculus
gatacagctgtgagagtcggatccg

SEQ ID NO: 440337 - DNA, 25 bp, Mus musculus
gatacaggaccttggagaaattagg

SEQ ID NO: 440338 - DNA, 25 bp, Mus musculus
gatacaggagggagttaacaacagc

SEQ ID NO: 440339 - DNA, 25 bp, Mus musculus
gatacagggtgttttcccaagggcg

SEQ ID NO: 440340 - DNA, 25 bp, Mus musculus
gatacagtacgttcttccctgggta

SEQ ID NO: 440341 - DNA, 25 bp, Mus musculus
gatacagttccggaaagcacagcca

SEQ ID NO: 440342 - DNA, 25 bp, Mus musculus
gatacatacgttcaattcccactga

SEQ ID NO: 440343 - DNA, 25 bp, Mus musculus
gatacatatatccttctagaattaa

SEQ ID NO: 440344 - DNA, 25 bp, Mus musculus
gatacatccacaaatccagcaggca

SEQ ID NO: 440345 - DNA, 25 bp, Mus musculus
gatacatctacggtggctgacccat

SEQ ID NO: 440346 - DNA, 25 bp, Mus musculus
gatacatgatccagagcggaaccct

SEQ ID NO: 440347 - DNA, 25 bp, Mus musculus
gatacatgatcttaacaaagtggct

SEQ ID NO: 440348 - DNA, 25 bp, Mus musculus
gatacatggagcacctgtgggcaag

SEQ ID NO: 440349 - DNA, 25 bp, Mus musculus
gatacatgggatgctcgaaacacca

SEQ ID NO: 440350 - DNA, 25 bp, Mus musculus
gatacatgtcactccgacctcagag

SEQ ID NO: 440351 - DNA, 25 bp, Mus musculus
gatacattaaggtgcaagctctctg

SEQ ID NO: 440352 - DNA, 25 bp, Mus musculus
gatacattttttgaccctcggtggc

SEQ ID NO: 440353 - DNA, 25 bp, Mus musculus
gataccaaccctttcagcctaaaag

SEQ ID NO: 440354 - DNA, 25 bp, Mus musculus
gataccaacgtgtgtgagcccaaag

SEQ ID NO: 440355 - DNA, 25 bp, Mus musculus
gataccaagagcttagtcccaccag

SEQ ID NO: 440356 - DNA, 25 bp, Mus musculus
gataccactaaaaccccttctgcag

SEQ ID NO: 440357 - DNA, 25 bp, Mus musculus
gataccactgttcccggaccggaat

SEQ ID NO: 440358 - DNA, 25 bp, Mus musculus
gataccagccctcaaccgagtcaca

SEQ ID NO: 440359 - DNA, 25 bp, Mus musculus
gataccagctcccaaaatcctgtgg

SEQ ID NO: 440360 - DNA, 25 bp, Mus musculus
gataccagctgatgcgtgttctgag

SEQ ID NO: 440361 - DNA, 25 bp, Mus musculus
gataccagggctttgccagtcagga

SEQ ID NO: 440362 - DNA, 25 bp, Mus musculus
gataccatcactgaagcttcgggcg

SEQ ID NO: 440363 - DNA, 25 bp, Mus musculus
gataccatcccatcactagtcaggg

SEQ ID NO: 440364 - DNA, 25 bp, Mus musculus
gataccatggaagagcacacgtttg

SEQ ID NO: 440365 - DNA, 25 bp, Mus musculus
gatacccatctactgatagtgccga

SEQ ID NO: 440366 - DNA, 25 bp, Mus musculus
gatacccggacatacatgacctgga

SEQ ID NO: 440367 - DNA, 25 bp, Mus musculus
gataccctccacacaagcttctgat

SEQ ID NO: 440368 - DNA, 25 bp, Mus musculus
gataccctgtgctggaacggacaag

SEQ ID NO: 440369 - DNA, 25 bp, Mus musculus
gatacccttgggaacagtcggccag

SEQ ID NO: 440370 - DNA, 25 bp, Mus musculus
gataccgcaggatgccactgtgcag

SEQ ID NO: 440371 - DNA, 25 bp, Mus musculus
gataccgctctgtgctggctgtgaa

SEQ ID NO: 440372 - DNA, 25 bp, Mus musculus
gataccgttggaaaagccgcttcat

SEQ ID NO: 440373 - DNA, 25 bp, Mus musculus
gataccgtttgtgccagcgtgcgga

SEQ ID NO: 440374 - DNA, 25 bp, Mus musculus
gatacctaccaagtgcagcagtgca

SEQ ID NO: 440375 - DNA, 25 bp, Mus musculus
gatacctacctcactcagagccagg

SEQ ID NO: 440376 - DNA, 25 bp, Mus musculus
gatacctacttgctgctgctctggg

SEQ ID NO: 440377 - DNA, 25 bp, Mus musculus
gatacctagtactttgtctaaaggg

SEQ ID NO: 440378 - DNA, 25 bp, Mus musculus
gatacctcatgggtccaagctgaag

SEQ ID NO: 440379 - DNA, 25 bp, Mus musculus
gatacctccagacggactcactgtg

SEQ ID NO: 440380 - DNA, 25 bp, Mus musculus
gatacctcggtgtagcagaccacaa

SEQ ID NO: 440381 - DNA, 25 bp, Mus musculus
gatacctctggaacactggctactt

SEQ ID NO: 440382 - DNA, 25 bp, Mus musculus
gatacctgatatgtgactcctctga

SEQ ID NO: 440383 - DNA, 25 bp, Mus musculus
gatacctgcagggtccagaactctg

SEQ ID NO: 440384 - DNA, 25 bp, Mus musculus
gatacctgtctgtagtgagccccat

SEQ ID NO: 440385 - DNA, 25 bp, Mus musculus
gataccttcaagagaggcgctggga

SEQ ID NO: 440386 - DNA, 25 bp, Mus musculus
gataccttcattaacctccgcgagg

SEQ ID NO: 440387 - DNA, 25 bp, Mus musculus
gatacctttgagatggacagcttgt

SEQ ID NO: 440388 - DNA, 25 bp, Mus musculus
gatacctttttctgcttcaccaacc

SEQ ID NO: 440389 - DNA, 25 bp, Mus musculus
gataccttttttgggcagcgcaacg

SEQ ID NO: 440390 - DNA, 25 bp, Mus musculus
gatacgaaatgtcgtggccaaccgc

SEQ ID NO: 440391 - DNA, 25 bp, Mus musculus
gatacgacctggcatgaccctgttg

SEQ ID NO: 440392 - DNA, 25 bp, Mus musculus
gatacggccaaggaagggaactctg

SEQ ID NO: 440393 - DNA, 25 bp, Mus musculus
gatacggctcatctgggcactgtga

SEQ ID NO: 440394 - DNA, 25 bp, Mus musculus
gatacgggaatgatgagagcctcca

SEQ ID NO: 440395 - DNA, 25 bp, Mus musculus
gatacgggaggcactgtccatgttg

SEQ ID NO: 440396 - DNA, 25 bp, Mus musculus
gatacgggcagtgattgtacacgcc

SEQ ID NO: 440397 - DNA, 25 bp, Mus musculus
gatacgtcagtaaacttcgaagcaa

SEQ ID NO: 440398 - DNA, 25 bp, Mus musculus
gatacgtgctgttctcagcgctggg

SEQ ID NO: 440399 - DNA, 25 bp, Mus musculus
gatacgttaccaagtgctgtgctgc

SEQ ID NO: 440400 - DNA, 25 bp, Mus musculus
gatacgttgaaggtttgacctccca

SEQ ID NO: 440401 - DNA, 25 bp, Mus musculus
gatactaagatgacctcccctgtca

SEQ ID NO: 440402 - DNA, 25 bp, Mus musculus
gatactaatgtccagagggtccgcc

SEQ ID NO: 440403 - DNA, 25 bp, Mus musculus
gatactacagcttctacaccaatgg

SEQ ID NO: 440404 - DNA, 25 bp, Mus musculus
gatactacagtgagcgcgatgcggc

SEQ ID NO: 440405 - DNA, 25 bp, Mus musculus
gatactacggagattaatggaacaa

SEQ ID NO: 440406 - DNA, 25 bp, Mus musculus
gatactagacacctacattttaccg

SEQ ID NO: 440407 - DNA, 25 bp, Mus musculus
gatactagagagagatccacatgag

SEQ ID NO: 440408 - DNA, 25 bp, Mus musculus
gatactagcagattaaccaccatag

SEQ ID NO: 440409 - DNA, 25 bp, Mus musculus
gatactagcctctgttcctgaaggc

SEQ ID NO: 440410 - DNA, 25 bp, Mus musculus
gatactaggctgcaaggctctttcc

SEQ ID NO: 440411 - DNA, 25 bp, Mus musculus
gatactatacggcaacggtcctggt

SEQ ID NO: 440412 - DNA, 25 bp, Mus musculus
gatactatggccagggattcccctc

SEQ ID NO: 440413 - DNA, 25 bp, Mus musculus
gatactatgggcacctaccatggca

SEQ ID NO: 440414 - DNA, 25 bp, Mus musculus
gatactcagtagaatgcaggcttgg

SEQ ID NO: 440415 - DNA, 25 bp, Mus musculus
gatactccacgttcttccactgtgt

SEQ ID NO: 440416 - DNA, 25 bp, Mus musculus
gatactccagggtaactgtccagcc

SEQ ID NO: 440417 - DNA, 25 bp, Mus musculus
gatactccctcacccattgggaagg

SEQ ID NO: 440418 - DNA, 25 bp, Mus musculus
gatactccggctaccaacgtttgga

SEQ ID NO: 440419 - DNA, 25 bp, Mus musculus
gatactccgggaccgcaaagagcaa

SEQ ID NO: 440420 - DNA, 25 bp, Mus musculus
gatactccgttctgggctgggatca

SEQ ID NO: 440421 - DNA, 25 bp, Mus musculus
gatactcgcattcgttcttcatatg

SEQ ID NO: 440422 - DNA, 25 bp, Mus musculus
gatactcggctgtgttctggaagaa

SEQ ID NO: 440423 - DNA, 25 bp, Mus musculus
gatactctgctaggcaccttagtaa

SEQ ID NO: 440424 - DNA, 25 bp, Mus musculus
gatactctggactctaaaaggcaca

SEQ ID NO: 440425 - DNA, 25 bp, Mus musculus
gatactctgggcagatgcacagggc

SEQ ID NO: 440426 - DNA, 25 bp, Mus musculus
gatactctggtatgtgaagatgaag

SEQ ID NO: 440427 - DNA, 25 bp, Mus musculus
gatactctgtttgccaacgggtccg

SEQ ID NO: 440428 - DNA, 25 bp, Mus musculus
gatactgaagcgttctccgaagaag

SEQ ID NO: 440429 - DNA, 25 bp, Mus musculus
gatactgacacggatcctgccaact

SEQ ID NO: 440430 - DNA, 25 bp, Mus musculus
gatactgacactggtactggcccca

SEQ ID NO: 440431 - DNA, 25 bp, Mus musculus
gatactgagtcaaagagtttaatct

SEQ ID NO: 440432 - DNA, 25 bp, Mus musculus
gatactgcagttcccattggtgctg

SEQ ID NO: 440433 - DNA, 25 bp, Mus musculus
gatactgccctttcaggcaaccata

SEQ ID NO: 440434 - DNA, 25 bp, Mus musculus
gatactgctgtgactagtgaggcct

SEQ ID NO: 440435 - DNA, 25 bp, Mus musculus
gatactggaagtctcgagcgtctcc

SEQ ID NO: 440436 - DNA, 25 bp, Mus musculus
gatactggacaacgatggcctctac

SEQ ID NO: 440437 - DNA, 25 bp, Mus musculus
gatactggacctgcagcctgaatgg

SEQ ID NO: 440438 - DNA, 25 bp, Mus musculus
gatactggagctttcgcctgcctca

SEQ ID NO: 440439 - DNA, 25 bp, Mus musculus
gatactggcaaggtctaagctccga

SEQ ID NO: 440440 - DNA, 25 bp, Mus musculus
gatactggcagttcaaagcgaaacc

SEQ ID NO: 440441 - DNA, 25 bp, Mus musculus
gatactggccctactgaaagtcctg

SEQ ID NO: 440442 - DNA, 25 bp, Mus musculus
gatactggctgagtttgcaatagca

SEQ ID NO: 440443 - DNA, 25 bp, Mus musculus
gatactgggaatgcgcacactgtga

SEQ ID NO: 440444 - DNA, 25 bp, Mus musculus
gatactgggcacaatccatctggtg

SEQ ID NO: 440445 - DNA, 25 bp, Mus musculus
gatactggtgctggcagagacccaa

SEQ ID NO: 440446 - DNA, 25 bp, Mus musculus
gatactgtaaatatggcagccttgg

SEQ ID NO: 440447 - DNA, 25 bp, Mus musculus
gatactgtaaggatcgaggtgcgct

SEQ ID NO: 440448 - DNA, 25 bp, Mus musculus
gatactgtaatagcaccatgaaccc

SEQ ID NO: 440449 - DNA, 25 bp, Mus musculus
gatactgtagagttgcgagagcacc

SEQ ID NO: 440450 - DNA, 25 bp, Mus musculus
gatactgtcaagagctaaaacccgt

SEQ ID NO: 440451 - DNA, 25 bp, Mus musculus
gatactgtggttgggtgccttagca

SEQ ID NO: 440452 - DNA, 25 bp, Mus musculus
gatacttattcttgccctcctagaa

SEQ ID NO: 440453 - DNA, 25 bp, Mus musculus
gatacttcgcaacccagcctgactt

SEQ ID NO: 440454 - DNA, 25 bp, Mus musculus
gatacttctagtcaaggcagggcct

SEQ ID NO: 440455 - DNA, 25 bp, Mus musculus
gatacttcttgtacagttaggtctg

SEQ ID NO: 440456 - DNA, 25 bp, Mus musculus
gatacttcttgtgtcaggtccttag

SEQ ID NO: 440457 - DNA, 25 bp, Mus musculus
gatacttggaccaaagaccttgaag

SEQ ID NO: 440458 - DNA, 25 bp, Mus musculus
gatacttggcccctggatttcgaca

SEQ ID NO: 440459 - DNA, 25 bp, Mus musculus
gatacttggctctgggttcgcgctg

SEQ ID NO: 440460 - DNA, 25 bp, Mus musculus
gatacttgggaccaaatgcccatct

SEQ ID NO: 440461 - DNA, 25 bp, Mus musculus
gatacttgtttctcacagaacagag

SEQ ID NO: 440462 - DNA, 25 bp, Mus musculus
gatactttctctcaggtccatgagg

SEQ ID NO: 440463 - DNA, 25 bp, Mus musculus
gatagaaactaagggctagcaagca

SEQ ID NO: 440464 - DNA, 25 bp, Mus musculus
gatagaaagccggttcatcgtgctt

SEQ ID NO: 440465 - DNA, 25 bp, Mus musculus
gatagaaaggctacgacggctcaga

SEQ ID NO: 440466 - DNA, 25 bp, Mus musculus
gatagaaattgattgctgccagcat

SEQ ID NO: 440467 - DNA, 25 bp, Mus musculus
gatagaactcagaacagcttgccca

SEQ ID NO: 440468 - DNA, 25 bp, Mus musculus
gatagaactgtctcgagcctagcca

SEQ ID NO: 440469 - DNA, 25 bp, Mus musculus
gatagaacttgaccgctacctggac

SEQ ID NO: 440470 - DNA, 25 bp, Mus musculus
gatagaagcctctcgaaatgaactg

SEQ ID NO: 440471 - DNA, 25 bp, Mus musculus
gatagaattctaggtcttgggagga

SEQ ID NO: 440472 - DNA, 25 bp, Mus musculus
gatagacaaatgactgacagcccaa

SEQ ID NO: 440473 - DNA, 25 bp, Mus musculus
gatagacaatggtctgctccctcca

SEQ ID NO: 440474 - DNA, 25 bp, Mus musculus
gatagacagagagacgaagcccttc

SEQ ID NO: 440475 - DNA, 25 bp, Mus musculus
gatagacagatcaaatggtggccca

SEQ ID NO: 440476 - DNA, 25 bp, Mus musculus
gatagaccgcctgtggcatacaagt

SEQ ID NO: 440477 - DNA, 25 bp, Mus musculus
gatagacgctctccagaaagcaccc

SEQ ID NO: 440478 - DNA, 25 bp, Mus musculus
gatagactaaatcggcggctgtccc

SEQ ID NO: 440479 - DNA, 25 bp, Mus musculus
gatagactattgtccaactgcagtt

SEQ ID NO: 440480 - DNA, 25 bp, Mus musculus
gatagactcaatgccctgtgcctgg

SEQ ID NO: 440481 - DNA, 25 bp, Mus musculus
gatagactgagacctgtggccctca

SEQ ID NO: 440482 - DNA, 25 bp, Mus musculus
gatagactttcatagttccacagag

SEQ ID NO: 440483 - DNA, 25 bp, Mus musculus
gatagactttcctaaagcagccgtg

SEQ ID NO: 440484 - DNA, 25 bp, Mus musculus
gatagagaagtccatatgacggctc

SEQ ID NO: 440485 - DNA, 25 bp, Mus musculus
gatagagaccatcaaccagctgaag

SEQ ID NO: 440486 - DNA, 25 bp, Mus musculus
gatagagactcttcgactggcaagg

SEQ ID NO: 440487 - DNA, 25 bp, Mus musculus
gatagagatacccacgcgcaggtgt

SEQ ID NO: 440488 - DNA, 25 bp, Mus musculus
gatagagatccttcatggcagtgaa

SEQ ID NO: 440489 - DNA, 25 bp, Mus musculus
gatagagcactggtttccctgtcgc

SEQ ID NO: 440490 - DNA, 25 bp, Mus musculus
gatagagccgctgtggcttccgagc

SEQ ID NO: 440491 - DNA, 25 bp, Mus musculus
gatagagccttagaccgagagctga

SEQ ID NO: 440492 - DNA, 25 bp, Mus musculus
gatagagccttctcagatcccgaag

SEQ ID NO: 440493 - DNA, 25 bp, Mus musculus
gatagagctgcttcctcattccaaa

SEQ ID NO: 440494 - DNA, 25 bp, Mus musculus
gatagaggactatctggcctgccag

SEQ ID NO: 440495 - DNA, 25 bp, Mus musculus
gatagagggttcacgcctagcagag

SEQ ID NO: 440496 - DNA, 25 bp, Mus musculus
gatagagggtttcttgattctgacc

SEQ ID NO: 440497 - DNA, 25 bp, Mus musculus
gatagaggtctaaggattggaagac

SEQ ID NO: 440498 - DNA, 25 bp, Mus musculus
gatagagtcctgcaacatcaccgtg

SEQ ID NO: 440499 - DNA, 25 bp, Mus musculus
gatagagtgcatcaaccccaagaag

SEQ ID NO: 440500 - DNA, 25 bp, Mus musculus
gatagagtgcatcacccagggaaga

SEQ ID NO: 440501 - DNA, 25 bp, Mus musculus
gatagagtgtccagtcagagtgcca

SEQ ID NO: 440502 - DNA, 25 bp, Mus musculus
gatagatacagacgtgagtggcccc

SEQ ID NO: 440503 - DNA, 25 bp, Mus musculus
gatagatacctagctgttgtccatg

SEQ ID NO: 440504 - DNA, 25 bp, Mus musculus
gatagatagatccaggtctcccagc

SEQ ID NO: 440505 - DNA, 25 bp, Mus musculus
gatagatcgtgtgctccggcagaca

SEQ ID NO: 440506 - DNA, 25 bp, Mus musculus
gatagatgcctgcaaacttcctgcc

SEQ ID NO: 440507 - DNA, 25 bp, Mus musculus
gatagatgctaaatgcccaggccca

SEQ ID NO: 440508 - DNA, 25 bp, Mus musculus
gatagatgctgacccgtaccttaag

SEQ ID NO: 440509 - DNA, 25 bp, Mus musculus
gatagattccttacccagtgaagag

SEQ ID NO: 440510 - DNA, 25 bp, Mus musculus
gatagattgatcagaaattgcccct

SEQ ID NO: 440511 - DNA, 25 bp, Mus musculus
gatagatttgtacgacgagccagag

SEQ ID NO: 440512 - DNA, 25 bp, Mus musculus
gatagcaaaagtggctacagcccag

SEQ ID NO: 440513 - DNA, 25 bp, Mus musculus
gatagcaaggtgaccgagattccgc

SEQ ID NO: 440514 - DNA, 25 bp, Mus musculus
gatagcaagttctcgggtgagctca

SEQ ID NO: 440515 - DNA, 25 bp, Mus musculus
gatagcaatgggtcctcctctgaag

SEQ ID NO: 440516 - DNA, 25 bp, Mus musculus
gatagcaccagtcaaagagtttggc

SEQ ID NO: 440517 - DNA, 25 bp, Mus musculus
gatagcagttctgatcgtcattgtg

SEQ ID NO: 440518 - DNA, 25 bp, Mus musculus
gatagcataagacccaaacccataa

SEQ ID NO: 440519 - DNA, 25 bp, Mus musculus
gatagcatatttttccccttggagg

SEQ ID NO: 440520 - DNA, 25 bp, Mus musculus
gatagccaagcagttgggcgcagaa

SEQ ID NO: 440521 - DNA, 25 bp, Mus musculus
gatagccagagttgagccctgactg

SEQ ID NO: 440522 - DNA, 25 bp, Mus musculus
gatagccagctccttgatccggcag

SEQ ID NO: 440523 - DNA, 25 bp, Mus musculus
gatagcctacccagagttcattgaa

SEQ ID NO: 440524 - DNA, 25 bp, Mus musculus
gatagcctctttgggttgatactga

SEQ ID NO: 440525 - DNA, 25 bp, Mus musculus
gatagccttaattctcctgcctggg

SEQ ID NO: 440526 - DNA, 25 bp, Mus musculus
gatagcctttgggtatccagagtcc

SEQ ID NO: 440527 - DNA, 25 bp, Mus musculus
gatagcgcggtacacataattctca

SEQ ID NO: 440528 - DNA, 25 bp, Mus musculus
gatagctaaaatacttcctggtcac

SEQ ID NO: 440529 - DNA, 25 bp, Mus musculus
gatagctagagcatccacacgtgga

SEQ ID NO: 440530 - DNA, 25 bp, Mus musculus
gatagctcctaacaacctcctgctg

SEQ ID NO: 440531 - DNA, 25 bp, Mus musculus
gatagctcggccacttaccagagtg

SEQ ID NO: 440532 - DNA, 25 bp, Mus musculus
gatagctctatcaaaagaaccccaa

SEQ ID NO: 440533 - DNA, 25 bp, Mus musculus
gatagctgaaaccatgtgggatccc

SEQ ID NO: 440534 - DNA, 25 bp, Mus musculus
gatagctgaaactaggtgcgcctca

SEQ ID NO: 440535 - DNA, 25 bp, Mus musculus
gatagctgtctatttcagacttcag

SEQ ID NO: 440536 - DNA, 25 bp, Mus musculus
gatagctgtgatgatggacccagtc

SEQ ID NO: 440537 - DNA, 25 bp, Mus musculus
gatagctttcaaggagcacccctgt

SEQ ID NO: 440538 - DNA, 25 bp, Mus musculus
gataggaactccaagtctcgtctgg

SEQ ID NO: 440539 - DNA, 25 bp, Mus musculus
gataggaattttctacgggactcca

SEQ ID NO: 440540 - DNA, 25 bp, Mus musculus
gataggagactacaagcggcagaac

SEQ ID NO: 440541 - DNA, 25 bp, Mus musculus
gataggaggcccaaggaatctctct

SEQ ID NO: 440542 - DNA, 25 bp, Mus musculus
gataggatgagtcacccgtccctgt

SEQ ID NO: 440543 - DNA, 25 bp, Mus musculus
gataggatgggctacttaaactcat

SEQ ID NO: 440544 - DNA, 25 bp, Mus musculus
gataggattcactccatgcacccag

SEQ ID NO: 440545 - DNA, 25 bp, Mus musculus
gataggatttcaaaacaagaggccc

SEQ ID NO: 440546 - DNA, 25 bp, Mus musculus
gataggcacacagggctcattcctt

SEQ ID NO: 440547 - DNA, 25 bp, Mus musculus
gataggcagatccagaaggcattct

SEQ ID NO: 440548 - DNA, 25 bp, Mus musculus
gataggcagtgtatagcagtgtcag

SEQ ID NO: 440549 - DNA, 25 bp, Mus musculus
gataggccaggagcaaaacaagccc

SEQ ID NO: 440550 - DNA, 25 bp, Mus musculus
gataggccaggcgatgatacgcaag

SEQ ID NO: 440551 - DNA, 25 bp, Mus musculus
gataggcgttctgttgagccacaaa

SEQ ID NO: 440552 - DNA, 25 bp, Mus musculus
gataggctcggcaatgagtacccca

SEQ ID NO: 440553 - DNA, 25 bp, Mus musculus
gataggctctacgtcattggtggca

SEQ ID NO: 440554 - DNA, 25 bp, Mus musculus
gataggctgcgtccttcctaaccgg

SEQ ID NO: 440555 - DNA, 25 bp, Mus musculus
gatagggacctctgaacagctctga

SEQ ID NO: 440556 - DNA, 25 bp, Mus musculus
gatagggagcagaaacccaagggct

SEQ ID NO: 440557 - DNA, 25 bp, Mus musculus
gataggtccgtctccatgctaagga

SEQ ID NO: 440558 - DNA, 25 bp, Mus musculus
gataggtcctcacagaagaatctga

SEQ ID NO: 440559 - DNA, 25 bp, Mus musculus
gataggtctggtggaactacttcac

SEQ ID NO: 440560 - DNA, 25 bp, Mus musculus
gataggtggtgtcattcccctccaa

SEQ ID NO: 440561 - DNA, 25 bp, Mus musculus
gataggttatttctctaccagcaaa

SEQ ID NO: 440562 - DNA, 25 bp, Mus musculus
gataggttcctcaatgccaagtgac

SEQ ID NO: 440563 - DNA, 25 bp, Mus musculus
gataggtttctatttccccagctct

SEQ ID NO: 440564 - DNA, 25 bp, Mus musculus
gatagtaagaccattagagcccagc

SEQ ID NO: 440565 - DNA, 25 bp, Mus musculus
gatagtacagttcagcgagctgcaa

SEQ ID NO: 440566 - DNA, 25 bp, Mus musculus
gatagtagggttcctcacagcccag

SEQ ID NO: 440567 - DNA, 25 bp, Mus musculus
gatagtatgtccatggtgtccacct

SEQ ID NO: 440568 - DNA, 25 bp, Mus musculus
gatagtattcacatagccgcaaggc

SEQ ID NO: 440569 - DNA, 25 bp, Mus musculus
gatagtattcgcacactactgtccc

SEQ ID NO: 440570 - DNA, 25 bp, Mus musculus
gatagtcacagatgtgcctcttgca

SEQ ID NO: 440571 - DNA, 25 bp, Mus musculus
gatagtcatgtaacctactggccag

SEQ ID NO: 440572 - DNA, 25 bp, Mus musculus
gatagtccacactggacggagccca

SEQ ID NO: 440573 - DNA, 25 bp, Mus musculus
gatagtcctctatatattatgcata

SEQ ID NO: 440574 - DNA, 25 bp, Mus musculus
gatagtccttaagccttctgagagc

SEQ ID NO: 440575 - DNA, 25 bp, Mus musculus
gatagtcggacatgtacaattcgaa

SEQ ID NO: 440576 - DNA, 25 bp, Mus musculus
gatagtgaaagtcccaagaagagga

SEQ ID NO: 440577 - DNA, 25 bp, Mus musculus
gatagtgaactgcttcctgtctgtg

SEQ ID NO: 440578 - DNA, 25 bp, Mus musculus
gatagtgactcaggcacatcgtcag

SEQ ID NO: 440579 - DNA, 25 bp, Mus musculus
gatagtgcccttagcggatgttaca

SEQ ID NO: 440580 - DNA, 25 bp, Mus musculus
gatagtgctgctcataatcgcgcga

SEQ ID NO: 440581 - DNA, 25 bp, Mus musculus
gatagtggatcagaacgacaacgcc

SEQ ID NO: 440582 - DNA, 25 bp, Mus musculus
gatagtggatcccaacggactggct

SEQ ID NO: 440583 - DNA, 25 bp, Mus musculus
gatagtggcatccaggctgcatgaa

SEQ ID NO: 440584 - DNA, 25 bp, Mus musculus
gatagtggcgcaaagaggaaagcct

SEQ ID NO: 440585 - DNA, 25 bp, Mus musculus
gatagtggctggtctgtcagagcac

SEQ ID NO: 440586 - DNA, 25 bp, Mus musculus
gatagtgggccaggagaaaccctat

SEQ ID NO: 440587 - DNA, 25 bp, Mus musculus
gatagtggtcaccatcagctgggcc

SEQ ID NO: 440588 - DNA, 25 bp, Mus musculus
gatagtgtcactgggcattatgtca

SEQ ID NO: 440589 - DNA, 25 bp, Mus musculus
gatagtgtttgctcagcgcgcgaca

SEQ ID NO: 440590 - DNA, 25 bp, Mus musculus
gatagttaatggatccggctgggta

SEQ ID NO: 440591 - DNA, 25 bp, Mus musculus
gatagttcctgcagaattgtgaccc

SEQ ID NO: 440592 - DNA, 25 bp, Mus musculus
gatagttctagagcacggagcagga

SEQ ID NO: 440593 - DNA, 25 bp, Mus musculus
gatagttctggtccccttctgggca

SEQ ID NO: 440594 - DNA, 25 bp, Mus musculus
gatagttgggagcacagtgttctcc

SEQ ID NO: 440595 - DNA, 25 bp, Mus musculus
gatagtttccagcttagttaaataa

SEQ ID NO: 440596 - DNA, 25 bp, Mus musculus
gatagttttacagagacaggttgta

SEQ ID NO: 440597 - DNA, 25 bp, Mus musculus
gatataaaagtgagcgcagtgcctc

SEQ ID NO: 440598 - DNA, 25 bp, Mus musculus
gatataaacagaagcagatggcctg

SEQ ID NO: 440599 - DNA, 25 bp, Mus musculus
gatataaatggacgtatgcgtgcca

SEQ ID NO: 440600 - DNA, 25 bp, Mus musculus
gatataaggccaatgaatagacaga

SEQ ID NO: 440601 - DNA, 25 bp, Mus musculus
gatataatcccctatgtggtcaccg

SEQ ID NO: 440602 - DNA, 25 bp, Mus musculus
gatataatggcctcagcacagagcc

SEQ ID NO: 440603 - DNA, 25 bp, Mus musculus
gatatacacctgcacaaattgtgtg

SEQ ID NO: 440604 - DNA, 25 bp, Mus musculus
gatatacagttgcattacacacaca

SEQ ID NO: 440605 - DNA, 25 bp, Mus musculus
gatatacccttgctgataaaacatg

SEQ ID NO: 440606 - DNA, 25 bp, Mus musculus
gatataccgcgcttgtttgcctgta

SEQ ID NO: 440607 - DNA, 25 bp, Mus musculus
gatatacctctgtcctgcaattcgc

SEQ ID NO: 440608 - DNA, 25 bp, Mus musculus
gatataccttgatgcccactgtgag

SEQ ID NO: 440609 - DNA, 25 bp, Mus musculus
gatatactacattgagggaaccctt

SEQ ID NO: 440610 - DNA, 25 bp, Mus musculus
gatatactagagtttgcctagcatg

SEQ ID NO: 440611 - DNA, 25 bp, Mus musculus
gatatactcacacctccagagaggg

SEQ ID NO: 440612 - DNA, 25 bp, Mus musculus
gatatactcctggaacccaagagcc

SEQ ID NO: 440613 - DNA, 25 bp, Mus musculus
gatatactgggtccttcctacaaga

SEQ ID NO: 440614 - DNA, 25 bp, Mus musculus
gatatagaagggatgcgactcgtgt

SEQ ID NO: 440615 - DNA, 25 bp, Mus musculus
gatatagaatgcttcccaagagggc

SEQ ID NO: 440616 - DNA, 25 bp, Mus musculus
gatatagacagagacctagagccca

SEQ ID NO: 440617 - DNA, 25 bp, Mus musculus
gatatagcaatgtggtggccccagc

SEQ ID NO: 440618 - DNA, 25 bp, Mus musculus
gatatagcagcttcttcccatgaaa

SEQ ID NO: 440619 - DNA, 25 bp, Mus musculus
gatatagccccgatgaatgctgctg

SEQ ID NO: 440620 - DNA, 25 bp, Mus musculus
gatatagcccgcaggcacatgtacc

SEQ ID NO: 440621 - DNA, 25 bp, Mus musculus
gatatagtgctaatggcccaggcct

SEQ ID NO: 440622 - DNA, 25 bp, Mus musculus
gatatataagtattaaccgttccct

SEQ ID NO: 440623 - DNA, 25 bp, Mus musculus
gatatataatatgcccaggcccctg

SEQ ID NO: 440624 - DNA, 25 bp, Mus musculus
gatatataccactgctactgctttg

SEQ ID NO: 440625 - DNA, 25 bp, Mus musculus
gatatatatgaacaggacctcggct

SEQ ID NO: 440626 - DNA, 25 bp, Mus musculus
gatatatattcagggctccagaact

SEQ ID NO: 440627 - DNA, 25 bp, Mus musculus
gatatatctgaagctgaacactgcc

SEQ ID NO: 440628 - DNA, 25 bp, Mus musculus
gatatatgccaccatgacccgtttt

SEQ ID NO: 440629 - DNA, 25 bp, Mus musculus
gatatatgccgtaccccagcaagag

SEQ ID NO: 440630 - DNA, 25 bp, Mus musculus
gatatatgctgctgttattgaggct

SEQ ID NO: 440631 - DNA, 25 bp, Mus musculus
gatatatggtccagcggattctgcc

SEQ ID NO: 440632 - DNA, 25 bp, Mus musculus
gatatattattattggctgtgagaa

SEQ ID NO: 440633 - DNA, 25 bp, Mus musculus
gatatatttgatgccgacagtgcca

SEQ ID NO: 440634 - DNA, 25 bp, Mus musculus
gatatcaacttcttgagagctctct

SEQ ID NO: 440635 - DNA, 25 bp, Mus musculus
gatatcacagatctgttgtctgtac

SEQ ID NO: 440636 - DNA, 25 bp, Mus musculus
gatatcacagttccttaatcctggc

SEQ ID NO: 440637 - DNA, 25 bp, Mus musculus
gatatcaccaggagttaggccaccc

SEQ ID NO: 440638 - DNA, 25 bp, Mus musculus
gatatcaccatacctaaccagatgg

SEQ ID NO: 440639 - DNA, 25 bp, Mus musculus
gatatcaccgactggtgcccgaggc

SEQ ID NO: 440640 - DNA, 25 bp, Mus musculus
gatatcaccttgactccagagccag

SEQ ID NO: 440641 - DNA, 25 bp, Mus musculus
gatatcactcactggtctacagaca

SEQ ID NO: 440642 - DNA, 25 bp, Mus musculus
gatatcagagaccttggtgctgcca

SEQ ID NO: 440643 - DNA, 25 bp, Mus musculus
gatatcagccatctcagagccaggg

SEQ ID NO: 440644 - DNA, 25 bp, Mus musculus
gatatcaggctgcttatggacgacc

SEQ ID NO: 440645 - DNA, 25 bp, Mus musculus
gatatcatccgagtccgaggctctg

SEQ ID NO: 440646 - DNA, 25 bp, Mus musculus
gatatcatcgtttctccacacggag

SEQ ID NO: 440647 - DNA, 25 bp, Mus musculus
gatatcatgcatgggagagcccaca

SEQ ID NO: 440648 - DNA, 25 bp, Mus musculus
gatatcatgggctacaggttcctga

SEQ ID NO: 440649 - DNA, 25 bp, Mus musculus
gatatcatttcctttcctcaaacac

SEQ ID NO: 440650 - DNA, 25 bp, Mus musculus
gatatccagatgtcgagtccaacct

SEQ ID NO: 440651 - DNA, 25 bp, Mus musculus
gatatccaggtagtgtccagatcgc

SEQ ID NO: 440652 - DNA, 25 bp, Mus musculus
gatatccaggttggtgccatggctg

SEQ ID NO: 440653 - DNA, 25 bp, Mus musculus
gatatccccgaacagacagaagtgg

SEQ ID NO: 440654 - DNA, 25 bp, Mus musculus
gatatccccgatgttctcaagaagc

SEQ ID NO: 440655 - DNA, 25 bp, Mus musculus
gatatcccgggtaaggcagtggcac

SEQ ID NO: 440656 - DNA, 25 bp, Mus musculus
gatatccctggcctaaacctgagtc

SEQ ID NO: 440657 - DNA, 25 bp, Mus musculus
gatatccgaaaatcagggagtccct

SEQ ID NO: 440658 - DNA, 25 bp, Mus musculus
gatatccgcctcactcttatggaag

SEQ ID NO: 440659 - DNA, 25 bp, Mus musculus
gatatccgctacctgctgggctatg

SEQ ID NO: 440660 - DNA, 25 bp, Mus musculus
gatatcctagtcgtgtatgccaaga

SEQ ID NO: 440661 - DNA, 25 bp, Mus musculus
gatatcctcatggtgacgggtggca

SEQ ID NO: 440662 - DNA, 25 bp, Mus musculus
gatatcctgaggttcttgacagcac

SEQ ID NO: 440663 - DNA, 25 bp, Mus musculus
gatatcctgtaatagactcgggtcc

SEQ ID NO: 440664 - DNA, 25 bp, Mus musculus
gatatcgaagttttctgggcctccc

SEQ ID NO: 440665 - DNA, 25 bp, Mus musculus
gatatcgactcagagcctgtggccg

SEQ ID NO: 440666 - DNA, 25 bp, Mus musculus
gatatcgagcgtgaaatcggcgcca

SEQ ID NO: 440667 - DNA, 25 bp, Mus musculus
gatatcgaggtgctctccaccggga

SEQ ID NO: 440668 - DNA, 25 bp, Mus musculus
gatatcggcccctttgctaagagca

SEQ ID NO: 440669 - DNA, 25 bp, Mus musculus
gatatcgtccactctgtaccaggca

SEQ ID NO: 440670 - DNA, 25 bp, Mus musculus
gatatcgtcgacagcttggagtcaa

SEQ ID NO: 440671 - DNA, 25 bp, Mus musculus
gatatcgtggtcaattgctcaggcc

SEQ ID NO: 440672 - DNA, 25 bp, Mus musculus
gatatctagcgagaacttcctacgg

SEQ ID NO: 440673 - DNA, 25 bp, Mus musculus
gatatctccggacttcaggaccatg

SEQ ID NO: 440674 - DNA, 25 bp, Mus musculus
gatatctcggtgtgggactacgaca

SEQ ID NO: 440675 - DNA, 25 bp, Mus musculus
gatatctctctcaaaggaaccaaag

SEQ ID NO: 440676 - DNA, 25 bp, Mus musculus
gatatctgagcatagtgcacgccac

SEQ ID NO: 440677 - DNA, 25 bp, Mus musculus
gatatctgcagcaccacacttttgg

SEQ ID NO: 440678 - DNA, 25 bp, Mus musculus
gatatctgcattgccttccaggagg

SEQ ID NO: 440679 - DNA, 25 bp, Mus musculus
gatatctgctccgacctactggaga

SEQ ID NO: 440680 - DNA, 25 bp, Mus musculus
gatatctgtgccgatcccaggcagg

SEQ ID NO: 440681 - DNA, 25 bp, Mus musculus
gatatcttcatattggtggcaccac

SEQ ID NO: 440682 - DNA, 25 bp, Mus musculus
gatatcttccggtatagcagcatgg

SEQ ID NO: 440683 - DNA, 25 bp, Mus musculus
gatatctttagcaatgacactgccc

SEQ ID NO: 440684 - DNA, 25 bp, Mus musculus
gatatctttcaggtaaatttccagg

SEQ ID NO: 440685 - DNA, 25 bp, Mus musculus
gatatcttttccgtgtgcgggccag

SEQ ID NO: 440686 - DNA, 25 bp, Mus musculus
gatatgaattgtctcccacagcagc

SEQ ID NO: 440687 - DNA, 25 bp, Mus musculus
gatatgacagcctagctccctaagg

SEQ ID NO: 440688 - DNA, 25 bp, Mus musculus
gatatgacagctccgcccatggatg

SEQ ID NO: 440689 - DNA, 25 bp, Mus musculus
gatatgaggtcctaaagttcaaggc

SEQ ID NO: 440690 - DNA, 25 bp, Mus musculus
gatatgatacagctgatgaacaccg

SEQ ID NO: 440691 - DNA, 25 bp, Mus musculus
gatatgatatgtcaggtgcccgcct

SEQ ID NO: 440692 - DNA, 25 bp, Mus musculus
gatatgcaccgaccgaattttcgac

SEQ ID NO: 440693 - DNA, 25 bp, Mus musculus
gatatgcagaattcaagggatggct

SEQ ID NO: 440694 - DNA, 25 bp, Mus musculus
gatatgccctcttattccaactgaa

SEQ ID NO: 440695 - DNA, 25 bp, Mus musculus
gatatgcctgttcatgtgtcacaaa

SEQ ID NO: 440696 - DNA, 25 bp, Mus musculus
gatatgctttgacgtgcctgaccct

SEQ ID NO: 440697 - DNA, 25 bp, Mus musculus
gatatggaagcgacaacacccttgg

SEQ ID NO: 440698 - DNA, 25 bp, Mus musculus
gatatggaccacatagaggacccct

SEQ ID NO: 440699 - DNA, 25 bp, Mus musculus
gatatggagcgctttaagtacccgg

SEQ ID NO: 440700 - DNA, 25 bp, Mus musculus
gatatggaggatcgcaaatcctggc

SEQ ID NO: 440701 - DNA, 25 bp, Mus musculus
gatatggataaagccaggtttcagc

SEQ ID NO: 440702 - DNA, 25 bp, Mus musculus
gatatggcctgtgtcaacctgcttc

SEQ ID NO: 440703 - DNA, 25 bp, Mus musculus
gatatggctaaatcctattgggtcc

SEQ ID NO: 440704 - DNA, 25 bp, Mus musculus
gatatggctcttactacagatctgg

SEQ ID NO: 440705 - DNA, 25 bp, Mus musculus
gatatggctgctgacagagagactg

SEQ ID NO: 440706 - DNA, 25 bp, Mus musculus
gatatgggagttcttttacagcggt

SEQ ID NO: 440707 - DNA, 25 bp, Mus musculus
gatatgggatacgttcacagggacc

SEQ ID NO: 440708 - DNA, 25 bp, Mus musculus
gatatgggttactaagaacgaccgg

SEQ ID NO: 440709 - DNA, 25 bp, Mus musculus
gatatggtcgatcctacagacacag

SEQ ID NO: 440710 - DNA, 25 bp, Mus musculus
gatatggtgactagaccttgccagg

SEQ ID NO: 440711 - DNA, 25 bp, Mus musculus
gatatggtttggagcacaccctgca

SEQ ID NO: 440712 - DNA, 25 bp, Mus musculus
gatatgtccattctgtgcttaacta

SEQ ID NO: 440713 - DNA, 25 bp, Mus musculus
gatatgtcctttgtgcccacctggg

SEQ ID NO: 440714 - DNA, 25 bp, Mus musculus
gatatgtctgtctgctttaccatgt

SEQ ID NO: 440715 - DNA, 25 bp, Mus musculus
gatatgtgctggtgctacggacgac

SEQ ID NO: 440716 - DNA, 25 bp, Mus musculus
gatatgtggctgtgcccaaggacca

SEQ ID NO: 440717 - DNA, 25 bp, Mus musculus
gatatgtgtcaactgccgccgttca

SEQ ID NO: 440718 - DNA, 25 bp, Mus musculus
gatatgttaacagacccgagtcaag

SEQ ID NO: 440719 - DNA, 25 bp, Mus musculus
gatatgttcagtcttggccagggca

SEQ ID NO: 440720 - DNA, 25 bp, Mus musculus
gatattaatttgtgtcctttgccag

SEQ ID NO: 440721 - DNA, 25 bp, Mus musculus
gatattacacctagggacttgcaca

SEQ ID NO: 440722 - DNA, 25 bp, Mus musculus
gatattactgctccagggttcaacc

SEQ ID NO: 440723 - DNA, 25 bp, Mus musculus
gatattagcacttagacccagacca

SEQ ID NO: 440724 - DNA, 25 bp, Mus musculus
gatattagttccttacggcgccagc

SEQ ID NO: 440725 - DNA, 25 bp, Mus musculus
gatattatgtatgattggctcgcta

SEQ ID NO: 440726 - DNA, 25 bp, Mus musculus
gatattcaaaagaggcaagcagcga

SEQ ID NO: 440727 - DNA, 25 bp, Mus musculus
gatattcaacgagatcccctgatgg

SEQ ID NO: 440728 - DNA, 25 bp, Mus musculus
gatattcacatcaccagcaaccttg

SEQ ID NO: 440729 - DNA, 25 bp, Mus musculus
gatattcagactcggcagtacaggg

SEQ ID NO: 440730 - DNA, 25 bp, Mus musculus
gatattccagatggtcatcgtgcgc

SEQ ID NO: 440731 - DNA, 25 bp, Mus musculus
gatattccagcgctgttactgcggg

SEQ ID NO: 440732 - DNA, 25 bp, Mus musculus
gatattccggtcaaatagatgtcac

SEQ ID NO: 440733 - DNA, 25 bp, Mus musculus
gatattcgagttggagaacatgacc

SEQ ID NO: 440734 - DNA, 25 bp, Mus musculus
gatattcgcaagctccgtctcggag

SEQ ID NO: 440735 - DNA, 25 bp, Mus musculus
gatattcgccattgagatagccgcc

SEQ ID NO: 440736 - DNA, 25 bp, Mus musculus
gatattcggcagtgagctgggcacc

SEQ ID NO: 440737 - DNA, 25 bp, Mus musculus
gatattcggctatctccggacctgg

SEQ ID NO: 440738 - DNA, 25 bp, Mus musculus
gatattcgggagacttgggagaccc

SEQ ID NO: 440739 - DNA, 25 bp, Mus musculus
gatattcgggtctctgtgcaggcct

SEQ ID NO: 440740 - DNA, 25 bp, Mus musculus
gatattcgttgcacacacggccaag

SEQ ID NO: 440741 - DNA, 25 bp, Mus musculus
gatattctacgcaaaccacgacctg

SEQ ID NO: 440742 - DNA, 25 bp, Mus musculus
gatattctccgaacaccagtgtctg

SEQ ID NO: 440743 - DNA, 25 bp, Mus musculus
gatattctgggcaacaaagtctctg

SEQ ID NO: 440744 - DNA, 25 bp, Mus musculus
gatattctttgaaggccagcacatt

SEQ ID NO: 440745 - DNA, 25 bp, Mus musculus
gatattgaagccaaatgcctccaca

SEQ ID NO: 440746 - DNA, 25 bp, Mus musculus
gatattgatgtagaaaagctcaccc

SEQ ID NO: 440747 - DNA, 25 bp, Mus musculus
gatattgcaaagaaaatgtcacaca

SEQ ID NO: 440748 - DNA, 25 bp, Mus musculus
gatattgcagaggactttcccagag

SEQ ID NO: 440749 - DNA, 25 bp, Mus musculus
gatattgctgacatcattggtgacc

SEQ ID NO: 440750 - DNA, 25 bp, Mus musculus
gatattggaccagcaaaatggctca

SEQ ID NO: 440751 - DNA, 25 bp, Mus musculus
gatattggcttcatgggtcccaggg

SEQ ID NO: 440752 - DNA, 25 bp, Mus musculus
gatattggtcatcttgagcttgaac

SEQ ID NO: 440753 - DNA, 25 bp, Mus musculus
gatattgtcctgagtattacttagc

SEQ ID NO: 440754 - DNA, 25 bp, Mus musculus
gatattgtcgctgagaagcccttaa

SEQ ID NO: 440755 - DNA, 25 bp, Mus musculus
gatattgtcttcaccatcggcagtg

SEQ ID NO: 440756 - DNA, 25 bp, Mus musculus
gatatttaagatccctgccacagtg

SEQ ID NO: 440757 - DNA, 25 bp, Mus musculus
gatatttaataaaatcctttgcctt

SEQ ID NO: 440758 - DNA, 25 bp, Mus musculus
gatatttagccagctcatgggaact

SEQ ID NO: 440759 - DNA, 25 bp, Mus musculus
gatatttatggatttacagctgagg

SEQ ID NO: 440760 - DNA, 25 bp, Mus musculus
gatatttccataagtccagtagcag

SEQ ID NO: 440761 - DNA, 25 bp, Mus musculus
gatatttcccaaaggccttccagag

SEQ ID NO: 440762 - DNA, 25 bp, Mus musculus
gatatttctcgccagctccgtgtca

SEQ ID NO: 440763 - DNA, 25 bp, Mus musculus
gatatttctgtttctacttcaccac

SEQ ID NO: 440764 - DNA, 25 bp, Mus musculus
gatatttgattgaaccctgcgggtc

SEQ ID NO: 440765 - DNA, 25 bp, Mus musculus
gatatttggctagacaccttccggg

SEQ ID NO: 440766 - DNA, 25 bp, Mus musculus
gatatttgtgtctgttttccgcatg

SEQ ID NO: 440767 - DNA, 25 bp, Mus musculus
gatattttactggaacatgctctgt

SEQ ID NO: 440768 - DNA, 25 bp, Mus musculus
gatattttccctcatccatcaacca

SEQ ID NO: 440769 - DNA, 25 bp, Mus musculus
gatatttttgggtaaaggagatagg

SEQ ID NO: 440770 - DNA, 25 bp, Mus musculus
gatcaaaaacagctttaacccggag

SEQ ID NO: 440771 - DNA, 25 bp, Mus musculus
gatcaaaacagagaagtcagcccac

SEQ ID NO: 440772 - DNA, 25 bp, Mus musculus
gatcaaaccctatggactggactgg

SEQ ID NO: 440773 - DNA, 25 bp, Mus musculus
gatcaaacctgagggcacatctgca

SEQ ID NO: 440774 - DNA, 25 bp, Mus musculus
gatcaaagagatctgctccgccaag

SEQ ID NO: 440775 - DNA, 25 bp, Mus musculus
gatcaaagatgattggcgcctcccg

SEQ ID NO: 440776 - DNA, 25 bp, Mus musculus
gatcaaagccgggacaccattgtgg

SEQ ID NO: 440777 - DNA, 25 bp, Mus musculus
gatcaaaggagaaataccgacagct

SEQ ID NO: 440778 - DNA, 25 bp, Mus musculus
gatcaaagtcctgtcccggttggcc

SEQ ID NO: 440779 - DNA, 25 bp, Mus musculus
gatcaaatccagtgtagcctcattg

SEQ ID NO: 440780 - DNA, 25 bp, Mus musculus
gatcaaatcctagtgggcctgagca

SEQ ID NO: 440781 - DNA, 25 bp, Mus musculus
gatcaaatcttcaatggcggtgctc

SEQ ID NO: 440782 - DNA, 25 bp, Mus musculus
gatcaaccagccaatcctacagaag

SEQ ID NO: 440783 - DNA, 25 bp, Mus musculus
gatcaaccggtgtggagcgctgtac

SEQ ID NO: 440784 - DNA, 25 bp, Mus musculus
gatcaacgaagggtaaagtgcaggc

SEQ ID NO: 440785 - DNA, 25 bp, Mus musculus
gatcaacgagtacctcatgggcaag

SEQ ID NO: 440786 - DNA, 25 bp, Mus musculus
gatcaactctatagattcgagcggc

SEQ ID NO: 440787 - DNA, 25 bp, Mus musculus
gatcaactggacgactgggacagcc

SEQ ID NO: 440788 - DNA, 25 bp, Mus musculus
gatcaacttcagacaataggacccg

SEQ ID NO: 440789 - DNA, 25 bp, Mus musculus
gatcaagaacatctagaccatgcat

SEQ ID NO: 440790 - DNA, 25 bp, Mus musculus
gatcaagagatcgtcactaacccgc

SEQ ID NO: 440791 - DNA, 25 bp, Mus musculus
gatcaagagcgaggcttctccacgc

SEQ ID NO: 440792 - DNA, 25 bp, Mus musculus
gatcaagaggcctgtaaagaccaca

SEQ ID NO: 440793 - DNA, 25 bp, Mus musculus
gatcaagccccgtattacagagcag

SEQ ID NO: 440794 - DNA, 25 bp, Mus musculus
gatcaagctcatctggtacctctga

SEQ ID NO: 440795 - DNA, 25 bp, Mus musculus
gatcaaggaagtggcagacaaaggc

SEQ ID NO: 440796 - DNA, 25 bp, Mus musculus
gatcaaggacctgttaccatggaga

SEQ ID NO: 440797 - DNA, 25 bp, Mus musculus
gatcaagggaggagcttccaccaaa

SEQ ID NO: 440798 - DNA, 25 bp, Mus musculus
gatcaaggtctgtgctagataccaa

SEQ ID NO: 440799 - DNA, 25 bp, Mus musculus
gatcaagtccactgcagccaaagct

SEQ ID NO: 440800 - DNA, 25 bp, Mus musculus
gatcaagttccgcagacacctaaaa

SEQ ID NO: 440801 - DNA, 25 bp, Mus musculus
gatcaatagcattgggcgggccctc

SEQ ID NO: 440802 - DNA, 25 bp, Mus musculus
gatcaatatcctcaatatgaagttg

SEQ ID NO: 440803 - DNA, 25 bp, Mus musculus
gatcaatcctactgtgcatcccagg

SEQ ID NO: 440804 - DNA, 25 bp, Mus musculus
gatcaatgaaggaccagactgccta

SEQ ID NO: 440805 - DNA, 25 bp, Mus musculus
gatcaatgaggactgcaagctcccg

SEQ ID NO: 440806 - DNA, 25 bp, Mus musculus
gatcaatgagtgtgcatccagccca

SEQ ID NO: 440807 - DNA, 25 bp, Mus musculus
gatcaatgagtgtttgtctccccag

SEQ ID NO: 440808 - DNA, 25 bp, Mus musculus
gatcaatgctagagagtactaccca

SEQ ID NO: 440809 - DNA, 25 bp, Mus musculus
gatcaatggacagctggtgttctcc

SEQ ID NO: 440810 - DNA, 25 bp, Mus musculus
gatcaatggcgacattcgggcaaag

SEQ ID NO: 440811 - DNA, 25 bp, Mus musculus
gatcaattacactaggctcacagaa

SEQ ID NO: 440812 - DNA, 25 bp, Mus musculus
gatcaatttgcaatgcaggctacat

SEQ ID NO: 440813 - DNA, 25 bp, Mus musculus
gatcacaacttggagaagctcctgg

SEQ ID NO: 440814 - DNA, 25 bp, Mus musculus
gatcacaaggttccaggttacccct

SEQ ID NO: 440815 - DNA, 25 bp, Mus musculus
gatcacaatgactagccaggagctg

SEQ ID NO: 440816 - DNA, 25 bp, Mus musculus
gatcacaatgagttctggagcgcac

SEQ ID NO: 440817 - DNA, 25 bp, Mus musculus
gatcacacatttgcaagggaccacc

SEQ ID NO: 440818 - DNA, 25 bp, Mus musculus
gatcacaccttggaattctggccag

SEQ ID NO: 440819 - DNA, 25 bp, Mus musculus
gatcacactcgtagtcctggaaaaa

SEQ ID NO: 440820 - DNA, 25 bp, Mus musculus
gatcacagactatgggctcgagagc

SEQ ID NO: 440821 - DNA, 25 bp, Mus musculus
gatcacagatgagtggaacgcaaca

SEQ ID NO: 440822 - DNA, 25 bp, Mus musculus
gatcacagctagataatatatggcc

SEQ ID NO: 440823 - DNA, 25 bp, Mus musculus
gatcacagtggttcagaaagtccca

SEQ ID NO: 440824 - DNA, 25 bp, Mus musculus
gatcacatcctacaggtcagctgag

SEQ ID NO: 440825 - DNA, 25 bp, Mus musculus
gatcacatcctgtaccagacgctgg

SEQ ID NO: 440826 - DNA, 25 bp, Mus musculus
gatcacatgattgacacttgtctcc

SEQ ID NO: 440827 - DNA, 25 bp, Mus musculus
gatcaccacatgaaaacgcagcagg

SEQ ID NO: 440828 - DNA, 25 bp, Mus musculus
gatcaccacggttgttttctacggc

SEQ ID NO: 440829 - DNA, 25 bp, Mus musculus
gatcaccatcgtggcgggagtgctt

SEQ ID NO: 440830 - DNA, 25 bp, Mus musculus
gatcacccagctggcacgggcagga

SEQ ID NO: 440831 - DNA, 25 bp, Mus musculus
gatcacccagtggagacaatcagct

SEQ ID NO: 440832 - DNA, 25 bp, Mus musculus
gatcaccccttccagaacactgtag

SEQ ID NO: 440833 - DNA, 25 bp, Mus musculus
gatcaccggtgagtatatcagcccc

SEQ ID NO: 440834 - DNA, 25 bp, Mus musculus
gatcacctccgtgaaacggtggcag

SEQ ID NO: 440835 - DNA, 25 bp, Mus musculus
gatcacctggaggatggctaccact

SEQ ID NO: 440836 - DNA, 25 bp, Mus musculus
gatcaccttgtgaggcctataagag

SEQ ID NO: 440837 - DNA, 25 bp, Mus musculus
gatcacgagaagagctaccactact

SEQ ID NO: 440838 - DNA, 25 bp, Mus musculus
gatcacgagtccataggtggccatg

SEQ ID NO: 440839 - DNA, 25 bp, Mus musculus
gatcacgcagcttagaaagttcatg

SEQ ID NO: 440840 - DNA, 25 bp, Mus musculus
gatcacggagatcgccaaggagctc

SEQ ID NO: 440841 - DNA, 25 bp, Mus musculus
gatcacggattagtcaaccttagga

SEQ ID NO: 440842 - DNA, 25 bp, Mus musculus
gatcacggatttggagtcagacaag

SEQ ID NO: 440843 - DNA, 25 bp, Mus musculus
gatcacggccaagacgaggaaggct

SEQ ID NO: 440844 - DNA, 25 bp, Mus musculus
gatcacggtgccttatgtccaaacg

SEQ ID NO: 440845 - DNA, 25 bp, Mus musculus
gatcacgtcaaagagatgcgcagca

SEQ ID NO: 440846 - DNA, 25 bp, Mus musculus
gatcactaaatgtcctctgcacatg

SEQ ID NO: 440847 - DNA, 25 bp, Mus musculus
gatcactagctatcgaggacaagcc

SEQ ID NO: 440848 - DNA, 25 bp, Mus musculus
gatcactatgagaaaggcggaaccc

SEQ ID NO: 440849 - DNA, 25 bp, Mus musculus
gatcactattcagacaaactcctgg

SEQ ID NO: 440850 - DNA, 25 bp, Mus musculus
gatcactattggatgggaaacccag

SEQ ID NO: 440851 - DNA, 25 bp, Mus musculus
gatcactccattcctgactctgggc

SEQ ID NO: 440852 - DNA, 25 bp, Mus musculus
gatcactgaagcctatgaagacgcg

SEQ ID NO: 440853 - DNA, 25 bp, Mus musculus
gatcactgctggagtttacgcctgg

SEQ ID NO: 440854 - DNA, 25 bp, Mus musculus
gatcactgcttgttgctggagccgc

SEQ ID NO: 440855 - DNA, 25 bp, Mus musculus
gatcactgcttttaccacgggactg

SEQ ID NO: 440856 - DNA, 25 bp, Mus musculus
gatcactgtgaagatgggctatgca

SEQ ID NO: 440857 - DNA, 25 bp, Mus musculus
gatcacttggatacccctgcaaatg

SEQ ID NO: 440858 - DNA, 25 bp, Mus musculus
gatcacttgggagacttcacctgcg

SEQ ID NO: 440859 - DNA, 25 bp, Mus musculus
gatcagaaaacctcacccagtggca

SEQ ID NO: 440860 - DNA, 25 bp, Mus musculus
gatcagaaaggaggcaacactcagg

SEQ ID NO: 440861 - DNA, 25 bp, Mus musculus
gatcagaatggctcaggaacgcttg

SEQ ID NO: 440862 - DNA, 25 bp, Mus musculus
gatcagaatttgagtttctcagaaa

SEQ ID NO: 440863 - DNA, 25 bp, Mus musculus
gatcagaggattggaccagacacca

SEQ ID NO: 440864 - DNA, 25 bp, Mus musculus
gatcagaggctgtgactcaacccag

SEQ ID NO: 440865 - DNA, 25 bp, Mus musculus
gatcagagggaaccttggacccatc

SEQ ID NO: 440866 - DNA, 25 bp, Mus musculus
gatcagcacggcttacctgtccctt

SEQ ID NO: 440867 - DNA, 25 bp, Mus musculus
gatcagcagatgttcctgagcctag

SEQ ID NO: 440868 - DNA, 25 bp, Mus musculus
gatcagcagcgcaccattagcataa

SEQ ID NO: 440869 - DNA, 25 bp, Mus musculus
gatcagcagcttttcgaccgcaaga

SEQ ID NO: 440870 - DNA, 25 bp, Mus musculus
gatcagcagtatatggtcagcccaa

SEQ ID NO: 440871 - DNA, 25 bp, Mus musculus
gatcagcatcaaatcccattggcag

SEQ ID NO: 440872 - DNA, 25 bp, Mus musculus
gatcagcatggatgagaaactcagg

SEQ ID NO: 440873 - DNA, 25 bp, Mus musculus
gatcagcctgcatttcaagattagc

SEQ ID NO: 440874 - DNA, 25 bp, Mus musculus
gatcagcctgggtctctgggacact

SEQ ID NO: 440875 - DNA, 25 bp, Mus musculus
gatcagcgaagtggagcccaaatac

SEQ ID NO: 440876 - DNA, 25 bp, Mus musculus
gatcagcgacccagaatcctcataa

SEQ ID NO: 440877 - DNA, 25 bp, Mus musculus
gatcagcgtggaccaactgttcagc

SEQ ID NO: 440878 - DNA, 25 bp, Mus musculus
gatcagctccacaagtcttcacaag

SEQ ID NO: 440879 - DNA, 25 bp, Mus musculus
gatcagctgtctgctatgctgaaac

SEQ ID NO: 440880 - DNA, 25 bp, Mus musculus
gatcagctttcgaggcggacagaag

SEQ ID NO: 440881 - DNA, 25 bp, Mus musculus
gatcaggagatagacaactgtgccc

SEQ ID NO: 440882 - DNA, 25 bp, Mus musculus
gatcaggaggcgttacctgacagac

SEQ ID NO: 440883 - DNA, 25 bp, Mus musculus
gatcaggagttagaagttcaccaca

SEQ ID NO: 440884 - DNA, 25 bp, Mus musculus
gatcaggcctccataactgccagga

SEQ ID NO: 440885 - DNA, 25 bp, Mus musculus
gatcaggccttgacaatctgtaacc

SEQ ID NO: 440886 - DNA, 25 bp, Mus musculus
gatcaggcgtgagcttcagagcgct

SEQ ID NO: 440887 - DNA, 25 bp, Mus musculus
gatcaggctacgtcgatgtctcaac

SEQ ID NO: 440888 - DNA, 25 bp, Mus musculus
gatcagggaaggattgcactcgtcc

SEQ ID NO: 440889 - DNA, 25 bp, Mus musculus
gatcaggtacacaaatgctcgggac

SEQ ID NO: 440890 - DNA, 25 bp, Mus musculus
gatcagtattgagggcattggagcc

SEQ ID NO: 440891 - DNA, 25 bp, Mus musculus
gatcagtatttcacgagcctggtac

SEQ ID NO: 440892 - DNA, 25 bp, Mus musculus
gatcagtgatccatctcctaaaata

SEQ ID NO: 440893 - DNA, 25 bp, Mus musculus
gatcagtgattttaaggacccgccg

SEQ ID NO: 440894 - DNA, 25 bp, Mus musculus
gatcagtggatgttcggcaaagcca

SEQ ID NO: 440895 - DNA, 25 bp, Mus musculus
gatcagtgtcttgaagtgaccacca

SEQ ID NO: 440896 - DNA, 25 bp, Mus musculus
gatcagtgtgcctgaatgccacccg

SEQ ID NO: 440897 - DNA, 25 bp, Mus musculus
gatcagttaaccctactggcagcga

SEQ ID NO: 440898 - DNA, 25 bp, Mus musculus
gatcagttcaccacagccgttgtcg

SEQ ID NO: 440899 - DNA, 25 bp, Mus musculus
gatcagttcctacgtggcctacagc

SEQ ID NO: 440900 - DNA, 25 bp, Mus musculus
gatcataaaaggagtaacgctgccc

SEQ ID NO: 440901 - DNA, 25 bp, Mus musculus
gatcataagttcttgctaccccacc

SEQ ID NO: 440902 - DNA, 25 bp, Mus musculus
gatcatacatgtgccctccaggcgg

SEQ ID NO: 440903 - DNA, 25 bp, Mus musculus
gatcatagacaagatgaaaagagcc

SEQ ID NO: 440904 - DNA, 25 bp, Mus musculus
gatcatagcagcacagatgtccagg

SEQ ID NO: 440905 - DNA, 25 bp, Mus musculus
gatcatagcctgtgagactacgcct

SEQ ID NO: 440906 - DNA, 25 bp, Mus musculus
gatcatcaacccaggtgagagagag

SEQ ID NO: 440907 - DNA, 25 bp, Mus musculus
gatcatcaatcccatagtatctggg

SEQ ID NO: 440908 - DNA, 25 bp, Mus musculus
gatcatcagactgtgccgcagggct

SEQ ID NO: 440909 - DNA, 25 bp, Mus musculus
gatcatcagtttcccgtcaggctca

SEQ ID NO: 440910 - DNA, 25 bp, Mus musculus
gatcatcatctgtgtaggcatcgtg

SEQ ID NO: 440911 - DNA, 25 bp, Mus musculus
gatcatcattaaggacggaggcacg

SEQ ID NO: 440912 - DNA, 25 bp, Mus musculus
gatcatccagatgtcaagtgccaaa

SEQ ID NO: 440913 - DNA, 25 bp, Mus musculus
gatcatccctggtgctaagcatggg

SEQ ID NO: 440914 - DNA, 25 bp, Mus musculus
gatcatcctgagagtacaatctggg

SEQ ID NO: 440915 - DNA, 25 bp, Mus musculus
gatcatctcatcaaaggaaggctta

SEQ ID NO: 440916 - DNA, 25 bp, Mus musculus
gatcatctcggaagggctgtacgcc

SEQ ID NO: 440917 - DNA, 25 bp, Mus musculus
gatcatctctgtgcaagtgcccaag

SEQ ID NO: 440918 - DNA, 25 bp, Mus musculus
gatcatctgctaaacaccctggagg

SEQ ID NO: 440919 - DNA, 25 bp, Mus musculus
gatcatcttggcagttctcgcaggg

SEQ ID NO: 440920 - DNA, 25 bp, Mus musculus
gatcatcttgggagtgatctgcgcc

SEQ ID NO: 440921 - DNA, 25 bp, Mus musculus
gatcatctttgacctcctgcgggac

SEQ ID NO: 440922 - DNA, 25 bp, Mus musculus
gatcatgaccgaccttgaacgagcc

SEQ ID NO: 440923 - DNA, 25 bp, Mus musculus
gatcatgactatgtgcctctttggg

SEQ ID NO: 440924 - DNA, 25 bp, Mus musculus
gatcatgacttgatactgagctggg

SEQ ID NO: 440925 - DNA, 25 bp, Mus musculus
gatcatgagcaagtaccggaaacag

SEQ ID NO: 440926 - DNA, 25 bp, Mus musculus
gatcatgattgcaagagcccagaag

SEQ ID NO: 440927 - DNA, 25 bp, Mus musculus
gatcatgcagatcctgaccagggtg

SEQ ID NO: 440928 - DNA, 25 bp, Mus musculus
gatcatgcttcctgagaatggccgc

SEQ ID NO: 440929 - DNA, 25 bp, Mus musculus
gatcatggtccagctgcttcgcaca

SEQ ID NO: 440930 - DNA, 25 bp, Mus musculus
gatcatggttgtatctgcagtgccc

SEQ ID NO: 440931 - DNA, 25 bp, Mus musculus
gatcattcatcattggtctggactg

SEQ ID NO: 440932 - DNA, 25 bp, Mus musculus
gatcattcccatcagagtcagttag

SEQ ID NO: 440933 - DNA, 25 bp, Mus musculus
gatcattcgtgactgcatgtacggc

SEQ ID NO: 440934 - DNA, 25 bp, Mus musculus
gatcattctaagcaagcggaggctt

SEQ ID NO: 440935 - DNA, 25 bp, Mus musculus
gatcattctggaggcattgtagaca

SEQ ID NO: 440936 - DNA, 25 bp, Mus musculus
gatcattgccatagtcacgaagcca

SEQ ID NO: 440937 - DNA, 25 bp, Mus musculus
gatcattgggaactccgttggcgcc

SEQ ID NO: 440938 - DNA, 25 bp, Mus musculus
gatcatttaagttctgatgtgcaac

SEQ ID NO: 440939 - DNA, 25 bp, Mus musculus
gatcatttaccaggcctgcgggctg

SEQ ID NO: 440940 - DNA, 25 bp, Mus musculus
gatcatttatggaggcgccaggctc

SEQ ID NO: 440941 - DNA, 25 bp, Mus musculus
gatcatttcagtgggcatcctcgga

SEQ ID NO: 440942 - DNA, 25 bp, Mus musculus
gatcatttgaagatgctccaggcta

SEQ ID NO: 440943 - DNA, 25 bp, Mus musculus
gatcattttctccaagaggcctgcg

SEQ ID NO: 440944 - DNA, 25 bp, Mus musculus
gatccaaaaacttcacgtgaccaga

SEQ ID NO: 440945 - DNA, 25 bp, Mus musculus
gatccaaaaagtcggctcccagcat

SEQ ID NO: 440946 - DNA, 25 bp, Mus musculus
gatccaaatgtctaccagcggcggt

SEQ ID NO: 440947 - DNA, 25 bp, Mus musculus
gatccaacattcctttctgacctct

SEQ ID NO: 440948 - DNA, 25 bp, Mus musculus
gatccaaccccaggtaggagggact

SEQ ID NO: 440949 - DNA, 25 bp, Mus musculus
gatccaactggcttttctgagcggg

SEQ ID NO: 440950 - DNA, 25 bp, Mus musculus
gatccaacttgaggaccggaacaca

SEQ ID NO: 440951 - DNA, 25 bp, Mus musculus
gatccaagaacctgctaccccattg

SEQ ID NO: 440952 - DNA, 25 bp, Mus musculus
gatccaagaagggaagacgactgta

SEQ ID NO: 440953 - DNA, 25 bp, Mus musculus
gatccaagcactgaaatacgtagag

SEQ ID NO: 440954 - DNA, 25 bp, Mus musculus
gatccaagccatgtacagaccatag

SEQ ID NO: 440955 - DNA, 25 bp, Mus musculus
gatccaagtaagagactgggctgcc

SEQ ID NO: 440956 - DNA, 25 bp, Mus musculus
gatccaagtacaacatgagccctga

SEQ ID NO: 440957 - DNA, 25 bp, Mus musculus
gatccacacctgcaacctgtaggag

SEQ ID NO: 440958 - DNA, 25 bp, Mus musculus
gatccacagtgttccagtgctgagg

SEQ ID NO: 440959 - DNA, 25 bp, Mus musculus
gatccaccccgtccattgtttgaag

SEQ ID NO: 440960 - DNA, 25 bp, Mus musculus
gatccaccgtcaaaatgcagctgca

SEQ ID NO: 440961 - DNA, 25 bp, Mus musculus
gatccacgattactatgaacaccgg

SEQ ID NO: 440962 - DNA, 25 bp, Mus musculus
gatccacggcgctgaaaacaaatgt

SEQ ID NO: 440963 - DNA, 25 bp, Mus musculus
gatccactcacaaagagaatgcagg

SEQ ID NO: 440964 - DNA, 25 bp, Mus musculus
gatccactgtggagaagacattgca

SEQ ID NO: 440965 - DNA, 25 bp, Mus musculus
gatccagaaaagcaccatgggccga

SEQ ID NO: 440966 - DNA, 25 bp, Mus musculus
gatccagaaggagtgcgcccaaatt

SEQ ID NO: 440967 - DNA, 25 bp, Mus musculus
gatccagaagtacgtgaccaagcca

SEQ ID NO: 440968 - DNA, 25 bp, Mus musculus
gatccagacaaccaggtgcgagcac

SEQ ID NO: 440969 - DNA, 25 bp, Mus musculus
gatccagactcagaattccagagcg

SEQ ID NO: 440970 - DNA, 25 bp, Mus musculus
gatccagagaataagaagtcagcca

SEQ ID NO: 440971 - DNA, 25 bp, Mus musculus
gatccagagatatgcgccacgcttc

SEQ ID NO: 440972 - DNA, 25 bp, Mus musculus
gatccagagcttttgaagttattcc

SEQ ID NO: 440973 - DNA, 25 bp, Mus musculus
gatccagatatcgtaacaaagcggg

SEQ ID NO: 440974 - DNA, 25 bp, Mus musculus
gatccagatgcagaccaggaggact

SEQ ID NO: 440975 - DNA, 25 bp, Mus musculus
gatccagatttccagccggagctga

SEQ ID NO: 440976 - DNA, 25 bp, Mus musculus
gatccagcatttggcgtggctcgca

SEQ ID NO: 440977 - DNA, 25 bp, Mus musculus
gatccagccgttcactctgcgagga

SEQ ID NO: 440978 - DNA, 25 bp, Mus musculus
gatccagcgggtacaggcacttact

SEQ ID NO: 440979 - DNA, 25 bp, Mus musculus
gatccaggactgtgtgttgggccag

SEQ ID NO: 440980 - DNA, 25 bp, Mus musculus
gatccaggagatgttcagctactag

SEQ ID NO: 440981 - DNA, 25 bp, Mus musculus
gatccaggagccctacacttctgtg

SEQ ID NO: 440982 - DNA, 25 bp, Mus musculus
gatccaggcctgcaaagtcatagtg

SEQ ID NO: 440983 - DNA, 25 bp, Mus musculus
gatccaggcgtctgagaaccgcgta

SEQ ID NO: 440984 - DNA, 25 bp, Mus musculus
gatccaggctttgaggaccagctag

SEQ ID NO: 440985 - DNA, 25 bp, Mus musculus
gatccaggtggctcagtctatccag

SEQ ID NO: 440986 - DNA, 25 bp, Mus musculus
gatccaggttcaagaggcaaaccct

SEQ ID NO: 440987 - DNA, 25 bp, Mus musculus
gatccagtacggtgcagctctcatg

SEQ ID NO: 440988 - DNA, 25 bp, Mus musculus
gatccagtttctaaggcctcaccct

SEQ ID NO: 440989 - DNA, 25 bp, Mus musculus
gatccatatatcaccagcgaagcag

SEQ ID NO: 440990 - DNA, 25 bp, Mus musculus
gatccatcagcaaggtcttcacagg

SEQ ID NO: 440991 - DNA, 25 bp, Mus musculus
gatccatcccgcaaagaaacctaat

SEQ ID NO: 440992 - DNA, 25 bp, Mus musculus
gatccatccctttggtttctggttc

SEQ ID NO: 440993 - DNA, 25 bp, Mus musculus
gatccatccttattgttccgaggca

SEQ ID NO: 440994 - DNA, 25 bp, Mus musculus
gatccatggagcttgatggtcaccc

SEQ ID NO: 440995 - DNA, 25 bp, Mus musculus
gatccatgtggagctcctctggcag

SEQ ID NO: 440996 - DNA, 25 bp, Mus musculus
gatccattcacttcttctaccacta

SEQ ID NO: 440997 - DNA, 25 bp, Mus musculus
gatccattccacattcagctctgag

SEQ ID NO: 440998 - DNA, 25 bp, Mus musculus
gatccattgccggttcaagctgagc

SEQ ID NO: 440999 - DNA, 25 bp, Mus musculus
gatccattggacataagggcgacaa

SEQ ID NO: 441000 - DNA, 25 bp, Mus musculus
gatcccaaaacgacgcatgcggttg

SEQ ID NO: 441001 - DNA, 25 bp, Mus musculus
gatcccaaaatcgaagtagcccact

SEQ ID NO: 441002 - DNA, 25 bp, Mus musculus
gatcccaaactacttaataggaagc

SEQ ID NO: 441003 - DNA, 25 bp, Mus musculus
gatcccaaatgcatgcagtcttagg

SEQ ID NO: 441004 - DNA, 25 bp, Mus musculus
gatcccaacgagatttgtgtgacac

SEQ ID NO: 441005 - DNA, 25 bp, Mus musculus
gatcccaagattgcctgtaaacagg

SEQ ID NO: 441006 - DNA, 25 bp, Mus musculus
gatcccagatcccattaaataaaac

SEQ ID NO: 441007 - DNA, 25 bp, Mus musculus
gatcccagctaaatgtcgtcgaggt

SEQ ID NO: 441008 - DNA, 25 bp, Mus musculus
gatcccagctacatgggcaaacgcc

SEQ ID NO: 441009 - DNA, 25 bp, Mus musculus
gatcccaggacttgatccccaactt

SEQ ID NO: 441010 - DNA, 25 bp, Mus musculus
gatcccagtggagaacattttgcct

SEQ ID NO: 441011 - DNA, 25 bp, Mus musculus
gatcccagtttgctagcagcattga

SEQ ID NO: 441012 - DNA, 25 bp, Mus musculus
gatcccattggaatcccgagcctga

SEQ ID NO: 441013 - DNA, 25 bp, Mus musculus
gatccccaggaaggtgcataccagg

SEQ ID NO: 441014 - DNA, 25 bp, Mus musculus
gatccccaggtttccatctttatta

SEQ ID NO: 441015 - DNA, 25 bp, Mus musculus
gatccccggctcttcgtagatggca

SEQ ID NO: 441016 - DNA, 25 bp, Mus musculus
gatccccgggtgatgactactctga

SEQ ID NO: 441017 - DNA, 25 bp, Mus musculus
gatccccttggaggttcggctgaac

SEQ ID NO: 441018 - DNA, 25 bp, Mus musculus
gatcccctttggaactaagcaggca

SEQ ID NO: 441019 - DNA, 25 bp, Mus musculus
gatcccgcagctttacttttaagaa

SEQ ID NO: 441020 - DNA, 25 bp, Mus musculus
gatcccgccgctagatggcagctgg

SEQ ID NO: 441021 - DNA, 25 bp, Mus musculus
gatcccggagcctcgttagcgtgag

SEQ ID NO: 441022 - DNA, 25 bp, Mus musculus
gatcccgtcaaaatagtgagatgcc

SEQ ID NO: 441023 - DNA, 25 bp, Mus musculus
gatccctaggagaactgatgtcgag

SEQ ID NO: 441024 - DNA, 25 bp, Mus musculus
gatccctattccctattcttgttgc

SEQ ID NO: 441025 - DNA, 25 bp, Mus musculus
gatccctcaagtggagcctgctgct

SEQ ID NO: 441026 - DNA, 25 bp, Mus musculus
gatccctcccaagtggaacatctgg

SEQ ID NO: 441027 - DNA, 25 bp, Mus musculus
gatccctctcctgtactttgttctg

SEQ ID NO: 441028 - DNA, 25 bp, Mus musculus
gatccctctgctatggttaaatcta

SEQ ID NO: 441029 - DNA, 25 bp, Mus musculus
gatccctctgggtcatgtctaaagg

SEQ ID NO: 441030 - DNA, 25 bp, Mus musculus
gatccctctgtgagagcgagcaggt

SEQ ID NO: 441031 - DNA, 25 bp, Mus musculus
gatccctcttttgaggagaaagcaa

SEQ ID NO: 441032 - DNA, 25 bp, Mus musculus
gatccctgaatttgtgactccagta

SEQ ID NO: 441033 - DNA, 25 bp, Mus musculus
gatccctgaccttgcatagttgcca

SEQ ID NO: 441034 - DNA, 25 bp, Mus musculus
gatccctgagatagcaacagaggct

SEQ ID NO: 441035 - DNA, 25 bp, Mus musculus
gatccctgcaaactcctagactgtg

SEQ ID NO: 441036 - DNA, 25 bp, Mus musculus
gatccctggctctaggagctcggtt

SEQ ID NO: 441037 - DNA, 25 bp, Mus musculus
gatccctgggacttcatggtaaaag

SEQ ID NO: 441038 - DNA, 25 bp, Mus musculus
gatccctgggcctcgtggttattgg

SEQ ID NO: 441039 - DNA, 25 bp, Mus musculus
gatcccttgcaactggaagaagcag

SEQ ID NO: 441040 - DNA, 25 bp, Mus musculus
gatcccttggatactcgaagaccag

SEQ ID NO: 441041 - DNA, 25 bp, Mus musculus
gatccgaaaccaacctacagctgtg

SEQ ID NO: 441042 - DNA, 25 bp, Mus musculus
gatccgaaatttcctccatgcgaag

SEQ ID NO: 441043 - DNA, 25 bp, Mus musculus
gatccgaactcagggcaagactaga

SEQ ID NO: 441044 - DNA, 25 bp, Mus musculus
gatccgagcattaagttccgaggag

SEQ ID NO: 441045 - DNA, 25 bp, Mus musculus
gatccgatcaagtcccaggttgcta

SEQ ID NO: 441046 - DNA, 25 bp, Mus musculus
gatccgatcctgatgactacgccag

SEQ ID NO: 441047 - DNA, 25 bp, Mus musculus
gatccgattatcagtacgtgggcaa

SEQ ID NO: 441048 - DNA, 25 bp, Mus musculus
gatccgattcaaccagtactttaag

SEQ ID NO: 441049 - DNA, 25 bp, Mus musculus
gatccgattgggagccatctctcaa

SEQ ID NO: 441050 - DNA, 25 bp, Mus musculus
gatccgcaagcgaattggtccttac

SEQ ID NO: 441051 - DNA, 25 bp, Mus musculus
gatccgcaggtcagatgacaacgag

SEQ ID NO: 441052 - DNA, 25 bp, Mus musculus
gatccgcatgcgaagctggtgagaa

SEQ ID NO: 441053 - DNA, 25 bp, Mus musculus
gatccgccaggccattgaacggcaa

SEQ ID NO: 441054 - DNA, 25 bp, Mus musculus
gatccgcctgatgcctgagaagaag

SEQ ID NO: 441055 - DNA, 25 bp, Mus musculus
gatccgccttgcatgtggcttcagg

SEQ ID NO: 441056 - DNA, 25 bp, Mus musculus
gatccgcgcgtatttcaccctgagt

SEQ ID NO: 441057 - DNA, 25 bp, Mus musculus
gatccgcttacgtgaagagccaccg

SEQ ID NO: 441058 - DNA, 25 bp, Mus musculus
gatccggaagtcatggtaagcctgt

SEQ ID NO: 441059 - DNA, 25 bp, Mus musculus
gatccggagcattgcccagacagca

SEQ ID NO: 441060 - DNA, 25 bp, Mus musculus
gatccggcactgacaggattagtgg

SEQ ID NO: 441061 - DNA, 25 bp, Mus musculus
gatccggcttctgctgtattatcaa

SEQ ID NO: 441062 - DNA, 25 bp, Mus musculus
gatccgggatctgtctgagcatctc

SEQ ID NO: 441063 - DNA, 25 bp, Mus musculus
gatccgggcgcacgatgttcagaat

SEQ ID NO: 441064 - DNA, 25 bp, Mus musculus
gatccggtgaccatcgagaacaaag

SEQ ID NO: 441065 - DNA, 25 bp, Mus musculus
gatccgtattacctattgtgaacct

SEQ ID NO: 441066 - DNA, 25 bp, Mus musculus
gatccgtcagtcgtttgggctgtaa

SEQ ID NO: 441067 - DNA, 25 bp, Mus musculus
gatccgtctcggctactgcagagca

SEQ ID NO: 441068 - DNA, 25 bp, Mus musculus
gatccgtgcaaaggttgctctcctg

SEQ ID NO: 441069 - DNA, 25 bp, Mus musculus
gatccgtggcaactggacttccagc

SEQ ID NO: 441070 - DNA, 25 bp, Mus musculus
gatccgtgtggctgacgtggaccaa

SEQ ID NO: 441071 - DNA, 25 bp, Mus musculus
gatccgtgttctacaaccccttctg

SEQ ID NO: 441072 - DNA, 25 bp, Mus musculus
gatccgttagtgactggcagctgcc

SEQ ID NO: 441073 - DNA, 25 bp, Mus musculus
gatccgttcagaatgccagcaatgg

SEQ ID NO: 441074 - DNA, 25 bp, Mus musculus
gatccgtttggcctctcaattgaac

SEQ ID NO: 441075 - DNA, 25 bp, Mus musculus
gatcctaacatcagggagaggactt

SEQ ID NO: 441076 - DNA, 25 bp, Mus musculus
gatcctaattatcttcatatggtag

SEQ ID NO: 441077 - DNA, 25 bp, Mus musculus
gatcctacggaagttatggcaaagc

SEQ ID NO: 441078 - DNA, 25 bp, Mus musculus
gatcctaggaggtggcagcatttcc

SEQ ID NO: 441079 - DNA, 25 bp, Mus musculus
gatcctaggatctcagccacatctg

SEQ ID NO: 441080 - DNA, 25 bp, Mus musculus
gatcctagttacttggtctcccaga

SEQ ID NO: 441081 - DNA, 25 bp, Mus musculus
gatcctatggaaaaacgtccgtgtg

SEQ ID NO: 441082 - DNA, 25 bp, Mus musculus
gatcctcacccagagagcgggacat

SEQ ID NO: 441083 - DNA, 25 bp, Mus musculus
gatcctcacgaatgctcagggacag

SEQ ID NO: 441084 - DNA, 25 bp, Mus musculus
gatcctcagacttggtctccctcgg

SEQ ID NO: 441085 - DNA, 25 bp, Mus musculus
gatcctcaggctggaaaactgaaca

SEQ ID NO: 441086 - DNA, 25 bp, Mus musculus
gatcctcagtttggtgcagtcctcg

SEQ ID NO: 441087 - DNA, 25 bp, Mus musculus
gatcctccaggtccctgaatggcat

SEQ ID NO: 441088 - DNA, 25 bp, Mus musculus
gatcctcccaagtgaatgacagcca

SEQ ID NO: 441089 - DNA, 25 bp, Mus musculus
gatcctccggatgtggtgaagacca

SEQ ID NO: 441090 - DNA, 25 bp, Mus musculus
gatcctcctgtgagtgctgccctga

SEQ ID NO: 441091 - DNA, 25 bp, Mus musculus
gatcctcgagtattcagacgtggcg

SEQ ID NO: 441092 - DNA, 25 bp, Mus musculus
gatcctcgctctgcaaagctgcttt

SEQ ID NO: 441093 - DNA, 25 bp, Mus musculus
gatcctcgggatttgcgggaccgca

SEQ ID NO: 441094 - DNA, 25 bp, Mus musculus
gatcctcgtgtggaagtacccgtcc

SEQ ID NO: 441095 - DNA, 25 bp, Mus musculus
gatcctctcttatggtatgtctgaa

SEQ ID NO: 441096 - DNA, 25 bp, Mus musculus
gatcctctggaagcgaagtccccat

SEQ ID NO: 441097 - DNA, 25 bp, Mus musculus
gatcctctggtaaagggaatcccag

SEQ ID NO: 441098 - DNA, 25 bp, Mus musculus
gatcctctggtcatagaactcggcc

SEQ ID NO: 441099 - DNA, 25 bp, Mus musculus
gatcctcttcgattacctgacggcc

SEQ ID NO: 441100 - DNA, 25 bp, Mus musculus
gatcctcttctgctgggctcggaga

SEQ ID NO: 441101 - DNA, 25 bp, Mus musculus
gatcctgaaaccatgagcatgtggg

SEQ ID NO: 441102 - DNA, 25 bp, Mus musculus
gatcctgaaaccctgagagctatga

SEQ ID NO: 441103 - DNA, 25 bp, Mus musculus
gatcctgaagccaaacctctgatct

SEQ ID NO: 441104 - DNA, 25 bp, Mus musculus
gatcctgagaatccagcactatgtc

SEQ ID NO: 441105 - DNA, 25 bp, Mus musculus
gatcctgagctccaaagaagctggg

SEQ ID NO: 441106 - DNA, 25 bp, Mus musculus
gatcctgaggatttgggtaccaaca

SEQ ID NO: 441107 - DNA, 25 bp, Mus musculus
gatcctgagggaaagagactcctta

SEQ ID NO: 441108 - DNA, 25 bp, Mus musculus
gatcctgatcggagacctttggcca

SEQ ID NO: 441109 - DNA, 25 bp, Mus musculus
gatcctgatgacgaagttacgagca

SEQ ID NO: 441110 - DNA, 25 bp, Mus musculus
gatcctgatgctggcgtccctggac

SEQ ID NO: 441111 - DNA, 25 bp, Mus musculus
gatcctgatttcatcgccagctttg

SEQ ID NO: 441112 - DNA, 25 bp, Mus musculus
gatcctgcagcgagatgggacagca

SEQ ID NO: 441113 - DNA, 25 bp, Mus musculus
gatcctgcaggccaacattcggtgg

SEQ ID NO: 441114 - DNA, 25 bp, Mus musculus
gatcctgccgagtgccggattgcac

SEQ ID NO: 441115 - DNA, 25 bp, Mus musculus
gatcctgctagggtacaaccagctg

SEQ ID NO: 441116 - DNA, 25 bp, Mus musculus
gatcctgctcagttttgcttccggg

SEQ ID NO: 441117 - DNA, 25 bp, Mus musculus
gatcctggaaaagcgcaaagggcca

SEQ ID NO: 441118 - DNA, 25 bp, Mus musculus
gatcctggaagtgcagtagctcctg

SEQ ID NO: 441119 - DNA, 25 bp, Mus musculus
gatcctggaataaggcgtctgcctc

SEQ ID NO: 441120 - DNA, 25 bp, Mus musculus
gatcctggacaagatcatgattctc

SEQ ID NO: 441121 - DNA, 25 bp, Mus musculus
gatcctggaccagacacctgtaaag

SEQ ID NO: 441122 - DNA, 25 bp, Mus musculus
gatcctggagccgtgttctgacctg

SEQ ID NO: 441123 - DNA, 25 bp, Mus musculus
gatcctggatgagaaatgctgtgcc

SEQ ID NO: 441124 - DNA, 25 bp, Mus musculus
gatcctggatgtgtaagaagacctc

SEQ ID NO: 441125 - DNA, 25 bp, Mus musculus
gatcctggatttctacaccgcgagc

SEQ ID NO: 441126 - DNA, 25 bp, Mus musculus
gatcctggcacttgtctgggaactg

SEQ ID NO: 441127 - DNA, 25 bp, Mus musculus
gatcctggcaggttacaaatactgt

SEQ ID NO: 441128 - DNA, 25 bp, Mus musculus
gatcctggctcaccatagacgtgga

SEQ ID NO: 441129 - DNA, 25 bp, Mus musculus
gatcctgggactagtgaatggctca

SEQ ID NO: 441130 - DNA, 25 bp, Mus musculus
gatcctgggtatgctagagtgcctg

SEQ ID NO: 441131 - DNA, 25 bp, Mus musculus
gatcctggtaatgatgagctactac

SEQ ID NO: 441132 - DNA, 25 bp, Mus musculus
gatcctggtcctgaagagggagcct

SEQ ID NO: 441133 - DNA, 25 bp, Mus musculus
gatcctggtgtagccctgcatggta

SEQ ID NO: 441134 - DNA, 25 bp, Mus musculus
gatcctgtacctgaggcaaaaaaca

SEQ ID NO: 441135 - DNA, 25 bp, Mus musculus
gatcctgtccaacaagaagccggag

SEQ ID NO: 441136 - DNA, 25 bp, Mus musculus
gatcctgtgcatctacaaatgctca

SEQ ID NO: 441137 - DNA, 25 bp, Mus musculus
gatcctgtgcggaaagagaaaccaa

SEQ ID NO: 441138 - DNA, 25 bp, Mus musculus
gatcctgttttggtattctttttgc

SEQ ID NO: 441139 - DNA, 25 bp, Mus musculus
gatccttcggaacagcgctcaagtt

SEQ ID NO: 441140 - DNA, 25 bp, Mus musculus
gatccttctacccttccagggcaca

SEQ ID NO: 441141 - DNA, 25 bp, Mus musculus
gatccttctgtggagagatgcccga

SEQ ID NO: 441142 - DNA, 25 bp, Mus musculus
gatccttgactgcaactggctggta

SEQ ID NO: 441143 - DNA, 25 bp, Mus musculus
gatccttgtgaaaggtttgttccac

SEQ ID NO: 441144 - DNA, 25 bp, Mus musculus
gatcctttcacccaaacaaacaatg

SEQ ID NO: 441145 - DNA, 25 bp, Mus musculus
gatcctttcccctgagcatgcactt

SEQ ID NO: 441146 - DNA, 25 bp, Mus musculus
gatcctttcctttcctgcgagtgct

SEQ ID NO: 441147 - DNA, 25 bp, Mus musculus
gatcctttggaaccagagtacacac

SEQ ID NO: 441148 - DNA, 25 bp, Mus musculus
gatccttttaggcaatacgctccaa

SEQ ID NO: 441149 - DNA, 25 bp, Mus musculus
gatcgaaccaatcccctgaacatca

SEQ ID NO: 441150 - DNA, 25 bp, Mus musculus
gatcgaaggcctaacagattcctgg

SEQ ID NO: 441151 - DNA, 25 bp, Mus musculus
gatcgaatgcatccctatctggcca

SEQ ID NO: 441152 - DNA, 25 bp, Mus musculus
gatcgaatggagtgtgacaaagcta

SEQ ID NO: 441153 - DNA, 25 bp, Mus musculus
gatcgaatttccctgtgcctcaagg

SEQ ID NO: 441154 - DNA, 25 bp, Mus musculus
gatcgacaaccaagccaaagacatg

SEQ ID NO: 441155 - DNA, 25 bp, Mus musculus
gatcgacaatttcttcagtgagccg

SEQ ID NO: 441156 - DNA, 25 bp, Mus musculus
gatcgacatgtagttcctccagctg

SEQ ID NO: 441157 - DNA, 25 bp, Mus musculus
gatcgacccatctgcttgactatag

SEQ ID NO: 441158 - DNA, 25 bp, Mus musculus
gatcgacccggagcagctaagcaat

SEQ ID NO: 441159 - DNA, 25 bp, Mus musculus
gatcgagaaccaaaagtgacctgag

SEQ ID NO: 441160 - DNA, 25 bp, Mus musculus
gatcgagaagatcttgacggacgcc

SEQ ID NO: 441161 - DNA, 25 bp, Mus musculus
gatcgagatcactccatcccacgaa

SEQ ID NO: 441162 - DNA, 25 bp, Mus musculus
gatcgagcacgaccctatggttgag

SEQ ID NO: 441163 - DNA, 25 bp, Mus musculus
gatcgagcatacctacactggcggc

SEQ ID NO: 441164 - DNA, 25 bp, Mus musculus
gatcgagctgccactactattctgt

SEQ ID NO: 441165 - DNA, 25 bp, Mus musculus
gatcgaggccaagtttgacaaggaa

SEQ ID NO: 441166 - DNA, 25 bp, Mus musculus
gatcgagtcctacaagcatgaccgg

SEQ ID NO: 441167 - DNA, 25 bp, Mus musculus
gatcgagttccgtgggctaattatt

SEQ ID NO: 441168 - DNA, 25 bp, Mus musculus
gatcgatacttgctgctgcacccag

SEQ ID NO: 441169 - DNA, 25 bp, Mus musculus
gatcgatcaccactgcatgaagctg

SEQ ID NO: 441170 - DNA, 25 bp, Mus musculus
gatcgatgaccttaagacgcagctg

SEQ ID NO: 441171 - DNA, 25 bp, Mus musculus
gatcgatgtctccacagagggcgtt

SEQ ID NO: 441172 - DNA, 25 bp, Mus musculus
gatcgatgtgagtggttctatgaac

SEQ ID NO: 441173 - DNA, 25 bp, Mus musculus
gatcgatgtttacggcatggtgccc

SEQ ID NO: 441174 - DNA, 25 bp, Mus musculus
gatcgattgtccacatccaatggga

SEQ ID NO: 441175 - DNA, 25 bp, Mus musculus
gatcgcaaatcctggcttactcctt

SEQ ID NO: 441176 - DNA, 25 bp, Mus musculus
gatcgcacataaggccatcagctca

SEQ ID NO: 441177 - DNA, 25 bp, Mus musculus
gatcgcagagggtatcatgccacgc

SEQ ID NO: 441178 - DNA, 25 bp, Mus musculus
gatcgcagggtcatgctaggtgcca

SEQ ID NO: 441179 - DNA, 25 bp, Mus musculus
gatcgcagggttatttcagtggacc

SEQ ID NO: 441180 - DNA, 25 bp, Mus musculus
gatcgcagtgttatgccagtagctg

SEQ ID NO: 441181 - DNA, 25 bp, Mus musculus
gatcgccaagaaaggcagcgaagtg

SEQ ID NO: 441182 - DNA, 25 bp, Mus musculus
gatcgccatcgctctgctgaaggaa

SEQ ID NO: 441183 - DNA, 25 bp, Mus musculus
gatcgcccatgccaatttagaatga

SEQ ID NO: 441184 - DNA, 25 bp, Mus musculus
gatcgccccactcagttcttgaagg

SEQ ID NO: 441185 - DNA, 25 bp, Mus musculus
gatcgccgacctcaagaaatggaag

SEQ ID NO: 441186 - DNA, 25 bp, Mus musculus
gatcgccgcgcaactactggcatat

SEQ ID NO: 441187 - DNA, 25 bp, Mus musculus
gatcgccgcgtcagccggtttcgcg

SEQ ID NO: 441188 - DNA, 25 bp, Mus musculus
gatcgccttgccctgtatgattttg

SEQ ID NO: 441189 - DNA, 25 bp, Mus musculus
gatcgcgagtcaggttctgcacagc

SEQ ID NO: 441190 - DNA, 25 bp, Mus musculus
gatcgcgcgcctggagaaagagttc

SEQ ID NO: 441191 - DNA, 25 bp, Mus musculus
gatcgcggttcctgtcgtgctgact

SEQ ID NO: 441192 - DNA, 25 bp, Mus musculus
gatcgcggttgctcttcagtcgcca

SEQ ID NO: 441193 - DNA, 25 bp, Mus musculus
gatcgctcgctatactactgggtca

SEQ ID NO: 441194 - DNA, 25 bp, Mus musculus
gatcgctgacactgggagttctgag

SEQ ID NO: 441195 - DNA, 25 bp, Mus musculus
gatcgctgctcacacccttggagat

SEQ ID NO: 441196 - DNA, 25 bp, Mus musculus
gatcgctgtctgctatcttttaaaa

SEQ ID NO: 441197 - DNA, 25 bp, Mus musculus
gatcgcttccgcctccatgagatct

SEQ ID NO: 441198 - DNA, 25 bp, Mus musculus
gatcgctttcaacgccaagattgga

SEQ ID NO: 441199 - DNA, 25 bp, Mus musculus
gatcggaaccgacccagctttgatg

SEQ ID NO: 441200 - DNA, 25 bp, Mus musculus
gatcggaagtgtctagctcatgtca

SEQ ID NO: 441201 - DNA, 25 bp, Mus musculus
gatcggcagtcttttggctgctact

SEQ ID NO: 441202 - DNA, 25 bp, Mus musculus
gatcggctcattgaggtaccctggg

SEQ ID NO: 441203 - DNA, 25 bp, Mus musculus
gatcggctgtatgccttggaccaga

SEQ ID NO: 441204 - DNA, 25 bp, Mus musculus
gatcgggaccctcaccctttgtgtg

SEQ ID NO: 441205 - DNA, 25 bp, Mus musculus
gatcgggcaccagggaagcaattga

SEQ ID NO: 441206 - DNA, 25 bp, Mus musculus
gatcgggcttaaccataaaaatgag

SEQ ID NO: 441207 - DNA, 25 bp, Mus musculus
gatcggtatgttgccatctgtaagc

SEQ ID NO: 441208 - DNA, 25 bp, Mus musculus
gatcggtcacacaattgcaggagca

SEQ ID NO: 441209 - DNA, 25 bp, Mus musculus
gatcggtcccttacagttgagctcg

SEQ ID NO: 441210 - DNA, 25 bp, Mus musculus
gatcggtgtcctgcaatagtattag

SEQ ID NO: 441211 - DNA, 25 bp, Mus musculus
gatcgtcaaccatgtggcccggttt

SEQ ID NO: 441212 - DNA, 25 bp, Mus musculus
gatcgtcaagtggaacctgctaacc

SEQ ID NO: 441213 - DNA, 25 bp, Mus musculus
gatcgtcagacaagcccatcaggat

SEQ ID NO: 441214 - DNA, 25 bp, Mus musculus
gatcgtcattgtgctttttgttaaa

SEQ ID NO: 441215 - DNA, 25 bp, Mus musculus
gatcgtccatctgttctaaagactt

SEQ ID NO: 441216 - DNA, 25 bp, Mus musculus
gatcgtccggagacatagctttaca

SEQ ID NO: 441217 - DNA, 25 bp, Mus musculus
gatcgtctcagtgtcctgattccca

SEQ ID NO: 441218 - DNA, 25 bp, Mus musculus
gatcgtctgccttgtcttgccggga

SEQ ID NO: 441219 - DNA, 25 bp, Mus musculus
gatcgtcttcgtgtcttcggaccaa

SEQ ID NO: 441220 - DNA, 25 bp, Mus musculus
gatcgtgaagaacctcccgaatggg

SEQ ID NO: 441221 - DNA, 25 bp, Mus musculus
gatcgtgaagatacccagtacagcc

SEQ ID NO: 441222 - DNA, 25 bp, Mus musculus
gatcgtgaccagcacctacaaggga

SEQ ID NO: 441223 - DNA, 25 bp, Mus musculus
gatcgtgagaatgacccttagcctg

SEQ ID NO: 441224 - DNA, 25 bp, Mus musculus
gatcgtgcagcacttgtttatattc

SEQ ID NO: 441225 - DNA, 25 bp, Mus musculus
gatcgtggtctcacggaatgcaaac

SEQ ID NO: 441226 - DNA, 25 bp, Mus musculus
gatcgtgtagaagaagtgccctggc

SEQ ID NO: 441227 - DNA, 25 bp, Mus musculus
gatcgtgtcatctcatgctccccat

SEQ ID NO: 441228 - DNA, 25 bp, Mus musculus
gatcgttatcaagaagggcctggag

SEQ ID NO: 441229 - DNA, 25 bp, Mus musculus
gatcgttctggtcggccagcgtaac

SEQ ID NO: 441230 - DNA, 25 bp, Mus musculus
gatctaaaaacaacagacacttctc

SEQ ID NO: 441231 - DNA, 25 bp, Mus musculus
gatctaaacccaagtcctatgcagg

SEQ ID NO: 441232 - DNA, 25 bp, Mus musculus
gatctaacccaggagaaaacccgct

SEQ ID NO: 441233 - DNA, 25 bp, Mus musculus
gatctaacgtgtggtgcctgggaaa

SEQ ID NO: 441234 - DNA, 25 bp, Mus musculus
gatctaataaaccaagtggcctggg

SEQ ID NO: 441235 - DNA, 25 bp, Mus musculus
gatctaattggtcctgagtggcgtc

SEQ ID NO: 441236 - DNA, 25 bp, Mus musculus
gatctacaccaaagcgggtgcgcct

SEQ ID NO: 441237 - DNA, 25 bp, Mus musculus
gatctacagaaggtaagggagcatt

SEQ ID NO: 441238 - DNA, 25 bp, Mus musculus
gatctacagacacccacgaagagga

SEQ ID NO: 441239 - DNA, 25 bp, Mus musculus
gatctacagcgtgccctggaaaggc

SEQ ID NO: 441240 - DNA, 25 bp, Mus musculus
gatctacagctagaatcatggcaaa

SEQ ID NO: 441241 - DNA, 25 bp, Mus musculus
gatctacagcttcgccattcgccta

SEQ ID NO: 441242 - DNA, 25 bp, Mus musculus
gatctacatcaacgctctgtcggag

SEQ ID NO: 441243 - DNA, 25 bp, Mus musculus
gatctacccttcttggaactgggct

SEQ ID NO: 441244 - DNA, 25 bp, Mus musculus
gatctaccgcggagaggaagcttca

SEQ ID NO: 441245 - DNA, 25 bp, Mus musculus
gatctaccgtaccttggaaaccctg

SEQ ID NO: 441246 - DNA, 25 bp, Mus musculus
gatctacctattctcgctcctggct

SEQ ID NO: 441247 - DNA, 25 bp, Mus musculus
gatctacgaactggaggagcacaag

SEQ ID NO: 441248 - DNA, 25 bp, Mus musculus
gatctacgaggtctgctccaacggc

SEQ ID NO: 441249 - DNA, 25 bp, Mus musculus
gatctactcataggagggtcccagg

SEQ ID NO: 441250 - DNA, 25 bp, Mus musculus
gatctactccttagtgacaatacta

SEQ ID NO: 441251 - DNA, 25 bp, Mus musculus
gatctactcggcaaacctagtgcgt

SEQ ID NO: 441252 - DNA, 25 bp, Mus musculus
gatctagagacagagcgaaggcttc

SEQ ID NO: 441253 - DNA, 25 bp, Mus musculus
gatctagagcggaggcgctagcaca

SEQ ID NO: 441254 - DNA, 25 bp, Mus musculus
gatctagcagcagaaagcagctcta

SEQ ID NO: 441255 - DNA, 25 bp, Mus musculus
gatctagccatctgcgatctggacg

SEQ ID NO: 441256 - DNA, 25 bp, Mus musculus
gatctagcctgcaggacttaaaggg

SEQ ID NO: 441257 - DNA, 25 bp, Mus musculus
gatctagctcctgcttgagtccgga

SEQ ID NO: 441258 - DNA, 25 bp, Mus musculus
gatctagctgccctcaattccaagc

SEQ ID NO: 441259 - DNA, 25 bp, Mus musculus
gatctaggaatggttgactatagcg

SEQ ID NO: 441260 - DNA, 25 bp, Mus musculus
gatctaggagtccatcccaacagcg

SEQ ID NO: 441261 - DNA, 25 bp, Mus musculus
gatctaggtctgaagagtgcctcct

SEQ ID NO: 441262 - DNA, 25 bp, Mus musculus
gatctatcagtgtacagaatgcaag

SEQ ID NO: 441263 - DNA, 25 bp, Mus musculus
gatctatctcatccacaacggtggc

SEQ ID NO: 441264 - DNA, 25 bp, Mus musculus
gatctatgatcagaatgactcttgt

SEQ ID NO: 441265 - DNA, 25 bp, Mus musculus
gatctatgccactgggtgcacggtt

SEQ ID NO: 441266 - DNA, 25 bp, Mus musculus
gatctattatctcgttctctagtga

SEQ ID NO: 441267 - DNA, 25 bp, Mus musculus
gatctattgcaagtcatgttacggc

SEQ ID NO: 441268 - DNA, 25 bp, Mus musculus
gatctcaaagacaaccaactagtgg

SEQ ID NO: 441269 - DNA, 25 bp, Mus musculus
gatctcaacatggagctgcctcagg

SEQ ID NO: 441270 - DNA, 25 bp, Mus musculus
gatctcaatatggaactaccacagg

SEQ ID NO: 441271 - DNA, 25 bp, Mus musculus
gatctcaattcacagacaaggttgg

SEQ ID NO: 441272 - DNA, 25 bp, Mus musculus
gatctcactgccagtcatcgggctg

SEQ ID NO: 441273 - DNA, 25 bp, Mus musculus
gatctcagacacatccacgggaagg

SEQ ID NO: 441274 - DNA, 25 bp, Mus musculus
gatctcagagtcagagtgggaacca

SEQ ID NO: 441275 - DNA, 25 bp, Mus musculus
gatctcagccggcttaatgactgga

SEQ ID NO: 441276 - DNA, 25 bp, Mus musculus
gatctcaggacagaggaagccatga

SEQ ID NO: 441277 - DNA, 25 bp, Mus musculus
gatctcatcaagagagcccggctgg

SEQ ID NO: 441278 - DNA, 25 bp, Mus musculus
gatctcatccgaacatggctccagc

SEQ ID NO: 441279 - DNA, 25 bp, Mus musculus
gatctcattagcagattccctcctg

SEQ ID NO: 441280 - DNA, 25 bp, Mus musculus
gatctccacggacaggactctgatg

SEQ ID NO: 441281 - DNA, 25 bp, Mus musculus
gatctccagccatcctcaggtagaa

SEQ ID NO: 441282 - DNA, 25 bp, Mus musculus
gatctccatgtacaccctcagtagg

SEQ ID NO: 441283 - DNA, 25 bp, Mus musculus
gatctcccagttggaaatggctcga

SEQ ID NO: 441284 - DNA, 25 bp, Mus musculus
gatctccgaagagtgagtcttctgg

SEQ ID NO: 441285 - DNA, 25 bp, Mus musculus
gatctccgagactctggctcgaggg

SEQ ID NO: 441286 - DNA, 25 bp, Mus musculus
gatctcctaactccacaaaggcatg

SEQ ID NO: 441287 - DNA, 25 bp, Mus musculus
gatctcctaaggtgggacacaccct

SEQ ID NO: 441288 - DNA, 25 bp, Mus musculus
gatctcctcgaggtagcctaagccg

SEQ ID NO: 441289 - DNA, 25 bp, Mus musculus
gatctcctggtagcatgacctttgg

SEQ ID NO: 441290 - DNA, 25 bp, Mus musculus
gatctcctgttgtatcatgagagaa

SEQ ID NO: 441291 - DNA, 25 bp, Mus musculus
gatctccttgctagagaccgctagg

SEQ ID NO: 441292 - DNA, 25 bp, Mus musculus
gatctccttttgcaagttggccggg

SEQ ID NO: 441293 - DNA, 25 bp, Mus musculus
gatctcggaagtgcggacagccact

SEQ ID NO: 441294 - DNA, 25 bp, Mus musculus
gatctcggacgacaatgccaagcta

SEQ ID NO: 441295 - DNA, 25 bp, Mus musculus
gatctcggacggagcctcagtttct

SEQ ID NO: 441296 - DNA, 25 bp, Mus musculus
gatctcggcgttcctgtgtcttctt

SEQ ID NO: 441297 - DNA, 25 bp, Mus musculus
gatctcggttgtctcccaagtcgga

SEQ ID NO: 441298 - DNA, 25 bp, Mus musculus
gatctcgtgatcgtcgtggccgtca

SEQ ID NO: 441299 - DNA, 25 bp, Mus musculus
gatctctacgggaacaatgcagcag

SEQ ID NO: 441300 - DNA, 25 bp, Mus musculus
gatctctataacttaaggagcttgg

SEQ ID NO: 441301 - DNA, 25 bp, Mus musculus
gatctctccgctggaagtgctcgac

SEQ ID NO: 441302 - DNA, 25 bp, Mus musculus
gatctctcgggtatgaaaggccaaa

SEQ ID NO: 441303 - DNA, 25 bp, Mus musculus
gatctctctgtgtctgctccaaatg

SEQ ID NO: 441304 - DNA, 25 bp, Mus musculus
gatctctgaattacggagtctttag

SEQ ID NO: 441305 - DNA, 25 bp, Mus musculus
gatctctgacaacagcatgtgccca

SEQ ID NO: 441306 - DNA, 25 bp, Mus musculus
gatctctgaggattacaggctgccc

SEQ ID NO: 441307 - DNA, 25 bp, Mus musculus
gatctctgccggctagacacttgca

SEQ ID NO: 441308 - DNA, 25 bp, Mus musculus
gatctctgcgcccaagagcagggaa

SEQ ID NO: 441309 - DNA, 25 bp, Mus musculus
gatctctggtgttgatgcaaaacca

SEQ ID NO: 441310 - DNA, 25 bp, Mus musculus
gatctctgtgactccatccttcagt

SEQ ID NO: 441311 - DNA, 25 bp, Mus musculus
gatctctgtggacgaagccttgcgc

SEQ ID NO: 441312 - DNA, 25 bp, Mus musculus
gatctctgttttggttgtaactcgc

SEQ ID NO: 441313 - DNA, 25 bp, Mus musculus
gatctcttaacaacccctgaccagg

SEQ ID NO: 441314 - DNA, 25 bp, Mus musculus
gatctcttccagtcaagaccagctt

SEQ ID NO: 441315 - DNA, 25 bp, Mus musculus
gatctcttccagtgggcggtgagcc

SEQ ID NO: 441316 - DNA, 25 bp, Mus musculus
gatctgaaatatgatgccgctggaa

SEQ ID NO: 441317 - DNA, 25 bp, Mus musculus
gatctgaagaatgcagccccgtgtg

SEQ ID NO: 441318 - DNA, 25 bp, Mus musculus
gatctgaagtgcaaaatactttcca

SEQ ID NO: 441319 - DNA, 25 bp, Mus musculus
gatctgaatccccttctggctgtgg

SEQ ID NO: 441320 - DNA, 25 bp, Mus musculus
gatctgacagccaggtgcgcaagct

SEQ ID NO: 441321 - DNA, 25 bp, Mus musculus
gatctgacccctgtagacatcgtag

SEQ ID NO: 441322 - DNA, 25 bp, Mus musculus
gatctgacgttggagaggaaccttg

SEQ ID NO: 441323 - DNA, 25 bp, Mus musculus
gatctgactgggattgcatgagaga

SEQ ID NO: 441324 - DNA, 25 bp, Mus musculus
gatctgacttgggaattctccttgg

SEQ ID NO: 441325 - DNA, 25 bp, Mus musculus
gatctgagaaatctggcccctggtg

SEQ ID NO: 441326 - DNA, 25 bp, Mus musculus
gatctgagatccaagcatggcctgg

SEQ ID NO: 441327 - DNA, 25 bp, Mus musculus
gatctgaggattccacttctgggca

SEQ ID NO: 441328 - DNA, 25 bp, Mus musculus
gatctgagtctgcttccaggcccgt

SEQ ID NO: 441329 - DNA, 25 bp, Mus musculus
gatctgagtgagctaactggcacca

SEQ ID NO: 441330 - DNA, 25 bp, Mus musculus
gatctgataccaggaagtgtggcca

SEQ ID NO: 441331 - DNA, 25 bp, Mus musculus
gatctgatcagaccgccacaatgag

SEQ ID NO: 441332 - DNA, 25 bp, Mus musculus
gatctgatggagttctgatagccta

SEQ ID NO: 441333 - DNA, 25 bp, Mus musculus
gatctgcaggagaccatggacatga

SEQ ID NO: 441334 - DNA, 25 bp, Mus musculus
gatctgcaggtaccgcattacatgc

SEQ ID NO: 441335 - DNA, 25 bp, Mus musculus
gatctgcatcgcacgggctgtagtt

SEQ ID NO: 441336 - DNA, 25 bp, Mus musculus
gatctgccgaacatgggcaaccact

SEQ ID NO: 441337 - DNA, 25 bp, Mus musculus
gatctgccgctctgtcacacggtgg

SEQ ID NO: 441338 - DNA, 25 bp, Mus musculus
gatctgcctccagcgataccagtga

SEQ ID NO: 441339 - DNA, 25 bp, Mus musculus
gatctgcctgttgtagtcttagcct

SEQ ID NO: 441340 - DNA, 25 bp, Mus musculus
gatctgcgacaagtacctcccaggt

SEQ ID NO: 441341 - DNA, 25 bp, Mus musculus
gatctgcgatcaagcctcggtcaag

SEQ ID NO: 441342 - DNA, 25 bp, Mus musculus
gatctgcggacaattgtgccttggg

SEQ ID NO: 441343 - DNA, 25 bp, Mus musculus
gatctgcggcttcaatcaggctgaa

SEQ ID NO: 441344 - DNA, 25 bp, Mus musculus
gatctgctggacatctaacaatggg

SEQ ID NO: 441345 - DNA, 25 bp, Mus musculus
gatctggaacaccaactgctcagtc

SEQ ID NO: 441346 - DNA, 25 bp, Mus musculus
gatctggaagtccaactgcgtgccg

SEQ ID NO: 441347 - DNA, 25 bp, Mus musculus
gatctggacccgctgaatccaaggg

SEQ ID NO: 441348 - DNA, 25 bp, Mus musculus
gatctggaccttgccgttaataaag

SEQ ID NO: 441349 - DNA, 25 bp, Mus musculus
gatctggagcatatttaagccgaca

SEQ ID NO: 441350 - DNA, 25 bp, Mus musculus
gatctggatcaacaaaggctgcaca

SEQ ID NO: 441351 - DNA, 25 bp, Mus musculus
gatctggcagcacccgaggtttgca

SEQ ID NO: 441352 - DNA, 25 bp, Mus musculus
gatctggcagtcatagcttggcacc

SEQ ID NO: 441353 - DNA, 25 bp, Mus musculus
gatctggccaaaatccccaagagcg

SEQ ID NO: 441354 - DNA, 25 bp, Mus musculus
gatctgggagtcagctcaggaccaa

SEQ ID NO: 441355 - DNA, 25 bp, Mus musculus
gatctgggcacctactcgtccttga

SEQ ID NO: 441356 - DNA, 25 bp, Mus musculus
gatctgggccataagcatcaccatg

SEQ ID NO: 441357 - DNA, 25 bp, Mus musculus
gatctgggctcttccatattcatca

SEQ ID NO: 441358 - DNA, 25 bp, Mus musculus
gatctgggtgtttcctccactgaac

SEQ ID NO: 441359 - DNA, 25 bp, Mus musculus
gatctgggttgtcactgtttgtgcc

SEQ ID NO: 441360 - DNA, 25 bp, Mus musculus
gatctggtcaagtaaggctccctgg

SEQ ID NO: 441361 - DNA, 25 bp, Mus musculus
gatctggtcgtgttcctagcgctca

SEQ ID NO: 441362 - DNA, 25 bp, Mus musculus
gatctggtgacaggagagcaagccc

SEQ ID NO: 441363 - DNA, 25 bp, Mus musculus
gatctggtgctggaccgaatccgta

SEQ ID NO: 441364 - DNA, 25 bp, Mus musculus
gatctggtggacaataaccgcagca

SEQ ID NO: 441365 - DNA, 25 bp, Mus musculus
gatctggtggtcaaggaagtccgac

SEQ ID NO: 441366 - DNA, 25 bp, Mus musculus
gatctgtacagccacaatgcgccag

SEQ ID NO: 441367 - DNA, 25 bp, Mus musculus
gatctgtacctgtgcacagtgagct

SEQ ID NO: 441368 - DNA, 25 bp, Mus musculus
gatctgtactgtggctaataccgca

SEQ ID NO: 441369 - DNA, 25 bp, Mus musculus
gatctgtagggtcatggcatctgct

SEQ ID NO: 441370 - DNA, 25 bp, Mus musculus
gatctgtctcttgctcgttccgtga

SEQ ID NO: 441371 - DNA, 25 bp, Mus musculus
gatctgtctgattcctcctctcatg

SEQ ID NO: 441372 - DNA, 25 bp, Mus musculus
gatctgtcttggctacttggtgaaa

SEQ ID NO: 441373 - DNA, 25 bp, Mus musculus
gatctgtgacaacatccccggtctg

SEQ ID NO: 441374 - DNA, 25 bp, Mus musculus
gatctgtgactttggactggcccga

SEQ ID NO: 441375 - DNA, 25 bp, Mus musculus
gatctgtgagtcagccttagcaggg

SEQ ID NO: 441376 - DNA, 25 bp, Mus musculus
gatctgtgatctgaatgtaggctgg

SEQ ID NO: 441377 - DNA, 25 bp, Mus musculus
gatctgtgtccctttcgcagactca

SEQ ID NO: 441378 - DNA, 25 bp, Mus musculus
gatctgttattgtagttgtgactct

SEQ ID NO: 441379 - DNA, 25 bp, Mus musculus
gatctgttgggcacaccatcactgg

SEQ ID NO: 441380 - DNA, 25 bp, Mus musculus
gatctgttggtaagtcctgagtgca

SEQ ID NO: 441381 - DNA, 25 bp, Mus musculus
gatctgttgtctaagagccctcact

SEQ ID NO: 441382 - DNA, 25 bp, Mus musculus
gatcttaacctccagtagcaaattg

SEQ ID NO: 441383 - DNA, 25 bp, Mus musculus
gatcttacatatgatgttggcccaa

SEQ ID NO: 441384 - DNA, 25 bp, Mus musculus
gatcttacgagcgttgaaggccaaa

SEQ ID NO: 441385 - DNA, 25 bp, Mus musculus
gatcttacgtacactgataccagga

SEQ ID NO: 441386 - DNA, 25 bp, Mus musculus
gatcttagagcctgggacctaaaac

SEQ ID NO: 441387 - DNA, 25 bp, Mus musculus
gatcttagatcacctgtagcctgga

SEQ ID NO: 441388 - DNA, 25 bp, Mus musculus
gatcttatcttgaccgggactccaa

SEQ ID NO: 441389 - DNA, 25 bp, Mus musculus
gatcttcaacctctgtagacaccga

SEQ ID NO: 441390 - DNA, 25 bp, Mus musculus
gatcttcaagaagagacctgtgacc

SEQ ID NO: 441391 - DNA, 25 bp, Mus musculus
gatcttcacaaataccagggagcgg

SEQ ID NO: 441392 - DNA, 25 bp, Mus musculus
gatcttcaggcctcaacgctgtctt

SEQ ID NO: 441393 - DNA, 25 bp, Mus musculus
gatcttcagggatggctgagaccca

SEQ ID NO: 441394 - DNA, 25 bp, Mus musculus
gatcttcagggtatgaggaaacttc

SEQ ID NO: 441395 - DNA, 25 bp, Mus musculus
gatcttcagtgtgggaccacctggc

SEQ ID NO: 441396 - DNA, 25 bp, Mus musculus
gatcttccggatactcattgtggcc

SEQ ID NO: 441397 - DNA, 25 bp, Mus musculus
gatcttcctgaatcagtctctcaaa

SEQ ID NO: 441398 - DNA, 25 bp, Mus musculus
gatcttcggatctatgtttacgtga

SEQ ID NO: 441399 - DNA, 25 bp, Mus musculus
gatcttcgggaatgctgctgtgctt

SEQ ID NO: 441400 - DNA, 25 bp, Mus musculus
gatcttcgggacacctttgcagcca

SEQ ID NO: 441401 - DNA, 25 bp, Mus musculus
gatcttctatgcctgcctagccgga

SEQ ID NO: 441402 - DNA, 25 bp, Mus musculus
gatcttctctaggaacttgggccgc

SEQ ID NO: 441403 - DNA, 25 bp, Mus musculus
gatcttctggagtaccaagcacaca

SEQ ID NO: 441404 - DNA, 25 bp, Mus musculus
gatcttgaaaagacagtggaccagc

SEQ ID NO: 441405 - DNA, 25 bp, Mus musculus
gatcttgaacctaccctctcctgtg

SEQ ID NO: 441406 - DNA, 25 bp, Mus musculus
gatcttgagactgtcatcccgccag

SEQ ID NO: 441407 - DNA, 25 bp, Mus musculus
gatcttgagggcctagacttaagag

SEQ ID NO: 441408 - DNA, 25 bp, Mus musculus
gatcttgctagaaacttccctgggc

SEQ ID NO: 441409 - DNA, 25 bp, Mus musculus
gatcttgctgaacatcggcctggct

SEQ ID NO: 441410 - DNA, 25 bp, Mus musculus
gatcttggaggcatatcaactgtcg

SEQ ID NO: 441411 - DNA, 25 bp, Mus musculus
gatcttggcccttcatgcaggtagc

SEQ ID NO: 441412 - DNA, 25 bp, Mus musculus
gatcttggccgagatggagacgcaa

SEQ ID NO: 441413 - DNA, 25 bp, Mus musculus
gatcttggcgtaacattgaccacca

SEQ ID NO: 441414 - DNA, 25 bp, Mus musculus
gatcttgggaagagggcacctacgc

SEQ ID NO: 441415 - DNA, 25 bp, Mus musculus
gatcttgggctgctcaaactcgcgt

SEQ ID NO: 441416 - DNA, 25 bp, Mus musculus
gatctttacccagtcgacgacacgg

SEQ ID NO: 441417 - DNA, 25 bp, Mus musculus
gatctttctaccatgagggactgga

SEQ ID NO: 441418 - DNA, 25 bp, Mus musculus
gatctttcttcttctgccggtgcgg

SEQ ID NO: 441419 - DNA, 25 bp, Mus musculus
gatctttctttcatgcggcccttgg

SEQ ID NO: 441420 - DNA, 25 bp, Mus musculus
gatctttgacatgttgctggctacg

SEQ ID NO: 441421 - DNA, 25 bp, Mus musculus
gatctttgcttgtcttgcctcccag

SEQ ID NO: 441422 - DNA, 25 bp, Mus musculus
gatctttggctacaacacagggctc

SEQ ID NO: 441423 - DNA, 25 bp, Mus musculus
gatctttgtataggttctctcagac

SEQ ID NO: 441424 - DNA, 25 bp, Mus musculus
gatctttgtccggtgtgggctaccc

SEQ ID NO: 441425 - DNA, 25 bp, Mus musculus
gatcttttagttttgagccctgcga

SEQ ID NO: 441426 - DNA, 25 bp, Mus musculus
gatcttttcgtgtcctgccggcagg

SEQ ID NO: 441427 - DNA, 25 bp, Mus musculus
gatcttttgaacgaagccctttttg

SEQ ID NO: 441428 - DNA, 25 bp, Mus musculus
gatcttttgataatttataccttag

SEQ ID NO: 441429 - DNA, 25 bp, Mus musculus
gatcttttggtgcaggtgtatcctg

SEQ ID NO: 441430 - DNA, 25 bp, Mus musculus
gatgaaaaactgtaagcctgcgtga

SEQ ID NO: 441431 - DNA, 25 bp, Mus musculus
gatgaaaagcataccacagaagaaa

SEQ ID NO: 441432 - DNA, 25 bp, Mus musculus
gatgaaaagtctcgtactagcctca

SEQ ID NO: 441433 - DNA, 25 bp, Mus musculus
gatgaaaatatgacgaggtccacgc

SEQ ID NO: 441434 - DNA, 25 bp, Mus musculus
gatgaaaatgataacgcaccggaga

SEQ ID NO: 441435 - DNA, 25 bp, Mus musculus
gatgaaacaagcatgcagctccctg

SEQ ID NO: 441436 - DNA, 25 bp, Mus musculus
gatgaaacaccactcagaagcttgg

SEQ ID NO: 441437 - DNA, 25 bp, Mus musculus
gatgaaaccctgcagcatgctttaa

SEQ ID NO: 441438 - DNA, 25 bp, Mus musculus
gatgaaagaactctagaggaagaag

SEQ ID NO: 441439 - DNA, 25 bp, Mus musculus
gatgaaagaatacagctgcgacacc

SEQ ID NO: 441440 - DNA, 25 bp, Mus musculus
gatgaaagcttccagccccttggtg

SEQ ID NO: 441441 - DNA, 25 bp, Mus musculus
gatgaaagggacaaactcacctgct

SEQ ID NO: 441442 - DNA, 25 bp, Mus musculus
gatgaaatcagagaagaaggaccct

SEQ ID NO: 441443 - DNA, 25 bp, Mus musculus
gatgaaatcagcctggccaaggaga

SEQ ID NO: 441444 - DNA, 25 bp, Mus musculus
gatgaaatccaccaaagctcacgcg

SEQ ID NO: 441445 - DNA, 25 bp, Mus musculus
gatgaaatcgcaggcaggcacagtt

SEQ ID NO: 441446 - DNA, 25 bp, Mus musculus
gatgaaatctccttctagactttga

SEQ ID NO: 441447 - DNA, 25 bp, Mus musculus
gatgaaatcttcctcctgacggcag

SEQ ID NO: 441448 - DNA, 25 bp, Mus musculus
gatgaaatgcaaatcgcttcgcgct

SEQ ID NO: 441449 - DNA, 25 bp, Mus musculus
gatgaaatgtgtgcactagctccca

SEQ ID NO: 441450 - DNA, 25 bp, Mus musculus
gatgaaattgatgcggctctgccca

SEQ ID NO: 441451 - DNA, 25 bp, Mus musculus
gatgaaatttcccagctccgaatgc

SEQ ID NO: 441452 - DNA, 25 bp, Mus musculus
gatgaacaaagacttagggaagcct

SEQ ID NO: 441453 - DNA, 25 bp, Mus musculus
gatgaacaagctatggcccgagtct

SEQ ID NO: 441454 - DNA, 25 bp, Mus musculus
gatgaacacagtagcccagctggta

SEQ ID NO: 441455 - DNA, 25 bp, Mus musculus
gatgaacacatggacactgcagaag

SEQ ID NO: 441456 - DNA, 25 bp, Mus musculus
gatgaacagccatgcccaaactggg

SEQ ID NO: 441457 - DNA, 25 bp, Mus musculus
gatgaacatcaagtcagcaacgtgg

SEQ ID NO: 441458 - DNA, 25 bp, Mus musculus
gatgaacatcccagagtacgacgac

SEQ ID NO: 441459 - DNA, 25 bp, Mus musculus
gatgaacatccgaacctacctggtg

SEQ ID NO: 441460 - DNA, 25 bp, Mus musculus
gatgaacattcttatacattccttc

SEQ ID NO: 441461 - DNA, 25 bp, Mus musculus
gatgaaccattgcttgcctgaggga

SEQ ID NO: 441462 - DNA, 25 bp, Mus musculus
gatgaacccacggaaaacgatgccc

SEQ ID NO: 441463 - DNA, 25 bp, Mus musculus
gatgaacccacttggctacaggcat

SEQ ID NO: 441464 - DNA, 25 bp, Mus musculus
gatgaaccctcatgtgtgcgaggca

SEQ ID NO: 441465 - DNA, 25 bp, Mus musculus
gatgaaccgcttccgacagagcttg

SEQ ID NO: 441466 - DNA, 25 bp, Mus musculus
gatgaaccgggcttacctgcagagc

SEQ ID NO: 441467 - DNA, 25 bp, Mus musculus
gatgaacctatcagacccagggaaa

SEQ ID NO: 441468 - DNA, 25 bp, Mus musculus
gatgaacctggacgacctaacaaga

SEQ ID NO: 441469 - DNA, 25 bp, Mus musculus
gatgaacctgtagccaccaagatgg

SEQ ID NO: 441470 - DNA, 25 bp, Mus musculus
gatgaacgcacagctgaccatggag

SEQ ID NO: 441471 - DNA, 25 bp, Mus musculus
gatgaacggctgactactcaagaca

SEQ ID NO: 441472 - DNA, 25 bp, Mus musculus
gatgaactaaggacacagactcgca

SEQ ID NO: 441473 - DNA, 25 bp, Mus musculus
gatgaactccaccagcagacagtgt

SEQ ID NO: 441474 - DNA, 25 bp, Mus musculus
gatgaactccagagccgttaggacg

SEQ ID NO: 441475 - DNA, 25 bp, Mus musculus
gatgaactgagaacgtcctggaagg

SEQ ID NO: 441476 - DNA, 25 bp, Mus musculus
gatgaactggttaagcaggctggcc

SEQ ID NO: 441477 - DNA, 25 bp, Mus musculus
gatgaagaactccttcgggccctgg

SEQ ID NO: 441478 - DNA, 25 bp, Mus musculus
gatgaagaagaagattaacatggag

SEQ ID NO: 441479 - DNA, 25 bp, Mus musculus
gatgaagaatctactcccaggctga

SEQ ID NO: 441480 - DNA, 25 bp, Mus musculus
gatgaagacagccacatagtgaaga

SEQ ID NO: 441481 - DNA, 25 bp, Mus musculus
gatgaagacgactatcccaacggct

SEQ ID NO: 441482 - DNA, 25 bp, Mus musculus
gatgaagatctcacgcccggatgtc

SEQ ID NO: 441483 - DNA, 25 bp, Mus musculus
gatgaagatcttgctcctccgtaaa

SEQ ID NO: 441484 - DNA, 25 bp, Mus musculus
gatgaagcactgaagatagcaggct

SEQ ID NO: 441485 - DNA, 25 bp, Mus musculus
gatgaagcagattcgccacgtcagc

SEQ ID NO: 441486 - DNA, 25 bp, Mus musculus
gatgaagccatcgacaagaagatca

SEQ ID NO: 441487 - DNA, 25 bp, Mus musculus
gatgaagccccctgaataaacctgg

SEQ ID NO: 441488 - DNA, 25 bp, Mus musculus
gatgaagccgctgatctggaaaggc

SEQ ID NO: 441489 - DNA, 25 bp, Mus musculus
gatgaagccttattgcgtaacctgc

SEQ ID NO: 441490 - DNA, 25 bp, Mus musculus
gatgaagccttctagacccatgtga

SEQ ID NO: 441491 - DNA, 25 bp, Mus musculus
gatgaagcgcctcatgtcctgagga

SEQ ID NO: 441492 - DNA, 25 bp, Mus musculus
gatgaagctcattatcctggaacac

SEQ ID NO: 441493 - DNA, 25 bp, Mus musculus
gatgaagctcgaggctgcagacaaa

SEQ ID NO: 441494 - DNA, 25 bp, Mus musculus
gatgaagctgactccgtgtttttaa

SEQ ID NO: 441495 - DNA, 25 bp, Mus musculus
gatgaagctgtgactggcccattga

SEQ ID NO: 441496 - DNA, 25 bp, Mus musculus
gatgaagcttgccactcggctagcg

SEQ ID NO: 441497 - DNA, 25 bp, Mus musculus
gatgaaggaccttgtgtctcggcca

SEQ ID NO: 441498 - DNA, 25 bp, Mus musculus
gatgaagggcccaggcatgcagaat

SEQ ID NO: 441499 - DNA, 25 bp, Mus musculus
gatgaaggtctctacacgatccgag

SEQ ID NO: 441500 - DNA, 25 bp, Mus musculus
gatgaagtcatcactgagaggaaga

SEQ ID NO: 441501 - DNA, 25 bp, Mus musculus
gatgaagtcatcagagacgcgccat

SEQ ID NO: 441502 - DNA, 25 bp, Mus musculus
gatgaagtcattgaatatgacggcg

SEQ ID NO: 441503 - DNA, 25 bp, Mus musculus
gatgaagtgagcagcattgtaaagg

SEQ ID NO: 441504 - DNA, 25 bp, Mus musculus
gatgaagtgctaatgagcccgtgtt

SEQ ID NO: 441505 - DNA, 25 bp, Mus musculus
gatgaagttaaggaaccctcccgtg

SEQ ID NO: 441506 - DNA, 25 bp, Mus musculus
gatgaagttcccctgaagatcctgg

SEQ ID NO: 441507 - DNA, 25 bp, Mus musculus
gatgaagttcgacagctatgcgcgc

SEQ ID NO: 441508 - DNA, 25 bp, Mus musculus
gatgaagttgtaaaggccacctcca

SEQ ID NO: 441509 - DNA, 25 bp, Mus musculus
gatgaataccgagctttccaggaag

SEQ ID NO: 441510 - DNA, 25 bp, Mus musculus
gatgaataccgcaaagagcacgaga

SEQ ID NO: 441511 - DNA, 25 bp, Mus musculus
gatgaatatctaactcaggacccgc

SEQ ID NO: 441512 - DNA, 25 bp, Mus musculus
gatgaatcaggcaccgactgtgggc

SEQ ID NO: 441513 - DNA, 25 bp, Mus musculus
gatgaatcctggaacatgtcctgta

SEQ ID NO: 441514 - DNA, 25 bp, Mus musculus
gatgaatcggaggaagacatcccca

SEQ ID NO: 441515 - DNA, 25 bp, Mus musculus
gatgaatctaacaaaaactgcagtc

SEQ ID NO: 441516 - DNA, 25 bp, Mus musculus
gatgaatctccaggtggcacagtga

SEQ ID NO: 441517 - DNA, 25 bp, Mus musculus
gatgaatctgattgggcactcccat

SEQ ID NO: 441518 - DNA, 25 bp, Mus musculus
gatgaatgcagaggcctcaagcacc

SEQ ID NO: 441519 - DNA, 25 bp, Mus musculus
gatgaatgcatcgtggccctacatg

SEQ ID NO: 441520 - DNA, 25 bp, Mus musculus
gatgaatggcatcactacgccctga

SEQ ID NO: 441521 - DNA, 25 bp, Mus musculus
gatgaatgtaccagtgccgtgagca

SEQ ID NO: 441522 - DNA, 25 bp, Mus musculus
gatgaatgtaccttgtgccaacctg

SEQ ID NO: 441523 - DNA, 25 bp, Mus musculus
gatgaatgtcatggctaaggctgag

SEQ ID NO: 441524 - DNA, 25 bp, Mus musculus
gatgaattaacctgccactgtggcg

SEQ ID NO: 441525 - DNA, 25 bp, Mus musculus
gatgaattcagtactaaaaggtgct

SEQ ID NO: 441526 - DNA, 25 bp, Mus musculus
gatgaattctgccttatgccttgac

SEQ ID NO: 441527 - DNA, 25 bp, Mus musculus
gatgaattctttcaggaggcccaga

SEQ ID NO: 441528 - DNA, 25 bp, Mus musculus
gatgaattgcccttggatgagcgct

SEQ ID NO: 441529 - DNA, 25 bp, Mus musculus
gatgaatttcacacacaggcagacc

SEQ ID NO: 441530 - DNA, 25 bp, Mus musculus
gatgacaaacctctccaccgaatgg

SEQ ID NO: 441531 - DNA, 25 bp, Mus musculus
gatgacaaccatgcatatggactgt

SEQ ID NO: 441532 - DNA, 25 bp, Mus musculus
gatgacaacgaacctgagtgccagt

SEQ ID NO: 441533 - DNA, 25 bp, Mus musculus
gatgacaactacgtcaacctccggg

SEQ ID NO: 441534 - DNA, 25 bp, Mus musculus
gatgacaactacgtgaaccccaaaa

SEQ ID NO: 441535 - DNA, 25 bp, Mus musculus
gatgacaactatgtgaaccccaagg

SEQ ID NO: 441536 - DNA, 25 bp, Mus musculus
gatgacaaggcctgtgcacacttct

SEQ ID NO: 441537 - DNA, 25 bp, Mus musculus
gatgacaagtgggacacactgccca

SEQ ID NO: 441538 - DNA, 25 bp, Mus musculus
gatgacaattgcctacgaaagtgga

SEQ ID NO: 441539 - DNA, 25 bp, Mus musculus
gatgacacagctgcaaaaacccttg

SEQ ID NO: 441540 - DNA, 25 bp, Mus musculus
gatgacacataccacactcagggaa

SEQ ID NO: 441541 - DNA, 25 bp, Mus musculus
gatgacaccactcaccatgggaagc

SEQ ID NO: 441542 - DNA, 25 bp, Mus musculus
gatgacaccgacgatcaggcagatg

SEQ ID NO: 441543 - DNA, 25 bp, Mus musculus
gatgacagaatcaggagaaagatgc

SEQ ID NO: 441544 - DNA, 25 bp, Mus musculus
gatgacagacgtgctcagcgctgag

SEQ ID NO: 441545 - DNA, 25 bp, Mus musculus
gatgacagcaccagccatagtgacc

SEQ ID NO: 441546 - DNA, 25 bp, Mus musculus
gatgacagcttagaaagaagagggc

SEQ ID NO: 441547 - DNA, 25 bp, Mus musculus
gatgacaggtcaatgctccgagtgg

SEQ ID NO: 441548 - DNA, 25 bp, Mus musculus
gatgacaggttctttcgcagggctg

SEQ ID NO: 441549 - DNA, 25 bp, Mus musculus
gatgacagtgaaccctccagaaaag

SEQ ID NO: 441550 - DNA, 25 bp, Mus musculus
gatgacagtgagtgcctcagtatcc

SEQ ID NO: 441551 - DNA, 25 bp, Mus musculus
gatgacagtgtccttgaagcttcca

SEQ ID NO: 441552 - DNA, 25 bp, Mus musculus
gatgacatatatagcacagtgcctc

SEQ ID NO: 441553 - DNA, 25 bp, Mus musculus
gatgacatcgacttggtggctgaca

SEQ ID NO: 441554 - DNA, 25 bp, Mus musculus
gatgacatctcttttacctggcgct

SEQ ID NO: 441555 - DNA, 25 bp, Mus musculus
gatgacatctgtaagatagactttg

SEQ ID NO: 441556 - DNA, 25 bp, Mus musculus
gatgacatggattttacacagctga

SEQ ID NO: 441557 - DNA, 25 bp, Mus musculus
gatgacatgtccagcaccagtgaag

SEQ ID NO: 441558 - DNA, 25 bp, Mus musculus
gatgacattctctaccacgtgaagg

SEQ ID NO: 441559 - DNA, 25 bp, Mus musculus
gatgacattgtggactaacgctaga

SEQ ID NO: 441560 - DNA, 25 bp, Mus musculus
gatgacatttgcaccattacaaagg

SEQ ID NO: 441561 - DNA, 25 bp, Mus musculus
gatgaccaaagtaaaggccgctccc

SEQ ID NO: 441562 - DNA, 25 bp, Mus musculus
gatgaccacatgcttatacagaacg

SEQ ID NO: 441563 - DNA, 25 bp, Mus musculus
gatgaccacatggagtactgccgag

SEQ ID NO: 441564 - DNA, 25 bp, Mus musculus
gatgaccacgtagttgcaagagcag

SEQ ID NO: 441565 - DNA, 25 bp, Mus musculus
gatgaccagacactacttgagcaga

SEQ ID NO: 441566 - DNA, 25 bp, Mus musculus
gatgaccagcaatagaatcttagct

SEQ ID NO: 441567 - DNA, 25 bp, Mus musculus
gatgaccaggccgttgtgctgaaag

SEQ ID NO: 441568 - DNA, 25 bp, Mus musculus
gatgaccatcaagggcaacttcagt

SEQ ID NO: 441569 - DNA, 25 bp, Mus musculus
gatgaccattgatcatgcctttaac

SEQ ID NO: 441570 - DNA, 25 bp, Mus musculus
gatgacccacatatccactggaatc

SEQ ID NO: 441571 - DNA, 25 bp, Mus musculus
gatgacccactgtttaaagtttctg

SEQ ID NO: 441572 - DNA, 25 bp, Mus musculus
gatgacccgcgttggatcggagcct

SEQ ID NO: 441573 - DNA, 25 bp, Mus musculus
gatgacccggctactgacaatgctc

SEQ ID NO: 441574 - DNA, 25 bp, Mus musculus
gatgaccctgaaacactggaaaata

SEQ ID NO: 441575 - DNA, 25 bp, Mus musculus
gatgaccctgccttcgacatgcaag

SEQ ID NO: 441576 - DNA, 25 bp, Mus musculus
gatgaccgcaatctgtaccgttgtg

SEQ ID NO: 441577 - DNA, 25 bp, Mus musculus
gatgaccgttaccttttaagcctga

SEQ ID NO: 441578 - DNA, 25 bp, Mus musculus
gatgacctaccagaagatggcgcgc

SEQ ID NO: 441579 - DNA, 25 bp, Mus musculus
gatgacctacctaagacctgatttg

SEQ ID NO: 441580 - DNA, 25 bp, Mus musculus
gatgacctagacgtgcttaccagga

SEQ ID NO: 441581 - DNA, 25 bp, Mus musculus
gatgacctcgtcatgggagtctaca

SEQ ID NO: 441582 - DNA, 25 bp, Mus musculus
gatgacctctgtggctgagtctcag

SEQ ID NO: 441583 - DNA, 25 bp, Mus musculus
gatgaccttatttggagactgagcc

SEQ ID NO: 441584 - DNA, 25 bp, Mus musculus
gatgaccttgaacttacgattccct

SEQ ID NO: 441585 - DNA, 25 bp, Mus musculus
gatgaccttggacagctagtgtgca

SEQ ID NO: 441586 - DNA, 25 bp, Mus musculus
gatgacgaaaaccttgccactgagt

SEQ ID NO: 441587 - DNA, 25 bp, Mus musculus
gatgacgaccactctgagggaggcc

SEQ ID NO: 441588 - DNA, 25 bp, Mus musculus
gatgacgatgttgacctttccaggg

SEQ ID NO: 441589 - DNA, 25 bp, Mus musculus
gatgacgattttgaggaccctgact

SEQ ID NO: 441590 - DNA, 25 bp, Mus musculus
gatgacgcatcaggcaaaggcacct

SEQ ID NO: 441591 - DNA, 25 bp, Mus musculus
gatgacgccatcttgctagaggaac

SEQ ID NO: 441592 - DNA, 25 bp, Mus musculus
gatgacggagacctttatgaatctg

SEQ ID NO: 441593 - DNA, 25 bp, Mus musculus
gatgacgtaattgacggctacccgg

SEQ ID NO: 441594 - DNA, 25 bp, Mus musculus
gatgacgtatatgttgcgcaggcgc

SEQ ID NO: 441595 - DNA, 25 bp, Mus musculus
gatgacgtcaactgctcagggaagg

SEQ ID NO: 441596 - DNA, 25 bp, Mus musculus
gatgacgtcatcctgaacgagcctt

SEQ ID NO: 441597 - DNA, 25 bp, Mus musculus
gatgacgttgaccatcctgctgccg

SEQ ID NO: 441598 - DNA, 25 bp, Mus musculus
gatgactaaatgatggaagccaaag

SEQ ID NO: 441599 - DNA, 25 bp, Mus musculus
gatgactactgagttcctgccgctg

SEQ ID NO: 441600 - DNA, 25 bp, Mus musculus
gatgactaggagttttcaaggagga

SEQ ID NO: 441601 - DNA, 25 bp, Mus musculus
gatgactatcttaggacacctttgg

SEQ ID NO: 441602 - DNA, 25 bp, Mus musculus
gatgactcagttgacactggctgcc

SEQ ID NO: 441603 - DNA, 25 bp, Mus musculus
gatgactcagttgacgctggccctg

SEQ ID NO: 441604 - DNA, 25 bp, Mus musculus
gatgactccacagtagatgcaggaa

SEQ ID NO: 441605 - DNA, 25 bp, Mus musculus
gatgactccctatgtggtaactcga

SEQ ID NO: 441606 - DNA, 25 bp, Mus musculus
gatgactccctggagaacggacagt

SEQ ID NO: 441607 - DNA, 25 bp, Mus musculus
gatgactccggtgcttggtacagaa

SEQ ID NO: 441608 - DNA, 25 bp, Mus musculus
gatgactcctagagattcaggctgg

SEQ ID NO: 441609 - DNA, 25 bp, Mus musculus
gatgactcttcaatccagggtgcca

SEQ ID NO: 441610 - DNA, 25 bp, Mus musculus
gatgactgaacagcgccagaagaca

SEQ ID NO: 441611 - DNA, 25 bp, Mus musculus
gatgactgcagaaaggatccgggcc

SEQ ID NO: 441612 - DNA, 25 bp, Mus musculus
gatgactgtgctcattcccaagctc

SEQ ID NO: 441613 - DNA, 25 bp, Mus musculus
gatgacttccagacaccactttgtg

SEQ ID NO: 441614 - DNA, 25 bp, Mus musculus
gatgacttccataacctacgactga

SEQ ID NO: 441615 - DNA, 25 bp, Mus musculus
gatgacttctacacggccactgaga

SEQ ID NO: 441616 - DNA, 25 bp, Mus musculus
gatgacttctacttcggcggtcccg

SEQ ID NO: 441617 - DNA, 25 bp, Mus musculus
gatgacttggaagctcaggatgccc

SEQ ID NO: 441618 - DNA, 25 bp, Mus musculus
gatgactttagatgctccgaccctt

SEQ ID NO: 441619 - DNA, 25 bp, Mus musculus
gatgactttgacaacttggccctga

SEQ ID NO: 441620 - DNA, 25 bp, Mus musculus
gatgagaacattaaaaacagctttt

SEQ ID NO: 441621 - DNA, 25 bp, Mus musculus
gatgagaacccagccctagagtttg

SEQ ID NO: 441622 - DNA, 25 bp, Mus musculus
gatgagaaccgtttcgtggccgtca

SEQ ID NO: 441623 - DNA, 25 bp, Mus musculus
gatgagaacctaccaaacaagccca

SEQ ID NO: 441624 - DNA, 25 bp, Mus musculus
gatgagaagcccgtggaagccatta

SEQ ID NO: 441625 - DNA, 25 bp, Mus musculus
gatgagaaggctaatggaacgcacc

SEQ ID NO: 441626 - DNA, 25 bp, Mus musculus
gatgagaataaaccggcacaaccct

SEQ ID NO: 441627 - DNA, 25 bp, Mus musculus
gatgagaatcgctccctggctggga

SEQ ID NO: 441628 - DNA, 25 bp, Mus musculus
gatgagaattactggcaccgctgct

SEQ ID NO: 441629 - DNA, 25 bp, Mus musculus
gatgagacaggcaccaacagtgaga

SEQ ID NO: 441630 - DNA, 25 bp, Mus musculus
gatgagacagttccaggccatgcga

SEQ ID NO: 441631 - DNA, 25 bp, Mus musculus
gatgagacccttgttgccaggaaaa

SEQ ID NO: 441632 - DNA, 25 bp, Mus musculus
gatgagaccgtgctgttccgctact

SEQ ID NO: 441633 - DNA, 25 bp, Mus musculus
gatgagacctggtttctagggatgc

SEQ ID NO: 441634 - DNA, 25 bp, Mus musculus
gatgagacctgtaagcttgcctgta

SEQ ID NO: 441635 - DNA, 25 bp, Mus musculus
gatgagactgaagctactacacgca

SEQ ID NO: 441636 - DNA, 25 bp, Mus musculus
gatgagacttggcattctaccccag

SEQ ID NO: 441637 - DNA, 25 bp, Mus musculus
gatgagagagattcccagttcccca

SEQ ID NO: 441638 - DNA, 25 bp, Mus musculus
gatgagagcatcctggacactgtca

SEQ ID NO: 441639 - DNA, 25 bp, Mus musculus
gatgagagccactcctcgtgtgcga

SEQ ID NO: 441640 - DNA, 25 bp, Mus musculus
gatgagagctggtttgttacccctc

SEQ ID NO: 441641 - DNA, 25 bp, Mus musculus
gatgagaggtctacacaagcagtgc

SEQ ID NO: 441642 - DNA, 25 bp, Mus musculus
gatgagagtacctcgtcagcaacct

SEQ ID NO: 441643 - DNA, 25 bp, Mus musculus
gatgagatcaacttcacgagagtcc

SEQ ID NO: 441644 - DNA, 25 bp, Mus musculus
gatgagatccgcaagaacctgggca

SEQ ID NO: 441645 - DNA, 25 bp, Mus musculus
gatgagatccttaaccactgctggg

SEQ ID NO: 441646 - DNA, 25 bp, Mus musculus
gatgagatctagagttgggaccctg

SEQ ID NO: 441647 - DNA, 25 bp, Mus musculus
gatgagatgctactcaaggcttgcg

SEQ ID NO: 441648 - DNA, 25 bp, Mus musculus
gatgagatgtacctaagagaccacc

SEQ ID NO: 441649 - DNA, 25 bp, Mus musculus
gatgagatgtctgttgcatcccgta

SEQ ID NO: 441650 - DNA, 25 bp, Mus musculus
gatgagcaaacgagtcaaggcccta

SEQ ID NO: 441651 - DNA, 25 bp, Mus musculus
gatgagcaagtatgttggaacacca

SEQ ID NO: 441652 - DNA, 25 bp, Mus musculus
gatgagcagacacctagaatgggaa

SEQ ID NO: 441653 - DNA, 25 bp, Mus musculus
gatgagcagacatcatgcccagtct

SEQ ID NO: 441654 - DNA, 25 bp, Mus musculus
gatgagcagagcaaccacgatatca

SEQ ID NO: 441655 - DNA, 25 bp, Mus musculus
gatgagcagataagaaaagcgtcct

SEQ ID NO: 441656 - DNA, 25 bp, Mus musculus
gatgagcagatagaatgttaccgcc

SEQ ID NO: 441657 - DNA, 25 bp, Mus musculus
gatgagcagatgtcttaacgccgcg

SEQ ID NO: 441658 - DNA, 25 bp, Mus musculus
gatgagcaggcgaaggctccccgac

SEQ ID NO: 441659 - DNA, 25 bp, Mus musculus
gatgagcagtttgtcccagattttc

SEQ ID NO: 441660 - DNA, 25 bp, Mus musculus
gatgagcatgatttcctgggccagt

SEQ ID NO: 441661 - DNA, 25 bp, Mus musculus
gatgagccaagggtttccgtctgag

SEQ ID NO: 441662 - DNA, 25 bp, Mus musculus
gatgagccacaaactgcgcatagga

SEQ ID NO: 441663 - DNA, 25 bp, Mus musculus
gatgagccacttcttccggagactg

SEQ ID NO: 441664 - DNA, 25 bp, Mus musculus
gatgagccatatccccgacttgtgg

SEQ ID NO: 441665 - DNA, 25 bp, Mus musculus
gatgagcccaggtcctttgttcttg

SEQ ID NO: 441666 - DNA, 25 bp, Mus musculus
gatgagccccatggtgaagagtccc

SEQ ID NO: 441667 - DNA, 25 bp, Mus musculus
gatgagccgaaatcgaatcgctgaa

SEQ ID NO: 441668 - DNA, 25 bp, Mus musculus
gatgagccgctgtcttcaagtgtac

SEQ ID NO: 441669 - DNA, 25 bp, Mus musculus
gatgagccgttactgagagaaaacc

SEQ ID NO: 441670 - DNA, 25 bp, Mus musculus
gatgagcgaccttacacctgtgaca

SEQ ID NO: 441671 - DNA, 25 bp, Mus musculus
gatgagcgcctcacttggattacag

SEQ ID NO: 441672 - DNA, 25 bp, Mus musculus
gatgagcgtcatcaactctgcagga

SEQ ID NO: 441673 - DNA, 25 bp, Mus musculus
gatgagcgtgggtacccgaagctct

SEQ ID NO: 441674 - DNA, 25 bp, Mus musculus
gatgagctaaccaaggatacattcc

SEQ ID NO: 441675 - DNA, 25 bp, Mus musculus
gatgagctacattgtggccgcgcct

SEQ ID NO: 441676 - DNA, 25 bp, Mus musculus
gatgagctactactggtcagcctgt

SEQ ID NO: 441677 - DNA, 25 bp, Mus musculus
gatgagctcagcacagattttcaga

SEQ ID NO: 441678 - DNA, 25 bp, Mus musculus
gatgagctgaacgagcaggcttgct

SEQ ID NO: 441679 - DNA, 25 bp, Mus musculus
gatgagctgaggtttgctaggccaa

SEQ ID NO: 441680 - DNA, 25 bp, Mus musculus
gatgagctgatcgaaattgagagcg

SEQ ID NO: 441681 - DNA, 25 bp, Mus musculus
gatgagctggacaagtattcggaag

SEQ ID NO: 441682 - DNA, 25 bp, Mus musculus
gatgagctggcctttgctgaggacc

SEQ ID NO: 441683 - DNA, 25 bp, Mus musculus
gatgagctggttagacccttccaag

SEQ ID NO: 441684 - DNA, 25 bp, Mus musculus
gatgagcttcagtgggatcttccgc

SEQ ID NO: 441685 - DNA, 25 bp, Mus musculus
gatgagcttgcaaactctccatggg

SEQ ID NO: 441686 - DNA, 25 bp, Mus musculus
gatgaggactcttcgggaaatcagg

SEQ ID NO: 441687 - DNA, 25 bp, Mus musculus
gatgaggagccattggaattaaaca

SEQ ID NO: 441688 - DNA, 25 bp, Mus musculus
gatgaggatgacgactgcacttaca

SEQ ID NO: 441689 - DNA, 25 bp, Mus musculus
gatgaggattacaatggacaagcca

SEQ ID NO: 441690 - DNA, 25 bp, Mus musculus
gatgaggcataagcgcctttctccc

SEQ ID NO: 441691 - DNA, 25 bp, Mus musculus
gatgaggccaccctttggagctgca

SEQ ID NO: 441692 - DNA, 25 bp, Mus musculus
gatgaggctatcctagctgccctcg

SEQ ID NO: 441693 - DNA, 25 bp, Mus musculus
gatgagggactgacctagaaagatt

SEQ ID NO: 441694 - DNA, 25 bp, Mus musculus
gatgagggccccagagatgtacaga

SEQ ID NO: 441695 - DNA, 25 bp, Mus musculus
gatgagggcctgaataaaaagcctg

SEQ ID NO: 441696 - DNA, 25 bp, Mus musculus
gatgagggtttccatctcccaggga

SEQ ID NO: 441697 - DNA, 25 bp, Mus musculus
gatgaggtatacagcctgacagcca

SEQ ID NO: 441698 - DNA, 25 bp, Mus musculus
gatgaggtcacttggctggttcgcc

SEQ ID NO: 441699 - DNA, 25 bp, Mus musculus
gatgagtacaccagctctgtaggct

SEQ ID NO: 441700 - DNA, 25 bp, Mus musculus
gatgagtacatgctgcccttcgagg

SEQ ID NO: 441701 - DNA, 25 bp, Mus musculus
gatgagtcatcttaaggcaaagcac

SEQ ID NO: 441702 - DNA, 25 bp, Mus musculus
gatgagtccccacttgcttcctgag

SEQ ID NO: 441703 - DNA, 25 bp, Mus musculus
gatgagtccgaagctgtagcgcaga

SEQ ID NO: 441704 - DNA, 25 bp, Mus musculus
gatgagtctgatttctaccccacca

SEQ ID NO: 441705 - DNA, 25 bp, Mus musculus
gatgagtgaacatttttccttccct

SEQ ID NO: 441706 - DNA, 25 bp, Mus musculus
gatgagtgcaacctcggccattgtg

SEQ ID NO: 441707 - DNA, 25 bp, Mus musculus
gatgagtggaggcaaaaacatttgc

SEQ ID NO: 441708 - DNA, 25 bp, Mus musculus
gatgagtggtgttgaccgtttctct

SEQ ID NO: 441709 - DNA, 25 bp, Mus musculus
gatgagttaccgagctgagcctctt

SEQ ID NO: 441710 - DNA, 25 bp, Mus musculus
gatgagttatttaaaatgggcaaca

SEQ ID NO: 441711 - DNA, 25 bp, Mus musculus
gatgagttcactaacacgtgtccgg

SEQ ID NO: 441712 - DNA, 25 bp, Mus musculus
gatgagttccgactgaagatctgct

SEQ ID NO: 441713 - DNA, 25 bp, Mus musculus
gatgagttcctgagcttcgtccctg

SEQ ID NO: 441714 - DNA, 25 bp, Mus musculus
gatgagttcgcccaatacatggagc

SEQ ID NO: 441715 - DNA, 25 bp, Mus musculus
gatgagttctttctgtccctcagga

SEQ ID NO: 441716 - DNA, 25 bp, Mus musculus
gatgagttgggttgtcagcctgttc

SEQ ID NO: 441717 - DNA, 25 bp, Mus musculus
gatgagtttcccaagtacctgcgca

SEQ ID NO: 441718 - DNA, 25 bp, Mus musculus
gatgagtttctgagcttcgtgccca

SEQ ID NO: 441719 - DNA, 25 bp, Mus musculus
gatgataacacctaccttgcagggt

SEQ ID NO: 441720 - DNA, 25 bp, Mus musculus
gatgataaccgtggccttgggcaag

SEQ ID NO: 441721 - DNA, 25 bp, Mus musculus
gatgataactgaagcacttgcctac

SEQ ID NO: 441722 - DNA, 25 bp, Mus musculus
gatgataatacaagccacgggaaga

SEQ ID NO: 441723 - DNA, 25 bp, Mus musculus
gatgatacagacaggacagccagga

SEQ ID NO: 441724 - DNA, 25 bp, Mus musculus
gatgatacagagcatgtctgcagag

SEQ ID NO: 441725 - DNA, 25 bp, Mus musculus
gatgatatcatcaacgtgctgcaag

SEQ ID NO: 441726 - DNA, 25 bp, Mus musculus
gatgatattatgctatccacaggct

SEQ ID NO: 441727 - DNA, 25 bp, Mus musculus
gatgatattgaatgcccgctgggct

SEQ ID NO: 441728 - DNA, 25 bp, Mus musculus
gatgatcaaccatttgcaggaggca

SEQ ID NO: 441729 - DNA, 25 bp, Mus musculus
gatgatcaccattacacctgtggcc

SEQ ID NO: 441730 - DNA, 25 bp, Mus musculus
gatgatcagggtacctgtcatcccc

SEQ ID NO: 441731 - DNA, 25 bp, Mus musculus
gatgatccatctcttcttctgactg

SEQ ID NO: 441732 - DNA, 25 bp, Mus musculus
gatgatcccaatgagtaggctggag

SEQ ID NO: 441733 - DNA, 25 bp, Mus musculus
gatgatccggagcacttagctgcca

SEQ ID NO: 441734 - DNA, 25 bp, Mus musculus
gatgatccggctttcggcggccctt

SEQ ID NO: 441735 - DNA, 25 bp, Mus musculus
gatgatccgggcctatggtctgcac

SEQ ID NO: 441736 - DNA, 25 bp, Mus musculus
gatgatcctggctagcaagcagcct

SEQ ID NO: 441737 - DNA, 25 bp, Mus musculus
gatgatctaattggtcctgagtggc

SEQ ID NO: 441738 - DNA, 25 bp, Mus musculus
gatgatctagtgagcgaactatcta

SEQ ID NO: 441739 - DNA, 25 bp, Mus musculus
gatgatctatctccaagcctttgca

SEQ ID NO: 441740 - DNA, 25 bp, Mus musculus
gatgatctgactctgtgcaaggctg

SEQ ID NO: 441741 - DNA, 25 bp, Mus musculus
gatgatctgcttgcggatcccagag

SEQ ID NO: 441742 - DNA, 25 bp, Mus musculus
gatgatctgtaccacaagaggctga

SEQ ID NO: 441743 - DNA, 25 bp, Mus musculus
gatgatcttgatgccttcactcagg

SEQ ID NO: 441744 - DNA, 25 bp, Mus musculus
gatgatgaaaagaaggccggcccat

SEQ ID NO: 441745 - DNA, 25 bp, Mus musculus
gatgatgaactttcctaccggcgag

SEQ ID NO: 441746 - DNA, 25 bp, Mus musculus
gatgatgaccgtccttcctggcgta

SEQ ID NO: 441747 - DNA, 25 bp, Mus musculus
gatgatgacctttcaaaagtggcag

SEQ ID NO: 441748 - DNA, 25 bp, Mus musculus
gatgatgacgctgagacacttgcca

SEQ ID NO: 441749 - DNA, 25 bp, Mus musculus
gatgatgagaaacgacagtggcacc

SEQ ID NO: 441750 - DNA, 25 bp, Mus musculus
gatgatgagatgatgaccccagaga

SEQ ID NO: 441751 - DNA, 25 bp, Mus musculus
gatgatgagctgacaatcagcgtgg

SEQ ID NO: 441752 - DNA, 25 bp, Mus musculus
gatgatgatcgtatccccaggcgtg

SEQ ID NO: 441753 - DNA, 25 bp, Mus musculus
gatgatgcaaaatgtctccgtggag

SEQ ID NO: 441754 - DNA, 25 bp, Mus musculus
gatgatgcagagcttcggagcctac

SEQ ID NO: 441755 - DNA, 25 bp, Mus musculus
gatgatgcagtgaagattctcctcg

SEQ ID NO: 441756 - DNA, 25 bp, Mus musculus
gatgatgcatatcggctgcgcctgc

SEQ ID NO: 441757 - DNA, 25 bp, Mus musculus
gatgatgccatttgcggtgaccacc

SEQ ID NO: 441758 - DNA, 25 bp, Mus musculus
gatgatgccgtgttgctgctgaacc

SEQ ID NO: 441759 - DNA, 25 bp, Mus musculus
gatgatgccttcctacatggaccca

SEQ ID NO: 441760 - DNA, 25 bp, Mus musculus
gatgatgcgcgtctacaactggaac

SEQ ID NO: 441761 - DNA, 25 bp, Mus musculus
gatgatgcgctatggctccaagggc

SEQ ID NO: 441762 - DNA, 25 bp, Mus musculus
gatgatgctcccgttgctgatggtg

SEQ ID NO: 441763 - DNA, 25 bp, Mus musculus
gatgatgctcgaaagaagttccacc

SEQ ID NO: 441764 - DNA, 25 bp, Mus musculus
gatgatgctgacacagaccagggcc

SEQ ID NO: 441765 - DNA, 25 bp, Mus musculus
gatgatgcttccaggacaaatcggc

SEQ ID NO: 441766 - DNA, 25 bp, Mus musculus
gatgatgcttttgctcgggccttaa

SEQ ID NO: 441767 - DNA, 25 bp, Mus musculus
gatgatggacgttaacagcagcggc

SEQ ID NO: 441768 - DNA, 25 bp, Mus musculus
gatgatggatgtctagaaaacgccc

SEQ ID NO: 441769 - DNA, 25 bp, Mus musculus
gatgatggcaagtacgtctacctgg

SEQ ID NO: 441770 - DNA, 25 bp, Mus musculus
gatgatggcacttcacaacagccta

SEQ ID NO: 441771 - DNA, 25 bp, Mus musculus
gatgatggccatacgaagttcacag

SEQ ID NO: 441772 - DNA, 25 bp, Mus musculus
gatgatggcctcctagaaacaaacg

SEQ ID NO: 441773 - DNA, 25 bp, Mus musculus
gatgatggctgatcaaggctctgaa

SEQ ID NO: 441774 - DNA, 25 bp, Mus musculus
gatgatgggcaacgttcacgtagca

SEQ ID NO: 441775 - DNA, 25 bp, Mus musculus
gatgatgggtgattctggcagcaac

SEQ ID NO: 441776 - DNA, 25 bp, Mus musculus
gatgatggtgattgtgtagatccac

SEQ ID NO: 441777 - DNA, 25 bp, Mus musculus
gatgatgtaattgactggtgcccag

SEQ ID NO: 441778 - DNA, 25 bp, Mus musculus
gatgatgtacctagcgacagcacag

SEQ ID NO: 441779 - DNA, 25 bp, Mus musculus
gatgatgtccccatagctgcgtaga

SEQ ID NO: 441780 - DNA, 25 bp, Mus musculus
gatgatgtctgcaaacaccgtggct

SEQ ID NO: 441781 - DNA, 25 bp, Mus musculus
gatgatgtgcccctactcgaagact

SEQ ID NO: 441782 - DNA, 25 bp, Mus musculus
gatgatgtgctccaaacaccgtgaa

SEQ ID NO: 441783 - DNA, 25 bp, Mus musculus
gatgatgtgtcttcaccaccctggg

SEQ ID NO: 441784 - DNA, 25 bp, Mus musculus
gatgatgtgttttccagacttcccc

SEQ ID NO: 441785 - DNA, 25 bp, Mus musculus
gatgatgttcaccaaggcggagcac

SEQ ID NO: 441786 - DNA, 25 bp, Mus musculus
gatgatgttcctccatgcaaagctg

SEQ ID NO: 441787 - DNA, 25 bp, Mus musculus
gatgattactgtcctccggaacaag

SEQ ID NO: 441788 - DNA, 25 bp, Mus musculus
gatgattcacatcccagggcttcgg

SEQ ID NO: 441789 - DNA, 25 bp, Mus musculus
gatgattcactttggccgagagcta

SEQ ID NO: 441790 - DNA, 25 bp, Mus musculus
gatgattccccatgaagggcctgga

SEQ ID NO: 441791 - DNA, 25 bp, Mus musculus
gatgattctgtatgggactccctcc

SEQ ID NO: 441792 - DNA, 25 bp, Mus musculus
gatgattgaaatgtgatgagtacac

SEQ ID NO: 441793 - DNA, 25 bp, Mus musculus
gatgattgcagcttcggtgcctgga

SEQ ID NO: 441794 - DNA, 25 bp, Mus musculus
gatgattggacgctgcaacctggct

SEQ ID NO: 441795 - DNA, 25 bp, Mus musculus
gatgatttaagcactgactctgagc

SEQ ID NO: 441796 - DNA, 25 bp, Mus musculus
gatgatttatttcttccacgaccct

SEQ ID NO: 441797 - DNA, 25 bp, Mus musculus
gatgatttcatgatgggagccagca

SEQ ID NO: 441798 - DNA, 25 bp, Mus musculus
gatgatttccggcaatcgcctggga

SEQ ID NO: 441799 - DNA, 25 bp, Mus musculus
gatgcaaaattacccagcctgccag

SEQ ID NO: 441800 - DNA, 25 bp, Mus musculus
gatgcaaacgctttcgatgggttga

SEQ ID NO: 441801 - DNA, 25 bp, Mus musculus
gatgcaaacttatacgtcagcgggc

SEQ ID NO: 441802 - DNA, 25 bp, Mus musculus
gatgcaaagaatcccgtccgcttcg

SEQ ID NO: 441803 - DNA, 25 bp, Mus musculus
gatgcaaagactctccttcgcccgt

SEQ ID NO: 441804 - DNA, 25 bp, Mus musculus
gatgcaaagagctatttttcacaga

SEQ ID NO: 441805 - DNA, 25 bp, Mus musculus
gatgcaaagggcattccctctaagg

SEQ ID NO: 441806 - DNA, 25 bp, Mus musculus
gatgcaaatccttgatcgccgagct

SEQ ID NO: 441807 - DNA, 25 bp, Mus musculus
gatgcaaattgagggacgacagctt

SEQ ID NO: 441808 - DNA, 25 bp, Mus musculus
gatgcaacaggagcttgttgctcca

SEQ ID NO: 441809 - DNA, 25 bp, Mus musculus
gatgcaagatatcaccagggctggc

SEQ ID NO: 441810 - DNA, 25 bp, Mus musculus
gatgcaagcaacctgtgaactcagg

SEQ ID NO: 441811 - DNA, 25 bp, Mus musculus
gatgcaagcacgtttctcagtgcca

SEQ ID NO: 441812 - DNA, 25 bp, Mus musculus
gatgcaagggtagaccgtgaagcca

SEQ ID NO: 441813 - DNA, 25 bp, Mus musculus
gatgcaatcctgaagccagagcaag

SEQ ID NO: 441814 - DNA, 25 bp, Mus musculus
gatgcaatctccgaagcacgtggga

SEQ ID NO: 441815 - DNA, 25 bp, Mus musculus
gatgcaatctcggaaaggccaaagc

SEQ ID NO: 441816 - DNA, 25 bp, Mus musculus
gatgcaatgctgtctgtctcaagca

SEQ ID NO: 441817 - DNA, 25 bp, Mus musculus
gatgcacacatcttcgagccacagg

SEQ ID NO: 441818 - DNA, 25 bp, Mus musculus
gatgcacacttgtggaccacaaccc

SEQ ID NO: 441819 - DNA, 25 bp, Mus musculus
gatgcacagcatgcctgactgagga

SEQ ID NO: 441820 - DNA, 25 bp, Mus musculus
gatgcacagtagtgttttcccagag

SEQ ID NO: 441821 - DNA, 25 bp, Mus musculus
gatgcacagtcaagattggccgccg

SEQ ID NO: 441822 - DNA, 25 bp, Mus musculus
gatgcacatgtctgggaggataatt

SEQ ID NO: 441823 - DNA, 25 bp, Mus musculus
gatgcacattcctgagacactaaag

SEQ ID NO: 441824 - DNA, 25 bp, Mus musculus
gatgcaccactaatgagaactccta

SEQ ID NO: 441825 - DNA, 25 bp, Mus musculus
gatgcacccttcgtgtttgccgagg

SEQ ID NO: 441826 - DNA, 25 bp, Mus musculus
gatgcaccgcgtctcctatgctgtg

SEQ ID NO: 441827 - DNA, 25 bp, Mus musculus
gatgcaccggtgagctagaagtcaa

SEQ ID NO: 441828 - DNA, 25 bp, Mus musculus
gatgcacctggtaactgggcacaat

SEQ ID NO: 441829 - DNA, 25 bp, Mus musculus
gatgcacgaccacgtgaaaggcaaa

SEQ ID NO: 441830 - DNA, 25 bp, Mus musculus
gatgcacgcggtttcaggacgtcaa

SEQ ID NO: 441831 - DNA, 25 bp, Mus musculus
gatgcacgtgtcaaacctgtccagg

SEQ ID NO: 441832 - DNA, 25 bp, Mus musculus
gatgcacgttgtcatttcagagcca

SEQ ID NO: 441833 - DNA, 25 bp, Mus musculus
gatgcactagttacgtttcctgttg

SEQ ID NO: 441834 - DNA, 25 bp, Mus musculus
gatgcactcaacagcagcttagcgt

SEQ ID NO: 441835 - DNA, 25 bp, Mus musculus
gatgcactcaagcaaagcctcgtgg

SEQ ID NO: 441836 - DNA, 25 bp, Mus musculus
gatgcactccctttttgatgtggca

SEQ ID NO: 441837 - DNA, 25 bp, Mus musculus
gatgcactgtggttctcagactcca

SEQ ID NO: 441838 - DNA, 25 bp, Mus musculus
gatgcacttgcccttatccgactag

SEQ ID NO: 441839 - DNA, 25 bp, Mus musculus
gatgcacttggcactccttgaggaa

SEQ ID NO: 441840 - DNA, 25 bp, Mus musculus
gatgcagaaacaaaagcacccgcca

SEQ ID NO: 441841 - DNA, 25 bp, Mus musculus
gatgcagaaactcaaccaggtcatt

SEQ ID NO: 441842 - DNA, 25 bp, Mus musculus
gatgcagaaatgaacgccagtcaga

SEQ ID NO: 441843 - DNA, 25 bp, Mus musculus
gatgcagaatttggctcactctgag

SEQ ID NO: 441844 - DNA, 25 bp, Mus musculus
gatgcagacagatcacagaaacggt

SEQ ID NO: 441845 - DNA, 25 bp, Mus musculus
gatgcagacattcagctcaaggcgc

SEQ ID NO: 441846 - DNA, 25 bp, Mus musculus
gatgcagactgtagccacctcctac

SEQ ID NO: 441847 - DNA, 25 bp, Mus musculus
gatgcagagatatcaggaccagaag

SEQ ID NO: 441848 - DNA, 25 bp, Mus musculus
gatgcagagccttatccaccactca

SEQ ID NO: 441849 - DNA, 25 bp, Mus musculus
gatgcagagttcgttaaagcccgcg

SEQ ID NO: 441850 - DNA, 25 bp, Mus musculus
gatgcagatctgacgtaagttgcga

SEQ ID NO: 441851 - DNA, 25 bp, Mus musculus
gatgcagatgaactccgtggtgcca

SEQ ID NO: 441852 - DNA, 25 bp, Mus musculus
gatgcagattcctgttatggccaga

SEQ ID NO: 441853 - DNA, 25 bp, Mus musculus
gatgcagcaaaattacccgttccag

SEQ ID NO: 441854 - DNA, 25 bp, Mus musculus
gatgcagcaactgttacttctcaac

SEQ ID NO: 441855 - DNA, 25 bp, Mus musculus
gatgcagcaagatctcggcgaagca

SEQ ID NO: 441856 - DNA, 25 bp, Mus musculus
gatgcagcatctgaggtaaagccct

SEQ ID NO: 441857 - DNA, 25 bp, Mus musculus
gatgcagccagttttgagtcaacca

SEQ ID NO: 441858 - DNA, 25 bp, Mus musculus
gatgcagcccagagtttcagaggtc

SEQ ID NO: 441859 - DNA, 25 bp, Mus musculus
gatgcagccgagagaatgtcaatcc

SEQ ID NO: 441860 - DNA, 25 bp, Mus musculus
gatgcagcctccactgctgtgatca

SEQ ID NO: 441861 - DNA, 25 bp, Mus musculus
gatgcagctaacaattacgcccgcg

SEQ ID NO: 441862 - DNA, 25 bp, Mus musculus
gatgcagctgtctgggaccactcaa

SEQ ID NO: 441863 - DNA, 25 bp, Mus musculus
gatgcaggactctctggaagtcacg

SEQ ID NO: 441864 - DNA, 25 bp, Mus musculus
gatgcaggatatccgtgccaggaac

SEQ ID NO: 441865 - DNA, 25 bp, Mus musculus
gatgcaggccacacactgtttaccg

SEQ ID NO: 441866 - DNA, 25 bp, Mus musculus
gatgcaggcgctcagctgacacttt

SEQ ID NO: 441867 - DNA, 25 bp, Mus musculus
gatgcaggcgctccagtagaagact

SEQ ID NO: 441868 - DNA, 25 bp, Mus musculus
gatgcaggcgtatcacctgagcaga

SEQ ID NO: 441869 - DNA, 25 bp, Mus musculus
gatgcaggctacactcagatccttg

SEQ ID NO: 441870 - DNA, 25 bp, Mus musculus
gatgcaggtcaactataatctgtga

SEQ ID NO: 441871 - DNA, 25 bp, Mus musculus
gatgcaggtcttcactcagccaaaa

SEQ ID NO: 441872 - DNA, 25 bp, Mus musculus
gatgcaggtgagtccatgaagcgcc

SEQ ID NO: 441873 - DNA, 25 bp, Mus musculus
gatgcagtaaaagtgtgccccggat

SEQ ID NO: 441874 - DNA, 25 bp, Mus musculus
gatgcagtcaataacaccagggtgg

SEQ ID NO: 441875 - DNA, 25 bp, Mus musculus
gatgcagtcatctcctcagcaggaa

SEQ ID NO: 441876 - DNA, 25 bp, Mus musculus
gatgcagtcctgttttggccaccac

SEQ ID NO: 441877 - DNA, 25 bp, Mus musculus
gatgcagtgcttcagtgatgcaacc

SEQ ID NO: 441878 - DNA, 25 bp, Mus musculus
gatgcagtgggtcctggcactcaca

SEQ ID NO: 441879 - DNA, 25 bp, Mus musculus
gatgcagttccaaccggagtcctgg

SEQ ID NO: 441880 - DNA, 25 bp, Mus musculus
gatgcagttccactatagtgtccgg

SEQ ID NO: 441881 - DNA, 25 bp, Mus musculus
gatgcagttgtttcctgtagcccaa

SEQ ID NO: 441882 - DNA, 25 bp, Mus musculus
gatgcagttttttgacccaaggaca

SEQ ID NO: 441883 - DNA, 25 bp, Mus musculus
gatgcatatatggtggcctccgggc

SEQ ID NO: 441884 - DNA, 25 bp, Mus musculus
gatgcatcctgaaggccggctttga

SEQ ID NO: 441885 - DNA, 25 bp, Mus musculus
gatgcatctgccattctgggccact

SEQ ID NO: 441886 - DNA, 25 bp, Mus musculus
gatgcatgaacacagctccctgggt

SEQ ID NO: 441887 - DNA, 25 bp, Mus musculus
gatgcatggatggttcaaggccaag

SEQ ID NO: 441888 - DNA, 25 bp, Mus musculus
gatgcattcagatctcggacgtcct

SEQ ID NO: 441889 - DNA, 25 bp, Mus musculus
gatgccaaagtgcatagggccctag

SEQ ID NO: 441890 - DNA, 25 bp, Mus musculus
gatgccaacatcgtacagccagtag

SEQ ID NO: 441891 - DNA, 25 bp, Mus musculus
gatgccaaccaggagatgaactctc

SEQ ID NO: 441892 - DNA, 25 bp, Mus musculus
gatgccaagaagacgttccactgcg

SEQ ID NO: 441893 - DNA, 25 bp, Mus musculus
gatgccaaggacctcaaacagcttg

SEQ ID NO: 441894 - DNA, 25 bp, Mus musculus
gatgccaagtccgtgaatgggaaag

SEQ ID NO: 441895 - DNA, 25 bp, Mus musculus
gatgccacaccttgaccctgaatga

SEQ ID NO: 441896 - DNA, 25 bp, Mus musculus
gatgccacagcgatttaaggccaag

SEQ ID NO: 441897 - DNA, 25 bp, Mus musculus
gatgccacagttggcctgccctgtg

SEQ ID NO: 441898 - DNA, 25 bp, Mus musculus
gatgccacccacaatcttgacctgt

SEQ ID NO: 441899 - DNA, 25 bp, Mus musculus
gatgccacggccatgtgcctagggt

SEQ ID NO: 441900 - DNA, 25 bp, Mus musculus
gatgccagagctgcgaagtgctacg

SEQ ID NO: 441901 - DNA, 25 bp, Mus musculus
gatgccagcagagagttacagaccc

SEQ ID NO: 441902 - DNA, 25 bp, Mus musculus
gatgccagctaaatgtcttcagaaa

SEQ ID NO: 441903 - DNA, 25 bp, Mus musculus
gatgccaggcgagtttgatcccacc

SEQ ID NO: 441904 - DNA, 25 bp, Mus musculus
gatgccagtccccatgacttccaag

SEQ ID NO: 441905 - DNA, 25 bp, Mus musculus
gatgccagtgtagtgcactccttag

SEQ ID NO: 441906 - DNA, 25 bp, Mus musculus
gatgccagttcatctgaaaggcggg

SEQ ID NO: 441907 - DNA, 25 bp, Mus musculus
gatgccatcaatgggttgctggtcc

SEQ ID NO: 441908 - DNA, 25 bp, Mus musculus
gatgccatccctacaaccagtggtg

SEQ ID NO: 441909 - DNA, 25 bp, Mus musculus
gatgccatcgcgagagcctttagag

SEQ ID NO: 441910 - DNA, 25 bp, Mus musculus
gatgccatctttgtccagcgggacc

SEQ ID NO: 441911 - DNA, 25 bp, Mus musculus
gatgccatgtttactgtgacccaag

SEQ ID NO: 441912 - DNA, 25 bp, Mus musculus
gatgccattaccagtctccgaggag

SEQ ID NO: 441913 - DNA, 25 bp, Mus musculus
gatgcccaagggagtgggttcctcc

SEQ ID NO: 441914 - DNA, 25 bp, Mus musculus
gatgcccaagtagaacagtcagcct

SEQ ID NO: 441915 - DNA, 25 bp, Mus musculus
gatgcccacagtgctgggtgtcctg

SEQ ID NO: 441916 - DNA, 25 bp, Mus musculus
gatgcccaggcagctcgagaattca

SEQ ID NO: 441917 - DNA, 25 bp, Mus musculus
gatgcccagtccttcgtacgcttga

SEQ ID NO: 441918 - DNA, 25 bp, Mus musculus
gatgcccatccctcttagacaacag

SEQ ID NO: 441919 - DNA, 25 bp, Mus musculus
gatgcccatgggaagcaaagcaaca

SEQ ID NO: 441920 - DNA, 25 bp, Mus musculus
gatgccccatagtagaattatgagt

SEQ ID NO: 441921 - DNA, 25 bp, Mus musculus
gatgccccatcttcacgtagcagct

SEQ ID NO: 441922 - DNA, 25 bp, Mus musculus
gatgccccctgtaggatctagaagc

SEQ ID NO: 441923 - DNA, 25 bp, Mus musculus
gatgccccgatactgcctctttgga

SEQ ID NO: 441924 - DNA, 25 bp, Mus musculus
gatgccccgcatactggaggaaagc

SEQ ID NO: 441925 - DNA, 25 bp, Mus musculus
gatgccccgttctgttaaaatccaa

SEQ ID NO: 441926 - DNA, 25 bp, Mus musculus
gatgcccgcaccatgttactcctta

SEQ ID NO: 441927 - DNA, 25 bp, Mus musculus
gatgcccgggatcaaaggactcttg

SEQ ID NO: 441928 - DNA, 25 bp, Mus musculus
gatgccctcatccagctcaataagg

SEQ ID NO: 441929 - DNA, 25 bp, Mus musculus
gatgccctccctgttgtggcctgtg

SEQ ID NO: 441930 - DNA, 25 bp, Mus musculus
gatgccctgaacttgactctggaac

SEQ ID NO: 441931 - DNA, 25 bp, Mus musculus
gatgccctgaagaccgagttcaaag

SEQ ID NO: 441932 - DNA, 25 bp, Mus musculus
gatgccctgagacctaatgttcttg

SEQ ID NO: 441933 - DNA, 25 bp, Mus musculus
gatgccctgaggcacacatggacag

SEQ ID NO: 441934 - DNA, 25 bp, Mus musculus
gatgcccttctgcacagtgacagca

SEQ ID NO: 441935 - DNA, 25 bp, Mus musculus
gatgccgacactgatgctacatgta

SEQ ID NO: 441936 - DNA, 25 bp, Mus musculus
gatgccgaccgggaagtcacttcta

SEQ ID NO: 441937 - DNA, 25 bp, Mus musculus
gatgccgacgatgccgtgtacgagc

SEQ ID NO: 441938 - DNA, 25 bp, Mus musculus
gatgccgcctactacttcgaaaggg

SEQ ID NO: 441939 - DNA, 25 bp, Mus musculus
gatgccgcgatcagttgccctacat

SEQ ID NO: 441940 - DNA, 25 bp, Mus musculus
gatgccgctgtctttcactcaacca

SEQ ID NO: 441941 - DNA, 25 bp, Mus musculus
gatgccggcgacctcaatgtgcttg

SEQ ID NO: 441942 - DNA, 25 bp, Mus musculus
gatgccgggacagaaagactgcgac

SEQ ID NO: 441943 - DNA, 25 bp, Mus musculus
gatgccgtaggaaaaacctttgcct

SEQ ID NO: 441944 - DNA, 25 bp, Mus musculus
gatgccgtcatcaagagccctagtg

SEQ ID NO: 441945 - DNA, 25 bp, Mus musculus
gatgccgtcctcctaaataaccagt

SEQ ID NO: 441946 - DNA, 25 bp, Mus musculus
gatgccgtctccacagaacatgctg

SEQ ID NO: 441947 - DNA, 25 bp, Mus musculus
gatgccgtggcccaacaatgctgtt

SEQ ID NO: 441948 - DNA, 25 bp, Mus musculus
gatgccgtgtacgagctcaacagca

SEQ ID NO: 441949 - DNA, 25 bp, Mus musculus
gatgccgttttgagtgacacagagc

SEQ ID NO: 441950 - DNA, 25 bp, Mus musculus
gatgcctaaagccaaaatgtggtct

SEQ ID NO: 441951 - DNA, 25 bp, Mus musculus
gatgcctaactaatcaggaagtggt

SEQ ID NO: 441952 - DNA, 25 bp, Mus musculus
gatgcctaattatgaacccaacgtg

SEQ ID NO: 441953 - DNA, 25 bp, Mus musculus
gatgcctacctgatgaagctgcgcc

SEQ ID NO: 441954 - DNA, 25 bp, Mus musculus
gatgcctacgctatcaaaacggagc

SEQ ID NO: 441955 - DNA, 25 bp, Mus musculus
gatgcctacgctgaaaaccactgac

SEQ ID NO: 441956 - DNA, 25 bp, Mus musculus
gatgcctaggatgtactgtttaccc

SEQ ID NO: 441957 - DNA, 25 bp, Mus musculus
gatgcctatgacctggaaagaactg

SEQ ID NO: 441958 - DNA, 25 bp, Mus musculus
gatgcctatggagtcgggagctaca

SEQ ID NO: 441959 - DNA, 25 bp, Mus musculus
gatgcctatgggtaccactccagtg

SEQ ID NO: 441960 - DNA, 25 bp, Mus musculus
gatgcctcacgagtggcttccagcg

SEQ ID NO: 441961 - DNA, 25 bp, Mus musculus
gatgcctcagttactaccgtaggaa

SEQ ID NO: 441962 - DNA, 25 bp, Mus musculus
gatgcctccaggacatgtacgcaag

SEQ ID NO: 441963 - DNA, 25 bp, Mus musculus
gatgcctccgggttcacatgtagag

SEQ ID NO: 441964 - DNA, 25 bp, Mus musculus
gatgcctcctgctcaaataagccaa

SEQ ID NO: 441965 - DNA, 25 bp, Mus musculus
gatgcctcctgtagaaaacctgtag

SEQ ID NO: 441966 - DNA, 25 bp, Mus musculus
gatgcctcgtcccaggccgagtcag

SEQ ID NO: 441967 - DNA, 25 bp, Mus musculus
gatgcctctccagtgtcatctgcgt

SEQ ID NO: 441968 - DNA, 25 bp, Mus musculus
gatgcctctgaaattgtgagcaaga

SEQ ID NO: 441969 - DNA, 25 bp, Mus musculus
gatgcctctgcaaagccaggttggg

SEQ ID NO: 441970 - DNA, 25 bp, Mus musculus
gatgcctgccatttgtgagtttctg

SEQ ID NO: 441971 - DNA, 25 bp, Mus musculus
gatgcctgcctggttagactttaaa

SEQ ID NO: 441972 - DNA, 25 bp, Mus musculus
gatgcctggccgaaaggtcactgat

SEQ ID NO: 441973 - DNA, 25 bp, Mus musculus
gatgcctgggatcgaaaactatgcc

SEQ ID NO: 441974 - DNA, 25 bp, Mus musculus
gatgcctgtgctctgaaagcctcta

SEQ ID NO: 441975 - DNA, 25 bp, Mus musculus
gatgccttcattcagaactacgtgg

SEQ ID NO: 441976 - DNA, 25 bp, Mus musculus
gatgccttctttgaagcccgagaaa

SEQ ID NO: 441977 - DNA, 25 bp, Mus musculus
gatgccttgaccgtccagtaacgtg

SEQ ID NO: 441978 - DNA, 25 bp, Mus musculus
gatgcctttccggtagcaggtcaga

SEQ ID NO: 441979 - DNA, 25 bp, Mus musculus
gatgcctttgaagccgagaaacagg

SEQ ID NO: 441980 - DNA, 25 bp, Mus musculus
gatgcgaccatttaaagtgagaccc

SEQ ID NO: 441981 - DNA, 25 bp, Mus musculus
gatgcgactgttcttccgtgagccc

SEQ ID NO: 441982 - DNA, 25 bp, Mus musculus
gatgcgagactacctccagcggatt

SEQ ID NO: 441983 - DNA, 25 bp, Mus musculus
gatgcgagcggccttcaccgcgttt

SEQ ID NO: 441984 - DNA, 25 bp, Mus musculus
gatgcgatgctggttacactggtca

SEQ ID NO: 441985 - DNA, 25 bp, Mus musculus
gatgcgcacaacatggacaacttgg

SEQ ID NO: 441986 - DNA, 25 bp, Mus musculus
gatgcgcacgcgaacattttttaga

SEQ ID NO: 441987 - DNA, 25 bp, Mus musculus
gatgcgcagatctacgtgaccacag

SEQ ID NO: 441988 - DNA, 25 bp, Mus musculus
gatgcgcaggaaggtagtacctacg

SEQ ID NO: 441989 - DNA, 25 bp, Mus musculus
gatgcgcagtgatgtccatccaagt

SEQ ID NO: 441990 - DNA, 25 bp, Mus musculus
gatgcgcatcattcacggtgtgggc

SEQ ID NO: 441991 - DNA, 25 bp, Mus musculus
gatgcgccgcaaccggtttaaatgg

SEQ ID NO: 441992 - DNA, 25 bp, Mus musculus
gatgcgcctacagcccttcaatgaa

SEQ ID NO: 441993 - DNA, 25 bp, Mus musculus
gatgcgcctatgtaccagtgctaca

SEQ ID NO: 441994 - DNA, 25 bp, Mus musculus
gatgcgctgaaacagaaccttgtgg

SEQ ID NO: 441995 - DNA, 25 bp, Mus musculus
gatgcgctgccgctggctagatcct

SEQ ID NO: 441996 - DNA, 25 bp, Mus musculus
gatgcgctggtccactcttgttgag

SEQ ID NO: 441997 - DNA, 25 bp, Mus musculus
gatgcgctgtacacttgatccagaa

SEQ ID NO: 441998 - DNA, 25 bp, Mus musculus
gatgcggactcccataactctgaag

SEQ ID NO: 441999 - DNA, 25 bp, Mus musculus
gatgcggcctagaaactgctgctgg

SEQ ID NO: 442000 - DNA, 25 bp, Mus musculus
gatgcggctgcctgagcaacctgga

SEQ ID NO: 442001 - DNA, 25 bp, Mus musculus
gatgcgggagctcccaccgcagtat

SEQ ID NO: 442002 - DNA, 25 bp, Mus musculus
gatgcgggttacaacaggtgctcca

SEQ ID NO: 442003 - DNA, 25 bp, Mus musculus
gatgcggtgatcaaggtccttcagc

SEQ ID NO: 442004 - DNA, 25 bp, Mus musculus
gatgcggttaaaaccgaccagcgat

SEQ ID NO: 442005 - DNA, 25 bp, Mus musculus
gatgcggtttggatatcttccccgg

SEQ ID NO: 442006 - DNA, 25 bp, Mus musculus
gatgcgtgaagtccaggttcctccg

SEQ ID NO: 442007 - DNA, 25 bp, Mus musculus
gatgctaaagaggaaagaaccactt

SEQ ID NO: 442008 - DNA, 25 bp, Mus musculus
gatgctaaggcaaggagtccagtca

SEQ ID NO: 442009 - DNA, 25 bp, Mus musculus
gatgctaccttactggcactgcttg

SEQ ID NO: 442010 - DNA, 25 bp, Mus musculus
gatgctactgtcctgaaccacggga

SEQ ID NO: 442011 - DNA, 25 bp, Mus musculus
gatgctacttcaattcaccttatgg

SEQ ID NO: 442012 - DNA, 25 bp, Mus musculus
gatgctagagactaccaaccatgga

SEQ ID NO: 442013 - DNA, 25 bp, Mus musculus
gatgctagcattaatggcaccacca

SEQ ID NO: 442014 - DNA, 25 bp, Mus musculus
gatgctaggacttgcttcacccctc

SEQ ID NO: 442015 - DNA, 25 bp, Mus musculus
gatgctaggcgtggacaaaggctcc

SEQ ID NO: 442016 - DNA, 25 bp, Mus musculus
gatgctagtagcttcctggatggaa

SEQ ID NO: 442017 - DNA, 25 bp, Mus musculus
gatgctagtatcaaagagtacgttg

SEQ ID NO: 442018 - DNA, 25 bp, Mus musculus
gatgctagtgattctctgatcctgg

SEQ ID NO: 442019 - DNA, 25 bp, Mus musculus
gatgctatcctgtcccgagagtgga

SEQ ID NO: 442020 - DNA, 25 bp, Mus musculus
gatgctatctccacaacaggctggt

SEQ ID NO: 442021 - DNA, 25 bp, Mus musculus
gatgctattgcgatgagaatgtaca

SEQ ID NO: 442022 - DNA, 25 bp, Mus musculus
gatgctcaacaatctccctggtgtg

SEQ ID NO: 442023 - DNA, 25 bp, Mus musculus
gatgctcaagcatgtcgtaaaccca

SEQ ID NO: 442024 - DNA, 25 bp, Mus musculus
gatgctcacagcaaagtcacagaga

SEQ ID NO: 442025 - DNA, 25 bp, Mus musculus
gatgctcactagtgaaccccaggga

SEQ ID NO: 442026 - DNA, 25 bp, Mus musculus
gatgctcagatcaactttagcccag

SEQ ID NO: 442027 - DNA, 25 bp, Mus musculus
gatgctcagccagtatgcagggcag

SEQ ID NO: 442028 - DNA, 25 bp, Mus musculus
gatgctcaggagtttacccagtgcc

SEQ ID NO: 442029 - DNA, 25 bp, Mus musculus
gatgctcagtgaaccaaggtaccta

SEQ ID NO: 442030 - DNA, 25 bp, Mus musculus
gatgctcatcggactgctgctggct

SEQ ID NO: 442031 - DNA, 25 bp, Mus musculus
gatgctcatgggattgtcttcacgg

SEQ ID NO: 442032 - DNA, 25 bp, Mus musculus
gatgctcatggtgaccaacagaggg

SEQ ID NO: 442033 - DNA, 25 bp, Mus musculus
gatgctccactgtccaaatcaatac

SEQ ID NO: 442034 - DNA, 25 bp, Mus musculus
gatgctccatgggtgaaggctactg

SEQ ID NO: 442035 - DNA, 25 bp, Mus musculus
gatgctccctccagaggagtcctgt

SEQ ID NO: 442036 - DNA, 25 bp, Mus musculus
gatgctccgacaccagagaactgtg

SEQ ID NO: 442037 - DNA, 25 bp, Mus musculus
gatgctccgagaaaacacgctggtc

SEQ ID NO: 442038 - DNA, 25 bp, Mus musculus
gatgctcctgcaactcctggcttga

SEQ ID NO: 442039 - DNA, 25 bp, Mus musculus
gatgctcgattgaaaggcagacccc

SEQ ID NO: 442040 - DNA, 25 bp, Mus musculus
gatgctcgccatcaaagtccagtgg

SEQ ID NO: 442041 - DNA, 25 bp, Mus musculus
gatgctcggaagagtacctggcaca

SEQ ID NO: 442042 - DNA, 25 bp, Mus musculus
gatgctcggcgctcggctgcatgcc

SEQ ID NO: 442043 - DNA, 25 bp, Mus musculus
gatgctcgtggcgtggaacacagcc

SEQ ID NO: 442044 - DNA, 25 bp, Mus musculus
gatgctctccgtgcttggttcgcag

SEQ ID NO: 442045 - DNA, 25 bp, Mus musculus
gatgctctctcagtcttgccttgac

SEQ ID NO: 442046 - DNA, 25 bp, Mus musculus
gatgctctctggctgtagaggacca

SEQ ID NO: 442047 - DNA, 25 bp, Mus musculus
gatgctctgcatagacaactgtggc

SEQ ID NO: 442048 - DNA, 25 bp, Mus musculus
gatgctctgtttcgagggttgaacc

SEQ ID NO: 442049 - DNA, 25 bp, Mus musculus
gatgctcttcagttcgtgtgtggac

SEQ ID NO: 442050 - DNA, 25 bp, Mus musculus
gatgctcttcatccactttgcaaat

SEQ ID NO: 442051 - DNA, 25 bp, Mus musculus
gatgctctttgctgccatgggacag

SEQ ID NO: 442052 - DNA, 25 bp, Mus musculus
gatgctgaaattaccacactgaaga

SEQ ID NO: 442053 - DNA, 25 bp, Mus musculus
gatgctgaagactggtatgacaccc

SEQ ID NO: 442054 - DNA, 25 bp, Mus musculus
gatgctgaagttagacaaagagaat

SEQ ID NO: 442055 - DNA, 25 bp, Mus musculus
gatgctgaatcgcttcaaggcctaa

SEQ ID NO: 442056 - DNA, 25 bp, Mus musculus
gatgctgacgctggtgataacgccc

SEQ ID NO: 442057 - DNA, 25 bp, Mus musculus
gatgctgacggacaggctacccttt

SEQ ID NO: 442058 - DNA, 25 bp, Mus musculus
gatgctgagaggagctcgagctacc

SEQ ID NO: 442059 - DNA, 25 bp, Mus musculus
gatgctgaggaacaccacatgccat

SEQ ID NO: 442060 - DNA, 25 bp, Mus musculus
gatgctgagtctcctgaaaccccta

SEQ ID NO: 442061 - DNA, 25 bp, Mus musculus
gatgctgatcgccaacctgttctac

SEQ ID NO: 442062 - DNA, 25 bp, Mus musculus
gatgctgatggcaacctcgtgggct

SEQ ID NO: 442063 - DNA, 25 bp, Mus musculus
gatgctgcaagctgaaatggactgt

SEQ ID NO: 442064 - DNA, 25 bp, Mus musculus
gatgctgcaccctctgagtcttttg

SEQ ID NO: 442065 - DNA, 25 bp, Mus musculus
gatgctgcagccgaactcatcgact

SEQ ID NO: 442066 - DNA, 25 bp, Mus musculus
gatgctgcagggaacgaaggctcct

SEQ ID NO: 442067 - DNA, 25 bp, Mus musculus
gatgctgcagtaaggagcactcaca

SEQ ID NO: 442068 - DNA, 25 bp, Mus musculus
gatgctgccttctcgggtgtgacca

SEQ ID NO: 442069 - DNA, 25 bp, Mus musculus
gatgctgcgcgcagccctcctaaag

SEQ ID NO: 442070 - DNA, 25 bp, Mus musculus
gatgctgcggctctggatagcctcc

SEQ ID NO: 442071 - DNA, 25 bp, Mus musculus
gatgctgcggttgtccttctgtaca

SEQ ID NO: 442072 - DNA, 25 bp, Mus musculus
gatgctgctaagctcaccgtgtcca

SEQ ID NO: 442073 - DNA, 25 bp, Mus musculus
gatgctgctattgggctgctaatgc

SEQ ID NO: 442074 - DNA, 25 bp, Mus musculus
gatgctgctggtacactggcttgga

SEQ ID NO: 442075 - DNA, 25 bp, Mus musculus
gatgctgcttctgacaggtgccgag

SEQ ID NO: 442076 - DNA, 25 bp, Mus musculus
gatgctgctttgactctagcgtcgc

SEQ ID NO: 442077 - DNA, 25 bp, Mus musculus
gatgctggacacaaactcaactttg

SEQ ID NO: 442078 - DNA, 25 bp, Mus musculus
gatgctggacactactgctccctgg

SEQ ID NO: 442079 - DNA, 25 bp, Mus musculus
gatgctggactgctttgtgaacacc

SEQ ID NO: 442080 - DNA, 25 bp, Mus musculus
gatgctggattaaaagacgccaccg

SEQ ID NO: 442081 - DNA, 25 bp, Mus musculus
gatgctggcaattcctgctagtcta

SEQ ID NO: 442082 - DNA, 25 bp, Mus musculus
gatgctggcacggaaacttgggtct

SEQ ID NO: 442083 - DNA, 25 bp, Mus musculus
gatgctggcatctactactgtgtga

SEQ ID NO: 442084 - DNA, 25 bp, Mus musculus
gatgctggctgtttccaggagcccg

SEQ ID NO: 442085 - DNA, 25 bp, Mus musculus
gatgctgggcagttttatgcaaaat

SEQ ID NO: 442086 - DNA, 25 bp, Mus musculus
gatgctgggtttggacgttcctacc

SEQ ID NO: 442087 - DNA, 25 bp, Mus musculus
gatgctggttgaagccctccgtagg

SEQ ID NO: 442088 - DNA, 25 bp, Mus musculus
gatgctgtaaggacagggattcctc

SEQ ID NO: 442089 - DNA, 25 bp, Mus musculus
gatgctgtaccaccattgccaaagg

SEQ ID NO: 442090 - DNA, 25 bp, Mus musculus
gatgctgtagcaactaaaggcccca

SEQ ID NO: 442091 - DNA, 25 bp, Mus musculus
gatgctgtcgccaggagatgtacct

SEQ ID NO: 442092 - DNA, 25 bp, Mus musculus
gatgctgtctcgtgaggtgtcctag

SEQ ID NO: 442093 - DNA, 25 bp, Mus musculus
gatgctgtgctctcctacgggatga

SEQ ID NO: 442094 - DNA, 25 bp, Mus musculus
gatgctgtggaataaatctaaggtc

SEQ ID NO: 442095 - DNA, 25 bp, Mus musculus
gatgctgtggcttgctggatagtta

SEQ ID NO: 442096 - DNA, 25 bp, Mus musculus
gatgctgttcttgtaggctgcccaa

SEQ ID NO: 442097 - DNA, 25 bp, Mus musculus
gatgctgttgggttccctttcccct

SEQ ID NO: 442098 - DNA, 25 bp, Mus musculus
gatgcttaagcggaaggatctagct

SEQ ID NO: 442099 - DNA, 25 bp, Mus musculus
gatgcttaatggcacacacctggct

SEQ ID NO: 442100 - DNA, 25 bp, Mus musculus
gatgcttacgaccaggagatccgag

SEQ ID NO: 442101 - DNA, 25 bp, Mus musculus
gatgcttagttatgactgtcatccc

SEQ ID NO: 442102 - DNA, 25 bp, Mus musculus
gatgcttagttgtatccgcacgctg

SEQ ID NO: 442103 - DNA, 25 bp, Mus musculus
gatgcttatgatctaaaggctgcca

SEQ ID NO: 442104 - DNA, 25 bp, Mus musculus
gatgcttcaaacattatagatgacg

SEQ ID NO: 442105 - DNA, 25 bp, Mus musculus
gatgcttcaactacccagtcaggga

SEQ ID NO: 442106 - DNA, 25 bp, Mus musculus
gatgcttcacatccgctaccggctg

SEQ ID NO: 442107 - DNA, 25 bp, Mus musculus
gatgcttcagcctgcactcctgagt

SEQ ID NO: 442108 - DNA, 25 bp, Mus musculus
gatgcttccggccactaagtcctgg

SEQ ID NO: 442109 - DNA, 25 bp, Mus musculus
gatgcttcctcaagtcgagtggcag

SEQ ID NO: 442110 - DNA, 25 bp, Mus musculus
gatgcttcgagagtggactaaccct

SEQ ID NO: 442111 - DNA, 25 bp, Mus musculus
gatgcttcggaatgaccaggacacc

SEQ ID NO: 442112 - DNA, 25 bp, Mus musculus
gatgcttcgtattgctttggattag

SEQ ID NO: 442113 - DNA, 25 bp, Mus musculus
gatgcttcgttcctgacattggtgg

SEQ ID NO: 442114 - DNA, 25 bp, Mus musculus
gatgcttgactgctgtcttttctca

SEQ ID NO: 442115 - DNA, 25 bp, Mus musculus
gatgcttgccaacacactggaagtt

SEQ ID NO: 442116 - DNA, 25 bp, Mus musculus
gatgcttgcctgaataaagacccgt

SEQ ID NO: 442117 - DNA, 25 bp, Mus musculus
gatgcttgcttcgtatgtaagccgg

SEQ ID NO: 442118 - DNA, 25 bp, Mus musculus
gatgcttggcaacccacgttaaagg

SEQ ID NO: 442119 - DNA, 25 bp, Mus musculus
gatgcttggcacgaggagtcttcct

SEQ ID NO: 442120 - DNA, 25 bp, Mus musculus
gatgcttggcttgtgaaaggctctg

SEQ ID NO: 442121 - DNA, 25 bp, Mus musculus
gatgcttgtcgctgcccatgcagga

SEQ ID NO: 442122 - DNA, 25 bp, Mus musculus
gatgctttgaagttgccctcaacct

SEQ ID NO: 442123 - DNA, 25 bp, Mus musculus
gatgctttggactccaccctggcag

SEQ ID NO: 442124 - DNA, 25 bp, Mus musculus
gatgctttgtaacatgtccatatgc

SEQ ID NO: 442125 - DNA, 25 bp, Mus musculus
gatgcttttatggagcttctcagaa

SEQ ID NO: 442126 - DNA, 25 bp, Mus musculus
gatggaaaaaagtagctgctccagg

SEQ ID NO: 442127 - DNA, 25 bp, Mus musculus
gatggaaaccatcagtctgcggcgc

SEQ ID NO: 442128 - DNA, 25 bp, Mus musculus
gatggaaacccttgggcaaggctag

SEQ ID NO: 442129 - DNA, 25 bp, Mus musculus
gatggaaactctggcaacatctacc

SEQ ID NO: 442130 - DNA, 25 bp, Mus musculus
gatggaaagaacagaagacacacta

SEQ ID NO: 442131 - DNA, 25 bp, Mus musculus
gatggaaatcaacctcacctcctgg

SEQ ID NO: 442132 - DNA, 25 bp, Mus musculus
gatggaaatcaaggacagcagcaac

SEQ ID NO: 442133 - DNA, 25 bp, Mus musculus
gatggaaatccgtagctgcttgccc

SEQ ID NO: 442134 - DNA, 25 bp, Mus musculus
gatggaaatgacaagcacgtccctg

SEQ ID NO: 442135 - DNA, 25 bp, Mus musculus
gatggaacccaaaagctctgcacag

SEQ ID NO: 442136 - DNA, 25 bp, Mus musculus
gatggaaccggtaagaaatctgggc

SEQ ID NO: 442137 - DNA, 25 bp, Mus musculus
gatggaactcaaatgtcttcgccaa

SEQ ID NO: 442138 - DNA, 25 bp, Mus musculus
gatggaactcgtgcggagaaacacc

SEQ ID NO: 442139 - DNA, 25 bp, Mus musculus
gatggaactgaaacgcaaagattcg

SEQ ID NO: 442140 - DNA, 25 bp, Mus musculus
gatggaagacccattgagcaacagg

SEQ ID NO: 442141 - DNA, 25 bp, Mus musculus
gatggaagaccccactttgaaagag

SEQ ID NO: 442142 - DNA, 25 bp, Mus musculus
gatggaagacgatccccgtgtggct

SEQ ID NO: 442143 - DNA, 25 bp, Mus musculus
gatggaagccatatatgtgacatac

SEQ ID NO: 442144 - DNA, 25 bp, Mus musculus
gatggaagcggtttgcttgccagcc

SEQ ID NO: 442145 - DNA, 25 bp, Mus musculus
gatggaagctatctgctgcgagaca

SEQ ID NO: 442146 - DNA, 25 bp, Mus musculus
gatggaatcataggtgttctttcta

SEQ ID NO: 442147 - DNA, 25 bp, Mus musculus
gatggaatccagacgaggaaccgca

SEQ ID NO: 442148 - DNA, 25 bp, Mus musculus
gatggaatctatcgcctctcgggca

SEQ ID NO: 442149 - DNA, 25 bp, Mus musculus
gatggacaaagtgacccaactgtgg

SEQ ID NO: 442150 - DNA, 25 bp, Mus musculus
gatggacaaatctcactgtggctac

SEQ ID NO: 442151 - DNA, 25 bp, Mus musculus
gatggacaacgaagaagagaaccac

SEQ ID NO: 442152 - DNA, 25 bp, Mus musculus
gatggacaactggtttcacccgggc

SEQ ID NO: 442153 - DNA, 25 bp, Mus musculus
gatggacactccctcctaatggtga

SEQ ID NO: 442154 - DNA, 25 bp, Mus musculus
gatggacagcgaaccgagtacttct

SEQ ID NO: 442155 - DNA, 25 bp, Mus musculus
gatggacagtgtggagaacccttgc

SEQ ID NO: 442156 - DNA, 25 bp, Mus musculus
gatggaccaagaccacagtagcagt

SEQ ID NO: 442157 - DNA, 25 bp, Mus musculus
gatggacccctacataaaagagatg

SEQ ID NO: 442158 - DNA, 25 bp, Mus musculus
gatggaccctcttccgtctagtaag

SEQ ID NO: 442159 - DNA, 25 bp, Mus musculus
gatggacgccgtcttggaacctttc

SEQ ID NO: 442160 - DNA, 25 bp, Mus musculus
gatggacgcctgatgaaccactgaa

SEQ ID NO: 442161 - DNA, 25 bp, Mus musculus
gatggacgcgtcttcaccgtccgca

SEQ ID NO: 442162 - DNA, 25 bp, Mus musculus
gatggacggactgataacttgggaa

SEQ ID NO: 442163 - DNA, 25 bp, Mus musculus
gatggacggttactttacaggccca

SEQ ID NO: 442164 - DNA, 25 bp, Mus musculus
gatggactcatggttgcaactccag

SEQ ID NO: 442165 - DNA, 25 bp, Mus musculus
gatggactcatgtatgtcaagcggc

SEQ ID NO: 442166 - DNA, 25 bp, Mus musculus
gatggactccagcaagcatgtgact

SEQ ID NO: 442167 - DNA, 25 bp, Mus musculus
gatggactcctctggaaacttagcc

SEQ ID NO: 442168 - DNA, 25 bp, Mus musculus
gatggactcttaggactgtacaggc

SEQ ID NO: 442169 - DNA, 25 bp, Mus musculus
gatggactgctcctccattctggaa

SEQ ID NO: 442170 - DNA, 25 bp, Mus musculus
gatggactgtgtaaacctctggaga

SEQ ID NO: 442171 - DNA, 25 bp, Mus musculus
gatggacttattcacacggcacagc

SEQ ID NO: 442172 - DNA, 25 bp, Mus musculus
gatggacttcatcaaggacctgcct

SEQ ID NO: 442173 - DNA, 25 bp, Mus musculus
gatggagaaaaactgcaggcactgc

SEQ ID NO: 442174 - DNA, 25 bp, Mus musculus
gatggagaagcctcgaactcgacct

SEQ ID NO: 442175 - DNA, 25 bp, Mus musculus
gatggagacatcatagcatctggga

SEQ ID NO: 442176 - DNA, 25 bp, Mus musculus
gatggagaccatctacgacctgggt

SEQ ID NO: 442177 - DNA, 25 bp, Mus musculus
gatggagaccattctacactggcag

SEQ ID NO: 442178 - DNA, 25 bp, Mus musculus
gatggagaccatttcttcggtgaca

SEQ ID NO: 442179 - DNA, 25 bp, Mus musculus
gatggagagcatactgcaggccctg

SEQ ID NO: 442180 - DNA, 25 bp, Mus musculus
gatggagagctgagacccttggcaa

SEQ ID NO: 442181 - DNA, 25 bp, Mus musculus
gatggagagctgatcttccgccacg

SEQ ID NO: 442182 - DNA, 25 bp, Mus musculus
gatggagagctggtgaccctgtacc

SEQ ID NO: 442183 - DNA, 25 bp, Mus musculus
gatggagaggtgtacacctgcacac

SEQ ID NO: 442184 - DNA, 25 bp, Mus musculus
gatggagcacctcctggcagctatg

SEQ ID NO: 442185 - DNA, 25 bp, Mus musculus
gatggagcagcttcacaaggaaagt

SEQ ID NO: 442186 - DNA, 25 bp, Mus musculus
gatggagcaggaagatcttgaaagc

SEQ ID NO: 442187 - DNA, 25 bp, Mus musculus
gatggagccacccttacaggataag

SEQ ID NO: 442188 - DNA, 25 bp, Mus musculus
gatggagccatcaagccagaaacca

SEQ ID NO: 442189 - DNA, 25 bp, Mus musculus
gatggagcccaagcacgagttcatg

SEQ ID NO: 442190 - DNA, 25 bp, Mus musculus
gatggagcccatcacaaaagtgtct

SEQ ID NO: 442191 - DNA, 25 bp, Mus musculus
gatggagccctcttgcggaagccat

SEQ ID NO: 442192 - DNA, 25 bp, Mus musculus
gatggagccctgtgaataccgtgaa

SEQ ID NO: 442193 - DNA, 25 bp, Mus musculus
gatggagctcaacagaaaggaccct

SEQ ID NO: 442194 - DNA, 25 bp, Mus musculus
gatggagctcctcgctacaaagtag

SEQ ID NO: 442195 - DNA, 25 bp, Mus musculus
gatggagctgtgaccttttgagcag

SEQ ID NO: 442196 - DNA, 25 bp, Mus musculus
gatggaggagcaagaaagccaatca

SEQ ID NO: 442197 - DNA, 25 bp, Mus musculus
gatggaggccgtcttaaacctgaga

SEQ ID NO: 442198 - DNA, 25 bp, Mus musculus
gatggaggctctgtctctgacgtca

SEQ ID NO: 442199 - DNA, 25 bp, Mus musculus
gatggagggcacaagagaaatactg

SEQ ID NO: 442200 - DNA, 25 bp, Mus musculus
gatggagtaagacagccgccttgct

SEQ ID NO: 442201 - DNA, 25 bp, Mus musculus
gatggagttcctgtcttgatgcacg

SEQ ID NO: 442202 - DNA, 25 bp, Mus musculus
gatggagttgcgtttggagcacccc

SEQ ID NO: 442203 - DNA, 25 bp, Mus musculus
gatggatagtgatgatcagggtacc

SEQ ID NO: 442204 - DNA, 25 bp, Mus musculus
gatggatatcccaaacacgctggag

SEQ ID NO: 442205 - DNA, 25 bp, Mus musculus
gatggatcaagtcgcaactaggagt

SEQ ID NO: 442206 - DNA, 25 bp, Mus musculus
gatggatcataaccgcgtacgcttg

SEQ ID NO: 442207 - DNA, 25 bp, Mus musculus
gatggatccaggttgtgaaacatct

SEQ ID NO: 442208 - DNA, 25 bp, Mus musculus
gatggatccctagtacttatttaag

SEQ ID NO: 442209 - DNA, 25 bp, Mus musculus
gatggatcctagcagccagtttgag

SEQ ID NO: 442210 - DNA, 25 bp, Mus musculus
gatggatcggttccccagcgccctg

SEQ ID NO: 442211 - DNA, 25 bp, Mus musculus
gatggatctaaaaggctggagatgc

SEQ ID NO: 442212 - DNA, 25 bp, Mus musculus
gatggatctgatcttggccctagga

SEQ ID NO: 442213 - DNA, 25 bp, Mus musculus
gatggatgaccccacagtagattgg

SEQ ID NO: 442214 - DNA, 25 bp, Mus musculus
gatggatgacccctcgctgtaaaaa

SEQ ID NO: 442215 - DNA, 25 bp, Mus musculus
gatggatgacgcagaagtggcccac

SEQ ID NO: 442216 - DNA, 25 bp, Mus musculus
gatggatgcatctaacctaggaggc

SEQ ID NO: 442217 - DNA, 25 bp, Mus musculus
gatggatgccacagccaatgatgtg

SEQ ID NO: 442218 - DNA, 25 bp, Mus musculus
gatggatgctcattcatgcccactg

SEQ ID NO: 442219 - DNA, 25 bp, Mus musculus
gatggatggacagcagagagcctct

SEQ ID NO: 442220 - DNA, 25 bp, Mus musculus
gatggatggatagcttaggtgccta

SEQ ID NO: 442221 - DNA, 25 bp, Mus musculus
gatggatgtaccttcatgcctgtcc

SEQ ID NO: 442222 - DNA, 25 bp, Mus musculus
gatggattcctacgtgagctctaca

SEQ ID NO: 442223 - DNA, 25 bp, Mus musculus
gatggattgaagactgcaaagaaca

SEQ ID NO: 442224 - DNA, 25 bp, Mus musculus
gatggattgagttttacgcacacag

SEQ ID NO: 442225 - DNA, 25 bp, Mus musculus
gatggattgatcacagaaggttggc

SEQ ID NO: 442226 - DNA, 25 bp, Mus musculus
gatggattttgcttctggacccagg

SEQ ID NO: 442227 - DNA, 25 bp, Mus musculus
gatggcaaagtctgtagcaacagag

SEQ ID NO: 442228 - DNA, 25 bp, Mus musculus
gatggcaacaaggtacagggagcta

SEQ ID NO: 442229 - DNA, 25 bp, Mus musculus
gatggcaactggtacctgcagcgga

SEQ ID NO: 442230 - DNA, 25 bp, Mus musculus
gatggcaagccacggtacagctatg

SEQ ID NO: 442231 - DNA, 25 bp, Mus musculus
gatggcacaatcacctgaaccctga

SEQ ID NO: 442232 - DNA, 25 bp, Mus musculus
gatggcacacaatagttccctgagg

SEQ ID NO: 442233 - DNA, 25 bp, Mus musculus
gatggcacagttccctcaaaagatt

SEQ ID NO: 442234 - DNA, 25 bp, Mus musculus
gatggcaccaagtacccagaactgg

SEQ ID NO: 442235 - DNA, 25 bp, Mus musculus
gatggcacccggaaagtggacttct

SEQ ID NO: 442236 - DNA, 25 bp, Mus musculus
gatggcacgaacatgacttatggaa

SEQ ID NO: 442237 - DNA, 25 bp, Mus musculus
gatggcacggagtcctatctcactg

SEQ ID NO: 442238 - DNA, 25 bp, Mus musculus
gatggcactagcactgggttcccaa

SEQ ID NO: 442239 - DNA, 25 bp, Mus musculus
gatggcagcaaagtcctggctacta

SEQ ID NO: 442240 - DNA, 25 bp, Mus musculus
gatggcagctatggtccacataggg

SEQ ID NO: 442241 - DNA, 25 bp, Mus musculus
gatggcaggcagttctactccgcaa

SEQ ID NO: 442242 - DNA, 25 bp, Mus musculus
gatggcagttgaaggcctcctaaga

SEQ ID NO: 442243 - DNA, 25 bp, Mus musculus
gatggcataaaaacataacaggttc

SEQ ID NO: 442244 - DNA, 25 bp, Mus musculus
gatggcatctcctgacgagaacgtg

SEQ ID NO: 442245 - DNA, 25 bp, Mus musculus
gatggcattcctctgatcctggaca

SEQ ID NO: 442246 - DNA, 25 bp, Mus musculus
gatggcattggcacccgtactatca

SEQ ID NO: 442247 - DNA, 25 bp, Mus musculus
gatggcattgtaccagggagtctcc

SEQ ID NO: 442248 - DNA, 25 bp, Mus musculus
gatggccaacaaagcaccttctcag

SEQ ID NO: 442249 - DNA, 25 bp, Mus musculus
gatggccaccaactcatctgccgag

SEQ ID NO: 442250 - DNA, 25 bp, Mus musculus
gatggccaccaagcgataagacagc

SEQ ID NO: 442251 - DNA, 25 bp, Mus musculus
gatggccactgatgtacacgctgaa

SEQ ID NO: 442252 - DNA, 25 bp, Mus musculus
gatggccagcccttatatcttctac

SEQ ID NO: 442253 - DNA, 25 bp, Mus musculus
gatggccaggcttttcttacagctc

SEQ ID NO: 442254 - DNA, 25 bp, Mus musculus
gatggccagtaccaccaagtcaggc

SEQ ID NO: 442255 - DNA, 25 bp, Mus musculus
gatggccatctctagtacacctgag

SEQ ID NO: 442256 - DNA, 25 bp, Mus musculus
gatggccatgaagcccaaaccggct

SEQ ID NO: 442257 - DNA, 25 bp, Mus musculus
gatggccattcagggaacctcagca

SEQ ID NO: 442258 - DNA, 25 bp, Mus musculus
gatggcccgatgctgaaccatactg

SEQ ID NO: 442259 - DNA, 25 bp, Mus musculus
gatggccctcactgagtgtcaactg

SEQ ID NO: 442260 - DNA, 25 bp, Mus musculus
gatggccctctagctaggctgaaaa

SEQ ID NO: 442261 - DNA, 25 bp, Mus musculus
gatggccctgaacagcttctatccc

SEQ ID NO: 442262 - DNA, 25 bp, Mus musculus
gatggcccttcttgtgctcacagct

SEQ ID NO: 442263 - DNA, 25 bp, Mus musculus
gatggccgtcgcatactgctgcctc

SEQ ID NO: 442264 - DNA, 25 bp, Mus musculus
gatggccgtctccagctagatagga

SEQ ID NO: 442265 - DNA, 25 bp, Mus musculus
gatggcctacaagcgctcatggaga

SEQ ID NO: 442266 - DNA, 25 bp, Mus musculus
gatggcctacaagctctaaggtgca

SEQ ID NO: 442267 - DNA, 25 bp, Mus musculus
gatggcctgacactgaagctctttc

SEQ ID NO: 442268 - DNA, 25 bp, Mus musculus
gatggcctgaccagtggatcctaac

SEQ ID NO: 442269 - DNA, 25 bp, Mus musculus
gatggcctgagcttgattcccagga

SEQ ID NO: 442270 - DNA, 25 bp, Mus musculus
gatggcctggactcttctgacaccg

SEQ ID NO: 442271 - DNA, 25 bp, Mus musculus
gatggcgccactgaaaatcaagcta

SEQ ID NO: 442272 - DNA, 25 bp, Mus musculus
gatggcgcctcttgacacaacagga

SEQ ID NO: 442273 - DNA, 25 bp, Mus musculus
gatggcggaagatcaaactggctgt

SEQ ID NO: 442274 - DNA, 25 bp, Mus musculus
gatggcggcgaagccttacgtgcca

SEQ ID NO: 442275 - DNA, 25 bp, Mus musculus
gatggcggcttcagggctgcaaggg

SEQ ID NO: 442276 - DNA, 25 bp, Mus musculus
gatggcgggattgtcagtactctgt

SEQ ID NO: 442277 - DNA, 25 bp, Mus musculus
gatggcgtccaccttcaggaagtca

SEQ ID NO: 442278 - DNA, 25 bp, Mus musculus
gatggcgttccctgttttctatgag

SEQ ID NO: 442279 - DNA, 25 bp, Mus musculus
gatggcgttgccgacttcactgtgg

SEQ ID NO: 442280 - DNA, 25 bp, Mus musculus
gatggctacagctacggaagccgca

SEQ ID NO: 442281 - DNA, 25 bp, Mus musculus
gatggctacatcaccaggaacgaga

SEQ ID NO: 442282 - DNA, 25 bp, Mus musculus
gatggctcagccaaaaactcctgtg

SEQ ID NO: 442283 - DNA, 25 bp, Mus musculus
gatggctcaggctataaagtgctag

SEQ ID NO: 442284 - DNA, 25 bp, Mus musculus
gatggctccagctctacaagtttgt

SEQ ID NO: 442285 - DNA, 25 bp, Mus musculus
gatggctccagggtaaaccacgtgg

SEQ ID NO: 442286 - DNA, 25 bp, Mus musculus
gatggctccagggtagcacaggtac

SEQ ID NO: 442287 - DNA, 25 bp, Mus musculus
gatggctccccaggcaatggcattg

SEQ ID NO: 442288 - DNA, 25 bp, Mus musculus
gatggctccctgcacacttcttcag

SEQ ID NO: 442289 - DNA, 25 bp, Mus musculus
gatggctctctctgcagaagtctgg

SEQ ID NO: 442290 - DNA, 25 bp, Mus musculus
gatggctctgcaaagcactgtggac

SEQ ID NO: 442291 - DNA, 25 bp, Mus musculus
gatggctctgctgtcacacctaaaa

SEQ ID NO: 442292 - DNA, 25 bp, Mus musculus
gatggctcttcaaaaactcagaccg

SEQ ID NO: 442293 - DNA, 25 bp, Mus musculus
gatggctcttcgtcctagggtccta

SEQ ID NO: 442294 - DNA, 25 bp, Mus musculus
gatggctgagactaatccccaaggg

SEQ ID NO: 442295 - DNA, 25 bp, Mus musculus
gatggctgcctcctgtctatgaaga

SEQ ID NO: 442296 - DNA, 25 bp, Mus musculus
gatggctggctaggaggtacacact

SEQ ID NO: 442297 - DNA, 25 bp, Mus musculus
gatggctgtacacataccacgtgag

SEQ ID NO: 442298 - DNA, 25 bp, Mus musculus
gatggctgtcagtatgccctgtgca

SEQ ID NO: 442299 - DNA, 25 bp, Mus musculus
gatggcttagacagggatgactacc

SEQ ID NO: 442300 - DNA, 25 bp, Mus musculus
gatggcttcggtacccgacggatgc

SEQ ID NO: 442301 - DNA, 25 bp, Mus musculus
gatggcttctcaccttaggcatgca

SEQ ID NO: 442302 - DNA, 25 bp, Mus musculus
gatggcttgacttggcaacagtgcc

SEQ ID NO: 442303 - DNA, 25 bp, Mus musculus
gatggctttaacgtgcggatccctc

SEQ ID NO: 442304 - DNA, 25 bp, Mus musculus
gatggctttgacaactgcgacgcgg

SEQ ID NO: 442305 - DNA, 25 bp, Mus musculus
gatggctttgtcctcatcccagacc

SEQ ID NO: 442306 - DNA, 25 bp, Mus musculus
gatggcttttgtcaggagactcgct

SEQ ID NO: 442307 - DNA, 25 bp, Mus musculus
gatgggaaatacgagctgttgacag

SEQ ID NO: 442308 - DNA, 25 bp, Mus musculus
gatgggaaatccagtcctagagtga

SEQ ID NO: 442309 - DNA, 25 bp, Mus musculus
gatgggaaatgatggattgtcttga

SEQ ID NO: 442310 - DNA, 25 bp, Mus musculus
gatgggaaattaggtcagttgtccc

SEQ ID NO: 442311 - DNA, 25 bp, Mus musculus
gatgggaacattgtctgcaatcctg

SEQ ID NO: 442312 - DNA, 25 bp, Mus musculus
gatgggaactcagacgacgaccttt

SEQ ID NO: 442313 - DNA, 25 bp, Mus musculus
gatgggaagcagttgtctaaaaaca

SEQ ID NO: 442314 - DNA, 25 bp, Mus musculus
gatgggaagcctcgctacagcgtct

SEQ ID NO: 442315 - DNA, 25 bp, Mus musculus
gatgggaagcctgagaatgagacaa

SEQ ID NO: 442316 - DNA, 25 bp, Mus musculus
gatgggaaggaaactccgaccagct

SEQ ID NO: 442317 - DNA, 25 bp, Mus musculus
gatgggaaggagtttgacttgtcct

SEQ ID NO: 442318 - DNA, 25 bp, Mus musculus
gatgggacactatggtgccactgag

SEQ ID NO: 442319 - DNA, 25 bp, Mus musculus
gatgggaccccaggatcctagtgtg

SEQ ID NO: 442320 - DNA, 25 bp, Mus musculus
gatgggacctgcttcttctttggcc

SEQ ID NO: 442321 - DNA, 25 bp, Mus musculus
gatgggacgccaacgtcaaaaactt

SEQ ID NO: 442322 - DNA, 25 bp, Mus musculus
gatgggacggtcaaatccagcctgg

SEQ ID NO: 442323 - DNA, 25 bp, Mus musculus
gatgggactcactcagccctgtgaa

SEQ ID NO: 442324 - DNA, 25 bp, Mus musculus
gatgggactccctatctcgtgtgta

SEQ ID NO: 442325 - DNA, 25 bp, Mus musculus
gatgggactcctcagcgtagacttg

SEQ ID NO: 442326 - DNA, 25 bp, Mus musculus
gatgggagccactgtccacgggctc

SEQ ID NO: 442327 - DNA, 25 bp, Mus musculus
gatgggagttaaaaggctggctacc

SEQ ID NO: 442328 - DNA, 25 bp, Mus musculus
gatgggatcatctgcaaatcagacc

SEQ ID NO: 442329 - DNA, 25 bp, Mus musculus
gatgggatccccttcagtgcgatgc

SEQ ID NO: 442330 - DNA, 25 bp, Mus musculus
gatgggatctactacgaaggctgct

SEQ ID NO: 442331 - DNA, 25 bp, Mus musculus
gatgggcacaatgacacgggcttag

SEQ ID NO: 442332 - DNA, 25 bp, Mus musculus
gatgggcacctatcgaaccctggat

SEQ ID NO: 442333 - DNA, 25 bp, Mus musculus
gatgggcagaagaaagtccaagaag

SEQ ID NO: 442334 - DNA, 25 bp, Mus musculus
gatgggcatcatcaataactctgta

SEQ ID NO: 442335 - DNA, 25 bp, Mus musculus
gatgggccaggcttacttaccacag

SEQ ID NO: 442336 - DNA, 25 bp, Mus musculus
gatgggccatcctgcttcttcctta

SEQ ID NO: 442337 - DNA, 25 bp, Mus musculus
gatgggcccagaagtccaagttatg

SEQ ID NO: 442338 - DNA, 25 bp, Mus musculus
gatgggccccatgagcaggtctttg

SEQ ID NO: 442339 - DNA, 25 bp, Mus musculus
gatgggcccgtgctctgaatactca

SEQ ID NO: 442340 - DNA, 25 bp, Mus musculus
gatgggccctaattcggtcatgcca

SEQ ID NO: 442341 - DNA, 25 bp, Mus musculus
gatgggccgaactacatgtaccaag

SEQ ID NO: 442342 - DNA, 25 bp, Mus musculus
gatgggcctcccactttagaatgga

SEQ ID NO: 442343 - DNA, 25 bp, Mus musculus
gatgggcctcgcttaatctacgtga

SEQ ID NO: 442344 - DNA, 25 bp, Mus musculus
gatgggcctgcttctcactgtggat

SEQ ID NO: 442345 - DNA, 25 bp, Mus musculus
gatgggccttggtccccaaaatgaa

SEQ ID NO: 442346 - DNA, 25 bp, Mus musculus
gatgggcgaatatgccacgctgttt

SEQ ID NO: 442347 - DNA, 25 bp, Mus musculus
gatgggctccaggtcaacttcagag

SEQ ID NO: 442348 - DNA, 25 bp, Mus musculus
gatgggctctatgactgtgacaacc

SEQ ID NO: 442349 - DNA, 25 bp, Mus musculus
gatgggctgactcacattaaaggca

SEQ ID NO: 442350 - DNA, 25 bp, Mus musculus
gatgggctggctgacaattacaaca

SEQ ID NO: 442351 - DNA, 25 bp, Mus musculus
gatgggcttcatggatttctacacc

SEQ ID NO: 442352 - DNA, 25 bp, Mus musculus
gatgggcttggcttcggtgacaaca

SEQ ID NO: 442353 - DNA, 25 bp, Mus musculus
gatgggctttgctgaaggtgacacc

SEQ ID NO: 442354 - DNA, 25 bp, Mus musculus
gatgggctttgtgtgtgaacgactc

SEQ ID NO: 442355 - DNA, 25 bp, Mus musculus
gatgggtaacaagcttggatctgga

SEQ ID NO: 442356 - DNA, 25 bp, Mus musculus
gatgggtactatgctcgctctgaag

SEQ ID NO: 442357 - DNA, 25 bp, Mus musculus
gatgggtcactaactcggatccaag

SEQ ID NO: 442358 - DNA, 25 bp, Mus musculus
gatgggtcatctacaccaccgagat

SEQ ID NO: 442359 - DNA, 25 bp, Mus musculus
gatgggtctcccacttgtaaagatt

SEQ ID NO: 442360 - DNA, 25 bp, Mus musculus
gatgggtgaatcttaaccgccaagg

SEQ ID NO: 442361 - DNA, 25 bp, Mus musculus
gatgggtgcacctaatctgatagca

SEQ ID NO: 442362 - DNA, 25 bp, Mus musculus
gatgggtggtcctctgaatccagcg

SEQ ID NO: 442363 - DNA, 25 bp, Mus musculus
gatgggttcagcacaagctctggct

SEQ ID NO: 442364 - DNA, 25 bp, Mus musculus
gatgggttgcacaccaaagggtcga

SEQ ID NO: 442365 - DNA, 25 bp, Mus musculus
gatgggtttgtcatgcattcctggg

SEQ ID NO: 442366 - DNA, 25 bp, Mus musculus
gatgggttttgcaccaatccagcct

SEQ ID NO: 442367 - DNA, 25 bp, Mus musculus
gatggtaaactggtcaacgctccct

SEQ ID NO: 442368 - DNA, 25 bp, Mus musculus
gatggtaaatcccaccacggtgctt

SEQ ID NO: 442369 - DNA, 25 bp, Mus musculus
gatggtaacagcaacatgtcccggg

SEQ ID NO: 442370 - DNA, 25 bp, Mus musculus
gatggtaaccacctacggatcctgg

SEQ ID NO: 442371 - DNA, 25 bp, Mus musculus
gatggtaactacatgtcttggtgac

SEQ ID NO: 442372 - DNA, 25 bp, Mus musculus
gatggtaactgcaacatggagggcc

SEQ ID NO: 442373 - DNA, 25 bp, Mus musculus
gatggtacagcccacagtgatcacc

SEQ ID NO: 442374 - DNA, 25 bp, Mus musculus
gatggtacaggacttcttatggaaa

SEQ ID NO: 442375 - DNA, 25 bp, Mus musculus
gatggtaccaagactaccctggctc

SEQ ID NO: 442376 - DNA, 25 bp, Mus musculus
gatggtagaactagagagactcagt

SEQ ID NO: 442377 - DNA, 25 bp, Mus musculus
gatggtatcatgtacagagatctca

SEQ ID NO: 442378 - DNA, 25 bp, Mus musculus
gatggtcaaacacgtcacagggcgc

SEQ ID NO: 442379 - DNA, 25 bp, Mus musculus
gatggtcaaggaagcactcagtgct

SEQ ID NO: 442380 - DNA, 25 bp, Mus musculus
gatggtcacccaatctggccaattg

SEQ ID NO: 442381 - DNA, 25 bp, Mus musculus
gatggtccacacctggcatcactga

SEQ ID NO: 442382 - DNA, 25 bp, Mus musculus
gatggtcccatctactatggactga

SEQ ID NO: 442383 - DNA, 25 bp, Mus musculus
gatggtccttacagaggacgccatg

SEQ ID NO: 442384 - DNA, 25 bp, Mus musculus
gatggtcgtgcccacaaattgagga

SEQ ID NO: 442385 - DNA, 25 bp, Mus musculus
gatggtctgcctagtgaacgctgag

SEQ ID NO: 442386 - DNA, 25 bp, Mus musculus
gatggtctgtcaacatctccacagc

SEQ ID NO: 442387 - DNA, 25 bp, Mus musculus
gatggtgaaaacgtctgcctgacgc

SEQ ID NO: 442388 - DNA, 25 bp, Mus musculus
gatggtgaacatctccctgcgtgtg

SEQ ID NO: 442389 - DNA, 25 bp, Mus musculus
gatggtgacgtccagtgcaatgtcc

SEQ ID NO: 442390 - DNA, 25 bp, Mus musculus
gatggtgagtgtgaactgccctttg

SEQ ID NO: 442391 - DNA, 25 bp, Mus musculus
gatggtgatatcttccggcaacctg

SEQ ID NO: 442392 - DNA, 25 bp, Mus musculus
gatggtgcactgcattctgcgcaga

SEQ ID NO: 442393 - DNA, 25 bp, Mus musculus
gatggtgccccacaaagttctttag

SEQ ID NO: 442394 - DNA, 25 bp, Mus musculus
gatggtgcctatcattgctctctgg

SEQ ID NO: 442395 - DNA, 25 bp, Mus musculus
gatggtgcttcggtgagcgtccaca

SEQ ID NO: 442396 - DNA, 25 bp, Mus musculus
gatggtggaccaactgatctctgag

SEQ ID NO: 442397 - DNA, 25 bp, Mus musculus
gatggtgtaaaactaacagatattt

SEQ ID NO: 442398 - DNA, 25 bp, Mus musculus
gatggtgtacctgtgtcctagagga

SEQ ID NO: 442399 - DNA, 25 bp, Mus musculus
gatggtgtctcctgattgtttgctc

SEQ ID NO: 442400 - DNA, 25 bp, Mus musculus
gatggtgtctgtgaccttggtccag

SEQ ID NO: 442401 - DNA, 25 bp, Mus musculus
gatggttacagttaggagagttgat

SEQ ID NO: 442402 - DNA, 25 bp, Mus musculus
gatggttatacctcgtgcccactgg

SEQ ID NO: 442403 - DNA, 25 bp, Mus musculus
gatggttcacccacacctaggactg

SEQ ID NO: 442404 - DNA, 25 bp, Mus musculus
gatggttcagcagtcacgagtactt

SEQ ID NO: 442405 - DNA, 25 bp, Mus musculus
gatggttgccacctcaccagagaga

SEQ ID NO: 442406 - DNA, 25 bp, Mus musculus
gatggttggacagtctgcccagagc

SEQ ID NO: 442407 - DNA, 25 bp, Mus musculus
gatggttggtaatcattttggagac

SEQ ID NO: 442408 - DNA, 25 bp, Mus musculus
gatggtttttcctctcaactaggcc

SEQ ID NO: 442409 - DNA, 25 bp, Mus musculus
gatgtaaatccaaacagtcatgctg

SEQ ID NO: 442410 - DNA, 25 bp, Mus musculus
gatgtaaatcttagaatgcccagaa

SEQ ID NO: 442411 - DNA, 25 bp, Mus musculus
gatgtaactgccaaaacagctagct

SEQ ID NO: 442412 - DNA, 25 bp, Mus musculus
gatgtaagatgcaaacctcctggcc

SEQ ID NO: 442413 - DNA, 25 bp, Mus musculus
gatgtaagtacgcagtgactcacag

SEQ ID NO: 442414 - DNA, 25 bp, Mus musculus
gatgtaagtgcctctggagccaagg

SEQ ID NO: 442415 - DNA, 25 bp, Mus musculus
gatgtaatacatacggcccttcggg

SEQ ID NO: 442416 - DNA, 25 bp, Mus musculus
gatgtaataccccaagatgtctgct

SEQ ID NO: 442417 - DNA, 25 bp, Mus musculus
gatgtaatcgcgctcaccaagcagg

SEQ ID NO: 442418 - DNA, 25 bp, Mus musculus
gatgtaattcccttgcctggtccct

SEQ ID NO: 442419 - DNA, 25 bp, Mus musculus
gatgtacaccgccaagtagccattg

SEQ ID NO: 442420 - DNA, 25 bp, Mus musculus
gatgtacactcatctgaaaaatccc

SEQ ID NO: 442421 - DNA, 25 bp, Mus musculus
gatgtacagatgctgcaagacgcca

SEQ ID NO: 442422 - DNA, 25 bp, Mus musculus
gatgtacaggacactcccagagaga

SEQ ID NO: 442423 - DNA, 25 bp, Mus musculus
gatgtaccactctcgcatgcagcga

SEQ ID NO: 442424 - DNA, 25 bp, Mus musculus
gatgtaccactgattggccctgcaa

SEQ ID NO: 442425 - DNA, 25 bp, Mus musculus
gatgtaccgactttcgtaagtaccg

SEQ ID NO: 442426 - DNA, 25 bp, Mus musculus
gatgtaccggaaagaatgtctgccg

SEQ ID NO: 442427 - DNA, 25 bp, Mus musculus
gatgtacgatgagatcttccactcc

SEQ ID NO: 442428 - DNA, 25 bp, Mus musculus
gatgtacgcctaccatcgtggtgga

SEQ ID NO: 442429 - DNA, 25 bp, Mus musculus
gatgtacgttcgacaccgtgtgcaa

SEQ ID NO: 442430 - DNA, 25 bp, Mus musculus
gatgtactcataggccaatctgtat

SEQ ID NO: 442431 - DNA, 25 bp, Mus musculus
gatgtactgaaaaccgcatttggca

SEQ ID NO: 442432 - DNA, 25 bp, Mus musculus
gatgtactgccatggatcaggtctt

SEQ ID NO: 442433 - DNA, 25 bp, Mus musculus
gatgtacttataactctggcatggc

SEQ ID NO: 442434 - DNA, 25 bp, Mus musculus
gatgtacttatttaggcagtgcctc

SEQ ID NO: 442435 - DNA, 25 bp, Mus musculus
gatgtagaagagatcaccccagcca

SEQ ID NO: 442436 - DNA, 25 bp, Mus musculus
gatgtagagaccatgcagcagacaa

SEQ ID NO: 442437 - DNA, 25 bp, Mus musculus
gatgtagatatcagccacctcggtg

SEQ ID NO: 442438 - DNA, 25 bp, Mus musculus
gatgtagatgaacccgtggctccct

SEQ ID NO: 442439 - DNA, 25 bp, Mus musculus
gatgtagatgtcctatgcatatact

SEQ ID NO: 442440 - DNA, 25 bp, Mus musculus
gatgtagcaaagtggtcagagttct

SEQ ID NO: 442441 - DNA, 25 bp, Mus musculus
gatgtagcctgactgctgaaacgct

SEQ ID NO: 442442 - DNA, 25 bp, Mus musculus
gatgtagcttttatcccgacgagcg

SEQ ID NO: 442443 - DNA, 25 bp, Mus musculus
gatgtagggctgaactctctccaga

SEQ ID NO: 442444 - DNA, 25 bp, Mus musculus
gatgtagtcccagttccaagtgtcc

SEQ ID NO: 442445 - DNA, 25 bp, Mus musculus
gatgtagtcgtcagccttgagggca

SEQ ID NO: 442446 - DNA, 25 bp, Mus musculus
gatgtagtttttagcagggcagacc

SEQ ID NO: 442447 - DNA, 25 bp, Mus musculus
gatgtataaccacagctggccagag

SEQ ID NO: 442448 - DNA, 25 bp, Mus musculus
gatgtatcacagtggcagagcagct

SEQ ID NO: 442449 - DNA, 25 bp, Mus musculus
gatgtatcagcttggccatgcccag

SEQ ID NO: 442450 - DNA, 25 bp, Mus musculus
gatgtatcgcctctacatggcagaa

SEQ ID NO: 442451 - DNA, 25 bp, Mus musculus
gatgtatgatccgtccgcagttaat

SEQ ID NO: 442452 - DNA, 25 bp, Mus musculus
gatgtatgatgcttaaccctcccaa

SEQ ID NO: 442453 - DNA, 25 bp, Mus musculus
gatgtatggtcaacaaattgctcac

SEQ ID NO: 442454 - DNA, 25 bp, Mus musculus
gatgtatgtacaagctccaggctga

SEQ ID NO: 442455 - DNA, 25 bp, Mus musculus
gatgtatgtcagctcagacgcgtga

SEQ ID NO: 442456 - DNA, 25 bp, Mus musculus
gatgtatgtcatggctctggcctag

SEQ ID NO: 442457 - DNA, 25 bp, Mus musculus
gatgtatgtgtaacagcccactgtg

SEQ ID NO: 442458 - DNA, 25 bp, Mus musculus
gatgtattcaaggtcaggctcagaa

SEQ ID NO: 442459 - DNA, 25 bp, Mus musculus
gatgtattcccagcaggactgtcca

SEQ ID NO: 442460 - DNA, 25 bp, Mus musculus
gatgtcaaagacagcatgccatgga

SEQ ID NO: 442461 - DNA, 25 bp, Mus musculus
gatgtcaaagacagctcagaggcct

SEQ ID NO: 442462 - DNA, 25 bp, Mus musculus
gatgtcaacattgatgcccctgtgc

SEQ ID NO: 442463 - DNA, 25 bp, Mus musculus
gatgtcaactcataccaccggtgct

SEQ ID NO: 442464 - DNA, 25 bp, Mus musculus
gatgtcaagatcaaactcaaggtcc

SEQ ID NO: 442465 - DNA, 25 bp, Mus musculus
gatgtcacacacaatgacacagagg

SEQ ID NO: 442466 - DNA, 25 bp, Mus musculus
gatgtcacaggaacagatcgccagt

SEQ ID NO: 442467 - DNA, 25 bp, Mus musculus
gatgtcaccaacagacttctgactg

SEQ ID NO: 442468 - DNA, 25 bp, Mus musculus
gatgtcaccagctttgaaggctcca

SEQ ID NO: 442469 - DNA, 25 bp, Mus musculus
gatgtcaccgaatggccacagcttg

SEQ ID NO: 442470 - DNA, 25 bp, Mus musculus
gatgtcactcgaaaagccttagcag

SEQ ID NO: 442471 - DNA, 25 bp, Mus musculus
gatgtcataagcaaaccagggccag

SEQ ID NO: 442472 - DNA, 25 bp, Mus musculus
gatgtcatcaactacgggacgccca

SEQ ID NO: 442473 - DNA, 25 bp, Mus musculus
gatgtcatcagagttcccagtgccc

SEQ ID NO: 442474 - DNA, 25 bp, Mus musculus
gatgtcatcgagcagtactcccagg

SEQ ID NO: 442475 - DNA, 25 bp, Mus musculus
gatgtcatggacgtcaacacccaga

SEQ ID NO: 442476 - DNA, 25 bp, Mus musculus
gatgtcatgtaccttcagctacttg

SEQ ID NO: 442477 - DNA, 25 bp, Mus musculus
gatgtcatgtgactaacagcgaccc

SEQ ID NO: 442478 - DNA, 25 bp, Mus musculus
gatgtcattaccagcttttctctga

SEQ ID NO: 442479 - DNA, 25 bp, Mus musculus
gatgtccaatgttcacctgcagcaa

SEQ ID NO: 442480 - DNA, 25 bp, Mus musculus
gatgtccagcaaaatgcagcggcct

SEQ ID NO: 442481 - DNA, 25 bp, Mus musculus
gatgtccagtgtccttatgattgag

SEQ ID NO: 442482 - DNA, 25 bp, Mus musculus
gatgtccatagggaaactcctccct

SEQ ID NO: 442483 - DNA, 25 bp, Mus musculus
gatgtccattaagcccactgggagg

SEQ ID NO: 442484 - DNA, 25 bp, Mus musculus
gatgtccattcttctatgggaagga

SEQ ID NO: 442485 - DNA, 25 bp, Mus musculus
gatgtcccaaagttcgtccctaagg

SEQ ID NO: 442486 - DNA, 25 bp, Mus musculus
gatgtccccatatgtacagaactga

SEQ ID NO: 442487 - DNA, 25 bp, Mus musculus
gatgtcccctgagccttgggtgcaa

SEQ ID NO: 442488 - DNA, 25 bp, Mus musculus
gatgtcccgagatgtgtacagcacc

SEQ ID NO: 442489 - DNA, 25 bp, Mus musculus
gatgtcccgctgttaactccgagca

SEQ ID NO: 442490 - DNA, 25 bp, Mus musculus
gatgtcccggtgactacgtctgatg

SEQ ID NO: 442491 - DNA, 25 bp, Mus musculus
gatgtccctggagcagaatatccca

SEQ ID NO: 442492 - DNA, 25 bp, Mus musculus
gatgtccgaggagggcttcttctac

SEQ ID NO: 442493 - DNA, 25 bp, Mus musculus
gatgtccgcagatcaacagagtcag

SEQ ID NO: 442494 - DNA, 25 bp, Mus musculus
gatgtccgtccagaccaggctgttt

SEQ ID NO: 442495 - DNA, 25 bp, Mus musculus
gatgtcctcaagtgcaaagcttcaa

SEQ ID NO: 442496 - DNA, 25 bp, Mus musculus
gatgtcctctgaagctccaatggta

SEQ ID NO: 442497 - DNA, 25 bp, Mus musculus
gatgtcctcttaccggcacatgcat

SEQ ID NO: 442498 - DNA, 25 bp, Mus musculus
gatgtcctggacgttcaccggacag

SEQ ID NO: 442499 - DNA, 25 bp, Mus musculus
gatgtcctggactatggcctcaagc

SEQ ID NO: 442500 - DNA, 25 bp, Mus musculus
gatgtcctggagaaaaccgaactgg

SEQ ID NO: 442501 - DNA, 25 bp, Mus musculus
gatgtcctggctatcctttctacct

SEQ ID NO: 442502 - DNA, 25 bp, Mus musculus
gatgtcctggtggtttgaacccttg

SEQ ID NO: 442503 - DNA, 25 bp, Mus musculus
gatgtcctgtttaatccgccaaagc

SEQ ID NO: 442504 - DNA, 25 bp, Mus musculus
gatgtcctttgaagagccagcatag

SEQ ID NO: 442505 - DNA, 25 bp, Mus musculus
gatgtcgaacggctaaaacccggct

SEQ ID NO: 442506 - DNA, 25 bp, Mus musculus
gatgtcgaagcacaacctggagtcg

SEQ ID NO: 442507 - DNA, 25 bp, Mus musculus
gatgtcgatgctatggactgcacac

SEQ ID NO: 442508 - DNA, 25 bp, Mus musculus
gatgtcggacactaccttcaaagcc

SEQ ID NO: 442509 - DNA, 25 bp, Mus musculus
gatgtcggtcagtgcgagatccgct

SEQ ID NO: 442510 - DNA, 25 bp, Mus musculus
gatgtcggttggctgttgttctcac

SEQ ID NO: 442511 - DNA, 25 bp, Mus musculus
gatgtcgtcactattggagccccag

SEQ ID NO: 442512 - DNA, 25 bp, Mus musculus
gatgtcgtcggcgatccaagagtcg

SEQ ID NO: 442513 - DNA, 25 bp, Mus musculus
gatgtcgtgttctactcacccctga

SEQ ID NO: 442514 - DNA, 25 bp, Mus musculus
gatgtctacatcagccagtggaagc

SEQ ID NO: 442515 - DNA, 25 bp, Mus musculus
gatgtctactcatgaatttgagaag

SEQ ID NO: 442516 - DNA, 25 bp, Mus musculus
gatgtctattctttactacctgggc

SEQ ID NO: 442517 - DNA, 25 bp, Mus musculus
gatgtctcagcaagagtgtggcccc

SEQ ID NO: 442518 - DNA, 25 bp, Mus musculus
gatgtctccaggatgtaactgccca

SEQ ID NO: 442519 - DNA, 25 bp, Mus musculus
gatgtctcccgtgctaagctagctg

SEQ ID NO: 442520 - DNA, 25 bp, Mus musculus
gatgtctctgaatgagttccagccg

SEQ ID NO: 442521 - DNA, 25 bp, Mus musculus
gatgtctctggaagcagcgctgtga

SEQ ID NO: 442522 - DNA, 25 bp, Mus musculus
gatgtctctgttgggaagcctgcca

SEQ ID NO: 442523 - DNA, 25 bp, Mus musculus
gatgtctcttccaagccctgtaggg

SEQ ID NO: 442524 - DNA, 25 bp, Mus musculus
gatgtctgatttactccccatgagg

SEQ ID NO: 442525 - DNA, 25 bp, Mus musculus
gatgtctgcaaataattcccctcca

SEQ ID NO: 442526 - DNA, 25 bp, Mus musculus
gatgtctgcatcacgggtcatcttg

SEQ ID NO: 442527 - DNA, 25 bp, Mus musculus
gatgtctgccagagcgccaaagtgt

SEQ ID NO: 442528 - DNA, 25 bp, Mus musculus
gatgtctgccttccgcgttgaacgc

SEQ ID NO: 442529 - DNA, 25 bp, Mus musculus
gatgtctgcggaggaactggccttc

SEQ ID NO: 442530 - DNA, 25 bp, Mus musculus
gatgtctggtaactggaaatctaca

SEQ ID NO: 442531 - DNA, 25 bp, Mus musculus
gatgtctgtggacccaacaaggagc

SEQ ID NO: 442532 - DNA, 25 bp, Mus musculus
gatgtctgtggatcgctacgtggcc

SEQ ID NO: 442533 - DNA, 25 bp, Mus musculus
gatgtctgtggcaaaacctttggcc

SEQ ID NO: 442534 - DNA, 25 bp, Mus musculus
gatgtcttagtggagtcagagccct

SEQ ID NO: 442535 - DNA, 25 bp, Mus musculus
gatgtcttccaagaggacaaggctg

SEQ ID NO: 442536 - DNA, 25 bp, Mus musculus
gatgtcttccacgagtcaaaccggt

SEQ ID NO: 442537 - DNA, 25 bp, Mus musculus
gatgtcttccgatcaactaggagga

SEQ ID NO: 442538 - DNA, 25 bp, Mus musculus
gatgtcttcctatcacggatcaagg

SEQ ID NO: 442539 - DNA, 25 bp, Mus musculus
gatgtcttgggtctgacttttcgga

SEQ ID NO: 442540 - DNA, 25 bp, Mus musculus
gatgtcttgtcattgccctgtgtca

SEQ ID NO: 442541 - DNA, 25 bp, Mus musculus
gatgtcttgtctgctgtaccagctg

SEQ ID NO: 442542 - DNA, 25 bp, Mus musculus
gatgtctttgaagcctatacccagc

SEQ ID NO: 442543 - DNA, 25 bp, Mus musculus
gatgtgaacctgtgatgggaacccc

SEQ ID NO: 442544 - DNA, 25 bp, Mus musculus
gatgtgaactcaaacaccaagcacc

SEQ ID NO: 442545 - DNA, 25 bp, Mus musculus
gatgtgaactgctatggctccggcg

SEQ ID NO: 442546 - DNA, 25 bp, Mus musculus
gatgtgaagactggactccttgcgc

SEQ ID NO: 442547 - DNA, 25 bp, Mus musculus
gatgtgaagtactacaccctggaag

SEQ ID NO: 442548 - DNA, 25 bp, Mus musculus
gatgtgacacagacaggattccctg

SEQ ID NO: 442549 - DNA, 25 bp, Mus musculus
gatgtgaccctgaggtttctttgtt

SEQ ID NO: 442550 - DNA, 25 bp, Mus musculus
gatgtgacctatgagcgcgtaagca

SEQ ID NO: 442551 - DNA, 25 bp, Mus musculus
gatgtgactatcaccaccctgaggg

SEQ ID NO: 442552 - DNA, 25 bp, Mus musculus
gatgtgactctaccccagcagggaa

SEQ ID NO: 442553 - DNA, 25 bp, Mus musculus
gatgtgagcaacctaagcctgcagg

SEQ ID NO: 442554 - DNA, 25 bp, Mus musculus
gatgtgagcagtcagaactctccgg

SEQ ID NO: 442555 - DNA, 25 bp, Mus musculus
gatgtgagcctgattcctgctgagg

SEQ ID NO: 442556 - DNA, 25 bp, Mus musculus
gatgtgatccgtgccatgaacgtca

SEQ ID NO: 442557 - DNA, 25 bp, Mus musculus
gatgtgatctactggttccgacaga

SEQ ID NO: 442558 - DNA, 25 bp, Mus musculus
gatgtgatctgctgtgagtggttac

SEQ ID NO: 442559 - DNA, 25 bp, Mus musculus
gatgtgatctgcttgcgaactcaaa

SEQ ID NO: 442560 - DNA, 25 bp, Mus musculus
gatgtgattgagtgccatgagcacc

SEQ ID NO: 442561 - DNA, 25 bp, Mus musculus
gatgtgcaaagcaagacctgaagcc

SEQ ID NO: 442562 - DNA, 25 bp, Mus musculus
gatgtgcaccacgagagactgctgc

SEQ ID NO: 442563 - DNA, 25 bp, Mus musculus
gatgtgcacccagaaatcctatgag

SEQ ID NO: 442564 - DNA, 25 bp, Mus musculus
gatgtgcagagcagagcacggcttt

SEQ ID NO: 442565 - DNA, 25 bp, Mus musculus
gatgtgcagccaacttacgttcgag

SEQ ID NO: 442566 - DNA, 25 bp, Mus musculus
gatgtgcagctcttcatggccgatg

SEQ ID NO: 442567 - DNA, 25 bp, Mus musculus
gatgtgcaggcctcaaagctgtgcc

SEQ ID NO: 442568 - DNA, 25 bp, Mus musculus
gatgtgcagtccatgtatcagccgc

SEQ ID NO: 442569 - DNA, 25 bp, Mus musculus
gatgtgcccacgatagacactggct

SEQ ID NO: 442570 - DNA, 25 bp, Mus musculus
gatgtgcccatgcatctgaactgca

SEQ ID NO: 442571 - DNA, 25 bp, Mus musculus
gatgtgccccatggacatatcacct

SEQ ID NO: 442572 - DNA, 25 bp, Mus musculus
gatgtgccggccttcttacagcaga

SEQ ID NO: 442573 - DNA, 25 bp, Mus musculus
gatgtgcctcctccaaagagtcgga

SEQ ID NO: 442574 - DNA, 25 bp, Mus musculus
gatgtgcctggccagtaccttgcct

SEQ ID NO: 442575 - DNA, 25 bp, Mus musculus
gatgtgccttctaacttcatttgtg

SEQ ID NO: 442576 - DNA, 25 bp, Mus musculus
gatgtgcgccactacttcctggttt

SEQ ID NO: 442577 - DNA, 25 bp, Mus musculus
gatgtgcgctcctacatgctcattg

SEQ ID NO: 442578 - DNA, 25 bp, Mus musculus
gatgtgcggaagttcaaagagacaa

SEQ ID NO: 442579 - DNA, 25 bp, Mus musculus
gatgtgctaactgcttcttcccacg

SEQ ID NO: 442580 - DNA, 25 bp, Mus musculus
gatgtgctcgggtgctcaataaatg

SEQ ID NO: 442581 - DNA, 25 bp, Mus musculus
gatgtgctctataccatcgccagga

SEQ ID NO: 442582 - DNA, 25 bp, Mus musculus
gatgtgctgacatggagaaccctag

SEQ ID NO: 442583 - DNA, 25 bp, Mus musculus
gatgtgctgagacgaccctcgaaag

SEQ ID NO: 442584 - DNA, 25 bp, Mus musculus
gatgtgctgcactcactctacggga

SEQ ID NO: 442585 - DNA, 25 bp, Mus musculus
gatgtgctgcttgatgaaccgccgc

SEQ ID NO: 442586 - DNA, 25 bp, Mus musculus
gatgtgcttcgtgttagagtgccca

SEQ ID NO: 442587 - DNA, 25 bp, Mus musculus
gatgtgcttgccttctcttcgccct

SEQ ID NO: 442588 - DNA, 25 bp, Mus musculus
gatgtggaaccccaaccgagagttg

SEQ ID NO: 442589 - DNA, 25 bp, Mus musculus
gatgtggagcctgataccctacaga

SEQ ID NO: 442590 - DNA, 25 bp, Mus musculus
gatgtggaggccatgaactttccga

SEQ ID NO: 442591 - DNA, 25 bp, Mus musculus
gatgtggagggcacagactacctca

SEQ ID NO: 442592 - DNA, 25 bp, Mus musculus
gatgtggagtctctaacagggacac

SEQ ID NO: 442593 - DNA, 25 bp, Mus musculus
gatgtggcacgcaagatgttccgcc

SEQ ID NO: 442594 - DNA, 25 bp, Mus musculus
gatgtggccaagtcagtcacctcgg

SEQ ID NO: 442595 - DNA, 25 bp, Mus musculus
gatgtggccctagtcaagctcaaga

SEQ ID NO: 442596 - DNA, 25 bp, Mus musculus
gatgtggccgaatttctgtaccagg

SEQ ID NO: 442597 - DNA, 25 bp, Mus musculus
gatgtggcgaagaaacgggctctca

SEQ ID NO: 442598 - DNA, 25 bp, Mus musculus
gatgtggctgctgactggaacttac

SEQ ID NO: 442599 - DNA, 25 bp, Mus musculus
gatgtggctggagtgtctttatact

SEQ ID NO: 442600 - DNA, 25 bp, Mus musculus
gatgtggcttcattctccagggaac

SEQ ID NO: 442601 - DNA, 25 bp, Mus musculus
gatgtgggccctagaaccttcagag

SEQ ID NO: 442602 - DNA, 25 bp, Mus musculus
gatgtgggtgggatccagaacctca

SEQ ID NO: 442603 - DNA, 25 bp, Mus musculus
gatgtggtccacaggtagatgtctt

SEQ ID NO: 442604 - DNA, 25 bp, Mus musculus
gatgtggtcggaacatccctgttgg

SEQ ID NO: 442605 - DNA, 25 bp, Mus musculus
gatgtggtctttgcaaatcgcccag

SEQ ID NO: 442606 - DNA, 25 bp, Mus musculus
gatgtggtgacctacctcctggaga

SEQ ID NO: 442607 - DNA, 25 bp, Mus musculus
gatgtgtaacacagcttggaatttg

SEQ ID NO: 442608 - DNA, 25 bp, Mus musculus
gatgtgtatattggtgtatctgaga

SEQ ID NO: 442609 - DNA, 25 bp, Mus musculus
gatgtgtcaccggtgtactgtccgc

SEQ ID NO: 442610 - DNA, 25 bp, Mus musculus
gatgtgtcagggacagtgtgctcat

SEQ ID NO: 442611 - DNA, 25 bp, Mus musculus
gatgtgtccacaatcgacgggaacg

SEQ ID NO: 442612 - DNA, 25 bp, Mus musculus
gatgtgtccagatgtcagcgtgcct

SEQ ID NO: 442613 - DNA, 25 bp, Mus musculus
gatgtgtccgataccgacgtcgagg

SEQ ID NO: 442614 - DNA, 25 bp, Mus musculus
gatgtgtccgccatttccagagcca

SEQ ID NO: 442615 - DNA, 25 bp, Mus musculus
gatgtgtctctcatgggtggcctca

SEQ ID NO: 442616 - DNA, 25 bp, Mus musculus
gatgtgtctttcgacttccacgggc

SEQ ID NO: 442617 - DNA, 25 bp, Mus musculus
gatgtgtgctctggctgactcccaa

SEQ ID NO: 442618 - DNA, 25 bp, Mus musculus
gatgtgtgcttcctcctgcgacttc

SEQ ID NO: 442619 - DNA, 25 bp, Mus musculus
gatgtgtggcctccaaatctgccaa

SEQ ID NO: 442620 - DNA, 25 bp, Mus musculus
gatgtgtggctgctaccagagataa

SEQ ID NO: 442621 - DNA, 25 bp, Mus musculus
gatgtgtgtttgaattgccagcaga

SEQ ID NO: 442622 - DNA, 25 bp, Mus musculus
gatgtgttacatgaggccctgcagg

SEQ ID NO: 442623 - DNA, 25 bp, Mus musculus
gatgtgttccgcctagctaaggaga

SEQ ID NO: 442624 - DNA, 25 bp, Mus musculus
gatgtgttctgtcaacctgaggcca

SEQ ID NO: 442625 - DNA, 25 bp, Mus musculus
gatgtgttgatacaacagagtggcc

SEQ ID NO: 442626 - DNA, 25 bp, Mus musculus
gatgtgttgatgcagctgaagtcca

SEQ ID NO: 442627 - DNA, 25 bp, Mus musculus
gatgtgttttttcagctcctccgcc

SEQ ID NO: 442628 - DNA, 25 bp, Mus musculus
gatgttaaacttcaggcagggccgt

SEQ ID NO: 442629 - DNA, 25 bp, Mus musculus
gatgttaacacacccaaccgaggga

SEQ ID NO: 442630 - DNA, 25 bp, Mus musculus
gatgttaacattcctcagcacgcta

SEQ ID NO: 442631 - DNA, 25 bp, Mus musculus
gatgttacactcagtaatgtgcccg

SEQ ID NO: 442632 - DNA, 25 bp, Mus musculus
gatgttaccgagacacacacagaag

SEQ ID NO: 442633 - DNA, 25 bp, Mus musculus
gatgttacttcgaggtcacaccgag

SEQ ID NO: 442634 - DNA, 25 bp, Mus musculus
gatgttatactaagtcgctgaacca

SEQ ID NO: 442635 - DNA, 25 bp, Mus musculus
gatgttatgacacctatgcggcaga

SEQ ID NO: 442636 - DNA, 25 bp, Mus musculus
gatgttcaaaagtgccagcgggcca

SEQ ID NO: 442637 - DNA, 25 bp, Mus musculus
gatgttcaagctacggcagatgcgg

SEQ ID NO: 442638 - DNA, 25 bp, Mus musculus
gatgttcagattcccaaaggagcct

SEQ ID NO: 442639 - DNA, 25 bp, Mus musculus
gatgttcatggcactcacctggcag

SEQ ID NO: 442640 - DNA, 25 bp, Mus musculus
gatgttccaacctgaaagaggcaga

SEQ ID NO: 442641 - DNA, 25 bp, Mus musculus
gatgttccacaagaagtccgaggca

SEQ ID NO: 442642 - DNA, 25 bp, Mus musculus
gatgttccatcagcaggcgctgcag

SEQ ID NO: 442643 - DNA, 25 bp, Mus musculus
gatgttcccattggcctcctacgga

SEQ ID NO: 442644 - DNA, 25 bp, Mus musculus
gatgttccccattctttatcccttg

SEQ ID NO: 442645 - DNA, 25 bp, Mus musculus
gatgttcccggaaacgccttggtag

SEQ ID NO: 442646 - DNA, 25 bp, Mus musculus
gatgttccgcgaggcagtaaaccag

SEQ ID NO: 442647 - DNA, 25 bp, Mus musculus
gatgttcgacgctgctaagtccccg

SEQ ID NO: 442648 - DNA, 25 bp, Mus musculus
gatgttcgagcactggacttcccta

SEQ ID NO: 442649 - DNA, 25 bp, Mus musculus
gatgttcgatcagtcccagattcag

SEQ ID NO: 442650 - DNA, 25 bp, Mus musculus
gatgttctcatgacttgctccagaa

SEQ ID NO: 442651 - DNA, 25 bp, Mus musculus
gatgttcttcaccttgcagatgcca

SEQ ID NO: 442652 - DNA, 25 bp, Mus musculus
gatgttcttcatgattcagccccag

SEQ ID NO: 442653 - DNA, 25 bp, Mus musculus
gatgttgaaagctctgggtccacca

SEQ ID NO: 442654 - DNA, 25 bp, Mus musculus
gatgttgaccctaaaatcctgcagc

SEQ ID NO: 442655 - DNA, 25 bp, Mus musculus
gatgttgacgtagaagcccatgatg

SEQ ID NO: 442656 - DNA, 25 bp, Mus musculus
gatgttgagttgctccgctcgcagc

SEQ ID NO: 442657 - DNA, 25 bp, Mus musculus
gatgttgatgtgatgcagctctgcc

SEQ ID NO: 442658 - DNA, 25 bp, Mus musculus
gatgttgcacgctcgatttgacgtt

SEQ ID NO: 442659 - DNA, 25 bp, Mus musculus
gatgttgccagccatcaagacggaa

SEQ ID NO: 442660 - DNA, 25 bp, Mus musculus
gatgttgcctccagatggaacagga

SEQ ID NO: 442661 - DNA, 25 bp, Mus musculus
gatgttgccttccagtgagttccaa

SEQ ID NO: 442662 - DNA, 25 bp, Mus musculus
gatgttgctaggtctctgctgcaga

SEQ ID NO: 442663 - DNA, 25 bp, Mus musculus
gatgttgctgaaactccggagatca

SEQ ID NO: 442664 - DNA, 25 bp, Mus musculus
gatgttggaaccgtatgtgacccca

SEQ ID NO: 442665 - DNA, 25 bp, Mus musculus
gatgttggccacagcataaacccag

SEQ ID NO: 442666 - DNA, 25 bp, Mus musculus
gatgttggctctctgtactgttcca

SEQ ID NO: 442667 - DNA, 25 bp, Mus musculus
gatgttgtacatttgcattcctggc

SEQ ID NO: 442668 - DNA, 25 bp, Mus musculus
gatgttgtcaaatacctccggagac

SEQ ID NO: 442669 - DNA, 25 bp, Mus musculus
gatgttgtgagaacccgcatgatga

SEQ ID NO: 442670 - DNA, 25 bp, Mus musculus
gatgttgtggcaccacatcctgcat

SEQ ID NO: 442671 - DNA, 25 bp, Mus musculus
gatgtttcagcatcagaaatttcta

SEQ ID NO: 442672 - DNA, 25 bp, Mus musculus
gatgtttccactatgcaggcagcac

SEQ ID NO: 442673 - DNA, 25 bp, Mus musculus
gatgtttccactctggtcgcctgtg

SEQ ID NO: 442674 - DNA, 25 bp, Mus musculus
gatgtttccagaccatgttcccaag

SEQ ID NO: 442675 - DNA, 25 bp, Mus musculus
gatgtttcccaccttataaagaaga

SEQ ID NO: 442676 - DNA, 25 bp, Mus musculus
gatgtttccccgaagttgtcctgct

SEQ ID NO: 442677 - DNA, 25 bp, Mus musculus
gatgtttctaactgcggtgctctca

SEQ ID NO: 442678 - DNA, 25 bp, Mus musculus
gatgtttctgcacactgcccagtgg

SEQ ID NO: 442679 - DNA, 25 bp, Mus musculus
gatgtttctggccagtaccttggag

SEQ ID NO: 442680 - DNA, 25 bp, Mus musculus
gatgtttcttggtgacctgccagaa

SEQ ID NO: 442681 - DNA, 25 bp, Mus musculus
gatgtttgaagatccgtacgctgcc

SEQ ID NO: 442682 - DNA, 25 bp, Mus musculus
gatgtttgcgctacctggcatggag

SEQ ID NO: 442683 - DNA, 25 bp, Mus musculus
gatgtttttcgtcttctgccaggag

SEQ ID NO: 442684 - DNA, 25 bp, Mus musculus
gattaaaacaagcttggcactcagt

SEQ ID NO: 442685 - DNA, 25 bp, Mus musculus
gattaaaacggatgcagcaggcctc

SEQ ID NO: 442686 - DNA, 25 bp, Mus musculus
gattaaaaggagcacagactggtcg

SEQ ID NO: 442687 - DNA, 25 bp, Mus musculus
gattaaaattgaggacacgccagtg

SEQ ID NO: 442688 - DNA, 25 bp, Mus musculus
gattaaacagcataccgcccctgtg

SEQ ID NO: 442689 - DNA, 25 bp, Mus musculus
gattaaacatagagatgcccgcagt

SEQ ID NO: 442690 - DNA, 25 bp, Mus musculus
gattaaacatgccacgggcgaggcc

SEQ ID NO: 442691 - DNA, 25 bp, Mus musculus
gattaaacttccacatcctggcggg

SEQ ID NO: 442692 - DNA, 25 bp, Mus musculus
gattaaagcactatccagccaggag

SEQ ID NO: 442693 - DNA, 25 bp, Mus musculus
gattaaaggtgaacgaggctctcca

SEQ ID NO: 442694 - DNA, 25 bp, Mus musculus
gattaaaggtgtccatagagctctc

SEQ ID NO: 442695 - DNA, 25 bp, Mus musculus
gattaaataaggaattagctgactc

SEQ ID NO: 442696 - DNA, 25 bp, Mus musculus
gattaaatacctggatcctgagtac

SEQ ID NO: 442697 - DNA, 25 bp, Mus musculus
gattaaatagttcccagtccagcaa

SEQ ID NO: 442698 - DNA, 25 bp, Mus musculus
gattaaattggcctgtggagacaca

SEQ ID NO: 442699 - DNA, 25 bp, Mus musculus
gattaacaagcggatcttggccctg

SEQ ID NO: 442700 - DNA, 25 bp, Mus musculus
gattaacactctggaggagcgcctg

SEQ ID NO: 442701 - DNA, 25 bp, Mus musculus
gattaacacttcatgtcactcagtg

SEQ ID NO: 442702 - DNA, 25 bp, Mus musculus
gattaacctgcctttgaacccatag

SEQ ID NO: 442703 - DNA, 25 bp, Mus musculus
gattaaccttcggtcttggcaccag

SEQ ID NO: 442704 - DNA, 25 bp, Mus musculus
gattaacgattaatatggaagggcc

SEQ ID NO: 442705 - DNA, 25 bp, Mus musculus
gattaacggagaattcaaggagctc

SEQ ID NO: 442706 - DNA, 25 bp, Mus musculus
gattaactaggaaaggcgatatcat

SEQ ID NO: 442707 - DNA, 25 bp, Mus musculus
gattaactggtagcattaaccacca

SEQ ID NO: 442708 - DNA, 25 bp, Mus musculus
gattaagcagaaattgggtcccatg

SEQ ID NO: 442709 - DNA, 25 bp, Mus musculus
gattaagcattgtgtagacctgtga

SEQ ID NO: 442710 - DNA, 25 bp, Mus musculus
gattaagcctgaaaccggagcggcc

SEQ ID NO: 442711 - DNA, 25 bp, Mus musculus
gattaagggatcagacaagtcaaat

SEQ ID NO: 442712 - DNA, 25 bp, Mus musculus
gattaagtgggtcaccagcctgcaa

SEQ ID NO: 442713 - DNA, 25 bp, Mus musculus
gattaatcacccaaagtctgcttgg

SEQ ID NO: 442714 - DNA, 25 bp, Mus musculus
gattaatgagacctatctggcccgc

SEQ ID NO: 442715 - DNA, 25 bp, Mus musculus
gattaatggagtcttttcagcacct

SEQ ID NO: 442716 - DNA, 25 bp, Mus musculus
gattaattccccaccaagggtggat

SEQ ID NO: 442717 - DNA, 25 bp, Mus musculus
gattaatttataactctgctccatg

SEQ ID NO: 442718 - DNA, 25 bp, Mus musculus
gattacaacatcactggctggctgg

SEQ ID NO: 442719 - DNA, 25 bp, Mus musculus
gattacaacgatgccgacatggcgc

SEQ ID NO: 442720 - DNA, 25 bp, Mus musculus
gattacaagagtgcaccactacagc

SEQ ID NO: 442721 - DNA, 25 bp, Mus musculus
gattacaagtcattctgccacgaag

SEQ ID NO: 442722 - DNA, 25 bp, Mus musculus
gattacagacatttccaacgggccg

SEQ ID NO: 442723 - DNA, 25 bp, Mus musculus
gattacagccggtatccagctcggg

SEQ ID NO: 442724 - DNA, 25 bp, Mus musculus
gattacatacactgcctcgtgccag

SEQ ID NO: 442725 - DNA, 25 bp, Mus musculus
gattacataggcctgagccatccca

SEQ ID NO: 442726 - DNA, 25 bp, Mus musculus
gattacattggtagacaaactgtct

SEQ ID NO: 442727 - DNA, 25 bp, Mus musculus
gattacatttggttccaggcaccag

SEQ ID NO: 442728 - DNA, 25 bp, Mus musculus
gattaccaaagtcatggacgtccgg

SEQ ID NO: 442729 - DNA, 25 bp, Mus musculus
gattaccaagcacgtactgcagagg

SEQ ID NO: 442730 - DNA, 25 bp, Mus musculus
gattaccaattaaaccataagtaga

SEQ ID NO: 442731 - DNA, 25 bp, Mus musculus
gattaccaattccaagtggagctgg

SEQ ID NO: 442732 - DNA, 25 bp, Mus musculus
gattaccagcaatatgttctgcctg

SEQ ID NO: 442733 - DNA, 25 bp, Mus musculus
gattacccctgtagaaatccgcggg

SEQ ID NO: 442734 - DNA, 25 bp, Mus musculus
gattacccgaaaatgctccaaatgg

SEQ ID NO: 442735 - DNA, 25 bp, Mus musculus
gattaccctgtgtgtagcctagcag

SEQ ID NO: 442736 - DNA, 25 bp, Mus musculus
gattaccgaataccagcatgaggct

SEQ ID NO: 442737 - DNA, 25 bp, Mus musculus
gattaccggtgttggtgctgtctcc

SEQ ID NO: 442738 - DNA, 25 bp, Mus musculus
gattacctaccgaggcatcgagcag

SEQ ID NO: 442739 - DNA, 25 bp, Mus musculus
gattaccttgtgcagcccttcatgg

SEQ ID NO: 442740 - DNA, 25 bp, Mus musculus
gattacgcaaatgcatctgtagggc

SEQ ID NO: 442741 - DNA, 25 bp, Mus musculus
gattacgcgcatgttgaggtcccgg

SEQ ID NO: 442742 - DNA, 25 bp, Mus musculus
gattacgtcctgaacctgaagcagc

SEQ ID NO: 442743 - DNA, 25 bp, Mus musculus
gattactattttgcactggcccaca

SEQ ID NO: 442744 - DNA, 25 bp, Mus musculus
gattactcaggttctccacatccgt

SEQ ID NO: 442745 - DNA, 25 bp, Mus musculus
gattactcccatcaaggcacaaaca

SEQ ID NO: 442746 - DNA, 25 bp, Mus musculus
gattactcggacattaccccgggca

SEQ ID NO: 442747 - DNA, 25 bp, Mus musculus
gattactctacgcaaagcgaccagg

SEQ ID NO: 442748 - DNA, 25 bp, Mus musculus
gattactctcgggatgctgctctga

SEQ ID NO: 442749 - DNA, 25 bp, Mus musculus
gattactctctcatgtggaaggccc

SEQ ID NO: 442750 - DNA, 25 bp, Mus musculus
gattactggaaaactcgggcacttt

SEQ ID NO: 442751 - DNA, 25 bp, Mus musculus
gattacttacacaccaagtgccgga

SEQ ID NO: 442752 - DNA, 25 bp, Mus musculus
gattagaaagcaaaggtagtcctca

SEQ ID NO: 442753 - DNA, 25 bp, Mus musculus
gattagacatctacggtgacgcaca

SEQ ID NO: 442754 - DNA, 25 bp, Mus musculus
gattagacccaggaacaggaagaga

SEQ ID NO: 442755 - DNA, 25 bp, Mus musculus
gattagactgacaggaagccaggct

SEQ ID NO: 442756 - DNA, 25 bp, Mus musculus
gattagagacccaagagcagttgcc

SEQ ID NO: 442757 - DNA, 25 bp, Mus musculus
gattagaggactcacagtatatgct

SEQ ID NO: 442758 - DNA, 25 bp, Mus musculus
gattagatgggctggttctggtcct

SEQ ID NO: 442759 - DNA, 25 bp, Mus musculus
gattagcacacttttcatagcagga

SEQ ID NO: 442760 - DNA, 25 bp, Mus musculus
gattagcagatatctccaggagggc

SEQ ID NO: 442761 - DNA, 25 bp, Mus musculus
gattagcctaaggtcccgggatgcc

SEQ ID NO: 442762 - DNA, 25 bp, Mus musculus
gattagcctgaacaaaagaagccct

SEQ ID NO: 442763 - DNA, 25 bp, Mus musculus
gattagcgggtaccatatgcaggaa

SEQ ID NO: 442764 - DNA, 25 bp, Mus musculus
gattagcgtgagctttactgagagc

SEQ ID NO: 442765 - DNA, 25 bp, Mus musculus
gattagctcttactgtgcagaggag

SEQ ID NO: 442766 - DNA, 25 bp, Mus musculus
gattaggaaaaggtgctgaggctca

SEQ ID NO: 442767 - DNA, 25 bp, Mus musculus
gattaggcatcaccatttccccagt

SEQ ID NO: 442768 - DNA, 25 bp, Mus musculus
gattaggccacctgaaggacatagc

SEQ ID NO: 442769 - DNA, 25 bp, Mus musculus
gattagggactatgacgcagttggc

SEQ ID NO: 442770 - DNA, 25 bp, Mus musculus
gattaggtgtttcaacattaagacc

SEQ ID NO: 442771 - DNA, 25 bp, Mus musculus
gattagtcgtggataccggctgcca

SEQ ID NO: 442772 - DNA, 25 bp, Mus musculus
gattagtgcccctctctcatttgaa

SEQ ID NO: 442773 - DNA, 25 bp, Mus musculus
gattagtggatgacacggacgccat

SEQ ID NO: 442774 - DNA, 25 bp, Mus musculus
gattagtgtcacacatgtgtccgga

SEQ ID NO: 442775 - DNA, 25 bp, Mus musculus
gattagtgtcacagggctggacccc

SEQ ID NO: 442776 - DNA, 25 bp, Mus musculus
gattataaaagaagacgccagtcct

SEQ ID NO: 442777 - DNA, 25 bp, Mus musculus
gattataaaccatacgccacagctg

SEQ ID NO: 442778 - DNA, 25 bp, Mus musculus
gattataaacccaccaacacggaga

SEQ ID NO: 442779 - DNA, 25 bp, Mus musculus
gattataatggagttgccacccagg

SEQ ID NO: 442780 - DNA, 25 bp, Mus musculus
gattataccatagttagtacggagt

SEQ ID NO: 442781 - DNA, 25 bp, Mus musculus
gattatactggcctctgggataccc

SEQ ID NO: 442782 - DNA, 25 bp, Mus musculus
gattatagagatgctccacaactac

SEQ ID NO: 442783 - DNA, 25 bp, Mus musculus
gattatatcgctggaatgcccagga

SEQ ID NO: 442784 - DNA, 25 bp, Mus musculus
gattatatgtgcgtctctgaagctg

SEQ ID NO: 442785 - DNA, 25 bp, Mus musculus
gattatcaagatttccagcacctgg

SEQ ID NO: 442786 - DNA, 25 bp, Mus musculus
gattatcacgtttgtggaccccaga

SEQ ID NO: 442787 - DNA, 25 bp, Mus musculus
gattatccagaaccctacagaccag

SEQ ID NO: 442788 - DNA, 25 bp, Mus musculus
gattatccagttatcccacgcagtt

SEQ ID NO: 442789 - DNA, 25 bp, Mus musculus
gattatcccagatgtctagcagtca

SEQ ID NO: 442790 - DNA, 25 bp, Mus musculus
gattatccccgcctcatagaagagg

SEQ ID NO: 442791 - DNA, 25 bp, Mus musculus
gattatccgactgcgacacaatgtg

SEQ ID NO: 442792 - DNA, 25 bp, Mus musculus
gattatcgcctcacatggaagcctg

SEQ ID NO: 442793 - DNA, 25 bp, Mus musculus
gattatcgtcccagagtcaacggca

SEQ ID NO: 442794 - DNA, 25 bp, Mus musculus
gattatctccatgaggccctcggtg

SEQ ID NO: 442795 - DNA, 25 bp, Mus musculus
gattatctcccgagctgtgggtcga

SEQ ID NO: 442796 - DNA, 25 bp, Mus musculus
gattatctgactcctcccgtggcag

SEQ ID NO: 442797 - DNA, 25 bp, Mus musculus
gattatctggtccttagcacgtggc

SEQ ID NO: 442798 - DNA, 25 bp, Mus musculus
gattatcttgacagaggctacccca

SEQ ID NO: 442799 - DNA, 25 bp, Mus musculus
gattatctttgaatgcgctgctccc

SEQ ID NO: 442800 - DNA, 25 bp, Mus musculus
gattatgaagatgccggttaccaga

SEQ ID NO: 442801 - DNA, 25 bp, Mus musculus
gattatgaatctgaaagtgctacgt

SEQ ID NO: 442802 - DNA, 25 bp, Mus musculus
gattatgacacagcttcctccttat

SEQ ID NO: 442803 - DNA, 25 bp, Mus musculus
gattatgacctcagccatgcccagt

SEQ ID NO: 442804 - DNA, 25 bp, Mus musculus
gattatgagcgaaccatgaggcggc

SEQ ID NO: 442805 - DNA, 25 bp, Mus musculus
gattatgaggcctttccggaccagg

SEQ ID NO: 442806 - DNA, 25 bp, Mus musculus
gattatgccaagaaggcccctaggg

SEQ ID NO: 442807 - DNA, 25 bp, Mus musculus
gattatgctcacatggtgtgtccag

SEQ ID NO: 442808 - DNA, 25 bp, Mus musculus
gattatggagaacctgctgcctcga

SEQ ID NO: 442809 - DNA, 25 bp, Mus musculus
gattatggagctagccgtgcatgcc

SEQ ID NO: 442810 - DNA, 25 bp, Mus musculus
gattatggccgacagctccatgacg

SEQ ID NO: 442811 - DNA, 25 bp, Mus musculus
gattatggccgagagaacagccacc

SEQ ID NO: 442812 - DNA, 25 bp, Mus musculus
gattatggtcagtcagtcttgatct

SEQ ID NO: 442813 - DNA, 25 bp, Mus musculus
gattatgtatcttaaacaagtgtgg

SEQ ID NO: 442814 - DNA, 25 bp, Mus musculus
gattatgtctcggagcctcagcagg

SEQ ID NO: 442815 - DNA, 25 bp, Mus musculus
gattatgtgaacctcccaccgaatg

SEQ ID NO: 442816 - DNA, 25 bp, Mus musculus
gattattagcagtcttacaggcaca

SEQ ID NO: 442817 - DNA, 25 bp, Mus musculus
gattattgacacgtccatgcgaggg

SEQ ID NO: 442818 - DNA, 25 bp, Mus musculus
gattattgggtaactgactgtttcc

SEQ ID NO: 442819 - DNA, 25 bp, Mus musculus
gattatttggccttcaaacgccagc

SEQ ID NO: 442820 - DNA, 25 bp, Mus musculus
gattcaaaaactgtacatctgccta

SEQ ID NO: 442821 - DNA, 25 bp, Mus musculus
gattcaaaaagatgtccgcagcaga

SEQ ID NO: 442822 - DNA, 25 bp, Mus musculus
gattcaaacctgtggtaccatggcc

SEQ ID NO: 442823 - DNA, 25 bp, Mus musculus
gattcaaaccttgcggactgtgcag

SEQ ID NO: 442824 - DNA, 25 bp, Mus musculus
gattcaaagatgtctgggccaggac

SEQ ID NO: 442825 - DNA, 25 bp, Mus musculus
gattcaaatgagatgtctccacagg

SEQ ID NO: 442826 - DNA, 25 bp, Mus musculus
gattcaacaggtagacatggcggca

SEQ ID NO: 442827 - DNA, 25 bp, Mus musculus
gattcaacctctggccatcgatgga

SEQ ID NO: 442828 - DNA, 25 bp, Mus musculus
gattcaactatatcattggaggctc

SEQ ID NO: 442829 - DNA, 25 bp, Mus musculus
gattcaactatggaggctgcttggg

SEQ ID NO: 442830 - DNA, 25 bp, Mus musculus
gattcaactgtcacaaacgctgcgc

SEQ ID NO: 442831 - DNA, 25 bp, Mus musculus
gattcaagaactgttttgccactgt

SEQ ID NO: 442832 - DNA, 25 bp, Mus musculus
gattcaagaagagccatcatgtcgg

SEQ ID NO: 442833 - DNA, 25 bp, Mus musculus
gattcaagatcagccagcaagtcct

SEQ ID NO: 442834 - DNA, 25 bp, Mus musculus
gattcaagatcgacatgccacacag

SEQ ID NO: 442835 - DNA, 25 bp, Mus musculus
gattcaagcagctacgacgcggcta

SEQ ID NO: 442836 - DNA, 25 bp, Mus musculus
gattcaagcatctgggtcttcaaga

SEQ ID NO: 442837 - DNA, 25 bp, Mus musculus
gattcaagctgaggaccacggctct

SEQ ID NO: 442838 - DNA, 25 bp, Mus musculus
gattcaaggtgtttgccaatggcca

SEQ ID NO: 442839 - DNA, 25 bp, Mus musculus
gattcaagtgcagctaactgctagg

SEQ ID NO: 442840 - DNA, 25 bp, Mus musculus
gattcaagttctcaccgagacctgg

SEQ ID NO: 442841 - DNA, 25 bp, Mus musculus
gattcaatatcattggcggccgacc

SEQ ID NO: 442842 - DNA, 25 bp, Mus musculus
gattcaatgtcacccctccaatgca

SEQ ID NO: 442843 - DNA, 25 bp, Mus musculus
gattcacaaatcaaacccaattaaa

SEQ ID NO: 442844 - DNA, 25 bp, Mus musculus
gattcacagctgtaatccctacact

SEQ ID NO: 442845 - DNA, 25 bp, Mus musculus
gattcacatagaggctcagtacggg

SEQ ID NO: 442846 - DNA, 25 bp, Mus musculus
gattcacccacctctagactcagag

SEQ ID NO: 442847 - DNA, 25 bp, Mus musculus
gattcaccggtcagagcaaaaaacg

SEQ ID NO: 442848 - DNA, 25 bp, Mus musculus
gattcacgaggatgtagagcggcaa

SEQ ID NO: 442849 - DNA, 25 bp, Mus musculus
gattcacgcagagttcgcacttcag

SEQ ID NO: 442850 - DNA, 25 bp, Mus musculus
gattcacgcgcagttcctcaaagaa

SEQ ID NO: 442851 - DNA, 25 bp, Mus musculus
gattcacggacatgccggaggagtt

SEQ ID NO: 442852 - DNA, 25 bp, Mus musculus
gattcacggttttctgctcctaggg

SEQ ID NO: 442853 - DNA, 25 bp, Mus musculus
gattcactatgaccctctacttcgc

SEQ ID NO: 442854 - DNA, 25 bp, Mus musculus
gattcactatgcttccaagggctca

SEQ ID NO: 442855 - DNA, 25 bp, Mus musculus
gattcactcttcgtcgttggctagg

SEQ ID NO: 442856 - DNA, 25 bp, Mus musculus
gattcactgcgttgttgagaggact

SEQ ID NO: 442857 - DNA, 25 bp, Mus musculus
gattcacttctagtcccgggtggtg

SEQ ID NO: 442858 - DNA, 25 bp, Mus musculus
gattcagaattaacagcgcggcacg

SEQ ID NO: 442859 - DNA, 25 bp, Mus musculus
gattcagagaccaggcttgtacttg

SEQ ID NO: 442860 - DNA, 25 bp, Mus musculus
gattcagagacctatggagaagaga

SEQ ID NO: 442861 - DNA, 25 bp, Mus musculus
gattcagagagggataagcagcccc

SEQ ID NO: 442862 - DNA, 25 bp, Mus musculus
gattcagagatcatgcaacaaaagc

SEQ ID NO: 442863 - DNA, 25 bp, Mus musculus
gattcagagctataccaacgtccaa

SEQ ID NO: 442864 - DNA, 25 bp, Mus musculus
gattcagagggctatgcagctcctg

SEQ ID NO: 442865 - DNA, 25 bp, Mus musculus
gattcagaggtaggtcgtgaccatc

SEQ ID NO: 442866 - DNA, 25 bp, Mus musculus
gattcagcagacattggccttggag

SEQ ID NO: 442867 - DNA, 25 bp, Mus musculus
gattcagcagatatccgtctacatt

SEQ ID NO: 442868 - DNA, 25 bp, Mus musculus
gattcagccactggctcccggaggg

SEQ ID NO: 442869 - DNA, 25 bp, Mus musculus
gattcagccatctggaagacctgtg

SEQ ID NO: 442870 - DNA, 25 bp, Mus musculus
gattcagcgggctcaatatacgcag

SEQ ID NO: 442871 - DNA, 25 bp, Mus musculus
gattcaggctcggatacttactggg

SEQ ID NO: 442872 - DNA, 25 bp, Mus musculus
gattcaggcttgactctcgggagca

SEQ ID NO: 442873 - DNA, 25 bp, Mus musculus
gattcagggagccatcaccacttgg

SEQ ID NO: 442874 - DNA, 25 bp, Mus musculus
gattcagggcttcagtcactctagg

SEQ ID NO: 442875 - DNA, 25 bp, Mus musculus
gattcagggttagccaagtccattg

SEQ ID NO: 442876 - DNA, 25 bp, Mus musculus
gattcaggtaccacttcagaggcag

SEQ ID NO: 442877 - DNA, 25 bp, Mus musculus
gattcaggtattgcacgagtacggc

SEQ ID NO: 442878 - DNA, 25 bp, Mus musculus
gattcaggtatttggccatcgggcc

SEQ ID NO: 442879 - DNA, 25 bp, Mus musculus
gattcaggtcgtatgccgccagatg

SEQ ID NO: 442880 - DNA, 25 bp, Mus musculus
gattcaggttattcccgagtggcca

SEQ ID NO: 442881 - DNA, 25 bp, Mus musculus
gattcagtatcacctggcacaggga

SEQ ID NO: 442882 - DNA, 25 bp, Mus musculus
gattcagtatggtaatagtggccgg

SEQ ID NO: 442883 - DNA, 25 bp, Mus musculus
gattcagtcaaatccacttttcgcc

SEQ ID NO: 442884 - DNA, 25 bp, Mus musculus
gattcagtcaacttacccagtggag

SEQ ID NO: 442885 - DNA, 25 bp, Mus musculus
gattcagtctgaagatcatggatcg

SEQ ID NO: 442886 - DNA, 25 bp, Mus musculus
gattcagtgatgagctgggctctgc

SEQ ID NO: 442887 - DNA, 25 bp, Mus musculus
gattcatagcccatggtgacgcaga

SEQ ID NO: 442888 - DNA, 25 bp, Mus musculus
gattcatatcggctctgggtgctca

SEQ ID NO: 442889 - DNA, 25 bp, Mus musculus
gattcatcgagatatcaaagggcag

SEQ ID NO: 442890 - DNA, 25 bp, Mus musculus
gattcatcggctgcatcagggaggt

SEQ ID NO: 442891 - DNA, 25 bp, Mus musculus
gattcatgaaccagcgtggagctag

SEQ ID NO: 442892 - DNA, 25 bp, Mus musculus
gattcatgaacctgtgatagcccag

SEQ ID NO: 442893 - DNA, 25 bp, Mus musculus
gattcatgagtacaagcggcaggtc

SEQ ID NO: 442894 - DNA, 25 bp, Mus musculus
gattcatgcctttgctacctcgtag

SEQ ID NO: 442895 - DNA, 25 bp, Mus musculus
gattcatggacctcccaatggccag

SEQ ID NO: 442896 - DNA, 25 bp, Mus musculus
gattcatggctgtgtgattcagaag

SEQ ID NO: 442897 - DNA, 25 bp, Mus musculus
gattcatggtgcatggctaccgcag

SEQ ID NO: 442898 - DNA, 25 bp, Mus musculus
gattcatgtgactagccgtgtgacc

SEQ ID NO: 442899 - DNA, 25 bp, Mus musculus
gattccaaaatctacatctatgatg

SEQ ID NO: 442900 - DNA, 25 bp, Mus musculus
gattccaacctccatccaatgattg

SEQ ID NO: 442901 - DNA, 25 bp, Mus musculus
gattccacatcgtgcgagccaatga

SEQ ID NO: 442902 - DNA, 25 bp, Mus musculus
gattccacccaatgcaactctgatg

SEQ ID NO: 442903 - DNA, 25 bp, Mus musculus
gattccacggtgtcaagaacatgag

SEQ ID NO: 442904 - DNA, 25 bp, Mus musculus
gattccactgttgagaagaactgtc

SEQ ID NO: 442905 - DNA, 25 bp, Mus musculus
gattccagagatctgtgctgtcaca

SEQ ID NO: 442906 - DNA, 25 bp, Mus musculus
gattccagcatccacagataccaag

SEQ ID NO: 442907 - DNA, 25 bp, Mus musculus
gattccaggtctacatgtaggtctc

SEQ ID NO: 442908 - DNA, 25 bp, Mus musculus
gattccagtgagtgaccaaggtcct

SEQ ID NO: 442909 - DNA, 25 bp, Mus musculus
gattccagtggtgatctgtgcagca

SEQ ID NO: 442910 - DNA, 25 bp, Mus musculus
gattccagtgtagacagccatacag

SEQ ID NO: 442911 - DNA, 25 bp, Mus musculus
gattccatgaaaaagtttgagcggg

SEQ ID NO: 442912 - DNA, 25 bp, Mus musculus
gattccatgctaccgtcctagtaag

SEQ ID NO: 442913 - DNA, 25 bp, Mus musculus
gattcccaaagaactgtgccaccca

SEQ ID NO: 442914 - DNA, 25 bp, Mus musculus
gattcccaaggagtgtccaagccat

SEQ ID NO: 442915 - DNA, 25 bp, Mus musculus
gattcccacaatgagctcgccggtg

SEQ ID NO: 442916 - DNA, 25 bp, Mus musculus
gattcccacagtgtaggcctcgagg

SEQ ID NO: 442917 - DNA, 25 bp, Mus musculus
gattcccagaatgcactgcgggtgg

SEQ ID NO: 442918 - DNA, 25 bp, Mus musculus
gattcccagccgacagctgctaaag

SEQ ID NO: 442919 - DNA, 25 bp, Mus musculus
gattcccaggaccagaccaactttg

SEQ ID NO: 442920 - DNA, 25 bp, Mus musculus
gattcccaggccacttccaaaggct

SEQ ID NO: 442921 - DNA, 25 bp, Mus musculus
gattcccatgaccagggctgctatg

SEQ ID NO: 442922 - DNA, 25 bp, Mus musculus
gattccccgggctcaagacaaagct

SEQ ID NO: 442923 - DNA, 25 bp, Mus musculus
gattcccctagtcgtgttcactgcc

SEQ ID NO: 442924 - DNA, 25 bp, Mus musculus
gattcccgctacgagcatgtcatga

SEQ ID NO: 442925 - DNA, 25 bp, Mus musculus
gattcccgctgaggtgatcaaccgg

SEQ ID NO: 442926 - DNA, 25 bp, Mus musculus
gattcccggaatgcagcccggacaa

SEQ ID NO: 442927 - DNA, 25 bp, Mus musculus
gattcccgggatgacttcaactctg

SEQ ID NO: 442928 - DNA, 25 bp, Mus musculus
gattcccgtgaagcagtttcccaag

SEQ ID NO: 442929 - DNA, 25 bp, Mus musculus
gattccctacacgttcatccttaga

SEQ ID NO: 442930 - DNA, 25 bp, Mus musculus
gattccctcctgcttttacctaacg

SEQ ID NO: 442931 - DNA, 25 bp, Mus musculus
gattccctctgcaaaaaatggccaa

SEQ ID NO: 442932 - DNA, 25 bp, Mus musculus
gattccctgaaaatgcctaagatgg

SEQ ID NO: 442933 - DNA, 25 bp, Mus musculus
gattccctgcctagacctctgggca

SEQ ID NO: 442934 - DNA, 25 bp, Mus musculus
gattccctgctaacagtgctgctgg

SEQ ID NO: 442935 - DNA, 25 bp, Mus musculus
gattccgagacatgttgactagcgc

SEQ ID NO: 442936 - DNA, 25 bp, Mus musculus
gattccgagcctgggaaaggcaaag

SEQ ID NO: 442937 - DNA, 25 bp, Mus musculus
gattccgaggcctctagaacagcta

SEQ ID NO: 442938 - DNA, 25 bp, Mus musculus
gattccgagggatgccaatgactga

SEQ ID NO: 442939 - DNA, 25 bp, Mus musculus
gattccgctttcctggtagccactg

SEQ ID NO: 442940 - DNA, 25 bp, Mus musculus
gattccggaacccttggtgctaggt

SEQ ID NO: 442941 - DNA, 25 bp, Mus musculus
gattccggatttggtcaagctgaga

SEQ ID NO: 442942 - DNA, 25 bp, Mus musculus
gattccggcttcgagcctactgtgg

SEQ ID NO: 442943 - DNA, 25 bp, Mus musculus
gattccgggaatgacatctatggca

SEQ ID NO: 442944 - DNA, 25 bp, Mus musculus
gattccggggcatgtctgagatctc

SEQ ID NO: 442945 - DNA, 25 bp, Mus musculus
gattccgtgggactgcacagctcta

SEQ ID NO: 442946 - DNA, 25 bp, Mus musculus
gattccgtggttgacaagatcacag

SEQ ID NO: 442947 - DNA, 25 bp, Mus musculus
gattccgttgcttttgggcgcagag

SEQ ID NO: 442948 - DNA, 25 bp, Mus musculus
gattccgtttgatggcagagtccca

SEQ ID NO: 442949 - DNA, 25 bp, Mus musculus
gattcctaagcaaaacggcgtggtg

SEQ ID NO: 442950 - DNA, 25 bp, Mus musculus
gattcctagtttctgtaaccacggg

SEQ ID NO: 442951 - DNA, 25 bp, Mus musculus
gattcctcactttatggctgtcaca

SEQ ID NO: 442952 - DNA, 25 bp, Mus musculus
gattcctcagaaatgtggtggcctc

SEQ ID NO: 442953 - DNA, 25 bp, Mus musculus
gattcctcccatggcggaagctgac

SEQ ID NO: 442954 - DNA, 25 bp, Mus musculus
gattcctcctcggtttgctaaaaag

SEQ ID NO: 442955 - DNA, 25 bp, Mus musculus
gattcctcctttccaggtgcggctg

SEQ ID NO: 442956 - DNA, 25 bp, Mus musculus
gattcctcggtagaacattttgctg

SEQ ID NO: 442957 - DNA, 25 bp, Mus musculus
gattcctctcctacaacacacaggg

SEQ ID NO: 442958 - DNA, 25 bp, Mus musculus
gattcctcttatgaaagctatagcc

SEQ ID NO: 442959 - DNA, 25 bp, Mus musculus
gattcctcttccattcttgctgttg

SEQ ID NO: 442960 - DNA, 25 bp, Mus musculus
gattcctgactaatcccagagggct

SEQ ID NO: 442961 - DNA, 25 bp, Mus musculus
gattcctgagacctatctggtggaa

SEQ ID NO: 442962 - DNA, 25 bp, Mus musculus
gattcctgcacgaagcactagacga

SEQ ID NO: 442963 - DNA, 25 bp, Mus musculus
gattcctgcgtagtacctgagagca

SEQ ID NO: 442964 - DNA, 25 bp, Mus musculus
gattcctgctgccaaccttgatgct

SEQ ID NO: 442965 - DNA, 25 bp, Mus musculus
gattcctggaaggagctcgcacaca

SEQ ID NO: 442966 - DNA, 25 bp, Mus musculus
gattcctggatacggagcagctgct

SEQ ID NO: 442967 - DNA, 25 bp, Mus musculus
gattcctggatcacaaaacgccagc

SEQ ID NO: 442968 - DNA, 25 bp, Mus musculus
gattcctggctctggaaactctggg

SEQ ID NO: 442969 - DNA, 25 bp, Mus musculus
gattcctggcttccgagattgtctc

SEQ ID NO: 442970 - DNA, 25 bp, Mus musculus
gattcctgggtcgagttcattgagc

SEQ ID NO: 442971 - DNA, 25 bp, Mus musculus
gattcctggtactcactggcagcca

SEQ ID NO: 442972 - DNA, 25 bp, Mus musculus
gattcctgtctctatgctgtagccg

SEQ ID NO: 442973 - DNA, 25 bp, Mus musculus
gattccttagatgtgctgagcagcc

SEQ ID NO: 442974 - DNA, 25 bp, Mus musculus
gattccttgaactacgtaccatgca

SEQ ID NO: 442975 - DNA, 25 bp, Mus musculus
gattccttgcagatggatgtagtga

SEQ ID NO: 442976 - DNA, 25 bp, Mus musculus
gattccttgggaggttcacttgcca

SEQ ID NO: 442977 - DNA, 25 bp, Mus musculus
gattcgaaagagatggcgttctgtg

SEQ ID NO: 442978 - DNA, 25 bp, Mus musculus
gattcgacaggactggaaacccaca

SEQ ID NO: 442979 - DNA, 25 bp, Mus musculus
gattcgacgcgagattgccaacagc

SEQ ID NO: 442980 - DNA, 25 bp, Mus musculus
gattcgagagagatgcagcacttgc

SEQ ID NO: 442981 - DNA, 25 bp, Mus musculus
gattcgaggaaagaggccaagcttg

SEQ ID NO: 442982 - DNA, 25 bp, Mus musculus
gattcgaggaatcaatgaggtcgca

SEQ ID NO: 442983 - DNA, 25 bp, Mus musculus
gattcgcatcatggtgtctcgcagc

SEQ ID NO: 442984 - DNA, 25 bp, Mus musculus
gattcgcatgactgaggagttccgg

SEQ ID NO: 442985 - DNA, 25 bp, Mus musculus
gattcgcccgagtgtacgtcctggg

SEQ ID NO: 442986 - DNA, 25 bp, Mus musculus
gattcgctggagacaaacaggccca

SEQ ID NO: 442987 - DNA, 25 bp, Mus musculus
gattcggacaagcacctcctcaaga

SEQ ID NO: 442988 - DNA, 25 bp, Mus musculus
gattcggactccgttgagcctcctg

SEQ ID NO: 442989 - DNA, 25 bp, Mus musculus
gattcggagtgagacctttggcacc

SEQ ID NO: 442990 - DNA, 25 bp, Mus musculus
gattcggcagtttgcgttccctggc

SEQ ID NO: 442991 - DNA, 25 bp, Mus musculus
gattcggcgggaaacgaccatcgat

SEQ ID NO: 442992 - DNA, 25 bp, Mus musculus
gattcgggttgttagggtcatctga

SEQ ID NO: 442993 - DNA, 25 bp, Mus musculus
gattcggtgagactctgccacaaaa

SEQ ID NO: 442994 - DNA, 25 bp, Mus musculus
gattcgtacagccaagatccagcag

SEQ ID NO: 442995 - DNA, 25 bp, Mus musculus
gattcgtatgagaaaaggacaccca

SEQ ID NO: 442996 - DNA, 25 bp, Mus musculus
gattcgtcattctcgccgaacactg

SEQ ID NO: 442997 - DNA, 25 bp, Mus musculus
gattcgtcgccagcatcaatgaagg

SEQ ID NO: 442998 - DNA, 25 bp, Mus musculus
gattcgtttggaacctggagggcca

SEQ ID NO: 442999 - DNA, 25 bp, Mus musculus
gattctaacatcatagcgctggcag

SEQ ID NO: 443000 - DNA, 25 bp, Mus musculus
gattctaagatctcgctgggcattg

SEQ ID NO: 443001 - DNA, 25 bp, Mus musculus
gattctacacacaactcccatgcaa

SEQ ID NO: 443002 - DNA, 25 bp, Mus musculus
gattctacctgggattttcctttgg

SEQ ID NO: 443003 - DNA, 25 bp, Mus musculus
gattctactgaggtaaatgcttggt

SEQ ID NO: 443004 - DNA, 25 bp, Mus musculus
gattctagacggaactgcagggcca

SEQ ID NO: 443005 - DNA, 25 bp, Mus musculus
gattctagagcagacgagccacatg

SEQ ID NO: 443006 - DNA, 25 bp, Mus musculus
gattctagagccctacccagtgtgg

SEQ ID NO: 443007 - DNA, 25 bp, Mus musculus
gattctagcactgccctgtaagcgt

SEQ ID NO: 443008 - DNA, 25 bp, Mus musculus
gattctaggaattcgcctcacttgg

SEQ ID NO: 443009 - DNA, 25 bp, Mus musculus
gattctaggatgtgaggcccagcag

SEQ ID NO: 443010 - DNA, 25 bp, Mus musculus
gattctaggtgcctcataccaatgc

SEQ ID NO: 443011 - DNA, 25 bp, Mus musculus
gattctatatgacacgtacccgctg

SEQ ID NO: 443012 - DNA, 25 bp, Mus musculus
gattctattgaatgggccttgccac

SEQ ID NO: 443013 - DNA, 25 bp, Mus musculus
gattctatttttgagcagcatccaa

SEQ ID NO: 443014 - DNA, 25 bp, Mus musculus
gattctcagagtataacaatttgtt

SEQ ID NO: 443015 - DNA, 25 bp, Mus musculus
gattctcaggcggaggcagctgtac

SEQ ID NO: 443016 - DNA, 25 bp, Mus musculus
gattctcagtactggcgcttcacca

SEQ ID NO: 443017 - DNA, 25 bp, Mus musculus
gattctcatcatgcaggcctgcaga

SEQ ID NO: 443018 - DNA, 25 bp, Mus musculus
gattctcattcagagcaccacggct

SEQ ID NO: 443019 - DNA, 25 bp, Mus musculus
gattctccaggagtctaaaagccaa

SEQ ID NO: 443020 - DNA, 25 bp, Mus musculus
gattctcccgagcataagaccactg

SEQ ID NO: 443021 - DNA, 25 bp, Mus musculus
gattctcccggaacagaacgacaga

SEQ ID NO: 443022 - DNA, 25 bp, Mus musculus
gattctcccggcgataaacaggact

SEQ ID NO: 443023 - DNA, 25 bp, Mus musculus
gattctcccttgacaaggttagcat

SEQ ID NO: 443024 - DNA, 25 bp, Mus musculus
gattctcctgagtagtggtgccctg

SEQ ID NO: 443025 - DNA, 25 bp, Mus musculus
gattctcctggctgtgaacactgtg

SEQ ID NO: 443026 - DNA, 25 bp, Mus musculus
gattctcggaacactgctcttcttg

SEQ ID NO: 443027 - DNA, 25 bp, Mus musculus
gattctcgtctgactggctgtggag

SEQ ID NO: 443028 - DNA, 25 bp, Mus musculus
gattctctaccaaatacaggcagga

SEQ ID NO: 443029 - DNA, 25 bp, Mus musculus
gattctctcagacgtgccacattct

SEQ ID NO: 443030 - DNA, 25 bp, Mus musculus
gattctctctgcatccaccattggc

SEQ ID NO: 443031 - DNA, 25 bp, Mus musculus
gattctctgaagaacaggtgggcct

SEQ ID NO: 443032 - DNA, 25 bp, Mus musculus
gattctctgatcctggtgggaaaag

SEQ ID NO: 443033 - DNA, 25 bp, Mus musculus
gattctctgcaactaaccctgggct

SEQ ID NO: 443034 - DNA, 25 bp, Mus musculus
gattctctgccaggaactcgaggac

SEQ ID NO: 443035 - DNA, 25 bp, Mus musculus
gattctctggcccaacacggtggaa

SEQ ID NO: 443036 - DNA, 25 bp, Mus musculus
gattctctgtgaccgtggcgcaaag

SEQ ID NO: 443037 - DNA, 25 bp, Mus musculus
gattctgaaccccatatccttctca

SEQ ID NO: 443038 - DNA, 25 bp, Mus musculus
gattctgaagagagatatgccacca

SEQ ID NO: 443039 - DNA, 25 bp, Mus musculus
gattctgaagccgagaagcagtcgc

SEQ ID NO: 443040 - DNA, 25 bp, Mus musculus
gattctgaattccatcaaagggcac

SEQ ID NO: 443041 - DNA, 25 bp, Mus musculus
gattctgactccctggcactaggat

SEQ ID NO: 443042 - DNA, 25 bp, Mus musculus
gattctgactcggactcacctttca

SEQ ID NO: 443043 - DNA, 25 bp, Mus musculus
gattctgagacgcaaaagcttgacc

SEQ ID NO: 443044 - DNA, 25 bp, Mus musculus
gattctgagagcatggtacccttcc

SEQ ID NO: 443045 - DNA, 25 bp, Mus musculus
gattctgaggcatatagctgggccg

SEQ ID NO: 443046 - DNA, 25 bp, Mus musculus
gattctgatgacgacgagaggccca

SEQ ID NO: 443047 - DNA, 25 bp, Mus musculus
gattctgatggaaagagggctccac

SEQ ID NO: 443048 - DNA, 25 bp, Mus musculus
gattctgattgctccatcccttgtt

SEQ ID NO: 443049 - DNA, 25 bp, Mus musculus
gattctgcaagcctctgtagccggt

SEQ ID NO: 443050 - DNA, 25 bp, Mus musculus
gattctgcaaggaggagctagccct

SEQ ID NO: 443051 - DNA, 25 bp, Mus musculus
gattctgcattgtgagccgctctcc

SEQ ID NO: 443052 - DNA, 25 bp, Mus musculus
gattctgccaatactggacactcag

SEQ ID NO: 443053 - DNA, 25 bp, Mus musculus
gattctgcctctacccttgtggtgg

SEQ ID NO: 443054 - DNA, 25 bp, Mus musculus
gattctgcctgagagcgccgtttgg

SEQ ID NO: 443055 - DNA, 25 bp, Mus musculus
gattctgcggagtgccatcagctac

SEQ ID NO: 443056 - DNA, 25 bp, Mus musculus
gattctggagagaagccgaacacct

SEQ ID NO: 443057 - DNA, 25 bp, Mus musculus
gattctggcaccctggtccgagatc

SEQ ID NO: 443058 - DNA, 25 bp, Mus musculus
gattctggccctgcgactcagtgtt

SEQ ID NO: 443059 - DNA, 25 bp, Mus musculus
gattctggcgctggtcatcagtgca

SEQ ID NO: 443060 - DNA, 25 bp, Mus musculus
gattctgggactataaggtatatgc

SEQ ID NO: 443061 - DNA, 25 bp, Mus musculus
gattctgggagacgctcaagctgaa

SEQ ID NO: 443062 - DNA, 25 bp, Mus musculus
gattctgggttcctatgtccgcatc

SEQ ID NO: 443063 - DNA, 25 bp, Mus musculus
gattctggttccttggtgctgcccc

SEQ ID NO: 443064 - DNA, 25 bp, Mus musculus
gattctgtataaactttgagatgaa

SEQ ID NO: 443065 - DNA, 25 bp, Mus musculus
gattctgtatgatgtggctaaaggc

SEQ ID NO: 443066 - DNA, 25 bp, Mus musculus
gattctgtcacagccgcaacgtgct

SEQ ID NO: 443067 - DNA, 25 bp, Mus musculus
gattctgtgaacctaccgctggatg

SEQ ID NO: 443068 - DNA, 25 bp, Mus musculus
gattctgtgacccttgcagacggcc

SEQ ID NO: 443069 - DNA, 25 bp, Mus musculus
gattctgtggcaacccatccttcca

SEQ ID NO: 443070 - DNA, 25 bp, Mus musculus
gattctgtggccacactgaacagtg

SEQ ID NO: 443071 - DNA, 25 bp, Mus musculus
gattctgtgtccaagctgcctctac

SEQ ID NO: 443072 - DNA, 25 bp, Mus musculus
gattctgttctctcaagccacctgg

SEQ ID NO: 443073 - DNA, 25 bp, Mus musculus
gattctgtttccacgtctgaccttc

SEQ ID NO: 443074 - DNA, 25 bp, Mus musculus
gattctgtttggacaacgcccgtat

SEQ ID NO: 443075 - DNA, 25 bp, Mus musculus
gattcttcagaagtacattgaacgg

SEQ ID NO: 443076 - DNA, 25 bp, Mus musculus
gattcttcatctgagtacctcggag

SEQ ID NO: 443077 - DNA, 25 bp, Mus musculus
gattcttccctaccatgtgtgtcca

SEQ ID NO: 443078 - DNA, 25 bp, Mus musculus
gattcttccgggagagacctggctt

SEQ ID NO: 443079 - DNA, 25 bp, Mus musculus
gattcttcgtggtgtgatctcagca

SEQ ID NO: 443080 - DNA, 25 bp, Mus musculus
gattcttctagaaagggttcccact

SEQ ID NO: 443081 - DNA, 25 bp, Mus musculus
gattcttctagagaacggcgccgac

SEQ ID NO: 443082 - DNA, 25 bp, Mus musculus
gattcttgaagaaagcactgcccaa

SEQ ID NO: 443083 - DNA, 25 bp, Mus musculus
gattcttggaggttccccaacccag

SEQ ID NO: 443084 - DNA, 25 bp, Mus musculus
gattcttgtcatggtgagcctcctg

SEQ ID NO: 443085 - DNA, 25 bp, Mus musculus
gattctttacgacagctcccctggt

SEQ ID NO: 443086 - DNA, 25 bp, Mus musculus
gattctttccaacttgtccatagat

SEQ ID NO: 443087 - DNA, 25 bp, Mus musculus
gattctttcttgtgttctattccta

SEQ ID NO: 443088 - DNA, 25 bp, Mus musculus
gattctttgacaagtttggaaacct

SEQ ID NO: 443089 - DNA, 25 bp, Mus musculus
gattctttgcactgcatcagcgccg

SEQ ID NO: 443090 - DNA, 25 bp, Mus musculus
gattgaaaacctggctctgagccca

SEQ ID NO: 443091 - DNA, 25 bp, Mus musculus
gattgaaaggtccagccatcaccct

SEQ ID NO: 443092 - DNA, 25 bp, Mus musculus
gattgaacaagacctgcctatcacg

SEQ ID NO: 443093 - DNA, 25 bp, Mus musculus
gattgaactgtagcccaaattgccc

SEQ ID NO: 443094 - DNA, 25 bp, Mus musculus
gattgaagactctcctacttggaag

SEQ ID NO: 443095 - DNA, 25 bp, Mus musculus
gattgaagcaagagaaacgtgatga

SEQ ID NO: 443096 - DNA, 25 bp, Mus musculus
gattgaagcatgtgccacgcttggc

SEQ ID NO: 443097 - DNA, 25 bp, Mus musculus
gattgaagccatcaacgggcagagc

SEQ ID NO: 443098 - DNA, 25 bp, Mus musculus
gattgaagcctagcagttgtatccc

SEQ ID NO: 443099 - DNA, 25 bp, Mus musculus
gattgaagttgaacaggctctggcc

SEQ ID NO: 443100 - DNA, 25 bp, Mus musculus
gattgaagttgcctggctccttgcg

SEQ ID NO: 443101 - DNA, 25 bp, Mus musculus
gattgaatagtttgtgcccggctct

SEQ ID NO: 443102 - DNA, 25 bp, Mus musculus
gattgaatccataccagagaagccc

SEQ ID NO: 443103 - DNA, 25 bp, Mus musculus
gattgaattccgctggcgcaggatc

SEQ ID NO: 443104 - DNA, 25 bp, Mus musculus
gattgaattgccaaaccaggcgtgc

SEQ ID NO: 443105 - DNA, 25 bp, Mus musculus
gattgacaggtccatgaaagccagg

SEQ ID NO: 443106 - DNA, 25 bp, Mus musculus
gattgacatcctgcctgaccgctta

SEQ ID NO: 443107 - DNA, 25 bp, Mus musculus
gattgacatctattccacccgggag

SEQ ID NO: 443108 - DNA, 25 bp, Mus musculus
gattgaccataatactatgaccctc

SEQ ID NO: 443109 - DNA, 25 bp, Mus musculus
gattgacccaagttactgacccaag

SEQ ID NO: 443110 - DNA, 25 bp, Mus musculus
gattgaccgagttacctgaggccag

SEQ ID NO: 443111 - DNA, 25 bp, Mus musculus
gattgaccggctagaaaaaggcagc

SEQ ID NO: 443112 - DNA, 25 bp, Mus musculus
gattgaccggtttcactgcttccta

SEQ ID NO: 443113 - DNA, 25 bp, Mus musculus
gattgacgtgcatactcgcttccag

SEQ ID NO: 443114 - DNA, 25 bp, Mus musculus
gattgactacatgctccagggagtg

SEQ ID NO: 443115 - DNA, 25 bp, Mus musculus
gattgactagccatgtctgcgttgg

SEQ ID NO: 443116 - DNA, 25 bp, Mus musculus
gattgactctattggctcctcacgg

SEQ ID NO: 443117 - DNA, 25 bp, Mus musculus
gattgactggaaaagacctgaaccc

SEQ ID NO: 443118 - DNA, 25 bp, Mus musculus
gattgacttctcctgtgagctcggc

SEQ ID NO: 443119 - DNA, 25 bp, Mus musculus
gattgacttgtctctccgaagccga

SEQ ID NO: 443120 - DNA, 25 bp, Mus musculus
gattgactttctacggttccggcca

SEQ ID NO: 443121 - DNA, 25 bp, Mus musculus
gattgagagaatgacgggaaagcct

SEQ ID NO: 443122 - DNA, 25 bp, Mus musculus
gattgagatctgcatagctgactgg

SEQ ID NO: 443123 - DNA, 25 bp, Mus musculus
gattgagcaacggtacccagaggaa

SEQ ID NO: 443124 - DNA, 25 bp, Mus musculus
gattgagcagcttccgatggaccta

SEQ ID NO: 443125 - DNA, 25 bp, Mus musculus
gattgagcccttcttaggcacctgg

SEQ ID NO: 443126 - DNA, 25 bp, Mus musculus
gattgagccggctcaggctgtcgct

SEQ ID NO: 443127 - DNA, 25 bp, Mus musculus
gattgaggaacaaaacaagcagctt

SEQ ID NO: 443128 - DNA, 25 bp, Mus musculus
gattgaggacgcatccactggcttg

SEQ ID NO: 443129 - DNA, 25 bp, Mus musculus
gattgagtcctttcctacggaaggc

SEQ ID NO: 443130 - DNA, 25 bp, Mus musculus
gattgagtgtgagatggcttttgtc

SEQ ID NO: 443131 - DNA, 25 bp, Mus musculus
gattgatatcctggttgggacccca

SEQ ID NO: 443132 - DNA, 25 bp, Mus musculus
gattgatatttctcctagagggagg

SEQ ID NO: 443133 - DNA, 25 bp, Mus musculus
gattgatcggaccagcagaaaccgc

SEQ ID NO: 443134 - DNA, 25 bp, Mus musculus
gattgatctttccagagtgccagga

SEQ ID NO: 443135 - DNA, 25 bp, Mus musculus
gattgatgcatatagccacctggag

SEQ ID NO: 443136 - DNA, 25 bp, Mus musculus
gattgatggagtgaaccttgccgcc

SEQ ID NO: 443137 - DNA, 25 bp, Mus musculus
gattgatgttagttctgtacttggg

SEQ ID NO: 443138 - DNA, 25 bp, Mus musculus
gattgattacctgcctgaagcccaa

SEQ ID NO: 443139 - DNA, 25 bp, Mus musculus
gattgattccaacatatcttaattt

SEQ ID NO: 443140 - DNA, 25 bp, Mus musculus
gattgattggtctgaattcggaagg

SEQ ID NO: 443141 - DNA, 25 bp, Mus musculus
gattgatttcaacagccaaaccaag

SEQ ID NO: 443142 - DNA, 25 bp, Mus musculus
gattgatttcgagactctggccctg

SEQ ID NO: 443143 - DNA, 25 bp, Mus musculus
gattgatttgtacgtaccctacccg

SEQ ID NO: 443144 - DNA, 25 bp, Mus musculus
gattgcaagttggatactcgaccag

SEQ ID NO: 443145 - DNA, 25 bp, Mus musculus
gattgcacagagagagtgacaccca

SEQ ID NO: 443146 - DNA, 25 bp, Mus musculus
gattgcacagtgtagacagacaagt

SEQ ID NO: 443147 - DNA, 25 bp, Mus musculus
gattgcactggtttggagtcccgga

SEQ ID NO: 443148 - DNA, 25 bp, Mus musculus
gattgcagccatcatacacagccct

SEQ ID NO: 443149 - DNA, 25 bp, Mus musculus
gattgcagctaaagactctgggagg

SEQ ID NO: 443150 - DNA, 25 bp, Mus musculus
gattgcagctccactggcctgctta

SEQ ID NO: 443151 - DNA, 25 bp, Mus musculus
gattgcagtccaggtgaggaacttc

SEQ ID NO: 443152 - DNA, 25 bp, Mus musculus
gattgcatagcaaatctgccatggc

SEQ ID NO: 443153 - DNA, 25 bp, Mus musculus
gattgcatctgtaacctacctggga

SEQ ID NO: 443154 - DNA, 25 bp, Mus musculus
gattgcatgtcaaatttatgcacgc

SEQ ID NO: 443155 - DNA, 25 bp, Mus musculus
gattgcattttaggctccaggagac

SEQ ID NO: 443156 - DNA, 25 bp, Mus musculus
gattgcatttttacaccatctgtag

SEQ ID NO: 443157 - DNA, 25 bp, Mus musculus
gattgccaacccacttgagacagag

SEQ ID NO: 443158 - DNA, 25 bp, Mus musculus
gattgccaactgctgtatgcgccag

SEQ ID NO: 443159 - DNA, 25 bp, Mus musculus
gattgccacaagttcgcggtcagct

SEQ ID NO: 443160 - DNA, 25 bp, Mus musculus
gattgccatctaatgaagggttttt

SEQ ID NO: 443161 - DNA, 25 bp, Mus musculus
gattgccatctggaccctctgtggg

SEQ ID NO: 443162 - DNA, 25 bp, Mus musculus
gattgccatgcattcagatagccag

SEQ ID NO: 443163 - DNA, 25 bp, Mus musculus
gattgcccaggttctaaggacagca

SEQ ID NO: 443164 - DNA, 25 bp, Mus musculus
gattgcccagtgattctccagaagc

SEQ ID NO: 443165 - DNA, 25 bp, Mus musculus
gattgccccatgtgccgtcttcatc

SEQ ID NO: 443166 - DNA, 25 bp, Mus musculus
gattgccctgtcttatggaaatcac

SEQ ID NO: 443167 - DNA, 25 bp, Mus musculus
gattgcccttggagaagcaccggta

SEQ ID NO: 443168 - DNA, 25 bp, Mus musculus
gattgcctcaagtgctgtaggacag

SEQ ID NO: 443169 - DNA, 25 bp, Mus musculus
gattgcctggatcaagaagctgcct

SEQ ID NO: 443170 - DNA, 25 bp, Mus musculus
gattgcctggtaggcccggcaacag

SEQ ID NO: 443171 - DNA, 25 bp, Mus musculus
gattgccttcatgtcgtggagccca

SEQ ID NO: 443172 - DNA, 25 bp, Mus musculus
gattgccttttgactgacgggttcc

SEQ ID NO: 443173 - DNA, 25 bp, Mus musculus
gattgcgaaagaagggcagttaact

SEQ ID NO: 443174 - DNA, 25 bp, Mus musculus
gattgcgactcactgctcgaaccct

SEQ ID NO: 443175 - DNA, 25 bp, Mus musculus
gattgcgaggctgccaacgttcact

SEQ ID NO: 443176 - DNA, 25 bp, Mus musculus
gattgcggccgtctggatcatctct

SEQ ID NO: 443177 - DNA, 25 bp, Mus musculus
gattgcgggacattctccattcaga

SEQ ID NO: 443178 - DNA, 25 bp, Mus musculus
gattgcggtactcgcctctctcggt

SEQ ID NO: 443179 - DNA, 25 bp, Mus musculus
gattgcgttagagaattagcagccg

SEQ ID NO: 443180 - DNA, 25 bp, Mus musculus
gattgcgtttcagctagctcttcac

SEQ ID NO: 443181 - DNA, 25 bp, Mus musculus
gattgctaaaacacattggtggtcc

SEQ ID NO: 443182 - DNA, 25 bp, Mus musculus
gattgctccgtagttaagagactga

SEQ ID NO: 443183 - DNA, 25 bp, Mus musculus
gattgctctgattgttgaaccaaca

SEQ ID NO: 443184 - DNA, 25 bp, Mus musculus
gattgctcttttcggtgattacagg

SEQ ID NO: 443185 - DNA, 25 bp, Mus musculus
gattgctgacagcaacggattcgat

SEQ ID NO: 443186 - DNA, 25 bp, Mus musculus
gattgctgacgtggacacggactcc

SEQ ID NO: 443187 - DNA, 25 bp, Mus musculus
gattgctgagtcacgtcactttgaa

SEQ ID NO: 443188 - DNA, 25 bp, Mus musculus
gattgctgccttcaaagaacaccag

SEQ ID NO: 443189 - DNA, 25 bp, Mus musculus
gattgctggagcttaaaaacgggca

SEQ ID NO: 443190 - DNA, 25 bp, Mus musculus
gattgctgtctctcatgagtgatgg

SEQ ID NO: 443191 - DNA, 25 bp, Mus musculus
gattgctgtctgctgaagatcaaga

SEQ ID NO: 443192 - DNA, 25 bp, Mus musculus
gattgctgtggagacatctatggtc

SEQ ID NO: 443193 - DNA, 25 bp, Mus musculus
gattgcttacggatagtctgcccca

SEQ ID NO: 443194 - DNA, 25 bp, Mus musculus
gattgcttcgtcttcttgccttaca

SEQ ID NO: 443195 - DNA, 25 bp, Mus musculus
gattgcttcttctggccactgaggg

SEQ ID NO: 443196 - DNA, 25 bp, Mus musculus
gattgcttgctacccctgaacagtg

SEQ ID NO: 443197 - DNA, 25 bp, Mus musculus
gattgctttgggatactctggtatg

SEQ ID NO: 443198 - DNA, 25 bp, Mus musculus
gattgcttttggatcgcggctgcga

SEQ ID NO: 443199 - DNA, 25 bp, Mus musculus
gattggaagaccacggagaagacca

SEQ ID NO: 443200 - DNA, 25 bp, Mus musculus
gattggaagagatgcacacagcgct

SEQ ID NO: 443201 - DNA, 25 bp, Mus musculus
gattggaagttgaccccagcaagca

SEQ ID NO: 443202 - DNA, 25 bp, Mus musculus
gattggaataaccaggacacgcttg

SEQ ID NO: 443203 - DNA, 25 bp, Mus musculus
gattggaatatctcttaaagcctga

SEQ ID NO: 443204 - DNA, 25 bp, Mus musculus
gattggacagcggatgcctcggtat

SEQ ID NO: 443205 - DNA, 25 bp, Mus musculus
gattggacagctcctatagacagca

SEQ ID NO: 443206 - DNA, 25 bp, Mus musculus
gattggaccatctagtgtggaaggc

SEQ ID NO: 443207 - DNA, 25 bp, Mus musculus
gattggactcaactcacagcttcac

SEQ ID NO: 443208 - DNA, 25 bp, Mus musculus
gattggagaaagctatagacttcag

SEQ ID NO: 443209 - DNA, 25 bp, Mus musculus
gattggagattgtccacataaaggg

SEQ ID NO: 443210 - DNA, 25 bp, Mus musculus
gattggatacacgtgccaccggctt

SEQ ID NO: 443211 - DNA, 25 bp, Mus musculus
gattggatatcctggctaggtccca

SEQ ID NO: 443212 - DNA, 25 bp, Mus musculus
gattggatgacttctgcaagcctga

SEQ ID NO: 443213 - DNA, 25 bp, Mus musculus
gattggattacccacctcttacggc

SEQ ID NO: 443214 - DNA, 25 bp, Mus musculus
gattggattctcatctcccgaagga

SEQ ID NO: 443215 - DNA, 25 bp, Mus musculus
gattggcaatggtacaagagcccac

SEQ ID NO: 443216 - DNA, 25 bp, Mus musculus
gattggcacacagctttgaaagcca

SEQ ID NO: 443217 - DNA, 25 bp, Mus musculus
gattggcagcttctaaatggacctc

SEQ ID NO: 443218 - DNA, 25 bp, Mus musculus
gattggcagttgtggagttcctttc

SEQ ID NO: 443219 - DNA, 25 bp, Mus musculus
gattggcatccagtccgcaaagtta

SEQ ID NO: 443220 - DNA, 25 bp, Mus musculus
gattggccaagtgacagctcgtgac

SEQ ID NO: 443221 - DNA, 25 bp, Mus musculus
gattggcccttggagcatcgaaaag

SEQ ID NO: 443222 - DNA, 25 bp, Mus musculus
gattggcctaactgaccagaacggg

SEQ ID NO: 443223 - DNA, 25 bp, Mus musculus
gattggcctccgatttactgtgtag

SEQ ID NO: 443224 - DNA, 25 bp, Mus musculus
gattggcctgcatgacccacaaaag

SEQ ID NO: 443225 - DNA, 25 bp, Mus musculus
gattggcctgtctaacatcacccag

SEQ ID NO: 443226 - DNA, 25 bp, Mus musculus
gattggcggtgcctctcaagccgat

SEQ ID NO: 443227 - DNA, 25 bp, Mus musculus
gattggctacagattacaaggcccc

SEQ ID NO: 443228 - DNA, 25 bp, Mus musculus
gattggctaccaaaaggccttgcac

SEQ ID NO: 443229 - DNA, 25 bp, Mus musculus
gattggctatgcatacactgtggta

SEQ ID NO: 443230 - DNA, 25 bp, Mus musculus
gattggctccaagcaatagcatcta

SEQ ID NO: 443231 - DNA, 25 bp, Mus musculus
gattgggacctgagccgagagaact

SEQ ID NO: 443232 - DNA, 25 bp, Mus musculus
gattgggatcctcgaattgtcagac

SEQ ID NO: 443233 - DNA, 25 bp, Mus musculus
gattgggatcttcagtctccctgtt

SEQ ID NO: 443234 - DNA, 25 bp, Mus musculus
gattgggccaatcattacctcgcta

SEQ ID NO: 443235 - DNA, 25 bp, Mus musculus
gattgggccatcctggtaaaccgga

SEQ ID NO: 443236 - DNA, 25 bp, Mus musculus
gattgggcctgaatggttccagcag

SEQ ID NO: 443237 - DNA, 25 bp, Mus musculus
gattgggtcacacgttacatgctgc

SEQ ID NO: 443238 - DNA, 25 bp, Mus musculus
gattggtaataagcccacgctccgg

SEQ ID NO: 443239 - DNA, 25 bp, Mus musculus
gattggtagccctatgtttgcatca

SEQ ID NO: 443240 - DNA, 25 bp, Mus musculus
gattggtcattccacaggaacggtt

SEQ ID NO: 443241 - DNA, 25 bp, Mus musculus
gattggtgagagaaagcactccgtt

SEQ ID NO: 443242 - DNA, 25 bp, Mus musculus
gattggtgagccagggataccgatc

SEQ ID NO: 443243 - DNA, 25 bp, Mus musculus
gattggtgcaaaactcagcccctga

SEQ ID NO: 443244 - DNA, 25 bp, Mus musculus
gattgtaaagtgacctaccaggccc

SEQ ID NO: 443245 - DNA, 25 bp, Mus musculus
gattgtaaccgttgccaaaagccag

SEQ ID NO: 443246 - DNA, 25 bp, Mus musculus
gattgtaagagaacattgccagcct

SEQ ID NO: 443247 - DNA, 25 bp, Mus musculus
gattgtaagaggcagaataccagga

SEQ ID NO: 443248 - DNA, 25 bp, Mus musculus
gattgtaccttggtcactgttgcct

SEQ ID NO: 443249 - DNA, 25 bp, Mus musculus
gattgtactcgcacgggctactcag

SEQ ID NO: 443250 - DNA, 25 bp, Mus musculus
gattgtactgaaaagccttccctgg

SEQ ID NO: 443251 - DNA, 25 bp, Mus musculus
gattgtactgcgtcagcttgctcca

SEQ ID NO: 443252 - DNA, 25 bp, Mus musculus
gattgtagactacgacgactccctg

SEQ ID NO: 443253 - DNA, 25 bp, Mus musculus
gattgtagcccagatctcagagccc

SEQ ID NO: 443254 - DNA, 25 bp, Mus musculus
gattgtaggacagcctcagattgcg

SEQ ID NO: 443255 - DNA, 25 bp, Mus musculus
gattgtatatctgcttacctgtggc

SEQ ID NO: 443256 - DNA, 25 bp, Mus musculus
gattgtattgcacgtcattaagctg

SEQ ID NO: 443257 - DNA, 25 bp, Mus musculus
gattgtcaatacagagcttcgtttg

SEQ ID NO: 443258 - DNA, 25 bp, Mus musculus
gattgtcaatgaaagtccagcctcc

SEQ ID NO: 443259 - DNA, 25 bp, Mus musculus
gattgtcacccagatgctcgaattg

SEQ ID NO: 443260 - DNA, 25 bp, Mus musculus
gattgtcaccgttaagtcagctgga

SEQ ID NO: 443261 - DNA, 25 bp, Mus musculus
gattgtcacctatgggcgcgttccc

SEQ ID NO: 443262 - DNA, 25 bp, Mus musculus
gattgtcactcagaagatcacgacg

SEQ ID NO: 443263 - DNA, 25 bp, Mus musculus
gattgtcatcacgtccattctgggc

SEQ ID NO: 443264 - DNA, 25 bp, Mus musculus
gattgtcatcagaagactctcactc

SEQ ID NO: 443265 - DNA, 25 bp, Mus musculus
gattgtcatccctgcggtgctccct

SEQ ID NO: 443266 - DNA, 25 bp, Mus musculus
gattgtcatggccatagactccgtg

SEQ ID NO: 443267 - DNA, 25 bp, Mus musculus
gattgtcattcagaacccatgtgag

SEQ ID NO: 443268 - DNA, 25 bp, Mus musculus
gattgtcgacctggtcctggatcga

SEQ ID NO: 443269 - DNA, 25 bp, Mus musculus
gattgtcggtcactatcagctggcc

SEQ ID NO: 443270 - DNA, 25 bp, Mus musculus
gattgtcgtggacatgttcttttcc

SEQ ID NO: 443271 - DNA, 25 bp, Mus musculus
gattgtcgttctcggaagcctgagc

SEQ ID NO: 443272 - DNA, 25 bp, Mus musculus
gattgtctaccatccggaacgcaga

SEQ ID NO: 443273 - DNA, 25 bp, Mus musculus
gattgtctcagcatgatcaggtcaa

SEQ ID NO: 443274 - DNA, 25 bp, Mus musculus
gattgtcttacggatctgcctggcg

SEQ ID NO: 443275 - DNA, 25 bp, Mus musculus
gattgtcttaggaccgtaccacgag

SEQ ID NO: 443276 - DNA, 25 bp, Mus musculus
gattgtgaaactaagcccgtgggag

SEQ ID NO: 443277 - DNA, 25 bp, Mus musculus
gattgtgaaatacctttaggcttgt

SEQ ID NO: 443278 - DNA, 25 bp, Mus musculus
gattgtgacaccctcagaaaaggct

SEQ ID NO: 443279 - DNA, 25 bp, Mus musculus
gattgtgagtcaccgtgtagatgca

SEQ ID NO: 443280 - DNA, 25 bp, Mus musculus
gattgtgctgaaccagagtccctgg

SEQ ID NO: 443281 - DNA, 25 bp, Mus musculus
gattgtggaccgattccttcacctg

SEQ ID NO: 443282 - DNA, 25 bp, Mus musculus
gattgtggagattgcccggcttcgc

SEQ ID NO: 443283 - DNA, 25 bp, Mus musculus
gattgtggattaccacggctgtgac

SEQ ID NO: 443284 - DNA, 25 bp, Mus musculus
gattgtggcctcatgagtcatttgc

SEQ ID NO: 443285 - DNA, 25 bp, Mus musculus
gattgtggtcacagcttctgccaag

SEQ ID NO: 443286 - DNA, 25 bp, Mus musculus
gattgtggtgctatccataactgga

SEQ ID NO: 443287 - DNA, 25 bp, Mus musculus
gattgtgtaaccaaagctgaacgtg

SEQ ID NO: 443288 - DNA, 25 bp, Mus musculus
gattgtgtacccttgagcaactcaa

SEQ ID NO: 443289 - DNA, 25 bp, Mus musculus
gattgtgtagaaactgactccggcc

SEQ ID NO: 443290 - DNA, 25 bp, Mus musculus
gattgtgtcccatgtccagatggag

SEQ ID NO: 443291 - DNA, 25 bp, Mus musculus
gattgtgtcggattgactggtccca

SEQ ID NO: 443292 - DNA, 25 bp, Mus musculus
gattgtgtctggacgcactgcacgg

SEQ ID NO: 443293 - DNA, 25 bp, Mus musculus
gattgtgtgcctttccgtgacctgg

SEQ ID NO: 443294 - DNA, 25 bp, Mus musculus
gattgtgttcgagctgatccctctc

SEQ ID NO: 443295 - DNA, 25 bp, Mus musculus
gattgtgttggacacccacctgcac

SEQ ID NO: 443296 - DNA, 25 bp, Mus musculus
gattgttaaattctcgcaaaaccat

SEQ ID NO: 443297 - DNA, 25 bp, Mus musculus
gattgttaccaagactccaggctag

SEQ ID NO: 443298 - DNA, 25 bp, Mus musculus
gattgttactagctctgggatccta

SEQ ID NO: 443299 - DNA, 25 bp, Mus musculus
gattgttatcaccaagacgacccca

SEQ ID NO: 443300 - DNA, 25 bp, Mus musculus
gattgttatcgagggctttcagacc

SEQ ID NO: 443301 - DNA, 25 bp, Mus musculus
gattgttcaacctaaacttcatttt

SEQ ID NO: 443302 - DNA, 25 bp, Mus musculus
gattgttcatgttccattctgctaa

SEQ ID NO: 443303 - DNA, 25 bp, Mus musculus
gattgttccaaatactcagcagagt

SEQ ID NO: 443304 - DNA, 25 bp, Mus musculus
gattgttccgaccactacgtgctag

SEQ ID NO: 443305 - DNA, 25 bp, Mus musculus
gattgttgacaagtgctccggagcc

SEQ ID NO: 443306 - DNA, 25 bp, Mus musculus
gattgtttacccatggactcagaga

SEQ ID NO: 443307 - DNA, 25 bp, Mus musculus
gattgtttaccgcagacaccgcgtg

SEQ ID NO: 443308 - DNA, 25 bp, Mus musculus
gattgtttgctcaggtctgcgacga

SEQ ID NO: 443309 - DNA, 25 bp, Mus musculus
gattgtttggccaacccagctgtgc

SEQ ID NO: 443310 - DNA, 25 bp, Mus musculus
gatttaaaatcctcccctggctgga

SEQ ID NO: 443311 - DNA, 25 bp, Mus musculus
gatttaaccgcaaggataccagtga

SEQ ID NO: 443312 - DNA, 25 bp, Mus musculus
gatttaacgtctggtgctgcccgag

SEQ ID NO: 443313 - DNA, 25 bp, Mus musculus
gatttaagaattttgggacacacac

SEQ ID NO: 443314 - DNA, 25 bp, Mus musculus
gatttaagcgagaactggagtaggt

SEQ ID NO: 443315 - DNA, 25 bp, Mus musculus
gatttaaggccaagtcaataagcgg

SEQ ID NO: 443316 - DNA, 25 bp, Mus musculus
gatttaatccattaactcaactgat

SEQ ID NO: 443317 - DNA, 25 bp, Mus musculus
gatttaatgagggaaatacgagcca

SEQ ID NO: 443318 - DNA, 25 bp, Mus musculus
gatttaattcttgggaagagctttg

SEQ ID NO: 443319 - DNA, 25 bp, Mus musculus
gatttacactctcagctgaacagag

SEQ ID NO: 443320 - DNA, 25 bp, Mus musculus
gatttacagtatgcgctccaggaga

SEQ ID NO: 443321 - DNA, 25 bp, Mus musculus
gatttacagtcatttcccgcaggaa

SEQ ID NO: 443322 - DNA, 25 bp, Mus musculus
gatttaccactgtcgggagcagcct

SEQ ID NO: 443323 - DNA, 25 bp, Mus musculus
gatttaccagtgtatcaatcaggtg

SEQ ID NO: 443324 - DNA, 25 bp, Mus musculus
gatttacctgctcccattgacttca

SEQ ID NO: 443325 - DNA, 25 bp, Mus musculus
gatttacgcaccaaagcaaccgtgg

SEQ ID NO: 443326 - DNA, 25 bp, Mus musculus
gatttagcaccggaggctcctttcc

SEQ ID NO: 443327 - DNA, 25 bp, Mus musculus
gatttagcactgtccagaaggaagc

SEQ ID NO: 443328 - DNA, 25 bp, Mus musculus
gatttaggatcctctgactctgtgg

SEQ ID NO: 443329 - DNA, 25 bp, Mus musculus
gatttaggcctcatcggtgcttccg

SEQ ID NO: 443330 - DNA, 25 bp, Mus musculus
gatttaggtacaggtggctgtcaac

SEQ ID NO: 443331 - DNA, 25 bp, Mus musculus
gatttagtattctgtgtaaagtgcc

SEQ ID NO: 443332 - DNA, 25 bp, Mus musculus
gatttagttacaaggacaacgtcga

SEQ ID NO: 443333 - DNA, 25 bp, Mus musculus
gatttataaaaaagcccagcgacag

SEQ ID NO: 443334 - DNA, 25 bp, Mus musculus
gatttatatgcatgctggacctgga

SEQ ID NO: 443335 - DNA, 25 bp, Mus musculus
gatttatcagaaatgacagctcgtc

SEQ ID NO: 443336 - DNA, 25 bp, Mus musculus
gatttatcagcgagagtggcaacgc

SEQ ID NO: 443337 - DNA, 25 bp, Mus musculus
gatttatcccggcaaaacccgactg

SEQ ID NO: 443338 - DNA, 25 bp, Mus musculus
gatttatcttaggatccgcccatga

SEQ ID NO: 443339 - DNA, 25 bp, Mus musculus
gatttatcttgtcagcagtgtacca

SEQ ID NO: 443340 - DNA, 25 bp, Mus musculus
gatttatgcggtgtcaagctcctgc

SEQ ID NO: 443341 - DNA, 25 bp, Mus musculus
gatttatgtagtgcacatccctggg

SEQ ID NO: 443342 - DNA, 25 bp, Mus musculus
gatttattaatatcccagaggcgtg

SEQ ID NO: 443343 - DNA, 25 bp, Mus musculus
gatttattcacttcaggttagcctg

SEQ ID NO: 443344 - DNA, 25 bp, Mus musculus
gatttattcacttctacttgtggac

SEQ ID NO: 443345 - DNA, 25 bp, Mus musculus
gatttattctagacagtgcagggca

SEQ ID NO: 443346 - DNA, 25 bp, Mus musculus
gatttattgatgtctcgccagcaga

SEQ ID NO: 443347 - DNA, 25 bp, Mus musculus
gatttattgcacatactgagtacag

SEQ ID NO: 443348 - DNA, 25 bp, Mus musculus
gatttattgctaagaggctctgccc

SEQ ID NO: 443349 - DNA, 25 bp, Mus musculus
gatttattttgtcctgttccctggc

SEQ ID NO: 443350 - DNA, 25 bp, Mus musculus
gatttcaaaactggtcagaaggcag

SEQ ID NO: 443351 - DNA, 25 bp, Mus musculus
gatttcaaagtcttaccccaggagg

SEQ ID NO: 443352 - DNA, 25 bp, Mus musculus
gatttcaagaccctggcggatgtgc

SEQ ID NO: 443353 - DNA, 25 bp, Mus musculus
gatttcaagagggcagggcagcttc

SEQ ID NO: 443354 - DNA, 25 bp, Mus musculus
gatttcaagccatgatacgcctggg

SEQ ID NO: 443355 - DNA, 25 bp, Mus musculus
gatttcaatcatcagagcccatctg

SEQ ID NO: 443356 - DNA, 25 bp, Mus musculus
gatttcacagaagttagcctttggc

SEQ ID NO: 443357 - DNA, 25 bp, Mus musculus
gatttcacctcatgttctgaccaga

SEQ ID NO: 443358 - DNA, 25 bp, Mus musculus
gatttcacctgcaaaacaaaacatg

SEQ ID NO: 443359 - DNA, 25 bp, Mus musculus
gatttcacgaacgaagccacactgg

SEQ ID NO: 443360 - DNA, 25 bp, Mus musculus
gatttcagacgatgctggagccacc

SEQ ID NO: 443361 - DNA, 25 bp, Mus musculus
gatttcagcctggacaacgaggtgc

SEQ ID NO: 443362 - DNA, 25 bp, Mus musculus
gatttcaggtgccattgctttccgt

SEQ ID NO: 443363 - DNA, 25 bp, Mus musculus
gatttcatcagctgacggtgccttg

SEQ ID NO: 443364 - DNA, 25 bp, Mus musculus
gatttcatccggcttcatggtgcag

SEQ ID NO: 443365 - DNA, 25 bp, Mus musculus
gatttcatcgtgcaacggtacgtgg

SEQ ID NO: 443366 - DNA, 25 bp, Mus musculus
gatttcattccgtcgcagccagaag

SEQ ID NO: 443367 - DNA, 25 bp, Mus musculus
gatttccactagaaggcgcctctga

SEQ ID NO: 443368 - DNA, 25 bp, Mus musculus
gatttccagacagcataggtgggag

SEQ ID NO: 443369 - DNA, 25 bp, Mus musculus
gatttccagccatggcaaaatctgg

SEQ ID NO: 443370 - DNA, 25 bp, Mus musculus
gatttccagccctgtgttttctcca

SEQ ID NO: 443371 - DNA, 25 bp, Mus musculus
gatttccagcggagtcatcgtggcc

SEQ ID NO: 443372 - DNA, 25 bp, Mus musculus
gatttccagctgcttccggttgtat

SEQ ID NO: 443373 - DNA, 25 bp, Mus musculus
gatttccatcctgtcgagtaacgag

SEQ ID NO: 443374 - DNA, 25 bp, Mus musculus
gatttccccaaagattcagagctgg

SEQ ID NO: 443375 - DNA, 25 bp, Mus musculus
gatttccccttagatcctcggatgg

SEQ ID NO: 443376 - DNA, 25 bp, Mus musculus
gatttcccgatgcttcctcagaggg

SEQ ID NO: 443377 - DNA, 25 bp, Mus musculus
gatttccctaaacagcccacgttga

SEQ ID NO: 443378 - DNA, 25 bp, Mus musculus
gatttccctgccctccgagaagagg

SEQ ID NO: 443379 - DNA, 25 bp, Mus musculus
gatttccctggagcttgacaaaaag

SEQ ID NO: 443380 - DNA, 25 bp, Mus musculus
gatttccctgtacatcccctctgag

SEQ ID NO: 443381 - DNA, 25 bp, Mus musculus
gatttccgggaccttgtacacagcc

SEQ ID NO: 443382 - DNA, 25 bp, Mus musculus
gatttcctctcaaaggtcacgctgg

SEQ ID NO: 443383 - DNA, 25 bp, Mus musculus
gatttcctgactgttcgcaggccct

SEQ ID NO: 443384 - DNA, 25 bp, Mus musculus
gatttcctgaggacatgctagccta

SEQ ID NO: 443385 - DNA, 25 bp, Mus musculus
gatttcctgaggatccattgagcgc

SEQ ID NO: 443386 - DNA, 25 bp, Mus musculus
gatttcctgctgcaacgagtcgaga

SEQ ID NO: 443387 - DNA, 25 bp, Mus musculus
gatttcctgtcacggagatcacaga

SEQ ID NO: 443388 - DNA, 25 bp, Mus musculus
gatttccttgacgtgtctcccgagg

SEQ ID NO: 443389 - DNA, 25 bp, Mus musculus
gatttcgagctgatccatgaggagc

SEQ ID NO: 443390 - DNA, 25 bp, Mus musculus
gatttcgatgttttcaaagcccggg

SEQ ID NO: 443391 - DNA, 25 bp, Mus musculus
gatttcgcacaacagatacagaagg

SEQ ID NO: 443392 - DNA, 25 bp, Mus musculus
gatttcgctcccgaagcaaagttta

SEQ ID NO: 443393 - DNA, 25 bp, Mus musculus
gatttcgggcagaacagcctgtttg

SEQ ID NO: 443394 - DNA, 25 bp, Mus musculus
gatttcgtaccgaggctgcagcggc

SEQ ID NO: 443395 - DNA, 25 bp, Mus musculus
gatttcgtggctgcctggtcaacca

SEQ ID NO: 443396 - DNA, 25 bp, Mus musculus
gatttcgttgaaagtctcccagtga

SEQ ID NO: 443397 - DNA, 25 bp, Mus musculus
gatttctacacactttcctgatgga

SEQ ID NO: 443398 - DNA, 25 bp, Mus musculus
gatttctaccatgacgtgctgccgg

SEQ ID NO: 443399 - DNA, 25 bp, Mus musculus
gatttctaccggaagactagccgta

SEQ ID NO: 443400 - DNA, 25 bp, Mus musculus
gatttctcacaagtgcacagcaggg

SEQ ID NO: 443401 - DNA, 25 bp, Mus musculus
gatttctcagagatcagtctagcag

SEQ ID NO: 443402 - DNA, 25 bp, Mus musculus
gatttctccgcaaagaaaagggaag

SEQ ID NO: 443403 - DNA, 25 bp, Mus musculus
gatttctcggtcacggcattcgcct

SEQ ID NO: 443404 - DNA, 25 bp, Mus musculus
gatttctgacaattaaaacattctg

SEQ ID NO: 443405 - DNA, 25 bp, Mus musculus
gatttctgacctggacttctgcgcc

SEQ ID NO: 443406 - DNA, 25 bp, Mus musculus
gatttctgaggaacaaatctccctc

SEQ ID NO: 443407 - DNA, 25 bp, Mus musculus
gatttctgatactctcattggtggc

SEQ ID NO: 443408 - DNA, 25 bp, Mus musculus
gatttctggcactgctgacagctgc

SEQ ID NO: 443409 - DNA, 25 bp, Mus musculus
gatttctggccaaacctactcaggt

SEQ ID NO: 443410 - DNA, 25 bp, Mus musculus
gatttctgggaaacggagtcgcctc

SEQ ID NO: 443411 - DNA, 25 bp, Mus musculus
gatttcttcggtgagagtgagccgc

SEQ ID NO: 443412 - DNA, 25 bp, Mus musculus
gatttcttctactctgccctggtgg

SEQ ID NO: 443413 - DNA, 25 bp, Mus musculus
gatttcttcttaaccagcgcgcttg

SEQ ID NO: 443414 - DNA, 25 bp, Mus musculus
gatttcttggattccagggaggctc

SEQ ID NO: 443415 - DNA, 25 bp, Mus musculus
gatttcttttagtgggcggctactc

SEQ ID NO: 443416 - DNA, 25 bp, Mus musculus
gatttgaacagagcccagaggtacc

SEQ ID NO: 443417 - DNA, 25 bp, Mus musculus
gatttgaagactcggatccagggca

SEQ ID NO: 443418 - DNA, 25 bp, Mus musculus
gatttgaagccactccatgtactgg

SEQ ID NO: 443419 - DNA, 25 bp, Mus musculus
gatttgacagtttgagcgacacttc

SEQ ID NO: 443420 - DNA, 25 bp, Mus musculus
gatttgaccccaacaccagggagga

SEQ ID NO: 443421 - DNA, 25 bp, Mus musculus
gatttgaccccttgcgagatgccga

SEQ ID NO: 443422 - DNA, 25 bp, Mus musculus
gatttgacggtctctacagtggtcg

SEQ ID NO: 443423 - DNA, 25 bp, Mus musculus
gatttgacgttggttgccctggcca

SEQ ID NO: 443424 - DNA, 25 bp, Mus musculus
gatttgacgttttaatcgggaggag

SEQ ID NO: 443425 - DNA, 25 bp, Mus musculus
gatttgagaacgaaaactggaaaga

SEQ ID NO: 443426 - DNA, 25 bp, Mus musculus
gatttgagacgttgtccccagcctg

SEQ ID NO: 443427 - DNA, 25 bp, Mus musculus
gatttgaggagataaaagaccgact

SEQ ID NO: 443428 - DNA, 25 bp, Mus musculus
gatttgagggataagttcacggcca

SEQ ID NO: 443429 - DNA, 25 bp, Mus musculus
gatttgagtggaatgtgaggtcttc

SEQ ID NO: 443430 - DNA, 25 bp, Mus musculus
gatttgatatcagactccgaggcag

SEQ ID NO: 443431 - DNA, 25 bp, Mus musculus
gatttgatcacatatgccggctatg

SEQ ID NO: 443432 - DNA, 25 bp, Mus musculus
gatttgatgatatgtcctcaccagg

SEQ ID NO: 443433 - DNA, 25 bp, Mus musculus
gatttgatgtgttccagatcggcag

SEQ ID NO: 443434 - DNA, 25 bp, Mus musculus
gatttgattcacctcaggagcacgg

SEQ ID NO: 443435 - DNA, 25 bp, Mus musculus
gatttgcaaccccaaggaagtcctt

SEQ ID NO: 443436 - DNA, 25 bp, Mus musculus
gatttgcaagtatgtctccccaagg

SEQ ID NO: 443437 - DNA, 25 bp, Mus musculus
gatttgcagctaagagtgatggccc

SEQ ID NO: 443438 - DNA, 25 bp, Mus musculus
gatttgcaggactcgactctggaga

SEQ ID NO: 443439 - DNA, 25 bp, Mus musculus
gatttgccaaacatacggactacgg

SEQ ID NO: 443440 - DNA, 25 bp, Mus musculus
gatttgccacactgacgggatagct

SEQ ID NO: 443441 - DNA, 25 bp, Mus musculus
gatttgccagggtcaacatccgcta

SEQ ID NO: 443442 - DNA, 25 bp, Mus musculus
gatttgccccagagtcgaagtagct

SEQ ID NO: 443443 - DNA, 25 bp, Mus musculus
gatttgccccgggaaggaagcagca

SEQ ID NO: 443444 - DNA, 25 bp, Mus musculus
gatttgccctggaaaggacttacca

SEQ ID NO: 443445 - DNA, 25 bp, Mus musculus
gatttgccgaatcaacaaggagagc

SEQ ID NO: 443446 - DNA, 25 bp, Mus musculus
gatttgccgatttgccgagccatgc

SEQ ID NO: 443447 - DNA, 25 bp, Mus musculus
gatttgcctaccgttacccagactg

SEQ ID NO: 443448 - DNA, 25 bp, Mus musculus
gatttgcctccgtaaacatttgtag

SEQ ID NO: 443449 - DNA, 25 bp, Mus musculus
gatttgcctctgacgctccaggaag

SEQ ID NO: 443450 - DNA, 25 bp, Mus musculus
gatttgcgtgctgacacaggtagcg

SEQ ID NO: 443451 - DNA, 25 bp, Mus musculus
gatttgctgactaaatggaagcctg

SEQ ID NO: 443452 - DNA, 25 bp, Mus musculus
gatttgctgtctgttatgatctaga

SEQ ID NO: 443453 - DNA, 25 bp, Mus musculus
gatttgcttcaggtaagtcaccagg

SEQ ID NO: 443454 - DNA, 25 bp, Mus musculus
gatttggaaagtggacagcccaggc

SEQ ID NO: 443455 - DNA, 25 bp, Mus musculus
gatttggaacttggagaactgagaa

SEQ ID NO: 443456 - DNA, 25 bp, Mus musculus
gatttggagaatcgctgtcagagcc

SEQ ID NO: 443457 - DNA, 25 bp, Mus musculus
gatttggagccaccatgggagacaa

SEQ ID NO: 443458 - DNA, 25 bp, Mus musculus
gatttggatctgaaactctgtcggg

SEQ ID NO: 443459 - DNA, 25 bp, Mus musculus
gatttggcaaaggtccccgagtgta

SEQ ID NO: 443460 - DNA, 25 bp, Mus musculus
gatttggcctctttgggatctacaa

SEQ ID NO: 443461 - DNA, 25 bp, Mus musculus
gatttggctgatcctaggacctgga

SEQ ID NO: 443462 - DNA, 25 bp, Mus musculus
gatttgggagctgtatacttgagcg

SEQ ID NO: 443463 - DNA, 25 bp, Mus musculus
gatttgggcccctcagcatggttag

SEQ ID NO: 443464 - DNA, 25 bp, Mus musculus
gatttgggcctcagtctctagtcct

SEQ ID NO: 443465 - DNA, 25 bp, Mus musculus
gatttgggcgcagcagttttgaacc

SEQ ID NO: 443466 - DNA, 25 bp, Mus musculus
gatttgggcgtcatgactcagcagg

SEQ ID NO: 443467 - DNA, 25 bp, Mus musculus
gatttgggtatccaggagaacttct

SEQ ID NO: 443468 - DNA, 25 bp, Mus musculus
gatttggtgcctagactgctccctg

SEQ ID NO: 443469 - DNA, 25 bp, Mus musculus
gatttggtgggtgtaactgagttcc

SEQ ID NO: 443470 - DNA, 25 bp, Mus musculus
gatttggtggtcttcgctctgggcc

SEQ ID NO: 443471 - DNA, 25 bp, Mus musculus
gatttgtcacgtctgcatcggagcc

SEQ ID NO: 443472 - DNA, 25 bp, Mus musculus
gatttgtcctactcccagtcctacg

SEQ ID NO: 443473 - DNA, 25 bp, Mus musculus
gatttgtcttctcggctgctctccc

SEQ ID NO: 443474 - DNA, 25 bp, Mus musculus
gatttgtgctatttcggcagaggca

SEQ ID NO: 443475 - DNA, 25 bp, Mus musculus
gatttgtgggagctgccttcttcca

SEQ ID NO: 443476 - DNA, 25 bp, Mus musculus
gatttgtgtgtctgttacagccagc

SEQ ID NO: 443477 - DNA, 25 bp, Mus musculus
gatttgttacttacatactaaggaa

SEQ ID NO: 443478 - DNA, 25 bp, Mus musculus
gatttgttcccaacctggctgatgg

SEQ ID NO: 443479 - DNA, 25 bp, Mus musculus
gatttgttggcacctatctcggagc

SEQ ID NO: 443480 - DNA, 25 bp, Mus musculus
gattttaaaacagccctccactggg

SEQ ID NO: 443481 - DNA, 25 bp, Mus musculus
gattttaaacggcttcctggaggca

SEQ ID NO: 443482 - DNA, 25 bp, Mus musculus
gattttaaagctttccagacaccgc

SEQ ID NO: 443483 - DNA, 25 bp, Mus musculus
gattttaacagcttgcaacaggtaa

SEQ ID NO: 443484 - DNA, 25 bp, Mus musculus
gattttaacttcgaacccggctcag

SEQ ID NO: 443485 - DNA, 25 bp, Mus musculus
gattttacaaaagagccaccctgcc

SEQ ID NO: 443486 - DNA, 25 bp, Mus musculus
gattttacacctaacccctgcagag

SEQ ID NO: 443487 - DNA, 25 bp, Mus musculus
gattttacaggtgacaataggcaca

SEQ ID NO: 443488 - DNA, 25 bp, Mus musculus
gattttaccactgaaggccgactgg

SEQ ID NO: 443489 - DNA, 25 bp, Mus musculus
gattttacccagcagggagagcccg

SEQ ID NO: 443490 - DNA, 25 bp, Mus musculus
gattttactaccaagcttccaaggg

SEQ ID NO: 443491 - DNA, 25 bp, Mus musculus
gattttacttcttattttgcattgc

SEQ ID NO: 443492 - DNA, 25 bp, Mus musculus
gattttatcaggatgtgcacagcca

SEQ ID NO: 443493 - DNA, 25 bp, Mus musculus
gattttatctctcggaagagtttga

SEQ ID NO: 443494 - DNA, 25 bp, Mus musculus
gattttcaaagacgcactggcccag

SEQ ID NO: 443495 - DNA, 25 bp, Mus musculus
gattttcaaagtcccctcggaggct

SEQ ID NO: 443496 - DNA, 25 bp, Mus musculus
gattttcaagggtcagttccgacct

SEQ ID NO: 443497 - DNA, 25 bp, Mus musculus
gattttcactccagatgtttcccag

SEQ ID NO: 443498 - DNA, 25 bp, Mus musculus
gattttcagatcttgtcccaattgg

SEQ ID NO: 443499 - DNA, 25 bp, Mus musculus
gattttccaagcatggctactcttc

SEQ ID NO: 443500 - DNA, 25 bp, Mus musculus
gattttccagcctggacgctgacgc

SEQ ID NO: 443501 - DNA, 25 bp, Mus musculus
gattttccatcacaaacgaagacta

SEQ ID NO: 443502 - DNA, 25 bp, Mus musculus
gattttcccaagctgaacaactgaa

SEQ ID NO: 443503 - DNA, 25 bp, Mus musculus
gattttccggatcgacgtgaaggca

SEQ ID NO: 443504 - DNA, 25 bp, Mus musculus
gattttccggatgaagctgggctcc

SEQ ID NO: 443505 - DNA, 25 bp, Mus musculus
gattttcctgtacatgggcgtcaca

SEQ ID NO: 443506 - DNA, 25 bp, Mus musculus
gattttcctgttcccgtatccttgg

SEQ ID NO: 443507 - DNA, 25 bp, Mus musculus
gattttcgccgttaccagggagcca

SEQ ID NO: 443508 - DNA, 25 bp, Mus musculus
gattttctcctgcaagtactgcccg

SEQ ID NO: 443509 - DNA, 25 bp, Mus musculus
gattttctggactgaaggtcatagg

SEQ ID NO: 443510 - DNA, 25 bp, Mus musculus
gattttctgtgcaacgagggccaca

SEQ ID NO: 443511 - DNA, 25 bp, Mus musculus
gattttcttatacatacccttcgtg

SEQ ID NO: 443512 - DNA, 25 bp, Mus musculus
gattttctttgcctccccttgagtg

SEQ ID NO: 443513 - DNA, 25 bp, Mus musculus
gattttgaacctagaaaagcctgtt

SEQ ID NO: 443514 - DNA, 25 bp, Mus musculus
gattttgaagagctgttggcaccca

SEQ ID NO: 443515 - DNA, 25 bp, Mus musculus
gattttgacattgccggacagttcg

SEQ ID NO: 443516 - DNA, 25 bp, Mus musculus
gattttgagttcacccctaagccag

SEQ ID NO: 443517 - DNA, 25 bp, Mus musculus
gattttgccaactgggagacttaaa

SEQ ID NO: 443518 - DNA, 25 bp, Mus musculus
gattttgcccatcgacacaaggagc

SEQ ID NO: 443519 - DNA, 25 bp, Mus musculus
gattttgctaacctgacaccctttg

SEQ ID NO: 443520 - DNA, 25 bp, Mus musculus
gattttggaccactcaatctggcca

SEQ ID NO: 443521 - DNA, 25 bp, Mus musculus
gattttggagtctggaaagccttca

SEQ ID NO: 443522 - DNA, 25 bp, Mus musculus
gattttggtaaagcagtcgcccctg

SEQ ID NO: 443523 - DNA, 25 bp, Mus musculus
gattttgtgatgtccgccagaggct

SEQ ID NO: 443524 - DNA, 25 bp, Mus musculus
gattttgttgaagacgactcagaca

SEQ ID NO: 443525 - DNA, 25 bp, Mus musculus
gattttgttgatgctcccagactgg

SEQ ID NO: 443526 - DNA, 25 bp, Mus musculus
gatttttctaatatggcctctgccg

SEQ ID NO: 443527 - DNA, 25 bp, Mus musculus
gatttttctacccaaatgacaccca

SEQ ID NO: 443528 - DNA, 25 bp, Mus musculus
gatttttgaggacaccatcagcacc

SEQ ID NO: 443529 - DNA, 25 bp, Mus musculus
gatttttgccagttagtagcccagc

SEQ ID NO: 443530 - DNA, 25 bp, Mus musculus
gatttttggccgcactctacgagaa

SEQ ID NO: 443531 - DNA, 25 bp, Mus musculus
gatttttggtgaagatggcctgaca

SEQ ID NO: 443532 - DNA, 25 bp, Mus musculus
gattttttaatctaagcaccactga

SEQ ID NO: 443533 - DNA, 25 bp, Mus musculus
gattttttcactaaaggccctggag

SEQ ID NO: 443534 - DNA, 25 bp, Mus musculus
gcaaaaaagagagaacctgacacta

SEQ ID NO: 443535 - DNA, 25 bp, Mus musculus
gcaaaaactctgaccatgacctggg

SEQ ID NO: 443536 - DNA, 25 bp, Mus musculus
gcaaaaagaaccctagcctgaagag

SEQ ID NO: 443537 - DNA, 25 bp, Mus musculus
gcaaaaaggctcaaaattcttcgtt

SEQ ID NO: 443538 - DNA, 25 bp, Mus musculus
gcaaaaatgtggtcccggtgtacga

SEQ ID NO: 443539 - DNA, 25 bp, Mus musculus
gcaaaacaggcactctctagggact

SEQ ID NO: 443540 - DNA, 25 bp, Mus musculus
gcaaaaccacctcttagctgaatgg

SEQ ID NO: 443541 - DNA, 25 bp, Mus musculus
gcaaaaccatgtactgtgccaggta

SEQ ID NO: 443542 - DNA, 25 bp, Mus musculus
gcaaaacctaggaggaagaccttct

SEQ ID NO: 443543 - DNA, 25 bp, Mus musculus
gcaaaaccttcacttattccagtgg

SEQ ID NO: 443544 - DNA, 25 bp, Mus musculus
gcaaaaccttgtggagccttatgag

SEQ ID NO: 443545 - DNA, 25 bp, Mus musculus
gcaaaactaagatattggcctagca

SEQ ID NO: 443546 - DNA, 25 bp, Mus musculus
gcaaaactgggcgaattacagcgca

SEQ ID NO: 443547 - DNA, 25 bp, Mus musculus
gcaaaagaagcagcagttagcgtct

SEQ ID NO: 443548 - DNA, 25 bp, Mus musculus
gcaaaagagagatgtacagtcgcct

SEQ ID NO: 443549 - DNA, 25 bp, Mus musculus
gcaaaagagaggacaacttgcggga

SEQ ID NO: 443550 - DNA, 25 bp, Mus musculus
gcaaaagatgttcccctggccagtg

SEQ ID NO: 443551 - DNA, 25 bp, Mus musculus
gcaaaagattcagccgtacacggag

SEQ ID NO: 443552 - DNA, 25 bp, Mus musculus
gcaaaagcgtttctgctgaatcctg

SEQ ID NO: 443553 - DNA, 25 bp, Mus musculus
gcaaaagtggcctaagggaacaagg

SEQ ID NO: 443554 - DNA, 25 bp, Mus musculus
gcaaaagttgtagcgccaggctacc

SEQ ID NO: 443555 - DNA, 25 bp, Mus musculus
gcaaaataccagcagacgcaacagg

SEQ ID NO: 443556 - DNA, 25 bp, Mus musculus
gcaaaatactttgtacatcttaacc

SEQ ID NO: 443557 - DNA, 25 bp, Mus musculus
gcaaaatcaacgctccctagcaggg

SEQ ID NO: 443558 - DNA, 25 bp, Mus musculus
gcaaaatcacgctaacgacgccttg

SEQ ID NO: 443559 - DNA, 25 bp, Mus musculus
gcaaaatcagcccatacagtcagac

SEQ ID NO: 443560 - DNA, 25 bp, Mus musculus
gcaaaatgcggagcagcccgccttt

SEQ ID NO: 443561 - DNA, 25 bp, Mus musculus
gcaaaatggcttcctagcgagcgca

SEQ ID NO: 443562 - DNA, 25 bp, Mus musculus
gcaaacaactgcatctggaagccat

SEQ ID NO: 443563 - DNA, 25 bp, Mus musculus
gcaaacaccatggacatcggacgga

SEQ ID NO: 443564 - DNA, 25 bp, Mus musculus
gcaaacagctgtggcgaggttcctc

SEQ ID NO: 443565 - DNA, 25 bp, Mus musculus
gcaaacaggaagtcatcaaaggctt

SEQ ID NO: 443566 - DNA, 25 bp, Mus musculus
gcaaacaggcttgcaggacgctggc

SEQ ID NO: 443567 - DNA, 25 bp, Mus musculus
gcaaacagtgcacggagaagcctta

SEQ ID NO: 443568 - DNA, 25 bp, Mus musculus
gcaaacagttggttaaagcaaacat

SEQ ID NO: 443569 - DNA, 25 bp, Mus musculus
gcaaacatagttgcatcagaactca

SEQ ID NO: 443570 - DNA, 25 bp, Mus musculus
gcaaacatctgttgcctgggcagac

SEQ ID NO: 443571 - DNA, 25 bp, Mus musculus
gcaaacatgtcaagtccgagccaaa

SEQ ID NO: 443572 - DNA, 25 bp, Mus musculus
gcaaaccaagcctgtaccgtcctgg

SEQ ID NO: 443573 - DNA, 25 bp, Mus musculus
gcaaaccagcattgagacggaccga

SEQ ID NO: 443574 - DNA, 25 bp, Mus musculus
gcaaaccatcgaaaaggagagccga

SEQ ID NO: 443575 - DNA, 25 bp, Mus musculus
gcaaaccctgagaagtggagagaga

SEQ ID NO: 443576 - DNA, 25 bp, Mus musculus
gcaaaccctgtccaggttaatgtgt

SEQ ID NO: 443577 - DNA, 25 bp, Mus musculus
gcaaacccttcagatgccgaggctt

SEQ ID NO: 443578 - DNA, 25 bp, Mus musculus
gcaaaccgatatagtgaggcccacc

SEQ ID NO: 443579 - DNA, 25 bp, Mus musculus
gcaaacctgagtgccggctggaaag

SEQ ID NO: 443580 - DNA, 25 bp, Mus musculus
gcaaacctgcacaactggaaacctg

SEQ ID NO: 443581 - DNA, 25 bp, Mus musculus
gcaaacctggaaagaacaccttggg

SEQ ID NO: 443582 - DNA, 25 bp, Mus musculus
gcaaacctgttttccatagtgatta

SEQ ID NO: 443583 - DNA, 25 bp, Mus musculus
gcaaaccttccatttttgatgcgac

SEQ ID NO: 443584 - DNA, 25 bp, Mus musculus
gcaaacgcctggatcagccacaaat

SEQ ID NO: 443585 - DNA, 25 bp, Mus musculus
gcaaacgggccagtctggtagccca

SEQ ID NO: 443586 - DNA, 25 bp, Mus musculus
gcaaacgtctctagacagccaggag

SEQ ID NO: 443587 - DNA, 25 bp, Mus musculus
gcaaactaaatgtcaacctcctggg

SEQ ID NO: 443588 - DNA, 25 bp, Mus musculus
gcaaactacttctttaatgacccaa

SEQ ID NO: 443589 - DNA, 25 bp, Mus musculus
gcaaactcttttggttggctaaaca

SEQ ID NO: 443590 - DNA, 25 bp, Mus musculus
gcaaactgcagtggagggtggaagc

SEQ ID NO: 443591 - DNA, 25 bp, Mus musculus
gcaaactgcccgtcatccttgaaga

SEQ ID NO: 443592 - DNA, 25 bp, Mus musculus
gcaaactgctgacctgggcatcttg

SEQ ID NO: 443593 - DNA, 25 bp, Mus musculus
gcaaactgggaagctcaacagcgta

SEQ ID NO: 443594 - DNA, 25 bp, Mus musculus
gcaaactggttggaatctgcggcag

SEQ ID NO: 443595 - DNA, 25 bp, Mus musculus
gcaaacttgacttagaagactggga

SEQ ID NO: 443596 - DNA, 25 bp, Mus musculus
gcaaactttttggttcgttccagca

SEQ ID NO: 443597 - DNA, 25 bp, Mus musculus
gcaaagaaaaccgagaaggaggccg

SEQ ID NO: 443598 - DNA, 25 bp, Mus musculus
gcaaagaacacaatcacacgaaaga

SEQ ID NO: 443599 - DNA, 25 bp, Mus musculus
gcaaagaagattgcgaaagaagggc

SEQ ID NO: 443600 - DNA, 25 bp, Mus musculus
gcaaagaaggtgtccacggtggttt

SEQ ID NO: 443601 - DNA, 25 bp, Mus musculus
gcaaagactatctgatactcacagt

SEQ ID NO: 443602 - DNA, 25 bp, Mus musculus
gcaaagagactacagatgacccagt

SEQ ID NO: 443603 - DNA, 25 bp, Mus musculus
gcaaagagagccattacctaccaga

SEQ ID NO: 443604 - DNA, 25 bp, Mus musculus
gcaaagagctttcctacgtgatcag

SEQ ID NO: 443605 - DNA, 25 bp, Mus musculus
gcaaagaggccgcattagaagaggg

SEQ ID NO: 443606 - DNA, 25 bp, Mus musculus
gcaaagagtccgtgtggccaacatg

SEQ ID NO: 443607 - DNA, 25 bp, Mus musculus
gcaaagagtgtttcctagcctgagc

SEQ ID NO: 443608 - DNA, 25 bp, Mus musculus
gcaaagatatgctgatgagactccc

SEQ ID NO: 443609 - DNA, 25 bp, Mus musculus
gcaaagattaccatagaccctaagg

SEQ ID NO: 443610 - DNA, 25 bp, Mus musculus
gcaaagcaagaacaaacactacctt

SEQ ID NO: 443611 - DNA, 25 bp, Mus musculus
gcaaagcacctctcatgtgattgaa

SEQ ID NO: 443612 - DNA, 25 bp, Mus musculus
gcaaagcagtcaagtccagaagcag

SEQ ID NO: 443613 - DNA, 25 bp, Mus musculus
gcaaagcagtcatttttacaaattg

SEQ ID NO: 443614 - DNA, 25 bp, Mus musculus
gcaaagcccacaagtacctgcggct

SEQ ID NO: 443615 - DNA, 25 bp, Mus musculus
gcaaagcccagctgtgagactcaag

SEQ ID NO: 443616 - DNA, 25 bp, Mus musculus
gcaaagccggaggttacagcaaagc

SEQ ID NO: 443617 - DNA, 25 bp, Mus musculus
gcaaagcctgtggtccagagttgaa

SEQ ID NO: 443618 - DNA, 25 bp, Mus musculus
gcaaagccttgcgagtcatcatcca

SEQ ID NO: 443619 - DNA, 25 bp, Mus musculus
gcaaagcgtagcatttagtcaccat

SEQ ID NO: 443620 - DNA, 25 bp, Mus musculus
gcaaagctacatgcctctgtgaagg

SEQ ID NO: 443621 - DNA, 25 bp, Mus musculus
gcaaagctccacaggtgatgcttgt

SEQ ID NO: 443622 - DNA, 25 bp, Mus musculus
gcaaagcttcaagcgcagcctggga

SEQ ID NO: 443623 - DNA, 25 bp, Mus musculus
gcaaaggaccctgaaaatggcgata

SEQ ID NO: 443624 - DNA, 25 bp, Mus musculus
gcaaaggccacgtcagaaacaacag

SEQ ID NO: 443625 - DNA, 25 bp, Mus musculus
gcaaaggctgcccagcggacttcat

SEQ ID NO: 443626 - DNA, 25 bp, Mus musculus
gcaaagggcctgtcctgcaaagtgt

SEQ ID NO: 443627 - DNA, 25 bp, Mus musculus
gcaaaggtcctacttgagccacagg

SEQ ID NO: 443628 - DNA, 25 bp, Mus musculus
gcaaaggtcggatgatgagagccct

SEQ ID NO: 443629 - DNA, 25 bp, Mus musculus
gcaaaggtgtcctagaaatggccag

SEQ ID NO: 443630 - DNA, 25 bp, Mus musculus
gcaaagtcagcaaccatcgtagcag

SEQ ID NO: 443631 - DNA, 25 bp, Mus musculus
gcaaagtctgctctttaccccagta

SEQ ID NO: 443632 - DNA, 25 bp, Mus musculus
gcaaagtgaaacctccacttccaaa

SEQ ID NO: 443633 - DNA, 25 bp, Mus musculus
gcaaagtgacatcaaattaaaggaa

SEQ ID NO: 443634 - DNA, 25 bp, Mus musculus
gcaaagtgcagtgagactgtgtccc

SEQ ID NO: 443635 - DNA, 25 bp, Mus musculus
gcaaagtggatctgactcccgattt

SEQ ID NO: 443636 - DNA, 25 bp, Mus musculus
gcaaagtggtcaagagaagcggcct

SEQ ID NO: 443637 - DNA, 25 bp, Mus musculus
gcaaagtggtcctagcctcaagaga

SEQ ID NO: 443638 - DNA, 25 bp, Mus musculus
gcaaagttaaatatgtttacagacc

SEQ ID NO: 443639 - DNA, 25 bp, Mus musculus
gcaaagttctcgaagggctccagta

SEQ ID NO: 443640 - DNA, 25 bp, Mus musculus
gcaaagttgcatttcccctggaagt

SEQ ID NO: 443641 - DNA, 25 bp, Mus musculus
gcaaagtttataaacccagactggg

SEQ ID NO: 443642 - DNA, 25 bp, Mus musculus
gcaaatacaatgaggacatccgcag

SEQ ID NO: 443643 - DNA, 25 bp, Mus musculus
gcaaatagcagcgacaacgaggacc

SEQ ID NO: 443644 - DNA, 25 bp, Mus musculus
gcaaatatgctacaacagcccggaa

SEQ ID NO: 443645 - DNA, 25 bp, Mus musculus
gcaaatatggaggtggtaccaaccc

SEQ ID NO: 443646 - DNA, 25 bp, Mus musculus
gcaaatatgtctgtagggaactcca

SEQ ID NO: 443647 - DNA, 25 bp, Mus musculus
gcaaatccgctattccgtgccagaa

SEQ ID NO: 443648 - DNA, 25 bp, Mus musculus
gcaaatcctcctagttccacctatg

SEQ ID NO: 443649 - DNA, 25 bp, Mus musculus
gcaaatcgccgagcacttaggagta

SEQ ID NO: 443650 - DNA, 25 bp, Mus musculus
gcaaatcgcgcactctgaggactgg

SEQ ID NO: 443651 - DNA, 25 bp, Mus musculus
gcaaatcgtactgggcctgctggaa

SEQ ID NO: 443652 - DNA, 25 bp, Mus musculus
gcaaatcttgtttccactactgata

SEQ ID NO: 443653 - DNA, 25 bp, Mus musculus
gcaaatgactgctgacctggagaca

SEQ ID NO: 443654 - DNA, 25 bp, Mus musculus
gcaaatgcatcctgtcaacaagtta

SEQ ID NO: 443655 - DNA, 25 bp, Mus musculus
gcaaatgctgtctgtattggtacct

SEQ ID NO: 443656 - DNA, 25 bp, Mus musculus
gcaaatggaaaccagtaccctgcag

SEQ ID NO: 443657 - DNA, 25 bp, Mus musculus
gcaaatggatgcattgagacaagac

SEQ ID NO: 443658 - DNA, 25 bp, Mus musculus
gcaaatgggagcttatcaacgtcta

SEQ ID NO: 443659 - DNA, 25 bp, Mus musculus
gcaaatgtcaccagtagcccaaaag

SEQ ID NO: 443660 - DNA, 25 bp, Mus musculus
gcaaatgtgtacctagcagatctca

SEQ ID NO: 443661 - DNA, 25 bp, Mus musculus
gcaaatgtgtgacttagaaaactaa

SEQ ID NO: 443662 - DNA, 25 bp, Mus musculus
gcaaattaaacttggccaggcatct

SEQ ID NO: 443663 - DNA, 25 bp, Mus musculus
gcaaattccagcttcgggcaagtga

SEQ ID NO: 443664 - DNA, 25 bp, Mus musculus
gcaaatttgcactcatgaacaggga

SEQ ID NO: 443665 - DNA, 25 bp, Mus musculus
gcaacaaagccagcccatgtgtaat

SEQ ID NO: 443666 - DNA, 25 bp, Mus musculus
gcaacaaatgctaaacgggacaccc

SEQ ID NO: 443667 - DNA, 25 bp, Mus musculus
gcaacaaattgtacataggcctagc

SEQ ID NO: 443668 - DNA, 25 bp, Mus musculus
gcaacaacatgggtgcgactccgaa

SEQ ID NO: 443669 - DNA, 25 bp, Mus musculus
gcaacaacccggatgtggaggtcag

SEQ ID NO: 443670 - DNA, 25 bp, Mus musculus
gcaacaactacatgtacgcccgcgt

SEQ ID NO: 443671 - DNA, 25 bp, Mus musculus
gcaacaagaagttcgcacgctcgga

SEQ ID NO: 443672 - DNA, 25 bp, Mus musculus
gcaacaagacccaacgggccaaata

SEQ ID NO: 443673 - DNA, 25 bp, Mus musculus
gcaacaagcttgacatggcccagta

SEQ ID NO: 443674 - DNA, 25 bp, Mus musculus
gcaacaagtacaccaagagccgagg

SEQ ID NO: 443675 - DNA, 25 bp, Mus musculus
gcaacaagtagaggacaacaaaatg

SEQ ID NO: 443676 - DNA, 25 bp, Mus musculus
gcaacaatggtatgaggaacagcag

SEQ ID NO: 443677 - DNA, 25 bp, Mus musculus
gcaacaattggtggcgccatctcag

SEQ ID NO: 443678 - DNA, 25 bp, Mus musculus
gcaacacagtcttcagcatgtacag

SEQ ID NO: 443679 - DNA, 25 bp, Mus musculus
gcaacacataagtaatcaaatgagt

SEQ ID NO: 443680 - DNA, 25 bp, Mus musculus
gcaacaccgtgtgagcatctccaag

SEQ ID NO: 443681 - DNA, 25 bp, Mus musculus
gcaacagaccaccaataccgtagag

SEQ ID NO: 443682 - DNA, 25 bp, Mus musculus
gcaacagatccaaacagcttcgaag

SEQ ID NO: 443683 - DNA, 25 bp, Mus musculus
gcaacagattgctctaccgagtgga

SEQ ID NO: 443684 - DNA, 25 bp, Mus musculus
gcaacagctcagatgtccctcatat

SEQ ID NO: 443685 - DNA, 25 bp, Mus musculus
gcaacaggcgctagaagtcaaagag

SEQ ID NO: 443686 - DNA, 25 bp, Mus musculus
gcaacaggcttgtccctaggataca

SEQ ID NO: 443687 - DNA, 25 bp, Mus musculus
gcaacaggtgcaacggaggccagca

SEQ ID NO: 443688 - DNA, 25 bp, Mus musculus
gcaacagtggacaaatggcaaacta

SEQ ID NO: 443689 - DNA, 25 bp, Mus musculus
gcaacagtgtgtaagatcccaccag

SEQ ID NO: 443690 - DNA, 25 bp, Mus musculus
gcaacatcctttggccacaggacat

SEQ ID NO: 443691 - DNA, 25 bp, Mus musculus
gcaacatctttctggccttggaccg

SEQ ID NO: 443692 - DNA, 25 bp, Mus musculus
gcaacatgacactggaagcgatccg

SEQ ID NO: 443693 - DNA, 25 bp, Mus musculus
gcaacatggaagctctggcgtcacg

SEQ ID NO: 443694 - DNA, 25 bp, Mus musculus
gcaacatggctccttggcactgtgg

SEQ ID NO: 443695 - DNA, 25 bp, Mus musculus
gcaacatgttccaaagcaaatacct

SEQ ID NO: 443696 - DNA, 25 bp, Mus musculus
gcaacattgatcatactgcctgcct

SEQ ID NO: 443697 - DNA, 25 bp, Mus musculus
gcaacattgtgctcctgactcaggc

SEQ ID NO: 443698 - DNA, 25 bp, Mus musculus
gcaaccaaggtaagcagctgggtcg

SEQ ID NO: 443699 - DNA, 25 bp, Mus musculus
gcaaccagagtatgaacctcaaacg

SEQ ID NO: 443700 - DNA, 25 bp, Mus musculus
gcaaccagagtttccattctgaagg

SEQ ID NO: 443701 - DNA, 25 bp, Mus musculus
gcaaccagattccatgggacatgat

SEQ ID NO: 443702 - DNA, 25 bp, Mus musculus
gcaaccagttgaccccagtgagagt

SEQ ID NO: 443703 - DNA, 25 bp, Mus musculus
gcaacccagaagatcacagtcacga

SEQ ID NO: 443704 - DNA, 25 bp, Mus musculus
gcaacccaggtacattcaactagga

SEQ ID NO: 443705 - DNA, 25 bp, Mus musculus
gcaacccagtttcgaggcagctttt

SEQ ID NO: 443706 - DNA, 25 bp, Mus musculus
gcaacccgcttacgaggcggtcttc

SEQ ID NO: 443707 - DNA, 25 bp, Mus musculus
gcaacccggacactctgtgcatgga

SEQ ID NO: 443708 - DNA, 25 bp, Mus musculus
gcaacccggtggtagccaatagaac

SEQ ID NO: 443709 - DNA, 25 bp, Mus musculus
gcaaccctggtctggtggactacag

SEQ ID NO: 443710 - DNA, 25 bp, Mus musculus
gcaaccgacagcgatcttaggaagt

SEQ ID NO: 443711 - DNA, 25 bp, Mus musculus
gcaaccgggtcaagttggtcaacct

SEQ ID NO: 443712 - DNA, 25 bp, Mus musculus
gcaaccgttacttggaccccagtga

SEQ ID NO: 443713 - DNA, 25 bp, Mus musculus
gcaacctacttccttctagctgcag

SEQ ID NO: 443714 - DNA, 25 bp, Mus musculus
gcaacctcatccaaagcatcttgga

SEQ ID NO: 443715 - DNA, 25 bp, Mus musculus
gcaacctccaccaaacatgatggag

SEQ ID NO: 443716 - DNA, 25 bp, Mus musculus
gcaacctgcgtaagccgtgtaaccg

SEQ ID NO: 443717 - DNA, 25 bp, Mus musculus
gcaacctgggctggtgcattcctta

SEQ ID NO: 443718 - DNA, 25 bp, Mus musculus
gcaacctgtatcacggagatgtcga

SEQ ID NO: 443719 - DNA, 25 bp, Mus musculus
gcaaccttagtgctcttccgaaaga

SEQ ID NO: 443720 - DNA, 25 bp, Mus musculus
gcaacgaatcgcagcacaggctgga

SEQ ID NO: 443721 - DNA, 25 bp, Mus musculus
gcaacgacagcatttctgagctcta

SEQ ID NO: 443722 - DNA, 25 bp, Mus musculus
gcaacgagaactatacggccgaggt

SEQ ID NO: 443723 - DNA, 25 bp, Mus musculus
gcaacgtgctacatagggacctgaa

SEQ ID NO: 443724 - DNA, 25 bp, Mus musculus
gcaacgtggttctgtggaagcccag

SEQ ID NO: 443725 - DNA, 25 bp, Mus musculus
gcaacgttgacgtctgatgtcgaga

SEQ ID NO: 443726 - DNA, 25 bp, Mus musculus
gcaacgttgcttaccaaagctccgt

SEQ ID NO: 443727 - DNA, 25 bp, Mus musculus
gcaactaagctgatttgtcatctag

SEQ ID NO: 443728 - DNA, 25 bp, Mus musculus
gcaactagtcggtgtgaggtccaag

SEQ ID NO: 443729 - DNA, 25 bp, Mus musculus
gcaactatgatgctgggactacaga

SEQ ID NO: 443730 - DNA, 25 bp, Mus musculus
gcaactcaatcacactttgctctta

SEQ ID NO: 443731 - DNA, 25 bp, Mus musculus
gcaactccggctcctacaaaggaag

SEQ ID NO: 443732 - DNA, 25 bp, Mus musculus
gcaactcggaagtcaacatcctggg

SEQ ID NO: 443733 - DNA, 25 bp, Mus musculus
gcaactcggtagttgaaataatcct

SEQ ID NO: 443734 - DNA, 25 bp, Mus musculus
gcaactctgacctccgtatacagaa

SEQ ID NO: 443735 - DNA, 25 bp, Mus musculus
gcaactctggctacgctgggaaaaa

SEQ ID NO: 443736 - DNA, 25 bp, Mus musculus
gcaactctgtgagtaattgactcaa

SEQ ID NO: 443737 - DNA, 25 bp, Mus musculus
gcaactgaacccctgtcttctgcag

SEQ ID NO: 443738 - DNA, 25 bp, Mus musculus
gcaactgacaaagcattaaatttta

SEQ ID NO: 443739 - DNA, 25 bp, Mus musculus
gcaactgagaccacacacgggtgga

SEQ ID NO: 443740 - DNA, 25 bp, Mus musculus
gcaactgagtttcaccagcgccggt

SEQ ID NO: 443741 - DNA, 25 bp, Mus musculus
gcaactgcagttctaggaccgtaag

SEQ ID NO: 443742 - DNA, 25 bp, Mus musculus
gcaactgcgcaagagctgtgtggct

SEQ ID NO: 443743 - DNA, 25 bp, Mus musculus
gcaactggaccagccatcgtggagt

SEQ ID NO: 443744 - DNA, 25 bp, Mus musculus
gcaactggatataacagctattact

SEQ ID NO: 443745 - DNA, 25 bp, Mus musculus
gcaactggcaccactactgggagaa

SEQ ID NO: 443746 - DNA, 25 bp, Mus musculus
gcaactggcccgatttctggatctt

SEQ ID NO: 443747 - DNA, 25 bp, Mus musculus
gcaactgggcagttccatcctggga

SEQ ID NO: 443748 - DNA, 25 bp, Mus musculus
gcaactgggtcatgcttctccacga

SEQ ID NO: 443749 - DNA, 25 bp, Mus musculus
gcaactgggtcctgcaacataaagg

SEQ ID NO: 443750 - DNA, 25 bp, Mus musculus
gcaactgtcaagagagaaggcgaat

SEQ ID NO: 443751 - DNA, 25 bp, Mus musculus
gcaactgtctaatctacccggctca

SEQ ID NO: 443752 - DNA, 25 bp, Mus musculus
gcaactgtggtggactttctgagga

SEQ ID NO: 443753 - DNA, 25 bp, Mus musculus
gcaactgttcccagagcactcggta

SEQ ID NO: 443754 - DNA, 25 bp, Mus musculus
gcaactgttgacaaggaacctcaca

SEQ ID NO: 443755 - DNA, 25 bp, Mus musculus
gcaactgttgactacgcgacgtgag

SEQ ID NO: 443756 - DNA, 25 bp, Mus musculus
gcaacttagctcttgttcttagtca

SEQ ID NO: 443757 - DNA, 25 bp, Mus musculus
gcaacttatatgtcttccccaaggt

SEQ ID NO: 443758 - DNA, 25 bp, Mus musculus
gcaacttcgacaaagccgaggcgct

SEQ ID NO: 443759 - DNA, 25 bp, Mus musculus
gcaacttcttagagcggcaacagga

SEQ ID NO: 443760 - DNA, 25 bp, Mus musculus
gcaacttgacttcccgaggcatgga

SEQ ID NO: 443761 - DNA, 25 bp, Mus musculus
gcaactttagggacattgaggtggc

SEQ ID NO: 443762 - DNA, 25 bp, Mus musculus
gcaactttcggcagctgcaggagaa

SEQ ID NO: 443763 - DNA, 25 bp, Mus musculus
gcaactttcggccaagactagcaag

SEQ ID NO: 443764 - DNA, 25 bp, Mus musculus
gcaactttcttttaaccttcatggg

SEQ ID NO: 443765 - DNA, 25 bp, Mus musculus
gcaactttggaacatattacagaga

SEQ ID NO: 443766 - DNA, 25 bp, Mus musculus
gcaagaaaatagcaatgcgtgggaa

SEQ ID NO: 443767 - DNA, 25 bp, Mus musculus
gcaagaaaccatgactgtaacgctc

SEQ ID NO: 443768 - DNA, 25 bp, Mus musculus
gcaagaaagtgaagagacgctccca

SEQ ID NO: 443769 - DNA, 25 bp, Mus musculus
gcaagaaatgtaaagagccagattc

SEQ ID NO: 443770 - DNA, 25 bp, Mus musculus
gcaagaacagctcaccagtgtggat

SEQ ID NO: 443771 - DNA, 25 bp, Mus musculus
gcaagaacataactcagcgcggcaa

SEQ ID NO: 443772 - DNA, 25 bp, Mus musculus
gcaagaaccactattgtttggaagt

SEQ ID NO: 443773 - DNA, 25 bp, Mus musculus
gcaagaacgtcaatgcgggtggcca

SEQ ID NO: 443774 - DNA, 25 bp, Mus musculus
gcaagaaggcccgtctagaagaggt

SEQ ID NO: 443775 - DNA, 25 bp, Mus musculus
gcaagaagttcacagccagaggctt

SEQ ID NO: 443776 - DNA, 25 bp, Mus musculus
gcaagaagttttccagcccctacag

SEQ ID NO: 443777 - DNA, 25 bp, Mus musculus
gcaagaatcattcaggctcaggatc

SEQ ID NO: 443778 - DNA, 25 bp, Mus musculus
gcaagaatgtatgctacgaccacca

SEQ ID NO: 443779 - DNA, 25 bp, Mus musculus
gcaagacaagaagaacctgggaata

SEQ ID NO: 443780 - DNA, 25 bp, Mus musculus
gcaagacatgctagtaccacaggag

SEQ ID NO: 443781 - DNA, 25 bp, Mus musculus
gcaagacccttttaagatcagctgg

SEQ ID NO: 443782 - DNA, 25 bp, Mus musculus
gcaagaccgtgatccaagcagagat

SEQ ID NO: 443783 - DNA, 25 bp, Mus musculus
gcaagacgcactgttactggagagg

SEQ ID NO: 443784 - DNA, 25 bp, Mus musculus
gcaagactgtacaggaggagcgccc

SEQ ID NO: 443785 - DNA, 25 bp, Mus musculus
gcaagactgtgcatcctgtaacctg

SEQ ID NO: 443786 - DNA, 25 bp, Mus musculus
gcaagagaacagtcatgctaccagt

SEQ ID NO: 443787 - DNA, 25 bp, Mus musculus
gcaagagaatgctcccctgggtgct

SEQ ID NO: 443788 - DNA, 25 bp, Mus musculus
gcaagagagagaacctttcttctct

SEQ ID NO: 443789 - DNA, 25 bp, Mus musculus
gcaagagcaccgctgtgcacgcaaa

SEQ ID NO: 443790 - DNA, 25 bp, Mus musculus
gcaagagcagcataggattacaacc

SEQ ID NO: 443791 - DNA, 25 bp, Mus musculus
gcaagagctatcgtgggccactgaa

SEQ ID NO: 443792 - DNA, 25 bp, Mus musculus
gcaagaggcttcttttaaagtacac

SEQ ID NO: 443793 - DNA, 25 bp, Mus musculus
gcaagagggcacgaggtaacagtcc

SEQ ID NO: 443794 - DNA, 25 bp, Mus musculus
gcaagagtgagaatatgtccccagt

SEQ ID NO: 443795 - DNA, 25 bp, Mus musculus
gcaagataaggagtgacagctggct

SEQ ID NO: 443796 - DNA, 25 bp, Mus musculus
gcaagatattcttcaggaggacaga

SEQ ID NO: 443797 - DNA, 25 bp, Mus musculus
gcaagatccaagatgtctaccaggg

SEQ ID NO: 443798 - DNA, 25 bp, Mus musculus
gcaagatctcaccattggtcagcaa

SEQ ID NO: 443799 - DNA, 25 bp, Mus musculus
gcaagatctgtgatgggctccggaa

SEQ ID NO: 443800 - DNA, 25 bp, Mus musculus
gcaagatgctgatgacgctgccgct

SEQ ID NO: 443801 - DNA, 25 bp, Mus musculus
gcaagattcagacattaaacaagtt

SEQ ID NO: 443802 - DNA, 25 bp, Mus musculus
gcaagatttacccacttccagggag

SEQ ID NO: 443803 - DNA, 25 bp, Mus musculus
gcaagcaaacaaccacatgactgag

SEQ ID NO: 443804 - DNA, 25 bp, Mus musculus
gcaagcacaccccattaaacagagg

SEQ ID NO: 443805 - DNA, 25 bp, Mus musculus
gcaagcacatggttctggcggcctt

SEQ ID NO: 443806 - DNA, 25 bp, Mus musculus
gcaagcagagatgaaattcccctcc

SEQ ID NO: 443807 - DNA, 25 bp, Mus musculus
gcaagcaggaggtatggcaaccaca

SEQ ID NO: 443808 - DNA, 25 bp, Mus musculus
gcaagccactgctctaagattgaag

SEQ ID NO: 443809 - DNA, 25 bp, Mus musculus
gcaagccacttttttgtgtgccccg

SEQ ID NO: 443810 - DNA, 25 bp, Mus musculus
gcaagccagagtatagccctcaact

SEQ ID NO: 443811 - DNA, 25 bp, Mus musculus
gcaagccctcatgagagatttcttt

SEQ ID NO: 443812 - DNA, 25 bp, Mus musculus
gcaagccctttgaaactcttcatgg

SEQ ID NO: 443813 - DNA, 25 bp, Mus musculus
gcaagccgattttgtctgcaacacg

SEQ ID NO: 443814 - DNA, 25 bp, Mus musculus
gcaagccgctatgcctcagtggaga

SEQ ID NO: 443815 - DNA, 25 bp, Mus musculus
gcaagccgcttttattcagacccat

SEQ ID NO: 443816 - DNA, 25 bp, Mus musculus
gcaagcctcaccagtctttttggaa

SEQ ID NO: 443817 - DNA, 25 bp, Mus musculus
gcaagcctcttctgatctcgcggcg

SEQ ID NO: 443818 - DNA, 25 bp, Mus musculus
gcaagcctggttatcgagcaagtct

SEQ ID NO: 443819 - DNA, 25 bp, Mus musculus
gcaagcctgtgcaactgacctacag

SEQ ID NO: 443820 - DNA, 25 bp, Mus musculus
gcaagcctttttactggagaacgtc

SEQ ID NO: 443821 - DNA, 25 bp, Mus musculus
gcaagcgcctgtgagacctgaacaa

SEQ ID NO: 443822 - DNA, 25 bp, Mus musculus
gcaagcgctcgagtccagatgatgg

SEQ ID NO: 443823 - DNA, 25 bp, Mus musculus
gcaagcggaatgctcaaagttaccc

SEQ ID NO: 443824 - DNA, 25 bp, Mus musculus
gcaagcgttgaagcacaagtggcca

SEQ ID NO: 443825 - DNA, 25 bp, Mus musculus
gcaagctaaacaagaaggcacctgt

SEQ ID NO: 443826 - DNA, 25 bp, Mus musculus
gcaagctaagaagtaagaacagatg

SEQ ID NO: 443827 - DNA, 25 bp, Mus musculus
gcaagctaagtagtttttatctcta

SEQ ID NO: 443828 - DNA, 25 bp, Mus musculus
gcaagctccctattataactacaag

SEQ ID NO: 443829 - DNA, 25 bp, Mus musculus
gcaagctccgacatgtgctgcgaga

SEQ ID NO: 443830 - DNA, 25 bp, Mus musculus
gcaagctccgtgtccatcatggtgg

SEQ ID NO: 443831 - DNA, 25 bp, Mus musculus
gcaagctctactgcgctaccaagta

SEQ ID NO: 443832 - DNA, 25 bp, Mus musculus
gcaagctctgggtcaccagcatcct

SEQ ID NO: 443833 - DNA, 25 bp, Mus musculus
gcaagctgccaaaaaacaacacagg

SEQ ID NO: 443834 - DNA, 25 bp, Mus musculus
gcaagctgctggaaagtggcccttt

SEQ ID NO: 443835 - DNA, 25 bp, Mus musculus
gcaagctggctgatgtcctcgaaga

SEQ ID NO: 443836 - DNA, 25 bp, Mus musculus
gcaagctgttggctttctactccgg

SEQ ID NO: 443837 - DNA, 25 bp, Mus musculus
gcaagcttatgaggtgcgtccaccc

SEQ ID NO: 443838 - DNA, 25 bp, Mus musculus
gcaagcttgcgctcaagtggcaccc

SEQ ID NO: 443839 - DNA, 25 bp, Mus musculus
gcaagcttgggttctccggaagagt

SEQ ID NO: 443840 - DNA, 25 bp, Mus musculus
gcaaggaaccatacatactgaatga

SEQ ID NO: 443841 - DNA, 25 bp, Mus musculus
gcaaggaagcttggttaattttaag

SEQ ID NO: 443842 - DNA, 25 bp, Mus musculus
gcaaggaaggtgacaagcacaccct

SEQ ID NO: 443843 - DNA, 25 bp, Mus musculus
gcaaggaccgcatgagttaccacgt

SEQ ID NO: 443844 - DNA, 25 bp, Mus musculus
gcaaggacgcatgcttatttttaat

SEQ ID NO: 443845 - DNA, 25 bp, Mus musculus
gcaaggacgccaattttgttcttaa

SEQ ID NO: 443846 - DNA, 25 bp, Mus musculus
gcaaggacggttagagcgcatcagt

SEQ ID NO: 443847 - DNA, 25 bp, Mus musculus
gcaaggactgcggagactgcgacaa

SEQ ID NO: 443848 - DNA, 25 bp, Mus musculus
gcaaggacttgcacagacagtcgat

SEQ ID NO: 443849 - DNA, 25 bp, Mus musculus
gcaaggatatggcactggtgcttat

SEQ ID NO: 443850 - DNA, 25 bp, Mus musculus
gcaaggattaatgtccagacttggt

SEQ ID NO: 443851 - DNA, 25 bp, Mus musculus
gcaaggatttccgttgtcactaaga

SEQ ID NO: 443852 - DNA, 25 bp, Mus musculus
gcaaggcagtcattccacagggaag

SEQ ID NO: 443853 - DNA, 25 bp, Mus musculus
gcaaggccaaatccgtgcagaagtc

SEQ ID NO: 443854 - DNA, 25 bp, Mus musculus
gcaaggccccttacagtggacagct

SEQ ID NO: 443855 - DNA, 25 bp, Mus musculus
gcaaggccgctttctctgggagacc

SEQ ID NO: 443856 - DNA, 25 bp, Mus musculus
gcaaggccggagctttgaccataaa

SEQ ID NO: 443857 - DNA, 25 bp, Mus musculus
gcaaggccgttttagaactcagaga

SEQ ID NO: 443858 - DNA, 25 bp, Mus musculus
gcaaggcctattagttcatcacgga

SEQ ID NO: 443859 - DNA, 25 bp, Mus musculus
gcaaggcctcattcggtttttctac

SEQ ID NO: 443860 - DNA, 25 bp, Mus musculus
gcaaggcctgctgtgtgatcgcagc

SEQ ID NO: 443861 - DNA, 25 bp, Mus musculus
gcaaggccttaggaaacagggcaaa

SEQ ID NO: 443862 - DNA, 25 bp, Mus musculus
gcaaggctcgctcagtgatgaccaa

SEQ ID NO: 443863 - DNA, 25 bp, Mus musculus
gcaaggctctgcatgagatagcact

SEQ ID NO: 443864 - DNA, 25 bp, Mus musculus
gcaaggctcttcagcatacagatga

SEQ ID NO: 443865 - DNA, 25 bp, Mus musculus
gcaaggctgatggatgatctggacc

SEQ ID NO: 443866 - DNA, 25 bp, Mus musculus
gcaaggctgccgtgcaaatcaaagt

SEQ ID NO: 443867 - DNA, 25 bp, Mus musculus
gcaaggcttgacagtgctcaggcca

SEQ ID NO: 443868 - DNA, 25 bp, Mus musculus
gcaaggctttctcttcctgggagat

SEQ ID NO: 443869 - DNA, 25 bp, Mus musculus
gcaagggcagtcatctggcttccta

SEQ ID NO: 443870 - DNA, 25 bp, Mus musculus
gcaagggctccagctggttacataa

SEQ ID NO: 443871 - DNA, 25 bp, Mus musculus
gcaagggctttgtgtaccgctcgca

SEQ ID NO: 443872 - DNA, 25 bp, Mus musculus
gcaagggttccacacaatgcaggga

SEQ ID NO: 443873 - DNA, 25 bp, Mus musculus
gcaaggtaccataagctgttcacac

SEQ ID NO: 443874 - DNA, 25 bp, Mus musculus
gcaaggtactcatactcagtaggta

SEQ ID NO: 443875 - DNA, 25 bp, Mus musculus
gcaaggtgacgtcattggtcagata

SEQ ID NO: 443876 - DNA, 25 bp, Mus musculus
gcaaggtgctcccagggagcccaca

SEQ ID NO: 443877 - DNA, 25 bp, Mus musculus
gcaaggtggagcactaccgcatcat

SEQ ID NO: 443878 - DNA, 25 bp, Mus musculus
gcaaggtggtacatgaagctcaact

SEQ ID NO: 443879 - DNA, 25 bp, Mus musculus
gcaagtaaccccaccctgggcatag

SEQ ID NO: 443880 - DNA, 25 bp, Mus musculus
gcaagtacgtttttcccaaacgcag

SEQ ID NO: 443881 - DNA, 25 bp, Mus musculus
gcaagtagcaagtaggctgttctca

SEQ ID NO: 443882 - DNA, 25 bp, Mus musculus
gcaagtagcaatcctgccaaaggct

SEQ ID NO: 443883 - DNA, 25 bp, Mus musculus
gcaagtagctgtgaccaaagggaac

SEQ ID NO: 443884 - DNA, 25 bp, Mus musculus
gcaagtaggctgttctcagatacaa

SEQ ID NO: 443885 - DNA, 25 bp, Mus musculus
gcaagtatctacctcggtttaaagc

SEQ ID NO: 443886 - DNA, 25 bp, Mus musculus
gcaagtcactgatagccgcagaaac

SEQ ID NO: 443887 - DNA, 25 bp, Mus musculus
gcaagtcccagggttacctgagccg

SEQ ID NO: 443888 - DNA, 25 bp, Mus musculus
gcaagtccgagctggctgctaacct

SEQ ID NO: 443889 - DNA, 25 bp, Mus musculus
gcaagtccgagggtcgcgagctact

SEQ ID NO: 443890 - DNA, 25 bp, Mus musculus
gcaagtctgtggataaggaccccat

SEQ ID NO: 443891 - DNA, 25 bp, Mus musculus
gcaagtcttgtacagcgaatcagca

SEQ ID NO: 443892 - DNA, 25 bp, Mus musculus
gcaagtctttggctctacagaggaa

SEQ ID NO: 443893 - DNA, 25 bp, Mus musculus
gcaagtgcaaatgtaggcgtaccca

SEQ ID NO: 443894 - DNA, 25 bp, Mus musculus
gcaagtgccctggtgggttcagctc

SEQ ID NO: 443895 - DNA, 25 bp, Mus musculus
gcaagtgctcgaaatgacatccaga

SEQ ID NO: 443896 - DNA, 25 bp, Mus musculus
gcaagtgctctctccattctgcaga

SEQ ID NO: 443897 - DNA, 25 bp, Mus musculus
gcaagtgctgctctactgagccaca

SEQ ID NO: 443898 - DNA, 25 bp, Mus musculus
gcaagtggaagctcggctgtgtacc

SEQ ID NO: 443899 - DNA, 25 bp, Mus musculus
gcaagtggacattgtgaatcagtac

SEQ ID NO: 443900 - DNA, 25 bp, Mus musculus
gcaagtggttggacagctcgaatca

SEQ ID NO: 443901 - DNA, 25 bp, Mus musculus
gcaagtgtacgatctgggccgaacc

SEQ ID NO: 443902 - DNA, 25 bp, Mus musculus
gcaagtgtcccttggtatctatcaa

SEQ ID NO: 443903 - DNA, 25 bp, Mus musculus
gcaagttaaaggctgcaccactacg

SEQ ID NO: 443904 - DNA, 25 bp, Mus musculus
gcaagttcaagcagggccaagagca

SEQ ID NO: 443905 - DNA, 25 bp, Mus musculus
gcaagttcatcatcgctaacgcgcg

SEQ ID NO: 443906 - DNA, 25 bp, Mus musculus
gcaagttccggaaactggtgaccgc

SEQ ID NO: 443907 - DNA, 25 bp, Mus musculus
gcaagttcgacctgactgggatccc

SEQ ID NO: 443908 - DNA, 25 bp, Mus musculus
gcaagttctacaacagcccagagga

SEQ ID NO: 443909 - DNA, 25 bp, Mus musculus
gcaagttctaccagatgaccggccg

SEQ ID NO: 443910 - DNA, 25 bp, Mus musculus
gcaagttggaaatgctgcccggaaa

SEQ ID NO: 443911 - DNA, 25 bp, Mus musculus
gcaagttgtcctcacctgtagtaga

SEQ ID NO: 443912 - DNA, 25 bp, Mus musculus
gcaataaaataagccgtccacggga

SEQ ID NO: 443913 - DNA, 25 bp, Mus musculus
gcaataaacattgggtttcgtctgg

SEQ ID NO: 443914 - DNA, 25 bp, Mus musculus
gcaataaaggacaaagctgacgaga

SEQ ID NO: 443915 - DNA, 25 bp, Mus musculus
gcaataacctgtacataagccatca

SEQ ID NO: 443916 - DNA, 25 bp, Mus musculus
gcaataagccaacagtcacggccgt

SEQ ID NO: 443917 - DNA, 25 bp, Mus musculus
gcaataatagtcagagggtccctcc

SEQ ID NO: 443918 - DNA, 25 bp, Mus musculus
gcaatactcagtggataaaaggctt

SEQ ID NO: 443919 - DNA, 25 bp, Mus musculus
gcaatactcggtggcgatagcgcag

SEQ ID NO: 443920 - DNA, 25 bp, Mus musculus
gcaatagacccttgacctggcatct

SEQ ID NO: 443921 - DNA, 25 bp, Mus musculus
gcaatagcgacaactccataccggg

SEQ ID NO: 443922 - DNA, 25 bp, Mus musculus
gcaatagctgcgacagcgaaagcga

SEQ ID NO: 443923 - DNA, 25 bp, Mus musculus
gcaataggcccttttgcaggctgtt

SEQ ID NO: 443924 - DNA, 25 bp, Mus musculus
gcaatagggctccagaaattccata

SEQ ID NO: 443925 - DNA, 25 bp, Mus musculus
gcaatatagtgatgccggaggccac

SEQ ID NO: 443926 - DNA, 25 bp, Mus musculus
gcaatatccggtttttagaggacgc

SEQ ID NO: 443927 - DNA, 25 bp, Mus musculus
gcaatatgctctggagacattgcct

SEQ ID NO: 443928 - DNA, 25 bp, Mus musculus
gcaatattcactgggcacttgctgg

SEQ ID NO: 443929 - DNA, 25 bp, Mus musculus
gcaatattcgacagcctcaaggaga

SEQ ID NO: 443930 - DNA, 25 bp, Mus musculus
gcaatcaagtccgttagccaggccg

SEQ ID NO: 443931 - DNA, 25 bp, Mus musculus
gcaatcaggcgcagcggcggacaac

SEQ ID NO: 443932 - DNA, 25 bp, Mus musculus
gcaatcatcttcttggaccaaagcc

SEQ ID NO: 443933 - DNA, 25 bp, Mus musculus
gcaatcatgtgacgtagcccacgga

SEQ ID NO: 443934 - DNA, 25 bp, Mus musculus
gcaatcccctcgtgagtgactgaag

SEQ ID NO: 443935 - DNA, 25 bp, Mus musculus
gcaatccctatagcagtgggcaacg

SEQ ID NO: 443936 - DNA, 25 bp, Mus musculus
gcaatccttgcttggaggccaggcg

SEQ ID NO: 443937 - DNA, 25 bp, Mus musculus
gcaatctgggatttactgagcctct

SEQ ID NO: 443938 - DNA, 25 bp, Mus musculus
gcaatctggtgagtgtgccatgcca

SEQ ID NO: 443939 - DNA, 25 bp, Mus musculus
gcaatcttaaatcccaggcacagtg

SEQ ID NO: 443940 - DNA, 25 bp, Mus musculus
gcaatctttgtgcagagccccaact

SEQ ID NO: 443941 - DNA, 25 bp, Mus musculus
gcaatgaaaatcctgcgcaaagcag

SEQ ID NO: 443942 - DNA, 25 bp, Mus musculus
gcaatgaaggtgaatttaggaggcc

SEQ ID NO: 443943 - DNA, 25 bp, Mus musculus
gcaatgaataagcaagaagccctct

SEQ ID NO: 443944 - DNA, 25 bp, Mus musculus
gcaatgaattgtacaccaggatccc

SEQ ID NO: 443945 - DNA, 25 bp, Mus musculus
gcaatgacaccgagctgatagcctg

SEQ ID NO: 443946 - DNA, 25 bp, Mus musculus
gcaatgacgctgtctgctaccagga

SEQ ID NO: 443947 - DNA, 25 bp, Mus musculus
gcaatgagaacttcgagaggccggt

SEQ ID NO: 443948 - DNA, 25 bp, Mus musculus
gcaatgagataatagccaggcggct

SEQ ID NO: 443949 - DNA, 25 bp, Mus musculus
gcaatgatagaactgggctgtcaca

SEQ ID NO: 443950 - DNA, 25 bp, Mus musculus
gcaatgatccctgcgaaggaggcaa

SEQ ID NO: 443951 - DNA, 25 bp, Mus musculus
gcaatgattatcctgcttctgccac

SEQ ID NO: 443952 - DNA, 25 bp, Mus musculus
gcaatgattcctgccctacagtcgg

SEQ ID NO: 443953 - DNA, 25 bp, Mus musculus
gcaatgcaagaaacatgggttcaga

SEQ ID NO: 443954 - DNA, 25 bp, Mus musculus
gcaatgcacaccctagaaacactgc

SEQ ID NO: 443955 - DNA, 25 bp, Mus musculus
gcaatgcacagtttttccgcgagaa

SEQ ID NO: 443956 - DNA, 25 bp, Mus musculus
gcaatgcagtcatcagccctgggag

SEQ ID NO: 443957 - DNA, 25 bp, Mus musculus
gcaatgccctgcacaggctcaagct

SEQ ID NO: 443958 - DNA, 25 bp, Mus musculus
gcaatgcctcgagacatcctgatgg

SEQ ID NO: 443959 - DNA, 25 bp, Mus musculus
gcaatgcttgttgtccagccaaagg

SEQ ID NO: 443960 - DNA, 25 bp, Mus musculus
gcaatggaaccagcacacgtggata

SEQ ID NO: 443961 - DNA, 25 bp, Mus musculus
gcaatggaacctcactcttcttaga

SEQ ID NO: 443962 - DNA, 25 bp, Mus musculus
gcaatggcactgtgactgtcaggag

SEQ ID NO: 443963 - DNA, 25 bp, Mus musculus
gcaatggccgccatacactgggaca

SEQ ID NO: 443964 - DNA, 25 bp, Mus musculus
gcaatggctacagctgccgtttccg

SEQ ID NO: 443965 - DNA, 25 bp, Mus musculus
gcaatgggaaatggaacctttccct

SEQ ID NO: 443966 - DNA, 25 bp, Mus musculus
gcaatggtgtcctcatacaaaagga

SEQ ID NO: 443967 - DNA, 25 bp, Mus musculus
gcaatggttctgtaaccccagggta

SEQ ID NO: 443968 - DNA, 25 bp, Mus musculus
gcaatgtcaatgtgaagccaggaga

SEQ ID NO: 443969 - DNA, 25 bp, Mus musculus
gcaatgtcagggtcagcagagagct

SEQ ID NO: 443970 - DNA, 25 bp, Mus musculus
gcaatgtccgctgtaccatgaaggg

SEQ ID NO: 443971 - DNA, 25 bp, Mus musculus
gcaatgtgatctcccagtgtcgtga

SEQ ID NO: 443972 - DNA, 25 bp, Mus musculus
gcaatgtgctgccaaacgatccgtt

SEQ ID NO: 443973 - DNA, 25 bp, Mus musculus
gcaatgtggaggtgtgagctacata

SEQ ID NO: 443974 - DNA, 25 bp, Mus musculus
gcaatgttcccgactgcagagagaa

SEQ ID NO: 443975 - DNA, 25 bp, Mus musculus
gcaatgttcctatggccaacctggg

SEQ ID NO: 443976 - DNA, 25 bp, Mus musculus
gcaatgttcctgcagtaaaatggga

SEQ ID NO: 443977 - DNA, 25 bp, Mus musculus
gcaatgttgtatgggctacgcggcc

SEQ ID NO: 443978 - DNA, 25 bp, Mus musculus
gcaattaccacacgttcagggcaga

SEQ ID NO: 443979 - DNA, 25 bp, Mus musculus
gcaattaccgatcccacttgtgatg

SEQ ID NO: 443980 - DNA, 25 bp, Mus musculus
gcaattagcccagctacactaggcg

SEQ ID NO: 443981 - DNA, 25 bp, Mus musculus
gcaattcacgagaggcagggacctg

SEQ ID NO: 443982 - DNA, 25 bp, Mus musculus
gcaattccactgtctgataagggct

SEQ ID NO: 443983 - DNA, 25 bp, Mus musculus
gcaattccagcctatcacctcagag

SEQ ID NO: 443984 - DNA, 25 bp, Mus musculus
gcaattcgcaaactgggcctggtaa

SEQ ID NO: 443985 - DNA, 25 bp, Mus musculus
gcaattctgagtactctagcttccc

SEQ ID NO: 443986 - DNA, 25 bp, Mus musculus
gcaattctgtgtggtgatggagcca

SEQ ID NO: 443987 - DNA, 25 bp, Mus musculus
gcaattgcccaggatgcagaccaga

SEQ ID NO: 443988 - DNA, 25 bp, Mus musculus
gcaattgtcctcttttagatgtgta

SEQ ID NO: 443989 - DNA, 25 bp, Mus musculus
gcaatttaattaagcgtcagattct

SEQ ID NO: 443990 - DNA, 25 bp, Mus musculus
gcaatttaggcaaaagggattccgt

SEQ ID NO: 443991 - DNA, 25 bp, Mus musculus
gcaatttccctgaaccactttaaag

SEQ ID NO: 443992 - DNA, 25 bp, Mus musculus
gcaattttccagctacgtacatata

SEQ ID NO: 443993 - DNA, 25 bp, Mus musculus
gcaatttttgttgccagagcctgca

SEQ ID NO: 443994 - DNA, 25 bp, Mus musculus
gcacaaagacgtcagaaacggttcc

SEQ ID NO: 443995 - DNA, 25 bp, Mus musculus
gcacaacaagtttcagagggacacc

SEQ ID NO: 443996 - DNA, 25 bp, Mus musculus
gcacaacatcttagtttgagagtaa

SEQ ID NO: 443997 - DNA, 25 bp, Mus musculus
gcacaaccttgcagagaaagccagg

SEQ ID NO: 443998 - DNA, 25 bp, Mus musculus
gcacaacttgaactactggcagctg

SEQ ID NO: 443999 - DNA, 25 bp, Mus musculus
gcacaagcagagatcctggagtgtt

SEQ ID NO: 444000 - DNA, 25 bp, Mus musculus
gcacaaggtatatgaatctctagaa

SEQ ID NO: 444001 - DNA, 25 bp, Mus musculus
gcacaagtattatcacagagcctgg

SEQ ID NO: 444002 - DNA, 25 bp, Mus musculus
gcacaagtgactgagaggatcccga

SEQ ID NO: 444003 - DNA, 25 bp, Mus musculus
gcacaagttgaaggatcaatatcct

SEQ ID NO: 444004 - DNA, 25 bp, Mus musculus
gcacaataaccttggtggccgacca

SEQ ID NO: 444005 - DNA, 25 bp, Mus musculus
gcacaatatgacgacagcccatctg

SEQ ID NO: 444006 - DNA, 25 bp, Mus musculus
gcacaatctgtgatgatcgctggga

SEQ ID NO: 444007 - DNA, 25 bp, Mus musculus
gcacaattgccgtcccttaggtttg

SEQ ID NO: 444008 - DNA, 25 bp, Mus musculus
gcacacaacttcacagacggtctgg

SEQ ID NO: 444009 - DNA, 25 bp, Mus musculus
gcacacaatgcagataccaaacgac

SEQ ID NO: 444010 - DNA, 25 bp, Mus musculus
gcacacacgcttctagtatctagga

SEQ ID NO: 444011 - DNA, 25 bp, Mus musculus
gcacacatgcaagatcgggagagga

SEQ ID NO: 444012 - DNA, 25 bp, Mus musculus
gcacacatgtgcgaatccataccgg

SEQ ID NO: 444013 - DNA, 25 bp, Mus musculus
gcacaccacagttctgaagactata

SEQ ID NO: 444014 - DNA, 25 bp, Mus musculus
gcacaccagagtacctggcaccaga

SEQ ID NO: 444015 - DNA, 25 bp, Mus musculus
gcacaccagggtacttgccatcgag

SEQ ID NO: 444016 - DNA, 25 bp, Mus musculus
gcacaccccacgtagatctgggaag

SEQ ID NO: 444017 - DNA, 25 bp, Mus musculus
gcacacgaatttacaacctgggaag

SEQ ID NO: 444018 - DNA, 25 bp, Mus musculus
gcacacggcagcttatctccgggag

SEQ ID NO: 444019 - DNA, 25 bp, Mus musculus
gcacacgggaacgaagaggcttgat

SEQ ID NO: 444020 - DNA, 25 bp, Mus musculus
gcacacgtggaatctagcaagctga

SEQ ID NO: 444021 - DNA, 25 bp, Mus musculus
gcacactagtgcctggtgagacaca

SEQ ID NO: 444022 - DNA, 25 bp, Mus musculus
gcacactcttgttctccgggcgagg

SEQ ID NO: 444023 - DNA, 25 bp, Mus musculus
gcacactctttgaaatcctacatgg

SEQ ID NO: 444024 - DNA, 25 bp, Mus musculus
gcacagaacctgatattatgggcta

SEQ ID NO: 444025 - DNA, 25 bp, Mus musculus
gcacagacatggttgggatactaga

SEQ ID NO: 444026 - DNA, 25 bp, Mus musculus
gcacagacctcctggtaagacactt

SEQ ID NO: 444027 - DNA, 25 bp, Mus musculus
gcacagagaagcctgaggattctca

SEQ ID NO: 444028 - DNA, 25 bp, Mus musculus
gcacagagcctcaagggtgtacctg

SEQ ID NO: 444029 - DNA, 25 bp, Mus musculus
gcacagaggacatggctaaggattg

SEQ ID NO: 444030 - DNA, 25 bp, Mus musculus
gcacagaggtcagttaaaggtccag

SEQ ID NO: 444031 - DNA, 25 bp, Mus musculus
gcacagagtgtcaattcagccgcag

SEQ ID NO: 444032 - DNA, 25 bp, Mus musculus
gcacagcaatggaacggtggctccg

SEQ ID NO: 444033 - DNA, 25 bp, Mus musculus
gcacagcagagtacttcagggccta

SEQ ID NO: 444034 - DNA, 25 bp, Mus musculus
gcacagcagcagagaatgaattcgt

SEQ ID NO: 444035 - DNA, 25 bp, Mus musculus
gcacagcagcgcatttgactcagaa

SEQ ID NO: 444036 - DNA, 25 bp, Mus musculus
gcacagcagtccttagccctgaagt

SEQ ID NO: 444037 - DNA, 25 bp, Mus musculus
gcacagctgagggtctctggctaca

SEQ ID NO: 444038 - DNA, 25 bp, Mus musculus
gcacagctgatggtaggaagagtcc

SEQ ID NO: 444039 - DNA, 25 bp, Mus musculus
gcacagctgcattggccattcacct

SEQ ID NO: 444040 - DNA, 25 bp, Mus musculus
gcacagctgctcctcttctctgaaa

SEQ ID NO: 444041 - DNA, 25 bp, Mus musculus
gcacagctggtccatgtcccggaat

SEQ ID NO: 444042 - DNA, 25 bp, Mus musculus
gcacagctttaattgaggcctcaca

SEQ ID NO: 444043 - DNA, 25 bp, Mus musculus
gcacaggaacctctggaacatcggg

SEQ ID NO: 444044 - DNA, 25 bp, Mus musculus
gcacaggagttcagcaagtaccaga

SEQ ID NO: 444045 - DNA, 25 bp, Mus musculus
gcacaggatatggagctgcagcatc

SEQ ID NO: 444046 - DNA, 25 bp, Mus musculus
gcacaggctattgggataactagct

SEQ ID NO: 444047 - DNA, 25 bp, Mus musculus
gcacaggctctctatgccagcatga

SEQ ID NO: 444048 - DNA, 25 bp, Mus musculus
gcacaggtgatttccgcaaacaaaa

SEQ ID NO: 444049 - DNA, 25 bp, Mus musculus
gcacagtagacctgaccgtccatca

SEQ ID NO: 444050 - DNA, 25 bp, Mus musculus
gcacagtctggtactggcccggctt

SEQ ID NO: 444051 - DNA, 25 bp, Mus musculus
gcacagtggagcagtcggttctgca

SEQ ID NO: 444052 - DNA, 25 bp, Mus musculus
gcacagtggccatgtcagggtctca

SEQ ID NO: 444053 - DNA, 25 bp, Mus musculus
gcacagtgttccttcagctgggact

SEQ ID NO: 444054 - DNA, 25 bp, Mus musculus
gcacagttatctttatgtccttaga

SEQ ID NO: 444055 - DNA, 25 bp, Mus musculus
gcacagttcgacaaggagcatacct

SEQ ID NO: 444056 - DNA, 25 bp, Mus musculus
gcacataactagaaatctgagctag

SEQ ID NO: 444057 - DNA, 25 bp, Mus musculus
gcacatcaggcaaaacgcatacata

SEQ ID NO: 444058 - DNA, 25 bp, Mus musculus
gcacatcaggcacacacaggagttt

SEQ ID NO: 444059 - DNA, 25 bp, Mus musculus
gcacatcagtacttataaaggtcta

SEQ ID NO: 444060 - DNA, 25 bp, Mus musculus
gcacatgaaggagtacccggactac

SEQ ID NO: 444061 - DNA, 25 bp, Mus musculus
gcacatgaccaaatgaacatattgt

SEQ ID NO: 444062 - DNA, 25 bp, Mus musculus
gcacatgactcagggcttggacatg

SEQ ID NO: 444063 - DNA, 25 bp, Mus musculus
gcacatgactgctaccaggaggctg

SEQ ID NO: 444064 - DNA, 25 bp, Mus musculus
gcacatggccgtggcaggctagcct

SEQ ID NO: 444065 - DNA, 25 bp, Mus musculus
gcacatgggcattgctcgactggca

SEQ ID NO: 444066 - DNA, 25 bp, Mus musculus
gcacatgtgctgttaattgccacct

SEQ ID NO: 444067 - DNA, 25 bp, Mus musculus
gcacattccgggttcaggaggacac

SEQ ID NO: 444068 - DNA, 25 bp, Mus musculus
gcacattctgtcagtccacgggcag

SEQ ID NO: 444069 - DNA, 25 bp, Mus musculus
gcacattgtctcattggtcacacat

SEQ ID NO: 444070 - DNA, 25 bp, Mus musculus
gcacattgtctgcatacttcatgag

SEQ ID NO: 444071 - DNA, 25 bp, Mus musculus
gcacatttcgttttgagagaccgga

SEQ ID NO: 444072 - DNA, 25 bp, Mus musculus
gcacatttgtttccgtgagctggaa

SEQ ID NO: 444073 - DNA, 25 bp, Mus musculus
gcacattttaaactaaggcactcta

SEQ ID NO: 444074 - DNA, 25 bp, Mus musculus
gcacattttgtggtactcctgagtt

SEQ ID NO: 444075 - DNA, 25 bp, Mus musculus
gcaccaaacctatcccgaggaagag

SEQ ID NO: 444076 - DNA, 25 bp, Mus musculus
gcaccaaatcatgctgtgggagaag

SEQ ID NO: 444077 - DNA, 25 bp, Mus musculus
gcaccaacgtgacatataagccatt

SEQ ID NO: 444078 - DNA, 25 bp, Mus musculus
gcaccaaggagcagatcgtggagat

SEQ ID NO: 444079 - DNA, 25 bp, Mus musculus
gcaccaagggaatagccagaacagg

SEQ ID NO: 444080 - DNA, 25 bp, Mus musculus
gcaccaatcatgacagctatacaga

SEQ ID NO: 444081 - DNA, 25 bp, Mus musculus
gcaccaattgctgccttagccatgg

SEQ ID NO: 444082 - DNA, 25 bp, Mus musculus
gcaccaccaagtaaccatgagaaag

SEQ ID NO: 444083 - DNA, 25 bp, Mus musculus
gcaccacccctgtttttccagtttg

SEQ ID NO: 444084 - DNA, 25 bp, Mus musculus
gcaccactgaatcttattaaacgtg

SEQ ID NO: 444085 - DNA, 25 bp, Mus musculus
gcaccagaagctccttgaggctgta

SEQ ID NO: 444086 - DNA, 25 bp, Mus musculus
gcaccagactttctttacagaggga

SEQ ID NO: 444087 - DNA, 25 bp, Mus musculus
gcaccaggtaagttgagtaactttc

SEQ ID NO: 444088 - DNA, 25 bp, Mus musculus
gcaccatcgcaccttgccaaataaa

SEQ ID NO: 444089 - DNA, 25 bp, Mus musculus
gcaccatgaagaggcagtgacccag

SEQ ID NO: 444090 - DNA, 25 bp, Mus musculus
gcaccatggaacagcggttagccga

SEQ ID NO: 444091 - DNA, 25 bp, Mus musculus
gcaccattcaagatgataaacgtgt

SEQ ID NO: 444092 - DNA, 25 bp, Mus musculus
gcaccattctgtgttcaagggaaga

SEQ ID NO: 444093 - DNA, 25 bp, Mus musculus
gcacccaagggaatggtcctccagg

SEQ ID NO: 444094 - DNA, 25 bp, Mus musculus
gcacccacgaaggtgtgcttccagg

SEQ ID NO: 444095 - DNA, 25 bp, Mus musculus
gcacccacttgctcatagatgcaga

SEQ ID NO: 444096 - DNA, 25 bp, Mus musculus
gcacccagatagatggtggccacgg

SEQ ID NO: 444097 - DNA, 25 bp, Mus musculus
gcacccattctgctggttccacagg

SEQ ID NO: 444098 - DNA, 25 bp, Mus musculus
gcaccccaagataagaagacagata

SEQ ID NO: 444099 - DNA, 25 bp, Mus musculus
gcaccccgaagcagttctgccgggt

SEQ ID NO: 444100 - DNA, 25 bp, Mus musculus
gcacccctgggaatttttggacaca

SEQ ID NO: 444101 - DNA, 25 bp, Mus musculus
gcacccgactcaaagcattggccga

SEQ ID NO: 444102 - DNA, 25 bp, Mus musculus
gcaccctaacaaccctggacagaaa

SEQ ID NO: 444103 - DNA, 25 bp, Mus musculus
gcaccctctgttaggatgcgcccaa

SEQ ID NO: 444104 - DNA, 25 bp, Mus musculus
gcaccctggagcctgtattcggaaa

SEQ ID NO: 444105 - DNA, 25 bp, Mus musculus
gcaccctgtgttctccacagggctt

SEQ ID NO: 444106 - DNA, 25 bp, Mus musculus
gcaccgacagaacttgcttccagac

SEQ ID NO: 444107 - DNA, 25 bp, Mus musculus
gcaccgactttatgagcaacctgag

SEQ ID NO: 444108 - DNA, 25 bp, Mus musculus
gcaccgaggaaatgtagcccaattc

SEQ ID NO: 444109 - DNA, 25 bp, Mus musculus
gcaccgagtgtttcattcagcccat

SEQ ID NO: 444110 - DNA, 25 bp, Mus musculus
gcaccgatggccagctggtcgttaa

SEQ ID NO: 444111 - DNA, 25 bp, Mus musculus
gcaccgcatctcacgtgactgctgg

SEQ ID NO: 444112 - DNA, 25 bp, Mus musculus
gcaccgccaacaagagagtaaattt

SEQ ID NO: 444113 - DNA, 25 bp, Mus musculus
gcaccggaggcagatcattggattc

SEQ ID NO: 444114 - DNA, 25 bp, Mus musculus
gcaccggcacgctttacatcgcgga

SEQ ID NO: 444115 - DNA, 25 bp, Mus musculus
gcaccggcagaagatagaagaccag

SEQ ID NO: 444116 - DNA, 25 bp, Mus musculus
gcaccggccatgaagctgaagctga

SEQ ID NO: 444117 - DNA, 25 bp, Mus musculus
gcaccggctgtatgagatggccaac

SEQ ID NO: 444118 - DNA, 25 bp, Mus musculus
gcaccggtccggagtttctttcatt

SEQ ID NO: 444119 - DNA, 25 bp, Mus musculus
gcaccgtcgtgtttgtggtacccca

SEQ ID NO: 444120 - DNA, 25 bp, Mus musculus
gcaccgtttccttgagctgtcctgg

SEQ ID NO: 444121 - DNA, 25 bp, Mus musculus
gcacctaatgtttgtgtttgctcaa

SEQ ID NO: 444122 - DNA, 25 bp, Mus musculus
gcacctactacattgactcaaccat

SEQ ID NO: 444123 - DNA, 25 bp, Mus musculus
gcacctcaatggtcaggcgctcaga

SEQ ID NO: 444124 - DNA, 25 bp, Mus musculus
gcacctcccgggatgtgactctggg

SEQ ID NO: 444125 - DNA, 25 bp, Mus musculus
gcacctcgggactaactaggatctg

SEQ ID NO: 444126 - DNA, 25 bp, Mus musculus
gcacctgacattgaactcttggaag

SEQ ID NO: 444127 - DNA, 25 bp, Mus musculus
gcacctgagcaagaaaccccataag

SEQ ID NO: 444128 - DNA, 25 bp, Mus musculus
gcacctgcacgttgggacagcagct

SEQ ID NO: 444129 - DNA, 25 bp, Mus musculus
gcacctgcgccgttagtgagcacta

SEQ ID NO: 444130 - DNA, 25 bp, Mus musculus
gcacctgctccatgggcttcagaat

SEQ ID NO: 444131 - DNA, 25 bp, Mus musculus
gcacctgctttcaaacctaacaact

SEQ ID NO: 444132 - DNA, 25 bp, Mus musculus
gcacctggcgctatccgacttgtta

SEQ ID NO: 444133 - DNA, 25 bp, Mus musculus
gcacctgggcatgggacttgtagaa

SEQ ID NO: 444134 - DNA, 25 bp, Mus musculus
gcacctgggcgcagaacaaaagggc

SEQ ID NO: 444135 - DNA, 25 bp, Mus musculus
gcacctgtagcatcgagtgtcttct

SEQ ID NO: 444136 - DNA, 25 bp, Mus musculus
gcacctgtccagagttttagccatt

SEQ ID NO: 444137 - DNA, 25 bp, Mus musculus
gcacctgtctacatagctcattgag

SEQ ID NO: 444138 - DNA, 25 bp, Mus musculus
gcacctgtctatgtcctgagtaaga

SEQ ID NO: 444139 - DNA, 25 bp, Mus musculus
gcacctgtgactggcgtaaagcaaa

SEQ ID NO: 444140 - DNA, 25 bp, Mus musculus
gcacctgtggtgaaagccctaagca

SEQ ID NO: 444141 - DNA, 25 bp, Mus musculus
gcacctgttcagagtcacacaaata

SEQ ID NO: 444142 - DNA, 25 bp, Mus musculus
gcaccttaacccaccgagctagtaa

SEQ ID NO: 444143 - DNA, 25 bp, Mus musculus
gcaccttcagaatggcgcatgttga

SEQ ID NO: 444144 - DNA, 25 bp, Mus musculus
gcaccttgtcccaagctgagccatg

SEQ ID NO: 444145 - DNA, 25 bp, Mus musculus
gcacctttactagttgtcgggagct

SEQ ID NO: 444146 - DNA, 25 bp, Mus musculus
gcacctttcttgatgtctggacaga

SEQ ID NO: 444147 - DNA, 25 bp, Mus musculus
gcacgaagttaagctgacagtacag

SEQ ID NO: 444148 - DNA, 25 bp, Mus musculus
gcacgaatgcggaaccctacaggat

SEQ ID NO: 444149 - DNA, 25 bp, Mus musculus
gcacgacatagctaccagtctggag

SEQ ID NO: 444150 - DNA, 25 bp, Mus musculus
gcacgacctaaaaactgctgaagag

SEQ ID NO: 444151 - DNA, 25 bp, Mus musculus
gcacgacctttttccagacaccaga

SEQ ID NO: 444152 - DNA, 25 bp, Mus musculus
gcacgagaattacgatgaggcctta

SEQ ID NO: 444153 - DNA, 25 bp, Mus musculus
gcacgagcacagacaccacttctta

SEQ ID NO: 444154 - DNA, 25 bp, Mus musculus
gcacgaggcacatcttactctttta

SEQ ID NO: 444155 - DNA, 25 bp, Mus musculus
gcacgatcactttctaaactacctg

SEQ ID NO: 444156 - DNA, 25 bp, Mus musculus
gcacgatgtcgttcaacaatctgag

SEQ ID NO: 444157 - DNA, 25 bp, Mus musculus
gcacgatgtttattgagaaacagaa

SEQ ID NO: 444158 - DNA, 25 bp, Mus musculus
gcacgcccgtttgcaatgattgcct

SEQ ID NO: 444159 - DNA, 25 bp, Mus musculus
gcacgccggtggagaaagctgtatt

SEQ ID NO: 444160 - DNA, 25 bp, Mus musculus
gcacgcctagggacgcggagaacat

SEQ ID NO: 444161 - DNA, 25 bp, Mus musculus
gcacgcctgggttctgtctgagcat

SEQ ID NO: 444162 - DNA, 25 bp, Mus musculus
gcacgctgaagcagatacctttttc

SEQ ID NO: 444163 - DNA, 25 bp, Mus musculus
gcacggacactttcccgtatccagg

SEQ ID NO: 444164 - DNA, 25 bp, Mus musculus
gcacggatggtgagaaatatggata

SEQ ID NO: 444165 - DNA, 25 bp, Mus musculus
gcacggatttgacggagctacacga

SEQ ID NO: 444166 - DNA, 25 bp, Mus musculus
gcacggcctcaagaacgaacatgga

SEQ ID NO: 444167 - DNA, 25 bp, Mus musculus
gcacggcctctgtggatgactagaa

SEQ ID NO: 444168 - DNA, 25 bp, Mus musculus
gcacggcggcacgtagctttaatac

SEQ ID NO: 444169 - DNA, 25 bp, Mus musculus
gcacggctcccagaaattaattcta

SEQ ID NO: 444170 - DNA, 25 bp, Mus musculus
gcacggctgaatacttccctactaa

SEQ ID NO: 444171 - DNA, 25 bp, Mus musculus
gcacgggatatctctgtctaaagga

SEQ ID NO: 444172 - DNA, 25 bp, Mus musculus
gcacgggatgaaactaaaagagcca

SEQ ID NO: 444173 - DNA, 25 bp, Mus musculus
gcacggtcttagaggtttcagaacc

SEQ ID NO: 444174 - DNA, 25 bp, Mus musculus
gcacggtgggttgccatgctacaga

SEQ ID NO: 444175 - DNA, 25 bp, Mus musculus
gcacgtactttcctgactgagccat

SEQ ID NO: 444176 - DNA, 25 bp, Mus musculus
gcacgtcagcctacccagaagagaa

SEQ ID NO: 444177 - DNA, 25 bp, Mus musculus
gcacgtcagtgcactttactccagg

SEQ ID NO: 444178 - DNA, 25 bp, Mus musculus
gcacgtcgcttgcaggcctgtttta

SEQ ID NO: 444179 - DNA, 25 bp, Mus musculus
gcacgtggaaagtagaccggaacga

SEQ ID NO: 444180 - DNA, 25 bp, Mus musculus
gcacgtgtgcgcagaagcattggca

SEQ ID NO: 444181 - DNA, 25 bp, Mus musculus
gcacgttaacaacgcgcggtcctgg

SEQ ID NO: 444182 - DNA, 25 bp, Mus musculus
gcacgttgaatgtgggccagagcca

SEQ ID NO: 444183 - DNA, 25 bp, Mus musculus
gcactaaactttctcttccaccatg

SEQ ID NO: 444184 - DNA, 25 bp, Mus musculus
gcactaaagccttggaaacactacg

SEQ ID NO: 444185 - DNA, 25 bp, Mus musculus
gcactaaattgcacgggctgcggca

SEQ ID NO: 444186 - DNA, 25 bp, Mus musculus
gcactaaggagcttgaacagagcct

SEQ ID NO: 444187 - DNA, 25 bp, Mus musculus
gcactacaaagggaatccattcagg

SEQ ID NO: 444188 - DNA, 25 bp, Mus musculus
gcactacagcatcgatgaagctgag

SEQ ID NO: 444189 - DNA, 25 bp, Mus musculus
gcactactaagatggcaggcctcat

SEQ ID NO: 444190 - DNA, 25 bp, Mus musculus
gcactactgagagatttggagccct

SEQ ID NO: 444191 - DNA, 25 bp, Mus musculus
gcactactgttggaacccggacact

SEQ ID NO: 444192 - DNA, 25 bp, Mus musculus
gcactagaaaagatgctctggcccc

SEQ ID NO: 444193 - DNA, 25 bp, Mus musculus
gcactagaaggcaaacccgctgtgg

SEQ ID NO: 444194 - DNA, 25 bp, Mus musculus
gcactagacaactcggaaaaacacg

SEQ ID NO: 444195 - DNA, 25 bp, Mus musculus
gcactagaggtgaccttgggtagcc

SEQ ID NO: 444196 - DNA, 25 bp, Mus musculus
gcactatgtcttaccagcagcagca

SEQ ID NO: 444197 - DNA, 25 bp, Mus musculus
gcactatgtgactacccggaaaggg

SEQ ID NO: 444198 - DNA, 25 bp, Mus musculus
gcactatttactgcttcaatcccag

SEQ ID NO: 444199 - DNA, 25 bp, Mus musculus
gcactcaaatattgtaactctgcgt

SEQ ID NO: 444200 - DNA, 25 bp, Mus musculus
gcactcaagtgggcttcaggcatct

SEQ ID NO: 444201 - DNA, 25 bp, Mus musculus
gcactcacatagtgcctaacaacca

SEQ ID NO: 444202 - DNA, 25 bp, Mus musculus
gcactcactgttcactttaataagt

SEQ ID NO: 444203 - DNA, 25 bp, Mus musculus
gcactcactttgcaggcggcgcatt

SEQ ID NO: 444204 - DNA, 25 bp, Mus musculus
gcactcagactacagggccaagctg

SEQ ID NO: 444205 - DNA, 25 bp, Mus musculus
gcactcgagcctaatcaaacacctg

SEQ ID NO: 444206 - DNA, 25 bp, Mus musculus
gcactcggaatttgatgaacagcat

SEQ ID NO: 444207 - DNA, 25 bp, Mus musculus
gcactctctaaatgctttagtttgg

SEQ ID NO: 444208 - DNA, 25 bp, Mus musculus
gcactctctggcgacttggcagttt

SEQ ID NO: 444209 - DNA, 25 bp, Mus musculus
gcactgaaacagacaggcgacgatg

SEQ ID NO: 444210 - DNA, 25 bp, Mus musculus
gcactgaatatacccagcatggtgg

SEQ ID NO: 444211 - DNA, 25 bp, Mus musculus
gcactgaggccatgcttgtgctcaa

SEQ ID NO: 444212 - DNA, 25 bp, Mus musculus
gcactgaggtgcacacagtgtgccc

SEQ ID NO: 444213 - DNA, 25 bp, Mus musculus
gcactgattgctgtttttataatgc

SEQ ID NO: 444214 - DNA, 25 bp, Mus musculus
gcactgcactgaatcgcttctggga

SEQ ID NO: 444215 - DNA, 25 bp, Mus musculus
gcactgcatgccctcagagatggaa

SEQ ID NO: 444216 - DNA, 25 bp, Mus musculus
gcactgcatgtacattggtgcacag

SEQ ID NO: 444217 - DNA, 25 bp, Mus musculus
gcactgcctatgagcacttcacaag

SEQ ID NO: 444218 - DNA, 25 bp, Mus musculus
gcactgccttttgggaaaccctcag

SEQ ID NO: 444219 - DNA, 25 bp, Mus musculus
gcactgcggcaaaaaggccattttc

SEQ ID NO: 444220 - DNA, 25 bp, Mus musculus
gcactgctgccttaagatctcatta

SEQ ID NO: 444221 - DNA, 25 bp, Mus musculus
gcactgcttgtcgtgggatcctaca

SEQ ID NO: 444222 - DNA, 25 bp, Mus musculus
gcactggattaatggcactggctgg

SEQ ID NO: 444223 - DNA, 25 bp, Mus musculus
gcactggccttcaaagaatcacgaa

SEQ ID NO: 444224 - DNA, 25 bp, Mus musculus
gcactgggacaatagctgggagctt

SEQ ID NO: 444225 - DNA, 25 bp, Mus musculus
gcactgggcacactgtatggcaacg

SEQ ID NO: 444226 - DNA, 25 bp, Mus musculus
gcactgggtctgatattgatcccct

SEQ ID NO: 444227 - DNA, 25 bp, Mus musculus
gcactgggtggagctaggccctcaa

SEQ ID NO: 444228 - DNA, 25 bp, Mus musculus
gcactgggtgtttgacgaagcctcc

SEQ ID NO: 444229 - DNA, 25 bp, Mus musculus
gcactgggtttttcgagtgctgacc

SEQ ID NO: 444230 - DNA, 25 bp, Mus musculus
gcactggtaaaaccgaactccagga

SEQ ID NO: 444231 - DNA, 25 bp, Mus musculus
gcactggtgacttcggacctctgaa

SEQ ID NO: 444232 - DNA, 25 bp, Mus musculus
gcactgtatcagcacggaattcacc

SEQ ID NO: 444233 - DNA, 25 bp, Mus musculus
gcactgtcaacgctgtaagcccggt

SEQ ID NO: 444234 - DNA, 25 bp, Mus musculus
gcactgtcaagaaaatgcaagaaac

SEQ ID NO: 444235 - DNA, 25 bp, Mus musculus
gcactgtgaagcagggactgtgaca

SEQ ID NO: 444236 - DNA, 25 bp, Mus musculus
gcactgtgcataccaaaaggctgtc

SEQ ID NO: 444237 - DNA, 25 bp, Mus musculus
gcactgtgctctgggtaaactgtaa

SEQ ID NO: 444238 - DNA, 25 bp, Mus musculus
gcactgtgctgtccctggcagaaaa

SEQ ID NO: 444239 - DNA, 25 bp, Mus musculus
gcactgtgcttgcacctgaaaaggt

SEQ ID NO: 444240 - DNA, 25 bp, Mus musculus
gcactgttggatctagctgaacgaa

SEQ ID NO: 444241 - DNA, 25 bp, Mus musculus
gcacttacacagaggtgcacctaag

SEQ ID NO: 444242 - DNA, 25 bp, Mus musculus
gcacttacggaacgagggaaccttg

SEQ ID NO: 444243 - DNA, 25 bp, Mus musculus
gcacttacttggtattcgatctcca

SEQ ID NO: 444244 - DNA, 25 bp, Mus musculus
gcacttagcccgtgttctctcctgg

SEQ ID NO: 444245 - DNA, 25 bp, Mus musculus
gcacttaggtccatgttacaccctg

SEQ ID NO: 444246 - DNA, 25 bp, Mus musculus
gcacttagttccctacaagagacct

SEQ ID NO: 444247 - DNA, 25 bp, Mus musculus
gcacttcaaagtgacgcgcactgga

SEQ ID NO: 444248 - DNA, 25 bp, Mus musculus
gcacttcctccttggcaggcctagg

SEQ ID NO: 444249 - DNA, 25 bp, Mus musculus
gcacttcgcaaggagcccactaatt

SEQ ID NO: 444250 - DNA, 25 bp, Mus musculus
gcacttgaacaccaagggatggctt

SEQ ID NO: 444251 - DNA, 25 bp, Mus musculus
gcacttgctggcgaacgacatacct

SEQ ID NO: 444252 - DNA, 25 bp, Mus musculus
gcacttgggagtactggtcctggaa

SEQ ID NO: 444253 - DNA, 25 bp, Mus musculus
gcacttgtgtaatgagaactgcatt

SEQ ID NO: 444254 - DNA, 25 bp, Mus musculus
gcactttaacccgaggctggacact

SEQ ID NO: 444255 - DNA, 25 bp, Mus musculus
gcactttaagtcactcggaggacaa

SEQ ID NO: 444256 - DNA, 25 bp, Mus musculus
gcactttcaatgtgatccgcctggt

SEQ ID NO: 444257 - DNA, 25 bp, Mus musculus
gcactttctggccagaatccgcggg

SEQ ID NO: 444258 - DNA, 25 bp, Mus musculus
gcactttcttgccagatacaatttc

SEQ ID NO: 444259 - DNA, 25 bp, Mus musculus
gcactttgaatgcatctaatctagt

SEQ ID NO: 444260 - DNA, 25 bp, Mus musculus
gcactttgtgctttagacaggccag

SEQ ID NO: 444261 - DNA, 25 bp, Mus musculus
gcacttttagaagtcctcacgaccg

SEQ ID NO: 444262 - DNA, 25 bp, Mus musculus
gcagaaaacacttcaggtcctgatg

SEQ ID NO: 444263 - DNA, 25 bp, Mus musculus
gcagaaaacccacaatccttagagt

SEQ ID NO: 444264 - DNA, 25 bp, Mus musculus
gcagaaaagtgttggcatcagccct

SEQ ID NO: 444265 - DNA, 25 bp, Mus musculus
gcagaaacagaccaggaatactatt

SEQ ID NO: 444266 - DNA, 25 bp, Mus musculus
gcagaaagaacacattctcagaaga

SEQ ID NO: 444267 - DNA, 25 bp, Mus musculus
gcagaaagaggtaagatgctaccca

SEQ ID NO: 444268 - DNA, 25 bp, Mus musculus
gcagaaagcaaaacagaggacacag

SEQ ID NO: 444269 - DNA, 25 bp, Mus musculus
gcagaaagcaagtcaaggagaaatg

SEQ ID NO: 444270 - DNA, 25 bp, Mus musculus
gcagaaagcacaacagcaggaagct

SEQ ID NO: 444271 - DNA, 25 bp, Mus musculus
gcagaaagcagaagattccctggaa

SEQ ID NO: 444272 - DNA, 25 bp, Mus musculus
gcagaaagcccaacactacctagtg

SEQ ID NO: 444273 - DNA, 25 bp, Mus musculus
gcagaaagtttacccgggcatccag

SEQ ID NO: 444274 - DNA, 25 bp, Mus musculus
gcagaaatcattttatagcaacaat

SEQ ID NO: 444275 - DNA, 25 bp, Mus musculus
gcagaaatgtgacagcgccaaccat

SEQ ID NO: 444276 - DNA, 25 bp, Mus musculus
gcagaaattcgccaaggatgactcg

SEQ ID NO: 444277 - DNA, 25 bp, Mus musculus
gcagaaccccgagtaaatagccttg

SEQ ID NO: 444278 - DNA, 25 bp, Mus musculus
gcagaacccctttcataaatgagag

SEQ ID NO: 444279 - DNA, 25 bp, Mus musculus
gcagaaccctttcatgaggctgagt

SEQ ID NO: 444280 - DNA, 25 bp, Mus musculus
gcagaacctctctgagccgtcggag

SEQ ID NO: 444281 - DNA, 25 bp, Mus musculus
gcagaaccttacatgcgcatctttt

SEQ ID NO: 444282 - DNA, 25 bp, Mus musculus
gcagaacgcagttccacagttgaaa

SEQ ID NO: 444283 - DNA, 25 bp, Mus musculus
gcagaacgccattgtagccaagatg

SEQ ID NO: 444284 - DNA, 25 bp, Mus musculus
gcagaactcctcaagcctacatgtg

SEQ ID NO: 444285 - DNA, 25 bp, Mus musculus
gcagaactcttactaggcataggaa

SEQ ID NO: 444286 - DNA, 25 bp, Mus musculus
gcagaactgcgatggcggactcgct

SEQ ID NO: 444287 - DNA, 25 bp, Mus musculus
gcagaactgctcatcatcggctggt

SEQ ID NO: 444288 - DNA, 25 bp, Mus musculus
gcagaactgtccctcctggatagca

SEQ ID NO: 444289 - DNA, 25 bp, Mus musculus
gcagaactgtgaatcttggaacaaa

SEQ ID NO: 444290 - DNA, 25 bp, Mus musculus
gcagaacttccactcggtgcgggaa

SEQ ID NO: 444291 - DNA, 25 bp, Mus musculus
gcagaagaatcccatcgtttatcat

SEQ ID NO: 444292 - DNA, 25 bp, Mus musculus
gcagaagaggccgatgttgtttgaa

SEQ ID NO: 444293 - DNA, 25 bp, Mus musculus
gcagaagcaattggaggcatagagt

SEQ ID NO: 444294 - DNA, 25 bp, Mus musculus
gcagaagccccctgaaaacgaaggt

SEQ ID NO: 444295 - DNA, 25 bp, Mus musculus
gcagaagccgtagcagaagcaacag

SEQ ID NO: 444296 - DNA, 25 bp, Mus musculus
gcagaagcgcgtctagaaactcctt

SEQ ID NO: 444297 - DNA, 25 bp, Mus musculus
gcagaagctcctgccttgcttgtgg

SEQ ID NO: 444298 - DNA, 25 bp, Mus musculus
gcagaagctcgcctacagtttcgtt

SEQ ID NO: 444299 - DNA, 25 bp, Mus musculus
gcagaagctcggattcacagctgag

SEQ ID NO: 444300 - DNA, 25 bp, Mus musculus
gcagaagctcgttgaaagaactaga

SEQ ID NO: 444301 - DNA, 25 bp, Mus musculus
gcagaaggacatcttaggaaaatca

SEQ ID NO: 444302 - DNA, 25 bp, Mus musculus
gcagaaggattgtcatggcatggta

SEQ ID NO: 444303 - DNA, 25 bp, Mus musculus
gcagaagtaaaaagcacccgagcca

SEQ ID NO: 444304 - DNA, 25 bp, Mus musculus
gcagaagtaagaagatcctgagttc

SEQ ID NO: 444305 - DNA, 25 bp, Mus musculus
gcagaagtacaagcgcagaatagat

SEQ ID NO: 444306 - DNA, 25 bp, Mus musculus
gcagaatacaaatgcagtgcgtttg

SEQ ID NO: 444307 - DNA, 25 bp, Mus musculus
gcagaatatcctgcctgaccatggg

SEQ ID NO: 444308 - DNA, 25 bp, Mus musculus
gcagaatcagcggtcaacaactcct

SEQ ID NO: 444309 - DNA, 25 bp, Mus musculus
gcagaatccggatgcagctcctgta

SEQ ID NO: 444310 - DNA, 25 bp, Mus musculus
gcagaatgcactctctcggagcagg

SEQ ID NO: 444311 - DNA, 25 bp, Mus musculus
gcagaatggccagactacagtagag

SEQ ID NO: 444312 - DNA, 25 bp, Mus musculus
gcagaattcagtggcgctccaagct

SEQ ID NO: 444313 - DNA, 25 bp, Mus musculus
gcagaattcataaagggcagccata

SEQ ID NO: 444314 - DNA, 25 bp, Mus musculus
gcagaattcgactgaagacacatgg

SEQ ID NO: 444315 - DNA, 25 bp, Mus musculus
gcagacaaaagtgtggtggcctccc

SEQ ID NO: 444316 - DNA, 25 bp, Mus musculus
gcagacaaggatggtgagatctact

SEQ ID NO: 444317 - DNA, 25 bp, Mus musculus
gcagacacacttacaccagaggaat

SEQ ID NO: 444318 - DNA, 25 bp, Mus musculus
gcagacacagggagtcaatcatgct

SEQ ID NO: 444319 - DNA, 25 bp, Mus musculus
gcagacagactgtcaacttcagcag

SEQ ID NO: 444320 - DNA, 25 bp, Mus musculus
gcagacagtctaacagatgatatca

SEQ ID NO: 444321 - DNA, 25 bp, Mus musculus
gcagacagtggttccgcaagctggc

SEQ ID NO: 444322 - DNA, 25 bp, Mus musculus
gcagacataacacagggagccagtg

SEQ ID NO: 444323 - DNA, 25 bp, Mus musculus
gcagacataggagcatccacactgg

SEQ ID NO: 444324 - DNA, 25 bp, Mus musculus
gcagacatctgccgcccagcaggat

SEQ ID NO: 444325 - DNA, 25 bp, Mus musculus
gcagacatgaagtacccttcctcct

SEQ ID NO: 444326 - DNA, 25 bp, Mus musculus
gcagaccaggactgaatttcagagg

SEQ ID NO: 444327 - DNA, 25 bp, Mus musculus
gcagaccagggttgactgacaccag

SEQ ID NO: 444328 - DNA, 25 bp, Mus musculus
gcagacccagttttgacaatgccag

SEQ ID NO: 444329 - DNA, 25 bp, Mus musculus
gcagacccgcacaggctatacagta

SEQ ID NO: 444330 - DNA, 25 bp, Mus musculus
gcagaccctcagactgcttccagag

SEQ ID NO: 444331 - DNA, 25 bp, Mus musculus
gcagaccctgccaagtggagaggag

SEQ ID NO: 444332 - DNA, 25 bp, Mus musculus
gcagaccctgcgagtgctgtgtcta

SEQ ID NO: 444333 - DNA, 25 bp, Mus musculus
gcagaccgtgatcttaagcgcctcg

SEQ ID NO: 444334 - DNA, 25 bp, Mus musculus
gcagacctgacatcgtttgtaccac

SEQ ID NO: 444335 - DNA, 25 bp, Mus musculus
gcagaccttccggactgagataaaa

SEQ ID NO: 444336 - DNA, 25 bp, Mus musculus
gcagaccttgacttcactgagagag

SEQ ID NO: 444337 - DNA, 25 bp, Mus musculus
gcagacgagcgttctccaggcataa

SEQ ID NO: 444338 - DNA, 25 bp, Mus musculus
gcagacgatctacaaggacaccgag

SEQ ID NO: 444339 - DNA, 25 bp, Mus musculus
gcagacgcaacagggaattttccat

SEQ ID NO: 444340 - DNA, 25 bp, Mus musculus
gcagacgcggcctatttcctctaat

SEQ ID NO: 444341 - DNA, 25 bp, Mus musculus
gcagacggctctagtttcaaatacc

SEQ ID NO: 444342 - DNA, 25 bp, Mus musculus
gcagacgtcagagagatccacagga

SEQ ID NO: 444343 - DNA, 25 bp, Mus musculus
gcagacgtggagaactcgggtaaaa

SEQ ID NO: 444344 - DNA, 25 bp, Mus musculus
gcagactacaccttggagaccacag

SEQ ID NO: 444345 - DNA, 25 bp, Mus musculus
gcagactatgaacaggatacagcag

SEQ ID NO: 444346 - DNA, 25 bp, Mus musculus
gcagactccttacttgcacagcaga

SEQ ID NO: 444347 - DNA, 25 bp, Mus musculus
gcagactcgacagttcaagagcaag

SEQ ID NO: 444348 - DNA, 25 bp, Mus musculus
gcagactctgcccatttccatggaa

SEQ ID NO: 444349 - DNA, 25 bp, Mus musculus
gcagactgctggtatgttcacaaag

SEQ ID NO: 444350 - DNA, 25 bp, Mus musculus
gcagactgggaggttgtcactaccc

SEQ ID NO: 444351 - DNA, 25 bp, Mus musculus
gcagacttgctgagtatcacggaga

SEQ ID NO: 444352 - DNA, 25 bp, Mus musculus
gcagacttgtttttattctagataa

SEQ ID NO: 444353 - DNA, 25 bp, Mus musculus
gcagagaacatggatgatatgggca

SEQ ID NO: 444354 - DNA, 25 bp, Mus musculus
gcagagaacctcagccatgttggcc

SEQ ID NO: 444355 - DNA, 25 bp, Mus musculus
gcagagaacgtgtagttagagcagt

SEQ ID NO: 444356 - DNA, 25 bp, Mus musculus
gcagagaactacttcttcaaccagt

SEQ ID NO: 444357 - DNA, 25 bp, Mus musculus
gcagagaagttcacaccgagcagtc

SEQ ID NO: 444358 - DNA, 25 bp, Mus musculus
gcagagaatttctcaggctcccgta

SEQ ID NO: 444359 - DNA, 25 bp, Mus musculus
gcagagacagtccagcaggcctgca

SEQ ID NO: 444360 - DNA, 25 bp, Mus musculus
gcagagactcgagcttcctccaagt

SEQ ID NO: 444361 - DNA, 25 bp, Mus musculus
gcagagactgatctagaactcctga

SEQ ID NO: 444362 - DNA, 25 bp, Mus musculus
gcagagacttgaatccaggacctta

SEQ ID NO: 444363 - DNA, 25 bp, Mus musculus
gcagagagcaagaatgatagctgtc

SEQ ID NO: 444364 - DNA, 25 bp, Mus musculus
gcagagagcaggagtgtgccagccg

SEQ ID NO: 444365 - DNA, 25 bp, Mus musculus
gcagagagccattacgtgtcccaga

SEQ ID NO: 444366 - DNA, 25 bp, Mus musculus
gcagagagcggagaagacattcccc

SEQ ID NO: 444367 - DNA, 25 bp, Mus musculus
gcagagaggatttaaccgcaaggat

SEQ ID NO: 444368 - DNA, 25 bp, Mus musculus
gcagagaggttggaagcccggttta

SEQ ID NO: 444369 - DNA, 25 bp, Mus musculus
gcagagagtgctcctccaaggacaa

SEQ ID NO: 444370 - DNA, 25 bp, Mus musculus
gcagagatcaccagaagcaagtggg

SEQ ID NO: 444371 - DNA, 25 bp, Mus musculus
gcagagatgctatccaacaggccta

SEQ ID NO: 444372 - DNA, 25 bp, Mus musculus
gcagagatgttgtgagcagtgtacc

SEQ ID NO: 444373 - DNA, 25 bp, Mus musculus
gcagagattgtgacctagaaggcca

SEQ ID NO: 444374 - DNA, 25 bp, Mus musculus
gcagagcaaggctctcagcctaagc

SEQ ID NO: 444375 - DNA, 25 bp, Mus musculus
gcagagcacagcaccttggtagtgg

SEQ ID NO: 444376 - DNA, 25 bp, Mus musculus
gcagagcagccttgagccaggagta

SEQ ID NO: 444377 - DNA, 25 bp, Mus musculus
gcagagcatccgctatgcaggatgt

SEQ ID NO: 444378 - DNA, 25 bp, Mus musculus
gcagagcattctgggtgatggaacc

SEQ ID NO: 444379 - DNA, 25 bp, Mus musculus
gcagagccagcagaatctccgggct

SEQ ID NO: 444380 - DNA, 25 bp, Mus musculus
gcagagccgacctgaagctgataga

SEQ ID NO: 444381 - DNA, 25 bp, Mus musculus
gcagagcctgaaccttgatatccaa

SEQ ID NO: 444382 - DNA, 25 bp, Mus musculus
gcagagcctgcgcaagatggtcatc

SEQ ID NO: 444383 - DNA, 25 bp, Mus musculus
gcagagcctgttctggccgcggtgg

SEQ ID NO: 444384 - DNA, 25 bp, Mus musculus
gcagagcgctatttcagagagtgga

SEQ ID NO: 444385 - DNA, 25 bp, Mus musculus
gcagagcgtcatctccggacatgga

SEQ ID NO: 444386 - DNA, 25 bp, Mus musculus
gcagagctaccaagaggcagccgct

SEQ ID NO: 444387 - DNA, 25 bp, Mus musculus
gcagagctagaaagtgccctccagg

SEQ ID NO: 444388 - DNA, 25 bp, Mus musculus
gcagagctctcaaaaactgaaagcc

SEQ ID NO: 444389 - DNA, 25 bp, Mus musculus
gcagagctcttgttgcattcctgaa

SEQ ID NO: 444390 - DNA, 25 bp, Mus musculus
gcagagcttcagctattcactaaaa

SEQ ID NO: 444391 - DNA, 25 bp, Mus musculus
gcagaggaccctttagacggcacaa

SEQ ID NO: 444392 - DNA, 25 bp, Mus musculus
gcagaggagaaaagcaaggcagaag

SEQ ID NO: 444393 - DNA, 25 bp, Mus musculus
gcagaggagcccaaatgcagttagg

SEQ ID NO: 444394 - DNA, 25 bp, Mus musculus
gcagaggaggctgtccggctccttt

SEQ ID NO: 444395 - DNA, 25 bp, Mus musculus
gcagaggatcccttcttgaactccg

SEQ ID NO: 444396 - DNA, 25 bp, Mus musculus
gcagaggcaataaccaatgggtccc

SEQ ID NO: 444397 - DNA, 25 bp, Mus musculus
gcagaggccacttcacttagtagag

SEQ ID NO: 444398 - DNA, 25 bp, Mus musculus
gcagaggcctttgctcgaactggaa

SEQ ID NO: 444399 - DNA, 25 bp, Mus musculus
gcagaggctcctttgtgctcgtaca

SEQ ID NO: 444400 - DNA, 25 bp, Mus musculus
gcagaggctcttcggcttccagccg

SEQ ID NO: 444401 - DNA, 25 bp, Mus musculus
gcagagggcctcagaatgttttcaa

SEQ ID NO: 444402 - DNA, 25 bp, Mus musculus
gcagagggtacccaggaacctccct

SEQ ID NO: 444403 - DNA, 25 bp, Mus musculus
gcagaggtctccgtgaagctcagga

SEQ ID NO: 444404 - DNA, 25 bp, Mus musculus
gcagagtccctgtgttgaggacgca

SEQ ID NO: 444405 - DNA, 25 bp, Mus musculus
gcagagtccctgttcacagttcagt

SEQ ID NO: 444406 - DNA, 25 bp, Mus musculus
gcagagtcctttctacggcgacaag

SEQ ID NO: 444407 - DNA, 25 bp, Mus musculus
gcagagtcttgggactgggaccctt

SEQ ID NO: 444408 - DNA, 25 bp, Mus musculus
gcagagtgagtcttgcagagtttca

SEQ ID NO: 444409 - DNA, 25 bp, Mus musculus
gcagagtgatacctagcccagtcag

SEQ ID NO: 444410 - DNA, 25 bp, Mus musculus
gcagagtgcagttttagcagacgct

SEQ ID NO: 444411 - DNA, 25 bp, Mus musculus
gcagagtgtctccttgcagtaaaca

SEQ ID NO: 444412 - DNA, 25 bp, Mus musculus
gcagagttacatacagagagcaccg

SEQ ID NO: 444413 - DNA, 25 bp, Mus musculus
gcagataaacatgcaagccaagcag

SEQ ID NO: 444414 - DNA, 25 bp, Mus musculus
gcagataaccagcttctggcagttg

SEQ ID NO: 444415 - DNA, 25 bp, Mus musculus
gcagatacttggtctgtcagccagg

SEQ ID NO: 444416 - DNA, 25 bp, Mus musculus
gcagatactttgaatgtaggcagtt

SEQ ID NO: 444417 - DNA, 25 bp, Mus musculus
gcagatatcagtgtggccaaggaca

SEQ ID NO: 444418 - DNA, 25 bp, Mus musculus
gcagatatccaaagggtgcagcccc

SEQ ID NO: 444419 - DNA, 25 bp, Mus musculus
gcagatatttgtctcctcaacagcc

SEQ ID NO: 444420 - DNA, 25 bp, Mus musculus
gcagatcaccaaaagcttggacatt

SEQ ID NO: 444421 - DNA, 25 bp, Mus musculus
gcagatcagactctcctcgttcgcg

SEQ ID NO: 444422 - DNA, 25 bp, Mus musculus
gcagatcattgcatcctcagaccaa

SEQ ID NO: 444423 - DNA, 25 bp, Mus musculus
gcagatccaagagtttccagtccca

SEQ ID NO: 444424 - DNA, 25 bp, Mus musculus
gcagatccccaacgctttcctagtg

SEQ ID NO: 444425 - DNA, 25 bp, Mus musculus
gcagatccttgctcattggagaaca

SEQ ID NO: 444426 - DNA, 25 bp, Mus musculus
gcagatcgaatattggcagcagtca

SEQ ID NO: 444427 - DNA, 25 bp, Mus musculus
gcagatctcatctcttcgctcggca

SEQ ID NO: 444428 - DNA, 25 bp, Mus musculus
gcagatctcgctctcgtacataaga

SEQ ID NO: 444429 - DNA, 25 bp, Mus musculus
gcagatctgggtcacttgtttgtac

SEQ ID NO: 444430 - DNA, 25 bp, Mus musculus
gcagatcttaacctccagtagcaaa

SEQ ID NO: 444431 - DNA, 25 bp, Mus musculus
gcagatcttatgaggcttccgagcc

SEQ ID NO: 444432 - DNA, 25 bp, Mus musculus
gcagatgacaaatccggagaccgat

SEQ ID NO: 444433 - DNA, 25 bp, Mus musculus
gcagatgaccacactcttccaggag

SEQ ID NO: 444434 - DNA, 25 bp, Mus musculus
gcagatgactgagcccgagctgcag

SEQ ID NO: 444435 - DNA, 25 bp, Mus musculus
gcagatgactgggaggcaaacaccc

SEQ ID NO: 444436 - DNA, 25 bp, Mus musculus
gcagatgccctgaggcacacatgga

SEQ ID NO: 444437 - DNA, 25 bp, Mus musculus
gcagatgccttgtgctggtgacacc

SEQ ID NO: 444438 - DNA, 25 bp, Mus musculus
gcagatgcgttgcaaaacctggtga

SEQ ID NO: 444439 - DNA, 25 bp, Mus musculus
gcagatgcttgcctagaaactcgga

SEQ ID NO: 444440 - DNA, 25 bp, Mus musculus
gcagatggccaaacaacagcaggag

SEQ ID NO: 444441 - DNA, 25 bp, Mus musculus
gcagatgggaaaagctgaactcgcc

SEQ ID NO: 444442 - DNA, 25 bp, Mus musculus
gcagatgtaccagcacttgaactat

SEQ ID NO: 444443 - DNA, 25 bp, Mus musculus
gcagatgtcatcacaatagcccgat

SEQ ID NO: 444444 - DNA, 25 bp, Mus musculus
gcagatgtcattaaggccgctcacc

SEQ ID NO: 444445 - DNA, 25 bp, Mus musculus
gcagatgtcttaacgccgcggtttt

SEQ ID NO: 444446 - DNA, 25 bp, Mus musculus
gcagatgtcttcctttgcaaacaga

SEQ ID NO: 444447 - DNA, 25 bp, Mus musculus
gcagatgtgagggatgctcaaggct

SEQ ID NO: 444448 - DNA, 25 bp, Mus musculus
gcagatgtggaatggcaacagcaaa

SEQ ID NO: 444449 - DNA, 25 bp, Mus musculus
gcagatgttcttagtcagtgagcca

SEQ ID NO: 444450 - DNA, 25 bp, Mus musculus
gcagatgtttgccattgctgtccca

SEQ ID NO: 444451 - DNA, 25 bp, Mus musculus
gcagattatccaccatggcggccag

SEQ ID NO: 444452 - DNA, 25 bp, Mus musculus
gcagattcaaagtataagcaatggg

SEQ ID NO: 444453 - DNA, 25 bp, Mus musculus
gcagattcagaccttcgaggccaag

SEQ ID NO: 444454 - DNA, 25 bp, Mus musculus
gcagattctgaatcattgagtgcac

SEQ ID NO: 444455 - DNA, 25 bp, Mus musculus
gcagattgctgaatgacacctcggc

SEQ ID NO: 444456 - DNA, 25 bp, Mus musculus
gcagattgctgaccccgggaaacag

SEQ ID NO: 444457 - DNA, 25 bp, Mus musculus
gcagattgtagaaaggcagcctcga

SEQ ID NO: 444458 - DNA, 25 bp, Mus musculus
gcagcaaaacttggtgcttctgaaa

SEQ ID NO: 444459 - DNA, 25 bp, Mus musculus
gcagcaaagatgtaaaggccagact

SEQ ID NO: 444460 - DNA, 25 bp, Mus musculus
gcagcaaagttcatatagcctgaga

SEQ ID NO: 444461 - DNA, 25 bp, Mus musculus
gcagcaaccgaccatccagtaggat

SEQ ID NO: 444462 - DNA, 25 bp, Mus musculus
gcagcaactactacaacagctgaga

SEQ ID NO: 444463 - DNA, 25 bp, Mus musculus
gcagcaactgcgcttaaccgcttaa

SEQ ID NO: 444464 - DNA, 25 bp, Mus musculus
gcagcaagccaagaggttccggcac

SEQ ID NO: 444465 - DNA, 25 bp, Mus musculus
gcagcaagcgagacatcaagaggag

SEQ ID NO: 444466 - DNA, 25 bp, Mus musculus
gcagcaaggactccgagtcaagagt

SEQ ID NO: 444467 - DNA, 25 bp, Mus musculus
gcagcaagggacctaggctaagttt

SEQ ID NO: 444468 - DNA, 25 bp, Mus musculus
gcagcaagtcaaccagcagaggaga

SEQ ID NO: 444469 - DNA, 25 bp, Mus musculus
gcagcaagtgcttcagacccagaga

SEQ ID NO: 444470 - DNA, 25 bp, Mus musculus
gcagcacaagctttatgtcagagca

SEQ ID NO: 444471 - DNA, 25 bp, Mus musculus
gcagcacacttgcaaaagccttcct

SEQ ID NO: 444472 - DNA, 25 bp, Mus musculus
gcagcacagctttatcaggaaaaca

SEQ ID NO: 444473 - DNA, 25 bp, Mus musculus
gcagcacctctcatctggactctgt

SEQ ID NO: 444474 - DNA, 25 bp, Mus musculus
gcagcactgattgcacgaacagcaa

SEQ ID NO: 444475 - DNA, 25 bp, Mus musculus
gcagcactgctctgtactacgccag

SEQ ID NO: 444476 - DNA, 25 bp, Mus musculus
gcagcagacaggtgccaactgagaa

SEQ ID NO: 444477 - DNA, 25 bp, Mus musculus
gcagcagagaatgaattcgtgaccc

SEQ ID NO: 444478 - DNA, 25 bp, Mus musculus
gcagcagagcctagtgggtttactt

SEQ ID NO: 444479 - DNA, 25 bp, Mus musculus
gcagcagcaacaactcaactcgtgg

SEQ ID NO: 444480 - DNA, 25 bp, Mus musculus
gcagcagcactccactatgattggg

SEQ ID NO: 444481 - DNA, 25 bp, Mus musculus
gcagcagccgcttggattcacagta

SEQ ID NO: 444482 - DNA, 25 bp, Mus musculus
gcagcagcctaagtcgtggttacct

SEQ ID NO: 444483 - DNA, 25 bp, Mus musculus
gcagcaggcacagacattatcggta

SEQ ID NO: 444484 - DNA, 25 bp, Mus musculus
gcagcaggctgttagtttctgggca

SEQ ID NO: 444485 - DNA, 25 bp, Mus musculus
gcagcagggcctttcaacactggga

SEQ ID NO: 444486 - DNA, 25 bp, Mus musculus
gcagcaggtctcatccctggcgtca

SEQ ID NO: 444487 - DNA, 25 bp, Mus musculus
gcagcaggtgcacttatacatgaca

SEQ ID NO: 444488 - DNA, 25 bp, Mus musculus
gcagcaggttctggaatccccgaga

SEQ ID NO: 444489 - DNA, 25 bp, Mus musculus
gcagcagtaaaggatggccgcctac

SEQ ID NO: 444490 - DNA, 25 bp, Mus musculus
gcagcagtaccagagcaatccagat

SEQ ID NO: 444491 - DNA, 25 bp, Mus musculus
gcagcagtcatgagcagagattaca

SEQ ID NO: 444492 - DNA, 25 bp, Mus musculus
gcagcagtcccccataagttaactg

SEQ ID NO: 444493 - DNA, 25 bp, Mus musculus
gcagcagtctgttcacttgggcgga

SEQ ID NO: 444494 - DNA, 25 bp, Mus musculus
gcagcagtgcctctaaaattactga

SEQ ID NO: 444495 - DNA, 25 bp, Mus musculus
gcagcagtggtccatctggtaacat

SEQ ID NO: 444496 - DNA, 25 bp, Mus musculus
gcagcagttagcgtcttccgtgcag

SEQ ID NO: 444497 - DNA, 25 bp, Mus musculus
gcagcagttgcactagagaatcctt

SEQ ID NO: 444498 - DNA, 25 bp, Mus musculus
gcagcataaagacagatcgacccag

SEQ ID NO: 444499 - DNA, 25 bp, Mus musculus
gcagcatactgccagaaggtggctc

SEQ ID NO: 444500 - DNA, 25 bp, Mus musculus
gcagcatactttccttcaccgtgta

SEQ ID NO: 444501 - DNA, 25 bp, Mus musculus
gcagcatcatatctggcttaacgga

SEQ ID NO: 444502 - DNA, 25 bp, Mus musculus
gcagcatgatctttattcaggtccc

SEQ ID NO: 444503 - DNA, 25 bp, Mus musculus
gcagcatggcagtgtcacgctacta

SEQ ID NO: 444504 - DNA, 25 bp, Mus musculus
gcagcatgggctttacaaaccctca

SEQ ID NO: 444505 - DNA, 25 bp, Mus musculus
gcagcatgtgtctggtggacttcca

SEQ ID NO: 444506 - DNA, 25 bp, Mus musculus
gcagcattgaaagcatcgtagtcta

SEQ ID NO: 444507 - DNA, 25 bp, Mus musculus
gcagcattgactgtacacccttcag

SEQ ID NO: 444508 - DNA, 25 bp, Mus musculus
gcagcattgtggaaggaatcattcg

SEQ ID NO: 444509 - DNA, 25 bp, Mus musculus
gcagcattgttgaagtcctcaccga

SEQ ID NO: 444510 - DNA, 25 bp, Mus musculus
gcagccaacccgagcagtgatcttt

SEQ ID NO: 444511 - DNA, 25 bp, Mus musculus
gcagccaacttattggcatgatgga

SEQ ID NO: 444512 - DNA, 25 bp, Mus musculus
gcagccaagacatgtctagcccaac

SEQ ID NO: 444513 - DNA, 25 bp, Mus musculus
gcagccaagagatgcggaggacctt

SEQ ID NO: 444514 - DNA, 25 bp, Mus musculus
gcagccacttgtgcaggaccaggta

SEQ ID NO: 444515 - DNA, 25 bp, Mus musculus
gcagccagatttgccagattagcaa

SEQ ID NO: 444516 - DNA, 25 bp, Mus musculus
gcagccagcctgataggtcccacgt

SEQ ID NO: 444517 - DNA, 25 bp, Mus musculus
gcagccagctcatctgacatcagag

SEQ ID NO: 444518 - DNA, 25 bp, Mus musculus
gcagccagtctcgagaccggctgga

SEQ ID NO: 444519 - DNA, 25 bp, Mus musculus
gcagccagtttttgcctgttttaga

SEQ ID NO: 444520 - DNA, 25 bp, Mus musculus
gcagccatataccatgagcgcatcg

SEQ ID NO: 444521 - DNA, 25 bp, Mus musculus
gcagccatcatagcaggtcacgcat

SEQ ID NO: 444522 - DNA, 25 bp, Mus musculus
gcagccatgcctgagcttttatttc

SEQ ID NO: 444523 - DNA, 25 bp, Mus musculus
gcagccatggttacagcacaagtta

SEQ ID NO: 444524 - DNA, 25 bp, Mus musculus
gcagccatgtcctgaaatcatcact

SEQ ID NO: 444525 - DNA, 25 bp, Mus musculus
gcagccattcccagcaaagtaacgt

SEQ ID NO: 444526 - DNA, 25 bp, Mus musculus
gcagccattgccaatcactgcttca

SEQ ID NO: 444527 - DNA, 25 bp, Mus musculus
gcagccatttcaagcatgcaggaag

SEQ ID NO: 444528 - DNA, 25 bp, Mus musculus
gcagcccacctgtgcaatcatagga

SEQ ID NO: 444529 - DNA, 25 bp, Mus musculus
gcagcccactgtctgctgtggcagt

SEQ ID NO: 444530 - DNA, 25 bp, Mus musculus
gcagcccactttggcctctggagga

SEQ ID NO: 444531 - DNA, 25 bp, Mus musculus
gcagcccagaggtaccagtatgcct

SEQ ID NO: 444532 - DNA, 25 bp, Mus musculus
gcagcccagatgaggaccacttcat

SEQ ID NO: 444533 - DNA, 25 bp, Mus musculus
gcagcccagcggtttccccaaggaa

SEQ ID NO: 444534 - DNA, 25 bp, Mus musculus
gcagcccaggttcgcttgagtccgc

SEQ ID NO: 444535 - DNA, 25 bp, Mus musculus
gcagcccagtattaactgttcagaa

SEQ ID NO: 444536 - DNA, 25 bp, Mus musculus
gcagcccctcaaccccattatttat

SEQ ID NO: 444537 - DNA, 25 bp, Mus musculus
gcagccccttgtggaaagcatggat

SEQ ID NO: 444538 - DNA, 25 bp, Mus musculus
gcagcccgaagattcaccatggtga

SEQ ID NO: 444539 - DNA, 25 bp, Mus musculus
gcagcccgagcgtttggagagtacc

SEQ ID NO: 444540 - DNA, 25 bp, Mus musculus
gcagccctagcccaagttgctggaa

SEQ ID NO: 444541 - DNA, 25 bp, Mus musculus
gcagccctctggaacatggcactgt

SEQ ID NO: 444542 - DNA, 25 bp, Mus musculus
gcagccctggaagcactagatgaat

SEQ ID NO: 444543 - DNA, 25 bp, Mus musculus
gcagccctgtgattcgttttccaca

SEQ ID NO: 444544 - DNA, 25 bp, Mus musculus
gcagccgagaacgtaacccggcggt

SEQ ID NO: 444545 - DNA, 25 bp, Mus musculus
gcagccgaggtttttagcttaaaca

SEQ ID NO: 444546 - DNA, 25 bp, Mus musculus
gcagccggaaacaaggaggcctcgt

SEQ ID NO: 444547 - DNA, 25 bp, Mus musculus
gcagccgtgagccacctagcctgaa

SEQ ID NO: 444548 - DNA, 25 bp, Mus musculus
gcagcctaagttgagacatggccac

SEQ ID NO: 444549 - DNA, 25 bp, Mus musculus
gcagcctacttacccagtgcttctt

SEQ ID NO: 444550 - DNA, 25 bp, Mus musculus
gcagcctatctagagttgatccaag

SEQ ID NO: 444551 - DNA, 25 bp, Mus musculus
gcagcctatgtgcaaacccagagga

SEQ ID NO: 444552 - DNA, 25 bp, Mus musculus
gcagcctcaggaactaccttgtaaa

SEQ ID NO: 444553 - DNA, 25 bp, Mus musculus
gcagcctcccttcataatgtgagca

SEQ ID NO: 444554 - DNA, 25 bp, Mus musculus
gcagcctctgcaatgagaaattcgg

SEQ ID NO: 444555 - DNA, 25 bp, Mus musculus
gcagcctctgctgtagaatttatat

SEQ ID NO: 444556 - DNA, 25 bp, Mus musculus
gcagcctgcattgcttcataataca

SEQ ID NO: 444557 - DNA, 25 bp, Mus musculus
gcagcctgcgccattacctgtatct

SEQ ID NO: 444558 - DNA, 25 bp, Mus musculus
gcagcctgcgggaagaccaataaat

SEQ ID NO: 444559 - DNA, 25 bp, Mus musculus
gcagcctggccatagcactttctgg

SEQ ID NO: 444560 - DNA, 25 bp, Mus musculus
gcagcctgggtgattctcaaagaca

SEQ ID NO: 444561 - DNA, 25 bp, Mus musculus
gcagcctgtatgtcttgggaaccca

SEQ ID NO: 444562 - DNA, 25 bp, Mus musculus
gcagcctgtccttgagtcaccagag

SEQ ID NO: 444563 - DNA, 25 bp, Mus musculus
gcagcctgtgtgttctggtcacgag

SEQ ID NO: 444564 - DNA, 25 bp, Mus musculus
gcagccttgggttgctgagctcaca

SEQ ID NO: 444565 - DNA, 25 bp, Mus musculus
gcagcctttggctctctcacaggga

SEQ ID NO: 444566 - DNA, 25 bp, Mus musculus
gcagcgaaatgtagcagccttggcc

SEQ ID NO: 444567 - DNA, 25 bp, Mus musculus
gcagcgactgcattgtggtggacac

SEQ ID NO: 444568 - DNA, 25 bp, Mus musculus
gcagcgagactacccttccagggtg

SEQ ID NO: 444569 - DNA, 25 bp, Mus musculus
gcagcgagccccacaacgcgagagg

SEQ ID NO: 444570 - DNA, 25 bp, Mus musculus
gcagcgcaaagcaaaggaagccaca

SEQ ID NO: 444571 - DNA, 25 bp, Mus musculus
gcagcgcaactttcagatagcggag

SEQ ID NO: 444572 - DNA, 25 bp, Mus musculus
gcagcgcaaggagaaagagctcact

SEQ ID NO: 444573 - DNA, 25 bp, Mus musculus
gcagcgcacagccacatttattgtt

SEQ ID NO: 444574 - DNA, 25 bp, Mus musculus
gcagcgcaggcacacaaggttgatc

SEQ ID NO: 444575 - DNA, 25 bp, Mus musculus
gcagcgcatgaagctaatagcggct

SEQ ID NO: 444576 - DNA, 25 bp, Mus musculus
gcagcgccaattactgtgtgctgga

SEQ ID NO: 444577 - DNA, 25 bp, Mus musculus
gcagcgccacaaagtcttcgagaag

SEQ ID NO: 444578 - DNA, 25 bp, Mus musculus
gcagcgccacgatcttccttgagga

SEQ ID NO: 444579 - DNA, 25 bp, Mus musculus
gcagcgcctcttgacctacatggta

SEQ ID NO: 444580 - DNA, 25 bp, Mus musculus
gcagcgcgcgcttttcgcagtgtta

SEQ ID NO: 444581 - DNA, 25 bp, Mus musculus
gcagcgcttgttagcaccctagggt

SEQ ID NO: 444582 - DNA, 25 bp, Mus musculus
gcagcgcttgttctgacaatgacag

SEQ ID NO: 444583 - DNA, 25 bp, Mus musculus
gcagcggatccctgtactgaatgaa

SEQ ID NO: 444584 - DNA, 25 bp, Mus musculus
gcagcggccgatcttccactgttct

SEQ ID NO: 444585 - DNA, 25 bp, Mus musculus
gcagcggcgggagctttttaccagc

SEQ ID NO: 444586 - DNA, 25 bp, Mus musculus
gcagcggcggtgtttgatttttcac

SEQ ID NO: 444587 - DNA, 25 bp, Mus musculus
gcagcggctcatcaatatccaagat

SEQ ID NO: 444588 - DNA, 25 bp, Mus musculus
gcagcgggtttcgagtaggtttcta

SEQ ID NO: 444589 - DNA, 25 bp, Mus musculus
gcagcggtactatcgactttgaaga

SEQ ID NO: 444590 - DNA, 25 bp, Mus musculus
gcagcggtgcgcatagcagcaaatt

SEQ ID NO: 444591 - DNA, 25 bp, Mus musculus
gcagcgtcagagtggtgctcccgct

SEQ ID NO: 444592 - DNA, 25 bp, Mus musculus
gcagcgtcagattcaacgcgcgcct

SEQ ID NO: 444593 - DNA, 25 bp, Mus musculus
gcagcgtctgttttcggagcctcca

SEQ ID NO: 444594 - DNA, 25 bp, Mus musculus
gcagcgtgcatcctgaacttccaga

SEQ ID NO: 444595 - DNA, 25 bp, Mus musculus
gcagcgttcagtttcagcccgagtg

SEQ ID NO: 444596 - DNA, 25 bp, Mus musculus
gcagcgttcgcttcacagtggagaa

SEQ ID NO: 444597 - DNA, 25 bp, Mus musculus
gcagcgttttatcactccttaggaa

SEQ ID NO: 444598 - DNA, 25 bp, Mus musculus
gcagctaaaatctgggcttagtacg

SEQ ID NO: 444599 - DNA, 25 bp, Mus musculus
gcagctaaaggagcttgcttcaaag

SEQ ID NO: 444600 - DNA, 25 bp, Mus musculus
gcagctaacatctgggcttacggag

SEQ ID NO: 444601 - DNA, 25 bp, Mus musculus
gcagctaatgaaggtgaataacaac

SEQ ID NO: 444602 - DNA, 25 bp, Mus musculus
gcagctaattgcgaagtcccagtta

SEQ ID NO: 444603 - DNA, 25 bp, Mus musculus
gcagctagtgctggcttcatacccg

SEQ ID NO: 444604 - DNA, 25 bp, Mus musculus
gcagctatatctctgggatgccaga

SEQ ID NO: 444605 - DNA, 25 bp, Mus musculus
gcagctattccacatgccgcagaag

SEQ ID NO: 444606 - DNA, 25 bp, Mus musculus
gcagctattggcatcggcatcgtta

SEQ ID NO: 444607 - DNA, 25 bp, Mus musculus
gcagctcaacaagcagcgggtctgg

SEQ ID NO: 444608 - DNA, 25 bp, Mus musculus
gcagctcaagcaggtcatcgacact

SEQ ID NO: 444609 - DNA, 25 bp, Mus musculus
gcagctcccgaaaaagatgtcgcag

SEQ ID NO: 444610 - DNA, 25 bp, Mus musculus
gcagctcccggaaagtaaggacgcc

SEQ ID NO: 444611 - DNA, 25 bp, Mus musculus
gcagctccgggctgccagtgtcaca

SEQ ID NO: 444612 - DNA, 25 bp, Mus musculus
gcagctccttctcatctcatcgttg

SEQ ID NO: 444613 - DNA, 25 bp, Mus musculus
gcagctccttgatggacctgagtcc

SEQ ID NO: 444614 - DNA, 25 bp, Mus musculus
gcagctctcaggtcacgtggcctgg

SEQ ID NO: 444615 - DNA, 25 bp, Mus musculus
gcagctctcctgatactcgcggtga

SEQ ID NO: 444616 - DNA, 25 bp, Mus musculus
gcagctctggtacactcctgttgaa

SEQ ID NO: 444617 - DNA, 25 bp, Mus musculus
gcagctctttgcgatttcttattta

SEQ ID NO: 444618 - DNA, 25 bp, Mus musculus
gcagctgaacgggactcaacgggtt

SEQ ID NO: 444619 - DNA, 25 bp, Mus musculus
gcagctgagttctataaagaggccc

SEQ ID NO: 444620 - DNA, 25 bp, Mus musculus
gcagctgatgatggccagagcacta

SEQ ID NO: 444621 - DNA, 25 bp, Mus musculus
gcagctgcaaccaggagtccctgat

SEQ ID NO: 444622 - DNA, 25 bp, Mus musculus
gcagctgccggaacaagtaggaaga

SEQ ID NO: 444623 - DNA, 25 bp, Mus musculus
gcagctgcgtgacttttaccggccc

SEQ ID NO: 444624 - DNA, 25 bp, Mus musculus
gcagctgctccatccataggttcta

SEQ ID NO: 444625 - DNA, 25 bp, Mus musculus
gcagctgctgacgatcttccgggaa

SEQ ID NO: 444626 - DNA, 25 bp, Mus musculus
gcagctgcttcatctagggtgttta

SEQ ID NO: 444627 - DNA, 25 bp, Mus musculus
gcagctgcttggtcatgtgtggtca

SEQ ID NO: 444628 - DNA, 25 bp, Mus musculus
gcagctggacagacccagccatcat

SEQ ID NO: 444629 - DNA, 25 bp, Mus musculus
gcagctggacccgaatatccctgga

SEQ ID NO: 444630 - DNA, 25 bp, Mus musculus
gcagctggacgcataccggaatgag

SEQ ID NO: 444631 - DNA, 25 bp, Mus musculus
gcagctggagcgtttactttaggcc

SEQ ID NO: 444632 - DNA, 25 bp, Mus musculus
gcagctggcactagtttggaccgac

SEQ ID NO: 444633 - DNA, 25 bp, Mus musculus
gcagctggcaggagtgcaacaagaa

SEQ ID NO: 444634 - DNA, 25 bp, Mus musculus
gcagctggccatcgatctgagcaaa

SEQ ID NO: 444635 - DNA, 25 bp, Mus musculus
gcagctgggctctctagactctgag

SEQ ID NO: 444636 - DNA, 25 bp, Mus musculus
gcagctggtcgagaaaccaaatacg

SEQ ID NO: 444637 - DNA, 25 bp, Mus musculus
gcagctgtcaagagcggcagactat

SEQ ID NO: 444638 - DNA, 25 bp, Mus musculus
gcagctgtcttgctccttactaagg

SEQ ID NO: 444639 - DNA, 25 bp, Mus musculus
gcagctgtgtcaccgctccagactt

SEQ ID NO: 444640 - DNA, 25 bp, Mus musculus
gcagcttaaaggaccaccagaggaa

SEQ ID NO: 444641 - DNA, 25 bp, Mus musculus
gcagcttacaaagggtgggctcact

SEQ ID NO: 444642 - DNA, 25 bp, Mus musculus
gcagcttcaaaaggccagatggcga

SEQ ID NO: 444643 - DNA, 25 bp, Mus musculus
gcagcttcctgaggtaccaagggag

SEQ ID NO: 444644 - DNA, 25 bp, Mus musculus
gcagcttcctgtggttatctcaaca

SEQ ID NO: 444645 - DNA, 25 bp, Mus musculus
gcagcttcggctcttcccgtgatcg

SEQ ID NO: 444646 - DNA, 25 bp, Mus musculus
gcagcttgacggatagtggcatcca

SEQ ID NO: 444647 - DNA, 25 bp, Mus musculus
gcagcttgagcatgagagccgccta

SEQ ID NO: 444648 - DNA, 25 bp, Mus musculus
gcagcttgcagcagtaacaacccgg

SEQ ID NO: 444649 - DNA, 25 bp, Mus musculus
gcagcttgcagccattgtaccgaaa

SEQ ID NO: 444650 - DNA, 25 bp, Mus musculus
gcagcttgcatatcacgagggccat

SEQ ID NO: 444651 - DNA, 25 bp, Mus musculus
gcagcttggaacagggactttggca

SEQ ID NO: 444652 - DNA, 25 bp, Mus musculus
gcagctttaccgagccaatccagga

SEQ ID NO: 444653 - DNA, 25 bp, Mus musculus
gcagctttgaacacggcgccctacg

SEQ ID NO: 444654 - DNA, 25 bp, Mus musculus
gcagctttgacctgtcattccagcg

SEQ ID NO: 444655 - DNA, 25 bp, Mus musculus
gcagctttggaaacaccatgtctga

SEQ ID NO: 444656 - DNA, 25 bp, Mus musculus
gcagcttttacaattcaggcagcag

SEQ ID NO: 444657 - DNA, 25 bp, Mus musculus
gcagcttttccctctaaatgataca

SEQ ID NO: 444658 - DNA, 25 bp, Mus musculus
gcagcttttccttcatgagtcagag

SEQ ID NO: 444659 - DNA, 25 bp, Mus musculus
gcagcttttggaacgacgccttcga

SEQ ID NO: 444660 - DNA, 25 bp, Mus musculus
gcaggaaaagctaataaaagctctg

SEQ ID NO: 444661 - DNA, 25 bp, Mus musculus
gcaggaaaggcaaggtacagtctat

SEQ ID NO: 444662 - DNA, 25 bp, Mus musculus
gcaggaacaggatgtgactctactt

SEQ ID NO: 444663 - DNA, 25 bp, Mus musculus
gcaggaactcaaactcccacaggag

SEQ ID NO: 444664 - DNA, 25 bp, Mus musculus
gcaggaactcaaggatggcgtcatc

SEQ ID NO: 444665 - DNA, 25 bp, Mus musculus
gcaggaagacccttgtgtatgtaac

SEQ ID NO: 444666 - DNA, 25 bp, Mus musculus
gcaggaagcccagtaaagttgatat

SEQ ID NO: 444667 - DNA, 25 bp, Mus musculus
gcaggaatccgagagggtttatgaa

SEQ ID NO: 444668 - DNA, 25 bp, Mus musculus
gcaggaatgcagtccgcctgactca

SEQ ID NO: 444669 - DNA, 25 bp, Mus musculus
gcaggacacctgcttagtgaataag

SEQ ID NO: 444670 - DNA, 25 bp, Mus musculus
gcaggacagcgatcatggaactcga

SEQ ID NO: 444671 - DNA, 25 bp, Mus musculus
gcaggacaggtcgagtctccagccg

SEQ ID NO: 444672 - DNA, 25 bp, Mus musculus
gcaggacatgcatgccaaagggaca

SEQ ID NO: 444673 - DNA, 25 bp, Mus musculus
gcaggaccagaaaaggacaggttcc

SEQ ID NO: 444674 - DNA, 25 bp, Mus musculus
gcaggaccccatagcagcaaactgt

SEQ ID NO: 444675 - DNA, 25 bp, Mus musculus
gcaggacgggatactttaaagaaca

SEQ ID NO: 444676 - DNA, 25 bp, Mus musculus
gcaggacgggctaagggcacttcta

SEQ ID NO: 444677 - DNA, 25 bp, Mus musculus
gcaggacggtgtctcatcacaagcc

SEQ ID NO: 444678 - DNA, 25 bp, Mus musculus
gcaggacgtgcccagtaacaaggat

SEQ ID NO: 444679 - DNA, 25 bp, Mus musculus
gcaggactcccatcaggcatatcca

SEQ ID NO: 444680 - DNA, 25 bp, Mus musculus
gcaggactcgtatggcggtgacttt

SEQ ID NO: 444681 - DNA, 25 bp, Mus musculus
gcaggagagccaaccttctattaga

SEQ ID NO: 444682 - DNA, 25 bp, Mus musculus
gcaggagcagaagaacgtaccagga

SEQ ID NO: 444683 - DNA, 25 bp, Mus musculus
gcaggagcgataccacagtttagcc

SEQ ID NO: 444684 - DNA, 25 bp, Mus musculus
gcaggagctactgaacgattacaga

SEQ ID NO: 444685 - DNA, 25 bp, Mus musculus
gcaggagcttgatgacctaatgcag

SEQ ID NO: 444686 - DNA, 25 bp, Mus musculus
gcaggaggccaaaaagctaaagctt

SEQ ID NO: 444687 - DNA, 25 bp, Mus musculus
gcaggagggaacacatggagcacct

SEQ ID NO: 444688 - DNA, 25 bp, Mus musculus
gcaggagggcaataaaccgaatcac

SEQ ID NO: 444689 - DNA, 25 bp, Mus musculus
gcaggagtacgtgcttaacgacagt

SEQ ID NO: 444690 - DNA, 25 bp, Mus musculus
gcaggagtcttcatggcagttacca

SEQ ID NO: 444691 - DNA, 25 bp, Mus musculus
gcaggagttagttagcaaagagcag

SEQ ID NO: 444692 - DNA, 25 bp, Mus musculus
gcaggataggttaaccccaaagaca

SEQ ID NO: 444693 - DNA, 25 bp, Mus musculus
gcaggatcccacataaccagacgta

SEQ ID NO: 444694 - DNA, 25 bp, Mus musculus
gcaggatcctttgctgcttgagcaa

SEQ ID NO: 444695 - DNA, 25 bp, Mus musculus
gcaggatgcttgtgaatgtgagcct

SEQ ID NO: 444696 - DNA, 25 bp, Mus musculus
gcaggattcagagtcagcaagtgat

SEQ ID NO: 444697 - DNA, 25 bp, Mus musculus
gcaggcaaatcctcatgacaccgag

SEQ ID NO: 444698 - DNA, 25 bp, Mus musculus
gcaggcaagttccaacctctgctgc

SEQ ID NO: 444699 - DNA, 25 bp, Mus musculus
gcaggcaatctgagttcaggctctt

SEQ ID NO: 444700 - DNA, 25 bp, Mus musculus
gcaggcagcatttccgttagcggcg

SEQ ID NO: 444701 - DNA, 25 bp, Mus musculus
gcaggcagccatggtcctgatcgca

SEQ ID NO: 444702 - DNA, 25 bp, Mus musculus
gcaggcatcagacggcattcatcac

SEQ ID NO: 444703 - DNA, 25 bp, Mus musculus
gcaggcatgcatccagttttccgaa

SEQ ID NO: 444704 - DNA, 25 bp, Mus musculus
gcaggcatggcataccacggcctta

SEQ ID NO: 444705 - DNA, 25 bp, Mus musculus
gcaggcatttaagggagctccttgg

SEQ ID NO: 444706 - DNA, 25 bp, Mus musculus
gcaggccacaagacggcaggttcag

SEQ ID NO: 444707 - DNA, 25 bp, Mus musculus
gcaggccagcatagagatcgactcg

SEQ ID NO: 444708 - DNA, 25 bp, Mus musculus
gcaggccaggtgaacatatacagct

SEQ ID NO: 444709 - DNA, 25 bp, Mus musculus
gcaggccatcctggatccggagctg

SEQ ID NO: 444710 - DNA, 25 bp, Mus musculus
gcaggccgagaaggcactctgactg

SEQ ID NO: 444711 - DNA, 25 bp, Mus musculus
gcaggccgaggactttcatccagag

SEQ ID NO: 444712 - DNA, 25 bp, Mus musculus
gcaggccgcagtgttcaagttccca

SEQ ID NO: 444713 - DNA, 25 bp, Mus musculus
gcaggcctccaggatccaaatggga

SEQ ID NO: 444714 - DNA, 25 bp, Mus musculus
gcaggcctcctcagaaacaaactta

SEQ ID NO: 444715 - DNA, 25 bp, Mus musculus
gcaggcctctagcacgttaacaacg

SEQ ID NO: 444716 - DNA, 25 bp, Mus musculus
gcaggcctggtgtggtctccaaagc

SEQ ID NO: 444717 - DNA, 25 bp, Mus musculus
gcaggcctgttttatcaagtagtca

SEQ ID NO: 444718 - DNA, 25 bp, Mus musculus
gcaggccttaatggtagtgcatcct

SEQ ID NO: 444719 - DNA, 25 bp, Mus musculus
gcaggccttagcgtgagtgatcact

SEQ ID NO: 444720 - DNA, 25 bp, Mus musculus
gcaggccttccgcagtggagcctct

SEQ ID NO: 444721 - DNA, 25 bp, Mus musculus
gcaggccttgcatcgtactctgagg

SEQ ID NO: 444722 - DNA, 25 bp, Mus musculus
gcaggcctttcatggagtacaacaa

SEQ ID NO: 444723 - DNA, 25 bp, Mus musculus
gcaggcgcagggaaggatccgtttt

SEQ ID NO: 444724 - DNA, 25 bp, Mus musculus
gcaggcgccacctcatcaggattgt

SEQ ID NO: 444725 - DNA, 25 bp, Mus musculus
gcaggcgcgagccatggagggcaac

SEQ ID NO: 444726 - DNA, 25 bp, Mus musculus
gcaggcgctatggaaatggtcaccg

SEQ ID NO: 444727 - DNA, 25 bp, Mus musculus
gcaggcgctcagatcaagactgtcg

SEQ ID NO: 444728 - DNA, 25 bp, Mus musculus
gcaggcgtgcctgtcaagactaact

SEQ ID NO: 444729 - DNA, 25 bp, Mus musculus
gcaggctagcccagtcgcatttaaa

SEQ ID NO: 444730 - DNA, 25 bp, Mus musculus
gcaggcttaccaaccagagcagtga

SEQ ID NO: 444731 - DNA, 25 bp, Mus musculus
gcaggcttctccaccagcattgctg

SEQ ID NO: 444732 - DNA, 25 bp, Mus musculus
gcaggcttctgagagatgactagga

SEQ ID NO: 444733 - DNA, 25 bp, Mus musculus
gcaggcttctggagtcagccccggg

SEQ ID NO: 444734 - DNA, 25 bp, Mus musculus
gcagggaaaactacaactaagtgat

SEQ ID NO: 444735 - DNA, 25 bp, Mus musculus
gcagggacccagtggtaatctgttt

SEQ ID NO: 444736 - DNA, 25 bp, Mus musculus
gcagggaggttttgagtacaacctg

SEQ ID NO: 444737 - DNA, 25 bp, Mus musculus
gcagggagtctttaccctgacgcct

SEQ ID NO: 444738 - DNA, 25 bp, Mus musculus
gcagggataccactcctatagatta

SEQ ID NO: 444739 - DNA, 25 bp, Mus musculus
gcagggattcaaagcatagctagga

SEQ ID NO: 444740 - DNA, 25 bp, Mus musculus
gcagggattcccacaaggttgacaa

SEQ ID NO: 444741 - DNA, 25 bp, Mus musculus
gcagggattcctgtcaaactgtgaa

SEQ ID NO: 444742 - DNA, 25 bp, Mus musculus
gcagggcagccttctagagactaga

SEQ ID NO: 444743 - DNA, 25 bp, Mus musculus
gcagggcaggcacaattattacatc

SEQ ID NO: 444744 - DNA, 25 bp, Mus musculus
gcagggcatagtagtagctgccaag

SEQ ID NO: 444745 - DNA, 25 bp, Mus musculus
gcagggcccatatttgtcttcaggg

SEQ ID NO: 444746 - DNA, 25 bp, Mus musculus
gcagggctccctcttaagttactgg

SEQ ID NO: 444747 - DNA, 25 bp, Mus musculus
gcagggctgaaggtcactccagctg

SEQ ID NO: 444748 - DNA, 25 bp, Mus musculus
gcagggctggaaagaactttacaaa

SEQ ID NO: 444749 - DNA, 25 bp, Mus musculus
gcagggtaccgcgtgagttgaaaca

SEQ ID NO: 444750 - DNA, 25 bp, Mus musculus
gcagggtagccctaagcacggaatg

SEQ ID NO: 444751 - DNA, 25 bp, Mus musculus
gcagggtagccgaaacacacgaatt

SEQ ID NO: 444752 - DNA, 25 bp, Mus musculus
gcagggtagggtgcctcattcctct

SEQ ID NO: 444753 - DNA, 25 bp, Mus musculus
gcagggtgtaagaagagtcacaaga

SEQ ID NO: 444754 - DNA, 25 bp, Mus musculus
gcagggtttaagataacagaagctt

SEQ ID NO: 444755 - DNA, 25 bp, Mus musculus
gcagggtttcttaggttcaggcaga

SEQ ID NO: 444756 - DNA, 25 bp, Mus musculus
gcagggtttgtgtcgccagcagccc

SEQ ID NO: 444757 - DNA, 25 bp, Mus musculus
gcaggtaacttatccgcagctcagt

SEQ ID NO: 444758 - DNA, 25 bp, Mus musculus
gcaggtaaggcctttgtacagaggc

SEQ ID NO: 444759 - DNA, 25 bp, Mus musculus
gcaggtaatcttcacatgttcttat

SEQ ID NO: 444760 - DNA, 25 bp, Mus musculus
gcaggtagagcccttctccctagtc

SEQ ID NO: 444761 - DNA, 25 bp, Mus musculus
gcaggtatcacagtccgcatggtca

SEQ ID NO: 444762 - DNA, 25 bp, Mus musculus
gcaggtatccatgcggtgagatact

SEQ ID NO: 444763 - DNA, 25 bp, Mus musculus
gcaggtcacgagaaaggaccacaat

SEQ ID NO: 444764 - DNA, 25 bp, Mus musculus
gcaggtcatgcacactcgaaataaa

SEQ ID NO: 444765 - DNA, 25 bp, Mus musculus
gcaggtccaggctgactagagagct

SEQ ID NO: 444766 - DNA, 25 bp, Mus musculus
gcaggtccctgagcatgctaagcag

SEQ ID NO: 444767 - DNA, 25 bp, Mus musculus
gcaggtccgcccaattaaagcagtc

SEQ ID NO: 444768 - DNA, 25 bp, Mus musculus
gcaggtcctcctctcgctggtagaa

SEQ ID NO: 444769 - DNA, 25 bp, Mus musculus
gcaggtccttgtctctcatgtatga

SEQ ID NO: 444770 - DNA, 25 bp, Mus musculus
gcaggtccttttttcaaccagcagg

SEQ ID NO: 444771 - DNA, 25 bp, Mus musculus
gcaggtcgcctctccgcgagttgga

SEQ ID NO: 444772 - DNA, 25 bp, Mus musculus
gcaggtcggataactcggcaggaaa

SEQ ID NO: 444773 - DNA, 25 bp, Mus musculus
gcaggtctacctggccagcatgtgg

SEQ ID NO: 444774 - DNA, 25 bp, Mus musculus
gcaggtgactgccacgactcctgag

SEQ ID NO: 444775 - DNA, 25 bp, Mus musculus
gcaggtgatgtttttgcaaagagca

SEQ ID NO: 444776 - DNA, 25 bp, Mus musculus
gcaggtgccacacgctatgctctct

SEQ ID NO: 444777 - DNA, 25 bp, Mus musculus
gcaggtgcgctcatggtgtatgaca

SEQ ID NO: 444778 - DNA, 25 bp, Mus musculus
gcaggtggatccaatgatgctttca

SEQ ID NO: 444779 - DNA, 25 bp, Mus musculus
gcaggtgtcccaaagaagctgtagt

SEQ ID NO: 444780 - DNA, 25 bp, Mus musculus
gcaggtgtcttagtggttaaaaaca

SEQ ID NO: 444781 - DNA, 25 bp, Mus musculus
gcaggtgttccctgtggccacacaa

SEQ ID NO: 444782 - DNA, 25 bp, Mus musculus
gcaggtgttgctgtctcccaagagc

SEQ ID NO: 444783 - DNA, 25 bp, Mus musculus
gcaggttaagcccattttccgagag

SEQ ID NO: 444784 - DNA, 25 bp, Mus musculus
gcaggttatagccaaggtgcaacac

SEQ ID NO: 444785 - DNA, 25 bp, Mus musculus
gcaggttgacttagctacttcggcc

SEQ ID NO: 444786 - DNA, 25 bp, Mus musculus
gcaggtttctcggtcatacatggtc

SEQ ID NO: 444787 - DNA, 25 bp, Mus musculus
gcaggttttcccacatgtcagaaca

SEQ ID NO: 444788 - DNA, 25 bp, Mus musculus
gcagtaaaagccaagtcgtgcccca

SEQ ID NO: 444789 - DNA, 25 bp, Mus musculus
gcagtaacccagcttgcatctgaga

SEQ ID NO: 444790 - DNA, 25 bp, Mus musculus
gcagtaaccgtttacagaagcaact

SEQ ID NO: 444791 - DNA, 25 bp, Mus musculus
gcagtaaggcccagttcctcaggag

SEQ ID NO: 444792 - DNA, 25 bp, Mus musculus
gcagtaataagttccatgattccgg

SEQ ID NO: 444793 - DNA, 25 bp, Mus musculus
gcagtacaaaaatcgccaggccata

SEQ ID NO: 444794 - DNA, 25 bp, Mus musculus
gcagtaccatccgttgggagtcatg

SEQ ID NO: 444795 - DNA, 25 bp, Mus musculus
gcagtactcttgtaaaacctacagg

SEQ ID NO: 444796 - DNA, 25 bp, Mus musculus
gcagtagaaacctgtaccacatgta

SEQ ID NO: 444797 - DNA, 25 bp, Mus musculus
gcagtagaaccttgtcatttttaga

SEQ ID NO: 444798 - DNA, 25 bp, Mus musculus
gcagtagcattgcagcgtcctccag

SEQ ID NO: 444799 - DNA, 25 bp, Mus musculus
gcagtagcccagtataccttcaagg

SEQ ID NO: 444800 - DNA, 25 bp, Mus musculus
gcagtagtgccaatgtccggagacc

SEQ ID NO: 444801 - DNA, 25 bp, Mus musculus
gcagtataaccaagtccccagtgaa

SEQ ID NO: 444802 - DNA, 25 bp, Mus musculus
gcagtatagataaggctggccctga

SEQ ID NO: 444803 - DNA, 25 bp, Mus musculus
gcagtatcaccacccaagaattggg

SEQ ID NO: 444804 - DNA, 25 bp, Mus musculus
gcagtatcctactcctgaagcgtca

SEQ ID NO: 444805 - DNA, 25 bp, Mus musculus
gcagtatgctacagcttgagcccag

SEQ ID NO: 444806 - DNA, 25 bp, Mus musculus
gcagtattagctttatcgtcaaggt

SEQ ID NO: 444807 - DNA, 25 bp, Mus musculus
gcagtattcaagcagagatcttccc

SEQ ID NO: 444808 - DNA, 25 bp, Mus musculus
gcagtcaatcatgcttgtcaacata

SEQ ID NO: 444809 - DNA, 25 bp, Mus musculus
gcagtcagctgcaaacattaatgaa

SEQ ID NO: 444810 - DNA, 25 bp, Mus musculus
gcagtcagtttttgtctagagctca

SEQ ID NO: 444811 - DNA, 25 bp, Mus musculus
gcagtcatgtcttagtatcaattat

SEQ ID NO: 444812 - DNA, 25 bp, Mus musculus
gcagtccacactagtgctctaggga

SEQ ID NO: 444813 - DNA, 25 bp, Mus musculus
gcagtccacttcacaagactctgaa

SEQ ID NO: 444814 - DNA, 25 bp, Mus musculus
gcagtccagagagtacagtaaccac

SEQ ID NO: 444815 - DNA, 25 bp, Mus musculus
gcagtccagccaaggtgtggaccat

SEQ ID NO: 444816 - DNA, 25 bp, Mus musculus
gcagtccatgcataagtacaacccc

SEQ ID NO: 444817 - DNA, 25 bp, Mus musculus
gcagtccattttgaaacgaacaagg

SEQ ID NO: 444818 - DNA, 25 bp, Mus musculus
gcagtcccaccggtcaaagtctatg

SEQ ID NO: 444819 - DNA, 25 bp, Mus musculus
gcagtcccctttggcggagcgtttt

SEQ ID NO: 444820 - DNA, 25 bp, Mus musculus
gcagtccctggacgcagacaatgga

SEQ ID NO: 444821 - DNA, 25 bp, Mus musculus
gcagtccgtggagggtgacatcaat

SEQ ID NO: 444822 - DNA, 25 bp, Mus musculus
gcagtcctgattactactgttgcta

SEQ ID NO: 444823 - DNA, 25 bp, Mus musculus
gcagtcgcccttagcaaatatttgt

SEQ ID NO: 444824 - DNA, 25 bp, Mus musculus
gcagtcgggctgttgttctgagcaa

SEQ ID NO: 444825 - DNA, 25 bp, Mus musculus
gcagtctaagactagtgagcagtct

SEQ ID NO: 444826 - DNA, 25 bp, Mus musculus
gcagtctctatcaactgagctccag

SEQ ID NO: 444827 - DNA, 25 bp, Mus musculus
gcagtctctcttgtacccggatgaa

SEQ ID NO: 444828 - DNA, 25 bp, Mus musculus
gcagtctgcacccacataagctaag

SEQ ID NO: 444829 - DNA, 25 bp, Mus musculus
gcagtctgccatccccagggtgtgt

SEQ ID NO: 444830 - DNA, 25 bp, Mus musculus
gcagtctgcggccttggattctccc

SEQ ID NO: 444831 - DNA, 25 bp, Mus musculus
gcagtctgtactcttcatggatgaa

SEQ ID NO: 444832 - DNA, 25 bp, Mus musculus
gcagtcttcaaatcccaaatgagta

SEQ ID NO: 444833 - DNA, 25 bp, Mus musculus
gcagtcttcagctgtgaggcccaca

SEQ ID NO: 444834 - DNA, 25 bp, Mus musculus
gcagtcttctgagcctgagttgcag

SEQ ID NO: 444835 - DNA, 25 bp, Mus musculus
gcagtcttggtagacgagcccctta

SEQ ID NO: 444836 - DNA, 25 bp, Mus musculus
gcagtgaaacctctgcaaattcaaa

SEQ ID NO: 444837 - DNA, 25 bp, Mus musculus
gcagtgaacagcctccataggcaca

SEQ ID NO: 444838 - DNA, 25 bp, Mus musculus
gcagtgaactgagtagcccaggcca

SEQ ID NO: 444839 - DNA, 25 bp, Mus musculus
gcagtgaagcacaacatccgaggca

SEQ ID NO: 444840 - DNA, 25 bp, Mus musculus
gcagtgaatacatcaccccaatcct

SEQ ID NO: 444841 - DNA, 25 bp, Mus musculus
gcagtgaccactttaggccgtaggg

SEQ ID NO: 444842 - DNA, 25 bp, Mus musculus
gcagtgactcagacgatctggaaga

SEQ ID NO: 444843 - DNA, 25 bp, Mus musculus
gcagtgactgtttcatcgtgtgact

SEQ ID NO: 444844 - DNA, 25 bp, Mus musculus
gcagtgatccattgcagtgcgggca

SEQ ID NO: 444845 - DNA, 25 bp, Mus musculus
gcagtgcacccccagattagctctg

SEQ ID NO: 444846 - DNA, 25 bp, Mus musculus
gcagtgcatagaggttcccgagtcc

SEQ ID NO: 444847 - DNA, 25 bp, Mus musculus
gcagtgccagcatccttaacatggg

SEQ ID NO: 444848 - DNA, 25 bp, Mus musculus
gcagtgccagcgtgtatctagtgaa

SEQ ID NO: 444849 - DNA, 25 bp, Mus musculus
gcagtgcgcagggtcttgaatacag

SEQ ID NO: 444850 - DNA, 25 bp, Mus musculus
gcagtgcggatctttctcttcggaa

SEQ ID NO: 444851 - DNA, 25 bp, Mus musculus
gcagtgcgtctgttactttctggcc

SEQ ID NO: 444852 - DNA, 25 bp, Mus musculus
gcagtgctaacgacacggagtcgga

SEQ ID NO: 444853 - DNA, 25 bp, Mus musculus
gcagtgctctaaaggctggcgtcac

SEQ ID NO: 444854 - DNA, 25 bp, Mus musculus
gcagtgcttcactctggctgtctgt

SEQ ID NO: 444855 - DNA, 25 bp, Mus musculus
gcagtggaagaccttgtgtcctgtt

SEQ ID NO: 444856 - DNA, 25 bp, Mus musculus
gcagtggacagcgagtaccctaaaa

SEQ ID NO: 444857 - DNA, 25 bp, Mus musculus
gcagtggccatatcaccgggaacta

SEQ ID NO: 444858 - DNA, 25 bp, Mus musculus
gcagtggccccatgcttttcatgca

SEQ ID NO: 444859 - DNA, 25 bp, Mus musculus
gcagtggcgccgttttaccgagcct

SEQ ID NO: 444860 - DNA, 25 bp, Mus musculus
gcagtggctacctgcttccacaggg

SEQ ID NO: 444861 - DNA, 25 bp, Mus musculus
gcagtggctgatgggaaactctcca

SEQ ID NO: 444862 - DNA, 25 bp, Mus musculus
gcagtggctgtggtgccaagacact

SEQ ID NO: 444863 - DNA, 25 bp, Mus musculus
gcagtgggtactcctaggactttta

SEQ ID NO: 444864 - DNA, 25 bp, Mus musculus
gcagtgggtctctgtttctctacaa

SEQ ID NO: 444865 - DNA, 25 bp, Mus musculus
gcagtggtcaaagcagaggttccct

SEQ ID NO: 444866 - DNA, 25 bp, Mus musculus
gcagtggtccatctggtaacatggc

SEQ ID NO: 444867 - DNA, 25 bp, Mus musculus
gcagtggtttcatcattaggcttta

SEQ ID NO: 444868 - DNA, 25 bp, Mus musculus
gcagtgtaccttgtgccaccgaatt

SEQ ID NO: 444869 - DNA, 25 bp, Mus musculus
gcagtgtatactgtacatcagtgtg

SEQ ID NO: 444870 - DNA, 25 bp, Mus musculus
gcagtgtcagtgcacaggtcccaat

SEQ ID NO: 444871 - DNA, 25 bp, Mus musculus
gcagtgtcagttcagagaagttaag

SEQ ID NO: 444872 - DNA, 25 bp, Mus musculus
gcagtgtcccattaattcggcgcat

SEQ ID NO: 444873 - DNA, 25 bp, Mus musculus
gcagtgtccccagcgggccttaaga

SEQ ID NO: 444874 - DNA, 25 bp, Mus musculus
gcagtgtctactgccaagggcttta

SEQ ID NO: 444875 - DNA, 25 bp, Mus musculus
gcagtgtctcagtactgtctctacg

SEQ ID NO: 444876 - DNA, 25 bp, Mus musculus
gcagtgtctgcaccttccggaacag

SEQ ID NO: 444877 - DNA, 25 bp, Mus musculus
gcagtgtctggttctttgcagctct

SEQ ID NO: 444878 - DNA, 25 bp, Mus musculus
gcagtgtgaatgagagccagccaca

SEQ ID NO: 444879 - DNA, 25 bp, Mus musculus
gcagtgtgcatcttctccgtgagga

SEQ ID NO: 444880 - DNA, 25 bp, Mus musculus
gcagtgttatcacaggacagggtaa

SEQ ID NO: 444881 - DNA, 25 bp, Mus musculus
gcagtgttcattgggcagcctacag

SEQ ID NO: 444882 - DNA, 25 bp, Mus musculus
gcagtgttctgtcgctgaagcccta

SEQ ID NO: 444883 - DNA, 25 bp, Mus musculus
gcagtgttgactccacaaggtttgg

SEQ ID NO: 444884 - DNA, 25 bp, Mus musculus
gcagtgttgtaagtagagcaggcta

SEQ ID NO: 444885 - DNA, 25 bp, Mus musculus
gcagttaactgccagggacctgctc

SEQ ID NO: 444886 - DNA, 25 bp, Mus musculus
gcagttacagtacaggagcccctgg

SEQ ID NO: 444887 - DNA, 25 bp, Mus musculus
gcagttactgcatccagaattatga

SEQ ID NO: 444888 - DNA, 25 bp, Mus musculus
gcagttagaccatcgaaagcccagt

SEQ ID NO: 444889 - DNA, 25 bp, Mus musculus
gcagttagcgatgctctcgactcat

SEQ ID NO: 444890 - DNA, 25 bp, Mus musculus
gcagttatacgacggctacgatgag

SEQ ID NO: 444891 - DNA, 25 bp, Mus musculus
gcagttatccggttatccgtggtac

SEQ ID NO: 444892 - DNA, 25 bp, Mus musculus
gcagttatggtagcctgaaacccta

SEQ ID NO: 444893 - DNA, 25 bp, Mus musculus
gcagttatgtagaaatgaagtcacc

SEQ ID NO: 444894 - DNA, 25 bp, Mus musculus
gcagttcaaactagcaccagccaca

SEQ ID NO: 444895 - DNA, 25 bp, Mus musculus
gcagttcaaggagagggcacgtcca

SEQ ID NO: 444896 - DNA, 25 bp, Mus musculus
gcagttcaagttcatttgtacaccc

SEQ ID NO: 444897 - DNA, 25 bp, Mus musculus
gcagttcacacgaacggatttccga

SEQ ID NO: 444898 - DNA, 25 bp, Mus musculus
gcagttcatcttccagcagcctgag

SEQ ID NO: 444899 - DNA, 25 bp, Mus musculus
gcagttcatcttgggaccagaccag

SEQ ID NO: 444900 - DNA, 25 bp, Mus musculus
gcagttccactcactttcaaaggct

SEQ ID NO: 444901 - DNA, 25 bp, Mus musculus
gcagttccttgatccgcatccagca

SEQ ID NO: 444902 - DNA, 25 bp, Mus musculus
gcagttcgaagaattctggccacgg

SEQ ID NO: 444903 - DNA, 25 bp, Mus musculus
gcagttcggcatcttggaacccatg

SEQ ID NO: 444904 - DNA, 25 bp, Mus musculus
gcagttcgggaaaatgctactctca

SEQ ID NO: 444905 - DNA, 25 bp, Mus musculus
gcagttctagcacttgctccttgaa

SEQ ID NO: 444906 - DNA, 25 bp, Mus musculus
gcagttctaggaccgtaagcatcca

SEQ ID NO: 444907 - DNA, 25 bp, Mus musculus
gcagttctaggcaaggtcagcccga

SEQ ID NO: 444908 - DNA, 25 bp, Mus musculus
gcagttctggctgccagtcggccag

SEQ ID NO: 444909 - DNA, 25 bp, Mus musculus
gcagttcttggaggcctggtacaac

SEQ ID NO: 444910 - DNA, 25 bp, Mus musculus
gcagttgcgtatgtccacagccagg

SEQ ID NO: 444911 - DNA, 25 bp, Mus musculus
gcagttggtactggctcagaatttc

SEQ ID NO: 444912 - DNA, 25 bp, Mus musculus
gcagttgtagccgtagagacccact

SEQ ID NO: 444913 - DNA, 25 bp, Mus musculus
gcagttgtcatcactaacgcaaagt

SEQ ID NO: 444914 - DNA, 25 bp, Mus musculus
gcagttgtcatgaaggttacgcccc

SEQ ID NO: 444915 - DNA, 25 bp, Mus musculus
gcagttgtgaactacctgacacgga

SEQ ID NO: 444916 - DNA, 25 bp, Mus musculus
gcagtttaaccgaaaacacttgtga

SEQ ID NO: 444917 - DNA, 25 bp, Mus musculus
gcagtttaaccgattccccagcagt

SEQ ID NO: 444918 - DNA, 25 bp, Mus musculus
gcagtttacccagcactctcaggag

SEQ ID NO: 444919 - DNA, 25 bp, Mus musculus
gcagtttatataatctcaggagccc

SEQ ID NO: 444920 - DNA, 25 bp, Mus musculus
gcagtttcaccatggccctgagcat

SEQ ID NO: 444921 - DNA, 25 bp, Mus musculus
gcagtttccaaagctagcagccgaa

SEQ ID NO: 444922 - DNA, 25 bp, Mus musculus
gcagtttccctggaggcatgatcac

SEQ ID NO: 444923 - DNA, 25 bp, Mus musculus
gcagtttcctctgcagccgaaggga

SEQ ID NO: 444924 - DNA, 25 bp, Mus musculus
gcagtttggagcacctttggccaga

SEQ ID NO: 444925 - DNA, 25 bp, Mus musculus
gcagtttgtaagtcagcctgcagca

SEQ ID NO: 444926 - DNA, 25 bp, Mus musculus
gcagttttaacaacagggttcccag

SEQ ID NO: 444927 - DNA, 25 bp, Mus musculus
gcagttttatgctgccccactcgga

SEQ ID NO: 444928 - DNA, 25 bp, Mus musculus
gcagttttcaataagggccaggttt

SEQ ID NO: 444929 - DNA, 25 bp, Mus musculus
gcagttttgacggaagcagcacacc

SEQ ID NO: 444930 - DNA, 25 bp, Mus musculus
gcagttttgagagtagcacgcccac

SEQ ID NO: 444931 - DNA, 25 bp, Mus musculus
gcagtttttggtggcttatcttgag

SEQ ID NO: 444932 - DNA, 25 bp, Mus musculus
gcagttttttgatgagtccacccca

SEQ ID NO: 444933 - DNA, 25 bp, Mus musculus
gcataaactttaggcatggcagtgt

SEQ ID NO: 444934 - DNA, 25 bp, Mus musculus
gcataaagatgagagccaggctccc

SEQ ID NO: 444935 - DNA, 25 bp, Mus musculus
gcataacagctagcatactctgggt

SEQ ID NO: 444936 - DNA, 25 bp, Mus musculus
gcataacattccagtcccttcaggg

SEQ ID NO: 444937 - DNA, 25 bp, Mus musculus
gcataacctttccttagccaagtga

SEQ ID NO: 444938 - DNA, 25 bp, Mus musculus
gcataatcttctagataaaccacag

SEQ ID NO: 444939 - DNA, 25 bp, Mus musculus
gcataatgatataaacgccacgctg

SEQ ID NO: 444940 - DNA, 25 bp, Mus musculus
gcatacagagctccgattaatcgtg

SEQ ID NO: 444941 - DNA, 25 bp, Mus musculus
gcatacagtggagtcaaaagaggtc

SEQ ID NO: 444942 - DNA, 25 bp, Mus musculus
gcatacattcgcaaaaacaacccct

SEQ ID NO: 444943 - DNA, 25 bp, Mus musculus
gcataccatttatcgggctcggcgc

SEQ ID NO: 444944 - DNA, 25 bp, Mus musculus
gcatacctgattgatctagacctga

SEQ ID NO: 444945 - DNA, 25 bp, Mus musculus
gcatacggtgccaaagctgaactcc

SEQ ID NO: 444946 - DNA, 25 bp, Mus musculus
gcatactatactcttccccgctggt

SEQ ID NO: 444947 - DNA, 25 bp, Mus musculus
gcatactgcaagagacctgggtttt

SEQ ID NO: 444948 - DNA, 25 bp, Mus musculus
gcatacttccagatggtaatgctat

SEQ ID NO: 444949 - DNA, 25 bp, Mus musculus
gcatagaagctcttggacaacagct

SEQ ID NO: 444950 - DNA, 25 bp, Mus musculus
gcatagacaagatcgcagcgcaagg

SEQ ID NO: 444951 - DNA, 25 bp, Mus musculus
gcatagacattccatacggcttggt

SEQ ID NO: 444952 - DNA, 25 bp, Mus musculus
gcatagacgcggaccttaaactcga

SEQ ID NO: 444953 - DNA, 25 bp, Mus musculus
gcatagagctcttcataccttccaa

SEQ ID NO: 444954 - DNA, 25 bp, Mus musculus
gcatagagggctccaacagcgtctt

SEQ ID NO: 444955 - DNA, 25 bp, Mus musculus
gcatagaggtcggtgctgacatcta

SEQ ID NO: 444956 - DNA, 25 bp, Mus musculus
gcatagatgaatgtttaccacagga

SEQ ID NO: 444957 - DNA, 25 bp, Mus musculus
gcatagcaccgcaaatttaacggcc

SEQ ID NO: 444958 - DNA, 25 bp, Mus musculus
gcatagctggtcctttggagcagtt

SEQ ID NO: 444959 - DNA, 25 bp, Mus musculus
gcatagctgtgtgctcttggcgtct

SEQ ID NO: 444960 - DNA, 25 bp, Mus musculus
gcataggacgatttgagtggtccca

SEQ ID NO: 444961 - DNA, 25 bp, Mus musculus
gcataggtttcaggtttcacaactg

SEQ ID NO: 444962 - DNA, 25 bp, Mus musculus
gcatagtaccttgacctgcgcggac

SEQ ID NO: 444963 - DNA, 25 bp, Mus musculus
gcatagtccttggaattgaactaaa

SEQ ID NO: 444964 - DNA, 25 bp, Mus musculus
gcatatcactgagtttactgtaggg

SEQ ID NO: 444965 - DNA, 25 bp, Mus musculus
gcatatcagttaagcctgaggaaac

SEQ ID NO: 444966 - DNA, 25 bp, Mus musculus
gcatatcctcctaagaaggtggtgt

SEQ ID NO: 444967 - DNA, 25 bp, Mus musculus
gcatatcttaagcttccaggaataa

SEQ ID NO: 444968 - DNA, 25 bp, Mus musculus
gcatatgccactatactttgttctc

SEQ ID NO: 444969 - DNA, 25 bp, Mus musculus
gcatatgcgcgagggttcaacacag

SEQ ID NO: 444970 - DNA, 25 bp, Mus musculus
gcatatgctagtaagtttcttccag

SEQ ID NO: 444971 - DNA, 25 bp, Mus musculus
gcatatgtccccaaggcctcttaga

SEQ ID NO: 444972 - DNA, 25 bp, Mus musculus
gcatatgtgagaaaggcagcgcctc

SEQ ID NO: 444973 - DNA, 25 bp, Mus musculus
gcatattgctgccatcttcaaaggc

SEQ ID NO: 444974 - DNA, 25 bp, Mus musculus
gcatatttggtaccgggaatggctc

SEQ ID NO: 444975 - DNA, 25 bp, Mus musculus
gcatcaacgtgtcactggagcagct

SEQ ID NO: 444976 - DNA, 25 bp, Mus musculus
gcatcaactgtctcgagggaagcca

SEQ ID NO: 444977 - DNA, 25 bp, Mus musculus
gcatcaagacagttgccattcacag

SEQ ID NO: 444978 - DNA, 25 bp, Mus musculus
gcatcaagcttatagaattcctgga

SEQ ID NO: 444979 - DNA, 25 bp, Mus musculus
gcatcaatacgacaatttcccagga

SEQ ID NO: 444980 - DNA, 25 bp, Mus musculus
gcatcaatggcataccaaactccta

SEQ ID NO: 444981 - DNA, 25 bp, Mus musculus
gcatcaattttacaggcagtgtccc

SEQ ID NO: 444982 - DNA, 25 bp, Mus musculus
gcatcacaaagagagcaagccgttt

SEQ ID NO: 444983 - DNA, 25 bp, Mus musculus
gcatcacagtgtttgagagggacca

SEQ ID NO: 444984 - DNA, 25 bp, Mus musculus
gcatcaccagaggaatatccgaagc

SEQ ID NO: 444985 - DNA, 25 bp, Mus musculus
gcatcacgatggagaaaatgtcccg

SEQ ID NO: 444986 - DNA, 25 bp, Mus musculus
gcatcactttgtcaggccgagctca

SEQ ID NO: 444987 - DNA, 25 bp, Mus musculus
gcatcagagaggatcctttcttcca

SEQ ID NO: 444988 - DNA, 25 bp, Mus musculus
gcatcagatcgctctgctgtgtgca

SEQ ID NO: 444989 - DNA, 25 bp, Mus musculus
gcatcagatctgttagaactggagg

SEQ ID NO: 444990 - DNA, 25 bp, Mus musculus
gcatcagcatcaaaaaccagagaat

SEQ ID NO: 444991 - DNA, 25 bp, Mus musculus
gcatcagcccttctgttgggcagta

SEQ ID NO: 444992 - DNA, 25 bp, Mus musculus
gcatcaggactattggcactcacta

SEQ ID NO: 444993 - DNA, 25 bp, Mus musculus
gcatcaggccctcagaatatacagt

SEQ ID NO: 444994 - DNA, 25 bp, Mus musculus
gcatcagggtgcatctctagacagt

SEQ ID NO: 444995 - DNA, 25 bp, Mus musculus
gcatcagtaccatctccagggcaaa

SEQ ID NO: 444996 - DNA, 25 bp, Mus musculus
gcatcagtccaggattgagcatgac

SEQ ID NO: 444997 - DNA, 25 bp, Mus musculus
gcatcatacgaaccaactataaggg

SEQ ID NO: 444998 - DNA, 25 bp, Mus musculus
gcatcatcagcattttggccaggtt

SEQ ID NO: 444999 - DNA, 25 bp, Mus musculus
gcatcatccgtgtcgttttccatga

SEQ ID NO: 445000 - DNA, 25 bp, Mus musculus
gcatcatcctcgaagaaaagtcagt

SEQ ID NO: 445001 - DNA, 25 bp, Mus musculus
gcatcatcttgttgttcgacgccca

SEQ ID NO: 445002 - DNA, 25 bp, Mus musculus
gcatccaaggttacgcaagtgacag

SEQ ID NO: 445003 - DNA, 25 bp, Mus musculus
gcatccactatcaataccatctgta

SEQ ID NO: 445004 - DNA, 25 bp, Mus musculus
gcatccaggtgccattcatcagaaa

SEQ ID NO: 445005 - DNA, 25 bp, Mus musculus
gcatccagtcgcatgtacacgttga

SEQ ID NO: 445006 - DNA, 25 bp, Mus musculus
gcatccagtgccatcattgacatca

SEQ ID NO: 445007 - DNA, 25 bp, Mus musculus
gcatccataagacaaattgaaactg

SEQ ID NO: 445008 - DNA, 25 bp, Mus musculus
gcatccatccgtttacccatttgag

SEQ ID NO: 445009 - DNA, 25 bp, Mus musculus
gcatcccagagacttcatagctgca

SEQ ID NO: 445010 - DNA, 25 bp, Mus musculus
gcatcccagggctctgcaaaaggcc

SEQ ID NO: 445011 - DNA, 25 bp, Mus musculus
gcatccccggtacttaatgaaaggc

SEQ ID NO: 445012 - DNA, 25 bp, Mus musculus
gcatcccggtgcgaatctctctgat

SEQ ID NO: 445013 - DNA, 25 bp, Mus musculus
gcatcccggtgtatgagggcgacca

SEQ ID NO: 445014 - DNA, 25 bp, Mus musculus
gcatcccgtgtgtcatgcctttctt

SEQ ID NO: 445015 - DNA, 25 bp, Mus musculus
gcatccctgcgctattattgcaccg

SEQ ID NO: 445016 - DNA, 25 bp, Mus musculus
gcatccctgtgaagatgacatcgtg

SEQ ID NO: 445017 - DNA, 25 bp, Mus musculus
gcatccctttggaggtggtaaccac

SEQ ID NO: 445018 - DNA, 25 bp, Mus musculus
gcatccggagatggcaacgctgtga

SEQ ID NO: 445019 - DNA, 25 bp, Mus musculus
gcatccggcaacatgtagcccttca

SEQ ID NO: 445020 - DNA, 25 bp, Mus musculus
gcatccgggaacagagagtcacagg

SEQ ID NO: 445021 - DNA, 25 bp, Mus musculus
gcatcctaggcaacctaaagaacat

SEQ ID NO: 445022 - DNA, 25 bp, Mus musculus
gcatcctcactgtaggccgggagaa

SEQ ID NO: 445023 - DNA, 25 bp, Mus musculus
gcatcctccaagaggtacagaccgc

SEQ ID NO: 445024 - DNA, 25 bp, Mus musculus
gcatcctgcaggacggccgcatctt

SEQ ID NO: 445025 - DNA, 25 bp, Mus musculus
gcatcctgtacgaaaaagccattgg

SEQ ID NO: 445026 - DNA, 25 bp, Mus musculus
gcatccttgagctcttcaacaacag

SEQ ID NO: 445027 - DNA, 25 bp, Mus musculus
gcatccttgctgtgttcctggccga

SEQ ID NO: 445028 - DNA, 25 bp, Mus musculus
gcatccttggctcttaatcctctaa

SEQ ID NO: 445029 - DNA, 25 bp, Mus musculus
gcatcgaatcaccaaaacgtcgcgg

SEQ ID NO: 445030 - DNA, 25 bp, Mus musculus
gcatcgacaaggacgtgtggctcca

SEQ ID NO: 445031 - DNA, 25 bp, Mus musculus
gcatcgaggagaacattcgcgccaa

SEQ ID NO: 445032 - DNA, 25 bp, Mus musculus
gcatcgagggcttcactaatgtcaa

SEQ ID NO: 445033 - DNA, 25 bp, Mus musculus
gcatcgatcgatctgcgtctcaatg

SEQ ID NO: 445034 - DNA, 25 bp, Mus musculus
gcatcgcgaacaaaggagcccgcgt

SEQ ID NO: 445035 - DNA, 25 bp, Mus musculus
gcatcgcggctgaactcaattgtga

SEQ ID NO: 445036 - DNA, 25 bp, Mus musculus
gcatcgctcaggtctgatactggga

SEQ ID NO: 445037 - DNA, 25 bp, Mus musculus
gcatcgctctgtggacgcctgtaaa

SEQ ID NO: 445038 - DNA, 25 bp, Mus musculus
gcatcgcttacgtgcagggcatgaa

SEQ ID NO: 445039 - DNA, 25 bp, Mus musculus
gcatcgcttagctgtgtggcacacg

SEQ ID NO: 445040 - DNA, 25 bp, Mus musculus
gcatcggatgcttccctgagtctat

SEQ ID NO: 445041 - DNA, 25 bp, Mus musculus
gcatcgttaggaacacacacattgt

SEQ ID NO: 445042 - DNA, 25 bp, Mus musculus
gcatcgttgtgtatgactaccagcg

SEQ ID NO: 445043 - DNA, 25 bp, Mus musculus
gcatctacccacacctggttctgtt

SEQ ID NO: 445044 - DNA, 25 bp, Mus musculus
gcatctacttagaatcacaggcatg

SEQ ID NO: 445045 - DNA, 25 bp, Mus musculus
gcatctaggactacttggtgcccag

SEQ ID NO: 445046 - DNA, 25 bp, Mus musculus
gcatctatggtgagacatttccgga

SEQ ID NO: 445047 - DNA, 25 bp, Mus musculus
gcatctatgttcatgtcacagttta

SEQ ID NO: 445048 - DNA, 25 bp, Mus musculus
gcatctcaaacgcaaaaagaaatat

SEQ ID NO: 445049 - DNA, 25 bp, Mus musculus
gcatctccaaaatatcgagcccaga

SEQ ID NO: 445050 - DNA, 25 bp, Mus musculus
gcatctcccagtgcttgcgtgaaga

SEQ ID NO: 445051 - DNA, 25 bp, Mus musculus
gcatctccctactctggagcatcaa

SEQ ID NO: 445052 - DNA, 25 bp, Mus musculus
gcatctccctgcagaccttggagga

SEQ ID NO: 445053 - DNA, 25 bp, Mus musculus
gcatctcgggcatctttcgcttcgt

SEQ ID NO: 445054 - DNA, 25 bp, Mus musculus
gcatctctcgcttggctctgactgg

SEQ ID NO: 445055 - DNA, 25 bp, Mus musculus
gcatctctgagatcttgcgatccca

SEQ ID NO: 445056 - DNA, 25 bp, Mus musculus
gcatctctgagggtgccaatgtcgg

SEQ ID NO: 445057 - DNA, 25 bp, Mus musculus
gcatctctgagttctgaaaacaggc

SEQ ID NO: 445058 - DNA, 25 bp, Mus musculus
gcatctctgatctcgactgctccag

SEQ ID NO: 445059 - DNA, 25 bp, Mus musculus
gcatctctgctacgcgtgtcactga

SEQ ID NO: 445060 - DNA, 25 bp, Mus musculus
gcatctgagggagcaggtaactgcc

SEQ ID NO: 445061 - DNA, 25 bp, Mus musculus
gcatctgagggcttcccgagtcaaa

SEQ ID NO: 445062 - DNA, 25 bp, Mus musculus
gcatctgcatgaccagtgccatttg

SEQ ID NO: 445063 - DNA, 25 bp, Mus musculus
gcatctgcctgatccgcaaggtgaa

SEQ ID NO: 445064 - DNA, 25 bp, Mus musculus
gcatctgccttcagaaagcctctct

SEQ ID NO: 445065 - DNA, 25 bp, Mus musculus
gcatctggagtttagtgtgccaccg

SEQ ID NO: 445066 - DNA, 25 bp, Mus musculus
gcatctggctttgcatagaccattt

SEQ ID NO: 445067 - DNA, 25 bp, Mus musculus
gcatctgggcgctgttcgaggaccc

SEQ ID NO: 445068 - DNA, 25 bp, Mus musculus
gcatctggtcaagcgtcccactgtg

SEQ ID NO: 445069 - DNA, 25 bp, Mus musculus
gcatctgtaatggacaggtgcagca

SEQ ID NO: 445070 - DNA, 25 bp, Mus musculus
gcatctgtcagaacgtggcacctac

SEQ ID NO: 445071 - DNA, 25 bp, Mus musculus
gcatcttagacaggtgtgctggcac

SEQ ID NO: 445072 - DNA, 25 bp, Mus musculus
gcatcttatggaagagtctgttggg

SEQ ID NO: 445073 - DNA, 25 bp, Mus musculus
gcatcttcaactgtgaggcctctca

SEQ ID NO: 445074 - DNA, 25 bp, Mus musculus
gcatcttcagcttcccgggttctca

SEQ ID NO: 445075 - DNA, 25 bp, Mus musculus
gcatcttcggagtggccagccggtt

SEQ ID NO: 445076 - DNA, 25 bp, Mus musculus
gcatcttgagtcttactgtggtgca

SEQ ID NO: 445077 - DNA, 25 bp, Mus musculus
gcatcttgccaagcgggccatggaa

SEQ ID NO: 445078 - DNA, 25 bp, Mus musculus
gcatcttgctgggagagcaccggtt

SEQ ID NO: 445079 - DNA, 25 bp, Mus musculus
gcatcttgtaggaaccagtgcctga

SEQ ID NO: 445080 - DNA, 25 bp, Mus musculus
gcatctttagagcaggtgggttcaa

SEQ ID NO: 445081 - DNA, 25 bp, Mus musculus
gcatctttctaagtgtacaggacca

SEQ ID NO: 445082 - DNA, 25 bp, Mus musculus
gcatctttgggtgccctggcgtgcc

SEQ ID NO: 445083 - DNA, 25 bp, Mus musculus
gcatgaaaaacacacaaagaccttg

SEQ ID NO: 445084 - DNA, 25 bp, Mus musculus
gcatgaaatgaaggaacggcttctc

SEQ ID NO: 445085 - DNA, 25 bp, Mus musculus
gcatgaacgatcacacttggtcttt

SEQ ID NO: 445086 - DNA, 25 bp, Mus musculus
gcatgaagaccaacagtaggtatct

SEQ ID NO: 445087 - DNA, 25 bp, Mus musculus
gcatgaagatggaggcaagctgccc

SEQ ID NO: 445088 - DNA, 25 bp, Mus musculus
gcatgaaggacgacagcaaagggaa

SEQ ID NO: 445089 - DNA, 25 bp, Mus musculus
gcatgaagttgcacatccctgagag

SEQ ID NO: 445090 - DNA, 25 bp, Mus musculus
gcatgaatctgagtgacgagagcct

SEQ ID NO: 445091 - DNA, 25 bp, Mus musculus
gcatgaatggacgtccatcttacaa

SEQ ID NO: 445092 - DNA, 25 bp, Mus musculus
gcatgacccagaacctacgagaagt

SEQ ID NO: 445093 - DNA, 25 bp, Mus musculus
gcatgaccccttctatgcttagggc

SEQ ID NO: 445094 - DNA, 25 bp, Mus musculus
gcatgactgggactgcttgttcaca

SEQ ID NO: 445095 - DNA, 25 bp, Mus musculus
gcatgagaactgagctggtgacgca

SEQ ID NO: 445096 - DNA, 25 bp, Mus musculus
gcatgagcaacaagtgaaacagcct

SEQ ID NO: 445097 - DNA, 25 bp, Mus musculus
gcatgagcagacattctcgtatttt

SEQ ID NO: 445098 - DNA, 25 bp, Mus musculus
gcatgagccattggatgttccatca

SEQ ID NO: 445099 - DNA, 25 bp, Mus musculus
gcatgagccctaatctgccacagag

SEQ ID NO: 445100 - DNA, 25 bp, Mus musculus
gcatgaggatgatggttggaccaca

SEQ ID NO: 445101 - DNA, 25 bp, Mus musculus
gcatgaggccctagttataatagaa

SEQ ID NO: 445102 - DNA, 25 bp, Mus musculus
gcatgagggcaagaccattttcgcc

SEQ ID NO: 445103 - DNA, 25 bp, Mus musculus
gcatgagtgcgagggacaacttgaa

SEQ ID NO: 445104 - DNA, 25 bp, Mus musculus
gcatgatcaggcagctagttaggcc

SEQ ID NO: 445105 - DNA, 25 bp, Mus musculus
gcatgatctgctcttcgggaaccaa

SEQ ID NO: 445106 - DNA, 25 bp, Mus musculus
gcatgatgactgctgtgacgactat

SEQ ID NO: 445107 - DNA, 25 bp, Mus musculus
gcatgatgcacgaccttgttggcaa

SEQ ID NO: 445108 - DNA, 25 bp, Mus musculus
gcatgatggcgtggaaagctgaatt

SEQ ID NO: 445109 - DNA, 25 bp, Mus musculus
gcatgattttggttgcaggctgaca

SEQ ID NO: 445110 - DNA, 25 bp, Mus musculus
gcatgcacaaggtcagctagcggtg

SEQ ID NO: 445111 - DNA, 25 bp, Mus musculus
gcatgcacactttccttaccgagag

SEQ ID NO: 445112 - DNA, 25 bp, Mus musculus
gcatgcagcctttgaaagcctggag

SEQ ID NO: 445113 - DNA, 25 bp, Mus musculus
gcatgcagtgtacgcagtgagctaa

SEQ ID NO: 445114 - DNA, 25 bp, Mus musculus
gcatgccaaggaggtaagcaaagct

SEQ ID NO: 445115 - DNA, 25 bp, Mus musculus
gcatgcccaggtgattgtctcagca

SEQ ID NO: 445116 - DNA, 25 bp, Mus musculus
gcatgcccgcactaaggagcttgaa

SEQ ID NO: 445117 - DNA, 25 bp, Mus musculus
gcatgcccgggatcagcagtcagat

SEQ ID NO: 445118 - DNA, 25 bp, Mus musculus
gcatgccctgccacaaagtaaacga

SEQ ID NO: 445119 - DNA, 25 bp, Mus musculus
gcatgccgaggttgctgctcgcaga

SEQ ID NO: 445120 - DNA, 25 bp, Mus musculus
gcatgccgtgtatcgaaaactgggt

SEQ ID NO: 445121 - DNA, 25 bp, Mus musculus
gcatgcctatgggtttcagctcaaa

SEQ ID NO: 445122 - DNA, 25 bp, Mus musculus
gcatgcctgcccactgaagtttgga

SEQ ID NO: 445123 - DNA, 25 bp, Mus musculus
gcatgcctggccaccgtgggaaaaa

SEQ ID NO: 445124 - DNA, 25 bp, Mus musculus
gcatgccttgtgctccagtgcgcct

SEQ ID NO: 445125 - DNA, 25 bp, Mus musculus
gcatgcctttccctcatcggcttgt

SEQ ID NO: 445126 - DNA, 25 bp, Mus musculus
gcatgcgccagattgccatcaagtt

SEQ ID NO: 445127 - DNA, 25 bp, Mus musculus
gcatgcgtcagctgcacaaggcgct

SEQ ID NO: 445128 - DNA, 25 bp, Mus musculus
gcatgcgttaactctccagaggacc

SEQ ID NO: 445129 - DNA, 25 bp, Mus musculus
gcatgctatcaatagcatgggccag

SEQ ID NO: 445130 - DNA, 25 bp, Mus musculus
gcatgctcacaaggcagcgcaagtt

SEQ ID NO: 445131 - DNA, 25 bp, Mus musculus
gcatgctgaagctgtacgcgcacaa

SEQ ID NO: 445132 - DNA, 25 bp, Mus musculus
gcatgctgacacacgtccataggtg

SEQ ID NO: 445133 - DNA, 25 bp, Mus musculus
gcatgctgtgactgaattcctgaaa

SEQ ID NO: 445134 - DNA, 25 bp, Mus musculus
gcatgcttaagttccataatatgaa

SEQ ID NO: 445135 - DNA, 25 bp, Mus musculus
gcatgcttgtgtaattgtgtcccct

SEQ ID NO: 445136 - DNA, 25 bp, Mus musculus
gcatggaaagcagcaacgtggaagt

SEQ ID NO: 445137 - DNA, 25 bp, Mus musculus
gcatggaagcatgccatccaaagag

SEQ ID NO: 445138 - DNA, 25 bp, Mus musculus
gcatggaccctaaagcccggagatt

SEQ ID NO: 445139 - DNA, 25 bp, Mus musculus
gcatggacgccaccgtgcaagttaa

SEQ ID NO: 445140 - DNA, 25 bp, Mus musculus
gcatggacgtaacaacagcctctgg

SEQ ID NO: 445141 - DNA, 25 bp, Mus musculus
gcatggactccaagtgggctgctct

SEQ ID NO: 445142 - DNA, 25 bp, Mus musculus
gcatggagacactgtgcttgatctg

SEQ ID NO: 445143 - DNA, 25 bp, Mus musculus
gcatggagatgctggtggaacacca

SEQ ID NO: 445144 - DNA, 25 bp, Mus musculus
gcatggagatgttccctgcggcaca

SEQ ID NO: 445145 - DNA, 25 bp, Mus musculus
gcatggaggtctaccaccgggccgt

SEQ ID NO: 445146 - DNA, 25 bp, Mus musculus
gcatggagttcttcaacgggcggct

SEQ ID NO: 445147 - DNA, 25 bp, Mus musculus
gcatggataagcaactcctggattt

SEQ ID NO: 445148 - DNA, 25 bp, Mus musculus
gcatggcaccaatgacattatgtta

SEQ ID NO: 445149 - DNA, 25 bp, Mus musculus
gcatggcaggcctgccccttactga

SEQ ID NO: 445150 - DNA, 25 bp, Mus musculus
gcatggcatttgcattgctggccaa

SEQ ID NO: 445151 - DNA, 25 bp, Mus musculus
gcatggcctcatcacctgatgcctg

SEQ ID NO: 445152 - DNA, 25 bp, Mus musculus
gcatggcctcttgatggcaagcgaa

SEQ ID NO: 445153 - DNA, 25 bp, Mus musculus
gcatggccttggtcatggacaccag

SEQ ID NO: 445154 - DNA, 25 bp, Mus musculus
gcatggcgctgctcaaagtcaagtt

SEQ ID NO: 445155 - DNA, 25 bp, Mus musculus
gcatggcggagatctttggcacaga

SEQ ID NO: 445156 - DNA, 25 bp, Mus musculus
gcatggcgtgaccttagcaggctta

SEQ ID NO: 445157 - DNA, 25 bp, Mus musculus
gcatggctaaggatggatgacccct

SEQ ID NO: 445158 - DNA, 25 bp, Mus musculus
gcatggctagttccctctgagttaa

SEQ ID NO: 445159 - DNA, 25 bp, Mus musculus
gcatggctatttgcccgtgaccaag

SEQ ID NO: 445160 - DNA, 25 bp, Mus musculus
gcatggctcccagaaacaagatcag

SEQ ID NO: 445161 - DNA, 25 bp, Mus musculus
gcatggctcttctcgcagttgttgg

SEQ ID NO: 445162 - DNA, 25 bp, Mus musculus
gcatggctggaaagaacacctggtt

SEQ ID NO: 445163 - DNA, 25 bp, Mus musculus
gcatggcttttatggatccctgaag

SEQ ID NO: 445164 - DNA, 25 bp, Mus musculus
gcatggtaatgctgaatcctaaaaa

SEQ ID NO: 445165 - DNA, 25 bp, Mus musculus
gcatggtactccacctcttgcatag

SEQ ID NO: 445166 - DNA, 25 bp, Mus musculus
gcatggtctcatctctgcatcagga

SEQ ID NO: 445167 - DNA, 25 bp, Mus musculus
gcatggtctgtgaagtcaggcccca

SEQ ID NO: 445168 - DNA, 25 bp, Mus musculus
gcatggtgctgccaactctcttggt

SEQ ID NO: 445169 - DNA, 25 bp, Mus musculus
gcatggtggcccatcccatggccat

SEQ ID NO: 445170 - DNA, 25 bp, Mus musculus
gcatggtggtgggagcagcaaagct

SEQ ID NO: 445171 - DNA, 25 bp, Mus musculus
gcatggttctaaggttcattgagga

SEQ ID NO: 445172 - DNA, 25 bp, Mus musculus
gcatgtcatcaatctacacgtgaga

SEQ ID NO: 445173 - DNA, 25 bp, Mus musculus
gcatgtccaataacacgggcgtagt

SEQ ID NO: 445174 - DNA, 25 bp, Mus musculus
gcatgtcccagctttctcaggagga

SEQ ID NO: 445175 - DNA, 25 bp, Mus musculus
gcatgtccggtaggcatagctgtca

SEQ ID NO: 445176 - DNA, 25 bp, Mus musculus
gcatgtcctccgtgtccatattcga

SEQ ID NO: 445177 - DNA, 25 bp, Mus musculus
gcatgtcgcctcttgcagaaagcag

SEQ ID NO: 445178 - DNA, 25 bp, Mus musculus
gcatgtcggtaatggctctggctgt

SEQ ID NO: 445179 - DNA, 25 bp, Mus musculus
gcatgtctgacgtcaatcttgatga

SEQ ID NO: 445180 - DNA, 25 bp, Mus musculus
gcatgtctggccaagcaccaggatg

SEQ ID NO: 445181 - DNA, 25 bp, Mus musculus
gcatgtgaacagtgaccatccaggg

SEQ ID NO: 445182 - DNA, 25 bp, Mus musculus
gcatgtgatagcaaaggcgggccct

SEQ ID NO: 445183 - DNA, 25 bp, Mus musculus
gcatgtgcaccagcgggcttcttca

SEQ ID NO: 445184 - DNA, 25 bp, Mus musculus
gcatgtgccacgcttggcccaagct

SEQ ID NO: 445185 - DNA, 25 bp, Mus musculus
gcatgtgcggagctacaatcacctc

SEQ ID NO: 445186 - DNA, 25 bp, Mus musculus
gcatgtgctatgctgctacaggcca

SEQ ID NO: 445187 - DNA, 25 bp, Mus musculus
gcatgtgctctcattctcccactag

SEQ ID NO: 445188 - DNA, 25 bp, Mus musculus
gcatgtgcttttctccaccggagga

SEQ ID NO: 445189 - DNA, 25 bp, Mus musculus
gcatgtgtgccctcatgtagcgtgc

SEQ ID NO: 445190 - DNA, 25 bp, Mus musculus
gcatgtgtgcgtgcgcaaacgtgta

SEQ ID NO: 445191 - DNA, 25 bp, Mus musculus
gcatgttacgggtctttcattcaaa

SEQ ID NO: 445192 - DNA, 25 bp, Mus musculus
gcatgttccacatcgtcattatcca

SEQ ID NO: 445193 - DNA, 25 bp, Mus musculus
gcatgttggcaagctcagagactgt

SEQ ID NO: 445194 - DNA, 25 bp, Mus musculus
gcatgttgtcccatagcctggtgca

SEQ ID NO: 445195 - DNA, 25 bp, Mus musculus
gcatgttttcagacgactttggcag

SEQ ID NO: 445196 - DNA, 25 bp, Mus musculus
gcattaaaggagtggcccagagcag

SEQ ID NO: 445197 - DNA, 25 bp, Mus musculus
gcattaatactgttgaaaacgtggg

SEQ ID NO: 445198 - DNA, 25 bp, Mus musculus
gcattaccacaagaatgagctgggc

SEQ ID NO: 445199 - DNA, 25 bp, Mus musculus
gcattactacaacgaagcagattct

SEQ ID NO: 445200 - DNA, 25 bp, Mus musculus
gcattacttcagacgggttgttgcc

SEQ ID NO: 445201 - DNA, 25 bp, Mus musculus
gcattagagctcttaatcttaggct

SEQ ID NO: 445202 - DNA, 25 bp, Mus musculus
gcattatcgaggtgcctcggttttt

SEQ ID NO: 445203 - DNA, 25 bp, Mus musculus
gcattatctcaaagaggacgcctgg

SEQ ID NO: 445204 - DNA, 25 bp, Mus musculus
gcattattcttgagtgggcacagcc

SEQ ID NO: 445205 - DNA, 25 bp, Mus musculus
gcattcaaggacattcacatcacgg

SEQ ID NO: 445206 - DNA, 25 bp, Mus musculus
gcattcaaggtaaaggcgagtaccc

SEQ ID NO: 445207 - DNA, 25 bp, Mus musculus
gcattcatttgtcaaaactgagtat

SEQ ID NO: 445208 - DNA, 25 bp, Mus musculus
gcattccaaatggtagacacgctgg

SEQ ID NO: 445209 - DNA, 25 bp, Mus musculus
gcattccataaacgactggcttcag

SEQ ID NO: 445210 - DNA, 25 bp, Mus musculus
gcattccccaagttctccggaagag

SEQ ID NO: 445211 - DNA, 25 bp, Mus musculus
gcattccccgagtcctagctcttga

SEQ ID NO: 445212 - DNA, 25 bp, Mus musculus
gcattcctggctctaaagccctttg

SEQ ID NO: 445213 - DNA, 25 bp, Mus musculus
gcattcctgtgagagtgtgcaccag

SEQ ID NO: 445214 - DNA, 25 bp, Mus musculus
gcattccttccagaacagggcaggg

SEQ ID NO: 445215 - DNA, 25 bp, Mus musculus
gcattcggaggaggaaacggaaatc

SEQ ID NO: 445216 - DNA, 25 bp, Mus musculus
gcattctatctttcattcactactg

SEQ ID NO: 445217 - DNA, 25 bp, Mus musculus
gcattctcagcaagccttttcgcag

SEQ ID NO: 445218 - DNA, 25 bp, Mus musculus
gcattctcatatcgcccactggtgg

SEQ ID NO: 445219 - DNA, 25 bp, Mus musculus
gcattctgcagaagactggtttcag

SEQ ID NO: 445220 - DNA, 25 bp, Mus musculus
gcattctgcttctttactcaacgga

SEQ ID NO: 445221 - DNA, 25 bp, Mus musculus
gcattcttgcttcacggagctcacg

SEQ ID NO: 445222 - DNA, 25 bp, Mus musculus
gcattgaaggaaagatacgtacgca

SEQ ID NO: 445223 - DNA, 25 bp, Mus musculus
gcattgaatggaaaaggagctccca

SEQ ID NO: 445224 - DNA, 25 bp, Mus musculus
gcattgagactgacctgtggacgcc

SEQ ID NO: 445225 - DNA, 25 bp, Mus musculus
gcattgagagcacaagacgccagag

SEQ ID NO: 445226 - DNA, 25 bp, Mus musculus
gcattgagcagagcatcgagcagga

SEQ ID NO: 445227 - DNA, 25 bp, Mus musculus
gcattgaggtgattctgtcacacga

SEQ ID NO: 445228 - DNA, 25 bp, Mus musculus
gcattgagttacaccctgatgggcg

SEQ ID NO: 445229 - DNA, 25 bp, Mus musculus
gcattgcacacctcaggctatggaa

SEQ ID NO: 445230 - DNA, 25 bp, Mus musculus
gcattgcactcatggccgtcatcgg

SEQ ID NO: 445231 - DNA, 25 bp, Mus musculus
gcattgccatacctgaggcctcgaa

SEQ ID NO: 445232 - DNA, 25 bp, Mus musculus
gcattgccggagcagaaccatctac

SEQ ID NO: 445233 - DNA, 25 bp, Mus musculus
gcattgcctagaccgacacggagga

SEQ ID NO: 445234 - DNA, 25 bp, Mus musculus
gcattgctcgatcaggtacttcctt

SEQ ID NO: 445235 - DNA, 25 bp, Mus musculus
gcattgctgaaactggcccgaaact

SEQ ID NO: 445236 - DNA, 25 bp, Mus musculus
gcattgctgcaggactaagagttta

SEQ ID NO: 445237 - DNA, 25 bp, Mus musculus
gcattgctgcagtgtgtggcctcac

SEQ ID NO: 445238 - DNA, 25 bp, Mus musculus
gcattgcttccggacaggttggccc

SEQ ID NO: 445239 - DNA, 25 bp, Mus musculus
gcattggccattaaccacaagctgg

SEQ ID NO: 445240 - DNA, 25 bp, Mus musculus
gcattggcctttgatccagtccaga

SEQ ID NO: 445241 - DNA, 25 bp, Mus musculus
gcattggtttgctacagcgagctca

SEQ ID NO: 445242 - DNA, 25 bp, Mus musculus
gcattgtagagagggtgcgaatcca

SEQ ID NO: 445243 - DNA, 25 bp, Mus musculus
gcattgtcatgaccctggtacccgg

SEQ ID NO: 445244 - DNA, 25 bp, Mus musculus
gcattgtgaagactacgttcgccca

SEQ ID NO: 445245 - DNA, 25 bp, Mus musculus
gcattgttacatgggaactttcaaa

SEQ ID NO: 445246 - DNA, 25 bp, Mus musculus
gcattgttcatctgcttcatcaacc

SEQ ID NO: 445247 - DNA, 25 bp, Mus musculus
gcattgttgaccttcttagccgaga

SEQ ID NO: 445248 - DNA, 25 bp, Mus musculus
gcattgttgcatgaagaggctacca

SEQ ID NO: 445249 - DNA, 25 bp, Mus musculus
gcattgttgcccttcactcccaggg

SEQ ID NO: 445250 - DNA, 25 bp, Mus musculus
gcattgtttgcctagattccgagaa

SEQ ID NO: 445251 - DNA, 25 bp, Mus musculus
gcatttaaacacttgagcagggcag

SEQ ID NO: 445252 - DNA, 25 bp, Mus musculus
gcatttactgtacatttctcccgag

SEQ ID NO: 445253 - DNA, 25 bp, Mus musculus
gcatttagcgtttctagggcggtac

SEQ ID NO: 445254 - DNA, 25 bp, Mus musculus
gcatttagtgaaggcagtgcttgcc

SEQ ID NO: 445255 - DNA, 25 bp, Mus musculus
gcatttatacagacgcgtaatcaca

SEQ ID NO: 445256 - DNA, 25 bp, Mus musculus
gcatttataggttgctgcctcagac

SEQ ID NO: 445257 - DNA, 25 bp, Mus musculus
gcatttatcttagagcctcacaaag

SEQ ID NO: 445258 - DNA, 25 bp, Mus musculus
gcatttatgttcaacccagccaggg

SEQ ID NO: 445259 - DNA, 25 bp, Mus musculus
gcatttcaaagagtcgtccgagctg

SEQ ID NO: 445260 - DNA, 25 bp, Mus musculus
gcatttcacagtaatctctctagag

SEQ ID NO: 445261 - DNA, 25 bp, Mus musculus
gcatttcatatagcatttcctctca

SEQ ID NO: 445262 - DNA, 25 bp, Mus musculus
gcatttcccatgtaccagatcccag

SEQ ID NO: 445263 - DNA, 25 bp, Mus musculus
gcatttccgctctgtgtatcagcac

SEQ ID NO: 445264 - DNA, 25 bp, Mus musculus
gcatttcctgaacctgacgtagctg

SEQ ID NO: 445265 - DNA, 25 bp, Mus musculus
gcatttcgttgtccacagagcccat

SEQ ID NO: 445266 - DNA, 25 bp, Mus musculus
gcatttctcaggacacctggcattt

SEQ ID NO: 445267 - DNA, 25 bp, Mus musculus
gcatttctgcaagtgaggccaagga

SEQ ID NO: 445268 - DNA, 25 bp, Mus musculus
gcatttctgcctatcagcgcctggg

SEQ ID NO: 445269 - DNA, 25 bp, Mus musculus
gcatttctgcctcgtgtgcactggg

SEQ ID NO: 445270 - DNA, 25 bp, Mus musculus
gcatttctggaaagctccgtcccct

SEQ ID NO: 445271 - DNA, 25 bp, Mus musculus
gcatttgattaagtgaccagggttc

SEQ ID NO: 445272 - DNA, 25 bp, Mus musculus
gcatttgcaacacatcaggatccag

SEQ ID NO: 445273 - DNA, 25 bp, Mus musculus
gcatttgcctccatctatagtcggg

SEQ ID NO: 445274 - DNA, 25 bp, Mus musculus
gcatttgcctgaggcgaccacggta

SEQ ID NO: 445275 - DNA, 25 bp, Mus musculus
gcatttggaagtaacaggacctctt

SEQ ID NO: 445276 - DNA, 25 bp, Mus musculus
gcatttggacctgccgggaaagtag

SEQ ID NO: 445277 - DNA, 25 bp, Mus musculus
gcatttggtccctggttggcaaccc

SEQ ID NO: 445278 - DNA, 25 bp, Mus musculus
gcatttggtgccatctgctgcacta

SEQ ID NO: 445279 - DNA, 25 bp, Mus musculus
gcatttgtggcctcagcagcaggta

SEQ ID NO: 445280 - DNA, 25 bp, Mus musculus
gcatttgttgcagccaggaccttcg

SEQ ID NO: 445281 - DNA, 25 bp, Mus musculus
gcattttattcttttgctgtggaaa

SEQ ID NO: 445282 - DNA, 25 bp, Mus musculus
gcattttgacaacatccacagggac

SEQ ID NO: 445283 - DNA, 25 bp, Mus musculus
gcattttgtatgtgaacccgcagga

SEQ ID NO: 445284 - DNA, 25 bp, Mus musculus
gcattttttcagagacaaaacattt

SEQ ID NO: 445285 - DNA, 25 bp, Mus musculus
gccaaaaaactctccaggtttgtca

SEQ ID NO: 445286 - DNA, 25 bp, Mus musculus
gccaaaaaggaatcaagcaccggat

SEQ ID NO: 445287 - DNA, 25 bp, Mus musculus
gccaaaaggaaaacgagaggacctg

SEQ ID NO: 445288 - DNA, 25 bp, Mus musculus
gccaaaatggcctttattactccag

SEQ ID NO: 445289 - DNA, 25 bp, Mus musculus
gccaaaatgtttgctgtgtcccaag

SEQ ID NO: 445290 - DNA, 25 bp, Mus musculus
gccaaacagggtcaaagaagacatc

SEQ ID NO: 445291 - DNA, 25 bp, Mus musculus
gccaaacaggtcttaagggagccac

SEQ ID NO: 445292 - DNA, 25 bp, Mus musculus
gccaaacctttcgtgcctagcgtaa

SEQ ID NO: 445293 - DNA, 25 bp, Mus musculus
gccaaactctaccatgaactgcggg

SEQ ID NO: 445294 - DNA, 25 bp, Mus musculus
gccaaactgctttcgaccgtgtata

SEQ ID NO: 445295 - DNA, 25 bp, Mus musculus
gccaaagacgttaccttctccctgg

SEQ ID NO: 445296 - DNA, 25 bp, Mus musculus
gccaaagactgtaatggtaagctta

SEQ ID NO: 445297 - DNA, 25 bp, Mus musculus
gccaaagagtccaaggcctaggttt

SEQ ID NO: 445298 - DNA, 25 bp, Mus musculus
gccaaagatcctatcagagtgggta

SEQ ID NO: 445299 - DNA, 25 bp, Mus musculus
gccaaagcgttgtgagtgctctact

SEQ ID NO: 445300 - DNA, 25 bp, Mus musculus
gccaaagctttgtgctagctcccaa

SEQ ID NO: 445301 - DNA, 25 bp, Mus musculus
gccaaaggatagtggaacttgccca

SEQ ID NO: 445302 - DNA, 25 bp, Mus musculus
gccaaaggtttcttcgaattactgt

SEQ ID NO: 445303 - DNA, 25 bp, Mus musculus
gccaaagtctttgttgaccgggcca

SEQ ID NO: 445304 - DNA, 25 bp, Mus musculus
gccaaagtgtggtgtctgtagcaac

SEQ ID NO: 445305 - DNA, 25 bp, Mus musculus
gccaaatatttctcgctcccatcag

SEQ ID NO: 445306 - DNA, 25 bp, Mus musculus
gccaaatcctccacccgggtgaagg

SEQ ID NO: 445307 - DNA, 25 bp, Mus musculus
gccaaatgacgttctggatgggcct

SEQ ID NO: 445308 - DNA, 25 bp, Mus musculus
gccaaattgctgaagaggcccttgt

SEQ ID NO: 445309 - DNA, 25 bp, Mus musculus
gccaacaagaagagtgagggtagtc

SEQ ID NO: 445310 - DNA, 25 bp, Mus musculus
gccaacaccaggatcattcctaagg

SEQ ID NO: 445311 - DNA, 25 bp, Mus musculus
gccaacagctctccacagggtagta

SEQ ID NO: 445312 - DNA, 25 bp, Mus musculus
gccaacagtgagacgtcagccagtc

SEQ ID NO: 445313 - DNA, 25 bp, Mus musculus
gccaacagtgctaaggagaaggacc

SEQ ID NO: 445314 - DNA, 25 bp, Mus musculus
gccaacatgcctgtttgtaatcgtg

SEQ ID NO: 445315 - DNA, 25 bp, Mus musculus
gccaaccagcaagaaacggagcagt

SEQ ID NO: 445316 - DNA, 25 bp, Mus musculus
gccaaccagggctaactcggtctat

SEQ ID NO: 445317 - DNA, 25 bp, Mus musculus
gccaaccaggtcacagcctcttgtg

SEQ ID NO: 445318 - DNA, 25 bp, Mus musculus
gccaaccgcttgtgtggaactacag

SEQ ID NO: 445319 - DNA, 25 bp, Mus musculus
gccaacctcatgtcctctgaggaga

SEQ ID NO: 445320 - DNA, 25 bp, Mus musculus
gccaacctgcgttcagtctgtcgtg

SEQ ID NO: 445321 - DNA, 25 bp, Mus musculus
gccaacgagacctgaataaagactg

SEQ ID NO: 445322 - DNA, 25 bp, Mus musculus
gccaacggccgctgcctgtatgtgg

SEQ ID NO: 445323 - DNA, 25 bp, Mus musculus
gccaacgggttgcatctctagctcc

SEQ ID NO: 445324 - DNA, 25 bp, Mus musculus
gccaactagatttcaatacgactcg

SEQ ID NO: 445325 - DNA, 25 bp, Mus musculus
gccaactccgcaataaactgtgtcc

SEQ ID NO: 445326 - DNA, 25 bp, Mus musculus
gccaactcggatacccctatgtgcg

SEQ ID NO: 445327 - DNA, 25 bp, Mus musculus
gccaactggctgaaaatagaccccg

SEQ ID NO: 445328 - DNA, 25 bp, Mus musculus
gccaactgggaattgtatgtcacaa

SEQ ID NO: 445329 - DNA, 25 bp, Mus musculus
gccaactgggaggtgatgctactgt

SEQ ID NO: 445330 - DNA, 25 bp, Mus musculus
gccaacttgatagaacggcgacagt

SEQ ID NO: 445331 - DNA, 25 bp, Mus musculus
gccaactttatgtcagggtcccagg

SEQ ID NO: 445332 - DNA, 25 bp, Mus musculus
gccaactttcttcccatgacaataa

SEQ ID NO: 445333 - DNA, 25 bp, Mus musculus
gccaagaaattcagcgaggtcacca

SEQ ID NO: 445334 - DNA, 25 bp, Mus musculus
gccaagaagtcggtggacaagaaca

SEQ ID NO: 445335 - DNA, 25 bp, Mus musculus
gccaagacatatacagggtgagcct

SEQ ID NO: 445336 - DNA, 25 bp, Mus musculus
gccaagactacaacagaggaacact

SEQ ID NO: 445337 - DNA, 25 bp, Mus musculus
gccaagactatgtgctttaaagcca

SEQ ID NO: 445338 - DNA, 25 bp, Mus musculus
gccaagactgggagagcctttgatc

SEQ ID NO: 445339 - DNA, 25 bp, Mus musculus
gccaagagccttttgacatctgttc

SEQ ID NO: 445340 - DNA, 25 bp, Mus musculus
gccaagaggccagattgatgcggat

SEQ ID NO: 445341 - DNA, 25 bp, Mus musculus
gccaagatgacttccaatccatggg

SEQ ID NO: 445342 - DNA, 25 bp, Mus musculus
gccaagatgagcgtgggacacctga

SEQ ID NO: 445343 - DNA, 25 bp, Mus musculus
gccaagattctgcagtgaagcatgc

SEQ ID NO: 445344 - DNA, 25 bp, Mus musculus
gccaagcagcagcagggtctcaata

SEQ ID NO: 445345 - DNA, 25 bp, Mus musculus
gccaagcagtttctgtgattccagg

SEQ ID NO: 445346 - DNA, 25 bp, Mus musculus
gccaagccttggaagaatgttcaaa

SEQ ID NO: 445347 - DNA, 25 bp, Mus musculus
gccaagctaatcaacctgggagtgt

SEQ ID NO: 445348 - DNA, 25 bp, Mus musculus
gccaagctgtcccagatccgacaga

SEQ ID NO: 445349 - DNA, 25 bp, Mus musculus
gccaaggaaacatcagccagacatg

SEQ ID NO: 445350 - DNA, 25 bp, Mus musculus
gccaaggagcgctatgacaaagcta

SEQ ID NO: 445351 - DNA, 25 bp, Mus musculus
gccaaggagtcttcccagggtagct

SEQ ID NO: 445352 - DNA, 25 bp, Mus musculus
gccaaggcagacagtctaacagatg

SEQ ID NO: 445353 - DNA, 25 bp, Mus musculus
gccaaggcgagaaggaaatgtacac

SEQ ID NO: 445354 - DNA, 25 bp, Mus musculus
gccaagggaggcagcaactctgtga

SEQ ID NO: 445355 - DNA, 25 bp, Mus musculus
gccaagggccacctgtgatcctaag

SEQ ID NO: 445356 - DNA, 25 bp, Mus musculus
gccaagggcttgcagaacaccttaa

SEQ ID NO: 445357 - DNA, 25 bp, Mus musculus
gccaaggtggaggtgaacatcccca

SEQ ID NO: 445358 - DNA, 25 bp, Mus musculus
gccaaggtggatcaggtcctgcaca

SEQ ID NO: 445359 - DNA, 25 bp, Mus musculus
gccaaggtggctggcaacgaaacca

SEQ ID NO: 445360 - DNA, 25 bp, Mus musculus
gccaagtaactctgagccgggacgc

SEQ ID NO: 445361 - DNA, 25 bp, Mus musculus
gccaagtaagacacaggccttccct

SEQ ID NO: 445362 - DNA, 25 bp, Mus musculus
gccaagtagagcctgcaaacaagtt

SEQ ID NO: 445363 - DNA, 25 bp, Mus musculus
gccaagtatgcccacctgagtgatg

SEQ ID NO: 445364 - DNA, 25 bp, Mus musculus
gccaagtattgcatccaggtgtcag

SEQ ID NO: 445365 - DNA, 25 bp, Mus musculus
gccaagtcagggatcaaaattctcg

SEQ ID NO: 445366 - DNA, 25 bp, Mus musculus
gccaagtcagtgctgtgtctgtgcc

SEQ ID NO: 445367 - DNA, 25 bp, Mus musculus
gccaagtgatacttctggcgtatgt

SEQ ID NO: 445368 - DNA, 25 bp, Mus musculus
gccaagtgatgtttccaagtccaga

SEQ ID NO: 445369 - DNA, 25 bp, Mus musculus
gccaagtgtacagtctggtgccaga

SEQ ID NO: 445370 - DNA, 25 bp, Mus musculus
gccaagtgtcctgtgaaagcctcct

SEQ ID NO: 445371 - DNA, 25 bp, Mus musculus
gccaataaatgtgagagcagcccat

SEQ ID NO: 445372 - DNA, 25 bp, Mus musculus
gccaatacaaagacatctaaccagt

SEQ ID NO: 445373 - DNA, 25 bp, Mus musculus
gccaatagtcacagaggtaaccgca

SEQ ID NO: 445374 - DNA, 25 bp, Mus musculus
gccaatatagcatcgaccctgtcac

SEQ ID NO: 445375 - DNA, 25 bp, Mus musculus
gccaatcaaacaagctcaagactaa

SEQ ID NO: 445376 - DNA, 25 bp, Mus musculus
gccaatcgcctcctggtggtgctga

SEQ ID NO: 445377 - DNA, 25 bp, Mus musculus
gccaatcggtggtgagagcgactca

SEQ ID NO: 445378 - DNA, 25 bp, Mus musculus
gccaatctgaatgctcagatcctaa

SEQ ID NO: 445379 - DNA, 25 bp, Mus musculus
gccaatgagaacctgagtctgaagt

SEQ ID NO: 445380 - DNA, 25 bp, Mus musculus
gccaatgaggtcactacaggaaaca

SEQ ID NO: 445381 - DNA, 25 bp, Mus musculus
gccaatgggctcacggacctgatta

SEQ ID NO: 445382 - DNA, 25 bp, Mus musculus
gccaatgggttgctatccgctcaga

SEQ ID NO: 445383 - DNA, 25 bp, Mus musculus
gccaatgtaactgtcgccgctgtga

SEQ ID NO: 445384 - DNA, 25 bp, Mus musculus
gccaatgtaaggacaagcagtaaca

SEQ ID NO: 445385 - DNA, 25 bp, Mus musculus
gccaatgtagtgagaaacgtccgcc

SEQ ID NO: 445386 - DNA, 25 bp, Mus musculus
gccaatgtgacaatttggaatcata

SEQ ID NO: 445387 - DNA, 25 bp, Mus musculus
gccaattacttaagccaggtgtatt

SEQ ID NO: 445388 - DNA, 25 bp, Mus musculus
gccaattaggacaaccactggaggt

SEQ ID NO: 445389 - DNA, 25 bp, Mus musculus
gccaattagtagattttctgactga

SEQ ID NO: 445390 - DNA, 25 bp, Mus musculus
gccaattcagtgagaaccccaggat

SEQ ID NO: 445391 - DNA, 25 bp, Mus musculus
gccaattctgatgtgaggcagacag

SEQ ID NO: 445392 - DNA, 25 bp, Mus musculus
gccaattgaccatcctcagctgagg

SEQ ID NO: 445393 - DNA, 25 bp, Mus musculus
gccaattgtccctatatccctttga

SEQ ID NO: 445394 - DNA, 25 bp, Mus musculus
gccacaaagtttgcattacgcagga

SEQ ID NO: 445395 - DNA, 25 bp, Mus musculus
gccacaacctatgactacaagacag

SEQ ID NO: 445396 - DNA, 25 bp, Mus musculus
gccacaagataccatcagaagggag

SEQ ID NO: 445397 - DNA, 25 bp, Mus musculus
gccacaaggtcagcgagttcaagga

SEQ ID NO: 445398 - DNA, 25 bp, Mus musculus
gccacaagtatttgggtactgccag

SEQ ID NO: 445399 - DNA, 25 bp, Mus musculus
gccacaatggctctgacgcttggtg

SEQ ID NO: 445400 - DNA, 25 bp, Mus musculus
gccacacaatggaaagacagccgac

SEQ ID NO: 445401 - DNA, 25 bp, Mus musculus
gccacacagagatagtccacactgg

SEQ ID NO: 445402 - DNA, 25 bp, Mus musculus
gccacacatgggagggcagcttcta

SEQ ID NO: 445403 - DNA, 25 bp, Mus musculus
gccacactgtgacgaagagcacctt

SEQ ID NO: 445404 - DNA, 25 bp, Mus musculus
gccacacttgttgtagaagcctgag

SEQ ID NO: 445405 - DNA, 25 bp, Mus musculus
gccacagactctcgctatgggcaga

SEQ ID NO: 445406 - DNA, 25 bp, Mus musculus
gccacagagccagttaatgattcct

SEQ ID NO: 445407 - DNA, 25 bp, Mus musculus
gccacagagccctgagattgtttgg

SEQ ID NO: 445408 - DNA, 25 bp, Mus musculus
gccacaggacatgggcagcagccag

SEQ ID NO: 445409 - DNA, 25 bp, Mus musculus
gccacaggagcaggtaccgtctgaa

SEQ ID NO: 445410 - DNA, 25 bp, Mus musculus
gccacaggcctttttaaatgctacc

SEQ ID NO: 445411 - DNA, 25 bp, Mus musculus
gccacaggcggtattctgagtacca

SEQ ID NO: 445412 - DNA, 25 bp, Mus musculus
gccacagggaactggatgccctctt

SEQ ID NO: 445413 - DNA, 25 bp, Mus musculus
gccacagggtccacgaagcattgat

SEQ ID NO: 445414 - DNA, 25 bp, Mus musculus
gccacaggtaagcagggcctctctt

SEQ ID NO: 445415 - DNA, 25 bp, Mus musculus
gccacaggtacctagcttgtcgtta

SEQ ID NO: 445416 - DNA, 25 bp, Mus musculus
gccacaggtctctctttgcacatga

SEQ ID NO: 445417 - DNA, 25 bp, Mus musculus
gccacagtagggaagaggctagact

SEQ ID NO: 445418 - DNA, 25 bp, Mus musculus
gccacagtcctgttgtcattgaaga

SEQ ID NO: 445419 - DNA, 25 bp, Mus musculus
gccacagtggcttctctcggccgtg

SEQ ID NO: 445420 - DNA, 25 bp, Mus musculus
gccacagttcatctcctaccaggag

SEQ ID NO: 445421 - DNA, 25 bp, Mus musculus
gccacagtttgtagttctctagaca

SEQ ID NO: 445422 - DNA, 25 bp, Mus musculus
gccacataagtaacagcccaggttc

SEQ ID NO: 445423 - DNA, 25 bp, Mus musculus
gccacatctcttagaagttgatgct

SEQ ID NO: 445424 - DNA, 25 bp, Mus musculus
gccacatggtcacttgttatctgca

SEQ ID NO: 445425 - DNA, 25 bp, Mus musculus
gccacattgatggtccggagagcca

SEQ ID NO: 445426 - DNA, 25 bp, Mus musculus
gccacattgcagtctgaaccattca

SEQ ID NO: 445427 - DNA, 25 bp, Mus musculus
gccacattgtagaacggtgcacaca

SEQ ID NO: 445428 - DNA, 25 bp, Mus musculus
gccacattgtcctgagcgtcgagaa

SEQ ID NO: 445429 - DNA, 25 bp, Mus musculus
gccaccaatgtgcaaaagtcaggaa

SEQ ID NO: 445430 - DNA, 25 bp, Mus musculus
gccaccacagccctaggatcataga

SEQ ID NO: 445431 - DNA, 25 bp, Mus musculus
gccaccacatggagcggattattga

SEQ ID NO: 445432 - DNA, 25 bp, Mus musculus
gccaccatcatgacgaaggaccaaa

SEQ ID NO: 445433 - DNA, 25 bp, Mus musculus
gccaccatgctcaaggagattttga

SEQ ID NO: 445434 - DNA, 25 bp, Mus musculus
gccaccatgggtctggagaagtccc

SEQ ID NO: 445435 - DNA, 25 bp, Mus musculus
gccaccatgtcattgaatggtcagt

SEQ ID NO: 445436 - DNA, 25 bp, Mus musculus
gccaccatgttgttaaagtccagta

SEQ ID NO: 445437 - DNA, 25 bp, Mus musculus
gccacccaagcccaataagaggagt

SEQ ID NO: 445438 - DNA, 25 bp, Mus musculus
gccacccaggtcgagattcagagct

SEQ ID NO: 445439 - DNA, 25 bp, Mus musculus
gccacccatgaagttccgtgattct

SEQ ID NO: 445440 - DNA, 25 bp, Mus musculus
gccacccttgcttgagccttggcat

SEQ ID NO: 445441 - DNA, 25 bp, Mus musculus
gccaccgactgcctctttagctttt

SEQ ID NO: 445442 - DNA, 25 bp, Mus musculus
gccaccgcagcgttttacgggaaca

SEQ ID NO: 445443 - DNA, 25 bp, Mus musculus
gccaccgccttacagacaagacggg

SEQ ID NO: 445444 - DNA, 25 bp, Mus musculus
gccaccggagcttggaaattaatga

SEQ ID NO: 445445 - DNA, 25 bp, Mus musculus
gccaccgtgacattgcgaggtatct

SEQ ID NO: 445446 - DNA, 25 bp, Mus musculus
gccaccgtgtggaagagcagtctct

SEQ ID NO: 445447 - DNA, 25 bp, Mus musculus
gccacctatgtcagggcgggccttc

SEQ ID NO: 445448 - DNA, 25 bp, Mus musculus
gccacctcatggacggcaagcagct

SEQ ID NO: 445449 - DNA, 25 bp, Mus musculus
gccacctccgcctgggaggctttga

SEQ ID NO: 445450 - DNA, 25 bp, Mus musculus
gccacctgggcatgaaaggaatccg

SEQ ID NO: 445451 - DNA, 25 bp, Mus musculus
gccacctgtgtctggatctgctgaa

SEQ ID NO: 445452 - DNA, 25 bp, Mus musculus
gccacgaagatcgacaaggaggcgt

SEQ ID NO: 445453 - DNA, 25 bp, Mus musculus
gccacgaaggcatctaaagaccagg

SEQ ID NO: 445454 - DNA, 25 bp, Mus musculus
gccacgagactcttgacagcggcgc

SEQ ID NO: 445455 - DNA, 25 bp, Mus musculus
gccacgagtggaggctgagactcaa

SEQ ID NO: 445456 - DNA, 25 bp, Mus musculus
gccacgctgatgagaaacctgcaga

SEQ ID NO: 445457 - DNA, 25 bp, Mus musculus
gccacgctgcagacctaattgggaa

SEQ ID NO: 445458 - DNA, 25 bp, Mus musculus
gccacggcacagtcagctcctttgt

SEQ ID NO: 445459 - DNA, 25 bp, Mus musculus
gccacggccagagggtatcaaagta

SEQ ID NO: 445460 - DNA, 25 bp, Mus musculus
gccacggcggcaggagttaaacaaa

SEQ ID NO: 445461 - DNA, 25 bp, Mus musculus
gccacgggagcttagtgagacctgt

SEQ ID NO: 445462 - DNA, 25 bp, Mus musculus
gccacgggagtgtcataaccaagct

SEQ ID NO: 445463 - DNA, 25 bp, Mus musculus
gccacgggctagagagcattaacca

SEQ ID NO: 445464 - DNA, 25 bp, Mus musculus
gccacggtgaagagtaacgctgtcc

SEQ ID NO: 445465 - DNA, 25 bp, Mus musculus
gccacggtggtggaggaactcttca

SEQ ID NO: 445466 - DNA, 25 bp, Mus musculus
gccacgtgggatgcaagaaatgccc

SEQ ID NO: 445467 - DNA, 25 bp, Mus musculus
gccacgtgggctgaggtttctcttt

SEQ ID NO: 445468 - DNA, 25 bp, Mus musculus
gccacgtggtgactaaggattatcc

SEQ ID NO: 445469 - DNA, 25 bp, Mus musculus
gccactactaattgccagagaccag

SEQ ID NO: 445470 - DNA, 25 bp, Mus musculus
gccactatgaaggagacgccgcttt

SEQ ID NO: 445471 - DNA, 25 bp, Mus musculus
gccactatgagatgctgggcacctg

SEQ ID NO: 445472 - DNA, 25 bp, Mus musculus
gccactcactaatgcctgtcgggaa

SEQ ID NO: 445473 - DNA, 25 bp, Mus musculus
gccactccgtgggaagcaattctga

SEQ ID NO: 445474 - DNA, 25 bp, Mus musculus
gccactcctcctttgtgattctgga

SEQ ID NO: 445475 - DNA, 25 bp, Mus musculus
gccactcctggctgcttctaatctg

SEQ ID NO: 445476 - DNA, 25 bp, Mus musculus
gccactcggtcagaatgcaagcaga

SEQ ID NO: 445477 - DNA, 25 bp, Mus musculus
gccactctgggaatgaacggataaa

SEQ ID NO: 445478 - DNA, 25 bp, Mus musculus
gccactctttgctgcttgagacgga

SEQ ID NO: 445479 - DNA, 25 bp, Mus musculus
gccactgaagcatgctcttgtcgtg

SEQ ID NO: 445480 - DNA, 25 bp, Mus musculus
gccactgagatggagcagaccttgt

SEQ ID NO: 445481 - DNA, 25 bp, Mus musculus
gccactgatctagagggtgcttact

SEQ ID NO: 445482 - DNA, 25 bp, Mus musculus
gccactgcagaactgtgatgactaa

SEQ ID NO: 445483 - DNA, 25 bp, Mus musculus
gccactgcaggcacttaagcttctg

SEQ ID NO: 445484 - DNA, 25 bp, Mus musculus
gccactggctggctaacgtcaaata

SEQ ID NO: 445485 - DNA, 25 bp, Mus musculus
gccactggtgtagatcaggaaatcc

SEQ ID NO: 445486 - DNA, 25 bp, Mus musculus
gccactgtccccatgtttccaaagg

SEQ ID NO: 445487 - DNA, 25 bp, Mus musculus
gccactgtcgaggacatgctgcctt

SEQ ID NO: 445488 - DNA, 25 bp, Mus musculus
gccactgttccaaaatactaataag

SEQ ID NO: 445489 - DNA, 25 bp, Mus musculus
gccacttactaatgttctgcgtgtg

SEQ ID NO: 445490 - DNA, 25 bp, Mus musculus
gccacttctgtgatctgaacctgga

SEQ ID NO: 445491 - DNA, 25 bp, Mus musculus
gccactttaacccttctggaaatct

SEQ ID NO: 445492 - DNA, 25 bp, Mus musculus
gccactttactgagggatgctgtaa

SEQ ID NO: 445493 - DNA, 25 bp, Mus musculus
gccagaaacgaggaaagcagcacta

SEQ ID NO: 445494 - DNA, 25 bp, Mus musculus
gccagaaactcaagcaatgggtgag

SEQ ID NO: 445495 - DNA, 25 bp, Mus musculus
gccagaaagtcgcttcagaatgctg

SEQ ID NO: 445496 - DNA, 25 bp, Mus musculus
gccagaagacagtgaagcgctacga

SEQ ID NO: 445497 - DNA, 25 bp, Mus musculus
gccagaagaggatgtaagacgcctt

SEQ ID NO: 445498 - DNA, 25 bp, Mus musculus
gccagaagcagcgtgaattccaaga

SEQ ID NO: 445499 - DNA, 25 bp, Mus musculus
gccagaagcccgtcctgaagtctct

SEQ ID NO: 445500 - DNA, 25 bp, Mus musculus
gccagaagtcacgatagagaagtcc

SEQ ID NO: 445501 - DNA, 25 bp, Mus musculus
gccagaatgatcagtgtgtccagaa

SEQ ID NO: 445502 - DNA, 25 bp, Mus musculus
gccagacaaccaacttgaagccatt

SEQ ID NO: 445503 - DNA, 25 bp, Mus musculus
gccagacagacaggtgacttcctgt

SEQ ID NO: 445504 - DNA, 25 bp, Mus musculus
gccagacggcgtaagagggtcctat

SEQ ID NO: 445505 - DNA, 25 bp, Mus musculus
gccagactgacctatgcaacgagag

SEQ ID NO: 445506 - DNA, 25 bp, Mus musculus
gccagactgatctccttttggagtg

SEQ ID NO: 445507 - DNA, 25 bp, Mus musculus
gccagacttgtttggtaatccccgg

SEQ ID NO: 445508 - DNA, 25 bp, Mus musculus
gccagactttattctttgggattcc

SEQ ID NO: 445509 - DNA, 25 bp, Mus musculus
gccagagacaatgatttaaatgacc

SEQ ID NO: 445510 - DNA, 25 bp, Mus musculus
gccagagacctatgcatcccgaatg

SEQ ID NO: 445511 - DNA, 25 bp, Mus musculus
gccagagcatgtgcaaacatcttac

SEQ ID NO: 445512 - DNA, 25 bp, Mus musculus
gccagagccacctaagaaccctgat

SEQ ID NO: 445513 - DNA, 25 bp, Mus musculus
gccagagctcgtggacctgctgtgc

SEQ ID NO: 445514 - DNA, 25 bp, Mus musculus
gccagagctgtatccccgaaagggt

SEQ ID NO: 445515 - DNA, 25 bp, Mus musculus
gccagaggaacgactacagcttggg

SEQ ID NO: 445516 - DNA, 25 bp, Mus musculus
gccagaggcactaaacaggaagtcc

SEQ ID NO: 445517 - DNA, 25 bp, Mus musculus
gccagaggctattcttccaagagtg

SEQ ID NO: 445518 - DNA, 25 bp, Mus musculus
gccagagggtttggatgcagcatct

SEQ ID NO: 445519 - DNA, 25 bp, Mus musculus
gccagagtgacaggcacaggaacag

SEQ ID NO: 445520 - DNA, 25 bp, Mus musculus
gccagagtgatctgaaacgcacata

SEQ ID NO: 445521 - DNA, 25 bp, Mus musculus
gccagagtgggctctacagtcccca

SEQ ID NO: 445522 - DNA, 25 bp, Mus musculus
gccagagttctcaacagggtcacaa

SEQ ID NO: 445523 - DNA, 25 bp, Mus musculus
gccagagttggcttacagggtttaa

SEQ ID NO: 445524 - DNA, 25 bp, Mus musculus
gccagatatgttccgagcacagcag

SEQ ID NO: 445525 - DNA, 25 bp, Mus musculus
gccagatctgattgatttcccttca

SEQ ID NO: 445526 - DNA, 25 bp, Mus musculus
gccagatgctacgaggtaagacaac

SEQ ID NO: 445527 - DNA, 25 bp, Mus musculus
gccagatggccaaacctaccaggag

SEQ ID NO: 445528 - DNA, 25 bp, Mus musculus
gccagatggccctcctagagtgaga

SEQ ID NO: 445529 - DNA, 25 bp, Mus musculus
gccagattgtctagcacttccagca

SEQ ID NO: 445530 - DNA, 25 bp, Mus musculus
gccagcacaacgtggtgtctgcgaa

SEQ ID NO: 445531 - DNA, 25 bp, Mus musculus
gccagcacctgtgggtttaccaaac

SEQ ID NO: 445532 - DNA, 25 bp, Mus musculus
gccagcactgtgacccctgttctct

SEQ ID NO: 445533 - DNA, 25 bp, Mus musculus
gccagcagtggccaatgtccaggaa

SEQ ID NO: 445534 - DNA, 25 bp, Mus musculus
gccagcatcttttcaaaggcttctg

SEQ ID NO: 445535 - DNA, 25 bp, Mus musculus
gccagcattgcaacccaagagggag

SEQ ID NO: 445536 - DNA, 25 bp, Mus musculus
gccagccacagttcagctgtgggaa

SEQ ID NO: 445537 - DNA, 25 bp, Mus musculus
gccagccaggcaaataagattaagc

SEQ ID NO: 445538 - DNA, 25 bp, Mus musculus
gccagccagtacaggagatctttga

SEQ ID NO: 445539 - DNA, 25 bp, Mus musculus
gccagccagttcaagtacgccttgg

SEQ ID NO: 445540 - DNA, 25 bp, Mus musculus
gccagcccatgtggttagtatcctt

SEQ ID NO: 445541 - DNA, 25 bp, Mus musculus
gccagccctacgtgtatgagatcga

SEQ ID NO: 445542 - DNA, 25 bp, Mus musculus
gccagccctccgaatttcttggaaa

SEQ ID NO: 445543 - DNA, 25 bp, Mus musculus
gccagcctggaaaccgtgggtccta

SEQ ID NO: 445544 - DNA, 25 bp, Mus musculus
gccagcctgtaagaatgtggatgca

SEQ ID NO: 445545 - DNA, 25 bp, Mus musculus
gccagcctgtgagttttaggatagc

SEQ ID NO: 445546 - DNA, 25 bp, Mus musculus
gccagcctgtggaaactctttttga

SEQ ID NO: 445547 - DNA, 25 bp, Mus musculus
gccagccttgaaaatagaacaatat

SEQ ID NO: 445548 - DNA, 25 bp, Mus musculus
gccagccttgccaggacgctgggct

SEQ ID NO: 445549 - DNA, 25 bp, Mus musculus
gccagccttgtctgcccgtgatgac

SEQ ID NO: 445550 - DNA, 25 bp, Mus musculus
gccagcctttgggtgagatttttaa

SEQ ID NO: 445551 - DNA, 25 bp, Mus musculus
gccagcgaacaacatcacatctctt

SEQ ID NO: 445552 - DNA, 25 bp, Mus musculus
gccagcgaggaagagctgataacga

SEQ ID NO: 445553 - DNA, 25 bp, Mus musculus
gccagcgcgcggagacttgagaaaa

SEQ ID NO: 445554 - DNA, 25 bp, Mus musculus
gccagcgcgggcagatttcattgag

SEQ ID NO: 445555 - DNA, 25 bp, Mus musculus
gccagctaccaactatgtggactca

SEQ ID NO: 445556 - DNA, 25 bp, Mus musculus
gccagctcaatgctgcccaaggact

SEQ ID NO: 445557 - DNA, 25 bp, Mus musculus
gccagctctgttctgttcagtattg

SEQ ID NO: 445558 - DNA, 25 bp, Mus musculus
gccagctgccactctgaggatgtgt

SEQ ID NO: 445559 - DNA, 25 bp, Mus musculus
gccagctggtctcagaatcctgcaa

SEQ ID NO: 445560 - DNA, 25 bp, Mus musculus
gccagctgtgagtaatggccacaca

SEQ ID NO: 445561 - DNA, 25 bp, Mus musculus
gccagctgtggatcctaaaattcat

SEQ ID NO: 445562 - DNA, 25 bp, Mus musculus
gccagcttcagcaaaaggatccaga

SEQ ID NO: 445563 - DNA, 25 bp, Mus musculus
gccagcttgatgaggaccgcagtct

SEQ ID NO: 445564 - DNA, 25 bp, Mus musculus
gccagcttggcgtgtacaaagcatt

SEQ ID NO: 445565 - DNA, 25 bp, Mus musculus
gccagcttgtgcagccacctttgga

SEQ ID NO: 445566 - DNA, 25 bp, Mus musculus
gccaggaatcagcaaagacttaaga

SEQ ID NO: 445567 - DNA, 25 bp, Mus musculus
gccaggaatgactctactcccctgt

SEQ ID NO: 445568 - DNA, 25 bp, Mus musculus
gccaggactcagtatcttggctaat

SEQ ID NO: 445569 - DNA, 25 bp, Mus musculus
gccaggactccattaaagccgctaa

SEQ ID NO: 445570 - DNA, 25 bp, Mus musculus
gccaggactgccgaaaggaaggtta

SEQ ID NO: 445571 - DNA, 25 bp, Mus musculus
gccaggagagcccactaatgtctta

SEQ ID NO: 445572 - DNA, 25 bp, Mus musculus
gccaggaggacaacacacttcttcg

SEQ ID NO: 445573 - DNA, 25 bp, Mus musculus
gccaggaggcgaaaactgcaaccgt

SEQ ID NO: 445574 - DNA, 25 bp, Mus musculus
gccaggagtctacgtacagccatct

SEQ ID NO: 445575 - DNA, 25 bp, Mus musculus
gccaggagtgtcttcttggaacaga

SEQ ID NO: 445576 - DNA, 25 bp, Mus musculus
gccaggatacatgatgcaatttaaa

SEQ ID NO: 445577 - DNA, 25 bp, Mus musculus
gccaggatcacagaactcacttcat

SEQ ID NO: 445578 - DNA, 25 bp, Mus musculus
gccaggatgagaagcaacaagcctt

SEQ ID NO: 445579 - DNA, 25 bp, Mus musculus
gccaggatttgagcggcagctgcct

SEQ ID NO: 445580 - DNA, 25 bp, Mus musculus
gccaggcaacaaatgagcttcatga

SEQ ID NO: 445581 - DNA, 25 bp, Mus musculus
gccaggcatgaacgctgagacttgc

SEQ ID NO: 445582 - DNA, 25 bp, Mus musculus
gccaggcattgttctagccatacaa

SEQ ID NO: 445583 - DNA, 25 bp, Mus musculus
gccaggcatttctctgagtacaaag

SEQ ID NO: 445584 - DNA, 25 bp, Mus musculus
gccaggccatgtcagaactacagaa

SEQ ID NO: 445585 - DNA, 25 bp, Mus musculus
gccaggccggccagataaagaaact

SEQ ID NO: 445586 - DNA, 25 bp, Mus musculus
gccaggctaaggacattttctataa

SEQ ID NO: 445587 - DNA, 25 bp, Mus musculus
gccaggctgaccacttcattggaaa

SEQ ID NO: 445588 - DNA, 25 bp, Mus musculus
gccaggctggcaatatacagagcag

SEQ ID NO: 445589 - DNA, 25 bp, Mus musculus
gccagggatcatgcgcacagtctat

SEQ ID NO: 445590 - DNA, 25 bp, Mus musculus
gccagggcttccgacttggagacca

SEQ ID NO: 445591 - DNA, 25 bp, Mus musculus
gccagggtctctctcaaacctgtga

SEQ ID NO: 445592 - DNA, 25 bp, Mus musculus
gccaggtcgccttccccagaaaagt

SEQ ID NO: 445593 - DNA, 25 bp, Mus musculus
gccaggtggaggtcttacatcgcca

SEQ ID NO: 445594 - DNA, 25 bp, Mus musculus
gccaggtgggcgtctagaaaggatg

SEQ ID NO: 445595 - DNA, 25 bp, Mus musculus
gccaggtggtaaatattcagagtcc

SEQ ID NO: 445596 - DNA, 25 bp, Mus musculus
gccaggtgtactgtgccaaggatca

SEQ ID NO: 445597 - DNA, 25 bp, Mus musculus
gccaggttgaccttactactctgta

SEQ ID NO: 445598 - DNA, 25 bp, Mus musculus
gccaggttttgacaactgtgccagg

SEQ ID NO: 445599 - DNA, 25 bp, Mus musculus
gccagtaaataaccacagcagtgta

SEQ ID NO: 445600 - DNA, 25 bp, Mus musculus
gccagtaactaaaatggcattctgc

SEQ ID NO: 445601 - DNA, 25 bp, Mus musculus
gccagtaagagctccacaggtatat

SEQ ID NO: 445602 - DNA, 25 bp, Mus musculus
gccagtaatcttcaagccagacctc

SEQ ID NO: 445603 - DNA, 25 bp, Mus musculus
gccagtatccagagtttacccggaa

SEQ ID NO: 445604 - DNA, 25 bp, Mus musculus
gccagtattgggagacttcagctac

SEQ ID NO: 445605 - DNA, 25 bp, Mus musculus
gccagtccatgggatacagcaggtg

SEQ ID NO: 445606 - DNA, 25 bp, Mus musculus
gccagtccatttgctgctgtctggg

SEQ ID NO: 445607 - DNA, 25 bp, Mus musculus
gccagtcccatgtccatcaacgagg

SEQ ID NO: 445608 - DNA, 25 bp, Mus musculus
gccagtctgcttaaatcttcaaagg

SEQ ID NO: 445609 - DNA, 25 bp, Mus musculus
gccagtgaaggtgcctgagaaccca

SEQ ID NO: 445610 - DNA, 25 bp, Mus musculus
gccagtgacagcttggacgcagtct

SEQ ID NO: 445611 - DNA, 25 bp, Mus musculus
gccagtgagtaactaactcccttac

SEQ ID NO: 445612 - DNA, 25 bp, Mus musculus
gccagtgctaggtttggaaatgaca

SEQ ID NO: 445613 - DNA, 25 bp, Mus musculus
gccagtgctgaaactcgtaagagaa

SEQ ID NO: 445614 - DNA, 25 bp, Mus musculus
gccagtggcattgtgttaaccgtaa

SEQ ID NO: 445615 - DNA, 25 bp, Mus musculus
gccagtggcctgaagaagttttaag

SEQ ID NO: 445616 - DNA, 25 bp, Mus musculus
gccagtgggtgcatcatacgctcta

SEQ ID NO: 445617 - DNA, 25 bp, Mus musculus
gccagtgtactgttgctcattaggg

SEQ ID NO: 445618 - DNA, 25 bp, Mus musculus
gccagtgtagcagtcttgacgcaga

SEQ ID NO: 445619 - DNA, 25 bp, Mus musculus
gccagtgtggcctagtcacaggcta

SEQ ID NO: 445620 - DNA, 25 bp, Mus musculus
gccagtgtgtacaaggcccgaaaca

SEQ ID NO: 445621 - DNA, 25 bp, Mus musculus
gccagtgtgtggtctaagccactga

SEQ ID NO: 445622 - DNA, 25 bp, Mus musculus
gccagttaacaagactatagcagca

SEQ ID NO: 445623 - DNA, 25 bp, Mus musculus
gccagttaagcgcttgcatccaagt

SEQ ID NO: 445624 - DNA, 25 bp, Mus musculus
gccagttacaagcaaggagatccca

SEQ ID NO: 445625 - DNA, 25 bp, Mus musculus
gccagttatctctgaggccactctg

SEQ ID NO: 445626 - DNA, 25 bp, Mus musculus
gccagttcgcggaagatcctcggat

SEQ ID NO: 445627 - DNA, 25 bp, Mus musculus
gccagttgccagaaccgctctttaa

SEQ ID NO: 445628 - DNA, 25 bp, Mus musculus
gccagtttctcggtagttgcagcag

SEQ ID NO: 445629 - DNA, 25 bp, Mus musculus
gccagtttctgaaccgcaagcagcg

SEQ ID NO: 445630 - DNA, 25 bp, Mus musculus
gccataaaatggaaatacccgcttt

SEQ ID NO: 445631 - DNA, 25 bp, Mus musculus
gccataaaggccctgcaagaatggt

SEQ ID NO: 445632 - DNA, 25 bp, Mus musculus
gccataagatgctacagtgaacgtc

SEQ ID NO: 445633 - DNA, 25 bp, Mus musculus
gccataagcttgtctccctggtctt

SEQ ID NO: 445634 - DNA, 25 bp, Mus musculus
gccataatgggagatacagacagca

SEQ ID NO: 445635 - DNA, 25 bp, Mus musculus
gccataatgggcaacccaagggtca

SEQ ID NO: 445636 - DNA, 25 bp, Mus musculus
gccataattgcctcgagccacgtag

SEQ ID NO: 445637 - DNA, 25 bp, Mus musculus
gccatacaatagtggactaagttaa

SEQ ID NO: 445638 - DNA, 25 bp, Mus musculus
gccataccgaggatgagcgtccatg

SEQ ID NO: 445639 - DNA, 25 bp, Mus musculus
gccatagcaatgtaaatttcatgag

SEQ ID NO: 445640 - DNA, 25 bp, Mus musculus
gccatagggatgctcttcatccact

SEQ ID NO: 445641 - DNA, 25 bp, Mus musculus
gccatatcaatattgctaaactgga

SEQ ID NO: 445642 - DNA, 25 bp, Mus musculus
gccatatggcgactactgtagctac

SEQ ID NO: 445643 - DNA, 25 bp, Mus musculus
gccatatttaatttctttgctgtaa

SEQ ID NO: 445644 - DNA, 25 bp, Mus musculus
gccatattttccagtattgtcacct

SEQ ID NO: 445645 - DNA, 25 bp, Mus musculus
gccatcaacatttcagagggtactt

SEQ ID NO: 445646 - DNA, 25 bp, Mus musculus
gccatcatagcaggtcacgcatcag

SEQ ID NO: 445647 - DNA, 25 bp, Mus musculus
gccatcatagttgataatgtatgtg

SEQ ID NO: 445648 - DNA, 25 bp, Mus musculus
gccatcatgctaggctctgtgtggt

SEQ ID NO: 445649 - DNA, 25 bp, Mus musculus
gccatcattcgtcggcccgagcgat

SEQ ID NO: 445650 - DNA, 25 bp, Mus musculus
gccatccagggagctttacagaaag

SEQ ID NO: 445651 - DNA, 25 bp, Mus musculus
gccatcccaggcagtatctacagaa

SEQ ID NO: 445652 - DNA, 25 bp, Mus musculus
gccatccgaggaggctcagagtgaa

SEQ ID NO: 445653 - DNA, 25 bp, Mus musculus
gccatcctaggaatatcggtgcaga

SEQ ID NO: 445654 - DNA, 25 bp, Mus musculus
gccatccttaggagacgtttccagg

SEQ ID NO: 445655 - DNA, 25 bp, Mus musculus
gccatcgagacatctctgcggctga

SEQ ID NO: 445656 - DNA, 25 bp, Mus musculus
gccatcgagatctgcgtctgagccg

SEQ ID NO: 445657 - DNA, 25 bp, Mus musculus
gccatcgcagtgttcgtcttgagga

SEQ ID NO: 445658 - DNA, 25 bp, Mus musculus
gccatcgtgaaaaaacagcttgtaa

SEQ ID NO: 445659 - DNA, 25 bp, Mus musculus
gccatcgtgtactcagcagaggaag

SEQ ID NO: 445660 - DNA, 25 bp, Mus musculus
gccatctcctttagggtctccagtg

SEQ ID NO: 445661 - DNA, 25 bp, Mus musculus
gccatctctgtatcaggcttctgga

SEQ ID NO: 445662 - DNA, 25 bp, Mus musculus
gccatctgtggagcgaatggaagcc

SEQ ID NO: 445663 - DNA, 25 bp, Mus musculus
gccatcttgagttttaggattattg

SEQ ID NO: 445664 - DNA, 25 bp, Mus musculus
gccatcttgctggtataaacaaagg

SEQ ID NO: 445665 - DNA, 25 bp, Mus musculus
gccatctttagagtggtccgagcca

SEQ ID NO: 445666 - DNA, 25 bp, Mus musculus
gccatgaaacaggtacgaggtgaaa

SEQ ID NO: 445667 - DNA, 25 bp, Mus musculus
gccatgaactttccgagtagtggcc

SEQ ID NO: 445668 - DNA, 25 bp, Mus musculus
gccatgacacaatccgagacctaga

SEQ ID NO: 445669 - DNA, 25 bp, Mus musculus
gccatgaccttgtgctatgccaggg

SEQ ID NO: 445670 - DNA, 25 bp, Mus musculus
gccatgactgtcagcaaccattggt

SEQ ID NO: 445671 - DNA, 25 bp, Mus musculus
gccatgactttaatataagttagct

SEQ ID NO: 445672 - DNA, 25 bp, Mus musculus
gccatgagaagcgtgtgaagctgca

SEQ ID NO: 445673 - DNA, 25 bp, Mus musculus
gccatgatagtagaagcctgctcct

SEQ ID NO: 445674 - DNA, 25 bp, Mus musculus
gccatgatcaagaaggacgggctca

SEQ ID NO: 445675 - DNA, 25 bp, Mus musculus
gccatgatcggaatgtggtcaccat

SEQ ID NO: 445676 - DNA, 25 bp, Mus musculus
gccatgccaaagacaggccccttaa

SEQ ID NO: 445677 - DNA, 25 bp, Mus musculus
gccatgcccaggatcaattctagaa

SEQ ID NO: 445678 - DNA, 25 bp, Mus musculus
gccatgcccagtgatcccagtttaa

SEQ ID NO: 445679 - DNA, 25 bp, Mus musculus
gccatgctgctagaagcagaactcg

SEQ ID NO: 445680 - DNA, 25 bp, Mus musculus
gccatggaaagagctgagaatcagt

SEQ ID NO: 445681 - DNA, 25 bp, Mus musculus
gccatggacgtcatgctgtgcaccg

SEQ ID NO: 445682 - DNA, 25 bp, Mus musculus
gccatggcagcagaccttctcagaa

SEQ ID NO: 445683 - DNA, 25 bp, Mus musculus
gccatggccatgctagctcggaaat

SEQ ID NO: 445684 - DNA, 25 bp, Mus musculus
gccatggcctatgtgctgtgcaaca

SEQ ID NO: 445685 - DNA, 25 bp, Mus musculus
gccatggctgggaatttaactttga

SEQ ID NO: 445686 - DNA, 25 bp, Mus musculus
gccatgggaaccagcaaagttgcct

SEQ ID NO: 445687 - DNA, 25 bp, Mus musculus
gccatgggactagatctgcaggaga

SEQ ID NO: 445688 - DNA, 25 bp, Mus musculus
gccatgggagcatgctgttactctc

SEQ ID NO: 445689 - DNA, 25 bp, Mus musculus
gccatgggtgactctgtctgtcctg

SEQ ID NO: 445690 - DNA, 25 bp, Mus musculus
gccatggtacaagggaaagtgactc

SEQ ID NO: 445691 - DNA, 25 bp, Mus musculus
gccatggtccatgaactactgggca

SEQ ID NO: 445692 - DNA, 25 bp, Mus musculus
gccatggtccgggacactgtcatga

SEQ ID NO: 445693 - DNA, 25 bp, Mus musculus
gccatggtgcactctgaaagtttga

SEQ ID NO: 445694 - DNA, 25 bp, Mus musculus
gccatggttctagtccaaacttgaa

SEQ ID NO: 445695 - DNA, 25 bp, Mus musculus
gccatgtcaaagagtacccagtgct

SEQ ID NO: 445696 - DNA, 25 bp, Mus musculus
gccatgtcactgcagacatttcctt

SEQ ID NO: 445697 - DNA, 25 bp, Mus musculus
gccatgtcatggaagggtcacccac

SEQ ID NO: 445698 - DNA, 25 bp, Mus musculus
gccatgtcccgctgttctgtaaata

SEQ ID NO: 445699 - DNA, 25 bp, Mus musculus
gccatgtccttcctgaaggatcatg

SEQ ID NO: 445700 - DNA, 25 bp, Mus musculus
gccatgtctccgagccaattggctg

SEQ ID NO: 445701 - DNA, 25 bp, Mus musculus
gccatgtctggaaagggcatcacca

SEQ ID NO: 445702 - DNA, 25 bp, Mus musculus
gccatgtctgtttactggtatccag

SEQ ID NO: 445703 - DNA, 25 bp, Mus musculus
gccatgtgactatccggcgggcagt

SEQ ID NO: 445704 - DNA, 25 bp, Mus musculus
gccatgtgtctcacaagtcaagacg

SEQ ID NO: 445705 - DNA, 25 bp, Mus musculus
gccatgttactgctcctaagtgcag

SEQ ID NO: 445706 - DNA, 25 bp, Mus musculus
gccatgttcgctgcagatcccaaaa

SEQ ID NO: 445707 - DNA, 25 bp, Mus musculus
gccatgttgacaaaggcacagcaga

SEQ ID NO: 445708 - DNA, 25 bp, Mus musculus
gccatgttgtactggagctctgtaa

SEQ ID NO: 445709 - DNA, 25 bp, Mus musculus
gccatgttgtcaacttgcccagaaa

SEQ ID NO: 445710 - DNA, 25 bp, Mus musculus
gccatgttgtggaaaataacagata

SEQ ID NO: 445711 - DNA, 25 bp, Mus musculus
gccatgtttccaggtgttcccggtt

SEQ ID NO: 445712 - DNA, 25 bp, Mus musculus
gccatgtttggagagttgttcttct

SEQ ID NO: 445713 - DNA, 25 bp, Mus musculus
gccattaatcccctcttgaagacct

SEQ ID NO: 445714 - DNA, 25 bp, Mus musculus
gccattacaatttggaattcttcac

SEQ ID NO: 445715 - DNA, 25 bp, Mus musculus
gccattagcagtagacagggtccca

SEQ ID NO: 445716 - DNA, 25 bp, Mus musculus
gccattaggaaaaaggacgagccca

SEQ ID NO: 445717 - DNA, 25 bp, Mus musculus
gccattatgaagatcacggcatcga

SEQ ID NO: 445718 - DNA, 25 bp, Mus musculus
gccattcacgaagggatccagaggg

SEQ ID NO: 445719 - DNA, 25 bp, Mus musculus
gccattccggatgcgctgagtgaga

SEQ ID NO: 445720 - DNA, 25 bp, Mus musculus
gccattctgaggagacagcacgaga

SEQ ID NO: 445721 - DNA, 25 bp, Mus musculus
gccattctggatgcgttgaagcacc

SEQ ID NO: 445722 - DNA, 25 bp, Mus musculus
gccattctgggaagaaacctcgtgt

SEQ ID NO: 445723 - DNA, 25 bp, Mus musculus
gccattcttttaactgccgagcctg

SEQ ID NO: 445724 - DNA, 25 bp, Mus musculus
gccattgaggctacattagaaaggg

SEQ ID NO: 445725 - DNA, 25 bp, Mus musculus
gccattgatcaaggcagggttcttg

SEQ ID NO: 445726 - DNA, 25 bp, Mus musculus
gccattgatggaatactttctatag

SEQ ID NO: 445727 - DNA, 25 bp, Mus musculus
gccattgccacgtgaacaaccattt

SEQ ID NO: 445728 - DNA, 25 bp, Mus musculus
gccattgcctcgaaaaccaaagaga

SEQ ID NO: 445729 - DNA, 25 bp, Mus musculus
gccattggtgcaggcctctgatcaa

SEQ ID NO: 445730 - DNA, 25 bp, Mus musculus
gccattgtacctacctggttcccta

SEQ ID NO: 445731 - DNA, 25 bp, Mus musculus
gccattgtgcctcttgggtctatag

SEQ ID NO: 445732 - DNA, 25 bp, Mus musculus
gccattgtgcgggtcagatttccag

SEQ ID NO: 445733 - DNA, 25 bp, Mus musculus
gccattgtggcagctgttcagggca

SEQ ID NO: 445734 - DNA, 25 bp, Mus musculus
gccatttccagcagggtagggtaac

SEQ ID NO: 445735 - DNA, 25 bp, Mus musculus
gccatttcctgtgtgaagcctagca

SEQ ID NO: 445736 - DNA, 25 bp, Mus musculus
gccatttctctcacccatagcatag

SEQ ID NO: 445737 - DNA, 25 bp, Mus musculus
gccatttgttagttggtgccgtcca

SEQ ID NO: 445738 - DNA, 25 bp, Mus musculus
gcccaaagccaagagtgagttcaac

SEQ ID NO: 445739 - DNA, 25 bp, Mus musculus
gcccaacacagccatgcggctgttt

SEQ ID NO: 445740 - DNA, 25 bp, Mus musculus
gcccaacagtaacaaagcgtgcgtt

SEQ ID NO: 445741 - DNA, 25 bp, Mus musculus
gcccaacatggctgactattactat

SEQ ID NO: 445742 - DNA, 25 bp, Mus musculus
gcccaacatttagacggagcttggg

SEQ ID NO: 445743 - DNA, 25 bp, Mus musculus
gcccaacccagctgaatgctgtgga

SEQ ID NO: 445744 - DNA, 25 bp, Mus musculus
gcccaactgttgtaagagctgacag

SEQ ID NO: 445745 - DNA, 25 bp, Mus musculus
gcccaagaactcagggagtgtctga

SEQ ID NO: 445746 - DNA, 25 bp, Mus musculus
gcccaagaagcgctcgttcatgatt

SEQ ID NO: 445747 - DNA, 25 bp, Mus musculus
gcccaagcgcatagtgtggctcctg

SEQ ID NO: 445748 - DNA, 25 bp, Mus musculus
gcccaagcttagtaacttcaaaagt

SEQ ID NO: 445749 - DNA, 25 bp, Mus musculus
gcccaaggaggaaatgatcacagct

SEQ ID NO: 445750 - DNA, 25 bp, Mus musculus
gcccaaggatgggaaaaatattcat

SEQ ID NO: 445751 - DNA, 25 bp, Mus musculus
gcccaaggcacacatcagctgtcat

SEQ ID NO: 445752 - DNA, 25 bp, Mus musculus
gcccaaggcctgatgtggcctccaa

SEQ ID NO: 445753 - DNA, 25 bp, Mus musculus
gcccaaggcctgtgcgaggtgctat

SEQ ID NO: 445754 - DNA, 25 bp, Mus musculus
gcccaagggcgtggatgtgcatcca

SEQ ID NO: 445755 - DNA, 25 bp, Mus musculus
gcccaaggtcacgagaccaagtgac

SEQ ID NO: 445756 - DNA, 25 bp, Mus musculus
gcccaagtccgaggtagtctcacta

SEQ ID NO: 445757 - DNA, 25 bp, Mus musculus
gcccaagtgtagaaacctctgaaaa

SEQ ID NO: 445758 - DNA, 25 bp, Mus musculus
gcccaatcatggtcgtcactcagct

SEQ ID NO: 445759 - DNA, 25 bp, Mus musculus
gcccaatccagatgaagatctccga

SEQ ID NO: 445760 - DNA, 25 bp, Mus musculus
gcccaatggcaggaaactgataggt

SEQ ID NO: 445761 - DNA, 25 bp, Mus musculus
gcccacaagggctggcattaaagat

SEQ ID NO: 445762 - DNA, 25 bp, Mus musculus
gcccacaatggctgacgaactgtat

SEQ ID NO: 445763 - DNA, 25 bp, Mus musculus
gcccacacaggaaaaggctgtcatt

SEQ ID NO: 445764 - DNA, 25 bp, Mus musculus
gcccacagaccgaagctgaagtgtt

SEQ ID NO: 445765 - DNA, 25 bp, Mus musculus
gcccacatcagcaagacactcgtta

SEQ ID NO: 445766 - DNA, 25 bp, Mus musculus
gcccacatggagtcgctttacagca

SEQ ID NO: 445767 - DNA, 25 bp, Mus musculus
gcccacatggatcaagaatttatcg

SEQ ID NO: 445768 - DNA, 25 bp, Mus musculus
gcccacattattcttctccgacatt

SEQ ID NO: 445769 - DNA, 25 bp, Mus musculus
gcccacctggagatctagaagacga

SEQ ID NO: 445770 - DNA, 25 bp, Mus musculus
gcccacctgggctagaatacttaaa

SEQ ID NO: 445771 - DNA, 25 bp, Mus musculus
gcccacggacgctcaggttaacttg

SEQ ID NO: 445772 - DNA, 25 bp, Mus musculus
gcccacggcctcttccggatgagga

SEQ ID NO: 445773 - DNA, 25 bp, Mus musculus
gcccacgtggtagctgtaacttcaa

SEQ ID NO: 445774 - DNA, 25 bp, Mus musculus
gcccacgtggtcttcacaattggaa

SEQ ID NO: 445775 - DNA, 25 bp, Mus musculus
gcccactctatggaggattcttgaa

SEQ ID NO: 445776 - DNA, 25 bp, Mus musculus
gcccactgtagtgacgctcttcgat

SEQ ID NO: 445777 - DNA, 25 bp, Mus musculus
gcccacttaaccacgcataacagag

SEQ ID NO: 445778 - DNA, 25 bp, Mus musculus
gcccacttgtgattcccacagtgta

SEQ ID NO: 445779 - DNA, 25 bp, Mus musculus
gcccagaaagtgagcatggctccag

SEQ ID NO: 445780 - DNA, 25 bp, Mus musculus
gcccagaacctgataagacaagata

SEQ ID NO: 445781 - DNA, 25 bp, Mus musculus
gcccagaactcgaggcgtctgctta

SEQ ID NO: 445782 - DNA, 25 bp, Mus musculus
gcccagaactgtgcggtcatgcaca

SEQ ID NO: 445783 - DNA, 25 bp, Mus musculus
gcccagaacttcgaggactggacca

SEQ ID NO: 445784 - DNA, 25 bp, Mus musculus
gcccagacacttaagttggaatggt

SEQ ID NO: 445785 - DNA, 25 bp, Mus musculus
gcccagacctcgcttaataagacgt

SEQ ID NO: 445786 - DNA, 25 bp, Mus musculus
gcccagacctgaatgctgtgctcca

SEQ ID NO: 445787 - DNA, 25 bp, Mus musculus
gcccagacgtccctggatgatggcc

SEQ ID NO: 445788 - DNA, 25 bp, Mus musculus
gcccagagaggtgtgcagcaagtta

SEQ ID NO: 445789 - DNA, 25 bp, Mus musculus
gcccagagagttgaaagtgccaaag

SEQ ID NO: 445790 - DNA, 25 bp, Mus musculus
gcccagagcggttgtttctacagta

SEQ ID NO: 445791 - DNA, 25 bp, Mus musculus
gcccagaggaaagaggcctgataca

SEQ ID NO: 445792 - DNA, 25 bp, Mus musculus
gcccagatcccgcaggacaggtcga

SEQ ID NO: 445793 - DNA, 25 bp, Mus musculus
gcccagattgtttctaagttgtatt

SEQ ID NO: 445794 - DNA, 25 bp, Mus musculus
gcccagcaactttgcgggctccagg

SEQ ID NO: 445795 - DNA, 25 bp, Mus musculus
gcccagcaaggccacaatgatgttg

SEQ ID NO: 445796 - DNA, 25 bp, Mus musculus
gcccagcatagggtgttagccccaa

SEQ ID NO: 445797 - DNA, 25 bp, Mus musculus
gcccagcatcgaaggataactttga

SEQ ID NO: 445798 - DNA, 25 bp, Mus musculus
gcccagcatggatagattaagaaat

SEQ ID NO: 445799 - DNA, 25 bp, Mus musculus
gcccagccctgcttttgtcagcgtg

SEQ ID NO: 445800 - DNA, 25 bp, Mus musculus
gcccagcgccgagcaaagactatta

SEQ ID NO: 445801 - DNA, 25 bp, Mus musculus
gcccagctccgagaaaagtcgcagt

SEQ ID NO: 445802 - DNA, 25 bp, Mus musculus
gcccagctgcagtttgatatgacaa

SEQ ID NO: 445803 - DNA, 25 bp, Mus musculus
gcccaggaggtaagttgatgcacac

SEQ ID NO: 445804 - DNA, 25 bp, Mus musculus
gcccagggaagcatgacggtgttaa

SEQ ID NO: 445805 - DNA, 25 bp, Mus musculus
gcccagggacccatgctcatatgag

SEQ ID NO: 445806 - DNA, 25 bp, Mus musculus
gcccagggacctatagaaatgcaga

SEQ ID NO: 445807 - DNA, 25 bp, Mus musculus
gcccagggctaaacgagaagagttg

SEQ ID NO: 445808 - DNA, 25 bp, Mus musculus
gcccaggtgacctgaactgaacaac

SEQ ID NO: 445809 - DNA, 25 bp, Mus musculus
gcccaggttgtacccgtgagagcca

SEQ ID NO: 445810 - DNA, 25 bp, Mus musculus
gcccagtagaagactatatgaactt

SEQ ID NO: 445811 - DNA, 25 bp, Mus musculus
gcccagtatccgtcagaagaaatta

SEQ ID NO: 445812 - DNA, 25 bp, Mus musculus
gcccagtcatgcaggaaaacctcag

SEQ ID NO: 445813 - DNA, 25 bp, Mus musculus
gcccagtggaagtacagatgactca

SEQ ID NO: 445814 - DNA, 25 bp, Mus musculus
gcccagtggctctagaaccgatgaa

SEQ ID NO: 445815 - DNA, 25 bp, Mus musculus
gcccagttaaggcacgggtagcact

SEQ ID NO: 445816 - DNA, 25 bp, Mus musculus
gcccatcagatagttcaaagcaaag

SEQ ID NO: 445817 - DNA, 25 bp, Mus musculus
gcccatccaggaactgctaatcaac

SEQ ID NO: 445818 - DNA, 25 bp, Mus musculus
gcccatctggtggtggtgacctcca

SEQ ID NO: 445819 - DNA, 25 bp, Mus musculus
gcccatcttgttaaacccgatatta

SEQ ID NO: 445820 - DNA, 25 bp, Mus musculus
gcccatggatcctgccaagaagaga

SEQ ID NO: 445821 - DNA, 25 bp, Mus musculus
gcccatgtaaatctaatgtgtcaag

SEQ ID NO: 445822 - DNA, 25 bp, Mus musculus
gcccatgtaacaacctgaaacagtc

SEQ ID NO: 445823 - DNA, 25 bp, Mus musculus
gcccatgtccaaactggagtcacag

SEQ ID NO: 445824 - DNA, 25 bp, Mus musculus
gcccatgtttaccactgcctctgaa

SEQ ID NO: 445825 - DNA, 25 bp, Mus musculus
gcccattccgaaggtagtcagataa

SEQ ID NO: 445826 - DNA, 25 bp, Mus musculus
gcccattggcactgagactctagag

SEQ ID NO: 445827 - DNA, 25 bp, Mus musculus
gcccattttcaaaggagctctccct

SEQ ID NO: 445828 - DNA, 25 bp, Mus musculus
gccccaaagaaagctccaagaaaga

SEQ ID NO: 445829 - DNA, 25 bp, Mus musculus
gccccaaatggccagtgtacaaatg

SEQ ID NO: 445830 - DNA, 25 bp, Mus musculus
gccccaactgaacgatcctgtggct

SEQ ID NO: 445831 - DNA, 25 bp, Mus musculus
gccccaactgtggagtggtctttac

SEQ ID NO: 445832 - DNA, 25 bp, Mus musculus
gccccaagcagctgaggaaacatcc

SEQ ID NO: 445833 - DNA, 25 bp, Mus musculus
gccccaagggtcctaaataccagat

SEQ ID NO: 445834 - DNA, 25 bp, Mus musculus
gccccactagggacgccgggttctg

SEQ ID NO: 445835 - DNA, 25 bp, Mus musculus
gccccactatgcctctgctggatgt

SEQ ID NO: 445836 - DNA, 25 bp, Mus musculus
gccccactctgaaaaaagacaccag

SEQ ID NO: 445837 - DNA, 25 bp, Mus musculus
gccccagaagtcttgctctaaggtg

SEQ ID NO: 445838 - DNA, 25 bp, Mus musculus
gccccagactgtaggttcatcgatg

SEQ ID NO: 445839 - DNA, 25 bp, Mus musculus
gccccagagaagcaatcaagtccct

SEQ ID NO: 445840 - DNA, 25 bp, Mus musculus
gccccagagacccaagtgatgttat

SEQ ID NO: 445841 - DNA, 25 bp, Mus musculus
gccccagagctactctgagtttttc

SEQ ID NO: 445842 - DNA, 25 bp, Mus musculus
gccccagccgcgagtatatgagaga

SEQ ID NO: 445843 - DNA, 25 bp, Mus musculus
gccccaggaaggaaatgatgcagct

SEQ ID NO: 445844 - DNA, 25 bp, Mus musculus
gccccatattgaagccgtgagcaac

SEQ ID NO: 445845 - DNA, 25 bp, Mus musculus
gccccatctgtgagaagcgcttcat

SEQ ID NO: 445846 - DNA, 25 bp, Mus musculus
gccccgaagttccaaagagatcctg

SEQ ID NO: 445847 - DNA, 25 bp, Mus musculus
gccccgacacacaggtagcatagga

SEQ ID NO: 445848 - DNA, 25 bp, Mus musculus
gccccgagccggaagatccatttca

SEQ ID NO: 445849 - DNA, 25 bp, Mus musculus
gccccgaggggtaggtactgtcatt

SEQ ID NO: 445850 - DNA, 25 bp, Mus musculus
gccccgcatggagcgggcatagctt

SEQ ID NO: 445851 - DNA, 25 bp, Mus musculus
gccccgccaagggatgggaaacagc

SEQ ID NO: 445852 - DNA, 25 bp, Mus musculus
gccccggagcgttggagtaatagcc

SEQ ID NO: 445853 - DNA, 25 bp, Mus musculus
gccccggcattttgaagtcgtaaca

SEQ ID NO: 445854 - DNA, 25 bp, Mus musculus
gccccgggacctgaaaatgctctgt

SEQ ID NO: 445855 - DNA, 25 bp, Mus musculus
gccccgggtgctgtatggaaaacct

SEQ ID NO: 445856 - DNA, 25 bp, Mus musculus
gccccggtggttgaaaatgatatcc

SEQ ID NO: 445857 - DNA, 25 bp, Mus musculus
gccccggttgctctgcaccttggag

SEQ ID NO: 445858 - DNA, 25 bp, Mus musculus
gccccgtgaccaagtctaagtaagt

SEQ ID NO: 445859 - DNA, 25 bp, Mus musculus
gccccgtggccgaaaatgataccct

SEQ ID NO: 445860 - DNA, 25 bp, Mus musculus
gcccctcccaagtgaagtgatccag

SEQ ID NO: 445861 - DNA, 25 bp, Mus musculus
gcccctcggttaaggacagcaagcc

SEQ ID NO: 445862 - DNA, 25 bp, Mus musculus
gcccctctttggtttggctaggtca

SEQ ID NO: 445863 - DNA, 25 bp, Mus musculus
gcccctgagaaaagggatgcttcat

SEQ ID NO: 445864 - DNA, 25 bp, Mus musculus
gcccctgagtatgagaaagctgcca

SEQ ID NO: 445865 - DNA, 25 bp, Mus musculus
gcccctgatgattgtcactcagaag

SEQ ID NO: 445866 - DNA, 25 bp, Mus musculus
gcccctgccaagtggcctagagctt

SEQ ID NO: 445867 - DNA, 25 bp, Mus musculus
gcccctgcgcgtaatggcagtgccg

SEQ ID NO: 445868 - DNA, 25 bp, Mus musculus
gcccctgctgtgatgccttctacaa

SEQ ID NO: 445869 - DNA, 25 bp, Mus musculus
gcccctggaagtgaatccaacagtg

SEQ ID NO: 445870 - DNA, 25 bp, Mus musculus
gcccctgggattggagactcctcat

SEQ ID NO: 445871 - DNA, 25 bp, Mus musculus
gcccctggtggccaggatcctgcat

SEQ ID NO: 445872 - DNA, 25 bp, Mus musculus
gcccctgttgggagtctaactctga

SEQ ID NO: 445873 - DNA, 25 bp, Mus musculus
gccccttaatagtgaaggtcagaat

SEQ ID NO: 445874 - DNA, 25 bp, Mus musculus
gccccttgggatatatttggcaacc

SEQ ID NO: 445875 - DNA, 25 bp, Mus musculus
gcccctttgggctctagggtcacat

SEQ ID NO: 445876 - DNA, 25 bp, Mus musculus
gccccttttctgtgtgctccttcga

SEQ ID NO: 445877 - DNA, 25 bp, Mus musculus
gcccgaaaatgctattggcacctta

SEQ ID NO: 445878 - DNA, 25 bp, Mus musculus
gcccgaaactggatcacctggagag

SEQ ID NO: 445879 - DNA, 25 bp, Mus musculus
gcccgaagactcgaagaacgccatg

SEQ ID NO: 445880 - DNA, 25 bp, Mus musculus
gcccgaagcacctagaaagacgatg

SEQ ID NO: 445881 - DNA, 25 bp, Mus musculus
gcccgaattttaagcagcacccagg

SEQ ID NO: 445882 - DNA, 25 bp, Mus musculus
gcccgagccgtgttcttcccggatt

SEQ ID NO: 445883 - DNA, 25 bp, Mus musculus
gcccgaggccgtagatccagggctc

SEQ ID NO: 445884 - DNA, 25 bp, Mus musculus
gcccgagttcatggtgtcagtcagc

SEQ ID NO: 445885 - DNA, 25 bp, Mus musculus
gcccgattggcaaaatacttactat

SEQ ID NO: 445886 - DNA, 25 bp, Mus musculus
gcccgatttctgaagatcccgagaa

SEQ ID NO: 445887 - DNA, 25 bp, Mus musculus
gcccgcaccaaaagagcagggtgta

SEQ ID NO: 445888 - DNA, 25 bp, Mus musculus
gcccgcacggtaagaagctgtcaga

SEQ ID NO: 445889 - DNA, 25 bp, Mus musculus
gcccgcacttagacaacactcagag

SEQ ID NO: 445890 - DNA, 25 bp, Mus musculus
gcccgcagcgatagccatggaagtt

SEQ ID NO: 445891 - DNA, 25 bp, Mus musculus
gcccgcatttagttctgtgccggaa

SEQ ID NO: 445892 - DNA, 25 bp, Mus musculus
gcccgccatggccgacaaaatggac

SEQ ID NO: 445893 - DNA, 25 bp, Mus musculus
gcccgcccgatgtacgtaagcttgg

SEQ ID NO: 445894 - DNA, 25 bp, Mus musculus
gcccgccgaggtgctgtaaatgctg

SEQ ID NO: 445895 - DNA, 25 bp, Mus musculus
gcccgcctgtgatgtgcatattaaa

SEQ ID NO: 445896 - DNA, 25 bp, Mus musculus
gcccgcgatggtctcaaaattgcta

SEQ ID NO: 445897 - DNA, 25 bp, Mus musculus
gcccgcgcaagtggcagaacagcat

SEQ ID NO: 445898 - DNA, 25 bp, Mus musculus
gcccgctcaacctggcttacttgta

SEQ ID NO: 445899 - DNA, 25 bp, Mus musculus
gcccgcttttctcaggtaggactgt

SEQ ID NO: 445900 - DNA, 25 bp, Mus musculus
gcccggaactcctttattgtactga

SEQ ID NO: 445901 - DNA, 25 bp, Mus musculus
gcccggaagagaaagcgaactagca

SEQ ID NO: 445902 - DNA, 25 bp, Mus musculus
gcccggactcgtgctgctagaagga

SEQ ID NO: 445903 - DNA, 25 bp, Mus musculus
gcccggagggcttagtccctagcca

SEQ ID NO: 445904 - DNA, 25 bp, Mus musculus
gcccggatctcatatgtgctaggta

SEQ ID NO: 445905 - DNA, 25 bp, Mus musculus
gcccggcaagatccagaggcacctg

SEQ ID NO: 445906 - DNA, 25 bp, Mus musculus
gcccggcagcacattttatctaaca

SEQ ID NO: 445907 - DNA, 25 bp, Mus musculus
gcccggcagctcatttccatgggag

SEQ ID NO: 445908 - DNA, 25 bp, Mus musculus
gcccggcagggagccaatgaaatca

SEQ ID NO: 445909 - DNA, 25 bp, Mus musculus
gcccggcatgtgagagagcagctct

SEQ ID NO: 445910 - DNA, 25 bp, Mus musculus
gcccggcctggcttgatcaacttgg

SEQ ID NO: 445911 - DNA, 25 bp, Mus musculus
gcccggcggaaatgaggtctacaaa

SEQ ID NO: 445912 - DNA, 25 bp, Mus musculus
gcccggctaacatgtcaggttttaa

SEQ ID NO: 445913 - DNA, 25 bp, Mus musculus
gcccggctatcctgtcttccttaat

SEQ ID NO: 445914 - DNA, 25 bp, Mus musculus
gcccgggactctcggtcattctgat

SEQ ID NO: 445915 - DNA, 25 bp, Mus musculus
gcccgggcagcgacaagcagcagca

SEQ ID NO: 445916 - DNA, 25 bp, Mus musculus
gcccgggccaggaatgttgcatgaa

SEQ ID NO: 445917 - DNA, 25 bp, Mus musculus
gcccgggctgtcactctaggaatgc

SEQ ID NO: 445918 - DNA, 25 bp, Mus musculus
gcccgggtacctgtggcaacttaca

SEQ ID NO: 445919 - DNA, 25 bp, Mus musculus
gcccgggtacttcaccagctaacta

SEQ ID NO: 445920 - DNA, 25 bp, Mus musculus
gcccgggtatcctcattctaacaac

SEQ ID NO: 445921 - DNA, 25 bp, Mus musculus
gcccgtcagcacatcgaggagttga

SEQ ID NO: 445922 - DNA, 25 bp, Mus musculus
gcccgtcagcttcgtgctagactgt

SEQ ID NO: 445923 - DNA, 25 bp, Mus musculus
gcccgtcagtacatctcagttcaga

SEQ ID NO: 445924 - DNA, 25 bp, Mus musculus
gcccgtcattctcacgtaatcgata

SEQ ID NO: 445925 - DNA, 25 bp, Mus musculus
gcccgtccataaagcgctgctggct

SEQ ID NO: 445926 - DNA, 25 bp, Mus musculus
gcccgtcctcctttgacttcttgaa

SEQ ID NO: 445927 - DNA, 25 bp, Mus musculus
gcccgtctgctgaagcacgtagtaa

SEQ ID NO: 445928 - DNA, 25 bp, Mus musculus
gcccgtgaaggtgcaaacgtccact

SEQ ID NO: 445929 - DNA, 25 bp, Mus musculus
gcccgtgaccgagagagttagctga

SEQ ID NO: 445930 - DNA, 25 bp, Mus musculus
gcccgtgatagcagagacattcgag

SEQ ID NO: 445931 - DNA, 25 bp, Mus musculus
gcccgtggaccgaaagctgtctaag

SEQ ID NO: 445932 - DNA, 25 bp, Mus musculus
gcccgtggccatcctgagtctttga

SEQ ID NO: 445933 - DNA, 25 bp, Mus musculus
gcccgtgtcatgcttctgcatagca

SEQ ID NO: 445934 - DNA, 25 bp, Mus musculus
gcccgtgtgcaccagatgatcaaga

SEQ ID NO: 445935 - DNA, 25 bp, Mus musculus
gcccgttaaacttccctgagtggag

SEQ ID NO: 445936 - DNA, 25 bp, Mus musculus
gcccgttaagggaagtagctactct

SEQ ID NO: 445937 - DNA, 25 bp, Mus musculus
gcccgtttgatattgtagtccaggg

SEQ ID NO: 445938 - DNA, 25 bp, Mus musculus
gcccgtttggtcactggaggatatg

SEQ ID NO: 445939 - DNA, 25 bp, Mus musculus
gccctaaaaaggataggcaagtgca

SEQ ID NO: 445940 - DNA, 25 bp, Mus musculus
gccctaagggagaaagaatgctcac

SEQ ID NO: 445941 - DNA, 25 bp, Mus musculus
gccctaatttttactatggcaatgt

SEQ ID NO: 445942 - DNA, 25 bp, Mus musculus
gccctacctgcattgttggatcctg

SEQ ID NO: 445943 - DNA, 25 bp, Mus musculus
gccctagaccaggaactctgcaagt

SEQ ID NO: 445944 - DNA, 25 bp, Mus musculus
gccctagagagcactctaggctgtg

SEQ ID NO: 445945 - DNA, 25 bp, Mus musculus
gccctaggatcatagacaagatgaa

SEQ ID NO: 445946 - DNA, 25 bp, Mus musculus
gccctagtggcttctgaggccaaga

SEQ ID NO: 445947 - DNA, 25 bp, Mus musculus
gccctatcagtcaacagcagtgcca

SEQ ID NO: 445948 - DNA, 25 bp, Mus musculus
gccctatcatgggagacgttgacat

SEQ ID NO: 445949 - DNA, 25 bp, Mus musculus
gccctatgggcactcaagctggatg

SEQ ID NO: 445950 - DNA, 25 bp, Mus musculus
gccctattgcttctctctaggataa

SEQ ID NO: 445951 - DNA, 25 bp, Mus musculus
gccctatttcatctgcgacgaggaa

SEQ ID NO: 445952 - DNA, 25 bp, Mus musculus
gccctcagcagtagtgttcttcaga

SEQ ID NO: 445953 - DNA, 25 bp, Mus musculus
gccctcaggtcaagcgcgagttgag

SEQ ID NO: 445954 - DNA, 25 bp, Mus musculus
gccctcatcactgctgggcgatgga

SEQ ID NO: 445955 - DNA, 25 bp, Mus musculus
gccctccgtgtgctggaattgaatg

SEQ ID NO: 445956 - DNA, 25 bp, Mus musculus
gccctcgaatagagagcttcctgga

SEQ ID NO: 445957 - DNA, 25 bp, Mus musculus
gccctcgctgtggtgttccggataa

SEQ ID NO: 445958 - DNA, 25 bp, Mus musculus
gccctcgcttccagatgatgcaatg

SEQ ID NO: 445959 - DNA, 25 bp, Mus musculus
gccctctgcatggtaggcatggaaa

SEQ ID NO: 445960 - DNA, 25 bp, Mus musculus
gccctctggatcaggccattggcct

SEQ ID NO: 445961 - DNA, 25 bp, Mus musculus
gccctctgggaacctatcaccataa

SEQ ID NO: 445962 - DNA, 25 bp, Mus musculus
gccctgaagtaagcagaagcgccgc

SEQ ID NO: 445963 - DNA, 25 bp, Mus musculus
gccctgaattcactcgggtgtattg

SEQ ID NO: 445964 - DNA, 25 bp, Mus musculus
gccctgaccagctgcgggtttgact

SEQ ID NO: 445965 - DNA, 25 bp, Mus musculus
gccctgaccgtgcagttcgtgaccg

SEQ ID NO: 445966 - DNA, 25 bp, Mus musculus
gccctgagcatcttgtctgagcagt

SEQ ID NO: 445967 - DNA, 25 bp, Mus musculus
gccctgaggataggtccgtctccat

SEQ ID NO: 445968 - DNA, 25 bp, Mus musculus
gccctgagggcatgtggcttgatca

SEQ ID NO: 445969 - DNA, 25 bp, Mus musculus
gccctgagtgtagttgccatccacg

SEQ ID NO: 445970 - DNA, 25 bp, Mus musculus
gccctgcagagaaagtaagtaatgc

SEQ ID NO: 445971 - DNA, 25 bp, Mus musculus
gccctgcagcagatgaataaatgta

SEQ ID NO: 445972 - DNA, 25 bp, Mus musculus
gccctgcagtgacaggactggctca

SEQ ID NO: 445973 - DNA, 25 bp, Mus musculus
gccctgccgggctctctgtgaggat

SEQ ID NO: 445974 - DNA, 25 bp, Mus musculus
gccctgcctgtctcccattgtctgg

SEQ ID NO: 445975 - DNA, 25 bp, Mus musculus
gccctgcgtaaagtgatggccccag

SEQ ID NO: 445976 - DNA, 25 bp, Mus musculus
gccctgctaatcttgaaaatatgga

SEQ ID NO: 445977 - DNA, 25 bp, Mus musculus
gccctgctcagtcttcctggacttg

SEQ ID NO: 445978 - DNA, 25 bp, Mus musculus
gccctgctgctcagacctgcttgaa

SEQ ID NO: 445979 - DNA, 25 bp, Mus musculus
gccctgctgctttgcaacgggatga

SEQ ID NO: 445980 - DNA, 25 bp, Mus musculus
gccctgctggccctgtgtctcagtt

SEQ ID NO: 445981 - DNA, 25 bp, Mus musculus
gccctgctgggaatgtgaccgaaaa

SEQ ID NO: 445982 - DNA, 25 bp, Mus musculus
gccctgcttctagctttgaacctgg

SEQ ID NO: 445983 - DNA, 25 bp, Mus musculus
gccctgctttccagatgctttggag

SEQ ID NO: 445984 - DNA, 25 bp, Mus musculus
gccctggacacacagcttttcattt

SEQ ID NO: 445985 - DNA, 25 bp, Mus musculus
gccctggaggatgctatgacaccaa

SEQ ID NO: 445986 - DNA, 25 bp, Mus musculus
gccctggagttaatggtgcccctgg

SEQ ID NO: 445987 - DNA, 25 bp, Mus musculus
gccctggcagctacgtggtattcct

SEQ ID NO: 445988 - DNA, 25 bp, Mus musculus
gccctggcatagcatttcgccctga

SEQ ID NO: 445989 - DNA, 25 bp, Mus musculus
gccctggctgtacggaattcacaag

SEQ ID NO: 445990 - DNA, 25 bp, Mus musculus
gccctgggccagagaatcacctttt

SEQ ID NO: 445991 - DNA, 25 bp, Mus musculus
gccctgggccagtttgtcatgaaga

SEQ ID NO: 445992 - DNA, 25 bp, Mus musculus
gccctgggcccagaagaatgaccaa

SEQ ID NO: 445993 - DNA, 25 bp, Mus musculus
gccctggttatggagtgtgctcgct

SEQ ID NO: 445994 - DNA, 25 bp, Mus musculus
gccctggttctatccaactagtgaa

SEQ ID NO: 445995 - DNA, 25 bp, Mus musculus
gccctgtagggtttgctcaccagct

SEQ ID NO: 445996 - DNA, 25 bp, Mus musculus
gccctgtatcctcagctacattaaa

SEQ ID NO: 445997 - DNA, 25 bp, Mus musculus
gccctgtgcactagaatccttaata

SEQ ID NO: 445998 - DNA, 25 bp, Mus musculus
gccctgtggctctgatcggttccga

SEQ ID NO: 445999 - DNA, 25 bp, Mus musculus
gccctgttactggtgctagagctaa

SEQ ID NO: 446000 - DNA, 25 bp, Mus musculus
gccctgttggaaaggaactaacaat

SEQ ID NO: 446001 - DNA, 25 bp, Mus musculus
gccctgttttctttggtagccggag

SEQ ID NO: 446002 - DNA, 25 bp, Mus musculus
gcccttaggctgcttcgggtacagc

SEQ ID NO: 446003 - DNA, 25 bp, Mus musculus
gcccttcagaggacgtaggcttaga

SEQ ID NO: 446004 - DNA, 25 bp, Mus musculus
gcccttcagcaatggagagatacag

SEQ ID NO: 446005 - DNA, 25 bp, Mus musculus
gcccttcagtgattgtgtgtcaaca

SEQ ID NO: 446006 - DNA, 25 bp, Mus musculus
gcccttcatgtttgctaccggagag

SEQ ID NO: 446007 - DNA, 25 bp, Mus musculus
gcccttcccgtgacagcctatgata

SEQ ID NO: 446008 - DNA, 25 bp, Mus musculus
gcccttccggtgagatcgagagcgt

SEQ ID NO: 446009 - DNA, 25 bp, Mus musculus
gcccttcgagttgttggagccaccg

SEQ ID NO: 446010 - DNA, 25 bp, Mus musculus
gcccttcggtaccacagcatcatga

SEQ ID NO: 446011 - DNA, 25 bp, Mus musculus
gcccttctgagaacatggcccaaga

SEQ ID NO: 446012 - DNA, 25 bp, Mus musculus
gcccttcttctcttgcaataagtca

SEQ ID NO: 446013 - DNA, 25 bp, Mus musculus
gcccttgaccttgggaaacacaatg

SEQ ID NO: 446014 - DNA, 25 bp, Mus musculus
gcccttgagcctagtcgtgataaca

SEQ ID NO: 446015 - DNA, 25 bp, Mus musculus
gcccttggtgccagccattcattga

SEQ ID NO: 446016 - DNA, 25 bp, Mus musculus
gcccttgtagagtatgcagcagtca

SEQ ID NO: 446017 - DNA, 25 bp, Mus musculus
gcccttgtagctttacccacagtta

SEQ ID NO: 446018 - DNA, 25 bp, Mus musculus
gcccttgtgcgagaacttgaagtga

SEQ ID NO: 446019 - DNA, 25 bp, Mus musculus
gcccttgtggctgctgtcagaagca

SEQ ID NO: 446020 - DNA, 25 bp, Mus musculus
gccctttcaacaatgaggcaggttt

SEQ ID NO: 446021 - DNA, 25 bp, Mus musculus
gccctttgattaatttgcaactgac

SEQ ID NO: 446022 - DNA, 25 bp, Mus musculus
gccctttgcggtgggcagcatctga

SEQ ID NO: 446023 - DNA, 25 bp, Mus musculus
gccctttgtcatagtgtttacttcc

SEQ ID NO: 446024 - DNA, 25 bp, Mus musculus
gcccttttgcttactggatgggatt

SEQ ID NO: 446025 - DNA, 25 bp, Mus musculus
gccgaaaatttttcaaggatcctca

SEQ ID NO: 446026 - DNA, 25 bp, Mus musculus
gccgaaagctgcacgaggactgaat

SEQ ID NO: 446027 - DNA, 25 bp, Mus musculus
gccgaacacaagaagctggaagctg

SEQ ID NO: 446028 - DNA, 25 bp, Mus musculus
gccgaacagcagaaggcgcaattca

SEQ ID NO: 446029 - DNA, 25 bp, Mus musculus
gccgaacctactgtgcaagaaatga

SEQ ID NO: 446030 - DNA, 25 bp, Mus musculus
gccgaacggcgtgtaggcgccatct

SEQ ID NO: 446031 - DNA, 25 bp, Mus musculus
gccgaagaactaaaagactgcccca

SEQ ID NO: 446032 - DNA, 25 bp, Mus musculus
gccgaagactccaacagcctaggta

SEQ ID NO: 446033 - DNA, 25 bp, Mus musculus
gccgaagagtcccatgacagcgatg

SEQ ID NO: 446034 - DNA, 25 bp, Mus musculus
gccgaagcgccgtgcagcgctgcgg

SEQ ID NO: 446035 - DNA, 25 bp, Mus musculus
gccgaatcccggagctatgtctgaa

SEQ ID NO: 446036 - DNA, 25 bp, Mus musculus
gccgaatgtcgcagaaccttagata

SEQ ID NO: 446037 - DNA, 25 bp, Mus musculus
gccgacaagaatatgcacacaatgc

SEQ ID NO: 446038 - DNA, 25 bp, Mus musculus
gccgacccctatgccagtggaaaaa

SEQ ID NO: 446039 - DNA, 25 bp, Mus musculus
gccgaccctcgctgagaactgactt

SEQ ID NO: 446040 - DNA, 25 bp, Mus musculus
gccgaccgaagcttgcggtccgact

SEQ ID NO: 446041 - DNA, 25 bp, Mus musculus
gccgaccgagctgtctaatatctca

SEQ ID NO: 446042 - DNA, 25 bp, Mus musculus
gccgaccgggagattgaacacgcat

SEQ ID NO: 446043 - DNA, 25 bp, Mus musculus
gccgagaagctgtacccgctgccgg

SEQ ID NO: 446044 - DNA, 25 bp, Mus musculus
gccgagatgagctcctaatagatta

SEQ ID NO: 446045 - DNA, 25 bp, Mus musculus
gccgagcggatctagcagccatata

SEQ ID NO: 446046 - DNA, 25 bp, Mus musculus
gccgaggagccaaatattagcgcga

SEQ ID NO: 446047 - DNA, 25 bp, Mus musculus
gccgagggaccaaaggctgtctcct

SEQ ID NO: 446048 - DNA, 25 bp, Mus musculus
gccgaggtccagagtggaccccaga

SEQ ID NO: 446049 - DNA, 25 bp, Mus musculus
gccgagtctggcctagcatatgtga

SEQ ID NO: 446050 - DNA, 25 bp, Mus musculus
gccgagtgggcattacagacctttc

SEQ ID NO: 446051 - DNA, 25 bp, Mus musculus
gccgagtgtctgtgcgtttatcata

SEQ ID NO: 446052 - DNA, 25 bp, Mus musculus
gccgagtttagctttggacagaccg

SEQ ID NO: 446053 - DNA, 25 bp, Mus musculus
gccgatcaggtttcgactggcgtct

SEQ ID NO: 446054 - DNA, 25 bp, Mus musculus
gccgatccaacgaagggcagatata

SEQ ID NO: 446055 - DNA, 25 bp, Mus musculus
gccgatcgaagccagaaatgcagcc

SEQ ID NO: 446056 - DNA, 25 bp, Mus musculus
gccgatcgcttcgagctggagctca

SEQ ID NO: 446057 - DNA, 25 bp, Mus musculus
gccgatctacggtggtaccaacgaa

SEQ ID NO: 446058 - DNA, 25 bp, Mus musculus
gccgatctggacaggaccttagcaa

SEQ ID NO: 446059 - DNA, 25 bp, Mus musculus
gccgatgaccatactgcagaagagc

SEQ ID NO: 446060 - DNA, 25 bp, Mus musculus
gccgattcatggatgggagccccta

SEQ ID NO: 446061 - DNA, 25 bp, Mus musculus
gccgatttccagacagcataggtgg

SEQ ID NO: 446062 - DNA, 25 bp, Mus musculus
gccgcacaagatcctaccatgaaga

SEQ ID NO: 446063 - DNA, 25 bp, Mus musculus
gccgcagcatgctagcagcactcat

SEQ ID NO: 446064 - DNA, 25 bp, Mus musculus
gccgcaggaagtgcaaaccacagat

SEQ ID NO: 446065 - DNA, 25 bp, Mus musculus
gccgcatcatggacagggtgccctt

SEQ ID NO: 446066 - DNA, 25 bp, Mus musculus
gccgcatcttgtactcgtcgctcag

SEQ ID NO: 446067 - DNA, 25 bp, Mus musculus
gccgccaggctctgccagtttgcta

SEQ ID NO: 446068 - DNA, 25 bp, Mus musculus
gccgcccaatgagcagtctagtctt

SEQ ID NO: 446069 - DNA, 25 bp, Mus musculus
gccgccgcctgagcaaagtgaatga

SEQ ID NO: 446070 - DNA, 25 bp, Mus musculus
gccgccgcggtatctgcagagtctg

SEQ ID NO: 446071 - DNA, 25 bp, Mus musculus
gccgccggatgctttgaagttgccc

SEQ ID NO: 446072 - DNA, 25 bp, Mus musculus
gccgccgttaggagaaccctgcgtt

SEQ ID NO: 446073 - DNA, 25 bp, Mus musculus
gccgcctgaaggacatgcataaaag

SEQ ID NO: 446074 - DNA, 25 bp, Mus musculus
gccgcctggacgagatactttgtag

SEQ ID NO: 446075 - DNA, 25 bp, Mus musculus
gccgcctgggactacaagtacctga

SEQ ID NO: 446076 - DNA, 25 bp, Mus musculus
gccgcctttgatgttctgactggtg

SEQ ID NO: 446077 - DNA, 25 bp, Mus musculus
gccgcgaccgcgatggctacagcta

SEQ ID NO: 446078 - DNA, 25 bp, Mus musculus
gccgcgagtcgtccttgaccgtagc

SEQ ID NO: 446079 - DNA, 25 bp, Mus musculus
gccgcgccatgcaagtggccaaggt

SEQ ID NO: 446080 - DNA, 25 bp, Mus musculus
gccgcgctgctggatttgaccgaga

SEQ ID NO: 446081 - DNA, 25 bp, Mus musculus
gccgcggacagttcttaaagggcca

SEQ ID NO: 446082 - DNA, 25 bp, Mus musculus
gccgcggcgagtctgcattctgctt

SEQ ID NO: 446083 - DNA, 25 bp, Mus musculus
gccgcggcggcggaggctagtgggt

SEQ ID NO: 446084 - DNA, 25 bp, Mus musculus
gccgcgggcgcttgcagcgtcttct

SEQ ID NO: 446085 - DNA, 25 bp, Mus musculus
gccgcggtttctggacaggttcagt

SEQ ID NO: 446086 - DNA, 25 bp, Mus musculus
gccgcgtgtgctttattgactatga

SEQ ID NO: 446087 - DNA, 25 bp, Mus musculus
gccgcgttgatgagcgcactagctg

SEQ ID NO: 446088 - DNA, 25 bp, Mus musculus
gccgctagtggccttacgtaagctc

SEQ ID NO: 446089 - DNA, 25 bp, Mus musculus
gccgctatgcccctaatcgacgtag

SEQ ID NO: 446090 - DNA, 25 bp, Mus musculus
gccgctctgggactgagcacagaat

SEQ ID NO: 446091 - DNA, 25 bp, Mus musculus
gccgctctgggtgcacgttcttagg

SEQ ID NO: 446092 - DNA, 25 bp, Mus musculus
gccgctcttgcttccaatgctaaca

SEQ ID NO: 446093 - DNA, 25 bp, Mus musculus
gccgctgaaactgactgcacctgtg

SEQ ID NO: 446094 - DNA, 25 bp, Mus musculus
gccgctgacaaagaaaaaccagaag

SEQ ID NO: 446095 - DNA, 25 bp, Mus musculus
gccgctgacccaggttgttttccag

SEQ ID NO: 446096 - DNA, 25 bp, Mus musculus
gccgctgcaactccatccgtgtgga

SEQ ID NO: 446097 - DNA, 25 bp, Mus musculus
gccgctgcagctgtttgtggaccac

SEQ ID NO: 446098 - DNA, 25 bp, Mus musculus
gccgctggagcaccttcactgtggt

SEQ ID NO: 446099 - DNA, 25 bp, Mus musculus
gccgctggccacagtagctcttggt

SEQ ID NO: 446100 - DNA, 25 bp, Mus musculus
gccgctgtcaaattctaaggcgact

SEQ ID NO: 446101 - DNA, 25 bp, Mus musculus
gccgctgtccccaaggagtttgcca

SEQ ID NO: 446102 - DNA, 25 bp, Mus musculus
gccgctgtttattaggctctgagct

SEQ ID NO: 446103 - DNA, 25 bp, Mus musculus
gccgcttcatctctataagtctttt

SEQ ID NO: 446104 - DNA, 25 bp, Mus musculus
gccgcttcggattcttggaccagac

SEQ ID NO: 446105 - DNA, 25 bp, Mus musculus
gccgcttgtgagatatggctttctc

SEQ ID NO: 446106 - DNA, 25 bp, Mus musculus
gccgcttttggccacgctacgtgaa

SEQ ID NO: 446107 - DNA, 25 bp, Mus musculus
gccggaagatcctcgggcgtcgcct

SEQ ID NO: 446108 - DNA, 25 bp, Mus musculus
gccggaagattccacgccaattcat

SEQ ID NO: 446109 - DNA, 25 bp, Mus musculus
gccggaagcgctttttgattggctg

SEQ ID NO: 446110 - DNA, 25 bp, Mus musculus
gccggaagttgcatctcagtcatca

SEQ ID NO: 446111 - DNA, 25 bp, Mus musculus
gccggacaccctttagtatcgcaga

SEQ ID NO: 446112 - DNA, 25 bp, Mus musculus
gccggacaggccactagaaaattca

SEQ ID NO: 446113 - DNA, 25 bp, Mus musculus
gccggaccctggatgacatgtcaga

SEQ ID NO: 446114 - DNA, 25 bp, Mus musculus
gccggactgaaaaacttaaatgtcg

SEQ ID NO: 446115 - DNA, 25 bp, Mus musculus
gccggactttcaggatggcactaag

SEQ ID NO: 446116 - DNA, 25 bp, Mus musculus
gccggagactctgtttgaaattgta

SEQ ID NO: 446117 - DNA, 25 bp, Mus musculus
gccggaggatagagaacaggactca

SEQ ID NO: 446118 - DNA, 25 bp, Mus musculus
gccggagtcgcaccgtattcactga

SEQ ID NO: 446119 - DNA, 25 bp, Mus musculus
gccggatgctttgaagttgccctca

SEQ ID NO: 446120 - DNA, 25 bp, Mus musculus
gccggcaacttttatccagctcgaa

SEQ ID NO: 446121 - DNA, 25 bp, Mus musculus
gccggcaagacaacgatcctgtaca

SEQ ID NO: 446122 - DNA, 25 bp, Mus musculus
gccggcagtgctagctttattttta

SEQ ID NO: 446123 - DNA, 25 bp, Mus musculus
gccggccgctcacaagaaagtaaga

SEQ ID NO: 446124 - DNA, 25 bp, Mus musculus
gccggcggttcaaatgggccattga

SEQ ID NO: 446125 - DNA, 25 bp, Mus musculus
gccggctctcacaggatcagactgt

SEQ ID NO: 446126 - DNA, 25 bp, Mus musculus
gccggctgcagtacacagagtacca

SEQ ID NO: 446127 - DNA, 25 bp, Mus musculus
gccggctgcgctttgataaggtcct

SEQ ID NO: 446128 - DNA, 25 bp, Mus musculus
gccggcttagtcgagctggattaca

SEQ ID NO: 446129 - DNA, 25 bp, Mus musculus
gccgggaaagtagtcgtggccatca

SEQ ID NO: 446130 - DNA, 25 bp, Mus musculus
gccgggactctggtacattaatatt

SEQ ID NO: 446131 - DNA, 25 bp, Mus musculus
gccgggagaacagggtatgataacc

SEQ ID NO: 446132 - DNA, 25 bp, Mus musculus
gccgggagttgggtttcaccagctc

SEQ ID NO: 446133 - DNA, 25 bp, Mus musculus
gccgggagtttgtcggccgcctcca

SEQ ID NO: 446134 - DNA, 25 bp, Mus musculus
gccgggatggtggatatgatttcaa

SEQ ID NO: 446135 - DNA, 25 bp, Mus musculus
gccgggccaccagctttgatagtca

SEQ ID NO: 446136 - DNA, 25 bp, Mus musculus
gccgggccatgacgagaaactacga

SEQ ID NO: 446137 - DNA, 25 bp, Mus musculus
gccgggccatgcagctagcgttaaa

SEQ ID NO: 446138 - DNA, 25 bp, Mus musculus
gccgggccgctctaaggtcttcaat

SEQ ID NO: 446139 - DNA, 25 bp, Mus musculus
gccgggctctgtacagcgcggctta

SEQ ID NO: 446140 - DNA, 25 bp, Mus musculus
gccgggcttggaatccgccacaggt

SEQ ID NO: 446141 - DNA, 25 bp, Mus musculus
gccgggtctgactcatttctgtaca

SEQ ID NO: 446142 - DNA, 25 bp, Mus musculus
gccgggttccgctgttggtcatcat

SEQ ID NO: 446143 - DNA, 25 bp, Mus musculus
gccggtaccccagtgaatatttaga

SEQ ID NO: 446144 - DNA, 25 bp, Mus musculus
gccggtaccgtgtgcatcagaacta

SEQ ID NO: 446145 - DNA, 25 bp, Mus musculus
gccggtacctggaagatgcgcagca

SEQ ID NO: 446146 - DNA, 25 bp, Mus musculus
gccggtgaatccctgtctggactga

SEQ ID NO: 446147 - DNA, 25 bp, Mus musculus
gccggtgaccatgagcagtttgcta

SEQ ID NO: 446148 - DNA, 25 bp, Mus musculus
gccggtgcggaatcgctccttcaac

SEQ ID NO: 446149 - DNA, 25 bp, Mus musculus
gccggttccccgcaggtaactgaat

SEQ ID NO: 446150 - DNA, 25 bp, Mus musculus
gccggttcctgtggagaaacaaact

SEQ ID NO: 446151 - DNA, 25 bp, Mus musculus
gccggttctccattgcctgtctcat

SEQ ID NO: 446152 - DNA, 25 bp, Mus musculus
gccgtagcaggagcttaagccccat

SEQ ID NO: 446153 - DNA, 25 bp, Mus musculus
gccgtaggtggagtgtttgtcattc

SEQ ID NO: 446154 - DNA, 25 bp, Mus musculus
gccgtcatcttccaatggtgaagtg

SEQ ID NO: 446155 - DNA, 25 bp, Mus musculus
gccgtccgtagtgctgcgctcattt

SEQ ID NO: 446156 - DNA, 25 bp, Mus musculus
gccgtcgttgagttacctttatttg

SEQ ID NO: 446157 - DNA, 25 bp, Mus musculus
gccgtctaacgctggcagccatcta

SEQ ID NO: 446158 - DNA, 25 bp, Mus musculus
gccgtctaccgctgggacaagaaga

SEQ ID NO: 446159 - DNA, 25 bp, Mus musculus
gccgtctcggcaggaaaagtttcta

SEQ ID NO: 446160 - DNA, 25 bp, Mus musculus
gccgtgagtctagaggctcagacct

SEQ ID NO: 446161 - DNA, 25 bp, Mus musculus
gccgtgattggtgctagtgtctcca

SEQ ID NO: 446162 - DNA, 25 bp, Mus musculus
gccgtgcggtggacactctactaag

SEQ ID NO: 446163 - DNA, 25 bp, Mus musculus
gccgtgctcgtagcttagaaataca

SEQ ID NO: 446164 - DNA, 25 bp, Mus musculus
gccgtggactcaaatgggaacatca

SEQ ID NO: 446165 - DNA, 25 bp, Mus musculus
gccgtggagggaatctttctagcta

SEQ ID NO: 446166 - DNA, 25 bp, Mus musculus
gccgtggcaatagcaccgaggttta

SEQ ID NO: 446167 - DNA, 25 bp, Mus musculus
gccgtggcacattcctttgatgtta

SEQ ID NO: 446168 - DNA, 25 bp, Mus musculus
gccgtggcaggctagcctccgtctg

SEQ ID NO: 446169 - DNA, 25 bp, Mus musculus
gccgtggcccgatgcctctgaaatt

SEQ ID NO: 446170 - DNA, 25 bp, Mus musculus
gccgtggcgcttatcagaggaagat

SEQ ID NO: 446171 - DNA, 25 bp, Mus musculus
gccgtggctgggaagaaactctcta

SEQ ID NO: 446172 - DNA, 25 bp, Mus musculus
gccgtggtccctacagtgagtgagt

SEQ ID NO: 446173 - DNA, 25 bp, Mus musculus
gccgtgtttgcactacaggtgctga

SEQ ID NO: 446174 - DNA, 25 bp, Mus musculus
gccgttatcagcatcctggtgggta

SEQ ID NO: 446175 - DNA, 25 bp, Mus musculus
gccgttccagtgcatggtgtgccaa

SEQ ID NO: 446176 - DNA, 25 bp, Mus musculus
gccgttgccataagtctcctgagag

SEQ ID NO: 446177 - DNA, 25 bp, Mus musculus
gccgtttccgtctgtagagttccat

SEQ ID NO: 446178 - DNA, 25 bp, Mus musculus
gccgtttctctccttatcttactgg

SEQ ID NO: 446179 - DNA, 25 bp, Mus musculus
gccgtttgaaggagcaggtgaccct

SEQ ID NO: 446180 - DNA, 25 bp, Mus musculus
gccgtttgttctggctccgagagcg

SEQ ID NO: 446181 - DNA, 25 bp, Mus musculus
gcctaaaatgccttaatgattggaa

SEQ ID NO: 446182 - DNA, 25 bp, Mus musculus
gcctaaactcttctgtcggtctgta

SEQ ID NO: 446183 - DNA, 25 bp, Mus musculus
gcctaaatgtttctgtcaggagaga

SEQ ID NO: 446184 - DNA, 25 bp, Mus musculus
gcctaacccatagagtgacccaaga

SEQ ID NO: 446185 - DNA, 25 bp, Mus musculus
gcctaactacctgtctgtgtgtttg

SEQ ID NO: 446186 - DNA, 25 bp, Mus musculus
gcctaactaggattcttgaggatgt

SEQ ID NO: 446187 - DNA, 25 bp, Mus musculus
gcctaagaatgacatccagtacctg

SEQ ID NO: 446188 - DNA, 25 bp, Mus musculus
gcctaagaggacagaaccagcaaca

SEQ ID NO: 446189 - DNA, 25 bp, Mus musculus
gcctaagtctgcttttgcactggca

SEQ ID NO: 446190 - DNA, 25 bp, Mus musculus
gcctaagttagaccacaaagagaac

SEQ ID NO: 446191 - DNA, 25 bp, Mus musculus
gcctaatagtcaagctgcctgatga

SEQ ID NO: 446192 - DNA, 25 bp, Mus musculus
gcctaatgacctagatgactccgta

SEQ ID NO: 446193 - DNA, 25 bp, Mus musculus
gcctaatgctttggaataaggatgt

SEQ ID NO: 446194 - DNA, 25 bp, Mus musculus
gcctacaagcccaagggatatcccg

SEQ ID NO: 446195 - DNA, 25 bp, Mus musculus
gcctacaagctctaaggtgcatgaa

SEQ ID NO: 446196 - DNA, 25 bp, Mus musculus
gcctacaagtcaacgctgcctgaat

SEQ ID NO: 446197 - DNA, 25 bp, Mus musculus
gcctacacagtgaagaaccgatcct

SEQ ID NO: 446198 - DNA, 25 bp, Mus musculus
gcctacatcgacagccttatggcgg

SEQ ID NO: 446199 - DNA, 25 bp, Mus musculus
gcctacatgatatttcaagggctgt

SEQ ID NO: 446200 - DNA, 25 bp, Mus musculus
gcctacatgtatggctgtgcggata

SEQ ID NO: 446201 - DNA, 25 bp, Mus musculus
gcctacccacttgctcttgagaaga

SEQ ID NO: 446202 - DNA, 25 bp, Mus musculus
gcctacggcttgtctgctgaagtaa

SEQ ID NO: 446203 - DNA, 25 bp, Mus musculus
gcctacgtgttggtgctgactgaaa

SEQ ID NO: 446204 - DNA, 25 bp, Mus musculus
gcctacgtttgtcctggatcccgcg

SEQ ID NO: 446205 - DNA, 25 bp, Mus musculus
gcctactcctacatgggcaacgaga

SEQ ID NO: 446206 - DNA, 25 bp, Mus musculus
gcctactcttggtgctgtgttgaac

SEQ ID NO: 446207 - DNA, 25 bp, Mus musculus
gcctacttcagcaggtaaactgtcc

SEQ ID NO: 446208 - DNA, 25 bp, Mus musculus
gcctacttcatctgcatttgtattg

SEQ ID NO: 446209 - DNA, 25 bp, Mus musculus
gcctactttattgacagcagcacat

SEQ ID NO: 446210 - DNA, 25 bp, Mus musculus
gcctagaaccctaccatgcactaag

SEQ ID NO: 446211 - DNA, 25 bp, Mus musculus
gcctagaagccagcgtagaccttga

SEQ ID NO: 446212 - DNA, 25 bp, Mus musculus
gcctagaagccatcgagctggatga

SEQ ID NO: 446213 - DNA, 25 bp, Mus musculus
gcctagaaggctcattctcatcttg

SEQ ID NO: 446214 - DNA, 25 bp, Mus musculus
gcctagacttgtagatgaatagact

SEQ ID NO: 446215 - DNA, 25 bp, Mus musculus
gcctagagggcttcgcacaggtgat

SEQ ID NO: 446216 - DNA, 25 bp, Mus musculus
gcctagatgagaagcccgttccttc

SEQ ID NO: 446217 - DNA, 25 bp, Mus musculus
gcctagattcagatttgtcagatgg

SEQ ID NO: 446218 - DNA, 25 bp, Mus musculus
gcctagattgcaagaagctcgcccg

SEQ ID NO: 446219 - DNA, 25 bp, Mus musculus
gcctagcaaatgaatattccgccat

SEQ ID NO: 446220 - DNA, 25 bp, Mus musculus
gcctagcagatgtccctcgagagtg

SEQ ID NO: 446221 - DNA, 25 bp, Mus musculus
gcctagcagggagggctcattctga

SEQ ID NO: 446222 - DNA, 25 bp, Mus musculus
gcctagcagttgtggtgaacatctt

SEQ ID NO: 446223 - DNA, 25 bp, Mus musculus
gcctagcatcccctctcaagagaga

SEQ ID NO: 446224 - DNA, 25 bp, Mus musculus
gcctagcggaggatggagatacaca

SEQ ID NO: 446225 - DNA, 25 bp, Mus musculus
gcctaggaaacgcaaggatctgctt

SEQ ID NO: 446226 - DNA, 25 bp, Mus musculus
gcctaggacaatgcttcagttacag

SEQ ID NO: 446227 - DNA, 25 bp, Mus musculus
gcctaggaggccttcagtagcgata

SEQ ID NO: 446228 - DNA, 25 bp, Mus musculus
gcctaggatctactgagtgctttga

SEQ ID NO: 446229 - DNA, 25 bp, Mus musculus
gcctaggcaggtcttaaacttgtaa

SEQ ID NO: 446230 - DNA, 25 bp, Mus musculus
gcctaggctgctctcagaacttttg

SEQ ID NO: 446231 - DNA, 25 bp, Mus musculus
gcctagtaatggttcgccacggtga

SEQ ID NO: 446232 - DNA, 25 bp, Mus musculus
gcctagtggccctagaaaagaagta

SEQ ID NO: 446233 - DNA, 25 bp, Mus musculus
gcctagtgtgatgaagaccttgccc

SEQ ID NO: 446234 - DNA, 25 bp, Mus musculus
gcctatacctatgagcggacactga

SEQ ID NO: 446235 - DNA, 25 bp, Mus musculus
gcctatagggtcagcacctaggcag

SEQ ID NO: 446236 - DNA, 25 bp, Mus musculus
gcctatagtgtttggccaggctgcc

SEQ ID NO: 446237 - DNA, 25 bp, Mus musculus
gcctatataaatcacttggacacat

SEQ ID NO: 446238 - DNA, 25 bp, Mus musculus
gcctatgacacgttgagcctggaca

SEQ ID NO: 446239 - DNA, 25 bp, Mus musculus
gcctatgatgcagagagacagctca

SEQ ID NO: 446240 - DNA, 25 bp, Mus musculus
gcctatggaggttgggtcccctaga

SEQ ID NO: 446241 - DNA, 25 bp, Mus musculus
gcctatggctcctaagaaatttttg

SEQ ID NO: 446242 - DNA, 25 bp, Mus musculus
gcctatgtgcctattaacagataag

SEQ ID NO: 446243 - DNA, 25 bp, Mus musculus
gcctatgtggtctatgaggacatct

SEQ ID NO: 446244 - DNA, 25 bp, Mus musculus
gcctatgtgtatcacaatgagaatg

SEQ ID NO: 446245 - DNA, 25 bp, Mus musculus
gcctattctgagcagattgtcccca

SEQ ID NO: 446246 - DNA, 25 bp, Mus musculus
gcctattgttaacccctgatgagaa

SEQ ID NO: 446247 - DNA, 25 bp, Mus musculus
gcctatttataaacatgtcacatcc

SEQ ID NO: 446248 - DNA, 25 bp, Mus musculus
gcctcaaacgaggagatcagctact

SEQ ID NO: 446249 - DNA, 25 bp, Mus musculus
gcctcaaacttgtgaacctccggtg

SEQ ID NO: 446250 - DNA, 25 bp, Mus musculus
gcctcaaagggacaagataactgcc

SEQ ID NO: 446251 - DNA, 25 bp, Mus musculus
gcctcaaatgagtctagctgtctag

SEQ ID NO: 446252 - DNA, 25 bp, Mus musculus
gcctcaagtgcaggtccaagatgaa

SEQ ID NO: 446253 - DNA, 25 bp, Mus musculus
gcctcacacgggaaaggctgctcct

SEQ ID NO: 446254 - DNA, 25 bp, Mus musculus
gcctcacctgcatagtaagaccctt

SEQ ID NO: 446255 - DNA, 25 bp, Mus musculus
gcctcactggagaacgcgctggagc

SEQ ID NO: 446256 - DNA, 25 bp, Mus musculus
gcctcagaaaagaaacgtctagatt

SEQ ID NO: 446257 - DNA, 25 bp, Mus musculus
gcctcagaagacagcacctgtaata

SEQ ID NO: 446258 - DNA, 25 bp, Mus musculus
gcctcagagcaaagagcactctttc

SEQ ID NO: 446259 - DNA, 25 bp, Mus musculus
gcctcagatgcaatgcaggccatca

SEQ ID NO: 446260 - DNA, 25 bp, Mus musculus
gcctcagccgtgaaatccatcattt

SEQ ID NO: 446261 - DNA, 25 bp, Mus musculus
gcctcagcctttccctgaagtgaca

SEQ ID NO: 446262 - DNA, 25 bp, Mus musculus
gcctcaggcccgagtacaaaggaca

SEQ ID NO: 446263 - DNA, 25 bp, Mus musculus
gcctcagggaattatacaagaccag

SEQ ID NO: 446264 - DNA, 25 bp, Mus musculus
gcctcaggtaaagggtgagactcac

SEQ ID NO: 446265 - DNA, 25 bp, Mus musculus
gcctcaggtccgtgccatggtgaaa

SEQ ID NO: 446266 - DNA, 25 bp, Mus musculus
gcctcaggttcgataagccccagga

SEQ ID NO: 446267 - DNA, 25 bp, Mus musculus
gcctcagtacctgggaagagtggct

SEQ ID NO: 446268 - DNA, 25 bp, Mus musculus
gcctcagtacgtgggtatccggctc

SEQ ID NO: 446269 - DNA, 25 bp, Mus musculus
gcctcagtttcttatctatgcggtg

SEQ ID NO: 446270 - DNA, 25 bp, Mus musculus
gcctcataaacagccgtgcggtgga

SEQ ID NO: 446271 - DNA, 25 bp, Mus musculus
gcctcatatagcctagacttgtctt

SEQ ID NO: 446272 - DNA, 25 bp, Mus musculus
gcctcatcattggtgggcacctgtt

SEQ ID NO: 446273 - DNA, 25 bp, Mus musculus
gcctcatctcaaagctgggtaccag

SEQ ID NO: 446274 - DNA, 25 bp, Mus musculus
gcctcatctgctgggctagggacta

SEQ ID NO: 446275 - DNA, 25 bp, Mus musculus
gcctcatgaagccaagagtcgctgt

SEQ ID NO: 446276 - DNA, 25 bp, Mus musculus
gcctcattggaggaacaggtcccac

SEQ ID NO: 446277 - DNA, 25 bp, Mus musculus
gcctcatttgagcaagagcctggga

SEQ ID NO: 446278 - DNA, 25 bp, Mus musculus
gcctccacctgtcaagtgctaggac

SEQ ID NO: 446279 - DNA, 25 bp, Mus musculus
gcctccagatggaacaggactagaa

SEQ ID NO: 446280 - DNA, 25 bp, Mus musculus
gcctccagcataaagggacgcatgg

SEQ ID NO: 446281 - DNA, 25 bp, Mus musculus
gcctccaggctcctgaaagggccat

SEQ ID NO: 446282 - DNA, 25 bp, Mus musculus
gcctccagggaggtgtaaggatcct

SEQ ID NO: 446283 - DNA, 25 bp, Mus musculus
gcctccagggtagacagggctgtca

SEQ ID NO: 446284 - DNA, 25 bp, Mus musculus
gcctccataggcacaaaattggcag

SEQ ID NO: 446285 - DNA, 25 bp, Mus musculus
gcctcccagggaagtatagtcaatg

SEQ ID NO: 446286 - DNA, 25 bp, Mus musculus
gcctccccagagatgcaaagcaagt

SEQ ID NO: 446287 - DNA, 25 bp, Mus musculus
gcctccccggtggatgtggtaaaga

SEQ ID NO: 446288 - DNA, 25 bp, Mus musculus
gcctcccgggctcctaacattgaag

SEQ ID NO: 446289 - DNA, 25 bp, Mus musculus
gcctccctcgttcttaccttctgtg

SEQ ID NO: 446290 - DNA, 25 bp, Mus musculus
gcctccctggatgattgacgtacaa

SEQ ID NO: 446291 - DNA, 25 bp, Mus musculus
gcctccctgggaccgttgttcataa

SEQ ID NO: 446292 - DNA, 25 bp, Mus musculus
gcctccgaaagggaacgagattctg

SEQ ID NO: 446293 - DNA, 25 bp, Mus musculus
gcctccgaggagactgcatttgttg

SEQ ID NO: 446294 - DNA, 25 bp, Mus musculus
gcctccggaataaaacccatgtgaa

SEQ ID NO: 446295 - DNA, 25 bp, Mus musculus
gcctccggacctgtattgggaacaa

SEQ ID NO: 446296 - DNA, 25 bp, Mus musculus
gcctccggagatttaagcgagaact

SEQ ID NO: 446297 - DNA, 25 bp, Mus musculus
gcctccgtgttctgatgctgcgcaa

SEQ ID NO: 446298 - DNA, 25 bp, Mus musculus
gcctcctaagtgcaagggccatcac

SEQ ID NO: 446299 - DNA, 25 bp, Mus musculus
gcctcctcctgtagctgaatgtctg

SEQ ID NO: 446300 - DNA, 25 bp, Mus musculus
gcctcctcgcctggtcaatagtgaa

SEQ ID NO: 446301 - DNA, 25 bp, Mus musculus
gcctcctgaaagtgagggcttttac

SEQ ID NO: 446302 - DNA, 25 bp, Mus musculus
gcctcctgaaggaaaaatagacctc

SEQ ID NO: 446303 - DNA, 25 bp, Mus musculus
gcctcctgatgcctgccatttgtga

SEQ ID NO: 446304 - DNA, 25 bp, Mus musculus
gcctcctgcaagagccaggcttgtc

SEQ ID NO: 446305 - DNA, 25 bp, Mus musculus
gcctcctgccttgtgacacatcctg

SEQ ID NO: 446306 - DNA, 25 bp, Mus musculus
gcctcctggatagtaagtagccact

SEQ ID NO: 446307 - DNA, 25 bp, Mus musculus
gcctccttgattagcaagcagtatc

SEQ ID NO: 446308 - DNA, 25 bp, Mus musculus
gcctcgactgtgtgtgtacatgctg

SEQ ID NO: 446309 - DNA, 25 bp, Mus musculus
gcctcgaggcttgtcggtgactaga

SEQ ID NO: 446310 - DNA, 25 bp, Mus musculus
gcctcgatttcatccagcagcagaa

SEQ ID NO: 446311 - DNA, 25 bp, Mus musculus
gcctcgcaggcgtcaagagtgtgtg

SEQ ID NO: 446312 - DNA, 25 bp, Mus musculus
gcctcgcagttgtgtctggtagagt

SEQ ID NO: 446313 - DNA, 25 bp, Mus musculus
gcctcgccgctgttgtacgtgtaca

SEQ ID NO: 446314 - DNA, 25 bp, Mus musculus
gcctcgcgctgtgagtatacaactg

SEQ ID NO: 446315 - DNA, 25 bp, Mus musculus
gcctcgctacgataggtaatgatat

SEQ ID NO: 446316 - DNA, 25 bp, Mus musculus
gcctcggagacgaggcccaactcat

SEQ ID NO: 446317 - DNA, 25 bp, Mus musculus
gcctcggagggatgtatttcaacaa

SEQ ID NO: 446318 - DNA, 25 bp, Mus musculus
gcctcggatccaaaaagtacagtta

SEQ ID NO: 446319 - DNA, 25 bp, Mus musculus
gcctcggatggcaccctgattcagg

SEQ ID NO: 446320 - DNA, 25 bp, Mus musculus
gcctcggcctttgatcaagatggaa

SEQ ID NO: 446321 - DNA, 25 bp, Mus musculus
gcctcggcgacctgcgcgacatgat

SEQ ID NO: 446322 - DNA, 25 bp, Mus musculus
gcctcgggccgaaggtttccgacag

SEQ ID NO: 446323 - DNA, 25 bp, Mus musculus
gcctcggtttgcagccaggaacctg

SEQ ID NO: 446324 - DNA, 25 bp, Mus musculus
gcctcgtcagatgggaacacacctg

SEQ ID NO: 446325 - DNA, 25 bp, Mus musculus
gcctcgtcgtgttcctggtgttgca

SEQ ID NO: 446326 - DNA, 25 bp, Mus musculus
gcctcgtggagtccccgacgaaaag

SEQ ID NO: 446327 - DNA, 25 bp, Mus musculus
gcctcgtgggaccaagcaactctta

SEQ ID NO: 446328 - DNA, 25 bp, Mus musculus
gcctcgtgtggctgtataactcggt

SEQ ID NO: 446329 - DNA, 25 bp, Mus musculus
gcctcgttcttctagattctgggac

SEQ ID NO: 446330 - DNA, 25 bp, Mus musculus
gcctctaaggattatgtttggatta

SEQ ID NO: 446331 - DNA, 25 bp, Mus musculus
gcctctatgagggtcgtcgtgcacc

SEQ ID NO: 446332 - DNA, 25 bp, Mus musculus
gcctctcacaggtacttaactttgg

SEQ ID NO: 446333 - DNA, 25 bp, Mus musculus
gcctctcaccatcgaaggcagctgg

SEQ ID NO: 446334 - DNA, 25 bp, Mus musculus
gcctctcagccaggttaagcagatt

SEQ ID NO: 446335 - DNA, 25 bp, Mus musculus
gcctctcatgcattgtgacaagctg

SEQ ID NO: 446336 - DNA, 25 bp, Mus musculus
gcctctccaccttgacttccagctg

SEQ ID NO: 446337 - DNA, 25 bp, Mus musculus
gcctctcctggttattgtttgcaag

SEQ ID NO: 446338 - DNA, 25 bp, Mus musculus
gcctctcgccccagaaatgagctgg

SEQ ID NO: 446339 - DNA, 25 bp, Mus musculus
gcctctcggtagtggtctgcctgga

SEQ ID NO: 446340 - DNA, 25 bp, Mus musculus
gcctctctctgcaagaatgtctgag

SEQ ID NO: 446341 - DNA, 25 bp, Mus musculus
gcctctcttgagtgctaagccagga

SEQ ID NO: 446342 - DNA, 25 bp, Mus musculus
gcctctgacaggaggcaccgagccc

SEQ ID NO: 446343 - DNA, 25 bp, Mus musculus
gcctctgagcagagagtagcctgtg

SEQ ID NO: 446344 - DNA, 25 bp, Mus musculus
gcctctgaggaatctggccgctgcc

SEQ ID NO: 446345 - DNA, 25 bp, Mus musculus
gcctctgatgtgtgggcagcatact

SEQ ID NO: 446346 - DNA, 25 bp, Mus musculus
gcctctgcgtggaatgtgctttcaa

SEQ ID NO: 446347 - DNA, 25 bp, Mus musculus
gcctctgctctttgctgttggccca

SEQ ID NO: 446348 - DNA, 25 bp, Mus musculus
gcctctgggacgtacgtggtctcca

SEQ ID NO: 446349 - DNA, 25 bp, Mus musculus
gcctctgtagatgcttgggagctaa

SEQ ID NO: 446350 - DNA, 25 bp, Mus musculus
gcctctgtgggtcgaatatcctgat

SEQ ID NO: 446351 - DNA, 25 bp, Mus musculus
gcctctgtgtggaggtgacctagca

SEQ ID NO: 446352 - DNA, 25 bp, Mus musculus
gcctctgttttgtggctaaaagctg

SEQ ID NO: 446353 - DNA, 25 bp, Mus musculus
gcctcttcctgcgtgcgcggtgatg

SEQ ID NO: 446354 - DNA, 25 bp, Mus musculus
gcctcttctagcaagtagttcccag

SEQ ID NO: 446355 - DNA, 25 bp, Mus musculus
gcctcttgacctacatggtacgaga

SEQ ID NO: 446356 - DNA, 25 bp, Mus musculus
gcctcttgacctgattgctataatg

SEQ ID NO: 446357 - DNA, 25 bp, Mus musculus
gcctcttgaggatgcagttgaaaat

SEQ ID NO: 446358 - DNA, 25 bp, Mus musculus
gcctcttggcaaagaactgagctgg

SEQ ID NO: 446359 - DNA, 25 bp, Mus musculus
gcctcttggtatccagtcttcactg

SEQ ID NO: 446360 - DNA, 25 bp, Mus musculus
gcctcttgttattgttgggatcgca

SEQ ID NO: 446361 - DNA, 25 bp, Mus musculus
gcctctttatagctgtgacccttga

SEQ ID NO: 446362 - DNA, 25 bp, Mus musculus
gcctctttcgaattagtgctgggat

SEQ ID NO: 446363 - DNA, 25 bp, Mus musculus
gcctgaaaggagttatctagtgcca

SEQ ID NO: 446364 - DNA, 25 bp, Mus musculus
gcctgaacacatttcggagaacaag

SEQ ID NO: 446365 - DNA, 25 bp, Mus musculus
gcctgaacaggaacagctaagcttc

SEQ ID NO: 446366 - DNA, 25 bp, Mus musculus
gcctgaacaggagcactataatggt

SEQ ID NO: 446367 - DNA, 25 bp, Mus musculus
gcctgaacccacagacgtaaaagtc

SEQ ID NO: 446368 - DNA, 25 bp, Mus musculus
gcctgaactgatatggctcccagaa

SEQ ID NO: 446369 - DNA, 25 bp, Mus musculus
gcctgaagacctccgtgtgccagga

SEQ ID NO: 446370 - DNA, 25 bp, Mus musculus
gcctgaagagctagcacacgctggt

SEQ ID NO: 446371 - DNA, 25 bp, Mus musculus
gcctgaaggcggaactggatgacct

SEQ ID NO: 446372 - DNA, 25 bp, Mus musculus
gcctgaaggtattagaaagccctgg

SEQ ID NO: 446373 - DNA, 25 bp, Mus musculus
gcctgaaggtgctactcaacgctga

SEQ ID NO: 446374 - DNA, 25 bp, Mus musculus
gcctgaagtatgaaattgtccctag

SEQ ID NO: 446375 - DNA, 25 bp, Mus musculus
gcctgaagtgaatttccagaagcag

SEQ ID NO: 446376 - DNA, 25 bp, Mus musculus
gcctgaatctcaaacagcgtgggta

SEQ ID NO: 446377 - DNA, 25 bp, Mus musculus
gcctgacaaaggatgcacacaatgc

SEQ ID NO: 446378 - DNA, 25 bp, Mus musculus
gcctgacaatctgtaccccgaggag

SEQ ID NO: 446379 - DNA, 25 bp, Mus musculus
gcctgacaggaaagtgtttctgcca

SEQ ID NO: 446380 - DNA, 25 bp, Mus musculus
gcctgacagggtctttcacgctaga

SEQ ID NO: 446381 - DNA, 25 bp, Mus musculus
gcctgacagtctctttcacataaca

SEQ ID NO: 446382 - DNA, 25 bp, Mus musculus
gcctgactaaggctcagtctgctaa

SEQ ID NO: 446383 - DNA, 25 bp, Mus musculus
gcctgactgctgaaacgctcttttt

SEQ ID NO: 446384 - DNA, 25 bp, Mus musculus
gcctgagacattcctcgcttgggaa

SEQ ID NO: 446385 - DNA, 25 bp, Mus musculus
gcctgagattctgataacatgcctg

SEQ ID NO: 446386 - DNA, 25 bp, Mus musculus
gcctgagcagcatgtttccgaaaga

SEQ ID NO: 446387 - DNA, 25 bp, Mus musculus
gcctgagccagggaacactgttgtt

SEQ ID NO: 446388 - DNA, 25 bp, Mus musculus
gcctgagccggtgcaaacactagat

SEQ ID NO: 446389 - DNA, 25 bp, Mus musculus
gcctgaggaacaactgggcaccttg

SEQ ID NO: 446390 - DNA, 25 bp, Mus musculus
gcctgaggactactccatgtgtgga

SEQ ID NO: 446391 - DNA, 25 bp, Mus musculus
gcctgaggatgttttcccgacaaga

SEQ ID NO: 446392 - DNA, 25 bp, Mus musculus
gcctgagggcctgctttctaaggga

SEQ ID NO: 446393 - DNA, 25 bp, Mus musculus
gcctgaggtcagaagtatgaatgct

SEQ ID NO: 446394 - DNA, 25 bp, Mus musculus
gcctgaggtcttctcccggtgttta

SEQ ID NO: 446395 - DNA, 25 bp, Mus musculus
gcctgagtgctacatccgtggcagc

SEQ ID NO: 446396 - DNA, 25 bp, Mus musculus
gcctgataagccaaccgtgagccag

SEQ ID NO: 446397 - DNA, 25 bp, Mus musculus
gcctgatatagacagtcttccattc

SEQ ID NO: 446398 - DNA, 25 bp, Mus musculus
gcctgatcacgtggacgcaaggacg

SEQ ID NO: 446399 - DNA, 25 bp, Mus musculus
gcctgatccttccttctggcagaga

SEQ ID NO: 446400 - DNA, 25 bp, Mus musculus
gcctgatgaagtttgagtcccgcgg

SEQ ID NO: 446401 - DNA, 25 bp, Mus musculus
gcctgatggacgcaagaagcttcga

SEQ ID NO: 446402 - DNA, 25 bp, Mus musculus
gcctgatggagaagatcgggcccaa

SEQ ID NO: 446403 - DNA, 25 bp, Mus musculus
gcctgatggcgttaatgactcctga

SEQ ID NO: 446404 - DNA, 25 bp, Mus musculus
gcctgatggctctatgcagcactgt

SEQ ID NO: 446405 - DNA, 25 bp, Mus musculus
gcctgatgggattggaacggtttca

SEQ ID NO: 446406 - DNA, 25 bp, Mus musculus
gcctgatgtgttttgctacgtgagt

SEQ ID NO: 446407 - DNA, 25 bp, Mus musculus
gcctgattggcttagggtacactca

SEQ ID NO: 446408 - DNA, 25 bp, Mus musculus
gcctgatttcaaaaggatcgtaaca

SEQ ID NO: 446409 - DNA, 25 bp, Mus musculus
gcctgcaaggaaacagcacttacac

SEQ ID NO: 446410 - DNA, 25 bp, Mus musculus
gcctgcacaaatctccctcaaagaa

SEQ ID NO: 446411 - DNA, 25 bp, Mus musculus
gcctgcacaactctgtatttctaga

SEQ ID NO: 446412 - DNA, 25 bp, Mus musculus
gcctgcacaagtacgctgcgctctt

SEQ ID NO: 446413 - DNA, 25 bp, Mus musculus
gcctgcacgggaagaaatgcaccgt

SEQ ID NO: 446414 - DNA, 25 bp, Mus musculus
gcctgcactgaagcggatgaaaaca

SEQ ID NO: 446415 - DNA, 25 bp, Mus musculus
gcctgcagaacaagatggcgccgtc

SEQ ID NO: 446416 - DNA, 25 bp, Mus musculus
gcctgcagaagccacaagacttgga

SEQ ID NO: 446417 - DNA, 25 bp, Mus musculus
gcctgcagatgccaggacaagaagc

SEQ ID NO: 446418 - DNA, 25 bp, Mus musculus
gcctgcaggagctagaacagacgcg

SEQ ID NO: 446419 - DNA, 25 bp, Mus musculus
gcctgcagggagacgcgtcgttctc

SEQ ID NO: 446420 - DNA, 25 bp, Mus musculus
gcctgcattcccaaagaagttggct

SEQ ID NO: 446421 - DNA, 25 bp, Mus musculus
gcctgcccttgcgattaataaaaag

SEQ ID NO: 446422 - DNA, 25 bp, Mus musculus
gcctgccggtagacttggctgaaga

SEQ ID NO: 446423 - DNA, 25 bp, Mus musculus
gcctgcctagccataaaaccttgga

SEQ ID NO: 446424 - DNA, 25 bp, Mus musculus
gcctgcctatgctgtgctgcttgcc

SEQ ID NO: 446425 - DNA, 25 bp, Mus musculus
gcctgcctcagtctcgttcttctgg

SEQ ID NO: 446426 - DNA, 25 bp, Mus musculus
gcctgcctccacatgttgggataaa

SEQ ID NO: 446427 - DNA, 25 bp, Mus musculus
gcctgcctgaggcagtcataaccca

SEQ ID NO: 446428 - DNA, 25 bp, Mus musculus
gcctgcctgttgtggactgaggcca

SEQ ID NO: 446429 - DNA, 25 bp, Mus musculus
gcctgccttccaatcctgttctgaa

SEQ ID NO: 446430 - DNA, 25 bp, Mus musculus
gcctgccttctttcggaagtattga

SEQ ID NO: 446431 - DNA, 25 bp, Mus musculus
gcctgccttgtgtgcacaaagccat

SEQ ID NO: 446432 - DNA, 25 bp, Mus musculus
gcctgcgcaccccatttagggaata

SEQ ID NO: 446433 - DNA, 25 bp, Mus musculus
gcctgcgcagctccatgtcggagaa

SEQ ID NO: 446434 - DNA, 25 bp, Mus musculus
gcctgcgcgcatacagcttgctctt

SEQ ID NO: 446435 - DNA, 25 bp, Mus musculus
gcctgcggaacaaccgtgaggcacc

SEQ ID NO: 446436 - DNA, 25 bp, Mus musculus
gcctgcggtcttgagacggagcacc

SEQ ID NO: 446437 - DNA, 25 bp, Mus musculus
gcctgcgttcggtttgtcctgtgag

SEQ ID NO: 446438 - DNA, 25 bp, Mus musculus
gcctgctaaattgcctggaggagtc

SEQ ID NO: 446439 - DNA, 25 bp, Mus musculus
gcctgctaagatgcctgtgagccca

SEQ ID NO: 446440 - DNA, 25 bp, Mus musculus
gcctgctcagaagggaaatactacc

SEQ ID NO: 446441 - DNA, 25 bp, Mus musculus
gcctgctccaatgatttccaagtag

SEQ ID NO: 446442 - DNA, 25 bp, Mus musculus
gcctgctccagcgtatgtgtttaca

SEQ ID NO: 446443 - DNA, 25 bp, Mus musculus
gcctgctcctcttgtgtctcctgtg

SEQ ID NO: 446444 - DNA, 25 bp, Mus musculus
gcctgctctcttacatttctgactg

SEQ ID NO: 446445 - DNA, 25 bp, Mus musculus
gcctgctgacgcctctcaatgtgga

SEQ ID NO: 446446 - DNA, 25 bp, Mus musculus
gcctgctgccggagaaagccgttta

SEQ ID NO: 446447 - DNA, 25 bp, Mus musculus
gcctgctgcgcagaatgcagaaacg

SEQ ID NO: 446448 - DNA, 25 bp, Mus musculus
gcctgctgctagagatgctcttcct

SEQ ID NO: 446449 - DNA, 25 bp, Mus musculus
gcctgctgggctgtcggcattacga

SEQ ID NO: 446450 - DNA, 25 bp, Mus musculus
gcctgctggtggcatttagtgcctg

SEQ ID NO: 446451 - DNA, 25 bp, Mus musculus
gcctgctgtcctggagatagaccta

SEQ ID NO: 446452 - DNA, 25 bp, Mus musculus
gcctgctgtgtctgtgttatctgta

SEQ ID NO: 446453 - DNA, 25 bp, Mus musculus
gcctgcttactgctacaaatctggt

SEQ ID NO: 446454 - DNA, 25 bp, Mus musculus
gcctgcttccagtttaaagccgaga

SEQ ID NO: 446455 - DNA, 25 bp, Mus musculus
gcctggaaaaccaggcgccttccag

SEQ ID NO: 446456 - DNA, 25 bp, Mus musculus
gcctggaactcatgtaaaagggaga

SEQ ID NO: 446457 - DNA, 25 bp, Mus musculus
gcctggaagactgagcaggcccaca

SEQ ID NO: 446458 - DNA, 25 bp, Mus musculus
gcctggacaaagtgtgacagaacca

SEQ ID NO: 446459 - DNA, 25 bp, Mus musculus
gcctggacacgtacacgcacgtgaa

SEQ ID NO: 446460 - DNA, 25 bp, Mus musculus
gcctggacagtgctcaggagacccc

SEQ ID NO: 446461 - DNA, 25 bp, Mus musculus
gcctggacccatgctgactgcaatt

SEQ ID NO: 446462 - DNA, 25 bp, Mus musculus
gcctggaccgggaagcattaaccaa

SEQ ID NO: 446463 - DNA, 25 bp, Mus musculus
gcctggaccttgtgatgggaaccca

SEQ ID NO: 446464 - DNA, 25 bp, Mus musculus
gcctggagaccgacatactctttgg

SEQ ID NO: 446465 - DNA, 25 bp, Mus musculus
gcctggagagtaaaggaatcacttc

SEQ ID NO: 446466 - DNA, 25 bp, Mus musculus
gcctggagccatcaagaacttcgtg

SEQ ID NO: 446467 - DNA, 25 bp, Mus musculus
gcctggaggaggttgcttttgaacc

SEQ ID NO: 446468 - DNA, 25 bp, Mus musculus
gcctggaggattacatcaacgaccg

SEQ ID NO: 446469 - DNA, 25 bp, Mus musculus
gcctggagggaacattcaagaacca

SEQ ID NO: 446470 - DNA, 25 bp, Mus musculus
gcctggagtctacaaatgtcactga

SEQ ID NO: 446471 - DNA, 25 bp, Mus musculus
gcctggataaccactgaggcaggag

SEQ ID NO: 446472 - DNA, 25 bp, Mus musculus
gcctggataacctactgaaaccttg

SEQ ID NO: 446473 - DNA, 25 bp, Mus musculus
gcctggataccacattgaagactca

SEQ ID NO: 446474 - DNA, 25 bp, Mus musculus
gcctggatggccaagacaagctggt

SEQ ID NO: 446475 - DNA, 25 bp, Mus musculus
gcctggattccaagtctgtcgtaga

SEQ ID NO: 446476 - DNA, 25 bp, Mus musculus
gcctggcacgagacagaggaaaaga

SEQ ID NO: 446477 - DNA, 25 bp, Mus musculus
gcctggcacggcactatgatcgaag

SEQ ID NO: 446478 - DNA, 25 bp, Mus musculus
gcctggcccatttagttacacactg

SEQ ID NO: 446479 - DNA, 25 bp, Mus musculus
gcctggcccgaggaaatctttatac

SEQ ID NO: 446480 - DNA, 25 bp, Mus musculus
gcctggccctaatgcatgctgagta

SEQ ID NO: 446481 - DNA, 25 bp, Mus musculus
gcctggcctctctccgaggtgctga

SEQ ID NO: 446482 - DNA, 25 bp, Mus musculus
gcctggcctggtgggacaatacctt

SEQ ID NO: 446483 - DNA, 25 bp, Mus musculus
gcctggcgctgcttcccaagggtgt

SEQ ID NO: 446484 - DNA, 25 bp, Mus musculus
gcctggcggcaagtgtagcatttca

SEQ ID NO: 446485 - DNA, 25 bp, Mus musculus
gcctggctatgttcatgttttgctc

SEQ ID NO: 446486 - DNA, 25 bp, Mus musculus
gcctggctctggaaccttttaagaa

SEQ ID NO: 446487 - DNA, 25 bp, Mus musculus
gcctggctggctgctagtgatatag

SEQ ID NO: 446488 - DNA, 25 bp, Mus musculus
gcctggcttccctcaaacttctaaa

SEQ ID NO: 446489 - DNA, 25 bp, Mus musculus
gcctgggaaccttagaggaaactgg

SEQ ID NO: 446490 - DNA, 25 bp, Mus musculus
gcctgggaatttagccgggaatccg

SEQ ID NO: 446491 - DNA, 25 bp, Mus musculus
gcctgggacccatttcggactgcaa

SEQ ID NO: 446492 - DNA, 25 bp, Mus musculus
gcctgggacccttcagacttttcga

SEQ ID NO: 446493 - DNA, 25 bp, Mus musculus
gcctgggagcttgcgcggatgatgc

SEQ ID NO: 446494 - DNA, 25 bp, Mus musculus
gcctgggcatttggccctttgtcct

SEQ ID NO: 446495 - DNA, 25 bp, Mus musculus
gcctgggctcggttgtatactcttc

SEQ ID NO: 446496 - DNA, 25 bp, Mus musculus
gcctgggctttatgatgaccgtgta

SEQ ID NO: 446497 - DNA, 25 bp, Mus musculus
gcctgggtcagtcacttaagcaaga

SEQ ID NO: 446498 - DNA, 25 bp, Mus musculus
gcctgggtcgcctgcggttatgtaa

SEQ ID NO: 446499 - DNA, 25 bp, Mus musculus
gcctgggtgccatcatgataatgga

SEQ ID NO: 446500 - DNA, 25 bp, Mus musculus
gcctggtccaaatacaatccccgag

SEQ ID NO: 446501 - DNA, 25 bp, Mus musculus
gcctggtgaagcttggtggcaccat

SEQ ID NO: 446502 - DNA, 25 bp, Mus musculus
gcctggtgacctcagtgggccaaaa

SEQ ID NO: 446503 - DNA, 25 bp, Mus musculus
gcctggtggatcgaaaacgctcctg

SEQ ID NO: 446504 - DNA, 25 bp, Mus musculus
gcctggtgtagtttcccacctccta

SEQ ID NO: 446505 - DNA, 25 bp, Mus musculus
gcctggtgtgagacttcctgtcaaa

SEQ ID NO: 446506 - DNA, 25 bp, Mus musculus
gcctggtgtggatcctgattgcctc

SEQ ID NO: 446507 - DNA, 25 bp, Mus musculus
gcctggtttccccataaagggcaga

SEQ ID NO: 446508 - DNA, 25 bp, Mus musculus
gcctgtaaaggccaaaagaaactct

SEQ ID NO: 446509 - DNA, 25 bp, Mus musculus
gcctgtaatctcaagattgctggtg

SEQ ID NO: 446510 - DNA, 25 bp, Mus musculus
gcctgtacctccagctgcaaagcag

SEQ ID NO: 446511 - DNA, 25 bp, Mus musculus
gcctgtacgaggagatttggaaagt

SEQ ID NO: 446512 - DNA, 25 bp, Mus musculus
gcctgtagagctgaataacgatgcg

SEQ ID NO: 446513 - DNA, 25 bp, Mus musculus
gcctgtagctggacgatttgccctg

SEQ ID NO: 446514 - DNA, 25 bp, Mus musculus
gcctgtatgtgcttgcttctctgga

SEQ ID NO: 446515 - DNA, 25 bp, Mus musculus
gcctgtattccatgtgctgtagcaa

SEQ ID NO: 446516 - DNA, 25 bp, Mus musculus
gcctgtcaagatggaggacaccact

SEQ ID NO: 446517 - DNA, 25 bp, Mus musculus
gcctgtcagtcaaggatggccttca

SEQ ID NO: 446518 - DNA, 25 bp, Mus musculus
gcctgtccaaggtcatgagaccttg

SEQ ID NO: 446519 - DNA, 25 bp, Mus musculus
gcctgtccgagatgcatccgcggcg

SEQ ID NO: 446520 - DNA, 25 bp, Mus musculus
gcctgtcctatgagtatgtgtaacg

SEQ ID NO: 446521 - DNA, 25 bp, Mus musculus
gcctgtctgtcagaagtcactaggg

SEQ ID NO: 446522 - DNA, 25 bp, Mus musculus
gcctgtctgttgtcatacttttcaa

SEQ ID NO: 446523 - DNA, 25 bp, Mus musculus
gcctgtgaatgaattgtctctttgt

SEQ ID NO: 446524 - DNA, 25 bp, Mus musculus
gcctgtgactgctaagacttgggac

SEQ ID NO: 446525 - DNA, 25 bp, Mus musculus
gcctgtgatccctcttttgaggaga

SEQ ID NO: 446526 - DNA, 25 bp, Mus musculus
gcctgtgattttaactgcttagcca

SEQ ID NO: 446527 - DNA, 25 bp, Mus musculus
gcctgtgcatttcttggagccttgt

SEQ ID NO: 446528 - DNA, 25 bp, Mus musculus
gcctgtgcgatagctgtctatttca

SEQ ID NO: 446529 - DNA, 25 bp, Mus musculus
gcctgtgcggactcgcctgcgtgac

SEQ ID NO: 446530 - DNA, 25 bp, Mus musculus
gcctgtgctaattgaacaaggagaa

SEQ ID NO: 446531 - DNA, 25 bp, Mus musculus
gcctgtgctgcaaacggtactggaa

SEQ ID NO: 446532 - DNA, 25 bp, Mus musculus
gcctgtgcttccatctcgctctgaa

SEQ ID NO: 446533 - DNA, 25 bp, Mus musculus
gcctgtgctttcttctgttgttgga

SEQ ID NO: 446534 - DNA, 25 bp, Mus musculus
gcctgtgctttgttgaacctttccg

SEQ ID NO: 446535 - DNA, 25 bp, Mus musculus
gcctgtgggacatctaaatggatcc

SEQ ID NO: 446536 - DNA, 25 bp, Mus musculus
gcctgtgggtcataactggattgcc

SEQ ID NO: 446537 - DNA, 25 bp, Mus musculus
gcctgtggtttgttaatgtcgaagt

SEQ ID NO: 446538 - DNA, 25 bp, Mus musculus
gcctgtgtagagttggctcctttca

SEQ ID NO: 446539 - DNA, 25 bp, Mus musculus
gcctgtgtggatgcctgtaacctca

SEQ ID NO: 446540 - DNA, 25 bp, Mus musculus
gcctgtgtggtccagatgttcttcc

SEQ ID NO: 446541 - DNA, 25 bp, Mus musculus
gcctgtgttaatgagagttatatcc

SEQ ID NO: 446542 - DNA, 25 bp, Mus musculus
gcctgttaaagcctgagtctgacct

SEQ ID NO: 446543 - DNA, 25 bp, Mus musculus
gcctgttacacatcgagtcccggaa

SEQ ID NO: 446544 - DNA, 25 bp, Mus musculus
gcctgttcactacggctgcaaggaa

SEQ ID NO: 446545 - DNA, 25 bp, Mus musculus
gcctgttcccatttggtcactagat

SEQ ID NO: 446546 - DNA, 25 bp, Mus musculus
gcctgttctgtgagggtgccttcaa

SEQ ID NO: 446547 - DNA, 25 bp, Mus musculus
gcctgttggcttcatatttgtacaa

SEQ ID NO: 446548 - DNA, 25 bp, Mus musculus
gcctgtttcggctcttgttcctatt

SEQ ID NO: 446549 - DNA, 25 bp, Mus musculus
gcctgtttctgttgaccttctggga

SEQ ID NO: 446550 - DNA, 25 bp, Mus musculus
gcctgtttgatgagctgcgggccaa

SEQ ID NO: 446551 - DNA, 25 bp, Mus musculus
gcctgtttgcgtccttcggagatga

SEQ ID NO: 446552 - DNA, 25 bp, Mus musculus
gccttaaaacccaacaggtgtctgt

SEQ ID NO: 446553 - DNA, 25 bp, Mus musculus
gccttaacagagctcaccatttgaa

SEQ ID NO: 446554 - DNA, 25 bp, Mus musculus
gccttaacatgtggaacgtgtgctg

SEQ ID NO: 446555 - DNA, 25 bp, Mus musculus
gccttaaccctactaaagcatgatg

SEQ ID NO: 446556 - DNA, 25 bp, Mus musculus
gccttaagagccctaactctggttt

SEQ ID NO: 446557 - DNA, 25 bp, Mus musculus
gccttacagcaaactagagcagtcg

SEQ ID NO: 446558 - DNA, 25 bp, Mus musculus
gccttacaggaaggatgagtaccct

SEQ ID NO: 446559 - DNA, 25 bp, Mus musculus
gccttaccaagacgacagcggttct

SEQ ID NO: 446560 - DNA, 25 bp, Mus musculus
gccttacctgagagtgtcacttccg

SEQ ID NO: 446561 - DNA, 25 bp, Mus musculus
gccttacctggaaagctaaaatgtt

SEQ ID NO: 446562 - DNA, 25 bp, Mus musculus
gccttacgtcgacagttgccagtga

SEQ ID NO: 446563 - DNA, 25 bp, Mus musculus
gccttactaggtagtccgggctggc

SEQ ID NO: 446564 - DNA, 25 bp, Mus musculus
gccttactggctgctaccgtagaga

SEQ ID NO: 446565 - DNA, 25 bp, Mus musculus
gccttagaccgtgctttctgtggca

SEQ ID NO: 446566 - DNA, 25 bp, Mus musculus
gccttaggagcctagagcctgaaaa

SEQ ID NO: 446567 - DNA, 25 bp, Mus musculus
gccttattctaggaccactgtggaa

SEQ ID NO: 446568 - DNA, 25 bp, Mus musculus
gccttattctataggatttttgtcc

SEQ ID NO: 446569 - DNA, 25 bp, Mus musculus
gccttcaacacaagcacggctttcg

SEQ ID NO: 446570 - DNA, 25 bp, Mus musculus
gccttcaaggcctggtaagcaaccc

SEQ ID NO: 446571 - DNA, 25 bp, Mus musculus
gccttcaataatctggagaatctgg

SEQ ID NO: 446572 - DNA, 25 bp, Mus musculus
gccttcactgcgaggcctgtggaga

SEQ ID NO: 446573 - DNA, 25 bp, Mus musculus
gccttcagacgtaagtaccagctca

SEQ ID NO: 446574 - DNA, 25 bp, Mus musculus
gccttcaggctaataattacagacg

SEQ ID NO: 446575 - DNA, 25 bp, Mus musculus
gccttcaggttagtctctccagaaa

SEQ ID NO: 446576 - DNA, 25 bp, Mus musculus
gccttcatcatggtgcagtccctgg

SEQ ID NO: 446577 - DNA, 25 bp, Mus musculus
gccttcatgggatgcttcgtgtatt

SEQ ID NO: 446578 - DNA, 25 bp, Mus musculus
gccttcatgtgccaggtaacaggaa

SEQ ID NO: 446579 - DNA, 25 bp, Mus musculus
gccttccacctagagatgactgtca

SEQ ID NO: 446580 - DNA, 25 bp, Mus musculus
gccttccacgtccagtcagagcgta

SEQ ID NO: 446581 - DNA, 25 bp, Mus musculus
gccttccagagattggcccaactga

SEQ ID NO: 446582 - DNA, 25 bp, Mus musculus
gccttccaggcccttcgaaagatgg

SEQ ID NO: 446583 - DNA, 25 bp, Mus musculus
gccttccctttaaaatcagctctga

SEQ ID NO: 446584 - DNA, 25 bp, Mus musculus
gccttccgaggtccacacggagaag

SEQ ID NO: 446585 - DNA, 25 bp, Mus musculus
gccttcctggtcagatatcagagtg

SEQ ID NO: 446586 - DNA, 25 bp, Mus musculus
gccttcctggttgcttttctcatga

SEQ ID NO: 446587 - DNA, 25 bp, Mus musculus
gccttccttggctcatttgtcaatg

SEQ ID NO: 446588 - DNA, 25 bp, Mus musculus
gccttccttgtgctgggtaacagat

SEQ ID NO: 446589 - DNA, 25 bp, Mus musculus
gccttcgtcgccatggtgaccacgg

SEQ ID NO: 446590 - DNA, 25 bp, Mus musculus
gccttcgtgggctctggtataccag

SEQ ID NO: 446591 - DNA, 25 bp, Mus musculus
gccttctagtccgagagccacagtt

SEQ ID NO: 446592 - DNA, 25 bp, Mus musculus
gccttctgctagcttggttccccaa

SEQ ID NO: 446593 - DNA, 25 bp, Mus musculus
gccttctgggagctgggacatcctc

SEQ ID NO: 446594 - DNA, 25 bp, Mus musculus
gccttctgtgttacggcttggtgaa

SEQ ID NO: 446595 - DNA, 25 bp, Mus musculus
gccttcttcccagcaattgttggtt

SEQ ID NO: 446596 - DNA, 25 bp, Mus musculus
gccttcttggcgcactacttcgaga

SEQ ID NO: 446597 - DNA, 25 bp, Mus musculus
gccttctttgaagggcagggatgcc

SEQ ID NO: 446598 - DNA, 25 bp, Mus musculus
gccttgaaaccatgactagccctgg

SEQ ID NO: 446599 - DNA, 25 bp, Mus musculus
gccttgaaaggctaatgctgccttc

SEQ ID NO: 446600 - DNA, 25 bp, Mus musculus
gccttgaacttcaaagagctggctg

SEQ ID NO: 446601 - DNA, 25 bp, Mus musculus
gccttgaaggcagggatgggttgct

SEQ ID NO: 446602 - DNA, 25 bp, Mus musculus
gccttgaatgataattgaagtcttc

SEQ ID NO: 446603 - DNA, 25 bp, Mus musculus
gccttgacccaactatgggctgtag

SEQ ID NO: 446604 - DNA, 25 bp, Mus musculus
gccttgagccactgagaacttcggg

SEQ ID NO: 446605 - DNA, 25 bp, Mus musculus
gccttgaggatgaagacgcgctgca

SEQ ID NO: 446606 - DNA, 25 bp, Mus musculus
gccttgcagcgacaacaaccagata

SEQ ID NO: 446607 - DNA, 25 bp, Mus musculus
gccttgccacaggtgccagatgatt

SEQ ID NO: 446608 - DNA, 25 bp, Mus musculus
gccttgcccgtgttgcagatccaga

SEQ ID NO: 446609 - DNA, 25 bp, Mus musculus
gccttgcgccgccatttctcggtgt

SEQ ID NO: 446610 - DNA, 25 bp, Mus musculus
gccttgcggcaggacccgtctttaa

SEQ ID NO: 446611 - DNA, 25 bp, Mus musculus
gccttgctcatctgttgggacgccc

SEQ ID NO: 446612 - DNA, 25 bp, Mus musculus
gccttgctggctctacctgagagag

SEQ ID NO: 446613 - DNA, 25 bp, Mus musculus
gccttgcttggaacaatccctgaga

SEQ ID NO: 446614 - DNA, 25 bp, Mus musculus
gccttggaaagcaacgacagcattt

SEQ ID NO: 446615 - DNA, 25 bp, Mus musculus
gccttggaaatcgtcgccttcgtag

SEQ ID NO: 446616 - DNA, 25 bp, Mus musculus
gccttggactgtgtcgggcagttca

SEQ ID NO: 446617 - DNA, 25 bp, Mus musculus
gccttggacttactgagtctcattg

SEQ ID NO: 446618 - DNA, 25 bp, Mus musculus
gccttggattcctggcgctggtcca

SEQ ID NO: 446619 - DNA, 25 bp, Mus musculus
gccttggcattcaagcattccctag

SEQ ID NO: 446620 - DNA, 25 bp, Mus musculus
gccttggccacgaacaggactggta

SEQ ID NO: 446621 - DNA, 25 bp, Mus musculus
gccttggcccttgctattgctcagg

SEQ ID NO: 446622 - DNA, 25 bp, Mus musculus
gccttggccgcctctgcactgagaa

SEQ ID NO: 446623 - DNA, 25 bp, Mus musculus
gccttgggcaggagcatcatagcaa

SEQ ID NO: 446624 - DNA, 25 bp, Mus musculus
gccttgggcgcctagtgattacgta

SEQ ID NO: 446625 - DNA, 25 bp, Mus musculus
gccttgggcttccttataattgctg

SEQ ID NO: 446626 - DNA, 25 bp, Mus musculus
gccttgggtaaaaaagtctctgcag

SEQ ID NO: 446627 - DNA, 25 bp, Mus musculus
gccttgggttcaatgcccttaccca

SEQ ID NO: 446628 - DNA, 25 bp, Mus musculus
gccttggtcaccttatggaaattcc

SEQ ID NO: 446629 - DNA, 25 bp, Mus musculus
gccttggtcattactgtgtgccgcc

SEQ ID NO: 446630 - DNA, 25 bp, Mus musculus
gccttggttccaagggtcccaggag

SEQ ID NO: 446631 - DNA, 25 bp, Mus musculus
gccttgtacagacagggaaaactga

SEQ ID NO: 446632 - DNA, 25 bp, Mus musculus
gccttgtcccctttgtccatcgaga

SEQ ID NO: 446633 - DNA, 25 bp, Mus musculus
gccttgtccctgaagaagttcctga

SEQ ID NO: 446634 - DNA, 25 bp, Mus musculus
gccttgtgatgaatagactcactga

SEQ ID NO: 446635 - DNA, 25 bp, Mus musculus
gccttgtggtaattcggagtgccta

SEQ ID NO: 446636 - DNA, 25 bp, Mus musculus
gccttgttacccacccatgtaggaa

SEQ ID NO: 446637 - DNA, 25 bp, Mus musculus
gcctttaaagaggaaccgcagaccg

SEQ ID NO: 446638 - DNA, 25 bp, Mus musculus
gcctttaatgagcacggttcccagt

SEQ ID NO: 446639 - DNA, 25 bp, Mus musculus
gcctttaatttctgagtgatgcctg

SEQ ID NO: 446640 - DNA, 25 bp, Mus musculus
gcctttactttgctccagggcatat

SEQ ID NO: 446641 - DNA, 25 bp, Mus musculus
gcctttagacccatggaagtggcca

SEQ ID NO: 446642 - DNA, 25 bp, Mus musculus
gcctttagccgtttggacccgactg

SEQ ID NO: 446643 - DNA, 25 bp, Mus musculus
gcctttatgcaaagcacggaacgag

SEQ ID NO: 446644 - DNA, 25 bp, Mus musculus
gcctttattatgagtccagacccag

SEQ ID NO: 446645 - DNA, 25 bp, Mus musculus
gcctttattgcttgtgggaaaactc

SEQ ID NO: 446646 - DNA, 25 bp, Mus musculus
gcctttcaagctggcacaggtggta

SEQ ID NO: 446647 - DNA, 25 bp, Mus musculus
gcctttcctgtaggctgttccggga

SEQ ID NO: 446648 - DNA, 25 bp, Mus musculus
gcctttcgattatgatcccaatgag

SEQ ID NO: 446649 - DNA, 25 bp, Mus musculus
gcctttctagacattgggtactcca

SEQ ID NO: 446650 - DNA, 25 bp, Mus musculus
gcctttctataggaaaacaccctag

SEQ ID NO: 446651 - DNA, 25 bp, Mus musculus
gcctttctcagtggtgttgctcatc

SEQ ID NO: 446652 - DNA, 25 bp, Mus musculus
gcctttctcatttcaccaagataat

SEQ ID NO: 446653 - DNA, 25 bp, Mus musculus
gcctttctcccccttcttagagatg

SEQ ID NO: 446654 - DNA, 25 bp, Mus musculus
gcctttctggtgtgccccgcaacag

SEQ ID NO: 446655 - DNA, 25 bp, Mus musculus
gcctttctttgtaacctgcaggtgg

SEQ ID NO: 446656 - DNA, 25 bp, Mus musculus
gcctttgaactgatgctggatggag

SEQ ID NO: 446657 - DNA, 25 bp, Mus musculus
gcctttgagcgcatcgaggaccaga

SEQ ID NO: 446658 - DNA, 25 bp, Mus musculus
gcctttgcaaatgaccctgatgtga

SEQ ID NO: 446659 - DNA, 25 bp, Mus musculus
gcctttgcacagctccctactgagt

SEQ ID NO: 446660 - DNA, 25 bp, Mus musculus
gcctttgcagagaagcggacctcag

SEQ ID NO: 446661 - DNA, 25 bp, Mus musculus
gcctttgcccattacaaatcaagta

SEQ ID NO: 446662 - DNA, 25 bp, Mus musculus
gcctttgcgattgtggagcgagccc

SEQ ID NO: 446663 - DNA, 25 bp, Mus musculus
gcctttgcggagaagagtgacccag

SEQ ID NO: 446664 - DNA, 25 bp, Mus musculus
gcctttgcggagagagcaaccctct

SEQ ID NO: 446665 - DNA, 25 bp, Mus musculus
gcctttggcatttgacaggacatac

SEQ ID NO: 446666 - DNA, 25 bp, Mus musculus
gcctttgtaagttgtcatagagaat

SEQ ID NO: 446667 - DNA, 25 bp, Mus musculus
gcctttgtataacaagagaaatatt

SEQ ID NO: 446668 - DNA, 25 bp, Mus musculus
gcctttgtcaatctggtatctttgc

SEQ ID NO: 446669 - DNA, 25 bp, Mus musculus
gccttttactattgctggcacacag

SEQ ID NO: 446670 - DNA, 25 bp, Mus musculus
gccttttcacacagccagagcatgt

SEQ ID NO: 446671 - DNA, 25 bp, Mus musculus
gccttttcaccaaagctgcagatga

SEQ ID NO: 446672 - DNA, 25 bp, Mus musculus
gccttttctcgtccattgagtcgga

SEQ ID NO: 446673 - DNA, 25 bp, Mus musculus
gccttttgacatctgttctgtgccc

SEQ ID NO: 446674 - DNA, 25 bp, Mus musculus
gccttttgagtagcatccggcaaca

SEQ ID NO: 446675 - DNA, 25 bp, Mus musculus
gccttttgatgaagaagcatctgcc

SEQ ID NO: 446676 - DNA, 25 bp, Mus musculus
gccttttggaaataggtgacatgag

SEQ ID NO: 446677 - DNA, 25 bp, Mus musculus
gcgaaaactccatttacctagagga

SEQ ID NO: 446678 - DNA, 25 bp, Mus musculus
gcgaaaagccatgcaaccagaccat

SEQ ID NO: 446679 - DNA, 25 bp, Mus musculus
gcgaaaccgttgaaatgcataacct

SEQ ID NO: 446680 - DNA, 25 bp, Mus musculus
gcgaaactaccgacagtgtggccag

SEQ ID NO: 446681 - DNA, 25 bp, Mus musculus
gcgaaagaagctaaggcaccctggt

SEQ ID NO: 446682 - DNA, 25 bp, Mus musculus
gcgaaagacgatcaaaaccatgctg

SEQ ID NO: 446683 - DNA, 25 bp, Mus musculus
gcgaaagccagtgttcccagatagt

SEQ ID NO: 446684 - DNA, 25 bp, Mus musculus
gcgaaagccctcattacacgtcctg

SEQ ID NO: 446685 - DNA, 25 bp, Mus musculus
gcgaaataagattggcagcctggcg

SEQ ID NO: 446686 - DNA, 25 bp, Mus musculus
gcgaaattccgcatgggctccagga

SEQ ID NO: 446687 - DNA, 25 bp, Mus musculus
gcgaacgcttggaacaggaactctt

SEQ ID NO: 446688 - DNA, 25 bp, Mus musculus
gcgaactcttcgctgagcagcccag

SEQ ID NO: 446689 - DNA, 25 bp, Mus musculus
gcgaagaaattacatgcctttggct

SEQ ID NO: 446690 - DNA, 25 bp, Mus musculus
gcgaagactacaggctcccaatgat

SEQ ID NO: 446691 - DNA, 25 bp, Mus musculus
gcgaagattcttccaccggagagct

SEQ ID NO: 446692 - DNA, 25 bp, Mus musculus
gcgaagcagacaagactgccgtgct

SEQ ID NO: 446693 - DNA, 25 bp, Mus musculus
gcgaagccaccctgcggaaactgcg

SEQ ID NO: 446694 - DNA, 25 bp, Mus musculus
gcgaagccggttccctctgctgtga

SEQ ID NO: 446695 - DNA, 25 bp, Mus musculus
gcgaaggccggcttctgagtcgttt

SEQ ID NO: 446696 - DNA, 25 bp, Mus musculus
gcgaagtacgcgtgcctttgcccgt

SEQ ID NO: 446697 - DNA, 25 bp, Mus musculus
gcgaagtgcttcactcctgaatgta

SEQ ID NO: 446698 - DNA, 25 bp, Mus musculus
gcgaagttaaacacaaagctcaggg

SEQ ID NO: 446699 - DNA, 25 bp, Mus musculus
gcgaatacagaaggctgtggtccct

SEQ ID NO: 446700 - DNA, 25 bp, Mus musculus
gcgaatctttacaagcactgcagga

SEQ ID NO: 446701 - DNA, 25 bp, Mus musculus
gcgacaaccgatgtgaagacagata

SEQ ID NO: 446702 - DNA, 25 bp, Mus musculus
gcgacaagtctaagccaggccagtt

SEQ ID NO: 446703 - DNA, 25 bp, Mus musculus
gcgacacaacaccaatatcgccgag

SEQ ID NO: 446704 - DNA, 25 bp, Mus musculus
gcgacacagcttgtttggaattatg

SEQ ID NO: 446705 - DNA, 25 bp, Mus musculus
gcgacaccggaagtggctgtggtcc

SEQ ID NO: 446706 - DNA, 25 bp, Mus musculus
gcgacaccgtgccttagggaagaat

SEQ ID NO: 446707 - DNA, 25 bp, Mus musculus
gcgacacgtctctactgtaccttta

SEQ ID NO: 446708 - DNA, 25 bp, Mus musculus
gcgacacttaccgagcttatgagga

SEQ ID NO: 446709 - DNA, 25 bp, Mus musculus
gcgacagacacacaagacactcggt

SEQ ID NO: 446710 - DNA, 25 bp, Mus musculus
gcgacagacacggaacatgagccaa

SEQ ID NO: 446711 - DNA, 25 bp, Mus musculus
gcgacagtcgccaacggaactgctt

SEQ ID NO: 446712 - DNA, 25 bp, Mus musculus
gcgacatcagccgagaacagttgaa

SEQ ID NO: 446713 - DNA, 25 bp, Mus musculus
gcgacatgcaggacggcttcgacat

SEQ ID NO: 446714 - DNA, 25 bp, Mus musculus
gcgaccagacccttcttgcagagag

SEQ ID NO: 446715 - DNA, 25 bp, Mus musculus
gcgacccagaccatggccattagag

SEQ ID NO: 446716 - DNA, 25 bp, Mus musculus
gcgaccccggcagatcatcagttag

SEQ ID NO: 446717 - DNA, 25 bp, Mus musculus
gcgacccgctttagcctgcaggact

SEQ ID NO: 446718 - DNA, 25 bp, Mus musculus
gcgacctgtgaacgtgcccttagat

SEQ ID NO: 446719 - DNA, 25 bp, Mus musculus
gcgaccttggtgaagccctggctta

SEQ ID NO: 446720 - DNA, 25 bp, Mus musculus
gcgacgagagaagctgaagacatcc

SEQ ID NO: 446721 - DNA, 25 bp, Mus musculus
gcgacgagatttctggacaagccca

SEQ ID NO: 446722 - DNA, 25 bp, Mus musculus
gcgacgcgggtgagtcaagcccaca

SEQ ID NO: 446723 - DNA, 25 bp, Mus musculus
gcgacgctgggatcaagtccccaga

SEQ ID NO: 446724 - DNA, 25 bp, Mus musculus
gcgacggcggcaaacataagaaatt

SEQ ID NO: 446725 - DNA, 25 bp, Mus musculus
gcgacgggccctgaaactaatgtag

SEQ ID NO: 446726 - DNA, 25 bp, Mus musculus
gcgactatccagctttgtgccagga

SEQ ID NO: 446727 - DNA, 25 bp, Mus musculus
gcgactcagtgtttaggtctctcga

SEQ ID NO: 446728 - DNA, 25 bp, Mus musculus
gcgactgcaggaagagttagacctc

SEQ ID NO: 446729 - DNA, 25 bp, Mus musculus
gcgactgcggcaaagcgagagcctc

SEQ ID NO: 446730 - DNA, 25 bp, Mus musculus
gcgactgtccccacgtgttccgaag

SEQ ID NO: 446731 - DNA, 25 bp, Mus musculus
gcgacttcgtgtgccgacgctgcta

SEQ ID NO: 446732 - DNA, 25 bp, Mus musculus
gcgagaaatccaatgcctgcaagtg

SEQ ID NO: 446733 - DNA, 25 bp, Mus musculus
gcgagaaccgcaagtactacctgga

SEQ ID NO: 446734 - DNA, 25 bp, Mus musculus
gcgagagactgatcccaggagcgta

SEQ ID NO: 446735 - DNA, 25 bp, Mus musculus
gcgagagattctttccctgacggta

SEQ ID NO: 446736 - DNA, 25 bp, Mus musculus
gcgagatagcagtccacactagtgc

SEQ ID NO: 446737 - DNA, 25 bp, Mus musculus
gcgagcaatggcctatgagacctta

SEQ ID NO: 446738 - DNA, 25 bp, Mus musculus
gcgagcactctgaattactgagcca

SEQ ID NO: 446739 - DNA, 25 bp, Mus musculus
gcgagcagcaaaagagaccctgcct

SEQ ID NO: 446740 - DNA, 25 bp, Mus musculus
gcgagcagctacagtccatgaagga

SEQ ID NO: 446741 - DNA, 25 bp, Mus musculus
gcgagcccctgaccgagtatgatca

SEQ ID NO: 446742 - DNA, 25 bp, Mus musculus
gcgagcccgtgaatctacctgacaa

SEQ ID NO: 446743 - DNA, 25 bp, Mus musculus
gcgagctcacttcttcccagagtga

SEQ ID NO: 446744 - DNA, 25 bp, Mus musculus
gcgagctcgcgagcgcggaggaggc

SEQ ID NO: 446745 - DNA, 25 bp, Mus musculus
gcgagcttacactaccagtctcatg

SEQ ID NO: 446746 - DNA, 25 bp, Mus musculus
gcgaggaaagcaggaaagcgtcatc

SEQ ID NO: 446747 - DNA, 25 bp, Mus musculus
gcgaggacacactcaacaaacctgg

SEQ ID NO: 446748 - DNA, 25 bp, Mus musculus
gcgaggactctcctgcctattcaag

SEQ ID NO: 446749 - DNA, 25 bp, Mus musculus
gcgaggactgggaacttcttgacag

SEQ ID NO: 446750 - DNA, 25 bp, Mus musculus
gcgaggattgctcctgcatccagga

SEQ ID NO: 446751 - DNA, 25 bp, Mus musculus
gcgaggcactatgggcagaggaagg

SEQ ID NO: 446752 - DNA, 25 bp, Mus musculus
gcgaggcatggagagtgacttttac

SEQ ID NO: 446753 - DNA, 25 bp, Mus musculus
gcgaggccggctacaacagaaattt

SEQ ID NO: 446754 - DNA, 25 bp, Mus musculus
gcgaggcctgcaacatccggtttag

SEQ ID NO: 446755 - DNA, 25 bp, Mus musculus
gcgaggcgccggactgcgaaacaaa

SEQ ID NO: 446756 - DNA, 25 bp, Mus musculus
gcgagggcgccattttacatttcca

SEQ ID NO: 446757 - DNA, 25 bp, Mus musculus
gcgagggtctcgcaagacaccgttt

SEQ ID NO: 446758 - DNA, 25 bp, Mus musculus
gcgaggtaagctgcccgggctgaag

SEQ ID NO: 446759 - DNA, 25 bp, Mus musculus
gcgaggtatgtaacttaggctggca

SEQ ID NO: 446760 - DNA, 25 bp, Mus musculus
gcgaggttaatggtgcaaaggtaca

SEQ ID NO: 446761 - DNA, 25 bp, Mus musculus
gcgaggttcttaaggtgcgactaca

SEQ ID NO: 446762 - DNA, 25 bp, Mus musculus
gcgagtcaccccaatgtttccagga

SEQ ID NO: 446763 - DNA, 25 bp, Mus musculus
gcgagtcgctgacctgctccgtttt

SEQ ID NO: 446764 - DNA, 25 bp, Mus musculus
gcgagtctctcctgcggtcagacgc

SEQ ID NO: 446765 - DNA, 25 bp, Mus musculus
gcgagtgtgagggtgggaacagccc

SEQ ID NO: 446766 - DNA, 25 bp, Mus musculus
gcgagttcaccagcacattccagga

SEQ ID NO: 446767 - DNA, 25 bp, Mus musculus
gcgagttcatacatccctgagcggg

SEQ ID NO: 446768 - DNA, 25 bp, Mus musculus
gcgagttcccggctccgtgggcggg

SEQ ID NO: 446769 - DNA, 25 bp, Mus musculus
gcgagttcttcaaccagcagggcaa

SEQ ID NO: 446770 - DNA, 25 bp, Mus musculus
gcgagttgagcgagaacacgccgca

SEQ ID NO: 446771 - DNA, 25 bp, Mus musculus
gcgataaactcccacctcaggcttt

SEQ ID NO: 446772 - DNA, 25 bp, Mus musculus
gcgataagagcatatactacttctc

SEQ ID NO: 446773 - DNA, 25 bp, Mus musculus
gcgataaggtatactggcagcggca

SEQ ID NO: 446774 - DNA, 25 bp, Mus musculus
gcgataccttgtatggccggaagga

SEQ ID NO: 446775 - DNA, 25 bp, Mus musculus
gcgatagacccagcacccagtgaat

SEQ ID NO: 446776 - DNA, 25 bp, Mus musculus
gcgatagacctacaaccctagggtg

SEQ ID NO: 446777 - DNA, 25 bp, Mus musculus
gcgatagccacgcagcctgttttat

SEQ ID NO: 446778 - DNA, 25 bp, Mus musculus
gcgatagtgatgtctgcggccaaga

SEQ ID NO: 446779 - DNA, 25 bp, Mus musculus
gcgatccccttgttccctcggtgtg

SEQ ID NO: 446780 - DNA, 25 bp, Mus musculus
gcgatccggcggcaattattcacga

SEQ ID NO: 446781 - DNA, 25 bp, Mus musculus
gcgatcgccgtgtaaaatgagatat

SEQ ID NO: 446782 - DNA, 25 bp, Mus musculus
gcgatcggtgagacggctcttttct

SEQ ID NO: 446783 - DNA, 25 bp, Mus musculus
gcgatctcattcagtgtgtacaagg

SEQ ID NO: 446784 - DNA, 25 bp, Mus musculus
gcgatgacctatgcacagctggaaa

SEQ ID NO: 446785 - DNA, 25 bp, Mus musculus
gcgatgaggccagtgtttccagaca

SEQ ID NO: 446786 - DNA, 25 bp, Mus musculus
gcgatgcctcaagctttgcctctgg

SEQ ID NO: 446787 - DNA, 25 bp, Mus musculus
gcgatggaacaaaacgcctcaaaac

SEQ ID NO: 446788 - DNA, 25 bp, Mus musculus
gcgatggtaatttaccagaagcagc

SEQ ID NO: 446789 - DNA, 25 bp, Mus musculus
gcgatgtccctaccttccagaatgg

SEQ ID NO: 446790 - DNA, 25 bp, Mus musculus
gcgatgtttattgggactggaccta

SEQ ID NO: 446791 - DNA, 25 bp, Mus musculus
gcgattacccctttgtccctagtga

SEQ ID NO: 446792 - DNA, 25 bp, Mus musculus
gcgattgaagggatgctgcccgcct

SEQ ID NO: 446793 - DNA, 25 bp, Mus musculus
gcgattgagaaagaatgcggcatca

SEQ ID NO: 446794 - DNA, 25 bp, Mus musculus
gcgatttcacttggtggttcccagg

SEQ ID NO: 446795 - DNA, 25 bp, Mus musculus
gcgatttgacaacgagaccttccag

SEQ ID NO: 446796 - DNA, 25 bp, Mus musculus
gcgatttgggcagttcagttcttca

SEQ ID NO: 446797 - DNA, 25 bp, Mus musculus
gcgcaagtgcttctactggtctctt

SEQ ID NO: 446798 - DNA, 25 bp, Mus musculus
gcgcacaaccggagctgtctcagtc

SEQ ID NO: 446799 - DNA, 25 bp, Mus musculus
gcgcacggatcaacgagagtcttca

SEQ ID NO: 446800 - DNA, 25 bp, Mus musculus
gcgcactggctggttaatcttctaa

SEQ ID NO: 446801 - DNA, 25 bp, Mus musculus
gcgcagaacaaaagggccccttgaa

SEQ ID NO: 446802 - DNA, 25 bp, Mus musculus
gcgcagaagcattggcagacccgag

SEQ ID NO: 446803 - DNA, 25 bp, Mus musculus
gcgcagaagggagctctccagatgt

SEQ ID NO: 446804 - DNA, 25 bp, Mus musculus
gcgcagaagtctggccttactggtt

SEQ ID NO: 446805 - DNA, 25 bp, Mus musculus
gcgcagactttaaaactcaagtggt

SEQ ID NO: 446806 - DNA, 25 bp, Mus musculus
gcgcagccggcaaccagagtttccg

SEQ ID NO: 446807 - DNA, 25 bp, Mus musculus
gcgcaggctccagtccgttttgaaa

SEQ ID NO: 446808 - DNA, 25 bp, Mus musculus
gcgcagtctgcaatggaggctctag

SEQ ID NO: 446809 - DNA, 25 bp, Mus musculus
gcgcagtgttgcatgtgagtttcta

SEQ ID NO: 446810 - DNA, 25 bp, Mus musculus
gcgcagttgctactatcctcaagag

SEQ ID NO: 446811 - DNA, 25 bp, Mus musculus
gcgcatcgctgaacaagggtccaaa

SEQ ID NO: 446812 - DNA, 25 bp, Mus musculus
gcgcatcggcgctgccgaagctcat

SEQ ID NO: 446813 - DNA, 25 bp, Mus musculus
gcgcattcttgcacatttatctggg

SEQ ID NO: 446814 - DNA, 25 bp, Mus musculus
gcgcattgctggaagaaaacctgta

SEQ ID NO: 446815 - DNA, 25 bp, Mus musculus
gcgcatttctctctgagagagctga

SEQ ID NO: 446816 - DNA, 25 bp, Mus musculus
gcgcatttggatggagacgttcacc

SEQ ID NO: 446817 - DNA, 25 bp, Mus musculus
gcgccaacaaagtactgttcctggg

SEQ ID NO: 446818 - DNA, 25 bp, Mus musculus
gcgccacgggccttggtcattttgg

SEQ ID NO: 446819 - DNA, 25 bp, Mus musculus
gcgccactacgggattaagcctgaa

SEQ ID NO: 446820 - DNA, 25 bp, Mus musculus
gcgccagctagtcctgctgctgctg

SEQ ID NO: 446821 - DNA, 25 bp, Mus musculus
gcgccaggtctgcaattctgtttta

SEQ ID NO: 446822 - DNA, 25 bp, Mus musculus
gcgccaggtggcaatgaagagaaca

SEQ ID NO: 446823 - DNA, 25 bp, Mus musculus
gcgccatcttgctggatctctataa

SEQ ID NO: 446824 - DNA, 25 bp, Mus musculus
gcgccatggccttatcagcaaagtg

SEQ ID NO: 446825 - DNA, 25 bp, Mus musculus
gcgccatgtagcagtccgaaagtat

SEQ ID NO: 446826 - DNA, 25 bp, Mus musculus
gcgcccagagggaagtagctgtatt

SEQ ID NO: 446827 - DNA, 25 bp, Mus musculus
gcgcccaggcgctgtgtataccctg

SEQ ID NO: 446828 - DNA, 25 bp, Mus musculus
gcgccccgccgctttgtgtctggga

SEQ ID NO: 446829 - DNA, 25 bp, Mus musculus
gcgccccgtccgtaactagctggga

SEQ ID NO: 446830 - DNA, 25 bp, Mus musculus
gcgccctagccggttctgtctggaa

SEQ ID NO: 446831 - DNA, 25 bp, Mus musculus
gcgccgagcaaagactattaccagt

SEQ ID NO: 446832 - DNA, 25 bp, Mus musculus
gcgccgaggccttcaagtgcatgat

SEQ ID NO: 446833 - DNA, 25 bp, Mus musculus
gcgccgatgggcttaactttctcat

SEQ ID NO: 446834 - DNA, 25 bp, Mus musculus
gcgccgggacacagctccgactgtt

SEQ ID NO: 446835 - DNA, 25 bp, Mus musculus
gcgccgtgttgcattttcctaaaga

SEQ ID NO: 446836 - DNA, 25 bp, Mus musculus
gcgcctaacaaaactgaagtgtcag

SEQ ID NO: 446837 - DNA, 25 bp, Mus musculus
gcgcctaagccgcagtctcgatgca

SEQ ID NO: 446838 - DNA, 25 bp, Mus musculus
gcgcctcatctatggccaagacagt

SEQ ID NO: 446839 - DNA, 25 bp, Mus musculus
gcgcctccctggatcttgccaagga

SEQ ID NO: 446840 - DNA, 25 bp, Mus musculus
gcgcctccttcaagggctgacctgg

SEQ ID NO: 446841 - DNA, 25 bp, Mus musculus
gcgcctgagaacaaagacccaagtg

SEQ ID NO: 446842 - DNA, 25 bp, Mus musculus
gcgcctgcgctcagggagtgccaac

SEQ ID NO: 446843 - DNA, 25 bp, Mus musculus
gcgccttcgcgctcaagatcaacag

SEQ ID NO: 446844 - DNA, 25 bp, Mus musculus
gcgccttgggcgaactactttgctt

SEQ ID NO: 446845 - DNA, 25 bp, Mus musculus
gcgcgaacctgcaagatctgctcag

SEQ ID NO: 446846 - DNA, 25 bp, Mus musculus
gcgcgaatcccatgagctccaataa

SEQ ID NO: 446847 - DNA, 25 bp, Mus musculus
gcgcgaatcccgtacatcttaagct

SEQ ID NO: 446848 - DNA, 25 bp, Mus musculus
gcgcgagcgctcagtactccagcga

SEQ ID NO: 446849 - DNA, 25 bp, Mus musculus
gcgcgagctcgcaaccggagctgtc

SEQ ID NO: 446850 - DNA, 25 bp, Mus musculus
gcgcgcagaaccttgggagtcagaa

SEQ ID NO: 446851 - DNA, 25 bp, Mus musculus
gcgcgctgagcaagtggccttcgtt

SEQ ID NO: 446852 - DNA, 25 bp, Mus musculus
gcgcggattcctggtgaggcaaact

SEQ ID NO: 446853 - DNA, 25 bp, Mus musculus
gcgcggcacgagttacaagtagaaa

SEQ ID NO: 446854 - DNA, 25 bp, Mus musculus
gcgcggcgctaggatgaacgctcct

SEQ ID NO: 446855 - DNA, 25 bp, Mus musculus
gcgcggcgggcatgataacaagccc

SEQ ID NO: 446856 - DNA, 25 bp, Mus musculus
gcgcgggtatgcacaggttccatgc

SEQ ID NO: 446857 - DNA, 25 bp, Mus musculus
gcgcgggtatgcacgggttttcctc

SEQ ID NO: 446858 - DNA, 25 bp, Mus musculus
gcgcgggtgccaaagagttgtcctt

SEQ ID NO: 446859 - DNA, 25 bp, Mus musculus
gcgcggttcctttaatctgagcaga

SEQ ID NO: 446860 - DNA, 25 bp, Mus musculus
gcgcgtaatggcagtgccgtgtccc

SEQ ID NO: 446861 - DNA, 25 bp, Mus musculus
gcgcgtgcgtgctaagtgtgctccc

SEQ ID NO: 446862 - DNA, 25 bp, Mus musculus
gcgctaaagcatcattgtacaagac

SEQ ID NO: 446863 - DNA, 25 bp, Mus musculus
gcgctaaccttagtgacaagacttc

SEQ ID NO: 446864 - DNA, 25 bp, Mus musculus
gcgctaagtttacagggacctcagg

SEQ ID NO: 446865 - DNA, 25 bp, Mus musculus
gcgctacctggagaagaacccttgt

SEQ ID NO: 446866 - DNA, 25 bp, Mus musculus
gcgctacgacggcttgaagtacgat

SEQ ID NO: 446867 - DNA, 25 bp, Mus musculus
gcgctatcgagtggctgtacccagc

SEQ ID NO: 446868 - DNA, 25 bp, Mus musculus
gcgctcaggagcatggttcttcaaa

SEQ ID NO: 446869 - DNA, 25 bp, Mus musculus
gcgctcgcaaagtccctcaaaatga

SEQ ID NO: 446870 - DNA, 25 bp, Mus musculus
gcgctcggctctttctttgactgga

SEQ ID NO: 446871 - DNA, 25 bp, Mus musculus
gcgctctggtcctcaagtcattgaa

SEQ ID NO: 446872 - DNA, 25 bp, Mus musculus
gcgctcttctcgcagatgacttatg

SEQ ID NO: 446873 - DNA, 25 bp, Mus musculus
gcgctgatgcggctcctggaccttc

SEQ ID NO: 446874 - DNA, 25 bp, Mus musculus
gcgctgccgcaaagatcctctaagt

SEQ ID NO: 446875 - DNA, 25 bp, Mus musculus
gcgctgctttcaattctacccggga

SEQ ID NO: 446876 - DNA, 25 bp, Mus musculus
gcgctggaacccatggacacttcat

SEQ ID NO: 446877 - DNA, 25 bp, Mus musculus
gcgctgggacctgcaaataagttct

SEQ ID NO: 446878 - DNA, 25 bp, Mus musculus
gcgctgtcgcggacacccagacttg

SEQ ID NO: 446879 - DNA, 25 bp, Mus musculus
gcgctgtcggaaacatggatgcaac

SEQ ID NO: 446880 - DNA, 25 bp, Mus musculus
gcgctgtcggatgcggcaagacaaa

SEQ ID NO: 446881 - DNA, 25 bp, Mus musculus
gcgctgtcggtgtggccctctccag

SEQ ID NO: 446882 - DNA, 25 bp, Mus musculus
gcgcttagggacagaagttgaaaca

SEQ ID NO: 446883 - DNA, 25 bp, Mus musculus
gcgcttcagacgcagatatcggaat

SEQ ID NO: 446884 - DNA, 25 bp, Mus musculus
gcgcttctacaactatgccaggatg

SEQ ID NO: 446885 - DNA, 25 bp, Mus musculus
gcgcttgcgctccacagtgaacgta

SEQ ID NO: 446886 - DNA, 25 bp, Mus musculus
gcggaaaccgcctcacagggttcac

SEQ ID NO: 446887 - DNA, 25 bp, Mus musculus
gcggaacaggctacaggaggtcatc

SEQ ID NO: 446888 - DNA, 25 bp, Mus musculus
gcggaagaattataggtgccctgtc

SEQ ID NO: 446889 - DNA, 25 bp, Mus musculus
gcggaagatcctcggatctaaccca

SEQ ID NO: 446890 - DNA, 25 bp, Mus musculus
gcggaatccacagtcaacaagcttg

SEQ ID NO: 446891 - DNA, 25 bp, Mus musculus
gcggaatggcgctcgtcctacgaag

SEQ ID NO: 446892 - DNA, 25 bp, Mus musculus
gcggacacttcaaatcacgagactg

SEQ ID NO: 446893 - DNA, 25 bp, Mus musculus
gcggaccgacactcttctgaggcac

SEQ ID NO: 446894 - DNA, 25 bp, Mus musculus
gcggacctgctgtggctgccgcttc

SEQ ID NO: 446895 - DNA, 25 bp, Mus musculus
gcggactcgtggagactgctgctca

SEQ ID NO: 446896 - DNA, 25 bp, Mus musculus
gcggacttcaagatccctatggaga

SEQ ID NO: 446897 - DNA, 25 bp, Mus musculus
gcggagaaatgcgtgcagatcgctc

SEQ ID NO: 446898 - DNA, 25 bp, Mus musculus
gcggagaagtcgctcaccactccga

SEQ ID NO: 446899 - DNA, 25 bp, Mus musculus
gcggagagcttcactaccactggat

SEQ ID NO: 446900 - DNA, 25 bp, Mus musculus
gcggagcgaaaaagccagaaagacc

SEQ ID NO: 446901 - DNA, 25 bp, Mus musculus
gcggagcgttttaacgttggccacg

SEQ ID NO: 446902 - DNA, 25 bp, Mus musculus
gcggaggctttctaccttcccagga

SEQ ID NO: 446903 - DNA, 25 bp, Mus musculus
gcggagggctcttctacgctaccgg

SEQ ID NO: 446904 - DNA, 25 bp, Mus musculus
gcggagtctcaagggcacagattta

SEQ ID NO: 446905 - DNA, 25 bp, Mus musculus
gcggagtctggatctgtcattcaac

SEQ ID NO: 446906 - DNA, 25 bp, Mus musculus
gcggagtggagctcccagccagacc

SEQ ID NO: 446907 - DNA, 25 bp, Mus musculus
gcggataaacaaacaccagcgcgtg

SEQ ID NO: 446908 - DNA, 25 bp, Mus musculus
gcggatcacatggtcgaggagccct

SEQ ID NO: 446909 - DNA, 25 bp, Mus musculus
gcggatcattccctaattactggct

SEQ ID NO: 446910 - DNA, 25 bp, Mus musculus
gcggatccttcaggcatatataact

SEQ ID NO: 446911 - DNA, 25 bp, Mus musculus
gcggatttaaaaagccacacagata

SEQ ID NO: 446912 - DNA, 25 bp, Mus musculus
gcggcaagaagaccctccatgaagt

SEQ ID NO: 446913 - DNA, 25 bp, Mus musculus
gcggcacactgggtcttgactctca

SEQ ID NO: 446914 - DNA, 25 bp, Mus musculus
gcggcaccttgctatttcttctcag

SEQ ID NO: 446915 - DNA, 25 bp, Mus musculus
gcggcacgagctcgactccaaaaca

SEQ ID NO: 446916 - DNA, 25 bp, Mus musculus
gcggcactcgtggagacagcagata

SEQ ID NO: 446917 - DNA, 25 bp, Mus musculus
gcggcacttgcatcagagactcggt

SEQ ID NO: 446918 - DNA, 25 bp, Mus musculus
gcggcagagttccttcagcattaga

SEQ ID NO: 446919 - DNA, 25 bp, Mus musculus
gcggcagatgttgaccagcagcttc

SEQ ID NO: 446920 - DNA, 25 bp, Mus musculus
gcggcagccactagaagaaggaaga

SEQ ID NO: 446921 - DNA, 25 bp, Mus musculus
gcggcagccaggaacgtacactttg

SEQ ID NO: 446922 - DNA, 25 bp, Mus musculus
gcggcagcccttgtgaaccacaggg

SEQ ID NO: 446923 - DNA, 25 bp, Mus musculus
gcggcagctgcctcgtaaaaggacg

SEQ ID NO: 446924 - DNA, 25 bp, Mus musculus
gcggcaggcaactacaagtcggtgt

SEQ ID NO: 446925 - DNA, 25 bp, Mus musculus
gcggcagtgaaacgaacggctctca

SEQ ID NO: 446926 - DNA, 25 bp, Mus musculus
gcggcatctgctatgaagtctcaag

SEQ ID NO: 446927 - DNA, 25 bp, Mus musculus
gcggcattctctgctgcttcagctg

SEQ ID NO: 446928 - DNA, 25 bp, Mus musculus
gcggccagcggcaagtttacatgca

SEQ ID NO: 446929 - DNA, 25 bp, Mus musculus
gcggccatcgcgtctgctaagagga

SEQ ID NO: 446930 - DNA, 25 bp, Mus musculus
gcggccatctttagtccgggcaaga

SEQ ID NO: 446931 - DNA, 25 bp, Mus musculus
gcggccgcttccgacttagtttctt

SEQ ID NO: 446932 - DNA, 25 bp, Mus musculus
gcggccggaccgatcagccttaagt

SEQ ID NO: 446933 - DNA, 25 bp, Mus musculus
gcggccggcaggaacatgctgctca

SEQ ID NO: 446934 - DNA, 25 bp, Mus musculus
gcggccgtcaaccacactatcttgg

SEQ ID NO: 446935 - DNA, 25 bp, Mus musculus
gcggcctccccacattgggcttgtg

SEQ ID NO: 446936 - DNA, 25 bp, Mus musculus
gcggcctgctctggacactgtggtc

SEQ ID NO: 446937 - DNA, 25 bp, Mus musculus
gcggccttagggaaatgaacattgt

SEQ ID NO: 446938 - DNA, 25 bp, Mus musculus
gcggccttcccgctagagcggcgag

SEQ ID NO: 446939 - DNA, 25 bp, Mus musculus
gcggcgatatccagtctggctgcaa

SEQ ID NO: 446940 - DNA, 25 bp, Mus musculus
gcggcgatggccttacagtcaacct

SEQ ID NO: 446941 - DNA, 25 bp, Mus musculus
gcggcgattcgtcttccagaagtac

SEQ ID NO: 446942 - DNA, 25 bp, Mus musculus
gcggcgcacggcctacctttgtgca

SEQ ID NO: 446943 - DNA, 25 bp, Mus musculus
gcggcgccaacaagaagctgagtaa

SEQ ID NO: 446944 - DNA, 25 bp, Mus musculus
gcggcggatgtaacctgtgcagctc

SEQ ID NO: 446945 - DNA, 25 bp, Mus musculus
gcggcggcattttgcaggcagcatt

SEQ ID NO: 446946 - DNA, 25 bp, Mus musculus
gcggcggctccgttaactttgcact

SEQ ID NO: 446947 - DNA, 25 bp, Mus musculus
gcggcggctcctacaaatgcatcaa

SEQ ID NO: 446948 - DNA, 25 bp, Mus musculus
gcggcgggatcactggctccccgag

SEQ ID NO: 446949 - DNA, 25 bp, Mus musculus
gcggcgttaaattctcggactggag

SEQ ID NO: 446950 - DNA, 25 bp, Mus musculus
gcggctagtcataccacaatgtaga

SEQ ID NO: 446951 - DNA, 25 bp, Mus musculus
gcggctcccgatggagactgacgca

SEQ ID NO: 446952 - DNA, 25 bp, Mus musculus
gcggctccgggactcgtggtgttcc

SEQ ID NO: 446953 - DNA, 25 bp, Mus musculus
gcggctcggattttccagcgtttcc

SEQ ID NO: 446954 - DNA, 25 bp, Mus musculus
gcggctcttaatggagcaccatggg

SEQ ID NO: 446955 - DNA, 25 bp, Mus musculus
gcggctgccagttcaaaaaatcaag

SEQ ID NO: 446956 - DNA, 25 bp, Mus musculus
gcggctgcgacctgggtcacaccga

SEQ ID NO: 446957 - DNA, 25 bp, Mus musculus
gcggctggtcgatcttcatggctca

SEQ ID NO: 446958 - DNA, 25 bp, Mus musculus
gcggctgtcaaacctgctgtagaaa

SEQ ID NO: 446959 - DNA, 25 bp, Mus musculus
gcggcttcattctcggcagtgacaa

SEQ ID NO: 446960 - DNA, 25 bp, Mus musculus
gcggcttccaccgtgtagctgtgaa

SEQ ID NO: 446961 - DNA, 25 bp, Mus musculus
gcggcttctccatcagtaagtttcc

SEQ ID NO: 446962 - DNA, 25 bp, Mus musculus
gcggcttgtgcgtccttcccgagct

SEQ ID NO: 446963 - DNA, 25 bp, Mus musculus
gcggcttgttgcacttagggatcct

SEQ ID NO: 446964 - DNA, 25 bp, Mus musculus
gcggctttagcctttgcaagcggaa

SEQ ID NO: 446965 - DNA, 25 bp, Mus musculus
gcgggaaatctacccaggcagcaaa

SEQ ID NO: 446966 - DNA, 25 bp, Mus musculus
gcgggaagctcctttacaatggaaa

SEQ ID NO: 446967 - DNA, 25 bp, Mus musculus
gcgggacaggccgaaatgaccacgc

SEQ ID NO: 446968 - DNA, 25 bp, Mus musculus
gcgggacttgtatccatgattgacc

SEQ ID NO: 446969 - DNA, 25 bp, Mus musculus
gcgggaggatcacaatcattggcct

SEQ ID NO: 446970 - DNA, 25 bp, Mus musculus
gcgggaggatggaaacagaccctaa

SEQ ID NO: 446971 - DNA, 25 bp, Mus musculus
gcgggaggtcatgccttacgcgcac

SEQ ID NO: 446972 - DNA, 25 bp, Mus musculus
gcgggagtatgcagccaacaagttt

SEQ ID NO: 446973 - DNA, 25 bp, Mus musculus
gcgggatgtcccagaatttatgatc

SEQ ID NO: 446974 - DNA, 25 bp, Mus musculus
gcgggattcccttacagagagtgtc

SEQ ID NO: 446975 - DNA, 25 bp, Mus musculus
gcgggcacgtcgttgcgcgtcctca

SEQ ID NO: 446976 - DNA, 25 bp, Mus musculus
gcgggcagctttccaactcagatgt

SEQ ID NO: 446977 - DNA, 25 bp, Mus musculus
gcgggcatatcgagacaagctgaag

SEQ ID NO: 446978 - DNA, 25 bp, Mus musculus
gcgggcatatggcacgaactacatc

SEQ ID NO: 446979 - DNA, 25 bp, Mus musculus
gcgggcatccttgtcattcctgaga

SEQ ID NO: 446980 - DNA, 25 bp, Mus musculus
gcgggccaacagtgacacggatctg

SEQ ID NO: 446981 - DNA, 25 bp, Mus musculus
gcgggccaccgcaaagttatctaaa

SEQ ID NO: 446982 - DNA, 25 bp, Mus musculus
gcgggcggcgatgatgggcggccat

SEQ ID NO: 446983 - DNA, 25 bp, Mus musculus
gcgggctccgatcgtaagtactgaa

SEQ ID NO: 446984 - DNA, 25 bp, Mus musculus
gcgggctggcctctatgaataacct

SEQ ID NO: 446985 - DNA, 25 bp, Mus musculus
gcgggtatcccatcaccagataaag

SEQ ID NO: 446986 - DNA, 25 bp, Mus musculus
gcgggtcctcataaacatctcgggt

SEQ ID NO: 446987 - DNA, 25 bp, Mus musculus
gcgggtctctgttcacatggctcaa

SEQ ID NO: 446988 - DNA, 25 bp, Mus musculus
gcgggtgacgtatgtttcagctact

SEQ ID NO: 446989 - DNA, 25 bp, Mus musculus
gcgggtgctcgtggtaaatgcctca

SEQ ID NO: 446990 - DNA, 25 bp, Mus musculus
gcgggtgtcaattggatccttagcc

SEQ ID NO: 446991 - DNA, 25 bp, Mus musculus
gcgggtgtttctgtaactggatctt

SEQ ID NO: 446992 - DNA, 25 bp, Mus musculus
gcgggttaatcaggatcttcacaaa

SEQ ID NO: 446993 - DNA, 25 bp, Mus musculus
gcgggttcaggactaatgtctccaa

SEQ ID NO: 446994 - DNA, 25 bp, Mus musculus
gcgggttgtttctcaagatgctgaa

SEQ ID NO: 446995 - DNA, 25 bp, Mus musculus
gcggtaaggtcttctgctttctaac

SEQ ID NO: 446996 - DNA, 25 bp, Mus musculus
gcggtaagtgtgatcccgacgacca

SEQ ID NO: 446997 - DNA, 25 bp, Mus musculus
gcggtacctggccatgaacaagaga

SEQ ID NO: 446998 - DNA, 25 bp, Mus musculus
gcggtaggcgtgttcgaccttctga

SEQ ID NO: 446999 - DNA, 25 bp, Mus musculus
gcggtataaaagatgcgattcagga

SEQ ID NO: 447000 - DNA, 25 bp, Mus musculus
gcggtcactgagtacctagcagcgg

SEQ ID NO: 447001 - DNA, 25 bp, Mus musculus
gcggtcccggcttccagaaagatgg

SEQ ID NO: 447002 - DNA, 25 bp, Mus musculus
gcggtcctccccttagagttgagca

SEQ ID NO: 447003 - DNA, 25 bp, Mus musculus
gcggtcttcgcctcgacctagtcga

SEQ ID NO: 447004 - DNA, 25 bp, Mus musculus
gcggtgaacagacagtgagcatatc

SEQ ID NO: 447005 - DNA, 25 bp, Mus musculus
gcggtgactttgactacccgggagc

SEQ ID NO: 447006 - DNA, 25 bp, Mus musculus
gcggtgaggcagtttttagccgtta

SEQ ID NO: 447007 - DNA, 25 bp, Mus musculus
gcggtgcgcatccaagcctatgact

SEQ ID NO: 447008 - DNA, 25 bp, Mus musculus
gcggtgctcaaagctcctctatgcc

SEQ ID NO: 447009 - DNA, 25 bp, Mus musculus
gcggtgctgggaagtcatttagcct

SEQ ID NO: 447010 - DNA, 25 bp, Mus musculus
gcggtggtacatcctcatgcaacag

SEQ ID NO: 447011 - DNA, 25 bp, Mus musculus
gcggtggttctctcatcagtccgaa

SEQ ID NO: 447012 - DNA, 25 bp, Mus musculus
gcggtgtactacgtgtgcgcgctca

SEQ ID NO: 447013 - DNA, 25 bp, Mus musculus
gcggtgtagtcgataatagccacat

SEQ ID NO: 447014 - DNA, 25 bp, Mus musculus
gcggttcacgaggagaccgaagccc

SEQ ID NO: 447015 - DNA, 25 bp, Mus musculus
gcggttcaggcatccaaatcggtca

SEQ ID NO: 447016 - DNA, 25 bp, Mus musculus
gcggttctcgggtacaaagttcaag

SEQ ID NO: 447017 - DNA, 25 bp, Mus musculus
gcggttgaaaacctggccaccaata

SEQ ID NO: 447018 - DNA, 25 bp, Mus musculus
gcggttgatgcacctttcttttcag

SEQ ID NO: 447019 - DNA, 25 bp, Mus musculus
gcggtttcaaaagcttccagacgta

SEQ ID NO: 447020 - DNA, 25 bp, Mus musculus
gcggtttgaatgcaattcaggcttc

SEQ ID NO: 447021 - DNA, 25 bp, Mus musculus
gcggtttgtccttctgtcgagggaa

SEQ ID NO: 447022 - DNA, 25 bp, Mus musculus
gcgtaaacccctttgctcctaggtg

SEQ ID NO: 447023 - DNA, 25 bp, Mus musculus
gcgtaaagtgatggccccaggctgt

SEQ ID NO: 447024 - DNA, 25 bp, Mus musculus
gcgtaactcctatgtagttggccag

SEQ ID NO: 447025 - DNA, 25 bp, Mus musculus
gcgtaattgtaagtgccctgggcca

SEQ ID NO: 447026 - DNA, 25 bp, Mus musculus
gcgtacacattgtccttaagccgtt

SEQ ID NO: 447027 - DNA, 25 bp, Mus musculus
gcgtagactcaaaaacaaccgggag

SEQ ID NO: 447028 - DNA, 25 bp, Mus musculus
gcgtagaggccttcgtcccacggtg

SEQ ID NO: 447029 - DNA, 25 bp, Mus musculus
gcgtagccataaagcggatcaactt

SEQ ID NO: 447030 - DNA, 25 bp, Mus musculus
gcgtattatctttctatggcgaaaa

SEQ ID NO: 447031 - DNA, 25 bp, Mus musculus
gcgtcaaagccaacgatcgcgagcg

SEQ ID NO: 447032 - DNA, 25 bp, Mus musculus
gcgtcaactggatggaagactccga

SEQ ID NO: 447033 - DNA, 25 bp, Mus musculus
gcgtcacccagtatcttttgtagcc

SEQ ID NO: 447034 - DNA, 25 bp, Mus musculus
gcgtcactggtactcaacatgctgg

SEQ ID NO: 447035 - DNA, 25 bp, Mus musculus
gcgtcagcagcatatccggaacctt

SEQ ID NO: 447036 - DNA, 25 bp, Mus musculus
gcgtcagttgctaattggacttctg

SEQ ID NO: 447037 - DNA, 25 bp, Mus musculus
gcgtcatggtcgcatccactctggt

SEQ ID NO: 447038 - DNA, 25 bp, Mus musculus
gcgtccagacgaggcggtacaagtt

SEQ ID NO: 447039 - DNA, 25 bp, Mus musculus
gcgtccagtctgtgaacgggataat

SEQ ID NO: 447040 - DNA, 25 bp, Mus musculus
gcgtcccagtcactgaccgttgtag

SEQ ID NO: 447041 - DNA, 25 bp, Mus musculus
gcgtccctctaactgctctgttttt

SEQ ID NO: 447042 - DNA, 25 bp, Mus musculus
gcgtccgccaagtcatcagatagtg

SEQ ID NO: 447043 - DNA, 25 bp, Mus musculus
gcgtcgaccccagttttgcaggcaa

SEQ ID NO: 447044 - DNA, 25 bp, Mus musculus
gcgtcgccatgcactaccagatgag

SEQ ID NO: 447045 - DNA, 25 bp, Mus musculus
gcgtcgcctgggtgcagcgcagtgt

SEQ ID NO: 447046 - DNA, 25 bp, Mus musculus
gcgtcgctctaggtgtcgcctcgtt

SEQ ID NO: 447047 - DNA, 25 bp, Mus musculus
gcgtcggaccagtcgttcggctgct

SEQ ID NO: 447048 - DNA, 25 bp, Mus musculus
gcgtctaacgctttctcactcggga

SEQ ID NO: 447049 - DNA, 25 bp, Mus musculus
gcgtctaagaagctcggaaggtcct

SEQ ID NO: 447050 - DNA, 25 bp, Mus musculus
gcgtctaagccgcacgtggagatcc

SEQ ID NO: 447051 - DNA, 25 bp, Mus musculus
gcgtctacaagaggccgcctaggga

SEQ ID NO: 447052 - DNA, 25 bp, Mus musculus
gcgtctaccgcttccagaggcgcgg

SEQ ID NO: 447053 - DNA, 25 bp, Mus musculus
gcgtctatgacagattaccacgaag

SEQ ID NO: 447054 - DNA, 25 bp, Mus musculus
gcgtctccaggttgcgcatcttggc

SEQ ID NO: 447055 - DNA, 25 bp, Mus musculus
gcgtctctggattcactgctgggtg

SEQ ID NO: 447056 - DNA, 25 bp, Mus musculus
gcgtctgatcgtgaagaacctcccg

SEQ ID NO: 447057 - DNA, 25 bp, Mus musculus
gcgtctggttttcaccctggagttc

SEQ ID NO: 447058 - DNA, 25 bp, Mus musculus
gcgtctgtttaagttgacgtccaga

SEQ ID NO: 447059 - DNA, 25 bp, Mus musculus
gcgtgaaccctaggttgggagtact

SEQ ID NO: 447060 - DNA, 25 bp, Mus musculus
gcgtgaatgttgtcactatgacgga

SEQ ID NO: 447061 - DNA, 25 bp, Mus musculus
gcgtgagagggtgctgctaacccat

SEQ ID NO: 447062 - DNA, 25 bp, Mus musculus
gcgtgatcgctctccaattcgagga

SEQ ID NO: 447063 - DNA, 25 bp, Mus musculus
gcgtgcactcccaggcgtaaataaa

SEQ ID NO: 447064 - DNA, 25 bp, Mus musculus
gcgtgcattggctactcttgaagga

SEQ ID NO: 447065 - DNA, 25 bp, Mus musculus
gcgtgccggctttggagcttaacaa

SEQ ID NO: 447066 - DNA, 25 bp, Mus musculus
gcgtgcgaccccagagcaagaggcc

SEQ ID NO: 447067 - DNA, 25 bp, Mus musculus
gcgtgcgagacctgctgtactatta

SEQ ID NO: 447068 - DNA, 25 bp, Mus musculus
gcgtgctaagtgtgctcccggaagt

SEQ ID NO: 447069 - DNA, 25 bp, Mus musculus
gcgtgctcggctttgcgcgcgctca

SEQ ID NO: 447070 - DNA, 25 bp, Mus musculus
gcgtgctctgacacaaaaggttgat

SEQ ID NO: 447071 - DNA, 25 bp, Mus musculus
gcgtgctctgctagccggtgatcga

SEQ ID NO: 447072 - DNA, 25 bp, Mus musculus
gcgtgcttacacttactaatatagc

SEQ ID NO: 447073 - DNA, 25 bp, Mus musculus
gcgtgcttctgtgcttctcccagga

SEQ ID NO: 447074 - DNA, 25 bp, Mus musculus
gcgtgcttttcatgtgcaagactca

SEQ ID NO: 447075 - DNA, 25 bp, Mus musculus
gcgtggaaatagaaagggccctcaa

SEQ ID NO: 447076 - DNA, 25 bp, Mus musculus
gcgtggaagccaaggaaatcttttc

SEQ ID NO: 447077 - DNA, 25 bp, Mus musculus
gcgtggacatcatctcaggtagcct

SEQ ID NO: 447078 - DNA, 25 bp, Mus musculus
gcgtggactccgataaagaactctc

SEQ ID NO: 447079 - DNA, 25 bp, Mus musculus
gcgtggagcgttactgattcacaca

SEQ ID NO: 447080 - DNA, 25 bp, Mus musculus
gcgtggccacgcatcattgcaatca

SEQ ID NO: 447081 - DNA, 25 bp, Mus musculus
gcgtggcctccaaagattctgctga

SEQ ID NO: 447082 - DNA, 25 bp, Mus musculus
gcgtggctgtcaagaccggctctgt

SEQ ID NO: 447083 - DNA, 25 bp, Mus musculus
gcgtgggcaccatcctgagcaatgt

SEQ ID NO: 447084 - DNA, 25 bp, Mus musculus
gcgtgggtacccgaagctcttctct

SEQ ID NO: 447085 - DNA, 25 bp, Mus musculus
gcgtgggtctcaatgcctatggcta

SEQ ID NO: 447086 - DNA, 25 bp, Mus musculus
gcgtggtggcctcagtaatgtatac

SEQ ID NO: 447087 - DNA, 25 bp, Mus musculus
gcgtgtagtgtcttagtgtcgtcca

SEQ ID NO: 447088 - DNA, 25 bp, Mus musculus
gcgtgtcaatggcagctgcgccttc

SEQ ID NO: 447089 - DNA, 25 bp, Mus musculus
gcgtgtctcgctgtgcgtccatgca

SEQ ID NO: 447090 - DNA, 25 bp, Mus musculus
gcgtgtctgcctacggaccattgag

SEQ ID NO: 447091 - DNA, 25 bp, Mus musculus
gcgtgtcttcttcgagcagccctgc

SEQ ID NO: 447092 - DNA, 25 bp, Mus musculus
gcgtgtgaccttgcctcagattgaa

SEQ ID NO: 447093 - DNA, 25 bp, Mus musculus
gcgtgtgacgattgcccctttaaag

SEQ ID NO: 447094 - DNA, 25 bp, Mus musculus
gcgtgtgcagctgtgacccatatac

SEQ ID NO: 447095 - DNA, 25 bp, Mus musculus
gcgtgtgctcatcaaaacatccttc

SEQ ID NO: 447096 - DNA, 25 bp, Mus musculus
gcgtgttccggaacctatccctcga

SEQ ID NO: 447097 - DNA, 25 bp, Mus musculus
gcgtgttgagccgtcctctcggaaa

SEQ ID NO: 447098 - DNA, 25 bp, Mus musculus
gcgttaactctccagaggaccctga

SEQ ID NO: 447099 - DNA, 25 bp, Mus musculus
gcgttacattggtcgtgagcctcca

SEQ ID NO: 447100 - DNA, 25 bp, Mus musculus
gcgttacctgccttacacttgaaga

SEQ ID NO: 447101 - DNA, 25 bp, Mus musculus
gcgttaggcttgctgtctcctcagg

SEQ ID NO: 447102 - DNA, 25 bp, Mus musculus
gcgttattgacacctttaacctagg

SEQ ID NO: 447103 - DNA, 25 bp, Mus musculus
gcgttattgttctgccgggcggaca

SEQ ID NO: 447104 - DNA, 25 bp, Mus musculus
gcgttcaaggaggaagccagtgcct

SEQ ID NO: 447105 - DNA, 25 bp, Mus musculus
gcgttcattcagatccccaggtggg

SEQ ID NO: 447106 - DNA, 25 bp, Mus musculus
gcgttcggatgcaattgggcccaga

SEQ ID NO: 447107 - DNA, 25 bp, Mus musculus
gcgttcgtcccacttaggccaagaa

SEQ ID NO: 447108 - DNA, 25 bp, Mus musculus
gcgttcgtgagctactggcatggta

SEQ ID NO: 447109 - DNA, 25 bp, Mus musculus
gcgttgccagcttgcccctaagcaa

SEQ ID NO: 447110 - DNA, 25 bp, Mus musculus
gcgttgctttaacagatactagaca

SEQ ID NO: 447111 - DNA, 25 bp, Mus musculus
gcgttgtccacaagcgatgtcatga

SEQ ID NO: 447112 - DNA, 25 bp, Mus musculus
gcgtttaaacatggctcagctgggt

SEQ ID NO: 447113 - DNA, 25 bp, Mus musculus
gcgtttacaagatggcacgtagcca

SEQ ID NO: 447114 - DNA, 25 bp, Mus musculus
gcgtttatccagtcccgagttatgt

SEQ ID NO: 447115 - DNA, 25 bp, Mus musculus
gcgtttcaacataattcagccagga

SEQ ID NO: 447116 - DNA, 25 bp, Mus musculus
gcgtttccagacactagtagcccag

SEQ ID NO: 447117 - DNA, 25 bp, Mus musculus
gcgtttccagtcaactgctgcctga

SEQ ID NO: 447118 - DNA, 25 bp, Mus musculus
gctaaaaaagctgagtgaagacagt

SEQ ID NO: 447119 - DNA, 25 bp, Mus musculus
gctaaaaaccagcaggaaatcctca

SEQ ID NO: 447120 - DNA, 25 bp, Mus musculus
gctaaaaactgtgatgtctgcgcca

SEQ ID NO: 447121 - DNA, 25 bp, Mus musculus
gctaaaaggatatccgcctacggcg

SEQ ID NO: 447122 - DNA, 25 bp, Mus musculus
gctaaaaggtctccagtgtcttctc

SEQ ID NO: 447123 - DNA, 25 bp, Mus musculus
gctaaaatgctcctggactccgtgg

SEQ ID NO: 447124 - DNA, 25 bp, Mus musculus
gctaaaattaagtggagcgggcctg

SEQ ID NO: 447125 - DNA, 25 bp, Mus musculus
gctaaacaactgagcaaatccacac

SEQ ID NO: 447126 - DNA, 25 bp, Mus musculus
gctaaacaagttctacaacgtggat

SEQ ID NO: 447127 - DNA, 25 bp, Mus musculus
gctaaaccgtcagtgctgggtcctg

SEQ ID NO: 447128 - DNA, 25 bp, Mus musculus
gctaaacgacagcagtcacgcaggg

SEQ ID NO: 447129 - DNA, 25 bp, Mus musculus
gctaaactcaagaacgtggcctgga

SEQ ID NO: 447130 - DNA, 25 bp, Mus musculus
gctaaactgtaataacgttgggaag

SEQ ID NO: 447131 - DNA, 25 bp, Mus musculus
gctaaagatatggtgcagcctactt

SEQ ID NO: 447132 - DNA, 25 bp, Mus musculus
gctaaagatcttggatggacctaaa

SEQ ID NO: 447133 - DNA, 25 bp, Mus musculus
gctaaagattttggtcacgtgcagt

SEQ ID NO: 447134 - DNA, 25 bp, Mus musculus
gctaaaggaaagttgtaataatatc

SEQ ID NO: 447135 - DNA, 25 bp, Mus musculus
gctaaaggatcgcaattgtcacaac

SEQ ID NO: 447136 - DNA, 25 bp, Mus musculus
gctaaaggctgagaggaactaccac

SEQ ID NO: 447137 - DNA, 25 bp, Mus musculus
gctaaagtcacacagccagctcttg

SEQ ID NO: 447138 - DNA, 25 bp, Mus musculus
gctaaagtccaaattctaatcaggg

SEQ ID NO: 447139 - DNA, 25 bp, Mus musculus
gctaaagtgctgtttgcaaatcctc

SEQ ID NO: 447140 - DNA, 25 bp, Mus musculus
gctaaagttacggaggttggctgcc

SEQ ID NO: 447141 - DNA, 25 bp, Mus musculus
gctaaataagtatcccataaacatg

SEQ ID NO: 447142 - DNA, 25 bp, Mus musculus
gctaaatcacagaccattcatggaa

SEQ ID NO: 447143 - DNA, 25 bp, Mus musculus
gctaaatcatgatgcggtaaacaat

SEQ ID NO: 447144 - DNA, 25 bp, Mus musculus
gctaaatgacagaaggctacagacc

SEQ ID NO: 447145 - DNA, 25 bp, Mus musculus
gctaacaatgaaggcgagaactcca

SEQ ID NO: 447146 - DNA, 25 bp, Mus musculus
gctaacacatatgggcagctgggaa

SEQ ID NO: 447147 - DNA, 25 bp, Mus musculus
gctaacatgctttcgctactggagg

SEQ ID NO: 447148 - DNA, 25 bp, Mus musculus
gctaacatgttgcaggaatactcca

SEQ ID NO: 447149 - DNA, 25 bp, Mus musculus
gctaacctcctcaatgattctgtgg

SEQ ID NO: 447150 - DNA, 25 bp, Mus musculus
gctaactaacactaaggtccgcctc

SEQ ID NO: 447151 - DNA, 25 bp, Mus musculus
gctaactaataggagtaatgtcatc

SEQ ID NO: 447152 - DNA, 25 bp, Mus musculus
gctaactcgagagccctgttgaagc

SEQ ID NO: 447153 - DNA, 25 bp, Mus musculus
gctaactgggaagtatactgctgcc

SEQ ID NO: 447154 - DNA, 25 bp, Mus musculus
gctaagaaaatatgccaaaacatgc

SEQ ID NO: 447155 - DNA, 25 bp, Mus musculus
gctaagaagctgatcctgggaggac

SEQ ID NO: 447156 - DNA, 25 bp, Mus musculus
gctaagaattgaggttcctgggaac

SEQ ID NO: 447157 - DNA, 25 bp, Mus musculus
gctaagagcactccaactgctgaag

SEQ ID NO: 447158 - DNA, 25 bp, Mus musculus
gctaagaggaaacccactgtggaaa

SEQ ID NO: 447159 - DNA, 25 bp, Mus musculus
gctaagatccagtaataaagtgtgc

SEQ ID NO: 447160 - DNA, 25 bp, Mus musculus
gctaagatgctccttcgagtgcaca

SEQ ID NO: 447161 - DNA, 25 bp, Mus musculus
gctaagcaactgagaggcccgtgga

SEQ ID NO: 447162 - DNA, 25 bp, Mus musculus
gctaagcaatagacaggagccgtca

SEQ ID NO: 447163 - DNA, 25 bp, Mus musculus
gctaagcccgcgatgggaaagaccg

SEQ ID NO: 447164 - DNA, 25 bp, Mus musculus
gctaagccgcgtgttgatccatctc

SEQ ID NO: 447165 - DNA, 25 bp, Mus musculus
gctaagcgagcgaaaaatttggcct

SEQ ID NO: 447166 - DNA, 25 bp, Mus musculus
gctaagctctggaatgaatggtgca

SEQ ID NO: 447167 - DNA, 25 bp, Mus musculus
gctaagctgggtctaaatctcggag

SEQ ID NO: 447168 - DNA, 25 bp, Mus musculus
gctaagcttagttgttgccgtgcaa

SEQ ID NO: 447169 - DNA, 25 bp, Mus musculus
gctaagcttccaaccgcgggtgttc

SEQ ID NO: 447170 - DNA, 25 bp, Mus musculus
gctaaggaccctgtcaatcgcagag

SEQ ID NO: 447171 - DNA, 25 bp, Mus musculus
gctaaggatgataacattgaactct

SEQ ID NO: 447172 - DNA, 25 bp, Mus musculus
gctaaggccagagtaccagcttcac

SEQ ID NO: 447173 - DNA, 25 bp, Mus musculus
gctaaggcgaaaacgtggcaagtgt

SEQ ID NO: 447174 - DNA, 25 bp, Mus musculus
gctaagtaaaagcactgacggataa

SEQ ID NO: 447175 - DNA, 25 bp, Mus musculus
gctaagtctagagaatctaaccctg

SEQ ID NO: 447176 - DNA, 25 bp, Mus musculus
gctaagtgacgaaaaggctgctgga

SEQ ID NO: 447177 - DNA, 25 bp, Mus musculus
gctaagtgtgcagttgccagatgat

SEQ ID NO: 447178 - DNA, 25 bp, Mus musculus
gctaagtgtggctggcctctttccc

SEQ ID NO: 447179 - DNA, 25 bp, Mus musculus
gctaagtgttgctagaggtccagaa

SEQ ID NO: 447180 - DNA, 25 bp, Mus musculus
gctaatattgctcttgcccgccctg

SEQ ID NO: 447181 - DNA, 25 bp, Mus musculus
gctaatcatcatcgtgggacctgga

SEQ ID NO: 447182 - DNA, 25 bp, Mus musculus
gctaatccgtaaaagcgccaccggg

SEQ ID NO: 447183 - DNA, 25 bp, Mus musculus
gctaatcgtgcactgggaaacatca

SEQ ID NO: 447184 - DNA, 25 bp, Mus musculus
gctaatctgcttccccttctgctga

SEQ ID NO: 447185 - DNA, 25 bp, Mus musculus
gctaatgaaactgcagaaccagcga

SEQ ID NO: 447186 - DNA, 25 bp, Mus musculus
gctaatgagcccgtgtttccatgaa

SEQ ID NO: 447187 - DNA, 25 bp, Mus musculus
gctaatgcagagatggacaaacccg

SEQ ID NO: 447188 - DNA, 25 bp, Mus musculus
gctaatggcatgcaagttctctcca

SEQ ID NO: 447189 - DNA, 25 bp, Mus musculus
gctaattatgggttgctgccctgga

SEQ ID NO: 447190 - DNA, 25 bp, Mus musculus
gctaattctcgccaatgctttatac

SEQ ID NO: 447191 - DNA, 25 bp, Mus musculus
gctaattgcagagataataaatctg

SEQ ID NO: 447192 - DNA, 25 bp, Mus musculus
gctaattgcagcatgatggcgtgga

SEQ ID NO: 447193 - DNA, 25 bp, Mus musculus
gctaattgtaagttgtgggcctctg

SEQ ID NO: 447194 - DNA, 25 bp, Mus musculus
gctaattgtgacaactgagtgggag

SEQ ID NO: 447195 - DNA, 25 bp, Mus musculus
gctaatttcgcgttccttgtttacg

SEQ ID NO: 447196 - DNA, 25 bp, Mus musculus
gctacaaaatatgttccaggtctgg

SEQ ID NO: 447197 - DNA, 25 bp, Mus musculus
gctacaaagaggattggctaccctg

SEQ ID NO: 447198 - DNA, 25 bp, Mus musculus
gctacaaaggaatgactcaattcca

SEQ ID NO: 447199 - DNA, 25 bp, Mus musculus
gctacaaagtccctgtgctgggctg

SEQ ID NO: 447200 - DNA, 25 bp, Mus musculus
gctacaacaacaaacgtgcacaggg

SEQ ID NO: 447201 - DNA, 25 bp, Mus musculus
gctacaacgcgctcatcatgatggc

SEQ ID NO: 447202 - DNA, 25 bp, Mus musculus
gctacaacggttcggagctccaaga

SEQ ID NO: 447203 - DNA, 25 bp, Mus musculus
gctacaactcttggcaaaatcgctg

SEQ ID NO: 447204 - DNA, 25 bp, Mus musculus
gctacaactgggtggtgctaaggct

SEQ ID NO: 447205 - DNA, 25 bp, Mus musculus
gctacaagagcgatgtacaagccaa

SEQ ID NO: 447206 - DNA, 25 bp, Mus musculus
gctacaagatgaagcgccaggctaa

SEQ ID NO: 447207 - DNA, 25 bp, Mus musculus
gctacaaggcaagggcatgggatat

SEQ ID NO: 447208 - DNA, 25 bp, Mus musculus
gctacaaggtgaactcatctgtatg

SEQ ID NO: 447209 - DNA, 25 bp, Mus musculus
gctacaagttagtcagtgggtcggt

SEQ ID NO: 447210 - DNA, 25 bp, Mus musculus
gctacaagttatcaccaaatgccct

SEQ ID NO: 447211 - DNA, 25 bp, Mus musculus
gctacaatgtaacccggccagaagg

SEQ ID NO: 447212 - DNA, 25 bp, Mus musculus
gctacaattgcgttaaagaccacaa

SEQ ID NO: 447213 - DNA, 25 bp, Mus musculus
gctacacacttgatgactgaaggaa

SEQ ID NO: 447214 - DNA, 25 bp, Mus musculus
gctacaccaagatacctgaccaggg

SEQ ID NO: 447215 - DNA, 25 bp, Mus musculus
gctacacccggtgcagctttttggg

SEQ ID NO: 447216 - DNA, 25 bp, Mus musculus
gctacacgaaggactccagcatggg

SEQ ID NO: 447217 - DNA, 25 bp, Mus musculus
gctacacgatacagatgaaaaccgg

SEQ ID NO: 447218 - DNA, 25 bp, Mus musculus
gctacacgggaggttaatgcattta

SEQ ID NO: 447219 - DNA, 25 bp, Mus musculus
gctacacgtacacggagacctcggt

SEQ ID NO: 447220 - DNA, 25 bp, Mus musculus
gctacactctgagaatgctcttgaa

SEQ ID NO: 447221 - DNA, 25 bp, Mus musculus
gctacactgtaagctctgtggagca

SEQ ID NO: 447222 - DNA, 25 bp, Mus musculus
gctacacttgtgtttatcacccctg

SEQ ID NO: 447223 - DNA, 25 bp, Mus musculus
gctacagacaccgagaatatccgct

SEQ ID NO: 447224 - DNA, 25 bp, Mus musculus
gctacagattagtgcaacaagctaa

SEQ ID NO: 447225 - DNA, 25 bp, Mus musculus
gctacagccgtgtcatgggtgcatg

SEQ ID NO: 447226 - DNA, 25 bp, Mus musculus
gctacagccttcagaataatcagag

SEQ ID NO: 447227 - DNA, 25 bp, Mus musculus
gctacaggatgcgttcagtgggctc

SEQ ID NO: 447228 - DNA, 25 bp, Mus musculus
gctacagtgcccgttttaaaaatgg

SEQ ID NO: 447229 - DNA, 25 bp, Mus musculus
gctacagtggtaggcatttttcaca

SEQ ID NO: 447230 - DNA, 25 bp, Mus musculus
gctacatcatcgagtgcaagctggg

SEQ ID NO: 447231 - DNA, 25 bp, Mus musculus
gctacatcgaaggtctgcaggctct

SEQ ID NO: 447232 - DNA, 25 bp, Mus musculus
gctacatgaagcttgccagaggcag

SEQ ID NO: 447233 - DNA, 25 bp, Mus musculus
gctacatggaaagcccatgtctcca

SEQ ID NO: 447234 - DNA, 25 bp, Mus musculus
gctacatggatcagtgggtgcccgt

SEQ ID NO: 447235 - DNA, 25 bp, Mus musculus
gctacattcatggaagcagccaggc

SEQ ID NO: 447236 - DNA, 25 bp, Mus musculus
gctacattctgcctgcttgccggag

SEQ ID NO: 447237 - DNA, 25 bp, Mus musculus
gctaccaaaaagaggtcctttctgg

SEQ ID NO: 447238 - DNA, 25 bp, Mus musculus
gctaccaactggatgaggacttcca

SEQ ID NO: 447239 - DNA, 25 bp, Mus musculus
gctaccacctagcagggcattcttg

SEQ ID NO: 447240 - DNA, 25 bp, Mus musculus
gctaccagagtttgctgacgcgcgc

SEQ ID NO: 447241 - DNA, 25 bp, Mus musculus
gctaccatagtgacaaacggcgcct

SEQ ID NO: 447242 - DNA, 25 bp, Mus musculus
gctaccatatgtggtttgcatagtc

SEQ ID NO: 447243 - DNA, 25 bp, Mus musculus
gctacccaggagcaagtggaactct

SEQ ID NO: 447244 - DNA, 25 bp, Mus musculus
gctacccagtagagcttgggcagaa

SEQ ID NO: 447245 - DNA, 25 bp, Mus musculus
gctaccccattggaagtggccatca

SEQ ID NO: 447246 - DNA, 25 bp, Mus musculus
gctacccggagctcgtgaatgggcc

SEQ ID NO: 447247 - DNA, 25 bp, Mus musculus
gctacccggagcttacatttaaaat

SEQ ID NO: 447248 - DNA, 25 bp, Mus musculus
gctaccgcagagaacagcaaacttt

SEQ ID NO: 447249 - DNA, 25 bp, Mus musculus
gctaccgtaatgtttggcaagtggg

SEQ ID NO: 447250 - DNA, 25 bp, Mus musculus
gctaccgtacagtctcaggcatgga

SEQ ID NO: 447251 - DNA, 25 bp, Mus musculus
gctaccgtcctagtaagtgactctc

SEQ ID NO: 447252 - DNA, 25 bp, Mus musculus
gctaccgtggctgacgtaaggacca

SEQ ID NO: 447253 - DNA, 25 bp, Mus musculus
gctacctagactcctcagagatggg

SEQ ID NO: 447254 - DNA, 25 bp, Mus musculus
gctacctccaagaaaaatgtgttcc

SEQ ID NO: 447255 - DNA, 25 bp, Mus musculus
gctacctctctagcactatgtctga

SEQ ID NO: 447256 - DNA, 25 bp, Mus musculus
gctacctgagagttgactaccacct

SEQ ID NO: 447257 - DNA, 25 bp, Mus musculus
gctacctgctgtatggagagtgcca

SEQ ID NO: 447258 - DNA, 25 bp, Mus musculus
gctacctggagaagccttgcctgag

SEQ ID NO: 447259 - DNA, 25 bp, Mus musculus
gctacctggataaggtgcgcgcctt

SEQ ID NO: 447260 - DNA, 25 bp, Mus musculus
gctacctggcgctggtgaagaccat

SEQ ID NO: 447261 - DNA, 25 bp, Mus musculus
gctacctgggtaaggaactgccgga

SEQ ID NO: 447262 - DNA, 25 bp, Mus musculus
gctacctgggtaaggcccaaaatgg

SEQ ID NO: 447263 - DNA, 25 bp, Mus musculus
gctacgagaaggatctgacagaccc

SEQ ID NO: 447264 - DNA, 25 bp, Mus musculus
gctacgccactcaagaagccattgt

SEQ ID NO: 447265 - DNA, 25 bp, Mus musculus
gctacgcttttgcagcattcgcacg

SEQ ID NO: 447266 - DNA, 25 bp, Mus musculus
gctacggaagggtgagacagacatc

SEQ ID NO: 447267 - DNA, 25 bp, Mus musculus
gctacggcaacgtgaatgacccagg

SEQ ID NO: 447268 - DNA, 25 bp, Mus musculus
gctacggccgctggtgatcaaacaa

SEQ ID NO: 447269 - DNA, 25 bp, Mus musculus
gctacgggccatgctagccattgaa

SEQ ID NO: 447270 - DNA, 25 bp, Mus musculus
gctacgggtacaagggcagcatctt

SEQ ID NO: 447271 - DNA, 25 bp, Mus musculus
gctacggtaacagatatggtggaca

SEQ ID NO: 447272 - DNA, 25 bp, Mus musculus
gctacggttcagtctctgttgcctg

SEQ ID NO: 447273 - DNA, 25 bp, Mus musculus
gctacgtacgaatagagagctccaa

SEQ ID NO: 447274 - DNA, 25 bp, Mus musculus
gctacgtatcgggaaggcatgacca

SEQ ID NO: 447275 - DNA, 25 bp, Mus musculus
gctacgtgcccgaaattgctgctct

SEQ ID NO: 447276 - DNA, 25 bp, Mus musculus
gctacgtgctactgccgcttcttca

SEQ ID NO: 447277 - DNA, 25 bp, Mus musculus
gctacgtggtgctggccgtgttcct

SEQ ID NO: 447278 - DNA, 25 bp, Mus musculus
gctactaacaagctgtgtggaaacc

SEQ ID NO: 447279 - DNA, 25 bp, Mus musculus
gctactacggcaacagagacgctac

SEQ ID NO: 447280 - DNA, 25 bp, Mus musculus
gctactagcatgtggctgtcaggag

SEQ ID NO: 447281 - DNA, 25 bp, Mus musculus
gctactaggcaaactgctgtcccag

SEQ ID NO: 447282 - DNA, 25 bp, Mus musculus
gctactaggcctttgagctatgaca

SEQ ID NO: 447283 - DNA, 25 bp, Mus musculus
gctactataatacggacttacctgg

SEQ ID NO: 447284 - DNA, 25 bp, Mus musculus
gctactatagctgcaattctggctc

SEQ ID NO: 447285 - DNA, 25 bp, Mus musculus
gctactatgccttccctcagatgat

SEQ ID NO: 447286 - DNA, 25 bp, Mus musculus
gctactccgccatgtttgggcccaa

SEQ ID NO: 447287 - DNA, 25 bp, Mus musculus
gctactcctgacaaacctgggcatg

SEQ ID NO: 447288 - DNA, 25 bp, Mus musculus
gctactcgctgtcctcgactgtggc

SEQ ID NO: 447289 - DNA, 25 bp, Mus musculus
gctactcggagcaaaaccaagtgaa

SEQ ID NO: 447290 - DNA, 25 bp, Mus musculus
gctactctcctgagacactctgcag

SEQ ID NO: 447291 - DNA, 25 bp, Mus musculus
gctactctgaatggaaggactacgg

SEQ ID NO: 447292 - DNA, 25 bp, Mus musculus
gctactctgatagacggctgtgccg

SEQ ID NO: 447293 - DNA, 25 bp, Mus musculus
gctactgccccaacgatatcgagtt

SEQ ID NO: 447294 - DNA, 25 bp, Mus musculus
gctactgctcagttagcaccctttg

SEQ ID NO: 447295 - DNA, 25 bp, Mus musculus
gctactgctgttccctgggagctta

SEQ ID NO: 447296 - DNA, 25 bp, Mus musculus
gctactggaaaagatggatagctcc

SEQ ID NO: 447297 - DNA, 25 bp, Mus musculus
gctactggctctagattgagggttc

SEQ ID NO: 447298 - DNA, 25 bp, Mus musculus
gctactgggcctgaactgatactgc

SEQ ID NO: 447299 - DNA, 25 bp, Mus musculus
gctactgtacaaccttcgggtccta

SEQ ID NO: 447300 - DNA, 25 bp, Mus musculus
gctactgtaggttcgttaaaggcac

SEQ ID NO: 447301 - DNA, 25 bp, Mus musculus
gctactgtgggctggtgattcatca

SEQ ID NO: 447302 - DNA, 25 bp, Mus musculus
gctactgtgtagacttggcatctga

SEQ ID NO: 447303 - DNA, 25 bp, Mus musculus
gctacttaagcccaatgtgaagcaa

SEQ ID NO: 447304 - DNA, 25 bp, Mus musculus
gctacttaggcagggtcagacttcc

SEQ ID NO: 447305 - DNA, 25 bp, Mus musculus
gctacttcaacgtctactgccaggg

SEQ ID NO: 447306 - DNA, 25 bp, Mus musculus
gctacttcctgttgcttgcagccca

SEQ ID NO: 447307 - DNA, 25 bp, Mus musculus
gctacttctagcactgaccctgatt

SEQ ID NO: 447308 - DNA, 25 bp, Mus musculus
gctagaaaactagcgttattttaca

SEQ ID NO: 447309 - DNA, 25 bp, Mus musculus
gctagaaatgcactgggccgcgaat

SEQ ID NO: 447310 - DNA, 25 bp, Mus musculus
gctagaactcgatgtggatgaccct

SEQ ID NO: 447311 - DNA, 25 bp, Mus musculus
gctagaactctggtcatggcacttg

SEQ ID NO: 447312 - DNA, 25 bp, Mus musculus
gctagaagagataaatcaggctact

SEQ ID NO: 447313 - DNA, 25 bp, Mus musculus
gctagaccacattcactggaagtct

SEQ ID NO: 447314 - DNA, 25 bp, Mus musculus
gctagacgcttactctaccacgtga

SEQ ID NO: 447315 - DNA, 25 bp, Mus musculus
gctagacgggacaacttcacgggat

SEQ ID NO: 447316 - DNA, 25 bp, Mus musculus
gctagactagctggtcaaccctggt

SEQ ID NO: 447317 - DNA, 25 bp, Mus musculus
gctagactatgtgcctgacccagtg

SEQ ID NO: 447318 - DNA, 25 bp, Mus musculus
gctagactcagtcgccttcatggaa

SEQ ID NO: 447319 - DNA, 25 bp, Mus musculus
gctagactgccccattttgagagca

SEQ ID NO: 447320 - DNA, 25 bp, Mus musculus
gctagactggaggaaaagatgaccc

SEQ ID NO: 447321 - DNA, 25 bp, Mus musculus
gctagagaatctactggaagagacc

SEQ ID NO: 447322 - DNA, 25 bp, Mus musculus
gctagagatcccaactgagaatgct

SEQ ID NO: 447323 - DNA, 25 bp, Mus musculus
gctagagcactttcctaaaatgcaa

SEQ ID NO: 447324 - DNA, 25 bp, Mus musculus
gctagagcgcgcagtgaacgaaaaa

SEQ ID NO: 447325 - DNA, 25 bp, Mus musculus
gctagagctgtacccaagaagaaga

SEQ ID NO: 447326 - DNA, 25 bp, Mus musculus
gctagaggtggatgcaatcgtcaat

SEQ ID NO: 447327 - DNA, 25 bp, Mus musculus
gctagagtgacatcgcttgcctttc

SEQ ID NO: 447328 - DNA, 25 bp, Mus musculus
gctagagtggccatgtttcagaacc

SEQ ID NO: 447329 - DNA, 25 bp, Mus musculus
gctagagtgtctaataagatgtcaa

SEQ ID NO: 447330 - DNA, 25 bp, Mus musculus
gctagataattacatgaaggtcata

SEQ ID NO: 447331 - DNA, 25 bp, Mus musculus
gctagataccaataccctgtctcaa

SEQ ID NO: 447332 - DNA, 25 bp, Mus musculus
gctagatctacatgggctgcgggaa

SEQ ID NO: 447333 - DNA, 25 bp, Mus musculus
gctagatggccctcaagctggcaca

SEQ ID NO: 447334 - DNA, 25 bp, Mus musculus
gctagatgggatcccagacttggaa

SEQ ID NO: 447335 - DNA, 25 bp, Mus musculus
gctagatgtacctttgcctactgag

SEQ ID NO: 447336 - DNA, 25 bp, Mus musculus
gctagattcgtttggagagcagaac

SEQ ID NO: 447337 - DNA, 25 bp, Mus musculus
gctagattgacactgagcctgtccg

SEQ ID NO: 447338 - DNA, 25 bp, Mus musculus
gctagcaatggagaataagtggtcc

SEQ ID NO: 447339 - DNA, 25 bp, Mus musculus
gctagcacaccagcttgggtaccgg

SEQ ID NO: 447340 - DNA, 25 bp, Mus musculus
gctagcagagcagcagcacttgggc

SEQ ID NO: 447341 - DNA, 25 bp, Mus musculus
gctagccacctaagcaatttgaaag

SEQ ID NO: 447342 - DNA, 25 bp, Mus musculus
gctagccccatcaaggaaaccatgg

SEQ ID NO: 447343 - DNA, 25 bp, Mus musculus
gctagcccggaagaccagtgtcaat

SEQ ID NO: 447344 - DNA, 25 bp, Mus musculus
gctagccctcaaatgcgtcttccgg

SEQ ID NO: 447345 - DNA, 25 bp, Mus musculus
gctagccggtgatcgagccttcaac

SEQ ID NO: 447346 - DNA, 25 bp, Mus musculus
gctagcctattacattggttagttc

SEQ ID NO: 447347 - DNA, 25 bp, Mus musculus
gctagcctggagaaaccctgccgct

SEQ ID NO: 447348 - DNA, 25 bp, Mus musculus
gctagcgaagacaaccctgaggagt

SEQ ID NO: 447349 - DNA, 25 bp, Mus musculus
gctagcggtgccagctgtgattagc

SEQ ID NO: 447350 - DNA, 25 bp, Mus musculus
gctagcgttaaagagtgcggcaact

SEQ ID NO: 447351 - DNA, 25 bp, Mus musculus
gctagctagaggcaatacattccaa

SEQ ID NO: 447352 - DNA, 25 bp, Mus musculus
gctagctataatcacactactggaa

SEQ ID NO: 447353 - DNA, 25 bp, Mus musculus
gctagctgagtagagttcaccggca

SEQ ID NO: 447354 - DNA, 25 bp, Mus musculus
gctagctgctcctgctctgactcag

SEQ ID NO: 447355 - DNA, 25 bp, Mus musculus
gctagctgcttgtgatagggcctca

SEQ ID NO: 447356 - DNA, 25 bp, Mus musculus
gctagctggctagactcagagagct

SEQ ID NO: 447357 - DNA, 25 bp, Mus musculus
gctagctggcttcttctgggtcaca

SEQ ID NO: 447358 - DNA, 25 bp, Mus musculus
gctagcttaattagagccatcagag

SEQ ID NO: 447359 - DNA, 25 bp, Mus musculus
gctagcttcaatggtggcctgggca

SEQ ID NO: 447360 - DNA, 25 bp, Mus musculus
gctagcttggtaagcccagccatgt

SEQ ID NO: 447361 - DNA, 25 bp, Mus musculus
gctaggaccaatggagcatactgat

SEQ ID NO: 447362 - DNA, 25 bp, Mus musculus
gctaggacgcaacctcatcagcaac

SEQ ID NO: 447363 - DNA, 25 bp, Mus musculus
gctaggacttttcacagctcagtaa

SEQ ID NO: 447364 - DNA, 25 bp, Mus musculus
gctaggagccaagctcaggctcaga

SEQ ID NO: 447365 - DNA, 25 bp, Mus musculus
gctaggcaactgcataactttggga

SEQ ID NO: 447366 - DNA, 25 bp, Mus musculus
gctaggcagtgaccaagaaccctgg

SEQ ID NO: 447367 - DNA, 25 bp, Mus musculus
gctaggcatgacaaaggtacttctc

SEQ ID NO: 447368 - DNA, 25 bp, Mus musculus
gctaggccaatttgcctgtggctga

SEQ ID NO: 447369 - DNA, 25 bp, Mus musculus
gctaggccacctctacagtgggaaa

SEQ ID NO: 447370 - DNA, 25 bp, Mus musculus
gctaggccaccttcataacaaaagg

SEQ ID NO: 447371 - DNA, 25 bp, Mus musculus
gctaggccctctggtagatttaaaa

SEQ ID NO: 447372 - DNA, 25 bp, Mus musculus
gctaggccgagaggagctgtctctc

SEQ ID NO: 447373 - DNA, 25 bp, Mus musculus
gctaggctaatcagaaagggcataa

SEQ ID NO: 447374 - DNA, 25 bp, Mus musculus
gctaggctacgtgctcaaggacaaa

SEQ ID NO: 447375 - DNA, 25 bp, Mus musculus
gctaggctttgacttggatgctcat

SEQ ID NO: 447376 - DNA, 25 bp, Mus musculus
gctagggaatccaaaaggcggcaca

SEQ ID NO: 447377 - DNA, 25 bp, Mus musculus
gctagggacatgtgggctgactaca

SEQ ID NO: 447378 - DNA, 25 bp, Mus musculus
gctagggctctcaagccatggccac

SEQ ID NO: 447379 - DNA, 25 bp, Mus musculus
gctagggttgccagcagaagagcca

SEQ ID NO: 447380 - DNA, 25 bp, Mus musculus
gctaggtcacagcacattcatcaag

SEQ ID NO: 447381 - DNA, 25 bp, Mus musculus
gctaggtcagctccctcaaaacagg

SEQ ID NO: 447382 - DNA, 25 bp, Mus musculus
gctaggtgtactggcgggcgtctga

SEQ ID NO: 447383 - DNA, 25 bp, Mus musculus
gctaggttctttactgccggtaccg

SEQ ID NO: 447384 - DNA, 25 bp, Mus musculus
gctagtagagagaaggaccgagtca

SEQ ID NO: 447385 - DNA, 25 bp, Mus musculus
gctagtcaatgagaaacggttcccg

SEQ ID NO: 447386 - DNA, 25 bp, Mus musculus
gctagtcacctctgctggtcggaga

SEQ ID NO: 447387 - DNA, 25 bp, Mus musculus
gctagtcagtggatagtgtagttct

SEQ ID NO: 447388 - DNA, 25 bp, Mus musculus
gctagtctttgcaggctgaacccat

SEQ ID NO: 447389 - DNA, 25 bp, Mus musculus
gctagtgaggccagacagtgctgtt

SEQ ID NO: 447390 - DNA, 25 bp, Mus musculus
gctagtggccactctcagaaaaaga

SEQ ID NO: 447391 - DNA, 25 bp, Mus musculus
gctagtgggtcctccggtgactctg

SEQ ID NO: 447392 - DNA, 25 bp, Mus musculus
gctagtgggtgtgcatttagcaccc

SEQ ID NO: 447393 - DNA, 25 bp, Mus musculus
gctagtgtagaaagtgccacagtcc

SEQ ID NO: 447394 - DNA, 25 bp, Mus musculus
gctagtgtcagtaaaagggtcccct

SEQ ID NO: 447395 - DNA, 25 bp, Mus musculus
gctagtgttggcaagccctcagcac

SEQ ID NO: 447396 - DNA, 25 bp, Mus musculus
gctagttgggcatctggaaagccac

SEQ ID NO: 447397 - DNA, 25 bp, Mus musculus
gctagttgtggtaagacgccagttt

SEQ ID NO: 447398 - DNA, 25 bp, Mus musculus
gctagttttaatgtccatgggatgg

SEQ ID NO: 447399 - DNA, 25 bp, Mus musculus
gctataaaaagagctccgcagcatg

SEQ ID NO: 447400 - DNA, 25 bp, Mus musculus
gctataacaactgtggtcaggtggg

SEQ ID NO: 447401 - DNA, 25 bp, Mus musculus
gctataagggcacaaccaagagctt

SEQ ID NO: 447402 - DNA, 25 bp, Mus musculus
gctataatcatgctatatactggca

SEQ ID NO: 447403 - DNA, 25 bp, Mus musculus
gctataatgtataccaccatgtggg

SEQ ID NO: 447404 - DNA, 25 bp, Mus musculus
gctatacaagtctgatggtctgaga

SEQ ID NO: 447405 - DNA, 25 bp, Mus musculus
gctatacatttgctgaaatgccttg

SEQ ID NO: 447406 - DNA, 25 bp, Mus musculus
gctataccctcaactctaacctggg

SEQ ID NO: 447407 - DNA, 25 bp, Mus musculus
gctataccttgaactaggcttggac

SEQ ID NO: 447408 - DNA, 25 bp, Mus musculus
gctatactttgctccctagaccaca

SEQ ID NO: 447409 - DNA, 25 bp, Mus musculus
gctatagaatgctaggagctctgga

SEQ ID NO: 447410 - DNA, 25 bp, Mus musculus
gctatagactattccgctggcaggg

SEQ ID NO: 447411 - DNA, 25 bp, Mus musculus
gctatagcacctacagtcctgtgga

SEQ ID NO: 447412 - DNA, 25 bp, Mus musculus
gctatagccttctccttttcatcaa

SEQ ID NO: 447413 - DNA, 25 bp, Mus musculus
gctataggaccctgaaagaaagttt

SEQ ID NO: 447414 - DNA, 25 bp, Mus musculus
gctatatacttgatggcctttgaca

SEQ ID NO: 447415 - DNA, 25 bp, Mus musculus
gctatatgttcgctggtgggtccca

SEQ ID NO: 447416 - DNA, 25 bp, Mus musculus
gctatcaagcgaggagagcgatcta

SEQ ID NO: 447417 - DNA, 25 bp, Mus musculus
gctatcaaggcagtgcaagccttca

SEQ ID NO: 447418 - DNA, 25 bp, Mus musculus
gctatcaccacagggagtcacaggg

SEQ ID NO: 447419 - DNA, 25 bp, Mus musculus
gctatcagcagtcatcaggtgacca

SEQ ID NO: 447420 - DNA, 25 bp, Mus musculus
gctatcataacccagtcaggtctac

SEQ ID NO: 447421 - DNA, 25 bp, Mus musculus
gctatcatcatgtccatgtgggaga

SEQ ID NO: 447422 - DNA, 25 bp, Mus musculus
gctatccgctgcatccacagtgagg

SEQ ID NO: 447423 - DNA, 25 bp, Mus musculus
gctatcgcgctcaagaacacggagg

SEQ ID NO: 447424 - DNA, 25 bp, Mus musculus
gctatctcctaaaacatggaaatgt

SEQ ID NO: 447425 - DNA, 25 bp, Mus musculus
gctatcttcccttcagtcttgctgg

SEQ ID NO: 447426 - DNA, 25 bp, Mus musculus
gctatcttgagacatactgggccac

SEQ ID NO: 447427 - DNA, 25 bp, Mus musculus
gctatctttggaaatgaatcctttc

SEQ ID NO: 447428 - DNA, 25 bp, Mus musculus
gctatgaagcggttacgggtccctc

SEQ ID NO: 447429 - DNA, 25 bp, Mus musculus
gctatgacggtgtacgccctggtag

SEQ ID NO: 447430 - DNA, 25 bp, Mus musculus
gctatgactggagcatgcgccaaca

SEQ ID NO: 447431 - DNA, 25 bp, Mus musculus
gctatgagaactttggaacctaact

SEQ ID NO: 447432 - DNA, 25 bp, Mus musculus
gctatgagagtatcagaccttctgg

SEQ ID NO: 447433 - DNA, 25 bp, Mus musculus
gctatgagcgggttaacagtcctga

SEQ ID NO: 447434 - DNA, 25 bp, Mus musculus
gctatgagcttgcatccttgtgtga

SEQ ID NO: 447435 - DNA, 25 bp, Mus musculus
gctatgatccagacgccaaggctgc

SEQ ID NO: 447436 - DNA, 25 bp, Mus musculus
gctatgatggaggacaaggccaacg

SEQ ID NO: 447437 - DNA, 25 bp, Mus musculus
gctatgatgtagtaaaggaatgcct

SEQ ID NO: 447438 - DNA, 25 bp, Mus musculus
gctatgcactgggtctaaagagcag

SEQ ID NO: 447439 - DNA, 25 bp, Mus musculus
gctatgcagatcttgtggactccag

SEQ ID NO: 447440 - DNA, 25 bp, Mus musculus
gctatgcatactacctgcctggtgg

SEQ ID NO: 447441 - DNA, 25 bp, Mus musculus
gctatgcctaacgtactgtgcccag

SEQ ID NO: 447442 - DNA, 25 bp, Mus musculus
gctatgccttcagtagctgctcaat

SEQ ID NO: 447443 - DNA, 25 bp, Mus musculus
gctatgccttctatggatgccactg

SEQ ID NO: 447444 - DNA, 25 bp, Mus musculus
gctatgctacgcacatggtcgggaa

SEQ ID NO: 447445 - DNA, 25 bp, Mus musculus
gctatggaaaaaatggctgatgctt

SEQ ID NO: 447446 - DNA, 25 bp, Mus musculus
gctatggcagctttcaggctgtgga

SEQ ID NO: 447447 - DNA, 25 bp, Mus musculus
gctatggccagtccaccggagagtt

SEQ ID NO: 447448 - DNA, 25 bp, Mus musculus
gctatgggcagctggacatctttcc

SEQ ID NO: 447449 - DNA, 25 bp, Mus musculus
gctatgggcccatgaacgtgaacat

SEQ ID NO: 447450 - DNA, 25 bp, Mus musculus
gctatggtcgcttcatgctcttgga

SEQ ID NO: 447451 - DNA, 25 bp, Mus musculus
gctatggtctggaagctaggcctga

SEQ ID NO: 447452 - DNA, 25 bp, Mus musculus
gctatggtgacaaggacgagttccc

SEQ ID NO: 447453 - DNA, 25 bp, Mus musculus
gctatggtggtttcctgcggcgtca

SEQ ID NO: 447454 - DNA, 25 bp, Mus musculus
gctatgtccgtcattggagacagac

SEQ ID NO: 447455 - DNA, 25 bp, Mus musculus
gctatgtgactcgagtacggagaca

SEQ ID NO: 447456 - DNA, 25 bp, Mus musculus
gctatgtgctcgaagatggacctga

SEQ ID NO: 447457 - DNA, 25 bp, Mus musculus
gctatgtgtacaaggcggccagcga

SEQ ID NO: 447458 - DNA, 25 bp, Mus musculus
gctatgttctgtgcagagccccaga

SEQ ID NO: 447459 - DNA, 25 bp, Mus musculus
gctatgttgatgctacgtatcggga

SEQ ID NO: 447460 - DNA, 25 bp, Mus musculus
gctattaccatcaccccagagagag

SEQ ID NO: 447461 - DNA, 25 bp, Mus musculus
gctattatgagaatggatcttcagt

SEQ ID NO: 447462 - DNA, 25 bp, Mus musculus
gctattcaggactacagcgcctcgg

SEQ ID NO: 447463 - DNA, 25 bp, Mus musculus
gctattctattgtaactgccagtga

SEQ ID NO: 447464 - DNA, 25 bp, Mus musculus
gctattctctgccttcactaaacaa

SEQ ID NO: 447465 - DNA, 25 bp, Mus musculus
gctattgacccatacagctgttgga

SEQ ID NO: 447466 - DNA, 25 bp, Mus musculus
gctattgagagtaatgtgatgtttg

SEQ ID NO: 447467 - DNA, 25 bp, Mus musculus
gctattgcctcacagagccgttgga

SEQ ID NO: 447468 - DNA, 25 bp, Mus musculus
gctattgctacaatcaacattcgca

SEQ ID NO: 447469 - DNA, 25 bp, Mus musculus
gctattgctcaggacactgcccaga

SEQ ID NO: 447470 - DNA, 25 bp, Mus musculus
gctattggaggcactctgttaccca

SEQ ID NO: 447471 - DNA, 25 bp, Mus musculus
gctattgtctgctttttactgcttc

SEQ ID NO: 447472 - DNA, 25 bp, Mus musculus
gctatttacacgcatgcaacgcctg

SEQ ID NO: 447473 - DNA, 25 bp, Mus musculus
gctatttcaagtaagcagatacttt

SEQ ID NO: 447474 - DNA, 25 bp, Mus musculus
gctatttccccttgcaagcagttgg

SEQ ID NO: 447475 - DNA, 25 bp, Mus musculus
gctatttctgcccaccgaggagaga

SEQ ID NO: 447476 - DNA, 25 bp, Mus musculus
gctatttctgtgtgttccaagaaca

SEQ ID NO: 447477 - DNA, 25 bp, Mus musculus
gctatttgctgttgagttatcccaa

SEQ ID NO: 447478 - DNA, 25 bp, Mus musculus
gctattttttgatggcgcttctcca

SEQ ID NO: 447479 - DNA, 25 bp, Mus musculus
gctcaaaacatagaattgattgagg

SEQ ID NO: 447480 - DNA, 25 bp, Mus musculus
gctcaaaactctcatgtcacgaagg

SEQ ID NO: 447481 - DNA, 25 bp, Mus musculus
gctcaaaggcagactccctcgggtt

SEQ ID NO: 447482 - DNA, 25 bp, Mus musculus
gctcaaaggcatcgtcaccaaactg

SEQ ID NO: 447483 - DNA, 25 bp, Mus musculus
gctcaacaacgtggacgcactgcgt

SEQ ID NO: 447484 - DNA, 25 bp, Mus musculus
gctcaacagcccagacttactagaa

SEQ ID NO: 447485 - DNA, 25 bp, Mus musculus
gctcaagaacggcagccttgactca

SEQ ID NO: 447486 - DNA, 25 bp, Mus musculus
gctcaagcgcaaatactggtggaaa

SEQ ID NO: 447487 - DNA, 25 bp, Mus musculus
gctcaaggaggagtgcaaggacttt

SEQ ID NO: 447488 - DNA, 25 bp, Mus musculus
gctcaaggtagctgtggagtcttga

SEQ ID NO: 447489 - DNA, 25 bp, Mus musculus
gctcaagtgattggaccagtggtcc

SEQ ID NO: 447490 - DNA, 25 bp, Mus musculus
gctcaagttacctgaatacccaagt

SEQ ID NO: 447491 - DNA, 25 bp, Mus musculus
gctcaatactatctgcctgggcatg

SEQ ID NO: 447492 - DNA, 25 bp, Mus musculus
gctcaatgaccgatgaacatgggca

SEQ ID NO: 447493 - DNA, 25 bp, Mus musculus
gctcaatgcagaaggacggatccag

SEQ ID NO: 447494 - DNA, 25 bp, Mus musculus
gctcacactttgtccagagaactgg

SEQ ID NO: 447495 - DNA, 25 bp, Mus musculus
gctcacagtgctttgggactccagt

SEQ ID NO: 447496 - DNA, 25 bp, Mus musculus
gctcacagttagctgcctttttctg

SEQ ID NO: 447497 - DNA, 25 bp, Mus musculus
gctcacatcagtgctttaaatgctg

SEQ ID NO: 447498 - DNA, 25 bp, Mus musculus
gctcacattgtaacttagtccccag

SEQ ID NO: 447499 - DNA, 25 bp, Mus musculus
gctcaccactagtgtctgctccgtg

SEQ ID NO: 447500 - DNA, 25 bp, Mus musculus
gctcaccgacaagcagcgactttga

SEQ ID NO: 447501 - DNA, 25 bp, Mus musculus
gctcaccgcgtcacctgatggatgg

SEQ ID NO: 447502 - DNA, 25 bp, Mus musculus
gctcacctggaagcgcctagtggca

SEQ ID NO: 447503 - DNA, 25 bp, Mus musculus
gctcacctgtgctcaaaccaaatca

SEQ ID NO: 447504 - DNA, 25 bp, Mus musculus
gctcacgaggagatgtccgactgcc

SEQ ID NO: 447505 - DNA, 25 bp, Mus musculus
gctcacggccagacgagagcaatcg

SEQ ID NO: 447506 - DNA, 25 bp, Mus musculus
gctcacgttctggttactggcactg

SEQ ID NO: 447507 - DNA, 25 bp, Mus musculus
gctcactccacgctgaattctaggt

SEQ ID NO: 447508 - DNA, 25 bp, Mus musculus
gctcactgtgcagctggtatgaaca

SEQ ID NO: 447509 - DNA, 25 bp, Mus musculus
gctcacttgagaaacactgcagagt

SEQ ID NO: 447510 - DNA, 25 bp, Mus musculus
gctcactttggcaggtagcaaccgg

SEQ ID NO: 447511 - DNA, 25 bp, Mus musculus
gctcacttttgactaggcccttgct

SEQ ID NO: 447512 - DNA, 25 bp, Mus musculus
gctcagaaactctcctcaggcgatg

SEQ ID NO: 447513 - DNA, 25 bp, Mus musculus
gctcagaagagaaagcaaggttccc

SEQ ID NO: 447514 - DNA, 25 bp, Mus musculus
gctcagaatgtatcctggcccagga

SEQ ID NO: 447515 - DNA, 25 bp, Mus musculus
gctcagacatcagtatcggttgtga

SEQ ID NO: 447516 - DNA, 25 bp, Mus musculus
gctcagaccagtgcaaaccagaagg

SEQ ID NO: 447517 - DNA, 25 bp, Mus musculus
gctcagacctagctcgggagcctaa

SEQ ID NO: 447518 - DNA, 25 bp, Mus musculus
gctcagactggtgaaaataggaatt

SEQ ID NO: 447519 - DNA, 25 bp, Mus musculus
gctcagagaagtagaggaagcaccc

SEQ ID NO: 447520 - DNA, 25 bp, Mus musculus
gctcagagacaagcaactgggatct

SEQ ID NO: 447521 - DNA, 25 bp, Mus musculus
gctcagagcagagacaccgggaatc

SEQ ID NO: 447522 - DNA, 25 bp, Mus musculus
gctcagagcagggtagcttctctgg

SEQ ID NO: 447523 - DNA, 25 bp, Mus musculus
gctcagagcccgaattgatccaggt

SEQ ID NO: 447524 - DNA, 25 bp, Mus musculus
gctcagaggtcagcagcacgtgctt

SEQ ID NO: 447525 - DNA, 25 bp, Mus musculus
gctcagagtaagtgtgagccccaga

SEQ ID NO: 447526 - DNA, 25 bp, Mus musculus
gctcagagtcttctccactgggaaa

SEQ ID NO: 447527 - DNA, 25 bp, Mus musculus
gctcagatcgcgaaagtgggccaga

SEQ ID NO: 447528 - DNA, 25 bp, Mus musculus
gctcagcaacgcctcgggaaattgg

SEQ ID NO: 447529 - DNA, 25 bp, Mus musculus
gctcagccagaatgtccagaagatg

SEQ ID NO: 447530 - DNA, 25 bp, Mus musculus
gctcagccgtggagacaacatgtgt

SEQ ID NO: 447531 - DNA, 25 bp, Mus musculus
gctcagcgataagccttggtgacca

SEQ ID NO: 447532 - DNA, 25 bp, Mus musculus
gctcagcgctgggtctgtgggaact

SEQ ID NO: 447533 - DNA, 25 bp, Mus musculus
gctcagcggattcagcgggctcaat

SEQ ID NO: 447534 - DNA, 25 bp, Mus musculus
gctcagctgatcctgtggcctgtcc

SEQ ID NO: 447535 - DNA, 25 bp, Mus musculus
gctcagcttgatcccagtttgctag

SEQ ID NO: 447536 - DNA, 25 bp, Mus musculus
gctcagcttgtccaccgtcttcttg

SEQ ID NO: 447537 - DNA, 25 bp, Mus musculus
gctcagctttctacacccatagtgt

SEQ ID NO: 447538 - DNA, 25 bp, Mus musculus
gctcaggaacacagatggacagagg

SEQ ID NO: 447539 - DNA, 25 bp, Mus musculus
gctcaggaatttggcgagccatcaa

SEQ ID NO: 447540 - DNA, 25 bp, Mus musculus
gctcaggacctcacagattatggga

SEQ ID NO: 447541 - DNA, 25 bp, Mus musculus
gctcaggagctacttgatgaaattg

SEQ ID NO: 447542 - DNA, 25 bp, Mus musculus
gctcaggcaggagggcaaaacatca

SEQ ID NO: 447543 - DNA, 25 bp, Mus musculus
gctcaggccatctacgagggactgt

SEQ ID NO: 447544 - DNA, 25 bp, Mus musculus
gctcaggccatcttctcttctcgaa

SEQ ID NO: 447545 - DNA, 25 bp, Mus musculus
gctcaggccgggagaccttctccag

SEQ ID NO: 447546 - DNA, 25 bp, Mus musculus
gctcaggctcaaaccatctcttgca

SEQ ID NO: 447547 - DNA, 25 bp, Mus musculus
gctcaggctcagagcgctcagagca

SEQ ID NO: 447548 - DNA, 25 bp, Mus musculus
gctcagggatcggactttggcacct

SEQ ID NO: 447549 - DNA, 25 bp, Mus musculus
gctcagggcctgacaaagtaatgaa

SEQ ID NO: 447550 - DNA, 25 bp, Mus musculus
gctcagggcggcttttggaactcaa

SEQ ID NO: 447551 - DNA, 25 bp, Mus musculus
gctcaggtagcatccggcctggaaa

SEQ ID NO: 447552 - DNA, 25 bp, Mus musculus
gctcaggtgactatcacggatcgga

SEQ ID NO: 447553 - DNA, 25 bp, Mus musculus
gctcagtcccaaggagaaaaaccga

SEQ ID NO: 447554 - DNA, 25 bp, Mus musculus
gctcagtccccatactgattaccag

SEQ ID NO: 447555 - DNA, 25 bp, Mus musculus
gctcagtgaagaaagtactggtgca

SEQ ID NO: 447556 - DNA, 25 bp, Mus musculus
gctcagtgccgtttttaggatgtca

SEQ ID NO: 447557 - DNA, 25 bp, Mus musculus
gctcagtgcttaagatttgatgttt

SEQ ID NO: 447558 - DNA, 25 bp, Mus musculus
gctcagttgcagacagggacgtcca

SEQ ID NO: 447559 - DNA, 25 bp, Mus musculus
gctcagtttagagtccggctcagaa

SEQ ID NO: 447560 - DNA, 25 bp, Mus musculus
gctcataaagagcagaatttgcaca

SEQ ID NO: 447561 - DNA, 25 bp, Mus musculus
gctcatagcacagaccaagcaggtg

SEQ ID NO: 447562 - DNA, 25 bp, Mus musculus
gctcatagtggattttgaacttaag

SEQ ID NO: 447563 - DNA, 25 bp, Mus musculus
gctcatagttcttgctaacgccatt

SEQ ID NO: 447564 - DNA, 25 bp, Mus musculus
gctcatatgcagataaatagtaact

SEQ ID NO: 447565 - DNA, 25 bp, Mus musculus
gctcatattacagcaacccagcatg

SEQ ID NO: 447566 - DNA, 25 bp, Mus musculus
gctcatcaatctgcagacgttccat

SEQ ID NO: 447567 - DNA, 25 bp, Mus musculus
gctcatcgggatgaactgcactttg

SEQ ID NO: 447568 - DNA, 25 bp, Mus musculus
gctcatctaacaggaagcttgctga

SEQ ID NO: 447569 - DNA, 25 bp, Mus musculus
gctcatctaggctgcacataaactg

SEQ ID NO: 447570 - DNA, 25 bp, Mus musculus
gctcatctcaccaaggtatcgtggg

SEQ ID NO: 447571 - DNA, 25 bp, Mus musculus
gctcatctgacatcagagcctctct

SEQ ID NO: 447572 - DNA, 25 bp, Mus musculus
gctcatctgtcaccttggccataag

SEQ ID NO: 447573 - DNA, 25 bp, Mus musculus
gctcatgaagaaggataagtacacg

SEQ ID NO: 447574 - DNA, 25 bp, Mus musculus
gctcatgcagaatgtggcctcttgt

SEQ ID NO: 447575 - DNA, 25 bp, Mus musculus
gctcatgcagcataggaggcttcaa

SEQ ID NO: 447576 - DNA, 25 bp, Mus musculus
gctcatgcctcgttatggtctcgaa

SEQ ID NO: 447577 - DNA, 25 bp, Mus musculus
gctcatggtaggatgtgtgctgtca

SEQ ID NO: 447578 - DNA, 25 bp, Mus musculus
gctcatggtcaaatctctggtgcac

SEQ ID NO: 447579 - DNA, 25 bp, Mus musculus
gctcattatcaatccaacaggctgg

SEQ ID NO: 447580 - DNA, 25 bp, Mus musculus
gctcattctatatccctgacaggta

SEQ ID NO: 447581 - DNA, 25 bp, Mus musculus
gctcattgagaggaagagggccttc

SEQ ID NO: 447582 - DNA, 25 bp, Mus musculus
gctcattggatttcttgggtaccca

SEQ ID NO: 447583 - DNA, 25 bp, Mus musculus
gctcattgtcgttgtggcggccaca

SEQ ID NO: 447584 - DNA, 25 bp, Mus musculus
gctcatttcccaaaggcagaccagc

SEQ ID NO: 447585 - DNA, 25 bp, Mus musculus
gctcatttgcccttaaattatgcta

SEQ ID NO: 447586 - DNA, 25 bp, Mus musculus
gctccaaatgtagacagcaattgtc

SEQ ID NO: 447587 - DNA, 25 bp, Mus musculus
gctccaacatgtagcaaggacgcat

SEQ ID NO: 447588 - DNA, 25 bp, Mus musculus
gctccaacgtaaggaacagaacttg

SEQ ID NO: 447589 - DNA, 25 bp, Mus musculus
gctccaagcctcaggtatctctcag

SEQ ID NO: 447590 - DNA, 25 bp, Mus musculus
gctccaagcgactttcagcatgatg

SEQ ID NO: 447591 - DNA, 25 bp, Mus musculus
gctccaaggagacccgatgatccat

SEQ ID NO: 447592 - DNA, 25 bp, Mus musculus
gctccaatagccagggacaactttc

SEQ ID NO: 447593 - DNA, 25 bp, Mus musculus
gctccaatgatttccaagtagctat

SEQ ID NO: 447594 - DNA, 25 bp, Mus musculus
gctccacgggtctgtcaggtgcagt

SEQ ID NO: 447595 - DNA, 25 bp, Mus musculus
gctccagaatggaaggcctgagaag

SEQ ID NO: 447596 - DNA, 25 bp, Mus musculus
gctccagagagcatccctagtcttg

SEQ ID NO: 447597 - DNA, 25 bp, Mus musculus
gctccagaggaaagaatagacaaga

SEQ ID NO: 447598 - DNA, 25 bp, Mus musculus
gctccagaggccttctttcttctgt

SEQ ID NO: 447599 - DNA, 25 bp, Mus musculus
gctccagcgtatggttgatgccaga

SEQ ID NO: 447600 - DNA, 25 bp, Mus musculus
gctccagggctgttgactggcctgt

SEQ ID NO: 447601 - DNA, 25 bp, Mus musculus
gctccaggtagaccctgagccctat

SEQ ID NO: 447602 - DNA, 25 bp, Mus musculus
gctccagtaaaacagctcaatggat

SEQ ID NO: 447603 - DNA, 25 bp, Mus musculus
gctccagtatcgaggaagggctccg

SEQ ID NO: 447604 - DNA, 25 bp, Mus musculus
gctccagtcagcacgagggtacttg

SEQ ID NO: 447605 - DNA, 25 bp, Mus musculus
gctccatcctgggaccttgagtaga

SEQ ID NO: 447606 - DNA, 25 bp, Mus musculus
gctccatgacgtaaccaatctttct

SEQ ID NO: 447607 - DNA, 25 bp, Mus musculus
gctccatgccactgttttctgatta

SEQ ID NO: 447608 - DNA, 25 bp, Mus musculus
gctccatgtgcagagggaagaccag

SEQ ID NO: 447609 - DNA, 25 bp, Mus musculus
gctccatgtggtcagcctctgtcct

SEQ ID NO: 447610 - DNA, 25 bp, Mus musculus
gctcccagaagctaaggacattgag

SEQ ID NO: 447611 - DNA, 25 bp, Mus musculus
gctcccagagaaggttaatttctgg

SEQ ID NO: 447612 - DNA, 25 bp, Mus musculus
gctcccagtttttgccccagtgtct

SEQ ID NO: 447613 - DNA, 25 bp, Mus musculus
gctccccagcgtacaatttattagg

SEQ ID NO: 447614 - DNA, 25 bp, Mus musculus
gctccccagggaggtgtcattaacc

SEQ ID NO: 447615 - DNA, 25 bp, Mus musculus
gctcccctttagaaccggtgtgtga

SEQ ID NO: 447616 - DNA, 25 bp, Mus musculus
gctcccgagagggattcaaagggca

SEQ ID NO: 447617 - DNA, 25 bp, Mus musculus
gctcccgccgactgggtccttggga

SEQ ID NO: 447618 - DNA, 25 bp, Mus musculus
gctcccggacctctgcgtgttaaag

SEQ ID NO: 447619 - DNA, 25 bp, Mus musculus
gctcccggactctgtgcaggcactg

SEQ ID NO: 447620 - DNA, 25 bp, Mus musculus
gctcccgggagcagtactttacaga

SEQ ID NO: 447621 - DNA, 25 bp, Mus musculus
gctcccggtggctctagggcttctc

SEQ ID NO: 447622 - DNA, 25 bp, Mus musculus
gctccctcctgcctcaatgggagat

SEQ ID NO: 447623 - DNA, 25 bp, Mus musculus
gctccctctctaactttgttcacga

SEQ ID NO: 447624 - DNA, 25 bp, Mus musculus
gctccctctgataatgtaactgcca

SEQ ID NO: 447625 - DNA, 25 bp, Mus musculus
gctccctgatgtctcaaagcctgaa

SEQ ID NO: 447626 - DNA, 25 bp, Mus musculus
gctccgaaccgaatcatcactgtgg

SEQ ID NO: 447627 - DNA, 25 bp, Mus musculus
gctccgaactctgcaaggaactgtg

SEQ ID NO: 447628 - DNA, 25 bp, Mus musculus
gctccgaagacaggaaggtatctcc

SEQ ID NO: 447629 - DNA, 25 bp, Mus musculus
gctccgaatgagacatcccctaaga

SEQ ID NO: 447630 - DNA, 25 bp, Mus musculus
gctccgagcaggaagggctgaccac

SEQ ID NO: 447631 - DNA, 25 bp, Mus musculus
gctccgagcagtttgtttggaataa

SEQ ID NO: 447632 - DNA, 25 bp, Mus musculus
gctccgagggattcgagtcatacca

SEQ ID NO: 447633 - DNA, 25 bp, Mus musculus
gctccgagtttgacctttaccaagg

SEQ ID NO: 447634 - DNA, 25 bp, Mus musculus
gctccgatgaacttgaatctgtctg

SEQ ID NO: 447635 - DNA, 25 bp, Mus musculus
gctccgcggagaccgtctgagccta

SEQ ID NO: 447636 - DNA, 25 bp, Mus musculus
gctccggactctgcttactgttcat

SEQ ID NO: 447637 - DNA, 25 bp, Mus musculus
gctccggatacaccaatacagtttg

SEQ ID NO: 447638 - DNA, 25 bp, Mus musculus
gctccggctgctgtggaatttacag

SEQ ID NO: 447639 - DNA, 25 bp, Mus musculus
gctccgggagctcgtacatctatgg

SEQ ID NO: 447640 - DNA, 25 bp, Mus musculus
gctccgggatcctaatcagtcacta

SEQ ID NO: 447641 - DNA, 25 bp, Mus musculus
gctccgggcagcacaggatcctgtg

SEQ ID NO: 447642 - DNA, 25 bp, Mus musculus
gctccgtcggagaacaacataatgg

SEQ ID NO: 447643 - DNA, 25 bp, Mus musculus
gctccgtggccttagtcatctctgg

SEQ ID NO: 447644 - DNA, 25 bp, Mus musculus
gctccgtggtggtagaatcgactgt

SEQ ID NO: 447645 - DNA, 25 bp, Mus musculus
gctccgtgtgctgcgttaatggaga

SEQ ID NO: 447646 - DNA, 25 bp, Mus musculus
gctccgtttggaccaacccaagttg

SEQ ID NO: 447647 - DNA, 25 bp, Mus musculus
gctcctaagacacacagacctctgg

SEQ ID NO: 447648 - DNA, 25 bp, Mus musculus
gctcctacatgtgggcttgcccagg

SEQ ID NO: 447649 - DNA, 25 bp, Mus musculus
gctcctactactgatgaccaacttg

SEQ ID NO: 447650 - DNA, 25 bp, Mus musculus
gctcctagtggagggctctaccatc

SEQ ID NO: 447651 - DNA, 25 bp, Mus musculus
gctcctatctagaagtggctgcatc

SEQ ID NO: 447652 - DNA, 25 bp, Mus musculus
gctcctcagccaagttcaaagcctt

SEQ ID NO: 447653 - DNA, 25 bp, Mus musculus
gctcctcatggcctaatcagtctgt

SEQ ID NO: 447654 - DNA, 25 bp, Mus musculus
gctcctccagggtgatgtgtgacaa

SEQ ID NO: 447655 - DNA, 25 bp, Mus musculus
gctcctccatgttgacagctctgaa

SEQ ID NO: 447656 - DNA, 25 bp, Mus musculus
gctcctccttcgtacaattccgggt

SEQ ID NO: 447657 - DNA, 25 bp, Mus musculus
gctcctcgatgactttaagcttgtc

SEQ ID NO: 447658 - DNA, 25 bp, Mus musculus
gctcctcgggcctttctgatcgtgg

SEQ ID NO: 447659 - DNA, 25 bp, Mus musculus
gctcctctccgctcccggcgagagg

SEQ ID NO: 447660 - DNA, 25 bp, Mus musculus
gctcctctgatagtgactgtggcaa

SEQ ID NO: 447661 - DNA, 25 bp, Mus musculus
gctcctgacaggatttgttcacaat

SEQ ID NO: 447662 - DNA, 25 bp, Mus musculus
gctcctgcaaacctgaaagaaacgt

SEQ ID NO: 447663 - DNA, 25 bp, Mus musculus
gctcctgcatgttctgtggctccgg

SEQ ID NO: 447664 - DNA, 25 bp, Mus musculus
gctcctgcccgaagaacctctgtat

SEQ ID NO: 447665 - DNA, 25 bp, Mus musculus
gctcctgcctattaagaactgtata

SEQ ID NO: 447666 - DNA, 25 bp, Mus musculus
gctcctggccttggagtgtgcaggg

SEQ ID NO: 447667 - DNA, 25 bp, Mus musculus
gctcctgggaacctttgggcgacct

SEQ ID NO: 447668 - DNA, 25 bp, Mus musculus
gctcctggtctgtcgtgtctcttaa

SEQ ID NO: 447669 - DNA, 25 bp, Mus musculus
gctcctgtgcggtgtgcaagttccc

SEQ ID NO: 447670 - DNA, 25 bp, Mus musculus
gctcctgtggccaaagagtgtcccg

SEQ ID NO: 447671 - DNA, 25 bp, Mus musculus
gctcctgtggttgctgccagtccag

SEQ ID NO: 447672 - DNA, 25 bp, Mus musculus
gctccttcaaacaaagaggcttttg

SEQ ID NO: 447673 - DNA, 25 bp, Mus musculus
gctccttctggacctagtggccgaa

SEQ ID NO: 447674 - DNA, 25 bp, Mus musculus
gctccttctggaggaattgacttca

SEQ ID NO: 447675 - DNA, 25 bp, Mus musculus
gctccttgcagaggtgggacactga

SEQ ID NO: 447676 - DNA, 25 bp, Mus musculus
gctccttgctttcggtttcttcccg

SEQ ID NO: 447677 - DNA, 25 bp, Mus musculus
gctccttgtcacagcacagtgcttc

SEQ ID NO: 447678 - DNA, 25 bp, Mus musculus
gctcctttacaaaaaattaaagcat

SEQ ID NO: 447679 - DNA, 25 bp, Mus musculus
gctcctttcaatggactctcagctg

SEQ ID NO: 447680 - DNA, 25 bp, Mus musculus
gctcctttgggtttgccttttggca

SEQ ID NO: 447681 - DNA, 25 bp, Mus musculus
gctcgaagagggatgcacaattacc

SEQ ID NO: 447682 - DNA, 25 bp, Mus musculus
gctcgaatccgtcaaaacactaggg

SEQ ID NO: 447683 - DNA, 25 bp, Mus musculus
gctcgactgcgcaacctcagagagt

SEQ ID NO: 447684 - DNA, 25 bp, Mus musculus
gctcgagagattttgaccctacttc

SEQ ID NO: 447685 - DNA, 25 bp, Mus musculus
gctcgagctttgcttcagcccagcg

SEQ ID NO: 447686 - DNA, 25 bp, Mus musculus
gctcgagtgagttgccagtggccct

SEQ ID NO: 447687 - DNA, 25 bp, Mus musculus
gctcgatctaccacacaaataattg

SEQ ID NO: 447688 - DNA, 25 bp, Mus musculus
gctcgatcttgctctcaggttgaca

SEQ ID NO: 447689 - DNA, 25 bp, Mus musculus
gctcgcaatgcggagtggctatctc

SEQ ID NO: 447690 - DNA, 25 bp, Mus musculus
gctcgcagggagcataccagtgaat

SEQ ID NO: 447691 - DNA, 25 bp, Mus musculus
gctcgcccggaaccacagtatggaa

SEQ ID NO: 447692 - DNA, 25 bp, Mus musculus
gctcgcccgggaaaagaagctctat

SEQ ID NO: 447693 - DNA, 25 bp, Mus musculus
gctcgctgaggaagccttgtgtgca

SEQ ID NO: 447694 - DNA, 25 bp, Mus musculus
gctcgcttgacaacacaaaagtggg

SEQ ID NO: 447695 - DNA, 25 bp, Mus musculus
gctcgcttttctgaaggcttacggg

SEQ ID NO: 447696 - DNA, 25 bp, Mus musculus
gctcggaacagctcattcagtgacg

SEQ ID NO: 447697 - DNA, 25 bp, Mus musculus
gctcggatgtgaggctgtcatgcaa

SEQ ID NO: 447698 - DNA, 25 bp, Mus musculus
gctcggcaacaggaacatcactgtg

SEQ ID NO: 447699 - DNA, 25 bp, Mus musculus
gctcggcatcaatttaggctacatt

SEQ ID NO: 447700 - DNA, 25 bp, Mus musculus
gctcggccaccatgatgcaaatctg

SEQ ID NO: 447701 - DNA, 25 bp, Mus musculus
gctcggcgtcctgggaaggtcacct

SEQ ID NO: 447702 - DNA, 25 bp, Mus musculus
gctcggctcgtcttggcgccaatgg

SEQ ID NO: 447703 - DNA, 25 bp, Mus musculus
gctcgggactctggattggactcaa

SEQ ID NO: 447704 - DNA, 25 bp, Mus musculus
gctcgggaggcgaccctcgcagaca

SEQ ID NO: 447705 - DNA, 25 bp, Mus musculus
gctcgggatacctgggcattgctta

SEQ ID NO: 447706 - DNA, 25 bp, Mus musculus
gctcgggattctcggcatgcttgct

SEQ ID NO: 447707 - DNA, 25 bp, Mus musculus
gctcgggcccagactgagtatcgct

SEQ ID NO: 447708 - DNA, 25 bp, Mus musculus
gctcgggctggcagatacaagctca

SEQ ID NO: 447709 - DNA, 25 bp, Mus musculus
gctcgggtctagtctggtgctcagt

SEQ ID NO: 447710 - DNA, 25 bp, Mus musculus
gctcggttgattcagtaatgtatcc

SEQ ID NO: 447711 - DNA, 25 bp, Mus musculus
gctcgtaacacattccaagaagaag

SEQ ID NO: 447712 - DNA, 25 bp, Mus musculus
gctcgtcatagacatcatcatgatg

SEQ ID NO: 447713 - DNA, 25 bp, Mus musculus
gctcgtgaacttggctgctgatccc

SEQ ID NO: 447714 - DNA, 25 bp, Mus musculus
gctcgtgcgatgcttctccgtgtga

SEQ ID NO: 447715 - DNA, 25 bp, Mus musculus
gctcgtgggtgacacatacacactc

SEQ ID NO: 447716 - DNA, 25 bp, Mus musculus
gctcgtgttgaattggacccttgcc

SEQ ID NO: 447717 - DNA, 25 bp, Mus musculus
gctcgttcatgattatttcagtgtc

SEQ ID NO: 447718 - DNA, 25 bp, Mus musculus
gctcgttctagttcgtccaccatgg

SEQ ID NO: 447719 - DNA, 25 bp, Mus musculus
gctcgttgggcctgctaaacaaggg

SEQ ID NO: 447720 - DNA, 25 bp, Mus musculus
gctcgttttggttttgtcggactgc

SEQ ID NO: 447721 - DNA, 25 bp, Mus musculus
gctctaaagaagctaggccccgagg

SEQ ID NO: 447722 - DNA, 25 bp, Mus musculus
gctctaactgtggataaagactcca

SEQ ID NO: 447723 - DNA, 25 bp, Mus musculus
gctctaaggtgcatgaaccctttcc

SEQ ID NO: 447724 - DNA, 25 bp, Mus musculus
gctctaagtgttcacgggctcccag

SEQ ID NO: 447725 - DNA, 25 bp, Mus musculus
gctctaatctccctccatgaagaac

SEQ ID NO: 447726 - DNA, 25 bp, Mus musculus
gctctaccactggagtgactcggga

SEQ ID NO: 447727 - DNA, 25 bp, Mus musculus
gctctaccaggtcacggaagcgtat

SEQ ID NO: 447728 - DNA, 25 bp, Mus musculus
gctctacgagaagagccggcgcttg

SEQ ID NO: 447729 - DNA, 25 bp, Mus musculus
gctctacggtggatagcgtgttccg

SEQ ID NO: 447730 - DNA, 25 bp, Mus musculus
gctctagagaatgggtcttgttcca

SEQ ID NO: 447731 - DNA, 25 bp, Mus musculus
gctctagctaaactgggccatgaaa

SEQ ID NO: 447732 - DNA, 25 bp, Mus musculus
gctctcaaaggctccaagaagctgg

SEQ ID NO: 447733 - DNA, 25 bp, Mus musculus
gctctcaagagactggtagccacag

SEQ ID NO: 447734 - DNA, 25 bp, Mus musculus
gctctcaaggatgctacattgtcca

SEQ ID NO: 447735 - DNA, 25 bp, Mus musculus
gctctcagagctggtcaagaaccga

SEQ ID NO: 447736 - DNA, 25 bp, Mus musculus
gctctcagcattgactttctgtttg

SEQ ID NO: 447737 - DNA, 25 bp, Mus musculus
gctctcagcggtggaacacaggcta

SEQ ID NO: 447738 - DNA, 25 bp, Mus musculus
gctctcagggctgtggatccaactt

SEQ ID NO: 447739 - DNA, 25 bp, Mus musculus
gctctcagggtgtcaaaggtgacaa

SEQ ID NO: 447740 - DNA, 25 bp, Mus musculus
gctctcagtgtacacaaagatgctg

SEQ ID NO: 447741 - DNA, 25 bp, Mus musculus
gctctcagtgtcttctcgtcctcag

SEQ ID NO: 447742 - DNA, 25 bp, Mus musculus
gctctccaagttctagactagcctg

SEQ ID NO: 447743 - DNA, 25 bp, Mus musculus
gctctccacagacacccagtgattg

SEQ ID NO: 447744 - DNA, 25 bp, Mus musculus
gctctccagtcaagctgcgctctct

SEQ ID NO: 447745 - DNA, 25 bp, Mus musculus
gctctccggagaagatgctgccgct

SEQ ID NO: 447746 - DNA, 25 bp, Mus musculus
gctctccgggagaagctctgatcca

SEQ ID NO: 447747 - DNA, 25 bp, Mus musculus
gctctcggtcgtggttgtttacaac

SEQ ID NO: 447748 - DNA, 25 bp, Mus musculus
gctctcgtgaaccagctgaacagat

SEQ ID NO: 447749 - DNA, 25 bp, Mus musculus
gctctctaaatcatgcgctgcctgg

SEQ ID NO: 447750 - DNA, 25 bp, Mus musculus
gctctctaataggaccatgtcatgg

SEQ ID NO: 447751 - DNA, 25 bp, Mus musculus
gctctctaccatagggaagatagcc

SEQ ID NO: 447752 - DNA, 25 bp, Mus musculus
gctctctcacactaaagggcagttt

SEQ ID NO: 447753 - DNA, 25 bp, Mus musculus
gctctctctggcaagtccttacatg

SEQ ID NO: 447754 - DNA, 25 bp, Mus musculus
gctctctggcccttgttaaacacag

SEQ ID NO: 447755 - DNA, 25 bp, Mus musculus
gctctctgtcaaaggtacaccaagt

SEQ ID NO: 447756 - DNA, 25 bp, Mus musculus
gctctcttctgatcttctggagtac

SEQ ID NO: 447757 - DNA, 25 bp, Mus musculus
gctctctttggaacggatgcggacg

SEQ ID NO: 447758 - DNA, 25 bp, Mus musculus
gctctgaaagttcgtgaccgcctca

SEQ ID NO: 447759 - DNA, 25 bp, Mus musculus
gctctgaactccttcatctctggaa

SEQ ID NO: 447760 - DNA, 25 bp, Mus musculus
gctctgaagaatagcagggacctca

SEQ ID NO: 447761 - DNA, 25 bp, Mus musculus
gctctgaaggtgagtccaagatccc

SEQ ID NO: 447762 - DNA, 25 bp, Mus musculus
gctctgaagtcacctctggccttgg

SEQ ID NO: 447763 - DNA, 25 bp, Mus musculus
gctctgaatcctaaagatgcctgcc

SEQ ID NO: 447764 - DNA, 25 bp, Mus musculus
gctctgacctagcttcttggctggg

SEQ ID NO: 447765 - DNA, 25 bp, Mus musculus
gctctgactgctaggtgtactggcg

SEQ ID NO: 447766 - DNA, 25 bp, Mus musculus
gctctgactggaattgcctgcttct

SEQ ID NO: 447767 - DNA, 25 bp, Mus musculus
gctctgacttgggtgagtcactaag

SEQ ID NO: 447768 - DNA, 25 bp, Mus musculus
gctctgagactgctgacacgcctat

SEQ ID NO: 447769 - DNA, 25 bp, Mus musculus
gctctgagccagatactacaggata

SEQ ID NO: 447770 - DNA, 25 bp, Mus musculus
gctctgagctgatggtatggccaca

SEQ ID NO: 447771 - DNA, 25 bp, Mus musculus
gctctgatatctgaaccccgtgctg

SEQ ID NO: 447772 - DNA, 25 bp, Mus musculus
gctctgatctggaaacgatgccgga

SEQ ID NO: 447773 - DNA, 25 bp, Mus musculus
gctctgatgattggcctcgcgtggt

SEQ ID NO: 447774 - DNA, 25 bp, Mus musculus
gctctgcaaagaccggactcagggt

SEQ ID NO: 447775 - DNA, 25 bp, Mus musculus
gctctgcaattgctatggagtccag

SEQ ID NO: 447776 - DNA, 25 bp, Mus musculus
gctctgcacagatcagggtattcag

SEQ ID NO: 447777 - DNA, 25 bp, Mus musculus
gctctgcatatcagttaagcctgag

SEQ ID NO: 447778 - DNA, 25 bp, Mus musculus
gctctgccaatacctgctgaactga

SEQ ID NO: 447779 - DNA, 25 bp, Mus musculus
gctctgccaggcagcttgctaactt

SEQ ID NO: 447780 - DNA, 25 bp, Mus musculus
gctctgcccttaatgtaccgattat

SEQ ID NO: 447781 - DNA, 25 bp, Mus musculus
gctctgcctgccacagcctgtagag

SEQ ID NO: 447782 - DNA, 25 bp, Mus musculus
gctctgcctttgtataacaagagaa

SEQ ID NO: 447783 - DNA, 25 bp, Mus musculus
gctctgcgacactacatcaatctca

SEQ ID NO: 447784 - DNA, 25 bp, Mus musculus
gctctgcgctcgacctcctggtggt

SEQ ID NO: 447785 - DNA, 25 bp, Mus musculus
gctctgcgtttcgtcgggcgacagc

SEQ ID NO: 447786 - DNA, 25 bp, Mus musculus
gctctgctgcaaaactggtctgcta

SEQ ID NO: 447787 - DNA, 25 bp, Mus musculus
gctctgctgcactccctgcggagga

SEQ ID NO: 447788 - DNA, 25 bp, Mus musculus
gctctgctgtggagtttcctttgat

SEQ ID NO: 447789 - DNA, 25 bp, Mus musculus
gctctgcttccaacgggtcttcggg

SEQ ID NO: 447790 - DNA, 25 bp, Mus musculus
gctctgcttgacatgaggtcctcca

SEQ ID NO: 447791 - DNA, 25 bp, Mus musculus
gctctggaaacctgatggggccgcc

SEQ ID NO: 447792 - DNA, 25 bp, Mus musculus
gctctggaaggttcagaactctgaa

SEQ ID NO: 447793 - DNA, 25 bp, Mus musculus
gctctggaagtttgtaaacaccaac

SEQ ID NO: 447794 - DNA, 25 bp, Mus musculus
gctctggacctgagatagctctttg

SEQ ID NO: 447795 - DNA, 25 bp, Mus musculus
gctctggagacagccgagaagtgca

SEQ ID NO: 447796 - DNA, 25 bp, Mus musculus
gctctggagcgacatgtggcacaaa

SEQ ID NO: 447797 - DNA, 25 bp, Mus musculus
gctctggagtttagcaaaaagctag

SEQ ID NO: 447798 - DNA, 25 bp, Mus musculus
gctctgggatagtgttagctagtca

SEQ ID NO: 447799 - DNA, 25 bp, Mus musculus
gctctgggcaaacgcagtacataca

SEQ ID NO: 447800 - DNA, 25 bp, Mus musculus
gctctgggcaaggacattaattaat

SEQ ID NO: 447801 - DNA, 25 bp, Mus musculus
gctctggtcatgttggcctccgaaa

SEQ ID NO: 447802 - DNA, 25 bp, Mus musculus
gctctggttcatgcaaggatcactc

SEQ ID NO: 447803 - DNA, 25 bp, Mus musculus
gctctggttccaagagggctccgca

SEQ ID NO: 447804 - DNA, 25 bp, Mus musculus
gctctgtaggaattccccggacgcg

SEQ ID NO: 447805 - DNA, 25 bp, Mus musculus
gctctgtatcttctatatttgccgt

SEQ ID NO: 447806 - DNA, 25 bp, Mus musculus
gctctgtcagatacgttaatgcata

SEQ ID NO: 447807 - DNA, 25 bp, Mus musculus
gctctgtgcagctgcattggtctgg

SEQ ID NO: 447808 - DNA, 25 bp, Mus musculus
gctctgtggtcaagtccgaggccag

SEQ ID NO: 447809 - DNA, 25 bp, Mus musculus
gctcttagcgcctgcgtagtgcgcc

SEQ ID NO: 447810 - DNA, 25 bp, Mus musculus
gctcttagtggatgcaggtgtctgc

SEQ ID NO: 447811 - DNA, 25 bp, Mus musculus
gctcttattctccacagtcaccgag

SEQ ID NO: 447812 - DNA, 25 bp, Mus musculus
gctcttcagcttctctctagttggc

SEQ ID NO: 447813 - DNA, 25 bp, Mus musculus
gctcttctccattctgtctgcgaca

SEQ ID NO: 447814 - DNA, 25 bp, Mus musculus
gctcttctctcataggcttcaatgg

SEQ ID NO: 447815 - DNA, 25 bp, Mus musculus
gctcttcttgcaaaatgaaactctt

SEQ ID NO: 447816 - DNA, 25 bp, Mus musculus
gctcttcttgcttgatgcctacgtg

SEQ ID NO: 447817 - DNA, 25 bp, Mus musculus
gctcttgacgcagtgagcgccgcag

SEQ ID NO: 447818 - DNA, 25 bp, Mus musculus
gctcttgagattcagttcatcttga

SEQ ID NO: 447819 - DNA, 25 bp, Mus musculus
gctcttgagtggacagacttcccca

SEQ ID NO: 447820 - DNA, 25 bp, Mus musculus
gctcttgcccttggtagctctctgg

SEQ ID NO: 447821 - DNA, 25 bp, Mus musculus
gctcttgctggttaaacccaggact

SEQ ID NO: 447822 - DNA, 25 bp, Mus musculus
gctcttggagcaaggccgcctgttg

SEQ ID NO: 447823 - DNA, 25 bp, Mus musculus
gctcttggagcttgatgagtccttc

SEQ ID NO: 447824 - DNA, 25 bp, Mus musculus
gctcttggctagattaagctttgga

SEQ ID NO: 447825 - DNA, 25 bp, Mus musculus
gctcttggctatgctctttcactta

SEQ ID NO: 447826 - DNA, 25 bp, Mus musculus
gctcttgtgacgtcacgccgatcct

SEQ ID NO: 447827 - DNA, 25 bp, Mus musculus
gctcttgtgcaaaattgatagctaa

SEQ ID NO: 447828 - DNA, 25 bp, Mus musculus
gctcttgtgggttggaattgtcatc

SEQ ID NO: 447829 - DNA, 25 bp, Mus musculus
gctcttgtgtgctccagatgcgaac

SEQ ID NO: 447830 - DNA, 25 bp, Mus musculus
gctctttacgttaaatccggaatct

SEQ ID NO: 447831 - DNA, 25 bp, Mus musculus
gctctttatttgctcttccccaggg

SEQ ID NO: 447832 - DNA, 25 bp, Mus musculus
gctctttcaactacctgactgggca

SEQ ID NO: 447833 - DNA, 25 bp, Mus musculus
gctctttcgaacgtacgcggcgagg

SEQ ID NO: 447834 - DNA, 25 bp, Mus musculus
gctctttgctctcaggttgggccgt

SEQ ID NO: 447835 - DNA, 25 bp, Mus musculus
gctctttgctgcaggtttctctgca

SEQ ID NO: 447836 - DNA, 25 bp, Mus musculus
gctctttggaggcatggacacactt

SEQ ID NO: 447837 - DNA, 25 bp, Mus musculus
gctctttggtgcgaagcccgtgaaa

SEQ ID NO: 447838 - DNA, 25 bp, Mus musculus
gctctttgtgtattgcccattccgg

SEQ ID NO: 447839 - DNA, 25 bp, Mus musculus
gctctttgtgttcatcgccctggga

SEQ ID NO: 447840 - DNA, 25 bp, Mus musculus
gctgaaaaactcagacgcaatataa

SEQ ID NO: 447841 - DNA, 25 bp, Mus musculus
gctgaaaacatcgtggtcaccaccg

SEQ ID NO: 447842 - DNA, 25 bp, Mus musculus
gctgaaaagaaacctgaatgtgggc

SEQ ID NO: 447843 - DNA, 25 bp, Mus musculus
gctgaaaagcaaggatgccctgcga

SEQ ID NO: 447844 - DNA, 25 bp, Mus musculus
gctgaaacactcttcccaagttgga

SEQ ID NO: 447845 - DNA, 25 bp, Mus musculus
gctgaaaccctctgcaactgtctag

SEQ ID NO: 447846 - DNA, 25 bp, Mus musculus
gctgaaacttatcgttgggcccgaa

SEQ ID NO: 447847 - DNA, 25 bp, Mus musculus
gctgaaagcgaaggacagatggctc

SEQ ID NO: 447848 - DNA, 25 bp, Mus musculus
gctgaaaggagaggcatgttactga

SEQ ID NO: 447849 - DNA, 25 bp, Mus musculus
gctgaaagtatactccagagccctg

SEQ ID NO: 447850 - DNA, 25 bp, Mus musculus
gctgaaatccttgtgtgcaacacta

SEQ ID NO: 447851 - DNA, 25 bp, Mus musculus
gctgaaatgccttggtatcaaagaa

SEQ ID NO: 447852 - DNA, 25 bp, Mus musculus
gctgaaatggtctctggcacggcct

SEQ ID NO: 447853 - DNA, 25 bp, Mus musculus
gctgaaatgtgacttctgggcctgt

SEQ ID NO: 447854 - DNA, 25 bp, Mus musculus
gctgaaattgcaagcatgagttaac

SEQ ID NO: 447855 - DNA, 25 bp, Mus musculus
gctgaacaaatccacgtgcaatgtg

SEQ ID NO: 447856 - DNA, 25 bp, Mus musculus
gctgaacacccgcaggagctcgaag

SEQ ID NO: 447857 - DNA, 25 bp, Mus musculus
gctgaacacggcgttcgaccggctg

SEQ ID NO: 447858 - DNA, 25 bp, Mus musculus
gctgaacacttgtaggtggtaggca

SEQ ID NO: 447859 - DNA, 25 bp, Mus musculus
gctgaacagcttgagggcctctggt

SEQ ID NO: 447860 - DNA, 25 bp, Mus musculus
gctgaacatcgagcaggacgtggca

SEQ ID NO: 447861 - DNA, 25 bp, Mus musculus
gctgaaccagagaagatctatgcca

SEQ ID NO: 447862 - DNA, 25 bp, Mus musculus
gctgaaccagccacgtggaagacga

SEQ ID NO: 447863 - DNA, 25 bp, Mus musculus
gctgaaccgacagtttatggatttc

SEQ ID NO: 447864 - DNA, 25 bp, Mus musculus
gctgaacctcactttgccgcaggga

SEQ ID NO: 447865 - DNA, 25 bp, Mus musculus
gctgaacgaattgtttttctctgtc

SEQ ID NO: 447866 - DNA, 25 bp, Mus musculus
gctgaacgggtcaagaagtggattc

SEQ ID NO: 447867 - DNA, 25 bp, Mus musculus
gctgaacgtggaaagctgcgtccca

SEQ ID NO: 447868 - DNA, 25 bp, Mus musculus
gctgaacttagctggtttgcagtct

SEQ ID NO: 447869 - DNA, 25 bp, Mus musculus
gctgaagaagaggattattctaacc

SEQ ID NO: 447870 - DNA, 25 bp, Mus musculus
gctgaagactgcatggattggctcc

SEQ ID NO: 447871 - DNA, 25 bp, Mus musculus
gctgaagagaaaagctgacgaaatc

SEQ ID NO: 447872 - DNA, 25 bp, Mus musculus
gctgaagagcatcgaacaactcggg

SEQ ID NO: 447873 - DNA, 25 bp, Mus musculus
gctgaagcaggcaagaagatctttg

SEQ ID NO: 447874 - DNA, 25 bp, Mus musculus
gctgaagcagtaagattgttgtaag

SEQ ID NO: 447875 - DNA, 25 bp, Mus musculus
gctgaagcatgttaccgaagactgt

SEQ ID NO: 447876 - DNA, 25 bp, Mus musculus
gctgaagcccaacctaggcaatggg

SEQ ID NO: 447877 - DNA, 25 bp, Mus musculus
gctgaaggaatctgtggaacgctac

SEQ ID NO: 447878 - DNA, 25 bp, Mus musculus
gctgaaggacttgcgaaagccctca

SEQ ID NO: 447879 - DNA, 25 bp, Mus musculus
gctgaaggtgcacatctcacaggga

SEQ ID NO: 447880 - DNA, 25 bp, Mus musculus
gctgaatacttgagctgcctttgca

SEQ ID NO: 447881 - DNA, 25 bp, Mus musculus
gctgaatatgccctagccagaggct

SEQ ID NO: 447882 - DNA, 25 bp, Mus musculus
gctgaatatggagctgaagccctgg

SEQ ID NO: 447883 - DNA, 25 bp, Mus musculus
gctgaatcagagctcgtccggtgcc

SEQ ID NO: 447884 - DNA, 25 bp, Mus musculus
gctgaatcagcaacttctcagtgtt

SEQ ID NO: 447885 - DNA, 25 bp, Mus musculus
gctgaatcagtagcttgcaaatgtg

SEQ ID NO: 447886 - DNA, 25 bp, Mus musculus
gctgaatgtctatgtccaagtggcc

SEQ ID NO: 447887 - DNA, 25 bp, Mus musculus
gctgaatgttcctgtgggtactgtc

SEQ ID NO: 447888 - DNA, 25 bp, Mus musculus
gctgacaccaacctctgctgttgaa

SEQ ID NO: 447889 - DNA, 25 bp, Mus musculus
gctgacacgcattctgacaatagca

SEQ ID NO: 447890 - DNA, 25 bp, Mus musculus
gctgacacgggtctagacttgaaca

SEQ ID NO: 447891 - DNA, 25 bp, Mus musculus
gctgacactcagtcccactggcagt

SEQ ID NO: 447892 - DNA, 25 bp, Mus musculus
gctgacactggctaatgggaaccaa

SEQ ID NO: 447893 - DNA, 25 bp, Mus musculus
gctgacagaagtcacaatgtagacc

SEQ ID NO: 447894 - DNA, 25 bp, Mus musculus
gctgacagagcattacccacaaggt

SEQ ID NO: 447895 - DNA, 25 bp, Mus musculus
gctgacagggtagcagctgacagcc

SEQ ID NO: 447896 - DNA, 25 bp, Mus musculus
gctgacagtttccaggcagaggaat

SEQ ID NO: 447897 - DNA, 25 bp, Mus musculus
gctgacatcaaagaattgggagtca

SEQ ID NO: 447898 - DNA, 25 bp, Mus musculus
gctgacatcattatcaacactgtag

SEQ ID NO: 447899 - DNA, 25 bp, Mus musculus
gctgacatgtcctccaagagtgcca

SEQ ID NO: 447900 - DNA, 25 bp, Mus musculus
gctgaccatatctgagggcctgcct

SEQ ID NO: 447901 - DNA, 25 bp, Mus musculus
gctgacccccaaggtaagggcctgt

SEQ ID NO: 447902 - DNA, 25 bp, Mus musculus
gctgacctgggcatcttggaaagcc

SEQ ID NO: 447903 - DNA, 25 bp, Mus musculus
gctgacctgggtcatgaaggcttca

SEQ ID NO: 447904 - DNA, 25 bp, Mus musculus
gctgacctggttctggttccacaaa

SEQ ID NO: 447905 - DNA, 25 bp, Mus musculus
gctgacctttccctctcttggatgg

SEQ ID NO: 447906 - DNA, 25 bp, Mus musculus
gctgacgactgatgagggttttacc

SEQ ID NO: 447907 - DNA, 25 bp, Mus musculus
gctgacgctggcttacttgacgaga

SEQ ID NO: 447908 - DNA, 25 bp, Mus musculus
gctgacgggtttgggtggcttcctc

SEQ ID NO: 447909 - DNA, 25 bp, Mus musculus
gctgacggttgctgtggactcctat

SEQ ID NO: 447910 - DNA, 25 bp, Mus musculus
gctgactacctgttaacaaattgga

SEQ ID NO: 447911 - DNA, 25 bp, Mus musculus
gctgactattactatgatgtgaacc

SEQ ID NO: 447912 - DNA, 25 bp, Mus musculus
gctgactccattagtattaaccttc

SEQ ID NO: 447913 - DNA, 25 bp, Mus musculus
gctgactctgcagggagaactccca

SEQ ID NO: 447914 - DNA, 25 bp, Mus musculus
gctgactctggccttctctgctggc

SEQ ID NO: 447915 - DNA, 25 bp, Mus musculus
gctgactcttaccaggtcctgggca

SEQ ID NO: 447916 - DNA, 25 bp, Mus musculus
gctgactgacagctggaaacagagt

SEQ ID NO: 447917 - DNA, 25 bp, Mus musculus
gctgactgagaaggtcgacagactc

SEQ ID NO: 447918 - DNA, 25 bp, Mus musculus
gctgactgcagcctacaaaagggag

SEQ ID NO: 447919 - DNA, 25 bp, Mus musculus
gctgactgccgatgagaaactgatc

SEQ ID NO: 447920 - DNA, 25 bp, Mus musculus
gctgactgcttgctttctccaggaa

SEQ ID NO: 447921 - DNA, 25 bp, Mus musculus
gctgactgctttgggttcgtgaacc

SEQ ID NO: 447922 - DNA, 25 bp, Mus musculus
gctgacttgaccataccaaattgga

SEQ ID NO: 447923 - DNA, 25 bp, Mus musculus
gctgacttgggagtctgtgcacaaa

SEQ ID NO: 447924 - DNA, 25 bp, Mus musculus
gctgacttgtacgagctgggctcca

SEQ ID NO: 447925 - DNA, 25 bp, Mus musculus
gctgactttcggaggctatgacccc

SEQ ID NO: 447926 - DNA, 25 bp, Mus musculus
gctgactttgaactctccgccttgt

SEQ ID NO: 447927 - DNA, 25 bp, Mus musculus
gctgagaacttgagcctggcctgag

SEQ ID NO: 447928 - DNA, 25 bp, Mus musculus
gctgagaagagtatagagccttttc

SEQ ID NO: 447929 - DNA, 25 bp, Mus musculus
gctgagaagtctcctgcagaaatga

SEQ ID NO: 447930 - DNA, 25 bp, Mus musculus
gctgagaatacctgctgggatgcta

SEQ ID NO: 447931 - DNA, 25 bp, Mus musculus
gctgagaatgttcttgaactcccga

SEQ ID NO: 447932 - DNA, 25 bp, Mus musculus
gctgagaattatcagcttctgtggg

SEQ ID NO: 447933 - DNA, 25 bp, Mus musculus
gctgagacagagttgagcctcctgt

SEQ ID NO: 447934 - DNA, 25 bp, Mus musculus
gctgagaccctttcgtcatccttgg

SEQ ID NO: 447935 - DNA, 25 bp, Mus musculus
gctgagacgcatcgcagagctagaa

SEQ ID NO: 447936 - DNA, 25 bp, Mus musculus
gctgagacgtaaccgacttccgctt

SEQ ID NO: 447937 - DNA, 25 bp, Mus musculus
gctgagagccaaactgaaccgagag

SEQ ID NO: 447938 - DNA, 25 bp, Mus musculus
gctgagagccaattggaggcgacaa

SEQ ID NO: 447939 - DNA, 25 bp, Mus musculus
gctgagagctctggctgcccggcta

SEQ ID NO: 447940 - DNA, 25 bp, Mus musculus
gctgagaggcacaaatactggcatg

SEQ ID NO: 447941 - DNA, 25 bp, Mus musculus
gctgagaggctagagtgataaagaa

SEQ ID NO: 447942 - DNA, 25 bp, Mus musculus
gctgagagtcaaaggaacaacgatc

SEQ ID NO: 447943 - DNA, 25 bp, Mus musculus
gctgagatgctagttcatgactatg

SEQ ID NO: 447944 - DNA, 25 bp, Mus musculus
gctgagatgctctacaggcgaatca

SEQ ID NO: 447945 - DNA, 25 bp, Mus musculus
gctgagatgctggaacacgtacgga

SEQ ID NO: 447946 - DNA, 25 bp, Mus musculus
gctgagatggtagctggatgccacc

SEQ ID NO: 447947 - DNA, 25 bp, Mus musculus
gctgagatttaaccggaccttgtcc

SEQ ID NO: 447948 - DNA, 25 bp, Mus musculus
gctgagcacacagaccgcatggatt

SEQ ID NO: 447949 - DNA, 25 bp, Mus musculus
gctgagcacgttcacagctccagag

SEQ ID NO: 447950 - DNA, 25 bp, Mus musculus
gctgagcacttgtagagcactggat

SEQ ID NO: 447951 - DNA, 25 bp, Mus musculus
gctgagcagatgacactgaagggtt

SEQ ID NO: 447952 - DNA, 25 bp, Mus musculus
gctgagcagcagtgagtagggttgg

SEQ ID NO: 447953 - DNA, 25 bp, Mus musculus
gctgagcatgatgggaagcccttct

SEQ ID NO: 447954 - DNA, 25 bp, Mus musculus
gctgagcatgctgaacgagtcctga

SEQ ID NO: 447955 - DNA, 25 bp, Mus musculus
gctgagccagaaaagatcctactgt

SEQ ID NO: 447956 - DNA, 25 bp, Mus musculus
gctgagccagccaaagaatcttaag

SEQ ID NO: 447957 - DNA, 25 bp, Mus musculus
gctgagccatgcaatcaccaaatct

SEQ ID NO: 447958 - DNA, 25 bp, Mus musculus
gctgagccgcaacgccaatggattt

SEQ ID NO: 447959 - DNA, 25 bp, Mus musculus
gctgagccgcctagcttcctacagt

SEQ ID NO: 447960 - DNA, 25 bp, Mus musculus
gctgagctcactccggaacttgtga

SEQ ID NO: 447961 - DNA, 25 bp, Mus musculus
gctgagctccctacacagatgaagg

SEQ ID NO: 447962 - DNA, 25 bp, Mus musculus
gctgagctgagacgcctgtgattca

SEQ ID NO: 447963 - DNA, 25 bp, Mus musculus
gctgagctgcagttacaaaacatcg

SEQ ID NO: 447964 - DNA, 25 bp, Mus musculus
gctgagctgttcttgtgtggctgtt

SEQ ID NO: 447965 - DNA, 25 bp, Mus musculus
gctgagcttaatctggagcgttctg

SEQ ID NO: 447966 - DNA, 25 bp, Mus musculus
gctgaggaccaggtgctggcacaca

SEQ ID NO: 447967 - DNA, 25 bp, Mus musculus
gctgaggccattttcagggcaacat

SEQ ID NO: 447968 - DNA, 25 bp, Mus musculus
gctgaggcctccaggtgcgctctgt

SEQ ID NO: 447969 - DNA, 25 bp, Mus musculus
gctgaggcgcactacaagggtaatc

SEQ ID NO: 447970 - DNA, 25 bp, Mus musculus
gctgaggcggaagagtataaagacc

SEQ ID NO: 447971 - DNA, 25 bp, Mus musculus
gctgagggactgtttccgagcccag

SEQ ID NO: 447972 - DNA, 25 bp, Mus musculus
gctgagggtagccagtaaataacca

SEQ ID NO: 447973 - DNA, 25 bp, Mus musculus
gctgagggtttgttggccatctgcc

SEQ ID NO: 447974 - DNA, 25 bp, Mus musculus
gctgaggtgtgatcctaagccccaa

SEQ ID NO: 447975 - DNA, 25 bp, Mus musculus
gctgagtaaaccagacctccttgaa

SEQ ID NO: 447976 - DNA, 25 bp, Mus musculus
gctgagtacaaacgccaaaacccta

SEQ ID NO: 447977 - DNA, 25 bp, Mus musculus
gctgagtagtttgcactagggcgcc

SEQ ID NO: 447978 - DNA, 25 bp, Mus musculus
gctgagtataacaagctgcgctacg

SEQ ID NO: 447979 - DNA, 25 bp, Mus musculus
gctgagtgagaatgggagacccaaa

SEQ ID NO: 447980 - DNA, 25 bp, Mus musculus
gctgagtgagaccacgtctcagagt

SEQ ID NO: 447981 - DNA, 25 bp, Mus musculus
gctgagtgccagtgaatgcagatgt

SEQ ID NO: 447982 - DNA, 25 bp, Mus musculus
gctgagtggataaacagcacgggat

SEQ ID NO: 447983 - DNA, 25 bp, Mus musculus
gctgagttctgttgccctgctgtgg

SEQ ID NO: 447984 - DNA, 25 bp, Mus musculus
gctgagttgcaacctaaagcatctt

SEQ ID NO: 447985 - DNA, 25 bp, Mus musculus
gctgagttgcctgccagactcctga

SEQ ID NO: 447986 - DNA, 25 bp, Mus musculus
gctgagttgcttctaagccttccaa

SEQ ID NO: 447987 - DNA, 25 bp, Mus musculus
gctgagttgtctgaaatccttagtg

SEQ ID NO: 447988 - DNA, 25 bp, Mus musculus
gctgataaccaagcgcacatggtcc

SEQ ID NO: 447989 - DNA, 25 bp, Mus musculus
gctgataagctgctggcgacttaga

SEQ ID NO: 447990 - DNA, 25 bp, Mus musculus
gctgataatggaaaacccgtgcctt

SEQ ID NO: 447991 - DNA, 25 bp, Mus musculus
gctgatacaatctaactggaccggt

SEQ ID NO: 447992 - DNA, 25 bp, Mus musculus
gctgatacatccctatttgaactgg

SEQ ID NO: 447993 - DNA, 25 bp, Mus musculus
gctgatatctcttggcctaggtggg

SEQ ID NO: 447994 - DNA, 25 bp, Mus musculus
gctgatatgcagaaagggcacaacc

SEQ ID NO: 447995 - DNA, 25 bp, Mus musculus
gctgatcacagtcaaggctacctct

SEQ ID NO: 447996 - DNA, 25 bp, Mus musculus
gctgatcacagtgcagtggaagcta

SEQ ID NO: 447997 - DNA, 25 bp, Mus musculus
gctgatcagaaatcatggcggctct

SEQ ID NO: 447998 - DNA, 25 bp, Mus musculus
gctgatcctcagtagaatgtgggct

SEQ ID NO: 447999 - DNA, 25 bp, Mus musculus
gctgatcctgacgacatcctgggct

SEQ ID NO: 448000 - DNA, 25 bp, Mus musculus
gctgatcttgatggaggctaccccg

SEQ ID NO: 448001 - DNA, 25 bp, Mus musculus
gctgatcttgtcattagccacgcag

SEQ ID NO: 448002 - DNA, 25 bp, Mus musculus
gctgatgaacaggtggccctacgta

SEQ ID NO: 448003 - DNA, 25 bp, Mus musculus
gctgatgaacccaccgaggatgaca

SEQ ID NO: 448004 - DNA, 25 bp, Mus musculus
gctgatgaagttcttgctctctcct

SEQ ID NO: 448005 - DNA, 25 bp, Mus musculus
gctgatgaccctcaacgttggtgga

SEQ ID NO: 448006 - DNA, 25 bp, Mus musculus
gctgatgcgcccatccaacaaagca

SEQ ID NO: 448007 - DNA, 25 bp, Mus musculus
gctgatgctttgctcatccctggtg

SEQ ID NO: 448008 - DNA, 25 bp, Mus musculus
gctgatggcatccagtctctacgaa

SEQ ID NO: 448009 - DNA, 25 bp, Mus musculus
gctgatggcttaacatttgattgtc

SEQ ID NO: 448010 - DNA, 25 bp, Mus musculus
gctgatgggcttagctgcttgcact

SEQ ID NO: 448011 - DNA, 25 bp, Mus musculus
gctgatgttaccacacccctgggtg

SEQ ID NO: 448012 - DNA, 25 bp, Mus musculus
gctgatgtttgtgaacccacccgaa

SEQ ID NO: 448013 - DNA, 25 bp, Mus musculus
gctgattacttcaaaaaccggcgcc

SEQ ID NO: 448014 - DNA, 25 bp, Mus musculus
gctgattatgcaacacagtagttag

SEQ ID NO: 448015 - DNA, 25 bp, Mus musculus
gctgatttccttccttagcacaagg

SEQ ID NO: 448016 - DNA, 25 bp, Mus musculus
gctgatttggctcagatcacctgga

SEQ ID NO: 448017 - DNA, 25 bp, Mus musculus
gctgatttgtttgtagcaagaaagg

SEQ ID NO: 448018 - DNA, 25 bp, Mus musculus
gctgattttccctgttccctgaagg

SEQ ID NO: 448019 - DNA, 25 bp, Mus musculus
gctgatttttcagggtaagattaaa

SEQ ID NO: 448020 - DNA, 25 bp, Mus musculus
gctgcaaaaagagaaggaacgcctg

SEQ ID NO: 448021 - DNA, 25 bp, Mus musculus
gctgcaaatgccacacaacacgtgg

SEQ ID NO: 448022 - DNA, 25 bp, Mus musculus
gctgcaaattgacccgatccgcgtg

SEQ ID NO: 448023 - DNA, 25 bp, Mus musculus
gctgcaacagagtgctccacaggtg

SEQ ID NO: 448024 - DNA, 25 bp, Mus musculus
gctgcaacgcctacaggaggacttt

SEQ ID NO: 448025 - DNA, 25 bp, Mus musculus
gctgcaactgctgtaacaatgatac

SEQ ID NO: 448026 - DNA, 25 bp, Mus musculus
gctgcaactgctttcggaggactcc

SEQ ID NO: 448027 - DNA, 25 bp, Mus musculus
gctgcaactggacgagacctgtgct

SEQ ID NO: 448028 - DNA, 25 bp, Mus musculus
gctgcaactgtcttcgctggtaacc

SEQ ID NO: 448029 - DNA, 25 bp, Mus musculus
gctgcaagacccctgaagtctcctt

SEQ ID NO: 448030 - DNA, 25 bp, Mus musculus
gctgcaagaccggagaaagatgtaa

SEQ ID NO: 448031 - DNA, 25 bp, Mus musculus
gctgcaaggtgtgcccaggtaaaaa

SEQ ID NO: 448032 - DNA, 25 bp, Mus musculus
gctgcaagtaaagcggaagctgcat

SEQ ID NO: 448033 - DNA, 25 bp, Mus musculus
gctgcaatattgttccctgggttga

SEQ ID NO: 448034 - DNA, 25 bp, Mus musculus
gctgcaatcctgaatccagtgggta

SEQ ID NO: 448035 - DNA, 25 bp, Mus musculus
gctgcaatgcacctaagggctggta

SEQ ID NO: 448036 - DNA, 25 bp, Mus musculus
gctgcaatgctagtttcccagtggg

SEQ ID NO: 448037 - DNA, 25 bp, Mus musculus
gctgcacaagaattgaaaatgcttc

SEQ ID NO: 448038 - DNA, 25 bp, Mus musculus
gctgcacagatggagactacacgtt

SEQ ID NO: 448039 - DNA, 25 bp, Mus musculus
gctgcacagctaagattggcacaca

SEQ ID NO: 448040 - DNA, 25 bp, Mus musculus
gctgcacccaccctcgtgtgtggga

SEQ ID NO: 448041 - DNA, 25 bp, Mus musculus
gctgcaccgctcaaggaaaacaatg

SEQ ID NO: 448042 - DNA, 25 bp, Mus musculus
gctgcacgctggaactgagtctaca

SEQ ID NO: 448043 - DNA, 25 bp, Mus musculus
gctgcacggaagagtgtctgctcca

SEQ ID NO: 448044 - DNA, 25 bp, Mus musculus
gctgcactccagctcaggaaaggtg

SEQ ID NO: 448045 - DNA, 25 bp, Mus musculus
gctgcactcttaaagttcacgcctg

SEQ ID NO: 448046 - DNA, 25 bp, Mus musculus
gctgcacttggcactggcttctcct

SEQ ID NO: 448047 - DNA, 25 bp, Mus musculus
gctgcagaagatccccaaggtatca

SEQ ID NO: 448048 - DNA, 25 bp, Mus musculus
gctgcagacagctaggcggttttat

SEQ ID NO: 448049 - DNA, 25 bp, Mus musculus
gctgcagactaagccggtcattact

SEQ ID NO: 448050 - DNA, 25 bp, Mus musculus
gctgcagcaagatgtgggacaacct

SEQ ID NO: 448051 - DNA, 25 bp, Mus musculus
gctgcagcagtgtcttgcaagaatg

SEQ ID NO: 448052 - DNA, 25 bp, Mus musculus
gctgcagccaaaatccaggcgagtt

SEQ ID NO: 448053 - DNA, 25 bp, Mus musculus
gctgcagccatgagtgtcacatcta

SEQ ID NO: 448054 - DNA, 25 bp, Mus musculus
gctgcagctcttgggacctacgtgg

SEQ ID NO: 448055 - DNA, 25 bp, Mus musculus
gctgcaggaaaagtatggtcccatc

SEQ ID NO: 448056 - DNA, 25 bp, Mus musculus
gctgcaggccaataaaggagccagg

SEQ ID NO: 448057 - DNA, 25 bp, Mus musculus
gctgcaggccacaggtgagaccatt

SEQ ID NO: 448058 - DNA, 25 bp, Mus musculus
gctgcaggccattctaccggaggcg

SEQ ID NO: 448059 - DNA, 25 bp, Mus musculus
gctgcagggccttcaggcaaaaacc

SEQ ID NO: 448060 - DNA, 25 bp, Mus musculus
gctgcagtgaattcagggaccctga

SEQ ID NO: 448061 - DNA, 25 bp, Mus musculus
gctgcagtgcaaacggcaaacattc

SEQ ID NO: 448062 - DNA, 25 bp, Mus musculus
gctgcagtggatgcttcctttaaca

SEQ ID NO: 448063 - DNA, 25 bp, Mus musculus
gctgcagtgtctttgtggcaagagt

SEQ ID NO: 448064 - DNA, 25 bp, Mus musculus
gctgcagttcgctgcgctcaacaag

SEQ ID NO: 448065 - DNA, 25 bp, Mus musculus
gctgcataatcgagacacgctcgga

SEQ ID NO: 448066 - DNA, 25 bp, Mus musculus
gctgcatactgcacattcagagtca

SEQ ID NO: 448067 - DNA, 25 bp, Mus musculus
gctgcatagagatcagtaccctctg

SEQ ID NO: 448068 - DNA, 25 bp, Mus musculus
gctgcatcaaaaagacaagctaact

SEQ ID NO: 448069 - DNA, 25 bp, Mus musculus
gctgcatcaacacatggagcactgt

SEQ ID NO: 448070 - DNA, 25 bp, Mus musculus
gctgcatcgggttccctccgagtct

SEQ ID NO: 448071 - DNA, 25 bp, Mus musculus
gctgcatctgtgtggtgatacctca

SEQ ID NO: 448072 - DNA, 25 bp, Mus musculus
gctgcatctttcgtgacctcatgga

SEQ ID NO: 448073 - DNA, 25 bp, Mus musculus
gctgcatgccctttgcacgtgcgca

SEQ ID NO: 448074 - DNA, 25 bp, Mus musculus
gctgcatgcctacatcctgcgtgtg

SEQ ID NO: 448075 - DNA, 25 bp, Mus musculus
gctgcatggactgagccaattcggt

SEQ ID NO: 448076 - DNA, 25 bp, Mus musculus
gctgcatgggctagctttggactct

SEQ ID NO: 448077 - DNA, 25 bp, Mus musculus
gctgcatgtgtagggtaggcccggg

SEQ ID NO: 448078 - DNA, 25 bp, Mus musculus
gctgcattctgaggcgtttacaaga

SEQ ID NO: 448079 - DNA, 25 bp, Mus musculus
gctgcattgacctggaccgtggagt

SEQ ID NO: 448080 - DNA, 25 bp, Mus musculus
gctgcattgtacgtaaggacccgcg

SEQ ID NO: 448081 - DNA, 25 bp, Mus musculus
gctgcattgttcacggcaagactgg

SEQ ID NO: 448082 - DNA, 25 bp, Mus musculus
gctgccaagctgctcttcaacatgg

SEQ ID NO: 448083 - DNA, 25 bp, Mus musculus
gctgccacaggtgtacttaatgcta

SEQ ID NO: 448084 - DNA, 25 bp, Mus musculus
gctgccactactattctgtgacctg

SEQ ID NO: 448085 - DNA, 25 bp, Mus musculus
gctgccactatggagtgataccaaa

SEQ ID NO: 448086 - DNA, 25 bp, Mus musculus
gctgccactgcagagcctgatgtga

SEQ ID NO: 448087 - DNA, 25 bp, Mus musculus
gctgccagagttcgtagtaggccta

SEQ ID NO: 448088 - DNA, 25 bp, Mus musculus
gctgccagcgtccacttcatctgtg

SEQ ID NO: 448089 - DNA, 25 bp, Mus musculus
gctgccaggctctcagctgaaagaa

SEQ ID NO: 448090 - DNA, 25 bp, Mus musculus
gctgccatcaagtcaggatctccat

SEQ ID NO: 448091 - DNA, 25 bp, Mus musculus
gctgccatgtggatttacctcaagc

SEQ ID NO: 448092 - DNA, 25 bp, Mus musculus
gctgccattcaagtgagcctgttgg

SEQ ID NO: 448093 - DNA, 25 bp, Mus musculus
gctgcccaagctctaccagaaggtg

SEQ ID NO: 448094 - DNA, 25 bp, Mus musculus
gctgcccacgctgcaaaaactgtta

SEQ ID NO: 448095 - DNA, 25 bp, Mus musculus
gctgcccactgatacgcctttggaa

SEQ ID NO: 448096 - DNA, 25 bp, Mus musculus
gctgccccagaagaaagaattcgtg

SEQ ID NO: 448097 - DNA, 25 bp, Mus musculus
gctgccccgggaactactgcaaaaa

SEQ ID NO: 448098 - DNA, 25 bp, Mus musculus
gctgcccgcagactttggacctcgg

SEQ ID NO: 448099 - DNA, 25 bp, Mus musculus
gctgcccgctctttacaggttgaaa

SEQ ID NO: 448100 - DNA, 25 bp, Mus musculus
gctgcccgggacaaagaggagattt

SEQ ID NO: 448101 - DNA, 25 bp, Mus musculus
gctgcccgtcaaaaggtgtgtggaa

SEQ ID NO: 448102 - DNA, 25 bp, Mus musculus
gctgcccgtccaccttgaagaaaac

SEQ ID NO: 448103 - DNA, 25 bp, Mus musculus
gctgccctgcaaagatgggtggaaa

SEQ ID NO: 448104 - DNA, 25 bp, Mus musculus
gctgccctggcttgaggctaggtct

SEQ ID NO: 448105 - DNA, 25 bp, Mus musculus
gctgccgacggcttccagcaaaaga

SEQ ID NO: 448106 - DNA, 25 bp, Mus musculus
gctgccgactgatgtgaaacctgcc

SEQ ID NO: 448107 - DNA, 25 bp, Mus musculus
gctgccgagacgtatgccaatatca

SEQ ID NO: 448108 - DNA, 25 bp, Mus musculus
gctgccgagccagaaaacgatgcat

SEQ ID NO: 448109 - DNA, 25 bp, Mus musculus
gctgccgagggctgcacttctaaga

SEQ ID NO: 448110 - DNA, 25 bp, Mus musculus
gctgccgagtctggtgtacaacaca

SEQ ID NO: 448111 - DNA, 25 bp, Mus musculus
gctgccgcgcaaactgctggtcact

SEQ ID NO: 448112 - DNA, 25 bp, Mus musculus
gctgccgctaaatctgctgctaagg

SEQ ID NO: 448113 - DNA, 25 bp, Mus musculus
gctgccggagctctaccataaaata

SEQ ID NO: 448114 - DNA, 25 bp, Mus musculus
gctgccggccacatgaagctggtgt

SEQ ID NO: 448115 - DNA, 25 bp, Mus musculus
gctgccgtggcctatatcatggaca

SEQ ID NO: 448116 - DNA, 25 bp, Mus musculus
gctgcctaagcctgctttgagatca

SEQ ID NO: 448117 - DNA, 25 bp, Mus musculus
gctgcctacggctctacaaggaggt

SEQ ID NO: 448118 - DNA, 25 bp, Mus musculus
gctgcctcctgagcaaagacagagt

SEQ ID NO: 448119 - DNA, 25 bp, Mus musculus
gctgcctcgggactgtatagatgcc

SEQ ID NO: 448120 - DNA, 25 bp, Mus musculus
gctgcctctggatacccatttcaca

SEQ ID NO: 448121 - DNA, 25 bp, Mus musculus
gctgcctgatttcactcccaagtaa

SEQ ID NO: 448122 - DNA, 25 bp, Mus musculus
gctgcctgcagaatggaacgtgtta

SEQ ID NO: 448123 - DNA, 25 bp, Mus musculus
gctgcctgcagctaaactctcgtaa

SEQ ID NO: 448124 - DNA, 25 bp, Mus musculus
gctgcctgccgagcacagtcttatt

SEQ ID NO: 448125 - DNA, 25 bp, Mus musculus
gctgcctggacctccttgggatacg

SEQ ID NO: 448126 - DNA, 25 bp, Mus musculus
gctgcctggctctatgcctgagaaa

SEQ ID NO: 448127 - DNA, 25 bp, Mus musculus
gctgcctgggccataagtaacttaa

SEQ ID NO: 448128 - DNA, 25 bp, Mus musculus
gctgcctgggctctaacaaacattg

SEQ ID NO: 448129 - DNA, 25 bp, Mus musculus
gctgcctgggtggtagccctagcct

SEQ ID NO: 448130 - DNA, 25 bp, Mus musculus
gctgcctggttggtaatctgtctaa

SEQ ID NO: 448131 - DNA, 25 bp, Mus musculus
gctgcctgtcacttatcctgctgga

SEQ ID NO: 448132 - DNA, 25 bp, Mus musculus
gctgccttagccatggctattattg

SEQ ID NO: 448133 - DNA, 25 bp, Mus musculus
gctgccttaggaaatgattgacgtc

SEQ ID NO: 448134 - DNA, 25 bp, Mus musculus
gctgccttctctctgaacgcggctt

SEQ ID NO: 448135 - DNA, 25 bp, Mus musculus
gctgccttgggatgttgacggacct

SEQ ID NO: 448136 - DNA, 25 bp, Mus musculus
gctgccttgtgactggttctcacag

SEQ ID NO: 448137 - DNA, 25 bp, Mus musculus
gctgcgaactgtgtagcctgctcca

SEQ ID NO: 448138 - DNA, 25 bp, Mus musculus
gctgcgaagggacattgaagccacc

SEQ ID NO: 448139 - DNA, 25 bp, Mus musculus
gctgcgagacaaaacttgaaacaag

SEQ ID NO: 448140 - DNA, 25 bp, Mus musculus
gctgcgagatcatgtcctccgagag

SEQ ID NO: 448141 - DNA, 25 bp, Mus musculus
gctgcgagcgcgtagtaatcaacat

SEQ ID NO: 448142 - DNA, 25 bp, Mus musculus
gctgcgagcttccagtcatgccgaa

SEQ ID NO: 448143 - DNA, 25 bp, Mus musculus
gctgcgatcaccactcacagaagga

SEQ ID NO: 448144 - DNA, 25 bp, Mus musculus
gctgcgattgagtccactggctaac

SEQ ID NO: 448145 - DNA, 25 bp, Mus musculus
gctgcgccactggatctgagcaaga

SEQ ID NO: 448146 - DNA, 25 bp, Mus musculus
gctgcgcgacataaggaaggaacca

SEQ ID NO: 448147 - DNA, 25 bp, Mus musculus
gctgcgcgagcgttgtctatcatgg

SEQ ID NO: 448148 - DNA, 25 bp, Mus musculus
gctgcgcgcggttctactgtttctg

SEQ ID NO: 448149 - DNA, 25 bp, Mus musculus
gctgcgctcgctaagcttcttctgg

SEQ ID NO: 448150 - DNA, 25 bp, Mus musculus
gctgcgctctggctttcgtgaacat

SEQ ID NO: 448151 - DNA, 25 bp, Mus musculus
gctgcggaacaggacgccctctgat

SEQ ID NO: 448152 - DNA, 25 bp, Mus musculus
gctgcggagcaaagaccgcctttct

SEQ ID NO: 448153 - DNA, 25 bp, Mus musculus
gctgcggagcccaaggatcaagaag

SEQ ID NO: 448154 - DNA, 25 bp, Mus musculus
gctgcggatcgtgcgtgaacactac

SEQ ID NO: 448155 - DNA, 25 bp, Mus musculus
gctgcggcacctttaagacgaggga

SEQ ID NO: 448156 - DNA, 25 bp, Mus musculus
gctgcggccgtcaccggaaatctta

SEQ ID NO: 448157 - DNA, 25 bp, Mus musculus
gctgcgggaagaaagccgtctcctt

SEQ ID NO: 448158 - DNA, 25 bp, Mus musculus
gctgcgggccttaagggcacgcatc

SEQ ID NO: 448159 - DNA, 25 bp, Mus musculus
gctgcgggctgagttcactgctccg

SEQ ID NO: 448160 - DNA, 25 bp, Mus musculus
gctgcgggggtgttttcattttctc

SEQ ID NO: 448161 - DNA, 25 bp, Mus musculus
gctgcgggtccttggtgttctagca

SEQ ID NO: 448162 - DNA, 25 bp, Mus musculus
gctgcggtccaactgctgaagtctc

SEQ ID NO: 448163 - DNA, 25 bp, Mus musculus
gctgcggttgctgctgtattccaca

SEQ ID NO: 448164 - DNA, 25 bp, Mus musculus
gctgcgtacttagccagagggctcg

SEQ ID NO: 448165 - DNA, 25 bp, Mus musculus
gctgcgtagagccacatgaagcctg

SEQ ID NO: 448166 - DNA, 25 bp, Mus musculus
gctgcgtcacagaagcttccctgga

SEQ ID NO: 448167 - DNA, 25 bp, Mus musculus
gctgcgtctgactggacatttttac

SEQ ID NO: 448168 - DNA, 25 bp, Mus musculus
gctgctaaacaaacgtggcgactgg

SEQ ID NO: 448169 - DNA, 25 bp, Mus musculus
gctgctaacctcatgaaaagcggtg

SEQ ID NO: 448170 - DNA, 25 bp, Mus musculus
gctgctaaggcagataacttatggc

SEQ ID NO: 448171 - DNA, 25 bp, Mus musculus
gctgctacaacaattcacaccggga

SEQ ID NO: 448172 - DNA, 25 bp, Mus musculus
gctgctacaatttcttgaacaagga

SEQ ID NO: 448173 - DNA, 25 bp, Mus musculus
gctgctactactgcagcattgtgga

SEQ ID NO: 448174 - DNA, 25 bp, Mus musculus
gctgctactgaggaactcggccgaa

SEQ ID NO: 448175 - DNA, 25 bp, Mus musculus
gctgctacttccgttattttaagac

SEQ ID NO: 448176 - DNA, 25 bp, Mus musculus
gctgctagaagtggacgtagatgca

SEQ ID NO: 448177 - DNA, 25 bp, Mus musculus
gctgctaggatctcccagctgccaa

SEQ ID NO: 448178 - DNA, 25 bp, Mus musculus
gctgctatggctatgggaattgctc

SEQ ID NO: 448179 - DNA, 25 bp, Mus musculus
gctgctatgtttaccagatggtctg

SEQ ID NO: 448180 - DNA, 25 bp, Mus musculus
gctgctatttcagaatttttaccta

SEQ ID NO: 448181 - DNA, 25 bp, Mus musculus
gctgctcaacatcggtgcccaactt

SEQ ID NO: 448182 - DNA, 25 bp, Mus musculus
gctgctcaacgcacatgtacagtga

SEQ ID NO: 448183 - DNA, 25 bp, Mus musculus
gctgctcaataaatggtcactcaat

SEQ ID NO: 448184 - DNA, 25 bp, Mus musculus
gctgctcacagtacaaggctaagga

SEQ ID NO: 448185 - DNA, 25 bp, Mus musculus
gctgctcacattctccctggtgctg

SEQ ID NO: 448186 - DNA, 25 bp, Mus musculus
gctgctcagaactgccgtaaacgta

SEQ ID NO: 448187 - DNA, 25 bp, Mus musculus
gctgctcagtcgcttcctctgtacg

SEQ ID NO: 448188 - DNA, 25 bp, Mus musculus
gctgctccacgggtctgtcaggtgc

SEQ ID NO: 448189 - DNA, 25 bp, Mus musculus
gctgctccatcatgtgaaagctggg

SEQ ID NO: 448190 - DNA, 25 bp, Mus musculus
gctgctcccggactctgtgcaggca

SEQ ID NO: 448191 - DNA, 25 bp, Mus musculus
gctgctccctggatgactactacct

SEQ ID NO: 448192 - DNA, 25 bp, Mus musculus
gctgctccgggatgcttgactaaca

SEQ ID NO: 448193 - DNA, 25 bp, Mus musculus
gctgctcctgagaaactaatctgtg

SEQ ID NO: 448194 - DNA, 25 bp, Mus musculus
gctgctcctgctttgccggctgagg

SEQ ID NO: 448195 - DNA, 25 bp, Mus musculus
gctgctcctgtttccactggcccgg

SEQ ID NO: 448196 - DNA, 25 bp, Mus musculus
gctgctctccgtctgtggcattaat

SEQ ID NO: 448197 - DNA, 25 bp, Mus musculus
gctgctctctgtgtcaagccatgtg

SEQ ID NO: 448198 - DNA, 25 bp, Mus musculus
gctgctctgaacagcaagcaactgg

SEQ ID NO: 448199 - DNA, 25 bp, Mus musculus
gctgctctgataatggactcttgga

SEQ ID NO: 448200 - DNA, 25 bp, Mus musculus
gctgctctggataaggctactgtgc

SEQ ID NO: 448201 - DNA, 25 bp, Mus musculus
gctgctctgtagatctgaaggactg

SEQ ID NO: 448202 - DNA, 25 bp, Mus musculus
gctgctgaactttgtgactatctaa

SEQ ID NO: 448203 - DNA, 25 bp, Mus musculus
gctgctgaagttggctccaccttag

SEQ ID NO: 448204 - DNA, 25 bp, Mus musculus
gctgctgagattgttgagatggtac

SEQ ID NO: 448205 - DNA, 25 bp, Mus musculus
gctgctgagccctatgagaccattg

SEQ ID NO: 448206 - DNA, 25 bp, Mus musculus
gctgctgagcctgtctagtgctgtg

SEQ ID NO: 448207 - DNA, 25 bp, Mus musculus
gctgctgataaaactggaactcggg

SEQ ID NO: 448208 - DNA, 25 bp, Mus musculus
gctgctgatctcaatgagaaagaat

SEQ ID NO: 448209 - DNA, 25 bp, Mus musculus
gctgctgatgaaatgactctgggtc

SEQ ID NO: 448210 - DNA, 25 bp, Mus musculus
gctgctgcaagcctgatctgaagaa

SEQ ID NO: 448211 - DNA, 25 bp, Mus musculus
gctgctgcctgatgactacctggac

SEQ ID NO: 448212 - DNA, 25 bp, Mus musculus
gctgctgcctgtagatgggactgac

SEQ ID NO: 448213 - DNA, 25 bp, Mus musculus
gctgctgcctttgaccagggtccat

SEQ ID NO: 448214 - DNA, 25 bp, Mus musculus
gctgctgcgctcaactctttcctgt

SEQ ID NO: 448215 - DNA, 25 bp, Mus musculus
gctgctgcggctgttatctgtctca

SEQ ID NO: 448216 - DNA, 25 bp, Mus musculus
gctgctgctactggagaacgacgcg

SEQ ID NO: 448217 - DNA, 25 bp, Mus musculus
gctgctgctcatagctcgagccaga

SEQ ID NO: 448218 - DNA, 25 bp, Mus musculus
gctgctgctgtcttaaatgtcctga

SEQ ID NO: 448219 - DNA, 25 bp, Mus musculus
gctgctgctgttggaaagatccgta

SEQ ID NO: 448220 - DNA, 25 bp, Mus musculus
gctgctgcttcgaccactactggta

SEQ ID NO: 448221 - DNA, 25 bp, Mus musculus
gctgctggaaactagactgtatgtt

SEQ ID NO: 448222 - DNA, 25 bp, Mus musculus
gctgctggactggatatggaccctg

SEQ ID NO: 448223 - DNA, 25 bp, Mus musculus
gctgctggagcaaatgaagaactct

SEQ ID NO: 448224 - DNA, 25 bp, Mus musculus
gctgctggagctagacaacaattca

SEQ ID NO: 448225 - DNA, 25 bp, Mus musculus
gctgctggcccctgagatgatctca

SEQ ID NO: 448226 - DNA, 25 bp, Mus musculus
gctgctggccgtggtcattataata

SEQ ID NO: 448227 - DNA, 25 bp, Mus musculus
gctgctggctaagagcacctattag

SEQ ID NO: 448228 - DNA, 25 bp, Mus musculus
gctgctggctcacactgatcccagg

SEQ ID NO: 448229 - DNA, 25 bp, Mus musculus
gctgctgggccgcactacgctcaga

SEQ ID NO: 448230 - DNA, 25 bp, Mus musculus
gctgctgggcgtgcacaacatcgat

SEQ ID NO: 448231 - DNA, 25 bp, Mus musculus
gctgctgggctcatgactgctgcta

SEQ ID NO: 448232 - DNA, 25 bp, Mus musculus
gctgctgggtcaactgagccattat

SEQ ID NO: 448233 - DNA, 25 bp, Mus musculus
gctgctggtcacaagcgaatacccc

SEQ ID NO: 448234 - DNA, 25 bp, Mus musculus
gctgctggtccatgaaccaacttgc

SEQ ID NO: 448235 - DNA, 25 bp, Mus musculus
gctgctggtggcttcgatgaatatt

SEQ ID NO: 448236 - DNA, 25 bp, Mus musculus
gctgctggtgtcagtactagactct

SEQ ID NO: 448237 - DNA, 25 bp, Mus musculus
gctgctgtcacttcataaccggcgg

SEQ ID NO: 448238 - DNA, 25 bp, Mus musculus
gctgctgtcagcgtcacttctaaaa

SEQ ID NO: 448239 - DNA, 25 bp, Mus musculus
gctgctgtgttgacgagactgcctg

SEQ ID NO: 448240 - DNA, 25 bp, Mus musculus
gctgctgttgatcgtccaccttgga

SEQ ID NO: 448241 - DNA, 25 bp, Mus musculus
gctgctgttttcagtggctgctcca

SEQ ID NO: 448242 - DNA, 25 bp, Mus musculus
gctgcttcaaccctgttttcaggat

SEQ ID NO: 448243 - DNA, 25 bp, Mus musculus
gctgcttcagacagcactgttccag

SEQ ID NO: 448244 - DNA, 25 bp, Mus musculus
gctgcttcctcattccaaatacaaa

SEQ ID NO: 448245 - DNA, 25 bp, Mus musculus
gctgcttcctgtcccactactgtag

SEQ ID NO: 448246 - DNA, 25 bp, Mus musculus
gctgcttctcaacaggatgccctgg

SEQ ID NO: 448247 - DNA, 25 bp, Mus musculus
gctgcttgaaatccccaggccagcg

SEQ ID NO: 448248 - DNA, 25 bp, Mus musculus
gctgcttgacaaagaggccctggaa

SEQ ID NO: 448249 - DNA, 25 bp, Mus musculus
gctgcttgactgtggagttgacgtc

SEQ ID NO: 448250 - DNA, 25 bp, Mus musculus
gctgcttggaccttggacaccagga

SEQ ID NO: 448251 - DNA, 25 bp, Mus musculus
gctgctttaacttttggttaacgtg

SEQ ID NO: 448252 - DNA, 25 bp, Mus musculus
gctgctttacacatttaagactgca

SEQ ID NO: 448253 - DNA, 25 bp, Mus musculus
gctgctttagagtagtcgagaccca

SEQ ID NO: 448254 - DNA, 25 bp, Mus musculus
gctgctttagcaagggaacctgcgg

SEQ ID NO: 448255 - DNA, 25 bp, Mus musculus
gctgctttcaggtaagtcctctggg

SEQ ID NO: 448256 - DNA, 25 bp, Mus musculus
gctgctttgctgtataggaacctgg

SEQ ID NO: 448257 - DNA, 25 bp, Mus musculus
gctgctttggagctcaatgacccca

SEQ ID NO: 448258 - DNA, 25 bp, Mus musculus
gctgctttgtctcccccaagtgtgt

SEQ ID NO: 448259 - DNA, 25 bp, Mus musculus
gctgcttttcctcaacacctcctgt

SEQ ID NO: 448260 - DNA, 25 bp, Mus musculus
gctgcttttggaacccagaataata

SEQ ID NO: 448261 - DNA, 25 bp, Mus musculus
gctgcttttggatggagttaggtaa

SEQ ID NO: 448262 - DNA, 25 bp, Mus musculus
gctggaaacaccagcactgtcccgg

SEQ ID NO: 448263 - DNA, 25 bp, Mus musculus
gctggaaagcatgtatgcggccctc

SEQ ID NO: 448264 - DNA, 25 bp, Mus musculus
gctggaaagcgaccacctattgttt

SEQ ID NO: 448265 - DNA, 25 bp, Mus musculus
gctggaacagatgcacgtcctcgat

SEQ ID NO: 448266 - DNA, 25 bp, Mus musculus
gctggaacagccgaacattgtgcat

SEQ ID NO: 448267 - DNA, 25 bp, Mus musculus
gctggaaccctctcgtggaaacatt

SEQ ID NO: 448268 - DNA, 25 bp, Mus musculus
gctggaacccttgttttggacctga

SEQ ID NO: 448269 - DNA, 25 bp, Mus musculus
gctggaagaacgctacaaatgtgcc

SEQ ID NO: 448270 - DNA, 25 bp, Mus musculus
gctggaagcagaaatacgaaggctg

SEQ ID NO: 448271 - DNA, 25 bp, Mus musculus
gctggaagcttgcaaagtaaaccct

SEQ ID NO: 448272 - DNA, 25 bp, Mus musculus
gctggaaggcagtaaagggtctaca

SEQ ID NO: 448273 - DNA, 25 bp, Mus musculus
gctggaagggtcaaaaaagatgccc

SEQ ID NO: 448274 - DNA, 25 bp, Mus musculus
gctggaagtacgtcttagatctatc

SEQ ID NO: 448275 - DNA, 25 bp, Mus musculus
gctggaatgtctgctgacgcactgc

SEQ ID NO: 448276 - DNA, 25 bp, Mus musculus
gctggaattctgcacctgctttcaa

SEQ ID NO: 448277 - DNA, 25 bp, Mus musculus
gctggaattgcaccacactggaccg

SEQ ID NO: 448278 - DNA, 25 bp, Mus musculus
gctggacaaggcactaggacctaga

SEQ ID NO: 448279 - DNA, 25 bp, Mus musculus
gctggacacccctctcgaaaggctt

SEQ ID NO: 448280 - DNA, 25 bp, Mus musculus
gctggacactagtggagacctcttc

SEQ ID NO: 448281 - DNA, 25 bp, Mus musculus
gctggacatggcgatcaaatggtcg

SEQ ID NO: 448282 - DNA, 25 bp, Mus musculus
gctggacattatgttgtcagagaaa

SEQ ID NO: 448283 - DNA, 25 bp, Mus musculus
gctggaccatggactctttagaatc

SEQ ID NO: 448284 - DNA, 25 bp, Mus musculus
gctggaccccgacttacattgctga

SEQ ID NO: 448285 - DNA, 25 bp, Mus musculus
gctggacccctcaggttaagaaatt

SEQ ID NO: 448286 - DNA, 25 bp, Mus musculus
gctggaccttgacctgaagtataag

SEQ ID NO: 448287 - DNA, 25 bp, Mus musculus
gctggacgatgagctagagtgtgct

SEQ ID NO: 448288 - DNA, 25 bp, Mus musculus
gctggacgcagcatggagaccttct

SEQ ID NO: 448289 - DNA, 25 bp, Mus musculus
gctggacggacggctagctagttca

SEQ ID NO: 448290 - DNA, 25 bp, Mus musculus
gctggacgggatctcacagactacc

SEQ ID NO: 448291 - DNA, 25 bp, Mus musculus
gctggactgaccgataggctgtatg

SEQ ID NO: 448292 - DNA, 25 bp, Mus musculus
gctggactgctgtgtcccacaaaca

SEQ ID NO: 448293 - DNA, 25 bp, Mus musculus
gctggagaaagaacatagctgacct

SEQ ID NO: 448294 - DNA, 25 bp, Mus musculus
gctggagaccaggatttaaggatca

SEQ ID NO: 448295 - DNA, 25 bp, Mus musculus
gctggagatactgactaaatttacc

SEQ ID NO: 448296 - DNA, 25 bp, Mus musculus
gctggagattccctgtcaggaactt

SEQ ID NO: 448297 - DNA, 25 bp, Mus musculus
gctggagattttggttcgcgaccca

SEQ ID NO: 448298 - DNA, 25 bp, Mus musculus
gctggagcaattctaatttgtgttg

SEQ ID NO: 448299 - DNA, 25 bp, Mus musculus
gctggagccacctgaatattgggaa

SEQ ID NO: 448300 - DNA, 25 bp, Mus musculus
gctggagccagcttcatacaaatgg

SEQ ID NO: 448301 - DNA, 25 bp, Mus musculus
gctggagcccatcaaaagtcagggt

SEQ ID NO: 448302 - DNA, 25 bp, Mus musculus
gctggagccccaaggtgagagcccc

SEQ ID NO: 448303 - DNA, 25 bp, Mus musculus
gctggagccggctgcgctttgataa

SEQ ID NO: 448304 - DNA, 25 bp, Mus musculus
gctggagccggttaaactttaacag

SEQ ID NO: 448305 - DNA, 25 bp, Mus musculus
gctggagctgcagctcttgggacct

SEQ ID NO: 448306 - DNA, 25 bp, Mus musculus
gctggagctgctcacaatcactggg

SEQ ID NO: 448307 - DNA, 25 bp, Mus musculus
gctggaggccattgacatcctgtgg

SEQ ID NO: 448308 - DNA, 25 bp, Mus musculus
gctggaggccttgcattcaactggc

SEQ ID NO: 448309 - DNA, 25 bp, Mus musculus
gctggagtacccaccacttgctctg

SEQ ID NO: 448310 - DNA, 25 bp, Mus musculus
gctggagtatgctgacaaagtcttc

SEQ ID NO: 448311 - DNA, 25 bp, Mus musculus
gctggagtcgggtatatttagaaaa

SEQ ID NO: 448312 - DNA, 25 bp, Mus musculus
gctggagttagggtcggtcttaatt

SEQ ID NO: 448313 - DNA, 25 bp, Mus musculus
gctggagttgcacttcagcctgtac

SEQ ID NO: 448314 - DNA, 25 bp, Mus musculus
gctggagtttgaacttcagagctat

SEQ ID NO: 448315 - DNA, 25 bp, Mus musculus
gctggataagaagtacgcattgccc

SEQ ID NO: 448316 - DNA, 25 bp, Mus musculus
gctggataccagacttttagggaga

SEQ ID NO: 448317 - DNA, 25 bp, Mus musculus
gctggatacccagactactatgaga

SEQ ID NO: 448318 - DNA, 25 bp, Mus musculus
gctggatcacaagatcagagggccg

SEQ ID NO: 448319 - DNA, 25 bp, Mus musculus
gctggatcccaagtgcaaagtaatt

SEQ ID NO: 448320 - DNA, 25 bp, Mus musculus
gctggatctaacaggccacaactga

SEQ ID NO: 448321 - DNA, 25 bp, Mus musculus
gctggatgacaggatgccgtttgaa

SEQ ID NO: 448322 - DNA, 25 bp, Mus musculus
gctggatgacccgaaacacgttcag

SEQ ID NO: 448323 - DNA, 25 bp, Mus musculus
gctggatgaccgtgcagatgccctc

SEQ ID NO: 448324 - DNA, 25 bp, Mus musculus
gctggatgcagattcaatggccgtt

SEQ ID NO: 448325 - DNA, 25 bp, Mus musculus
gctggatgtctgtactcacctttca

SEQ ID NO: 448326 - DNA, 25 bp, Mus musculus
gctggattctgacccgagctctgca

SEQ ID NO: 448327 - DNA, 25 bp, Mus musculus
gctggattggctaatttcagggcaa

SEQ ID NO: 448328 - DNA, 25 bp, Mus musculus
gctggcaagcacaggagctgtctgt

SEQ ID NO: 448329 - DNA, 25 bp, Mus musculus
gctggcaagccaaggcctgaaaggg

SEQ ID NO: 448330 - DNA, 25 bp, Mus musculus
gctggcaaggcagaacagaatcaac

SEQ ID NO: 448331 - DNA, 25 bp, Mus musculus
gctggcacaagggatctactacgtc

SEQ ID NO: 448332 - DNA, 25 bp, Mus musculus
gctggcactatttggcagcatttct

SEQ ID NO: 448333 - DNA, 25 bp, Mus musculus
gctggcagacctagactgaccctat

SEQ ID NO: 448334 - DNA, 25 bp, Mus musculus
gctggcagcctctgccaagaaggtg

SEQ ID NO: 448335 - DNA, 25 bp, Mus musculus
gctggcagtagctcccctatttaag

SEQ ID NO: 448336 - DNA, 25 bp, Mus musculus
gctggcatcactcggtcaatcagcc

SEQ ID NO: 448337 - DNA, 25 bp, Mus musculus
gctggcatgatagacaaaataaacc

SEQ ID NO: 448338 - DNA, 25 bp, Mus musculus
gctggcatttcatgccactgcagaa

SEQ ID NO: 448339 - DNA, 25 bp, Mus musculus
gctggccactacttacacgaggagg

SEQ ID NO: 448340 - DNA, 25 bp, Mus musculus
gctggccagcgatgtcctctatagg

SEQ ID NO: 448341 - DNA, 25 bp, Mus musculus
gctggccaggaacttgagtgacatt

SEQ ID NO: 448342 - DNA, 25 bp, Mus musculus
gctggcccacatgaaacacaaggag

SEQ ID NO: 448343 - DNA, 25 bp, Mus musculus
gctggccccactgatgtctgactga

SEQ ID NO: 448344 - DNA, 25 bp, Mus musculus
gctggccgccaggtacatagacttc

SEQ ID NO: 448345 - DNA, 25 bp, Mus musculus
gctggccgtgttcctcaacgagcag

SEQ ID NO: 448346 - DNA, 25 bp, Mus musculus
gctggcctctgtgctgagagaatac

SEQ ID NO: 448347 - DNA, 25 bp, Mus musculus
gctggccttgccgttttggttgtct

SEQ ID NO: 448348 - DNA, 25 bp, Mus musculus
gctggcgctggccattttaaggacc

SEQ ID NO: 448349 - DNA, 25 bp, Mus musculus
gctggcggccttcatgaagaatttc

SEQ ID NO: 448350 - DNA, 25 bp, Mus musculus
gctggcgggattgcatctgagaccc

SEQ ID NO: 448351 - DNA, 25 bp, Mus musculus
gctggcgggcgttaacattacactc

SEQ ID NO: 448352 - DNA, 25 bp, Mus musculus
gctggcgtctcgctctcggtttcca

SEQ ID NO: 448353 - DNA, 25 bp, Mus musculus
gctggctaagagcacctattaggtg

SEQ ID NO: 448354 - DNA, 25 bp, Mus musculus
gctggctaatgcaggacgacctctc

SEQ ID NO: 448355 - DNA, 25 bp, Mus musculus
gctggctagcctttggagatgcgca

SEQ ID NO: 448356 - DNA, 25 bp, Mus musculus
gctggctatgcaaccgaaagtggga

SEQ ID NO: 448357 - DNA, 25 bp, Mus musculus
gctggctattactgtggaccgctac

SEQ ID NO: 448358 - DNA, 25 bp, Mus musculus
gctggctcacaggtttgaggagacc

SEQ ID NO: 448359 - DNA, 25 bp, Mus musculus
gctggctctaagtctcctgacacga

SEQ ID NO: 448360 - DNA, 25 bp, Mus musculus
gctggctctagctaccttctcggaa

SEQ ID NO: 448361 - DNA, 25 bp, Mus musculus
gctggctgcaaccaacatatcctgg

SEQ ID NO: 448362 - DNA, 25 bp, Mus musculus
gctggctgcatccaaagctgctaaa

SEQ ID NO: 448363 - DNA, 25 bp, Mus musculus
gctggctgcctacagagaccttctg

SEQ ID NO: 448364 - DNA, 25 bp, Mus musculus
gctggctggaaaaagacccttcacc

SEQ ID NO: 448365 - DNA, 25 bp, Mus musculus
gctggctggaactgcgacgtcttga

SEQ ID NO: 448366 - DNA, 25 bp, Mus musculus
gctggctggcactgatattctcctg

SEQ ID NO: 448367 - DNA, 25 bp, Mus musculus
gctggctggtcaccgggtggcccag

SEQ ID NO: 448368 - DNA, 25 bp, Mus musculus
gctggctggtgcagaagatcttcaa

SEQ ID NO: 448369 - DNA, 25 bp, Mus musculus
gctggctgtgtaacaagctggtctg

SEQ ID NO: 448370 - DNA, 25 bp, Mus musculus
gctggcttcattggttccgaggaga

SEQ ID NO: 448371 - DNA, 25 bp, Mus musculus
gctggcttcggcttgctaacctgcc

SEQ ID NO: 448372 - DNA, 25 bp, Mus musculus
gctggcttctgtatacccgagggaa

SEQ ID NO: 448373 - DNA, 25 bp, Mus musculus
gctggcttgaaacggaacgacctct

SEQ ID NO: 448374 - DNA, 25 bp, Mus musculus
gctggcttgggaactgaaaccacat

SEQ ID NO: 448375 - DNA, 25 bp, Mus musculus
gctggcttgtcgatgttgctgtttg

SEQ ID NO: 448376 - DNA, 25 bp, Mus musculus
gctggcttgtgagtgtcctctcaga

SEQ ID NO: 448377 - DNA, 25 bp, Mus musculus
gctgggaaactaagccgagcggaac

SEQ ID NO: 448378 - DNA, 25 bp, Mus musculus
gctgggaacacagtcgaaagccttc

SEQ ID NO: 448379 - DNA, 25 bp, Mus musculus
gctgggaactttgggatcacaggca

SEQ ID NO: 448380 - DNA, 25 bp, Mus musculus
gctgggaagtgacttagtcaagtac

SEQ ID NO: 448381 - DNA, 25 bp, Mus musculus
gctgggaatctagggacctgcctcg

SEQ ID NO: 448382 - DNA, 25 bp, Mus musculus
gctgggaatgcgttattacccaaag

SEQ ID NO: 448383 - DNA, 25 bp, Mus musculus
gctgggaatggaattgagtcttctc

SEQ ID NO: 448384 - DNA, 25 bp, Mus musculus
gctgggacaccacattggagcccgc

SEQ ID NO: 448385 - DNA, 25 bp, Mus musculus
gctgggacatgctctaggactggaa

SEQ ID NO: 448386 - DNA, 25 bp, Mus musculus
gctgggaccaaattcaggttcctgt

SEQ ID NO: 448387 - DNA, 25 bp, Mus musculus
gctgggactgattgatttttcggaa

SEQ ID NO: 448388 - DNA, 25 bp, Mus musculus
gctgggacttctgttattactagga

SEQ ID NO: 448389 - DNA, 25 bp, Mus musculus
gctgggagagcacatgcaagtacct

SEQ ID NO: 448390 - DNA, 25 bp, Mus musculus
gctgggagcagaaatcaggtcctct

SEQ ID NO: 448391 - DNA, 25 bp, Mus musculus
gctgggagcagggtaaatattttta

SEQ ID NO: 448392 - DNA, 25 bp, Mus musculus
gctgggagcattttacacatgggaa

SEQ ID NO: 448393 - DNA, 25 bp, Mus musculus
gctgggataccaactcattactggg

SEQ ID NO: 448394 - DNA, 25 bp, Mus musculus
gctgggatcattggaagaatcaaac

SEQ ID NO: 448395 - DNA, 25 bp, Mus musculus
gctgggatcccgagagtcatcttgt

SEQ ID NO: 448396 - DNA, 25 bp, Mus musculus
gctgggatgacagatttgcaacccc

SEQ ID NO: 448397 - DNA, 25 bp, Mus musculus
gctgggatggataccaccttctgga

SEQ ID NO: 448398 - DNA, 25 bp, Mus musculus
gctgggattacgagctggagccatc

SEQ ID NO: 448399 - DNA, 25 bp, Mus musculus
gctgggattagctcaaagtgccttc

SEQ ID NO: 448400 - DNA, 25 bp, Mus musculus
gctgggattgatcgcatgtaccgcc

SEQ ID NO: 448401 - DNA, 25 bp, Mus musculus
gctgggcaccttcttggctatggaa

SEQ ID NO: 448402 - DNA, 25 bp, Mus musculus
gctgggcactgaacatgaaggaact

SEQ ID NO: 448403 - DNA, 25 bp, Mus musculus
gctgggcagagcaccctactatcat

SEQ ID NO: 448404 - DNA, 25 bp, Mus musculus
gctgggcagcgaatgacaacatggt

SEQ ID NO: 448405 - DNA, 25 bp, Mus musculus
gctgggcatctcgtcctttgtcctg

SEQ ID NO: 448406 - DNA, 25 bp, Mus musculus
gctgggccaagtgactggactcgct

SEQ ID NO: 448407 - DNA, 25 bp, Mus musculus
gctgggccaattctgcgcactgaga

SEQ ID NO: 448408 - DNA, 25 bp, Mus musculus
gctgggccagaaaccgaaagtcctg

SEQ ID NO: 448409 - DNA, 25 bp, Mus musculus
gctgggcccaaaatcacagtggtcc

SEQ ID NO: 448410 - DNA, 25 bp, Mus musculus
gctgggccccagatggacgacatct

SEQ ID NO: 448411 - DNA, 25 bp, Mus musculus
gctgggccccgttgagacaatcctt

SEQ ID NO: 448412 - DNA, 25 bp, Mus musculus
gctgggcctccttgctagttataac

SEQ ID NO: 448413 - DNA, 25 bp, Mus musculus
gctgggccttggagtaaacggaact

SEQ ID NO: 448414 - DNA, 25 bp, Mus musculus
gctgggcgtggcttcacgctgcttc

SEQ ID NO: 448415 - DNA, 25 bp, Mus musculus
gctgggctctgctccactgttgtaa

SEQ ID NO: 448416 - DNA, 25 bp, Mus musculus
gctgggctgctaaaccgggaactgt

SEQ ID NO: 448417 - DNA, 25 bp, Mus musculus
gctgggcttcagctgtgccaacaag

SEQ ID NO: 448418 - DNA, 25 bp, Mus musculus
gctggggtgactcagcagcattcca

SEQ ID NO: 448419 - DNA, 25 bp, Mus musculus
gctgggtagcattccacgacgttaa

SEQ ID NO: 448420 - DNA, 25 bp, Mus musculus
gctgggtctgttagccttcatctgg

SEQ ID NO: 448421 - DNA, 25 bp, Mus musculus
gctgggtcttcaacgtccggacact

SEQ ID NO: 448422 - DNA, 25 bp, Mus musculus
gctgggtgcctgacaagctctttgc

SEQ ID NO: 448423 - DNA, 25 bp, Mus musculus
gctgggtggctaagggactctcaat

SEQ ID NO: 448424 - DNA, 25 bp, Mus musculus
gctgggtgtttaggccttcaagaga

SEQ ID NO: 448425 - DNA, 25 bp, Mus musculus
gctgggttgcttttcgcccaaatca

SEQ ID NO: 448426 - DNA, 25 bp, Mus musculus
gctgggtttctgcaggtcttgtccc

SEQ ID NO: 448427 - DNA, 25 bp, Mus musculus
gctggtaaacataggtggcgacttc

SEQ ID NO: 448428 - DNA, 25 bp, Mus musculus
gctggtacaaaaggcagagctggtt

SEQ ID NO: 448429 - DNA, 25 bp, Mus musculus
gctggtaccccaagccaaaggttca

SEQ ID NO: 448430 - DNA, 25 bp, Mus musculus
gctggtacgtgagggctttaaaaca

SEQ ID NO: 448431 - DNA, 25 bp, Mus musculus
gctggtagcatagcaccgcaaattt

SEQ ID NO: 448432 - DNA, 25 bp, Mus musculus
gctggtatccctcattccctgcaga

SEQ ID NO: 448433 - DNA, 25 bp, Mus musculus
gctggtcacaaatccataggctaaa

SEQ ID NO: 448434 - DNA, 25 bp, Mus musculus
gctggtcacagtgagtcgctcgccg

SEQ ID NO: 448435 - DNA, 25 bp, Mus musculus
gctggtcagcgatcgtaaactccta

SEQ ID NO: 448436 - DNA, 25 bp, Mus musculus
gctggtcagctgaaaatctttgatc

SEQ ID NO: 448437 - DNA, 25 bp, Mus musculus
gctggtccccagattggccatgagg

SEQ ID NO: 448438 - DNA, 25 bp, Mus musculus
gctggtcccttttcacatctggagg

SEQ ID NO: 448439 - DNA, 25 bp, Mus musculus
gctggtcctggtgccctgaccaata

SEQ ID NO: 448440 - DNA, 25 bp, Mus musculus
gctggtcgcaatgcaatatattgtg

SEQ ID NO: 448441 - DNA, 25 bp, Mus musculus
gctggtcgtcctacgaaaaaggcgg

SEQ ID NO: 448442 - DNA, 25 bp, Mus musculus
gctggtcttcgaactgcagctgtgg

SEQ ID NO: 448443 - DNA, 25 bp, Mus musculus
gctggtgaaaggaaccaagggtgag

SEQ ID NO: 448444 - DNA, 25 bp, Mus musculus
gctggtgattcatcactccctagga

SEQ ID NO: 448445 - DNA, 25 bp, Mus musculus
gctggtgcccgaaacgtatccgaat

SEQ ID NO: 448446 - DNA, 25 bp, Mus musculus
gctggtgccgcccacttgacgtgtc

SEQ ID NO: 448447 - DNA, 25 bp, Mus musculus
gctggtgccttgttttattggtgga

SEQ ID NO: 448448 - DNA, 25 bp, Mus musculus
gctggtggtgttcgcctcactctga

SEQ ID NO: 448449 - DNA, 25 bp, Mus musculus
gctggtgtcacctggagatgccctc

SEQ ID NO: 448450 - DNA, 25 bp, Mus musculus
gctggtgtccaacctggacttcgga

SEQ ID NO: 448451 - DNA, 25 bp, Mus musculus
gctggtgtggcaggtttgacctcac

SEQ ID NO: 448452 - DNA, 25 bp, Mus musculus
gctggtgtgtgaaccccaataccgg

SEQ ID NO: 448453 - DNA, 25 bp, Mus musculus
gctggtgttgatggttcataccttt

SEQ ID NO: 448454 - DNA, 25 bp, Mus musculus
gctggttaaacactccactggacgg

SEQ ID NO: 448455 - DNA, 25 bp, Mus musculus
gctggttaaagtgcagagccgcaca

SEQ ID NO: 448456 - DNA, 25 bp, Mus musculus
gctggttcattatcacggagcccat

SEQ ID NO: 448457 - DNA, 25 bp, Mus musculus
gctggttccagcgactgaggagcat

SEQ ID NO: 448458 - DNA, 25 bp, Mus musculus
gctggttgaccccatgagacctgga

SEQ ID NO: 448459 - DNA, 25 bp, Mus musculus
gctggttgagccttcaaagtcctaa

SEQ ID NO: 448460 - DNA, 25 bp, Mus musculus
gctggttgcagtaatgggttttgaa

SEQ ID NO: 448461 - DNA, 25 bp, Mus musculus
gctggttgccgaatcatctcctgta

SEQ ID NO: 448462 - DNA, 25 bp, Mus musculus
gctggtttctgccaaagacggacat

SEQ ID NO: 448463 - DNA, 25 bp, Mus musculus
gctggttttagtacgaagaacatta

SEQ ID NO: 448464 - DNA, 25 bp, Mus musculus
gctgtaaagcatgaccacggcatct

SEQ ID NO: 448465 - DNA, 25 bp, Mus musculus
gctgtaacaattcccagtgtggtat

SEQ ID NO: 448466 - DNA, 25 bp, Mus musculus
gctgtaactggccaaaatcctggtc

SEQ ID NO: 448467 - DNA, 25 bp, Mus musculus
gctgtaagcccggagacggaagtct

SEQ ID NO: 448468 - DNA, 25 bp, Mus musculus
gctgtaagggcatccggacctgtct

SEQ ID NO: 448469 - DNA, 25 bp, Mus musculus
gctgtaagtaaaaagctatgaagga

SEQ ID NO: 448470 - DNA, 25 bp, Mus musculus
gctgtaagtaaagagctgtgcccca

SEQ ID NO: 448471 - DNA, 25 bp, Mus musculus
gctgtaatctagtgaaactgtagcc

SEQ ID NO: 448472 - DNA, 25 bp, Mus musculus
gctgtaatgtactccgctctctgcc

SEQ ID NO: 448473 - DNA, 25 bp, Mus musculus
gctgtacagtgcgactagccgggtc

SEQ ID NO: 448474 - DNA, 25 bp, Mus musculus
gctgtacatctgataacaccttcat

SEQ ID NO: 448475 - DNA, 25 bp, Mus musculus
gctgtaccagcggaaagagcctgtt

SEQ ID NO: 448476 - DNA, 25 bp, Mus musculus
gctgtactccgcacattttccgtta

SEQ ID NO: 448477 - DNA, 25 bp, Mus musculus
gctgtactcctgactccttgtgtga

SEQ ID NO: 448478 - DNA, 25 bp, Mus musculus
gctgtacttgctctgacacattgag

SEQ ID NO: 448479 - DNA, 25 bp, Mus musculus
gctgtagcatttggtagagacttga

SEQ ID NO: 448480 - DNA, 25 bp, Mus musculus
gctgtagctggcagtatgtgtccca

SEQ ID NO: 448481 - DNA, 25 bp, Mus musculus
gctgtaggactctgggactgagacc

SEQ ID NO: 448482 - DNA, 25 bp, Mus musculus
gctgtagtcctctactcagagactg

SEQ ID NO: 448483 - DNA, 25 bp, Mus musculus
gctgtagtgacagcttaaggcagga

SEQ ID NO: 448484 - DNA, 25 bp, Mus musculus
gctgtagtgtgctagaagtcggcca

SEQ ID NO: 448485 - DNA, 25 bp, Mus musculus
gctgtatgacctcggacatctggaa

SEQ ID NO: 448486 - DNA, 25 bp, Mus musculus
gctgtatgcccagaaaggtgtccat

SEQ ID NO: 448487 - DNA, 25 bp, Mus musculus
gctgtatggaaaacctaagataaag

SEQ ID NO: 448488 - DNA, 25 bp, Mus musculus
gctgtatttaaactcccatcctggg

SEQ ID NO: 448489 - DNA, 25 bp, Mus musculus
gctgtcaaagacctcgtgtgctcca

SEQ ID NO: 448490 - DNA, 25 bp, Mus musculus
gctgtcaaagcctacgtccgtgtgt

SEQ ID NO: 448491 - DNA, 25 bp, Mus musculus
gctgtcaacagaagtggttaagaca

SEQ ID NO: 448492 - DNA, 25 bp, Mus musculus
gctgtcaacaggaaatgtggtccca

SEQ ID NO: 448493 - DNA, 25 bp, Mus musculus
gctgtcaagcagatactgagaatag

SEQ ID NO: 448494 - DNA, 25 bp, Mus musculus
gctgtcaatatctgcgctgccacca

SEQ ID NO: 448495 - DNA, 25 bp, Mus musculus
gctgtcacctgctcagctgcgtttg

SEQ ID NO: 448496 - DNA, 25 bp, Mus musculus
gctgtcacgggatgtcaggctgctc

SEQ ID NO: 448497 - DNA, 25 bp, Mus musculus
gctgtcagagcacaccctcagtgaa

SEQ ID NO: 448498 - DNA, 25 bp, Mus musculus
gctgtcagcacaagcaggtggcgca

SEQ ID NO: 448499 - DNA, 25 bp, Mus musculus
gctgtcagcctactatttgtccgga

SEQ ID NO: 448500 - DNA, 25 bp, Mus musculus
gctgtcagcctgtgcagtcttgaca

SEQ ID NO: 448501 - DNA, 25 bp, Mus musculus
gctgtcaggaaagtcagtgcccgtg

SEQ ID NO: 448502 - DNA, 25 bp, Mus musculus
gctgtcagtctcttggtaaatggca

SEQ ID NO: 448503 - DNA, 25 bp, Mus musculus
gctgtccccgggacttagtgctgaa

SEQ ID NO: 448504 - DNA, 25 bp, Mus musculus
gctgtccccttgatcggcaagctcg

SEQ ID NO: 448505 - DNA, 25 bp, Mus musculus
gctgtcccgcatgcaagaggactgg

SEQ ID NO: 448506 - DNA, 25 bp, Mus musculus
gctgtccctccaaagtacatgagtg

SEQ ID NO: 448507 - DNA, 25 bp, Mus musculus
gctgtccctgctaggccatccatgt

SEQ ID NO: 448508 - DNA, 25 bp, Mus musculus
gctgtccctgggatgagatgccctg

SEQ ID NO: 448509 - DNA, 25 bp, Mus musculus
gctgtccgaggaaacctagcgctca

SEQ ID NO: 448510 - DNA, 25 bp, Mus musculus
gctgtccggcctccaatgagtgtga

SEQ ID NO: 448511 - DNA, 25 bp, Mus musculus
gctgtcctcacctgttcctgtaaga

SEQ ID NO: 448512 - DNA, 25 bp, Mus musculus
gctgtcctgggaacatgctggccct

SEQ ID NO: 448513 - DNA, 25 bp, Mus musculus
gctgtcgatgtgtctggaattcaaa

SEQ ID NO: 448514 - DNA, 25 bp, Mus musculus
gctgtcgggagagcaaactacctac

SEQ ID NO: 448515 - DNA, 25 bp, Mus musculus
gctgtcggttcggaacatgtctcca

SEQ ID NO: 448516 - DNA, 25 bp, Mus musculus
gctgtctaattgctcctgaactcca

SEQ ID NO: 448517 - DNA, 25 bp, Mus musculus
gctgtctagttaagggatacttggc

SEQ ID NO: 448518 - DNA, 25 bp, Mus musculus
gctgtctccgcagtgagttgttcca

SEQ ID NO: 448519 - DNA, 25 bp, Mus musculus
gctgtctcggcaactgaagccttca

SEQ ID NO: 448520 - DNA, 25 bp, Mus musculus
gctgtctctaggactgctctccaga

SEQ ID NO: 448521 - DNA, 25 bp, Mus musculus
gctgtctctccactcgctgggtcga

SEQ ID NO: 448522 - DNA, 25 bp, Mus musculus
gctgtctgattcgtgccagtgtgca

SEQ ID NO: 448523 - DNA, 25 bp, Mus musculus
gctgtctgcgcatcaaccatttggg

SEQ ID NO: 448524 - DNA, 25 bp, Mus musculus
gctgtctggatgtctcaagttgtgt

SEQ ID NO: 448525 - DNA, 25 bp, Mus musculus
gctgtctggggcagggaaacttctc

SEQ ID NO: 448526 - DNA, 25 bp, Mus musculus
gctgtctgtgactgatctggcgcga

SEQ ID NO: 448527 - DNA, 25 bp, Mus musculus
gctgtctgtgcaggtatggtttcca

SEQ ID NO: 448528 - DNA, 25 bp, Mus musculus
gctgtcttccctcagatactaaagg

SEQ ID NO: 448529 - DNA, 25 bp, Mus musculus
gctgtcttggtgaatcagttcacaa

SEQ ID NO: 448530 - DNA, 25 bp, Mus musculus
gctgtcttgttttagcatccgtgag

SEQ ID NO: 448531 - DNA, 25 bp, Mus musculus
gctgtctttcttcgctcccttcaat

SEQ ID NO: 448532 - DNA, 25 bp, Mus musculus
gctgtgaaagatctatgttgccaaa

SEQ ID NO: 448533 - DNA, 25 bp, Mus musculus
gctgtgaaagatggagaaaaacgtg

SEQ ID NO: 448534 - DNA, 25 bp, Mus musculus
gctgtgaacaacgtggaggctacct

SEQ ID NO: 448535 - DNA, 25 bp, Mus musculus
gctgtgaacatatccctgggcctgt

SEQ ID NO: 448536 - DNA, 25 bp, Mus musculus
gctgtgaactttggcgctgctggca

SEQ ID NO: 448537 - DNA, 25 bp, Mus musculus
gctgtgacaattaaggtaagaacta

SEQ ID NO: 448538 - DNA, 25 bp, Mus musculus
gctgtgacacactttacctggttga

SEQ ID NO: 448539 - DNA, 25 bp, Mus musculus
gctgtgaccccaagctggaaaagta

SEQ ID NO: 448540 - DNA, 25 bp, Mus musculus
gctgtgacctgcaaccgagaagaaa

SEQ ID NO: 448541 - DNA, 25 bp, Mus musculus
gctgtgagagtgtcgcttcaccgga

SEQ ID NO: 448542 - DNA, 25 bp, Mus musculus
gctgtgaggagctgccatgtgaccc

SEQ ID NO: 448543 - DNA, 25 bp, Mus musculus
gctgtgagtatacaactgcatttgc

SEQ ID NO: 448544 - DNA, 25 bp, Mus musculus
gctgtgatgctggaatccgggccat

SEQ ID NO: 448545 - DNA, 25 bp, Mus musculus
gctgtgatgtatctagtagccactt

SEQ ID NO: 448546 - DNA, 25 bp, Mus musculus
gctgtgcacaaggaggcccagtact

SEQ ID NO: 448547 - DNA, 25 bp, Mus musculus
gctgtgcagatcacccaacatcggg

SEQ ID NO: 448548 - DNA, 25 bp, Mus musculus
gctgtgcagcatgaggtcgaagaat

SEQ ID NO: 448549 - DNA, 25 bp, Mus musculus
gctgtgcatgcaagtggttcctccg

SEQ ID NO: 448550 - DNA, 25 bp, Mus musculus
gctgtgccaaacctgtccaaaatct

SEQ ID NO: 448551 - DNA, 25 bp, Mus musculus
gctgtgccaacatgatactcatgac

SEQ ID NO: 448552 - DNA, 25 bp, Mus musculus
gctgtgccagctatagttgtgttcc

SEQ ID NO: 448553 - DNA, 25 bp, Mus musculus
gctgtgcccacttccttcagagagg

SEQ ID NO: 448554 - DNA, 25 bp, Mus musculus
gctgtgcccggttcgcgatgtttac

SEQ ID NO: 448555 - DNA, 25 bp, Mus musculus
gctgtgcccttaacaaaagccgtga

SEQ ID NO: 448556 - DNA, 25 bp, Mus musculus
gctgtgcgacgctacatgaagaaca

SEQ ID NO: 448557 - DNA, 25 bp, Mus musculus
gctgtgcgagctagagatccggatt

SEQ ID NO: 448558 - DNA, 25 bp, Mus musculus
gctgtgctctttacctacctgggaa

SEQ ID NO: 448559 - DNA, 25 bp, Mus musculus
gctgtgctgaaaaataccatgacca

SEQ ID NO: 448560 - DNA, 25 bp, Mus musculus
gctgtgctggctgctaaaggataaa

SEQ ID NO: 448561 - DNA, 25 bp, Mus musculus
gctgtgctgggaaactcatccattc

SEQ ID NO: 448562 - DNA, 25 bp, Mus musculus
gctgtgcttcagtgttagagactac

SEQ ID NO: 448563 - DNA, 25 bp, Mus musculus
gctgtggaaaagttacggcggcaaa

SEQ ID NO: 448564 - DNA, 25 bp, Mus musculus
gctgtggaacaagacggtgactgcc

SEQ ID NO: 448565 - DNA, 25 bp, Mus musculus
gctgtggaatttacagcatagccca

SEQ ID NO: 448566 - DNA, 25 bp, Mus musculus
gctgtggacgaagactgtagagact

SEQ ID NO: 448567 - DNA, 25 bp, Mus musculus
gctgtggagccaaggatgatgccca

SEQ ID NO: 448568 - DNA, 25 bp, Mus musculus
gctgtggatctagattgctgcgctc

SEQ ID NO: 448569 - DNA, 25 bp, Mus musculus
gctgtggatgtagcctgactgctga

SEQ ID NO: 448570 - DNA, 25 bp, Mus musculus
gctgtggcagcaagcattattggcg

SEQ ID NO: 448571 - DNA, 25 bp, Mus musculus
gctgtggcagccagagttcaaactg

SEQ ID NO: 448572 - DNA, 25 bp, Mus musculus
gctgtggccatcattaaagctctgg

SEQ ID NO: 448573 - DNA, 25 bp, Mus musculus
gctgtggcctcaccggtgctgaata

SEQ ID NO: 448574 - DNA, 25 bp, Mus musculus
gctgtggcgatgaccgatgaccgca

SEQ ID NO: 448575 - DNA, 25 bp, Mus musculus
gctgtggcggtcactatcactgctg

SEQ ID NO: 448576 - DNA, 25 bp, Mus musculus
gctgtggctcacatccaagggcagt

SEQ ID NO: 448577 - DNA, 25 bp, Mus musculus
gctgtgggatgcgagactacctcca

SEQ ID NO: 448578 - DNA, 25 bp, Mus musculus
gctgtgggccgtgccacgcctaaga

SEQ ID NO: 448579 - DNA, 25 bp, Mus musculus
gctgtggtcaaggtctttcctgccc

SEQ ID NO: 448580 - DNA, 25 bp, Mus musculus
gctgtggtccctgggaccccaaata

SEQ ID NO: 448581 - DNA, 25 bp, Mus musculus
gctgtggtgaccattcattcagagg

SEQ ID NO: 448582 - DNA, 25 bp, Mus musculus
gctgtggtgcctccctaagaagtga

SEQ ID NO: 448583 - DNA, 25 bp, Mus musculus
gctgtggttacctgcatgagacttc

SEQ ID NO: 448584 - DNA, 25 bp, Mus musculus
gctgtggttggcctgtactatatac

SEQ ID NO: 448585 - DNA, 25 bp, Mus musculus
gctgtgtaggagctccttgactttg

SEQ ID NO: 448586 - DNA, 25 bp, Mus musculus
gctgtgtcaaactgacagttaatgc

SEQ ID NO: 448587 - DNA, 25 bp, Mus musculus
gctgtgtccaaaatgcccctcaagg

SEQ ID NO: 448588 - DNA, 25 bp, Mus musculus
gctgtgtcccttgtcccaagactga

SEQ ID NO: 448589 - DNA, 25 bp, Mus musculus
gctgtgtctttaatcagtcatttga

SEQ ID NO: 448590 - DNA, 25 bp, Mus musculus
gctgtgtgattcagaagcaacatgt

SEQ ID NO: 448591 - DNA, 25 bp, Mus musculus
gctgtgtgcacttcatgactctaaa

SEQ ID NO: 448592 - DNA, 25 bp, Mus musculus
gctgtgtggatatcaaggacctgcc

SEQ ID NO: 448593 - DNA, 25 bp, Mus musculus
gctgtgttcaccttgctcccatgga

SEQ ID NO: 448594 - DNA, 25 bp, Mus musculus
gctgtgttgtctacgcacgttcacc

SEQ ID NO: 448595 - DNA, 25 bp, Mus musculus
gctgttaacaccttccgagctgtgg

SEQ ID NO: 448596 - DNA, 25 bp, Mus musculus
gctgttaacagctgcatggttcatg

SEQ ID NO: 448597 - DNA, 25 bp, Mus musculus
gctgttaacttaggaggccgcagga

SEQ ID NO: 448598 - DNA, 25 bp, Mus musculus
gctgttaattgccacctttgccata

SEQ ID NO: 448599 - DNA, 25 bp, Mus musculus
gctgttaccagatttgccctctggg

SEQ ID NO: 448600 - DNA, 25 bp, Mus musculus
gctgttactcttctgagcccctgag

SEQ ID NO: 448601 - DNA, 25 bp, Mus musculus
gctgttagataaggtggatcatgac

SEQ ID NO: 448602 - DNA, 25 bp, Mus musculus
gctgttagcccaccgaaaggagcat

SEQ ID NO: 448603 - DNA, 25 bp, Mus musculus
gctgttcaggcatctcttcccatgg

SEQ ID NO: 448604 - DNA, 25 bp, Mus musculus
gctgttccaggtgaacttgggtccc

SEQ ID NO: 448605 - DNA, 25 bp, Mus musculus
gctgttccccaaagaaggtcagagg

SEQ ID NO: 448606 - DNA, 25 bp, Mus musculus
gctgttcccttacctgaagccagtg

SEQ ID NO: 448607 - DNA, 25 bp, Mus musculus
gctgttctctaccagaaactagttg

SEQ ID NO: 448608 - DNA, 25 bp, Mus musculus
gctgttctgaattgcccagcctgta

SEQ ID NO: 448609 - DNA, 25 bp, Mus musculus
gctgttgaacaacctgggcccatct

SEQ ID NO: 448610 - DNA, 25 bp, Mus musculus
gctgttgaagaatgcgtccctggca

SEQ ID NO: 448611 - DNA, 25 bp, Mus musculus
gctgttgaagttgcatctgaaattc

SEQ ID NO: 448612 - DNA, 25 bp, Mus musculus
gctgttgagttatcccaacttaaag

SEQ ID NO: 448613 - DNA, 25 bp, Mus musculus
gctgttgcaggatctgaccactcgg

SEQ ID NO: 448614 - DNA, 25 bp, Mus musculus
gctgttgctcttctacctgattcgg

SEQ ID NO: 448615 - DNA, 25 bp, Mus musculus
gctgttggacaaatgaaacttgagg

SEQ ID NO: 448616 - DNA, 25 bp, Mus musculus
gctgttggcccatgtaggcccagaa

SEQ ID NO: 448617 - DNA, 25 bp, Mus musculus
gctgttggccttaaagacctgggtt

SEQ ID NO: 448618 - DNA, 25 bp, Mus musculus
gctgttggctaagagcaccgtgcag

SEQ ID NO: 448619 - DNA, 25 bp, Mus musculus
gctgttgtacatctccgcggaggac

SEQ ID NO: 448620 - DNA, 25 bp, Mus musculus
gctgttgtgtgaggtaaccccggca

SEQ ID NO: 448621 - DNA, 25 bp, Mus musculus
gctgttgttgattaatcttgctata

SEQ ID NO: 448622 - DNA, 25 bp, Mus musculus
gctgtttaagaatcatgtctttggg

SEQ ID NO: 448623 - DNA, 25 bp, Mus musculus
gctgtttcagggaggagacgacaca

SEQ ID NO: 448624 - DNA, 25 bp, Mus musculus
gctgtttccatagccttgtgggctt

SEQ ID NO: 448625 - DNA, 25 bp, Mus musculus
gctgtttgatcgtctctgcgtgaga

SEQ ID NO: 448626 - DNA, 25 bp, Mus musculus
gctgtttgcaaatcctcctagttcc

SEQ ID NO: 448627 - DNA, 25 bp, Mus musculus
gctgtttgcccctgaaagctttaga

SEQ ID NO: 448628 - DNA, 25 bp, Mus musculus
gctgtttgcttctgggctaaagaga

SEQ ID NO: 448629 - DNA, 25 bp, Mus musculus
gctgtttggttggaggcgcctacac

SEQ ID NO: 448630 - DNA, 25 bp, Mus musculus
gctgttttaatgttaggcatgttgg

SEQ ID NO: 448631 - DNA, 25 bp, Mus musculus
gctgttttcgcctgtcagccatgaa

SEQ ID NO: 448632 - DNA, 25 bp, Mus musculus
gctgttttgggtagttggtgtttca

SEQ ID NO: 448633 - DNA, 25 bp, Mus musculus
gctgtttttattggcagttacccca

SEQ ID NO: 448634 - DNA, 25 bp, Mus musculus
gctgtttttctctatgccttggagg

SEQ ID NO: 448635 - DNA, 25 bp, Mus musculus
gcttaaaacccaccaactgcaatgg

SEQ ID NO: 448636 - DNA, 25 bp, Mus musculus
gcttaaaagccgagtcctctgatgg

SEQ ID NO: 448637 - DNA, 25 bp, Mus musculus
gcttaaaatctgagtcaaatttgcc

SEQ ID NO: 448638 - DNA, 25 bp, Mus musculus
gcttaaacacatggtgggttccgga

SEQ ID NO: 448639 - DNA, 25 bp, Mus musculus
gcttaaacagcttgaaacagagcag

SEQ ID NO: 448640 - DNA, 25 bp, Mus musculus
gcttaaacctcggacagtggcaacg

SEQ ID NO: 448641 - DNA, 25 bp, Mus musculus
gcttaaactggctgcagaacggctc

SEQ ID NO: 448642 - DNA, 25 bp, Mus musculus
gcttaaagagcataagctgacgtca

SEQ ID NO: 448643 - DNA, 25 bp, Mus musculus
gcttaaatcaagtgaccggaccgga

SEQ ID NO: 448644 - DNA, 25 bp, Mus musculus
gcttaaccgattagcccacatcaga

SEQ ID NO: 448645 - DNA, 25 bp, Mus musculus
gcttaacgatgtagataccttctga

SEQ ID NO: 448646 - DNA, 25 bp, Mus musculus
gcttaactctaacccgaactcttgg

SEQ ID NO: 448647 - DNA, 25 bp, Mus musculus
gcttaagcaaagaagggcagtggtc

SEQ ID NO: 448648 - DNA, 25 bp, Mus musculus
gcttaagccaggagatgagtagaaa

SEQ ID NO: 448649 - DNA, 25 bp, Mus musculus
gcttaaggagaggagaaaccacatc

SEQ ID NO: 448650 - DNA, 25 bp, Mus musculus
gcttaaggatagtcataagctctga

SEQ ID NO: 448651 - DNA, 25 bp, Mus musculus
gcttaattctgtgcgcggtggctcc

SEQ ID NO: 448652 - DNA, 25 bp, Mus musculus
gcttaatttggagtaggaaggccta

SEQ ID NO: 448653 - DNA, 25 bp, Mus musculus
gcttacacttggctgcgattgcatc

SEQ ID NO: 448654 - DNA, 25 bp, Mus musculus
gcttacagagttgccagtgtcccca

SEQ ID NO: 448655 - DNA, 25 bp, Mus musculus
gcttacaggcagaactagacgacgt

SEQ ID NO: 448656 - DNA, 25 bp, Mus musculus
gcttacaggcgttttctaggaacct

SEQ ID NO: 448657 - DNA, 25 bp, Mus musculus
gcttacagtcagagcagtagggaga

SEQ ID NO: 448658 - DNA, 25 bp, Mus musculus
gcttacatcatggtaagaggtttga

SEQ ID NO: 448659 - DNA, 25 bp, Mus musculus
gcttaccagataatgctactttatt

SEQ ID NO: 448660 - DNA, 25 bp, Mus musculus
gcttaccatagagacttgtgccacc

SEQ ID NO: 448661 - DNA, 25 bp, Mus musculus
gcttaccctgaaccaaccgtatgtg

SEQ ID NO: 448662 - DNA, 25 bp, Mus musculus
gcttaccggcctgtggacaagagtt

SEQ ID NO: 448663 - DNA, 25 bp, Mus musculus
gcttacctgtctccagagcgctggg

SEQ ID NO: 448664 - DNA, 25 bp, Mus musculus
gcttacgatgtgagcgcttacccac

SEQ ID NO: 448665 - DNA, 25 bp, Mus musculus
gcttacgcgacacagcttgtttgga

SEQ ID NO: 448666 - DNA, 25 bp, Mus musculus
gcttactactgaaatatgtgcccta

SEQ ID NO: 448667 - DNA, 25 bp, Mus musculus
gcttactcagtatagaaaggatggg

SEQ ID NO: 448668 - DNA, 25 bp, Mus musculus
gcttactctctagtccttcacaaga

SEQ ID NO: 448669 - DNA, 25 bp, Mus musculus
gcttactctgactttatctgccttc

SEQ ID NO: 448670 - DNA, 25 bp, Mus musculus
gcttacttgccagaaagagctgcga

SEQ ID NO: 448671 - DNA, 25 bp, Mus musculus
gcttagaaccattgatttagaggct

SEQ ID NO: 448672 - DNA, 25 bp, Mus musculus
gcttagactccagccaacagtgagg

SEQ ID NO: 448673 - DNA, 25 bp, Mus musculus
gcttagagaatgttccaggcctgaa

SEQ ID NO: 448674 - DNA, 25 bp, Mus musculus
gcttagagacagcaagaggcactgc

SEQ ID NO: 448675 - DNA, 25 bp, Mus musculus
gcttagagacatgggcttacaggag

SEQ ID NO: 448676 - DNA, 25 bp, Mus musculus
gcttagagtggtgtggtctgttcca

SEQ ID NO: 448677 - DNA, 25 bp, Mus musculus
gcttagatcattccagcgtgccgga

SEQ ID NO: 448678 - DNA, 25 bp, Mus musculus
gcttagatggcaatgaccgaccgga

SEQ ID NO: 448679 - DNA, 25 bp, Mus musculus
gcttagcaggcaaggctatagctcc

SEQ ID NO: 448680 - DNA, 25 bp, Mus musculus
gcttagccgcgaacacagatttggt

SEQ ID NO: 448681 - DNA, 25 bp, Mus musculus
gcttagcctgaggtgcgtctctgca

SEQ ID NO: 448682 - DNA, 25 bp, Mus musculus
gcttagctaagaatgagaggcatga

SEQ ID NO: 448683 - DNA, 25 bp, Mus musculus
gcttagctccaaacccgggaactca

SEQ ID NO: 448684 - DNA, 25 bp, Mus musculus
gcttagctgccttgagtcccttcga

SEQ ID NO: 448685 - DNA, 25 bp, Mus musculus
gcttaggacctgtacatgctactaa

SEQ ID NO: 448686 - DNA, 25 bp, Mus musculus
gcttaggcacagtggtctactggca

SEQ ID NO: 448687 - DNA, 25 bp, Mus musculus
gcttaggccttcttgcaaatcaaag

SEQ ID NO: 448688 - DNA, 25 bp, Mus musculus
gcttagggcccacgagaatgagact

SEQ ID NO: 448689 - DNA, 25 bp, Mus musculus
gcttaggtggttggctatccctgag

SEQ ID NO: 448690 - DNA, 25 bp, Mus musculus
gcttagtatgcctgacgatctcgta

SEQ ID NO: 448691 - DNA, 25 bp, Mus musculus
gcttagtgataataccctggtgccg

SEQ ID NO: 448692 - DNA, 25 bp, Mus musculus
gcttagttattacgccgcagaccct

SEQ ID NO: 448693 - DNA, 25 bp, Mus musculus
gcttagttgtatccgcacgctgccc

SEQ ID NO: 448694 - DNA, 25 bp, Mus musculus
gcttagtttagctgccccttgggat

SEQ ID NO: 448695 - DNA, 25 bp, Mus musculus
gcttataaaaccacaatggcatgat

SEQ ID NO: 448696 - DNA, 25 bp, Mus musculus
gcttatcaacaacgagctctctcac

SEQ ID NO: 448697 - DNA, 25 bp, Mus musculus
gcttatcagtggaatgaagtttctc

SEQ ID NO: 448698 - DNA, 25 bp, Mus musculus
gcttatccgcctacagcctgatggg

SEQ ID NO: 448699 - DNA, 25 bp, Mus musculus
gcttatctgcatggagcccaggatg

SEQ ID NO: 448700 - DNA, 25 bp, Mus musculus
gcttatgacaggtgagcagccccaa

SEQ ID NO: 448701 - DNA, 25 bp, Mus musculus
gcttatgcacagtacagccttagga

SEQ ID NO: 448702 - DNA, 25 bp, Mus musculus
gcttattaagaaaggcacagttgat

SEQ ID NO: 448703 - DNA, 25 bp, Mus musculus
gcttattcaagtccaaggttaccag

SEQ ID NO: 448704 - DNA, 25 bp, Mus musculus
gcttattcgattttaaaagaagaca

SEQ ID NO: 448705 - DNA, 25 bp, Mus musculus
gcttattggaagaggacgatcgatc

SEQ ID NO: 448706 - DNA, 25 bp, Mus musculus
gcttattggccacccggagatgtcg

SEQ ID NO: 448707 - DNA, 25 bp, Mus musculus
gcttattggcgcaagaacctttgga

SEQ ID NO: 448708 - DNA, 25 bp, Mus musculus
gcttatttaacaaaagagagcatgg

SEQ ID NO: 448709 - DNA, 25 bp, Mus musculus
gcttatttcacctcaaaggccttgg

SEQ ID NO: 448710 - DNA, 25 bp, Mus musculus
gcttatttcataggtgttatttcca

SEQ ID NO: 448711 - DNA, 25 bp, Mus musculus
gcttatttgccctgccttgacccaa

SEQ ID NO: 448712 - DNA, 25 bp, Mus musculus
gcttcaaaaagcttcatgggcgatc

SEQ ID NO: 448713 - DNA, 25 bp, Mus musculus
gcttcaaaatggtgaaccggctcaa

SEQ ID NO: 448714 - DNA, 25 bp, Mus musculus
gcttcaaaatttatagggtcctagc

SEQ ID NO: 448715 - DNA, 25 bp, Mus musculus
gcttcaaagcatggagatggcacac

SEQ ID NO: 448716 - DNA, 25 bp, Mus musculus
gcttcaaatcagagccgtgggctac

SEQ ID NO: 448717 - DNA, 25 bp, Mus musculus
gcttcaacctttagctgctgcccta

SEQ ID NO: 448718 - DNA, 25 bp, Mus musculus
gcttcaacttaacctgtagccaagg

SEQ ID NO: 448719 - DNA, 25 bp, Mus musculus
gcttcaagaagctacagtaccatag

SEQ ID NO: 448720 - DNA, 25 bp, Mus musculus
gcttcaagaaggctcaaggtgccag

SEQ ID NO: 448721 - DNA, 25 bp, Mus musculus
gcttcaaggctctatagctctagat

SEQ ID NO: 448722 - DNA, 25 bp, Mus musculus
gcttcaaggtgctcaagtcagacca

SEQ ID NO: 448723 - DNA, 25 bp, Mus musculus
gcttcaaggttacaggatggcccga

SEQ ID NO: 448724 - DNA, 25 bp, Mus musculus
gcttcaataaggagcaaggtcgctt

SEQ ID NO: 448725 - DNA, 25 bp, Mus musculus
gcttcaatcccagttgttaaagcca

SEQ ID NO: 448726 - DNA, 25 bp, Mus musculus
gcttcaatgaaatggaggccccaac

SEQ ID NO: 448727 - DNA, 25 bp, Mus musculus
gcttcacagagtggacaggatgcca

SEQ ID NO: 448728 - DNA, 25 bp, Mus musculus
gcttcacatttcttggttgacctgg

SEQ ID NO: 448729 - DNA, 25 bp, Mus musculus
gcttcaccctgccttttcgtggctg

SEQ ID NO: 448730 - DNA, 25 bp, Mus musculus
gcttcaccctttgtcattctaagag

SEQ ID NO: 448731 - DNA, 25 bp, Mus musculus
gcttcacgcgaagcccggaatttct

SEQ ID NO: 448732 - DNA, 25 bp, Mus musculus
gcttcactatcagttaccccagatg

SEQ ID NO: 448733 - DNA, 25 bp, Mus musculus
gcttcactggaaaaacggcttactg

SEQ ID NO: 448734 - DNA, 25 bp, Mus musculus
gcttcactgggctgcaatacctgcg

SEQ ID NO: 448735 - DNA, 25 bp, Mus musculus
gcttcacttaccaaatgctgtcacg

SEQ ID NO: 448736 - DNA, 25 bp, Mus musculus
gcttcacttgtaaggagcctcctcg

SEQ ID NO: 448737 - DNA, 25 bp, Mus musculus
gcttcagaaagtatcaggtaaccag

SEQ ID NO: 448738 - DNA, 25 bp, Mus musculus
gcttcagacactgtggtcacacagg

SEQ ID NO: 448739 - DNA, 25 bp, Mus musculus
gcttcagactcagacataacctttc

SEQ ID NO: 448740 - DNA, 25 bp, Mus musculus
gcttcagagcctgagtatgggactc

SEQ ID NO: 448741 - DNA, 25 bp, Mus musculus
gcttcagagcctgggagttttatta

SEQ ID NO: 448742 - DNA, 25 bp, Mus musculus
gcttcagagcttgggtgacatcagt

SEQ ID NO: 448743 - DNA, 25 bp, Mus musculus
gcttcagaggaaaaggtacggacca

SEQ ID NO: 448744 - DNA, 25 bp, Mus musculus
gcttcagagggtgaatgtccagcct

SEQ ID NO: 448745 - DNA, 25 bp, Mus musculus
gcttcagatacgatgcactcaggca

SEQ ID NO: 448746 - DNA, 25 bp, Mus musculus
gcttcagatcggaggtgtatgtgca

SEQ ID NO: 448747 - DNA, 25 bp, Mus musculus
gcttcagcaatatttccgcggccaa

SEQ ID NO: 448748 - DNA, 25 bp, Mus musculus
gcttcagcatagtcgcagaatccaa

SEQ ID NO: 448749 - DNA, 25 bp, Mus musculus
gcttcagcgaccacgagctggtgca

SEQ ID NO: 448750 - DNA, 25 bp, Mus musculus
gcttcagcggcatgacagtccttca

SEQ ID NO: 448751 - DNA, 25 bp, Mus musculus
gcttcagcgggcagcagtttcatcg

SEQ ID NO: 448752 - DNA, 25 bp, Mus musculus
gcttcagctttcagcctgctggtta

SEQ ID NO: 448753 - DNA, 25 bp, Mus musculus
gcttcaggaagctctcagatgcaca

SEQ ID NO: 448754 - DNA, 25 bp, Mus musculus
gcttcaggatgagagagccgctgtc

SEQ ID NO: 448755 - DNA, 25 bp, Mus musculus
gcttcaggcaggcagtatcactcat

SEQ ID NO: 448756 - DNA, 25 bp, Mus musculus
gcttcaggcatcctatagaagaaga

SEQ ID NO: 448757 - DNA, 25 bp, Mus musculus
gcttcaggcatcttctaccggccag

SEQ ID NO: 448758 - DNA, 25 bp, Mus musculus
gcttcaggcctagctttaaaactct

SEQ ID NO: 448759 - DNA, 25 bp, Mus musculus
gcttcagggtcagagaccagaagta

SEQ ID NO: 448760 - DNA, 25 bp, Mus musculus
gcttcagtaaatcacggcatatgga

SEQ ID NO: 448761 - DNA, 25 bp, Mus musculus
gcttcagtaagatgccccacgtgca

SEQ ID NO: 448762 - DNA, 25 bp, Mus musculus
gcttcagtcaccctgcacttggagg

SEQ ID NO: 448763 - DNA, 25 bp, Mus musculus
gcttcagtcctagggaagtatctct

SEQ ID NO: 448764 - DNA, 25 bp, Mus musculus
gcttcagtgacttcgaggtgcggca

SEQ ID NO: 448765 - DNA, 25 bp, Mus musculus
gcttcataaagacaaggtactccct

SEQ ID NO: 448766 - DNA, 25 bp, Mus musculus
gcttcataagatacccatgtgactg

SEQ ID NO: 448767 - DNA, 25 bp, Mus musculus
gcttcataatgcttgattgattcca

SEQ ID NO: 448768 - DNA, 25 bp, Mus musculus
gcttcatactaaacaagggcctggt

SEQ ID NO: 448769 - DNA, 25 bp, Mus musculus
gcttcatccgctggctcaacaagga

SEQ ID NO: 448770 - DNA, 25 bp, Mus musculus
gcttcatccggtatggctggcgctg

SEQ ID NO: 448771 - DNA, 25 bp, Mus musculus
gcttcatcgaagagaaggcacttct

SEQ ID NO: 448772 - DNA, 25 bp, Mus musculus
gcttcatctagggtgtttatctctg

SEQ ID NO: 448773 - DNA, 25 bp, Mus musculus
gcttcatctgcgatcctgacgacga

SEQ ID NO: 448774 - DNA, 25 bp, Mus musculus
gcttcatgaggctccttattcagta

SEQ ID NO: 448775 - DNA, 25 bp, Mus musculus
gcttcatggcctgactggttccttg

SEQ ID NO: 448776 - DNA, 25 bp, Mus musculus
gcttcatggtgctaaaatgtgtgac

SEQ ID NO: 448777 - DNA, 25 bp, Mus musculus
gcttcattgagattgcctctgggat

SEQ ID NO: 448778 - DNA, 25 bp, Mus musculus
gcttcatttgcatacagcaagtgtt

SEQ ID NO: 448779 - DNA, 25 bp, Mus musculus
gcttcatttttagtatgagacaacc

SEQ ID NO: 448780 - DNA, 25 bp, Mus musculus
gcttccacaaccagtcggagctcaa

SEQ ID NO: 448781 - DNA, 25 bp, Mus musculus
gcttccacatatacacggatacact

SEQ ID NO: 448782 - DNA, 25 bp, Mus musculus
gcttccagacgcagatgacgacgcg

SEQ ID NO: 448783 - DNA, 25 bp, Mus musculus
gcttccagatgatgcaatgctgtct

SEQ ID NO: 448784 - DNA, 25 bp, Mus musculus
gcttccagatgcatactgagtggga

SEQ ID NO: 448785 - DNA, 25 bp, Mus musculus
gcttccagcagcagtaactcggtct

SEQ ID NO: 448786 - DNA, 25 bp, Mus musculus
gcttccagctgatgtgaagttttac

SEQ ID NO: 448787 - DNA, 25 bp, Mus musculus
gcttccaggaaaactatgcaggcat

SEQ ID NO: 448788 - DNA, 25 bp, Mus musculus
gcttccagggccacatctgagttgg

SEQ ID NO: 448789 - DNA, 25 bp, Mus musculus
gcttccatacacagtgagcaaaagt

SEQ ID NO: 448790 - DNA, 25 bp, Mus musculus
gcttccatggccaatctaagagcag

SEQ ID NO: 448791 - DNA, 25 bp, Mus musculus
gcttccatgggcttgaattgtgtgt

SEQ ID NO: 448792 - DNA, 25 bp, Mus musculus
gcttcccaacaaggaaaggctcata

SEQ ID NO: 448793 - DNA, 25 bp, Mus musculus
gcttcccacgagagctgcagacatt

SEQ ID NO: 448794 - DNA, 25 bp, Mus musculus
gcttcccagcctcgcatggtttgga

SEQ ID NO: 448795 - DNA, 25 bp, Mus musculus
gcttcccaggccgaaaagagttggt

SEQ ID NO: 448796 - DNA, 25 bp, Mus musculus
gcttccccgaagaatggactccatg

SEQ ID NO: 448797 - DNA, 25 bp, Mus musculus
gcttccccttctgctgagctttaaa

SEQ ID NO: 448798 - DNA, 25 bp, Mus musculus
gcttcccggacatcattggtgccca

SEQ ID NO: 448799 - DNA, 25 bp, Mus musculus
gcttcccggcattttcctctttgga

SEQ ID NO: 448800 - DNA, 25 bp, Mus musculus
gcttccctgcagattgagcctctga

SEQ ID NO: 448801 - DNA, 25 bp, Mus musculus
gcttccctgtcattgcttgctctag

SEQ ID NO: 448802 - DNA, 25 bp, Mus musculus
gcttccctgttcttgttctctagat

SEQ ID NO: 448803 - DNA, 25 bp, Mus musculus
gcttccctttggtaaagagcagtga

SEQ ID NO: 448804 - DNA, 25 bp, Mus musculus
gcttccgagcacagcatggcggtca

SEQ ID NO: 448805 - DNA, 25 bp, Mus musculus
gcttccgagtcagcaagggagctca

SEQ ID NO: 448806 - DNA, 25 bp, Mus musculus
gcttccggggctgtctgttgactct

SEQ ID NO: 448807 - DNA, 25 bp, Mus musculus
gcttccgggtaaatgcagaactcca

SEQ ID NO: 448808 - DNA, 25 bp, Mus musculus
gcttccgtgactatagggctgtaga

SEQ ID NO: 448809 - DNA, 25 bp, Mus musculus
gcttccgtgagaagaccggagcgct

SEQ ID NO: 448810 - DNA, 25 bp, Mus musculus
gcttccgtggaatgaggctcaggct

SEQ ID NO: 448811 - DNA, 25 bp, Mus musculus
gcttccgtggcttctacaagggcac

SEQ ID NO: 448812 - DNA, 25 bp, Mus musculus
gcttcctaacctgtaaaaatggaga

SEQ ID NO: 448813 - DNA, 25 bp, Mus musculus
gcttcctagagcaacaaaaccaggt

SEQ ID NO: 448814 - DNA, 25 bp, Mus musculus
gcttcctaggcaacagcgtggctat

SEQ ID NO: 448815 - DNA, 25 bp, Mus musculus
gcttcctcggtcaaataaaatcgtg

SEQ ID NO: 448816 - DNA, 25 bp, Mus musculus
gcttcctgagtttggccaattggca

SEQ ID NO: 448817 - DNA, 25 bp, Mus musculus
gcttcctgatttcaatgcactagac

SEQ ID NO: 448818 - DNA, 25 bp, Mus musculus
gcttcctgcagaactataggcttgg

SEQ ID NO: 448819 - DNA, 25 bp, Mus musculus
gcttcctggaagaacgaccttgacc

SEQ ID NO: 448820 - DNA, 25 bp, Mus musculus
gcttccttggaacggtcactgcaaa

SEQ ID NO: 448821 - DNA, 25 bp, Mus musculus
gcttcctttggaagttcgagcccag

SEQ ID NO: 448822 - DNA, 25 bp, Mus musculus
gcttcgagagtatgaggcggcacta

SEQ ID NO: 448823 - DNA, 25 bp, Mus musculus
gcttcgagcccaacctagacgtgga

SEQ ID NO: 448824 - DNA, 25 bp, Mus musculus
gcttcgagccggagaaacccttgtt

SEQ ID NO: 448825 - DNA, 25 bp, Mus musculus
gcttcgaggatccttctaactagaa

SEQ ID NO: 448826 - DNA, 25 bp, Mus musculus
gcttcgagtgtgtcatggccagctc

SEQ ID NO: 448827 - DNA, 25 bp, Mus musculus
gcttcgccatggtgagctcgggcct

SEQ ID NO: 448828 - DNA, 25 bp, Mus musculus
gcttcgctaagaccctgatgatgga

SEQ ID NO: 448829 - DNA, 25 bp, Mus musculus
gcttcgctccgaagaccgggtcaaa

SEQ ID NO: 448830 - DNA, 25 bp, Mus musculus
gcttcggcaagaccgaaacccatca

SEQ ID NO: 448831 - DNA, 25 bp, Mus musculus
gcttcggctttattctcacagacta

SEQ ID NO: 448832 - DNA, 25 bp, Mus musculus
gcttcgggctggaggacattcctga

SEQ ID NO: 448833 - DNA, 25 bp, Mus musculus
gcttcgggtgtttccgcagccttgc

SEQ ID NO: 448834 - DNA, 25 bp, Mus musculus
gcttcggtcactgctaggacttcta

SEQ ID NO: 448835 - DNA, 25 bp, Mus musculus
gcttcggtcgtatctatgatcctga

SEQ ID NO: 448836 - DNA, 25 bp, Mus musculus
gcttcgtgaacataaccgcgtgtgc

SEQ ID NO: 448837 - DNA, 25 bp, Mus musculus
gcttcgtgggcctcaatagcctgga

SEQ ID NO: 448838 - DNA, 25 bp, Mus musculus
gcttcgtgtcccgagagttctgtcg

SEQ ID NO: 448839 - DNA, 25 bp, Mus musculus
gcttctaaacctactggtcccagag

SEQ ID NO: 448840 - DNA, 25 bp, Mus musculus
gcttctaaagaagcgcctctgctgc

SEQ ID NO: 448841 - DNA, 25 bp, Mus musculus
gcttctaaagtcagagggccttctc

SEQ ID NO: 448842 - DNA, 25 bp, Mus musculus
gcttctaatccttatactcaggagg

SEQ ID NO: 448843 - DNA, 25 bp, Mus musculus
gcttctaatgccatcgggaccagca

SEQ ID NO: 448844 - DNA, 25 bp, Mus musculus
gcttctacaagagccataggtgtgc

SEQ ID NO: 448845 - DNA, 25 bp, Mus musculus
gcttctactggaaaggaaccctctg

SEQ ID NO: 448846 - DNA, 25 bp, Mus musculus
gcttctatagaagtgtaagatgcac

SEQ ID NO: 448847 - DNA, 25 bp, Mus musculus
gcttctatcggaatgcccagggcaa

SEQ ID NO: 448848 - DNA, 25 bp, Mus musculus
gcttctcagaagcatggttgggctc

SEQ ID NO: 448849 - DNA, 25 bp, Mus musculus
gcttctcatgttgtatctgtagagg

SEQ ID NO: 448850 - DNA, 25 bp, Mus musculus
gcttctccccaaagttaggcgtctg

SEQ ID NO: 448851 - DNA, 25 bp, Mus musculus
gcttctcgagaggaactgcgcaacg

SEQ ID NO: 448852 - DNA, 25 bp, Mus musculus
gcttctctcaggaaaatgaggctga

SEQ ID NO: 448853 - DNA, 25 bp, Mus musculus
gcttctctggagatttgagaacgaa

SEQ ID NO: 448854 - DNA, 25 bp, Mus musculus
gcttctcttgctgagtgagggccca

SEQ ID NO: 448855 - DNA, 25 bp, Mus musculus
gcttctctttgagtcaccacagaaa

SEQ ID NO: 448856 - DNA, 25 bp, Mus musculus
gcttctcttttgtagaaatctgacg

SEQ ID NO: 448857 - DNA, 25 bp, Mus musculus
gcttctgaacttaggtctcaggttg

SEQ ID NO: 448858 - DNA, 25 bp, Mus musculus
gcttctgaagaaggacacctggcgg

SEQ ID NO: 448859 - DNA, 25 bp, Mus musculus
gcttctgacccatgccctattattt

SEQ ID NO: 448860 - DNA, 25 bp, Mus musculus
gcttctgaggttttggcatgctttc

SEQ ID NO: 448861 - DNA, 25 bp, Mus musculus
gcttctgagtaagacagcacccggg

SEQ ID NO: 448862 - DNA, 25 bp, Mus musculus
gcttctgagtcatcacatgtacctg

SEQ ID NO: 448863 - DNA, 25 bp, Mus musculus
gcttctgatggacattcacgtggca

SEQ ID NO: 448864 - DNA, 25 bp, Mus musculus
gcttctgcaaaaggtaaggtttctg

SEQ ID NO: 448865 - DNA, 25 bp, Mus musculus
gcttctgcgctctgcctgctatgga

SEQ ID NO: 448866 - DNA, 25 bp, Mus musculus
gcttctggagcgatcgcgtccctgt

SEQ ID NO: 448867 - DNA, 25 bp, Mus musculus
gcttctggagcggtcatctttaact

SEQ ID NO: 448868 - DNA, 25 bp, Mus musculus
gcttctggataaatatgaggctgca

SEQ ID NO: 448869 - DNA, 25 bp, Mus musculus
gcttctggcagttgcatgatcttgc

SEQ ID NO: 448870 - DNA, 25 bp, Mus musculus
gcttctggccatgcatttgtttata

SEQ ID NO: 448871 - DNA, 25 bp, Mus musculus
gcttctgggagggacatctgctgcc

SEQ ID NO: 448872 - DNA, 25 bp, Mus musculus
gcttctgggaggtcctctggagtct

SEQ ID NO: 448873 - DNA, 25 bp, Mus musculus
gcttctgggctatgaccgctgcgat

SEQ ID NO: 448874 - DNA, 25 bp, Mus musculus
gcttctgggcttcatgttggtcaca

SEQ ID NO: 448875 - DNA, 25 bp, Mus musculus
gcttctggtccactctcttgagagc

SEQ ID NO: 448876 - DNA, 25 bp, Mus musculus
gcttctgtaggacccgaggaacact

SEQ ID NO: 448877 - DNA, 25 bp, Mus musculus
gcttctgtatggcagaggtcacacc

SEQ ID NO: 448878 - DNA, 25 bp, Mus musculus
gcttctgtcaaaacgacggagtcag

SEQ ID NO: 448879 - DNA, 25 bp, Mus musculus
gcttctgtggtttgaaaaagttgtg

SEQ ID NO: 448880 - DNA, 25 bp, Mus musculus
gcttctgtttcagagatgcccgtgt

SEQ ID NO: 448881 - DNA, 25 bp, Mus musculus
gcttcttaaggaggcagcacgacac

SEQ ID NO: 448882 - DNA, 25 bp, Mus musculus
gcttcttacgcactaaagcacttca

SEQ ID NO: 448883 - DNA, 25 bp, Mus musculus
gcttcttcaaccctacttctgtctg

SEQ ID NO: 448884 - DNA, 25 bp, Mus musculus
gcttcttcaagttcctcaccgagga

SEQ ID NO: 448885 - DNA, 25 bp, Mus musculus
gcttcttcccagaagtcacggatag

SEQ ID NO: 448886 - DNA, 25 bp, Mus musculus
gcttcttcggagactgcgtgactca

SEQ ID NO: 448887 - DNA, 25 bp, Mus musculus
gcttcttgacagaggatgagcgcct

SEQ ID NO: 448888 - DNA, 25 bp, Mus musculus
gcttcttgcaaaacacagtcgctgg

SEQ ID NO: 448889 - DNA, 25 bp, Mus musculus
gcttcttgcaggaaggcgacctcat

SEQ ID NO: 448890 - DNA, 25 bp, Mus musculus
gcttcttggtatattctgaggttct

SEQ ID NO: 448891 - DNA, 25 bp, Mus musculus
gcttcttgttgtgtacccatggacc

SEQ ID NO: 448892 - DNA, 25 bp, Mus musculus
gcttctttaaagatccatggccaag

SEQ ID NO: 448893 - DNA, 25 bp, Mus musculus
gcttctttaagagggcgccgtgacc

SEQ ID NO: 448894 - DNA, 25 bp, Mus musculus
gcttctttacggctaagaccacctt

SEQ ID NO: 448895 - DNA, 25 bp, Mus musculus
gcttctttgggtgcgggagagactt

SEQ ID NO: 448896 - DNA, 25 bp, Mus musculus
gcttcttttgtatagactaaaccca

SEQ ID NO: 448897 - DNA, 25 bp, Mus musculus
gcttgaaaaagctccctagtctaga

SEQ ID NO: 448898 - DNA, 25 bp, Mus musculus
gcttgaaaacttcaagaacagtcta

SEQ ID NO: 448899 - DNA, 25 bp, Mus musculus
gcttgaaaagatcagtaggccatca

SEQ ID NO: 448900 - DNA, 25 bp, Mus musculus
gcttgaacaactccccggtgaatgg

SEQ ID NO: 448901 - DNA, 25 bp, Mus musculus
gcttgaacaagagcacaggcgtgta

SEQ ID NO: 448902 - DNA, 25 bp, Mus musculus
gcttgaacttcaattgggacggcca

SEQ ID NO: 448903 - DNA, 25 bp, Mus musculus
gcttgaagacgaagacccagatcct

SEQ ID NO: 448904 - DNA, 25 bp, Mus musculus
gcttgaagcctagacaacagcaccg

SEQ ID NO: 448905 - DNA, 25 bp, Mus musculus
gcttgaagcctatgagcccgtgtgt

SEQ ID NO: 448906 - DNA, 25 bp, Mus musculus
gcttgaagcctctggaaaacaccca

SEQ ID NO: 448907 - DNA, 25 bp, Mus musculus
gcttgaaggagaaagcaggtttaca

SEQ ID NO: 448908 - DNA, 25 bp, Mus musculus
gcttgaaggctttgctgccgggaca

SEQ ID NO: 448909 - DNA, 25 bp, Mus musculus
gcttgaaggtgttgccctcagggcc

SEQ ID NO: 448910 - DNA, 25 bp, Mus musculus
gcttgaagttaaggaggccacgcca

SEQ ID NO: 448911 - DNA, 25 bp, Mus musculus
gcttgaatcttcagagtggcggtag

SEQ ID NO: 448912 - DNA, 25 bp, Mus musculus
gcttgaatggaccaaacgtgagaac

SEQ ID NO: 448913 - DNA, 25 bp, Mus musculus
gcttgacaagaacgaaaggacgcct

SEQ ID NO: 448914 - DNA, 25 bp, Mus musculus
gcttgacaagttccgcactgcgtgg

SEQ ID NO: 448915 - DNA, 25 bp, Mus musculus
gcttgacacctttgagactcccacg

SEQ ID NO: 448916 - DNA, 25 bp, Mus musculus
gcttgacactcatctgctgttacca

SEQ ID NO: 448917 - DNA, 25 bp, Mus musculus
gcttgacagtgctcaggccatcttc

SEQ ID NO: 448918 - DNA, 25 bp, Mus musculus
gcttgacagtgtgcggaaaacctcc

SEQ ID NO: 448919 - DNA, 25 bp, Mus musculus
gcttgaccactccagaatgcttgat

SEQ ID NO: 448920 - DNA, 25 bp, Mus musculus
gcttgacccggcacatcaataagtg

SEQ ID NO: 448921 - DNA, 25 bp, Mus musculus
gcttgagcaacctgcaaaacatcga

SEQ ID NO: 448922 - DNA, 25 bp, Mus musculus
gcttgagcccagagactgtcagacc

SEQ ID NO: 448923 - DNA, 25 bp, Mus musculus
gcttgagccccgtcactaaggtgga

SEQ ID NO: 448924 - DNA, 25 bp, Mus musculus
gcttgagcctcttcaaggcttccaa

SEQ ID NO: 448925 - DNA, 25 bp, Mus musculus
gcttgagctttcctggcacctgtag

SEQ ID NO: 448926 - DNA, 25 bp, Mus musculus
gcttgagggcgaagtggaaaggcct

SEQ ID NO: 448927 - DNA, 25 bp, Mus musculus
gcttgagtacctagggaaggcctct

SEQ ID NO: 448928 - DNA, 25 bp, Mus musculus
gcttgataatgaacgctgtgctggg

SEQ ID NO: 448929 - DNA, 25 bp, Mus musculus
gcttgatactgactgccttggatgg

SEQ ID NO: 448930 - DNA, 25 bp, Mus musculus
gcttgatccaggtatttatctgagg

SEQ ID NO: 448931 - DNA, 25 bp, Mus musculus
gcttgatgccaacacacagaggaga

SEQ ID NO: 448932 - DNA, 25 bp, Mus musculus
gcttgatggccactgtaaccgacat

SEQ ID NO: 448933 - DNA, 25 bp, Mus musculus
gcttgatgtccaggttgtcagcgca

SEQ ID NO: 448934 - DNA, 25 bp, Mus musculus
gcttgattcgaacggagagaccacc

SEQ ID NO: 448935 - DNA, 25 bp, Mus musculus
gcttgatttaacatagggattccat

SEQ ID NO: 448936 - DNA, 25 bp, Mus musculus
gcttgcaaaagctataaccacgtgg

SEQ ID NO: 448937 - DNA, 25 bp, Mus musculus
gcttgcaagctaaaggaaggccact

SEQ ID NO: 448938 - DNA, 25 bp, Mus musculus
gcttgcaggagaagctgaataattc

SEQ ID NO: 448939 - DNA, 25 bp, Mus musculus
gcttgcaggatacagaaagatcacc

SEQ ID NO: 448940 - DNA, 25 bp, Mus musculus
gcttgcaggctgtgcccgaaactgg

SEQ ID NO: 448941 - DNA, 25 bp, Mus musculus
gcttgcagtggttagatgccccata

SEQ ID NO: 448942 - DNA, 25 bp, Mus musculus
gcttgcatctcctgttatacccaga

SEQ ID NO: 448943 - DNA, 25 bp, Mus musculus
gcttgcattgttcattaggatagcc

SEQ ID NO: 448944 - DNA, 25 bp, Mus musculus
gcttgccagatgaaaaaccagactc

SEQ ID NO: 448945 - DNA, 25 bp, Mus musculus
gcttgccagccgagtaagacttact

SEQ ID NO: 448946 - DNA, 25 bp, Mus musculus
gcttgcccaagatcccgcagcttta

SEQ ID NO: 448947 - DNA, 25 bp, Mus musculus
gcttgcccacacaggtctgacagga

SEQ ID NO: 448948 - DNA, 25 bp, Mus musculus
gcttgcctagcagagaacgcctatg

SEQ ID NO: 448949 - DNA, 25 bp, Mus musculus
gcttgcctcgcacatgatcttctgg

SEQ ID NO: 448950 - DNA, 25 bp, Mus musculus
gcttgcctctcctcgacttacaggg

SEQ ID NO: 448951 - DNA, 25 bp, Mus musculus
gcttgcctgtccacactgctcatag

SEQ ID NO: 448952 - DNA, 25 bp, Mus musculus
gcttgcgaagtgtgtggctttaccc

SEQ ID NO: 448953 - DNA, 25 bp, Mus musculus
gcttgcgactttctcctcttgctgg

SEQ ID NO: 448954 - DNA, 25 bp, Mus musculus
gcttgcgccaacaggaagagctcaa

SEQ ID NO: 448955 - DNA, 25 bp, Mus musculus
gcttgcgctgcagacagtgtggaca

SEQ ID NO: 448956 - DNA, 25 bp, Mus musculus
gcttgctccggaagccttcagatga

SEQ ID NO: 448957 - DNA, 25 bp, Mus musculus
gcttgctcttaaacaaaatacatta

SEQ ID NO: 448958 - DNA, 25 bp, Mus musculus
gcttgctgacaagtaccacttccgg

SEQ ID NO: 448959 - DNA, 25 bp, Mus musculus
gcttgctgataagcccagcaaactg

SEQ ID NO: 448960 - DNA, 25 bp, Mus musculus
gcttgctgtcataattccttagatg

SEQ ID NO: 448961 - DNA, 25 bp, Mus musculus
gcttgcttcaagtcaccctggaagg

SEQ ID NO: 448962 - DNA, 25 bp, Mus musculus
gcttgcttctctgctggactccttg

SEQ ID NO: 448963 - DNA, 25 bp, Mus musculus
gcttgctttctatggacacgctgct

SEQ ID NO: 448964 - DNA, 25 bp, Mus musculus
gcttgctttctccaggaatagggac

SEQ ID NO: 448965 - DNA, 25 bp, Mus musculus
gcttggaacgccagccttgtctgcc

SEQ ID NO: 448966 - DNA, 25 bp, Mus musculus
gcttggaactcacttgtaagaagaa

SEQ ID NO: 448967 - DNA, 25 bp, Mus musculus
gcttggaagaggttataagccacca

SEQ ID NO: 448968 - DNA, 25 bp, Mus musculus
gcttggacagatacctggccctggt

SEQ ID NO: 448969 - DNA, 25 bp, Mus musculus
gcttggagaaagtccccggcatctt

SEQ ID NO: 448970 - DNA, 25 bp, Mus musculus
gcttggaggaactcaaccaggccat

SEQ ID NO: 448971 - DNA, 25 bp, Mus musculus
gcttggaggagatcctgtcagcctg

SEQ ID NO: 448972 - DNA, 25 bp, Mus musculus
gcttggaggctctgtaatctaggga

SEQ ID NO: 448973 - DNA, 25 bp, Mus musculus
gcttggaggtcgagagggagccgcc

SEQ ID NO: 448974 - DNA, 25 bp, Mus musculus
gcttggatagcacactctggctgaa

SEQ ID NO: 448975 - DNA, 25 bp, Mus musculus
gcttggatgggctcctctatggacc

SEQ ID NO: 448976 - DNA, 25 bp, Mus musculus
gcttggattgactgacttcactgga

SEQ ID NO: 448977 - DNA, 25 bp, Mus musculus
gcttggcaaattccccgcttggacc

SEQ ID NO: 448978 - DNA, 25 bp, Mus musculus
gcttggcattcttcttccgactggt

SEQ ID NO: 448979 - DNA, 25 bp, Mus musculus
gcttggccccgaagcagtaagcttg

SEQ ID NO: 448980 - DNA, 25 bp, Mus musculus
gcttggcccgatcagttctcagtaa

SEQ ID NO: 448981 - DNA, 25 bp, Mus musculus
gcttggcctgactatacataaggac

SEQ ID NO: 448982 - DNA, 25 bp, Mus musculus
gcttggcgatggctcacttagcgaa

SEQ ID NO: 448983 - DNA, 25 bp, Mus musculus
gcttggcggcctcttttcagccctt

SEQ ID NO: 448984 - DNA, 25 bp, Mus musculus
gcttggctatttggaagtttcggca

SEQ ID NO: 448985 - DNA, 25 bp, Mus musculus
gcttggctccaaaacgaggttacca

SEQ ID NO: 448986 - DNA, 25 bp, Mus musculus
gcttggctgttgttcctaatgcaga

SEQ ID NO: 448987 - DNA, 25 bp, Mus musculus
gcttggcttagaagtgaggctccct

SEQ ID NO: 448988 - DNA, 25 bp, Mus musculus
gcttgggagcactcgcgagatctga

SEQ ID NO: 448989 - DNA, 25 bp, Mus musculus
gcttgggattcgtggctctatactc

SEQ ID NO: 448990 - DNA, 25 bp, Mus musculus
gcttgggcagaacacccaggcaact

SEQ ID NO: 448991 - DNA, 25 bp, Mus musculus
gcttgggcatgagtagaactttaaa

SEQ ID NO: 448992 - DNA, 25 bp, Mus musculus
gcttgggccttcacagacagcagaa

SEQ ID NO: 448993 - DNA, 25 bp, Mus musculus
gcttgggcgatgaggaatttgaaat

SEQ ID NO: 448994 - DNA, 25 bp, Mus musculus
gcttgggcgccatggaactcattca

SEQ ID NO: 448995 - DNA, 25 bp, Mus musculus
gcttgggtgactcagaatacacata

SEQ ID NO: 448996 - DNA, 25 bp, Mus musculus
gcttgggtgaggatttccagagaca

SEQ ID NO: 448997 - DNA, 25 bp, Mus musculus
gcttgggtgagtagaacttacagtc

SEQ ID NO: 448998 - DNA, 25 bp, Mus musculus
gcttgggtgttcagcacagggacca

SEQ ID NO: 448999 - DNA, 25 bp, Mus musculus
gcttgggttatttctgggccacaga

SEQ ID NO: 449000 - DNA, 25 bp, Mus musculus
gcttggtataactggcagccgtaca

SEQ ID NO: 449001 - DNA, 25 bp, Mus musculus
gcttggtatattgccctatactggg

SEQ ID NO: 449002 - DNA, 25 bp, Mus musculus
gcttggtcacagaaagtggtcatcc

SEQ ID NO: 449003 - DNA, 25 bp, Mus musculus
gcttggtccccatgttaacagttgg

SEQ ID NO: 449004 - DNA, 25 bp, Mus musculus
gcttggtgaaaggtggacatactga

SEQ ID NO: 449005 - DNA, 25 bp, Mus musculus
gcttggtgctctcctgctggtgaca

SEQ ID NO: 449006 - DNA, 25 bp, Mus musculus
gcttggtgttagatcctgctttttt

SEQ ID NO: 449007 - DNA, 25 bp, Mus musculus
gcttggttaaaccttctgtgctcca

SEQ ID NO: 449008 - DNA, 25 bp, Mus musculus
gcttggttgcacatccatggaggca

SEQ ID NO: 449009 - DNA, 25 bp, Mus musculus
gcttgtaaaactcaaagagccgagt

SEQ ID NO: 449010 - DNA, 25 bp, Mus musculus
gcttgtaaatggaacgacaaccccg

SEQ ID NO: 449011 - DNA, 25 bp, Mus musculus
gcttgtaaccatctgcatttcccca

SEQ ID NO: 449012 - DNA, 25 bp, Mus musculus
gcttgtaatgcatgcccagtagttt

SEQ ID NO: 449013 - DNA, 25 bp, Mus musculus
gcttgtaattgctgacgtctagaga

SEQ ID NO: 449014 - DNA, 25 bp, Mus musculus
gcttgtacctgtggatcgacgccca

SEQ ID NO: 449015 - DNA, 25 bp, Mus musculus
gcttgtactctttggtaagaaatct

SEQ ID NO: 449016 - DNA, 25 bp, Mus musculus
gcttgtagcgcccagcgcttgcgct

SEQ ID NO: 449017 - DNA, 25 bp, Mus musculus
gcttgtagctccagaggttcggtcc

SEQ ID NO: 449018 - DNA, 25 bp, Mus musculus
gcttgtagtctattaaaaaccccag

SEQ ID NO: 449019 - DNA, 25 bp, Mus musculus
gcttgtagtcttagccagaggatcg

SEQ ID NO: 449020 - DNA, 25 bp, Mus musculus
gcttgtataatggtgctggccacgt

SEQ ID NO: 449021 - DNA, 25 bp, Mus musculus
gcttgtatctaactgcacagcaggg

SEQ ID NO: 449022 - DNA, 25 bp, Mus musculus
gcttgtattcaacgcctcggacaga

SEQ ID NO: 449023 - DNA, 25 bp, Mus musculus
gcttgtcagaagctattttaagtac

SEQ ID NO: 449024 - DNA, 25 bp, Mus musculus
gcttgtcatctaagcactttggagg

SEQ ID NO: 449025 - DNA, 25 bp, Mus musculus
gcttgtcccggaaaaccatggtgcc

SEQ ID NO: 449026 - DNA, 25 bp, Mus musculus
gcttgtccgagccaagatacaacat

SEQ ID NO: 449027 - DNA, 25 bp, Mus musculus
gcttgtcgccaagtgggaaatagac

SEQ ID NO: 449028 - DNA, 25 bp, Mus musculus
gcttgtcggtgactagagcctcctc

SEQ ID NO: 449029 - DNA, 25 bp, Mus musculus
gcttgtcgtagcgagaatttagcaa

SEQ ID NO: 449030 - DNA, 25 bp, Mus musculus
gcttgtctccagtgaaaacttcgat

SEQ ID NO: 449031 - DNA, 25 bp, Mus musculus
gcttgtctctagtactggcgtgcag

SEQ ID NO: 449032 - DNA, 25 bp, Mus musculus
gcttgtctgtgaagacgaccatggt

SEQ ID NO: 449033 - DNA, 25 bp, Mus musculus
gcttgtcttatatggcagtctggcc

SEQ ID NO: 449034 - DNA, 25 bp, Mus musculus
gcttgtgcaaaaccaactgtggcgt

SEQ ID NO: 449035 - DNA, 25 bp, Mus musculus
gcttgtgctggtatgtggctctatc

SEQ ID NO: 449036 - DNA, 25 bp, Mus musculus
gcttgtggaagaagttgaacctgcc

SEQ ID NO: 449037 - DNA, 25 bp, Mus musculus
gcttgtggtgacgtcatctccggga

SEQ ID NO: 449038 - DNA, 25 bp, Mus musculus
gcttgtgtgatgttcgcatgtgaca

SEQ ID NO: 449039 - DNA, 25 bp, Mus musculus
gcttgtgttttgagcttctgtgaca

SEQ ID NO: 449040 - DNA, 25 bp, Mus musculus
gcttgttaccgggaagcctgcctgg

SEQ ID NO: 449041 - DNA, 25 bp, Mus musculus
gcttgttcaaacatcgaagagtatt

SEQ ID NO: 449042 - DNA, 25 bp, Mus musculus
gcttgttcctgataggacttttcag

SEQ ID NO: 449043 - DNA, 25 bp, Mus musculus
gcttgttcctgtttgatcatacgag

SEQ ID NO: 449044 - DNA, 25 bp, Mus musculus
gcttgttgtcaagcctcatgagaga

SEQ ID NO: 449045 - DNA, 25 bp, Mus musculus
gcttgtttgacgttacctggagtga

SEQ ID NO: 449046 - DNA, 25 bp, Mus musculus
gctttaaaaagcacactgctgaccc

SEQ ID NO: 449047 - DNA, 25 bp, Mus musculus
gctttaaaactcttggagattgaac

SEQ ID NO: 449048 - DNA, 25 bp, Mus musculus
gctttaaatagctcactaagaccaa

SEQ ID NO: 449049 - DNA, 25 bp, Mus musculus
gctttaaatgctgacttcagtagca

SEQ ID NO: 449050 - DNA, 25 bp, Mus musculus
gctttaacaactacgacaagtccaa

SEQ ID NO: 449051 - DNA, 25 bp, Mus musculus
gctttaaccgcctccgtgtagatga

SEQ ID NO: 449052 - DNA, 25 bp, Mus musculus
gctttaagattaagctagtcatccc

SEQ ID NO: 449053 - DNA, 25 bp, Mus musculus
gctttaagggcgcagtctcaatgac

SEQ ID NO: 449054 - DNA, 25 bp, Mus musculus
gctttacctggtgtctacattggcc

SEQ ID NO: 449055 - DNA, 25 bp, Mus musculus
gctttacgaggcacagagacttcat

SEQ ID NO: 449056 - DNA, 25 bp, Mus musculus
gctttactggccctaaatggctaca

SEQ ID NO: 449057 - DNA, 25 bp, Mus musculus
gctttactttgattccatgctaccg

SEQ ID NO: 449058 - DNA, 25 bp, Mus musculus
gctttagaaaggcatccccggacct

SEQ ID NO: 449059 - DNA, 25 bp, Mus musculus
gctttagaactcacggaacgcagtc

SEQ ID NO: 449060 - DNA, 25 bp, Mus musculus
gctttagccggagtgcgaaccttat

SEQ ID NO: 449061 - DNA, 25 bp, Mus musculus
gctttagcgagatatgcccctggaa

SEQ ID NO: 449062 - DNA, 25 bp, Mus musculus
gctttagcttccctgatgtgtgaca

SEQ ID NO: 449063 - DNA, 25 bp, Mus musculus
gctttaggccaacttgcaggaagga

SEQ ID NO: 449064 - DNA, 25 bp, Mus musculus
gctttaggcttactatggaaatgga

SEQ ID NO: 449065 - DNA, 25 bp, Mus musculus
gctttagggaacattgccagtaaga

SEQ ID NO: 449066 - DNA, 25 bp, Mus musculus
gctttagggctcagtagtgcaggat

SEQ ID NO: 449067 - DNA, 25 bp, Mus musculus
gctttataggacttaattctcctcc

SEQ ID NO: 449068 - DNA, 25 bp, Mus musculus
gctttatcaaccagcacacggtgga

SEQ ID NO: 449069 - DNA, 25 bp, Mus musculus
gctttatctgctgggacatgcctga

SEQ ID NO: 449070 - DNA, 25 bp, Mus musculus
gctttatgagagagatgactaccgg

SEQ ID NO: 449071 - DNA, 25 bp, Mus musculus
gctttattaacacaatcaaggccgt

SEQ ID NO: 449072 - DNA, 25 bp, Mus musculus
gctttattctcaaggctgccccaga

SEQ ID NO: 449073 - DNA, 25 bp, Mus musculus
gctttatttaccagccgtgccagcg

SEQ ID NO: 449074 - DNA, 25 bp, Mus musculus
gctttcaagagcaaattccccgcgg

SEQ ID NO: 449075 - DNA, 25 bp, Mus musculus
gctttcaagggaatgcaggcagcca

SEQ ID NO: 449076 - DNA, 25 bp, Mus musculus
gctttcacagtacagcccaggctgg

SEQ ID NO: 449077 - DNA, 25 bp, Mus musculus
gctttcagactaagacgaaggcaca

SEQ ID NO: 449078 - DNA, 25 bp, Mus musculus
gctttcagcaagtggtgcatgccat

SEQ ID NO: 449079 - DNA, 25 bp, Mus musculus
gctttcagcagatcagcagcgtccg

SEQ ID NO: 449080 - DNA, 25 bp, Mus musculus
gctttcaggtttggctggcgttccg

SEQ ID NO: 449081 - DNA, 25 bp, Mus musculus
gctttcagtcaccagctagagcgca

SEQ ID NO: 449082 - DNA, 25 bp, Mus musculus
gctttcagtgttatctaacacgaag

SEQ ID NO: 449083 - DNA, 25 bp, Mus musculus
gctttcatcttcaaacaggaggaga

SEQ ID NO: 449084 - DNA, 25 bp, Mus musculus
gctttcatgcgaggcttggtagcag

SEQ ID NO: 449085 - DNA, 25 bp, Mus musculus
gctttccacaatttagtgcccttcg

SEQ ID NO: 449086 - DNA, 25 bp, Mus musculus
gctttccagccaagcacctgttggg

SEQ ID NO: 449087 - DNA, 25 bp, Mus musculus
gctttcccagaacctgcgtgttcag

SEQ ID NO: 449088 - DNA, 25 bp, Mus musculus
gctttcccctccagatacactgtgg

SEQ ID NO: 449089 - DNA, 25 bp, Mus musculus
gctttccccttgctctaatgctcag

SEQ ID NO: 449090 - DNA, 25 bp, Mus musculus
gctttcccgtcctggctaggttagg

SEQ ID NO: 449091 - DNA, 25 bp, Mus musculus
gctttccctagacatagcaaactta

SEQ ID NO: 449092 - DNA, 25 bp, Mus musculus
gctttccgatttgcgtgatccacag

SEQ ID NO: 449093 - DNA, 25 bp, Mus musculus
gctttcctaaccctgatgatcgaca

SEQ ID NO: 449094 - DNA, 25 bp, Mus musculus
gctttcctcaagtgcctacagttct

SEQ ID NO: 449095 - DNA, 25 bp, Mus musculus
gctttcctgcgacagtatggccaga

SEQ ID NO: 449096 - DNA, 25 bp, Mus musculus
gctttcctggctgggttggtagacc

SEQ ID NO: 449097 - DNA, 25 bp, Mus musculus
gctttcctgggagcagaagtcaccg

SEQ ID NO: 449098 - DNA, 25 bp, Mus musculus
gctttccttagcgagtaacacttgg

SEQ ID NO: 449099 - DNA, 25 bp, Mus musculus
gctttcggaaaattgcctgggcgtt

SEQ ID NO: 449100 - DNA, 25 bp, Mus musculus
gctttcggctgaatccaaggacttg

SEQ ID NO: 449101 - DNA, 25 bp, Mus musculus
gctttctaagacatggccgtgcgcg

SEQ ID NO: 449102 - DNA, 25 bp, Mus musculus
gctttctacctcacagaaaggccaa

SEQ ID NO: 449103 - DNA, 25 bp, Mus musculus
gctttctactgcaacaacgtttgcg

SEQ ID NO: 449104 - DNA, 25 bp, Mus musculus
gctttctcaccttcaggaactgtta

SEQ ID NO: 449105 - DNA, 25 bp, Mus musculus
gctttctccaggaatagggaccttt

SEQ ID NO: 449106 - DNA, 25 bp, Mus musculus
gctttctcctgagccataattgctg

SEQ ID NO: 449107 - DNA, 25 bp, Mus musculus
gctttctctggtagacagcggccaa

SEQ ID NO: 449108 - DNA, 25 bp, Mus musculus
gctttctgacctttgcgggacggtg

SEQ ID NO: 449109 - DNA, 25 bp, Mus musculus
gctttctgcgcttagcaaggccctg

SEQ ID NO: 449110 - DNA, 25 bp, Mus musculus
gctttctgcgtctggtcctgctctc

SEQ ID NO: 449111 - DNA, 25 bp, Mus musculus
gctttctggagatacctcatgtcca

SEQ ID NO: 449112 - DNA, 25 bp, Mus musculus
gctttctggatgtggcgctgctaca

SEQ ID NO: 449113 - DNA, 25 bp, Mus musculus
gctttcttgtagttggaattgccac

SEQ ID NO: 449114 - DNA, 25 bp, Mus musculus
gctttctttaactcgcttttaccag

SEQ ID NO: 449115 - DNA, 25 bp, Mus musculus
gctttctttgtaacggacctctgtc

SEQ ID NO: 449116 - DNA, 25 bp, Mus musculus
gctttgaaaatggtcctccaggagc

SEQ ID NO: 449117 - DNA, 25 bp, Mus musculus
gctttgaacaccctgcctttggatc

SEQ ID NO: 449118 - DNA, 25 bp, Mus musculus
gctttgaagactcaggacggccaga

SEQ ID NO: 449119 - DNA, 25 bp, Mus musculus
gctttgaagcctggcaaaggccctg

SEQ ID NO: 449120 - DNA, 25 bp, Mus musculus
gctttgaagtgaaggaccatgctca

SEQ ID NO: 449121 - DNA, 25 bp, Mus musculus
gctttgacaacccaaacgaagaggt

SEQ ID NO: 449122 - DNA, 25 bp, Mus musculus
gctttgactaccagggcaagacgga

SEQ ID NO: 449123 - DNA, 25 bp, Mus musculus
gctttgacttttacacattctctgg

SEQ ID NO: 449124 - DNA, 25 bp, Mus musculus
gctttgagcaaagtagcagaaaata

SEQ ID NO: 449125 - DNA, 25 bp, Mus musculus
gctttgagctctacttggccctacg

SEQ ID NO: 449126 - DNA, 25 bp, Mus musculus
gctttgatgtcgacgggctggaccc

SEQ ID NO: 449127 - DNA, 25 bp, Mus musculus
gctttgcaacataacccagagggtg

SEQ ID NO: 449128 - DNA, 25 bp, Mus musculus
gctttgcaatggcaacctggtggat

SEQ ID NO: 449129 - DNA, 25 bp, Mus musculus
gctttgcacttatttttagaaggca

SEQ ID NO: 449130 - DNA, 25 bp, Mus musculus
gctttgcagagcaacctgggcctgt

SEQ ID NO: 449131 - DNA, 25 bp, Mus musculus
gctttgcagccgagtcagatgtcca

SEQ ID NO: 449132 - DNA, 25 bp, Mus musculus
gctttgcagctaatgccccttcaga

SEQ ID NO: 449133 - DNA, 25 bp, Mus musculus
gctttgccaaactggactgagccgt

SEQ ID NO: 449134 - DNA, 25 bp, Mus musculus
gctttgccagaatgcccttatagga

SEQ ID NO: 449135 - DNA, 25 bp, Mus musculus
gctttgccagagtgatggagttcaa

SEQ ID NO: 449136 - DNA, 25 bp, Mus musculus
gctttgcccacgacacaaggactgt

SEQ ID NO: 449137 - DNA, 25 bp, Mus musculus
gctttgccgtgcacagactgggaga

SEQ ID NO: 449138 - DNA, 25 bp, Mus musculus
gctttgcctgtgctaattgaacaag

SEQ ID NO: 449139 - DNA, 25 bp, Mus musculus
gctttgcgtgttggcagagtgccca

SEQ ID NO: 449140 - DNA, 25 bp, Mus musculus
gctttgctcagtaagcagcctagct

SEQ ID NO: 449141 - DNA, 25 bp, Mus musculus
gctttgctgctgtcagtgcttccca

SEQ ID NO: 449142 - DNA, 25 bp, Mus musculus
gctttgctgcttacactggccggaa

SEQ ID NO: 449143 - DNA, 25 bp, Mus musculus
gctttgctgtactcaaaggactgag

SEQ ID NO: 449144 - DNA, 25 bp, Mus musculus
gctttgctgtcctaaaccattgtta

SEQ ID NO: 449145 - DNA, 25 bp, Mus musculus
gctttgcttaacgagtaccagagga

SEQ ID NO: 449146 - DNA, 25 bp, Mus musculus
gctttggaaagcatcagataaccct

SEQ ID NO: 449147 - DNA, 25 bp, Mus musculus
gctttggacttgtgctctgaggccc

SEQ ID NO: 449148 - DNA, 25 bp, Mus musculus
gctttggaggcagacacttgagtgt

SEQ ID NO: 449149 - DNA, 25 bp, Mus musculus
gctttggatccgttcactctaataa

SEQ ID NO: 449150 - DNA, 25 bp, Mus musculus
gctttggatggctaagtgtttttgc

SEQ ID NO: 449151 - DNA, 25 bp, Mus musculus
gctttggcaagaagacctgattgga

SEQ ID NO: 449152 - DNA, 25 bp, Mus musculus
gctttggccctgttagtgtcactgg

SEQ ID NO: 449153 - DNA, 25 bp, Mus musculus
gctttgggaggagagtcacacatga

SEQ ID NO: 449154 - DNA, 25 bp, Mus musculus
gctttgggcacaagatagaccggat

SEQ ID NO: 449155 - DNA, 25 bp, Mus musculus
gctttgggtacagtagcacacacca

SEQ ID NO: 449156 - DNA, 25 bp, Mus musculus
gctttggtacaggtgcaacttcatg

SEQ ID NO: 449157 - DNA, 25 bp, Mus musculus
gctttggtgaagaaggaatctcgac

SEQ ID NO: 449158 - DNA, 25 bp, Mus musculus
gctttgtaagaagctcaaccgggaa

SEQ ID NO: 449159 - DNA, 25 bp, Mus musculus
gctttgtacttcttctgagaactga

SEQ ID NO: 449160 - DNA, 25 bp, Mus musculus
gctttgtatggaaatatgtttggac

SEQ ID NO: 449161 - DNA, 25 bp, Mus musculus
gctttgtattctggactcttggtga

SEQ ID NO: 449162 - DNA, 25 bp, Mus musculus
gctttgtcaagcatcgatactggag

SEQ ID NO: 449163 - DNA, 25 bp, Mus musculus
gctttgtcactagccaatctgcaga

SEQ ID NO: 449164 - DNA, 25 bp, Mus musculus
gctttgtcccaagtgctcagcgtgg

SEQ ID NO: 449165 - DNA, 25 bp, Mus musculus
gctttgtccccattgtggccgagga

SEQ ID NO: 449166 - DNA, 25 bp, Mus musculus
gctttgtcccgtttcctcaccgata

SEQ ID NO: 449167 - DNA, 25 bp, Mus musculus
gctttgtgagtttgctaagtcattc

SEQ ID NO: 449168 - DNA, 25 bp, Mus musculus
gctttgtgctggttgaggccctgca

SEQ ID NO: 449169 - DNA, 25 bp, Mus musculus
gctttgtgggtactcatcttggaca

SEQ ID NO: 449170 - DNA, 25 bp, Mus musculus
gctttgttaaggaagtcatattcag

SEQ ID NO: 449171 - DNA, 25 bp, Mus musculus
gcttttaaagcctggaagaggacca

SEQ ID NO: 449172 - DNA, 25 bp, Mus musculus
gcttttaaatactaactctggcata

SEQ ID NO: 449173 - DNA, 25 bp, Mus musculus
gcttttaatagaaagcatggcacca

SEQ ID NO: 449174 - DNA, 25 bp, Mus musculus
gcttttacctaacgtaacagcagag

SEQ ID NO: 449175 - DNA, 25 bp, Mus musculus
gcttttacctgcttgaccattgtga

SEQ ID NO: 449176 - DNA, 25 bp, Mus musculus
gcttttagatttttggaccttgaca

SEQ ID NO: 449177 - DNA, 25 bp, Mus musculus
gcttttatcaaggacatgctgccga

SEQ ID NO: 449178 - DNA, 25 bp, Mus musculus
gcttttatgaacagccagatgtgga

SEQ ID NO: 449179 - DNA, 25 bp, Mus musculus
gcttttatgcaaaatggcggaccag

SEQ ID NO: 449180 - DNA, 25 bp, Mus musculus
gcttttcaaatgactgaggagtaaa

SEQ ID NO: 449181 - DNA, 25 bp, Mus musculus
gcttttcaatgagatcaatgctcgc

SEQ ID NO: 449182 - DNA, 25 bp, Mus musculus
gcttttcatcgtggctgggatccta

SEQ ID NO: 449183 - DNA, 25 bp, Mus musculus
gcttttcccaggtcttaaagatgcg

SEQ ID NO: 449184 - DNA, 25 bp, Mus musculus
gcttttcccgatagagcaggctggg

SEQ ID NO: 449185 - DNA, 25 bp, Mus musculus
gcttttctaaaagcctgagccgagg

SEQ ID NO: 449186 - DNA, 25 bp, Mus musculus
gcttttctacactattgcagaggga

SEQ ID NO: 449187 - DNA, 25 bp, Mus musculus
gcttttctcatgaagtagaagcatt

SEQ ID NO: 449188 - DNA, 25 bp, Mus musculus
gcttttctgagccttcggtttcaca

SEQ ID NO: 449189 - DNA, 25 bp, Mus musculus
gcttttctgctcgatcgggtttcca

SEQ ID NO: 449190 - DNA, 25 bp, Mus musculus
gcttttctgtgcacatgtggatgac

SEQ ID NO: 449191 - DNA, 25 bp, Mus musculus
gcttttctgttctcaatgtttgtag

SEQ ID NO: 449192 - DNA, 25 bp, Mus musculus
gcttttctttgacctgaaggatgag

SEQ ID NO: 449193 - DNA, 25 bp, Mus musculus
gcttttgaacataatgggcgcccct

SEQ ID NO: 449194 - DNA, 25 bp, Mus musculus
gcttttgaacccgagtccattttgc

SEQ ID NO: 449195 - DNA, 25 bp, Mus musculus
gcttttgaagaaacacccatgctgg

SEQ ID NO: 449196 - DNA, 25 bp, Mus musculus
gcttttgactgttgaaatctccaag

SEQ ID NO: 449197 - DNA, 25 bp, Mus musculus
gcttttgagctgtttgataccgaca

SEQ ID NO: 449198 - DNA, 25 bp, Mus musculus
gcttttgcaaaatatcaccataggg

SEQ ID NO: 449199 - DNA, 25 bp, Mus musculus
gcttttgcagaagcagcccggctct

SEQ ID NO: 449200 - DNA, 25 bp, Mus musculus
gcttttgccccatcgctggatagca

SEQ ID NO: 449201 - DNA, 25 bp, Mus musculus
gcttttgccgacaatctcaagtgga

SEQ ID NO: 449202 - DNA, 25 bp, Mus musculus
gcttttgccgagagctagagccctg

SEQ ID NO: 449203 - DNA, 25 bp, Mus musculus
gcttttgctctctcagttgtgacca

SEQ ID NO: 449204 - DNA, 25 bp, Mus musculus
gcttttgctctgacctgcctgacgc

SEQ ID NO: 449205 - DNA, 25 bp, Mus musculus
gcttttggcgacaaatgcaggatca

SEQ ID NO: 449206 - DNA, 25 bp, Mus musculus
gcttttgggtcattctcacggagga

SEQ ID NO: 449207 - DNA, 25 bp, Mus musculus
gcttttggtctgtccccgaatactg

SEQ ID NO: 449208 - DNA, 25 bp, Mus musculus
gcttttggttggaaatcactgcttg

SEQ ID NO: 449209 - DNA, 25 bp, Mus musculus
gcttttgtatctgcgaagtgcttca

SEQ ID NO: 449210 - DNA, 25 bp, Mus musculus
gcttttgtctcacgccgagcacatg

SEQ ID NO: 449211 - DNA, 25 bp, Mus musculus
gcttttgtgtcactactggcccctg

SEQ ID NO: 449212 - DNA, 25 bp, Mus musculus
gctttttagctttggaaatggcctt

SEQ ID NO: 449213 - DNA, 25 bp, Mus musculus
gctttttatatatcacatgcaccat

SEQ ID NO: 449214 - DNA, 25 bp, Mus musculus
gctttttgccatgatgtgctcacca

SEQ ID NO: 449215 - DNA, 25 bp, Mus musculus
gctttttgcctcttgagcgctggaa

SEQ ID NO: 449216 - DNA, 25 bp, Mus musculus
gctttttgttttctccaaggatccg

SEQ ID NO: 449217 - DNA, 25 bp, Mus musculus
gcttttttccctgccagtaaccatt

SEQ ID NO: 449218 - DNA, 25 bp, Mus musculus
gcttttttgagcacgagggtcgccc

SEQ ID NO: 449219 - DNA, 25 bp, Mus musculus
gcttttttgcgaactgcatcgagga

SEQ ID NO: 449220 - DNA, 25 bp, Mus musculus
ggaaaaaatcccagcagaggccctg

SEQ ID NO: 449221 - DNA, 25 bp, Mus musculus
ggaaaaaccgccgtcgatacagtgt

SEQ ID NO: 449222 - DNA, 25 bp, Mus musculus
ggaaaaacggccagatcagcactct

SEQ ID NO: 449223 - DNA, 25 bp, Mus musculus
ggaaaaactattgccggcctcgtga

SEQ ID NO: 449224 - DNA, 25 bp, Mus musculus
ggaaaaagacagatgtcatcctgtt

SEQ ID NO: 449225 - DNA, 25 bp, Mus musculus
ggaaaaagaccaacagcctacgtgc

SEQ ID NO: 449226 - DNA, 25 bp, Mus musculus
ggaaaaagagaaaaccatcgcattg

SEQ ID NO: 449227 - DNA, 25 bp, Mus musculus
ggaaaaagccttgtcttctaatact

SEQ ID NO: 449228 - DNA, 25 bp, Mus musculus
ggaaaaagcggacctccatcgaggt

SEQ ID NO: 449229 - DNA, 25 bp, Mus musculus
ggaaaaaggatcttgccaattagac

SEQ ID NO: 449230 - DNA, 25 bp, Mus musculus
ggaaaaataaccaatcttctccaga

SEQ ID NO: 449231 - DNA, 25 bp, Mus musculus
ggaaaaattcagctctcaaacagga

SEQ ID NO: 449232 - DNA, 25 bp, Mus musculus
ggaaaacaaggaacatgcggctgct

SEQ ID NO: 449233 - DNA, 25 bp, Mus musculus
ggaaaacacagatacaagcagctca

SEQ ID NO: 449234 - DNA, 25 bp, Mus musculus
ggaaaacaggtacgactgcctcgga

SEQ ID NO: 449235 - DNA, 25 bp, Mus musculus
ggaaaaccatttgcgcccgtgttca

SEQ ID NO: 449236 - DNA, 25 bp, Mus musculus
ggaaaaccgtggaggccatccgaga

SEQ ID NO: 449237 - DNA, 25 bp, Mus musculus
ggaaaaccgtgtcgcccatctaatg

SEQ ID NO: 449238 - DNA, 25 bp, Mus musculus
ggaaaacctccaagattcacaaggg

SEQ ID NO: 449239 - DNA, 25 bp, Mus musculus
ggaaaacctgtaagagactacctca

SEQ ID NO: 449240 - DNA, 25 bp, Mus musculus
ggaaaaccttctcctcgtgcaagta

SEQ ID NO: 449241 - DNA, 25 bp, Mus musculus
ggaaaacgatcaaaatgcagtgttt

SEQ ID NO: 449242 - DNA, 25 bp, Mus musculus
ggaaaactccacagattattgtttc

SEQ ID NO: 449243 - DNA, 25 bp, Mus musculus
ggaaaactcgggtcctggagcagct

SEQ ID NO: 449244 - DNA, 25 bp, Mus musculus
ggaaaactcgtgtcctgcgtaccca

SEQ ID NO: 449245 - DNA, 25 bp, Mus musculus
ggaaaactctactcggctacagtga

SEQ ID NO: 449246 - DNA, 25 bp, Mus musculus
ggaaaactctcagggccctattaag

SEQ ID NO: 449247 - DNA, 25 bp, Mus musculus
ggaaaactgaggcagaatccccaag

SEQ ID NO: 449248 - DNA, 25 bp, Mus musculus
ggaaaactgcagaaccttagccaag

SEQ ID NO: 449249 - DNA, 25 bp, Mus musculus
ggaaaacttcgtccgctacctggag

SEQ ID NO: 449250 - DNA, 25 bp, Mus musculus
ggaaaactttggtctaacagcacag

SEQ ID NO: 449251 - DNA, 25 bp, Mus musculus
ggaaaagaatccttgcaagtgtgaa

SEQ ID NO: 449252 - DNA, 25 bp, Mus musculus
ggaaaagacagatagtagattgtag

SEQ ID NO: 449253 - DNA, 25 bp, Mus musculus
ggaaaagaccctcatcaatggcctg

SEQ ID NO: 449254 - DNA, 25 bp, Mus musculus
ggaaaagacgccatgacctctgaca

SEQ ID NO: 449255 - DNA, 25 bp, Mus musculus
ggaaaagatacagaccaggcagggc

SEQ ID NO: 449256 - DNA, 25 bp, Mus musculus
ggaaaagatcactagctgcgccact

SEQ ID NO: 449257 - DNA, 25 bp, Mus musculus
ggaaaagatgcttcatacctggtaa

SEQ ID NO: 449258 - DNA, 25 bp, Mus musculus
ggaaaagcagacagaagccaccaat

SEQ ID NO: 449259 - DNA, 25 bp, Mus musculus
ggaaaagccaaaagtgacccctgtg

SEQ ID NO: 449260 - DNA, 25 bp, Mus musculus
ggaaaagccgcttcatctctataag

SEQ ID NO: 449261 - DNA, 25 bp, Mus musculus
ggaaaagcggtttcttgacaaggcg

SEQ ID NO: 449262 - DNA, 25 bp, Mus musculus
ggaaaagctatacgtgtaaagaatg

SEQ ID NO: 449263 - DNA, 25 bp, Mus musculus
ggaaaagctgacttgcaaggcaacg

SEQ ID NO: 449264 - DNA, 25 bp, Mus musculus
ggaaaagctgcttcccctgcgaagt

SEQ ID NO: 449265 - DNA, 25 bp, Mus musculus
ggaaaagctggctcaaccccattga

SEQ ID NO: 449266 - DNA, 25 bp, Mus musculus
ggaaaagcttgacctgctacgtgga

SEQ ID NO: 449267 - DNA, 25 bp, Mus musculus
ggaaaagctttctctaccacggcat

SEQ ID NO: 449268 - DNA, 25 bp, Mus musculus
ggaaaagctttgcactccacctaga

SEQ ID NO: 449269 - DNA, 25 bp, Mus musculus
ggaaaaggacacattcgacaacagg

SEQ ID NO: 449270 - DNA, 25 bp, Mus musculus
ggaaaaggccacatctgaactaaga

SEQ ID NO: 449271 - DNA, 25 bp, Mus musculus
ggaaaaggccatgatcaagaccgct

SEQ ID NO: 449272 - DNA, 25 bp, Mus musculus
ggaaaaggtgctgaggctcatcaca

SEQ ID NO: 449273 - DNA, 25 bp, Mus musculus
ggaaaagtgacctagtcaacaacag

SEQ ID NO: 449274 - DNA, 25 bp, Mus musculus
ggaaaagtttaacgaccactcaatg

SEQ ID NO: 449275 - DNA, 25 bp, Mus musculus
ggaaaatcctctgtccattcgatgc

SEQ ID NO: 449276 - DNA, 25 bp, Mus musculus
ggaaaatgactctccccagatgtga

SEQ ID NO: 449277 - DNA, 25 bp, Mus musculus
ggaaaatgctccctgtctgccatcg

SEQ ID NO: 449278 - DNA, 25 bp, Mus musculus
ggaaaattatacacatctggtctct

SEQ ID NO: 449279 - DNA, 25 bp, Mus musculus
ggaaaattggcgactctctgctaga

SEQ ID NO: 449280 - DNA, 25 bp, Mus musculus
ggaaacaaattccagagctgactcc

SEQ ID NO: 449281 - DNA, 25 bp, Mus musculus
ggaaacaactacaccatcgagctgg

SEQ ID NO: 449282 - DNA, 25 bp, Mus musculus
ggaaacaccctaactgaacaaagtg

SEQ ID NO: 449283 - DNA, 25 bp, Mus musculus
ggaaacactcatccgtgcactaagg

SEQ ID NO: 449284 - DNA, 25 bp, Mus musculus
ggaaacactgctgcccataatagaa

SEQ ID NO: 449285 - DNA, 25 bp, Mus musculus
ggaaacagactcatgcccgactaat

SEQ ID NO: 449286 - DNA, 25 bp, Mus musculus
ggaaacagaggatgctcaagcaccc

SEQ ID NO: 449287 - DNA, 25 bp, Mus musculus
ggaaacagatttgccaccctgcatg

SEQ ID NO: 449288 - DNA, 25 bp, Mus musculus
ggaaacagctaccaatacacttgga

SEQ ID NO: 449289 - DNA, 25 bp, Mus musculus
ggaaacaggttctcggcaagcacca

SEQ ID NO: 449290 - DNA, 25 bp, Mus musculus
ggaaacagtcctacgtatgcagtgg

SEQ ID NO: 449291 - DNA, 25 bp, Mus musculus
ggaaacataattgacatctcgggat

SEQ ID NO: 449292 - DNA, 25 bp, Mus musculus
ggaaacatcgcgtagacaaagctct

SEQ ID NO: 449293 - DNA, 25 bp, Mus musculus
ggaaacatggctccgtgaacaagaa

SEQ ID NO: 449294 - DNA, 25 bp, Mus musculus
ggaaaccatcggtgcaaacctacag

SEQ ID NO: 449295 - DNA, 25 bp, Mus musculus
ggaaacccaatatcaaactgctgtg

SEQ ID NO: 449296 - DNA, 25 bp, Mus musculus
ggaaaccctcaagagaatccagagt

SEQ ID NO: 449297 - DNA, 25 bp, Mus musculus
ggaaaccctgctgaccattgtagag

SEQ ID NO: 449298 - DNA, 25 bp, Mus musculus
ggaaaccgaggtaccatcactgctg

SEQ ID NO: 449299 - DNA, 25 bp, Mus musculus
ggaaacgccctggtcatcttcgtga

SEQ ID NO: 449300 - DNA, 25 bp, Mus musculus
ggaaacggactcacagagctaagag

SEQ ID NO: 449301 - DNA, 25 bp, Mus musculus
ggaaacggccccagctgttcttgag

SEQ ID NO: 449302 - DNA, 25 bp, Mus musculus
ggaaacgtcaccgaaatcaggagcg

SEQ ID NO: 449303 - DNA, 25 bp, Mus musculus
ggaaactccacaaatgccagtcggt

SEQ ID NO: 449304 - DNA, 25 bp, Mus musculus
ggaaactggttcttcagctcagaca

SEQ ID NO: 449305 - DNA, 25 bp, Mus musculus
ggaaactgttatctgatgcccctca

SEQ ID NO: 449306 - DNA, 25 bp, Mus musculus
ggaaacttaatcttcggctccttgg

SEQ ID NO: 449307 - DNA, 25 bp, Mus musculus
ggaaacttcccatttgatcacacgg

SEQ ID NO: 449308 - DNA, 25 bp, Mus musculus
ggaaacttccccttgttctggatgg

SEQ ID NO: 449309 - DNA, 25 bp, Mus musculus
ggaaacttctgcttataactcccag

SEQ ID NO: 449310 - DNA, 25 bp, Mus musculus
ggaaacttcttcgatgtcatgactg

SEQ ID NO: 449311 - DNA, 25 bp, Mus musculus
ggaaacttgctgatggccctggaga

SEQ ID NO: 449312 - DNA, 25 bp, Mus musculus
ggaaacttgtctgtgccaaccccag

SEQ ID NO: 449313 - DNA, 25 bp, Mus musculus
ggaaagaaaccccatctacgtagca

SEQ ID NO: 449314 - DNA, 25 bp, Mus musculus
ggaaagaaatcataacaaggtctac

SEQ ID NO: 449315 - DNA, 25 bp, Mus musculus
ggaaagaacctattacagagacggg

SEQ ID NO: 449316 - DNA, 25 bp, Mus musculus
ggaaagaactaagagcaccgaagcc

SEQ ID NO: 449317 - DNA, 25 bp, Mus musculus
ggaaagaaggcagagatctgtcatg

SEQ ID NO: 449318 - DNA, 25 bp, Mus musculus
ggaaagaagtatgctctcatgtggg

SEQ ID NO: 449319 - DNA, 25 bp, Mus musculus
ggaaagaatcattccgtgggccgcc

SEQ ID NO: 449320 - DNA, 25 bp, Mus musculus
ggaaagaatcctagcaatgtctgct

SEQ ID NO: 449321 - DNA, 25 bp, Mus musculus
ggaaagaattctctggtcggcccca

SEQ ID NO: 449322 - DNA, 25 bp, Mus musculus
ggaaagacgctcttgaaccagcagg

SEQ ID NO: 449323 - DNA, 25 bp, Mus musculus
ggaaagactctttgactcttgctgg

SEQ ID NO: 449324 - DNA, 25 bp, Mus musculus
ggaaagacttaattgcccaggcacg

SEQ ID NO: 449325 - DNA, 25 bp, Mus musculus
ggaaagagaacagccaccacggttt

SEQ ID NO: 449326 - DNA, 25 bp, Mus musculus
ggaaagagctcccaataacagggcc

SEQ ID NO: 449327 - DNA, 25 bp, Mus musculus
ggaaagatcaacctcacctacaggg

SEQ ID NO: 449328 - DNA, 25 bp, Mus musculus
ggaaagatctcaactaccctgcctg

SEQ ID NO: 449329 - DNA, 25 bp, Mus musculus
ggaaagcaatcccaacatgtctgag

SEQ ID NO: 449330 - DNA, 25 bp, Mus musculus
ggaaagcatcaagtggcaaaggcca

SEQ ID NO: 449331 - DNA, 25 bp, Mus musculus
ggaaagcattaccttgaccagctga

SEQ ID NO: 449332 - DNA, 25 bp, Mus musculus
ggaaagccacaatcaccatcgagag

SEQ ID NO: 449333 - DNA, 25 bp, Mus musculus
ggaaagcccattgtatgactgccgc

SEQ ID NO: 449334 - DNA, 25 bp, Mus musculus
ggaaagcctaagatggtgacccgct

SEQ ID NO: 449335 - DNA, 25 bp, Mus musculus
ggaaagcctcctgcggtttccaagg

SEQ ID NO: 449336 - DNA, 25 bp, Mus musculus
ggaaagcctgcaccctcaggcgcat

SEQ ID NO: 449337 - DNA, 25 bp, Mus musculus
ggaaagcgatgatgactcccggcct

SEQ ID NO: 449338 - DNA, 25 bp, Mus musculus
ggaaagctctccatctccttgtgat

SEQ ID NO: 449339 - DNA, 25 bp, Mus musculus
ggaaagctgagtccctggatcacag

SEQ ID NO: 449340 - DNA, 25 bp, Mus musculus
ggaaagctggtctaatctggaaaca

SEQ ID NO: 449341 - DNA, 25 bp, Mus musculus
ggaaaggaagcctcgttgccaccat

SEQ ID NO: 449342 - DNA, 25 bp, Mus musculus
ggaaaggaatgtcccactggcgact

SEQ ID NO: 449343 - DNA, 25 bp, Mus musculus
ggaaaggactctaagcacagcgact

SEQ ID NO: 449344 - DNA, 25 bp, Mus musculus
ggaaaggcgcactggctacgcgtct

SEQ ID NO: 449345 - DNA, 25 bp, Mus musculus
ggaaaggctacgctagtcacagtga

SEQ ID NO: 449346 - DNA, 25 bp, Mus musculus
ggaaagggcgttccagatctgaaca

SEQ ID NO: 449347 - DNA, 25 bp, Mus musculus
ggaaaggtcctcgatgtgctgcact

SEQ ID NO: 449348 - DNA, 25 bp, Mus musculus
ggaaaggttttcagatgacacatac

SEQ ID NO: 449349 - DNA, 25 bp, Mus musculus
ggaaagtcagcgctcacattaagga

SEQ ID NO: 449350 - DNA, 25 bp, Mus musculus
ggaaagtcattcagtcccactagtg

SEQ ID NO: 449351 - DNA, 25 bp, Mus musculus
ggaaagtccaaccacgaagccatgg

SEQ ID NO: 449352 - DNA, 25 bp, Mus musculus
ggaaagtccttctggtcctgcccaa

SEQ ID NO: 449353 - DNA, 25 bp, Mus musculus
ggaaagtgtgctgactgccacaagc

SEQ ID NO: 449354 - DNA, 25 bp, Mus musculus
ggaaagttatgaggactcaccccag

SEQ ID NO: 449355 - DNA, 25 bp, Mus musculus
ggaaagttgatgtgtggtccgccaa

SEQ ID NO: 449356 - DNA, 25 bp, Mus musculus
ggaaagtttctgcattctacttcag

SEQ ID NO: 449357 - DNA, 25 bp, Mus musculus
ggaaataacatggtaagtgattgag

SEQ ID NO: 449358 - DNA, 25 bp, Mus musculus
ggaaataactatgcccagggattaa

SEQ ID NO: 449359 - DNA, 25 bp, Mus musculus
ggaaataatacgctgcacactggag

SEQ ID NO: 449360 - DNA, 25 bp, Mus musculus
ggaaatacactagactggccagctg

SEQ ID NO: 449361 - DNA, 25 bp, Mus musculus
ggaaatacttcgagctgtgcctggc

SEQ ID NO: 449362 - DNA, 25 bp, Mus musculus
ggaaatacttcgttcagctctgcag

SEQ ID NO: 449363 - DNA, 25 bp, Mus musculus
ggaaatatacactctgggcaagaag

SEQ ID NO: 449364 - DNA, 25 bp, Mus musculus
ggaaatatcctagatagctgagcaa

SEQ ID NO: 449365 - DNA, 25 bp, Mus musculus
ggaaatatgctgtacagggttcact

SEQ ID NO: 449366 - DNA, 25 bp, Mus musculus
ggaaatatgtgttcctgcaccgcaa

SEQ ID NO: 449367 - DNA, 25 bp, Mus musculus
ggaaatcaaggtgtgcgacagccag

SEQ ID NO: 449368 - DNA, 25 bp, Mus musculus
ggaaatcaccctcatcacctgtgca

SEQ ID NO: 449369 - DNA, 25 bp, Mus musculus
ggaaatcaggccagacagaacagtg

SEQ ID NO: 449370 - DNA, 25 bp, Mus musculus
ggaaatcagtgtaccgtggctcgct

SEQ ID NO: 449371 - DNA, 25 bp, Mus musculus
ggaaatcatctttgctcctgagcag

SEQ ID NO: 449372 - DNA, 25 bp, Mus musculus
ggaaatcatgtctgcaggctcccag

SEQ ID NO: 449373 - DNA, 25 bp, Mus musculus
ggaaatccagacacggtagagaact

SEQ ID NO: 449374 - DNA, 25 bp, Mus musculus
ggaaatccaggcttcactgagagaa

SEQ ID NO: 449375 - DNA, 25 bp, Mus musculus
ggaaatccagtccagggcaagcact

SEQ ID NO: 449376 - DNA, 25 bp, Mus musculus
ggaaatccatttcaattgctctgca

SEQ ID NO: 449377 - DNA, 25 bp, Mus musculus
ggaaatccctaccaaaaactagctg

SEQ ID NO: 449378 - DNA, 25 bp, Mus musculus
ggaaatccctttgagcccttcccag

SEQ ID NO: 449379 - DNA, 25 bp, Mus musculus
ggaaatccgaatcacccacatgttg

SEQ ID NO: 449380 - DNA, 25 bp, Mus musculus
ggaaatcctctgtgcccaacatgta

SEQ ID NO: 449381 - DNA, 25 bp, Mus musculus
ggaaatccttacagtcaacggagaa

SEQ ID NO: 449382 - DNA, 25 bp, Mus musculus
ggaaatcgccattacccacactggg

SEQ ID NO: 449383 - DNA, 25 bp, Mus musculus
ggaaatcggccttcaccaagactga

SEQ ID NO: 449384 - DNA, 25 bp, Mus musculus
ggaaatcgtgcacctgcaagccggt

SEQ ID NO: 449385 - DNA, 25 bp, Mus musculus
ggaaatctactttgcgtacgagagg

SEQ ID NO: 449386 - DNA, 25 bp, Mus musculus
ggaaatctgtactgctggatgctca

SEQ ID NO: 449387 - DNA, 25 bp, Mus musculus
ggaaatctttcgtgacaatgccgtc

SEQ ID NO: 449388 - DNA, 25 bp, Mus musculus
ggaaatgaaacttgttctcccgact

SEQ ID NO: 449389 - DNA, 25 bp, Mus musculus
ggaaatgaagacagtccgtttcata

SEQ ID NO: 449390 - DNA, 25 bp, Mus musculus
ggaaatgacaacgtcagcgccacag

SEQ ID NO: 449391 - DNA, 25 bp, Mus musculus
ggaaatgcagctcgagaagcccaga

SEQ ID NO: 449392 - DNA, 25 bp, Mus musculus
ggaaatgcaggatctaaccagcccg

SEQ ID NO: 449393 - DNA, 25 bp, Mus musculus
ggaaatgccaagaccgactctagag

SEQ ID NO: 449394 - DNA, 25 bp, Mus musculus
ggaaatgcccggtgtcctgccatcg

SEQ ID NO: 449395 - DNA, 25 bp, Mus musculus
ggaaatgcgtatacttctcaggctg

SEQ ID NO: 449396 - DNA, 25 bp, Mus musculus
ggaaatgctccttggtacctgtggt

SEQ ID NO: 449397 - DNA, 25 bp, Mus musculus
ggaaatgggtattgtaggtatgact

SEQ ID NO: 449398 - DNA, 25 bp, Mus musculus
ggaaatgtagtccagcagctcgtgt

SEQ ID NO: 449399 - DNA, 25 bp, Mus musculus
ggaaatgtccaactccaaagagctg

SEQ ID NO: 449400 - DNA, 25 bp, Mus musculus
ggaaatgtccttttgagccagctca

SEQ ID NO: 449401 - DNA, 25 bp, Mus musculus
ggaaatgtttccattacaaagtagc

SEQ ID NO: 449402 - DNA, 25 bp, Mus musculus
ggaaattcaaaaggtacagactata

SEQ ID NO: 449403 - DNA, 25 bp, Mus musculus
ggaaattcgagttggccctagccac

SEQ ID NO: 449404 - DNA, 25 bp, Mus musculus
ggaaattcttgcactgtaccccggt

SEQ ID NO: 449405 - DNA, 25 bp, Mus musculus
ggaaattgtgagacttcagtaccca

SEQ ID NO: 449406 - DNA, 25 bp, Mus musculus
ggaaatttctaggaacacagcagag

SEQ ID NO: 449407 - DNA, 25 bp, Mus musculus
ggaaatttgaacactctgagctggc

SEQ ID NO: 449408 - DNA, 25 bp, Mus musculus
ggaacaaacacagagacctacagct

SEQ ID NO: 449409 - DNA, 25 bp, Mus musculus
ggaacaaagggctggagtctcacag

SEQ ID NO: 449410 - DNA, 25 bp, Mus musculus
ggaacaacacctgcttctggaggaa

SEQ ID NO: 449411 - DNA, 25 bp, Mus musculus
ggaacaacaggcctcggccgagctt

SEQ ID NO: 449412 - DNA, 25 bp, Mus musculus
ggaacaactgttatgggaccacctg

SEQ ID NO: 449413 - DNA, 25 bp, Mus musculus
ggaacaagctgtgcgatctagacca

SEQ ID NO: 449414 - DNA, 25 bp, Mus musculus
ggaacaataaagaggcctgcacagc

SEQ ID NO: 449415 - DNA, 25 bp, Mus musculus
ggaacaatctacagaccagatagtg

SEQ ID NO: 449416 - DNA, 25 bp, Mus musculus
ggaacacaactaccgactgaagcag

SEQ ID NO: 449417 - DNA, 25 bp, Mus musculus
ggaacacaactatagctcgcctgca

SEQ ID NO: 449418 - DNA, 25 bp, Mus musculus
ggaacacacacttgggagcctcagt

SEQ ID NO: 449419 - DNA, 25 bp, Mus musculus
ggaacacacttctttcagttaacta

SEQ ID NO: 449420 - DNA, 25 bp, Mus musculus
ggaacacagccgtcacacttggtgt

SEQ ID NO: 449421 - DNA, 25 bp, Mus musculus
ggaacacattggacctgacacactg

SEQ ID NO: 449422 - DNA, 25 bp, Mus musculus
ggaacaccagctctaaccgggagaa

SEQ ID NO: 449423 - DNA, 25 bp, Mus musculus
ggaacaccaggtcaaaacttacatc

SEQ ID NO: 449424 - DNA, 25 bp, Mus musculus
ggaacacccttagaataagaatcat

SEQ ID NO: 449425 - DNA, 25 bp, Mus musculus
ggaacacctggtgagccatcactca

SEQ ID NO: 449426 - DNA, 25 bp, Mus musculus
ggaacacgagctgttacggccgcat

SEQ ID NO: 449427 - DNA, 25 bp, Mus musculus
ggaacacgatcctccttctgggcat

SEQ ID NO: 449428 - DNA, 25 bp, Mus musculus
ggaacacgttcatcgggactcccta

SEQ ID NO: 449429 - DNA, 25 bp, Mus musculus
ggaacactcccgagctagactaggg

SEQ ID NO: 449430 - DNA, 25 bp, Mus musculus
ggaacactctgctgattgccgggct

SEQ ID NO: 449431 - DNA, 25 bp, Mus musculus
ggaacactgaggagctaggccatga

SEQ ID NO: 449432 - DNA, 25 bp, Mus musculus
ggaacactgcgatcgccaagaaagg

SEQ ID NO: 449433 - DNA, 25 bp, Mus musculus
ggaacacttcccatgtaggcccgtg

SEQ ID NO: 449434 - DNA, 25 bp, Mus musculus
ggaacactttcggtagcaccctata

SEQ ID NO: 449435 - DNA, 25 bp, Mus musculus
ggaacagatgaaatgatgagtctga

SEQ ID NO: 449436 - DNA, 25 bp, Mus musculus
ggaacagcctgtcattgaaccagaa

SEQ ID NO: 449437 - DNA, 25 bp, Mus musculus
ggaacagctctggtataacggcaag

SEQ ID NO: 449438 - DNA, 25 bp, Mus musculus
ggaacagctctgtgtgtgacgaaag

SEQ ID NO: 449439 - DNA, 25 bp, Mus musculus
ggaacagctgttcttggaccacaat

SEQ ID NO: 449440 - DNA, 25 bp, Mus musculus
ggaacagctttccttgcctactgga

SEQ ID NO: 449441 - DNA, 25 bp, Mus musculus
ggaacaggacactttgctacacatc

SEQ ID NO: 449442 - DNA, 25 bp, Mus musculus
ggaacaggagcctgagaacccacat

SEQ ID NO: 449443 - DNA, 25 bp, Mus musculus
ggaacaggttctctactaagggcaa

SEQ ID NO: 449444 - DNA, 25 bp, Mus musculus
ggaacagtaaagacagtgccaccag

SEQ ID NO: 449445 - DNA, 25 bp, Mus musculus
ggaacagtgatgagcacaccacgga

SEQ ID NO: 449446 - DNA, 25 bp, Mus musculus
ggaacagttgatttctaatacggcg

SEQ ID NO: 449447 - DNA, 25 bp, Mus musculus
ggaacataattaacaccaggcagag

SEQ ID NO: 449448 - DNA, 25 bp, Mus musculus
ggaacatacctcttgagaccctcgg

SEQ ID NO: 449449 - DNA, 25 bp, Mus musculus
ggaacatatcaccagccttggcaag

SEQ ID NO: 449450 - DNA, 25 bp, Mus musculus
ggaacatatggagcaggaactggaa

SEQ ID NO: 449451 - DNA, 25 bp, Mus musculus
ggaacatcggtacaccctgagaact

SEQ ID NO: 449452 - DNA, 25 bp, Mus musculus
ggaacatctccgaaactccctgtgg

SEQ ID NO: 449453 - DNA, 25 bp, Mus musculus
ggaacatgaactccctagctccttg

SEQ ID NO: 449454 - DNA, 25 bp, Mus musculus
ggaacatgcacttttccattcctga

SEQ ID NO: 449455 - DNA, 25 bp, Mus musculus
ggaacatggtgacttagaactgtgc

SEQ ID NO: 449456 - DNA, 25 bp, Mus musculus
ggaacatgtctgagtaccccggagt

SEQ ID NO: 449457 - DNA, 25 bp, Mus musculus
ggaacattgattctaagccccactg

SEQ ID NO: 449458 - DNA, 25 bp, Mus musculus
ggaacattgctacatactacggtgc

SEQ ID NO: 449459 - DNA, 25 bp, Mus musculus
ggaacattgctggacttatccggca

SEQ ID NO: 449460 - DNA, 25 bp, Mus musculus
ggaaccaactcagattcacagacag

SEQ ID NO: 449461 - DNA, 25 bp, Mus musculus
ggaaccacaccaatctctctttggc

SEQ ID NO: 449462 - DNA, 25 bp, Mus musculus
ggaaccacgcgcaacagaactttgc

SEQ ID NO: 449463 - DNA, 25 bp, Mus musculus
ggaaccacgctgacatttgacactg

SEQ ID NO: 449464 - DNA, 25 bp, Mus musculus
ggaaccagtggcatacggacaccat

SEQ ID NO: 449465 - DNA, 25 bp, Mus musculus
ggaaccagtttcagcagatcaagag

SEQ ID NO: 449466 - DNA, 25 bp, Mus musculus
ggaaccatggtgaactgtctaggca

SEQ ID NO: 449467 - DNA, 25 bp, Mus musculus
ggaacccagcaaggcggtgcctgat

SEQ ID NO: 449468 - DNA, 25 bp, Mus musculus
ggaacccagctgacactctcgggca

SEQ ID NO: 449469 - DNA, 25 bp, Mus musculus
ggaacccattcagtaggcacagtgc

SEQ ID NO: 449470 - DNA, 25 bp, Mus musculus
ggaaccccagcgatgtcaggacatt

SEQ ID NO: 449471 - DNA, 25 bp, Mus musculus
ggaaccctagtaatgataatcgtga

SEQ ID NO: 449472 - DNA, 25 bp, Mus musculus
ggaaccctatctttgctgaggcgga

SEQ ID NO: 449473 - DNA, 25 bp, Mus musculus
ggaaccctgctgagacctttcaaag

SEQ ID NO: 449474 - DNA, 25 bp, Mus musculus
ggaaccctggtgtctcaattcagca

SEQ ID NO: 449475 - DNA, 25 bp, Mus musculus
ggaacccttcaccttaatgttgcgt

SEQ ID NO: 449476 - DNA, 25 bp, Mus musculus
ggaaccctttgtgccagaacctgga

SEQ ID NO: 449477 - DNA, 25 bp, Mus musculus
ggaacccttttctgtccctgagtga

SEQ ID NO: 449478 - DNA, 25 bp, Mus musculus
ggaaccgagccttacagagcctgat

SEQ ID NO: 449479 - DNA, 25 bp, Mus musculus
ggaaccgcagcttctcccgatttgt

SEQ ID NO: 449480 - DNA, 25 bp, Mus musculus
ggaaccgcatccaaaatcctcagga

SEQ ID NO: 449481 - DNA, 25 bp, Mus musculus
ggaaccgcttatatgtccacccaga

SEQ ID NO: 449482 - DNA, 25 bp, Mus musculus
ggaaccgctttctgcacatgcatga

SEQ ID NO: 449483 - DNA, 25 bp, Mus musculus
ggaaccgggaagatttgcacacaga

SEQ ID NO: 449484 - DNA, 25 bp, Mus musculus
ggaacctaacaatgacggagatgag

SEQ ID NO: 449485 - DNA, 25 bp, Mus musculus
ggaacctaactttgctgagtctcag

SEQ ID NO: 449486 - DNA, 25 bp, Mus musculus
ggaacctaccggatctagaaggacg

SEQ ID NO: 449487 - DNA, 25 bp, Mus musculus
ggaacctactgctacatcatgaaga

SEQ ID NO: 449488 - DNA, 25 bp, Mus musculus
ggaacctcaagggacgagacacagt

SEQ ID NO: 449489 - DNA, 25 bp, Mus musculus
ggaacctcatcataaagccagtggg

SEQ ID NO: 449490 - DNA, 25 bp, Mus musculus
ggaacctcatggaccttgctgaagg

SEQ ID NO: 449491 - DNA, 25 bp, Mus musculus
ggaacctgatggtatctccgcctgt

SEQ ID NO: 449492 - DNA, 25 bp, Mus musculus
ggaacctggagctcacacaagttgg

SEQ ID NO: 449493 - DNA, 25 bp, Mus musculus
ggaacctgtccctgtcgctggtgga

SEQ ID NO: 449494 - DNA, 25 bp, Mus musculus
ggaacctgtcgaactgaagactcag

SEQ ID NO: 449495 - DNA, 25 bp, Mus musculus
ggaacctgtgtaccatgcaactgca

SEQ ID NO: 449496 - DNA, 25 bp, Mus musculus
ggaaccttctgtaacgcctgcacaa

SEQ ID NO: 449497 - DNA, 25 bp, Mus musculus
ggaaccttgtaaccctgagccatta

SEQ ID NO: 449498 - DNA, 25 bp, Mus musculus
ggaacgacctctggatgcacatgtg

SEQ ID NO: 449499 - DNA, 25 bp, Mus musculus
ggaacgcactttccggatgccgaag

SEQ ID NO: 449500 - DNA, 25 bp, Mus musculus
ggaacgcagtgcacatcaagggacc

SEQ ID NO: 449501 - DNA, 25 bp, Mus musculus
ggaacgccagcatcaacattacgga

SEQ ID NO: 449502 - DNA, 25 bp, Mus musculus
ggaacgcctgctctaacttacacgg

SEQ ID NO: 449503 - DNA, 25 bp, Mus musculus
ggaacgccttggaccttttcagaca

SEQ ID NO: 449504 - DNA, 25 bp, Mus musculus
ggaacgctcagatttcatcggtgaa

SEQ ID NO: 449505 - DNA, 25 bp, Mus musculus
ggaacgctccactctggatcaggta

SEQ ID NO: 449506 - DNA, 25 bp, Mus musculus
ggaacgctctgctaaaccacaagga

SEQ ID NO: 449507 - DNA, 25 bp, Mus musculus
ggaacgctgccaaagaattgagctg

SEQ ID NO: 449508 - DNA, 25 bp, Mus musculus
ggaacgctgcctgcttagagcccat

SEQ ID NO: 449509 - DNA, 25 bp, Mus musculus
ggaacgcttccgctgtaacatcgac

SEQ ID NO: 449510 - DNA, 25 bp, Mus musculus
ggaacgcttctcttatgtttctacc

SEQ ID NO: 449511 - DNA, 25 bp, Mus musculus
ggaacgtcagctccctctacagcat

SEQ ID NO: 449512 - DNA, 25 bp, Mus musculus
ggaacgtggcaaacctcatcagcat

SEQ ID NO: 449513 - DNA, 25 bp, Mus musculus
ggaacgtgggcagtctcctctgtgt

SEQ ID NO: 449514 - DNA, 25 bp, Mus musculus
ggaacgttctcccatacagtaaata

SEQ ID NO: 449515 - DNA, 25 bp, Mus musculus
ggaacgttgcctcgatgacgacaca

SEQ ID NO: 449516 - DNA, 25 bp, Mus musculus
ggaactaaagttggatgcgccctat

SEQ ID NO: 449517 - DNA, 25 bp, Mus musculus
ggaactaagtggtgataaggcaccc

SEQ ID NO: 449518 - DNA, 25 bp, Mus musculus
ggaactacagagcaaataacaaggg

SEQ ID NO: 449519 - DNA, 25 bp, Mus musculus
ggaactacagcaccgtctcatcgag

SEQ ID NO: 449520 - DNA, 25 bp, Mus musculus
ggaactacagcatcctgaccttgga

SEQ ID NO: 449521 - DNA, 25 bp, Mus musculus
ggaactacgttgtcctcagctggga

SEQ ID NO: 449522 - DNA, 25 bp, Mus musculus
ggaactactgtaagaagaccccact

SEQ ID NO: 449523 - DNA, 25 bp, Mus musculus
ggaactataccatgaaaccctgagc

SEQ ID NO: 449524 - DNA, 25 bp, Mus musculus
ggaactattactacagcctggccag

SEQ ID NO: 449525 - DNA, 25 bp, Mus musculus
ggaactcaaccagctactgaaagga

SEQ ID NO: 449526 - DNA, 25 bp, Mus musculus
ggaactcaccagcttaatgcttaca

SEQ ID NO: 449527 - DNA, 25 bp, Mus musculus
ggaactccactatgcaaagacccac

SEQ ID NO: 449528 - DNA, 25 bp, Mus musculus
ggaactcccattgcctcttatgaag

SEQ ID NO: 449529 - DNA, 25 bp, Mus musculus
ggaactcccctgtgattgcagtaaa

SEQ ID NO: 449530 - DNA, 25 bp, Mus musculus
ggaactccgtcagtgcaacctgcaa

SEQ ID NO: 449531 - DNA, 25 bp, Mus musculus
ggaactccttaaactgcagtgcaga

SEQ ID NO: 449532 - DNA, 25 bp, Mus musculus
ggaactcgagtgagtttcagtgccc

SEQ ID NO: 449533 - DNA, 25 bp, Mus musculus
ggaactcttaagtttctctacggtg

SEQ ID NO: 449534 - DNA, 25 bp, Mus musculus
ggaactgagacaccctaagactggc

SEQ ID NO: 449535 - DNA, 25 bp, Mus musculus
ggaactgagctcatcgactccttgg

SEQ ID NO: 449536 - DNA, 25 bp, Mus musculus
ggaactgatcctaacagaagcactg

SEQ ID NO: 449537 - DNA, 25 bp, Mus musculus
ggaactgcatgagccatttctttgt

SEQ ID NO: 449538 - DNA, 25 bp, Mus musculus
ggaactgcccagattggagacggaa

SEQ ID NO: 449539 - DNA, 25 bp, Mus musculus
ggaactgctaatcaaccatgggaag

SEQ ID NO: 449540 - DNA, 25 bp, Mus musculus
ggaactgctccggtctcaatgatga

SEQ ID NO: 449541 - DNA, 25 bp, Mus musculus
ggaactggcaagctcacgtgtgtca

SEQ ID NO: 449542 - DNA, 25 bp, Mus musculus
ggaactggcgtacctgcggcttaat

SEQ ID NO: 449543 - DNA, 25 bp, Mus musculus
ggaactgggcagagccagtcttctg

SEQ ID NO: 449544 - DNA, 25 bp, Mus musculus
ggaactggtgcagaacgtctgcccc

SEQ ID NO: 449545 - DNA, 25 bp, Mus musculus
ggaactggttgcttcatcatgggca

SEQ ID NO: 449546 - DNA, 25 bp, Mus musculus
ggaactgtacaatctacacaaaagg

SEQ ID NO: 449547 - DNA, 25 bp, Mus musculus
ggaactgtgttaccaaagtgtttat

SEQ ID NO: 449548 - DNA, 25 bp, Mus musculus
ggaactgttatttcaccctcgaggg

SEQ ID NO: 449549 - DNA, 25 bp, Mus musculus
ggaactgttcagtgctcgccctatg

SEQ ID NO: 449550 - DNA, 25 bp, Mus musculus
ggaactgttgcagcctctctcaggc

SEQ ID NO: 449551 - DNA, 25 bp, Mus musculus
ggaacttaacttacacatgccgtgc

SEQ ID NO: 449552 - DNA, 25 bp, Mus musculus
ggaacttacaatctgcgagccagga

SEQ ID NO: 449553 - DNA, 25 bp, Mus musculus
ggaacttaccagttatgccaggcta

SEQ ID NO: 449554 - DNA, 25 bp, Mus musculus
ggaacttccaagcaaagcccgatga

SEQ ID NO: 449555 - DNA, 25 bp, Mus musculus
ggaacttcgcagacacttgacggac

SEQ ID NO: 449556 - DNA, 25 bp, Mus musculus
ggaacttcgccaagagcctagaggg

SEQ ID NO: 449557 - DNA, 25 bp, Mus musculus
ggaacttcgtcatgtcagcagccca

SEQ ID NO: 449558 - DNA, 25 bp, Mus musculus
ggaacttctgcgatgggacctcatg

SEQ ID NO: 449559 - DNA, 25 bp, Mus musculus
ggaacttgactactgaagcagcaga

SEQ ID NO: 449560 - DNA, 25 bp, Mus musculus
ggaacttgccctttgccctggtaga

SEQ ID NO: 449561 - DNA, 25 bp, Mus musculus
ggaacttgctgagtaaaccagacct

SEQ ID NO: 449562 - DNA, 25 bp, Mus musculus
ggaacttggacacaactctggcttg

SEQ ID NO: 449563 - DNA, 25 bp, Mus musculus
ggaacttggagaactgagaaataaa

SEQ ID NO: 449564 - DNA, 25 bp, Mus musculus
ggaactttccatcctcccatctgtt

SEQ ID NO: 449565 - DNA, 25 bp, Mus musculus
ggaacttttgggtcctctcgcggcg

SEQ ID NO: 449566 - DNA, 25 bp, Mus musculus
ggaagaaactttgggacctgctgga

SEQ ID NO: 449567 - DNA, 25 bp, Mus musculus
ggaagaaagtaagaccccggctgat

SEQ ID NO: 449568 - DNA, 25 bp, Mus musculus
ggaagaaatacaccaagccctacga

SEQ ID NO: 449569 - DNA, 25 bp, Mus musculus
ggaagaaatgagtgccctgctggcc

SEQ ID NO: 449570 - DNA, 25 bp, Mus musculus
ggaagaaattactcgcagccggaca

SEQ ID NO: 449571 - DNA, 25 bp, Mus musculus
ggaagaacagaaggatgccacaact

SEQ ID NO: 449572 - DNA, 25 bp, Mus musculus
ggaagaacagtcaccactttgagaa

SEQ ID NO: 449573 - DNA, 25 bp, Mus musculus
ggaagaacataccagaaagccatca

SEQ ID NO: 449574 - DNA, 25 bp, Mus musculus
ggaagaacctcctcatgaagcacga

SEQ ID NO: 449575 - DNA, 25 bp, Mus musculus
ggaagaacgcagttgagtcaccact

SEQ ID NO: 449576 - DNA, 25 bp, Mus musculus
ggaagaagaaccacaaatgtggcca

SEQ ID NO: 449577 - DNA, 25 bp, Mus musculus
ggaagaagccacctaaaccatgaga

SEQ ID NO: 449578 - DNA, 25 bp, Mus musculus
ggaagaagcctcacatcgtcatcag

SEQ ID NO: 449579 - DNA, 25 bp, Mus musculus
ggaagaatatggagacacacacgtg

SEQ ID NO: 449580 - DNA, 25 bp, Mus musculus
ggaagaatctgagagcccaggccat

SEQ ID NO: 449581 - DNA, 25 bp, Mus musculus
ggaagaatctttacctgcccctaca

SEQ ID NO: 449582 - DNA, 25 bp, Mus musculus
ggaagaatctttttgtcaggcctga

SEQ ID NO: 449583 - DNA, 25 bp, Mus musculus
ggaagaatgctacacaccgagggct

SEQ ID NO: 449584 - DNA, 25 bp, Mus musculus
ggaagaatgtacaggccactctgaa

SEQ ID NO: 449585 - DNA, 25 bp, Mus musculus
ggaagaattgctgaagcctgcccca

SEQ ID NO: 449586 - DNA, 25 bp, Mus musculus
ggaagaatttcccagccacttagag

SEQ ID NO: 449587 - DNA, 25 bp, Mus musculus
ggaagacactcaagaccacaaaatt

SEQ ID NO: 449588 - DNA, 25 bp, Mus musculus
ggaagacagccctggaaatggtcca

SEQ ID NO: 449589 - DNA, 25 bp, Mus musculus
ggaagacatcttcacatagggctct

SEQ ID NO: 449590 - DNA, 25 bp, Mus musculus
ggaagacatggagtagacctggtta

SEQ ID NO: 449591 - DNA, 25 bp, Mus musculus
ggaagacattgtgaaccgtgacgga

SEQ ID NO: 449592 - DNA, 25 bp, Mus musculus
ggaagacattgttggcccgcgctgt

SEQ ID NO: 449593 - DNA, 25 bp, Mus musculus
ggaagaccatgcatcaccaactgga

SEQ ID NO: 449594 - DNA, 25 bp, Mus musculus
ggaagacccggaaatcagacaaaag

SEQ ID NO: 449595 - DNA, 25 bp, Mus musculus
ggaagaccctgagtctcagcgtccg

SEQ ID NO: 449596 - DNA, 25 bp, Mus musculus
ggaagacctcagcttgacactcatc

SEQ ID NO: 449597 - DNA, 25 bp, Mus musculus
ggaagactacccacagaaagagatc

SEQ ID NO: 449598 - DNA, 25 bp, Mus musculus
ggaagactcagacgtcacagactag

SEQ ID NO: 449599 - DNA, 25 bp, Mus musculus
ggaagactcccgattcaaagtggcg

SEQ ID NO: 449600 - DNA, 25 bp, Mus musculus
ggaagactctatgcatcatgacggc

SEQ ID NO: 449601 - DNA, 25 bp, Mus musculus
ggaagactgagcaggcccacagtat

SEQ ID NO: 449602 - DNA, 25 bp, Mus musculus
ggaagactgcccctaacctgtgaat

SEQ ID NO: 449603 - DNA, 25 bp, Mus musculus
ggaagactgctaagggaaaacttgc

SEQ ID NO: 449604 - DNA, 25 bp, Mus musculus
ggaagacttcgaccctctagatgca

SEQ ID NO: 449605 - DNA, 25 bp, Mus musculus
ggaagagaaacatatatttgagaac

SEQ ID NO: 449606 - DNA, 25 bp, Mus musculus
ggaagagaagagtatccatctcatg

SEQ ID NO: 449607 - DNA, 25 bp, Mus musculus
ggaagagaattacctggcatcaata

SEQ ID NO: 449608 - DNA, 25 bp, Mus musculus
ggaagagacgagtcctcacgtcctt

SEQ ID NO: 449609 - DNA, 25 bp, Mus musculus
ggaagagactcccttgttacctttg

SEQ ID NO: 449610 - DNA, 25 bp, Mus musculus
ggaagagagtagtaattagcctgga

SEQ ID NO: 449611 - DNA, 25 bp, Mus musculus
ggaagagagtttgcgccactcaggc

SEQ ID NO: 449612 - DNA, 25 bp, Mus musculus
ggaagagccacccagttatttgaaa

SEQ ID NO: 449613 - DNA, 25 bp, Mus musculus
ggaagagccatagaagagcgagccc

SEQ ID NO: 449614 - DNA, 25 bp, Mus musculus
ggaagagccccacctgtgaactgct

SEQ ID NO: 449615 - DNA, 25 bp, Mus musculus
ggaagagtcccaaattagaagacag

SEQ ID NO: 449616 - DNA, 25 bp, Mus musculus
ggaagagtccccactgttgacagga

SEQ ID NO: 449617 - DNA, 25 bp, Mus musculus
ggaagagtgcctatgacccaaagtc

SEQ ID NO: 449618 - DNA, 25 bp, Mus musculus
ggaagagtggctgggaaagttccca

SEQ ID NO: 449619 - DNA, 25 bp, Mus musculus
ggaagagtgtcccagcagctatatc

SEQ ID NO: 449620 - DNA, 25 bp, Mus musculus
ggaagagtttgatgatacactccag

SEQ ID NO: 449621 - DNA, 25 bp, Mus musculus
ggaagagtttgtccctaattcattc

SEQ ID NO: 449622 - DNA, 25 bp, Mus musculus
ggaagataccttcaactggcctaga

SEQ ID NO: 449623 - DNA, 25 bp, Mus musculus
ggaagatcaccaacaatgtgcagcg

SEQ ID NO: 449624 - DNA, 25 bp, Mus musculus
ggaagatcctgtgccaatcaaacga

SEQ ID NO: 449625 - DNA, 25 bp, Mus musculus
ggaagatccttgtaggcagtgacga

SEQ ID NO: 449626 - DNA, 25 bp, Mus musculus
ggaagatctacctcaagctactggg

SEQ ID NO: 449627 - DNA, 25 bp, Mus musculus
ggaagatcttctacgagtcgaggcc

SEQ ID NO: 449628 - DNA, 25 bp, Mus musculus
ggaagatgctcaatccctggatgat

SEQ ID NO: 449629 - DNA, 25 bp, Mus musculus
ggaagatggctttactggcctcaaa

SEQ ID NO: 449630 - DNA, 25 bp, Mus musculus
ggaagatgtcaaacgaagggcacct

SEQ ID NO: 449631 - DNA, 25 bp, Mus musculus
ggaagatgtccaccacagtcaaggt

SEQ ID NO: 449632 - DNA, 25 bp, Mus musculus
ggaagatgtcttagccatggcaaag

SEQ ID NO: 449633 - DNA, 25 bp, Mus musculus
ggaagatgtttgtcctcactgtttc

SEQ ID NO: 449634 - DNA, 25 bp, Mus musculus
ggaagattagaaactgcccctctgg

SEQ ID NO: 449635 - DNA, 25 bp, Mus musculus
ggaagattgctgtacatgccgccct

SEQ ID NO: 449636 - DNA, 25 bp, Mus musculus
ggaagattttccacatcgacaccaa

SEQ ID NO: 449637 - DNA, 25 bp, Mus musculus
ggaagcaaacagcacagtcgccttt

SEQ ID NO: 449638 - DNA, 25 bp, Mus musculus
ggaagcaaagagaagtcccatcctt

SEQ ID NO: 449639 - DNA, 25 bp, Mus musculus
ggaagcaacggtgttcactgcgccc

SEQ ID NO: 449640 - DNA, 25 bp, Mus musculus
ggaagcaactgaacgacactctgga

SEQ ID NO: 449641 - DNA, 25 bp, Mus musculus
ggaagcaagcactcctggaagggct

SEQ ID NO: 449642 - DNA, 25 bp, Mus musculus
ggaagcaagccgctgaaagccatta

SEQ ID NO: 449643 - DNA, 25 bp, Mus musculus
ggaagcacggagttctaggcagccg

SEQ ID NO: 449644 - DNA, 25 bp, Mus musculus
ggaagcagcgctcttcccaagcagc

SEQ ID NO: 449645 - DNA, 25 bp, Mus musculus
ggaagcaggctcacaatggagacca

SEQ ID NO: 449646 - DNA, 25 bp, Mus musculus
ggaagcaggctttcacacatacaca

SEQ ID NO: 449647 - DNA, 25 bp, Mus musculus
ggaagcagtttacgctcccacccaa

SEQ ID NO: 449648 - DNA, 25 bp, Mus musculus
ggaagcatgctcacctatgaagcca

SEQ ID NO: 449649 - DNA, 25 bp, Mus musculus
ggaagcattttcctggctgattaaa

SEQ ID NO: 449650 - DNA, 25 bp, Mus musculus
ggaagccaaccccaactgaagctga

SEQ ID NO: 449651 - DNA, 25 bp, Mus musculus
ggaagccagagtctatcttgtatga

SEQ ID NO: 449652 - DNA, 25 bp, Mus musculus
ggaagccatccccaggccatcgtgt

SEQ ID NO: 449653 - DNA, 25 bp, Mus musculus
ggaagcccaagagcatcactgacat

SEQ ID NO: 449654 - DNA, 25 bp, Mus musculus
ggaagcccctgctgttgcatcggaa

SEQ ID NO: 449655 - DNA, 25 bp, Mus musculus
ggaagccctccttgactgtaactga

SEQ ID NO: 449656 - DNA, 25 bp, Mus musculus
ggaagcccttggtctctttggagag

SEQ ID NO: 449657 - DNA, 25 bp, Mus musculus
ggaagccggtgttcatttatgacca

SEQ ID NO: 449658 - DNA, 25 bp, Mus musculus
ggaagccgtctctatctgcaaagga

SEQ ID NO: 449659 - DNA, 25 bp, Mus musculus
ggaagcctatttccgtgaacccgca

SEQ ID NO: 449660 - DNA, 25 bp, Mus musculus
ggaagcctccttggcagaaacagaa

SEQ ID NO: 449661 - DNA, 25 bp, Mus musculus
ggaagcctcttcattatgctgcaga

SEQ ID NO: 449662 - DNA, 25 bp, Mus musculus
ggaagccttccctagagagccagct

SEQ ID NO: 449663 - DNA, 25 bp, Mus musculus
ggaagccttcctacaatcattactg

SEQ ID NO: 449664 - DNA, 25 bp, Mus musculus
ggaagccttgctatcctgggcaaca

SEQ ID NO: 449665 - DNA, 25 bp, Mus musculus
ggaagcctttggtttgaccacataa

SEQ ID NO: 449666 - DNA, 25 bp, Mus musculus
ggaagcgcagcgagcactctgaatt

SEQ ID NO: 449667 - DNA, 25 bp, Mus musculus
ggaagcgtgtgaacagcagtccctc

SEQ ID NO: 449668 - DNA, 25 bp, Mus musculus
ggaagcgttatccaggacagtgcta

SEQ ID NO: 449669 - DNA, 25 bp, Mus musculus
ggaagctaaacacctcagctatctg

SEQ ID NO: 449670 - DNA, 25 bp, Mus musculus
ggaagctaatgtctgtctcaagaca

SEQ ID NO: 449671 - DNA, 25 bp, Mus musculus
ggaagctagagaccacagtgaacct

SEQ ID NO: 449672 - DNA, 25 bp, Mus musculus
ggaagctcgcctgtcctctaagagg

SEQ ID NO: 449673 - DNA, 25 bp, Mus musculus
ggaagctctaaggaaaaccacggag

SEQ ID NO: 449674 - DNA, 25 bp, Mus musculus
ggaagctctgatccagctccgtgca

SEQ ID NO: 449675 - DNA, 25 bp, Mus musculus
ggaagctgatttcatggaggtcacc

SEQ ID NO: 449676 - DNA, 25 bp, Mus musculus
ggaagcttccgctccttcagaaaac

SEQ ID NO: 449677 - DNA, 25 bp, Mus musculus
ggaagcttcttgatgcccgactgca

SEQ ID NO: 449678 - DNA, 25 bp, Mus musculus
ggaagcttgaaatcatccctgcgag

SEQ ID NO: 449679 - DNA, 25 bp, Mus musculus
ggaagcttggctgggcagtctctta

SEQ ID NO: 449680 - DNA, 25 bp, Mus musculus
ggaagcttgtgagccttgtaggcca

SEQ ID NO: 449681 - DNA, 25 bp, Mus musculus
ggaagctttcatccatccaatagga

SEQ ID NO: 449682 - DNA, 25 bp, Mus musculus
ggaagctttcttagggcccaatgct

SEQ ID NO: 449683 - DNA, 25 bp, Mus musculus
ggaaggaaagagagcagaacagcaa

SEQ ID NO: 449684 - DNA, 25 bp, Mus musculus
ggaaggaacgcctctcagagcctct

SEQ ID NO: 449685 - DNA, 25 bp, Mus musculus
ggaaggaagggtcttagccacacca

SEQ ID NO: 449686 - DNA, 25 bp, Mus musculus
ggaaggacccactcatactggagga

SEQ ID NO: 449687 - DNA, 25 bp, Mus musculus
ggaaggaccctcataacctcgaagg

SEQ ID NO: 449688 - DNA, 25 bp, Mus musculus
ggaaggacctcttatcatgcctgga

SEQ ID NO: 449689 - DNA, 25 bp, Mus musculus
ggaaggacctgttcttagagagtgt

SEQ ID NO: 449690 - DNA, 25 bp, Mus musculus
ggaaggacgactgatataaggccaa

SEQ ID NO: 449691 - DNA, 25 bp, Mus musculus
ggaaggacgattcagcatgctcaac

SEQ ID NO: 449692 - DNA, 25 bp, Mus musculus
ggaaggacggtgagtgtcccacact

SEQ ID NO: 449693 - DNA, 25 bp, Mus musculus
ggaaggagcaacacttaacctggct

SEQ ID NO: 449694 - DNA, 25 bp, Mus musculus
ggaaggatcaagctgtcaagagtac

SEQ ID NO: 449695 - DNA, 25 bp, Mus musculus
ggaaggatctctatgctaacaacgt

SEQ ID NO: 449696 - DNA, 25 bp, Mus musculus
ggaaggcaaaacaaacggctggctg

SEQ ID NO: 449697 - DNA, 25 bp, Mus musculus
ggaaggcaccaagctcgatgatgac

SEQ ID NO: 449698 - DNA, 25 bp, Mus musculus
ggaaggcaccatgtaccctctgttt

SEQ ID NO: 449699 - DNA, 25 bp, Mus musculus
ggaaggcagccattctgtgaccgct

SEQ ID NO: 449700 - DNA, 25 bp, Mus musculus
ggaaggccagattctagcccaatgg

SEQ ID NO: 449701 - DNA, 25 bp, Mus musculus
ggaaggcccttggaagcatcttgat

SEQ ID NO: 449702 - DNA, 25 bp, Mus musculus
ggaaggcctcttgtgcactggagac

SEQ ID NO: 449703 - DNA, 25 bp, Mus musculus
ggaaggcgactagtcactgatcatg

SEQ ID NO: 449704 - DNA, 25 bp, Mus musculus
ggaaggcggaacacgatgttagcaa

SEQ ID NO: 449705 - DNA, 25 bp, Mus musculus
ggaaggcgttcggtttgctcaaagc

SEQ ID NO: 449706 - DNA, 25 bp, Mus musculus
ggaaggctagcccacttccgcactt

SEQ ID NO: 449707 - DNA, 25 bp, Mus musculus
ggaaggctcaagaggcccggtaggc

SEQ ID NO: 449708 - DNA, 25 bp, Mus musculus
ggaaggctgcttgctcatctcacac

SEQ ID NO: 449709 - DNA, 25 bp, Mus musculus
ggaaggctggcacatactcctcagg

SEQ ID NO: 449710 - DNA, 25 bp, Mus musculus
ggaaggcttttggttggaaatcact

SEQ ID NO: 449711 - DNA, 25 bp, Mus musculus
ggaagggaacttgcaagactttgct

SEQ ID NO: 449712 - DNA, 25 bp, Mus musculus
ggaagggatcaatctcaagttcatg

SEQ ID NO: 449713 - DNA, 25 bp, Mus musculus
ggaagggcaccatcaaaaagcagtt

SEQ ID NO: 449714 - DNA, 25 bp, Mus musculus
ggaagggccctaccaagatgctaga

SEQ ID NO: 449715 - DNA, 25 bp, Mus musculus
ggaagggtcccatcaacttcaccgt

SEQ ID NO: 449716 - DNA, 25 bp, Mus musculus
ggaaggtaacgactgtaagaaagca

SEQ ID NO: 449717 - DNA, 25 bp, Mus musculus
ggaaggtatccatgtatctgcttac

SEQ ID NO: 449718 - DNA, 25 bp, Mus musculus
ggaaggtcctcagccataaacaggg

SEQ ID NO: 449719 - DNA, 25 bp, Mus musculus
ggaaggtctacaggcatcaatgagg

SEQ ID NO: 449720 - DNA, 25 bp, Mus musculus
ggaaggtggcctacatcaagctgga

SEQ ID NO: 449721 - DNA, 25 bp, Mus musculus
ggaaggtgtctcgatgcctgcctca

SEQ ID NO: 449722 - DNA, 25 bp, Mus musculus
ggaagtaaggctccctgtcacgctt

SEQ ID NO: 449723 - DNA, 25 bp, Mus musculus
ggaagtaagttctattggccattgt

SEQ ID NO: 449724 - DNA, 25 bp, Mus musculus
ggaagtaccatccaactccaggctt

SEQ ID NO: 449725 - DNA, 25 bp, Mus musculus
ggaagtactgcttccagggcctccc

SEQ ID NO: 449726 - DNA, 25 bp, Mus musculus
ggaagtacttcaccaccaaagccat

SEQ ID NO: 449727 - DNA, 25 bp, Mus musculus
ggaagtaggtctagcccaagtccag

SEQ ID NO: 449728 - DNA, 25 bp, Mus musculus
ggaagtatgctacactacaaaggag

SEQ ID NO: 449729 - DNA, 25 bp, Mus musculus
ggaagtatggtctgagttctgtaca

SEQ ID NO: 449730 - DNA, 25 bp, Mus musculus
ggaagtcaacatttcaatgcctctg

SEQ ID NO: 449731 - DNA, 25 bp, Mus musculus
ggaagtcaagaaatgaaagcgggca

SEQ ID NO: 449732 - DNA, 25 bp, Mus musculus
ggaagtcaccatctcaagccaaggc

SEQ ID NO: 449733 - DNA, 25 bp, Mus musculus
ggaagtcagctctttcatacgtgcg

SEQ ID NO: 449734 - DNA, 25 bp, Mus musculus
ggaagtcagtgtaagcgacccacct

SEQ ID NO: 449735 - DNA, 25 bp, Mus musculus
ggaagtcatacacccgatgcacaga

SEQ ID NO: 449736 - DNA, 25 bp, Mus musculus
ggaagtcatccgaacctaggctgag

SEQ ID NO: 449737 - DNA, 25 bp, Mus musculus
ggaagtcatggtaagcctgttttca

SEQ ID NO: 449738 - DNA, 25 bp, Mus musculus
ggaagtcccaactgaccctaggctg

SEQ ID NO: 449739 - DNA, 25 bp, Mus musculus
ggaagtccccaaggtttacatggca

SEQ ID NO: 449740 - DNA, 25 bp, Mus musculus
ggaagtccgcagttaccttgtgcag

SEQ ID NO: 449741 - DNA, 25 bp, Mus musculus
ggaagtcggccatggcgtctctccg

SEQ ID NO: 449742 - DNA, 25 bp, Mus musculus
ggaagtcgtgcttataggattttct

SEQ ID NO: 449743 - DNA, 25 bp, Mus musculus
ggaagtctctccacccagaatggca

SEQ ID NO: 449744 - DNA, 25 bp, Mus musculus
ggaagtcttccgttggtaccactag

SEQ ID NO: 449745 - DNA, 25 bp, Mus musculus
ggaagtgaacatgttgaagttgctt

SEQ ID NO: 449746 - DNA, 25 bp, Mus musculus
ggaagtgaagtaccctttcccgctg

SEQ ID NO: 449747 - DNA, 25 bp, Mus musculus
ggaagtgaccacctttcgagaaaag

SEQ ID NO: 449748 - DNA, 25 bp, Mus musculus
ggaagtgactaaacagtgcatggca

SEQ ID NO: 449749 - DNA, 25 bp, Mus musculus
ggaagtgatgcctatgctaatctga

SEQ ID NO: 449750 - DNA, 25 bp, Mus musculus
ggaagtgcatccaagggccggaaaa

SEQ ID NO: 449751 - DNA, 25 bp, Mus musculus
ggaagtgcccacagactcactggaa

SEQ ID NO: 449752 - DNA, 25 bp, Mus musculus
ggaagtgcctgctccttacactgct

SEQ ID NO: 449753 - DNA, 25 bp, Mus musculus
ggaagtggccatcaaacctcaatat

SEQ ID NO: 449754 - DNA, 25 bp, Mus musculus
ggaagtggtcgaggcggtcaccgac

SEQ ID NO: 449755 - DNA, 25 bp, Mus musculus
ggaagtgtgtctccaaaacggcttg

SEQ ID NO: 449756 - DNA, 25 bp, Mus musculus
ggaagtgttcgccagttactgcatg

SEQ ID NO: 449757 - DNA, 25 bp, Mus musculus
ggaagttcagtgcagtctccccagg

SEQ ID NO: 449758 - DNA, 25 bp, Mus musculus
ggaagttcgtcatgcctccagcaag

SEQ ID NO: 449759 - DNA, 25 bp, Mus musculus
ggaagttctgcaaagcccctactaa

SEQ ID NO: 449760 - DNA, 25 bp, Mus musculus
ggaagttctttctggcaccctagga

SEQ ID NO: 449761 - DNA, 25 bp, Mus musculus
ggaagtttcacttaccgcaggctct

SEQ ID NO: 449762 - DNA, 25 bp, Mus musculus
ggaataaatagatgctgcctcgcct

SEQ ID NO: 449763 - DNA, 25 bp, Mus musculus
ggaataaatcacctcgcccttggct

SEQ ID NO: 449764 - DNA, 25 bp, Mus musculus
ggaataaccacacgtttaaggccag

SEQ ID NO: 449765 - DNA, 25 bp, Mus musculus
ggaataacccgatcatgcatagctg

SEQ ID NO: 449766 - DNA, 25 bp, Mus musculus
ggaataatcactggctgagacatcg

SEQ ID NO: 449767 - DNA, 25 bp, Mus musculus
ggaatacaagcaaagcaggccgaga

SEQ ID NO: 449768 - DNA, 25 bp, Mus musculus
ggaatacacaggaactacagtacag

SEQ ID NO: 449769 - DNA, 25 bp, Mus musculus
ggaatacccctacacaaccaagatg

SEQ ID NO: 449770 - DNA, 25 bp, Mus musculus
ggaatacctctacaccaagcagttg

SEQ ID NO: 449771 - DNA, 25 bp, Mus musculus
ggaatacctggtgcatgcgctccaa

SEQ ID NO: 449772 - DNA, 25 bp, Mus musculus
ggaatacgatgttgtggtcagcacc

SEQ ID NO: 449773 - DNA, 25 bp, Mus musculus
ggaatactgagaaatcggctcccac

SEQ ID NO: 449774 - DNA, 25 bp, Mus musculus
ggaatactgtaccaaagtgcctgga

SEQ ID NO: 449775 - DNA, 25 bp, Mus musculus
ggaatacttaatggatactagtgat

SEQ ID NO: 449776 - DNA, 25 bp, Mus musculus
ggaatacttcagcaggacacagtca

SEQ ID NO: 449777 - DNA, 25 bp, Mus musculus
ggaatacttggttgtcctcccagga

SEQ ID NO: 449778 - DNA, 25 bp, Mus musculus
ggaatagacgatgatatcctcccta

SEQ ID NO: 449779 - DNA, 25 bp, Mus musculus
ggaatagccaggaagaacgagagca

SEQ ID NO: 449780 - DNA, 25 bp, Mus musculus
ggaataggatcatctgagcccagca

SEQ ID NO: 449781 - DNA, 25 bp, Mus musculus
ggaatagtatccacaccagggacgg

SEQ ID NO: 449782 - DNA, 25 bp, Mus musculus
ggaatatcacgctctgctcctggca

SEQ ID NO: 449783 - DNA, 25 bp, Mus musculus
ggaatatcagcccaaaccacggatg

SEQ ID NO: 449784 - DNA, 25 bp, Mus musculus
ggaatatgaagaccatcccgatgag

SEQ ID NO: 449785 - DNA, 25 bp, Mus musculus
ggaatatgatgacaagcagccactg

SEQ ID NO: 449786 - DNA, 25 bp, Mus musculus
ggaatatgtccagagagggcacgcc

SEQ ID NO: 449787 - DNA, 25 bp, Mus musculus
ggaatattccgctttcgtggtgcac

SEQ ID NO: 449788 - DNA, 25 bp, Mus musculus
ggaatcaagacgacaagaacctggg

SEQ ID NO: 449789 - DNA, 25 bp, Mus musculus
ggaatcacagagacaaaaatcgcag

SEQ ID NO: 449790 - DNA, 25 bp, Mus musculus
ggaatcacgcacttcactccctgga

SEQ ID NO: 449791 - DNA, 25 bp, Mus musculus
ggaatcatccgctgtgtgcacctgg

SEQ ID NO: 449792 - DNA, 25 bp, Mus musculus
ggaatcatctcatcaccaagcggga

SEQ ID NO: 449793 - DNA, 25 bp, Mus musculus
ggaatcattcagagcagggccacat

SEQ ID NO: 449794 - DNA, 25 bp, Mus musculus
ggaatccaaaagtactgccccgagg

SEQ ID NO: 449795 - DNA, 25 bp, Mus musculus
ggaatccaagtaagttcttcatttg

SEQ ID NO: 449796 - DNA, 25 bp, Mus musculus
ggaatcctacggtgcaactggcctg

SEQ ID NO: 449797 - DNA, 25 bp, Mus musculus
ggaatcctagatacatgaatcaact

SEQ ID NO: 449798 - DNA, 25 bp, Mus musculus
ggaatcctgtatcctaatcaccaag

SEQ ID NO: 449799 - DNA, 25 bp, Mus musculus
ggaatcgctccttcaactccgcggg

SEQ ID NO: 449800 - DNA, 25 bp, Mus musculus
ggaatcggccctggatctctgctgt

SEQ ID NO: 449801 - DNA, 25 bp, Mus musculus
ggaatctaagaaccccatgtacatg

SEQ ID NO: 449802 - DNA, 25 bp, Mus musculus
ggaatctcagcccaaacagatgatg

SEQ ID NO: 449803 - DNA, 25 bp, Mus musculus
ggaatctcagggactttggataagg

SEQ ID NO: 449804 - DNA, 25 bp, Mus musculus
ggaatctccgatacaaaacaactga

SEQ ID NO: 449805 - DNA, 25 bp, Mus musculus
ggaatctccttggtctcatccacag

SEQ ID NO: 449806 - DNA, 25 bp, Mus musculus
ggaatctctgcatgctagcctggaa

SEQ ID NO: 449807 - DNA, 25 bp, Mus musculus
ggaatctgaaatttgagagagaaac

SEQ ID NO: 449808 - DNA, 25 bp, Mus musculus
ggaatctgagttggaacaggacctc

SEQ ID NO: 449809 - DNA, 25 bp, Mus musculus
ggaatctgatgcttttggccctgga

SEQ ID NO: 449810 - DNA, 25 bp, Mus musculus
ggaatctggcactctgcctccaggg

SEQ ID NO: 449811 - DNA, 25 bp, Mus musculus
ggaatctgggccatcagctgaaaaa

SEQ ID NO: 449812 - DNA, 25 bp, Mus musculus
ggaatctgttcagtcaaggctttga

SEQ ID NO: 449813 - DNA, 25 bp, Mus musculus
ggaatctgtttcctcacctatagga

SEQ ID NO: 449814 - DNA, 25 bp, Mus musculus
ggaatcttagaccagtgtgaaccct

SEQ ID NO: 449815 - DNA, 25 bp, Mus musculus
ggaatgaatttcgagtacaactgac

SEQ ID NO: 449816 - DNA, 25 bp, Mus musculus
ggaatgacattcgaaggaacctggc

SEQ ID NO: 449817 - DNA, 25 bp, Mus musculus
ggaatgagcaaaaagcacccacaag

SEQ ID NO: 449818 - DNA, 25 bp, Mus musculus
ggaatgagtcctgccctatgaatac

SEQ ID NO: 449819 - DNA, 25 bp, Mus musculus
ggaatgatactttaagacaatgtct

SEQ ID NO: 449820 - DNA, 25 bp, Mus musculus
ggaatgattagagcaaactgttgtc

SEQ ID NO: 449821 - DNA, 25 bp, Mus musculus
ggaatgcaggctaccaacaactcag

SEQ ID NO: 449822 - DNA, 25 bp, Mus musculus
ggaatgcgttattacccaaagacaa

SEQ ID NO: 449823 - DNA, 25 bp, Mus musculus
ggaatgcttgtcctagccgctgaaa

SEQ ID NO: 449824 - DNA, 25 bp, Mus musculus
ggaatggaatcccaagacgttacgt

SEQ ID NO: 449825 - DNA, 25 bp, Mus musculus
ggaatggagagtctgttcccagaag

SEQ ID NO: 449826 - DNA, 25 bp, Mus musculus
ggaatggcctgcgaaatccatcaaa

SEQ ID NO: 449827 - DNA, 25 bp, Mus musculus
ggaatggcgctggagaaagcaatca

SEQ ID NO: 449828 - DNA, 25 bp, Mus musculus
ggaatgtactcatcacattgatgtc

SEQ ID NO: 449829 - DNA, 25 bp, Mus musculus
ggaatgtagtcgctttcacataaca

SEQ ID NO: 449830 - DNA, 25 bp, Mus musculus
ggaatgtatgtctaggctcacctca

SEQ ID NO: 449831 - DNA, 25 bp, Mus musculus
ggaatgtcagcaatgaccccgatgt

SEQ ID NO: 449832 - DNA, 25 bp, Mus musculus
ggaatgtcccttgctgccctgaaga

SEQ ID NO: 449833 - DNA, 25 bp, Mus musculus
ggaatgtgccgccaagggaaacctt

SEQ ID NO: 449834 - DNA, 25 bp, Mus musculus
ggaatgtggagcgtgctaaaagcac

SEQ ID NO: 449835 - DNA, 25 bp, Mus musculus
ggaatgtggtgagactgagccccta

SEQ ID NO: 449836 - DNA, 25 bp, Mus musculus
ggaatgttattcctcaccctgactt

SEQ ID NO: 449837 - DNA, 25 bp, Mus musculus
ggaattaaaaagttctatgacctag

SEQ ID NO: 449838 - DNA, 25 bp, Mus musculus
ggaattaacagacccgcggttcaat

SEQ ID NO: 449839 - DNA, 25 bp, Mus musculus
ggaattacacgaaaacgcctcaacg

SEQ ID NO: 449840 - DNA, 25 bp, Mus musculus
ggaattagactttgaactgagcctc

SEQ ID NO: 449841 - DNA, 25 bp, Mus musculus
ggaattagcattgtgaacctgactg

SEQ ID NO: 449842 - DNA, 25 bp, Mus musculus
ggaattattccataggcaccagcca

SEQ ID NO: 449843 - DNA, 25 bp, Mus musculus
ggaattcagaaccttggctcaccgt

SEQ ID NO: 449844 - DNA, 25 bp, Mus musculus
ggaattcagccagggcaaggcagtc

SEQ ID NO: 449845 - DNA, 25 bp, Mus musculus
ggaattcattgatgtccacgtcaaa

SEQ ID NO: 449846 - DNA, 25 bp, Mus musculus
ggaattccccggacgcgaggttctg

SEQ ID NO: 449847 - DNA, 25 bp, Mus musculus
ggaattcctgtcaaggattgctcca

SEQ ID NO: 449848 - DNA, 25 bp, Mus musculus
ggaattctgggtggtcccctccgct

SEQ ID NO: 449849 - DNA, 25 bp, Mus musculus
ggaattctgtccatcgtcacggaga

SEQ ID NO: 449850 - DNA, 25 bp, Mus musculus
ggaattcttttaagtgcgctcagca

SEQ ID NO: 449851 - DNA, 25 bp, Mus musculus
ggaattgccaagtaggtctccccga

SEQ ID NO: 449852 - DNA, 25 bp, Mus musculus
ggaattgctgccaggtgcccttctg

SEQ ID NO: 449853 - DNA, 25 bp, Mus musculus
ggaattggccctgcctcgatgacag

SEQ ID NO: 449854 - DNA, 25 bp, Mus musculus
ggaattgggcttttgcattttaaag

SEQ ID NO: 449855 - DNA, 25 bp, Mus musculus
ggaattgtagtgaactcagatagag

SEQ ID NO: 449856 - DNA, 25 bp, Mus musculus
ggaatttaaccgcagacaacagaag

SEQ ID NO: 449857 - DNA, 25 bp, Mus musculus
ggaatttaggatccaccactggtgg

SEQ ID NO: 449858 - DNA, 25 bp, Mus musculus
ggaatttatccagactcgcgtgcaa

SEQ ID NO: 449859 - DNA, 25 bp, Mus musculus
ggaatttcagggaacccaggcttga

SEQ ID NO: 449860 - DNA, 25 bp, Mus musculus
ggaatttcagtccacttcaccagag

SEQ ID NO: 449861 - DNA, 25 bp, Mus musculus
ggaatttcgtacctcacctgagagc

SEQ ID NO: 449862 - DNA, 25 bp, Mus musculus
ggaatttgaaaccagcatagcagtg

SEQ ID NO: 449863 - DNA, 25 bp, Mus musculus
ggaatttgggccctgccaacaggca

SEQ ID NO: 449864 - DNA, 25 bp, Mus musculus
ggaattttctctgccaccggtaaca

SEQ ID NO: 449865 - DNA, 25 bp, Mus musculus
ggaattttgcatactgggctgctgg

SEQ ID NO: 449866 - DNA, 25 bp, Mus musculus
ggaattttgccaccctgaggatcag

SEQ ID NO: 449867 - DNA, 25 bp, Mus musculus
ggacaaaacttcctcataccctgag

SEQ ID NO: 449868 - DNA, 25 bp, Mus musculus
ggacaaaatgtctgcgaggagcccg

SEQ ID NO: 449869 - DNA, 25 bp, Mus musculus
ggacaaacaatcctgcaagctggag

SEQ ID NO: 449870 - DNA, 25 bp, Mus musculus
ggacaaaccaaagacggcctctgag

SEQ ID NO: 449871 - DNA, 25 bp, Mus musculus
ggacaaactcccaaggctggcacta

SEQ ID NO: 449872 - DNA, 25 bp, Mus musculus
ggacaaagactcaggcccaaatgct

SEQ ID NO: 449873 - DNA, 25 bp, Mus musculus
ggacaaagctaaaccactcaacagc

SEQ ID NO: 449874 - DNA, 25 bp, Mus musculus
ggacaaagctattcccgctcgggac

SEQ ID NO: 449875 - DNA, 25 bp, Mus musculus
ggacaaagcttgaaaggccctccat

SEQ ID NO: 449876 - DNA, 25 bp, Mus musculus
ggacaaaggcaacagagagtcattt

SEQ ID NO: 449877 - DNA, 25 bp, Mus musculus
ggacaaaggctctactaccctggag

SEQ ID NO: 449878 - DNA, 25 bp, Mus musculus
ggacaaatcgctgtcagtggcatga

SEQ ID NO: 449879 - DNA, 25 bp, Mus musculus
ggacaaattcacacaatcacaagtt

SEQ ID NO: 449880 - DNA, 25 bp, Mus musculus
ggacaacaaacgagatcaggctacg

SEQ ID NO: 449881 - DNA, 25 bp, Mus musculus
ggacaacaaatgaccaggacactgg

SEQ ID NO: 449882 - DNA, 25 bp, Mus musculus
ggacaacagttaaagcagccctctt

SEQ ID NO: 449883 - DNA, 25 bp, Mus musculus
ggacaacgcacagttcctgagaagg

SEQ ID NO: 449884 - DNA, 25 bp, Mus musculus
ggacaactagcagcctgaagccatc

SEQ ID NO: 449885 - DNA, 25 bp, Mus musculus
ggacaagaagccactgacacggcta

SEQ ID NO: 449886 - DNA, 25 bp, Mus musculus
ggacaagatgaagtctttctgccag

SEQ ID NO: 449887 - DNA, 25 bp, Mus musculus
ggacaagattgaaccgcctcgtgct

SEQ ID NO: 449888 - DNA, 25 bp, Mus musculus
ggacaagccgccatttctgacacag

SEQ ID NO: 449889 - DNA, 25 bp, Mus musculus
ggacaagctaaagaaggtgctggac

SEQ ID NO: 449890 - DNA, 25 bp, Mus musculus
ggacaaggctccacaagaccctggg

SEQ ID NO: 449891 - DNA, 25 bp, Mus musculus
ggacaaggtaatgcatgctgggact

SEQ ID NO: 449892 - DNA, 25 bp, Mus musculus
ggacaagtgtctaccaatgctgcgg

SEQ ID NO: 449893 - DNA, 25 bp, Mus musculus
ggacaagttcacaacggcctgtaat

SEQ ID NO: 449894 - DNA, 25 bp, Mus musculus
ggacaatcccaatacagactctaag

SEQ ID NO: 449895 - DNA, 25 bp, Mus musculus
ggacaatctattgcggtcaagctat

SEQ ID NO: 449896 - DNA, 25 bp, Mus musculus
ggacaattaacgatcccactggcct

SEQ ID NO: 449897 - DNA, 25 bp, Mus musculus
ggacacaactcattttcagggaact

SEQ ID NO: 449898 - DNA, 25 bp, Mus musculus
ggacacacctgctgctctgtacaaa

SEQ ID NO: 449899 - DNA, 25 bp, Mus musculus
ggacacatgaactaacttgcccaag

SEQ ID NO: 449900 - DNA, 25 bp, Mus musculus
ggacaccaatggatgcgctttaatt

SEQ ID NO: 449901 - DNA, 25 bp, Mus musculus
ggacaccacggagacaacttagtag

SEQ ID NO: 449902 - DNA, 25 bp, Mus musculus
ggacaccaggagaccacaaagaagt

SEQ ID NO: 449903 - DNA, 25 bp, Mus musculus
ggacacccactttgatgacgatgag

SEQ ID NO: 449904 - DNA, 25 bp, Mus musculus
ggacacccgataggagaagaggcac

SEQ ID NO: 449905 - DNA, 25 bp, Mus musculus
ggacaccctcacagagccaagtatt

SEQ ID NO: 449906 - DNA, 25 bp, Mus musculus
ggacaccctgcagccaagttctttg

SEQ ID NO: 449907 - DNA, 25 bp, Mus musculus
ggacaccgggatgtgcaaagcactc

SEQ ID NO: 449908 - DNA, 25 bp, Mus musculus
ggacaccgtaacatttgggcctgca

SEQ ID NO: 449909 - DNA, 25 bp, Mus musculus
ggacacctaggtacaaacagcacag

SEQ ID NO: 449910 - DNA, 25 bp, Mus musculus
ggacacctccgctggatgagctgca

SEQ ID NO: 449911 - DNA, 25 bp, Mus musculus
ggacacctcgggaacacagttatga

SEQ ID NO: 449912 - DNA, 25 bp, Mus musculus
ggacacctgaggacattctgagact

SEQ ID NO: 449913 - DNA, 25 bp, Mus musculus
ggacacctgccccaagaaacagctt

SEQ ID NO: 449914 - DNA, 25 bp, Mus musculus
ggacaccttggcacacactggtcta

SEQ ID NO: 449915 - DNA, 25 bp, Mus musculus
ggacactagacttcactgctggaga

SEQ ID NO: 449916 - DNA, 25 bp, Mus musculus
ggacactatgaactgctcagctcag

SEQ ID NO: 449917 - DNA, 25 bp, Mus musculus
ggacactctgtgtttgaaagggcct

SEQ ID NO: 449918 - DNA, 25 bp, Mus musculus
ggacactgacagattatggacacac

SEQ ID NO: 449919 - DNA, 25 bp, Mus musculus
ggacactgagcagaagacccaaact

SEQ ID NO: 449920 - DNA, 25 bp, Mus musculus
ggacactggcagctcctgatcctga

SEQ ID NO: 449921 - DNA, 25 bp, Mus musculus
ggacactggtgtcgtctgccacaaa

SEQ ID NO: 449922 - DNA, 25 bp, Mus musculus
ggacactggtttggcaacggctctg

SEQ ID NO: 449923 - DNA, 25 bp, Mus musculus
ggacacttatcccatcgctgcagac

SEQ ID NO: 449924 - DNA, 25 bp, Mus musculus
ggacactttctcatatcatttgaaa

SEQ ID NO: 449925 - DNA, 25 bp, Mus musculus
ggacactttgagaaaccacgttgct

SEQ ID NO: 449926 - DNA, 25 bp, Mus musculus
ggacagaaatctagggccccattag

SEQ ID NO: 449927 - DNA, 25 bp, Mus musculus
ggacagaaccagttagctgccataa

SEQ ID NO: 449928 - DNA, 25 bp, Mus musculus
ggacagaagttctaagatagcctct

SEQ ID NO: 449929 - DNA, 25 bp, Mus musculus
ggacagactccctcagctctctgag

SEQ ID NO: 449930 - DNA, 25 bp, Mus musculus
ggacagactccttgtagcactgcat

SEQ ID NO: 449931 - DNA, 25 bp, Mus musculus
ggacagactctgttctacaaaccag

SEQ ID NO: 449932 - DNA, 25 bp, Mus musculus
ggacagagcacagcaactgtcaatg

SEQ ID NO: 449933 - DNA, 25 bp, Mus musculus
ggacagagcttgcagtacccagatg

SEQ ID NO: 449934 - DNA, 25 bp, Mus musculus
ggacagaggcttccatacaccggag

SEQ ID NO: 449935 - DNA, 25 bp, Mus musculus
ggacagattcccctctgcttatgag

SEQ ID NO: 449936 - DNA, 25 bp, Mus musculus
ggacagcatggtagcaggaaagcaa

SEQ ID NO: 449937 - DNA, 25 bp, Mus musculus
ggacagcattggacagtgagccctc

SEQ ID NO: 449938 - DNA, 25 bp, Mus musculus
ggacagccacctatgtactctggga

SEQ ID NO: 449939 - DNA, 25 bp, Mus musculus
ggacagccagtatcagaaaccagag

SEQ ID NO: 449940 - DNA, 25 bp, Mus musculus
ggacagccgggtctatttcctcaga

SEQ ID NO: 449941 - DNA, 25 bp, Mus musculus
ggacagctcccgtagcaacctggtt

SEQ ID NO: 449942 - DNA, 25 bp, Mus musculus
ggacagctgcagacacagacatgac

SEQ ID NO: 449943 - DNA, 25 bp, Mus musculus
ggacaggatagggttggtcaccaac

SEQ ID NO: 449944 - DNA, 25 bp, Mus musculus
ggacaggatggctactcgctcacct

SEQ ID NO: 449945 - DNA, 25 bp, Mus musculus
ggacagggatgagggatccctataa

SEQ ID NO: 449946 - DNA, 25 bp, Mus musculus
ggacagggcttctggaaacatccaa

SEQ ID NO: 449947 - DNA, 25 bp, Mus musculus
ggacaggtacgagctcactgccttg

SEQ ID NO: 449948 - DNA, 25 bp, Mus musculus
ggacaggtcccggtatgcagttcta

SEQ ID NO: 449949 - DNA, 25 bp, Mus musculus
ggacaggttaatatagagtcacaac

SEQ ID NO: 449950 - DNA, 25 bp, Mus musculus
ggacagtaaagctctgaaaataccc

SEQ ID NO: 449951 - DNA, 25 bp, Mus musculus
ggacagtcacttggaacaggcttca

SEQ ID NO: 449952 - DNA, 25 bp, Mus musculus
ggacagtcatccaacaccgagaaga

SEQ ID NO: 449953 - DNA, 25 bp, Mus musculus
ggacagtccaaataacaacccggag

SEQ ID NO: 449954 - DNA, 25 bp, Mus musculus
ggacagtgagccctcccaaatgata

SEQ ID NO: 449955 - DNA, 25 bp, Mus musculus
ggacagtgccttcaggttagtctct

SEQ ID NO: 449956 - DNA, 25 bp, Mus musculus
ggacagttcttaaagggccagcccg

SEQ ID NO: 449957 - DNA, 25 bp, Mus musculus
ggacagttgctgtcgttgagccaac

SEQ ID NO: 449958 - DNA, 25 bp, Mus musculus
ggacagtttgctcccaagtgtatgc

SEQ ID NO: 449959 - DNA, 25 bp, Mus musculus
ggacatagaggcagactagaagcta

SEQ ID NO: 449960 - DNA, 25 bp, Mus musculus
ggacatagatgatgacggccaccag

SEQ ID NO: 449961 - DNA, 25 bp, Mus musculus
ggacatagtttaaccccagacttag

SEQ ID NO: 449962 - DNA, 25 bp, Mus musculus
ggacatcccattcaggcggctggaa

SEQ ID NO: 449963 - DNA, 25 bp, Mus musculus
ggacatccgccttgatcctggcata

SEQ ID NO: 449964 - DNA, 25 bp, Mus musculus
ggacatccttctccacacaggcgat

SEQ ID NO: 449965 - DNA, 25 bp, Mus musculus
ggacatctaccagtacctcaggcag

SEQ ID NO: 449966 - DNA, 25 bp, Mus musculus
ggacatgaaaaacacatcagcctca

SEQ ID NO: 449967 - DNA, 25 bp, Mus musculus
ggacatgaaacggtacctgcaggcc

SEQ ID NO: 449968 - DNA, 25 bp, Mus musculus
ggacatgaagtaaacaccacgctaa

SEQ ID NO: 449969 - DNA, 25 bp, Mus musculus
ggacatgaagtgctacctactagag

SEQ ID NO: 449970 - DNA, 25 bp, Mus musculus
ggacatgacaccaactatacggaaa

SEQ ID NO: 449971 - DNA, 25 bp, Mus musculus
ggacatgatcatccgggaagctgat

SEQ ID NO: 449972 - DNA, 25 bp, Mus musculus
ggacatgctcccttctgagtggcga

SEQ ID NO: 449973 - DNA, 25 bp, Mus musculus
ggacatggaaaagggattcgaaaga

SEQ ID NO: 449974 - DNA, 25 bp, Mus musculus
ggacatggcaagatcccacagacga

SEQ ID NO: 449975 - DNA, 25 bp, Mus musculus
ggacatggccagatctctcacaaaa

SEQ ID NO: 449976 - DNA, 25 bp, Mus musculus
ggacatggctgttggcatcccggac

SEQ ID NO: 449977 - DNA, 25 bp, Mus musculus
ggacatgtatgcttgtgtagctacc

SEQ ID NO: 449978 - DNA, 25 bp, Mus musculus
ggacattagttggaagcctgtggaa

SEQ ID NO: 449979 - DNA, 25 bp, Mus musculus
ggacattattttgcagccaacctga

SEQ ID NO: 449980 - DNA, 25 bp, Mus musculus
ggacattgccttcgcctatcagaga

SEQ ID NO: 449981 - DNA, 25 bp, Mus musculus
ggacattggtgttctggccactcag

SEQ ID NO: 449982 - DNA, 25 bp, Mus musculus
ggacattgttctctacctgtgtgac

SEQ ID NO: 449983 - DNA, 25 bp, Mus musculus
ggacatttgacattgcctgctctgc

SEQ ID NO: 449984 - DNA, 25 bp, Mus musculus
ggacatttgtcctcagctctggagc

SEQ ID NO: 449985 - DNA, 25 bp, Mus musculus
ggacatttgtgagcaaacacgcagt

SEQ ID NO: 449986 - DNA, 25 bp, Mus musculus
ggaccaaacctcaaagcatggctga

SEQ ID NO: 449987 - DNA, 25 bp, Mus musculus
ggaccaaagttaactcttgagtgct

SEQ ID NO: 449988 - DNA, 25 bp, Mus musculus
ggaccaactctcattaggccaaggc

SEQ ID NO: 449989 - DNA, 25 bp, Mus musculus
ggaccaagcaaagtacagtgcttgc

SEQ ID NO: 449990 - DNA, 25 bp, Mus musculus
ggaccaagcctgaacaaaatgaatc

SEQ ID NO: 449991 - DNA, 25 bp, Mus musculus
ggaccaaggcctcacaaaagaacac

SEQ ID NO: 449992 - DNA, 25 bp, Mus musculus
ggaccaagtgctatctaaccatgag

SEQ ID NO: 449993 - DNA, 25 bp, Mus musculus
ggaccaagtttgtagcctgcatctg

SEQ ID NO: 449994 - DNA, 25 bp, Mus musculus
ggaccaatctaagacgagagccgtt

SEQ ID NO: 449995 - DNA, 25 bp, Mus musculus
ggaccaatgaaagcttagaacctcg

SEQ ID NO: 449996 - DNA, 25 bp, Mus musculus
ggaccaatgtgtatgagggccttct

SEQ ID NO: 449997 - DNA, 25 bp, Mus musculus
ggaccaatgtttccgctgaggaaca

SEQ ID NO: 449998 - DNA, 25 bp, Mus musculus
ggaccacaatgcactaagggacctt

SEQ ID NO: 449999 - DNA, 25 bp, Mus musculus
ggaccacagccacagagaccaaggt

SEQ ID NO: 450000 - DNA, 25 bp, Mus musculus
ggaccacattcacaacctaaggctg

SEQ ID NO: 450001 - DNA, 25 bp, Mus musculus
ggaccaccccaagtattcagacatg

SEQ ID NO: 450002 - DNA, 25 bp, Mus musculus
ggaccacggagaaggtcgtcacaga

SEQ ID NO: 450003 - DNA, 25 bp, Mus musculus
ggaccactccccattgattctcaaa

SEQ ID NO: 450004 - DNA, 25 bp, Mus musculus
ggaccactcggtgaccataaagaag

SEQ ID NO: 450005 - DNA, 25 bp, Mus musculus
ggaccactgtattagccattctgag

SEQ ID NO: 450006 - DNA, 25 bp, Mus musculus
ggaccacttgattgaacgcctgtac

SEQ ID NO: 450007 - DNA, 25 bp, Mus musculus
ggaccacttgcctggataaatcttt

SEQ ID NO: 450008 - DNA, 25 bp, Mus musculus
ggaccacttgtctgccatgctctag

SEQ ID NO: 450009 - DNA, 25 bp, Mus musculus
ggaccagaaatccagctgtggctgc

SEQ ID NO: 450010 - DNA, 25 bp, Mus musculus
ggaccagaaggctcgcactagctac

SEQ ID NO: 450011 - DNA, 25 bp, Mus musculus
ggaccagagtaaggatgcagtttga

SEQ ID NO: 450012 - DNA, 25 bp, Mus musculus
ggaccagccctgagacccaagcgga

SEQ ID NO: 450013 - DNA, 25 bp, Mus musculus
ggaccaggctgcgtacttagccaga

SEQ ID NO: 450014 - DNA, 25 bp, Mus musculus
ggaccagggatcctcatacctcaga

SEQ ID NO: 450015 - DNA, 25 bp, Mus musculus
ggaccaggtccttcactaacagtgc

SEQ ID NO: 450016 - DNA, 25 bp, Mus musculus
ggaccagtccccatattcaaacata

SEQ ID NO: 450017 - DNA, 25 bp, Mus musculus
ggaccatatgttctccggagcgcag

SEQ ID NO: 450018 - DNA, 25 bp, Mus musculus
ggaccatcttccatgctatgcggca

SEQ ID NO: 450019 - DNA, 25 bp, Mus musculus
ggaccatgacctagctgaccatgaa

SEQ ID NO: 450020 - DNA, 25 bp, Mus musculus
ggacccaaggttctcttctgctaga

SEQ ID NO: 450021 - DNA, 25 bp, Mus musculus
ggacccagacattacatggcctgct

SEQ ID NO: 450022 - DNA, 25 bp, Mus musculus
ggacccaggcagtaacgttgcacca

SEQ ID NO: 450023 - DNA, 25 bp, Mus musculus
ggacccaggcctcacattggaatct

SEQ ID NO: 450024 - DNA, 25 bp, Mus musculus
ggacccagggatgcgtgaagctgga

SEQ ID NO: 450025 - DNA, 25 bp, Mus musculus
ggacccagtatgctagcagctgaac

SEQ ID NO: 450026 - DNA, 25 bp, Mus musculus
ggacccagtccctatgaactcagag

SEQ ID NO: 450027 - DNA, 25 bp, Mus musculus
ggacccagtggaagccaaaccattc

SEQ ID NO: 450028 - DNA, 25 bp, Mus musculus
ggacccattacatcttataaagcta

SEQ ID NO: 450029 - DNA, 25 bp, Mus musculus
ggacccattagcaccatctttcaaa

SEQ ID NO: 450030 - DNA, 25 bp, Mus musculus
ggacccctggtactgcaactatgtg

SEQ ID NO: 450031 - DNA, 25 bp, Mus musculus
ggaccccttctgatttgccacgcga

SEQ ID NO: 450032 - DNA, 25 bp, Mus musculus
ggacccctttagtgggcacaggctg

SEQ ID NO: 450033 - DNA, 25 bp, Mus musculus
ggacccgaggcaaccaatgctgtga

SEQ ID NO: 450034 - DNA, 25 bp, Mus musculus
ggacccgcgcctatggcttcagaga

SEQ ID NO: 450035 - DNA, 25 bp, Mus musculus
ggacccgctaagtgctgccagagtt

SEQ ID NO: 450036 - DNA, 25 bp, Mus musculus
ggacccggacataaagagcctgcat

SEQ ID NO: 450037 - DNA, 25 bp, Mus musculus
ggacccggatgacgttccacctggt

SEQ ID NO: 450038 - DNA, 25 bp, Mus musculus
ggacccggatgcatggcctgaatga

SEQ ID NO: 450039 - DNA, 25 bp, Mus musculus
ggacccgtctttaaagtgatggaga

SEQ ID NO: 450040 - DNA, 25 bp, Mus musculus
ggaccctaatgtctgcccttgatga

SEQ ID NO: 450041 - DNA, 25 bp, Mus musculus
ggaccctcagctttgtagccccagt

SEQ ID NO: 450042 - DNA, 25 bp, Mus musculus
ggaccctcgccttcgatgagtatgg

SEQ ID NO: 450043 - DNA, 25 bp, Mus musculus
ggaccctgagcagaaccaactgttg

SEQ ID NO: 450044 - DNA, 25 bp, Mus musculus
ggaccctgagctagccatggcgttc

SEQ ID NO: 450045 - DNA, 25 bp, Mus musculus
ggaccctggcagagactatgagttg

SEQ ID NO: 450046 - DNA, 25 bp, Mus musculus
ggaccctgtccaatatgccaagcag

SEQ ID NO: 450047 - DNA, 25 bp, Mus musculus
ggaccctgtggcctacccaaagttg

SEQ ID NO: 450048 - DNA, 25 bp, Mus musculus
ggacccttaggaaatgtgcaaatga

SEQ ID NO: 450049 - DNA, 25 bp, Mus musculus
ggacccttgtatctgaagcctttgg

SEQ ID NO: 450050 - DNA, 25 bp, Mus musculus
ggaccctttctgactgcctggagga

SEQ ID NO: 450051 - DNA, 25 bp, Mus musculus
ggacccttttccagacgacttgaca

SEQ ID NO: 450052 - DNA, 25 bp, Mus musculus
ggaccgaagtcctagtcaccaggag

SEQ ID NO: 450053 - DNA, 25 bp, Mus musculus
ggaccgatcccaaggctcctatctg

SEQ ID NO: 450054 - DNA, 25 bp, Mus musculus
ggaccgcatcaacagcagcatagag

SEQ ID NO: 450055 - DNA, 25 bp, Mus musculus
ggaccgctatgagaaccgaaatctg

SEQ ID NO: 450056 - DNA, 25 bp, Mus musculus
ggaccgctgttctccttaaggatgc

SEQ ID NO: 450057 - DNA, 25 bp, Mus musculus
ggaccggactagaagccatgttgca

SEQ ID NO: 450058 - DNA, 25 bp, Mus musculus
ggaccgtaagcatccatcaaaaaga

SEQ ID NO: 450059 - DNA, 25 bp, Mus musculus
ggaccgtcccacctatccagtagtt

SEQ ID NO: 450060 - DNA, 25 bp, Mus musculus
ggaccgtctgcaatatttcactgga

SEQ ID NO: 450061 - DNA, 25 bp, Mus musculus
ggaccgtggctctcagggtgtcaaa

SEQ ID NO: 450062 - DNA, 25 bp, Mus musculus
ggaccgtgtctcagcccaagaagcg

SEQ ID NO: 450063 - DNA, 25 bp, Mus musculus
ggacctaagggcgtaggcacctcct

SEQ ID NO: 450064 - DNA, 25 bp, Mus musculus
ggacctaccaaaatgaccgcacctg

SEQ ID NO: 450065 - DNA, 25 bp, Mus musculus
ggacctaccgggagcatttcgtgaa

SEQ ID NO: 450066 - DNA, 25 bp, Mus musculus
ggacctagttgtgaccctgacgctg

SEQ ID NO: 450067 - DNA, 25 bp, Mus musculus
ggacctatattctggactgctgaga

SEQ ID NO: 450068 - DNA, 25 bp, Mus musculus
ggacctatgcaccaaccattatgtg

SEQ ID NO: 450069 - DNA, 25 bp, Mus musculus
ggacctatgtctctcagggcagcat

SEQ ID NO: 450070 - DNA, 25 bp, Mus musculus
ggacctcacggcagacatcaaaaag

SEQ ID NO: 450071 - DNA, 25 bp, Mus musculus
ggacctcaggttcttcgctgctgta

SEQ ID NO: 450072 - DNA, 25 bp, Mus musculus
ggacctcagttttcctggtccccag

SEQ ID NO: 450073 - DNA, 25 bp, Mus musculus
ggacctcatcaagacgggacgttcg

SEQ ID NO: 450074 - DNA, 25 bp, Mus musculus
ggacctcccaatgcgggcaagagca

SEQ ID NO: 450075 - DNA, 25 bp, Mus musculus
ggacctccgggacatgatcagcatg

SEQ ID NO: 450076 - DNA, 25 bp, Mus musculus
ggacctcggctttccggagcgcaag

SEQ ID NO: 450077 - DNA, 25 bp, Mus musculus
ggacctcgggagtagtatgctaaca

SEQ ID NO: 450078 - DNA, 25 bp, Mus musculus
ggacctctaaaacgtgagcctgcat

SEQ ID NO: 450079 - DNA, 25 bp, Mus musculus
ggacctctgccaacagacttgcgga

SEQ ID NO: 450080 - DNA, 25 bp, Mus musculus
ggacctctggaagtggcttccccag

SEQ ID NO: 450081 - DNA, 25 bp, Mus musculus
ggacctgaagtgtatccgcaacgag

SEQ ID NO: 450082 - DNA, 25 bp, Mus musculus
ggacctgacttgaaggaagcaccca

SEQ ID NO: 450083 - DNA, 25 bp, Mus musculus
ggacctgagacttggtctccaagaa

SEQ ID NO: 450084 - DNA, 25 bp, Mus musculus
ggacctgagctaccaacaaaagatt

SEQ ID NO: 450085 - DNA, 25 bp, Mus musculus
ggacctgagttcacacccgggaagc

SEQ ID NO: 450086 - DNA, 25 bp, Mus musculus
ggacctgatgtaattgccaaagcca

SEQ ID NO: 450087 - DNA, 25 bp, Mus musculus
ggacctgcaagaggaacacaccttc

SEQ ID NO: 450088 - DNA, 25 bp, Mus musculus
ggacctgcgagagaacacggagttc

SEQ ID NO: 450089 - DNA, 25 bp, Mus musculus
ggacctggaccataacgagatctcg

SEQ ID NO: 450090 - DNA, 25 bp, Mus musculus
ggacctggagaaacagaacgcagct

SEQ ID NO: 450091 - DNA, 25 bp, Mus musculus
ggacctggcagtggcagaatcatgt

SEQ ID NO: 450092 - DNA, 25 bp, Mus musculus
ggacctggcggataccctgcagtga

SEQ ID NO: 450093 - DNA, 25 bp, Mus musculus
ggacctgggcactggcttctgtaaa

SEQ ID NO: 450094 - DNA, 25 bp, Mus musculus
ggacctggtctcaggatcctgcttg

SEQ ID NO: 450095 - DNA, 25 bp, Mus musculus
ggacctgtctccttcttctttgcat

SEQ ID NO: 450096 - DNA, 25 bp, Mus musculus
ggacctgtctctcctagcctgcaaa

SEQ ID NO: 450097 - DNA, 25 bp, Mus musculus
ggacctgtgtagagaatgaagagtc

SEQ ID NO: 450098 - DNA, 25 bp, Mus musculus
ggacctgttgaactaccaatacttg

SEQ ID NO: 450099 - DNA, 25 bp, Mus musculus
ggacctgttgatatggataaagcca

SEQ ID NO: 450100 - DNA, 25 bp, Mus musculus
ggaccttagtcgagtgtgctgagaa

SEQ ID NO: 450101 - DNA, 25 bp, Mus musculus
ggaccttcaagggagctgtgcattt

SEQ ID NO: 450102 - DNA, 25 bp, Mus musculus
ggaccttcccctaatctggtacttg

SEQ ID NO: 450103 - DNA, 25 bp, Mus musculus
ggaccttctgaacaatggccaaccg

SEQ ID NO: 450104 - DNA, 25 bp, Mus musculus
ggaccttctgtgcatcccttagatg

SEQ ID NO: 450105 - DNA, 25 bp, Mus musculus
ggaccttcttcacatgtactgacaa

SEQ ID NO: 450106 - DNA, 25 bp, Mus musculus
ggaccttgccgccagagttcattct

SEQ ID NO: 450107 - DNA, 25 bp, Mus musculus
ggaccttggcccaggctatcagaga

SEQ ID NO: 450108 - DNA, 25 bp, Mus musculus
ggacctttgaagaactgatgtgaaa

SEQ ID NO: 450109 - DNA, 25 bp, Mus musculus
ggacctttgcagatctccctgggaa

SEQ ID NO: 450110 - DNA, 25 bp, Mus musculus
ggacctttgggatctggacgctgct

SEQ ID NO: 450111 - DNA, 25 bp, Mus musculus
ggacgaagactgtagagactaccca

SEQ ID NO: 450112 - DNA, 25 bp, Mus musculus
ggacgaaggccaagaaccgctttca

SEQ ID NO: 450113 - DNA, 25 bp, Mus musculus
ggacgaagtgtctgtagcagcaacc

SEQ ID NO: 450114 - DNA, 25 bp, Mus musculus
ggacgaattgctgaagcccactgaa

SEQ ID NO: 450115 - DNA, 25 bp, Mus musculus
ggacgacaaggttcttcatgctgca

SEQ ID NO: 450116 - DNA, 25 bp, Mus musculus
ggacgacactggacagaactctgag

SEQ ID NO: 450117 - DNA, 25 bp, Mus musculus
ggacgacatccggaacatcttctgg

SEQ ID NO: 450118 - DNA, 25 bp, Mus musculus
ggacgaccatttctacgccgagtac

SEQ ID NO: 450119 - DNA, 25 bp, Mus musculus
ggacgacccctaatctaatgagaaa

SEQ ID NO: 450120 - DNA, 25 bp, Mus musculus
ggacgacctgtacctggacatcacg

SEQ ID NO: 450121 - DNA, 25 bp, Mus musculus
ggacgacctgtgttctgacctagag

SEQ ID NO: 450122 - DNA, 25 bp, Mus musculus
ggacgacgacgaagagcctgctgcc

SEQ ID NO: 450123 - DNA, 25 bp, Mus musculus
ggacgactgcccataagaaaacgag

SEQ ID NO: 450124 - DNA, 25 bp, Mus musculus
ggacgactgctctctagaactggga

SEQ ID NO: 450125 - DNA, 25 bp, Mus musculus
ggacgacttctttctcatgttagca

SEQ ID NO: 450126 - DNA, 25 bp, Mus musculus
ggacgattcttggtaggctcttgcg

SEQ ID NO: 450127 - DNA, 25 bp, Mus musculus
ggacgattgctcaatggtgatctgg

SEQ ID NO: 450128 - DNA, 25 bp, Mus musculus
ggacgcattattgacacttctctga

SEQ ID NO: 450129 - DNA, 25 bp, Mus musculus
ggacgccctgactacatacatgtac

SEQ ID NO: 450130 - DNA, 25 bp, Mus musculus
ggacgccgcgctctagggtctgcgg

SEQ ID NO: 450131 - DNA, 25 bp, Mus musculus
ggacgcgcgcgcttcccttattggg

SEQ ID NO: 450132 - DNA, 25 bp, Mus musculus
ggacgcgctgttgtcgccagagaac

SEQ ID NO: 450133 - DNA, 25 bp, Mus musculus
ggacgcgtcctcagacgccgcgagt

SEQ ID NO: 450134 - DNA, 25 bp, Mus musculus
ggacgctcatctactacctggacga

SEQ ID NO: 450135 - DNA, 25 bp, Mus musculus
ggacgctgttgctggagacccacat

SEQ ID NO: 450136 - DNA, 25 bp, Mus musculus
ggacggaccctctaatgtgcaagct

SEQ ID NO: 450137 - DNA, 25 bp, Mus musculus
ggacggaccctgaccactatgaaac

SEQ ID NO: 450138 - DNA, 25 bp, Mus musculus
ggacggccgccctgtaatagcctaa

SEQ ID NO: 450139 - DNA, 25 bp, Mus musculus
ggacggccgcttctacatgaccgag

SEQ ID NO: 450140 - DNA, 25 bp, Mus musculus
ggacggctgcaaaccatcttccgag

SEQ ID NO: 450141 - DNA, 25 bp, Mus musculus
ggacggtaacagagcccgtgtcgta

SEQ ID NO: 450142 - DNA, 25 bp, Mus musculus
ggacgtaatttcattattgggaaca

SEQ ID NO: 450143 - DNA, 25 bp, Mus musculus
ggacgtacctgaactgcgatcgcta

SEQ ID NO: 450144 - DNA, 25 bp, Mus musculus
ggacgtagctgtttacttcccagac

SEQ ID NO: 450145 - DNA, 25 bp, Mus musculus
ggacgtcaacatagccctctgctgc

SEQ ID NO: 450146 - DNA, 25 bp, Mus musculus
ggacgtcatccgctgctatctggaa

SEQ ID NO: 450147 - DNA, 25 bp, Mus musculus
ggacgtccttcgtaacaggaacatc

SEQ ID NO: 450148 - DNA, 25 bp, Mus musculus
ggacgtctaactttccataaaatag

SEQ ID NO: 450149 - DNA, 25 bp, Mus musculus
ggacgtctgctcttcagggctgcag

SEQ ID NO: 450150 - DNA, 25 bp, Mus musculus
ggacgtgaaaacatacctgagatcg

SEQ ID NO: 450151 - DNA, 25 bp, Mus musculus
ggacgtgagcacagatgaattcgaa

SEQ ID NO: 450152 - DNA, 25 bp, Mus musculus
ggacgtggcggcgattatcacccga

SEQ ID NO: 450153 - DNA, 25 bp, Mus musculus
ggacgttcgtcacatcttgccgaag

SEQ ID NO: 450154 - DNA, 25 bp, Mus musculus
ggactaactggcctcacagggatga

SEQ ID NO: 450155 - DNA, 25 bp, Mus musculus
ggactaagaaacaccactcagggaa

SEQ ID NO: 450156 - DNA, 25 bp, Mus musculus
ggactacaacatggcaaaagcaaag

SEQ ID NO: 450157 - DNA, 25 bp, Mus musculus
ggactacatggggatcaaaggcccc

SEQ ID NO: 450158 - DNA, 25 bp, Mus musculus
ggactaccctcgtaacagcctcgag

SEQ ID NO: 450159 - DNA, 25 bp, Mus musculus
ggactacgccgcaagggataggccc

SEQ ID NO: 450160 - DNA, 25 bp, Mus musculus
ggactactgcagaccagatggccca

SEQ ID NO: 450161 - DNA, 25 bp, Mus musculus
ggactagacatcctcagggtggcaa

SEQ ID NO: 450162 - DNA, 25 bp, Mus musculus
ggactagactgaagctgcggttcat

SEQ ID NO: 450163 - DNA, 25 bp, Mus musculus
ggactataagaaactgtgtctccaa

SEQ ID NO: 450164 - DNA, 25 bp, Mus musculus
ggactatacttcaggacatcattcc

SEQ ID NO: 450165 - DNA, 25 bp, Mus musculus
ggactatcaattatactgccgcaga

SEQ ID NO: 450166 - DNA, 25 bp, Mus musculus
ggactatcccaccagtgcctttgga

SEQ ID NO: 450167 - DNA, 25 bp, Mus musculus
ggactatgactacctccgggactgg

SEQ ID NO: 450168 - DNA, 25 bp, Mus musculus
ggactatgatccaggcaaagctcca

SEQ ID NO: 450169 - DNA, 25 bp, Mus musculus
ggactatgcacgatgggaacacaca

SEQ ID NO: 450170 - DNA, 25 bp, Mus musculus
ggactcaccatcacggataacggcg

SEQ ID NO: 450171 - DNA, 25 bp, Mus musculus
ggactcacctttcaactactcctgg

SEQ ID NO: 450172 - DNA, 25 bp, Mus musculus
ggactcactgtcctcgtaatgcaga

SEQ ID NO: 450173 - DNA, 25 bp, Mus musculus
ggactcagagaacaccatttggttg

SEQ ID NO: 450174 - DNA, 25 bp, Mus musculus
ggactcagagcatcaacagcgcctt

SEQ ID NO: 450175 - DNA, 25 bp, Mus musculus
ggactcagagctgggtgacccctgt

SEQ ID NO: 450176 - DNA, 25 bp, Mus musculus
ggactcagaggaatcttgtggacac

SEQ ID NO: 450177 - DNA, 25 bp, Mus musculus
ggactcagcctggaaggactgtgct

SEQ ID NO: 450178 - DNA, 25 bp, Mus musculus
ggactcagtgccagctacgctagga

SEQ ID NO: 450179 - DNA, 25 bp, Mus musculus
ggactcatcaccactatatgctgtg

SEQ ID NO: 450180 - DNA, 25 bp, Mus musculus
ggactcatgctgtttctaaccacca

SEQ ID NO: 450181 - DNA, 25 bp, Mus musculus
ggactccaaccacactatcggcgtg

SEQ ID NO: 450182 - DNA, 25 bp, Mus musculus
ggactccagacagagttctgcagaa

SEQ ID NO: 450183 - DNA, 25 bp, Mus musculus
ggactccaggagtgtttcagctcga

SEQ ID NO: 450184 - DNA, 25 bp, Mus musculus
ggactccagggtcgatgaacagcct

SEQ ID NO: 450185 - DNA, 25 bp, Mus musculus
ggactcccacgtccgttatcttgat

SEQ ID NO: 450186 - DNA, 25 bp, Mus musculus
ggactccctctgatactgcttgaaa

SEQ ID NO: 450187 - DNA, 25 bp, Mus musculus
ggactccggagaattcccagtgtga

SEQ ID NO: 450188 - DNA, 25 bp, Mus musculus
ggactcctacagattggccaagaaa

SEQ ID NO: 450189 - DNA, 25 bp, Mus musculus
ggactcctcctagttttgcaggttt

SEQ ID NO: 450190 - DNA, 25 bp, Mus musculus
ggactcgatccttaccacggttgtt

SEQ ID NO: 450191 - DNA, 25 bp, Mus musculus
ggactcgcctcttctggactttaag

SEQ ID NO: 450192 - DNA, 25 bp, Mus musculus
ggactcggcagcttggtccactgct

SEQ ID NO: 450193 - DNA, 25 bp, Mus musculus
ggactcgggcaaaacggaaatctag

SEQ ID NO: 450194 - DNA, 25 bp, Mus musculus
ggactcgggcgggtcatatatttca

SEQ ID NO: 450195 - DNA, 25 bp, Mus musculus
ggactcgtgttctcctgccaggaca

SEQ ID NO: 450196 - DNA, 25 bp, Mus musculus
ggactctattctaagccaaggataa

SEQ ID NO: 450197 - DNA, 25 bp, Mus musculus
ggactctcagctgtaactctgtatt

SEQ ID NO: 450198 - DNA, 25 bp, Mus musculus
ggactctgatccctcactggctgtc

SEQ ID NO: 450199 - DNA, 25 bp, Mus musculus
ggactctggatagagggcaccctgc

SEQ ID NO: 450200 - DNA, 25 bp, Mus musculus
ggactctggtgcacagccctatcaa

SEQ ID NO: 450201 - DNA, 25 bp, Mus musculus
ggactcttacagatgcccatgtgta

SEQ ID NO: 450202 - DNA, 25 bp, Mus musculus
ggactcttacccactggaactggag

SEQ ID NO: 450203 - DNA, 25 bp, Mus musculus
ggactctttaaggtgagcgcccaca

SEQ ID NO: 450204 - DNA, 25 bp, Mus musculus
ggactgacattttgtccctaccctc

SEQ ID NO: 450205 - DNA, 25 bp, Mus musculus
ggactgacctagaaagattaatttt

SEQ ID NO: 450206 - DNA, 25 bp, Mus musculus
ggactgagaataaatgtaagcaggg

SEQ ID NO: 450207 - DNA, 25 bp, Mus musculus
ggactgagatacgtggaccttggaa

SEQ ID NO: 450208 - DNA, 25 bp, Mus musculus
ggactgagctccacccatgcatggt

SEQ ID NO: 450209 - DNA, 25 bp, Mus musculus
ggactgaggcaaatccagggagctt

SEQ ID NO: 450210 - DNA, 25 bp, Mus musculus
ggactgagtccaaggtgctttgttg

SEQ ID NO: 450211 - DNA, 25 bp, Mus musculus
ggactgatttcaggtggcagccacc

SEQ ID NO: 450212 - DNA, 25 bp, Mus musculus
ggactgcaccatcgagtcatttttg

SEQ ID NO: 450213 - DNA, 25 bp, Mus musculus
ggactgcagcatcaggaaagctaga

SEQ ID NO: 450214 - DNA, 25 bp, Mus musculus
ggactgcattccctgctgccaactg

SEQ ID NO: 450215 - DNA, 25 bp, Mus musculus
ggactgcccaagaaacccgagatta

SEQ ID NO: 450216 - DNA, 25 bp, Mus musculus
ggactgcctgcctaccaatgttgag

SEQ ID NO: 450217 - DNA, 25 bp, Mus musculus
ggactgcgggctggaatacgacctt

SEQ ID NO: 450218 - DNA, 25 bp, Mus musculus
ggactgctcccgtctttggccaaaa

SEQ ID NO: 450219 - DNA, 25 bp, Mus musculus
ggactgctgtttgggctttctgaaa

SEQ ID NO: 450220 - DNA, 25 bp, Mus musculus
ggactggaagtttcatttccgcatc

SEQ ID NO: 450221 - DNA, 25 bp, Mus musculus
ggactggacagcttgaatctctgct

SEQ ID NO: 450222 - DNA, 25 bp, Mus musculus
ggactggaccctcaaactgcaagat

SEQ ID NO: 450223 - DNA, 25 bp, Mus musculus
ggactggaccctcgcattgaagaga

SEQ ID NO: 450224 - DNA, 25 bp, Mus musculus
ggactggcccacatcagtctactaa

SEQ ID NO: 450225 - DNA, 25 bp, Mus musculus
ggactggcccactcagtactgtgaa

SEQ ID NO: 450226 - DNA, 25 bp, Mus musculus
ggactggcccagctatcactcagag

SEQ ID NO: 450227 - DNA, 25 bp, Mus musculus
ggactggcctggaaaactggagaca

SEQ ID NO: 450228 - DNA, 25 bp, Mus musculus
ggactggtccagtttgtactgtcaa

SEQ ID NO: 450229 - DNA, 25 bp, Mus musculus
ggactgtaaacggagctgctaggac

SEQ ID NO: 450230 - DNA, 25 bp, Mus musculus
ggactgtaaggaagcataccatgaa

SEQ ID NO: 450231 - DNA, 25 bp, Mus musculus
ggactgtacaagcaccagagaagct

SEQ ID NO: 450232 - DNA, 25 bp, Mus musculus
ggactgtactaccagtggtgtcctg

SEQ ID NO: 450233 - DNA, 25 bp, Mus musculus
ggactgtatctcgtttgttcactgt

SEQ ID NO: 450234 - DNA, 25 bp, Mus musculus
ggactgtcggcactgagaacacgaa

SEQ ID NO: 450235 - DNA, 25 bp, Mus musculus
ggactgtgacaaagcctatgtacag

SEQ ID NO: 450236 - DNA, 25 bp, Mus musculus
ggactgtgcaataggtcgtcacctc

SEQ ID NO: 450237 - DNA, 25 bp, Mus musculus
ggactgtgccaccataagggactct

SEQ ID NO: 450238 - DNA, 25 bp, Mus musculus
ggacttaactgatcccacgctggag

SEQ ID NO: 450239 - DNA, 25 bp, Mus musculus
ggacttaaggcccattcaggaggaa

SEQ ID NO: 450240 - DNA, 25 bp, Mus musculus
ggacttatactatgcagcgccactg

SEQ ID NO: 450241 - DNA, 25 bp, Mus musculus
ggacttatgactgcccaagcgcggc

SEQ ID NO: 450242 - DNA, 25 bp, Mus musculus
ggacttcaacgccttctatgcatgg

SEQ ID NO: 450243 - DNA, 25 bp, Mus musculus
ggacttcacgtactctggccgaaag

SEQ ID NO: 450244 - DNA, 25 bp, Mus musculus
ggacttcagcaactaccacgatgtg

SEQ ID NO: 450245 - DNA, 25 bp, Mus musculus
ggacttcatccagtctcaccgaaga

SEQ ID NO: 450246 - DNA, 25 bp, Mus musculus
ggacttccattttcaggcagtaagg

SEQ ID NO: 450247 - DNA, 25 bp, Mus musculus
ggacttcctgctcaaggccatcatg

SEQ ID NO: 450248 - DNA, 25 bp, Mus musculus
ggacttcgacgggaagctcagcttc

SEQ ID NO: 450249 - DNA, 25 bp, Mus musculus
ggacttctagggacaaacaactgtg

SEQ ID NO: 450250 - DNA, 25 bp, Mus musculus
ggacttctcagtgaggacctggacc

SEQ ID NO: 450251 - DNA, 25 bp, Mus musculus
ggacttctcattattccgccactta

SEQ ID NO: 450252 - DNA, 25 bp, Mus musculus
ggacttctcccaatgttgcccgtaa

SEQ ID NO: 450253 - DNA, 25 bp, Mus musculus
ggacttctgaagtcgctgagaacca

SEQ ID NO: 450254 - DNA, 25 bp, Mus musculus
ggacttctgcaaagacccggatgca

SEQ ID NO: 450255 - DNA, 25 bp, Mus musculus
ggacttctgctaaaccattgctggc

SEQ ID NO: 450256 - DNA, 25 bp, Mus musculus
ggacttctggcgcttcctcctcggg

SEQ ID NO: 450257 - DNA, 25 bp, Mus musculus
ggacttctggttccctcagagtgga

SEQ ID NO: 450258 - DNA, 25 bp, Mus musculus
ggacttcttcaaactcttccatgtg

SEQ ID NO: 450259 - DNA, 25 bp, Mus musculus
ggacttgaactcagccgccctgtac

SEQ ID NO: 450260 - DNA, 25 bp, Mus musculus
ggacttgaagcacgactcgcgcatc

SEQ ID NO: 450261 - DNA, 25 bp, Mus musculus
ggacttgagacttttccacggaatg

SEQ ID NO: 450262 - DNA, 25 bp, Mus musculus
ggacttgctaccttcacctgctggg

SEQ ID NO: 450263 - DNA, 25 bp, Mus musculus
ggacttggaccctggcactagaggt

SEQ ID NO: 450264 - DNA, 25 bp, Mus musculus
ggacttgtgggtagctgaagcctct

SEQ ID NO: 450265 - DNA, 25 bp, Mus musculus
ggactttaaattctcagggcctcga

SEQ ID NO: 450266 - DNA, 25 bp, Mus musculus
ggactttagcaccatgacgcacctg

SEQ ID NO: 450267 - DNA, 25 bp, Mus musculus
ggactttgaactgcctgagagtggc

SEQ ID NO: 450268 - DNA, 25 bp, Mus musculus
ggactttgccgaccaggaaaacttg

SEQ ID NO: 450269 - DNA, 25 bp, Mus musculus
ggactttgtactcgactaccccagg

SEQ ID NO: 450270 - DNA, 25 bp, Mus musculus
ggacttttcagccaccttgagcatg

SEQ ID NO: 450271 - DNA, 25 bp, Mus musculus
ggacttttggctcaaccctgtgcaa

SEQ ID NO: 450272 - DNA, 25 bp, Mus musculus
ggactttttaccagggcttggagca

SEQ ID NO: 450273 - DNA, 25 bp, Mus musculus
ggagaaaaatggtccccttggctca

SEQ ID NO: 450274 - DNA, 25 bp, Mus musculus
ggagaaaactttagaccgcgagcaa

SEQ ID NO: 450275 - DNA, 25 bp, Mus musculus
ggagaaaagctctacactggactaa

SEQ ID NO: 450276 - DNA, 25 bp, Mus musculus
ggagaaaattcaaaacgagactact

SEQ ID NO: 450277 - DNA, 25 bp, Mus musculus
ggagaaaattcagctagaactggag

SEQ ID NO: 450278 - DNA, 25 bp, Mus musculus
ggagaaaatttccacgctgggctca

SEQ ID NO: 450279 - DNA, 25 bp, Mus musculus
ggagaaacagcgacacagcgtgtgc

SEQ ID NO: 450280 - DNA, 25 bp, Mus musculus
ggagaaacccggcaacggattccag

SEQ ID NO: 450281 - DNA, 25 bp, Mus musculus
ggagaaacccttcgccattgccaag

SEQ ID NO: 450282 - DNA, 25 bp, Mus musculus
ggagaaactgttcgttcccactggg

SEQ ID NO: 450283 - DNA, 25 bp, Mus musculus
ggagaaagacagacgagcaccttga

SEQ ID NO: 450284 - DNA, 25 bp, Mus musculus
ggagaaagagcttccaccttggcga

SEQ ID NO: 450285 - DNA, 25 bp, Mus musculus
ggagaaagccccttcatctgtgtgg

SEQ ID NO: 450286 - DNA, 25 bp, Mus musculus
ggagaaagtcaataataccctgctg

SEQ ID NO: 450287 - DNA, 25 bp, Mus musculus
ggagaaagtcccacaggctaaaaga

SEQ ID NO: 450288 - DNA, 25 bp, Mus musculus
ggagaaagtgcacttctttgtcgga

SEQ ID NO: 450289 - DNA, 25 bp, Mus musculus
ggagaaattcatggtcaacagcgct

SEQ ID NO: 450290 - DNA, 25 bp, Mus musculus
ggagaacacagtcccgactacggtc

SEQ ID NO: 450291 - DNA, 25 bp, Mus musculus
ggagaacagagacaagagaatgact

SEQ ID NO: 450292 - DNA, 25 bp, Mus musculus
ggagaacaggtggatgccttcatgt

SEQ ID NO: 450293 - DNA, 25 bp, Mus musculus
ggagaacattgccttccctaagcgg

SEQ ID NO: 450294 - DNA, 25 bp, Mus musculus
ggagaacccagctttgatatgatga

SEQ ID NO: 450295 - DNA, 25 bp, Mus musculus
ggagaaccccaacagtacaagcgtg

SEQ ID NO: 450296 - DNA, 25 bp, Mus musculus
ggagaacctctctacaatgctgtgg

SEQ ID NO: 450297 - DNA, 25 bp, Mus musculus
ggagaacctctttgtcctcagcgtg

SEQ ID NO: 450298 - DNA, 25 bp, Mus musculus
ggagaactcggccttgacagctgaa

SEQ ID NO: 450299 - DNA, 25 bp, Mus musculus
ggagaactctaaacttcagtgtgga

SEQ ID NO: 450300 - DNA, 25 bp, Mus musculus
ggagaactctctatatcaaatgaag

SEQ ID NO: 450301 - DNA, 25 bp, Mus musculus
ggagaactgacagcccgcatgaata

SEQ ID NO: 450302 - DNA, 25 bp, Mus musculus
ggagaacttcattaaaccatttagg

SEQ ID NO: 450303 - DNA, 25 bp, Mus musculus
ggagaactttctggtgccctgggca

SEQ ID NO: 450304 - DNA, 25 bp, Mus musculus
ggagaagaacagcatccttgacact

SEQ ID NO: 450305 - DNA, 25 bp, Mus musculus
ggagaagaaccttgcatatctgaag

SEQ ID NO: 450306 - DNA, 25 bp, Mus musculus
ggagaagaaggaggccatcacgtac

SEQ ID NO: 450307 - DNA, 25 bp, Mus musculus
ggagaagaccattaaccagaccatt

SEQ ID NO: 450308 - DNA, 25 bp, Mus musculus
ggagaagacccatgagcactcggga

SEQ ID NO: 450309 - DNA, 25 bp, Mus musculus
ggagaagagatctggacaattttta

SEQ ID NO: 450310 - DNA, 25 bp, Mus musculus
ggagaagattttcgagccagcatag

SEQ ID NO: 450311 - DNA, 25 bp, Mus musculus
ggagaagccgtacatgtgcagcatc

SEQ ID NO: 450312 - DNA, 25 bp, Mus musculus
ggagaagcctctagtggagcacact

SEQ ID NO: 450313 - DNA, 25 bp, Mus musculus
ggagaagctcaatgtgggacagcca

SEQ ID NO: 450314 - DNA, 25 bp, Mus musculus
ggagaaggaagctaaacacctcagc

SEQ ID NO: 450315 - DNA, 25 bp, Mus musculus
ggagaaggagatgtccaatccccag

SEQ ID NO: 450316 - DNA, 25 bp, Mus musculus
ggagaaggatccacaagtcccagag

SEQ ID NO: 450317 - DNA, 25 bp, Mus musculus
ggagaaggccatggttgccctcatt

SEQ ID NO: 450318 - DNA, 25 bp, Mus musculus
ggagaaggccttgagcaacctcatt

SEQ ID NO: 450319 - DNA, 25 bp, Mus musculus
ggagaagggatcacaagactccgcc

SEQ ID NO: 450320 - DNA, 25 bp, Mus musculus
ggagaagggctctcaatcaccacag

SEQ ID NO: 450321 - DNA, 25 bp, Mus musculus
ggagaaggttccagtgccagctgta

SEQ ID NO: 450322 - DNA, 25 bp, Mus musculus
ggagaagtcactgaacaccatggct

SEQ ID NO: 450323 - DNA, 25 bp, Mus musculus
ggagaagtcgttaaatggcccacca

SEQ ID NO: 450324 - DNA, 25 bp, Mus musculus
ggagaagtgccctaaaggagactga

SEQ ID NO: 450325 - DNA, 25 bp, Mus musculus
ggagaagtgctactgcctgccattc

SEQ ID NO: 450326 - DNA, 25 bp, Mus musculus
ggagaataagcagaaaacccacaat

SEQ ID NO: 450327 - DNA, 25 bp, Mus musculus
ggagaatactaagaaggcccttttg

SEQ ID NO: 450328 - DNA, 25 bp, Mus musculus
ggagaatactttagatatgccttaa

SEQ ID NO: 450329 - DNA, 25 bp, Mus musculus
ggagaatagctaccactgcctgtgt

SEQ ID NO: 450330 - DNA, 25 bp, Mus musculus
ggagaatccacctgaacacctgtaa

SEQ ID NO: 450331 - DNA, 25 bp, Mus musculus
ggagaatcccgtatcctcagagtaa

SEQ ID NO: 450332 - DNA, 25 bp, Mus musculus
ggagaatgaaagataccactataag

SEQ ID NO: 450333 - DNA, 25 bp, Mus musculus
ggagaatgatgaccccgagaaatgc

SEQ ID NO: 450334 - DNA, 25 bp, Mus musculus
ggagaatgctaccacccaagatgcg

SEQ ID NO: 450335 - DNA, 25 bp, Mus musculus
ggagaatgtcgctgtgtgcctgcca

SEQ ID NO: 450336 - DNA, 25 bp, Mus musculus
ggagaattgaaaagtgccaccatgc

SEQ ID NO: 450337 - DNA, 25 bp, Mus musculus
ggagaatttgacacactgccctggg

SEQ ID NO: 450338 - DNA, 25 bp, Mus musculus
ggagacaaagaaaaagcgctctggt

SEQ ID NO: 450339 - DNA, 25 bp, Mus musculus
ggagacacaaggacaaacactgcgg

SEQ ID NO: 450340 - DNA, 25 bp, Mus musculus
ggagacacacctttagatattgcag

SEQ ID NO: 450341 - DNA, 25 bp, Mus musculus
ggagacactgcagactcgtcgctca

SEQ ID NO: 450342 - DNA, 25 bp, Mus musculus
ggagacactgggacccagggtcctt

SEQ ID NO: 450343 - DNA, 25 bp, Mus musculus
ggagacagacagacgttgctggaaa

SEQ ID NO: 450344 - DNA, 25 bp, Mus musculus
ggagacagtcctgcatgtccatatt

SEQ ID NO: 450345 - DNA, 25 bp, Mus musculus
ggagacatcgatagccctgattgat

SEQ ID NO: 450346 - DNA, 25 bp, Mus musculus
ggagacatgcactacaaaacctggt

SEQ ID NO: 450347 - DNA, 25 bp, Mus musculus
ggagaccatttacccctacctagag

SEQ ID NO: 450348 - DNA, 25 bp, Mus musculus
ggagacccagattaaagacagaaag

SEQ ID NO: 450349 - DNA, 25 bp, Mus musculus
ggagaccctattcacacagagccta

SEQ ID NO: 450350 - DNA, 25 bp, Mus musculus
ggagaccctgcatagagtcctttga

SEQ ID NO: 450351 - DNA, 25 bp, Mus musculus
ggagaccgatgcaaaaccctgttag

SEQ ID NO: 450352 - DNA, 25 bp, Mus musculus
ggagaccgctctcgagtttgtaagc

SEQ ID NO: 450353 - DNA, 25 bp, Mus musculus
ggagaccgctctcttagaactgaat

SEQ ID NO: 450354 - DNA, 25 bp, Mus musculus
ggagaccggcctaagcaggcttaat

SEQ ID NO: 450355 - DNA, 25 bp, Mus musculus
ggagaccgtctgagcctaccctcgg

SEQ ID NO: 450356 - DNA, 25 bp, Mus musculus
ggagacctaaaacgccaacctcagg

SEQ ID NO: 450357 - DNA, 25 bp, Mus musculus
ggagacctccgatgctaagagcact

SEQ ID NO: 450358 - DNA, 25 bp, Mus musculus
ggagacctcctgattttatgaactt

SEQ ID NO: 450359 - DNA, 25 bp, Mus musculus
ggagacctgacatcactgactatgc

SEQ ID NO: 450360 - DNA, 25 bp, Mus musculus
ggagacctgcgactactttgagaaa

SEQ ID NO: 450361 - DNA, 25 bp, Mus musculus
ggagaccttcaccttttgccaggag

SEQ ID NO: 450362 - DNA, 25 bp, Mus musculus
ggagacctttgctcatctcagtgag

SEQ ID NO: 450363 - DNA, 25 bp, Mus musculus
ggagacgacactcagacactaggca

SEQ ID NO: 450364 - DNA, 25 bp, Mus musculus
ggagacgcaatcctgaccactgact

SEQ ID NO: 450365 - DNA, 25 bp, Mus musculus
ggagacgccggacactatagacgct

SEQ ID NO: 450366 - DNA, 25 bp, Mus musculus
ggagactacaccacagctactgatg

SEQ ID NO: 450367 - DNA, 25 bp, Mus musculus
ggagactaccatcttcccagtggaa

SEQ ID NO: 450368 - DNA, 25 bp, Mus musculus
ggagactattactgcgatgggacat

SEQ ID NO: 450369 - DNA, 25 bp, Mus musculus
ggagactcaccctgctttgctgaga

SEQ ID NO: 450370 - DNA, 25 bp, Mus musculus
ggagactcagcaggccttcgaaata

SEQ ID NO: 450371 - DNA, 25 bp, Mus musculus
ggagactctagctcactgccactgt

SEQ ID NO: 450372 - DNA, 25 bp, Mus musculus
ggagactctgctcttatcctgagga

SEQ ID NO: 450373 - DNA, 25 bp, Mus musculus
ggagactgtccccaattctgccatg

SEQ ID NO: 450374 - DNA, 25 bp, Mus musculus
ggagacttgtgcacatccattcttc

SEQ ID NO: 450375 - DNA, 25 bp, Mus musculus
ggagacttgtttgctttcctgtagc

SEQ ID NO: 450376 - DNA, 25 bp, Mus musculus
ggagactttctacccgacactgtgg

SEQ ID NO: 450377 - DNA, 25 bp, Mus musculus
ggagactttgtctaccagggccact

SEQ ID NO: 450378 - DNA, 25 bp, Mus musculus
ggagagaaacccctgaatacaggct

SEQ ID NO: 450379 - DNA, 25 bp, Mus musculus
ggagagaaaccgcaggctaacagct

SEQ ID NO: 450380 - DNA, 25 bp, Mus musculus
ggagagaaactgaccaaggaaccat

SEQ ID NO: 450381 - DNA, 25 bp, Mus musculus
ggagagaagcccttagataccctca

SEQ ID NO: 450382 - DNA, 25 bp, Mus musculus
ggagagaatcggctttctctgcaag

SEQ ID NO: 450383 - DNA, 25 bp, Mus musculus
ggagagaatgattccaacttggcag

SEQ ID NO: 450384 - DNA, 25 bp, Mus musculus
ggagagaattagatgccacagaagc

SEQ ID NO: 450385 - DNA, 25 bp, Mus musculus
ggagagaccaaagccatcgagatcg

SEQ ID NO: 450386 - DNA, 25 bp, Mus musculus
ggagagattcccatactgcaggttt

SEQ ID NO: 450387 - DNA, 25 bp, Mus musculus
ggagagattccccatggctaagatc

SEQ ID NO: 450388 - DNA, 25 bp, Mus musculus
ggagagcacagctgcgtcctgcgcc

SEQ ID NO: 450389 - DNA, 25 bp, Mus musculus
ggagagccatccacctttaaacttg

SEQ ID NO: 450390 - DNA, 25 bp, Mus musculus
ggagagcccggagtcttcgtctgta

SEQ ID NO: 450391 - DNA, 25 bp, Mus musculus
ggagagcctaccacgaagcactttt

SEQ ID NO: 450392 - DNA, 25 bp, Mus musculus
ggagagcctccactattgaaatgcc

SEQ ID NO: 450393 - DNA, 25 bp, Mus musculus
ggagagcctcgatccttcaaacctg

SEQ ID NO: 450394 - DNA, 25 bp, Mus musculus
ggagagcgtcatcgataacccctat

SEQ ID NO: 450395 - DNA, 25 bp, Mus musculus
ggagagcttccacacattagacatg

SEQ ID NO: 450396 - DNA, 25 bp, Mus musculus
ggagagcttccgattgccagtgtga

SEQ ID NO: 450397 - DNA, 25 bp, Mus musculus
ggagaggaccgaagcccttgactta

SEQ ID NO: 450398 - DNA, 25 bp, Mus musculus
ggagaggccatggtctgcgtctaaa

SEQ ID NO: 450399 - DNA, 25 bp, Mus musculus
ggagaggccgcatccacattgatgt

SEQ ID NO: 450400 - DNA, 25 bp, Mus musculus
ggagaggtgctttcagtttcactgc

SEQ ID NO: 450401 - DNA, 25 bp, Mus musculus
ggagagtactcacaggccctttgct

SEQ ID NO: 450402 - DNA, 25 bp, Mus musculus
ggagagtccaaatggctgtgctgta

SEQ ID NO: 450403 - DNA, 25 bp, Mus musculus
ggagagtgagctagatctgcgacac

SEQ ID NO: 450404 - DNA, 25 bp, Mus musculus
ggagagtgttctaataaacctttgc

SEQ ID NO: 450405 - DNA, 25 bp, Mus musculus
ggagagttagctttcctagcaaggg

SEQ ID NO: 450406 - DNA, 25 bp, Mus musculus
ggagagttattccagtttagaagga

SEQ ID NO: 450407 - DNA, 25 bp, Mus musculus
ggagataagtttgccagccgacatg

SEQ ID NO: 450408 - DNA, 25 bp, Mus musculus
ggagataatcctgaatggcaacgag

SEQ ID NO: 450409 - DNA, 25 bp, Mus musculus
ggagataattaggagccatgtcagc

SEQ ID NO: 450410 - DNA, 25 bp, Mus musculus
ggagatacacatcctctaacgttgg

SEQ ID NO: 450411 - DNA, 25 bp, Mus musculus
ggagatactgcctggaaccttcccc

SEQ ID NO: 450412 - DNA, 25 bp, Mus musculus
ggagatcacacttagcctgaagcag

SEQ ID NO: 450413 - DNA, 25 bp, Mus musculus
ggagatccaagtccaggaaccctag

SEQ ID NO: 450414 - DNA, 25 bp, Mus musculus
ggagatccatcaaatggcctagcct

SEQ ID NO: 450415 - DNA, 25 bp, Mus musculus
ggagatcccaaccaagatgcgagtg

SEQ ID NO: 450416 - DNA, 25 bp, Mus musculus
ggagatccggtatgcaatgcctgcg

SEQ ID NO: 450417 - DNA, 25 bp, Mus musculus
ggagatcgagaacaaccctacagtc

SEQ ID NO: 450418 - DNA, 25 bp, Mus musculus
ggagatcgccttctaccggaaagat

SEQ ID NO: 450419 - DNA, 25 bp, Mus musculus
ggagatcgcgctagaccctgtcttg

SEQ ID NO: 450420 - DNA, 25 bp, Mus musculus
ggagatctcaatatacacagtgcaa

SEQ ID NO: 450421 - DNA, 25 bp, Mus musculus
ggagatgaccactgtgttggctcag

SEQ ID NO: 450422 - DNA, 25 bp, Mus musculus
ggagatgcactgctcatgaatgaga

SEQ ID NO: 450423 - DNA, 25 bp, Mus musculus
ggagatgccatcaaccttatagtaa

SEQ ID NO: 450424 - DNA, 25 bp, Mus musculus
ggagatgctaaaaaacccacgccgg

SEQ ID NO: 450425 - DNA, 25 bp, Mus musculus
ggagatgctatttcagtgagatgca

SEQ ID NO: 450426 - DNA, 25 bp, Mus musculus
ggagatgctccaaatgacccacgtg

SEQ ID NO: 450427 - DNA, 25 bp, Mus musculus
ggagatgctggatcacttacccgag

SEQ ID NO: 450428 - DNA, 25 bp, Mus musculus
ggagatggagggtccctgagggaca

SEQ ID NO: 450429 - DNA, 25 bp, Mus musculus
ggagatgtggaaacagaaggttttc

SEQ ID NO: 450430 - DNA, 25 bp, Mus musculus
ggagattcacagaccggccatgatg

SEQ ID NO: 450431 - DNA, 25 bp, Mus musculus
ggagattgagcctagagcctctgca

SEQ ID NO: 450432 - DNA, 25 bp, Mus musculus
ggagattgccgcatcaccaaggaca

SEQ ID NO: 450433 - DNA, 25 bp, Mus musculus
ggagattgtggaccccgttgacatc

SEQ ID NO: 450434 - DNA, 25 bp, Mus musculus
ggagcaaacgtggatgcctcagcct

SEQ ID NO: 450435 - DNA, 25 bp, Mus musculus
ggagcaaatctcagccgtcactaag

SEQ ID NO: 450436 - DNA, 25 bp, Mus musculus
ggagcaaatgtcactggattccagt

SEQ ID NO: 450437 - DNA, 25 bp, Mus musculus
ggagcaagacctgaatgacctcggt

SEQ ID NO: 450438 - DNA, 25 bp, Mus musculus
ggagcaagagaacctacttcctgtg

SEQ ID NO: 450439 - DNA, 25 bp, Mus musculus
ggagcaagccttgatacttccagac

SEQ ID NO: 450440 - DNA, 25 bp, Mus musculus
ggagcaagctcggtcaatgggataa

SEQ ID NO: 450441 - DNA, 25 bp, Mus musculus
ggagcaaggatcgcgtgctagctta

SEQ ID NO: 450442 - DNA, 25 bp, Mus musculus
ggagcaataaccatcgcaacgacca

SEQ ID NO: 450443 - DNA, 25 bp, Mus musculus
ggagcaatcctaagtggccagacat

SEQ ID NO: 450444 - DNA, 25 bp, Mus musculus
ggagcaatgcgccaaactgtacagc

SEQ ID NO: 450445 - DNA, 25 bp, Mus musculus
ggagcacagccctttccagatcagg

SEQ ID NO: 450446 - DNA, 25 bp, Mus musculus
ggagcacagcgcctctctataggag

SEQ ID NO: 450447 - DNA, 25 bp, Mus musculus
ggagcacagtgcctaccagacaatt

SEQ ID NO: 450448 - DNA, 25 bp, Mus musculus
ggagcacatggtgccttctgaccac

SEQ ID NO: 450449 - DNA, 25 bp, Mus musculus
ggagcaccccatcgtggcctttgaa

SEQ ID NO: 450450 - DNA, 25 bp, Mus musculus
ggagcacccctatggtagatattga

SEQ ID NO: 450451 - DNA, 25 bp, Mus musculus
ggagcaccctgattcactagctgag

SEQ ID NO: 450452 - DNA, 25 bp, Mus musculus
ggagcaccgacttgattccctctaa

SEQ ID NO: 450453 - DNA, 25 bp, Mus musculus
ggagcactacaacatgacagccgag

SEQ ID NO: 450454 - DNA, 25 bp, Mus musculus
ggagcactcctctgtcctcgtcatg

SEQ ID NO: 450455 - DNA, 25 bp, Mus musculus
ggagcagaagctagaggcacacagc

SEQ ID NO: 450456 - DNA, 25 bp, Mus musculus
ggagcagacattagcaacaccctgg

SEQ ID NO: 450457 - DNA, 25 bp, Mus musculus
ggagcagatgacacctgggcccagc

SEQ ID NO: 450458 - DNA, 25 bp, Mus musculus
ggagcagccctcttgcaaaaaagcc

SEQ ID NO: 450459 - DNA, 25 bp, Mus musculus
ggagcagcctgccacttgaacttcc

SEQ ID NO: 450460 - DNA, 25 bp, Mus musculus
ggagcagccttcttgcctctgctct

SEQ ID NO: 450461 - DNA, 25 bp, Mus musculus
ggagcagctattcaacatggccaag

SEQ ID NO: 450462 - DNA, 25 bp, Mus musculus
ggagcagctttcagtctggccgaga

SEQ ID NO: 450463 - DNA, 25 bp, Mus musculus
ggagcaggaggtgccagcttggagg

SEQ ID NO: 450464 - DNA, 25 bp, Mus musculus
ggagcaggatcatgagccaccctat

SEQ ID NO: 450465 - DNA, 25 bp, Mus musculus
ggagcaggctcataacccacttaat

SEQ ID NO: 450466 - DNA, 25 bp, Mus musculus
ggagcagggttcctagcaacttata

SEQ ID NO: 450467 - DNA, 25 bp, Mus musculus
ggagcagtggcctgtcgctctctgc

SEQ ID NO: 450468 - DNA, 25 bp, Mus musculus
ggagcagttccaccagcctcggaac

SEQ ID NO: 450469 - DNA, 25 bp, Mus musculus
ggagcatatcgtgcccaacgctgaa

SEQ ID NO: 450470 - DNA, 25 bp, Mus musculus
ggagcatccaccacctcttcaatga

SEQ ID NO: 450471 - DNA, 25 bp, Mus musculus
ggagcatcccgaggccctttctttg

SEQ ID NO: 450472 - DNA, 25 bp, Mus musculus
ggagcatcgcgtacgcccggaagaa

SEQ ID NO: 450473 - DNA, 25 bp, Mus musculus
ggagcatgcgccgtccatcgtgttc

SEQ ID NO: 450474 - DNA, 25 bp, Mus musculus
ggagcatgtggccatacaactctta

SEQ ID NO: 450475 - DNA, 25 bp, Mus musculus
ggagcatgtgtaacagcctcttctc

SEQ ID NO: 450476 - DNA, 25 bp, Mus musculus
ggagcattaccttccccgtggaata

SEQ ID NO: 450477 - DNA, 25 bp, Mus musculus
ggagcattagctgaactgagcaggc

SEQ ID NO: 450478 - DNA, 25 bp, Mus musculus
ggagcatttacagccttactgggag

SEQ ID NO: 450479 - DNA, 25 bp, Mus musculus
ggagccaaaatcagtgccagagaca

SEQ ID NO: 450480 - DNA, 25 bp, Mus musculus
ggagccaacaattgactgagtctgt

SEQ ID NO: 450481 - DNA, 25 bp, Mus musculus
ggagccaacatccatgaccaacttt

SEQ ID NO: 450482 - DNA, 25 bp, Mus musculus
ggagccaaccagaccgtgtgtgaac

SEQ ID NO: 450483 - DNA, 25 bp, Mus musculus
ggagccacaagcctgcagtgaatgt

SEQ ID NO: 450484 - DNA, 25 bp, Mus musculus
ggagccacagatgccataagccttg

SEQ ID NO: 450485 - DNA, 25 bp, Mus musculus
ggagccacagcctggcacgaatttt

SEQ ID NO: 450486 - DNA, 25 bp, Mus musculus
ggagccaccagcgagttctatgaca

SEQ ID NO: 450487 - DNA, 25 bp, Mus musculus
ggagccaccgtagttagtattaatg

SEQ ID NO: 450488 - DNA, 25 bp, Mus musculus
ggagccactgctgcctttagacaaa

SEQ ID NO: 450489 - DNA, 25 bp, Mus musculus
ggagccagactccattttctcaagt

SEQ ID NO: 450490 - DNA, 25 bp, Mus musculus
ggagccagagctttaacaactacga

SEQ ID NO: 450491 - DNA, 25 bp, Mus musculus
ggagccagagttagaaaatgagttg

SEQ ID NO: 450492 - DNA, 25 bp, Mus musculus
ggagccagcgtaacgggccgctagt

SEQ ID NO: 450493 - DNA, 25 bp, Mus musculus
ggagccaggactacattaatgacgc

SEQ ID NO: 450494 - DNA, 25 bp, Mus musculus
ggagccaggtatgtggcccaaatcc

SEQ ID NO: 450495 - DNA, 25 bp, Mus musculus
ggagccatcaggaaaagcaaacgaa

SEQ ID NO: 450496 - DNA, 25 bp, Mus musculus
ggagccatgtcttattacactgcca

SEQ ID NO: 450497 - DNA, 25 bp, Mus musculus
ggagccatgttgcacgatatggtca

SEQ ID NO: 450498 - DNA, 25 bp, Mus musculus
ggagcccaaagaaccaatatctgac

SEQ ID NO: 450499 - DNA, 25 bp, Mus musculus
ggagcccaactggtagccttgaaga

SEQ ID NO: 450500 - DNA, 25 bp, Mus musculus
ggagcccactaattctgcagagact

SEQ ID NO: 450501 - DNA, 25 bp, Mus musculus
ggagcccagaacagataatacctga

SEQ ID NO: 450502 - DNA, 25 bp, Mus musculus
ggagcccagcatgtagatagacaga

SEQ ID NO: 450503 - DNA, 25 bp, Mus musculus
ggagcccagccctgtagaagtaaga

SEQ ID NO: 450504 - DNA, 25 bp, Mus musculus
ggagcccatctttattgtcacggag

SEQ ID NO: 450505 - DNA, 25 bp, Mus musculus
ggagcccatggatacgcaagaggaa

SEQ ID NO: 450506 - DNA, 25 bp, Mus musculus
ggagccccgagagatcctgattcga

SEQ ID NO: 450507 - DNA, 25 bp, Mus musculus
ggagccccgggtcatatcctatgtt

SEQ ID NO: 450508 - DNA, 25 bp, Mus musculus
ggagccccgtcaccaagtctgttat

SEQ ID NO: 450509 - DNA, 25 bp, Mus musculus
ggagcccctaacctgactatcatga

SEQ ID NO: 450510 - DNA, 25 bp, Mus musculus
ggagccctcatcttacatcagtgca

SEQ ID NO: 450511 - DNA, 25 bp, Mus musculus
ggagccctgcgagaattacatgcga

SEQ ID NO: 450512 - DNA, 25 bp, Mus musculus
ggagccctggggaactgtcttcatg

SEQ ID NO: 450513 - DNA, 25 bp, Mus musculus
ggagccgagctttcaaaccgacgca

SEQ ID NO: 450514 - DNA, 25 bp, Mus musculus
ggagccgcagacctacaggtccttc

SEQ ID NO: 450515 - DNA, 25 bp, Mus musculus
ggagccggtatcacccatgtgtgaa

SEQ ID NO: 450516 - DNA, 25 bp, Mus musculus
ggagcctaataacccctgaaacatg

SEQ ID NO: 450517 - DNA, 25 bp, Mus musculus
ggagcctagagcctgaaaatcactt

SEQ ID NO: 450518 - DNA, 25 bp, Mus musculus
ggagcctagtgtggcctcaaacttg

SEQ ID NO: 450519 - DNA, 25 bp, Mus musculus
ggagcctccacataaccaattcaga

SEQ ID NO: 450520 - DNA, 25 bp, Mus musculus
ggagcctccgcttgtggattgagaa

SEQ ID NO: 450521 - DNA, 25 bp, Mus musculus
ggagcctcctgtttgccccttggaa

SEQ ID NO: 450522 - DNA, 25 bp, Mus musculus
ggagcctcggaatcattttactgga

SEQ ID NO: 450523 - DNA, 25 bp, Mus musculus
ggagcctctctgtggatttagcata

SEQ ID NO: 450524 - DNA, 25 bp, Mus musculus
ggagcctgaactgacccagagatgc

SEQ ID NO: 450525 - DNA, 25 bp, Mus musculus
ggagcctgaagccatcctggacact

SEQ ID NO: 450526 - DNA, 25 bp, Mus musculus
ggagcctgccctgctaaaaagcctg

SEQ ID NO: 450527 - DNA, 25 bp, Mus musculus
ggagcctgctggttgcccttgaaca

SEQ ID NO: 450528 - DNA, 25 bp, Mus musculus
ggagcctgggctgggtgtggcccaa

SEQ ID NO: 450529 - DNA, 25 bp, Mus musculus
ggagccttagactttgcccaggaac

SEQ ID NO: 450530 - DNA, 25 bp, Mus musculus
ggagccttctcctggagtactgtgg

SEQ ID NO: 450531 - DNA, 25 bp, Mus musculus
ggagccttgcctcactgcgctctcc

SEQ ID NO: 450532 - DNA, 25 bp, Mus musculus
ggagcgacgcgctcggtcttcgtcc

SEQ ID NO: 450533 - DNA, 25 bp, Mus musculus
ggagcgactggacacacttaagaca

SEQ ID NO: 450534 - DNA, 25 bp, Mus musculus
ggagcgagagcttctggctgcctca

SEQ ID NO: 450535 - DNA, 25 bp, Mus musculus
ggagcgagatagcagtccacactag

SEQ ID NO: 450536 - DNA, 25 bp, Mus musculus
ggagcgagtcaaggccatgttctac

SEQ ID NO: 450537 - DNA, 25 bp, Mus musculus
ggagcgcactctgttttcggaaaag

SEQ ID NO: 450538 - DNA, 25 bp, Mus musculus
ggagcgcagcgaagcccatttttct

SEQ ID NO: 450539 - DNA, 25 bp, Mus musculus
ggagcgccctagaccttcagtagaa

SEQ ID NO: 450540 - DNA, 25 bp, Mus musculus
ggagcgcctgcactctcagcatgac

SEQ ID NO: 450541 - DNA, 25 bp, Mus musculus
ggagcgcgacgattccaaagatgaa

SEQ ID NO: 450542 - DNA, 25 bp, Mus musculus
ggagcgcgggccgtgctcaaaactc

SEQ ID NO: 450543 - DNA, 25 bp, Mus musculus
ggagcgctcgatgcctactacaagc

SEQ ID NO: 450544 - DNA, 25 bp, Mus musculus
ggagcggctaggtgacctccttaag

SEQ ID NO: 450545 - DNA, 25 bp, Mus musculus
ggagcggtagtcatgtgtagctttc

SEQ ID NO: 450546 - DNA, 25 bp, Mus musculus
ggagcgtgaagagcctaaatgtttc

SEQ ID NO: 450547 - DNA, 25 bp, Mus musculus
ggagcgtgagtgagccttgacacac

SEQ ID NO: 450548 - DNA, 25 bp, Mus musculus
ggagcgtgctacctgaataagattg

SEQ ID NO: 450549 - DNA, 25 bp, Mus musculus
ggagctaaagcatcgatcatggctg

SEQ ID NO: 450550 - DNA, 25 bp, Mus musculus
ggagctaaataaccgccgaggacag

SEQ ID NO: 450551 - DNA, 25 bp, Mus musculus
ggagctaacctactaccactgagaa

SEQ ID NO: 450552 - DNA, 25 bp, Mus musculus
ggagctacacctgggacagaaacag

SEQ ID NO: 450553 - DNA, 25 bp, Mus musculus
ggagctaccctgcttatttgatatg

SEQ ID NO: 450554 - DNA, 25 bp, Mus musculus
ggagctaggcacatggtacttggat

SEQ ID NO: 450555 - DNA, 25 bp, Mus musculus
ggagctaggccctcaaagtctgccc

SEQ ID NO: 450556 - DNA, 25 bp, Mus musculus
ggagctagggtaagtgtccacctac

SEQ ID NO: 450557 - DNA, 25 bp, Mus musculus
ggagctataacccaaatgacacctg

SEQ ID NO: 450558 - DNA, 25 bp, Mus musculus
ggagctatagtcaccaaaagacctt

SEQ ID NO: 450559 - DNA, 25 bp, Mus musculus
ggagctatcctatcagagactgggc

SEQ ID NO: 450560 - DNA, 25 bp, Mus musculus
ggagctatctcatcgccccttaaga

SEQ ID NO: 450561 - DNA, 25 bp, Mus musculus
ggagctcagagctttgaccagcctg

SEQ ID NO: 450562 - DNA, 25 bp, Mus musculus
ggagctcagccgctttctctgatcc

SEQ ID NO: 450563 - DNA, 25 bp, Mus musculus
ggagctcaggatcgctactcctggt

SEQ ID NO: 450564 - DNA, 25 bp, Mus musculus
ggagctcagggacctcaaacaactg

SEQ ID NO: 450565 - DNA, 25 bp, Mus musculus
ggagctcagtgagtcccctcggtta

SEQ ID NO: 450566 - DNA, 25 bp, Mus musculus
ggagctccatcatcccaagcagtgg

SEQ ID NO: 450567 - DNA, 25 bp, Mus musculus
ggagctccatcttgcactgggcaga

SEQ ID NO: 450568 - DNA, 25 bp, Mus musculus
ggagctcccgaaactgccgcgtaaa

SEQ ID NO: 450569 - DNA, 25 bp, Mus musculus
ggagctccggaacaaggcaaatatt

SEQ ID NO: 450570 - DNA, 25 bp, Mus musculus
ggagctcctacatggtgcactggaa

SEQ ID NO: 450571 - DNA, 25 bp, Mus musculus
ggagctccttgggatttctttgaaa

SEQ ID NO: 450572 - DNA, 25 bp, Mus musculus
ggagctcgtcttccgacagaccatg

SEQ ID NO: 450573 - DNA, 25 bp, Mus musculus
ggagctcgtgaagctgtttccccgg

SEQ ID NO: 450574 - DNA, 25 bp, Mus musculus
ggagctctccagatgtgtgcgtaca

SEQ ID NO: 450575 - DNA, 25 bp, Mus musculus
ggagctctcccaaggcctgagggaa

SEQ ID NO: 450576 - DNA, 25 bp, Mus musculus
ggagctctctgtgggtcaccagcag

SEQ ID NO: 450577 - DNA, 25 bp, Mus musculus
ggagctctgtgaatgttgataagtc

SEQ ID NO: 450578 - DNA, 25 bp, Mus musculus
ggagctcttgttctcaaccactggg

SEQ ID NO: 450579 - DNA, 25 bp, Mus musculus
ggagctctttgccatgttgcctgta

SEQ ID NO: 450580 - DNA, 25 bp, Mus musculus
ggagctgacagaaaacattgttaca

SEQ ID NO: 450581 - DNA, 25 bp, Mus musculus
ggagctgaccgtgttgttgccaatg

SEQ ID NO: 450582 - DNA, 25 bp, Mus musculus
ggagctgacctgcaccttcaatgag

SEQ ID NO: 450583 - DNA, 25 bp, Mus musculus
ggagctgatagagaggcataaaaca

SEQ ID NO: 450584 - DNA, 25 bp, Mus musculus
ggagctgcaaaccataggccttcaa

SEQ ID NO: 450585 - DNA, 25 bp, Mus musculus
ggagctgcctgtagatcccctggct

SEQ ID NO: 450586 - DNA, 25 bp, Mus musculus
ggagctgccttcctccgacattttg

SEQ ID NO: 450587 - DNA, 25 bp, Mus musculus
ggagctgcgcttcgcatctgtccgc

SEQ ID NO: 450588 - DNA, 25 bp, Mus musculus
ggagctgctctcaaaaaagattctg

SEQ ID NO: 450589 - DNA, 25 bp, Mus musculus
ggagctgctgcacgtcaacgatgac

SEQ ID NO: 450590 - DNA, 25 bp, Mus musculus
ggagctggaagcatagccaatggca

SEQ ID NO: 450591 - DNA, 25 bp, Mus musculus
ggagctggccttcactttctgagaa

SEQ ID NO: 450592 - DNA, 25 bp, Mus musculus
ggagctgggcactaccttctgcaag

SEQ ID NO: 450593 - DNA, 25 bp, Mus musculus
ggagctgggcttcaacgattaccta

SEQ ID NO: 450594 - DNA, 25 bp, Mus musculus
ggagctggtgatgcatgctatcacc

SEQ ID NO: 450595 - DNA, 25 bp, Mus musculus
ggagctgtcagcatttcctttgtga

SEQ ID NO: 450596 - DNA, 25 bp, Mus musculus
ggagctgtctaaccaggatgcttca

SEQ ID NO: 450597 - DNA, 25 bp, Mus musculus
ggagctgtgaaggacatcaaccatt

SEQ ID NO: 450598 - DNA, 25 bp, Mus musculus
ggagctgtgcaagcccatggctacc

SEQ ID NO: 450599 - DNA, 25 bp, Mus musculus
ggagctgtgtcctacgttgaatgtt

SEQ ID NO: 450600 - DNA, 25 bp, Mus musculus
ggagctgtttctctgcacacgagga

SEQ ID NO: 450601 - DNA, 25 bp, Mus musculus
ggagctgtttctcttgccctgggct

SEQ ID NO: 450602 - DNA, 25 bp, Mus musculus
ggagcttacatatgtcactcaccag

SEQ ID NO: 450603 - DNA, 25 bp, Mus musculus
ggagcttcaagaccatctttgcgga

SEQ ID NO: 450604 - DNA, 25 bp, Mus musculus
ggagcttctaggtctttcccagatg

SEQ ID NO: 450605 - DNA, 25 bp, Mus musculus
ggagcttgcttcaaaggcctacgac

SEQ ID NO: 450606 - DNA, 25 bp, Mus musculus
ggagcttgctttagcttccctgatg

SEQ ID NO: 450607 - DNA, 25 bp, Mus musculus
ggagcttgcttttctgcacgctgct

SEQ ID NO: 450608 - DNA, 25 bp, Mus musculus
ggagcttggtgtttgtagtctacga

SEQ ID NO: 450609 - DNA, 25 bp, Mus musculus
ggagcttgttcgagatccacaggca

SEQ ID NO: 450610 - DNA, 25 bp, Mus musculus
ggagctttagtcaagagccctcaga

SEQ ID NO: 450611 - DNA, 25 bp, Mus musculus
ggagctttcagacgacatactaggc

SEQ ID NO: 450612 - DNA, 25 bp, Mus musculus
ggagctttgtcttcacttctgtaga

SEQ ID NO: 450613 - DNA, 25 bp, Mus musculus
ggagctttgtgaattcctcagttga

SEQ ID NO: 450614 - DNA, 25 bp, Mus musculus
ggaggaaattttatgccgactaaga

SEQ ID NO: 450615 - DNA, 25 bp, Mus musculus
ggaggaaccatggtcagcgtgctca

SEQ ID NO: 450616 - DNA, 25 bp, Mus musculus
ggaggaacccctattactgctgctg

SEQ ID NO: 450617 - DNA, 25 bp, Mus musculus
ggaggaaccctcattttaggtccag

SEQ ID NO: 450618 - DNA, 25 bp, Mus musculus
ggaggaacctttcctctgtcccaca

SEQ ID NO: 450619 - DNA, 25 bp, Mus musculus
ggaggaacttgaactgtgatagccc

SEQ ID NO: 450620 - DNA, 25 bp, Mus musculus
ggaggaagacatgcctgcgggtgaa

SEQ ID NO: 450621 - DNA, 25 bp, Mus musculus
ggaggaagcagagataaagactcac

SEQ ID NO: 450622 - DNA, 25 bp, Mus musculus
ggaggaagccatcccattgccgtgt

SEQ ID NO: 450623 - DNA, 25 bp, Mus musculus
ggaggaatatcgtagctggccgctt

SEQ ID NO: 450624 - DNA, 25 bp, Mus musculus
ggaggaattctacaccaaggctgag

SEQ ID NO: 450625 - DNA, 25 bp, Mus musculus
ggaggaattttcagccccgctggaa

SEQ ID NO: 450626 - DNA, 25 bp, Mus musculus
ggaggacacctcgtatctgtgctca

SEQ ID NO: 450627 - DNA, 25 bp, Mus musculus
ggaggacactgggatccagactcca

SEQ ID NO: 450628 - DNA, 25 bp, Mus musculus
ggaggacactgtgcctccatctgtt

SEQ ID NO: 450629 - DNA, 25 bp, Mus musculus
ggaggacagctgttcgggttttcac

SEQ ID NO: 450630 - DNA, 25 bp, Mus musculus
ggaggacatctttctaatactgtaa

SEQ ID NO: 450631 - DNA, 25 bp, Mus musculus
ggaggaccacagaaccactgggata

SEQ ID NO: 450632 - DNA, 25 bp, Mus musculus
ggaggaccaggatcttgccaaagca

SEQ ID NO: 450633 - DNA, 25 bp, Mus musculus
ggaggactcgcttctgcacttgaca

SEQ ID NO: 450634 - DNA, 25 bp, Mus musculus
ggaggacttatcagccgaagcaggc

SEQ ID NO: 450635 - DNA, 25 bp, Mus musculus
ggaggacttcagcatcgaccacagt

SEQ ID NO: 450636 - DNA, 25 bp, Mus musculus
ggaggacttcctcaactcttgtccc

SEQ ID NO: 450637 - DNA, 25 bp, Mus musculus
ggaggagacgttctagctcgcacat

SEQ ID NO: 450638 - DNA, 25 bp, Mus musculus
ggaggagactcagccacgagtgaaa

SEQ ID NO: 450639 - DNA, 25 bp, Mus musculus
ggaggagagaacctttgtgtctaca

SEQ ID NO: 450640 - DNA, 25 bp, Mus musculus
ggaggagccttaacaccttgtgtag

SEQ ID NO: 450641 - DNA, 25 bp, Mus musculus
ggaggagcgctcgttctagttcgtc

SEQ ID NO: 450642 - DNA, 25 bp, Mus musculus
ggaggagctatgcaccaagatcaca

SEQ ID NO: 450643 - DNA, 25 bp, Mus musculus
ggaggaggcctacacccatcttagt

SEQ ID NO: 450644 - DNA, 25 bp, Mus musculus
ggaggaggccttcacgcacattaag

SEQ ID NO: 450645 - DNA, 25 bp, Mus musculus
ggaggagtctaagagagccatcagc

SEQ ID NO: 450646 - DNA, 25 bp, Mus musculus
ggaggagttcctcacactaatcagg

SEQ ID NO: 450647 - DNA, 25 bp, Mus musculus
ggaggatagttaccagcatcgtttg

SEQ ID NO: 450648 - DNA, 25 bp, Mus musculus
ggaggatgactctgttttatgggta

SEQ ID NO: 450649 - DNA, 25 bp, Mus musculus
ggaggatgcctctctgggcactctt

SEQ ID NO: 450650 - DNA, 25 bp, Mus musculus
ggaggatgtgcgatataaaccaggc

SEQ ID NO: 450651 - DNA, 25 bp, Mus musculus
ggaggattgactctagctcctgctt

SEQ ID NO: 450652 - DNA, 25 bp, Mus musculus
ggaggcaaaaccataggccagttta

SEQ ID NO: 450653 - DNA, 25 bp, Mus musculus
ggaggcaatctctggaaaatagtat

SEQ ID NO: 450654 - DNA, 25 bp, Mus musculus
ggaggcacctgaaacactaattgga

SEQ ID NO: 450655 - DNA, 25 bp, Mus musculus
ggaggcagaacacatgccctctctc

SEQ ID NO: 450656 - DNA, 25 bp, Mus musculus
ggaggcagaagtaagaagatcctga

SEQ ID NO: 450657 - DNA, 25 bp, Mus musculus
ggaggcagacccaggactttactga

SEQ ID NO: 450658 - DNA, 25 bp, Mus musculus
ggaggcagcacagcatctttggaga

SEQ ID NO: 450659 - DNA, 25 bp, Mus musculus
ggaggcaggtcagtttgcacactta

SEQ ID NO: 450660 - DNA, 25 bp, Mus musculus
ggaggcattcgacttcctaacggaa

SEQ ID NO: 450661 - DNA, 25 bp, Mus musculus
ggaggccaccatcgcagagttagaa

SEQ ID NO: 450662 - DNA, 25 bp, Mus musculus
ggaggccagcgtctgacattataag

SEQ ID NO: 450663 - DNA, 25 bp, Mus musculus
ggaggccattgtcgccatgtttgac

SEQ ID NO: 450664 - DNA, 25 bp, Mus musculus
ggaggccccacaaaaagcgtcatga

SEQ ID NO: 450665 - DNA, 25 bp, Mus musculus
ggaggccgttcactcagctgtatca

SEQ ID NO: 450666 - DNA, 25 bp, Mus musculus
ggaggcctacctgcgtgaagattga

SEQ ID NO: 450667 - DNA, 25 bp, Mus musculus
ggaggcctctatggacctggtgaaa

SEQ ID NO: 450668 - DNA, 25 bp, Mus musculus
ggaggcctctcaatcggttcagttg

SEQ ID NO: 450669 - DNA, 25 bp, Mus musculus
ggaggcctttaagttatagaacatc

SEQ ID NO: 450670 - DNA, 25 bp, Mus musculus
ggaggcggtacagttcctgaccctg

SEQ ID NO: 450671 - DNA, 25 bp, Mus musculus
ggaggctccgaggtctaacattatt

SEQ ID NO: 450672 - DNA, 25 bp, Mus musculus
ggaggctctgacttatgacggtgca

SEQ ID NO: 450673 - DNA, 25 bp, Mus musculus
ggaggctcttaacaacatgggattt

SEQ ID NO: 450674 - DNA, 25 bp, Mus musculus
ggaggctgactcttaaatggctcta

SEQ ID NO: 450675 - DNA, 25 bp, Mus musculus
ggaggctggacctcggatatacggg

SEQ ID NO: 450676 - DNA, 25 bp, Mus musculus
ggaggctggccttttccaggaccgc

SEQ ID NO: 450677 - DNA, 25 bp, Mus musculus
ggaggcttccaccaatccgtacaga

SEQ ID NO: 450678 - DNA, 25 bp, Mus musculus
ggaggcttcttatgcgtctttcaaa

SEQ ID NO: 450679 - DNA, 25 bp, Mus musculus
ggaggcttggatggaattgcagtct

SEQ ID NO: 450680 - DNA, 25 bp, Mus musculus
ggagggaaacagtcaggtgataatt

SEQ ID NO: 450681 - DNA, 25 bp, Mus musculus
ggagggaccccagcttaagtcggat

SEQ ID NO: 450682 - DNA, 25 bp, Mus musculus
ggagggatacaggactaaacgacac

SEQ ID NO: 450683 - DNA, 25 bp, Mus musculus
ggagggcaatagattaaacttcacc

SEQ ID NO: 450684 - DNA, 25 bp, Mus musculus
ggagggcacatctgtgaggaatttt

SEQ ID NO: 450685 - DNA, 25 bp, Mus musculus
ggagggcacctggaacactggatat

SEQ ID NO: 450686 - DNA, 25 bp, Mus musculus
ggagggcactcactcacatgcttgg

SEQ ID NO: 450687 - DNA, 25 bp, Mus musculus
ggagggcagctttctaaccatataa

SEQ ID NO: 450688 - DNA, 25 bp, Mus musculus
ggagggccagagttcactcccaaca

SEQ ID NO: 450689 - DNA, 25 bp, Mus musculus
ggagggccatctgcgtatccatcaa

SEQ ID NO: 450690 - DNA, 25 bp, Mus musculus
ggagggcccaacagatggcagcctc

SEQ ID NO: 450691 - DNA, 25 bp, Mus musculus
ggagggccgcctttgatgttctgac

SEQ ID NO: 450692 - DNA, 25 bp, Mus musculus
ggagggcggcttactaaacctgaga

SEQ ID NO: 450693 - DNA, 25 bp, Mus musculus
ggagggctcagacatcaggacatca

SEQ ID NO: 450694 - DNA, 25 bp, Mus musculus
ggagggctcccatgaagctaatgaa

SEQ ID NO: 450695 - DNA, 25 bp, Mus musculus
ggagggctgcatacaccatcatcaa

SEQ ID NO: 450696 - DNA, 25 bp, Mus musculus
ggagggctttcagaggcaactgcaa

SEQ ID NO: 450697 - DNA, 25 bp, Mus musculus
ggagggtaaccataagccagggact

SEQ ID NO: 450698 - DNA, 25 bp, Mus musculus
ggagggtcctgaatgagctcatcta

SEQ ID NO: 450699 - DNA, 25 bp, Mus musculus
ggagggtgacccacatcatagtgct

SEQ ID NO: 450700 - DNA, 25 bp, Mus musculus
ggaggtaaggttcatgttcagttca

SEQ ID NO: 450701 - DNA, 25 bp, Mus musculus
ggaggtagctgtgttcacagtcgaa

SEQ ID NO: 450702 - DNA, 25 bp, Mus musculus
ggaggtcaccgtagctcgcatctca

SEQ ID NO: 450703 - DNA, 25 bp, Mus musculus
ggaggtcactaccatgcccatgtgg

SEQ ID NO: 450704 - DNA, 25 bp, Mus musculus
ggaggtcactgaacatgggctgcat

SEQ ID NO: 450705 - DNA, 25 bp, Mus musculus
ggaggtcagagcttcgttccagaag

SEQ ID NO: 450706 - DNA, 25 bp, Mus musculus
ggaggtcatcttcaacagccggtag

SEQ ID NO: 450707 - DNA, 25 bp, Mus musculus
ggaggtcatgttcgcccctcaagaa

SEQ ID NO: 450708 - DNA, 25 bp, Mus musculus
ggaggtccagccttcttgcgaaagc

SEQ ID NO: 450709 - DNA, 25 bp, Mus musculus
ggaggtccagctacagagagagcca

SEQ ID NO: 450710 - DNA, 25 bp, Mus musculus
ggaggtcccgcctagattcctgaag

SEQ ID NO: 450711 - DNA, 25 bp, Mus musculus
ggaggtccgagttctcgtccccacg

SEQ ID NO: 450712 - DNA, 25 bp, Mus musculus
ggaggtctcccagccatgtacagaa

SEQ ID NO: 450713 - DNA, 25 bp, Mus musculus
ggaggtctgccctgacttgcaaatc

SEQ ID NO: 450714 - DNA, 25 bp, Mus musculus
ggaggtctgctactcaccaggagaa

SEQ ID NO: 450715 - DNA, 25 bp, Mus musculus
ggaggtcttctccactcactgaggc

SEQ ID NO: 450716 - DNA, 25 bp, Mus musculus
ggaggtgccaaaggagtcttctagc

SEQ ID NO: 450717 - DNA, 25 bp, Mus musculus
ggaggtgccctcaccctagtgggat

SEQ ID NO: 450718 - DNA, 25 bp, Mus musculus
ggaggtgcgcaacccactgtttgac

SEQ ID NO: 450719 - DNA, 25 bp, Mus musculus
ggaggtgctccctgcatactatgac

SEQ ID NO: 450720 - DNA, 25 bp, Mus musculus
ggaggtggtcctaaagttcgcccag

SEQ ID NO: 450721 - DNA, 25 bp, Mus musculus
ggaggtgtaccagttccagctgttg

SEQ ID NO: 450722 - DNA, 25 bp, Mus musculus
ggaggtgtcagctctgacccagcct

SEQ ID NO: 450723 - DNA, 25 bp, Mus musculus
ggaggttgttcacctgcaggccaca

SEQ ID NO: 450724 - DNA, 25 bp, Mus musculus
ggaggtttccttgtcacacttaaca

SEQ ID NO: 450725 - DNA, 25 bp, Mus musculus
ggagtaaaattgcagacagacaagc

SEQ ID NO: 450726 - DNA, 25 bp, Mus musculus
ggagtaaatgcaaccaacgggacag

SEQ ID NO: 450727 - DNA, 25 bp, Mus musculus
ggagtacaactttcaggtcctgaag

SEQ ID NO: 450728 - DNA, 25 bp, Mus musculus
ggagtacaaggacacacccatggac

SEQ ID NO: 450729 - DNA, 25 bp, Mus musculus
ggagtaccatcgacatcaagcctga

SEQ ID NO: 450730 - DNA, 25 bp, Mus musculus
ggagtaccccactaacctaagcgtg

SEQ ID NO: 450731 - DNA, 25 bp, Mus musculus
ggagtacctcattggcatccagggc

SEQ ID NO: 450732 - DNA, 25 bp, Mus musculus
ggagtacctgtaccacaagcatttg

SEQ ID NO: 450733 - DNA, 25 bp, Mus musculus
ggagtactacaggaaacgcggcatt

SEQ ID NO: 450734 - DNA, 25 bp, Mus musculus
ggagtactactctccctcagtaaag

SEQ ID NO: 450735 - DNA, 25 bp, Mus musculus
ggagtactggaaagacttgcaggca

SEQ ID NO: 450736 - DNA, 25 bp, Mus musculus
ggagtagctgcctgagtcaccggcc

SEQ ID NO: 450737 - DNA, 25 bp, Mus musculus
ggagtagtctccatgctgtatcaat

SEQ ID NO: 450738 - DNA, 25 bp, Mus musculus
ggagtagtttacagcccaggcatga

SEQ ID NO: 450739 - DNA, 25 bp, Mus musculus
ggagtatctccagcttagggccatc

SEQ ID NO: 450740 - DNA, 25 bp, Mus musculus
ggagtatgaagcaaagcgcctaaca

SEQ ID NO: 450741 - DNA, 25 bp, Mus musculus
ggagtatgacctgaaagtgccccga

SEQ ID NO: 450742 - DNA, 25 bp, Mus musculus
ggagtatgtcccattccaggccgga

SEQ ID NO: 450743 - DNA, 25 bp, Mus musculus
ggagtattctgactgcgttgccaca

SEQ ID NO: 450744 - DNA, 25 bp, Mus musculus
ggagtattcttctccatgtccagga

SEQ ID NO: 450745 - DNA, 25 bp, Mus musculus
ggagtatttatcaacggcaggcctc

SEQ ID NO: 450746 - DNA, 25 bp, Mus musculus
ggagtatttcatggtgcccactcag

SEQ ID NO: 450747 - DNA, 25 bp, Mus musculus
ggagtattttgcagtctctgcagga

SEQ ID NO: 450748 - DNA, 25 bp, Mus musculus
ggagtcaagaaacccaacgtagcca

SEQ ID NO: 450749 - DNA, 25 bp, Mus musculus
ggagtcacacagcactaaggcaaag

SEQ ID NO: 450750 - DNA, 25 bp, Mus musculus
ggagtcacctagctacttatcagca

SEQ ID NO: 450751 - DNA, 25 bp, Mus musculus
ggagtcagacctagataaatgtgtg

SEQ ID NO: 450752 - DNA, 25 bp, Mus musculus
ggagtcagactttgaggccatgtgt

SEQ ID NO: 450753 - DNA, 25 bp, Mus musculus
ggagtccacattggtctctgccatt

SEQ ID NO: 450754 - DNA, 25 bp, Mus musculus
ggagtccacctttggtgccttggtg

SEQ ID NO: 450755 - DNA, 25 bp, Mus musculus
ggagtcccatcagctgcaaacctgg

SEQ ID NO: 450756 - DNA, 25 bp, Mus musculus
ggagtccctgcctaaccagggcgtt

SEQ ID NO: 450757 - DNA, 25 bp, Mus musculus
ggagtccctgcgaatgcgaaagcct

SEQ ID NO: 450758 - DNA, 25 bp, Mus musculus
ggagtccggatagtggtccagccta

SEQ ID NO: 450759 - DNA, 25 bp, Mus musculus
ggagtccgttctcccctaccatgta

SEQ ID NO: 450760 - DNA, 25 bp, Mus musculus
ggagtcctcaccctgcatcaaggaa

SEQ ID NO: 450761 - DNA, 25 bp, Mus musculus
ggagtcctcctctggcattgttgaa

SEQ ID NO: 450762 - DNA, 25 bp, Mus musculus
ggagtcctgagctcacactaaatac

SEQ ID NO: 450763 - DNA, 25 bp, Mus musculus
ggagtcctgttcctgggagatccaa

SEQ ID NO: 450764 - DNA, 25 bp, Mus musculus
ggagtcgggctcataccatgtcggt

SEQ ID NO: 450765 - DNA, 25 bp, Mus musculus
ggagtctccacacacccttcaagag

SEQ ID NO: 450766 - DNA, 25 bp, Mus musculus
ggagtctctcccacgacgacgacag

SEQ ID NO: 450767 - DNA, 25 bp, Mus musculus
ggagtctctgtttcagcgcttggga

SEQ ID NO: 450768 - DNA, 25 bp, Mus musculus
ggagtctgaaaccatgggcccgata

SEQ ID NO: 450769 - DNA, 25 bp, Mus musculus
ggagtctgaagctctattttcccta

SEQ ID NO: 450770 - DNA, 25 bp, Mus musculus
ggagtctgaccctgagtttgtgcct

SEQ ID NO: 450771 - DNA, 25 bp, Mus musculus
ggagtctgcagcctcttatctgagc

SEQ ID NO: 450772 - DNA, 25 bp, Mus musculus
ggagtcttcacacggactacatctc

SEQ ID NO: 450773 - DNA, 25 bp, Mus musculus
ggagtcttcagcaacttcttgtttg

SEQ ID NO: 450774 - DNA, 25 bp, Mus musculus
ggagtcttcctaacacgcagctaga

SEQ ID NO: 450775 - DNA, 25 bp, Mus musculus
ggagtcttttcatactgaccgtgag

SEQ ID NO: 450776 - DNA, 25 bp, Mus musculus
ggagtgaacacttagaagatcagac

SEQ ID NO: 450777 - DNA, 25 bp, Mus musculus
ggagtgaaccactgccaacctgtga

SEQ ID NO: 450778 - DNA, 25 bp, Mus musculus
ggagtgaaggccaataaagatgctc

SEQ ID NO: 450779 - DNA, 25 bp, Mus musculus
ggagtgaatggaccccttcaactgg

SEQ ID NO: 450780 - DNA, 25 bp, Mus musculus
ggagtgacattctaccatgcagcca

SEQ ID NO: 450781 - DNA, 25 bp, Mus musculus
ggagtgaccccagtgtttgacaaca

SEQ ID NO: 450782 - DNA, 25 bp, Mus musculus
ggagtgatcctagagccacagcaca

SEQ ID NO: 450783 - DNA, 25 bp, Mus musculus
ggagtgcattctgaacatatagtag

SEQ ID NO: 450784 - DNA, 25 bp, Mus musculus
ggagtgcccagtaccaaagttcgct

SEQ ID NO: 450785 - DNA, 25 bp, Mus musculus
ggagtgccgccgtctaaaaagatga

SEQ ID NO: 450786 - DNA, 25 bp, Mus musculus
ggagtgctacatacaagcccaaggc

SEQ ID NO: 450787 - DNA, 25 bp, Mus musculus
ggagtgctacttacgggcttgcctc

SEQ ID NO: 450788 - DNA, 25 bp, Mus musculus
ggagtgctctgctacttgtgctgga

SEQ ID NO: 450789 - DNA, 25 bp, Mus musculus
ggagtgctcttattctccacagtca

SEQ ID NO: 450790 - DNA, 25 bp, Mus musculus
ggagtggatctcaccaaggtcctca

SEQ ID NO: 450791 - DNA, 25 bp, Mus musculus
ggagtggccaccgagttcgtgccca

SEQ ID NO: 450792 - DNA, 25 bp, Mus musculus
ggagtggcttgcatgcttacttcaa

SEQ ID NO: 450793 - DNA, 25 bp, Mus musculus
ggagtgggaactgcgtctttgtttc

SEQ ID NO: 450794 - DNA, 25 bp, Mus musculus
ggagtgggcaagacctgcgtccttt

SEQ ID NO: 450795 - DNA, 25 bp, Mus musculus
ggagtggtcctgtgcacgctgcacc

SEQ ID NO: 450796 - DNA, 25 bp, Mus musculus
ggagtggtgctaccaaaggacccca

SEQ ID NO: 450797 - DNA, 25 bp, Mus musculus
ggagtgtcagaacaggaccctgaaa

SEQ ID NO: 450798 - DNA, 25 bp, Mus musculus
ggagtgtccacagatcgtgcagcac

SEQ ID NO: 450799 - DNA, 25 bp, Mus musculus
ggagtgtccattcccttctcagggc

SEQ ID NO: 450800 - DNA, 25 bp, Mus musculus
ggagtgtcctcctcaacatcaggga

SEQ ID NO: 450801 - DNA, 25 bp, Mus musculus
ggagtgtgacaaagctaagtagtat

SEQ ID NO: 450802 - DNA, 25 bp, Mus musculus
ggagtgttagatctctctacaaaga

SEQ ID NO: 450803 - DNA, 25 bp, Mus musculus
ggagtgtttcgcttgccagcagcca

SEQ ID NO: 450804 - DNA, 25 bp, Mus musculus
ggagtgtttgattagtttttcctca

SEQ ID NO: 450805 - DNA, 25 bp, Mus musculus
ggagttaatctcttcgacacagctg

SEQ ID NO: 450806 - DNA, 25 bp, Mus musculus
ggagttacacccagaggacacgctt

SEQ ID NO: 450807 - DNA, 25 bp, Mus musculus
ggagttagcatgtcccaggctcgca

SEQ ID NO: 450808 - DNA, 25 bp, Mus musculus
ggagttaggacttcagtggtgccac

SEQ ID NO: 450809 - DNA, 25 bp, Mus musculus
ggagttcaggttcagtacacacaca

SEQ ID NO: 450810 - DNA, 25 bp, Mus musculus
ggagttccaggtgacttttgcacac

SEQ ID NO: 450811 - DNA, 25 bp, Mus musculus
ggagttccatcagctaacacaaatg

SEQ ID NO: 450812 - DNA, 25 bp, Mus musculus
ggagttcccactggcacaggagtca

SEQ ID NO: 450813 - DNA, 25 bp, Mus musculus
ggagttcccatctataagaaaagca

SEQ ID NO: 450814 - DNA, 25 bp, Mus musculus
ggagttccccgaccgagtttctcag

SEQ ID NO: 450815 - DNA, 25 bp, Mus musculus
ggagttccgtgcgaccagtaatgcg

SEQ ID NO: 450816 - DNA, 25 bp, Mus musculus
ggagttcctgcacgatcccatcaag

SEQ ID NO: 450817 - DNA, 25 bp, Mus musculus
ggagttcgttccaatagacagcccg

SEQ ID NO: 450818 - DNA, 25 bp, Mus musculus
ggagttctaaaaacaggtggtatct

SEQ ID NO: 450819 - DNA, 25 bp, Mus musculus
ggagttctacatcctctggacgaag

SEQ ID NO: 450820 - DNA, 25 bp, Mus musculus
ggagttctccccaattacaatgagg

SEQ ID NO: 450821 - DNA, 25 bp, Mus musculus
ggagttctctacattatgggtaaca

SEQ ID NO: 450822 - DNA, 25 bp, Mus musculus
ggagttgacatcttcgcgttattga

SEQ ID NO: 450823 - DNA, 25 bp, Mus musculus
ggagttgagcaccatgtaccggcac

SEQ ID NO: 450824 - DNA, 25 bp, Mus musculus
ggagttgatcgcctatagccagtac

SEQ ID NO: 450825 - DNA, 25 bp, Mus musculus
ggagttgccaatccattgcccaaag

SEQ ID NO: 450826 - DNA, 25 bp, Mus musculus
ggagttgctgtgactactatataag

SEQ ID NO: 450827 - DNA, 25 bp, Mus musculus
ggagttggaggacacttaccacgaa

SEQ ID NO: 450828 - DNA, 25 bp, Mus musculus
ggagttggccgcttgctcccagagc

SEQ ID NO: 450829 - DNA, 25 bp, Mus musculus
ggagttgtaagcaggacctaggcct

SEQ ID NO: 450830 - DNA, 25 bp, Mus musculus
ggagttgtttctcagtgtctaaaaa

SEQ ID NO: 450831 - DNA, 25 bp, Mus musculus
ggagtttatcttcccctgagtgcgc

SEQ ID NO: 450832 - DNA, 25 bp, Mus musculus
ggagtttcactacagccggtacatc

SEQ ID NO: 450833 - DNA, 25 bp, Mus musculus
ggagtttcacttggaattgcctgca

SEQ ID NO: 450834 - DNA, 25 bp, Mus musculus
ggagtttcattctagggcaggagca

SEQ ID NO: 450835 - DNA, 25 bp, Mus musculus
ggagtttccacacactcagctgcag

SEQ ID NO: 450836 - DNA, 25 bp, Mus musculus
ggagtttccgtacatctgcaagggt

SEQ ID NO: 450837 - DNA, 25 bp, Mus musculus
ggagtttcgcaacctagaactggaa

SEQ ID NO: 450838 - DNA, 25 bp, Mus musculus
ggagtttctcctctgaccctcaatg

SEQ ID NO: 450839 - DNA, 25 bp, Mus musculus
ggagtttgacccttgcttttgcatc

SEQ ID NO: 450840 - DNA, 25 bp, Mus musculus
ggagtttgattaccaggcccagcat

SEQ ID NO: 450841 - DNA, 25 bp, Mus musculus
ggagttttcccctggatccaagaag

SEQ ID NO: 450842 - DNA, 25 bp, Mus musculus
ggagttttccctcaagcacagttgg

SEQ ID NO: 450843 - DNA, 25 bp, Mus musculus
ggataaaagaacaccgtcagcgtcg

SEQ ID NO: 450844 - DNA, 25 bp, Mus musculus
ggataaaagacataaatggtcccac

SEQ ID NO: 450845 - DNA, 25 bp, Mus musculus
ggataaaagccctgtccgtgactgg

SEQ ID NO: 450846 - DNA, 25 bp, Mus musculus
ggataaaattacacaagggtacttg

SEQ ID NO: 450847 - DNA, 25 bp, Mus musculus
ggataaagatttgcctcagtacaca

SEQ ID NO: 450848 - DNA, 25 bp, Mus musculus
ggataaaggttcagaggccagcagc

SEQ ID NO: 450849 - DNA, 25 bp, Mus musculus
ggataaatcacttacatgctcaatg

SEQ ID NO: 450850 - DNA, 25 bp, Mus musculus
ggataaatcgctctacctcacctaa

SEQ ID NO: 450851 - DNA, 25 bp, Mus musculus
ggataaattcaaccctcacacgtca

SEQ ID NO: 450852 - DNA, 25 bp, Mus musculus
ggataacaaaccaggcaacaaccag

SEQ ID NO: 450853 - DNA, 25 bp, Mus musculus
ggataacagccacctcttccagggt

SEQ ID NO: 450854 - DNA, 25 bp, Mus musculus
ggataaccctacaaactcaggtcag

SEQ ID NO: 450855 - DNA, 25 bp, Mus musculus
ggataacgcagctctcagcagaagg

SEQ ID NO: 450856 - DNA, 25 bp, Mus musculus
ggataacgcatataccctgaccaac

SEQ ID NO: 450857 - DNA, 25 bp, Mus musculus
ggataactataaagtcgctctggag

SEQ ID NO: 450858 - DNA, 25 bp, Mus musculus
ggataactgtaacagcccggctcca

SEQ ID NO: 450859 - DNA, 25 bp, Mus musculus
ggataagaactaacacaagactgag

SEQ ID NO: 450860 - DNA, 25 bp, Mus musculus
ggataagaaggcaaacgagagaaga

SEQ ID NO: 450861 - DNA, 25 bp, Mus musculus
ggataagctcgtgctccaagccttg

SEQ ID NO: 450862 - DNA, 25 bp, Mus musculus
ggataatcagttcaccctggctgtg

SEQ ID NO: 450863 - DNA, 25 bp, Mus musculus
ggatacaagaacaaacatctcccag

SEQ ID NO: 450864 - DNA, 25 bp, Mus musculus
ggatacaatacacggacgaattcac

SEQ ID NO: 450865 - DNA, 25 bp, Mus musculus
ggatacaccaccatctcaaaacact

SEQ ID NO: 450866 - DNA, 25 bp, Mus musculus
ggatacactcattcagttggccaag

SEQ ID NO: 450867 - DNA, 25 bp, Mus musculus
ggataccactcattctagatcagaa

SEQ ID NO: 450868 - DNA, 25 bp, Mus musculus
ggataccactcctatagattagagg

SEQ ID NO: 450869 - DNA, 25 bp, Mus musculus
ggataccagtgaagcttcttacgca

SEQ ID NO: 450870 - DNA, 25 bp, Mus musculus
ggataccataaaacatttcggaagc

SEQ ID NO: 450871 - DNA, 25 bp, Mus musculus
ggatacccacgtaactggacatttg

SEQ ID NO: 450872 - DNA, 25 bp, Mus musculus
ggatacccaggagttcacatgccgg

SEQ ID NO: 450873 - DNA, 25 bp, Mus musculus
ggatacccatgtttcacccacatag

SEQ ID NO: 450874 - DNA, 25 bp, Mus musculus
ggataccccgcttctactgggagga

SEQ ID NO: 450875 - DNA, 25 bp, Mus musculus
ggataccctgtgataaccctaaaag

SEQ ID NO: 450876 - DNA, 25 bp, Mus musculus
ggataccgatggcttctcagacgtg

SEQ ID NO: 450877 - DNA, 25 bp, Mus musculus
ggataccgcaggtcaggaggactat

SEQ ID NO: 450878 - DNA, 25 bp, Mus musculus
ggatacctctagatctaccttaaga

SEQ ID NO: 450879 - DNA, 25 bp, Mus musculus
ggatacgatctacccatacctggag

SEQ ID NO: 450880 - DNA, 25 bp, Mus musculus
ggatactacggcttccctctgcagt

SEQ ID NO: 450881 - DNA, 25 bp, Mus musculus
ggatactagtgataattttgttgct

SEQ ID NO: 450882 - DNA, 25 bp, Mus musculus
ggatacttagattccacatctcttg

SEQ ID NO: 450883 - DNA, 25 bp, Mus musculus
ggatagaacccagattgacctcagt

SEQ ID NO: 450884 - DNA, 25 bp, Mus musculus
ggatagaagtatctgcctgcagcca

SEQ ID NO: 450885 - DNA, 25 bp, Mus musculus
ggatagacctcctgctcctcgatga

SEQ ID NO: 450886 - DNA, 25 bp, Mus musculus
ggatagacctgctgaaccacttgat

SEQ ID NO: 450887 - DNA, 25 bp, Mus musculus
ggatagatcgcaagacgagacccga

SEQ ID NO: 450888 - DNA, 25 bp, Mus musculus
ggatagattttcacccacaatggga

SEQ ID NO: 450889 - DNA, 25 bp, Mus musculus
ggatagcacacctctgaaatggcaa

SEQ ID NO: 450890 - DNA, 25 bp, Mus musculus
ggatagccgagagtacccagatgca

SEQ ID NO: 450891 - DNA, 25 bp, Mus musculus
ggatagcgtccaatctaggtgccac

SEQ ID NO: 450892 - DNA, 25 bp, Mus musculus
ggatagctgcagattacgttggcct

SEQ ID NO: 450893 - DNA, 25 bp, Mus musculus
ggataggaagctctcagcagcagaa

SEQ ID NO: 450894 - DNA, 25 bp, Mus musculus
ggataggtgaggtctacacctcccc

SEQ ID NO: 450895 - DNA, 25 bp, Mus musculus
ggatagtccacgcaatgtcacagaa

SEQ ID NO: 450896 - DNA, 25 bp, Mus musculus
ggatagtggccatgtgtcaggattc

SEQ ID NO: 450897 - DNA, 25 bp, Mus musculus
ggatataacataccagacccacgag

SEQ ID NO: 450898 - DNA, 25 bp, Mus musculus
ggatataagcagcactgtactctgc

SEQ ID NO: 450899 - DNA, 25 bp, Mus musculus
ggatataattctggctttggagtca

SEQ ID NO: 450900 - DNA, 25 bp, Mus musculus
ggatatactttacgcaggtcgaacg

SEQ ID NO: 450901 - DNA, 25 bp, Mus musculus
ggatatagggttgctttgtagaaag

SEQ ID NO: 450902 - DNA, 25 bp, Mus musculus
ggatatatgtcagcccaggacggca

SEQ ID NO: 450903 - DNA, 25 bp, Mus musculus
ggatatcacttacttggaactggtt

SEQ ID NO: 450904 - DNA, 25 bp, Mus musculus
ggatatcccagaacaagagaccagc

SEQ ID NO: 450905 - DNA, 25 bp, Mus musculus
ggatatccctggtacctcagaggag

SEQ ID NO: 450906 - DNA, 25 bp, Mus musculus
ggatatccggcctgtgaaggactca

SEQ ID NO: 450907 - DNA, 25 bp, Mus musculus
ggatatcctggatgcctcacggctt

SEQ ID NO: 450908 - DNA, 25 bp, Mus musculus
ggatatcctttgacatgattgttca

SEQ ID NO: 450909 - DNA, 25 bp, Mus musculus
ggatatcgttagaggcggccaagca

SEQ ID NO: 450910 - DNA, 25 bp, Mus musculus
ggatatctccattttaccatcatga

SEQ ID NO: 450911 - DNA, 25 bp, Mus musculus
ggatatctccctttaagccctgtcg

SEQ ID NO: 450912 - DNA, 25 bp, Mus musculus
ggatatctgcaaccatcaaggcctc

SEQ ID NO: 450913 - DNA, 25 bp, Mus musculus
ggatatctgcaacctcccactgaga

SEQ ID NO: 450914 - DNA, 25 bp, Mus musculus
ggatatgaaactccgacaccttgga

SEQ ID NO: 450915 - DNA, 25 bp, Mus musculus
ggatatgaccccagaacaatgaagc

SEQ ID NO: 450916 - DNA, 25 bp, Mus musculus
ggatatgcactacccaacagccaag

SEQ ID NO: 450917 - DNA, 25 bp, Mus musculus
ggatatggagcttctatcgccgcca

SEQ ID NO: 450918 - DNA, 25 bp, Mus musculus
ggatatggagtcactcaccgggcca

SEQ ID NO: 450919 - DNA, 25 bp, Mus musculus
ggatatggccctcttcaacaacggg

SEQ ID NO: 450920 - DNA, 25 bp, Mus musculus
ggatatgtcagaccctctctcagca

SEQ ID NO: 450921 - DNA, 25 bp, Mus musculus
ggatattcacctccgctatggccgt

SEQ ID NO: 450922 - DNA, 25 bp, Mus musculus
ggatcaaaacttcagcgtcacagct

SEQ ID NO: 450923 - DNA, 25 bp, Mus musculus
ggatcaaagtcaccgacgccaatga

SEQ ID NO: 450924 - DNA, 25 bp, Mus musculus
ggatcaaatagatggctcgcccgtt

SEQ ID NO: 450925 - DNA, 25 bp, Mus musculus
ggatcaacgagagcctaagccagct

SEQ ID NO: 450926 - DNA, 25 bp, Mus musculus
ggatcaacgtgacccatggcgatag

SEQ ID NO: 450927 - DNA, 25 bp, Mus musculus
ggatcaactgcggtgcatccgtaag

SEQ ID NO: 450928 - DNA, 25 bp, Mus musculus
ggatcaagatagaagctgctgctgc

SEQ ID NO: 450929 - DNA, 25 bp, Mus musculus
ggatcaagatcaaacagcccagaag

SEQ ID NO: 450930 - DNA, 25 bp, Mus musculus
ggatcaaggaagctctcagtcgtca

SEQ ID NO: 450931 - DNA, 25 bp, Mus musculus
ggatcacaagtataaggccagctca

SEQ ID NO: 450932 - DNA, 25 bp, Mus musculus
ggatcacaccaacgagcaacagaag

SEQ ID NO: 450933 - DNA, 25 bp, Mus musculus
ggatcacactatccaaattgcagag

SEQ ID NO: 450934 - DNA, 25 bp, Mus musculus
ggatcacagagttttcagccctaag

SEQ ID NO: 450935 - DNA, 25 bp, Mus musculus
ggatcacaggttcatggcgagctat

SEQ ID NO: 450936 - DNA, 25 bp, Mus musculus
ggatcacatcttaagtaatatatag

SEQ ID NO: 450937 - DNA, 25 bp, Mus musculus
ggatcacatggtaccgaaacgggca

SEQ ID NO: 450938 - DNA, 25 bp, Mus musculus
ggatcaccctaagccaaaaagtgtg

SEQ ID NO: 450939 - DNA, 25 bp, Mus musculus
ggatcaccctctctgagctgcttct

SEQ ID NO: 450940 - DNA, 25 bp, Mus musculus
ggatcactaggtctcccagtaaaag

SEQ ID NO: 450941 - DNA, 25 bp, Mus musculus
ggatcactgagtggcttgcgctcca

SEQ ID NO: 450942 - DNA, 25 bp, Mus musculus
ggatcagaagccataagtcccgctg

SEQ ID NO: 450943 - DNA, 25 bp, Mus musculus
ggatcaggatcaagagcactcacgt

SEQ ID NO: 450944 - DNA, 25 bp, Mus musculus
ggatcaggtcttccacgtggattgc

SEQ ID NO: 450945 - DNA, 25 bp, Mus musculus
ggatcaggttcccattcaacacgag

SEQ ID NO: 450946 - DNA, 25 bp, Mus musculus
ggatcagtaagtcctgcccacagtg

SEQ ID NO: 450947 - DNA, 25 bp, Mus musculus
ggatcataattcgtttgcctgctgg

SEQ ID NO: 450948 - DNA, 25 bp, Mus musculus
ggatcataggatcagagccacacct

SEQ ID NO: 450949 - DNA, 25 bp, Mus musculus
ggatcatcaatcgttgtggcacaga

SEQ ID NO: 450950 - DNA, 25 bp, Mus musculus
ggatcatcccttggattcagcaact

SEQ ID NO: 450951 - DNA, 25 bp, Mus musculus
ggatcattacatttccagaaaactg

SEQ ID NO: 450952 - DNA, 25 bp, Mus musculus
ggatcattcctaaggccccagcaag

SEQ ID NO: 450953 - DNA, 25 bp, Mus musculus
ggatcattcctgctcagcggccagg

SEQ ID NO: 450954 - DNA, 25 bp, Mus musculus
ggatcattgagagcaagcgagccag

SEQ ID NO: 450955 - DNA, 25 bp, Mus musculus
ggatcattgtcaggatacctggtag

SEQ ID NO: 450956 - DNA, 25 bp, Mus musculus
ggatccacaatggtaccgtctctga

SEQ ID NO: 450957 - DNA, 25 bp, Mus musculus
ggatccacggcacccttatttattg

SEQ ID NO: 450958 - DNA, 25 bp, Mus musculus
ggatccagacttaagcttactgcag

SEQ ID NO: 450959 - DNA, 25 bp, Mus musculus
ggatccagatgtgctcaaccagagg

SEQ ID NO: 450960 - DNA, 25 bp, Mus musculus
ggatccaggataacagatattcaca

SEQ ID NO: 450961 - DNA, 25 bp, Mus musculus
ggatccataacagagaatccggatg

SEQ ID NO: 450962 - DNA, 25 bp, Mus musculus
ggatccattactcggtgcccatgag

SEQ ID NO: 450963 - DNA, 25 bp, Mus musculus
ggatccattgacagagacaacatgt

SEQ ID NO: 450964 - DNA, 25 bp, Mus musculus
ggatcccaagcaatacccaaagaag

SEQ ID NO: 450965 - DNA, 25 bp, Mus musculus
ggatcccatagccttgaggaccagc

SEQ ID NO: 450966 - DNA, 25 bp, Mus musculus
ggatccccggatacgattgtgcgcc

SEQ ID NO: 450967 - DNA, 25 bp, Mus musculus
ggatcccggaacaactcagactggg

SEQ ID NO: 450968 - DNA, 25 bp, Mus musculus
ggatcccgtgctatctcagccatgg

SEQ ID NO: 450969 - DNA, 25 bp, Mus musculus
ggatccctaagtaacaccaatgtgg

SEQ ID NO: 450970 - DNA, 25 bp, Mus musculus
ggatccctacccaagagttgctgag

SEQ ID NO: 450971 - DNA, 25 bp, Mus musculus
ggatccctctacagcgacgtcagta

SEQ ID NO: 450972 - DNA, 25 bp, Mus musculus
ggatccctgggtttatctgctgcta

SEQ ID NO: 450973 - DNA, 25 bp, Mus musculus
ggatccctggttttctccaagaagg

SEQ ID NO: 450974 - DNA, 25 bp, Mus musculus
ggatccgaggactgattcaactgct

SEQ ID NO: 450975 - DNA, 25 bp, Mus musculus
ggatccgtcagggtttccagcacca

SEQ ID NO: 450976 - DNA, 25 bp, Mus musculus
ggatccgtttgtacaggccaagctg

SEQ ID NO: 450977 - DNA, 25 bp, Mus musculus
ggatcctaattgtgtcagggccact

SEQ ID NO: 450978 - DNA, 25 bp, Mus musculus
ggatcctacagtggcgtcagctggt

SEQ ID NO: 450979 - DNA, 25 bp, Mus musculus
ggatcctacgcttcttccttcatag

SEQ ID NO: 450980 - DNA, 25 bp, Mus musculus
ggatcctcccaaagctggaccaaac

SEQ ID NO: 450981 - DNA, 25 bp, Mus musculus
ggatcctctatctcgggcctcttgc

SEQ ID NO: 450982 - DNA, 25 bp, Mus musculus
ggatcctgacttggcgccctttgtg

SEQ ID NO: 450983 - DNA, 25 bp, Mus musculus
ggatcctgcacctgaaccgctggag

SEQ ID NO: 450984 - DNA, 25 bp, Mus musculus
ggatcctgcactgactctggagaag

SEQ ID NO: 450985 - DNA, 25 bp, Mus musculus
ggatcctgggattcgcaccgtccct

SEQ ID NO: 450986 - DNA, 25 bp, Mus musculus
ggatccttctactgtgtcaaccaca

SEQ ID NO: 450987 - DNA, 25 bp, Mus musculus
ggatccttctcgaatcacacgggtg

SEQ ID NO: 450988 - DNA, 25 bp, Mus musculus
ggatccttgaagaccaccacataga

SEQ ID NO: 450989 - DNA, 25 bp, Mus musculus
ggatccttgggacaagccactacgg

SEQ ID NO: 450990 - DNA, 25 bp, Mus musculus
ggatcgaactcaggcccttatgatt

SEQ ID NO: 450991 - DNA, 25 bp, Mus musculus
ggatcgacaaactcatgcactttaa

SEQ ID NO: 450992 - DNA, 25 bp, Mus musculus
ggatcgcagctcgagaaaacattca

SEQ ID NO: 450993 - DNA, 25 bp, Mus musculus
ggatcgcctctatctctacctcaga

SEQ ID NO: 450994 - DNA, 25 bp, Mus musculus
ggatcgcctgttctttgccccaact

SEQ ID NO: 450995 - DNA, 25 bp, Mus musculus
ggatcgctacccagacacattgctg

SEQ ID NO: 450996 - DNA, 25 bp, Mus musculus
ggatcgcttgcccaactcttggcgc

SEQ ID NO: 450997 - DNA, 25 bp, Mus musculus
ggatcggatcacgtctacagagcca

SEQ ID NO: 450998 - DNA, 25 bp, Mus musculus
ggatcggcctcagtgaccatataca

SEQ ID NO: 450999 - DNA, 25 bp, Mus musculus
ggatcgtcctgaccctgcttggctg

SEQ ID NO: 451000 - DNA, 25 bp, Mus musculus
ggatcgtcgcatcaccaggttcgtg

SEQ ID NO: 451001 - DNA, 25 bp, Mus musculus
ggatcgtgatcaagacagaggagca

SEQ ID NO: 451002 - DNA, 25 bp, Mus musculus
ggatcgttttcttgctcctccaaaa

SEQ ID NO: 451003 - DNA, 25 bp, Mus musculus
ggatctaaaatcacagcagggaacg

SEQ ID NO: 451004 - DNA, 25 bp, Mus musculus
ggatctaaaccacactgcgcaggga

SEQ ID NO: 451005 - DNA, 25 bp, Mus musculus
ggatctaaccacttcagcacagcag

SEQ ID NO: 451006 - DNA, 25 bp, Mus musculus
ggatctaatgttactcttctctgcc

SEQ ID NO: 451007 - DNA, 25 bp, Mus musculus
ggatctacataatcaccatggtggg

SEQ ID NO: 451008 - DNA, 25 bp, Mus musculus
ggatctacccgggaacacagagggc

SEQ ID NO: 451009 - DNA, 25 bp, Mus musculus
ggatctactggtgagcagtgccaca

SEQ ID NO: 451010 - DNA, 25 bp, Mus musculus
ggatctagccttatgcccgggcctg

SEQ ID NO: 451011 - DNA, 25 bp, Mus musculus
ggatctagccttccgtgacagctgg

SEQ ID NO: 451012 - DNA, 25 bp, Mus musculus
ggatctattctcttcctcgctcagg

SEQ ID NO: 451013 - DNA, 25 bp, Mus musculus
ggatctattcttaaagtcccatctt

SEQ ID NO: 451014 - DNA, 25 bp, Mus musculus
ggatctcaaggcctcgtcttccgag

SEQ ID NO: 451015 - DNA, 25 bp, Mus musculus
ggatctcaattaagtctggaccacg

SEQ ID NO: 451016 - DNA, 25 bp, Mus musculus
ggatctcctgtacgaggccagaaga

SEQ ID NO: 451017 - DNA, 25 bp, Mus musculus
ggatctctaacgtcaatgcccggtg

SEQ ID NO: 451018 - DNA, 25 bp, Mus musculus
ggatctctcatgtgccgtctggtca

SEQ ID NO: 451019 - DNA, 25 bp, Mus musculus
ggatctctctgagcacaatggaggg

SEQ ID NO: 451020 - DNA, 25 bp, Mus musculus
ggatctctggtcaagtcggagccga

SEQ ID NO: 451021 - DNA, 25 bp, Mus musculus
ggatctctgtaagtagggccacgac

SEQ ID NO: 451022 - DNA, 25 bp, Mus musculus
ggatctcttctttcgctctcctttg

SEQ ID NO: 451023 - DNA, 25 bp, Mus musculus
ggatctgaagccactggtacgtgga

SEQ ID NO: 451024 - DNA, 25 bp, Mus musculus
ggatctgaggcctactctctggaag

SEQ ID NO: 451025 - DNA, 25 bp, Mus musculus
ggatctgcaagaccctctaggctac

SEQ ID NO: 451026 - DNA, 25 bp, Mus musculus
ggatctgcaggactggctcctttac

SEQ ID NO: 451027 - DNA, 25 bp, Mus musculus
ggatctgccagtgtgctctacagga

SEQ ID NO: 451028 - DNA, 25 bp, Mus musculus
ggatctgcccagctgcaatgttgga

SEQ ID NO: 451029 - DNA, 25 bp, Mus musculus
ggatctggaagctcccctctgggtt

SEQ ID NO: 451030 - DNA, 25 bp, Mus musculus
ggatctggactctgttgcatgactg

SEQ ID NO: 451031 - DNA, 25 bp, Mus musculus
ggatctgggcatttcatcactgtaa

SEQ ID NO: 451032 - DNA, 25 bp, Mus musculus
ggatctgtgaccacacgtgcctggg

SEQ ID NO: 451033 - DNA, 25 bp, Mus musculus
ggatcttatcgaacagcctggccat

SEQ ID NO: 451034 - DNA, 25 bp, Mus musculus
ggatcttatcgctgtgggccttgca

SEQ ID NO: 451035 - DNA, 25 bp, Mus musculus
ggatcttatctgtcagcactgggca

SEQ ID NO: 451036 - DNA, 25 bp, Mus musculus
ggatcttgatccacatctctagctc

SEQ ID NO: 451037 - DNA, 25 bp, Mus musculus
ggatcttgtcttcaaatacagctcc

SEQ ID NO: 451038 - DNA, 25 bp, Mus musculus
ggatcttttgtatgtggcttctcag

SEQ ID NO: 451039 - DNA, 25 bp, Mus musculus
ggatgaaaatcaccaggccagggct

SEQ ID NO: 451040 - DNA, 25 bp, Mus musculus
ggatgaaacacaactgcactgggac

SEQ ID NO: 451041 - DNA, 25 bp, Mus musculus
ggatgaaactgtccacacacactgg

SEQ ID NO: 451042 - DNA, 25 bp, Mus musculus
ggatgaacatcaacctccgggaggt

SEQ ID NO: 451043 - DNA, 25 bp, Mus musculus
ggatgaactgtaccaggccacgaag

SEQ ID NO: 451044 - DNA, 25 bp, Mus musculus
ggatgaagatgcacccacaagtgta

SEQ ID NO: 451045 - DNA, 25 bp, Mus musculus
ggatgaagcaaagacgaagcccctc

SEQ ID NO: 451046 - DNA, 25 bp, Mus musculus
ggatgaagcgccctacgatgtgcct

SEQ ID NO: 451047 - DNA, 25 bp, Mus musculus
ggatgaaggaactgcccctgaccca

SEQ ID NO: 451048 - DNA, 25 bp, Mus musculus
ggatgaatattaacgcggaagcctt

SEQ ID NO: 451049 - DNA, 25 bp, Mus musculus
ggatgaatgccaagaccctaacagt

SEQ ID NO: 451050 - DNA, 25 bp, Mus musculus
ggatgaattatagctgctggttcgt

SEQ ID NO: 451051 - DNA, 25 bp, Mus musculus
ggatgacaaaagtgaatgcccctgc

SEQ ID NO: 451052 - DNA, 25 bp, Mus musculus
ggatgacaccactctcaatgcactg

SEQ ID NO: 451053 - DNA, 25 bp, Mus musculus
ggatgacacggtccctaagaactga

SEQ ID NO: 451054 - DNA, 25 bp, Mus musculus
ggatgacatcatgtaccatgtcaag

SEQ ID NO: 451055 - DNA, 25 bp, Mus musculus
ggatgacatccttgaccgactgaca

SEQ ID NO: 451056 - DNA, 25 bp, Mus musculus
ggatgaccaaactgcacatgagcca

SEQ ID NO: 451057 - DNA, 25 bp, Mus musculus
ggatgaccagctctttgtgtcctac

SEQ ID NO: 451058 - DNA, 25 bp, Mus musculus
ggatgaccccgagcttgtgaccttc

SEQ ID NO: 451059 - DNA, 25 bp, Mus musculus
ggatgaccgcagtgtctgccccaca

SEQ ID NO: 451060 - DNA, 25 bp, Mus musculus
ggatgacctagaccctgaacgagag

SEQ ID NO: 451061 - DNA, 25 bp, Mus musculus
ggatgacctgcctaaaaccgaggaa

SEQ ID NO: 451062 - DNA, 25 bp, Mus musculus
ggatgacgaatcttagcacatctct

SEQ ID NO: 451063 - DNA, 25 bp, Mus musculus
ggatgactctttgcctgatgacact

SEQ ID NO: 451064 - DNA, 25 bp, Mus musculus
ggatgactgagtacctgaaccggca

SEQ ID NO: 451065 - DNA, 25 bp, Mus musculus
ggatgactggcaattacctactaac

SEQ ID NO: 451066 - DNA, 25 bp, Mus musculus
ggatgacttagttccaggctggctt

SEQ ID NO: 451067 - DNA, 25 bp, Mus musculus
ggatgactttgacggcacctatgaa

SEQ ID NO: 451068 - DNA, 25 bp, Mus musculus
ggatgagactctactcttggtgcta

SEQ ID NO: 451069 - DNA, 25 bp, Mus musculus
ggatgagagatcaccacaagagagg

SEQ ID NO: 451070 - DNA, 25 bp, Mus musculus
ggatgagattcttgatgacacagct

SEQ ID NO: 451071 - DNA, 25 bp, Mus musculus
ggatgagcctggctataccgtgcca

SEQ ID NO: 451072 - DNA, 25 bp, Mus musculus
ggatgagctttctcaccttcaggaa

SEQ ID NO: 451073 - DNA, 25 bp, Mus musculus
ggatgagtacttccggcaacctgtg

SEQ ID NO: 451074 - DNA, 25 bp, Mus musculus
ggatgagttaacagacacactttag

SEQ ID NO: 451075 - DNA, 25 bp, Mus musculus
ggatgataggtgtgtgccaacgccc

SEQ ID NO: 451076 - DNA, 25 bp, Mus musculus
ggatgatatcatctggccccaagtt

SEQ ID NO: 451077 - DNA, 25 bp, Mus musculus
ggatgatcacggacccttttaggag

SEQ ID NO: 451078 - DNA, 25 bp, Mus musculus
ggatgatcagcgaagacctgggcca

SEQ ID NO: 451079 - DNA, 25 bp, Mus musculus
ggatgatctatatctccagccattg

SEQ ID NO: 451080 - DNA, 25 bp, Mus musculus
ggatgatgatgtcgtttttaagaac

SEQ ID NO: 451081 - DNA, 25 bp, Mus musculus
ggatgatggcctacaagctctaagg

SEQ ID NO: 451082 - DNA, 25 bp, Mus musculus
ggatgatgggccaagcagcctgcat

SEQ ID NO: 451083 - DNA, 25 bp, Mus musculus
ggatgattatcgtgaggagaccgag

SEQ ID NO: 451084 - DNA, 25 bp, Mus musculus
ggatgattcccataacacccaatat

SEQ ID NO: 451085 - DNA, 25 bp, Mus musculus
ggatgatttcacgtgcgggccagaa

SEQ ID NO: 451086 - DNA, 25 bp, Mus musculus
ggatgcaaagatagccaggcccttc

SEQ ID NO: 451087 - DNA, 25 bp, Mus musculus
ggatgcaaggtctcatgaatgccag

SEQ ID NO: 451088 - DNA, 25 bp, Mus musculus
ggatgcaatacactccatgggctta

SEQ ID NO: 451089 - DNA, 25 bp, Mus musculus
ggatgcacatctttcccatctggga

SEQ ID NO: 451090 - DNA, 25 bp, Mus musculus
ggatgcacctcttggatccccagga

SEQ ID NO: 451091 - DNA, 25 bp, Mus musculus
ggatgcactcggtagcttacacgga

SEQ ID NO: 451092 - DNA, 25 bp, Mus musculus
ggatgcagacacctcacaaggagca

SEQ ID NO: 451093 - DNA, 25 bp, Mus musculus
ggatgcagtagctcctggaaagttc

SEQ ID NO: 451094 - DNA, 25 bp, Mus musculus
ggatgcagtattcagcagccagctg

SEQ ID NO: 451095 - DNA, 25 bp, Mus musculus
ggatgcatagctgggacaattacct

SEQ ID NO: 451096 - DNA, 25 bp, Mus musculus
ggatgcatcgcaacactcggtcagt

SEQ ID NO: 451097 - DNA, 25 bp, Mus musculus
ggatgccaccgaggaagaacagcct

SEQ ID NO: 451098 - DNA, 25 bp, Mus musculus
ggatgccacctgctttcctggaaag

SEQ ID NO: 451099 - DNA, 25 bp, Mus musculus
ggatgccactaatactggaataaag

SEQ ID NO: 451100 - DNA, 25 bp, Mus musculus
ggatgccagacatcaagctagagca

SEQ ID NO: 451101 - DNA, 25 bp, Mus musculus
ggatgccagtctcatctgttgcgta

SEQ ID NO: 451102 - DNA, 25 bp, Mus musculus
ggatgccggcatatacgagtgtgaa

SEQ ID NO: 451103 - DNA, 25 bp, Mus musculus
ggatgcctcggaagcttacctgaag

SEQ ID NO: 451104 - DNA, 25 bp, Mus musculus
ggatgcctctgaccttgaccagcaa

SEQ ID NO: 451105 - DNA, 25 bp, Mus musculus
ggatgccttcaaaatcttggtttct

SEQ ID NO: 451106 - DNA, 25 bp, Mus musculus
ggatgccttcattcacggaccacaa

SEQ ID NO: 451107 - DNA, 25 bp, Mus musculus
ggatgccttgataacccagatagaa

SEQ ID NO: 451108 - DNA, 25 bp, Mus musculus
ggatgcgagagttgataaataccac

SEQ ID NO: 451109 - DNA, 25 bp, Mus musculus
ggatgcgcctctttcaccatggagc

SEQ ID NO: 451110 - DNA, 25 bp, Mus musculus
ggatgcggcagaactccagtcagaa

SEQ ID NO: 451111 - DNA, 25 bp, Mus musculus
ggatgctaccgtgctgaacttcgta

SEQ ID NO: 451112 - DNA, 25 bp, Mus musculus
ggatgctcaagtgcctgcgcttcaa

SEQ ID NO: 451113 - DNA, 25 bp, Mus musculus
ggatgctccccagccagatgtgaag

SEQ ID NO: 451114 - DNA, 25 bp, Mus musculus
ggatgctccgctcttcagaaactgg

SEQ ID NO: 451115 - DNA, 25 bp, Mus musculus
ggatgctcctgaagactactgatag

SEQ ID NO: 451116 - DNA, 25 bp, Mus musculus
ggatgctccttaatgctggcgtaga

SEQ ID NO: 451117 - DNA, 25 bp, Mus musculus
ggatgctctcccacagacagttctt

SEQ ID NO: 451118 - DNA, 25 bp, Mus musculus
ggatgctgaacaaacctctctccag

SEQ ID NO: 451119 - DNA, 25 bp, Mus musculus
ggatgctgatactgtcctccgcgct

SEQ ID NO: 451120 - DNA, 25 bp, Mus musculus
ggatgctgatctctcgaaacctgct

SEQ ID NO: 451121 - DNA, 25 bp, Mus musculus
ggatgctgcaagtctggacccagaa

SEQ ID NO: 451122 - DNA, 25 bp, Mus musculus
ggatgctgcgagtttcacctatgga

SEQ ID NO: 451123 - DNA, 25 bp, Mus musculus
ggatgctgttgtatggagccttgtc

SEQ ID NO: 451124 - DNA, 25 bp, Mus musculus
ggatgcttagcctggcccggagtct

SEQ ID NO: 451125 - DNA, 25 bp, Mus musculus
ggatgcttccgactatttgtcacag

SEQ ID NO: 451126 - DNA, 25 bp, Mus musculus
ggatggaacctttggcactcaggcc

SEQ ID NO: 451127 - DNA, 25 bp, Mus musculus
ggatggaattctgggacagattcct

SEQ ID NO: 451128 - DNA, 25 bp, Mus musculus
ggatggacatggtcatttcctcagt

SEQ ID NO: 451129 - DNA, 25 bp, Mus musculus
ggatggacctaatccctaggctgag

SEQ ID NO: 451130 - DNA, 25 bp, Mus musculus
ggatggactctgttcctgtcaccca

SEQ ID NO: 451131 - DNA, 25 bp, Mus musculus
ggatggagcagccatcccaacccag

SEQ ID NO: 451132 - DNA, 25 bp, Mus musculus
ggatggagcctgagaagttaccttc

SEQ ID NO: 451133 - DNA, 25 bp, Mus musculus
ggatggcctctgaatccaaattaga

SEQ ID NO: 451134 - DNA, 25 bp, Mus musculus
ggatggcgcttcatactcaaggtta

SEQ ID NO: 451135 - DNA, 25 bp, Mus musculus
ggatgggcagccattcttcaggatc

SEQ ID NO: 451136 - DNA, 25 bp, Mus musculus
ggatgggtaccctccagtacgacaa

SEQ ID NO: 451137 - DNA, 25 bp, Mus musculus
ggatggtcacagcttggcactctga

SEQ ID NO: 451138 - DNA, 25 bp, Mus musculus
ggatggtcaccaactccgaagtgtc

SEQ ID NO: 451139 - DNA, 25 bp, Mus musculus
ggatggtgacccctgcaaatttgca

SEQ ID NO: 451140 - DNA, 25 bp, Mus musculus
ggatggttaccagacaaactccccg

SEQ ID NO: 451141 - DNA, 25 bp, Mus musculus
ggatgtaccatctgttcctgcttca

SEQ ID NO: 451142 - DNA, 25 bp, Mus musculus
ggatgtaggagaaaaatggtcccct

SEQ ID NO: 451143 - DNA, 25 bp, Mus musculus
ggatgtatccaaccagacgactgta

SEQ ID NO: 451144 - DNA, 25 bp, Mus musculus
ggatgtatctatcctccgaggttcc

SEQ ID NO: 451145 - DNA, 25 bp, Mus musculus
ggatgtatttcaacaactgctgccg

SEQ ID NO: 451146 - DNA, 25 bp, Mus musculus
ggatgtcaccaagccagagcagata

SEQ ID NO: 451147 - DNA, 25 bp, Mus musculus
ggatgtcagccatggagtaactgag

SEQ ID NO: 451148 - DNA, 25 bp, Mus musculus
ggatgtcagcccagattacggtcca

SEQ ID NO: 451149 - DNA, 25 bp, Mus musculus
ggatgtccatatgcctgtctgttca

SEQ ID NO: 451150 - DNA, 25 bp, Mus musculus
ggatgtcctcatgagctccagcgca

SEQ ID NO: 451151 - DNA, 25 bp, Mus musculus
ggatgtccttcaggccctagtcagg

SEQ ID NO: 451152 - DNA, 25 bp, Mus musculus
ggatgtctatgttacggcccaccaa

SEQ ID NO: 451153 - DNA, 25 bp, Mus musculus
ggatgtctcctgaaaagcctatggg

SEQ ID NO: 451154 - DNA, 25 bp, Mus musculus
ggatgtctgcgagtaaaattgtctg

SEQ ID NO: 451155 - DNA, 25 bp, Mus musculus
ggatgtctgttaccttgaagtgatc

SEQ ID NO: 451156 - DNA, 25 bp, Mus musculus
ggatgtgactgcctaacctaggtgt

SEQ ID NO: 451157 - DNA, 25 bp, Mus musculus
ggatgtgatcctctgttgccaagca

SEQ ID NO: 451158 - DNA, 25 bp, Mus musculus
ggatgtgcctcagccacaggccatt

SEQ ID NO: 451159 - DNA, 25 bp, Mus musculus
ggatgtgctcacctatgtcaaactg

SEQ ID NO: 451160 - DNA, 25 bp, Mus musculus
ggatgtggacaaacactatctcagc

SEQ ID NO: 451161 - DNA, 25 bp, Mus musculus
ggatgtggagcaagctaaggcaaaa

SEQ ID NO: 451162 - DNA, 25 bp, Mus musculus
ggatgtggatcccaacctgtgtacc

SEQ ID NO: 451163 - DNA, 25 bp, Mus musculus
ggatgtggctgatacttattcttgc

SEQ ID NO: 451164 - DNA, 25 bp, Mus musculus
ggatgtggttgaaatttgcacttag

SEQ ID NO: 451165 - DNA, 25 bp, Mus musculus
ggatgtgtcagaataccttgggcca

SEQ ID NO: 451166 - DNA, 25 bp, Mus musculus
ggatgttatcattcggcccagcagt

SEQ ID NO: 451167 - DNA, 25 bp, Mus musculus
ggatgttcagctgactacctacttc

SEQ ID NO: 451168 - DNA, 25 bp, Mus musculus
ggatgttctgattccacctggcagc

SEQ ID NO: 451169 - DNA, 25 bp, Mus musculus
ggatgttgcgccttgtcaacccttc

SEQ ID NO: 451170 - DNA, 25 bp, Mus musculus
ggatgttggtccatttgggccactc

SEQ ID NO: 451171 - DNA, 25 bp, Mus musculus
ggatgtttgaacaccatcaattccc

SEQ ID NO: 451172 - DNA, 25 bp, Mus musculus
ggattaaccaaagtcttgccgcagg

SEQ ID NO: 451173 - DNA, 25 bp, Mus musculus
ggattacaccaacgatgacctcaag

SEQ ID NO: 451174 - DNA, 25 bp, Mus musculus
ggattacacctgaatggaattgagc

SEQ ID NO: 451175 - DNA, 25 bp, Mus musculus
ggattacagatatgtgccacaacgc

SEQ ID NO: 451176 - DNA, 25 bp, Mus musculus
ggattacagcagcttaacactggag

SEQ ID NO: 451177 - DNA, 25 bp, Mus musculus
ggattacaggcatgtccgactctat

SEQ ID NO: 451178 - DNA, 25 bp, Mus musculus
ggattaccgctacgaggtgctcacg

SEQ ID NO: 451179 - DNA, 25 bp, Mus musculus
ggattaccggtgatatctgtgaggc

SEQ ID NO: 451180 - DNA, 25 bp, Mus musculus
ggattacggcactatggcatgagca

SEQ ID NO: 451181 - DNA, 25 bp, Mus musculus
ggattactgccctgatagaagctgg

SEQ ID NO: 451182 - DNA, 25 bp, Mus musculus
ggattactgtttgatgcctgaccca

SEQ ID NO: 451183 - DNA, 25 bp, Mus musculus
ggattagagacatttgcaaaggccc

SEQ ID NO: 451184 - DNA, 25 bp, Mus musculus
ggattagtatccacacagttgccta

SEQ ID NO: 451185 - DNA, 25 bp, Mus musculus
ggattatagacctccagtgcacgag

SEQ ID NO: 451186 - DNA, 25 bp, Mus musculus
ggattatagataggtattgtgtact

SEQ ID NO: 451187 - DNA, 25 bp, Mus musculus
ggattatgtcacgttttcagaacaa

SEQ ID NO: 451188 - DNA, 25 bp, Mus musculus
ggattatgtgcatgaaccgcctgga

SEQ ID NO: 451189 - DNA, 25 bp, Mus musculus
ggattattctaacccagactgagca

SEQ ID NO: 451190 - DNA, 25 bp, Mus musculus
ggattcaaccctggccatgtggata

SEQ ID NO: 451191 - DNA, 25 bp, Mus musculus
ggattcacagctgagtgacagggcc

SEQ ID NO: 451192 - DNA, 25 bp, Mus musculus
ggattcactgaactggccttgggca

SEQ ID NO: 451193 - DNA, 25 bp, Mus musculus
ggattcaggaattgctccaccagca

SEQ ID NO: 451194 - DNA, 25 bp, Mus musculus
ggattcatctctgccatgggctaca

SEQ ID NO: 451195 - DNA, 25 bp, Mus musculus
ggattcattagcagaaagccctgag

SEQ ID NO: 451196 - DNA, 25 bp, Mus musculus
ggattccaacgtgggcaagacctgc

SEQ ID NO: 451197 - DNA, 25 bp, Mus musculus
ggattccagagtagcatctcaggat

SEQ ID NO: 451198 - DNA, 25 bp, Mus musculus
ggattcccaggaggcgacaagttcg

SEQ ID NO: 451199 - DNA, 25 bp, Mus musculus
ggattcctatgggacacagcagcca

SEQ ID NO: 451200 - DNA, 25 bp, Mus musculus
ggattcctcgtcagctgggatgaga

SEQ ID NO: 451201 - DNA, 25 bp, Mus musculus
ggattcctttctcggcaccagacac

SEQ ID NO: 451202 - DNA, 25 bp, Mus musculus
ggattctacggcaacggcgagacca

SEQ ID NO: 451203 - DNA, 25 bp, Mus musculus
ggattctactcatgacctgaggtca

SEQ ID NO: 451204 - DNA, 25 bp, Mus musculus
ggattctatccaaagccctgggagg

SEQ ID NO: 451205 - DNA, 25 bp, Mus musculus
ggattctcccgattctactgaaatg

SEQ ID NO: 451206 - DNA, 25 bp, Mus musculus
ggattctgattgcagctccactggc

SEQ ID NO: 451207 - DNA, 25 bp, Mus musculus
ggattcttcatgtccctcattcagg

SEQ ID NO: 451208 - DNA, 25 bp, Mus musculus
ggattcttcctcatgctcagtacag

SEQ ID NO: 451209 - DNA, 25 bp, Mus musculus
ggattcttcgcgctctggaccaagg

SEQ ID NO: 451210 - DNA, 25 bp, Mus musculus
ggattgaaaccagggtcggccactg

SEQ ID NO: 451211 - DNA, 25 bp, Mus musculus
ggattgaacaccaagaccacgctgg

SEQ ID NO: 451212 - DNA, 25 bp, Mus musculus
ggattgaatctaaccaacaacttga

SEQ ID NO: 451213 - DNA, 25 bp, Mus musculus
ggattgacagcaactctgggacgtc

SEQ ID NO: 451214 - DNA, 25 bp, Mus musculus
ggattgacctgtccctgattgagtc

SEQ ID NO: 451215 - DNA, 25 bp, Mus musculus
ggattgactcggaaacccttggcat

SEQ ID NO: 451216 - DNA, 25 bp, Mus musculus
ggattgagtgcctagacggtcgccc

SEQ ID NO: 451217 - DNA, 25 bp, Mus musculus
ggattgatccgagggaccatgaagc

SEQ ID NO: 451218 - DNA, 25 bp, Mus musculus
ggattgcaaagacagacccgggttc

SEQ ID NO: 451219 - DNA, 25 bp, Mus musculus
ggattgcgggcgaaccagagctctt

SEQ ID NO: 451220 - DNA, 25 bp, Mus musculus
ggattgctagcatccccgggagttc

SEQ ID NO: 451221 - DNA, 25 bp, Mus musculus
ggattgctctttggctgctccactg

SEQ ID NO: 451222 - DNA, 25 bp, Mus musculus
ggattgcttccaagatcggccctaa

SEQ ID NO: 451223 - DNA, 25 bp, Mus musculus
ggattgcttcctctctgggatcgag

SEQ ID NO: 451224 - DNA, 25 bp, Mus musculus
ggattgcttttatgcccaggtcgaa

SEQ ID NO: 451225 - DNA, 25 bp, Mus musculus
ggattggactccatgatctgtcact

SEQ ID NO: 451226 - DNA, 25 bp, Mus musculus
ggattggacttctcagcagcagcag

SEQ ID NO: 451227 - DNA, 25 bp, Mus musculus
ggattggagactcctcatgtctgag

SEQ ID NO: 451228 - DNA, 25 bp, Mus musculus
ggattggccgctaccgcatgatcaa

SEQ ID NO: 451229 - DNA, 25 bp, Mus musculus
ggattggccgggagctttccgccaa

SEQ ID NO: 451230 - DNA, 25 bp, Mus musculus
ggattggcctattcatgcgaagacg

SEQ ID NO: 451231 - DNA, 25 bp, Mus musculus
ggattggcctctgcacctcacttag

SEQ ID NO: 451232 - DNA, 25 bp, Mus musculus
ggattgggcagtgaacctcctgttc

SEQ ID NO: 451233 - DNA, 25 bp, Mus musculus
ggattgtatccctcacttttgcata

SEQ ID NO: 451234 - DNA, 25 bp, Mus musculus
ggattgtcccaaccctcaggatcaa

SEQ ID NO: 451235 - DNA, 25 bp, Mus musculus
ggattgtctggcaaaccctgctgct

SEQ ID NO: 451236 - DNA, 25 bp, Mus musculus
ggattgtctgtggttattaaccctg

SEQ ID NO: 451237 - DNA, 25 bp, Mus musculus
ggattgtgccactctcgacacgatg

SEQ ID NO: 451238 - DNA, 25 bp, Mus musculus
ggatttaaaggcattcaccaacttg

SEQ ID NO: 451239 - DNA, 25 bp, Mus musculus
ggatttaacatcaaaagcgtgcagt

SEQ ID NO: 451240 - DNA, 25 bp, Mus musculus
ggatttagctccctaaatgcaagct

SEQ ID NO: 451241 - DNA, 25 bp, Mus musculus
ggatttataaaacagcgccgcatag

SEQ ID NO: 451242 - DNA, 25 bp, Mus musculus
ggatttcaataccacgctacacagg

SEQ ID NO: 451243 - DNA, 25 bp, Mus musculus
ggatttcagatctccggtggcccac

SEQ ID NO: 451244 - DNA, 25 bp, Mus musculus
ggatttcagccttcctcatgcagaa

SEQ ID NO: 451245 - DNA, 25 bp, Mus musculus
ggatttccagtgctttgaactctca

SEQ ID NO: 451246 - DNA, 25 bp, Mus musculus
ggatttcgcatcagctcatcttggg

SEQ ID NO: 451247 - DNA, 25 bp, Mus musculus
ggatttcgggaatatcagatcattg

SEQ ID NO: 451248 - DNA, 25 bp, Mus musculus
ggatttctattcttgttatcagcca

SEQ ID NO: 451249 - DNA, 25 bp, Mus musculus
ggatttctgaatggctcacccacgg

SEQ ID NO: 451250 - DNA, 25 bp, Mus musculus
ggatttctttaaggccggcagaggc

SEQ ID NO: 451251 - DNA, 25 bp, Mus musculus
ggatttctttgaaagaacaacaaca

SEQ ID NO: 451252 - DNA, 25 bp, Mus musculus
ggatttgaagatgcacaggacccac

SEQ ID NO: 451253 - DNA, 25 bp, Mus musculus
ggatttgagccctttaccatggaaa

SEQ ID NO: 451254 - DNA, 25 bp, Mus musculus
ggatttgcaaaacctggcatggagc

SEQ ID NO: 451255 - DNA, 25 bp, Mus musculus
ggatttgcaacagcactggccagca

SEQ ID NO: 451256 - DNA, 25 bp, Mus musculus
ggatttgccattgcagccgctctag

SEQ ID NO: 451257 - DNA, 25 bp, Mus musculus
ggatttgcccaaagttaggtgtgag

SEQ ID NO: 451258 - DNA, 25 bp, Mus musculus
ggatttgctccttagtttcacttgg

SEQ ID NO: 451259 - DNA, 25 bp, Mus musculus
ggatttggactatgcaaaagctaaa

SEQ ID NO: 451260 - DNA, 25 bp, Mus musculus
ggatttgggttctgtacgcccttga

SEQ ID NO: 451261 - DNA, 25 bp, Mus musculus
ggattttccttccatacggccccag

SEQ ID NO: 451262 - DNA, 25 bp, Mus musculus
ggattttcgtcctgttccagtgttc

SEQ ID NO: 451263 - DNA, 25 bp, Mus musculus
ggattttctactacatgaccagcgc

SEQ ID NO: 451264 - DNA, 25 bp, Mus musculus
ggattttggataagaacaagcatca

SEQ ID NO: 451265 - DNA, 25 bp, Mus musculus
ggatttttggattttccgctcacag

SEQ ID NO: 451266 - DNA, 25 bp, Mus musculus
ggattttttgacagctccaggtcag

SEQ ID NO: 451267 - DNA, 25 bp, Mus musculus
ggcaaaaactgtgcacctagaggag

SEQ ID NO: 451268 - DNA, 25 bp, Mus musculus
ggcaaaaagctttggcccgtcgagc

SEQ ID NO: 451269 - DNA, 25 bp, Mus musculus
ggcaaaaccataggccagtttactc

SEQ ID NO: 451270 - DNA, 25 bp, Mus musculus
ggcaaaaccggaagaccttatggat

SEQ ID NO: 451271 - DNA, 25 bp, Mus musculus
ggcaaaacctattctcttccaccga

SEQ ID NO: 451272 - DNA, 25 bp, Mus musculus
ggcaaaacgtttagacacagctcaa

SEQ ID NO: 451273 - DNA, 25 bp, Mus musculus
ggcaaaagcctttggcctacaagcc

SEQ ID NO: 451274 - DNA, 25 bp, Mus musculus
ggcaaaaggagttagctgcctccct

SEQ ID NO: 451275 - DNA, 25 bp, Mus musculus
ggcaaacaaggtccggtccaagttg

SEQ ID NO: 451276 - DNA, 25 bp, Mus musculus
ggcaaacagaacctatttagcttag

SEQ ID NO: 451277 - DNA, 25 bp, Mus musculus
ggcaaacaggccttatatcaactga

SEQ ID NO: 451278 - DNA, 25 bp, Mus musculus
ggcaaaccggaactgactggcacag

SEQ ID NO: 451279 - DNA, 25 bp, Mus musculus
ggcaaaccggtccagcacttcatga

SEQ ID NO: 451280 - DNA, 25 bp, Mus musculus
ggcaaactcttagctgggcatgatg

SEQ ID NO: 451281 - DNA, 25 bp, Mus musculus
ggcaaactgcctcggcacatgagga

SEQ ID NO: 451282 - DNA, 25 bp, Mus musculus
ggcaaagaccctaacacctgcggtg

SEQ ID NO: 451283 - DNA, 25 bp, Mus musculus
ggcaaagacctaataaacagggctt

SEQ ID NO: 451284 - DNA, 25 bp, Mus musculus
ggcaaagcacatccagtgtaattgt

SEQ ID NO: 451285 - DNA, 25 bp, Mus musculus
ggcaaaggaaaggatacccgttcat

SEQ ID NO: 451286 - DNA, 25 bp, Mus musculus
ggcaaaggacagatttcaataacaa

SEQ ID NO: 451287 - DNA, 25 bp, Mus musculus
ggcaaaggacggaggaaacaaagct

SEQ ID NO: 451288 - DNA, 25 bp, Mus musculus
ggcaaagtcgtggtgccccgtgcgt

SEQ ID NO: 451289 - DNA, 25 bp, Mus musculus
ggcaaatagcctgagcagtcggtca

SEQ ID NO: 451290 - DNA, 25 bp, Mus musculus
ggcaaatagggagaaagtatttcca

SEQ ID NO: 451291 - DNA, 25 bp, Mus musculus
ggcaaatccaaactaccaggcggag

SEQ ID NO: 451292 - DNA, 25 bp, Mus musculus
ggcaaatccgtgaataccagctcta

SEQ ID NO: 451293 - DNA, 25 bp, Mus musculus
ggcaaatctgtgcttctttatgagg

SEQ ID NO: 451294 - DNA, 25 bp, Mus musculus
ggcaaatgaatgtctccagcgtcga

SEQ ID NO: 451295 - DNA, 25 bp, Mus musculus
ggcaaatgttgtggtcactggacct

SEQ ID NO: 451296 - DNA, 25 bp, Mus musculus
ggcaaattccttgcgtcctgacgag

SEQ ID NO: 451297 - DNA, 25 bp, Mus musculus
ggcaaattcgatctttaccctgtga

SEQ ID NO: 451298 - DNA, 25 bp, Mus musculus
ggcaaatttcacaccgtccggacag

SEQ ID NO: 451299 - DNA, 25 bp, Mus musculus
ggcaacaaacacttcagtcatgtgg

SEQ ID NO: 451300 - DNA, 25 bp, Mus musculus
ggcaacaaatgacccactggaaagg

SEQ ID NO: 451301 - DNA, 25 bp, Mus musculus
ggcaacacatgaggcctttgtgggt

SEQ ID NO: 451302 - DNA, 25 bp, Mus musculus
ggcaacaggccttggattctcagcc

SEQ ID NO: 451303 - DNA, 25 bp, Mus musculus
ggcaacatactttatctgggaggca

SEQ ID NO: 451304 - DNA, 25 bp, Mus musculus
ggcaacatgcaggttctagtgactt

SEQ ID NO: 451305 - DNA, 25 bp, Mus musculus
ggcaacatgctcattgtggtcactg

SEQ ID NO: 451306 - DNA, 25 bp, Mus musculus
ggcaacattccaaactctccacagg

SEQ ID NO: 451307 - DNA, 25 bp, Mus musculus
ggcaaccccttctggatggatccct

SEQ ID NO: 451308 - DNA, 25 bp, Mus musculus
ggcaaccgcgctgaggatctgtaca

SEQ ID NO: 451309 - DNA, 25 bp, Mus musculus
ggcaaccggcgttcatattatccta

SEQ ID NO: 451310 - DNA, 25 bp, Mus musculus
ggcaacctgggcataagcaacgaca

SEQ ID NO: 451311 - DNA, 25 bp, Mus musculus
ggcaacggcttctcccgggagctga

SEQ ID NO: 451312 - DNA, 25 bp, Mus musculus
ggcaacgggctctacaacttcatcg

SEQ ID NO: 451313 - DNA, 25 bp, Mus musculus
ggcaacgtgctggttattatcgcgg

SEQ ID NO: 451314 - DNA, 25 bp, Mus musculus
ggcaactaaatttctttgctgtttg

SEQ ID NO: 451315 - DNA, 25 bp, Mus musculus
ggcaactgctacatcttcaactggg

SEQ ID NO: 451316 - DNA, 25 bp, Mus musculus
ggcaactgctatgaagccatataaa

SEQ ID NO: 451317 - DNA, 25 bp, Mus musculus
ggcaacttctgcaacgagcgcttca

SEQ ID NO: 451318 - DNA, 25 bp, Mus musculus
ggcaacttctggatagcagcttcag

SEQ ID NO: 451319 - DNA, 25 bp, Mus musculus
ggcaacttgggctcacctgcattaa

SEQ ID NO: 451320 - DNA, 25 bp, Mus musculus
ggcaagaaacccacagtaaggctca

SEQ ID NO: 451321 - DNA, 25 bp, Mus musculus
ggcaagaactgcaaatccacgctga

SEQ ID NO: 451322 - DNA, 25 bp, Mus musculus
ggcaagaatatctccgtcagcatgg

SEQ ID NO: 451323 - DNA, 25 bp, Mus musculus
ggcaagacaacggtgagtgaagctc

SEQ ID NO: 451324 - DNA, 25 bp, Mus musculus
ggcaagacgtgcctgacttaccgct

SEQ ID NO: 451325 - DNA, 25 bp, Mus musculus
ggcaagagaaagaggctgaccaata

SEQ ID NO: 451326 - DNA, 25 bp, Mus musculus
ggcaagagacgtggctgcaatatct

SEQ ID NO: 451327 - DNA, 25 bp, Mus musculus
ggcaagagccttaaactgtgtatcg

SEQ ID NO: 451328 - DNA, 25 bp, Mus musculus
ggcaagatgctgaccctgagtgaaa

SEQ ID NO: 451329 - DNA, 25 bp, Mus musculus
ggcaagccagccctagcattgttat

SEQ ID NO: 451330 - DNA, 25 bp, Mus musculus
ggcaagcgccattgagtgtcactcg

SEQ ID NO: 451331 - DNA, 25 bp, Mus musculus
ggcaagctctattccctgggcaaag

SEQ ID NO: 451332 - DNA, 25 bp, Mus musculus
ggcaaggcatagagagagacatggg

SEQ ID NO: 451333 - DNA, 25 bp, Mus musculus
ggcaagggtgcttctcctgcttcag

SEQ ID NO: 451334 - DNA, 25 bp, Mus musculus
ggcaaggtgcgtcctgaaatcatca

SEQ ID NO: 451335 - DNA, 25 bp, Mus musculus
ggcaagtacagcgatcccatggaga

SEQ ID NO: 451336 - DNA, 25 bp, Mus musculus
ggcaagtacgagaagccgccgttca

SEQ ID NO: 451337 - DNA, 25 bp, Mus musculus
ggcaagtcaccctgcatcagcatca

SEQ ID NO: 451338 - DNA, 25 bp, Mus musculus
ggcaagtcactctccgtctctgggt

SEQ ID NO: 451339 - DNA, 25 bp, Mus musculus
ggcaagtcttagtcatgttctcaaa

SEQ ID NO: 451340 - DNA, 25 bp, Mus musculus
ggcaagtgcatctcacccattttga

SEQ ID NO: 451341 - DNA, 25 bp, Mus musculus
ggcaagtgcgccaacagagaaacaa

SEQ ID NO: 451342 - DNA, 25 bp, Mus musculus
ggcaagttcacttaccccacaggag

SEQ ID NO: 451343 - DNA, 25 bp, Mus musculus
ggcaagttcattgagccccaggtga

SEQ ID NO: 451344 - DNA, 25 bp, Mus musculus
ggcaagttcttcctcgatttccgca

SEQ ID NO: 451345 - DNA, 25 bp, Mus musculus
ggcaataaaatcaggcatcatggca

SEQ ID NO: 451346 - DNA, 25 bp, Mus musculus
ggcaatagctctgggacgcctaaac

SEQ ID NO: 451347 - DNA, 25 bp, Mus musculus
ggcaatagctgacttcttggcctga

SEQ ID NO: 451348 - DNA, 25 bp, Mus musculus
ggcaatatggacaagagcgctcaca

SEQ ID NO: 451349 - DNA, 25 bp, Mus musculus
ggcaatgacatctaggcaagcccat

SEQ ID NO: 451350 - DNA, 25 bp, Mus musculus
ggcaatgaccattataataacaagg

SEQ ID NO: 451351 - DNA, 25 bp, Mus musculus
ggcaatgacttggacttctacctga

SEQ ID NO: 451352 - DNA, 25 bp, Mus musculus
ggcaatgcacacactggcccttatt

SEQ ID NO: 451353 - DNA, 25 bp, Mus musculus
ggcaatgcatactacatagactggc

SEQ ID NO: 451354 - DNA, 25 bp, Mus musculus
ggcaatgccgtgatttcagagagaa

SEQ ID NO: 451355 - DNA, 25 bp, Mus musculus
ggcaatgtcatgttcctcctccaga

SEQ ID NO: 451356 - DNA, 25 bp, Mus musculus
ggcaattgcaagcaagcctgctatg

SEQ ID NO: 451357 - DNA, 25 bp, Mus musculus
ggcaatttacacacttgtcttttaa

SEQ ID NO: 451358 - DNA, 25 bp, Mus musculus
ggcacaaaagtaggtgagactgctt

SEQ ID NO: 451359 - DNA, 25 bp, Mus musculus
ggcacaaacagcttgtcagggcgtt

SEQ ID NO: 451360 - DNA, 25 bp, Mus musculus
ggcacaaactacacggtgaataact

SEQ ID NO: 451361 - DNA, 25 bp, Mus musculus
ggcacaaatttcagtcccaggcgga

SEQ ID NO: 451362 - DNA, 25 bp, Mus musculus
ggcacaagcacagtcacagtcagag

SEQ ID NO: 451363 - DNA, 25 bp, Mus musculus
ggcacaaggcaactgactagctgat

SEQ ID NO: 451364 - DNA, 25 bp, Mus musculus
ggcacaagttcaggagacccgaagg

SEQ ID NO: 451365 - DNA, 25 bp, Mus musculus
ggcacacaaatattgactcactgaa

SEQ ID NO: 451366 - DNA, 25 bp, Mus musculus
ggcacacacctaaaagactgtttgg

SEQ ID NO: 451367 - DNA, 25 bp, Mus musculus
ggcacacagattcaccagcagaaag

SEQ ID NO: 451368 - DNA, 25 bp, Mus musculus
ggcacacagctttgaaagccacatt

SEQ ID NO: 451369 - DNA, 25 bp, Mus musculus
ggcacacagggctcattccttcttg

SEQ ID NO: 451370 - DNA, 25 bp, Mus musculus
ggcacaccgtttaccagacattcag

SEQ ID NO: 451371 - DNA, 25 bp, Mus musculus
ggcacactacgcaaagcttcatggg

SEQ ID NO: 451372 - DNA, 25 bp, Mus musculus
ggcacactgtgagaccaataattcc

SEQ ID NO: 451373 - DNA, 25 bp, Mus musculus
ggcacagaccatcatgaaggctcga

SEQ ID NO: 451374 - DNA, 25 bp, Mus musculus
ggcacagacctcacagttacactga

SEQ ID NO: 451375 - DNA, 25 bp, Mus musculus
ggcacagacggtacgcgatgccctg

SEQ ID NO: 451376 - DNA, 25 bp, Mus musculus
ggcacagacttcagtgtcctcctga

SEQ ID NO: 451377 - DNA, 25 bp, Mus musculus
ggcacagctctttgggatcctcaca

SEQ ID NO: 451378 - DNA, 25 bp, Mus musculus
ggcacaggccggaccaagcatcctt

SEQ ID NO: 451379 - DNA, 25 bp, Mus musculus
ggcacaggcctgtgatccctctttt

SEQ ID NO: 451380 - DNA, 25 bp, Mus musculus
ggcacaggtcgagaaggcatgactc

SEQ ID NO: 451381 - DNA, 25 bp, Mus musculus
ggcacagtatgcgtgtatgcacaca

SEQ ID NO: 451382 - DNA, 25 bp, Mus musculus
ggcacagtcttgtgtagcctggctg

SEQ ID NO: 451383 - DNA, 25 bp, Mus musculus
ggcacatacagttcagtcactttcg

SEQ ID NO: 451384 - DNA, 25 bp, Mus musculus
ggcacataggcacagtcacgggaat

SEQ ID NO: 451385 - DNA, 25 bp, Mus musculus
ggcacatatttgtggatttcctgac

SEQ ID NO: 451386 - DNA, 25 bp, Mus musculus
ggcacatctttgatctgggtcattg

SEQ ID NO: 451387 - DNA, 25 bp, Mus musculus
ggcacatgccagagtccaagtttag

SEQ ID NO: 451388 - DNA, 25 bp, Mus musculus
ggcaccaagtttgacctgagacagt

SEQ ID NO: 451389 - DNA, 25 bp, Mus musculus
ggcaccaatgtagctggaggacttg

SEQ ID NO: 451390 - DNA, 25 bp, Mus musculus
ggcaccacaggtttgagcattttga

SEQ ID NO: 451391 - DNA, 25 bp, Mus musculus
ggcaccagagtatctgtgtttccct

SEQ ID NO: 451392 - DNA, 25 bp, Mus musculus
ggcaccagccccttggaagtcctgg

SEQ ID NO: 451393 - DNA, 25 bp, Mus musculus
ggcaccagtatgtgggcagacctct

SEQ ID NO: 451394 - DNA, 25 bp, Mus musculus
ggcaccatctgctggtcctgagtca

SEQ ID NO: 451395 - DNA, 25 bp, Mus musculus
ggcaccatgcccatgacactgggtt

SEQ ID NO: 451396 - DNA, 25 bp, Mus musculus
ggcaccattgagtatgaccctcgca

SEQ ID NO: 451397 - DNA, 25 bp, Mus musculus
ggcacccacaaaacttcctcaaaag

SEQ ID NO: 451398 - DNA, 25 bp, Mus musculus
ggcacccacttgcagccctgtgatt

SEQ ID NO: 451399 - DNA, 25 bp, Mus musculus
ggcacccgatacctgtttgttgaat

SEQ ID NO: 451400 - DNA, 25 bp, Mus musculus
ggcaccctcagcaactactacgtgg

SEQ ID NO: 451401 - DNA, 25 bp, Mus musculus
ggcaccctgtgacagcgcaaaggct

SEQ ID NO: 451402 - DNA, 25 bp, Mus musculus
ggcaccgaaaaggatacaccaccat

SEQ ID NO: 451403 - DNA, 25 bp, Mus musculus
ggcaccgcgccaacaaagtactgtt

SEQ ID NO: 451404 - DNA, 25 bp, Mus musculus
ggcaccggaccgcaatctgcagttt

SEQ ID NO: 451405 - DNA, 25 bp, Mus musculus
ggcaccgtgtcatgaaaaccatatg

SEQ ID NO: 451406 - DNA, 25 bp, Mus musculus
ggcacctaaccacaggacaactctg

SEQ ID NO: 451407 - DNA, 25 bp, Mus musculus
ggcacctcagactccgtgtttgcgg

SEQ ID NO: 451408 - DNA, 25 bp, Mus musculus
ggcacctctgtctcttgtaaatgac

SEQ ID NO: 451409 - DNA, 25 bp, Mus musculus
ggcacctgcagaagctatacctgaa

SEQ ID NO: 451410 - DNA, 25 bp, Mus musculus
ggcacctggtgcttcatcgactgga

SEQ ID NO: 451411 - DNA, 25 bp, Mus musculus
ggcaccttgctgtgagagccaggaa

SEQ ID NO: 451412 - DNA, 25 bp, Mus musculus
ggcaccttgttggtagtctcttgct

SEQ ID NO: 451413 - DNA, 25 bp, Mus musculus
ggcacctttgtgtgaagccccactt

SEQ ID NO: 451414 - DNA, 25 bp, Mus musculus
ggcacgaaaagtacattcagacacc

SEQ ID NO: 451415 - DNA, 25 bp, Mus musculus
ggcacgaaccctgctagaccatgag

SEQ ID NO: 451416 - DNA, 25 bp, Mus musculus
ggcacgagaatcttccccagagcca

SEQ ID NO: 451417 - DNA, 25 bp, Mus musculus
ggcacgattaatcctgtgatcctca

SEQ ID NO: 451418 - DNA, 25 bp, Mus musculus
ggcacgcagcatggagtcttattca

SEQ ID NO: 451419 - DNA, 25 bp, Mus musculus
ggcacgcctcagtcaactcatgcag

SEQ ID NO: 451420 - DNA, 25 bp, Mus musculus
ggcacgtcttgaccttgaacggaaa

SEQ ID NO: 451421 - DNA, 25 bp, Mus musculus
ggcacgttcaatgtgacatgtcaga

SEQ ID NO: 451422 - DNA, 25 bp, Mus musculus
ggcacgttgcgtagcgctctgctcc

SEQ ID NO: 451423 - DNA, 25 bp, Mus musculus
ggcactaaggggtcaaggagctcca

SEQ ID NO: 451424 - DNA, 25 bp, Mus musculus
ggcactacacacagatagaatcaat

SEQ ID NO: 451425 - DNA, 25 bp, Mus musculus
ggcactatgaatctgcacactggaa

SEQ ID NO: 451426 - DNA, 25 bp, Mus musculus
ggcactccgcgatgcagctcctgaa

SEQ ID NO: 451427 - DNA, 25 bp, Mus musculus
ggcactctactaggcaggtctggaa

SEQ ID NO: 451428 - DNA, 25 bp, Mus musculus
ggcactctgacctgattttcataag

SEQ ID NO: 451429 - DNA, 25 bp, Mus musculus
ggcactcttgtggatgctggattta

SEQ ID NO: 451430 - DNA, 25 bp, Mus musculus
ggcactgcaactcatttgctctcag

SEQ ID NO: 451431 - DNA, 25 bp, Mus musculus
ggcactgcccgaccctaacaaaggg

SEQ ID NO: 451432 - DNA, 25 bp, Mus musculus
ggcactgctgacagctgctgttcgc

SEQ ID NO: 451433 - DNA, 25 bp, Mus musculus
ggcactggatcacagaaggccacga

SEQ ID NO: 451434 - DNA, 25 bp, Mus musculus
ggcactggtcttttgtggccccaaa

SEQ ID NO: 451435 - DNA, 25 bp, Mus musculus
ggcactgtgactgacttccctggat

SEQ ID NO: 451436 - DNA, 25 bp, Mus musculus
ggcactgttaactcccagggaatcc

SEQ ID NO: 451437 - DNA, 25 bp, Mus musculus
ggcactgtttctccacgtatatttg

SEQ ID NO: 451438 - DNA, 25 bp, Mus musculus
ggcacttagaagaaatgcgctcact

SEQ ID NO: 451439 - DNA, 25 bp, Mus musculus
ggcactttagacttacccctgggat

SEQ ID NO: 451440 - DNA, 25 bp, Mus musculus
ggcactttcggcatgactactcact

SEQ ID NO: 451441 - DNA, 25 bp, Mus musculus
ggcagaaagaaatttggcacctcct

SEQ ID NO: 451442 - DNA, 25 bp, Mus musculus
ggcagaaagctcctaccgtcagagg

SEQ ID NO: 451443 - DNA, 25 bp, Mus musculus
ggcagaaaggtaaggatccaggata

SEQ ID NO: 451444 - DNA, 25 bp, Mus musculus
ggcagaaagtaagtcagctgcacct

SEQ ID NO: 451445 - DNA, 25 bp, Mus musculus
ggcagaactgctctctcatttttcg

SEQ ID NO: 451446 - DNA, 25 bp, Mus musculus
ggcagaagacagtgtgctctacccc

SEQ ID NO: 451447 - DNA, 25 bp, Mus musculus
ggcagaagccactgagtccagctga

SEQ ID NO: 451448 - DNA, 25 bp, Mus musculus
ggcagaaggcattccatcagaactc

SEQ ID NO: 451449 - DNA, 25 bp, Mus musculus
ggcagaatcagcacccctgggaatt

SEQ ID NO: 451450 - DNA, 25 bp, Mus musculus
ggcagaatcagcctttcaatctcaa

SEQ ID NO: 451451 - DNA, 25 bp, Mus musculus
ggcagacactcatctgacatctaag

SEQ ID NO: 451452 - DNA, 25 bp, Mus musculus
ggcagacactgaatatagggaggtt

SEQ ID NO: 451453 - DNA, 25 bp, Mus musculus
ggcagacactgacgcttagaaagag

SEQ ID NO: 451454 - DNA, 25 bp, Mus musculus
ggcagacactgctaatcaaccctgg

SEQ ID NO: 451455 - DNA, 25 bp, Mus musculus
ggcagacagcgcctcctgaaagtga

SEQ ID NO: 451456 - DNA, 25 bp, Mus musculus
ggcagaccagccaggagtgctgaat

SEQ ID NO: 451457 - DNA, 25 bp, Mus musculus
ggcagactgtgataggccgcgggcc

SEQ ID NO: 451458 - DNA, 25 bp, Mus musculus
ggcagactgtggtgtgccacaacct

SEQ ID NO: 451459 - DNA, 25 bp, Mus musculus
ggcagagaccctgcccatctttgag

SEQ ID NO: 451460 - DNA, 25 bp, Mus musculus
ggcagagccatgttactgctcctaa

SEQ ID NO: 451461 - DNA, 25 bp, Mus musculus
ggcagagctaagtgggtctacactt

SEQ ID NO: 451462 - DNA, 25 bp, Mus musculus
ggcagagctccatcgtacactacat

SEQ ID NO: 451463 - DNA, 25 bp, Mus musculus
ggcagaggaaccgaagtgaagatca

SEQ ID NO: 451464 - DNA, 25 bp, Mus musculus
ggcagaggacatcaccaggttataa

SEQ ID NO: 451465 - DNA, 25 bp, Mus musculus
ggcagaggccaatccacctgagttt

SEQ ID NO: 451466 - DNA, 25 bp, Mus musculus
ggcagaggtctatgatccacccaca

SEQ ID NO: 451467 - DNA, 25 bp, Mus musculus
ggcagagtaagtatttgtccaggac

SEQ ID NO: 451468 - DNA, 25 bp, Mus musculus
ggcagagtctgctcatcacaggcaa

SEQ ID NO: 451469 - DNA, 25 bp, Mus musculus
ggcagagtcttcacaggctttggaa

SEQ ID NO: 451470 - DNA, 25 bp, Mus musculus
ggcagatcctaataagcagctcgag

SEQ ID NO: 451471 - DNA, 25 bp, Mus musculus
ggcagatctgaagccaccgaggata

SEQ ID NO: 451472 - DNA, 25 bp, Mus musculus
ggcagattgaagtttgacccctaat

SEQ ID NO: 451473 - DNA, 25 bp, Mus musculus
ggcagattgcataaggcccaggcca

SEQ ID NO: 451474 - DNA, 25 bp, Mus musculus
ggcagcagctgaacgagaccattga

SEQ ID NO: 451475 - DNA, 25 bp, Mus musculus
ggcagcagcttcttgacgtcaggac

SEQ ID NO: 451476 - DNA, 25 bp, Mus musculus
ggcagcaggcaggactcagctagct

SEQ ID NO: 451477 - DNA, 25 bp, Mus musculus
ggcagcaggcgacactaagtgcact

SEQ ID NO: 451478 - DNA, 25 bp, Mus musculus
ggcagcatccagagggagaaatcaa

SEQ ID NO: 451479 - DNA, 25 bp, Mus musculus
ggcagcatgtgcctccctcagtgac

SEQ ID NO: 451480 - DNA, 25 bp, Mus musculus
ggcagcatgtgctttcgattaatca

SEQ ID NO: 451481 - DNA, 25 bp, Mus musculus
ggcagcattatgatgtccagtgtcc

SEQ ID NO: 451482 - DNA, 25 bp, Mus musculus
ggcagcattcctgtgatgcagagat

SEQ ID NO: 451483 - DNA, 25 bp, Mus musculus
ggcagccagaagacatgagccaagg

SEQ ID NO: 451484 - DNA, 25 bp, Mus musculus
ggcagccaggatttaataaacaaca

SEQ ID NO: 451485 - DNA, 25 bp, Mus musculus
ggcagccagtccaggtgaggcagga

SEQ ID NO: 451486 - DNA, 25 bp, Mus musculus
ggcagcccagttcatgcaacagaga

SEQ ID NO: 451487 - DNA, 25 bp, Mus musculus
ggcagccccattccagtgtctaagt

SEQ ID NO: 451488 - DNA, 25 bp, Mus musculus
ggcagccccttggtcatggatccta

SEQ ID NO: 451489 - DNA, 25 bp, Mus musculus
ggcagcccttccttcaagtttaaga

SEQ ID NO: 451490 - DNA, 25 bp, Mus musculus
ggcagccgggcttcaagagcaacat

SEQ ID NO: 451491 - DNA, 25 bp, Mus musculus
ggcagcctacttggctgagtgagaa

SEQ ID NO: 451492 - DNA, 25 bp, Mus musculus
ggcagcctgattataaacatcccaa

SEQ ID NO: 451493 - DNA, 25 bp, Mus musculus
ggcagcctgggagcaaacattgtca

SEQ ID NO: 451494 - DNA, 25 bp, Mus musculus
ggcagcctgttatcgactacattga

SEQ ID NO: 451495 - DNA, 25 bp, Mus musculus
ggcagccttgagaacagcgcctata

SEQ ID NO: 451496 - DNA, 25 bp, Mus musculus
ggcagcctttctgaactggagtcga

SEQ ID NO: 451497 - DNA, 25 bp, Mus musculus
ggcagcgcctaaccatagcagaaat

SEQ ID NO: 451498 - DNA, 25 bp, Mus musculus
ggcagcggaccacacataaattatt

SEQ ID NO: 451499 - DNA, 25 bp, Mus musculus
ggcagcgtgttcatcaccctcaaga

SEQ ID NO: 451500 - DNA, 25 bp, Mus musculus
ggcagctaagcaggccagagtaaga

SEQ ID NO: 451501 - DNA, 25 bp, Mus musculus
ggcagctaagctcttccagggacag

SEQ ID NO: 451502 - DNA, 25 bp, Mus musculus
ggcagctatcggaaccagcttaccc

SEQ ID NO: 451503 - DNA, 25 bp, Mus musculus
ggcagctcccagaactaggttttaa

SEQ ID NO: 451504 - DNA, 25 bp, Mus musculus
ggcagctcgaaacatggtactacag

SEQ ID NO: 451505 - DNA, 25 bp, Mus musculus
ggcagctgaatattttccaggtgta

SEQ ID NO: 451506 - DNA, 25 bp, Mus musculus
ggcagctgagcacttttccatggtc

SEQ ID NO: 451507 - DNA, 25 bp, Mus musculus
ggcagctgagtctgcggcgcggagc

SEQ ID NO: 451508 - DNA, 25 bp, Mus musculus
ggcagctgcccctcaagttggagaa

SEQ ID NO: 451509 - DNA, 25 bp, Mus musculus
ggcagctgctctccatagaacatga

SEQ ID NO: 451510 - DNA, 25 bp, Mus musculus
ggcagctgctgaaatgagcgttaca

SEQ ID NO: 451511 - DNA, 25 bp, Mus musculus
ggcagctggcctattagtaccaaag

SEQ ID NO: 451512 - DNA, 25 bp, Mus musculus
ggcagctgtagaccctgtcactcgg

SEQ ID NO: 451513 - DNA, 25 bp, Mus musculus
ggcagctgtcaaaaacaaggatggg

SEQ ID NO: 451514 - DNA, 25 bp, Mus musculus
ggcagctgtctggtcccttgggatc

SEQ ID NO: 451515 - DNA, 25 bp, Mus musculus
ggcagcttgatcttggaccccagaa

SEQ ID NO: 451516 - DNA, 25 bp, Mus musculus
ggcagcttgcccgagttctactaca

SEQ ID NO: 451517 - DNA, 25 bp, Mus musculus
ggcaggaacagctgactcattagta

SEQ ID NO: 451518 - DNA, 25 bp, Mus musculus
ggcaggacactgagcagaagaccca

SEQ ID NO: 451519 - DNA, 25 bp, Mus musculus
ggcaggacccagcagacagatttta

SEQ ID NO: 451520 - DNA, 25 bp, Mus musculus
ggcaggactactaccaatgaagaac

SEQ ID NO: 451521 - DNA, 25 bp, Mus musculus
ggcaggagctcaacagacatcagat

SEQ ID NO: 451522 - DNA, 25 bp, Mus musculus
ggcaggagcttttgacagctggtta

SEQ ID NO: 451523 - DNA, 25 bp, Mus musculus
ggcaggagtacctggccagtctact

SEQ ID NO: 451524 - DNA, 25 bp, Mus musculus
ggcaggattttgtcgttctcaaaca

SEQ ID NO: 451525 - DNA, 25 bp, Mus musculus
ggcaggcaagatccccaactggctt

SEQ ID NO: 451526 - DNA, 25 bp, Mus musculus
ggcaggcaccataataattcagaat

SEQ ID NO: 451527 - DNA, 25 bp, Mus musculus
ggcaggcactgagctgcactctggc

SEQ ID NO: 451528 - DNA, 25 bp, Mus musculus
ggcaggcagaaacgtgtcaccatca

SEQ ID NO: 451529 - DNA, 25 bp, Mus musculus
ggcaggcatctgcttgcatctctgt

SEQ ID NO: 451530 - DNA, 25 bp, Mus musculus
ggcaggccagaccttgaaacagttg

SEQ ID NO: 451531 - DNA, 25 bp, Mus musculus
ggcaggccagcaataaaactgtcga

SEQ ID NO: 451532 - DNA, 25 bp, Mus musculus
ggcaggcctgcaagaaacatgagct

SEQ ID NO: 451533 - DNA, 25 bp, Mus musculus
ggcaggccttaagcctgggaagaga

SEQ ID NO: 451534 - DNA, 25 bp, Mus musculus
ggcaggccttgctctgtaggcatca

SEQ ID NO: 451535 - DNA, 25 bp, Mus musculus
ggcaggctataccaacaagatcgtg

SEQ ID NO: 451536 - DNA, 25 bp, Mus musculus
ggcaggctcagcaacataggacgat

SEQ ID NO: 451537 - DNA, 25 bp, Mus musculus
ggcaggctttctaaatggatgtact

SEQ ID NO: 451538 - DNA, 25 bp, Mus musculus
ggcagggcagcggatcctttgccac

SEQ ID NO: 451539 - DNA, 25 bp, Mus musculus
ggcagggccagcatttaccaatcgg

SEQ ID NO: 451540 - DNA, 25 bp, Mus musculus
ggcagggcccgtccattatcaacta

SEQ ID NO: 451541 - DNA, 25 bp, Mus musculus
ggcagggcctatgccagacctgaga

SEQ ID NO: 451542 - DNA, 25 bp, Mus musculus
ggcagggtcatcaaaccgcaggtca

SEQ ID NO: 451543 - DNA, 25 bp, Mus musculus
ggcaggtaagcgtcttgcagcccta

SEQ ID NO: 451544 - DNA, 25 bp, Mus musculus
ggcaggtcatcacggtcattatcac

SEQ ID NO: 451545 - DNA, 25 bp, Mus musculus
ggcaggttaccacaatgcaccgaga

SEQ ID NO: 451546 - DNA, 25 bp, Mus musculus
ggcaggttctcgatacatagctggg

SEQ ID NO: 451547 - DNA, 25 bp, Mus musculus
ggcaggtttgacctcacccactgca

SEQ ID NO: 451548 - DNA, 25 bp, Mus musculus
ggcagtaaaccaatccagagagcag

SEQ ID NO: 451549 - DNA, 25 bp, Mus musculus
ggcagtaacgttgcaccaccttaca

SEQ ID NO: 451550 - DNA, 25 bp, Mus musculus
ggcagtaagcttcaggcacagtcat

SEQ ID NO: 451551 - DNA, 25 bp, Mus musculus
ggcagtaaggattttcgcacaggaa

SEQ ID NO: 451552 - DNA, 25 bp, Mus musculus
ggcagtaattccagtacctatgagg

SEQ ID NO: 451553 - DNA, 25 bp, Mus musculus
ggcagtacacttttgatgaattcac

SEQ ID NO: 451554 - DNA, 25 bp, Mus musculus
ggcagtataaaagagtcccaccagg

SEQ ID NO: 451555 - DNA, 25 bp, Mus musculus
ggcagtattacctccaggctgagca

SEQ ID NO: 451556 - DNA, 25 bp, Mus musculus
ggcagtcctaccctacttggtccgt

SEQ ID NO: 451557 - DNA, 25 bp, Mus musculus
ggcagtcggctctctaagttcaaga

SEQ ID NO: 451558 - DNA, 25 bp, Mus musculus
ggcagtctctatttgaaaggatcga

SEQ ID NO: 451559 - DNA, 25 bp, Mus musculus
ggcagtctgtcttcttacccaaacg

SEQ ID NO: 451560 - DNA, 25 bp, Mus musculus
ggcagtcttcaaaactcaaatgaaa

SEQ ID NO: 451561 - DNA, 25 bp, Mus musculus
ggcagtgatctgtggttccggctta

SEQ ID NO: 451562 - DNA, 25 bp, Mus musculus
ggcagtgcccgattccaagtgtgtc

SEQ ID NO: 451563 - DNA, 25 bp, Mus musculus
ggcagtggccttatcaatgtaacat

SEQ ID NO: 451564 - DNA, 25 bp, Mus musculus
ggcagtggctcatgcgctctaacgt

SEQ ID NO: 451565 - DNA, 25 bp, Mus musculus
ggcagtggtgacagtaggctttcaa

SEQ ID NO: 451566 - DNA, 25 bp, Mus musculus
ggcagtgtaacaaatcaagtctcca

SEQ ID NO: 451567 - DNA, 25 bp, Mus musculus
ggcagtgtcggctcttggcaataaa

SEQ ID NO: 451568 - DNA, 25 bp, Mus musculus
ggcagtgtgagtatgctagatatca

SEQ ID NO: 451569 - DNA, 25 bp, Mus musculus
ggcagtgtgatcttcaccatcagga

SEQ ID NO: 451570 - DNA, 25 bp, Mus musculus
ggcagtgtggccatcctacagaagt

SEQ ID NO: 451571 - DNA, 25 bp, Mus musculus
ggcagtgttcagctccagcggttat

SEQ ID NO: 451572 - DNA, 25 bp, Mus musculus
ggcagttaccccagcttgtcatgtg

SEQ ID NO: 451573 - DNA, 25 bp, Mus musculus
ggcagttacgtcatgctctccatct

SEQ ID NO: 451574 - DNA, 25 bp, Mus musculus
ggcagttattaattttcctcaagaa

SEQ ID NO: 451575 - DNA, 25 bp, Mus musculus
ggcagttcggttctttcccagggat

SEQ ID NO: 451576 - DNA, 25 bp, Mus musculus
ggcagttctacctgggaagtcaccc

SEQ ID NO: 451577 - DNA, 25 bp, Mus musculus
ggcagttgcagctaaattccaaagt

SEQ ID NO: 451578 - DNA, 25 bp, Mus musculus
ggcagtttcaacatacagcaggacc

SEQ ID NO: 451579 - DNA, 25 bp, Mus musculus
ggcagtttcatgatacagcaccaga

SEQ ID NO: 451580 - DNA, 25 bp, Mus musculus
ggcataaccatctaccggctgctgg

SEQ ID NO: 451581 - DNA, 25 bp, Mus musculus
ggcataacttatgcacagggaagtt

SEQ ID NO: 451582 - DNA, 25 bp, Mus musculus
ggcatacagtcgcttctcaatggtg

SEQ ID NO: 451583 - DNA, 25 bp, Mus musculus
ggcatacatcttcccagcactctga

SEQ ID NO: 451584 - DNA, 25 bp, Mus musculus
ggcataccaatacgaacaggaggat

SEQ ID NO: 451585 - DNA, 25 bp, Mus musculus
ggcatactctatatggtcctgagga

SEQ ID NO: 451586 - DNA, 25 bp, Mus musculus
ggcatactgcgagccctgctacatt

SEQ ID NO: 451587 - DNA, 25 bp, Mus musculus
ggcatagagtcagtatgcccacagt

SEQ ID NO: 451588 - DNA, 25 bp, Mus musculus
ggcatagtaccacaaagtaaatcta

SEQ ID NO: 451589 - DNA, 25 bp, Mus musculus
ggcatagtcgcctagaagatcggaa

SEQ ID NO: 451590 - DNA, 25 bp, Mus musculus
ggcatatataactacacacttgttg

SEQ ID NO: 451591 - DNA, 25 bp, Mus musculus
ggcatatcgcctctgttccaggaag

SEQ ID NO: 451592 - DNA, 25 bp, Mus musculus
ggcatatgccaaagagttagaccag

SEQ ID NO: 451593 - DNA, 25 bp, Mus musculus
ggcatatggcaatgtaccccaggct

SEQ ID NO: 451594 - DNA, 25 bp, Mus musculus
ggcatcaacccagagcagatacagg

SEQ ID NO: 451595 - DNA, 25 bp, Mus musculus
ggcatcatcagcaggtcaccataaa

SEQ ID NO: 451596 - DNA, 25 bp, Mus musculus
ggcatcatcataactcgcggaggga

SEQ ID NO: 451597 - DNA, 25 bp, Mus musculus
ggcatcatcggattcacacgctcag

SEQ ID NO: 451598 - DNA, 25 bp, Mus musculus
ggcatccatcaactgccagtacctt

SEQ ID NO: 451599 - DNA, 25 bp, Mus musculus
ggcatccatttatgaccagcatcca

SEQ ID NO: 451600 - DNA, 25 bp, Mus musculus
ggcatccggacaagctgtgccctgc

SEQ ID NO: 451601 - DNA, 25 bp, Mus musculus
ggcatcctcaagtcagaaagtctgg

SEQ ID NO: 451602 - DNA, 25 bp, Mus musculus
ggcatccttgcagtcacctgatgaa

SEQ ID NO: 451603 - DNA, 25 bp, Mus musculus
ggcatcggctttgggctgatctcca

SEQ ID NO: 451604 - DNA, 25 bp, Mus musculus
ggcatcgtccacagactcagagtca

SEQ ID NO: 451605 - DNA, 25 bp, Mus musculus
ggcatctaaagaccaggccataggc

SEQ ID NO: 451606 - DNA, 25 bp, Mus musculus
ggcatctccactttactccagcata

SEQ ID NO: 451607 - DNA, 25 bp, Mus musculus
ggcatctggctctgcaaagctggta

SEQ ID NO: 451608 - DNA, 25 bp, Mus musculus
ggcatctgtctttcaagtgctgaag

SEQ ID NO: 451609 - DNA, 25 bp, Mus musculus
ggcatcttccgggtgggagaaaggg

SEQ ID NO: 451610 - DNA, 25 bp, Mus musculus
ggcatcttggcttctcgcagtgaga

SEQ ID NO: 451611 - DNA, 25 bp, Mus musculus
ggcatctttcatgaccaaaaccgtg

SEQ ID NO: 451612 - DNA, 25 bp, Mus musculus
ggcatctttcgcttcgtgcgcgcat

SEQ ID NO: 451613 - DNA, 25 bp, Mus musculus
ggcatcttttctgagatcctgggag

SEQ ID NO: 451614 - DNA, 25 bp, Mus musculus
ggcatgaacttaacagcggcagaca

SEQ ID NO: 451615 - DNA, 25 bp, Mus musculus
ggcatgaatgctgccatttggatgg

SEQ ID NO: 451616 - DNA, 25 bp, Mus musculus
ggcatgaccggcttcgcttcagaga

SEQ ID NO: 451617 - DNA, 25 bp, Mus musculus
ggcatgaggctcaaaatcctgaatt

SEQ ID NO: 451618 - DNA, 25 bp, Mus musculus
ggcatgatactggttccgagtccga

SEQ ID NO: 451619 - DNA, 25 bp, Mus musculus
ggcatgatgagttcctagtgcttgg

SEQ ID NO: 451620 - DNA, 25 bp, Mus musculus
ggcatgatgctttgtaacatgtcca

SEQ ID NO: 451621 - DNA, 25 bp, Mus musculus
ggcatgcacacatttcgctgtgcct

SEQ ID NO: 451622 - DNA, 25 bp, Mus musculus
ggcatgcaccattctctgagttaga

SEQ ID NO: 451623 - DNA, 25 bp, Mus musculus
ggcatgcactctataatcgagctaa

SEQ ID NO: 451624 - DNA, 25 bp, Mus musculus
ggcatgcatgcgacgtattaccaca

SEQ ID NO: 451625 - DNA, 25 bp, Mus musculus
ggcatgcccaaacgtgaagctgaga

SEQ ID NO: 451626 - DNA, 25 bp, Mus musculus
ggcatgctgcctcgacttggtgacc

SEQ ID NO: 451627 - DNA, 25 bp, Mus musculus
ggcatgcttcagacaggaatcccaa

SEQ ID NO: 451628 - DNA, 25 bp, Mus musculus
ggcatggactagacctcctggtggc

SEQ ID NO: 451629 - DNA, 25 bp, Mus musculus
ggcatgggaccacttcacaaaagca

SEQ ID NO: 451630 - DNA, 25 bp, Mus musculus
ggcatgggccgcattcacaagggca

SEQ ID NO: 451631 - DNA, 25 bp, Mus musculus
ggcatggggatagcccaagccgcca

SEQ ID NO: 451632 - DNA, 25 bp, Mus musculus
ggcatgtaaccttttatggtacagg

SEQ ID NO: 451633 - DNA, 25 bp, Mus musculus
ggcatgtcaacttcacgctcctggg

SEQ ID NO: 451634 - DNA, 25 bp, Mus musculus
ggcatgtcacagatgtgttgatctt

SEQ ID NO: 451635 - DNA, 25 bp, Mus musculus
ggcatgtgctaccaaaaccttccca

SEQ ID NO: 451636 - DNA, 25 bp, Mus musculus
ggcatgttacttggtggattctcca

SEQ ID NO: 451637 - DNA, 25 bp, Mus musculus
ggcatgttcattcccagctcctact

SEQ ID NO: 451638 - DNA, 25 bp, Mus musculus
ggcatgttttcaggccacaccgagt

SEQ ID NO: 451639 - DNA, 25 bp, Mus musculus
ggcattacatccctacagactccga

SEQ ID NO: 451640 - DNA, 25 bp, Mus musculus
ggcattacgaggttgccaggctcct

SEQ ID NO: 451641 - DNA, 25 bp, Mus musculus
ggcattagcactttcatagatgacg

SEQ ID NO: 451642 - DNA, 25 bp, Mus musculus
ggcattaggaacaactggccctgct

SEQ ID NO: 451643 - DNA, 25 bp, Mus musculus
ggcattatctcattcataccggtca

SEQ ID NO: 451644 - DNA, 25 bp, Mus musculus
ggcattatgagctgtaccccaggga

SEQ ID NO: 451645 - DNA, 25 bp, Mus musculus
ggcattcaatgcatctcttcaagac

SEQ ID NO: 451646 - DNA, 25 bp, Mus musculus
ggcattcctcgaaaccaacagggtg

SEQ ID NO: 451647 - DNA, 25 bp, Mus musculus
ggcattcctggcatcataggcggca

SEQ ID NO: 451648 - DNA, 25 bp, Mus musculus
ggcattctccagagcgatccagagg

SEQ ID NO: 451649 - DNA, 25 bp, Mus musculus
ggcattgaatcaagcccttctcgct

SEQ ID NO: 451650 - DNA, 25 bp, Mus musculus
ggcattgacccggtaagtgggcata

SEQ ID NO: 451651 - DNA, 25 bp, Mus musculus
ggcattgagccatcccagggacttg

SEQ ID NO: 451652 - DNA, 25 bp, Mus musculus
ggcattgagctagcctgtctgcaga

SEQ ID NO: 451653 - DNA, 25 bp, Mus musculus
ggcattgagtttctcacttgagata

SEQ ID NO: 451654 - DNA, 25 bp, Mus musculus
ggcattgccttgtggtacacccgag

SEQ ID NO: 451655 - DNA, 25 bp, Mus musculus
ggcattgcgctgagatgaaccccaa

SEQ ID NO: 451656 - DNA, 25 bp, Mus musculus
ggcattggcattcaggtcattcaca

SEQ ID NO: 451657 - DNA, 25 bp, Mus musculus
ggcattggctcacccgacatctggg

SEQ ID NO: 451658 - DNA, 25 bp, Mus musculus
ggcattgggcccagaacttcatgga

SEQ ID NO: 451659 - DNA, 25 bp, Mus musculus
ggcattgggtgccagggcttggcca

SEQ ID NO: 451660 - DNA, 25 bp, Mus musculus
ggcattggttgaaagggctttccgt

SEQ ID NO: 451661 - DNA, 25 bp, Mus musculus
ggcatttactgctttccttggaact

SEQ ID NO: 451662 - DNA, 25 bp, Mus musculus
ggcatttgtcattcctacggcggca

SEQ ID NO: 451663 - DNA, 25 bp, Mus musculus
ggcatttgtccagctataaaagagg

SEQ ID NO: 451664 - DNA, 25 bp, Mus musculus
ggcattttgaaaacaaggttccaga

SEQ ID NO: 451665 - DNA, 25 bp, Mus musculus
ggccaaaaggcggtactcaactcac

SEQ ID NO: 451666 - DNA, 25 bp, Mus musculus
ggccaaacattcaatcacatgagtt

SEQ ID NO: 451667 - DNA, 25 bp, Mus musculus
ggccaaactcagtcctgtataccat

SEQ ID NO: 451668 - DNA, 25 bp, Mus musculus
ggccaaactctgcccttcctgaagt

SEQ ID NO: 451669 - DNA, 25 bp, Mus musculus
ggccaaagtcaataaccccaagtag

SEQ ID NO: 451670 - DNA, 25 bp, Mus musculus
ggccaaagtcacactgaacatctgt

SEQ ID NO: 451671 - DNA, 25 bp, Mus musculus
ggccaaatagccagcctttccctta

SEQ ID NO: 451672 - DNA, 25 bp, Mus musculus
ggccaaattgggatcctaacctaag

SEQ ID NO: 451673 - DNA, 25 bp, Mus musculus
ggccaacaaaagcaaggacctctag

SEQ ID NO: 451674 - DNA, 25 bp, Mus musculus
ggccaacaagccaagagactcaagt

SEQ ID NO: 451675 - DNA, 25 bp, Mus musculus
ggccaacaatagaaggttcaactct

SEQ ID NO: 451676 - DNA, 25 bp, Mus musculus
ggccaacactgataccaaaggtcgg

SEQ ID NO: 451677 - DNA, 25 bp, Mus musculus
ggccaacaggcaagcttctcaggag

SEQ ID NO: 451678 - DNA, 25 bp, Mus musculus
ggccaacatcctaaagaccagtgaa

SEQ ID NO: 451679 - DNA, 25 bp, Mus musculus
ggccaaccaggatgaacaactctag

SEQ ID NO: 451680 - DNA, 25 bp, Mus musculus
ggccaacgtgatgaaaaccctgcag

SEQ ID NO: 451681 - DNA, 25 bp, Mus musculus
ggccaagaactagtcaccacggatg

SEQ ID NO: 451682 - DNA, 25 bp, Mus musculus
ggccaagagctctatatccaggaaa

SEQ ID NO: 451683 - DNA, 25 bp, Mus musculus
ggccaagaggagcttctccagccag

SEQ ID NO: 451684 - DNA, 25 bp, Mus musculus
ggccaagagtttaaccacgggctgg

SEQ ID NO: 451685 - DNA, 25 bp, Mus musculus
ggccaaggaaacatcaagaccctcg

SEQ ID NO: 451686 - DNA, 25 bp, Mus musculus
ggccaaggagcgcaaagtaaacaag

SEQ ID NO: 451687 - DNA, 25 bp, Mus musculus
ggccaaggcagtgagaaccaagttt

SEQ ID NO: 451688 - DNA, 25 bp, Mus musculus
ggccaagggtcagcaattcaagtca

SEQ ID NO: 451689 - DNA, 25 bp, Mus musculus
ggccaatcagggatgtccgcagtaa

SEQ ID NO: 451690 - DNA, 25 bp, Mus musculus
ggccaatcctgggtgccagatctag

SEQ ID NO: 451691 - DNA, 25 bp, Mus musculus
ggccaatcgtgtctaaccgctggaa

SEQ ID NO: 451692 - DNA, 25 bp, Mus musculus
ggccaattcgttgccttgctcagaa

SEQ ID NO: 451693 - DNA, 25 bp, Mus musculus
ggccaattggtaagcttcaggttca

SEQ ID NO: 451694 - DNA, 25 bp, Mus musculus
ggccacaagagggatattgacgtct

SEQ ID NO: 451695 - DNA, 25 bp, Mus musculus
ggccacaagatgaagcaaaggaaca

SEQ ID NO: 451696 - DNA, 25 bp, Mus musculus
ggccacacggaacatgaactcagga

SEQ ID NO: 451697 - DNA, 25 bp, Mus musculus
ggccacacgttcatcaccattaaca

SEQ ID NO: 451698 - DNA, 25 bp, Mus musculus
ggccacagatcaaggagttgactga

SEQ ID NO: 451699 - DNA, 25 bp, Mus musculus
ggccacagcaccagattcagtttga

SEQ ID NO: 451700 - DNA, 25 bp, Mus musculus
ggccacaggcctaagttccgttcca

SEQ ID NO: 451701 - DNA, 25 bp, Mus musculus
ggccacaggtccaactctaacttga

SEQ ID NO: 451702 - DNA, 25 bp, Mus musculus
ggccaccaccacaagtaacgacaaa

SEQ ID NO: 451703 - DNA, 25 bp, Mus musculus
ggccaccatatctaaatgagacaag

SEQ ID NO: 451704 - DNA, 25 bp, Mus musculus
ggccaccatctgataaccacggcag

SEQ ID NO: 451705 - DNA, 25 bp, Mus musculus
ggccacccagctccttaaaagtttg

SEQ ID NO: 451706 - DNA, 25 bp, Mus musculus
ggccaccctgtgagatgccaacgag

SEQ ID NO: 451707 - DNA, 25 bp, Mus musculus
ggccaccgttatgcaatgttcagcg

SEQ ID NO: 451708 - DNA, 25 bp, Mus musculus
ggccaccttggctaacctactgcat

SEQ ID NO: 451709 - DNA, 25 bp, Mus musculus
ggccacctttatcccatatagacga

SEQ ID NO: 451710 - DNA, 25 bp, Mus musculus
ggccacgggcacgttctcatctgtg

SEQ ID NO: 451711 - DNA, 25 bp, Mus musculus
ggccacgtcctacacggaagatgat

SEQ ID NO: 451712 - DNA, 25 bp, Mus musculus
ggccacgtgagaagcaatggagact

SEQ ID NO: 451713 - DNA, 25 bp, Mus musculus
ggccactgcaaatgtcttccgagga

SEQ ID NO: 451714 - DNA, 25 bp, Mus musculus
ggccactgcatgaaggtaccctggt

SEQ ID NO: 451715 - DNA, 25 bp, Mus musculus
ggccactgtcgaagacctctgagga

SEQ ID NO: 451716 - DNA, 25 bp, Mus musculus
ggccactgttaagtagcctgaagaa

SEQ ID NO: 451717 - DNA, 25 bp, Mus musculus
ggccactttgcttccattgatgcgg

SEQ ID NO: 451718 - DNA, 25 bp, Mus musculus
ggccagaagcactgttataaacagt

SEQ ID NO: 451719 - DNA, 25 bp, Mus musculus
ggccagaagccctcagactagtatt

SEQ ID NO: 451720 - DNA, 25 bp, Mus musculus
ggccagaagcttacggattccgcag

SEQ ID NO: 451721 - DNA, 25 bp, Mus musculus
ggccagaattacagctaaggagact

SEQ ID NO: 451722 - DNA, 25 bp, Mus musculus
ggccagacaagagcactgaatctcc

SEQ ID NO: 451723 - DNA, 25 bp, Mus musculus
ggccagaccaacgacaggtgcttcg

SEQ ID NO: 451724 - DNA, 25 bp, Mus musculus
ggccagacccggaggtgctgtccct

SEQ ID NO: 451725 - DNA, 25 bp, Mus musculus
ggccagacctctgagtacacggtgt

SEQ ID NO: 451726 - DNA, 25 bp, Mus musculus
ggccagagactgaggaaagaaaccc

SEQ ID NO: 451727 - DNA, 25 bp, Mus musculus
ggccagagactgcatggaaatcgaa

SEQ ID NO: 451728 - DNA, 25 bp, Mus musculus
ggccagagagttcaccacaagtaaa

SEQ ID NO: 451729 - DNA, 25 bp, Mus musculus
ggccagagcatgtcccagatcttta

SEQ ID NO: 451730 - DNA, 25 bp, Mus musculus
ggccagagcctgatgttacaaaagt

SEQ ID NO: 451731 - DNA, 25 bp, Mus musculus
ggccagagctgatctcctcttcggg

SEQ ID NO: 451732 - DNA, 25 bp, Mus musculus
ggccagagtcttaggctcttcaaga

SEQ ID NO: 451733 - DNA, 25 bp, Mus musculus
ggccagagtggaaagcagtgtccca

SEQ ID NO: 451734 - DNA, 25 bp, Mus musculus
ggccagatactactccgctctgcga

SEQ ID NO: 451735 - DNA, 25 bp, Mus musculus
ggccagatctgtggatacctcaaag

SEQ ID NO: 451736 - DNA, 25 bp, Mus musculus
ggccagcaagcagtccaaactacag

SEQ ID NO: 451737 - DNA, 25 bp, Mus musculus
ggccagcacactgagccatctgtaa

SEQ ID NO: 451738 - DNA, 25 bp, Mus musculus
ggccagcatacccaggccgctttaa

SEQ ID NO: 451739 - DNA, 25 bp, Mus musculus
ggccagcatgtcttctgcacatttt

SEQ ID NO: 451740 - DNA, 25 bp, Mus musculus
ggccagcctgggataaattgcagaa

SEQ ID NO: 451741 - DNA, 25 bp, Mus musculus
ggccagcctttgtccactacgataa

SEQ ID NO: 451742 - DNA, 25 bp, Mus musculus
ggccagcgcaggaacactagtgtct

SEQ ID NO: 451743 - DNA, 25 bp, Mus musculus
ggccagcgccaaggacaacattaat

SEQ ID NO: 451744 - DNA, 25 bp, Mus musculus
ggccagctcctgcaagatgaatccg

SEQ ID NO: 451745 - DNA, 25 bp, Mus musculus
ggccaggacgccaataccaagaaat

SEQ ID NO: 451746 - DNA, 25 bp, Mus musculus
ggccaggatcaagaccagcactgtc

SEQ ID NO: 451747 - DNA, 25 bp, Mus musculus
ggccaggatcctgcatacccatgta

SEQ ID NO: 451748 - DNA, 25 bp, Mus musculus
ggccaggcagattccaaccatgaga

SEQ ID NO: 451749 - DNA, 25 bp, Mus musculus
ggccaggctagtccagaaccgatta

SEQ ID NO: 451750 - DNA, 25 bp, Mus musculus
ggccaggctgttttatgtcacttga

SEQ ID NO: 451751 - DNA, 25 bp, Mus musculus
ggccagggacctagagtacatttat

SEQ ID NO: 451752 - DNA, 25 bp, Mus musculus
ggccagtaccttggagaatacttta

SEQ ID NO: 451753 - DNA, 25 bp, Mus musculus
ggccagtctggctcccttccaaaat

SEQ ID NO: 451754 - DNA, 25 bp, Mus musculus
ggccagtgcttaaacatacccgaat

SEQ ID NO: 451755 - DNA, 25 bp, Mus musculus
ggccagtggtgaaagacctgccaac

SEQ ID NO: 451756 - DNA, 25 bp, Mus musculus
ggccagtttactctcacctctgtcc

SEQ ID NO: 451757 - DNA, 25 bp, Mus musculus
ggccatacatgggagagcagagatc

SEQ ID NO: 451758 - DNA, 25 bp, Mus musculus
ggccatagtatcctacaatctcttc

SEQ ID NO: 451759 - DNA, 25 bp, Mus musculus
ggccatcaagatccagttcacatcg

SEQ ID NO: 451760 - DNA, 25 bp, Mus musculus
ggccatcagaagtatccttattcag

SEQ ID NO: 451761 - DNA, 25 bp, Mus musculus
ggccatcagattggtgaaaaaccca

SEQ ID NO: 451762 - DNA, 25 bp, Mus musculus
ggccatcatgcgcaccatgtggttt

SEQ ID NO: 451763 - DNA, 25 bp, Mus musculus
ggccatccgcaacacggaatctcag

SEQ ID NO: 451764 - DNA, 25 bp, Mus musculus
ggccatcgtcctgttcccttttggg

SEQ ID NO: 451765 - DNA, 25 bp, Mus musculus
ggccatctgctgtgtgggtttccct

SEQ ID NO: 451766 - DNA, 25 bp, Mus musculus
ggccatgctatagttcagtacaaag

SEQ ID NO: 451767 - DNA, 25 bp, Mus musculus
ggccatgctcactccgagaccttaa

SEQ ID NO: 451768 - DNA, 25 bp, Mus musculus
ggccatggacacacctagaaggagc

SEQ ID NO: 451769 - DNA, 25 bp, Mus musculus
ggccatggccaacgtctctaagaaa

SEQ ID NO: 451770 - DNA, 25 bp, Mus musculus
ggccatggccagaaggagccaagaa

SEQ ID NO: 451771 - DNA, 25 bp, Mus musculus
ggccatgggaacttgtcagaagtca

SEQ ID NO: 451772 - DNA, 25 bp, Mus musculus
ggccatgtgcagcaagagccaagca

SEQ ID NO: 451773 - DNA, 25 bp, Mus musculus
ggccattctgcatagagtccaggca

SEQ ID NO: 451774 - DNA, 25 bp, Mus musculus
ggccattggttagtatcaggaaaag

SEQ ID NO: 451775 - DNA, 25 bp, Mus musculus
ggccatttaggaggaatcagtcact

SEQ ID NO: 451776 - DNA, 25 bp, Mus musculus
ggccatttggtactagacagcagac

SEQ ID NO: 451777 - DNA, 25 bp, Mus musculus
ggcccaaattgcattgtagtagtca

SEQ ID NO: 451778 - DNA, 25 bp, Mus musculus
ggcccaacagggacaggagacttga

SEQ ID NO: 451779 - DNA, 25 bp, Mus musculus
ggcccaacgcataggctgatctgtt

SEQ ID NO: 451780 - DNA, 25 bp, Mus musculus
ggcccaacggctgcagaagaacttt

SEQ ID NO: 451781 - DNA, 25 bp, Mus musculus
ggcccaactgtaggaggaactctca

SEQ ID NO: 451782 - DNA, 25 bp, Mus musculus
ggcccaagaacatcacctgtgtggt

SEQ ID NO: 451783 - DNA, 25 bp, Mus musculus
ggcccaagcaccagggcagctttat

SEQ ID NO: 451784 - DNA, 25 bp, Mus musculus
ggcccaagggtttcctgatgctcga

SEQ ID NO: 451785 - DNA, 25 bp, Mus musculus
ggcccaatcacagtgagttctcatg

SEQ ID NO: 451786 - DNA, 25 bp, Mus musculus
ggcccacagtatcctggaggcatga

SEQ ID NO: 451787 - DNA, 25 bp, Mus musculus
ggcccacatcagtctactaattaag

SEQ ID NO: 451788 - DNA, 25 bp, Mus musculus
ggcccaccaggaaagtacacagatg

SEQ ID NO: 451789 - DNA, 25 bp, Mus musculus
ggcccacgctttctggaaaaccagg

SEQ ID NO: 451790 - DNA, 25 bp, Mus musculus
ggcccacgtacacacccatggaagt

SEQ ID NO: 451791 - DNA, 25 bp, Mus musculus
ggcccactagccttttatttgtcag

SEQ ID NO: 451792 - DNA, 25 bp, Mus musculus
ggcccacttgtgatcttcccattag

SEQ ID NO: 451793 - DNA, 25 bp, Mus musculus
ggcccagacaagatcctaatgaggt

SEQ ID NO: 451794 - DNA, 25 bp, Mus musculus
ggcccagagagaccgtaaagttgct

SEQ ID NO: 451795 - DNA, 25 bp, Mus musculus
ggcccagcgagttgcaggaacatat

SEQ ID NO: 451796 - DNA, 25 bp, Mus musculus
ggcccaggaagagacaacagctatc

SEQ ID NO: 451797 - DNA, 25 bp, Mus musculus
ggcccaggcagtattcaacaataca

SEQ ID NO: 451798 - DNA, 25 bp, Mus musculus
ggcccaggccacttatttccagcag

SEQ ID NO: 451799 - DNA, 25 bp, Mus musculus
ggcccaggcgtggacttagttctca

SEQ ID NO: 451800 - DNA, 25 bp, Mus musculus
ggcccaggcgtggagacttcattca

SEQ ID NO: 451801 - DNA, 25 bp, Mus musculus
ggcccaggctaatgaacagaggtat

SEQ ID NO: 451802 - DNA, 25 bp, Mus musculus
ggcccagtacctctgcaatgttgaa

SEQ ID NO: 451803 - DNA, 25 bp, Mus musculus
ggcccagtgcgacccttgatctcgt

SEQ ID NO: 451804 - DNA, 25 bp, Mus musculus
ggcccagttcttccgtgttgctcag

SEQ ID NO: 451805 - DNA, 25 bp, Mus musculus
ggcccatatatgcattcaaaccgtg

SEQ ID NO: 451806 - DNA, 25 bp, Mus musculus
ggcccatgcgacactgaaggagcgt

SEQ ID NO: 451807 - DNA, 25 bp, Mus musculus
ggcccatgggctatttcgagctgca

SEQ ID NO: 451808 - DNA, 25 bp, Mus musculus
ggcccattgagagcaacaagttcga

SEQ ID NO: 451809 - DNA, 25 bp, Mus musculus
ggccccaagatagggtaatatgttt

SEQ ID NO: 451810 - DNA, 25 bp, Mus musculus
ggccccactgtggttctgtctacgt

SEQ ID NO: 451811 - DNA, 25 bp, Mus musculus
ggccccagagcccaggagtatgaat

SEQ ID NO: 451812 - DNA, 25 bp, Mus musculus
ggccccagcctgagatatttcttag

SEQ ID NO: 451813 - DNA, 25 bp, Mus musculus
ggccccagtcctccagagcagttta

SEQ ID NO: 451814 - DNA, 25 bp, Mus musculus
ggccccatcaggatttcaggagaga

SEQ ID NO: 451815 - DNA, 25 bp, Mus musculus
ggccccattgctactggaattcatg

SEQ ID NO: 451816 - DNA, 25 bp, Mus musculus
ggccccgagtcatagtctcgtcttt

SEQ ID NO: 451817 - DNA, 25 bp, Mus musculus
ggccccgcgctatggagttcctttg

SEQ ID NO: 451818 - DNA, 25 bp, Mus musculus
ggccccggctgcacctcaggatgtt

SEQ ID NO: 451819 - DNA, 25 bp, Mus musculus
ggccccggtagatcgcttcttcacg

SEQ ID NO: 451820 - DNA, 25 bp, Mus musculus
ggccccgtcatcgtcggctggagat

SEQ ID NO: 451821 - DNA, 25 bp, Mus musculus
ggcccctctccttgccagtgtgctg

SEQ ID NO: 451822 - DNA, 25 bp, Mus musculus
ggcccctctgtttggtgatttctga

SEQ ID NO: 451823 - DNA, 25 bp, Mus musculus
ggcccctggagacgataaaatgaaa

SEQ ID NO: 451824 - DNA, 25 bp, Mus musculus
ggcccctgtaggtcagagacattat

SEQ ID NO: 451825 - DNA, 25 bp, Mus musculus
ggccccttccgggactgacattaag

SEQ ID NO: 451826 - DNA, 25 bp, Mus musculus
ggccccttgggacagatgctttgaa

SEQ ID NO: 451827 - DNA, 25 bp, Mus musculus
ggcccctttatacccggcagcatgt

SEQ ID NO: 451828 - DNA, 25 bp, Mus musculus
ggcccgacctgaatccttctaagga

SEQ ID NO: 451829 - DNA, 25 bp, Mus musculus
ggcccgagccctcggatcgagatca

SEQ ID NO: 451830 - DNA, 25 bp, Mus musculus
ggcccgcagcgaccatttaactgca

SEQ ID NO: 451831 - DNA, 25 bp, Mus musculus
ggcccgcatcccagcaaattttgta

SEQ ID NO: 451832 - DNA, 25 bp, Mus musculus
ggcccggatgacctgtctcctacgg

SEQ ID NO: 451833 - DNA, 25 bp, Mus musculus
ggcccggcctgcttgcatcctggct

SEQ ID NO: 451834 - DNA, 25 bp, Mus musculus
ggcccgggccattcgctttagacag

SEQ ID NO: 451835 - DNA, 25 bp, Mus musculus
ggcccgtatcgtactcaccgcaggg

SEQ ID NO: 451836 - DNA, 25 bp, Mus musculus
ggcccgttgcatctccacttctaag

SEQ ID NO: 451837 - DNA, 25 bp, Mus musculus
ggccctaaattataccagcactacc

SEQ ID NO: 451838 - DNA, 25 bp, Mus musculus
ggccctatcagcagaagagcgaatt

SEQ ID NO: 451839 - DNA, 25 bp, Mus musculus
ggccctcagaaacctgcagctgtca

SEQ ID NO: 451840 - DNA, 25 bp, Mus musculus
ggccctcagtatccagtgctgccag

SEQ ID NO: 451841 - DNA, 25 bp, Mus musculus
ggccctcccatgaataatcctgttt

SEQ ID NO: 451842 - DNA, 25 bp, Mus musculus
ggccctccccaggtgacagtgggaa

SEQ ID NO: 451843 - DNA, 25 bp, Mus musculus
ggccctctccgctgtctgtatccag

SEQ ID NO: 451844 - DNA, 25 bp, Mus musculus
ggccctctggaactggacctgacag

SEQ ID NO: 451845 - DNA, 25 bp, Mus musculus
ggccctctggtctcaactgtcatgg

SEQ ID NO: 451846 - DNA, 25 bp, Mus musculus
ggccctgaaatgagctcagcaatat

SEQ ID NO: 451847 - DNA, 25 bp, Mus musculus
ggccctgaactgaatgactctgctt

SEQ ID NO: 451848 - DNA, 25 bp, Mus musculus
ggccctgactgccaagcttcaactg

SEQ ID NO: 451849 - DNA, 25 bp, Mus musculus
ggccctgcacccagagagaaggaag

SEQ ID NO: 451850 - DNA, 25 bp, Mus musculus
ggccctgctgcgtgagacccagaag

SEQ ID NO: 451851 - DNA, 25 bp, Mus musculus
ggccctggccagaagtagtcctact

SEQ ID NO: 451852 - DNA, 25 bp, Mus musculus
ggccctggcggtcagcaaattcctg

SEQ ID NO: 451853 - DNA, 25 bp, Mus musculus
ggccctggctactgggaccaatact

SEQ ID NO: 451854 - DNA, 25 bp, Mus musculus
ggccctggtccgttaagaactgaga

SEQ ID NO: 451855 - DNA, 25 bp, Mus musculus
ggccctgtcctctgaaatgctgaaa

SEQ ID NO: 451856 - DNA, 25 bp, Mus musculus
ggccctgtctcatatgtatctcaag

SEQ ID NO: 451857 - DNA, 25 bp, Mus musculus
ggccctgtgctgctagacaacgtag

SEQ ID NO: 451858 - DNA, 25 bp, Mus musculus
ggccctgtgtccctaacccttgtgt

SEQ ID NO: 451859 - DNA, 25 bp, Mus musculus
ggccctgttagtgctataccctgga

SEQ ID NO: 451860 - DNA, 25 bp, Mus musculus
ggccctgttgcagcccatgggtgaa

SEQ ID NO: 451861 - DNA, 25 bp, Mus musculus
ggcccttacctgaagctctgctgtg

SEQ ID NO: 451862 - DNA, 25 bp, Mus musculus
ggcccttaggccctgtgactgattg

SEQ ID NO: 451863 - DNA, 25 bp, Mus musculus
ggcccttcggtttgctcagcgtacg

SEQ ID NO: 451864 - DNA, 25 bp, Mus musculus
ggcccttgccccttaatagtgaagg

SEQ ID NO: 451865 - DNA, 25 bp, Mus musculus
ggcccttgctagttcccattgcttg

SEQ ID NO: 451866 - DNA, 25 bp, Mus musculus
ggcccttggaagtgtagctgctatt

SEQ ID NO: 451867 - DNA, 25 bp, Mus musculus
ggcccttggcactgcaaccctgagg

SEQ ID NO: 451868 - DNA, 25 bp, Mus musculus
ggcccttggccttctctaaattacg

SEQ ID NO: 451869 - DNA, 25 bp, Mus musculus
ggccctttgacatccgcacggagtg

SEQ ID NO: 451870 - DNA, 25 bp, Mus musculus
ggcccttttcataccaccttcagtg

SEQ ID NO: 451871 - DNA, 25 bp, Mus musculus
ggccgaaggtacaccgagtaccgct

SEQ ID NO: 451872 - DNA, 25 bp, Mus musculus
ggccgacctgcatcctcttaaggaa

SEQ ID NO: 451873 - DNA, 25 bp, Mus musculus
ggccgactttgatgaaccccagaga

SEQ ID NO: 451874 - DNA, 25 bp, Mus musculus
ggccgaggaatagaaataggtctga

SEQ ID NO: 451875 - DNA, 25 bp, Mus musculus
ggccgagtcagcagatgcttcgtat

SEQ ID NO: 451876 - DNA, 25 bp, Mus musculus
ggccgatactccagcaacgaattca

SEQ ID NO: 451877 - DNA, 25 bp, Mus musculus
ggccgatcgaagagggcatcttagt

SEQ ID NO: 451878 - DNA, 25 bp, Mus musculus
ggccgcaaaaaacgcattccctata

SEQ ID NO: 451879 - DNA, 25 bp, Mus musculus
ggccgcaagcatgggatgccatcaa

SEQ ID NO: 451880 - DNA, 25 bp, Mus musculus
ggccgcaagctttgctcacatctct

SEQ ID NO: 451881 - DNA, 25 bp, Mus musculus
ggccgcaagttcatgtttcccaagg

SEQ ID NO: 451882 - DNA, 25 bp, Mus musculus
ggccgcaccagtaagcctttgaact

SEQ ID NO: 451883 - DNA, 25 bp, Mus musculus
ggccgcacgcgagttcattctgaag

SEQ ID NO: 451884 - DNA, 25 bp, Mus musculus
ggccgcactacaacccgatggaggt

SEQ ID NO: 451885 - DNA, 25 bp, Mus musculus
ggccgccatttctactgcagaggaa

SEQ ID NO: 451886 - DNA, 25 bp, Mus musculus
ggccgcccactccaagagagggttt

SEQ ID NO: 451887 - DNA, 25 bp, Mus musculus
ggccgcccgccatattggttcttct

SEQ ID NO: 451888 - DNA, 25 bp, Mus musculus
ggccgccctcctatgaacctttatt

SEQ ID NO: 451889 - DNA, 25 bp, Mus musculus
ggccgcctcccctttgcttggcttg

SEQ ID NO: 451890 - DNA, 25 bp, Mus musculus
ggccgcctcttttgggaacccatga

SEQ ID NO: 451891 - DNA, 25 bp, Mus musculus
ggccgcctgcgaaaaaagtgcccgt

SEQ ID NO: 451892 - DNA, 25 bp, Mus musculus
ggccgcgagatctccaggtccttct

SEQ ID NO: 451893 - DNA, 25 bp, Mus musculus
ggccgcgccaggtattcctgcagaa

SEQ ID NO: 451894 - DNA, 25 bp, Mus musculus
ggccgcgggctttatacaagttaca

SEQ ID NO: 451895 - DNA, 25 bp, Mus musculus
ggccgctacgtccacaaagatgaga

SEQ ID NO: 451896 - DNA, 25 bp, Mus musculus
ggccgctagcccagagcacattgat

SEQ ID NO: 451897 - DNA, 25 bp, Mus musculus
ggccgctgccagtccagattacaag

SEQ ID NO: 451898 - DNA, 25 bp, Mus musculus
ggccgcttgcttggactgtcttgca

SEQ ID NO: 451899 - DNA, 25 bp, Mus musculus
ggccggaaaacgctgggattcattc

SEQ ID NO: 451900 - DNA, 25 bp, Mus musculus
ggccggaactcaagatggctgcgtt

SEQ ID NO: 451901 - DNA, 25 bp, Mus musculus
ggccggcatagcatacaaggtcaat

SEQ ID NO: 451902 - DNA, 25 bp, Mus musculus
ggccggcctctgataaacctgtgga

SEQ ID NO: 451903 - DNA, 25 bp, Mus musculus
ggccggctagatctcttctgcctct

SEQ ID NO: 451904 - DNA, 25 bp, Mus musculus
ggccgggagacgtgttacgctctca

SEQ ID NO: 451905 - DNA, 25 bp, Mus musculus
ggccgggcaaagtctccggcacgtt

SEQ ID NO: 451906 - DNA, 25 bp, Mus musculus
ggccggtgtacaaacagcgtggtca

SEQ ID NO: 451907 - DNA, 25 bp, Mus musculus
ggccggttaccagtctctcaagaag

SEQ ID NO: 451908 - DNA, 25 bp, Mus musculus
ggccgtccctgagtcgcactaaatt

SEQ ID NO: 451909 - DNA, 25 bp, Mus musculus
ggccgtccttccttggaagcatcca

SEQ ID NO: 451910 - DNA, 25 bp, Mus musculus
ggccgtctctccgtttgcagaaatt

SEQ ID NO: 451911 - DNA, 25 bp, Mus musculus
ggccgtgagaccagttgttagcatt

SEQ ID NO: 451912 - DNA, 25 bp, Mus musculus
ggccgtggccatcaagacgctgaaa

SEQ ID NO: 451913 - DNA, 25 bp, Mus musculus
ggccgtggcttagtcctgcacctta

SEQ ID NO: 451914 - DNA, 25 bp, Mus musculus
ggccgtggtccaaaacactattcag

SEQ ID NO: 451915 - DNA, 25 bp, Mus musculus
ggccgtgtgaaagcggcggccgtgg

SEQ ID NO: 451916 - DNA, 25 bp, Mus musculus
ggcctaaggcactctcagcttttga

SEQ ID NO: 451917 - DNA, 25 bp, Mus musculus
ggcctaagtcacagccaaggagaac

SEQ ID NO: 451918 - DNA, 25 bp, Mus musculus
ggcctaagttggttccagagtcaca

SEQ ID NO: 451919 - DNA, 25 bp, Mus musculus
ggcctaatccctcccaactggtgga

SEQ ID NO: 451920 - DNA, 25 bp, Mus musculus
ggcctaatgcatggtcccctggtga

SEQ ID NO: 451921 - DNA, 25 bp, Mus musculus
ggcctacctgacagcctcggtgtgg

SEQ ID NO: 451922 - DNA, 25 bp, Mus musculus
ggcctagacgcctctggagaacagc

SEQ ID NO: 451923 - DNA, 25 bp, Mus musculus
ggcctagcctcctttatttcataca

SEQ ID NO: 451924 - DNA, 25 bp, Mus musculus
ggcctagtggtaccgctgatcctga

SEQ ID NO: 451925 - DNA, 25 bp, Mus musculus
ggcctataagatcagatacccggag

SEQ ID NO: 451926 - DNA, 25 bp, Mus musculus
ggcctattagtaccaaagaaggact

SEQ ID NO: 451927 - DNA, 25 bp, Mus musculus
ggcctcaagggcattctagaaatcc

SEQ ID NO: 451928 - DNA, 25 bp, Mus musculus
ggcctcaccggtgctgaatagagag

SEQ ID NO: 451929 - DNA, 25 bp, Mus musculus
ggcctcagtgaaacccaagcacttc

SEQ ID NO: 451930 - DNA, 25 bp, Mus musculus
ggcctccagccaatgtgaacctaat

SEQ ID NO: 451931 - DNA, 25 bp, Mus musculus
ggcctccaggcagtgtatgacccgt

SEQ ID NO: 451932 - DNA, 25 bp, Mus musculus
ggcctccctggagtcctaactatga

SEQ ID NO: 451933 - DNA, 25 bp, Mus musculus
ggcctccctggtcagacgcctggta

SEQ ID NO: 451934 - DNA, 25 bp, Mus musculus
ggcctcctcatgtatgcaatctatt

SEQ ID NO: 451935 - DNA, 25 bp, Mus musculus
ggcctcctctgaccgattttgagaa

SEQ ID NO: 451936 - DNA, 25 bp, Mus musculus
ggcctcctgcaacgttctgataaga

SEQ ID NO: 451937 - DNA, 25 bp, Mus musculus
ggcctcctggatctaccttgtgtga

SEQ ID NO: 451938 - DNA, 25 bp, Mus musculus
ggcctcctgttcctatgaccggaaa

SEQ ID NO: 451939 - DNA, 25 bp, Mus musculus
ggcctcgctcctggtggacggcata

SEQ ID NO: 451940 - DNA, 25 bp, Mus musculus
ggcctctactggtctgcaaatcttg

SEQ ID NO: 451941 - DNA, 25 bp, Mus musculus
ggcctctactgtattctgtgtccca

SEQ ID NO: 451942 - DNA, 25 bp, Mus musculus
ggcctctcggtagctggaagcacat

SEQ ID NO: 451943 - DNA, 25 bp, Mus musculus
ggcctctgaagatgtcctttctgtc

SEQ ID NO: 451944 - DNA, 25 bp, Mus musculus
ggcctctgctgagtgaacccctggt

SEQ ID NO: 451945 - DNA, 25 bp, Mus musculus
ggcctctggtgctcttctcttcaga

SEQ ID NO: 451946 - DNA, 25 bp, Mus musculus
ggcctctgtgcccacaaggtcagat

SEQ ID NO: 451947 - DNA, 25 bp, Mus musculus
ggcctctgttactgaagcacttgca

SEQ ID NO: 451948 - DNA, 25 bp, Mus musculus
ggcctctttgatggcaactgctgtc

SEQ ID NO: 451949 - DNA, 25 bp, Mus musculus
ggcctgaagctcctccttcgtgtag

SEQ ID NO: 451950 - DNA, 25 bp, Mus musculus
ggcctgaagctgtcaccctagatgt

SEQ ID NO: 451951 - DNA, 25 bp, Mus musculus
ggcctgacaagtacttcaccctggg

SEQ ID NO: 451952 - DNA, 25 bp, Mus musculus
ggcctgacggtgagaatatttagct

SEQ ID NO: 451953 - DNA, 25 bp, Mus musculus
ggcctgagggtagagctcaaccgta

SEQ ID NO: 451954 - DNA, 25 bp, Mus musculus
ggcctgatgctgacttaccttggaa

SEQ ID NO: 451955 - DNA, 25 bp, Mus musculus
ggcctgatgggagacactgtcgcaa

SEQ ID NO: 451956 - DNA, 25 bp, Mus musculus
ggcctgcacctgtctatgtcctgag

SEQ ID NO: 451957 - DNA, 25 bp, Mus musculus
ggcctgccaaaaccacagatgtgtg

SEQ ID NO: 451958 - DNA, 25 bp, Mus musculus
ggcctgccatcaactactcggtgta

SEQ ID NO: 451959 - DNA, 25 bp, Mus musculus
ggcctgcctcttatttgaccatctg

SEQ ID NO: 451960 - DNA, 25 bp, Mus musculus
ggcctgcctggtctcactgttctaa

SEQ ID NO: 451961 - DNA, 25 bp, Mus musculus
ggcctgcggttcgaaactcagctaa

SEQ ID NO: 451962 - DNA, 25 bp, Mus musculus
ggcctgcgtctctggaactacaata

SEQ ID NO: 451963 - DNA, 25 bp, Mus musculus
ggcctgctacttggttacttggaaa

SEQ ID NO: 451964 - DNA, 25 bp, Mus musculus
ggcctgctcaagtctctgcgcttga

SEQ ID NO: 451965 - DNA, 25 bp, Mus musculus
ggcctgctgcatctggatattaaga

SEQ ID NO: 451966 - DNA, 25 bp, Mus musculus
ggcctgcttttgatggagacacacg

SEQ ID NO: 451967 - DNA, 25 bp, Mus musculus
ggcctggacgatcaccttagtaaat

SEQ ID NO: 451968 - DNA, 25 bp, Mus musculus
ggcctggagcaactgcaacttataa

SEQ ID NO: 451969 - DNA, 25 bp, Mus musculus
ggcctggcatactggaagcatttaa

SEQ ID NO: 451970 - DNA, 25 bp, Mus musculus
ggcctggccacgaatactactacat

SEQ ID NO: 451971 - DNA, 25 bp, Mus musculus
ggcctggcccaatatgaagatccga

SEQ ID NO: 451972 - DNA, 25 bp, Mus musculus
ggcctggcgtgtatctgaatatctc

SEQ ID NO: 451973 - DNA, 25 bp, Mus musculus
ggcctggctaatgcgcaagtggtca

SEQ ID NO: 451974 - DNA, 25 bp, Mus musculus
ggcctgggatattcaaagacttgca

SEQ ID NO: 451975 - DNA, 25 bp, Mus musculus
ggcctgggtgcttctacagctgaaa

SEQ ID NO: 451976 - DNA, 25 bp, Mus musculus
ggcctggttatctcgccactctgga

SEQ ID NO: 451977 - DNA, 25 bp, Mus musculus
ggcctggttctccatagactgggaa

SEQ ID NO: 451978 - DNA, 25 bp, Mus musculus
ggcctgtagatattgccagcaagtc

SEQ ID NO: 451979 - DNA, 25 bp, Mus musculus
ggcctgtcccctagtgctttgtcca

SEQ ID NO: 451980 - DNA, 25 bp, Mus musculus
ggcctgtggcatatccgagttttta

SEQ ID NO: 451981 - DNA, 25 bp, Mus musculus
ggcctgtgtcatgtttcccgtcggg

SEQ ID NO: 451982 - DNA, 25 bp, Mus musculus
ggcctgttcaatgccatccactgtg

SEQ ID NO: 451983 - DNA, 25 bp, Mus musculus
ggccttaacctgtccaagtatgcag

SEQ ID NO: 451984 - DNA, 25 bp, Mus musculus
ggccttacgtaagctctcagcatgc

SEQ ID NO: 451985 - DNA, 25 bp, Mus musculus
ggccttagagctatagagaatctga

SEQ ID NO: 451986 - DNA, 25 bp, Mus musculus
ggccttatctgactgtcctgcctct

SEQ ID NO: 451987 - DNA, 25 bp, Mus musculus
ggccttcagagtcagatgtcttcat

SEQ ID NO: 451988 - DNA, 25 bp, Mus musculus
ggccttcagatcctcttatctcagc

SEQ ID NO: 451989 - DNA, 25 bp, Mus musculus
ggccttcagtgcaagattcaagatc

SEQ ID NO: 451990 - DNA, 25 bp, Mus musculus
ggccttcatgggtaacaagttggac

SEQ ID NO: 451991 - DNA, 25 bp, Mus musculus
ggccttcctgcccttgttaacacaa

SEQ ID NO: 451992 - DNA, 25 bp, Mus musculus
ggccttctatgtgaaagcccgagac

SEQ ID NO: 451993 - DNA, 25 bp, Mus musculus
ggccttctgcgctatcttgcaccga

SEQ ID NO: 451994 - DNA, 25 bp, Mus musculus
ggccttctgtgagcccggcaatgtg

SEQ ID NO: 451995 - DNA, 25 bp, Mus musculus
ggccttcttgttcagcttcgtggtg

SEQ ID NO: 451996 - DNA, 25 bp, Mus musculus
ggccttgaaaacctcgacagtcctg

SEQ ID NO: 451997 - DNA, 25 bp, Mus musculus
ggccttgaagctcagaaaccctgca

SEQ ID NO: 451998 - DNA, 25 bp, Mus musculus
ggccttgacgttttccatcccagac

SEQ ID NO: 451999 - DNA, 25 bp, Mus musculus
ggccttgagtcctgctggcactgac

SEQ ID NO: 452000 - DNA, 25 bp, Mus musculus
ggccttgccgagctccgtttctaga

SEQ ID NO: 452001 - DNA, 25 bp, Mus musculus
ggccttgctctaggtctcaccgtga

SEQ ID NO: 452002 - DNA, 25 bp, Mus musculus
ggccttggaagccagtgacccagtt

SEQ ID NO: 452003 - DNA, 25 bp, Mus musculus
ggccttgtgcctagccatggagaca

SEQ ID NO: 452004 - DNA, 25 bp, Mus musculus
ggcctttagtttgaaaagtacactg

SEQ ID NO: 452005 - DNA, 25 bp, Mus musculus
ggcctttatgagtcacaccctggaa

SEQ ID NO: 452006 - DNA, 25 bp, Mus musculus
ggcctttcagtctttagaccctgca

SEQ ID NO: 452007 - DNA, 25 bp, Mus musculus
ggcctttgaagtatctgctacccga

SEQ ID NO: 452008 - DNA, 25 bp, Mus musculus
ggcctttgacaaaagtgtgacatgc

SEQ ID NO: 452009 - DNA, 25 bp, Mus musculus
ggcctttgactttgcagctcgggaa

SEQ ID NO: 452010 - DNA, 25 bp, Mus musculus
ggcctttgatgccttccccaatgct

SEQ ID NO: 452011 - DNA, 25 bp, Mus musculus
ggcctttgcaacaggcttgtcccta

SEQ ID NO: 452012 - DNA, 25 bp, Mus musculus
ggcctttgcaggtacctgtgctcag

SEQ ID NO: 452013 - DNA, 25 bp, Mus musculus
ggcctttgcctctttgtatgcagca

SEQ ID NO: 452014 - DNA, 25 bp, Mus musculus
ggcctttggctttcactggtggaga

SEQ ID NO: 452015 - DNA, 25 bp, Mus musculus
ggcctttgtccaacaacttgttagt

SEQ ID NO: 452016 - DNA, 25 bp, Mus musculus
ggcctttgtcccagcaggtggatct

SEQ ID NO: 452017 - DNA, 25 bp, Mus musculus
ggcctttgtgggtccttgacaccag

SEQ ID NO: 452018 - DNA, 25 bp, Mus musculus
ggcgaaaaaagcacagaggtccctg

SEQ ID NO: 452019 - DNA, 25 bp, Mus musculus
ggcgaaaagagtagtaggccttctc

SEQ ID NO: 452020 - DNA, 25 bp, Mus musculus
ggcgaaaaggcaccccgccatgtct

SEQ ID NO: 452021 - DNA, 25 bp, Mus musculus
ggcgaaacaatggacacctcctgag

SEQ ID NO: 452022 - DNA, 25 bp, Mus musculus
ggcgaacactactaactcctgcggt

SEQ ID NO: 452023 - DNA, 25 bp, Mus musculus
ggcgaagactgttgtaaatgttacc

SEQ ID NO: 452024 - DNA, 25 bp, Mus musculus
ggcgaagttcatcttctcccaggtc

SEQ ID NO: 452025 - DNA, 25 bp, Mus musculus
ggcgacaaggtactgttgcacttca

SEQ ID NO: 452026 - DNA, 25 bp, Mus musculus
ggcgacaataaaaaccaaggtgctg

SEQ ID NO: 452027 - DNA, 25 bp, Mus musculus
ggcgacagtatgacatcacgggact

SEQ ID NO: 452028 - DNA, 25 bp, Mus musculus
ggcgacatctcccagcgcttcttga

SEQ ID NO: 452029 - DNA, 25 bp, Mus musculus
ggcgacatgaaaacttcccggctga

SEQ ID NO: 452030 - DNA, 25 bp, Mus musculus
ggcgacattgtctacaagagagtca

SEQ ID NO: 452031 - DNA, 25 bp, Mus musculus
ggcgaccactgagcacgttgaggta

SEQ ID NO: 452032 - DNA, 25 bp, Mus musculus
ggcgactatgcgacacctgagcaga

SEQ ID NO: 452033 - DNA, 25 bp, Mus musculus
ggcgactctagtttcccatgcagga

SEQ ID NO: 452034 - DNA, 25 bp, Mus musculus
ggcgactgccacatccccggtgtgg

SEQ ID NO: 452035 - DNA, 25 bp, Mus musculus
ggcgactgcctgtggaagttgcaca

SEQ ID NO: 452036 - DNA, 25 bp, Mus musculus
ggcgacttggcatgctaacacagaa

SEQ ID NO: 452037 - DNA, 25 bp, Mus musculus
ggcgagaggccgatcctcaagcccg

SEQ ID NO: 452038 - DNA, 25 bp, Mus musculus
ggcgagagtcatgtattacctctag

SEQ ID NO: 452039 - DNA, 25 bp, Mus musculus
ggcgagcgcctttgttcactgcggc

SEQ ID NO: 452040 - DNA, 25 bp, Mus musculus
ggcgagctccgtccaaaagaaaatg

SEQ ID NO: 452041 - DNA, 25 bp, Mus musculus
ggcgaggcattctagtggtgtcacc

SEQ ID NO: 452042 - DNA, 25 bp, Mus musculus
ggcgagtaccacaaagtgtagcagc

SEQ ID NO: 452043 - DNA, 25 bp, Mus musculus
ggcgagtcatttagtccctgtggga

SEQ ID NO: 452044 - DNA, 25 bp, Mus musculus
ggcgagtgctacttcaccaacggga

SEQ ID NO: 452045 - DNA, 25 bp, Mus musculus
ggcgagttagactgttaaggaacgt

SEQ ID NO: 452046 - DNA, 25 bp, Mus musculus
ggcgagtttaccacaccctgagtct

SEQ ID NO: 452047 - DNA, 25 bp, Mus musculus
ggcgataaatgcgagttccagtgtg

SEQ ID NO: 452048 - DNA, 25 bp, Mus musculus
ggcgatcagcgttcggttattctgg

SEQ ID NO: 452049 - DNA, 25 bp, Mus musculus
ggcgatgctacccagtttccagaat

SEQ ID NO: 452050 - DNA, 25 bp, Mus musculus
ggcgatgtagagaccttcccgattc

SEQ ID NO: 452051 - DNA, 25 bp, Mus musculus
ggcgattgcattcagcactccagag

SEQ ID NO: 452052 - DNA, 25 bp, Mus musculus
ggcgcacatctcactcgtctaggag

SEQ ID NO: 452053 - DNA, 25 bp, Mus musculus
ggcgcagccgctagtggccttacgt

SEQ ID NO: 452054 - DNA, 25 bp, Mus musculus
ggcgcaggatcctctgcagaaagag

SEQ ID NO: 452055 - DNA, 25 bp, Mus musculus
ggcgcaggcaccaccgagggaacat

SEQ ID NO: 452056 - DNA, 25 bp, Mus musculus
ggcgcaggctgcatcttcattgaaa

SEQ ID NO: 452057 - DNA, 25 bp, Mus musculus
ggcgcatcactacttagagcagaag

SEQ ID NO: 452058 - DNA, 25 bp, Mus musculus
ggcgcatccgggacacggcagacat

SEQ ID NO: 452059 - DNA, 25 bp, Mus musculus
ggcgcatgcgcaaggtggttctcga

SEQ ID NO: 452060 - DNA, 25 bp, Mus musculus
ggcgcattcacccttgtctattgaa

SEQ ID NO: 452061 - DNA, 25 bp, Mus musculus
ggcgcattgtgctctcttcagggaa

SEQ ID NO: 452062 - DNA, 25 bp, Mus musculus
ggcgccagttcaagtaacgggtgtt

SEQ ID NO: 452063 - DNA, 25 bp, Mus musculus
ggcgccatcaaccaggtaatggtga

SEQ ID NO: 452064 - DNA, 25 bp, Mus musculus
ggcgccatgggcttcatcctaatgt

SEQ ID NO: 452065 - DNA, 25 bp, Mus musculus
ggcgcccacaggcacgtggacttat

SEQ ID NO: 452066 - DNA, 25 bp, Mus musculus
ggcgcccagagctacatgaacgccg

SEQ ID NO: 452067 - DNA, 25 bp, Mus musculus
ggcgccctctgctcttgatttttgg

SEQ ID NO: 452068 - DNA, 25 bp, Mus musculus
ggcgccctggtcgaattagaattta

SEQ ID NO: 452069 - DNA, 25 bp, Mus musculus
ggcgccgcctcatgagggacttcaa

SEQ ID NO: 452070 - DNA, 25 bp, Mus musculus
ggcgcctcagcaaaggtcacagtgt

SEQ ID NO: 452071 - DNA, 25 bp, Mus musculus
ggcgccttaaccagcaacttcgagt

SEQ ID NO: 452072 - DNA, 25 bp, Mus musculus
ggcgcgaggagctgttcatcgaaca

SEQ ID NO: 452073 - DNA, 25 bp, Mus musculus
ggcgcgatgtccgaaaagaagcagc

SEQ ID NO: 452074 - DNA, 25 bp, Mus musculus
ggcgcgcacttacggacttacctag

SEQ ID NO: 452075 - DNA, 25 bp, Mus musculus
ggcgcgctggtcctttgatactaag

SEQ ID NO: 452076 - DNA, 25 bp, Mus musculus
ggcgcggcagagtagcatccttgct

SEQ ID NO: 452077 - DNA, 25 bp, Mus musculus
ggcgcggccaacaagaagatgagca

SEQ ID NO: 452078 - DNA, 25 bp, Mus musculus
ggcgcgtcctcaggcagaagaagtt

SEQ ID NO: 452079 - DNA, 25 bp, Mus musculus
ggcgctaccataccaagaccttgct

SEQ ID NO: 452080 - DNA, 25 bp, Mus musculus
ggcgctaggtgctctccagaaacca

SEQ ID NO: 452081 - DNA, 25 bp, Mus musculus
ggcgctccttccttgacatccagtt

SEQ ID NO: 452082 - DNA, 25 bp, Mus musculus
ggcgctcgggcatgcttgggtgtgt

SEQ ID NO: 452083 - DNA, 25 bp, Mus musculus
ggcgctctgagtgtatcgtccttct

SEQ ID NO: 452084 - DNA, 25 bp, Mus musculus
ggcgctgaagaccaagacaatatgc

SEQ ID NO: 452085 - DNA, 25 bp, Mus musculus
ggcgctgaagcatctggctggaccc

SEQ ID NO: 452086 - DNA, 25 bp, Mus musculus
ggcgctgaagccacgaaaatctgat

SEQ ID NO: 452087 - DNA, 25 bp, Mus musculus
ggcgctgcctgtgaaaccattagag

SEQ ID NO: 452088 - DNA, 25 bp, Mus musculus
ggcgctgcgagaagactcagtccta

SEQ ID NO: 452089 - DNA, 25 bp, Mus musculus
ggcgctgcttggctctcttatcctg

SEQ ID NO: 452090 - DNA, 25 bp, Mus musculus
ggcgctggctcctacatctacgaga

SEQ ID NO: 452091 - DNA, 25 bp, Mus musculus
ggcgctgtgtattatttgcactgaa

SEQ ID NO: 452092 - DNA, 25 bp, Mus musculus
ggcgcttcaagcgtgtgctccagaa

SEQ ID NO: 452093 - DNA, 25 bp, Mus musculus
ggcggaaaaaggatttcaaaatcat

SEQ ID NO: 452094 - DNA, 25 bp, Mus musculus
ggcggaaacccctccgatgcgttag

SEQ ID NO: 452095 - DNA, 25 bp, Mus musculus
ggcggaacatatgccatcctcacat

SEQ ID NO: 452096 - DNA, 25 bp, Mus musculus
ggcggaacctttaccactggacaga

SEQ ID NO: 452097 - DNA, 25 bp, Mus musculus
ggcggaagtgaaaccacgagacagt

SEQ ID NO: 452098 - DNA, 25 bp, Mus musculus
ggcggacaaggaagctggcggtgga

SEQ ID NO: 452099 - DNA, 25 bp, Mus musculus
ggcggactgcagagacaatgagacc

SEQ ID NO: 452100 - DNA, 25 bp, Mus musculus
ggcggagcacctcacttttctggag

SEQ ID NO: 452101 - DNA, 25 bp, Mus musculus
ggcggatccatttagcgaactgcag

SEQ ID NO: 452102 - DNA, 25 bp, Mus musculus
ggcggcaacgtggactacaagaaca

SEQ ID NO: 452103 - DNA, 25 bp, Mus musculus
ggcggcagcgcattgaccctgtgct

SEQ ID NO: 452104 - DNA, 25 bp, Mus musculus
ggcggcataagcctgctggttcaaa

SEQ ID NO: 452105 - DNA, 25 bp, Mus musculus
ggcggccatcgggatctgccgaaca

SEQ ID NO: 452106 - DNA, 25 bp, Mus musculus
ggcggccatgcaacgagatctgctc

SEQ ID NO: 452107 - DNA, 25 bp, Mus musculus
ggcggccccacgaaaaataacgctg

SEQ ID NO: 452108 - DNA, 25 bp, Mus musculus
ggcggccgccaaaggctatacagaa

SEQ ID NO: 452109 - DNA, 25 bp, Mus musculus
ggcggcgacggcagatgaaaacatc

SEQ ID NO: 452110 - DNA, 25 bp, Mus musculus
ggcggcgcatttcctaggttatcaa

SEQ ID NO: 452111 - DNA, 25 bp, Mus musculus
ggcggcgggataggaattcaacatt

SEQ ID NO: 452112 - DNA, 25 bp, Mus musculus
ggcggcggtggcttcaagtcatctt

SEQ ID NO: 452113 - DNA, 25 bp, Mus musculus
ggcggctacctttgcttactgggat

SEQ ID NO: 452114 - DNA, 25 bp, Mus musculus
ggcggctttgcctctgagatcagct

SEQ ID NO: 452115 - DNA, 25 bp, Mus musculus
ggcgggaacatcctgcatagcttca

SEQ ID NO: 452116 - DNA, 25 bp, Mus musculus
ggcgggcactgaactataaagcaca

SEQ ID NO: 452117 - DNA, 25 bp, Mus musculus
ggcgggccaccctctgtctgcaagg

SEQ ID NO: 452118 - DNA, 25 bp, Mus musculus
ggcgggccagcctctaatttgcaca

SEQ ID NO: 452119 - DNA, 25 bp, Mus musculus
ggcgggcgctaaccagatcttgact

SEQ ID NO: 452120 - DNA, 25 bp, Mus musculus
ggcggtatcccaaggaggtccaaga

SEQ ID NO: 452121 - DNA, 25 bp, Mus musculus
ggcggtcacagaagagcagtgtgga

SEQ ID NO: 452122 - DNA, 25 bp, Mus musculus
ggcggtcccaggtctcggaagataa

SEQ ID NO: 452123 - DNA, 25 bp, Mus musculus
ggcggtcctcgcagcagcaattgct

SEQ ID NO: 452124 - DNA, 25 bp, Mus musculus
ggcggtcttcggtcctcagccagct

SEQ ID NO: 452125 - DNA, 25 bp, Mus musculus
ggcggtgcagaagttcctggcctca

SEQ ID NO: 452126 - DNA, 25 bp, Mus musculus
ggcggtggccaagcatatagcaaca

SEQ ID NO: 452127 - DNA, 25 bp, Mus musculus
ggcggtggcgcctgtggctgtgcac

SEQ ID NO: 452128 - DNA, 25 bp, Mus musculus
ggcggtggtcagagctcctacattt

SEQ ID NO: 452129 - DNA, 25 bp, Mus musculus
ggcggttgactagatacagtacaca

SEQ ID NO: 452130 - DNA, 25 bp, Mus musculus
ggcggtttctgttcccgtatgagaa

SEQ ID NO: 452131 - DNA, 25 bp, Mus musculus
ggcgtaaaactgtgcgaaaccttag

SEQ ID NO: 452132 - DNA, 25 bp, Mus musculus
ggcgtaactgtaataggcaaagacc

SEQ ID NO: 452133 - DNA, 25 bp, Mus musculus
ggcgtacatctttgaccaccgggag

SEQ ID NO: 452134 - DNA, 25 bp, Mus musculus
ggcgtaccctactaatgaacttgag

SEQ ID NO: 452135 - DNA, 25 bp, Mus musculus
ggcgtagcatacaactccaaggtgg

SEQ ID NO: 452136 - DNA, 25 bp, Mus musculus
ggcgtaggccttgaaaacctcgaca

SEQ ID NO: 452137 - DNA, 25 bp, Mus musculus
ggcgtattgctgtgcctacccgaaa

SEQ ID NO: 452138 - DNA, 25 bp, Mus musculus
ggcgtcaaagttcaccctagtcaga

SEQ ID NO: 452139 - DNA, 25 bp, Mus musculus
ggcgtcagtgttcatatgggatcca

SEQ ID NO: 452140 - DNA, 25 bp, Mus musculus
ggcgtcatcgtctactatgccagga

SEQ ID NO: 452141 - DNA, 25 bp, Mus musculus
ggcgtcccgggcattaactgaccaa

SEQ ID NO: 452142 - DNA, 25 bp, Mus musculus
ggcgtcctactaagtaagagaggca

SEQ ID NO: 452143 - DNA, 25 bp, Mus musculus
ggcgtccttaccatcgctgtgcgga

SEQ ID NO: 452144 - DNA, 25 bp, Mus musculus
ggcgtccttcccaggcagggattca

SEQ ID NO: 452145 - DNA, 25 bp, Mus musculus
ggcgtcgtgaaactccaactggaat

SEQ ID NO: 452146 - DNA, 25 bp, Mus musculus
ggcgtctcctttcaagggtcccgca

SEQ ID NO: 452147 - DNA, 25 bp, Mus musculus
ggcgtctgaccaccaagcatagcag

SEQ ID NO: 452148 - DNA, 25 bp, Mus musculus
ggcgtctgagggaccacagcgctcc

SEQ ID NO: 452149 - DNA, 25 bp, Mus musculus
ggcgtgacacccataaaggatctga

SEQ ID NO: 452150 - DNA, 25 bp, Mus musculus
ggcgtgcctaggacaatgcttcagt

SEQ ID NO: 452151 - DNA, 25 bp, Mus musculus
ggcgtgctctggaacagctactaga

SEQ ID NO: 452152 - DNA, 25 bp, Mus musculus
ggcgtggaaatgtaacatgcttgtt

SEQ ID NO: 452153 - DNA, 25 bp, Mus musculus
ggcgtgtccacgtcactcaggagga

SEQ ID NO: 452154 - DNA, 25 bp, Mus musculus
ggcgtgtttttacgacaactgcaag

SEQ ID NO: 452155 - DNA, 25 bp, Mus musculus
ggcgttacctgacagactcctttct

SEQ ID NO: 452156 - DNA, 25 bp, Mus musculus
ggcgttacggccttgacatggcttc

SEQ ID NO: 452157 - DNA, 25 bp, Mus musculus
ggcgttccgaactccaaccctagat

SEQ ID NO: 452158 - DNA, 25 bp, Mus musculus
ggcgttcctcagatccttcgatggt

SEQ ID NO: 452159 - DNA, 25 bp, Mus musculus
ggcgttcgggccaatcactctcttg

SEQ ID NO: 452160 - DNA, 25 bp, Mus musculus
ggcgttcttgcatggtgtgatcaca

SEQ ID NO: 452161 - DNA, 25 bp, Mus musculus
ggcgttggcaccagcatctgcagaa

SEQ ID NO: 452162 - DNA, 25 bp, Mus musculus
ggcgttggtcatccccagactgcct

SEQ ID NO: 452163 - DNA, 25 bp, Mus musculus
ggcgttgttaaagggcttcaagatc

SEQ ID NO: 452164 - DNA, 25 bp, Mus musculus
ggcgtttgctgatgaaccacctgaa

SEQ ID NO: 452165 - DNA, 25 bp, Mus musculus
ggcgtttgtgcctcgtgagccccgt

SEQ ID NO: 452166 - DNA, 25 bp, Mus musculus
ggctaaaaatagctctcagagtgag

SEQ ID NO: 452167 - DNA, 25 bp, Mus musculus
ggctaaaagagaatcacccaggaag

SEQ ID NO: 452168 - DNA, 25 bp, Mus musculus
ggctaaaagcctgaggtacccaagc

SEQ ID NO: 452169 - DNA, 25 bp, Mus musculus
ggctaaaatgctggccccaggccta

SEQ ID NO: 452170 - DNA, 25 bp, Mus musculus
ggctaaacctgtaccacttctggag

SEQ ID NO: 452171 - DNA, 25 bp, Mus musculus
ggctaaaggcttttagtccagggat

SEQ ID NO: 452172 - DNA, 25 bp, Mus musculus
ggctaaatagaagggacgttgagtt

SEQ ID NO: 452173 - DNA, 25 bp, Mus musculus
ggctaacctggctagaaactgctga

SEQ ID NO: 452174 - DNA, 25 bp, Mus musculus
ggctaacgtcaaataccagcttagg

SEQ ID NO: 452175 - DNA, 25 bp, Mus musculus
ggctaactcgaagctggaaacccgt

SEQ ID NO: 452176 - DNA, 25 bp, Mus musculus
ggctaacttcaaacctcgcttgtga

SEQ ID NO: 452177 - DNA, 25 bp, Mus musculus
ggctaagatgactgcctttcctgat

SEQ ID NO: 452178 - DNA, 25 bp, Mus musculus
ggctaaggccaaaggtagtataaca

SEQ ID NO: 452179 - DNA, 25 bp, Mus musculus
ggctaagggacaggagactttctac

SEQ ID NO: 452180 - DNA, 25 bp, Mus musculus
ggctaagggcacttctacccaacat

SEQ ID NO: 452181 - DNA, 25 bp, Mus musculus
ggctaaggtcctgaactaaataaat

SEQ ID NO: 452182 - DNA, 25 bp, Mus musculus
ggctaagtccatcttccggcctggg

SEQ ID NO: 452183 - DNA, 25 bp, Mus musculus
ggctaatacttttccctctcttctt

SEQ ID NO: 452184 - DNA, 25 bp, Mus musculus
ggctaatccctgagagaaccgtttg

SEQ ID NO: 452185 - DNA, 25 bp, Mus musculus
ggctaatgaaacactagagaagtca

SEQ ID NO: 452186 - DNA, 25 bp, Mus musculus
ggctaattaatgtttgtttccttgt

SEQ ID NO: 452187 - DNA, 25 bp, Mus musculus
ggctaattagtattttatctcaaaa

SEQ ID NO: 452188 - DNA, 25 bp, Mus musculus
ggctacaacttctacggcaccgaga

SEQ ID NO: 452189 - DNA, 25 bp, Mus musculus
ggctacaatctctaccgactggtgg

SEQ ID NO: 452190 - DNA, 25 bp, Mus musculus
ggctacacatcagtagtgagcagag

SEQ ID NO: 452191 - DNA, 25 bp, Mus musculus
ggctaccaaaacatcgaggatgaag

SEQ ID NO: 452192 - DNA, 25 bp, Mus musculus
ggctaccatttgcaagggccgcagc

SEQ ID NO: 452193 - DNA, 25 bp, Mus musculus
ggctaccccatgcagatcgaacagt

SEQ ID NO: 452194 - DNA, 25 bp, Mus musculus
ggctaccctaccatctgctatttcg

SEQ ID NO: 452195 - DNA, 25 bp, Mus musculus
ggctacctagcgaagccccttgttg

SEQ ID NO: 452196 - DNA, 25 bp, Mus musculus
ggctacctggtctacaagttgagtt

SEQ ID NO: 452197 - DNA, 25 bp, Mus musculus
ggctacgacccaaccagagtaagga

SEQ ID NO: 452198 - DNA, 25 bp, Mus musculus
ggctacgagacggatcaccaggatt

SEQ ID NO: 452199 - DNA, 25 bp, Mus musculus
ggctacgatccggagcattgcccag

SEQ ID NO: 452200 - DNA, 25 bp, Mus musculus
ggctacgcgtctgtgggtcctgacc

SEQ ID NO: 452201 - DNA, 25 bp, Mus musculus
ggctacgctgccaactactgtgatg

SEQ ID NO: 452202 - DNA, 25 bp, Mus musculus
ggctacggaccatcttgctacagaa

SEQ ID NO: 452203 - DNA, 25 bp, Mus musculus
ggctacgtccttccaccagtgaatt

SEQ ID NO: 452204 - DNA, 25 bp, Mus musculus
ggctacgtcgatgtctcaactccat

SEQ ID NO: 452205 - DNA, 25 bp, Mus musculus
ggctacgtggatgtgttgaccctca

SEQ ID NO: 452206 - DNA, 25 bp, Mus musculus
ggctactacaaccaggcggaaggct

SEQ ID NO: 452207 - DNA, 25 bp, Mus musculus
ggctactactggttccaccgcatgg

SEQ ID NO: 452208 - DNA, 25 bp, Mus musculus
ggctactatcatctggaccgggcaa

SEQ ID NO: 452209 - DNA, 25 bp, Mus musculus
ggctactcctacaacaactgggcgg

SEQ ID NO: 452210 - DNA, 25 bp, Mus musculus
ggctacttagccacgatcacgatgg

SEQ ID NO: 452211 - DNA, 25 bp, Mus musculus
ggctacttcgacatccaggctgaga

SEQ ID NO: 452212 - DNA, 25 bp, Mus musculus
ggctactttctgtttcacttcgaga

SEQ ID NO: 452213 - DNA, 25 bp, Mus musculus
ggctagagcctccaaacatacttat

SEQ ID NO: 452214 - DNA, 25 bp, Mus musculus
ggctagagctccgttcctttgaggt

SEQ ID NO: 452215 - DNA, 25 bp, Mus musculus
ggctagatcacacaccctatcctga

SEQ ID NO: 452216 - DNA, 25 bp, Mus musculus
ggctagcaaggatcacagctccgat

SEQ ID NO: 452217 - DNA, 25 bp, Mus musculus
ggctagccctgaagatcagtctgga

SEQ ID NO: 452218 - DNA, 25 bp, Mus musculus
ggctagccctgtggtcactcctggt

SEQ ID NO: 452219 - DNA, 25 bp, Mus musculus
ggctagcggccatttactggatcac

SEQ ID NO: 452220 - DNA, 25 bp, Mus musculus
ggctagctcaaggtcatcaatgtaa

SEQ ID NO: 452221 - DNA, 25 bp, Mus musculus
ggctagctcactgggaaagcccctg

SEQ ID NO: 452222 - DNA, 25 bp, Mus musculus
ggctagctggccactgaacatcatg

SEQ ID NO: 452223 - DNA, 25 bp, Mus musculus
ggctagcttccagtccacaggtcaa

SEQ ID NO: 452224 - DNA, 25 bp, Mus musculus
ggctaggaaatctctattcagcgtc

SEQ ID NO: 452225 - DNA, 25 bp, Mus musculus
ggctagggctctagggcaccactgt

SEQ ID NO: 452226 - DNA, 25 bp, Mus musculus
ggctaggtctgtcccaagctgacat

SEQ ID NO: 452227 - DNA, 25 bp, Mus musculus
ggctaggttttactgccacacagag

SEQ ID NO: 452228 - DNA, 25 bp, Mus musculus
ggctagtggatcatggtaagttccc

SEQ ID NO: 452229 - DNA, 25 bp, Mus musculus
ggctagtgtcacctttcctgaggga

SEQ ID NO: 452230 - DNA, 25 bp, Mus musculus
ggctatacacaccttacactgcagg

SEQ ID NO: 452231 - DNA, 25 bp, Mus musculus
ggctatagctcctattccactggag

SEQ ID NO: 452232 - DNA, 25 bp, Mus musculus
ggctatatgtacttttaccgcagga

SEQ ID NO: 452233 - DNA, 25 bp, Mus musculus
ggctatcactgaactgcactgagat

SEQ ID NO: 452234 - DNA, 25 bp, Mus musculus
ggctatcagagaccaagggccctag

SEQ ID NO: 452235 - DNA, 25 bp, Mus musculus
ggctatcagagacccccagtgttct

SEQ ID NO: 452236 - DNA, 25 bp, Mus musculus
ggctatcattctctttctaagcata

SEQ ID NO: 452237 - DNA, 25 bp, Mus musculus
ggctatcgggaacacttcctaaata

SEQ ID NO: 452238 - DNA, 25 bp, Mus musculus
ggctatgaacccaacagaggtggat

SEQ ID NO: 452239 - DNA, 25 bp, Mus musculus
ggctatggacaatatgactgtgcgt

SEQ ID NO: 452240 - DNA, 25 bp, Mus musculus
ggctatgggaattgctcagcttttt

SEQ ID NO: 452241 - DNA, 25 bp, Mus musculus
ggctatggttccttaatgactgtct

SEQ ID NO: 452242 - DNA, 25 bp, Mus musculus
ggctattactggatcacgggcagga

SEQ ID NO: 452243 - DNA, 25 bp, Mus musculus
ggctattcatcccaagtcaggtagc

SEQ ID NO: 452244 - DNA, 25 bp, Mus musculus
ggctattcctttctgcacgtgcgag

SEQ ID NO: 452245 - DNA, 25 bp, Mus musculus
ggctattgtttcatcctgacctgga

SEQ ID NO: 452246 - DNA, 25 bp, Mus musculus
ggctatttcccatgcagcgcagaag

SEQ ID NO: 452247 - DNA, 25 bp, Mus musculus
ggctattttgctactctacagggaa

SEQ ID NO: 452248 - DNA, 25 bp, Mus musculus
ggctcaaaattcttcgttgaactct

SEQ ID NO: 452249 - DNA, 25 bp, Mus musculus
ggctcaacttcagcggcttcggcta

SEQ ID NO: 452250 - DNA, 25 bp, Mus musculus
ggctcaagccatccttgtgctaaga

SEQ ID NO: 452251 - DNA, 25 bp, Mus musculus
ggctcaagtcagtttcctggtggaa

SEQ ID NO: 452252 - DNA, 25 bp, Mus musculus
ggctcaatccctagtacatctaaag

SEQ ID NO: 452253 - DNA, 25 bp, Mus musculus
ggctcaatgagatgtgccctgcaca

SEQ ID NO: 452254 - DNA, 25 bp, Mus musculus
ggctcaatgagcctcgctatgccac

SEQ ID NO: 452255 - DNA, 25 bp, Mus musculus
ggctcaatgtgccttccccagacat

SEQ ID NO: 452256 - DNA, 25 bp, Mus musculus
ggctcacaagtgtcaactcttacag

SEQ ID NO: 452257 - DNA, 25 bp, Mus musculus
ggctcaccgcagaagcagtagcagt

SEQ ID NO: 452258 - DNA, 25 bp, Mus musculus
ggctcacctgcacatggagatcgtg

SEQ ID NO: 452259 - DNA, 25 bp, Mus musculus
ggctcagaactaatagcgtcccgaa

SEQ ID NO: 452260 - DNA, 25 bp, Mus musculus
ggctcagacagtaagggtgcatgct

SEQ ID NO: 452261 - DNA, 25 bp, Mus musculus
ggctcagagcctagacagtttccac

SEQ ID NO: 452262 - DNA, 25 bp, Mus musculus
ggctcagcctgcctaggaaacgcaa

SEQ ID NO: 452263 - DNA, 25 bp, Mus musculus
ggctcagctatagtccaacataaga

SEQ ID NO: 452264 - DNA, 25 bp, Mus musculus
ggctcaggagcacccagaagtaaca

SEQ ID NO: 452265 - DNA, 25 bp, Mus musculus
ggctcaggcgagtagctagcgctca

SEQ ID NO: 452266 - DNA, 25 bp, Mus musculus
ggctcagggacatcgggataccact

SEQ ID NO: 452267 - DNA, 25 bp, Mus musculus
ggctcagtatctgctggtgaacaca

SEQ ID NO: 452268 - DNA, 25 bp, Mus musculus
ggctcagtcacgcaggaatatccag

SEQ ID NO: 452269 - DNA, 25 bp, Mus musculus
ggctcagtcagatcgcacaggctgg

SEQ ID NO: 452270 - DNA, 25 bp, Mus musculus
ggctcagtctccacacatagctgca

SEQ ID NO: 452271 - DNA, 25 bp, Mus musculus
ggctcagtctctccggcagtgtatt

SEQ ID NO: 452272 - DNA, 25 bp, Mus musculus
ggctcataacaacttcgtcgggcga

SEQ ID NO: 452273 - DNA, 25 bp, Mus musculus
ggctcataatgctccagtaaaggtg

SEQ ID NO: 452274 - DNA, 25 bp, Mus musculus
ggctcatagaaaagcgacatcgcat

SEQ ID NO: 452275 - DNA, 25 bp, Mus musculus
ggctcatattccagtctcatggaca

SEQ ID NO: 452276 - DNA, 25 bp, Mus musculus
ggctcatattcgcactcctgggcag

SEQ ID NO: 452277 - DNA, 25 bp, Mus musculus
ggctcatcacggtaggcaagctgga

SEQ ID NO: 452278 - DNA, 25 bp, Mus musculus
ggctcatcagctgcggcaacaagta

SEQ ID NO: 452279 - DNA, 25 bp, Mus musculus
ggctcatctagctgggtttcctggt

SEQ ID NO: 452280 - DNA, 25 bp, Mus musculus
ggctcatctccctttttagtccgac

SEQ ID NO: 452281 - DNA, 25 bp, Mus musculus
ggctcatgaaccatccagtgtgtgt

SEQ ID NO: 452282 - DNA, 25 bp, Mus musculus
ggctcatgatcttcaggaacaacaa

SEQ ID NO: 452283 - DNA, 25 bp, Mus musculus
ggctcatgggccagccttctctgag

SEQ ID NO: 452284 - DNA, 25 bp, Mus musculus
ggctcatgtaagtgccggtgtccat

SEQ ID NO: 452285 - DNA, 25 bp, Mus musculus
ggctcatttcatggtagcagtaaac

SEQ ID NO: 452286 - DNA, 25 bp, Mus musculus
ggctccaaaggacatttgagtgatc

SEQ ID NO: 452287 - DNA, 25 bp, Mus musculus
ggctccacagcggatattgcccgaa

SEQ ID NO: 452288 - DNA, 25 bp, Mus musculus
ggctccaccctgaagatacactaca

SEQ ID NO: 452289 - DNA, 25 bp, Mus musculus
ggctccagagtcgaccaagtgcttg

SEQ ID NO: 452290 - DNA, 25 bp, Mus musculus
ggctccagcataaaaccagggcccc

SEQ ID NO: 452291 - DNA, 25 bp, Mus musculus
ggctccagcatcacgaccggttctg

SEQ ID NO: 452292 - DNA, 25 bp, Mus musculus
ggctccagccacaggtaagcagggc

SEQ ID NO: 452293 - DNA, 25 bp, Mus musculus
ggctccatcgccaacactgtaagaa

SEQ ID NO: 452294 - DNA, 25 bp, Mus musculus
ggctccattaacactgaattgcagg

SEQ ID NO: 452295 - DNA, 25 bp, Mus musculus
ggctcccaaacgagttgttcaacat

SEQ ID NO: 452296 - DNA, 25 bp, Mus musculus
ggctcccagaaattaattctagaaa

SEQ ID NO: 452297 - DNA, 25 bp, Mus musculus
ggctcccgtggataagaaccttgtc

SEQ ID NO: 452298 - DNA, 25 bp, Mus musculus
ggctccctacggatgagacccttca

SEQ ID NO: 452299 - DNA, 25 bp, Mus musculus
ggctccctgaaacctgtcagatgtg

SEQ ID NO: 452300 - DNA, 25 bp, Mus musculus
ggctccctgcaagcttccatgtaat

SEQ ID NO: 452301 - DNA, 25 bp, Mus musculus
ggctccctgctatgagggtctgtga

SEQ ID NO: 452302 - DNA, 25 bp, Mus musculus
ggctccctgtcctacggcaatgaag

SEQ ID NO: 452303 - DNA, 25 bp, Mus musculus
ggctccgcgagtaaccagtctctgg

SEQ ID NO: 452304 - DNA, 25 bp, Mus musculus
ggctccggtgcccagtatacttaag

SEQ ID NO: 452305 - DNA, 25 bp, Mus musculus
ggctcctactggtacttcttaatgc

SEQ ID NO: 452306 - DNA, 25 bp, Mus musculus
ggctcctatttgtgggacatgaatt

SEQ ID NO: 452307 - DNA, 25 bp, Mus musculus
ggctcctctcagcatttatctgttg

SEQ ID NO: 452308 - DNA, 25 bp, Mus musculus
ggctcctgaaagtgcaccgttaaaa

SEQ ID NO: 452309 - DNA, 25 bp, Mus musculus
ggctccttcctcagaaaagcttaag

SEQ ID NO: 452310 - DNA, 25 bp, Mus musculus
ggctccttgacctgggacttactaa

SEQ ID NO: 452311 - DNA, 25 bp, Mus musculus
ggctccttgatgacatttccagtcg

SEQ ID NO: 452312 - DNA, 25 bp, Mus musculus
ggctccttgcaaatcactgtcttca

SEQ ID NO: 452313 - DNA, 25 bp, Mus musculus
ggctccttggtcagcatcaccaaag

SEQ ID NO: 452314 - DNA, 25 bp, Mus musculus
ggctcctttgtgaccgtgctgcccg

SEQ ID NO: 452315 - DNA, 25 bp, Mus musculus
ggctcctttttatatgttcaaccaa

SEQ ID NO: 452316 - DNA, 25 bp, Mus musculus
ggctcgaagcaaaagtacagatatt

SEQ ID NO: 452317 - DNA, 25 bp, Mus musculus
ggctcgaggcctttctgacgcagaa

SEQ ID NO: 452318 - DNA, 25 bp, Mus musculus
ggctcgatgcactgaccaggcaggt

SEQ ID NO: 452319 - DNA, 25 bp, Mus musculus
ggctcgattctctgccctgatctag

SEQ ID NO: 452320 - DNA, 25 bp, Mus musculus
ggctcgcaccccactttctaggacc

SEQ ID NO: 452321 - DNA, 25 bp, Mus musculus
ggctcgcagcagagctactcctaga

SEQ ID NO: 452322 - DNA, 25 bp, Mus musculus
ggctcggagcactttctctgaggaa

SEQ ID NO: 452323 - DNA, 25 bp, Mus musculus
ggctcggagtgtaccccactaagaa

SEQ ID NO: 452324 - DNA, 25 bp, Mus musculus
ggctcggattattcggtgctagcgt

SEQ ID NO: 452325 - DNA, 25 bp, Mus musculus
ggctcggccataccaatgcaactgt

SEQ ID NO: 452326 - DNA, 25 bp, Mus musculus
ggctcggccctcagtagtactcaga

SEQ ID NO: 452327 - DNA, 25 bp, Mus musculus
ggctcggctgcctgttgcgcttgtc

SEQ ID NO: 452328 - DNA, 25 bp, Mus musculus
ggctcggcttgagaccctggtcctg

SEQ ID NO: 452329 - DNA, 25 bp, Mus musculus
ggctcgggactcaccccagtgttaa

SEQ ID NO: 452330 - DNA, 25 bp, Mus musculus
ggctcggttctcctacaaatggcag

SEQ ID NO: 452331 - DNA, 25 bp, Mus musculus
ggctcgtctaattcagaagcttcgc

SEQ ID NO: 452332 - DNA, 25 bp, Mus musculus
ggctcgtgataactgggatctgccc

SEQ ID NO: 452333 - DNA, 25 bp, Mus musculus
ggctcgttatcagcttcggcatgga

SEQ ID NO: 452334 - DNA, 25 bp, Mus musculus
ggctctaacaatttcttttccaaca

SEQ ID NO: 452335 - DNA, 25 bp, Mus musculus
ggctctaagcaccacactgattgat

SEQ ID NO: 452336 - DNA, 25 bp, Mus musculus
ggctctaagtagcatattgtccttc

SEQ ID NO: 452337 - DNA, 25 bp, Mus musculus
ggctctacatgttccccgcactgag

SEQ ID NO: 452338 - DNA, 25 bp, Mus musculus
ggctctaccgccttggaatgttgca

SEQ ID NO: 452339 - DNA, 25 bp, Mus musculus
ggctctatctctagtggcccacagt

SEQ ID NO: 452340 - DNA, 25 bp, Mus musculus
ggctctatggtgctggccacgacat

SEQ ID NO: 452341 - DNA, 25 bp, Mus musculus
ggctctcaggataaactcccagtgt

SEQ ID NO: 452342 - DNA, 25 bp, Mus musculus
ggctctcaggcctcacggaatgtca

SEQ ID NO: 452343 - DNA, 25 bp, Mus musculus
ggctctcatcaccaggttcaacatg

SEQ ID NO: 452344 - DNA, 25 bp, Mus musculus
ggctctccacagagaatttttattc

SEQ ID NO: 452345 - DNA, 25 bp, Mus musculus
ggctctcctgaaccttcaactcgag

SEQ ID NO: 452346 - DNA, 25 bp, Mus musculus
ggctctctacacagtcacaggacag

SEQ ID NO: 452347 - DNA, 25 bp, Mus musculus
ggctctctgcaggacattcttcaac

SEQ ID NO: 452348 - DNA, 25 bp, Mus musculus
ggctctctggatctatggtgctaga

SEQ ID NO: 452349 - DNA, 25 bp, Mus musculus
ggctctctgtgtatggactgagttt

SEQ ID NO: 452350 - DNA, 25 bp, Mus musculus
ggctctctgttcttccgatttgtca

SEQ ID NO: 452351 - DNA, 25 bp, Mus musculus
ggctctcttccagttgtcacacatt

SEQ ID NO: 452352 - DNA, 25 bp, Mus musculus
ggctctctttgcatatctgtcacag

SEQ ID NO: 452353 - DNA, 25 bp, Mus musculus
ggctctgacttacctgaattcatct

SEQ ID NO: 452354 - DNA, 25 bp, Mus musculus
ggctctgagaagctctttgccccgg

SEQ ID NO: 452355 - DNA, 25 bp, Mus musculus
ggctctgcaaaaggcccggaatcca

SEQ ID NO: 452356 - DNA, 25 bp, Mus musculus
ggctctgcaggcttgatccctttct

SEQ ID NO: 452357 - DNA, 25 bp, Mus musculus
ggctctgcgtgcaggcgctgctgct

SEQ ID NO: 452358 - DNA, 25 bp, Mus musculus
ggctctggactttgttggctctgga

SEQ ID NO: 452359 - DNA, 25 bp, Mus musculus
ggctctgggaccacttgcctggata

SEQ ID NO: 452360 - DNA, 25 bp, Mus musculus
ggctctgtaggtaatgggattctct

SEQ ID NO: 452361 - DNA, 25 bp, Mus musculus
ggctctgtttcaagtgctgccccag

SEQ ID NO: 452362 - DNA, 25 bp, Mus musculus
ggctcttatcccagatatatgctgc

SEQ ID NO: 452363 - DNA, 25 bp, Mus musculus
ggctcttatgtatcttgtaccggca

SEQ ID NO: 452364 - DNA, 25 bp, Mus musculus
ggctcttcacctgagtaccaaacat

SEQ ID NO: 452365 - DNA, 25 bp, Mus musculus
ggctcttcctctgtagtaatgacat

SEQ ID NO: 452366 - DNA, 25 bp, Mus musculus
ggctcttgctgtagattgacaacaa

SEQ ID NO: 452367 - DNA, 25 bp, Mus musculus
ggctcttggatgaagggcactaccc

SEQ ID NO: 452368 - DNA, 25 bp, Mus musculus
ggctctttgcaagggctctgggacc

SEQ ID NO: 452369 - DNA, 25 bp, Mus musculus
ggctctttgtagttcccatggcgtt

SEQ ID NO: 452370 - DNA, 25 bp, Mus musculus
ggctgaaaccaagggttcgtgatca

SEQ ID NO: 452371 - DNA, 25 bp, Mus musculus
ggctgaacatgagaagcggctgtct

SEQ ID NO: 452372 - DNA, 25 bp, Mus musculus
ggctgaactcaggaaactatctcct

SEQ ID NO: 452373 - DNA, 25 bp, Mus musculus
ggctgacaaaggtaaccagaccttg

SEQ ID NO: 452374 - DNA, 25 bp, Mus musculus
ggctgacaaagttcgcaccatgcta

SEQ ID NO: 452375 - DNA, 25 bp, Mus musculus
ggctgacaaataactgtcctccttg

SEQ ID NO: 452376 - DNA, 25 bp, Mus musculus
ggctgacacccctacagtaccatgt

SEQ ID NO: 452377 - DNA, 25 bp, Mus musculus
ggctgacaggttcatcaattccaaa

SEQ ID NO: 452378 - DNA, 25 bp, Mus musculus
ggctgaccagagcttgcacccatgt

SEQ ID NO: 452379 - DNA, 25 bp, Mus musculus
ggctgacccagaactatgaggcgta

SEQ ID NO: 452380 - DNA, 25 bp, Mus musculus
ggctgaccttttacctgcgcataga

SEQ ID NO: 452381 - DNA, 25 bp, Mus musculus
ggctgactctggctgactcttcagt

SEQ ID NO: 452382 - DNA, 25 bp, Mus musculus
ggctgactgctcacttaaaggaggc

SEQ ID NO: 452383 - DNA, 25 bp, Mus musculus
ggctgactgggaaagcatcctggca

SEQ ID NO: 452384 - DNA, 25 bp, Mus musculus
ggctgactgggtcgtttctcctaac

SEQ ID NO: 452385 - DNA, 25 bp, Mus musculus
ggctgacttcgaacttgcaatgatt

SEQ ID NO: 452386 - DNA, 25 bp, Mus musculus
ggctgagactcaaatgatatgaact

SEQ ID NO: 452387 - DNA, 25 bp, Mus musculus
ggctgagcaatggaaacagtctctc

SEQ ID NO: 452388 - DNA, 25 bp, Mus musculus
ggctgagccgcatcacttaagtcca

SEQ ID NO: 452389 - DNA, 25 bp, Mus musculus
ggctgagcctctggagtcgagccct

SEQ ID NO: 452390 - DNA, 25 bp, Mus musculus
ggctgagcgccacacattgagtgct

SEQ ID NO: 452391 - DNA, 25 bp, Mus musculus
ggctgagcgtgcaaagccgccgttt

SEQ ID NO: 452392 - DNA, 25 bp, Mus musculus
ggctgagcttgcaacccaggactta

SEQ ID NO: 452393 - DNA, 25 bp, Mus musculus
ggctgaggaagctgaccggcatcct

SEQ ID NO: 452394 - DNA, 25 bp, Mus musculus
ggctgaggatcacttggacaacaat

SEQ ID NO: 452395 - DNA, 25 bp, Mus musculus
ggctgatccattgtcaaccggagct

SEQ ID NO: 452396 - DNA, 25 bp, Mus musculus
ggctgatctgctgcatcgatctaca

SEQ ID NO: 452397 - DNA, 25 bp, Mus musculus
ggctgattgtcatccctgcggtgct

SEQ ID NO: 452398 - DNA, 25 bp, Mus musculus
ggctgatttgcaaacggatctgtga

SEQ ID NO: 452399 - DNA, 25 bp, Mus musculus
ggctgcaaaataaatagactctgaa

SEQ ID NO: 452400 - DNA, 25 bp, Mus musculus
ggctgcaaacaatctgtgaagtttc

SEQ ID NO: 452401 - DNA, 25 bp, Mus musculus
ggctgcaatgccttatgggagctgc

SEQ ID NO: 452402 - DNA, 25 bp, Mus musculus
ggctgcaccgatttacagtgcttga

SEQ ID NO: 452403 - DNA, 25 bp, Mus musculus
ggctgcagagaatgatctgtcctca

SEQ ID NO: 452404 - DNA, 25 bp, Mus musculus
ggctgcagtttgaggagcattgcaa

SEQ ID NO: 452405 - DNA, 25 bp, Mus musculus
ggctgcataatgatcgacgtcggga

SEQ ID NO: 452406 - DNA, 25 bp, Mus musculus
ggctgcatgcattagaggaacctca

SEQ ID NO: 452407 - DNA, 25 bp, Mus musculus
ggctgcattacaccctatagttaca

SEQ ID NO: 452408 - DNA, 25 bp, Mus musculus
ggctgccactggacctcagaaaagt

SEQ ID NO: 452409 - DNA, 25 bp, Mus musculus
ggctgccagagggacgtgttaaaaa

SEQ ID NO: 452410 - DNA, 25 bp, Mus musculus
ggctgccagatacaaggccctcaac

SEQ ID NO: 452411 - DNA, 25 bp, Mus musculus
ggctgccagatcagcatgaaaagat

SEQ ID NO: 452412 - DNA, 25 bp, Mus musculus
ggctgccagccaatgcttttagtca

SEQ ID NO: 452413 - DNA, 25 bp, Mus musculus
ggctgcccggtacccgaagaagatt

SEQ ID NO: 452414 - DNA, 25 bp, Mus musculus
ggctgccgccggagaggcatccaca

SEQ ID NO: 452415 - DNA, 25 bp, Mus musculus
ggctgcctcagcacgtgcagaagga

SEQ ID NO: 452416 - DNA, 25 bp, Mus musculus
ggctgcctctgagaataacctacta

SEQ ID NO: 452417 - DNA, 25 bp, Mus musculus
ggctgcctgggctaatcagtgtcat

SEQ ID NO: 452418 - DNA, 25 bp, Mus musculus
ggctgccttgccagtaaattttcat

SEQ ID NO: 452419 - DNA, 25 bp, Mus musculus
ggctgccttgcttctaaacacctag

SEQ ID NO: 452420 - DNA, 25 bp, Mus musculus
ggctgcgacccaataaagatacaga

SEQ ID NO: 452421 - DNA, 25 bp, Mus musculus
ggctgcggcgcagctcatcgttcgt

SEQ ID NO: 452422 - DNA, 25 bp, Mus musculus
ggctgcggttgtacagcttcaggca

SEQ ID NO: 452423 - DNA, 25 bp, Mus musculus
ggctgctaaccaaaccaaaggaccg

SEQ ID NO: 452424 - DNA, 25 bp, Mus musculus
ggctgctacctcaaactcctttttg

SEQ ID NO: 452425 - DNA, 25 bp, Mus musculus
ggctgctcagcctttccctgttggg

SEQ ID NO: 452426 - DNA, 25 bp, Mus musculus
ggctgctcatatatcttcaggaaca

SEQ ID NO: 452427 - DNA, 25 bp, Mus musculus
ggctgctcttattccgtggacaggt

SEQ ID NO: 452428 - DNA, 25 bp, Mus musculus
ggctgctgacctaactacatattac

SEQ ID NO: 452429 - DNA, 25 bp, Mus musculus
ggctgctgctcatccatcacacatg

SEQ ID NO: 452430 - DNA, 25 bp, Mus musculus
ggctgcttcccaatacctgcgctgt

SEQ ID NO: 452431 - DNA, 25 bp, Mus musculus
ggctgcttctaatctgtcctgacca

SEQ ID NO: 452432 - DNA, 25 bp, Mus musculus
ggctgcttgctccactttcatgaga

SEQ ID NO: 452433 - DNA, 25 bp, Mus musculus
ggctgcttgtgagtccatccttgaa

SEQ ID NO: 452434 - DNA, 25 bp, Mus musculus
ggctggaaagatggagacaaatact

SEQ ID NO: 452435 - DNA, 25 bp, Mus musculus
ggctggaaggcctaaaacctctgtc

SEQ ID NO: 452436 - DNA, 25 bp, Mus musculus
ggctggacactcaaactacatctag

SEQ ID NO: 452437 - DNA, 25 bp, Mus musculus
ggctggaccagccttaggagctttt

SEQ ID NO: 452438 - DNA, 25 bp, Mus musculus
ggctggactgtagggagctttccca

SEQ ID NO: 452439 - DNA, 25 bp, Mus musculus
ggctggagaaccgtgatttcaatta

SEQ ID NO: 452440 - DNA, 25 bp, Mus musculus
ggctggagcatgaagtataaatggc

SEQ ID NO: 452441 - DNA, 25 bp, Mus musculus
ggctggagcccagattgaattccga

SEQ ID NO: 452442 - DNA, 25 bp, Mus musculus
ggctggagtctcacagctgcctcca

SEQ ID NO: 452443 - DNA, 25 bp, Mus musculus
ggctggagttgaagcaggaccaact

SEQ ID NO: 452444 - DNA, 25 bp, Mus musculus
ggctggatcagctggagacagacca

SEQ ID NO: 452445 - DNA, 25 bp, Mus musculus
ggctggatcataaaggctaatattt

SEQ ID NO: 452446 - DNA, 25 bp, Mus musculus
ggctggatcgcggagcactctcgat

SEQ ID NO: 452447 - DNA, 25 bp, Mus musculus
ggctggatgatgttggtgctggtgc

SEQ ID NO: 452448 - DNA, 25 bp, Mus musculus
ggctggcagtctggcactgaacagt

SEQ ID NO: 452449 - DNA, 25 bp, Mus musculus
ggctggcatggcacctaaggcttcg

SEQ ID NO: 452450 - DNA, 25 bp, Mus musculus
ggctggcattcttggcgtaccctga

SEQ ID NO: 452451 - DNA, 25 bp, Mus musculus
ggctggccatcctgtatcgctttga

SEQ ID NO: 452452 - DNA, 25 bp, Mus musculus
ggctggcccgtacacattataagag

SEQ ID NO: 452453 - DNA, 25 bp, Mus musculus
ggctggccctgggaaaggccacact

SEQ ID NO: 452454 - DNA, 25 bp, Mus musculus
ggctggctatccctactctaacgtg

SEQ ID NO: 452455 - DNA, 25 bp, Mus musculus
ggctggctatgagatccctgaactt

SEQ ID NO: 452456 - DNA, 25 bp, Mus musculus
ggctggctgaataattgaattgtgg

SEQ ID NO: 452457 - DNA, 25 bp, Mus musculus
ggctggcttcgggaaattaatcaca

SEQ ID NO: 452458 - DNA, 25 bp, Mus musculus
ggctgggaccacttggtagaagaac

SEQ ID NO: 452459 - DNA, 25 bp, Mus musculus
ggctgggacccttcacatcaatcaa

SEQ ID NO: 452460 - DNA, 25 bp, Mus musculus
ggctgggccaagatctctaacatga

SEQ ID NO: 452461 - DNA, 25 bp, Mus musculus
ggctgggcctttagagacttttgta

SEQ ID NO: 452462 - DNA, 25 bp, Mus musculus
ggctgggctaagagactacgaatga

SEQ ID NO: 452463 - DNA, 25 bp, Mus musculus
ggctgggtgagcacgcagccaggag

SEQ ID NO: 452464 - DNA, 25 bp, Mus musculus
ggctgggtgctcataccaatttaag

SEQ ID NO: 452465 - DNA, 25 bp, Mus musculus
ggctggtagaaacactccttccggc

SEQ ID NO: 452466 - DNA, 25 bp, Mus musculus
ggctggtgcctttgtccacgagaaa

SEQ ID NO: 452467 - DNA, 25 bp, Mus musculus
ggctggtggaaagaagaccaactgc

SEQ ID NO: 452468 - DNA, 25 bp, Mus musculus
ggctggtttctaactcagagacatc

SEQ ID NO: 452469 - DNA, 25 bp, Mus musculus
ggctgtaaccacacgagctcaggtg

SEQ ID NO: 452470 - DNA, 25 bp, Mus musculus
ggctgtaacctttctagaccggcta

SEQ ID NO: 452471 - DNA, 25 bp, Mus musculus
ggctgtagacctcgaaaccatcatg

SEQ ID NO: 452472 - DNA, 25 bp, Mus musculus
ggctgtagcttaaggcctggcttcc

SEQ ID NO: 452473 - DNA, 25 bp, Mus musculus
ggctgtagtcataagcactgtgtac

SEQ ID NO: 452474 - DNA, 25 bp, Mus musculus
ggctgtatagcattccattgcatga

SEQ ID NO: 452475 - DNA, 25 bp, Mus musculus
ggctgtatgccaactgcgaggacgt

SEQ ID NO: 452476 - DNA, 25 bp, Mus musculus
ggctgtcacttaactcctgagctta

SEQ ID NO: 452477 - DNA, 25 bp, Mus musculus
ggctgtccacactattgccagattg

SEQ ID NO: 452478 - DNA, 25 bp, Mus musculus
ggctgtccacggcaattccactgta

SEQ ID NO: 452479 - DNA, 25 bp, Mus musculus
ggctgtcccaactccctgattaaag

SEQ ID NO: 452480 - DNA, 25 bp, Mus musculus
ggctgtcccagctcaacaaggtcct

SEQ ID NO: 452481 - DNA, 25 bp, Mus musculus
ggctgtcccgtctctctgggtgtca

SEQ ID NO: 452482 - DNA, 25 bp, Mus musculus
ggctgtcgtatcctttgcctcagat

SEQ ID NO: 452483 - DNA, 25 bp, Mus musculus
ggctgtctcaagaaccaaggtcaga

SEQ ID NO: 452484 - DNA, 25 bp, Mus musculus
ggctgtgaactaacttgatttccca

SEQ ID NO: 452485 - DNA, 25 bp, Mus musculus
ggctgtgaagcatcctaaaacatta

SEQ ID NO: 452486 - DNA, 25 bp, Mus musculus
ggctgtgacctatggagcagactca

SEQ ID NO: 452487 - DNA, 25 bp, Mus musculus
ggctgtgactctacatctgcaaccg

SEQ ID NO: 452488 - DNA, 25 bp, Mus musculus
ggctgtgcactcctcttgtgctaaa

SEQ ID NO: 452489 - DNA, 25 bp, Mus musculus
ggctgtgccattgtgccagaaacat

SEQ ID NO: 452490 - DNA, 25 bp, Mus musculus
ggctgtgctcaagtgccgcctggaa

SEQ ID NO: 452491 - DNA, 25 bp, Mus musculus
ggctgtgctggcaagtatggacctt

SEQ ID NO: 452492 - DNA, 25 bp, Mus musculus
ggctgtgctggccacctaaaagata

SEQ ID NO: 452493 - DNA, 25 bp, Mus musculus
ggctgtgggacaatggccctgctaa

SEQ ID NO: 452494 - DNA, 25 bp, Mus musculus
ggctgtgtaacccaatcatacgata

SEQ ID NO: 452495 - DNA, 25 bp, Mus musculus
ggctgtgtcggtgtttcagccaccg

SEQ ID NO: 452496 - DNA, 25 bp, Mus musculus
ggctgttaccgcgagaagctcgctc

SEQ ID NO: 452497 - DNA, 25 bp, Mus musculus
ggctgttcagcaacgaggttccaca

SEQ ID NO: 452498 - DNA, 25 bp, Mus musculus
ggctgttcagcctgacaggaaagtg

SEQ ID NO: 452499 - DNA, 25 bp, Mus musculus
ggctgttctaaggtgagacttctcc

SEQ ID NO: 452500 - DNA, 25 bp, Mus musculus
ggctgtttcagatgtggaagcattt

SEQ ID NO: 452501 - DNA, 25 bp, Mus musculus
ggctgtttcatcttctcgctgggag

SEQ ID NO: 452502 - DNA, 25 bp, Mus musculus
ggctgtttgcccaaggcgacacaga

SEQ ID NO: 452503 - DNA, 25 bp, Mus musculus
ggctgttttatgtcccaaaggccca

SEQ ID NO: 452504 - DNA, 25 bp, Mus musculus
ggctgttttgctctcaccgaactga

SEQ ID NO: 452505 - DNA, 25 bp, Mus musculus
ggctgttttgcttgagacctggtta

SEQ ID NO: 452506 - DNA, 25 bp, Mus musculus
ggcttaaaatcagatactacatatg

SEQ ID NO: 452507 - DNA, 25 bp, Mus musculus
ggcttaaatacttgcctctatcttt

SEQ ID NO: 452508 - DNA, 25 bp, Mus musculus
ggcttaagagacaaacagttggatc

SEQ ID NO: 452509 - DNA, 25 bp, Mus musculus
ggcttaagtggctggccgtcctcag

SEQ ID NO: 452510 - DNA, 25 bp, Mus musculus
ggcttacacctttggcatttacatc

SEQ ID NO: 452511 - DNA, 25 bp, Mus musculus
ggcttaccagcccacttcaaagtga

SEQ ID NO: 452512 - DNA, 25 bp, Mus musculus
ggcttaccattagaaggatgcagtt

SEQ ID NO: 452513 - DNA, 25 bp, Mus musculus
ggcttaccgcagatttgtgccagca

SEQ ID NO: 452514 - DNA, 25 bp, Mus musculus
ggcttaccggcaccggctgctctgg

SEQ ID NO: 452515 - DNA, 25 bp, Mus musculus
ggcttactacgcagagccactggca

SEQ ID NO: 452516 - DNA, 25 bp, Mus musculus
ggcttactacttctccagggatgat

SEQ ID NO: 452517 - DNA, 25 bp, Mus musculus
ggcttactgccatctttcctttgag

SEQ ID NO: 452518 - DNA, 25 bp, Mus musculus
ggcttagagccaagctgctgcagct

SEQ ID NO: 452519 - DNA, 25 bp, Mus musculus
ggcttagatcccagtcgtcagacta

SEQ ID NO: 452520 - DNA, 25 bp, Mus musculus
ggcttagctgcttgcacttccctct

SEQ ID NO: 452521 - DNA, 25 bp, Mus musculus
ggcttaggtcgctatgggttccaca

SEQ ID NO: 452522 - DNA, 25 bp, Mus musculus
ggcttagtatcctttttagttgcag

SEQ ID NO: 452523 - DNA, 25 bp, Mus musculus
ggcttagtcccatgaggcctgcgca

SEQ ID NO: 452524 - DNA, 25 bp, Mus musculus
ggcttagttgctccctgaaaccgct

SEQ ID NO: 452525 - DNA, 25 bp, Mus musculus
ggcttataatcaatctcccaggtgt

SEQ ID NO: 452526 - DNA, 25 bp, Mus musculus
ggcttatagcagcagtattatgacc

SEQ ID NO: 452527 - DNA, 25 bp, Mus musculus
ggcttatgtcctggctacctgcatg

SEQ ID NO: 452528 - DNA, 25 bp, Mus musculus
ggcttcaagtcaactcccggatgga

SEQ ID NO: 452529 - DNA, 25 bp, Mus musculus
ggcttcacacattggcttccctcag

SEQ ID NO: 452530 - DNA, 25 bp, Mus musculus
ggcttcacagaccagaactaccgag

SEQ ID NO: 452531 - DNA, 25 bp, Mus musculus
ggcttcactgtaaccttagtcctga

SEQ ID NO: 452532 - DNA, 25 bp, Mus musculus
ggcttcagacaagcaataaagaaag

SEQ ID NO: 452533 - DNA, 25 bp, Mus musculus
ggcttcagacgttcccttggtccaa

SEQ ID NO: 452534 - DNA, 25 bp, Mus musculus
ggcttcaggcatcttggcactctac

SEQ ID NO: 452535 - DNA, 25 bp, Mus musculus
ggcttcagtgtcaggtgaccagtct

SEQ ID NO: 452536 - DNA, 25 bp, Mus musculus
ggcttcagtgtctgtgagtggtcac

SEQ ID NO: 452537 - DNA, 25 bp, Mus musculus
ggcttcatagttcccacccaggatt

SEQ ID NO: 452538 - DNA, 25 bp, Mus musculus
ggcttcatccgtgggccatgatgga

SEQ ID NO: 452539 - DNA, 25 bp, Mus musculus
ggcttcatgatctgccacgtgctca

SEQ ID NO: 452540 - DNA, 25 bp, Mus musculus
ggcttcatgtagttccagatgggac

SEQ ID NO: 452541 - DNA, 25 bp, Mus musculus
ggcttcattttttgtccctctgcat

SEQ ID NO: 452542 - DNA, 25 bp, Mus musculus
ggcttccaagcaaaaatcttccctg

SEQ ID NO: 452543 - DNA, 25 bp, Mus musculus
ggcttccaggacagtgacggtgaca

SEQ ID NO: 452544 - DNA, 25 bp, Mus musculus
ggcttcccacaggataggaactgaa

SEQ ID NO: 452545 - DNA, 25 bp, Mus musculus
ggcttcccagtatagcagtcatgtc

SEQ ID NO: 452546 - DNA, 25 bp, Mus musculus
ggcttcccattaaaggccagcatgc

SEQ ID NO: 452547 - DNA, 25 bp, Mus musculus
ggcttccccaaaattctatattcag

SEQ ID NO: 452548 - DNA, 25 bp, Mus musculus
ggcttccgagccaccgtaatgctag

SEQ ID NO: 452549 - DNA, 25 bp, Mus musculus
ggcttccggcaatccttctgcttca

SEQ ID NO: 452550 - DNA, 25 bp, Mus musculus
ggcttcctaacagtgacaatgatct

SEQ ID NO: 452551 - DNA, 25 bp, Mus musculus
ggcttcctatctaggaacactgaag

SEQ ID NO: 452552 - DNA, 25 bp, Mus musculus
ggcttcctcatgcacctgctttcaa

SEQ ID NO: 452553 - DNA, 25 bp, Mus musculus
ggcttcgatgcttgtatttttcaga

SEQ ID NO: 452554 - DNA, 25 bp, Mus musculus
ggcttcgcggtagacaaatctgaca

SEQ ID NO: 452555 - DNA, 25 bp, Mus musculus
ggcttcgcggtcagcggcatcgttt

SEQ ID NO: 452556 - DNA, 25 bp, Mus musculus
ggcttcgctggactatgcttctcag

SEQ ID NO: 452557 - DNA, 25 bp, Mus musculus
ggcttcgctggtgatgatgctccca

SEQ ID NO: 452558 - DNA, 25 bp, Mus musculus
ggcttcgggcttctccaacaatagt

SEQ ID NO: 452559 - DNA, 25 bp, Mus musculus
ggcttcgttcgtggctatagccgac

SEQ ID NO: 452560 - DNA, 25 bp, Mus musculus
ggcttctaactgtggcggtcggcaa

SEQ ID NO: 452561 - DNA, 25 bp, Mus musculus
ggcttctcagctggaacgctttagc

SEQ ID NO: 452562 - DNA, 25 bp, Mus musculus
ggcttctccatgtggcggcacaaca

SEQ ID NO: 452563 - DNA, 25 bp, Mus musculus
ggcttctccctgcaggtgcctggct

SEQ ID NO: 452564 - DNA, 25 bp, Mus musculus
ggcttctcgatttaggtacaggtgg

SEQ ID NO: 452565 - DNA, 25 bp, Mus musculus
ggcttctctatggttaacttctcgc

SEQ ID NO: 452566 - DNA, 25 bp, Mus musculus
ggcttctgcaaacatggacctcatg

SEQ ID NO: 452567 - DNA, 25 bp, Mus musculus
ggcttctgcaacacactgaatatcg

SEQ ID NO: 452568 - DNA, 25 bp, Mus musculus
ggcttctgccctgattccagctgga

SEQ ID NO: 452569 - DNA, 25 bp, Mus musculus
ggcttctgcgcctactcggagtgat

SEQ ID NO: 452570 - DNA, 25 bp, Mus musculus
ggcttctggcttttgctgaagtcta

SEQ ID NO: 452571 - DNA, 25 bp, Mus musculus
ggcttctgtcttgcccttgcttttc

SEQ ID NO: 452572 - DNA, 25 bp, Mus musculus
ggcttgaagagaggccacaccctca

SEQ ID NO: 452573 - DNA, 25 bp, Mus musculus
ggcttgaaggttagtccctccgcag

SEQ ID NO: 452574 - DNA, 25 bp, Mus musculus
ggcttgaatcaaccaggaccccttg

SEQ ID NO: 452575 - DNA, 25 bp, Mus musculus
ggcttgacagcaaccttagtggaca

SEQ ID NO: 452576 - DNA, 25 bp, Mus musculus
ggcttgcagcattgccggagcagaa

SEQ ID NO: 452577 - DNA, 25 bp, Mus musculus
ggcttgcatctctctaatgaagtca

SEQ ID NO: 452578 - DNA, 25 bp, Mus musculus
ggcttgccaaatgagagttggaaaa

SEQ ID NO: 452579 - DNA, 25 bp, Mus musculus
ggcttgccatcataaagataatctg

SEQ ID NO: 452580 - DNA, 25 bp, Mus musculus
ggcttgccccgatgcttagcttatt

SEQ ID NO: 452581 - DNA, 25 bp, Mus musculus
ggcttgccgacaagcatcttcacct

SEQ ID NO: 452582 - DNA, 25 bp, Mus musculus
ggcttgccgacttaaggcccagaaa

SEQ ID NO: 452583 - DNA, 25 bp, Mus musculus
ggcttgcgacccaccggacaagtgt

SEQ ID NO: 452584 - DNA, 25 bp, Mus musculus
ggcttgctggtctaccctgaggaca

SEQ ID NO: 452585 - DNA, 25 bp, Mus musculus
ggcttgcttcggaactcaacgggag

SEQ ID NO: 452586 - DNA, 25 bp, Mus musculus
ggcttgctttctggtaccacactgt

SEQ ID NO: 452587 - DNA, 25 bp, Mus musculus
ggcttggaaagaagattaccccgtg

SEQ ID NO: 452588 - DNA, 25 bp, Mus musculus
ggcttggaaatgattcaccactgga

SEQ ID NO: 452589 - DNA, 25 bp, Mus musculus
ggcttggaccaacgaaaacgaggct

SEQ ID NO: 452590 - DNA, 25 bp, Mus musculus
ggcttggacttatgggaaaacagca

SEQ ID NO: 452591 - DNA, 25 bp, Mus musculus
ggcttggagaaggaaaccgcctggg

SEQ ID NO: 452592 - DNA, 25 bp, Mus musculus
ggcttggagacaggactaaatcaga

SEQ ID NO: 452593 - DNA, 25 bp, Mus musculus
ggcttggccgctacagtgtgcagta

SEQ ID NO: 452594 - DNA, 25 bp, Mus musculus
ggcttggcctcaactgggaatggtt

SEQ ID NO: 452595 - DNA, 25 bp, Mus musculus
ggcttgggaccactgaacagatatt

SEQ ID NO: 452596 - DNA, 25 bp, Mus musculus
ggcttgggtagctaaacaaactctc

SEQ ID NO: 452597 - DNA, 25 bp, Mus musculus
ggcttgggtcttctcctcaatcgag

SEQ ID NO: 452598 - DNA, 25 bp, Mus musculus
ggcttgggttgctcacatcagtgct

SEQ ID NO: 452599 - DNA, 25 bp, Mus musculus
ggcttgtaagcatgtcccgccctgg

SEQ ID NO: 452600 - DNA, 25 bp, Mus musculus
ggcttgtagaagacagaccctctga

SEQ ID NO: 452601 - DNA, 25 bp, Mus musculus
ggcttgtccctaggatacagtagca

SEQ ID NO: 452602 - DNA, 25 bp, Mus musculus
ggcttgtcgcttactctgaggaacc

SEQ ID NO: 452603 - DNA, 25 bp, Mus musculus
ggcttgtgccagtcgctagctacat

SEQ ID NO: 452604 - DNA, 25 bp, Mus musculus
ggcttgtgcctctcccagtgcacaa

SEQ ID NO: 452605 - DNA, 25 bp, Mus musculus
ggcttgtggtcttgcggatccctga

SEQ ID NO: 452606 - DNA, 25 bp, Mus musculus
ggcttgtgttgtttcatttctcaga

SEQ ID NO: 452607 - DNA, 25 bp, Mus musculus
ggcttgttcaccaacgatgagggaa

SEQ ID NO: 452608 - DNA, 25 bp, Mus musculus
ggcttgttttccagacctgactgtg

SEQ ID NO: 452609 - DNA, 25 bp, Mus musculus
ggctttaaacggctgaacatggaca

SEQ ID NO: 452610 - DNA, 25 bp, Mus musculus
ggctttaacatcactttctaatggg

SEQ ID NO: 452611 - DNA, 25 bp, Mus musculus
ggctttaaccgcatcatagtggaga

SEQ ID NO: 452612 - DNA, 25 bp, Mus musculus
ggctttaaccggtttcgcagcaaga

SEQ ID NO: 452613 - DNA, 25 bp, Mus musculus
ggctttaagggaaacgtgtgcctga

SEQ ID NO: 452614 - DNA, 25 bp, Mus musculus
ggctttaccacgctaggctgactgg

SEQ ID NO: 452615 - DNA, 25 bp, Mus musculus
ggctttaggtgtcaaactattaaca

SEQ ID NO: 452616 - DNA, 25 bp, Mus musculus
ggctttcactgagcacacagcatgg

SEQ ID NO: 452617 - DNA, 25 bp, Mus musculus
ggctttcctcttacctcctcagtgg

SEQ ID NO: 452618 - DNA, 25 bp, Mus musculus
ggctttcctgcggagcaatcacgaa

SEQ ID NO: 452619 - DNA, 25 bp, Mus musculus
ggctttcgaggagatgacccgcaat

SEQ ID NO: 452620 - DNA, 25 bp, Mus musculus
ggctttcgagtgattttcaagcaga

SEQ ID NO: 452621 - DNA, 25 bp, Mus musculus
ggctttctcctacagacagatggca

SEQ ID NO: 452622 - DNA, 25 bp, Mus musculus
ggctttctgcctcggacagtctgga

SEQ ID NO: 452623 - DNA, 25 bp, Mus musculus
ggctttctgttggtgccatctagtg

SEQ ID NO: 452624 - DNA, 25 bp, Mus musculus
ggctttgagaggaacaccaagtcca

SEQ ID NO: 452625 - DNA, 25 bp, Mus musculus
ggctttgcatagaccatttcacaga

SEQ ID NO: 452626 - DNA, 25 bp, Mus musculus
ggctttggaccagcattttgtcttc

SEQ ID NO: 452627 - DNA, 25 bp, Mus musculus
ggctttgtaagcactatggtccata

SEQ ID NO: 452628 - DNA, 25 bp, Mus musculus
ggctttgtgccataaaactcttggg

SEQ ID NO: 452629 - DNA, 25 bp, Mus musculus
ggcttttaacggacttcaaatatgg

SEQ ID NO: 452630 - DNA, 25 bp, Mus musculus
ggcttttaagggaagattacagtgt

SEQ ID NO: 452631 - DNA, 25 bp, Mus musculus
ggcttttcaggaagtgcaccacaca

SEQ ID NO: 452632 - DNA, 25 bp, Mus musculus
ggcttttcatctccatggttacagg

SEQ ID NO: 452633 - DNA, 25 bp, Mus musculus
ggcttttgagccctacagcagacta

SEQ ID NO: 452634 - DNA, 25 bp, Mus musculus
ggcttttgcacccagatcttcgaca

SEQ ID NO: 452635 - DNA, 25 bp, Mus musculus
ggcttttgcatatccctgtgggctg

SEQ ID NO: 452636 - DNA, 25 bp, Mus musculus
ggcttttgccaacggactgaaccag

SEQ ID NO: 452637 - DNA, 25 bp, Mus musculus
ggctttttaagttagtgctgaaggc

SEQ ID NO: 452638 - DNA, 25 bp, Mus musculus
gggaaaacaccatcaagcttacgat

SEQ ID NO: 452639 - DNA, 25 bp, Mus musculus
gggaaaacagcccagcgttgactcc

SEQ ID NO: 452640 - DNA, 25 bp, Mus musculus
gggaaaacccttcatcctgctaggc

SEQ ID NO: 452641 - DNA, 25 bp, Mus musculus
gggaaaacctttagctggagctcca

SEQ ID NO: 452642 - DNA, 25 bp, Mus musculus
gggaaaactgaagcaaattgccttg

SEQ ID NO: 452643 - DNA, 25 bp, Mus musculus
gggaaaactgcaggataaagagcat

SEQ ID NO: 452644 - DNA, 25 bp, Mus musculus
gggaaaagacagcaacaacctgtgc

SEQ ID NO: 452645 - DNA, 25 bp, Mus musculus
gggaaaagagtgaagagagtcttct

SEQ ID NO: 452646 - DNA, 25 bp, Mus musculus
gggaaaagccacaatagaagactct

SEQ ID NO: 452647 - DNA, 25 bp, Mus musculus
gggaaaatccgaccagagcgccttg

SEQ ID NO: 452648 - DNA, 25 bp, Mus musculus
gggaaacaaagcaacctcaaatgag

SEQ ID NO: 452649 - DNA, 25 bp, Mus musculus
gggaaacagacttcagccagtggct

SEQ ID NO: 452650 - DNA, 25 bp, Mus musculus
gggaaacagcttcaggaccccgatc

SEQ ID NO: 452651 - DNA, 25 bp, Mus musculus
gggaaacattctctgcccagccctt

SEQ ID NO: 452652 - DNA, 25 bp, Mus musculus
gggaaaccccgagctagacaatgtg

SEQ ID NO: 452653 - DNA, 25 bp, Mus musculus
gggaaacctacagtcagaagcagct

SEQ ID NO: 452654 - DNA, 25 bp, Mus musculus
gggaaacctgaattgttgctgtaga

SEQ ID NO: 452655 - DNA, 25 bp, Mus musculus
gggaaactattctagacgcctgagc

SEQ ID NO: 452656 - DNA, 25 bp, Mus musculus
gggaaactccattgtatgtgtttcc

SEQ ID NO: 452657 - DNA, 25 bp, Mus musculus
gggaaactgtgcgacctgggcacaa

SEQ ID NO: 452658 - DNA, 25 bp, Mus musculus
gggaaacttgccctgtggttcatac

SEQ ID NO: 452659 - DNA, 25 bp, Mus musculus
gggaaagacgcttccttaactcatg

SEQ ID NO: 452660 - DNA, 25 bp, Mus musculus
gggaaagatacagaagatgggacct

SEQ ID NO: 452661 - DNA, 25 bp, Mus musculus
gggaaagatccagaaccaggtcgcg

SEQ ID NO: 452662 - DNA, 25 bp, Mus musculus
gggaaagcaccaactaccctggaga

SEQ ID NO: 452663 - DNA, 25 bp, Mus musculus
gggaaataaaatgttcttgatagag

SEQ ID NO: 452664 - DNA, 25 bp, Mus musculus
gggaaatactaccaagcttcataca

SEQ ID NO: 452665 - DNA, 25 bp, Mus musculus
gggaaatatcaatgctaatggcaat

SEQ ID NO: 452666 - DNA, 25 bp, Mus musculus
gggaaatatctgttcagccctcaca

SEQ ID NO: 452667 - DNA, 25 bp, Mus musculus
gggaaatctttgagcctgtcataca

SEQ ID NO: 452668 - DNA, 25 bp, Mus musculus
gggaaatgacacacgactcacagat

SEQ ID NO: 452669 - DNA, 25 bp, Mus musculus
gggaaattgtcgacgcctctggcta

SEQ ID NO: 452670 - DNA, 25 bp, Mus musculus
gggaacaaatcccacatgtgccggg

SEQ ID NO: 452671 - DNA, 25 bp, Mus musculus
gggaacaacggaggcccctcctgag

SEQ ID NO: 452672 - DNA, 25 bp, Mus musculus
gggaacacttctccgtggcacagag

SEQ ID NO: 452673 - DNA, 25 bp, Mus musculus
gggaacagcctgatttatacacaaa

SEQ ID NO: 452674 - DNA, 25 bp, Mus musculus
gggaacaggcctgtcccaactctga

SEQ ID NO: 452675 - DNA, 25 bp, Mus musculus
gggaacaggctttggccaccacagt

SEQ ID NO: 452676 - DNA, 25 bp, Mus musculus
gggaaccaccaagccagatctgtta

SEQ ID NO: 452677 - DNA, 25 bp, Mus musculus
gggaaccagcgcatagacctgaact

SEQ ID NO: 452678 - DNA, 25 bp, Mus musculus
gggaaccaggttcactctgggaact

SEQ ID NO: 452679 - DNA, 25 bp, Mus musculus
gggaacccaggagtttgctgcccag

SEQ ID NO: 452680 - DNA, 25 bp, Mus musculus
gggaacccctccaatgacagatcat

SEQ ID NO: 452681 - DNA, 25 bp, Mus musculus
gggaacccctcgaaattgcgtgcag

SEQ ID NO: 452682 - DNA, 25 bp, Mus musculus
gggaacccttctgtcaacaccaaga

SEQ ID NO: 452683 - DNA, 25 bp, Mus musculus
gggaacctccttccggcacgattgc

SEQ ID NO: 452684 - DNA, 25 bp, Mus musculus
gggaacgaatgcaccgtggtcctgt

SEQ ID NO: 452685 - DNA, 25 bp, Mus musculus
gggaacgagcatgataattttacaa

SEQ ID NO: 452686 - DNA, 25 bp, Mus musculus
gggaactcaacctaggacttctgca

SEQ ID NO: 452687 - DNA, 25 bp, Mus musculus
gggaactccagggtcctctgggaga

SEQ ID NO: 452688 - DNA, 25 bp, Mus musculus
gggaactcccaaacactggctcaaa

SEQ ID NO: 452689 - DNA, 25 bp, Mus musculus
gggaactcccatgggtctgataaga

SEQ ID NO: 452690 - DNA, 25 bp, Mus musculus
gggaactgccatctctccgtggacc

SEQ ID NO: 452691 - DNA, 25 bp, Mus musculus
gggaactggaaagcgctcggctctt

SEQ ID NO: 452692 - DNA, 25 bp, Mus musculus
gggaacttcaattgctagaacttga

SEQ ID NO: 452693 - DNA, 25 bp, Mus musculus
gggaacttgcaagactttgctgtgg

SEQ ID NO: 452694 - DNA, 25 bp, Mus musculus
gggaacttgtctgagtaccacagca

SEQ ID NO: 452695 - DNA, 25 bp, Mus musculus
gggaactttcaagccacctttagct

SEQ ID NO: 452696 - DNA, 25 bp, Mus musculus
gggaacttttggattgaaggaaatg

SEQ ID NO: 452697 - DNA, 25 bp, Mus musculus
gggaagaaaagcagttcaaccagga

SEQ ID NO: 452698 - DNA, 25 bp, Mus musculus
gggaagaaccaattgctgccacagt

SEQ ID NO: 452699 - DNA, 25 bp, Mus musculus
gggaagaatcctctggctaggctaa

SEQ ID NO: 452700 - DNA, 25 bp, Mus musculus
gggaagaattctaccagccatgctc

SEQ ID NO: 452701 - DNA, 25 bp, Mus musculus
gggaagactcggaccaaactgacag

SEQ ID NO: 452702 - DNA, 25 bp, Mus musculus
gggaagagatcaccccttccagaac

SEQ ID NO: 452703 - DNA, 25 bp, Mus musculus
gggaagagctatagccaagctcaga

SEQ ID NO: 452704 - DNA, 25 bp, Mus musculus
gggaagagttcctacagcgaccaaa

SEQ ID NO: 452705 - DNA, 25 bp, Mus musculus
gggaagcagctcctcaacttagtgg

SEQ ID NO: 452706 - DNA, 25 bp, Mus musculus
gggaagccactgttctgacaacgca

SEQ ID NO: 452707 - DNA, 25 bp, Mus musculus
gggaagccctgcatcattatcaagc

SEQ ID NO: 452708 - DNA, 25 bp, Mus musculus
gggaagcctgccactgtcaatcaag

SEQ ID NO: 452709 - DNA, 25 bp, Mus musculus
gggaagctaacatcaaggccgtcag

SEQ ID NO: 452710 - DNA, 25 bp, Mus musculus
gggaagctaaccaccacagtatgag

SEQ ID NO: 452711 - DNA, 25 bp, Mus musculus
gggaagctaacttgccagtggcact

SEQ ID NO: 452712 - DNA, 25 bp, Mus musculus
gggaagcttgtgtgttagattagcc

SEQ ID NO: 452713 - DNA, 25 bp, Mus musculus
gggaaggagccactggcttcttttc

SEQ ID NO: 452714 - DNA, 25 bp, Mus musculus
gggaaggcaaccacgtttacgcata

SEQ ID NO: 452715 - DNA, 25 bp, Mus musculus
gggaaggctcttgcatcctgctgca

SEQ ID NO: 452716 - DNA, 25 bp, Mus musculus
gggaaggctttcagtcagtgctcag

SEQ ID NO: 452717 - DNA, 25 bp, Mus musculus
gggaaggtcacctctcccttccgag

SEQ ID NO: 452718 - DNA, 25 bp, Mus musculus
gggaaggtccacagcctgtcaggct

SEQ ID NO: 452719 - DNA, 25 bp, Mus musculus
gggaaggttcagtgactctgaagat

SEQ ID NO: 452720 - DNA, 25 bp, Mus musculus
gggaaggttggctcattttcattga

SEQ ID NO: 452721 - DNA, 25 bp, Mus musculus
gggaagtcgcctcacagtcagatga

SEQ ID NO: 452722 - DNA, 25 bp, Mus musculus
gggaagtgaaccagtgactccagct

SEQ ID NO: 452723 - DNA, 25 bp, Mus musculus
gggaagtgttcgatccagccgagca

SEQ ID NO: 452724 - DNA, 25 bp, Mus musculus
gggaagttctttgaatacactctga

SEQ ID NO: 452725 - DNA, 25 bp, Mus musculus
gggaatacaccacgatctgcaggct

SEQ ID NO: 452726 - DNA, 25 bp, Mus musculus
gggaatcctcttgggcagtccttca

SEQ ID NO: 452727 - DNA, 25 bp, Mus musculus
gggaatcctggctacctcactggga

SEQ ID NO: 452728 - DNA, 25 bp, Mus musculus
gggaatcctttctggcacatctgac

SEQ ID NO: 452729 - DNA, 25 bp, Mus musculus
gggaatcgagaagcgtccccagcag

SEQ ID NO: 452730 - DNA, 25 bp, Mus musculus
gggaatctaatatcagctacctgtc

SEQ ID NO: 452731 - DNA, 25 bp, Mus musculus
gggaatctccaccattaacagaggg

SEQ ID NO: 452732 - DNA, 25 bp, Mus musculus
gggaatctgtactgttgacctcatg

SEQ ID NO: 452733 - DNA, 25 bp, Mus musculus
gggaatgtcaagtccttttggcata

SEQ ID NO: 452734 - DNA, 25 bp, Mus musculus
gggaatgtcccaggaacctcaatca

SEQ ID NO: 452735 - DNA, 25 bp, Mus musculus
gggaatgttggaaagagcaagcacc

SEQ ID NO: 452736 - DNA, 25 bp, Mus musculus
gggaattcaagtggctggcctcaca

SEQ ID NO: 452737 - DNA, 25 bp, Mus musculus
gggaattccactgtaatacgtttca

SEQ ID NO: 452738 - DNA, 25 bp, Mus musculus
gggaattcccaaaaacactgcacga

SEQ ID NO: 452739 - DNA, 25 bp, Mus musculus
gggaattctcctaaataatacatgt

SEQ ID NO: 452740 - DNA, 25 bp, Mus musculus
gggaattgaccagctatgctcctgt

SEQ ID NO: 452741 - DNA, 25 bp, Mus musculus
gggaatttccttgtcatagccgtga

SEQ ID NO: 452742 - DNA, 25 bp, Mus musculus
gggaatttctacaagccaggcgagc

SEQ ID NO: 452743 - DNA, 25 bp, Mus musculus
gggaatttgtcctgctctgggctga

SEQ ID NO: 452744 - DNA, 25 bp, Mus musculus
gggacaaaatgctccacccaaacct

SEQ ID NO: 452745 - DNA, 25 bp, Mus musculus
gggacaaactgtactatgctggatt

SEQ ID NO: 452746 - DNA, 25 bp, Mus musculus
gggacaaataatcaccaggaagtag

SEQ ID NO: 452747 - DNA, 25 bp, Mus musculus
gggacaacagttgccacagggagtt

SEQ ID NO: 452748 - DNA, 25 bp, Mus musculus
gggacaaccagcaggtaaggccagc

SEQ ID NO: 452749 - DNA, 25 bp, Mus musculus
gggacaacgtgtggcctgactgctc

SEQ ID NO: 452750 - DNA, 25 bp, Mus musculus
gggacaagacgccttcagagcagat

SEQ ID NO: 452751 - DNA, 25 bp, Mus musculus
gggacaagagatttctggcactgct

SEQ ID NO: 452752 - DNA, 25 bp, Mus musculus
gggacaagtcgagcggcaagcacta

SEQ ID NO: 452753 - DNA, 25 bp, Mus musculus
gggacaagtttgtctgcttgagtga

SEQ ID NO: 452754 - DNA, 25 bp, Mus musculus
gggacaataacccactggcagtgaa

SEQ ID NO: 452755 - DNA, 25 bp, Mus musculus
gggacaatgcacaatggctgggcct

SEQ ID NO: 452756 - DNA, 25 bp, Mus musculus
gggacacaaaagggaactctagctg

SEQ ID NO: 452757 - DNA, 25 bp, Mus musculus
gggacacaaggccaatcactccttc

SEQ ID NO: 452758 - DNA, 25 bp, Mus musculus
gggacacacacctggactagtgtta

SEQ ID NO: 452759 - DNA, 25 bp, Mus musculus
gggacacaccttccctaggcctgag

SEQ ID NO: 452760 - DNA, 25 bp, Mus musculus
gggacacacggtgcaatcaagccag

SEQ ID NO: 452761 - DNA, 25 bp, Mus musculus
gggacacagtgtcaggagcctcact

SEQ ID NO: 452762 - DNA, 25 bp, Mus musculus
gggacaccgccctgttatatttaag

SEQ ID NO: 452763 - DNA, 25 bp, Mus musculus
gggacaccttcctgagttgacggct

SEQ ID NO: 452764 - DNA, 25 bp, Mus musculus
gggacacggaacacctatctgctgc

SEQ ID NO: 452765 - DNA, 25 bp, Mus musculus
gggacacgtgtcttcatgcttttgt

SEQ ID NO: 452766 - DNA, 25 bp, Mus musculus
gggacactaacagttcctagccgag

SEQ ID NO: 452767 - DNA, 25 bp, Mus musculus
gggacactgggcttgtaggccccta

SEQ ID NO: 452768 - DNA, 25 bp, Mus musculus
gggacactgtgaccaagatctgcgt

SEQ ID NO: 452769 - DNA, 25 bp, Mus musculus
gggacacttctcctgccgatcaaga

SEQ ID NO: 452770 - DNA, 25 bp, Mus musculus
gggacacttgctcaggactggcact

SEQ ID NO: 452771 - DNA, 25 bp, Mus musculus
gggacacttttccagacccacaggc

SEQ ID NO: 452772 - DNA, 25 bp, Mus musculus
gggacagaaagcctcacagatgcct

SEQ ID NO: 452773 - DNA, 25 bp, Mus musculus
gggacagaactccagcccattgtga

SEQ ID NO: 452774 - DNA, 25 bp, Mus musculus
gggacagacaaactacccagcagac

SEQ ID NO: 452775 - DNA, 25 bp, Mus musculus
gggacagactgtccacacctggctg

SEQ ID NO: 452776 - DNA, 25 bp, Mus musculus
gggacagagtgctccaatggttatc

SEQ ID NO: 452777 - DNA, 25 bp, Mus musculus
gggacagcaccaaggacacatggaa

SEQ ID NO: 452778 - DNA, 25 bp, Mus musculus
gggacagcagcgagatccaagcccg

SEQ ID NO: 452779 - DNA, 25 bp, Mus musculus
gggacagcatctctagggacagcat

SEQ ID NO: 452780 - DNA, 25 bp, Mus musculus
gggacagccaaatcacagccattga

SEQ ID NO: 452781 - DNA, 25 bp, Mus musculus
gggacagcccactgaacatcaagca

SEQ ID NO: 452782 - DNA, 25 bp, Mus musculus
gggacagccctacttttcagtggaa

SEQ ID NO: 452783 - DNA, 25 bp, Mus musculus
gggacagccgcatctagacttttat

SEQ ID NO: 452784 - DNA, 25 bp, Mus musculus
gggacagcctgttgagaaatcttcg

SEQ ID NO: 452785 - DNA, 25 bp, Mus musculus
gggacagccttcttcatgtacaatg

SEQ ID NO: 452786 - DNA, 25 bp, Mus musculus
gggacagcttttcactacaagagac

SEQ ID NO: 452787 - DNA, 25 bp, Mus musculus
gggacaggcaacgttgacgtctgat

SEQ ID NO: 452788 - DNA, 25 bp, Mus musculus
gggacaggcaagactttcaccatgg

SEQ ID NO: 452789 - DNA, 25 bp, Mus musculus
gggacaggcactgtctaaataaatt

SEQ ID NO: 452790 - DNA, 25 bp, Mus musculus
gggacagtatgtaaccactgatcac

SEQ ID NO: 452791 - DNA, 25 bp, Mus musculus
gggacagtctctaattcctgatgaa

SEQ ID NO: 452792 - DNA, 25 bp, Mus musculus
gggacatatcctccgccctgaggac

SEQ ID NO: 452793 - DNA, 25 bp, Mus musculus
gggacatcacctatcgcttccaggg

SEQ ID NO: 452794 - DNA, 25 bp, Mus musculus
gggacatccctgaccttcgggtttg

SEQ ID NO: 452795 - DNA, 25 bp, Mus musculus
gggacattagctgcccaagtgacat

SEQ ID NO: 452796 - DNA, 25 bp, Mus musculus
gggacattcacacccacctaaagag

SEQ ID NO: 452797 - DNA, 25 bp, Mus musculus
gggacattccggtgcacctagaaac

SEQ ID NO: 452798 - DNA, 25 bp, Mus musculus
gggacattcgggactcagatccaga

SEQ ID NO: 452799 - DNA, 25 bp, Mus musculus
gggacattgaaaaaagctgctgtgc

SEQ ID NO: 452800 - DNA, 25 bp, Mus musculus
gggacattgcgaaaccggatcagga

SEQ ID NO: 452801 - DNA, 25 bp, Mus musculus
gggacattgctgaccgcttcaacgt

SEQ ID NO: 452802 - DNA, 25 bp, Mus musculus
gggacattggaaggacaaactcatc

SEQ ID NO: 452803 - DNA, 25 bp, Mus musculus
gggacatttccctcaacgcgctgat

SEQ ID NO: 452804 - DNA, 25 bp, Mus musculus
gggaccaaatgcagaccagggttga

SEQ ID NO: 452805 - DNA, 25 bp, Mus musculus
gggaccacctgatcttctggagtca

SEQ ID NO: 452806 - DNA, 25 bp, Mus musculus
gggaccacgctaaggaatctggaga

SEQ ID NO: 452807 - DNA, 25 bp, Mus musculus
gggaccacgtgagcacgggctactt

SEQ ID NO: 452808 - DNA, 25 bp, Mus musculus
gggaccatgcactactgagcctgag

SEQ ID NO: 452809 - DNA, 25 bp, Mus musculus
gggaccatgctctgaactccttcat

SEQ ID NO: 452810 - DNA, 25 bp, Mus musculus
gggacccaagctgaaggcaactctg

SEQ ID NO: 452811 - DNA, 25 bp, Mus musculus
gggacccatgttcatcattattagc

SEQ ID NO: 452812 - DNA, 25 bp, Mus musculus
gggaccccaaatacttctccgtgtg

SEQ ID NO: 452813 - DNA, 25 bp, Mus musculus
gggaccccactgcatacttccgtgt

SEQ ID NO: 452814 - DNA, 25 bp, Mus musculus
gggaccccggagacccatgctcagg

SEQ ID NO: 452815 - DNA, 25 bp, Mus musculus
gggacccctcaagttctcagagaag

SEQ ID NO: 452816 - DNA, 25 bp, Mus musculus
gggacccctgccttgtgatgtacaa

SEQ ID NO: 452817 - DNA, 25 bp, Mus musculus
gggaccctgagttaaaaacctgctg

SEQ ID NO: 452818 - DNA, 25 bp, Mus musculus
gggaccctgattatttaaacaccag

SEQ ID NO: 452819 - DNA, 25 bp, Mus musculus
gggaccctgcggtccttccgagaga

SEQ ID NO: 452820 - DNA, 25 bp, Mus musculus
gggaccctggcagcaactgcagttc

SEQ ID NO: 452821 - DNA, 25 bp, Mus musculus
gggaccctgggaaagaatccacatg

SEQ ID NO: 452822 - DNA, 25 bp, Mus musculus
gggacccttttctcaccagcagagg

SEQ ID NO: 452823 - DNA, 25 bp, Mus musculus
gggaccgactagaccaaccagtgat

SEQ ID NO: 452824 - DNA, 25 bp, Mus musculus
gggaccgaggctgccagattccagc

SEQ ID NO: 452825 - DNA, 25 bp, Mus musculus
gggaccggccttcattttcctgaca

SEQ ID NO: 452826 - DNA, 25 bp, Mus musculus
gggaccggtcttccccagagcagct

SEQ ID NO: 452827 - DNA, 25 bp, Mus musculus
gggacctacacgtttcacctgaaag

SEQ ID NO: 452828 - DNA, 25 bp, Mus musculus
gggacctcacgcagatggctgatga

SEQ ID NO: 452829 - DNA, 25 bp, Mus musculus
gggacctcattttcccctggtctgg

SEQ ID NO: 452830 - DNA, 25 bp, Mus musculus
gggacctccgctgccatgaaaatta

SEQ ID NO: 452831 - DNA, 25 bp, Mus musculus
gggacctcggaagcttgcttccctg

SEQ ID NO: 452832 - DNA, 25 bp, Mus musculus
gggacctgagattcccaggccactt

SEQ ID NO: 452833 - DNA, 25 bp, Mus musculus
gggacctgctcctggatccggcctg

SEQ ID NO: 452834 - DNA, 25 bp, Mus musculus
gggacctgggatgaccacttaatga

SEQ ID NO: 452835 - DNA, 25 bp, Mus musculus
gggacctgggctatgtatacctcaa

SEQ ID NO: 452836 - DNA, 25 bp, Mus musculus
gggaccttcctctgcaaaactgtga

SEQ ID NO: 452837 - DNA, 25 bp, Mus musculus
gggaccttgcccacttagctgctga

SEQ ID NO: 452838 - DNA, 25 bp, Mus musculus
gggacgcagcagacagctcctagct

SEQ ID NO: 452839 - DNA, 25 bp, Mus musculus
gggacgccaacagccgtagtcatgg

SEQ ID NO: 452840 - DNA, 25 bp, Mus musculus
gggacgcgagccaacactggtgtct

SEQ ID NO: 452841 - DNA, 25 bp, Mus musculus
gggacgcgtgcacacagctgcttta

SEQ ID NO: 452842 - DNA, 25 bp, Mus musculus
gggacgctacagaaatcactactga

SEQ ID NO: 452843 - DNA, 25 bp, Mus musculus
gggacggaagatgcctccttgcacg

SEQ ID NO: 452844 - DNA, 25 bp, Mus musculus
gggacgggacttcgctatcttcaga

SEQ ID NO: 452845 - DNA, 25 bp, Mus musculus
gggacggtgcccattcagccatttg

SEQ ID NO: 452846 - DNA, 25 bp, Mus musculus
gggacgtcacggaattttcaacatg

SEQ ID NO: 452847 - DNA, 25 bp, Mus musculus
gggacgtcattccaagaaccactca

SEQ ID NO: 452848 - DNA, 25 bp, Mus musculus
gggacgtctcacactgtggattccc

SEQ ID NO: 452849 - DNA, 25 bp, Mus musculus
gggacgtgagcaagaacatggcccc

SEQ ID NO: 452850 - DNA, 25 bp, Mus musculus
gggacgtttgtattctggccgacag

SEQ ID NO: 452851 - DNA, 25 bp, Mus musculus
gggactaaagatgtgaacaaccact

SEQ ID NO: 452852 - DNA, 25 bp, Mus musculus
gggactaggactacaaaccctggtg

SEQ ID NO: 452853 - DNA, 25 bp, Mus musculus
gggactcaagacagccttccgtgga

SEQ ID NO: 452854 - DNA, 25 bp, Mus musculus
gggactcacctaccagctgtgttgt

SEQ ID NO: 452855 - DNA, 25 bp, Mus musculus
gggactcacgggactggatgcaact

SEQ ID NO: 452856 - DNA, 25 bp, Mus musculus
gggactcactgtatcaccctgactg

SEQ ID NO: 452857 - DNA, 25 bp, Mus musculus
gggactcagccacgtactgcctact

SEQ ID NO: 452858 - DNA, 25 bp, Mus musculus
gggactccaaatgatcaggcagtgt

SEQ ID NO: 452859 - DNA, 25 bp, Mus musculus
gggactccacaggtcaccgggttct

SEQ ID NO: 452860 - DNA, 25 bp, Mus musculus
gggactccagtgcatcatgcttttg

SEQ ID NO: 452861 - DNA, 25 bp, Mus musculus
gggactcctcactctcaggttcatg

SEQ ID NO: 452862 - DNA, 25 bp, Mus musculus
gggactcctcctttgtgttcacaga

SEQ ID NO: 452863 - DNA, 25 bp, Mus musculus
gggactcctgaaagccctgaaggtt

SEQ ID NO: 452864 - DNA, 25 bp, Mus musculus
gggactcctgcctgagccaaatctt

SEQ ID NO: 452865 - DNA, 25 bp, Mus musculus
gggactcctggaatagcctctggga

SEQ ID NO: 452866 - DNA, 25 bp, Mus musculus
gggactcggtaaaatggcactacct

SEQ ID NO: 452867 - DNA, 25 bp, Mus musculus
gggactcttcattcaggccgtggca

SEQ ID NO: 452868 - DNA, 25 bp, Mus musculus
gggactgacttatgctggcctgcca

SEQ ID NO: 452869 - DNA, 25 bp, Mus musculus
gggactgagccttcttttccccact

SEQ ID NO: 452870 - DNA, 25 bp, Mus musculus
gggactgcaagatgatgccctacag

SEQ ID NO: 452871 - DNA, 25 bp, Mus musculus
gggactgcacctcttaaaaagttgc

SEQ ID NO: 452872 - DNA, 25 bp, Mus musculus
gggactgcagtgatgcctccatggt

SEQ ID NO: 452873 - DNA, 25 bp, Mus musculus
gggactgccctctatgacagacttc

SEQ ID NO: 452874 - DNA, 25 bp, Mus musculus
gggactggagcaagccccggctgct

SEQ ID NO: 452875 - DNA, 25 bp, Mus musculus
gggactggcaactataacatcgagg

SEQ ID NO: 452876 - DNA, 25 bp, Mus musculus
gggactgtatcaaccccaagtaccg

SEQ ID NO: 452877 - DNA, 25 bp, Mus musculus
gggactgtcacccaagattcctgag

SEQ ID NO: 452878 - DNA, 25 bp, Mus musculus
gggactgtcattctcagtatcatgt

SEQ ID NO: 452879 - DNA, 25 bp, Mus musculus
gggactgtctgctgacaaagctgtg

SEQ ID NO: 452880 - DNA, 25 bp, Mus musculus
gggactgttactcaacctcttctta

SEQ ID NO: 452881 - DNA, 25 bp, Mus musculus
gggactgtttcctgtatttacctgg

SEQ ID NO: 452882 - DNA, 25 bp, Mus musculus
gggacttattcagacaccggaccaa

SEQ ID NO: 452883 - DNA, 25 bp, Mus musculus
gggacttccaagatctgaacacgaa

SEQ ID NO: 452884 - DNA, 25 bp, Mus musculus
gggacttgacacacctatccagggt

SEQ ID NO: 452885 - DNA, 25 bp, Mus musculus
gggacttgatgccaacgcctgctaa

SEQ ID NO: 452886 - DNA, 25 bp, Mus musculus
gggacttgcgccaataaagctttgt

SEQ ID NO: 452887 - DNA, 25 bp, Mus musculus
gggacttgtccctgattctgcataa

SEQ ID NO: 452888 - DNA, 25 bp, Mus musculus
gggactttcccattctcagctgagg

SEQ ID NO: 452889 - DNA, 25 bp, Mus musculus
gggacttttctgcagcatgccagag

SEQ ID NO: 452890 - DNA, 25 bp, Mus musculus
gggacttttgtcacacgccacttca

SEQ ID NO: 452891 - DNA, 25 bp, Mus musculus
gggagaacaaaatgctgtagcctga

SEQ ID NO: 452892 - DNA, 25 bp, Mus musculus
gggagaacctaatgcaagtgtgcct

SEQ ID NO: 452893 - DNA, 25 bp, Mus musculus
gggagaacttcaccgagaccgatgt

SEQ ID NO: 452894 - DNA, 25 bp, Mus musculus
gggagaagagggattaccttcgcac

SEQ ID NO: 452895 - DNA, 25 bp, Mus musculus
gggagacacctcacggctggaagcc

SEQ ID NO: 452896 - DNA, 25 bp, Mus musculus
gggagacgtccctgatcattggctt

SEQ ID NO: 452897 - DNA, 25 bp, Mus musculus
gggagactaccagacttcaccattg

SEQ ID NO: 452898 - DNA, 25 bp, Mus musculus
gggagactccacttgcgctatggca

SEQ ID NO: 452899 - DNA, 25 bp, Mus musculus
gggagactccctctatccagtcggt

SEQ ID NO: 452900 - DNA, 25 bp, Mus musculus
gggagacttacattcctgcctgttt

SEQ ID NO: 452901 - DNA, 25 bp, Mus musculus
gggagacttagcgtggaacccactg

SEQ ID NO: 452902 - DNA, 25 bp, Mus musculus
gggagagagggactttacacacacc

SEQ ID NO: 452903 - DNA, 25 bp, Mus musculus
gggagagcaagcagaacgcagttcc

SEQ ID NO: 452904 - DNA, 25 bp, Mus musculus
gggagagcacttcgtacctgtcacc

SEQ ID NO: 452905 - DNA, 25 bp, Mus musculus
gggagagcctcctttgtctcgcttg

SEQ ID NO: 452906 - DNA, 25 bp, Mus musculus
gggagaggcagtcttcaaaactcaa

SEQ ID NO: 452907 - DNA, 25 bp, Mus musculus
gggagatagatcatagacagggaca

SEQ ID NO: 452908 - DNA, 25 bp, Mus musculus
gggagatatagaaagcgcctcttgt

SEQ ID NO: 452909 - DNA, 25 bp, Mus musculus
gggagatcaacatatgtgaatttcc

SEQ ID NO: 452910 - DNA, 25 bp, Mus musculus
gggagatcagcttcaggacaaatgt

SEQ ID NO: 452911 - DNA, 25 bp, Mus musculus
gggagatcccctttgatgcctgcat

SEQ ID NO: 452912 - DNA, 25 bp, Mus musculus
gggagatcggcatcagcaatgccct

SEQ ID NO: 452913 - DNA, 25 bp, Mus musculus
gggagatcgttcctagcctaacaca

SEQ ID NO: 452914 - DNA, 25 bp, Mus musculus
gggagatggcccagacctcttcttc

SEQ ID NO: 452915 - DNA, 25 bp, Mus musculus
gggagattttccctcagacgctttg

SEQ ID NO: 452916 - DNA, 25 bp, Mus musculus
gggagcactgacaaaagaactctgc

SEQ ID NO: 452917 - DNA, 25 bp, Mus musculus
gggagcagatcatgaccaccaacgt

SEQ ID NO: 452918 - DNA, 25 bp, Mus musculus
gggagcatcatccagggccgaaatc

SEQ ID NO: 452919 - DNA, 25 bp, Mus musculus
gggagcatttaacaaccagtaaggc

SEQ ID NO: 452920 - DNA, 25 bp, Mus musculus
gggagccaaacaaaattgctatgct

SEQ ID NO: 452921 - DNA, 25 bp, Mus musculus
gggagccaaacctctttactggagc

SEQ ID NO: 452922 - DNA, 25 bp, Mus musculus
gggagccacccatctttagcaagga

SEQ ID NO: 452923 - DNA, 25 bp, Mus musculus
gggagccagacacctctttctcatg

SEQ ID NO: 452924 - DNA, 25 bp, Mus musculus
gggagccagccgcattcttaaggat

SEQ ID NO: 452925 - DNA, 25 bp, Mus musculus
gggagcccagcttctactgcagtca

SEQ ID NO: 452926 - DNA, 25 bp, Mus musculus
gggagcccatatatattttgttcat

SEQ ID NO: 452927 - DNA, 25 bp, Mus musculus
gggagccctagagaacaagggttca

SEQ ID NO: 452928 - DNA, 25 bp, Mus musculus
gggagccggcatcaaatcatcagca

SEQ ID NO: 452929 - DNA, 25 bp, Mus musculus
gggagcctagccaaagcctagccaa

SEQ ID NO: 452930 - DNA, 25 bp, Mus musculus
gggagcctcctgaagaactcaaata

SEQ ID NO: 452931 - DNA, 25 bp, Mus musculus
gggagcctctcgaacagtcacgcct

SEQ ID NO: 452932 - DNA, 25 bp, Mus musculus
gggagcctggatttaactggcgact

SEQ ID NO: 452933 - DNA, 25 bp, Mus musculus
gggagccttcatacggcctactggc

SEQ ID NO: 452934 - DNA, 25 bp, Mus musculus
gggagcgccgatggatcttccccaa

SEQ ID NO: 452935 - DNA, 25 bp, Mus musculus
gggagcggacaaggctccttttact

SEQ ID NO: 452936 - DNA, 25 bp, Mus musculus
gggagcggccctacttgtgcattca

SEQ ID NO: 452937 - DNA, 25 bp, Mus musculus
gggagcgtccgctcgcccattgact

SEQ ID NO: 452938 - DNA, 25 bp, Mus musculus
gggagcgtgcattttgtcataagtt

SEQ ID NO: 452939 - DNA, 25 bp, Mus musculus
gggagctaagtcctccatggcgatt

SEQ ID NO: 452940 - DNA, 25 bp, Mus musculus
gggagctcaccctactgttcaggct

SEQ ID NO: 452941 - DNA, 25 bp, Mus musculus
gggagctcggaactgaaagcttact

SEQ ID NO: 452942 - DNA, 25 bp, Mus musculus
gggagctctaggtggcttaaatact

SEQ ID NO: 452943 - DNA, 25 bp, Mus musculus
gggagctgagatccctagtcactcc

SEQ ID NO: 452944 - DNA, 25 bp, Mus musculus
gggagctgtcttattgtctctcaca

SEQ ID NO: 452945 - DNA, 25 bp, Mus musculus
gggagcttccctaaggcacgactga

SEQ ID NO: 452946 - DNA, 25 bp, Mus musculus
gggagcttcggcaacattccaaact

SEQ ID NO: 452947 - DNA, 25 bp, Mus musculus
gggagcttttcatcctgatctgcag

SEQ ID NO: 452948 - DNA, 25 bp, Mus musculus
gggaggaaccactacacgaagcttt

SEQ ID NO: 452949 - DNA, 25 bp, Mus musculus
gggaggaactatgcagatcacgtca

SEQ ID NO: 452950 - DNA, 25 bp, Mus musculus
gggaggaatctgttctatgtctgcc

SEQ ID NO: 452951 - DNA, 25 bp, Mus musculus
gggaggagaccccactctattttgc

SEQ ID NO: 452952 - DNA, 25 bp, Mus musculus
gggaggagttcaacaaatatttggg

SEQ ID NO: 452953 - DNA, 25 bp, Mus musculus
gggaggcagaactgatgggcgcagc

SEQ ID NO: 452954 - DNA, 25 bp, Mus musculus
gggaggccaaagagtcaagtgtttt

SEQ ID NO: 452955 - DNA, 25 bp, Mus musculus
gggaggccctcaatagctactatct

SEQ ID NO: 452956 - DNA, 25 bp, Mus musculus
gggaggcctggcttcacaaatgacc

SEQ ID NO: 452957 - DNA, 25 bp, Mus musculus
gggaggctcacaatactggatcaga

SEQ ID NO: 452958 - DNA, 25 bp, Mus musculus
gggaggctcagaccttctagacaag

SEQ ID NO: 452959 - DNA, 25 bp, Mus musculus
gggaggtcctcgtctctgtgacaaa

SEQ ID NO: 452960 - DNA, 25 bp, Mus musculus
gggaggtctttgactccagcctccc

SEQ ID NO: 452961 - DNA, 25 bp, Mus musculus
gggagtacaagccaaatgtacatga

SEQ ID NO: 452962 - DNA, 25 bp, Mus musculus
gggagtactattgagtgcacgccag

SEQ ID NO: 452963 - DNA, 25 bp, Mus musculus
gggagtatttctgcgtcctccgcga

SEQ ID NO: 452964 - DNA, 25 bp, Mus musculus
gggagtcaactccatcagatgaggt

SEQ ID NO: 452965 - DNA, 25 bp, Mus musculus
gggagtcaccacatctcagcagcaa

SEQ ID NO: 452966 - DNA, 25 bp, Mus musculus
gggagtccagcctgtaatgctctgt

SEQ ID NO: 452967 - DNA, 25 bp, Mus musculus
gggagtccagcttcgacctagcaga

SEQ ID NO: 452968 - DNA, 25 bp, Mus musculus
gggagtcccttccatgacctgctca

SEQ ID NO: 452969 - DNA, 25 bp, Mus musculus
gggagtcccttctgagctacttcca

SEQ ID NO: 452970 - DNA, 25 bp, Mus musculus
gggagtcgttcctctacagatctga

SEQ ID NO: 452971 - DNA, 25 bp, Mus musculus
gggagtctacattcaccgaaccgat

SEQ ID NO: 452972 - DNA, 25 bp, Mus musculus
gggagtctcctacaccaggctacat

SEQ ID NO: 452973 - DNA, 25 bp, Mus musculus
gggagtctcctttagcaaccctaga

SEQ ID NO: 452974 - DNA, 25 bp, Mus musculus
gggagtgaagtcctagtccaacact

SEQ ID NO: 452975 - DNA, 25 bp, Mus musculus
gggagtgacctctaacatacgtaag

SEQ ID NO: 452976 - DNA, 25 bp, Mus musculus
gggagtgcacacttcctgctaagtc

SEQ ID NO: 452977 - DNA, 25 bp, Mus musculus
gggagtgcctgctggctgatctcca

SEQ ID NO: 452978 - DNA, 25 bp, Mus musculus
gggagtggactctggcctgtaccta

SEQ ID NO: 452979 - DNA, 25 bp, Mus musculus
gggagtgttaggacatttaaaagca

SEQ ID NO: 452980 - DNA, 25 bp, Mus musculus
gggagttcactcaccgtacctgtag

SEQ ID NO: 452981 - DNA, 25 bp, Mus musculus
gggagttctgactttggccattaga

SEQ ID NO: 452982 - DNA, 25 bp, Mus musculus
gggagttcttcataccacaaggtgt

SEQ ID NO: 452983 - DNA, 25 bp, Mus musculus
gggagtttccagcacatctggaatg

SEQ ID NO: 452984 - DNA, 25 bp, Mus musculus
gggataacagccactacaaggacag

SEQ ID NO: 452985 - DNA, 25 bp, Mus musculus
gggatacaagaagcactaccaggcc

SEQ ID NO: 452986 - DNA, 25 bp, Mus musculus
gggatacagcccgagaagtgcctgc

SEQ ID NO: 452987 - DNA, 25 bp, Mus musculus
gggatacgtgtgaaaactttctagc

SEQ ID NO: 452988 - DNA, 25 bp, Mus musculus
gggatactcccttcggaaaacagct

SEQ ID NO: 452989 - DNA, 25 bp, Mus musculus
gggatactgttccagcacgtacaag

SEQ ID NO: 452990 - DNA, 25 bp, Mus musculus
gggatagatattacgtgcggccgcc

SEQ ID NO: 452991 - DNA, 25 bp, Mus musculus
gggatataaccaacaccagggacca

SEQ ID NO: 452992 - DNA, 25 bp, Mus musculus
gggatattcttcaatatgcttgcaa

SEQ ID NO: 452993 - DNA, 25 bp, Mus musculus
gggatattgctctctacctgtaccg

SEQ ID NO: 452994 - DNA, 25 bp, Mus musculus
gggatcaaacacagcagtatgaaga

SEQ ID NO: 452995 - DNA, 25 bp, Mus musculus
gggatcacagtcagtaaccactatg

SEQ ID NO: 452996 - DNA, 25 bp, Mus musculus
gggatcacgtccgtcctgtggccga

SEQ ID NO: 452997 - DNA, 25 bp, Mus musculus
gggatcagcagccacacgaggttta

SEQ ID NO: 452998 - DNA, 25 bp, Mus musculus
gggatcaggatctacagccaatcag

SEQ ID NO: 452999 - DNA, 25 bp, Mus musculus
gggatcagggctagacgcttactct

SEQ ID NO: 453000 - DNA, 25 bp, Mus musculus
gggatcaggtgtgccctttaaatgt

SEQ ID NO: 453001 - DNA, 25 bp, Mus musculus
gggatcatcgaatacccctttgact

SEQ ID NO: 453002 - DNA, 25 bp, Mus musculus
gggatcattacacggcacaacctga

SEQ ID NO: 453003 - DNA, 25 bp, Mus musculus
gggatccagaaatcacggccctcaa

SEQ ID NO: 453004 - DNA, 25 bp, Mus musculus
gggatccatgaaagagccacctttt

SEQ ID NO: 453005 - DNA, 25 bp, Mus musculus
gggatcccacaatggccaagtttgg

SEQ ID NO: 453006 - DNA, 25 bp, Mus musculus
gggatcccacgtacatgggagtgca

SEQ ID NO: 453007 - DNA, 25 bp, Mus musculus
gggatcccctgtttgatacgctgag

SEQ ID NO: 453008 - DNA, 25 bp, Mus musculus
gggatccctaccgattcaagaagcg

SEQ ID NO: 453009 - DNA, 25 bp, Mus musculus
gggatcccttcaatggccagagacc

SEQ ID NO: 453010 - DNA, 25 bp, Mus musculus
gggatccgcggcttctacaaaggga

SEQ ID NO: 453011 - DNA, 25 bp, Mus musculus
gggatcctaggttcaaggctgcagt

SEQ ID NO: 453012 - DNA, 25 bp, Mus musculus
gggatcctatgccttcttttgactt

SEQ ID NO: 453013 - DNA, 25 bp, Mus musculus
gggatcctatttaagagatatgctg

SEQ ID NO: 453014 - DNA, 25 bp, Mus musculus
gggatcctcgtcttccaggttctaa

SEQ ID NO: 453015 - DNA, 25 bp, Mus musculus
gggatcctctcaatggccactgcta

SEQ ID NO: 453016 - DNA, 25 bp, Mus musculus
gggatcctgatcgtgctaagctcgg

SEQ ID NO: 453017 - DNA, 25 bp, Mus musculus
gggatcctgtaattctggcatatta

SEQ ID NO: 453018 - DNA, 25 bp, Mus musculus
gggatccttcctctactgtcaaccg

SEQ ID NO: 453019 - DNA, 25 bp, Mus musculus
gggatcgcaataccatgctggccaa

SEQ ID NO: 453020 - DNA, 25 bp, Mus musculus
gggatcggactttggcacctcctcc

SEQ ID NO: 453021 - DNA, 25 bp, Mus musculus
gggatcggcaaccacggctttctga

SEQ ID NO: 453022 - DNA, 25 bp, Mus musculus
gggatcgtttgcatcgggcccaatg

SEQ ID NO: 453023 - DNA, 25 bp, Mus musculus
gggatctcagccatagtcgttggct

SEQ ID NO: 453024 - DNA, 25 bp, Mus musculus
gggatctccaaatctgcagccagga

SEQ ID NO: 453025 - DNA, 25 bp, Mus musculus
gggatctgggtcaacaagtcttgct

SEQ ID NO: 453026 - DNA, 25 bp, Mus musculus
gggatcttgatattgtgctacacac

SEQ ID NO: 453027 - DNA, 25 bp, Mus musculus
gggatctttccgggccggtcctctg

SEQ ID NO: 453028 - DNA, 25 bp, Mus musculus
gggatgaacagacaaattggattag

SEQ ID NO: 453029 - DNA, 25 bp, Mus musculus
gggatgaagaacagcggcttcattc

SEQ ID NO: 453030 - DNA, 25 bp, Mus musculus
gggatgaagatcagcgagaatcctc

SEQ ID NO: 453031 - DNA, 25 bp, Mus musculus
gggatgaccattctgcaactacacg

SEQ ID NO: 453032 - DNA, 25 bp, Mus musculus
gggatgacttctctcgtcgctaccg

SEQ ID NO: 453033 - DNA, 25 bp, Mus musculus
gggatgcaaccgctaaccctgatga

SEQ ID NO: 453034 - DNA, 25 bp, Mus musculus
gggatgcccaccgtagagtgcagca

SEQ ID NO: 453035 - DNA, 25 bp, Mus musculus
gggatgcggccataacacagctcct

SEQ ID NO: 453036 - DNA, 25 bp, Mus musculus
gggatgctcacaaatctccaatctg

SEQ ID NO: 453037 - DNA, 25 bp, Mus musculus
gggatgcttgagaaggtcaaaaggg

SEQ ID NO: 453038 - DNA, 25 bp, Mus musculus
gggatgcttggccttaacctgtcca

SEQ ID NO: 453039 - DNA, 25 bp, Mus musculus
gggatggagtatgttcctcatgcga

SEQ ID NO: 453040 - DNA, 25 bp, Mus musculus
gggatggatatagcccgcaggcaca

SEQ ID NO: 453041 - DNA, 25 bp, Mus musculus
gggatggattccatttccaaaccag

SEQ ID NO: 453042 - DNA, 25 bp, Mus musculus
gggatggccacaccacatgagctag

SEQ ID NO: 453043 - DNA, 25 bp, Mus musculus
gggatggcccgattggcaaaatact

SEQ ID NO: 453044 - DNA, 25 bp, Mus musculus
gggatgggaaccaccacattttcct

SEQ ID NO: 453045 - DNA, 25 bp, Mus musculus
gggatggtccacgtcagaaaactca

SEQ ID NO: 453046 - DNA, 25 bp, Mus musculus
gggatgtaccttggtcctttcacac

SEQ ID NO: 453047 - DNA, 25 bp, Mus musculus
gggatgtcccatcttaccgctacca

SEQ ID NO: 453048 - DNA, 25 bp, Mus musculus
gggatgtgagaacccctgacaagct

SEQ ID NO: 453049 - DNA, 25 bp, Mus musculus
gggatgtggctatgacagagaatac

SEQ ID NO: 453050 - DNA, 25 bp, Mus musculus
gggatgtggtgcgatctccaaccag

SEQ ID NO: 453051 - DNA, 25 bp, Mus musculus
gggatgtgtaccacctcaatcggca

SEQ ID NO: 453052 - DNA, 25 bp, Mus musculus
gggatgtgtctgtagacttctcaca

SEQ ID NO: 453053 - DNA, 25 bp, Mus musculus
gggatgttttgactctgcacatatt

SEQ ID NO: 453054 - DNA, 25 bp, Mus musculus
gggattaaagcatgccctgccacaa

SEQ ID NO: 453055 - DNA, 25 bp, Mus musculus
gggattacatgacaccagagcagag

SEQ ID NO: 453056 - DNA, 25 bp, Mus musculus
gggattacccacttaccatggctgg

SEQ ID NO: 453057 - DNA, 25 bp, Mus musculus
gggattcaaagccaccgactgtgtg

SEQ ID NO: 453058 - DNA, 25 bp, Mus musculus
gggattcactgactagccagtctag

SEQ ID NO: 453059 - DNA, 25 bp, Mus musculus
gggattccagacaggcggcctttgc

SEQ ID NO: 453060 - DNA, 25 bp, Mus musculus
gggattccatattggcagctgcaga

SEQ ID NO: 453061 - DNA, 25 bp, Mus musculus
gggattcctcgggagcgcaggcccg

SEQ ID NO: 453062 - DNA, 25 bp, Mus musculus
gggattctcatcaacagtcaaggtg

SEQ ID NO: 453063 - DNA, 25 bp, Mus musculus
gggattctcgggtcttgtacttaag

SEQ ID NO: 453064 - DNA, 25 bp, Mus musculus
gggattgaacccataaccgctcaga

SEQ ID NO: 453065 - DNA, 25 bp, Mus musculus
gggattgaccctaccactgggacag

SEQ ID NO: 453066 - DNA, 25 bp, Mus musculus
gggattgatccactcagacagatgg

SEQ ID NO: 453067 - DNA, 25 bp, Mus musculus
gggattgcgcctatacgtctctgga

SEQ ID NO: 453068 - DNA, 25 bp, Mus musculus
gggatttaacagaggcgcgcactcg

SEQ ID NO: 453069 - DNA, 25 bp, Mus musculus
gggatttccaacatccaggctggct

SEQ ID NO: 453070 - DNA, 25 bp, Mus musculus
gggatttctccaaggatcttctgaa

SEQ ID NO: 453071 - DNA, 25 bp, Mus musculus
gggatttgggcctcgttagctccct

SEQ ID NO: 453072 - DNA, 25 bp, Mus musculus
gggatttgtcaactccacctacggc

SEQ ID NO: 453073 - DNA, 25 bp, Mus musculus
gggatttgtcttccttcacctgctg

SEQ ID NO: 453074 - DNA, 25 bp, Mus musculus
gggattttctttcctgtggatgaag

SEQ ID NO: 453075 - DNA, 25 bp, Mus musculus
gggcaaaacgctggcattacttcag

SEQ ID NO: 453076 - DNA, 25 bp, Mus musculus
gggcaaacagcatacatgcgagcca

SEQ ID NO: 453077 - DNA, 25 bp, Mus musculus
gggcaaacctctggagtccaaggct

SEQ ID NO: 453078 - DNA, 25 bp, Mus musculus
gggcaaagcccatgagtgaataaaa

SEQ ID NO: 453079 - DNA, 25 bp, Mus musculus
gggcaaagcgccaggaagatctcat

SEQ ID NO: 453080 - DNA, 25 bp, Mus musculus
gggcaaatgccttccagcgctggaa

SEQ ID NO: 453081 - DNA, 25 bp, Mus musculus
gggcaacaccaactggaaaactttg

SEQ ID NO: 453082 - DNA, 25 bp, Mus musculus
gggcaacatagtatacctctcatgt

SEQ ID NO: 453083 - DNA, 25 bp, Mus musculus
gggcaacggccattcagctgcatta

SEQ ID NO: 453084 - DNA, 25 bp, Mus musculus
gggcaactagccaaatgtcaatttc

SEQ ID NO: 453085 - DNA, 25 bp, Mus musculus
gggcaactcccaatctccggtacag

SEQ ID NO: 453086 - DNA, 25 bp, Mus musculus
gggcaagaccgcgtaagagagaata

SEQ ID NO: 453087 - DNA, 25 bp, Mus musculus
gggcaagagcttccacacatatgac

SEQ ID NO: 453088 - DNA, 25 bp, Mus musculus
gggcaaggatggctatcactcacaa

SEQ ID NO: 453089 - DNA, 25 bp, Mus musculus
gggcaagtagacaccccaggtctct

SEQ ID NO: 453090 - DNA, 25 bp, Mus musculus
gggcaatatactgggatgctacata

SEQ ID NO: 453091 - DNA, 25 bp, Mus musculus
gggcaatatctgctctacactaggg

SEQ ID NO: 453092 - DNA, 25 bp, Mus musculus
gggcaatgccatcgcctttgccacg

SEQ ID NO: 453093 - DNA, 25 bp, Mus musculus
gggcacaaaaagtgaccatgccttc

SEQ ID NO: 453094 - DNA, 25 bp, Mus musculus
gggcacaacacactaatacagcatg

SEQ ID NO: 453095 - DNA, 25 bp, Mus musculus
gggcacacatagaggcctctaccac

SEQ ID NO: 453096 - DNA, 25 bp, Mus musculus
gggcacagcatgagctccctccata

SEQ ID NO: 453097 - DNA, 25 bp, Mus musculus
gggcacaggaccctgttctagagtc

SEQ ID NO: 453098 - DNA, 25 bp, Mus musculus
gggcacaggccattcgacgccttct

SEQ ID NO: 453099 - DNA, 25 bp, Mus musculus
gggcacatacactccttcggcttta

SEQ ID NO: 453100 - DNA, 25 bp, Mus musculus
gggcacatgcatgctcctcactgta

SEQ ID NO: 453101 - DNA, 25 bp, Mus musculus
gggcaccagaaatatcaatcactcg

SEQ ID NO: 453102 - DNA, 25 bp, Mus musculus
gggcaccagtgaaaaaaccgcgact

SEQ ID NO: 453103 - DNA, 25 bp, Mus musculus
gggcaccagttgtgacatctctctc

SEQ ID NO: 453104 - DNA, 25 bp, Mus musculus
gggcacccaagtacatcgagcactt

SEQ ID NO: 453105 - DNA, 25 bp, Mus musculus
gggcacccactgaagtctccagatt

SEQ ID NO: 453106 - DNA, 25 bp, Mus musculus
gggcacccatgcacgtcttcatcag

SEQ ID NO: 453107 - DNA, 25 bp, Mus musculus
gggcacctccatgtctagttctcgt

SEQ ID NO: 453108 - DNA, 25 bp, Mus musculus
gggcacctgcaagggttccacacaa

SEQ ID NO: 453109 - DNA, 25 bp, Mus musculus
gggcacgattcgctcctccattttt

SEQ ID NO: 453110 - DNA, 25 bp, Mus musculus
gggcacggacaacccatatcctgat

SEQ ID NO: 453111 - DNA, 25 bp, Mus musculus
gggcacgtttctagctgtacataca

SEQ ID NO: 453112 - DNA, 25 bp, Mus musculus
gggcactaccatgtaccctggcatt

SEQ ID NO: 453113 - DNA, 25 bp, Mus musculus
gggcactgccttgggagccatgctt

SEQ ID NO: 453114 - DNA, 25 bp, Mus musculus
gggcactgtctaatcactaataaag

SEQ ID NO: 453115 - DNA, 25 bp, Mus musculus
gggcactgtctcacaacctctcaag

SEQ ID NO: 453116 - DNA, 25 bp, Mus musculus
gggcacttgggcaggcatgcttcat

SEQ ID NO: 453117 - DNA, 25 bp, Mus musculus
gggcagaaaacccagtgcactctgg

SEQ ID NO: 453118 - DNA, 25 bp, Mus musculus
gggcagaaataagctagatctggat

SEQ ID NO: 453119 - DNA, 25 bp, Mus musculus
gggcagaaccaacactcgaccacag

SEQ ID NO: 453120 - DNA, 25 bp, Mus musculus
gggcagaacgcatgcactgaaatct

SEQ ID NO: 453121 - DNA, 25 bp, Mus musculus
gggcagacccgcaacatcactgtag

SEQ ID NO: 453122 - DNA, 25 bp, Mus musculus
gggcagagagaagcttaccttctat

SEQ ID NO: 453123 - DNA, 25 bp, Mus musculus
gggcagaggcttgaatcaaccagga

SEQ ID NO: 453124 - DNA, 25 bp, Mus musculus
gggcagagtcccagcttaagtatac

SEQ ID NO: 453125 - DNA, 25 bp, Mus musculus
gggcagatatcagagaacaacatcc

SEQ ID NO: 453126 - DNA, 25 bp, Mus musculus
gggcagatcctcaagcaaacctatg

SEQ ID NO: 453127 - DNA, 25 bp, Mus musculus
gggcagccccttcgtgagcaacttt

SEQ ID NO: 453128 - DNA, 25 bp, Mus musculus
gggcagccgaacaagctgtcggact

SEQ ID NO: 453129 - DNA, 25 bp, Mus musculus
gggcagccgagttagtcccaagtcg

SEQ ID NO: 453130 - DNA, 25 bp, Mus musculus
gggcagcgcgcatggacctttcctc

SEQ ID NO: 453131 - DNA, 25 bp, Mus musculus
gggcagcggccttcataccatgggt

SEQ ID NO: 453132 - DNA, 25 bp, Mus musculus
gggcagctaatgaaacctcgcagat

SEQ ID NO: 453133 - DNA, 25 bp, Mus musculus
gggcagctggactacagacgttact

SEQ ID NO: 453134 - DNA, 25 bp, Mus musculus
gggcaggaagtcaagaaatgaaagc

SEQ ID NO: 453135 - DNA, 25 bp, Mus musculus
gggcaggcacacctgtgcgtctcct

SEQ ID NO: 453136 - DNA, 25 bp, Mus musculus
gggcaggcaccatgaacaagttacg

SEQ ID NO: 453137 - DNA, 25 bp, Mus musculus
gggcaggccttgtcacaacatccaa

SEQ ID NO: 453138 - DNA, 25 bp, Mus musculus
gggcagggatttcaatcctcccatc

SEQ ID NO: 453139 - DNA, 25 bp, Mus musculus
gggcagggcactgaccatttcagaa

SEQ ID NO: 453140 - DNA, 25 bp, Mus musculus
gggcagggccagcaatctaagtact

SEQ ID NO: 453141 - DNA, 25 bp, Mus musculus
gggcagggccgctggactaggtggg

SEQ ID NO: 453142 - DNA, 25 bp, Mus musculus
gggcaggtgcccatgtaaacactgg

SEQ ID NO: 453143 - DNA, 25 bp, Mus musculus
gggcagtaacagagtcacagtcatt

SEQ ID NO: 453144 - DNA, 25 bp, Mus musculus
gggcagtacatcgagccatgaaact

SEQ ID NO: 453145 - DNA, 25 bp, Mus musculus
gggcagtagaccttttgcagacgga

SEQ ID NO: 453146 - DNA, 25 bp, Mus musculus
gggcagtagctttctaaggccagca

SEQ ID NO: 453147 - DNA, 25 bp, Mus musculus
gggcagtccagctttccaattacag

SEQ ID NO: 453148 - DNA, 25 bp, Mus musculus
gggcagtgaccttcccttctgtgct

SEQ ID NO: 453149 - DNA, 25 bp, Mus musculus
gggcagtgcgcagcctggatcctct

SEQ ID NO: 453150 - DNA, 25 bp, Mus musculus
gggcagtgcgcatctccagcctggt

SEQ ID NO: 453151 - DNA, 25 bp, Mus musculus
gggcagtggtcttccccaggctgca

SEQ ID NO: 453152 - DNA, 25 bp, Mus musculus
gggcagttttatccaacgggagata

SEQ ID NO: 453153 - DNA, 25 bp, Mus musculus
gggcatatgacatattcttgtcact

SEQ ID NO: 453154 - DNA, 25 bp, Mus musculus
gggcatcagagacaccaattacctt

SEQ ID NO: 453155 - DNA, 25 bp, Mus musculus
gggcatcatacaccctgttattcag

SEQ ID NO: 453156 - DNA, 25 bp, Mus musculus
gggcatccaaactctcgaatcaaag

SEQ ID NO: 453157 - DNA, 25 bp, Mus musculus
gggcatccttagagcacccaagaag

SEQ ID NO: 453158 - DNA, 25 bp, Mus musculus
gggcatctcaactgctttggctatg

SEQ ID NO: 453159 - DNA, 25 bp, Mus musculus
gggcatcttgctcccgtcttcctta

SEQ ID NO: 453160 - DNA, 25 bp, Mus musculus
gggcatgatggcaccttcctgtgat

SEQ ID NO: 453161 - DNA, 25 bp, Mus musculus
gggcatgctgctacaataaggctca

SEQ ID NO: 453162 - DNA, 25 bp, Mus musculus
gggcatggacaacagctacctcagt

SEQ ID NO: 453163 - DNA, 25 bp, Mus musculus
gggcatggcatggaagtacccttcc

SEQ ID NO: 453164 - DNA, 25 bp, Mus musculus
gggcatggccctgtctgacttcaga

SEQ ID NO: 453165 - DNA, 25 bp, Mus musculus
gggcattacgctcgcacaagactta

SEQ ID NO: 453166 - DNA, 25 bp, Mus musculus
gggcattatcctctacctgcttttt

SEQ ID NO: 453167 - DNA, 25 bp, Mus musculus
gggcattgacccaggaatcggatag

SEQ ID NO: 453168 - DNA, 25 bp, Mus musculus
gggcatttgggttgctctcaagaca

SEQ ID NO: 453169 - DNA, 25 bp, Mus musculus
gggcattttagcacagcacgtacag

SEQ ID NO: 453170 - DNA, 25 bp, Mus musculus
gggccaaaggcctgtccgatgtgaa

SEQ ID NO: 453171 - DNA, 25 bp, Mus musculus
gggccaaggctctacgtgtcagtca

SEQ ID NO: 453172 - DNA, 25 bp, Mus musculus
gggccacagcggtcatcatgctcgt

SEQ ID NO: 453173 - DNA, 25 bp, Mus musculus
gggccacagctcagtgtgattgata

SEQ ID NO: 453174 - DNA, 25 bp, Mus musculus
gggccacaggtaaaagctatctgtt

SEQ ID NO: 453175 - DNA, 25 bp, Mus musculus
gggccaccaggagtaagacagtagt

SEQ ID NO: 453176 - DNA, 25 bp, Mus musculus
gggccaccagtacttcctgagacgt

SEQ ID NO: 453177 - DNA, 25 bp, Mus musculus
gggccaccatcctagtaaactttgc

SEQ ID NO: 453178 - DNA, 25 bp, Mus musculus
gggccacccgcccttgaacttgaag

SEQ ID NO: 453179 - DNA, 25 bp, Mus musculus
gggccaccctccaggatgagctgaa

SEQ ID NO: 453180 - DNA, 25 bp, Mus musculus
gggccaccttctggcatcttgagct

SEQ ID NO: 453181 - DNA, 25 bp, Mus musculus
gggccacgtgactcgctaaaaatgg

SEQ ID NO: 453182 - DNA, 25 bp, Mus musculus
gggccactgtcttctagtgtctgaa

SEQ ID NO: 453183 - DNA, 25 bp, Mus musculus
gggccagacaagacaatcagctatg

SEQ ID NO: 453184 - DNA, 25 bp, Mus musculus
gggccagagagagttcaagcgcatc

SEQ ID NO: 453185 - DNA, 25 bp, Mus musculus
gggccagaggataccatcccatcac

SEQ ID NO: 453186 - DNA, 25 bp, Mus musculus
gggccagccctgctcactggtctgt

SEQ ID NO: 453187 - DNA, 25 bp, Mus musculus
gggccagctgacttccatatagagg

SEQ ID NO: 453188 - DNA, 25 bp, Mus musculus
gggccaggtcacagtctagctaatg

SEQ ID NO: 453189 - DNA, 25 bp, Mus musculus
gggccaggtccctcatccagagttg

SEQ ID NO: 453190 - DNA, 25 bp, Mus musculus
gggccaggtctctactgcctgcaga

SEQ ID NO: 453191 - DNA, 25 bp, Mus musculus
gggccaggttatcttaagttcattt

SEQ ID NO: 453192 - DNA, 25 bp, Mus musculus
gggccagtaggaatatgtaacttca

SEQ ID NO: 453193 - DNA, 25 bp, Mus musculus
gggccatacctatgaaccatcacag

SEQ ID NO: 453194 - DNA, 25 bp, Mus musculus
gggccatcaatgcatcaaccgaggc

SEQ ID NO: 453195 - DNA, 25 bp, Mus musculus
gggccatccttttctacccagagaa

SEQ ID NO: 453196 - DNA, 25 bp, Mus musculus
gggccatctgagtgggagagagcaa

SEQ ID NO: 453197 - DNA, 25 bp, Mus musculus
gggccatgaaatatccatagctatt

SEQ ID NO: 453198 - DNA, 25 bp, Mus musculus
gggccatgaagcatccagtttcctg

SEQ ID NO: 453199 - DNA, 25 bp, Mus musculus
gggccatgcacagacacagctcatg

SEQ ID NO: 453200 - DNA, 25 bp, Mus musculus
gggccatgcacagcctcactggaga

SEQ ID NO: 453201 - DNA, 25 bp, Mus musculus
gggccatgctatactccagggagtg

SEQ ID NO: 453202 - DNA, 25 bp, Mus musculus
gggccatgctgtatcacacggaaga

SEQ ID NO: 453203 - DNA, 25 bp, Mus musculus
gggccatttttatgtcaaggtgtaa

SEQ ID NO: 453204 - DNA, 25 bp, Mus musculus
gggcccaacagtggatctgccatta

SEQ ID NO: 453205 - DNA, 25 bp, Mus musculus
gggcccaactcatacaaggagataa

SEQ ID NO: 453206 - DNA, 25 bp, Mus musculus
gggcccacgtgcagttttgaacata

SEQ ID NO: 453207 - DNA, 25 bp, Mus musculus
gggcccagacggagctctaaatgaa

SEQ ID NO: 453208 - DNA, 25 bp, Mus musculus
gggcccaggcatgcagaattattct

SEQ ID NO: 453209 - DNA, 25 bp, Mus musculus
gggcccaggccactttagaatctta

SEQ ID NO: 453210 - DNA, 25 bp, Mus musculus
gggcccagggactggatttctgtat

SEQ ID NO: 453211 - DNA, 25 bp, Mus musculus
gggcccagtacgagaaatacagctt

SEQ ID NO: 453212 - DNA, 25 bp, Mus musculus
gggcccatgcccaaagtgtgcagta

SEQ ID NO: 453213 - DNA, 25 bp, Mus musculus
gggccccagcccactatgaaattga

SEQ ID NO: 453214 - DNA, 25 bp, Mus musculus
gggcccctctcttgggtctgtgctg

SEQ ID NO: 453215 - DNA, 25 bp, Mus musculus
gggcccctgcccattttctgaattg

SEQ ID NO: 453216 - DNA, 25 bp, Mus musculus
gggcccctggctctgtgtataaact

SEQ ID NO: 453217 - DNA, 25 bp, Mus musculus
gggcccgccttgaccataagtttga

SEQ ID NO: 453218 - DNA, 25 bp, Mus musculus
gggcccgttccatgaaacactggct

SEQ ID NO: 453219 - DNA, 25 bp, Mus musculus
gggccctactgtggcatcctactgt

SEQ ID NO: 453220 - DNA, 25 bp, Mus musculus
gggccctcaagtgtctcagctgtca

SEQ ID NO: 453221 - DNA, 25 bp, Mus musculus
gggccctgacttgcctttagttcac

SEQ ID NO: 453222 - DNA, 25 bp, Mus musculus
gggccctgagccctttctagtcctt

SEQ ID NO: 453223 - DNA, 25 bp, Mus musculus
gggccctgatcgaccagtagtggtc

SEQ ID NO: 453224 - DNA, 25 bp, Mus musculus
gggccctgcactctgtcgatgagtc

SEQ ID NO: 453225 - DNA, 25 bp, Mus musculus
gggcccttagctgtgaccatcatca

SEQ ID NO: 453226 - DNA, 25 bp, Mus musculus
gggcccttatcggaaagcagcgact

SEQ ID NO: 453227 - DNA, 25 bp, Mus musculus
gggcccttcagtgtgctgtcgatgt

SEQ ID NO: 453228 - DNA, 25 bp, Mus musculus
gggcccttcctatgggaactgagaa

SEQ ID NO: 453229 - DNA, 25 bp, Mus musculus
gggcccttcctcctcttagtgtgca

SEQ ID NO: 453230 - DNA, 25 bp, Mus musculus
gggccctttggatactgtctgacac

SEQ ID NO: 453231 - DNA, 25 bp, Mus musculus
gggccgaaatcaagggtatagactt

SEQ ID NO: 453232 - DNA, 25 bp, Mus musculus
gggccgaggctcttgtattttgact

SEQ ID NO: 453233 - DNA, 25 bp, Mus musculus
gggccgctaccctgggacttgccag

SEQ ID NO: 453234 - DNA, 25 bp, Mus musculus
gggccgctagagtcaagcttgctat

SEQ ID NO: 453235 - DNA, 25 bp, Mus musculus
gggccgtgcttagtggacaactgaa

SEQ ID NO: 453236 - DNA, 25 bp, Mus musculus
gggcctaccacggaccatgaaggca

SEQ ID NO: 453237 - DNA, 25 bp, Mus musculus
gggcctaggcactcattccttcaca

SEQ ID NO: 453238 - DNA, 25 bp, Mus musculus
gggcctagtgagaaacacaatgtag

SEQ ID NO: 453239 - DNA, 25 bp, Mus musculus
gggcctagtggtacaggtctgtaac

SEQ ID NO: 453240 - DNA, 25 bp, Mus musculus
gggcctatcatcatggaccttacag

SEQ ID NO: 453241 - DNA, 25 bp, Mus musculus
gggcctcaaggtcagctccagttca

SEQ ID NO: 453242 - DNA, 25 bp, Mus musculus
gggcctccattgacataagtacctt

SEQ ID NO: 453243 - DNA, 25 bp, Mus musculus
gggcctcccatctcactgttttcaa

SEQ ID NO: 453244 - DNA, 25 bp, Mus musculus
gggcctcccctattggaaagaacag

SEQ ID NO: 453245 - DNA, 25 bp, Mus musculus
gggcctcccttgagttcctggcagg

SEQ ID NO: 453246 - DNA, 25 bp, Mus musculus
gggcctcctgagtctgtaaagaaga

SEQ ID NO: 453247 - DNA, 25 bp, Mus musculus
gggcctcgcctgtaaaaggaacaat

SEQ ID NO: 453248 - DNA, 25 bp, Mus musculus
gggcctctgaagcatctccaagtct

SEQ ID NO: 453249 - DNA, 25 bp, Mus musculus
gggcctctggacatcaaaggttcct

SEQ ID NO: 453250 - DNA, 25 bp, Mus musculus
gggcctctggtgtgagctcctgaca

SEQ ID NO: 453251 - DNA, 25 bp, Mus musculus
gggcctgcacaaacagccgggcttc

SEQ ID NO: 453252 - DNA, 25 bp, Mus musculus
gggcctgcagacacgatttccttag

SEQ ID NO: 453253 - DNA, 25 bp, Mus musculus
gggcctgcccctcacaaatgaactg

SEQ ID NO: 453254 - DNA, 25 bp, Mus musculus
gggcctgcccttgagctgttgagct

SEQ ID NO: 453255 - DNA, 25 bp, Mus musculus
gggcctgctcctgcaactctgtgga

SEQ ID NO: 453256 - DNA, 25 bp, Mus musculus
gggcctgctctgaaaatctatgaat

SEQ ID NO: 453257 - DNA, 25 bp, Mus musculus
gggcctgctttttgcattgagcggc

SEQ ID NO: 453258 - DNA, 25 bp, Mus musculus
gggcctggccaatctggaccattat

SEQ ID NO: 453259 - DNA, 25 bp, Mus musculus
gggcctggctgttcgcacctttatg

SEQ ID NO: 453260 - DNA, 25 bp, Mus musculus
gggcctgggcaactggaacaacaat

SEQ ID NO: 453261 - DNA, 25 bp, Mus musculus
gggcctgtaccaagggtgtgtggcc

SEQ ID NO: 453262 - DNA, 25 bp, Mus musculus
gggcctgtatattcccacgcagatg

SEQ ID NO: 453263 - DNA, 25 bp, Mus musculus
gggcctgtcggttacgggcggcgca

SEQ ID NO: 453264 - DNA, 25 bp, Mus musculus
gggcctgttggctcttacttcatat

SEQ ID NO: 453265 - DNA, 25 bp, Mus musculus
gggcctgtttgaggacatcgatacc

SEQ ID NO: 453266 - DNA, 25 bp, Mus musculus
gggccttaagaatgccggaagcagt

SEQ ID NO: 453267 - DNA, 25 bp, Mus musculus
gggccttagtctgcagtgacctgaa

SEQ ID NO: 453268 - DNA, 25 bp, Mus musculus
gggccttcatcattgccgtcattta

SEQ ID NO: 453269 - DNA, 25 bp, Mus musculus
gggccttctgcgtcccacggcagaa

SEQ ID NO: 453270 - DNA, 25 bp, Mus musculus
gggccttctggatttggtgagcaca

SEQ ID NO: 453271 - DNA, 25 bp, Mus musculus
gggccttgaattttggtagcgaaag

SEQ ID NO: 453272 - DNA, 25 bp, Mus musculus
gggccttgcactggtactttggaca

SEQ ID NO: 453273 - DNA, 25 bp, Mus musculus
gggccttgctcagttccatccagaa

SEQ ID NO: 453274 - DNA, 25 bp, Mus musculus
gggcctttagctcttggacatccaa

SEQ ID NO: 453275 - DNA, 25 bp, Mus musculus
gggcctttctctcaaaagagggact

SEQ ID NO: 453276 - DNA, 25 bp, Mus musculus
gggcgacacccatgttatacgtgaa

SEQ ID NO: 453277 - DNA, 25 bp, Mus musculus
gggcgacatcaatcacgaacgagga

SEQ ID NO: 453278 - DNA, 25 bp, Mus musculus
gggcgacatcccgttaagctatcta

SEQ ID NO: 453279 - DNA, 25 bp, Mus musculus
gggcgactcagtacctacggaagag

SEQ ID NO: 453280 - DNA, 25 bp, Mus musculus
gggcgactgttgacttccttctccg

SEQ ID NO: 453281 - DNA, 25 bp, Mus musculus
gggcgagaatcaatggcaagtccga

SEQ ID NO: 453282 - DNA, 25 bp, Mus musculus
gggcgagccctacatgtacctgagt

SEQ ID NO: 453283 - DNA, 25 bp, Mus musculus
gggcgcattcataggattaaaatta

SEQ ID NO: 453284 - DNA, 25 bp, Mus musculus
gggcgccatcccgaagtttgagctt

SEQ ID NO: 453285 - DNA, 25 bp, Mus musculus
gggcgctcgtctttgacattggctc

SEQ ID NO: 453286 - DNA, 25 bp, Mus musculus
gggcgctgctcaataaagctgtgtg

SEQ ID NO: 453287 - DNA, 25 bp, Mus musculus
gggcggaatccctcaacttctgaga

SEQ ID NO: 453288 - DNA, 25 bp, Mus musculus
gggcggcaatcctccttccagttgc

SEQ ID NO: 453289 - DNA, 25 bp, Mus musculus
gggcggcctcagtaccttctttgaa

SEQ ID NO: 453290 - DNA, 25 bp, Mus musculus
gggcggtgccatccccattactcaa

SEQ ID NO: 453291 - DNA, 25 bp, Mus musculus
gggcggtttatctcatccactagac

SEQ ID NO: 453292 - DNA, 25 bp, Mus musculus
gggcgtaggcaccacattctgatct

SEQ ID NO: 453293 - DNA, 25 bp, Mus musculus
gggcgtctgcatacaataacctgaa

SEQ ID NO: 453294 - DNA, 25 bp, Mus musculus
gggcgtcttcgctcacatcctgaac

SEQ ID NO: 453295 - DNA, 25 bp, Mus musculus
gggcgtgccaaaaccaaactggaat

SEQ ID NO: 453296 - DNA, 25 bp, Mus musculus
gggcgtggccgctacccctttatct

SEQ ID NO: 453297 - DNA, 25 bp, Mus musculus
gggcgtgttatcatgcagatcatca

SEQ ID NO: 453298 - DNA, 25 bp, Mus musculus
gggcgtttccaatcgggtgtcaatt

SEQ ID NO: 453299 - DNA, 25 bp, Mus musculus
gggctaattggagctgtaaaacacc

SEQ ID NO: 453300 - DNA, 25 bp, Mus musculus
gggctacaaaaatgagtcggtacaa

SEQ ID NO: 453301 - DNA, 25 bp, Mus musculus
gggctaccacatgcgatccaacttg

SEQ ID NO: 453302 - DNA, 25 bp, Mus musculus
gggctactacttctctggcaactgt

SEQ ID NO: 453303 - DNA, 25 bp, Mus musculus
gggctagactgggaaccacctctta

SEQ ID NO: 453304 - DNA, 25 bp, Mus musculus
gggctagcctaagccctggcttaca

SEQ ID NO: 453305 - DNA, 25 bp, Mus musculus
gggctagctaaacagcatctcactg

SEQ ID NO: 453306 - DNA, 25 bp, Mus musculus
gggctaggtcagttcccaagcagca

SEQ ID NO: 453307 - DNA, 25 bp, Mus musculus
gggctagtcccgagttacagaaaca

SEQ ID NO: 453308 - DNA, 25 bp, Mus musculus
gggctatatcctcaacgcacatagg

SEQ ID NO: 453309 - DNA, 25 bp, Mus musculus
gggctatccttttgaactcaaggga

SEQ ID NO: 453310 - DNA, 25 bp, Mus musculus
gggctatgtaaacccggatctgcta

SEQ ID NO: 453311 - DNA, 25 bp, Mus musculus
gggctcaacagccacatagttttac

SEQ ID NO: 453312 - DNA, 25 bp, Mus musculus
gggctcaaccataaaccaaagggca

SEQ ID NO: 453313 - DNA, 25 bp, Mus musculus
gggctcaagaccctccatttgggaa

SEQ ID NO: 453314 - DNA, 25 bp, Mus musculus
gggctcaatatacgcagcacctcct

SEQ ID NO: 453315 - DNA, 25 bp, Mus musculus
gggctcaatcaccagcaccctatag

SEQ ID NO: 453316 - DNA, 25 bp, Mus musculus
gggctcagacatacacagttcttta

SEQ ID NO: 453317 - DNA, 25 bp, Mus musculus
gggctcagatgacagaccgtcacgg

SEQ ID NO: 453318 - DNA, 25 bp, Mus musculus
gggctcatccctactggtggtgaca

SEQ ID NO: 453319 - DNA, 25 bp, Mus musculus
gggctccaaagacagaccaagtgct

SEQ ID NO: 453320 - DNA, 25 bp, Mus musculus
gggctccacggaaggcaaatatgaa

SEQ ID NO: 453321 - DNA, 25 bp, Mus musculus
gggctcccacccaagacagttgatg

SEQ ID NO: 453322 - DNA, 25 bp, Mus musculus
gggctccggaccagaaactcttaga

SEQ ID NO: 453323 - DNA, 25 bp, Mus musculus
gggctccggtcacagatctacgtat

SEQ ID NO: 453324 - DNA, 25 bp, Mus musculus
gggctcctgatggtaaatgcgctgt

SEQ ID NO: 453325 - DNA, 25 bp, Mus musculus
gggctcctgggttccttgtcagtgt

SEQ ID NO: 453326 - DNA, 25 bp, Mus musculus
gggctcctttgctgaacttgaaatg

SEQ ID NO: 453327 - DNA, 25 bp, Mus musculus
gggctcgccctgattggttgctcca

SEQ ID NO: 453328 - DNA, 25 bp, Mus musculus
gggctctagggcaccactgtaccct

SEQ ID NO: 453329 - DNA, 25 bp, Mus musculus
gggctctcatcttgaagccgttgat

SEQ ID NO: 453330 - DNA, 25 bp, Mus musculus
gggctctcctcttacgacacagggt

SEQ ID NO: 453331 - DNA, 25 bp, Mus musculus
gggctctgaccatcgcaatgcttga

SEQ ID NO: 453332 - DNA, 25 bp, Mus musculus
gggctctgactcagacaagatcctt

SEQ ID NO: 453333 - DNA, 25 bp, Mus musculus
gggctctgatggtctgaaatacatt

SEQ ID NO: 453334 - DNA, 25 bp, Mus musculus
gggctctgccctcaaaatacaatgc

SEQ ID NO: 453335 - DNA, 25 bp, Mus musculus
gggctctggccctcagacaagaatc

SEQ ID NO: 453336 - DNA, 25 bp, Mus musculus
gggctctgtagcttcatagtctcac

SEQ ID NO: 453337 - DNA, 25 bp, Mus musculus
gggctcttccactactgcatcggca

SEQ ID NO: 453338 - DNA, 25 bp, Mus musculus
gggctgaagctactaatttggaaga

SEQ ID NO: 453339 - DNA, 25 bp, Mus musculus
gggctgaagttcctccagcaactga

SEQ ID NO: 453340 - DNA, 25 bp, Mus musculus
gggctgaccacaggaaagaggccat

SEQ ID NO: 453341 - DNA, 25 bp, Mus musculus
gggctgacgcacatactgtgtgtca

SEQ ID NO: 453342 - DNA, 25 bp, Mus musculus
gggctgagaagaagctcgatctacc

SEQ ID NO: 453343 - DNA, 25 bp, Mus musculus
gggctgatccagcatgtcccttgct

SEQ ID NO: 453344 - DNA, 25 bp, Mus musculus
gggctgcaacatcctcaaagtcgaa

SEQ ID NO: 453345 - DNA, 25 bp, Mus musculus
gggctgcacactgggatcctattta

SEQ ID NO: 453346 - DNA, 25 bp, Mus musculus
gggctgcagcattccaataatccaa

SEQ ID NO: 453347 - DNA, 25 bp, Mus musculus
gggctgcatccctgaagaaaattga

SEQ ID NO: 453348 - DNA, 25 bp, Mus musculus
gggctgccaccggttcctcttatga

SEQ ID NO: 453349 - DNA, 25 bp, Mus musculus
gggctgccagcatgttctctcgaaa

SEQ ID NO: 453350 - DNA, 25 bp, Mus musculus
gggctgcctcttgcttgaccaggaa

SEQ ID NO: 453351 - DNA, 25 bp, Mus musculus
gggctgctcatagttcttgctaacg

SEQ ID NO: 453352 - DNA, 25 bp, Mus musculus
gggctgctccacacctgcgggttct

SEQ ID NO: 453353 - DNA, 25 bp, Mus musculus
gggctgctgaagaatccgtcctgga

SEQ ID NO: 453354 - DNA, 25 bp, Mus musculus
gggctgctgtccctcaacggaagaa

SEQ ID NO: 453355 - DNA, 25 bp, Mus musculus
gggctgcttccgatcacctgggatt

SEQ ID NO: 453356 - DNA, 25 bp, Mus musculus
gggctgcttcgcttgccggttccca

SEQ ID NO: 453357 - DNA, 25 bp, Mus musculus
gggctggaatcagacggaaatctcc

SEQ ID NO: 453358 - DNA, 25 bp, Mus musculus
gggctggcaatatcctgtgaactta

SEQ ID NO: 453359 - DNA, 25 bp, Mus musculus
gggctggcccctccttaaagagttg

SEQ ID NO: 453360 - DNA, 25 bp, Mus musculus
gggctggccctgatagattttggtt

SEQ ID NO: 453361 - DNA, 25 bp, Mus musculus
gggctggcctgacaagacttccaag

SEQ ID NO: 453362 - DNA, 25 bp, Mus musculus
gggctggcgactatacctaccgtga

SEQ ID NO: 453363 - DNA, 25 bp, Mus musculus
gggctggcttcctgtcacctagtgg

SEQ ID NO: 453364 - DNA, 25 bp, Mus musculus
gggctgggattctcgccatggccaa

SEQ ID NO: 453365 - DNA, 25 bp, Mus musculus
gggctgggcacttaggacctcagtt

SEQ ID NO: 453366 - DNA, 25 bp, Mus musculus
gggctgggcgctgcgcagaagctct

SEQ ID NO: 453367 - DNA, 25 bp, Mus musculus
gggctgggttgaaaaccttctagct

SEQ ID NO: 453368 - DNA, 25 bp, Mus musculus
gggctgtcataatagtccactcctc

SEQ ID NO: 453369 - DNA, 25 bp, Mus musculus
gggctgtccggctgtcccgtgtcac

SEQ ID NO: 453370 - DNA, 25 bp, Mus musculus
gggctgtcctatccacactcgaaat

SEQ ID NO: 453371 - DNA, 25 bp, Mus musculus
gggctgtcggcttccttcataaata

SEQ ID NO: 453372 - DNA, 25 bp, Mus musculus
gggctgtgcagacatcactaacctg

SEQ ID NO: 453373 - DNA, 25 bp, Mus musculus
gggctgtgccatacccaccttggat

SEQ ID NO: 453374 - DNA, 25 bp, Mus musculus
gggctgttatcacacaaggctctga

SEQ ID NO: 453375 - DNA, 25 bp, Mus musculus
gggcttaaattctagcaggctcaga

SEQ ID NO: 453376 - DNA, 25 bp, Mus musculus
gggcttaatcttcacctccaccttg

SEQ ID NO: 453377 - DNA, 25 bp, Mus musculus
gggcttacaggttaactttggctct

SEQ ID NO: 453378 - DNA, 25 bp, Mus musculus
gggcttatctgcagaggcacacagc

SEQ ID NO: 453379 - DNA, 25 bp, Mus musculus
gggcttcaccatccccgggttctgt

SEQ ID NO: 453380 - DNA, 25 bp, Mus musculus
gggcttccccaacacgatctgagag

SEQ ID NO: 453381 - DNA, 25 bp, Mus musculus
gggcttcccttgttcccagaataag

SEQ ID NO: 453382 - DNA, 25 bp, Mus musculus
gggcttcgctctatgaatagtctgt

SEQ ID NO: 453383 - DNA, 25 bp, Mus musculus
gggcttctatgtcacaagtaagagg

SEQ ID NO: 453384 - DNA, 25 bp, Mus musculus
gggcttctcctaacttcctagatgt

SEQ ID NO: 453385 - DNA, 25 bp, Mus musculus
gggcttctgaaataatatcggaagg

SEQ ID NO: 453386 - DNA, 25 bp, Mus musculus
gggcttctgtacagttccagggaaa

SEQ ID NO: 453387 - DNA, 25 bp, Mus musculus
gggcttcttacgatccttgaggacc

SEQ ID NO: 453388 - DNA, 25 bp, Mus musculus
gggcttgaaatgatagcagttctga

SEQ ID NO: 453389 - DNA, 25 bp, Mus musculus
gggcttgagttgctctttccagatg

SEQ ID NO: 453390 - DNA, 25 bp, Mus musculus
gggcttgcaaggacccagaagttct

SEQ ID NO: 453391 - DNA, 25 bp, Mus musculus
gggcttgcagacttgaccttccaca

SEQ ID NO: 453392 - DNA, 25 bp, Mus musculus
gggcttgcggccaccatggcgtatt

SEQ ID NO: 453393 - DNA, 25 bp, Mus musculus
gggcttgcgtttacatccacttact

SEQ ID NO: 453394 - DNA, 25 bp, Mus musculus
gggcttggacctgcctcctctaaag

SEQ ID NO: 453395 - DNA, 25 bp, Mus musculus
gggcttgtgtgtatgcacctcatga

SEQ ID NO: 453396 - DNA, 25 bp, Mus musculus
gggcttgttgccattcccctagatg

SEQ ID NO: 453397 - DNA, 25 bp, Mus musculus
gggctttagaactgctctgccaggc

SEQ ID NO: 453398 - DNA, 25 bp, Mus musculus
gggctttgactcaacagcattgaga

SEQ ID NO: 453399 - DNA, 25 bp, Mus musculus
gggctttgatctggcttcgtttaac

SEQ ID NO: 453400 - DNA, 25 bp, Mus musculus
gggctttgcactctgctccttagca

SEQ ID NO: 453401 - DNA, 25 bp, Mus musculus
gggctttgcgtactgtacggctact

SEQ ID NO: 453402 - DNA, 25 bp, Mus musculus
gggctttggaccatcgcctgattat

SEQ ID NO: 453403 - DNA, 25 bp, Mus musculus
gggctttggctcttacatcagtgaa

SEQ ID NO: 453404 - DNA, 25 bp, Mus musculus
gggcttttacagctgtcacttttgg

SEQ ID NO: 453405 - DNA, 25 bp, Mus musculus
ggggaagtcaacaaggacgaatgct

SEQ ID NO: 453406 - DNA, 25 bp, Mus musculus
ggggactttatagctcagggtctag

SEQ ID NO: 453407 - DNA, 25 bp, Mus musculus
ggggtgcctgcactctcagcttcca

SEQ ID NO: 453408 - DNA, 25 bp, Mus musculus
gggtaaagggaccaagtccagccat

SEQ ID NO: 453409 - DNA, 25 bp, Mus musculus
gggtaacacacaacatcatccatgg

SEQ ID NO: 453410 - DNA, 25 bp, Mus musculus
gggtaacagaaagtatcgacgagga

SEQ ID NO: 453411 - DNA, 25 bp, Mus musculus
gggtaaccttgatcctgtctttaga

SEQ ID NO: 453412 - DNA, 25 bp, Mus musculus
gggtaatctaaacagccacgtatgc

SEQ ID NO: 453413 - DNA, 25 bp, Mus musculus
gggtaatgatttatcaaacgtgtat

SEQ ID NO: 453414 - DNA, 25 bp, Mus musculus
gggtaattctatatccctgggcaat

SEQ ID NO: 453415 - DNA, 25 bp, Mus musculus
gggtacaaaccctacagctgcgagg

SEQ ID NO: 453416 - DNA, 25 bp, Mus musculus
gggtacaaagcaaggaactccagca

SEQ ID NO: 453417 - DNA, 25 bp, Mus musculus
gggtacaatagtttgagaaatccat

SEQ ID NO: 453418 - DNA, 25 bp, Mus musculus
gggtacatatggactccgctgagaa

SEQ ID NO: 453419 - DNA, 25 bp, Mus musculus
gggtacatcctatagaaactgactg

SEQ ID NO: 453420 - DNA, 25 bp, Mus musculus
gggtacatttatcagccgcagccaa

SEQ ID NO: 453421 - DNA, 25 bp, Mus musculus
gggtaccatgacagtacaacagtgt

SEQ ID NO: 453422 - DNA, 25 bp, Mus musculus
gggtacccctgttcctcctatgaga

SEQ ID NO: 453423 - DNA, 25 bp, Mus musculus
gggtaccgaggcaaacagaacttgg

SEQ ID NO: 453424 - DNA, 25 bp, Mus musculus
gggtaccgataattagctctcaaca

SEQ ID NO: 453425 - DNA, 25 bp, Mus musculus
gggtaccttaaatgccagttcgtcg

SEQ ID NO: 453426 - DNA, 25 bp, Mus musculus
gggtactaatggtggcagccagcca

SEQ ID NO: 453427 - DNA, 25 bp, Mus musculus
gggtactcctaggacttttatacag

SEQ ID NO: 453428 - DNA, 25 bp, Mus musculus
gggtactctaggtctcggaccgtag

SEQ ID NO: 453429 - DNA, 25 bp, Mus musculus
gggtactgcacaccaagcattcgag

SEQ ID NO: 453430 - DNA, 25 bp, Mus musculus
gggtacttatatctgagacacagag

SEQ ID NO: 453431 - DNA, 25 bp, Mus musculus
gggtacttctgttcaagccgaggca

SEQ ID NO: 453432 - DNA, 25 bp, Mus musculus
gggtacttgggagcccactgttgcc

SEQ ID NO: 453433 - DNA, 25 bp, Mus musculus
gggtagaaccctcctcgtccatcac

SEQ ID NO: 453434 - DNA, 25 bp, Mus musculus
gggtagcagcccttcgaggaaagaa

SEQ ID NO: 453435 - DNA, 25 bp, Mus musculus
gggtagcatctcaccacgtctggtc

SEQ ID NO: 453436 - DNA, 25 bp, Mus musculus
gggtagccgctgctacaaaacccgc

SEQ ID NO: 453437 - DNA, 25 bp, Mus musculus
gggtagggtcctatcaacgctcctt

SEQ ID NO: 453438 - DNA, 25 bp, Mus musculus
gggtaggtccaaagccttagctagc

SEQ ID NO: 453439 - DNA, 25 bp, Mus musculus
gggtagttctccaagactagtgatt

SEQ ID NO: 453440 - DNA, 25 bp, Mus musculus
gggtataagggaaaagaccagcctg

SEQ ID NO: 453441 - DNA, 25 bp, Mus musculus
gggtatacccacttctgccagggtg

SEQ ID NO: 453442 - DNA, 25 bp, Mus musculus
gggtatagcacctcttgaactgaag

SEQ ID NO: 453443 - DNA, 25 bp, Mus musculus
gggtatcgttttatccatttctggg

SEQ ID NO: 453444 - DNA, 25 bp, Mus musculus
gggtatctagtcaaattctttcagc

SEQ ID NO: 453445 - DNA, 25 bp, Mus musculus
gggtatctgcgatgagtcagacaca

SEQ ID NO: 453446 - DNA, 25 bp, Mus musculus
gggtatctttaacaatgactgtcag

SEQ ID NO: 453447 - DNA, 25 bp, Mus musculus
gggtatgactcttctgaggactgct

SEQ ID NO: 453448 - DNA, 25 bp, Mus musculus
gggtattcaaaaagagctcctcaca

SEQ ID NO: 453449 - DNA, 25 bp, Mus musculus
gggtattcctctgtcttgcgtgcgc

SEQ ID NO: 453450 - DNA, 25 bp, Mus musculus
gggtatttgcagtattctctcaaac

SEQ ID NO: 453451 - DNA, 25 bp, Mus musculus
gggtcaaagcaatgaggtaaaaggc

SEQ ID NO: 453452 - DNA, 25 bp, Mus musculus
gggtcaaagcccctgtattcaccga

SEQ ID NO: 453453 - DNA, 25 bp, Mus musculus
gggtcaaatcattcgtctcaccttt

SEQ ID NO: 453454 - DNA, 25 bp, Mus musculus
gggtcaactgttctcttcacgtagg

SEQ ID NO: 453455 - DNA, 25 bp, Mus musculus
gggtcaagacttgcccagtgaacag

SEQ ID NO: 453456 - DNA, 25 bp, Mus musculus
gggtcaagatcttctcagccggagt

SEQ ID NO: 453457 - DNA, 25 bp, Mus musculus
gggtcaatggctgcaacctgccaaa

SEQ ID NO: 453458 - DNA, 25 bp, Mus musculus
gggtcacagcttcaggcctagcttt

SEQ ID NO: 453459 - DNA, 25 bp, Mus musculus
gggtcacctgagaacacagctggtt

SEQ ID NO: 453460 - DNA, 25 bp, Mus musculus
gggtcacgaaactcagggctgtagc

SEQ ID NO: 453461 - DNA, 25 bp, Mus musculus
gggtcacgtccttctagactgggtc

SEQ ID NO: 453462 - DNA, 25 bp, Mus musculus
gggtcactggcggttggagcgcaca

SEQ ID NO: 453463 - DNA, 25 bp, Mus musculus
gggtcacttgcctgtgccgacacat

SEQ ID NO: 453464 - DNA, 25 bp, Mus musculus
gggtcactttccagcttaaggcgga

SEQ ID NO: 453465 - DNA, 25 bp, Mus musculus
gggtcactttgatgttgcgtttttg

SEQ ID NO: 453466 - DNA, 25 bp, Mus musculus
gggtcagaggaagcttatcaaccat

SEQ ID NO: 453467 - DNA, 25 bp, Mus musculus
gggtcagaggttcaaacgaagtctc

SEQ ID NO: 453468 - DNA, 25 bp, Mus musculus
gggtcagatctcagctcactcttct

SEQ ID NO: 453469 - DNA, 25 bp, Mus musculus
gggtcaggaccaaagtgaagctcaa

SEQ ID NO: 453470 - DNA, 25 bp, Mus musculus
gggtcaggatccaggcatgccttac

SEQ ID NO: 453471 - DNA, 25 bp, Mus musculus
gggtcaggcatgtagctgcaatcca

SEQ ID NO: 453472 - DNA, 25 bp, Mus musculus
gggtcaggtgattatcacgtatcat

SEQ ID NO: 453473 - DNA, 25 bp, Mus musculus
gggtcaggtttcatggcccatgctt

SEQ ID NO: 453474 - DNA, 25 bp, Mus musculus
gggtcagtatctctccaactacttt

SEQ ID NO: 453475 - DNA, 25 bp, Mus musculus
gggtcagtcgcacggccatcatcat

SEQ ID NO: 453476 - DNA, 25 bp, Mus musculus
gggtcagtgatccagccagctttgc

SEQ ID NO: 453477 - DNA, 25 bp, Mus musculus
gggtcagtgctgaagctgctcaaca

SEQ ID NO: 453478 - DNA, 25 bp, Mus musculus
gggtcagtgtccacgacatcaaaaa

SEQ ID NO: 453479 - DNA, 25 bp, Mus musculus
gggtcatctgaactgcttccatgca

SEQ ID NO: 453480 - DNA, 25 bp, Mus musculus
gggtcattgggaaggagtcataaaa

SEQ ID NO: 453481 - DNA, 25 bp, Mus musculus
gggtcattgtcatttaccacatgag

SEQ ID NO: 453482 - DNA, 25 bp, Mus musculus
gggtccaccctagccaagagttatg

SEQ ID NO: 453483 - DNA, 25 bp, Mus musculus
gggtccagacagtgcccttaccctg

SEQ ID NO: 453484 - DNA, 25 bp, Mus musculus
gggtccagcctatcttgaacgagca

SEQ ID NO: 453485 - DNA, 25 bp, Mus musculus
gggtccaggcgtacagtcactatga

SEQ ID NO: 453486 - DNA, 25 bp, Mus musculus
gggtccatcagagaggagtcaaagt

SEQ ID NO: 453487 - DNA, 25 bp, Mus musculus
gggtccatgcttagataatccatgt

SEQ ID NO: 453488 - DNA, 25 bp, Mus musculus
gggtccattcacttgactgtgggct

SEQ ID NO: 453489 - DNA, 25 bp, Mus musculus
gggtcccagagagcaaacttacatt

SEQ ID NO: 453490 - DNA, 25 bp, Mus musculus
gggtcccagccaagcagagtgtcat

SEQ ID NO: 453491 - DNA, 25 bp, Mus musculus
gggtcccatcttcccggcctgtagt

SEQ ID NO: 453492 - DNA, 25 bp, Mus musculus
gggtcccatgttgttacccacaaag

SEQ ID NO: 453493 - DNA, 25 bp, Mus musculus
gggtccccagaatatccgtgtcaac

SEQ ID NO: 453494 - DNA, 25 bp, Mus musculus
gggtccctcctgagctactggaagg

SEQ ID NO: 453495 - DNA, 25 bp, Mus musculus
gggtccctccttagcgaaaggcagc

SEQ ID NO: 453496 - DNA, 25 bp, Mus musculus
gggtccctgaccttggctcactagt

SEQ ID NO: 453497 - DNA, 25 bp, Mus musculus
gggtccctgaggactcccaggcgct

SEQ ID NO: 453498 - DNA, 25 bp, Mus musculus
gggtccctggcctcagactatagta

SEQ ID NO: 453499 - DNA, 25 bp, Mus musculus
gggtccctggtctcacagaagcaga

SEQ ID NO: 453500 - DNA, 25 bp, Mus musculus
gggtccctgtggtcagctggccaaa

SEQ ID NO: 453501 - DNA, 25 bp, Mus musculus
gggtccgaatcattaaaacattacg

SEQ ID NO: 453502 - DNA, 25 bp, Mus musculus
gggtccgatgcaaacttagactctg

SEQ ID NO: 453503 - DNA, 25 bp, Mus musculus
gggtccgctatcacgggcggctcaa

SEQ ID NO: 453504 - DNA, 25 bp, Mus musculus
gggtcctaggctcatatattcatcc

SEQ ID NO: 453505 - DNA, 25 bp, Mus musculus
gggtcctatgcacagtagggcattc

SEQ ID NO: 453506 - DNA, 25 bp, Mus musculus
gggtcctggacttggatgacttcaa

SEQ ID NO: 453507 - DNA, 25 bp, Mus musculus
gggtcctgtgcaccagactgaagca

SEQ ID NO: 453508 - DNA, 25 bp, Mus musculus
gggtcctgtttgcacctctgaatct

SEQ ID NO: 453509 - DNA, 25 bp, Mus musculus
gggtcgactcacacagcagtcagca

SEQ ID NO: 453510 - DNA, 25 bp, Mus musculus
gggtcgcaaggctaacctcgcgccg

SEQ ID NO: 453511 - DNA, 25 bp, Mus musculus
gggtcgcaccttgtggccgttattg

SEQ ID NO: 453512 - DNA, 25 bp, Mus musculus
gggtcgccgccatcttgtcattgag

SEQ ID NO: 453513 - DNA, 25 bp, Mus musculus
gggtcgccggaaacattgtgcgcca

SEQ ID NO: 453514 - DNA, 25 bp, Mus musculus
gggtcgcgctggtcttcgaactgca

SEQ ID NO: 453515 - DNA, 25 bp, Mus musculus
gggtcgtagtggcttcctgacccct

SEQ ID NO: 453516 - DNA, 25 bp, Mus musculus
gggtcgtcatcttactgcctcgcag

SEQ ID NO: 453517 - DNA, 25 bp, Mus musculus
gggtcgtgtccctcattctctagca

SEQ ID NO: 453518 - DNA, 25 bp, Mus musculus
gggtcgtttcctgcacatgttcctt

SEQ ID NO: 453519 - DNA, 25 bp, Mus musculus
gggtctacctcatctctgccacaaa

SEQ ID NO: 453520 - DNA, 25 bp, Mus musculus
gggtctacttactacctcacagagg

SEQ ID NO: 453521 - DNA, 25 bp, Mus musculus
gggtctagagccacttcagcctttg

SEQ ID NO: 453522 - DNA, 25 bp, Mus musculus
gggtctagagcctctcccttggaga

SEQ ID NO: 453523 - DNA, 25 bp, Mus musculus
gggtctaggcagtgcccttggccca

SEQ ID NO: 453524 - DNA, 25 bp, Mus musculus
gggtctatccgagaaatcatcctgc

SEQ ID NO: 453525 - DNA, 25 bp, Mus musculus
gggtctcagccaagcctttgagctg

SEQ ID NO: 453526 - DNA, 25 bp, Mus musculus
gggtctcatgagctcctcttcctca

SEQ ID NO: 453527 - DNA, 25 bp, Mus musculus
gggtctccctcgtcctagagctagt

SEQ ID NO: 453528 - DNA, 25 bp, Mus musculus
gggtctccgtacacagatgtgccat

SEQ ID NO: 453529 - DNA, 25 bp, Mus musculus
gggtctcctaacagttccaatcgtg

SEQ ID NO: 453530 - DNA, 25 bp, Mus musculus
gggtctccttcccatagggcaagat

SEQ ID NO: 453531 - DNA, 25 bp, Mus musculus
gggtctcggttcttcctggctctat

SEQ ID NO: 453532 - DNA, 25 bp, Mus musculus
gggtctctaaatcaacatgagcgaa

SEQ ID NO: 453533 - DNA, 25 bp, Mus musculus
gggtctctaaggctcctccagcttc

SEQ ID NO: 453534 - DNA, 25 bp, Mus musculus
gggtctctcagtcaaatccagggct

SEQ ID NO: 453535 - DNA, 25 bp, Mus musculus
gggtctctctcagggataggcacac

SEQ ID NO: 453536 - DNA, 25 bp, Mus musculus
gggtctctgtgaactgtccattcca

SEQ ID NO: 453537 - DNA, 25 bp, Mus musculus
gggtctcttcttggataaacactcc

SEQ ID NO: 453538 - DNA, 25 bp, Mus musculus
gggtctgacccctccatggaaaagg

SEQ ID NO: 453539 - DNA, 25 bp, Mus musculus
gggtctgaggacagttcacacacaa

SEQ ID NO: 453540 - DNA, 25 bp, Mus musculus
gggtctgatttgctgagacaccagc

SEQ ID NO: 453541 - DNA, 25 bp, Mus musculus
gggtctgcatcagggaccccacaaa

SEQ ID NO: 453542 - DNA, 25 bp, Mus musculus
gggtctgccctcagttggctgctca

SEQ ID NO: 453543 - DNA, 25 bp, Mus musculus
gggtctggcaggtcccggcttgcca

SEQ ID NO: 453544 - DNA, 25 bp, Mus musculus
gggtctggctttactgtttctgcat

SEQ ID NO: 453545 - DNA, 25 bp, Mus musculus
gggtctgtgattaggtttctggtcc

SEQ ID NO: 453546 - DNA, 25 bp, Mus musculus
gggtcttaagaccactccggacact

SEQ ID NO: 453547 - DNA, 25 bp, Mus musculus
gggtcttagcccacttggagagcta

SEQ ID NO: 453548 - DNA, 25 bp, Mus musculus
gggtcttaggacgtgggcattcttc

SEQ ID NO: 453549 - DNA, 25 bp, Mus musculus
gggtcttatcatcacatcagggcta

SEQ ID NO: 453550 - DNA, 25 bp, Mus musculus
gggtcttatttgctcccgctgaccc

SEQ ID NO: 453551 - DNA, 25 bp, Mus musculus
gggtcttcaagaggtctcctaccaa

SEQ ID NO: 453552 - DNA, 25 bp, Mus musculus
gggtcttgaccatgaaaggctgctg

SEQ ID NO: 453553 - DNA, 25 bp, Mus musculus
gggtcttgactccactgctagcggt

SEQ ID NO: 453554 - DNA, 25 bp, Mus musculus
gggtcttggccagtgagtctagtca

SEQ ID NO: 453555 - DNA, 25 bp, Mus musculus
gggtcttgtcgcgtccgcgtgattc

SEQ ID NO: 453556 - DNA, 25 bp, Mus musculus
gggtctttcctcacgtcactcaggg

SEQ ID NO: 453557 - DNA, 25 bp, Mus musculus
gggtcttttgcataataatatctct

SEQ ID NO: 453558 - DNA, 25 bp, Mus musculus
gggtgaacacaccaaagactttcct

SEQ ID NO: 453559 - DNA, 25 bp, Mus musculus
gggtgaaccctcacaagctctgagc

SEQ ID NO: 453560 - DNA, 25 bp, Mus musculus
gggtgaactgaaagattggtatgca

SEQ ID NO: 453561 - DNA, 25 bp, Mus musculus
gggtgacagccacctacgtgtgtct

SEQ ID NO: 453562 - DNA, 25 bp, Mus musculus
gggtgacatcagtcctctagtatgc

SEQ ID NO: 453563 - DNA, 25 bp, Mus musculus
gggtgacctccctaatatgtgccaa

SEQ ID NO: 453564 - DNA, 25 bp, Mus musculus
gggtgacctctgtctcttagctcag

SEQ ID NO: 453565 - DNA, 25 bp, Mus musculus
gggtgacctgtgtgtgcctcatcct

SEQ ID NO: 453566 - DNA, 25 bp, Mus musculus
gggtgagagcatccatagacagcat

SEQ ID NO: 453567 - DNA, 25 bp, Mus musculus
gggtgagatatcttccctacctgaa

SEQ ID NO: 453568 - DNA, 25 bp, Mus musculus
gggtgagccaattccccacgtggaa

SEQ ID NO: 453569 - DNA, 25 bp, Mus musculus
gggtgagcgctggttgccgagggtt

SEQ ID NO: 453570 - DNA, 25 bp, Mus musculus
gggtgaggactcacacacgtacgcg

SEQ ID NO: 453571 - DNA, 25 bp, Mus musculus
gggtgagtcaccatctatgatacat

SEQ ID NO: 453572 - DNA, 25 bp, Mus musculus
gggtgagtcgctgaccctctctgag

SEQ ID NO: 453573 - DNA, 25 bp, Mus musculus
gggtgagtttgcttcactagtggcc

SEQ ID NO: 453574 - DNA, 25 bp, Mus musculus
gggtgatgattgtcaatacagagct

SEQ ID NO: 453575 - DNA, 25 bp, Mus musculus
gggtgcagtcaagccaggcagaccc

SEQ ID NO: 453576 - DNA, 25 bp, Mus musculus
gggtgccaatctccagtcctcatga

SEQ ID NO: 453577 - DNA, 25 bp, Mus musculus
gggtgccactgacctgtaaatccag

SEQ ID NO: 453578 - DNA, 25 bp, Mus musculus
gggtgccagacacaggccagtatct

SEQ ID NO: 453579 - DNA, 25 bp, Mus musculus
gggtgccagtcaaggctctgtgcca

SEQ ID NO: 453580 - DNA, 25 bp, Mus musculus
gggtgcccaataaagcgtgtttgaa

SEQ ID NO: 453581 - DNA, 25 bp, Mus musculus
gggtgcccgcgttctgagaaagtct

SEQ ID NO: 453582 - DNA, 25 bp, Mus musculus
gggtgcctcaacagcaaacgtcagt

SEQ ID NO: 453583 - DNA, 25 bp, Mus musculus
gggtgcctgcccttggaccagagtc

SEQ ID NO: 453584 - DNA, 25 bp, Mus musculus
gggtgctaaaataggtactacatgg

SEQ ID NO: 453585 - DNA, 25 bp, Mus musculus
gggtgctagccatccagcatagggt

SEQ ID NO: 453586 - DNA, 25 bp, Mus musculus
gggtgctagccccatcaaggaaacc

SEQ ID NO: 453587 - DNA, 25 bp, Mus musculus
gggtgctatgaggaattgtatgcat

SEQ ID NO: 453588 - DNA, 25 bp, Mus musculus
gggtgctcccagtaagttgtccttc

SEQ ID NO: 453589 - DNA, 25 bp, Mus musculus
gggtgctcctttatacacagcaagt

SEQ ID NO: 453590 - DNA, 25 bp, Mus musculus
gggtgctctggtccaagttccctag

SEQ ID NO: 453591 - DNA, 25 bp, Mus musculus
gggtgctgaataaacctggagagcc

SEQ ID NO: 453592 - DNA, 25 bp, Mus musculus
gggtgctgaccatatcctgaaacgc

SEQ ID NO: 453593 - DNA, 25 bp, Mus musculus
gggtgctgtccacacagggattccc

SEQ ID NO: 453594 - DNA, 25 bp, Mus musculus
gggtgcttgctgaaggttctctgaa

SEQ ID NO: 453595 - DNA, 25 bp, Mus musculus
gggtgcttggcctgactatacataa

SEQ ID NO: 453596 - DNA, 25 bp, Mus musculus
gggtggaaattgcaagttaagaact

SEQ ID NO: 453597 - DNA, 25 bp, Mus musculus
gggtggaagcatacatccccttgtg

SEQ ID NO: 453598 - DNA, 25 bp, Mus musculus
gggtggaattccacggccctgacct

SEQ ID NO: 453599 - DNA, 25 bp, Mus musculus
gggtggacgaacgttcgcctctgct

SEQ ID NO: 453600 - DNA, 25 bp, Mus musculus
gggtggagaccccaaatatgcccat

SEQ ID NO: 453601 - DNA, 25 bp, Mus musculus
gggtggagccacagatccttgtaca

SEQ ID NO: 453602 - DNA, 25 bp, Mus musculus
gggtggcacacctcattccaggaag

SEQ ID NO: 453603 - DNA, 25 bp, Mus musculus
gggtggcatgtgaacctactgttac

SEQ ID NO: 453604 - DNA, 25 bp, Mus musculus
gggtggctagccatggaagctcaaa

SEQ ID NO: 453605 - DNA, 25 bp, Mus musculus
gggtgggacaaaacatcttcctccg

SEQ ID NO: 453606 - DNA, 25 bp, Mus musculus
gggtgggctgtctcaggctcacttc

SEQ ID NO: 453607 - DNA, 25 bp, Mus musculus
gggtggggtcgcatccccagctcac

SEQ ID NO: 453608 - DNA, 25 bp, Mus musculus
gggtgggtcagtttgccctaataga

SEQ ID NO: 453609 - DNA, 25 bp, Mus musculus
gggtggtccctaatatcagctgaag

SEQ ID NO: 453610 - DNA, 25 bp, Mus musculus
gggtggtccctccagatgagtggca

SEQ ID NO: 453611 - DNA, 25 bp, Mus musculus
gggtggtgatccatttcaagttatg

SEQ ID NO: 453612 - DNA, 25 bp, Mus musculus
gggtgtacaatgatcggctgcataa

SEQ ID NO: 453613 - DNA, 25 bp, Mus musculus
gggtgtagaccccatagtctccttt

SEQ ID NO: 453614 - DNA, 25 bp, Mus musculus
gggtgtagtcccttatcagcatggc

SEQ ID NO: 453615 - DNA, 25 bp, Mus musculus
gggtgtatcaacacctcagggccca

SEQ ID NO: 453616 - DNA, 25 bp, Mus musculus
gggtgtcaaacatacagtacctgca

SEQ ID NO: 453617 - DNA, 25 bp, Mus musculus
gggtgtcaccgctgaccttatgaag

SEQ ID NO: 453618 - DNA, 25 bp, Mus musculus
gggtgtcagaaattggccctccaca

SEQ ID NO: 453619 - DNA, 25 bp, Mus musculus
gggtgtctcagcagaaggtccctcc

SEQ ID NO: 453620 - DNA, 25 bp, Mus musculus
gggtgtctcctagctaactaacact

SEQ ID NO: 453621 - DNA, 25 bp, Mus musculus
gggtgtgaatcatacctgcttctca

SEQ ID NO: 453622 - DNA, 25 bp, Mus musculus
gggtgtgactgagtgatatgacttc

SEQ ID NO: 453623 - DNA, 25 bp, Mus musculus
gggtgtgccctccttacatgttcca

SEQ ID NO: 453624 - DNA, 25 bp, Mus musculus
gggtgtgcctctccgcgctggattt

SEQ ID NO: 453625 - DNA, 25 bp, Mus musculus
gggtgtgcgttccagtttttaagct

SEQ ID NO: 453626 - DNA, 25 bp, Mus musculus
gggtgtgtacccgaatcttccaggg

SEQ ID NO: 453627 - DNA, 25 bp, Mus musculus
gggtgttagcctgtcgactcaatag

SEQ ID NO: 453628 - DNA, 25 bp, Mus musculus
gggtgtttcttatggccccagagcc

SEQ ID NO: 453629 - DNA, 25 bp, Mus musculus
gggtgtttggtgacttgtgtttcct

SEQ ID NO: 453630 - DNA, 25 bp, Mus musculus
gggtgttttccaatatgaacagtgt

SEQ ID NO: 453631 - DNA, 25 bp, Mus musculus
gggttaagaacatggacaacctcaa

SEQ ID NO: 453632 - DNA, 25 bp, Mus musculus
gggttaagcctcgataaagaccttg

SEQ ID NO: 453633 - DNA, 25 bp, Mus musculus
gggttaaggcccctagagcacacga

SEQ ID NO: 453634 - DNA, 25 bp, Mus musculus
gggttaccacaatttcatcatcaga

SEQ ID NO: 453635 - DNA, 25 bp, Mus musculus
gggttaccgactcagagcccttcgc

SEQ ID NO: 453636 - DNA, 25 bp, Mus musculus
gggttacgagttcacgcctgcgatc

SEQ ID NO: 453637 - DNA, 25 bp, Mus musculus
gggttagagaaaacgcttcaccatc

SEQ ID NO: 453638 - DNA, 25 bp, Mus musculus
gggttagcccacagagcaaagcttg

SEQ ID NO: 453639 - DNA, 25 bp, Mus musculus
gggttaggcaactgccatgctgagc

SEQ ID NO: 453640 - DNA, 25 bp, Mus musculus
gggttagggaatgagtcctgcccta

SEQ ID NO: 453641 - DNA, 25 bp, Mus musculus
gggttataggcagagccaaacctaa

SEQ ID NO: 453642 - DNA, 25 bp, Mus musculus
gggttatcccgaatgcctttgagca

SEQ ID NO: 453643 - DNA, 25 bp, Mus musculus
gggttatgttcagcattccagtgaa

SEQ ID NO: 453644 - DNA, 25 bp, Mus musculus
gggttattgatgatagccatatacc

SEQ ID NO: 453645 - DNA, 25 bp, Mus musculus
gggttcaaagagcagcacctctcat

SEQ ID NO: 453646 - DNA, 25 bp, Mus musculus
gggttcacacaagctgtctcaggat

SEQ ID NO: 453647 - DNA, 25 bp, Mus musculus
gggttcacgatcctgctcctgactg

SEQ ID NO: 453648 - DNA, 25 bp, Mus musculus
gggttcacgcccaggcgctgccttg

SEQ ID NO: 453649 - DNA, 25 bp, Mus musculus
gggttcagaaactcccctagcatct

SEQ ID NO: 453650 - DNA, 25 bp, Mus musculus
gggttcagctctctgcacacgtgtg

SEQ ID NO: 453651 - DNA, 25 bp, Mus musculus
gggttcatttcatgtctgggcagca

SEQ ID NO: 453652 - DNA, 25 bp, Mus musculus
gggttccaattgcttcccgtccttg

SEQ ID NO: 453653 - DNA, 25 bp, Mus musculus
gggttcccacctggcacgcatggat

SEQ ID NO: 453654 - DNA, 25 bp, Mus musculus
gggttccccaataattggagcaggg

SEQ ID NO: 453655 - DNA, 25 bp, Mus musculus
gggttcccctcgatcactgtaactg

SEQ ID NO: 453656 - DNA, 25 bp, Mus musculus
gggttcccgcagaaaagcctattga

SEQ ID NO: 453657 - DNA, 25 bp, Mus musculus
gggttccctgggacaagtagtctag

SEQ ID NO: 453658 - DNA, 25 bp, Mus musculus
gggttccggccatcaagctgtcaga

SEQ ID NO: 453659 - DNA, 25 bp, Mus musculus
gggttcctcgcacgttcgccactga

SEQ ID NO: 453660 - DNA, 25 bp, Mus musculus
gggttcctgagataacaaggaatta

SEQ ID NO: 453661 - DNA, 25 bp, Mus musculus
gggttcggatctgttcgcaagtgct

SEQ ID NO: 453662 - DNA, 25 bp, Mus musculus
gggttcggcagctccgacaatcgta

SEQ ID NO: 453663 - DNA, 25 bp, Mus musculus
gggttcgtactctgcttcggcttta

SEQ ID NO: 453664 - DNA, 25 bp, Mus musculus
gggttctaataaactctcagcagcc

SEQ ID NO: 453665 - DNA, 25 bp, Mus musculus
gggttctactacatgaaatgactat

SEQ ID NO: 453666 - DNA, 25 bp, Mus musculus
gggttctcaagacacagacagcaaa

SEQ ID NO: 453667 - DNA, 25 bp, Mus musculus
gggttctgagtctcctgaagaatac

SEQ ID NO: 453668 - DNA, 25 bp, Mus musculus
gggttctgccccacactacgaagtg

SEQ ID NO: 453669 - DNA, 25 bp, Mus musculus
gggttcttgatccaactgcgcgatg

SEQ ID NO: 453670 - DNA, 25 bp, Mus musculus
gggttgcagcacactctcacggacc

SEQ ID NO: 453671 - DNA, 25 bp, Mus musculus
gggttgccaactcacagtttgatgt

SEQ ID NO: 453672 - DNA, 25 bp, Mus musculus
gggttgccaattccatcatcagaga

SEQ ID NO: 453673 - DNA, 25 bp, Mus musculus
gggttgcccagacactcaagaaagg

SEQ ID NO: 453674 - DNA, 25 bp, Mus musculus
gggttgcccatttcaaattgaacag

SEQ ID NO: 453675 - DNA, 25 bp, Mus musculus
gggttgcctccgagttccgccacgg

SEQ ID NO: 453676 - DNA, 25 bp, Mus musculus
gggttgctctccacacatcacgagg

SEQ ID NO: 453677 - DNA, 25 bp, Mus musculus
gggttgctggagttggccaccacat

SEQ ID NO: 453678 - DNA, 25 bp, Mus musculus
gggttggagttcctttacacactgc

SEQ ID NO: 453679 - DNA, 25 bp, Mus musculus
gggttggatccccaggctactttct

SEQ ID NO: 453680 - DNA, 25 bp, Mus musculus
gggttgtaatccatcgtccatctat

SEQ ID NO: 453681 - DNA, 25 bp, Mus musculus
gggttgtaggccactctgaaaagct

SEQ ID NO: 453682 - DNA, 25 bp, Mus musculus
gggttgttaggtgcggaggatcccg

SEQ ID NO: 453683 - DNA, 25 bp, Mus musculus
gggttgttggccagtctggctccct

SEQ ID NO: 453684 - DNA, 25 bp, Mus musculus
gggtttacaggaacaggagtacagc

SEQ ID NO: 453685 - DNA, 25 bp, Mus musculus
gggtttagtcccaaatgagtcagca

SEQ ID NO: 453686 - DNA, 25 bp, Mus musculus
gggtttataagccacaaggtcgact

SEQ ID NO: 453687 - DNA, 25 bp, Mus musculus
gggtttcagaatggagttactcgag

SEQ ID NO: 453688 - DNA, 25 bp, Mus musculus
gggtttcagcaaatcagtgtcatgg

SEQ ID NO: 453689 - DNA, 25 bp, Mus musculus
gggtttcatgcacaggacctctgaa

SEQ ID NO: 453690 - DNA, 25 bp, Mus musculus
gggtttccgcgcctttcctcaatca

SEQ ID NO: 453691 - DNA, 25 bp, Mus musculus
gggtttctatggttactggtgtcca

SEQ ID NO: 453692 - DNA, 25 bp, Mus musculus
gggtttctgaccacaagctcccctt

SEQ ID NO: 453693 - DNA, 25 bp, Mus musculus
gggtttctggcttccatggtcacca

SEQ ID NO: 453694 - DNA, 25 bp, Mus musculus
gggtttcttctgcagccgctacaaa

SEQ ID NO: 453695 - DNA, 25 bp, Mus musculus
gggtttgaccccatgactcctgata

SEQ ID NO: 453696 - DNA, 25 bp, Mus musculus
gggtttgactgcttaggaatttcca

SEQ ID NO: 453697 - DNA, 25 bp, Mus musculus
gggtttgctcctttagctcttagag

SEQ ID NO: 453698 - DNA, 25 bp, Mus musculus
gggtttggatccctaactgaacagc

SEQ ID NO: 453699 - DNA, 25 bp, Mus musculus
gggtttgggacttctagctgcacag

SEQ ID NO: 453700 - DNA, 25 bp, Mus musculus
gggtttgtccagactcataaactca

SEQ ID NO: 453701 - DNA, 25 bp, Mus musculus
gggttttacaatcctggcatagctt

SEQ ID NO: 453702 - DNA, 25 bp, Mus musculus
gggttttccaatgcccacagcagga

SEQ ID NO: 453703 - DNA, 25 bp, Mus musculus
gggttttcccaatatccagagcatc

SEQ ID NO: 453704 - DNA, 25 bp, Mus musculus
gggttttcttcctcgacacctgcag

SEQ ID NO: 453705 - DNA, 25 bp, Mus musculus
gggttttgcacaccctactcggtgg

SEQ ID NO: 453706 - DNA, 25 bp, Mus musculus
gggttttgcagtggccagaacacaa

SEQ ID NO: 453707 - DNA, 25 bp, Mus musculus
ggtaaaaagtgtctccgcaccaaga

SEQ ID NO: 453708 - DNA, 25 bp, Mus musculus
ggtaaaacgcaagcccttgtcacgg

SEQ ID NO: 453709 - DNA, 25 bp, Mus musculus
ggtaaaagctaccaagagtagaact

SEQ ID NO: 453710 - DNA, 25 bp, Mus musculus
ggtaaaattacaggactgacacatg

SEQ ID NO: 453711 - DNA, 25 bp, Mus musculus
ggtaaaattatgataccggtacaga

SEQ ID NO: 453712 - DNA, 25 bp, Mus musculus
ggtaaacgggacagatctggcccct

SEQ ID NO: 453713 - DNA, 25 bp, Mus musculus
ggtaaactggcacaaaccagaagga

SEQ ID NO: 453714 - DNA, 25 bp, Mus musculus
ggtaaagcactttcacctgcaagca

SEQ ID NO: 453715 - DNA, 25 bp, Mus musculus
ggtaaatgttgcttcagtgcatgtg

SEQ ID NO: 453716 - DNA, 25 bp, Mus musculus
ggtaaatttccaggtctctcttcgg

SEQ ID NO: 453717 - DNA, 25 bp, Mus musculus
ggtaacaacctgatctactatgtgc

SEQ ID NO: 453718 - DNA, 25 bp, Mus musculus
ggtaacaacttctgcgcgggcagtc

SEQ ID NO: 453719 - DNA, 25 bp, Mus musculus
ggtaacacagccactactcagctgg

SEQ ID NO: 453720 - DNA, 25 bp, Mus musculus
ggtaacaccatctcttgccttttgt

SEQ ID NO: 453721 - DNA, 25 bp, Mus musculus
ggtaacactggtcaccctggcatga

SEQ ID NO: 453722 - DNA, 25 bp, Mus musculus
ggtaacagcctgactctgatcgacc

SEQ ID NO: 453723 - DNA, 25 bp, Mus musculus
ggtaacaggaacatggcctctgctg

SEQ ID NO: 453724 - DNA, 25 bp, Mus musculus
ggtaacatcaagctatctggctgct

SEQ ID NO: 453725 - DNA, 25 bp, Mus musculus
ggtaaccacgtttcgcttccagcag

SEQ ID NO: 453726 - DNA, 25 bp, Mus musculus
ggtaaccagatccactgtcctcagg

SEQ ID NO: 453727 - DNA, 25 bp, Mus musculus
ggtaacccctgatccagtctgcata

SEQ ID NO: 453728 - DNA, 25 bp, Mus musculus
ggtaacctaatttgtggcctcctga

SEQ ID NO: 453729 - DNA, 25 bp, Mus musculus
ggtaaccttcttcagggccagccag

SEQ ID NO: 453730 - DNA, 25 bp, Mus musculus
ggtaactagcaactgtctaactgga

SEQ ID NO: 453731 - DNA, 25 bp, Mus musculus
ggtaactagttcgagctctgagagc

SEQ ID NO: 453732 - DNA, 25 bp, Mus musculus
ggtaactcagtataaagccatggct

SEQ ID NO: 453733 - DNA, 25 bp, Mus musculus
ggtaactgatattcaccaagtcctg

SEQ ID NO: 453734 - DNA, 25 bp, Mus musculus
ggtaagaacctagcgatgtgaaaga

SEQ ID NO: 453735 - DNA, 25 bp, Mus musculus
ggtaagaccattgttgcctccgctg

SEQ ID NO: 453736 - DNA, 25 bp, Mus musculus
ggtaagacccgttctgttcccagtg

SEQ ID NO: 453737 - DNA, 25 bp, Mus musculus
ggtaagagaaatctgttatgattca

SEQ ID NO: 453738 - DNA, 25 bp, Mus musculus
ggtaagagcgcttggagttcccaac

SEQ ID NO: 453739 - DNA, 25 bp, Mus musculus
ggtaagcagtgtgcctcaccttggc

SEQ ID NO: 453740 - DNA, 25 bp, Mus musculus
ggtaagcccttttgcctggaacaca

SEQ ID NO: 453741 - DNA, 25 bp, Mus musculus
ggtaagcgaagacttcaatcccagc

SEQ ID NO: 453742 - DNA, 25 bp, Mus musculus
ggtaagggtcactttgatgttgcgt

SEQ ID NO: 453743 - DNA, 25 bp, Mus musculus
ggtaagtagtaacttcaccaatgta

SEQ ID NO: 453744 - DNA, 25 bp, Mus musculus
ggtaagtggccggatttcctgtcac

SEQ ID NO: 453745 - DNA, 25 bp, Mus musculus
ggtaagttgaatctctgagccatgg

SEQ ID NO: 453746 - DNA, 25 bp, Mus musculus
ggtaataaacataggcccaggaggg

SEQ ID NO: 453747 - DNA, 25 bp, Mus musculus
ggtaataaattcatctacaaccttt

SEQ ID NO: 453748 - DNA, 25 bp, Mus musculus
ggtaatagccacaagcatcgccatt

SEQ ID NO: 453749 - DNA, 25 bp, Mus musculus
ggtaatatagccctcctgctcagct

SEQ ID NO: 453750 - DNA, 25 bp, Mus musculus
ggtaatcgccatgcccgaagagtca

SEQ ID NO: 453751 - DNA, 25 bp, Mus musculus
ggtaatctcgctacaagtgacacgt

SEQ ID NO: 453752 - DNA, 25 bp, Mus musculus
ggtaatgatatcaccctaccttcac

SEQ ID NO: 453753 - DNA, 25 bp, Mus musculus
ggtaatgctgctgaaagatcccaag

SEQ ID NO: 453754 - DNA, 25 bp, Mus musculus
ggtaatgggctgcaattttccagct

SEQ ID NO: 453755 - DNA, 25 bp, Mus musculus
ggtaattacactgtacagcctgtaa

SEQ ID NO: 453756 - DNA, 25 bp, Mus musculus
ggtaattcccaagacgttccagcag

SEQ ID NO: 453757 - DNA, 25 bp, Mus musculus
ggtaattgactgacggctggcttca

SEQ ID NO: 453758 - DNA, 25 bp, Mus musculus
ggtaattgccgatgctgttcccagc

SEQ ID NO: 453759 - DNA, 25 bp, Mus musculus
ggtaatttgtgatgaagtctctctc

SEQ ID NO: 453760 - DNA, 25 bp, Mus musculus
ggtacaacggagtgcctgcttctgg

SEQ ID NO: 453761 - DNA, 25 bp, Mus musculus
ggtacaactaccttcctgatgggca

SEQ ID NO: 453762 - DNA, 25 bp, Mus musculus
ggtacaagaaaccacccatgacgtg

SEQ ID NO: 453763 - DNA, 25 bp, Mus musculus
ggtacaagccagtcaaatatggcca

SEQ ID NO: 453764 - DNA, 25 bp, Mus musculus
ggtacaagcgtaattttgccatcac

SEQ ID NO: 453765 - DNA, 25 bp, Mus musculus
ggtacacaccgttcatggcaaagtc

SEQ ID NO: 453766 - DNA, 25 bp, Mus musculus
ggtacaccacgttcgcatggaggag

SEQ ID NO: 453767 - DNA, 25 bp, Mus musculus
ggtacaccggcttcagagaggccag

SEQ ID NO: 453768 - DNA, 25 bp, Mus musculus
ggtacaccttgccagtcactgtgga

SEQ ID NO: 453769 - DNA, 25 bp, Mus musculus
ggtacacggctgtctttactgtcat

SEQ ID NO: 453770 - DNA, 25 bp, Mus musculus
ggtacactctttgtagcctaaggga

SEQ ID NO: 453771 - DNA, 25 bp, Mus musculus
ggtacactgatactggagccaggtt

SEQ ID NO: 453772 - DNA, 25 bp, Mus musculus
ggtacactggcttggagagggctgg

SEQ ID NO: 453773 - DNA, 25 bp, Mus musculus
ggtacactgggcagaactcacaaag

SEQ ID NO: 453774 - DNA, 25 bp, Mus musculus
ggtacacttctagcaactgggtcat

SEQ ID NO: 453775 - DNA, 25 bp, Mus musculus
ggtacagcgcgctcaagcgccgctt

SEQ ID NO: 453776 - DNA, 25 bp, Mus musculus
ggtacaggaacgaagaaaatgactc

SEQ ID NO: 453777 - DNA, 25 bp, Mus musculus
ggtacaggctatttcaggagggatt

SEQ ID NO: 453778 - DNA, 25 bp, Mus musculus
ggtacaggtctgtaactccacttac

SEQ ID NO: 453779 - DNA, 25 bp, Mus musculus
ggtacatcactatccggcgcaagtc

SEQ ID NO: 453780 - DNA, 25 bp, Mus musculus
ggtacatcttattaagaactatctc

SEQ ID NO: 453781 - DNA, 25 bp, Mus musculus
ggtacatcttggcttccagcatcgg

SEQ ID NO: 453782 - DNA, 25 bp, Mus musculus
ggtacatgttccgtcacaagggcac

SEQ ID NO: 453783 - DNA, 25 bp, Mus musculus
ggtacattccttcatcatttctaga

SEQ ID NO: 453784 - DNA, 25 bp, Mus musculus
ggtacattggtatacgggccttcaa

SEQ ID NO: 453785 - DNA, 25 bp, Mus musculus
ggtaccaaaggctccatcgcgagta

SEQ ID NO: 453786 - DNA, 25 bp, Mus musculus
ggtaccaacccactgaactggcgtg

SEQ ID NO: 453787 - DNA, 25 bp, Mus musculus
ggtaccacactgttgcccagtctga

SEQ ID NO: 453788 - DNA, 25 bp, Mus musculus
ggtaccagcagttcctctacatggg

SEQ ID NO: 453789 - DNA, 25 bp, Mus musculus
ggtaccagcctaagcagcgttcaat

SEQ ID NO: 453790 - DNA, 25 bp, Mus musculus
ggtaccagtccagcatctaacttgt

SEQ ID NO: 453791 - DNA, 25 bp, Mus musculus
ggtaccatctgcgtcaggctttgaa

SEQ ID NO: 453792 - DNA, 25 bp, Mus musculus
ggtacccaagccttctggatctgct

SEQ ID NO: 453793 - DNA, 25 bp, Mus musculus
ggtacccaccattgtcgtgataggg

SEQ ID NO: 453794 - DNA, 25 bp, Mus musculus
ggtacccaccttcgcttatgagaag

SEQ ID NO: 453795 - DNA, 25 bp, Mus musculus
ggtacccagaactgtggacccctca

SEQ ID NO: 453796 - DNA, 25 bp, Mus musculus
ggtacccagaagagagcttgagcct

SEQ ID NO: 453797 - DNA, 25 bp, Mus musculus
ggtaccccaggataccaagttcatt

SEQ ID NO: 453798 - DNA, 25 bp, Mus musculus
ggtacccgacggatgctgaatcgct

SEQ ID NO: 453799 - DNA, 25 bp, Mus musculus
ggtaccctcacaagtccagatgctg

SEQ ID NO: 453800 - DNA, 25 bp, Mus musculus
ggtaccggcctcttacacagatgag

SEQ ID NO: 453801 - DNA, 25 bp, Mus musculus
ggtaccgtcaagaatgccactggaa

SEQ ID NO: 453802 - DNA, 25 bp, Mus musculus
ggtacctacttgtcagatggagctg

SEQ ID NO: 453803 - DNA, 25 bp, Mus musculus
ggtacctccctccatcatcaagttg

SEQ ID NO: 453804 - DNA, 25 bp, Mus musculus
ggtacctcgtaaccatggagctgga

SEQ ID NO: 453805 - DNA, 25 bp, Mus musculus
ggtacctgcaatacgcatacgacgg

SEQ ID NO: 453806 - DNA, 25 bp, Mus musculus
ggtacctggcgcacacagaacagga

SEQ ID NO: 453807 - DNA, 25 bp, Mus musculus
ggtacctgttcccactgcatggaga

SEQ ID NO: 453808 - DNA, 25 bp, Mus musculus
ggtaccttatccaccagagccttgg

SEQ ID NO: 453809 - DNA, 25 bp, Mus musculus
ggtaccttcacgcagctctccgatg

SEQ ID NO: 453810 - DNA, 25 bp, Mus musculus
ggtacctttggtggcttgggatcaa

SEQ ID NO: 453811 - DNA, 25 bp, Mus musculus
ggtacgagaccaaggacactaattc

SEQ ID NO: 453812 - DNA, 25 bp, Mus musculus
ggtacgatgaattcccacatgtggg

SEQ ID NO: 453813 - DNA, 25 bp, Mus musculus
ggtacgcctggaacattgcattgag

SEQ ID NO: 453814 - DNA, 25 bp, Mus musculus
ggtacgcgctctggtcttcacatta

SEQ ID NO: 453815 - DNA, 25 bp, Mus musculus
ggtacgctgtttttcctctgactga

SEQ ID NO: 453816 - DNA, 25 bp, Mus musculus
ggtacggccacgaacctctgtagtc

SEQ ID NO: 453817 - DNA, 25 bp, Mus musculus
ggtacggtgtatagtcagatgccaa

SEQ ID NO: 453818 - DNA, 25 bp, Mus musculus
ggtacgtcaagtgtcatctctgtca

SEQ ID NO: 453819 - DNA, 25 bp, Mus musculus
ggtacgtggactactcactcctttc

SEQ ID NO: 453820 - DNA, 25 bp, Mus musculus
ggtacgtggcagtctgtccttcaga

SEQ ID NO: 453821 - DNA, 25 bp, Mus musculus
ggtacgtttatcatgccttagtggt

SEQ ID NO: 453822 - DNA, 25 bp, Mus musculus
ggtactaaacccagtggcacactcg

SEQ ID NO: 453823 - DNA, 25 bp, Mus musculus
ggtactaatggtggcagccagccat

SEQ ID NO: 453824 - DNA, 25 bp, Mus musculus
ggtactacattccttggagataaga

SEQ ID NO: 453825 - DNA, 25 bp, Mus musculus
ggtactagccatcagacccagatgt

SEQ ID NO: 453826 - DNA, 25 bp, Mus musculus
ggtactaggcttttgcattttaaag

SEQ ID NO: 453827 - DNA, 25 bp, Mus musculus
ggtactcacctgtgttttccagcag

SEQ ID NO: 453828 - DNA, 25 bp, Mus musculus
ggtactcacgcttactggagcagaa

SEQ ID NO: 453829 - DNA, 25 bp, Mus musculus
ggtactcactactgttggcctctca

SEQ ID NO: 453830 - DNA, 25 bp, Mus musculus
ggtactcactgcactctgggctggg

SEQ ID NO: 453831 - DNA, 25 bp, Mus musculus
ggtactcccaggtcttcctgacgga

SEQ ID NO: 453832 - DNA, 25 bp, Mus musculus
ggtactccgtacacaaggcggtgga

SEQ ID NO: 453833 - DNA, 25 bp, Mus musculus
ggtactcctgagtttcttgccccag

SEQ ID NO: 453834 - DNA, 25 bp, Mus musculus
ggtactctacctcaaccagatggga

SEQ ID NO: 453835 - DNA, 25 bp, Mus musculus
ggtactgacggagctgaacggcatc

SEQ ID NO: 453836 - DNA, 25 bp, Mus musculus
ggtactgagctttgaagttgcttct

SEQ ID NO: 453837 - DNA, 25 bp, Mus musculus
ggtactgccagtgttcacacaccta

SEQ ID NO: 453838 - DNA, 25 bp, Mus musculus
ggtactggaagacagaacacgttct

SEQ ID NO: 453839 - DNA, 25 bp, Mus musculus
ggtactgggcaaagctgaactccaa

SEQ ID NO: 453840 - DNA, 25 bp, Mus musculus
ggtactgtcattttgtaaatggagc

SEQ ID NO: 453841 - DNA, 25 bp, Mus musculus
ggtactgtgcacttcctgtaaaaat

SEQ ID NO: 453842 - DNA, 25 bp, Mus musculus
ggtacttaaaccttggcatgcccgt

SEQ ID NO: 453843 - DNA, 25 bp, Mus musculus
ggtacttatccgacaccagagagtt

SEQ ID NO: 453844 - DNA, 25 bp, Mus musculus
ggtacttcagtccagatgcctgcag

SEQ ID NO: 453845 - DNA, 25 bp, Mus musculus
ggtacttgaaatcccggcaagcgcc

SEQ ID NO: 453846 - DNA, 25 bp, Mus musculus
ggtacttgtggaaccaggaccctca

SEQ ID NO: 453847 - DNA, 25 bp, Mus musculus
ggtactttcccagacaagactgagg

SEQ ID NO: 453848 - DNA, 25 bp, Mus musculus
ggtagaacaaagaaactgcctgctg

SEQ ID NO: 453849 - DNA, 25 bp, Mus musculus
ggtagaaccaatactcacctcagaa

SEQ ID NO: 453850 - DNA, 25 bp, Mus musculus
ggtagaacttccttccccatagaca

SEQ ID NO: 453851 - DNA, 25 bp, Mus musculus
ggtagaagaccttttgcttagagtc

SEQ ID NO: 453852 - DNA, 25 bp, Mus musculus
ggtagaatgtagacgtacttcatca

SEQ ID NO: 453853 - DNA, 25 bp, Mus musculus
ggtagacaaccaacatgacttccag

SEQ ID NO: 453854 - DNA, 25 bp, Mus musculus
ggtagacagggtagaagccatcctt

SEQ ID NO: 453855 - DNA, 25 bp, Mus musculus
ggtagacatttaggcgcttccccga

SEQ ID NO: 453856 - DNA, 25 bp, Mus musculus
ggtagacccagagaacgagtttgct

SEQ ID NO: 453857 - DNA, 25 bp, Mus musculus
ggtagacccccttgctttgctgaaa

SEQ ID NO: 453858 - DNA, 25 bp, Mus musculus
ggtagactgctccacgggatatatt

SEQ ID NO: 453859 - DNA, 25 bp, Mus musculus
ggtagactgctttgtatcccggcct

SEQ ID NO: 453860 - DNA, 25 bp, Mus musculus
ggtagagggtcttataatccaactg

SEQ ID NO: 453861 - DNA, 25 bp, Mus musculus
ggtagagtcctaacaataagccagt

SEQ ID NO: 453862 - DNA, 25 bp, Mus musculus
ggtagataccgacatgccctgaagc

SEQ ID NO: 453863 - DNA, 25 bp, Mus musculus
ggtagatagcaacgaggtcagcctc

SEQ ID NO: 453864 - DNA, 25 bp, Mus musculus
ggtagatcatgtttgaccacagcat

SEQ ID NO: 453865 - DNA, 25 bp, Mus musculus
ggtagatctggagcatgacccctca

SEQ ID NO: 453866 - DNA, 25 bp, Mus musculus
ggtagatgccacacttcaagaggag

SEQ ID NO: 453867 - DNA, 25 bp, Mus musculus
ggtagatgccattgaccccaccagg

SEQ ID NO: 453868 - DNA, 25 bp, Mus musculus
ggtagatgctcaggtccaggaactc

SEQ ID NO: 453869 - DNA, 25 bp, Mus musculus
ggtagattccatgtacaagccgctg

SEQ ID NO: 453870 - DNA, 25 bp, Mus musculus
ggtagattctcctcaccctaaaagg

SEQ ID NO: 453871 - DNA, 25 bp, Mus musculus
ggtagatttcctccgtgtcagtcag

SEQ ID NO: 453872 - DNA, 25 bp, Mus musculus
ggtagcaatgcactgaaaaggaaat

SEQ ID NO: 453873 - DNA, 25 bp, Mus musculus
ggtagcacgctactcaaacaactta

SEQ ID NO: 453874 - DNA, 25 bp, Mus musculus
ggtagcactttgaacaacttttggg

SEQ ID NO: 453875 - DNA, 25 bp, Mus musculus
ggtagcagatcaggacctactgcca

SEQ ID NO: 453876 - DNA, 25 bp, Mus musculus
ggtagcagcttcagtttcagcagca

SEQ ID NO: 453877 - DNA, 25 bp, Mus musculus
ggtagcagtagaagccccaagtagg

SEQ ID NO: 453878 - DNA, 25 bp, Mus musculus
ggtagcagttgttttcccgtatgaa

SEQ ID NO: 453879 - DNA, 25 bp, Mus musculus
ggtagcatcctagcaaaggccctat

SEQ ID NO: 453880 - DNA, 25 bp, Mus musculus
ggtagcatcgttatcacgttctcat

SEQ ID NO: 453881 - DNA, 25 bp, Mus musculus
ggtagcatgtttccttgaccagtgc

SEQ ID NO: 453882 - DNA, 25 bp, Mus musculus
ggtagccacagacttattttcatgc

SEQ ID NO: 453883 - DNA, 25 bp, Mus musculus
ggtagccaccccttgtcctgaacta

SEQ ID NO: 453884 - DNA, 25 bp, Mus musculus
ggtagccaggctgaacacaggagca

SEQ ID NO: 453885 - DNA, 25 bp, Mus musculus
ggtagccatacagcgacttccagat

SEQ ID NO: 453886 - DNA, 25 bp, Mus musculus
ggtagccattgtgtctcgaagaagc

SEQ ID NO: 453887 - DNA, 25 bp, Mus musculus
ggtagcccaaggtacaactatttag

SEQ ID NO: 453888 - DNA, 25 bp, Mus musculus
ggtagcccagtgtgattgcagccgc

SEQ ID NO: 453889 - DNA, 25 bp, Mus musculus
ggtagcccatgagccctttctgcag

SEQ ID NO: 453890 - DNA, 25 bp, Mus musculus
ggtagccccagtgttgattcgagaa

SEQ ID NO: 453891 - DNA, 25 bp, Mus musculus
ggtagccccattcaccagattctgc

SEQ ID NO: 453892 - DNA, 25 bp, Mus musculus
ggtagccctggcagctcgtgccaga

SEQ ID NO: 453893 - DNA, 25 bp, Mus musculus
ggtagccgctttggcggcgcgcagg

SEQ ID NO: 453894 - DNA, 25 bp, Mus musculus
ggtagcctagcaccctttgtcttga

SEQ ID NO: 453895 - DNA, 25 bp, Mus musculus
ggtagcctgaaaccctatgtagatc

SEQ ID NO: 453896 - DNA, 25 bp, Mus musculus
ggtagcctgtgttagggccctgccc

SEQ ID NO: 453897 - DNA, 25 bp, Mus musculus
ggtagccttttcgagcctgacgcct

SEQ ID NO: 453898 - DNA, 25 bp, Mus musculus
ggtagctataagtgctcctgccgcg

SEQ ID NO: 453899 - DNA, 25 bp, Mus musculus
ggtagctcagcccaaaaaaccgtgc

SEQ ID NO: 453900 - DNA, 25 bp, Mus musculus
ggtagctccagccactgacaagcaa

SEQ ID NO: 453901 - DNA, 25 bp, Mus musculus
ggtagctctgagagcaaccctggac

SEQ ID NO: 453902 - DNA, 25 bp, Mus musculus
ggtagctgccacagacaacgctcat

SEQ ID NO: 453903 - DNA, 25 bp, Mus musculus
ggtagctgggctagcatgcagattt

SEQ ID NO: 453904 - DNA, 25 bp, Mus musculus
ggtagcttctctggtagaaggagaa

SEQ ID NO: 453905 - DNA, 25 bp, Mus musculus
ggtagcttctggcttgaaaccctct

SEQ ID NO: 453906 - DNA, 25 bp, Mus musculus
ggtaggaaacaactccgtgcccgat

SEQ ID NO: 453907 - DNA, 25 bp, Mus musculus
ggtaggaccatcttataaagaagca

SEQ ID NO: 453908 - DNA, 25 bp, Mus musculus
ggtaggattcctcccatggctaatg

SEQ ID NO: 453909 - DNA, 25 bp, Mus musculus
ggtaggcagtcaagctgcattgctt

SEQ ID NO: 453910 - DNA, 25 bp, Mus musculus
ggtaggcatttttcacaagtattcc

SEQ ID NO: 453911 - DNA, 25 bp, Mus musculus
ggtaggccatctttggaacgagtca

SEQ ID NO: 453912 - DNA, 25 bp, Mus musculus
ggtaggcccggcaacaggtgctgct

SEQ ID NO: 453913 - DNA, 25 bp, Mus musculus
ggtaggctttgagcacgccggcttc

SEQ ID NO: 453914 - DNA, 25 bp, Mus musculus
ggtagggcatttttcagggatctga

SEQ ID NO: 453915 - DNA, 25 bp, Mus musculus
ggtagggttagaaagaccgaatatg

SEQ ID NO: 453916 - DNA, 25 bp, Mus musculus
ggtagtaaccagatagtccacacac

SEQ ID NO: 453917 - DNA, 25 bp, Mus musculus
ggtagtagacttcagcagccaagct

SEQ ID NO: 453918 - DNA, 25 bp, Mus musculus
ggtagtagagttccgccacatgaga

SEQ ID NO: 453919 - DNA, 25 bp, Mus musculus
ggtagtagctctggaatttgacact

SEQ ID NO: 453920 - DNA, 25 bp, Mus musculus
ggtagtctcttgctatagaagtcag

SEQ ID NO: 453921 - DNA, 25 bp, Mus musculus
ggtagtgaaggcctgtagggacctt

SEQ ID NO: 453922 - DNA, 25 bp, Mus musculus
ggtagtgagtaccttcaagagaagc

SEQ ID NO: 453923 - DNA, 25 bp, Mus musculus
ggtagtgattgcctttctccgccaa

SEQ ID NO: 453924 - DNA, 25 bp, Mus musculus
ggtagtggctgcttacccgctcgga

SEQ ID NO: 453925 - DNA, 25 bp, Mus musculus
ggtagtgtctgtgtatagccagcag

SEQ ID NO: 453926 - DNA, 25 bp, Mus musculus
ggtagtgttccctctgcaaatgatc

SEQ ID NO: 453927 - DNA, 25 bp, Mus musculus
ggtagtgttcttttcctcaatgaca

SEQ ID NO: 453928 - DNA, 25 bp, Mus musculus
ggtagttacagccaacagagggtca

SEQ ID NO: 453929 - DNA, 25 bp, Mus musculus
ggtagttctgatgctccctcaagtg

SEQ ID NO: 453930 - DNA, 25 bp, Mus musculus
ggtagttgcacacctagtctggagt

SEQ ID NO: 453931 - DNA, 25 bp, Mus musculus
ggtagttgttctctcaggccacaca

SEQ ID NO: 453932 - DNA, 25 bp, Mus musculus
ggtagtttcttccttcgcctctcaa

SEQ ID NO: 453933 - DNA, 25 bp, Mus musculus
ggtagttttatatcaccttgatgca

SEQ ID NO: 453934 - DNA, 25 bp, Mus musculus
ggtataaaaatctccccacagcctc

SEQ ID NO: 453935 - DNA, 25 bp, Mus musculus
ggtataacaccaaggaccgagctgt

SEQ ID NO: 453936 - DNA, 25 bp, Mus musculus
ggtataacttcagcgcatcctccaa

SEQ ID NO: 453937 - DNA, 25 bp, Mus musculus
ggtataacttgtctagtctagtcta

SEQ ID NO: 453938 - DNA, 25 bp, Mus musculus
ggtataagatgtgccctccaggaac

SEQ ID NO: 453939 - DNA, 25 bp, Mus musculus
ggtatagaatcccatcacgcgtggg

SEQ ID NO: 453940 - DNA, 25 bp, Mus musculus
ggtatagaatgctgggaccttgagc

SEQ ID NO: 453941 - DNA, 25 bp, Mus musculus
ggtatagagattgtccctgccctgc

SEQ ID NO: 453942 - DNA, 25 bp, Mus musculus
ggtatagagtatctgcttttcctgt

SEQ ID NO: 453943 - DNA, 25 bp, Mus musculus
ggtatagcatctgactttccctctg

SEQ ID NO: 453944 - DNA, 25 bp, Mus musculus
ggtatagccgtcaagaaaaccaggc

SEQ ID NO: 453945 - DNA, 25 bp, Mus musculus
ggtatagcctgacaaccgtgtgttg

SEQ ID NO: 453946 - DNA, 25 bp, Mus musculus
ggtatagctaccaaagtctcctgga

SEQ ID NO: 453947 - DNA, 25 bp, Mus musculus
ggtatagctcaatgatacaccccag

SEQ ID NO: 453948 - DNA, 25 bp, Mus musculus
ggtataggcctgctcttagaaataa

SEQ ID NO: 453949 - DNA, 25 bp, Mus musculus
ggtatatacctttccagacgcggga

SEQ ID NO: 453950 - DNA, 25 bp, Mus musculus
ggtatatctacaacaggagtcgggt

SEQ ID NO: 453951 - DNA, 25 bp, Mus musculus
ggtatatcttcagcgtgacctgcaa

SEQ ID NO: 453952 - DNA, 25 bp, Mus musculus
ggtatattaccgcttccaccgggct

SEQ ID NO: 453953 - DNA, 25 bp, Mus musculus
ggtatattctatgggctctcccctc

SEQ ID NO: 453954 - DNA, 25 bp, Mus musculus
ggtatcaaatcacaagcctggctgg

SEQ ID NO: 453955 - DNA, 25 bp, Mus musculus
ggtatcaactcttacggcagccagc

SEQ ID NO: 453956 - DNA, 25 bp, Mus musculus
ggtatcacaagaccatgattctgac

SEQ ID NO: 453957 - DNA, 25 bp, Mus musculus
ggtatcacagtcaccctggctttgg

SEQ ID NO: 453958 - DNA, 25 bp, Mus musculus
ggtatcacctggaggccaagtacag

SEQ ID NO: 453959 - DNA, 25 bp, Mus musculus
ggtatcagagcatcgccacagaatg

SEQ ID NO: 453960 - DNA, 25 bp, Mus musculus
ggtatccaacatcctcgaacagctg

SEQ ID NO: 453961 - DNA, 25 bp, Mus musculus
ggtatccaggaaggcggcccagcct

SEQ ID NO: 453962 - DNA, 25 bp, Mus musculus
ggtatccaggtctaaatcaggtgct

SEQ ID NO: 453963 - DNA, 25 bp, Mus musculus
ggtatccagtgtgacaggacagttg

SEQ ID NO: 453964 - DNA, 25 bp, Mus musculus
ggtatccagttcagtgacctctctc

SEQ ID NO: 453965 - DNA, 25 bp, Mus musculus
ggtatcccatgcctgccagctgatg

SEQ ID NO: 453966 - DNA, 25 bp, Mus musculus
ggtatccctcctaagctcccaggat

SEQ ID NO: 453967 - DNA, 25 bp, Mus musculus
ggtatccggagcagagggtatattt

SEQ ID NO: 453968 - DNA, 25 bp, Mus musculus
ggtatcgcttgggaggccaccgcct

SEQ ID NO: 453969 - DNA, 25 bp, Mus musculus
ggtatctactatgtccccaaaggaa

SEQ ID NO: 453970 - DNA, 25 bp, Mus musculus
ggtatctatcaatgctcttccggaa

SEQ ID NO: 453971 - DNA, 25 bp, Mus musculus
ggtatctccaagcacccaattaaga

SEQ ID NO: 453972 - DNA, 25 bp, Mus musculus
ggtatctgaagtaccactggccttg

SEQ ID NO: 453973 - DNA, 25 bp, Mus musculus
ggtatcttaaccaggcattgtgtgc

SEQ ID NO: 453974 - DNA, 25 bp, Mus musculus
ggtatcttctggtgttcaaggccca

SEQ ID NO: 453975 - DNA, 25 bp, Mus musculus
ggtatcttttcagaagactcgtgaa

SEQ ID NO: 453976 - DNA, 25 bp, Mus musculus
ggtatgaaagcctccaaatccctgg

SEQ ID NO: 453977 - DNA, 25 bp, Mus musculus
ggtatgaatcccacagagggcactg

SEQ ID NO: 453978 - DNA, 25 bp, Mus musculus
ggtatgacagaatacacccgccagg

SEQ ID NO: 453979 - DNA, 25 bp, Mus musculus
ggtatgactgcacgtggaacaccac

SEQ ID NO: 453980 - DNA, 25 bp, Mus musculus
ggtatgcaaaatccactacggaggc

SEQ ID NO: 453981 - DNA, 25 bp, Mus musculus
ggtatgcacgggttttcctctagct

SEQ ID NO: 453982 - DNA, 25 bp, Mus musculus
ggtatgcctacctggcgtctctggg

SEQ ID NO: 453983 - DNA, 25 bp, Mus musculus
ggtatgcttacctcagtccctggca

SEQ ID NO: 453984 - DNA, 25 bp, Mus musculus
ggtatggacacctatgcctttatct

SEQ ID NO: 453985 - DNA, 25 bp, Mus musculus
ggtatggaccattccaccgtctcct

SEQ ID NO: 453986 - DNA, 25 bp, Mus musculus
ggtatggccacatggcaagccagaa

SEQ ID NO: 453987 - DNA, 25 bp, Mus musculus
ggtatggccctgttcatggtttccc

SEQ ID NO: 453988 - DNA, 25 bp, Mus musculus
ggtatggctgcctaatcttccctgc

SEQ ID NO: 453989 - DNA, 25 bp, Mus musculus
ggtatggtatatcctggctgcaaga

SEQ ID NO: 453990 - DNA, 25 bp, Mus musculus
ggtatgtattgtccagccagcacag

SEQ ID NO: 453991 - DNA, 25 bp, Mus musculus
ggtatgtcagcaccctgccaaaaaa

SEQ ID NO: 453992 - DNA, 25 bp, Mus musculus
ggtatgtcatctcctcgtccatcgg

SEQ ID NO: 453993 - DNA, 25 bp, Mus musculus
ggtatgtggcccaaatcctggatga

SEQ ID NO: 453994 - DNA, 25 bp, Mus musculus
ggtattaacaaagaccaccctggct

SEQ ID NO: 453995 - DNA, 25 bp, Mus musculus
ggtattaagtccttgcccctgcaga

SEQ ID NO: 453996 - DNA, 25 bp, Mus musculus
ggtattatacccctcgagaagaaga

SEQ ID NO: 453997 - DNA, 25 bp, Mus musculus
ggtattatacgaggatgccgcccga

SEQ ID NO: 453998 - DNA, 25 bp, Mus musculus
ggtattcacaaagccctccaggagg

SEQ ID NO: 453999 - DNA, 25 bp, Mus musculus
ggtattcacgcccatcaaggcagac

SEQ ID NO: 454000 - DNA, 25 bp, Mus musculus
ggtattcactaaccacctcaagttt

SEQ ID NO: 454001 - DNA, 25 bp, Mus musculus
ggtattcagtatagtcctgggtact

SEQ ID NO: 454002 - DNA, 25 bp, Mus musculus
ggtattcctctccagttcagctggg

SEQ ID NO: 454003 - DNA, 25 bp, Mus musculus
ggtattcctgttcgatgacctcctg

SEQ ID NO: 454004 - DNA, 25 bp, Mus musculus
ggtattcgcgggtctcaggcagccc

SEQ ID NO: 454005 - DNA, 25 bp, Mus musculus
ggtattgaacgcctccaacgaacaa

SEQ ID NO: 454006 - DNA, 25 bp, Mus musculus
ggtattgactatagccaaggcgcca

SEQ ID NO: 454007 - DNA, 25 bp, Mus musculus
ggtattggagcgtgaagagcctaaa

SEQ ID NO: 454008 - DNA, 25 bp, Mus musculus
ggtatttaagacacagcctccctcg

SEQ ID NO: 454009 - DNA, 25 bp, Mus musculus
ggtatttcctgactagactgcattt

SEQ ID NO: 454010 - DNA, 25 bp, Mus musculus
ggtatttgcagctaggccctatcct

SEQ ID NO: 454011 - DNA, 25 bp, Mus musculus
ggtattttagtgtttcttctggtca

SEQ ID NO: 454012 - DNA, 25 bp, Mus musculus
ggtcaaaaagctccccaatccatgc

SEQ ID NO: 454013 - DNA, 25 bp, Mus musculus
ggtcaaagaaaatgctaacgctgga

SEQ ID NO: 454014 - DNA, 25 bp, Mus musculus
ggtcaaatccttctatgccagccag

SEQ ID NO: 454015 - DNA, 25 bp, Mus musculus
ggtcaacagtgtattatttcccagg

SEQ ID NO: 454016 - DNA, 25 bp, Mus musculus
ggtcaaccctcacggtacctcatta

SEQ ID NO: 454017 - DNA, 25 bp, Mus musculus
ggtcaagaaatacagaaatggcagt

SEQ ID NO: 454018 - DNA, 25 bp, Mus musculus
ggtcaagaactacaacccgctggag

SEQ ID NO: 454019 - DNA, 25 bp, Mus musculus
ggtcaagagcgcgtctaaagccgta

SEQ ID NO: 454020 - DNA, 25 bp, Mus musculus
ggtcaagatcgccacaaccagagct

SEQ ID NO: 454021 - DNA, 25 bp, Mus musculus
ggtcaagcaccatggataaacagtc

SEQ ID NO: 454022 - DNA, 25 bp, Mus musculus
ggtcaagcccgtcagagccagtttt

SEQ ID NO: 454023 - DNA, 25 bp, Mus musculus
ggtcaagctatctcctaaaacatgg

SEQ ID NO: 454024 - DNA, 25 bp, Mus musculus
ggtcaaggaagcatcagaagaaaac

SEQ ID NO: 454025 - DNA, 25 bp, Mus musculus
ggtcaaggtctttcctgcccctgct

SEQ ID NO: 454026 - DNA, 25 bp, Mus musculus
ggtcaaggttacatcccagtggaag

SEQ ID NO: 454027 - DNA, 25 bp, Mus musculus
ggtcaagtccatgcgaaacgtgcca

SEQ ID NO: 454028 - DNA, 25 bp, Mus musculus
ggtcaagtccggcagaggtacctct

SEQ ID NO: 454029 - DNA, 25 bp, Mus musculus
ggtcaagttaccagcacacaacatg

SEQ ID NO: 454030 - DNA, 25 bp, Mus musculus
ggtcaagttcaaccagcgctcggtg

SEQ ID NO: 454031 - DNA, 25 bp, Mus musculus
ggtcaagttctatacgcctgatgcg

SEQ ID NO: 454032 - DNA, 25 bp, Mus musculus
ggtcaagttcttccgtgccctgaga

SEQ ID NO: 454033 - DNA, 25 bp, Mus musculus
ggtcaataccggagcgagcgttcgt

SEQ ID NO: 454034 - DNA, 25 bp, Mus musculus
ggtcaataggctccttggcttgcag

SEQ ID NO: 454035 - DNA, 25 bp, Mus musculus
ggtcaatgacaacgaagccagaaag

SEQ ID NO: 454036 - DNA, 25 bp, Mus musculus
ggtcaattacttcacatggccaacg

SEQ ID NO: 454037 - DNA, 25 bp, Mus musculus
ggtcaattcagccaccagattccag

SEQ ID NO: 454038 - DNA, 25 bp, Mus musculus
ggtcaattccatgctgtcagttcaa

SEQ ID NO: 454039 - DNA, 25 bp, Mus musculus
ggtcaattctaagccgatttctgaa

SEQ ID NO: 454040 - DNA, 25 bp, Mus musculus
ggtcacaaccatgaagagccactga

SEQ ID NO: 454041 - DNA, 25 bp, Mus musculus
ggtcacacacatgtagtcccagcta

SEQ ID NO: 454042 - DNA, 25 bp, Mus musculus
ggtcacacatatgctatcaggaggg

SEQ ID NO: 454043 - DNA, 25 bp, Mus musculus
ggtcacaccctcaacctgctgtgtg

SEQ ID NO: 454044 - DNA, 25 bp, Mus musculus
ggtcacagactcctgcgtagtggca

SEQ ID NO: 454045 - DNA, 25 bp, Mus musculus
ggtcacatccccaaaaagttactct

SEQ ID NO: 454046 - DNA, 25 bp, Mus musculus
ggtcacatgcactttctttcccagg

SEQ ID NO: 454047 - DNA, 25 bp, Mus musculus
ggtcacatggcagaaggcctccaat

SEQ ID NO: 454048 - DNA, 25 bp, Mus musculus
ggtcacatgtctgctctggagtagt

SEQ ID NO: 454049 - DNA, 25 bp, Mus musculus
ggtcaccacttgcacacacaaagga

SEQ ID NO: 454050 - DNA, 25 bp, Mus musculus
ggtcaccagcaggaatgctcttgtg

SEQ ID NO: 454051 - DNA, 25 bp, Mus musculus
ggtcacccaccgtcagatttacaga

SEQ ID NO: 454052 - DNA, 25 bp, Mus musculus
ggtcacccagaagcgagtgcttaag

SEQ ID NO: 454053 - DNA, 25 bp, Mus musculus
ggtcacccagccagccttttgtcat

SEQ ID NO: 454054 - DNA, 25 bp, Mus musculus
ggtcacccaggatgccacgacttgt

SEQ ID NO: 454055 - DNA, 25 bp, Mus musculus
ggtcaccgaacctgcagagatcatg

SEQ ID NO: 454056 - DNA, 25 bp, Mus musculus
ggtcaccgtgataggatcttccaaa

SEQ ID NO: 454057 - DNA, 25 bp, Mus musculus
ggtcacctacagcaaaacccatggg

SEQ ID NO: 454058 - DNA, 25 bp, Mus musculus
ggtcacctatgaggatccccaggct

SEQ ID NO: 454059 - DNA, 25 bp, Mus musculus
ggtcacctcaaacatttcccatagc

SEQ ID NO: 454060 - DNA, 25 bp, Mus musculus
ggtcacctccatcataagctgttag

SEQ ID NO: 454061 - DNA, 25 bp, Mus musculus
ggtcacctctctccttcttgcatag

SEQ ID NO: 454062 - DNA, 25 bp, Mus musculus
ggtcaccttggtcatcgcaaagcat

SEQ ID NO: 454063 - DNA, 25 bp, Mus musculus
ggtcacgaggtgtgtctacggctca

SEQ ID NO: 454064 - DNA, 25 bp, Mus musculus
ggtcacgatagccaaaattcccaga

SEQ ID NO: 454065 - DNA, 25 bp, Mus musculus
ggtcacgcatatttggcccaggaat

SEQ ID NO: 454066 - DNA, 25 bp, Mus musculus
ggtcactactgacctcgcgctgtag

SEQ ID NO: 454067 - DNA, 25 bp, Mus musculus
ggtcactccgcctgagggctacgat

SEQ ID NO: 454068 - DNA, 25 bp, Mus musculus
ggtcactctccaattatgatggaag

SEQ ID NO: 454069 - DNA, 25 bp, Mus musculus
ggtcactgatagagattttcccgcg

SEQ ID NO: 454070 - DNA, 25 bp, Mus musculus
ggtcactggtggaatctgacttgct

SEQ ID NO: 454071 - DNA, 25 bp, Mus musculus
ggtcacttaaagatgaactcagtgc

SEQ ID NO: 454072 - DNA, 25 bp, Mus musculus
ggtcacttctggtagctggtcatca

SEQ ID NO: 454073 - DNA, 25 bp, Mus musculus
ggtcactttatagctccagtctggg

SEQ ID NO: 454074 - DNA, 25 bp, Mus musculus
ggtcagaatatatttccatgtgtca

SEQ ID NO: 454075 - DNA, 25 bp, Mus musculus
ggtcagactctgtcactaaacaagt

SEQ ID NO: 454076 - DNA, 25 bp, Mus musculus
ggtcagattctgcatgtgtccacag

SEQ ID NO: 454077 - DNA, 25 bp, Mus musculus
ggtcagcagattaacccatgtcaca

SEQ ID NO: 454078 - DNA, 25 bp, Mus musculus
ggtcagcagcacatgggcatcagag

SEQ ID NO: 454079 - DNA, 25 bp, Mus musculus
ggtcagccctcacgagctacctggt

SEQ ID NO: 454080 - DNA, 25 bp, Mus musculus
ggtcagcctgaagtccaagtctcgg

SEQ ID NO: 454081 - DNA, 25 bp, Mus musculus
ggtcagcctgctgctcattgggatt

SEQ ID NO: 454082 - DNA, 25 bp, Mus musculus
ggtcagcgcctacatcaagaagatc

SEQ ID NO: 454083 - DNA, 25 bp, Mus musculus
ggtcagcttctatggcaacacccag

SEQ ID NO: 454084 - DNA, 25 bp, Mus musculus
ggtcaggcgaggaccaactccacct

SEQ ID NO: 454085 - DNA, 25 bp, Mus musculus
ggtcagggacccacacttaggaagt

SEQ ID NO: 454086 - DNA, 25 bp, Mus musculus
ggtcagtaatgagcagcgccagcat

SEQ ID NO: 454087 - DNA, 25 bp, Mus musculus
ggtcagtcaccaacagaagatcagt

SEQ ID NO: 454088 - DNA, 25 bp, Mus musculus
ggtcagtcagcagtaaactcctagg

SEQ ID NO: 454089 - DNA, 25 bp, Mus musculus
ggtcagtctggtctataggtccagc

SEQ ID NO: 454090 - DNA, 25 bp, Mus musculus
ggtcagtgataaataactcctctag

SEQ ID NO: 454091 - DNA, 25 bp, Mus musculus
ggtcagtgctacacagttcacctgt

SEQ ID NO: 454092 - DNA, 25 bp, Mus musculus
ggtcagttccttatgtcaccacaga

SEQ ID NO: 454093 - DNA, 25 bp, Mus musculus
ggtcagttgacccaagaactgttct

SEQ ID NO: 454094 - DNA, 25 bp, Mus musculus
ggtcataaatgatctgctgctgctg

SEQ ID NO: 454095 - DNA, 25 bp, Mus musculus
ggtcataaggcagccaccgttgggt

SEQ ID NO: 454096 - DNA, 25 bp, Mus musculus
ggtcataatctcatccctccgttgg

SEQ ID NO: 454097 - DNA, 25 bp, Mus musculus
ggtcataatggacagggaagatctc

SEQ ID NO: 454098 - DNA, 25 bp, Mus musculus
ggtcatacattcctagccagccggg

SEQ ID NO: 454099 - DNA, 25 bp, Mus musculus
ggtcatacgattttggtttacctcg

SEQ ID NO: 454100 - DNA, 25 bp, Mus musculus
ggtcatacttccatctccttgaaca

SEQ ID NO: 454101 - DNA, 25 bp, Mus musculus
ggtcatatattgacaagaaatggtg

SEQ ID NO: 454102 - DNA, 25 bp, Mus musculus
ggtcatcagccttgtgcagcgaaca

SEQ ID NO: 454103 - DNA, 25 bp, Mus musculus
ggtcatcccagactcgcgggtcctt

SEQ ID NO: 454104 - DNA, 25 bp, Mus musculus
ggtcatcccaggaatctaaactaag

SEQ ID NO: 454105 - DNA, 25 bp, Mus musculus
ggtcatcctgacctacaatggtaag

SEQ ID NO: 454106 - DNA, 25 bp, Mus musculus
ggtcatctccattaatataaaaggc

SEQ ID NO: 454107 - DNA, 25 bp, Mus musculus
ggtcatctgattctgtggccacact

SEQ ID NO: 454108 - DNA, 25 bp, Mus musculus
ggtcatcttaggcaggatggcccct

SEQ ID NO: 454109 - DNA, 25 bp, Mus musculus
ggtcatgagcctccttcgcttccag

SEQ ID NO: 454110 - DNA, 25 bp, Mus musculus
ggtcatgatctccacatgcccagag

SEQ ID NO: 454111 - DNA, 25 bp, Mus musculus
ggtcatgctgccatcaacaaatatg

SEQ ID NO: 454112 - DNA, 25 bp, Mus musculus
ggtcatggacaacctgaacttgccc

SEQ ID NO: 454113 - DNA, 25 bp, Mus musculus
ggtcatgtcacagccagaacgatgt

SEQ ID NO: 454114 - DNA, 25 bp, Mus musculus
ggtcatgttcgctccttagccggca

SEQ ID NO: 454115 - DNA, 25 bp, Mus musculus
ggtcatgtttcccacccacaaatta

SEQ ID NO: 454116 - DNA, 25 bp, Mus musculus
ggtcattaccccagcaagtgcattg

SEQ ID NO: 454117 - DNA, 25 bp, Mus musculus
ggtcattagtgttcccagaggcaga

SEQ ID NO: 454118 - DNA, 25 bp, Mus musculus
ggtcattatggaacggctgcagcag

SEQ ID NO: 454119 - DNA, 25 bp, Mus musculus
ggtcattctggtagatgactacagc

SEQ ID NO: 454120 - DNA, 25 bp, Mus musculus
ggtcattgacaaagatggcatccac

SEQ ID NO: 454121 - DNA, 25 bp, Mus musculus
ggtcattgctgtgggcatcttcctg

SEQ ID NO: 454122 - DNA, 25 bp, Mus musculus
ggtcatttcacaccaggagcccaga

SEQ ID NO: 454123 - DNA, 25 bp, Mus musculus
ggtcattttggtagaggcaccccca

SEQ ID NO: 454124 - DNA, 25 bp, Mus musculus
ggtccaaacagcctcaacctgggtc

SEQ ID NO: 454125 - DNA, 25 bp, Mus musculus
ggtccaaagccctgaacacctgtgg

SEQ ID NO: 454126 - DNA, 25 bp, Mus musculus
ggtccaaagccttagctagcctggg

SEQ ID NO: 454127 - DNA, 25 bp, Mus musculus
ggtccaaaggaagccaggccggcaa

SEQ ID NO: 454128 - DNA, 25 bp, Mus musculus
ggtccaaatccagctaccaagtgtt

SEQ ID NO: 454129 - DNA, 25 bp, Mus musculus
ggtccaagacctttatgaaacaatg

SEQ ID NO: 454130 - DNA, 25 bp, Mus musculus
ggtccaagcaatgctcagtgctgtg

SEQ ID NO: 454131 - DNA, 25 bp, Mus musculus
ggtccaagcccaggattggttgcgc

SEQ ID NO: 454132 - DNA, 25 bp, Mus musculus
ggtccaagccccaaagagataacag

SEQ ID NO: 454133 - DNA, 25 bp, Mus musculus
ggtccaagcttcctagtagccaagg

SEQ ID NO: 454134 - DNA, 25 bp, Mus musculus
ggtccaagttcattcagcaaggcaa

SEQ ID NO: 454135 - DNA, 25 bp, Mus musculus
ggtccacaggttctcaatgcccaga

SEQ ID NO: 454136 - DNA, 25 bp, Mus musculus
ggtccacattgccactgccattatg

SEQ ID NO: 454137 - DNA, 25 bp, Mus musculus
ggtccaccagcggttttgtttctgt

SEQ ID NO: 454138 - DNA, 25 bp, Mus musculus
ggtccacctgaagacaccaagttca

SEQ ID NO: 454139 - DNA, 25 bp, Mus musculus
ggtccacggcaacaacaaagtcatg

SEQ ID NO: 454140 - DNA, 25 bp, Mus musculus
ggtccactgtgcaaagtcctcaggt

SEQ ID NO: 454141 - DNA, 25 bp, Mus musculus
ggtccagactgccactcttgcaatc

SEQ ID NO: 454142 - DNA, 25 bp, Mus musculus
ggtccagagaagtggcagacactca

SEQ ID NO: 454143 - DNA, 25 bp, Mus musculus
ggtccagattctactacccagtgta

SEQ ID NO: 454144 - DNA, 25 bp, Mus musculus
ggtccagcaactcatccacgggttt

SEQ ID NO: 454145 - DNA, 25 bp, Mus musculus
ggtccagccccttctcatagcatag

SEQ ID NO: 454146 - DNA, 25 bp, Mus musculus
ggtccagcgcaaacaagcgcagtca

SEQ ID NO: 454147 - DNA, 25 bp, Mus musculus
ggtccagcgggactacactcttaag

SEQ ID NO: 454148 - DNA, 25 bp, Mus musculus
ggtccaggaaaatactgctgctgca

SEQ ID NO: 454149 - DNA, 25 bp, Mus musculus
ggtccaggcctgtgatagtcctcag

SEQ ID NO: 454150 - DNA, 25 bp, Mus musculus
ggtccaggtatactatgggcccagc

SEQ ID NO: 454151 - DNA, 25 bp, Mus musculus
ggtccagtatccatcaaagtgcagg

SEQ ID NO: 454152 - DNA, 25 bp, Mus musculus
ggtccagtcagcaaggcaacagagc

SEQ ID NO: 454153 - DNA, 25 bp, Mus musculus
ggtccagtctgtgagcttgccatcc

SEQ ID NO: 454154 - DNA, 25 bp, Mus musculus
ggtccatcataccttgggttctcaa

SEQ ID NO: 454155 - DNA, 25 bp, Mus musculus
ggtccatgccaaccactccaggaat

SEQ ID NO: 454156 - DNA, 25 bp, Mus musculus
ggtccattcggagcataactgagtt

SEQ ID NO: 454157 - DNA, 25 bp, Mus musculus
ggtcccaacattgtactcagcgagg

SEQ ID NO: 454158 - DNA, 25 bp, Mus musculus
ggtcccaagccagagtgagagtcaa

SEQ ID NO: 454159 - DNA, 25 bp, Mus musculus
ggtcccaagggagctcacattatgg

SEQ ID NO: 454160 - DNA, 25 bp, Mus musculus
ggtcccagaatgacagctgcctaca

SEQ ID NO: 454161 - DNA, 25 bp, Mus musculus
ggtcccagcccttggatagtgagaa

SEQ ID NO: 454162 - DNA, 25 bp, Mus musculus
ggtcccaggactcaaccaatggcct

SEQ ID NO: 454163 - DNA, 25 bp, Mus musculus
ggtcccatacttttgtagctcatag

SEQ ID NO: 454164 - DNA, 25 bp, Mus musculus
ggtccccaagtagattcctgatcag

SEQ ID NO: 454165 - DNA, 25 bp, Mus musculus
ggtccccagaggataccatgagagt

SEQ ID NO: 454166 - DNA, 25 bp, Mus musculus
ggtccccggctcttgacgcagtgag

SEQ ID NO: 454167 - DNA, 25 bp, Mus musculus
ggtccccgtggagcaataaacatgg

SEQ ID NO: 454168 - DNA, 25 bp, Mus musculus
ggtcccctactctgtctcgttggag

SEQ ID NO: 454169 - DNA, 25 bp, Mus musculus
ggtcccctggctgaactgaaaatgc

SEQ ID NO: 454170 - DNA, 25 bp, Mus musculus
ggtcccctgtgaaacttgctgtcca

SEQ ID NO: 454171 - DNA, 25 bp, Mus musculus
ggtccccttggctcatccaaaagct

SEQ ID NO: 454172 - DNA, 25 bp, Mus musculus
ggtcccgcctgcatttttctccgaa

SEQ ID NO: 454173 - DNA, 25 bp, Mus musculus
ggtcccggagccgaatcaggtgtcc

SEQ ID NO: 454174 - DNA, 25 bp, Mus musculus
ggtcccggcaagagcagagcccgct

SEQ ID NO: 454175 - DNA, 25 bp, Mus musculus
ggtcccgggcgcataagtgaaatca

SEQ ID NO: 454176 - DNA, 25 bp, Mus musculus
ggtcccgtgttctaaagctcctgag

SEQ ID NO: 454177 - DNA, 25 bp, Mus musculus
ggtccctcagtgtcctcgggaaaat

SEQ ID NO: 454178 - DNA, 25 bp, Mus musculus
ggtccctgactacaacacaatgatg

SEQ ID NO: 454179 - DNA, 25 bp, Mus musculus
ggtcccttagcgtcagtaaccctgg

SEQ ID NO: 454180 - DNA, 25 bp, Mus musculus
ggtcccttgctgcttgggtccatct

SEQ ID NO: 454181 - DNA, 25 bp, Mus musculus
ggtccgaagtgtcagctttaggcct

SEQ ID NO: 454182 - DNA, 25 bp, Mus musculus
ggtccgaggagagcccaatgtttca

SEQ ID NO: 454183 - DNA, 25 bp, Mus musculus
ggtccgctgcaaaccgaatggcttt

SEQ ID NO: 454184 - DNA, 25 bp, Mus musculus
ggtccgcttggatgttgcacgctcg

SEQ ID NO: 454185 - DNA, 25 bp, Mus musculus
ggtccgtaacaacgtggctgccctt

SEQ ID NO: 454186 - DNA, 25 bp, Mus musculus
ggtccgtgaccttgggaagctgaac

SEQ ID NO: 454187 - DNA, 25 bp, Mus musculus
ggtccgtgccatatctctctgccct

SEQ ID NO: 454188 - DNA, 25 bp, Mus musculus
ggtcctacttgagccacaggccttt

SEQ ID NO: 454189 - DNA, 25 bp, Mus musculus
ggtcctaggaatgttttctctgcta

SEQ ID NO: 454190 - DNA, 25 bp, Mus musculus
ggtcctaggttaaatgtggatgaca

SEQ ID NO: 454191 - DNA, 25 bp, Mus musculus
ggtcctattcctttgccagatccat

SEQ ID NO: 454192 - DNA, 25 bp, Mus musculus
ggtcctcagaggtatcaggtcctat

SEQ ID NO: 454193 - DNA, 25 bp, Mus musculus
ggtcctcatccagctcacaagaaag

SEQ ID NO: 454194 - DNA, 25 bp, Mus musculus
ggtcctccacaacaaaatgaagcgg

SEQ ID NO: 454195 - DNA, 25 bp, Mus musculus
ggtcctccccataggcaaaaagttg

SEQ ID NO: 454196 - DNA, 25 bp, Mus musculus
ggtcctcgtcgtctgcactgctgtc

SEQ ID NO: 454197 - DNA, 25 bp, Mus musculus
ggtcctctaggttctccgtgaaaat

SEQ ID NO: 454198 - DNA, 25 bp, Mus musculus
ggtcctctgaggacacttcctcctg

SEQ ID NO: 454199 - DNA, 25 bp, Mus musculus
ggtcctctgctatgaactgttccaa

SEQ ID NO: 454200 - DNA, 25 bp, Mus musculus
ggtcctgactctcacccatgtgatg

SEQ ID NO: 454201 - DNA, 25 bp, Mus musculus
ggtcctgagacaaaagtaactgccg

SEQ ID NO: 454202 - DNA, 25 bp, Mus musculus
ggtcctgatggtcttcttctcaaag

SEQ ID NO: 454203 - DNA, 25 bp, Mus musculus
ggtcctgccggagtcggcttctgct

SEQ ID NO: 454204 - DNA, 25 bp, Mus musculus
ggtcctgctttgtagaacctcgaaa

SEQ ID NO: 454205 - DNA, 25 bp, Mus musculus
ggtcctggatcgaatccgaaagctg

SEQ ID NO: 454206 - DNA, 25 bp, Mus musculus
ggtcctggctctgataacgtgttat

SEQ ID NO: 454207 - DNA, 25 bp, Mus musculus
ggtcctgggaaacctctgcttgata

SEQ ID NO: 454208 - DNA, 25 bp, Mus musculus
ggtcctggtgaatgagccctacgag

SEQ ID NO: 454209 - DNA, 25 bp, Mus musculus
ggtcctgtctctatggaagggcctc

SEQ ID NO: 454210 - DNA, 25 bp, Mus musculus
ggtcctgtgattggaaactggtgac

SEQ ID NO: 454211 - DNA, 25 bp, Mus musculus
ggtccttgaagtggctgaatctcat

SEQ ID NO: 454212 - DNA, 25 bp, Mus musculus
ggtccttggaagcatacagaacagt

SEQ ID NO: 454213 - DNA, 25 bp, Mus musculus
ggtccttggtgttctagcacccagt

SEQ ID NO: 454214 - DNA, 25 bp, Mus musculus
ggtccttgtccgtgtcttctgttca

SEQ ID NO: 454215 - DNA, 25 bp, Mus musculus
ggtcctttaccttcaggccgcgaga

SEQ ID NO: 454216 - DNA, 25 bp, Mus musculus
ggtcgaacgagatcgcaagaagctg

SEQ ID NO: 454217 - DNA, 25 bp, Mus musculus
ggtcgacctgttggccgtgaagaaa

SEQ ID NO: 454218 - DNA, 25 bp, Mus musculus
ggtcgagggcgaagaatatatactc

SEQ ID NO: 454219 - DNA, 25 bp, Mus musculus
ggtcgagttcatcacagcgtctggc

SEQ ID NO: 454220 - DNA, 25 bp, Mus musculus
ggtcgcatggtgaagcaccagtgct

SEQ ID NO: 454221 - DNA, 25 bp, Mus musculus
ggtcgctcaggattgaaagactggt

SEQ ID NO: 454222 - DNA, 25 bp, Mus musculus
ggtcgctgagcaaacctcggtcata

SEQ ID NO: 454223 - DNA, 25 bp, Mus musculus
ggtcgctgtcccaccttttccaagt

SEQ ID NO: 454224 - DNA, 25 bp, Mus musculus
ggtcgcttcaagtcaatcagaggga

SEQ ID NO: 454225 - DNA, 25 bp, Mus musculus
ggtcggatacaacaagggcctcact

SEQ ID NO: 454226 - DNA, 25 bp, Mus musculus
ggtcggattcggcttcagacagcaa

SEQ ID NO: 454227 - DNA, 25 bp, Mus musculus
ggtcgggcctcgtcaaagcactttg

SEQ ID NO: 454228 - DNA, 25 bp, Mus musculus
ggtcgtcacagaaatatgcaagctg

SEQ ID NO: 454229 - DNA, 25 bp, Mus musculus
ggtcgtcactattcaaggcgcacag

SEQ ID NO: 454230 - DNA, 25 bp, Mus musculus
ggtcgtcctaccaatgtgatgtgct

SEQ ID NO: 454231 - DNA, 25 bp, Mus musculus
ggtcgtgatgtccaagctgtgccca

SEQ ID NO: 454232 - DNA, 25 bp, Mus musculus
ggtcgtgctgatcctcttcctagtg

SEQ ID NO: 454233 - DNA, 25 bp, Mus musculus
ggtcgtgttctcaccacagtctggg

SEQ ID NO: 454234 - DNA, 25 bp, Mus musculus
ggtctaaatgtcgacgtggtcccac

SEQ ID NO: 454235 - DNA, 25 bp, Mus musculus
ggtctaatagatgagcggctgcctt

SEQ ID NO: 454236 - DNA, 25 bp, Mus musculus
ggtctaattggcctcctccttctag

SEQ ID NO: 454237 - DNA, 25 bp, Mus musculus
ggtctacaccagagtgccaacgagt

SEQ ID NO: 454238 - DNA, 25 bp, Mus musculus
ggtctacagtagagcttgtgcccca

SEQ ID NO: 454239 - DNA, 25 bp, Mus musculus
ggtctacatgtaggtctctctctgc

SEQ ID NO: 454240 - DNA, 25 bp, Mus musculus
ggtctaccctccgtgtaagcctgag

SEQ ID NO: 454241 - DNA, 25 bp, Mus musculus
ggtctacgagaacatgaagcaggct

SEQ ID NO: 454242 - DNA, 25 bp, Mus musculus
ggtctacgggcactgtctaatcact

SEQ ID NO: 454243 - DNA, 25 bp, Mus musculus
ggtctactaagggaacaggccgagt

SEQ ID NO: 454244 - DNA, 25 bp, Mus musculus
ggtctagtctagcacccagggaaga

SEQ ID NO: 454245 - DNA, 25 bp, Mus musculus
ggtctataaacgctaccagatggtt

SEQ ID NO: 454246 - DNA, 25 bp, Mus musculus
ggtctatagaaagagcaggcgcact

SEQ ID NO: 454247 - DNA, 25 bp, Mus musculus
ggtctataggtccagctccagtaca

SEQ ID NO: 454248 - DNA, 25 bp, Mus musculus
ggtctatctaaactccatgtctaca

SEQ ID NO: 454249 - DNA, 25 bp, Mus musculus
ggtctatctgaaggtggccaagcca

SEQ ID NO: 454250 - DNA, 25 bp, Mus musculus
ggtctatgtagaagccaaagccaag

SEQ ID NO: 454251 - DNA, 25 bp, Mus musculus
ggtctatttcaccacgtcactgcct

SEQ ID NO: 454252 - DNA, 25 bp, Mus musculus
ggtctatttcctcagatatcccgca

SEQ ID NO: 454253 - DNA, 25 bp, Mus musculus
ggtctcaagcgccatcatactggat

SEQ ID NO: 454254 - DNA, 25 bp, Mus musculus
ggtctcactacaaccacagtcaaga

SEQ ID NO: 454255 - DNA, 25 bp, Mus musculus
ggtctcagagatgtgcagccagtca

SEQ ID NO: 454256 - DNA, 25 bp, Mus musculus
ggtctccaagcatttccgcaaaggt

SEQ ID NO: 454257 - DNA, 25 bp, Mus musculus
ggtctccagggctacaaatctgcct

SEQ ID NO: 454258 - DNA, 25 bp, Mus musculus
ggtctcccaagtcaagaaactgtgt

SEQ ID NO: 454259 - DNA, 25 bp, Mus musculus
ggtctcccaagtttcttagttctgt

SEQ ID NO: 454260 - DNA, 25 bp, Mus musculus
ggtctcccagatcccagcagagtgt

SEQ ID NO: 454261 - DNA, 25 bp, Mus musculus
ggtctccccaacagctgacagtttc

SEQ ID NO: 454262 - DNA, 25 bp, Mus musculus
ggtctcccgatttgggctgtgagat

SEQ ID NO: 454263 - DNA, 25 bp, Mus musculus
ggtctccgggtagtcatggcgtccc

SEQ ID NO: 454264 - DNA, 25 bp, Mus musculus
ggtctccgtcgcttcacggtgttca

SEQ ID NO: 454265 - DNA, 25 bp, Mus musculus
ggtctcctgacgagctggcgtcctc

SEQ ID NO: 454266 - DNA, 25 bp, Mus musculus
ggtctcctgagactccttacactgc

SEQ ID NO: 454267 - DNA, 25 bp, Mus musculus
ggtctcctgggatacatgaatccga

SEQ ID NO: 454268 - DNA, 25 bp, Mus musculus
ggtctccttggttgtcagtcctccg

SEQ ID NO: 454269 - DNA, 25 bp, Mus musculus
ggtctcgaccaggaaacctgactca

SEQ ID NO: 454270 - DNA, 25 bp, Mus musculus
ggtctcgtgttccatctcgctcttg

SEQ ID NO: 454271 - DNA, 25 bp, Mus musculus
ggtctctaaccttactatctgacag

SEQ ID NO: 454272 - DNA, 25 bp, Mus musculus
ggtctctactatggcaccctgggca

SEQ ID NO: 454273 - DNA, 25 bp, Mus musculus
ggtctctcacaaggacatcagcgag

SEQ ID NO: 454274 - DNA, 25 bp, Mus musculus
ggtctctccggacgacattactatg

SEQ ID NO: 454275 - DNA, 25 bp, Mus musculus
ggtctctcctgctgccggaagttgg

SEQ ID NO: 454276 - DNA, 25 bp, Mus musculus
ggtctctctggaacatgtctgctgc

SEQ ID NO: 454277 - DNA, 25 bp, Mus musculus
ggtctctgaagaggcaaattgcatt

SEQ ID NO: 454278 - DNA, 25 bp, Mus musculus
ggtctctgccggagagctctcagca

SEQ ID NO: 454279 - DNA, 25 bp, Mus musculus
ggtctctgttcctagtgggtgcgca

SEQ ID NO: 454280 - DNA, 25 bp, Mus musculus
ggtctgaaatacattggcatccatt

SEQ ID NO: 454281 - DNA, 25 bp, Mus musculus
ggtctgaccaacgagaagcccaatc

SEQ ID NO: 454282 - DNA, 25 bp, Mus musculus
ggtctgcatgtggagaaagtttaaa

SEQ ID NO: 454283 - DNA, 25 bp, Mus musculus
ggtctgccgttgtgggacccttcct

SEQ ID NO: 454284 - DNA, 25 bp, Mus musculus
ggtctgcctgaaatacgccggagta

SEQ ID NO: 454285 - DNA, 25 bp, Mus musculus
ggtctgcgtcctaggatgtactgag

SEQ ID NO: 454286 - DNA, 25 bp, Mus musculus
ggtctgcgtctgtgtccccaagaga

SEQ ID NO: 454287 - DNA, 25 bp, Mus musculus
ggtctgctcatccttcatcgttgtt

SEQ ID NO: 454288 - DNA, 25 bp, Mus musculus
ggtctgctgacagacaggacccttg

SEQ ID NO: 454289 - DNA, 25 bp, Mus musculus
ggtctggataaaagagcccctctgc

SEQ ID NO: 454290 - DNA, 25 bp, Mus musculus
ggtctggcggaggagatcaccttcc

SEQ ID NO: 454291 - DNA, 25 bp, Mus musculus
ggtctggctacaccgtcacaaggct

SEQ ID NO: 454292 - DNA, 25 bp, Mus musculus
ggtctggctgcctctggatacccat

SEQ ID NO: 454293 - DNA, 25 bp, Mus musculus
ggtctgtagattgagcccactgatg

SEQ ID NO: 454294 - DNA, 25 bp, Mus musculus
ggtctgtagtgtcataattccctca

SEQ ID NO: 454295 - DNA, 25 bp, Mus musculus
ggtctgtcttccctcttcagcactg

SEQ ID NO: 454296 - DNA, 25 bp, Mus musculus
ggtctgtgcaaaaaatggctcccga

SEQ ID NO: 454297 - DNA, 25 bp, Mus musculus
ggtctgtgccagaggaatttgccca

SEQ ID NO: 454298 - DNA, 25 bp, Mus musculus
ggtctgtgctacttagggaactcaa

SEQ ID NO: 454299 - DNA, 25 bp, Mus musculus
ggtctgttattacagatttgttaca

SEQ ID NO: 454300 - DNA, 25 bp, Mus musculus
ggtctgttccaagaggaggtccctc

SEQ ID NO: 454301 - DNA, 25 bp, Mus musculus
ggtctgttccaggttgacgtcgagc

SEQ ID NO: 454302 - DNA, 25 bp, Mus musculus
ggtcttaaaacactgttggcggaca

SEQ ID NO: 454303 - DNA, 25 bp, Mus musculus
ggtcttaaagatgcgacctgtcatc

SEQ ID NO: 454304 - DNA, 25 bp, Mus musculus
ggtcttacggaacatgggcttcgca

SEQ ID NO: 454305 - DNA, 25 bp, Mus musculus
ggtcttagacccatcaagcttgagg

SEQ ID NO: 454306 - DNA, 25 bp, Mus musculus
ggtcttagttactgcctagcccagc

SEQ ID NO: 454307 - DNA, 25 bp, Mus musculus
ggtcttatgagttcagagaggatcc

SEQ ID NO: 454308 - DNA, 25 bp, Mus musculus
ggtcttatttagcaccacgtggatt

SEQ ID NO: 454309 - DNA, 25 bp, Mus musculus
ggtcttcacctgtctccattgctgc

SEQ ID NO: 454310 - DNA, 25 bp, Mus musculus
ggtcttcactgcatgatagccctta

SEQ ID NO: 454311 - DNA, 25 bp, Mus musculus
ggtcttccagtgtaaccaccgtcac

SEQ ID NO: 454312 - DNA, 25 bp, Mus musculus
ggtcttcctggctaagagctaccca

SEQ ID NO: 454313 - DNA, 25 bp, Mus musculus
ggtcttccttcttccacactattta

SEQ ID NO: 454314 - DNA, 25 bp, Mus musculus
ggtcttcgctggagtcatgtgcaca

SEQ ID NO: 454315 - DNA, 25 bp, Mus musculus
ggtcttctgcatacctggctcccag

SEQ ID NO: 454316 - DNA, 25 bp, Mus musculus
ggtcttcttcagctgcaacacggag

SEQ ID NO: 454317 - DNA, 25 bp, Mus musculus
ggtcttgaactcacgaacctcattc

SEQ ID NO: 454318 - DNA, 25 bp, Mus musculus
ggtcttgaactcagctcgacagaag

SEQ ID NO: 454319 - DNA, 25 bp, Mus musculus
ggtcttgaactctggattacaggca

SEQ ID NO: 454320 - DNA, 25 bp, Mus musculus
ggtcttgcttaccaacctcttacag

SEQ ID NO: 454321 - DNA, 25 bp, Mus musculus
ggtcttggtttctgtgccttgatcc

SEQ ID NO: 454322 - DNA, 25 bp, Mus musculus
ggtctttcaaaccaacaagggagtg

SEQ ID NO: 454323 - DNA, 25 bp, Mus musculus
ggtctttcattcaaaaccctgatct

SEQ ID NO: 454324 - DNA, 25 bp, Mus musculus
ggtctttctggagaacccgctggag

SEQ ID NO: 454325 - DNA, 25 bp, Mus musculus
ggtctttgcttctcagccaacatgg

SEQ ID NO: 454326 - DNA, 25 bp, Mus musculus
ggtcttttaagatctagtgtatcta

SEQ ID NO: 454327 - DNA, 25 bp, Mus musculus
ggtcttttcacctgattcacctgat

SEQ ID NO: 454328 - DNA, 25 bp, Mus musculus
ggtgaaacaccaagaggccagtggc

SEQ ID NO: 454329 - DNA, 25 bp, Mus musculus
ggtgaaagccaggttgcctgccttc

SEQ ID NO: 454330 - DNA, 25 bp, Mus musculus
ggtgaaagtcccaataacaggctct

SEQ ID NO: 454331 - DNA, 25 bp, Mus musculus
ggtgaaagtctacaacagacagacc

SEQ ID NO: 454332 - DNA, 25 bp, Mus musculus
ggtgaaatgctgaccactcctgttt

SEQ ID NO: 454333 - DNA, 25 bp, Mus musculus
ggtgaaattcccaaagagcagtgga

SEQ ID NO: 454334 - DNA, 25 bp, Mus musculus
ggtgaacaaggcagactagactctt

SEQ ID NO: 454335 - DNA, 25 bp, Mus musculus
ggtgaacagagcatacccttactcc

SEQ ID NO: 454336 - DNA, 25 bp, Mus musculus
ggtgaacatttctggtgaggagaga

SEQ ID NO: 454337 - DNA, 25 bp, Mus musculus
ggtgaacgatccctctacagacgat

SEQ ID NO: 454338 - DNA, 25 bp, Mus musculus
ggtgaacgatctgacactatttctc

SEQ ID NO: 454339 - DNA, 25 bp, Mus musculus
ggtgaacgctctagccatcgcggtg

SEQ ID NO: 454340 - DNA, 25 bp, Mus musculus
ggtgaactgcagaggatttgtgctc

SEQ ID NO: 454341 - DNA, 25 bp, Mus musculus
ggtgaactttagtaccaaatagcta

SEQ ID NO: 454342 - DNA, 25 bp, Mus musculus
ggtgaagaacgacctgactgccaag

SEQ ID NO: 454343 - DNA, 25 bp, Mus musculus
ggtgaagctagctgccaaatgcatc

SEQ ID NO: 454344 - DNA, 25 bp, Mus musculus
ggtgaaggacttcgacgtaaacaag

SEQ ID NO: 454345 - DNA, 25 bp, Mus musculus
ggtgaaggccaatgacagaacctat

SEQ ID NO: 454346 - DNA, 25 bp, Mus musculus
ggtgaagggactccgccacatactt

SEQ ID NO: 454347 - DNA, 25 bp, Mus musculus
ggtgaagggccatgcatacgctgtc

SEQ ID NO: 454348 - DNA, 25 bp, Mus musculus
ggtgaagtcaatccaacttcagaaa

SEQ ID NO: 454349 - DNA, 25 bp, Mus musculus
ggtgaatctacctttgtctctttgt

SEQ ID NO: 454350 - DNA, 25 bp, Mus musculus
ggtgaatctcatgggacagctgcag

SEQ ID NO: 454351 - DNA, 25 bp, Mus musculus
ggtgaatctgaaggactgcttactc

SEQ ID NO: 454352 - DNA, 25 bp, Mus musculus
ggtgaatctgcttccatggaaaagg

SEQ ID NO: 454353 - DNA, 25 bp, Mus musculus
ggtgaatgcactaccctgagcttca

SEQ ID NO: 454354 - DNA, 25 bp, Mus musculus
ggtgaatggaccgacgacatggctc

SEQ ID NO: 454355 - DNA, 25 bp, Mus musculus
ggtgaatgtccaaaagctcctggcc

SEQ ID NO: 454356 - DNA, 25 bp, Mus musculus
ggtgaattccactccaggaccacag

SEQ ID NO: 454357 - DNA, 25 bp, Mus musculus
ggtgaattgtaaccagcgctgccaa

SEQ ID NO: 454358 - DNA, 25 bp, Mus musculus
ggtgaatttcattcctaaaagtggc

SEQ ID NO: 454359 - DNA, 25 bp, Mus musculus
ggtgacaagaacaacgatggccgaa

SEQ ID NO: 454360 - DNA, 25 bp, Mus musculus
ggtgacaaggcacatcatgaaccca

SEQ ID NO: 454361 - DNA, 25 bp, Mus musculus
ggtgacacagcatcctttggaaatg

SEQ ID NO: 454362 - DNA, 25 bp, Mus musculus
ggtgacactgtatcctgctagagaa

SEQ ID NO: 454363 - DNA, 25 bp, Mus musculus
ggtgacactttttgtagaacccatg

SEQ ID NO: 454364 - DNA, 25 bp, Mus musculus
ggtgacagcagtatccgctattttg

SEQ ID NO: 454365 - DNA, 25 bp, Mus musculus
ggtgacagcatgactttgagcctca

SEQ ID NO: 454366 - DNA, 25 bp, Mus musculus
ggtgacagtttgttaagcctagctt

SEQ ID NO: 454367 - DNA, 25 bp, Mus musculus
ggtgacatctgcaaccaaggcctgt

SEQ ID NO: 454368 - DNA, 25 bp, Mus musculus
ggtgacatgacccagacacgtgttt

SEQ ID NO: 454369 - DNA, 25 bp, Mus musculus
ggtgacatgggaacaaaaggttctc

SEQ ID NO: 454370 - DNA, 25 bp, Mus musculus
ggtgaccacaaaggcgtcaagggac

SEQ ID NO: 454371 - DNA, 25 bp, Mus musculus
ggtgaccacattgcacacgcagaag

SEQ ID NO: 454372 - DNA, 25 bp, Mus musculus
ggtgaccaccaagcgaatcattgag

SEQ ID NO: 454373 - DNA, 25 bp, Mus musculus
ggtgaccacggcctgccatgagttc

SEQ ID NO: 454374 - DNA, 25 bp, Mus musculus
ggtgaccactcaaaccatcagcagg

SEQ ID NO: 454375 - DNA, 25 bp, Mus musculus
ggtgaccagagtatttccagcccag

SEQ ID NO: 454376 - DNA, 25 bp, Mus musculus
ggtgaccaggtcacagctacgcttt

SEQ ID NO: 454377 - DNA, 25 bp, Mus musculus
ggtgacccagcggaaccctgtggaa

SEQ ID NO: 454378 - DNA, 25 bp, Mus musculus
ggtgacccctgatgatccctgtgta

SEQ ID NO: 454379 - DNA, 25 bp, Mus musculus
ggtgaccctccctagaaaatgcttc

SEQ ID NO: 454380 - DNA, 25 bp, Mus musculus
ggtgacccttgactccgaactttga

SEQ ID NO: 454381 - DNA, 25 bp, Mus musculus
ggtgacctccccagaagtagaaatt

SEQ ID NO: 454382 - DNA, 25 bp, Mus musculus
ggtgacctccttaagtcgttgacag

SEQ ID NO: 454383 - DNA, 25 bp, Mus musculus
ggtgacgcaaccagattccatggga

SEQ ID NO: 454384 - DNA, 25 bp, Mus musculus
ggtgacggtctggaaccaaaccagt

SEQ ID NO: 454385 - DNA, 25 bp, Mus musculus
ggtgactaaacgaggcttcagctcg

SEQ ID NO: 454386 - DNA, 25 bp, Mus musculus
ggtgactaagcccaaactgtggcct

SEQ ID NO: 454387 - DNA, 25 bp, Mus musculus
ggtgactagagcctcctcgtgtcca

SEQ ID NO: 454388 - DNA, 25 bp, Mus musculus
ggtgactatatgtggatggcgcccc

SEQ ID NO: 454389 - DNA, 25 bp, Mus musculus
ggtgactcaaaagtagccgcatcgg

SEQ ID NO: 454390 - DNA, 25 bp, Mus musculus
ggtgactctaagctaattgttgccc

SEQ ID NO: 454391 - DNA, 25 bp, Mus musculus
ggtgactgccaactacctgctggag

SEQ ID NO: 454392 - DNA, 25 bp, Mus musculus
ggtgacttagaactgtgcacacagt

SEQ ID NO: 454393 - DNA, 25 bp, Mus musculus
ggtgactttggtgacctgtgtcccc

SEQ ID NO: 454394 - DNA, 25 bp, Mus musculus
ggtgagaaacccctgagaactgtgt

SEQ ID NO: 454395 - DNA, 25 bp, Mus musculus
ggtgagaatcaaagaaacggctctg

SEQ ID NO: 454396 - DNA, 25 bp, Mus musculus
ggtgagacacattctaaactcatga

SEQ ID NO: 454397 - DNA, 25 bp, Mus musculus
ggtgagacccagaaatccgtgctag

SEQ ID NO: 454398 - DNA, 25 bp, Mus musculus
ggtgagagaacagggcgacactatc

SEQ ID NO: 454399 - DNA, 25 bp, Mus musculus
ggtgagagacccagagctgagaact

SEQ ID NO: 454400 - DNA, 25 bp, Mus musculus
ggtgagcagtgttctccaccttccg

SEQ ID NO: 454401 - DNA, 25 bp, Mus musculus
ggtgagcatgtctgggtttcccctt

SEQ ID NO: 454402 - DNA, 25 bp, Mus musculus
ggtgagccagggataccgatcgctc

SEQ ID NO: 454403 - DNA, 25 bp, Mus musculus
ggtgagccatcagttccagaatata

SEQ ID NO: 454404 - DNA, 25 bp, Mus musculus
ggtgagcccagttcctatcaataag

SEQ ID NO: 454405 - DNA, 25 bp, Mus musculus
ggtgagccctgcttattttgctatg

SEQ ID NO: 454406 - DNA, 25 bp, Mus musculus
ggtgagcctgaagtgataggccttt

SEQ ID NO: 454407 - DNA, 25 bp, Mus musculus
ggtgagctgcactgtctccaagatg

SEQ ID NO: 454408 - DNA, 25 bp, Mus musculus
ggtgagctgctctaaactaatgaaa

SEQ ID NO: 454409 - DNA, 25 bp, Mus musculus
ggtgagcttgctgagaaaatgccca

SEQ ID NO: 454410 - DNA, 25 bp, Mus musculus
ggtgagctttgtattagtatctgcc

SEQ ID NO: 454411 - DNA, 25 bp, Mus musculus
ggtgaggactgccacttttatttcc

SEQ ID NO: 454412 - DNA, 25 bp, Mus musculus
ggtgaggatggctctccagtcctgc

SEQ ID NO: 454413 - DNA, 25 bp, Mus musculus
ggtgaggcaccaagaccaactggat

SEQ ID NO: 454414 - DNA, 25 bp, Mus musculus
ggtgaggcaccgtttcgaactctgc

SEQ ID NO: 454415 - DNA, 25 bp, Mus musculus
ggtgagggctatgtgatctccttca

SEQ ID NO: 454416 - DNA, 25 bp, Mus musculus
ggtgagtagcctgtaaacctcccca

SEQ ID NO: 454417 - DNA, 25 bp, Mus musculus
ggtgagtccttccaaagcagctgca

SEQ ID NO: 454418 - DNA, 25 bp, Mus musculus
ggtgagtctcctagcaatcctgtga

SEQ ID NO: 454419 - DNA, 25 bp, Mus musculus
ggtgagtgaggcatttctgcttctt

SEQ ID NO: 454420 - DNA, 25 bp, Mus musculus
ggtgagtggtatgcagcaagtctcc

SEQ ID NO: 454421 - DNA, 25 bp, Mus musculus
ggtgagtggtccaatacctctggct

SEQ ID NO: 454422 - DNA, 25 bp, Mus musculus
ggtgagtgtcagtcatccctagggc

SEQ ID NO: 454423 - DNA, 25 bp, Mus musculus
ggtgagtgtcccctgtaccattcat

SEQ ID NO: 454424 - DNA, 25 bp, Mus musculus
ggtgataaacccatccacgaaattt

SEQ ID NO: 454425 - DNA, 25 bp, Mus musculus
ggtgataacaatgtccctttgcata

SEQ ID NO: 454426 - DNA, 25 bp, Mus musculus
ggtgatagccccaacgaaacatcta

SEQ ID NO: 454427 - DNA, 25 bp, Mus musculus
ggtgatagctctgtctccatgtgtc

SEQ ID NO: 454428 - DNA, 25 bp, Mus musculus
ggtgatatcctaaccaaggcagcca

SEQ ID NO: 454429 - DNA, 25 bp, Mus musculus
ggtgatcaccaacgcgaacgagaac

SEQ ID NO: 454430 - DNA, 25 bp, Mus musculus
ggtgatcacggctcagcaagcgact

SEQ ID NO: 454431 - DNA, 25 bp, Mus musculus
ggtgatcactcttgttcagtgccat

SEQ ID NO: 454432 - DNA, 25 bp, Mus musculus
ggtgatccgagttcgatccctagga

SEQ ID NO: 454433 - DNA, 25 bp, Mus musculus
ggtgatccgggcctccttttctcag

SEQ ID NO: 454434 - DNA, 25 bp, Mus musculus
ggtgatcgccgaggaatttgccaat

SEQ ID NO: 454435 - DNA, 25 bp, Mus musculus
ggtgatctagaaacaaccccagaag

SEQ ID NO: 454436 - DNA, 25 bp, Mus musculus
ggtgatctcaaaggatgaggctcct

SEQ ID NO: 454437 - DNA, 25 bp, Mus musculus
ggtgatctggtcataaacagcgcag

SEQ ID NO: 454438 - DNA, 25 bp, Mus musculus
ggtgatcttcacctacattcgaggt

SEQ ID NO: 454439 - DNA, 25 bp, Mus musculus
ggtgatcttgaggatccttgtgtcc

SEQ ID NO: 454440 - DNA, 25 bp, Mus musculus
ggtgatgaccttgaacgccttgggc

SEQ ID NO: 454441 - DNA, 25 bp, Mus musculus
ggtgatgacgcctctctgaaaacag

SEQ ID NO: 454442 - DNA, 25 bp, Mus musculus
ggtgatgcctctctgtatcccaggc

SEQ ID NO: 454443 - DNA, 25 bp, Mus musculus
ggtgatggacgcaaagaaactggcc

SEQ ID NO: 454444 - DNA, 25 bp, Mus musculus
ggtgatggtgacacccgtcaacgag

SEQ ID NO: 454445 - DNA, 25 bp, Mus musculus
ggtgatgttctacccaaatttgtgg

SEQ ID NO: 454446 - DNA, 25 bp, Mus musculus
ggtgatgtttgtgtctgtgttctgc

SEQ ID NO: 454447 - DNA, 25 bp, Mus musculus
ggtgattccacttgtagcgagccag

SEQ ID NO: 454448 - DNA, 25 bp, Mus musculus
ggtgattccataaatccaccacacc

SEQ ID NO: 454449 - DNA, 25 bp, Mus musculus
ggtgattctacccacaaaagtccct

SEQ ID NO: 454450 - DNA, 25 bp, Mus musculus
ggtgatttcttgctaaccccaggaa

SEQ ID NO: 454451 - DNA, 25 bp, Mus musculus
ggtgcaaaaactcctactccgctga

SEQ ID NO: 454452 - DNA, 25 bp, Mus musculus
ggtgcaacccgcttacgaggcggtc

SEQ ID NO: 454453 - DNA, 25 bp, Mus musculus
ggtgcaagcgccctacactgttctg

SEQ ID NO: 454454 - DNA, 25 bp, Mus musculus
ggtgcaaggctccaagactgctcat

SEQ ID NO: 454455 - DNA, 25 bp, Mus musculus
ggtgcaatcagcaaaatccacagaa

SEQ ID NO: 454456 - DNA, 25 bp, Mus musculus
ggtgcacaacacactgcccatgggt

SEQ ID NO: 454457 - DNA, 25 bp, Mus musculus
ggtgcacaagatgacgtggaaacgt

SEQ ID NO: 454458 - DNA, 25 bp, Mus musculus
ggtgcacaggtatacatggaggaaa

SEQ ID NO: 454459 - DNA, 25 bp, Mus musculus
ggtgcaccaggatgaaaaacagaga

SEQ ID NO: 454460 - DNA, 25 bp, Mus musculus
ggtgcacgttctgcgttctcgagag

SEQ ID NO: 454461 - DNA, 25 bp, Mus musculus
ggtgcactggcattgagtttctcac

SEQ ID NO: 454462 - DNA, 25 bp, Mus musculus
ggtgcactgtgctgagctcatagaa

SEQ ID NO: 454463 - DNA, 25 bp, Mus musculus
ggtgcacttcctacccctgctggcc

SEQ ID NO: 454464 - DNA, 25 bp, Mus musculus
ggtgcacttgccaacagggattcgg

SEQ ID NO: 454465 - DNA, 25 bp, Mus musculus
ggtgcagaacataacatcccggttg

SEQ ID NO: 454466 - DNA, 25 bp, Mus musculus
ggtgcagatatacccaagatagggc

SEQ ID NO: 454467 - DNA, 25 bp, Mus musculus
ggtgcagatccccagcttctaggaa

SEQ ID NO: 454468 - DNA, 25 bp, Mus musculus
ggtgcagcaatcaagaagccagggt

SEQ ID NO: 454469 - DNA, 25 bp, Mus musculus
ggtgcagcgacttccttcagatgtg

SEQ ID NO: 454470 - DNA, 25 bp, Mus musculus
ggtgcagctgtaaatatacccagag

SEQ ID NO: 454471 - DNA, 25 bp, Mus musculus
ggtgcaggatctaagtgcacagctg

SEQ ID NO: 454472 - DNA, 25 bp, Mus musculus
ggtgcaggcccagttctccaagtga

SEQ ID NO: 454473 - DNA, 25 bp, Mus musculus
ggtgcagtatcagctcaagtcagag

SEQ ID NO: 454474 - DNA, 25 bp, Mus musculus
ggtgcagtgcgctttgccccccgta

SEQ ID NO: 454475 - DNA, 25 bp, Mus musculus
ggtgcagttgtctgcgtgcctatca

SEQ ID NO: 454476 - DNA, 25 bp, Mus musculus
ggtgcatcatcgtatacactaagtg

SEQ ID NO: 454477 - DNA, 25 bp, Mus musculus
ggtgcatccatcagtacacttgctg

SEQ ID NO: 454478 - DNA, 25 bp, Mus musculus
ggtgcatccctttgcggactccgtg

SEQ ID NO: 454479 - DNA, 25 bp, Mus musculus
ggtgcatcctatatgtaacattcaa

SEQ ID NO: 454480 - DNA, 25 bp, Mus musculus
ggtgcatcggactcagctggctttg

SEQ ID NO: 454481 - DNA, 25 bp, Mus musculus
ggtgcatctgaagggacccagcttg

SEQ ID NO: 454482 - DNA, 25 bp, Mus musculus
ggtgcatgctctcaggatcggctca

SEQ ID NO: 454483 - DNA, 25 bp, Mus musculus
ggtgcattgcctgaacaaagccaag

SEQ ID NO: 454484 - DNA, 25 bp, Mus musculus
ggtgcattggcaacactcgtcagat

SEQ ID NO: 454485 - DNA, 25 bp, Mus musculus
ggtgcatttgttcttacccgggcag

SEQ ID NO: 454486 - DNA, 25 bp, Mus musculus
ggtgcattttggtgggttcacccat

SEQ ID NO: 454487 - DNA, 25 bp, Mus musculus
ggtgccaaaaagtaaagtccctgct

SEQ ID NO: 454488 - DNA, 25 bp, Mus musculus
ggtgccaactctgctcctgaatgcg

SEQ ID NO: 454489 - DNA, 25 bp, Mus musculus
ggtgccacgattggtaccacaggaa

SEQ ID NO: 454490 - DNA, 25 bp, Mus musculus
ggtgccacttccatttctaactcta

SEQ ID NO: 454491 - DNA, 25 bp, Mus musculus
ggtgccagcacctgagatgcatcta

SEQ ID NO: 454492 - DNA, 25 bp, Mus musculus
ggtgccagcagcagagtccctgtgt

SEQ ID NO: 454493 - DNA, 25 bp, Mus musculus
ggtgccagcatacctgcattcacat

SEQ ID NO: 454494 - DNA, 25 bp, Mus musculus
ggtgccagctttcacaccaaaaaca

SEQ ID NO: 454495 - DNA, 25 bp, Mus musculus
ggtgccaggtccaaaagacatcaaa

SEQ ID NO: 454496 - DNA, 25 bp, Mus musculus
ggtgccagtaagtgaggtcacagcc

SEQ ID NO: 454497 - DNA, 25 bp, Mus musculus
ggtgccatcatgcaaccggaatgtg

SEQ ID NO: 454498 - DNA, 25 bp, Mus musculus
ggtgccatctccttccgggtcaagt

SEQ ID NO: 454499 - DNA, 25 bp, Mus musculus
ggtgccatttgcagatccatgtcct

SEQ ID NO: 454500 - DNA, 25 bp, Mus musculus
ggtgcccaaaccattccgtactgag

SEQ ID NO: 454501 - DNA, 25 bp, Mus musculus
ggtgcccaacttcaagcttctacaa

SEQ ID NO: 454502 - DNA, 25 bp, Mus musculus
ggtgcccagcgtcaaaaactgaggc

SEQ ID NO: 454503 - DNA, 25 bp, Mus musculus
ggtgcccaggctgcaatcgtggtct

SEQ ID NO: 454504 - DNA, 25 bp, Mus musculus
ggtgcccaggtcaatgctactaatg

SEQ ID NO: 454505 - DNA, 25 bp, Mus musculus
ggtgcccatgcttgttctggacccg

SEQ ID NO: 454506 - DNA, 25 bp, Mus musculus
ggtgccccaatttattgcccaataa

SEQ ID NO: 454507 - DNA, 25 bp, Mus musculus
ggtgcccctagtcaaagacctgctg

SEQ ID NO: 454508 - DNA, 25 bp, Mus musculus
ggtgcccctgagcaaagaccttgtg

SEQ ID NO: 454509 - DNA, 25 bp, Mus musculus
ggtgcccctggagcttctgccctct

SEQ ID NO: 454510 - DNA, 25 bp, Mus musculus
ggtgcccgcaaatgagaagggctct

SEQ ID NO: 454511 - DNA, 25 bp, Mus musculus
ggtgccctacactgcgctcactatg

SEQ ID NO: 454512 - DNA, 25 bp, Mus musculus
ggtgccctactgactttgctgaagt

SEQ ID NO: 454513 - DNA, 25 bp, Mus musculus
ggtgccctcaccctagtgggatgct

SEQ ID NO: 454514 - DNA, 25 bp, Mus musculus
ggtgccctgcacagatagtaaacat

SEQ ID NO: 454515 - DNA, 25 bp, Mus musculus
ggtgccctggaacccagtctttaga

SEQ ID NO: 454516 - DNA, 25 bp, Mus musculus
ggtgcccttcacctgcagtagcgta

SEQ ID NO: 454517 - DNA, 25 bp, Mus musculus
ggtgccctttttcttttccatccat

SEQ ID NO: 454518 - DNA, 25 bp, Mus musculus
ggtgccgttcccagcctcgtggagt

SEQ ID NO: 454519 - DNA, 25 bp, Mus musculus
ggtgcctaacatgatcatacctcgg

SEQ ID NO: 454520 - DNA, 25 bp, Mus musculus
ggtgcctaagaccttgccaaaatta

SEQ ID NO: 454521 - DNA, 25 bp, Mus musculus
ggtgcctgccgtttagaagctgcct

SEQ ID NO: 454522 - DNA, 25 bp, Mus musculus
ggtgcctggtacagatctgcgacaa

SEQ ID NO: 454523 - DNA, 25 bp, Mus musculus
ggtgcgaatcctactcctgggcttg

SEQ ID NO: 454524 - DNA, 25 bp, Mus musculus
ggtgcgatcgttaccacttcaaata

SEQ ID NO: 454525 - DNA, 25 bp, Mus musculus
ggtgcggagttgtggttacacacat

SEQ ID NO: 454526 - DNA, 25 bp, Mus musculus
ggtgcggcctgcagaattttggttt

SEQ ID NO: 454527 - DNA, 25 bp, Mus musculus
ggtgcgggtccaaatagcctgtttt

SEQ ID NO: 454528 - DNA, 25 bp, Mus musculus
ggtgcgtgcgcagggatacacataa

SEQ ID NO: 454529 - DNA, 25 bp, Mus musculus
ggtgcgttggcagagtagccctacc

SEQ ID NO: 454530 - DNA, 25 bp, Mus musculus
ggtgctaaaagcaacacaggaggct

SEQ ID NO: 454531 - DNA, 25 bp, Mus musculus
ggtgctaaggcacacatactcaggg

SEQ ID NO: 454532 - DNA, 25 bp, Mus musculus
ggtgctaatggcgaacagtgtctga

SEQ ID NO: 454533 - DNA, 25 bp, Mus musculus
ggtgctaatgtcaatcagaagaatg

SEQ ID NO: 454534 - DNA, 25 bp, Mus musculus
ggtgctacccatgtctaaatggagg

SEQ ID NO: 454535 - DNA, 25 bp, Mus musculus
ggtgctacccctttagttctggcaa

SEQ ID NO: 454536 - DNA, 25 bp, Mus musculus
ggtgctactacgctactatgagtct

SEQ ID NO: 454537 - DNA, 25 bp, Mus musculus
ggtgctagcctaccaccatagggtg

SEQ ID NO: 454538 - DNA, 25 bp, Mus musculus
ggtgctaggctatgacgaaaccatc

SEQ ID NO: 454539 - DNA, 25 bp, Mus musculus
ggtgctatcaaaggcagcagtgaac

SEQ ID NO: 454540 - DNA, 25 bp, Mus musculus
ggtgctcaaggcaactggaaccaga

SEQ ID NO: 454541 - DNA, 25 bp, Mus musculus
ggtgctcactgtagaacccgtcggg

SEQ ID NO: 454542 - DNA, 25 bp, Mus musculus
ggtgctcagagaagtagccagctaa

SEQ ID NO: 454543 - DNA, 25 bp, Mus musculus
ggtgctcatcaaatgcagattgatg

SEQ ID NO: 454544 - DNA, 25 bp, Mus musculus
ggtgctccaacaccaagagctcgga

SEQ ID NO: 454545 - DNA, 25 bp, Mus musculus
ggtgctccaagcttcagacattatg

SEQ ID NO: 454546 - DNA, 25 bp, Mus musculus
ggtgctccaggaacttgtctactgt

SEQ ID NO: 454547 - DNA, 25 bp, Mus musculus
ggtgctcccgagacacacgtgttgc

SEQ ID NO: 454548 - DNA, 25 bp, Mus musculus
ggtgctccgccgagaatcccctgtt

SEQ ID NO: 454549 - DNA, 25 bp, Mus musculus
ggtgctccggatcgccagtagttct

SEQ ID NO: 454550 - DNA, 25 bp, Mus musculus
ggtgctccgtgtgtcacttcctgct

SEQ ID NO: 454551 - DNA, 25 bp, Mus musculus
ggtgctctccttccggaaacctgat

SEQ ID NO: 454552 - DNA, 25 bp, Mus musculus
ggtgctctggcaaactagcccagta

SEQ ID NO: 454553 - DNA, 25 bp, Mus musculus
ggtgctcttcagtaataatctaaag

SEQ ID NO: 454554 - DNA, 25 bp, Mus musculus
ggtgctgacatctagtatcaacagg

SEQ ID NO: 454555 - DNA, 25 bp, Mus musculus
ggtgctgactcaaactcccagccag

SEQ ID NO: 454556 - DNA, 25 bp, Mus musculus
ggtgctgagcacacaacaaaagttt

SEQ ID NO: 454557 - DNA, 25 bp, Mus musculus
ggtgctgatccctcctttcgaaact

SEQ ID NO: 454558 - DNA, 25 bp, Mus musculus
ggtgctgcagcactcacgcaaaggt

SEQ ID NO: 454559 - DNA, 25 bp, Mus musculus
ggtgctgccacgtgacttccacgaa

SEQ ID NO: 454560 - DNA, 25 bp, Mus musculus
ggtgctgcccaagccactgaattgc

SEQ ID NO: 454561 - DNA, 25 bp, Mus musculus
ggtgctgcgcgttttgggcaaaccc

SEQ ID NO: 454562 - DNA, 25 bp, Mus musculus
ggtgctgtatccatgggccgaaaat

SEQ ID NO: 454563 - DNA, 25 bp, Mus musculus
ggtgctgtcactatcgctggtgctg

SEQ ID NO: 454564 - DNA, 25 bp, Mus musculus
ggtgctgtccctcttaattctttgt

SEQ ID NO: 454565 - DNA, 25 bp, Mus musculus
ggtgctgtgtagctgtccagtaaca

SEQ ID NO: 454566 - DNA, 25 bp, Mus musculus
ggtgctgttgttccaaactgtgtgc

SEQ ID NO: 454567 - DNA, 25 bp, Mus musculus
ggtgctgtttcgctccgggactctt

SEQ ID NO: 454568 - DNA, 25 bp, Mus musculus
ggtgctgtttttttctccgtgcaca

SEQ ID NO: 454569 - DNA, 25 bp, Mus musculus
ggtgcttatgcagactcacatgtgg

SEQ ID NO: 454570 - DNA, 25 bp, Mus musculus
ggtgcttcctgacactcgggacaca

SEQ ID NO: 454571 - DNA, 25 bp, Mus musculus
ggtgcttcggtcttcagcagcgata

SEQ ID NO: 454572 - DNA, 25 bp, Mus musculus
ggtgcttgaatctccacattcgttg

SEQ ID NO: 454573 - DNA, 25 bp, Mus musculus
ggtgctttctcgtgtggcctcagct

SEQ ID NO: 454574 - DNA, 25 bp, Mus musculus
ggtgctttgtaccatcctcactgta

SEQ ID NO: 454575 - DNA, 25 bp, Mus musculus
ggtggaaacacaagatgccctgggt

SEQ ID NO: 454576 - DNA, 25 bp, Mus musculus
ggtggaacacaacctatcgccgcta

SEQ ID NO: 454577 - DNA, 25 bp, Mus musculus
ggtggaaccaaacctccctagagag

SEQ ID NO: 454578 - DNA, 25 bp, Mus musculus
ggtggaacccaatgacacccttgag

SEQ ID NO: 454579 - DNA, 25 bp, Mus musculus
ggtggaactcacaggcagagcagtc

SEQ ID NO: 454580 - DNA, 25 bp, Mus musculus
ggtggaactcttactgcaggctgca

SEQ ID NO: 454581 - DNA, 25 bp, Mus musculus
ggtggaagaaaccaactgttcctgc

SEQ ID NO: 454582 - DNA, 25 bp, Mus musculus
ggtggaagagctggccctgacacaa

SEQ ID NO: 454583 - DNA, 25 bp, Mus musculus
ggtggaagtctcatccctcacagtt

SEQ ID NO: 454584 - DNA, 25 bp, Mus musculus
ggtggaatgagacacaagatgccct

SEQ ID NO: 454585 - DNA, 25 bp, Mus musculus
ggtggacacacaactgctacaggat

SEQ ID NO: 454586 - DNA, 25 bp, Mus musculus
ggtggacagcgccatcgatgacatt

SEQ ID NO: 454587 - DNA, 25 bp, Mus musculus
ggtggacagctaccaaccactgtga

SEQ ID NO: 454588 - DNA, 25 bp, Mus musculus
ggtggacatctgtggacatctggcc

SEQ ID NO: 454589 - DNA, 25 bp, Mus musculus
ggtggacccctgagtctactagtgc

SEQ ID NO: 454590 - DNA, 25 bp, Mus musculus
ggtggacgcggccattaaagcccat

SEQ ID NO: 454591 - DNA, 25 bp, Mus musculus
ggtggactccttcttccctcgaagc

SEQ ID NO: 454592 - DNA, 25 bp, Mus musculus
ggtggactgcccaattcttcttccc

SEQ ID NO: 454593 - DNA, 25 bp, Mus musculus
ggtggactgctgtcctccagcataa

SEQ ID NO: 454594 - DNA, 25 bp, Mus musculus
ggtggagacacttatctggtccctg

SEQ ID NO: 454595 - DNA, 25 bp, Mus musculus
ggtggagacccagataagacctgtc

SEQ ID NO: 454596 - DNA, 25 bp, Mus musculus
ggtggagcgcatcctgttcatctat

SEQ ID NO: 454597 - DNA, 25 bp, Mus musculus
ggtggaggccacaaacagaattatc

SEQ ID NO: 454598 - DNA, 25 bp, Mus musculus
ggtggagtgatcagggacccctaaa

SEQ ID NO: 454599 - DNA, 25 bp, Mus musculus
ggtggatatgatttcaaaactggtc

SEQ ID NO: 454600 - DNA, 25 bp, Mus musculus
ggtggatccgtttgaccccagaggc

SEQ ID NO: 454601 - DNA, 25 bp, Mus musculus
ggtggatcctcgaacctggctaagc

SEQ ID NO: 454602 - DNA, 25 bp, Mus musculus
ggtggatgaggtcggagcgccccat

SEQ ID NO: 454603 - DNA, 25 bp, Mus musculus
ggtggatgccaaatcactggaggcc

SEQ ID NO: 454604 - DNA, 25 bp, Mus musculus
ggtggatgcctatgttaactgttgc

SEQ ID NO: 454605 - DNA, 25 bp, Mus musculus
ggtggatggatcgttcctgctctga

SEQ ID NO: 454606 - DNA, 25 bp, Mus musculus
ggtggatggctcaggacaactcctt

SEQ ID NO: 454607 - DNA, 25 bp, Mus musculus
ggtggatgtgaataactacggcccc

SEQ ID NO: 454608 - DNA, 25 bp, Mus musculus
ggtggattcaggcaaccctacccat

SEQ ID NO: 454609 - DNA, 25 bp, Mus musculus
ggtggatttgtctgtactaactgaa

SEQ ID NO: 454610 - DNA, 25 bp, Mus musculus
ggtggcaagtctttatctattgagc

SEQ ID NO: 454611 - DNA, 25 bp, Mus musculus
ggtggcacagcatctagccaagggt

SEQ ID NO: 454612 - DNA, 25 bp, Mus musculus
ggtggcacccttcaggaaccagtgt

SEQ ID NO: 454613 - DNA, 25 bp, Mus musculus
ggtggcagaacttagggtcaaagca

SEQ ID NO: 454614 - DNA, 25 bp, Mus musculus
ggtggcagccatgcaagttcgctat

SEQ ID NO: 454615 - DNA, 25 bp, Mus musculus
ggtggcatctccagctacgcaaatg

SEQ ID NO: 454616 - DNA, 25 bp, Mus musculus
ggtggccacacgtaagacttttgag

SEQ ID NO: 454617 - DNA, 25 bp, Mus musculus
ggtggccaccttctacttcctcttg

SEQ ID NO: 454618 - DNA, 25 bp, Mus musculus
ggtggccacggtcatctgtaactcc

SEQ ID NO: 454619 - DNA, 25 bp, Mus musculus
ggtggccagctcctgccaagatcaa

SEQ ID NO: 454620 - DNA, 25 bp, Mus musculus
ggtggccagtgagcgacaacaccat

SEQ ID NO: 454621 - DNA, 25 bp, Mus musculus
ggtggcccagcttctgtttacgtca

SEQ ID NO: 454622 - DNA, 25 bp, Mus musculus
ggtggcccattgaaaagcgccgcga

SEQ ID NO: 454623 - DNA, 25 bp, Mus musculus
ggtggccccacttttgttgagaatg

SEQ ID NO: 454624 - DNA, 25 bp, Mus musculus
ggtggccgaccaaaaggactattca

SEQ ID NO: 454625 - DNA, 25 bp, Mus musculus
ggtggccgcgggtgagaggctgtgc

SEQ ID NO: 454626 - DNA, 25 bp, Mus musculus
ggtggccgtatcttgctgaactatg

SEQ ID NO: 454627 - DNA, 25 bp, Mus musculus
ggtggcctcccaattccagtgaaag

SEQ ID NO: 454628 - DNA, 25 bp, Mus musculus
ggtggcctggcattagcatgtaagc

SEQ ID NO: 454629 - DNA, 25 bp, Mus musculus
ggtggcctgggctacagcggcggtg

SEQ ID NO: 454630 - DNA, 25 bp, Mus musculus
ggtggccttatgtagaacacgctaa

SEQ ID NO: 454631 - DNA, 25 bp, Mus musculus
ggtggccttgccctggtatgaccat

SEQ ID NO: 454632 - DNA, 25 bp, Mus musculus
ggtggccttgctactgcactacagc

SEQ ID NO: 454633 - DNA, 25 bp, Mus musculus
ggtggcgcagctcaaacagaaagtc

SEQ ID NO: 454634 - DNA, 25 bp, Mus musculus
ggtggcggacccttcttagcatcgg

SEQ ID NO: 454635 - DNA, 25 bp, Mus musculus
ggtggctattgactccttgacatct

SEQ ID NO: 454636 - DNA, 25 bp, Mus musculus
ggtggctcacatgccaggtgacatt

SEQ ID NO: 454637 - DNA, 25 bp, Mus musculus
ggtggctcctcctagtgaatcagtg

SEQ ID NO: 454638 - DNA, 25 bp, Mus musculus
ggtggctcctctggtgggatccatt

SEQ ID NO: 454639 - DNA, 25 bp, Mus musculus
ggtggctctggctccatagcgcctc

SEQ ID NO: 454640 - DNA, 25 bp, Mus musculus
ggtggctgcggcatcaagatcttta

SEQ ID NO: 454641 - DNA, 25 bp, Mus musculus
ggtggctgggctatgactcagtcta

SEQ ID NO: 454642 - DNA, 25 bp, Mus musculus
ggtggctgtaaccacgacatggact

SEQ ID NO: 454643 - DNA, 25 bp, Mus musculus
ggtggcttccgaggtataaagcagc

SEQ ID NO: 454644 - DNA, 25 bp, Mus musculus
ggtggcttcctgactctctcgagta

SEQ ID NO: 454645 - DNA, 25 bp, Mus musculus
ggtgggaacccttcactagtggctt

SEQ ID NO: 454646 - DNA, 25 bp, Mus musculus
ggtgggaagcccatttcacatgcag

SEQ ID NO: 454647 - DNA, 25 bp, Mus musculus
ggtgggacgacaaactacatagcag

SEQ ID NO: 454648 - DNA, 25 bp, Mus musculus
ggtgggaggctctcactcttccttg

SEQ ID NO: 454649 - DNA, 25 bp, Mus musculus
ggtgggataaccttccgtgatcaga

SEQ ID NO: 454650 - DNA, 25 bp, Mus musculus
ggtgggcaccatcttcatcattcaa

SEQ ID NO: 454651 - DNA, 25 bp, Mus musculus
ggtgggcaccgtgatcatgatgaaa

SEQ ID NO: 454652 - DNA, 25 bp, Mus musculus
ggtgggcagcactaccaatgaagcc

SEQ ID NO: 454653 - DNA, 25 bp, Mus musculus
ggtgggcataattgatctttagggc

SEQ ID NO: 454654 - DNA, 25 bp, Mus musculus
ggtgggccaagcaagaactctgtct

SEQ ID NO: 454655 - DNA, 25 bp, Mus musculus
ggtgggctctaaggtcctatgctca

SEQ ID NO: 454656 - DNA, 25 bp, Mus musculus
ggtgggtctcctgaattctggcctg

SEQ ID NO: 454657 - DNA, 25 bp, Mus musculus
ggtgggttattggaagccttgctct

SEQ ID NO: 454658 - DNA, 25 bp, Mus musculus
ggtggtacctaaaattgtatcatca

SEQ ID NO: 454659 - DNA, 25 bp, Mus musculus
ggtggtagccctagcctgaggttta

SEQ ID NO: 454660 - DNA, 25 bp, Mus musculus
ggtggtatgaacatagccactttcc

SEQ ID NO: 454661 - DNA, 25 bp, Mus musculus
ggtggtcaacctccctaatcctaat

SEQ ID NO: 454662 - DNA, 25 bp, Mus musculus
ggtggtcaatcaagcccagttggct

SEQ ID NO: 454663 - DNA, 25 bp, Mus musculus
ggtggtcatggccaactataacgtg

SEQ ID NO: 454664 - DNA, 25 bp, Mus musculus
ggtggtccaacaccagaatctaggg

SEQ ID NO: 454665 - DNA, 25 bp, Mus musculus
ggtggtccaagtgtccaagaaatcg

SEQ ID NO: 454666 - DNA, 25 bp, Mus musculus
ggtggtccgaaaaaactcatccgag

SEQ ID NO: 454667 - DNA, 25 bp, Mus musculus
ggtggtcttctcaaccgtcctgcag

SEQ ID NO: 454668 - DNA, 25 bp, Mus musculus
ggtggtgggtacacaatactgctca

SEQ ID NO: 454669 - DNA, 25 bp, Mus musculus
ggtggtgtcactggctcacctgaag

SEQ ID NO: 454670 - DNA, 25 bp, Mus musculus
ggtggttaccatcgaagtgcccttg

SEQ ID NO: 454671 - DNA, 25 bp, Mus musculus
ggtggttgccacaaactcctggagg

SEQ ID NO: 454672 - DNA, 25 bp, Mus musculus
ggtggttgtacctcccttgactcca

SEQ ID NO: 454673 - DNA, 25 bp, Mus musculus
ggtggtttctgtgcgtgcaaatcaa

SEQ ID NO: 454674 - DNA, 25 bp, Mus musculus
ggtgtaaaatgtaaagctgccctag

SEQ ID NO: 454675 - DNA, 25 bp, Mus musculus
ggtgtaaacgaatgagaggctgctc

SEQ ID NO: 454676 - DNA, 25 bp, Mus musculus
ggtgtaacttcttgcgccagcggct

SEQ ID NO: 454677 - DNA, 25 bp, Mus musculus
ggtgtaatgttgctccctgatccca

SEQ ID NO: 454678 - DNA, 25 bp, Mus musculus
ggtgtacaccagtcatttcgcagag

SEQ ID NO: 454679 - DNA, 25 bp, Mus musculus
ggtgtacactctgttgctgccagga

SEQ ID NO: 454680 - DNA, 25 bp, Mus musculus
ggtgtacagagagcctcgtggatta

SEQ ID NO: 454681 - DNA, 25 bp, Mus musculus
ggtgtacagcctgtccatgtgtgga

SEQ ID NO: 454682 - DNA, 25 bp, Mus musculus
ggtgtaccaatagaaggccctctga

SEQ ID NO: 454683 - DNA, 25 bp, Mus musculus
ggtgtaccacaaaaggctctgctct

SEQ ID NO: 454684 - DNA, 25 bp, Mus musculus
ggtgtaccccaagcaagtgacctgg

SEQ ID NO: 454685 - DNA, 25 bp, Mus musculus
ggtgtacgcgtgctctcccgtgtac

SEQ ID NO: 454686 - DNA, 25 bp, Mus musculus
ggtgtactgatacctgccagcccat

SEQ ID NO: 454687 - DNA, 25 bp, Mus musculus
ggtgtagaatttttatctaagcata

SEQ ID NO: 454688 - DNA, 25 bp, Mus musculus
ggtgtagccacttcataaggtgcca

SEQ ID NO: 454689 - DNA, 25 bp, Mus musculus
ggtgtagccccgtcacaacaaaggt

SEQ ID NO: 454690 - DNA, 25 bp, Mus musculus
ggtgtagcgtcctgggctgacctct

SEQ ID NO: 454691 - DNA, 25 bp, Mus musculus
ggtgtagctaagttccagcaggaaa

SEQ ID NO: 454692 - DNA, 25 bp, Mus musculus
ggtgtagctcaggacttcatcaaag

SEQ ID NO: 454693 - DNA, 25 bp, Mus musculus
ggtgtagtaagcctgcattcctcta

SEQ ID NO: 454694 - DNA, 25 bp, Mus musculus
ggtgtatattcatgagccgctgact

SEQ ID NO: 454695 - DNA, 25 bp, Mus musculus
ggtgtatgcaccattcactgggaag

SEQ ID NO: 454696 - DNA, 25 bp, Mus musculus
ggtgtattttagcacagggcagtcc

SEQ ID NO: 454697 - DNA, 25 bp, Mus musculus
ggtgtcaaggatgtatacgccccga

SEQ ID NO: 454698 - DNA, 25 bp, Mus musculus
ggtgtcaataagaaccagactgtga

SEQ ID NO: 454699 - DNA, 25 bp, Mus musculus
ggtgtcaccatacgcagcctcaaat

SEQ ID NO: 454700 - DNA, 25 bp, Mus musculus
ggtgtcagaccaacttactgcctag

SEQ ID NO: 454701 - DNA, 25 bp, Mus musculus
ggtgtcagcctctgtccacttggca

SEQ ID NO: 454702 - DNA, 25 bp, Mus musculus
ggtgtcaggtctcctagaagtagac

SEQ ID NO: 454703 - DNA, 25 bp, Mus musculus
ggtgtcagtctctctagtcagttcc

SEQ ID NO: 454704 - DNA, 25 bp, Mus musculus
ggtgtcattccaacattggtttaca

SEQ ID NO: 454705 - DNA, 25 bp, Mus musculus
ggtgtccaacagagcccagcctttg

SEQ ID NO: 454706 - DNA, 25 bp, Mus musculus
ggtgtccaacctggacttcggagtg

SEQ ID NO: 454707 - DNA, 25 bp, Mus musculus
ggtgtccactagcatcccggaggtt

SEQ ID NO: 454708 - DNA, 25 bp, Mus musculus
ggtgtccactgcgtacatccacaaa

SEQ ID NO: 454709 - DNA, 25 bp, Mus musculus
ggtgtccagagctaaggctaaatag

SEQ ID NO: 454710 - DNA, 25 bp, Mus musculus
ggtgtccagggatatcgccagtgat

SEQ ID NO: 454711 - DNA, 25 bp, Mus musculus
ggtgtccctcagtgttctgctgcaa

SEQ ID NO: 454712 - DNA, 25 bp, Mus musculus
ggtgtcccttgatcagcgctgggct

SEQ ID NO: 454713 - DNA, 25 bp, Mus musculus
ggtgtcctaaagtcaggagagaagc

SEQ ID NO: 454714 - DNA, 25 bp, Mus musculus
ggtgtcctcatcaaagccagctggg

SEQ ID NO: 454715 - DNA, 25 bp, Mus musculus
ggtgtccttctacaccttccgtgag

SEQ ID NO: 454716 - DNA, 25 bp, Mus musculus
ggtgtcgacctagccaagatcctga

SEQ ID NO: 454717 - DNA, 25 bp, Mus musculus
ggtgtcgcacgctggcatgatcaac

SEQ ID NO: 454718 - DNA, 25 bp, Mus musculus
ggtgtcgcacttcacctcaggcagg

SEQ ID NO: 454719 - DNA, 25 bp, Mus musculus
ggtgtcggagctagccacggtcatt

SEQ ID NO: 454720 - DNA, 25 bp, Mus musculus
ggtgtctaatgcatccacgctgctt

SEQ ID NO: 454721 - DNA, 25 bp, Mus musculus
ggtgtctaccttctgaacaagaaca

SEQ ID NO: 454722 - DNA, 25 bp, Mus musculus
ggtgtctccttccaggcatgctgtg

SEQ ID NO: 454723 - DNA, 25 bp, Mus musculus
ggtgtctgggtctcttagtagctga

SEQ ID NO: 454724 - DNA, 25 bp, Mus musculus
ggtgtctgttcccttctccgtgttc

SEQ ID NO: 454725 - DNA, 25 bp, Mus musculus
ggtgtcttcccagtgctacatgtgc

SEQ ID NO: 454726 - DNA, 25 bp, Mus musculus
ggtgtcttcgtgtaccagctcatga

SEQ ID NO: 454727 - DNA, 25 bp, Mus musculus
ggtgtgaaatctgtcctagggagca

SEQ ID NO: 454728 - DNA, 25 bp, Mus musculus
ggtgtgaagaacatgctactggcat

SEQ ID NO: 454729 - DNA, 25 bp, Mus musculus
ggtgtgaataaagtgactcttccta

SEQ ID NO: 454730 - DNA, 25 bp, Mus musculus
ggtgtgacaatggaactcaggtgac

SEQ ID NO: 454731 - DNA, 25 bp, Mus musculus
ggtgtgacccacagcctgactctaa

SEQ ID NO: 454732 - DNA, 25 bp, Mus musculus
ggtgtgactcagcaagcagccttcc

SEQ ID NO: 454733 - DNA, 25 bp, Mus musculus
ggtgtgacttacaggactctgcaga

SEQ ID NO: 454734 - DNA, 25 bp, Mus musculus
ggtgtgagacccctgtatgatagca

SEQ ID NO: 454735 - DNA, 25 bp, Mus musculus
ggtgtgatgcgctctgctatgcctt

SEQ ID NO: 454736 - DNA, 25 bp, Mus musculus
ggtgtgattgccgatccccagataa

SEQ ID NO: 454737 - DNA, 25 bp, Mus musculus
ggtgtgcacaactgaggatccctga

SEQ ID NO: 454738 - DNA, 25 bp, Mus musculus
ggtgtgcacaccagccatgaggaaa

SEQ ID NO: 454739 - DNA, 25 bp, Mus musculus
ggtgtgcacacccttcgtcaagaag

SEQ ID NO: 454740 - DNA, 25 bp, Mus musculus
ggtgtgcaccatcgcaccttgccaa

SEQ ID NO: 454741 - DNA, 25 bp, Mus musculus
ggtgtgcactaccaaccacattggt

SEQ ID NO: 454742 - DNA, 25 bp, Mus musculus
ggtgtgcagaacagggccagtacca

SEQ ID NO: 454743 - DNA, 25 bp, Mus musculus
ggtgtgcagacccaagtcatcgttt

SEQ ID NO: 454744 - DNA, 25 bp, Mus musculus
ggtgtgcagcactcgtcaggaaatt

SEQ ID NO: 454745 - DNA, 25 bp, Mus musculus
ggtgtgccaatcagggatcctaaca

SEQ ID NO: 454746 - DNA, 25 bp, Mus musculus
ggtgtgccacaacctatgactacaa

SEQ ID NO: 454747 - DNA, 25 bp, Mus musculus
ggtgtgccatcttccccaggtaggt

SEQ ID NO: 454748 - DNA, 25 bp, Mus musculus
ggtgtgcgccttctactacctgggc

SEQ ID NO: 454749 - DNA, 25 bp, Mus musculus
ggtgtgctaaatcagctgctgccaa

SEQ ID NO: 454750 - DNA, 25 bp, Mus musculus
ggtgtgctgcaaggactcctcctag

SEQ ID NO: 454751 - DNA, 25 bp, Mus musculus
ggtgtgctggcaacttcaagttaga

SEQ ID NO: 454752 - DNA, 25 bp, Mus musculus
ggtgtgctgtacataagcctaggaa

SEQ ID NO: 454753 - DNA, 25 bp, Mus musculus
ggtgtggatcgaaaaggaccccgca

SEQ ID NO: 454754 - DNA, 25 bp, Mus musculus
ggtgtggccatcttgatctacctgc

SEQ ID NO: 454755 - DNA, 25 bp, Mus musculus
ggtgtggccctgctgtcattaacat

SEQ ID NO: 454756 - DNA, 25 bp, Mus musculus
ggtgtggctaatccaccttcgcagc

SEQ ID NO: 454757 - DNA, 25 bp, Mus musculus
ggtgtggtccctgtcagttttgtcc

SEQ ID NO: 454758 - DNA, 25 bp, Mus musculus
ggtgtggtgccacgctcctttacaa

SEQ ID NO: 454759 - DNA, 25 bp, Mus musculus
ggtgtgtaattctggagaagactga

SEQ ID NO: 454760 - DNA, 25 bp, Mus musculus
ggtgtgtagatttcaaactctctgg

SEQ ID NO: 454761 - DNA, 25 bp, Mus musculus
ggtgtgtaggatgcgccaagatccc

SEQ ID NO: 454762 - DNA, 25 bp, Mus musculus
ggtgtgtatctcatagcaggtttgg

SEQ ID NO: 454763 - DNA, 25 bp, Mus musculus
ggtgtgtgccctacaaatagactga

SEQ ID NO: 454764 - DNA, 25 bp, Mus musculus
ggtgtgttatatcggcctggactca

SEQ ID NO: 454765 - DNA, 25 bp, Mus musculus
ggtgtgtttaactttgtcaacaaag

SEQ ID NO: 454766 - DNA, 25 bp, Mus musculus
ggtgtgtttcctcttcaaccgggag

SEQ ID NO: 454767 - DNA, 25 bp, Mus musculus
ggtgttacagcaaatccgctccagg

SEQ ID NO: 454768 - DNA, 25 bp, Mus musculus
ggtgttacctcgatccctgtggctg

SEQ ID NO: 454769 - DNA, 25 bp, Mus musculus
ggtgttcaacaactccgtgccagtg

SEQ ID NO: 454770 - DNA, 25 bp, Mus musculus
ggtgttcacatcagattgctttggg

SEQ ID NO: 454771 - DNA, 25 bp, Mus musculus
ggtgttcctgatagcaagttccgta

SEQ ID NO: 454772 - DNA, 25 bp, Mus musculus
ggtgttcggttatggagcctctctc

SEQ ID NO: 454773 - DNA, 25 bp, Mus musculus
ggtgttctagatctggccaaagcca

SEQ ID NO: 454774 - DNA, 25 bp, Mus musculus
ggtgttgaacccagaaactcatgca

SEQ ID NO: 454775 - DNA, 25 bp, Mus musculus
ggtgttgacttctccaaggctacgg

SEQ ID NO: 454776 - DNA, 25 bp, Mus musculus
ggtgttgcgcacattcatccgaaag

SEQ ID NO: 454777 - DNA, 25 bp, Mus musculus
ggtgttggcctcctctgcatgatgt

SEQ ID NO: 454778 - DNA, 25 bp, Mus musculus
ggtgttgtacactgccctgcgatgc

SEQ ID NO: 454779 - DNA, 25 bp, Mus musculus
ggtgttgtcagcacttcaagagaac

SEQ ID NO: 454780 - DNA, 25 bp, Mus musculus
ggtgttgttccgatgctcagggaca

SEQ ID NO: 454781 - DNA, 25 bp, Mus musculus
ggtgtttcaggattcagagacctca

SEQ ID NO: 454782 - DNA, 25 bp, Mus musculus
ggtgtttccatctctgaccacagga

SEQ ID NO: 454783 - DNA, 25 bp, Mus musculus
ggtgtttccgcagccttgctgcctt

SEQ ID NO: 454784 - DNA, 25 bp, Mus musculus
ggtgtttctaagcatcccctcagtg

SEQ ID NO: 454785 - DNA, 25 bp, Mus musculus
ggtgtttctccctctcggaggcaca

SEQ ID NO: 454786 - DNA, 25 bp, Mus musculus
ggtgtttgattaagcactggccttc

SEQ ID NO: 454787 - DNA, 25 bp, Mus musculus
ggtgtttggctcactgctctgcaag

SEQ ID NO: 454788 - DNA, 25 bp, Mus musculus
ggtgttttatgctgtggcttattca

SEQ ID NO: 454789 - DNA, 25 bp, Mus musculus
ggtgttttcctccaatgccttccaa

SEQ ID NO: 454790 - DNA, 25 bp, Mus musculus
ggtgtttttagcagccaagtgtcat

SEQ ID NO: 454791 - DNA, 25 bp, Mus musculus
ggttaaaccagcctcgctttggatt

SEQ ID NO: 454792 - DNA, 25 bp, Mus musculus
ggttaaagagtcaacaggctgccag

SEQ ID NO: 454793 - DNA, 25 bp, Mus musculus
ggttaaatggatcccttatggccct

SEQ ID NO: 454794 - DNA, 25 bp, Mus musculus
ggttaaccagattcatcttgtcata

SEQ ID NO: 454795 - DNA, 25 bp, Mus musculus
ggttaaccggagagcagcccttggt

SEQ ID NO: 454796 - DNA, 25 bp, Mus musculus
ggttaagagaacaagaggaatccca

SEQ ID NO: 454797 - DNA, 25 bp, Mus musculus
ggttaagccgctgtcattactgaaa

SEQ ID NO: 454798 - DNA, 25 bp, Mus musculus
ggttaaggtggtgaccatctgctgc

SEQ ID NO: 454799 - DNA, 25 bp, Mus musculus
ggttaatagcaacaaccaggagctg

SEQ ID NO: 454800 - DNA, 25 bp, Mus musculus
ggttaatgatcaatgccacccctgg

SEQ ID NO: 454801 - DNA, 25 bp, Mus musculus
ggttacaaagtacaggcatcccaca

SEQ ID NO: 454802 - DNA, 25 bp, Mus musculus
ggttacaaccggtgcctagctgatg

SEQ ID NO: 454803 - DNA, 25 bp, Mus musculus
ggttacaacttcgtgtccagaagcg

SEQ ID NO: 454804 - DNA, 25 bp, Mus musculus
ggttacaagtgatagccagaaatgc

SEQ ID NO: 454805 - DNA, 25 bp, Mus musculus
ggttacacaagctctaccaggagaa

SEQ ID NO: 454806 - DNA, 25 bp, Mus musculus
ggttacagatggttggattttgtaa

SEQ ID NO: 454807 - DNA, 25 bp, Mus musculus
ggttacaggtgtgctcccaaaggct

SEQ ID NO: 454808 - DNA, 25 bp, Mus musculus
ggttacagtcttcttcatggccgga

SEQ ID NO: 454809 - DNA, 25 bp, Mus musculus
ggttacagttttagctaagcctctc

SEQ ID NO: 454810 - DNA, 25 bp, Mus musculus
ggttacatcaccaatcagtctccag

SEQ ID NO: 454811 - DNA, 25 bp, Mus musculus
ggttacatcgcatcccgggtgctct

SEQ ID NO: 454812 - DNA, 25 bp, Mus musculus
ggttacatcgcctagttccaaagca

SEQ ID NO: 454813 - DNA, 25 bp, Mus musculus
ggttaccagactgcagaactcgtta

SEQ ID NO: 454814 - DNA, 25 bp, Mus musculus
ggttaccagctacaccattcagcag

SEQ ID NO: 454815 - DNA, 25 bp, Mus musculus
ggttacccctggctactgagtccga

SEQ ID NO: 454816 - DNA, 25 bp, Mus musculus
ggttaccgggaattgtcagcagctc

SEQ ID NO: 454817 - DNA, 25 bp, Mus musculus
ggttacctagttccatgatgcacag

SEQ ID NO: 454818 - DNA, 25 bp, Mus musculus
ggttacctcggatcccacaagtgct

SEQ ID NO: 454819 - DNA, 25 bp, Mus musculus
ggttacgggcctggtgtaccaatag

SEQ ID NO: 454820 - DNA, 25 bp, Mus musculus
ggttactaccgttggctgcagcgtg

SEQ ID NO: 454821 - DNA, 25 bp, Mus musculus
ggttactgagacaacggttaccgag

SEQ ID NO: 454822 - DNA, 25 bp, Mus musculus
ggttactggctcttgtgcaaaattg

SEQ ID NO: 454823 - DNA, 25 bp, Mus musculus
ggttactggtgtccaacagagccca

SEQ ID NO: 454824 - DNA, 25 bp, Mus musculus
ggttagaacaggtggctggcaccta

SEQ ID NO: 454825 - DNA, 25 bp, Mus musculus
ggttagacacgtggactcagggcct

SEQ ID NO: 454826 - DNA, 25 bp, Mus musculus
ggttagaccaccaggaaaagatgct

SEQ ID NO: 454827 - DNA, 25 bp, Mus musculus
ggttagggcccctgatgatgagaca

SEQ ID NO: 454828 - DNA, 25 bp, Mus musculus
ggttagtccactgagaatgtgtttg

SEQ ID NO: 454829 - DNA, 25 bp, Mus musculus
ggttagtggcacgaaagactggcat

SEQ ID NO: 454830 - DNA, 25 bp, Mus musculus
ggttatacacggaaagcagctgctc

SEQ ID NO: 454831 - DNA, 25 bp, Mus musculus
ggttatcagatatgcaggcgccaca

SEQ ID NO: 454832 - DNA, 25 bp, Mus musculus
ggttatcattgacggcctggacgcc

SEQ ID NO: 454833 - DNA, 25 bp, Mus musculus
ggttatccacatccctgaagctggg

SEQ ID NO: 454834 - DNA, 25 bp, Mus musculus
ggttatcccctagcagaagtgtcct

SEQ ID NO: 454835 - DNA, 25 bp, Mus musculus
ggttatcgacacacaggaagagcag

SEQ ID NO: 454836 - DNA, 25 bp, Mus musculus
ggttatctcaacaacgaaggctagg

SEQ ID NO: 454837 - DNA, 25 bp, Mus musculus
ggttatcttagaaagagctctgcca

SEQ ID NO: 454838 - DNA, 25 bp, Mus musculus
ggttatgaaccttttagccccagca

SEQ ID NO: 454839 - DNA, 25 bp, Mus musculus
ggttatgccacagctttttcccgca

SEQ ID NO: 454840 - DNA, 25 bp, Mus musculus
ggttatgcttcatggtccttcctcc

SEQ ID NO: 454841 - DNA, 25 bp, Mus musculus
ggttattacccagttcacgtctcag

SEQ ID NO: 454842 - DNA, 25 bp, Mus musculus
ggttattgagtcctccatgccaaag

SEQ ID NO: 454843 - DNA, 25 bp, Mus musculus
ggttcaaaatttccctcacacactc

SEQ ID NO: 454844 - DNA, 25 bp, Mus musculus
ggttcaaagaacaatcgcaaggaca

SEQ ID NO: 454845 - DNA, 25 bp, Mus musculus
ggttcaaagctatccctggagcatc

SEQ ID NO: 454846 - DNA, 25 bp, Mus musculus
ggttcaaagtttccaagatccagcc

SEQ ID NO: 454847 - DNA, 25 bp, Mus musculus
ggttcaacactagtgactttccttc

SEQ ID NO: 454848 - DNA, 25 bp, Mus musculus
ggttcaacgcaaagttcgccgtgga

SEQ ID NO: 454849 - DNA, 25 bp, Mus musculus
ggttcaacttcaagctcagggtcgg

SEQ ID NO: 454850 - DNA, 25 bp, Mus musculus
ggttcaagagcgcatggcacttctg

SEQ ID NO: 454851 - DNA, 25 bp, Mus musculus
ggttcaagcacctggagcgcagaaa

SEQ ID NO: 454852 - DNA, 25 bp, Mus musculus
ggttcaagtagttcagcccactgca

SEQ ID NO: 454853 - DNA, 25 bp, Mus musculus
ggttcaatctggcagactcccagtg

SEQ ID NO: 454854 - DNA, 25 bp, Mus musculus
ggttcaatctgttgtccgcatcaga

SEQ ID NO: 454855 - DNA, 25 bp, Mus musculus
ggttcaatgcagtcatgatccgcgc

SEQ ID NO: 454856 - DNA, 25 bp, Mus musculus
ggttcaatgtctagcacctactaca

SEQ ID NO: 454857 - DNA, 25 bp, Mus musculus
ggttcacaagtgacgcagccaatgg

SEQ ID NO: 454858 - DNA, 25 bp, Mus musculus
ggttcacaccgtgcagtctccaagg

SEQ ID NO: 454859 - DNA, 25 bp, Mus musculus
ggttcacagacatcccaaagccttt

SEQ ID NO: 454860 - DNA, 25 bp, Mus musculus
ggttcacctcgaacacccagaagag

SEQ ID NO: 454861 - DNA, 25 bp, Mus musculus
ggttcagagcgtgcctctgttgtta

SEQ ID NO: 454862 - DNA, 25 bp, Mus musculus
ggttcagattctggatgcccacgtg

SEQ ID NO: 454863 - DNA, 25 bp, Mus musculus
ggttcagcctgaactatataccagg

SEQ ID NO: 454864 - DNA, 25 bp, Mus musculus
ggttcaggaagcacagccaaaggag

SEQ ID NO: 454865 - DNA, 25 bp, Mus musculus
ggttcagggaccctcccttgatgca

SEQ ID NO: 454866 - DNA, 25 bp, Mus musculus
ggttcagtgttgctgatcaccagag

SEQ ID NO: 454867 - DNA, 25 bp, Mus musculus
ggttcagttcacaacttctcagtga

SEQ ID NO: 454868 - DNA, 25 bp, Mus musculus
ggttcatagaccataggctctggat

SEQ ID NO: 454869 - DNA, 25 bp, Mus musculus
ggttcatcatcctcccagaggccag

SEQ ID NO: 454870 - DNA, 25 bp, Mus musculus
ggttcatccagtcattcttcccaaa

SEQ ID NO: 454871 - DNA, 25 bp, Mus musculus
ggttcatccctgatatggccctggc

SEQ ID NO: 454872 - DNA, 25 bp, Mus musculus
ggttcatgagaagacggtgcgcaca

SEQ ID NO: 454873 - DNA, 25 bp, Mus musculus
ggttcatgcagttccgtgccaagga

SEQ ID NO: 454874 - DNA, 25 bp, Mus musculus
ggttcatggctttcactcggcaggg

SEQ ID NO: 454875 - DNA, 25 bp, Mus musculus
ggttcattgaaaaatccttagtgat

SEQ ID NO: 454876 - DNA, 25 bp, Mus musculus
ggttccaaaacaagcgtgccaagat

SEQ ID NO: 454877 - DNA, 25 bp, Mus musculus
ggttccaacagcaactccccgtgga

SEQ ID NO: 454878 - DNA, 25 bp, Mus musculus
ggttccaagagccatttggtttcac

SEQ ID NO: 454879 - DNA, 25 bp, Mus musculus
ggttccaattgcagtgtcaccacag

SEQ ID NO: 454880 - DNA, 25 bp, Mus musculus
ggttccacaggaaggcaagcgcagt

SEQ ID NO: 454881 - DNA, 25 bp, Mus musculus
ggttccacatccaagaactacatgt

SEQ ID NO: 454882 - DNA, 25 bp, Mus musculus
ggttccagcattcacatatcccagt

SEQ ID NO: 454883 - DNA, 25 bp, Mus musculus
ggttccagggccattgtaggacccg

SEQ ID NO: 454884 - DNA, 25 bp, Mus musculus
ggttccattcgaccaaaagtcagga

SEQ ID NO: 454885 - DNA, 25 bp, Mus musculus
ggttcccaaagaggtgtccgatcat

SEQ ID NO: 454886 - DNA, 25 bp, Mus musculus
ggttcccaagttagtcagagccctg

SEQ ID NO: 454887 - DNA, 25 bp, Mus musculus
ggttcccacagaatgcggctgtatg

SEQ ID NO: 454888 - DNA, 25 bp, Mus musculus
ggttcccacggttcaaagaggagca

SEQ ID NO: 454889 - DNA, 25 bp, Mus musculus
ggttcccacttgtatcctccagtta

SEQ ID NO: 454890 - DNA, 25 bp, Mus musculus
ggttcccagtccgaaaacaggccat

SEQ ID NO: 454891 - DNA, 25 bp, Mus musculus
ggttcccagttccacagctagctat

SEQ ID NO: 454892 - DNA, 25 bp, Mus musculus
ggttcccattcagttccatcagcag

SEQ ID NO: 454893 - DNA, 25 bp, Mus musculus
ggttccccaaatctgtatatcattg

SEQ ID NO: 454894 - DNA, 25 bp, Mus musculus
ggttcccgagcacggccatcaagat

SEQ ID NO: 454895 - DNA, 25 bp, Mus musculus
ggttcccgcctagacatggctctga

SEQ ID NO: 454896 - DNA, 25 bp, Mus musculus
ggttcccgtgggatcactttccaag

SEQ ID NO: 454897 - DNA, 25 bp, Mus musculus
ggttccctaatctgggatctgcaag

SEQ ID NO: 454898 - DNA, 25 bp, Mus musculus
ggttccctctcttgaggcagaagag

SEQ ID NO: 454899 - DNA, 25 bp, Mus musculus
ggttccctcttctgggatgctctac

SEQ ID NO: 454900 - DNA, 25 bp, Mus musculus
ggttccctgagataactgaagatgt

SEQ ID NO: 454901 - DNA, 25 bp, Mus musculus
ggttccctggctatatctgacactg

SEQ ID NO: 454902 - DNA, 25 bp, Mus musculus
ggttccgagtgagcctgaggaacct

SEQ ID NO: 454903 - DNA, 25 bp, Mus musculus
ggttccgccaactttcacgctgctt

SEQ ID NO: 454904 - DNA, 25 bp, Mus musculus
ggttccgcgggtatgatcgactcag

SEQ ID NO: 454905 - DNA, 25 bp, Mus musculus
ggttccggaagtacctctggcagtt

SEQ ID NO: 454906 - DNA, 25 bp, Mus musculus
ggttcctaaactcagtcagagctgt

SEQ ID NO: 454907 - DNA, 25 bp, Mus musculus
ggttcctaagggactctagattcca

SEQ ID NO: 454908 - DNA, 25 bp, Mus musculus
ggttcctcgggctggcaaagtccaa

SEQ ID NO: 454909 - DNA, 25 bp, Mus musculus
ggttcctgaccaaaaagagttctga

SEQ ID NO: 454910 - DNA, 25 bp, Mus musculus
ggttcctgatttcctgggtgccctc

SEQ ID NO: 454911 - DNA, 25 bp, Mus musculus
ggttcctgccaccatacaggcgatg

SEQ ID NO: 454912 - DNA, 25 bp, Mus musculus
ggttcctgcctcctttaactgaaag

SEQ ID NO: 454913 - DNA, 25 bp, Mus musculus
ggttcctggaccaatccccttggat

SEQ ID NO: 454914 - DNA, 25 bp, Mus musculus
ggttcctggccttgatcctgctgag

SEQ ID NO: 454915 - DNA, 25 bp, Mus musculus
ggttcctggttaagacacgctgctc

SEQ ID NO: 454916 - DNA, 25 bp, Mus musculus
ggttcctgtgtttggaaatccgaag

SEQ ID NO: 454917 - DNA, 25 bp, Mus musculus
ggttccttgggaccatcgtctcatc

SEQ ID NO: 454918 - DNA, 25 bp, Mus musculus
ggttcctttggattgctccacagca

SEQ ID NO: 454919 - DNA, 25 bp, Mus musculus
ggttcgaaaactcagcaatggcagg

SEQ ID NO: 454920 - DNA, 25 bp, Mus musculus
ggttcgaaaagatcacgcccctcgt

SEQ ID NO: 454921 - DNA, 25 bp, Mus musculus
ggttcgaccccacgtatggatccag

SEQ ID NO: 454922 - DNA, 25 bp, Mus musculus
ggttcgacttgctagggatttccca

SEQ ID NO: 454923 - DNA, 25 bp, Mus musculus
ggttcgagtgtcatacttggagata

SEQ ID NO: 454924 - DNA, 25 bp, Mus musculus
ggttcgcagccatctaccagaagaa

SEQ ID NO: 454925 - DNA, 25 bp, Mus musculus
ggttcgccctcatcacacagcggat

SEQ ID NO: 454926 - DNA, 25 bp, Mus musculus
ggttcgtagctttaacaattcatga

SEQ ID NO: 454927 - DNA, 25 bp, Mus musculus
ggttcgtccagggtgcaacgctgcc

SEQ ID NO: 454928 - DNA, 25 bp, Mus musculus
ggttcgtcttctaggctgtcctctg

SEQ ID NO: 454929 - DNA, 25 bp, Mus musculus
ggttcgtgaacctgctggacttaga

SEQ ID NO: 454930 - DNA, 25 bp, Mus musculus
ggttcgtgatcattaccgggccaca

SEQ ID NO: 454931 - DNA, 25 bp, Mus musculus
ggttctacagtgactggagttccaa

SEQ ID NO: 454932 - DNA, 25 bp, Mus musculus
ggttctagacaacgccctacctact

SEQ ID NO: 454933 - DNA, 25 bp, Mus musculus
ggttctagacacttccacactgatt

SEQ ID NO: 454934 - DNA, 25 bp, Mus musculus
ggttctaggaatgaatgtttgtggc

SEQ ID NO: 454935 - DNA, 25 bp, Mus musculus
ggttctatgaacatctgcactcagg

SEQ ID NO: 454936 - DNA, 25 bp, Mus musculus
ggttctcaaaaatctgctccttggt

SEQ ID NO: 454937 - DNA, 25 bp, Mus musculus
ggttctcaaccgacagggatcttaa

SEQ ID NO: 454938 - DNA, 25 bp, Mus musculus
ggttctcacagaattaggtcctcag

SEQ ID NO: 454939 - DNA, 25 bp, Mus musculus
ggttctcatattgccgttcccatgt

SEQ ID NO: 454940 - DNA, 25 bp, Mus musculus
ggttctccaaggaacgtgagcccca

SEQ ID NO: 454941 - DNA, 25 bp, Mus musculus
ggttctccatggtccttgaccttgt

SEQ ID NO: 454942 - DNA, 25 bp, Mus musculus
ggttctcgctcagagagtgcccatc

SEQ ID NO: 454943 - DNA, 25 bp, Mus musculus
ggttctcgctcgctcagttccgttt

SEQ ID NO: 454944 - DNA, 25 bp, Mus musculus
ggttctcgcttagtttcttctccga

SEQ ID NO: 454945 - DNA, 25 bp, Mus musculus
ggttctcgggatatctagcacccag

SEQ ID NO: 454946 - DNA, 25 bp, Mus musculus
ggttctctctgtcccgtcagtactc

SEQ ID NO: 454947 - DNA, 25 bp, Mus musculus
ggttctctttctggtccctgcaagg

SEQ ID NO: 454948 - DNA, 25 bp, Mus musculus
ggttctgaacataactcctctctct

SEQ ID NO: 454949 - DNA, 25 bp, Mus musculus
ggttctgagcacataagccctggtt

SEQ ID NO: 454950 - DNA, 25 bp, Mus musculus
ggttctgatacaagcttaagccggg

SEQ ID NO: 454951 - DNA, 25 bp, Mus musculus
ggttctgcgcgttctcccgttgggt

SEQ ID NO: 454952 - DNA, 25 bp, Mus musculus
ggttctgctcaaacagtcaacattg

SEQ ID NO: 454953 - DNA, 25 bp, Mus musculus
ggttctggacaagcccggcaaggtc

SEQ ID NO: 454954 - DNA, 25 bp, Mus musculus
ggttctggacatgacgggtctcctg

SEQ ID NO: 454955 - DNA, 25 bp, Mus musculus
ggttctggactacacaacgcgcagg

SEQ ID NO: 454956 - DNA, 25 bp, Mus musculus
ggttctggagtcagcagggtttctc

SEQ ID NO: 454957 - DNA, 25 bp, Mus musculus
ggttctggccaaaacgctgcccgtc

SEQ ID NO: 454958 - DNA, 25 bp, Mus musculus
ggttctgggaaactaactcaagtct

SEQ ID NO: 454959 - DNA, 25 bp, Mus musculus
ggttctgggccagcatgtcttcctc

SEQ ID NO: 454960 - DNA, 25 bp, Mus musculus
ggttctggtgtcatatgcccctgca

SEQ ID NO: 454961 - DNA, 25 bp, Mus musculus
ggttctgttcactgtggtctgccca

SEQ ID NO: 454962 - DNA, 25 bp, Mus musculus
ggttctgtttatgaggccctggaca

SEQ ID NO: 454963 - DNA, 25 bp, Mus musculus
ggttcttaacacaggagacccgaca

SEQ ID NO: 454964 - DNA, 25 bp, Mus musculus
ggttcttagccctgacagctctgag

SEQ ID NO: 454965 - DNA, 25 bp, Mus musculus
ggttcttcaacagcctaaccatgag

SEQ ID NO: 454966 - DNA, 25 bp, Mus musculus
ggttcttcctatggtcaaacgtcag

SEQ ID NO: 454967 - DNA, 25 bp, Mus musculus
ggttcttcgctttgtgaaaggccaa

SEQ ID NO: 454968 - DNA, 25 bp, Mus musculus
ggttcttctcactttcactcttaca

SEQ ID NO: 454969 - DNA, 25 bp, Mus musculus
ggttctttaacagatgagtccaaaa

SEQ ID NO: 454970 - DNA, 25 bp, Mus musculus
ggttctttatccactggaactgcag

SEQ ID NO: 454971 - DNA, 25 bp, Mus musculus
ggttctttcatcaagctgaggcagg

SEQ ID NO: 454972 - DNA, 25 bp, Mus musculus
ggttgaaaaccttctagctcagaga

SEQ ID NO: 454973 - DNA, 25 bp, Mus musculus
ggttgaaactactttaaagctggag

SEQ ID NO: 454974 - DNA, 25 bp, Mus musculus
ggttgaacccaaggtctcccatgtg

SEQ ID NO: 454975 - DNA, 25 bp, Mus musculus
ggttgaagccattcaggaccgccta

SEQ ID NO: 454976 - DNA, 25 bp, Mus musculus
ggttgaagctctttggagtactcca

SEQ ID NO: 454977 - DNA, 25 bp, Mus musculus
ggttgaaggcctagaaccaaggaca

SEQ ID NO: 454978 - DNA, 25 bp, Mus musculus
ggttgaatccttttcagacttgagc

SEQ ID NO: 454979 - DNA, 25 bp, Mus musculus
ggttgaattatctggactgcagcct

SEQ ID NO: 454980 - DNA, 25 bp, Mus musculus
ggttgaccggacctccacaatctag

SEQ ID NO: 454981 - DNA, 25 bp, Mus musculus
ggttgaccgtcaggcatccacagtt

SEQ ID NO: 454982 - DNA, 25 bp, Mus musculus
ggttgacctaccttgggcaatgagg

SEQ ID NO: 454983 - DNA, 25 bp, Mus musculus
ggttgacttcttctgcgagacctgc

SEQ ID NO: 454984 - DNA, 25 bp, Mus musculus
ggttgagacaagtccagactgccct

SEQ ID NO: 454985 - DNA, 25 bp, Mus musculus
ggttgaggctcgttgctagagcact

SEQ ID NO: 454986 - DNA, 25 bp, Mus musculus
ggttgatgatgccaccagcctggtc

SEQ ID NO: 454987 - DNA, 25 bp, Mus musculus
ggttgatgcacccagcctgaaagga

SEQ ID NO: 454988 - DNA, 25 bp, Mus musculus
ggttgattcctgtcctctcttaaga

SEQ ID NO: 454989 - DNA, 25 bp, Mus musculus
ggttgcacagataaaggccaccatc

SEQ ID NO: 454990 - DNA, 25 bp, Mus musculus
ggttgcacattactggctccctatc

SEQ ID NO: 454991 - DNA, 25 bp, Mus musculus
ggttgcagcttctctgactgcagtc

SEQ ID NO: 454992 - DNA, 25 bp, Mus musculus
ggttgcaggaacctgaagcctccat

SEQ ID NO: 454993 - DNA, 25 bp, Mus musculus
ggttgcagggtgcacccctacttag

SEQ ID NO: 454994 - DNA, 25 bp, Mus musculus
ggttgcaggtatagcatctcccaca

SEQ ID NO: 454995 - DNA, 25 bp, Mus musculus
ggttgcagtgctaaaatgcccaggc

SEQ ID NO: 454996 - DNA, 25 bp, Mus musculus
ggttgcatgtacatccacggaggag

SEQ ID NO: 454997 - DNA, 25 bp, Mus musculus
ggttgccaccatcttcctggacatt

SEQ ID NO: 454998 - DNA, 25 bp, Mus musculus
ggttgcccaagttctctgtccctag

SEQ ID NO: 454999 - DNA, 25 bp, Mus musculus
ggttgccctcacagggacatctcta

SEQ ID NO: 455000 - DNA, 25 bp, Mus musculus
ggttgccgaatgcttggtagctcca

SEQ ID NO: 455001 - DNA, 25 bp, Mus musculus
ggttgccgtggctgcttgaatgaat

SEQ ID NO: 455002 - DNA, 25 bp, Mus musculus
ggttgcctccttggctcccaaagag

SEQ ID NO: 455003 - DNA, 25 bp, Mus musculus
ggttgccttgaccaacaagttctgg

SEQ ID NO: 455004 - DNA, 25 bp, Mus musculus
ggttgcgctgcgagaacttcccagt

SEQ ID NO: 455005 - DNA, 25 bp, Mus musculus
ggttgcggactgactggtacccagc

SEQ ID NO: 455006 - DNA, 25 bp, Mus musculus
ggttgctaccgaagagttttggatc

SEQ ID NO: 455007 - DNA, 25 bp, Mus musculus
ggttgctcattaacacaccctgcag

SEQ ID NO: 455008 - DNA, 25 bp, Mus musculus
ggttgctcccgatggctccaggtta

SEQ ID NO: 455009 - DNA, 25 bp, Mus musculus
ggttgctcttcataccccaggaagg

SEQ ID NO: 455010 - DNA, 25 bp, Mus musculus
ggttgctgatctcccactactggaa

SEQ ID NO: 455011 - DNA, 25 bp, Mus musculus
ggttgctgctgctggcccgtgacca

SEQ ID NO: 455012 - DNA, 25 bp, Mus musculus
ggttgctggcactcagaacccggac

SEQ ID NO: 455013 - DNA, 25 bp, Mus musculus
ggttggaagccaagaatgctgctgc

SEQ ID NO: 455014 - DNA, 25 bp, Mus musculus
ggttggatctgtatttgaatatcag

SEQ ID NO: 455015 - DNA, 25 bp, Mus musculus
ggttggcataccttcagataacaag

SEQ ID NO: 455016 - DNA, 25 bp, Mus musculus
ggttggcccaacctgaaatgaagga

SEQ ID NO: 455017 - DNA, 25 bp, Mus musculus
ggttggccctcacttgctagatgca

SEQ ID NO: 455018 - DNA, 25 bp, Mus musculus
ggttggctcaattttgaagacacga

SEQ ID NO: 455019 - DNA, 25 bp, Mus musculus
ggttggctcattttcattgagaaga

SEQ ID NO: 455020 - DNA, 25 bp, Mus musculus
ggttgggccacgagttcctgaatga

SEQ ID NO: 455021 - DNA, 25 bp, Mus musculus
ggttgggccgtctttctgagcctca

SEQ ID NO: 455022 - DNA, 25 bp, Mus musculus
ggttggtaaccctaacatctgatga

SEQ ID NO: 455023 - DNA, 25 bp, Mus musculus
ggttggtagtccaccccagagatca

SEQ ID NO: 455024 - DNA, 25 bp, Mus musculus
ggttggtccccagctgaaaatgaag

SEQ ID NO: 455025 - DNA, 25 bp, Mus musculus
ggttggtcctgctgccgaaagcgaa

SEQ ID NO: 455026 - DNA, 25 bp, Mus musculus
ggttggtgtcgcagaacatggccct

SEQ ID NO: 455027 - DNA, 25 bp, Mus musculus
ggttgtaaaactgagtgatcctagg

SEQ ID NO: 455028 - DNA, 25 bp, Mus musculus
ggttgtaatgcccacgcctctctcg

SEQ ID NO: 455029 - DNA, 25 bp, Mus musculus
ggttgtaccctaatgaaatcgtgtc

SEQ ID NO: 455030 - DNA, 25 bp, Mus musculus
ggttgtagcccctggactcacatgg

SEQ ID NO: 455031 - DNA, 25 bp, Mus musculus
ggttgtatctactggctgccgcctg

SEQ ID NO: 455032 - DNA, 25 bp, Mus musculus
ggttgtatcttcatctgccccgttg

SEQ ID NO: 455033 - DNA, 25 bp, Mus musculus
ggttgtattcttccctaacagagga

SEQ ID NO: 455034 - DNA, 25 bp, Mus musculus
ggttgtcaaggctgctcatcctcag

SEQ ID NO: 455035 - DNA, 25 bp, Mus musculus
ggttgtcagacagatggtacccatc

SEQ ID NO: 455036 - DNA, 25 bp, Mus musculus
ggttgtcagatcacccaaagctgga

SEQ ID NO: 455037 - DNA, 25 bp, Mus musculus
ggttgtccttcccttcaatcgcagg

SEQ ID NO: 455038 - DNA, 25 bp, Mus musculus
ggttgtcggattgaccataatacta

SEQ ID NO: 455039 - DNA, 25 bp, Mus musculus
ggttgtcgtctgtcagcttggattc

SEQ ID NO: 455040 - DNA, 25 bp, Mus musculus
ggttgtctgaaggaggacctctccg

SEQ ID NO: 455041 - DNA, 25 bp, Mus musculus
ggttgtctgcaccactctgcatgtt

SEQ ID NO: 455042 - DNA, 25 bp, Mus musculus
ggttgtcttgccagcccatgctcag

SEQ ID NO: 455043 - DNA, 25 bp, Mus musculus
ggttgtgactcacctagggctacac

SEQ ID NO: 455044 - DNA, 25 bp, Mus musculus
ggttgtgcttccattcctcggcgga

SEQ ID NO: 455045 - DNA, 25 bp, Mus musculus
ggttgttagaagactcttccctgtt

SEQ ID NO: 455046 - DNA, 25 bp, Mus musculus
ggttgttcacaaggacccgcctgat

SEQ ID NO: 455047 - DNA, 25 bp, Mus musculus
ggttgtttcatcaggttttccggag

SEQ ID NO: 455048 - DNA, 25 bp, Mus musculus
ggttgtttctgaggtgggttcctca

SEQ ID NO: 455049 - DNA, 25 bp, Mus musculus
ggttgtttgggttgatccctgttgc

SEQ ID NO: 455050 - DNA, 25 bp, Mus musculus
ggtttacacgaagactggatcctga

SEQ ID NO: 455051 - DNA, 25 bp, Mus musculus
ggtttacactgttgccacccccatt

SEQ ID NO: 455052 - DNA, 25 bp, Mus musculus
ggtttaccaaacacacaggcagact

SEQ ID NO: 455053 - DNA, 25 bp, Mus musculus
ggtttaccagagaagctaatgcaga

SEQ ID NO: 455054 - DNA, 25 bp, Mus musculus
ggtttacgaccacagcaccttcagg

SEQ ID NO: 455055 - DNA, 25 bp, Mus musculus
ggtttacgcctatgacgctgacagt

SEQ ID NO: 455056 - DNA, 25 bp, Mus musculus
ggtttacgtcccaacagccacattg

SEQ ID NO: 455057 - DNA, 25 bp, Mus musculus
ggtttactggagcactgtaccccaa

SEQ ID NO: 455058 - DNA, 25 bp, Mus musculus
ggtttagaacttctcccctgaggag

SEQ ID NO: 455059 - DNA, 25 bp, Mus musculus
ggtttagaccagcaactgccggatg

SEQ ID NO: 455060 - DNA, 25 bp, Mus musculus
ggtttagccccggaattgactggat

SEQ ID NO: 455061 - DNA, 25 bp, Mus musculus
ggtttagctaacaactgccagggaa

SEQ ID NO: 455062 - DNA, 25 bp, Mus musculus
ggtttaggcactgacatcggcggca

SEQ ID NO: 455063 - DNA, 25 bp, Mus musculus
ggtttaggctgagaaactgtctgcc

SEQ ID NO: 455064 - DNA, 25 bp, Mus musculus
ggtttagggcccaaggagacaatga

SEQ ID NO: 455065 - DNA, 25 bp, Mus musculus
ggtttagtgactttgcagacatgca

SEQ ID NO: 455066 - DNA, 25 bp, Mus musculus
ggtttataacccaagagatcttcct

SEQ ID NO: 455067 - DNA, 25 bp, Mus musculus
ggtttatcagtatcaggtacctcaa

SEQ ID NO: 455068 - DNA, 25 bp, Mus musculus
ggtttattccactacaaagagcaat

SEQ ID NO: 455069 - DNA, 25 bp, Mus musculus
ggtttattccctggagacgccagtg

SEQ ID NO: 455070 - DNA, 25 bp, Mus musculus
ggtttattggcacgccttggactca

SEQ ID NO: 455071 - DNA, 25 bp, Mus musculus
ggtttatttgcaagacgacgacagt

SEQ ID NO: 455072 - DNA, 25 bp, Mus musculus
ggtttcaaagtgtcagaggccagca

SEQ ID NO: 455073 - DNA, 25 bp, Mus musculus
ggtttcacagcaggtagggctcctt

SEQ ID NO: 455074 - DNA, 25 bp, Mus musculus
ggtttcacatagagagcgcacagga

SEQ ID NO: 455075 - DNA, 25 bp, Mus musculus
ggtttcacatccctagtggcaaggg

SEQ ID NO: 455076 - DNA, 25 bp, Mus musculus
ggtttcactagggtattctcaagag

SEQ ID NO: 455077 - DNA, 25 bp, Mus musculus
ggtttcactgtataatctgttctag

SEQ ID NO: 455078 - DNA, 25 bp, Mus musculus
ggtttcagccactctgccagaagct

SEQ ID NO: 455079 - DNA, 25 bp, Mus musculus
ggtttcataatcctggaccgatcca

SEQ ID NO: 455080 - DNA, 25 bp, Mus musculus
ggtttcattcacttccatccctaga

SEQ ID NO: 455081 - DNA, 25 bp, Mus musculus
ggtttccaaacctgatatgatttcc

SEQ ID NO: 455082 - DNA, 25 bp, Mus musculus
ggtttccaagcggtctctcccgaga

SEQ ID NO: 455083 - DNA, 25 bp, Mus musculus
ggtttccatagcagctccaccatct

SEQ ID NO: 455084 - DNA, 25 bp, Mus musculus
ggtttccatgctgaatacggctccg

SEQ ID NO: 455085 - DNA, 25 bp, Mus musculus
ggtttccatgcttcccccaagttct

SEQ ID NO: 455086 - DNA, 25 bp, Mus musculus
ggtttccattgcaccccactaacag

SEQ ID NO: 455087 - DNA, 25 bp, Mus musculus
ggtttccctgccgaagcttgccaat

SEQ ID NO: 455088 - DNA, 25 bp, Mus musculus
ggtttccgtgtccagtcccgaagtg

SEQ ID NO: 455089 - DNA, 25 bp, Mus musculus
ggtttccgtgtggtcagcccttcca

SEQ ID NO: 455090 - DNA, 25 bp, Mus musculus
ggtttcctgatctgcagcaggtgca

SEQ ID NO: 455091 - DNA, 25 bp, Mus musculus
ggtttcctgtatgtgcccaccgcga

SEQ ID NO: 455092 - DNA, 25 bp, Mus musculus
ggtttccttcgcaaagtcagccaag

SEQ ID NO: 455093 - DNA, 25 bp, Mus musculus
ggtttccttgcttccaacggcagca

SEQ ID NO: 455094 - DNA, 25 bp, Mus musculus
ggtttcgatcaaagcctgccagcag

SEQ ID NO: 455095 - DNA, 25 bp, Mus musculus
ggtttcgccctcacacatcggtggg

SEQ ID NO: 455096 - DNA, 25 bp, Mus musculus
ggtttcgctggagccatcatcctca

SEQ ID NO: 455097 - DNA, 25 bp, Mus musculus
ggtttcggtagcgactgattctcag

SEQ ID NO: 455098 - DNA, 25 bp, Mus musculus
ggtttcggtcccaactgctgtcagt

SEQ ID NO: 455099 - DNA, 25 bp, Mus musculus
ggtttctaaccaaagggcagcagtg

SEQ ID NO: 455100 - DNA, 25 bp, Mus musculus
ggtttctaactcagagacatctgcc

SEQ ID NO: 455101 - DNA, 25 bp, Mus musculus
ggtttctcaagctcccttccagggt

SEQ ID NO: 455102 - DNA, 25 bp, Mus musculus
ggtttctcagcacacagatgccact

SEQ ID NO: 455103 - DNA, 25 bp, Mus musculus
ggtttctcagtgtcctaaaaatggc

SEQ ID NO: 455104 - DNA, 25 bp, Mus musculus
ggtttctcggtcaaggctagtggca

SEQ ID NO: 455105 - DNA, 25 bp, Mus musculus
ggtttctcttttacttctcatctgt

SEQ ID NO: 455106 - DNA, 25 bp, Mus musculus
ggtttctgccaacctggactatcag

SEQ ID NO: 455107 - DNA, 25 bp, Mus musculus
ggtttctgctgaaatgcccgccgct

SEQ ID NO: 455108 - DNA, 25 bp, Mus musculus
ggtttctgtcacttggtaaagagct

SEQ ID NO: 455109 - DNA, 25 bp, Mus musculus
ggtttcttaccagcaattagcagcc

SEQ ID NO: 455110 - DNA, 25 bp, Mus musculus
ggtttcttcagatctgtgatgattg

SEQ ID NO: 455111 - DNA, 25 bp, Mus musculus
ggtttcttcccctgcagccatctat

SEQ ID NO: 455112 - DNA, 25 bp, Mus musculus
ggtttctttctctaccctgagatgg

SEQ ID NO: 455113 - DNA, 25 bp, Mus musculus
ggtttgaaagctcggctccaaccca

SEQ ID NO: 455114 - DNA, 25 bp, Mus musculus
ggtttgaacctctttatgtagtaca

SEQ ID NO: 455115 - DNA, 25 bp, Mus musculus
ggtttgaagattgtggcagtcactc

SEQ ID NO: 455116 - DNA, 25 bp, Mus musculus
ggtttgacatcaagggcaccactga

SEQ ID NO: 455117 - DNA, 25 bp, Mus musculus
ggtttgaccgtgaccgactcttcag

SEQ ID NO: 455118 - DNA, 25 bp, Mus musculus
ggtttgacctgtctaaaagagagag

SEQ ID NO: 455119 - DNA, 25 bp, Mus musculus
ggtttgaggaagtctgaagagcata

SEQ ID NO: 455120 - DNA, 25 bp, Mus musculus
ggtttgatgcccacccatggcatgg

SEQ ID NO: 455121 - DNA, 25 bp, Mus musculus
ggtttgcagtcttatgtgaggtgcc

SEQ ID NO: 455122 - DNA, 25 bp, Mus musculus
ggtttgccaaacagcttcgagcgga

SEQ ID NO: 455123 - DNA, 25 bp, Mus musculus
ggtttgccatggtttaaatacagtt

SEQ ID NO: 455124 - DNA, 25 bp, Mus musculus
ggtttgccgacgaaaagaggagcat

SEQ ID NO: 455125 - DNA, 25 bp, Mus musculus
ggtttgccttttggcatgccgcctc

SEQ ID NO: 455126 - DNA, 25 bp, Mus musculus
ggtttgctagtccatgccacagtgc

SEQ ID NO: 455127 - DNA, 25 bp, Mus musculus
ggtttgctgcacaagcggctccatg

SEQ ID NO: 455128 - DNA, 25 bp, Mus musculus
ggtttggccaactgacctggacgtg

SEQ ID NO: 455129 - DNA, 25 bp, Mus musculus
ggtttggctggcgttccgaactcca

SEQ ID NO: 455130 - DNA, 25 bp, Mus musculus
ggtttggcttcattgtctttcaaaa

SEQ ID NO: 455131 - DNA, 25 bp, Mus musculus
ggtttgggccctggactagcttgca

SEQ ID NO: 455132 - DNA, 25 bp, Mus musculus
ggtttggtcaggagataagcgcccc

SEQ ID NO: 455133 - DNA, 25 bp, Mus musculus
ggtttggtcccttgatgtatcaaag

SEQ ID NO: 455134 - DNA, 25 bp, Mus musculus
ggtttggtttccttggcaattatgg

SEQ ID NO: 455135 - DNA, 25 bp, Mus musculus
ggtttgtacagtggcaagtcctccc

SEQ ID NO: 455136 - DNA, 25 bp, Mus musculus
ggtttgtagccaagcagcacattag

SEQ ID NO: 455137 - DNA, 25 bp, Mus musculus
ggtttgtcacacctggaagccctgg

SEQ ID NO: 455138 - DNA, 25 bp, Mus musculus
ggtttgtcccttctctcaacacagg

SEQ ID NO: 455139 - DNA, 25 bp, Mus musculus
ggtttgtgccaacacctagcttgtt

SEQ ID NO: 455140 - DNA, 25 bp, Mus musculus
ggttttaacagtatcccggatgcct

SEQ ID NO: 455141 - DNA, 25 bp, Mus musculus
ggttttaacctggagctcaagccca

SEQ ID NO: 455142 - DNA, 25 bp, Mus musculus
ggttttacgaattctccatccgtct

SEQ ID NO: 455143 - DNA, 25 bp, Mus musculus
ggttttactatgacagatattcact

SEQ ID NO: 455144 - DNA, 25 bp, Mus musculus
ggttttatcaatagccagccgtcgc

SEQ ID NO: 455145 - DNA, 25 bp, Mus musculus
ggttttcatcggtacacgcagcggt

SEQ ID NO: 455146 - DNA, 25 bp, Mus musculus
ggttttccaagaatccctcggcatg

SEQ ID NO: 455147 - DNA, 25 bp, Mus musculus
ggttttccagaaatggatttgaggc

SEQ ID NO: 455148 - DNA, 25 bp, Mus musculus
ggttttccagagatcccacacccag

SEQ ID NO: 455149 - DNA, 25 bp, Mus musculus
ggttttccagagcaacgccaactat

SEQ ID NO: 455150 - DNA, 25 bp, Mus musculus
ggttttccctggcatcagagttcag

SEQ ID NO: 455151 - DNA, 25 bp, Mus musculus
ggttttccgaggtttcaagccactg

SEQ ID NO: 455152 - DNA, 25 bp, Mus musculus
ggttttcctcagtctccacgtacgt

SEQ ID NO: 455153 - DNA, 25 bp, Mus musculus
ggttttccttgtggcatttgggaag

SEQ ID NO: 455154 - DNA, 25 bp, Mus musculus
ggttttcgtgccgagacggctccag

SEQ ID NO: 455155 - DNA, 25 bp, Mus musculus
ggttttctacgttatcccactggcg

SEQ ID NO: 455156 - DNA, 25 bp, Mus musculus
ggttttctagtgcagcatcccggaa

SEQ ID NO: 455157 - DNA, 25 bp, Mus musculus
ggttttctgtcactgtcatccgtat

SEQ ID NO: 455158 - DNA, 25 bp, Mus musculus
ggttttgaaaactcaccgggcagca

SEQ ID NO: 455159 - DNA, 25 bp, Mus musculus
ggttttgacaacacactctaggcct

SEQ ID NO: 455160 - DNA, 25 bp, Mus musculus
ggttttgccctagagcatcggattg

SEQ ID NO: 455161 - DNA, 25 bp, Mus musculus
ggttttgctctctatttgttccctt

SEQ ID NO: 455162 - DNA, 25 bp, Mus musculus
ggttttgctgtggatgtagcctgac

SEQ ID NO: 455163 - DNA, 25 bp, Mus musculus
ggttttggagcctctctcgattctg

SEQ ID NO: 455164 - DNA, 25 bp, Mus musculus
ggttttgggactgcatgctctggta

SEQ ID NO: 455165 - DNA, 25 bp, Mus musculus
ggttttgtggcacactaaggtcaca

SEQ ID NO: 455166 - DNA, 25 bp, Mus musculus
ggtttttatgtgcagaacattgtta

SEQ ID NO: 455167 - DNA, 25 bp, Mus musculus
ggtttttattatcagccagcgcgct

SEQ ID NO: 455168 - DNA, 25 bp, Mus musculus
ggtttttcctagtgcctgatgccac

SEQ ID NO: 455169 - DNA, 25 bp, Mus musculus
ggtttttctctcactgacacagggc

SEQ ID NO: 455170 - DNA, 25 bp, Mus musculus
ggtttttgactcattacatgtatag

SEQ ID NO: 455171 - DNA, 25 bp, Mus musculus
ggtttttgctcagactcctccttga

SEQ ID NO: 455172 - DNA, 25 bp, Mus musculus
ggtttttgctccatcccaaggctag

SEQ ID NO: 455173 - DNA, 25 bp, Mus musculus
ggttttttatcacagccagctaagc

SEQ ID NO: 455174 - DNA, 25 bp, Mus musculus
gtaaaaaggcatgactatagtattg

SEQ ID NO: 455175 - DNA, 25 bp, Mus musculus
gtaaaagacagtgacatgaccaatc

SEQ ID NO: 455176 - DNA, 25 bp, Mus musculus
gtaaaatagagcagagggagccgcc

SEQ ID NO: 455177 - DNA, 25 bp, Mus musculus
gtaaacaggtctggcaggctcaggc

SEQ ID NO: 455178 - DNA, 25 bp, Mus musculus
gtaaacattactggtcacccagcct

SEQ ID NO: 455179 - DNA, 25 bp, Mus musculus
gtaaaccatggactttctcgaagag

SEQ ID NO: 455180 - DNA, 25 bp, Mus musculus
gtaaaccctactgtttctctggagg

SEQ ID NO: 455181 - DNA, 25 bp, Mus musculus
gtaaaccggaactctgggagctgcc

SEQ ID NO: 455182 - DNA, 25 bp, Mus musculus
gtaaactacattgaaactgccccga

SEQ ID NO: 455183 - DNA, 25 bp, Mus musculus
gtaaacttgggcttccaggcgctgc

SEQ ID NO: 455184 - DNA, 25 bp, Mus musculus
gtaaagaagacacccagactctgct

SEQ ID NO: 455185 - DNA, 25 bp, Mus musculus
gtaaagaagatcatagtccctggcc

SEQ ID NO: 455186 - DNA, 25 bp, Mus musculus
gtaaagatcccgagacatttccctg

SEQ ID NO: 455187 - DNA, 25 bp, Mus musculus
gtaaagcatgatgtggcctaccgcc

SEQ ID NO: 455188 - DNA, 25 bp, Mus musculus
gtaaagcttctccatcaataccaga

SEQ ID NO: 455189 - DNA, 25 bp, Mus musculus
gtaaaggaactacagcggcaagcca

SEQ ID NO: 455190 - DNA, 25 bp, Mus musculus
gtaaaggcggcagcccttgtgaacc

SEQ ID NO: 455191 - DNA, 25 bp, Mus musculus
gtaaagtaagagctctgcagggtct

SEQ ID NO: 455192 - DNA, 25 bp, Mus musculus
gtaaagtgcagaagtcggaacccag

SEQ ID NO: 455193 - DNA, 25 bp, Mus musculus
gtaaatacagcctgtctcctcctat

SEQ ID NO: 455194 - DNA, 25 bp, Mus musculus
gtaaatctagatctgtattccccag

SEQ ID NO: 455195 - DNA, 25 bp, Mus musculus
gtaaatgccgccgagagacagaggt

SEQ ID NO: 455196 - DNA, 25 bp, Mus musculus
gtaaatgctgtaacaattcccagtg

SEQ ID NO: 455197 - DNA, 25 bp, Mus musculus
gtaaatgtgaaagtgcaccttctct

SEQ ID NO: 455198 - DNA, 25 bp, Mus musculus
gtaaatgtgttcgtcccaccacggg

SEQ ID NO: 455199 - DNA, 25 bp, Mus musculus
gtaaattcccttccctcaagtgcct

SEQ ID NO: 455200 - DNA, 25 bp, Mus musculus
gtaaattgttataatacagtcacct

SEQ ID NO: 455201 - DNA, 25 bp, Mus musculus
gtaacaaagggctcacaggtcatcc

SEQ ID NO: 455202 - DNA, 25 bp, Mus musculus
gtaacaaaggtctcggactccctgg

SEQ ID NO: 455203 - DNA, 25 bp, Mus musculus
gtaacacatgacacaatgtccgttt

SEQ ID NO: 455204 - DNA, 25 bp, Mus musculus
gtaacactagtgctaccactgcctc

SEQ ID NO: 455205 - DNA, 25 bp, Mus musculus
gtaacactggatgggctcctctcat

SEQ ID NO: 455206 - DNA, 25 bp, Mus musculus
gtaacagattcagggccaggcccct

SEQ ID NO: 455207 - DNA, 25 bp, Mus musculus
gtaacagcagagttggtgccttggt

SEQ ID NO: 455208 - DNA, 25 bp, Mus musculus
gtaacagccctgtctggtcccgaaa

SEQ ID NO: 455209 - DNA, 25 bp, Mus musculus
gtaacagctattgtatcatcaaggg

SEQ ID NO: 455210 - DNA, 25 bp, Mus musculus
gtaacatggattttatactacagaa

SEQ ID NO: 455211 - DNA, 25 bp, Mus musculus
gtaaccaaaagtagcacgggccgag

SEQ ID NO: 455212 - DNA, 25 bp, Mus musculus
gtaaccatctgtctctaggaagcca

SEQ ID NO: 455213 - DNA, 25 bp, Mus musculus
gtaaccatctttaacataatggcag

SEQ ID NO: 455214 - DNA, 25 bp, Mus musculus
gtaaccccggctggctagaatcatg

SEQ ID NO: 455215 - DNA, 25 bp, Mus musculus
gtaacccgggaacagcaaagacact

SEQ ID NO: 455216 - DNA, 25 bp, Mus musculus
gtaaccctgggagctcagacacgat

SEQ ID NO: 455217 - DNA, 25 bp, Mus musculus
gtaacccttaaagtcactgagaagg

SEQ ID NO: 455218 - DNA, 25 bp, Mus musculus
gtaacctgtcaaggatgacgtcaca

SEQ ID NO: 455219 - DNA, 25 bp, Mus musculus
gtaacgtacttcactattaaatgga

SEQ ID NO: 455220 - DNA, 25 bp, Mus musculus
gtaactaaatgacttatgcaggaac

SEQ ID NO: 455221 - DNA, 25 bp, Mus musculus
gtaactacccttgaggactcctggg

SEQ ID NO: 455222 - DNA, 25 bp, Mus musculus
gtaactccaaattccacaggacctg

SEQ ID NO: 455223 - DNA, 25 bp, Mus musculus
gtaactccacttactccagaggccg

SEQ ID NO: 455224 - DNA, 25 bp, Mus musculus
gtaactgagactggatgagcactcc

SEQ ID NO: 455225 - DNA, 25 bp, Mus musculus
gtaactgcacggtttcagccagcca

SEQ ID NO: 455226 - DNA, 25 bp, Mus musculus
gtaactgcccttggcagaagctcca

SEQ ID NO: 455227 - DNA, 25 bp, Mus musculus
gtaactggaaatacaaggttcatta

SEQ ID NO: 455228 - DNA, 25 bp, Mus musculus
gtaactgtgtctcttctgtctgtcc

SEQ ID NO: 455229 - DNA, 25 bp, Mus musculus
gtaacttcagatgcataccagagga

SEQ ID NO: 455230 - DNA, 25 bp, Mus musculus
gtaacttctgaattatgggaacccg

SEQ ID NO: 455231 - DNA, 25 bp, Mus musculus
gtaacttctgctctacagtcgaggg

SEQ ID NO: 455232 - DNA, 25 bp, Mus musculus
gtaagaagctcaaccgggaagccca

SEQ ID NO: 455233 - DNA, 25 bp, Mus musculus
gtaagatctgacactttccaagaag

SEQ ID NO: 455234 - DNA, 25 bp, Mus musculus
gtaagatgcctgtcactcatcccaa

SEQ ID NO: 455235 - DNA, 25 bp, Mus musculus
gtaagcagctccactaagtactatg

SEQ ID NO: 455236 - DNA, 25 bp, Mus musculus
gtaagccagaggaccgcttgcaggt

SEQ ID NO: 455237 - DNA, 25 bp, Mus musculus
gtaagccccaagatctcaagacgca

SEQ ID NO: 455238 - DNA, 25 bp, Mus musculus
gtaagcccggagacggaagtctagt

SEQ ID NO: 455239 - DNA, 25 bp, Mus musculus
gtaagcctttctattcccaacggtg

SEQ ID NO: 455240 - DNA, 25 bp, Mus musculus
gtaagcttaagcaacaactgactgt

SEQ ID NO: 455241 - DNA, 25 bp, Mus musculus
gtaaggacactgacatggcgcggaa

SEQ ID NO: 455242 - DNA, 25 bp, Mus musculus
gtaaggagctttcccattccgtttg

SEQ ID NO: 455243 - DNA, 25 bp, Mus musculus
gtaaggcctttgtacagaggctgcc

SEQ ID NO: 455244 - DNA, 25 bp, Mus musculus
gtaagggcttcctagacaagtggaa

SEQ ID NO: 455245 - DNA, 25 bp, Mus musculus
gtaagtagagcaggctatgaaggtc

SEQ ID NO: 455246 - DNA, 25 bp, Mus musculus
gtaagtatttggactctgaatctgc

SEQ ID NO: 455247 - DNA, 25 bp, Mus musculus
gtaagtctcttctaattggtctgga

SEQ ID NO: 455248 - DNA, 25 bp, Mus musculus
gtaagtgactctcacacaggctcag

SEQ ID NO: 455249 - DNA, 25 bp, Mus musculus
gtaagttgttccctcacttctccca

SEQ ID NO: 455250 - DNA, 25 bp, Mus musculus
gtaatactgccacacccataagagg

SEQ ID NO: 455251 - DNA, 25 bp, Mus musculus
gtaatagcactttgcccctctgcca

SEQ ID NO: 455252 - DNA, 25 bp, Mus musculus
gtaatagcctctccacagcctcttg

SEQ ID NO: 455253 - DNA, 25 bp, Mus musculus
gtaatattcatacggcacgggctgt

SEQ ID NO: 455254 - DNA, 25 bp, Mus musculus
gtaatcacgcaaacgaagcagtccc

SEQ ID NO: 455255 - DNA, 25 bp, Mus musculus
gtaatcccagcatgtcttcgcagag

SEQ ID NO: 455256 - DNA, 25 bp, Mus musculus
gtaatcgtcacccagaaaacccagg

SEQ ID NO: 455257 - DNA, 25 bp, Mus musculus
gtaatcgtggtgtgttctacttcag

SEQ ID NO: 455258 - DNA, 25 bp, Mus musculus
gtaatctaactcaatgaagtcatcg

SEQ ID NO: 455259 - DNA, 25 bp, Mus musculus
gtaatctggcctgggcaccttggca

SEQ ID NO: 455260 - DNA, 25 bp, Mus musculus
gtaatgaatgactcggacacccagg

SEQ ID NO: 455261 - DNA, 25 bp, Mus musculus
gtaatgcagacacatccacactggt

SEQ ID NO: 455262 - DNA, 25 bp, Mus musculus
gtaatgctttcaatctactgcaagg

SEQ ID NO: 455263 - DNA, 25 bp, Mus musculus
gtaatggcatttcccaggccccgaa

SEQ ID NO: 455264 - DNA, 25 bp, Mus musculus
gtaattaggacttctactacctcag

SEQ ID NO: 455265 - DNA, 25 bp, Mus musculus
gtaattcacagcctctccggacagg

SEQ ID NO: 455266 - DNA, 25 bp, Mus musculus
gtaattcattgcagatccaccagga

SEQ ID NO: 455267 - DNA, 25 bp, Mus musculus
gtaatttgtccgttccttaagcaag

SEQ ID NO: 455268 - DNA, 25 bp, Mus musculus
gtacaaacttgtccctgagcgtcgg

SEQ ID NO: 455269 - DNA, 25 bp, Mus musculus
gtacaaaggcctgaacctcacggag

SEQ ID NO: 455270 - DNA, 25 bp, Mus musculus
gtacaacaaaacttctgatctattg

SEQ ID NO: 455271 - DNA, 25 bp, Mus musculus
gtacaactgctggagaggcgactgc

SEQ ID NO: 455272 - DNA, 25 bp, Mus musculus
gtacaagctggtggaactcgacccc

SEQ ID NO: 455273 - DNA, 25 bp, Mus musculus
gtacaagtacaagtccagcggccat

SEQ ID NO: 455274 - DNA, 25 bp, Mus musculus
gtacaatcagaagaccgtggtggct

SEQ ID NO: 455275 - DNA, 25 bp, Mus musculus
gtacacaccagagcgcgggtgctgc

SEQ ID NO: 455276 - DNA, 25 bp, Mus musculus
gtacacacctggctatcactcagaa

SEQ ID NO: 455277 - DNA, 25 bp, Mus musculus
gtacacagggaagcggacaaatgcc

SEQ ID NO: 455278 - DNA, 25 bp, Mus musculus
gtacacggcagtaagcttttttcca

SEQ ID NO: 455279 - DNA, 25 bp, Mus musculus
gtacactctgttgctgccaggagtc

SEQ ID NO: 455280 - DNA, 25 bp, Mus musculus
gtacacttacatggcagcagcggcc

SEQ ID NO: 455281 - DNA, 25 bp, Mus musculus
gtacacttgatagcgtgggcctcgg

SEQ ID NO: 455282 - DNA, 25 bp, Mus musculus
gtacagaggatgacagggagccaaa

SEQ ID NO: 455283 - DNA, 25 bp, Mus musculus
gtacagattcctcgagaaatgtttg

SEQ ID NO: 455284 - DNA, 25 bp, Mus musculus
gtacagccacgataatacaggagtt

SEQ ID NO: 455285 - DNA, 25 bp, Mus musculus
gtacagccctggctagacaagagcg

SEQ ID NO: 455286 - DNA, 25 bp, Mus musculus
gtacagcgcggcttaggtcccggat

SEQ ID NO: 455287 - DNA, 25 bp, Mus musculus
gtacaggaatgagggaaacagcccg

SEQ ID NO: 455288 - DNA, 25 bp, Mus musculus
gtacagtgtcttttccaggctagca

SEQ ID NO: 455289 - DNA, 25 bp, Mus musculus
gtacagttcacttgtaaacaccatt

SEQ ID NO: 455290 - DNA, 25 bp, Mus musculus
gtacatatcggccaccaaagactcg

SEQ ID NO: 455291 - DNA, 25 bp, Mus musculus
gtacatcaggtgctctaccgggcgc

SEQ ID NO: 455292 - DNA, 25 bp, Mus musculus
gtacatctggcggagcaccgtgagc

SEQ ID NO: 455293 - DNA, 25 bp, Mus musculus
gtacattacaaaatacaaaggcttt

SEQ ID NO: 455294 - DNA, 25 bp, Mus musculus
gtaccaagaacctggccagtgacca

SEQ ID NO: 455295 - DNA, 25 bp, Mus musculus
gtaccaccagtaaggatttttgcag

SEQ ID NO: 455296 - DNA, 25 bp, Mus musculus
gtaccactcctttagaactaaagct

SEQ ID NO: 455297 - DNA, 25 bp, Mus musculus
gtaccaggcccaggataacttcatg

SEQ ID NO: 455298 - DNA, 25 bp, Mus musculus
gtaccatccgttgggagtcatgaga

SEQ ID NO: 455299 - DNA, 25 bp, Mus musculus
gtaccatggcaatgatctcaaactg

SEQ ID NO: 455300 - DNA, 25 bp, Mus musculus
gtacccatagtcagttggcagatcg

SEQ ID NO: 455301 - DNA, 25 bp, Mus musculus
gtacccattgactctctactgccaa

SEQ ID NO: 455302 - DNA, 25 bp, Mus musculus
gtacccctttgctcagtcagctcag

SEQ ID NO: 455303 - DNA, 25 bp, Mus musculus
gtacccggtcgtcccaaagatgtgg

SEQ ID NO: 455304 - DNA, 25 bp, Mus musculus
gtacccttgttgagctagaggcttt

SEQ ID NO: 455305 - DNA, 25 bp, Mus musculus
gtaccgtgactttattgacaaccag

SEQ ID NO: 455306 - DNA, 25 bp, Mus musculus
gtaccgttaagctgccttctgcggg

SEQ ID NO: 455307 - DNA, 25 bp, Mus musculus
gtacctctgggtgggtgacctctgc

SEQ ID NO: 455308 - DNA, 25 bp, Mus musculus
gtacctgcggcaacgccaagagctg

SEQ ID NO: 455309 - DNA, 25 bp, Mus musculus
gtacctggacgagatcaacctgctg

SEQ ID NO: 455310 - DNA, 25 bp, Mus musculus
gtacctgtccatagcagagcgggcc

SEQ ID NO: 455311 - DNA, 25 bp, Mus musculus
gtaccttacgttgggtgtcctgcag

SEQ ID NO: 455312 - DNA, 25 bp, Mus musculus
gtaccttcttcatttatgtctggcc

SEQ ID NO: 455313 - DNA, 25 bp, Mus musculus
gtacgaaaattaccagccagggtct

SEQ ID NO: 455314 - DNA, 25 bp, Mus musculus
gtacgaagatggatcaagagcccca

SEQ ID NO: 455315 - DNA, 25 bp, Mus musculus
gtacgactactacggttggcaggcc

SEQ ID NO: 455316 - DNA, 25 bp, Mus musculus
gtacgagcagcccatcaacgaggag

SEQ ID NO: 455317 - DNA, 25 bp, Mus musculus
gtacgatgggacagacagcttggcc

SEQ ID NO: 455318 - DNA, 25 bp, Mus musculus
gtacgccgcgtattcatcacagatg

SEQ ID NO: 455319 - DNA, 25 bp, Mus musculus
gtacgcgttcatcggacccttggag

SEQ ID NO: 455320 - DNA, 25 bp, Mus musculus
gtacgcttgatctcagtggctgcaa

SEQ ID NO: 455321 - DNA, 25 bp, Mus musculus
gtacggcgggaacgcaacaacatcg

SEQ ID NO: 455322 - DNA, 25 bp, Mus musculus
gtactactccagacaaccaccagga

SEQ ID NO: 455323 - DNA, 25 bp, Mus musculus
gtactactgattctgggcctccagg

SEQ ID NO: 455324 - DNA, 25 bp, Mus musculus
gtactatcagtaccaccgggacaag

SEQ ID NO: 455325 - DNA, 25 bp, Mus musculus
gtactcatgcagtgacgaccaccag

SEQ ID NO: 455326 - DNA, 25 bp, Mus musculus
gtactcatggcggtgagacttcctg

SEQ ID NO: 455327 - DNA, 25 bp, Mus musculus
gtactcatgggctcgtgctcggcca

SEQ ID NO: 455328 - DNA, 25 bp, Mus musculus
gtactcctgtgacagagccgagccc

SEQ ID NO: 455329 - DNA, 25 bp, Mus musculus
gtactctatctggatgcctcttacg

SEQ ID NO: 455330 - DNA, 25 bp, Mus musculus
gtactctctcgctgacctgcagcag

SEQ ID NO: 455331 - DNA, 25 bp, Mus musculus
gtactgaccagacttgagactccct

SEQ ID NO: 455332 - DNA, 25 bp, Mus musculus
gtactggtgggccacagtcctcaaa

SEQ ID NO: 455333 - DNA, 25 bp, Mus musculus
gtactgtcaatagttttagataaag

SEQ ID NO: 455334 - DNA, 25 bp, Mus musculus
gtactgtcctggcttctttccttct

SEQ ID NO: 455335 - DNA, 25 bp, Mus musculus
gtactttgtgcgcttcgaggtgccc

SEQ ID NO: 455336 - DNA, 25 bp, Mus musculus
gtactttttcatccactcatacgta

SEQ ID NO: 455337 - DNA, 25 bp, Mus musculus
gtagaaaacctagatgccaccagtg

SEQ ID NO: 455338 - DNA, 25 bp, Mus musculus
gtagaaacccacaagcaagccaagg

SEQ ID NO: 455339 - DNA, 25 bp, Mus musculus
gtagaaacgtactcccaagatgggt

SEQ ID NO: 455340 - DNA, 25 bp, Mus musculus
gtagaaagtccctcaaggttgacgt

SEQ ID NO: 455341 - DNA, 25 bp, Mus musculus
gtagaaatcatagctagccggccca

SEQ ID NO: 455342 - DNA, 25 bp, Mus musculus
gtagaactaactcagatggaccatc

SEQ ID NO: 455343 - DNA, 25 bp, Mus musculus
gtagaactcagccatccctgtgtga

SEQ ID NO: 455344 - DNA, 25 bp, Mus musculus
gtagaagaaatacctccagccaacc

SEQ ID NO: 455345 - DNA, 25 bp, Mus musculus
gtagaagccccagtaccatcgatgt

SEQ ID NO: 455346 - DNA, 25 bp, Mus musculus
gtagaagtatccttcctgagcctca

SEQ ID NO: 455347 - DNA, 25 bp, Mus musculus
gtagaattcgtttcccgcgtcccag

SEQ ID NO: 455348 - DNA, 25 bp, Mus musculus
gtagacccctctctttgctgctgaa

SEQ ID NO: 455349 - DNA, 25 bp, Mus musculus
gtagacgcacagtcccctgagagtc

SEQ ID NO: 455350 - DNA, 25 bp, Mus musculus
gtagactaggctggtttataaccca

SEQ ID NO: 455351 - DNA, 25 bp, Mus musculus
gtagactggcctccacacaagcttg

SEQ ID NO: 455352 - DNA, 25 bp, Mus musculus
gtagagaccgctgtaccatccgggt

SEQ ID NO: 455353 - DNA, 25 bp, Mus musculus
gtagagagtccctccgtgctgtgcc

SEQ ID NO: 455354 - DNA, 25 bp, Mus musculus
gtagagatgtgacaagccggccaaa

SEQ ID NO: 455355 - DNA, 25 bp, Mus musculus
gtagagcaagcccagatacctccag

SEQ ID NO: 455356 - DNA, 25 bp, Mus musculus
gtagagcccttctccctagtctcgg

SEQ ID NO: 455357 - DNA, 25 bp, Mus musculus
gtagagctcatcttggttacactgc

SEQ ID NO: 455358 - DNA, 25 bp, Mus musculus
gtagagctggttgctatctggcaag

SEQ ID NO: 455359 - DNA, 25 bp, Mus musculus
gtagatagacggacacctggaactt

SEQ ID NO: 455360 - DNA, 25 bp, Mus musculus
gtagatagacttggccaccgctgag

SEQ ID NO: 455361 - DNA, 25 bp, Mus musculus
gtagatatagacctccaggctagac

SEQ ID NO: 455362 - DNA, 25 bp, Mus musculus
gtagcaaagatgacggacaggccct

SEQ ID NO: 455363 - DNA, 25 bp, Mus musculus
gtagcaaaggcaccaagaagttccg

SEQ ID NO: 455364 - DNA, 25 bp, Mus musculus
gtagcacaagactagctcaattctg

SEQ ID NO: 455365 - DNA, 25 bp, Mus musculus
gtagcacttgcctagaaggctccag

SEQ ID NO: 455366 - DNA, 25 bp, Mus musculus
gtagcagaaaacaaccagcccggta

SEQ ID NO: 455367 - DNA, 25 bp, Mus musculus
gtagcagccggcttcagggaacatc

SEQ ID NO: 455368 - DNA, 25 bp, Mus musculus
gtagcataatgcacacgacatctgg

SEQ ID NO: 455369 - DNA, 25 bp, Mus musculus
gtagcatattcttgtgatcccagca

SEQ ID NO: 455370 - DNA, 25 bp, Mus musculus
gtagccaagaacagcgctggccagg

SEQ ID NO: 455371 - DNA, 25 bp, Mus musculus
gtagccaagttcctgcacaagcatg

SEQ ID NO: 455372 - DNA, 25 bp, Mus musculus
gtagccacttggttggaagcacagt

SEQ ID NO: 455373 - DNA, 25 bp, Mus musculus
gtagccagcggtgttggcaacacgc

SEQ ID NO: 455374 - DNA, 25 bp, Mus musculus
gtagcccagtattgacccagccttg

SEQ ID NO: 455375 - DNA, 25 bp, Mus musculus
gtagccctgcatggtacagttttgc

SEQ ID NO: 455376 - DNA, 25 bp, Mus musculus
gtagccggcagcattaagaaccatt

SEQ ID NO: 455377 - DNA, 25 bp, Mus musculus
gtagccgtaccacatcttccagtag

SEQ ID NO: 455378 - DNA, 25 bp, Mus musculus
gtagcggctataaaaagaacatggg

SEQ ID NO: 455379 - DNA, 25 bp, Mus musculus
gtagcgtaaagtaccctgtggccca

SEQ ID NO: 455380 - DNA, 25 bp, Mus musculus
gtagcgtgctactcatgatcatcta

SEQ ID NO: 455381 - DNA, 25 bp, Mus musculus
gtagctagtcccagaaaacaccagg

SEQ ID NO: 455382 - DNA, 25 bp, Mus musculus
gtagctatgaggacctctggtgctg

SEQ ID NO: 455383 - DNA, 25 bp, Mus musculus
gtagctattatgtttccaacccaag

SEQ ID NO: 455384 - DNA, 25 bp, Mus musculus
gtagctcacagtaagcacctaagga

SEQ ID NO: 455385 - DNA, 25 bp, Mus musculus
gtagctcctccaccttctgagacat

SEQ ID NO: 455386 - DNA, 25 bp, Mus musculus
gtagctcctgctatggtcatgctgc

SEQ ID NO: 455387 - DNA, 25 bp, Mus musculus
gtagctctgcggtgtagaaaagaaa

SEQ ID NO: 455388 - DNA, 25 bp, Mus musculus
gtagctctgtcctcctaatggaaac

SEQ ID NO: 455389 - DNA, 25 bp, Mus musculus
gtagctgaaggcacgcaaacctgag

SEQ ID NO: 455390 - DNA, 25 bp, Mus musculus
gtagctgaatgtctgccttcccata

SEQ ID NO: 455391 - DNA, 25 bp, Mus musculus
gtagctgacttgctggcttttgctg

SEQ ID NO: 455392 - DNA, 25 bp, Mus musculus
gtagcttccccacggctttgcatgg

SEQ ID NO: 455393 - DNA, 25 bp, Mus musculus
gtagcttctccataacagcacctgc

SEQ ID NO: 455394 - DNA, 25 bp, Mus musculus
gtagcttctgcaattccattcgcca

SEQ ID NO: 455395 - DNA, 25 bp, Mus musculus
gtagcttgacagaggccactccggt

SEQ ID NO: 455396 - DNA, 25 bp, Mus musculus
gtagcttggccgtagcagacctgct

SEQ ID NO: 455397 - DNA, 25 bp, Mus musculus
gtagctttaataccagatctcagga

SEQ ID NO: 455398 - DNA, 25 bp, Mus musculus
gtaggaaatagaggcccaaggcccg

SEQ ID NO: 455399 - DNA, 25 bp, Mus musculus
gtaggaagacctttaaggcaagtat

SEQ ID NO: 455400 - DNA, 25 bp, Mus musculus
gtaggaatccggctgcatccgacct

SEQ ID NO: 455401 - DNA, 25 bp, Mus musculus
gtaggaccacaggataaagttagtt

SEQ ID NO: 455402 - DNA, 25 bp, Mus musculus
gtaggacccataccagacggctttg

SEQ ID NO: 455403 - DNA, 25 bp, Mus musculus
gtaggacccgattcagtcacatctg

SEQ ID NO: 455404 - DNA, 25 bp, Mus musculus
gtaggactgaacaccacaaggctgt

SEQ ID NO: 455405 - DNA, 25 bp, Mus musculus
gtaggctccgtgctcctggaccagt

SEQ ID NO: 455406 - DNA, 25 bp, Mus musculus
gtaggctgcccagtaacaccaggtt

SEQ ID NO: 455407 - DNA, 25 bp, Mus musculus
gtaggctggactggcccacatcagt

SEQ ID NO: 455408 - DNA, 25 bp, Mus musculus
gtaggctgggcccaggctggtccgg

SEQ ID NO: 455409 - DNA, 25 bp, Mus musculus
gtaggctttctgcaccagcgtacag

SEQ ID NO: 455410 - DNA, 25 bp, Mus musculus
gtagggacagcatgttcagggctac

SEQ ID NO: 455411 - DNA, 25 bp, Mus musculus
gtagggagagcgatccgccgcttca

SEQ ID NO: 455412 - DNA, 25 bp, Mus musculus
gtagggagcggcgagaaggcctcgt

SEQ ID NO: 455413 - DNA, 25 bp, Mus musculus
gtagggttacaatgatgccaagatc

SEQ ID NO: 455414 - DNA, 25 bp, Mus musculus
gtaggtaactctccatggcctttgc

SEQ ID NO: 455415 - DNA, 25 bp, Mus musculus
gtaggtgttcgcatcgccgtcgcct

SEQ ID NO: 455416 - DNA, 25 bp, Mus musculus
gtaggtttccaattggctattgccg

SEQ ID NO: 455417 - DNA, 25 bp, Mus musculus
gtagtacaagcaatacagagcagtc

SEQ ID NO: 455418 - DNA, 25 bp, Mus musculus
gtagtacacactggccttgaaatca

SEQ ID NO: 455419 - DNA, 25 bp, Mus musculus
gtagtcaagtctacccctgcagcca

SEQ ID NO: 455420 - DNA, 25 bp, Mus musculus
gtagtcagccttgtcttctcctgta

SEQ ID NO: 455421 - DNA, 25 bp, Mus musculus
gtagtcgaccgagcggcgagcgctg

SEQ ID NO: 455422 - DNA, 25 bp, Mus musculus
gtagtctctgatctcccgttcttgg

SEQ ID NO: 455423 - DNA, 25 bp, Mus musculus
gtagtgactgcagcccttgtccaca

SEQ ID NO: 455424 - DNA, 25 bp, Mus musculus
gtagtgagactatcttaccttcagt

SEQ ID NO: 455425 - DNA, 25 bp, Mus musculus
gtagtgagctacctgatatgtgtgc

SEQ ID NO: 455426 - DNA, 25 bp, Mus musculus
gtagtgctgcgctcattttcacagc

SEQ ID NO: 455427 - DNA, 25 bp, Mus musculus
gtagtggagccaatacttaaaccca

SEQ ID NO: 455428 - DNA, 25 bp, Mus musculus
gtagtggcactcctctcacatggtg

SEQ ID NO: 455429 - DNA, 25 bp, Mus musculus
gtagtggcctcagctcctcatctgt

SEQ ID NO: 455430 - DNA, 25 bp, Mus musculus
gtagtggtctgcatacaatacagtc

SEQ ID NO: 455431 - DNA, 25 bp, Mus musculus
gtagttactgaaagccacgccacca

SEQ ID NO: 455432 - DNA, 25 bp, Mus musculus
gtagttcccctgtcacctttcttag

SEQ ID NO: 455433 - DNA, 25 bp, Mus musculus
gtagttcctgctgaagccctgcctg

SEQ ID NO: 455434 - DNA, 25 bp, Mus musculus
gtagttggggcttctacacgggcca

SEQ ID NO: 455435 - DNA, 25 bp, Mus musculus
gtagtttgcacacccatcccagtgg

SEQ ID NO: 455436 - DNA, 25 bp, Mus musculus
gtataaagaaggaccaagccgctga

SEQ ID NO: 455437 - DNA, 25 bp, Mus musculus
gtataaagaatgtgcaaagacctcc

SEQ ID NO: 455438 - DNA, 25 bp, Mus musculus
gtataaataattcctgaagtctcag

SEQ ID NO: 455439 - DNA, 25 bp, Mus musculus
gtataactggctccaaaagtttggg

SEQ ID NO: 455440 - DNA, 25 bp, Mus musculus
gtataagaccaacatccgagagctg

SEQ ID NO: 455441 - DNA, 25 bp, Mus musculus
gtatacgacctcttgcactgcctgg

SEQ ID NO: 455442 - DNA, 25 bp, Mus musculus
gtatacgcgaaatcttgcaagacag

SEQ ID NO: 455443 - DNA, 25 bp, Mus musculus
gtatacgctcatgattgactagcca

SEQ ID NO: 455444 - DNA, 25 bp, Mus musculus
gtatactccggtcccataggcacgg

SEQ ID NO: 455445 - DNA, 25 bp, Mus musculus
gtatagtctagccatgtctccaccc

SEQ ID NO: 455446 - DNA, 25 bp, Mus musculus
gtatagtggacagcagagtggctcc

SEQ ID NO: 455447 - DNA, 25 bp, Mus musculus
gtatatactgttgcctgctaacccc

SEQ ID NO: 455448 - DNA, 25 bp, Mus musculus
gtatatatatgtgcgaggccgcggc

SEQ ID NO: 455449 - DNA, 25 bp, Mus musculus
gtatatatgacactggattcccaaa

SEQ ID NO: 455450 - DNA, 25 bp, Mus musculus
gtatatccctttggtaattgcagta

SEQ ID NO: 455451 - DNA, 25 bp, Mus musculus
gtatatcgcggtgcctcctgggaaa

SEQ ID NO: 455452 - DNA, 25 bp, Mus musculus
gtatatcttaaaaaacaggaatgtg

SEQ ID NO: 455453 - DNA, 25 bp, Mus musculus
gtatatgaactctttcttagcaggc

SEQ ID NO: 455454 - DNA, 25 bp, Mus musculus
gtatattgcttgtctctctatagaa

SEQ ID NO: 455455 - DNA, 25 bp, Mus musculus
gtatcaaatgaagcgtaaagctgcc

SEQ ID NO: 455456 - DNA, 25 bp, Mus musculus
gtatcaactcagaaaaccctcccag

SEQ ID NO: 455457 - DNA, 25 bp, Mus musculus
gtatcaataatcacccaaggaggag

SEQ ID NO: 455458 - DNA, 25 bp, Mus musculus
gtatcacaaggcacacaaacactgg

SEQ ID NO: 455459 - DNA, 25 bp, Mus musculus
gtatcacactagtttccaaggtcag

SEQ ID NO: 455460 - DNA, 25 bp, Mus musculus
gtatcacggaatgacacgcccaaga

SEQ ID NO: 455461 - DNA, 25 bp, Mus musculus
gtatcactctccagcattatcgagg

SEQ ID NO: 455462 - DNA, 25 bp, Mus musculus
gtatcactgtggtaaagggtttctt

SEQ ID NO: 455463 - DNA, 25 bp, Mus musculus
gtatcacttgggttcatacctcgag

SEQ ID NO: 455464 - DNA, 25 bp, Mus musculus
gtatcaggatcagtgagagccccga

SEQ ID NO: 455465 - DNA, 25 bp, Mus musculus
gtatcatcacgtgggaaaactgctg

SEQ ID NO: 455466 - DNA, 25 bp, Mus musculus
gtatccaagacatcacaagtgccct

SEQ ID NO: 455467 - DNA, 25 bp, Mus musculus
gtatccaatgaacgcccagctgctg

SEQ ID NO: 455468 - DNA, 25 bp, Mus musculus
gtatccacggacattccatcttggg

SEQ ID NO: 455469 - DNA, 25 bp, Mus musculus
gtatcccaatgacatagccctgctg

SEQ ID NO: 455470 - DNA, 25 bp, Mus musculus
gtatccctgagtcaaaacgcatgcg

SEQ ID NO: 455471 - DNA, 25 bp, Mus musculus
gtatcctcctgagttcagccttgtg

SEQ ID NO: 455472 - DNA, 25 bp, Mus musculus
gtatccttctggtgagctgctctaa

SEQ ID NO: 455473 - DNA, 25 bp, Mus musculus
gtatcgaacccaccttctctgcaag

SEQ ID NO: 455474 - DNA, 25 bp, Mus musculus
gtatcgccactttgaccagcacact

SEQ ID NO: 455475 - DNA, 25 bp, Mus musculus
gtatcgttccttctgcaagatcctg

SEQ ID NO: 455476 - DNA, 25 bp, Mus musculus
gtatctatcaaccagtttgctctgg

SEQ ID NO: 455477 - DNA, 25 bp, Mus musculus
gtatctccttcaggatgcccaagaa

SEQ ID NO: 455478 - DNA, 25 bp, Mus musculus
gtatctgaccagatccggcctgagg

SEQ ID NO: 455479 - DNA, 25 bp, Mus musculus
gtatctgtacccctgaacactggca

SEQ ID NO: 455480 - DNA, 25 bp, Mus musculus
gtatctgttaccaaaggccctgaaa

SEQ ID NO: 455481 - DNA, 25 bp, Mus musculus
gtatcttggaacagcccgcagtggt

SEQ ID NO: 455482 - DNA, 25 bp, Mus musculus
gtatctttgcttacggccagacagg

SEQ ID NO: 455483 - DNA, 25 bp, Mus musculus
gtatgaaaacactctggccggtcag

SEQ ID NO: 455484 - DNA, 25 bp, Mus musculus
gtatgaaagctaaaaccgtgactgc

SEQ ID NO: 455485 - DNA, 25 bp, Mus musculus
gtatgaaggtcctgcaaacccgagg

SEQ ID NO: 455486 - DNA, 25 bp, Mus musculus
gtatgagaacctttccggcctccgg

SEQ ID NO: 455487 - DNA, 25 bp, Mus musculus
gtatgagcaacagcgagacaacctg

SEQ ID NO: 455488 - DNA, 25 bp, Mus musculus
gtatgagccgcgtctttcgcagcca

SEQ ID NO: 455489 - DNA, 25 bp, Mus musculus
gtatgagctggtaccaggcacccag

SEQ ID NO: 455490 - DNA, 25 bp, Mus musculus
gtatgataagaacagcgacggcgct

SEQ ID NO: 455491 - DNA, 25 bp, Mus musculus
gtatgatacacgcttgcctggccag

SEQ ID NO: 455492 - DNA, 25 bp, Mus musculus
gtatgatccccaccagaaattccag

SEQ ID NO: 455493 - DNA, 25 bp, Mus musculus
gtatgattgtagcagcctctcaggc

SEQ ID NO: 455494 - DNA, 25 bp, Mus musculus
gtatgcactgcaaaagccagcggtg

SEQ ID NO: 455495 - DNA, 25 bp, Mus musculus
gtatgcatgctgaagggccagacca

SEQ ID NO: 455496 - DNA, 25 bp, Mus musculus
gtatgctgttcacctcagctctctc

SEQ ID NO: 455497 - DNA, 25 bp, Mus musculus
gtatgctgttccactattccactga

SEQ ID NO: 455498 - DNA, 25 bp, Mus musculus
gtatggcgaagcaaggagtgacccc

SEQ ID NO: 455499 - DNA, 25 bp, Mus musculus
gtatggctcagagcagcaaagggta

SEQ ID NO: 455500 - DNA, 25 bp, Mus musculus
gtatggctccatcctgaaacgcggg

SEQ ID NO: 455501 - DNA, 25 bp, Mus musculus
gtatggcttcccttctgcacacaag

SEQ ID NO: 455502 - DNA, 25 bp, Mus musculus
gtatggtggtcttggcccctccctc

SEQ ID NO: 455503 - DNA, 25 bp, Mus musculus
gtatggtgtaccttgcctcctggag

SEQ ID NO: 455504 - DNA, 25 bp, Mus musculus
gtatgtaaccactgatcactccagc

SEQ ID NO: 455505 - DNA, 25 bp, Mus musculus
gtatgtagcaatgtggcccagggca

SEQ ID NO: 455506 - DNA, 25 bp, Mus musculus
gtatgtctgggtacagcaccagggt

SEQ ID NO: 455507 - DNA, 25 bp, Mus musculus
gtatgtgacctggaggaccctggca

SEQ ID NO: 455508 - DNA, 25 bp, Mus musculus
gtatgtgcatgaaagtaccagtgcc

SEQ ID NO: 455509 - DNA, 25 bp, Mus musculus
gtatgtggtccgaagcagctccaag

SEQ ID NO: 455510 - DNA, 25 bp, Mus musculus
gtatgtgtcactgaagcgctccggt

SEQ ID NO: 455511 - DNA, 25 bp, Mus musculus
gtatgtttgtacagttcttcccaaa

SEQ ID NO: 455512 - DNA, 25 bp, Mus musculus
gtattatctccccttctgcatggca

SEQ ID NO: 455513 - DNA, 25 bp, Mus musculus
gtattatgacctgacctggctgagc

SEQ ID NO: 455514 - DNA, 25 bp, Mus musculus
gtattcaattacttctcctgccctg

SEQ ID NO: 455515 - DNA, 25 bp, Mus musculus
gtattcactgccgttcatcccagga

SEQ ID NO: 455516 - DNA, 25 bp, Mus musculus
gtattcatgcctggaagccccttgg

SEQ ID NO: 455517 - DNA, 25 bp, Mus musculus
gtattcatggttgctcttggagccc

SEQ ID NO: 455518 - DNA, 25 bp, Mus musculus
gtattccaaggcgtagaggcgatcc

SEQ ID NO: 455519 - DNA, 25 bp, Mus musculus
gtattccagcagaccagaggccgtc

SEQ ID NO: 455520 - DNA, 25 bp, Mus musculus
gtattccagtgcagagaaccaagga

SEQ ID NO: 455521 - DNA, 25 bp, Mus musculus
gtattccgtttgtcaataccaaggg

SEQ ID NO: 455522 - DNA, 25 bp, Mus musculus
gtattcgctcttgtattatcctgcc

SEQ ID NO: 455523 - DNA, 25 bp, Mus musculus
gtattctgactttcctcactaggga

SEQ ID NO: 455524 - DNA, 25 bp, Mus musculus
gtattctgtctgtgcgcgctaccaa

SEQ ID NO: 455525 - DNA, 25 bp, Mus musculus
gtattgactttgcaactcgtaagat

SEQ ID NO: 455526 - DNA, 25 bp, Mus musculus
gtattgcctgactcaaagcttcaga

SEQ ID NO: 455527 - DNA, 25 bp, Mus musculus
gtattgcctgttgtgcgcgcaggcc

SEQ ID NO: 455528 - DNA, 25 bp, Mus musculus
gtattgtacagagggaaagcgcacc

SEQ ID NO: 455529 - DNA, 25 bp, Mus musculus
gtattgtatacacagggccaccagc

SEQ ID NO: 455530 - DNA, 25 bp, Mus musculus
gtatttaaaccacgtccgggctgca

SEQ ID NO: 455531 - DNA, 25 bp, Mus musculus
gtatttaccagatcgccaagcgtcg

SEQ ID NO: 455532 - DNA, 25 bp, Mus musculus
gtatttatagtgcaccagaagccag

SEQ ID NO: 455533 - DNA, 25 bp, Mus musculus
gtatttatccaagtgagtttacaag

SEQ ID NO: 455534 - DNA, 25 bp, Mus musculus
gtatttcaaaactagcagctccctg

SEQ ID NO: 455535 - DNA, 25 bp, Mus musculus
gtatttcaggtgttgagtatcccag

SEQ ID NO: 455536 - DNA, 25 bp, Mus musculus
gtatttgtgtctgaagctggccccg

SEQ ID NO: 455537 - DNA, 25 bp, Mus musculus
gtattttattatcttgtccaggacc

SEQ ID NO: 455538 - DNA, 25 bp, Mus musculus
gtcaaaaaacagcaggaactcctcg

SEQ ID NO: 455539 - DNA, 25 bp, Mus musculus
gtcaaaacctgagtcccgggtggca

SEQ ID NO: 455540 - DNA, 25 bp, Mus musculus
gtcaaaacttacatcaagggaagag

SEQ ID NO: 455541 - DNA, 25 bp, Mus musculus
gtcaaaagagtaagagccgctcccg

SEQ ID NO: 455542 - DNA, 25 bp, Mus musculus
gtcaaaatgctatgccagcctcagg

SEQ ID NO: 455543 - DNA, 25 bp, Mus musculus
gtcaaagacttggtcgccctaggcc

SEQ ID NO: 455544 - DNA, 25 bp, Mus musculus
gtcaaagcccacttgttggcatcag

SEQ ID NO: 455545 - DNA, 25 bp, Mus musculus
gtcaaaggcactggatgtcatatca

SEQ ID NO: 455546 - DNA, 25 bp, Mus musculus
gtcaaattctaaggcgacttaccaa

SEQ ID NO: 455547 - DNA, 25 bp, Mus musculus
gtcaacaacagtcctgattccaaaa

SEQ ID NO: 455548 - DNA, 25 bp, Mus musculus
gtcaacagagagatcaaggtccttc

SEQ ID NO: 455549 - DNA, 25 bp, Mus musculus
gtcaacatctacaaggaaggccagg

SEQ ID NO: 455550 - DNA, 25 bp, Mus musculus
gtcaacatgctctgataacaccttg

SEQ ID NO: 455551 - DNA, 25 bp, Mus musculus
gtcaaccagggagaaggaacccact

SEQ ID NO: 455552 - DNA, 25 bp, Mus musculus
gtcaacccacacacgactacgagtg

SEQ ID NO: 455553 - DNA, 25 bp, Mus musculus
gtcaactcaacgagaaggtggctca

SEQ ID NO: 455554 - DNA, 25 bp, Mus musculus
gtcaactgattgtggaacgctcggg

SEQ ID NO: 455555 - DNA, 25 bp, Mus musculus
gtcaactggatcttctaggctcaaa

SEQ ID NO: 455556 - DNA, 25 bp, Mus musculus
gtcaagaagaagctcacctaccagt

SEQ ID NO: 455557 - DNA, 25 bp, Mus musculus
gtcaagagtctagagctggagccct

SEQ ID NO: 455558 - DNA, 25 bp, Mus musculus
gtcaagatccgcaggattcgcgcca

SEQ ID NO: 455559 - DNA, 25 bp, Mus musculus
gtcaagattcttctcgaatccaggg

SEQ ID NO: 455560 - DNA, 25 bp, Mus musculus
gtcaagcaggcctgagggactgtcc

SEQ ID NO: 455561 - DNA, 25 bp, Mus musculus
gtcaagcattcacaaggaccttctg

SEQ ID NO: 455562 - DNA, 25 bp, Mus musculus
gtcaagctacccctagaagacgcga

SEQ ID NO: 455563 - DNA, 25 bp, Mus musculus
gtcaagctatctatcaccgcaagtg

SEQ ID NO: 455564 - DNA, 25 bp, Mus musculus
gtcaagctccgagggcagcctttct

SEQ ID NO: 455565 - DNA, 25 bp, Mus musculus
gtcaagctgctagcctggcttctgg

SEQ ID NO: 455566 - DNA, 25 bp, Mus musculus
gtcaagtttttcagctccccagtcg

SEQ ID NO: 455567 - DNA, 25 bp, Mus musculus
gtcaatcctacagcataaccatggt

SEQ ID NO: 455568 - DNA, 25 bp, Mus musculus
gtcaatggagcggaaaacgatccct

SEQ ID NO: 455569 - DNA, 25 bp, Mus musculus
gtcacaaatctctggcaccaaaggg

SEQ ID NO: 455570 - DNA, 25 bp, Mus musculus
gtcacaacaatgaggctgggcgcca

SEQ ID NO: 455571 - DNA, 25 bp, Mus musculus
gtcacacaaataagcctcaggcatt

SEQ ID NO: 455572 - DNA, 25 bp, Mus musculus
gtcacaccagtaaccagtgcaatca

SEQ ID NO: 455573 - DNA, 25 bp, Mus musculus
gtcacagaccttgagacccgaggga

SEQ ID NO: 455574 - DNA, 25 bp, Mus musculus
gtcacagagataacctgagccttta

SEQ ID NO: 455575 - DNA, 25 bp, Mus musculus
gtcacagcgccagaagtggttccag

SEQ ID NO: 455576 - DNA, 25 bp, Mus musculus
gtcacaggctgtatttggaaaccag

SEQ ID NO: 455577 - DNA, 25 bp, Mus musculus
gtcacagtattgaaacctaacacta

SEQ ID NO: 455578 - DNA, 25 bp, Mus musculus
gtcacagtcagaggcacaggtacag

SEQ ID NO: 455579 - DNA, 25 bp, Mus musculus
gtcacatatatggaggcatcggcaa

SEQ ID NO: 455580 - DNA, 25 bp, Mus musculus
gtcacatgtgttgttacagatcacc

SEQ ID NO: 455581 - DNA, 25 bp, Mus musculus
gtcaccaacacaattccacaagagg

SEQ ID NO: 455582 - DNA, 25 bp, Mus musculus
gtcaccacctagctttctctctggg

SEQ ID NO: 455583 - DNA, 25 bp, Mus musculus
gtcaccacggtagaaggcttaggca

SEQ ID NO: 455584 - DNA, 25 bp, Mus musculus
gtcaccacgtccagcagaagatcat

SEQ ID NO: 455585 - DNA, 25 bp, Mus musculus
gtcaccagcaagaagactatgagcc

SEQ ID NO: 455586 - DNA, 25 bp, Mus musculus
gtcaccaggcttttgagtctccaac

SEQ ID NO: 455587 - DNA, 25 bp, Mus musculus
gtcaccatcgagacaggtacagctg

SEQ ID NO: 455588 - DNA, 25 bp, Mus musculus
gtcacccagaggacatttaagctcg

SEQ ID NO: 455589 - DNA, 25 bp, Mus musculus
gtcaccctcccgaggagactggcta

SEQ ID NO: 455590 - DNA, 25 bp, Mus musculus
gtcaccctgagggagcacctggaga

SEQ ID NO: 455591 - DNA, 25 bp, Mus musculus
gtcacccttctgcaatccttgtaaa

SEQ ID NO: 455592 - DNA, 25 bp, Mus musculus
gtcaccgagtggaaagcaagccgag

SEQ ID NO: 455593 - DNA, 25 bp, Mus musculus
gtcacgagccgtgcagggtctttcc

SEQ ID NO: 455594 - DNA, 25 bp, Mus musculus
gtcacgatctctgattccttgcaga

SEQ ID NO: 455595 - DNA, 25 bp, Mus musculus
gtcacgcagactgccagggacagtg

SEQ ID NO: 455596 - DNA, 25 bp, Mus musculus
gtcacgcagcatccagggttggctt

SEQ ID NO: 455597 - DNA, 25 bp, Mus musculus
gtcacggtggttggctgtgattacc

SEQ ID NO: 455598 - DNA, 25 bp, Mus musculus
gtcacgtagccagaagagactcgcc

SEQ ID NO: 455599 - DNA, 25 bp, Mus musculus
gtcacgtgacttctatcatacttgc

SEQ ID NO: 455600 - DNA, 25 bp, Mus musculus
gtcactatgtatctatgcgcccagg

SEQ ID NO: 455601 - DNA, 25 bp, Mus musculus
gtcactcagaagatcacgacgttgg

SEQ ID NO: 455602 - DNA, 25 bp, Mus musculus
gtcactcatgctgggcacacactgg

SEQ ID NO: 455603 - DNA, 25 bp, Mus musculus
gtcactcggaaaaaatgcgcaccag

SEQ ID NO: 455604 - DNA, 25 bp, Mus musculus
gtcactctgaggagggctatgccag

SEQ ID NO: 455605 - DNA, 25 bp, Mus musculus
gtcactgaaatctctcacttaccct

SEQ ID NO: 455606 - DNA, 25 bp, Mus musculus
gtcactgaatctgctgctggccaag

SEQ ID NO: 455607 - DNA, 25 bp, Mus musculus
gtcactgcttcaagatgaaatctcc

SEQ ID NO: 455608 - DNA, 25 bp, Mus musculus
gtcactggaaggctgcgtgtctccc

SEQ ID NO: 455609 - DNA, 25 bp, Mus musculus
gtcactgtactcgacaataaagtag

SEQ ID NO: 455610 - DNA, 25 bp, Mus musculus
gtcactgtgcatacccaaccggatg

SEQ ID NO: 455611 - DNA, 25 bp, Mus musculus
gtcactgtgcgtgccaacattgctg

SEQ ID NO: 455612 - DNA, 25 bp, Mus musculus
gtcactttatttcaaagcaactctg

SEQ ID NO: 455613 - DNA, 25 bp, Mus musculus
gtcagaactgaaggagcttatcaac

SEQ ID NO: 455614 - DNA, 25 bp, Mus musculus
gtcagacgtggactactggcagccc

SEQ ID NO: 455615 - DNA, 25 bp, Mus musculus
gtcagagaccgtgcactacaagcga

SEQ ID NO: 455616 - DNA, 25 bp, Mus musculus
gtcagagggtcacgtggctacaact

SEQ ID NO: 455617 - DNA, 25 bp, Mus musculus
gtcagagtggtgctcccgctgtcca

SEQ ID NO: 455618 - DNA, 25 bp, Mus musculus
gtcagagttggcaggcccagccctg

SEQ ID NO: 455619 - DNA, 25 bp, Mus musculus
gtcagatcataccaaaccattgtgt

SEQ ID NO: 455620 - DNA, 25 bp, Mus musculus
gtcagatcgtgactcaggcgccaat

SEQ ID NO: 455621 - DNA, 25 bp, Mus musculus
gtcagcaaactgacatcagagaaga

SEQ ID NO: 455622 - DNA, 25 bp, Mus musculus
gtcagcatcttctactaattcagag

SEQ ID NO: 455623 - DNA, 25 bp, Mus musculus
gtcagccatggtattgtggtcccca

SEQ ID NO: 455624 - DNA, 25 bp, Mus musculus
gtcagcgctccacagatccatctgt

SEQ ID NO: 455625 - DNA, 25 bp, Mus musculus
gtcagcggcatcgttttccctctag

SEQ ID NO: 455626 - DNA, 25 bp, Mus musculus
gtcagcgtggacaagcatcagagcc

SEQ ID NO: 455627 - DNA, 25 bp, Mus musculus
gtcagcttgatgtctggttcccagc

SEQ ID NO: 455628 - DNA, 25 bp, Mus musculus
gtcaggattcatgggaggttatttc

SEQ ID NO: 455629 - DNA, 25 bp, Mus musculus
gtcaggcaatctgctgggcactccg

SEQ ID NO: 455630 - DNA, 25 bp, Mus musculus
gtcaggccgcacagccaatgggctg

SEQ ID NO: 455631 - DNA, 25 bp, Mus musculus
gtcaggctgcacacgcagagcgtct

SEQ ID NO: 455632 - DNA, 25 bp, Mus musculus
gtcagtactctttcctcatgcgctg

SEQ ID NO: 455633 - DNA, 25 bp, Mus musculus
gtcagtcaccaaggcagggacgtta

SEQ ID NO: 455634 - DNA, 25 bp, Mus musculus
gtcagtctccggacgcgcagcggct

SEQ ID NO: 455635 - DNA, 25 bp, Mus musculus
gtcagtgccactcgctcagaagatg

SEQ ID NO: 455636 - DNA, 25 bp, Mus musculus
gtcagttctccccttctacgtgtag

SEQ ID NO: 455637 - DNA, 25 bp, Mus musculus
gtcagttggtaacccggacccacat

SEQ ID NO: 455638 - DNA, 25 bp, Mus musculus
gtcagtttgcatccattcatttcag

SEQ ID NO: 455639 - DNA, 25 bp, Mus musculus
gtcataaaaggatggaacacacttc

SEQ ID NO: 455640 - DNA, 25 bp, Mus musculus
gtcataactggagcgtgattttccc

SEQ ID NO: 455641 - DNA, 25 bp, Mus musculus
gtcatactggcatcctgaagtttat

SEQ ID NO: 455642 - DNA, 25 bp, Mus musculus
gtcatatgctgcgacacacgggcga

SEQ ID NO: 455643 - DNA, 25 bp, Mus musculus
gtcatcaaagtttaggcatcccagg

SEQ ID NO: 455644 - DNA, 25 bp, Mus musculus
gtcatcaacatctcaggcctgcggt

SEQ ID NO: 455645 - DNA, 25 bp, Mus musculus
gtcatcacaagtcaagaagttcaca

SEQ ID NO: 455646 - DNA, 25 bp, Mus musculus
gtcatcacaccggtgaggaagtgtt

SEQ ID NO: 455647 - DNA, 25 bp, Mus musculus
gtcatcactgagaggaagaccaaga

SEQ ID NO: 455648 - DNA, 25 bp, Mus musculus
gtcatcatcgggaaggtgcgcctga

SEQ ID NO: 455649 - DNA, 25 bp, Mus musculus
gtcatcgtctgtgtgggctacttca

SEQ ID NO: 455650 - DNA, 25 bp, Mus musculus
gtcatctcagaagaatcgccccagt

SEQ ID NO: 455651 - DNA, 25 bp, Mus musculus
gtcatctccgtgactgtgaagcccc

SEQ ID NO: 455652 - DNA, 25 bp, Mus musculus
gtcatgaatcctcgcctctgctggg

SEQ ID NO: 455653 - DNA, 25 bp, Mus musculus
gtcatgagtctagtgaaggaacgag

SEQ ID NO: 455654 - DNA, 25 bp, Mus musculus
gtcatgagtgcctagcgcccttggt

SEQ ID NO: 455655 - DNA, 25 bp, Mus musculus
gtcatgatgctgatccggaaccacc

SEQ ID NO: 455656 - DNA, 25 bp, Mus musculus
gtcatgccgttaccctcagagttaa

SEQ ID NO: 455657 - DNA, 25 bp, Mus musculus
gtcatgctaccagtttgctttagag

SEQ ID NO: 455658 - DNA, 25 bp, Mus musculus
gtcatggcagccgaagagaaggacc

SEQ ID NO: 455659 - DNA, 25 bp, Mus musculus
gtcatggcgcacagtctgaggcacc

SEQ ID NO: 455660 - DNA, 25 bp, Mus musculus
gtcatggctatcacaaatcctcagg

SEQ ID NO: 455661 - DNA, 25 bp, Mus musculus
gtcatggtgatcaaacgccctggca

SEQ ID NO: 455662 - DNA, 25 bp, Mus musculus
gtcatggtgccattctcaaagccag

SEQ ID NO: 455663 - DNA, 25 bp, Mus musculus
gtcattcatcaacatcggtcttctg

SEQ ID NO: 455664 - DNA, 25 bp, Mus musculus
gtcattgaggacgacatcgacgcca

SEQ ID NO: 455665 - DNA, 25 bp, Mus musculus
gtcatttatcctgaggcgcccgagg

SEQ ID NO: 455666 - DNA, 25 bp, Mus musculus
gtcatttgagaagaggatatgccaa

SEQ ID NO: 455667 - DNA, 25 bp, Mus musculus
gtcattttgcacctaaacgccggcg

SEQ ID NO: 455668 - DNA, 25 bp, Mus musculus
gtccaaatggattgcgttaatcctc

SEQ ID NO: 455669 - DNA, 25 bp, Mus musculus
gtccaaccagaaatcggcgacgcaa

SEQ ID NO: 455670 - DNA, 25 bp, Mus musculus
gtccaattacatggccacttgtggg

SEQ ID NO: 455671 - DNA, 25 bp, Mus musculus
gtccacactgcgagtgcgtgcccaa

SEQ ID NO: 455672 - DNA, 25 bp, Mus musculus
gtccacagcaaaggattgaagctag

SEQ ID NO: 455673 - DNA, 25 bp, Mus musculus
gtccacagggaaacggaagatcact

SEQ ID NO: 455674 - DNA, 25 bp, Mus musculus
gtccacagggagagatgcaaacagt

SEQ ID NO: 455675 - DNA, 25 bp, Mus musculus
gtccacgctgtctatgccatcaagg

SEQ ID NO: 455676 - DNA, 25 bp, Mus musculus
gtccactgtagtgggcagagtctgt

SEQ ID NO: 455677 - DNA, 25 bp, Mus musculus
gtccagccggcactctacagagaaa

SEQ ID NO: 455678 - DNA, 25 bp, Mus musculus
gtccaggagccaaagccgagaaggt

SEQ ID NO: 455679 - DNA, 25 bp, Mus musculus
gtccagggtagatatagacctccag

SEQ ID NO: 455680 - DNA, 25 bp, Mus musculus
gtccagtccgccgaaaacagcttta

SEQ ID NO: 455681 - DNA, 25 bp, Mus musculus
gtccagtgagttaggacacagggca

SEQ ID NO: 455682 - DNA, 25 bp, Mus musculus
gtccagtgctcacatgacccaaggg

SEQ ID NO: 455683 - DNA, 25 bp, Mus musculus
gtccagtttggtgagctgacatcca

SEQ ID NO: 455684 - DNA, 25 bp, Mus musculus
gtccatagcgttctcccgagcggtg

SEQ ID NO: 455685 - DNA, 25 bp, Mus musculus
gtccatcagatacggttaccagagg

SEQ ID NO: 455686 - DNA, 25 bp, Mus musculus
gtccatcaggagcatcgggtcccat

SEQ ID NO: 455687 - DNA, 25 bp, Mus musculus
gtccatccgaggtggttggctgccc

SEQ ID NO: 455688 - DNA, 25 bp, Mus musculus
gtccatcttcttcattctactgctg

SEQ ID NO: 455689 - DNA, 25 bp, Mus musculus
gtccatggtgttcacaggagaacag

SEQ ID NO: 455690 - DNA, 25 bp, Mus musculus
gtccatggttggctgaatctgtaaa

SEQ ID NO: 455691 - DNA, 25 bp, Mus musculus
gtccattgacttgggagcctgtcca

SEQ ID NO: 455692 - DNA, 25 bp, Mus musculus
gtccattgcttcagtacgtcctcag

SEQ ID NO: 455693 - DNA, 25 bp, Mus musculus
gtcccaacctggtggctctccatgg

SEQ ID NO: 455694 - DNA, 25 bp, Mus musculus
gtcccaagaagaaccatgaatttag

SEQ ID NO: 455695 - DNA, 25 bp, Mus musculus
gtcccagcccagatccaaggaacga

SEQ ID NO: 455696 - DNA, 25 bp, Mus musculus
gtcccagctgggaaaaagagtccca

SEQ ID NO: 455697 - DNA, 25 bp, Mus musculus
gtcccaggtcgctggcaggctcagc

SEQ ID NO: 455698 - DNA, 25 bp, Mus musculus
gtcccagttctaggcgcttccagtg

SEQ ID NO: 455699 - DNA, 25 bp, Mus musculus
gtcccatagtgataataaagactgg

SEQ ID NO: 455700 - DNA, 25 bp, Mus musculus
gtcccatggtggtagattctcttct

SEQ ID NO: 455701 - DNA, 25 bp, Mus musculus
gtccccgagtcccaaagaaagcaag

SEQ ID NO: 455702 - DNA, 25 bp, Mus musculus
gtccccgcaggctgctccttcggcg

SEQ ID NO: 455703 - DNA, 25 bp, Mus musculus
gtcccctctagcctaaggtcagtag

SEQ ID NO: 455704 - DNA, 25 bp, Mus musculus
gtcccctgtaaacttagatgctgtg

SEQ ID NO: 455705 - DNA, 25 bp, Mus musculus
gtcccgccttgcagagttacttggt

SEQ ID NO: 455706 - DNA, 25 bp, Mus musculus
gtcccggaacaggatcccaaatgca

SEQ ID NO: 455707 - DNA, 25 bp, Mus musculus
gtcccggccagagcgcgaaaggaca

SEQ ID NO: 455708 - DNA, 25 bp, Mus musculus
gtcccgtggaacctgggtctagcca

SEQ ID NO: 455709 - DNA, 25 bp, Mus musculus
gtccctaaggatcccgctacctggt

SEQ ID NO: 455710 - DNA, 25 bp, Mus musculus
gtccctagccatggactcgcagaaa

SEQ ID NO: 455711 - DNA, 25 bp, Mus musculus
gtccctagggcgacaccgtgcctta

SEQ ID NO: 455712 - DNA, 25 bp, Mus musculus
gtccctatagtgcagcaaagaggaa

SEQ ID NO: 455713 - DNA, 25 bp, Mus musculus
gtccctctgaaaatgtggcgcccag

SEQ ID NO: 455714 - DNA, 25 bp, Mus musculus
gtccctctgcagtatgtggccactc

SEQ ID NO: 455715 - DNA, 25 bp, Mus musculus
gtccctctgcatgaacaagttgatt

SEQ ID NO: 455716 - DNA, 25 bp, Mus musculus
gtccctgctaggacggccttacact

SEQ ID NO: 455717 - DNA, 25 bp, Mus musculus
gtccctggcacagagtgaacactcg

SEQ ID NO: 455718 - DNA, 25 bp, Mus musculus
gtccctgtaggcacaagggcaccac

SEQ ID NO: 455719 - DNA, 25 bp, Mus musculus
gtcccttagactggttgcatagaaa

SEQ ID NO: 455720 - DNA, 25 bp, Mus musculus
gtccctttcaggatccagacttaag

SEQ ID NO: 455721 - DNA, 25 bp, Mus musculus
gtccgacccagagtgtggcgctcat

SEQ ID NO: 455722 - DNA, 25 bp, Mus musculus
gtccgactcacagggctgtctttgt

SEQ ID NO: 455723 - DNA, 25 bp, Mus musculus
gtccgctcacgctggctactcggaa

SEQ ID NO: 455724 - DNA, 25 bp, Mus musculus
gtccggatcagcacggcttacctgt

SEQ ID NO: 455725 - DNA, 25 bp, Mus musculus
gtccggctcctttccttgaagattt

SEQ ID NO: 455726 - DNA, 25 bp, Mus musculus
gtccgggcagctgctcgccgaagtt

SEQ ID NO: 455727 - DNA, 25 bp, Mus musculus
gtccggttatccgtggcacagcctg

SEQ ID NO: 455728 - DNA, 25 bp, Mus musculus
gtccgtgcccatcgccaaaaagtgg

SEQ ID NO: 455729 - DNA, 25 bp, Mus musculus
gtcctaagggattcctttctcggca

SEQ ID NO: 455730 - DNA, 25 bp, Mus musculus
gtcctacctatatttcttcccggtg

SEQ ID NO: 455731 - DNA, 25 bp, Mus musculus
gtcctactttgatttccggtcctca

SEQ ID NO: 455732 - DNA, 25 bp, Mus musculus
gtcctagtctgagtataccctgctg

SEQ ID NO: 455733 - DNA, 25 bp, Mus musculus
gtcctcaaaagcctcgccggagaag

SEQ ID NO: 455734 - DNA, 25 bp, Mus musculus
gtcctcaaataccttctcaaggcag

SEQ ID NO: 455735 - DNA, 25 bp, Mus musculus
gtcctcaaatgccagacttaccaga

SEQ ID NO: 455736 - DNA, 25 bp, Mus musculus
gtcctcacgtccttttttcctatag

SEQ ID NO: 455737 - DNA, 25 bp, Mus musculus
gtcctcagctttctgcctgtgcttc

SEQ ID NO: 455738 - DNA, 25 bp, Mus musculus
gtcctcccggcaacgtcagagaagg

SEQ ID NO: 455739 - DNA, 25 bp, Mus musculus
gtcctccttagtctatcatagatag

SEQ ID NO: 455740 - DNA, 25 bp, Mus musculus
gtcctctggacagggatccattcaa

SEQ ID NO: 455741 - DNA, 25 bp, Mus musculus
gtcctgacagtgtctgtattttgaa

SEQ ID NO: 455742 - DNA, 25 bp, Mus musculus
gtcctgactctgctgtgggaagaca

SEQ ID NO: 455743 - DNA, 25 bp, Mus musculus
gtcctgcaccagatgttgtctcaga

SEQ ID NO: 455744 - DNA, 25 bp, Mus musculus
gtcctgcactgagcttattcatcca

SEQ ID NO: 455745 - DNA, 25 bp, Mus musculus
gtcctgcagctatccaaagaaccgt

SEQ ID NO: 455746 - DNA, 25 bp, Mus musculus
gtcctgcgcggaggagggtcctggg

SEQ ID NO: 455747 - DNA, 25 bp, Mus musculus
gtcctgctcgcagacaggaagtggc

SEQ ID NO: 455748 - DNA, 25 bp, Mus musculus
gtccttaaggaaacagaccagcctt

SEQ ID NO: 455749 - DNA, 25 bp, Mus musculus
gtccttacagtaagaccgtggtttg

SEQ ID NO: 455750 - DNA, 25 bp, Mus musculus
gtccttagactgcacagcagaacag

SEQ ID NO: 455751 - DNA, 25 bp, Mus musculus
gtccttcacaagaaacagttcacca

SEQ ID NO: 455752 - DNA, 25 bp, Mus musculus
gtccttcctctgaagaactctctgc

SEQ ID NO: 455753 - DNA, 25 bp, Mus musculus
gtccttctgactttatcaagccggg

SEQ ID NO: 455754 - DNA, 25 bp, Mus musculus
gtcctttgcaagagcggcctgtgat

SEQ ID NO: 455755 - DNA, 25 bp, Mus musculus
gtcgaagagtcttctgctggtcccc

SEQ ID NO: 455756 - DNA, 25 bp, Mus musculus
gtcgacgaacgcagagaagcgcgca

SEQ ID NO: 455757 - DNA, 25 bp, Mus musculus
gtcgaggtgcacacagcagtgttct

SEQ ID NO: 455758 - DNA, 25 bp, Mus musculus
gtcgagttcgaagctccaagcggcc

SEQ ID NO: 455759 - DNA, 25 bp, Mus musculus
gtcgatagcgacagacccgaagggt

SEQ ID NO: 455760 - DNA, 25 bp, Mus musculus
gtcgatgctgtacgtctcttatccc

SEQ ID NO: 455761 - DNA, 25 bp, Mus musculus
gtcgcacctatgtcctgcctgcaga

SEQ ID NO: 455762 - DNA, 25 bp, Mus musculus
gtcgcactcagcaacaggttccaag

SEQ ID NO: 455763 - DNA, 25 bp, Mus musculus
gtcgcagagccagctacgacacgag

SEQ ID NO: 455764 - DNA, 25 bp, Mus musculus
gtcgccaagctttcgtcaggtccag

SEQ ID NO: 455765 - DNA, 25 bp, Mus musculus
gtcgccagcatctttgtgccactag

SEQ ID NO: 455766 - DNA, 25 bp, Mus musculus
gtcgccatgccggagaacgtagctt

SEQ ID NO: 455767 - DNA, 25 bp, Mus musculus
gtcgcgcgtcccagtcgcagtggtc

SEQ ID NO: 455768 - DNA, 25 bp, Mus musculus
gtcgctcccgacagaactgaatgta

SEQ ID NO: 455769 - DNA, 25 bp, Mus musculus
gtcgctgccttctcaacagcaggca

SEQ ID NO: 455770 - DNA, 25 bp, Mus musculus
gtcgctgtgtctccggagcctgtca

SEQ ID NO: 455771 - DNA, 25 bp, Mus musculus
gtcggaaagtatcctgcttgcatgc

SEQ ID NO: 455772 - DNA, 25 bp, Mus musculus
gtcggaaggcagtctacccagtcgt

SEQ ID NO: 455773 - DNA, 25 bp, Mus musculus
gtcggaatgaagttgtcggtttaat

SEQ ID NO: 455774 - DNA, 25 bp, Mus musculus
gtcggcaaactgacttacctctgct

SEQ ID NO: 455775 - DNA, 25 bp, Mus musculus
gtcggcacctgagggaaggtcccca

SEQ ID NO: 455776 - DNA, 25 bp, Mus musculus
gtcggcatccaccataagcatttgt

SEQ ID NO: 455777 - DNA, 25 bp, Mus musculus
gtcggccgagttggcactccgcgat

SEQ ID NO: 455778 - DNA, 25 bp, Mus musculus
gtcggcctgggagatcgttttaaga

SEQ ID NO: 455779 - DNA, 25 bp, Mus musculus
gtcggccttgctctcgatatcgacc

SEQ ID NO: 455780 - DNA, 25 bp, Mus musculus
gtcggcgtcgcagggtgggagaagc

SEQ ID NO: 455781 - DNA, 25 bp, Mus musculus
gtcggcttatcccaggtcccggtca

SEQ ID NO: 455782 - DNA, 25 bp, Mus musculus
gtcggtccctcacagagtggcccgt

SEQ ID NO: 455783 - DNA, 25 bp, Mus musculus
gtcggtgcacaaggcgcagagtcct

SEQ ID NO: 455784 - DNA, 25 bp, Mus musculus
gtcggttcttcagtatcttctggaa

SEQ ID NO: 455785 - DNA, 25 bp, Mus musculus
gtcgtaaatacatggctcgtctaat

SEQ ID NO: 455786 - DNA, 25 bp, Mus musculus
gtcgtagatcctctccgtggccaga

SEQ ID NO: 455787 - DNA, 25 bp, Mus musculus
gtcgtctgctgctcccgggccgtga

SEQ ID NO: 455788 - DNA, 25 bp, Mus musculus
gtcgtctggtgagcgccatcgtgct

SEQ ID NO: 455789 - DNA, 25 bp, Mus musculus
gtcgtctggtttcccttctgcaaag

SEQ ID NO: 455790 - DNA, 25 bp, Mus musculus
gtcgtctttccaggtaatacaagtg

SEQ ID NO: 455791 - DNA, 25 bp, Mus musculus
gtcgtgaccactgagcaactgctgc

SEQ ID NO: 455792 - DNA, 25 bp, Mus musculus
gtcgtgagaaaaaggtgcccggcca

SEQ ID NO: 455793 - DNA, 25 bp, Mus musculus
gtcgtgagctcacaatgctgccgtg

SEQ ID NO: 455794 - DNA, 25 bp, Mus musculus
gtcgtgcacgaggtgacccaggcct

SEQ ID NO: 455795 - DNA, 25 bp, Mus musculus
gtcgtggagacaccaggcctagact

SEQ ID NO: 455796 - DNA, 25 bp, Mus musculus
gtcgtggagtgacccctcctgcagt

SEQ ID NO: 455797 - DNA, 25 bp, Mus musculus
gtcgtggccgaatctccgcttgcga

SEQ ID NO: 455798 - DNA, 25 bp, Mus musculus
gtcgtggtccaatgttgtttactac

SEQ ID NO: 455799 - DNA, 25 bp, Mus musculus
gtctaagagtatggagaaacccacc

SEQ ID NO: 455800 - DNA, 25 bp, Mus musculus
gtctacccagatgtttggcttggga

SEQ ID NO: 455801 - DNA, 25 bp, Mus musculus
gtctacctcccgtggtgattccata

SEQ ID NO: 455802 - DNA, 25 bp, Mus musculus
gtctactgaccatggaacagatcat

SEQ ID NO: 455803 - DNA, 25 bp, Mus musculus
gtctactgtttcatgcaccgccgat

SEQ ID NO: 455804 - DNA, 25 bp, Mus musculus
gtctagagacccagacgctcgggat

SEQ ID NO: 455805 - DNA, 25 bp, Mus musculus
gtctagagcttctccaccgtgggaa

SEQ ID NO: 455806 - DNA, 25 bp, Mus musculus
gtctagccggcttccggcagagcga

SEQ ID NO: 455807 - DNA, 25 bp, Mus musculus
gtctagctgtctggtgggcacccaa

SEQ ID NO: 455808 - DNA, 25 bp, Mus musculus
gtctaggagactgtgaagtccaggc

SEQ ID NO: 455809 - DNA, 25 bp, Mus musculus
gtctaggagcctcgcagcctcacgt

SEQ ID NO: 455810 - DNA, 25 bp, Mus musculus
gtctataaaactttacgtggctcaa

SEQ ID NO: 455811 - DNA, 25 bp, Mus musculus
gtctatctaagaaataccgccagga

SEQ ID NO: 455812 - DNA, 25 bp, Mus musculus
gtctatgtagcgaacccctgtctca

SEQ ID NO: 455813 - DNA, 25 bp, Mus musculus
gtctcaacaaattccaaatcgatgg

SEQ ID NO: 455814 - DNA, 25 bp, Mus musculus
gtctcaccttgctgtctctgacagg

SEQ ID NO: 455815 - DNA, 25 bp, Mus musculus
gtctcagcaatctgttccggaggaa

SEQ ID NO: 455816 - DNA, 25 bp, Mus musculus
gtctcaggagacaatcaccataggg

SEQ ID NO: 455817 - DNA, 25 bp, Mus musculus
gtctcaggctcacttctgccaggga

SEQ ID NO: 455818 - DNA, 25 bp, Mus musculus
gtctcagtgtgacatggacagtaac

SEQ ID NO: 455819 - DNA, 25 bp, Mus musculus
gtctcatccacctggtaacctacat

SEQ ID NO: 455820 - DNA, 25 bp, Mus musculus
gtctcatgccagctatacatactgc

SEQ ID NO: 455821 - DNA, 25 bp, Mus musculus
gtctcattattctcaggacgaagtg

SEQ ID NO: 455822 - DNA, 25 bp, Mus musculus
gtctccaaggtaacggcaactctcc

SEQ ID NO: 455823 - DNA, 25 bp, Mus musculus
gtctccagacgggaacagagtttga

SEQ ID NO: 455824 - DNA, 25 bp, Mus musculus
gtctccattgtaccacctggcctta

SEQ ID NO: 455825 - DNA, 25 bp, Mus musculus
gtctcccagacagtaaggttacagg

SEQ ID NO: 455826 - DNA, 25 bp, Mus musculus
gtctccctgtcctgcaagtcaatca

SEQ ID NO: 455827 - DNA, 25 bp, Mus musculus
gtctccctttctgtgctgttcttgg

SEQ ID NO: 455828 - DNA, 25 bp, Mus musculus
gtctccgcaggagccggatctcgag

SEQ ID NO: 455829 - DNA, 25 bp, Mus musculus
gtctcctacttgttaatgacccaga

SEQ ID NO: 455830 - DNA, 25 bp, Mus musculus
gtctcctccgtgacacatgcacggg

SEQ ID NO: 455831 - DNA, 25 bp, Mus musculus
gtctcctgccagagtggaacagctg

SEQ ID NO: 455832 - DNA, 25 bp, Mus musculus
gtctcgaggagctggacatgcacgt

SEQ ID NO: 455833 - DNA, 25 bp, Mus musculus
gtctcgatcccacagaccggaaggg

SEQ ID NO: 455834 - DNA, 25 bp, Mus musculus
gtctctaaagatctgtggtgtcctg

SEQ ID NO: 455835 - DNA, 25 bp, Mus musculus
gtctctatacctacaactgctcagt

SEQ ID NO: 455836 - DNA, 25 bp, Mus musculus
gtctctccgtttgcagaaattctcc

SEQ ID NO: 455837 - DNA, 25 bp, Mus musculus
gtctctctaagcatgatgactcaga

SEQ ID NO: 455838 - DNA, 25 bp, Mus musculus
gtctctctaaggaagcagagcggaa

SEQ ID NO: 455839 - DNA, 25 bp, Mus musculus
gtctctgccgggactaactgccaag

SEQ ID NO: 455840 - DNA, 25 bp, Mus musculus
gtctctgctactggtgtgcagtttg

SEQ ID NO: 455841 - DNA, 25 bp, Mus musculus
gtctcttatcaattgcacgtctatg

SEQ ID NO: 455842 - DNA, 25 bp, Mus musculus
gtctcttggtagtgacagaagggtc

SEQ ID NO: 455843 - DNA, 25 bp, Mus musculus
gtctgaaacacttcaacttatcaag

SEQ ID NO: 455844 - DNA, 25 bp, Mus musculus
gtctgaaatgccttccgagccggga

SEQ ID NO: 455845 - DNA, 25 bp, Mus musculus
gtctgaaggagtgcaaagcccggca

SEQ ID NO: 455846 - DNA, 25 bp, Mus musculus
gtctgaataaaaccaggtcctctct

SEQ ID NO: 455847 - DNA, 25 bp, Mus musculus
gtctgacctagagggcggcaccttc

SEQ ID NO: 455848 - DNA, 25 bp, Mus musculus
gtctgaccttaagcccagcatcgaa

SEQ ID NO: 455849 - DNA, 25 bp, Mus musculus
gtctgacgatctggacaacctcaag

SEQ ID NO: 455850 - DNA, 25 bp, Mus musculus
gtctgagaagcaaagtaacggctat

SEQ ID NO: 455851 - DNA, 25 bp, Mus musculus
gtctgagagattatttgggatattc

SEQ ID NO: 455852 - DNA, 25 bp, Mus musculus
gtctgagccatgctaccaccaaggg

SEQ ID NO: 455853 - DNA, 25 bp, Mus musculus
gtctgaggcgtcaacatcaccaaaa

SEQ ID NO: 455854 - DNA, 25 bp, Mus musculus
gtctgcaaggcagatcagcatcttg

SEQ ID NO: 455855 - DNA, 25 bp, Mus musculus
gtctgcaatggaggctctaggaccg

SEQ ID NO: 455856 - DNA, 25 bp, Mus musculus
gtctgcacctgcaaggtatggctgc

SEQ ID NO: 455857 - DNA, 25 bp, Mus musculus
gtctgcccatgccaatcgacgtggt

SEQ ID NO: 455858 - DNA, 25 bp, Mus musculus
gtctgcgaccgccagttcgactgcg

SEQ ID NO: 455859 - DNA, 25 bp, Mus musculus
gtctgctaagcaagaactataccat

SEQ ID NO: 455860 - DNA, 25 bp, Mus musculus
gtctgctacgatgaggcctttccca

SEQ ID NO: 455861 - DNA, 25 bp, Mus musculus
gtctgctacttggaatgcaactcta

SEQ ID NO: 455862 - DNA, 25 bp, Mus musculus
gtctgctgcccacaggtgacctgtc

SEQ ID NO: 455863 - DNA, 25 bp, Mus musculus
gtctgctgccgctgaggttctctgg

SEQ ID NO: 455864 - DNA, 25 bp, Mus musculus
gtctgctgtgccttggagtcttcag

SEQ ID NO: 455865 - DNA, 25 bp, Mus musculus
gtctgcttaggtggttggctatccc

SEQ ID NO: 455866 - DNA, 25 bp, Mus musculus
gtctggaaattctcatagtacctca

SEQ ID NO: 455867 - DNA, 25 bp, Mus musculus
gtctggacaagagcatcacgctgcc

SEQ ID NO: 455868 - DNA, 25 bp, Mus musculus
gtctggagagcccaattgcctgctc

SEQ ID NO: 455869 - DNA, 25 bp, Mus musculus
gtctggagccatggcctggacgtct

SEQ ID NO: 455870 - DNA, 25 bp, Mus musculus
gtctggatccagcacctttcctcag

SEQ ID NO: 455871 - DNA, 25 bp, Mus musculus
gtctggccctaatgcctgcagcact

SEQ ID NO: 455872 - DNA, 25 bp, Mus musculus
gtctggctcctagcagtctttggtc

SEQ ID NO: 455873 - DNA, 25 bp, Mus musculus
gtctgggaaaggcaaacactaggtt

SEQ ID NO: 455874 - DNA, 25 bp, Mus musculus
gtctgggatctagcgcttcggctcg

SEQ ID NO: 455875 - DNA, 25 bp, Mus musculus
gtctgggccctttcttcctaaagtg

SEQ ID NO: 455876 - DNA, 25 bp, Mus musculus
gtctgggttagaaagcggtgcctcc

SEQ ID NO: 455877 - DNA, 25 bp, Mus musculus
gtctggttaacaacgctggcctcaa

SEQ ID NO: 455878 - DNA, 25 bp, Mus musculus
gtctggttcattcggctctcaaagg

SEQ ID NO: 455879 - DNA, 25 bp, Mus musculus
gtctgtaagcttagttaaaacctgc

SEQ ID NO: 455880 - DNA, 25 bp, Mus musculus
gtctgtagagggtcgctccgctagc

SEQ ID NO: 455881 - DNA, 25 bp, Mus musculus
gtctgtcaacagaatagtcctcaca

SEQ ID NO: 455882 - DNA, 25 bp, Mus musculus
gtctgtcactgttggctgcttcgcc

SEQ ID NO: 455883 - DNA, 25 bp, Mus musculus
gtctgtctagaaggccactggccac

SEQ ID NO: 455884 - DNA, 25 bp, Mus musculus
gtctgtctcagaggaatctggaaaa

SEQ ID NO: 455885 - DNA, 25 bp, Mus musculus
gtctgtctctcatcttgccaaggag

SEQ ID NO: 455886 - DNA, 25 bp, Mus musculus
gtctgtggcttatgaagtctgtcta

SEQ ID NO: 455887 - DNA, 25 bp, Mus musculus
gtctgtggtagtgtgtctgctgctc

SEQ ID NO: 455888 - DNA, 25 bp, Mus musculus
gtctgttttctgcttgccagctgag

SEQ ID NO: 455889 - DNA, 25 bp, Mus musculus
gtcttaaattctttgtagccaagga

SEQ ID NO: 455890 - DNA, 25 bp, Mus musculus
gtcttacatacacctaaaaacatgg

SEQ ID NO: 455891 - DNA, 25 bp, Mus musculus
gtcttacggtgtcctacagttgcca

SEQ ID NO: 455892 - DNA, 25 bp, Mus musculus
gtcttcaagggacgcagcaagctga

SEQ ID NO: 455893 - DNA, 25 bp, Mus musculus
gtcttcacatactgcaagtccaggg

SEQ ID NO: 455894 - DNA, 25 bp, Mus musculus
gtcttcatcctctggctttgtggat

SEQ ID NO: 455895 - DNA, 25 bp, Mus musculus
gtcttcatggtggtcacggccgtca

SEQ ID NO: 455896 - DNA, 25 bp, Mus musculus
gtcttccaagttcaatgacatcgta

SEQ ID NO: 455897 - DNA, 25 bp, Mus musculus
gtcttccacgtggattgcttcacct

SEQ ID NO: 455898 - DNA, 25 bp, Mus musculus
gtcttccaggaggagaacaaggccc

SEQ ID NO: 455899 - DNA, 25 bp, Mus musculus
gtcttccaggatcgcgtgcctgcca

SEQ ID NO: 455900 - DNA, 25 bp, Mus musculus
gtcttcccgcagaaggagaggcgcc

SEQ ID NO: 455901 - DNA, 25 bp, Mus musculus
gtcttccctcacagctaaaacacag

SEQ ID NO: 455902 - DNA, 25 bp, Mus musculus
gtcttctaaagcttcaggtccccag

SEQ ID NO: 455903 - DNA, 25 bp, Mus musculus
gtcttctatgcatacatcagtcagg

SEQ ID NO: 455904 - DNA, 25 bp, Mus musculus
gtcttcttgctacacagctgtcttg

SEQ ID NO: 455905 - DNA, 25 bp, Mus musculus
gtcttctttgttaggagtctcgctc

SEQ ID NO: 455906 - DNA, 25 bp, Mus musculus
gtcttgaatagctgctgggccaccc

SEQ ID NO: 455907 - DNA, 25 bp, Mus musculus
gtcttgatgtctagaagtgagccta

SEQ ID NO: 455908 - DNA, 25 bp, Mus musculus
gtcttgccagagaactcaactccgg

SEQ ID NO: 455909 - DNA, 25 bp, Mus musculus
gtcttgctggatgcgcagtgatgtc

SEQ ID NO: 455910 - DNA, 25 bp, Mus musculus
gtcttggatttgctacacacatgga

SEQ ID NO: 455911 - DNA, 25 bp, Mus musculus
gtcttgggcatctcacggcctcatt

SEQ ID NO: 455912 - DNA, 25 bp, Mus musculus
gtcttggtatcttgatggacagatg

SEQ ID NO: 455913 - DNA, 25 bp, Mus musculus
gtcttggtattttaagtgaaggcaa

SEQ ID NO: 455914 - DNA, 25 bp, Mus musculus
gtcttgtgttatagctcagtagtcc

SEQ ID NO: 455915 - DNA, 25 bp, Mus musculus
gtcttgttagacattggcccaccct

SEQ ID NO: 455916 - DNA, 25 bp, Mus musculus
gtctttaagtgtacatgtttggaaa

SEQ ID NO: 455917 - DNA, 25 bp, Mus musculus
gtctttacactatgagggccgcgcg

SEQ ID NO: 455918 - DNA, 25 bp, Mus musculus
gtctttctgtgcagttatggtagcc

SEQ ID NO: 455919 - DNA, 25 bp, Mus musculus
gtctttgaattcttccaaaactgaa

SEQ ID NO: 455920 - DNA, 25 bp, Mus musculus
gtctttgagggccatgtttccacag

SEQ ID NO: 455921 - DNA, 25 bp, Mus musculus
gtctttgcatcagctttggaggtaa

SEQ ID NO: 455922 - DNA, 25 bp, Mus musculus
gtctttgcctgatgagaagccagtg

SEQ ID NO: 455923 - DNA, 25 bp, Mus musculus
gtcttttagcagtcatgtcttagta

SEQ ID NO: 455924 - DNA, 25 bp, Mus musculus
gtctttttaaacactcctgaacagc

SEQ ID NO: 455925 - DNA, 25 bp, Mus musculus
gtctttttgcagaacccagattcca

SEQ ID NO: 455926 - DNA, 25 bp, Mus musculus
gtgaaaacacagaagtaacgtccgg

SEQ ID NO: 455927 - DNA, 25 bp, Mus musculus
gtgaaacaatatctgcctccatggc

SEQ ID NO: 455928 - DNA, 25 bp, Mus musculus
gtgaaagcaagtgaccgcgggcctt

SEQ ID NO: 455929 - DNA, 25 bp, Mus musculus
gtgaaatacacataggcggccagga

SEQ ID NO: 455930 - DNA, 25 bp, Mus musculus
gtgaacaaaagtgtccgcatcctcg

SEQ ID NO: 455931 - DNA, 25 bp, Mus musculus
gtgaacaacacatcttgcagtctta

SEQ ID NO: 455932 - DNA, 25 bp, Mus musculus
gtgaacaatctcaacgccaccgagg

SEQ ID NO: 455933 - DNA, 25 bp, Mus musculus
gtgaacactacctgcggcccagcgt

SEQ ID NO: 455934 - DNA, 25 bp, Mus musculus
gtgaacagcaacaatgaccgaggtg

SEQ ID NO: 455935 - DNA, 25 bp, Mus musculus
gtgaaccaggcagagcttaccggag

SEQ ID NO: 455936 - DNA, 25 bp, Mus musculus
gtgaacccaacaactccagaatccg

SEQ ID NO: 455937 - DNA, 25 bp, Mus musculus
gtgaaccccgtgtgctatgccctgt

SEQ ID NO: 455938 - DNA, 25 bp, Mus musculus
gtgaacctcctcgttcctgttgtgt

SEQ ID NO: 455939 - DNA, 25 bp, Mus musculus
gtgaactccggtccgttagtgcccg

SEQ ID NO: 455940 - DNA, 25 bp, Mus musculus
gtgaactctggactcacctcctgca

SEQ ID NO: 455941 - DNA, 25 bp, Mus musculus
gtgaacttcatgagcagacctacag

SEQ ID NO: 455942 - DNA, 25 bp, Mus musculus
gtgaacttttttctggcctcaaatg

SEQ ID NO: 455943 - DNA, 25 bp, Mus musculus
gtgaagatcagtttccagcccgcgg

SEQ ID NO: 455944 - DNA, 25 bp, Mus musculus
gtgaagatgacggtgcccaggacac

SEQ ID NO: 455945 - DNA, 25 bp, Mus musculus
gtgaagcagatcaacaagcgggcct

SEQ ID NO: 455946 - DNA, 25 bp, Mus musculus
gtgaagccccatccaacagtacaaa

SEQ ID NO: 455947 - DNA, 25 bp, Mus musculus
gtgaagcccttacccgtggaacaga

SEQ ID NO: 455948 - DNA, 25 bp, Mus musculus
gtgaagcctgctgaggagcctctaa

SEQ ID NO: 455949 - DNA, 25 bp, Mus musculus
gtgaagctactaaaccccatgttgg

SEQ ID NO: 455950 - DNA, 25 bp, Mus musculus
gtgaagtccttgtacctgggccgca

SEQ ID NO: 455951 - DNA, 25 bp, Mus musculus
gtgaagtctggtgagtatggccacc

SEQ ID NO: 455952 - DNA, 25 bp, Mus musculus
gtgaatcgatttactaccagcatgc

SEQ ID NO: 455953 - DNA, 25 bp, Mus musculus
gtgaatctaagcaaaaaggcagtat

SEQ ID NO: 455954 - DNA, 25 bp, Mus musculus
gtgaatggtaaaaatctttgctgct

SEQ ID NO: 455955 - DNA, 25 bp, Mus musculus
gtgaatgtcttgttgtgaatcaaag

SEQ ID NO: 455956 - DNA, 25 bp, Mus musculus
gtgaattacagcaaatctctgtttt

SEQ ID NO: 455957 - DNA, 25 bp, Mus musculus
gtgaattcacctctccagctaccag

SEQ ID NO: 455958 - DNA, 25 bp, Mus musculus
gtgacaaaagccctgcagcatcggt

SEQ ID NO: 455959 - DNA, 25 bp, Mus musculus
gtgacaaatgaccatggacctgtct

SEQ ID NO: 455960 - DNA, 25 bp, Mus musculus
gtgacaagctgtccaaagatcccgt

SEQ ID NO: 455961 - DNA, 25 bp, Mus musculus
gtgacaattcccaaggaccctcggg

SEQ ID NO: 455962 - DNA, 25 bp, Mus musculus
gtgacacacgctgagccccagaagt

SEQ ID NO: 455963 - DNA, 25 bp, Mus musculus
gtgacacccagcacgtactcctgtg

SEQ ID NO: 455964 - DNA, 25 bp, Mus musculus
gtgacactctgaacgtactcccggg

SEQ ID NO: 455965 - DNA, 25 bp, Mus musculus
gtgacacttgagtccccagcagagc

SEQ ID NO: 455966 - DNA, 25 bp, Mus musculus
gtgacagacaagtggcctcatactg

SEQ ID NO: 455967 - DNA, 25 bp, Mus musculus
gtgacagatcacctagacctggagt

SEQ ID NO: 455968 - DNA, 25 bp, Mus musculus
gtgacagatttctacccagccaaga

SEQ ID NO: 455969 - DNA, 25 bp, Mus musculus
gtgacagcgccctaaggccggacta

SEQ ID NO: 455970 - DNA, 25 bp, Mus musculus
gtgacagcgggacccaaggactcta

SEQ ID NO: 455971 - DNA, 25 bp, Mus musculus
gtgacagggccaagccagaggctct

SEQ ID NO: 455972 - DNA, 25 bp, Mus musculus
gtgacagtcactctttccatatctt

SEQ ID NO: 455973 - DNA, 25 bp, Mus musculus
gtgacagtctcgtcgccatccttga

SEQ ID NO: 455974 - DNA, 25 bp, Mus musculus
gtgacagtgagagtgacgacagttc

SEQ ID NO: 455975 - DNA, 25 bp, Mus musculus
gtgacagtgtctggatcctccctgc

SEQ ID NO: 455976 - DNA, 25 bp, Mus musculus
gtgacataagtcatctgctgtgttc

SEQ ID NO: 455977 - DNA, 25 bp, Mus musculus
gtgacatcaggtgccctagctaccg

SEQ ID NO: 455978 - DNA, 25 bp, Mus musculus
gtgacatgctgttgaacaacacagg

SEQ ID NO: 455979 - DNA, 25 bp, Mus musculus
gtgaccaaacccacctcagatgagg

SEQ ID NO: 455980 - DNA, 25 bp, Mus musculus
gtgaccaatggtgttcgtgccgccc

SEQ ID NO: 455981 - DNA, 25 bp, Mus musculus
gtgaccactcaatgctggagcagtg

SEQ ID NO: 455982 - DNA, 25 bp, Mus musculus
gtgaccaggtgggacgcctcctttt

SEQ ID NO: 455983 - DNA, 25 bp, Mus musculus
gtgacccagtgggttaaagagctgt

SEQ ID NO: 455984 - DNA, 25 bp, Mus musculus
gtgacccctggctcaacggaagaaa

SEQ ID NO: 455985 - DNA, 25 bp, Mus musculus
gtgacccctgtaaaaggtcagtcaa

SEQ ID NO: 455986 - DNA, 25 bp, Mus musculus
gtgacccgggcaagatcaagcggct

SEQ ID NO: 455987 - DNA, 25 bp, Mus musculus
gtgaccctgttgttggcagtgccta

SEQ ID NO: 455988 - DNA, 25 bp, Mus musculus
gtgaccgccatcaaagctgccttgg

SEQ ID NO: 455989 - DNA, 25 bp, Mus musculus
gtgacctacaaacaagacctgtgtg

SEQ ID NO: 455990 - DNA, 25 bp, Mus musculus
gtgacctcgaatgcagtacctctga

SEQ ID NO: 455991 - DNA, 25 bp, Mus musculus
gtgacctctgacaaatccgctcatt

SEQ ID NO: 455992 - DNA, 25 bp, Mus musculus
gtgacctggctttgattgtatttac

SEQ ID NO: 455993 - DNA, 25 bp, Mus musculus
gtgacctgtcatcccgcagagagaa

SEQ ID NO: 455994 - DNA, 25 bp, Mus musculus
gtgacgaaaatcagcacactgctca

SEQ ID NO: 455995 - DNA, 25 bp, Mus musculus
gtgactccaataccaagagctccag

SEQ ID NO: 455996 - DNA, 25 bp, Mus musculus
gtgactccacttttgacccttggcg

SEQ ID NO: 455997 - DNA, 25 bp, Mus musculus
gtgactccagctttgagacagccct

SEQ ID NO: 455998 - DNA, 25 bp, Mus musculus
gtgactcggcactcgcagctccggg

SEQ ID NO: 455999 - DNA, 25 bp, Mus musculus
gtgactcttcaattctctcagcgag

SEQ ID NO: 456000 - DNA, 25 bp, Mus musculus
gtgactggcaagaagcacccgtgct

SEQ ID NO: 456001 - DNA, 25 bp, Mus musculus
gtgactgtaacctcgaacacctggc

SEQ ID NO: 456002 - DNA, 25 bp, Mus musculus
gtgactgtcccattctgactcacca

SEQ ID NO: 456003 - DNA, 25 bp, Mus musculus
gtgacttctgggatccttttgcaac

SEQ ID NO: 456004 - DNA, 25 bp, Mus musculus
gtgacttcttatgatcctctacgga

SEQ ID NO: 456005 - DNA, 25 bp, Mus musculus
gtgactttcagatacgacggcgcca

SEQ ID NO: 456006 - DNA, 25 bp, Mus musculus
gtgactttgcctcccagggtgacca

SEQ ID NO: 456007 - DNA, 25 bp, Mus musculus
gtgagaaagagagaatgcacacagc

SEQ ID NO: 456008 - DNA, 25 bp, Mus musculus
gtgagaccgtcttccctgtggcaga

SEQ ID NO: 456009 - DNA, 25 bp, Mus musculus
gtgagacggcgcttcccttatggaa

SEQ ID NO: 456010 - DNA, 25 bp, Mus musculus
gtgagagcagctgggttactcctgt

SEQ ID NO: 456011 - DNA, 25 bp, Mus musculus
gtgagatcacctttacccacttgac

SEQ ID NO: 456012 - DNA, 25 bp, Mus musculus
gtgagatcccatcacagaaacagga

SEQ ID NO: 456013 - DNA, 25 bp, Mus musculus
gtgagatcgcatcggaaccatcgga

SEQ ID NO: 456014 - DNA, 25 bp, Mus musculus
gtgagatgaagcacgaactccgctt

SEQ ID NO: 456015 - DNA, 25 bp, Mus musculus
gtgagcagcggccaggagaacggca

SEQ ID NO: 456016 - DNA, 25 bp, Mus musculus
gtgagccacagcatgcatttgagtg

SEQ ID NO: 456017 - DNA, 25 bp, Mus musculus
gtgagccacgcaaagcactgacctt

SEQ ID NO: 456018 - DNA, 25 bp, Mus musculus
gtgagcccggacgagtctgactctg

SEQ ID NO: 456019 - DNA, 25 bp, Mus musculus
gtgagcccgtgagacagctctgcag

SEQ ID NO: 456020 - DNA, 25 bp, Mus musculus
gtgagccctcccaaatgatacaggg

SEQ ID NO: 456021 - DNA, 25 bp, Mus musculus
gtgagcctatgagcgaactgtctgg

SEQ ID NO: 456022 - DNA, 25 bp, Mus musculus
gtgagcgaagctcctatactcatgg

SEQ ID NO: 456023 - DNA, 25 bp, Mus musculus
gtgagcgcgcgcttaaatgcacccg

SEQ ID NO: 456024 - DNA, 25 bp, Mus musculus
gtgagcgcttgccttgccatgagaa

SEQ ID NO: 456025 - DNA, 25 bp, Mus musculus
gtgagctaaatagcgacttcccgct

SEQ ID NO: 456026 - DNA, 25 bp, Mus musculus
gtgagctagatctgcgacaccacgg

SEQ ID NO: 456027 - DNA, 25 bp, Mus musculus
gtgagctccacccagcatgacacgg

SEQ ID NO: 456028 - DNA, 25 bp, Mus musculus
gtgagctctaattcttaatgaatag

SEQ ID NO: 456029 - DNA, 25 bp, Mus musculus
gtgagctttgcaatgaatgatagcc

SEQ ID NO: 456030 - DNA, 25 bp, Mus musculus
gtgaggagacccgtcccagactgtg

SEQ ID NO: 456031 - DNA, 25 bp, Mus musculus
gtgaggagccgctgctcactttccc

SEQ ID NO: 456032 - DNA, 25 bp, Mus musculus
gtgaggcaaacgctctgcccgctga

SEQ ID NO: 456033 - DNA, 25 bp, Mus musculus
gtgaggccgggcacatcatggcatg

SEQ ID NO: 456034 - DNA, 25 bp, Mus musculus
gtgagtagtggcaacgctgcgctcc

SEQ ID NO: 456035 - DNA, 25 bp, Mus musculus
gtgagtccggccgagggcaggtagt

SEQ ID NO: 456036 - DNA, 25 bp, Mus musculus
gtgagtgccaccgttcaagacagtg

SEQ ID NO: 456037 - DNA, 25 bp, Mus musculus
gtgagtggcgttgcctgagctccct

SEQ ID NO: 456038 - DNA, 25 bp, Mus musculus
gtgagttctcatgtccagttccttt

SEQ ID NO: 456039 - DNA, 25 bp, Mus musculus
gtgagttctctcagcagttcctgga

SEQ ID NO: 456040 - DNA, 25 bp, Mus musculus
gtgataaagaagaggacaactcggg

SEQ ID NO: 456041 - DNA, 25 bp, Mus musculus
gtgataaatcctccacagcctggtg

SEQ ID NO: 456042 - DNA, 25 bp, Mus musculus
gtgatccaagcactgatccctggga

SEQ ID NO: 456043 - DNA, 25 bp, Mus musculus
gtgatccacccggagagaacctgac

SEQ ID NO: 456044 - DNA, 25 bp, Mus musculus
gtgatccagaccctgcagccttctg

SEQ ID NO: 456045 - DNA, 25 bp, Mus musculus
gtgatcgatgccaaaagccccttct

SEQ ID NO: 456046 - DNA, 25 bp, Mus musculus
gtgatctgctgaaatggactttttg

SEQ ID NO: 456047 - DNA, 25 bp, Mus musculus
gtgatcttagtcgagcttgggctgc

SEQ ID NO: 456048 - DNA, 25 bp, Mus musculus
gtgatcttgttaaagcaaccctgag

SEQ ID NO: 456049 - DNA, 25 bp, Mus musculus
gtgatgacagacacggcaagagcca

SEQ ID NO: 456050 - DNA, 25 bp, Mus musculus
gtgatgccaaatcccaaaggcctgt

SEQ ID NO: 456051 - DNA, 25 bp, Mus musculus
gtgatgcccacacctacgtgcaggc

SEQ ID NO: 456052 - DNA, 25 bp, Mus musculus
gtgatggcttccagctccaacgatg

SEQ ID NO: 456053 - DNA, 25 bp, Mus musculus
gtgatgtccatccaagtgcagcctg

SEQ ID NO: 456054 - DNA, 25 bp, Mus musculus
gtgatgtgatcctcaccaacctggc

SEQ ID NO: 456055 - DNA, 25 bp, Mus musculus
gtgatgttgctgaacctggaggcca

SEQ ID NO: 456056 - DNA, 25 bp, Mus musculus
gtgattacaggtaaccaaggctcta

SEQ ID NO: 456057 - DNA, 25 bp, Mus musculus
gtgattgccccatgtgccgtcttca

SEQ ID NO: 456058 - DNA, 25 bp, Mus musculus
gtgatttacacacaccccgaggttg

SEQ ID NO: 456059 - DNA, 25 bp, Mus musculus
gtgcaaactccgactacaccttcgg

SEQ ID NO: 456060 - DNA, 25 bp, Mus musculus
gtgcaactgcacaacaacgaggcgg

SEQ ID NO: 456061 - DNA, 25 bp, Mus musculus
gtgcaaggtcatgtgggaaatgcct

SEQ ID NO: 456062 - DNA, 25 bp, Mus musculus
gtgcaattgttctagggaggcctcc

SEQ ID NO: 456063 - DNA, 25 bp, Mus musculus
gtgcacacacactggtcaaaatggt

SEQ ID NO: 456064 - DNA, 25 bp, Mus musculus
gtgcacatccgacagctgggaccct

SEQ ID NO: 456065 - DNA, 25 bp, Mus musculus
gtgcacatctttactcgtttctgag

SEQ ID NO: 456066 - DNA, 25 bp, Mus musculus
gtgcaccccataagccctgaagagg

SEQ ID NO: 456067 - DNA, 25 bp, Mus musculus
gtgcactaccttgggacagagaccg

SEQ ID NO: 456068 - DNA, 25 bp, Mus musculus
gtgcactccggccttgtgacccttg

SEQ ID NO: 456069 - DNA, 25 bp, Mus musculus
gtgcacttgagggtgtttcaacccc

SEQ ID NO: 456070 - DNA, 25 bp, Mus musculus
gtgcagaactgctccaaagggacct

SEQ ID NO: 456071 - DNA, 25 bp, Mus musculus
gtgcagagaggtgaaatacgattat

SEQ ID NO: 456072 - DNA, 25 bp, Mus musculus
gtgcagagggtagtccacacgggcg

SEQ ID NO: 456073 - DNA, 25 bp, Mus musculus
gtgcagatgcttccacacaggctca

SEQ ID NO: 456074 - DNA, 25 bp, Mus musculus
gtgcagccgctgataagcacccaga

SEQ ID NO: 456075 - DNA, 25 bp, Mus musculus
gtgcagcggaccgacactcttctga

SEQ ID NO: 456076 - DNA, 25 bp, Mus musculus
gtgcagctttttgggaaaacctggc

SEQ ID NO: 456077 - DNA, 25 bp, Mus musculus
gtgcaggcacgcaccggacgcagac

SEQ ID NO: 456078 - DNA, 25 bp, Mus musculus
gtgcagttaaaaaccacgggaggtg

SEQ ID NO: 456079 - DNA, 25 bp, Mus musculus
gtgcataactcaaaacacatgtgga

SEQ ID NO: 456080 - DNA, 25 bp, Mus musculus
gtgcatcagagacagctgctcacca

SEQ ID NO: 456081 - DNA, 25 bp, Mus musculus
gtgcattccataactcgctgtttgt

SEQ ID NO: 456082 - DNA, 25 bp, Mus musculus
gtgccaacaagacggagagtgccct

SEQ ID NO: 456083 - DNA, 25 bp, Mus musculus
gtgccactgcttcaacaaataccgg

SEQ ID NO: 456084 - DNA, 25 bp, Mus musculus
gtgccaggtttccacgcatatgcca

SEQ ID NO: 456085 - DNA, 25 bp, Mus musculus
gtgccatagccatcctcttcgcggt

SEQ ID NO: 456086 - DNA, 25 bp, Mus musculus
gtgcccaattcctgtgcttatgagc

SEQ ID NO: 456087 - DNA, 25 bp, Mus musculus
gtgcccagctgtggagaagcctcac

SEQ ID NO: 456088 - DNA, 25 bp, Mus musculus
gtgcccaggtaacggtcctttcatc

SEQ ID NO: 456089 - DNA, 25 bp, Mus musculus
gtgcccagtccttgttgactaccag

SEQ ID NO: 456090 - DNA, 25 bp, Mus musculus
gtgccccgttcctggcgcacgaggt

SEQ ID NO: 456091 - DNA, 25 bp, Mus musculus
gtgccctacaaggtgatcatgaagc

SEQ ID NO: 456092 - DNA, 25 bp, Mus musculus
gtgccctgcgcctcattcgggagct

SEQ ID NO: 456093 - DNA, 25 bp, Mus musculus
gtgcccttggcccagagccatgctg

SEQ ID NO: 456094 - DNA, 25 bp, Mus musculus
gtgccgcccacttgacgtgtccaga

SEQ ID NO: 456095 - DNA, 25 bp, Mus musculus
gtgccggtttgcctcctgtccatag

SEQ ID NO: 456096 - DNA, 25 bp, Mus musculus
gtgcctaccgcccaggtgctgagat

SEQ ID NO: 456097 - DNA, 25 bp, Mus musculus
gtgcctaccgctttggacgcctaag

SEQ ID NO: 456098 - DNA, 25 bp, Mus musculus
gtgcctagacggtcgcccaggagca

SEQ ID NO: 456099 - DNA, 25 bp, Mus musculus
gtgcctcagcagtatagcagttcag

SEQ ID NO: 456100 - DNA, 25 bp, Mus musculus
gtgcctcagcagtgaaccctgcatc

SEQ ID NO: 456101 - DNA, 25 bp, Mus musculus
gtgcctccaacgttgtcttcccgga

SEQ ID NO: 456102 - DNA, 25 bp, Mus musculus
gtgcctcctgagtggcaccgctggc

SEQ ID NO: 456103 - DNA, 25 bp, Mus musculus
gtgcctcgaagcctgggcctgcttc

SEQ ID NO: 456104 - DNA, 25 bp, Mus musculus
gtgcctgccaaagttagcaaattaa

SEQ ID NO: 456105 - DNA, 25 bp, Mus musculus
gtgcctgccacatcgtgctgtgtga

SEQ ID NO: 456106 - DNA, 25 bp, Mus musculus
gtgccttcctggtccaaatggatcc

SEQ ID NO: 456107 - DNA, 25 bp, Mus musculus
gtgcgaccccgagaatcatgccaag

SEQ ID NO: 456108 - DNA, 25 bp, Mus musculus
gtgcgacttcagctccacaaacaag

SEQ ID NO: 456109 - DNA, 25 bp, Mus musculus
gtgcgagaccacacctcaaagaaag

SEQ ID NO: 456110 - DNA, 25 bp, Mus musculus
gtgcgagagttgagcctggctcaca

SEQ ID NO: 456111 - DNA, 25 bp, Mus musculus
gtgcgcaccactccttcgtcgaggt

SEQ ID NO: 456112 - DNA, 25 bp, Mus musculus
gtgcggctctctgctctctcgaaag

SEQ ID NO: 456113 - DNA, 25 bp, Mus musculus
gtgcggctgcggaagaatgtctgct

SEQ ID NO: 456114 - DNA, 25 bp, Mus musculus
gtgcgggtcgcaatctggaaaatcc

SEQ ID NO: 456115 - DNA, 25 bp, Mus musculus
gtgcggtatcacctacaagatggaa

SEQ ID NO: 456116 - DNA, 25 bp, Mus musculus
gtgcgtacccacctgaacagttctg

SEQ ID NO: 456117 - DNA, 25 bp, Mus musculus
gtgcgtggcccgacaccccatggta

SEQ ID NO: 456118 - DNA, 25 bp, Mus musculus
gtgctaagtcacaccagggatcccc

SEQ ID NO: 456119 - DNA, 25 bp, Mus musculus
gtgctacattggatagacagaaggc

SEQ ID NO: 456120 - DNA, 25 bp, Mus musculus
gtgctagatccacagaaccgcgagt

SEQ ID NO: 456121 - DNA, 25 bp, Mus musculus
gtgctcaaagaagtgcggaccctca

SEQ ID NO: 456122 - DNA, 25 bp, Mus musculus
gtgctcacacgagcaaagggcccgg

SEQ ID NO: 456123 - DNA, 25 bp, Mus musculus
gtgctcagtatcactaaccaaggaa

SEQ ID NO: 456124 - DNA, 25 bp, Mus musculus
gtgctcattgccctcaagactgctt

SEQ ID NO: 456125 - DNA, 25 bp, Mus musculus
gtgctccaatggttatctaaggaag

SEQ ID NO: 456126 - DNA, 25 bp, Mus musculus
gtgctcccttgcattgttcatctgc

SEQ ID NO: 456127 - DNA, 25 bp, Mus musculus
gtgctccggctaaacaaccttatgg

SEQ ID NO: 456128 - DNA, 25 bp, Mus musculus
gtgctctatgcacgtgcctatacta

SEQ ID NO: 456129 - DNA, 25 bp, Mus musculus
gtgctctctcagacctaatgtgaag

SEQ ID NO: 456130 - DNA, 25 bp, Mus musculus
gtgctcttctcttcagacggctaca

SEQ ID NO: 456131 - DNA, 25 bp, Mus musculus
gtgctgacctccaagtaccgttaag

SEQ ID NO: 456132 - DNA, 25 bp, Mus musculus
gtgctgagactcgaacccatggctt

SEQ ID NO: 456133 - DNA, 25 bp, Mus musculus
gtgctgccaacaaacagagcgtcgg

SEQ ID NO: 456134 - DNA, 25 bp, Mus musculus
gtgctgccaggctcactgcggacgc

SEQ ID NO: 456135 - DNA, 25 bp, Mus musculus
gtgctgccgagcatctacctctgca

SEQ ID NO: 456136 - DNA, 25 bp, Mus musculus
gtgctgctcgcatgccgatgtcagt

SEQ ID NO: 456137 - DNA, 25 bp, Mus musculus
gtgctggagcgagatagcagtccac

SEQ ID NO: 456138 - DNA, 25 bp, Mus musculus
gtgctgggcccggatgacctgtctc

SEQ ID NO: 456139 - DNA, 25 bp, Mus musculus
gtgctgtcctggctgcggctacttc

SEQ ID NO: 456140 - DNA, 25 bp, Mus musculus
gtgctgtgataaactgacatctgct

SEQ ID NO: 456141 - DNA, 25 bp, Mus musculus
gtgctgtgtacctgcccaactgtga

SEQ ID NO: 456142 - DNA, 25 bp, Mus musculus
gtgctgttgctctgtgccccgagga

SEQ ID NO: 456143 - DNA, 25 bp, Mus musculus
gtgcttacaacaccctgagccagtg

SEQ ID NO: 456144 - DNA, 25 bp, Mus musculus
gtgcttaggacgcccgttacccaca

SEQ ID NO: 456145 - DNA, 25 bp, Mus musculus
gtgcttcagcaggacatcttcaggg

SEQ ID NO: 456146 - DNA, 25 bp, Mus musculus
gtgcttcccggatagctgtgcccaa

SEQ ID NO: 456147 - DNA, 25 bp, Mus musculus
gtgcttcggtgagcgtccacacctg

SEQ ID NO: 456148 - DNA, 25 bp, Mus musculus
gtgcttgctccggtcatcgacctaa

SEQ ID NO: 456149 - DNA, 25 bp, Mus musculus
gtggaaaagccctgaggctcccgct

SEQ ID NO: 456150 - DNA, 25 bp, Mus musculus
gtggaaactccagaccaacattggt

SEQ ID NO: 456151 - DNA, 25 bp, Mus musculus
gtggaaagtctgaagcgcgagctcc

SEQ ID NO: 456152 - DNA, 25 bp, Mus musculus
gtggaacagcgcaataaggccctcg

SEQ ID NO: 456153 - DNA, 25 bp, Mus musculus
gtggaacatcccaggaacacatgtg

SEQ ID NO: 456154 - DNA, 25 bp, Mus musculus
gtggaacttgggagccacgccttca

SEQ ID NO: 456155 - DNA, 25 bp, Mus musculus
gtggaatcagcagcggtggcactac

SEQ ID NO: 456156 - DNA, 25 bp, Mus musculus
gtggacagcccaggcaatgcagcct

SEQ ID NO: 456157 - DNA, 25 bp, Mus musculus
gtggacaggtccaccaggaccacag

SEQ ID NO: 456158 - DNA, 25 bp, Mus musculus
gtggactctctcagtttgtgtggag

SEQ ID NO: 456159 - DNA, 25 bp, Mus musculus
gtggagaacagcaccaaggccgctg

SEQ ID NO: 456160 - DNA, 25 bp, Mus musculus
gtggagaccagcacaatgcgcaggc

SEQ ID NO: 456161 - DNA, 25 bp, Mus musculus
gtggagacctgagcaaccctgatgg

SEQ ID NO: 456162 - DNA, 25 bp, Mus musculus
gtggagccagcacttgcaacagcag

SEQ ID NO: 456163 - DNA, 25 bp, Mus musculus
gtggagcgaggctatgatccctctc

SEQ ID NO: 456164 - DNA, 25 bp, Mus musculus
gtggagcggtgctctctgtcctctg

SEQ ID NO: 456165 - DNA, 25 bp, Mus musculus
gtggaggacccgaagaactgcatca

SEQ ID NO: 456166 - DNA, 25 bp, Mus musculus
gtggaggacgccatcgcagtgctca

SEQ ID NO: 456167 - DNA, 25 bp, Mus musculus
gtggaggctggcaagacgtatcttc

SEQ ID NO: 456168 - DNA, 25 bp, Mus musculus
gtggagggctctaccatcaagaagc

SEQ ID NO: 456169 - DNA, 25 bp, Mus musculus
gtggagtacacccttcggaagcgac

SEQ ID NO: 456170 - DNA, 25 bp, Mus musculus
gtggatatcttctctaaagtgcgca

SEQ ID NO: 456171 - DNA, 25 bp, Mus musculus
gtggatcctgattgcctcctccctg

SEQ ID NO: 456172 - DNA, 25 bp, Mus musculus
gtggatcgccagacccaaacggatg

SEQ ID NO: 456173 - DNA, 25 bp, Mus musculus
gtggatcttggagccagttccccga

SEQ ID NO: 456174 - DNA, 25 bp, Mus musculus
gtggatgttcatcaacagtagctta

SEQ ID NO: 456175 - DNA, 25 bp, Mus musculus
gtggattaccactgacaggcccgga

SEQ ID NO: 456176 - DNA, 25 bp, Mus musculus
gtggattctgccaagccccgggtct

SEQ ID NO: 456177 - DNA, 25 bp, Mus musculus
gtggcaagggctccaaagcacatgt

SEQ ID NO: 456178 - DNA, 25 bp, Mus musculus
gtggcacccaacacagctgagctgt

SEQ ID NO: 456179 - DNA, 25 bp, Mus musculus
gtggcacgtgcacttcaccgagtct

SEQ ID NO: 456180 - DNA, 25 bp, Mus musculus
gtggcactactgtacagaaagcaag

SEQ ID NO: 456181 - DNA, 25 bp, Mus musculus
gtggcactgatcctcttttactctg

SEQ ID NO: 456182 - DNA, 25 bp, Mus musculus
gtggcaggttcttcagcatcagtgt

SEQ ID NO: 456183 - DNA, 25 bp, Mus musculus
gtggcagtagcatcctcggccaccg

SEQ ID NO: 456184 - DNA, 25 bp, Mus musculus
gtggccaagcgttcgccctcgaact

SEQ ID NO: 456185 - DNA, 25 bp, Mus musculus
gtggccacacatcacacataagcag

SEQ ID NO: 456186 - DNA, 25 bp, Mus musculus
gtggccaggccatcccattctggct

SEQ ID NO: 456187 - DNA, 25 bp, Mus musculus
gtggcccaccagtgttaccatggct

SEQ ID NO: 456188 - DNA, 25 bp, Mus musculus
gtggcccgtccagataagatttcag

SEQ ID NO: 456189 - DNA, 25 bp, Mus musculus
gtggccgctgcctactctttaccga

SEQ ID NO: 456190 - DNA, 25 bp, Mus musculus
gtggcctacgacagcaatgttctag

SEQ ID NO: 456191 - DNA, 25 bp, Mus musculus
gtggcctcaggagaagccctttctt

SEQ ID NO: 456192 - DNA, 25 bp, Mus musculus
gtggcctcgcgctgtgagtatacaa

SEQ ID NO: 456193 - DNA, 25 bp, Mus musculus
gtggccttaaatctgcaccgcatag

SEQ ID NO: 456194 - DNA, 25 bp, Mus musculus
gtggccttctgcctcttgggaatag

SEQ ID NO: 456195 - DNA, 25 bp, Mus musculus
gtggcgatcacgcttcctcctctat

SEQ ID NO: 456196 - DNA, 25 bp, Mus musculus
gtggcgatcccattcctaaaagtcc

SEQ ID NO: 456197 - DNA, 25 bp, Mus musculus
gtggcgcagcaagcacactgatcgg

SEQ ID NO: 456198 - DNA, 25 bp, Mus musculus
gtggcgccacctactgggacaatgg

SEQ ID NO: 456199 - DNA, 25 bp, Mus musculus
gtggcggagccatcaagcgatgtaa

SEQ ID NO: 456200 - DNA, 25 bp, Mus musculus
gtggcgtcggcaaaccggcgcttct

SEQ ID NO: 456201 - DNA, 25 bp, Mus musculus
gtggctcaactatctccatcacgga

SEQ ID NO: 456202 - DNA, 25 bp, Mus musculus
gtggctcacagatagccataactct

SEQ ID NO: 456203 - DNA, 25 bp, Mus musculus
gtggctcggtaagtgcgctgatcca

SEQ ID NO: 456204 - DNA, 25 bp, Mus musculus
gtggctgagcagtcacccttcaaga

SEQ ID NO: 456205 - DNA, 25 bp, Mus musculus
gtggctgccaacaccaggatcattc

SEQ ID NO: 456206 - DNA, 25 bp, Mus musculus
gtggctgccacttttgaccgcaccg

SEQ ID NO: 456207 - DNA, 25 bp, Mus musculus
gtggctgggcactcaaaacttcgtc

SEQ ID NO: 456208 - DNA, 25 bp, Mus musculus
gtggcttatgggaggaccacgccct

SEQ ID NO: 456209 - DNA, 25 bp, Mus musculus
gtggcttcccgcagattgagattaa

SEQ ID NO: 456210 - DNA, 25 bp, Mus musculus
gtggcttgcagaagcacacccacct

SEQ ID NO: 456211 - DNA, 25 bp, Mus musculus
gtggcttgttatttcccaagaaccg

SEQ ID NO: 456212 - DNA, 25 bp, Mus musculus
gtggcttttccctggatcagctaca

SEQ ID NO: 456213 - DNA, 25 bp, Mus musculus
gtgggacaaatgttggccaccagtt

SEQ ID NO: 456214 - DNA, 25 bp, Mus musculus
gtgggacccgctacgacgctgacct

SEQ ID NO: 456215 - DNA, 25 bp, Mus musculus
gtgggaccgaacacttggccgagct

SEQ ID NO: 456216 - DNA, 25 bp, Mus musculus
gtgggaccgtggcagtccaccacat

SEQ ID NO: 456217 - DNA, 25 bp, Mus musculus
gtgggaccttctttgctcctcacca

SEQ ID NO: 456218 - DNA, 25 bp, Mus musculus
gtgggactagaggttggacctcaca

SEQ ID NO: 456219 - DNA, 25 bp, Mus musculus
gtgggagcggactcagagccaccat

SEQ ID NO: 456220 - DNA, 25 bp, Mus musculus
gtgggcacactcaagaaacgactcg

SEQ ID NO: 456221 - DNA, 25 bp, Mus musculus
gtgggcagcccaccatgtattcaga

SEQ ID NO: 456222 - DNA, 25 bp, Mus musculus
gtgggcagcccagacagatccaatg

SEQ ID NO: 456223 - DNA, 25 bp, Mus musculus
gtgggcagcctcaattcagaaaaca

SEQ ID NO: 456224 - DNA, 25 bp, Mus musculus
gtgggcagggccattgcagacacta

SEQ ID NO: 456225 - DNA, 25 bp, Mus musculus
gtgggccaagcccaactgaccagaa

SEQ ID NO: 456226 - DNA, 25 bp, Mus musculus
gtgggctgcttttctcacttatcca

SEQ ID NO: 456227 - DNA, 25 bp, Mus musculus
gtgggtacacacatgtcacagtatg

SEQ ID NO: 456228 - DNA, 25 bp, Mus musculus
gtgggtaggacattataaacgtata

SEQ ID NO: 456229 - DNA, 25 bp, Mus musculus
gtgggtggacacagcaacatgcctt

SEQ ID NO: 456230 - DNA, 25 bp, Mus musculus
gtgggttctcggcatcgcagcaact

SEQ ID NO: 456231 - DNA, 25 bp, Mus musculus
gtgggtttcccttggcatgccgcct

SEQ ID NO: 456232 - DNA, 25 bp, Mus musculus
gtggtaatgcaatgcacaccctaga

SEQ ID NO: 456233 - DNA, 25 bp, Mus musculus
gtggtacaggacagaaccctcttct

SEQ ID NO: 456234 - DNA, 25 bp, Mus musculus
gtggtacaggcgaggtcgaactaca

SEQ ID NO: 456235 - DNA, 25 bp, Mus musculus
gtggtaccaccagccagctcagaag

SEQ ID NO: 456236 - DNA, 25 bp, Mus musculus
gtggtacgcacatgcctacacacac

SEQ ID NO: 456237 - DNA, 25 bp, Mus musculus
gtggtacttgtcatccttgggctaa

SEQ ID NO: 456238 - DNA, 25 bp, Mus musculus
gtggtagacccccttgacgcgagtc

SEQ ID NO: 456239 - DNA, 25 bp, Mus musculus
gtggtagtcgctgcagtccgctgcc

SEQ ID NO: 456240 - DNA, 25 bp, Mus musculus
gtggtattgtgaacctgggctctgt

SEQ ID NO: 456241 - DNA, 25 bp, Mus musculus
gtggtcacggatgcccgcagcttgt

SEQ ID NO: 456242 - DNA, 25 bp, Mus musculus
gtggtcactgattcctgttccccag

SEQ ID NO: 456243 - DNA, 25 bp, Mus musculus
gtggtcagctgatgaaaccctgcag

SEQ ID NO: 456244 - DNA, 25 bp, Mus musculus
gtggtccaatacctctggcttccca

SEQ ID NO: 456245 - DNA, 25 bp, Mus musculus
gtggtcccttgtgttctatcccaga

SEQ ID NO: 456246 - DNA, 25 bp, Mus musculus
gtggtcctcccagaaagtgaagatg

SEQ ID NO: 456247 - DNA, 25 bp, Mus musculus
gtggtccttaccagccactgtctgg

SEQ ID NO: 456248 - DNA, 25 bp, Mus musculus
gtggtccttgaatccagcccgtcgg

SEQ ID NO: 456249 - DNA, 25 bp, Mus musculus
gtggtcggttctcctccccatgaga

SEQ ID NO: 456250 - DNA, 25 bp, Mus musculus
gtggtctcagtagccgcagaggtct

SEQ ID NO: 456251 - DNA, 25 bp, Mus musculus
gtggtctcgagcaatcccggccctg

SEQ ID NO: 456252 - DNA, 25 bp, Mus musculus
gtggtcttagcctgccctgtcgcca

SEQ ID NO: 456253 - DNA, 25 bp, Mus musculus
gtggtcttcaccacaggagctccca

SEQ ID NO: 456254 - DNA, 25 bp, Mus musculus
gtggtgagtgcctttgatccagcac

SEQ ID NO: 456255 - DNA, 25 bp, Mus musculus
gtggtgccaccctcattgccaggaa

SEQ ID NO: 456256 - DNA, 25 bp, Mus musculus
gtggtgccccgttcacaaactgcca

SEQ ID NO: 456257 - DNA, 25 bp, Mus musculus
gtggtgctggtaggcctttaatttc

SEQ ID NO: 456258 - DNA, 25 bp, Mus musculus
gtggtggcccagtaaataccagggc

SEQ ID NO: 456259 - DNA, 25 bp, Mus musculus
gtggtggtggcaggcaccataataa

SEQ ID NO: 456260 - DNA, 25 bp, Mus musculus
gtggtgtcacccagtcgtgaagcga

SEQ ID NO: 456261 - DNA, 25 bp, Mus musculus
gtggtgttcacaaggaagaaaggtc

SEQ ID NO: 456262 - DNA, 25 bp, Mus musculus
gtggtgtttccactgccaactggga

SEQ ID NO: 456263 - DNA, 25 bp, Mus musculus
gtggtgtttcccttagcgtgcatct

SEQ ID NO: 456264 - DNA, 25 bp, Mus musculus
gtggttacacacattaggtcttcct

SEQ ID NO: 456265 - DNA, 25 bp, Mus musculus
gtggttcccaaagcccatgtctctg

SEQ ID NO: 456266 - DNA, 25 bp, Mus musculus
gtggttgtgctttttctctgtagta

SEQ ID NO: 456267 - DNA, 25 bp, Mus musculus
gtggtttggacacctagacaggcta

SEQ ID NO: 456268 - DNA, 25 bp, Mus musculus
gtggttttcacagccaacgactctg

SEQ ID NO: 456269 - DNA, 25 bp, Mus musculus
gtggttttccgcatgggcccttcca

SEQ ID NO: 456270 - DNA, 25 bp, Mus musculus
gtgtaaactcttgtttcctctgcag

SEQ ID NO: 456271 - DNA, 25 bp, Mus musculus
gtgtaactcaaacccatgtaactgg

SEQ ID NO: 456272 - DNA, 25 bp, Mus musculus
gtgtaacttctgagtgacagccatg

SEQ ID NO: 456273 - DNA, 25 bp, Mus musculus
gtgtaccaatgctaatagtatctcg

SEQ ID NO: 456274 - DNA, 25 bp, Mus musculus
gtgtaccattcctaaggactgccat

SEQ ID NO: 456275 - DNA, 25 bp, Mus musculus
gtgtacgccagaccttcaagacgca

SEQ ID NO: 456276 - DNA, 25 bp, Mus musculus
gtgtactgagtacccacctggcctg

SEQ ID NO: 456277 - DNA, 25 bp, Mus musculus
gtgtagaaccgtgcgtgaggccacc

SEQ ID NO: 456278 - DNA, 25 bp, Mus musculus
gtgtagcagccattgaagattcata

SEQ ID NO: 456279 - DNA, 25 bp, Mus musculus
gtgtataacgtcacctccagggagc

SEQ ID NO: 456280 - DNA, 25 bp, Mus musculus
gtgtatcgtcccagctggtcccctt

SEQ ID NO: 456281 - DNA, 25 bp, Mus musculus
gtgtatgagggtgctcagagtccct

SEQ ID NO: 456282 - DNA, 25 bp, Mus musculus
gtgtatgccacttgctcctttggcc

SEQ ID NO: 456283 - DNA, 25 bp, Mus musculus
gtgtatgtacctcacgcatgcctgg

SEQ ID NO: 456284 - DNA, 25 bp, Mus musculus
gtgtattacatcaaccaggactcag

SEQ ID NO: 456285 - DNA, 25 bp, Mus musculus
gtgtcaaacacaataaaaagaagcc

SEQ ID NO: 456286 - DNA, 25 bp, Mus musculus
gtgtcaaatcttaaaccctcacggg

SEQ ID NO: 456287 - DNA, 25 bp, Mus musculus
gtgtcaagaccactgctttaaagag

SEQ ID NO: 456288 - DNA, 25 bp, Mus musculus
gtgtcacacgccctgctaccttgat

SEQ ID NO: 456289 - DNA, 25 bp, Mus musculus
gtgtcaccactgcagcatttctgga

SEQ ID NO: 456290 - DNA, 25 bp, Mus musculus
gtgtcatgacattcgccaagcaagg

SEQ ID NO: 456291 - DNA, 25 bp, Mus musculus
gtgtcattcaaagaaaccataagca

SEQ ID NO: 456292 - DNA, 25 bp, Mus musculus
gtgtccaaatgaaagtgccctctct

SEQ ID NO: 456293 - DNA, 25 bp, Mus musculus
gtgtccaagctgcacctgcacggtt

SEQ ID NO: 456294 - DNA, 25 bp, Mus musculus
gtgtccaaggttgcccacaagtgct

SEQ ID NO: 456295 - DNA, 25 bp, Mus musculus
gtgtccacaaagtgcaaaagagggc

SEQ ID NO: 456296 - DNA, 25 bp, Mus musculus
gtgtccctcacgagtcgtccagtgg

SEQ ID NO: 456297 - DNA, 25 bp, Mus musculus
gtgtccctgaacctttcctttgagg

SEQ ID NO: 456298 - DNA, 25 bp, Mus musculus
gtgtccgtaaatggagtgccccagt

SEQ ID NO: 456299 - DNA, 25 bp, Mus musculus
gtgtcctctccagctgacagtgagt

SEQ ID NO: 456300 - DNA, 25 bp, Mus musculus
gtgtcctgactcttctccttgtaaa

SEQ ID NO: 456301 - DNA, 25 bp, Mus musculus
gtgtcgccgccacaggtacctagct

SEQ ID NO: 456302 - DNA, 25 bp, Mus musculus
gtgtcgctggcaccctcagaagtca

SEQ ID NO: 456303 - DNA, 25 bp, Mus musculus
gtgtctaagcactggatccgggccc

SEQ ID NO: 456304 - DNA, 25 bp, Mus musculus
gtgtctacagtaaccgctacccgga

SEQ ID NO: 456305 - DNA, 25 bp, Mus musculus
gtgtctataactccaaccttctggg

SEQ ID NO: 456306 - DNA, 25 bp, Mus musculus
gtgtctataccagtgaaccctaagg

SEQ ID NO: 456307 - DNA, 25 bp, Mus musculus
gtgtctcagtcttgccggctccatg

SEQ ID NO: 456308 - DNA, 25 bp, Mus musculus
gtgtctcatctttgcacctctctca

SEQ ID NO: 456309 - DNA, 25 bp, Mus musculus
gtgtctccctctccttcgcccaggg

SEQ ID NO: 456310 - DNA, 25 bp, Mus musculus
gtgtctgaagaaagcccagggctcc

SEQ ID NO: 456311 - DNA, 25 bp, Mus musculus
gtgtctgaccaagaagctgccggct

SEQ ID NO: 456312 - DNA, 25 bp, Mus musculus
gtgtctgcctccgtagtttccctaa

SEQ ID NO: 456313 - DNA, 25 bp, Mus musculus
gtgtctggtcagtctcagggcgttt

SEQ ID NO: 456314 - DNA, 25 bp, Mus musculus
gtgtctggtggtaactgtgtgctca

SEQ ID NO: 456315 - DNA, 25 bp, Mus musculus
gtgtctgtacattaccctgcaccca

SEQ ID NO: 456316 - DNA, 25 bp, Mus musculus
gtgtctgttacagccagcttgaggg

SEQ ID NO: 456317 - DNA, 25 bp, Mus musculus
gtgtgacatcctaacctctgcctgg

SEQ ID NO: 456318 - DNA, 25 bp, Mus musculus
gtgtgaccaaatcatccaagctgga

SEQ ID NO: 456319 - DNA, 25 bp, Mus musculus
gtgtgaccttcagtaacagcaaact

SEQ ID NO: 456320 - DNA, 25 bp, Mus musculus
gtgtgacgcagctctgccctcctag

SEQ ID NO: 456321 - DNA, 25 bp, Mus musculus
gtgtgagtcaccagtagagaccgta

SEQ ID NO: 456322 - DNA, 25 bp, Mus musculus
gtgtgagtgatctgctctgccctgg

SEQ ID NO: 456323 - DNA, 25 bp, Mus musculus
gtgtgataaggcagtggagaccaac

SEQ ID NO: 456324 - DNA, 25 bp, Mus musculus
gtgtgattggttggccggcatcttc

SEQ ID NO: 456325 - DNA, 25 bp, Mus musculus
gtgtgcacacaaaacgaacaaatgt

SEQ ID NO: 456326 - DNA, 25 bp, Mus musculus
gtgtgcaccagagcagggttctgcc

SEQ ID NO: 456327 - DNA, 25 bp, Mus musculus
gtgtgccaggcagttctcagcttca

SEQ ID NO: 456328 - DNA, 25 bp, Mus musculus
gtgtgcccagcgagtatacctaccg

SEQ ID NO: 456329 - DNA, 25 bp, Mus musculus
gtgtgcggaccaaaacccagaagct

SEQ ID NO: 456330 - DNA, 25 bp, Mus musculus
gtgtgctgaagaactcgctccctgt

SEQ ID NO: 456331 - DNA, 25 bp, Mus musculus
gtgtggacacggcatcccgccgtct

SEQ ID NO: 456332 - DNA, 25 bp, Mus musculus
gtgtggactaactcagcaggatagg

SEQ ID NO: 456333 - DNA, 25 bp, Mus musculus
gtgtggcaaccactatagtccttag

SEQ ID NO: 456334 - DNA, 25 bp, Mus musculus
gtgtggcagttgttgattatcaaac

SEQ ID NO: 456335 - DNA, 25 bp, Mus musculus
gtgtggccaccgcagaaagttctca

SEQ ID NO: 456336 - DNA, 25 bp, Mus musculus
gtgtggccggttccgcgttcgccgg

SEQ ID NO: 456337 - DNA, 25 bp, Mus musculus
gtgtggctgttgacagccacgccca

SEQ ID NO: 456338 - DNA, 25 bp, Mus musculus
gtgtgggaaccagctcttgaagact

SEQ ID NO: 456339 - DNA, 25 bp, Mus musculus
gtgtggtactcatgatcgtctccct

SEQ ID NO: 456340 - DNA, 25 bp, Mus musculus
gtgtggtagtaaatcaaagacccgg

SEQ ID NO: 456341 - DNA, 25 bp, Mus musculus
gtgtggtgatacctcaaagctctgt

SEQ ID NO: 456342 - DNA, 25 bp, Mus musculus
gtgtgtaaccaatgccgccagaagt

SEQ ID NO: 456343 - DNA, 25 bp, Mus musculus
gtgtgtacacatttggactccccag

SEQ ID NO: 456344 - DNA, 25 bp, Mus musculus
gtgtgtaccaccacagcgccattat

SEQ ID NO: 456345 - DNA, 25 bp, Mus musculus
gtgtgtagcactggccttggatatc

SEQ ID NO: 456346 - DNA, 25 bp, Mus musculus
gtgtgtcacactcttcaccgctgaa

SEQ ID NO: 456347 - DNA, 25 bp, Mus musculus
gtgtgtcagagctccggaagtcaag

SEQ ID NO: 456348 - DNA, 25 bp, Mus musculus
gtgtgtcagtgctaacatttctgtc

SEQ ID NO: 456349 - DNA, 25 bp, Mus musculus
gtgtgtctataaacctgaccccaga

SEQ ID NO: 456350 - DNA, 25 bp, Mus musculus
gtgtgtgaaacaaaagccttgcctt

SEQ ID NO: 456351 - DNA, 25 bp, Mus musculus
gtgtgtgacactgatgaagggccca

SEQ ID NO: 456352 - DNA, 25 bp, Mus musculus
gtgtgtgacgtcaccttgcgggctc

SEQ ID NO: 456353 - DNA, 25 bp, Mus musculus
gtgtgtggagattcccgggctctca

SEQ ID NO: 456354 - DNA, 25 bp, Mus musculus
gtgtgttccagcattattcaagata

SEQ ID NO: 456355 - DNA, 25 bp, Mus musculus
gtgttaaggcatttatcaccaccac

SEQ ID NO: 456356 - DNA, 25 bp, Mus musculus
gtgttaagtacatgagaagcctcca

SEQ ID NO: 456357 - DNA, 25 bp, Mus musculus
gtgttaccactaagcagccaaaagc

SEQ ID NO: 456358 - DNA, 25 bp, Mus musculus
gtgttatagtaaccaggctgggctt

SEQ ID NO: 456359 - DNA, 25 bp, Mus musculus
gtgttcacaccacaaaaaacgctag

SEQ ID NO: 456360 - DNA, 25 bp, Mus musculus
gtgttcaccttaatccaaggactgg

SEQ ID NO: 456361 - DNA, 25 bp, Mus musculus
gtgttcatgcccataagcgacccgg

SEQ ID NO: 456362 - DNA, 25 bp, Mus musculus
gtgttccgggcgatgtcttggtttc

SEQ ID NO: 456363 - DNA, 25 bp, Mus musculus
gtgttcctgtaccaggccatccaag

SEQ ID NO: 456364 - DNA, 25 bp, Mus musculus
gtgttcgatgtcacctctgggaagg

SEQ ID NO: 456365 - DNA, 25 bp, Mus musculus
gtgttcggaacagggccaggctcac

SEQ ID NO: 456366 - DNA, 25 bp, Mus musculus
gtgttctgagcgtcaacacaaagtg

SEQ ID NO: 456367 - DNA, 25 bp, Mus musculus
gtgttctggagtaacaatttctgat

SEQ ID NO: 456368 - DNA, 25 bp, Mus musculus
gtgttctttgaaggaccccgttcat

SEQ ID NO: 456369 - DNA, 25 bp, Mus musculus
gtgttgggccacctcagtcagacag

SEQ ID NO: 456370 - DNA, 25 bp, Mus musculus
gtgttgtccagccacaagcgcaccg

SEQ ID NO: 456371 - DNA, 25 bp, Mus musculus
gtgttgtgtttgcttcctcttagga

SEQ ID NO: 456372 - DNA, 25 bp, Mus musculus
gtgtttaacacagaggcgcaccctc

SEQ ID NO: 456373 - DNA, 25 bp, Mus musculus
gtgtttagacactttccagggcagc

SEQ ID NO: 456374 - DNA, 25 bp, Mus musculus
gtgtttatctcgcaactcttctggg

SEQ ID NO: 456375 - DNA, 25 bp, Mus musculus
gtgtttattggttagggccatcacc

SEQ ID NO: 456376 - DNA, 25 bp, Mus musculus
gtgtttcagccaccacccacggtgg

SEQ ID NO: 456377 - DNA, 25 bp, Mus musculus
gtgtttcggtctctccctgctgcag

SEQ ID NO: 456378 - DNA, 25 bp, Mus musculus
gtgtttctgtgcagcagttgatgac

SEQ ID NO: 456379 - DNA, 25 bp, Mus musculus
gtgtttgccaccttggacccggcgc

SEQ ID NO: 456380 - DNA, 25 bp, Mus musculus
gtgttttcacctctcgcctgctgag

SEQ ID NO: 456381 - DNA, 25 bp, Mus musculus
gtgttttcctcttcttgtaagcaca

SEQ ID NO: 456382 - DNA, 25 bp, Mus musculus
gttaaaaagccgacaggtacaagct

SEQ ID NO: 456383 - DNA, 25 bp, Mus musculus
gttaaaaatatctccgatgccgacg

SEQ ID NO: 456384 - DNA, 25 bp, Mus musculus
gttaaaagtggctccgccagcctgg

SEQ ID NO: 456385 - DNA, 25 bp, Mus musculus
gttaaaggcaaggtatcctcacttg

SEQ ID NO: 456386 - DNA, 25 bp, Mus musculus
gttaaaggtggtgggaatcacacag

SEQ ID NO: 456387 - DNA, 25 bp, Mus musculus
gttaaagtcttttcctggttcacag

SEQ ID NO: 456388 - DNA, 25 bp, Mus musculus
gttaaatccacacgccagaaaggga

SEQ ID NO: 456389 - DNA, 25 bp, Mus musculus
gttaacacctcctgtgtatcaggca

SEQ ID NO: 456390 - DNA, 25 bp, Mus musculus
gttaacatcccgtcattttctgtca

SEQ ID NO: 456391 - DNA, 25 bp, Mus musculus
gttaaccacagcgaggacacagcaa

SEQ ID NO: 456392 - DNA, 25 bp, Mus musculus
gttaaccacttctaaataccgagcg

SEQ ID NO: 456393 - DNA, 25 bp, Mus musculus
gttaaccacttttgctgtgcatgca

SEQ ID NO: 456394 - DNA, 25 bp, Mus musculus
gttaacccgagcatcaggagtccgt

SEQ ID NO: 456395 - DNA, 25 bp, Mus musculus
gttaaccctcatccaggcggagtcg

SEQ ID NO: 456396 - DNA, 25 bp, Mus musculus
gttaacgatgaaagtgacaccaggg

SEQ ID NO: 456397 - DNA, 25 bp, Mus musculus
gttaacgcgcaaacgtgcagagcca

SEQ ID NO: 456398 - DNA, 25 bp, Mus musculus
gttaacgcgcccagggcctttcagt

SEQ ID NO: 456399 - DNA, 25 bp, Mus musculus
gttaacttcctggagggcgatccca

SEQ ID NO: 456400 - DNA, 25 bp, Mus musculus
gttaagacgactctcacggcttggg

SEQ ID NO: 456401 - DNA, 25 bp, Mus musculus
gttaagcaaaaatccctcccaggtg

SEQ ID NO: 456402 - DNA, 25 bp, Mus musculus
gttaagcagctcatctcagttccca

SEQ ID NO: 456403 - DNA, 25 bp, Mus musculus
gttaagctgttcatgcacgtgcctg

SEQ ID NO: 456404 - DNA, 25 bp, Mus musculus
gttaatatcaagacgctgcgcctgg

SEQ ID NO: 456405 - DNA, 25 bp, Mus musculus
gttaatattgtcaggcggagcacag

SEQ ID NO: 456406 - DNA, 25 bp, Mus musculus
gttaatcacactttctgacactaaa

SEQ ID NO: 456407 - DNA, 25 bp, Mus musculus
gttaatccctacaaatacccagagg

SEQ ID NO: 456408 - DNA, 25 bp, Mus musculus
gttaatgaaactggatccacggccc

SEQ ID NO: 456409 - DNA, 25 bp, Mus musculus
gttaatggcactggttctctgggca

SEQ ID NO: 456410 - DNA, 25 bp, Mus musculus
gttaatggtcctattatctggagca

SEQ ID NO: 456411 - DNA, 25 bp, Mus musculus
gttacaaaacaaaagcaatgaggcc

SEQ ID NO: 456412 - DNA, 25 bp, Mus musculus
gttacaaacacaacgtcagcttcag

SEQ ID NO: 456413 - DNA, 25 bp, Mus musculus
gttacaaagctgtgggacttccgga

SEQ ID NO: 456414 - DNA, 25 bp, Mus musculus
gttacaacacaggaggttgacaggc

SEQ ID NO: 456415 - DNA, 25 bp, Mus musculus
gttacaagaaccgacctggcctcag

SEQ ID NO: 456416 - DNA, 25 bp, Mus musculus
gttacaagcgggtgccaacatagct

SEQ ID NO: 456417 - DNA, 25 bp, Mus musculus
gttacaatggcgaactcctgcaccg

SEQ ID NO: 456418 - DNA, 25 bp, Mus musculus
gttacacagggccagactcaaagat

SEQ ID NO: 456419 - DNA, 25 bp, Mus musculus
gttacactgactacaatgcccactg

SEQ ID NO: 456420 - DNA, 25 bp, Mus musculus
gttacactggagagaacgtcagccc

SEQ ID NO: 456421 - DNA, 25 bp, Mus musculus
gttacagacaccacttaacagcagg

SEQ ID NO: 456422 - DNA, 25 bp, Mus musculus
gttacagcatccaaaaggtcatcgg

SEQ ID NO: 456423 - DNA, 25 bp, Mus musculus
gttacagtcctgctcttagattggg

SEQ ID NO: 456424 - DNA, 25 bp, Mus musculus
gttacagtttattcacgcagaaagg

SEQ ID NO: 456425 - DNA, 25 bp, Mus musculus
gttaccaacaaagtagaaagtagtg

SEQ ID NO: 456426 - DNA, 25 bp, Mus musculus
gttaccaccaacattctccggagac

SEQ ID NO: 456427 - DNA, 25 bp, Mus musculus
gttaccagcaacttaagaagctgca

SEQ ID NO: 456428 - DNA, 25 bp, Mus musculus
gttacccacaccttcgagggtagct

SEQ ID NO: 456429 - DNA, 25 bp, Mus musculus
gttacccagctgttgagaccctcag

SEQ ID NO: 456430 - DNA, 25 bp, Mus musculus
gttaccctaggtactcagctgctga

SEQ ID NO: 456431 - DNA, 25 bp, Mus musculus
gttaccctgcttagaaaaggagcca

SEQ ID NO: 456432 - DNA, 25 bp, Mus musculus
gttaccctgggctgtgaaagatggc

SEQ ID NO: 456433 - DNA, 25 bp, Mus musculus
gttaccgagcctgtctggcgcgact

SEQ ID NO: 456434 - DNA, 25 bp, Mus musculus
gttaccgtcaacaacagacccctgg

SEQ ID NO: 456435 - DNA, 25 bp, Mus musculus
gttaccgtggaataacacataccag

SEQ ID NO: 456436 - DNA, 25 bp, Mus musculus
gttacctctggtcatggaacttcac

SEQ ID NO: 456437 - DNA, 25 bp, Mus musculus
gttacgaggtccgagagcttcgcac

SEQ ID NO: 456438 - DNA, 25 bp, Mus musculus
gttacgcctgggaaagagtcttaga

SEQ ID NO: 456439 - DNA, 25 bp, Mus musculus
gttacggaacctacggctcggcgag

SEQ ID NO: 456440 - DNA, 25 bp, Mus musculus
gttacggacttcttgcgagctgcca

SEQ ID NO: 456441 - DNA, 25 bp, Mus musculus
gttacggctcttggaacccagcgag

SEQ ID NO: 456442 - DNA, 25 bp, Mus musculus
gttacgttttctcaagcaagcggca

SEQ ID NO: 456443 - DNA, 25 bp, Mus musculus
gttactaccaactgaatgataccaa

SEQ ID NO: 456444 - DNA, 25 bp, Mus musculus
gttactaccaccagctgagtcggca

SEQ ID NO: 456445 - DNA, 25 bp, Mus musculus
gttactatcaagtcagatgcgcctg

SEQ ID NO: 456446 - DNA, 25 bp, Mus musculus
gttactatgaggaagccgtgccgct

SEQ ID NO: 456447 - DNA, 25 bp, Mus musculus
gttactccagagtgacgcaacaaca

SEQ ID NO: 456448 - DNA, 25 bp, Mus musculus
gttactccgggtgtcaacagctgcg

SEQ ID NO: 456449 - DNA, 25 bp, Mus musculus
gttactctctcagtgctcagccggg

SEQ ID NO: 456450 - DNA, 25 bp, Mus musculus
gttactgacccaagacggtggtgtg

SEQ ID NO: 456451 - DNA, 25 bp, Mus musculus
gttactgcccgatcaagcatcaagg

SEQ ID NO: 456452 - DNA, 25 bp, Mus musculus
gttactgctggctgtaagaccacca

SEQ ID NO: 456453 - DNA, 25 bp, Mus musculus
gttactggtaaggattggccggctc

SEQ ID NO: 456454 - DNA, 25 bp, Mus musculus
gttacttcaaagcacactgacgcag

SEQ ID NO: 456455 - DNA, 25 bp, Mus musculus
gttagaaaagcacacccgttactgg

SEQ ID NO: 456456 - DNA, 25 bp, Mus musculus
gttagaactgacacccgcccttgtg

SEQ ID NO: 456457 - DNA, 25 bp, Mus musculus
gttagacaagggaggaatcacagga

SEQ ID NO: 456458 - DNA, 25 bp, Mus musculus
gttagactgcagactcacacttcca

SEQ ID NO: 456459 - DNA, 25 bp, Mus musculus
gttagactgttaaggaacgtgggca

SEQ ID NO: 456460 - DNA, 25 bp, Mus musculus
gttagagccagcactttatcccggg

SEQ ID NO: 456461 - DNA, 25 bp, Mus musculus
gttagagcctcagagtgggtcgcca

SEQ ID NO: 456462 - DNA, 25 bp, Mus musculus
gttagaggattttgcacacatttag

SEQ ID NO: 456463 - DNA, 25 bp, Mus musculus
gttagcacatgatactcccagagga

SEQ ID NO: 456464 - DNA, 25 bp, Mus musculus
gttagccacacactgccacgtaaca

SEQ ID NO: 456465 - DNA, 25 bp, Mus musculus
gttagcggagtggagctgtctcact

SEQ ID NO: 456466 - DNA, 25 bp, Mus musculus
gttagctcagagatggcagttccca

SEQ ID NO: 456467 - DNA, 25 bp, Mus musculus
gttagctctcttgtatgtgtgtgca

SEQ ID NO: 456468 - DNA, 25 bp, Mus musculus
gttagctggccggaaactgcactgg

SEQ ID NO: 456469 - DNA, 25 bp, Mus musculus
gttagcttccagatccccacactgg

SEQ ID NO: 456470 - DNA, 25 bp, Mus musculus
gttaggaccattactgccagaggag

SEQ ID NO: 456471 - DNA, 25 bp, Mus musculus
gttagtccacacctattcatccatg

SEQ ID NO: 456472 - DNA, 25 bp, Mus musculus
gttagtccgggctgaactggccctg

SEQ ID NO: 456473 - DNA, 25 bp, Mus musculus
gttagtcctgacctagttagctgca

SEQ ID NO: 456474 - DNA, 25 bp, Mus musculus
gttagtggccacaggcttagtatcc

SEQ ID NO: 456475 - DNA, 25 bp, Mus musculus
gttagttaagttgtccatgcttgcc

SEQ ID NO: 456476 - DNA, 25 bp, Mus musculus
gttagttcacagtttttcagctatg

SEQ ID NO: 456477 - DNA, 25 bp, Mus musculus
gttataacctttttgaaggcaggca

SEQ ID NO: 456478 - DNA, 25 bp, Mus musculus
gttataattctctaccccgcagttg

SEQ ID NO: 456479 - DNA, 25 bp, Mus musculus
gttataatttcagctgtacatgcgc

SEQ ID NO: 456480 - DNA, 25 bp, Mus musculus
gttataccatcgttcggctgacccg

SEQ ID NO: 456481 - DNA, 25 bp, Mus musculus
gttataccttagagcccagatggag

SEQ ID NO: 456482 - DNA, 25 bp, Mus musculus
gttatacgggcaggagaggtcacca

SEQ ID NO: 456483 - DNA, 25 bp, Mus musculus
gttatagggacccagcttccagcac

SEQ ID NO: 456484 - DNA, 25 bp, Mus musculus
gttatagtcccatagccaacccagg

SEQ ID NO: 456485 - DNA, 25 bp, Mus musculus
gttatagtgaaacagcagttgaccc

SEQ ID NO: 456486 - DNA, 25 bp, Mus musculus
gttatcagccactctacacatctcg

SEQ ID NO: 456487 - DNA, 25 bp, Mus musculus
gttatcccagagcatgaatcaccga

SEQ ID NO: 456488 - DNA, 25 bp, Mus musculus
gttatccgtggtactgccagcctgc

SEQ ID NO: 456489 - DNA, 25 bp, Mus musculus
gttatcctcttaatgcacctgctgg

SEQ ID NO: 456490 - DNA, 25 bp, Mus musculus
gttatctagtacacaaatgcacatg

SEQ ID NO: 456491 - DNA, 25 bp, Mus musculus
gttatctgccaagaaacaggcatct

SEQ ID NO: 456492 - DNA, 25 bp, Mus musculus
gttatcttatccaccatccttacag

SEQ ID NO: 456493 - DNA, 25 bp, Mus musculus
gttatcttctgacgactcctcctcg

SEQ ID NO: 456494 - DNA, 25 bp, Mus musculus
gttatgacgccctagctgaccttca

SEQ ID NO: 456495 - DNA, 25 bp, Mus musculus
gttatgatacatatccacgcttggg

SEQ ID NO: 456496 - DNA, 25 bp, Mus musculus
gttatgatgaaagaccctccggact

SEQ ID NO: 456497 - DNA, 25 bp, Mus musculus
gttatgccctccttgcacacacagg

SEQ ID NO: 456498 - DNA, 25 bp, Mus musculus
gttattaaggtacctccacctgctg

SEQ ID NO: 456499 - DNA, 25 bp, Mus musculus
gttattaagtgcaaagcggctgtcc

SEQ ID NO: 456500 - DNA, 25 bp, Mus musculus
gttattactgacagccaccgacggg

SEQ ID NO: 456501 - DNA, 25 bp, Mus musculus
gttattacttatgcccagcgccagg

SEQ ID NO: 456502 - DNA, 25 bp, Mus musculus
gttattccaggaatctgaaagagat

SEQ ID NO: 456503 - DNA, 25 bp, Mus musculus
gttattgaggctgttttggctggca

SEQ ID NO: 456504 - DNA, 25 bp, Mus musculus
gttattgggaagaaccacgtggcag

SEQ ID NO: 456505 - DNA, 25 bp, Mus musculus
gttcaaaagactatccagctcaatg

SEQ ID NO: 456506 - DNA, 25 bp, Mus musculus
gttcaaagccacatgcaccaacgtg

SEQ ID NO: 456507 - DNA, 25 bp, Mus musculus
gttcaaagcccacccaagagaggaa

SEQ ID NO: 456508 - DNA, 25 bp, Mus musculus
gttcaaagcccagtgtaacctcgca

SEQ ID NO: 456509 - DNA, 25 bp, Mus musculus
gttcaacaagctgggctcagcctct

SEQ ID NO: 456510 - DNA, 25 bp, Mus musculus
gttcaaccagacagtccagagctct

SEQ ID NO: 456511 - DNA, 25 bp, Mus musculus
gttcaagagtactggttgctcttct

SEQ ID NO: 456512 - DNA, 25 bp, Mus musculus
gttcaagcttgctgaccccgatgag

SEQ ID NO: 456513 - DNA, 25 bp, Mus musculus
gttcaatatgtaacgggtttcaagg

SEQ ID NO: 456514 - DNA, 25 bp, Mus musculus
gttcacaacaaagagcaacttgaaa

SEQ ID NO: 456515 - DNA, 25 bp, Mus musculus
gttcacagaaggacataccaaaggg

SEQ ID NO: 456516 - DNA, 25 bp, Mus musculus
gttcacagttattttacggcaccaa

SEQ ID NO: 456517 - DNA, 25 bp, Mus musculus
gttcacatattacacacacgcaggg

SEQ ID NO: 456518 - DNA, 25 bp, Mus musculus
gttcacatcgctataccataaagag

SEQ ID NO: 456519 - DNA, 25 bp, Mus musculus
gttcaccaaacaatggccctgctgg

SEQ ID NO: 456520 - DNA, 25 bp, Mus musculus
gttcaccttcacagaaagcagccat

SEQ ID NO: 456521 - DNA, 25 bp, Mus musculus
gttcacctttgacacagatgcccgg

SEQ ID NO: 456522 - DNA, 25 bp, Mus musculus
gttcacggctatcccagcacattcg

SEQ ID NO: 456523 - DNA, 25 bp, Mus musculus
gttcacgggtttggatgctttgttt

SEQ ID NO: 456524 - DNA, 25 bp, Mus musculus
gttcactccagattaaaagtccaag

SEQ ID NO: 456525 - DNA, 25 bp, Mus musculus
gttcactctaattgtggtcctggct

SEQ ID NO: 456526 - DNA, 25 bp, Mus musculus
gttcactctgcagaacacactgagg

SEQ ID NO: 456527 - DNA, 25 bp, Mus musculus
gttcacttcttaaaacaggcagttg

SEQ ID NO: 456528 - DNA, 25 bp, Mus musculus
gttcagaactcttatcctacagcca

SEQ ID NO: 456529 - DNA, 25 bp, Mus musculus
gttcagaaggccacagaaaacttgc

SEQ ID NO: 456530 - DNA, 25 bp, Mus musculus
gttcagaatcgcagctcccagcttg

SEQ ID NO: 456531 - DNA, 25 bp, Mus musculus
gttcagagaggccaaggactcaccg

SEQ ID NO: 456532 - DNA, 25 bp, Mus musculus
gttcagatccctgagtgtctaggga

SEQ ID NO: 456533 - DNA, 25 bp, Mus musculus
gttcagatcctagccctcaaagaaa

SEQ ID NO: 456534 - DNA, 25 bp, Mus musculus
gttcagatttccagcacccttgtag

SEQ ID NO: 456535 - DNA, 25 bp, Mus musculus
gttcagcctacttcagacctcacag

SEQ ID NO: 456536 - DNA, 25 bp, Mus musculus
gttcagccttggaaactagtcttca

SEQ ID NO: 456537 - DNA, 25 bp, Mus musculus
gttcagcgacaggtacaagttccag

SEQ ID NO: 456538 - DNA, 25 bp, Mus musculus
gttcagctcgaaaaataattatttg

SEQ ID NO: 456539 - DNA, 25 bp, Mus musculus
gttcaggaagattaccacggtcaca

SEQ ID NO: 456540 - DNA, 25 bp, Mus musculus
gttcaggcccaccaaaatggcgagc

SEQ ID NO: 456541 - DNA, 25 bp, Mus musculus
gttcaggctctggatacttagattc

SEQ ID NO: 456542 - DNA, 25 bp, Mus musculus
gttcagtatgctggcagctcattgt

SEQ ID NO: 456543 - DNA, 25 bp, Mus musculus
gttcagtcacctaacagttgccagg

SEQ ID NO: 456544 - DNA, 25 bp, Mus musculus
gttcagtcagaccagtaagcccttc

SEQ ID NO: 456545 - DNA, 25 bp, Mus musculus
gttcagtctccctagtctgaaacca

SEQ ID NO: 456546 - DNA, 25 bp, Mus musculus
gttcagtggaattaaacccaacgca

SEQ ID NO: 456547 - DNA, 25 bp, Mus musculus
gttcagtgtgtagccctggcaccgg

SEQ ID NO: 456548 - DNA, 25 bp, Mus musculus
gttcatacttgcctgggaacttcag

SEQ ID NO: 456549 - DNA, 25 bp, Mus musculus
gttcatcaagaacggatcgcattgg

SEQ ID NO: 456550 - DNA, 25 bp, Mus musculus
gttcatcaaggagctgcggagccga

SEQ ID NO: 456551 - DNA, 25 bp, Mus musculus
gttcatcacctgtgccaagctctgc

SEQ ID NO: 456552 - DNA, 25 bp, Mus musculus
gttcatcagtaaaaacgagtttgcc

SEQ ID NO: 456553 - DNA, 25 bp, Mus musculus
gttcatccaacaggccactgagctg

SEQ ID NO: 456554 - DNA, 25 bp, Mus musculus
gttcatccacctgatgctgttttaa

SEQ ID NO: 456555 - DNA, 25 bp, Mus musculus
gttcatccggatagacacagcctgt

SEQ ID NO: 456556 - DNA, 25 bp, Mus musculus
gttcatctgaaacaaagtggatcga

SEQ ID NO: 456557 - DNA, 25 bp, Mus musculus
gttcatctgtttgagctgctctggg

SEQ ID NO: 456558 - DNA, 25 bp, Mus musculus
gttcattaccgcctagcctctaagg

SEQ ID NO: 456559 - DNA, 25 bp, Mus musculus
gttccaaagcaagaccaggcacagg

SEQ ID NO: 456560 - DNA, 25 bp, Mus musculus
gttccaaatggaaacacgctgccaa

SEQ ID NO: 456561 - DNA, 25 bp, Mus musculus
gttccaatacggaccagcaggcgag

SEQ ID NO: 456562 - DNA, 25 bp, Mus musculus
gttccacaaggaagaagcgctgccc

SEQ ID NO: 456563 - DNA, 25 bp, Mus musculus
gttccacctcccatgaacacatgag

SEQ ID NO: 456564 - DNA, 25 bp, Mus musculus
gttccacgccctgctaaccaagcat

SEQ ID NO: 456565 - DNA, 25 bp, Mus musculus
gttccagcaacaaccttggtccagt

SEQ ID NO: 456566 - DNA, 25 bp, Mus musculus
gttccagggtcaacctctgtttcct

SEQ ID NO: 456567 - DNA, 25 bp, Mus musculus
gttccagtacccgtgcctgaggctg

SEQ ID NO: 456568 - DNA, 25 bp, Mus musculus
gttccagtgaagataccctaaagag

SEQ ID NO: 456569 - DNA, 25 bp, Mus musculus
gttcccaaggactacggatgatgca

SEQ ID NO: 456570 - DNA, 25 bp, Mus musculus
gttcccaaggctggattgtggagtc

SEQ ID NO: 456571 - DNA, 25 bp, Mus musculus
gttcccacccagagcgacaaagttt

SEQ ID NO: 456572 - DNA, 25 bp, Mus musculus
gttcccaccctgctacgtgcagaga

SEQ ID NO: 456573 - DNA, 25 bp, Mus musculus
gttcccagcctcagtaatgttccag

SEQ ID NO: 456574 - DNA, 25 bp, Mus musculus
gttcccaggatgatgccagcaagga

SEQ ID NO: 456575 - DNA, 25 bp, Mus musculus
gttcccattaagagaaacctcggtg

SEQ ID NO: 456576 - DNA, 25 bp, Mus musculus
gttcccattgtgaagaagcactgcg

SEQ ID NO: 456577 - DNA, 25 bp, Mus musculus
gttccccacctgctcggactgagaa

SEQ ID NO: 456578 - DNA, 25 bp, Mus musculus
gttccccaggcctgtgatgcctaac

SEQ ID NO: 456579 - DNA, 25 bp, Mus musculus
gttccccgttctcagttccaaagct

SEQ ID NO: 456580 - DNA, 25 bp, Mus musculus
gttcccgcatccagccaggagtgaa

SEQ ID NO: 456581 - DNA, 25 bp, Mus musculus
gttcccgcgaggatccatgacctga

SEQ ID NO: 456582 - DNA, 25 bp, Mus musculus
gttcccggaccggaatccgagtgtg

SEQ ID NO: 456583 - DNA, 25 bp, Mus musculus
gttcccggcaacaacgcagccattt

SEQ ID NO: 456584 - DNA, 25 bp, Mus musculus
gttcccgttgtgagtatgctgaacc

SEQ ID NO: 456585 - DNA, 25 bp, Mus musculus
gttccctaggtgacggttctctccg

SEQ ID NO: 456586 - DNA, 25 bp, Mus musculus
gttccctgctgaagactgtaatatg

SEQ ID NO: 456587 - DNA, 25 bp, Mus musculus
gttccgacgttccagacccagggat

SEQ ID NO: 456588 - DNA, 25 bp, Mus musculus
gttccgatctatgaccaggtgagtt

SEQ ID NO: 456589 - DNA, 25 bp, Mus musculus
gttccgcctgcctcgggcagctaag

SEQ ID NO: 456590 - DNA, 25 bp, Mus musculus
gttccggaactttggaggcatgaaa

SEQ ID NO: 456591 - DNA, 25 bp, Mus musculus
gttccggaatgtaccacaggccaga

SEQ ID NO: 456592 - DNA, 25 bp, Mus musculus
gttccgggtagatatgcctggctcg

SEQ ID NO: 456593 - DNA, 25 bp, Mus musculus
gttccgggtgtctggtcagtctcag

SEQ ID NO: 456594 - DNA, 25 bp, Mus musculus
gttccgtgatgcacagcaccatctc

SEQ ID NO: 456595 - DNA, 25 bp, Mus musculus
gttccgtgggaataagagctttcct

SEQ ID NO: 456596 - DNA, 25 bp, Mus musculus
gttccgtgggctaattattactaca

SEQ ID NO: 456597 - DNA, 25 bp, Mus musculus
gttccgtgtggatcgcaaggacgac

SEQ ID NO: 456598 - DNA, 25 bp, Mus musculus
gttcctaacaggagcatcagtccag

SEQ ID NO: 456599 - DNA, 25 bp, Mus musculus
gttcctaagaaaaatccggcttcag

SEQ ID NO: 456600 - DNA, 25 bp, Mus musculus
gttcctactggagaagcctgcgctg

SEQ ID NO: 456601 - DNA, 25 bp, Mus musculus
gttcctcacaggtggtcaggcgcag

SEQ ID NO: 456602 - DNA, 25 bp, Mus musculus
gttcctcgtgctgtgatgaccccag

SEQ ID NO: 456603 - DNA, 25 bp, Mus musculus
gttcctcgtggagcccgacaaggag

SEQ ID NO: 456604 - DNA, 25 bp, Mus musculus
gttcctctcacctaagtgggcttca

SEQ ID NO: 456605 - DNA, 25 bp, Mus musculus
gttcctgacacggaagcccttcctc

SEQ ID NO: 456606 - DNA, 25 bp, Mus musculus
gttcctgccatataataagccttag

SEQ ID NO: 456607 - DNA, 25 bp, Mus musculus
gttcctgccatgactcatctcaggg

SEQ ID NO: 456608 - DNA, 25 bp, Mus musculus
gttcctgcccagacgtccctggatg

SEQ ID NO: 456609 - DNA, 25 bp, Mus musculus
gttccttcccagctgagtccagtag

SEQ ID NO: 456610 - DNA, 25 bp, Mus musculus
gttccttctcagctgacatcccaga

SEQ ID NO: 456611 - DNA, 25 bp, Mus musculus
gttccttgccttgactccttggaga

SEQ ID NO: 456612 - DNA, 25 bp, Mus musculus
gttcgaaataaagcgggagccttct

SEQ ID NO: 456613 - DNA, 25 bp, Mus musculus
gttcgaaatgaatggcaaggccctc

SEQ ID NO: 456614 - DNA, 25 bp, Mus musculus
gttcgaccactatagcaagcaggag

SEQ ID NO: 456615 - DNA, 25 bp, Mus musculus
gttcgacttccgaaggagcccgcgg

SEQ ID NO: 456616 - DNA, 25 bp, Mus musculus
gttcgagaacagtacaccacggtca

SEQ ID NO: 456617 - DNA, 25 bp, Mus musculus
gttcgagaacatcaaggaagagtac

SEQ ID NO: 456618 - DNA, 25 bp, Mus musculus
gttcgagtttgaccccaatgccagg

SEQ ID NO: 456619 - DNA, 25 bp, Mus musculus
gttcgagtttggattttaggcgcca

SEQ ID NO: 456620 - DNA, 25 bp, Mus musculus
gttcgcccggcctgggctagcacgt

SEQ ID NO: 456621 - DNA, 25 bp, Mus musculus
gttcgcctatgctgatgccagggcc

SEQ ID NO: 456622 - DNA, 25 bp, Mus musculus
gttcgcgacccatacagctcgactg

SEQ ID NO: 456623 - DNA, 25 bp, Mus musculus
gttcgcgcacggcttccacgagctg

SEQ ID NO: 456624 - DNA, 25 bp, Mus musculus
gttcgctaccgaatgaggagcccca

SEQ ID NO: 456625 - DNA, 25 bp, Mus musculus
gttcggagcatctgcaacagccatg

SEQ ID NO: 456626 - DNA, 25 bp, Mus musculus
gttcgtcagcggttcagccggctga

SEQ ID NO: 456627 - DNA, 25 bp, Mus musculus
gttcgtgtacaaagaggagcatccg

SEQ ID NO: 456628 - DNA, 25 bp, Mus musculus
gttcgtgtgtggtatctgcctgccg

SEQ ID NO: 456629 - DNA, 25 bp, Mus musculus
gttctaaagttcaaggtagggcatt

SEQ ID NO: 456630 - DNA, 25 bp, Mus musculus
gttctaactctggtcatacatgtgc

SEQ ID NO: 456631 - DNA, 25 bp, Mus musculus
gttctaatgtcttcacggcgtggcg

SEQ ID NO: 456632 - DNA, 25 bp, Mus musculus
gttctacacacaaccatgctgcggg

SEQ ID NO: 456633 - DNA, 25 bp, Mus musculus
gttctacacggcacacactgtcggt

SEQ ID NO: 456634 - DNA, 25 bp, Mus musculus
gttctacagaagcaacgagtgtcct

SEQ ID NO: 456635 - DNA, 25 bp, Mus musculus
gttctacctagcaccctagctctag

SEQ ID NO: 456636 - DNA, 25 bp, Mus musculus
gttctaccttgcgagtgctacacgg

SEQ ID NO: 456637 - DNA, 25 bp, Mus musculus
gttctacgacaaagacggctcacgg

SEQ ID NO: 456638 - DNA, 25 bp, Mus musculus
gttctaggccagcacgggatacgta

SEQ ID NO: 456639 - DNA, 25 bp, Mus musculus
gttctattcctaactctgttttcaa

SEQ ID NO: 456640 - DNA, 25 bp, Mus musculus
gttctatttcccacttcaaatggcc

SEQ ID NO: 456641 - DNA, 25 bp, Mus musculus
gttctcagtcgtaagctgacttctg

SEQ ID NO: 456642 - DNA, 25 bp, Mus musculus
gttctcatgcagagtggccgagcca

SEQ ID NO: 456643 - DNA, 25 bp, Mus musculus
gttctccagggagcgctcattgaga

SEQ ID NO: 456644 - DNA, 25 bp, Mus musculus
gttctccatcgctagtgactacagg

SEQ ID NO: 456645 - DNA, 25 bp, Mus musculus
gttctcccactttcaggacaaaaag

SEQ ID NO: 456646 - DNA, 25 bp, Mus musculus
gttctcccatgggcaggtggtatct

SEQ ID NO: 456647 - DNA, 25 bp, Mus musculus
gttctcgagtaagatttagctcccg

SEQ ID NO: 456648 - DNA, 25 bp, Mus musculus
gttctctacctgtgtgacacctcca

SEQ ID NO: 456649 - DNA, 25 bp, Mus musculus
gttctctagtgctggtagtcaggca

SEQ ID NO: 456650 - DNA, 25 bp, Mus musculus
gttctgacttctccactatgcaggg

SEQ ID NO: 456651 - DNA, 25 bp, Mus musculus
gttctgagcatatacccacctgtgt

SEQ ID NO: 456652 - DNA, 25 bp, Mus musculus
gttctgagccacgaggaccttactg

SEQ ID NO: 456653 - DNA, 25 bp, Mus musculus
gttctgatcccaggcctgctgctgt

SEQ ID NO: 456654 - DNA, 25 bp, Mus musculus
gttctgatgggctagctgcttgagt

SEQ ID NO: 456655 - DNA, 25 bp, Mus musculus
gttctgattagtgttggacatgcca

SEQ ID NO: 456656 - DNA, 25 bp, Mus musculus
gttctgcagacgagccaatgaccac

SEQ ID NO: 456657 - DNA, 25 bp, Mus musculus
gttctgcatcttgagctacaggcat

SEQ ID NO: 456658 - DNA, 25 bp, Mus musculus
gttctgcccaccctgggcagttacg

SEQ ID NO: 456659 - DNA, 25 bp, Mus musculus
gttctgcgttctcgagaggttccca

SEQ ID NO: 456660 - DNA, 25 bp, Mus musculus
gttctgctgatcctaattctggcca

SEQ ID NO: 456661 - DNA, 25 bp, Mus musculus
gttctggaagacacacatggctgcg

SEQ ID NO: 456662 - DNA, 25 bp, Mus musculus
gttctggacaagctcacactgtgca

SEQ ID NO: 456663 - DNA, 25 bp, Mus musculus
gttctggactctgttggcctccgtg

SEQ ID NO: 456664 - DNA, 25 bp, Mus musculus
gttctggagaggaggacatctttct

SEQ ID NO: 456665 - DNA, 25 bp, Mus musculus
gttctggctgaaatggtaaatacat

SEQ ID NO: 456666 - DNA, 25 bp, Mus musculus
gttctggtatccaaaagcaggctgg

SEQ ID NO: 456667 - DNA, 25 bp, Mus musculus
gttctgtacttcaccaatggccacc

SEQ ID NO: 456668 - DNA, 25 bp, Mus musculus
gttctgtggcagtagcatcctcggc

SEQ ID NO: 456669 - DNA, 25 bp, Mus musculus
gttctgttttagagatgcctctgtg

SEQ ID NO: 456670 - DNA, 25 bp, Mus musculus
gttcttaagaacacatctatttcca

SEQ ID NO: 456671 - DNA, 25 bp, Mus musculus
gttcttattttcagatagccccacc

SEQ ID NO: 456672 - DNA, 25 bp, Mus musculus
gttcttcacacctcaagcatcccag

SEQ ID NO: 456673 - DNA, 25 bp, Mus musculus
gttcttcagcttcgagccggtgccg

SEQ ID NO: 456674 - DNA, 25 bp, Mus musculus
gttcttctccagtaacagctgcagg

SEQ ID NO: 456675 - DNA, 25 bp, Mus musculus
gttcttgcaaaaaatcctacccagg

SEQ ID NO: 456676 - DNA, 25 bp, Mus musculus
gttctttatatctacgttggaccag

SEQ ID NO: 456677 - DNA, 25 bp, Mus musculus
gttgaaagcgctggtttctccttcg

SEQ ID NO: 456678 - DNA, 25 bp, Mus musculus
gttgaacgctctgactaccgcagct

SEQ ID NO: 456679 - DNA, 25 bp, Mus musculus
gttgaactccgcttacatgactggg

SEQ ID NO: 456680 - DNA, 25 bp, Mus musculus
gttgaactgcccacttccctttcta

SEQ ID NO: 456681 - DNA, 25 bp, Mus musculus
gttgaagatctcaagcgtgagcctc

SEQ ID NO: 456682 - DNA, 25 bp, Mus musculus
gttgaaggtctccagcggctccaaa

SEQ ID NO: 456683 - DNA, 25 bp, Mus musculus
gttgaagtccaaaagcctcccgagg

SEQ ID NO: 456684 - DNA, 25 bp, Mus musculus
gttgaagtccgcctgcattagctgt

SEQ ID NO: 456685 - DNA, 25 bp, Mus musculus
gttgaagttgctttccccgggctcg

SEQ ID NO: 456686 - DNA, 25 bp, Mus musculus
gttgaataccgcgttgctgcagacc

SEQ ID NO: 456687 - DNA, 25 bp, Mus musculus
gttgaatgccgagttagtttgcccg

SEQ ID NO: 456688 - DNA, 25 bp, Mus musculus
gttgaatgttcctcccgatcttctg

SEQ ID NO: 456689 - DNA, 25 bp, Mus musculus
gttgacaccctgcaccatgtctggg

SEQ ID NO: 456690 - DNA, 25 bp, Mus musculus
gttgacacttttgatgaagagcccc

SEQ ID NO: 456691 - DNA, 25 bp, Mus musculus
gttgacagcaccagtggacagcggt

SEQ ID NO: 456692 - DNA, 25 bp, Mus musculus
gttgacagccaaagagtccacgcct

SEQ ID NO: 456693 - DNA, 25 bp, Mus musculus
gttgaccaggcttaaatgatcttcc

SEQ ID NO: 456694 - DNA, 25 bp, Mus musculus
gttgaccgcacccatgaggacgatg

SEQ ID NO: 456695 - DNA, 25 bp, Mus musculus
gttgacgagatgaaaggccggaccc

SEQ ID NO: 456696 - DNA, 25 bp, Mus musculus
gttgacgcacaaccgagcacattga

SEQ ID NO: 456697 - DNA, 25 bp, Mus musculus
gttgactcaccaggaacaccgtgtg

SEQ ID NO: 456698 - DNA, 25 bp, Mus musculus
gttgactcatcaaaccaatgcagac

SEQ ID NO: 456699 - DNA, 25 bp, Mus musculus
gttgagaaaacacgaagccttcctg

SEQ ID NO: 456700 - DNA, 25 bp, Mus musculus
gttgagacggttacaggtgaaatcc

SEQ ID NO: 456701 - DNA, 25 bp, Mus musculus
gttgagcttttctgagccttcggtt

SEQ ID NO: 456702 - DNA, 25 bp, Mus musculus
gttgatacaaacctcgccatagcgg

SEQ ID NO: 456703 - DNA, 25 bp, Mus musculus
gttgatcagtatccagcagcggccg

SEQ ID NO: 456704 - DNA, 25 bp, Mus musculus
gttgatgagcttcccatggaatgca

SEQ ID NO: 456705 - DNA, 25 bp, Mus musculus
gttgatgcacactaatacgagtcca

SEQ ID NO: 456706 - DNA, 25 bp, Mus musculus
gttgatgctttaatagcagtacccc

SEQ ID NO: 456707 - DNA, 25 bp, Mus musculus
gttgatgtgccattctacgtgaggg

SEQ ID NO: 456708 - DNA, 25 bp, Mus musculus
gttgcaagagttcccggcggcggct

SEQ ID NO: 456709 - DNA, 25 bp, Mus musculus
gttgcaccacaagaccggagttcct

SEQ ID NO: 456710 - DNA, 25 bp, Mus musculus
gttgcacgaaccactaattgtcctg

SEQ ID NO: 456711 - DNA, 25 bp, Mus musculus
gttgcacgcagaccccttcattcat

SEQ ID NO: 456712 - DNA, 25 bp, Mus musculus
gttgcactgattgatgggattcgag

SEQ ID NO: 456713 - DNA, 25 bp, Mus musculus
gttgcagacttgcatgttacgggtc

SEQ ID NO: 456714 - DNA, 25 bp, Mus musculus
gttgcaggcagcgttggtgacacca

SEQ ID NO: 456715 - DNA, 25 bp, Mus musculus
gttgcagggccctacaggtccagtt

SEQ ID NO: 456716 - DNA, 25 bp, Mus musculus
gttgcagtcggcgtcagagcagctc

SEQ ID NO: 456717 - DNA, 25 bp, Mus musculus
gttgcagtctgaagccgtccctgga

SEQ ID NO: 456718 - DNA, 25 bp, Mus musculus
gttgcatctcctgtgaaatggacac

SEQ ID NO: 456719 - DNA, 25 bp, Mus musculus
gttgcattggcagacatgattctca

SEQ ID NO: 456720 - DNA, 25 bp, Mus musculus
gttgcatttaggatgctgcagctga

SEQ ID NO: 456721 - DNA, 25 bp, Mus musculus
gttgccaaggacaggaacgctctgc

SEQ ID NO: 456722 - DNA, 25 bp, Mus musculus
gttgccaaggataacaccacgtgtg

SEQ ID NO: 456723 - DNA, 25 bp, Mus musculus
gttgccaaggcttccatgaataagg

SEQ ID NO: 456724 - DNA, 25 bp, Mus musculus
gttgccaccacatgactaataaatg

SEQ ID NO: 456725 - DNA, 25 bp, Mus musculus
gttgccctaagatgccacgatgctg

SEQ ID NO: 456726 - DNA, 25 bp, Mus musculus
gttgccctttgtccttgcaggaaaa

SEQ ID NO: 456727 - DNA, 25 bp, Mus musculus
gttgcctagattggagccggacgcc

SEQ ID NO: 456728 - DNA, 25 bp, Mus musculus
gttgcctcaggtgtatatcaacatc

SEQ ID NO: 456729 - DNA, 25 bp, Mus musculus
gttgcctgccatccgaggaggctca

SEQ ID NO: 456730 - DNA, 25 bp, Mus musculus
gttgcctgcctacatctgcgaatga

SEQ ID NO: 456731 - DNA, 25 bp, Mus musculus
gttgccttaagctgcacctgccgag

SEQ ID NO: 456732 - DNA, 25 bp, Mus musculus
gttgcgcacagtccctctgctagca

SEQ ID NO: 456733 - DNA, 25 bp, Mus musculus
gttgcgcatatctctatataaagtt

SEQ ID NO: 456734 - DNA, 25 bp, Mus musculus
gttgcgctcgcactactgcgcgctg

SEQ ID NO: 456735 - DNA, 25 bp, Mus musculus
gttgcggtctagctccacctcgctg

SEQ ID NO: 456736 - DNA, 25 bp, Mus musculus
gttgctaaacaattgggagcccagc

SEQ ID NO: 456737 - DNA, 25 bp, Mus musculus
gttgctacagcaacaagtagtttgc

SEQ ID NO: 456738 - DNA, 25 bp, Mus musculus
gttgctacatttggcccaccacggg

SEQ ID NO: 456739 - DNA, 25 bp, Mus musculus
gttgctagccttttggcacgtgttt

SEQ ID NO: 456740 - DNA, 25 bp, Mus musculus
gttgctagttcaagctctctatccc

SEQ ID NO: 456741 - DNA, 25 bp, Mus musculus
gttgctataacgacaagcctggcag

SEQ ID NO: 456742 - DNA, 25 bp, Mus musculus
gttgctatcaacacacagaggccct

SEQ ID NO: 456743 - DNA, 25 bp, Mus musculus
gttgctcaacattctggacgccagg

SEQ ID NO: 456744 - DNA, 25 bp, Mus musculus
gttgctcaagaaacagacgtgcggg

SEQ ID NO: 456745 - DNA, 25 bp, Mus musculus
gttgctcagcggaacagcatccatt

SEQ ID NO: 456746 - DNA, 25 bp, Mus musculus
gttgctcctctggttgacctgagtg

SEQ ID NO: 456747 - DNA, 25 bp, Mus musculus
gttgctgcagactcccaatgtcgga

SEQ ID NO: 456748 - DNA, 25 bp, Mus musculus
gttgctgctcctcagacgccgggac

SEQ ID NO: 456749 - DNA, 25 bp, Mus musculus
gttgctggccaagcgtcgctacatg

SEQ ID NO: 456750 - DNA, 25 bp, Mus musculus
gttgctggtcctgagttccataaga

SEQ ID NO: 456751 - DNA, 25 bp, Mus musculus
gttgctgtcattcttcgttctccca

SEQ ID NO: 456752 - DNA, 25 bp, Mus musculus
gttgctgtgctcacaagtgccttcc

SEQ ID NO: 456753 - DNA, 25 bp, Mus musculus
gttgctgtttcgcagacccacaggc

SEQ ID NO: 456754 - DNA, 25 bp, Mus musculus
gttgcttaaagtcctgaccagggtg

SEQ ID NO: 456755 - DNA, 25 bp, Mus musculus
gttgcttagcaacaaaaggtcacaa

SEQ ID NO: 456756 - DNA, 25 bp, Mus musculus
gttgcttcagcaagccacaagttgg

SEQ ID NO: 456757 - DNA, 25 bp, Mus musculus
gttgcttgcctcagtacaatgtggg

SEQ ID NO: 456758 - DNA, 25 bp, Mus musculus
gttggaaaccatcccacatttgagg

SEQ ID NO: 456759 - DNA, 25 bp, Mus musculus
gttggaaccattctcacccatgaaa

SEQ ID NO: 456760 - DNA, 25 bp, Mus musculus
gttggaaccttctgacgagccggac

SEQ ID NO: 456761 - DNA, 25 bp, Mus musculus
gttggaactggtgcagaacgtctgc

SEQ ID NO: 456762 - DNA, 25 bp, Mus musculus
gttggaatcacacattactctgctg

SEQ ID NO: 456763 - DNA, 25 bp, Mus musculus
gttggaatggaatctgggacacctg

SEQ ID NO: 456764 - DNA, 25 bp, Mus musculus
gttggaccctgaacagcgctggcta

SEQ ID NO: 456765 - DNA, 25 bp, Mus musculus
gttggaccgtcgcaattctcccatg

SEQ ID NO: 456766 - DNA, 25 bp, Mus musculus
gttggacttccagaacgccgtgtgt

SEQ ID NO: 456767 - DNA, 25 bp, Mus musculus
gttggagactctccactcgaagtgt

SEQ ID NO: 456768 - DNA, 25 bp, Mus musculus
gttggagcgcaaaacgacacttaca

SEQ ID NO: 456769 - DNA, 25 bp, Mus musculus
gttggatcatctgtgctacattgga

SEQ ID NO: 456770 - DNA, 25 bp, Mus musculus
gttggatctacctctagcagctagc

SEQ ID NO: 456771 - DNA, 25 bp, Mus musculus
gttggattccatcactgcctcggag

SEQ ID NO: 456772 - DNA, 25 bp, Mus musculus
gttggcacgtttccagcctcagggt

SEQ ID NO: 456773 - DNA, 25 bp, Mus musculus
gttggcagaagctaccctgtgtttt

SEQ ID NO: 456774 - DNA, 25 bp, Mus musculus
gttggccaccacatagtagtacccc

SEQ ID NO: 456775 - DNA, 25 bp, Mus musculus
gttggccacgttcggtcactcgagt

SEQ ID NO: 456776 - DNA, 25 bp, Mus musculus
gttggcctcagctttcagacttgcg

SEQ ID NO: 456777 - DNA, 25 bp, Mus musculus
gttggcctgccctgtggtgaagaca

SEQ ID NO: 456778 - DNA, 25 bp, Mus musculus
gttggccttcgacaccgagctggta

SEQ ID NO: 456779 - DNA, 25 bp, Mus musculus
gttggcgacggctctgaggacaacc

SEQ ID NO: 456780 - DNA, 25 bp, Mus musculus
gttggcgccacctgcacgggcttct

SEQ ID NO: 456781 - DNA, 25 bp, Mus musculus
gttggcgcccgtgcgaccgcataaa

SEQ ID NO: 456782 - DNA, 25 bp, Mus musculus
gttggcgcgctttacggacctggaa

SEQ ID NO: 456783 - DNA, 25 bp, Mus musculus
gttggcgtggtaacacatgcgttgc

SEQ ID NO: 456784 - DNA, 25 bp, Mus musculus
gttggctaggcagcaggaataccca

SEQ ID NO: 456785 - DNA, 25 bp, Mus musculus
gttggctagtttcgaagtaacctgt

SEQ ID NO: 456786 - DNA, 25 bp, Mus musculus
gttggctgcccttaagtcacctttg

SEQ ID NO: 456787 - DNA, 25 bp, Mus musculus
gttggctggtgcagcaacccggctt

SEQ ID NO: 456788 - DNA, 25 bp, Mus musculus
gttggcttacacagtttgatttagt

SEQ ID NO: 456789 - DNA, 25 bp, Mus musculus
gttgggaaactactacattgctgca

SEQ ID NO: 456790 - DNA, 25 bp, Mus musculus
gttgggaatatatcacttaaggacc

SEQ ID NO: 456791 - DNA, 25 bp, Mus musculus
gttgggacaagcgaccccagcggct

SEQ ID NO: 456792 - DNA, 25 bp, Mus musculus
gttgggacagtggtttggacaccta

SEQ ID NO: 456793 - DNA, 25 bp, Mus musculus
gttgggaccaaagttaactcttgag

SEQ ID NO: 456794 - DNA, 25 bp, Mus musculus
gttgggagaatcaagaaaagtcatc

SEQ ID NO: 456795 - DNA, 25 bp, Mus musculus
gttgggagattaccaccaccttgga

SEQ ID NO: 456796 - DNA, 25 bp, Mus musculus
gttgggcatgacattacaaccccag

SEQ ID NO: 456797 - DNA, 25 bp, Mus musculus
gttgggccaggttttcatgcgtatt

SEQ ID NO: 456798 - DNA, 25 bp, Mus musculus
gttgggccgctaatcaaataaacag

SEQ ID NO: 456799 - DNA, 25 bp, Mus musculus
gttgggctactccaggactgcccag

SEQ ID NO: 456800 - DNA, 25 bp, Mus musculus
gttgggctccacaccatacagctcg

SEQ ID NO: 456801 - DNA, 25 bp, Mus musculus
gttgggctgccaagtttgtctgacc

SEQ ID NO: 456802 - DNA, 25 bp, Mus musculus
gttgggttccatgtccacctgtatg

SEQ ID NO: 456803 - DNA, 25 bp, Mus musculus
gttgggttcccacacaatctcctag

SEQ ID NO: 456804 - DNA, 25 bp, Mus musculus
gttggtactgtaagcatgtcatgtc

SEQ ID NO: 456805 - DNA, 25 bp, Mus musculus
gttggtatcctgttccccagcgaga

SEQ ID NO: 456806 - DNA, 25 bp, Mus musculus
gttggtcaccacagacctaccatgt

SEQ ID NO: 456807 - DNA, 25 bp, Mus musculus
gttggtccccagacggagttgtgat

SEQ ID NO: 456808 - DNA, 25 bp, Mus musculus
gttggtgagggcagcacacgctcct

SEQ ID NO: 456809 - DNA, 25 bp, Mus musculus
gttggtgtttcagctttctctgtca

SEQ ID NO: 456810 - DNA, 25 bp, Mus musculus
gttgtaactatgctgaaggtccctc

SEQ ID NO: 456811 - DNA, 25 bp, Mus musculus
gttgtactttcatgcaccacaggga

SEQ ID NO: 456812 - DNA, 25 bp, Mus musculus
gttgtagattccgacataattgtac

SEQ ID NO: 456813 - DNA, 25 bp, Mus musculus
gttgtaggtaagatatctttcaggt

SEQ ID NO: 456814 - DNA, 25 bp, Mus musculus
gttgtagtcactccaattttggtca

SEQ ID NO: 456815 - DNA, 25 bp, Mus musculus
gttgtagtctgatgtggtcggaaca

SEQ ID NO: 456816 - DNA, 25 bp, Mus musculus
gttgtcacctgaaaacctacctgga

SEQ ID NO: 456817 - DNA, 25 bp, Mus musculus
gttgtcagaacagccacagagcgca

SEQ ID NO: 456818 - DNA, 25 bp, Mus musculus
gttgtcattgaagagtcaggcagca

SEQ ID NO: 456819 - DNA, 25 bp, Mus musculus
gttgtcattggcatcatcgccaccg

SEQ ID NO: 456820 - DNA, 25 bp, Mus musculus
gttgtcctaggaacatcatcatggg

SEQ ID NO: 456821 - DNA, 25 bp, Mus musculus
gttgtccttggtgaggaatgcccaa

SEQ ID NO: 456822 - DNA, 25 bp, Mus musculus
gttgtcttggctcacctcatcacag

SEQ ID NO: 456823 - DNA, 25 bp, Mus musculus
gttgtctttaattactaccacgtag

SEQ ID NO: 456824 - DNA, 25 bp, Mus musculus
gttgtgaccacgactgcctctggga

SEQ ID NO: 456825 - DNA, 25 bp, Mus musculus
gttgtgaccatcaaacccggaggct

SEQ ID NO: 456826 - DNA, 25 bp, Mus musculus
gttgtgaccatttcctacattctga

SEQ ID NO: 456827 - DNA, 25 bp, Mus musculus
gttgtgagggactccaagaactcca

SEQ ID NO: 456828 - DNA, 25 bp, Mus musculus
gttgtgccctacctggatgagcccc

SEQ ID NO: 456829 - DNA, 25 bp, Mus musculus
gttgtgctgtgtacattcccatggg

SEQ ID NO: 456830 - DNA, 25 bp, Mus musculus
gttgtgggtccactacactgtggca

SEQ ID NO: 456831 - DNA, 25 bp, Mus musculus
gttgtgtccgattctgattgctcca

SEQ ID NO: 456832 - DNA, 25 bp, Mus musculus
gttgttagtcctgtgactgtctggg

SEQ ID NO: 456833 - DNA, 25 bp, Mus musculus
gttgttcctgctcctgtctctctag

SEQ ID NO: 456834 - DNA, 25 bp, Mus musculus
gttgttctagagctgaccactccag

SEQ ID NO: 456835 - DNA, 25 bp, Mus musculus
gttgttgagcgaaggccgacatgcc

SEQ ID NO: 456836 - DNA, 25 bp, Mus musculus
gttgttggcgcgttagacctcccag

SEQ ID NO: 456837 - DNA, 25 bp, Mus musculus
gttgttgttgctgcccgctctgagc

SEQ ID NO: 456838 - DNA, 25 bp, Mus musculus
gttgtttctaccttgctttccctag

SEQ ID NO: 456839 - DNA, 25 bp, Mus musculus
gtttaaaaccaagcagacccacctg

SEQ ID NO: 456840 - DNA, 25 bp, Mus musculus
gtttaaacctgattgccccaagaag

SEQ ID NO: 456841 - DNA, 25 bp, Mus musculus
gtttaaaccttgctcaggctcggca

SEQ ID NO: 456842 - DNA, 25 bp, Mus musculus
gtttaaatccccacgctgaaccagg

SEQ ID NO: 456843 - DNA, 25 bp, Mus musculus
gtttaagaacctcctggctggcggc

SEQ ID NO: 456844 - DNA, 25 bp, Mus musculus
gtttaaggtcccattctgcaaggca

SEQ ID NO: 456845 - DNA, 25 bp, Mus musculus
gtttaaggttctcggcacgcctcgc

SEQ ID NO: 456846 - DNA, 25 bp, Mus musculus
gtttaataagttcactacatgtcag

SEQ ID NO: 456847 - DNA, 25 bp, Mus musculus
gtttaatagaacagacgcatccgga

SEQ ID NO: 456848 - DNA, 25 bp, Mus musculus
gtttaatcttgttcagcgaacagca

SEQ ID NO: 456849 - DNA, 25 bp, Mus musculus
gtttaattgctgtgaagagctactc

SEQ ID NO: 456850 - DNA, 25 bp, Mus musculus
gtttacaaagtgactcgtcccctgg

SEQ ID NO: 456851 - DNA, 25 bp, Mus musculus
gtttacaagagatcacacgtgccat

SEQ ID NO: 456852 - DNA, 25 bp, Mus musculus
gtttaccaaaccctagaatgcaggg

SEQ ID NO: 456853 - DNA, 25 bp, Mus musculus
gtttaccagcaaactggagggcatg

SEQ ID NO: 456854 - DNA, 25 bp, Mus musculus
gtttacctgaggaacaatggactgt

SEQ ID NO: 456855 - DNA, 25 bp, Mus musculus
gtttactggcactaagcactggcac

SEQ ID NO: 456856 - DNA, 25 bp, Mus musculus
gtttactgtactgctggtctcctgg

SEQ ID NO: 456857 - DNA, 25 bp, Mus musculus
gtttagagagaggacacccctctcc

SEQ ID NO: 456858 - DNA, 25 bp, Mus musculus
gtttagcacttagtgaacttctcag

SEQ ID NO: 456859 - DNA, 25 bp, Mus musculus
gtttagctctcagcttgtacgaggc

SEQ ID NO: 456860 - DNA, 25 bp, Mus musculus
gtttagtccagcttatcaaatgtca

SEQ ID NO: 456861 - DNA, 25 bp, Mus musculus
gtttatacggactgaaatgtaaggg

SEQ ID NO: 456862 - DNA, 25 bp, Mus musculus
gtttatcactttcatgcattccatg

SEQ ID NO: 456863 - DNA, 25 bp, Mus musculus
gtttatccttccacaatcatcctca

SEQ ID NO: 456864 - DNA, 25 bp, Mus musculus
gtttatggaaaagcatctgcctgac

SEQ ID NO: 456865 - DNA, 25 bp, Mus musculus
gtttattcagctcaccggccagtag

SEQ ID NO: 456866 - DNA, 25 bp, Mus musculus
gtttcaaatgtgactgcccctccgg

SEQ ID NO: 456867 - DNA, 25 bp, Mus musculus
gtttcaccggcaagactgatcttag

SEQ ID NO: 456868 - DNA, 25 bp, Mus musculus
gtttcagaaccaggaccggaaccag

SEQ ID NO: 456869 - DNA, 25 bp, Mus musculus
gtttcagccaagtcccagagaaaag

SEQ ID NO: 456870 - DNA, 25 bp, Mus musculus
gtttcaggcgcagagtcccattcag

SEQ ID NO: 456871 - DNA, 25 bp, Mus musculus
gtttcagtttgccacctccagatgt

SEQ ID NO: 456872 - DNA, 25 bp, Mus musculus
gtttcatactactggcctggcctgg

SEQ ID NO: 456873 - DNA, 25 bp, Mus musculus
gtttccaaattgacctacctgtggg

SEQ ID NO: 456874 - DNA, 25 bp, Mus musculus
gtttccaagtgacaccccaggaggg

SEQ ID NO: 456875 - DNA, 25 bp, Mus musculus
gtttccaccaactcttggaggccag

SEQ ID NO: 456876 - DNA, 25 bp, Mus musculus
gtttccagaccttcaggagcttgat

SEQ ID NO: 456877 - DNA, 25 bp, Mus musculus
gtttcccaatcagtcaaaggcagca

SEQ ID NO: 456878 - DNA, 25 bp, Mus musculus
gtttcccatggaagagacgcctctg

SEQ ID NO: 456879 - DNA, 25 bp, Mus musculus
gtttcccggaaagaagcaactgcaa

SEQ ID NO: 456880 - DNA, 25 bp, Mus musculus
gtttcccttcccgagcaatggcaag

SEQ ID NO: 456881 - DNA, 25 bp, Mus musculus
gtttccgaagtaagtctgtatagag

SEQ ID NO: 456882 - DNA, 25 bp, Mus musculus
gtttccgtgtgatcctcctgtccca

SEQ ID NO: 456883 - DNA, 25 bp, Mus musculus
gtttcctcaccgatattctctctct

SEQ ID NO: 456884 - DNA, 25 bp, Mus musculus
gtttcctgaggtttacgtgcccaca

SEQ ID NO: 456885 - DNA, 25 bp, Mus musculus
gtttcctgcgcaagtacggctctga

SEQ ID NO: 456886 - DNA, 25 bp, Mus musculus
gtttcctgctaaagccgtgtccgag

SEQ ID NO: 456887 - DNA, 25 bp, Mus musculus
gtttcctgtgtggctctctagtgaa

SEQ ID NO: 456888 - DNA, 25 bp, Mus musculus
gtttccttatcagcccacagcattg

SEQ ID NO: 456889 - DNA, 25 bp, Mus musculus
gtttcctttctgtgtcactggcata

SEQ ID NO: 456890 - DNA, 25 bp, Mus musculus
gtttcgacaccagcttttagccagg

SEQ ID NO: 456891 - DNA, 25 bp, Mus musculus
gtttcgagcccaacagccagatggt

SEQ ID NO: 456892 - DNA, 25 bp, Mus musculus
gtttcgttgtcggtatcggtcttca

SEQ ID NO: 456893 - DNA, 25 bp, Mus musculus
gtttctaaaatgctggaccgcctgc

SEQ ID NO: 456894 - DNA, 25 bp, Mus musculus
gtttctaaactcttaacacctgaag

SEQ ID NO: 456895 - DNA, 25 bp, Mus musculus
gtttctaaagaagcgggagcagcac

SEQ ID NO: 456896 - DNA, 25 bp, Mus musculus
gtttctaataaattcctccaggcca

SEQ ID NO: 456897 - DNA, 25 bp, Mus musculus
gtttctactggccagaatgttggat

SEQ ID NO: 456898 - DNA, 25 bp, Mus musculus
gtttctagacagaccctcacctggg

SEQ ID NO: 456899 - DNA, 25 bp, Mus musculus
gtttctagtccaagcagcagccgag

SEQ ID NO: 456900 - DNA, 25 bp, Mus musculus
gtttctcagctatctggctctgtag

SEQ ID NO: 456901 - DNA, 25 bp, Mus musculus
gtttctcattaaagagtgccttcca

SEQ ID NO: 456902 - DNA, 25 bp, Mus musculus
gtttctccagagcaagtgacagtca

SEQ ID NO: 456903 - DNA, 25 bp, Mus musculus
gtttctccccagacgtggtcatatg

SEQ ID NO: 456904 - DNA, 25 bp, Mus musculus
gtttctgcagcaatggtgaagcccc

SEQ ID NO: 456905 - DNA, 25 bp, Mus musculus
gtttctgcatgatattgtattcgta

SEQ ID NO: 456906 - DNA, 25 bp, Mus musculus
gtttctgccagaaacgccttccaag

SEQ ID NO: 456907 - DNA, 25 bp, Mus musculus
gtttctgctgctctactcaagtggg

SEQ ID NO: 456908 - DNA, 25 bp, Mus musculus
gtttctggaagccagtggaataaag

SEQ ID NO: 456909 - DNA, 25 bp, Mus musculus
gtttctggctccaacgtggcaagga

SEQ ID NO: 456910 - DNA, 25 bp, Mus musculus
gtttctgtcttttcctgcatctggg

SEQ ID NO: 456911 - DNA, 25 bp, Mus musculus
gtttcttccattgacctgaaggcat

SEQ ID NO: 456912 - DNA, 25 bp, Mus musculus
gtttcttgcttctctcctgggccca

SEQ ID NO: 456913 - DNA, 25 bp, Mus musculus
gtttctttgctaagttgccggccag

SEQ ID NO: 456914 - DNA, 25 bp, Mus musculus
gtttgaacagttccagagacttgca

SEQ ID NO: 456915 - DNA, 25 bp, Mus musculus
gtttgaacccaagagaaaggaagtg

SEQ ID NO: 456916 - DNA, 25 bp, Mus musculus
gtttgaagatcaaggtcaggacttt

SEQ ID NO: 456917 - DNA, 25 bp, Mus musculus
gtttgaatatgagacctgccccagt

SEQ ID NO: 456918 - DNA, 25 bp, Mus musculus
gtttgaattacacgtcgccgccaca

SEQ ID NO: 456919 - DNA, 25 bp, Mus musculus
gtttgacaatgacttcccggctctg

SEQ ID NO: 456920 - DNA, 25 bp, Mus musculus
gtttgacatctacaggaaggtgccc

SEQ ID NO: 456921 - DNA, 25 bp, Mus musculus
gtttgacgccatcacagagctgctg

SEQ ID NO: 456922 - DNA, 25 bp, Mus musculus
gtttgactacaaggcccatcagcgg

SEQ ID NO: 456923 - DNA, 25 bp, Mus musculus
gtttgagaacggcaattatcggcgc

SEQ ID NO: 456924 - DNA, 25 bp, Mus musculus
gtttgagacctaccctatgagcgag

SEQ ID NO: 456925 - DNA, 25 bp, Mus musculus
gtttgagcggcagcattacccggag

SEQ ID NO: 456926 - DNA, 25 bp, Mus musculus
gtttgaggacctggatctgagtcag

SEQ ID NO: 456927 - DNA, 25 bp, Mus musculus
gtttgatcaagagcaggcacctggg

SEQ ID NO: 456928 - DNA, 25 bp, Mus musculus
gtttgcaactaacccggatccgagg

SEQ ID NO: 456929 - DNA, 25 bp, Mus musculus
gtttgcagacccaatgaccgcaggt

SEQ ID NO: 456930 - DNA, 25 bp, Mus musculus
gtttgccaggttgtcatgtcttgag

SEQ ID NO: 456931 - DNA, 25 bp, Mus musculus
gtttgccagttggtcaggtccccag

SEQ ID NO: 456932 - DNA, 25 bp, Mus musculus
gtttgccatcgacacagacttgtag

SEQ ID NO: 456933 - DNA, 25 bp, Mus musculus
gtttgcccacaaagcacgagctctg

SEQ ID NO: 456934 - DNA, 25 bp, Mus musculus
gtttgcccgcgggaactcagctgag

SEQ ID NO: 456935 - DNA, 25 bp, Mus musculus
gtttgctattttgtcatggtaccca

SEQ ID NO: 456936 - DNA, 25 bp, Mus musculus
gtttgctcaggtctgcgacgagccc

SEQ ID NO: 456937 - DNA, 25 bp, Mus musculus
gtttgctcccaagtgtatgctactg

SEQ ID NO: 456938 - DNA, 25 bp, Mus musculus
gtttgctctccaaaggtagccttga

SEQ ID NO: 456939 - DNA, 25 bp, Mus musculus
gtttgctgacaaatggctatgcttt

SEQ ID NO: 456940 - DNA, 25 bp, Mus musculus
gtttgcttaaccatgaagacaggaa

SEQ ID NO: 456941 - DNA, 25 bp, Mus musculus
gtttgcttattgatgaaactcaggc

SEQ ID NO: 456942 - DNA, 25 bp, Mus musculus
gtttggaacactaatggacatggga

SEQ ID NO: 456943 - DNA, 25 bp, Mus musculus
gtttggaaccgatgtcagacctgag

SEQ ID NO: 456944 - DNA, 25 bp, Mus musculus
gtttggaccatgattctcccgggca

SEQ ID NO: 456945 - DNA, 25 bp, Mus musculus
gtttggactacttgatgatcagtga

SEQ ID NO: 456946 - DNA, 25 bp, Mus musculus
gtttggagtggcctacgacagcaat

SEQ ID NO: 456947 - DNA, 25 bp, Mus musculus
gtttggcgctttctccctgcttgga

SEQ ID NO: 456948 - DNA, 25 bp, Mus musculus
gtttggctaaaaacatgcctgaccc

SEQ ID NO: 456949 - DNA, 25 bp, Mus musculus
gtttggctactatggaggtccctgc

SEQ ID NO: 456950 - DNA, 25 bp, Mus musculus
gtttggctgaaaatgatctccaagg

SEQ ID NO: 456951 - DNA, 25 bp, Mus musculus
gtttgggaaaacagctggtcacatt

SEQ ID NO: 456952 - DNA, 25 bp, Mus musculus
gtttgggacacgagacacgatggat

SEQ ID NO: 456953 - DNA, 25 bp, Mus musculus
gtttggtctgaatggcccctcctga

SEQ ID NO: 456954 - DNA, 25 bp, Mus musculus
gtttggttgtacatagcagccctgg

SEQ ID NO: 456955 - DNA, 25 bp, Mus musculus
gtttgtagccatgctcacagagctc

SEQ ID NO: 456956 - DNA, 25 bp, Mus musculus
gtttgtaggcattacactgcatcag

SEQ ID NO: 456957 - DNA, 25 bp, Mus musculus
gtttgtcactcgaaggaaccgccaa

SEQ ID NO: 456958 - DNA, 25 bp, Mus musculus
gtttgtcactcgaccctccggaatc

SEQ ID NO: 456959 - DNA, 25 bp, Mus musculus
gtttgtccacgatgctcaacttggc

SEQ ID NO: 456960 - DNA, 25 bp, Mus musculus
gtttgtgacccagtagagaccgaag

SEQ ID NO: 456961 - DNA, 25 bp, Mus musculus
gtttgtgcctgtcaagtacgagcta

SEQ ID NO: 456962 - DNA, 25 bp, Mus musculus
gtttgtggagaagaccctgagctgc

SEQ ID NO: 456963 - DNA, 25 bp, Mus musculus
gtttgtggaggcaggatttgacccc

SEQ ID NO: 456964 - DNA, 25 bp, Mus musculus
gtttgtgtcctctgaaggccacacc

SEQ ID NO: 456965 - DNA, 25 bp, Mus musculus
gtttgttcattctggagaggaacca

SEQ ID NO: 456966 - DNA, 25 bp, Mus musculus
gtttgttccacttcaaaaggagtct

SEQ ID NO: 456967 - DNA, 25 bp, Mus musculus
gtttgttccctgacaactttgtaag

SEQ ID NO: 456968 - DNA, 25 bp, Mus musculus
gtttgttctggagagggaccaccca

SEQ ID NO: 456969 - DNA, 25 bp, Mus musculus
gtttgttggccatctgcctctctct

SEQ ID NO: 456970 - DNA, 25 bp, Mus musculus
gtttgttggctaaggtctcatgtag

SEQ ID NO: 456971 - DNA, 25 bp, Mus musculus
gtttgttttctagcacccagataga

SEQ ID NO: 456972 - DNA, 25 bp, Mus musculus
gtttgttttgccacatgagaaaaaa

SEQ ID NO: 456973 - DNA, 25 bp, Mus musculus
gttttaacatcaccccagtcttcca

SEQ ID NO: 456974 - DNA, 25 bp, Mus musculus
gttttaataccgtgtccagaccttg

SEQ ID NO: 456975 - DNA, 25 bp, Mus musculus
gttttacaaggcaaagcagaagttg

SEQ ID NO: 456976 - DNA, 25 bp, Mus musculus
gttttaccagagcaaagcaagagcc

SEQ ID NO: 456977 - DNA, 25 bp, Mus musculus
gttttaccctgaactgaagctagct

SEQ ID NO: 456978 - DNA, 25 bp, Mus musculus
gttttacttccgagacctgactgcc

SEQ ID NO: 456979 - DNA, 25 bp, Mus musculus
gttttagaaatactccagcgtccag

SEQ ID NO: 456980 - DNA, 25 bp, Mus musculus
gttttatattcctgagcaccctgtg

SEQ ID NO: 456981 - DNA, 25 bp, Mus musculus
gttttattttgattgagttggcggc

SEQ ID NO: 456982 - DNA, 25 bp, Mus musculus
gttttcaaccaagaaccgatggcag

SEQ ID NO: 456983 - DNA, 25 bp, Mus musculus
gttttcaacccacaacaggctgcga

SEQ ID NO: 456984 - DNA, 25 bp, Mus musculus
gttttcaacggaacaccttgtctgg

SEQ ID NO: 456985 - DNA, 25 bp, Mus musculus
gttttcaagaccaccaagaccaagg

SEQ ID NO: 456986 - DNA, 25 bp, Mus musculus
gttttcagacgaccccacggaactg

SEQ ID NO: 456987 - DNA, 25 bp, Mus musculus
gttttccaacgatggtgtcctcagg

SEQ ID NO: 456988 - DNA, 25 bp, Mus musculus
gttttccagctgtatagccccgcag

SEQ ID NO: 456989 - DNA, 25 bp, Mus musculus
gttttccgcatggtcaagcagggag

SEQ ID NO: 456990 - DNA, 25 bp, Mus musculus
gttttcggcgcccacaaggactgtg

SEQ ID NO: 456991 - DNA, 25 bp, Mus musculus
gttttctacaaatgtgttgggctac

SEQ ID NO: 456992 - DNA, 25 bp, Mus musculus
gttttctcgggacctgacagctgga

SEQ ID NO: 456993 - DNA, 25 bp, Mus musculus
gttttctctaacctgcgctgcggca

SEQ ID NO: 456994 - DNA, 25 bp, Mus musculus
gttttctgcagatctaggaccttgt

SEQ ID NO: 456995 - DNA, 25 bp, Mus musculus
gttttcttgcataaaagtcaaactt

SEQ ID NO: 456996 - DNA, 25 bp, Mus musculus
gttttgaacgtaaagaatgctgact

SEQ ID NO: 456997 - DNA, 25 bp, Mus musculus
gttttgaattctctgaagaagcggc

SEQ ID NO: 456998 - DNA, 25 bp, Mus musculus
gttttgaattgcaggtggagactct

SEQ ID NO: 456999 - DNA, 25 bp, Mus musculus
gttttgaggccggaagcgtcgcggc

SEQ ID NO: 457000 - DNA, 25 bp, Mus musculus
gttttgagtgccatccagttgcgac

SEQ ID NO: 457001 - DNA, 25 bp, Mus musculus
gttttgcacattggaagtaaaccca

SEQ ID NO: 457002 - DNA, 25 bp, Mus musculus
gttttgccaccctccgggagcatgt

SEQ ID NO: 457003 - DNA, 25 bp, Mus musculus
gttttgcctacctcatgtgcgcttg

SEQ ID NO: 457004 - DNA, 25 bp, Mus musculus
gttttgctcatggaagactctgaaa

SEQ ID NO: 457005 - DNA, 25 bp, Mus musculus
gttttggacagcctccatgcattct

SEQ ID NO: 457006 - DNA, 25 bp, Mus musculus
gttttggacccactgcgtactagca

SEQ ID NO: 457007 - DNA, 25 bp, Mus musculus
gttttggctgggacaacagcgttgc

SEQ ID NO: 457008 - DNA, 25 bp, Mus musculus
gttttgtccctacaaagtacaggca

SEQ ID NO: 457009 - DNA, 25 bp, Mus musculus
gttttgtgggcggaaactcactgcc

SEQ ID NO: 457010 - DNA, 25 bp, Mus musculus
gtttttaaccaaccgaggcactgca

SEQ ID NO: 457011 - DNA, 25 bp, Mus musculus
gtttttccatcacattccacaggtg

SEQ ID NO: 457012 - DNA, 25 bp, Mus musculus
gtttttctcacagatttcgatagtg

SEQ ID NO: 457013 - DNA, 25 bp, Mus musculus
gtttttcttctaggcaccacaggca

SEQ ID NO: 457014 - DNA, 25 bp, Mus musculus
gtttttggaacacgcacactgcagc

SEQ ID NO: 457015 - DNA, 25 bp, Mus musculus
gtttttgtatgcagaggacgggcct

SEQ ID NO: 457016 - DNA, 25 bp, Mus musculus
gtttttgtgaatggacggccactcc

SEQ ID NO: 457017 - DNA, 25 bp, Mus musculus
gttttttattatgtggccctggcct

SEQ ID NO: 457018 - DNA, 25 bp, Mus musculus
gttttttcagctcctccgcctctga

SEQ ID NO: 457019 - DNA, 25 bp, Mus musculus
taaaaaagaccagactccgagaggc

SEQ ID NO: 457020 - DNA, 25 bp, Mus musculus
taaaaaagactggtgtagactccac

SEQ ID NO: 457021 - DNA, 25 bp, Mus musculus
taaaaaagcataaactccagaaggg

SEQ ID NO: 457022 - DNA, 25 bp, Mus musculus
taaaaaaggccagacttagcgtgct

SEQ ID NO: 457023 - DNA, 25 bp, Mus musculus
taaaaaagggaactggtcccagcat

SEQ ID NO: 457024 - DNA, 25 bp, Mus musculus
taaaaaagtgaacaatgagcaaact

SEQ ID NO: 457025 - DNA, 25 bp, Mus musculus
taaaaaatagctgtcacaacagccg

SEQ ID NO: 457026 - DNA, 25 bp, Mus musculus
taaaaaatgtggatcggagtagcgc

SEQ ID NO: 457027 - DNA, 25 bp, Mus musculus
taaaaacaacgtgaagcaatgccag

SEQ ID NO: 457028 - DNA, 25 bp, Mus musculus
taaaaacaaggccaggtagacgcac

SEQ ID NO: 457029 - DNA, 25 bp, Mus musculus
taaaaacaatgtaagtctggagggc

SEQ ID NO: 457030 - DNA, 25 bp, Mus musculus
taaaaacagctggagcatggcggag

SEQ ID NO: 457031 - DNA, 25 bp, Mus musculus
taaaaaccaaggtatggaaagtgtg

SEQ ID NO: 457032 - DNA, 25 bp, Mus musculus
taaaaacccgttgtcagtgagagga

SEQ ID NO: 457033 - DNA, 25 bp, Mus musculus
taaaaaccggatgcacaagaacaga

SEQ ID NO: 457034 - DNA, 25 bp, Mus musculus
taaaaacgaggtgctaatctggcct

SEQ ID NO: 457035 - DNA, 25 bp, Mus musculus
taaaaacgagtttgcccagagatca

SEQ ID NO: 457036 - DNA, 25 bp, Mus musculus
taaaaacgctggatgatcgagtcct

SEQ ID NO: 457037 - DNA, 25 bp, Mus musculus
taaaaacgctgggatcaaactggcc

SEQ ID NO: 457038 - DNA, 25 bp, Mus musculus
taaaaacgggaaagtatatgctaat

SEQ ID NO: 457039 - DNA, 25 bp, Mus musculus
taaaaacggtcattggattcatctc

SEQ ID NO: 457040 - DNA, 25 bp, Mus musculus
taaaaactgcgttcacatcctggcc

SEQ ID NO: 457041 - DNA, 25 bp, Mus musculus
taaaaactgcttgtaatagccatgc

SEQ ID NO: 457042 - DNA, 25 bp, Mus musculus
taaaaactgtgctcaaccacgcgag

SEQ ID NO: 457043 - DNA, 25 bp, Mus musculus
taaaaactgttctcaggaccttggg

SEQ ID NO: 457044 - DNA, 25 bp, Mus musculus
taaaaagaaatcagagctaactcca

SEQ ID NO: 457045 - DNA, 25 bp, Mus musculus
taaaaagacaattgagtgcatcacg

SEQ ID NO: 457046 - DNA, 25 bp, Mus musculus
taaaaagacacgacattaatcctgg

SEQ ID NO: 457047 - DNA, 25 bp, Mus musculus
taaaaagacgaagaaccagcaagat

SEQ ID NO: 457048 - DNA, 25 bp, Mus musculus
taaaaagatgctgccacgagatgag

SEQ ID NO: 457049 - DNA, 25 bp, Mus musculus
taaaaagcactgtagctacacaccc

SEQ ID NO: 457050 - DNA, 25 bp, Mus musculus
taaaaagcagcagtgaccctagagc

SEQ ID NO: 457051 - DNA, 25 bp, Mus musculus
taaaaagccacagatcaccacggag

SEQ ID NO: 457052 - DNA, 25 bp, Mus musculus
taaaaagcgacctgtgactgcagac

SEQ ID NO: 457053 - DNA, 25 bp, Mus musculus
taaaaagctgtgtcttgccgggcgt

SEQ ID NO: 457054 - DNA, 25 bp, Mus musculus
taaaaagggcccactgtcaagtctg

SEQ ID NO: 457055 - DNA, 25 bp, Mus musculus
taaaaagggtgcttgaccactggcc

SEQ ID NO: 457056 - DNA, 25 bp, Mus musculus
taaaaaggtctggtcagcattgccc

SEQ ID NO: 457057 - DNA, 25 bp, Mus musculus
taaaaaggtgaactcagcatgctgc

SEQ ID NO: 457058 - DNA, 25 bp, Mus musculus
taaaaaggtttctggagcctgcatc

SEQ ID NO: 457059 - DNA, 25 bp, Mus musculus
taaaaagtaatgtagccggtgattc

SEQ ID NO: 457060 - DNA, 25 bp, Mus musculus
taaaaagtaccatgtgtctcccctg

SEQ ID NO: 457061 - DNA, 25 bp, Mus musculus
taaaaagtagtatctcctggtggcc

SEQ ID NO: 457062 - DNA, 25 bp, Mus musculus
taaaaagtggttgcacaggcccctt

SEQ ID NO: 457063 - DNA, 25 bp, Mus musculus
taaaaataaagtcctgccgggcgtg

SEQ ID NO: 457064 - DNA, 25 bp, Mus musculus
taaaaatacaactcgggtcagacca

SEQ ID NO: 457065 - DNA, 25 bp, Mus musculus
taaaaatagtttagctgtggcccct

SEQ ID NO: 457066 - DNA, 25 bp, Mus musculus
taaaaatcaggtgtctccaatgctg

SEQ ID NO: 457067 - DNA, 25 bp, Mus musculus
taaaaatcagtgaaatcgctgcccc

SEQ ID NO: 457068 - DNA, 25 bp, Mus musculus
taaaaatccccacacaggacacgtg

SEQ ID NO: 457069 - DNA, 25 bp, Mus musculus
taaaaatccctaaatgtgccgccac

SEQ ID NO: 457070 - DNA, 25 bp, Mus musculus
taaaaatcttgacgaccattcctta

SEQ ID NO: 457071 - DNA, 25 bp, Mus musculus
taaaaatgagcgaaaacgccgccgc

SEQ ID NO: 457072 - DNA, 25 bp, Mus musculus
taaaaatggccctgggataacagag

SEQ ID NO: 457073 - DNA, 25 bp, Mus musculus
taaaaatggcctcaaggctggtctc

SEQ ID NO: 457074 - DNA, 25 bp, Mus musculus
taaaaatggtgcttcggtcttcagc

SEQ ID NO: 457075 - DNA, 25 bp, Mus musculus
taaaaatggtgtcctagaagaggcg

SEQ ID NO: 457076 - DNA, 25 bp, Mus musculus
taaaaattcagaagcacaagttgaa

SEQ ID NO: 457077 - DNA, 25 bp, Mus musculus
taaaaattcagacggtcaagcaagt

SEQ ID NO: 457078 - DNA, 25 bp, Mus musculus
taaaaattggatcaaaagccttggg

SEQ ID NO: 457079 - DNA, 25 bp, Mus musculus
taaaaattgtgctcgcaggagacac

SEQ ID NO: 457080 - DNA, 25 bp, Mus musculus
taaaaattgtgctgggttgagccca

SEQ ID NO: 457081 - DNA, 25 bp, Mus musculus
taaaaatttgcatcgggccagttgc

SEQ ID NO: 457082 - DNA, 25 bp, Mus musculus
taaaacaaagctatatacaaagact

SEQ ID NO: 457083 - DNA, 25 bp, Mus musculus
taaaacaaattggatctgaatgaag

SEQ ID NO: 457084 - DNA, 25 bp, Mus musculus
taaaacaagctttccatctggtgcc

SEQ ID NO: 457085 - DNA, 25 bp, Mus musculus
taaaacacaagctctgaaggctgct

SEQ ID NO: 457086 - DNA, 25 bp, Mus musculus
taaaacacagagcatttgagtccct

SEQ ID NO: 457087 - DNA, 25 bp, Mus musculus
taaaacaccctgaagaatcccgtag

SEQ ID NO: 457088 - DNA, 25 bp, Mus musculus
taaaacaccttggttggccacgata

SEQ ID NO: 457089 - DNA, 25 bp, Mus musculus
taaaacacggtgtgagtacaggatc

SEQ ID NO: 457090 - DNA, 25 bp, Mus musculus
taaaacactgacgtcaagacttggg

SEQ ID NO: 457091 - DNA, 25 bp, Mus musculus
taaaacaggcttggtgtcatctacc

SEQ ID NO: 457092 - DNA, 25 bp, Mus musculus
taaaacaggtctaggtcccaggaag

SEQ ID NO: 457093 - DNA, 25 bp, Mus musculus
taaaacagtggaatctgcctccagc

SEQ ID NO: 457094 - DNA, 25 bp, Mus musculus
taaaacatcagctcttgacccgagg

SEQ ID NO: 457095 - DNA, 25 bp, Mus musculus
taaaacatcgagcttcaaatgtctt

SEQ ID NO: 457096 - DNA, 25 bp, Mus musculus
taaaacatggtcgtgctggagtgcc

SEQ ID NO: 457097 - DNA, 25 bp, Mus musculus
taaaacattaggctcgggttaggca

SEQ ID NO: 457098 - DNA, 25 bp, Mus musculus
taaaacattaggtgttgtcatggat

SEQ ID NO: 457099 - DNA, 25 bp, Mus musculus
taaaacattgattgctggacagaag

SEQ ID NO: 457100 - DNA, 25 bp, Mus musculus
taaaacattgggtgctgtggctgca

SEQ ID NO: 457101 - DNA, 25 bp, Mus musculus
taaaaccacgtatattcgccaggga

SEQ ID NO: 457102 - DNA, 25 bp, Mus musculus
taaaaccacttgaggcttctctgga

SEQ ID NO: 457103 - DNA, 25 bp, Mus musculus
taaaaccagaacaagggtgcccagt

SEQ ID NO: 457104 - DNA, 25 bp, Mus musculus
taaaaccagatactagttcaagcct

SEQ ID NO: 457105 - DNA, 25 bp, Mus musculus
taaaaccagctgtgatggtgcacac

SEQ ID NO: 457106 - DNA, 25 bp, Mus musculus
taaaacccaggttgcgattcaaggc

SEQ ID NO: 457107 - DNA, 25 bp, Mus musculus
taaaacccccgctcttgtgacgtca

SEQ ID NO: 457108 - DNA, 25 bp, Mus musculus
taaaacccgagagtgcttcacgaga

SEQ ID NO: 457109 - DNA, 25 bp, Mus musculus
taaaaccctatgtggacctccaggc

SEQ ID NO: 457110 - DNA, 25 bp, Mus musculus
taaaaccctgttacgatgtcggcga

SEQ ID NO: 457111 - DNA, 25 bp, Mus musculus
taaaaccgtgaacaaaaggccagtg

SEQ ID NO: 457112 - DNA, 25 bp, Mus musculus
taaaacctatggctcagtgtccctc

SEQ ID NO: 457113 - DNA, 25 bp, Mus musculus
taaaacctcagtcaccagtcagtgg

SEQ ID NO: 457114 - DNA, 25 bp, Mus musculus
taaaacctcgcctccaacaaggcag

SEQ ID NO: 457115 - DNA, 25 bp, Mus musculus
taaaaccttggaggccggtcgtgtg

SEQ ID NO: 457116 - DNA, 25 bp, Mus musculus
taaaaccttggctggtggaccacac

SEQ ID NO: 457117 - DNA, 25 bp, Mus musculus
taaaacctttgcagggagtaccgca

SEQ ID NO: 457118 - DNA, 25 bp, Mus musculus
taaaacgatcggactcctgagagga

SEQ ID NO: 457119 - DNA, 25 bp, Mus musculus
taaaacgatgaccacaaagtcccgg

SEQ ID NO: 457120 - DNA, 25 bp, Mus musculus
taaaacgcaccttacattcaaagga

SEQ ID NO: 457121 - DNA, 25 bp, Mus musculus
taaaacgcgcgccaacgttgacaag

SEQ ID NO: 457122 - DNA, 25 bp, Mus musculus
taaaacgctgcggttactagccact

SEQ ID NO: 457123 - DNA, 25 bp, Mus musculus
taaaacgctttcagcatccctgcgc

SEQ ID NO: 457124 - DNA, 25 bp, Mus musculus
taaaacggacaaggccttcaaggct

SEQ ID NO: 457125 - DNA, 25 bp, Mus musculus
taaaacggctctgccaggagctgac

SEQ ID NO: 457126 - DNA, 25 bp, Mus musculus
taaaacgggactgatggacgtgtcc

SEQ ID NO: 457127 - DNA, 25 bp, Mus musculus
taaaacgtgaaccaaaatgccaggc

SEQ ID NO: 457128 - DNA, 25 bp, Mus musculus
taaaactaaagcctccgctgaagaa

SEQ ID NO: 457129 - DNA, 25 bp, Mus musculus
taaaactaagttggcctcactgggc

SEQ ID NO: 457130 - DNA, 25 bp, Mus musculus
taaaactcaaatttgcacgaggcat

SEQ ID NO: 457131 - DNA, 25 bp, Mus musculus
taaaactcagtaatccactgggctt

SEQ ID NO: 457132 - DNA, 25 bp, Mus musculus
taaaactccacctaagcaaaacgca

SEQ ID NO: 457133 - DNA, 25 bp, Mus musculus
taaaactcggagaccttgggcttgg

SEQ ID NO: 457134 - DNA, 25 bp, Mus musculus
taaaactgaccgtctatggcacgac

SEQ ID NO: 457135 - DNA, 25 bp, Mus musculus
taaaactgcatttgacccggatgtg

SEQ ID NO: 457136 - DNA, 25 bp, Mus musculus
taaaactgccctctgtgagatcata

SEQ ID NO: 457137 - DNA, 25 bp, Mus musculus
taaaactggtcagcccttggagaga

SEQ ID NO: 457138 - DNA, 25 bp, Mus musculus
taaaactgtagcaaatgatctgtgg

SEQ ID NO: 457139 - DNA, 25 bp, Mus musculus
taaaactgtgactaccaggtatggc

SEQ ID NO: 457140 - DNA, 25 bp, Mus musculus
taaaactgtgagcacctgggaggct

SEQ ID NO: 457141 - DNA, 25 bp, Mus musculus
taaaacttactggacccgagagctg

SEQ ID NO: 457142 - DNA, 25 bp, Mus musculus
taaaacttcttgcaagcgttcgggc

SEQ ID NO: 457143 - DNA, 25 bp, Mus musculus
taaaactttacgtggctcaactatc

SEQ ID NO: 457144 - DNA, 25 bp, Mus musculus
taaaacttttcaacagcgggcataa

SEQ ID NO: 457145 - DNA, 25 bp, Mus musculus
taaaagaacggagcggaagctctgg

SEQ ID NO: 457146 - DNA, 25 bp, Mus musculus
taaaagaagtggctttgtgtccgag

SEQ ID NO: 457147 - DNA, 25 bp, Mus musculus
taaaagacacataggtttaggactg

SEQ ID NO: 457148 - DNA, 25 bp, Mus musculus
taaaagaccatggttgtgtccaagg

SEQ ID NO: 457149 - DNA, 25 bp, Mus musculus
taaaagacctcgaggacgtcgtcgg

SEQ ID NO: 457150 - DNA, 25 bp, Mus musculus
taaaagacctttcacctctggacaa

SEQ ID NO: 457151 - DNA, 25 bp, Mus musculus
taaaagacgaacttgaacctgaagg

SEQ ID NO: 457152 - DNA, 25 bp, Mus musculus
taaaagacgatgtgttatgtgccgg

SEQ ID NO: 457153 - DNA, 25 bp, Mus musculus
taaaagactgtttggattctacaca

SEQ ID NO: 457154 - DNA, 25 bp, Mus musculus
taaaagagaaagactgagccaggtg

SEQ ID NO: 457155 - DNA, 25 bp, Mus musculus
taaaagagaagtgccaccctgtaga

SEQ ID NO: 457156 - DNA, 25 bp, Mus musculus
taaaagagcccgacaggatagttgg

SEQ ID NO: 457157 - DNA, 25 bp, Mus musculus
taaaagagcggcaacgtggatcaac

SEQ ID NO: 457158 - DNA, 25 bp, Mus musculus
taaaagaggactgcaatgccatggc

SEQ ID NO: 457159 - DNA, 25 bp, Mus musculus
taaaagatatgtattgcaggcccag

SEQ ID NO: 457160 - DNA, 25 bp, Mus musculus
taaaagatcccgtgaagccagacaa

SEQ ID NO: 457161 - DNA, 25 bp, Mus musculus
taaaagatcttcgttcaggagggag

SEQ ID NO: 457162 - DNA, 25 bp, Mus musculus
taaaagattagactgctacttagga

SEQ ID NO: 457163 - DNA, 25 bp, Mus musculus
taaaagcaaagagtcaacatgggcc

SEQ ID NO: 457164 - DNA, 25 bp, Mus musculus
taaaagcaaatataataccagggcc

SEQ ID NO: 457165 - DNA, 25 bp, Mus musculus
taaaagcacttcagggtcaaaaggc

SEQ ID NO: 457166 - DNA, 25 bp, Mus musculus
taaaagcagccagtaatttctgtgt

SEQ ID NO: 457167 - DNA, 25 bp, Mus musculus
taaaagcagcctttctcaggtgcgg

SEQ ID NO: 457168 - DNA, 25 bp, Mus musculus
taaaagcagcgggactgtaggcgat

SEQ ID NO: 457169 - DNA, 25 bp, Mus musculus
taaaagcaggattcttccagccggt

SEQ ID NO: 457170 - DNA, 25 bp, Mus musculus
taaaagcagggagtctgtggcctcg

SEQ ID NO: 457171 - DNA, 25 bp, Mus musculus
taaaagcatagcgtgttctctggca

SEQ ID NO: 457172 - DNA, 25 bp, Mus musculus
taaaagcattcacaccctgggtctc

SEQ ID NO: 457173 - DNA, 25 bp, Mus musculus
taaaagccaagtcgtgccccacacg

SEQ ID NO: 457174 - DNA, 25 bp, Mus musculus
taaaagccactttgtccgatgagga

SEQ ID NO: 457175 - DNA, 25 bp, Mus musculus
taaaagccagcgatgtgcttgccag

SEQ ID NO: 457176 - DNA, 25 bp, Mus musculus
taaaagccatcgagcagttctgcca

SEQ ID NO: 457177 - DNA, 25 bp, Mus musculus
taaaagccgggaagcgtatcccacg

SEQ ID NO: 457178 - DNA, 25 bp, Mus musculus
taaaagccgtccagaggagtggttg

SEQ ID NO: 457179 - DNA, 25 bp, Mus musculus
taaaagcctagagaagtgagcagca

SEQ ID NO: 457180 - DNA, 25 bp, Mus musculus
taaaagccttatggtccccataggg

SEQ ID NO: 457181 - DNA, 25 bp, Mus musculus
taaaagccttgaggactctcagtgc

SEQ ID NO: 457182 - DNA, 25 bp, Mus musculus
taaaagcctttgaagagttcctggc

SEQ ID NO: 457183 - DNA, 25 bp, Mus musculus
taaaagcgacagtgaaacccagact

SEQ ID NO: 457184 - DNA, 25 bp, Mus musculus
taaaagcgatttggactcggacagc

SEQ ID NO: 457185 - DNA, 25 bp, Mus musculus
taaaagcggctgttcaaatgaaatg

SEQ ID NO: 457186 - DNA, 25 bp, Mus musculus
taaaagctacctcaacatggatgcc

SEQ ID NO: 457187 - DNA, 25 bp, Mus musculus
taaaagctgagcttgcaggcagcca

SEQ ID NO: 457188 - DNA, 25 bp, Mus musculus
taaaagctggcaagcgtatcccaag

SEQ ID NO: 457189 - DNA, 25 bp, Mus musculus
taaaagctgtcactgaaaccccggt

SEQ ID NO: 457190 - DNA, 25 bp, Mus musculus
taaaagctgtctatgcaatcacctc

SEQ ID NO: 457191 - DNA, 25 bp, Mus musculus
taaaagcttcagtcgcggttcagat

SEQ ID NO: 457192 - DNA, 25 bp, Mus musculus
taaaagcttctaataccggagcggg

SEQ ID NO: 457193 - DNA, 25 bp, Mus musculus
taaaagctttttgcaggtctgctgc

SEQ ID NO: 457194 - DNA, 25 bp, Mus musculus
taaaaggaagaaccaccagggcaag

SEQ ID NO: 457195 - DNA, 25 bp, Mus musculus
taaaaggacgcggagcagcaatacc

SEQ ID NO: 457196 - DNA, 25 bp, Mus musculus
taaaaggagaccacctgtcaagggc

SEQ ID NO: 457197 - DNA, 25 bp, Mus musculus
taaaaggagcaaagcgaggacctgg

SEQ ID NO: 457198 - DNA, 25 bp, Mus musculus
taaaaggatgggaacaagctaagtg

SEQ ID NO: 457199 - DNA, 25 bp, Mus musculus
taaaagggacaacagttaaagcagc

SEQ ID NO: 457200 - DNA, 25 bp, Mus musculus
taaaagggacgggtgtctctcatct

SEQ ID NO: 457201 - DNA, 25 bp, Mus musculus
taaaagggtagtagcatttggccaa

SEQ ID NO: 457202 - DNA, 25 bp, Mus musculus
taaaaggtaatgttgtcagcaagaa

SEQ ID NO: 457203 - DNA, 25 bp, Mus musculus
taaaaggtctgttctctcgagcaga

SEQ ID NO: 457204 - DNA, 25 bp, Mus musculus
taaaaggtgctgtcaaaggagtgta

SEQ ID NO: 457205 - DNA, 25 bp, Mus musculus
taaaaggttactcctgccacaggac

SEQ ID NO: 457206 - DNA, 25 bp, Mus musculus
taaaaggttccctgaccgcatgggt

SEQ ID NO: 457207 - DNA, 25 bp, Mus musculus
taaaagtaagtggaccccaggcagg

SEQ ID NO: 457208 - DNA, 25 bp, Mus musculus
taaaagtaggaggtaatctgtcagc

SEQ ID NO: 457209 - DNA, 25 bp, Mus musculus
taaaagtatctttctgccgggtgtg

SEQ ID NO: 457210 - DNA, 25 bp, Mus musculus
taaaagtcaaactttaagtagctgc

SEQ ID NO: 457211 - DNA, 25 bp, Mus musculus
taaaagtcagcagaaacccaaagcc

SEQ ID NO: 457212 - DNA, 25 bp, Mus musculus
taaaagtccaggcttaggagggcac

SEQ ID NO: 457213 - DNA, 25 bp, Mus musculus
taaaagtcctacaaaggccagacga

SEQ ID NO: 457214 - DNA, 25 bp, Mus musculus
taaaagtcgacgtggactgctgcga

SEQ ID NO: 457215 - DNA, 25 bp, Mus musculus
taaaagtcgcctaaaaacgcgcaag

SEQ ID NO: 457216 - DNA, 25 bp, Mus musculus
taaaagtctcacttctgaatgccac

SEQ ID NO: 457217 - DNA, 25 bp, Mus musculus
taaaagtctcagcttaagcctaaga

SEQ ID NO: 457218 - DNA, 25 bp, Mus musculus
taaaagtgaactggcaagcagcggg

SEQ ID NO: 457219 - DNA, 25 bp, Mus musculus
taaaagtgaattgtatttggctctc

SEQ ID NO: 457220 - DNA, 25 bp, Mus musculus
taaaagtgaggatgcgctggaagcc

SEQ ID NO: 457221 - DNA, 25 bp, Mus musculus
taaaagtgcctgaaatcgcctgcca

SEQ ID NO: 457222 - DNA, 25 bp, Mus musculus
taaaagtggccatcagcaccgtgaa

SEQ ID NO: 457223 - DNA, 25 bp, Mus musculus
taaaagtgtcgagccctgactaccc

SEQ ID NO: 457224 - DNA, 25 bp, Mus musculus
taaaagtgttcaatagagcccagac

SEQ ID NO: 457225 - DNA, 25 bp, Mus musculus
taaaagtgtttcagcaggtggtcca

SEQ ID NO: 457226 - DNA, 25 bp, Mus musculus
taaaagttaagatgctagacacctc

SEQ ID NO: 457227 - DNA, 25 bp, Mus musculus
taaaagttaggtgctcagttgtccc

SEQ ID NO: 457228 - DNA, 25 bp, Mus musculus
taaaagttcacctcaagctgcagtg

SEQ ID NO: 457229 - DNA, 25 bp, Mus musculus
taaaagttcccatctgaaggcccac

SEQ ID NO: 457230 - DNA, 25 bp, Mus musculus
taaaagttcctttctagtatcatgt

SEQ ID NO: 457231 - DNA, 25 bp, Mus musculus
taaaagttcttacattgaatctgct

SEQ ID NO: 457232 - DNA, 25 bp, Mus musculus
taaaagttgccataagcctcagctt

SEQ ID NO: 457233 - DNA, 25 bp, Mus musculus
taaaagttggccttgtctctgctgc

SEQ ID NO: 457234 - DNA, 25 bp, Mus musculus
taaaagttggcttgcaagtcaatcg

SEQ ID NO: 457235 - DNA, 25 bp, Mus musculus
taaaagtttactcggacacctcatc

SEQ ID NO: 457236 - DNA, 25 bp, Mus musculus
taaaataacatgaagggtgaccctc

SEQ ID NO: 457237 - DNA, 25 bp, Mus musculus
taaaataactggtgtaatagcacag

SEQ ID NO: 457238 - DNA, 25 bp, Mus musculus
taaaatactccggtgtagccccatg

SEQ ID NO: 457239 - DNA, 25 bp, Mus musculus
taaaatagcagcaagggacctaggc

SEQ ID NO: 457240 - DNA, 25 bp, Mus musculus
taaaatagcccttgaaccagagcag

SEQ ID NO: 457241 - DNA, 25 bp, Mus musculus
taaaataggcaaggctgagatggct

SEQ ID NO: 457242 - DNA, 25 bp, Mus musculus
taaaatagtattgctccaacccgtg

SEQ ID NO: 457243 - DNA, 25 bp, Mus musculus
taaaatagtggatctcgtagctgcc

SEQ ID NO: 457244 - DNA, 25 bp, Mus musculus
taaaatagttctgtggtgacagtcg

SEQ ID NO: 457245 - DNA, 25 bp, Mus musculus
taaaatatagttgattcatccaatc

SEQ ID NO: 457246 - DNA, 25 bp, Mus musculus
taaaatatagtttgcgcttcggtcg

SEQ ID NO: 457247 - DNA, 25 bp, Mus musculus
taaaatatgctctcctgttaaatgc

SEQ ID NO: 457248 - DNA, 25 bp, Mus musculus
taaaatatgtatagactgggccatc

SEQ ID NO: 457249 - DNA, 25 bp, Mus musculus
taaaatattccaagatgagcctctg

SEQ ID NO: 457250 - DNA, 25 bp, Mus musculus
taaaatcaatctgcctgccccagag

SEQ ID NO: 457251 - DNA, 25 bp, Mus musculus
taaaatcacacgtaggcaggctacc

SEQ ID NO: 457252 - DNA, 25 bp, Mus musculus
taaaatcacgttgacgtcggacccg

SEQ ID NO: 457253 - DNA, 25 bp, Mus musculus
taaaatcagtcgctagacccaggag

SEQ ID NO: 457254 - DNA, 25 bp, Mus musculus
taaaatcatacaaaggtggtcctgg

SEQ ID NO: 457255 - DNA, 25 bp, Mus musculus
taaaatcatgcctaagtacaccaga

SEQ ID NO: 457256 - DNA, 25 bp, Mus musculus
taaaatccagataagcgacttgtcc

SEQ ID NO: 457257 - DNA, 25 bp, Mus musculus
taaaatcctgtatccggcgagccat

SEQ ID NO: 457258 - DNA, 25 bp, Mus musculus
taaaatccttgagccagagtgaaac

SEQ ID NO: 457259 - DNA, 25 bp, Mus musculus
taaaatccttttgctgagagtcata

SEQ ID NO: 457260 - DNA, 25 bp, Mus musculus
taaaatcgccgagggcttgctgcag

SEQ ID NO: 457261 - DNA, 25 bp, Mus musculus
taaaatcgtctttgcagcggacggg

SEQ ID NO: 457262 - DNA, 25 bp, Mus musculus
taaaatctagtcagtatgccccgga

SEQ ID NO: 457263 - DNA, 25 bp, Mus musculus
taaaatctcacatcgcttggctcgt

SEQ ID NO: 457264 - DNA, 25 bp, Mus musculus
taaaatctgggcttagtacgaaggc

SEQ ID NO: 457265 - DNA, 25 bp, Mus musculus
taaaatctggttggtgctcatctaa

SEQ ID NO: 457266 - DNA, 25 bp, Mus musculus
taaaatctgtaaatagcacatgacc

SEQ ID NO: 457267 - DNA, 25 bp, Mus musculus
taaaatctgtggttacggtagctgc

SEQ ID NO: 457268 - DNA, 25 bp, Mus musculus
taaaatcttagttatgccaggccta

SEQ ID NO: 457269 - DNA, 25 bp, Mus musculus
taaaatcttgaactccccatggatg

SEQ ID NO: 457270 - DNA, 25 bp, Mus musculus
taaaatgaagatctgatcagcagag

SEQ ID NO: 457271 - DNA, 25 bp, Mus musculus
taaaatgagcaccagggctctttcc

SEQ ID NO: 457272 - DNA, 25 bp, Mus musculus
taaaatgatacccatcaccctggcg

SEQ ID NO: 457273 - DNA, 25 bp, Mus musculus
taaaatgatcgttgagggctggtga

SEQ ID NO: 457274 - DNA, 25 bp, Mus musculus
taaaatgcatcgtccttcagcctgg

SEQ ID NO: 457275 - DNA, 25 bp, Mus musculus
taaaatgccatgaccaacacagtgt

SEQ ID NO: 457276 - DNA, 25 bp, Mus musculus
taaaatgccgtctaaatatttgcca

SEQ ID NO: 457277 - DNA, 25 bp, Mus musculus
taaaatgctacgtcccctgaatgag

SEQ ID NO: 457278 - DNA, 25 bp, Mus musculus
taaaatggagctcttggccttgccc

SEQ ID NO: 457279 - DNA, 25 bp, Mus musculus
taaaatggagtctcggaagtgcccg

SEQ ID NO: 457280 - DNA, 25 bp, Mus musculus
taaaatgggcaacaagattctccag

SEQ ID NO: 457281 - DNA, 25 bp, Mus musculus
taaaatggtccttctgttgattctg

SEQ ID NO: 457282 - DNA, 25 bp, Mus musculus
taaaatggtcgtgagaacagtgagc

SEQ ID NO: 457283 - DNA, 25 bp, Mus musculus
taaaatggtgacgagcttacttccc

SEQ ID NO: 457284 - DNA, 25 bp, Mus musculus
taaaatgtcgagctagagggtcact

SEQ ID NO: 457285 - DNA, 25 bp, Mus musculus
taaaatgtctaaatcctcccgctcg

SEQ ID NO: 457286 - DNA, 25 bp, Mus musculus
taaaatgtgaagttacttgccccag

SEQ ID NO: 457287 - DNA, 25 bp, Mus musculus
taaaattaaatacccagagctcact

SEQ ID NO: 457288 - DNA, 25 bp, Mus musculus
taaaattaatcatgcagggacacag

SEQ ID NO: 457289 - DNA, 25 bp, Mus musculus
taaaattagggcttcctgttgcagc

SEQ ID NO: 457290 - DNA, 25 bp, Mus musculus
taaaattagttacctagtgccagcc

SEQ ID NO: 457291 - DNA, 25 bp, Mus musculus
taaaattcccgaggaaccaactgat

SEQ ID NO: 457292 - DNA, 25 bp, Mus musculus
taaaattctcattgctaacagagga

SEQ ID NO: 457293 - DNA, 25 bp, Mus musculus
taaaattctcgggtgcagagtggca

SEQ ID NO: 457294 - DNA, 25 bp, Mus musculus
taaaattctggacgaaggcaccact

SEQ ID NO: 457295 - DNA, 25 bp, Mus musculus
taaaattgacatgggaaagctcctg

SEQ ID NO: 457296 - DNA, 25 bp, Mus musculus
taaaattgtgtccactgaaggccag

SEQ ID NO: 457297 - DNA, 25 bp, Mus musculus
taaaatttggacatggctaatcgag

SEQ ID NO: 457298 - DNA, 25 bp, Mus musculus
taaaattttaggacagagcagcacc

SEQ ID NO: 457299 - DNA, 25 bp, Mus musculus
taaacaaactctctgcataagcaga

SEQ ID NO: 457300 - DNA, 25 bp, Mus musculus
taaacaaaggtaacggctgctggtc

SEQ ID NO: 457301 - DNA, 25 bp, Mus musculus
taaacaacgcggcagggaacttcat

SEQ ID NO: 457302 - DNA, 25 bp, Mus musculus
taaacaagaatggttacactataca

SEQ ID NO: 457303 - DNA, 25 bp, Mus musculus
taaacaagacctgaggaactcgctc

SEQ ID NO: 457304 - DNA, 25 bp, Mus musculus
taaacaagatgtcgatgcaggcggt

SEQ ID NO: 457305 - DNA, 25 bp, Mus musculus
taaacaagggccactggaggtagtc

SEQ ID NO: 457306 - DNA, 25 bp, Mus musculus
taaacaagtctgtagaggatctccc

SEQ ID NO: 457307 - DNA, 25 bp, Mus musculus
taaacaagtgcacgaagctcaggac

SEQ ID NO: 457308 - DNA, 25 bp, Mus musculus
taaacaatatgacaaagcctgccga

SEQ ID NO: 457309 - DNA, 25 bp, Mus musculus
taaacaatatggagacgaggcctcc

SEQ ID NO: 457310 - DNA, 25 bp, Mus musculus
taaacaatcaacttgttcaggccgg

SEQ ID NO: 457311 - DNA, 25 bp, Mus musculus
taaacaatcagtagtcctggccaag

SEQ ID NO: 457312 - DNA, 25 bp, Mus musculus
taaacaatccgatcgtgaaggcacg

SEQ ID NO: 457313 - DNA, 25 bp, Mus musculus
taaacaatgacagtcccgaggccat

SEQ ID NO: 457314 - DNA, 25 bp, Mus musculus
taaacaattacctgcctgactggca

SEQ ID NO: 457315 - DNA, 25 bp, Mus musculus
taaacacaaagcttagcgggcgagg

SEQ ID NO: 457316 - DNA, 25 bp, Mus musculus
taaacacaaaggaggaatgtccctg

SEQ ID NO: 457317 - DNA, 25 bp, Mus musculus
taaacacaaaggtacgggtgccagc

SEQ ID NO: 457318 - DNA, 25 bp, Mus musculus
taaacacagatagggaggggcctcc

SEQ ID NO: 457319 - DNA, 25 bp, Mus musculus
taaacacagcatcctgtggtcacca

SEQ ID NO: 457320 - DNA, 25 bp, Mus musculus
taaacacatgggtctgcaaaaatac

SEQ ID NO: 457321 - DNA, 25 bp, Mus musculus
taaacaccaaccaagatgtcacaca

SEQ ID NO: 457322 - DNA, 25 bp, Mus musculus
taaacaccacgctaaatgctacaga

SEQ ID NO: 457323 - DNA, 25 bp, Mus musculus
taaacacccgattgctcatcagttc

SEQ ID NO: 457324 - DNA, 25 bp, Mus musculus
taaacaccgaggaggagagtctctt

SEQ ID NO: 457325 - DNA, 25 bp, Mus musculus
taaacacctaggatgagctttgcct

SEQ ID NO: 457326 - DNA, 25 bp, Mus musculus
taaacacctgaaccggatccctagg

SEQ ID NO: 457327 - DNA, 25 bp, Mus musculus
taaacacctggtgatagccgacacc

SEQ ID NO: 457328 - DNA, 25 bp, Mus musculus
taaacactaagtggccgagaagctg

SEQ ID NO: 457329 - DNA, 25 bp, Mus musculus
taaacactcctgaacagctaatatc

SEQ ID NO: 457330 - DNA, 25 bp, Mus musculus
taaacactgcttcggtgctccagga

SEQ ID NO: 457331 - DNA, 25 bp, Mus musculus
taaacactggtacaggacaggccac

SEQ ID NO: 457332 - DNA, 25 bp, Mus musculus
taaacactggttgggagggagcctt

SEQ ID NO: 457333 - DNA, 25 bp, Mus musculus
taaacacttgcgagtgagcagcctc

SEQ ID NO: 457334 - DNA, 25 bp, Mus musculus
taaacagaaggatggtagctagagg

SEQ ID NO: 457335 - DNA, 25 bp, Mus musculus
taaacagaaggcaattcagggtccc

SEQ ID NO: 457336 - DNA, 25 bp, Mus musculus
taaacagataccctggtccctggaa

SEQ ID NO: 457337 - DNA, 25 bp, Mus musculus
taaacagatcaaccgccttgaggat

SEQ ID NO: 457338 - DNA, 25 bp, Mus musculus
taaacagcaagccaagtcatggatg

SEQ ID NO: 457339 - DNA, 25 bp, Mus musculus
taaacagcagtgttcccaaactggg

SEQ ID NO: 457340 - DNA, 25 bp, Mus musculus
taaacagccgctgctttgcgagtcg

SEQ ID NO: 457341 - DNA, 25 bp, Mus musculus
taaacagcctcaaggagcatgagcc

SEQ ID NO: 457342 - DNA, 25 bp, Mus musculus
taaacagcgattgggccggcaggat

SEQ ID NO: 457343 - DNA, 25 bp, Mus musculus
taaacagcgcagcactgtggacatc

SEQ ID NO: 457344 - DNA, 25 bp, Mus musculus
taaacagcggccacatcagtgacgt

SEQ ID NO: 457345 - DNA, 25 bp, Mus musculus
taaacagctcacgatgccaggaact

SEQ ID NO: 457346 - DNA, 25 bp, Mus musculus
taaacagctggtttcagcaccggcc

SEQ ID NO: 457347 - DNA, 25 bp, Mus musculus
taaacagcttggagtgtgcacggat

SEQ ID NO: 457348 - DNA, 25 bp, Mus musculus
taaacaggcagctaaaacggagacc

SEQ ID NO: 457349 - DNA, 25 bp, Mus musculus
taaacaggcatagttggactggctg

SEQ ID NO: 457350 - DNA, 25 bp, Mus musculus
taaacaggctacactgggctggcag

SEQ ID NO: 457351 - DNA, 25 bp, Mus musculus
taaacagggccttgcaggcatcacc

SEQ ID NO: 457352 - DNA, 25 bp, Mus musculus
taaacaggtgccagaatgtctcagc

SEQ ID NO: 457353 - DNA, 25 bp, Mus musculus
taaacaggtttcaggaagtctacca

SEQ ID NO: 457354 - DNA, 25 bp, Mus musculus
taaacagtaagctggaggttgagtg

SEQ ID NO: 457355 - DNA, 25 bp, Mus musculus
taaacagtactatgacggctcggag

SEQ ID NO: 457356 - DNA, 25 bp, Mus musculus
taaacagtactgtcagcgacataag

SEQ ID NO: 457357 - DNA, 25 bp, Mus musculus
taaacagtatgtgcaagaccgtgag

SEQ ID NO: 457358 - DNA, 25 bp, Mus musculus
taaacagtcaagtcaggtcaagcaa

SEQ ID NO: 457359 - DNA, 25 bp, Mus musculus
taaacagtgccacatctacggaaga

SEQ ID NO: 457360 - DNA, 25 bp, Mus musculus
taaacagtgtggacagatgccggca

SEQ ID NO: 457361 - DNA, 25 bp, Mus musculus
taaacagtgtggatacaagcccctc

SEQ ID NO: 457362 - DNA, 25 bp, Mus musculus
taaacagttcaagaagccccagtgg

SEQ ID NO: 457363 - DNA, 25 bp, Mus musculus
taaacagttttcttcaggacagtcc

SEQ ID NO: 457364 - DNA, 25 bp, Mus musculus
taaacatatgcggattcatacaggg

SEQ ID NO: 457365 - DNA, 25 bp, Mus musculus
taaacatatttcctagaccaacggt

SEQ ID NO: 457366 - DNA, 25 bp, Mus musculus
taaacatcaaagtcgatgggcgtgc

SEQ ID NO: 457367 - DNA, 25 bp, Mus musculus
taaacatcatgtacgacgggctggc

SEQ ID NO: 457368 - DNA, 25 bp, Mus musculus
taaacatcctcctgtagttccggga

SEQ ID NO: 457369 - DNA, 25 bp, Mus musculus
taaacatcctgttgttgagcacggc

SEQ ID NO: 457370 - DNA, 25 bp, Mus musculus
taaacatcgggccaagatggacgat

SEQ ID NO: 457371 - DNA, 25 bp, Mus musculus
taaacatggcttgctacctaaggcg

SEQ ID NO: 457372 - DNA, 25 bp, Mus musculus
taaacatgggagtaagaacacagct

SEQ ID NO: 457373 - DNA, 25 bp, Mus musculus
taaacatgggcttgccgatgaagcc

SEQ ID NO: 457374 - DNA, 25 bp, Mus musculus
taaacatgtcaggttcgccctcatc

SEQ ID NO: 457375 - DNA, 25 bp, Mus musculus
taaacatgttccatctctgtgaggg

SEQ ID NO: 457376 - DNA, 25 bp, Mus musculus
taaacatgttgtgcgggctatagcg

SEQ ID NO: 457377 - DNA, 25 bp, Mus musculus
taaacattagtttgaccgggattcg

SEQ ID NO: 457378 - DNA, 25 bp, Mus musculus
taaacattagtttggcttcgatgct

SEQ ID NO: 457379 - DNA, 25 bp, Mus musculus
taaacattattctggtagacagcgc

SEQ ID NO: 457380 - DNA, 25 bp, Mus musculus
taaacattcagtgctcgcctttaat

SEQ ID NO: 457381 - DNA, 25 bp, Mus musculus
taaacattcatggtcgcaggcaaag

SEQ ID NO: 457382 - DNA, 25 bp, Mus musculus
taaacattgccaaacaacattgagc

SEQ ID NO: 457383 - DNA, 25 bp, Mus musculus
taaacatttgcttaaaggtactgag

SEQ ID NO: 457384 - DNA, 25 bp, Mus musculus
taaaccaacccaaaggatgctgcgg

SEQ ID NO: 457385 - DNA, 25 bp, Mus musculus
taaaccaactacaaatgcaagtcag

SEQ ID NO: 457386 - DNA, 25 bp, Mus musculus
taaaccaatcccacagtcagtcagg

SEQ ID NO: 457387 - DNA, 25 bp, Mus musculus
taaaccacaaggacctaccagtgct

SEQ ID NO: 457388 - DNA, 25 bp, Mus musculus
taaaccacagcaggagctctacagg

SEQ ID NO: 457389 - DNA, 25 bp, Mus musculus
taaaccagacggtgttgaatcgtgc

SEQ ID NO: 457390 - DNA, 25 bp, Mus musculus
taaaccagagggagattgcacaagg

SEQ ID NO: 457391 - DNA, 25 bp, Mus musculus
taaaccagaggttcgagaccctgtg

SEQ ID NO: 457392 - DNA, 25 bp, Mus musculus
taaaccagccggacatgtgcgtcta

SEQ ID NO: 457393 - DNA, 25 bp, Mus musculus
taaaccagcgtgttgatgacgcact

SEQ ID NO: 457394 - DNA, 25 bp, Mus musculus
taaaccaggaggtatagtgcaaggc

SEQ ID NO: 457395 - DNA, 25 bp, Mus musculus
taaaccaggataatgatggaatcat

SEQ ID NO: 457396 - DNA, 25 bp, Mus musculus
taaaccaggccaataagcgacacgg

SEQ ID NO: 457397 - DNA, 25 bp, Mus musculus
taaaccagggctgactggagggaac

SEQ ID NO: 457398 - DNA, 25 bp, Mus musculus
taaaccagtagctgggtacaagcct

SEQ ID NO: 457399 - DNA, 25 bp, Mus musculus
taaaccatgctaaaggaacgggctg

SEQ ID NO: 457400 - DNA, 25 bp, Mus musculus
taaacccaattcagctgtcggacat

SEQ ID NO: 457401 - DNA, 25 bp, Mus musculus
taaacccaggctcttgcatgctagg

SEQ ID NO: 457402 - DNA, 25 bp, Mus musculus
taaacccagggcttttgtgttctgg

SEQ ID NO: 457403 - DNA, 25 bp, Mus musculus
taaacccagttgcttacggtggatc

SEQ ID NO: 457404 - DNA, 25 bp, Mus musculus
taaacccatctgagaggccagccat

SEQ ID NO: 457405 - DNA, 25 bp, Mus musculus
taaaccccttggaagcaaacatggt

SEQ ID NO: 457406 - DNA, 25 bp, Mus musculus
taaacccgaccctgcggatgtttgg

SEQ ID NO: 457407 - DNA, 25 bp, Mus musculus
taaacccgtggttatgagaatatcc

SEQ ID NO: 457408 - DNA, 25 bp, Mus musculus
taaaccctcggaagctgattgaagt

SEQ ID NO: 457409 - DNA, 25 bp, Mus musculus
taaaccctgaggaaatgagacgaag

SEQ ID NO: 457410 - DNA, 25 bp, Mus musculus
taaaccctgattaccggcaggaaat

SEQ ID NO: 457411 - DNA, 25 bp, Mus musculus
taaacccttcatcctaccgggatgc

SEQ ID NO: 457412 - DNA, 25 bp, Mus musculus
taaacccttctgtgggtcaaggatt

SEQ ID NO: 457413 - DNA, 25 bp, Mus musculus
taaaccgaacctgatgggtctgccc

SEQ ID NO: 457414 - DNA, 25 bp, Mus musculus
taaaccgaatctggaagagcctgtg

SEQ ID NO: 457415 - DNA, 25 bp, Mus musculus
taaaccgactcccatgtgaatgagg

SEQ ID NO: 457416 - DNA, 25 bp, Mus musculus
taaaccgcgggctgccgcatcgtgc

SEQ ID NO: 457417 - DNA, 25 bp, Mus musculus
taaaccggacttcatctgtgagagc

SEQ ID NO: 457418 - DNA, 25 bp, Mus musculus
taaaccggagtgtagctacttctag

SEQ ID NO: 457419 - DNA, 25 bp, Mus musculus
taaaccggccaagcttggtccagct

SEQ ID NO: 457420 - DNA, 25 bp, Mus musculus
taaaccgggtcaggacaattcatgt

SEQ ID NO: 457421 - DNA, 25 bp, Mus musculus
taaaccggttatgcacattggagcc

SEQ ID NO: 457422 - DNA, 25 bp, Mus musculus
taaaccgtagccatgagggaaatcg

SEQ ID NO: 457423 - DNA, 25 bp, Mus musculus
taaacctaaagtccatcagcaagcg

SEQ ID NO: 457424 - DNA, 25 bp, Mus musculus
taaacctactgaagaatttgctcag

SEQ ID NO: 457425 - DNA, 25 bp, Mus musculus
taaacctccgcagtacagaccaagg

SEQ ID NO: 457426 - DNA, 25 bp, Mus musculus
taaacctcgggctcatctagctggg

SEQ ID NO: 457427 - DNA, 25 bp, Mus musculus
taaacctgacagtacactttcacag

SEQ ID NO: 457428 - DNA, 25 bp, Mus musculus
taaacctgagtaccaaatgtaggca

SEQ ID NO: 457429 - DNA, 25 bp, Mus musculus
taaacctgctatgcggtgaggagca

SEQ ID NO: 457430 - DNA, 25 bp, Mus musculus
taaacctggagatagttgcttaggc

SEQ ID NO: 457431 - DNA, 25 bp, Mus musculus
taaacctggattgtacagagcctga

SEQ ID NO: 457432 - DNA, 25 bp, Mus musculus
taaacctggcagctatagaatacac

SEQ ID NO: 457433 - DNA, 25 bp, Mus musculus
taaacctgtcgtatggcctagtctc

SEQ ID NO: 457434 - DNA, 25 bp, Mus musculus
taaacctgtgcaaccaaattccttg

SEQ ID NO: 457435 - DNA, 25 bp, Mus musculus
taaacctgttggtggaaaaggcgcg

SEQ ID NO: 457436 - DNA, 25 bp, Mus musculus
taaaccttagctctcaaagccgtgg

SEQ ID NO: 457437 - DNA, 25 bp, Mus musculus
taaaccttagtcctcttctgggtga

SEQ ID NO: 457438 - DNA, 25 bp, Mus musculus
taaaccttcttgctcctctggaggg

SEQ ID NO: 457439 - DNA, 25 bp, Mus musculus
taaaccttggactgaggcaggagac

SEQ ID NO: 457440 - DNA, 25 bp, Mus musculus
taaacgacaatcaggaaacgaactc

SEQ ID NO: 457441 - DNA, 25 bp, Mus musculus
taaacgacagtcttgcaacagtgga

SEQ ID NO: 457442 - DNA, 25 bp, Mus musculus
taaacgactgaactttgcaatgaaa

SEQ ID NO: 457443 - DNA, 25 bp, Mus musculus
taaacgacttcaggagcttggagcc

SEQ ID NO: 457444 - DNA, 25 bp, Mus musculus
taaacgagcccgacatgcttttccc

SEQ ID NO: 457445 - DNA, 25 bp, Mus musculus
taaacgaggcttcagctcgcaggct

SEQ ID NO: 457446 - DNA, 25 bp, Mus musculus
taaacgccacagatcctgacgaggg

SEQ ID NO: 457447 - DNA, 25 bp, Mus musculus
taaacgccctggataactgcaagag

SEQ ID NO: 457448 - DNA, 25 bp, Mus musculus
taaacgcctcgaatgcttcagatgg

SEQ ID NO: 457449 - DNA, 25 bp, Mus musculus
taaacgccttagaaccctgtgcact

SEQ ID NO: 457450 - DNA, 25 bp, Mus musculus
taaacgcgggtttctcactaaggat

SEQ ID NO: 457451 - DNA, 25 bp, Mus musculus
taaacgctgtgtgtccctcatactg

SEQ ID NO: 457452 - DNA, 25 bp, Mus musculus
taaacgcttagcacgagcactcgat

SEQ ID NO: 457453 - DNA, 25 bp, Mus musculus
taaacggaagcgcacgcctaaatgc

SEQ ID NO: 457454 - DNA, 25 bp, Mus musculus
taaacggcctgtcgactgtgggcat

SEQ ID NO: 457455 - DNA, 25 bp, Mus musculus
taaacgggagaccagtgcaatcaga

SEQ ID NO: 457456 - DNA, 25 bp, Mus musculus
taaacgggtcgcttatgtgttgagt

SEQ ID NO: 457457 - DNA, 25 bp, Mus musculus
taaacggtggctaacccagggtgag

SEQ ID NO: 457458 - DNA, 25 bp, Mus musculus
taaacgtcaacgctcaaaatggatt

SEQ ID NO: 457459 - DNA, 25 bp, Mus musculus
taaacgtctgcgacttcagtggtcc

SEQ ID NO: 457460 - DNA, 25 bp, Mus musculus
taaacgtgaatgctgtactcaccga

SEQ ID NO: 457461 - DNA, 25 bp, Mus musculus
taaacgtgacagcttagaaccacag

SEQ ID NO: 457462 - DNA, 25 bp, Mus musculus
taaacgtgggtatactttggctctc

SEQ ID NO: 457463 - DNA, 25 bp, Mus musculus
taaacgtgttagagccagagagcgg

SEQ ID NO: 457464 - DNA, 25 bp, Mus musculus
taaactaaagactctgccttccgtg

SEQ ID NO: 457465 - DNA, 25 bp, Mus musculus
taaactaatttctggtgagcccttg

SEQ ID NO: 457466 - DNA, 25 bp, Mus musculus
taaactacaggcgaccactctggga

SEQ ID NO: 457467 - DNA, 25 bp, Mus musculus
taaactacagtgttcactcctggag

SEQ ID NO: 457468 - DNA, 25 bp, Mus musculus
taaactacgaaggtgagtcacaagg

SEQ ID NO: 457469 - DNA, 25 bp, Mus musculus
taaactaggaagagtgattggcccc

SEQ ID NO: 457470 - DNA, 25 bp, Mus musculus
taaactagtcattcatgtacccaca

SEQ ID NO: 457471 - DNA, 25 bp, Mus musculus
taaactagtgcctctcctggtccag

SEQ ID NO: 457472 - DNA, 25 bp, Mus musculus
taaactatcataggaacaggcgaca

SEQ ID NO: 457473 - DNA, 25 bp, Mus musculus
taaactatgtgagagtcaagaatgc

SEQ ID NO: 457474 - DNA, 25 bp, Mus musculus
taaactcaagcagaagggagccatc

SEQ ID NO: 457475 - DNA, 25 bp, Mus musculus
taaactcacagtccgccatggtcag

SEQ ID NO: 457476 - DNA, 25 bp, Mus musculus
taaactcaccgtgctaaggatggct

SEQ ID NO: 457477 - DNA, 25 bp, Mus musculus
taaactcagtctttgaccaactggg

SEQ ID NO: 457478 - DNA, 25 bp, Mus musculus
taaactccactcctgtcaaagggtg

SEQ ID NO: 457479 - DNA, 25 bp, Mus musculus
taaactcgttgaggctagggccaac

SEQ ID NO: 457480 - DNA, 25 bp, Mus musculus
taaactctacctgtggcctatgcgg

SEQ ID NO: 457481 - DNA, 25 bp, Mus musculus
taaactctcagaacaggaaaaggcc

SEQ ID NO: 457482 - DNA, 25 bp, Mus musculus
taaactctcgtctgctcctctgtcg

SEQ ID NO: 457483 - DNA, 25 bp, Mus musculus
taaactgaaatgtgacgtctgtggc

SEQ ID NO: 457484 - DNA, 25 bp, Mus musculus
taaactgacacattgtagaaagagc

SEQ ID NO: 457485 - DNA, 25 bp, Mus musculus
taaactgaccgaggaagggtgcaca

SEQ ID NO: 457486 - DNA, 25 bp, Mus musculus
taaactgacctaactcgaggaggag

SEQ ID NO: 457487 - DNA, 25 bp, Mus musculus
taaactgaggcatacaacggagcaa

SEQ ID NO: 457488 - DNA, 25 bp, Mus musculus
taaactgatgagtggtgttgaccgt

SEQ ID NO: 457489 - DNA, 25 bp, Mus musculus
taaactgcagcgtttccctgagacg

SEQ ID NO: 457490 - DNA, 25 bp, Mus musculus
taaactgcctcaaagtccaggtgct

SEQ ID NO: 457491 - DNA, 25 bp, Mus musculus
taaactgcgtctgctggaagaagct

SEQ ID NO: 457492 - DNA, 25 bp, Mus musculus
taaactgctcaaccaagaagagggc

SEQ ID NO: 457493 - DNA, 25 bp, Mus musculus
taaactgctgctgtgacaaggactg

SEQ ID NO: 457494 - DNA, 25 bp, Mus musculus
taaactggaaggttgcaatagaacc

SEQ ID NO: 457495 - DNA, 25 bp, Mus musculus
taaactggattgtactaggtggact

SEQ ID NO: 457496 - DNA, 25 bp, Mus musculus
taaactgggctcttgcatgacctat

SEQ ID NO: 457497 - DNA, 25 bp, Mus musculus
taaactgggcttggaaagatactgg

SEQ ID NO: 457498 - DNA, 25 bp, Mus musculus
taaactgggtgaccaacatgctggc

SEQ ID NO: 457499 - DNA, 25 bp, Mus musculus
taaactgtaccagctgatcggcaag

SEQ ID NO: 457500 - DNA, 25 bp, Mus musculus
taaactgtactcgtccgtgtggaac

SEQ ID NO: 457501 - DNA, 25 bp, Mus musculus
taaactgtcaggagcacggactctg

SEQ ID NO: 457502 - DNA, 25 bp, Mus musculus
taaactgtcagtctccttaacaagc

SEQ ID NO: 457503 - DNA, 25 bp, Mus musculus
taaactgtccccatcttcatgataa

SEQ ID NO: 457504 - DNA, 25 bp, Mus musculus
taaactgtgccattcctaaagggct

SEQ ID NO: 457505 - DNA, 25 bp, Mus musculus
taaactgtggtgacttggactgccg

SEQ ID NO: 457506 - DNA, 25 bp, Mus musculus
taaactgtgtggagtggagactaaa

SEQ ID NO: 457507 - DNA, 25 bp, Mus musculus
taaactgtgttaccaagaagcccct

SEQ ID NO: 457508 - DNA, 25 bp, Mus musculus
taaacttacgtgacctgcttgcagc

SEQ ID NO: 457509 - DNA, 25 bp, Mus musculus
taaacttagatgtcaggaaggagca

SEQ ID NO: 457510 - DNA, 25 bp, Mus musculus
taaacttagcgtctcccctgagtgg

SEQ ID NO: 457511 - DNA, 25 bp, Mus musculus
taaacttaggtgttcgaggcctggt

SEQ ID NO: 457512 - DNA, 25 bp, Mus musculus
taaacttcagtgtggacgcttagaa

SEQ ID NO: 457513 - DNA, 25 bp, Mus musculus
taaacttcatactgttgggatgtgc

SEQ ID NO: 457514 - DNA, 25 bp, Mus musculus
taaacttccaggcaatgtgacctgg

SEQ ID NO: 457515 - DNA, 25 bp, Mus musculus
taaacttcgacacagcaaagggtgc

SEQ ID NO: 457516 - DNA, 25 bp, Mus musculus
taaacttcgtgaaccgtgactggct

SEQ ID NO: 457517 - DNA, 25 bp, Mus musculus
taaacttctagtcagccatggagcc

SEQ ID NO: 457518 - DNA, 25 bp, Mus musculus
taaacttgaagcttcttagagacaa

SEQ ID NO: 457519 - DNA, 25 bp, Mus musculus
taaacttgactgaattggcactggc

SEQ ID NO: 457520 - DNA, 25 bp, Mus musculus
taaacttgatgacttggtgcggccg

SEQ ID NO: 457521 - DNA, 25 bp, Mus musculus
taaacttgcctttgagcgttaagcc

SEQ ID NO: 457522 - DNA, 25 bp, Mus musculus
taaacttgcggtctgctgggaacat

SEQ ID NO: 457523 - DNA, 25 bp, Mus musculus
taaacttggcattggcgtgcaatcc

SEQ ID NO: 457524 - DNA, 25 bp, Mus musculus
taaacttggccacgaagagcagcaa

SEQ ID NO: 457525 - DNA, 25 bp, Mus musculus
taaacttggcctgtgccgtgcagac

SEQ ID NO: 457526 - DNA, 25 bp, Mus musculus
taaactttatccaagtgagcaccct

SEQ ID NO: 457527 - DNA, 25 bp, Mus musculus
taaactttccaagagcggtgcccct

SEQ ID NO: 457528 - DNA, 25 bp, Mus musculus
taaactttctctgatctctctgtgt

SEQ ID NO: 457529 - DNA, 25 bp, Mus musculus
taaactttgtctaggctctgcatac

SEQ ID NO: 457530 - DNA, 25 bp, Mus musculus
taaagaaaaaatcaagcaggcgaaa

SEQ ID NO: 457531 - DNA, 25 bp, Mus musculus
taaagaaaatgtaaccgtggccgca

SEQ ID NO: 457532 - DNA, 25 bp, Mus musculus
taaagaaacactctctggcatcagg

SEQ ID NO: 457533 - DNA, 25 bp, Mus musculus
taaagaaaccagtgttgccatcgag

SEQ ID NO: 457534 - DNA, 25 bp, Mus musculus
taaagaaacctaaactcgaggctgg

SEQ ID NO: 457535 - DNA, 25 bp, Mus musculus
taaagaaagagcaaacgtggatggg

SEQ ID NO: 457536 - DNA, 25 bp, Mus musculus
taaagaaagtctgaggtgttcccca

SEQ ID NO: 457537 - DNA, 25 bp, Mus musculus
taaagaaatctggactcaaggcccc

SEQ ID NO: 457538 - DNA, 25 bp, Mus musculus
taaagaaattgctcgagactccatc

SEQ ID NO: 457539 - DNA, 25 bp, Mus musculus
taaagaacaacgcacttctggagct

SEQ ID NO: 457540 - DNA, 25 bp, Mus musculus
taaagaacagttcctacggctacgg

SEQ ID NO: 457541 - DNA, 25 bp, Mus musculus
taaagaacccaagagcgtacgcaat

SEQ ID NO: 457542 - DNA, 25 bp, Mus musculus
taaagaactaacgatgccccaggtc

SEQ ID NO: 457543 - DNA, 25 bp, Mus musculus
taaagaactggagacaagggctgca

SEQ ID NO: 457544 - DNA, 25 bp, Mus musculus
taaagaacttcatcggctgcagacg

SEQ ID NO: 457545 - DNA, 25 bp, Mus musculus
taaagaagaaccagagcggagagcc

SEQ ID NO: 457546 - DNA, 25 bp, Mus musculus
taaagaagaccgatgtcccactgct

SEQ ID NO: 457547 - DNA, 25 bp, Mus musculus
taaagaagacgccttgaccacacag

SEQ ID NO: 457548 - DNA, 25 bp, Mus musculus
taaagaagactccactgagcaccgg

SEQ ID NO: 457549 - DNA, 25 bp, Mus musculus
taaagaagacttagagatgacgctg

SEQ ID NO: 457550 - DNA, 25 bp, Mus musculus
taaagaagagagctagcaacctgca

SEQ ID NO: 457551 - DNA, 25 bp, Mus musculus
taaagaagaggagagacggttcgcc

SEQ ID NO: 457552 - DNA, 25 bp, Mus musculus
taaagaagaggagcggcccctgtgt

SEQ ID NO: 457553 - DNA, 25 bp, Mus musculus
taaagaagatcgacagctgcgagcg

SEQ ID NO: 457554 - DNA, 25 bp, Mus musculus
taaagaagccaaggaccacgatgtg

SEQ ID NO: 457555 - DNA, 25 bp, Mus musculus
taaagaagccgcctccaggtagtct

SEQ ID NO: 457556 - DNA, 25 bp, Mus musculus
taaagaagccgctggaagaaagcca

SEQ ID NO: 457557 - DNA, 25 bp, Mus musculus
taaagaagccggtggcattttttag

SEQ ID NO: 457558 - DNA, 25 bp, Mus musculus
taaagaaggattctggacgggctct

SEQ ID NO: 457559 - DNA, 25 bp, Mus musculus
taaagaaggcgctaaccaaaggtct

SEQ ID NO: 457560 - DNA, 25 bp, Mus musculus
taaagaagggcgaaaagagtagtag

SEQ ID NO: 457561 - DNA, 25 bp, Mus musculus
taaagaagtgatcgagctgcccgtg

SEQ ID NO: 457562 - DNA, 25 bp, Mus musculus
taaagaatatggctgtgccccatgg

SEQ ID NO: 457563 - DNA, 25 bp, Mus musculus
taaagaatatgtcgaagatctggcc

SEQ ID NO: 457564 - DNA, 25 bp, Mus musculus
taaagaatcacccagaaccgctaag

SEQ ID NO: 457565 - DNA, 25 bp, Mus musculus
taaagaatgcttcctcgagctggct

SEQ ID NO: 457566 - DNA, 25 bp, Mus musculus
taaagaatgggatccggtaacctgg

SEQ ID NO: 457567 - DNA, 25 bp, Mus musculus
taaagaatgtcagaaccgggaggga

SEQ ID NO: 457568 - DNA, 25 bp, Mus musculus
taaagaattagccttggaccaaatg

SEQ ID NO: 457569 - DNA, 25 bp, Mus musculus
taaagaattgggttacccagccact

SEQ ID NO: 457570 - DNA, 25 bp, Mus musculus
taaagacaaagaccggaactgggat

SEQ ID NO: 457571 - DNA, 25 bp, Mus musculus
taaagacaagccctgcattggagtc

SEQ ID NO: 457572 - DNA, 25 bp, Mus musculus
taaagacaagcgtgtggtaccgaga

SEQ ID NO: 457573 - DNA, 25 bp, Mus musculus
taaagacaaggatgcctacagcagc

SEQ ID NO: 457574 - DNA, 25 bp, Mus musculus
taaagacaagtgctctgcaggccgc

SEQ ID NO: 457575 - DNA, 25 bp, Mus musculus
taaagacaatcagattaacccgaag

SEQ ID NO: 457576 - DNA, 25 bp, Mus musculus
taaagacaatgtgtaccaaatggga

SEQ ID NO: 457577 - DNA, 25 bp, Mus musculus
taaagacacagatgcggtgatgggc

SEQ ID NO: 457578 - DNA, 25 bp, Mus musculus
taaagacacccgtgggtccatccag

SEQ ID NO: 457579 - DNA, 25 bp, Mus musculus
taaagacagaagtcctgggcagcgg

SEQ ID NO: 457580 - DNA, 25 bp, Mus musculus
taaagacagtaagcaagagagcaca

SEQ ID NO: 457581 - DNA, 25 bp, Mus musculus
taaagacagtgcaggagtctgggcc

SEQ ID NO: 457582 - DNA, 25 bp, Mus musculus
taaagacagtgtgtggcccttgcct

SEQ ID NO: 457583 - DNA, 25 bp, Mus musculus
taaagacatatccacagacctgagg

SEQ ID NO: 457584 - DNA, 25 bp, Mus musculus
taaagacattttgaacgaggccggc

SEQ ID NO: 457585 - DNA, 25 bp, Mus musculus
taaagaccaggccataggcctcagg

SEQ ID NO: 457586 - DNA, 25 bp, Mus musculus
taaagaccatgctggatggacaccg

SEQ ID NO: 457587 - DNA, 25 bp, Mus musculus
taaagacccagcagtacatatccgg

SEQ ID NO: 457588 - DNA, 25 bp, Mus musculus
taaagacccctttaagcatgtggtg

SEQ ID NO: 457589 - DNA, 25 bp, Mus musculus
taaagacccgatacatgaacgctcc

SEQ ID NO: 457590 - DNA, 25 bp, Mus musculus
taaagacccttacagctttgggagg

SEQ ID NO: 457591 - DNA, 25 bp, Mus musculus
taaagacctttctcactgcggtggg

SEQ ID NO: 457592 - DNA, 25 bp, Mus musculus
taaagacgacatagacggcatccag

SEQ ID NO: 457593 - DNA, 25 bp, Mus musculus
taaagacgacggcaacagtgtggac

SEQ ID NO: 457594 - DNA, 25 bp, Mus musculus
taaagacgatgttgcctggcgagca

SEQ ID NO: 457595 - DNA, 25 bp, Mus musculus
taaagacgtactacaggctgcagca

SEQ ID NO: 457596 - DNA, 25 bp, Mus musculus
taaagacgtctcacatgtctgcagg

SEQ ID NO: 457597 - DNA, 25 bp, Mus musculus
taaagactattccatggaagcccgg

SEQ ID NO: 457598 - DNA, 25 bp, Mus musculus
taaagactctgaacggaatggcctg

SEQ ID NO: 457599 - DNA, 25 bp, Mus musculus
taaagactggcaagatgtggactgc

SEQ ID NO: 457600 - DNA, 25 bp, Mus musculus
taaagactgtctgtatggagccact

SEQ ID NO: 457601 - DNA, 25 bp, Mus musculus
taaagacttccagccgtattacggg

SEQ ID NO: 457602 - DNA, 25 bp, Mus musculus
taaagagaaaactgtgggccgagct

SEQ ID NO: 457603 - DNA, 25 bp, Mus musculus
taaagagaaaggcaccaagcggaga

SEQ ID NO: 457604 - DNA, 25 bp, Mus musculus
taaagagaaccatgatacccagcca

SEQ ID NO: 457605 - DNA, 25 bp, Mus musculus
taaagagacactgtagcactggtgg

SEQ ID NO: 457606 - DNA, 25 bp, Mus musculus
taaagagacgcctggttgagagaca

SEQ ID NO: 457607 - DNA, 25 bp, Mus musculus
taaagagactagagatggagctgtg

SEQ ID NO: 457608 - DNA, 25 bp, Mus musculus
taaagagactgactccgagcggctg

SEQ ID NO: 457609 - DNA, 25 bp, Mus musculus
taaagagagttctcccagctggtcc

SEQ ID NO: 457610 - DNA, 25 bp, Mus musculus
taaagagatcagactttctggcccc

SEQ ID NO: 457611 - DNA, 25 bp, Mus musculus
taaagagcaaacctcgagcactgga

SEQ ID NO: 457612 - DNA, 25 bp, Mus musculus
taaagagcaacagaggcagagactg

SEQ ID NO: 457613 - DNA, 25 bp, Mus musculus
taaagagcatgagcagacattctcg

SEQ ID NO: 457614 - DNA, 25 bp, Mus musculus
taaagagcccaggagttagcagagg

SEQ ID NO: 457615 - DNA, 25 bp, Mus musculus
taaagagctccatcacttcaggatc

SEQ ID NO: 457616 - DNA, 25 bp, Mus musculus
taaagagctgtaagttgtgggaatt

SEQ ID NO: 457617 - DNA, 25 bp, Mus musculus
taaagaggacaggaggtggcttccc

SEQ ID NO: 457618 - DNA, 25 bp, Mus musculus
taaagaggaggtgatcccaggatcc

SEQ ID NO: 457619 - DNA, 25 bp, Mus musculus
taaagaggagtttgctggtgtccga

SEQ ID NO: 457620 - DNA, 25 bp, Mus musculus
taaagaggcttatgagttcaaggaa

SEQ ID NO: 457621 - DNA, 25 bp, Mus musculus
taaagagggacatcaggtactgagc

SEQ ID NO: 457622 - DNA, 25 bp, Mus musculus
taaagagtcatctgtcccaggccac

SEQ ID NO: 457623 - DNA, 25 bp, Mus musculus
taaagagtcctcatttgcacagcaa

SEQ ID NO: 457624 - DNA, 25 bp, Mus musculus
taaagagtggtgttcctgaggcact

SEQ ID NO: 457625 - DNA, 25 bp, Mus musculus
taaagagtgttttctgtgcagcggc

SEQ ID NO: 457626 - DNA, 25 bp, Mus musculus
taaagatacagaaatcaggcttggc

SEQ ID NO: 457627 - DNA, 25 bp, Mus musculus
taaagataggactgggctgcatgac

SEQ ID NO: 457628 - DNA, 25 bp, Mus musculus
taaagatagtcgtcaaggccagtgg

SEQ ID NO: 457629 - DNA, 25 bp, Mus musculus
taaagatcccagagcagcagtgcac

SEQ ID NO: 457630 - DNA, 25 bp, Mus musculus
taaagatcctacaacagaaatgcgg

SEQ ID NO: 457631 - DNA, 25 bp, Mus musculus
taaagatcgagaagacagcacctag

SEQ ID NO: 457632 - DNA, 25 bp, Mus musculus
taaagatcttgggaggaggccagct

SEQ ID NO: 457633 - DNA, 25 bp, Mus musculus
taaagatgaccaggtgagacggcca

SEQ ID NO: 457634 - DNA, 25 bp, Mus musculus
taaagatgacgaaagagtcccagct

SEQ ID NO: 457635 - DNA, 25 bp, Mus musculus
taaagatgccatttctgtcgcctcc

SEQ ID NO: 457636 - DNA, 25 bp, Mus musculus
taaagatgcccggacagtgaaggct

SEQ ID NO: 457637 - DNA, 25 bp, Mus musculus
taaagatgcctgcagtcgatagctg

SEQ ID NO: 457638 - DNA, 25 bp, Mus musculus
taaagatgccttgtcgtgcagaaac

SEQ ID NO: 457639 - DNA, 25 bp, Mus musculus
taaagatggaagttactacgaaggc

SEQ ID NO: 457640 - DNA, 25 bp, Mus musculus
taaagatggacgtcactgttgcccc

SEQ ID NO: 457641 - DNA, 25 bp, Mus musculus
taaagatgggttgttggagtcctga

SEQ ID NO: 457642 - DNA, 25 bp, Mus musculus
taaagatgtcggactgcttcctgca

SEQ ID NO: 457643 - DNA, 25 bp, Mus musculus
taaagatgtgaacaaccactcgtgg

SEQ ID NO: 457644 - DNA, 25 bp, Mus musculus
taaagatgtgtctggtctgcccgaa

SEQ ID NO: 457645 - DNA, 25 bp, Mus musculus
taaagatgttagctatagcccaagg

SEQ ID NO: 457646 - DNA, 25 bp, Mus musculus
taaagattaatagtagctcaagtcg

SEQ ID NO: 457647 - DNA, 25 bp, Mus musculus
taaagattatgacagagaagccact

SEQ ID NO: 457648 - DNA, 25 bp, Mus musculus
taaagattcactcgagcaggcggta

SEQ ID NO: 457649 - DNA, 25 bp, Mus musculus
taaagattccgtaacaggctctggg

SEQ ID NO: 457650 - DNA, 25 bp, Mus musculus
taaagatttccttcagcgggagcac

SEQ ID NO: 457651 - DNA, 25 bp, Mus musculus
taaagattttgccagcgagtcccgg

SEQ ID NO: 457652 - DNA, 25 bp, Mus musculus
taaagcaaccagtttgggacccgca

SEQ ID NO: 457653 - DNA, 25 bp, Mus musculus
taaagcaagccatgtctcagtcact

SEQ ID NO: 457654 - DNA, 25 bp, Mus musculus
taaagcaaggcagtcagtaacctgc

SEQ ID NO: 457655 - DNA, 25 bp, Mus musculus
taaagcaagtacaagttctcgcatg

SEQ ID NO: 457656 - DNA, 25 bp, Mus musculus
taaagcacaccacctatcagcggtc

SEQ ID NO: 457657 - DNA, 25 bp, Mus musculus
taaagcacaggtatcaggtaacagg

SEQ ID NO: 457658 - DNA, 25 bp, Mus musculus
taaagcacagtttgaagcatggcgt

SEQ ID NO: 457659 - DNA, 25 bp, Mus musculus
taaagcaccatgtccgggagatctc

SEQ ID NO: 457660 - DNA, 25 bp, Mus musculus
taaagcaccctttgtagaccatgaa

SEQ ID NO: 457661 - DNA, 25 bp, Mus musculus
taaagcagatgacaagtgtccccgg

SEQ ID NO: 457662 - DNA, 25 bp, Mus musculus
taaagcagatgtagccggtcatgcc

SEQ ID NO: 457663 - DNA, 25 bp, Mus musculus
taaagcagcacccaatattcaagga

SEQ ID NO: 457664 - DNA, 25 bp, Mus musculus
taaagcagccagtgcgcgtgtggaa

SEQ ID NO: 457665 - DNA, 25 bp, Mus musculus
taaagcagctggtgcctccaggatc

SEQ ID NO: 457666 - DNA, 25 bp, Mus musculus
taaagcagcttgatatcctaggtga

SEQ ID NO: 457667 - DNA, 25 bp, Mus musculus
taaagcaggcgttaagatcaacccc

SEQ ID NO: 457668 - DNA, 25 bp, Mus musculus
taaagcaggctggaacttacaggtc

SEQ ID NO: 457669 - DNA, 25 bp, Mus musculus
taaagcaggtcatggcaccgtgaga

SEQ ID NO: 457670 - DNA, 25 bp, Mus musculus
taaagcagttactggaggactccac

SEQ ID NO: 457671 - DNA, 25 bp, Mus musculus
taaagcatagaatcccctgtactgt

SEQ ID NO: 457672 - DNA, 25 bp, Mus musculus
taaagcatctcactagtgcccagag

SEQ ID NO: 457673 - DNA, 25 bp, Mus musculus
taaagcatgctagtgattcaagttc

SEQ ID NO: 457674 - DNA, 25 bp, Mus musculus
taaagcatggctggtaggactcacg

SEQ ID NO: 457675 - DNA, 25 bp, Mus musculus
taaagccaaacataggctgggtctg

SEQ ID NO: 457676 - DNA, 25 bp, Mus musculus
taaagccaaccttagtgctcctggc

SEQ ID NO: 457677 - DNA, 25 bp, Mus musculus
taaagccagcgccatatacaacagg

SEQ ID NO: 457678 - DNA, 25 bp, Mus musculus
taaagccagggtaacactcaagagt

SEQ ID NO: 457679 - DNA, 25 bp, Mus musculus
taaagccatatccttcaagagacag

SEQ ID NO: 457680 - DNA, 25 bp, Mus musculus
taaagccatcgctacacctgagctt

SEQ ID NO: 457681 - DNA, 25 bp, Mus musculus
taaagccatgttagtcacagcacag

SEQ ID NO: 457682 - DNA, 25 bp, Mus musculus
taaagccattttagtcaaaggtcat

SEQ ID NO: 457683 - DNA, 25 bp, Mus musculus
taaagcccaggtgaactgctcggat

SEQ ID NO: 457684 - DNA, 25 bp, Mus musculus
taaagccccgcggagctatagatcc

SEQ ID NO: 457685 - DNA, 25 bp, Mus musculus
taaagcccgggaattctaaagctgc

SEQ ID NO: 457686 - DNA, 25 bp, Mus musculus
taaagccctaagctgccttattcag

SEQ ID NO: 457687 - DNA, 25 bp, Mus musculus
taaagccctttggaagaatactcag

SEQ ID NO: 457688 - DNA, 25 bp, Mus musculus
taaagccgagatttcagcacaaacc

SEQ ID NO: 457689 - DNA, 25 bp, Mus musculus
taaagccgccgctgaatgtttcgcg

SEQ ID NO: 457690 - DNA, 25 bp, Mus musculus
taaagccggcgaacagatcaacaat

SEQ ID NO: 457691 - DNA, 25 bp, Mus musculus
taaagccggtattttacgtgatcac

SEQ ID NO: 457692 - DNA, 25 bp, Mus musculus
taaagccgtaaagccaaaggctgcc

SEQ ID NO: 457693 - DNA, 25 bp, Mus musculus
taaagcctaggcgtcagctggtgtt

SEQ ID NO: 457694 - DNA, 25 bp, Mus musculus
taaagcctatccgtgcagttacccg

SEQ ID NO: 457695 - DNA, 25 bp, Mus musculus
taaagcctccctaacagccagagtc

SEQ ID NO: 457696 - DNA, 25 bp, Mus musculus
taaagcctcctgtccttgttgaagc

SEQ ID NO: 457697 - DNA, 25 bp, Mus musculus
taaagcctctgttcgtggaacccag

SEQ ID NO: 457698 - DNA, 25 bp, Mus musculus
taaagcctggatgcgaaggaagcag

SEQ ID NO: 457699 - DNA, 25 bp, Mus musculus
taaagcctttaggtatcccagcgcc

SEQ ID NO: 457700 - DNA, 25 bp, Mus musculus
taaagcgattcggttccttatccgg

SEQ ID NO: 457701 - DNA, 25 bp, Mus musculus
taaagcggataactcagccacaggc

SEQ ID NO: 457702 - DNA, 25 bp, Mus musculus
taaagcgggctgagagatcgcgtca

SEQ ID NO: 457703 - DNA, 25 bp, Mus musculus
taaagcgtacccacgaatccgatgc

SEQ ID NO: 457704 - DNA, 25 bp, Mus musculus
taaagcgtcgtccagtctaggtctg

SEQ ID NO: 457705 - DNA, 25 bp, Mus musculus
taaagcgttgcatgtacgtccggag

SEQ ID NO: 457706 - DNA, 25 bp, Mus musculus
taaagctaactattagcctctatct

SEQ ID NO: 457707 - DNA, 25 bp, Mus musculus
taaagctacaatcatgcctcgaggg

SEQ ID NO: 457708 - DNA, 25 bp, Mus musculus
taaagctaccactgataactccccg

SEQ ID NO: 457709 - DNA, 25 bp, Mus musculus
taaagctagctctccaggtcagaaa

SEQ ID NO: 457710 - DNA, 25 bp, Mus musculus
taaagctagtagtccattcaccagg

SEQ ID NO: 457711 - DNA, 25 bp, Mus musculus
taaagctccggatctacttcctgga

SEQ ID NO: 457712 - DNA, 25 bp, Mus musculus
taaagctcggatttatcgcccaagg

SEQ ID NO: 457713 - DNA, 25 bp, Mus musculus
taaagctcggtactgccatctagga

SEQ ID NO: 457714 - DNA, 25 bp, Mus musculus
taaagctctgaagtgaaggcccatg

SEQ ID NO: 457715 - DNA, 25 bp, Mus musculus
taaagctctgctcccaaggaatgca

SEQ ID NO: 457716 - DNA, 25 bp, Mus musculus
taaagctgaagacacttggacccat

SEQ ID NO: 457717 - DNA, 25 bp, Mus musculus
taaagctgcctaaaaagactctgtc

SEQ ID NO: 457718 - DNA, 25 bp, Mus musculus
taaagctgctcggagtggacttcgg

SEQ ID NO: 457719 - DNA, 25 bp, Mus musculus
taaagctggaaggatcaacctggtc

SEQ ID NO: 457720 - DNA, 25 bp, Mus musculus
taaagctggcccttggaactacaat

SEQ ID NO: 457721 - DNA, 25 bp, Mus musculus
taaagctggcgtatcctcctggatg

SEQ ID NO: 457722 - DNA, 25 bp, Mus musculus
taaagctggctgacatcaacgggcc

SEQ ID NO: 457723 - DNA, 25 bp, Mus musculus
taaagctggttacggcaaatgcacg

SEQ ID NO: 457724 - DNA, 25 bp, Mus musculus
taaagctggttgactccggaagcgt

SEQ ID NO: 457725 - DNA, 25 bp, Mus musculus
taaagctgtccctgaagtgtgtcgc

SEQ ID NO: 457726 - DNA, 25 bp, Mus musculus
taaagctgtcgttgactggccacat

SEQ ID NO: 457727 - DNA, 25 bp, Mus musculus
taaagctgtggcaaggagtgacgcc

SEQ ID NO: 457728 - DNA, 25 bp, Mus musculus
taaagcttaacttattcagtagagc

SEQ ID NO: 457729 - DNA, 25 bp, Mus musculus
taaagcttaatgacctgatccaacg

SEQ ID NO: 457730 - DNA, 25 bp, Mus musculus
taaagcttacccagcagtaggtgcc

SEQ ID NO: 457731 - DNA, 25 bp, Mus musculus
taaagcttgagtttggccacagacg

SEQ ID NO: 457732 - DNA, 25 bp, Mus musculus
taaagcttgctgacctgaagtgaac

SEQ ID NO: 457733 - DNA, 25 bp, Mus musculus
taaagcttggcaacccaacagaccg

SEQ ID NO: 457734 - DNA, 25 bp, Mus musculus
taaaggaaacagcagtgaatggccc

SEQ ID NO: 457735 - DNA, 25 bp, Mus musculus
taaaggaaccttcagcagcagtcac

SEQ ID NO: 457736 - DNA, 25 bp, Mus musculus
taaaggaactgggtacaagcccctg

SEQ ID NO: 457737 - DNA, 25 bp, Mus musculus
taaaggaagacttaggccagcgctt

SEQ ID NO: 457738 - DNA, 25 bp, Mus musculus
taaaggaagtgaccagtctgcagct

SEQ ID NO: 457739 - DNA, 25 bp, Mus musculus
taaaggaagtggatgccctgaacca

SEQ ID NO: 457740 - DNA, 25 bp, Mus musculus
taaaggaatattactacaccaggaa

SEQ ID NO: 457741 - DNA, 25 bp, Mus musculus
taaaggaatcacttcataaaggagt

SEQ ID NO: 457742 - DNA, 25 bp, Mus musculus
taaaggaattctttgccaaggcccg

SEQ ID NO: 457743 - DNA, 25 bp, Mus musculus
taaaggacaacgtggactactgggt

SEQ ID NO: 457744 - DNA, 25 bp, Mus musculus
taaaggacaagtcaccacaggacag

SEQ ID NO: 457745 - DNA, 25 bp, Mus musculus
taaaggacaccttgggacgagaggc

SEQ ID NO: 457746 - DNA, 25 bp, Mus musculus
taaaggaccgctggaggatatttat

SEQ ID NO: 457747 - DNA, 25 bp, Mus musculus
taaaggacgagcttcagctctgcgg

SEQ ID NO: 457748 - DNA, 25 bp, Mus musculus
taaaggacgtgtgttggccgtatgc

SEQ ID NO: 457749 - DNA, 25 bp, Mus musculus
taaaggacttcactggtgaggacag

SEQ ID NO: 457750 - DNA, 25 bp, Mus musculus
taaaggacttcgcagtgacgtcagg

SEQ ID NO: 457751 - DNA, 25 bp, Mus musculus
taaaggagacgttaagtggcctggc

SEQ ID NO: 457752 - DNA, 25 bp, Mus musculus
taaaggagctacagcaggtccgaga

SEQ ID NO: 457753 - DNA, 25 bp, Mus musculus
taaaggagtggctgaatggttttgg

SEQ ID NO: 457754 - DNA, 25 bp, Mus musculus
taaaggagttacacacaccaggcct

SEQ ID NO: 457755 - DNA, 25 bp, Mus musculus
taaaggatccgtttgtgaaggccgc

SEQ ID NO: 457756 - DNA, 25 bp, Mus musculus
taaaggatctcaaggtcatactggg

SEQ ID NO: 457757 - DNA, 25 bp, Mus musculus
taaaggatgatgaaagaaggcagag

SEQ ID NO: 457758 - DNA, 25 bp, Mus musculus
taaaggatgtgtgggctcactgccg

SEQ ID NO: 457759 - DNA, 25 bp, Mus musculus
taaaggattttaaggccctgccaca

SEQ ID NO: 457760 - DNA, 25 bp, Mus musculus
taaaggcaaacgaaaacgctgtgtc

SEQ ID NO: 457761 - DNA, 25 bp, Mus musculus
taaaggcaaagttctcctgagtaaa

SEQ ID NO: 457762 - DNA, 25 bp, Mus musculus
taaaggcaaatgcttccacagcagg

SEQ ID NO: 457763 - DNA, 25 bp, Mus musculus
taaaggcaagccacggaacagaaga

SEQ ID NO: 457764 - DNA, 25 bp, Mus musculus
taaaggcacctaccatactgagaga

SEQ ID NO: 457765 - DNA, 25 bp, Mus musculus
taaaggcagaagtacacaccagagc

SEQ ID NO: 457766 - DNA, 25 bp, Mus musculus
taaaggcagggctttctgaaagcag

SEQ ID NO: 457767 - DNA, 25 bp, Mus musculus
taaaggcagttggtagtcctggcca

SEQ ID NO: 457768 - DNA, 25 bp, Mus musculus
taaaggcatcctgctgaatgagtac

SEQ ID NO: 457769 - DNA, 25 bp, Mus musculus
taaaggcatgcattaactcaatggc

SEQ ID NO: 457770 - DNA, 25 bp, Mus musculus
taaaggcattactgagactcaaggt

SEQ ID NO: 457771 - DNA, 25 bp, Mus musculus
taaaggccaaccctgtggcagactc

SEQ ID NO: 457772 - DNA, 25 bp, Mus musculus
taaaggccactagggtttccagatc

SEQ ID NO: 457773 - DNA, 25 bp, Mus musculus
taaaggcccctctacttgcaaggag

SEQ ID NO: 457774 - DNA, 25 bp, Mus musculus
taaaggccgtaagacataagagttc

SEQ ID NO: 457775 - DNA, 25 bp, Mus musculus
taaaggccgttaagccagttggaga

SEQ ID NO: 457776 - DNA, 25 bp, Mus musculus
taaaggcctctactctgatactcgg

SEQ ID NO: 457777 - DNA, 25 bp, Mus musculus
taaaggccttggtgaaggcagaccc

SEQ ID NO: 457778 - DNA, 25 bp, Mus musculus
taaaggcgagtcactgttcatgggc

SEQ ID NO: 457779 - DNA, 25 bp, Mus musculus
taaaggcgatggacataacaggagc

SEQ ID NO: 457780 - DNA, 25 bp, Mus musculus
taaaggcgggcaagagcctgaagcc

SEQ ID NO: 457781 - DNA, 25 bp, Mus musculus
taaaggcgtgcggttaggccagcac

SEQ ID NO: 457782 - DNA, 25 bp, Mus musculus
taaaggctattaaaggtcacgtgaa

SEQ ID NO: 457783 - DNA, 25 bp, Mus musculus
taaaggctcctcaaccataaggccg

SEQ ID NO: 457784 - DNA, 25 bp, Mus musculus
taaaggctccttgtcgagatgggct

SEQ ID NO: 457785 - DNA, 25 bp, Mus musculus
taaaggcttcccaagcaagagagcc

SEQ ID NO: 457786 - DNA, 25 bp, Mus musculus
taaaggcttcttcgtaggcaacatc

SEQ ID NO: 457787 - DNA, 25 bp, Mus musculus
taaaggcttgtcaaacccatgcagt

SEQ ID NO: 457788 - DNA, 25 bp, Mus musculus
taaaggcttgtcagtgcatctcacc

SEQ ID NO: 457789 - DNA, 25 bp, Mus musculus
taaaggctttttcagtagagtccgg

SEQ ID NO: 457790 - DNA, 25 bp, Mus musculus
taaagggaaagacttctttctgcag

SEQ ID NO: 457791 - DNA, 25 bp, Mus musculus
taaagggaacgctgagatgcacact

SEQ ID NO: 457792 - DNA, 25 bp, Mus musculus
taaagggaatggcttactcaatggc

SEQ ID NO: 457793 - DNA, 25 bp, Mus musculus
taaagggacatcgagagtcaagagt

SEQ ID NO: 457794 - DNA, 25 bp, Mus musculus
taaagggacgctgaaggcatcctcg

SEQ ID NO: 457795 - DNA, 25 bp, Mus musculus
taaagggacttgtagcagagaacct

SEQ ID NO: 457796 - DNA, 25 bp, Mus musculus
taaagggagctatccagatcacctg

SEQ ID NO: 457797 - DNA, 25 bp, Mus musculus
taaagggatactgccaatctgccca

SEQ ID NO: 457798 - DNA, 25 bp, Mus musculus
taaagggattatgtgcctgccaagc

SEQ ID NO: 457799 - DNA, 25 bp, Mus musculus
taaagggattcgtgccagtactgct

SEQ ID NO: 457800 - DNA, 25 bp, Mus musculus
taaagggcacaactacggaacatct

SEQ ID NO: 457801 - DNA, 25 bp, Mus musculus
taaagggcacactcactggtcgttg

SEQ ID NO: 457802 - DNA, 25 bp, Mus musculus
taaagggccaccttgtgggtcaggt

SEQ ID NO: 457803 - DNA, 25 bp, Mus musculus
taaagggccagagcaaaaactccac

SEQ ID NO: 457804 - DNA, 25 bp, Mus musculus
taaagggccaggtagcaaccagatg

SEQ ID NO: 457805 - DNA, 25 bp, Mus musculus
taaagggctcaaaacaaggcacagg

SEQ ID NO: 457806 - DNA, 25 bp, Mus musculus
taaagggctgcacacctttggtctc

SEQ ID NO: 457807 - DNA, 25 bp, Mus musculus
taaagggggtatagtctaatgatgc

SEQ ID NO: 457808 - DNA, 25 bp, Mus musculus
taaagggtaaagatttcctgctggc

SEQ ID NO: 457809 - DNA, 25 bp, Mus musculus
taaagggtagcaccttgcctccatg

SEQ ID NO: 457810 - DNA, 25 bp, Mus musculus
taaagggtctaatgccaggaacagc

SEQ ID NO: 457811 - DNA, 25 bp, Mus musculus
taaagggtgcaacttcgtgctgaag

SEQ ID NO: 457812 - DNA, 25 bp, Mus musculus
taaagggtgcacctgtaataggaca

SEQ ID NO: 457813 - DNA, 25 bp, Mus musculus
taaagggttcccacaactgcctgga

SEQ ID NO: 457814 - DNA, 25 bp, Mus musculus
taaagggttctgcatgtccacactc

SEQ ID NO: 457815 - DNA, 25 bp, Mus musculus
taaagggttgtcttagtcctcagcc

SEQ ID NO: 457816 - DNA, 25 bp, Mus musculus
taaaggtaaacagccttggtccgca

SEQ ID NO: 457817 - DNA, 25 bp, Mus musculus
taaaggtacccgatcatgtcagaga

SEQ ID NO: 457818 - DNA, 25 bp, Mus musculus
taaaggtagaaacggccatatgagc

SEQ ID NO: 457819 - DNA, 25 bp, Mus musculus
taaaggtagtgttcaatgatggcag

SEQ ID NO: 457820 - DNA, 25 bp, Mus musculus
taaaggtcacgtgaagacgctttgc

SEQ ID NO: 457821 - DNA, 25 bp, Mus musculus
taaaggtccaggctcttcagcagta

SEQ ID NO: 457822 - DNA, 25 bp, Mus musculus
taaaggtcgcgtgtgtatcgagcag

SEQ ID NO: 457823 - DNA, 25 bp, Mus musculus
taaaggtctatgaggaccccaaccg

SEQ ID NO: 457824 - DNA, 25 bp, Mus musculus
taaaggtcttcaactcagccagcta

SEQ ID NO: 457825 - DNA, 25 bp, Mus musculus
taaaggtcttgaagctgaggcaacc

SEQ ID NO: 457826 - DNA, 25 bp, Mus musculus
taaaggtgacttggatcctggctgc

SEQ ID NO: 457827 - DNA, 25 bp, Mus musculus
taaaggtgcactatcggcttaccgc

SEQ ID NO: 457828 - DNA, 25 bp, Mus musculus
taaaggtgccacagaatacatacag

SEQ ID NO: 457829 - DNA, 25 bp, Mus musculus
taaaggtgcgtacaattctcctcct

SEQ ID NO: 457830 - DNA, 25 bp, Mus musculus
taaaggtgctggtgcgtgacgacca

SEQ ID NO: 457831 - DNA, 25 bp, Mus musculus
taaaggtggtgcaactcttccgaga

SEQ ID NO: 457832 - DNA, 25 bp, Mus musculus
taaaggtggtggaatgctcacggtc

SEQ ID NO: 457833 - DNA, 25 bp, Mus musculus
taaaggtgtcaattaccgtgagcac

SEQ ID NO: 457834 - DNA, 25 bp, Mus musculus
taaaggttcctcctgacttcaagag

SEQ ID NO: 457835 - DNA, 25 bp, Mus musculus
taaaggttcgagtctgggtgccagc

SEQ ID NO: 457836 - DNA, 25 bp, Mus musculus
taaaggttctctgtagccaagtctg

SEQ ID NO: 457837 - DNA, 25 bp, Mus musculus
taaaggttgacttgccctacggcgc

SEQ ID NO: 457838 - DNA, 25 bp, Mus musculus
taaaggttggtctgggaagtctgtc

SEQ ID NO: 457839 - DNA, 25 bp, Mus musculus
taaaggtttggaatctgagcagggt

SEQ ID NO: 457840 - DNA, 25 bp, Mus musculus
taaaggttttgccaaggacgcagct

SEQ ID NO: 457841 - DNA, 25 bp, Mus musculus
taaagtaagttggagcggattgaag

SEQ ID NO: 457842 - DNA, 25 bp, Mus musculus
taaagtacaacatcctcccagtggc

SEQ ID NO: 457843 - DNA, 25 bp, Mus musculus
taaagtacagtgagctatgctgcag

SEQ ID NO: 457844 - DNA, 25 bp, Mus musculus
taaagtaccctgactttggcttcag

SEQ ID NO: 457845 - DNA, 25 bp, Mus musculus
taaagtacttggtgtctcgtgcaat

SEQ ID NO: 457846 - DNA, 25 bp, Mus musculus
taaagtagcctgtgcacagatggcg

SEQ ID NO: 457847 - DNA, 25 bp, Mus musculus
taaagtatggttttcactgactctg

SEQ ID NO: 457848 - DNA, 25 bp, Mus musculus
taaagtatgttctcagtatcctgcc

SEQ ID NO: 457849 - DNA, 25 bp, Mus musculus
taaagtcaaatggacatgtgcccgg

SEQ ID NO: 457850 - DNA, 25 bp, Mus musculus
taaagtcaatgtacttctgcagcac

SEQ ID NO: 457851 - DNA, 25 bp, Mus musculus
taaagtcagaagactgcttgagacc

SEQ ID NO: 457852 - DNA, 25 bp, Mus musculus
taaagtcagactcgtgtctgcgaag

SEQ ID NO: 457853 - DNA, 25 bp, Mus musculus
taaagtcagcggacaacctggtgtc

SEQ ID NO: 457854 - DNA, 25 bp, Mus musculus
taaagtcagggctcacaatgaaagc

SEQ ID NO: 457855 - DNA, 25 bp, Mus musculus
taaagtcattcagagcctcagagga

SEQ ID NO: 457856 - DNA, 25 bp, Mus musculus
taaagtccaacctgctctcgggaag

SEQ ID NO: 457857 - DNA, 25 bp, Mus musculus
taaagtccaccaggaaaatgccctt

SEQ ID NO: 457858 - DNA, 25 bp, Mus musculus
taaagtccactccatgtagccacag

SEQ ID NO: 457859 - DNA, 25 bp, Mus musculus
taaagtccagaagaggcgagtccaa

SEQ ID NO: 457860 - DNA, 25 bp, Mus musculus
taaagtcccggctgaagtgaacgct

SEQ ID NO: 457861 - DNA, 25 bp, Mus musculus
taaagtccctttctgcccgatggtg

SEQ ID NO: 457862 - DNA, 25 bp, Mus musculus
taaagtccggttacaccttgccaga

SEQ ID NO: 457863 - DNA, 25 bp, Mus musculus
taaagtcctcatgctccggtaaccg

SEQ ID NO: 457864 - DNA, 25 bp, Mus musculus
taaagtccttattctcacttacatg

SEQ ID NO: 457865 - DNA, 25 bp, Mus musculus
taaagtcgatgatgttgttgtaatc

SEQ ID NO: 457866 - DNA, 25 bp, Mus musculus
taaagtcgctaatatttggtgcagc

SEQ ID NO: 457867 - DNA, 25 bp, Mus musculus
taaagtcgctgctatccggaagtca

SEQ ID NO: 457868 - DNA, 25 bp, Mus musculus
taaagtcggtcgtgcatcgcttcct

SEQ ID NO: 457869 - DNA, 25 bp, Mus musculus
taaagtcggttctcgttcatagcaa

SEQ ID NO: 457870 - DNA, 25 bp, Mus musculus
taaagtcgtagaaacccgatgcaac

SEQ ID NO: 457871 - DNA, 25 bp, Mus musculus
taaagtcgtctatagcatcctgcag

SEQ ID NO: 457872 - DNA, 25 bp, Mus musculus
taaagtctaagagtggaggaagaac

SEQ ID NO: 457873 - DNA, 25 bp, Mus musculus
taaagtctaccgagctgtgcggcac

SEQ ID NO: 457874 - DNA, 25 bp, Mus musculus
taaagtctccaggagctgaagtcgg

SEQ ID NO: 457875 - DNA, 25 bp, Mus musculus
taaagtctcctgaccacagcaaagg

SEQ ID NO: 457876 - DNA, 25 bp, Mus musculus
taaagtctgcttcatttgcatacag

SEQ ID NO: 457877 - DNA, 25 bp, Mus musculus
taaagtctgcttgagcgtatagcgc

SEQ ID NO: 457878 - DNA, 25 bp, Mus musculus
taaagtcttttctgctacaatgggt

SEQ ID NO: 457879 - DNA, 25 bp, Mus musculus
taaagtgaaaagcagggccctcaag

SEQ ID NO: 457880 - DNA, 25 bp, Mus musculus
taaagtgaagctttcggatcccggg

SEQ ID NO: 457881 - DNA, 25 bp, Mus musculus
taaagtgaccagtggcaaatgggaa

SEQ ID NO: 457882 - DNA, 25 bp, Mus musculus
taaagtgacctcgatctagtaccag

SEQ ID NO: 457883 - DNA, 25 bp, Mus musculus
taaagtgactcagtgcaggcaggcc

SEQ ID NO: 457884 - DNA, 25 bp, Mus musculus
taaagtgagcacattcgagaagcca

SEQ ID NO: 457885 - DNA, 25 bp, Mus musculus
taaagtgagtgattcctggctgaca

SEQ ID NO: 457886 - DNA, 25 bp, Mus musculus
taaagtgcaatcatggaagggctcc

SEQ ID NO: 457887 - DNA, 25 bp, Mus musculus
taaagtgcataatgctgacgccgcc

SEQ ID NO: 457888 - DNA, 25 bp, Mus musculus
taaagtgcccgagctgatcagaacc

SEQ ID NO: 457889 - DNA, 25 bp, Mus musculus
taaagtgccctatccgaggagatgg

SEQ ID NO: 457890 - DNA, 25 bp, Mus musculus
taaagtgcctagtgttctatgggag

SEQ ID NO: 457891 - DNA, 25 bp, Mus musculus
taaagtgcgcatcttcggcctcaag

SEQ ID NO: 457892 - DNA, 25 bp, Mus musculus
taaagtgctcctggaaaaccgctcc

SEQ ID NO: 457893 - DNA, 25 bp, Mus musculus
taaagtgctttgcaggcctccaaga

SEQ ID NO: 457894 - DNA, 25 bp, Mus musculus
taaagtggaacagagatgccagacc

SEQ ID NO: 457895 - DNA, 25 bp, Mus musculus
taaagtggattacaaccggctaggc

SEQ ID NO: 457896 - DNA, 25 bp, Mus musculus
taaagtggcactacttcaaagggcc

SEQ ID NO: 457897 - DNA, 25 bp, Mus musculus
taaagtggccgaacatcaacaacaa

SEQ ID NO: 457898 - DNA, 25 bp, Mus musculus
taaagtggtcggtaggagagcatcc

SEQ ID NO: 457899 - DNA, 25 bp, Mus musculus
taaagtggttggattggatcagcag

SEQ ID NO: 457900 - DNA, 25 bp, Mus musculus
taaagtggtttcagtccccaaggag

SEQ ID NO: 457901 - DNA, 25 bp, Mus musculus
taaagtgtcctgactcttctccttg

SEQ ID NO: 457902 - DNA, 25 bp, Mus musculus
taaagtgttgcaacggcagaatcgc

SEQ ID NO: 457903 - DNA, 25 bp, Mus musculus
taaagtgtttgaccttcgctacaag

SEQ ID NO: 457904 - DNA, 25 bp, Mus musculus
taaagtgtttggcatccgcccaggc

SEQ ID NO: 457905 - DNA, 25 bp, Mus musculus
taaagttatcacaagctggtggcaa

SEQ ID NO: 457906 - DNA, 25 bp, Mus musculus
taaagttatgggaagcgcagccatg

SEQ ID NO: 457907 - DNA, 25 bp, Mus musculus
taaagttcacgcctggagctgttct

SEQ ID NO: 457908 - DNA, 25 bp, Mus musculus
taaagttccgcagtgacctctctcg

SEQ ID NO: 457909 - DNA, 25 bp, Mus musculus
taaagttcctccattccaagattgc

SEQ ID NO: 457910 - DNA, 25 bp, Mus musculus
taaagttcgaggctggcaagtctgc

SEQ ID NO: 457911 - DNA, 25 bp, Mus musculus
taaagttctaatacacaacgggtgg

SEQ ID NO: 457912 - DNA, 25 bp, Mus musculus
taaagttctgctgcctcctggtagt

SEQ ID NO: 457913 - DNA, 25 bp, Mus musculus
taaagttctgctggctccactggga

SEQ ID NO: 457914 - DNA, 25 bp, Mus musculus
taaagttcttgataatgaaaggcct

SEQ ID NO: 457915 - DNA, 25 bp, Mus musculus
taaagttgaaaatccgcagtcccct

SEQ ID NO: 457916 - DNA, 25 bp, Mus musculus
taaagttgatgccatgccaaaggac

SEQ ID NO: 457917 - DNA, 25 bp, Mus musculus
taaagttggaaaagtgagggtgcca

SEQ ID NO: 457918 - DNA, 25 bp, Mus musculus
taaagttgtcttggatacctctgaa

SEQ ID NO: 457919 - DNA, 25 bp, Mus musculus
taaagttgtggctcggatccgccct

SEQ ID NO: 457920 - DNA, 25 bp, Mus musculus
taaagtttcctcctgcttgtcgcaa

SEQ ID NO: 457921 - DNA, 25 bp, Mus musculus
taaagtttctcctctgatcttaaag

SEQ ID NO: 457922 - DNA, 25 bp, Mus musculus
taaagtttgcctgagaaagtctagg

SEQ ID NO: 457923 - DNA, 25 bp, Mus musculus
taaagtttgctcagcatctgggcag

SEQ ID NO: 457924 - DNA, 25 bp, Mus musculus
taaagtttgtatatgtgaatcagtg

SEQ ID NO: 457925 - DNA, 25 bp, Mus musculus
taaataaaacgtgcgatcagcagcc

SEQ ID NO: 457926 - DNA, 25 bp, Mus musculus
taaataaacagaccacctaaagtgg

SEQ ID NO: 457927 - DNA, 25 bp, Mus musculus
taaataaacattcagtgctcgcctt

SEQ ID NO: 457928 - DNA, 25 bp, Mus musculus
taaataaactttaagcaaacagaca

SEQ ID NO: 457929 - DNA, 25 bp, Mus musculus
taaataaagacatccgttcaagctc

SEQ ID NO: 457930 - DNA, 25 bp, Mus musculus
taaataaagagaagcctaaggaaga

SEQ ID NO: 457931 - DNA, 25 bp, Mus musculus
taaataaatgagcaggagtttccct

SEQ ID NO: 457932 - DNA, 25 bp, Mus musculus
taaataactggtccttgcccacaga

SEQ ID NO: 457933 - DNA, 25 bp, Mus musculus
taaataataaagagggaggccagtc

SEQ ID NO: 457934 - DNA, 25 bp, Mus musculus
taaataatgtacaggcccaggactg

SEQ ID NO: 457935 - DNA, 25 bp, Mus musculus
taaatacacggctcggtccaagtgc

SEQ ID NO: 457936 - DNA, 25 bp, Mus musculus
taaatacacttgtccgttagccttc

SEQ ID NO: 457937 - DNA, 25 bp, Mus musculus
taaatacatgagttctggccccgtg

SEQ ID NO: 457938 - DNA, 25 bp, Mus musculus
taaatacattgtgacctgtgtgatc

SEQ ID NO: 457939 - DNA, 25 bp, Mus musculus
taaataccaagagcgacttacctgg

SEQ ID NO: 457940 - DNA, 25 bp, Mus musculus
taaataccacgttagacctccaggc

SEQ ID NO: 457941 - DNA, 25 bp, Mus musculus
taaataccctgagactgtccagcag

SEQ ID NO: 457942 - DNA, 25 bp, Mus musculus
taaatacgccctgatgggagctgct

SEQ ID NO: 457943 - DNA, 25 bp, Mus musculus
taaatactaccagatattacgtgcc

SEQ ID NO: 457944 - DNA, 25 bp, Mus musculus
taaatactgacctgggaacagatct

SEQ ID NO: 457945 - DNA, 25 bp, Mus musculus
taaatactggttctgctaccgtact

SEQ ID NO: 457946 - DNA, 25 bp, Mus musculus
taaatacttctccaagctaggagcc

SEQ ID NO: 457947 - DNA, 25 bp, Mus musculus
taaatagccaagaaaagcatcaagg

SEQ ID NO: 457948 - DNA, 25 bp, Mus musculus
taaataggcgctttataaagatgga

SEQ ID NO: 457949 - DNA, 25 bp, Mus musculus
taaatagtagaccattcaccacgca

SEQ ID NO: 457950 - DNA, 25 bp, Mus musculus
taaatagtgatcctcgggactggtc

SEQ ID NO: 457951 - DNA, 25 bp, Mus musculus
taaatagttaatgcacggaaggtac

SEQ ID NO: 457952 - DNA, 25 bp, Mus musculus
taaatataagaaatggcgtgctccc

SEQ ID NO: 457953 - DNA, 25 bp, Mus musculus
taaatatacctctttgcttctcatg

SEQ ID NO: 457954 - DNA, 25 bp, Mus musculus
taaatatcacctgtgtggcagtggg

SEQ ID NO: 457955 - DNA, 25 bp, Mus musculus
taaatatgaaggaatggcaggacgg

SEQ ID NO: 457956 - DNA, 25 bp, Mus musculus
taaatatggcaggattatgctgctc

SEQ ID NO: 457957 - DNA, 25 bp, Mus musculus
taaatatggcgaagaatgccctgag

SEQ ID NO: 457958 - DNA, 25 bp, Mus musculus
taaatatggcgggagtaagagcttc

SEQ ID NO: 457959 - DNA, 25 bp, Mus musculus
taaatatgtacaaaggcacttcggg

SEQ ID NO: 457960 - DNA, 25 bp, Mus musculus
taaatatgtttgtttgtaaagacac

SEQ ID NO: 457961 - DNA, 25 bp, Mus musculus
taaatattgaaaactgctgtccacc

SEQ ID NO: 457962 - DNA, 25 bp, Mus musculus
taaatcaaatcaaccagctgccgca

SEQ ID NO: 457963 - DNA, 25 bp, Mus musculus
taaatcaacccgtgcctgaagcaga

SEQ ID NO: 457964 - DNA, 25 bp, Mus musculus
taaatcaagcttcatctaatgccct

SEQ ID NO: 457965 - DNA, 25 bp, Mus musculus
taaatcaatcaaataaaggtcttca

SEQ ID NO: 457966 - DNA, 25 bp, Mus musculus
taaatcaatgaagagtagggcttct

SEQ ID NO: 457967 - DNA, 25 bp, Mus musculus
taaatcaggaaggaacctagtcagg

SEQ ID NO: 457968 - DNA, 25 bp, Mus musculus
taaatcaggcatggttctaaggttc

SEQ ID NO: 457969 - DNA, 25 bp, Mus musculus
taaatcaggtaagtgtttccagatc

SEQ ID NO: 457970 - DNA, 25 bp, Mus musculus
taaatcagtgacgatccaggctccg

SEQ ID NO: 457971 - DNA, 25 bp, Mus musculus
taaatcagtgcagtaggtgagactc

SEQ ID NO: 457972 - DNA, 25 bp, Mus musculus
taaatcatctttgccacgaggaagc

SEQ ID NO: 457973 - DNA, 25 bp, Mus musculus
taaatcattgagacggagcagcctg

SEQ ID NO: 457974 - DNA, 25 bp, Mus musculus
taaatccaaaggatgtgatcagtgc

SEQ ID NO: 457975 - DNA, 25 bp, Mus musculus
taaatccaagatgccttactagcag

SEQ ID NO: 457976 - DNA, 25 bp, Mus musculus
taaatccacattcttggatgcctgg

SEQ ID NO: 457977 - DNA, 25 bp, Mus musculus
taaatccacttgacagagtgcccgt

SEQ ID NO: 457978 - DNA, 25 bp, Mus musculus
taaatccagagcaagctttgggctg

SEQ ID NO: 457979 - DNA, 25 bp, Mus musculus
taaatccagcctgtcagtcaggatg

SEQ ID NO: 457980 - DNA, 25 bp, Mus musculus
taaatccaggacgtggcaaggagct

SEQ ID NO: 457981 - DNA, 25 bp, Mus musculus
taaatccagtcaacagctggccccg

SEQ ID NO: 457982 - DNA, 25 bp, Mus musculus
taaatccagtgctaccaagtggtcc

SEQ ID NO: 457983 - DNA, 25 bp, Mus musculus
taaatccatcacattgccaaatagc

SEQ ID NO: 457984 - DNA, 25 bp, Mus musculus
taaatcccacgacctggcagtatca

SEQ ID NO: 457985 - DNA, 25 bp, Mus musculus
taaatcccagagctatgactgcaca

SEQ ID NO: 457986 - DNA, 25 bp, Mus musculus
taaatcccaggagaatgagctgcct

SEQ ID NO: 457987 - DNA, 25 bp, Mus musculus
taaatcccgccaactacgagaagct

SEQ ID NO: 457988 - DNA, 25 bp, Mus musculus
taaatccctgaggagtctgccctgc

SEQ ID NO: 457989 - DNA, 25 bp, Mus musculus
taaatccctgtaattgaggcgtgtc

SEQ ID NO: 457990 - DNA, 25 bp, Mus musculus
taaatccctgtgtttcgtgcccatg

SEQ ID NO: 457991 - DNA, 25 bp, Mus musculus
taaatccggaatctttgagcgtctg

SEQ ID NO: 457992 - DNA, 25 bp, Mus musculus
taaatccgtcaagctatgtgcagca

SEQ ID NO: 457993 - DNA, 25 bp, Mus musculus
taaatcctagcttggaagactctag

SEQ ID NO: 457994 - DNA, 25 bp, Mus musculus
taaatccttggaagatcttcccggc

SEQ ID NO: 457995 - DNA, 25 bp, Mus musculus
taaatcgcacaaacttttgggccgg

SEQ ID NO: 457996 - DNA, 25 bp, Mus musculus
taaatcggatccacagactgacttc

SEQ ID NO: 457997 - DNA, 25 bp, Mus musculus
taaatcggccttgtgaagaagtgct

SEQ ID NO: 457998 - DNA, 25 bp, Mus musculus
taaatcgggtactagttgcagctct

SEQ ID NO: 457999 - DNA, 25 bp, Mus musculus
taaatcgtcctattcagctgcaaca

SEQ ID NO: 458000 - DNA, 25 bp, Mus musculus
taaatctaagatgctcccagcaaag

SEQ ID NO: 458001 - DNA, 25 bp, Mus musculus
taaatctaaggtctgatggatgcca

SEQ ID NO: 458002 - DNA, 25 bp, Mus musculus
taaatctaggacagagtgccaggct

SEQ ID NO: 458003 - DNA, 25 bp, Mus musculus
taaatctagtcaagcaacccatccc

SEQ ID NO: 458004 - DNA, 25 bp, Mus musculus
taaatctccagctctgctattgctg

SEQ ID NO: 458005 - DNA, 25 bp, Mus musculus
taaatctccctagtcttgcctggca

SEQ ID NO: 458006 - DNA, 25 bp, Mus musculus
taaatctgaaacctgattctgctgg

SEQ ID NO: 458007 - DNA, 25 bp, Mus musculus
taaatctgaagagtcactcagggcc

SEQ ID NO: 458008 - DNA, 25 bp, Mus musculus
taaatctgccatggtcacaaagtcc

SEQ ID NO: 458009 - DNA, 25 bp, Mus musculus
taaatctggagcactagacgaggca

SEQ ID NO: 458010 - DNA, 25 bp, Mus musculus
taaatctgggctcggtcttcctgca

SEQ ID NO: 458011 - DNA, 25 bp, Mus musculus
taaatcttccatactgatagcccta

SEQ ID NO: 458012 - DNA, 25 bp, Mus musculus
taaatcttgccacgcggtcttcctg

SEQ ID NO: 458013 - DNA, 25 bp, Mus musculus
taaatcttggccagcttaggatgcg

SEQ ID NO: 458014 - DNA, 25 bp, Mus musculus
taaatcttgtggtgtaggaccaggc

SEQ ID NO: 458015 - DNA, 25 bp, Mus musculus
taaatcttgttttgacattagcagt

SEQ ID NO: 458016 - DNA, 25 bp, Mus musculus
taaatgaaacatcgctaagtgacta

SEQ ID NO: 458017 - DNA, 25 bp, Mus musculus
taaatgaagtcagactggcgaccag

SEQ ID NO: 458018 - DNA, 25 bp, Mus musculus
taaatgaattggtggatgccagaga

SEQ ID NO: 458019 - DNA, 25 bp, Mus musculus
taaatgacaagcaacagtgaagctg

SEQ ID NO: 458020 - DNA, 25 bp, Mus musculus
taaatgaccagccttactacccttc

SEQ ID NO: 458021 - DNA, 25 bp, Mus musculus
taaatgacgtctgattgccatgggc

SEQ ID NO: 458022 - DNA, 25 bp, Mus musculus
taaatgagacctttttcgttggcga

SEQ ID NO: 458023 - DNA, 25 bp, Mus musculus
taaatgagagaactgacctggcacc

SEQ ID NO: 458024 - DNA, 25 bp, Mus musculus
taaatgagctcaaactgtgcttccg

SEQ ID NO: 458025 - DNA, 25 bp, Mus musculus
taaatgaggcaagcaaccccaagat

SEQ ID NO: 458026 - DNA, 25 bp, Mus musculus
taaatgaggccaaacacctgggcat

SEQ ID NO: 458027 - DNA, 25 bp, Mus musculus
taaatgagtctgtcagtatcccggt

SEQ ID NO: 458028 - DNA, 25 bp, Mus musculus
taaatgatcgagttccgtgggctaa

SEQ ID NO: 458029 - DNA, 25 bp, Mus musculus
taaatgatgatgacgtgaccgggtc

SEQ ID NO: 458030 - DNA, 25 bp, Mus musculus
taaatgattctttgtgactcctggg

SEQ ID NO: 458031 - DNA, 25 bp, Mus musculus
taaatgattgtacaccagagacctg

SEQ ID NO: 458032 - DNA, 25 bp, Mus musculus
taaatgattgttaactctgcagacc

SEQ ID NO: 458033 - DNA, 25 bp, Mus musculus
taaatgcaaacaagtgctccctagc

SEQ ID NO: 458034 - DNA, 25 bp, Mus musculus
taaatgcaaccaccagagttacctc

SEQ ID NO: 458035 - DNA, 25 bp, Mus musculus
taaatgcaagcccagaacagaactg

SEQ ID NO: 458036 - DNA, 25 bp, Mus musculus
taaatgcaaggacgtcaaggacacc

SEQ ID NO: 458037 - DNA, 25 bp, Mus musculus
taaatgcaccgtgcgttccgcgtct

SEQ ID NO: 458038 - DNA, 25 bp, Mus musculus
taaatgcaggcttggcccactgtgg

SEQ ID NO: 458039 - DNA, 25 bp, Mus musculus
taaatgcagggttaatgccgaacct

SEQ ID NO: 458040 - DNA, 25 bp, Mus musculus
taaatgcagtgatacccttgaaggg

SEQ ID NO: 458041 - DNA, 25 bp, Mus musculus
taaatgcagtgtgcctcgtcatctg

SEQ ID NO: 458042 - DNA, 25 bp, Mus musculus
taaatgcatagtatctgacaaccca

SEQ ID NO: 458043 - DNA, 25 bp, Mus musculus
taaatgcatcagataaaaaccacag

SEQ ID NO: 458044 - DNA, 25 bp, Mus musculus
taaatgccagcgttgaggccctagc

SEQ ID NO: 458045 - DNA, 25 bp, Mus musculus
taaatgccagctgtgccgatctgcc

SEQ ID NO: 458046 - DNA, 25 bp, Mus musculus
taaatgccagtcgtgacgaaattcg

SEQ ID NO: 458047 - DNA, 25 bp, Mus musculus
taaatgccatgtcatcccaagctgc

SEQ ID NO: 458048 - DNA, 25 bp, Mus musculus
taaatgcccacaaatgagaatgtgg

SEQ ID NO: 458049 - DNA, 25 bp, Mus musculus
taaatgcccgacttgatgcagtatc

SEQ ID NO: 458050 - DNA, 25 bp, Mus musculus
taaatgccgctgtcaaattctaagg

SEQ ID NO: 458051 - DNA, 25 bp, Mus musculus
taaatgcctgctatgatggtgacac

SEQ ID NO: 458052 - DNA, 25 bp, Mus musculus
taaatgcgagctactcctctggagt

SEQ ID NO: 458053 - DNA, 25 bp, Mus musculus
taaatgcgctgtgagggtgacctct

SEQ ID NO: 458054 - DNA, 25 bp, Mus musculus
taaatgctacagacccgcacaggaa

SEQ ID NO: 458055 - DNA, 25 bp, Mus musculus
taaatgctaccataactccttagag

SEQ ID NO: 458056 - DNA, 25 bp, Mus musculus
taaatgctacgccatgtccaaggat

SEQ ID NO: 458057 - DNA, 25 bp, Mus musculus
taaatgctactgaaacttgcctgag

SEQ ID NO: 458058 - DNA, 25 bp, Mus musculus
taaatgctcagcaaaagttgagacg

SEQ ID NO: 458059 - DNA, 25 bp, Mus musculus
taaatgctcctgatactctctgcga

SEQ ID NO: 458060 - DNA, 25 bp, Mus musculus
taaatgctcggctccttgcagacaa

SEQ ID NO: 458061 - DNA, 25 bp, Mus musculus
taaatgctgctaaaccccaagaggc

SEQ ID NO: 458062 - DNA, 25 bp, Mus musculus
taaatgctgtttatgaagatggacc

SEQ ID NO: 458063 - DNA, 25 bp, Mus musculus
taaatgcttaccgtgtgacccttgg

SEQ ID NO: 458064 - DNA, 25 bp, Mus musculus
taaatgctttagaactacctggccc

SEQ ID NO: 458065 - DNA, 25 bp, Mus musculus
taaatggaaagaatatgggacaccc

SEQ ID NO: 458066 - DNA, 25 bp, Mus musculus
taaatggaactaaatgctcttgcaa

SEQ ID NO: 458067 - DNA, 25 bp, Mus musculus
taaatggacacctccttggacgaca

SEQ ID NO: 458068 - DNA, 25 bp, Mus musculus
taaatggcagaacgttgaacagtcc

SEQ ID NO: 458069 - DNA, 25 bp, Mus musculus
taaatggcagctcattgaaaccaat

SEQ ID NO: 458070 - DNA, 25 bp, Mus musculus
taaatggcagtgtcccagtgagcca

SEQ ID NO: 458071 - DNA, 25 bp, Mus musculus
taaatggcgaaactcgtgaagcggc

SEQ ID NO: 458072 - DNA, 25 bp, Mus musculus
taaatggcgtgtgcgtagaatcgag

SEQ ID NO: 458073 - DNA, 25 bp, Mus musculus
taaatggctacgtagtcatcaggcc

SEQ ID NO: 458074 - DNA, 25 bp, Mus musculus
taaatggctactttaaatcccaggg

SEQ ID NO: 458075 - DNA, 25 bp, Mus musculus
taaatggctctgtttctggaagcca

SEQ ID NO: 458076 - DNA, 25 bp, Mus musculus
taaatgggaatctcatccaggagtc

SEQ ID NO: 458077 - DNA, 25 bp, Mus musculus
taaatgggagagtagccatcaggtc

SEQ ID NO: 458078 - DNA, 25 bp, Mus musculus
taaatgggcaacaggaagagtcaac

SEQ ID NO: 458079 - DNA, 25 bp, Mus musculus
taaatgggtacgaccggaagatctc

SEQ ID NO: 458080 - DNA, 25 bp, Mus musculus
taaatggtaggtctggaattcctct

SEQ ID NO: 458081 - DNA, 25 bp, Mus musculus
taaatggtcacctacacggcttagt

SEQ ID NO: 458082 - DNA, 25 bp, Mus musculus
taaatggtcagttagggtctacgca

SEQ ID NO: 458083 - DNA, 25 bp, Mus musculus
taaatggtcgggtacagattctcac

SEQ ID NO: 458084 - DNA, 25 bp, Mus musculus
taaatggtgcctgtccctgagacca

SEQ ID NO: 458085 - DNA, 25 bp, Mus musculus
taaatgtaatgcgtgtggaagagcc

SEQ ID NO: 458086 - DNA, 25 bp, Mus musculus
taaatgtattcgttcccaccagcag

SEQ ID NO: 458087 - DNA, 25 bp, Mus musculus
taaatgtcaaagagaactcgcgggc

SEQ ID NO: 458088 - DNA, 25 bp, Mus musculus
taaatgtcccaaggagcaggatcgc

SEQ ID NO: 458089 - DNA, 25 bp, Mus musculus
taaatgtcctctgacgagccacctg

SEQ ID NO: 458090 - DNA, 25 bp, Mus musculus
taaatgtcctgaagcatcccaagtg

SEQ ID NO: 458091 - DNA, 25 bp, Mus musculus
taaatgtcctgagttcggaagtcat

SEQ ID NO: 458092 - DNA, 25 bp, Mus musculus
taaatgtctttgctgcgtgaccacg

SEQ ID NO: 458093 - DNA, 25 bp, Mus musculus
taaatgtgagccgatcctacagtgg

SEQ ID NO: 458094 - DNA, 25 bp, Mus musculus
taaatgtgatacaagcctggaggag

SEQ ID NO: 458095 - DNA, 25 bp, Mus musculus
taaatgtgcttcgtgtgggcccaaa

SEQ ID NO: 458096 - DNA, 25 bp, Mus musculus
taaatgtggatgacaatgactggga

SEQ ID NO: 458097 - DNA, 25 bp, Mus musculus
taaatgtggtgttagtcgttctggg

SEQ ID NO: 458098 - DNA, 25 bp, Mus musculus
taaatgtgtcaaccgccaaactcgg

SEQ ID NO: 458099 - DNA, 25 bp, Mus musculus
taaatgtgtccctcttgtccgagaa

SEQ ID NO: 458100 - DNA, 25 bp, Mus musculus
taaatgtgtcgtctgatgcggccta

SEQ ID NO: 458101 - DNA, 25 bp, Mus musculus
taaatgttaggtgttaggcatctgc

SEQ ID NO: 458102 - DNA, 25 bp, Mus musculus
taaatgttcatgactgaccaatggc

SEQ ID NO: 458103 - DNA, 25 bp, Mus musculus
taaatgttggttgatggaacggtcc

SEQ ID NO: 458104 - DNA, 25 bp, Mus musculus
taaatgttgtatcctaaagacccac

SEQ ID NO: 458105 - DNA, 25 bp, Mus musculus
taaatgttgtgtgtgccgcagtgca

SEQ ID NO: 458106 - DNA, 25 bp, Mus musculus
taaattaacactgcctggagtcacg

SEQ ID NO: 458107 - DNA, 25 bp, Mus musculus
taaattaattcacttgaccgcgggt

SEQ ID NO: 458108 - DNA, 25 bp, Mus musculus
taaattaattggtaaatatccatga

SEQ ID NO: 458109 - DNA, 25 bp, Mus musculus
taaattacaccaagactgcgggagg

SEQ ID NO: 458110 - DNA, 25 bp, Mus musculus
taaattacgcttccaaatgaaacag

SEQ ID NO: 458111 - DNA, 25 bp, Mus musculus
taaattagaaaccaccatacatatg

SEQ ID NO: 458112 - DNA, 25 bp, Mus musculus
taaattaggacaggaactaggccgg

SEQ ID NO: 458113 - DNA, 25 bp, Mus musculus
taaattaggcattcgaggctccaac

SEQ ID NO: 458114 - DNA, 25 bp, Mus musculus
taaattagggtcactcttccaggag

SEQ ID NO: 458115 - DNA, 25 bp, Mus musculus
taaattattggaacagtttgggctg

SEQ ID NO: 458116 - DNA, 25 bp, Mus musculus
taaattattggtccgactggtccga

SEQ ID NO: 458117 - DNA, 25 bp, Mus musculus
taaattcatgcactacacctggctg

SEQ ID NO: 458118 - DNA, 25 bp, Mus musculus
taaattcctagcaaagtgccgtaag

SEQ ID NO: 458119 - DNA, 25 bp, Mus musculus
taaattcctggtgcttgtgccgaag

SEQ ID NO: 458120 - DNA, 25 bp, Mus musculus
taaattcctttttgtcctgctgtgg

SEQ ID NO: 458121 - DNA, 25 bp, Mus musculus
taaattcgacatgatccagggactg

SEQ ID NO: 458122 - DNA, 25 bp, Mus musculus
taaattcgttgggacactaaatgag

SEQ ID NO: 458123 - DNA, 25 bp, Mus musculus
taaattctagcaggctcagacgcaa

SEQ ID NO: 458124 - DNA, 25 bp, Mus musculus
taaattctggctttgagtgacatcc

SEQ ID NO: 458125 - DNA, 25 bp, Mus musculus
taaattctgggcttacgctgactat

SEQ ID NO: 458126 - DNA, 25 bp, Mus musculus
taaattctgtgaccctgtaggccag

SEQ ID NO: 458127 - DNA, 25 bp, Mus musculus
taaattcttcagctttccagggaac

SEQ ID NO: 458128 - DNA, 25 bp, Mus musculus
taaattgagaagtcgatgtgggcac

SEQ ID NO: 458129 - DNA, 25 bp, Mus musculus
taaattgagcacgtttaccttggcc

SEQ ID NO: 458130 - DNA, 25 bp, Mus musculus
taaattgcagttcgtagttccttgc

SEQ ID NO: 458131 - DNA, 25 bp, Mus musculus
taaattgccaaacctcagccagtcg

SEQ ID NO: 458132 - DNA, 25 bp, Mus musculus
taaattgccaggcaccgtagcatgc

SEQ ID NO: 458133 - DNA, 25 bp, Mus musculus
taaattgcctcatccagttcgaaga

SEQ ID NO: 458134 - DNA, 25 bp, Mus musculus
taaattgcgatacgccaacaacagc

SEQ ID NO: 458135 - DNA, 25 bp, Mus musculus
taaattgctcaaaaatgctccccgc

SEQ ID NO: 458136 - DNA, 25 bp, Mus musculus
taaattggaaggatgcacgaatccc

SEQ ID NO: 458137 - DNA, 25 bp, Mus musculus
taaattgggcaactctggagctcca

SEQ ID NO: 458138 - DNA, 25 bp, Mus musculus
taaattggtccaagcacaaaggcca

SEQ ID NO: 458139 - DNA, 25 bp, Mus musculus
taaattgtacttctacttcaaagac

SEQ ID NO: 458140 - DNA, 25 bp, Mus musculus
taaattgtcttctaccctctgtagg

SEQ ID NO: 458141 - DNA, 25 bp, Mus musculus
taaattgttctatccagaccttggg

SEQ ID NO: 458142 - DNA, 25 bp, Mus musculus
taaattgttgagttcttccccatcc

SEQ ID NO: 458143 - DNA, 25 bp, Mus musculus
taaatttatcaaccagcgcgagaag

SEQ ID NO: 458144 - DNA, 25 bp, Mus musculus
taaatttcaaatggagctactagca

SEQ ID NO: 458145 - DNA, 25 bp, Mus musculus
taaatttcagttcagggcatgacct

SEQ ID NO: 458146 - DNA, 25 bp, Mus musculus
taaatttcctgtactcgtagccagg

SEQ ID NO: 458147 - DNA, 25 bp, Mus musculus
taaatttctgtagcactgtggaaga

SEQ ID NO: 458148 - DNA, 25 bp, Mus musculus
taaatttgcacggagaaacacctga

SEQ ID NO: 458149 - DNA, 25 bp, Mus musculus
taaatttgctaagagccgagggcgg

SEQ ID NO: 458150 - DNA, 25 bp, Mus musculus
taaattttaatacgagtgtgcaggc

SEQ ID NO: 458151 - DNA, 25 bp, Mus musculus
taaattttagtcatctccagggcta

SEQ ID NO: 458152 - DNA, 25 bp, Mus musculus
taaattttatctacaagaaagctag

SEQ ID NO: 458153 - DNA, 25 bp, Mus musculus
taaattttcagaaggacctcctgag

SEQ ID NO: 458154 - DNA, 25 bp, Mus musculus
taaatttttacagggagccacagcg

SEQ ID NO: 458155 - DNA, 25 bp, Mus musculus
taacaaaacagggtagcaaggagca

SEQ ID NO: 458156 - DNA, 25 bp, Mus musculus
taacaaaagggactccgcatatagc

SEQ ID NO: 458157 - DNA, 25 bp, Mus musculus
taacaaaccccgtgtgtggagactc

SEQ ID NO: 458158 - DNA, 25 bp, Mus musculus
taacaaaccctgtatgaaacgtagg

SEQ ID NO: 458159 - DNA, 25 bp, Mus musculus
taacaaagaggacaagcggcctcgc

SEQ ID NO: 458160 - DNA, 25 bp, Mus musculus
taacaaagcctatcggaaacccaga

SEQ ID NO: 458161 - DNA, 25 bp, Mus musculus
taacaaagctgagcacacgtctggg

SEQ ID NO: 458162 - DNA, 25 bp, Mus musculus
taacaaaggcaagaagcggcggaac

SEQ ID NO: 458163 - DNA, 25 bp, Mus musculus
taacaaaggcaggactccagctgga

SEQ ID NO: 458164 - DNA, 25 bp, Mus musculus
taacaaaggcatggagcatctctac

SEQ ID NO: 458165 - DNA, 25 bp, Mus musculus
taacaaagggctccagtctgagcac

SEQ ID NO: 458166 - DNA, 25 bp, Mus musculus
taacaaatagtgaactggaccggga

SEQ ID NO: 458167 - DNA, 25 bp, Mus musculus
taacaaatcagatcaaagtcagaag

SEQ ID NO: 458168 - DNA, 25 bp, Mus musculus
taacaaatccactagttcgagaagc

SEQ ID NO: 458169 - DNA, 25 bp, Mus musculus
taacaaatgccagaagtgccccaag

SEQ ID NO: 458170 - DNA, 25 bp, Mus musculus
taacaaatgctgtgatgcaaggacc

SEQ ID NO: 458171 - DNA, 25 bp, Mus musculus
taacaacaaaacaagagtgcccggt

SEQ ID NO: 458172 - DNA, 25 bp, Mus musculus
taacaacaaaagaggccagacacag

SEQ ID NO: 458173 - DNA, 25 bp, Mus musculus
taacaacaagagcagcgtagacctg

SEQ ID NO: 458174 - DNA, 25 bp, Mus musculus
taacaacacatagacttaaagcagt

SEQ ID NO: 458175 - DNA, 25 bp, Mus musculus
taacaacatgcctgtgacggcccgt

SEQ ID NO: 458176 - DNA, 25 bp, Mus musculus
taacaaccatgtccgtcttccaaga

SEQ ID NO: 458177 - DNA, 25 bp, Mus musculus
taacaacctcctgctgagagctgga

SEQ ID NO: 458178 - DNA, 25 bp, Mus musculus
taacaacctgattaagtagtcgctg

SEQ ID NO: 458179 - DNA, 25 bp, Mus musculus
taacaacgactacgaagatcctgag

SEQ ID NO: 458180 - DNA, 25 bp, Mus musculus
taacaacgctatttaagcagctcgg

SEQ ID NO: 458181 - DNA, 25 bp, Mus musculus
taacaacgctgctcttgctggtggc

SEQ ID NO: 458182 - DNA, 25 bp, Mus musculus
taacaacgtgggagaaaacatcttc

SEQ ID NO: 458183 - DNA, 25 bp, Mus musculus
taacaactatacgagcctgggactg

SEQ ID NO: 458184 - DNA, 25 bp, Mus musculus
taacaactatagctcgggtgggccc

SEQ ID NO: 458185 - DNA, 25 bp, Mus musculus
taacaactcgaagacttggaacaag

SEQ ID NO: 458186 - DNA, 25 bp, Mus musculus
taacaactctactaatgcggagctg

SEQ ID NO: 458187 - DNA, 25 bp, Mus musculus
taacaactgatattgctgtcccaac

SEQ ID NO: 458188 - DNA, 25 bp, Mus musculus
taacaactgtgaaccaccgtatggg

SEQ ID NO: 458189 - DNA, 25 bp, Mus musculus
taacaacttggacaacagctgggcc

SEQ ID NO: 458190 - DNA, 25 bp, Mus musculus
taacaactttccatcctaggaggat

SEQ ID NO: 458191 - DNA, 25 bp, Mus musculus
taacaagacctgcatgactgaacgg

SEQ ID NO: 458192 - DNA, 25 bp, Mus musculus
taacaagacgcagagagctccaagc

SEQ ID NO: 458193 - DNA, 25 bp, Mus musculus
taacaagagacctcagacagcaagg

SEQ ID NO: 458194 - DNA, 25 bp, Mus musculus
taacaagagctgatgctgtacactc

SEQ ID NO: 458195 - DNA, 25 bp, Mus musculus
taacaagaggcatgggtacggctgc

SEQ ID NO: 458196 - DNA, 25 bp, Mus musculus
taacaagaggtgataggctgcgtcc

SEQ ID NO: 458197 - DNA, 25 bp, Mus musculus
taacaagatcttcggtgtgacaacc

SEQ ID NO: 458198 - DNA, 25 bp, Mus musculus
taacaagcagattcggagtcccgga

SEQ ID NO: 458199 - DNA, 25 bp, Mus musculus
taacaagcatctactggctgcggga

SEQ ID NO: 458200 - DNA, 25 bp, Mus musculus
taacaagccatctacgtgtcatagc

SEQ ID NO: 458201 - DNA, 25 bp, Mus musculus
taacaagcctcggaagactacaatt

SEQ ID NO: 458202 - DNA, 25 bp, Mus musculus
taacaagcgagtcccactgttgggt

SEQ ID NO: 458203 - DNA, 25 bp, Mus musculus
taacaaggacaaggtagcagccctc

SEQ ID NO: 458204 - DNA, 25 bp, Mus musculus
taacaaggacttggtgaccatggtc

SEQ ID NO: 458205 - DNA, 25 bp, Mus musculus
taacaaggagccatagcaagcacca

SEQ ID NO: 458206 - DNA, 25 bp, Mus musculus
taacaaggctggcatcgtgcaggct

SEQ ID NO: 458207 - DNA, 25 bp, Mus musculus
taacaagggagcttggccacgagtg

SEQ ID NO: 458208 - DNA, 25 bp, Mus musculus
taacaaggtggtatgctcctcgcca

SEQ ID NO: 458209 - DNA, 25 bp, Mus musculus
taacaagtcctctgtgtaagcaaga

SEQ ID NO: 458210 - DNA, 25 bp, Mus musculus
taacaagtgcacaaaggaagctccc

SEQ ID NO: 458211 - DNA, 25 bp, Mus musculus
taacaagtttaagctagcccaggct

SEQ ID NO: 458212 - DNA, 25 bp, Mus musculus
taacaatatcaaacatccaccaggc

SEQ ID NO: 458213 - DNA, 25 bp, Mus musculus
taacaatatgcagttgtgcccaggt

SEQ ID NO: 458214 - DNA, 25 bp, Mus musculus
taacaatcaagatggtacatgctga

SEQ ID NO: 458215 - DNA, 25 bp, Mus musculus
taacaatcagcggaaggaaagacca

SEQ ID NO: 458216 - DNA, 25 bp, Mus musculus
taacaatcatacacgaccaccgact

SEQ ID NO: 458217 - DNA, 25 bp, Mus musculus
taacaatcatatatgaccgccggct

SEQ ID NO: 458218 - DNA, 25 bp, Mus musculus
taacaatgatgtcaaaccgcaggga

SEQ ID NO: 458219 - DNA, 25 bp, Mus musculus
taacaatgattgagtgcgcactgtc

SEQ ID NO: 458220 - DNA, 25 bp, Mus musculus
taacaatgcagttagcatgagcagt

SEQ ID NO: 458221 - DNA, 25 bp, Mus musculus
taacaatgggatattaatgagctga

SEQ ID NO: 458222 - DNA, 25 bp, Mus musculus
taacaattgaaagtacaacccacag

SEQ ID NO: 458223 - DNA, 25 bp, Mus musculus
taacaatttacatccctaccgacag

SEQ ID NO: 458224 - DNA, 25 bp, Mus musculus
taacacaaggagacatgaacgctgc

SEQ ID NO: 458225 - DNA, 25 bp, Mus musculus
taacacaaggtatccaggtagagac

SEQ ID NO: 458226 - DNA, 25 bp, Mus musculus
taacacacaggatgcgtatggtcgc

SEQ ID NO: 458227 - DNA, 25 bp, Mus musculus
taacacacctactgggattccctgg

SEQ ID NO: 458228 - DNA, 25 bp, Mus musculus
taacaccaaggaagatgggacctgg

SEQ ID NO: 458229 - DNA, 25 bp, Mus musculus
taacaccagtgggtctgccagagtc

SEQ ID NO: 458230 - DNA, 25 bp, Mus musculus
taacaccctagtttttggcagccaa

SEQ ID NO: 458231 - DNA, 25 bp, Mus musculus
taacaccgaggaagacgtggacacc

SEQ ID NO: 458232 - DNA, 25 bp, Mus musculus
taacaccgctgctccagtgcaggag

SEQ ID NO: 458233 - DNA, 25 bp, Mus musculus
taacacctgaaagcaacgcctagca

SEQ ID NO: 458234 - DNA, 25 bp, Mus musculus
taacacctgtactctatctgtaaga

SEQ ID NO: 458235 - DNA, 25 bp, Mus musculus
taacacctgttaatggagacactcc

SEQ ID NO: 458236 - DNA, 25 bp, Mus musculus
taacaccttaactggctgggcaagc

SEQ ID NO: 458237 - DNA, 25 bp, Mus musculus
taacacgcagtctccattgtgagcc

SEQ ID NO: 458238 - DNA, 25 bp, Mus musculus
taacacgtaagacgtcgagaccatg

SEQ ID NO: 458239 - DNA, 25 bp, Mus musculus
taacacgttcaatccggctaagtcg

SEQ ID NO: 458240 - DNA, 25 bp, Mus musculus
taacactacaaatagatggagtcct

SEQ ID NO: 458241 - DNA, 25 bp, Mus musculus
taacactatcctcttttttgcccgc

SEQ ID NO: 458242 - DNA, 25 bp, Mus musculus
taacactccggtgatggagccagga

SEQ ID NO: 458243 - DNA, 25 bp, Mus musculus
taacactcgcttcggaatagcagcc

SEQ ID NO: 458244 - DNA, 25 bp, Mus musculus
taacactgaggatctgagttggccg

SEQ ID NO: 458245 - DNA, 25 bp, Mus musculus
taacactgaggcatggcactaaaac

SEQ ID NO: 458246 - DNA, 25 bp, Mus musculus
taacactgtgcagctacggagcctc

SEQ ID NO: 458247 - DNA, 25 bp, Mus musculus
taacacttcctatcctaaatgcagg

SEQ ID NO: 458248 - DNA, 25 bp, Mus musculus
taacacttcgcattgggagactagg

SEQ ID NO: 458249 - DNA, 25 bp, Mus musculus
taacacttgttagatatttaggtcc

SEQ ID NO: 458250 - DNA, 25 bp, Mus musculus
taacagaaacatcgtacacaagggc

SEQ ID NO: 458251 - DNA, 25 bp, Mus musculus
taacagaagatgtcgtgaacaccgg

SEQ ID NO: 458252 - DNA, 25 bp, Mus musculus
taacagaaggtggaatgtcctttgg

SEQ ID NO: 458253 - DNA, 25 bp, Mus musculus
taacagaagtgggacagttacgact

SEQ ID NO: 458254 - DNA, 25 bp, Mus musculus
taacagacaaagacaaggacggcat

SEQ ID NO: 458255 - DNA, 25 bp, Mus musculus
taacagacagcctggaagccttggc

SEQ ID NO: 458256 - DNA, 25 bp, Mus musculus
taacagaccagatacttccgggagc

SEQ ID NO: 458257 - DNA, 25 bp, Mus musculus
taacagacctaggaagcaattaccc

SEQ ID NO: 458258 - DNA, 25 bp, Mus musculus
taacagactcatccatcacaaaaat

SEQ ID NO: 458259 - DNA, 25 bp, Mus musculus
taacagagagttgtccgtcagaaga

SEQ ID NO: 458260 - DNA, 25 bp, Mus musculus
taacagaggaagacagagttcgccg

SEQ ID NO: 458261 - DNA, 25 bp, Mus musculus
taacagaggaatcagacagcggaat

SEQ ID NO: 458262 - DNA, 25 bp, Mus musculus
taacagagttggtcaatatgcagtg

SEQ ID NO: 458263 - DNA, 25 bp, Mus musculus
taacagataataaacgatcaccagg

SEQ ID NO: 458264 - DNA, 25 bp, Mus musculus
taacagataatgtcaagtatgaaga

SEQ ID NO: 458265 - DNA, 25 bp, Mus musculus
taacagatagcatcctagaccggga

SEQ ID NO: 458266 - DNA, 25 bp, Mus musculus
taacagatgcatggatagacttcag

SEQ ID NO: 458267 - DNA, 25 bp, Mus musculus
taacagatgtcaaccgggaaagcac

SEQ ID NO: 458268 - DNA, 25 bp, Mus musculus
taacagatttggttcgcagcacaag

SEQ ID NO: 458269 - DNA, 25 bp, Mus musculus
taacagcacacatgagctaggccct

SEQ ID NO: 458270 - DNA, 25 bp, Mus musculus
taacagcacagcagtgtcaaacatg

SEQ ID NO: 458271 - DNA, 25 bp, Mus musculus
taacagcaccttggaactgcactgg

SEQ ID NO: 458272 - DNA, 25 bp, Mus musculus
taacagcagtcagaaggtgcgcagc

SEQ ID NO: 458273 - DNA, 25 bp, Mus musculus
taacagcagtctacagagaatgggc

SEQ ID NO: 458274 - DNA, 25 bp, Mus musculus
taacagcagtggatgtgaaggaaac

SEQ ID NO: 458275 - DNA, 25 bp, Mus musculus
taacagcagtgttcttctggcaacg

SEQ ID NO: 458276 - DNA, 25 bp, Mus musculus
taacagcattgggatatacacagac

SEQ ID NO: 458277 - DNA, 25 bp, Mus musculus
taacagccaagaatgaggaccggga

SEQ ID NO: 458278 - DNA, 25 bp, Mus musculus
taacagcctatgttcccaatgcagg

SEQ ID NO: 458279 - DNA, 25 bp, Mus musculus
taacagcggcatgaacctattggac

SEQ ID NO: 458280 - DNA, 25 bp, Mus musculus
taacagctagtgacggaggcaaacc

SEQ ID NO: 458281 - DNA, 25 bp, Mus musculus
taacagctctgagtgtgggcagcag

SEQ ID NO: 458282 - DNA, 25 bp, Mus musculus
taacagctgcgaagtgaagggcact

SEQ ID NO: 458283 - DNA, 25 bp, Mus musculus
taacagctgtaatccctttaaaggt

SEQ ID NO: 458284 - DNA, 25 bp, Mus musculus
taacagctgtgtgtactgcggtaca

SEQ ID NO: 458285 - DNA, 25 bp, Mus musculus
taacagctgtttgccgagtggagct

SEQ ID NO: 458286 - DNA, 25 bp, Mus musculus
taacagcttgactgtggagctcaca

SEQ ID NO: 458287 - DNA, 25 bp, Mus musculus
taacaggaagatgttgccaccgtca

SEQ ID NO: 458288 - DNA, 25 bp, Mus musculus
taacaggaagtctagcagtggccct

SEQ ID NO: 458289 - DNA, 25 bp, Mus musculus
taacaggatacaactgggcacaaac

SEQ ID NO: 458290 - DNA, 25 bp, Mus musculus
taacaggcctgtcaaactctgggag

SEQ ID NO: 458291 - DNA, 25 bp, Mus musculus
taacaggcgtcaggcaatgccaagg

SEQ ID NO: 458292 - DNA, 25 bp, Mus musculus
taacagggacagaaaaagttagctg

SEQ ID NO: 458293 - DNA, 25 bp, Mus musculus
taacagggccagatggattctttaa

SEQ ID NO: 458294 - DNA, 25 bp, Mus musculus
taacagggctgtaggcactgagcaa

SEQ ID NO: 458295 - DNA, 25 bp, Mus musculus
taacaggtcatgctgtctctgcagt

SEQ ID NO: 458296 - DNA, 25 bp, Mus musculus
taacaggttagctcacattccaggc

SEQ ID NO: 458297 - DNA, 25 bp, Mus musculus
taacagtacttgagcatagtttctg

SEQ ID NO: 458298 - DNA, 25 bp, Mus musculus
taacagtagcagctaacgctggcca

SEQ ID NO: 458299 - DNA, 25 bp, Mus musculus
taacagtagggcgtggcagttcacg

SEQ ID NO: 458300 - DNA, 25 bp, Mus musculus
taacagtccccgtggaaaccaggct

SEQ ID NO: 458301 - DNA, 25 bp, Mus musculus
taacagtcggatgtcctgccaggat

SEQ ID NO: 458302 - DNA, 25 bp, Mus musculus
taacagtctacaggatggctggccc

SEQ ID NO: 458303 - DNA, 25 bp, Mus musculus
taacagtctataaaatgcatccccg

SEQ ID NO: 458304 - DNA, 25 bp, Mus musculus
taacagtgaaaaccgctggctagct

SEQ ID NO: 458305 - DNA, 25 bp, Mus musculus
taacagtgaattccagttgtacaac

SEQ ID NO: 458306 - DNA, 25 bp, Mus musculus
taacagtgacagatgtgaccccgga

SEQ ID NO: 458307 - DNA, 25 bp, Mus musculus
taacagtgatgacagataaatacag

SEQ ID NO: 458308 - DNA, 25 bp, Mus musculus
taacagtgatgctggtaagaaacac

SEQ ID NO: 458309 - DNA, 25 bp, Mus musculus
taacagtgcaccatgtgtaaacgtg

SEQ ID NO: 458310 - DNA, 25 bp, Mus musculus
taacagtgcgtactatgtggatgcc

SEQ ID NO: 458311 - DNA, 25 bp, Mus musculus
taacagtgctcagacagcggaagtg

SEQ ID NO: 458312 - DNA, 25 bp, Mus musculus
taacagtggccttgctggacaatag

SEQ ID NO: 458313 - DNA, 25 bp, Mus musculus
taacagtggtacatatgcagaaggg

SEQ ID NO: 458314 - DNA, 25 bp, Mus musculus
taacagtgtacaaaagaatcgtgcc

SEQ ID NO: 458315 - DNA, 25 bp, Mus musculus
taacagtgtgagtagccaaccaccg

SEQ ID NO: 458316 - DNA, 25 bp, Mus musculus
taacagtgtgatgaacgtgggtcgc

SEQ ID NO: 458317 - DNA, 25 bp, Mus musculus
taacagtgtgctaggagagcctcag

SEQ ID NO: 458318 - DNA, 25 bp, Mus musculus
taacagttcctagccgagttggcgg

SEQ ID NO: 458319 - DNA, 25 bp, Mus musculus
taacagttgttgatgttccccattc

SEQ ID NO: 458320 - DNA, 25 bp, Mus musculus
taacagtttgagtgttggacagcca

SEQ ID NO: 458321 - DNA, 25 bp, Mus musculus
taacataaactagtgatcgatcccc

SEQ ID NO: 458322 - DNA, 25 bp, Mus musculus
taacataaagcagtggaaattcccc

SEQ ID NO: 458323 - DNA, 25 bp, Mus musculus
taacatatgtaatcagtccccaagg

SEQ ID NO: 458324 - DNA, 25 bp, Mus musculus
taacatcaactttggtggactgccc

SEQ ID NO: 458325 - DNA, 25 bp, Mus musculus
taacatcagatctgggcaagtgtcc

SEQ ID NO: 458326 - DNA, 25 bp, Mus musculus
taacatccactaatgtgtcccagag

SEQ ID NO: 458327 - DNA, 25 bp, Mus musculus
taacatccaggagaaatatggcccg

SEQ ID NO: 458328 - DNA, 25 bp, Mus musculus
taacatccatgctggccttaggccc

SEQ ID NO: 458329 - DNA, 25 bp, Mus musculus
taacatccgtaagcagtctgtggcc

SEQ ID NO: 458330 - DNA, 25 bp, Mus musculus
taacatcctcatttcccagagcagg

SEQ ID NO: 458331 - DNA, 25 bp, Mus musculus
taacatcgaggatcatcttccagca

SEQ ID NO: 458332 - DNA, 25 bp, Mus musculus
taacatcgcctgcatcgaagccaag

SEQ ID NO: 458333 - DNA, 25 bp, Mus musculus
taacatcggccctcccatgaataat

SEQ ID NO: 458334 - DNA, 25 bp, Mus musculus
taacatcgtgcggagattcctgaac

SEQ ID NO: 458335 - DNA, 25 bp, Mus musculus
taacatctcaggaacactagtcaag

SEQ ID NO: 458336 - DNA, 25 bp, Mus musculus
taacatctctatcgagacgtacggt

SEQ ID NO: 458337 - DNA, 25 bp, Mus musculus
taacatctctttacgaaccccgagg

SEQ ID NO: 458338 - DNA, 25 bp, Mus musculus
taacatctgagtacttgaatacagt

SEQ ID NO: 458339 - DNA, 25 bp, Mus musculus
taacatctgatctgtggaaccgctg

SEQ ID NO: 458340 - DNA, 25 bp, Mus musculus
taacatctgccctcctagcgcattg

SEQ ID NO: 458341 - DNA, 25 bp, Mus musculus
taacatctgggttggagtccctcag

SEQ ID NO: 458342 - DNA, 25 bp, Mus musculus
taacatgaacaaaaacggtggcacc

SEQ ID NO: 458343 - DNA, 25 bp, Mus musculus
taacatgacaagcaccatatctgag

SEQ ID NO: 458344 - DNA, 25 bp, Mus musculus
taacatgatcaatgggacttccggg

SEQ ID NO: 458345 - DNA, 25 bp, Mus musculus
taacatgatgctagtcactgagaag

SEQ ID NO: 458346 - DNA, 25 bp, Mus musculus
taacatgatttggagccaccatggg

SEQ ID NO: 458347 - DNA, 25 bp, Mus musculus
taacatgcaaagtagcagggttcat

SEQ ID NO: 458348 - DNA, 25 bp, Mus musculus
taacatgcttcattgctccaggaac

SEQ ID NO: 458349 - DNA, 25 bp, Mus musculus
taacatggaatggagtggtagctga

SEQ ID NO: 458350 - DNA, 25 bp, Mus musculus
taacatggagttcgagcagtgcatc

SEQ ID NO: 458351 - DNA, 25 bp, Mus musculus
taacatggcaatccagtacagactg

SEQ ID NO: 458352 - DNA, 25 bp, Mus musculus
taacatggcacagccgtgaaggtgc

SEQ ID NO: 458353 - DNA, 25 bp, Mus musculus
taacatggcagtggtccattgcagc

SEQ ID NO: 458354 - DNA, 25 bp, Mus musculus
taacatggcattgtgggattgaaag

SEQ ID NO: 458355 - DNA, 25 bp, Mus musculus
taacatgggcacatccgtcgtggac

SEQ ID NO: 458356 - DNA, 25 bp, Mus musculus
taacatggtactttggtcctaatag

SEQ ID NO: 458357 - DNA, 25 bp, Mus musculus
taacatgtcctgagttataaggccc

SEQ ID NO: 458358 - DNA, 25 bp, Mus musculus
taacattattactgaagctacggag

SEQ ID NO: 458359 - DNA, 25 bp, Mus musculus
taacattcccttagttgctcaggaa

SEQ ID NO: 458360 - DNA, 25 bp, Mus musculus
taacattgcaaatatccctcgggac

SEQ ID NO: 458361 - DNA, 25 bp, Mus musculus
taacattgcgtggtctattgatggc

SEQ ID NO: 458362 - DNA, 25 bp, Mus musculus
taacattgctcatggctgtagaatc

SEQ ID NO: 458363 - DNA, 25 bp, Mus musculus
taacattgctggcagaggatcgagc

SEQ ID NO: 458364 - DNA, 25 bp, Mus musculus
taacattgttgtttctctccccaaa

SEQ ID NO: 458365 - DNA, 25 bp, Mus musculus
taacatttcgggatggagaaaccag

SEQ ID NO: 458366 - DNA, 25 bp, Mus musculus
taacatttgcaggatgtcccttggt

SEQ ID NO: 458367 - DNA, 25 bp, Mus musculus
taacatttgggtagaaacactgcat

SEQ ID NO: 458368 - DNA, 25 bp, Mus musculus
taaccaaaggtcttaagcatgccag

SEQ ID NO: 458369 - DNA, 25 bp, Mus musculus
taaccaacttgcgaaagaaaccgat

SEQ ID NO: 458370 - DNA, 25 bp, Mus musculus
taaccaagagttgagttgcttccct

SEQ ID NO: 458371 - DNA, 25 bp, Mus musculus
taaccaagcacaggtgaggtcatgg

SEQ ID NO: 458372 - DNA, 25 bp, Mus musculus
taaccaagcctgcattcgggatggc

SEQ ID NO: 458373 - DNA, 25 bp, Mus musculus
taaccaagcttgtgttaagtcagct

SEQ ID NO: 458374 - DNA, 25 bp, Mus musculus
taaccaagggactgggcagttggca

SEQ ID NO: 458375 - DNA, 25 bp, Mus musculus
taaccaaggttcaggtgtacgcaga

SEQ ID NO: 458376 - DNA, 25 bp, Mus musculus
taaccaataagtaaggcagttgcca

SEQ ID NO: 458377 - DNA, 25 bp, Mus musculus
taaccacagagagaacaccagactg

SEQ ID NO: 458378 - DNA, 25 bp, Mus musculus
taaccacagcagtgtagttattgcc

SEQ ID NO: 458379 - DNA, 25 bp, Mus musculus
taaccacattgtgaaccgagagcca

SEQ ID NO: 458380 - DNA, 25 bp, Mus musculus
taaccacctggaacgagatgaagcc

SEQ ID NO: 458381 - DNA, 25 bp, Mus musculus
taaccacgcctactgagcagaggtg

SEQ ID NO: 458382 - DNA, 25 bp, Mus musculus
taaccacggttccacagagtcatcg

SEQ ID NO: 458383 - DNA, 25 bp, Mus musculus
taaccactaaaattcacaggcaggg

SEQ ID NO: 458384 - DNA, 25 bp, Mus musculus
taaccactatgcttggtttgatgct

SEQ ID NO: 458385 - DNA, 25 bp, Mus musculus
taaccactgggtataggaagacatc

SEQ ID NO: 458386 - DNA, 25 bp, Mus musculus
taaccacttcaacgaaggaggagca

SEQ ID NO: 458387 - DNA, 25 bp, Mus musculus
taaccagaacgttgaattgcagctc

SEQ ID NO: 458388 - DNA, 25 bp, Mus musculus
taaccagagacccactgttgatgaa

SEQ ID NO: 458389 - DNA, 25 bp, Mus musculus
taaccagagatacggctggcaccct

SEQ ID NO: 458390 - DNA, 25 bp, Mus musculus
taaccagaggattcggtgtctcggc

SEQ ID NO: 458391 - DNA, 25 bp, Mus musculus
taaccagagtgccaaagtgattcgc

SEQ ID NO: 458392 - DNA, 25 bp, Mus musculus
taaccagcctgtgtgtcagagccag

SEQ ID NO: 458393 - DNA, 25 bp, Mus musculus
taaccagcgacgtcacagtggatgc

SEQ ID NO: 458394 - DNA, 25 bp, Mus musculus
taaccagcggttttagctcccagtc

SEQ ID NO: 458395 - DNA, 25 bp, Mus musculus
taaccagctgtggagcacgtggagc

SEQ ID NO: 458396 - DNA, 25 bp, Mus musculus
taaccaggagttggttagcaagctc

SEQ ID NO: 458397 - DNA, 25 bp, Mus musculus
taaccaggatacgtggtcaagcctg

SEQ ID NO: 458398 - DNA, 25 bp, Mus musculus
taaccagggcattgcacaagaggaa

SEQ ID NO: 458399 - DNA, 25 bp, Mus musculus
taaccagggccagaagtagctttgc

SEQ ID NO: 458400 - DNA, 25 bp, Mus musculus
taaccaggtggacactcaaggcaga

SEQ ID NO: 458401 - DNA, 25 bp, Mus musculus
taaccagtacagcatcccagagatc

SEQ ID NO: 458402 - DNA, 25 bp, Mus musculus
taaccagtcagaggcagtacatgct

SEQ ID NO: 458403 - DNA, 25 bp, Mus musculus
taaccagtgaaaccagcctaatagt

SEQ ID NO: 458404 - DNA, 25 bp, Mus musculus
taaccagtgctttgggatcaggaca

SEQ ID NO: 458405 - DNA, 25 bp, Mus musculus
taaccagtgggcgtctgagctagtc

SEQ ID NO: 458406 - DNA, 25 bp, Mus musculus
taaccagtgtgagaaaacttccggt

SEQ ID NO: 458407 - DNA, 25 bp, Mus musculus
taaccataaccagcgggtcatcggc

SEQ ID NO: 458408 - DNA, 25 bp, Mus musculus
taaccatcatgagtctggaccgatc

SEQ ID NO: 458409 - DNA, 25 bp, Mus musculus
taaccatcctcgagaagaccgtgtc

SEQ ID NO: 458410 - DNA, 25 bp, Mus musculus
taaccatgagcaggcaacgtttgct

SEQ ID NO: 458411 - DNA, 25 bp, Mus musculus
taaccatggagaaaccctcagagac

SEQ ID NO: 458412 - DNA, 25 bp, Mus musculus
taaccattcccttctgtcttgaagc

SEQ ID NO: 458413 - DNA, 25 bp, Mus musculus
taaccattgagaggcgaaatcagca

SEQ ID NO: 458414 - DNA, 25 bp, Mus musculus
taaccattgaggctgagagacgacg

SEQ ID NO: 458415 - DNA, 25 bp, Mus musculus
taaccattgctgatcattagagcag

SEQ ID NO: 458416 - DNA, 25 bp, Mus musculus
taaccattgtaactagtttgtgtaa

SEQ ID NO: 458417 - DNA, 25 bp, Mus musculus
taaccattgtgaaaggtgcccaggg

SEQ ID NO: 458418 - DNA, 25 bp, Mus musculus
taaccattgtggctgaccatccagg

SEQ ID NO: 458419 - DNA, 25 bp, Mus musculus
taaccattgtgggtcagcggctgag

SEQ ID NO: 458420 - DNA, 25 bp, Mus musculus
taaccatttacatttcaacgctgaa

SEQ ID NO: 458421 - DNA, 25 bp, Mus musculus
taacccaaagttggctcaggaccca

SEQ ID NO: 458422 - DNA, 25 bp, Mus musculus
taacccaacagacgctggcaaggct

SEQ ID NO: 458423 - DNA, 25 bp, Mus musculus
taacccaccgagctagtaattacag

SEQ ID NO: 458424 - DNA, 25 bp, Mus musculus
taacccagacgagaactgtatccgc

SEQ ID NO: 458425 - DNA, 25 bp, Mus musculus
taacccagagcctaagaactgcttg

SEQ ID NO: 458426 - DNA, 25 bp, Mus musculus
taacccagcagtttgtcactgtcac

SEQ ID NO: 458427 - DNA, 25 bp, Mus musculus
taacccagccagacttgccactggg

SEQ ID NO: 458428 - DNA, 25 bp, Mus musculus
taacccagccagtgagcagtcaggg

SEQ ID NO: 458429 - DNA, 25 bp, Mus musculus
taacccatacatctaagttagagga

SEQ ID NO: 458430 - DNA, 25 bp, Mus musculus
taacccatcttggatgcaataccag

SEQ ID NO: 458431 - DNA, 25 bp, Mus musculus
taaccccagttagtgacgtgtgaag

SEQ ID NO: 458432 - DNA, 25 bp, Mus musculus
taaccccgagcaacaccatgaagct

SEQ ID NO: 458433 - DNA, 25 bp, Mus musculus
taaccccggtgaccagaatagccta

SEQ ID NO: 458434 - DNA, 25 bp, Mus musculus
taaccccgtaagtactgtgtaacat

SEQ ID NO: 458435 - DNA, 25 bp, Mus musculus
taacccctacccagtgagatgagaa

SEQ ID NO: 458436 - DNA, 25 bp, Mus musculus
taacccctacggagatggatacgac

SEQ ID NO: 458437 - DNA, 25 bp, Mus musculus
taacccctccagtatcagcatggct

SEQ ID NO: 458438 - DNA, 25 bp, Mus musculus
taacccctctgggagtaaagatggg

SEQ ID NO: 458439 - DNA, 25 bp, Mus musculus
taacccctggacatgtgccactgag

SEQ ID NO: 458440 - DNA, 25 bp, Mus musculus
taacccctgtaagtgagcgtgtgcc

SEQ ID NO: 458441 - DNA, 25 bp, Mus musculus
taacccgaagagttaaggctacacg

SEQ ID NO: 458442 - DNA, 25 bp, Mus musculus
taacccgagtagaccgatgctcgtg

SEQ ID NO: 458443 - DNA, 25 bp, Mus musculus
taacccggaagcgaatcaggtacag

SEQ ID NO: 458444 - DNA, 25 bp, Mus musculus
taacccggcttctcaaatgttggcc

SEQ ID NO: 458445 - DNA, 25 bp, Mus musculus
taacccggtactccgtgactacctg

SEQ ID NO: 458446 - DNA, 25 bp, Mus musculus
taacccgtgatcatctaggaccagg

SEQ ID NO: 458447 - DNA, 25 bp, Mus musculus
taaccctaaatgaggacctgagctc

SEQ ID NO: 458448 - DNA, 25 bp, Mus musculus
taaccctattggaggacctggaaag

SEQ ID NO: 458449 - DNA, 25 bp, Mus musculus
taaccctcgattgccggagacagag

SEQ ID NO: 458450 - DNA, 25 bp, Mus musculus
taaccctgagaggaccatcactgtg

SEQ ID NO: 458451 - DNA, 25 bp, Mus musculus
taaccctgagccagtgcttctgcag

SEQ ID NO: 458452 - DNA, 25 bp, Mus musculus
taaccctgatgataaatctggtcca

SEQ ID NO: 458453 - DNA, 25 bp, Mus musculus
taaccctggacctcggaagtctatg

SEQ ID NO: 458454 - DNA, 25 bp, Mus musculus
taaccctgggaggaactagacagaa

SEQ ID NO: 458455 - DNA, 25 bp, Mus musculus
taaccctggggagaagattggagcc

SEQ ID NO: 458456 - DNA, 25 bp, Mus musculus
taaccctgtaagagacactgaactg

SEQ ID NO: 458457 - DNA, 25 bp, Mus musculus
taaccctgtgactggtctccaggaa

SEQ ID NO: 458458 - DNA, 25 bp, Mus musculus
taacccttagtactgaccgtgccgt

SEQ ID NO: 458459 - DNA, 25 bp, Mus musculus
taacccttctggaaatctcagcgag

SEQ ID NO: 458460 - DNA, 25 bp, Mus musculus
taacccttctgtaaatgagcaccaa

SEQ ID NO: 458461 - DNA, 25 bp, Mus musculus
taacccttggaggtgtgactacagc

SEQ ID NO: 458462 - DNA, 25 bp, Mus musculus
taacccttttgggtgcaacaaagat

SEQ ID NO: 458463 - DNA, 25 bp, Mus musculus
taaccgaaggctttgagcgcgacgt

SEQ ID NO: 458464 - DNA, 25 bp, Mus musculus
taaccgaatgaatcaggcaagccgg

SEQ ID NO: 458465 - DNA, 25 bp, Mus musculus
taaccgagaagggttcctgtggaag

SEQ ID NO: 458466 - DNA, 25 bp, Mus musculus
taaccgaggaaactctctaggagag

SEQ ID NO: 458467 - DNA, 25 bp, Mus musculus
taaccgaggaggcaatggactagct

SEQ ID NO: 458468 - DNA, 25 bp, Mus musculus
taaccgagggcataggtgccaacgc

SEQ ID NO: 458469 - DNA, 25 bp, Mus musculus
taaccgcaaggataccagtgaagct

SEQ ID NO: 458470 - DNA, 25 bp, Mus musculus
taaccgcaatgtgcaatgccgggcc

SEQ ID NO: 458471 - DNA, 25 bp, Mus musculus
taaccgcagatacacaaaggacagg

SEQ ID NO: 458472 - DNA, 25 bp, Mus musculus
taaccgctattcctaagtttcacag

SEQ ID NO: 458473 - DNA, 25 bp, Mus musculus
taaccgctgccagaaggagttcgag

SEQ ID NO: 458474 - DNA, 25 bp, Mus musculus
taaccgcttcccaaagatcctggag

SEQ ID NO: 458475 - DNA, 25 bp, Mus musculus
taaccgctttatttcagtagatgag

SEQ ID NO: 458476 - DNA, 25 bp, Mus musculus
taaccggacagccacgaacatgatg

SEQ ID NO: 458477 - DNA, 25 bp, Mus musculus
taaccggaccatcttcgacagtgac

SEQ ID NO: 458478 - DNA, 25 bp, Mus musculus
taaccggagcaacacgctaagggag

SEQ ID NO: 458479 - DNA, 25 bp, Mus musculus
taaccggattgggtctagggagcca

SEQ ID NO: 458480 - DNA, 25 bp, Mus musculus
taaccgggaaagatattactgctct

SEQ ID NO: 458481 - DNA, 25 bp, Mus musculus
taaccgggacagacgtaaggtcagg

SEQ ID NO: 458482 - DNA, 25 bp, Mus musculus
taaccgggtaattgcgcaggctggc

SEQ ID NO: 458483 - DNA, 25 bp, Mus musculus
taaccgggttgtgatcagtaacagt

SEQ ID NO: 458484 - DNA, 25 bp, Mus musculus
taaccggtcagagagcgatatccgc

SEQ ID NO: 458485 - DNA, 25 bp, Mus musculus
taaccggtgcagtgggttccaaggc

SEQ ID NO: 458486 - DNA, 25 bp, Mus musculus
taaccggtgtcattttcttaccatt

SEQ ID NO: 458487 - DNA, 25 bp, Mus musculus
taaccggttccagcaggtggagagc

SEQ ID NO: 458488 - DNA, 25 bp, Mus musculus
taaccgtactatggtgcaactgggc

SEQ ID NO: 458489 - DNA, 25 bp, Mus musculus
taaccgtcactcagtcacatcttgt

SEQ ID NO: 458490 - DNA, 25 bp, Mus musculus
taaccgtccatgttcagggccagga

SEQ ID NO: 458491 - DNA, 25 bp, Mus musculus
taaccgtgcacagcacaacaaagag

SEQ ID NO: 458492 - DNA, 25 bp, Mus musculus
taaccgtgggtgtgtgcaagtgcaa

SEQ ID NO: 458493 - DNA, 25 bp, Mus musculus
taaccgttactgagcaacctctcca

SEQ ID NO: 458494 - DNA, 25 bp, Mus musculus
taacctaaatgtaagccaggccagc

SEQ ID NO: 458495 - DNA, 25 bp, Mus musculus
taacctacttatccacgagcggacg

SEQ ID NO: 458496 - DNA, 25 bp, Mus musculus
taacctagccagctggagagtccaa

SEQ ID NO: 458497 - DNA, 25 bp, Mus musculus
taacctaggcagaagtttaaatctc

SEQ ID NO: 458498 - DNA, 25 bp, Mus musculus
taacctagggcatcttaaaccagct

SEQ ID NO: 458499 - DNA, 25 bp, Mus musculus
taacctattatgagggtcacccctg

SEQ ID NO: 458500 - DNA, 25 bp, Mus musculus
taacctcactgagtggagtggcaca

SEQ ID NO: 458501 - DNA, 25 bp, Mus musculus
taacctcagaggaaagagactcact

SEQ ID NO: 458502 - DNA, 25 bp, Mus musculus
taacctcagagtagtcaaggccttc

SEQ ID NO: 458503 - DNA, 25 bp, Mus musculus
taacctcattgttagggccatggtc

SEQ ID NO: 458504 - DNA, 25 bp, Mus musculus
taacctccatctcaaagctactgca

SEQ ID NO: 458505 - DNA, 25 bp, Mus musculus
taacctcggacacacatctccatga

SEQ ID NO: 458506 - DNA, 25 bp, Mus musculus
taacctctatggaatgggaacctcc

SEQ ID NO: 458507 - DNA, 25 bp, Mus musculus
taacctctgaactactgagactcga

SEQ ID NO: 458508 - DNA, 25 bp, Mus musculus
taacctctgtttcggtggagcaccc

SEQ ID NO: 458509 - DNA, 25 bp, Mus musculus
taacctcttggcagccagaaaatag

SEQ ID NO: 458510 - DNA, 25 bp, Mus musculus
taacctgactcagaacggtatgctg

SEQ ID NO: 458511 - DNA, 25 bp, Mus musculus
taacctgagaagaggcgccaccttt

SEQ ID NO: 458512 - DNA, 25 bp, Mus musculus
taacctgagcctttaaattgccttg

SEQ ID NO: 458513 - DNA, 25 bp, Mus musculus
taacctgatcccctaatttgaagta

SEQ ID NO: 458514 - DNA, 25 bp, Mus musculus
taacctgatggccatagacacggtg

SEQ ID NO: 458515 - DNA, 25 bp, Mus musculus
taacctgcaccttcagttggaggca

SEQ ID NO: 458516 - DNA, 25 bp, Mus musculus
taacctgcaggtggaatcactccga

SEQ ID NO: 458517 - DNA, 25 bp, Mus musculus
taacctgcatgaaccgtaagtggtc

SEQ ID NO: 458518 - DNA, 25 bp, Mus musculus
taacctgcccaagacttctgttgtc

SEQ ID NO: 458519 - DNA, 25 bp, Mus musculus
taacctgctggccactaaacactgg

SEQ ID NO: 458520 - DNA, 25 bp, Mus musculus
taacctgcttcagctagaggaggcg

SEQ ID NO: 458521 - DNA, 25 bp, Mus musculus
taacctgctttctgtctgtgtgacc

SEQ ID NO: 458522 - DNA, 25 bp, Mus musculus
taacctgggacgttctggatcggac

SEQ ID NO: 458523 - DNA, 25 bp, Mus musculus
taacctgggagactgcttcctggca

SEQ ID NO: 458524 - DNA, 25 bp, Mus musculus
taacctgggctcacagctggtggag

SEQ ID NO: 458525 - DNA, 25 bp, Mus musculus
taacctggtgaagcaaaagcctgaa

SEQ ID NO: 458526 - DNA, 25 bp, Mus musculus
taacctgtacatgggcaagctggaa

SEQ ID NO: 458527 - DNA, 25 bp, Mus musculus
taacctgtataagctctggcccggg

SEQ ID NO: 458528 - DNA, 25 bp, Mus musculus
taacctgtcggttttctgtgaccac

SEQ ID NO: 458529 - DNA, 25 bp, Mus musculus
taacctgtgcactgaaagcacgggc

SEQ ID NO: 458530 - DNA, 25 bp, Mus musculus
taacctgtttggtgcatactaggca

SEQ ID NO: 458531 - DNA, 25 bp, Mus musculus
taaccttacttatcagggcgtcaag

SEQ ID NO: 458532 - DNA, 25 bp, Mus musculus
taaccttcagtgtcttcagctttct

SEQ ID NO: 458533 - DNA, 25 bp, Mus musculus
taaccttcgaaaaacagcgccacct

SEQ ID NO: 458534 - DNA, 25 bp, Mus musculus
taaccttcgaaagagccaccttgtg

SEQ ID NO: 458535 - DNA, 25 bp, Mus musculus
taaccttgaaggaaggcacgcccgt

SEQ ID NO: 458536 - DNA, 25 bp, Mus musculus
taaccttgacagttcggagcaccta

SEQ ID NO: 458537 - DNA, 25 bp, Mus musculus
taaccttgctttgcgtccgtgcgat

SEQ ID NO: 458538 - DNA, 25 bp, Mus musculus
taaccttggattatatggcggcacc

SEQ ID NO: 458539 - DNA, 25 bp, Mus musculus
taaccttggccttccctgaacatca

SEQ ID NO: 458540 - DNA, 25 bp, Mus musculus
taacgaaagatggaggcaagcaaac

SEQ ID NO: 458541 - DNA, 25 bp, Mus musculus
taacgaaatggaggtacacgcatcc

SEQ ID NO: 458542 - DNA, 25 bp, Mus musculus
taacgaagaggccaaagaaccggat

SEQ ID NO: 458543 - DNA, 25 bp, Mus musculus
taacgaagttaacagcgaggctccc

SEQ ID NO: 458544 - DNA, 25 bp, Mus musculus
taacgaatggtacgtctgaggacaa

SEQ ID NO: 458545 - DNA, 25 bp, Mus musculus
taacgacaaagctttgggaatccag

SEQ ID NO: 458546 - DNA, 25 bp, Mus musculus
taacgacactttggtgcactgtgag

SEQ ID NO: 458547 - DNA, 25 bp, Mus musculus
taacgacattgattcttctacctgg

SEQ ID NO: 458548 - DNA, 25 bp, Mus musculus
taacgacctacctgatgaacctgat

SEQ ID NO: 458549 - DNA, 25 bp, Mus musculus
taacgactcggaagaggttgccagt

SEQ ID NO: 458550 - DNA, 25 bp, Mus musculus
taacgactctatttgcataacggag

SEQ ID NO: 458551 - DNA, 25 bp, Mus musculus
taacgactgacaacaggcggcttgt

SEQ ID NO: 458552 - DNA, 25 bp, Mus musculus
taacgactgtgagaccttctgggac

SEQ ID NO: 458553 - DNA, 25 bp, Mus musculus
taacgagaccagtggaccctctgtg

SEQ ID NO: 458554 - DNA, 25 bp, Mus musculus
taacgatgcaatcacagaagctggg

SEQ ID NO: 458555 - DNA, 25 bp, Mus musculus
taacgatgcgattctggagtggcca

SEQ ID NO: 458556 - DNA, 25 bp, Mus musculus
taacgatgtgctcaagatggatatc

SEQ ID NO: 458557 - DNA, 25 bp, Mus musculus
taacgcacaagagctgtgaggcccg

SEQ ID NO: 458558 - DNA, 25 bp, Mus musculus
taacgcagatggaaagtcagcaggc

SEQ ID NO: 458559 - DNA, 25 bp, Mus musculus
taacgcaggagcaaatggaagacag

SEQ ID NO: 458560 - DNA, 25 bp, Mus musculus
taacgccaagtagcatggaggagcg

SEQ ID NO: 458561 - DNA, 25 bp, Mus musculus
taacgcgaaaaaccggacaagatgg

SEQ ID NO: 458562 - DNA, 25 bp, Mus musculus
taacgctaacgaagagaaggaccat

SEQ ID NO: 458563 - DNA, 25 bp, Mus musculus
taacgctgatgtagactggtaccac

SEQ ID NO: 458564 - DNA, 25 bp, Mus musculus
taacgctgcatgcagtgggtactcc

SEQ ID NO: 458565 - DNA, 25 bp, Mus musculus
taacgctggccgacaacagcttagc

SEQ ID NO: 458566 - DNA, 25 bp, Mus musculus
taacgcttctcctagggcttcagag

SEQ ID NO: 458567 - DNA, 25 bp, Mus musculus
taacgcttgtctcatgccagcgacc

SEQ ID NO: 458568 - DNA, 25 bp, Mus musculus
taacggaattgtataagggctctgt

SEQ ID NO: 458569 - DNA, 25 bp, Mus musculus
taacggacctctgtcttgtctttgc

SEQ ID NO: 458570 - DNA, 25 bp, Mus musculus
taacggagcctgtctggaataccag

SEQ ID NO: 458571 - DNA, 25 bp, Mus musculus
taacggcaccatcaagcagtgggag

SEQ ID NO: 458572 - DNA, 25 bp, Mus musculus
taacggcagatgcattcaggattgc

SEQ ID NO: 458573 - DNA, 25 bp, Mus musculus
taacggcagtccataggttcacagc

SEQ ID NO: 458574 - DNA, 25 bp, Mus musculus
taacggcagtgtgagtcattaacag

SEQ ID NO: 458575 - DNA, 25 bp, Mus musculus
taacggcctacaggacggctatggc

SEQ ID NO: 458576 - DNA, 25 bp, Mus musculus
taacggctccagacgctgtaacacg

SEQ ID NO: 458577 - DNA, 25 bp, Mus musculus
taacggctctcagtaaagctccggc

SEQ ID NO: 458578 - DNA, 25 bp, Mus musculus
taacggctttcgataactagggcga

SEQ ID NO: 458579 - DNA, 25 bp, Mus musculus
taacgggaacattggagtaaattca

SEQ ID NO: 458580 - DNA, 25 bp, Mus musculus
taacgggagttctctgacagtctct

SEQ ID NO: 458581 - DNA, 25 bp, Mus musculus
taacgggcaccgctcagattcagat

SEQ ID NO: 458582 - DNA, 25 bp, Mus musculus
taacgggtggcttcaaagtgtccca

SEQ ID NO: 458583 - DNA, 25 bp, Mus musculus
taacgggtttcaaggctatttacag

SEQ ID NO: 458584 - DNA, 25 bp, Mus musculus
taacggtcactacgaggacaagctg

SEQ ID NO: 458585 - DNA, 25 bp, Mus musculus
taacggtcagaagcttcaggtgtcc

SEQ ID NO: 458586 - DNA, 25 bp, Mus musculus
taacggtcccctaatctccaggagg

SEQ ID NO: 458587 - DNA, 25 bp, Mus musculus
taacggtgattaagctctgcactgg

SEQ ID NO: 458588 - DNA, 25 bp, Mus musculus
taacggtgccataccctgtgagtgc

SEQ ID NO: 458589 - DNA, 25 bp, Mus musculus
taacggtgcccgaggattacatcac

SEQ ID NO: 458590 - DNA, 25 bp, Mus musculus
taacggtgggacctatggatgccac

SEQ ID NO: 458591 - DNA, 25 bp, Mus musculus
taacggttaaaagatggactgagga

SEQ ID NO: 458592 - DNA, 25 bp, Mus musculus
taacggttaaaccagcctcgctttg

SEQ ID NO: 458593 - DNA, 25 bp, Mus musculus
taacggtttactgttagtgaaggtg

SEQ ID NO: 458594 - DNA, 25 bp, Mus musculus
taacgtaataagaaagcccagtgcc

SEQ ID NO: 458595 - DNA, 25 bp, Mus musculus
taacgtagcacaagatcagaaggat

SEQ ID NO: 458596 - DNA, 25 bp, Mus musculus
taacgtatgcttcaggacatgcgga

SEQ ID NO: 458597 - DNA, 25 bp, Mus musculus
taacgtcaacctggaagagatgctc

SEQ ID NO: 458598 - DNA, 25 bp, Mus musculus
taacgtcatgctggcaggcgtcaag

SEQ ID NO: 458599 - DNA, 25 bp, Mus musculus
taacgtccggtgtatttccagcagc

SEQ ID NO: 458600 - DNA, 25 bp, Mus musculus
taacgtcctgaacgagaagctctgc

SEQ ID NO: 458601 - DNA, 25 bp, Mus musculus
taacgtcgtggaccggtatcatcac

SEQ ID NO: 458602 - DNA, 25 bp, Mus musculus
taacgtctcagaggatgcccgagca

SEQ ID NO: 458603 - DNA, 25 bp, Mus musculus
taacgtctcctggagcgaagctcta

SEQ ID NO: 458604 - DNA, 25 bp, Mus musculus
taacgtctgactctgtccaaatgag

SEQ ID NO: 458605 - DNA, 25 bp, Mus musculus
taacgtgaaagactccagctgccaa

SEQ ID NO: 458606 - DNA, 25 bp, Mus musculus
taacgtgagcttaatgccagggtct

SEQ ID NO: 458607 - DNA, 25 bp, Mus musculus
taacgtgatctaaaagacctgggac

SEQ ID NO: 458608 - DNA, 25 bp, Mus musculus
taacgtgcctgagatggccataacc

SEQ ID NO: 458609 - DNA, 25 bp, Mus musculus
taacgtgctgcagaacctagggacg

SEQ ID NO: 458610 - DNA, 25 bp, Mus musculus
taacgtggctcagtacgtgaaacag

SEQ ID NO: 458611 - DNA, 25 bp, Mus musculus
taacgtgggcaccttggatctggca

SEQ ID NO: 458612 - DNA, 25 bp, Mus musculus
taacgtgggtagaggagcacttctg

SEQ ID NO: 458613 - DNA, 25 bp, Mus musculus
taacgtggtactgtgcctgctggct

SEQ ID NO: 458614 - DNA, 25 bp, Mus musculus
taacgtggtagatgaaaccggatgc

SEQ ID NO: 458615 - DNA, 25 bp, Mus musculus
taacgtgtaagactttcagacaacc

SEQ ID NO: 458616 - DNA, 25 bp, Mus musculus
taacgtgtggacagagacaactcag

SEQ ID NO: 458617 - DNA, 25 bp, Mus musculus
taacgtgtggcactgagacgccttc

SEQ ID NO: 458618 - DNA, 25 bp, Mus musculus
taacgtttacacgtgtctttccaag

SEQ ID NO: 458619 - DNA, 25 bp, Mus musculus
taacgtttgcagcatcgccaagcgc

SEQ ID NO: 458620 - DNA, 25 bp, Mus musculus
taacgtttgccatcggacagctgac

SEQ ID NO: 458621 - DNA, 25 bp, Mus musculus
taactaaaaaacaaccatggtggcg

SEQ ID NO: 458622 - DNA, 25 bp, Mus musculus
taactaacagggataggcagagcac

SEQ ID NO: 458623 - DNA, 25 bp, Mus musculus
taactaacgagtgtgcagagcagac

SEQ ID NO: 458624 - DNA, 25 bp, Mus musculus
taactaagccccatgtcctgaagag

SEQ ID NO: 458625 - DNA, 25 bp, Mus musculus
taactaatatggcaggtaggctctc

SEQ ID NO: 458626 - DNA, 25 bp, Mus musculus
taactaatggctcacgtatgtgcag

SEQ ID NO: 458627 - DNA, 25 bp, Mus musculus
taactaatgttgaatgaccgcactg

SEQ ID NO: 458628 - DNA, 25 bp, Mus musculus
taactacaagggagcaagcatgggc

SEQ ID NO: 458629 - DNA, 25 bp, Mus musculus
taactacagttcacgcaaagggcag

SEQ ID NO: 458630 - DNA, 25 bp, Mus musculus
taactaccaggacactattggccgc

SEQ ID NO: 458631 - DNA, 25 bp, Mus musculus
taactaccagggaggcaatgcagct

SEQ ID NO: 458632 - DNA, 25 bp, Mus musculus
taactacgatgggatctggagcaag

SEQ ID NO: 458633 - DNA, 25 bp, Mus musculus
taactactagctctaagccactggg

SEQ ID NO: 458634 - DNA, 25 bp, Mus musculus
taactactgaagagatcgaccacgc

SEQ ID NO: 458635 - DNA, 25 bp, Mus musculus
taactactggtactttgatgccacc

SEQ ID NO: 458636 - DNA, 25 bp, Mus musculus
taactactgtggacgaaggcaccct

SEQ ID NO: 458637 - DNA, 25 bp, Mus musculus
taactagactgccattcacagctgg

SEQ ID NO: 458638 - DNA, 25 bp, Mus musculus
taactagagcccagtttggcggaca

SEQ ID NO: 458639 - DNA, 25 bp, Mus musculus
taactagccagccttccttacagaa

SEQ ID NO: 458640 - DNA, 25 bp, Mus musculus
taactagcctacagaagccaacgag

SEQ ID NO: 458641 - DNA, 25 bp, Mus musculus
taactagctgggacgagccgtgagt

SEQ ID NO: 458642 - DNA, 25 bp, Mus musculus
taactaggtagcactgacattctct

SEQ ID NO: 458643 - DNA, 25 bp, Mus musculus
taactaggtcggcagacttcagatg

SEQ ID NO: 458644 - DNA, 25 bp, Mus musculus
taactagtgtccagtccagtgcctg

SEQ ID NO: 458645 - DNA, 25 bp, Mus musculus
taactatattgaccagagacccgca

SEQ ID NO: 458646 - DNA, 25 bp, Mus musculus
taactatatttaccactgagttagg

SEQ ID NO: 458647 - DNA, 25 bp, Mus musculus
taactatcctgatggcgactgtccg

SEQ ID NO: 458648 - DNA, 25 bp, Mus musculus
taactatggaaacggaggctgtcag

SEQ ID NO: 458649 - DNA, 25 bp, Mus musculus
taactatggtagcttgggatcgaca

SEQ ID NO: 458650 - DNA, 25 bp, Mus musculus
taactatggtgcaaaatccacgagc

SEQ ID NO: 458651 - DNA, 25 bp, Mus musculus
taactatgtaaccttgactcgggtg

SEQ ID NO: 458652 - DNA, 25 bp, Mus musculus
taactatgttagtggcgacgtcacc

SEQ ID NO: 458653 - DNA, 25 bp, Mus musculus
taactattcccatctacggcggagg

SEQ ID NO: 458654 - DNA, 25 bp, Mus musculus
taactatttcacagcacagcaggcc

SEQ ID NO: 458655 - DNA, 25 bp, Mus musculus
taactcacggttagactcacagcaa

SEQ ID NO: 458656 - DNA, 25 bp, Mus musculus
taactcactgggaaatcatctttgc

SEQ ID NO: 458657 - DNA, 25 bp, Mus musculus
taactcatgttctttgccttgccaa

SEQ ID NO: 458658 - DNA, 25 bp, Mus musculus
taactccacgttcatctctagcggg

SEQ ID NO: 458659 - DNA, 25 bp, Mus musculus
taactccagtcagcaaatatagcag

SEQ ID NO: 458660 - DNA, 25 bp, Mus musculus
taactccagtgtagtggctctctaa

SEQ ID NO: 458661 - DNA, 25 bp, Mus musculus
taactcccaggtgaagagcgaggcc

SEQ ID NO: 458662 - DNA, 25 bp, Mus musculus
taactcctccacttgtgctcaagag

SEQ ID NO: 458663 - DNA, 25 bp, Mus musculus
taactcctgcttatctgacagctgc

SEQ ID NO: 458664 - DNA, 25 bp, Mus musculus
taactccttttgagaaagccatggc

SEQ ID NO: 458665 - DNA, 25 bp, Mus musculus
taactcgacgcatcaaagtggcagg

SEQ ID NO: 458666 - DNA, 25 bp, Mus musculus
taactcgactcagaagacccattgg

SEQ ID NO: 458667 - DNA, 25 bp, Mus musculus
taactcgccagggtgagcatagccc

SEQ ID NO: 458668 - DNA, 25 bp, Mus musculus
taactcggaacaggtctaagggcat

SEQ ID NO: 458669 - DNA, 25 bp, Mus musculus
taactcggcaggaaaaggtacttgc

SEQ ID NO: 458670 - DNA, 25 bp, Mus musculus
taactcggccatggaaccggaggtc

SEQ ID NO: 458671 - DNA, 25 bp, Mus musculus
taactcggtctgttaaggcagctcc

SEQ ID NO: 458672 - DNA, 25 bp, Mus musculus
taactcgtggacaatggatgcctct

SEQ ID NO: 458673 - DNA, 25 bp, Mus musculus
taactcgttgcaagagcgcgtggac

SEQ ID NO: 458674 - DNA, 25 bp, Mus musculus
taactctagggcttgagagggccac

SEQ ID NO: 458675 - DNA, 25 bp, Mus musculus
taactctcacaactactgggatgcg

SEQ ID NO: 458676 - DNA, 25 bp, Mus musculus
taactctctgttgcgcatggccatc

SEQ ID NO: 458677 - DNA, 25 bp, Mus musculus
taactctgaagacgtggacacggag

SEQ ID NO: 458678 - DNA, 25 bp, Mus musculus
taactctgaccataaatgctgaggc

SEQ ID NO: 458679 - DNA, 25 bp, Mus musculus
taactctgggatcttaaaagtcgac

SEQ ID NO: 458680 - DNA, 25 bp, Mus musculus
taactctgggatgctggtgcggact

SEQ ID NO: 458681 - DNA, 25 bp, Mus musculus
taactctggtcatacatgtgcagta

SEQ ID NO: 458682 - DNA, 25 bp, Mus musculus
taactcttccgttgacagccagcag

SEQ ID NO: 458683 - DNA, 25 bp, Mus musculus
taactgaaaacaagcaccggtactg

SEQ ID NO: 458684 - DNA, 25 bp, Mus musculus
taactgaaattgaaagccccgaact

SEQ ID NO: 458685 - DNA, 25 bp, Mus musculus
taactgaacagcaccagagttctgg

SEQ ID NO: 458686 - DNA, 25 bp, Mus musculus
taactgaagggaagcctgcacactg

SEQ ID NO: 458687 - DNA, 25 bp, Mus musculus
taactgacacggtaagcaaatcttg

SEQ ID NO: 458688 - DNA, 25 bp, Mus musculus
taactgacactgttacaaggccatg

SEQ ID NO: 458689 - DNA, 25 bp, Mus musculus
taactgacctggaaaggaggagcct

SEQ ID NO: 458690 - DNA, 25 bp, Mus musculus
taactgactgcccacggtttccagg

SEQ ID NO: 458691 - DNA, 25 bp, Mus musculus
taactgagaatcatctggagcccga

SEQ ID NO: 458692 - DNA, 25 bp, Mus musculus
taactgagacatggtcctgaggcca

SEQ ID NO: 458693 - DNA, 25 bp, Mus musculus
taactgagctgcactaattccaaac

SEQ ID NO: 458694 - DNA, 25 bp, Mus musculus
taactgaggagtctccggaagcccg

SEQ ID NO: 458695 - DNA, 25 bp, Mus musculus
taactgagtctggaaacccatctgc

SEQ ID NO: 458696 - DNA, 25 bp, Mus musculus
taactgagtggtacatcctgcaggc

SEQ ID NO: 458697 - DNA, 25 bp, Mus musculus
taactgagtggtagaaaccccaggc

SEQ ID NO: 458698 - DNA, 25 bp, Mus musculus
taactgagttccttgggcccatggg

SEQ ID NO: 458699 - DNA, 25 bp, Mus musculus
taactgatatcggagccaggtatgt

SEQ ID NO: 458700 - DNA, 25 bp, Mus musculus
taactgatcaaagagtcaatggcgc

SEQ ID NO: 458701 - DNA, 25 bp, Mus musculus
taactgattaaagtaacaagattct

SEQ ID NO: 458702 - DNA, 25 bp, Mus musculus
taactgcacccgcacgtttgtcact

SEQ ID NO: 458703 - DNA, 25 bp, Mus musculus
taactgcagcctgagattgcaactg

SEQ ID NO: 458704 - DNA, 25 bp, Mus musculus
taactgcagttgatggtgggaaacc

SEQ ID NO: 458705 - DNA, 25 bp, Mus musculus
taactgcggcaggatttactgctgg

SEQ ID NO: 458706 - DNA, 25 bp, Mus musculus
taactgctaggcgaaatagctggga

SEQ ID NO: 458707 - DNA, 25 bp, Mus musculus
taactgcttgaaggtgctacaattc

SEQ ID NO: 458708 - DNA, 25 bp, Mus musculus
taactgcttgtcaacaatgggccag

SEQ ID NO: 458709 - DNA, 25 bp, Mus musculus
taactggaaatgaggcgactctgcc

SEQ ID NO: 458710 - DNA, 25 bp, Mus musculus
taactggaaccgaactctgggaaag

SEQ ID NO: 458711 - DNA, 25 bp, Mus musculus
taactggatagacggataactgcgc

SEQ ID NO: 458712 - DNA, 25 bp, Mus musculus
taactggcaccatgaaagtagcagg

SEQ ID NO: 458713 - DNA, 25 bp, Mus musculus
taactggcagcacaatggcaggcaa

SEQ ID NO: 458714 - DNA, 25 bp, Mus musculus
taactggccagtacagagacacaca

SEQ ID NO: 458715 - DNA, 25 bp, Mus musculus
taactggcgaacacagaaaggcttc

SEQ ID NO: 458716 - DNA, 25 bp, Mus musculus
taactggctaaggagtttgtgccca

SEQ ID NO: 458717 - DNA, 25 bp, Mus musculus
taactggctatcagagaaacctgcc

SEQ ID NO: 458718 - DNA, 25 bp, Mus musculus
taactgggaacttggacaccggctg

SEQ ID NO: 458719 - DNA, 25 bp, Mus musculus
taactgggataagcattccttggtc

SEQ ID NO: 458720 - DNA, 25 bp, Mus musculus
taactgggcctatggcttcggatgg

SEQ ID NO: 458721 - DNA, 25 bp, Mus musculus
taactggtaaaaagatatatttgag

SEQ ID NO: 458722 - DNA, 25 bp, Mus musculus
taactggtgccatgaccggaacgta

SEQ ID NO: 458723 - DNA, 25 bp, Mus musculus
taactggtgggctgcgttgctcaca

SEQ ID NO: 458724 - DNA, 25 bp, Mus musculus
taactggtgtcctcgttcagaactc

SEQ ID NO: 458725 - DNA, 25 bp, Mus musculus
taactggtgtgacagaaaaggacct

SEQ ID NO: 458726 - DNA, 25 bp, Mus musculus
taactgtagaaggaagtcagacacc

SEQ ID NO: 458727 - DNA, 25 bp, Mus musculus
taactgtagcatgggaagcagccgg

SEQ ID NO: 458728 - DNA, 25 bp, Mus musculus
taactgtcacctggcatggctggga

SEQ ID NO: 458729 - DNA, 25 bp, Mus musculus
taactgtcccaaatctggaaggtcc

SEQ ID NO: 458730 - DNA, 25 bp, Mus musculus
taactgtcccttgtatggtgtggct

SEQ ID NO: 458731 - DNA, 25 bp, Mus musculus
taactgtcctccgtttttggtggct

SEQ ID NO: 458732 - DNA, 25 bp, Mus musculus
taactgtcctgtagcaatttgagaa

SEQ ID NO: 458733 - DNA, 25 bp, Mus musculus
taactgtctcaggaaaacgatcaaa

SEQ ID NO: 458734 - DNA, 25 bp, Mus musculus
taactgtgaaataccgcaagctcga

SEQ ID NO: 458735 - DNA, 25 bp, Mus musculus
taactgtgaactttggcctagcctg

SEQ ID NO: 458736 - DNA, 25 bp, Mus musculus
taactgtgaatctcaaggctgcagc

SEQ ID NO: 458737 - DNA, 25 bp, Mus musculus
taactgtgacgtggaatttccgacc

SEQ ID NO: 458738 - DNA, 25 bp, Mus musculus
taactgtgagatttgtagacccaac

SEQ ID NO: 458739 - DNA, 25 bp, Mus musculus
taactgtgatattgacgctgctgac

SEQ ID NO: 458740 - DNA, 25 bp, Mus musculus
taactgtgatgaaggaaaggaccct

SEQ ID NO: 458741 - DNA, 25 bp, Mus musculus
taactgtgccgataagatcagccgg

SEQ ID NO: 458742 - DNA, 25 bp, Mus musculus
taactgtggatttactgtgtgcaag

SEQ ID NO: 458743 - DNA, 25 bp, Mus musculus
taactgtggttctggcgcagatgcc

SEQ ID NO: 458744 - DNA, 25 bp, Mus musculus
taactgtgtggtgtccaggcctggc

SEQ ID NO: 458745 - DNA, 25 bp, Mus musculus
taactgttggcgtggtaacacatgc

SEQ ID NO: 458746 - DNA, 25 bp, Mus musculus
taacttaacctatctggccctcaca

SEQ ID NO: 458747 - DNA, 25 bp, Mus musculus
taacttaccccgatttgggatgtca

SEQ ID NO: 458748 - DNA, 25 bp, Mus musculus
taacttactacctgggagggctgac

SEQ ID NO: 458749 - DNA, 25 bp, Mus musculus
taacttagactgtgggttcaccacg

SEQ ID NO: 458750 - DNA, 25 bp, Mus musculus
taacttagcagttaagacaactggc

SEQ ID NO: 458751 - DNA, 25 bp, Mus musculus
taacttataaagtgcacctcgccgc

SEQ ID NO: 458752 - DNA, 25 bp, Mus musculus
taacttattgtctaggccagagcgg

SEQ ID NO: 458753 - DNA, 25 bp, Mus musculus
taacttcaacaagctcgtgatgccc

SEQ ID NO: 458754 - DNA, 25 bp, Mus musculus
taacttcaccaatgtacttgttgcc

SEQ ID NO: 458755 - DNA, 25 bp, Mus musculus
taacttcagccaccttttctcatga

SEQ ID NO: 458756 - DNA, 25 bp, Mus musculus
taacttcagtgcaagagactttgtc

SEQ ID NO: 458757 - DNA, 25 bp, Mus musculus
taacttccagtcactcactctttgg

SEQ ID NO: 458758 - DNA, 25 bp, Mus musculus
taacttccgaggcacgtgatagcgt

SEQ ID NO: 458759 - DNA, 25 bp, Mus musculus
taacttccgggattcggtgggcctg

SEQ ID NO: 458760 - DNA, 25 bp, Mus musculus
taacttcctgtcatgagctgggcct

SEQ ID NO: 458761 - DNA, 25 bp, Mus musculus
taacttcgcggattagtgacagtca

SEQ ID NO: 458762 - DNA, 25 bp, Mus musculus
taacttcgctgatgggcacttgaca

SEQ ID NO: 458763 - DNA, 25 bp, Mus musculus
taacttctgatgtagatgtgccgcc

SEQ ID NO: 458764 - DNA, 25 bp, Mus musculus
taacttctgtgccttggatctgccc

SEQ ID NO: 458765 - DNA, 25 bp, Mus musculus
taacttcttcagacatgcccgaggc

SEQ ID NO: 458766 - DNA, 25 bp, Mus musculus
taacttgagctcctggtttaagggc

SEQ ID NO: 458767 - DNA, 25 bp, Mus musculus
taacttgcaacgtgaaccaggaggt

SEQ ID NO: 458768 - DNA, 25 bp, Mus musculus
taacttgctgccaatgtaaggacaa

SEQ ID NO: 458769 - DNA, 25 bp, Mus musculus
taacttggaattggtggcgatcctc

SEQ ID NO: 458770 - DNA, 25 bp, Mus musculus
taacttggaccggattggccagctg

SEQ ID NO: 458771 - DNA, 25 bp, Mus musculus
taacttggtacactgatctggctga

SEQ ID NO: 458772 - DNA, 25 bp, Mus musculus
taacttgtctaactgctcttttggg

SEQ ID NO: 458773 - DNA, 25 bp, Mus musculus
taacttgttgctagatacagaaggc

SEQ ID NO: 458774 - DNA, 25 bp, Mus musculus
taactttactgcttcccttgctggc

SEQ ID NO: 458775 - DNA, 25 bp, Mus musculus
taactttatatccagaagaagagga

SEQ ID NO: 458776 - DNA, 25 bp, Mus musculus
taactttatgtccttgagaaccagc

SEQ ID NO: 458777 - DNA, 25 bp, Mus musculus
taactttattatacaaaggtactgg

SEQ ID NO: 458778 - DNA, 25 bp, Mus musculus
taactttcaattcggaacctcggca

SEQ ID NO: 458779 - DNA, 25 bp, Mus musculus
taactttcagtgaggcccttggagc

SEQ ID NO: 458780 - DNA, 25 bp, Mus musculus
taactttcatgcttaaggctggatc

SEQ ID NO: 458781 - DNA, 25 bp, Mus musculus
taactttcattaccagtaaccctga

SEQ ID NO: 458782 - DNA, 25 bp, Mus musculus
taactttctacctccaacatggcgg

SEQ ID NO: 458783 - DNA, 25 bp, Mus musculus
taactttgcactccgacgtgtcacc

SEQ ID NO: 458784 - DNA, 25 bp, Mus musculus
taactttgcagacagatgacccttg

SEQ ID NO: 458785 - DNA, 25 bp, Mus musculus
taactttgcatagagaagccacatc

SEQ ID NO: 458786 - DNA, 25 bp, Mus musculus
taactttgctggctatggaactcac

SEQ ID NO: 458787 - DNA, 25 bp, Mus musculus
taactttgttctccgtgacccacgg

SEQ ID NO: 458788 - DNA, 25 bp, Mus musculus
taacttttcagagccaatctctgcg

SEQ ID NO: 458789 - DNA, 25 bp, Mus musculus
taacttttccagttgggagccgcac

SEQ ID NO: 458790 - DNA, 25 bp, Mus musculus
taacttttgatcgaactggcaggcg

SEQ ID NO: 458791 - DNA, 25 bp, Mus musculus
taactttttctcatatgcagtcagc

SEQ ID NO: 458792 - DNA, 25 bp, Mus musculus
taagaaaaccactgcgtgtccgggc

SEQ ID NO: 458793 - DNA, 25 bp, Mus musculus
taagaaaaccgttgctcgcctaagg

SEQ ID NO: 458794 - DNA, 25 bp, Mus musculus
taagaaaagcatccaggagacttgt

SEQ ID NO: 458795 - DNA, 25 bp, Mus musculus
taagaaaatacacactgccagatgg

SEQ ID NO: 458796 - DNA, 25 bp, Mus musculus
taagaaacaaatgtgtggctgcgga

SEQ ID NO: 458797 - DNA, 25 bp, Mus musculus
taagaaaccacacatgcaccaacag

SEQ ID NO: 458798 - DNA, 25 bp, Mus musculus
taagaaagagcaacaggactactgg

SEQ ID NO: 458799 - DNA, 25 bp, Mus musculus
taagaaagatgatgcgggtgcctca

SEQ ID NO: 458800 - DNA, 25 bp, Mus musculus
taagaaagccgtggatgccgaacca

SEQ ID NO: 458801 - DNA, 25 bp, Mus musculus
taagaaagctcagttgcaacaaacc

SEQ ID NO: 458802 - DNA, 25 bp, Mus musculus
taagaaagctggtgagtcaggttcc

SEQ ID NO: 458803 - DNA, 25 bp, Mus musculus
taagaaagggacacgccattgctct

SEQ ID NO: 458804 - DNA, 25 bp, Mus musculus
taagaaaggtatggtggtcagcaga

SEQ ID NO: 458805 - DNA, 25 bp, Mus musculus
taagaaaggtcctcgagtggatcca

SEQ ID NO: 458806 - DNA, 25 bp, Mus musculus
taagaaatgaggtggtcatggttgc

SEQ ID NO: 458807 - DNA, 25 bp, Mus musculus
taagaaatgcactcccaacgcagtg

SEQ ID NO: 458808 - DNA, 25 bp, Mus musculus
taagaaatgtgacctgtaccggctg

SEQ ID NO: 458809 - DNA, 25 bp, Mus musculus
taagaaatgtgatgtagccgggcgt

SEQ ID NO: 458810 - DNA, 25 bp, Mus musculus
taagaaattatacacaggacctggt

SEQ ID NO: 458811 - DNA, 25 bp, Mus musculus
taagaacaaaagaatcctcctagtg

SEQ ID NO: 458812 - DNA, 25 bp, Mus musculus
taagaacaagctagtccagactgcc

SEQ ID NO: 458813 - DNA, 25 bp, Mus musculus
taagaacaatgacttccagctggga

SEQ ID NO: 458814 - DNA, 25 bp, Mus musculus
taagaacagataagagtgcgggctc

SEQ ID NO: 458815 - DNA, 25 bp, Mus musculus
taagaacatgcgtctcaaggtgaag

SEQ ID NO: 458816 - DNA, 25 bp, Mus musculus
taagaacatgtgtaagctgcggccc

SEQ ID NO: 458817 - DNA, 25 bp, Mus musculus
taagaaccacacagacgattcacag

SEQ ID NO: 458818 - DNA, 25 bp, Mus musculus
taagaaccaggaaagcagcctcaag

SEQ ID NO: 458819 - DNA, 25 bp, Mus musculus
taagaaccaggagcgaaagcatcag

SEQ ID NO: 458820 - DNA, 25 bp, Mus musculus
taagaaccatgacgatgaggccaca

SEQ ID NO: 458821 - DNA, 25 bp, Mus musculus
taagaacccaatggtgagtggacgc

SEQ ID NO: 458822 - DNA, 25 bp, Mus musculus
taagaaccgctcagatagtgtttgg

SEQ ID NO: 458823 - DNA, 25 bp, Mus musculus
taagaacctctcgtggtccagcaag

SEQ ID NO: 458824 - DNA, 25 bp, Mus musculus
taagaacctggtcactggtcatgat

SEQ ID NO: 458825 - DNA, 25 bp, Mus musculus
taagaacgtgacctacaagcacagg

SEQ ID NO: 458826 - DNA, 25 bp, Mus musculus
taagaactcctcatgctcacttggc

SEQ ID NO: 458827 - DNA, 25 bp, Mus musculus
taagaactctggtggcctggccact

SEQ ID NO: 458828 - DNA, 25 bp, Mus musculus
taagaactctgtgccaggaacctga

SEQ ID NO: 458829 - DNA, 25 bp, Mus musculus
taagaactgggcacggacattcaac

SEQ ID NO: 458830 - DNA, 25 bp, Mus musculus
taagaactgtcctgaaggtcccagc

SEQ ID NO: 458831 - DNA, 25 bp, Mus musculus
taagaactttcatgaggacaccctc

SEQ ID NO: 458832 - DNA, 25 bp, Mus musculus
taagaagaagctcctgattagggca

SEQ ID NO: 458833 - DNA, 25 bp, Mus musculus
taagaagaatcaaagaagcgtcccc

SEQ ID NO: 458834 - DNA, 25 bp, Mus musculus
taagaagaatgtgcccgtgtccaag

SEQ ID NO: 458835 - DNA, 25 bp, Mus musculus
taagaagaggcacagagcaccgtgt

SEQ ID NO: 458836 - DNA, 25 bp, Mus musculus
taagaagagggttccattgacaaga

SEQ ID NO: 458837 - DNA, 25 bp, Mus musculus
taagaagagtagacattccagtatc

SEQ ID NO: 458838 - DNA, 25 bp, Mus musculus
taagaagatcctgctagaggaagcc

SEQ ID NO: 458839 - DNA, 25 bp, Mus musculus
taagaagcaccagcgcaaggctgtg

SEQ ID NO: 458840 - DNA, 25 bp, Mus musculus
taagaagcaggcagactgtgaagct

SEQ ID NO: 458841 - DNA, 25 bp, Mus musculus
taagaagcgttctgtgtacgaccgg

SEQ ID NO: 458842 - DNA, 25 bp, Mus musculus
taagaagctagagcatcctggcctc

SEQ ID NO: 458843 - DNA, 25 bp, Mus musculus
taagaagctcaaagtcgctgaggcc

SEQ ID NO: 458844 - DNA, 25 bp, Mus musculus
taagaagctcctccgtccgcacttg

SEQ ID NO: 458845 - DNA, 25 bp, Mus musculus
taagaaggaggtgtgttcagttgcc

SEQ ID NO: 458846 - DNA, 25 bp, Mus musculus
taagaaggccgagagctcaggaatc

SEQ ID NO: 458847 - DNA, 25 bp, Mus musculus
taagaaggcggaggtgctgactcac

SEQ ID NO: 458848 - DNA, 25 bp, Mus musculus
taagaagggccagtgtgcactcgtc

SEQ ID NO: 458849 - DNA, 25 bp, Mus musculus
taagaagggtggtcctactgccaaa

SEQ ID NO: 458850 - DNA, 25 bp, Mus musculus
taagaagggtgtagctcacatctgg

SEQ ID NO: 458851 - DNA, 25 bp, Mus musculus
taagaaggtcaagatcgggctgtac

SEQ ID NO: 458852 - DNA, 25 bp, Mus musculus
taagaaggtgattgagcccatggcc

SEQ ID NO: 458853 - DNA, 25 bp, Mus musculus
taagaagtaaaataccctcctatgg

SEQ ID NO: 458854 - DNA, 25 bp, Mus musculus
taagaagtcagtcaaaagtgaagct

SEQ ID NO: 458855 - DNA, 25 bp, Mus musculus
taagaagtccctcctaagccatgag

SEQ ID NO: 458856 - DNA, 25 bp, Mus musculus
taagaagtgaggcaaaaaaccaatt

SEQ ID NO: 458857 - DNA, 25 bp, Mus musculus
taagaagtgcaaacgctacgacctc

SEQ ID NO: 458858 - DNA, 25 bp, Mus musculus
taagaagtgcacctgctatcggccc

SEQ ID NO: 458859 - DNA, 25 bp, Mus musculus
taagaagtggatgattgcatcgtgc

SEQ ID NO: 458860 - DNA, 25 bp, Mus musculus
taagaagttcacacagacccgttgg

SEQ ID NO: 458861 - DNA, 25 bp, Mus musculus
taagaagttcctgcaacccggaagt

SEQ ID NO: 458862 - DNA, 25 bp, Mus musculus
taagaagttggttgctgccaccgga

SEQ ID NO: 458863 - DNA, 25 bp, Mus musculus
taagaataaattttgcccaggtggt

SEQ ID NO: 458864 - DNA, 25 bp, Mus musculus
taagaatatgtctccaggtccagag

SEQ ID NO: 458865 - DNA, 25 bp, Mus musculus
taagaatattctcggttgtacgggc

SEQ ID NO: 458866 - DNA, 25 bp, Mus musculus
taagaatcaccctccaaccagtggt

SEQ ID NO: 458867 - DNA, 25 bp, Mus musculus
taagaatcacctactcgttccggct

SEQ ID NO: 458868 - DNA, 25 bp, Mus musculus
taagaatcatgcgtagccaggcagt

SEQ ID NO: 458869 - DNA, 25 bp, Mus musculus
taagaatcctcatcagtaccgcgtg

SEQ ID NO: 458870 - DNA, 25 bp, Mus musculus
taagaatctgtttcgtgatgagaaa

SEQ ID NO: 458871 - DNA, 25 bp, Mus musculus
taagaatgcgaaaaatgagccgccg

SEQ ID NO: 458872 - DNA, 25 bp, Mus musculus
taagaatggaaatacgaacagactc

SEQ ID NO: 458873 - DNA, 25 bp, Mus musculus
taagaatgtgaagcagaacgtgacc

SEQ ID NO: 458874 - DNA, 25 bp, Mus musculus
taagaattccactgtaactcggctc

SEQ ID NO: 458875 - DNA, 25 bp, Mus musculus
taagaattttaagatccggcggctc

SEQ ID NO: 458876 - DNA, 25 bp, Mus musculus
taagacaaaaatccagtggcacggg

SEQ ID NO: 458877 - DNA, 25 bp, Mus musculus
taagacaacattcttggaagcctgg

SEQ ID NO: 458878 - DNA, 25 bp, Mus musculus
taagacaacgagagcctcgggtctg

SEQ ID NO: 458879 - DNA, 25 bp, Mus musculus
taagacaacggcttcaccctgagta

SEQ ID NO: 458880 - DNA, 25 bp, Mus musculus
taagacaactgacgactatgaggca

SEQ ID NO: 458881 - DNA, 25 bp, Mus musculus
taagacaatgagcagatagaaggga

SEQ ID NO: 458882 - DNA, 25 bp, Mus musculus
taagacaccagacacagcctctgcg

SEQ ID NO: 458883 - DNA, 25 bp, Mus musculus
taagacacccgaagactatgctgac

SEQ ID NO: 458884 - DNA, 25 bp, Mus musculus
taagacacggcttcagattcaaggc

SEQ ID NO: 458885 - DNA, 25 bp, Mus musculus
taagacagaggtcactggtgaccac

SEQ ID NO: 458886 - DNA, 25 bp, Mus musculus
taagacagcatcatccatcagggag

SEQ ID NO: 458887 - DNA, 25 bp, Mus musculus
taagacagcatgaaggtacactggg

SEQ ID NO: 458888 - DNA, 25 bp, Mus musculus
taagacaggaccatcagatccggga

SEQ ID NO: 458889 - DNA, 25 bp, Mus musculus
taagacagttcggaccctacagact

SEQ ID NO: 458890 - DNA, 25 bp, Mus musculus
taagacataatcctcctagcctggg

SEQ ID NO: 458891 - DNA, 25 bp, Mus musculus
taagacatatgccactgctgagccc

SEQ ID NO: 458892 - DNA, 25 bp, Mus musculus
taagacatccctgtggtaaagtgcg

SEQ ID NO: 458893 - DNA, 25 bp, Mus musculus
taagacatgaactcctctgggcagg

SEQ ID NO: 458894 - DNA, 25 bp, Mus musculus
taagacatgcatagctcgtaccaaa

SEQ ID NO: 458895 - DNA, 25 bp, Mus musculus
taagacatgtaactgaacaccacac

SEQ ID NO: 458896 - DNA, 25 bp, Mus musculus
taagacatgtgttaactatcccagt

SEQ ID NO: 458897 - DNA, 25 bp, Mus musculus
taagaccaagcgaaagcagctgtcg

SEQ ID NO: 458898 - DNA, 25 bp, Mus musculus
taagaccaccttcttcaggaatctt

SEQ ID NO: 458899 - DNA, 25 bp, Mus musculus
taagaccagtgttcggaggaagacc

SEQ ID NO: 458900 - DNA, 25 bp, Mus musculus
taagaccatcacgtcgcattcggag

SEQ ID NO: 458901 - DNA, 25 bp, Mus musculus
taagaccatggaatggatgccctgg

SEQ ID NO: 458902 - DNA, 25 bp, Mus musculus
taagaccatgttagcgtcaccacag

SEQ ID NO: 458903 - DNA, 25 bp, Mus musculus
taagacccacatgtacccagtgcgg

SEQ ID NO: 458904 - DNA, 25 bp, Mus musculus
taagacccgcttttctggtgttgca

SEQ ID NO: 458905 - DNA, 25 bp, Mus musculus
taagaccctagctgaccatcactgg

SEQ ID NO: 458906 - DNA, 25 bp, Mus musculus
taagaccctcgttctgtgccctgag

SEQ ID NO: 458907 - DNA, 25 bp, Mus musculus
taagacccttgaattgacagacctc

SEQ ID NO: 458908 - DNA, 25 bp, Mus musculus
taagaccgccctttgtcagagtgac

SEQ ID NO: 458909 - DNA, 25 bp, Mus musculus
taagaccgtggttgacattgacacc

SEQ ID NO: 458910 - DNA, 25 bp, Mus musculus
taagacctacaatgtcgccgtggac

SEQ ID NO: 458911 - DNA, 25 bp, Mus musculus
taagacctcctcactctcatggttc

SEQ ID NO: 458912 - DNA, 25 bp, Mus musculus
taagacctgagagggttacctagga

SEQ ID NO: 458913 - DNA, 25 bp, Mus musculus
taagacctgtgggatgggcatctcc

SEQ ID NO: 458914 - DNA, 25 bp, Mus musculus
taagaccttcagaaagaaacacggg

SEQ ID NO: 458915 - DNA, 25 bp, Mus musculus
taagaccttgaatcaccctagtgga

SEQ ID NO: 458916 - DNA, 25 bp, Mus musculus
taagacgatctcctgcactagtgtc

SEQ ID NO: 458917 - DNA, 25 bp, Mus musculus
taagacggagccgtgcaagaagcct

SEQ ID NO: 458918 - DNA, 25 bp, Mus musculus
taagacggtctgtaccagccaggat

SEQ ID NO: 458919 - DNA, 25 bp, Mus musculus
taagactaaaaatgggcaggctggc

SEQ ID NO: 458920 - DNA, 25 bp, Mus musculus
taagactattgctcaaggacctgac

SEQ ID NO: 458921 - DNA, 25 bp, Mus musculus
taagactcagctggaccttgaagcc

SEQ ID NO: 458922 - DNA, 25 bp, Mus musculus
taagactcatccttgagcttcctgc

SEQ ID NO: 458923 - DNA, 25 bp, Mus musculus
taagactcgacctttgtgaggcaac

SEQ ID NO: 458924 - DNA, 25 bp, Mus musculus
taagactgaacttcacagtgggagc

SEQ ID NO: 458925 - DNA, 25 bp, Mus musculus
taagactgaatggaagcgagcagcc

SEQ ID NO: 458926 - DNA, 25 bp, Mus musculus
taagactgagtaagagcaaacgcga

SEQ ID NO: 458927 - DNA, 25 bp, Mus musculus
taagactgctgccaaataaacgggc

SEQ ID NO: 458928 - DNA, 25 bp, Mus musculus
taagactgttcaccaaagacgtttt

SEQ ID NO: 458929 - DNA, 25 bp, Mus musculus
taagacttcgagatgccgactggcg

SEQ ID NO: 458930 - DNA, 25 bp, Mus musculus
taagacttcggtggatgctgctgca

SEQ ID NO: 458931 - DNA, 25 bp, Mus musculus
taagacttgagaactaggttgggac

SEQ ID NO: 458932 - DNA, 25 bp, Mus musculus
taagacttgcaaagtcagcgttcac

SEQ ID NO: 458933 - DNA, 25 bp, Mus musculus
taagacttgggtcaacagtcgcaga

SEQ ID NO: 458934 - DNA, 25 bp, Mus musculus
taagactttgaacccgacgcaggct

SEQ ID NO: 458935 - DNA, 25 bp, Mus musculus
taagactttggactctcagtgtcgg

SEQ ID NO: 458936 - DNA, 25 bp, Mus musculus
taagagaaaagcttgcaagctaaag

SEQ ID NO: 458937 - DNA, 25 bp, Mus musculus
taagagaaattgataataccccgct

SEQ ID NO: 458938 - DNA, 25 bp, Mus musculus
taagagaacctcatatagggccaga

SEQ ID NO: 458939 - DNA, 25 bp, Mus musculus
taagagacaggtagagtatgccact

SEQ ID NO: 458940 - DNA, 25 bp, Mus musculus
taagagacctgagaatggccggaga

SEQ ID NO: 458941 - DNA, 25 bp, Mus musculus
taagagacggatgagcaggtctgcc

SEQ ID NO: 458942 - DNA, 25 bp, Mus musculus
taagagagacccacctagggagact

SEQ ID NO: 458943 - DNA, 25 bp, Mus musculus
taagagagactgaaaacttgcccgg

SEQ ID NO: 458944 - DNA, 25 bp, Mus musculus
taagagagccagtcagaacaaaagt

SEQ ID NO: 458945 - DNA, 25 bp, Mus musculus
taagagaggcatagggatctcacag

SEQ ID NO: 458946 - DNA, 25 bp, Mus musculus
taagagagtcaaaggaccaccgagc

SEQ ID NO: 458947 - DNA, 25 bp, Mus musculus
taagagagtgcatcctgttaccacg

SEQ ID NO: 458948 - DNA, 25 bp, Mus musculus
taagagagtgccttatgcaccccag

SEQ ID NO: 458949 - DNA, 25 bp, Mus musculus
taagagagtggcgtgcttcgagaac

SEQ ID NO: 458950 - DNA, 25 bp, Mus musculus
taagagagtttgatggtttgaggta

SEQ ID NO: 458951 - DNA, 25 bp, Mus musculus
taagagatagagatcatcctttgcg

SEQ ID NO: 458952 - DNA, 25 bp, Mus musculus
taagagatgcccgtgtctgtgctgg

SEQ ID NO: 458953 - DNA, 25 bp, Mus musculus
taagagcaccgaagccatcagctcg

SEQ ID NO: 458954 - DNA, 25 bp, Mus musculus
taagagcagtgctccaaagctccca

SEQ ID NO: 458955 - DNA, 25 bp, Mus musculus
taagagcatcccttttgcctaggcc

SEQ ID NO: 458956 - DNA, 25 bp, Mus musculus
taagagcatcgacaacctctctagt

SEQ ID NO: 458957 - DNA, 25 bp, Mus musculus
taagagcatcggctttgggccctga

SEQ ID NO: 458958 - DNA, 25 bp, Mus musculus
taagagcatgtctatagagggatgg

SEQ ID NO: 458959 - DNA, 25 bp, Mus musculus
taagagcatgtggtgtcctggagac

SEQ ID NO: 458960 - DNA, 25 bp, Mus musculus
taagagcattttggcagacacaagg

SEQ ID NO: 458961 - DNA, 25 bp, Mus musculus
taagagccacctcatctggaagcag

SEQ ID NO: 458962 - DNA, 25 bp, Mus musculus
taagagccatccctcagtacatgag

SEQ ID NO: 458963 - DNA, 25 bp, Mus musculus
taagagccctttctacgacagcagc

SEQ ID NO: 458964 - DNA, 25 bp, Mus musculus
taagagcctgaacctgctggtgtcg

SEQ ID NO: 458965 - DNA, 25 bp, Mus musculus
taagagcgcgtctccaaacagattg

SEQ ID NO: 458966 - DNA, 25 bp, Mus musculus
taagagcgttaacctcaccgacagg

SEQ ID NO: 458967 - DNA, 25 bp, Mus musculus
taagagctcccgatgcagtgatgat

SEQ ID NO: 458968 - DNA, 25 bp, Mus musculus
taagagctcttttctgcagacttgg

SEQ ID NO: 458969 - DNA, 25 bp, Mus musculus
taagagctggagtcgggtatattta

SEQ ID NO: 458970 - DNA, 25 bp, Mus musculus
taagagcttctaggagcagccagga

SEQ ID NO: 458971 - DNA, 25 bp, Mus musculus
taagaggacaagcaaaccagacgat

SEQ ID NO: 458972 - DNA, 25 bp, Mus musculus
taagaggaccatatgacgtggcaaa

SEQ ID NO: 458973 - DNA, 25 bp, Mus musculus
taagaggagggtggatcactcacac

SEQ ID NO: 458974 - DNA, 25 bp, Mus musculus
taagaggcactcctccctaagggaa

SEQ ID NO: 458975 - DNA, 25 bp, Mus musculus
taagaggcaggtagcaagccgagac

SEQ ID NO: 458976 - DNA, 25 bp, Mus musculus
taagaggccatgtccagatgtccag

SEQ ID NO: 458977 - DNA, 25 bp, Mus musculus
taagaggcggcgctgactggtttca

SEQ ID NO: 458978 - DNA, 25 bp, Mus musculus
taagaggctctacgtcagcgactgg

SEQ ID NO: 458979 - DNA, 25 bp, Mus musculus
taagaggctcttagccctattgctt

SEQ ID NO: 458980 - DNA, 25 bp, Mus musculus
taagagggaggcactgtttctaaac

SEQ ID NO: 458981 - DNA, 25 bp, Mus musculus
taagagggcgccgtgacccttgcac

SEQ ID NO: 458982 - DNA, 25 bp, Mus musculus
taagagggctggtgccatttaccca

SEQ ID NO: 458983 - DNA, 25 bp, Mus musculus
taagagggtcatcgccttccagctg

SEQ ID NO: 458984 - DNA, 25 bp, Mus musculus
taagaggtcagccatgtgacagctg

SEQ ID NO: 458985 - DNA, 25 bp, Mus musculus
taagaggtgcttgctgaaacacagc

SEQ ID NO: 458986 - DNA, 25 bp, Mus musculus
taagaggttatgacacgaaagggac

SEQ ID NO: 458987 - DNA, 25 bp, Mus musculus
taagaggttcctgcgaaagaaatcc

SEQ ID NO: 458988 - DNA, 25 bp, Mus musculus
taagaggttctccttcctactcagg

SEQ ID NO: 458989 - DNA, 25 bp, Mus musculus
taagagtaaactaaactgacaccac

SEQ ID NO: 458990 - DNA, 25 bp, Mus musculus
taagagtccagaaactgtaaatagg

SEQ ID NO: 458991 - DNA, 25 bp, Mus musculus
taagagtcgagttccacaacggtgg

SEQ ID NO: 458992 - DNA, 25 bp, Mus musculus
taagagtcggacgaagcgcttcaag

SEQ ID NO: 458993 - DNA, 25 bp, Mus musculus
taagagtctaccaggcacacagatg

SEQ ID NO: 458994 - DNA, 25 bp, Mus musculus
taagagtgactaccaagattcccca

SEQ ID NO: 458995 - DNA, 25 bp, Mus musculus
taagagtggacaaagtccatgcagc

SEQ ID NO: 458996 - DNA, 25 bp, Mus musculus
taagagtggcaaggctaaccagccc

SEQ ID NO: 458997 - DNA, 25 bp, Mus musculus
taagagtggccatgaaattagtccc

SEQ ID NO: 458998 - DNA, 25 bp, Mus musculus
taagagtggcctcataccttttcgg

SEQ ID NO: 458999 - DNA, 25 bp, Mus musculus
taagagttaccctgtagccaagact

SEQ ID NO: 459000 - DNA, 25 bp, Mus musculus
taagagttcacagtcagtttcacta

SEQ ID NO: 459001 - DNA, 25 bp, Mus musculus
taagagttcctcatttgaagacaga

SEQ ID NO: 459002 - DNA, 25 bp, Mus musculus
taagagttcttgactgtctgcttcc

SEQ ID NO: 459003 - DNA, 25 bp, Mus musculus
taagagttgtacttccaccaaaggc

SEQ ID NO: 459004 - DNA, 25 bp, Mus musculus
taagagtttccaaatctggagttca

SEQ ID NO: 459005 - DNA, 25 bp, Mus musculus
taagataacgcagcaacagaaggcc

SEQ ID NO: 459006 - DNA, 25 bp, Mus musculus
taagatacacaaggacaacagctga

SEQ ID NO: 459007 - DNA, 25 bp, Mus musculus
taagatacagtgtcgggtccctttc

SEQ ID NO: 459008 - DNA, 25 bp, Mus musculus
taagatacccggaaacgatgcatgc

SEQ ID NO: 459009 - DNA, 25 bp, Mus musculus
taagataccctgtcacagtgtgtgg

SEQ ID NO: 459010 - DNA, 25 bp, Mus musculus
taagatactttcaccaagagcttcc

SEQ ID NO: 459011 - DNA, 25 bp, Mus musculus
taagatagacaacaataaagacaac

SEQ ID NO: 459012 - DNA, 25 bp, Mus musculus
taagatagacttggaggacgccctg

SEQ ID NO: 459013 - DNA, 25 bp, Mus musculus
taagatagggtctgccagtcggcgt

SEQ ID NO: 459014 - DNA, 25 bp, Mus musculus
taagataggttcaacttttgacctt

SEQ ID NO: 459015 - DNA, 25 bp, Mus musculus
taagatattgaaagtggccagccag

SEQ ID NO: 459016 - DNA, 25 bp, Mus musculus
taagatcaacaaagactggctggag

SEQ ID NO: 459017 - DNA, 25 bp, Mus musculus
taagatcaatctgcctgagtccagg

SEQ ID NO: 459018 - DNA, 25 bp, Mus musculus
taagatcagctgtgctggaccacag

SEQ ID NO: 459019 - DNA, 25 bp, Mus musculus
taagatcagtgacttcggctgctcc

SEQ ID NO: 459020 - DNA, 25 bp, Mus musculus
taagatccatgaagtcaagggcccg

SEQ ID NO: 459021 - DNA, 25 bp, Mus musculus
taagatcgaggtggccacatacgcc

SEQ ID NO: 459022 - DNA, 25 bp, Mus musculus
taagatctagtctcagttcacgtgt

SEQ ID NO: 459023 - DNA, 25 bp, Mus musculus
taagatctcacactgctctcgagag

SEQ ID NO: 459024 - DNA, 25 bp, Mus musculus
taagatctgcccgttgcctgtgaca

SEQ ID NO: 459025 - DNA, 25 bp, Mus musculus
taagatctggattgtggagccaaac

SEQ ID NO: 459026 - DNA, 25 bp, Mus musculus
taagatctggctggtggtacctagc

SEQ ID NO: 459027 - DNA, 25 bp, Mus musculus
taagatctgtactgaccccaagctg

SEQ ID NO: 459028 - DNA, 25 bp, Mus musculus
taagatcttcccatcggctgtggca

SEQ ID NO: 459029 - DNA, 25 bp, Mus musculus
taagatgaaaagtccacgagtggcg

SEQ ID NO: 459030 - DNA, 25 bp, Mus musculus
taagatgaccttggctgagacccat

SEQ ID NO: 459031 - DNA, 25 bp, Mus musculus
taagatgcatgccaaacgtgtgttc

SEQ ID NO: 459032 - DNA, 25 bp, Mus musculus
taagatgcatttgggcggaaaccgc

SEQ ID NO: 459033 - DNA, 25 bp, Mus musculus
taagatgcgtttccacagacagctc

SEQ ID NO: 459034 - DNA, 25 bp, Mus musculus
taagatgctcctagcaaaagaatgc

SEQ ID NO: 459035 - DNA, 25 bp, Mus musculus
taagatggcgactgcagcagcggaa

SEQ ID NO: 459036 - DNA, 25 bp, Mus musculus
taagatggctatctcagtgctggga

SEQ ID NO: 459037 - DNA, 25 bp, Mus musculus
taagatggcttgctagactcaggcc

SEQ ID NO: 459038 - DNA, 25 bp, Mus musculus
taagatgggagtcatgctggcacct

SEQ ID NO: 459039 - DNA, 25 bp, Mus musculus
taagatgggctatcggctctgagag

SEQ ID NO: 459040 - DNA, 25 bp, Mus musculus
taagatgtcagaaatgcttggaatt

SEQ ID NO: 459041 - DNA, 25 bp, Mus musculus
taagatgtccttgtgagtccaaacc

SEQ ID NO: 459042 - DNA, 25 bp, Mus musculus
taagatgtgacaacgcttgtagctc

SEQ ID NO: 459043 - DNA, 25 bp, Mus musculus
taagattaagaaccagcctgagagg

SEQ ID NO: 459044 - DNA, 25 bp, Mus musculus
taagattacacaactcaccaaatgc

SEQ ID NO: 459045 - DNA, 25 bp, Mus musculus
taagattcgcagagtggagccagga

SEQ ID NO: 459046 - DNA, 25 bp, Mus musculus
taagattcgttgtgaggagaccctc

SEQ ID NO: 459047 - DNA, 25 bp, Mus musculus
taagattgagatcctacgcctggcc

SEQ ID NO: 459048 - DNA, 25 bp, Mus musculus
taagattgccaaaaaagtgatcagg

SEQ ID NO: 459049 - DNA, 25 bp, Mus musculus
taagattgtctcatcttctgcatca

SEQ ID NO: 459050 - DNA, 25 bp, Mus musculus
taagattgtgatgaggcacgcccat

SEQ ID NO: 459051 - DNA, 25 bp, Mus musculus
taagattgttgcacgagacgccagc

SEQ ID NO: 459052 - DNA, 25 bp, Mus musculus
taagatttttcatcctagtgctgag

SEQ ID NO: 459053 - DNA, 25 bp, Mus musculus
taagcaaaacatgagcttaaaccgc

SEQ ID NO: 459054 - DNA, 25 bp, Mus musculus
taagcaaaacgcacagcaagtcacc

SEQ ID NO: 459055 - DNA, 25 bp, Mus musculus
taagcaaaactcacgtagactgtgt

SEQ ID NO: 459056 - DNA, 25 bp, Mus musculus
taagcaaaagatgggcagaacctct

SEQ ID NO: 459057 - DNA, 25 bp, Mus musculus
taagcaacagccgagaaccagtgtg

SEQ ID NO: 459058 - DNA, 25 bp, Mus musculus
taagcaacccgtgtgactagcctgg

SEQ ID NO: 459059 - DNA, 25 bp, Mus musculus
taagcaacggaagcaagagcggtca

SEQ ID NO: 459060 - DNA, 25 bp, Mus musculus
taagcaactggatagcgtgaagccc

SEQ ID NO: 459061 - DNA, 25 bp, Mus musculus
taagcaagaaccaccgaactctggg

SEQ ID NO: 459062 - DNA, 25 bp, Mus musculus
taagcaagagcccagagaaacgttc

SEQ ID NO: 459063 - DNA, 25 bp, Mus musculus
taagcaagccgtcgagtctctgaaa

SEQ ID NO: 459064 - DNA, 25 bp, Mus musculus
taagcaaggtgctgccctacatgga

SEQ ID NO: 459065 - DNA, 25 bp, Mus musculus
taagcaatcccgagaggacactgtg

SEQ ID NO: 459066 - DNA, 25 bp, Mus musculus
taagcaatgagtctgtcttattgtc

SEQ ID NO: 459067 - DNA, 25 bp, Mus musculus
taagcaattcgaagtgcgctcctga

SEQ ID NO: 459068 - DNA, 25 bp, Mus musculus
taagcacacaagtgggactcggtgg

SEQ ID NO: 459069 - DNA, 25 bp, Mus musculus
taagcacacccaggtctcacatggg

SEQ ID NO: 459070 - DNA, 25 bp, Mus musculus
taagcacacctacgcgtttgagagt

SEQ ID NO: 459071 - DNA, 25 bp, Mus musculus
taagcacagctctttgtacggcccc

SEQ ID NO: 459072 - DNA, 25 bp, Mus musculus
taagcacagtgcctccttagaaggg

SEQ ID NO: 459073 - DNA, 25 bp, Mus musculus
taagcacatgaagtcgaaagcccac

SEQ ID NO: 459074 - DNA, 25 bp, Mus musculus
taagcacatgtctggttatgaacgg

SEQ ID NO: 459075 - DNA, 25 bp, Mus musculus
taagcaccacaatgagctagcagga

SEQ ID NO: 459076 - DNA, 25 bp, Mus musculus
taagcaccagatgtgtgatgatcca

SEQ ID NO: 459077 - DNA, 25 bp, Mus musculus
taagcaccgactcatcaaagtggag

SEQ ID NO: 459078 - DNA, 25 bp, Mus musculus
taagcacctaggctgttctcatggg

SEQ ID NO: 459079 - DNA, 25 bp, Mus musculus
taagcacctctttcagtattcaagt

SEQ ID NO: 459080 - DNA, 25 bp, Mus musculus
taagcaccttttgtggatacttggg

SEQ ID NO: 459081 - DNA, 25 bp, Mus musculus
taagcacggaatgagcaaaaagcac

SEQ ID NO: 459082 - DNA, 25 bp, Mus musculus
taagcactatggaaacaggcacagg

SEQ ID NO: 459083 - DNA, 25 bp, Mus musculus
taagcactttggaggtgcatacagg

SEQ ID NO: 459084 - DNA, 25 bp, Mus musculus
taagcacttttctcagccttctggg

SEQ ID NO: 459085 - DNA, 25 bp, Mus musculus
taagcagaactgaccttgagtggcc

SEQ ID NO: 459086 - DNA, 25 bp, Mus musculus
taagcagcacagttggacagaatcc

SEQ ID NO: 459087 - DNA, 25 bp, Mus musculus
taagcagcagatgcttctggaactc

SEQ ID NO: 459088 - DNA, 25 bp, Mus musculus
taagcagcagctagatgccatcgag

SEQ ID NO: 459089 - DNA, 25 bp, Mus musculus
taagcagcatgctaccccagggcac

SEQ ID NO: 459090 - DNA, 25 bp, Mus musculus
taagcagccgttcgcgatggatttc

SEQ ID NO: 459091 - DNA, 25 bp, Mus musculus
taagcagcgcacaaggcattctggt

SEQ ID NO: 459092 - DNA, 25 bp, Mus musculus
taagcagcggcaaacaaggcagttc

SEQ ID NO: 459093 - DNA, 25 bp, Mus musculus
taagcagctacaattcagagactac

SEQ ID NO: 459094 - DNA, 25 bp, Mus musculus
taagcagctatccaccggagaggag

SEQ ID NO: 459095 - DNA, 25 bp, Mus musculus
taagcagctccctccaggagaagca

SEQ ID NO: 459096 - DNA, 25 bp, Mus musculus
taagcagctgcgtgttcgaccaaca

SEQ ID NO: 459097 - DNA, 25 bp, Mus musculus
taagcagcttttacctgaagcaggg

SEQ ID NO: 459098 - DNA, 25 bp, Mus musculus
taagcaggaactcaggcggaaaagc

SEQ ID NO: 459099 - DNA, 25 bp, Mus musculus
taagcaggccgtttggcctttacca

SEQ ID NO: 459100 - DNA, 25 bp, Mus musculus
taagcaggctctgttcaccaggagg

SEQ ID NO: 459101 - DNA, 25 bp, Mus musculus
taagcagggccaccagtttctaaag

SEQ ID NO: 459102 - DNA, 25 bp, Mus musculus
taagcagtacagtcgcaacacaagg

SEQ ID NO: 459103 - DNA, 25 bp, Mus musculus
taagcagtcactgtttagtccagaa

SEQ ID NO: 459104 - DNA, 25 bp, Mus musculus
taagcagtccatgtacattgtaacc

SEQ ID NO: 459105 - DNA, 25 bp, Mus musculus
taagcagtgcatgcgtctgtgaccc

SEQ ID NO: 459106 - DNA, 25 bp, Mus musculus
taagcagtggttagtgattgggctc

SEQ ID NO: 459107 - DNA, 25 bp, Mus musculus
taagcagttctgttgtgctagggac

SEQ ID NO: 459108 - DNA, 25 bp, Mus musculus
taagcatatggttgtgtgcccagca

SEQ ID NO: 459109 - DNA, 25 bp, Mus musculus
taagcatcaaacctgaataaccggg

SEQ ID NO: 459110 - DNA, 25 bp, Mus musculus
taagcatccacttttgggaatccct

SEQ ID NO: 459111 - DNA, 25 bp, Mus musculus
taagcatccatgttgactgaccacg

SEQ ID NO: 459112 - DNA, 25 bp, Mus musculus
taagcatcctaaccgggagaacgtg

SEQ ID NO: 459113 - DNA, 25 bp, Mus musculus
taagcatctttagaatattacaatt

SEQ ID NO: 459114 - DNA, 25 bp, Mus musculus
taagcatgaagcatacttgggtctc

SEQ ID NO: 459115 - DNA, 25 bp, Mus musculus
taagcatgagaagtaccccaaggag

SEQ ID NO: 459116 - DNA, 25 bp, Mus musculus
taagcatgccagtatggccgagccc

SEQ ID NO: 459117 - DNA, 25 bp, Mus musculus
taagcatggacgggcttggcactaa

SEQ ID NO: 459118 - DNA, 25 bp, Mus musculus
taagcatgggcatgaccatggccat

SEQ ID NO: 459119 - DNA, 25 bp, Mus musculus
taagcatggttatgtgcccaaagaa

SEQ ID NO: 459120 - DNA, 25 bp, Mus musculus
taagcatgtctactactacctcaag

SEQ ID NO: 459121 - DNA, 25 bp, Mus musculus
taagcattacaagctaactgacacg

SEQ ID NO: 459122 - DNA, 25 bp, Mus musculus
taagcattaccatttcaaacgcaag

SEQ ID NO: 459123 - DNA, 25 bp, Mus musculus
taagcatttgtccatcttaagagtc

SEQ ID NO: 459124 - DNA, 25 bp, Mus musculus
taagccaacacactactctgggtgg

SEQ ID NO: 459125 - DNA, 25 bp, Mus musculus
taagccaagcatatgactacgtgag

SEQ ID NO: 459126 - DNA, 25 bp, Mus musculus
taagccacagtaccaggcaagattg

SEQ ID NO: 459127 - DNA, 25 bp, Mus musculus
taagccaccctttgtctgggttggg

SEQ ID NO: 459128 - DNA, 25 bp, Mus musculus
taagccacgaggaaagcaggaaagc

SEQ ID NO: 459129 - DNA, 25 bp, Mus musculus
taagccacgcgtcttttcgggcagc

SEQ ID NO: 459130 - DNA, 25 bp, Mus musculus
taagccactttcgtgtatagtgctc

SEQ ID NO: 459131 - DNA, 25 bp, Mus musculus
taagccagaatggagatgcgaccct

SEQ ID NO: 459132 - DNA, 25 bp, Mus musculus
taagccagacatacaaggtgctcag

SEQ ID NO: 459133 - DNA, 25 bp, Mus musculus
taagccagagagtgaacgtagttcc

SEQ ID NO: 459134 - DNA, 25 bp, Mus musculus
taagccagctgaagggtctcgtatt

SEQ ID NO: 459135 - DNA, 25 bp, Mus musculus
taagccagctttgctttcaactgac

SEQ ID NO: 459136 - DNA, 25 bp, Mus musculus
taagccaggaagtcaggcacggctg

SEQ ID NO: 459137 - DNA, 25 bp, Mus musculus
taagccagggcagttcagtgttcct

SEQ ID NO: 459138 - DNA, 25 bp, Mus musculus
taagccaggtgagccaggtatagcc

SEQ ID NO: 459139 - DNA, 25 bp, Mus musculus
taagccatcatcctgtctgtggaac

SEQ ID NO: 459140 - DNA, 25 bp, Mus musculus
taagccatgctgagcgagcactgag

SEQ ID NO: 459141 - DNA, 25 bp, Mus musculus
taagccattgagacaggagttccaa

SEQ ID NO: 459142 - DNA, 25 bp, Mus musculus
taagccattgcctccgtgtttgaga

SEQ ID NO: 459143 - DNA, 25 bp, Mus musculus
taagcccacctttgagatgcagcag

SEQ ID NO: 459144 - DNA, 25 bp, Mus musculus
taagcccactgataaatagaatccc

SEQ ID NO: 459145 - DNA, 25 bp, Mus musculus
taagcccagattccagtgaagccgc

SEQ ID NO: 459146 - DNA, 25 bp, Mus musculus
taagccccggctcaagtccggtggt

SEQ ID NO: 459147 - DNA, 25 bp, Mus musculus
taagcccggtatctattgctgtgct

SEQ ID NO: 459148 - DNA, 25 bp, Mus musculus
taagccctcggcgatcttgagcagt

SEQ ID NO: 459149 - DNA, 25 bp, Mus musculus
taagcccttagttgatgctgtgtac

SEQ ID NO: 459150 - DNA, 25 bp, Mus musculus
taagcccttggcagatcactgttga

SEQ ID NO: 459151 - DNA, 25 bp, Mus musculus
taagccgaataacaagcggtccagg

SEQ ID NO: 459152 - DNA, 25 bp, Mus musculus
taagccggttgctagttcctggagg

SEQ ID NO: 459153 - DNA, 25 bp, Mus musculus
taagccgtagtgagtactgaataca

SEQ ID NO: 459154 - DNA, 25 bp, Mus musculus
taagccgtgctagatggacatcggg

SEQ ID NO: 459155 - DNA, 25 bp, Mus musculus
taagccgtgctctgctctaactgaa

SEQ ID NO: 459156 - DNA, 25 bp, Mus musculus
taagccgttccctcggagctaaggg

SEQ ID NO: 459157 - DNA, 25 bp, Mus musculus
taagcctatatagtgggttcctccc

SEQ ID NO: 459158 - DNA, 25 bp, Mus musculus
taagcctcattgcaaggtgaccaag

SEQ ID NO: 459159 - DNA, 25 bp, Mus musculus
taagcctcggactcttcacctgtgg

SEQ ID NO: 459160 - DNA, 25 bp, Mus musculus
taagcctctactctgcagggagacg

SEQ ID NO: 459161 - DNA, 25 bp, Mus musculus
taagcctgaaagtcctgagagacgc

SEQ ID NO: 459162 - DNA, 25 bp, Mus musculus
taagcctgagctttcgttcccatgg

SEQ ID NO: 459163 - DNA, 25 bp, Mus musculus
taagcctgaggaaactgatcccacg

SEQ ID NO: 459164 - DNA, 25 bp, Mus musculus
taagcctgatactaggagcctcaca

SEQ ID NO: 459165 - DNA, 25 bp, Mus musculus
taagcctgccagcagctatggccag

SEQ ID NO: 459166 - DNA, 25 bp, Mus musculus
taagcctgccgtttaaaagagcctg

SEQ ID NO: 459167 - DNA, 25 bp, Mus musculus
taagcctgcgagaagcactaacctg

SEQ ID NO: 459168 - DNA, 25 bp, Mus musculus
taagcctgcggagaccaagaagctg

SEQ ID NO: 459169 - DNA, 25 bp, Mus musculus
taagcctgcgtgatgcctgttggtg

SEQ ID NO: 459170 - DNA, 25 bp, Mus musculus
taagcctggagctggcctaaagttc

SEQ ID NO: 459171 - DNA, 25 bp, Mus musculus
taagcctggcacaatagagtctgtc

SEQ ID NO: 459172 - DNA, 25 bp, Mus musculus
taagcctgttttcactaggctctgg

SEQ ID NO: 459173 - DNA, 25 bp, Mus musculus
taagccttagcacctgagttagaac

SEQ ID NO: 459174 - DNA, 25 bp, Mus musculus
taagccttcgaagtcgtccaagcgg

SEQ ID NO: 459175 - DNA, 25 bp, Mus musculus
taagccttctggaatcatcatccca

SEQ ID NO: 459176 - DNA, 25 bp, Mus musculus
taagcctttctcagctgcggctcgg

SEQ ID NO: 459177 - DNA, 25 bp, Mus musculus
taagcctttggagcctaccctgagg

SEQ ID NO: 459178 - DNA, 25 bp, Mus musculus
taagcgacaagaataccaggatgaa

SEQ ID NO: 459179 - DNA, 25 bp, Mus musculus
taagcgacacttggccttgcatgct

SEQ ID NO: 459180 - DNA, 25 bp, Mus musculus
taagcgagcctccagaatttacaac

SEQ ID NO: 459181 - DNA, 25 bp, Mus musculus
taagcgaggccgagaaggtctacat

SEQ ID NO: 459182 - DNA, 25 bp, Mus musculus
taagcgagtagcatacatgtcaggt

SEQ ID NO: 459183 - DNA, 25 bp, Mus musculus
taagcgcagccctgagttggagctc

SEQ ID NO: 459184 - DNA, 25 bp, Mus musculus
taagcgcagtgacctttggaagcct

SEQ ID NO: 459185 - DNA, 25 bp, Mus musculus
taagcgccgcctcaagtgtgaattc

SEQ ID NO: 459186 - DNA, 25 bp, Mus musculus
taagcgcctcctttgtgtcttcctg

SEQ ID NO: 459187 - DNA, 25 bp, Mus musculus
taagcgcctttcgaaactgctggaa

SEQ ID NO: 459188 - DNA, 25 bp, Mus musculus
taagcgctacgacctcattcaggag

SEQ ID NO: 459189 - DNA, 25 bp, Mus musculus
taagcggaaaaagagccactgtcac

SEQ ID NO: 459190 - DNA, 25 bp, Mus musculus
taagcggaacaaatcgcagagggcc

SEQ ID NO: 459191 - DNA, 25 bp, Mus musculus
taagcggaatctggccatagcaggc

SEQ ID NO: 459192 - DNA, 25 bp, Mus musculus
taagcggatgtacggcaagtcactg

SEQ ID NO: 459193 - DNA, 25 bp, Mus musculus
taagcggcatcatagcaacggttgt

SEQ ID NO: 459194 - DNA, 25 bp, Mus musculus
taagcggcttcagctacaaatggac

SEQ ID NO: 459195 - DNA, 25 bp, Mus musculus
taagcgggactcctaacgtcacgtc

SEQ ID NO: 459196 - DNA, 25 bp, Mus musculus
taagcggtccaagatcaagcctgat

SEQ ID NO: 459197 - DNA, 25 bp, Mus musculus
taagcggtgccctacagtgttttca

SEQ ID NO: 459198 - DNA, 25 bp, Mus musculus
taagcggtgtgggaatctgagtacc

SEQ ID NO: 459199 - DNA, 25 bp, Mus musculus
taagcgtcaggatagggaagcacat

SEQ ID NO: 459200 - DNA, 25 bp, Mus musculus
taagcgtctcacgagaagggacagc

SEQ ID NO: 459201 - DNA, 25 bp, Mus musculus
taagcgtctgctctactgtgcactg

SEQ ID NO: 459202 - DNA, 25 bp, Mus musculus
taagcgtgattacctgctgaggcca

SEQ ID NO: 459203 - DNA, 25 bp, Mus musculus
taagcgtgcttttcagttccggcca

SEQ ID NO: 459204 - DNA, 25 bp, Mus musculus
taagcgtgtaccatcagagctgaga

SEQ ID NO: 459205 - DNA, 25 bp, Mus musculus
taagcgttgatactggactttgcta

SEQ ID NO: 459206 - DNA, 25 bp, Mus musculus
taagcgttttcagtcctcagaggcg

SEQ ID NO: 459207 - DNA, 25 bp, Mus musculus
taagctaaacctctacctaatcatg

SEQ ID NO: 459208 - DNA, 25 bp, Mus musculus
taagctaaacttggaggtgactgac

SEQ ID NO: 459209 - DNA, 25 bp, Mus musculus
taagctaaaggcttactgggtaggg

SEQ ID NO: 459210 - DNA, 25 bp, Mus musculus
taagctacctttcaaatgggccgcg

SEQ ID NO: 459211 - DNA, 25 bp, Mus musculus
taagctactccctcaactaggtggg

SEQ ID NO: 459212 - DNA, 25 bp, Mus musculus
taagctagaacacacacccagtctg

SEQ ID NO: 459213 - DNA, 25 bp, Mus musculus
taagctaggattcaccctggcagag

SEQ ID NO: 459214 - DNA, 25 bp, Mus musculus
taagctaggcctctggataggactc

SEQ ID NO: 459215 - DNA, 25 bp, Mus musculus
taagctaggcggtcatgattcccat

SEQ ID NO: 459216 - DNA, 25 bp, Mus musculus
taagctagtcatccctcagttgtag

SEQ ID NO: 459217 - DNA, 25 bp, Mus musculus
taagctagtgatctggcaactgtgc

SEQ ID NO: 459218 - DNA, 25 bp, Mus musculus
taagctatgctctggttcccctgaa

SEQ ID NO: 459219 - DNA, 25 bp, Mus musculus
taagctatggttccggtcccaaaag

SEQ ID NO: 459220 - DNA, 25 bp, Mus musculus
taagctcagaacgaagtggaactcc

SEQ ID NO: 459221 - DNA, 25 bp, Mus musculus
taagctcagctttgacagaggctcc

SEQ ID NO: 459222 - DNA, 25 bp, Mus musculus
taagctcagtctcctgctctgcctt

SEQ ID NO: 459223 - DNA, 25 bp, Mus musculus
taagctcagtttggctaggtgctac

SEQ ID NO: 459224 - DNA, 25 bp, Mus musculus
taagctccacaagggcaagaacatg

SEQ ID NO: 459225 - DNA, 25 bp, Mus musculus
taagctccacctctatgcaggatgg

SEQ ID NO: 459226 - DNA, 25 bp, Mus musculus
taagctcctccactatgacatcacg

SEQ ID NO: 459227 - DNA, 25 bp, Mus musculus
taagctcctgttttcagttacacac

SEQ ID NO: 459228 - DNA, 25 bp, Mus musculus
taagctcgatatttttcttgtcgtg

SEQ ID NO: 459229 - DNA, 25 bp, Mus musculus
taagctcgccctatacctctgtgga

SEQ ID NO: 459230 - DNA, 25 bp, Mus musculus
taagctcgtgttgaagagaaggacc

SEQ ID NO: 459231 - DNA, 25 bp, Mus musculus
taagctcgttcagttaggcatggca

SEQ ID NO: 459232 - DNA, 25 bp, Mus musculus
taagctctacctcaaaggcaaggag

SEQ ID NO: 459233 - DNA, 25 bp, Mus musculus
taagctctcatttgggaagatggca

SEQ ID NO: 459234 - DNA, 25 bp, Mus musculus
taagctctgtatggtggccctgaag

SEQ ID NO: 459235 - DNA, 25 bp, Mus musculus
taagctctgtgatgtcagcctgccc

SEQ ID NO: 459236 - DNA, 25 bp, Mus musculus
taagctcttagcaaggaacactggg

SEQ ID NO: 459237 - DNA, 25 bp, Mus musculus
taagctcttggtagggacctgcaga

SEQ ID NO: 459238 - DNA, 25 bp, Mus musculus
taagctgaaatgtgacttctgggcc

SEQ ID NO: 459239 - DNA, 25 bp, Mus musculus
taagctgaaccggagccagcgagga

SEQ ID NO: 459240 - DNA, 25 bp, Mus musculus
taagctgaaggccattaaagcccgg

SEQ ID NO: 459241 - DNA, 25 bp, Mus musculus
taagctgaagtcttcctgggccaca

SEQ ID NO: 459242 - DNA, 25 bp, Mus musculus
taagctgacgtcatgaaggaacacc

SEQ ID NO: 459243 - DNA, 25 bp, Mus musculus
taagctgacttggtatgggaagccc

SEQ ID NO: 459244 - DNA, 25 bp, Mus musculus
taagctgagaaagtgccacaggctc

SEQ ID NO: 459245 - DNA, 25 bp, Mus musculus
taagctgagctttatacactgtgct

SEQ ID NO: 459246 - DNA, 25 bp, Mus musculus
taagctgcaccatgaatgagtccaa

SEQ ID NO: 459247 - DNA, 25 bp, Mus musculus
taagctgcatctatgagcagatcct

SEQ ID NO: 459248 - DNA, 25 bp, Mus musculus
taagctgccagaggatgtccactac

SEQ ID NO: 459249 - DNA, 25 bp, Mus musculus
taagctgcccgtatgtgaaagacaa

SEQ ID NO: 459250 - DNA, 25 bp, Mus musculus
taagctgctctatatccgcctggcg

SEQ ID NO: 459251 - DNA, 25 bp, Mus musculus
taagctgctggcgacttagaagaaa

SEQ ID NO: 459252 - DNA, 25 bp, Mus musculus
taagctggagaactggtcgctacag

SEQ ID NO: 459253 - DNA, 25 bp, Mus musculus
taagctggcgccctttgtcatccaa

SEQ ID NO: 459254 - DNA, 25 bp, Mus musculus
taagctgggccgagctgacggccgg

SEQ ID NO: 459255 - DNA, 25 bp, Mus musculus
taagctggttccttgggaccatcgt

SEQ ID NO: 459256 - DNA, 25 bp, Mus musculus
taagctgtaacaagtcgggaaagtc

SEQ ID NO: 459257 - DNA, 25 bp, Mus musculus
taagctgtctcaccaaactaccaag

SEQ ID NO: 459258 - DNA, 25 bp, Mus musculus
taagctgtcttccaacggcaatggc

SEQ ID NO: 459259 - DNA, 25 bp, Mus musculus
taagctgtgtctccacaagcgggac

SEQ ID NO: 459260 - DNA, 25 bp, Mus musculus
taagctgtgtgacaaaacatgccaa

SEQ ID NO: 459261 - DNA, 25 bp, Mus musculus
taagctgttcacattcagaagatgc

SEQ ID NO: 459262 - DNA, 25 bp, Mus musculus
taagctgtttggtggaggtagtcct

SEQ ID NO: 459263 - DNA, 25 bp, Mus musculus
taagctgttttgcaatggaggccca

SEQ ID NO: 459264 - DNA, 25 bp, Mus musculus
taagcttacaccaaacatgctgcga

SEQ ID NO: 459265 - DNA, 25 bp, Mus musculus
taagcttagcccttgcagcagcagc

SEQ ID NO: 459266 - DNA, 25 bp, Mus musculus
taagcttaggtgtcccacatggctg

SEQ ID NO: 459267 - DNA, 25 bp, Mus musculus
taagcttccaggtatccagccttgg

SEQ ID NO: 459268 - DNA, 25 bp, Mus musculus
taagcttcccaggagacgtgtcaac

SEQ ID NO: 459269 - DNA, 25 bp, Mus musculus
taagcttccgggacatcaaacggac

SEQ ID NO: 459270 - DNA, 25 bp, Mus musculus
taagcttcggaagaaccacatgtgg

SEQ ID NO: 459271 - DNA, 25 bp, Mus musculus
taagcttctggatgagaatgccaac

SEQ ID NO: 459272 - DNA, 25 bp, Mus musculus
taagcttctggtgtgaaatctgtcc

SEQ ID NO: 459273 - DNA, 25 bp, Mus musculus
taagcttgaaatgagttgtttgtca

SEQ ID NO: 459274 - DNA, 25 bp, Mus musculus
taagcttgcatgctgggtttgccga

SEQ ID NO: 459275 - DNA, 25 bp, Mus musculus
taagcttgccttaaatcgtttgaac

SEQ ID NO: 459276 - DNA, 25 bp, Mus musculus
taagcttgtcccacgtagagagaga

SEQ ID NO: 459277 - DNA, 25 bp, Mus musculus
taagctttcggaacccttgactgca

SEQ ID NO: 459278 - DNA, 25 bp, Mus musculus
taagctttgctcctgtggctccgaa

SEQ ID NO: 459279 - DNA, 25 bp, Mus musculus
taagctttggttcatggtgggacct

SEQ ID NO: 459280 - DNA, 25 bp, Mus musculus
taaggaaaatcatccgggctcgaga

SEQ ID NO: 459281 - DNA, 25 bp, Mus musculus
taaggaaaattaccagagcaccctg

SEQ ID NO: 459282 - DNA, 25 bp, Mus musculus
taaggaaacctttggctcagcattg

SEQ ID NO: 459283 - DNA, 25 bp, Mus musculus
taaggaaacgcctgggttgcaagtc

SEQ ID NO: 459284 - DNA, 25 bp, Mus musculus
taaggaaattctgcgactgatccag

SEQ ID NO: 459285 - DNA, 25 bp, Mus musculus
taaggaaattgaatagccacagctg

SEQ ID NO: 459286 - DNA, 25 bp, Mus musculus
taaggaacaggaatgtcgcaacatc

SEQ ID NO: 459287 - DNA, 25 bp, Mus musculus
taaggaacaggtcctctgggagcca

SEQ ID NO: 459288 - DNA, 25 bp, Mus musculus
taaggaaccaattccactcttcggg

SEQ ID NO: 459289 - DNA, 25 bp, Mus musculus
taaggaaccacacgtacttatgctg

SEQ ID NO: 459290 - DNA, 25 bp, Mus musculus
taaggaacccatctagctgcatgca

SEQ ID NO: 459291 - DNA, 25 bp, Mus musculus
taaggaacgcaaactagagcagcgg

SEQ ID NO: 459292 - DNA, 25 bp, Mus musculus
taaggaacgccagctacttgcaatg

SEQ ID NO: 459293 - DNA, 25 bp, Mus musculus
taaggaactgccaatcacgtgaccg

SEQ ID NO: 459294 - DNA, 25 bp, Mus musculus
taaggaagacatgtgcttagcagac

SEQ ID NO: 459295 - DNA, 25 bp, Mus musculus
taaggaagcagtttacgctcccacc

SEQ ID NO: 459296 - DNA, 25 bp, Mus musculus
taaggaaggcgagagcccagtgtct

SEQ ID NO: 459297 - DNA, 25 bp, Mus musculus
taaggaataatcagctgtatcctgg

SEQ ID NO: 459298 - DNA, 25 bp, Mus musculus
taaggaatatcaccggtctgtggcc

SEQ ID NO: 459299 - DNA, 25 bp, Mus musculus
taaggaatcctagtttgctcctgaa

SEQ ID NO: 459300 - DNA, 25 bp, Mus musculus
taaggaatcctgcagaacatgtccg

SEQ ID NO: 459301 - DNA, 25 bp, Mus musculus
taaggaatctggtcaagtggttgca

SEQ ID NO: 459302 - DNA, 25 bp, Mus musculus
taaggacaacagtgctaggagtgac

SEQ ID NO: 459303 - DNA, 25 bp, Mus musculus
taaggacacttggacgatgctggcc

SEQ ID NO: 459304 - DNA, 25 bp, Mus musculus
taaggacagcaggattctgtggcaa

SEQ ID NO: 459305 - DNA, 25 bp, Mus musculus
taaggacatccgcagccccgtagct

SEQ ID NO: 459306 - DNA, 25 bp, Mus musculus
taaggacatgatcaccaggatggac

SEQ ID NO: 459307 - DNA, 25 bp, Mus musculus
taaggacccctataccctgcaatgg

SEQ ID NO: 459308 - DNA, 25 bp, Mus musculus
taaggacccctgaagacacagctga

SEQ ID NO: 459309 - DNA, 25 bp, Mus musculus
taaggacccgagacaatgaattcct

SEQ ID NO: 459310 - DNA, 25 bp, Mus musculus
taaggaccctcctcggatggcatag

SEQ ID NO: 459311 - DNA, 25 bp, Mus musculus
taaggaccctggaattcagtgtgag

SEQ ID NO: 459312 - DNA, 25 bp, Mus musculus
taaggaccctggattcctccactga

SEQ ID NO: 459313 - DNA, 25 bp, Mus musculus
taaggacctagttcatcacctgtgc

SEQ ID NO: 459314 - DNA, 25 bp, Mus musculus
taaggacctcagatcccaggtggtc

SEQ ID NO: 459315 - DNA, 25 bp, Mus musculus
taaggacctcagtagttttcaaata

SEQ ID NO: 459316 - DNA, 25 bp, Mus musculus
taaggaccttggcacgcagttagca

SEQ ID NO: 459317 - DNA, 25 bp, Mus musculus
taaggacgacggcatttcctggagc

SEQ ID NO: 459318 - DNA, 25 bp, Mus musculus
taaggacgtgaagctgccagtgcag

SEQ ID NO: 459319 - DNA, 25 bp, Mus musculus
taaggacgtgcaagccatgaaagcc

SEQ ID NO: 459320 - DNA, 25 bp, Mus musculus
taaggactaaacagggtcggcgcct

SEQ ID NO: 459321 - DNA, 25 bp, Mus musculus
taaggactacttgcatacagtggag

SEQ ID NO: 459322 - DNA, 25 bp, Mus musculus
taaggactatatcagacctcggttc

SEQ ID NO: 459323 - DNA, 25 bp, Mus musculus
taaggactcaggtccagcactggca

SEQ ID NO: 459324 - DNA, 25 bp, Mus musculus
taaggactgagccttagggacccat

SEQ ID NO: 459325 - DNA, 25 bp, Mus musculus
taaggactgaggacccattatcagc

SEQ ID NO: 459326 - DNA, 25 bp, Mus musculus
taaggactgccatccaaattcatca

SEQ ID NO: 459327 - DNA, 25 bp, Mus musculus
taaggacttcggtgcaacttccggt

SEQ ID NO: 459328 - DNA, 25 bp, Mus musculus
taaggacttctgcagagacgttggc

SEQ ID NO: 459329 - DNA, 25 bp, Mus musculus
taaggacttgctgcacttaggaggc

SEQ ID NO: 459330 - DNA, 25 bp, Mus musculus
taaggagaagattggccccagcaag

SEQ ID NO: 459331 - DNA, 25 bp, Mus musculus
taaggagaagtttgatgccaccatg

SEQ ID NO: 459332 - DNA, 25 bp, Mus musculus
taaggagactccataccagtgtctg

SEQ ID NO: 459333 - DNA, 25 bp, Mus musculus
taaggagactgccacacagagtgtt

SEQ ID NO: 459334 - DNA, 25 bp, Mus musculus
taaggagagtatccaaacccttggc

SEQ ID NO: 459335 - DNA, 25 bp, Mus musculus
taaggagagtggcactacagacgcc

SEQ ID NO: 459336 - DNA, 25 bp, Mus musculus
taaggagcaccagttacagaatgga

SEQ ID NO: 459337 - DNA, 25 bp, Mus musculus
taaggagcagaaaggtcaacaggct

SEQ ID NO: 459338 - DNA, 25 bp, Mus musculus
taaggagcccatgaaaatcagcggg

SEQ ID NO: 459339 - DNA, 25 bp, Mus musculus
taaggagccctgaactctgcagtgc

SEQ ID NO: 459340 - DNA, 25 bp, Mus musculus
taaggagctacctgtcaacgcacaa

SEQ ID NO: 459341 - DNA, 25 bp, Mus musculus
taaggagctccagggatatccaggc

SEQ ID NO: 459342 - DNA, 25 bp, Mus musculus
taaggagctggataagaatggcgat

SEQ ID NO: 459343 - DNA, 25 bp, Mus musculus
taaggagcttgaacagagcctgctc

SEQ ID NO: 459344 - DNA, 25 bp, Mus musculus
taaggaggatacactttccacaggt

SEQ ID NO: 459345 - DNA, 25 bp, Mus musculus
taaggagggacatagaggcagacta

SEQ ID NO: 459346 - DNA, 25 bp, Mus musculus
taaggagtcaagtgccacggtcgac

SEQ ID NO: 459347 - DNA, 25 bp, Mus musculus
taaggagtgacagatctcgaagctg

SEQ ID NO: 459348 - DNA, 25 bp, Mus musculus
taaggagtgccgcaagttcttccgc

SEQ ID NO: 459349 - DNA, 25 bp, Mus musculus
taaggataagccatggtcccagagg

SEQ ID NO: 459350 - DNA, 25 bp, Mus musculus
taaggataagtttctgaggactgca

SEQ ID NO: 459351 - DNA, 25 bp, Mus musculus
taaggatagtggagctaggcagtct

SEQ ID NO: 459352 - DNA, 25 bp, Mus musculus
taaggatcaccacacagttgctagg

SEQ ID NO: 459353 - DNA, 25 bp, Mus musculus
taaggatcctgctcagaccatacct

SEQ ID NO: 459354 - DNA, 25 bp, Mus musculus
taaggatcttcgaccacgagcaagg

SEQ ID NO: 459355 - DNA, 25 bp, Mus musculus
taaggatgaccataacctccatgag

SEQ ID NO: 459356 - DNA, 25 bp, Mus musculus
taaggatgaccttatgtcactcagc

SEQ ID NO: 459357 - DNA, 25 bp, Mus musculus
taaggatgccaaccagaaaaaccag

SEQ ID NO: 459358 - DNA, 25 bp, Mus musculus
taaggatgccagatggctgctacgc

SEQ ID NO: 459359 - DNA, 25 bp, Mus musculus
taaggatgcccaggttcccatggct

SEQ ID NO: 459360 - DNA, 25 bp, Mus musculus
taaggatgcctgctggtttcacatg

SEQ ID NO: 459361 - DNA, 25 bp, Mus musculus
taaggatgctcacttgggttcaggt

SEQ ID NO: 459362 - DNA, 25 bp, Mus musculus
taaggatgctcctgggattacacat

SEQ ID NO: 459363 - DNA, 25 bp, Mus musculus
taaggatgctggcttgttggctccc

SEQ ID NO: 459364 - DNA, 25 bp, Mus musculus
taaggatggagggtgtaaccactct

SEQ ID NO: 459365 - DNA, 25 bp, Mus musculus
taaggatggccaaagaatcacctgt

SEQ ID NO: 459366 - DNA, 25 bp, Mus musculus
taaggatggccatatcagcgtcgag

SEQ ID NO: 459367 - DNA, 25 bp, Mus musculus
taaggatggttcacctccacgtgct

SEQ ID NO: 459368 - DNA, 25 bp, Mus musculus
taaggatgtctccaacagagcacag

SEQ ID NO: 459369 - DNA, 25 bp, Mus musculus
taaggattggaaggcacacctctgt

SEQ ID NO: 459370 - DNA, 25 bp, Mus musculus
taaggattggagcagcaaccgactg

SEQ ID NO: 459371 - DNA, 25 bp, Mus musculus
taaggatttggtatatacaatatgc

SEQ ID NO: 459372 - DNA, 25 bp, Mus musculus
taaggatttttgcagtcaatcatgc

SEQ ID NO: 459373 - DNA, 25 bp, Mus musculus
taaggcaatgactcgaagtctgcag

SEQ ID NO: 459374 - DNA, 25 bp, Mus musculus
taaggcacaaagttccgtaccagct

SEQ ID NO: 459375 - DNA, 25 bp, Mus musculus
taaggcacatggctaaagacacaga

SEQ ID NO: 459376 - DNA, 25 bp, Mus musculus
taaggcagactgacccacatgttct

SEQ ID NO: 459377 - DNA, 25 bp, Mus musculus
taaggcagagtatcacgtgagcgtc

SEQ ID NO: 459378 - DNA, 25 bp, Mus musculus
taaggcagataacttatggcctagt

SEQ ID NO: 459379 - DNA, 25 bp, Mus musculus
taaggcagcatccaagtcactgaga

SEQ ID NO: 459380 - DNA, 25 bp, Mus musculus
taaggcagcggatgaccctgagatt

SEQ ID NO: 459381 - DNA, 25 bp, Mus musculus
taaggcaggagctaacctcctcaat

SEQ ID NO: 459382 - DNA, 25 bp, Mus musculus
taaggcagtcctccaggccaatgat

SEQ ID NO: 459383 - DNA, 25 bp, Mus musculus
taaggccaaacgctgtgaaaacgac

SEQ ID NO: 459384 - DNA, 25 bp, Mus musculus
taaggccaagctttgcacaccggtt

SEQ ID NO: 459385 - DNA, 25 bp, Mus musculus
taaggccaagtcaataagcgggctt

SEQ ID NO: 459386 - DNA, 25 bp, Mus musculus
taaggccacagaccaggcagttaga

SEQ ID NO: 459387 - DNA, 25 bp, Mus musculus
taaggccaccgttcaaaaaattcag

SEQ ID NO: 459388 - DNA, 25 bp, Mus musculus
taaggccacgctctgtagctagcat

SEQ ID NO: 459389 - DNA, 25 bp, Mus musculus
taaggccagactatgcagactccaa

SEQ ID NO: 459390 - DNA, 25 bp, Mus musculus
taaggccagcctatgaatcggtctc

SEQ ID NO: 459391 - DNA, 25 bp, Mus musculus
taaggccagcggtgttcacaggatc

SEQ ID NO: 459392 - DNA, 25 bp, Mus musculus
taaggccagctaggatgacagtgaa

SEQ ID NO: 459393 - DNA, 25 bp, Mus musculus
taaggccaggtctctggaggaccct

SEQ ID NO: 459394 - DNA, 25 bp, Mus musculus
taaggccagtattgaagaccgttgt

SEQ ID NO: 459395 - DNA, 25 bp, Mus musculus
taaggccatgttcgaggaagcgtac

SEQ ID NO: 459396 - DNA, 25 bp, Mus musculus
taaggccccagtctctcaattatga

SEQ ID NO: 459397 - DNA, 25 bp, Mus musculus
taaggcccttccttcgcgtgcatgg

SEQ ID NO: 459398 - DNA, 25 bp, Mus musculus
taaggccgtattaccagctgtgtgt

SEQ ID NO: 459399 - DNA, 25 bp, Mus musculus
taaggccgtgtctattcaggtcaga

SEQ ID NO: 459400 - DNA, 25 bp, Mus musculus
taaggcctcagcaggacccaggact

SEQ ID NO: 459401 - DNA, 25 bp, Mus musculus
taaggcctcttcacaagtcaacgtg

SEQ ID NO: 459402 - DNA, 25 bp, Mus musculus
taaggccttaggctctagcccagca

SEQ ID NO: 459403 - DNA, 25 bp, Mus musculus
taaggccttcgccatgatcatcgac

SEQ ID NO: 459404 - DNA, 25 bp, Mus musculus
taaggccttgttggtcctcgctcgg

SEQ ID NO: 459405 - DNA, 25 bp, Mus musculus
taaggcgagacctatttgacaaggg

SEQ ID NO: 459406 - DNA, 25 bp, Mus musculus
taaggcgcccctgaagagattcaat

SEQ ID NO: 459407 - DNA, 25 bp, Mus musculus
taaggcgcctaaggccaggtctctg

SEQ ID NO: 459408 - DNA, 25 bp, Mus musculus
taaggcgccttcctgtgtcgtcgtg

SEQ ID NO: 459409 - DNA, 25 bp, Mus musculus
taaggcggatgactctcacacggtg

SEQ ID NO: 459410 - DNA, 25 bp, Mus musculus
taaggcggccttctctgactacaga

SEQ ID NO: 459411 - DNA, 25 bp, Mus musculus
taaggcggccttttcttatagatca

SEQ ID NO: 459412 - DNA, 25 bp, Mus musculus
taaggcgtacccctctggataggtg

SEQ ID NO: 459413 - DNA, 25 bp, Mus musculus
taaggcgtcaaggagtgtgcatcag

SEQ ID NO: 459414 - DNA, 25 bp, Mus musculus
taaggctacacgtttaatatgagag

SEQ ID NO: 459415 - DNA, 25 bp, Mus musculus
taaggctatctcgtgaatgatggat

SEQ ID NO: 459416 - DNA, 25 bp, Mus musculus
taaggctcaaggaacgtctatagat

SEQ ID NO: 459417 - DNA, 25 bp, Mus musculus
taaggctcccttggacatctcgtgg

SEQ ID NO: 459418 - DNA, 25 bp, Mus musculus
taaggctcctgtttatgcgtacatg

SEQ ID NO: 459419 - DNA, 25 bp, Mus musculus
taaggctcgccttgctaaacttcga

SEQ ID NO: 459420 - DNA, 25 bp, Mus musculus
taaggctcggctgtctagaaaaaca

SEQ ID NO: 459421 - DNA, 25 bp, Mus musculus
taaggctctgggttaatcaactaca

SEQ ID NO: 459422 - DNA, 25 bp, Mus musculus
taaggctctgtttagagacctggct

SEQ ID NO: 459423 - DNA, 25 bp, Mus musculus
taaggctgacagctgtgactgacag

SEQ ID NO: 459424 - DNA, 25 bp, Mus musculus
taaggctgatgtctctgccagagcg

SEQ ID NO: 459425 - DNA, 25 bp, Mus musculus
taaggctgcacgagtcctgcttggg

SEQ ID NO: 459426 - DNA, 25 bp, Mus musculus
taaggctgcttcagcagagctcaca

SEQ ID NO: 459427 - DNA, 25 bp, Mus musculus
taaggctggcaaagcaaagtgactc

SEQ ID NO: 459428 - DNA, 25 bp, Mus musculus
taaggctggcatccaaataattctg

SEQ ID NO: 459429 - DNA, 25 bp, Mus musculus
taaggctggccacacttgagagctg

SEQ ID NO: 459430 - DNA, 25 bp, Mus musculus
taaggctgggcagaatcttgataca

SEQ ID NO: 459431 - DNA, 25 bp, Mus musculus
taaggctgtacccagcaaaaagggc

SEQ ID NO: 459432 - DNA, 25 bp, Mus musculus
taaggctgtcaaaaggcccaacgag

SEQ ID NO: 459433 - DNA, 25 bp, Mus musculus
taaggcttaccgaggctttcttgaa

SEQ ID NO: 459434 - DNA, 25 bp, Mus musculus
taaggcttagttacccgggtgcaca

SEQ ID NO: 459435 - DNA, 25 bp, Mus musculus
taaggcttcagaccttgacggcgac

SEQ ID NO: 459436 - DNA, 25 bp, Mus musculus
taaggcttcgcccatggcatctaag

SEQ ID NO: 459437 - DNA, 25 bp, Mus musculus
taaggcttctacagtgacacaagga

SEQ ID NO: 459438 - DNA, 25 bp, Mus musculus
taaggcttgaagtttcagccagggc

SEQ ID NO: 459439 - DNA, 25 bp, Mus musculus
taaggcttgtttaaccctgctgaag

SEQ ID NO: 459440 - DNA, 25 bp, Mus musculus
taagggaaaccgtgctgctgtggct

SEQ ID NO: 459441 - DNA, 25 bp, Mus musculus
taagggaaccatttcactgccggac

SEQ ID NO: 459442 - DNA, 25 bp, Mus musculus
taagggaacctttatggccatctga

SEQ ID NO: 459443 - DNA, 25 bp, Mus musculus
taagggaagagagatgagtgtcagc

SEQ ID NO: 459444 - DNA, 25 bp, Mus musculus
taagggaagcagcacacatatggct

SEQ ID NO: 459445 - DNA, 25 bp, Mus musculus
taagggaagctctggtgaaccaagc

SEQ ID NO: 459446 - DNA, 25 bp, Mus musculus
taagggacagatgctaattgggtat

SEQ ID NO: 459447 - DNA, 25 bp, Mus musculus
taagggacagctcatcaaagcctgc

SEQ ID NO: 459448 - DNA, 25 bp, Mus musculus
taagggacgccaataagagctagtg

SEQ ID NO: 459449 - DNA, 25 bp, Mus musculus
taagggactctagattccaaggcta

SEQ ID NO: 459450 - DNA, 25 bp, Mus musculus
taagggagccctaaggagtcgctgc

SEQ ID NO: 459451 - DNA, 25 bp, Mus musculus
taagggaggccatgccagccttttt

SEQ ID NO: 459452 - DNA, 25 bp, Mus musculus
taagggagggtgcatctcacactgc

SEQ ID NO: 459453 - DNA, 25 bp, Mus musculus
taagggagtttgcagatacctcagg

SEQ ID NO: 459454 - DNA, 25 bp, Mus musculus
taagggatagaggaggacctcctcc

SEQ ID NO: 459455 - DNA, 25 bp, Mus musculus
taagggataggaacttgatcaatca

SEQ ID NO: 459456 - DNA, 25 bp, Mus musculus
taagggattccgagactccactggc

SEQ ID NO: 459457 - DNA, 25 bp, Mus musculus
taagggcaactgtaggactgagcgt

SEQ ID NO: 459458 - DNA, 25 bp, Mus musculus
taagggcaacttggctagtcaccgc

SEQ ID NO: 459459 - DNA, 25 bp, Mus musculus
taagggcaagtatgggcagttcagc

SEQ ID NO: 459460 - DNA, 25 bp, Mus musculus
taagggcacattttagcggacaaga

SEQ ID NO: 459461 - DNA, 25 bp, Mus musculus
taagggcacgtgactctcttgcaga

SEQ ID NO: 459462 - DNA, 25 bp, Mus musculus
taagggcagtgtgatcagaatacga

SEQ ID NO: 459463 - DNA, 25 bp, Mus musculus
taagggccagaagattgtgtcctgc

SEQ ID NO: 459464 - DNA, 25 bp, Mus musculus
taagggccagtatgttgaccatgcc

SEQ ID NO: 459465 - DNA, 25 bp, Mus musculus
taagggccatacctctctcaaggag

SEQ ID NO: 459466 - DNA, 25 bp, Mus musculus
taagggccccaaagaaaatgcacat

SEQ ID NO: 459467 - DNA, 25 bp, Mus musculus
taagggcctgtgtgagccacggata

SEQ ID NO: 459468 - DNA, 25 bp, Mus musculus
taagggcgaactggattacgaagac

SEQ ID NO: 459469 - DNA, 25 bp, Mus musculus
taagggctctcctgccatctctggg

SEQ ID NO: 459470 - DNA, 25 bp, Mus musculus
taagggctgcgcacaactatgaacg

SEQ ID NO: 459471 - DNA, 25 bp, Mus musculus
taagggctggctactggactgaagc

SEQ ID NO: 459472 - DNA, 25 bp, Mus musculus
taagggcttagacccaccaggtgct

SEQ ID NO: 459473 - DNA, 25 bp, Mus musculus
taagggctttcgtcacagcgatgcc

SEQ ID NO: 459474 - DNA, 25 bp, Mus musculus
taagggctttggtacctgggctatc

SEQ ID NO: 459475 - DNA, 25 bp, Mus musculus
taagggtctctccagggcacactgg

SEQ ID NO: 459476 - DNA, 25 bp, Mus musculus
taagggtctggatccaaattatacg

SEQ ID NO: 459477 - DNA, 25 bp, Mus musculus
taagggtctgggactcagcatgctt

SEQ ID NO: 459478 - DNA, 25 bp, Mus musculus
taagggtctgtcaaacaatcttgcc

SEQ ID NO: 459479 - DNA, 25 bp, Mus musculus
taagggtgcaatggcagtgtcagcc

SEQ ID NO: 459480 - DNA, 25 bp, Mus musculus
taagggtggccgaagaacttatgca

SEQ ID NO: 459481 - DNA, 25 bp, Mus musculus
taagggtggctctgtagcttcttgg

SEQ ID NO: 459482 - DNA, 25 bp, Mus musculus
taagggttagccaactataaggact

SEQ ID NO: 459483 - DNA, 25 bp, Mus musculus
taagggttccagaaacctgagcgtg

SEQ ID NO: 459484 - DNA, 25 bp, Mus musculus
taagggttcctatgagagcgcacgc

SEQ ID NO: 459485 - DNA, 25 bp, Mus musculus
taagggtttccgttggagctcaggc

SEQ ID NO: 459486 - DNA, 25 bp, Mus musculus
taagggtttcgtgtcggctgggcac

SEQ ID NO: 459487 - DNA, 25 bp, Mus musculus
taaggtaccaacactccagaatcgc

SEQ ID NO: 459488 - DNA, 25 bp, Mus musculus
taaggtagaaatgcagcagcctctc

SEQ ID NO: 459489 - DNA, 25 bp, Mus musculus
taaggtagcctgtgttagggccctg

SEQ ID NO: 459490 - DNA, 25 bp, Mus musculus
taaggtcaacatagactatacagcg

SEQ ID NO: 459491 - DNA, 25 bp, Mus musculus
taaggtcaagtttacagtgcacacc

SEQ ID NO: 459492 - DNA, 25 bp, Mus musculus
taaggtcacatgtctgaagcacagg

SEQ ID NO: 459493 - DNA, 25 bp, Mus musculus
taaggtcaccgggttgcaacggaga

SEQ ID NO: 459494 - DNA, 25 bp, Mus musculus
taaggtcacttgtagcatgtccagc

SEQ ID NO: 459495 - DNA, 25 bp, Mus musculus
taaggtcatcctgcgagtccaaggg

SEQ ID NO: 459496 - DNA, 25 bp, Mus musculus
taaggtcatctctcttccgggaagc

SEQ ID NO: 459497 - DNA, 25 bp, Mus musculus
taaggtcattctacttgcctcaaga

SEQ ID NO: 459498 - DNA, 25 bp, Mus musculus
taaggtccactacaatgtcgagttc

SEQ ID NO: 459499 - DNA, 25 bp, Mus musculus
taaggtcccagcaccaacttgagct

SEQ ID NO: 459500 - DNA, 25 bp, Mus musculus
taaggtccccttgatgacactgcag

SEQ ID NO: 459501 - DNA, 25 bp, Mus musculus
taaggtcccgttgcgtttgggctgc

SEQ ID NO: 459502 - DNA, 25 bp, Mus musculus
taaggtccctgccttgcctctaagg

SEQ ID NO: 459503 - DNA, 25 bp, Mus musculus
taaggtcctcattgcagtctcctgg

SEQ ID NO: 459504 - DNA, 25 bp, Mus musculus
taaggtcctgctgcacatgtctggg

SEQ ID NO: 459505 - DNA, 25 bp, Mus musculus
taaggtcctggcaactcagtaacag

SEQ ID NO: 459506 - DNA, 25 bp, Mus musculus
taaggtccttgtgagcccacgttgt

SEQ ID NO: 459507 - DNA, 25 bp, Mus musculus
taaggtctcgccatatagcccaggc

SEQ ID NO: 459508 - DNA, 25 bp, Mus musculus
taaggtctgactggaccagaggccc

SEQ ID NO: 459509 - DNA, 25 bp, Mus musculus
taaggtcttcggtgtacagctctcc

SEQ ID NO: 459510 - DNA, 25 bp, Mus musculus
taaggtctttctcggaaggcgactc

SEQ ID NO: 459511 - DNA, 25 bp, Mus musculus
taaggtgaccacagctgcgagctac

SEQ ID NO: 459512 - DNA, 25 bp, Mus musculus
taaggtgacttgtcttctagtgagc

SEQ ID NO: 459513 - DNA, 25 bp, Mus musculus
taaggtgataggtacaaggtgagct

SEQ ID NO: 459514 - DNA, 25 bp, Mus musculus
taaggtgatggcagagcctttctcg

SEQ ID NO: 459515 - DNA, 25 bp, Mus musculus
taaggtgattttccctgacgcagag

SEQ ID NO: 459516 - DNA, 25 bp, Mus musculus
taaggtgccactgctcctacaagca

SEQ ID NO: 459517 - DNA, 25 bp, Mus musculus
taaggtgccatggaacaggttgttc

SEQ ID NO: 459518 - DNA, 25 bp, Mus musculus
taaggtgcccagaataaaagctaac

SEQ ID NO: 459519 - DNA, 25 bp, Mus musculus
taaggtgcccttattgcttccaaat

SEQ ID NO: 459520 - DNA, 25 bp, Mus musculus
taaggtgcctattgggtcccaaagc

SEQ ID NO: 459521 - DNA, 25 bp, Mus musculus
taaggtgctcactcagatgggctcc

SEQ ID NO: 459522 - DNA, 25 bp, Mus musculus
taaggtggcatcagagacagaggcc

SEQ ID NO: 459523 - DNA, 25 bp, Mus musculus
taaggtggctgaatcctctgcatca

SEQ ID NO: 459524 - DNA, 25 bp, Mus musculus
taaggtgggactccaagtacctgac

SEQ ID NO: 459525 - DNA, 25 bp, Mus musculus
taaggtggtcaaaggcaaggccgaa

SEQ ID NO: 459526 - DNA, 25 bp, Mus musculus
taaggtggtccacatcagaacgctg

SEQ ID NO: 459527 - DNA, 25 bp, Mus musculus
taaggtggtcttttcccagcaggaa

SEQ ID NO: 459528 - DNA, 25 bp, Mus musculus
taaggtgtaccgttctcagagcgag

SEQ ID NO: 459529 - DNA, 25 bp, Mus musculus
taaggtgtgcgcaaacaggacaagt

SEQ ID NO: 459530 - DNA, 25 bp, Mus musculus
taaggttatccacagatggctcccc

SEQ ID NO: 459531 - DNA, 25 bp, Mus musculus
taaggttcactacgatcctgagaag

SEQ ID NO: 459532 - DNA, 25 bp, Mus musculus
taaggttcccaacgcctgcttgttc

SEQ ID NO: 459533 - DNA, 25 bp, Mus musculus
taaggttccccatggatctgaaaac

SEQ ID NO: 459534 - DNA, 25 bp, Mus musculus
taaggttcccctagtccgctgttgt

SEQ ID NO: 459535 - DNA, 25 bp, Mus musculus
taaggttcggaggttacacacagca

SEQ ID NO: 459536 - DNA, 25 bp, Mus musculus
taaggttctcatatctgttgactgc

SEQ ID NO: 459537 - DNA, 25 bp, Mus musculus
taaggttctgcactttcatacaccc

SEQ ID NO: 459538 - DNA, 25 bp, Mus musculus
taaggttggagggaaccgactcaga

SEQ ID NO: 459539 - DNA, 25 bp, Mus musculus
taagtaaagacacggctgagaggct

SEQ ID NO: 459540 - DNA, 25 bp, Mus musculus
taagtaacaataccacactgcatgg

SEQ ID NO: 459541 - DNA, 25 bp, Mus musculus
taagtaaccatcaccggagtcagcc

SEQ ID NO: 459542 - DNA, 25 bp, Mus musculus
taagtaacccgcttcgcagtgcgtg

SEQ ID NO: 459543 - DNA, 25 bp, Mus musculus
taagtaagacttccaaagtgcggcc

SEQ ID NO: 459544 - DNA, 25 bp, Mus musculus
taagtaagcattctaccacagagcc

SEQ ID NO: 459545 - DNA, 25 bp, Mus musculus
taagtaagccacacgggcagatgca

SEQ ID NO: 459546 - DNA, 25 bp, Mus musculus
taagtaaggaattgccagccaggat

SEQ ID NO: 459547 - DNA, 25 bp, Mus musculus
taagtaaggtaagtgtgagcctccc

SEQ ID NO: 459548 - DNA, 25 bp, Mus musculus
taagtaagtagaagtgatcattccc

SEQ ID NO: 459549 - DNA, 25 bp, Mus musculus
taagtacaacagctgacacgggcaa

SEQ ID NO: 459550 - DNA, 25 bp, Mus musculus
taagtacaagctgcacgctcatgag

SEQ ID NO: 459551 - DNA, 25 bp, Mus musculus
taagtacaaggtggaagccatctcc

SEQ ID NO: 459552 - DNA, 25 bp, Mus musculus
taagtacacgcttcccggaggcttg

SEQ ID NO: 459553 - DNA, 25 bp, Mus musculus
taagtacagttctctatgaccaggc

SEQ ID NO: 459554 - DNA, 25 bp, Mus musculus
taagtacccgcagcagttggaaagc

SEQ ID NO: 459555 - DNA, 25 bp, Mus musculus
taagtaccgcagtgggaaactgccc

SEQ ID NO: 459556 - DNA, 25 bp, Mus musculus
taagtaccgccatgagaagaacgag

SEQ ID NO: 459557 - DNA, 25 bp, Mus musculus
taagtacctaactagagcccgacgc

SEQ ID NO: 459558 - DNA, 25 bp, Mus musculus
taagtacctcagcaatggcccagga

SEQ ID NO: 459559 - DNA, 25 bp, Mus musculus
taagtacgggaacctcagtgctctg

SEQ ID NO: 459560 - DNA, 25 bp, Mus musculus
taagtacgtcgccaaattccaggga

SEQ ID NO: 459561 - DNA, 25 bp, Mus musculus
taagtactatgtcctctccctttcc

SEQ ID NO: 459562 - DNA, 25 bp, Mus musculus
taagtactggagcactaatgcccac

SEQ ID NO: 459563 - DNA, 25 bp, Mus musculus
taagtagaatcggaccagcatggac

SEQ ID NO: 459564 - DNA, 25 bp, Mus musculus
taagtagatacccataaccgaaagg

SEQ ID NO: 459565 - DNA, 25 bp, Mus musculus
taagtagatccgtagacctccgtcc

SEQ ID NO: 459566 - DNA, 25 bp, Mus musculus
taagtagatctaggcctgtggcagc

SEQ ID NO: 459567 - DNA, 25 bp, Mus musculus
taagtagcagaccttcgctcacgct

SEQ ID NO: 459568 - DNA, 25 bp, Mus musculus
taagtagcatcagccaaccaggaag

SEQ ID NO: 459569 - DNA, 25 bp, Mus musculus
taagtagccacattgtcatttccac

SEQ ID NO: 459570 - DNA, 25 bp, Mus musculus
taagtagcttttcgcaggccactgg

SEQ ID NO: 459571 - DNA, 25 bp, Mus musculus
taagtagggttaggcatttgaagct

SEQ ID NO: 459572 - DNA, 25 bp, Mus musculus
taagtagtacagtgaagagctcagc

SEQ ID NO: 459573 - DNA, 25 bp, Mus musculus
taagtagtcatcttgcacctgtgct

SEQ ID NO: 459574 - DNA, 25 bp, Mus musculus
taagtatacccatgaagagttcaca

SEQ ID NO: 459575 - DNA, 25 bp, Mus musculus
taagtatactgagaagggccggtgc

SEQ ID NO: 459576 - DNA, 25 bp, Mus musculus
taagtatccccaagctgactcggag

SEQ ID NO: 459577 - DNA, 25 bp, Mus musculus
taagtatgattgtcctgttgccagt

SEQ ID NO: 459578 - DNA, 25 bp, Mus musculus
taagtatgcacactcctgagagagg

SEQ ID NO: 459579 - DNA, 25 bp, Mus musculus
taagtatgccatcgtagtgacagag

SEQ ID NO: 459580 - DNA, 25 bp, Mus musculus
taagtattgcatagctttgcgccgt

SEQ ID NO: 459581 - DNA, 25 bp, Mus musculus
taagtattgtaccttcagcgtgcag

SEQ ID NO: 459582 - DNA, 25 bp, Mus musculus
taagtcaaaattgcaaagtccttgt

SEQ ID NO: 459583 - DNA, 25 bp, Mus musculus
taagtcaagcaatgcagggacatgg

SEQ ID NO: 459584 - DNA, 25 bp, Mus musculus
taagtcaaggatgattgtacacaac

SEQ ID NO: 459585 - DNA, 25 bp, Mus musculus
taagtcaaggcctcccgttgtatcc

SEQ ID NO: 459586 - DNA, 25 bp, Mus musculus
taagtcaagtgtgctcccgtgtgag

SEQ ID NO: 459587 - DNA, 25 bp, Mus musculus
taagtcacctcattagagaaccaag

SEQ ID NO: 459588 - DNA, 25 bp, Mus musculus
taagtcaccttttaaggcagtctca

SEQ ID NO: 459589 - DNA, 25 bp, Mus musculus
taagtcacgtgcagagtggtgcgct

SEQ ID NO: 459590 - DNA, 25 bp, Mus musculus
taagtcacgtgttttcacctgcccg

SEQ ID NO: 459591 - DNA, 25 bp, Mus musculus
taagtcagactggatcacgggccta

SEQ ID NO: 459592 - DNA, 25 bp, Mus musculus
taagtcagactttgtggtgcctcca

SEQ ID NO: 459593 - DNA, 25 bp, Mus musculus
taagtcagaggtatgcttcccgtga

SEQ ID NO: 459594 - DNA, 25 bp, Mus musculus
taagtcagcctgcagcataaccctc

SEQ ID NO: 459595 - DNA, 25 bp, Mus musculus
taagtcagcctttacggtgcagccc

SEQ ID NO: 459596 - DNA, 25 bp, Mus musculus
taagtcagctgcctaacttctggaa

SEQ ID NO: 459597 - DNA, 25 bp, Mus musculus
taagtcagtctcacctggctaggag

SEQ ID NO: 459598 - DNA, 25 bp, Mus musculus
taagtcatactagtgtctgcaggag

SEQ ID NO: 459599 - DNA, 25 bp, Mus musculus
taagtccaccctacattgccaggga

SEQ ID NO: 459600 - DNA, 25 bp, Mus musculus
taagtccactagcaaacgaggcaga

SEQ ID NO: 459601 - DNA, 25 bp, Mus musculus
taagtccagaacgtgcagaagtggg

SEQ ID NO: 459602 - DNA, 25 bp, Mus musculus
taagtccagcgcacttacagcacac

SEQ ID NO: 459603 - DNA, 25 bp, Mus musculus
taagtccagctggtgtactgtggcg

SEQ ID NO: 459604 - DNA, 25 bp, Mus musculus
taagtccatgcgtgaaaacctgcgg

SEQ ID NO: 459605 - DNA, 25 bp, Mus musculus
taagtcccaactacgtgctccaggg

SEQ ID NO: 459606 - DNA, 25 bp, Mus musculus
taagtcccatcactctggagagatg

SEQ ID NO: 459607 - DNA, 25 bp, Mus musculus
taagtccccagagaagtgacgagtc

SEQ ID NO: 459608 - DNA, 25 bp, Mus musculus
taagtccccttctggtgaagacaag

SEQ ID NO: 459609 - DNA, 25 bp, Mus musculus
taagtccctgggaagtagcagacct

SEQ ID NO: 459610 - DNA, 25 bp, Mus musculus
taagtccgcccaagtttgtgcctgg

SEQ ID NO: 459611 - DNA, 25 bp, Mus musculus
taagtccgtcgcatataagagaaga

SEQ ID NO: 459612 - DNA, 25 bp, Mus musculus
taagtccgtctcgttctgaatcaag

SEQ ID NO: 459613 - DNA, 25 bp, Mus musculus
taagtcctactggaagaccaaaacg

SEQ ID NO: 459614 - DNA, 25 bp, Mus musculus
taagtcctgcttccgatgtgccaag

SEQ ID NO: 459615 - DNA, 25 bp, Mus musculus
taagtcctgggctatctctagggct

SEQ ID NO: 459616 - DNA, 25 bp, Mus musculus
taagtcgaccagattacgagtggcg

SEQ ID NO: 459617 - DNA, 25 bp, Mus musculus
taagtcgcccagacaagaagagcaa

SEQ ID NO: 459618 - DNA, 25 bp, Mus musculus
taagtcggatcctggttgagaggcc

SEQ ID NO: 459619 - DNA, 25 bp, Mus musculus
taagtcgtgccaagaaatggtcaga

SEQ ID NO: 459620 - DNA, 25 bp, Mus musculus
taagtcgtggttacctggtactcac

SEQ ID NO: 459621 - DNA, 25 bp, Mus musculus
taagtcgtgtgatgacagctgtgac

SEQ ID NO: 459622 - DNA, 25 bp, Mus musculus
taagtctcaactgaaatcttggtgc

SEQ ID NO: 459623 - DNA, 25 bp, Mus musculus
taagtctcattggaaagtttagaag

SEQ ID NO: 459624 - DNA, 25 bp, Mus musculus
taagtctctgaccatcagcgtgcac

SEQ ID NO: 459625 - DNA, 25 bp, Mus musculus
taagtctgcttgagctccctcacag

SEQ ID NO: 459626 - DNA, 25 bp, Mus musculus
taagtctgtggatatcgaagggaag

SEQ ID NO: 459627 - DNA, 25 bp, Mus musculus
taagtcttaccaggcgttcagcgga

SEQ ID NO: 459628 - DNA, 25 bp, Mus musculus
taagtcttcaaacgattttgcattg

SEQ ID NO: 459629 - DNA, 25 bp, Mus musculus
taagtcttgggaaacacagtgtgca

SEQ ID NO: 459630 - DNA, 25 bp, Mus musculus
taagtcttttgtgtcatagtcagga

SEQ ID NO: 459631 - DNA, 25 bp, Mus musculus
taagtgaagccccagcagagagtgt

SEQ ID NO: 459632 - DNA, 25 bp, Mus musculus
taagtgaaggagaagccactgccca

SEQ ID NO: 459633 - DNA, 25 bp, Mus musculus
taagtgacatgctcctttgagggca

SEQ ID NO: 459634 - DNA, 25 bp, Mus musculus
taagtgaccacctgggtcagtccga

SEQ ID NO: 459635 - DNA, 25 bp, Mus musculus
taagtgaccgcaaaagtattgaacc

SEQ ID NO: 459636 - DNA, 25 bp, Mus musculus
taagtgactacagctatcctcagga

SEQ ID NO: 459637 - DNA, 25 bp, Mus musculus
taagtgagaccgtcactgagacaac

SEQ ID NO: 459638 - DNA, 25 bp, Mus musculus
taagtgagctcttgctgcagccctg

SEQ ID NO: 459639 - DNA, 25 bp, Mus musculus
taagtgagggcagtgtggcacccaa

SEQ ID NO: 459640 - DNA, 25 bp, Mus musculus
taagtgagggttccattgactgaac

SEQ ID NO: 459641 - DNA, 25 bp, Mus musculus
taagtgagtacaatctagggcagcc

SEQ ID NO: 459642 - DNA, 25 bp, Mus musculus
taagtgagtcctcaaaaccagggac

SEQ ID NO: 459643 - DNA, 25 bp, Mus musculus
taagtgagtctgctcaaccgggcac

SEQ ID NO: 459644 - DNA, 25 bp, Mus musculus
taagtgagttttctgactgcagtca

SEQ ID NO: 459645 - DNA, 25 bp, Mus musculus
taagtgatccttcttctgaaaatgc

SEQ ID NO: 459646 - DNA, 25 bp, Mus musculus
taagtgattcctcctggcctatgac

SEQ ID NO: 459647 - DNA, 25 bp, Mus musculus
taagtgattgagtttccagggtctg

SEQ ID NO: 459648 - DNA, 25 bp, Mus musculus
taagtgcacagtcaccaaggaggtg

SEQ ID NO: 459649 - DNA, 25 bp, Mus musculus
taagtgcactgaactccttcgggag

SEQ ID NO: 459650 - DNA, 25 bp, Mus musculus
taagtgcagtcttttctgtagtcat

SEQ ID NO: 459651 - DNA, 25 bp, Mus musculus
taagtgcatacccaatacacaggac

SEQ ID NO: 459652 - DNA, 25 bp, Mus musculus
taagtgcatgcatggaaggtgcctg

SEQ ID NO: 459653 - DNA, 25 bp, Mus musculus
taagtgccacaaccaggtaaagagg

SEQ ID NO: 459654 - DNA, 25 bp, Mus musculus
taagtgccagctcagtcaccagaag

SEQ ID NO: 459655 - DNA, 25 bp, Mus musculus
taagtgccatggacaaagacgatcc

SEQ ID NO: 459656 - DNA, 25 bp, Mus musculus
taagtgccctgtacatattgtatgt

SEQ ID NO: 459657 - DNA, 25 bp, Mus musculus
taagtgcctaggttgatcctcaagg

SEQ ID NO: 459658 - DNA, 25 bp, Mus musculus
taagtgcctccgtcttctcagaggg

SEQ ID NO: 459659 - DNA, 25 bp, Mus musculus
taagtgccttacagggtctgagcca

SEQ ID NO: 459660 - DNA, 25 bp, Mus musculus
taagtgcgatgatagactctcctcc

SEQ ID NO: 459661 - DNA, 25 bp, Mus musculus
taagtgcgcccactgatgtgcacat

SEQ ID NO: 459662 - DNA, 25 bp, Mus musculus
taagtgcgggcaccatgatgcatcc

SEQ ID NO: 459663 - DNA, 25 bp, Mus musculus
taagtgctacctaacagcagacccg

SEQ ID NO: 459664 - DNA, 25 bp, Mus musculus
taagtgctacgagactgagtgccag

SEQ ID NO: 459665 - DNA, 25 bp, Mus musculus
taagtgctagcattgggcacgaccc

SEQ ID NO: 459666 - DNA, 25 bp, Mus musculus
taagtgctccttggatctgggccac

SEQ ID NO: 459667 - DNA, 25 bp, Mus musculus
taagtgctctatgcctgagcaggaa

SEQ ID NO: 459668 - DNA, 25 bp, Mus musculus
taagtgctgctacctgccttcggtg

SEQ ID NO: 459669 - DNA, 25 bp, Mus musculus
taagtgctggtaccgatccctatcg

SEQ ID NO: 459670 - DNA, 25 bp, Mus musculus
taagtgcttcatctggactcatcgc

SEQ ID NO: 459671 - DNA, 25 bp, Mus musculus
taagtggaataataccaaggtggcc

SEQ ID NO: 459672 - DNA, 25 bp, Mus musculus
taagtggcaactcctctcgttcaaa

SEQ ID NO: 459673 - DNA, 25 bp, Mus musculus
taagtggcatgctcttctaagtcgt

SEQ ID NO: 459674 - DNA, 25 bp, Mus musculus
taagtggccagacatttacaagtga

SEQ ID NO: 459675 - DNA, 25 bp, Mus musculus
taagtggccggatccaagttcctga

SEQ ID NO: 459676 - DNA, 25 bp, Mus musculus
taagtggcctagctgcactgctgct

SEQ ID NO: 459677 - DNA, 25 bp, Mus musculus
taagtggcgctgactgcttgggtcc

SEQ ID NO: 459678 - DNA, 25 bp, Mus musculus
taagtggctatgacctgcagcaagg

SEQ ID NO: 459679 - DNA, 25 bp, Mus musculus
taagtgggaaaaactcacggatgcc

SEQ ID NO: 459680 - DNA, 25 bp, Mus musculus
taagtgggtcaacaacgcttcccgt

SEQ ID NO: 459681 - DNA, 25 bp, Mus musculus
taagtgggtggaacaagacgccgca

SEQ ID NO: 459682 - DNA, 25 bp, Mus musculus
taagtggtccctatagtgcagcaaa

SEQ ID NO: 459683 - DNA, 25 bp, Mus musculus
taagtggtgtcgtcatcagcatctc

SEQ ID NO: 459684 - DNA, 25 bp, Mus musculus
taagtgtaaccagtgcggcaaagcc

SEQ ID NO: 459685 - DNA, 25 bp, Mus musculus
taagtgtagattttcccagcgtggc

SEQ ID NO: 459686 - DNA, 25 bp, Mus musculus
taagtgtcacaatgggaatggctcc

SEQ ID NO: 459687 - DNA, 25 bp, Mus musculus
taagtgtcagcaacgccttgggtca

SEQ ID NO: 459688 - DNA, 25 bp, Mus musculus
taagtgtcattgtcacaggtcatcc

SEQ ID NO: 459689 - DNA, 25 bp, Mus musculus
taagtgtccacctactccatgagtg

SEQ ID NO: 459690 - DNA, 25 bp, Mus musculus
taagtgtccagtgcctggaagggcc

SEQ ID NO: 459691 - DNA, 25 bp, Mus musculus
taagtgtcccttatgtcaagagtca

SEQ ID NO: 459692 - DNA, 25 bp, Mus musculus
taagtgtcggaagaacaaggagtct

SEQ ID NO: 459693 - DNA, 25 bp, Mus musculus
taagtgtctttcatgatctctaaaa

SEQ ID NO: 459694 - DNA, 25 bp, Mus musculus
taagtgtgaattacccatgcccagc

SEQ ID NO: 459695 - DNA, 25 bp, Mus musculus
taagtgtgacccatcgcagctctgg

SEQ ID NO: 459696 - DNA, 25 bp, Mus musculus
taagtgtgctgtggcttccctcaag

SEQ ID NO: 459697 - DNA, 25 bp, Mus musculus
taagtgtggctatcaacagctacag

SEQ ID NO: 459698 - DNA, 25 bp, Mus musculus
taagtgtgtcatcccttcagaagtt

SEQ ID NO: 459699 - DNA, 25 bp, Mus musculus
taagttaaatgtctgatattgtggg

SEQ ID NO: 459700 - DNA, 25 bp, Mus musculus
taagttaatgacacaggcacagttg

SEQ ID NO: 459701 - DNA, 25 bp, Mus musculus
taagttacacggagctgacacagag

SEQ ID NO: 459702 - DNA, 25 bp, Mus musculus
taagttacatctcctctcaagatgg

SEQ ID NO: 459703 - DNA, 25 bp, Mus musculus
taagttaccggatgtcgagagagga

SEQ ID NO: 459704 - DNA, 25 bp, Mus musculus
taagttactggacctctgccaagga

SEQ ID NO: 459705 - DNA, 25 bp, Mus musculus
taagttacttcggagcacgtgggca

SEQ ID NO: 459706 - DNA, 25 bp, Mus musculus
taagttagagtcactgccactgcac

SEQ ID NO: 459707 - DNA, 25 bp, Mus musculus
taagttagctggtctcttaactgct

SEQ ID NO: 459708 - DNA, 25 bp, Mus musculus
taagttaggacttgagatttgctga

SEQ ID NO: 459709 - DNA, 25 bp, Mus musculus
taagttatgtcctcatgagctgggc

SEQ ID NO: 459710 - DNA, 25 bp, Mus musculus
taagttatttctacatgaatgagag

SEQ ID NO: 459711 - DNA, 25 bp, Mus musculus
taagttcatggccacgtacctgagg

SEQ ID NO: 459712 - DNA, 25 bp, Mus musculus
taagttcattaatgtatggtgacag

SEQ ID NO: 459713 - DNA, 25 bp, Mus musculus
taagttccaggtgtatgagctccgg

SEQ ID NO: 459714 - DNA, 25 bp, Mus musculus
taagttccatcttgctgtcccctgc

SEQ ID NO: 459715 - DNA, 25 bp, Mus musculus
taagttcccaagacatatctgctgc

SEQ ID NO: 459716 - DNA, 25 bp, Mus musculus
taagttctcaagtccctacactggg

SEQ ID NO: 459717 - DNA, 25 bp, Mus musculus
taagttctcaattataatgctgggt

SEQ ID NO: 459718 - DNA, 25 bp, Mus musculus
taagttctccagctctagacatgtc

SEQ ID NO: 459719 - DNA, 25 bp, Mus musculus
taagttctgttttcccatggagacc

SEQ ID NO: 459720 - DNA, 25 bp, Mus musculus
taagttcttcagagatcggcaggag

SEQ ID NO: 459721 - DNA, 25 bp, Mus musculus
taagttcttcttccagatgagccat

SEQ ID NO: 459722 - DNA, 25 bp, Mus musculus
taagttcttgtgagaaattagcatc

SEQ ID NO: 459723 - DNA, 25 bp, Mus musculus
taagttctttatcaatctgcagtgt

SEQ ID NO: 459724 - DNA, 25 bp, Mus musculus
taagttgaaagtgatcgatagccgc

SEQ ID NO: 459725 - DNA, 25 bp, Mus musculus
taagttgactgaggagccaaaccca

SEQ ID NO: 459726 - DNA, 25 bp, Mus musculus
taagttgaggttctagacagctgca

SEQ ID NO: 459727 - DNA, 25 bp, Mus musculus
taagttgagtgtcagctggtacgcc

SEQ ID NO: 459728 - DNA, 25 bp, Mus musculus
taagttgcaatgtccctggcgatgg

SEQ ID NO: 459729 - DNA, 25 bp, Mus musculus
taagttgccctccatgtccagagat

SEQ ID NO: 459730 - DNA, 25 bp, Mus musculus
taagttgcgaccatattcagaccca

SEQ ID NO: 459731 - DNA, 25 bp, Mus musculus
taagttggacaaggacaaatgatgc

SEQ ID NO: 459732 - DNA, 25 bp, Mus musculus
taagttgggactgttagtgccggca

SEQ ID NO: 459733 - DNA, 25 bp, Mus musculus
taagttggttgctcatttcttggtc

SEQ ID NO: 459734 - DNA, 25 bp, Mus musculus
taagttgtggtaagtaaccatcacc

SEQ ID NO: 459735 - DNA, 25 bp, Mus musculus
taagttgtgtgctcgggtgtccctt

SEQ ID NO: 459736 - DNA, 25 bp, Mus musculus
taagttgtgtgtgtccgaccgtgac

SEQ ID NO: 459737 - DNA, 25 bp, Mus musculus
taagtttactaaggaatcgcacgcc

SEQ ID NO: 459738 - DNA, 25 bp, Mus musculus
taagtttcaaagtaccagtgcctcc

SEQ ID NO: 459739 - DNA, 25 bp, Mus musculus
taagtttcacaactcccgctggatg

SEQ ID NO: 459740 - DNA, 25 bp, Mus musculus
taagtttccagccagccaaccctgg

SEQ ID NO: 459741 - DNA, 25 bp, Mus musculus
taagtttcccttgtcactgtaggac

SEQ ID NO: 459742 - DNA, 25 bp, Mus musculus
taagtttcgcaagcaggagcgcgca

SEQ ID NO: 459743 - DNA, 25 bp, Mus musculus
taagtttctatcgaagtgggctcag

SEQ ID NO: 459744 - DNA, 25 bp, Mus musculus
taagtttctcttgtcccatggtacg

SEQ ID NO: 459745 - DNA, 25 bp, Mus musculus
taagtttctgttcctcatgtacggg

SEQ ID NO: 459746 - DNA, 25 bp, Mus musculus
taagtttgactcacagggagttaga

SEQ ID NO: 459747 - DNA, 25 bp, Mus musculus
taagtttgaggacaacctcgtggcc

SEQ ID NO: 459748 - DNA, 25 bp, Mus musculus
taagtttggaaagcaatggacccca

SEQ ID NO: 459749 - DNA, 25 bp, Mus musculus
taagtttgggtctacagagctctcg

SEQ ID NO: 459750 - DNA, 25 bp, Mus musculus
taagtttgtggaccccatccaggac

SEQ ID NO: 459751 - DNA, 25 bp, Mus musculus
taagttttcagaacacttctgtgca

SEQ ID NO: 459752 - DNA, 25 bp, Mus musculus
taagttttgctaggccttccaacgc

SEQ ID NO: 459753 - DNA, 25 bp, Mus musculus
taagtttttgctaggcccgattcgg

SEQ ID NO: 459754 - DNA, 25 bp, Mus musculus
taataaaaacagctcccgctctctg

SEQ ID NO: 459755 - DNA, 25 bp, Mus musculus
taataaaaacgagccatttgtgctg

SEQ ID NO: 459756 - DNA, 25 bp, Mus musculus
taataaaacaaaccaggcaggcccg

SEQ ID NO: 459757 - DNA, 25 bp, Mus musculus
taataaaacggctcctaggctgact

SEQ ID NO: 459758 - DNA, 25 bp, Mus musculus
taataaaagcttgtccgggacctgc

SEQ ID NO: 459759 - DNA, 25 bp, Mus musculus
taataaaagtcgctgcactcgcgcc

SEQ ID NO: 459760 - DNA, 25 bp, Mus musculus
taataaaatcagcaagctcggctcc

SEQ ID NO: 459761 - DNA, 25 bp, Mus musculus
taataaacaacagcttctcttcctt

SEQ ID NO: 459762 - DNA, 25 bp, Mus musculus
taataaacacctggttcaaggaatc

SEQ ID NO: 459763 - DNA, 25 bp, Mus musculus
taataaactgggtcaatcacaggga

SEQ ID NO: 459764 - DNA, 25 bp, Mus musculus
taataaactgtcaacctgggctctc

SEQ ID NO: 459765 - DNA, 25 bp, Mus musculus
taataaacttcgagtcgtggtggcc

SEQ ID NO: 459766 - DNA, 25 bp, Mus musculus
taataaagaaccctgcagagagagc

SEQ ID NO: 459767 - DNA, 25 bp, Mus musculus
taataaaggcgacttctgcagcggg

SEQ ID NO: 459768 - DNA, 25 bp, Mus musculus
taataaaggtggagcaagcagagag

SEQ ID NO: 459769 - DNA, 25 bp, Mus musculus
taataaagtgcttctctcacaatct

SEQ ID NO: 459770 - DNA, 25 bp, Mus musculus
taataaataacgtgactgctggagg

SEQ ID NO: 459771 - DNA, 25 bp, Mus musculus
taataaattagagggtagcttggcc

SEQ ID NO: 459772 - DNA, 25 bp, Mus musculus
taataacaaggaagataaggctgac

SEQ ID NO: 459773 - DNA, 25 bp, Mus musculus
taataacagcggcaaggagctcagc

SEQ ID NO: 459774 - DNA, 25 bp, Mus musculus
taataacagtgggattcttagcagc

SEQ ID NO: 459775 - DNA, 25 bp, Mus musculus
taataaccttcagggccacgcactt

SEQ ID NO: 459776 - DNA, 25 bp, Mus musculus
taataagacatctgctacctgctgc

SEQ ID NO: 459777 - DNA, 25 bp, Mus musculus
taataagcagagactcgagcttcct

SEQ ID NO: 459778 - DNA, 25 bp, Mus musculus
taataagctcctgcgtatcacagag

SEQ ID NO: 459779 - DNA, 25 bp, Mus musculus
taataaggagtcagtcccagcaaga

SEQ ID NO: 459780 - DNA, 25 bp, Mus musculus
taataaggcctctgtagccatggct

SEQ ID NO: 459781 - DNA, 25 bp, Mus musculus
taataaggctgatctagaggctcaa

SEQ ID NO: 459782 - DNA, 25 bp, Mus musculus
taataaggttccacgtggctgatcc

SEQ ID NO: 459783 - DNA, 25 bp, Mus musculus
taataagtgttcagcgagcacatgg

SEQ ID NO: 459784 - DNA, 25 bp, Mus musculus
taataagttgtttgtgaaattccac

SEQ ID NO: 459785 - DNA, 25 bp, Mus musculus
taataataggagatatgctagctgg

SEQ ID NO: 459786 - DNA, 25 bp, Mus musculus
taataatagggacaggcttgccgga

SEQ ID NO: 459787 - DNA, 25 bp, Mus musculus
taataatccatgtaccccgtgttct

SEQ ID NO: 459788 - DNA, 25 bp, Mus musculus
taataatctgccaaagtctctatgt

SEQ ID NO: 459789 - DNA, 25 bp, Mus musculus
taataatgagagagcggccagtgcc

SEQ ID NO: 459790 - DNA, 25 bp, Mus musculus
taataatggagaaaaccctgctgga

SEQ ID NO: 459791 - DNA, 25 bp, Mus musculus
taataatgtacgagaaagcctcccc

SEQ ID NO: 459792 - DNA, 25 bp, Mus musculus
taatacaaccggtggaggtccaggt

SEQ ID NO: 459793 - DNA, 25 bp, Mus musculus
taatacaagcttaggcacagagtca

SEQ ID NO: 459794 - DNA, 25 bp, Mus musculus
taatacacggaaagaggaagagcct

SEQ ID NO: 459795 - DNA, 25 bp, Mus musculus
taatacagcctgttctcgccgtaaa

SEQ ID NO: 459796 - DNA, 25 bp, Mus musculus
taatacatgcactggttcaagaggc

SEQ ID NO: 459797 - DNA, 25 bp, Mus musculus
taatacattcttagcccaagagggc

SEQ ID NO: 459798 - DNA, 25 bp, Mus musculus
taataccaaggccatgcgaacgaca

SEQ ID NO: 459799 - DNA, 25 bp, Mus musculus
taataccagggccaataactgcaca

SEQ ID NO: 459800 - DNA, 25 bp, Mus musculus
taataccattcctgagtaaagcctc

SEQ ID NO: 459801 - DNA, 25 bp, Mus musculus
taatacccagaactgagttgtgtcc

SEQ ID NO: 459802 - DNA, 25 bp, Mus musculus
taatacccgagactatgagctaaat

SEQ ID NO: 459803 - DNA, 25 bp, Mus musculus
taataccctggattcttttccgact

SEQ ID NO: 459804 - DNA, 25 bp, Mus musculus
taatacccttgaggataagctgcct

SEQ ID NO: 459805 - DNA, 25 bp, Mus musculus
taataccggcgtgactcgctagctt

SEQ ID NO: 459806 - DNA, 25 bp, Mus musculus
taatacctgttttacaggagagccg

SEQ ID NO: 459807 - DNA, 25 bp, Mus musculus
taatactattaaatggagaagcccc

SEQ ID NO: 459808 - DNA, 25 bp, Mus musculus
taatactcagaggaaagaggcagct

SEQ ID NO: 459809 - DNA, 25 bp, Mus musculus
taatactcagatctcccgggaaacc

SEQ ID NO: 459810 - DNA, 25 bp, Mus musculus
taatactcagctctcaacacaggcg

SEQ ID NO: 459811 - DNA, 25 bp, Mus musculus
taatactcgaacctatactttatat

SEQ ID NO: 459812 - DNA, 25 bp, Mus musculus
taatactcgaggctctgaggcaggc

SEQ ID NO: 459813 - DNA, 25 bp, Mus musculus
taatactctgaaagacacctgtgtg

SEQ ID NO: 459814 - DNA, 25 bp, Mus musculus
taatactgtgtagtcatgtgtgcgc

SEQ ID NO: 459815 - DNA, 25 bp, Mus musculus
taatacttgtcactccctaggaggc

SEQ ID NO: 459816 - DNA, 25 bp, Mus musculus
taatagacaagcgtggacatctctg

SEQ ID NO: 459817 - DNA, 25 bp, Mus musculus
taatagacttctctcaagtgacctc

SEQ ID NO: 459818 - DNA, 25 bp, Mus musculus
taatagagaatctgtccctgcccgc

SEQ ID NO: 459819 - DNA, 25 bp, Mus musculus
taatagagccggctagaagaatctg

SEQ ID NO: 459820 - DNA, 25 bp, Mus musculus
taatagatgggaaagacaaggctgc

SEQ ID NO: 459821 - DNA, 25 bp, Mus musculus
taatagcatcatcgtgagcccgagg

SEQ ID NO: 459822 - DNA, 25 bp, Mus musculus
taatagcatgtccaagatataaatc

SEQ ID NO: 459823 - DNA, 25 bp, Mus musculus
taatagccacagatagagggcctgc

SEQ ID NO: 459824 - DNA, 25 bp, Mus musculus
taatagcctctctcagtctctgcat

SEQ ID NO: 459825 - DNA, 25 bp, Mus musculus
taatagcgcaagctacgagtgctgc

SEQ ID NO: 459826 - DNA, 25 bp, Mus musculus
taatagcgcccgtgttttgaagcca

SEQ ID NO: 459827 - DNA, 25 bp, Mus musculus
taataggaactctgaagcccgggct

SEQ ID NO: 459828 - DNA, 25 bp, Mus musculus
taataggacgtcctgagcatccatg

SEQ ID NO: 459829 - DNA, 25 bp, Mus musculus
taataggcgtgtgccaaaaatcggg

SEQ ID NO: 459830 - DNA, 25 bp, Mus musculus
taatagggaagaagtgccctgcctg

SEQ ID NO: 459831 - DNA, 25 bp, Mus musculus
taatagggtgtaatactgtatccca

SEQ ID NO: 459832 - DNA, 25 bp, Mus musculus
taataggtccatgtctgagctgccg

SEQ ID NO: 459833 - DNA, 25 bp, Mus musculus
taataggtcccgcattgccacctgg

SEQ ID NO: 459834 - DNA, 25 bp, Mus musculus
taatagtatctcgagaatcctggcc

SEQ ID NO: 459835 - DNA, 25 bp, Mus musculus
taatagtcaagatacacacacctgg

SEQ ID NO: 459836 - DNA, 25 bp, Mus musculus
taatagtcctcctctagatcagcag

SEQ ID NO: 459837 - DNA, 25 bp, Mus musculus
taatagtgccaatgtctgtgggcca

SEQ ID NO: 459838 - DNA, 25 bp, Mus musculus
taatagtggacccaatgtgtggaac

SEQ ID NO: 459839 - DNA, 25 bp, Mus musculus
taatagttgaagctggcgacaccct

SEQ ID NO: 459840 - DNA, 25 bp, Mus musculus
taatagttgcattgtgtggctccct

SEQ ID NO: 459841 - DNA, 25 bp, Mus musculus
taatataacgatgcctgaccctgag

SEQ ID NO: 459842 - DNA, 25 bp, Mus musculus
taatatacaacgatggtgtccctgg

SEQ ID NO: 459843 - DNA, 25 bp, Mus musculus
taatatactatgatacgaagcccgg

SEQ ID NO: 459844 - DNA, 25 bp, Mus musculus
taatatagataccaccacagtcttc

SEQ ID NO: 459845 - DNA, 25 bp, Mus musculus
taatatagctgtgccacagaagagc

SEQ ID NO: 459846 - DNA, 25 bp, Mus musculus
taatataggtaagtcttcaggagca

SEQ ID NO: 459847 - DNA, 25 bp, Mus musculus
taatatccagaacctcgtgcagaag

SEQ ID NO: 459848 - DNA, 25 bp, Mus musculus
taatatccagcagcttcagaggcag

SEQ ID NO: 459849 - DNA, 25 bp, Mus musculus
taatatcccagaagagcgacagaca

SEQ ID NO: 459850 - DNA, 25 bp, Mus musculus
taatatcccagaggcgtgaggtcag

SEQ ID NO: 459851 - DNA, 25 bp, Mus musculus
taatatcctatagagtgcatgttcc

SEQ ID NO: 459852 - DNA, 25 bp, Mus musculus
taatatcctgtgagaacgacctgca

SEQ ID NO: 459853 - DNA, 25 bp, Mus musculus
taatatcgcgatagttcctacggcg

SEQ ID NO: 459854 - DNA, 25 bp, Mus musculus
taatatctacttacagagctgtgag

SEQ ID NO: 459855 - DNA, 25 bp, Mus musculus
taatatgaaactccagacagctgtg

SEQ ID NO: 459856 - DNA, 25 bp, Mus musculus
taatatgactaatgacctccgaggc

SEQ ID NO: 459857 - DNA, 25 bp, Mus musculus
taatatgacttggtatgcagccgga

SEQ ID NO: 459858 - DNA, 25 bp, Mus musculus
taatatgagagtatggaattcgttg

SEQ ID NO: 459859 - DNA, 25 bp, Mus musculus
taatatgcagactgacggcccggcc

SEQ ID NO: 459860 - DNA, 25 bp, Mus musculus
taatatgctaccctgtgaaacggtc

SEQ ID NO: 459861 - DNA, 25 bp, Mus musculus
taatatgtactttgctgacagccag

SEQ ID NO: 459862 - DNA, 25 bp, Mus musculus
taatatgtcccaccacactgcgtgc

SEQ ID NO: 459863 - DNA, 25 bp, Mus musculus
taatatgtgccaagaggagccctct

SEQ ID NO: 459864 - DNA, 25 bp, Mus musculus
taatatgtgccttgtggcaacggga

SEQ ID NO: 459865 - DNA, 25 bp, Mus musculus
taatatgtgtaaaactacatctgag

SEQ ID NO: 459866 - DNA, 25 bp, Mus musculus
taatatgttgtatggtactaacccc

SEQ ID NO: 459867 - DNA, 25 bp, Mus musculus
taatattagccttgccaccacagga

SEQ ID NO: 459868 - DNA, 25 bp, Mus musculus
taatattcaatgtagtccgcctggc

SEQ ID NO: 459869 - DNA, 25 bp, Mus musculus
taatattcctagacgccaccacagg

SEQ ID NO: 459870 - DNA, 25 bp, Mus musculus
taatattccttgattaaatgcaaac

SEQ ID NO: 459871 - DNA, 25 bp, Mus musculus
taatattgaggaggccaaagaccgc

SEQ ID NO: 459872 - DNA, 25 bp, Mus musculus
taatattgcacccaggctctccctg

SEQ ID NO: 459873 - DNA, 25 bp, Mus musculus
taatattgctgatggcagtcgtgcc

SEQ ID NO: 459874 - DNA, 25 bp, Mus musculus
taatattggtagatttgtatccttc

SEQ ID NO: 459875 - DNA, 25 bp, Mus musculus
taatattttacagatgccaaacgtc

SEQ ID NO: 459876 - DNA, 25 bp, Mus musculus
taatcaaaatgttgggaaacggacg

SEQ ID NO: 459877 - DNA, 25 bp, Mus musculus
taatcaaattcaagagcatgcgcac

SEQ ID NO: 459878 - DNA, 25 bp, Mus musculus
taatcaacggcaagaacgagtcggc

SEQ ID NO: 459879 - DNA, 25 bp, Mus musculus
taatcaagatcccaaggactggccc

SEQ ID NO: 459880 - DNA, 25 bp, Mus musculus
taatcaagcacgtgaaggactccag

SEQ ID NO: 459881 - DNA, 25 bp, Mus musculus
taatcaagctacaaggaggttcctc

SEQ ID NO: 459882 - DNA, 25 bp, Mus musculus
taatcaaggcattcacatatgtgag

SEQ ID NO: 459883 - DNA, 25 bp, Mus musculus
taatcaagggtgagttggcaacaac

SEQ ID NO: 459884 - DNA, 25 bp, Mus musculus
taatcaagtactacccggagcagga

SEQ ID NO: 459885 - DNA, 25 bp, Mus musculus
taatcaagtggatcctgtccagtgc

SEQ ID NO: 459886 - DNA, 25 bp, Mus musculus
taatcaataaacaaggctcctaggc

SEQ ID NO: 459887 - DNA, 25 bp, Mus musculus
taatcacaaaagctagagtcttcca

SEQ ID NO: 459888 - DNA, 25 bp, Mus musculus
taatcacattgtccctgacattcag

SEQ ID NO: 459889 - DNA, 25 bp, Mus musculus
taatcaccagaatgagcatcactgg

SEQ ID NO: 459890 - DNA, 25 bp, Mus musculus
taatcaccgaggagttcgtccagca

SEQ ID NO: 459891 - DNA, 25 bp, Mus musculus
taatcaccggtgacgtctaaggctc

SEQ ID NO: 459892 - DNA, 25 bp, Mus musculus
taatcacgatcgctcacaaggactg

SEQ ID NO: 459893 - DNA, 25 bp, Mus musculus
taatcacggtagaatccagagccct

SEQ ID NO: 459894 - DNA, 25 bp, Mus musculus
taatcactccaagcacatgctatgg

SEQ ID NO: 459895 - DNA, 25 bp, Mus musculus
taatcactcctactgtcctgcctag

SEQ ID NO: 459896 - DNA, 25 bp, Mus musculus
taatcactgagggttgctgtccagt

SEQ ID NO: 459897 - DNA, 25 bp, Mus musculus
taatcactggtgaatcccctgggag

SEQ ID NO: 459898 - DNA, 25 bp, Mus musculus
taatcactttgttgtcggcaccgac

SEQ ID NO: 459899 - DNA, 25 bp, Mus musculus
taatcacttttcaaggccgtggagc

SEQ ID NO: 459900 - DNA, 25 bp, Mus musculus
taatcagaccaaagtactgtcccgg

SEQ ID NO: 459901 - DNA, 25 bp, Mus musculus
taatcagagaagatgaaaggcagct

SEQ ID NO: 459902 - DNA, 25 bp, Mus musculus
taatcagagtttctaagttacaact

SEQ ID NO: 459903 - DNA, 25 bp, Mus musculus
taatcagatcgaggagttacccagc

SEQ ID NO: 459904 - DNA, 25 bp, Mus musculus
taatcagatggtcagagtggaagcc

SEQ ID NO: 459905 - DNA, 25 bp, Mus musculus
taatcagccagagtgcacagaagca

SEQ ID NO: 459906 - DNA, 25 bp, Mus musculus
taatcagctaccaaggaacaacgca

SEQ ID NO: 459907 - DNA, 25 bp, Mus musculus
taatcagctctgcaaagggtaactc

SEQ ID NO: 459908 - DNA, 25 bp, Mus musculus
taatcaggacccattgcaaggaaca

SEQ ID NO: 459909 - DNA, 25 bp, Mus musculus
taatcaggatcttcacaaacatggt

SEQ ID NO: 459910 - DNA, 25 bp, Mus musculus
taatcaggcccttagaaactcagga

SEQ ID NO: 459911 - DNA, 25 bp, Mus musculus
taatcaggtggtgcctaaaaagcgg

SEQ ID NO: 459912 - DNA, 25 bp, Mus musculus
taatcagtccccagaatggccgcta

SEQ ID NO: 459913 - DNA, 25 bp, Mus musculus
taatcagtttctttctcgccacgag

SEQ ID NO: 459914 - DNA, 25 bp, Mus musculus
taatcatcaccatctcgtctgtcag

SEQ ID NO: 459915 - DNA, 25 bp, Mus musculus
taatcatcatctcggtgggtttgct

SEQ ID NO: 459916 - DNA, 25 bp, Mus musculus
taatcatcatgggagtacacaagca

SEQ ID NO: 459917 - DNA, 25 bp, Mus musculus
taatcatgaagaacccggaagtgga

SEQ ID NO: 459918 - DNA, 25 bp, Mus musculus
taatcatgagccgaagatcctgtgc

SEQ ID NO: 459919 - DNA, 25 bp, Mus musculus
taatcatgcacatacatctatgtgg

SEQ ID NO: 459920 - DNA, 25 bp, Mus musculus
taatcatgcggtctggagagccaca

SEQ ID NO: 459921 - DNA, 25 bp, Mus musculus
taatcatggccacaaacagagcaga

SEQ ID NO: 459922 - DNA, 25 bp, Mus musculus
taatcatggctgcagtcagaacacc

SEQ ID NO: 459923 - DNA, 25 bp, Mus musculus
taatcatgtagttgattgtgtaccc

SEQ ID NO: 459924 - DNA, 25 bp, Mus musculus
taatcattccgtctctatgtctgtc

SEQ ID NO: 459925 - DNA, 25 bp, Mus musculus
taatcattcttcaggaagtcaccac

SEQ ID NO: 459926 - DNA, 25 bp, Mus musculus
taatcattgaacatggcggtaagcc

SEQ ID NO: 459927 - DNA, 25 bp, Mus musculus
taatcattgaatgcgcgcagtcggt

SEQ ID NO: 459928 - DNA, 25 bp, Mus musculus
taatccaaagatgtagccagccctg

SEQ ID NO: 459929 - DNA, 25 bp, Mus musculus
taatccaaggactggcggtgtcacc

SEQ ID NO: 459930 - DNA, 25 bp, Mus musculus
taatccacccatctttgaaacagtt

SEQ ID NO: 459931 - DNA, 25 bp, Mus musculus
taatccacttagctgtattcatgga

SEQ ID NO: 459932 - DNA, 25 bp, Mus musculus
taatccagaatcaggagtgtcatgt

SEQ ID NO: 459933 - DNA, 25 bp, Mus musculus
taatccagccacaggagagcaagtg

SEQ ID NO: 459934 - DNA, 25 bp, Mus musculus
taatccagcggctgacagtgcagga

SEQ ID NO: 459935 - DNA, 25 bp, Mus musculus
taatccaggaaacatatggctgcca

SEQ ID NO: 459936 - DNA, 25 bp, Mus musculus
taatccaggatttgcctctgcgcga

SEQ ID NO: 459937 - DNA, 25 bp, Mus musculus
taatccagggaaactagaggtcaga

SEQ ID NO: 459938 - DNA, 25 bp, Mus musculus
taatccagtgatccctagcagagag

SEQ ID NO: 459939 - DNA, 25 bp, Mus musculus
taatccataggttttgctgcagctg

SEQ ID NO: 459940 - DNA, 25 bp, Mus musculus
taatccatattaaccaaaggcaggg

SEQ ID NO: 459941 - DNA, 25 bp, Mus musculus
taatccatgggtctggctacagtga

SEQ ID NO: 459942 - DNA, 25 bp, Mus musculus
taatccatgtacttgcgtgtcaggc

SEQ ID NO: 459943 - DNA, 25 bp, Mus musculus
taatcccagagctataatcccagag

SEQ ID NO: 459944 - DNA, 25 bp, Mus musculus
taatcccatctgtgctggcagccag

SEQ ID NO: 459945 - DNA, 25 bp, Mus musculus
taatccccggctgcatgtgactgtg

SEQ ID NO: 459946 - DNA, 25 bp, Mus musculus
taatcccctctcagacagagttgag

SEQ ID NO: 459947 - DNA, 25 bp, Mus musculus
taatcccgcagtatctacaaggtga

SEQ ID NO: 459948 - DNA, 25 bp, Mus musculus
taatcccggtacataggaggctgaa

SEQ ID NO: 459949 - DNA, 25 bp, Mus musculus
taatccctggcaaagtcaagactgt

SEQ ID NO: 459950 - DNA, 25 bp, Mus musculus
taatccctgggcaaatgaggtatgc

SEQ ID NO: 459951 - DNA, 25 bp, Mus musculus
taatccctggtgtggtatgtgacct

SEQ ID NO: 459952 - DNA, 25 bp, Mus musculus
taatccgaggccagcaagacttggt

SEQ ID NO: 459953 - DNA, 25 bp, Mus musculus
taatccgctgctgcgctcggtgttc

SEQ ID NO: 459954 - DNA, 25 bp, Mus musculus
taatccggaagagttttgtgcagag

SEQ ID NO: 459955 - DNA, 25 bp, Mus musculus
taatccggcagtgttgcagttagct

SEQ ID NO: 459956 - DNA, 25 bp, Mus musculus
taatccgtctgggtgctcgaggtga

SEQ ID NO: 459957 - DNA, 25 bp, Mus musculus
taatcctaagctgagtgaccatgac

SEQ ID NO: 459958 - DNA, 25 bp, Mus musculus
taatcctaatcctttatatagttcc

SEQ ID NO: 459959 - DNA, 25 bp, Mus musculus
taatcctagtatccctagttggtgg

SEQ ID NO: 459960 - DNA, 25 bp, Mus musculus
taatcctatggtaaatgctggagca

SEQ ID NO: 459961 - DNA, 25 bp, Mus musculus
taatcctcagaagtactaacgttgg

SEQ ID NO: 459962 - DNA, 25 bp, Mus musculus
taatcctcagaggagcagtctcacg

SEQ ID NO: 459963 - DNA, 25 bp, Mus musculus
taatcctcagcatttaaagagtcaa

SEQ ID NO: 459964 - DNA, 25 bp, Mus musculus
taatcctcaggtcagattcattgaa

SEQ ID NO: 459965 - DNA, 25 bp, Mus musculus
taatcctcgggtgaaatgacctgaa

SEQ ID NO: 459966 - DNA, 25 bp, Mus musculus
taatcctgagttgagctctgggacc

SEQ ID NO: 459967 - DNA, 25 bp, Mus musculus
taatcctggatgcttgccaatcctg

SEQ ID NO: 459968 - DNA, 25 bp, Mus musculus
taatcctggctacgatccggagcat

SEQ ID NO: 459969 - DNA, 25 bp, Mus musculus
taatccttcaaaagaatactgcctc

SEQ ID NO: 459970 - DNA, 25 bp, Mus musculus
taatccttctggagtcacactgtgc

SEQ ID NO: 459971 - DNA, 25 bp, Mus musculus
taatccttgcaaacagccgatgctg

SEQ ID NO: 459972 - DNA, 25 bp, Mus musculus
taatcgaagggctcatcaggaagac

SEQ ID NO: 459973 - DNA, 25 bp, Mus musculus
taatcgagaccccaaaggtacctgc

SEQ ID NO: 459974 - DNA, 25 bp, Mus musculus
taatcgagagagtcgtcagtgccct

SEQ ID NO: 459975 - DNA, 25 bp, Mus musculus
taatcgagatggcaacaggtcgacc

SEQ ID NO: 459976 - DNA, 25 bp, Mus musculus
taatcgagcattcaatcagggactc

SEQ ID NO: 459977 - DNA, 25 bp, Mus musculus
taatcgagcccacttcagggagcaa

SEQ ID NO: 459978 - DNA, 25 bp, Mus musculus
taatcgcaattggaaaaggcagctc

SEQ ID NO: 459979 - DNA, 25 bp, Mus musculus
taatcgcgcgagtcagcagaagtgc

SEQ ID NO: 459980 - DNA, 25 bp, Mus musculus
taatcgctacggtgtatcggacccg

SEQ ID NO: 459981 - DNA, 25 bp, Mus musculus
taatcgctggagagccaagcttcgt

SEQ ID NO: 459982 - DNA, 25 bp, Mus musculus
taatcgctggccatgttcccaagga

SEQ ID NO: 459983 - DNA, 25 bp, Mus musculus
taatcgcttaccagccgtacgggaa

SEQ ID NO: 459984 - DNA, 25 bp, Mus musculus
taatcggaggcaatgagatcagtcc

SEQ ID NO: 459985 - DNA, 25 bp, Mus musculus
taatcggctacgtccgtttcgttgt

SEQ ID NO: 459986 - DNA, 25 bp, Mus musculus
taatcgggagcatgccaagttccac

SEQ ID NO: 459987 - DNA, 25 bp, Mus musculus
taatcgggagccttcgagtcaacgc

SEQ ID NO: 459988 - DNA, 25 bp, Mus musculus
taatcgggctattctgccgtcagta

SEQ ID NO: 459989 - DNA, 25 bp, Mus musculus
taatcggtcctctggtcgctagcgt

SEQ ID NO: 459990 - DNA, 25 bp, Mus musculus
taatcggtttccctctctgctggca

SEQ ID NO: 459991 - DNA, 25 bp, Mus musculus
taatcgtattggtggcgtgcagcag

SEQ ID NO: 459992 - DNA, 25 bp, Mus musculus
taatcgtgctccatatttgaaaact

SEQ ID NO: 459993 - DNA, 25 bp, Mus musculus
taatcgtgctgctggtaccctgaac

SEQ ID NO: 459994 - DNA, 25 bp, Mus musculus
taatcgtttaaagcaccagtgtggc

SEQ ID NO: 459995 - DNA, 25 bp, Mus musculus
taatctaaaatgtcgaggtcacccc

SEQ ID NO: 459996 - DNA, 25 bp, Mus musculus
taatctatgccttccatggtagccg

SEQ ID NO: 459997 - DNA, 25 bp, Mus musculus
taatctcacaccaactgtgatctgc

SEQ ID NO: 459998 - DNA, 25 bp, Mus musculus
taatctcacccctgatggtatgcgc

SEQ ID NO: 459999 - DNA, 25 bp, Mus musculus
taatctcattctcggccagagctga

SEQ ID NO: 460000 - DNA, 25 bp, Mus musculus
taatctccagagagggtacacagcc

SEQ ID NO: 460001 - DNA, 25 bp, Mus musculus
taatctccggcgtttcatgtactgc

SEQ ID NO: 460002 - DNA, 25 bp, Mus musculus
taatctccgttctcagtgatggcac

SEQ ID NO: 460003 - DNA, 25 bp, Mus musculus
taatctcctgctgattaatcaccca

SEQ ID NO: 460004 - DNA, 25 bp, Mus musculus
taatctcgaaagcatcccaggtggc

SEQ ID NO: 460005 - DNA, 25 bp, Mus musculus
taatctcgagaccaacgtggaggag

SEQ ID NO: 460006 - DNA, 25 bp, Mus musculus
taatctctccggcattctatctcgc

SEQ ID NO: 460007 - DNA, 25 bp, Mus musculus
taatctctctgaagtgctgcgtgga

SEQ ID NO: 460008 - DNA, 25 bp, Mus musculus
taatctctgagcgtgaccaagacca

SEQ ID NO: 460009 - DNA, 25 bp, Mus musculus
taatctctgctggataagcggctgg

SEQ ID NO: 460010 - DNA, 25 bp, Mus musculus
taatctctgtgcagaggcaccgccc

SEQ ID NO: 460011 - DNA, 25 bp, Mus musculus
taatctgacatattacttagggtag

SEQ ID NO: 460012 - DNA, 25 bp, Mus musculus
taatctgactcccagtgtactggag

SEQ ID NO: 460013 - DNA, 25 bp, Mus musculus
taatctgagcttccattgaacagtg

SEQ ID NO: 460014 - DNA, 25 bp, Mus musculus
taatctgatcattctgctatagcac

SEQ ID NO: 460015 - DNA, 25 bp, Mus musculus
taatctgcacgtgtctgtggcgccc

SEQ ID NO: 460016 - DNA, 25 bp, Mus musculus
taatctgcagaattcgggacaccct

SEQ ID NO: 460017 - DNA, 25 bp, Mus musculus
taatctgcccgaacatgctggtcct

SEQ ID NO: 460018 - DNA, 25 bp, Mus musculus
taatctggagcgttctgaagcagga

SEQ ID NO: 460019 - DNA, 25 bp, Mus musculus
taatctggaggaacacactactgag

SEQ ID NO: 460020 - DNA, 25 bp, Mus musculus
taatctggtaatggtgtccctaagg

SEQ ID NO: 460021 - DNA, 25 bp, Mus musculus
taatctggtctaagatgaggagcca

SEQ ID NO: 460022 - DNA, 25 bp, Mus musculus
taatcttactgtgtgtcgctatgcc

SEQ ID NO: 460023 - DNA, 25 bp, Mus musculus
taatcttcatggaaggcaaccgtgc

SEQ ID NO: 460024 - DNA, 25 bp, Mus musculus
taatcttccagcatacaggagcgct

SEQ ID NO: 460025 - DNA, 25 bp, Mus musculus
taatcttcgacggaaactggaatgg

SEQ ID NO: 460026 - DNA, 25 bp, Mus musculus
taatcttcggcaagtacggtacagt

SEQ ID NO: 460027 - DNA, 25 bp, Mus musculus
taatcttcttgttggcggctccgtt

SEQ ID NO: 460028 - DNA, 25 bp, Mus musculus
taatctttacgaccaaccagcctcg

SEQ ID NO: 460029 - DNA, 25 bp, Mus musculus
taatctttatgcaccagcattggcg

SEQ ID NO: 460030 - DNA, 25 bp, Mus musculus
taatctttccatagactattcctgg

SEQ ID NO: 460031 - DNA, 25 bp, Mus musculus
taatctttgcactgggcaggttgcg

SEQ ID NO: 460032 - DNA, 25 bp, Mus musculus
taatgaaaaaactgcttcaggtgcc

SEQ ID NO: 460033 - DNA, 25 bp, Mus musculus
taatgaaaatgtcgccccaggaatg

SEQ ID NO: 460034 - DNA, 25 bp, Mus musculus
taatgaaacaagaccatctgagccc

SEQ ID NO: 460035 - DNA, 25 bp, Mus musculus
taatgaaagcatgcggtaccagcct

SEQ ID NO: 460036 - DNA, 25 bp, Mus musculus
taatgaaagtccaggtactgcggga

SEQ ID NO: 460037 - DNA, 25 bp, Mus musculus
taatgaacacattgcccctaacagg

SEQ ID NO: 460038 - DNA, 25 bp, Mus musculus
taatgaaccaatggaaggtgccttc

SEQ ID NO: 460039 - DNA, 25 bp, Mus musculus
taatgaaccagaacagctcgaggac

SEQ ID NO: 460040 - DNA, 25 bp, Mus musculus
taatgaaccggagctaaggaaccaa

SEQ ID NO: 460041 - DNA, 25 bp, Mus musculus
taatgaacctggagcaggtcgggcc

SEQ ID NO: 460042 - DNA, 25 bp, Mus musculus
taatgaacggcccagagtttcccag

SEQ ID NO: 460043 - DNA, 25 bp, Mus musculus
taatgaactattgaaaagccctgca

SEQ ID NO: 460044 - DNA, 25 bp, Mus musculus
taatgaactgtatgaagccgagctc

SEQ ID NO: 460045 - DNA, 25 bp, Mus musculus
taatgaagaagcatcggatccgggc

SEQ ID NO: 460046 - DNA, 25 bp, Mus musculus
taatgaagccctctgacagctcacc

SEQ ID NO: 460047 - DNA, 25 bp, Mus musculus
taatgaaggagccatggaatgccag

SEQ ID NO: 460048 - DNA, 25 bp, Mus musculus
taatgaatcagctgagccaaaggca

SEQ ID NO: 460049 - DNA, 25 bp, Mus musculus
taatgaatcctgaagcccagctgcc

SEQ ID NO: 460050 - DNA, 25 bp, Mus musculus
taatgaatggccacagcatcccaga

SEQ ID NO: 460051 - DNA, 25 bp, Mus musculus
taatgacaagttctggaaggtacgg

SEQ ID NO: 460052 - DNA, 25 bp, Mus musculus
taatgacactgttaacccatggcgt

SEQ ID NO: 460053 - DNA, 25 bp, Mus musculus
taatgacagggtctaaggagctgtc

SEQ ID NO: 460054 - DNA, 25 bp, Mus musculus
taatgacattacagtataagcagcc

SEQ ID NO: 460055 - DNA, 25 bp, Mus musculus
taatgaccaaaaaggtggagcacct

SEQ ID NO: 460056 - DNA, 25 bp, Mus musculus
taatgaccagctgatcagtcccaag

SEQ ID NO: 460057 - DNA, 25 bp, Mus musculus
taatgaccaggctaccatggacaca

SEQ ID NO: 460058 - DNA, 25 bp, Mus musculus
taatgaccaggtcattgccagcggc

SEQ ID NO: 460059 - DNA, 25 bp, Mus musculus
taatgaccagtttgcaggctccagc

SEQ ID NO: 460060 - DNA, 25 bp, Mus musculus
taatgaccattgcagtgggcacgga

SEQ ID NO: 460061 - DNA, 25 bp, Mus musculus
taatgacccaactaatgcccagtgt

SEQ ID NO: 460062 - DNA, 25 bp, Mus musculus
taatgacccagaaacattcctgccg

SEQ ID NO: 460063 - DNA, 25 bp, Mus musculus
taatgaccccttcttgagtccactg

SEQ ID NO: 460064 - DNA, 25 bp, Mus musculus
taatgacgcagagcttgccaaagcc

SEQ ID NO: 460065 - DNA, 25 bp, Mus musculus
taatgactactggacgctctaggca

SEQ ID NO: 460066 - DNA, 25 bp, Mus musculus
taatgactctcttgctgagggatgc

SEQ ID NO: 460067 - DNA, 25 bp, Mus musculus
taatgactgctcacattcagaagag

SEQ ID NO: 460068 - DNA, 25 bp, Mus musculus
taatgacttccactgcgagtgccgg

SEQ ID NO: 460069 - DNA, 25 bp, Mus musculus
taatgagaaaagtagtggaagccgt

SEQ ID NO: 460070 - DNA, 25 bp, Mus musculus
taatgagaatagctggccattgcct

SEQ ID NO: 460071 - DNA, 25 bp, Mus musculus
taatgagacctacacagaagagttg

SEQ ID NO: 460072 - DNA, 25 bp, Mus musculus
taatgagacttcctaaccgacagtg

SEQ ID NO: 460073 - DNA, 25 bp, Mus musculus
taatgagacttgttggtgagcccgc

SEQ ID NO: 460074 - DNA, 25 bp, Mus musculus
taatgagagactagggaccaagccc

SEQ ID NO: 460075 - DNA, 25 bp, Mus musculus
taatgagagcgcatggaactacctg

SEQ ID NO: 460076 - DNA, 25 bp, Mus musculus
taatgagagcgtctacacagaggat

SEQ ID NO: 460077 - DNA, 25 bp, Mus musculus
taatgagatctgttcccgactcgtc

SEQ ID NO: 460078 - DNA, 25 bp, Mus musculus
taatgagatgctagacctatcctgg

SEQ ID NO: 460079 - DNA, 25 bp, Mus musculus
taatgagattaaggcccgctctggc

SEQ ID NO: 460080 - DNA, 25 bp, Mus musculus
taatgagcacagctgattagcagat

SEQ ID NO: 460081 - DNA, 25 bp, Mus musculus
taatgagcagagagcctcgaaggcc

SEQ ID NO: 460082 - DNA, 25 bp, Mus musculus
taatgagctgaaacgcaaggacaag

SEQ ID NO: 460083 - DNA, 25 bp, Mus musculus
taatgaggaaaaatgagcaggcact

SEQ ID NO: 460084 - DNA, 25 bp, Mus musculus
taatgaggcacttcacgacagaccc

SEQ ID NO: 460085 - DNA, 25 bp, Mus musculus
taatgaggcagacgctggaaatcgc

SEQ ID NO: 460086 - DNA, 25 bp, Mus musculus
taatgaggccatagcaggctactcg

SEQ ID NO: 460087 - DNA, 25 bp, Mus musculus
taatgagggaatggactttgacacc

SEQ ID NO: 460088 - DNA, 25 bp, Mus musculus
taatgagtatagcaggccagccatg

SEQ ID NO: 460089 - DNA, 25 bp, Mus musculus
taatgagtgtcctgacagagactcg

SEQ ID NO: 460090 - DNA, 25 bp, Mus musculus
taatgataaactcaccagtgtgttt

SEQ ID NO: 460091 - DNA, 25 bp, Mus musculus
taatgatatccggtcttccagagtc

SEQ ID NO: 460092 - DNA, 25 bp, Mus musculus
taatgatcattttagcccagtcttg

SEQ ID NO: 460093 - DNA, 25 bp, Mus musculus
taatgatcgacgtcgggagatattg

SEQ ID NO: 460094 - DNA, 25 bp, Mus musculus
taatgatgaacatacagacggccac

SEQ ID NO: 460095 - DNA, 25 bp, Mus musculus
taatgatgaggcactgagggctact

SEQ ID NO: 460096 - DNA, 25 bp, Mus musculus
taatgatgatattgcctgccgagct

SEQ ID NO: 460097 - DNA, 25 bp, Mus musculus
taatgatgtccctcaagtccgggct

SEQ ID NO: 460098 - DNA, 25 bp, Mus musculus
taatgattacctgtccagcagctgc

SEQ ID NO: 460099 - DNA, 25 bp, Mus musculus
taatgattcctaagtcccaagtggg

SEQ ID NO: 460100 - DNA, 25 bp, Mus musculus
taatgcaaaaggtgtctcaaggctc

SEQ ID NO: 460101 - DNA, 25 bp, Mus musculus
taatgcaacgatcaggaaatctttc

SEQ ID NO: 460102 - DNA, 25 bp, Mus musculus
taatgcaaggccttgggagactgct

SEQ ID NO: 460103 - DNA, 25 bp, Mus musculus
taatgcaaggcggtcagtgtctgcc

SEQ ID NO: 460104 - DNA, 25 bp, Mus musculus
taatgcaaggtcagtaatgtccgcc

SEQ ID NO: 460105 - DNA, 25 bp, Mus musculus
taatgcaatgcacaccctagaaaca

SEQ ID NO: 460106 - DNA, 25 bp, Mus musculus
taatgcacagcttcatgtcgtggac

SEQ ID NO: 460107 - DNA, 25 bp, Mus musculus
taatgcaccactcagcacagaacat

SEQ ID NO: 460108 - DNA, 25 bp, Mus musculus
taatgcacctttcagcaagcgcctg

SEQ ID NO: 460109 - DNA, 25 bp, Mus musculus
taatgcacgctgaaggtccaggcac

SEQ ID NO: 460110 - DNA, 25 bp, Mus musculus
taatgcacggtgtctcaagaggttc

SEQ ID NO: 460111 - DNA, 25 bp, Mus musculus
taatgcacttgacatgggcgcctca

SEQ ID NO: 460112 - DNA, 25 bp, Mus musculus
taatgcagagctgctacaccgaggc

SEQ ID NO: 460113 - DNA, 25 bp, Mus musculus
taatgcagatgatgataggcctccc

SEQ ID NO: 460114 - DNA, 25 bp, Mus musculus
taatgcagcacttcccgcttgtcaa

SEQ ID NO: 460115 - DNA, 25 bp, Mus musculus
taatgcagcgattcacaagaagtgc

SEQ ID NO: 460116 - DNA, 25 bp, Mus musculus
taatgcaggaactgccttgggcagc

SEQ ID NO: 460117 - DNA, 25 bp, Mus musculus
taatgcaggaattgatccctgggcc

SEQ ID NO: 460118 - DNA, 25 bp, Mus musculus
taatgcagggtcgttcacggtggca

SEQ ID NO: 460119 - DNA, 25 bp, Mus musculus
taatgcagtaaggacagcaggattc

SEQ ID NO: 460120 - DNA, 25 bp, Mus musculus
taatgcataaggttggccccactgg

SEQ ID NO: 460121 - DNA, 25 bp, Mus musculus
taatgcattcccgatactcttgcgt

SEQ ID NO: 460122 - DNA, 25 bp, Mus musculus
taatgccaacaatgagaagatgcgc

SEQ ID NO: 460123 - DNA, 25 bp, Mus musculus
taatgccaggacaagtgatgcgggt

SEQ ID NO: 460124 - DNA, 25 bp, Mus musculus
taatgccagggtctcatcgttagag

SEQ ID NO: 460125 - DNA, 25 bp, Mus musculus
taatgccattggtgtattacagcag

SEQ ID NO: 460126 - DNA, 25 bp, Mus musculus
taatgcccacgagatcgaaggcacg

SEQ ID NO: 460127 - DNA, 25 bp, Mus musculus
taatgcccagagacgaggatgcctt

SEQ ID NO: 460128 - DNA, 25 bp, Mus musculus
taatgcccagtgtgggaagggtata

SEQ ID NO: 460129 - DNA, 25 bp, Mus musculus
taatgccccggaagttggaatcacg

SEQ ID NO: 460130 - DNA, 25 bp, Mus musculus
taatgcccctcaagcaatccagctg

SEQ ID NO: 460131 - DNA, 25 bp, Mus musculus
taatgcccgaatcccagatgtgcag

SEQ ID NO: 460132 - DNA, 25 bp, Mus musculus
taatgccgctgaggtccacgaaatc

SEQ ID NO: 460133 - DNA, 25 bp, Mus musculus
taatgcctctctttgtgtaatacct

SEQ ID NO: 460134 - DNA, 25 bp, Mus musculus
taatgcctgtaccacctgtttctgg

SEQ ID NO: 460135 - DNA, 25 bp, Mus musculus
taatgcgactaaggatccagatgcc

SEQ ID NO: 460136 - DNA, 25 bp, Mus musculus
taatgcgccaggattccatggagcc

SEQ ID NO: 460137 - DNA, 25 bp, Mus musculus
taatgcgctggctcggatcgatgct

SEQ ID NO: 460138 - DNA, 25 bp, Mus musculus
taatgcgcttggagtcggtgcctac

SEQ ID NO: 460139 - DNA, 25 bp, Mus musculus
taatgcggctgtgtccgtcctggag

SEQ ID NO: 460140 - DNA, 25 bp, Mus musculus
taatgctaactagaactctgaacaa

SEQ ID NO: 460141 - DNA, 25 bp, Mus musculus
taatgctaagagacgcgaggcagtg

SEQ ID NO: 460142 - DNA, 25 bp, Mus musculus
taatgctatgtagtgaaccaggaag

SEQ ID NO: 460143 - DNA, 25 bp, Mus musculus
taatgctcagctcccagggctctgg

SEQ ID NO: 460144 - DNA, 25 bp, Mus musculus
taatgctctgtgcaactcccatcac

SEQ ID NO: 460145 - DNA, 25 bp, Mus musculus
taatgctcttctcgatgaagcaaga

SEQ ID NO: 460146 - DNA, 25 bp, Mus musculus
taatgctctttctcgttctctggga

SEQ ID NO: 460147 - DNA, 25 bp, Mus musculus
taatgctgaccttcgaaagctggct

SEQ ID NO: 460148 - DNA, 25 bp, Mus musculus
taatgctgttgttcgctgcgggctc

SEQ ID NO: 460149 - DNA, 25 bp, Mus musculus
taatgcttcaagctcctggctggtg

SEQ ID NO: 460150 - DNA, 25 bp, Mus musculus
taatgcttcctaggtatctgtgtag

SEQ ID NO: 460151 - DNA, 25 bp, Mus musculus
taatgcttgtacaggccaaggccgt

SEQ ID NO: 460152 - DNA, 25 bp, Mus musculus
taatgctttggatacaacctgcgtg

SEQ ID NO: 460153 - DNA, 25 bp, Mus musculus
taatggaaccaaacctctggatggc

SEQ ID NO: 460154 - DNA, 25 bp, Mus musculus
taatggaagagatatcccgggcttc

SEQ ID NO: 460155 - DNA, 25 bp, Mus musculus
taatggaagcaattcttaaaacatg

SEQ ID NO: 460156 - DNA, 25 bp, Mus musculus
taatggaattaacagacccgcggtt

SEQ ID NO: 460157 - DNA, 25 bp, Mus musculus
taatggagacaggatatgcaacgcg

SEQ ID NO: 460158 - DNA, 25 bp, Mus musculus
taatggagaccgtcaacagcttgct

SEQ ID NO: 460159 - DNA, 25 bp, Mus musculus
taatggagatttggcatcagcaacc

SEQ ID NO: 460160 - DNA, 25 bp, Mus musculus
taatggagctccttaagaagtcggc

SEQ ID NO: 460161 - DNA, 25 bp, Mus musculus
taatggaggattatgtgggcaaccc

SEQ ID NO: 460162 - DNA, 25 bp, Mus musculus
taatggaggccatgacttcatcggc

SEQ ID NO: 460163 - DNA, 25 bp, Mus musculus
taatggatacccaccctgcagatag

SEQ ID NO: 460164 - DNA, 25 bp, Mus musculus
taatggatagctgcagaatgaccac

SEQ ID NO: 460165 - DNA, 25 bp, Mus musculus
taatggatccagtctgaccccagga

SEQ ID NO: 460166 - DNA, 25 bp, Mus musculus
taatggatctctcccaaacggtgat

SEQ ID NO: 460167 - DNA, 25 bp, Mus musculus
taatggatgccaaagcacgtgctga

SEQ ID NO: 460168 - DNA, 25 bp, Mus musculus
taatggattacagcagaggaccacc

SEQ ID NO: 460169 - DNA, 25 bp, Mus musculus
taatggattaccaccatcgtttcct

SEQ ID NO: 460170 - DNA, 25 bp, Mus musculus
taatggatttccttgcggaccgagg

SEQ ID NO: 460171 - DNA, 25 bp, Mus musculus
taatggcaccataggacagcactgg

SEQ ID NO: 460172 - DNA, 25 bp, Mus musculus
taatggcagcacaggtccacagtga

SEQ ID NO: 460173 - DNA, 25 bp, Mus musculus
taatggcattccttgactcggagtc

SEQ ID NO: 460174 - DNA, 25 bp, Mus musculus
taatggccacacagctgtcatccac

SEQ ID NO: 460175 - DNA, 25 bp, Mus musculus
taatggccatcaattgactgtacac

SEQ ID NO: 460176 - DNA, 25 bp, Mus musculus
taatggcccaggcttggacagagca

SEQ ID NO: 460177 - DNA, 25 bp, Mus musculus
taatggcccatagcaggtcttccag

SEQ ID NO: 460178 - DNA, 25 bp, Mus musculus
taatggcccgattatgttgctgttg

SEQ ID NO: 460179 - DNA, 25 bp, Mus musculus
taatggccctgcaccctatagtctt

SEQ ID NO: 460180 - DNA, 25 bp, Mus musculus
taatggccttggtcacctcagtcac

SEQ ID NO: 460181 - DNA, 25 bp, Mus musculus
taatggcggatccattaggattcac

SEQ ID NO: 460182 - DNA, 25 bp, Mus musculus
taatggcgggaagagacaccatcct

SEQ ID NO: 460183 - DNA, 25 bp, Mus musculus
taatggcgtaacatgatgggattgc

SEQ ID NO: 460184 - DNA, 25 bp, Mus musculus
taatggcgtctgcagcgctgtcgcc

SEQ ID NO: 460185 - DNA, 25 bp, Mus musculus
taatggctaccgtgtaacatggcgg

SEQ ID NO: 460186 - DNA, 25 bp, Mus musculus
taatggctcaagcaagcgtgctgca

SEQ ID NO: 460187 - DNA, 25 bp, Mus musculus
taatggctcagaggcaacaggtgca

SEQ ID NO: 460188 - DNA, 25 bp, Mus musculus
taatggctcaggtcttggtcccaag

SEQ ID NO: 460189 - DNA, 25 bp, Mus musculus
taatggctccctagaagtagcggtc

SEQ ID NO: 460190 - DNA, 25 bp, Mus musculus
taatggctctgaacttcagtcggac

SEQ ID NO: 460191 - DNA, 25 bp, Mus musculus
taatggctgaaagcagagcaatctg

SEQ ID NO: 460192 - DNA, 25 bp, Mus musculus
taatggcttatgataggtacctggc

SEQ ID NO: 460193 - DNA, 25 bp, Mus musculus
taatggcttctagaacctctgcaag

SEQ ID NO: 460194 - DNA, 25 bp, Mus musculus
taatggctttctcatctggccgggc

SEQ ID NO: 460195 - DNA, 25 bp, Mus musculus
taatgggaagtctcaaactctggga

SEQ ID NO: 460196 - DNA, 25 bp, Mus musculus
taatgggacaaaccaaccatggact

SEQ ID NO: 460197 - DNA, 25 bp, Mus musculus
taatgggagaagcttccagaggacc

SEQ ID NO: 460198 - DNA, 25 bp, Mus musculus
taatgggagtgaaacatgaggccag

SEQ ID NO: 460199 - DNA, 25 bp, Mus musculus
taatgggatgttgctaccacaagcc

SEQ ID NO: 460200 - DNA, 25 bp, Mus musculus
taatgggattgagtaccatcgccac

SEQ ID NO: 460201 - DNA, 25 bp, Mus musculus
taatgggcaaagtgatcctgtctct

SEQ ID NO: 460202 - DNA, 25 bp, Mus musculus
taatgggctggcatcagaactatca

SEQ ID NO: 460203 - DNA, 25 bp, Mus musculus
taatgggctgtaaccaggagctttc

SEQ ID NO: 460204 - DNA, 25 bp, Mus musculus
taatgggctttgcttaagagctccc

SEQ ID NO: 460205 - DNA, 25 bp, Mus musculus
taatgggttggcttgtgggtttctc

SEQ ID NO: 460206 - DNA, 25 bp, Mus musculus
taatggtaaaatgaggagacccggg

SEQ ID NO: 460207 - DNA, 25 bp, Mus musculus
taatggtcaccgtctgcagaccttt

SEQ ID NO: 460208 - DNA, 25 bp, Mus musculus
taatggtgcaaaggtacagctgtct

SEQ ID NO: 460209 - DNA, 25 bp, Mus musculus
taatggtgcgcttgcctaacacgcg

SEQ ID NO: 460210 - DNA, 25 bp, Mus musculus
taatggtggagggacattaccagcg

SEQ ID NO: 460211 - DNA, 25 bp, Mus musculus
taatggtgtgaagtgtggcagcccc

SEQ ID NO: 460212 - DNA, 25 bp, Mus musculus
taatggttcacagaacaccggtggc

SEQ ID NO: 460213 - DNA, 25 bp, Mus musculus
taatggttcacaggagctcaggaca

SEQ ID NO: 460214 - DNA, 25 bp, Mus musculus
taatggttcactttctggactggac

SEQ ID NO: 460215 - DNA, 25 bp, Mus musculus
taatggttcaggaaagacagctaca

SEQ ID NO: 460216 - DNA, 25 bp, Mus musculus
taatggttctcagtcagaggcagca

SEQ ID NO: 460217 - DNA, 25 bp, Mus musculus
taatggttctctgcacaaatgtgac

SEQ ID NO: 460218 - DNA, 25 bp, Mus musculus
taatggttgctttcggttttgctga

SEQ ID NO: 460219 - DNA, 25 bp, Mus musculus
taatggtttatatacaaaactctga

SEQ ID NO: 460220 - DNA, 25 bp, Mus musculus
taatgtaacaccacaccccatggaa

SEQ ID NO: 460221 - DNA, 25 bp, Mus musculus
taatgtaactggctctccggaaaga

SEQ ID NO: 460222 - DNA, 25 bp, Mus musculus
taatgtaagagagtacctagcctgc

SEQ ID NO: 460223 - DNA, 25 bp, Mus musculus
taatgtacaaggttcaggtgcgagc

SEQ ID NO: 460224 - DNA, 25 bp, Mus musculus
taatgtacccggaaagtgtccagca

SEQ ID NO: 460225 - DNA, 25 bp, Mus musculus
taatgtagcagtgaccagtagccag

SEQ ID NO: 460226 - DNA, 25 bp, Mus musculus
taatgtagctgtagccgagaacaca

SEQ ID NO: 460227 - DNA, 25 bp, Mus musculus
taatgtaggcctgacagaaagtggc

SEQ ID NO: 460228 - DNA, 25 bp, Mus musculus
taatgtataccattttctctactga

SEQ ID NO: 460229 - DNA, 25 bp, Mus musculus
taatgtcaacatgaagatagcctgg

SEQ ID NO: 460230 - DNA, 25 bp, Mus musculus
taatgtcacaagtctctaatcccgg

SEQ ID NO: 460231 - DNA, 25 bp, Mus musculus
taatgtcaccgacagctgtggcacg

SEQ ID NO: 460232 - DNA, 25 bp, Mus musculus
taatgtcagagcagaccccttcaag

SEQ ID NO: 460233 - DNA, 25 bp, Mus musculus
taatgtcattggcaccctcaaagga

SEQ ID NO: 460234 - DNA, 25 bp, Mus musculus
taatgtccaaatactctgaggtgca

SEQ ID NO: 460235 - DNA, 25 bp, Mus musculus
taatgtccacctggtcaagctcctg

SEQ ID NO: 460236 - DNA, 25 bp, Mus musculus
taatgtccactcttgtgagaaagca

SEQ ID NO: 460237 - DNA, 25 bp, Mus musculus
taatgtccatcctcttgaaataggg

SEQ ID NO: 460238 - DNA, 25 bp, Mus musculus
taatgtccatgggatgggagaatca

SEQ ID NO: 460239 - DNA, 25 bp, Mus musculus
taatgtccccagtgatgagcatggg

SEQ ID NO: 460240 - DNA, 25 bp, Mus musculus
taatgtccttactaaccactgatgg

SEQ ID NO: 460241 - DNA, 25 bp, Mus musculus
taatgtcgcaaggtggccgttactg

SEQ ID NO: 460242 - DNA, 25 bp, Mus musculus
taatgtctcctgtcatccagcatcc

SEQ ID NO: 460243 - DNA, 25 bp, Mus musculus
taatgtctgctgattcatcatctag

SEQ ID NO: 460244 - DNA, 25 bp, Mus musculus
taatgtcttagtgccctgggttcct

SEQ ID NO: 460245 - DNA, 25 bp, Mus musculus
taatgtcttgaaagctagctgcaca

SEQ ID NO: 460246 - DNA, 25 bp, Mus musculus
taatgtgaacactgtcaagaggaac

SEQ ID NO: 460247 - DNA, 25 bp, Mus musculus
taatgtgaccagtggacaacctgcc

SEQ ID NO: 460248 - DNA, 25 bp, Mus musculus
taatgtgacccaagcaccaggaagt

SEQ ID NO: 460249 - DNA, 25 bp, Mus musculus
taatgtgaggagtcagcaccgtgtc

SEQ ID NO: 460250 - DNA, 25 bp, Mus musculus
taatgtgcatgttcaagcccctggg

SEQ ID NO: 460251 - DNA, 25 bp, Mus musculus
taatgtgccccgtatccagtgtgaa

SEQ ID NO: 460252 - DNA, 25 bp, Mus musculus
taatgtgcctcctagtgaggccctg

SEQ ID NO: 460253 - DNA, 25 bp, Mus musculus
taatgtgcctcttctacctcagctg

SEQ ID NO: 460254 - DNA, 25 bp, Mus musculus
taatgtgcgtctcctgcgtctgctg

SEQ ID NO: 460255 - DNA, 25 bp, Mus musculus
taatgtgctctcaggacagactcag

SEQ ID NO: 460256 - DNA, 25 bp, Mus musculus
taatgtggactgaactgccctgtaa

SEQ ID NO: 460257 - DNA, 25 bp, Mus musculus
taatgtggcagaattcgactgaaga

SEQ ID NO: 460258 - DNA, 25 bp, Mus musculus
taatgtggcggtcaacaccaaggac

SEQ ID NO: 460259 - DNA, 25 bp, Mus musculus
taatgtgggcctgcactctatgaga

SEQ ID NO: 460260 - DNA, 25 bp, Mus musculus
taatgtgtaggtgaatgcagagtcc

SEQ ID NO: 460261 - DNA, 25 bp, Mus musculus
taatgtgtcccagagcttgaaggag

SEQ ID NO: 460262 - DNA, 25 bp, Mus musculus
taatgtgtgcataagttccgaggag

SEQ ID NO: 460263 - DNA, 25 bp, Mus musculus
taatgtgttcatcctgcggctgctg

SEQ ID NO: 460264 - DNA, 25 bp, Mus musculus
taatgttaaaaagcatgcgggcagg

SEQ ID NO: 460265 - DNA, 25 bp, Mus musculus
taatgttcatggaagcggctcgctc

SEQ ID NO: 460266 - DNA, 25 bp, Mus musculus
taatgttcccgatgtctacagccag

SEQ ID NO: 460267 - DNA, 25 bp, Mus musculus
taatgttcctgcagcgcagaggtca

SEQ ID NO: 460268 - DNA, 25 bp, Mus musculus
taatgttctgatcactgtgcgcccc

SEQ ID NO: 460269 - DNA, 25 bp, Mus musculus
taatgttgcgtagtgttctgcagcc

SEQ ID NO: 460270 - DNA, 25 bp, Mus musculus
taatgttgcgtctaaatgagttcag

SEQ ID NO: 460271 - DNA, 25 bp, Mus musculus
taatgttgctgttacccgtgctcgg

SEQ ID NO: 460272 - DNA, 25 bp, Mus musculus
taatgttgggacagatgacatcgcc

SEQ ID NO: 460273 - DNA, 25 bp, Mus musculus
taatgttgggatccagggctctcaa

SEQ ID NO: 460274 - DNA, 25 bp, Mus musculus
taatgttgtgagtaacccttggaca

SEQ ID NO: 460275 - DNA, 25 bp, Mus musculus
taatgttgtgcttcccctgagagag

SEQ ID NO: 460276 - DNA, 25 bp, Mus musculus
taatgtttagtaaatgttgtcctcc

SEQ ID NO: 460277 - DNA, 25 bp, Mus musculus
taatgtttgccaagctctcagcaga

SEQ ID NO: 460278 - DNA, 25 bp, Mus musculus
taatgttttacttagtgactgctag

SEQ ID NO: 460279 - DNA, 25 bp, Mus musculus
taattaaactcggtctgggctagct

SEQ ID NO: 460280 - DNA, 25 bp, Mus musculus
taattaaccatggaggagccagtgc

SEQ ID NO: 460281 - DNA, 25 bp, Mus musculus
taattaaccctcagactgcctagtg

SEQ ID NO: 460282 - DNA, 25 bp, Mus musculus
taattaacgaccaagcacctgtagc

SEQ ID NO: 460283 - DNA, 25 bp, Mus musculus
taattaactccctccacaccaaagg

SEQ ID NO: 460284 - DNA, 25 bp, Mus musculus
taattaagaatccagtgtccgacca

SEQ ID NO: 460285 - DNA, 25 bp, Mus musculus
taattaaggacgtcccactttgcca

SEQ ID NO: 460286 - DNA, 25 bp, Mus musculus
taattaaggcctacctatctggaac

SEQ ID NO: 460287 - DNA, 25 bp, Mus musculus
taattaagtgcatgaggcagaccgt

SEQ ID NO: 460288 - DNA, 25 bp, Mus musculus
taattaattgtagagcctgtgcata

SEQ ID NO: 460289 - DNA, 25 bp, Mus musculus
taattacactgaggaactggagagt

SEQ ID NO: 460290 - DNA, 25 bp, Mus musculus
taattacagacatcaaggagccaag

SEQ ID NO: 460291 - DNA, 25 bp, Mus musculus
taattacagacgaatagtcctggtt

SEQ ID NO: 460292 - DNA, 25 bp, Mus musculus
taattacagatttggtcaagttgac

SEQ ID NO: 460293 - DNA, 25 bp, Mus musculus
taattacagtgccatggcctaccgg

SEQ ID NO: 460294 - DNA, 25 bp, Mus musculus
taattacatcggcaagggctgtgac

SEQ ID NO: 460295 - DNA, 25 bp, Mus musculus
taattaccccatggtgctaggtgcc

SEQ ID NO: 460296 - DNA, 25 bp, Mus musculus
taattaccgtgtttgtgatggctac

SEQ ID NO: 460297 - DNA, 25 bp, Mus musculus
taattagaaagataaggccccgtgc

SEQ ID NO: 460298 - DNA, 25 bp, Mus musculus
taattagacactcggaatgaacgcg

SEQ ID NO: 460299 - DNA, 25 bp, Mus musculus
taattagccagtgacaaatgggaca

SEQ ID NO: 460300 - DNA, 25 bp, Mus musculus
taattagctccacggcgtatgccca

SEQ ID NO: 460301 - DNA, 25 bp, Mus musculus
taattagggaaagaaacatgcgcac

SEQ ID NO: 460302 - DNA, 25 bp, Mus musculus
taattagtctatagctcttggtggg

SEQ ID NO: 460303 - DNA, 25 bp, Mus musculus
taattagtgactttggaaacccagc

SEQ ID NO: 460304 - DNA, 25 bp, Mus musculus
taattagtgccctgcattctgtctg

SEQ ID NO: 460305 - DNA, 25 bp, Mus musculus
taattagttcccctgaaagtcacaa

SEQ ID NO: 460306 - DNA, 25 bp, Mus musculus
taattataggatgttccagtgtctg

SEQ ID NO: 460307 - DNA, 25 bp, Mus musculus
taattatgaatggtggcaatggcct

SEQ ID NO: 460308 - DNA, 25 bp, Mus musculus
taattattcccacactgccttcgct

SEQ ID NO: 460309 - DNA, 25 bp, Mus musculus
taattatttagtcccctgttcagca

SEQ ID NO: 460310 - DNA, 25 bp, Mus musculus
taattatttcgttcggaagcaccgg

SEQ ID NO: 460311 - DNA, 25 bp, Mus musculus
taattatttggaccggcacctaatc

SEQ ID NO: 460312 - DNA, 25 bp, Mus musculus
taattcaactctaaaggcttaaggg

SEQ ID NO: 460313 - DNA, 25 bp, Mus musculus
taattcaagagagatttccaagccc

SEQ ID NO: 460314 - DNA, 25 bp, Mus musculus
taattcacagtggtctggcactcga

SEQ ID NO: 460315 - DNA, 25 bp, Mus musculus
taattcagagtacccctttgctcag

SEQ ID NO: 460316 - DNA, 25 bp, Mus musculus
taattcatggcagcgactcggtgga

SEQ ID NO: 460317 - DNA, 25 bp, Mus musculus
taattccaacttgtatcacaccagt

SEQ ID NO: 460318 - DNA, 25 bp, Mus musculus
taattccagaacatacctcggcgca

SEQ ID NO: 460319 - DNA, 25 bp, Mus musculus
taattccagacatgctctgtagggc

SEQ ID NO: 460320 - DNA, 25 bp, Mus musculus
taattccagcgagagacagagggag

SEQ ID NO: 460321 - DNA, 25 bp, Mus musculus
taattccaggcatcaatggcatacc

SEQ ID NO: 460322 - DNA, 25 bp, Mus musculus
taattccccgaaatggtatgaggct

SEQ ID NO: 460323 - DNA, 25 bp, Mus musculus
taattccgtgacaacatgtgtgctg

SEQ ID NO: 460324 - DNA, 25 bp, Mus musculus
taattcctacttctgcatttgtggg

SEQ ID NO: 460325 - DNA, 25 bp, Mus musculus
taattcctcacgtagatgccggcaa

SEQ ID NO: 460326 - DNA, 25 bp, Mus musculus
taattcctccgatggtggacgcttg

SEQ ID NO: 460327 - DNA, 25 bp, Mus musculus
taattcctggaaggctgatgaagag

SEQ ID NO: 460328 - DNA, 25 bp, Mus musculus
taattccttggaaagccttgggcga

SEQ ID NO: 460329 - DNA, 25 bp, Mus musculus
taattcgtcaccaaggcaaagagct

SEQ ID NO: 460330 - DNA, 25 bp, Mus musculus
taattctacatatgccactgggtcc

SEQ ID NO: 460331 - DNA, 25 bp, Mus musculus
taattctgaggttacaaagtccatt

SEQ ID NO: 460332 - DNA, 25 bp, Mus musculus
taattctgcccacctcaagagggag

SEQ ID NO: 460333 - DNA, 25 bp, Mus musculus
taattctggagattgcctctggtca

SEQ ID NO: 460334 - DNA, 25 bp, Mus musculus
taattctggcttttaagaggccata

SEQ ID NO: 460335 - DNA, 25 bp, Mus musculus
taattcttgctaccaggactgccca

SEQ ID NO: 460336 - DNA, 25 bp, Mus musculus
taattctttaaaaatccacgcggag

SEQ ID NO: 460337 - DNA, 25 bp, Mus musculus
taattgaaaggactggccgtcagcg

SEQ ID NO: 460338 - DNA, 25 bp, Mus musculus
taattgacaatcaccgcaaagactg

SEQ ID NO: 460339 - DNA, 25 bp, Mus musculus
taattgacgaaaatgctggactggg

SEQ ID NO: 460340 - DNA, 25 bp, Mus musculus
taattgacgagcttggcagaggcac

SEQ ID NO: 460341 - DNA, 25 bp, Mus musculus
taattgactcaaggcaaacaagtga

SEQ ID NO: 460342 - DNA, 25 bp, Mus musculus
taattgagacagacctagaacagct

SEQ ID NO: 460343 - DNA, 25 bp, Mus musculus
taattgagacgtttctgtggataac

SEQ ID NO: 460344 - DNA, 25 bp, Mus musculus
taattgaggaagacactctggcacc

SEQ ID NO: 460345 - DNA, 25 bp, Mus musculus
taattgatttgtttgggaacgagca

SEQ ID NO: 460346 - DNA, 25 bp, Mus musculus
taattgcaagtcgacacacggaaga

SEQ ID NO: 460347 - DNA, 25 bp, Mus musculus
taattgcaccgtggccaacgaagaa

SEQ ID NO: 460348 - DNA, 25 bp, Mus musculus
taattgcagcctgaagcgtgtgcgc

SEQ ID NO: 460349 - DNA, 25 bp, Mus musculus
taattgcagtctatgggagcatcca

SEQ ID NO: 460350 - DNA, 25 bp, Mus musculus
taattgccagattggtctctgggca

SEQ ID NO: 460351 - DNA, 25 bp, Mus musculus
taattgccagggaactctcattggg

SEQ ID NO: 460352 - DNA, 25 bp, Mus musculus
taattgccccacattcaagttttgg

SEQ ID NO: 460353 - DNA, 25 bp, Mus musculus
taattgccccttgtctaatgccaga

SEQ ID NO: 460354 - DNA, 25 bp, Mus musculus
taattgcctgctgcccactggatct

SEQ ID NO: 460355 - DNA, 25 bp, Mus musculus
taattgccttactggctggctgacg

SEQ ID NO: 460356 - DNA, 25 bp, Mus musculus
taattgccttctcgctgggtgccct

SEQ ID NO: 460357 - DNA, 25 bp, Mus musculus
taattgcggatgtgtacagccccac

SEQ ID NO: 460358 - DNA, 25 bp, Mus musculus
taattgctaagagcatcgcccagcc

SEQ ID NO: 460359 - DNA, 25 bp, Mus musculus
taattgctcattggccatagtcttg

SEQ ID NO: 460360 - DNA, 25 bp, Mus musculus
taattgctgatacttacatgggaag

SEQ ID NO: 460361 - DNA, 25 bp, Mus musculus
taattgctgggacggaaaaccggat

SEQ ID NO: 460362 - DNA, 25 bp, Mus musculus
taattgctgtgttgcctctcctggg

SEQ ID NO: 460363 - DNA, 25 bp, Mus musculus
taattggagtgcttctcctctgcac

SEQ ID NO: 460364 - DNA, 25 bp, Mus musculus
taattggatcatgcacgcactgagg

SEQ ID NO: 460365 - DNA, 25 bp, Mus musculus
taattggcctcatctggactagcga

SEQ ID NO: 460366 - DNA, 25 bp, Mus musculus
taattggcttgatctgtcattccgc

SEQ ID NO: 460367 - DNA, 25 bp, Mus musculus
taattgggatcttgctttcagcagg

SEQ ID NO: 460368 - DNA, 25 bp, Mus musculus
taattgggattacaactccttggca

SEQ ID NO: 460369 - DNA, 25 bp, Mus musculus
taattgggcttatgacttaagagca

SEQ ID NO: 460370 - DNA, 25 bp, Mus musculus
taattggtaccgatttgaatggctg

SEQ ID NO: 460371 - DNA, 25 bp, Mus musculus
taattggtactcatggcggtgagac

SEQ ID NO: 460372 - DNA, 25 bp, Mus musculus
taattggtcctgagtggcgtctggt

SEQ ID NO: 460373 - DNA, 25 bp, Mus musculus
taattggtgtttggcttgtgtagga

SEQ ID NO: 460374 - DNA, 25 bp, Mus musculus
taattgtaagattgtactccaagcc

SEQ ID NO: 460375 - DNA, 25 bp, Mus musculus
taattgtcagcaggatcacaggcag

SEQ ID NO: 460376 - DNA, 25 bp, Mus musculus
taattgtccaagctaagtcgggcac

SEQ ID NO: 460377 - DNA, 25 bp, Mus musculus
taattgtggccgtcataggaagaag

SEQ ID NO: 460378 - DNA, 25 bp, Mus musculus
taattgtgggtttttcaacttactg

SEQ ID NO: 460379 - DNA, 25 bp, Mus musculus
taattgtggtgatccagaacctgtc

SEQ ID NO: 460380 - DNA, 25 bp, Mus musculus
taattgtggttgctttgacaggcct

SEQ ID NO: 460381 - DNA, 25 bp, Mus musculus
taattgtggttttggagcagctcat

SEQ ID NO: 460382 - DNA, 25 bp, Mus musculus
taattgtgtatccagtagctccatc

SEQ ID NO: 460383 - DNA, 25 bp, Mus musculus
taattgttcctatgtctcctgccag

SEQ ID NO: 460384 - DNA, 25 bp, Mus musculus
taattgtttcaggtattcatagatg

SEQ ID NO: 460385 - DNA, 25 bp, Mus musculus
taattgtttgctagacctaccacgg

SEQ ID NO: 460386 - DNA, 25 bp, Mus musculus
taatttaagttacgatggaagagct

SEQ ID NO: 460387 - DNA, 25 bp, Mus musculus
taatttacccgagtaacggctgcga

SEQ ID NO: 460388 - DNA, 25 bp, Mus musculus
taatttaccgtcacgaagtggaggg

SEQ ID NO: 460389 - DNA, 25 bp, Mus musculus
taatttacgaatctaggctgccaga

SEQ ID NO: 460390 - DNA, 25 bp, Mus musculus
taatttaggcagctgtcagaaaggc

SEQ ID NO: 460391 - DNA, 25 bp, Mus musculus
taatttattgactccagtgcccagg

SEQ ID NO: 460392 - DNA, 25 bp, Mus musculus
taatttcactgtcgttctaagggct

SEQ ID NO: 460393 - DNA, 25 bp, Mus musculus
taatttccacagcaggtcagcaagc

SEQ ID NO: 460394 - DNA, 25 bp, Mus musculus
taatttccactaagaagtacacaag

SEQ ID NO: 460395 - DNA, 25 bp, Mus musculus
taatttccactcagactgagcatgt

SEQ ID NO: 460396 - DNA, 25 bp, Mus musculus
taatttccatggtacttccaagccc

SEQ ID NO: 460397 - DNA, 25 bp, Mus musculus
taatttcccagtgcgaaggtcctgc

SEQ ID NO: 460398 - DNA, 25 bp, Mus musculus
taatttcgggatcctatgtgtcggc

SEQ ID NO: 460399 - DNA, 25 bp, Mus musculus
taatttcgggtgatgttggccagag

SEQ ID NO: 460400 - DNA, 25 bp, Mus musculus
taatttctgagcagaatttgctaag

SEQ ID NO: 460401 - DNA, 25 bp, Mus musculus
taatttctgatgattataaccggga

SEQ ID NO: 460402 - DNA, 25 bp, Mus musculus
taatttctgccgagacctggacctg

SEQ ID NO: 460403 - DNA, 25 bp, Mus musculus
taatttctggtggatacttgctaat

SEQ ID NO: 460404 - DNA, 25 bp, Mus musculus
taatttctttggtttactgccaggc

SEQ ID NO: 460405 - DNA, 25 bp, Mus musculus
taatttcttttgctaactggtttga

SEQ ID NO: 460406 - DNA, 25 bp, Mus musculus
taatttgccagttgagaatgcacct

SEQ ID NO: 460407 - DNA, 25 bp, Mus musculus
taatttgccttgacttgaaagacgc

SEQ ID NO: 460408 - DNA, 25 bp, Mus musculus
taatttgctttgacttcaattggga

SEQ ID NO: 460409 - DNA, 25 bp, Mus musculus
taatttggcccttaagccttggagc

SEQ ID NO: 460410 - DNA, 25 bp, Mus musculus
taatttgggacaccttgcttctgct

SEQ ID NO: 460411 - DNA, 25 bp, Mus musculus
taatttgtaagagcaggtccctgga

SEQ ID NO: 460412 - DNA, 25 bp, Mus musculus
taatttgtccgaagccgtgagcagc

SEQ ID NO: 460413 - DNA, 25 bp, Mus musculus
taattttcattgtcaccctgaccgg

SEQ ID NO: 460414 - DNA, 25 bp, Mus musculus
taattttccatgctatgcctcagga

SEQ ID NO: 460415 - DNA, 25 bp, Mus musculus
taattttcttctggtgcgagtgcac

SEQ ID NO: 460416 - DNA, 25 bp, Mus musculus
taattttgctctgttgctggaaggc

SEQ ID NO: 460417 - DNA, 25 bp, Mus musculus
taattttggatcgaatgctgcccga

SEQ ID NO: 460418 - DNA, 25 bp, Mus musculus
taattttggcaagtcaccagctgtc

SEQ ID NO: 460419 - DNA, 25 bp, Mus musculus
taattttgtccaccagctgacagag

SEQ ID NO: 460420 - DNA, 25 bp, Mus musculus
taatttttagcgatgatctggagca

SEQ ID NO: 460421 - DNA, 25 bp, Mus musculus
taatttttggcaagattaggtagcc

SEQ ID NO: 460422 - DNA, 25 bp, Mus musculus
tacaaaacataatcaatccctgggc

SEQ ID NO: 460423 - DNA, 25 bp, Mus musculus
tacaaaacatcggtgggcgacaact

SEQ ID NO: 460424 - DNA, 25 bp, Mus musculus
tacaaaactgctcaggcctggcgga

SEQ ID NO: 460425 - DNA, 25 bp, Mus musculus
tacaaaagaaggacgttccctgcgc

SEQ ID NO: 460426 - DNA, 25 bp, Mus musculus
tacaaaagagagaacccgggcatgt

SEQ ID NO: 460427 - DNA, 25 bp, Mus musculus
tacaaaaggacacgttcaagggaat

SEQ ID NO: 460428 - DNA, 25 bp, Mus musculus
tacaaaatgaaaggcacatcttaag

SEQ ID NO: 460429 - DNA, 25 bp, Mus musculus
tacaaacaagattaggaagccccaa

SEQ ID NO: 460430 - DNA, 25 bp, Mus musculus
tacaaacacgctcactgtggtggtc

SEQ ID NO: 460431 - DNA, 25 bp, Mus musculus
tacaaacacggactcttagacaaca

SEQ ID NO: 460432 - DNA, 25 bp, Mus musculus
tacaaacagaaagaagagagccgcc

SEQ ID NO: 460433 - DNA, 25 bp, Mus musculus
tacaaacagaggtcactggacaacg

SEQ ID NO: 460434 - DNA, 25 bp, Mus musculus
tacaaaccagcagaatatcctgcct

SEQ ID NO: 460435 - DNA, 25 bp, Mus musculus
tacaaaccccgtgtctcaggtggaa

SEQ ID NO: 460436 - DNA, 25 bp, Mus musculus
tacaaaccgaagcagttcagcatgc

SEQ ID NO: 460437 - DNA, 25 bp, Mus musculus
tacaaacctatgagctgagccacaa

SEQ ID NO: 460438 - DNA, 25 bp, Mus musculus
tacaaaccttgacctgatgagggac

SEQ ID NO: 460439 - DNA, 25 bp, Mus musculus
tacaaacgaccaatgaaaccagctg

SEQ ID NO: 460440 - DNA, 25 bp, Mus musculus
tacaaacgagtaccattcatggagc

SEQ ID NO: 460441 - DNA, 25 bp, Mus musculus
tacaaacgcagctgctaagttgccg

SEQ ID NO: 460442 - DNA, 25 bp, Mus musculus
tacaaactacctgggcatcgagtgg

SEQ ID NO: 460443 - DNA, 25 bp, Mus musculus
tacaaactcacggatttcggcgccg

SEQ ID NO: 460444 - DNA, 25 bp, Mus musculus
tacaaactcctggtgcagactggca

SEQ ID NO: 460445 - DNA, 25 bp, Mus musculus
tacaaactgatgaagctcgtcaggc

SEQ ID NO: 460446 - DNA, 25 bp, Mus musculus
tacaaactgccactgagatttctgc

SEQ ID NO: 460447 - DNA, 25 bp, Mus musculus
tacaaacttccaagatatactcggg

SEQ ID NO: 460448 - DNA, 25 bp, Mus musculus
tacaaacttggtggcaggctgctta

SEQ ID NO: 460449 - DNA, 25 bp, Mus musculus
tacaaagaggctggagctgggccaa

SEQ ID NO: 460450 - DNA, 25 bp, Mus musculus
tacaaagcacagcatgccaccgtgt

SEQ ID NO: 460451 - DNA, 25 bp, Mus musculus
tacaaagcagcatcttgaaggcgca

SEQ ID NO: 460452 - DNA, 25 bp, Mus musculus
tacaaagcctaggaggaagcagctc

SEQ ID NO: 460453 - DNA, 25 bp, Mus musculus
tacaaagcctcagggataatccaca

SEQ ID NO: 460454 - DNA, 25 bp, Mus musculus
tacaaagcctgcaggggtaagagcc

SEQ ID NO: 460455 - DNA, 25 bp, Mus musculus
tacaaagctactgtggccagtgacc

SEQ ID NO: 460456 - DNA, 25 bp, Mus musculus
tacaaagctattttccctggagtgg

SEQ ID NO: 460457 - DNA, 25 bp, Mus musculus
tacaaagctcatagaacagcatgtg

SEQ ID NO: 460458 - DNA, 25 bp, Mus musculus
tacaaagctggagattactggcgcc

SEQ ID NO: 460459 - DNA, 25 bp, Mus musculus
tacaaagctgggataccgtcgtcac

SEQ ID NO: 460460 - DNA, 25 bp, Mus musculus
tacaaaggaatgaactgcggcccac

SEQ ID NO: 460461 - DNA, 25 bp, Mus musculus
tacaaaggacgaggaacagtgagcc

SEQ ID NO: 460462 - DNA, 25 bp, Mus musculus
tacaaaggagagacggagaagcacg

SEQ ID NO: 460463 - DNA, 25 bp, Mus musculus
tacaaaggctccaactcagaacagc

SEQ ID NO: 460464 - DNA, 25 bp, Mus musculus
tacaaagggacatcagttcgagacc

SEQ ID NO: 460465 - DNA, 25 bp, Mus musculus
tacaaagggctgattgcatttaaca

SEQ ID NO: 460466 - DNA, 25 bp, Mus musculus
tacaaagtcactgtgggcgaagttc

SEQ ID NO: 460467 - DNA, 25 bp, Mus musculus
tacaaagtccgccttcctgagaacg

SEQ ID NO: 460468 - DNA, 25 bp, Mus musculus
tacaaagtctctagctgcgagcaga

SEQ ID NO: 460469 - DNA, 25 bp, Mus musculus
tacaaagtgagcagtagcaggactg

SEQ ID NO: 460470 - DNA, 25 bp, Mus musculus
tacaaagtgcttcttcagctgcgta

SEQ ID NO: 460471 - DNA, 25 bp, Mus musculus
tacaaagtgggttcccttgggccag

SEQ ID NO: 460472 - DNA, 25 bp, Mus musculus
tacaaagttccagtccccgtaactg

SEQ ID NO: 460473 - DNA, 25 bp, Mus musculus
tacaaatactcagggagggaggctt

SEQ ID NO: 460474 - DNA, 25 bp, Mus musculus
tacaaatagtcaagtaaaggttggg

SEQ ID NO: 460475 - DNA, 25 bp, Mus musculus
tacaaatccgaaagtacagatggct

SEQ ID NO: 460476 - DNA, 25 bp, Mus musculus
tacaaatcgctgagacacaggtccg

SEQ ID NO: 460477 - DNA, 25 bp, Mus musculus
tacaaatcttcagggaatggccaag

SEQ ID NO: 460478 - DNA, 25 bp, Mus musculus
tacaaatgaagtcggctggtttccc

SEQ ID NO: 460479 - DNA, 25 bp, Mus musculus
tacaaatgccttcaacatggaggat

SEQ ID NO: 460480 - DNA, 25 bp, Mus musculus
tacaaatggcgagggaaagcacaca

SEQ ID NO: 460481 - DNA, 25 bp, Mus musculus
tacaaatgggcactactataggact

SEQ ID NO: 460482 - DNA, 25 bp, Mus musculus
tacaaatgtcccaactgctaccggg

SEQ ID NO: 460483 - DNA, 25 bp, Mus musculus
tacaaatgtgatcgctgccaggcct

SEQ ID NO: 460484 - DNA, 25 bp, Mus musculus
tacaaatgtgtgtgacctgaaccca

SEQ ID NO: 460485 - DNA, 25 bp, Mus musculus
tacaaatgttccagtgccctttgaa

SEQ ID NO: 460486 - DNA, 25 bp, Mus musculus
tacaaattaccctcactgtgagtgt

SEQ ID NO: 460487 - DNA, 25 bp, Mus musculus
tacaaattattgtgcggatcccagc

SEQ ID NO: 460488 - DNA, 25 bp, Mus musculus
tacaaattccagttcaagctatgag

SEQ ID NO: 460489 - DNA, 25 bp, Mus musculus
tacaaattgtctgactccctcagtg

SEQ ID NO: 460490 - DNA, 25 bp, Mus musculus
tacaacaaagggagactgtcggctc

SEQ ID NO: 460491 - DNA, 25 bp, Mus musculus
tacaacaaccgagtggagatggcca

SEQ ID NO: 460492 - DNA, 25 bp, Mus musculus
tacaacaactcactagggccggagc

SEQ ID NO: 460493 - DNA, 25 bp, Mus musculus
tacaacaaggcagataaccccaggg

SEQ ID NO: 460494 - DNA, 25 bp, Mus musculus
tacaacaatgtctggtgtggcgcct

SEQ ID NO: 460495 - DNA, 25 bp, Mus musculus
tacaacaccagtgtggacgtgcgcc

SEQ ID NO: 460496 - DNA, 25 bp, Mus musculus
tacaacacctttgggtctgcagagg

SEQ ID NO: 460497 - DNA, 25 bp, Mus musculus
tacaacagagttggcaagtgtggca

SEQ ID NO: 460498 - DNA, 25 bp, Mus musculus
tacaacagccagcaagaatccaagg

SEQ ID NO: 460499 - DNA, 25 bp, Mus musculus
tacaacagcgcttgcaagagaaagc

SEQ ID NO: 460500 - DNA, 25 bp, Mus musculus
tacaacagctccgagtacgagggtc

SEQ ID NO: 460501 - DNA, 25 bp, Mus musculus
tacaacagctgtgggctaatcatgc

SEQ ID NO: 460502 - DNA, 25 bp, Mus musculus
tacaacaggctggataggaacccta

SEQ ID NO: 460503 - DNA, 25 bp, Mus musculus
tacaacagtaatgtgacagcatggg

SEQ ID NO: 460504 - DNA, 25 bp, Mus musculus
tacaacagtgtcgttaaccctaaca

SEQ ID NO: 460505 - DNA, 25 bp, Mus musculus
tacaacatacttgctggatgcccta

SEQ ID NO: 460506 - DNA, 25 bp, Mus musculus
tacaacatatccaccgaagactgcg

SEQ ID NO: 460507 - DNA, 25 bp, Mus musculus
tacaacatcaagcagaccgtggaag

SEQ ID NO: 460508 - DNA, 25 bp, Mus musculus
tacaacatcatgtgccacgtcgcag

SEQ ID NO: 460509 - DNA, 25 bp, Mus musculus
tacaacatctccagcacagtcaggg

SEQ ID NO: 460510 - DNA, 25 bp, Mus musculus
tacaacatgcatctggaatggctga

SEQ ID NO: 460511 - DNA, 25 bp, Mus musculus
tacaacatggagacctatgaccgca

SEQ ID NO: 460512 - DNA, 25 bp, Mus musculus
tacaacatggagtggaaatgggcat

SEQ ID NO: 460513 - DNA, 25 bp, Mus musculus
tacaacatgtatacctgcgggccca

SEQ ID NO: 460514 - DNA, 25 bp, Mus musculus
tacaaccaaccaagcatagacacag

SEQ ID NO: 460515 - DNA, 25 bp, Mus musculus
tacaaccaaggtgcattctaggaga

SEQ ID NO: 460516 - DNA, 25 bp, Mus musculus
tacaaccaatgtgctccgctgggca

SEQ ID NO: 460517 - DNA, 25 bp, Mus musculus
tacaaccacgtgtccaagtactgtg

SEQ ID NO: 460518 - DNA, 25 bp, Mus musculus
tacaaccactatggcgaccagattg

SEQ ID NO: 460519 - DNA, 25 bp, Mus musculus
tacaaccagcgcatgatggagcagc

SEQ ID NO: 460520 - DNA, 25 bp, Mus musculus
tacaaccaggaacaggagcaatgca

SEQ ID NO: 460521 - DNA, 25 bp, Mus musculus
tacaacccagtttggaaagcccaag

SEQ ID NO: 460522 - DNA, 25 bp, Mus musculus
tacaacccctacacggacagagtgg

SEQ ID NO: 460523 - DNA, 25 bp, Mus musculus
tacaacccctacaggtgggccttca

SEQ ID NO: 460524 - DNA, 25 bp, Mus musculus
tacaaccctatggtggcttccgggc

SEQ ID NO: 460525 - DNA, 25 bp, Mus musculus
tacaaccgcaaagatgggaagccct

SEQ ID NO: 460526 - DNA, 25 bp, Mus musculus
tacaaccgtgctacgagtgacagct

SEQ ID NO: 460527 - DNA, 25 bp, Mus musculus
tacaacctcctacaggtggtgcgcg

SEQ ID NO: 460528 - DNA, 25 bp, Mus musculus
tacaacctgtgtgaaagagtgccca

SEQ ID NO: 460529 - DNA, 25 bp, Mus musculus
tacaacctgtgtgcccagggacaag

SEQ ID NO: 460530 - DNA, 25 bp, Mus musculus
tacaacctttatgttggaatttgga

SEQ ID NO: 460531 - DNA, 25 bp, Mus musculus
tacaacgcagatgaagctagaagtc

SEQ ID NO: 460532 - DNA, 25 bp, Mus musculus
tacaacgctgtgtgaagaaccgggc

SEQ ID NO: 460533 - DNA, 25 bp, Mus musculus
tacaacggaatggaaagagacccct

SEQ ID NO: 460534 - DNA, 25 bp, Mus musculus
tacaacgggcatccaataaggcggg

SEQ ID NO: 460535 - DNA, 25 bp, Mus musculus
tacaacgggccttgagctggtggac

SEQ ID NO: 460536 - DNA, 25 bp, Mus musculus
tacaacgtgaacatggccttggcgg

SEQ ID NO: 460537 - DNA, 25 bp, Mus musculus
tacaacgtgacagagaaggtgcggc

SEQ ID NO: 460538 - DNA, 25 bp, Mus musculus
tacaacgtggtcatctgcatcgcct

SEQ ID NO: 460539 - DNA, 25 bp, Mus musculus
tacaactacgttcaagggacagcac

SEQ ID NO: 460540 - DNA, 25 bp, Mus musculus
tacaactcaagaagaggtcccgtgc

SEQ ID NO: 460541 - DNA, 25 bp, Mus musculus
tacaactcacgctatagaccaggct

SEQ ID NO: 460542 - DNA, 25 bp, Mus musculus
tacaactcatgactggtcagcctgg

SEQ ID NO: 460543 - DNA, 25 bp, Mus musculus
tacaactccgtgaggcaaaggacca

SEQ ID NO: 460544 - DNA, 25 bp, Mus musculus
tacaactcggacagggataacagct

SEQ ID NO: 460545 - DNA, 25 bp, Mus musculus
tacaactgagtgtgccctaggaaga

SEQ ID NO: 460546 - DNA, 25 bp, Mus musculus
tacaactgatctgcaacgtcacggg

SEQ ID NO: 460547 - DNA, 25 bp, Mus musculus
tacaactgcactgtctgtggccgca

SEQ ID NO: 460548 - DNA, 25 bp, Mus musculus
tacaactgctcttggaatctgggcc

SEQ ID NO: 460549 - DNA, 25 bp, Mus musculus
tacaactggctcctcggtgactcta

SEQ ID NO: 460550 - DNA, 25 bp, Mus musculus
tacaactgggcatggcaggataagg

SEQ ID NO: 460551 - DNA, 25 bp, Mus musculus
tacaactgtaactgtaggtgccagc

SEQ ID NO: 460552 - DNA, 25 bp, Mus musculus
tacaactgtgaatcaccaggccagt

SEQ ID NO: 460553 - DNA, 25 bp, Mus musculus
tacaactgttctctgctggacggca

SEQ ID NO: 460554 - DNA, 25 bp, Mus musculus
tacaactgttgtgccaggaggtgaa

SEQ ID NO: 460555 - DNA, 25 bp, Mus musculus
tacaactgtttgtcccttagagggc

SEQ ID NO: 460556 - DNA, 25 bp, Mus musculus
tacaacttataaacacgcggcagcc

SEQ ID NO: 460557 - DNA, 25 bp, Mus musculus
tacaacttgcggctgaggtcgcaga

SEQ ID NO: 460558 - DNA, 25 bp, Mus musculus
tacaacttgtatgggaaggacctga

SEQ ID NO: 460559 - DNA, 25 bp, Mus musculus
tacaagaacaacttagctgaccagt

SEQ ID NO: 460560 - DNA, 25 bp, Mus musculus
tacaagaactgcagacggtggctga

SEQ ID NO: 460561 - DNA, 25 bp, Mus musculus
tacaagaagatcgtcctgaatggcc

SEQ ID NO: 460562 - DNA, 25 bp, Mus musculus
tacaagaagatggtgctgcccaacc

SEQ ID NO: 460563 - DNA, 25 bp, Mus musculus
tacaagaaggctggtcaggagcgcc

SEQ ID NO: 460564 - DNA, 25 bp, Mus musculus
tacaagaaggtgatggctgctctac

SEQ ID NO: 460565 - DNA, 25 bp, Mus musculus
tacaagaagtcacagcacatgacgg

SEQ ID NO: 460566 - DNA, 25 bp, Mus musculus
tacaagaagtttcccagcaagcaac

SEQ ID NO: 460567 - DNA, 25 bp, Mus musculus
tacaagaattcacccggcaaggctg

SEQ ID NO: 460568 - DNA, 25 bp, Mus musculus
tacaagacacaggactacccatcag

SEQ ID NO: 460569 - DNA, 25 bp, Mus musculus
tacaagacagtgaaattgggcgcga

SEQ ID NO: 460570 - DNA, 25 bp, Mus musculus
tacaagaccattgcacgagaggaag

SEQ ID NO: 460571 - DNA, 25 bp, Mus musculus
tacaagaccgaccaagctgttcagg

SEQ ID NO: 460572 - DNA, 25 bp, Mus musculus
tacaagacctttgctgcttctgctg

SEQ ID NO: 460573 - DNA, 25 bp, Mus musculus
tacaagacgcatctgtttgggcggc

SEQ ID NO: 460574 - DNA, 25 bp, Mus musculus
tacaagactgtactctgtccatcgg

SEQ ID NO: 460575 - DNA, 25 bp, Mus musculus
tacaagacttcagagtagcgatctc

SEQ ID NO: 460576 - DNA, 25 bp, Mus musculus
tacaagagaccgacagatgaaccag

SEQ ID NO: 460577 - DNA, 25 bp, Mus musculus
tacaagagagtcctgtgaacagtca

SEQ ID NO: 460578 - DNA, 25 bp, Mus musculus
tacaagagattatcggcaagggccg

SEQ ID NO: 460579 - DNA, 25 bp, Mus musculus
tacaagaggcactgcgggagcattc

SEQ ID NO: 460580 - DNA, 25 bp, Mus musculus
tacaagaggcacttccatgaggaca

SEQ ID NO: 460581 - DNA, 25 bp, Mus musculus
tacaagaggttatgattttacaaca

SEQ ID NO: 460582 - DNA, 25 bp, Mus musculus
tacaagagttccttaccctgctggc

SEQ ID NO: 460583 - DNA, 25 bp, Mus musculus
tacaagagttctaaggttgccaccc

SEQ ID NO: 460584 - DNA, 25 bp, Mus musculus
tacaagatcctgaagacggcaacca

SEQ ID NO: 460585 - DNA, 25 bp, Mus musculus
tacaagatggccagcacggatgagt

SEQ ID NO: 460586 - DNA, 25 bp, Mus musculus
tacaagattagacgagctgccacga

SEQ ID NO: 460587 - DNA, 25 bp, Mus musculus
tacaagattatggagactatagccc

SEQ ID NO: 460588 - DNA, 25 bp, Mus musculus
tacaagcaaagcaggccgagaaggc

SEQ ID NO: 460589 - DNA, 25 bp, Mus musculus
tacaagcaagagttcagcgccaagg

SEQ ID NO: 460590 - DNA, 25 bp, Mus musculus
tacaagcaatagtgcaactggttct

SEQ ID NO: 460591 - DNA, 25 bp, Mus musculus
tacaagcagggaacacagaggtcac

SEQ ID NO: 460592 - DNA, 25 bp, Mus musculus
tacaagcatgcaagggtctactagc

SEQ ID NO: 460593 - DNA, 25 bp, Mus musculus
tacaagcattgcctagacggacgtt

SEQ ID NO: 460594 - DNA, 25 bp, Mus musculus
tacaagcccttgcaattggtgaccg

SEQ ID NO: 460595 - DNA, 25 bp, Mus musculus
tacaagcctatcatgcagaccacag

SEQ ID NO: 460596 - DNA, 25 bp, Mus musculus
tacaagcctgccaggtaccctgtga

SEQ ID NO: 460597 - DNA, 25 bp, Mus musculus
tacaagcgcctggagaaaagtggat

SEQ ID NO: 460598 - DNA, 25 bp, Mus musculus
tacaagcgcttgtgctaacagagcc

SEQ ID NO: 460599 - DNA, 25 bp, Mus musculus
tacaagcggagagtttatgcccaga

SEQ ID NO: 460600 - DNA, 25 bp, Mus musculus
tacaagctaaattccagaagagagc

SEQ ID NO: 460601 - DNA, 25 bp, Mus musculus
tacaagctagatcgaatcaagggcg

SEQ ID NO: 460602 - DNA, 25 bp, Mus musculus
tacaagctccataatggcgcccggg

SEQ ID NO: 460603 - DNA, 25 bp, Mus musculus
tacaagctcgctgggatcactggag

SEQ ID NO: 460604 - DNA, 25 bp, Mus musculus
tacaagctgagtagtgagggcacct

SEQ ID NO: 460605 - DNA, 25 bp, Mus musculus
tacaagctgctagtggccgatgctg

SEQ ID NO: 460606 - DNA, 25 bp, Mus musculus
tacaagctggcaacatgctaggcac

SEQ ID NO: 460607 - DNA, 25 bp, Mus musculus
tacaagctggtcatcactggagccc

SEQ ID NO: 460608 - DNA, 25 bp, Mus musculus
tacaagctgtcatgcatgagccctg

SEQ ID NO: 460609 - DNA, 25 bp, Mus musculus
tacaagctgtgacactcgcagacgg

SEQ ID NO: 460610 - DNA, 25 bp, Mus musculus
tacaaggaaagaagcagcctgggcc

SEQ ID NO: 460611 - DNA, 25 bp, Mus musculus
tacaaggaactcaatactcgtggtg

SEQ ID NO: 460612 - DNA, 25 bp, Mus musculus
tacaaggagagattggccaagcacg

SEQ ID NO: 460613 - DNA, 25 bp, Mus musculus
tacaaggagtcagagtaaccccttc

SEQ ID NO: 460614 - DNA, 25 bp, Mus musculus
tacaaggagttacttccatcagctg

SEQ ID NO: 460615 - DNA, 25 bp, Mus musculus
tacaaggatggctcaacaagggcag

SEQ ID NO: 460616 - DNA, 25 bp, Mus musculus
tacaaggatttctacgaccatggag

SEQ ID NO: 460617 - DNA, 25 bp, Mus musculus
tacaaggcaaagaggaactgctggc

SEQ ID NO: 460618 - DNA, 25 bp, Mus musculus
tacaaggcaaggacttactcaccgc

SEQ ID NO: 460619 - DNA, 25 bp, Mus musculus
tacaaggcagaacacaataaaaggg

SEQ ID NO: 460620 - DNA, 25 bp, Mus musculus
tacaaggcgggttaacagtggctac

SEQ ID NO: 460621 - DNA, 25 bp, Mus musculus
tacaaggcgtgtgtctgtccagtca

SEQ ID NO: 460622 - DNA, 25 bp, Mus musculus
tacaaggctctcaaggtcatataag

SEQ ID NO: 460623 - DNA, 25 bp, Mus musculus
tacaagggaacaggattcagacaca

SEQ ID NO: 460624 - DNA, 25 bp, Mus musculus
tacaagggactggatgggagtctcc

SEQ ID NO: 460625 - DNA, 25 bp, Mus musculus
tacaagggaggcacaggtgacagct

SEQ ID NO: 460626 - DNA, 25 bp, Mus musculus
tacaagggaggcatcacaaagtgtg

SEQ ID NO: 460627 - DNA, 25 bp, Mus musculus
tacaagggctcgtgtctatgggaca

SEQ ID NO: 460628 - DNA, 25 bp, Mus musculus
tacaaggtcacaaagtggagccacc

SEQ ID NO: 460629 - DNA, 25 bp, Mus musculus
tacaaggtggagaacaaacctgccc

SEQ ID NO: 460630 - DNA, 25 bp, Mus musculus
tacaaggtggatgtacacagtccgg

SEQ ID NO: 460631 - DNA, 25 bp, Mus musculus
tacaaggtttgaaggcccagcatgg

SEQ ID NO: 460632 - DNA, 25 bp, Mus musculus
tacaagtaacactggcatcaatggg

SEQ ID NO: 460633 - DNA, 25 bp, Mus musculus
tacaagtaacaggtcacaacatggg

SEQ ID NO: 460634 - DNA, 25 bp, Mus musculus
tacaagtaaccctcagacggcctaa

SEQ ID NO: 460635 - DNA, 25 bp, Mus musculus
tacaagtaagaacctgcacaccaag

SEQ ID NO: 460636 - DNA, 25 bp, Mus musculus
tacaagtacaccagctatccggatc

SEQ ID NO: 460637 - DNA, 25 bp, Mus musculus
tacaagtatgctgcaggagtccaga

SEQ ID NO: 460638 - DNA, 25 bp, Mus musculus
tacaagtatgtgatgaagcccacct

SEQ ID NO: 460639 - DNA, 25 bp, Mus musculus
tacaagtcagttgcttaccagttag

SEQ ID NO: 460640 - DNA, 25 bp, Mus musculus
tacaagtcccagtttgaagctcaga

SEQ ID NO: 460641 - DNA, 25 bp, Mus musculus
tacaagtccccaacgatggagggcc

SEQ ID NO: 460642 - DNA, 25 bp, Mus musculus
tacaagtcgggcaagaagatccacc

SEQ ID NO: 460643 - DNA, 25 bp, Mus musculus
tacaagtcgtgatcctcgggcagaa

SEQ ID NO: 460644 - DNA, 25 bp, Mus musculus
tacaagtctcacaaccgagagtggg

SEQ ID NO: 460645 - DNA, 25 bp, Mus musculus
tacaagtcttaatggtcctgagccg

SEQ ID NO: 460646 - DNA, 25 bp, Mus musculus
tacaagtgacaatgaaaccagcagg

SEQ ID NO: 460647 - DNA, 25 bp, Mus musculus
tacaagtgagaatttttcagcagcc

SEQ ID NO: 460648 - DNA, 25 bp, Mus musculus
tacaagtgagttaggagaggccaag

SEQ ID NO: 460649 - DNA, 25 bp, Mus musculus
tacaagtgccctagctgcgataaag

SEQ ID NO: 460650 - DNA, 25 bp, Mus musculus
tacaagtgcgctgtctgcgagaaga

SEQ ID NO: 460651 - DNA, 25 bp, Mus musculus
tacaagtgcggagacctggtgtttg

SEQ ID NO: 460652 - DNA, 25 bp, Mus musculus
tacaagtggcataaagagccgctgc

SEQ ID NO: 460653 - DNA, 25 bp, Mus musculus
tacaagttcaatgttcccatcgttc

SEQ ID NO: 460654 - DNA, 25 bp, Mus musculus
tacaagttcctcagcatacgcggct

SEQ ID NO: 460655 - DNA, 25 bp, Mus musculus
tacaagttcggatggatccgagcgg

SEQ ID NO: 460656 - DNA, 25 bp, Mus musculus
tacaagttctgcacttggcacctga

SEQ ID NO: 460657 - DNA, 25 bp, Mus musculus
tacaagttgaagctgggccaatcgg

SEQ ID NO: 460658 - DNA, 25 bp, Mus musculus
tacaagttgagctggtagacagggt

SEQ ID NO: 460659 - DNA, 25 bp, Mus musculus
tacaagttgcccgtgaaaaagcagg

SEQ ID NO: 460660 - DNA, 25 bp, Mus musculus
tacaagttggtctgccgcaagtgcc

SEQ ID NO: 460661 - DNA, 25 bp, Mus musculus
tacaagtttccgtcagagcagcatg

SEQ ID NO: 460662 - DNA, 25 bp, Mus musculus
tacaataacaagacctaccgggtgg

SEQ ID NO: 460663 - DNA, 25 bp, Mus musculus
tacaataacttgaccgaggagcaga

SEQ ID NO: 460664 - DNA, 25 bp, Mus musculus
tacaataatggatgagactctactc

SEQ ID NO: 460665 - DNA, 25 bp, Mus musculus
tacaatagcgggacctgtgtggacg

SEQ ID NO: 460666 - DNA, 25 bp, Mus musculus
tacaatagtagatgccctggatacc

SEQ ID NO: 460667 - DNA, 25 bp, Mus musculus
tacaatatatcagtaaacagtagtg

SEQ ID NO: 460668 - DNA, 25 bp, Mus musculus
tacaatatgcccctttgggacggac

SEQ ID NO: 460669 - DNA, 25 bp, Mus musculus
tacaatcaggcaaaaggatggtaga

SEQ ID NO: 460670 - DNA, 25 bp, Mus musculus
tacaatcatacaggtgtggcgggaa

SEQ ID NO: 460671 - DNA, 25 bp, Mus musculus
tacaatcgaggataccagtggtgcc

SEQ ID NO: 460672 - DNA, 25 bp, Mus musculus
tacaatcggaatggagtcaatgccc

SEQ ID NO: 460673 - DNA, 25 bp, Mus musculus
tacaatctactgatgagcgcgaagc

SEQ ID NO: 460674 - DNA, 25 bp, Mus musculus
tacaatctgcaacatgtcacagtgg

SEQ ID NO: 460675 - DNA, 25 bp, Mus musculus
tacaatctgcttgggatcgggaagg

SEQ ID NO: 460676 - DNA, 25 bp, Mus musculus
tacaatgaaaaaggcggcatggccg

SEQ ID NO: 460677 - DNA, 25 bp, Mus musculus
tacaatgaagaagcctgagaagcca

SEQ ID NO: 460678 - DNA, 25 bp, Mus musculus
tacaatgaagacaagccccactgtg

SEQ ID NO: 460679 - DNA, 25 bp, Mus musculus
tacaatgaccttgaagctcggaagc

SEQ ID NO: 460680 - DNA, 25 bp, Mus musculus
tacaatgagaaggtgggagcaaacg

SEQ ID NO: 460681 - DNA, 25 bp, Mus musculus
tacaatgagcgtttcacttggcgtc

SEQ ID NO: 460682 - DNA, 25 bp, Mus musculus
tacaatgagcttcgagtagcaccag

SEQ ID NO: 460683 - DNA, 25 bp, Mus musculus
tacaatgagtaagaggcgctgggcc

SEQ ID NO: 460684 - DNA, 25 bp, Mus musculus
tacaatgatgggaagttcaaccggg

SEQ ID NO: 460685 - DNA, 25 bp, Mus musculus
tacaatgcctatcgctgtgagggcg

SEQ ID NO: 460686 - DNA, 25 bp, Mus musculus
tacaatgctcatgtgtaaaccaggc

SEQ ID NO: 460687 - DNA, 25 bp, Mus musculus
tacaatgctctgtggtggcatcgcc

SEQ ID NO: 460688 - DNA, 25 bp, Mus musculus
tacaatgctgtaactatcccgtgcc

SEQ ID NO: 460689 - DNA, 25 bp, Mus musculus
tacaatgcttctgactccgttcagg

SEQ ID NO: 460690 - DNA, 25 bp, Mus musculus
tacaatggacagcaggagaccttca

SEQ ID NO: 460691 - DNA, 25 bp, Mus musculus
tacaatggcacacttctggacggca

SEQ ID NO: 460692 - DNA, 25 bp, Mus musculus
tacaatggccgttgatgacagcaat

SEQ ID NO: 460693 - DNA, 25 bp, Mus musculus
tacaatgggcttggtaacactcacc

SEQ ID NO: 460694 - DNA, 25 bp, Mus musculus
tacaatggtacacgtccctgcgagt

SEQ ID NO: 460695 - DNA, 25 bp, Mus musculus
tacaatgtacttggcttaggccgaa

SEQ ID NO: 460696 - DNA, 25 bp, Mus musculus
tacaatgtcatcgagaagctggcca

SEQ ID NO: 460697 - DNA, 25 bp, Mus musculus
tacaatgtcttggtgagacgacggc

SEQ ID NO: 460698 - DNA, 25 bp, Mus musculus
tacaatgtgaatggtctgaaggctc

SEQ ID NO: 460699 - DNA, 25 bp, Mus musculus
tacaatgttgttagctctccccagg

SEQ ID NO: 460700 - DNA, 25 bp, Mus musculus
tacaattactgctgagtgctgacct

SEQ ID NO: 460701 - DNA, 25 bp, Mus musculus
tacaattcagcattgacacagcccg

SEQ ID NO: 460702 - DNA, 25 bp, Mus musculus
tacaattcctcatgcagcaagtggg

SEQ ID NO: 460703 - DNA, 25 bp, Mus musculus
tacaattcgaatcctgctccaggga

SEQ ID NO: 460704 - DNA, 25 bp, Mus musculus
tacaattcgaattatgcaggtcttg

SEQ ID NO: 460705 - DNA, 25 bp, Mus musculus
tacaattcgttactcagactcaggg

SEQ ID NO: 460706 - DNA, 25 bp, Mus musculus
tacaattctaatgtgaatgtggttc

SEQ ID NO: 460707 - DNA, 25 bp, Mus musculus
tacaattgacagagaggcggtgcct

SEQ ID NO: 460708 - DNA, 25 bp, Mus musculus
tacaattgtccacgctgtgcagcga

SEQ ID NO: 460709 - DNA, 25 bp, Mus musculus
tacaatttcatgacggagcacttcc

SEQ ID NO: 460710 - DNA, 25 bp, Mus musculus
tacaatttctagtttcacaggagcg

SEQ ID NO: 460711 - DNA, 25 bp, Mus musculus
tacacaaactgcaggatttctgatt

SEQ ID NO: 460712 - DNA, 25 bp, Mus musculus
tacacaaagtcatcatggtgggcag

SEQ ID NO: 460713 - DNA, 25 bp, Mus musculus
tacacaaatcggatctccagcgagg

SEQ ID NO: 460714 - DNA, 25 bp, Mus musculus
tacacaacaggtctgacaactgggc

SEQ ID NO: 460715 - DNA, 25 bp, Mus musculus
tacacaacattgtctgatgttccct

SEQ ID NO: 460716 - DNA, 25 bp, Mus musculus
tacacaaccttaaacagagagccag

SEQ ID NO: 460717 - DNA, 25 bp, Mus musculus
tacacaacgaggctctacttcctgg

SEQ ID NO: 460718 - DNA, 25 bp, Mus musculus
tacacaagaagccatgttgccagcc

SEQ ID NO: 460719 - DNA, 25 bp, Mus musculus
tacacaagccctacctcattagtgg

SEQ ID NO: 460720 - DNA, 25 bp, Mus musculus
tacacaaggacatagctgctggcca

SEQ ID NO: 460721 - DNA, 25 bp, Mus musculus
tacacaagtaatttggtagatacct

SEQ ID NO: 460722 - DNA, 25 bp, Mus musculus
tacacaatgtgaagcttccggaggc

SEQ ID NO: 460723 - DNA, 25 bp, Mus musculus
tacacacaaaaagagtgcagctgtc

SEQ ID NO: 460724 - DNA, 25 bp, Mus musculus
tacacacaaccccaatttgttttca

SEQ ID NO: 460725 - DNA, 25 bp, Mus musculus
tacacacaagagcaggcagaggttc

SEQ ID NO: 460726 - DNA, 25 bp, Mus musculus
tacacacactggagaacgggaagac

SEQ ID NO: 460727 - DNA, 25 bp, Mus musculus
tacacacagatctagaggctccagg

SEQ ID NO: 460728 - DNA, 25 bp, Mus musculus
tacacacaggcgaggtacgaactgc

SEQ ID NO: 460729 - DNA, 25 bp, Mus musculus
tacacacagttcagggtggactccg

SEQ ID NO: 460730 - DNA, 25 bp, Mus musculus
tacacaccacgtatcaaggcagctg

SEQ ID NO: 460731 - DNA, 25 bp, Mus musculus
tacacaccatgtagagctggccagg

SEQ ID NO: 460732 - DNA, 25 bp, Mus musculus
tacacaccctgctacaaacctgaaa

SEQ ID NO: 460733 - DNA, 25 bp, Mus musculus
tacacacggttcgagaagattggac

SEQ ID NO: 460734 - DNA, 25 bp, Mus musculus
tacacactcaggtcagattgcccag

SEQ ID NO: 460735 - DNA, 25 bp, Mus musculus
tacacactgaactcatctcgggaga

SEQ ID NO: 460736 - DNA, 25 bp, Mus musculus
tacacactgctggtggcctcaaagg

SEQ ID NO: 460737 - DNA, 25 bp, Mus musculus
tacacactggtaagggagatacgcc

SEQ ID NO: 460738 - DNA, 25 bp, Mus musculus
tacacactggtcattgtcccacgga

SEQ ID NO: 460739 - DNA, 25 bp, Mus musculus
tacacacttggcaaggaggaccagt

SEQ ID NO: 460740 - DNA, 25 bp, Mus musculus
tacacagacattgtcaaaatgctgc

SEQ ID NO: 460741 - DNA, 25 bp, Mus musculus
tacacagaccaaccttagccgggga

SEQ ID NO: 460742 - DNA, 25 bp, Mus musculus
tacacagagtaccaacagttggagg

SEQ ID NO: 460743 - DNA, 25 bp, Mus musculus
tacacagatgaatcaggactcctgg

SEQ ID NO: 460744 - DNA, 25 bp, Mus musculus
tacacagcacagataaggtggcccg

SEQ ID NO: 460745 - DNA, 25 bp, Mus musculus
tacacagcagcggaccaaagaaaca

SEQ ID NO: 460746 - DNA, 25 bp, Mus musculus
tacacagccaggtacagcctaggtg

SEQ ID NO: 460747 - DNA, 25 bp, Mus musculus
tacacagcctgtttggagacagagg

SEQ ID NO: 460748 - DNA, 25 bp, Mus musculus
tacacagcgcgcagaagatcttcaa

SEQ ID NO: 460749 - DNA, 25 bp, Mus musculus
tacacagctcttagaaagccttggc

SEQ ID NO: 460750 - DNA, 25 bp, Mus musculus
tacacagctttcaaggcactgggcg

SEQ ID NO: 460751 - DNA, 25 bp, Mus musculus
tacacaggaccaggaacagttcgaa

SEQ ID NO: 460752 - DNA, 25 bp, Mus musculus
tacacaggaggaaatagtccgcgct

SEQ ID NO: 460753 - DNA, 25 bp, Mus musculus
tacacaggagtatcagtcgagcagg

SEQ ID NO: 460754 - DNA, 25 bp, Mus musculus
tacacaggagtgatttctgacgtcc

SEQ ID NO: 460755 - DNA, 25 bp, Mus musculus
tacacaggcttttagagaacgactc

SEQ ID NO: 460756 - DNA, 25 bp, Mus musculus
tacacagggaaggattcgaggctcc

SEQ ID NO: 460757 - DNA, 25 bp, Mus musculus
tacacagggtctagcagataacgcc

SEQ ID NO: 460758 - DNA, 25 bp, Mus musculus
tacacagtaaccatgcgccgtagga

SEQ ID NO: 460759 - DNA, 25 bp, Mus musculus
tacacagtccgtcaaatacgtcagc

SEQ ID NO: 460760 - DNA, 25 bp, Mus musculus
tacacagtcctgagagtgattggcc

SEQ ID NO: 460761 - DNA, 25 bp, Mus musculus
tacacagttcctccctgggtcacag

SEQ ID NO: 460762 - DNA, 25 bp, Mus musculus
tacacataggaagttcacacctggc

SEQ ID NO: 460763 - DNA, 25 bp, Mus musculus
tacacatagtaggaaaggaaggccc

SEQ ID NO: 460764 - DNA, 25 bp, Mus musculus
tacacatatgaaggagttgaggcca

SEQ ID NO: 460765 - DNA, 25 bp, Mus musculus
tacacatcacgcatgaggtcagcag

SEQ ID NO: 460766 - DNA, 25 bp, Mus musculus
tacacatcctgaacggtgagtggtc

SEQ ID NO: 460767 - DNA, 25 bp, Mus musculus
tacacatcctgaggtgcccaaggat

SEQ ID NO: 460768 - DNA, 25 bp, Mus musculus
tacacatcgggctgataagagcaag

SEQ ID NO: 460769 - DNA, 25 bp, Mus musculus
tacacatgcatcagactggctagcc

SEQ ID NO: 460770 - DNA, 25 bp, Mus musculus
tacacatggaatagagggcacaaca

SEQ ID NO: 460771 - DNA, 25 bp, Mus musculus
tacacatggcggtggacaaggagac

SEQ ID NO: 460772 - DNA, 25 bp, Mus musculus
tacacatggtgtgcatagcatatac

SEQ ID NO: 460773 - DNA, 25 bp, Mus musculus
tacacatgtgtatccttttccggaa

SEQ ID NO: 460774 - DNA, 25 bp, Mus musculus
tacacatgttatccagagctcatgg

SEQ ID NO: 460775 - DNA, 25 bp, Mus musculus
tacacattatagtcaggcagggccc

SEQ ID NO: 460776 - DNA, 25 bp, Mus musculus
tacacattcaatcttctatcagcat

SEQ ID NO: 460777 - DNA, 25 bp, Mus musculus
tacacattcgtggaggtcaagccag

SEQ ID NO: 460778 - DNA, 25 bp, Mus musculus
tacacatttccaggagggacagggc

SEQ ID NO: 460779 - DNA, 25 bp, Mus musculus
tacacatttgacctgaaccgtgaag

SEQ ID NO: 460780 - DNA, 25 bp, Mus musculus
tacacatttgcaggcttcttgggct

SEQ ID NO: 460781 - DNA, 25 bp, Mus musculus
tacaccaacggatcagcgagctgga

SEQ ID NO: 460782 - DNA, 25 bp, Mus musculus
tacaccaacttcgatgctgagaggg

SEQ ID NO: 460783 - DNA, 25 bp, Mus musculus
tacaccacagagaacggcattgcag

SEQ ID NO: 460784 - DNA, 25 bp, Mus musculus
tacaccacgagatcacatgctctgg

SEQ ID NO: 460785 - DNA, 25 bp, Mus musculus
tacaccacggaggagaggatctttg

SEQ ID NO: 460786 - DNA, 25 bp, Mus musculus
tacaccactacagggaagcagactg

SEQ ID NO: 460787 - DNA, 25 bp, Mus musculus
tacaccactggacgattagaaaagg

SEQ ID NO: 460788 - DNA, 25 bp, Mus musculus
tacaccagaaattgctaagttcctt

SEQ ID NO: 460789 - DNA, 25 bp, Mus musculus
tacaccagacttcgagggtgccacg

SEQ ID NO: 460790 - DNA, 25 bp, Mus musculus
tacaccagtgcttcgaaaggaggac

SEQ ID NO: 460791 - DNA, 25 bp, Mus musculus
tacaccatcccgaggaatacctggg

SEQ ID NO: 460792 - DNA, 25 bp, Mus musculus
tacaccatcggcaaagagattgtcg

SEQ ID NO: 460793 - DNA, 25 bp, Mus musculus
tacaccatggaagggtacctgtacg

SEQ ID NO: 460794 - DNA, 25 bp, Mus musculus
tacaccatggtgtcagtggcctaca

SEQ ID NO: 460795 - DNA, 25 bp, Mus musculus
tacaccatgtcatgagcctccatgg

SEQ ID NO: 460796 - DNA, 25 bp, Mus musculus
tacacccaatgtttgaagaggagga

SEQ ID NO: 460797 - DNA, 25 bp, Mus musculus
tacacccagactgtgagaaagagca

SEQ ID NO: 460798 - DNA, 25 bp, Mus musculus
tacacccaggctttggactaggcca

SEQ ID NO: 460799 - DNA, 25 bp, Mus musculus
tacacccagggtatggattcctgtc

SEQ ID NO: 460800 - DNA, 25 bp, Mus musculus
tacacccagtatccctatgtatggc

SEQ ID NO: 460801 - DNA, 25 bp, Mus musculus
tacaccccggtggttcttatgcaca

SEQ ID NO: 460802 - DNA, 25 bp, Mus musculus
tacacccgcctcagaaagcaaatgg

SEQ ID NO: 460803 - DNA, 25 bp, Mus musculus
tacacccgggtcacctattacttgg

SEQ ID NO: 460804 - DNA, 25 bp, Mus musculus
tacacccgggtgacatactacttag

SEQ ID NO: 460805 - DNA, 25 bp, Mus musculus
tacaccctaggaaagatgggaactc

SEQ ID NO: 460806 - DNA, 25 bp, Mus musculus
tacaccctcttgtgaaccctgtggg

SEQ ID NO: 460807 - DNA, 25 bp, Mus musculus
tacaccctgggtgtgttcatctgtt

SEQ ID NO: 460808 - DNA, 25 bp, Mus musculus
tacaccgacgcggaagatgtggcca

SEQ ID NO: 460809 - DNA, 25 bp, Mus musculus
tacaccgaggtttccagggtctgca

SEQ ID NO: 460810 - DNA, 25 bp, Mus musculus
tacaccgcatctatggagacaaggc

SEQ ID NO: 460811 - DNA, 25 bp, Mus musculus
tacaccggagaaggagcttgcatgc

SEQ ID NO: 460812 - DNA, 25 bp, Mus musculus
tacaccggagattatgctggcaagg

SEQ ID NO: 460813 - DNA, 25 bp, Mus musculus
tacaccgggctgtgagaacgttcct

SEQ ID NO: 460814 - DNA, 25 bp, Mus musculus
tacaccgtcgtgagttgccactgag

SEQ ID NO: 460815 - DNA, 25 bp, Mus musculus
tacaccgttccgtgcagtagcagaa

SEQ ID NO: 460816 - DNA, 25 bp, Mus musculus
tacacctagagcattagtatccctg

SEQ ID NO: 460817 - DNA, 25 bp, Mus musculus
tacacctgaagacaatgactgcccc

SEQ ID NO: 460818 - DNA, 25 bp, Mus musculus
tacacctgagcttatctgcacaagg

SEQ ID NO: 460819 - DNA, 25 bp, Mus musculus
tacacctgcaccagcgggaagctgt

SEQ ID NO: 460820 - DNA, 25 bp, Mus musculus
tacacctgggtgaatggcactgacc

SEQ ID NO: 460821 - DNA, 25 bp, Mus musculus
tacacctggtgctccggacgtaatt

SEQ ID NO: 460822 - DNA, 25 bp, Mus musculus
tacacctggttactatactggcaaa

SEQ ID NO: 460823 - DNA, 25 bp, Mus musculus
tacacctgtcaaaccatgtgagacc

SEQ ID NO: 460824 - DNA, 25 bp, Mus musculus
tacacctgtgttgctatgtcgacgt

SEQ ID NO: 460825 - DNA, 25 bp, Mus musculus
tacacctgttgaggaagcgtctctc

SEQ ID NO: 460826 - DNA, 25 bp, Mus musculus
tacaccttccgaaccatatctgtgg

SEQ ID NO: 460827 - DNA, 25 bp, Mus musculus
tacacctttggaagctcttagagac

SEQ ID NO: 460828 - DNA, 25 bp, Mus musculus
tacacgacgaacctcttgactgccg

SEQ ID NO: 460829 - DNA, 25 bp, Mus musculus
tacacgagttccatgctgatctacg

SEQ ID NO: 460830 - DNA, 25 bp, Mus musculus
tacacgatgaggaagagctagtccc

SEQ ID NO: 460831 - DNA, 25 bp, Mus musculus
tacacgattgtaagcttgcagcaca

SEQ ID NO: 460832 - DNA, 25 bp, Mus musculus
tacacgcaccaggtattaggccaca

SEQ ID NO: 460833 - DNA, 25 bp, Mus musculus
tacacgcaggtgcttatctccgagc

SEQ ID NO: 460834 - DNA, 25 bp, Mus musculus
tacacgcccgaggtgatagagaagt

SEQ ID NO: 460835 - DNA, 25 bp, Mus musculus
tacacgcggaactcgtctggagatg

SEQ ID NO: 460836 - DNA, 25 bp, Mus musculus
tacacgctatgccaaggagctctcc

SEQ ID NO: 460837 - DNA, 25 bp, Mus musculus
tacacgctggtgcagagagatcgca

SEQ ID NO: 460838 - DNA, 25 bp, Mus musculus
tacacgcttccaagacaatggcagg

SEQ ID NO: 460839 - DNA, 25 bp, Mus musculus
tacacggaaagcctgaactggtttg

SEQ ID NO: 460840 - DNA, 25 bp, Mus musculus
tacacggacgtgtccaacatgggcc

SEQ ID NO: 460841 - DNA, 25 bp, Mus musculus
tacacggagatcttggctgctaact

SEQ ID NO: 460842 - DNA, 25 bp, Mus musculus
tacacggaggtagggaatcatttct

SEQ ID NO: 460843 - DNA, 25 bp, Mus musculus
tacacggaggttcactatggagctg

SEQ ID NO: 460844 - DNA, 25 bp, Mus musculus
tacacggatacactttaataaacaa

SEQ ID NO: 460845 - DNA, 25 bp, Mus musculus
tacacggcgctcatcaacgtgacgg

SEQ ID NO: 460846 - DNA, 25 bp, Mus musculus
tacacggctcaaggagagaactgac

SEQ ID NO: 460847 - DNA, 25 bp, Mus musculus
tacacggctccgatgaatcaggctc

SEQ ID NO: 460848 - DNA, 25 bp, Mus musculus
tacacgggaaagaaggagactagca

SEQ ID NO: 460849 - DNA, 25 bp, Mus musculus
tacacgggaatgcaaggctatgact

SEQ ID NO: 460850 - DNA, 25 bp, Mus musculus
tacacgggctttgtctgagacccag

SEQ ID NO: 460851 - DNA, 25 bp, Mus musculus
tacacggtccaggtaaagggataag

SEQ ID NO: 460852 - DNA, 25 bp, Mus musculus
tacacgtacttcaaggtgccgacag

SEQ ID NO: 460853 - DNA, 25 bp, Mus musculus
tacacgtacttgtagaggaggctct

SEQ ID NO: 460854 - DNA, 25 bp, Mus musculus
tacacgtagcagtgtcaacaagcgt

SEQ ID NO: 460855 - DNA, 25 bp, Mus musculus
tacacgtcctgccatgctgaagagc

SEQ ID NO: 460856 - DNA, 25 bp, Mus musculus
tacacgtcgcctttgaagaaaacaa

SEQ ID NO: 460857 - DNA, 25 bp, Mus musculus
tacacgtgcgtctgtcctgaaggct

SEQ ID NO: 460858 - DNA, 25 bp, Mus musculus
tacacgttctgacaactggtggcaa

SEQ ID NO: 460859 - DNA, 25 bp, Mus musculus
tacacgttgaaaactgcgactccag

SEQ ID NO: 460860 - DNA, 25 bp, Mus musculus
tacacgttggaccttatgaaagctg

SEQ ID NO: 460861 - DNA, 25 bp, Mus musculus
tacacgtttcccaaggacgctgagt

SEQ ID NO: 460862 - DNA, 25 bp, Mus musculus
tacactacagattacacttgtggaa

SEQ ID NO: 460863 - DNA, 25 bp, Mus musculus
tacactacagtgtgcctgagggccc

SEQ ID NO: 460864 - DNA, 25 bp, Mus musculus
tacactactgggtgactgggaaacc

SEQ ID NO: 460865 - DNA, 25 bp, Mus musculus
tacactacttgatcgtcgccctgga

SEQ ID NO: 460866 - DNA, 25 bp, Mus musculus
tacactagcactcacagatgagggc

SEQ ID NO: 460867 - DNA, 25 bp, Mus musculus
tacactaggaaactgtctgcggtac

SEQ ID NO: 460868 - DNA, 25 bp, Mus musculus
tacactaggcgctgctagccgaatc

SEQ ID NO: 460869 - DNA, 25 bp, Mus musculus
tacactcccaggttggagcctaggg

SEQ ID NO: 460870 - DNA, 25 bp, Mus musculus
tacactccgagcaacgagcactttg

SEQ ID NO: 460871 - DNA, 25 bp, Mus musculus
tacactccggacatgaagcgtgagg

SEQ ID NO: 460872 - DNA, 25 bp, Mus musculus
tacactccttgggaagtactgcttc

SEQ ID NO: 460873 - DNA, 25 bp, Mus musculus
tacactcggccagatagcagcttct

SEQ ID NO: 460874 - DNA, 25 bp, Mus musculus
tacactctgaccaacaaggagatgc

SEQ ID NO: 460875 - DNA, 25 bp, Mus musculus
tacactctgccaggcatgccttggg

SEQ ID NO: 460876 - DNA, 25 bp, Mus musculus
tacactctggtccacttgaggcaca

SEQ ID NO: 460877 - DNA, 25 bp, Mus musculus
tacactgaacaagagctgaagcccc

SEQ ID NO: 460878 - DNA, 25 bp, Mus musculus
tacactgagagaacaaggaatttgc

SEQ ID NO: 460879 - DNA, 25 bp, Mus musculus
tacactgagcaagatacctttgagc

SEQ ID NO: 460880 - DNA, 25 bp, Mus musculus
tacactgatgggtgctacacgcgac

SEQ ID NO: 460881 - DNA, 25 bp, Mus musculus
tacactgcagatcatgaacgggcct

SEQ ID NO: 460882 - DNA, 25 bp, Mus musculus
tacactgcaggagaaccgtgtgcca

SEQ ID NO: 460883 - DNA, 25 bp, Mus musculus
tacactgccaactcgaagggtggag

SEQ ID NO: 460884 - DNA, 25 bp, Mus musculus
tacactgccgcgtgggtcacgtggc

SEQ ID NO: 460885 - DNA, 25 bp, Mus musculus
tacactgcgcagataaccacaaagg

SEQ ID NO: 460886 - DNA, 25 bp, Mus musculus
tacactgctcatccatgcctgtggg

SEQ ID NO: 460887 - DNA, 25 bp, Mus musculus
tacactgctgcgaagaattggctgg

SEQ ID NO: 460888 - DNA, 25 bp, Mus musculus
tacactgcttctgcgtggtgagacc

SEQ ID NO: 460889 - DNA, 25 bp, Mus musculus
tacactggaccacataagagccctg

SEQ ID NO: 460890 - DNA, 25 bp, Mus musculus
tacactggatctagcaggtggcacg

SEQ ID NO: 460891 - DNA, 25 bp, Mus musculus
tacactggcaaatccatcacggaca

SEQ ID NO: 460892 - DNA, 25 bp, Mus musculus
tacactggcactctggactggctgt

SEQ ID NO: 460893 - DNA, 25 bp, Mus musculus
tacactggctgtaacctagggatcg

SEQ ID NO: 460894 - DNA, 25 bp, Mus musculus
tacactgggaacctcgctatagatt

SEQ ID NO: 460895 - DNA, 25 bp, Mus musculus
tacactgtgagacgttcatctgcga

SEQ ID NO: 460896 - DNA, 25 bp, Mus musculus
tacactgtgaggtgggaagcatcct

SEQ ID NO: 460897 - DNA, 25 bp, Mus musculus
tacactgtggaggatacgatgcacc

SEQ ID NO: 460898 - DNA, 25 bp, Mus musculus
tacactgtgtgggttggcttcgatc

SEQ ID NO: 460899 - DNA, 25 bp, Mus musculus
tacacttacgtcacggtcggagagc

SEQ ID NO: 460900 - DNA, 25 bp, Mus musculus
tacacttcgacaggtgcgtcagaca

SEQ ID NO: 460901 - DNA, 25 bp, Mus musculus
tacacttgaggctgatgtcggaact

SEQ ID NO: 460902 - DNA, 25 bp, Mus musculus
tacacttggcaatagtctgtaacgc

SEQ ID NO: 460903 - DNA, 25 bp, Mus musculus
tacacttggcctgacaaatgtcgga

SEQ ID NO: 460904 - DNA, 25 bp, Mus musculus
tacacttgtgtacttggtcaggtgc

SEQ ID NO: 460905 - DNA, 25 bp, Mus musculus
tacactttaacaagcagtttatagc

SEQ ID NO: 460906 - DNA, 25 bp, Mus musculus
tacactttgggcagcaggacacttg

SEQ ID NO: 460907 - DNA, 25 bp, Mus musculus
tacagaaagagaaaagtccccggag

SEQ ID NO: 460908 - DNA, 25 bp, Mus musculus
tacagaaagataacacagacccagg

SEQ ID NO: 460909 - DNA, 25 bp, Mus musculus
tacagaaagccaagtcccatgtgtg

SEQ ID NO: 460910 - DNA, 25 bp, Mus musculus
tacagaacacaagtagtggccgcag

SEQ ID NO: 460911 - DNA, 25 bp, Mus musculus
tacagaacacgaagcgagaccttgc

SEQ ID NO: 460912 - DNA, 25 bp, Mus musculus
tacagaacagttgcagccagtggtt

SEQ ID NO: 460913 - DNA, 25 bp, Mus musculus
tacagaacatcctgcgccagagaac

SEQ ID NO: 460914 - DNA, 25 bp, Mus musculus
tacagaagaccgtgtgcgaatcgac

SEQ ID NO: 460915 - DNA, 25 bp, Mus musculus
tacagaagacggctgatggacccaa

SEQ ID NO: 460916 - DNA, 25 bp, Mus musculus
tacagaaggtctttcaggagcccaa

SEQ ID NO: 460917 - DNA, 25 bp, Mus musculus
tacagaagtatgagattgccctggc

SEQ ID NO: 460918 - DNA, 25 bp, Mus musculus
tacagaatagccaggacaaggctcc

SEQ ID NO: 460919 - DNA, 25 bp, Mus musculus
tacagaatctgcaggaagaccctcg

SEQ ID NO: 460920 - DNA, 25 bp, Mus musculus
tacagaatgacagtctgcgggagtg

SEQ ID NO: 460921 - DNA, 25 bp, Mus musculus
tacagaatgcatgcaaggacgccct

SEQ ID NO: 460922 - DNA, 25 bp, Mus musculus
tacagaatggccatgcgctaaagca

SEQ ID NO: 460923 - DNA, 25 bp, Mus musculus
tacagaattgccagggctactggaa

SEQ ID NO: 460924 - DNA, 25 bp, Mus musculus
tacagacaagaatgggttacgggcc

SEQ ID NO: 460925 - DNA, 25 bp, Mus musculus
tacagacagcttgaaatggtcaagg

SEQ ID NO: 460926 - DNA, 25 bp, Mus musculus
tacagacagtgacggaagataaccc

SEQ ID NO: 460927 - DNA, 25 bp, Mus musculus
tacagacatatgctatcaagcctgg

SEQ ID NO: 460928 - DNA, 25 bp, Mus musculus
tacagaccagctgctgaagatatcc

SEQ ID NO: 460929 - DNA, 25 bp, Mus musculus
tacagaccaggattaaggagacgga

SEQ ID NO: 460930 - DNA, 25 bp, Mus musculus
tacagacccacaaaaagtgacccgg

SEQ ID NO: 460931 - DNA, 25 bp, Mus musculus
tacagacccgcacaggaacctctgg

SEQ ID NO: 460932 - DNA, 25 bp, Mus musculus
tacagacccgtgagcaatcagaaga

SEQ ID NO: 460933 - DNA, 25 bp, Mus musculus
tacagaccgccagaacctcgggatt

SEQ ID NO: 460934 - DNA, 25 bp, Mus musculus
tacagacctgggactttagggctaa

SEQ ID NO: 460935 - DNA, 25 bp, Mus musculus
tacagacctgtctgacatgccagcg

SEQ ID NO: 460936 - DNA, 25 bp, Mus musculus
tacagacgaggtcaactgagagcca

SEQ ID NO: 460937 - DNA, 25 bp, Mus musculus
tacagacgcactcgtttacccggag

SEQ ID NO: 460938 - DNA, 25 bp, Mus musculus
tacagacgggttttacactgagccg

SEQ ID NO: 460939 - DNA, 25 bp, Mus musculus
tacagacggttaggcttggctgcga

SEQ ID NO: 460940 - DNA, 25 bp, Mus musculus
tacagacgtggctataatctccagc

SEQ ID NO: 460941 - DNA, 25 bp, Mus musculus
tacagactctactggtagtggatct

SEQ ID NO: 460942 - DNA, 25 bp, Mus musculus
tacagactcttaacaaacctcagga

SEQ ID NO: 460943 - DNA, 25 bp, Mus musculus
tacagactcttaaggtaggtgaaac

SEQ ID NO: 460944 - DNA, 25 bp, Mus musculus
tacagactgctgaagcttgccaacg

SEQ ID NO: 460945 - DNA, 25 bp, Mus musculus
tacagactgctggatactgagcgtg

SEQ ID NO: 460946 - DNA, 25 bp, Mus musculus
tacagactggcaagcagcattcggc

SEQ ID NO: 460947 - DNA, 25 bp, Mus musculus
tacagacttgttggaacagtggaga

SEQ ID NO: 460948 - DNA, 25 bp, Mus musculus
tacagacttttggaattgccttggg

SEQ ID NO: 460949 - DNA, 25 bp, Mus musculus
tacagagaactcaacacccaaggtg

SEQ ID NO: 460950 - DNA, 25 bp, Mus musculus
tacagagaccattccatgtccgtga

SEQ ID NO: 460951 - DNA, 25 bp, Mus musculus
tacagagacgggaaaatccaactga

SEQ ID NO: 460952 - DNA, 25 bp, Mus musculus
tacagagagattgagcttgaaagct

SEQ ID NO: 460953 - DNA, 25 bp, Mus musculus
tacagagagcagtaaagaagcattg

SEQ ID NO: 460954 - DNA, 25 bp, Mus musculus
tacagagaggaattgggcacctacc

SEQ ID NO: 460955 - DNA, 25 bp, Mus musculus
tacagagagtctatccgctcgcagg

SEQ ID NO: 460956 - DNA, 25 bp, Mus musculus
tacagagcaatcttcagagggccaa

SEQ ID NO: 460957 - DNA, 25 bp, Mus musculus
tacagagcatgtcccatcaatggtc

SEQ ID NO: 460958 - DNA, 25 bp, Mus musculus
tacagagcccaagctagacctgagc

SEQ ID NO: 460959 - DNA, 25 bp, Mus musculus
tacagagccgctacacaaaagagag

SEQ ID NO: 460960 - DNA, 25 bp, Mus musculus
tacagagcctcgaggaattgggcac

SEQ ID NO: 460961 - DNA, 25 bp, Mus musculus
tacagagcgcaaatgaccgggtgaa

SEQ ID NO: 460962 - DNA, 25 bp, Mus musculus
tacagagctgtgagagaaaatgcag

SEQ ID NO: 460963 - DNA, 25 bp, Mus musculus
tacagagcttggtgaacctgcggga

SEQ ID NO: 460964 - DNA, 25 bp, Mus musculus
tacagaggatacctggcctggagtc

SEQ ID NO: 460965 - DNA, 25 bp, Mus musculus
tacagaggccagatgatagagttca

SEQ ID NO: 460966 - DNA, 25 bp, Mus musculus
tacagaggccagattcagaacacgc

SEQ ID NO: 460967 - DNA, 25 bp, Mus musculus
tacagaggcccttccgagatcgggt

SEQ ID NO: 460968 - DNA, 25 bp, Mus musculus
tacagagggcgaaagaacagtcgga

SEQ ID NO: 460969 - DNA, 25 bp, Mus musculus
tacagaggtatacatcaagagctgg

SEQ ID NO: 460970 - DNA, 25 bp, Mus musculus
tacagagtaataattcccaggccgg

SEQ ID NO: 460971 - DNA, 25 bp, Mus musculus
tacagagtatcatttgccgcagtca

SEQ ID NO: 460972 - DNA, 25 bp, Mus musculus
tacagagtccaggaactgagcctag

SEQ ID NO: 460973 - DNA, 25 bp, Mus musculus
tacagagtctccgtgaatctggaat

SEQ ID NO: 460974 - DNA, 25 bp, Mus musculus
tacagagtgctaggctgctgacagg

SEQ ID NO: 460975 - DNA, 25 bp, Mus musculus
tacagagtgctccaggatgcgaccg

SEQ ID NO: 460976 - DNA, 25 bp, Mus musculus
tacagagtggctgcctgagctacag

SEQ ID NO: 460977 - DNA, 25 bp, Mus musculus
tacagagttactatcatggcccttg

SEQ ID NO: 460978 - DNA, 25 bp, Mus musculus
tacagagttgtaccagcgagcgatt

SEQ ID NO: 460979 - DNA, 25 bp, Mus musculus
tacagagttttctagggagccacgc

SEQ ID NO: 460980 - DNA, 25 bp, Mus musculus
tacagataggtacaaaggctctgct

SEQ ID NO: 460981 - DNA, 25 bp, Mus musculus
tacagatagtcaagagggtgcctcg

SEQ ID NO: 460982 - DNA, 25 bp, Mus musculus
tacagatcgagaacgagggcgtcct

SEQ ID NO: 460983 - DNA, 25 bp, Mus musculus
tacagatctcattggaggaagtccc

SEQ ID NO: 460984 - DNA, 25 bp, Mus musculus
tacagatctgtctggcttgccgaaa

SEQ ID NO: 460985 - DNA, 25 bp, Mus musculus
tacagatcttgggtcagacactgcg

SEQ ID NO: 460986 - DNA, 25 bp, Mus musculus
tacagatgcagtggtccaaggtcac

SEQ ID NO: 460987 - DNA, 25 bp, Mus musculus
tacagatgcgaatgcttccccggat

SEQ ID NO: 460988 - DNA, 25 bp, Mus musculus
tacagatgcggatccttcagagaac

SEQ ID NO: 460989 - DNA, 25 bp, Mus musculus
tacagatgctaaagatgagatcagt

SEQ ID NO: 460990 - DNA, 25 bp, Mus musculus
tacagatgctcctgccgtggacaca

SEQ ID NO: 460991 - DNA, 25 bp, Mus musculus
tacagatggaagcagaagccttagc

SEQ ID NO: 460992 - DNA, 25 bp, Mus musculus
tacagatggactatgctgccagcac

SEQ ID NO: 460993 - DNA, 25 bp, Mus musculus
tacagatggagaatcaccgtgaggc

SEQ ID NO: 460994 - DNA, 25 bp, Mus musculus
tacagatgtctgtgctaggaatcga

SEQ ID NO: 460995 - DNA, 25 bp, Mus musculus
tacagatgtggtaaaggtccgcttc

SEQ ID NO: 460996 - DNA, 25 bp, Mus musculus
tacagattccagtgagtgaccaagg

SEQ ID NO: 460997 - DNA, 25 bp, Mus musculus
tacagattcccagttagacagcagg

SEQ ID NO: 460998 - DNA, 25 bp, Mus musculus
tacagattcctatctacgagactgc

SEQ ID NO: 460999 - DNA, 25 bp, Mus musculus
tacagattcctggaaaagccaaggc

SEQ ID NO: 461000 - DNA, 25 bp, Mus musculus
tacagatttccagcataacggcaga

SEQ ID NO: 461001 - DNA, 25 bp, Mus musculus
tacagatttctacaaggataccact

SEQ ID NO: 461002 - DNA, 25 bp, Mus musculus
tacagcaagaggaaagggcggttca

SEQ ID NO: 461003 - DNA, 25 bp, Mus musculus
tacagcaaggaagctcgccattcct

SEQ ID NO: 461004 - DNA, 25 bp, Mus musculus
tacagcaagtcagttaggacctgcc

SEQ ID NO: 461005 - DNA, 25 bp, Mus musculus
tacagcaagtgggaacggtggcaca

SEQ ID NO: 461006 - DNA, 25 bp, Mus musculus
tacagcacaggtacatgccaattgg

SEQ ID NO: 461007 - DNA, 25 bp, Mus musculus
tacagcaccggctttactaatggca

SEQ ID NO: 461008 - DNA, 25 bp, Mus musculus
tacagcaccgtgagttcaagaccgg

SEQ ID NO: 461009 - DNA, 25 bp, Mus musculus
tacagcactggaaatgacgtatcag

SEQ ID NO: 461010 - DNA, 25 bp, Mus musculus
tacagcagaaccctttagtacagcg

SEQ ID NO: 461011 - DNA, 25 bp, Mus musculus
tacagcagaagatacccggagttcg

SEQ ID NO: 461012 - DNA, 25 bp, Mus musculus
tacagcagagcagcttgtaggccac

SEQ ID NO: 461013 - DNA, 25 bp, Mus musculus
tacagcagaggctagagtagttccc

SEQ ID NO: 461014 - DNA, 25 bp, Mus musculus
tacagcagataggtcgggagaaccc

SEQ ID NO: 461015 - DNA, 25 bp, Mus musculus
tacagcagcccttcggtcatcagtg

SEQ ID NO: 461016 - DNA, 25 bp, Mus musculus
tacagcagctctatcgccacatgga

SEQ ID NO: 461017 - DNA, 25 bp, Mus musculus
tacagcagctgcctatttttattga

SEQ ID NO: 461018 - DNA, 25 bp, Mus musculus
tacagcagcttgagtgaggcagctc

SEQ ID NO: 461019 - DNA, 25 bp, Mus musculus
tacagcaggatataagcgggctcag

SEQ ID NO: 461020 - DNA, 25 bp, Mus musculus
tacagcaggctccagttcatccaaa

SEQ ID NO: 461021 - DNA, 25 bp, Mus musculus
tacagcaggtgagcatgtctgggtt

SEQ ID NO: 461022 - DNA, 25 bp, Mus musculus
tacagcagtagcaggaaaaaaggcc

SEQ ID NO: 461023 - DNA, 25 bp, Mus musculus
tacagcagtgcggtgagacaatgaa

SEQ ID NO: 461024 - DNA, 25 bp, Mus musculus
tacagcagtgctacccagtggaact

SEQ ID NO: 461025 - DNA, 25 bp, Mus musculus
tacagcagtgggacatagtcagaca

SEQ ID NO: 461026 - DNA, 25 bp, Mus musculus
tacagcataccttcctgccagcaga

SEQ ID NO: 461027 - DNA, 25 bp, Mus musculus
tacagcatacttcagggtccagaga

SEQ ID NO: 461028 - DNA, 25 bp, Mus musculus
tacagcatcatgcagggcgagtaca

SEQ ID NO: 461029 - DNA, 25 bp, Mus musculus
tacagcatcggtgggcacagcatca

SEQ ID NO: 461030 - DNA, 25 bp, Mus musculus
tacagcatcgtctcttcggaggaag

SEQ ID NO: 461031 - DNA, 25 bp, Mus musculus
tacagcatgatgatggagaccgacc

SEQ ID NO: 461032 - DNA, 25 bp, Mus musculus
tacagcatgctggtggcctttacaa

SEQ ID NO: 461033 - DNA, 25 bp, Mus musculus
tacagcatgtcctactcgcagcagg

SEQ ID NO: 461034 - DNA, 25 bp, Mus musculus
tacagccaagagtactcgtcagacg

SEQ ID NO: 461035 - DNA, 25 bp, Mus musculus
tacagccagatgaggtgtcctgcaa

SEQ ID NO: 461036 - DNA, 25 bp, Mus musculus
tacagccagcttacctaagatagaa

SEQ ID NO: 461037 - DNA, 25 bp, Mus musculus
tacagccagcttgagggcttcagtg

SEQ ID NO: 461038 - DNA, 25 bp, Mus musculus
tacagccagggtaacagaggtctct

SEQ ID NO: 461039 - DNA, 25 bp, Mus musculus
tacagccattccgtttaggcagcgg

SEQ ID NO: 461040 - DNA, 25 bp, Mus musculus
tacagcccatgggttgactccttgc

SEQ ID NO: 461041 - DNA, 25 bp, Mus musculus
tacagccccagagtgatttccgcaa

SEQ ID NO: 461042 - DNA, 25 bp, Mus musculus
tacagccccatacgcactgtctgga

SEQ ID NO: 461043 - DNA, 25 bp, Mus musculus
tacagcccctgggaaatctgggagc

SEQ ID NO: 461044 - DNA, 25 bp, Mus musculus
tacagccctgttgtttgggacccag

SEQ ID NO: 461045 - DNA, 25 bp, Mus musculus
tacagccgagaatgtcctggaggat

SEQ ID NO: 461046 - DNA, 25 bp, Mus musculus
tacagccggacaagaggagtttgga

SEQ ID NO: 461047 - DNA, 25 bp, Mus musculus
tacagccggcagatgaccgtgaaca

SEQ ID NO: 461048 - DNA, 25 bp, Mus musculus
tacagccgggaagacaataactgca

SEQ ID NO: 461049 - DNA, 25 bp, Mus musculus
tacagccgtcttggagggaactggc

SEQ ID NO: 461050 - DNA, 25 bp, Mus musculus
tacagccgtgtcttcagatgatgca

SEQ ID NO: 461051 - DNA, 25 bp, Mus musculus
tacagccgtgtgcagtaccaattcg

SEQ ID NO: 461052 - DNA, 25 bp, Mus musculus
tacagcctactgtggaacaactgcg

SEQ ID NO: 461053 - DNA, 25 bp, Mus musculus
tacagcctcaggaacaaagaagtca

SEQ ID NO: 461054 - DNA, 25 bp, Mus musculus
tacagcctcaggatccatgtgcgag

SEQ ID NO: 461055 - DNA, 25 bp, Mus musculus
tacagcctgaccgtgagtacataca

SEQ ID NO: 461056 - DNA, 25 bp, Mus musculus
tacagcctgagtgacgaagggcacg

SEQ ID NO: 461057 - DNA, 25 bp, Mus musculus
tacagcctgtatggcatctgccgtg

SEQ ID NO: 461058 - DNA, 25 bp, Mus musculus
tacagcctgtggtatttcggaaccc

SEQ ID NO: 461059 - DNA, 25 bp, Mus musculus
tacagccttcaaatgtggtcacaga

SEQ ID NO: 461060 - DNA, 25 bp, Mus musculus
tacagccttgggacagtacctctgc

SEQ ID NO: 461061 - DNA, 25 bp, Mus musculus
tacagcgacacaaacctggacactt

SEQ ID NO: 461062 - DNA, 25 bp, Mus musculus
tacagcgacgacaaactcgagagga

SEQ ID NO: 461063 - DNA, 25 bp, Mus musculus
tacagcgagatcctggaagaaccac

SEQ ID NO: 461064 - DNA, 25 bp, Mus musculus
tacagcgagctgaacaaatggtcct

SEQ ID NO: 461065 - DNA, 25 bp, Mus musculus
tacagcgagttcagcgaagtcctcc

SEQ ID NO: 461066 - DNA, 25 bp, Mus musculus
tacagcgatgagatcgacctggagg

SEQ ID NO: 461067 - DNA, 25 bp, Mus musculus
tacagcgatggctttgttgacaccc

SEQ ID NO: 461068 - DNA, 25 bp, Mus musculus
tacagcgcacacacgacgagattgc

SEQ ID NO: 461069 - DNA, 25 bp, Mus musculus
tacagcgcagagcaaaatcgaatgg

SEQ ID NO: 461070 - DNA, 25 bp, Mus musculus
tacagcggcagcttcttcatccagg

SEQ ID NO: 461071 - DNA, 25 bp, Mus musculus
tacagcgggatgaattgcaaagacc

SEQ ID NO: 461072 - DNA, 25 bp, Mus musculus
tacagcgggtaccttccttcgagag

SEQ ID NO: 461073 - DNA, 25 bp, Mus musculus
tacagcggtgagtccttgagagaga

SEQ ID NO: 461074 - DNA, 25 bp, Mus musculus
tacagcggtgtgattcgtgcagaga

SEQ ID NO: 461075 - DNA, 25 bp, Mus musculus
tacagcgtgggattgtggtcctcaa

SEQ ID NO: 461076 - DNA, 25 bp, Mus musculus
tacagcgttgatgtgctcactatgc

SEQ ID NO: 461077 - DNA, 25 bp, Mus musculus
tacagctaaagtgtggaccccagag

SEQ ID NO: 461078 - DNA, 25 bp, Mus musculus
tacagctacaaaagccgatggcagc

SEQ ID NO: 461079 - DNA, 25 bp, Mus musculus
tacagctacgggaagtgagccgact

SEQ ID NO: 461080 - DNA, 25 bp, Mus musculus
tacagctcaacatggtcgacctcga

SEQ ID NO: 461081 - DNA, 25 bp, Mus musculus
tacagctcagtgactatgtccaggg

SEQ ID NO: 461082 - DNA, 25 bp, Mus musculus
tacagctcatggtatcattggcaca

SEQ ID NO: 461083 - DNA, 25 bp, Mus musculus
tacagctcattcgagaggagaaccg

SEQ ID NO: 461084 - DNA, 25 bp, Mus musculus
tacagctccgtgagaatgggcaaac

SEQ ID NO: 461085 - DNA, 25 bp, Mus musculus
tacagctctacagattgcttctggg

SEQ ID NO: 461086 - DNA, 25 bp, Mus musculus
tacagctctatcttatctccaggac

SEQ ID NO: 461087 - DNA, 25 bp, Mus musculus
tacagctgcaaccagagtatgaacc

SEQ ID NO: 461088 - DNA, 25 bp, Mus musculus
tacagctgcagttacacggtgtcgc

SEQ ID NO: 461089 - DNA, 25 bp, Mus musculus
tacagctgctgtgcattgttcactg

SEQ ID NO: 461090 - DNA, 25 bp, Mus musculus
tacagctggaagagttacaacgccc

SEQ ID NO: 461091 - DNA, 25 bp, Mus musculus
tacagctggtatcaggatggccgcc

SEQ ID NO: 461092 - DNA, 25 bp, Mus musculus
tacagctggtcatggagtacgtccc

SEQ ID NO: 461093 - DNA, 25 bp, Mus musculus
tacagctgtacataaccagtgaatg

SEQ ID NO: 461094 - DNA, 25 bp, Mus musculus
tacagctgtacttttccctggagga

SEQ ID NO: 461095 - DNA, 25 bp, Mus musculus
tacagctgtctagtgcgctccatga

SEQ ID NO: 461096 - DNA, 25 bp, Mus musculus
tacagctgtgtcaccatgggaggag

SEQ ID NO: 461097 - DNA, 25 bp, Mus musculus
tacagctgttgttaccacccagggc

SEQ ID NO: 461098 - DNA, 25 bp, Mus musculus
tacagcttatgcacaacctgggcaa

SEQ ID NO: 461099 - DNA, 25 bp, Mus musculus
tacagcttgcctctgggcctcagag

SEQ ID NO: 461100 - DNA, 25 bp, Mus musculus
tacagcttggaggacttaccgcaaa

SEQ ID NO: 461101 - DNA, 25 bp, Mus musculus
tacagcttgtggagatgatgccatc

SEQ ID NO: 461102 - DNA, 25 bp, Mus musculus
tacaggaaagcacatggcaggacag

SEQ ID NO: 461103 - DNA, 25 bp, Mus musculus
tacaggaaagcgcttagcaccggct

SEQ ID NO: 461104 - DNA, 25 bp, Mus musculus
tacaggaaattcaccaccgagagcg

SEQ ID NO: 461105 - DNA, 25 bp, Mus musculus
tacaggaaccatttggaacggtcac

SEQ ID NO: 461106 - DNA, 25 bp, Mus musculus
tacaggaagactaagagacacaacg

SEQ ID NO: 461107 - DNA, 25 bp, Mus musculus
tacaggaagagaggacctggagcac

SEQ ID NO: 461108 - DNA, 25 bp, Mus musculus
tacaggaagcatacctacatgaggc

SEQ ID NO: 461109 - DNA, 25 bp, Mus musculus
tacaggaaggattcatatcggctct

SEQ ID NO: 461110 - DNA, 25 bp, Mus musculus
tacaggaagttcaccaaataatgtt

SEQ ID NO: 461111 - DNA, 25 bp, Mus musculus
tacaggaatctgtgctacgtcatca

SEQ ID NO: 461112 - DNA, 25 bp, Mus musculus
tacaggaatgtgaagggaggcctct

SEQ ID NO: 461113 - DNA, 25 bp, Mus musculus
tacaggaattactacggttaccaag

SEQ ID NO: 461114 - DNA, 25 bp, Mus musculus
tacaggacaacattcagcacgcaga

SEQ ID NO: 461115 - DNA, 25 bp, Mus musculus
tacaggacagatgctgatgcagcct

SEQ ID NO: 461116 - DNA, 25 bp, Mus musculus
tacaggacctagaaggcggcatcag

SEQ ID NO: 461117 - DNA, 25 bp, Mus musculus
tacaggacctgagtcatcccatcaa

SEQ ID NO: 461118 - DNA, 25 bp, Mus musculus
tacaggactacaggagtgtaccacc

SEQ ID NO: 461119 - DNA, 25 bp, Mus musculus
tacaggactccgtgataagagcaag

SEQ ID NO: 461120 - DNA, 25 bp, Mus musculus
tacaggactttgtgaccccagagga

SEQ ID NO: 461121 - DNA, 25 bp, Mus musculus
tacaggagcagatgaacccaaagga

SEQ ID NO: 461122 - DNA, 25 bp, Mus musculus
tacaggagctaagaagagagacatg

SEQ ID NO: 461123 - DNA, 25 bp, Mus musculus
tacaggaggagcaagtgaccgttct

SEQ ID NO: 461124 - DNA, 25 bp, Mus musculus
tacaggagtttcttgtggcaggcag

SEQ ID NO: 461125 - DNA, 25 bp, Mus musculus
tacaggataacccagcatcaggaga

SEQ ID NO: 461126 - DNA, 25 bp, Mus musculus
tacaggatacgggagcacttgcatt

SEQ ID NO: 461127 - DNA, 25 bp, Mus musculus
tacaggatcctgacatgctctagag

SEQ ID NO: 461128 - DNA, 25 bp, Mus musculus
tacaggatgaacagccaggacaagc

SEQ ID NO: 461129 - DNA, 25 bp, Mus musculus
tacaggatgcatcatctggaccagg

SEQ ID NO: 461130 - DNA, 25 bp, Mus musculus
tacaggatgtgttcagaggccgcat

SEQ ID NO: 461131 - DNA, 25 bp, Mus musculus
tacaggattccccacatgaagctga

SEQ ID NO: 461132 - DNA, 25 bp, Mus musculus
tacaggcaaccaaaccgagaggcat

SEQ ID NO: 461133 - DNA, 25 bp, Mus musculus
tacaggcaactccttgacaggtgac

SEQ ID NO: 461134 - DNA, 25 bp, Mus musculus
tacaggcactcatcacagctatggg

SEQ ID NO: 461135 - DNA, 25 bp, Mus musculus
tacaggcaggagtggagcacagact

SEQ ID NO: 461136 - DNA, 25 bp, Mus musculus
tacaggcaggtaagtcacatttctc

SEQ ID NO: 461137 - DNA, 25 bp, Mus musculus
tacaggcagttcattcccgagagat

SEQ ID NO: 461138 - DNA, 25 bp, Mus musculus
tacaggcatccaaaaggagaccatc

SEQ ID NO: 461139 - DNA, 25 bp, Mus musculus
tacaggccagacagaagcgactatg

SEQ ID NO: 461140 - DNA, 25 bp, Mus musculus
tacaggcccattgtggagagtgcga

SEQ ID NO: 461141 - DNA, 25 bp, Mus musculus
tacaggccgcaatcgagtgggagac

SEQ ID NO: 461142 - DNA, 25 bp, Mus musculus
tacaggcctgctgtgaagtccgagg

SEQ ID NO: 461143 - DNA, 25 bp, Mus musculus
tacaggcctggacttgcagaagact

SEQ ID NO: 461144 - DNA, 25 bp, Mus musculus
tacaggcctgggtgatgcacgacat

SEQ ID NO: 461145 - DNA, 25 bp, Mus musculus
tacaggcctggtgtctacactcggg

SEQ ID NO: 461146 - DNA, 25 bp, Mus musculus
tacaggcgaggtcgaactacaaatg

SEQ ID NO: 461147 - DNA, 25 bp, Mus musculus
tacaggcgagttggagctcagaatc

SEQ ID NO: 461148 - DNA, 25 bp, Mus musculus
tacaggcgctgtgactacacctacg

SEQ ID NO: 461149 - DNA, 25 bp, Mus musculus
tacaggcggcagatacagatggtga

SEQ ID NO: 461150 - DNA, 25 bp, Mus musculus
tacaggctatgtttgcccgaggaat

SEQ ID NO: 461151 - DNA, 25 bp, Mus musculus
tacaggctctagtgtacccggaggc

SEQ ID NO: 461152 - DNA, 25 bp, Mus musculus
tacaggctgagacctggaacctgag

SEQ ID NO: 461153 - DNA, 25 bp, Mus musculus
tacaggctgatatcgcgtgcaagac

SEQ ID NO: 461154 - DNA, 25 bp, Mus musculus
tacaggctgattaagggacatggac

SEQ ID NO: 461155 - DNA, 25 bp, Mus musculus
tacaggctgcagttcaacgaatttg

SEQ ID NO: 461156 - DNA, 25 bp, Mus musculus
tacaggctgcatatccaggtgacac

SEQ ID NO: 461157 - DNA, 25 bp, Mus musculus
tacaggctgctcagaaccgcctgga

SEQ ID NO: 461158 - DNA, 25 bp, Mus musculus
tacaggctggaagaggatgtccttc

SEQ ID NO: 461159 - DNA, 25 bp, Mus musculus
tacaggctggctcctacaatctggc

SEQ ID NO: 461160 - DNA, 25 bp, Mus musculus
tacaggcttgtgaaggactgaacct

SEQ ID NO: 461161 - DNA, 25 bp, Mus musculus
tacagggaaaagacactcagttgct

SEQ ID NO: 461162 - DNA, 25 bp, Mus musculus
tacagggacagcttcaccttcagtg

SEQ ID NO: 461163 - DNA, 25 bp, Mus musculus
tacagggaccacataggaaagcagg

SEQ ID NO: 461164 - DNA, 25 bp, Mus musculus
tacagggagctcatagaacagctgc

SEQ ID NO: 461165 - DNA, 25 bp, Mus musculus
tacagggcctctccaatttgaggga

SEQ ID NO: 461166 - DNA, 25 bp, Mus musculus
tacagggctccatagtgtctggctc

SEQ ID NO: 461167 - DNA, 25 bp, Mus musculus
tacagggtcaatagtgggagctcag

SEQ ID NO: 461168 - DNA, 25 bp, Mus musculus
tacagggtgacttcagctctgagac

SEQ ID NO: 461169 - DNA, 25 bp, Mus musculus
tacagggtgtgacaacatgacgtgc

SEQ ID NO: 461170 - DNA, 25 bp, Mus musculus
tacagggtgttgaaagccagctcgg

SEQ ID NO: 461171 - DNA, 25 bp, Mus musculus
tacagggttctagcagtttccagaa

SEQ ID NO: 461172 - DNA, 25 bp, Mus musculus
tacagggttcttagctcgaaagctt

SEQ ID NO: 461173 - DNA, 25 bp, Mus musculus
tacagggtttaagacttctagactc

SEQ ID NO: 461174 - DNA, 25 bp, Mus musculus
tacaggtaagaggaaagcggtgaat

SEQ ID NO: 461175 - DNA, 25 bp, Mus musculus
tacaggtacaacgtaggaatttagg

SEQ ID NO: 461176 - DNA, 25 bp, Mus musculus
tacaggtacctgctgaatgagaaag

SEQ ID NO: 461177 - DNA, 25 bp, Mus musculus
tacaggtacgagctgatgaaggcct

SEQ ID NO: 461178 - DNA, 25 bp, Mus musculus
tacaggtagctttgcctccgagggc

SEQ ID NO: 461179 - DNA, 25 bp, Mus musculus
tacaggtaggaactctgatccttgc

SEQ ID NO: 461180 - DNA, 25 bp, Mus musculus
tacaggtcaagttagcccagctgct

SEQ ID NO: 461181 - DNA, 25 bp, Mus musculus
tacaggtcagaagttaaagcgaggc

SEQ ID NO: 461182 - DNA, 25 bp, Mus musculus
tacaggtcccagaatgacagctgcc

SEQ ID NO: 461183 - DNA, 25 bp, Mus musculus
tacaggtcccagtggcagtaggagc

SEQ ID NO: 461184 - DNA, 25 bp, Mus musculus
tacaggtctaagtcggttcttcagt

SEQ ID NO: 461185 - DNA, 25 bp, Mus musculus
tacaggtcttcagtagcaggcaaag

SEQ ID NO: 461186 - DNA, 25 bp, Mus musculus
tacaggtgaagccaaaaagcaagca

SEQ ID NO: 461187 - DNA, 25 bp, Mus musculus
tacaggtgagtctctgggcagcttc

SEQ ID NO: 461188 - DNA, 25 bp, Mus musculus
tacaggtgctcagattacacccagc

SEQ ID NO: 461189 - DNA, 25 bp, Mus musculus
tacaggtgggtcacagttggcatcc

SEQ ID NO: 461190 - DNA, 25 bp, Mus musculus
tacaggtggttgtgcactatatcca

SEQ ID NO: 461191 - DNA, 25 bp, Mus musculus
tacaggtgtttgacaggtagactgc

SEQ ID NO: 461192 - DNA, 25 bp, Mus musculus
tacaggttattagttgcaaaatgcc

SEQ ID NO: 461193 - DNA, 25 bp, Mus musculus
tacaggttcctcacaagcagaggta

SEQ ID NO: 461194 - DNA, 25 bp, Mus musculus
tacaggttgctggtataccccatga

SEQ ID NO: 461195 - DNA, 25 bp, Mus musculus
tacaggttgggagatgcagcctccc

SEQ ID NO: 461196 - DNA, 25 bp, Mus musculus
tacaggtttctgtgcactcgatgca

SEQ ID NO: 461197 - DNA, 25 bp, Mus musculus
tacaggtttcttcgacgctttgggc

SEQ ID NO: 461198 - DNA, 25 bp, Mus musculus
tacaggtttgatagagaatcgcccc

SEQ ID NO: 461199 - DNA, 25 bp, Mus musculus
tacaggtttttatgtatgggatacc

SEQ ID NO: 461200 - DNA, 25 bp, Mus musculus
tacagtaaacggaaagaatcttgga

SEQ ID NO: 461201 - DNA, 25 bp, Mus musculus
tacagtaacctccttagtggcagca

SEQ ID NO: 461202 - DNA, 25 bp, Mus musculus
tacagtaagcgagtggcagacatca

SEQ ID NO: 461203 - DNA, 25 bp, Mus musculus
tacagtaccaggactagcttatgca

SEQ ID NO: 461204 - DNA, 25 bp, Mus musculus
tacagtaccatgtcactcaggagaa

SEQ ID NO: 461205 - DNA, 25 bp, Mus musculus
tacagtaccctctgtgcctgcggtg

SEQ ID NO: 461206 - DNA, 25 bp, Mus musculus
tacagtaccgctgcatgttgcacgc

SEQ ID NO: 461207 - DNA, 25 bp, Mus musculus
tacagtacggatggagatgcaccac

SEQ ID NO: 461208 - DNA, 25 bp, Mus musculus
tacagtactatagtagtttaataag

SEQ ID NO: 461209 - DNA, 25 bp, Mus musculus
tacagtagaaggcataggaagcacc

SEQ ID NO: 461210 - DNA, 25 bp, Mus musculus
tacagtagaccgaaaccacttccgg

SEQ ID NO: 461211 - DNA, 25 bp, Mus musculus
tacagtagacctgaactggtgcgtc

SEQ ID NO: 461212 - DNA, 25 bp, Mus musculus
tacagtagagatgcagttggttccc

SEQ ID NO: 461213 - DNA, 25 bp, Mus musculus
tacagtagaggcgataattctgccc

SEQ ID NO: 461214 - DNA, 25 bp, Mus musculus
tacagtagcagctctttgcgatttc

SEQ ID NO: 461215 - DNA, 25 bp, Mus musculus
tacagtagcccattgagcccttgag

SEQ ID NO: 461216 - DNA, 25 bp, Mus musculus
tacagtagggccaagacagaattcc

SEQ ID NO: 461217 - DNA, 25 bp, Mus musculus
tacagtagggtcgatctgccgagct

SEQ ID NO: 461218 - DNA, 25 bp, Mus musculus
tacagtagggtgtttgcaggcttgc

SEQ ID NO: 461219 - DNA, 25 bp, Mus musculus
tacagtagtctttagcagaaagctc

SEQ ID NO: 461220 - DNA, 25 bp, Mus musculus
tacagtagttaagcttggttgtggc

SEQ ID NO: 461221 - DNA, 25 bp, Mus musculus
tacagtatcttggagggacagccgt

SEQ ID NO: 461222 - DNA, 25 bp, Mus musculus
tacagtatgaacctcagggtaggga

SEQ ID NO: 461223 - DNA, 25 bp, Mus musculus
tacagtatggccctgtcctacagcc

SEQ ID NO: 461224 - DNA, 25 bp, Mus musculus
tacagtcagatctcaggaatggaag

SEQ ID NO: 461225 - DNA, 25 bp, Mus musculus
tacagtcaggagaaagccgaaagct

SEQ ID NO: 461226 - DNA, 25 bp, Mus musculus
tacagtcaggctgagaagcatcctg

SEQ ID NO: 461227 - DNA, 25 bp, Mus musculus
tacagtcagtttccatccctagccg

SEQ ID NO: 461228 - DNA, 25 bp, Mus musculus
tacagtcatacattacggtgcccag

SEQ ID NO: 461229 - DNA, 25 bp, Mus musculus
tacagtcccctgtctgggtatttta

SEQ ID NO: 461230 - DNA, 25 bp, Mus musculus
tacagtccctcatgtggtggtaccc

SEQ ID NO: 461231 - DNA, 25 bp, Mus musculus
tacagtcctctacgctgtggtgacc

SEQ ID NO: 461232 - DNA, 25 bp, Mus musculus
tacagtcggatcatgcttccagctc

SEQ ID NO: 461233 - DNA, 25 bp, Mus musculus
tacagtctcaagagtctttcacaag

SEQ ID NO: 461234 - DNA, 25 bp, Mus musculus
tacagtctcctcaggtgacagggaa

SEQ ID NO: 461235 - DNA, 25 bp, Mus musculus
tacagtctgagaccactaggcacta

SEQ ID NO: 461236 - DNA, 25 bp, Mus musculus
tacagtctgagccaggacatttgat

SEQ ID NO: 461237 - DNA, 25 bp, Mus musculus
tacagtctggttgaaggttatccct

SEQ ID NO: 461238 - DNA, 25 bp, Mus musculus
tacagtcttgggaccaggcttcagc

SEQ ID NO: 461239 - DNA, 25 bp, Mus musculus
tacagtcttttaagtccagggtgca

SEQ ID NO: 461240 - DNA, 25 bp, Mus musculus
tacagtgaaatgaaggctgcccagg

SEQ ID NO: 461241 - DNA, 25 bp, Mus musculus
tacagtgaacttaaatgaaatcccc

SEQ ID NO: 461242 - DNA, 25 bp, Mus musculus
tacagtgaagggatgaagcacgtcc

SEQ ID NO: 461243 - DNA, 25 bp, Mus musculus
tacagtgaatctgaggccaacagcc

SEQ ID NO: 461244 - DNA, 25 bp, Mus musculus
tacagtgacagaatgacctcgcgct

SEQ ID NO: 461245 - DNA, 25 bp, Mus musculus
tacagtgacaggtaagacaccagac

SEQ ID NO: 461246 - DNA, 25 bp, Mus musculus
tacagtgaccgcgatgtgcaacatg

SEQ ID NO: 461247 - DNA, 25 bp, Mus musculus
tacagtgacgaggtggagatcatcc

SEQ ID NO: 461248 - DNA, 25 bp, Mus musculus
tacagtgactttggcacacaggccc

SEQ ID NO: 461249 - DNA, 25 bp, Mus musculus
tacagtgagaaagtgcgctgcgctc

SEQ ID NO: 461250 - DNA, 25 bp, Mus musculus
tacagtgagaaagtgggaccattca

SEQ ID NO: 461251 - DNA, 25 bp, Mus musculus
tacagtgagggttggcttcatagcc

SEQ ID NO: 461252 - DNA, 25 bp, Mus musculus
tacagtgatggagaggtgaacgacc

SEQ ID NO: 461253 - DNA, 25 bp, Mus musculus
tacagtgatgttccgggtggcacct

SEQ ID NO: 461254 - DNA, 25 bp, Mus musculus
tacagtgcactagccaagctcttgg

SEQ ID NO: 461255 - DNA, 25 bp, Mus musculus
tacagtgcagttagccctcaggaag

SEQ ID NO: 461256 - DNA, 25 bp, Mus musculus
tacagtgcatcgacatggacagcct

SEQ ID NO: 461257 - DNA, 25 bp, Mus musculus
tacagtgccaaagtgcaggagcagc

SEQ ID NO: 461258 - DNA, 25 bp, Mus musculus
tacagtgcccgagaagaaaaacttg

SEQ ID NO: 461259 - DNA, 25 bp, Mus musculus
tacagtgccctttggaaaccatcgg

SEQ ID NO: 461260 - DNA, 25 bp, Mus musculus
tacagtgcctgtctagtggaggttc

SEQ ID NO: 461261 - DNA, 25 bp, Mus musculus
tacagtgcgtgacctggatgaactc

SEQ ID NO: 461262 - DNA, 25 bp, Mus musculus
tacagtgctatcctgaagcgaccag

SEQ ID NO: 461263 - DNA, 25 bp, Mus musculus
tacagtgctggtgaatggtggctcc

SEQ ID NO: 461264 - DNA, 25 bp, Mus musculus
tacagtgctgtaggtgtgacggact

SEQ ID NO: 461265 - DNA, 25 bp, Mus musculus
tacagtgctgtgtatacttgtggcc

SEQ ID NO: 461266 - DNA, 25 bp, Mus musculus
tacagtgcttagaactggctatctg

SEQ ID NO: 461267 - DNA, 25 bp, Mus musculus
tacagtgcttgcatctcaggctaga

SEQ ID NO: 461268 - DNA, 25 bp, Mus musculus
tacagtggagaccaccagagttggc

SEQ ID NO: 461269 - DNA, 25 bp, Mus musculus
tacagtggagcagcgattctcagcc

SEQ ID NO: 461270 - DNA, 25 bp, Mus musculus
tacagtggcactcacagtcggacag

SEQ ID NO: 461271 - DNA, 25 bp, Mus musculus
tacagtggcagctcatcaataaggg

SEQ ID NO: 461272 - DNA, 25 bp, Mus musculus
tacagtggcatgactgtgtccgccg

SEQ ID NO: 461273 - DNA, 25 bp, Mus musculus
tacagtggcctgaagcatgaggaca

SEQ ID NO: 461274 - DNA, 25 bp, Mus musculus
tacagtggcgtggtgtaccctctca

SEQ ID NO: 461275 - DNA, 25 bp, Mus musculus
tacagtgggacggttgtcttccttg

SEQ ID NO: 461276 - DNA, 25 bp, Mus musculus
tacagtgggattcctgaccggcaga

SEQ ID NO: 461277 - DNA, 25 bp, Mus musculus
tacagtgggcgcaagaaggactctg

SEQ ID NO: 461278 - DNA, 25 bp, Mus musculus
tacagtggttacaacacaggaggtt

SEQ ID NO: 461279 - DNA, 25 bp, Mus musculus
tacagtgtactctatgagcccatgg

SEQ ID NO: 461280 - DNA, 25 bp, Mus musculus
tacagtgtagccaacaagcacggcc

SEQ ID NO: 461281 - DNA, 25 bp, Mus musculus
tacagtgtcaacctaagcttggccc

SEQ ID NO: 461282 - DNA, 25 bp, Mus musculus
tacagtgtcactgcttcaagatgaa

SEQ ID NO: 461283 - DNA, 25 bp, Mus musculus
tacagtgtcatcaaggagtcagacc

SEQ ID NO: 461284 - DNA, 25 bp, Mus musculus
tacagtgtcccagcaagtcaaaagt

SEQ ID NO: 461285 - DNA, 25 bp, Mus musculus
tacagtgttaacgtcaagggcaccg

SEQ ID NO: 461286 - DNA, 25 bp, Mus musculus
tacagtgttccttacgatgccacgc

SEQ ID NO: 461287 - DNA, 25 bp, Mus musculus
tacagtgtttgagcagcacaaggcc

SEQ ID NO: 461288 - DNA, 25 bp, Mus musculus
tacagtgttttgaagcggccattac

SEQ ID NO: 461289 - DNA, 25 bp, Mus musculus
tacagttcacacatacagagaggtg

SEQ ID NO: 461290 - DNA, 25 bp, Mus musculus
tacagttcagacctggagctcggga

SEQ ID NO: 461291 - DNA, 25 bp, Mus musculus
tacagttccatttgcatcaactgcc

SEQ ID NO: 461292 - DNA, 25 bp, Mus musculus
tacagttcttcgaagagcggcgacg

SEQ ID NO: 461293 - DNA, 25 bp, Mus musculus
tacagttgagtggttctggccgagc

SEQ ID NO: 461294 - DNA, 25 bp, Mus musculus
tacagttgcactgatgaggccaaac

SEQ ID NO: 461295 - DNA, 25 bp, Mus musculus
tacagttgccaagacatgatgtttc

SEQ ID NO: 461296 - DNA, 25 bp, Mus musculus
tacagttggagaaatcacggatgcc

SEQ ID NO: 461297 - DNA, 25 bp, Mus musculus
tacagttgggtagagcacattttgc

SEQ ID NO: 461298 - DNA, 25 bp, Mus musculus
tacagttgtatgcataggcaggcct

SEQ ID NO: 461299 - DNA, 25 bp, Mus musculus
tacagtttcaacacggatccagatg

SEQ ID NO: 461300 - DNA, 25 bp, Mus musculus
tacagtttcttgttcagacgggcag

SEQ ID NO: 461301 - DNA, 25 bp, Mus musculus
tacagtttgaacctgcaggaagacc

SEQ ID NO: 461302 - DNA, 25 bp, Mus musculus
tacagtttgtgtcggtaccgccgcg

SEQ ID NO: 461303 - DNA, 25 bp, Mus musculus
tacagttttaacttccacgtggtga

SEQ ID NO: 461304 - DNA, 25 bp, Mus musculus
tacagttttaccagaaatgcccagg

SEQ ID NO: 461305 - DNA, 25 bp, Mus musculus
tacagttttattacctgcagtgttg

SEQ ID NO: 461306 - DNA, 25 bp, Mus musculus
tacataaacccctgagcattctgca

SEQ ID NO: 461307 - DNA, 25 bp, Mus musculus
tacataagcacagagagcccgtggc

SEQ ID NO: 461308 - DNA, 25 bp, Mus musculus
tacataatccggttcctgagcagcc

SEQ ID NO: 461309 - DNA, 25 bp, Mus musculus
tacataatgagtctcgggccacatg

SEQ ID NO: 461310 - DNA, 25 bp, Mus musculus
tacataattggtactcatggcggtg

SEQ ID NO: 461311 - DNA, 25 bp, Mus musculus
tacatacaccgatctgtccccaatg

SEQ ID NO: 461312 - DNA, 25 bp, Mus musculus
tacatacagattaattggcacattt

SEQ ID NO: 461313 - DNA, 25 bp, Mus musculus
tacatacatgtactgtggactgccc

SEQ ID NO: 461314 - DNA, 25 bp, Mus musculus
tacataccattcgagagagccagca

SEQ ID NO: 461315 - DNA, 25 bp, Mus musculus
tacatacctatgctgaatggcccca

SEQ ID NO: 461316 - DNA, 25 bp, Mus musculus
tacatacgacgagaggcggaatggc

SEQ ID NO: 461317 - DNA, 25 bp, Mus musculus
tacatacgagtccttcgacagcagg

SEQ ID NO: 461318 - DNA, 25 bp, Mus musculus
tacatactatttgccacgctggagg

SEQ ID NO: 461319 - DNA, 25 bp, Mus musculus
tacatacttacacacgtttactagg

SEQ ID NO: 461320 - DNA, 25 bp, Mus musculus
tacatagaaactcattccaaatggt

SEQ ID NO: 461321 - DNA, 25 bp, Mus musculus
tacatagaatctgccttccgggtag

SEQ ID NO: 461322 - DNA, 25 bp, Mus musculus
tacatagacgacaaggcacagttcc

SEQ ID NO: 461323 - DNA, 25 bp, Mus musculus
tacatagagcagacgctggtcaccg

SEQ ID NO: 461324 - DNA, 25 bp, Mus musculus
tacatagcacgccatgtctgtgggc

SEQ ID NO: 461325 - DNA, 25 bp, Mus musculus
tacatagctgctatcagtgcccgct

SEQ ID NO: 461326 - DNA, 25 bp, Mus musculus
tacataggatccacaagaggcgtcg

SEQ ID NO: 461327 - DNA, 25 bp, Mus musculus
tacataggtcttcccttcgtcagga

SEQ ID NO: 461328 - DNA, 25 bp, Mus musculus
tacataggtgtctctcttggcagca

SEQ ID NO: 461329 - DNA, 25 bp, Mus musculus
tacatagtcaacgtgtcctgggcca

SEQ ID NO: 461330 - DNA, 25 bp, Mus musculus
tacatatagatttagctccctgatg

SEQ ID NO: 461331 - DNA, 25 bp, Mus musculus
tacatatattctgatcaaacacaat

SEQ ID NO: 461332 - DNA, 25 bp, Mus musculus
tacatatcagcatcaaaggcagcat

SEQ ID NO: 461333 - DNA, 25 bp, Mus musculus
tacatatcctgggtgatgggcaagt

SEQ ID NO: 461334 - DNA, 25 bp, Mus musculus
tacatatcgttatggagactcctct

SEQ ID NO: 461335 - DNA, 25 bp, Mus musculus
tacatatctatcgagtgcgcctgca

SEQ ID NO: 461336 - DNA, 25 bp, Mus musculus
tacatatctgcacaactgaataaat

SEQ ID NO: 461337 - DNA, 25 bp, Mus musculus
tacatatctgtgacctgcttctgag

SEQ ID NO: 461338 - DNA, 25 bp, Mus musculus
tacatatggcaagaggaatgcggca

SEQ ID NO: 461339 - DNA, 25 bp, Mus musculus
tacatattaaccttgaaaccgctct

SEQ ID NO: 461340 - DNA, 25 bp, Mus musculus
tacatcaacgacatgaagaggaggc

SEQ ID NO: 461341 - DNA, 25 bp, Mus musculus
tacatcaactatgaccagctggagg

SEQ ID NO: 461342 - DNA, 25 bp, Mus musculus
tacatcacagataagtgccccgagg

SEQ ID NO: 461343 - DNA, 25 bp, Mus musculus
tacatcacatctgactgcgggcaca

SEQ ID NO: 461344 - DNA, 25 bp, Mus musculus
tacatcaccgagaagctgtggcgga

SEQ ID NO: 461345 - DNA, 25 bp, Mus musculus
tacatcactcttctagaaaggcggg

SEQ ID NO: 461346 - DNA, 25 bp, Mus musculus
tacatcactgtggatgagctcaagg

SEQ ID NO: 461347 - DNA, 25 bp, Mus musculus
tacatcagacagcaggacctcaaag

SEQ ID NO: 461348 - DNA, 25 bp, Mus musculus
tacatcaggagaactgctcgtacca

SEQ ID NO: 461349 - DNA, 25 bp, Mus musculus
tacatcaggatgtccaagccctgtg

SEQ ID NO: 461350 - DNA, 25 bp, Mus musculus
tacatcaggctactctgacggcagg

SEQ ID NO: 461351 - DNA, 25 bp, Mus musculus
tacatcagtcctggaacggaagcca

SEQ ID NO: 461352 - DNA, 25 bp, Mus musculus
tacatcagtgcagggcttggtgcca

SEQ ID NO: 461353 - DNA, 25 bp, Mus musculus
tacatcatccctgacttgctgggtg

SEQ ID NO: 461354 - DNA, 25 bp, Mus musculus
tacatcatcctctgaatatgctggc

SEQ ID NO: 461355 - DNA, 25 bp, Mus musculus
tacatcatgaaaaggaggaagccca

SEQ ID NO: 461356 - DNA, 25 bp, Mus musculus
tacatcatggactggcgcatcaagg

SEQ ID NO: 461357 - DNA, 25 bp, Mus musculus
tacatccaaggctgaagtcaaggca

SEQ ID NO: 461358 - DNA, 25 bp, Mus musculus
tacatccaggccaaagacaaaggtg

SEQ ID NO: 461359 - DNA, 25 bp, Mus musculus
tacatccagtgaccagttagtgctg

SEQ ID NO: 461360 - DNA, 25 bp, Mus musculus
tacatcccgagaattgctgaagaca

SEQ ID NO: 461361 - DNA, 25 bp, Mus musculus
tacatccctagctcgagactttcct

SEQ ID NO: 461362 - DNA, 25 bp, Mus musculus
tacatccctatggacggcgaggact

SEQ ID NO: 461363 - DNA, 25 bp, Mus musculus
tacatccgggacctgtgcaatgggc

SEQ ID NO: 461364 - DNA, 25 bp, Mus musculus
tacatccggttttcccagatctgtg

SEQ ID NO: 461365 - DNA, 25 bp, Mus musculus
tacatccgtgacataaaataagact

SEQ ID NO: 461366 - DNA, 25 bp, Mus musculus
tacatcctgctaatggacatcgtgg

SEQ ID NO: 461367 - DNA, 25 bp, Mus musculus
tacatcctggacagattcgaagcaa

SEQ ID NO: 461368 - DNA, 25 bp, Mus musculus
tacatcctggagagcgatcaccact

SEQ ID NO: 461369 - DNA, 25 bp, Mus musculus
tacatcctgggttgtagaactctcc

SEQ ID NO: 461370 - DNA, 25 bp, Mus musculus
tacatcctgtctcccgttctatggc

SEQ ID NO: 461371 - DNA, 25 bp, Mus musculus
tacatccttggacttggcgacaggc

SEQ ID NO: 461372 - DNA, 25 bp, Mus musculus
tacatcgaagtctacccagggacct

SEQ ID NO: 461373 - DNA, 25 bp, Mus musculus
tacatcgacgacatcttgggtcgcg

SEQ ID NO: 461374 - DNA, 25 bp, Mus musculus
tacatcgacgtgagctactcgggct

SEQ ID NO: 461375 - DNA, 25 bp, Mus musculus
tacatcgagcacttcagcaagttct

SEQ ID NO: 461376 - DNA, 25 bp, Mus musculus
tacatcgattaacaagacagtcccc

SEQ ID NO: 461377 - DNA, 25 bp, Mus musculus
tacatcgctatgttgggaaggagcc

SEQ ID NO: 461378 - DNA, 25 bp, Mus musculus
tacatcgctgttgtagccggagcgc

SEQ ID NO: 461379 - DNA, 25 bp, Mus musculus
tacatcggccatgaagagggtggcc

SEQ ID NO: 461380 - DNA, 25 bp, Mus musculus
tacatcggcgagaataccacggtgg

SEQ ID NO: 461381 - DNA, 25 bp, Mus musculus
tacatcggctgaaaatgaactgggc

SEQ ID NO: 461382 - DNA, 25 bp, Mus musculus
tacatcgtgaaaggcaaccgaaagg

SEQ ID NO: 461383 - DNA, 25 bp, Mus musculus
tacatcgtggaaagtgctcagcaga

SEQ ID NO: 461384 - DNA, 25 bp, Mus musculus
tacatcgtggagattcaggtggccg

SEQ ID NO: 461385 - DNA, 25 bp, Mus musculus
tacatcgtggtgactgggtactggc

SEQ ID NO: 461386 - DNA, 25 bp, Mus musculus
tacatcgtgtccgtgaacgggcagc

SEQ ID NO: 461387 - DNA, 25 bp, Mus musculus
tacatcgttctcaatgtgggcctcg

SEQ ID NO: 461388 - DNA, 25 bp, Mus musculus
tacatctaacaagagcgagcagccc

SEQ ID NO: 461389 - DNA, 25 bp, Mus musculus
tacatctcagagtcggaagcctcct

SEQ ID NO: 461390 - DNA, 25 bp, Mus musculus
tacatctcggcgtttccagtcaact

SEQ ID NO: 461391 - DNA, 25 bp, Mus musculus
tacatctcggtcaaaaggttcccag

SEQ ID NO: 461392 - DNA, 25 bp, Mus musculus
tacatctctaggacggaggtgttag

SEQ ID NO: 461393 - DNA, 25 bp, Mus musculus
tacatctgaatctacagagagcagg

SEQ ID NO: 461394 - DNA, 25 bp, Mus musculus
tacatctgaggccaacttgtactga

SEQ ID NO: 461395 - DNA, 25 bp, Mus musculus
tacatctggagactttcggaaagcc

SEQ ID NO: 461396 - DNA, 25 bp, Mus musculus
tacatctgggcaatggccccgggaa

SEQ ID NO: 461397 - DNA, 25 bp, Mus musculus
tacatctgggcagtaggtctcctgg

SEQ ID NO: 461398 - DNA, 25 bp, Mus musculus
tacatctggtagatagccctcgacg

SEQ ID NO: 461399 - DNA, 25 bp, Mus musculus
tacatctgtgaggaagccctcggca

SEQ ID NO: 461400 - DNA, 25 bp, Mus musculus
tacatctgtgccagctcacggtgga

SEQ ID NO: 461401 - DNA, 25 bp, Mus musculus
tacatcttaaccaaccaccttaaag

SEQ ID NO: 461402 - DNA, 25 bp, Mus musculus
tacatcttcaacgtgaggcctgagg

SEQ ID NO: 461403 - DNA, 25 bp, Mus musculus
tacatcttcacctctggcactactg

SEQ ID NO: 461404 - DNA, 25 bp, Mus musculus
tacatcttcctagcaacggtgccag

SEQ ID NO: 461405 - DNA, 25 bp, Mus musculus
tacatcttctttgggagaggacccc

SEQ ID NO: 461406 - DNA, 25 bp, Mus musculus
tacatctttggcatgacccatcgga

SEQ ID NO: 461407 - DNA, 25 bp, Mus musculus
tacatgaaaggactacaagctggct

SEQ ID NO: 461408 - DNA, 25 bp, Mus musculus
tacatgaacaaactttcagcctcat

SEQ ID NO: 461409 - DNA, 25 bp, Mus musculus
tacatgaacacgagatgccctgctt

SEQ ID NO: 461410 - DNA, 25 bp, Mus musculus
tacatgaaccaggtggaggagactc

SEQ ID NO: 461411 - DNA, 25 bp, Mus musculus
tacatgaacccaagagttgtgagcc

SEQ ID NO: 461412 - DNA, 25 bp, Mus musculus
tacatgaagaccaatcagctaacag

SEQ ID NO: 461413 - DNA, 25 bp, Mus musculus
tacatgaagcccctggtcgaaagtc

SEQ ID NO: 461414 - DNA, 25 bp, Mus musculus
tacatgaaggctacactcacggtgc

SEQ ID NO: 461415 - DNA, 25 bp, Mus musculus
tacatgaagtccctggtgcagcaca

SEQ ID NO: 461416 - DNA, 25 bp, Mus musculus
tacatgaataaagtgccctgaagct

SEQ ID NO: 461417 - DNA, 25 bp, Mus musculus
tacatgaccagaagcgctacataag

SEQ ID NO: 461418 - DNA, 25 bp, Mus musculus
tacatgagaaggtagacagcctggc

SEQ ID NO: 461419 - DNA, 25 bp, Mus musculus
tacatgagcagaatatcacccggcc

SEQ ID NO: 461420 - DNA, 25 bp, Mus musculus
tacatgagcccatggtaaccacaaa

SEQ ID NO: 461421 - DNA, 25 bp, Mus musculus
tacatgagctggatcacacagggcg

SEQ ID NO: 461422 - DNA, 25 bp, Mus musculus
tacatgaggaataagacgtattatc

SEQ ID NO: 461423 - DNA, 25 bp, Mus musculus
tacatgaggtgatgcgctacagact

SEQ ID NO: 461424 - DNA, 25 bp, Mus musculus
tacatgagtctagttaaaagagggt

SEQ ID NO: 461425 - DNA, 25 bp, Mus musculus
tacatgatcggaggcagtgtccact

SEQ ID NO: 461426 - DNA, 25 bp, Mus musculus
tacatgatgaaccttgccagcctgt

SEQ ID NO: 461427 - DNA, 25 bp, Mus musculus
tacatgatgacgagcagagatcaca

SEQ ID NO: 461428 - DNA, 25 bp, Mus musculus
tacatgatgccgtgagactcaaccg

SEQ ID NO: 461429 - DNA, 25 bp, Mus musculus
tacatgattggaagacggaaaagtc

SEQ ID NO: 461430 - DNA, 25 bp, Mus musculus
tacatgcagcctgaagaggactggg

SEQ ID NO: 461431 - DNA, 25 bp, Mus musculus
tacatgcaggattactggaggacct

SEQ ID NO: 461432 - DNA, 25 bp, Mus musculus
tacatgcaggtacaaatacaagttt

SEQ ID NO: 461433 - DNA, 25 bp, Mus musculus
tacatgcagtgtacaaggactaaag

SEQ ID NO: 461434 - DNA, 25 bp, Mus musculus
tacatgccacctacaagattacgac

SEQ ID NO: 461435 - DNA, 25 bp, Mus musculus
tacatgccagctgggtaacagttga

SEQ ID NO: 461436 - DNA, 25 bp, Mus musculus
tacatgccatggttcccacatagga

SEQ ID NO: 461437 - DNA, 25 bp, Mus musculus
tacatgccccgtcatttaagcttgc

SEQ ID NO: 461438 - DNA, 25 bp, Mus musculus
tacatgcctggatctatgagcagag

SEQ ID NO: 461439 - DNA, 25 bp, Mus musculus
tacatgcgcctgatagtgaagttcc

SEQ ID NO: 461440 - DNA, 25 bp, Mus musculus
tacatgcgctgcgaccgtaagatgg

SEQ ID NO: 461441 - DNA, 25 bp, Mus musculus
tacatgcgtgatggagatggagctc

SEQ ID NO: 461442 - DNA, 25 bp, Mus musculus
tacatgctcattgcctgtgccatgc

SEQ ID NO: 461443 - DNA, 25 bp, Mus musculus
tacatgctgcaagagatcgacatcc

SEQ ID NO: 461444 - DNA, 25 bp, Mus musculus
tacatgctggtacgttatgaggacc

SEQ ID NO: 461445 - DNA, 25 bp, Mus musculus
tacatgctggtcttagtgctggctc

SEQ ID NO: 461446 - DNA, 25 bp, Mus musculus
tacatgcttgcactacgggagttct

SEQ ID NO: 461447 - DNA, 25 bp, Mus musculus
tacatggacaaagtccgggctctgg

SEQ ID NO: 461448 - DNA, 25 bp, Mus musculus
tacatggagagactttacaaatcag

SEQ ID NO: 461449 - DNA, 25 bp, Mus musculus
tacatggagccctatgatgcccgga

SEQ ID NO: 461450 - DNA, 25 bp, Mus musculus
tacatggatgagtctggaaaccccg

SEQ ID NO: 461451 - DNA, 25 bp, Mus musculus
tacatggatggtaccaaggacgcct

SEQ ID NO: 461452 - DNA, 25 bp, Mus musculus
tacatggcagaatcctgtaggcagc

SEQ ID NO: 461453 - DNA, 25 bp, Mus musculus
tacatggccacggacggctcgtata

SEQ ID NO: 461454 - DNA, 25 bp, Mus musculus
tacatggcccgcctagagatgagga

SEQ ID NO: 461455 - DNA, 25 bp, Mus musculus
tacatggccgtggtctatgcactgg

SEQ ID NO: 461456 - DNA, 25 bp, Mus musculus
tacatggcctatctgaagttcacca

SEQ ID NO: 461457 - DNA, 25 bp, Mus musculus
tacatggcgaagaagaaaccagttc

SEQ ID NO: 461458 - DNA, 25 bp, Mus musculus
tacatggcgatgttgcggtccggat

SEQ ID NO: 461459 - DNA, 25 bp, Mus musculus
tacatggcgctcaagaaggccctgt

SEQ ID NO: 461460 - DNA, 25 bp, Mus musculus
tacatggcggcggatggagacttca

SEQ ID NO: 461461 - DNA, 25 bp, Mus musculus
tacatggctcgtctaattcagaagc

SEQ ID NO: 461462 - DNA, 25 bp, Mus musculus
tacatggctggaagagacgaaggct

SEQ ID NO: 461463 - DNA, 25 bp, Mus musculus
tacatgggcacagactgagctgtcc

SEQ ID NO: 461464 - DNA, 25 bp, Mus musculus
tacatgggcgcaaaacaagagatcg

SEQ ID NO: 461465 - DNA, 25 bp, Mus musculus
tacatgggctatctggactaccgga

SEQ ID NO: 461466 - DNA, 25 bp, Mus musculus
tacatgggcttcgaggtggttagac

SEQ ID NO: 461467 - DNA, 25 bp, Mus musculus
tacatgggtatgaccaagaggagcc

SEQ ID NO: 461468 - DNA, 25 bp, Mus musculus
tacatgggtttatctctgagtcttg

SEQ ID NO: 461469 - DNA, 25 bp, Mus musculus
tacatggtagtgctcaaggaaaacg

SEQ ID NO: 461470 - DNA, 25 bp, Mus musculus
tacatggtccaccttaacgatctgg

SEQ ID NO: 461471 - DNA, 25 bp, Mus musculus
tacatggtctacgatccctcgagag

SEQ ID NO: 461472 - DNA, 25 bp, Mus musculus
tacatggtgaccaaggagctcctgg

SEQ ID NO: 461473 - DNA, 25 bp, Mus musculus
tacatggtgacccaagagtctgggc

SEQ ID NO: 461474 - DNA, 25 bp, Mus musculus
tacatggtggactggtcaggctacg

SEQ ID NO: 461475 - DNA, 25 bp, Mus musculus
tacatggttaccacagatgagcagc

SEQ ID NO: 461476 - DNA, 25 bp, Mus musculus
tacatgtagcactgccctggagggc

SEQ ID NO: 461477 - DNA, 25 bp, Mus musculus
tacatgtcaccttgccttgcaggct

SEQ ID NO: 461478 - DNA, 25 bp, Mus musculus
tacatgtccaatgccgtgcagaggg

SEQ ID NO: 461479 - DNA, 25 bp, Mus musculus
tacatgtccctggtcaacgtagggc

SEQ ID NO: 461480 - DNA, 25 bp, Mus musculus
tacatgtccctttgagtccagccag

SEQ ID NO: 461481 - DNA, 25 bp, Mus musculus
tacatgtcggcactgagagactgca

SEQ ID NO: 461482 - DNA, 25 bp, Mus musculus
tacatgtctgacaaaggaagccttc

SEQ ID NO: 461483 - DNA, 25 bp, Mus musculus
tacatgtcttcagccaagttttggg

SEQ ID NO: 461484 - DNA, 25 bp, Mus musculus
tacatgtgcatcctgggttctggga

SEQ ID NO: 461485 - DNA, 25 bp, Mus musculus
tacatgtgcccctgaaaagtttatt

SEQ ID NO: 461486 - DNA, 25 bp, Mus musculus
tacatgtgccctatctgtggagagc

SEQ ID NO: 461487 - DNA, 25 bp, Mus musculus
tacatgtgctcaggatataagcagc

SEQ ID NO: 461488 - DNA, 25 bp, Mus musculus
tacatgtgcttatatccgatccctg

SEQ ID NO: 461489 - DNA, 25 bp, Mus musculus
tacatgtggagccttagagcagccc

SEQ ID NO: 461490 - DNA, 25 bp, Mus musculus
tacatgtggcgactgactcacgacc

SEQ ID NO: 461491 - DNA, 25 bp, Mus musculus
tacatgtggctgagattgctggcaa

SEQ ID NO: 461492 - DNA, 25 bp, Mus musculus
tacatgtggctgtgcccttccaggg

SEQ ID NO: 461493 - DNA, 25 bp, Mus musculus
tacatgtgggactatgtgctgaccc

SEQ ID NO: 461494 - DNA, 25 bp, Mus musculus
tacatgtgtgaacactgcccagtgt

SEQ ID NO: 461495 - DNA, 25 bp, Mus musculus
tacatgtgtgaacctcaaacccagc

SEQ ID NO: 461496 - DNA, 25 bp, Mus musculus
tacatgtgtgggaccatcctgcagc

SEQ ID NO: 461497 - DNA, 25 bp, Mus musculus
tacatgttatatatagatcgcatca

SEQ ID NO: 461498 - DNA, 25 bp, Mus musculus
tacatgttggaaccgactcctggca

SEQ ID NO: 461499 - DNA, 25 bp, Mus musculus
tacattaaacccctcagctttaggc

SEQ ID NO: 461500 - DNA, 25 bp, Mus musculus
tacattaacttcctcagcgagctgg

SEQ ID NO: 461501 - DNA, 25 bp, Mus musculus
tacattaagactcggtccgccgtag

SEQ ID NO: 461502 - DNA, 25 bp, Mus musculus
tacattaaggagaacggctttggcc

SEQ ID NO: 461503 - DNA, 25 bp, Mus musculus
tacattacttagaatggccggcccc

SEQ ID NO: 461504 - DNA, 25 bp, Mus musculus
tacattagcagaccgtgaacatcct

SEQ ID NO: 461505 - DNA, 25 bp, Mus musculus
tacattagccacagcagaatccagc

SEQ ID NO: 461506 - DNA, 25 bp, Mus musculus
tacattagccccagaaggcagctgc

SEQ ID NO: 461507 - DNA, 25 bp, Mus musculus
tacattagcgtctacgaccaccaag

SEQ ID NO: 461508 - DNA, 25 bp, Mus musculus
tacattatgctttgccggacagtcg

SEQ ID NO: 461509 - DNA, 25 bp, Mus musculus
tacattattgaggtcaaggccacca

SEQ ID NO: 461510 - DNA, 25 bp, Mus musculus
tacattcaaaggatcagtaatcctc

SEQ ID NO: 461511 - DNA, 25 bp, Mus musculus
tacattcacgacaggtggaccgagc

SEQ ID NO: 461512 - DNA, 25 bp, Mus musculus
tacattccaaaagacaacagcctgc

SEQ ID NO: 461513 - DNA, 25 bp, Mus musculus
tacattccatggtgtcccacaaggg

SEQ ID NO: 461514 - DNA, 25 bp, Mus musculus
tacattccccggatttcgaggctgc

SEQ ID NO: 461515 - DNA, 25 bp, Mus musculus
tacattcctagacggcctcagtttt

SEQ ID NO: 461516 - DNA, 25 bp, Mus musculus
tacattcggaccaaagattgctggc

SEQ ID NO: 461517 - DNA, 25 bp, Mus musculus
tacattcggcagcagagtccgcatc

SEQ ID NO: 461518 - DNA, 25 bp, Mus musculus
tacattctctggaaggctcacagcc

SEQ ID NO: 461519 - DNA, 25 bp, Mus musculus
tacattctgaaagtaacatcccacc

SEQ ID NO: 461520 - DNA, 25 bp, Mus musculus
tacattctgaactgagcggctgctg

SEQ ID NO: 461521 - DNA, 25 bp, Mus musculus
tacattgaacggataatgacccagt

SEQ ID NO: 461522 - DNA, 25 bp, Mus musculus
tacattgaactaggaggtgagacca

SEQ ID NO: 461523 - DNA, 25 bp, Mus musculus
tacattgaagagcacatagaccggc

SEQ ID NO: 461524 - DNA, 25 bp, Mus musculus
tacattgaaggagcgcttccggtgc

SEQ ID NO: 461525 - DNA, 25 bp, Mus musculus
tacattgagcgactctgggcctacc

SEQ ID NO: 461526 - DNA, 25 bp, Mus musculus
tacattgagcgcaacgaaggctgcg

SEQ ID NO: 461527 - DNA, 25 bp, Mus musculus
tacattgagcgtctacaggacctgc

SEQ ID NO: 461528 - DNA, 25 bp, Mus musculus
tacattgagtttgtggccgacaggc

SEQ ID NO: 461529 - DNA, 25 bp, Mus musculus
tacattgcactgaaggactcttgcc

SEQ ID NO: 461530 - DNA, 25 bp, Mus musculus
tacattgccatggattgggaaccag

SEQ ID NO: 461531 - DNA, 25 bp, Mus musculus
tacattgccctagtaacagtaaacg

SEQ ID NO: 461532 - DNA, 25 bp, Mus musculus
tacattgcccttaacgtggacgact

SEQ ID NO: 461533 - DNA, 25 bp, Mus musculus
tacattgccgaggagatccagtggg

SEQ ID NO: 461534 - DNA, 25 bp, Mus musculus
tacattgccttcgacggcgtggtgg

SEQ ID NO: 461535 - DNA, 25 bp, Mus musculus
tacattgcgactgggcagaacctgc

SEQ ID NO: 461536 - DNA, 25 bp, Mus musculus
tacattgcgggcttcgttctccagg

SEQ ID NO: 461537 - DNA, 25 bp, Mus musculus
tacattggcctgatatcttctcaag

SEQ ID NO: 461538 - DNA, 25 bp, Mus musculus
tacattggctcaactgcgggagtgg

SEQ ID NO: 461539 - DNA, 25 bp, Mus musculus
tacattggtgcacaggtatacatgg

SEQ ID NO: 461540 - DNA, 25 bp, Mus musculus
tacattggtgtgagctacccgctgc

SEQ ID NO: 461541 - DNA, 25 bp, Mus musculus
tacattgtagttagaagttcaggca

SEQ ID NO: 461542 - DNA, 25 bp, Mus musculus
tacattgtatcttgctggaggtcag

SEQ ID NO: 461543 - DNA, 25 bp, Mus musculus
tacattgtcccctatgtcgtggaag

SEQ ID NO: 461544 - DNA, 25 bp, Mus musculus
tacattgtctatattgtggcacggg

SEQ ID NO: 461545 - DNA, 25 bp, Mus musculus
tacattgtgtactaccgtacccagc

SEQ ID NO: 461546 - DNA, 25 bp, Mus musculus
tacattgttctccacaaggcaagca

SEQ ID NO: 461547 - DNA, 25 bp, Mus musculus
tacatttactctgtccctggagacg

SEQ ID NO: 461548 - DNA, 25 bp, Mus musculus
tacatttagaatacctttgtcacac

SEQ ID NO: 461549 - DNA, 25 bp, Mus musculus
tacatttagagcttaagccctcggc

SEQ ID NO: 461550 - DNA, 25 bp, Mus musculus
tacatttcactctagacaggcatgg

SEQ ID NO: 461551 - DNA, 25 bp, Mus musculus
tacatttccaccagcagtgtctgag

SEQ ID NO: 461552 - DNA, 25 bp, Mus musculus
tacatttccagttattcagagaaga

SEQ ID NO: 461553 - DNA, 25 bp, Mus musculus
tacatttccctcagtaccagtcaga

SEQ ID NO: 461554 - DNA, 25 bp, Mus musculus
tacatttccggacaaccagggagtg

SEQ ID NO: 461555 - DNA, 25 bp, Mus musculus
tacatttctggaagagaatcttatc

SEQ ID NO: 461556 - DNA, 25 bp, Mus musculus
tacatttgcaacttgaggtcctgac

SEQ ID NO: 461557 - DNA, 25 bp, Mus musculus
tacatttggaggaccggtgttcccg

SEQ ID NO: 461558 - DNA, 25 bp, Mus musculus
tacatttgggcatggagtcttcaca

SEQ ID NO: 461559 - DNA, 25 bp, Mus musculus
tacatttgggtgttctttgaaggac

SEQ ID NO: 461560 - DNA, 25 bp, Mus musculus
tacatttgtggtggagacgctcatc

SEQ ID NO: 461561 - DNA, 25 bp, Mus musculus
tacatttgtgtccaagtcaggccag

SEQ ID NO: 461562 - DNA, 25 bp, Mus musculus
tacattttaaagactgctagggaag

SEQ ID NO: 461563 - DNA, 25 bp, Mus musculus
tacattttggaaagagttgtcttcc

SEQ ID NO: 461564 - DNA, 25 bp, Mus musculus
taccaaaaatagtcggtgtcacggt

SEQ ID NO: 461565 - DNA, 25 bp, Mus musculus
taccaaaagcttcctacagtgagag

SEQ ID NO: 461566 - DNA, 25 bp, Mus musculus
taccaaaaggtagcccaggagatca

SEQ ID NO: 461567 - DNA, 25 bp, Mus musculus
taccaaaatatgataggaaaatgcc

SEQ ID NO: 461568 - DNA, 25 bp, Mus musculus
taccaaaatggatctccggcgcctt

SEQ ID NO: 461569 - DNA, 25 bp, Mus musculus
taccaaaccgtcagtgagcctgctg

SEQ ID NO: 461570 - DNA, 25 bp, Mus musculus
taccaaacggactagagagtctccc

SEQ ID NO: 461571 - DNA, 25 bp, Mus musculus
taccaaacttgctggatgcgcctct

SEQ ID NO: 461572 - DNA, 25 bp, Mus musculus
taccaaagagctggctgggctacag

SEQ ID NO: 461573 - DNA, 25 bp, Mus musculus
taccaaagattagcaaagagccctg

SEQ ID NO: 461574 - DNA, 25 bp, Mus musculus
taccaaaggcgcaagacacaaaatt

SEQ ID NO: 461575 - DNA, 25 bp, Mus musculus
taccaaagggactactgcagaccag

SEQ ID NO: 461576 - DNA, 25 bp, Mus musculus
taccaaagggctgttcacactggag

SEQ ID NO: 461577 - DNA, 25 bp, Mus musculus
taccaaagtgacgtcaggctcagct

SEQ ID NO: 461578 - DNA, 25 bp, Mus musculus
taccaaatagctgtgaacctaaccg

SEQ ID NO: 461579 - DNA, 25 bp, Mus musculus
taccaaatggcaacaaccctacagg

SEQ ID NO: 461580 - DNA, 25 bp, Mus musculus
taccaaatgggtttcaccgtcctct

SEQ ID NO: 461581 - DNA, 25 bp, Mus musculus
taccaaatggtaagagaagcgaggc

SEQ ID NO: 461582 - DNA, 25 bp, Mus musculus
taccaaattgttagtgaggatgaag

SEQ ID NO: 461583 - DNA, 25 bp, Mus musculus
taccaacagagagaagtacgccgag

SEQ ID NO: 461584 - DNA, 25 bp, Mus musculus
taccaacagtaagaagtgtttcagg

SEQ ID NO: 461585 - DNA, 25 bp, Mus musculus
taccaacagtctggacattgagtgg

SEQ ID NO: 461586 - DNA, 25 bp, Mus musculus
taccaacagttcatagaccgagcca

SEQ ID NO: 461587 - DNA, 25 bp, Mus musculus
taccaaccactgcagagggctgggt

SEQ ID NO: 461588 - DNA, 25 bp, Mus musculus
taccaaccagacctgtatcctgtgg

SEQ ID NO: 461589 - DNA, 25 bp, Mus musculus
taccaaccagctgaagagagtgccc

SEQ ID NO: 461590 - DNA, 25 bp, Mus musculus
taccaaccatacaggtagagttagg

SEQ ID NO: 461591 - DNA, 25 bp, Mus musculus
taccaacgcttgacagagatcacag

SEQ ID NO: 461592 - DNA, 25 bp, Mus musculus
taccaacgggaagtaacactggctt

SEQ ID NO: 461593 - DNA, 25 bp, Mus musculus
taccaacgtaggctttgacccaaag

SEQ ID NO: 461594 - DNA, 25 bp, Mus musculus
taccaacgtgagtgctagcggagtc

SEQ ID NO: 461595 - DNA, 25 bp, Mus musculus
taccaactgaactgaatctccccgg

SEQ ID NO: 461596 - DNA, 25 bp, Mus musculus
taccaactgcaaagcagtcattttt

SEQ ID NO: 461597 - DNA, 25 bp, Mus musculus
taccaactgcgtacaagacgagacg

SEQ ID NO: 461598 - DNA, 25 bp, Mus musculus
taccaactggttctgaggacctgcc

SEQ ID NO: 461599 - DNA, 25 bp, Mus musculus
taccaacttcgagcactaggcaggt

SEQ ID NO: 461600 - DNA, 25 bp, Mus musculus
taccaagaaatggaccacagccgtg

SEQ ID NO: 461601 - DNA, 25 bp, Mus musculus
taccaagaagtacaggtgcgccgtg

SEQ ID NO: 461602 - DNA, 25 bp, Mus musculus
taccaagaatttcgaggtggacctg

SEQ ID NO: 461603 - DNA, 25 bp, Mus musculus
taccaagacatcaagccgtgtgtga

SEQ ID NO: 461604 - DNA, 25 bp, Mus musculus
taccaagacatctggattgggctcc

SEQ ID NO: 461605 - DNA, 25 bp, Mus musculus
taccaagagagtggtcaacattgcc

SEQ ID NO: 461606 - DNA, 25 bp, Mus musculus
taccaagcgcgtgacaaggaggatt

SEQ ID NO: 461607 - DNA, 25 bp, Mus musculus
taccaagcttcatacaatgtttgtg

SEQ ID NO: 461608 - DNA, 25 bp, Mus musculus
taccaagcttcgtgggaagaaatcc

SEQ ID NO: 461609 - DNA, 25 bp, Mus musculus
taccaaggaggagaactcagctttc

SEQ ID NO: 461610 - DNA, 25 bp, Mus musculus
taccaaggaggtcgagtcatctgtc

SEQ ID NO: 461611 - DNA, 25 bp, Mus musculus
taccaagggtatcggtgaagcccct

SEQ ID NO: 461612 - DNA, 25 bp, Mus musculus
taccaaggtgtgtattccagacccg

SEQ ID NO: 461613 - DNA, 25 bp, Mus musculus
taccaagtcttgcaggagcatcagc

SEQ ID NO: 461614 - DNA, 25 bp, Mus musculus
taccaagtggaaagtgaaatagttc

SEQ ID NO: 461615 - DNA, 25 bp, Mus musculus
taccaagtgtcccttgagaatgcag

SEQ ID NO: 461616 - DNA, 25 bp, Mus musculus
taccaagtgtttcatgcctgcaggg

SEQ ID NO: 461617 - DNA, 25 bp, Mus musculus
taccaagttcattcacaccaaggcc

SEQ ID NO: 461618 - DNA, 25 bp, Mus musculus
taccaagttccgtgtcagaccaaaa

SEQ ID NO: 461619 - DNA, 25 bp, Mus musculus
taccaagttggcctctcagatgcgc

SEQ ID NO: 461620 - DNA, 25 bp, Mus musculus
taccaataatggtcaccgtctgcag

SEQ ID NO: 461621 - DNA, 25 bp, Mus musculus
taccaatatccatacgttgaggcga

SEQ ID NO: 461622 - DNA, 25 bp, Mus musculus
taccaatatgcaattctcggaagcg

SEQ ID NO: 461623 - DNA, 25 bp, Mus musculus
taccaatatgcagttggctagcggc

SEQ ID NO: 461624 - DNA, 25 bp, Mus musculus
taccaatgagaagggctaggacaag

SEQ ID NO: 461625 - DNA, 25 bp, Mus musculus
taccaattggagaaagacttaacag

SEQ ID NO: 461626 - DNA, 25 bp, Mus musculus
taccaatttattatggaccagccca

SEQ ID NO: 461627 - DNA, 25 bp, Mus musculus
taccacaacgtggaagggttcaccg

SEQ ID NO: 461628 - DNA, 25 bp, Mus musculus
taccacaagggtccttgggccaaag

SEQ ID NO: 461629 - DNA, 25 bp, Mus musculus
taccacaatggcctaaagacagagg

SEQ ID NO: 461630 - DNA, 25 bp, Mus musculus
taccacaggaaggagttagggaatt

SEQ ID NO: 461631 - DNA, 25 bp, Mus musculus
taccacagggagtcaggctcagtgc

SEQ ID NO: 461632 - DNA, 25 bp, Mus musculus
taccacagggtcagacagggtctgt

SEQ ID NO: 461633 - DNA, 25 bp, Mus musculus
taccacaggtcatgctgaggcagct

SEQ ID NO: 461634 - DNA, 25 bp, Mus musculus
taccacagtcccatgggtaacggtg

SEQ ID NO: 461635 - DNA, 25 bp, Mus musculus
taccacagtctaggacagagaaagc

SEQ ID NO: 461636 - DNA, 25 bp, Mus musculus
taccacagtggtcctgggaagtact

SEQ ID NO: 461637 - DNA, 25 bp, Mus musculus
taccacatagctgaaaggagtccgg

SEQ ID NO: 461638 - DNA, 25 bp, Mus musculus
taccacatagggagaagccagttcc

SEQ ID NO: 461639 - DNA, 25 bp, Mus musculus
taccacatgagaaggaaaaatgaag

SEQ ID NO: 461640 - DNA, 25 bp, Mus musculus
taccacattcactggacattcttgg

SEQ ID NO: 461641 - DNA, 25 bp, Mus musculus
taccaccaagagctagtgggtgtgc

SEQ ID NO: 461642 - DNA, 25 bp, Mus musculus
taccaccatacctgctgctgtgcat

SEQ ID NO: 461643 - DNA, 25 bp, Mus musculus
taccaccattctgggaacagcgcaa

SEQ ID NO: 461644 - DNA, 25 bp, Mus musculus
taccaccctaaagcctctgggaaag

SEQ ID NO: 461645 - DNA, 25 bp, Mus musculus
taccaccgccagttgtttgaggagc

SEQ ID NO: 461646 - DNA, 25 bp, Mus musculus
taccaccgtggagatgtcgcttcgt

SEQ ID NO: 461647 - DNA, 25 bp, Mus musculus
taccacctcagatctactgctcggg

SEQ ID NO: 461648 - DNA, 25 bp, Mus musculus
taccacctggaatggttcatcaggg

SEQ ID NO: 461649 - DNA, 25 bp, Mus musculus
taccacctggagcttcatgtctgga

SEQ ID NO: 461650 - DNA, 25 bp, Mus musculus
taccacctggcgtcatgcaggaaga

SEQ ID NO: 461651 - DNA, 25 bp, Mus musculus
taccacgaaggaagcctagactagc

SEQ ID NO: 461652 - DNA, 25 bp, Mus musculus
taccacgactgtacccacaaggaag

SEQ ID NO: 461653 - DNA, 25 bp, Mus musculus
taccacgagtgtaccgcatgtcgcg

SEQ ID NO: 461654 - DNA, 25 bp, Mus musculus
taccacggaagctgaaacgggtcct

SEQ ID NO: 461655 - DNA, 25 bp, Mus musculus
taccacggcaaaatcagcagggaga

SEQ ID NO: 461656 - DNA, 25 bp, Mus musculus
taccacgtagtgaattgccctggac

SEQ ID NO: 461657 - DNA, 25 bp, Mus musculus
taccacgtgcatgtgaaagggactc

SEQ ID NO: 461658 - DNA, 25 bp, Mus musculus
taccacgtgttggatgagacaagcc

SEQ ID NO: 461659 - DNA, 25 bp, Mus musculus
taccactaccaataaagaggctgac

SEQ ID NO: 461660 - DNA, 25 bp, Mus musculus
taccactcagaggagaactgtcggc

SEQ ID NO: 461661 - DNA, 25 bp, Mus musculus
taccactgacaggaaggtcgagcct

SEQ ID NO: 461662 - DNA, 25 bp, Mus musculus
taccactgagtgagagtcccagcat

SEQ ID NO: 461663 - DNA, 25 bp, Mus musculus
taccactgctactgctttgaattat

SEQ ID NO: 461664 - DNA, 25 bp, Mus musculus
taccacttctacaggatgagccagg

SEQ ID NO: 461665 - DNA, 25 bp, Mus musculus
taccacttggagatgctgagcctgt

SEQ ID NO: 461666 - DNA, 25 bp, Mus musculus
taccacttggtgtgcgggctactgc

SEQ ID NO: 461667 - DNA, 25 bp, Mus musculus
taccactttcagctgggcttagggc

SEQ ID NO: 461668 - DNA, 25 bp, Mus musculus
taccagaagcctatggagacggacc

SEQ ID NO: 461669 - DNA, 25 bp, Mus musculus
taccagaatagcgagaagtctgctg

SEQ ID NO: 461670 - DNA, 25 bp, Mus musculus
taccagaatgctggttgggcaagcc

SEQ ID NO: 461671 - DNA, 25 bp, Mus musculus
taccagaatggagacggcttcggct

SEQ ID NO: 461672 - DNA, 25 bp, Mus musculus
taccagacactatataggcccggcg

SEQ ID NO: 461673 - DNA, 25 bp, Mus musculus
taccagacctggatcaaaagcaagc

SEQ ID NO: 461674 - DNA, 25 bp, Mus musculus
taccagacctgtgtagattagccca

SEQ ID NO: 461675 - DNA, 25 bp, Mus musculus
taccagagagggtatctgactcact

SEQ ID NO: 461676 - DNA, 25 bp, Mus musculus
taccagagattgagtaagtgccagg

SEQ ID NO: 461677 - DNA, 25 bp, Mus musculus
taccagagcctgaagcggttagctg

SEQ ID NO: 461678 - DNA, 25 bp, Mus musculus
taccagaggaatactgtgaagaatg

SEQ ID NO: 461679 - DNA, 25 bp, Mus musculus
taccagaggagaaccttgcatgttc

SEQ ID NO: 461680 - DNA, 25 bp, Mus musculus
taccagaggaggaggtttgcatcac

SEQ ID NO: 461681 - DNA, 25 bp, Mus musculus
taccagagtatatgagcctccagac

SEQ ID NO: 461682 - DNA, 25 bp, Mus musculus
taccagatagagaagtgcagagcca

SEQ ID NO: 461683 - DNA, 25 bp, Mus musculus
taccagatcccaggttcaacatggg

SEQ ID NO: 461684 - DNA, 25 bp, Mus musculus
taccagatccgcgaactggaacgcg

SEQ ID NO: 461685 - DNA, 25 bp, Mus musculus
taccagatgaacctcacgttagcag

SEQ ID NO: 461686 - DNA, 25 bp, Mus musculus
taccagatttcaaggtgcctgtgcg

SEQ ID NO: 461687 - DNA, 25 bp, Mus musculus
taccagcacagctagaagaggcaag

SEQ ID NO: 461688 - DNA, 25 bp, Mus musculus
taccagcagtggctcatcagggact

SEQ ID NO: 461689 - DNA, 25 bp, Mus musculus
taccagcatgacaatgtacacaggg

SEQ ID NO: 461690 - DNA, 25 bp, Mus musculus
taccagcccctgacatgaaagaaac

SEQ ID NO: 461691 - DNA, 25 bp, Mus musculus
taccagccggagatgtggcctcaat

SEQ ID NO: 461692 - DNA, 25 bp, Mus musculus
taccagcctgcagtaacaccttggg

SEQ ID NO: 461693 - DNA, 25 bp, Mus musculus
taccagcgaatgagatacgagtacg

SEQ ID NO: 461694 - DNA, 25 bp, Mus musculus
taccagcggtcatgacaagtcactc

SEQ ID NO: 461695 - DNA, 25 bp, Mus musculus
taccagcggttcagggacaatactt

SEQ ID NO: 461696 - DNA, 25 bp, Mus musculus
taccagcgtcatgcatctagatgga

SEQ ID NO: 461697 - DNA, 25 bp, Mus musculus
taccagctaaagagcaggcagatcc

SEQ ID NO: 461698 - DNA, 25 bp, Mus musculus
taccagctcacaatgacaggccctg

SEQ ID NO: 461699 - DNA, 25 bp, Mus musculus
taccagctgcagttcattaccacga

SEQ ID NO: 461700 - DNA, 25 bp, Mus musculus
taccagctgggaagaaacaaaaaat

SEQ ID NO: 461701 - DNA, 25 bp, Mus musculus
taccagctggttcctcaaagtttac

SEQ ID NO: 461702 - DNA, 25 bp, Mus musculus
taccagcttgggtaccagtgcacag

SEQ ID NO: 461703 - DNA, 25 bp, Mus musculus
taccagcttgtgtagcagcagcgtc

SEQ ID NO: 461704 - DNA, 25 bp, Mus musculus
taccaggaaagattcgggacagcaa

SEQ ID NO: 461705 - DNA, 25 bp, Mus musculus
taccaggaacacaagactgcagctc

SEQ ID NO: 461706 - DNA, 25 bp, Mus musculus
taccaggaatacgagccagaggcgt

SEQ ID NO: 461707 - DNA, 25 bp, Mus musculus
taccaggacgagctaacagcattgc

SEQ ID NO: 461708 - DNA, 25 bp, Mus musculus
taccaggacgccacggtcaatgatg

SEQ ID NO: 461709 - DNA, 25 bp, Mus musculus
taccaggagacattaggacctcggg

SEQ ID NO: 461710 - DNA, 25 bp, Mus musculus
taccaggattcatggagcgggatca

SEQ ID NO: 461711 - DNA, 25 bp, Mus musculus
taccaggcaggtggacttggtcccc

SEQ ID NO: 461712 - DNA, 25 bp, Mus musculus
taccaggcagtgtgccgagctctct

SEQ ID NO: 461713 - DNA, 25 bp, Mus musculus
taccaggcagttcgtgcagagacca

SEQ ID NO: 461714 - DNA, 25 bp, Mus musculus
taccaggccatgatgtaccagcaga

SEQ ID NO: 461715 - DNA, 25 bp, Mus musculus
taccaggccctgctgaaaataccac

SEQ ID NO: 461716 - DNA, 25 bp, Mus musculus
taccaggcctcggtctaaaagagga

SEQ ID NO: 461717 - DNA, 25 bp, Mus musculus
taccaggctagcatggatgagcagg

SEQ ID NO: 461718 - DNA, 25 bp, Mus musculus
taccagggaccggacttgcaatgtc

SEQ ID NO: 461719 - DNA, 25 bp, Mus musculus
taccagggactgtctcgaagggcac

SEQ ID NO: 461720 - DNA, 25 bp, Mus musculus
taccagggagttgacctcagacagc

SEQ ID NO: 461721 - DNA, 25 bp, Mus musculus
taccagggcgtcatcgcttggcagg

SEQ ID NO: 461722 - DNA, 25 bp, Mus musculus
taccaggtaaggaggcagcatccac

SEQ ID NO: 461723 - DNA, 25 bp, Mus musculus
taccaggtcctaagtcaacagcaga

SEQ ID NO: 461724 - DNA, 25 bp, Mus musculus
taccaggtcctcatcgacagcatgg

SEQ ID NO: 461725 - DNA, 25 bp, Mus musculus
taccaggtcctccagtaaggacaaa

SEQ ID NO: 461726 - DNA, 25 bp, Mus musculus
taccaggtgctcaacaagtggactc

SEQ ID NO: 461727 - DNA, 25 bp, Mus musculus
taccaggtggaagtcatagtgcggc

SEQ ID NO: 461728 - DNA, 25 bp, Mus musculus
taccaggtggcccttcgtgactttg

SEQ ID NO: 461729 - DNA, 25 bp, Mus musculus
taccaggtgtttgattcggccccaa

SEQ ID NO: 461730 - DNA, 25 bp, Mus musculus
taccaggttagcgacatcatcatca

SEQ ID NO: 461731 - DNA, 25 bp, Mus musculus
taccaggttgtagcatgcatctctt

SEQ ID NO: 461732 - DNA, 25 bp, Mus musculus
taccagtaatgaaacgaaagtagta

SEQ ID NO: 461733 - DNA, 25 bp, Mus musculus
taccagtactccaacttcaccaggg

SEQ ID NO: 461734 - DNA, 25 bp, Mus musculus
taccagtagacgagtaccagagtcc

SEQ ID NO: 461735 - DNA, 25 bp, Mus musculus
taccagtatgacacagaggagagcc

SEQ ID NO: 461736 - DNA, 25 bp, Mus musculus
taccagtcaccggattgaggcagga

SEQ ID NO: 461737 - DNA, 25 bp, Mus musculus
taccagtcccctttcggaagaagag

SEQ ID NO: 461738 - DNA, 25 bp, Mus musculus
taccagtcggaagaagaatgccaag

SEQ ID NO: 461739 - DNA, 25 bp, Mus musculus
taccagtgaccgtttctaatgttag

SEQ ID NO: 461740 - DNA, 25 bp, Mus musculus
taccagtgccacctctttcaaaaga

SEQ ID NO: 461741 - DNA, 25 bp, Mus musculus
taccagtgcccagctaaggaagaga

SEQ ID NO: 461742 - DNA, 25 bp, Mus musculus
taccagtggatgcttctgttgcagc

SEQ ID NO: 461743 - DNA, 25 bp, Mus musculus
taccagtggctcaaagaaaaagttc

SEQ ID NO: 461744 - DNA, 25 bp, Mus musculus
taccagtgtcatgagtgcggcaaga

SEQ ID NO: 461745 - DNA, 25 bp, Mus musculus
taccagttagaattaaggcacagga

SEQ ID NO: 461746 - DNA, 25 bp, Mus musculus
taccagttatggagagaccacgggt

SEQ ID NO: 461747 - DNA, 25 bp, Mus musculus
taccagttgcgaaaccttaagtgcc

SEQ ID NO: 461748 - DNA, 25 bp, Mus musculus
taccagttggccaacggcagcatct

SEQ ID NO: 461749 - DNA, 25 bp, Mus musculus
taccagttgtccttcaagtggagct

SEQ ID NO: 461750 - DNA, 25 bp, Mus musculus
taccagtttcaaagtaactcgcttg

SEQ ID NO: 461751 - DNA, 25 bp, Mus musculus
taccataaacaaccagctgagaggg

SEQ ID NO: 461752 - DNA, 25 bp, Mus musculus
taccataaatatgaccggcggtggc

SEQ ID NO: 461753 - DNA, 25 bp, Mus musculus
taccataactccttagagcaaagag

SEQ ID NO: 461754 - DNA, 25 bp, Mus musculus
taccatacaactaggaaactgccgg

SEQ ID NO: 461755 - DNA, 25 bp, Mus musculus
taccatactttcttagtgactgaga

SEQ ID NO: 461756 - DNA, 25 bp, Mus musculus
taccatagaagacctgggaagtgtg

SEQ ID NO: 461757 - DNA, 25 bp, Mus musculus
taccatagacccagccaagagggag

SEQ ID NO: 461758 - DNA, 25 bp, Mus musculus
taccatagcaatcgtggaggctgca

SEQ ID NO: 461759 - DNA, 25 bp, Mus musculus
taccatagccctattggaggagcag

SEQ ID NO: 461760 - DNA, 25 bp, Mus musculus
taccataggcgtggccaagaacagc

SEQ ID NO: 461761 - DNA, 25 bp, Mus musculus
taccatagggaagatagcctttagc

SEQ ID NO: 461762 - DNA, 25 bp, Mus musculus
taccatagggatagtcgagggcacg

SEQ ID NO: 461763 - DNA, 25 bp, Mus musculus
taccatagggtgacacagagttcca

SEQ ID NO: 461764 - DNA, 25 bp, Mus musculus
taccataggtactgtagcacctggg

SEQ ID NO: 461765 - DNA, 25 bp, Mus musculus
taccatataagaagacatatacatc

SEQ ID NO: 461766 - DNA, 25 bp, Mus musculus
taccatcaggccatacaacatcagt

SEQ ID NO: 461767 - DNA, 25 bp, Mus musculus
taccatcatagataggaccgtgtgg

SEQ ID NO: 461768 - DNA, 25 bp, Mus musculus
taccatcatgtgttacgggcagaca

SEQ ID NO: 461769 - DNA, 25 bp, Mus musculus
taccatccgctctttggcaaccaag

SEQ ID NO: 461770 - DNA, 25 bp, Mus musculus
taccatcgaggttacagaagcttga

SEQ ID NO: 461771 - DNA, 25 bp, Mus musculus
taccatcgatgggaaagagctactg

SEQ ID NO: 461772 - DNA, 25 bp, Mus musculus
taccatctgctgaggtggcaaagct

SEQ ID NO: 461773 - DNA, 25 bp, Mus musculus
taccatctgctgtcgtgaggacctg

SEQ ID NO: 461774 - DNA, 25 bp, Mus musculus
taccatctggatcctcagtgctggg

SEQ ID NO: 461775 - DNA, 25 bp, Mus musculus
taccatctggtgaagaggagcgcaa

SEQ ID NO: 461776 - DNA, 25 bp, Mus musculus
taccatgacatgtgagccccttagg

SEQ ID NO: 461777 - DNA, 25 bp, Mus musculus
taccatgattgatccagttcaacca

SEQ ID NO: 461778 - DNA, 25 bp, Mus musculus
taccatgcaagaggctcgaagcagc

SEQ ID NO: 461779 - DNA, 25 bp, Mus musculus
taccatgccctaccagggtgggaag

SEQ ID NO: 461780 - DNA, 25 bp, Mus musculus
taccatgcgatggatggagccaacc

SEQ ID NO: 461781 - DNA, 25 bp, Mus musculus
taccatgctaatcttgaactcagct

SEQ ID NO: 461782 - DNA, 25 bp, Mus musculus
taccatgctccggaaggagggaccc

SEQ ID NO: 461783 - DNA, 25 bp, Mus musculus
taccatggagtcaccagaggagcct

SEQ ID NO: 461784 - DNA, 25 bp, Mus musculus
taccatggatgcttctggaccaaag

SEQ ID NO: 461785 - DNA, 25 bp, Mus musculus
taccatggattctcctgttgagcct

SEQ ID NO: 461786 - DNA, 25 bp, Mus musculus
taccatggcatgacactgaaatctg

SEQ ID NO: 461787 - DNA, 25 bp, Mus musculus
taccatgggactgtgaaacttcgag

SEQ ID NO: 461788 - DNA, 25 bp, Mus musculus
taccatgggtaccactgctgcagag

SEQ ID NO: 461789 - DNA, 25 bp, Mus musculus
taccatggtttaaggtaagctcacc

SEQ ID NO: 461790 - DNA, 25 bp, Mus musculus
taccatgtcatgctaggctacaccg

SEQ ID NO: 461791 - DNA, 25 bp, Mus musculus
taccatgtgagactgtggaccccac

SEQ ID NO: 461792 - DNA, 25 bp, Mus musculus
taccatgtgtcatctagtccgaggg

SEQ ID NO: 461793 - DNA, 25 bp, Mus musculus
taccatgttctctaggagtccccag

SEQ ID NO: 461794 - DNA, 25 bp, Mus musculus
taccattaccgcagagtggagaccc

SEQ ID NO: 461795 - DNA, 25 bp, Mus musculus
taccattagaaataataggacgtcc

SEQ ID NO: 461796 - DNA, 25 bp, Mus musculus
taccattatataccaaccagtacag

SEQ ID NO: 461797 - DNA, 25 bp, Mus musculus
taccattcacgaagtactgtagaga

SEQ ID NO: 461798 - DNA, 25 bp, Mus musculus
taccattgagatagagggtctgcgc

SEQ ID NO: 461799 - DNA, 25 bp, Mus musculus
taccattgatgtgcccgctgtcgac

SEQ ID NO: 461800 - DNA, 25 bp, Mus musculus
taccattggcaggactcgctggaga

SEQ ID NO: 461801 - DNA, 25 bp, Mus musculus
taccattgggcagaatcggatcctg

SEQ ID NO: 461802 - DNA, 25 bp, Mus musculus
taccattgtgcatgaagggcgcttg

SEQ ID NO: 461803 - DNA, 25 bp, Mus musculus
taccatttgctttttatgacacggc

SEQ ID NO: 461804 - DNA, 25 bp, Mus musculus
tacccaaaacagaagagggccttgg

SEQ ID NO: 461805 - DNA, 25 bp, Mus musculus
tacccaaagacaataaaggcaaagt

SEQ ID NO: 461806 - DNA, 25 bp, Mus musculus
tacccaaagtacctggaagtctctg

SEQ ID NO: 461807 - DNA, 25 bp, Mus musculus
tacccaaagtcatataccttgtaga

SEQ ID NO: 461808 - DNA, 25 bp, Mus musculus
tacccaagcggtcaggaaagttcca

SEQ ID NO: 461809 - DNA, 25 bp, Mus musculus
tacccaaggacgtgaatgtcgccat

SEQ ID NO: 461810 - DNA, 25 bp, Mus musculus
tacccaagttttggacagcctccat

SEQ ID NO: 461811 - DNA, 25 bp, Mus musculus
tacccaatcatctgggcagcgggca

SEQ ID NO: 461812 - DNA, 25 bp, Mus musculus
tacccaatgcgtgtaaaataagtgc

SEQ ID NO: 461813 - DNA, 25 bp, Mus musculus
tacccacagatctccccactgaaga

SEQ ID NO: 461814 - DNA, 25 bp, Mus musculus
tacccacaggacgagaatgatcgca

SEQ ID NO: 461815 - DNA, 25 bp, Mus musculus
tacccacaggtagtagccataggca

SEQ ID NO: 461816 - DNA, 25 bp, Mus musculus
tacccacctaggaggaggatcaggc

SEQ ID NO: 461817 - DNA, 25 bp, Mus musculus
tacccacgacgtggaaattagagtc

SEQ ID NO: 461818 - DNA, 25 bp, Mus musculus
tacccacgcctggtgatgaccttgg

SEQ ID NO: 461819 - DNA, 25 bp, Mus musculus
tacccacgctggaatgagacatttg

SEQ ID NO: 461820 - DNA, 25 bp, Mus musculus
tacccacggaggcttttatgaggac

SEQ ID NO: 461821 - DNA, 25 bp, Mus musculus
tacccacgggatgaagaacctttca

SEQ ID NO: 461822 - DNA, 25 bp, Mus musculus
tacccacgtgggagaatgagaacaa

SEQ ID NO: 461823 - DNA, 25 bp, Mus musculus
tacccactcggtgtgaggtctactg

SEQ ID NO: 461824 - DNA, 25 bp, Mus musculus
tacccactggagagcaatccttgcc

SEQ ID NO: 461825 - DNA, 25 bp, Mus musculus
tacccacttgcgctgtaaaggaagg

SEQ ID NO: 461826 - DNA, 25 bp, Mus musculus
tacccagaaccatgtgtgcggagcg

SEQ ID NO: 461827 - DNA, 25 bp, Mus musculus
tacccagagacaacacaagtgtgac

SEQ ID NO: 461828 - DNA, 25 bp, Mus musculus
tacccagagatcaccgagatggacc

SEQ ID NO: 461829 - DNA, 25 bp, Mus musculus
tacccagagtctgacctagggagag

SEQ ID NO: 461830 - DNA, 25 bp, Mus musculus
tacccagcaagtatcacacccttga

SEQ ID NO: 461831 - DNA, 25 bp, Mus musculus
tacccagcctggacattatggacag

SEQ ID NO: 461832 - DNA, 25 bp, Mus musculus
tacccagcggtgagtatgtgacatg

SEQ ID NO: 461833 - DNA, 25 bp, Mus musculus
tacccagctgcaggtgttgactgag

SEQ ID NO: 461834 - DNA, 25 bp, Mus musculus
tacccaggaaagagctagtgtcaac

SEQ ID NO: 461835 - DNA, 25 bp, Mus musculus
tacccaggaacgatcaggagaaggg

SEQ ID NO: 461836 - DNA, 25 bp, Mus musculus
tacccaggccagattaccagcaata

SEQ ID NO: 461837 - DNA, 25 bp, Mus musculus
tacccaggtttgttaacgcgcccag

SEQ ID NO: 461838 - DNA, 25 bp, Mus musculus
tacccagtggagtacatgtgtccgt

SEQ ID NO: 461839 - DNA, 25 bp, Mus musculus
tacccagtggatggctagtcctaat

SEQ ID NO: 461840 - DNA, 25 bp, Mus musculus
tacccagtgtatgtggcttctacag

SEQ ID NO: 461841 - DNA, 25 bp, Mus musculus
tacccagttggtgaagatagccttg

SEQ ID NO: 461842 - DNA, 25 bp, Mus musculus
tacccatcgtgtggaaaagcacagg

SEQ ID NO: 461843 - DNA, 25 bp, Mus musculus
tacccatctgctccaatgccgggaa

SEQ ID NO: 461844 - DNA, 25 bp, Mus musculus
tacccatctttgaggtgcagcgacc

SEQ ID NO: 461845 - DNA, 25 bp, Mus musculus
tacccatgactgagggcagctggga

SEQ ID NO: 461846 - DNA, 25 bp, Mus musculus
tacccatggccaccttcgaggaggt

SEQ ID NO: 461847 - DNA, 25 bp, Mus musculus
tacccatgtatgcatacgcgtgttg

SEQ ID NO: 461848 - DNA, 25 bp, Mus musculus
tacccattgaccagatgaagaccag

SEQ ID NO: 461849 - DNA, 25 bp, Mus musculus
tacccattgggctgaacatctgtgc

SEQ ID NO: 461850 - DNA, 25 bp, Mus musculus
tacccattggtggacctgattgaca

SEQ ID NO: 461851 - DNA, 25 bp, Mus musculus
tacccattttggagagcactgacat

SEQ ID NO: 461852 - DNA, 25 bp, Mus musculus
taccccaagcaatgaaagtggctcc

SEQ ID NO: 461853 - DNA, 25 bp, Mus musculus
taccccaagtgaagactcccatgtg

SEQ ID NO: 461854 - DNA, 25 bp, Mus musculus
taccccaatgctaaggtggaacttg

SEQ ID NO: 461855 - DNA, 25 bp, Mus musculus
taccccacaaaatctggtctgtgag

SEQ ID NO: 461856 - DNA, 25 bp, Mus musculus
taccccagaattcgaagggcgagga

SEQ ID NO: 461857 - DNA, 25 bp, Mus musculus
taccccagagtatgacgacagtcga

SEQ ID NO: 461858 - DNA, 25 bp, Mus musculus
taccccagtgacgttctagagagcg

SEQ ID NO: 461859 - DNA, 25 bp, Mus musculus
taccccagtgatgaatggatttgcc

SEQ ID NO: 461860 - DNA, 25 bp, Mus musculus
taccccatggcgctagggaacttgg

SEQ ID NO: 461861 - DNA, 25 bp, Mus musculus
taccccgaggtgattctagggcgcc

SEQ ID NO: 461862 - DNA, 25 bp, Mus musculus
taccccgcagagtatacagcctagg

SEQ ID NO: 461863 - DNA, 25 bp, Mus musculus
taccccgctccagtgatattcttga

SEQ ID NO: 461864 - DNA, 25 bp, Mus musculus
taccccgcttctactgggaggaccg

SEQ ID NO: 461865 - DNA, 25 bp, Mus musculus
tacccctatggccagtaccagttcg

SEQ ID NO: 461866 - DNA, 25 bp, Mus musculus
tacccctctgtcacatcggagcagt

SEQ ID NO: 461867 - DNA, 25 bp, Mus musculus
tacccctgaacctgatgacctgaag

SEQ ID NO: 461868 - DNA, 25 bp, Mus musculus
tacccctgagggatatgacagggtg

SEQ ID NO: 461869 - DNA, 25 bp, Mus musculus
tacccctggactacaaatttacaag

SEQ ID NO: 461870 - DNA, 25 bp, Mus musculus
tacccctgggtgtgcaagaagtcca

SEQ ID NO: 461871 - DNA, 25 bp, Mus musculus
tacccctggtaatgcgaggtgctgc

SEQ ID NO: 461872 - DNA, 25 bp, Mus musculus
tacccctgtacaccttgcgggatgg

SEQ ID NO: 461873 - DNA, 25 bp, Mus musculus
tacccctgtggcttttgtaggcact

SEQ ID NO: 461874 - DNA, 25 bp, Mus musculus
taccccttcctgcgcctgtttagaa

SEQ ID NO: 461875 - DNA, 25 bp, Mus musculus
tacccctttctcactaactttatgg

SEQ ID NO: 461876 - DNA, 25 bp, Mus musculus
tacccgaagctcttctctcataggc

SEQ ID NO: 461877 - DNA, 25 bp, Mus musculus
tacccgacctgaagcacttgatgtg

SEQ ID NO: 461878 - DNA, 25 bp, Mus musculus
tacccgacggttgcatgtgagcttc

SEQ ID NO: 461879 - DNA, 25 bp, Mus musculus
tacccgactaggctgaaaacctggg

SEQ ID NO: 461880 - DNA, 25 bp, Mus musculus
tacccgagcgatgtgcggtattgcc

SEQ ID NO: 461881 - DNA, 25 bp, Mus musculus
tacccgaggcccagaagatgatgag

SEQ ID NO: 461882 - DNA, 25 bp, Mus musculus
tacccgagtagaagttagtaagctg

SEQ ID NO: 461883 - DNA, 25 bp, Mus musculus
tacccgagtgcaggaagatcagcag

SEQ ID NO: 461884 - DNA, 25 bp, Mus musculus
tacccgatgtaccttggaagcagga

SEQ ID NO: 461885 - DNA, 25 bp, Mus musculus
tacccgcaggaattatgaagcagcc

SEQ ID NO: 461886 - DNA, 25 bp, Mus musculus
tacccgccttcctttgccatagtga

SEQ ID NO: 461887 - DNA, 25 bp, Mus musculus
tacccgctgggatccttggcaagat

SEQ ID NO: 461888 - DNA, 25 bp, Mus musculus
tacccggaatgagctgtgttggccc

SEQ ID NO: 461889 - DNA, 25 bp, Mus musculus
tacccggaatttcagagacggccat

SEQ ID NO: 461890 - DNA, 25 bp, Mus musculus
tacccggacgtgtttatgcgcgagg

SEQ ID NO: 461891 - DNA, 25 bp, Mus musculus
tacccggagatactaacagatggag

SEQ ID NO: 461892 - DNA, 25 bp, Mus musculus
tacccggagctggtgttggagcaca

SEQ ID NO: 461893 - DNA, 25 bp, Mus musculus
tacccggagtgtgtagactagacat

SEQ ID NO: 461894 - DNA, 25 bp, Mus musculus
tacccgggagctatggacaagagcc

SEQ ID NO: 461895 - DNA, 25 bp, Mus musculus
tacccgggatttttgttgtcgcctg

SEQ ID NO: 461896 - DNA, 25 bp, Mus musculus
tacccggtccctgtactgaaggaag

SEQ ID NO: 461897 - DNA, 25 bp, Mus musculus
tacccggtgcccagactactgatgg

SEQ ID NO: 461898 - DNA, 25 bp, Mus musculus
tacccgtaactttgctgccaggatg

SEQ ID NO: 461899 - DNA, 25 bp, Mus musculus
tacccgtaagatcgtggatggcaga

SEQ ID NO: 461900 - DNA, 25 bp, Mus musculus
tacccgtagacgaagatggcttaga

SEQ ID NO: 461901 - DNA, 25 bp, Mus musculus
tacccgtagggtgtgcagctttcgt

SEQ ID NO: 461902 - DNA, 25 bp, Mus musculus
tacccgtcagtggaagactctcagg

SEQ ID NO: 461903 - DNA, 25 bp, Mus musculus
tacccgtcatgcagaaatggaagct

SEQ ID NO: 461904 - DNA, 25 bp, Mus musculus
tacccgtgctgcctgtgtgactaca

SEQ ID NO: 461905 - DNA, 25 bp, Mus musculus
tacccgtggaagaacagagaccgat

SEQ ID NO: 461906 - DNA, 25 bp, Mus musculus
taccctaagggcacacgagtggact

SEQ ID NO: 461907 - DNA, 25 bp, Mus musculus
taccctaagtcgaactgagcgcagg

SEQ ID NO: 461908 - DNA, 25 bp, Mus musculus
taccctaatgcagtaaggacagcag

SEQ ID NO: 461909 - DNA, 25 bp, Mus musculus
taccctactgtgtgagcaccctgat

SEQ ID NO: 461910 - DNA, 25 bp, Mus musculus
taccctagccgggaggaatacgagg

SEQ ID NO: 461911 - DNA, 25 bp, Mus musculus
taccctagtggaggacaaaaccaag

SEQ ID NO: 461912 - DNA, 25 bp, Mus musculus
taccctagtggaggtgccttggaca

SEQ ID NO: 461913 - DNA, 25 bp, Mus musculus
taccctcaggaggtttgctgtgccc

SEQ ID NO: 461914 - DNA, 25 bp, Mus musculus
taccctcctggttacagcgaacaga

SEQ ID NO: 461915 - DNA, 25 bp, Mus musculus
taccctcgcagatgtggacctagga

SEQ ID NO: 461916 - DNA, 25 bp, Mus musculus
taccctcgggcagagtgatacctag

SEQ ID NO: 461917 - DNA, 25 bp, Mus musculus
taccctcgttgggagaagatccgtc

SEQ ID NO: 461918 - DNA, 25 bp, Mus musculus
taccctctagtacggcagtgtctga

SEQ ID NO: 461919 - DNA, 25 bp, Mus musculus
taccctctgagacggcttcggacag

SEQ ID NO: 461920 - DNA, 25 bp, Mus musculus
taccctctgagcataacagtttcaa

SEQ ID NO: 461921 - DNA, 25 bp, Mus musculus
taccctctgcgtagtcctgtgtatc

SEQ ID NO: 461922 - DNA, 25 bp, Mus musculus
taccctctggagattgactatggcc

SEQ ID NO: 461923 - DNA, 25 bp, Mus musculus
taccctgaactgaagctagcttatg

SEQ ID NO: 461924 - DNA, 25 bp, Mus musculus
taccctgcacccattagtctgcagg

SEQ ID NO: 461925 - DNA, 25 bp, Mus musculus
taccctgcagcgtggataggaaaag

SEQ ID NO: 461926 - DNA, 25 bp, Mus musculus
taccctgcaggtagagcgtgaacct

SEQ ID NO: 461927 - DNA, 25 bp, Mus musculus
taccctgcaggtgtctagtcacatt

SEQ ID NO: 461928 - DNA, 25 bp, Mus musculus
taccctgcgcgaaaggaggagacta

SEQ ID NO: 461929 - DNA, 25 bp, Mus musculus
taccctgctggctatggaacgacca

SEQ ID NO: 461930 - DNA, 25 bp, Mus musculus
taccctgctggtcttctgcctgggc

SEQ ID NO: 461931 - DNA, 25 bp, Mus musculus
taccctgcttgttgtgcgtgacagc

SEQ ID NO: 461932 - DNA, 25 bp, Mus musculus
taccctggacaaaggatgccgagcc

SEQ ID NO: 461933 - DNA, 25 bp, Mus musculus
taccctggagactacacactgtgtg

SEQ ID NO: 461934 - DNA, 25 bp, Mus musculus
taccctggatgagagtgactgcttc

SEQ ID NO: 461935 - DNA, 25 bp, Mus musculus
taccctgggaaagcctcaatgaagc

SEQ ID NO: 461936 - DNA, 25 bp, Mus musculus
taccctggtattgccgatcgtatgc

SEQ ID NO: 461937 - DNA, 25 bp, Mus musculus
taccctggtggagaccaaaggcctc

SEQ ID NO: 461938 - DNA, 25 bp, Mus musculus
taccctggtggtatactgagacacc

SEQ ID NO: 461939 - DNA, 25 bp, Mus musculus
taccctggtgtcgtgatttggagct

SEQ ID NO: 461940 - DNA, 25 bp, Mus musculus
taccctgtatggagaacgcagtcct

SEQ ID NO: 461941 - DNA, 25 bp, Mus musculus
taccctgtcatggagaaaagcctgg

SEQ ID NO: 461942 - DNA, 25 bp, Mus musculus
taccctgtcggttactcttctggag

SEQ ID NO: 461943 - DNA, 25 bp, Mus musculus
taccctgtgtaatctggcatactgg

SEQ ID NO: 461944 - DNA, 25 bp, Mus musculus
taccctgttattgtgtgtgaaccag

SEQ ID NO: 461945 - DNA, 25 bp, Mus musculus
tacccttacaggaatctagtaagag

SEQ ID NO: 461946 - DNA, 25 bp, Mus musculus
tacccttcacctaaagagcatgagc

SEQ ID NO: 461947 - DNA, 25 bp, Mus musculus
tacccttcgattcgatgagctgaag

SEQ ID NO: 461948 - DNA, 25 bp, Mus musculus
tacccttctttagctggcggacggc

SEQ ID NO: 461949 - DNA, 25 bp, Mus musculus
tacccttgtcttcctttcaggagag

SEQ ID NO: 461950 - DNA, 25 bp, Mus musculus
tacccttgtgctttaggacggacct

SEQ ID NO: 461951 - DNA, 25 bp, Mus musculus
taccctttgaagatctgaatgccag

SEQ ID NO: 461952 - DNA, 25 bp, Mus musculus
taccctttgatgaagcccgctgtgg

SEQ ID NO: 461953 - DNA, 25 bp, Mus musculus
taccctttggcatgcctccaagtgc

SEQ ID NO: 461954 - DNA, 25 bp, Mus musculus
tacccttttacaggaggagaggcat

SEQ ID NO: 461955 - DNA, 25 bp, Mus musculus
tacccttttgatgggccaggacaga

SEQ ID NO: 461956 - DNA, 25 bp, Mus musculus
taccgaaagttagcactgcagtggc

SEQ ID NO: 461957 - DNA, 25 bp, Mus musculus
taccgaaatgttgatagcgacagct

SEQ ID NO: 461958 - DNA, 25 bp, Mus musculus
taccgaagactttgtgcggcagcgc

SEQ ID NO: 461959 - DNA, 25 bp, Mus musculus
taccgaaggatgtgcacgaaggaca

SEQ ID NO: 461960 - DNA, 25 bp, Mus musculus
taccgaattctggaccctgaaggcc

SEQ ID NO: 461961 - DNA, 25 bp, Mus musculus
taccgacacaaatatagtaagtgcc

SEQ ID NO: 461962 - DNA, 25 bp, Mus musculus
taccgacagcgttgggatgaagcct

SEQ ID NO: 461963 - DNA, 25 bp, Mus musculus
taccgacagtgaatgagggttcctc

SEQ ID NO: 461964 - DNA, 25 bp, Mus musculus
taccgacggttctactggagtggag

SEQ ID NO: 461965 - DNA, 25 bp, Mus musculus
taccgacgtcgaagcctgttggaga

SEQ ID NO: 461966 - DNA, 25 bp, Mus musculus
taccgacgtggtcaggttcaacgcc

SEQ ID NO: 461967 - DNA, 25 bp, Mus musculus
taccgactggaagacacatttggcc

SEQ ID NO: 461968 - DNA, 25 bp, Mus musculus
taccgagaggacagcattccacagc

SEQ ID NO: 461969 - DNA, 25 bp, Mus musculus
taccgagagggctgatctctgcgag

SEQ ID NO: 461970 - DNA, 25 bp, Mus musculus
taccgagcacctctttggatgcagt

SEQ ID NO: 461971 - DNA, 25 bp, Mus musculus
taccgagcccagtacctaaaaggtg

SEQ ID NO: 461972 - DNA, 25 bp, Mus musculus
taccgagccggtctcttaagaactt

SEQ ID NO: 461973 - DNA, 25 bp, Mus musculus
taccgagcggtcaaatggcattaca

SEQ ID NO: 461974 - DNA, 25 bp, Mus musculus
taccgagctcactttggaacagatg

SEQ ID NO: 461975 - DNA, 25 bp, Mus musculus
taccgaggagctccctgaagagttg

SEQ ID NO: 461976 - DNA, 25 bp, Mus musculus
taccgaggcttgtgcttgtaccaat

SEQ ID NO: 461977 - DNA, 25 bp, Mus musculus
taccgagtaagcaacatggatggac

SEQ ID NO: 461978 - DNA, 25 bp, Mus musculus
taccgagtagtcagccagttcgcca

SEQ ID NO: 461979 - DNA, 25 bp, Mus musculus
taccgagtttcagcatttggacagg

SEQ ID NO: 461980 - DNA, 25 bp, Mus musculus
taccgatatctgaaggcacgccggg

SEQ ID NO: 461981 - DNA, 25 bp, Mus musculus
taccgatgacctctttgcccgtaag

SEQ ID NO: 461982 - DNA, 25 bp, Mus musculus
taccgatgatgaggacacttgccaa

SEQ ID NO: 461983 - DNA, 25 bp, Mus musculus
taccgatgcacagcagtcaatgggc

SEQ ID NO: 461984 - DNA, 25 bp, Mus musculus
taccgatttgaatggctgaatttat

SEQ ID NO: 461985 - DNA, 25 bp, Mus musculus
taccgcaacggagagaagtttgagc

SEQ ID NO: 461986 - DNA, 25 bp, Mus musculus
taccgcaagaccaatttcgagggcc

SEQ ID NO: 461987 - DNA, 25 bp, Mus musculus
taccgcacgaatgtttcttttacca

SEQ ID NO: 461988 - DNA, 25 bp, Mus musculus
taccgcactctggaatattagccca

SEQ ID NO: 461989 - DNA, 25 bp, Mus musculus
taccgcagactttgctgtagccgaa

SEQ ID NO: 461990 - DNA, 25 bp, Mus musculus
taccgcagggacaccatacaaggtc

SEQ ID NO: 461991 - DNA, 25 bp, Mus musculus
taccgcagggtactttggatcacat

SEQ ID NO: 461992 - DNA, 25 bp, Mus musculus
taccgcatgagggatgatgagcaac

SEQ ID NO: 461993 - DNA, 25 bp, Mus musculus
taccgcatgttgcagtttctctggc

SEQ ID NO: 461994 - DNA, 25 bp, Mus musculus
taccgccaggcgatgttgctcaagg

SEQ ID NO: 461995 - DNA, 25 bp, Mus musculus
taccgccatgaggagttcaccaggg

SEQ ID NO: 461996 - DNA, 25 bp, Mus musculus
taccgccttaggcaaaacgtcaaga

SEQ ID NO: 461997 - DNA, 25 bp, Mus musculus
taccgccttcgtttgcatatggaaa

SEQ ID NO: 461998 - DNA, 25 bp, Mus musculus
taccgcgaacagaaggacctggact

SEQ ID NO: 461999 - DNA, 25 bp, Mus musculus
taccgcgagccgctttgcttgagcc

SEQ ID NO: 462000 - DNA, 25 bp, Mus musculus
taccgcgttaccgaatgtggcatcc

SEQ ID NO: 462001 - DNA, 25 bp, Mus musculus
taccgctatggaatgcagaactctg

SEQ ID NO: 462002 - DNA, 25 bp, Mus musculus
taccgctctgtgcttacggcgcaag

SEQ ID NO: 462003 - DNA, 25 bp, Mus musculus
taccgctgcaaagggaccaatggga

SEQ ID NO: 462004 - DNA, 25 bp, Mus musculus
taccgctgcgagctcatcaatggca

SEQ ID NO: 462005 - DNA, 25 bp, Mus musculus
taccgctggagtgagacatggattc

SEQ ID NO: 462006 - DNA, 25 bp, Mus musculus
taccgctgtgaaaccaaagaaacgt

SEQ ID NO: 462007 - DNA, 25 bp, Mus musculus
taccgcttagcttctccaagatgcc

SEQ ID NO: 462008 - DNA, 25 bp, Mus musculus
taccgcttctctaactgggtcgtca

SEQ ID NO: 462009 - DNA, 25 bp, Mus musculus
taccgcttgaaggaggtctgtccca

SEQ ID NO: 462010 - DNA, 25 bp, Mus musculus
taccgcttggccgaggagttaatgg

SEQ ID NO: 462011 - DNA, 25 bp, Mus musculus
taccggaagaatgccactcgggacg

SEQ ID NO: 462012 - DNA, 25 bp, Mus musculus
taccggaagcaacgtggtctatgaa

SEQ ID NO: 462013 - DNA, 25 bp, Mus musculus
taccggaagccatgacgacagcagc

SEQ ID NO: 462014 - DNA, 25 bp, Mus musculus
taccggaatgtggagtgagaccctg

SEQ ID NO: 462015 - DNA, 25 bp, Mus musculus
taccggacaccaactgcaaaagaag

SEQ ID NO: 462016 - DNA, 25 bp, Mus musculus
taccggagacaggtgcagtcactca

SEQ ID NO: 462017 - DNA, 25 bp, Mus musculus
taccggagcacgagaaggatgtctt

SEQ ID NO: 462018 - DNA, 25 bp, Mus musculus
taccggagcgagacgatttggccaa

SEQ ID NO: 462019 - DNA, 25 bp, Mus musculus
taccggaggtacagcaagttcttcg

SEQ ID NO: 462020 - DNA, 25 bp, Mus musculus
taccggataatgacgcagtgctggc

SEQ ID NO: 462021 - DNA, 25 bp, Mus musculus
taccggatcgcgaacctcagttcca

SEQ ID NO: 462022 - DNA, 25 bp, Mus musculus
taccggatgacttgctgcgggcatc

SEQ ID NO: 462023 - DNA, 25 bp, Mus musculus
taccggatgcactcatactacgggc

SEQ ID NO: 462024 - DNA, 25 bp, Mus musculus
taccggcgagatgctacttccaaag

SEQ ID NO: 462025 - DNA, 25 bp, Mus musculus
taccggcgggatatgggtcttacct

SEQ ID NO: 462026 - DNA, 25 bp, Mus musculus
taccggctacaagggagttacctgc

SEQ ID NO: 462027 - DNA, 25 bp, Mus musculus
taccggctggatacaattcattgaa

SEQ ID NO: 462028 - DNA, 25 bp, Mus musculus
taccggcttaatgtcgatggagtgg

SEQ ID NO: 462029 - DNA, 25 bp, Mus musculus
taccgggaactcttggatccttgcc

SEQ ID NO: 462030 - DNA, 25 bp, Mus musculus
taccgggacacaggaatgctgccaa

SEQ ID NO: 462031 - DNA, 25 bp, Mus musculus
taccgggacgaatgcgaactgcgca

SEQ ID NO: 462032 - DNA, 25 bp, Mus musculus
taccgggaggcatataaggacttct

SEQ ID NO: 462033 - DNA, 25 bp, Mus musculus
taccgggattgggtgtgccccaaca

SEQ ID NO: 462034 - DNA, 25 bp, Mus musculus
taccgggcaggaagattgcacaagt

SEQ ID NO: 462035 - DNA, 25 bp, Mus musculus
taccgggtggtgtacacagaccatc

SEQ ID NO: 462036 - DNA, 25 bp, Mus musculus
taccggtacagattatgtaactttg

SEQ ID NO: 462037 - DNA, 25 bp, Mus musculus
taccggtgggatctgcacaggctac

SEQ ID NO: 462038 - DNA, 25 bp, Mus musculus
taccggtgtgatgttcattacaaag

SEQ ID NO: 462039 - DNA, 25 bp, Mus musculus
taccggttaggcgtgcaaatgcatc

SEQ ID NO: 462040 - DNA, 25 bp, Mus musculus
taccgtacacagcacccgaggtgtg

SEQ ID NO: 462041 - DNA, 25 bp, Mus musculus
taccgtacacggctgcatgagaatg

SEQ ID NO: 462042 - DNA, 25 bp, Mus musculus
taccgtacccagcattttcaaagac

SEQ ID NO: 462043 - DNA, 25 bp, Mus musculus
taccgtagcatcacaatagtcagtg

SEQ ID NO: 462044 - DNA, 25 bp, Mus musculus
taccgtagcatcagtgacgacccga

SEQ ID NO: 462045 - DNA, 25 bp, Mus musculus
taccgtagccttgtgcagaaagggc

SEQ ID NO: 462046 - DNA, 25 bp, Mus musculus
taccgtcggaagcaccaggagttgc

SEQ ID NO: 462047 - DNA, 25 bp, Mus musculus
taccgtcgtgacttcgcagagatgt

SEQ ID NO: 462048 - DNA, 25 bp, Mus musculus
taccgtcgtgggtagggaggcaggc

SEQ ID NO: 462049 - DNA, 25 bp, Mus musculus
taccgtctgtggagatgtgcatggc

SEQ ID NO: 462050 - DNA, 25 bp, Mus musculus
taccgtgacacgaggagggcttttc

SEQ ID NO: 462051 - DNA, 25 bp, Mus musculus
taccgtgacatcaaggtgagaggat

SEQ ID NO: 462052 - DNA, 25 bp, Mus musculus
taccgtgagaagatgcagcaaggcc

SEQ ID NO: 462053 - DNA, 25 bp, Mus musculus
taccgtgatgctgtgactcctgaag

SEQ ID NO: 462054 - DNA, 25 bp, Mus musculus
taccgtgccatgtattaggagaaga

SEQ ID NO: 462055 - DNA, 25 bp, Mus musculus
taccgtggcgttctgggtaccatcc

SEQ ID NO: 462056 - DNA, 25 bp, Mus musculus
taccgtggggtgactacagtgcaga

SEQ ID NO: 462057 - DNA, 25 bp, Mus musculus
taccgtgtggatggacctgtgctgt

SEQ ID NO: 462058 - DNA, 25 bp, Mus musculus
taccgttcacacatcgataagtccg

SEQ ID NO: 462059 - DNA, 25 bp, Mus musculus
taccgttcgtggtgctggacgtcct

SEQ ID NO: 462060 - DNA, 25 bp, Mus musculus
taccgttctctgaggcactggagcc

SEQ ID NO: 462061 - DNA, 25 bp, Mus musculus
taccgttggtaatggcgcctgatgg

SEQ ID NO: 462062 - DNA, 25 bp, Mus musculus
taccgtttcgtatgtgacctgcaga

SEQ ID NO: 462063 - DNA, 25 bp, Mus musculus
taccgtttgcctggaggaagcgtgc

SEQ ID NO: 462064 - DNA, 25 bp, Mus musculus
tacctaaagtggcatacgcgacggc

SEQ ID NO: 462065 - DNA, 25 bp, Mus musculus
tacctaaccttcagtggattatcag

SEQ ID NO: 462066 - DNA, 25 bp, Mus musculus
tacctaatggttccttagaggctcc

SEQ ID NO: 462067 - DNA, 25 bp, Mus musculus
tacctaattggcagaagaaagacct

SEQ ID NO: 462068 - DNA, 25 bp, Mus musculus
tacctacagcacttacgggtgtctg

SEQ ID NO: 462069 - DNA, 25 bp, Mus musculus
tacctacatagatgcaacaagccct

SEQ ID NO: 462070 - DNA, 25 bp, Mus musculus
tacctacatctaatctacgctacat

SEQ ID NO: 462071 - DNA, 25 bp, Mus musculus
tacctacggtgaaagaaacagccgg

SEQ ID NO: 462072 - DNA, 25 bp, Mus musculus
tacctacggttgaaatgaaggccag

SEQ ID NO: 462073 - DNA, 25 bp, Mus musculus
tacctactatctcctctccttaagg

SEQ ID NO: 462074 - DNA, 25 bp, Mus musculus
tacctactcaagaatggcaccacgg

SEQ ID NO: 462075 - DNA, 25 bp, Mus musculus
tacctactgtgttaagagccgtgct

SEQ ID NO: 462076 - DNA, 25 bp, Mus musculus
tacctactgttagctgctgtgcagc

SEQ ID NO: 462077 - DNA, 25 bp, Mus musculus
tacctacttcatggatgcattttga

SEQ ID NO: 462078 - DNA, 25 bp, Mus musculus
tacctactttagattgggtggcaca

SEQ ID NO: 462079 - DNA, 25 bp, Mus musculus
tacctagaagttctcagaagggacc

SEQ ID NO: 462080 - DNA, 25 bp, Mus musculus
tacctagacaacgagaggagcaatg

SEQ ID NO: 462081 - DNA, 25 bp, Mus musculus
tacctagatgacagagggctcaggc

SEQ ID NO: 462082 - DNA, 25 bp, Mus musculus
tacctagcagcggaaatcctggagt

SEQ ID NO: 462083 - DNA, 25 bp, Mus musculus
tacctagcatatttctgacagtcag

SEQ ID NO: 462084 - DNA, 25 bp, Mus musculus
tacctaggagatatggaggccacac

SEQ ID NO: 462085 - DNA, 25 bp, Mus musculus
tacctaggagggtaaccatggcaac

SEQ ID NO: 462086 - DNA, 25 bp, Mus musculus
tacctaggccaagtgatcgctgcag

SEQ ID NO: 462087 - DNA, 25 bp, Mus musculus
tacctaggcctggacaaggaaggcc

SEQ ID NO: 462088 - DNA, 25 bp, Mus musculus
tacctagggtccgttgtggacgcca

SEQ ID NO: 462089 - DNA, 25 bp, Mus musculus
tacctagtcacactcatgggcaatg

SEQ ID NO: 462090 - DNA, 25 bp, Mus musculus
tacctagtcagggtgggcaacaacg

SEQ ID NO: 462091 - DNA, 25 bp, Mus musculus
tacctagtctgtccgttcatgccca

SEQ ID NO: 462092 - DNA, 25 bp, Mus musculus
tacctagtgggccattctcggctcc

SEQ ID NO: 462093 - DNA, 25 bp, Mus musculus
tacctatacagcacagggcgggata

SEQ ID NO: 462094 - DNA, 25 bp, Mus musculus
tacctatcctgccatcattgttgtg

SEQ ID NO: 462095 - DNA, 25 bp, Mus musculus
tacctatgaaccatcacagtgggtg

SEQ ID NO: 462096 - DNA, 25 bp, Mus musculus
tacctatgaatctgtgccagggcag

SEQ ID NO: 462097 - DNA, 25 bp, Mus musculus
tacctattttgtatcaagggcaagg

SEQ ID NO: 462098 - DNA, 25 bp, Mus musculus
tacctcaacgtgtcctggcgggttc

SEQ ID NO: 462099 - DNA, 25 bp, Mus musculus
tacctcagagagcacttgtcaaccg

SEQ ID NO: 462100 - DNA, 25 bp, Mus musculus
tacctcagctgaggtgaaggcgcag

SEQ ID NO: 462101 - DNA, 25 bp, Mus musculus
tacctcaggccttagaagacagtga

SEQ ID NO: 462102 - DNA, 25 bp, Mus musculus
tacctcaggtgtgtctgtatcacag

SEQ ID NO: 462103 - DNA, 25 bp, Mus musculus
tacctcagtagctagtgggcctcag

SEQ ID NO: 462104 - DNA, 25 bp, Mus musculus
tacctcagtggtgagacgctaccag

SEQ ID NO: 462105 - DNA, 25 bp, Mus musculus
tacctcatggcacaggtatgcagca

SEQ ID NO: 462106 - DNA, 25 bp, Mus musculus
tacctcatgtttaccatggtccttg

SEQ ID NO: 462107 - DNA, 25 bp, Mus musculus
tacctccaagagagtactgatgctg

SEQ ID NO: 462108 - DNA, 25 bp, Mus musculus
tacctccacatcaagaaaaagactc

SEQ ID NO: 462109 - DNA, 25 bp, Mus musculus
tacctccacgatggccagtgctgtg

SEQ ID NO: 462110 - DNA, 25 bp, Mus musculus
tacctccagcggattacagtgcctg

SEQ ID NO: 462111 - DNA, 25 bp, Mus musculus
tacctccaggttgaaggaacagcag

SEQ ID NO: 462112 - DNA, 25 bp, Mus musculus
tacctcccaggacgacagaagttct

SEQ ID NO: 462113 - DNA, 25 bp, Mus musculus
tacctcccatactcggtatgtgtgc

SEQ ID NO: 462114 - DNA, 25 bp, Mus musculus
tacctccctggcacatgaaactctg

SEQ ID NO: 462115 - DNA, 25 bp, Mus musculus
tacctcctctgtgggctgcaaggga

SEQ ID NO: 462116 - DNA, 25 bp, Mus musculus
tacctcctgtgattggcaagctgca

SEQ ID NO: 462117 - DNA, 25 bp, Mus musculus
tacctcgaaaggaaagagctggacc

SEQ ID NO: 462118 - DNA, 25 bp, Mus musculus
tacctcgctggtagcagtgggccat

SEQ ID NO: 462119 - DNA, 25 bp, Mus musculus
tacctcggaatgaatgcttcccctc

SEQ ID NO: 462120 - DNA, 25 bp, Mus musculus
tacctcggaggtctgaatatttata

SEQ ID NO: 462121 - DNA, 25 bp, Mus musculus
tacctcgggtctgagattgaaacca

SEQ ID NO: 462122 - DNA, 25 bp, Mus musculus
tacctcgtgttctgaaatgggagca

SEQ ID NO: 462123 - DNA, 25 bp, Mus musculus
tacctctcactgtaaatggtggaaa

SEQ ID NO: 462124 - DNA, 25 bp, Mus musculus
tacctctcagattacagcattgggc

SEQ ID NO: 462125 - DNA, 25 bp, Mus musculus
tacctctcctagcagtaagcgtggc

SEQ ID NO: 462126 - DNA, 25 bp, Mus musculus
tacctctcttttctagggagctgaa

SEQ ID NO: 462127 - DNA, 25 bp, Mus musculus
tacctctgcctctgttgtgtgacac

SEQ ID NO: 462128 - DNA, 25 bp, Mus musculus
tacctctggaaggatcaacgaaggg

SEQ ID NO: 462129 - DNA, 25 bp, Mus musculus
tacctctgtgcaaaagctcgacatc

SEQ ID NO: 462130 - DNA, 25 bp, Mus musculus
tacctctgtgttctggagcctgccg

SEQ ID NO: 462131 - DNA, 25 bp, Mus musculus
tacctcttagatgagcagacaccta

SEQ ID NO: 462132 - DNA, 25 bp, Mus musculus
tacctcttcatggtgcaggctcagg

SEQ ID NO: 462133 - DNA, 25 bp, Mus musculus
tacctcttgcctggatcgtttctcg

SEQ ID NO: 462134 - DNA, 25 bp, Mus musculus
tacctcttggagagtatggcacaac

SEQ ID NO: 462135 - DNA, 25 bp, Mus musculus
tacctcttgggctatcgggctgtct

SEQ ID NO: 462136 - DNA, 25 bp, Mus musculus
tacctgaaccctctcgtggtcgtgg

SEQ ID NO: 462137 - DNA, 25 bp, Mus musculus
tacctgaactgaacggctgtcctaa

SEQ ID NO: 462138 - DNA, 25 bp, Mus musculus
tacctgaagatgaaacccgtgtggc

SEQ ID NO: 462139 - DNA, 25 bp, Mus musculus
tacctgaagcaaacgctgacctctg

SEQ ID NO: 462140 - DNA, 25 bp, Mus musculus
tacctgaagctcgttctattctgaa

SEQ ID NO: 462141 - DNA, 25 bp, Mus musculus
tacctgaaggaattccgcacagagc

SEQ ID NO: 462142 - DNA, 25 bp, Mus musculus
tacctgaaggacaacagcggtagcc

SEQ ID NO: 462143 - DNA, 25 bp, Mus musculus
tacctgaagtactgagggacactgc

SEQ ID NO: 462144 - DNA, 25 bp, Mus musculus
tacctgaataagaattgggacgcca

SEQ ID NO: 462145 - DNA, 25 bp, Mus musculus
tacctgaatgtagactagggaccat

SEQ ID NO: 462146 - DNA, 25 bp, Mus musculus
tacctgaccagcttgggcaggaagc

SEQ ID NO: 462147 - DNA, 25 bp, Mus musculus
tacctgactcagagggtgaagccca

SEQ ID NO: 462148 - DNA, 25 bp, Mus musculus
tacctgacttcttggaggagttccc

SEQ ID NO: 462149 - DNA, 25 bp, Mus musculus
tacctgagaacgcagaaggctgtcg

SEQ ID NO: 462150 - DNA, 25 bp, Mus musculus
tacctgagacgtgccagtgtggccc

SEQ ID NO: 462151 - DNA, 25 bp, Mus musculus
tacctgagactaggagttacttcac

SEQ ID NO: 462152 - DNA, 25 bp, Mus musculus
tacctgagagacgaaaatgcctttg

SEQ ID NO: 462153 - DNA, 25 bp, Mus musculus
tacctgagcaaacatagggcggacc

SEQ ID NO: 462154 - DNA, 25 bp, Mus musculus
tacctgagcaggtggacaatctgtc

SEQ ID NO: 462155 - DNA, 25 bp, Mus musculus
tacctgagccgggagcaaactttta

SEQ ID NO: 462156 - DNA, 25 bp, Mus musculus
tacctgagccgtggaggaggcaatc

SEQ ID NO: 462157 - DNA, 25 bp, Mus musculus
tacctgagcggcaatgggatcagca

SEQ ID NO: 462158 - DNA, 25 bp, Mus musculus
tacctgagctcgaaaggcaaaacca

SEQ ID NO: 462159 - DNA, 25 bp, Mus musculus
tacctgaggaaaatcgggaagcagc

SEQ ID NO: 462160 - DNA, 25 bp, Mus musculus
tacctgaggcattactggagggacg

SEQ ID NO: 462161 - DNA, 25 bp, Mus musculus
tacctgagtggcagctgaagttgac

SEQ ID NO: 462162 - DNA, 25 bp, Mus musculus
tacctgagtttgtgcacagcattgc

SEQ ID NO: 462163 - DNA, 25 bp, Mus musculus
tacctgatagcattgaggatcctga

SEQ ID NO: 462164 - DNA, 25 bp, Mus musculus
tacctgatatgtgtgctgagaacca

SEQ ID NO: 462165 - DNA, 25 bp, Mus musculus
tacctgatgacataggagccgcact

SEQ ID NO: 462166 - DNA, 25 bp, Mus musculus
tacctgatgaccatgatcgtgggca

SEQ ID NO: 462167 - DNA, 25 bp, Mus musculus
tacctgatggttggagagggtcccc

SEQ ID NO: 462168 - DNA, 25 bp, Mus musculus
tacctgatgtgcctcgctgtctgag

SEQ ID NO: 462169 - DNA, 25 bp, Mus musculus
tacctgcacacttggcagaggccag

SEQ ID NO: 462170 - DNA, 25 bp, Mus musculus
tacctgcaccgttgggtagatccca

SEQ ID NO: 462171 - DNA, 25 bp, Mus musculus
tacctgcagggcaatatgagcggga

SEQ ID NO: 462172 - DNA, 25 bp, Mus musculus
tacctgcagtgttggttccagcagc

SEQ ID NO: 462173 - DNA, 25 bp, Mus musculus
tacctgcatcgtgttcatagagccg

SEQ ID NO: 462174 - DNA, 25 bp, Mus musculus
tacctgcattcacatccgggatggg

SEQ ID NO: 462175 - DNA, 25 bp, Mus musculus
tacctgccatctggagttgggctct

SEQ ID NO: 462176 - DNA, 25 bp, Mus musculus
tacctgcccaaagcaatgccaaagg

SEQ ID NO: 462177 - DNA, 25 bp, Mus musculus
tacctgccctggatatataaagtct

SEQ ID NO: 462178 - DNA, 25 bp, Mus musculus
tacctgccctttgggagtggaccaa

SEQ ID NO: 462179 - DNA, 25 bp, Mus musculus
tacctgccgccctatgaaaggacag

SEQ ID NO: 462180 - DNA, 25 bp, Mus musculus
tacctgcctagcaacagtgttctcg

SEQ ID NO: 462181 - DNA, 25 bp, Mus musculus
tacctgcctgagttaacgtctctgg

SEQ ID NO: 462182 - DNA, 25 bp, Mus musculus
tacctgcctgcaactgaaatttcaa

SEQ ID NO: 462183 - DNA, 25 bp, Mus musculus
tacctgcgctccttttcagccggga

SEQ ID NO: 462184 - DNA, 25 bp, Mus musculus
tacctgcggctctcacgcaagaagt

SEQ ID NO: 462185 - DNA, 25 bp, Mus musculus
tacctgcgggtcatgaagtgtcgcc

SEQ ID NO: 462186 - DNA, 25 bp, Mus musculus
tacctgcgtggcatggactggatcc

SEQ ID NO: 462187 - DNA, 25 bp, Mus musculus
tacctgcgtggtcaatggagactcc

SEQ ID NO: 462188 - DNA, 25 bp, Mus musculus
tacctgcgtggttatgagcaagccc

SEQ ID NO: 462189 - DNA, 25 bp, Mus musculus
tacctgcgttactacgtgggccaca

SEQ ID NO: 462190 - DNA, 25 bp, Mus musculus
tacctgctaagaagccagtattggg

SEQ ID NO: 462191 - DNA, 25 bp, Mus musculus
tacctgctatgatgaagtggacacg

SEQ ID NO: 462192 - DNA, 25 bp, Mus musculus
tacctgctcacaggaggagacaacg

SEQ ID NO: 462193 - DNA, 25 bp, Mus musculus
tacctgctcagcgaaagctttagga

SEQ ID NO: 462194 - DNA, 25 bp, Mus musculus
tacctgctccagtttacgctcactg

SEQ ID NO: 462195 - DNA, 25 bp, Mus musculus
tacctgctgcaaactcaattctggg

SEQ ID NO: 462196 - DNA, 25 bp, Mus musculus
tacctgctgcttcggaatggctctg

SEQ ID NO: 462197 - DNA, 25 bp, Mus musculus
tacctgctggatcagacggacgtgt

SEQ ID NO: 462198 - DNA, 25 bp, Mus musculus
tacctgctggcctacatcgtgagcg

SEQ ID NO: 462199 - DNA, 25 bp, Mus musculus
tacctgctggctgaaacagccgcgg

SEQ ID NO: 462200 - DNA, 25 bp, Mus musculus
tacctgctggctggctttgggatcg

SEQ ID NO: 462201 - DNA, 25 bp, Mus musculus
tacctgctgtttgctgggaccatga

SEQ ID NO: 462202 - DNA, 25 bp, Mus musculus
tacctgcttgaaagggatctcagag

SEQ ID NO: 462203 - DNA, 25 bp, Mus musculus
tacctgcttgctgtcgccggagata

SEQ ID NO: 462204 - DNA, 25 bp, Mus musculus
tacctggaacggaggaactacatca

SEQ ID NO: 462205 - DNA, 25 bp, Mus musculus
tacctggaatatcctcaggtttggg

SEQ ID NO: 462206 - DNA, 25 bp, Mus musculus
tacctggaatcccagagccttagca

SEQ ID NO: 462207 - DNA, 25 bp, Mus musculus
tacctggaccttggaaaggagacct

SEQ ID NO: 462208 - DNA, 25 bp, Mus musculus
tacctggagaaagacctgggccttc

SEQ ID NO: 462209 - DNA, 25 bp, Mus musculus
tacctggagagatatgcagcatctg

SEQ ID NO: 462210 - DNA, 25 bp, Mus musculus
tacctggagagtcagcatgtaggcc

SEQ ID NO: 462211 - DNA, 25 bp, Mus musculus
tacctggagatctgtgcagcggacg

SEQ ID NO: 462212 - DNA, 25 bp, Mus musculus
tacctggagcagtagaccttaacct

SEQ ID NO: 462213 - DNA, 25 bp, Mus musculus
tacctggagtatcgttccttctgca

SEQ ID NO: 462214 - DNA, 25 bp, Mus musculus
tacctggagtgaaggattgtggccc

SEQ ID NO: 462215 - DNA, 25 bp, Mus musculus
tacctggatcaaccaagtcatggcc

SEQ ID NO: 462216 - DNA, 25 bp, Mus musculus
tacctggatgcctctgaacttttgg

SEQ ID NO: 462217 - DNA, 25 bp, Mus musculus
tacctggcagaaggtgacaatgtga

SEQ ID NO: 462218 - DNA, 25 bp, Mus musculus
tacctggcccatacccaagggaaga

SEQ ID NO: 462219 - DNA, 25 bp, Mus musculus
tacctggccgtgcaagtaaggtcac

SEQ ID NO: 462220 - DNA, 25 bp, Mus musculus
tacctggcctactttgtgcgggagc

SEQ ID NO: 462221 - DNA, 25 bp, Mus musculus
tacctggcgaagcatgagaacactc

SEQ ID NO: 462222 - DNA, 25 bp, Mus musculus
tacctgggcaagtgattagactgca

SEQ ID NO: 462223 - DNA, 25 bp, Mus musculus
tacctgggcactcttcttgagcaag

SEQ ID NO: 462224 - DNA, 25 bp, Mus musculus
tacctgggcctttttactacgagct

SEQ ID NO: 462225 - DNA, 25 bp, Mus musculus
tacctgggcttgtagtactggactc

SEQ ID NO: 462226 - DNA, 25 bp, Mus musculus
tacctgggtcaggtacaaccctctg

SEQ ID NO: 462227 - DNA, 25 bp, Mus musculus
tacctggtagtattattgtgcttgg

SEQ ID NO: 462228 - DNA, 25 bp, Mus musculus
tacctggtcaactggatctggcgct

SEQ ID NO: 462229 - DNA, 25 bp, Mus musculus
tacctggtcatgatcattgtccgtg

SEQ ID NO: 462230 - DNA, 25 bp, Mus musculus
tacctggtcatggaatactacgtgg

SEQ ID NO: 462231 - DNA, 25 bp, Mus musculus
tacctggtccagcttgatgttcact

SEQ ID NO: 462232 - DNA, 25 bp, Mus musculus
tacctggtcctggacaacccagaag

SEQ ID NO: 462233 - DNA, 25 bp, Mus musculus
tacctggtccttttctcaacacata

SEQ ID NO: 462234 - DNA, 25 bp, Mus musculus
tacctggtctgatagctgcagtagg

SEQ ID NO: 462235 - DNA, 25 bp, Mus musculus
tacctggtgaaaggtggccttgcct

SEQ ID NO: 462236 - DNA, 25 bp, Mus musculus
tacctggtgataattgtcctgacgg

SEQ ID NO: 462237 - DNA, 25 bp, Mus musculus
tacctggtgcagatccgtgttctac

SEQ ID NO: 462238 - DNA, 25 bp, Mus musculus
tacctggtgggcttctacagcggca

SEQ ID NO: 462239 - DNA, 25 bp, Mus musculus
tacctggtgtgtgcagatgcggaca

SEQ ID NO: 462240 - DNA, 25 bp, Mus musculus
tacctggttaggtcaggcctgcctt

SEQ ID NO: 462241 - DNA, 25 bp, Mus musculus
tacctggttccctaaaggcctcaga

SEQ ID NO: 462242 - DNA, 25 bp, Mus musculus
tacctgtacagtgtggagtcccgga

SEQ ID NO: 462243 - DNA, 25 bp, Mus musculus
tacctgtcagaagggaactgcaagc

SEQ ID NO: 462244 - DNA, 25 bp, Mus musculus
tacctgtcagatcgcagggaaccag

SEQ ID NO: 462245 - DNA, 25 bp, Mus musculus
tacctgtcagctggagaatgtgctc

SEQ ID NO: 462246 - DNA, 25 bp, Mus musculus
tacctgtccatctagggcatccgtc

SEQ ID NO: 462247 - DNA, 25 bp, Mus musculus
tacctgtcccttcgcatccatctac

SEQ ID NO: 462248 - DNA, 25 bp, Mus musculus
tacctgtgacagaactcgagaatgg

SEQ ID NO: 462249 - DNA, 25 bp, Mus musculus
tacctgtggatcaaaaggccgtgct

SEQ ID NO: 462250 - DNA, 25 bp, Mus musculus
tacctgtggctttagagcgcaggcc

SEQ ID NO: 462251 - DNA, 25 bp, Mus musculus
tacctgtggttacgcaggacgcaag

SEQ ID NO: 462252 - DNA, 25 bp, Mus musculus
tacctgtgtatgcagagggcagcca

SEQ ID NO: 462253 - DNA, 25 bp, Mus musculus
tacctgtgtcgacatccgctggagg

SEQ ID NO: 462254 - DNA, 25 bp, Mus musculus
tacctgtgtggaagataggaactcc

SEQ ID NO: 462255 - DNA, 25 bp, Mus musculus
tacctgtgtgtactgtaggagtcca

SEQ ID NO: 462256 - DNA, 25 bp, Mus musculus
tacctgtgttatgacgccctagctg

SEQ ID NO: 462257 - DNA, 25 bp, Mus musculus
tacctgttcgttcctcatgtagcaa

SEQ ID NO: 462258 - DNA, 25 bp, Mus musculus
tacctgttgagtagagggatgttcc

SEQ ID NO: 462259 - DNA, 25 bp, Mus musculus
tacctgttggaagtgacctcgctcc

SEQ ID NO: 462260 - DNA, 25 bp, Mus musculus
taccttaaaactagcctgtgtgggc

SEQ ID NO: 462261 - DNA, 25 bp, Mus musculus
taccttaaacggagaggccaggcga

SEQ ID NO: 462262 - DNA, 25 bp, Mus musculus
taccttaaaggcagtagggcaaagc

SEQ ID NO: 462263 - DNA, 25 bp, Mus musculus
taccttaatgctgatcagtcgccgt

SEQ ID NO: 462264 - DNA, 25 bp, Mus musculus
taccttactggctgggatgaatctc

SEQ ID NO: 462265 - DNA, 25 bp, Mus musculus
taccttagggcctttgcatctgccg

SEQ ID NO: 462266 - DNA, 25 bp, Mus musculus
taccttaggtcttggcccttgagct

SEQ ID NO: 462267 - DNA, 25 bp, Mus musculus
taccttagtggtctgagcatcctca

SEQ ID NO: 462268 - DNA, 25 bp, Mus musculus
taccttatgagtatgggtcttttgc

SEQ ID NO: 462269 - DNA, 25 bp, Mus musculus
taccttcactctgtaaattagggag

SEQ ID NO: 462270 - DNA, 25 bp, Mus musculus
taccttcactgacttgggccgatgt

SEQ ID NO: 462271 - DNA, 25 bp, Mus musculus
taccttcaggagtgcagccatgtct

SEQ ID NO: 462272 - DNA, 25 bp, Mus musculus
taccttcagtcttccgtgagatggc

SEQ ID NO: 462273 - DNA, 25 bp, Mus musculus
taccttccaggagggtgacccacat

SEQ ID NO: 462274 - DNA, 25 bp, Mus musculus
taccttccagggtaagtatgcacac

SEQ ID NO: 462275 - DNA, 25 bp, Mus musculus
taccttcgaattcaggctcaggagc

SEQ ID NO: 462276 - DNA, 25 bp, Mus musculus
taccttctctatcctgagttgcaaa

SEQ ID NO: 462277 - DNA, 25 bp, Mus musculus
taccttctggatccgttttagagcc

SEQ ID NO: 462278 - DNA, 25 bp, Mus musculus
taccttgaagactggcagaaagccc

SEQ ID NO: 462279 - DNA, 25 bp, Mus musculus
taccttgaagaggaaactgtgtggc

SEQ ID NO: 462280 - DNA, 25 bp, Mus musculus
taccttgacctgcagaatgacctag

SEQ ID NO: 462281 - DNA, 25 bp, Mus musculus
taccttgaggcttgatagagacagt

SEQ ID NO: 462282 - DNA, 25 bp, Mus musculus
taccttgcagttaaagtgcaggtgc

SEQ ID NO: 462283 - DNA, 25 bp, Mus musculus
taccttgcatcttggcttcgacgcc

SEQ ID NO: 462284 - DNA, 25 bp, Mus musculus
taccttgccagcagggagtcagagg

SEQ ID NO: 462285 - DNA, 25 bp, Mus musculus
taccttgctttatggtcggacctgg

SEQ ID NO: 462286 - DNA, 25 bp, Mus musculus
taccttggagaatggcaactacctg

SEQ ID NO: 462287 - DNA, 25 bp, Mus musculus
taccttggctgctcggtcactcatg

SEQ ID NO: 462288 - DNA, 25 bp, Mus musculus
taccttggcttcatggcgatgcttc

SEQ ID NO: 462289 - DNA, 25 bp, Mus musculus
taccttgggtcaaagatgagctcca

SEQ ID NO: 462290 - DNA, 25 bp, Mus musculus
taccttgggtgtgtctgtgatagca

SEQ ID NO: 462291 - DNA, 25 bp, Mus musculus
taccttggtagcgtcctagggaggc

SEQ ID NO: 462292 - DNA, 25 bp, Mus musculus
taccttgtcagtcgtgtgtgcagat

SEQ ID NO: 462293 - DNA, 25 bp, Mus musculus
taccttgtccacttctccaaaagct

SEQ ID NO: 462294 - DNA, 25 bp, Mus musculus
tacctttaaggatcctcgcccaggg

SEQ ID NO: 462295 - DNA, 25 bp, Mus musculus
tacctttgagggatattggagccag

SEQ ID NO: 462296 - DNA, 25 bp, Mus musculus
tacctttgatactgtcctggacttc

SEQ ID NO: 462297 - DNA, 25 bp, Mus musculus
tacctttgctgtggatcgtctgagt

SEQ ID NO: 462298 - DNA, 25 bp, Mus musculus
tacgaaacaaatgccgagagatgct

SEQ ID NO: 462299 - DNA, 25 bp, Mus musculus
tacgaaaccgtagagaagcaaggtt

SEQ ID NO: 462300 - DNA, 25 bp, Mus musculus
tacgaaagccacgtggaggtgtccc

SEQ ID NO: 462301 - DNA, 25 bp, Mus musculus
tacgaaaggatctatctcaggctcc

SEQ ID NO: 462302 - DNA, 25 bp, Mus musculus
tacgaaatggtctgcctggtcaacg

SEQ ID NO: 462303 - DNA, 25 bp, Mus musculus
tacgaacaggcgtttcacggacagg

SEQ ID NO: 462304 - DNA, 25 bp, Mus musculus
tacgaacctgagctgctgttaatgc

SEQ ID NO: 462305 - DNA, 25 bp, Mus musculus
tacgaacctggacagagaaatccgg

SEQ ID NO: 462306 - DNA, 25 bp, Mus musculus
tacgaactaatcagagccactgtgg

SEQ ID NO: 462307 - DNA, 25 bp, Mus musculus
tacgaactgttgcacggagctggca

SEQ ID NO: 462308 - DNA, 25 bp, Mus musculus
tacgaagattatgagaccactgcca

SEQ ID NO: 462309 - DNA, 25 bp, Mus musculus
tacgaagcaaccaaatgccagggct

SEQ ID NO: 462310 - DNA, 25 bp, Mus musculus
tacgaagccgggacactaacagttc

SEQ ID NO: 462311 - DNA, 25 bp, Mus musculus
tacgaagctttgaagttcctcatgc

SEQ ID NO: 462312 - DNA, 25 bp, Mus musculus
tacgaagtcgatacgtccagtgcct

SEQ ID NO: 462313 - DNA, 25 bp, Mus musculus
tacgaagttgcacccagatctgaca

SEQ ID NO: 462314 - DNA, 25 bp, Mus musculus
tacgaatcacagcttcgggacctcg

SEQ ID NO: 462315 - DNA, 25 bp, Mus musculus
tacgaatcctttgacgaactctggg

SEQ ID NO: 462316 - DNA, 25 bp, Mus musculus
tacgaatcgtggagctagcacagct

SEQ ID NO: 462317 - DNA, 25 bp, Mus musculus
tacgaatgagcttccgtggtgacgg

SEQ ID NO: 462318 - DNA, 25 bp, Mus musculus
tacgaatgcttgatgcctcgggaga

SEQ ID NO: 462319 - DNA, 25 bp, Mus musculus
tacgaattctggtgcaagctcggcc

SEQ ID NO: 462320 - DNA, 25 bp, Mus musculus
tacgacaagaacattcaatcccggg

SEQ ID NO: 462321 - DNA, 25 bp, Mus musculus
tacgacaaggatcatcaggcccaga

SEQ ID NO: 462322 - DNA, 25 bp, Mus musculus
tacgacaagtccaaacctgtcacct

SEQ ID NO: 462323 - DNA, 25 bp, Mus musculus
tacgacaccctgttacagctcaggg

SEQ ID NO: 462324 - DNA, 25 bp, Mus musculus
tacgacaggatctgcagttccctcg

SEQ ID NO: 462325 - DNA, 25 bp, Mus musculus
tacgacatgatgagttctgagctgc

SEQ ID NO: 462326 - DNA, 25 bp, Mus musculus
tacgacccagaagagaatgtctccc

SEQ ID NO: 462327 - DNA, 25 bp, Mus musculus
tacgacccgggctttatggctactt

SEQ ID NO: 462328 - DNA, 25 bp, Mus musculus
tacgaccgcaaggactacgtctgag

SEQ ID NO: 462329 - DNA, 25 bp, Mus musculus
tacgacctagctcgaggaaccgtga

SEQ ID NO: 462330 - DNA, 25 bp, Mus musculus
tacgacctggaatgaagtgtgggca

SEQ ID NO: 462331 - DNA, 25 bp, Mus musculus
tacgacgactcagtgcaaaggctgc

SEQ ID NO: 462332 - DNA, 25 bp, Mus musculus
tacgacgtcatcctgaagacgggcc

SEQ ID NO: 462333 - DNA, 25 bp, Mus musculus
tacgacgtccagagggatgacagca

SEQ ID NO: 462334 - DNA, 25 bp, Mus musculus
tacgacgttgttgtgaccgctcgcg

SEQ ID NO: 462335 - DNA, 25 bp, Mus musculus
tacgactaaagagcttgcagggcct

SEQ ID NO: 462336 - DNA, 25 bp, Mus musculus
tacgactacgtaaccaacgagggca

SEQ ID NO: 462337 - DNA, 25 bp, Mus musculus
tacgactagaagaaaaattcggtgg

SEQ ID NO: 462338 - DNA, 25 bp, Mus musculus
tacgactatgacagtaatggaggcc

SEQ ID NO: 462339 - DNA, 25 bp, Mus musculus
tacgactccagtacatggtggctgc

SEQ ID NO: 462340 - DNA, 25 bp, Mus musculus
tacgactcccaagacccaaagtgtg

SEQ ID NO: 462341 - DNA, 25 bp, Mus musculus
tacgactcgagctacaagactggaa

SEQ ID NO: 462342 - DNA, 25 bp, Mus musculus
tacgactgcaaggaagaggaaatcc

SEQ ID NO: 462343 - DNA, 25 bp, Mus musculus
tacgagaagcatggcaactcaagcc

SEQ ID NO: 462344 - DNA, 25 bp, Mus musculus
tacgagaaggtcgaggatgcctgcc

SEQ ID NO: 462345 - DNA, 25 bp, Mus musculus
tacgagacagagcttagtctgcggc

SEQ ID NO: 462346 - DNA, 25 bp, Mus musculus
tacgagaccgtaagattgcctggct

SEQ ID NO: 462347 - DNA, 25 bp, Mus musculus
tacgagaccgtgatgaagcagctca

SEQ ID NO: 462348 - DNA, 25 bp, Mus musculus
tacgagagaactaactcccaaagtt

SEQ ID NO: 462349 - DNA, 25 bp, Mus musculus
tacgagagattttaccctgagggct

SEQ ID NO: 462350 - DNA, 25 bp, Mus musculus
tacgagagcgaagctgatacggcca

SEQ ID NO: 462351 - DNA, 25 bp, Mus musculus
tacgagagttccaccactgagcctt

SEQ ID NO: 462352 - DNA, 25 bp, Mus musculus
tacgagatgagaacagaagcacggc

SEQ ID NO: 462353 - DNA, 25 bp, Mus musculus
tacgagcactttgcagagcttgaca

SEQ ID NO: 462354 - DNA, 25 bp, Mus musculus
tacgagcagcgccagaaaaatgagg

SEQ ID NO: 462355 - DNA, 25 bp, Mus musculus
tacgagcagctgatgaacgaataca

SEQ ID NO: 462356 - DNA, 25 bp, Mus musculus
tacgagccagaaagatggaagacag

SEQ ID NO: 462357 - DNA, 25 bp, Mus musculus
tacgagcgctacaagaatgactgtc

SEQ ID NO: 462358 - DNA, 25 bp, Mus musculus
tacgagctactcaactgtgacaggc

SEQ ID NO: 462359 - DNA, 25 bp, Mus musculus
tacgaggacacagagcttgaacagg

SEQ ID NO: 462360 - DNA, 25 bp, Mus musculus
tacgaggactgtcatgcacacacgg

SEQ ID NO: 462361 - DNA, 25 bp, Mus musculus
tacgaggagtatcagaagcaactgg

SEQ ID NO: 462362 - DNA, 25 bp, Mus musculus
tacgaggccagtatgtaccagaccc

SEQ ID NO: 462363 - DNA, 25 bp, Mus musculus
tacgaggcggccaaactgatgaatg

SEQ ID NO: 462364 - DNA, 25 bp, Mus musculus
tacgaggctatttcaggtccgaggg

SEQ ID NO: 462365 - DNA, 25 bp, Mus musculus
tacgaggctgatggtgccaacgtgc

SEQ ID NO: 462366 - DNA, 25 bp, Mus musculus
tacgaggcttgctggcatctgagcc

SEQ ID NO: 462367 - DNA, 25 bp, Mus musculus
tacgagggacagctgtaaatctaac

SEQ ID NO: 462368 - DNA, 25 bp, Mus musculus
tacgagggcacttggaataacggcc

SEQ ID NO: 462369 - DNA, 25 bp, Mus musculus
tacgagggtaccatagaaggcaacg

SEQ ID NO: 462370 - DNA, 25 bp, Mus musculus
tacgaggtatctcctggcgaaggaa

SEQ ID NO: 462371 - DNA, 25 bp, Mus musculus
tacgaggtcttatcggacgtccgca

SEQ ID NO: 462372 - DNA, 25 bp, Mus musculus
tacgaggtggccaggattctgaacc

SEQ ID NO: 462373 - DNA, 25 bp, Mus musculus
tacgagtaacgatgtcaagtctggc

SEQ ID NO: 462374 - DNA, 25 bp, Mus musculus
tacgagtccatattaaaatgcacgg

SEQ ID NO: 462375 - DNA, 25 bp, Mus musculus
tacgagtccgccaaagtcctgaatg

SEQ ID NO: 462376 - DNA, 25 bp, Mus musculus
tacgagtcggtgtgcttcaagaagg

SEQ ID NO: 462377 - DNA, 25 bp, Mus musculus
tacgagtcgtcagtggccaagtttc

SEQ ID NO: 462378 - DNA, 25 bp, Mus musculus
tacgagtctagggacaacatgtgct

SEQ ID NO: 462379 - DNA, 25 bp, Mus musculus
tacgagttcccagagtattcgcggg

SEQ ID NO: 462380 - DNA, 25 bp, Mus musculus
tacgagttccctgaagaggagcgct

SEQ ID NO: 462381 - DNA, 25 bp, Mus musculus
tacgagttcgatgacgagtccatgc

SEQ ID NO: 462382 - DNA, 25 bp, Mus musculus
tacgataatccaggcattgcccggg

SEQ ID NO: 462383 - DNA, 25 bp, Mus musculus
tacgatagagagactgggaagccca

SEQ ID NO: 462384 - DNA, 25 bp, Mus musculus
tacgatcatagagcaaggttgcacc

SEQ ID NO: 462385 - DNA, 25 bp, Mus musculus
tacgatcctggtacaaacagtggtg

SEQ ID NO: 462386 - DNA, 25 bp, Mus musculus
tacgatcggctgcagactgatggcc

SEQ ID NO: 462387 - DNA, 25 bp, Mus musculus
tacgatctcaacctgtgcgggctga

SEQ ID NO: 462388 - DNA, 25 bp, Mus musculus
tacgatgaggagtatggctgtccca

SEQ ID NO: 462389 - DNA, 25 bp, Mus musculus
tacgatgaggcggtgcaagcttgtc

SEQ ID NO: 462390 - DNA, 25 bp, Mus musculus
tacgatgagttcatgaagcgcctgg

SEQ ID NO: 462391 - DNA, 25 bp, Mus musculus
tacgatgcatagacatacactcggg

SEQ ID NO: 462392 - DNA, 25 bp, Mus musculus
tacgatgccgacgaggaagtgcaac

SEQ ID NO: 462393 - DNA, 25 bp, Mus musculus
tacgatgccgactcagagcttgacg

SEQ ID NO: 462394 - DNA, 25 bp, Mus musculus
tacgatgcgctgtcttctgaactgc

SEQ ID NO: 462395 - DNA, 25 bp, Mus musculus
tacgatggccagtgctaagacggtg

SEQ ID NO: 462396 - DNA, 25 bp, Mus musculus
tacgatgggctggtatagtccaggc

SEQ ID NO: 462397 - DNA, 25 bp, Mus musculus
tacgatggtcatctcccgattgaag

SEQ ID NO: 462398 - DNA, 25 bp, Mus musculus
tacgatgttacccaagaagagagca

SEQ ID NO: 462399 - DNA, 25 bp, Mus musculus
tacgattaatgccatcgagggcctg

SEQ ID NO: 462400 - DNA, 25 bp, Mus musculus
tacgattggtgctgtctggcggcga

SEQ ID NO: 462401 - DNA, 25 bp, Mus musculus
tacgatttagaccagcctgggatgg

SEQ ID NO: 462402 - DNA, 25 bp, Mus musculus
tacgatttgtatagcagcgccctgg

SEQ ID NO: 462403 - DNA, 25 bp, Mus musculus
tacgcaaagtacagacggaggacca

SEQ ID NO: 462404 - DNA, 25 bp, Mus musculus
tacgcaagaggaaggccacattcag

SEQ ID NO: 462405 - DNA, 25 bp, Mus musculus
tacgcaagattgaagcagcctagcc

SEQ ID NO: 462406 - DNA, 25 bp, Mus musculus
tacgcagagaagcaaatgtacccgg

SEQ ID NO: 462407 - DNA, 25 bp, Mus musculus
tacgcagatgtgtttattggagccc

SEQ ID NO: 462408 - DNA, 25 bp, Mus musculus
tacgcagcactggaggactatcacc

SEQ ID NO: 462409 - DNA, 25 bp, Mus musculus
tacgcagggccaaagtgtcttatag

SEQ ID NO: 462410 - DNA, 25 bp, Mus musculus
tacgcagggccattgactctgtggg

SEQ ID NO: 462411 - DNA, 25 bp, Mus musculus
tacgcagggcgccatatgccttctg

SEQ ID NO: 462412 - DNA, 25 bp, Mus musculus
tacgcagtctactggaaccgtagca

SEQ ID NO: 462413 - DNA, 25 bp, Mus musculus
tacgcataaagtgcagaacgtgctg

SEQ ID NO: 462414 - DNA, 25 bp, Mus musculus
tacgcatatggctactacacaggag

SEQ ID NO: 462415 - DNA, 25 bp, Mus musculus
tacgcatcgcacctgaggaaaggca

SEQ ID NO: 462416 - DNA, 25 bp, Mus musculus
tacgccaagatggaggcagaacgtg

SEQ ID NO: 462417 - DNA, 25 bp, Mus musculus
tacgccaagcggtactcatggtccg

SEQ ID NO: 462418 - DNA, 25 bp, Mus musculus
tacgccaagcttgcagcagtagctg

SEQ ID NO: 462419 - DNA, 25 bp, Mus musculus
tacgccacaggaactacatacaagg

SEQ ID NO: 462420 - DNA, 25 bp, Mus musculus
tacgccatccccagtgaaatgtcag

SEQ ID NO: 462421 - DNA, 25 bp, Mus musculus
tacgccatggtctacggctacaacg

SEQ ID NO: 462422 - DNA, 25 bp, Mus musculus
tacgcccagatgcacaatgagaagg

SEQ ID NO: 462423 - DNA, 25 bp, Mus musculus
tacgcccgcctcaagattagtgatg

SEQ ID NO: 462424 - DNA, 25 bp, Mus musculus
tacgccgaggcttcggcgctgtacg

SEQ ID NO: 462425 - DNA, 25 bp, Mus musculus
tacgccgccgaccagtgggtttttg

SEQ ID NO: 462426 - DNA, 25 bp, Mus musculus
tacgccgcctgcttcaagagagaga

SEQ ID NO: 462427 - DNA, 25 bp, Mus musculus
tacgccgtcaaccaggtcctggaag

SEQ ID NO: 462428 - DNA, 25 bp, Mus musculus
tacgcctgcagagttaagcatgcca

SEQ ID NO: 462429 - DNA, 25 bp, Mus musculus
tacgcctggatgtggagttcaagcc

SEQ ID NO: 462430 - DNA, 25 bp, Mus musculus
tacgccttcgaggtgacaggatccc

SEQ ID NO: 462431 - DNA, 25 bp, Mus musculus
tacgcgagccaattcagaaaggaaa

SEQ ID NO: 462432 - DNA, 25 bp, Mus musculus
tacgcgatgacgcaccgcaggtttg

SEQ ID NO: 462433 - DNA, 25 bp, Mus musculus
tacgcgctatgttgtgtcgccagcc

SEQ ID NO: 462434 - DNA, 25 bp, Mus musculus
tacgcggagaccctctttagagcag

SEQ ID NO: 462435 - DNA, 25 bp, Mus musculus
tacgcggagcaggaaaacggaatca

SEQ ID NO: 462436 - DNA, 25 bp, Mus musculus
tacgcggatgctatggatgaccacc

SEQ ID NO: 462437 - DNA, 25 bp, Mus musculus
tacgcggcgcagaaagtcatggctt

SEQ ID NO: 462438 - DNA, 25 bp, Mus musculus
tacgcgggctgcgagaaagtttacg

SEQ ID NO: 462439 - DNA, 25 bp, Mus musculus
tacgcgtggaactgcatgactggga

SEQ ID NO: 462440 - DNA, 25 bp, Mus musculus
tacgcgtgtcccgaatgtggcaagg

SEQ ID NO: 462441 - DNA, 25 bp, Mus musculus
tacgcgtgtgcacagggcttttcgc

SEQ ID NO: 462442 - DNA, 25 bp, Mus musculus
tacgcgtgttgaagtctgaggacca

SEQ ID NO: 462443 - DNA, 25 bp, Mus musculus
tacgctacagatagaaagtgtgtgt

SEQ ID NO: 462444 - DNA, 25 bp, Mus musculus
tacgctaggctgctaacatggctgc

SEQ ID NO: 462445 - DNA, 25 bp, Mus musculus
tacgctatgcaagaagccaagcagc

SEQ ID NO: 462446 - DNA, 25 bp, Mus musculus
tacgctatggagaccccgagaagct

SEQ ID NO: 462447 - DNA, 25 bp, Mus musculus
tacgctatggccgaatcctggacag

SEQ ID NO: 462448 - DNA, 25 bp, Mus musculus
tacgctcactgttcgctgcctgtac

SEQ ID NO: 462449 - DNA, 25 bp, Mus musculus
tacgctcagtgaaaaaggcacgttg

SEQ ID NO: 462450 - DNA, 25 bp, Mus musculus
tacgctcattccaaaacatgaagac

SEQ ID NO: 462451 - DNA, 25 bp, Mus musculus
tacgctccccagtgctacaattgga

SEQ ID NO: 462452 - DNA, 25 bp, Mus musculus
tacgctctacacagggctggatttc

SEQ ID NO: 462453 - DNA, 25 bp, Mus musculus
tacgctcttcaaatggctgcactgg

SEQ ID NO: 462454 - DNA, 25 bp, Mus musculus
tacgctgaggcgtgtcgtttacccg

SEQ ID NO: 462455 - DNA, 25 bp, Mus musculus
tacgctgatatcttcaaccacagag

SEQ ID NO: 462456 - DNA, 25 bp, Mus musculus
tacgctgcaccaaaaggttctggac

SEQ ID NO: 462457 - DNA, 25 bp, Mus musculus
tacgctgcctgtacgggatgctaga

SEQ ID NO: 462458 - DNA, 25 bp, Mus musculus
tacgctggagacctgcttagaaaaa

SEQ ID NO: 462459 - DNA, 25 bp, Mus musculus
tacgctggctggacatttgacattg

SEQ ID NO: 462460 - DNA, 25 bp, Mus musculus
tacgctgggaagtcctgagagagcc

SEQ ID NO: 462461 - DNA, 25 bp, Mus musculus
tacgctgggcagtccgttacgctag

SEQ ID NO: 462462 - DNA, 25 bp, Mus musculus
tacgctggttagaggaaagaccccg

SEQ ID NO: 462463 - DNA, 25 bp, Mus musculus
tacgctgtcaccgatgtgcgcaagg

SEQ ID NO: 462464 - DNA, 25 bp, Mus musculus
tacgctgtgaccaggaaattctgtc

SEQ ID NO: 462465 - DNA, 25 bp, Mus musculus
tacgctgtgtcagaagataaccaga

SEQ ID NO: 462466 - DNA, 25 bp, Mus musculus
tacgcttccccagtgctatcagagg

SEQ ID NO: 462467 - DNA, 25 bp, Mus musculus
tacgctttcaggaggccgagtacaa

SEQ ID NO: 462468 - DNA, 25 bp, Mus musculus
tacgctttgtacagagggagcactc

SEQ ID NO: 462469 - DNA, 25 bp, Mus musculus
tacggaaccctgaaatcccagtgag

SEQ ID NO: 462470 - DNA, 25 bp, Mus musculus
tacggaacggtggtctttgcaggct

SEQ ID NO: 462471 - DNA, 25 bp, Mus musculus
tacggaagcctgtgcactcagtagg

SEQ ID NO: 462472 - DNA, 25 bp, Mus musculus
tacggaagctagaggaaaaacaggc

SEQ ID NO: 462473 - DNA, 25 bp, Mus musculus
tacggaatgtcaccaagtctgcagc

SEQ ID NO: 462474 - DNA, 25 bp, Mus musculus
tacggacacggagatcatgacgctg

SEQ ID NO: 462475 - DNA, 25 bp, Mus musculus
tacggacagacagcctaaaagggcg

SEQ ID NO: 462476 - DNA, 25 bp, Mus musculus
tacggaccatagaggaagaggcagc

SEQ ID NO: 462477 - DNA, 25 bp, Mus musculus
tacggacctgacgaccttatagaag

SEQ ID NO: 462478 - DNA, 25 bp, Mus musculus
tacggacctggaagaattggatgaa

SEQ ID NO: 462479 - DNA, 25 bp, Mus musculus
tacggactgccctataccaatggga

SEQ ID NO: 462480 - DNA, 25 bp, Mus musculus
tacggagcactctgcctcgaatacg

SEQ ID NO: 462481 - DNA, 25 bp, Mus musculus
tacggagccttggaaagcaacgaca

SEQ ID NO: 462482 - DNA, 25 bp, Mus musculus
tacggaggaggtcttcacagctcaa

SEQ ID NO: 462483 - DNA, 25 bp, Mus musculus
tacggaggcctcaacgagaagtctt

SEQ ID NO: 462484 - DNA, 25 bp, Mus musculus
tacggagggatcttccagtgacacg

SEQ ID NO: 462485 - DNA, 25 bp, Mus musculus
tacggagggtctcagaaagcctgca

SEQ ID NO: 462486 - DNA, 25 bp, Mus musculus
tacggataggcctagatgagaagcc

SEQ ID NO: 462487 - DNA, 25 bp, Mus musculus
tacggatcgtcctaggaatgctgct

SEQ ID NO: 462488 - DNA, 25 bp, Mus musculus
tacggatcgttctctccaacatgga

SEQ ID NO: 462489 - DNA, 25 bp, Mus musculus
tacggatctaacgtcttcccagagg

SEQ ID NO: 462490 - DNA, 25 bp, Mus musculus
tacggatcttactggaacaggctcg

SEQ ID NO: 462491 - DNA, 25 bp, Mus musculus
tacggatgatgcactagttacgttt

SEQ ID NO: 462492 - DNA, 25 bp, Mus musculus
tacggatggatggactttggccgcc

SEQ ID NO: 462493 - DNA, 25 bp, Mus musculus
tacggattccacgtttgagtcccaa

SEQ ID NO: 462494 - DNA, 25 bp, Mus musculus
tacggattcctagcggataccaaaa

SEQ ID NO: 462495 - DNA, 25 bp, Mus musculus
tacggattggcattcccatggcgga

SEQ ID NO: 462496 - DNA, 25 bp, Mus musculus
tacggatttacctcttttcggatgg

SEQ ID NO: 462497 - DNA, 25 bp, Mus musculus
tacggcaacatcgacaacaaacgga

SEQ ID NO: 462498 - DNA, 25 bp, Mus musculus
tacggcaactcctgtggctatggct

SEQ ID NO: 462499 - DNA, 25 bp, Mus musculus
tacggcaaggaaggattagacggca

SEQ ID NO: 462500 - DNA, 25 bp, Mus musculus
tacggcacaaagcagagtgtaccag

SEQ ID NO: 462501 - DNA, 25 bp, Mus musculus
tacggcaccccagagttagatgagg

SEQ ID NO: 462502 - DNA, 25 bp, Mus musculus
tacggcacgctggtcaaatatgttc

SEQ ID NO: 462503 - DNA, 25 bp, Mus musculus
tacggcagccgtccagtaatgatcg

SEQ ID NO: 462504 - DNA, 25 bp, Mus musculus
tacggcaggccattgaggagctaga

SEQ ID NO: 462505 - DNA, 25 bp, Mus musculus
tacggcaggttcaccatcaagtcgg

SEQ ID NO: 462506 - DNA, 25 bp, Mus musculus
tacggcagtcgctgccttctcaaca

SEQ ID NO: 462507 - DNA, 25 bp, Mus musculus
tacggcagtctgtgtcaaggtggtc

SEQ ID NO: 462508 - DNA, 25 bp, Mus musculus
tacggcagttccctggagttcacgg

SEQ ID NO: 462509 - DNA, 25 bp, Mus musculus
tacggcatccaaggcaagggactca

SEQ ID NO: 462510 - DNA, 25 bp, Mus musculus
tacggccaatccaagctgacagctt

SEQ ID NO: 462511 - DNA, 25 bp, Mus musculus
tacggccacccgacattgggaagaa

SEQ ID NO: 462512 - DNA, 25 bp, Mus musculus
tacggccagattcggaacagcgtca

SEQ ID NO: 462513 - DNA, 25 bp, Mus musculus
tacggccgcttctggtactaacaaa

SEQ ID NO: 462514 - DNA, 25 bp, Mus musculus
tacggccggaacacactcattcagt

SEQ ID NO: 462515 - DNA, 25 bp, Mus musculus
tacggcctatcatagcctcttatgt

SEQ ID NO: 462516 - DNA, 25 bp, Mus musculus
tacggcctctactctgccttcatgg

SEQ ID NO: 462517 - DNA, 25 bp, Mus musculus
tacggcctgttcctcaagggcattg

SEQ ID NO: 462518 - DNA, 25 bp, Mus musculus
tacggcggattggacttaagcatca

SEQ ID NO: 462519 - DNA, 25 bp, Mus musculus
tacggctacggctacaatggcatgg

SEQ ID NO: 462520 - DNA, 25 bp, Mus musculus
tacggctcatgaactgggtcactcc

SEQ ID NO: 462521 - DNA, 25 bp, Mus musculus
tacggctcatgggaaatgaccaccg

SEQ ID NO: 462522 - DNA, 25 bp, Mus musculus
tacggctgctgggtgtctatggctc

SEQ ID NO: 462523 - DNA, 25 bp, Mus musculus
tacggcttcaagagccactgcggga

SEQ ID NO: 462524 - DNA, 25 bp, Mus musculus
tacgggaaatcttcgcacctcaagg

SEQ ID NO: 462525 - DNA, 25 bp, Mus musculus
tacgggaatgccaccatgtctttga

SEQ ID NO: 462526 - DNA, 25 bp, Mus musculus
tacgggacctactgctatgccgaga

SEQ ID NO: 462527 - DNA, 25 bp, Mus musculus
tacgggacgtccattcggaaggcag

SEQ ID NO: 462528 - DNA, 25 bp, Mus musculus
tacgggactcgctgatgagacgaca

SEQ ID NO: 462529 - DNA, 25 bp, Mus musculus
tacgggagaaacagctgggctgcac

SEQ ID NO: 462530 - DNA, 25 bp, Mus musculus
tacgggagagaatcttgggcccctc

SEQ ID NO: 462531 - DNA, 25 bp, Mus musculus
tacgggaggcactgtccatgttggt

SEQ ID NO: 462532 - DNA, 25 bp, Mus musculus
tacgggaggccagtgatctagcatc

SEQ ID NO: 462533 - DNA, 25 bp, Mus musculus
tacgggatagtcagagtaaccccag

SEQ ID NO: 462534 - DNA, 25 bp, Mus musculus
tacgggatcgcacagtactgctgca

SEQ ID NO: 462535 - DNA, 25 bp, Mus musculus
tacgggattctctcaggttaatatg

SEQ ID NO: 462536 - DNA, 25 bp, Mus musculus
tacgggcacagaaacttgtggcttg

SEQ ID NO: 462537 - DNA, 25 bp, Mus musculus
tacgggcacgagcactttaggctgc

SEQ ID NO: 462538 - DNA, 25 bp, Mus musculus
tacgggcactgctctgggcatctct

SEQ ID NO: 462539 - DNA, 25 bp, Mus musculus
tacgggcctggtgtaccaatagaag

SEQ ID NO: 462540 - DNA, 25 bp, Mus musculus
tacgggctagcccagagtaatgagc

SEQ ID NO: 462541 - DNA, 25 bp, Mus musculus
tacgggctcatgtacttcgggccag

SEQ ID NO: 462542 - DNA, 25 bp, Mus musculus
tacgggctggctgggtcctcagacc

SEQ ID NO: 462543 - DNA, 25 bp, Mus musculus
tacgggcttgcactatgggatcatc

SEQ ID NO: 462544 - DNA, 25 bp, Mus musculus
tacgggtccctagaacagttcatcc

SEQ ID NO: 462545 - DNA, 25 bp, Mus musculus
tacgggtccgttgacgaatgcatgg

SEQ ID NO: 462546 - DNA, 25 bp, Mus musculus
tacgggtcgttgcttcatcaggaag

SEQ ID NO: 462547 - DNA, 25 bp, Mus musculus
tacgggtgctatttgtgccgcgaca

SEQ ID NO: 462548 - DNA, 25 bp, Mus musculus
tacggtagagatgaaccaagcctgg

SEQ ID NO: 462549 - DNA, 25 bp, Mus musculus
tacggtagccttgggaacctttcag

SEQ ID NO: 462550 - DNA, 25 bp, Mus musculus
tacggtatggcggaaatcctcaaca

SEQ ID NO: 462551 - DNA, 25 bp, Mus musculus
tacggtcacgtcctgaatttgcgac

SEQ ID NO: 462552 - DNA, 25 bp, Mus musculus
tacggtcggacggacgacaagatct

SEQ ID NO: 462553 - DNA, 25 bp, Mus musculus
tacggtcgtgtttgtcaactcaaaa

SEQ ID NO: 462554 - DNA, 25 bp, Mus musculus
tacggtgaccactgtgatgggcagc

SEQ ID NO: 462555 - DNA, 25 bp, Mus musculus
tacggtgactatgacatgcccctgg

SEQ ID NO: 462556 - DNA, 25 bp, Mus musculus
tacggtgcttgtgtctgagcttcgc

SEQ ID NO: 462557 - DNA, 25 bp, Mus musculus
tacggtgtacagagtcacagtagcc

SEQ ID NO: 462558 - DNA, 25 bp, Mus musculus
tacggtgtgaccactggaagcctgc

SEQ ID NO: 462559 - DNA, 25 bp, Mus musculus
tacggtgtgtcctccaagtacagag

SEQ ID NO: 462560 - DNA, 25 bp, Mus musculus
tacggtgtgtcgatgcaaaccaggc

SEQ ID NO: 462561 - DNA, 25 bp, Mus musculus
tacggttgtggcattgaatgttcag

SEQ ID NO: 462562 - DNA, 25 bp, Mus musculus
tacggtttcccttggcccgagatgc

SEQ ID NO: 462563 - DNA, 25 bp, Mus musculus
tacggtttctgcatggctaccctgc

SEQ ID NO: 462564 - DNA, 25 bp, Mus musculus
tacgtacgccatgaagagacactga

SEQ ID NO: 462565 - DNA, 25 bp, Mus musculus
tacgtactagaggttcggcactttc

SEQ ID NO: 462566 - DNA, 25 bp, Mus musculus
tacgtactgtgtccggacaacggct

SEQ ID NO: 462567 - DNA, 25 bp, Mus musculus
tacgtagaagccacggaattcccat

SEQ ID NO: 462568 - DNA, 25 bp, Mus musculus
tacgtagaagccatcggaacaccag

SEQ ID NO: 462569 - DNA, 25 bp, Mus musculus
tacgtagatgacaatgggactcggc

SEQ ID NO: 462570 - DNA, 25 bp, Mus musculus
tacgtagcagccagcaaggtttttc

SEQ ID NO: 462571 - DNA, 25 bp, Mus musculus
tacgtaggcctatgagaaacacaga

SEQ ID NO: 462572 - DNA, 25 bp, Mus musculus
tacgtagtgctgagctggaaacccc

SEQ ID NO: 462573 - DNA, 25 bp, Mus musculus
tacgtatgcacctgccgagaaggct

SEQ ID NO: 462574 - DNA, 25 bp, Mus musculus
tacgtatgtatggactctgaggcac

SEQ ID NO: 462575 - DNA, 25 bp, Mus musculus
tacgtcaacgcattgtggacttggc

SEQ ID NO: 462576 - DNA, 25 bp, Mus musculus
tacgtcaagcctgtagcctcggagg

SEQ ID NO: 462577 - DNA, 25 bp, Mus musculus
tacgtcaatggtgaatgggtccccg

SEQ ID NO: 462578 - DNA, 25 bp, Mus musculus
tacgtcactgtggagccgtgcatca

SEQ ID NO: 462579 - DNA, 25 bp, Mus musculus
tacgtcagcatcctgtcgtttgtag

SEQ ID NO: 462580 - DNA, 25 bp, Mus musculus
tacgtcatcacacacggcgaggaga

SEQ ID NO: 462581 - DNA, 25 bp, Mus musculus
tacgtcatgagtggtagcaggcatc

SEQ ID NO: 462582 - DNA, 25 bp, Mus musculus
tacgtcatgatctgccagcaccaag

SEQ ID NO: 462583 - DNA, 25 bp, Mus musculus
tacgtcattcgaggtatggcacccc

SEQ ID NO: 462584 - DNA, 25 bp, Mus musculus
tacgtccacctaaaagccaggcagt

SEQ ID NO: 462585 - DNA, 25 bp, Mus musculus
tacgtccgtttcgttgtcggtatcg

SEQ ID NO: 462586 - DNA, 25 bp, Mus musculus
tacgtcctgctgaaagctctggccc

SEQ ID NO: 462587 - DNA, 25 bp, Mus musculus
tacgtcctggccttacacagattcc

SEQ ID NO: 462588 - DNA, 25 bp, Mus musculus
tacgtcctgggtacaactgtgctgc

SEQ ID NO: 462589 - DNA, 25 bp, Mus musculus
tacgtcgcatctcgagaagggcacc

SEQ ID NO: 462590 - DNA, 25 bp, Mus musculus
tacgtctatttggtggccaggcggc

SEQ ID NO: 462591 - DNA, 25 bp, Mus musculus
tacgtcttcgattgctttagcctgg

SEQ ID NO: 462592 - DNA, 25 bp, Mus musculus
tacgtctttgtcgtgccagtagaag

SEQ ID NO: 462593 - DNA, 25 bp, Mus musculus
tacgtgaaacacatctacagctcgg

SEQ ID NO: 462594 - DNA, 25 bp, Mus musculus
tacgtgaaagagacagtggaccgac

SEQ ID NO: 462595 - DNA, 25 bp, Mus musculus
tacgtgaacagagggaaacttggac

SEQ ID NO: 462596 - DNA, 25 bp, Mus musculus
tacgtgaaccaagtcaaagtgcgag

SEQ ID NO: 462597 - DNA, 25 bp, Mus musculus
tacgtgaagaaggagacgtcgcccc

SEQ ID NO: 462598 - DNA, 25 bp, Mus musculus
tacgtgacagaagcatccatgaaca

SEQ ID NO: 462599 - DNA, 25 bp, Mus musculus
tacgtgacatacaagggagtctgac

SEQ ID NO: 462600 - DNA, 25 bp, Mus musculus
tacgtgacgacttgcgtgggcaaga

SEQ ID NO: 462601 - DNA, 25 bp, Mus musculus
tacgtgagctaccttctggacaagg

SEQ ID NO: 462602 - DNA, 25 bp, Mus musculus
tacgtgagggtgacacacagaaggc

SEQ ID NO: 462603 - DNA, 25 bp, Mus musculus
tacgtgagtgtacgccataagcttg

SEQ ID NO: 462604 - DNA, 25 bp, Mus musculus
tacgtgcacagttttgaagacccaa

SEQ ID NO: 462605 - DNA, 25 bp, Mus musculus
tacgtgcagggcatgtgtgatctcc

SEQ ID NO: 462606 - DNA, 25 bp, Mus musculus
tacgtgcagtgacaaacagtacctc

SEQ ID NO: 462607 - DNA, 25 bp, Mus musculus
tacgtgcagtgtctcagatcatgcc

SEQ ID NO: 462608 - DNA, 25 bp, Mus musculus
tacgtgcatctcgtcatatggctgc

SEQ ID NO: 462609 - DNA, 25 bp, Mus musculus
tacgtgccaatcactgtgtaaatag

SEQ ID NO: 462610 - DNA, 25 bp, Mus musculus
tacgtgcctccctggaaacgaagtg

SEQ ID NO: 462611 - DNA, 25 bp, Mus musculus
tacgtgcctgctcagactggaaacc

SEQ ID NO: 462612 - DNA, 25 bp, Mus musculus
tacgtggaaagtacacacacctgcc

SEQ ID NO: 462613 - DNA, 25 bp, Mus musculus
tacgtggaagtaatggcctgccctt

SEQ ID NO: 462614 - DNA, 25 bp, Mus musculus
tacgtggagatctggagcggccttt

SEQ ID NO: 462615 - DNA, 25 bp, Mus musculus
tacgtggagtgcaggcagtgtacac

SEQ ID NO: 462616 - DNA, 25 bp, Mus musculus
tacgtggccaaaggtgcatctcgag

SEQ ID NO: 462617 - DNA, 25 bp, Mus musculus
tacgtggccaatagcactagctgca

SEQ ID NO: 462618 - DNA, 25 bp, Mus musculus
tacgtggccaggtgcttctgagcaa

SEQ ID NO: 462619 - DNA, 25 bp, Mus musculus
tacgtggctcaacttgttagcagaa

SEQ ID NO: 462620 - DNA, 25 bp, Mus musculus
tacgtggcttggttgatgggactca

SEQ ID NO: 462621 - DNA, 25 bp, Mus musculus
tacgtgggactgtgtcttcgaaagc

SEQ ID NO: 462622 - DNA, 25 bp, Mus musculus
tacgtgggttccaggcactgaactc

SEQ ID NO: 462623 - DNA, 25 bp, Mus musculus
tacgtggtagccaagagagaaagcc

SEQ ID NO: 462624 - DNA, 25 bp, Mus musculus
tacgtggttcttagctgccgggaga

SEQ ID NO: 462625 - DNA, 25 bp, Mus musculus
tacgtgtagcttcttggcctccaac

SEQ ID NO: 462626 - DNA, 25 bp, Mus musculus
tacgtgtgtctttttgctgagggca

SEQ ID NO: 462627 - DNA, 25 bp, Mus musculus
tacgtgtttgtggtatggatgtcca

SEQ ID NO: 462628 - DNA, 25 bp, Mus musculus
tacgttattattaccgccgcgacat

SEQ ID NO: 462629 - DNA, 25 bp, Mus musculus
tacgttctaatgctcactgctgttg

SEQ ID NO: 462630 - DNA, 25 bp, Mus musculus
tacgttctccagtaggaaggccact

SEQ ID NO: 462631 - DNA, 25 bp, Mus musculus
tacgttctctgacgtggtgagcgcc

SEQ ID NO: 462632 - DNA, 25 bp, Mus musculus
tacgttctgaagtatgctgcaccga

SEQ ID NO: 462633 - DNA, 25 bp, Mus musculus
tacgttctttcttgactggttcagc

SEQ ID NO: 462634 - DNA, 25 bp, Mus musculus
tacgttgaccctaagacaggcgtgg

SEQ ID NO: 462635 - DNA, 25 bp, Mus musculus
tacgttggaccagaggctgcttccc

SEQ ID NO: 462636 - DNA, 25 bp, Mus musculus
tacgttggcagagacagagtgccgc

SEQ ID NO: 462637 - DNA, 25 bp, Mus musculus
tacgtttaaggaaagtgcaatggct

SEQ ID NO: 462638 - DNA, 25 bp, Mus musculus
tacgtttcacaaggagtggtggcaa

SEQ ID NO: 462639 - DNA, 25 bp, Mus musculus
tacgtttcacaggtttgcaggcgac

SEQ ID NO: 462640 - DNA, 25 bp, Mus musculus
tacgtttggcaatctagggtcatag

SEQ ID NO: 462641 - DNA, 25 bp, Mus musculus
tacgtttgtattttcggcaccacca

SEQ ID NO: 462642 - DNA, 25 bp, Mus musculus
tacgttttggagatcacagccaggg

SEQ ID NO: 462643 - DNA, 25 bp, Mus musculus
tactaaaaacaataaccagacggcg

SEQ ID NO: 462644 - DNA, 25 bp, Mus musculus
tactaaaaacatcaatgggcctgtg

SEQ ID NO: 462645 - DNA, 25 bp, Mus musculus
tactaaaagctcatgtccaacctgg

SEQ ID NO: 462646 - DNA, 25 bp, Mus musculus
tactaaaaggtgctacccatgtcta

SEQ ID NO: 462647 - DNA, 25 bp, Mus musculus
tactaaacatgtactgtgccactag

SEQ ID NO: 462648 - DNA, 25 bp, Mus musculus
tactaaagacttggagaaccggatg

SEQ ID NO: 462649 - DNA, 25 bp, Mus musculus
tactaaagagacatcacatgggctg

SEQ ID NO: 462650 - DNA, 25 bp, Mus musculus
tactaaagctttcatccctgccaag

SEQ ID NO: 462651 - DNA, 25 bp, Mus musculus
tactaaatggcaatagctcaggatt

SEQ ID NO: 462652 - DNA, 25 bp, Mus musculus
tactaaattactagaacagactggt

SEQ ID NO: 462653 - DNA, 25 bp, Mus musculus
tactaaattatgatcagagaagatg

SEQ ID NO: 462654 - DNA, 25 bp, Mus musculus
tactaacagaagcagggacaaagac

SEQ ID NO: 462655 - DNA, 25 bp, Mus musculus
tactaacagtggtgagaggagcacc

SEQ ID NO: 462656 - DNA, 25 bp, Mus musculus
tactaacccctcgtgctgggaggag

SEQ ID NO: 462657 - DNA, 25 bp, Mus musculus
tactaacgtacagtgagcagctcct

SEQ ID NO: 462658 - DNA, 25 bp, Mus musculus
tactaacgttggtttgggaagagcg

SEQ ID NO: 462659 - DNA, 25 bp, Mus musculus
tactaactattcaggacttactgtt

SEQ ID NO: 462660 - DNA, 25 bp, Mus musculus
tactaactgtggcagctgcgaccaa

SEQ ID NO: 462661 - DNA, 25 bp, Mus musculus
tactaactttttctgacattctggc

SEQ ID NO: 462662 - DNA, 25 bp, Mus musculus
tactaagaaggctcggaataaccgc

SEQ ID NO: 462663 - DNA, 25 bp, Mus musculus
tactaagacacatagctttgctgca

SEQ ID NO: 462664 - DNA, 25 bp, Mus musculus
tactaagagatgctgtagcagactg

SEQ ID NO: 462665 - DNA, 25 bp, Mus musculus
tactaagaggccgtgacacttggtt

SEQ ID NO: 462666 - DNA, 25 bp, Mus musculus
tactaagccgtcctttcggagccgg

SEQ ID NO: 462667 - DNA, 25 bp, Mus musculus
tactaagctagaacaacaccatggg

SEQ ID NO: 462668 - DNA, 25 bp, Mus musculus
tactaaggaaggcaagagaatatct

SEQ ID NO: 462669 - DNA, 25 bp, Mus musculus
tactaaggagatcccctggtgcctg

SEQ ID NO: 462670 - DNA, 25 bp, Mus musculus
tactaaggaggaggtcgctgagttc

SEQ ID NO: 462671 - DNA, 25 bp, Mus musculus
tactaaggcctttgcccgatgggtg

SEQ ID NO: 462672 - DNA, 25 bp, Mus musculus
tactaataacatggaggtagcgccc

SEQ ID NO: 462673 - DNA, 25 bp, Mus musculus
tactaatccgggagtcacactgcgg

SEQ ID NO: 462674 - DNA, 25 bp, Mus musculus
tactaatgtggtgattggaggtccc

SEQ ID NO: 462675 - DNA, 25 bp, Mus musculus
tactaattacgacgatgccatgcag

SEQ ID NO: 462676 - DNA, 25 bp, Mus musculus
tactaatttattgccgtcctggact

SEQ ID NO: 462677 - DNA, 25 bp, Mus musculus
tactacaacgagaaatgccaggcca

SEQ ID NO: 462678 - DNA, 25 bp, Mus musculus
tactacaacgccaactgggagctgg

SEQ ID NO: 462679 - DNA, 25 bp, Mus musculus
tactacaacgcctggatcgagcggc

SEQ ID NO: 462680 - DNA, 25 bp, Mus musculus
tactacaagagaccagaggacgact

SEQ ID NO: 462681 - DNA, 25 bp, Mus musculus
tactacaagagagctgcagtcgcct

SEQ ID NO: 462682 - DNA, 25 bp, Mus musculus
tactacaagctgtacctggtgcggc

SEQ ID NO: 462683 - DNA, 25 bp, Mus musculus
tactacaatgacacagagaggctcc

SEQ ID NO: 462684 - DNA, 25 bp, Mus musculus
tactacacataaaggatggaccgga

SEQ ID NO: 462685 - DNA, 25 bp, Mus musculus
tactacagaatcaagagaattggct

SEQ ID NO: 462686 - DNA, 25 bp, Mus musculus
tactacagactgctgaccgatgggc

SEQ ID NO: 462687 - DNA, 25 bp, Mus musculus
tactacagagaggactgcagaatgc

SEQ ID NO: 462688 - DNA, 25 bp, Mus musculus
tactacagaggagcaatgggcatca

SEQ ID NO: 462689 - DNA, 25 bp, Mus musculus
tactacaggatacttagaggaaact

SEQ ID NO: 462690 - DNA, 25 bp, Mus musculus
tactacaggttcttggcgaagcagg

SEQ ID NO: 462691 - DNA, 25 bp, Mus musculus
tactacagtcagtcgcagctggcca

SEQ ID NO: 462692 - DNA, 25 bp, Mus musculus
tactacagtccagataaagtccagg

SEQ ID NO: 462693 - DNA, 25 bp, Mus musculus
tactacatcagcaaacggaaacggg

SEQ ID NO: 462694 - DNA, 25 bp, Mus musculus
tactacatggactacctggcagcct

SEQ ID NO: 462695 - DNA, 25 bp, Mus musculus
tactacatggttgattccacagtcc

SEQ ID NO: 462696 - DNA, 25 bp, Mus musculus
tactacattaatggtgcctggacta

SEQ ID NO: 462697 - DNA, 25 bp, Mus musculus
tactaccagagatcggagccaaagg

SEQ ID NO: 462698 - DNA, 25 bp, Mus musculus
tactaccagatcagagaaaagctct

SEQ ID NO: 462699 - DNA, 25 bp, Mus musculus
tactaccagctaggagaccatgagc

SEQ ID NO: 462700 - DNA, 25 bp, Mus musculus
tactaccgcaagtttatccagcagg

SEQ ID NO: 462701 - DNA, 25 bp, Mus musculus
tactaccgcaggactaagagtgaca

SEQ ID NO: 462702 - DNA, 25 bp, Mus musculus
tactaccgtaggaagcacaaactgg

SEQ ID NO: 462703 - DNA, 25 bp, Mus musculus
tactacctgatggatccaagcggga

SEQ ID NO: 462704 - DNA, 25 bp, Mus musculus
tactacctgatggatgctgcctcct

SEQ ID NO: 462705 - DNA, 25 bp, Mus musculus
tactacctgcgacagatagtcctgg

SEQ ID NO: 462706 - DNA, 25 bp, Mus musculus
tactacctggcccagtaccgtggtg

SEQ ID NO: 462707 - DNA, 25 bp, Mus musculus
tactacctgtctctgcaccttggga

SEQ ID NO: 462708 - DNA, 25 bp, Mus musculus
tactacgaggaggtggctcacgtgc

SEQ ID NO: 462709 - DNA, 25 bp, Mus musculus
tactacgatgccatgggaaatcccc

SEQ ID NO: 462710 - DNA, 25 bp, Mus musculus
tactacgcgatcactagagggcggc

SEQ ID NO: 462711 - DNA, 25 bp, Mus musculus
tactacgcgcatactggatgaagca

SEQ ID NO: 462712 - DNA, 25 bp, Mus musculus
tactacgcgtgttcgacgaccagga

SEQ ID NO: 462713 - DNA, 25 bp, Mus musculus
tactacgctactatgagtctccctg

SEQ ID NO: 462714 - DNA, 25 bp, Mus musculus
tactacggatgtggagagatgccgc

SEQ ID NO: 462715 - DNA, 25 bp, Mus musculus
tactacggcagctactacggaggtc

SEQ ID NO: 462716 - DNA, 25 bp, Mus musculus
tactacggttcactgggcatgagcc

SEQ ID NO: 462717 - DNA, 25 bp, Mus musculus
tactactgaggagctgaaactttgg

SEQ ID NO: 462718 - DNA, 25 bp, Mus musculus
tactactggagaagttggcaagccc

SEQ ID NO: 462719 - DNA, 25 bp, Mus musculus
tactactggtttcgttgtcccaagg

SEQ ID NO: 462720 - DNA, 25 bp, Mus musculus
tactacttatgtctgaggcactgta

SEQ ID NO: 462721 - DNA, 25 bp, Mus musculus
tactacttcggctcggtgaacgcat

SEQ ID NO: 462722 - DNA, 25 bp, Mus musculus
tactacttgtctatgccagaggaag

SEQ ID NO: 462723 - DNA, 25 bp, Mus musculus
tactactttaccaagaccaaaattg

SEQ ID NO: 462724 - DNA, 25 bp, Mus musculus
tactactttcggagcactgcgcaga

SEQ ID NO: 462725 - DNA, 25 bp, Mus musculus
tactagaaggtttcagccagcactc

SEQ ID NO: 462726 - DNA, 25 bp, Mus musculus
tactagactaacaacactcttgccc

SEQ ID NO: 462727 - DNA, 25 bp, Mus musculus
tactagagaaagtgaaatgggccaa

SEQ ID NO: 462728 - DNA, 25 bp, Mus musculus
tactagagcacctgcgacagaggac

SEQ ID NO: 462729 - DNA, 25 bp, Mus musculus
tactagagcccgtgtgtcaccagct

SEQ ID NO: 462730 - DNA, 25 bp, Mus musculus
tactagagcttctgatggacattca

SEQ ID NO: 462731 - DNA, 25 bp, Mus musculus
tactagaggcttcacgctgaggaga

SEQ ID NO: 462732 - DNA, 25 bp, Mus musculus
tactagaggtgtgtggacaaagccc

SEQ ID NO: 462733 - DNA, 25 bp, Mus musculus
tactagcacctagatatttcgggac

SEQ ID NO: 462734 - DNA, 25 bp, Mus musculus
tactagcccaacagaagacaaagca

SEQ ID NO: 462735 - DNA, 25 bp, Mus musculus
tactagcctagcaaatgtgagccct

SEQ ID NO: 462736 - DNA, 25 bp, Mus musculus
tactagcctgcatcagcatggaccg

SEQ ID NO: 462737 - DNA, 25 bp, Mus musculus
tactagctgctcttcttgtgacccg

SEQ ID NO: 462738 - DNA, 25 bp, Mus musculus
tactaggaagggtcaagccatactg

SEQ ID NO: 462739 - DNA, 25 bp, Mus musculus
tactaggcatctgggtatctaccac

SEQ ID NO: 462740 - DNA, 25 bp, Mus musculus
tactaggcctggaagggctgttccc

SEQ ID NO: 462741 - DNA, 25 bp, Mus musculus
tactagtgggagctaacacctttgc

SEQ ID NO: 462742 - DNA, 25 bp, Mus musculus
tactagtgtaacacgtgtgctctcc

SEQ ID NO: 462743 - DNA, 25 bp, Mus musculus
tactagttcccggatggtggtggcc

SEQ ID NO: 462744 - DNA, 25 bp, Mus musculus
tactataattcttctggatgggcag

SEQ ID NO: 462745 - DNA, 25 bp, Mus musculus
tactatagctcaagccagctttgcc

SEQ ID NO: 462746 - DNA, 25 bp, Mus musculus
tactatagctcctgtaacggtggca

SEQ ID NO: 462747 - DNA, 25 bp, Mus musculus
tactatatacgtagcagaggctgac

SEQ ID NO: 462748 - DNA, 25 bp, Mus musculus
tactatcactatggttgcgatggac

SEQ ID NO: 462749 - DNA, 25 bp, Mus musculus
tactatcagcccatgagagccagag

SEQ ID NO: 462750 - DNA, 25 bp, Mus musculus
tactatcagctcgagcaggtcaagg

SEQ ID NO: 462751 - DNA, 25 bp, Mus musculus
tactatcagggaaagccatgctggg

SEQ ID NO: 462752 - DNA, 25 bp, Mus musculus
tactatccagatgagtgaccacctg

SEQ ID NO: 462753 - DNA, 25 bp, Mus musculus
tactatccggatctgaaaggacggg

SEQ ID NO: 462754 - DNA, 25 bp, Mus musculus
tactatcgccgcacggctgaatact

SEQ ID NO: 462755 - DNA, 25 bp, Mus musculus
tactatctcaactctttgctgacga

SEQ ID NO: 462756 - DNA, 25 bp, Mus musculus
tactatctcctctccttaaggcagc

SEQ ID NO: 462757 - DNA, 25 bp, Mus musculus
tactatctctgccttagaagcgccc

SEQ ID NO: 462758 - DNA, 25 bp, Mus musculus
tactatcttcccaggtagggctcca

SEQ ID NO: 462759 - DNA, 25 bp, Mus musculus
tactatcttttctaccctaataagt

SEQ ID NO: 462760 - DNA, 25 bp, Mus musculus
tactatgaaagaggacactgtcccc

SEQ ID NO: 462761 - DNA, 25 bp, Mus musculus
tactatgaccatcagcgcatgcagg

SEQ ID NO: 462762 - DNA, 25 bp, Mus musculus
tactatgactactcgggcaagcggc

SEQ ID NO: 462763 - DNA, 25 bp, Mus musculus
tactatgagtgcaaagttcctgcca

SEQ ID NO: 462764 - DNA, 25 bp, Mus musculus
tactatgatacgaagcccggtcttt

SEQ ID NO: 462765 - DNA, 25 bp, Mus musculus
tactatgatggctaccaggcccagc

SEQ ID NO: 462766 - DNA, 25 bp, Mus musculus
tactatgcacgcacagatgccagga

SEQ ID NO: 462767 - DNA, 25 bp, Mus musculus
tactatgccactgccctgaagagtc

SEQ ID NO: 462768 - DNA, 25 bp, Mus musculus
tactatgctaaagaggtcacccgcg

SEQ ID NO: 462769 - DNA, 25 bp, Mus musculus
tactatgctagagtggaaggccgag

SEQ ID NO: 462770 - DNA, 25 bp, Mus musculus
tactatgctctactatggaccatcc

SEQ ID NO: 462771 - DNA, 25 bp, Mus musculus
tactatggaaactcaaatggtgccc

SEQ ID NO: 462772 - DNA, 25 bp, Mus musculus
tactatggacaggactatcggaaca

SEQ ID NO: 462773 - DNA, 25 bp, Mus musculus
tactatggagtaggttctgctaagc

SEQ ID NO: 462774 - DNA, 25 bp, Mus musculus
tactatggattcagtccaggccctg

SEQ ID NO: 462775 - DNA, 25 bp, Mus musculus
tactatggccacgaggaagagctgc

SEQ ID NO: 462776 - DNA, 25 bp, Mus musculus
tactatggtggacaaaaggtgcccc

SEQ ID NO: 462777 - DNA, 25 bp, Mus musculus
tactatgtcaccacaatggcattgt

SEQ ID NO: 462778 - DNA, 25 bp, Mus musculus
tactatgtctttgaacgctgggaaa

SEQ ID NO: 462779 - DNA, 25 bp, Mus musculus
tactatgtggaccagcgcactgtgg

SEQ ID NO: 462780 - DNA, 25 bp, Mus musculus
tactatgtggagagcattgcggact

SEQ ID NO: 462781 - DNA, 25 bp, Mus musculus
tactatgtgtcctaccgaagaagcc

SEQ ID NO: 462782 - DNA, 25 bp, Mus musculus
tactatgttggaacttggcctggct

SEQ ID NO: 462783 - DNA, 25 bp, Mus musculus
tactattagaagaggcaccacacac

SEQ ID NO: 462784 - DNA, 25 bp, Mus musculus
tactattcagggagcccgggagaga

SEQ ID NO: 462785 - DNA, 25 bp, Mus musculus
tactattcgaagagatggccgggac

SEQ ID NO: 462786 - DNA, 25 bp, Mus musculus
tactattgccgcgaggttcctgact

SEQ ID NO: 462787 - DNA, 25 bp, Mus musculus
tactatttatagcttcagacagggc

SEQ ID NO: 462788 - DNA, 25 bp, Mus musculus
tactatttcgaggagattaacacgc

SEQ ID NO: 462789 - DNA, 25 bp, Mus musculus
tactcaaacacgctacaagaggttg

SEQ ID NO: 462790 - DNA, 25 bp, Mus musculus
tactcaaacaggaagggatagccac

SEQ ID NO: 462791 - DNA, 25 bp, Mus musculus
tactcaaactctgaacagtgcgctg

SEQ ID NO: 462792 - DNA, 25 bp, Mus musculus
tactcaaagtgagggacaaaactac

SEQ ID NO: 462793 - DNA, 25 bp, Mus musculus
tactcaacaatgatcggcagaacgc

SEQ ID NO: 462794 - DNA, 25 bp, Mus musculus
tactcaacctcgtcttggctccgag

SEQ ID NO: 462795 - DNA, 25 bp, Mus musculus
tactcaacgttaagctagccctgga

SEQ ID NO: 462796 - DNA, 25 bp, Mus musculus
tactcaactcaggtcgttaggcatg

SEQ ID NO: 462797 - DNA, 25 bp, Mus musculus
tactcaagagaatgcaacctgtgcc

SEQ ID NO: 462798 - DNA, 25 bp, Mus musculus
tactcaagcagccaacgttagcagc

SEQ ID NO: 462799 - DNA, 25 bp, Mus musculus
tactcaaggctatgcacactggtag

SEQ ID NO: 462800 - DNA, 25 bp, Mus musculus
tactcaatgaggaggtggcacgcag

SEQ ID NO: 462801 - DNA, 25 bp, Mus musculus
tactcaattcagtgcggctggctcc

SEQ ID NO: 462802 - DNA, 25 bp, Mus musculus
tactcaattccagatatggtagagg

SEQ ID NO: 462803 - DNA, 25 bp, Mus musculus
tactcacagttaagctgtagtgaca

SEQ ID NO: 462804 - DNA, 25 bp, Mus musculus
tactcaccagatcagcgtggagcag

SEQ ID NO: 462805 - DNA, 25 bp, Mus musculus
tactcacccacctcggaagcaaaat

SEQ ID NO: 462806 - DNA, 25 bp, Mus musculus
tactcacccctgttctcagactaag

SEQ ID NO: 462807 - DNA, 25 bp, Mus musculus
tactcaccctccagacaagaagctg

SEQ ID NO: 462808 - DNA, 25 bp, Mus musculus
tactcacctgaaagacagcgctcgc

SEQ ID NO: 462809 - DNA, 25 bp, Mus musculus
tactcactagtctcatctccttctg

SEQ ID NO: 462810 - DNA, 25 bp, Mus musculus
tactcactcatgagttggtcagtgt

SEQ ID NO: 462811 - DNA, 25 bp, Mus musculus
tactcactgtcatactaatagggtg

SEQ ID NO: 462812 - DNA, 25 bp, Mus musculus
tactcagaacatttcagggcagcct

SEQ ID NO: 462813 - DNA, 25 bp, Mus musculus
tactcagaagcccatacacagggtc

SEQ ID NO: 462814 - DNA, 25 bp, Mus musculus
tactcagaagctccaaaggcattgc

SEQ ID NO: 462815 - DNA, 25 bp, Mus musculus
tactcagaagtgtgatccccaccag

SEQ ID NO: 462816 - DNA, 25 bp, Mus musculus
tactcagacaaccagagcagcgtgc

SEQ ID NO: 462817 - DNA, 25 bp, Mus musculus
tactcagagctggtattacaacagg

SEQ ID NO: 462818 - DNA, 25 bp, Mus musculus
tactcagagggctcgctttgaggcc

SEQ ID NO: 462819 - DNA, 25 bp, Mus musculus
tactcagagtaagcaccagctggag

SEQ ID NO: 462820 - DNA, 25 bp, Mus musculus
tactcagatactgggcacagtcagg

SEQ ID NO: 462821 - DNA, 25 bp, Mus musculus
tactcagatgagtcgtccagacctg

SEQ ID NO: 462822 - DNA, 25 bp, Mus musculus
tactcagattgctggtcaggtcacc

SEQ ID NO: 462823 - DNA, 25 bp, Mus musculus
tactcagccaatgtgatggtggaca

SEQ ID NO: 462824 - DNA, 25 bp, Mus musculus
tactcagccttctctgtgggccgca

SEQ ID NO: 462825 - DNA, 25 bp, Mus musculus
tactcaggataaagggagggaagca

SEQ ID NO: 462826 - DNA, 25 bp, Mus musculus
tactcaggcccgtcacgtgtgatac

SEQ ID NO: 462827 - DNA, 25 bp, Mus musculus
tactcaggccggttcagcagaatgg

SEQ ID NO: 462828 - DNA, 25 bp, Mus musculus
tactcagggcaaaggacccatctgg

SEQ ID NO: 462829 - DNA, 25 bp, Mus musculus
tactcagggcgtgaacagctcacct

SEQ ID NO: 462830 - DNA, 25 bp, Mus musculus
tactcagtattaccgggctccggag

SEQ ID NO: 462831 - DNA, 25 bp, Mus musculus
tactcagtcatgaccagcaaggaca

SEQ ID NO: 462832 - DNA, 25 bp, Mus musculus
tactcagtgaggaacgacaagaaca

SEQ ID NO: 462833 - DNA, 25 bp, Mus musculus
tactcataccagttcgcacaggcgg

SEQ ID NO: 462834 - DNA, 25 bp, Mus musculus
tactcataccctcaggtgcagggcg

SEQ ID NO: 462835 - DNA, 25 bp, Mus musculus
tactcatcctataagccatggtggg

SEQ ID NO: 462836 - DNA, 25 bp, Mus musculus
tactcatcttctagtgactggcttg

SEQ ID NO: 462837 - DNA, 25 bp, Mus musculus
tactcatgactgttgctacaagcgc

SEQ ID NO: 462838 - DNA, 25 bp, Mus musculus
tactccaaagtgcagctgagcggcg

SEQ ID NO: 462839 - DNA, 25 bp, Mus musculus
tactccaagacgcagaagctgtcca

SEQ ID NO: 462840 - DNA, 25 bp, Mus musculus
tactccaagctggtaacagaaaacg

SEQ ID NO: 462841 - DNA, 25 bp, Mus musculus
tactccaagttaatgcatctggcgt

SEQ ID NO: 462842 - DNA, 25 bp, Mus musculus
tactccagaaggatggttctcctgc

SEQ ID NO: 462843 - DNA, 25 bp, Mus musculus
tactccagagagtcggaagacagct

SEQ ID NO: 462844 - DNA, 25 bp, Mus musculus
tactccagaggctaggtgaagcccc

SEQ ID NO: 462845 - DNA, 25 bp, Mus musculus
tactccagcaacgaattcattgtgg

SEQ ID NO: 462846 - DNA, 25 bp, Mus musculus
tactccagcgacctgtgcagctgga

SEQ ID NO: 462847 - DNA, 25 bp, Mus musculus
tactccaggatcatagaagggcagg

SEQ ID NO: 462848 - DNA, 25 bp, Mus musculus
tactccagtgctttctgcaggtcgg

SEQ ID NO: 462849 - DNA, 25 bp, Mus musculus
tactccatgcagatgagacctggtt

SEQ ID NO: 462850 - DNA, 25 bp, Mus musculus
tactcccaagtctgtgaggttccga

SEQ ID NO: 462851 - DNA, 25 bp, Mus musculus
tactcccagtggtgttgggacagat

SEQ ID NO: 462852 - DNA, 25 bp, Mus musculus
tactcccagtgtgccttcaatggcg

SEQ ID NO: 462853 - DNA, 25 bp, Mus musculus
tactcccatggccaaagctgtttag

SEQ ID NO: 462854 - DNA, 25 bp, Mus musculus
tactcccgggtcttgggctcaaatc

SEQ ID NO: 462855 - DNA, 25 bp, Mus musculus
tactcccggtagcagtgtgtcctca

SEQ ID NO: 462856 - DNA, 25 bp, Mus musculus
tactcccggtggtgttagaacagag

SEQ ID NO: 462857 - DNA, 25 bp, Mus musculus
tactccctccctactggtgtcagga

SEQ ID NO: 462858 - DNA, 25 bp, Mus musculus
tactccctggcggagagatgccgca

SEQ ID NO: 462859 - DNA, 25 bp, Mus musculus
tactccctgtatctattctagaaag

SEQ ID NO: 462860 - DNA, 25 bp, Mus musculus
tactccgagctgatgaaaggcctgg

SEQ ID NO: 462861 - DNA, 25 bp, Mus musculus
tactccgatacacttctgcagaggg

SEQ ID NO: 462862 - DNA, 25 bp, Mus musculus
tactccgcaagctgctgaagagggc

SEQ ID NO: 462863 - DNA, 25 bp, Mus musculus
tactccgggtacgatgaggaggcct

SEQ ID NO: 462864 - DNA, 25 bp, Mus musculus
tactccgtgcgtctgggtgatcata

SEQ ID NO: 462865 - DNA, 25 bp, Mus musculus
tactccgtggtatgcttggtgggac

SEQ ID NO: 462866 - DNA, 25 bp, Mus musculus
tactcctaaggtgggttcttgtagc

SEQ ID NO: 462867 - DNA, 25 bp, Mus musculus
tactcctactgtgcgatggaccaag

SEQ ID NO: 462868 - DNA, 25 bp, Mus musculus
tactcctcagcacctgtttcattgc

SEQ ID NO: 462869 - DNA, 25 bp, Mus musculus
tactcctcagtgacaagacagctgg

SEQ ID NO: 462870 - DNA, 25 bp, Mus musculus
tactcctctgctggttctgatgacg

SEQ ID NO: 462871 - DNA, 25 bp, Mus musculus
tactcctgagcgtattacgctggct

SEQ ID NO: 462872 - DNA, 25 bp, Mus musculus
tactcctgccgtggcatgtgcagag

SEQ ID NO: 462873 - DNA, 25 bp, Mus musculus
tactcctgctgtggtaatgggcagg

SEQ ID NO: 462874 - DNA, 25 bp, Mus musculus
tactcctgggaagaatgcatgaacc

SEQ ID NO: 462875 - DNA, 25 bp, Mus musculus
tactcctgggagtggcacagctgtc

SEQ ID NO: 462876 - DNA, 25 bp, Mus musculus
tactcctgttccagcaaggctgcgc

SEQ ID NO: 462877 - DNA, 25 bp, Mus musculus
tactcctgtttggactgaatgcgcc

SEQ ID NO: 462878 - DNA, 25 bp, Mus musculus
tactccttgtaacgactacctgaaa

SEQ ID NO: 462879 - DNA, 25 bp, Mus musculus
tactccttgtcctgacaggcatcat

SEQ ID NO: 462880 - DNA, 25 bp, Mus musculus
tactcgaaaggaggtccccgtgtct

SEQ ID NO: 462881 - DNA, 25 bp, Mus musculus
tactcgaatgaaaactgctaagtga

SEQ ID NO: 462882 - DNA, 25 bp, Mus musculus
tactcgactcttcgagggctctggg

SEQ ID NO: 462883 - DNA, 25 bp, Mus musculus
tactcgatagatgcagtgagagtca

SEQ ID NO: 462884 - DNA, 25 bp, Mus musculus
tactcgattcaacaagaaccgggca

SEQ ID NO: 462885 - DNA, 25 bp, Mus musculus
tactcgatttatctgtgggacccag

SEQ ID NO: 462886 - DNA, 25 bp, Mus musculus
tactcgcggatgaagaggcctccga

SEQ ID NO: 462887 - DNA, 25 bp, Mus musculus
tactcgctattcagcaaggcacagg

SEQ ID NO: 462888 - DNA, 25 bp, Mus musculus
tactcggcatgctgaaatggtggcc

SEQ ID NO: 462889 - DNA, 25 bp, Mus musculus
tactcgggagcactcagcacaaaac

SEQ ID NO: 462890 - DNA, 25 bp, Mus musculus
tactcgggatttccttgaacctgcc

SEQ ID NO: 462891 - DNA, 25 bp, Mus musculus
tactcgggccccaactgtgaaattg

SEQ ID NO: 462892 - DNA, 25 bp, Mus musculus
tactcgggctattcctacaagtcgg

SEQ ID NO: 462893 - DNA, 25 bp, Mus musculus
tactcggtcaactcgacgacgtgga

SEQ ID NO: 462894 - DNA, 25 bp, Mus musculus
tactcggtcatcgtgaagagcaggg

SEQ ID NO: 462895 - DNA, 25 bp, Mus musculus
tactcggtgatacagaagcggccta

SEQ ID NO: 462896 - DNA, 25 bp, Mus musculus
tactcggtgcagctggacgctttgc

SEQ ID NO: 462897 - DNA, 25 bp, Mus musculus
tactcgtagtactgagccaccatgc

SEQ ID NO: 462898 - DNA, 25 bp, Mus musculus
tactcgtcaaaatggccagaaggtc

SEQ ID NO: 462899 - DNA, 25 bp, Mus musculus
tactcgttagcaaccatacctgggt

SEQ ID NO: 462900 - DNA, 25 bp, Mus musculus
tactcgttggcagggactctggccg

SEQ ID NO: 462901 - DNA, 25 bp, Mus musculus
tactctaagcttgtcgtagcgagaa

SEQ ID NO: 462902 - DNA, 25 bp, Mus musculus
tactctacaattgttggcagcgccg

SEQ ID NO: 462903 - DNA, 25 bp, Mus musculus
tactctacagcattgcctaactggg

SEQ ID NO: 462904 - DNA, 25 bp, Mus musculus
tactctaccacgtgactgtggcctc

SEQ ID NO: 462905 - DNA, 25 bp, Mus musculus
tactctacggatcgacatttgtgcc

SEQ ID NO: 462906 - DNA, 25 bp, Mus musculus
tactctacgtctgggtcgagttgga

SEQ ID NO: 462907 - DNA, 25 bp, Mus musculus
tactctagcacctccatagaagagg

SEQ ID NO: 462908 - DNA, 25 bp, Mus musculus
tactctaggaaggaaggacaccctg

SEQ ID NO: 462909 - DNA, 25 bp, Mus musculus
tactctaggaatgaccgagaccaag

SEQ ID NO: 462910 - DNA, 25 bp, Mus musculus
tactctatctataaagggaccccgc

SEQ ID NO: 462911 - DNA, 25 bp, Mus musculus
tactctatgacagccattgcagtgg

SEQ ID NO: 462912 - DNA, 25 bp, Mus musculus
tactctatgcactactcggcgctgc

SEQ ID NO: 462913 - DNA, 25 bp, Mus musculus
tactctatgtattcctgggtcagga

SEQ ID NO: 462914 - DNA, 25 bp, Mus musculus
tactctcaagagtggcgggagcctg

SEQ ID NO: 462915 - DNA, 25 bp, Mus musculus
tactctcaagccgttctgggaagcc

SEQ ID NO: 462916 - DNA, 25 bp, Mus musculus
tactctcacgacctttctgggcggc

SEQ ID NO: 462917 - DNA, 25 bp, Mus musculus
tactctcaggtcgaacgaaaatgcc

SEQ ID NO: 462918 - DNA, 25 bp, Mus musculus
tactctcagtcacaactgcaatggc

SEQ ID NO: 462919 - DNA, 25 bp, Mus musculus
tactctcattggtggcgccagggag

SEQ ID NO: 462920 - DNA, 25 bp, Mus musculus
tactctccaaaaacccaatcagaca

SEQ ID NO: 462921 - DNA, 25 bp, Mus musculus
tactctcccaatcaaaagctgctgg

SEQ ID NO: 462922 - DNA, 25 bp, Mus musculus
tactctcccctcatatttgaccagg

SEQ ID NO: 462923 - DNA, 25 bp, Mus musculus
tactctccgtgcaacaacaactgtg

SEQ ID NO: 462924 - DNA, 25 bp, Mus musculus
tactctcctgctagagaatgggacc

SEQ ID NO: 462925 - DNA, 25 bp, Mus musculus
tactctcgctatgaatcccgtgtgg

SEQ ID NO: 462926 - DNA, 25 bp, Mus musculus
tactctcgtcgaacaagcatggaag

SEQ ID NO: 462927 - DNA, 25 bp, Mus musculus
tactctctataaggctacggcgtga

SEQ ID NO: 462928 - DNA, 25 bp, Mus musculus
tactctctccgctcaagtggcttct

SEQ ID NO: 462929 - DNA, 25 bp, Mus musculus
tactctctgccagaggtcatgggaa

SEQ ID NO: 462930 - DNA, 25 bp, Mus musculus
tactctctgcctccgggcttggtgc

SEQ ID NO: 462931 - DNA, 25 bp, Mus musculus
tactctctgtatgaggacaaaggag

SEQ ID NO: 462932 - DNA, 25 bp, Mus musculus
tactctcttgcaagaactggaacga

SEQ ID NO: 462933 - DNA, 25 bp, Mus musculus
tactctgaagtctgggtcatcccct

SEQ ID NO: 462934 - DNA, 25 bp, Mus musculus
tactctgacaacaatagccctgggc

SEQ ID NO: 462935 - DNA, 25 bp, Mus musculus
tactctgagcaccatgacactgaga

SEQ ID NO: 462936 - DNA, 25 bp, Mus musculus
tactctgagcactggaagacgcagc

SEQ ID NO: 462937 - DNA, 25 bp, Mus musculus
tactctgatgggttctagccctgca

SEQ ID NO: 462938 - DNA, 25 bp, Mus musculus
tactctgcgttttacatctgacttc

SEQ ID NO: 462939 - DNA, 25 bp, Mus musculus
tactctgctgtatcatggaacccgg

SEQ ID NO: 462940 - DNA, 25 bp, Mus musculus
tactctggacagacactggacacgc

SEQ ID NO: 462941 - DNA, 25 bp, Mus musculus
tactctggaccatggtggactctga

SEQ ID NO: 462942 - DNA, 25 bp, Mus musculus
tactctggactgcaggactactttg

SEQ ID NO: 462943 - DNA, 25 bp, Mus musculus
tactctggcgctggctttggaggca

SEQ ID NO: 462944 - DNA, 25 bp, Mus musculus
tactctggctgcaaagttatctgcc

SEQ ID NO: 462945 - DNA, 25 bp, Mus musculus
tactctgggtatgagaaacacttcc

SEQ ID NO: 462946 - DNA, 25 bp, Mus musculus
tactctgggtgtgtggagccatttg

SEQ ID NO: 462947 - DNA, 25 bp, Mus musculus
tactctggtgcttatctgatggcgg

SEQ ID NO: 462948 - DNA, 25 bp, Mus musculus
tactctggtgtgttgacatgctcaa

SEQ ID NO: 462949 - DNA, 25 bp, Mus musculus
tactctgtcaggatccacgttctgg

SEQ ID NO: 462950 - DNA, 25 bp, Mus musculus
tactctgtcgcacggcagttcaaca

SEQ ID NO: 462951 - DNA, 25 bp, Mus musculus
tactcttaagactgatggccacaca

SEQ ID NO: 462952 - DNA, 25 bp, Mus musculus
tactcttagagaccactgggctagc

SEQ ID NO: 462953 - DNA, 25 bp, Mus musculus
tactcttcagaatggttagagaccc

SEQ ID NO: 462954 - DNA, 25 bp, Mus musculus
tactcttcttggactgggccttgga

SEQ ID NO: 462955 - DNA, 25 bp, Mus musculus
tactcttgaaccacgaacgattgaa

SEQ ID NO: 462956 - DNA, 25 bp, Mus musculus
tactcttgcgtatcccaaggctggc

SEQ ID NO: 462957 - DNA, 25 bp, Mus musculus
tactcttggagacactgacgttccg

SEQ ID NO: 462958 - DNA, 25 bp, Mus musculus
tactctttaccgagggtatgtggct

SEQ ID NO: 462959 - DNA, 25 bp, Mus musculus
tactctttctggtgagtgagtgact

SEQ ID NO: 462960 - DNA, 25 bp, Mus musculus
tactctttggtcatgtgccgttaca

SEQ ID NO: 462961 - DNA, 25 bp, Mus musculus
tactgaaaactgcatggctacaggg

SEQ ID NO: 462962 - DNA, 25 bp, Mus musculus
tactgaaaaggaggtgctgacgtgc

SEQ ID NO: 462963 - DNA, 25 bp, Mus musculus
tactgaaagctggaacaacaggtga

SEQ ID NO: 462964 - DNA, 25 bp, Mus musculus
tactgaaatgcattccagaggagcc

SEQ ID NO: 462965 - DNA, 25 bp, Mus musculus
tactgaaattgtgaggatccacctg

SEQ ID NO: 462966 - DNA, 25 bp, Mus musculus
tactgaacaagaaggaacgaaggcg

SEQ ID NO: 462967 - DNA, 25 bp, Mus musculus
tactgaacaaggactctaacaggcc

SEQ ID NO: 462968 - DNA, 25 bp, Mus musculus
tactgaacactccaccgacggtgtc

SEQ ID NO: 462969 - DNA, 25 bp, Mus musculus
tactgaacatgatccctgtgggccc

SEQ ID NO: 462970 - DNA, 25 bp, Mus musculus
tactgaaccaaaggacttagcctgg

SEQ ID NO: 462971 - DNA, 25 bp, Mus musculus
tactgaacgcattgtccaagggagg

SEQ ID NO: 462972 - DNA, 25 bp, Mus musculus
tactgaacgcgcctgtggtgtcgat

SEQ ID NO: 462973 - DNA, 25 bp, Mus musculus
tactgaacgtgcttgaggtcctgaa

SEQ ID NO: 462974 - DNA, 25 bp, Mus musculus
tactgaactcatgggcaagggcaac

SEQ ID NO: 462975 - DNA, 25 bp, Mus musculus
tactgaactccaagcacaaagaggc

SEQ ID NO: 462976 - DNA, 25 bp, Mus musculus
tactgaactggcaagactacgaggg

SEQ ID NO: 462977 - DNA, 25 bp, Mus musculus
tactgaactggctcgctcagggtga

SEQ ID NO: 462978 - DNA, 25 bp, Mus musculus
tactgaacttgatgagcaactccgg

SEQ ID NO: 462979 - DNA, 25 bp, Mus musculus
tactgaagaatcaaactgtccgtgg

SEQ ID NO: 462980 - DNA, 25 bp, Mus musculus
tactgaagaggagactagtaagccc

SEQ ID NO: 462981 - DNA, 25 bp, Mus musculus
tactgaagatactcaagtcagggac

SEQ ID NO: 462982 - DNA, 25 bp, Mus musculus
tactgaagatcatgtaggagaggcc

SEQ ID NO: 462983 - DNA, 25 bp, Mus musculus
tactgaagattgtacaggcaccagc

SEQ ID NO: 462984 - DNA, 25 bp, Mus musculus
tactgaagatttacatgcaaggcaa

SEQ ID NO: 462985 - DNA, 25 bp, Mus musculus
tactgaagcagagattgacgctcac

SEQ ID NO: 462986 - DNA, 25 bp, Mus musculus
tactgaagctcggtgcgtctggctc

SEQ ID NO: 462987 - DNA, 25 bp, Mus musculus
tactgaatgattcccgagaggtgaa

SEQ ID NO: 462988 - DNA, 25 bp, Mus musculus
tactgaatgcatgaagagccctgga

SEQ ID NO: 462989 - DNA, 25 bp, Mus musculus
tactgaatgcatgtgaaaaaggttc

SEQ ID NO: 462990 - DNA, 25 bp, Mus musculus
tactgaatggttgggccagagctcc

SEQ ID NO: 462991 - DNA, 25 bp, Mus musculus
tactgacaaaccacatcccagaggt

SEQ ID NO: 462992 - DNA, 25 bp, Mus musculus
tactgacaaggatgacttcctgggc

SEQ ID NO: 462993 - DNA, 25 bp, Mus musculus
tactgacagcaaccgatggaggcaa

SEQ ID NO: 462994 - DNA, 25 bp, Mus musculus
tactgacagggtctccagtgacagt

SEQ ID NO: 462995 - DNA, 25 bp, Mus musculus
tactgacatacatgcaaggctcgtg

SEQ ID NO: 462996 - DNA, 25 bp, Mus musculus
tactgacatgaagtgccaacgaggg

SEQ ID NO: 462997 - DNA, 25 bp, Mus musculus
tactgacatttctgaatccagcggg

SEQ ID NO: 462998 - DNA, 25 bp, Mus musculus
tactgaccagtgtatgagagaggac

SEQ ID NO: 462999 - DNA, 25 bp, Mus musculus
tactgacccaggatagcaagaatca

SEQ ID NO: 463000 - DNA, 25 bp, Mus musculus
tactgacctccctttgcagctgagg

SEQ ID NO: 463001 - DNA, 25 bp, Mus musculus
tactgacgagcgtgggctatgccgt

SEQ ID NO: 463002 - DNA, 25 bp, Mus musculus
tactgacgggctttctgggcttgga

SEQ ID NO: 463003 - DNA, 25 bp, Mus musculus
tactgacgttggtatgcagcaacca

SEQ ID NO: 463004 - DNA, 25 bp, Mus musculus
tactgactcctgtggaaaaggcctc

SEQ ID NO: 463005 - DNA, 25 bp, Mus musculus
tactgactcggatgaccgtggctcc

SEQ ID NO: 463006 - DNA, 25 bp, Mus musculus
tactgactgaagctcggatgggtcc

SEQ ID NO: 463007 - DNA, 25 bp, Mus musculus
tactgactgttagagagggacctgg

SEQ ID NO: 463008 - DNA, 25 bp, Mus musculus
tactgacttagtagggatcgagaca

SEQ ID NO: 463009 - DNA, 25 bp, Mus musculus
tactgacttataggagggtcctttg

SEQ ID NO: 463010 - DNA, 25 bp, Mus musculus
tactgagaaaccaagaactgcccct

SEQ ID NO: 463011 - DNA, 25 bp, Mus musculus
tactgagaaaggaaggcactacacg

SEQ ID NO: 463012 - DNA, 25 bp, Mus musculus
tactgagaacataaacccttggcga

SEQ ID NO: 463013 - DNA, 25 bp, Mus musculus
tactgagaacgaaaacttcaaggat

SEQ ID NO: 463014 - DNA, 25 bp, Mus musculus
tactgagacgagagcaacaggctgg

SEQ ID NO: 463015 - DNA, 25 bp, Mus musculus
tactgagagcaactagaaaaactgg

SEQ ID NO: 463016 - DNA, 25 bp, Mus musculus
tactgagatgcagagcaagccttgc

SEQ ID NO: 463017 - DNA, 25 bp, Mus musculus
tactgagatggtacatcaggagaac

SEQ ID NO: 463018 - DNA, 25 bp, Mus musculus
tactgagcagagaacagcccctaag

SEQ ID NO: 463019 - DNA, 25 bp, Mus musculus
tactgagcagggacgtcttgtggaa

SEQ ID NO: 463020 - DNA, 25 bp, Mus musculus
tactgagccggcacaagaagcctag

SEQ ID NO: 463021 - DNA, 25 bp, Mus musculus
tactgagcctcagcagagtggccct

SEQ ID NO: 463022 - DNA, 25 bp, Mus musculus
tactgagcgacattgagaagacctt

SEQ ID NO: 463023 - DNA, 25 bp, Mus musculus
tactgagcgactgtgccaacgtctg

SEQ ID NO: 463024 - DNA, 25 bp, Mus musculus
tactgagcgtgcattgtggaagaca

SEQ ID NO: 463025 - DNA, 25 bp, Mus musculus
tactgagctctaaaacgatgagttc

SEQ ID NO: 463026 - DNA, 25 bp, Mus musculus
tactgaggatttctaaacggaggtc

SEQ ID NO: 463027 - DNA, 25 bp, Mus musculus
tactgaggcagtaatccctggtgtg

SEQ ID NO: 463028 - DNA, 25 bp, Mus musculus
tactgaggccaaaacagctattctc

SEQ ID NO: 463029 - DNA, 25 bp, Mus musculus
tactgagggcttgcgtgcctttcgg

SEQ ID NO: 463030 - DNA, 25 bp, Mus musculus
tactgaggtttacccaaagaactcg

SEQ ID NO: 463031 - DNA, 25 bp, Mus musculus
tactgagtaccattacgggtttgct

SEQ ID NO: 463032 - DNA, 25 bp, Mus musculus
tactgagtcactcaattctccatgc

SEQ ID NO: 463033 - DNA, 25 bp, Mus musculus
tactgagtcgtctcttggcaagaac

SEQ ID NO: 463034 - DNA, 25 bp, Mus musculus
tactgagtctaattggtgctgctag

SEQ ID NO: 463035 - DNA, 25 bp, Mus musculus
tactgagtctcattgaagtttgatc

SEQ ID NO: 463036 - DNA, 25 bp, Mus musculus
tactgagtggatagactgctctgct

SEQ ID NO: 463037 - DNA, 25 bp, Mus musculus
tactgagtgtccaaatgaaagtgcc

SEQ ID NO: 463038 - DNA, 25 bp, Mus musculus
tactgagtttctctgaaccagagcc

SEQ ID NO: 463039 - DNA, 25 bp, Mus musculus
tactgataaaatcgaggccaggagg

SEQ ID NO: 463040 - DNA, 25 bp, Mus musculus
tactgatacattctcaaaaatctcc

SEQ ID NO: 463041 - DNA, 25 bp, Mus musculus
tactgatagccaagcgagagagaga

SEQ ID NO: 463042 - DNA, 25 bp, Mus musculus
tactgatcagagagcgcatacggtg

SEQ ID NO: 463043 - DNA, 25 bp, Mus musculus
tactgatccaactcaatgattaaga

SEQ ID NO: 463044 - DNA, 25 bp, Mus musculus
tactgatccatggactacagtttgt

SEQ ID NO: 463045 - DNA, 25 bp, Mus musculus
tactgatcgcctacatagagccggt

SEQ ID NO: 463046 - DNA, 25 bp, Mus musculus
tactgatctacactgggaccatgag

SEQ ID NO: 463047 - DNA, 25 bp, Mus musculus
tactgatctgatgtactagccagtg

SEQ ID NO: 463048 - DNA, 25 bp, Mus musculus
tactgatgaagatatggaaccggac

SEQ ID NO: 463049 - DNA, 25 bp, Mus musculus
tactgatgaggttcaaagaaaacca

SEQ ID NO: 463050 - DNA, 25 bp, Mus musculus
tactgatgctctgcacggtgtgcct

SEQ ID NO: 463051 - DNA, 25 bp, Mus musculus
tactgatgggagtcctagcgggaac

SEQ ID NO: 463052 - DNA, 25 bp, Mus musculus
tactgatgggcaaaggattccagaa

SEQ ID NO: 463053 - DNA, 25 bp, Mus musculus
tactgatgtctaagggagccacacc

SEQ ID NO: 463054 - DNA, 25 bp, Mus musculus
tactgattcagctcaagccctggct

SEQ ID NO: 463055 - DNA, 25 bp, Mus musculus
tactgattgcttcctttctcttgca

SEQ ID NO: 463056 - DNA, 25 bp, Mus musculus
tactgcaaagttagaagaaactgcc

SEQ ID NO: 463057 - DNA, 25 bp, Mus musculus
tactgcaacagaataaagctctgcc

SEQ ID NO: 463058 - DNA, 25 bp, Mus musculus
tactgcaaccagaggcttcggaaag

SEQ ID NO: 463059 - DNA, 25 bp, Mus musculus
tactgcaagtgcctctggatcagag

SEQ ID NO: 463060 - DNA, 25 bp, Mus musculus
tactgcaatccggaccagtgctgga

SEQ ID NO: 463061 - DNA, 25 bp, Mus musculus
tactgcacaaaagcttaagcacctg

SEQ ID NO: 463062 - DNA, 25 bp, Mus musculus
tactgcacagggaagagggccatat

SEQ ID NO: 463063 - DNA, 25 bp, Mus musculus
tactgcacgctgtgcggagtggaac

SEQ ID NO: 463064 - DNA, 25 bp, Mus musculus
tactgcagatcagagacgagacccc

SEQ ID NO: 463065 - DNA, 25 bp, Mus musculus
tactgcagcacacggaaaggcaaga

SEQ ID NO: 463066 - DNA, 25 bp, Mus musculus
tactgcagcatgtggaaccagagcc

SEQ ID NO: 463067 - DNA, 25 bp, Mus musculus
tactgcagcctggacgaggaactgg

SEQ ID NO: 463068 - DNA, 25 bp, Mus musculus
tactgcaggaagagcaagctagcct

SEQ ID NO: 463069 - DNA, 25 bp, Mus musculus
tactgcaggaggagcaatatacccc

SEQ ID NO: 463070 - DNA, 25 bp, Mus musculus
tactgcaggatcttgctggctgccc

SEQ ID NO: 463071 - DNA, 25 bp, Mus musculus
tactgcagggaccatgtagggacca

SEQ ID NO: 463072 - DNA, 25 bp, Mus musculus
tactgcagtttttcaggagcgcaag

SEQ ID NO: 463073 - DNA, 25 bp, Mus musculus
tactgcatcgagcaaagtcggccga

SEQ ID NO: 463074 - DNA, 25 bp, Mus musculus
tactgcattaaaaaacttcgacgga

SEQ ID NO: 463075 - DNA, 25 bp, Mus musculus
tactgcattgcacggagatcatctg

SEQ ID NO: 463076 - DNA, 25 bp, Mus musculus
tactgccaaagctcaaaattccact

SEQ ID NO: 463077 - DNA, 25 bp, Mus musculus
tactgccaaaggtgatgggcagagc

SEQ ID NO: 463078 - DNA, 25 bp, Mus musculus
tactgccaataaaactgcggagccc

SEQ ID NO: 463079 - DNA, 25 bp, Mus musculus
tactgccagctggaaaatgcccatc

SEQ ID NO: 463080 - DNA, 25 bp, Mus musculus
tactgccatggtagctgcgggatgc

SEQ ID NO: 463081 - DNA, 25 bp, Mus musculus
tactgcccagacacaggctgggccg

SEQ ID NO: 463082 - DNA, 25 bp, Mus musculus
tactgcccaggaagacgtggtcagc

SEQ ID NO: 463083 - DNA, 25 bp, Mus musculus
tactgcccagtaatcttccagctga

SEQ ID NO: 463084 - DNA, 25 bp, Mus musculus
tactgccccgagatgtttgctgaca

SEQ ID NO: 463085 - DNA, 25 bp, Mus musculus
tactgccccgctttgaagctttgac

SEQ ID NO: 463086 - DNA, 25 bp, Mus musculus
tactgcccgcataggaatgccggtt

SEQ ID NO: 463087 - DNA, 25 bp, Mus musculus
tactgccctgaatgtgattgtcgag

SEQ ID NO: 463088 - DNA, 25 bp, Mus musculus
tactgccctgagtgttaccctgaca

SEQ ID NO: 463089 - DNA, 25 bp, Mus musculus
tactgcccttaagaagcgctatgtg

SEQ ID NO: 463090 - DNA, 25 bp, Mus musculus
tactgccgaggagtcaatgcaattg

SEQ ID NO: 463091 - DNA, 25 bp, Mus musculus
tactgccgcggtagctctaggcaac

SEQ ID NO: 463092 - DNA, 25 bp, Mus musculus
tactgccgctgtgtacattaaagtg

SEQ ID NO: 463093 - DNA, 25 bp, Mus musculus
tactgccggcccttgtagctttacc

SEQ ID NO: 463094 - DNA, 25 bp, Mus musculus
tactgccgggatacctttgatcacc

SEQ ID NO: 463095 - DNA, 25 bp, Mus musculus
tactgccggtaaaatcggagctcgg

SEQ ID NO: 463096 - DNA, 25 bp, Mus musculus
tactgcctctacgatgctgcggaca

SEQ ID NO: 463097 - DNA, 25 bp, Mus musculus
tactgcctgttggtgaaggtgagcc

SEQ ID NO: 463098 - DNA, 25 bp, Mus musculus
tactgccttcgcgaggaacttcagc

SEQ ID NO: 463099 - DNA, 25 bp, Mus musculus
tactgcgaagcttagaactgggcca

SEQ ID NO: 463100 - DNA, 25 bp, Mus musculus
tactgcgaccaggtgctacagggct

SEQ ID NO: 463101 - DNA, 25 bp, Mus musculus
tactgcgacccacattccgaattct

SEQ ID NO: 463102 - DNA, 25 bp, Mus musculus
tactgcgcaagtagaacctgctcag

SEQ ID NO: 463103 - DNA, 25 bp, Mus musculus
tactgcgctcagatgactggtccac

SEQ ID NO: 463104 - DNA, 25 bp, Mus musculus
tactgcggcaagcttttcaacgggc

SEQ ID NO: 463105 - DNA, 25 bp, Mus musculus
tactgcggcattgctgaaactggcc

SEQ ID NO: 463106 - DNA, 25 bp, Mus musculus
tactgcggtcctctaaaactgctgg

SEQ ID NO: 463107 - DNA, 25 bp, Mus musculus
tactgcgtaggagaccagctgaacg

SEQ ID NO: 463108 - DNA, 25 bp, Mus musculus
tactgcgtgtattgtactgggagag

SEQ ID NO: 463109 - DNA, 25 bp, Mus musculus
tactgcgtttggttgaggcccaggc

SEQ ID NO: 463110 - DNA, 25 bp, Mus musculus
tactgctaccatgaatgcctgtgtg

SEQ ID NO: 463111 - DNA, 25 bp, Mus musculus
tactgctaccggtgaggctggacct

SEQ ID NO: 463112 - DNA, 25 bp, Mus musculus
tactgctaccgttgtgggaaccagg

SEQ ID NO: 463113 - DNA, 25 bp, Mus musculus
tactgctactattacagagtactgc

SEQ ID NO: 463114 - DNA, 25 bp, Mus musculus
tactgctcactagcacaggatgact

SEQ ID NO: 463115 - DNA, 25 bp, Mus musculus
tactgctcactggtgtgtaacttcc

SEQ ID NO: 463116 - DNA, 25 bp, Mus musculus
tactgctctgcagcgctgaaggact

SEQ ID NO: 463117 - DNA, 25 bp, Mus musculus
tactgctgaagacccactcgatgga

SEQ ID NO: 463118 - DNA, 25 bp, Mus musculus
tactgctgaagggacaccaatcggt

SEQ ID NO: 463119 - DNA, 25 bp, Mus musculus
tactgctgaatgttctgatcgcccc

SEQ ID NO: 463120 - DNA, 25 bp, Mus musculus
tactgctgactattttggcctttgg

SEQ ID NO: 463121 - DNA, 25 bp, Mus musculus
tactgctgattttgaaaggaaggag

SEQ ID NO: 463122 - DNA, 25 bp, Mus musculus
tactgctgctttgctcacgcttaaa

SEQ ID NO: 463123 - DNA, 25 bp, Mus musculus
tactgctggcttgggaactgaaacc

SEQ ID NO: 463124 - DNA, 25 bp, Mus musculus
tactgctgtacaatgggcgcttcaa

SEQ ID NO: 463125 - DNA, 25 bp, Mus musculus
tactgctgtgcgaacactgaagact

SEQ ID NO: 463126 - DNA, 25 bp, Mus musculus
tactgctgttctcacatatggccta

SEQ ID NO: 463127 - DNA, 25 bp, Mus musculus
tactgcttacgggtggagccggaca

SEQ ID NO: 463128 - DNA, 25 bp, Mus musculus
tactgcttctgtgccaagagggagg

SEQ ID NO: 463129 - DNA, 25 bp, Mus musculus
tactgcttgacggtgatgactctgg

SEQ ID NO: 463130 - DNA, 25 bp, Mus musculus
tactgctttcccttcggacgacctg

SEQ ID NO: 463131 - DNA, 25 bp, Mus musculus
tactggaagcagaaactactgggcc

SEQ ID NO: 463132 - DNA, 25 bp, Mus musculus
tactggaaggttctcctccatggaa

SEQ ID NO: 463133 - DNA, 25 bp, Mus musculus
tactggaagtatggatactacagcc

SEQ ID NO: 463134 - DNA, 25 bp, Mus musculus
tactggaatccatgccttctggcac

SEQ ID NO: 463135 - DNA, 25 bp, Mus musculus
tactggaatgggacggttgtgcaca

SEQ ID NO: 463136 - DNA, 25 bp, Mus musculus
tactggaatgggagggaacccagcc

SEQ ID NO: 463137 - DNA, 25 bp, Mus musculus
tactggaattgtccaagaagagcac

SEQ ID NO: 463138 - DNA, 25 bp, Mus musculus
tactggacaagaaaacgaagacgga

SEQ ID NO: 463139 - DNA, 25 bp, Mus musculus
tactggacaggaaacagcaactggc

SEQ ID NO: 463140 - DNA, 25 bp, Mus musculus
tactggacatcaacacgggagtgca

SEQ ID NO: 463141 - DNA, 25 bp, Mus musculus
tactggacctcgctccttgaggaag

SEQ ID NO: 463142 - DNA, 25 bp, Mus musculus
tactggactggctggtatgactcgt

SEQ ID NO: 463143 - DNA, 25 bp, Mus musculus
tactggagaaatatatttgtgtggc

SEQ ID NO: 463144 - DNA, 25 bp, Mus musculus
tactggagaagcaaagagactgaca

SEQ ID NO: 463145 - DNA, 25 bp, Mus musculus
tactggagagcaacaccaaagcaag

SEQ ID NO: 463146 - DNA, 25 bp, Mus musculus
tactggagaggacatacaaggaccg

SEQ ID NO: 463147 - DNA, 25 bp, Mus musculus
tactggagcacgtgcagagcaaagc

SEQ ID NO: 463148 - DNA, 25 bp, Mus musculus
tactggagcagagatgacgtagccc

SEQ ID NO: 463149 - DNA, 25 bp, Mus musculus
tactggagcatactgaaggtgaaca

SEQ ID NO: 463150 - DNA, 25 bp, Mus musculus
tactggagcggaagcactttctgcg

SEQ ID NO: 463151 - DNA, 25 bp, Mus musculus
tactggagcgtaggcactgaatccc

SEQ ID NO: 463152 - DNA, 25 bp, Mus musculus
tactggagggcaacttatacgggag

SEQ ID NO: 463153 - DNA, 25 bp, Mus musculus
tactggagggcagagatagcaaacc

SEQ ID NO: 463154 - DNA, 25 bp, Mus musculus
tactggatcacaggtaagccactgt

SEQ ID NO: 463155 - DNA, 25 bp, Mus musculus
tactggatcagctatggaggacggc

SEQ ID NO: 463156 - DNA, 25 bp, Mus musculus
tactggatgccaacgaccctaagaa

SEQ ID NO: 463157 - DNA, 25 bp, Mus musculus
tactggatgtaagctgtgcagacct

SEQ ID NO: 463158 - DNA, 25 bp, Mus musculus
tactggattcattggctttagccta

SEQ ID NO: 463159 - DNA, 25 bp, Mus musculus
tactggattccagcacagtgactca

SEQ ID NO: 463160 - DNA, 25 bp, Mus musculus
tactggattctgaaatttcctgcag

SEQ ID NO: 463161 - DNA, 25 bp, Mus musculus
tactggattggtttggagaagcgcc

SEQ ID NO: 463162 - DNA, 25 bp, Mus musculus
tactggcaacagatggaagcccacg

SEQ ID NO: 463163 - DNA, 25 bp, Mus musculus
tactggcacatcagaaagaatcagc

SEQ ID NO: 463164 - DNA, 25 bp, Mus musculus
tactggcagcatatcacgaggcagc

SEQ ID NO: 463165 - DNA, 25 bp, Mus musculus
tactggcaggacaggtacaacttgc

SEQ ID NO: 463166 - DNA, 25 bp, Mus musculus
tactggcaggtaagtactttccggg

SEQ ID NO: 463167 - DNA, 25 bp, Mus musculus
tactggcatcataggcacatggacc

SEQ ID NO: 463168 - DNA, 25 bp, Mus musculus
tactggcatgaaattgaacccttcg

SEQ ID NO: 463169 - DNA, 25 bp, Mus musculus
tactggcatgatccgtacatcgagc

SEQ ID NO: 463170 - DNA, 25 bp, Mus musculus
tactggcatggtagctatgaggacc

SEQ ID NO: 463171 - DNA, 25 bp, Mus musculus
tactggcatgtaagacaggcgtgct

SEQ ID NO: 463172 - DNA, 25 bp, Mus musculus
tactggccaatgttgcggtgatcct

SEQ ID NO: 463173 - DNA, 25 bp, Mus musculus
tactggccaggatgcagggtaaact

SEQ ID NO: 463174 - DNA, 25 bp, Mus musculus
tactggcccagcacctacttctggt

SEQ ID NO: 463175 - DNA, 25 bp, Mus musculus
tactggccctatccaaggtgctgag

SEQ ID NO: 463176 - DNA, 25 bp, Mus musculus
tactggcctgcaagggaaggcactc

SEQ ID NO: 463177 - DNA, 25 bp, Mus musculus
tactggcgctgcctggacgacaacg

SEQ ID NO: 463178 - DNA, 25 bp, Mus musculus
tactggcggtcaagtctaccaggca

SEQ ID NO: 463179 - DNA, 25 bp, Mus musculus
tactggctacagaacatgaggcgct

SEQ ID NO: 463180 - DNA, 25 bp, Mus musculus
tactggctagagaatgttcacacgc

SEQ ID NO: 463181 - DNA, 25 bp, Mus musculus
tactggctggccaactacgtgtggg

SEQ ID NO: 463182 - DNA, 25 bp, Mus musculus
tactggctggtcctgtatggctgca

SEQ ID NO: 463183 - DNA, 25 bp, Mus musculus
tactggctgttactgacttgggtct

SEQ ID NO: 463184 - DNA, 25 bp, Mus musculus
tactggcttagcaatggatatgcag

SEQ ID NO: 463185 - DNA, 25 bp, Mus musculus
tactgggaaacttcacggaggccac

SEQ ID NO: 463186 - DNA, 25 bp, Mus musculus
tactgggaagtctctgtggctcacc

SEQ ID NO: 463187 - DNA, 25 bp, Mus musculus
tactgggacattaggttctgtcttc

SEQ ID NO: 463188 - DNA, 25 bp, Mus musculus
tactgggaccgtagtgtcgggacaa

SEQ ID NO: 463189 - DNA, 25 bp, Mus musculus
tactgggagagggttgggcacatgt

SEQ ID NO: 463190 - DNA, 25 bp, Mus musculus
tactgggagaggtgtctatcaaaga

SEQ ID NO: 463191 - DNA, 25 bp, Mus musculus
tactgggagccatttgcctttcctg

SEQ ID NO: 463192 - DNA, 25 bp, Mus musculus
tactgggagctgaccatagatcgct

SEQ ID NO: 463193 - DNA, 25 bp, Mus musculus
tactgggagtgcacatgtctctgaa

SEQ ID NO: 463194 - DNA, 25 bp, Mus musculus
tactgggcaccagagcagttttctt

SEQ ID NO: 463195 - DNA, 25 bp, Mus musculus
tactgggcaggagcctaccgaggtt

SEQ ID NO: 463196 - DNA, 25 bp, Mus musculus
tactgggcataaacaacaaccggat

SEQ ID NO: 463197 - DNA, 25 bp, Mus musculus
tactgggccaacctcatagacggag

SEQ ID NO: 463198 - DNA, 25 bp, Mus musculus
tactgggcgatacagaagagcagcc

SEQ ID NO: 463199 - DNA, 25 bp, Mus musculus
tactgggcgcctttacctggaatgg

SEQ ID NO: 463200 - DNA, 25 bp, Mus musculus
tactgggcgtggtaagactggactt

SEQ ID NO: 463201 - DNA, 25 bp, Mus musculus
tactgggctaaggtgagagctgtcc

SEQ ID NO: 463202 - DNA, 25 bp, Mus musculus
tactgggtaagaagagctgactcgg

SEQ ID NO: 463203 - DNA, 25 bp, Mus musculus
tactgggtatgctcaccgatgcagg

SEQ ID NO: 463204 - DNA, 25 bp, Mus musculus
tactgggtgctgaagccttggacac

SEQ ID NO: 463205 - DNA, 25 bp, Mus musculus
tactgggtgtgcttgtggctttgcc

SEQ ID NO: 463206 - DNA, 25 bp, Mus musculus
tactgggttacatcagggccgtgaa

SEQ ID NO: 463207 - DNA, 25 bp, Mus musculus
tactgggttttgcatttcaggacag

SEQ ID NO: 463208 - DNA, 25 bp, Mus musculus
tactggtacacagcagagtcgtggg

SEQ ID NO: 463209 - DNA, 25 bp, Mus musculus
tactggtacaggttgaagcaccgcc

SEQ ID NO: 463210 - DNA, 25 bp, Mus musculus
tactggtagagcagctgaccgactc

SEQ ID NO: 463211 - DNA, 25 bp, Mus musculus
tactggtagccactgtttctgcatg

SEQ ID NO: 463212 - DNA, 25 bp, Mus musculus
tactggtagctactgatggaggcaa

SEQ ID NO: 463213 - DNA, 25 bp, Mus musculus
tactggtcatagcagaagccttccg

SEQ ID NO: 463214 - DNA, 25 bp, Mus musculus
tactggtccaagataggtcggctga

SEQ ID NO: 463215 - DNA, 25 bp, Mus musculus
tactggtccaatatggctgaatgaa

SEQ ID NO: 463216 - DNA, 25 bp, Mus musculus
tactggtcccctgaatcgaagaaag

SEQ ID NO: 463217 - DNA, 25 bp, Mus musculus
tactggtgaggtgagctgcagaccc

SEQ ID NO: 463218 - DNA, 25 bp, Mus musculus
tactggtggtgacaagatcttcgaa

SEQ ID NO: 463219 - DNA, 25 bp, Mus musculus
tactggttcactgctcaatgccctg

SEQ ID NO: 463220 - DNA, 25 bp, Mus musculus
tactggttctatctggaatccggca

SEQ ID NO: 463221 - DNA, 25 bp, Mus musculus
tactgtaaactccagtggaagctag

SEQ ID NO: 463222 - DNA, 25 bp, Mus musculus
tactgtaagctgtgcgatgcctcct

SEQ ID NO: 463223 - DNA, 25 bp, Mus musculus
tactgtaatccacaaccctgacgga

SEQ ID NO: 463224 - DNA, 25 bp, Mus musculus
tactgtaccgtggagaagcctgtgg

SEQ ID NO: 463225 - DNA, 25 bp, Mus musculus
tactgtacctaccaacgggattcca

SEQ ID NO: 463226 - DNA, 25 bp, Mus musculus
tactgtacctgggttacttgcaaac

SEQ ID NO: 463227 - DNA, 25 bp, Mus musculus
tactgtaccttttgtatacacatcc

SEQ ID NO: 463228 - DNA, 25 bp, Mus musculus
tactgtagggtttgcttacagcaga

SEQ ID NO: 463229 - DNA, 25 bp, Mus musculus
tactgtagtgaagtgctggccatcc

SEQ ID NO: 463230 - DNA, 25 bp, Mus musculus
tactgtatcgcatttccccatgggc

SEQ ID NO: 463231 - DNA, 25 bp, Mus musculus
tactgtatcgtgagatctgcaaaac

SEQ ID NO: 463232 - DNA, 25 bp, Mus musculus
tactgtatctgagagtcaggcctga

SEQ ID NO: 463233 - DNA, 25 bp, Mus musculus
tactgtatggacatcgtcggcagct

SEQ ID NO: 463234 - DNA, 25 bp, Mus musculus
tactgtattgcaagctttctccaag

SEQ ID NO: 463235 - DNA, 25 bp, Mus musculus
tactgtcaaggaggagttgcacctc

SEQ ID NO: 463236 - DNA, 25 bp, Mus musculus
tactgtcacggacggaggaaagcca

SEQ ID NO: 463237 - DNA, 25 bp, Mus musculus
tactgtcactcgaagggcatctctg

SEQ ID NO: 463238 - DNA, 25 bp, Mus musculus
tactgtcacttacctggccataaac

SEQ ID NO: 463239 - DNA, 25 bp, Mus musculus
tactgtcagctcgaagaaagcctcg

SEQ ID NO: 463240 - DNA, 25 bp, Mus musculus
tactgtcaggacattcgagcttacg

SEQ ID NO: 463241 - DNA, 25 bp, Mus musculus
tactgtccaagggagatcatcagcc

SEQ ID NO: 463242 - DNA, 25 bp, Mus musculus
tactgtccatcttcaggctactggt

SEQ ID NO: 463243 - DNA, 25 bp, Mus musculus
tactgtcccacctcagtcaggcaga

SEQ ID NO: 463244 - DNA, 25 bp, Mus musculus
tactgtcccagttcataacacgtgt

SEQ ID NO: 463245 - DNA, 25 bp, Mus musculus
tactgtccggagcattcatgggcta

SEQ ID NO: 463246 - DNA, 25 bp, Mus musculus
tactgtccggatctgtgctctgaag

SEQ ID NO: 463247 - DNA, 25 bp, Mus musculus
tactgtccttgtcataaaacttgca

SEQ ID NO: 463248 - DNA, 25 bp, Mus musculus
tactgtcgatcacccagatggtaag

SEQ ID NO: 463249 - DNA, 25 bp, Mus musculus
tactgtcgattagatagatttctta

SEQ ID NO: 463250 - DNA, 25 bp, Mus musculus
tactgtcgccggatcctagtccgag

SEQ ID NO: 463251 - DNA, 25 bp, Mus musculus
tactgtcgctcctgcccttgaggtc

SEQ ID NO: 463252 - DNA, 25 bp, Mus musculus
tactgtcggagtatcacactggtgg

SEQ ID NO: 463253 - DNA, 25 bp, Mus musculus
tactgtcggcccatggagaagctgg

SEQ ID NO: 463254 - DNA, 25 bp, Mus musculus
tactgtcggtacctatccctggata

SEQ ID NO: 463255 - DNA, 25 bp, Mus musculus
tactgtcgtcgaggcaaccgttact

SEQ ID NO: 463256 - DNA, 25 bp, Mus musculus
tactgtctactgagggctgggcaag

SEQ ID NO: 463257 - DNA, 25 bp, Mus musculus
tactgtctcagtctccctgggtgct

SEQ ID NO: 463258 - DNA, 25 bp, Mus musculus
tactgtctggacactgggctttgcc

SEQ ID NO: 463259 - DNA, 25 bp, Mus musculus
tactgtctgggcagctggcatccat

SEQ ID NO: 463260 - DNA, 25 bp, Mus musculus
tactgtcttaggcagggcaaagccc

SEQ ID NO: 463261 - DNA, 25 bp, Mus musculus
tactgtcttgggtcatgtttcactg

SEQ ID NO: 463262 - DNA, 25 bp, Mus musculus
tactgtctttttggaaaggagggca

SEQ ID NO: 463263 - DNA, 25 bp, Mus musculus
tactgtgaagacttagctggaggct

SEQ ID NO: 463264 - DNA, 25 bp, Mus musculus
tactgtgaaggcaaacgagtccgct

SEQ ID NO: 463265 - DNA, 25 bp, Mus musculus
tactgtgaatctgtggccggctgga

SEQ ID NO: 463266 - DNA, 25 bp, Mus musculus
tactgtgacaaggagtatgccagcc

SEQ ID NO: 463267 - DNA, 25 bp, Mus musculus
tactgtgactaagagtattgtggag

SEQ ID NO: 463268 - DNA, 25 bp, Mus musculus
tactgtgactcagcatgaggaactt

SEQ ID NO: 463269 - DNA, 25 bp, Mus musculus
tactgtgagaggatcttatcataca

SEQ ID NO: 463270 - DNA, 25 bp, Mus musculus
tactgtgatgggagattggattatg

SEQ ID NO: 463271 - DNA, 25 bp, Mus musculus
tactgtgcagaggagagaatttagg

SEQ ID NO: 463272 - DNA, 25 bp, Mus musculus
tactgtgccatacgcctgctcttgg

SEQ ID NO: 463273 - DNA, 25 bp, Mus musculus
tactgtgcctaaccatgtgaaatga

SEQ ID NO: 463274 - DNA, 25 bp, Mus musculus
tactgtgccttcagtcagcagggca

SEQ ID NO: 463275 - DNA, 25 bp, Mus musculus
tactgtgcctttgatcgtgatgagc

SEQ ID NO: 463276 - DNA, 25 bp, Mus musculus
tactgtgcttggaggtaaacttccc

SEQ ID NO: 463277 - DNA, 25 bp, Mus musculus
tactgtggaactgtgcaatgaacaa

SEQ ID NO: 463278 - DNA, 25 bp, Mus musculus
tactgtggagtgcagcatggctctc

SEQ ID NO: 463279 - DNA, 25 bp, Mus musculus
tactgtggcacacacaatgggcagc

SEQ ID NO: 463280 - DNA, 25 bp, Mus musculus
tactgtgggctcatatagagagccc

SEQ ID NO: 463281 - DNA, 25 bp, Mus musculus
tactgtgtacccaaactgaggctca

SEQ ID NO: 463282 - DNA, 25 bp, Mus musculus
tactgtgtcagagccatttgtcctc

SEQ ID NO: 463283 - DNA, 25 bp, Mus musculus
tactgtgtcctgaaagcaccactgt

SEQ ID NO: 463284 - DNA, 25 bp, Mus musculus
tactgtgtctggcatgatgggcacc

SEQ ID NO: 463285 - DNA, 25 bp, Mus musculus
tactgtgtgtaagtgaattgaggtg

SEQ ID NO: 463286 - DNA, 25 bp, Mus musculus
tactgttaacgaatccttaccaaag

SEQ ID NO: 463287 - DNA, 25 bp, Mus musculus
tactgttacataaaagtctcacttc

SEQ ID NO: 463288 - DNA, 25 bp, Mus musculus
tactgttagatgtgggctgcaaggc

SEQ ID NO: 463289 - DNA, 25 bp, Mus musculus
tactgttagccctgttgagagtccc

SEQ ID NO: 463290 - DNA, 25 bp, Mus musculus
tactgttcaactccgatagaggtgg

SEQ ID NO: 463291 - DNA, 25 bp, Mus musculus
tactgttcacgttttaaatgtctct

SEQ ID NO: 463292 - DNA, 25 bp, Mus musculus
tactgttcactttccaggcaccata

SEQ ID NO: 463293 - DNA, 25 bp, Mus musculus
tactgttcagagatcaatgcaaggg

SEQ ID NO: 463294 - DNA, 25 bp, Mus musculus
tactgttcagagttacatgggccca

SEQ ID NO: 463295 - DNA, 25 bp, Mus musculus
tactgttcccaaccgcctggatgga

SEQ ID NO: 463296 - DNA, 25 bp, Mus musculus
tactgttctggctgagaggagatgc

SEQ ID NO: 463297 - DNA, 25 bp, Mus musculus
tactgttcttctgggagcacgtggc

SEQ ID NO: 463298 - DNA, 25 bp, Mus musculus
tactgttgctaagtccatctagaag

SEQ ID NO: 463299 - DNA, 25 bp, Mus musculus
tactgttggccagagcgtggaagcc

SEQ ID NO: 463300 - DNA, 25 bp, Mus musculus
tactgttgggatgtgcacttatgca

SEQ ID NO: 463301 - DNA, 25 bp, Mus musculus
tactgttgggcacttctagggactt

SEQ ID NO: 463302 - DNA, 25 bp, Mus musculus
tactgttgggctcctgatcctggct

SEQ ID NO: 463303 - DNA, 25 bp, Mus musculus
tactgtttggtatgaccccgctgaa

SEQ ID NO: 463304 - DNA, 25 bp, Mus musculus
tacttaaaggagattggccacggct

SEQ ID NO: 463305 - DNA, 25 bp, Mus musculus
tacttaaagtggtgcccgagggagc

SEQ ID NO: 463306 - DNA, 25 bp, Mus musculus
tacttaacaagtccagccagaggct

SEQ ID NO: 463307 - DNA, 25 bp, Mus musculus
tacttaacattcttaggctacagtg

SEQ ID NO: 463308 - DNA, 25 bp, Mus musculus
tacttaacatttgggaagaagccgc

SEQ ID NO: 463309 - DNA, 25 bp, Mus musculus
tacttaacccttgatgagccgatga

SEQ ID NO: 463310 - DNA, 25 bp, Mus musculus
tacttaaggaaatggcaaggctctt

SEQ ID NO: 463311 - DNA, 25 bp, Mus musculus
tacttaaggcgcatcctgcacacgt

SEQ ID NO: 463312 - DNA, 25 bp, Mus musculus
tacttaaggtgaggcctgcggattc

SEQ ID NO: 463313 - DNA, 25 bp, Mus musculus
tacttaagtgcagggcatggccatg

SEQ ID NO: 463314 - DNA, 25 bp, Mus musculus
tacttaatgcaatttcctgaggctg

SEQ ID NO: 463315 - DNA, 25 bp, Mus musculus
tacttaatgctacgtagagaccaga

SEQ ID NO: 463316 - DNA, 25 bp, Mus musculus
tacttacgccagagcttggaggtcg

SEQ ID NO: 463317 - DNA, 25 bp, Mus musculus
tacttacgccatgagatcagtgaac

SEQ ID NO: 463318 - DNA, 25 bp, Mus musculus
tacttacgtcacttgtccttcaaca

SEQ ID NO: 463319 - DNA, 25 bp, Mus musculus
tacttactcggaacctgcattctgg

SEQ ID NO: 463320 - DNA, 25 bp, Mus musculus
tacttactgggcaccggcatgagaa

SEQ ID NO: 463321 - DNA, 25 bp, Mus musculus
tacttactgggtgctgaagccttgg

SEQ ID NO: 463322 - DNA, 25 bp, Mus musculus
tacttagaacctgccgtgttatcga

SEQ ID NO: 463323 - DNA, 25 bp, Mus musculus
tacttagacaaacagcgcagtcggc

SEQ ID NO: 463324 - DNA, 25 bp, Mus musculus
tacttagactttgcggagtccgggc

SEQ ID NO: 463325 - DNA, 25 bp, Mus musculus
tacttagaggtgagctgaagccctg

SEQ ID NO: 463326 - DNA, 25 bp, Mus musculus
tacttagcatctgtacctacctgga

SEQ ID NO: 463327 - DNA, 25 bp, Mus musculus
tacttagcctttccgatcattcgtg

SEQ ID NO: 463328 - DNA, 25 bp, Mus musculus
tacttagctggtggagacacggtct

SEQ ID NO: 463329 - DNA, 25 bp, Mus musculus
tacttaggaggctatgagtgcagct

SEQ ID NO: 463330 - DNA, 25 bp, Mus musculus
tacttaggcccgagtgatcagccac

SEQ ID NO: 463331 - DNA, 25 bp, Mus musculus
tacttagggagacaaatgcccgtgg

SEQ ID NO: 463332 - DNA, 25 bp, Mus musculus
tacttaggtaaacacacagcgatgt

SEQ ID NO: 463333 - DNA, 25 bp, Mus musculus
tacttagtaccaaaaggtctcaagg

SEQ ID NO: 463334 - DNA, 25 bp, Mus musculus
tacttagtctaagcgatcagaacgg

SEQ ID NO: 463335 - DNA, 25 bp, Mus musculus
tacttagtgagcctcttgcagccca

SEQ ID NO: 463336 - DNA, 25 bp, Mus musculus
tacttagtgctttgagacgatcaga

SEQ ID NO: 463337 - DNA, 25 bp, Mus musculus
tacttatatttactcagaaactggg

SEQ ID NO: 463338 - DNA, 25 bp, Mus musculus
tacttatcagaacgctgcagcccaa

SEQ ID NO: 463339 - DNA, 25 bp, Mus musculus
tacttatgccaatgaatgtgttctg

SEQ ID NO: 463340 - DNA, 25 bp, Mus musculus
tacttatgggctgccaagaccctgg

SEQ ID NO: 463341 - DNA, 25 bp, Mus musculus
tacttatttaccaactgagcactgc

SEQ ID NO: 463342 - DNA, 25 bp, Mus musculus
tacttcaaagacactggaggcgatg

SEQ ID NO: 463343 - DNA, 25 bp, Mus musculus
tacttcaaccagaccaagggcttcc

SEQ ID NO: 463344 - DNA, 25 bp, Mus musculus
tacttcaaccaggatgtcttccggg

SEQ ID NO: 463345 - DNA, 25 bp, Mus musculus
tacttcaaccgaggcatcatggcag

SEQ ID NO: 463346 - DNA, 25 bp, Mus musculus
tacttcaagggcaactacgactttg

SEQ ID NO: 463347 - DNA, 25 bp, Mus musculus
tacttcaagtgcaacagcgagtggg

SEQ ID NO: 463348 - DNA, 25 bp, Mus musculus
tacttcaagtgtttggtgcatggga

SEQ ID NO: 463349 - DNA, 25 bp, Mus musculus
tacttcaatccttgggactgtccag

SEQ ID NO: 463350 - DNA, 25 bp, Mus musculus
tacttcaatgtcatcaacacctggg

SEQ ID NO: 463351 - DNA, 25 bp, Mus musculus
tacttcacaagtccggagaggagac

SEQ ID NO: 463352 - DNA, 25 bp, Mus musculus
tacttcaccactgagaccgtgctgg

SEQ ID NO: 463353 - DNA, 25 bp, Mus musculus
tacttcacccgtggaactagaggtc

SEQ ID NO: 463354 - DNA, 25 bp, Mus musculus
tacttcacctggtcaagatgccgag

SEQ ID NO: 463355 - DNA, 25 bp, Mus musculus
tacttcacgctagtgaccgaaggcg

SEQ ID NO: 463356 - DNA, 25 bp, Mus musculus
tacttcactgatctagaggccttgg

SEQ ID NO: 463357 - DNA, 25 bp, Mus musculus
tacttcacttggatctgggttggcc

SEQ ID NO: 463358 - DNA, 25 bp, Mus musculus
tacttcagaatgcaatggcagtacc

SEQ ID NO: 463359 - DNA, 25 bp, Mus musculus
tacttcagagaagttaaagtatggt

SEQ ID NO: 463360 - DNA, 25 bp, Mus musculus
tacttcagagatgcttcagctagga

SEQ ID NO: 463361 - DNA, 25 bp, Mus musculus
tacttcagcaaagcgtggcagcgcg

SEQ ID NO: 463362 - DNA, 25 bp, Mus musculus
tacttcagcacttaaatccctgagg

SEQ ID NO: 463363 - DNA, 25 bp, Mus musculus
tacttcagccatgctccggtggtgc

SEQ ID NO: 463364 - DNA, 25 bp, Mus musculus
tacttcagcctaagctactcgggag

SEQ ID NO: 463365 - DNA, 25 bp, Mus musculus
tacttcagctactcatcaatctatg

SEQ ID NO: 463366 - DNA, 25 bp, Mus musculus
tacttcaggaaaatgccgctgttgc

SEQ ID NO: 463367 - DNA, 25 bp, Mus musculus
tacttcaggagccttcaggagctgc

SEQ ID NO: 463368 - DNA, 25 bp, Mus musculus
tacttcaggatatctggaaggtgcc

SEQ ID NO: 463369 - DNA, 25 bp, Mus musculus
tacttcatacacagtgccacggctg

SEQ ID NO: 463370 - DNA, 25 bp, Mus musculus
tacttcatcgtgagcctggctgctg

SEQ ID NO: 463371 - DNA, 25 bp, Mus musculus
tacttcatgcagcttcagacgcgtt

SEQ ID NO: 463372 - DNA, 25 bp, Mus musculus
tacttcatggcaatagtgtgttcac

SEQ ID NO: 463373 - DNA, 25 bp, Mus musculus
tacttcatggtaggcgcttctgccg

SEQ ID NO: 463374 - DNA, 25 bp, Mus musculus
tacttcatgtacgtcctctgggctc

SEQ ID NO: 463375 - DNA, 25 bp, Mus musculus
tacttccacggctggcttattggcc

SEQ ID NO: 463376 - DNA, 25 bp, Mus musculus
tacttccaggctgaacccagtgctg

SEQ ID NO: 463377 - DNA, 25 bp, Mus musculus
tacttccagttccagctatttaaaa

SEQ ID NO: 463378 - DNA, 25 bp, Mus musculus
tacttcccacgacaagactgctcag

SEQ ID NO: 463379 - DNA, 25 bp, Mus musculus
tacttccggaccatggaggagctcc

SEQ ID NO: 463380 - DNA, 25 bp, Mus musculus
tacttccggcgcatcagtgagtctg

SEQ ID NO: 463381 - DNA, 25 bp, Mus musculus
tacttccgggacgaggagatgcaaa

SEQ ID NO: 463382 - DNA, 25 bp, Mus musculus
tacttccgtgtagccagactctggc

SEQ ID NO: 463383 - DNA, 25 bp, Mus musculus
tacttcctgccttgtgaccacacag

SEQ ID NO: 463384 - DNA, 25 bp, Mus musculus
tacttcctgggtgtctactggcaac

SEQ ID NO: 463385 - DNA, 25 bp, Mus musculus
tacttcctggtagcacctgcagtgg

SEQ ID NO: 463386 - DNA, 25 bp, Mus musculus
tacttcgaccggatgagcacatagc

SEQ ID NO: 463387 - DNA, 25 bp, Mus musculus
tacttcgagaacatgggtctacgct

SEQ ID NO: 463388 - DNA, 25 bp, Mus musculus
tacttcgcaaacagaatatctggcg

SEQ ID NO: 463389 - DNA, 25 bp, Mus musculus
tacttcggaacaaaactgcacaggc

SEQ ID NO: 463390 - DNA, 25 bp, Mus musculus
tacttcggagagtggtaagaccacg

SEQ ID NO: 463391 - DNA, 25 bp, Mus musculus
tacttcggagcctgtatggcacacc

SEQ ID NO: 463392 - DNA, 25 bp, Mus musculus
tacttcggatcctgggacggaacca

SEQ ID NO: 463393 - DNA, 25 bp, Mus musculus
tacttcgggctgttcctctcatggg

SEQ ID NO: 463394 - DNA, 25 bp, Mus musculus
tacttcggtattccaaggagcggca

SEQ ID NO: 463395 - DNA, 25 bp, Mus musculus
tacttcgtgggaaccatgagtgtgc

SEQ ID NO: 463396 - DNA, 25 bp, Mus musculus
tacttctacaaaggccgggactact

SEQ ID NO: 463397 - DNA, 25 bp, Mus musculus
tacttctactggctgtgcagggaca

SEQ ID NO: 463398 - DNA, 25 bp, Mus musculus
tacttctattcgagtgcgcgctggg

SEQ ID NO: 463399 - DNA, 25 bp, Mus musculus
tacttctcagccaactgtgcgtgtg

SEQ ID NO: 463400 - DNA, 25 bp, Mus musculus
tacttctctgttggacctgatgccc

SEQ ID NO: 463401 - DNA, 25 bp, Mus musculus
tacttctgaacagagcaagggagaa

SEQ ID NO: 463402 - DNA, 25 bp, Mus musculus
tacttctgcaggtcgtacaccctgg

SEQ ID NO: 463403 - DNA, 25 bp, Mus musculus
tacttctgcgtgctgggtgccatct

SEQ ID NO: 463404 - DNA, 25 bp, Mus musculus
tacttctggccttgacagactttag

SEQ ID NO: 463405 - DNA, 25 bp, Mus musculus
tacttctggtgactcacgaccgcct

SEQ ID NO: 463406 - DNA, 25 bp, Mus musculus
tacttctgtgaagaccgcaaggctg

SEQ ID NO: 463407 - DNA, 25 bp, Mus musculus
tacttctgtgactactgtgaccgct

SEQ ID NO: 463408 - DNA, 25 bp, Mus musculus
tacttctgtgagaaggagccttcaa

SEQ ID NO: 463409 - DNA, 25 bp, Mus musculus
tacttctgtgagtcctccaactgga

SEQ ID NO: 463410 - DNA, 25 bp, Mus musculus
tacttctgtttccatgaggccgccg

SEQ ID NO: 463411 - DNA, 25 bp, Mus musculus
tacttcttcctgcagtcggtggact

SEQ ID NO: 463412 - DNA, 25 bp, Mus musculus
tacttcttcgatccgtgagagcagc

SEQ ID NO: 463413 - DNA, 25 bp, Mus musculus
tacttgaaacgatacagcggacttc

SEQ ID NO: 463414 - DNA, 25 bp, Mus musculus
tacttgaaccaagaggatgctgtcc

SEQ ID NO: 463415 - DNA, 25 bp, Mus musculus
tacttgaaccggaagcactgcatac

SEQ ID NO: 463416 - DNA, 25 bp, Mus musculus
tacttgaagatcgagttccctcggg

SEQ ID NO: 463417 - DNA, 25 bp, Mus musculus
tacttgaagtctgcatccgggtcct

SEQ ID NO: 463418 - DNA, 25 bp, Mus musculus
tacttgaatgtgttagctgatgacc

SEQ ID NO: 463419 - DNA, 25 bp, Mus musculus
tacttgaccatgagaaagcattggc

SEQ ID NO: 463420 - DNA, 25 bp, Mus musculus
tacttgaccggctctgggccaattg

SEQ ID NO: 463421 - DNA, 25 bp, Mus musculus
tacttgacgatctttggaggaccca

SEQ ID NO: 463422 - DNA, 25 bp, Mus musculus
tacttgactgccaaggacggcactg

SEQ ID NO: 463423 - DNA, 25 bp, Mus musculus
tacttgagacaaaacactccaggtg

SEQ ID NO: 463424 - DNA, 25 bp, Mus musculus
tacttgagccaaaaaaccatcaggg

SEQ ID NO: 463425 - DNA, 25 bp, Mus musculus
tacttgagcccgactgcggcggagc

SEQ ID NO: 463426 - DNA, 25 bp, Mus musculus
tacttgagcgttcctagatctttag

SEQ ID NO: 463427 - DNA, 25 bp, Mus musculus
tacttgaggctatcagaacctccgg

SEQ ID NO: 463428 - DNA, 25 bp, Mus musculus
tacttgagggcggagatcctacctg

SEQ ID NO: 463429 - DNA, 25 bp, Mus musculus
tacttgagtatatggacggagctgc

SEQ ID NO: 463430 - DNA, 25 bp, Mus musculus
tacttgatgatcagtgagctagact

SEQ ID NO: 463431 - DNA, 25 bp, Mus musculus
tacttgatggagtcacaccctgagc

SEQ ID NO: 463432 - DNA, 25 bp, Mus musculus
tacttgatggttaaagagaatctgt

SEQ ID NO: 463433 - DNA, 25 bp, Mus musculus
tacttgatgtaagaggaccctgttc

SEQ ID NO: 463434 - DNA, 25 bp, Mus musculus
tacttgatttgatgacagagaccct

SEQ ID NO: 463435 - DNA, 25 bp, Mus musculus
tacttgcaaaccaaatgaaagcttg

SEQ ID NO: 463436 - DNA, 25 bp, Mus musculus
tacttgcagtgcctaaaagcagtgt

SEQ ID NO: 463437 - DNA, 25 bp, Mus musculus
tacttgcatgggtatgggtggccaa

SEQ ID NO: 463438 - DNA, 25 bp, Mus musculus
tacttgcccaggtgagacatggact

SEQ ID NO: 463439 - DNA, 25 bp, Mus musculus
tacttgccccatagatgatgctgaa

SEQ ID NO: 463440 - DNA, 25 bp, Mus musculus
tacttgcgctatctggccatgctgg

SEQ ID NO: 463441 - DNA, 25 bp, Mus musculus
tacttgctaatgtgtggcatttcac

SEQ ID NO: 463442 - DNA, 25 bp, Mus musculus
tacttgctacggacaggccgctttg

SEQ ID NO: 463443 - DNA, 25 bp, Mus musculus
tacttgctgaacaaatgctggtgtg

SEQ ID NO: 463444 - DNA, 25 bp, Mus musculus
tacttgctgtactttccaggactgg

SEQ ID NO: 463445 - DNA, 25 bp, Mus musculus
tacttgctgtgagaagttcggcctc

SEQ ID NO: 463446 - DNA, 25 bp, Mus musculus
tacttggaaagtacttgtgggatat

SEQ ID NO: 463447 - DNA, 25 bp, Mus musculus
tacttggaagacacagcaatttgcc

SEQ ID NO: 463448 - DNA, 25 bp, Mus musculus
tacttggaaggatgaggattttgct

SEQ ID NO: 463449 - DNA, 25 bp, Mus musculus
tacttggacaatgtgcagctgggtc

SEQ ID NO: 463450 - DNA, 25 bp, Mus musculus
tacttggagcggacgaggaagccaa

SEQ ID NO: 463451 - DNA, 25 bp, Mus musculus
tacttggaggagacatggtgaacca

SEQ ID NO: 463452 - DNA, 25 bp, Mus musculus
tacttggaggcccagaatggcacac

SEQ ID NO: 463453 - DNA, 25 bp, Mus musculus
tacttggatgagatccggcacttcc

SEQ ID NO: 463454 - DNA, 25 bp, Mus musculus
tacttggatgcagggttgcgccgac

SEQ ID NO: 463455 - DNA, 25 bp, Mus musculus
tacttggatgtcagctgaagactcc

SEQ ID NO: 463456 - DNA, 25 bp, Mus musculus
tacttggcaataggcgagggaacaa

SEQ ID NO: 463457 - DNA, 25 bp, Mus musculus
tacttggcattggacactcagggat

SEQ ID NO: 463458 - DNA, 25 bp, Mus musculus
tacttggcgacgatcgagaagcagc

SEQ ID NO: 463459 - DNA, 25 bp, Mus musculus
tacttggcgaggtgctgcttccctg

SEQ ID NO: 463460 - DNA, 25 bp, Mus musculus
tacttgggctactactgggcatgtg

SEQ ID NO: 463461 - DNA, 25 bp, Mus musculus
tacttgggtcctggaggatctattc

SEQ ID NO: 463462 - DNA, 25 bp, Mus musculus
tacttgggtcgcatgaggaacctgc

SEQ ID NO: 463463 - DNA, 25 bp, Mus musculus
tacttggtccgtcccagtagcggtc

SEQ ID NO: 463464 - DNA, 25 bp, Mus musculus
tacttggtggtgtagcagcaatcct

SEQ ID NO: 463465 - DNA, 25 bp, Mus musculus
tacttggtgttctgggcattcctac

SEQ ID NO: 463466 - DNA, 25 bp, Mus musculus
tacttgtagcaacgactctcagggt

SEQ ID NO: 463467 - DNA, 25 bp, Mus musculus
tacttgtatttttcagtggagtgca

SEQ ID NO: 463468 - DNA, 25 bp, Mus musculus
tacttgtgacctactgatggcctcc

SEQ ID NO: 463469 - DNA, 25 bp, Mus musculus
tacttgtgagcaatcctgtcggcac

SEQ ID NO: 463470 - DNA, 25 bp, Mus musculus
tacttgtgcacgctgccttctgtgc

SEQ ID NO: 463471 - DNA, 25 bp, Mus musculus
tacttgtgggtccaaagccaaaggc

SEQ ID NO: 463472 - DNA, 25 bp, Mus musculus
tacttgttaaaaagtgcctgccgac

SEQ ID NO: 463473 - DNA, 25 bp, Mus musculus
tacttgttaagaccggctggagccg

SEQ ID NO: 463474 - DNA, 25 bp, Mus musculus
tacttgttacttagacccgagcgga

SEQ ID NO: 463475 - DNA, 25 bp, Mus musculus
tacttgttcaaagccactgctggct

SEQ ID NO: 463476 - DNA, 25 bp, Mus musculus
tacttgttgctcttggtgtagacct

SEQ ID NO: 463477 - DNA, 25 bp, Mus musculus
tacttgtttcagtggtgcacgcata

SEQ ID NO: 463478 - DNA, 25 bp, Mus musculus
tactttacaaaacaatggctcagaa

SEQ ID NO: 463479 - DNA, 25 bp, Mus musculus
tactttacctcatggacggcagctg

SEQ ID NO: 463480 - DNA, 25 bp, Mus musculus
tactttactacagaccgaggcctgg

SEQ ID NO: 463481 - DNA, 25 bp, Mus musculus
tactttagagcacgttaaacatctc

SEQ ID NO: 463482 - DNA, 25 bp, Mus musculus
tactttagggacaggagagcccagc

SEQ ID NO: 463483 - DNA, 25 bp, Mus musculus
tactttatttctatactgtccaggg

SEQ ID NO: 463484 - DNA, 25 bp, Mus musculus
tactttcaaccgagcttcagagcca

SEQ ID NO: 463485 - DNA, 25 bp, Mus musculus
tactttcaagctgagacctgcaggc

SEQ ID NO: 463486 - DNA, 25 bp, Mus musculus
tactttcaaggccaagtgaagcccg

SEQ ID NO: 463487 - DNA, 25 bp, Mus musculus
tactttccatcttcgagggcgagag

SEQ ID NO: 463488 - DNA, 25 bp, Mus musculus
tactttccgggttcaagtcagcaga

SEQ ID NO: 463489 - DNA, 25 bp, Mus musculus
tactttccgtcgctctacgaccggg

SEQ ID NO: 463490 - DNA, 25 bp, Mus musculus
tactttcgcagtgagtttccctgtg

SEQ ID NO: 463491 - DNA, 25 bp, Mus musculus
tactttcggtttgtttgccacagcg

SEQ ID NO: 463492 - DNA, 25 bp, Mus musculus
tactttctctcctccacaggaggga

SEQ ID NO: 463493 - DNA, 25 bp, Mus musculus
tactttctgcagcaagtagcaccct

SEQ ID NO: 463494 - DNA, 25 bp, Mus musculus
tactttctggcccagatgggccggt

SEQ ID NO: 463495 - DNA, 25 bp, Mus musculus
tactttctggtatccctggcgacgg

SEQ ID NO: 463496 - DNA, 25 bp, Mus musculus
tactttctgtttttagggcgctgct

SEQ ID NO: 463497 - DNA, 25 bp, Mus musculus
tactttgaaacattactgtgctaca

SEQ ID NO: 463498 - DNA, 25 bp, Mus musculus
tactttgaactattaatcagctctg

SEQ ID NO: 463499 - DNA, 25 bp, Mus musculus
tactttgaattgagctatgctggcc

SEQ ID NO: 463500 - DNA, 25 bp, Mus musculus
tactttgacagagatttggtgctgc

SEQ ID NO: 463501 - DNA, 25 bp, Mus musculus
tactttgacctcatcctggcaaggg

SEQ ID NO: 463502 - DNA, 25 bp, Mus musculus
tactttgagaagaagagacgtcgca

SEQ ID NO: 463503 - DNA, 25 bp, Mus musculus
tactttgagaagctggccctcaggg

SEQ ID NO: 463504 - DNA, 25 bp, Mus musculus
tactttgagtggagtgatggaaccc

SEQ ID NO: 463505 - DNA, 25 bp, Mus musculus
tactttgatggaaacctggagaagc

SEQ ID NO: 463506 - DNA, 25 bp, Mus musculus
tactttgcagaatggaggcagctct

SEQ ID NO: 463507 - DNA, 25 bp, Mus musculus
tactttgcaggcaacccgagccttg

SEQ ID NO: 463508 - DNA, 25 bp, Mus musculus
tactttgccaagcaagggacaatgc

SEQ ID NO: 463509 - DNA, 25 bp, Mus musculus
tactttgctccagtataaccaagag

SEQ ID NO: 463510 - DNA, 25 bp, Mus musculus
tactttgctgatgaacatgcgtgtg

SEQ ID NO: 463511 - DNA, 25 bp, Mus musculus
tactttggaccagatgaagccttcc

SEQ ID NO: 463512 - DNA, 25 bp, Mus musculus
tactttggccggactgttgagaccc

SEQ ID NO: 463513 - DNA, 25 bp, Mus musculus
tactttgggcctgacgtgacagaac

SEQ ID NO: 463514 - DNA, 25 bp, Mus musculus
tactttgtaataacgcctgctggaa

SEQ ID NO: 463515 - DNA, 25 bp, Mus musculus
tactttgtacagtgtccggccttga

SEQ ID NO: 463516 - DNA, 25 bp, Mus musculus
tactttgtagaggtccaggctcctg

SEQ ID NO: 463517 - DNA, 25 bp, Mus musculus
tactttgtatagctggccctatggc

SEQ ID NO: 463518 - DNA, 25 bp, Mus musculus
tactttgtcactgcaggcaaccggc

SEQ ID NO: 463519 - DNA, 25 bp, Mus musculus
tactttgtccatattattatgtccc

SEQ ID NO: 463520 - DNA, 25 bp, Mus musculus
tactttgttaggaataggaggctgc

SEQ ID NO: 463521 - DNA, 25 bp, Mus musculus
tactttgttctcaataaatggataa

SEQ ID NO: 463522 - DNA, 25 bp, Mus musculus
tacttttacttcctggcctcctggg

SEQ ID NO: 463523 - DNA, 25 bp, Mus musculus
tacttttagccttctgggagccacc

SEQ ID NO: 463524 - DNA, 25 bp, Mus musculus
tacttttagcttccagatgcagccg

SEQ ID NO: 463525 - DNA, 25 bp, Mus musculus
tacttttcctatgttgtgtgcacgc

SEQ ID NO: 463526 - DNA, 25 bp, Mus musculus
tacttttcgggtcagggatcagaca

SEQ ID NO: 463527 - DNA, 25 bp, Mus musculus
tacttttcttgccaagcgcgctccg

SEQ ID NO: 463528 - DNA, 25 bp, Mus musculus
tacttttggcaggtcaactccgggc

SEQ ID NO: 463529 - DNA, 25 bp, Mus musculus
tacttttggcccttttgttagcgca

SEQ ID NO: 463530 - DNA, 25 bp, Mus musculus
tactttttacgctggacgagaggaa

SEQ ID NO: 463531 - DNA, 25 bp, Mus musculus
tactttttagctgaggtttccatag

SEQ ID NO: 463532 - DNA, 25 bp, Mus musculus
tactttttcagtggtgcagcagcag

SEQ ID NO: 463533 - DNA, 25 bp, Mus musculus
tactttttcatctaactgaccagag

SEQ ID NO: 463534 - DNA, 25 bp, Mus musculus
tagaaaaagccgaagactgctggcc

SEQ ID NO: 463535 - DNA, 25 bp, Mus musculus
tagaaaaatggacttggaccctggc

SEQ ID NO: 463536 - DNA, 25 bp, Mus musculus
tagaaaacaagctcgacctggacgg

SEQ ID NO: 463537 - DNA, 25 bp, Mus musculus
tagaaaacagcaagccccagctggg

SEQ ID NO: 463538 - DNA, 25 bp, Mus musculus
tagaaaacatcgaccaacacagaac

SEQ ID NO: 463539 - DNA, 25 bp, Mus musculus
tagaaaacctcctgcattgccagtt

SEQ ID NO: 463540 - DNA, 25 bp, Mus musculus
tagaaaagactagctgagggtgacc

SEQ ID NO: 463541 - DNA, 25 bp, Mus musculus
tagaaaagacttgtgaagccaggcg

SEQ ID NO: 463542 - DNA, 25 bp, Mus musculus
tagaaaaggcttttccaggcaacat

SEQ ID NO: 463543 - DNA, 25 bp, Mus musculus
tagaaaagggctggcctagtgtaca

SEQ ID NO: 463544 - DNA, 25 bp, Mus musculus
tagaaaatacaggtatcaccaagcc

SEQ ID NO: 463545 - DNA, 25 bp, Mus musculus
tagaaaatcactgctcccctggtca

SEQ ID NO: 463546 - DNA, 25 bp, Mus musculus
tagaaaatctgaaaccgtgaacacg

SEQ ID NO: 463547 - DNA, 25 bp, Mus musculus
tagaaaatgcctacaaacgactggc

SEQ ID NO: 463548 - DNA, 25 bp, Mus musculus
tagaaacaaacgaccatgccactgc

SEQ ID NO: 463549 - DNA, 25 bp, Mus musculus
tagaaacaagcctgaagcagactgt

SEQ ID NO: 463550 - DNA, 25 bp, Mus musculus
tagaaacagaaccactcaggtggcg

SEQ ID NO: 463551 - DNA, 25 bp, Mus musculus
tagaaacagaagagtccaaccgagt

SEQ ID NO: 463552 - DNA, 25 bp, Mus musculus
tagaaacaggctctttccagctctt

SEQ ID NO: 463553 - DNA, 25 bp, Mus musculus
tagaaacccggatagatcacatgat

SEQ ID NO: 463554 - DNA, 25 bp, Mus musculus
tagaaaccgcacagaccatagtaga

SEQ ID NO: 463555 - DNA, 25 bp, Mus musculus
tagaaaccggcctcgaatcgggact

SEQ ID NO: 463556 - DNA, 25 bp, Mus musculus
tagaaacctctacgaagcctcagct

SEQ ID NO: 463557 - DNA, 25 bp, Mus musculus
tagaaaccttttgagggcgtggcat

SEQ ID NO: 463558 - DNA, 25 bp, Mus musculus
tagaaacgaccagttcagccaggag

SEQ ID NO: 463559 - DNA, 25 bp, Mus musculus
tagaaacgctttaggttcccactca

SEQ ID NO: 463560 - DNA, 25 bp, Mus musculus
tagaaactggccttgcagaaaccca

SEQ ID NO: 463561 - DNA, 25 bp, Mus musculus
tagaaactggcgcttctgcccaaag

SEQ ID NO: 463562 - DNA, 25 bp, Mus musculus
tagaaacttgaaccctcctttggag

SEQ ID NO: 463563 - DNA, 25 bp, Mus musculus
tagaaactttgcagtgaccctggga

SEQ ID NO: 463564 - DNA, 25 bp, Mus musculus
tagaaagaagcccagttcccagtgg

SEQ ID NO: 463565 - DNA, 25 bp, Mus musculus
tagaaagagcactgagccagacgtg

SEQ ID NO: 463566 - DNA, 25 bp, Mus musculus
tagaaagagctctgccaagaaaact

SEQ ID NO: 463567 - DNA, 25 bp, Mus musculus
tagaaagcactactggagaggttcc

SEQ ID NO: 463568 - DNA, 25 bp, Mus musculus
tagaaagcgtcaggaaatggccaca

SEQ ID NO: 463569 - DNA, 25 bp, Mus musculus
tagaaagctaggcatgtaaccccag

SEQ ID NO: 463570 - DNA, 25 bp, Mus musculus
tagaaagcttgatccgattagcaga

SEQ ID NO: 463571 - DNA, 25 bp, Mus musculus
tagaaaggccatttcagggctcggg

SEQ ID NO: 463572 - DNA, 25 bp, Mus musculus
tagaaaggcgccgatgcagaattcc

SEQ ID NO: 463573 - DNA, 25 bp, Mus musculus
tagaaaggctttcagtgactggaga

SEQ ID NO: 463574 - DNA, 25 bp, Mus musculus
tagaaaggtggccaagtatcagaac

SEQ ID NO: 463575 - DNA, 25 bp, Mus musculus
tagaaagtatagtcctcgaggaagt

SEQ ID NO: 463576 - DNA, 25 bp, Mus musculus
tagaaagtcttatatgctgggcagt

SEQ ID NO: 463577 - DNA, 25 bp, Mus musculus
tagaaagtgaggaagacactaatca

SEQ ID NO: 463578 - DNA, 25 bp, Mus musculus
tagaaagttagttgcgctggcagca

SEQ ID NO: 463579 - DNA, 25 bp, Mus musculus
tagaaatacaattacgggcttggtg

SEQ ID NO: 463580 - DNA, 25 bp, Mus musculus
tagaaatgacaaaccctagagctgg

SEQ ID NO: 463581 - DNA, 25 bp, Mus musculus
tagaaatgggttgcaaacttatccc

SEQ ID NO: 463582 - DNA, 25 bp, Mus musculus
tagaaattcacagatggcacaggag

SEQ ID NO: 463583 - DNA, 25 bp, Mus musculus
tagaaattgtgaaaggagtagcaac

SEQ ID NO: 463584 - DNA, 25 bp, Mus musculus
tagaacaacagaaagtaggcagccc

SEQ ID NO: 463585 - DNA, 25 bp, Mus musculus
tagaacaacgtgctgatcccaatgc

SEQ ID NO: 463586 - DNA, 25 bp, Mus musculus
tagaacacggctctgcttatgaacg

SEQ ID NO: 463587 - DNA, 25 bp, Mus musculus
tagaacacttcggaggacctcaagg

SEQ ID NO: 463588 - DNA, 25 bp, Mus musculus
tagaacagagagaaatgactgcacg

SEQ ID NO: 463589 - DNA, 25 bp, Mus musculus
tagaacagtacctcaggctgccctt

SEQ ID NO: 463590 - DNA, 25 bp, Mus musculus
tagaacatcattcagtgacaaactc

SEQ ID NO: 463591 - DNA, 25 bp, Mus musculus
tagaacatgagatcacccagactgg

SEQ ID NO: 463592 - DNA, 25 bp, Mus musculus
tagaacatgagttccccggatgcct

SEQ ID NO: 463593 - DNA, 25 bp, Mus musculus
tagaacattagatctgagcccgatg

SEQ ID NO: 463594 - DNA, 25 bp, Mus musculus
tagaaccacttggaatgaatggcgc

SEQ ID NO: 463595 - DNA, 25 bp, Mus musculus
tagaaccagaacctgttttatgcag

SEQ ID NO: 463596 - DNA, 25 bp, Mus musculus
tagaaccatgcctctagtaggtgca

SEQ ID NO: 463597 - DNA, 25 bp, Mus musculus
tagaacccaaggagacagcaccatt

SEQ ID NO: 463598 - DNA, 25 bp, Mus musculus
tagaaccccatttcgcctgagtgag

SEQ ID NO: 463599 - DNA, 25 bp, Mus musculus
tagaaccgaccttgtatggcacagt

SEQ ID NO: 463600 - DNA, 25 bp, Mus musculus
tagaaccggctatttccaacctatg

SEQ ID NO: 463601 - DNA, 25 bp, Mus musculus
tagaaccgtctagaagatgcacttg

SEQ ID NO: 463602 - DNA, 25 bp, Mus musculus
tagaacctcaattaatgcctgctgg

SEQ ID NO: 463603 - DNA, 25 bp, Mus musculus
tagaacctcataaacctggtgcggt

SEQ ID NO: 463604 - DNA, 25 bp, Mus musculus
tagaacctgccgtgttatcgagctt

SEQ ID NO: 463605 - DNA, 25 bp, Mus musculus
tagaacctgggactatggactccgt

SEQ ID NO: 463606 - DNA, 25 bp, Mus musculus
tagaacctttctgggcggaccttca

SEQ ID NO: 463607 - DNA, 25 bp, Mus musculus
tagaacctttgaccgattttgtggc

SEQ ID NO: 463608 - DNA, 25 bp, Mus musculus
tagaacctttgtgcagactgtctgg

SEQ ID NO: 463609 - DNA, 25 bp, Mus musculus
tagaacgcctggagaatgacacact

SEQ ID NO: 463610 - DNA, 25 bp, Mus musculus
tagaacggcaggagctcattcagca

SEQ ID NO: 463611 - DNA, 25 bp, Mus musculus
tagaacgtgaggttttgcagagcct

SEQ ID NO: 463612 - DNA, 25 bp, Mus musculus
tagaactagcgagtgttaacctgtc

SEQ ID NO: 463613 - DNA, 25 bp, Mus musculus
tagaactcagagactgcgggcctta

SEQ ID NO: 463614 - DNA, 25 bp, Mus musculus
tagaactcagcaggtatggccgtgc

SEQ ID NO: 463615 - DNA, 25 bp, Mus musculus
tagaactgaattgtgggctgtggcc

SEQ ID NO: 463616 - DNA, 25 bp, Mus musculus
tagaactgctggtcagtcggcggtc

SEQ ID NO: 463617 - DNA, 25 bp, Mus musculus
tagaactggacacctggaagactgt

SEQ ID NO: 463618 - DNA, 25 bp, Mus musculus
tagaactgggcatggaaaggcacac

SEQ ID NO: 463619 - DNA, 25 bp, Mus musculus
tagaactgtgtttgtagatgcttaa

SEQ ID NO: 463620 - DNA, 25 bp, Mus musculus
tagaacttgttgatgtggccgcacc

SEQ ID NO: 463621 - DNA, 25 bp, Mus musculus
tagaagaaaactgactggctttgcc

SEQ ID NO: 463622 - DNA, 25 bp, Mus musculus
tagaagaaaattagccacacagtag

SEQ ID NO: 463623 - DNA, 25 bp, Mus musculus
tagaagaacttactatggtggacaa

SEQ ID NO: 463624 - DNA, 25 bp, Mus musculus
tagaagaagaccaatataatatgtg

SEQ ID NO: 463625 - DNA, 25 bp, Mus musculus
tagaagaagctcactggacaggtcc

SEQ ID NO: 463626 - DNA, 25 bp, Mus musculus
tagaagaaggaagcatgcgctacct

SEQ ID NO: 463627 - DNA, 25 bp, Mus musculus
tagaagaaggttatcgtttgccggc

SEQ ID NO: 463628 - DNA, 25 bp, Mus musculus
tagaagaagttctacgagacccgga

SEQ ID NO: 463629 - DNA, 25 bp, Mus musculus
tagaagaatgtgacccgtacagcgg

SEQ ID NO: 463630 - DNA, 25 bp, Mus musculus
tagaagacacaaggatgagccagcc

SEQ ID NO: 463631 - DNA, 25 bp, Mus musculus
tagaagacagagtggcacagggaac

SEQ ID NO: 463632 - DNA, 25 bp, Mus musculus
tagaagacgactggaaatacatggc

SEQ ID NO: 463633 - DNA, 25 bp, Mus musculus
tagaagacgcgaactctgagttccg

SEQ ID NO: 463634 - DNA, 25 bp, Mus musculus
tagaagactatatgaacttcacaca

SEQ ID NO: 463635 - DNA, 25 bp, Mus musculus
tagaagactctgtaggctggttgcc

SEQ ID NO: 463636 - DNA, 25 bp, Mus musculus
tagaagacttcctagtcacccgtcc

SEQ ID NO: 463637 - DNA, 25 bp, Mus musculus
tagaagagcaatcgtgaatccaacc

SEQ ID NO: 463638 - DNA, 25 bp, Mus musculus
tagaagagcagacttgtttttattc

SEQ ID NO: 463639 - DNA, 25 bp, Mus musculus
tagaagaggaaagtaataaggatat

SEQ ID NO: 463640 - DNA, 25 bp, Mus musculus
tagaagaggcaggttgtagatccga

SEQ ID NO: 463641 - DNA, 25 bp, Mus musculus
tagaagaggccaactgatctcagct

SEQ ID NO: 463642 - DNA, 25 bp, Mus musculus
tagaagagggtatcacagaggccat

SEQ ID NO: 463643 - DNA, 25 bp, Mus musculus
tagaagaggttcaacagctgcgcca

SEQ ID NO: 463644 - DNA, 25 bp, Mus musculus
tagaagatacaaagctgtcagaaca

SEQ ID NO: 463645 - DNA, 25 bp, Mus musculus
tagaagatctatactgggcaccaca

SEQ ID NO: 463646 - DNA, 25 bp, Mus musculus
tagaagatctccaaagcctgggctc

SEQ ID NO: 463647 - DNA, 25 bp, Mus musculus
tagaagatgatggtttgcaagccgc

SEQ ID NO: 463648 - DNA, 25 bp, Mus musculus
tagaagatgcttaccctctggcagg

SEQ ID NO: 463649 - DNA, 25 bp, Mus musculus
tagaagattaccagcagttcgtgag

SEQ ID NO: 463650 - DNA, 25 bp, Mus musculus
tagaagcagaactcgattgccaccg

SEQ ID NO: 463651 - DNA, 25 bp, Mus musculus
tagaagcaggttgatcagaaggccc

SEQ ID NO: 463652 - DNA, 25 bp, Mus musculus
tagaagccaaccctatggatgatgg

SEQ ID NO: 463653 - DNA, 25 bp, Mus musculus
tagaagccaatgtagaaagtgcgga

SEQ ID NO: 463654 - DNA, 25 bp, Mus musculus
tagaagccacggtcttatgccagtg

SEQ ID NO: 463655 - DNA, 25 bp, Mus musculus
tagaagccgcagcttcatgtgccct

SEQ ID NO: 463656 - DNA, 25 bp, Mus musculus
tagaagccttactcggaaagaaagc

SEQ ID NO: 463657 - DNA, 25 bp, Mus musculus
tagaagcgaagttcctctaggaaaa

SEQ ID NO: 463658 - DNA, 25 bp, Mus musculus
tagaagcgcctgcaattctcagagc

SEQ ID NO: 463659 - DNA, 25 bp, Mus musculus
tagaagcgctagaggaggaactaag

SEQ ID NO: 463660 - DNA, 25 bp, Mus musculus
tagaagcgggcctcacctgaagctt

SEQ ID NO: 463661 - DNA, 25 bp, Mus musculus
tagaagcggtatgcatggccgaaga

SEQ ID NO: 463662 - DNA, 25 bp, Mus musculus
tagaagcgtcttgcgtctgacaggg

SEQ ID NO: 463663 - DNA, 25 bp, Mus musculus
tagaagctaggaatgaactggatca

SEQ ID NO: 463664 - DNA, 25 bp, Mus musculus
tagaagctaggctgacatcttagca

SEQ ID NO: 463665 - DNA, 25 bp, Mus musculus
tagaagctccaggttcgcacaagag

SEQ ID NO: 463666 - DNA, 25 bp, Mus musculus
tagaagctgatttaggtcctaggcc

SEQ ID NO: 463667 - DNA, 25 bp, Mus musculus
tagaagcttctacatggtgctgcca

SEQ ID NO: 463668 - DNA, 25 bp, Mus musculus
tagaagcttgtcatccttgagggcc

SEQ ID NO: 463669 - DNA, 25 bp, Mus musculus
tagaaggacctgcttatccaagagc

SEQ ID NO: 463670 - DNA, 25 bp, Mus musculus
tagaaggagcactacccaatcattc

SEQ ID NO: 463671 - DNA, 25 bp, Mus musculus
tagaaggagctggtgtcttgcccga

SEQ ID NO: 463672 - DNA, 25 bp, Mus musculus
tagaaggagtgtgtatgagtgcctc

SEQ ID NO: 463673 - DNA, 25 bp, Mus musculus
tagaaggcaactatccaccctggca

SEQ ID NO: 463674 - DNA, 25 bp, Mus musculus
tagaaggccctctgatccagtgtgc

SEQ ID NO: 463675 - DNA, 25 bp, Mus musculus
tagaaggcgtccagtacattgcaga

SEQ ID NO: 463676 - DNA, 25 bp, Mus musculus
tagaagggaaaagtgaacccagtca

SEQ ID NO: 463677 - DNA, 25 bp, Mus musculus
tagaagggaaagcattaatgtctgg

SEQ ID NO: 463678 - DNA, 25 bp, Mus musculus
tagaagggaccagtacaggtttgac

SEQ ID NO: 463679 - DNA, 25 bp, Mus musculus
tagaagggagcttcacactgtgccc

SEQ ID NO: 463680 - DNA, 25 bp, Mus musculus
tagaagggtctacagcagtttgctc

SEQ ID NO: 463681 - DNA, 25 bp, Mus musculus
tagaaggtcctttgtgagcagggcc

SEQ ID NO: 463682 - DNA, 25 bp, Mus musculus
tagaaggtggtgcttcagaccctcc

SEQ ID NO: 463683 - DNA, 25 bp, Mus musculus
tagaaggttctgtataactggctcc

SEQ ID NO: 463684 - DNA, 25 bp, Mus musculus
tagaagtaataatatataggacatc

SEQ ID NO: 463685 - DNA, 25 bp, Mus musculus
tagaagtaatctaccccgagtttgg

SEQ ID NO: 463686 - DNA, 25 bp, Mus musculus
tagaagtaatctcgcactggcaccc

SEQ ID NO: 463687 - DNA, 25 bp, Mus musculus
tagaagtagacttacaagcagccgt

SEQ ID NO: 463688 - DNA, 25 bp, Mus musculus
tagaagtatcagagacaaaccggac

SEQ ID NO: 463689 - DNA, 25 bp, Mus musculus
tagaagtcagctgaccaggccagtg

SEQ ID NO: 463690 - DNA, 25 bp, Mus musculus
tagaagtcaggaagatgagctgtgc

SEQ ID NO: 463691 - DNA, 25 bp, Mus musculus
tagaagtctcaaggcctatggcgag

SEQ ID NO: 463692 - DNA, 25 bp, Mus musculus
tagaagtgagcagccgtgtcagtcc

SEQ ID NO: 463693 - DNA, 25 bp, Mus musculus
tagaagtgcgaaactctcatttctg

SEQ ID NO: 463694 - DNA, 25 bp, Mus musculus
tagaagtgcgcatgcatgacagcca

SEQ ID NO: 463695 - DNA, 25 bp, Mus musculus
tagaagtgtaccatctcaccaaggc

SEQ ID NO: 463696 - DNA, 25 bp, Mus musculus
tagaataatgtcacactcagccggc

SEQ ID NO: 463697 - DNA, 25 bp, Mus musculus
tagaatacaaggacgcaaatgccgc

SEQ ID NO: 463698 - DNA, 25 bp, Mus musculus
tagaatacagctacccactggtcgg

SEQ ID NO: 463699 - DNA, 25 bp, Mus musculus
tagaatagacttggacagggatggc

SEQ ID NO: 463700 - DNA, 25 bp, Mus musculus
tagaatagcggtggcctgaaaagcg

SEQ ID NO: 463701 - DNA, 25 bp, Mus musculus
tagaatcacagtgcatgcagggcgc

SEQ ID NO: 463702 - DNA, 25 bp, Mus musculus
tagaatccaagggagtcgtgtcccc

SEQ ID NO: 463703 - DNA, 25 bp, Mus musculus
tagaatccacgtgggagaagcccca

SEQ ID NO: 463704 - DNA, 25 bp, Mus musculus
tagaatcccatggtgacagctgcgg

SEQ ID NO: 463705 - DNA, 25 bp, Mus musculus
tagaatccgctcctcctgaaagatg

SEQ ID NO: 463706 - DNA, 25 bp, Mus musculus
tagaatcctgagtcttgaggcctcc

SEQ ID NO: 463707 - DNA, 25 bp, Mus musculus
tagaatctagaaaaggccagggtcc

SEQ ID NO: 463708 - DNA, 25 bp, Mus musculus
tagaatctcggcacgatgcagggct

SEQ ID NO: 463709 - DNA, 25 bp, Mus musculus
tagaatctgaacctcctccgtgaat

SEQ ID NO: 463710 - DNA, 25 bp, Mus musculus
tagaatctgcggctccttgctggag

SEQ ID NO: 463711 - DNA, 25 bp, Mus musculus
tagaatctgggcaactctgaacccg

SEQ ID NO: 463712 - DNA, 25 bp, Mus musculus
tagaatgaatgaaatcccgggtggc

SEQ ID NO: 463713 - DNA, 25 bp, Mus musculus
tagaatgcctggagcttgtacctgg

SEQ ID NO: 463714 - DNA, 25 bp, Mus musculus
tagaatgctaatgaggaaggcccgg

SEQ ID NO: 463715 - DNA, 25 bp, Mus musculus
tagaatggcggagtgtggaatccca

SEQ ID NO: 463716 - DNA, 25 bp, Mus musculus
tagaatggcgtgtaagtagacccct

SEQ ID NO: 463717 - DNA, 25 bp, Mus musculus
tagaatgtgttttcatgcccggcct

SEQ ID NO: 463718 - DNA, 25 bp, Mus musculus
tagaattactggacaccgtggcctt

SEQ ID NO: 463719 - DNA, 25 bp, Mus musculus
tagaattagagccagtgtaggcttg

SEQ ID NO: 463720 - DNA, 25 bp, Mus musculus
tagaattcacaaacgcatagctgcc

SEQ ID NO: 463721 - DNA, 25 bp, Mus musculus
tagaattcagtgtgaaccgcagcca

SEQ ID NO: 463722 - DNA, 25 bp, Mus musculus
tagaattcttgctacagtcaggaga

SEQ ID NO: 463723 - DNA, 25 bp, Mus musculus
tagaattgctctgggccctaaacgg

SEQ ID NO: 463724 - DNA, 25 bp, Mus musculus
tagaatttggaatccctgcaccggg

SEQ ID NO: 463725 - DNA, 25 bp, Mus musculus
tagacaaacccagagtagtgcgcct

SEQ ID NO: 463726 - DNA, 25 bp, Mus musculus
tagacaaacccctggactgggaggc

SEQ ID NO: 463727 - DNA, 25 bp, Mus musculus
tagacaacgtctcactgcctgctaa

SEQ ID NO: 463728 - DNA, 25 bp, Mus musculus
tagacaactcgttcatctggagagg

SEQ ID NO: 463729 - DNA, 25 bp, Mus musculus
tagacaagagatcgcaagtgagagc

SEQ ID NO: 463730 - DNA, 25 bp, Mus musculus
tagacaagaggatcagcaggttcat

SEQ ID NO: 463731 - DNA, 25 bp, Mus musculus
tagacaagatggataaaggatggcc

SEQ ID NO: 463732 - DNA, 25 bp, Mus musculus
tagacaagcagcaacgaaagcgcct

SEQ ID NO: 463733 - DNA, 25 bp, Mus musculus
tagacaagccaaagacctcttaagg

SEQ ID NO: 463734 - DNA, 25 bp, Mus musculus
tagacaaggaaggtccacggttact

SEQ ID NO: 463735 - DNA, 25 bp, Mus musculus
tagacaaggcctttgccagcgagga

SEQ ID NO: 463736 - DNA, 25 bp, Mus musculus
tagacaagtacaaggtcgaccctgg

SEQ ID NO: 463737 - DNA, 25 bp, Mus musculus
tagacaatcaccattcacctccaat

SEQ ID NO: 463738 - DNA, 25 bp, Mus musculus
tagacaatggaaactgaaggacaag

SEQ ID NO: 463739 - DNA, 25 bp, Mus musculus
tagacacaaagatggcttccaccgg

SEQ ID NO: 463740 - DNA, 25 bp, Mus musculus
tagacacaaattacggcaaagaaga

SEQ ID NO: 463741 - DNA, 25 bp, Mus musculus
tagacacagaaaaaggatccaagcc

SEQ ID NO: 463742 - DNA, 25 bp, Mus musculus
tagacacagactgctgctattgctc

SEQ ID NO: 463743 - DNA, 25 bp, Mus musculus
tagacacagcactttgaaccaggcc

SEQ ID NO: 463744 - DNA, 25 bp, Mus musculus
tagacacagcttggagggtaacccc

SEQ ID NO: 463745 - DNA, 25 bp, Mus musculus
tagacaccgacactgatgacgaggg

SEQ ID NO: 463746 - DNA, 25 bp, Mus musculus
tagacaccgggtctcagaatggaca

SEQ ID NO: 463747 - DNA, 25 bp, Mus musculus
tagacaccttagagctctctggcgg

SEQ ID NO: 463748 - DNA, 25 bp, Mus musculus
tagacacgctggagttgacacgcca

SEQ ID NO: 463749 - DNA, 25 bp, Mus musculus
tagacacgctgtacgatggcaagct

SEQ ID NO: 463750 - DNA, 25 bp, Mus musculus
tagacacggagacaaagaaggagct

SEQ ID NO: 463751 - DNA, 25 bp, Mus musculus
tagacacgggtttttcctgcagctg

SEQ ID NO: 463752 - DNA, 25 bp, Mus musculus
tagacactggttcaggatggacgcc

SEQ ID NO: 463753 - DNA, 25 bp, Mus musculus
tagacactgtgctcgtgaggcagga

SEQ ID NO: 463754 - DNA, 25 bp, Mus musculus
tagacacttccagctagtggcaggg

SEQ ID NO: 463755 - DNA, 25 bp, Mus musculus
tagacactttgttcaacctgcagca

SEQ ID NO: 463756 - DNA, 25 bp, Mus musculus
tagacagaaggataccgcagttccc

SEQ ID NO: 463757 - DNA, 25 bp, Mus musculus
tagacagaatgtttcccgtttgggc

SEQ ID NO: 463758 - DNA, 25 bp, Mus musculus
tagacagactcagaggcataacggt

SEQ ID NO: 463759 - DNA, 25 bp, Mus musculus
tagacagatattttgccaggcctgc

SEQ ID NO: 463760 - DNA, 25 bp, Mus musculus
tagacagcatgtgaatgtttaagca

SEQ ID NO: 463761 - DNA, 25 bp, Mus musculus
tagacagctgcacgttcaggctctg

SEQ ID NO: 463762 - DNA, 25 bp, Mus musculus
tagacagcttgtcttgcaagatggt

SEQ ID NO: 463763 - DNA, 25 bp, Mus musculus
tagacaggatgttctgccccaagtg

SEQ ID NO: 463764 - DNA, 25 bp, Mus musculus
tagacaggcatgtactccgaggact

SEQ ID NO: 463765 - DNA, 25 bp, Mus musculus
tagacaggctcattcactggtttcc

SEQ ID NO: 463766 - DNA, 25 bp, Mus musculus
tagacaggctgggtttgggacttca

SEQ ID NO: 463767 - DNA, 25 bp, Mus musculus
tagacagggagattcaagggctgcc

SEQ ID NO: 463768 - DNA, 25 bp, Mus musculus
tagacagggcatcaggataccacac

SEQ ID NO: 463769 - DNA, 25 bp, Mus musculus
tagacagggtgatcggaccaggtca

SEQ ID NO: 463770 - DNA, 25 bp, Mus musculus
tagacagtggaagacgacacgtgga

SEQ ID NO: 463771 - DNA, 25 bp, Mus musculus
tagacagttcagaccgctaacttac

SEQ ID NO: 463772 - DNA, 25 bp, Mus musculus
tagacatcagtaagccagggtttgg

SEQ ID NO: 463773 - DNA, 25 bp, Mus musculus
tagacatcatgtttgctcgttttgg

SEQ ID NO: 463774 - DNA, 25 bp, Mus musculus
tagacatcattgttcatccacctga

SEQ ID NO: 463775 - DNA, 25 bp, Mus musculus
tagacatcctctggtgggagccact

SEQ ID NO: 463776 - DNA, 25 bp, Mus musculus
tagacatctgttgccgccttcagga

SEQ ID NO: 463777 - DNA, 25 bp, Mus musculus
tagacatgacgagaaaggctctggc

SEQ ID NO: 463778 - DNA, 25 bp, Mus musculus
tagacatgctaacatggcacagccg

SEQ ID NO: 463779 - DNA, 25 bp, Mus musculus
tagacatggaaagcgacgatacccg

SEQ ID NO: 463780 - DNA, 25 bp, Mus musculus
tagacatggctcactcttggaatga

SEQ ID NO: 463781 - DNA, 25 bp, Mus musculus
tagacatggcttttaagcacccctg

SEQ ID NO: 463782 - DNA, 25 bp, Mus musculus
tagacattccagtatcatctgccat

SEQ ID NO: 463783 - DNA, 25 bp, Mus musculus
tagacattctggactgactgactga

SEQ ID NO: 463784 - DNA, 25 bp, Mus musculus
tagacattttcattggcaccgagga

SEQ ID NO: 463785 - DNA, 25 bp, Mus musculus
tagaccacatctgattccatcttgg

SEQ ID NO: 463786 - DNA, 25 bp, Mus musculus
tagaccacccgaggctagtgtagcc

SEQ ID NO: 463787 - DNA, 25 bp, Mus musculus
tagaccacctagtgaagagtcccag

SEQ ID NO: 463788 - DNA, 25 bp, Mus musculus
tagaccagatcaaagccatcagagg

SEQ ID NO: 463789 - DNA, 25 bp, Mus musculus
tagaccagcacctttttgatccaga

SEQ ID NO: 463790 - DNA, 25 bp, Mus musculus
tagaccagctcaacgagggcacccg

SEQ ID NO: 463791 - DNA, 25 bp, Mus musculus
tagaccagtgggtggtaactcatca

SEQ ID NO: 463792 - DNA, 25 bp, Mus musculus
tagaccagttgggtggtaaacctga

SEQ ID NO: 463793 - DNA, 25 bp, Mus musculus
tagaccattgctctcctgacattaa

SEQ ID NO: 463794 - DNA, 25 bp, Mus musculus
tagacccagagagatttgaacctcg

SEQ ID NO: 463795 - DNA, 25 bp, Mus musculus
tagacccaggtcgtttagagacagt

SEQ ID NO: 463796 - DNA, 25 bp, Mus musculus
tagacccatgggaatcaaagccagc

SEQ ID NO: 463797 - DNA, 25 bp, Mus musculus
tagacccattggtaggtgctgccct

SEQ ID NO: 463798 - DNA, 25 bp, Mus musculus
tagacccggttgagacaatccgcga

SEQ ID NO: 463799 - DNA, 25 bp, Mus musculus
tagaccctatgagcctttgtaagag

SEQ ID NO: 463800 - DNA, 25 bp, Mus musculus
tagaccctccttttagcatcccatg

SEQ ID NO: 463801 - DNA, 25 bp, Mus musculus
tagaccctgagaacactggaacgat

SEQ ID NO: 463802 - DNA, 25 bp, Mus musculus
tagaccctgcaaagtgtcccctggt

SEQ ID NO: 463803 - DNA, 25 bp, Mus musculus
tagaccctgcaagttttaggagttg

SEQ ID NO: 463804 - DNA, 25 bp, Mus musculus
tagaccgcgcgtggcatatcaaatg

SEQ ID NO: 463805 - DNA, 25 bp, Mus musculus
tagaccggagccatgaagtgatcca

SEQ ID NO: 463806 - DNA, 25 bp, Mus musculus
tagaccggccttaactcacattcaa

SEQ ID NO: 463807 - DNA, 25 bp, Mus musculus
tagaccggctattgatgtggcttgg

SEQ ID NO: 463808 - DNA, 25 bp, Mus musculus
tagaccggtaatggaaagatgcttc

SEQ ID NO: 463809 - DNA, 25 bp, Mus musculus
tagaccgtagagaaagcatggagcc

SEQ ID NO: 463810 - DNA, 25 bp, Mus musculus
tagacctagaattgcatccttggaa

SEQ ID NO: 463811 - DNA, 25 bp, Mus musculus
tagacctaggtgttccctctggcca

SEQ ID NO: 463812 - DNA, 25 bp, Mus musculus
tagacctcagagtctggctagcagg

SEQ ID NO: 463813 - DNA, 25 bp, Mus musculus
tagacctcccagttggtgaccagat

SEQ ID NO: 463814 - DNA, 25 bp, Mus musculus
tagacctcccgagccgagttggtca

SEQ ID NO: 463815 - DNA, 25 bp, Mus musculus
tagacctcgctggattcaggcttga

SEQ ID NO: 463816 - DNA, 25 bp, Mus musculus
tagacctgaagtggcgtcacacgct

SEQ ID NO: 463817 - DNA, 25 bp, Mus musculus
tagacctgatccaagaggaagaccc

SEQ ID NO: 463818 - DNA, 25 bp, Mus musculus
tagacctggacttctaggcagagcc

SEQ ID NO: 463819 - DNA, 25 bp, Mus musculus
tagacctggcttggacatgcgcctg

SEQ ID NO: 463820 - DNA, 25 bp, Mus musculus
tagacctgggtgttctctctgcttg

SEQ ID NO: 463821 - DNA, 25 bp, Mus musculus
tagacctggttaagcagaaacactg

SEQ ID NO: 463822 - DNA, 25 bp, Mus musculus
tagaccttcaggagccaacaacgat

SEQ ID NO: 463823 - DNA, 25 bp, Mus musculus
tagaccttgatgtgctattacgggc

SEQ ID NO: 463824 - DNA, 25 bp, Mus musculus
tagacctttgctctcatgtaggtgc

SEQ ID NO: 463825 - DNA, 25 bp, Mus musculus
tagacgaaggtgcaaacgggcaact

SEQ ID NO: 463826 - DNA, 25 bp, Mus musculus
tagacgaggccaagaggaagatcag

SEQ ID NO: 463827 - DNA, 25 bp, Mus musculus
tagacgattcagatacccagagaga

SEQ ID NO: 463828 - DNA, 25 bp, Mus musculus
tagacgcaacttcccctatggcaga

SEQ ID NO: 463829 - DNA, 25 bp, Mus musculus
tagacgcatttcaggaaggcacagt

SEQ ID NO: 463830 - DNA, 25 bp, Mus musculus
tagacgctgatagtccctaatctgc

SEQ ID NO: 463831 - DNA, 25 bp, Mus musculus
tagacggagaagagcatgtcggctt

SEQ ID NO: 463832 - DNA, 25 bp, Mus musculus
tagacggcagaggtgcaagccatct

SEQ ID NO: 463833 - DNA, 25 bp, Mus musculus
tagacggccgtgtgtagatatctct

SEQ ID NO: 463834 - DNA, 25 bp, Mus musculus
tagacgtatctctggagtcaatcgc

SEQ ID NO: 463835 - DNA, 25 bp, Mus musculus
tagacgtccataacaacctgcggca

SEQ ID NO: 463836 - DNA, 25 bp, Mus musculus
tagacgtcctgatcaataatgcggg

SEQ ID NO: 463837 - DNA, 25 bp, Mus musculus
tagacgtctccttcaacaagttggg

SEQ ID NO: 463838 - DNA, 25 bp, Mus musculus
tagacgtgagaagcaaccctctgca

SEQ ID NO: 463839 - DNA, 25 bp, Mus musculus
tagacgtggccagcttcttttgcag

SEQ ID NO: 463840 - DNA, 25 bp, Mus musculus
tagacgtggcgctctttatgtccaa

SEQ ID NO: 463841 - DNA, 25 bp, Mus musculus
tagactaacctgtaacatgcaggtg

SEQ ID NO: 463842 - DNA, 25 bp, Mus musculus
tagactacacagtgggttggagccc

SEQ ID NO: 463843 - DNA, 25 bp, Mus musculus
tagactacaggtccagctgcggtgc

SEQ ID NO: 463844 - DNA, 25 bp, Mus musculus
tagactacgtgaacaagaggacgcc

SEQ ID NO: 463845 - DNA, 25 bp, Mus musculus
tagactactagctccctgcactgtg

SEQ ID NO: 463846 - DNA, 25 bp, Mus musculus
tagactactgactagggacctgaca

SEQ ID NO: 463847 - DNA, 25 bp, Mus musculus
tagactactgtagggtggccatctc

SEQ ID NO: 463848 - DNA, 25 bp, Mus musculus
tagactagcctgaatttgatgcctt

SEQ ID NO: 463849 - DNA, 25 bp, Mus musculus
tagactatgacagggacactcagcc

SEQ ID NO: 463850 - DNA, 25 bp, Mus musculus
tagactatgcagagttcagtgacag

SEQ ID NO: 463851 - DNA, 25 bp, Mus musculus
tagactatgcggaaatgactgccac

SEQ ID NO: 463852 - DNA, 25 bp, Mus musculus
tagactattcctacctgatcggccg

SEQ ID NO: 463853 - DNA, 25 bp, Mus musculus
tagactcactgttccgagatggccg

SEQ ID NO: 463854 - DNA, 25 bp, Mus musculus
tagactcatctgctgttttccattt

SEQ ID NO: 463855 - DNA, 25 bp, Mus musculus
tagactccaacttttaactgtgtgt

SEQ ID NO: 463856 - DNA, 25 bp, Mus musculus
tagactccagggtgatgggcattaa

SEQ ID NO: 463857 - DNA, 25 bp, Mus musculus
tagactccggccagcactgtgtgat

SEQ ID NO: 463858 - DNA, 25 bp, Mus musculus
tagactcgttgttgactccctccgg

SEQ ID NO: 463859 - DNA, 25 bp, Mus musculus
tagactctgattgggacgaagaccc

SEQ ID NO: 463860 - DNA, 25 bp, Mus musculus
tagactcttaacaggtacggcacac

SEQ ID NO: 463861 - DNA, 25 bp, Mus musculus
tagactgaaccagaccttctcaagg

SEQ ID NO: 463862 - DNA, 25 bp, Mus musculus
tagactgatggatgcctgtgtgtcc

SEQ ID NO: 463863 - DNA, 25 bp, Mus musculus
tagactgcagatgaactcccctggc

SEQ ID NO: 463864 - DNA, 25 bp, Mus musculus
tagactgccctccatcctgagatgg

SEQ ID NO: 463865 - DNA, 25 bp, Mus musculus
tagactgctacaatactccctggtg

SEQ ID NO: 463866 - DNA, 25 bp, Mus musculus
tagactgctctgtttcaagacagga

SEQ ID NO: 463867 - DNA, 25 bp, Mus musculus
tagactggagatactggagggctca

SEQ ID NO: 463868 - DNA, 25 bp, Mus musculus
tagactggcaagcatcgaggaaccg

SEQ ID NO: 463869 - DNA, 25 bp, Mus musculus
tagactgggaatcctggagttgcca

SEQ ID NO: 463870 - DNA, 25 bp, Mus musculus
tagactggggtggtctgaactcaca

SEQ ID NO: 463871 - DNA, 25 bp, Mus musculus
tagacttacaagcagccgtgagcca

SEQ ID NO: 463872 - DNA, 25 bp, Mus musculus
tagacttactgctacactagactgt

SEQ ID NO: 463873 - DNA, 25 bp, Mus musculus
tagacttcacctttgaccggcgtgt

SEQ ID NO: 463874 - DNA, 25 bp, Mus musculus
tagacttcatgggaacagatgctgc

SEQ ID NO: 463875 - DNA, 25 bp, Mus musculus
tagacttcccatgctgtgaaagagc

SEQ ID NO: 463876 - DNA, 25 bp, Mus musculus
tagacttcgggttttgcgtacagcc

SEQ ID NO: 463877 - DNA, 25 bp, Mus musculus
tagacttctaagagggtcccagaga

SEQ ID NO: 463878 - DNA, 25 bp, Mus musculus
tagacttctctcaagtgacctccac

SEQ ID NO: 463879 - DNA, 25 bp, Mus musculus
tagacttctggaccatcatgggcaa

SEQ ID NO: 463880 - DNA, 25 bp, Mus musculus
tagacttgcaatccagtggcactgt

SEQ ID NO: 463881 - DNA, 25 bp, Mus musculus
tagagaaaggccgtcaccaaatcca

SEQ ID NO: 463882 - DNA, 25 bp, Mus musculus
tagagaaagggaacgaatccacgct

SEQ ID NO: 463883 - DNA, 25 bp, Mus musculus
tagagaacaaagacatcaggctggc

SEQ ID NO: 463884 - DNA, 25 bp, Mus musculus
tagagaacaagggttcacgcccagg

SEQ ID NO: 463885 - DNA, 25 bp, Mus musculus
tagagaacaagtttcgagccacgcg

SEQ ID NO: 463886 - DNA, 25 bp, Mus musculus
tagagaacagatgtcatgactctgt

SEQ ID NO: 463887 - DNA, 25 bp, Mus musculus
tagagaacagttaaggaggacaccc

SEQ ID NO: 463888 - DNA, 25 bp, Mus musculus
tagagaacatcatcgggcgggacta

SEQ ID NO: 463889 - DNA, 25 bp, Mus musculus
tagagaaccggtctctgcccaggag

SEQ ID NO: 463890 - DNA, 25 bp, Mus musculus
tagagaactagcacacgcacaggtc

SEQ ID NO: 463891 - DNA, 25 bp, Mus musculus
tagagaacttttggaactgcttggg

SEQ ID NO: 463892 - DNA, 25 bp, Mus musculus
tagagaagcaccctgccaactatgg

SEQ ID NO: 463893 - DNA, 25 bp, Mus musculus
tagagaagctcacggcaaatatggg

SEQ ID NO: 463894 - DNA, 25 bp, Mus musculus
tagagaaggctgtttccggcaagga

SEQ ID NO: 463895 - DNA, 25 bp, Mus musculus
tagagaaggtcctggcagtgtccca

SEQ ID NO: 463896 - DNA, 25 bp, Mus musculus
tagagaagtcaagcccatcttcacc

SEQ ID NO: 463897 - DNA, 25 bp, Mus musculus
tagagaagttgctactcggccactc

SEQ ID NO: 463898 - DNA, 25 bp, Mus musculus
tagagaagttgtatgcagccggtgc

SEQ ID NO: 463899 - DNA, 25 bp, Mus musculus
tagagaatggagatcagcccctgag

SEQ ID NO: 463900 - DNA, 25 bp, Mus musculus
tagagaatgttacatgttaccaaca

SEQ ID NO: 463901 - DNA, 25 bp, Mus musculus
tagagacaaagctgcaagagcattg

SEQ ID NO: 463902 - DNA, 25 bp, Mus musculus
tagagacaatagtgcagatggcagc

SEQ ID NO: 463903 - DNA, 25 bp, Mus musculus
tagagacaatggtagcagcctgtag

SEQ ID NO: 463904 - DNA, 25 bp, Mus musculus
tagagacactggcaatgactgggcc

SEQ ID NO: 463905 - DNA, 25 bp, Mus musculus
tagagacacttctccgggatgacca

SEQ ID NO: 463906 - DNA, 25 bp, Mus musculus
tagagaccagaataaacatttgagt

SEQ ID NO: 463907 - DNA, 25 bp, Mus musculus
tagagacccaatgcaagtgaagaca

SEQ ID NO: 463908 - DNA, 25 bp, Mus musculus
tagagaccccagtgcgttatcagga

SEQ ID NO: 463909 - DNA, 25 bp, Mus musculus
tagagaccctcactcgcttggttcg

SEQ ID NO: 463910 - DNA, 25 bp, Mus musculus
tagagaccctctgccaaatcgcttt

SEQ ID NO: 463911 - DNA, 25 bp, Mus musculus
tagagaccgctaggcttcttcatct

SEQ ID NO: 463912 - DNA, 25 bp, Mus musculus
tagagaccgtaagacccagctagct

SEQ ID NO: 463913 - DNA, 25 bp, Mus musculus
tagagaccgtaaggcttgaggaagt

SEQ ID NO: 463914 - DNA, 25 bp, Mus musculus
tagagacctctactagcgactggat

SEQ ID NO: 463915 - DNA, 25 bp, Mus musculus
tagagacgctgttgtcactgctgcc

SEQ ID NO: 463916 - DNA, 25 bp, Mus musculus
tagagacgtctctgaagcggctgca

SEQ ID NO: 463917 - DNA, 25 bp, Mus musculus
tagagactagctgtgtatccagacc

SEQ ID NO: 463918 - DNA, 25 bp, Mus musculus
tagagactcatacacgatggtactt

SEQ ID NO: 463919 - DNA, 25 bp, Mus musculus
tagagactcctaacaaggttgcctc

SEQ ID NO: 463920 - DNA, 25 bp, Mus musculus
tagagactcgggaatttaggcacct

SEQ ID NO: 463921 - DNA, 25 bp, Mus musculus
tagagacttcccatctgccttggtt

SEQ ID NO: 463922 - DNA, 25 bp, Mus musculus
tagagactttctttccacacgagga

SEQ ID NO: 463923 - DNA, 25 bp, Mus musculus
tagagacttttgtaacggtccctgg

SEQ ID NO: 463924 - DNA, 25 bp, Mus musculus
tagagagactatcggaccatggcgc

SEQ ID NO: 463925 - DNA, 25 bp, Mus musculus
tagagagagttcctcctgttgcagg

SEQ ID NO: 463926 - DNA, 25 bp, Mus musculus
tagagagataagacacggagcctgc

SEQ ID NO: 463927 - DNA, 25 bp, Mus musculus
tagagagatattcccagcagcctgg

SEQ ID NO: 463928 - DNA, 25 bp, Mus musculus
tagagagcaggttgatagtaccaga

SEQ ID NO: 463929 - DNA, 25 bp, Mus musculus
tagagagcagtgtttgccacaacag

SEQ ID NO: 463930 - DNA, 25 bp, Mus musculus
tagagagcccttcctcagggcttgg

SEQ ID NO: 463931 - DNA, 25 bp, Mus musculus
tagagagctcttgggaaatgctacc

SEQ ID NO: 463932 - DNA, 25 bp, Mus musculus
tagagaggattttacgtcgcagaaa

SEQ ID NO: 463933 - DNA, 25 bp, Mus musculus
tagagaggccacactgaatgacagt

SEQ ID NO: 463934 - DNA, 25 bp, Mus musculus
tagagagggaggagtcttgccccac

SEQ ID NO: 463935 - DNA, 25 bp, Mus musculus
tagagaggtctctgccagacatccg

SEQ ID NO: 463936 - DNA, 25 bp, Mus musculus
tagagagtaaaagcacaacgtgtcc

SEQ ID NO: 463937 - DNA, 25 bp, Mus musculus
tagagagtcagctaggaagacaaag

SEQ ID NO: 463938 - DNA, 25 bp, Mus musculus
tagagatagaacttaggacctccag

SEQ ID NO: 463939 - DNA, 25 bp, Mus musculus
tagagatcatcctttgcgtttgggc

SEQ ID NO: 463940 - DNA, 25 bp, Mus musculus
tagagatcctagagtggaccctgcg

SEQ ID NO: 463941 - DNA, 25 bp, Mus musculus
tagagatcgacattgcccaagagcg

SEQ ID NO: 463942 - DNA, 25 bp, Mus musculus
tagagatgaataagaagcgcgaggc

SEQ ID NO: 463943 - DNA, 25 bp, Mus musculus
tagagatgagcaagttcgatcggcc

SEQ ID NO: 463944 - DNA, 25 bp, Mus musculus
tagagatgcccagtaaacactttgc

SEQ ID NO: 463945 - DNA, 25 bp, Mus musculus
tagagatgccttgcctaatgctttg

SEQ ID NO: 463946 - DNA, 25 bp, Mus musculus
tagagatgctgccaactgtcgctgt

SEQ ID NO: 463947 - DNA, 25 bp, Mus musculus
tagagatgctgctgaccaaggagtg

SEQ ID NO: 463948 - DNA, 25 bp, Mus musculus
tagagatggccagtccaaagaggga

SEQ ID NO: 463949 - DNA, 25 bp, Mus musculus
tagagatgtcacctttggagatgga

SEQ ID NO: 463950 - DNA, 25 bp, Mus musculus
tagagattaccctccaccagaaggc

SEQ ID NO: 463951 - DNA, 25 bp, Mus musculus
tagagattacgtccatctaggatgg

SEQ ID NO: 463952 - DNA, 25 bp, Mus musculus
tagagattcctgttgccacctggag

SEQ ID NO: 463953 - DNA, 25 bp, Mus musculus
tagagattctcaggtccaggcgttt

SEQ ID NO: 463954 - DNA, 25 bp, Mus musculus
tagagattgtacaggcaggctcctc

SEQ ID NO: 463955 - DNA, 25 bp, Mus musculus
tagagatttccgatccagtgcggga

SEQ ID NO: 463956 - DNA, 25 bp, Mus musculus
tagagcaaaagcatgtccatcaagt

SEQ ID NO: 463957 - DNA, 25 bp, Mus musculus
tagagcaagggatggacatggtcat

SEQ ID NO: 463958 - DNA, 25 bp, Mus musculus
tagagcacaagggactgtttcctgt

SEQ ID NO: 463959 - DNA, 25 bp, Mus musculus
tagagcacacgaggtgtccctgaac

SEQ ID NO: 463960 - DNA, 25 bp, Mus musculus
tagagcacagggagatcgctgacac

SEQ ID NO: 463961 - DNA, 25 bp, Mus musculus
tagagcacccatctgctgcatagga

SEQ ID NO: 463962 - DNA, 25 bp, Mus musculus
tagagcacctgaaatctcacgcggg

SEQ ID NO: 463963 - DNA, 25 bp, Mus musculus
tagagcacgcccatgaaaagtcaat

SEQ ID NO: 463964 - DNA, 25 bp, Mus musculus
tagagcactgacaaacttagtcggg

SEQ ID NO: 463965 - DNA, 25 bp, Mus musculus
tagagcagaagatatgctgggcttc

SEQ ID NO: 463966 - DNA, 25 bp, Mus musculus
tagagcagagaaaagcgaccgagat

SEQ ID NO: 463967 - DNA, 25 bp, Mus musculus
tagagcagatcgagaccatagggaa

SEQ ID NO: 463968 - DNA, 25 bp, Mus musculus
tagagcagcacagcagatgactcca

SEQ ID NO: 463969 - DNA, 25 bp, Mus musculus
tagagcagcctagtgcgctctggcg

SEQ ID NO: 463970 - DNA, 25 bp, Mus musculus
tagagcagcttataaggcaagggct

SEQ ID NO: 463971 - DNA, 25 bp, Mus musculus
tagagccaccgttcatgtgggacac

SEQ ID NO: 463972 - DNA, 25 bp, Mus musculus
tagagccagctagacccttgggaaa

SEQ ID NO: 463973 - DNA, 25 bp, Mus musculus
tagagccaggaaatgtttagcctcc

SEQ ID NO: 463974 - DNA, 25 bp, Mus musculus
tagagccaggctagtgggtgtccca

SEQ ID NO: 463975 - DNA, 25 bp, Mus musculus
tagagccaggcttgaccgaaaggtg

SEQ ID NO: 463976 - DNA, 25 bp, Mus musculus
tagagccagtcggtgatagcaaagg

SEQ ID NO: 463977 - DNA, 25 bp, Mus musculus
tagagcccagcgagctgttgctggc

SEQ ID NO: 463978 - DNA, 25 bp, Mus musculus
tagagccccgggtctcttctggctt

SEQ ID NO: 463979 - DNA, 25 bp, Mus musculus
tagagcccctcctgttttaaatgat

SEQ ID NO: 463980 - DNA, 25 bp, Mus musculus
tagagcccggccacaaattctgagg

SEQ ID NO: 463981 - DNA, 25 bp, Mus musculus
tagagcccggtgaggtaactaaaga

SEQ ID NO: 463982 - DNA, 25 bp, Mus musculus
tagagccgctggaactgactgatga

SEQ ID NO: 463983 - DNA, 25 bp, Mus musculus
tagagccgtcatcttccaatggtga

SEQ ID NO: 463984 - DNA, 25 bp, Mus musculus
tagagccgtggattgatggactctg

SEQ ID NO: 463985 - DNA, 25 bp, Mus musculus
tagagcctacctggaaacacatcgg

SEQ ID NO: 463986 - DNA, 25 bp, Mus musculus
tagagcctcagccaactgtgcagac

SEQ ID NO: 463987 - DNA, 25 bp, Mus musculus
tagagcctcattagcaggactcgtg

SEQ ID NO: 463988 - DNA, 25 bp, Mus musculus
tagagcctggcttgggttgggatgc

SEQ ID NO: 463989 - DNA, 25 bp, Mus musculus
tagagccttaagtcaaccccagatg

SEQ ID NO: 463990 - DNA, 25 bp, Mus musculus
tagagccttttcaaattttacaggg

SEQ ID NO: 463991 - DNA, 25 bp, Mus musculus
tagagcgcagctgaggcactagagc

SEQ ID NO: 463992 - DNA, 25 bp, Mus musculus
tagagcgcgtccttcaggactggaa

SEQ ID NO: 463993 - DNA, 25 bp, Mus musculus
tagagcggcacgtggttcaagccat

SEQ ID NO: 463994 - DNA, 25 bp, Mus musculus
tagagcggtcttacttgcggaaaaa

SEQ ID NO: 463995 - DNA, 25 bp, Mus musculus
tagagcgttcttaattccaccctgg

SEQ ID NO: 463996 - DNA, 25 bp, Mus musculus
tagagctaaggataaggagagcctc

SEQ ID NO: 463997 - DNA, 25 bp, Mus musculus
tagagctactgacaagggtgacccg

SEQ ID NO: 463998 - DNA, 25 bp, Mus musculus
tagagctcacagttaccaagtctgg

SEQ ID NO: 463999 - DNA, 25 bp, Mus musculus
tagagctcattcttaaccgcactgc

SEQ ID NO: 464000 - DNA, 25 bp, Mus musculus
tagagctccatgtgcaagtgcatgt

SEQ ID NO: 464001 - DNA, 25 bp, Mus musculus
tagagctcccgcgaccagggtttat

SEQ ID NO: 464002 - DNA, 25 bp, Mus musculus
tagagctctctgacgtgcacaggga

SEQ ID NO: 464003 - DNA, 25 bp, Mus musculus
tagagctgaaacctcaaggccgaat

SEQ ID NO: 464004 - DNA, 25 bp, Mus musculus
tagagctgacaccaacctctgctgt

SEQ ID NO: 464005 - DNA, 25 bp, Mus musculus
tagagctgaccgaagatcagggacc

SEQ ID NO: 464006 - DNA, 25 bp, Mus musculus
tagagctgacctcgctgtccgatga

SEQ ID NO: 464007 - DNA, 25 bp, Mus musculus
tagagctgataaggtggtctcggcc

SEQ ID NO: 464008 - DNA, 25 bp, Mus musculus
tagagctgccctggttcaagagcac

SEQ ID NO: 464009 - DNA, 25 bp, Mus musculus
tagagctgcctattctgtaccctgc

SEQ ID NO: 464010 - DNA, 25 bp, Mus musculus
tagagctggtctctctggtgcttcc

SEQ ID NO: 464011 - DNA, 25 bp, Mus musculus
tagagctgtatcagacgggttccac

SEQ ID NO: 464012 - DNA, 25 bp, Mus musculus
tagagctgtccagcatcccggtgct

SEQ ID NO: 464013 - DNA, 25 bp, Mus musculus
tagagctgtgctgaggttgcccacg

SEQ ID NO: 464014 - DNA, 25 bp, Mus musculus
tagagcttacatacgggttctggca

SEQ ID NO: 464015 - DNA, 25 bp, Mus musculus
tagagcttaggtcttggctaacttc

SEQ ID NO: 464016 - DNA, 25 bp, Mus musculus
tagagcttgcctaccaccaagagct

SEQ ID NO: 464017 - DNA, 25 bp, Mus musculus
tagagcttgtttatcattagtgaac

SEQ ID NO: 464018 - DNA, 25 bp, Mus musculus
tagaggaaagggtcgccagagacaa

SEQ ID NO: 464019 - DNA, 25 bp, Mus musculus
tagaggaaatctactccgccggaga

SEQ ID NO: 464020 - DNA, 25 bp, Mus musculus
tagaggaacctcagacttcagagca

SEQ ID NO: 464021 - DNA, 25 bp, Mus musculus
tagaggaactagaaccagagtcccg

SEQ ID NO: 464022 - DNA, 25 bp, Mus musculus
tagaggaactggctagacacctgca

SEQ ID NO: 464023 - DNA, 25 bp, Mus musculus
tagaggaagtgcaggaaacaagacc

SEQ ID NO: 464024 - DNA, 25 bp, Mus musculus
tagaggaccttgtcaaatgggcgca

SEQ ID NO: 464025 - DNA, 25 bp, Mus musculus
tagaggagactgtcaggtccgttcc

SEQ ID NO: 464026 - DNA, 25 bp, Mus musculus
tagaggagatccacaaccattcgac

SEQ ID NO: 464027 - DNA, 25 bp, Mus musculus
tagaggagcctcagccatgtgagcc

SEQ ID NO: 464028 - DNA, 25 bp, Mus musculus
tagaggagcgcccaagaatcttggc

SEQ ID NO: 464029 - DNA, 25 bp, Mus musculus
tagaggagctaaacctgcccaagtt

SEQ ID NO: 464030 - DNA, 25 bp, Mus musculus
tagaggaggttttcctgcctggaat

SEQ ID NO: 464031 - DNA, 25 bp, Mus musculus
tagaggatgaactagcaaccatgca

SEQ ID NO: 464032 - DNA, 25 bp, Mus musculus
tagaggcacaggtctctaaccttac

SEQ ID NO: 464033 - DNA, 25 bp, Mus musculus
tagaggcaggaacctatttcaggac

SEQ ID NO: 464034 - DNA, 25 bp, Mus musculus
tagaggcagtgtggctaaagttacg

SEQ ID NO: 464035 - DNA, 25 bp, Mus musculus
tagaggcatctgctactccggctga

SEQ ID NO: 464036 - DNA, 25 bp, Mus musculus
tagaggccaaccctggatacacagt

SEQ ID NO: 464037 - DNA, 25 bp, Mus musculus
tagaggcccatttgagcgctggacc

SEQ ID NO: 464038 - DNA, 25 bp, Mus musculus
tagaggccccaggtagacgctggaa

SEQ ID NO: 464039 - DNA, 25 bp, Mus musculus
tagaggcccctctgtgccattaagt

SEQ ID NO: 464040 - DNA, 25 bp, Mus musculus
tagaggccctggatgaactcgcttc

SEQ ID NO: 464041 - DNA, 25 bp, Mus musculus
tagaggctatctgggtaagtggacc

SEQ ID NO: 464042 - DNA, 25 bp, Mus musculus
tagaggctccccacgcgggacctga

SEQ ID NO: 464043 - DNA, 25 bp, Mus musculus
tagaggctccgacctgctgtcttgg

SEQ ID NO: 464044 - DNA, 25 bp, Mus musculus
tagaggctctcgacttgcttgacag

SEQ ID NO: 464045 - DNA, 25 bp, Mus musculus
tagaggctctgctgggtgtacccct

SEQ ID NO: 464046 - DNA, 25 bp, Mus musculus
tagaggcttctactggctaccaggg

SEQ ID NO: 464047 - DNA, 25 bp, Mus musculus
tagagggaagtcgtattctcagacc

SEQ ID NO: 464048 - DNA, 25 bp, Mus musculus
tagagggaccaactcctaacagacc

SEQ ID NO: 464049 - DNA, 25 bp, Mus musculus
tagagggccagtgccatgatccgac

SEQ ID NO: 464050 - DNA, 25 bp, Mus musculus
tagagggcctttgttactccagaga

SEQ ID NO: 464051 - DNA, 25 bp, Mus musculus
tagagggcggttcctgtacatgcct

SEQ ID NO: 464052 - DNA, 25 bp, Mus musculus
tagagggctactactaccatcggag

SEQ ID NO: 464053 - DNA, 25 bp, Mus musculus
tagagggtgagtttcgtttgcctag

SEQ ID NO: 464054 - DNA, 25 bp, Mus musculus
tagaggtaagctgcactggtaacgt

SEQ ID NO: 464055 - DNA, 25 bp, Mus musculus
tagaggtcaccaccataatccggca

SEQ ID NO: 464056 - DNA, 25 bp, Mus musculus
tagaggtccactacgataatcccgc

SEQ ID NO: 464057 - DNA, 25 bp, Mus musculus
tagaggtccagaaagcagaaggatc

SEQ ID NO: 464058 - DNA, 25 bp, Mus musculus
tagaggtcctagacacacagactgc

SEQ ID NO: 464059 - DNA, 25 bp, Mus musculus
tagaggtctactgtactgtgtcccc

SEQ ID NO: 464060 - DNA, 25 bp, Mus musculus
tagaggtctagaggctgagtcaacc

SEQ ID NO: 464061 - DNA, 25 bp, Mus musculus
tagaggtgctacagctccaggcagt

SEQ ID NO: 464062 - DNA, 25 bp, Mus musculus
tagaggtggaccattctgaaccctt

SEQ ID NO: 464063 - DNA, 25 bp, Mus musculus
tagaggtggataaaggtacagtcct

SEQ ID NO: 464064 - DNA, 25 bp, Mus musculus
tagaggtggctctaatgtcctacgc

SEQ ID NO: 464065 - DNA, 25 bp, Mus musculus
tagaggttgactgtcttacccatgg

SEQ ID NO: 464066 - DNA, 25 bp, Mus musculus
tagagtaacctctcccttgggacct

SEQ ID NO: 464067 - DNA, 25 bp, Mus musculus
tagagtacattcgtgcgctgcagcg

SEQ ID NO: 464068 - DNA, 25 bp, Mus musculus
tagagtagctgttaccaatggcccg

SEQ ID NO: 464069 - DNA, 25 bp, Mus musculus
tagagtatgtgtcagagttcatgcc

SEQ ID NO: 464070 - DNA, 25 bp, Mus musculus
tagagtatttaagcccacctggtca

SEQ ID NO: 464071 - DNA, 25 bp, Mus musculus
tagagtcaagcttgctatggtcagc

SEQ ID NO: 464072 - DNA, 25 bp, Mus musculus
tagagtcaatctgtgggattctggc

SEQ ID NO: 464073 - DNA, 25 bp, Mus musculus
tagagtcagcccagcagaaaggcga

SEQ ID NO: 464074 - DNA, 25 bp, Mus musculus
tagagtcagcttcctccgatgagga

SEQ ID NO: 464075 - DNA, 25 bp, Mus musculus
tagagtcaggatgagaagttcaaga

SEQ ID NO: 464076 - DNA, 25 bp, Mus musculus
tagagtcaggcttcctgcccacact

SEQ ID NO: 464077 - DNA, 25 bp, Mus musculus
tagagtcatcacttctgccatgggt

SEQ ID NO: 464078 - DNA, 25 bp, Mus musculus
tagagtccaggaacatatactgggc

SEQ ID NO: 464079 - DNA, 25 bp, Mus musculus
tagagtccaggtacttggcccacac

SEQ ID NO: 464080 - DNA, 25 bp, Mus musculus
tagagtcctggccatatggtagatt

SEQ ID NO: 464081 - DNA, 25 bp, Mus musculus
tagagtccttaccatatcatagtta

SEQ ID NO: 464082 - DNA, 25 bp, Mus musculus
tagagtcggataccccattgtgaaa

SEQ ID NO: 464083 - DNA, 25 bp, Mus musculus
tagagtcggtcatgaacgtctccgg

SEQ ID NO: 464084 - DNA, 25 bp, Mus musculus
tagagtcggtggaatggctggcgct

SEQ ID NO: 464085 - DNA, 25 bp, Mus musculus
tagagtctgctcagcctattcatgg

SEQ ID NO: 464086 - DNA, 25 bp, Mus musculus
tagagtctgtctgtaataccagcat

SEQ ID NO: 464087 - DNA, 25 bp, Mus musculus
tagagtcttagtgaggtcccctgct

SEQ ID NO: 464088 - DNA, 25 bp, Mus musculus
tagagtgatctacacgtcctttgcc

SEQ ID NO: 464089 - DNA, 25 bp, Mus musculus
tagagtgatctcgaggcttgccgac

SEQ ID NO: 464090 - DNA, 25 bp, Mus musculus
tagagtgctacagatggaccgtggt

SEQ ID NO: 464091 - DNA, 25 bp, Mus musculus
tagagtggcggaacttaacccagac

SEQ ID NO: 464092 - DNA, 25 bp, Mus musculus
tagagtggtgctactgatagagtcc

SEQ ID NO: 464093 - DNA, 25 bp, Mus musculus
tagagtgtcccagaacgaagcaaaa

SEQ ID NO: 464094 - DNA, 25 bp, Mus musculus
tagagtgtgaacaagatgagcccca

SEQ ID NO: 464095 - DNA, 25 bp, Mus musculus
tagagttacacgtccacctggatgg

SEQ ID NO: 464096 - DNA, 25 bp, Mus musculus
tagagttacacttcgggctgcaaac

SEQ ID NO: 464097 - DNA, 25 bp, Mus musculus
tagagttaggatcctgctttccctg

SEQ ID NO: 464098 - DNA, 25 bp, Mus musculus
tagagttagtgggagatcccggcca

SEQ ID NO: 464099 - DNA, 25 bp, Mus musculus
tagagttatcatgataatggatacc

SEQ ID NO: 464100 - DNA, 25 bp, Mus musculus
tagagttcagcaccatcctcgaggg

SEQ ID NO: 464101 - DNA, 25 bp, Mus musculus
tagagttcagccacagttaagagcc

SEQ ID NO: 464102 - DNA, 25 bp, Mus musculus
tagagttcgagtccccactacaggg

SEQ ID NO: 464103 - DNA, 25 bp, Mus musculus
tagagtttatctgggtgagagcagc

SEQ ID NO: 464104 - DNA, 25 bp, Mus musculus
tagagtttgcctgccattcacaaaa

SEQ ID NO: 464105 - DNA, 25 bp, Mus musculus
tagataaacaaccagctccaaaggg

SEQ ID NO: 464106 - DNA, 25 bp, Mus musculus
tagataaataaatcacagccgcccc

SEQ ID NO: 464107 - DNA, 25 bp, Mus musculus
tagataaggagactaacaagactgt

SEQ ID NO: 464108 - DNA, 25 bp, Mus musculus
tagataatgctagcagccagctgcc

SEQ ID NO: 464109 - DNA, 25 bp, Mus musculus
tagatacactggagaggctgaaggc

SEQ ID NO: 464110 - DNA, 25 bp, Mus musculus
tagatactgtttccatccgcacaag

SEQ ID NO: 464111 - DNA, 25 bp, Mus musculus
tagatagagctagacgtgtggcctg

SEQ ID NO: 464112 - DNA, 25 bp, Mus musculus
tagatagatggagaagcctgagagt

SEQ ID NO: 464113 - DNA, 25 bp, Mus musculus
tagatagcctagactggcctctaag

SEQ ID NO: 464114 - DNA, 25 bp, Mus musculus
tagataggctacaaagtctttatga

SEQ ID NO: 464115 - DNA, 25 bp, Mus musculus
tagatatattccgaagaagcttgag

SEQ ID NO: 464116 - DNA, 25 bp, Mus musculus
tagatatctctaagtgaaatggtgc

SEQ ID NO: 464117 - DNA, 25 bp, Mus musculus
tagatatggctactcgtccagcagg

SEQ ID NO: 464118 - DNA, 25 bp, Mus musculus
tagatatggtgtgttggcaggtcct

SEQ ID NO: 464119 - DNA, 25 bp, Mus musculus
tagatatttcagacttatgggccct

SEQ ID NO: 464120 - DNA, 25 bp, Mus musculus
tagatcaacttccaggagctcagga

SEQ ID NO: 464121 - DNA, 25 bp, Mus musculus
tagatcaagaccaaccttcagaggg

SEQ ID NO: 464122 - DNA, 25 bp, Mus musculus
tagatcaagtgtagctgtgcaagca

SEQ ID NO: 464123 - DNA, 25 bp, Mus musculus
tagatcaatgatccagcgtgttggg

SEQ ID NO: 464124 - DNA, 25 bp, Mus musculus
tagatcacagctccgtgattggatg

SEQ ID NO: 464125 - DNA, 25 bp, Mus musculus
tagatcagaaacctacgttcttcca

SEQ ID NO: 464126 - DNA, 25 bp, Mus musculus
tagatcagcactctaccctggaagg

SEQ ID NO: 464127 - DNA, 25 bp, Mus musculus
tagatcagctcagggttccagtcag

SEQ ID NO: 464128 - DNA, 25 bp, Mus musculus
tagatcaggatgaaaagagccaggc

SEQ ID NO: 464129 - DNA, 25 bp, Mus musculus
tagatcaggcaaaagtttacagcca

SEQ ID NO: 464130 - DNA, 25 bp, Mus musculus
tagatcagtctgtggtactggcttc

SEQ ID NO: 464131 - DNA, 25 bp, Mus musculus
tagatcatacccacaaagagaagga

SEQ ID NO: 464132 - DNA, 25 bp, Mus musculus
tagatcatggcggtcagcagaagct

SEQ ID NO: 464133 - DNA, 25 bp, Mus musculus
tagatccaaatatggccctcagagg

SEQ ID NO: 464134 - DNA, 25 bp, Mus musculus
tagatccagtcagctggaaggaacg

SEQ ID NO: 464135 - DNA, 25 bp, Mus musculus
tagatcccaggattgggtgaagtag

SEQ ID NO: 464136 - DNA, 25 bp, Mus musculus
tagatccgtgcatcgtttctccctg

SEQ ID NO: 464137 - DNA, 25 bp, Mus musculus
tagatccgtgtaacctacaattgcc

SEQ ID NO: 464138 - DNA, 25 bp, Mus musculus
tagatcctaggagagtcggtgtgtc

SEQ ID NO: 464139 - DNA, 25 bp, Mus musculus
tagatcgagcccatagcatggacct

SEQ ID NO: 464140 - DNA, 25 bp, Mus musculus
tagatcgccacttgagaaagctgga

SEQ ID NO: 464141 - DNA, 25 bp, Mus musculus
tagatctaccttaagacttgagaac

SEQ ID NO: 464142 - DNA, 25 bp, Mus musculus
tagatctaggagacgctcagcgctg

SEQ ID NO: 464143 - DNA, 25 bp, Mus musculus
tagatctcccggagtcggaagcgcg

SEQ ID NO: 464144 - DNA, 25 bp, Mus musculus
tagatctgcttgtgcacctggtgca

SEQ ID NO: 464145 - DNA, 25 bp, Mus musculus
tagatcttgctgtatgtcccaggct

SEQ ID NO: 464146 - DNA, 25 bp, Mus musculus
tagatcttgtctccgtggcagcagc

SEQ ID NO: 464147 - DNA, 25 bp, Mus musculus
tagatctttagatccggagctcact

SEQ ID NO: 464148 - DNA, 25 bp, Mus musculus
tagatctttgtcaccttttagaggg

SEQ ID NO: 464149 - DNA, 25 bp, Mus musculus
tagatgaaagagaacaccaccgatt

SEQ ID NO: 464150 - DNA, 25 bp, Mus musculus
tagatgaagaaagcccggagtcgtc

SEQ ID NO: 464151 - DNA, 25 bp, Mus musculus
tagatgaatccaataacatcggccc

SEQ ID NO: 464152 - DNA, 25 bp, Mus musculus
tagatgacaccccactcaaactcag

SEQ ID NO: 464153 - DNA, 25 bp, Mus musculus
tagatgaccaagaagcacaggaagg

SEQ ID NO: 464154 - DNA, 25 bp, Mus musculus
tagatgaccgcgcagatgcactgca

SEQ ID NO: 464155 - DNA, 25 bp, Mus musculus
tagatgagccatatcctccaatagg

SEQ ID NO: 464156 - DNA, 25 bp, Mus musculus
tagatgagcccagagatcacacagg

SEQ ID NO: 464157 - DNA, 25 bp, Mus musculus
tagatgagcccatggaaagattctc

SEQ ID NO: 464158 - DNA, 25 bp, Mus musculus
tagatgagtgtgctcctagcccctg

SEQ ID NO: 464159 - DNA, 25 bp, Mus musculus
tagatgatgcgcatgcagcccaagt

SEQ ID NO: 464160 - DNA, 25 bp, Mus musculus
tagatgcagctgatgagaaattccg

SEQ ID NO: 464161 - DNA, 25 bp, Mus musculus
tagatgcagggaactcaacctagga

SEQ ID NO: 464162 - DNA, 25 bp, Mus musculus
tagatgccaatcactgccctggttc

SEQ ID NO: 464163 - DNA, 25 bp, Mus musculus
tagatgccatccagacggtgcaggc

SEQ ID NO: 464164 - DNA, 25 bp, Mus musculus
tagatgccgacgtcatcaacgcagg

SEQ ID NO: 464165 - DNA, 25 bp, Mus musculus
tagatgcctagatcatgaaaatgga

SEQ ID NO: 464166 - DNA, 25 bp, Mus musculus
tagatgcgactgacctttttgatcg

SEQ ID NO: 464167 - DNA, 25 bp, Mus musculus
tagatgcgccttccctggactgtcg

SEQ ID NO: 464168 - DNA, 25 bp, Mus musculus
tagatgctcaaatccctgggaatgt

SEQ ID NO: 464169 - DNA, 25 bp, Mus musculus
tagatgctcagaggtcgacagtgac

SEQ ID NO: 464170 - DNA, 25 bp, Mus musculus
tagatggaaacagagacattgagcc

SEQ ID NO: 464171 - DNA, 25 bp, Mus musculus
tagatggaaactaccccggaagctc

SEQ ID NO: 464172 - DNA, 25 bp, Mus musculus
tagatggaagacacccagttcaggg

SEQ ID NO: 464173 - DNA, 25 bp, Mus musculus
tagatggagcttccttgccacagag

SEQ ID NO: 464174 - DNA, 25 bp, Mus musculus
tagatggagttcatcgctgacatca

SEQ ID NO: 464175 - DNA, 25 bp, Mus musculus
tagatggatttttagagacctaccc

SEQ ID NO: 464176 - DNA, 25 bp, Mus musculus
tagatggcctctggtctccactgag

SEQ ID NO: 464177 - DNA, 25 bp, Mus musculus
tagatggccttgtaaccctcactcg

SEQ ID NO: 464178 - DNA, 25 bp, Mus musculus
tagatggcttccctcggactgtgag

SEQ ID NO: 464179 - DNA, 25 bp, Mus musculus
tagatgggcttgcacctcagtcgat

SEQ ID NO: 464180 - DNA, 25 bp, Mus musculus
tagatgtcagccaaaggtctgcggc

SEQ ID NO: 464181 - DNA, 25 bp, Mus musculus
tagatgtcctcgtcagctcaggaga

SEQ ID NO: 464182 - DNA, 25 bp, Mus musculus
tagatgtctgagtggccctaggctc

SEQ ID NO: 464183 - DNA, 25 bp, Mus musculus
tagatgtgactcaaaaggaggcctg

SEQ ID NO: 464184 - DNA, 25 bp, Mus musculus
tagatgttaagccaccatgcctgga

SEQ ID NO: 464185 - DNA, 25 bp, Mus musculus
tagatgttccatcaacagcacagga

SEQ ID NO: 464186 - DNA, 25 bp, Mus musculus
tagattaaacttcacctgtgcaagg

SEQ ID NO: 464187 - DNA, 25 bp, Mus musculus
tagattaaggctgggcacctcagag

SEQ ID NO: 464188 - DNA, 25 bp, Mus musculus
tagattacgccatggagaacagcac

SEQ ID NO: 464189 - DNA, 25 bp, Mus musculus
tagattacgtcctaggtaccaggca

SEQ ID NO: 464190 - DNA, 25 bp, Mus musculus
tagattagaaacgtcccacaagagt

SEQ ID NO: 464191 - DNA, 25 bp, Mus musculus
tagattagccaggaacaatgcccca

SEQ ID NO: 464192 - DNA, 25 bp, Mus musculus
tagattagctgatcccactggaatg

SEQ ID NO: 464193 - DNA, 25 bp, Mus musculus
tagattatgccgaagctctgctgag

SEQ ID NO: 464194 - DNA, 25 bp, Mus musculus
tagattcacggcagaagttcccatc

SEQ ID NO: 464195 - DNA, 25 bp, Mus musculus
tagattcatgagctgctttagaagc

SEQ ID NO: 464196 - DNA, 25 bp, Mus musculus
tagattccaagctagacacgaagcc

SEQ ID NO: 464197 - DNA, 25 bp, Mus musculus
tagattccaaggctatccccagctc

SEQ ID NO: 464198 - DNA, 25 bp, Mus musculus
tagattcgcagagtcgggaacacac

SEQ ID NO: 464199 - DNA, 25 bp, Mus musculus
tagattctgcggtcaacactgagcc

SEQ ID NO: 464200 - DNA, 25 bp, Mus musculus
tagattctgtatccctggacttggg

SEQ ID NO: 464201 - DNA, 25 bp, Mus musculus
tagattctttcatgaagcagcctgg

SEQ ID NO: 464202 - DNA, 25 bp, Mus musculus
tagattgactggtgagctcgacagc

SEQ ID NO: 464203 - DNA, 25 bp, Mus musculus
tagattgagatacaggaccccagga

SEQ ID NO: 464204 - DNA, 25 bp, Mus musculus
tagattgctgcgctctgcatccggg

SEQ ID NO: 464205 - DNA, 25 bp, Mus musculus
tagattggcagctacacaagacatg

SEQ ID NO: 464206 - DNA, 25 bp, Mus musculus
tagattgtaagctccaagtgggcac

SEQ ID NO: 464207 - DNA, 25 bp, Mus musculus
tagattgttgcctttcaccccggct

SEQ ID NO: 464208 - DNA, 25 bp, Mus musculus
tagatttactggacaaagggcagcc

SEQ ID NO: 464209 - DNA, 25 bp, Mus musculus
tagatttgagatgctcatcccctgc

SEQ ID NO: 464210 - DNA, 25 bp, Mus musculus
tagatttgaggtcttggtgcttcca

SEQ ID NO: 464211 - DNA, 25 bp, Mus musculus
tagatttgcctcgtttcccagacat

SEQ ID NO: 464212 - DNA, 25 bp, Mus musculus
tagattttaatacgcccatggtgac

SEQ ID NO: 464213 - DNA, 25 bp, Mus musculus
tagatttttctacctacctgaagga

SEQ ID NO: 464214 - DNA, 25 bp, Mus musculus
tagatttttgctacctctctgggcc

SEQ ID NO: 464215 - DNA, 25 bp, Mus musculus
tagcaaaatggattgccgacaggac

SEQ ID NO: 464216 - DNA, 25 bp, Mus musculus
tagcaaacagctgtggcgaggttcc

SEQ ID NO: 464217 - DNA, 25 bp, Mus musculus
tagcaaagcacgtcaccttggttcg

SEQ ID NO: 464218 - DNA, 25 bp, Mus musculus
tagcaaaggatgtgcttgccttctc

SEQ ID NO: 464219 - DNA, 25 bp, Mus musculus
tagcaaaggtaaaccctcctcatcc

SEQ ID NO: 464220 - DNA, 25 bp, Mus musculus
tagcaaatatttgttcaactgaaag

SEQ ID NO: 464221 - DNA, 25 bp, Mus musculus
tagcaaatctattcagaccatctgt

SEQ ID NO: 464222 - DNA, 25 bp, Mus musculus
tagcaacaagcctcaaagacagtgg

SEQ ID NO: 464223 - DNA, 25 bp, Mus musculus
tagcaacaccattgaggaaaacagg

SEQ ID NO: 464224 - DNA, 25 bp, Mus musculus
tagcaacagcacctagaggaatggc

SEQ ID NO: 464225 - DNA, 25 bp, Mus musculus
tagcaacagtgatagtgactcaggc

SEQ ID NO: 464226 - DNA, 25 bp, Mus musculus
tagcaacatcccatgctcagaagct

SEQ ID NO: 464227 - DNA, 25 bp, Mus musculus
tagcaaccctcagatggacaaacgg

SEQ ID NO: 464228 - DNA, 25 bp, Mus musculus
tagcaacctggtcagggtacgctct

SEQ ID NO: 464229 - DNA, 25 bp, Mus musculus
tagcaacgctgccttcatcttccgg

SEQ ID NO: 464230 - DNA, 25 bp, Mus musculus
tagcaacggcgtcatttccataggc

SEQ ID NO: 464231 - DNA, 25 bp, Mus musculus
tagcaacggctaaagggtcaagctc

SEQ ID NO: 464232 - DNA, 25 bp, Mus musculus
tagcaactacaagaacacacataag

SEQ ID NO: 464233 - DNA, 25 bp, Mus musculus
tagcaacttgctttcgtgaggcggg

SEQ ID NO: 464234 - DNA, 25 bp, Mus musculus
tagcaagaagcatactggtgatcat

SEQ ID NO: 464235 - DNA, 25 bp, Mus musculus
tagcaagaagcgcaaagtgtccctg

SEQ ID NO: 464236 - DNA, 25 bp, Mus musculus
tagcaagacagctgttgtagagcag

SEQ ID NO: 464237 - DNA, 25 bp, Mus musculus
tagcaagagcacaggactatgacag

SEQ ID NO: 464238 - DNA, 25 bp, Mus musculus
tagcaagatctcagtagtgaggccg

SEQ ID NO: 464239 - DNA, 25 bp, Mus musculus
tagcaagccgattaaagtcaccctg

SEQ ID NO: 464240 - DNA, 25 bp, Mus musculus
tagcaagctctatgtactccagtgg

SEQ ID NO: 464241 - DNA, 25 bp, Mus musculus
tagcaaggatcagtattcacagtgt

SEQ ID NO: 464242 - DNA, 25 bp, Mus musculus
tagcaagtacagaggcacaagccag

SEQ ID NO: 464243 - DNA, 25 bp, Mus musculus
tagcaagtcactcggctgaaagagc

SEQ ID NO: 464244 - DNA, 25 bp, Mus musculus
tagcaagtctatgtgcgtgtccaca

SEQ ID NO: 464245 - DNA, 25 bp, Mus musculus
tagcaagtgcatgatacagtctggt

SEQ ID NO: 464246 - DNA, 25 bp, Mus musculus
tagcaagtgtgattgactcatccag

SEQ ID NO: 464247 - DNA, 25 bp, Mus musculus
tagcaagttgagtcagagtgatccc

SEQ ID NO: 464248 - DNA, 25 bp, Mus musculus
tagcaagttttaagtgccacgggtt

SEQ ID NO: 464249 - DNA, 25 bp, Mus musculus
tagcaatatccgcaccgtggctgga

SEQ ID NO: 464250 - DNA, 25 bp, Mus musculus
tagcaatctgaatgagctgcgcctg

SEQ ID NO: 464251 - DNA, 25 bp, Mus musculus
tagcaatgaaagcatgcgagcccga

SEQ ID NO: 464252 - DNA, 25 bp, Mus musculus
tagcaatgccaatatctttcgaagg

SEQ ID NO: 464253 - DNA, 25 bp, Mus musculus
tagcaatggtaagggagtaacaaga

SEQ ID NO: 464254 - DNA, 25 bp, Mus musculus
tagcacaagatagacccttcaaatc

SEQ ID NO: 464255 - DNA, 25 bp, Mus musculus
tagcacaatctagtacaggcccgac

SEQ ID NO: 464256 - DNA, 25 bp, Mus musculus
tagcacagacctcattgacagactg

SEQ ID NO: 464257 - DNA, 25 bp, Mus musculus
tagcacagggaatggagccatcaag

SEQ ID NO: 464258 - DNA, 25 bp, Mus musculus
tagcacaggtgcaaatccatcagag

SEQ ID NO: 464259 - DNA, 25 bp, Mus musculus
tagcacatctctcctctctttgctt

SEQ ID NO: 464260 - DNA, 25 bp, Mus musculus
tagcacattatgtcaggtccatgac

SEQ ID NO: 464261 - DNA, 25 bp, Mus musculus
tagcaccagtttcagtggcggagcc

SEQ ID NO: 464262 - DNA, 25 bp, Mus musculus
tagcaccatgctgggcgtgttccgg

SEQ ID NO: 464263 - DNA, 25 bp, Mus musculus
tagcaccgatggatgttcacaatga

SEQ ID NO: 464264 - DNA, 25 bp, Mus musculus
tagcaccgcggcatcagctacgttc

SEQ ID NO: 464265 - DNA, 25 bp, Mus musculus
tagcaccggcgggttaagcatctcg

SEQ ID NO: 464266 - DNA, 25 bp, Mus musculus
tagcacctcctcatttatcattgag

SEQ ID NO: 464267 - DNA, 25 bp, Mus musculus
tagcacctgtgctttgcaacgtaca

SEQ ID NO: 464268 - DNA, 25 bp, Mus musculus
tagcacgctagaaggacagattccc

SEQ ID NO: 464269 - DNA, 25 bp, Mus musculus
tagcactcaaacgagacctcatggg

SEQ ID NO: 464270 - DNA, 25 bp, Mus musculus
tagcactcacgggaggagcgcttta

SEQ ID NO: 464271 - DNA, 25 bp, Mus musculus
tagcacttaacaaggatggaactcc

SEQ ID NO: 464272 - DNA, 25 bp, Mus musculus
tagcacttagaagcccagagcacct

SEQ ID NO: 464273 - DNA, 25 bp, Mus musculus
tagcacttcaaaacaggacatcccg

SEQ ID NO: 464274 - DNA, 25 bp, Mus musculus
tagcacttgcactcagagcgcactg

SEQ ID NO: 464275 - DNA, 25 bp, Mus musculus
tagcactttgaaccgggcgttgagc

SEQ ID NO: 464276 - DNA, 25 bp, Mus musculus
tagcagacacttgaagacagtgccc

SEQ ID NO: 464277 - DNA, 25 bp, Mus musculus
tagcagacaggcttgacccggttga

SEQ ID NO: 464278 - DNA, 25 bp, Mus musculus
tagcagacgctttgtagccgcagcc

SEQ ID NO: 464279 - DNA, 25 bp, Mus musculus
tagcagacggtaatctagaactcct

SEQ ID NO: 464280 - DNA, 25 bp, Mus musculus
tagcagactgcctcagaagggccaa

SEQ ID NO: 464281 - DNA, 25 bp, Mus musculus
tagcagactgtaggaagtgccgctg

SEQ ID NO: 464282 - DNA, 25 bp, Mus musculus
tagcagagagcattgccagcatggc

SEQ ID NO: 464283 - DNA, 25 bp, Mus musculus
tagcagagatagacctttcccaggg

SEQ ID NO: 464284 - DNA, 25 bp, Mus musculus
tagcagagcccagagagactggcaa

SEQ ID NO: 464285 - DNA, 25 bp, Mus musculus
tagcagagcttctggcctagggctg

SEQ ID NO: 464286 - DNA, 25 bp, Mus musculus
tagcagagctttggcaccccaagat

SEQ ID NO: 464287 - DNA, 25 bp, Mus musculus
tagcagaggcctctcaaccatctgg

SEQ ID NO: 464288 - DNA, 25 bp, Mus musculus
tagcagataccatcacacttggagg

SEQ ID NO: 464289 - DNA, 25 bp, Mus musculus
tagcagatacgtgtccccgaagaag

SEQ ID NO: 464290 - DNA, 25 bp, Mus musculus
tagcagatgctacccacattctggt

SEQ ID NO: 464291 - DNA, 25 bp, Mus musculus
tagcagatgctcgaagggacctgaa

SEQ ID NO: 464292 - DNA, 25 bp, Mus musculus
tagcagatggcagtctcaggagctg

SEQ ID NO: 464293 - DNA, 25 bp, Mus musculus
tagcagattatctgaaaagccatgc

SEQ ID NO: 464294 - DNA, 25 bp, Mus musculus
tagcagcaacctgggacgcatcttt

SEQ ID NO: 464295 - DNA, 25 bp, Mus musculus
tagcagcaaggatatgatactacac

SEQ ID NO: 464296 - DNA, 25 bp, Mus musculus
tagcagcaggactcgttgatgaccc

SEQ ID NO: 464297 - DNA, 25 bp, Mus musculus
tagcagcaggcaatcactcgtgagc

SEQ ID NO: 464298 - DNA, 25 bp, Mus musculus
tagcagcagtgttctgggcagctca

SEQ ID NO: 464299 - DNA, 25 bp, Mus musculus
tagcagcatcggctcccttaaaggg

SEQ ID NO: 464300 - DNA, 25 bp, Mus musculus
tagcagcccgctgccatgtggattt

SEQ ID NO: 464301 - DNA, 25 bp, Mus musculus
tagcagccgcaactggacggaagac

SEQ ID NO: 464302 - DNA, 25 bp, Mus musculus
tagcagccgctgagcacactaagtt

SEQ ID NO: 464303 - DNA, 25 bp, Mus musculus
tagcagcctgctctgaccaaatgga

SEQ ID NO: 464304 - DNA, 25 bp, Mus musculus
tagcagccttgatgcagaaagaccg

SEQ ID NO: 464305 - DNA, 25 bp, Mus musculus
tagcagctagactggtgtgacaacc

SEQ ID NO: 464306 - DNA, 25 bp, Mus musculus
tagcagctcgttctctacggcacgc

SEQ ID NO: 464307 - DNA, 25 bp, Mus musculus
tagcagctgaagtaccctcttctgg

SEQ ID NO: 464308 - DNA, 25 bp, Mus musculus
tagcagctgaattgttagaacactg

SEQ ID NO: 464309 - DNA, 25 bp, Mus musculus
tagcagctgcctcttggttctccgg

SEQ ID NO: 464310 - DNA, 25 bp, Mus musculus
tagcagctgtctagagcagtaggca

SEQ ID NO: 464311 - DNA, 25 bp, Mus musculus
tagcagcttcataggtaagagggaa

SEQ ID NO: 464312 - DNA, 25 bp, Mus musculus
tagcaggagagtatgatcacaggac

SEQ ID NO: 464313 - DNA, 25 bp, Mus musculus
tagcaggagataccacaggagaagc

SEQ ID NO: 464314 - DNA, 25 bp, Mus musculus
tagcaggatgccatgacaatcagga

SEQ ID NO: 464315 - DNA, 25 bp, Mus musculus
tagcaggatgcttcatcttccgggc

SEQ ID NO: 464316 - DNA, 25 bp, Mus musculus
tagcaggcactgtgacgagctgaaa

SEQ ID NO: 464317 - DNA, 25 bp, Mus musculus
tagcaggcgtagagtattcattacg

SEQ ID NO: 464318 - DNA, 25 bp, Mus musculus
tagcaggctaggacaccagtggtgc

SEQ ID NO: 464319 - DNA, 25 bp, Mus musculus
tagcaggctcacgtgcacagtgtgg

SEQ ID NO: 464320 - DNA, 25 bp, Mus musculus
tagcaggctcagacgcaaaagtcgg

SEQ ID NO: 464321 - DNA, 25 bp, Mus musculus
tagcagggaaggacatgactccagt

SEQ ID NO: 464322 - DNA, 25 bp, Mus musculus
tagcagggcagtccgattcagcatc

SEQ ID NO: 464323 - DNA, 25 bp, Mus musculus
tagcagggcatttctggcatcgcct

SEQ ID NO: 464324 - DNA, 25 bp, Mus musculus
tagcagggtagcaagatgtagcaca

SEQ ID NO: 464325 - DNA, 25 bp, Mus musculus
tagcagggttcattatacaatttcc

SEQ ID NO: 464326 - DNA, 25 bp, Mus musculus
tagcaggtaatcagggaaaggagcc

SEQ ID NO: 464327 - DNA, 25 bp, Mus musculus
tagcaggtacaccttctgagaagaa

SEQ ID NO: 464328 - DNA, 25 bp, Mus musculus
tagcaggtccagagagtgagcaccc

SEQ ID NO: 464329 - DNA, 25 bp, Mus musculus
tagcagtaagaccaagccagtggcc

SEQ ID NO: 464330 - DNA, 25 bp, Mus musculus
tagcagtaccccattgcacctaatg

SEQ ID NO: 464331 - DNA, 25 bp, Mus musculus
tagcagtactgagtcggcagaagcc

SEQ ID NO: 464332 - DNA, 25 bp, Mus musculus
tagcagtcaaatgtacttgttactc

SEQ ID NO: 464333 - DNA, 25 bp, Mus musculus
tagcagtcagattgaggaggcccgt

SEQ ID NO: 464334 - DNA, 25 bp, Mus musculus
tagcagtctgagtcccatggtaaca

SEQ ID NO: 464335 - DNA, 25 bp, Mus musculus
tagcagtgtaacctcagtggagtgc

SEQ ID NO: 464336 - DNA, 25 bp, Mus musculus
tagcagttacctttcttgtcacttg

SEQ ID NO: 464337 - DNA, 25 bp, Mus musculus
tagcagttgtacaaggagccaggcc

SEQ ID NO: 464338 - DNA, 25 bp, Mus musculus
tagcataaacataaggaggcagtcc

SEQ ID NO: 464339 - DNA, 25 bp, Mus musculus
tagcataactatcctctgagagcca

SEQ ID NO: 464340 - DNA, 25 bp, Mus musculus
tagcataactccctttgcagtcggg

SEQ ID NO: 464341 - DNA, 25 bp, Mus musculus
tagcatacaaaacatagcctggacc

SEQ ID NO: 464342 - DNA, 25 bp, Mus musculus
tagcataggactgcctggtatggcc

SEQ ID NO: 464343 - DNA, 25 bp, Mus musculus
tagcataggctgtggcattgtgcag

SEQ ID NO: 464344 - DNA, 25 bp, Mus musculus
tagcatcacagggttcctgtcgtcc

SEQ ID NO: 464345 - DNA, 25 bp, Mus musculus
tagcatcactgtggagcatgccctg

SEQ ID NO: 464346 - DNA, 25 bp, Mus musculus
tagcatccactgtgtttcccagctt

SEQ ID NO: 464347 - DNA, 25 bp, Mus musculus
tagcatccgcctgtgagaaaacgca

SEQ ID NO: 464348 - DNA, 25 bp, Mus musculus
tagcatccggcctggaaagaatgcc

SEQ ID NO: 464349 - DNA, 25 bp, Mus musculus
tagcatcctaggtggtcaagcatcc

SEQ ID NO: 464350 - DNA, 25 bp, Mus musculus
tagcatctctaacaggatccaggga

SEQ ID NO: 464351 - DNA, 25 bp, Mus musculus
tagcatgaagggagacagcggttcc

SEQ ID NO: 464352 - DNA, 25 bp, Mus musculus
tagcatgcgccatgagatcgagggc

SEQ ID NO: 464353 - DNA, 25 bp, Mus musculus
tagcatggattctgtgggcaccttc

SEQ ID NO: 464354 - DNA, 25 bp, Mus musculus
tagcatgggtgactctctgattcca

SEQ ID NO: 464355 - DNA, 25 bp, Mus musculus
tagcatgggtggctctctgagtccc

SEQ ID NO: 464356 - DNA, 25 bp, Mus musculus
tagcatgggtttctcttcatcggaa

SEQ ID NO: 464357 - DNA, 25 bp, Mus musculus
tagcatgtgacgtaccaagtggagc

SEQ ID NO: 464358 - DNA, 25 bp, Mus musculus
tagcatgtgagtatccctggtctgg

SEQ ID NO: 464359 - DNA, 25 bp, Mus musculus
tagcattagaccagagtgacccaga

SEQ ID NO: 464360 - DNA, 25 bp, Mus musculus
tagcattagggtggctagatcccgg

SEQ ID NO: 464361 - DNA, 25 bp, Mus musculus
tagcattataggagacccttccgga

SEQ ID NO: 464362 - DNA, 25 bp, Mus musculus
tagcattcaagtcaggaggctcata

SEQ ID NO: 464363 - DNA, 25 bp, Mus musculus
tagcattcccttggacaggaccttg

SEQ ID NO: 464364 - DNA, 25 bp, Mus musculus
tagcattcgctacaaactcaagggc

SEQ ID NO: 464365 - DNA, 25 bp, Mus musculus
tagcattgtggaagccaatgtcccc

SEQ ID NO: 464366 - DNA, 25 bp, Mus musculus
tagcatttcaaccaaatgcagcatg

SEQ ID NO: 464367 - DNA, 25 bp, Mus musculus
tagcatttcactaggtgcgcccaca

SEQ ID NO: 464368 - DNA, 25 bp, Mus musculus
tagcatttcttcagcgaccaagtca

SEQ ID NO: 464369 - DNA, 25 bp, Mus musculus
tagccaaaaaggagacgagcagtct

SEQ ID NO: 464370 - DNA, 25 bp, Mus musculus
tagccaaacccatgctagacccggg

SEQ ID NO: 464371 - DNA, 25 bp, Mus musculus
tagccaaagcctagccaaagttgct

SEQ ID NO: 464372 - DNA, 25 bp, Mus musculus
tagccaaagttgctgccgactgcgg

SEQ ID NO: 464373 - DNA, 25 bp, Mus musculus
tagccaacttctgccagggcacgtg

SEQ ID NO: 464374 - DNA, 25 bp, Mus musculus
tagccaagagagacagaggacactg

SEQ ID NO: 464375 - DNA, 25 bp, Mus musculus
tagccaagccagagctgaaggatcc

SEQ ID NO: 464376 - DNA, 25 bp, Mus musculus
tagccaaggcctgcaaagtgctgag

SEQ ID NO: 464377 - DNA, 25 bp, Mus musculus
tagccaatagttccccagggtcctg

SEQ ID NO: 464378 - DNA, 25 bp, Mus musculus
tagccaatgaaatgaatgacctcag

SEQ ID NO: 464379 - DNA, 25 bp, Mus musculus
tagccacaaagaaactggctggatg

SEQ ID NO: 464380 - DNA, 25 bp, Mus musculus
tagccacaatactgtggctcctctc

SEQ ID NO: 464381 - DNA, 25 bp, Mus musculus
tagccacacagatccaacaagaggt

SEQ ID NO: 464382 - DNA, 25 bp, Mus musculus
tagccaccacactgaggaatagaat

SEQ ID NO: 464383 - DNA, 25 bp, Mus musculus
tagccaccagcggaagatgaatcag

SEQ ID NO: 464384 - DNA, 25 bp, Mus musculus
tagccaccataagtgcaggcgatcg

SEQ ID NO: 464385 - DNA, 25 bp, Mus musculus
tagccacccctgtgttcatgcctgt

SEQ ID NO: 464386 - DNA, 25 bp, Mus musculus
tagccaccttgagtgacaggcggag

SEQ ID NO: 464387 - DNA, 25 bp, Mus musculus
tagccacgtaagaaaatgcctgtgc

SEQ ID NO: 464388 - DNA, 25 bp, Mus musculus
tagccactgggaagagttgacttca

SEQ ID NO: 464389 - DNA, 25 bp, Mus musculus
tagccacttctatccaggtcctgaa

SEQ ID NO: 464390 - DNA, 25 bp, Mus musculus
tagccagaacattcatcagtgtgtc

SEQ ID NO: 464391 - DNA, 25 bp, Mus musculus
tagccagagagctcacgttaggaac

SEQ ID NO: 464392 - DNA, 25 bp, Mus musculus
tagccagagggctcgatctgtaccc

SEQ ID NO: 464393 - DNA, 25 bp, Mus musculus
tagccagcatgacgtacccgtggtt

SEQ ID NO: 464394 - DNA, 25 bp, Mus musculus
tagccagccccagtagggtgttgcc

SEQ ID NO: 464395 - DNA, 25 bp, Mus musculus
tagccagccgttgttagcacttcat

SEQ ID NO: 464396 - DNA, 25 bp, Mus musculus
tagccagctactgaggtctgacaga

SEQ ID NO: 464397 - DNA, 25 bp, Mus musculus
tagccagctagcacaagcacgatgg

SEQ ID NO: 464398 - DNA, 25 bp, Mus musculus
tagccagctggagagtccaaatggc

SEQ ID NO: 464399 - DNA, 25 bp, Mus musculus
tagccagcttgtttcgcggtcagtg

SEQ ID NO: 464400 - DNA, 25 bp, Mus musculus
tagccaggagcatccactgaagagg

SEQ ID NO: 464401 - DNA, 25 bp, Mus musculus
tagccaggagggagaacagaaactc

SEQ ID NO: 464402 - DNA, 25 bp, Mus musculus
tagccaggagttcacatctcgggtc

SEQ ID NO: 464403 - DNA, 25 bp, Mus musculus
tagccaggtcaaggtgtcgatgcag

SEQ ID NO: 464404 - DNA, 25 bp, Mus musculus
tagccaggtcgcagatattgtccag

SEQ ID NO: 464405 - DNA, 25 bp, Mus musculus
tagccagtccacaagtgtagcctag

SEQ ID NO: 464406 - DNA, 25 bp, Mus musculus
tagccataaaaccttggaggccggt

SEQ ID NO: 464407 - DNA, 25 bp, Mus musculus
tagccatccggtggcgcaggtgtct

SEQ ID NO: 464408 - DNA, 25 bp, Mus musculus
tagccatccgtcatcaaaggcaggg

SEQ ID NO: 464409 - DNA, 25 bp, Mus musculus
tagccatcctaatgtcccatgccaa

SEQ ID NO: 464410 - DNA, 25 bp, Mus musculus
tagccatctaaggtgaagccccgaa

SEQ ID NO: 464411 - DNA, 25 bp, Mus musculus
tagccatctggtactggtgtgccga

SEQ ID NO: 464412 - DNA, 25 bp, Mus musculus
tagccatgactatcatggaggacag

SEQ ID NO: 464413 - DNA, 25 bp, Mus musculus
tagccatggactcactagactgctg

SEQ ID NO: 464414 - DNA, 25 bp, Mus musculus
tagccatggagagctaaaacttagg

SEQ ID NO: 464415 - DNA, 25 bp, Mus musculus
tagccatggctacttctgacgtgaa

SEQ ID NO: 464416 - DNA, 25 bp, Mus musculus
tagccatggcttcggtcctagctcc

SEQ ID NO: 464417 - DNA, 25 bp, Mus musculus
tagccattgggcgatacagcgtgac

SEQ ID NO: 464418 - DNA, 25 bp, Mus musculus
tagcccaagtagatggagcagccat

SEQ ID NO: 464419 - DNA, 25 bp, Mus musculus
tagcccacatcctatacaggtttga

SEQ ID NO: 464420 - DNA, 25 bp, Mus musculus
tagcccaggacaagtatgtggccga

SEQ ID NO: 464421 - DNA, 25 bp, Mus musculus
tagcccaggctaactggtctcgtct

SEQ ID NO: 464422 - DNA, 25 bp, Mus musculus
tagcccaggctagtccctaacttgg

SEQ ID NO: 464423 - DNA, 25 bp, Mus musculus
tagcccaggctctggttcccagaaa

SEQ ID NO: 464424 - DNA, 25 bp, Mus musculus
tagcccagtctcagtgggtgtggaa

SEQ ID NO: 464425 - DNA, 25 bp, Mus musculus
tagcccagtgatcagtcatggcatg

SEQ ID NO: 464426 - DNA, 25 bp, Mus musculus
tagcccatggccacgcatagtagag

SEQ ID NO: 464427 - DNA, 25 bp, Mus musculus
tagccccaaggctattagaaataca

SEQ ID NO: 464428 - DNA, 25 bp, Mus musculus
tagccccagttactaagaggcagag

SEQ ID NO: 464429 - DNA, 25 bp, Mus musculus
tagccccatgggtcctgtgttcctg

SEQ ID NO: 464430 - DNA, 25 bp, Mus musculus
tagcccctaaagctgcccatactgt

SEQ ID NO: 464431 - DNA, 25 bp, Mus musculus
tagcccctctgtacacgggctttgt

SEQ ID NO: 464432 - DNA, 25 bp, Mus musculus
tagcccctgaggtggaaaagctgct

SEQ ID NO: 464433 - DNA, 25 bp, Mus musculus
tagcccgtctgtagtccagggaaaa

SEQ ID NO: 464434 - DNA, 25 bp, Mus musculus
tagcccgtggactttgaccgataca

SEQ ID NO: 464435 - DNA, 25 bp, Mus musculus
tagccctccataaagaaggataggt

SEQ ID NO: 464436 - DNA, 25 bp, Mus musculus
tagccctcccatggggttgctgcag

SEQ ID NO: 464437 - DNA, 25 bp, Mus musculus
tagccctcgcctggacctttgaaaa

SEQ ID NO: 464438 - DNA, 25 bp, Mus musculus
tagccctcttaggtgggagaaagga

SEQ ID NO: 464439 - DNA, 25 bp, Mus musculus
tagccctcttgtgtaggcacaggaa

SEQ ID NO: 464440 - DNA, 25 bp, Mus musculus
tagcccttcatcaggaatttcatgg

SEQ ID NO: 464441 - DNA, 25 bp, Mus musculus
tagccgaaagtgagggtcgcacgct

SEQ ID NO: 464442 - DNA, 25 bp, Mus musculus
tagccgaaccgtgtcccattgagaa

SEQ ID NO: 464443 - DNA, 25 bp, Mus musculus
tagccgaatcatccagacatcacag

SEQ ID NO: 464444 - DNA, 25 bp, Mus musculus
tagccgaccagtgaccagagcattt

SEQ ID NO: 464445 - DNA, 25 bp, Mus musculus
tagccgacgtaagcttggacccgaa

SEQ ID NO: 464446 - DNA, 25 bp, Mus musculus
tagccgagaccaacacctggaatga

SEQ ID NO: 464447 - DNA, 25 bp, Mus musculus
tagccgcactgcagcacgagatgcg

SEQ ID NO: 464448 - DNA, 25 bp, Mus musculus
tagccgccagccaccttgagtgata

SEQ ID NO: 464449 - DNA, 25 bp, Mus musculus
tagccgcccgaaggttgctctgaga

SEQ ID NO: 464450 - DNA, 25 bp, Mus musculus
tagccgcgatggtgtcctcaaagtc

SEQ ID NO: 464451 - DNA, 25 bp, Mus musculus
tagccggacggctctgaatgcttca

SEQ ID NO: 464452 - DNA, 25 bp, Mus musculus
tagccggcaggaaagcagactcaat

SEQ ID NO: 464453 - DNA, 25 bp, Mus musculus
tagccggcctggaaaggtttgttct

SEQ ID NO: 464454 - DNA, 25 bp, Mus musculus
tagccgggacaagagcaatgtgttc

SEQ ID NO: 464455 - DNA, 25 bp, Mus musculus
tagccggtgctgtcctttggcagga

SEQ ID NO: 464456 - DNA, 25 bp, Mus musculus
tagccggtgttcagtcctcggaatg

SEQ ID NO: 464457 - DNA, 25 bp, Mus musculus
tagccgtcagtcaagcagaagaagg

SEQ ID NO: 464458 - DNA, 25 bp, Mus musculus
tagccgttcctgagggcttcaggct

SEQ ID NO: 464459 - DNA, 25 bp, Mus musculus
tagcctaaagagcaaatactccccg

SEQ ID NO: 464460 - DNA, 25 bp, Mus musculus
tagcctacattctgggcctgacagg

SEQ ID NO: 464461 - DNA, 25 bp, Mus musculus
tagcctaccaccatagggtgctagc

SEQ ID NO: 464462 - DNA, 25 bp, Mus musculus
tagcctacgacctgtgtgcaaagaa

SEQ ID NO: 464463 - DNA, 25 bp, Mus musculus
tagcctactgactgagaaactcttg

SEQ ID NO: 464464 - DNA, 25 bp, Mus musculus
tagcctagggcacataacaagtctc

SEQ ID NO: 464465 - DNA, 25 bp, Mus musculus
tagcctagttagcacaggacttgag

SEQ ID NO: 464466 - DNA, 25 bp, Mus musculus
tagcctatcagtatgggaaaaatgt

SEQ ID NO: 464467 - DNA, 25 bp, Mus musculus
tagcctatgagcaagtggccagggc

SEQ ID NO: 464468 - DNA, 25 bp, Mus musculus
tagcctcacccatttctctaatgga

SEQ ID NO: 464469 - DNA, 25 bp, Mus musculus
tagcctcagagcctactccaggagg

SEQ ID NO: 464470 - DNA, 25 bp, Mus musculus
tagcctcaggtccattccagcaaat

SEQ ID NO: 464471 - DNA, 25 bp, Mus musculus
tagcctccagttaaaggaaatcctg

SEQ ID NO: 464472 - DNA, 25 bp, Mus musculus
tagcctccttgtagttcatcccggt

SEQ ID NO: 464473 - DNA, 25 bp, Mus musculus
tagcctccttttgcaatagtcatag

SEQ ID NO: 464474 - DNA, 25 bp, Mus musculus
tagcctcggtggacgagaggatttt

SEQ ID NO: 464475 - DNA, 25 bp, Mus musculus
tagcctctgcaggttagcacacttg

SEQ ID NO: 464476 - DNA, 25 bp, Mus musculus
tagcctctgcggaatggatcacaca

SEQ ID NO: 464477 - DNA, 25 bp, Mus musculus
tagcctcttgggttgcttgagaagg

SEQ ID NO: 464478 - DNA, 25 bp, Mus musculus
tagcctgacagtggctggctagcct

SEQ ID NO: 464479 - DNA, 25 bp, Mus musculus
tagcctgaggctgcactacgtgcat

SEQ ID NO: 464480 - DNA, 25 bp, Mus musculus
tagcctgaggtttagttaggcctct

SEQ ID NO: 464481 - DNA, 25 bp, Mus musculus
tagcctgcagcctgataccttgaag

SEQ ID NO: 464482 - DNA, 25 bp, Mus musculus
tagcctgcagctaggcatggcagtt

SEQ ID NO: 464483 - DNA, 25 bp, Mus musculus
tagcctgcgctgacatcacattcaa

SEQ ID NO: 464484 - DNA, 25 bp, Mus musculus
tagcctggaagatacaagagcctcc

SEQ ID NO: 464485 - DNA, 25 bp, Mus musculus
tagcctggacacactgttttgtcag

SEQ ID NO: 464486 - DNA, 25 bp, Mus musculus
tagcctggatgtggcatgtagtagc

SEQ ID NO: 464487 - DNA, 25 bp, Mus musculus
tagcctggatttgccactatgaccc

SEQ ID NO: 464488 - DNA, 25 bp, Mus musculus
tagcctgggaaccatgacttgaagc

SEQ ID NO: 464489 - DNA, 25 bp, Mus musculus
tagcctgggagtcattcccctgcgg

SEQ ID NO: 464490 - DNA, 25 bp, Mus musculus
tagcctgggcaaaggtcctacttga

SEQ ID NO: 464491 - DNA, 25 bp, Mus musculus
tagcctgggcttggctcagggtaca

SEQ ID NO: 464492 - DNA, 25 bp, Mus musculus
tagcctgggctttgagattatgtct

SEQ ID NO: 464493 - DNA, 25 bp, Mus musculus
tagcctggtagtgaagtactggcca

SEQ ID NO: 464494 - DNA, 25 bp, Mus musculus
tagcctggtccatgtaatcacggag

SEQ ID NO: 464495 - DNA, 25 bp, Mus musculus
tagcctgtcctgtgagctgtcgcca

SEQ ID NO: 464496 - DNA, 25 bp, Mus musculus
tagcctgtctctgtggttataacct

SEQ ID NO: 464497 - DNA, 25 bp, Mus musculus
tagccttaaggaagccaatgctgtg

SEQ ID NO: 464498 - DNA, 25 bp, Mus musculus
tagccttagggagagagctgaccca

SEQ ID NO: 464499 - DNA, 25 bp, Mus musculus
tagccttgccaggtgttgggcccaa

SEQ ID NO: 464500 - DNA, 25 bp, Mus musculus
tagccttgggaatgcagacagaaat

SEQ ID NO: 464501 - DNA, 25 bp, Mus musculus
tagccttgggctttctggaactaac

SEQ ID NO: 464502 - DNA, 25 bp, Mus musculus
tagccttggtctggaagccacatcc

SEQ ID NO: 464503 - DNA, 25 bp, Mus musculus
tagcctttagctattatgagaatgg

SEQ ID NO: 464504 - DNA, 25 bp, Mus musculus
tagcctttggagatgcgcaggcctt

SEQ ID NO: 464505 - DNA, 25 bp, Mus musculus
tagccttttggaaacacctggtgcc

SEQ ID NO: 464506 - DNA, 25 bp, Mus musculus
tagcgaaagagaaagccctggtatc

SEQ ID NO: 464507 - DNA, 25 bp, Mus musculus
tagcgaagatcgatgcaacctcagc

SEQ ID NO: 464508 - DNA, 25 bp, Mus musculus
tagcgaagatttagtagtggcccca

SEQ ID NO: 464509 - DNA, 25 bp, Mus musculus
tagcgaagttggtaatgcagcactc

SEQ ID NO: 464510 - DNA, 25 bp, Mus musculus
tagcgaccacatgcactgagttgag

SEQ ID NO: 464511 - DNA, 25 bp, Mus musculus
tagcgactgattctcagagcggccc

SEQ ID NO: 464512 - DNA, 25 bp, Mus musculus
tagcgactgctgttttgatacttgg

SEQ ID NO: 464513 - DNA, 25 bp, Mus musculus
tagcgagacgagagacggcggtgtc

SEQ ID NO: 464514 - DNA, 25 bp, Mus musculus
tagcgagcgataatctctgggagcc

SEQ ID NO: 464515 - DNA, 25 bp, Mus musculus
tagcgagcgcatcagagaggatcct

SEQ ID NO: 464516 - DNA, 25 bp, Mus musculus
tagcgatctcagtttgctctctgga

SEQ ID NO: 464517 - DNA, 25 bp, Mus musculus
tagcgatgactcttggcacccacat

SEQ ID NO: 464518 - DNA, 25 bp, Mus musculus
tagcgcagagtaagatgagcacccc

SEQ ID NO: 464519 - DNA, 25 bp, Mus musculus
tagcgcagcgggaaatgtcagttct

SEQ ID NO: 464520 - DNA, 25 bp, Mus musculus
tagcgcaggccacgtagctaatccg

SEQ ID NO: 464521 - DNA, 25 bp, Mus musculus
tagcgcaggtgagtgactctgtgaa

SEQ ID NO: 464522 - DNA, 25 bp, Mus musculus
tagcgcatccgcttgccgggaggaa

SEQ ID NO: 464523 - DNA, 25 bp, Mus musculus
tagcgcctgggctttcagaactgtg

SEQ ID NO: 464524 - DNA, 25 bp, Mus musculus
tagcgcgaatggcttccagctcaga

SEQ ID NO: 464525 - DNA, 25 bp, Mus musculus
tagcgcgtgctcgattggaaacaga

SEQ ID NO: 464526 - DNA, 25 bp, Mus musculus
tagcgcttggaagcctagaccagac

SEQ ID NO: 464527 - DNA, 25 bp, Mus musculus
tagcggccattggtgctttctcgtg

SEQ ID NO: 464528 - DNA, 25 bp, Mus musculus
tagcggcgctcaatggacagagact

SEQ ID NO: 464529 - DNA, 25 bp, Mus musculus
tagcggcttgctgtgagacaaaccc

SEQ ID NO: 464530 - DNA, 25 bp, Mus musculus
tagcgggaacgtgaacgctgctgcc

SEQ ID NO: 464531 - DNA, 25 bp, Mus musculus
tagcgggcattaacaacatggacgg

SEQ ID NO: 464532 - DNA, 25 bp, Mus musculus
tagcgggtgatctgaggctgctctc

SEQ ID NO: 464533 - DNA, 25 bp, Mus musculus
tagcgtagaacctctagactagaac

SEQ ID NO: 464534 - DNA, 25 bp, Mus musculus
tagcgtatcgttctgcaccagcgcc

SEQ ID NO: 464535 - DNA, 25 bp, Mus musculus
tagcgtcaggcagttacaaagtctg

SEQ ID NO: 464536 - DNA, 25 bp, Mus musculus
tagcgtcccgaagaaagatgactct

SEQ ID NO: 464537 - DNA, 25 bp, Mus musculus
tagcgtccttgtcctccggtaggca

SEQ ID NO: 464538 - DNA, 25 bp, Mus musculus
tagcgtgactctgaaagcaatggac

SEQ ID NO: 464539 - DNA, 25 bp, Mus musculus
tagcgtgccttgcagtagagtaccc

SEQ ID NO: 464540 - DNA, 25 bp, Mus musculus
tagcgttagaccataccaaagccgg

SEQ ID NO: 464541 - DNA, 25 bp, Mus musculus
tagcgttgtttgacagccaagcccc

SEQ ID NO: 464542 - DNA, 25 bp, Mus musculus
tagcgtttcttagggcgacatgaca

SEQ ID NO: 464543 - DNA, 25 bp, Mus musculus
tagctaaaggagatcgtgcaattca

SEQ ID NO: 464544 - DNA, 25 bp, Mus musculus
tagctaaagggcttgacctggctgg

SEQ ID NO: 464545 - DNA, 25 bp, Mus musculus
tagctaaatgcatagggtaccaccc

SEQ ID NO: 464546 - DNA, 25 bp, Mus musculus
tagctaacagttatggtggcaaggc

SEQ ID NO: 464547 - DNA, 25 bp, Mus musculus
tagctacacaccctcgagaggccat

SEQ ID NO: 464548 - DNA, 25 bp, Mus musculus
tagctacagtagaagcctcaccaac

SEQ ID NO: 464549 - DNA, 25 bp, Mus musculus
tagctacagtgcatcttccttggaa

SEQ ID NO: 464550 - DNA, 25 bp, Mus musculus
tagctaccaaagaccttggatggag

SEQ ID NO: 464551 - DNA, 25 bp, Mus musculus
tagctaccgaccctggtcacatgca

SEQ ID NO: 464552 - DNA, 25 bp, Mus musculus
tagctacctcgagggttaccgagcc

SEQ ID NO: 464553 - DNA, 25 bp, Mus musculus
tagctacggaaaggtggcgatcagc

SEQ ID NO: 464554 - DNA, 25 bp, Mus musculus
tagctactacagacagaaatgaggg

SEQ ID NO: 464555 - DNA, 25 bp, Mus musculus
tagctacttttaccaccgggagaca

SEQ ID NO: 464556 - DNA, 25 bp, Mus musculus
tagctagctccgaatcctaggtgat

SEQ ID NO: 464557 - DNA, 25 bp, Mus musculus
tagctagtgggatgcagaccgtcac

SEQ ID NO: 464558 - DNA, 25 bp, Mus musculus
tagctagttggctgtacaccttccc

SEQ ID NO: 464559 - DNA, 25 bp, Mus musculus
tagctataatacacacaaccccaat

SEQ ID NO: 464560 - DNA, 25 bp, Mus musculus
tagctatagtcctcctacaggtgcc

SEQ ID NO: 464561 - DNA, 25 bp, Mus musculus
tagctatcgtggatcagcgaccttc

SEQ ID NO: 464562 - DNA, 25 bp, Mus musculus
tagctatgcatctacagccccagag

SEQ ID NO: 464563 - DNA, 25 bp, Mus musculus
tagctatgcatgtggcctaccggag

SEQ ID NO: 464564 - DNA, 25 bp, Mus musculus
tagctatggactgactacaaggccc

SEQ ID NO: 464565 - DNA, 25 bp, Mus musculus
tagctatggttccaccgagacctga

SEQ ID NO: 464566 - DNA, 25 bp, Mus musculus
tagctcaaaggtctcgtcgtcctcg

SEQ ID NO: 464567 - DNA, 25 bp, Mus musculus
tagctcaagtccacgcagagaatgg

SEQ ID NO: 464568 - DNA, 25 bp, Mus musculus
tagctcacgaggagagaggttttca

SEQ ID NO: 464569 - DNA, 25 bp, Mus musculus
tagctcagctacttgggagatcccg

SEQ ID NO: 464570 - DNA, 25 bp, Mus musculus
tagctcaggctttattacaccacgc

SEQ ID NO: 464571 - DNA, 25 bp, Mus musculus
tagctcaggttgacttcaagctcag

SEQ ID NO: 464572 - DNA, 25 bp, Mus musculus
tagctcatgtcactgaaaggcagaa

SEQ ID NO: 464573 - DNA, 25 bp, Mus musculus
tagctcatgttttaacgctgcatcc

SEQ ID NO: 464574 - DNA, 25 bp, Mus musculus
tagctcattagcacccgagccagtg

SEQ ID NO: 464575 - DNA, 25 bp, Mus musculus
tagctccaatgctgttgaaactctg

SEQ ID NO: 464576 - DNA, 25 bp, Mus musculus
tagctcccaagtcatttaaagtgtg

SEQ ID NO: 464577 - DNA, 25 bp, Mus musculus
tagctccgcctgaagaactgtttgc

SEQ ID NO: 464578 - DNA, 25 bp, Mus musculus
tagctccgtcatcgctggcaaagag

SEQ ID NO: 464579 - DNA, 25 bp, Mus musculus
tagctcctcatgatatatcctccag

SEQ ID NO: 464580 - DNA, 25 bp, Mus musculus
tagctcctgctccagggaatccagc

SEQ ID NO: 464581 - DNA, 25 bp, Mus musculus
tagctccttggcagtgaacagcaca

SEQ ID NO: 464582 - DNA, 25 bp, Mus musculus
tagctccttgtcttatgccgggcaa

SEQ ID NO: 464583 - DNA, 25 bp, Mus musculus
tagctcgagactttcctttcttgac

SEQ ID NO: 464584 - DNA, 25 bp, Mus musculus
tagctcgcaatgtgacaccaggacg

SEQ ID NO: 464585 - DNA, 25 bp, Mus musculus
tagctcggaagaccctctatggacc

SEQ ID NO: 464586 - DNA, 25 bp, Mus musculus
tagctcgggagcctaagatttagca

SEQ ID NO: 464587 - DNA, 25 bp, Mus musculus
tagctctaggcaaccccacggagct

SEQ ID NO: 464588 - DNA, 25 bp, Mus musculus
tagctctcagacttcagcgctggca

SEQ ID NO: 464589 - DNA, 25 bp, Mus musculus
tagctctcagctaattctcagggtc

SEQ ID NO: 464590 - DNA, 25 bp, Mus musculus
tagctctgacggatgactctttgcc

SEQ ID NO: 464591 - DNA, 25 bp, Mus musculus
tagctctgagttgagcggaacctca

SEQ ID NO: 464592 - DNA, 25 bp, Mus musculus
tagctctggatctgatgagaccggc

SEQ ID NO: 464593 - DNA, 25 bp, Mus musculus
tagctctgggctaccatgtggtgca

SEQ ID NO: 464594 - DNA, 25 bp, Mus musculus
tagctctgtgggataatgaactgtt

SEQ ID NO: 464595 - DNA, 25 bp, Mus musculus
tagctcttgttctgccatctcgggc

SEQ ID NO: 464596 - DNA, 25 bp, Mus musculus
tagctgaagatcaggaatctttacc

SEQ ID NO: 464597 - DNA, 25 bp, Mus musculus
tagctgaaggagatacagaggcccc

SEQ ID NO: 464598 - DNA, 25 bp, Mus musculus
tagctgaccttcacctctgggaaga

SEQ ID NO: 464599 - DNA, 25 bp, Mus musculus
tagctgactcttagtgaccaagttg

SEQ ID NO: 464600 - DNA, 25 bp, Mus musculus
tagctgagattttccgggcttctgg

SEQ ID NO: 464601 - DNA, 25 bp, Mus musculus
tagctgagccgagacctttaatggc

SEQ ID NO: 464602 - DNA, 25 bp, Mus musculus
tagctgaggaaggagcaaaatgcct

SEQ ID NO: 464603 - DNA, 25 bp, Mus musculus
tagctgaggcctgggagagtccaaa

SEQ ID NO: 464604 - DNA, 25 bp, Mus musculus
tagctgaggctgacggaaggaccta

SEQ ID NO: 464605 - DNA, 25 bp, Mus musculus
tagctgagtgcatagccaagctgcc

SEQ ID NO: 464606 - DNA, 25 bp, Mus musculus
tagctgatgctgctaccgaataggt

SEQ ID NO: 464607 - DNA, 25 bp, Mus musculus
tagctgattccaaatctaaacggag

SEQ ID NO: 464608 - DNA, 25 bp, Mus musculus
tagctgcacatcaaagctggcttgt

SEQ ID NO: 464609 - DNA, 25 bp, Mus musculus
tagctgcagactaaccactgaggac

SEQ ID NO: 464610 - DNA, 25 bp, Mus musculus
tagctgcagagctggatcctcagga

SEQ ID NO: 464611 - DNA, 25 bp, Mus musculus
tagctgcagcccaacagaaagcagg

SEQ ID NO: 464612 - DNA, 25 bp, Mus musculus
tagctgcagcttatgtaactcggaa

SEQ ID NO: 464613 - DNA, 25 bp, Mus musculus
tagctgccaaggtgcatgaaatcac

SEQ ID NO: 464614 - DNA, 25 bp, Mus musculus
tagctgctaagaataaattttgccc

SEQ ID NO: 464615 - DNA, 25 bp, Mus musculus
tagctgctaggatgttcaacctgca

SEQ ID NO: 464616 - DNA, 25 bp, Mus musculus
tagctgctcaagtcagtgcgccagg

SEQ ID NO: 464617 - DNA, 25 bp, Mus musculus
tagctgctgaagttgcaaaaagtcc

SEQ ID NO: 464618 - DNA, 25 bp, Mus musculus
tagctgctgccctaagggagtgacg

SEQ ID NO: 464619 - DNA, 25 bp, Mus musculus
tagctgctgctatcagctggattga

SEQ ID NO: 464620 - DNA, 25 bp, Mus musculus
tagctggaaacagttctgtgtgaac

SEQ ID NO: 464621 - DNA, 25 bp, Mus musculus
tagctggactgtaccaaccattctg

SEQ ID NO: 464622 - DNA, 25 bp, Mus musculus
tagctggagcttcccaggacctttg

SEQ ID NO: 464623 - DNA, 25 bp, Mus musculus
tagctggaggctaagaacgctgcat

SEQ ID NO: 464624 - DNA, 25 bp, Mus musculus
tagctggcaggattaaggagcaccc

SEQ ID NO: 464625 - DNA, 25 bp, Mus musculus
tagctggcataaagatctagtgcgt

SEQ ID NO: 464626 - DNA, 25 bp, Mus musculus
tagctgggccactcattccttgaaa

SEQ ID NO: 464627 - DNA, 25 bp, Mus musculus
tagctgggtgagttttcccagattc

SEQ ID NO: 464628 - DNA, 25 bp, Mus musculus
tagctggttcgatgcccagacctga

SEQ ID NO: 464629 - DNA, 25 bp, Mus musculus
tagctgtaaacctgagccgggagcc

SEQ ID NO: 464630 - DNA, 25 bp, Mus musculus
tagctgtacatccaagcttgttgcc

SEQ ID NO: 464631 - DNA, 25 bp, Mus musculus
tagctgtaccacaactcgtgactgg

SEQ ID NO: 464632 - DNA, 25 bp, Mus musculus
tagctgtagccataaaatccgtgcc

SEQ ID NO: 464633 - DNA, 25 bp, Mus musculus
tagctgtagtaaaacacaactcgcg

SEQ ID NO: 464634 - DNA, 25 bp, Mus musculus
tagctgtagtactttgacccgaggg

SEQ ID NO: 464635 - DNA, 25 bp, Mus musculus
tagctgtccagtaacataatcggca

SEQ ID NO: 464636 - DNA, 25 bp, Mus musculus
tagctgtctcttttaaatgccgctg

SEQ ID NO: 464637 - DNA, 25 bp, Mus musculus
tagctgtggaccgactgtgtacgac

SEQ ID NO: 464638 - DNA, 25 bp, Mus musculus
tagctgtgtgactggaggatccgca

SEQ ID NO: 464639 - DNA, 25 bp, Mus musculus
tagctgttagcaatggaagtgcctg

SEQ ID NO: 464640 - DNA, 25 bp, Mus musculus
tagctgttctgatctgtacccaagg

SEQ ID NO: 464641 - DNA, 25 bp, Mus musculus
tagctgttggaactcgaatgccgcc

SEQ ID NO: 464642 - DNA, 25 bp, Mus musculus
tagctgttttccttgatcggagcca

SEQ ID NO: 464643 - DNA, 25 bp, Mus musculus
tagcttaatagggtgtcgcctggcc

SEQ ID NO: 464644 - DNA, 25 bp, Mus musculus
tagcttacagatacatcgcctacag

SEQ ID NO: 464645 - DNA, 25 bp, Mus musculus
tagcttacaggtacaggtgacccag

SEQ ID NO: 464646 - DNA, 25 bp, Mus musculus
tagcttatgaacttggagggtttgc

SEQ ID NO: 464647 - DNA, 25 bp, Mus musculus
tagcttatgcactcataaccgagga

SEQ ID NO: 464648 - DNA, 25 bp, Mus musculus
tagcttcaacagcagcagacgggtc

SEQ ID NO: 464649 - DNA, 25 bp, Mus musculus
tagcttcaacgtgcccatgcagctg

SEQ ID NO: 464650 - DNA, 25 bp, Mus musculus
tagcttcacggacttctccacgctg

SEQ ID NO: 464651 - DNA, 25 bp, Mus musculus
tagcttccctgatgtgtgacaccgg

SEQ ID NO: 464652 - DNA, 25 bp, Mus musculus
tagcttccgccatggacgtgtggga

SEQ ID NO: 464653 - DNA, 25 bp, Mus musculus
tagcttctaccgtgggactggcgag

SEQ ID NO: 464654 - DNA, 25 bp, Mus musculus
tagcttctatgacctgtgggcccag

SEQ ID NO: 464655 - DNA, 25 bp, Mus musculus
tagcttctggtcacttggtcactgg

SEQ ID NO: 464656 - DNA, 25 bp, Mus musculus
tagcttcttcagaggcgactactgc

SEQ ID NO: 464657 - DNA, 25 bp, Mus musculus
tagcttggatcaaaaggacctggtg

SEQ ID NO: 464658 - DNA, 25 bp, Mus musculus
tagcttggatgatagcactgcacac

SEQ ID NO: 464659 - DNA, 25 bp, Mus musculus
tagcttggtgaaaaagatgcccatc

SEQ ID NO: 464660 - DNA, 25 bp, Mus musculus
tagcttggtggtctcgtttttggcc

SEQ ID NO: 464661 - DNA, 25 bp, Mus musculus
tagcttggttgagtcagttatgaac

SEQ ID NO: 464662 - DNA, 25 bp, Mus musculus
tagcttgtacacctataagccccgg

SEQ ID NO: 464663 - DNA, 25 bp, Mus musculus
tagcttgtcacatgccagcgttgct

SEQ ID NO: 464664 - DNA, 25 bp, Mus musculus
tagcttgtgtggagatttggccttc

SEQ ID NO: 464665 - DNA, 25 bp, Mus musculus
tagctttaagccttgtagccttggg

SEQ ID NO: 464666 - DNA, 25 bp, Mus musculus
tagctttaccatggtgggcaagacc

SEQ ID NO: 464667 - DNA, 25 bp, Mus musculus
tagctttatcgcgtactgccagagc

SEQ ID NO: 464668 - DNA, 25 bp, Mus musculus
tagctttcagctagcgccatgcctt

SEQ ID NO: 464669 - DNA, 25 bp, Mus musculus
tagctttcctaccagatatcacaga

SEQ ID NO: 464670 - DNA, 25 bp, Mus musculus
tagctttctctcatggagcttgccc

SEQ ID NO: 464671 - DNA, 25 bp, Mus musculus
tagctttgaagtctagcactggctg

SEQ ID NO: 464672 - DNA, 25 bp, Mus musculus
tagctttgattgcagcctgagcctg

SEQ ID NO: 464673 - DNA, 25 bp, Mus musculus
tagctttgcaaggtggacactccac

SEQ ID NO: 464674 - DNA, 25 bp, Mus musculus
tagctttgggcgagtcactcccacc

SEQ ID NO: 464675 - DNA, 25 bp, Mus musculus
tagctttgtacccattagtgtgaac

SEQ ID NO: 464676 - DNA, 25 bp, Mus musculus
tagcttttattttcccctctcatct

SEQ ID NO: 464677 - DNA, 25 bp, Mus musculus
tagcttttgtccctaacactgaagg

SEQ ID NO: 464678 - DNA, 25 bp, Mus musculus
taggaaaagcccatcgtccaatctg

SEQ ID NO: 464679 - DNA, 25 bp, Mus musculus
taggaaaagtctacgccaccaagca

SEQ ID NO: 464680 - DNA, 25 bp, Mus musculus
taggaaacaacactgttgtcgtggt

SEQ ID NO: 464681 - DNA, 25 bp, Mus musculus
taggaaacagtgtcaccctctgtgg

SEQ ID NO: 464682 - DNA, 25 bp, Mus musculus
taggaaacattgaaactcaggcgtg

SEQ ID NO: 464683 - DNA, 25 bp, Mus musculus
taggaaagcgaaggatcccaaggcc

SEQ ID NO: 464684 - DNA, 25 bp, Mus musculus
taggaaataaaacaccccaggcagg

SEQ ID NO: 464685 - DNA, 25 bp, Mus musculus
taggaaatcctctgaactccggaat

SEQ ID NO: 464686 - DNA, 25 bp, Mus musculus
taggaaatctttctgcggcgcaaag

SEQ ID NO: 464687 - DNA, 25 bp, Mus musculus
taggaacaaccaaccacctttgatg

SEQ ID NO: 464688 - DNA, 25 bp, Mus musculus
taggaacaactaggttacaccagac

SEQ ID NO: 464689 - DNA, 25 bp, Mus musculus
taggaacatctgctttcaccatgct

SEQ ID NO: 464690 - DNA, 25 bp, Mus musculus
taggaaccatcagttgccagccaac

SEQ ID NO: 464691 - DNA, 25 bp, Mus musculus
taggaaccatgtcagccctgctcat

SEQ ID NO: 464692 - DNA, 25 bp, Mus musculus
taggaacccctgcttactatgacgg

SEQ ID NO: 464693 - DNA, 25 bp, Mus musculus
taggaaccggattgccataggacac

SEQ ID NO: 464694 - DNA, 25 bp, Mus musculus
taggaaccgtgtccttcgtccctga

SEQ ID NO: 464695 - DNA, 25 bp, Mus musculus
taggaacctgtctaacacctgtagt

SEQ ID NO: 464696 - DNA, 25 bp, Mus musculus
taggaacggttgatccaaagagccc

SEQ ID NO: 464697 - DNA, 25 bp, Mus musculus
taggaactaaccatgagccccgagt

SEQ ID NO: 464698 - DNA, 25 bp, Mus musculus
taggaactatcgtcacctccatggc

SEQ ID NO: 464699 - DNA, 25 bp, Mus musculus
taggaactctgatcgtaaagtggtg

SEQ ID NO: 464700 - DNA, 25 bp, Mus musculus
taggaactgcctaaagtcccaggga

SEQ ID NO: 464701 - DNA, 25 bp, Mus musculus
taggaactggaagaagtgctcccaa

SEQ ID NO: 464702 - DNA, 25 bp, Mus musculus
taggaactgggtaagagagactgca

SEQ ID NO: 464703 - DNA, 25 bp, Mus musculus
taggaactttctgtcccgtggagga

SEQ ID NO: 464704 - DNA, 25 bp, Mus musculus
taggaagaatgtacccaggcagcag

SEQ ID NO: 464705 - DNA, 25 bp, Mus musculus
taggaagagagcgttgcgtagaccc

SEQ ID NO: 464706 - DNA, 25 bp, Mus musculus
taggaagagtcctgggcgtacctga

SEQ ID NO: 464707 - DNA, 25 bp, Mus musculus
taggaagcgcctcatacggtcatca

SEQ ID NO: 464708 - DNA, 25 bp, Mus musculus
taggaagctactttgtgaagaaacc

SEQ ID NO: 464709 - DNA, 25 bp, Mus musculus
taggaagcttgttgaccgatttcgc

SEQ ID NO: 464710 - DNA, 25 bp, Mus musculus
taggaaggatcctgggcatgacagc

SEQ ID NO: 464711 - DNA, 25 bp, Mus musculus
taggaagtccctaaaagaagcactg

SEQ ID NO: 464712 - DNA, 25 bp, Mus musculus
taggaagtgcaggagatcaagtgac

SEQ ID NO: 464713 - DNA, 25 bp, Mus musculus
taggaagtggcatgcgaaaaccagt

SEQ ID NO: 464714 - DNA, 25 bp, Mus musculus
taggaagtggttctactcacagact

SEQ ID NO: 464715 - DNA, 25 bp, Mus musculus
taggaataacttacaggcagggctc

SEQ ID NO: 464716 - DNA, 25 bp, Mus musculus
taggaatacaatgagatgattcaac

SEQ ID NO: 464717 - DNA, 25 bp, Mus musculus
taggaatcacaattggcatcgtcac

SEQ ID NO: 464718 - DNA, 25 bp, Mus musculus
taggaatctcctagtgtgaccatgg

SEQ ID NO: 464719 - DNA, 25 bp, Mus musculus
taggaatgccaacagtgacgtgtgc

SEQ ID NO: 464720 - DNA, 25 bp, Mus musculus
taggaatggacatgaccactgcgcc

SEQ ID NO: 464721 - DNA, 25 bp, Mus musculus
taggaatgtgatgggcgtcgcaccc

SEQ ID NO: 464722 - DNA, 25 bp, Mus musculus
taggaattctaatgtctagtctgca

SEQ ID NO: 464723 - DNA, 25 bp, Mus musculus
taggaattgtcaacaccttagcggt

SEQ ID NO: 464724 - DNA, 25 bp, Mus musculus
taggacaaccactggaggttccgcc

SEQ ID NO: 464725 - DNA, 25 bp, Mus musculus
taggacacctttggatttaccgtga

SEQ ID NO: 464726 - DNA, 25 bp, Mus musculus
taggacacgtgaatgtgccgcatgc

SEQ ID NO: 464727 - DNA, 25 bp, Mus musculus
taggacaggattcagcaggcctctg

SEQ ID NO: 464728 - DNA, 25 bp, Mus musculus
taggacaggcacaggtaaattgccc

SEQ ID NO: 464729 - DNA, 25 bp, Mus musculus
taggacataagtgccacgaagcggg

SEQ ID NO: 464730 - DNA, 25 bp, Mus musculus
taggacatcaggaccactctgcagg

SEQ ID NO: 464731 - DNA, 25 bp, Mus musculus
taggacatccctgcacagctaaagt

SEQ ID NO: 464732 - DNA, 25 bp, Mus musculus
taggacattgaatacccaggaagct

SEQ ID NO: 464733 - DNA, 25 bp, Mus musculus
taggaccagggcacatgtggacttc

SEQ ID NO: 464734 - DNA, 25 bp, Mus musculus
taggaccatcatgagccaaccagga

SEQ ID NO: 464735 - DNA, 25 bp, Mus musculus
taggacccacctctgagaacctcat

SEQ ID NO: 464736 - DNA, 25 bp, Mus musculus
taggaccctggaccttgctactggt

SEQ ID NO: 464737 - DNA, 25 bp, Mus musculus
taggaccctgggtcttactaggcag

SEQ ID NO: 464738 - DNA, 25 bp, Mus musculus
taggacctacttggagggcccatgc

SEQ ID NO: 464739 - DNA, 25 bp, Mus musculus
taggacctctgatgctatgcaccgc

SEQ ID NO: 464740 - DNA, 25 bp, Mus musculus
taggacctcttccagactgtgcaga

SEQ ID NO: 464741 - DNA, 25 bp, Mus musculus
taggacctgaccatgaccttagtgg

SEQ ID NO: 464742 - DNA, 25 bp, Mus musculus
taggacctgcttagcactccctaag

SEQ ID NO: 464743 - DNA, 25 bp, Mus musculus
taggacctgtgctcgcttggcaatc

SEQ ID NO: 464744 - DNA, 25 bp, Mus musculus
taggaccttgttacagaactctgcc

SEQ ID NO: 464745 - DNA, 25 bp, Mus musculus
taggacgatgtctcaccttgctgtc

SEQ ID NO: 464746 - DNA, 25 bp, Mus musculus
taggacgcggctaaaacttggccaa

SEQ ID NO: 464747 - DNA, 25 bp, Mus musculus
taggacgttggtagcgcttcttcgg

SEQ ID NO: 464748 - DNA, 25 bp, Mus musculus
taggactaccatcgaccttcagtgg

SEQ ID NO: 464749 - DNA, 25 bp, Mus musculus
taggactcatttcctttagaggaga

SEQ ID NO: 464750 - DNA, 25 bp, Mus musculus
taggactgcatctacccaatacaca

SEQ ID NO: 464751 - DNA, 25 bp, Mus musculus
taggactggaaacttattctcacag

SEQ ID NO: 464752 - DNA, 25 bp, Mus musculus
taggacttcccaccgaagcctacat

SEQ ID NO: 464753 - DNA, 25 bp, Mus musculus
taggacttccgggccgtaggcctga

SEQ ID NO: 464754 - DNA, 25 bp, Mus musculus
taggacttctgaatccactgctgtc

SEQ ID NO: 464755 - DNA, 25 bp, Mus musculus
taggacttgtctacataaggaaccc

SEQ ID NO: 464756 - DNA, 25 bp, Mus musculus
taggactttctaggagctccggttc

SEQ ID NO: 464757 - DNA, 25 bp, Mus musculus
taggagaaccctgcgttgccagctt

SEQ ID NO: 464758 - DNA, 25 bp, Mus musculus
taggagaagccacacgcagcttgaa

SEQ ID NO: 464759 - DNA, 25 bp, Mus musculus
taggagacattgacgcccagcatat

SEQ ID NO: 464760 - DNA, 25 bp, Mus musculus
taggagactacgaagcttgcatggg

SEQ ID NO: 464761 - DNA, 25 bp, Mus musculus
taggagactcgatgaaggacatttc

SEQ ID NO: 464762 - DNA, 25 bp, Mus musculus
taggagagagtgcaacagagaaaat

SEQ ID NO: 464763 - DNA, 25 bp, Mus musculus
taggagagattgttctttttaacca

SEQ ID NO: 464764 - DNA, 25 bp, Mus musculus
taggagagcatgtcttgtaccttcc

SEQ ID NO: 464765 - DNA, 25 bp, Mus musculus
taggagagtcccatcatgcagagga

SEQ ID NO: 464766 - DNA, 25 bp, Mus musculus
taggagatacttccgaggccaagga

SEQ ID NO: 464767 - DNA, 25 bp, Mus musculus
taggagatcttcatggagaaatgca

SEQ ID NO: 464768 - DNA, 25 bp, Mus musculus
taggagatctttaccagggccgaag

SEQ ID NO: 464769 - DNA, 25 bp, Mus musculus
taggagatgtgatcacctggtgcca

SEQ ID NO: 464770 - DNA, 25 bp, Mus musculus
taggagcaagtaaggtcccaccgtc

SEQ ID NO: 464771 - DNA, 25 bp, Mus musculus
taggagcacgtgtgcgcagaagcat

SEQ ID NO: 464772 - DNA, 25 bp, Mus musculus
taggagcagtgaccatcaagcaagc

SEQ ID NO: 464773 - DNA, 25 bp, Mus musculus
taggagccaccatgagatcagaacc

SEQ ID NO: 464774 - DNA, 25 bp, Mus musculus
taggagccagcaggatcagaaatct

SEQ ID NO: 464775 - DNA, 25 bp, Mus musculus
taggagcctacgtttgtcctggatc

SEQ ID NO: 464776 - DNA, 25 bp, Mus musculus
taggagcctgaacctctctgcagag

SEQ ID NO: 464777 - DNA, 25 bp, Mus musculus
taggagcctgaacctgcaagcagag

SEQ ID NO: 464778 - DNA, 25 bp, Mus musculus
taggagccttgggacggaggagaaa

SEQ ID NO: 464779 - DNA, 25 bp, Mus musculus
taggagcgcaaaacacaccagttct

SEQ ID NO: 464780 - DNA, 25 bp, Mus musculus
taggagctcgactgctttgtcagcc

SEQ ID NO: 464781 - DNA, 25 bp, Mus musculus
taggagctgcatgatcctgaatgac

SEQ ID NO: 464782 - DNA, 25 bp, Mus musculus
taggagctgcccttggtgccttcca

SEQ ID NO: 464783 - DNA, 25 bp, Mus musculus
taggagctgctgtaaccttgaagcc

SEQ ID NO: 464784 - DNA, 25 bp, Mus musculus
taggagctggactggaacaccctta

SEQ ID NO: 464785 - DNA, 25 bp, Mus musculus
taggagcttattatggtaccccagg

SEQ ID NO: 464786 - DNA, 25 bp, Mus musculus
taggagcttcaaaccagaattgtcg

SEQ ID NO: 464787 - DNA, 25 bp, Mus musculus
taggagctttacacaaactgcagga

SEQ ID NO: 464788 - DNA, 25 bp, Mus musculus
taggaggactccaagcgatgaaggc

SEQ ID NO: 464789 - DNA, 25 bp, Mus musculus
taggaggcagcgaatacagaaggct

SEQ ID NO: 464790 - DNA, 25 bp, Mus musculus
taggaggccttgagtctgtgagacc

SEQ ID NO: 464791 - DNA, 25 bp, Mus musculus
taggaggctcaagcgttcttggcag

SEQ ID NO: 464792 - DNA, 25 bp, Mus musculus
taggaggtgctttccccattgagaa

SEQ ID NO: 464793 - DNA, 25 bp, Mus musculus
taggaggtgtgggaaatcacttaaa

SEQ ID NO: 464794 - DNA, 25 bp, Mus musculus
taggagtacctagcaccaaagagac

SEQ ID NO: 464795 - DNA, 25 bp, Mus musculus
taggagttaaccctcatccaggcgg

SEQ ID NO: 464796 - DNA, 25 bp, Mus musculus
taggagttcttaggcctaggacagg

SEQ ID NO: 464797 - DNA, 25 bp, Mus musculus
taggagttttctcactgcaccagtt

SEQ ID NO: 464798 - DNA, 25 bp, Mus musculus
taggatacagtagcagctctttgcg

SEQ ID NO: 464799 - DNA, 25 bp, Mus musculus
taggatacccagaacgctgcaaggc

SEQ ID NO: 464800 - DNA, 25 bp, Mus musculus
taggatactaaaccagctgccttgg

SEQ ID NO: 464801 - DNA, 25 bp, Mus musculus
taggatactgacacgctctgacacg

SEQ ID NO: 464802 - DNA, 25 bp, Mus musculus
taggatagactaacaacccaacagt

SEQ ID NO: 464803 - DNA, 25 bp, Mus musculus
taggatagcctgtactgtcctggct

SEQ ID NO: 464804 - DNA, 25 bp, Mus musculus
taggatatcatcttgcccaggctag

SEQ ID NO: 464805 - DNA, 25 bp, Mus musculus
taggatcacacaggttcagggtctc

SEQ ID NO: 464806 - DNA, 25 bp, Mus musculus
taggatcacttaagaagcggtgctg

SEQ ID NO: 464807 - DNA, 25 bp, Mus musculus
taggatcatatgtgagcgcagtccc

SEQ ID NO: 464808 - DNA, 25 bp, Mus musculus
taggatccccgtgactgcagtgaat

SEQ ID NO: 464809 - DNA, 25 bp, Mus musculus
taggatcccggagaacgtggagcac

SEQ ID NO: 464810 - DNA, 25 bp, Mus musculus
taggatccctgcatctcagtgtgtg

SEQ ID NO: 464811 - DNA, 25 bp, Mus musculus
taggatcctacaactccggagcagt

SEQ ID NO: 464812 - DNA, 25 bp, Mus musculus
taggatctcacgctctaggcattgt

SEQ ID NO: 464813 - DNA, 25 bp, Mus musculus
taggatctcattcctgcagctcccg

SEQ ID NO: 464814 - DNA, 25 bp, Mus musculus
taggatctgaaacttaacccctaga

SEQ ID NO: 464815 - DNA, 25 bp, Mus musculus
taggatgaagactacaacttgttcc

SEQ ID NO: 464816 - DNA, 25 bp, Mus musculus
taggatgaccgtttaccaaccaaga

SEQ ID NO: 464817 - DNA, 25 bp, Mus musculus
taggatgcagtctcctgagcctgcg

SEQ ID NO: 464818 - DNA, 25 bp, Mus musculus
taggatgctgctgctcgtgtcagga

SEQ ID NO: 464819 - DNA, 25 bp, Mus musculus
taggatggcacaccacgatgagcag

SEQ ID NO: 464820 - DNA, 25 bp, Mus musculus
taggatgtcatccaacataagcatg

SEQ ID NO: 464821 - DNA, 25 bp, Mus musculus
taggattactacaggtcaggctaag

SEQ ID NO: 464822 - DNA, 25 bp, Mus musculus
taggattcccttcaacagtcacgag

SEQ ID NO: 464823 - DNA, 25 bp, Mus musculus
taggattgcctgttagaattgatct

SEQ ID NO: 464824 - DNA, 25 bp, Mus musculus
taggattggacgagccatgaagtgc

SEQ ID NO: 464825 - DNA, 25 bp, Mus musculus
taggattggatctgagtgggaacaa

SEQ ID NO: 464826 - DNA, 25 bp, Mus musculus
taggattgtatccagccttcactgg

SEQ ID NO: 464827 - DNA, 25 bp, Mus musculus
taggatttcagccatgtgcgtgcgc

SEQ ID NO: 464828 - DNA, 25 bp, Mus musculus
taggatttcctgcagtgagaatgac

SEQ ID NO: 464829 - DNA, 25 bp, Mus musculus
taggattttcctccgtggacgtttg

SEQ ID NO: 464830 - DNA, 25 bp, Mus musculus
taggcaaacccatgtagacgagcag

SEQ ID NO: 464831 - DNA, 25 bp, Mus musculus
taggcaacaactacgatgcggccag

SEQ ID NO: 464832 - DNA, 25 bp, Mus musculus
taggcaacccctgaaagcagaacat

SEQ ID NO: 464833 - DNA, 25 bp, Mus musculus
taggcaactccctaatgcataaggt

SEQ ID NO: 464834 - DNA, 25 bp, Mus musculus
taggcaactggacgctgccgccact

SEQ ID NO: 464835 - DNA, 25 bp, Mus musculus
taggcaagacggcaacactgcagtg

SEQ ID NO: 464836 - DNA, 25 bp, Mus musculus
taggcaagattcaaccgcactggct

SEQ ID NO: 464837 - DNA, 25 bp, Mus musculus
taggcaagccatgcaactggtcctg

SEQ ID NO: 464838 - DNA, 25 bp, Mus musculus
taggcaagtctgtgatagcagctgc

SEQ ID NO: 464839 - DNA, 25 bp, Mus musculus
taggcaatgtgctcgtggtgatcgc

SEQ ID NO: 464840 - DNA, 25 bp, Mus musculus
taggcacatgtccagagcgatgcag

SEQ ID NO: 464841 - DNA, 25 bp, Mus musculus
taggcaccacttcggctggctggcc

SEQ ID NO: 464842 - DNA, 25 bp, Mus musculus
taggcaccagcacggatttcagtgg

SEQ ID NO: 464843 - DNA, 25 bp, Mus musculus
taggcaccctggtcacttctgagga

SEQ ID NO: 464844 - DNA, 25 bp, Mus musculus
taggcaccgccgttgacgttatgaa

SEQ ID NO: 464845 - DNA, 25 bp, Mus musculus
taggcacctctgatctagacaagac

SEQ ID NO: 464846 - DNA, 25 bp, Mus musculus
taggcaccttagtaaaagaactcca

SEQ ID NO: 464847 - DNA, 25 bp, Mus musculus
taggcactagaaaagggcaggccca

SEQ ID NO: 464848 - DNA, 25 bp, Mus musculus
taggcactcagtggatacctgtccc

SEQ ID NO: 464849 - DNA, 25 bp, Mus musculus
taggcacttccctatgcttgaagct

SEQ ID NO: 464850 - DNA, 25 bp, Mus musculus
taggcagaaacagcacacgaaggtg

SEQ ID NO: 464851 - DNA, 25 bp, Mus musculus
taggcagacgcttttcgagctgagc

SEQ ID NO: 464852 - DNA, 25 bp, Mus musculus
taggcagactcatctaccctgtggg

SEQ ID NO: 464853 - DNA, 25 bp, Mus musculus
taggcagagtctaatggttttctcc

SEQ ID NO: 464854 - DNA, 25 bp, Mus musculus
taggcagagtctgttgctggagacc

SEQ ID NO: 464855 - DNA, 25 bp, Mus musculus
taggcagatccccattagctgtggc

SEQ ID NO: 464856 - DNA, 25 bp, Mus musculus
taggcagcaactctcgcatggatgt

SEQ ID NO: 464857 - DNA, 25 bp, Mus musculus
taggcagcacggacttgaacaacca

SEQ ID NO: 464858 - DNA, 25 bp, Mus musculus
taggcagcaggaatacccatgcgca

SEQ ID NO: 464859 - DNA, 25 bp, Mus musculus
taggcagcatcctctaggttttctg

SEQ ID NO: 464860 - DNA, 25 bp, Mus musculus
taggcagccatccaaagctagagcc

SEQ ID NO: 464861 - DNA, 25 bp, Mus musculus
taggcagcccaggttcgcttgagtc

SEQ ID NO: 464862 - DNA, 25 bp, Mus musculus
taggcagccgcccagttgatcttgt

SEQ ID NO: 464863 - DNA, 25 bp, Mus musculus
taggcagggtggaaccagcccctga

SEQ ID NO: 464864 - DNA, 25 bp, Mus musculus
taggcaggtcgaagttgctcaaccg

SEQ ID NO: 464865 - DNA, 25 bp, Mus musculus
taggcagttggagagaaatgtcgaa

SEQ ID NO: 464866 - DNA, 25 bp, Mus musculus
taggcataaagaaacagacgcaggc

SEQ ID NO: 464867 - DNA, 25 bp, Mus musculus
taggcatcacggtgcacacctgtaa

SEQ ID NO: 464868 - DNA, 25 bp, Mus musculus
taggcatctatcaaggagagtcccc

SEQ ID NO: 464869 - DNA, 25 bp, Mus musculus
taggcatctccttgcgacctgtgga

SEQ ID NO: 464870 - DNA, 25 bp, Mus musculus
taggcatcttgctccagactacaga

SEQ ID NO: 464871 - DNA, 25 bp, Mus musculus
taggcatgattttgctgcagcatgg

SEQ ID NO: 464872 - DNA, 25 bp, Mus musculus
taggcatgtgcacggtcagcagcca

SEQ ID NO: 464873 - DNA, 25 bp, Mus musculus
taggcattcatcaacagatagaggc

SEQ ID NO: 464874 - DNA, 25 bp, Mus musculus
taggcattgacgctttgactctggg

SEQ ID NO: 464875 - DNA, 25 bp, Mus musculus
taggcatttgccagcaggcagcgca

SEQ ID NO: 464876 - DNA, 25 bp, Mus musculus
taggccaggtagaacctgcgaagtg

SEQ ID NO: 464877 - DNA, 25 bp, Mus musculus
taggccataagtggcattgctcagc

SEQ ID NO: 464878 - DNA, 25 bp, Mus musculus
taggccatagcctgtctgggaattc

SEQ ID NO: 464879 - DNA, 25 bp, Mus musculus
taggccatcttcagtatgcttcagt

SEQ ID NO: 464880 - DNA, 25 bp, Mus musculus
taggcccaagtttcacaggcaggac

SEQ ID NO: 464881 - DNA, 25 bp, Mus musculus
taggcccaccacacgagtttacagg

SEQ ID NO: 464882 - DNA, 25 bp, Mus musculus
taggccccattttgggtccagggca

SEQ ID NO: 464883 - DNA, 25 bp, Mus musculus
taggcccgacaaaggcaagatgcgc

SEQ ID NO: 464884 - DNA, 25 bp, Mus musculus
taggcccgccccttcagttttcagg

SEQ ID NO: 464885 - DNA, 25 bp, Mus musculus
taggcccgggcttactgtggtccct

SEQ ID NO: 464886 - DNA, 25 bp, Mus musculus
taggcccggtcaaacactacatgtg

SEQ ID NO: 464887 - DNA, 25 bp, Mus musculus
taggcccgtgttgaggacaggaaac

SEQ ID NO: 464888 - DNA, 25 bp, Mus musculus
taggccctgctctgtatgtccttgt

SEQ ID NO: 464889 - DNA, 25 bp, Mus musculus
taggccctgctggtaacaaagtcat

SEQ ID NO: 464890 - DNA, 25 bp, Mus musculus
taggccctggtgaaccacaggtatg

SEQ ID NO: 464891 - DNA, 25 bp, Mus musculus
taggccctggttcaatacacttcga

SEQ ID NO: 464892 - DNA, 25 bp, Mus musculus
taggcccttccgactgcgtctatga

SEQ ID NO: 464893 - DNA, 25 bp, Mus musculus
taggcccttgatactcatgacgagc

SEQ ID NO: 464894 - DNA, 25 bp, Mus musculus
taggccgagtatccaacgttaacca

SEQ ID NO: 464895 - DNA, 25 bp, Mus musculus
taggccgctaatgtggctgcagaca

SEQ ID NO: 464896 - DNA, 25 bp, Mus musculus
taggccggcatgtctctacagagga

SEQ ID NO: 464897 - DNA, 25 bp, Mus musculus
taggccggttgctggcactcagaac

SEQ ID NO: 464898 - DNA, 25 bp, Mus musculus
taggccgtacgggagcagccagtct

SEQ ID NO: 464899 - DNA, 25 bp, Mus musculus
taggcctagatgagaagcccgttcc

SEQ ID NO: 464900 - DNA, 25 bp, Mus musculus
taggcctagattgagttcggtttcg

SEQ ID NO: 464901 - DNA, 25 bp, Mus musculus
taggcctagctttcaagcttgttgg

SEQ ID NO: 464902 - DNA, 25 bp, Mus musculus
taggcctcaaatgtgggactcaaag

SEQ ID NO: 464903 - DNA, 25 bp, Mus musculus
taggcctcctgtgtatcaagacttg

SEQ ID NO: 464904 - DNA, 25 bp, Mus musculus
taggcctcgaggctggcactctatc

SEQ ID NO: 464905 - DNA, 25 bp, Mus musculus
taggcctgacgactcttctaaaatg

SEQ ID NO: 464906 - DNA, 25 bp, Mus musculus
taggcctgccgtcatacatgctgca

SEQ ID NO: 464907 - DNA, 25 bp, Mus musculus
taggcctgcctaccaagcagagtcc

SEQ ID NO: 464908 - DNA, 25 bp, Mus musculus
taggcctggaaggtagctccacagt

SEQ ID NO: 464909 - DNA, 25 bp, Mus musculus
taggcctggagaccagaacgatacc

SEQ ID NO: 464910 - DNA, 25 bp, Mus musculus
taggcctggcccatgattgatgtcg

SEQ ID NO: 464911 - DNA, 25 bp, Mus musculus
taggcctgggctactttcgacttgg

SEQ ID NO: 464912 - DNA, 25 bp, Mus musculus
taggcctgtataagaacggcacgcc

SEQ ID NO: 464913 - DNA, 25 bp, Mus musculus
taggcctgtgtagttcattccccac

SEQ ID NO: 464914 - DNA, 25 bp, Mus musculus
taggccttagtcactgccattacgg

SEQ ID NO: 464915 - DNA, 25 bp, Mus musculus
taggccttcaactccactatcagaa

SEQ ID NO: 464916 - DNA, 25 bp, Mus musculus
taggccttctctccctagaaccagg

SEQ ID NO: 464917 - DNA, 25 bp, Mus musculus
taggccttgcatatgagatccacag

SEQ ID NO: 464918 - DNA, 25 bp, Mus musculus
taggccttttgaaaacagggactgg

SEQ ID NO: 464919 - DNA, 25 bp, Mus musculus
taggcgaagttctgctttgagaggc

SEQ ID NO: 464920 - DNA, 25 bp, Mus musculus
taggcgacacgcatgccaaagtgct

SEQ ID NO: 464921 - DNA, 25 bp, Mus musculus
taggcgacatgtttctcagcatcga

SEQ ID NO: 464922 - DNA, 25 bp, Mus musculus
taggcgagaccactatgtagacttc

SEQ ID NO: 464923 - DNA, 25 bp, Mus musculus
taggcgctggcactcattacgtctg

SEQ ID NO: 464924 - DNA, 25 bp, Mus musculus
taggcggttcttactcactgcgggt

SEQ ID NO: 464925 - DNA, 25 bp, Mus musculus
taggcgtattatgcggcccacagac

SEQ ID NO: 464926 - DNA, 25 bp, Mus musculus
taggcgtcacccagtatcttttgta

SEQ ID NO: 464927 - DNA, 25 bp, Mus musculus
taggcgtctgtcctgttgagcactg

SEQ ID NO: 464928 - DNA, 25 bp, Mus musculus
taggctaaagctaccagagggtgca

SEQ ID NO: 464929 - DNA, 25 bp, Mus musculus
taggctaagagtgtacagagaagca

SEQ ID NO: 464930 - DNA, 25 bp, Mus musculus
taggctaagtttttcggtctagcca

SEQ ID NO: 464931 - DNA, 25 bp, Mus musculus
taggctaccagtctcggccctctgt

SEQ ID NO: 464932 - DNA, 25 bp, Mus musculus
taggctacgacgaagccaagctcgc

SEQ ID NO: 464933 - DNA, 25 bp, Mus musculus
taggctcagcgcttagttatggagg

SEQ ID NO: 464934 - DNA, 25 bp, Mus musculus
taggctcagtcgacacagaacagga

SEQ ID NO: 464935 - DNA, 25 bp, Mus musculus
taggctcatgtgatcctctttatgc

SEQ ID NO: 464936 - DNA, 25 bp, Mus musculus
taggctccattgcatgtgtgctcct

SEQ ID NO: 464937 - DNA, 25 bp, Mus musculus
taggctccgtgagagccttggtctc

SEQ ID NO: 464938 - DNA, 25 bp, Mus musculus
taggctcgacttcttcaatccgcgg

SEQ ID NO: 464939 - DNA, 25 bp, Mus musculus
taggctcgtgctaatggtggtgacc

SEQ ID NO: 464940 - DNA, 25 bp, Mus musculus
taggctctgagataatttccaagcg

SEQ ID NO: 464941 - DNA, 25 bp, Mus musculus
taggctctggaaaagctaagcgtgc

SEQ ID NO: 464942 - DNA, 25 bp, Mus musculus
taggctctggatgagtggatctcca

SEQ ID NO: 464943 - DNA, 25 bp, Mus musculus
taggctcttgtgtaattccatctgg

SEQ ID NO: 464944 - DNA, 25 bp, Mus musculus
taggctgaattggaaactggtggac

SEQ ID NO: 464945 - DNA, 25 bp, Mus musculus
taggctgacatcttagcaagtgaac

SEQ ID NO: 464946 - DNA, 25 bp, Mus musculus
taggctgactgtgttccaagagaag

SEQ ID NO: 464947 - DNA, 25 bp, Mus musculus
taggctgagacctagccgcctgtgt

SEQ ID NO: 464948 - DNA, 25 bp, Mus musculus
taggctgagccttgccagattaggt

SEQ ID NO: 464949 - DNA, 25 bp, Mus musculus
taggctgcaccggtactgaggcccg

SEQ ID NO: 464950 - DNA, 25 bp, Mus musculus
taggctggccaaaaccctggttctg

SEQ ID NO: 464951 - DNA, 25 bp, Mus musculus
taggctggtcctggagcatggccct

SEQ ID NO: 464952 - DNA, 25 bp, Mus musculus
taggctgtaatgacaaccctgccgc

SEQ ID NO: 464953 - DNA, 25 bp, Mus musculus
taggctgtcccctgcaggtaccagg

SEQ ID NO: 464954 - DNA, 25 bp, Mus musculus
taggctgttgtgtcatcgatgtaga

SEQ ID NO: 464955 - DNA, 25 bp, Mus musculus
taggcttaaaggctggatgaaaaac

SEQ ID NO: 464956 - DNA, 25 bp, Mus musculus
taggcttatgcatcaaacgcctcct

SEQ ID NO: 464957 - DNA, 25 bp, Mus musculus
taggcttcaattacccactggagag

SEQ ID NO: 464958 - DNA, 25 bp, Mus musculus
taggcttcggccaacagatctgtct

SEQ ID NO: 464959 - DNA, 25 bp, Mus musculus
taggcttcttccttcttgtcacaag

SEQ ID NO: 464960 - DNA, 25 bp, Mus musculus
taggcttcttcttcaccgggctgct

SEQ ID NO: 464961 - DNA, 25 bp, Mus musculus
taggcttgacttctgctccaagagc

SEQ ID NO: 464962 - DNA, 25 bp, Mus musculus
taggcttggaccgaaacagagggaa

SEQ ID NO: 464963 - DNA, 25 bp, Mus musculus
taggcttggagcgacttaggaaatc

SEQ ID NO: 464964 - DNA, 25 bp, Mus musculus
taggcttgtgtgagttccccgagaa

SEQ ID NO: 464965 - DNA, 25 bp, Mus musculus
taggcttgttaaagaacttaagctt

SEQ ID NO: 464966 - DNA, 25 bp, Mus musculus
taggctttcaaacaactcaagtaag

SEQ ID NO: 464967 - DNA, 25 bp, Mus musculus
taggctttgatacccagctaggata

SEQ ID NO: 464968 - DNA, 25 bp, Mus musculus
taggctttgccgagatgggtcccat

SEQ ID NO: 464969 - DNA, 25 bp, Mus musculus
tagggaaacttgaaggctgcgacca

SEQ ID NO: 464970 - DNA, 25 bp, Mus musculus
tagggaaagctatggtcaggactgt

SEQ ID NO: 464971 - DNA, 25 bp, Mus musculus
tagggaacccgtgcagatgactttc

SEQ ID NO: 464972 - DNA, 25 bp, Mus musculus
tagggaacctcagccggactattga

SEQ ID NO: 464973 - DNA, 25 bp, Mus musculus
tagggaactaacatcagaacacacc

SEQ ID NO: 464974 - DNA, 25 bp, Mus musculus
tagggaagctggacacaattcggcg

SEQ ID NO: 464975 - DNA, 25 bp, Mus musculus
tagggaatagcccagtcccaagaag

SEQ ID NO: 464976 - DNA, 25 bp, Mus musculus
tagggaatccttatagccactcctt

SEQ ID NO: 464977 - DNA, 25 bp, Mus musculus
tagggaattattgaggacagttagc

SEQ ID NO: 464978 - DNA, 25 bp, Mus musculus
tagggacacagctactgtcacctgt

SEQ ID NO: 464979 - DNA, 25 bp, Mus musculus
tagggacagatcacactttgcatgg

SEQ ID NO: 464980 - DNA, 25 bp, Mus musculus
tagggacagcccaagaggaaacttg

SEQ ID NO: 464981 - DNA, 25 bp, Mus musculus
tagggacagccttcccaaagcttgg

SEQ ID NO: 464982 - DNA, 25 bp, Mus musculus
tagggaccataaactcagtgttctg

SEQ ID NO: 464983 - DNA, 25 bp, Mus musculus
tagggacccaagagaatcaaaggaa

SEQ ID NO: 464984 - DNA, 25 bp, Mus musculus
tagggacccctaatgacttctgtgg

SEQ ID NO: 464985 - DNA, 25 bp, Mus musculus
tagggacccgctgagtaactgagtg

SEQ ID NO: 464986 - DNA, 25 bp, Mus musculus
tagggacctgtaagagaagccccag

SEQ ID NO: 464987 - DNA, 25 bp, Mus musculus
tagggacgacaaaacagcagcactg

SEQ ID NO: 464988 - DNA, 25 bp, Mus musculus
tagggacggcggatgtacactttga

SEQ ID NO: 464989 - DNA, 25 bp, Mus musculus
tagggactcctggtgaaaatcaagc

SEQ ID NO: 464990 - DNA, 25 bp, Mus musculus
tagggactgactttgcatgtttttt

SEQ ID NO: 464991 - DNA, 25 bp, Mus musculus
tagggacttttccagataggcagtg

SEQ ID NO: 464992 - DNA, 25 bp, Mus musculus
tagggactttttcaggtaccatgcc

SEQ ID NO: 464993 - DNA, 25 bp, Mus musculus
tagggagaagcctggtcattgcgct

SEQ ID NO: 464994 - DNA, 25 bp, Mus musculus
tagggagacattaaggcatcaggtg

SEQ ID NO: 464995 - DNA, 25 bp, Mus musculus
tagggagacttgtactgatacggcc

SEQ ID NO: 464996 - DNA, 25 bp, Mus musculus
tagggagcccgtcgtaagtctgcaa

SEQ ID NO: 464997 - DNA, 25 bp, Mus musculus
tagggagcctagacaagaattcgta

SEQ ID NO: 464998 - DNA, 25 bp, Mus musculus
tagggagcttcaagggatagaatag

SEQ ID NO: 464999 - DNA, 25 bp, Mus musculus
tagggagtaagaaagtgctgctgac

SEQ ID NO: 465000 - DNA, 25 bp, Mus musculus
tagggagtcttacactggcagaaac

SEQ ID NO: 465001 - DNA, 25 bp, Mus musculus
tagggatacacatgagctctctggg

SEQ ID NO: 465002 - DNA, 25 bp, Mus musculus
tagggatagctcctgtctgaccaag

SEQ ID NO: 465003 - DNA, 25 bp, Mus musculus
tagggatctcacagcactcatcagg

SEQ ID NO: 465004 - DNA, 25 bp, Mus musculus
tagggatgcctgaacaagatgctca

SEQ ID NO: 465005 - DNA, 25 bp, Mus musculus
tagggatggcaaattccagactcag

SEQ ID NO: 465006 - DNA, 25 bp, Mus musculus
tagggattcttcatgggtcttgcac

SEQ ID NO: 465007 - DNA, 25 bp, Mus musculus
tagggatttcgagagcctgggcaaa

SEQ ID NO: 465008 - DNA, 25 bp, Mus musculus
tagggcaaattttaaacctgctcgg

SEQ ID NO: 465009 - DNA, 25 bp, Mus musculus
tagggcaacgttttcagctccagca

SEQ ID NO: 465010 - DNA, 25 bp, Mus musculus
tagggcaattcggtctcctgcagag

SEQ ID NO: 465011 - DNA, 25 bp, Mus musculus
tagggcactgcatgtcatccatcac

SEQ ID NO: 465012 - DNA, 25 bp, Mus musculus
tagggcactgggaccttcctgaaac

SEQ ID NO: 465013 - DNA, 25 bp, Mus musculus
tagggcagggcctttttcctgagac

SEQ ID NO: 465014 - DNA, 25 bp, Mus musculus
tagggcagtatctccggtgacatca

SEQ ID NO: 465015 - DNA, 25 bp, Mus musculus
tagggcatatgactgaccaagtggc

SEQ ID NO: 465016 - DNA, 25 bp, Mus musculus
tagggcatcaaaggctcagtccagt

SEQ ID NO: 465017 - DNA, 25 bp, Mus musculus
tagggccacgggacgaattccggag

SEQ ID NO: 465018 - DNA, 25 bp, Mus musculus
tagggccactgcacatatgtaacag

SEQ ID NO: 465019 - DNA, 25 bp, Mus musculus
tagggccatcaggtttgctaacaag

SEQ ID NO: 465020 - DNA, 25 bp, Mus musculus
tagggccatgtcagtgaaagggcat

SEQ ID NO: 465021 - DNA, 25 bp, Mus musculus
tagggcccagcaggaacaactttct

SEQ ID NO: 465022 - DNA, 25 bp, Mus musculus
tagggccccagtcacatttgatgaa

SEQ ID NO: 465023 - DNA, 25 bp, Mus musculus
tagggcccgggaatctgaagaagaa

SEQ ID NO: 465024 - DNA, 25 bp, Mus musculus
tagggcctacatgtgtgaacactgc

SEQ ID NO: 465025 - DNA, 25 bp, Mus musculus
tagggcctcaaagacaatacctgtc

SEQ ID NO: 465026 - DNA, 25 bp, Mus musculus
tagggcctcagcagaactacatggt

SEQ ID NO: 465027 - DNA, 25 bp, Mus musculus
tagggcggatcctcaccggaagttc

SEQ ID NO: 465028 - DNA, 25 bp, Mus musculus
tagggcgtactcttttagggctggc

SEQ ID NO: 465029 - DNA, 25 bp, Mus musculus
tagggcgtgtccttgatattgcacc

SEQ ID NO: 465030 - DNA, 25 bp, Mus musculus
tagggcgtttcttcacactctcagg

SEQ ID NO: 465031 - DNA, 25 bp, Mus musculus
tagggctagccaatgctatatggaa

SEQ ID NO: 465032 - DNA, 25 bp, Mus musculus
tagggctagtggataaacatcaccc

SEQ ID NO: 465033 - DNA, 25 bp, Mus musculus
tagggctcacagagggacatacaga

SEQ ID NO: 465034 - DNA, 25 bp, Mus musculus
tagggctcccacaaacggtttatcg

SEQ ID NO: 465035 - DNA, 25 bp, Mus musculus
tagggctccttctcaggagtgacaa

SEQ ID NO: 465036 - DNA, 25 bp, Mus musculus
tagggctggcctatgctgagattgc

SEQ ID NO: 465037 - DNA, 25 bp, Mus musculus
tagggctgtggcataagaaatcatc

SEQ ID NO: 465038 - DNA, 25 bp, Mus musculus
tagggtaaactaaacaagacattca

SEQ ID NO: 465039 - DNA, 25 bp, Mus musculus
tagggtacatcaacagctcggaggg

SEQ ID NO: 465040 - DNA, 25 bp, Mus musculus
tagggtagggagaagcattcaccaa

SEQ ID NO: 465041 - DNA, 25 bp, Mus musculus
tagggtagttgaagccctgcgcctc

SEQ ID NO: 465042 - DNA, 25 bp, Mus musculus
tagggtatgcaacagcctttagagc

SEQ ID NO: 465043 - DNA, 25 bp, Mus musculus
tagggtcacttggaagcgtctctcc

SEQ ID NO: 465044 - DNA, 25 bp, Mus musculus
tagggtcagacaccaggaatgcctt

SEQ ID NO: 465045 - DNA, 25 bp, Mus musculus
tagggtcagaccagagccaaatggt

SEQ ID NO: 465046 - DNA, 25 bp, Mus musculus
tagggtcccagagataattgcacag

SEQ ID NO: 465047 - DNA, 25 bp, Mus musculus
tagggtcccattcgagcctggattg

SEQ ID NO: 465048 - DNA, 25 bp, Mus musculus
tagggtcccgtgtcaccaatgtgaa

SEQ ID NO: 465049 - DNA, 25 bp, Mus musculus
tagggtcggtcttaattttgctctg

SEQ ID NO: 465050 - DNA, 25 bp, Mus musculus
tagggtcgtcttggcaaccagctgc

SEQ ID NO: 465051 - DNA, 25 bp, Mus musculus
tagggtctccagtgtgagaccacac

SEQ ID NO: 465052 - DNA, 25 bp, Mus musculus
tagggtctgcgggagcctagccaaa

SEQ ID NO: 465053 - DNA, 25 bp, Mus musculus
tagggtctggactcggtcctcgtcg

SEQ ID NO: 465054 - DNA, 25 bp, Mus musculus
tagggtctgtgggttccatcaaaca

SEQ ID NO: 465055 - DNA, 25 bp, Mus musculus
tagggtctttgcctcgcacggttcg

SEQ ID NO: 465056 - DNA, 25 bp, Mus musculus
tagggtgagtgctaagtcacaccag

SEQ ID NO: 465057 - DNA, 25 bp, Mus musculus
tagggtgcacctttaactccaggaa

SEQ ID NO: 465058 - DNA, 25 bp, Mus musculus
tagggtgctagccttccatcatgag

SEQ ID NO: 465059 - DNA, 25 bp, Mus musculus
tagggtggcgctaaagtcagtttgc

SEQ ID NO: 465060 - DNA, 25 bp, Mus musculus
tagggtgtaccactgtctgagcttg

SEQ ID NO: 465061 - DNA, 25 bp, Mus musculus
tagggttaagccctagctgctggca

SEQ ID NO: 465062 - DNA, 25 bp, Mus musculus
tagggttacgaaggaatgatgctcc

SEQ ID NO: 465063 - DNA, 25 bp, Mus musculus
tagggttgcacagataaaggccacc

SEQ ID NO: 465064 - DNA, 25 bp, Mus musculus
tagggttggtgctcatcaaatgcag

SEQ ID NO: 465065 - DNA, 25 bp, Mus musculus
taggtaaaaacaagccatgcagtca

SEQ ID NO: 465066 - DNA, 25 bp, Mus musculus
taggtaacacagatgacacagggac

SEQ ID NO: 465067 - DNA, 25 bp, Mus musculus
taggtaacagcgactcacatccaga

SEQ ID NO: 465068 - DNA, 25 bp, Mus musculus
taggtaaccatttctgtttgccaca

SEQ ID NO: 465069 - DNA, 25 bp, Mus musculus
taggtaaccgagtgtccagtctgca

SEQ ID NO: 465070 - DNA, 25 bp, Mus musculus
taggtaagggcatggcctctcatgc

SEQ ID NO: 465071 - DNA, 25 bp, Mus musculus
taggtaatccccattctgagacgag

SEQ ID NO: 465072 - DNA, 25 bp, Mus musculus
taggtaatcctatattcgtgtcctc

SEQ ID NO: 465073 - DNA, 25 bp, Mus musculus
taggtaccattatcggtcacgcccg

SEQ ID NO: 465074 - DNA, 25 bp, Mus musculus
taggtacccctcgaatggaacgcaa

SEQ ID NO: 465075 - DNA, 25 bp, Mus musculus
taggtacctgtaggtagaagagctt

SEQ ID NO: 465076 - DNA, 25 bp, Mus musculus
taggtacgatcaccaacagggcctc

SEQ ID NO: 465077 - DNA, 25 bp, Mus musculus
taggtactacgtcacggcatcagga

SEQ ID NO: 465078 - DNA, 25 bp, Mus musculus
taggtactttaatacaacagaagtt

SEQ ID NO: 465079 - DNA, 25 bp, Mus musculus
taggtagaggctaggacacggacta

SEQ ID NO: 465080 - DNA, 25 bp, Mus musculus
taggtagatcttgctggctgatatc

SEQ ID NO: 465081 - DNA, 25 bp, Mus musculus
taggtagccgttcctgagggcttca

SEQ ID NO: 465082 - DNA, 25 bp, Mus musculus
taggtaggcttgcttttacaggctc

SEQ ID NO: 465083 - DNA, 25 bp, Mus musculus
taggtagtggcttcactaagtcaga

SEQ ID NO: 465084 - DNA, 25 bp, Mus musculus
taggtatctgctttccctgtagctt

SEQ ID NO: 465085 - DNA, 25 bp, Mus musculus
taggtatctgtttggactacgagcg

SEQ ID NO: 465086 - DNA, 25 bp, Mus musculus
taggtattacagagtggccctttgc

SEQ ID NO: 465087 - DNA, 25 bp, Mus musculus
taggtattcagcaccccgattctgc

SEQ ID NO: 465088 - DNA, 25 bp, Mus musculus
taggtattttaggtccagggccatg

SEQ ID NO: 465089 - DNA, 25 bp, Mus musculus
taggtcaacaccagcttccaataaa

SEQ ID NO: 465090 - DNA, 25 bp, Mus musculus
taggtcacggcatgaacacaagggc

SEQ ID NO: 465091 - DNA, 25 bp, Mus musculus
taggtcactaaatcaaacagggtgg

SEQ ID NO: 465092 - DNA, 25 bp, Mus musculus
taggtcagagcctcgaagggcacct

SEQ ID NO: 465093 - DNA, 25 bp, Mus musculus
taggtcagtttgtaatttccatgag

SEQ ID NO: 465094 - DNA, 25 bp, Mus musculus
taggtccaggacaggtcatttcttc

SEQ ID NO: 465095 - DNA, 25 bp, Mus musculus
taggtccagtgtatctaaggtgccc

SEQ ID NO: 465096 - DNA, 25 bp, Mus musculus
taggtcccaaggcagtcagctgtga

SEQ ID NO: 465097 - DNA, 25 bp, Mus musculus
taggtcccctgtgccttgtcttagg

SEQ ID NO: 465098 - DNA, 25 bp, Mus musculus
taggtccctagtggccagccagggc

SEQ ID NO: 465099 - DNA, 25 bp, Mus musculus
taggtcctataaagtgcaagcatgg

SEQ ID NO: 465100 - DNA, 25 bp, Mus musculus
taggtcctcagaagctgtgtgacga

SEQ ID NO: 465101 - DNA, 25 bp, Mus musculus
taggtccttcctagctcattgttct

SEQ ID NO: 465102 - DNA, 25 bp, Mus musculus
taggtccttggttctcattgatgta

SEQ ID NO: 465103 - DNA, 25 bp, Mus musculus
taggtcgatcaaatagtgccagctc

SEQ ID NO: 465104 - DNA, 25 bp, Mus musculus
taggtcgcttctagagatgccttgc

SEQ ID NO: 465105 - DNA, 25 bp, Mus musculus
taggtcgggtgtgcttgggatgcgc

SEQ ID NO: 465106 - DNA, 25 bp, Mus musculus
taggtcgtatcagcacagtctccgc

SEQ ID NO: 465107 - DNA, 25 bp, Mus musculus
taggtctatagactctaggccaggc

SEQ ID NO: 465108 - DNA, 25 bp, Mus musculus
taggtctccaggcagcctgccagag

SEQ ID NO: 465109 - DNA, 25 bp, Mus musculus
taggtctcccattgagcagcgtgaa

SEQ ID NO: 465110 - DNA, 25 bp, Mus musculus
taggtctcgtgtcctgcaagggtcc

SEQ ID NO: 465111 - DNA, 25 bp, Mus musculus
taggtctctctccttcggactggtg

SEQ ID NO: 465112 - DNA, 25 bp, Mus musculus
taggtctctgaatgggtctgctggc

SEQ ID NO: 465113 - DNA, 25 bp, Mus musculus
taggtctgagatctggttatgccac

SEQ ID NO: 465114 - DNA, 25 bp, Mus musculus
taggtctgctggatcaacggcttgc

SEQ ID NO: 465115 - DNA, 25 bp, Mus musculus
taggtcttcgctccatcatcataat

SEQ ID NO: 465116 - DNA, 25 bp, Mus musculus
taggtgaacctcctttggacaacgg

SEQ ID NO: 465117 - DNA, 25 bp, Mus musculus
taggtgaagcctcaggatcagctgc

SEQ ID NO: 465118 - DNA, 25 bp, Mus musculus
taggtgaagggactcaaggccacac

SEQ ID NO: 465119 - DNA, 25 bp, Mus musculus
taggtgacactaaagagctcgaaga

SEQ ID NO: 465120 - DNA, 25 bp, Mus musculus
taggtgaccattagcttggttaaac

SEQ ID NO: 465121 - DNA, 25 bp, Mus musculus
taggtgaccccgctgaatatgctca

SEQ ID NO: 465122 - DNA, 25 bp, Mus musculus
taggtgacgtgatccacaatgctgg

SEQ ID NO: 465123 - DNA, 25 bp, Mus musculus
taggtgactagagcttcctactctg

SEQ ID NO: 465124 - DNA, 25 bp, Mus musculus
taggtgactctccactcctgggaag

SEQ ID NO: 465125 - DNA, 25 bp, Mus musculus
taggtgcactcggaaaaacgcctgc

SEQ ID NO: 465126 - DNA, 25 bp, Mus musculus
taggtgcatcaaccagaccgaaggg

SEQ ID NO: 465127 - DNA, 25 bp, Mus musculus
taggtgcatcctatatgtaacattc

SEQ ID NO: 465128 - DNA, 25 bp, Mus musculus
taggtgccacagagtgtatcagtcc

SEQ ID NO: 465129 - DNA, 25 bp, Mus musculus
taggtgccacctgctgtcaatgcgt

SEQ ID NO: 465130 - DNA, 25 bp, Mus musculus
taggtgcccagctgatgagccactt

SEQ ID NO: 465131 - DNA, 25 bp, Mus musculus
taggtgccctgtctgtagaacttgt

SEQ ID NO: 465132 - DNA, 25 bp, Mus musculus
taggtgcctgccgtactgttctggt

SEQ ID NO: 465133 - DNA, 25 bp, Mus musculus
taggtgcctggatgcatgtgtgccc

SEQ ID NO: 465134 - DNA, 25 bp, Mus musculus
taggtgctacgcgtggctttgaacc

SEQ ID NO: 465135 - DNA, 25 bp, Mus musculus
taggtgcttcccctctcataggagc

SEQ ID NO: 465136 - DNA, 25 bp, Mus musculus
taggtggacagagccaaaggcctca

SEQ ID NO: 465137 - DNA, 25 bp, Mus musculus
taggtggactcatgagacaaatgca

SEQ ID NO: 465138 - DNA, 25 bp, Mus musculus
taggtggataggtaatccccattct

SEQ ID NO: 465139 - DNA, 25 bp, Mus musculus
taggtggatctagaaggaacgtccc

SEQ ID NO: 465140 - DNA, 25 bp, Mus musculus
taggtggcatggcttccagcctcta

SEQ ID NO: 465141 - DNA, 25 bp, Mus musculus
taggtgggagctcattcagactgca

SEQ ID NO: 465142 - DNA, 25 bp, Mus musculus
taggtgggtctttatggaaaccagc

SEQ ID NO: 465143 - DNA, 25 bp, Mus musculus
taggtgtacacccatctgctcagag

SEQ ID NO: 465144 - DNA, 25 bp, Mus musculus
taggtgtagacttcccactgcagag

SEQ ID NO: 465145 - DNA, 25 bp, Mus musculus
taggtgtcacatggccctctagtgg

SEQ ID NO: 465146 - DNA, 25 bp, Mus musculus
taggtgtcatctctggctctgtgtg

SEQ ID NO: 465147 - DNA, 25 bp, Mus musculus
taggtgtcatgattattctctgtag

SEQ ID NO: 465148 - DNA, 25 bp, Mus musculus
taggtgtccagaccctttgccccag

SEQ ID NO: 465149 - DNA, 25 bp, Mus musculus
taggtgtcctaaaactctggagctg

SEQ ID NO: 465150 - DNA, 25 bp, Mus musculus
taggtgtcctgtagcaaactcatcc

SEQ ID NO: 465151 - DNA, 25 bp, Mus musculus
taggtgtctctatcagtgctttgtt

SEQ ID NO: 465152 - DNA, 25 bp, Mus musculus
taggtgttcactctgtagcgcatgc

SEQ ID NO: 465153 - DNA, 25 bp, Mus musculus
taggttacgcttgccctgagtgacc

SEQ ID NO: 465154 - DNA, 25 bp, Mus musculus
taggttagacctgccttactgaagc

SEQ ID NO: 465155 - DNA, 25 bp, Mus musculus
taggttataaggaagactgaacagc

SEQ ID NO: 465156 - DNA, 25 bp, Mus musculus
taggttatgttctttctctgagcta

SEQ ID NO: 465157 - DNA, 25 bp, Mus musculus
taggttcaggctgcctgtcagggct

SEQ ID NO: 465158 - DNA, 25 bp, Mus musculus
taggttcggttagacgacagcgcca

SEQ ID NO: 465159 - DNA, 25 bp, Mus musculus
taggttcttttgcatacactcgaca

SEQ ID NO: 465160 - DNA, 25 bp, Mus musculus
taggttgaaggctccccagtggaca

SEQ ID NO: 465161 - DNA, 25 bp, Mus musculus
taggttgcctttttatctccacgtg

SEQ ID NO: 465162 - DNA, 25 bp, Mus musculus
taggtttatggacacactgtgccca

SEQ ID NO: 465163 - DNA, 25 bp, Mus musculus
taggtttgaggtgaccctgaaaaga

SEQ ID NO: 465164 - DNA, 25 bp, Mus musculus
taggttttcctacatgccacctaca

SEQ ID NO: 465165 - DNA, 25 bp, Mus musculus
taggttttgagtctcgccacacagc

SEQ ID NO: 465166 - DNA, 25 bp, Mus musculus
taggttttgtactttgaacactgcc

SEQ ID NO: 465167 - DNA, 25 bp, Mus musculus
taggttttgtctctctgcacttaga

SEQ ID NO: 465168 - DNA, 25 bp, Mus musculus
tagtaaaacctgtggcctactttct

SEQ ID NO: 465169 - DNA, 25 bp, Mus musculus
tagtaaaatcaaactgaggtctcag

SEQ ID NO: 465170 - DNA, 25 bp, Mus musculus
tagtaaaatctagagagcggagcgg

SEQ ID NO: 465171 - DNA, 25 bp, Mus musculus
tagtaaacaggttgtctgcaccact

SEQ ID NO: 465172 - DNA, 25 bp, Mus musculus
tagtaaacagtttgatacaagccca

SEQ ID NO: 465173 - DNA, 25 bp, Mus musculus
tagtaaagccacattgaacactcct

SEQ ID NO: 465174 - DNA, 25 bp, Mus musculus
tagtaaataatggtacctgagcccc

SEQ ID NO: 465175 - DNA, 25 bp, Mus musculus
tagtaaatgttgtcctccattgccc

SEQ ID NO: 465176 - DNA, 25 bp, Mus musculus
tagtaacagatggagccctagaccg

SEQ ID NO: 465177 - DNA, 25 bp, Mus musculus
tagtaacagtgagctcaaagttttc

SEQ ID NO: 465178 - DNA, 25 bp, Mus musculus
tagtaacctctcaccttggcctgga

SEQ ID NO: 465179 - DNA, 25 bp, Mus musculus
tagtaactctaaagaagacgatgtc

SEQ ID NO: 465180 - DNA, 25 bp, Mus musculus
tagtaactggaggagcctcgggcct

SEQ ID NO: 465181 - DNA, 25 bp, Mus musculus
tagtaacttacgacctggagaccag

SEQ ID NO: 465182 - DNA, 25 bp, Mus musculus
tagtaagaaaagcacacacagacag

SEQ ID NO: 465183 - DNA, 25 bp, Mus musculus
tagtaagacctaaacctcaagtggc

SEQ ID NO: 465184 - DNA, 25 bp, Mus musculus
tagtaagacctagactcagaaggcc

SEQ ID NO: 465185 - DNA, 25 bp, Mus musculus
tagtaagccagagaataggcactag

SEQ ID NO: 465186 - DNA, 25 bp, Mus musculus
tagtaaggccagcagcaaagcaagg

SEQ ID NO: 465187 - DNA, 25 bp, Mus musculus
tagtaaggcctctccaatgggacag

SEQ ID NO: 465188 - DNA, 25 bp, Mus musculus
tagtaagtgccagattttcaaacac

SEQ ID NO: 465189 - DNA, 25 bp, Mus musculus
tagtaagtgggtccagacagtgccc

SEQ ID NO: 465190 - DNA, 25 bp, Mus musculus
tagtaatctggctttctggacctgg

SEQ ID NO: 465191 - DNA, 25 bp, Mus musculus
tagtaatggaacttggctgtggccc

SEQ ID NO: 465192 - DNA, 25 bp, Mus musculus
tagtacaagctacggatttagctcc

SEQ ID NO: 465193 - DNA, 25 bp, Mus musculus
tagtacactgtcctgagtcccgaag

SEQ ID NO: 465194 - DNA, 25 bp, Mus musculus
tagtacagcacctgaattattttgt

SEQ ID NO: 465195 - DNA, 25 bp, Mus musculus
tagtacagttaaataccaaccaata

SEQ ID NO: 465196 - DNA, 25 bp, Mus musculus
tagtacagttatataccaactagta

SEQ ID NO: 465197 - DNA, 25 bp, Mus musculus
tagtaccaacatgaccacacctgag

SEQ ID NO: 465198 - DNA, 25 bp, Mus musculus
tagtaccagaagtccactgagatca

SEQ ID NO: 465199 - DNA, 25 bp, Mus musculus
tagtacccaggcctatgagtgttgg

SEQ ID NO: 465200 - DNA, 25 bp, Mus musculus
tagtacccaggtctgtttcatccgg

SEQ ID NO: 465201 - DNA, 25 bp, Mus musculus
tagtaccctctctttgggcaaagcc

SEQ ID NO: 465202 - DNA, 25 bp, Mus musculus
tagtacctaatctggcgctgggaag

SEQ ID NO: 465203 - DNA, 25 bp, Mus musculus
tagtacctgtctcatctccagctgt

SEQ ID NO: 465204 - DNA, 25 bp, Mus musculus
tagtacctttgcagtctacacggtg

SEQ ID NO: 465205 - DNA, 25 bp, Mus musculus
tagtacgaagacagagaagtgccag

SEQ ID NO: 465206 - DNA, 25 bp, Mus musculus
tagtacgccttgagttatcctgcag

SEQ ID NO: 465207 - DNA, 25 bp, Mus musculus
tagtacgtcctgctgacacctggtc

SEQ ID NO: 465208 - DNA, 25 bp, Mus musculus
tagtactctggagcgaggatacccc

SEQ ID NO: 465209 - DNA, 25 bp, Mus musculus
tagtactgagtcaccacagaagaca

SEQ ID NO: 465210 - DNA, 25 bp, Mus musculus
tagtactgtacaaaccgtgtgtggc

SEQ ID NO: 465211 - DNA, 25 bp, Mus musculus
tagtactgtagataggacccagggc

SEQ ID NO: 465212 - DNA, 25 bp, Mus musculus
tagtacttaaacctcaaagggtgca

SEQ ID NO: 465213 - DNA, 25 bp, Mus musculus
tagtacttagcatacagccagagtc

SEQ ID NO: 465214 - DNA, 25 bp, Mus musculus
tagtacttgcatcggtgtctccggg

SEQ ID NO: 465215 - DNA, 25 bp, Mus musculus
tagtagaaccagaagccgatgagca

SEQ ID NO: 465216 - DNA, 25 bp, Mus musculus
tagtagaactcagaaccctcagaac

SEQ ID NO: 465217 - DNA, 25 bp, Mus musculus
tagtagaactggatcttcaccacct

SEQ ID NO: 465218 - DNA, 25 bp, Mus musculus
tagtagactggttgtatcgggccca

SEQ ID NO: 465219 - DNA, 25 bp, Mus musculus
tagtagagacaaaaccacccagagt

SEQ ID NO: 465220 - DNA, 25 bp, Mus musculus
tagtagatagcataagacccaaacc

SEQ ID NO: 465221 - DNA, 25 bp, Mus musculus
tagtagatgaggcagacaaagcccc

SEQ ID NO: 465222 - DNA, 25 bp, Mus musculus
tagtagcagagacaccaggctcttg

SEQ ID NO: 465223 - DNA, 25 bp, Mus musculus
tagtagcagcatgggacctatctcc

SEQ ID NO: 465224 - DNA, 25 bp, Mus musculus
tagtagccaaggtcgggcacctcta

SEQ ID NO: 465225 - DNA, 25 bp, Mus musculus
tagtagcctatgtccaccagaaaga

SEQ ID NO: 465226 - DNA, 25 bp, Mus musculus
tagtagcggaacaaatccacagggt

SEQ ID NO: 465227 - DNA, 25 bp, Mus musculus
tagtagctcccaggccgaatgcttc

SEQ ID NO: 465228 - DNA, 25 bp, Mus musculus
tagtagcttcagtcgtaaagggccc

SEQ ID NO: 465229 - DNA, 25 bp, Mus musculus
tagtaggccttctctatcagtgggt

SEQ ID NO: 465230 - DNA, 25 bp, Mus musculus
tagtagggacactcaaagtaagcct

SEQ ID NO: 465231 - DNA, 25 bp, Mus musculus
tagtagggtagttgaagccctgcgc

SEQ ID NO: 465232 - DNA, 25 bp, Mus musculus
tagtagtagtcgtctgagcccagca

SEQ ID NO: 465233 - DNA, 25 bp, Mus musculus
tagtagtctaacatctaggaacgcc

SEQ ID NO: 465234 - DNA, 25 bp, Mus musculus
tagtagtctgtcaggattgcatccc

SEQ ID NO: 465235 - DNA, 25 bp, Mus musculus
tagtagtggagatgaagctgtgcaa

SEQ ID NO: 465236 - DNA, 25 bp, Mus musculus
tagtagttctcaccttttcattgaa

SEQ ID NO: 465237 - DNA, 25 bp, Mus musculus
tagtagttgataccccctacttcgg

SEQ ID NO: 465238 - DNA, 25 bp, Mus musculus
tagtataccctactttctcagtcct

SEQ ID NO: 465239 - DNA, 25 bp, Mus musculus
tagtataccctagggagaggcagag

SEQ ID NO: 465240 - DNA, 25 bp, Mus musculus
tagtatatccagctgttttgtccac

SEQ ID NO: 465241 - DNA, 25 bp, Mus musculus
tagtatcagcttctgtgtggcaacc

SEQ ID NO: 465242 - DNA, 25 bp, Mus musculus
tagtatccagcatcccttggacaga

SEQ ID NO: 465243 - DNA, 25 bp, Mus musculus
tagtatcgagaagtacagaggcacc

SEQ ID NO: 465244 - DNA, 25 bp, Mus musculus
tagtatctaaagcttgaccaggagc

SEQ ID NO: 465245 - DNA, 25 bp, Mus musculus
tagtatctccaaagtgaccagcctg

SEQ ID NO: 465246 - DNA, 25 bp, Mus musculus
tagtatgatatgtttgacgctccaa

SEQ ID NO: 465247 - DNA, 25 bp, Mus musculus
tagtatgctgctgaccctctctggt

SEQ ID NO: 465248 - DNA, 25 bp, Mus musculus
tagtatggctcctccgctcatgcct

SEQ ID NO: 465249 - DNA, 25 bp, Mus musculus
tagtatgtacctacttcatggatgc

SEQ ID NO: 465250 - DNA, 25 bp, Mus musculus
tagtattaactctctctatcaggtt

SEQ ID NO: 465251 - DNA, 25 bp, Mus musculus
tagtattagccccaagagttcagtc

SEQ ID NO: 465252 - DNA, 25 bp, Mus musculus
tagtattccctttcagcaacctgcg

SEQ ID NO: 465253 - DNA, 25 bp, Mus musculus
tagtattgctgaaaagtatggctcc

SEQ ID NO: 465254 - DNA, 25 bp, Mus musculus
tagtatttccaccttgagctgatcc

SEQ ID NO: 465255 - DNA, 25 bp, Mus musculus
tagtcaaaggcgagccaaggcaacc

SEQ ID NO: 465256 - DNA, 25 bp, Mus musculus
tagtcaaatctagcatagcgcgctg

SEQ ID NO: 465257 - DNA, 25 bp, Mus musculus
tagtcaacatgcactcctatcagag

SEQ ID NO: 465258 - DNA, 25 bp, Mus musculus
tagtcaacggtcagcttatcggcgc

SEQ ID NO: 465259 - DNA, 25 bp, Mus musculus
tagtcaactgtaacataggcttgtc

SEQ ID NO: 465260 - DNA, 25 bp, Mus musculus
tagtcaagatgctggttcacaaccc

SEQ ID NO: 465261 - DNA, 25 bp, Mus musculus
tagtcaaggaagacgggaaagcaca

SEQ ID NO: 465262 - DNA, 25 bp, Mus musculus
tagtcaagtaccttttgtgtaagca

SEQ ID NO: 465263 - DNA, 25 bp, Mus musculus
tagtcaattctgcagcttacccgaa

SEQ ID NO: 465264 - DNA, 25 bp, Mus musculus
tagtcacaatgcttctgggtcacag

SEQ ID NO: 465265 - DNA, 25 bp, Mus musculus
tagtcacaattcactgcgggatgct

SEQ ID NO: 465266 - DNA, 25 bp, Mus musculus
tagtcacacttccacgaggatcggc

SEQ ID NO: 465267 - DNA, 25 bp, Mus musculus
tagtcacagatgcagtcctggaccg

SEQ ID NO: 465268 - DNA, 25 bp, Mus musculus
tagtcacaggctagggcctacatgt

SEQ ID NO: 465269 - DNA, 25 bp, Mus musculus
tagtcacagtggataaggaaccagg

SEQ ID NO: 465270 - DNA, 25 bp, Mus musculus
tagtcacatgactctcaccgaaggg

SEQ ID NO: 465271 - DNA, 25 bp, Mus musculus
tagtcaccccaggtagagaaggcaa

SEQ ID NO: 465272 - DNA, 25 bp, Mus musculus
tagtcaccgcagatgatggacggca

SEQ ID NO: 465273 - DNA, 25 bp, Mus musculus
tagtcacgaactgctggtgccttgt

SEQ ID NO: 465274 - DNA, 25 bp, Mus musculus
tagtcactgcatacacttagctttg

SEQ ID NO: 465275 - DNA, 25 bp, Mus musculus
tagtcactgtaacttgcttagaggg

SEQ ID NO: 465276 - DNA, 25 bp, Mus musculus
tagtcagaaagtctcgtcgtggccg

SEQ ID NO: 465277 - DNA, 25 bp, Mus musculus
tagtcagagatactccgttctgggc

SEQ ID NO: 465278 - DNA, 25 bp, Mus musculus
tagtcagcaagtacatgttaagagc

SEQ ID NO: 465279 - DNA, 25 bp, Mus musculus
tagtcagcgaccagcctttgcttgg

SEQ ID NO: 465280 - DNA, 25 bp, Mus musculus
tagtcagctcaaatgggacaactgg

SEQ ID NO: 465281 - DNA, 25 bp, Mus musculus
tagtcaggctgagaaggaaccagcc

SEQ ID NO: 465282 - DNA, 25 bp, Mus musculus
tagtcagtcactccaacccatggga

SEQ ID NO: 465283 - DNA, 25 bp, Mus musculus
tagtcatccatccagacaggggctc

SEQ ID NO: 465284 - DNA, 25 bp, Mus musculus
tagtcatcctatgcctgggagtggc

SEQ ID NO: 465285 - DNA, 25 bp, Mus musculus
tagtcatgcctgtcctccatggaga

SEQ ID NO: 465286 - DNA, 25 bp, Mus musculus
tagtcatggaaagagccctgctgtc

SEQ ID NO: 465287 - DNA, 25 bp, Mus musculus
tagtcatggccctgatggtgcggtc

SEQ ID NO: 465288 - DNA, 25 bp, Mus musculus
tagtcatggtgctgtgggagtcccc

SEQ ID NO: 465289 - DNA, 25 bp, Mus musculus
tagtcattgaggcacatccattggt

SEQ ID NO: 465290 - DNA, 25 bp, Mus musculus
tagtcattgccctggtagatggtcg

SEQ ID NO: 465291 - DNA, 25 bp, Mus musculus
tagtccaacataagaattacctgtg

SEQ ID NO: 465292 - DNA, 25 bp, Mus musculus
tagtccagacacaggcaaatgaggc

SEQ ID NO: 465293 - DNA, 25 bp, Mus musculus
tagtccagatttccgtttgagtccc

SEQ ID NO: 465294 - DNA, 25 bp, Mus musculus
tagtccagggctaaagctctagttg

SEQ ID NO: 465295 - DNA, 25 bp, Mus musculus
tagtccagtagagttggcaccaatc

SEQ ID NO: 465296 - DNA, 25 bp, Mus musculus
tagtccagtctataatgcagcagtg

SEQ ID NO: 465297 - DNA, 25 bp, Mus musculus
tagtccatgagagacacagctccca

SEQ ID NO: 465298 - DNA, 25 bp, Mus musculus
tagtccatgcatatgctttcagggc

SEQ ID NO: 465299 - DNA, 25 bp, Mus musculus
tagtccattccttcggcttcgggag

SEQ ID NO: 465300 - DNA, 25 bp, Mus musculus
tagtcccagtttgagccatcggcag

SEQ ID NO: 465301 - DNA, 25 bp, Mus musculus
tagtccccgaagtttgagataagtc

SEQ ID NO: 465302 - DNA, 25 bp, Mus musculus
tagtcccgactctctcaagactttc

SEQ ID NO: 465303 - DNA, 25 bp, Mus musculus
tagtccgaggccagcagtgttgtgt

SEQ ID NO: 465304 - DNA, 25 bp, Mus musculus
tagtccgcagcacttgaacgtccag

SEQ ID NO: 465305 - DNA, 25 bp, Mus musculus
tagtccgccacagagtgacgtcagg

SEQ ID NO: 465306 - DNA, 25 bp, Mus musculus
tagtccgggacctctcagggagtaa

SEQ ID NO: 465307 - DNA, 25 bp, Mus musculus
tagtccgtgatcaccatggcaggaa

SEQ ID NO: 465308 - DNA, 25 bp, Mus musculus
tagtcctcacattcttaggactgga

SEQ ID NO: 465309 - DNA, 25 bp, Mus musculus
tagtcctcctaattcatctgcatgg

SEQ ID NO: 465310 - DNA, 25 bp, Mus musculus
tagtcctcgaggaagtatgctacac

SEQ ID NO: 465311 - DNA, 25 bp, Mus musculus
tagtcctcggaagtgtgagcttgcg

SEQ ID NO: 465312 - DNA, 25 bp, Mus musculus
tagtcctcgtgcatctggtctcctg

SEQ ID NO: 465313 - DNA, 25 bp, Mus musculus
tagtcctgacgtgggtgtcccttgg

SEQ ID NO: 465314 - DNA, 25 bp, Mus musculus
tagtcctgcaccttacaattctgcc

SEQ ID NO: 465315 - DNA, 25 bp, Mus musculus
tagtcctgcagacgtaaagacctcg

SEQ ID NO: 465316 - DNA, 25 bp, Mus musculus
tagtcctgcccctggtcatgagtgt

SEQ ID NO: 465317 - DNA, 25 bp, Mus musculus
tagtcctggcgtacaaagcattcgc

SEQ ID NO: 465318 - DNA, 25 bp, Mus musculus
tagtcctgggactagccgctgaagt

SEQ ID NO: 465319 - DNA, 25 bp, Mus musculus
tagtcctgggataaggatgacaccc

SEQ ID NO: 465320 - DNA, 25 bp, Mus musculus
tagtcctgtaatagcatctcgcctg

SEQ ID NO: 465321 - DNA, 25 bp, Mus musculus
tagtccttcttacaagggaaaatga

SEQ ID NO: 465322 - DNA, 25 bp, Mus musculus
tagtccttgtgcaatcgaagaagtc

SEQ ID NO: 465323 - DNA, 25 bp, Mus musculus
tagtcgacaactgagcacaaaggct

SEQ ID NO: 465324 - DNA, 25 bp, Mus musculus
tagtcgacatggttgttgcttcaag

SEQ ID NO: 465325 - DNA, 25 bp, Mus musculus
tagtcgacccagcatctccaaaata

SEQ ID NO: 465326 - DNA, 25 bp, Mus musculus
tagtcgataatagccacatcagaga

SEQ ID NO: 465327 - DNA, 25 bp, Mus musculus
tagtcgcccctccattgagagttgg

SEQ ID NO: 465328 - DNA, 25 bp, Mus musculus
tagtcgcgtggacacactgttctca

SEQ ID NO: 465329 - DNA, 25 bp, Mus musculus
tagtcgctgtgttagtcaggcatcg

SEQ ID NO: 465330 - DNA, 25 bp, Mus musculus
tagtcggacactggaaaagctacag

SEQ ID NO: 465331 - DNA, 25 bp, Mus musculus
tagtcgggagaaaaagcagatatac

SEQ ID NO: 465332 - DNA, 25 bp, Mus musculus
tagtcggtgccttgcctcatagctg

SEQ ID NO: 465333 - DNA, 25 bp, Mus musculus
tagtcgtcaagaactagtggaagac

SEQ ID NO: 465334 - DNA, 25 bp, Mus musculus
tagtcgtcacaaaagccagggctca

SEQ ID NO: 465335 - DNA, 25 bp, Mus musculus
tagtcgtggtctcaacaagtgtgtt

SEQ ID NO: 465336 - DNA, 25 bp, Mus musculus
tagtcgttctgggtctgagttatct

SEQ ID NO: 465337 - DNA, 25 bp, Mus musculus
tagtctaaaccctgttccaaagcag

SEQ ID NO: 465338 - DNA, 25 bp, Mus musculus
tagtctacactgcactctggttcaa

SEQ ID NO: 465339 - DNA, 25 bp, Mus musculus
tagtctacgaatggccggttctggg

SEQ ID NO: 465340 - DNA, 25 bp, Mus musculus
tagtctagaatctgagcgtctccag

SEQ ID NO: 465341 - DNA, 25 bp, Mus musculus
tagtctagtcctggcaagtgtgtag

SEQ ID NO: 465342 - DNA, 25 bp, Mus musculus
tagtctagtggagtagtgcagcacc

SEQ ID NO: 465343 - DNA, 25 bp, Mus musculus
tagtctatactgtggacaacatatg

SEQ ID NO: 465344 - DNA, 25 bp, Mus musculus
tagtctcactacttggctggcctag

SEQ ID NO: 465345 - DNA, 25 bp, Mus musculus
tagtctcactgaaaggacatttgga

SEQ ID NO: 465346 - DNA, 25 bp, Mus musculus
tagtctcagagctggaataacaagc

SEQ ID NO: 465347 - DNA, 25 bp, Mus musculus
tagtctccctgaggaagcagttcca

SEQ ID NO: 465348 - DNA, 25 bp, Mus musculus
tagtctccgttcagctgagcttcat

SEQ ID NO: 465349 - DNA, 25 bp, Mus musculus
tagtctcctcctgcttatttctgag

SEQ ID NO: 465350 - DNA, 25 bp, Mus musculus
tagtctccttttaccatttcctgca

SEQ ID NO: 465351 - DNA, 25 bp, Mus musculus
tagtctctccagaaagtatacgcga

SEQ ID NO: 465352 - DNA, 25 bp, Mus musculus
tagtctctgactgggacgctctaga

SEQ ID NO: 465353 - DNA, 25 bp, Mus musculus
tagtctgaaggatagtggcaaggca

SEQ ID NO: 465354 - DNA, 25 bp, Mus musculus
tagtctgagggcctttgcctgctga

SEQ ID NO: 465355 - DNA, 25 bp, Mus musculus
tagtctgcaggttgagtttctcttc

SEQ ID NO: 465356 - DNA, 25 bp, Mus musculus
tagtctgcagtgacctgaagcggaa

SEQ ID NO: 465357 - DNA, 25 bp, Mus musculus
tagtctgcattttaccacacttgtc

SEQ ID NO: 465358 - DNA, 25 bp, Mus musculus
tagtctgcctagcaagcattacgcc

SEQ ID NO: 465359 - DNA, 25 bp, Mus musculus
tagtctgctgaaacataccaagtgt

SEQ ID NO: 465360 - DNA, 25 bp, Mus musculus
tagtctggacatggaacaatctgct

SEQ ID NO: 465361 - DNA, 25 bp, Mus musculus
tagtctggagtcagcatgtgccgag

SEQ ID NO: 465362 - DNA, 25 bp, Mus musculus
tagtctggatccagccctgaagcag

SEQ ID NO: 465363 - DNA, 25 bp, Mus musculus
tagtctggcgtcaataacagggatc

SEQ ID NO: 465364 - DNA, 25 bp, Mus musculus
tagtctgggtcaggccaatcacttc

SEQ ID NO: 465365 - DNA, 25 bp, Mus musculus
tagtctgtcgaatatggcatccaag

SEQ ID NO: 465366 - DNA, 25 bp, Mus musculus
tagtctgttaagcaaagtctcacag

SEQ ID NO: 465367 - DNA, 25 bp, Mus musculus
tagtctgttgagatatgttctggcc

SEQ ID NO: 465368 - DNA, 25 bp, Mus musculus
tagtcttcagggacatagccccaag

SEQ ID NO: 465369 - DNA, 25 bp, Mus musculus
tagtcttccgtgtgtcatcagccaa

SEQ ID NO: 465370 - DNA, 25 bp, Mus musculus
tagtcttggagtccaaatggctgcc

SEQ ID NO: 465371 - DNA, 25 bp, Mus musculus
tagtcttggccacccatctggcagc

SEQ ID NO: 465372 - DNA, 25 bp, Mus musculus
tagtctttagtagggcaagcagatc

SEQ ID NO: 465373 - DNA, 25 bp, Mus musculus
tagtctttctaagacagtcggctgg

SEQ ID NO: 465374 - DNA, 25 bp, Mus musculus
tagtctttgccctttatctgcctgg

SEQ ID NO: 465375 - DNA, 25 bp, Mus musculus
tagtctttggctacgtcactgagga

SEQ ID NO: 465376 - DNA, 25 bp, Mus musculus
tagtcttttttgtgtcggccgtggg

SEQ ID NO: 465377 - DNA, 25 bp, Mus musculus
tagtgaaagcgcgaggaacatgtgc

SEQ ID NO: 465378 - DNA, 25 bp, Mus musculus
tagtgaacgtcaagtgctagatgcc

SEQ ID NO: 465379 - DNA, 25 bp, Mus musculus
tagtgaactcagctagcgtggccac

SEQ ID NO: 465380 - DNA, 25 bp, Mus musculus
tagtgaactcatggatgctgacggg

SEQ ID NO: 465381 - DNA, 25 bp, Mus musculus
tagtgaacttcccaacccaggagac

SEQ ID NO: 465382 - DNA, 25 bp, Mus musculus
tagtgaagaactagaccagccctgt

SEQ ID NO: 465383 - DNA, 25 bp, Mus musculus
tagtgaagctatacgtgctgggcag

SEQ ID NO: 465384 - DNA, 25 bp, Mus musculus
tagtgaagggctgtccatcgatggc

SEQ ID NO: 465385 - DNA, 25 bp, Mus musculus
tagtgacaccctgaaagcaaaaacg

SEQ ID NO: 465386 - DNA, 25 bp, Mus musculus
tagtgacagaactcagtgctttgcc

SEQ ID NO: 465387 - DNA, 25 bp, Mus musculus
tagtgacagaatgtttcctcctggc

SEQ ID NO: 465388 - DNA, 25 bp, Mus musculus
tagtgacagagcattgaggttttac

SEQ ID NO: 465389 - DNA, 25 bp, Mus musculus
tagtgacagcgatcttagaagaacc

SEQ ID NO: 465390 - DNA, 25 bp, Mus musculus
tagtgacagtgcacgtgagacctct

SEQ ID NO: 465391 - DNA, 25 bp, Mus musculus
tagtgaccactatcctgtctgcctg

SEQ ID NO: 465392 - DNA, 25 bp, Mus musculus
tagtgaccccatgtacaagtgtgag

SEQ ID NO: 465393 - DNA, 25 bp, Mus musculus
tagtgaccctgagaatttattcccc

SEQ ID NO: 465394 - DNA, 25 bp, Mus musculus
tagtgaccgtttcagagactccagg

SEQ ID NO: 465395 - DNA, 25 bp, Mus musculus
tagtgacctcaataagcaagaacca

SEQ ID NO: 465396 - DNA, 25 bp, Mus musculus
tagtgacctctttgctctggcccct

SEQ ID NO: 465397 - DNA, 25 bp, Mus musculus
tagtgacggagggaaatgacattgc

SEQ ID NO: 465398 - DNA, 25 bp, Mus musculus
tagtgacggtccctttcagcagcag

SEQ ID NO: 465399 - DNA, 25 bp, Mus musculus
tagtgacgtcacaccatgcatatgt

SEQ ID NO: 465400 - DNA, 25 bp, Mus musculus
tagtgacgtgggtacaaactccagg

SEQ ID NO: 465401 - DNA, 25 bp, Mus musculus
tagtgactactgactgaacatttgt

SEQ ID NO: 465402 - DNA, 25 bp, Mus musculus
tagtgactccccatctagtgcttgc

SEQ ID NO: 465403 - DNA, 25 bp, Mus musculus
tagtgactccggtcttccaggatcg

SEQ ID NO: 465404 - DNA, 25 bp, Mus musculus
tagtgactttggtcgactgcccatg

SEQ ID NO: 465405 - DNA, 25 bp, Mus musculus
tagtgacttttatgattgttcaacc

SEQ ID NO: 465406 - DNA, 25 bp, Mus musculus
tagtgagaaaattgaggcctgctgc

SEQ ID NO: 465407 - DNA, 25 bp, Mus musculus
tagtgagaacagcagaccgagtgac

SEQ ID NO: 465408 - DNA, 25 bp, Mus musculus
tagtgagaacggagtcccagagagc

SEQ ID NO: 465409 - DNA, 25 bp, Mus musculus
tagtgagaagatcgcccagaggcat

SEQ ID NO: 465410 - DNA, 25 bp, Mus musculus
tagtgagaccaaggaaacatgtgcg

SEQ ID NO: 465411 - DNA, 25 bp, Mus musculus
tagtgagaggttagcctgatccagg

SEQ ID NO: 465412 - DNA, 25 bp, Mus musculus
tagtgagagtgtggttgaactgccc

SEQ ID NO: 465413 - DNA, 25 bp, Mus musculus
tagtgagatcaggagcaacctaccc

SEQ ID NO: 465414 - DNA, 25 bp, Mus musculus
tagtgagcagtctactcagccttcc

SEQ ID NO: 465415 - DNA, 25 bp, Mus musculus
tagtgagcagttccgatcccttggg

SEQ ID NO: 465416 - DNA, 25 bp, Mus musculus
tagtgagcctgatggaagatttcct

SEQ ID NO: 465417 - DNA, 25 bp, Mus musculus
tagtgagctcgtaggtacctgtagg

SEQ ID NO: 465418 - DNA, 25 bp, Mus musculus
tagtgaggacctaggcacctttggc

SEQ ID NO: 465419 - DNA, 25 bp, Mus musculus
tagtgaggccatgctacaagttcaa

SEQ ID NO: 465420 - DNA, 25 bp, Mus musculus
tagtgataagcctcgctgagaccat

SEQ ID NO: 465421 - DNA, 25 bp, Mus musculus
tagtgataccgctgtgaaaccaaag

SEQ ID NO: 465422 - DNA, 25 bp, Mus musculus
tagtgatacctgagccaccagatag

SEQ ID NO: 465423 - DNA, 25 bp, Mus musculus
tagtgatcacttctgcacaagtcag

SEQ ID NO: 465424 - DNA, 25 bp, Mus musculus
tagtgatcatgtgagtgagtctccc

SEQ ID NO: 465425 - DNA, 25 bp, Mus musculus
tagtgatcctctcggtggcctgtca

SEQ ID NO: 465426 - DNA, 25 bp, Mus musculus
tagtgatcgccatggcccgaaagga

SEQ ID NO: 465427 - DNA, 25 bp, Mus musculus
tagtgatcgctctagagaagtaact

SEQ ID NO: 465428 - DNA, 25 bp, Mus musculus
tagtgatgactgcatgggccaccga

SEQ ID NO: 465429 - DNA, 25 bp, Mus musculus
tagtgatgccaaacccaagagctga

SEQ ID NO: 465430 - DNA, 25 bp, Mus musculus
tagtgatgccggactggtaccaagc

SEQ ID NO: 465431 - DNA, 25 bp, Mus musculus
tagtgatggcgaccaaaatggccgc

SEQ ID NO: 465432 - DNA, 25 bp, Mus musculus
tagtgatgtccttgagaaagcctgg

SEQ ID NO: 465433 - DNA, 25 bp, Mus musculus
tagtgattcaagttcatccacagaa

SEQ ID NO: 465434 - DNA, 25 bp, Mus musculus
tagtgattcctaaagttccctcagc

SEQ ID NO: 465435 - DNA, 25 bp, Mus musculus
tagtgatttgcccaaggacttgtgc

SEQ ID NO: 465436 - DNA, 25 bp, Mus musculus
tagtgattttcaccttggcaggagc

SEQ ID NO: 465437 - DNA, 25 bp, Mus musculus
tagtgattttgacatgttccaagtg

SEQ ID NO: 465438 - DNA, 25 bp, Mus musculus
tagtgcaaaccttcccgtcatgggc

SEQ ID NO: 465439 - DNA, 25 bp, Mus musculus
tagtgcaacgatagcaaccccagaa

SEQ ID NO: 465440 - DNA, 25 bp, Mus musculus
tagtgcaccgagatatcaagccagg

SEQ ID NO: 465441 - DNA, 25 bp, Mus musculus
tagtgcagaacccttaggaacaacc

SEQ ID NO: 465442 - DNA, 25 bp, Mus musculus
tagtgcagaacgtgcgcctctaggt

SEQ ID NO: 465443 - DNA, 25 bp, Mus musculus
tagtgcagcatctttgaccagtgaa

SEQ ID NO: 465444 - DNA, 25 bp, Mus musculus
tagtgcaggagccacactgactgtg

SEQ ID NO: 465445 - DNA, 25 bp, Mus musculus
tagtgccaaacttcagatgaatcga

SEQ ID NO: 465446 - DNA, 25 bp, Mus musculus
tagtgccaacagcttaaggatgccc

SEQ ID NO: 465447 - DNA, 25 bp, Mus musculus
tagtgccaactttatccccacggtg

SEQ ID NO: 465448 - DNA, 25 bp, Mus musculus
tagtgccaagggagaacattacagc

SEQ ID NO: 465449 - DNA, 25 bp, Mus musculus
tagtgccaatgctcacaacacgtgg

SEQ ID NO: 465450 - DNA, 25 bp, Mus musculus
tagtgccagcacatttaagggaaga

SEQ ID NO: 465451 - DNA, 25 bp, Mus musculus
tagtgcccggcttagaaatgtgaac

SEQ ID NO: 465452 - DNA, 25 bp, Mus musculus
tagtgccgaccgtttcctgctggtg

SEQ ID NO: 465453 - DNA, 25 bp, Mus musculus
tagtgccgagcgaatcaagaaaaga

SEQ ID NO: 465454 - DNA, 25 bp, Mus musculus
tagtgcctccgtggaaaactaccag

SEQ ID NO: 465455 - DNA, 25 bp, Mus musculus
tagtgcctctcctcgagatccatag

SEQ ID NO: 465456 - DNA, 25 bp, Mus musculus
tagtgcctgcaccactgtgttagta

SEQ ID NO: 465457 - DNA, 25 bp, Mus musculus
tagtgcctgggatccggatgacagc

SEQ ID NO: 465458 - DNA, 25 bp, Mus musculus
tagtgcctggtgtacatgtcctgcc

SEQ ID NO: 465459 - DNA, 25 bp, Mus musculus
tagtgcctgtagagagaccgaagca

SEQ ID NO: 465460 - DNA, 25 bp, Mus musculus
tagtgccttgcctcgtactgaaggg

SEQ ID NO: 465461 - DNA, 25 bp, Mus musculus
tagtgcggcaggtgtctgacctcaa

SEQ ID NO: 465462 - DNA, 25 bp, Mus musculus
tagtgctacaggtcagtctctgatc

SEQ ID NO: 465463 - DNA, 25 bp, Mus musculus
tagtgctacccagtcaaggctgcag

SEQ ID NO: 465464 - DNA, 25 bp, Mus musculus
tagtgctatctttggaaatgaatcc

SEQ ID NO: 465465 - DNA, 25 bp, Mus musculus
tagtgctattctctgtgcctgggac

SEQ ID NO: 465466 - DNA, 25 bp, Mus musculus
tagtgctcatggcatcaaagggcag

SEQ ID NO: 465467 - DNA, 25 bp, Mus musculus
tagtgctctagggagggccgccttt

SEQ ID NO: 465468 - DNA, 25 bp, Mus musculus
tagtgctgaagtaggcgctgacgaa

SEQ ID NO: 465469 - DNA, 25 bp, Mus musculus
tagtgctgagatttgactgcaggtc

SEQ ID NO: 465470 - DNA, 25 bp, Mus musculus
tagtgctggaaaatgccttagaccg

SEQ ID NO: 465471 - DNA, 25 bp, Mus musculus
tagtgctggaacaggccctagatcg

SEQ ID NO: 465472 - DNA, 25 bp, Mus musculus
tagtgctgtcctgactctgggccag

SEQ ID NO: 465473 - DNA, 25 bp, Mus musculus
tagtgcttagtatcagaaatagtcc

SEQ ID NO: 465474 - DNA, 25 bp, Mus musculus
tagtgcttgcctcccatccaaagag

SEQ ID NO: 465475 - DNA, 25 bp, Mus musculus
tagtgctttgatcagacggttccca

SEQ ID NO: 465476 - DNA, 25 bp, Mus musculus
tagtgcttttgtgccacctcgtagg

SEQ ID NO: 465477 - DNA, 25 bp, Mus musculus
tagtggaagtgctacatggaacctg

SEQ ID NO: 465478 - DNA, 25 bp, Mus musculus
tagtggacagcatctcgaccatggc

SEQ ID NO: 465479 - DNA, 25 bp, Mus musculus
tagtggaccctacagcactgaaacg

SEQ ID NO: 465480 - DNA, 25 bp, Mus musculus
tagtggacctataatcctagatgct

SEQ ID NO: 465481 - DNA, 25 bp, Mus musculus
tagtggacgatgctcctccaggatg

SEQ ID NO: 465482 - DNA, 25 bp, Mus musculus
tagtggacgccatttaccagatggt

SEQ ID NO: 465483 - DNA, 25 bp, Mus musculus
tagtggacgtgaactgcagctctgt

SEQ ID NO: 465484 - DNA, 25 bp, Mus musculus
tagtggagagggtaccaagaccagc

SEQ ID NO: 465485 - DNA, 25 bp, Mus musculus
tagtggaggaactgcggaaatccca

SEQ ID NO: 465486 - DNA, 25 bp, Mus musculus
tagtggagtccagcaagagatcttt

SEQ ID NO: 465487 - DNA, 25 bp, Mus musculus
tagtggatcactcctgcaggctcag

SEQ ID NO: 465488 - DNA, 25 bp, Mus musculus
tagtggatcccctcacagtgaagga

SEQ ID NO: 465489 - DNA, 25 bp, Mus musculus
tagtggcaactctacagacctatga

SEQ ID NO: 465490 - DNA, 25 bp, Mus musculus
tagtggcactgtctcacttgggccc

SEQ ID NO: 465491 - DNA, 25 bp, Mus musculus
tagtggcagatcacccagtggagac

SEQ ID NO: 465492 - DNA, 25 bp, Mus musculus
tagtggcagcaaatttgatcttcgg

SEQ ID NO: 465493 - DNA, 25 bp, Mus musculus
tagtggcagcaataaacgcagggat

SEQ ID NO: 465494 - DNA, 25 bp, Mus musculus
tagtggcagcctcaatgcacaggtc

SEQ ID NO: 465495 - DNA, 25 bp, Mus musculus
tagtggcagcctcggccaagaagaa

SEQ ID NO: 465496 - DNA, 25 bp, Mus musculus
tagtggcagcgaggaactctacacc

SEQ ID NO: 465497 - DNA, 25 bp, Mus musculus
tagtggccattccttcaacgttgac

SEQ ID NO: 465498 - DNA, 25 bp, Mus musculus
tagtggcccgggttctgagtttcag

SEQ ID NO: 465499 - DNA, 25 bp, Mus musculus
tagtggccctgaattctgacaagaa

SEQ ID NO: 465500 - DNA, 25 bp, Mus musculus
tagtggccttacgtaagctctcagc

SEQ ID NO: 465501 - DNA, 25 bp, Mus musculus
tagtggcgcttgtacccatagtcag

SEQ ID NO: 465502 - DNA, 25 bp, Mus musculus
tagtggctatggcagtgtacaccag

SEQ ID NO: 465503 - DNA, 25 bp, Mus musculus
tagtggctccaaagcagtggttcag

SEQ ID NO: 465504 - DNA, 25 bp, Mus musculus
tagtggctctagcaaacctagcagg

SEQ ID NO: 465505 - DNA, 25 bp, Mus musculus
tagtggctgacgtggaactgtctcc

SEQ ID NO: 465506 - DNA, 25 bp, Mus musculus
tagtggctgccgcataaacctctgg

SEQ ID NO: 465507 - DNA, 25 bp, Mus musculus
tagtggctggcaccaacctcttcat

SEQ ID NO: 465508 - DNA, 25 bp, Mus musculus
tagtgggacactgggatggacattt

SEQ ID NO: 465509 - DNA, 25 bp, Mus musculus
tagtgggatccttcgagctctaagc

SEQ ID NO: 465510 - DNA, 25 bp, Mus musculus
tagtgggcacggatatggactaccc

SEQ ID NO: 465511 - DNA, 25 bp, Mus musculus
tagtgggccacaagtacactctgcg

SEQ ID NO: 465512 - DNA, 25 bp, Mus musculus
tagtgggcgttcgtctttgcgtctc

SEQ ID NO: 465513 - DNA, 25 bp, Mus musculus
tagtgggctcgcctttaagtcccat

SEQ ID NO: 465514 - DNA, 25 bp, Mus musculus
tagtgggcttacacatagactcaac

SEQ ID NO: 465515 - DNA, 25 bp, Mus musculus
tagtgggtcatctgattctgtggcc

SEQ ID NO: 465516 - DNA, 25 bp, Mus musculus
tagtggtatgtgacaactctgctgt

SEQ ID NO: 465517 - DNA, 25 bp, Mus musculus
tagtggtcaaagaggccagtggccc

SEQ ID NO: 465518 - DNA, 25 bp, Mus musculus
tagtggtcagcgagttggcaagccc

SEQ ID NO: 465519 - DNA, 25 bp, Mus musculus
tagtggtccgctcgttcaaacaaag

SEQ ID NO: 465520 - DNA, 25 bp, Mus musculus
tagtggtcggtgtcttaggcctcca

SEQ ID NO: 465521 - DNA, 25 bp, Mus musculus
tagtggtctgctcatgactgacagc

SEQ ID NO: 465522 - DNA, 25 bp, Mus musculus
tagtggtgagcaagaccggcttaga

SEQ ID NO: 465523 - DNA, 25 bp, Mus musculus
tagtggtggacctttctcatccggg

SEQ ID NO: 465524 - DNA, 25 bp, Mus musculus
tagtggtggccatcccaagagtgac

SEQ ID NO: 465525 - DNA, 25 bp, Mus musculus
tagtgtaaagcaagattcaaggcta

SEQ ID NO: 465526 - DNA, 25 bp, Mus musculus
tagtgtacagtaccaagtgatcccc

SEQ ID NO: 465527 - DNA, 25 bp, Mus musculus
tagtgtacatgcatgccagggtgtg

SEQ ID NO: 465528 - DNA, 25 bp, Mus musculus
tagtgtagttcaaaaaactgcttgc

SEQ ID NO: 465529 - DNA, 25 bp, Mus musculus
tagtgtatgggtttgatgcccaccc

SEQ ID NO: 465530 - DNA, 25 bp, Mus musculus
tagtgtcaacccaggtcttctcggg

SEQ ID NO: 465531 - DNA, 25 bp, Mus musculus
tagtgtcacaggcagaagctctgaa

SEQ ID NO: 465532 - DNA, 25 bp, Mus musculus
tagtgtcagaatatctatcgcttca

SEQ ID NO: 465533 - DNA, 25 bp, Mus musculus
tagtgtcattaatcgctcgccaaga

SEQ ID NO: 465534 - DNA, 25 bp, Mus musculus
tagtgtccctgcgagcacagaagtc

SEQ ID NO: 465535 - DNA, 25 bp, Mus musculus
tagtgtccctgtattccgtggccgc

SEQ ID NO: 465536 - DNA, 25 bp, Mus musculus
tagtgtcccttctcggttctctctg

SEQ ID NO: 465537 - DNA, 25 bp, Mus musculus
tagtgtccggtaagcctgaaacttg

SEQ ID NO: 465538 - DNA, 25 bp, Mus musculus
tagtgtcctaggaccctgcagggca

SEQ ID NO: 465539 - DNA, 25 bp, Mus musculus
tagtgtccttctcctagccggatgg

SEQ ID NO: 465540 - DNA, 25 bp, Mus musculus
tagtgtcggctcatcgcatgaagcg

SEQ ID NO: 465541 - DNA, 25 bp, Mus musculus
tagtgtcgggatagataactgctca

SEQ ID NO: 465542 - DNA, 25 bp, Mus musculus
tagtgtcgttatgtggttacagaac

SEQ ID NO: 465543 - DNA, 25 bp, Mus musculus
tagtgtctcagtgctcccgtctgtg

SEQ ID NO: 465544 - DNA, 25 bp, Mus musculus
tagtgtctccaatgactgtagggca

SEQ ID NO: 465545 - DNA, 25 bp, Mus musculus
tagtgtctcctgtcagcacaccaga

SEQ ID NO: 465546 - DNA, 25 bp, Mus musculus
tagtgtctcttaatgagtgtgaaga

SEQ ID NO: 465547 - DNA, 25 bp, Mus musculus
tagtgtctggcttcttccagcctga

SEQ ID NO: 465548 - DNA, 25 bp, Mus musculus
tagtgtctgtagaacccaggtccaa

SEQ ID NO: 465549 - DNA, 25 bp, Mus musculus
tagtgtctgtcctcttgtccatggt

SEQ ID NO: 465550 - DNA, 25 bp, Mus musculus
tagtgtgatcccaactgtcagtgcc

SEQ ID NO: 465551 - DNA, 25 bp, Mus musculus
tagtgtgattccaatgtgtttcttc

SEQ ID NO: 465552 - DNA, 25 bp, Mus musculus
tagtgtgcagtgaccgagacgtttc

SEQ ID NO: 465553 - DNA, 25 bp, Mus musculus
tagtgtggacaaccctcatgtatgc

SEQ ID NO: 465554 - DNA, 25 bp, Mus musculus
tagtgtggcagtccataggcaccgt

SEQ ID NO: 465555 - DNA, 25 bp, Mus musculus
tagtgtggccggactgactgtctcc

SEQ ID NO: 465556 - DNA, 25 bp, Mus musculus
tagtgtgggctcttcttcaccacgg

SEQ ID NO: 465557 - DNA, 25 bp, Mus musculus
tagtgtggtcttccttgacgtggaa

SEQ ID NO: 465558 - DNA, 25 bp, Mus musculus
tagtgtggttaagggcccggatcct

SEQ ID NO: 465559 - DNA, 25 bp, Mus musculus
tagtgttagcttgtgtggcagagtc

SEQ ID NO: 465560 - DNA, 25 bp, Mus musculus
tagtgttcactgagttggttccatt

SEQ ID NO: 465561 - DNA, 25 bp, Mus musculus
tagtgttctgcagcccgggcaagga

SEQ ID NO: 465562 - DNA, 25 bp, Mus musculus
tagtgttgatcccacgagagacagc

SEQ ID NO: 465563 - DNA, 25 bp, Mus musculus
tagtgttgtagtgaatgtaggagcc

SEQ ID NO: 465564 - DNA, 25 bp, Mus musculus
tagtgttgtatacctgaagtcccag

SEQ ID NO: 465565 - DNA, 25 bp, Mus musculus
tagttaaatggacacacctgccgtg

SEQ ID NO: 465566 - DNA, 25 bp, Mus musculus
tagttaacgaatgatggcccaccaa

SEQ ID NO: 465567 - DNA, 25 bp, Mus musculus
tagttaagcttggttgtggctgcac

SEQ ID NO: 465568 - DNA, 25 bp, Mus musculus
tagttaagggaacagcagtcaggtt

SEQ ID NO: 465569 - DNA, 25 bp, Mus musculus
tagttaaggtcaaggtcactgcagc

SEQ ID NO: 465570 - DNA, 25 bp, Mus musculus
tagttaagtaccctgagctcctgaa

SEQ ID NO: 465571 - DNA, 25 bp, Mus musculus
tagttacagtgtagacaaccagccc

SEQ ID NO: 465572 - DNA, 25 bp, Mus musculus
tagttaccaaccgtgaatgcgccaa

SEQ ID NO: 465573 - DNA, 25 bp, Mus musculus
tagttaccagccctgcaattggagc

SEQ ID NO: 465574 - DNA, 25 bp, Mus musculus
tagttacccatgagcacaggagggc

SEQ ID NO: 465575 - DNA, 25 bp, Mus musculus
tagttaccgggtcagatgtatttcc

SEQ ID NO: 465576 - DNA, 25 bp, Mus musculus
tagttactaatcgagatgcccgtgc

SEQ ID NO: 465577 - DNA, 25 bp, Mus musculus
tagttactgttgatctgatgggacc

SEQ ID NO: 465578 - DNA, 25 bp, Mus musculus
tagttagcaaagctcagggccagtg

SEQ ID NO: 465579 - DNA, 25 bp, Mus musculus
tagttagcatggtcagcagcggttc

SEQ ID NO: 465580 - DNA, 25 bp, Mus musculus
tagttagccaaaaggaagcaaggtg

SEQ ID NO: 465581 - DNA, 25 bp, Mus musculus
tagttagccataatgtgcctgtggg

SEQ ID NO: 465582 - DNA, 25 bp, Mus musculus
tagttaggcccacagggctccctga

SEQ ID NO: 465583 - DNA, 25 bp, Mus musculus
tagttaggcctctgtggctgtttca

SEQ ID NO: 465584 - DNA, 25 bp, Mus musculus
tagttaggttgtcttcagctgtgcc

SEQ ID NO: 465585 - DNA, 25 bp, Mus musculus
tagttagtcctcgtccccaaagagt

SEQ ID NO: 465586 - DNA, 25 bp, Mus musculus
tagttatctaaaagcccaggaaatc

SEQ ID NO: 465587 - DNA, 25 bp, Mus musculus
tagttatgcagctctctcgtgtccc

SEQ ID NO: 465588 - DNA, 25 bp, Mus musculus
tagttatgcatattaagcttcattg

SEQ ID NO: 465589 - DNA, 25 bp, Mus musculus
tagttatgcgggtttgccaatccat

SEQ ID NO: 465590 - DNA, 25 bp, Mus musculus
tagttatgctatctcagggctcaga

SEQ ID NO: 465591 - DNA, 25 bp, Mus musculus
tagttatgctctcccctgacagggc

SEQ ID NO: 465592 - DNA, 25 bp, Mus musculus
tagttatgtggatgcgacgctcgag

SEQ ID NO: 465593 - DNA, 25 bp, Mus musculus
tagttattgaactctagtgatgtga

SEQ ID NO: 465594 - DNA, 25 bp, Mus musculus
tagttcaaagacacttcccaggatc

SEQ ID NO: 465595 - DNA, 25 bp, Mus musculus
tagttcaagcagcaacaccagtggt

SEQ ID NO: 465596 - DNA, 25 bp, Mus musculus
tagttcaattgtatttcagcagccg

SEQ ID NO: 465597 - DNA, 25 bp, Mus musculus
tagttcacaagcagggagtggcctt

SEQ ID NO: 465598 - DNA, 25 bp, Mus musculus
tagttcagagcctcactgcggcaga

SEQ ID NO: 465599 - DNA, 25 bp, Mus musculus
tagttcagcacactgccaggcagtt

SEQ ID NO: 465600 - DNA, 25 bp, Mus musculus
tagttcagcctagctcaacacacat

SEQ ID NO: 465601 - DNA, 25 bp, Mus musculus
tagttcagcgcaaggatgacctcct

SEQ ID NO: 465602 - DNA, 25 bp, Mus musculus
tagttcagctgcaggattccgtgtc

SEQ ID NO: 465603 - DNA, 25 bp, Mus musculus
tagttcaggtcaaatttcagggaga

SEQ ID NO: 465604 - DNA, 25 bp, Mus musculus
tagttcagtggataatccaggatcc

SEQ ID NO: 465605 - DNA, 25 bp, Mus musculus
tagttccacagagcaaactttccag

SEQ ID NO: 465606 - DNA, 25 bp, Mus musculus
tagttccagccatgcaatgtcccgg

SEQ ID NO: 465607 - DNA, 25 bp, Mus musculus
tagttccaggaagtgcacttggcaa

SEQ ID NO: 465608 - DNA, 25 bp, Mus musculus
tagttccagtggatacacctacaga

SEQ ID NO: 465609 - DNA, 25 bp, Mus musculus
tagttcctgggcttggaccgccatt

SEQ ID NO: 465610 - DNA, 25 bp, Mus musculus
tagttcctgttgtctgggtctctgg

SEQ ID NO: 465611 - DNA, 25 bp, Mus musculus
tagttcggcaccagttgtgaacctc

SEQ ID NO: 465612 - DNA, 25 bp, Mus musculus
tagttcgtacgctagaccagagccc

SEQ ID NO: 465613 - DNA, 25 bp, Mus musculus
tagttcgtccaccatggcgtccgtg

SEQ ID NO: 465614 - DNA, 25 bp, Mus musculus
tagttcgtggtcacacacagcctga

SEQ ID NO: 465615 - DNA, 25 bp, Mus musculus
tagttctactgggaaccggcagacc

SEQ ID NO: 465616 - DNA, 25 bp, Mus musculus
tagttctatccatcgaggaggaggc

SEQ ID NO: 465617 - DNA, 25 bp, Mus musculus
tagttctcaccgacctttcagtgcg

SEQ ID NO: 465618 - DNA, 25 bp, Mus musculus
tagttctcacggtgatcggacgcac

SEQ ID NO: 465619 - DNA, 25 bp, Mus musculus
tagttctcactaaacttatgtcatt

SEQ ID NO: 465620 - DNA, 25 bp, Mus musculus
tagttctcagcagcagtgttactgg

SEQ ID NO: 465621 - DNA, 25 bp, Mus musculus
tagttctgaaacagctccctggcca

SEQ ID NO: 465622 - DNA, 25 bp, Mus musculus
tagttctgacatggacggctactgc

SEQ ID NO: 465623 - DNA, 25 bp, Mus musculus
tagttctgcgactaagctctagcac

SEQ ID NO: 465624 - DNA, 25 bp, Mus musculus
tagttctgggaaggagcatgcaacc

SEQ ID NO: 465625 - DNA, 25 bp, Mus musculus
tagttctgtacaatggcgtctcggg

SEQ ID NO: 465626 - DNA, 25 bp, Mus musculus
tagttcttacgttgtgatcctgtca

SEQ ID NO: 465627 - DNA, 25 bp, Mus musculus
tagttcttcgtttgattgggcgcca

SEQ ID NO: 465628 - DNA, 25 bp, Mus musculus
tagttcttgctaacgccatttctga

SEQ ID NO: 465629 - DNA, 25 bp, Mus musculus
tagttctttgggagacctagggcaa

SEQ ID NO: 465630 - DNA, 25 bp, Mus musculus
tagttgaaccctgataacaatgccc

SEQ ID NO: 465631 - DNA, 25 bp, Mus musculus
tagttgaagatacaccccgtgactg

SEQ ID NO: 465632 - DNA, 25 bp, Mus musculus
tagttgaagccctgcgcctcatttc

SEQ ID NO: 465633 - DNA, 25 bp, Mus musculus
tagttgaagtcgacatggaatgcca

SEQ ID NO: 465634 - DNA, 25 bp, Mus musculus
tagttgacactcattgggaagcctg

SEQ ID NO: 465635 - DNA, 25 bp, Mus musculus
tagttgacctgaacagtgagagcag

SEQ ID NO: 465636 - DNA, 25 bp, Mus musculus
tagttgacttaagcgcatgagacac

SEQ ID NO: 465637 - DNA, 25 bp, Mus musculus
tagttgagacggtgtgcagcccttt

SEQ ID NO: 465638 - DNA, 25 bp, Mus musculus
tagttgagagaaacctgacccggca

SEQ ID NO: 465639 - DNA, 25 bp, Mus musculus
tagttgagcccatcctgaagaggcg

SEQ ID NO: 465640 - DNA, 25 bp, Mus musculus
tagttgcagcttgggcggctcctgt

SEQ ID NO: 465641 - DNA, 25 bp, Mus musculus
tagttgccctgacctacagtggaag

SEQ ID NO: 465642 - DNA, 25 bp, Mus musculus
tagttgccgtggaatagcaattgca

SEQ ID NO: 465643 - DNA, 25 bp, Mus musculus
tagttgctgtaacactatctgacaa

SEQ ID NO: 465644 - DNA, 25 bp, Mus musculus
tagttggatggttatcagtgctgcc

SEQ ID NO: 465645 - DNA, 25 bp, Mus musculus
tagttggcacgctgtacctgtatcg

SEQ ID NO: 465646 - DNA, 25 bp, Mus musculus
tagttgggtgcaaggtctagcctaa

SEQ ID NO: 465647 - DNA, 25 bp, Mus musculus
tagttggtgactactcctcctcggc

SEQ ID NO: 465648 - DNA, 25 bp, Mus musculus
tagttgtagaattcacagtcagcac

SEQ ID NO: 465649 - DNA, 25 bp, Mus musculus
tagttgtatgcatggcaaccgcgcc

SEQ ID NO: 465650 - DNA, 25 bp, Mus musculus
tagttgtctccctaggaccagggct

SEQ ID NO: 465651 - DNA, 25 bp, Mus musculus
tagttgtgtttgacaacttgatctc

SEQ ID NO: 465652 - DNA, 25 bp, Mus musculus
tagttgttccacttcctacgatcaa

SEQ ID NO: 465653 - DNA, 25 bp, Mus musculus
tagttgttctggtagaccccaaagg

SEQ ID NO: 465654 - DNA, 25 bp, Mus musculus
tagttgttgctcaccatagtacgga

SEQ ID NO: 465655 - DNA, 25 bp, Mus musculus
tagtttaatagtagcgcggtcccca

SEQ ID NO: 465656 - DNA, 25 bp, Mus musculus
tagtttacacctacgacaaggaagg

SEQ ID NO: 465657 - DNA, 25 bp, Mus musculus
tagtttatgccgctctcgtcgcagc

SEQ ID NO: 465658 - DNA, 25 bp, Mus musculus
tagtttattggaacatgagctctgt

SEQ ID NO: 465659 - DNA, 25 bp, Mus musculus
tagtttcaaagagctgcctaggctg

SEQ ID NO: 465660 - DNA, 25 bp, Mus musculus
tagtttcaagggtgacctgggctga

SEQ ID NO: 465661 - DNA, 25 bp, Mus musculus
tagtttcagtgtgcataccatcagg

SEQ ID NO: 465662 - DNA, 25 bp, Mus musculus
tagtttccagctggcttccacgggc

SEQ ID NO: 465663 - DNA, 25 bp, Mus musculus
tagtttccattacccagatcgcagc

SEQ ID NO: 465664 - DNA, 25 bp, Mus musculus
tagtttccttatctgttcgatcgag

SEQ ID NO: 465665 - DNA, 25 bp, Mus musculus
tagtttctccggtgtcttctacaag

SEQ ID NO: 465666 - DNA, 25 bp, Mus musculus
tagtttctgacaaccctgcctttgg

SEQ ID NO: 465667 - DNA, 25 bp, Mus musculus
tagtttctgagttgcgcccgtcaag

SEQ ID NO: 465668 - DNA, 25 bp, Mus musculus
tagtttctgtccctcactagactga

SEQ ID NO: 465669 - DNA, 25 bp, Mus musculus
tagtttgaccacgaggtaggcagat

SEQ ID NO: 465670 - DNA, 25 bp, Mus musculus
tagtttgcagcatcactgcccttgg

SEQ ID NO: 465671 - DNA, 25 bp, Mus musculus
tagtttgcctaatctcagccagagc

SEQ ID NO: 465672 - DNA, 25 bp, Mus musculus
tagtttgcgcagacttgaagtactc

SEQ ID NO: 465673 - DNA, 25 bp, Mus musculus
tagtttggcttatctacagagtcag

SEQ ID NO: 465674 - DNA, 25 bp, Mus musculus
tagtttggtagactgctccacggga

SEQ ID NO: 465675 - DNA, 25 bp, Mus musculus
tagttttatgatccccgtgtccagg

SEQ ID NO: 465676 - DNA, 25 bp, Mus musculus
tagttttcttctcattccctgtcac

SEQ ID NO: 465677 - DNA, 25 bp, Mus musculus
tagttttgcccctggatgagaccgc

SEQ ID NO: 465678 - DNA, 25 bp, Mus musculus
tataaaaaacttcggacacatgcag

SEQ ID NO: 465679 - DNA, 25 bp, Mus musculus
tataaaaaccgtgagagctacccag

SEQ ID NO: 465680 - DNA, 25 bp, Mus musculus
tataaaaagcaacccagacacatgg

SEQ ID NO: 465681 - DNA, 25 bp, Mus musculus
tataaaacagcgagaagtgtcacac

SEQ ID NO: 465682 - DNA, 25 bp, Mus musculus
tataaaacgggaattctggagcggg

SEQ ID NO: 465683 - DNA, 25 bp, Mus musculus
tataaaacggtatcacaagaccatg

SEQ ID NO: 465684 - DNA, 25 bp, Mus musculus
tataaaagaaccgatggcacagcag

SEQ ID NO: 465685 - DNA, 25 bp, Mus musculus
tataaaagacattaaggccggactg

SEQ ID NO: 465686 - DNA, 25 bp, Mus musculus
tataaaagcgaatgcctgaggtcac

SEQ ID NO: 465687 - DNA, 25 bp, Mus musculus
tataaaagcggagtgtcccgaggac

SEQ ID NO: 465688 - DNA, 25 bp, Mus musculus
tataaaagctgagcacatggcacgc

SEQ ID NO: 465689 - DNA, 25 bp, Mus musculus
tataaaaggccctgccaaggctctt

SEQ ID NO: 465690 - DNA, 25 bp, Mus musculus
tataaaagggcctgtacacagtggc

SEQ ID NO: 465691 - DNA, 25 bp, Mus musculus
tataaacaacgaaacggctggtctc

SEQ ID NO: 465692 - DNA, 25 bp, Mus musculus
tataaacaatcaagagtcggcccac

SEQ ID NO: 465693 - DNA, 25 bp, Mus musculus
tataaacatcccaagtaacttttcg

SEQ ID NO: 465694 - DNA, 25 bp, Mus musculus
tataaacatcgaaaaggcgttcctc

SEQ ID NO: 465695 - DNA, 25 bp, Mus musculus
tataaacccagtttttccagatgga

SEQ ID NO: 465696 - DNA, 25 bp, Mus musculus
tataaaccgtgttagcagctcagga

SEQ ID NO: 465697 - DNA, 25 bp, Mus musculus
tataaacgatgtgtctggcgcccaa

SEQ ID NO: 465698 - DNA, 25 bp, Mus musculus
tataaacgttctaaatatagagcag

SEQ ID NO: 465699 - DNA, 25 bp, Mus musculus
tataaactacaacaacctgaccgag

SEQ ID NO: 465700 - DNA, 25 bp, Mus musculus
tataaactaggctatccattctggg

SEQ ID NO: 465701 - DNA, 25 bp, Mus musculus
tataaactgcagctagggaatcgag

SEQ ID NO: 465702 - DNA, 25 bp, Mus musculus
tataaactgctcctgagatggaccc

SEQ ID NO: 465703 - DNA, 25 bp, Mus musculus
tataaactgtggcttaaagtgcagc

SEQ ID NO: 465704 - DNA, 25 bp, Mus musculus
tataaagaaatacaacgtgggcgtc

SEQ ID NO: 465705 - DNA, 25 bp, Mus musculus
tataaagaaccatggatcaggccag

SEQ ID NO: 465706 - DNA, 25 bp, Mus musculus
tataaagacacctgcacagtggacc

SEQ ID NO: 465707 - DNA, 25 bp, Mus musculus
tataaagaccaggtgcactggagag

SEQ ID NO: 465708 - DNA, 25 bp, Mus musculus
tataaagagagagattgcagctgcc

SEQ ID NO: 465709 - DNA, 25 bp, Mus musculus
tataaagatcttcagacccgggagg

SEQ ID NO: 465710 - DNA, 25 bp, Mus musculus
tataaagcagctgacaacttgggtg

SEQ ID NO: 465711 - DNA, 25 bp, Mus musculus
tataaagcaggattagaggcagagt

SEQ ID NO: 465712 - DNA, 25 bp, Mus musculus
tataaagcagtctacagagctcgtc

SEQ ID NO: 465713 - DNA, 25 bp, Mus musculus
tataaagcgaagaccattccggcag

SEQ ID NO: 465714 - DNA, 25 bp, Mus musculus
tataaagcgtgggaaagacgcaatg

SEQ ID NO: 465715 - DNA, 25 bp, Mus musculus
tataaagctagcaatgtccgtggtc

SEQ ID NO: 465716 - DNA, 25 bp, Mus musculus
tataaagctataatgtgggctggag

SEQ ID NO: 465717 - DNA, 25 bp, Mus musculus
tataaagctatggaatggcctcgtg

SEQ ID NO: 465718 - DNA, 25 bp, Mus musculus
tataaaggaatgaagggcaggcagc

SEQ ID NO: 465719 - DNA, 25 bp, Mus musculus
tataaaggctttctaccctcgtggc

SEQ ID NO: 465720 - DNA, 25 bp, Mus musculus
tataaagggacggtggccatcaagg

SEQ ID NO: 465721 - DNA, 25 bp, Mus musculus
tataaagggcattctggaagcagcc

SEQ ID NO: 465722 - DNA, 25 bp, Mus musculus
tataaagggcgtctctaggcgttcc

SEQ ID NO: 465723 - DNA, 25 bp, Mus musculus
tataaagggctttcgtgcatcagta

SEQ ID NO: 465724 - DNA, 25 bp, Mus musculus
tataaaggtctaactttacttctgg

SEQ ID NO: 465725 - DNA, 25 bp, Mus musculus
tataaaggtggtaacactcgcacgg

SEQ ID NO: 465726 - DNA, 25 bp, Mus musculus
tataaaggttgctgccatgtccggt

SEQ ID NO: 465727 - DNA, 25 bp, Mus musculus
tataaaggtttggtcactgggacac

SEQ ID NO: 465728 - DNA, 25 bp, Mus musculus
tataaagtgctttcaagccgggcag

SEQ ID NO: 465729 - DNA, 25 bp, Mus musculus
tataaagtgtgttctgccccactgg

SEQ ID NO: 465730 - DNA, 25 bp, Mus musculus
tataaagtttcttaagagtcatgca

SEQ ID NO: 465731 - DNA, 25 bp, Mus musculus
tataaataaaacagagctagttgct

SEQ ID NO: 465732 - DNA, 25 bp, Mus musculus
tataaatagcaagaccgggccagga

SEQ ID NO: 465733 - DNA, 25 bp, Mus musculus
tataaatagccacctcactgacggg

SEQ ID NO: 465734 - DNA, 25 bp, Mus musculus
tataaatgcactgtcaagcagggcc

SEQ ID NO: 465735 - DNA, 25 bp, Mus musculus
tataaatggctctgtcatctgggac

SEQ ID NO: 465736 - DNA, 25 bp, Mus musculus
tataaatggcttcacaataagaatc

SEQ ID NO: 465737 - DNA, 25 bp, Mus musculus
tataaatgtccatgcaaacccggga

SEQ ID NO: 465738 - DNA, 25 bp, Mus musculus
tataaatgtgaccaacctgcagctg

SEQ ID NO: 465739 - DNA, 25 bp, Mus musculus
tataaattgcagtgaggccatctgc

SEQ ID NO: 465740 - DNA, 25 bp, Mus musculus
tataacaacaactggacacgacttc

SEQ ID NO: 465741 - DNA, 25 bp, Mus musculus
tataacaagactggttgggccatgg

SEQ ID NO: 465742 - DNA, 25 bp, Mus musculus
tataacaccatcatagcctgggcgc

SEQ ID NO: 465743 - DNA, 25 bp, Mus musculus
tataacaccctgctcgctgaaacag

SEQ ID NO: 465744 - DNA, 25 bp, Mus musculus
tataacagacacacgctggtggccg

SEQ ID NO: 465745 - DNA, 25 bp, Mus musculus
tataacagacacgagatgagcacct

SEQ ID NO: 465746 - DNA, 25 bp, Mus musculus
tataacagtggttgcagggactgca

SEQ ID NO: 465747 - DNA, 25 bp, Mus musculus
tataacagtttgagtacccagccta

SEQ ID NO: 465748 - DNA, 25 bp, Mus musculus
tataacatctacaacgtcggctcca

SEQ ID NO: 465749 - DNA, 25 bp, Mus musculus
tataaccacaatgcatgaatgggcc

SEQ ID NO: 465750 - DNA, 25 bp, Mus musculus
tataaccacagacgatgagcaagcc

SEQ ID NO: 465751 - DNA, 25 bp, Mus musculus
tataaccagttcctgtcgcaagtgg

SEQ ID NO: 465752 - DNA, 25 bp, Mus musculus
tataaccatcttggcgttgggccag

SEQ ID NO: 465753 - DNA, 25 bp, Mus musculus
tataacccacatcgtagccaaagtg

SEQ ID NO: 465754 - DNA, 25 bp, Mus musculus
tataacccactggttgcggaagccc

SEQ ID NO: 465755 - DNA, 25 bp, Mus musculus
tataacccaggacaaggccaagcta

SEQ ID NO: 465756 - DNA, 25 bp, Mus musculus
tataacccatactgataccattgct

SEQ ID NO: 465757 - DNA, 25 bp, Mus musculus
tataacccgtggtggaagtagccag

SEQ ID NO: 465758 - DNA, 25 bp, Mus musculus
tataaccctgaaggatgggctttgt

SEQ ID NO: 465759 - DNA, 25 bp, Mus musculus
tataaccctgatggacagccaatgg

SEQ ID NO: 465760 - DNA, 25 bp, Mus musculus
tataaccggcagaagatgaacactc

SEQ ID NO: 465761 - DNA, 25 bp, Mus musculus
tataacctcgcctatgtgaaggagg

SEQ ID NO: 465762 - DNA, 25 bp, Mus musculus
tataacctgcgaccagagctggtgg

SEQ ID NO: 465763 - DNA, 25 bp, Mus musculus
tataacctggctaacaaccggcagg

SEQ ID NO: 465764 - DNA, 25 bp, Mus musculus
tataacctgggcttgggatctgaca

SEQ ID NO: 465765 - DNA, 25 bp, Mus musculus
tataaccttttgcagagcaagcggg

SEQ ID NO: 465766 - DNA, 25 bp, Mus musculus
tataacgaagagtagttgtatcccc

SEQ ID NO: 465767 - DNA, 25 bp, Mus musculus
tataacggtctggaatgcaaaacgc

SEQ ID NO: 465768 - DNA, 25 bp, Mus musculus
tataacggtgagagaaccgtgccac

SEQ ID NO: 465769 - DNA, 25 bp, Mus musculus
tataacgtcagactgcccaagcagg

SEQ ID NO: 465770 - DNA, 25 bp, Mus musculus
tataacgtcctctgtgtcgtctggg

SEQ ID NO: 465771 - DNA, 25 bp, Mus musculus
tataactaagagtggagtgtccagc

SEQ ID NO: 465772 - DNA, 25 bp, Mus musculus
tataactacacacttgttgatatag

SEQ ID NO: 465773 - DNA, 25 bp, Mus musculus
tataactacgaaggaaaagagcccg

SEQ ID NO: 465774 - DNA, 25 bp, Mus musculus
tataactaggaatggtcactgggct

SEQ ID NO: 465775 - DNA, 25 bp, Mus musculus
tataactattccttgttcaatggca

SEQ ID NO: 465776 - DNA, 25 bp, Mus musculus
tataactctgctccatgtcttcaat

SEQ ID NO: 465777 - DNA, 25 bp, Mus musculus
tataactgaactacacctccagggc

SEQ ID NO: 465778 - DNA, 25 bp, Mus musculus
tataactgacacttccgttctggct

SEQ ID NO: 465779 - DNA, 25 bp, Mus musculus
tataactgaggctgcaaatgccaca

SEQ ID NO: 465780 - DNA, 25 bp, Mus musculus
tataactgccaataatgagaacaag

SEQ ID NO: 465781 - DNA, 25 bp, Mus musculus
tataactgcggtagaggtggccaca

SEQ ID NO: 465782 - DNA, 25 bp, Mus musculus
tataacttatccacagcactgagac

SEQ ID NO: 465783 - DNA, 25 bp, Mus musculus
tataacttgagaacctcctggtggc

SEQ ID NO: 465784 - DNA, 25 bp, Mus musculus
tataacttgcagctcattctgtcac

SEQ ID NO: 465785 - DNA, 25 bp, Mus musculus
tataagaagaagatggtacgccgtg

SEQ ID NO: 465786 - DNA, 25 bp, Mus musculus
tataagaattgccatggacatggca

SEQ ID NO: 465787 - DNA, 25 bp, Mus musculus
tataagaggaccatgaaagccatcg

SEQ ID NO: 465788 - DNA, 25 bp, Mus musculus
tataagatatgtcaaggattctgtg

SEQ ID NO: 465789 - DNA, 25 bp, Mus musculus
tataagatccggacgctggacagtg

SEQ ID NO: 465790 - DNA, 25 bp, Mus musculus
tataagatgtgtgccagggtctacc

SEQ ID NO: 465791 - DNA, 25 bp, Mus musculus
tataagcaaatgttaacaactctac

SEQ ID NO: 465792 - DNA, 25 bp, Mus musculus
tataagcaagaaaataaccacgttt

SEQ ID NO: 465793 - DNA, 25 bp, Mus musculus
tataagcaagactagttcacctccc

SEQ ID NO: 465794 - DNA, 25 bp, Mus musculus
tataagcactctccaagcagttggg

SEQ ID NO: 465795 - DNA, 25 bp, Mus musculus
tataagcaggactgatggctagccc

SEQ ID NO: 465796 - DNA, 25 bp, Mus musculus
tataagcatagagatgacaggctgc

SEQ ID NO: 465797 - DNA, 25 bp, Mus musculus
tataagccaaaaggtcggaaatgcc

SEQ ID NO: 465798 - DNA, 25 bp, Mus musculus
tataagccagaaaagatgaacatat

SEQ ID NO: 465799 - DNA, 25 bp, Mus musculus
tataagccagtaccagatgaacctc

SEQ ID NO: 465800 - DNA, 25 bp, Mus musculus
tataagccattaaaatatcatcctg

SEQ ID NO: 465801 - DNA, 25 bp, Mus musculus
tataagccctttaaacctggtagca

SEQ ID NO: 465802 - DNA, 25 bp, Mus musculus
tataagcctaacaactccagaagtg

SEQ ID NO: 465803 - DNA, 25 bp, Mus musculus
tataagctaagtgcgccatgggtgg

SEQ ID NO: 465804 - DNA, 25 bp, Mus musculus
tataagctacctctggccagctgca

SEQ ID NO: 465805 - DNA, 25 bp, Mus musculus
tataagctattcgagggtggtacca

SEQ ID NO: 465806 - DNA, 25 bp, Mus musculus
tataagctcccttttacagctctca

SEQ ID NO: 465807 - DNA, 25 bp, Mus musculus
tataagctccgtctcagccaatggt

SEQ ID NO: 465808 - DNA, 25 bp, Mus musculus
tataagctgatcaaggtaggcatgc

SEQ ID NO: 465809 - DNA, 25 bp, Mus musculus
tataagctgcgatttcacttggtgg

SEQ ID NO: 465810 - DNA, 25 bp, Mus musculus
tataagctgctttctaggtccatgt

SEQ ID NO: 465811 - DNA, 25 bp, Mus musculus
tataaggaatgaaaccccagcaaag

SEQ ID NO: 465812 - DNA, 25 bp, Mus musculus
tataaggcaaaaccacgaagaggtc

SEQ ID NO: 465813 - DNA, 25 bp, Mus musculus
tataaggcagatagagcataaagaa

SEQ ID NO: 465814 - DNA, 25 bp, Mus musculus
tataaggccaattactgctcaggag

SEQ ID NO: 465815 - DNA, 25 bp, Mus musculus
tataaggccagcctcacctgcatag

SEQ ID NO: 465816 - DNA, 25 bp, Mus musculus
tataaggccatccagaagcgcaggc

SEQ ID NO: 465817 - DNA, 25 bp, Mus musculus
tataaggtctctagggtcactgtaa

SEQ ID NO: 465818 - DNA, 25 bp, Mus musculus
tataaggtgcctcactgtgtaccca

SEQ ID NO: 465819 - DNA, 25 bp, Mus musculus
tataaggttaagaggtctgcccacc

SEQ ID NO: 465820 - DNA, 25 bp, Mus musculus
tataagtcgctgaaggtgtggtcca

SEQ ID NO: 465821 - DNA, 25 bp, Mus musculus
tataagtgatttgctggccagagcg

SEQ ID NO: 465822 - DNA, 25 bp, Mus musculus
tataagtgcaacctgtgcgaccacg

SEQ ID NO: 465823 - DNA, 25 bp, Mus musculus
tataagtgcctgtccaaagccaaga

SEQ ID NO: 465824 - DNA, 25 bp, Mus musculus
tataagtgggacaggatttgctgct

SEQ ID NO: 465825 - DNA, 25 bp, Mus musculus
tataagtgtgactgtacccggactg

SEQ ID NO: 465826 - DNA, 25 bp, Mus musculus
tataagtgtgagagcctgagtttgc

SEQ ID NO: 465827 - DNA, 25 bp, Mus musculus
tataagtgtgcctagcatggtagcc

SEQ ID NO: 465828 - DNA, 25 bp, Mus musculus
tataagttcacccagcaaagccgta

SEQ ID NO: 465829 - DNA, 25 bp, Mus musculus
tataagttcagagacttaccaggat

SEQ ID NO: 465830 - DNA, 25 bp, Mus musculus
tataatagacccacccttcggctgg

SEQ ID NO: 465831 - DNA, 25 bp, Mus musculus
tataataggatttacccgtggctgg

SEQ ID NO: 465832 - DNA, 25 bp, Mus musculus
tataatcaacatcagagcgtgagcc

SEQ ID NO: 465833 - DNA, 25 bp, Mus musculus
tataatcaaccgaacaccagagagt

SEQ ID NO: 465834 - DNA, 25 bp, Mus musculus
tataatcaaggagcggagccatgca

SEQ ID NO: 465835 - DNA, 25 bp, Mus musculus
tataatcctttcgacgatgacgtgg

SEQ ID NO: 465836 - DNA, 25 bp, Mus musculus
tataatctatcagctcgtggcagga

SEQ ID NO: 465837 - DNA, 25 bp, Mus musculus
tataatctgtgagaggctgctgcca

SEQ ID NO: 465838 - DNA, 25 bp, Mus musculus
tataatgaagatcacaagcgctgcg

SEQ ID NO: 465839 - DNA, 25 bp, Mus musculus
tataatgacccaggagagaggtgcc

SEQ ID NO: 465840 - DNA, 25 bp, Mus musculus
tataatgagctgcagagtgccttcc

SEQ ID NO: 465841 - DNA, 25 bp, Mus musculus
tataatgcaaggcaggcacatgacc

SEQ ID NO: 465842 - DNA, 25 bp, Mus musculus
tataatgccagcacccgggaaacaa

SEQ ID NO: 465843 - DNA, 25 bp, Mus musculus
tataatggagactgtccggacctgg

SEQ ID NO: 465844 - DNA, 25 bp, Mus musculus
tataatggcagcatcaacgaggcgc

SEQ ID NO: 465845 - DNA, 25 bp, Mus musculus
tataatggcccactttcctataagg

SEQ ID NO: 465846 - DNA, 25 bp, Mus musculus
tataatggcttgatgtagaattgcc

SEQ ID NO: 465847 - DNA, 25 bp, Mus musculus
tataatgtcgtggtcttagcctgcc

SEQ ID NO: 465848 - DNA, 25 bp, Mus musculus
tataatgtctttacagcagcctgca

SEQ ID NO: 465849 - DNA, 25 bp, Mus musculus
tataattacataagcacatcagtac

SEQ ID NO: 465850 - DNA, 25 bp, Mus musculus
tataattgcagtaggaagcaacgca

SEQ ID NO: 465851 - DNA, 25 bp, Mus musculus
tataattggacaatccaccacggtg

SEQ ID NO: 465852 - DNA, 25 bp, Mus musculus
tataattgtagctcttggaaggtag

SEQ ID NO: 465853 - DNA, 25 bp, Mus musculus
tataatttctcacttgggaggagcc

SEQ ID NO: 465854 - DNA, 25 bp, Mus musculus
tataatttgcgagcgaagctgcccc

SEQ ID NO: 465855 - DNA, 25 bp, Mus musculus
tatacaaacgaatcgtagggctgga

SEQ ID NO: 465856 - DNA, 25 bp, Mus musculus
tatacaaactgtgagtgacactgtg

SEQ ID NO: 465857 - DNA, 25 bp, Mus musculus
tatacaactattccaggctcccagg

SEQ ID NO: 465858 - DNA, 25 bp, Mus musculus
tatacaagactaccagatcactgcc

SEQ ID NO: 465859 - DNA, 25 bp, Mus musculus
tatacaagggcctgggactgggccc

SEQ ID NO: 465860 - DNA, 25 bp, Mus musculus
tatacaagggtgagaaaggaggctc

SEQ ID NO: 465861 - DNA, 25 bp, Mus musculus
tatacaagtcgtcggcagaagtctg

SEQ ID NO: 465862 - DNA, 25 bp, Mus musculus
tatacaagtgttgagagcacgtgca

SEQ ID NO: 465863 - DNA, 25 bp, Mus musculus
tatacaatagtgaccttcagcggtg

SEQ ID NO: 465864 - DNA, 25 bp, Mus musculus
tatacaatgctctcatccaggaagg

SEQ ID NO: 465865 - DNA, 25 bp, Mus musculus
tatacaatggcataatgaagcctgg

SEQ ID NO: 465866 - DNA, 25 bp, Mus musculus
tatacaatgtggaatgaataaatca

SEQ ID NO: 465867 - DNA, 25 bp, Mus musculus
tatacaatttccatgcatatgccac

SEQ ID NO: 465868 - DNA, 25 bp, Mus musculus
tatacacacatggtctgcagaacag

SEQ ID NO: 465869 - DNA, 25 bp, Mus musculus
tatacacagcaagtctctctggagt

SEQ ID NO: 465870 - DNA, 25 bp, Mus musculus
tatacacagctcaggtaggcactcc

SEQ ID NO: 465871 - DNA, 25 bp, Mus musculus
tatacacatcggcaaagagggccag

SEQ ID NO: 465872 - DNA, 25 bp, Mus musculus
tatacacatggtggtctgggcccag

SEQ ID NO: 465873 - DNA, 25 bp, Mus musculus
tatacacctaggaacagaatgagct

SEQ ID NO: 465874 - DNA, 25 bp, Mus musculus
tatacaccttaaatccaagcatggg

SEQ ID NO: 465875 - DNA, 25 bp, Mus musculus
tatacacgcatcaagctgagcaggc

SEQ ID NO: 465876 - DNA, 25 bp, Mus musculus
tatacactcaacacagattccctgg

SEQ ID NO: 465877 - DNA, 25 bp, Mus musculus
tatacactgttctagaggagccgtc

SEQ ID NO: 465878 - DNA, 25 bp, Mus musculus
tatacagaaaacgaagtcctcagag

SEQ ID NO: 465879 - DNA, 25 bp, Mus musculus
tatacagacagtggcgtgtttttat

SEQ ID NO: 465880 - DNA, 25 bp, Mus musculus
tatacagaggtgactcacagggcgg

SEQ ID NO: 465881 - DNA, 25 bp, Mus musculus
tatacagatcgacctggcactgtgc

SEQ ID NO: 465882 - DNA, 25 bp, Mus musculus
tatacagcaacagggaagggtccaa

SEQ ID NO: 465883 - DNA, 25 bp, Mus musculus
tatacagcagcactgtccaacgggc

SEQ ID NO: 465884 - DNA, 25 bp, Mus musculus
tatacagccaggatacatgatgcaa

SEQ ID NO: 465885 - DNA, 25 bp, Mus musculus
tatacagccagtgtccaaaagtagt

SEQ ID NO: 465886 - DNA, 25 bp, Mus musculus
tatacagccctgtccctgaggatgc

SEQ ID NO: 465887 - DNA, 25 bp, Mus musculus
tatacaggaaactggcaacaggtca

SEQ ID NO: 465888 - DNA, 25 bp, Mus musculus
tatacaggactttgggatggtggtc

SEQ ID NO: 465889 - DNA, 25 bp, Mus musculus
tatacaggaggcactcagtagctgc

SEQ ID NO: 465890 - DNA, 25 bp, Mus musculus
tatacaggatgttaagggagccagc

SEQ ID NO: 465891 - DNA, 25 bp, Mus musculus
tatacaggcaaagtacacatacaat

SEQ ID NO: 465892 - DNA, 25 bp, Mus musculus
tatacaggccagttggaagtcggca

SEQ ID NO: 465893 - DNA, 25 bp, Mus musculus
tatacagggacgtgatcacacgccg

SEQ ID NO: 465894 - DNA, 25 bp, Mus musculus
tatacagggctaatgaatatgcaga

SEQ ID NO: 465895 - DNA, 25 bp, Mus musculus
tatacaggtatttaccgagttcccg

SEQ ID NO: 465896 - DNA, 25 bp, Mus musculus
tatacaggtgacagcaacagcacag

SEQ ID NO: 465897 - DNA, 25 bp, Mus musculus
tatacagtattgtggcaccgcaccc

SEQ ID NO: 465898 - DNA, 25 bp, Mus musculus
tatacagtgaaacaagagccatcct

SEQ ID NO: 465899 - DNA, 25 bp, Mus musculus
tatacagtggaagagtgcacctgtg

SEQ ID NO: 465900 - DNA, 25 bp, Mus musculus
tatacagtggctccaagacttgccc

SEQ ID NO: 465901 - DNA, 25 bp, Mus musculus
tatacatacgacaaactcctctggc

SEQ ID NO: 465902 - DNA, 25 bp, Mus musculus
tatacatcatcaagggctactggcc

SEQ ID NO: 465903 - DNA, 25 bp, Mus musculus
tatacatccccatggctatgcaggc

SEQ ID NO: 465904 - DNA, 25 bp, Mus musculus
tatacatgaggagatggctgtccac

SEQ ID NO: 465905 - DNA, 25 bp, Mus musculus
tatacatggacaaacagcctggaag

SEQ ID NO: 465906 - DNA, 25 bp, Mus musculus
tataccaaataccagatccgagagc

SEQ ID NO: 465907 - DNA, 25 bp, Mus musculus
tataccacagaggaatagccagctg

SEQ ID NO: 465908 - DNA, 25 bp, Mus musculus
tataccacagattccaaaggctggc

SEQ ID NO: 465909 - DNA, 25 bp, Mus musculus
tataccacggaggtgtttgcccctg

SEQ ID NO: 465910 - DNA, 25 bp, Mus musculus
tataccactggcaaaatggctgccc

SEQ ID NO: 465911 - DNA, 25 bp, Mus musculus
tataccacttcacaagtcggaggct

SEQ ID NO: 465912 - DNA, 25 bp, Mus musculus
tataccagagtcacgtaggaccaca

SEQ ID NO: 465913 - DNA, 25 bp, Mus musculus
tataccagatgaaagccaaccttag

SEQ ID NO: 465914 - DNA, 25 bp, Mus musculus
tataccagctcactggcagctgtga

SEQ ID NO: 465915 - DNA, 25 bp, Mus musculus
tataccagctcagaatattgcagtg

SEQ ID NO: 465916 - DNA, 25 bp, Mus musculus
tataccataaagaggaggccccagc

SEQ ID NO: 465917 - DNA, 25 bp, Mus musculus
tataccatctgccagagtgccgggc

SEQ ID NO: 465918 - DNA, 25 bp, Mus musculus
tataccatgacatcttcagggcggc

SEQ ID NO: 465919 - DNA, 25 bp, Mus musculus
tataccatggagctgtgttgcctca

SEQ ID NO: 465920 - DNA, 25 bp, Mus musculus
tatacccacgagcaacacttggagg

SEQ ID NO: 465921 - DNA, 25 bp, Mus musculus
tatacccagggatacttaggattcc

SEQ ID NO: 465922 - DNA, 25 bp, Mus musculus
tatacccagggtcaggcggtcttaa

SEQ ID NO: 465923 - DNA, 25 bp, Mus musculus
tatacccagtgctcctatgaaggcc

SEQ ID NO: 465924 - DNA, 25 bp, Mus musculus
tatacccatgtaagaggaccagtct

SEQ ID NO: 465925 - DNA, 25 bp, Mus musculus
tataccccgcaaggctttgtagccg

SEQ ID NO: 465926 - DNA, 25 bp, Mus musculus
tataccctaggcacggtgatcctgc

SEQ ID NO: 465927 - DNA, 25 bp, Mus musculus
tatacccttgtcttttatactaacg

SEQ ID NO: 465928 - DNA, 25 bp, Mus musculus
tataccgaggtgaccagattctgag

SEQ ID NO: 465929 - DNA, 25 bp, Mus musculus
tataccgccaaaccacagaagtgtc

SEQ ID NO: 465930 - DNA, 25 bp, Mus musculus
tataccgctttgtgtgcgacctgca

SEQ ID NO: 465931 - DNA, 25 bp, Mus musculus
tataccgtgaggaagaagggcccat

SEQ ID NO: 465932 - DNA, 25 bp, Mus musculus
tataccgtggaggtgagcatcaacg

SEQ ID NO: 465933 - DNA, 25 bp, Mus musculus
tataccgtggtggagatgaacacag

SEQ ID NO: 465934 - DNA, 25 bp, Mus musculus
tatacctaccttctgggtgaccggg

SEQ ID NO: 465935 - DNA, 25 bp, Mus musculus
tatacctatgggagcgaggaacagc

SEQ ID NO: 465936 - DNA, 25 bp, Mus musculus
tatacctattggagtgccacacaga

SEQ ID NO: 465937 - DNA, 25 bp, Mus musculus
tatacctcacggagccattggtgcg

SEQ ID NO: 465938 - DNA, 25 bp, Mus musculus
tatacctccggagcatggaaagcga

SEQ ID NO: 465939 - DNA, 25 bp, Mus musculus
tatacctcggatatggatctgtagc

SEQ ID NO: 465940 - DNA, 25 bp, Mus musculus
tatacctgacatggtggtcgaggcc

SEQ ID NO: 465941 - DNA, 25 bp, Mus musculus
tatacctgccttgctgagaactcgc

SEQ ID NO: 465942 - DNA, 25 bp, Mus musculus
tatacctgcgaccagtacggcaaca

SEQ ID NO: 465943 - DNA, 25 bp, Mus musculus
tataccttcccgtcacagcaggagg

SEQ ID NO: 465944 - DNA, 25 bp, Mus musculus
tatacgacatggatggacatcatgg

SEQ ID NO: 465945 - DNA, 25 bp, Mus musculus
tatacgacctgcagacgtggatggg

SEQ ID NO: 465946 - DNA, 25 bp, Mus musculus
tatacgataggaatacaagggcccg

SEQ ID NO: 465947 - DNA, 25 bp, Mus musculus
tatacgatagtgagggagacaagtc

SEQ ID NO: 465948 - DNA, 25 bp, Mus musculus
tatacgctccgtgaatttttaaagc

SEQ ID NO: 465949 - DNA, 25 bp, Mus musculus
tatacggaatgatctgtgtggtccc

SEQ ID NO: 465950 - DNA, 25 bp, Mus musculus
tatacggagtgaaggaacccagagg

SEQ ID NO: 465951 - DNA, 25 bp, Mus musculus
tatacggagttgttgcctagcagaa

SEQ ID NO: 465952 - DNA, 25 bp, Mus musculus
tatacggccacggagaaattcccca

SEQ ID NO: 465953 - DNA, 25 bp, Mus musculus
tatacgggctcccacaaagaacgct

SEQ ID NO: 465954 - DNA, 25 bp, Mus musculus
tatacggtcttcagggtcaacatgt

SEQ ID NO: 465955 - DNA, 25 bp, Mus musculus
tatacgtacctaggagctgtgagct

SEQ ID NO: 465956 - DNA, 25 bp, Mus musculus
tatacgtcattgaggaagaggcagc

SEQ ID NO: 465957 - DNA, 25 bp, Mus musculus
tatacgtctgaacagatctttggag

SEQ ID NO: 465958 - DNA, 25 bp, Mus musculus
tatacgtctggacggtggcctcgac

SEQ ID NO: 465959 - DNA, 25 bp, Mus musculus
tatacgtgtgacagctgagccaggc

SEQ ID NO: 465960 - DNA, 25 bp, Mus musculus
tatacgttagctctagcccatgccg

SEQ ID NO: 465961 - DNA, 25 bp, Mus musculus
tatactagaaaaatgagccgggtgg

SEQ ID NO: 465962 - DNA, 25 bp, Mus musculus
tatactagccactgggacactctgt

SEQ ID NO: 465963 - DNA, 25 bp, Mus musculus
tatactagggtgaaagctgtgtccc

SEQ ID NO: 465964 - DNA, 25 bp, Mus musculus
tatactatgatacgaagcccggtct

SEQ ID NO: 465965 - DNA, 25 bp, Mus musculus
tatactatgcgagccttccacgagg

SEQ ID NO: 465966 - DNA, 25 bp, Mus musculus
tatactcagagcaacggaaaggagc

SEQ ID NO: 465967 - DNA, 25 bp, Mus musculus
tatactcaggctcctcacaagacgg

SEQ ID NO: 465968 - DNA, 25 bp, Mus musculus
tatactccaggcagttacagatgtg

SEQ ID NO: 465969 - DNA, 25 bp, Mus musculus
tatactcttaaatcctaagcgcagg

SEQ ID NO: 465970 - DNA, 25 bp, Mus musculus
tatactctttcgaaggacaacagcc

SEQ ID NO: 465971 - DNA, 25 bp, Mus musculus
tatactgaatccaaagaagtcaatg

SEQ ID NO: 465972 - DNA, 25 bp, Mus musculus
tatactgacgttgtgaggatccctg

SEQ ID NO: 465973 - DNA, 25 bp, Mus musculus
tatactgcacaccttctgatgggct

SEQ ID NO: 465974 - DNA, 25 bp, Mus musculus
tatactgcaccatctctgcggctgg

SEQ ID NO: 465975 - DNA, 25 bp, Mus musculus
tatactgcagtccaactcaaggccc

SEQ ID NO: 465976 - DNA, 25 bp, Mus musculus
tatactgccctggtagagcctcatg

SEQ ID NO: 465977 - DNA, 25 bp, Mus musculus
tatactgcctgagggagagcctggc

SEQ ID NO: 465978 - DNA, 25 bp, Mus musculus
tatactggcagaagctttcaccaag

SEQ ID NO: 465979 - DNA, 25 bp, Mus musculus
tatactggctggtgttacgtgtcaa

SEQ ID NO: 465980 - DNA, 25 bp, Mus musculus
tatactgggcaacagatgggactca

SEQ ID NO: 465981 - DNA, 25 bp, Mus musculus
tatactggtgacctgatgggcagcc

SEQ ID NO: 465982 - DNA, 25 bp, Mus musculus
tatactgtagctgatgcctgttcct

SEQ ID NO: 465983 - DNA, 25 bp, Mus musculus
tatactgtagtatccacaaaaggat

SEQ ID NO: 465984 - DNA, 25 bp, Mus musculus
tatactgtgatcctaatcatgggca

SEQ ID NO: 465985 - DNA, 25 bp, Mus musculus
tatactgtttctaggctcatccatc

SEQ ID NO: 465986 - DNA, 25 bp, Mus musculus
tatacttaaactgttgaaatgtggc

SEQ ID NO: 465987 - DNA, 25 bp, Mus musculus
tatacttaagaagcatgcagccgag

SEQ ID NO: 465988 - DNA, 25 bp, Mus musculus
tatacttaaggactgccccgttgga

SEQ ID NO: 465989 - DNA, 25 bp, Mus musculus
tatacttcagaaccgttggagtcca

SEQ ID NO: 465990 - DNA, 25 bp, Mus musculus
tatacttcagacttacctcggatcg

SEQ ID NO: 465991 - DNA, 25 bp, Mus musculus
tatacttcattgctccttcaggaca

SEQ ID NO: 465992 - DNA, 25 bp, Mus musculus
tatacttgaaggtgcagtctgcagg

SEQ ID NO: 465993 - DNA, 25 bp, Mus musculus
tatactttaagtgcctgaaaggtgg

SEQ ID NO: 465994 - DNA, 25 bp, Mus musculus
tatactttatctcgagcccagacgg

SEQ ID NO: 465995 - DNA, 25 bp, Mus musculus
tatactttcttatccactctgatgc

SEQ ID NO: 465996 - DNA, 25 bp, Mus musculus
tatacttttccatggccgaggtgca

SEQ ID NO: 465997 - DNA, 25 bp, Mus musculus
tatagaaaagccaattactgtactg

SEQ ID NO: 465998 - DNA, 25 bp, Mus musculus
tatagaaagagcaggcgcactaaga

SEQ ID NO: 465999 - DNA, 25 bp, Mus musculus
tatagaaaggcaagatgacagctct

SEQ ID NO: 466000 - DNA, 25 bp, Mus musculus
tatagaaagtctctaggccaaacct

SEQ ID NO: 466001 - DNA, 25 bp, Mus musculus
tatagaaatgctgcacacggtcact

SEQ ID NO: 466002 - DNA, 25 bp, Mus musculus
tatagaaccgaagcatcttaggccc

SEQ ID NO: 466003 - DNA, 25 bp, Mus musculus
tatagaaccggacattgtgaagccc

SEQ ID NO: 466004 - DNA, 25 bp, Mus musculus
tatagaacgtgtgacctctactcac

SEQ ID NO: 466005 - DNA, 25 bp, Mus musculus
tatagaactgaacgtcagcgggctc

SEQ ID NO: 466006 - DNA, 25 bp, Mus musculus
tatagaacttatagaatgcaggccc

SEQ ID NO: 466007 - DNA, 25 bp, Mus musculus
tatagaagccaagttgtagcggcta

SEQ ID NO: 466008 - DNA, 25 bp, Mus musculus
tatagaagctgcgaaaaagcaccgt

SEQ ID NO: 466009 - DNA, 25 bp, Mus musculus
tatagaatccgatgaatcccatggg

SEQ ID NO: 466010 - DNA, 25 bp, Mus musculus
tatagaatctctctgggccctgctg

SEQ ID NO: 466011 - DNA, 25 bp, Mus musculus
tatagacaagatcgatgtgtgcccc

SEQ ID NO: 466012 - DNA, 25 bp, Mus musculus
tatagacaaggcagtgcaagcagcc

SEQ ID NO: 466013 - DNA, 25 bp, Mus musculus
tatagacagaatcagcaccagtgct

SEQ ID NO: 466014 - DNA, 25 bp, Mus musculus
tatagaccaaacctgagtccgccag

SEQ ID NO: 466015 - DNA, 25 bp, Mus musculus
tatagaccacatcatgggccacggt

SEQ ID NO: 466016 - DNA, 25 bp, Mus musculus
tatagacccgacgagtccgttaacg

SEQ ID NO: 466017 - DNA, 25 bp, Mus musculus
tatagaccggaagccaccgtaggag

SEQ ID NO: 466018 - DNA, 25 bp, Mus musculus
tatagacctgaagtccatcctggga

SEQ ID NO: 466019 - DNA, 25 bp, Mus musculus
tatagacctgggtgtgaattccacc

SEQ ID NO: 466020 - DNA, 25 bp, Mus musculus
tatagacctgtatgctgagtgtgcc

SEQ ID NO: 466021 - DNA, 25 bp, Mus musculus
tatagacgagacagtgcctcagtgg

SEQ ID NO: 466022 - DNA, 25 bp, Mus musculus
tatagacgcgcgacgtgatcagttc

SEQ ID NO: 466023 - DNA, 25 bp, Mus musculus
tatagacgctcacgaatgcaggagt

SEQ ID NO: 466024 - DNA, 25 bp, Mus musculus
tatagacgctgacttggaacctgtg

SEQ ID NO: 466025 - DNA, 25 bp, Mus musculus
tatagacggctatccggaccaggct

SEQ ID NO: 466026 - DNA, 25 bp, Mus musculus
tatagactcctgtgcccaatcctgg

SEQ ID NO: 466027 - DNA, 25 bp, Mus musculus
tatagactcttccaagttgaaactg

SEQ ID NO: 466028 - DNA, 25 bp, Mus musculus
tatagactggattacctagctgccc

SEQ ID NO: 466029 - DNA, 25 bp, Mus musculus
tatagagacccttactagggttcca

SEQ ID NO: 466030 - DNA, 25 bp, Mus musculus
tatagagaggaagaagcactcacgg

SEQ ID NO: 466031 - DNA, 25 bp, Mus musculus
tatagagaggcagttccacaaggcc

SEQ ID NO: 466032 - DNA, 25 bp, Mus musculus
tatagagatagccaagtacacagta

SEQ ID NO: 466033 - DNA, 25 bp, Mus musculus
tatagagcaaggtactgtcacaaga

SEQ ID NO: 466034 - DNA, 25 bp, Mus musculus
tatagagcagcaccagaaaggaacc

SEQ ID NO: 466035 - DNA, 25 bp, Mus musculus
tatagaggaaagaactaagagcacc

SEQ ID NO: 466036 - DNA, 25 bp, Mus musculus
tatagaggcagcgtagacgacttac

SEQ ID NO: 466037 - DNA, 25 bp, Mus musculus
tatagaggccgctgtgaaccacaaa

SEQ ID NO: 466038 - DNA, 25 bp, Mus musculus
tatagaggccgttgccgtggagatc

SEQ ID NO: 466039 - DNA, 25 bp, Mus musculus
tatagagggcactgcttccggatca

SEQ ID NO: 466040 - DNA, 25 bp, Mus musculus
tatagaggtctctgctcagcaaccg

SEQ ID NO: 466041 - DNA, 25 bp, Mus musculus
tatagagtttccagtcccctgcgtg

SEQ ID NO: 466042 - DNA, 25 bp, Mus musculus
tatagagtttgtggctgaccctgca

SEQ ID NO: 466043 - DNA, 25 bp, Mus musculus
tatagagtttttccttcacatggct

SEQ ID NO: 466044 - DNA, 25 bp, Mus musculus
tatagataccgatgaagacttctga

SEQ ID NO: 466045 - DNA, 25 bp, Mus musculus
tatagatacggaaaccacacaggtg

SEQ ID NO: 466046 - DNA, 25 bp, Mus musculus
tatagatagtcagtgcccgatggtg

SEQ ID NO: 466047 - DNA, 25 bp, Mus musculus
tatagatcaaagaaaggcagatgtc

SEQ ID NO: 466048 - DNA, 25 bp, Mus musculus
tatagatcacatcaaactcctggcc

SEQ ID NO: 466049 - DNA, 25 bp, Mus musculus
tatagatctgtgaagtgtgaagttc

SEQ ID NO: 466050 - DNA, 25 bp, Mus musculus
tatagatgaagataccaggctccca

SEQ ID NO: 466051 - DNA, 25 bp, Mus musculus
tatagatgacgatgtcagcagcggc

SEQ ID NO: 466052 - DNA, 25 bp, Mus musculus
tatagatgactgttccagaccctcc

SEQ ID NO: 466053 - DNA, 25 bp, Mus musculus
tatagatgaggaatgtggaaacgct

SEQ ID NO: 466054 - DNA, 25 bp, Mus musculus
tatagatgagtgttcggacgcaagg

SEQ ID NO: 466055 - DNA, 25 bp, Mus musculus
tatagatgccggtgctccagagaac

SEQ ID NO: 466056 - DNA, 25 bp, Mus musculus
tatagattagcggagctcagcaagt

SEQ ID NO: 466057 - DNA, 25 bp, Mus musculus
tatagattcctgaccaaaggccagc

SEQ ID NO: 466058 - DNA, 25 bp, Mus musculus
tatagattggcccaggaaggctcac

SEQ ID NO: 466059 - DNA, 25 bp, Mus musculus
tatagatttcacctccccaaggatg

SEQ ID NO: 466060 - DNA, 25 bp, Mus musculus
tatagcaaaggtgtatcgccgggac

SEQ ID NO: 466061 - DNA, 25 bp, Mus musculus
tatagcaaatcaggctccagggaat

SEQ ID NO: 466062 - DNA, 25 bp, Mus musculus
tatagcaacgctgacgtgaaccggc

SEQ ID NO: 466063 - DNA, 25 bp, Mus musculus
tatagcacccaagataaaagagcgg

SEQ ID NO: 466064 - DNA, 25 bp, Mus musculus
tatagcagagaactcggtgctgttc

SEQ ID NO: 466065 - DNA, 25 bp, Mus musculus
tatagcagcggccattctggtgaca

SEQ ID NO: 466066 - DNA, 25 bp, Mus musculus
tatagcatgttgaagaagcctgcct

SEQ ID NO: 466067 - DNA, 25 bp, Mus musculus
tatagccaacggcaccagttcaggg

SEQ ID NO: 466068 - DNA, 25 bp, Mus musculus
tatagccacaggtacatgcacaggc

SEQ ID NO: 466069 - DNA, 25 bp, Mus musculus
tatagccactagcaaagggagagca

SEQ ID NO: 466070 - DNA, 25 bp, Mus musculus
tatagccagcctcctcattgaaggg

SEQ ID NO: 466071 - DNA, 25 bp, Mus musculus
tatagccatttttgtatctgcaccc

SEQ ID NO: 466072 - DNA, 25 bp, Mus musculus
tatagcccagaggtacaggataagc

SEQ ID NO: 466073 - DNA, 25 bp, Mus musculus
tatagccccatgactcccagatgtt

SEQ ID NO: 466074 - DNA, 25 bp, Mus musculus
tatagcccgagcagcctgatatgga

SEQ ID NO: 466075 - DNA, 25 bp, Mus musculus
tatagccggctggtaaacgacacat

SEQ ID NO: 466076 - DNA, 25 bp, Mus musculus
tatagccgggtcttaaagcgccatg

SEQ ID NO: 466077 - DNA, 25 bp, Mus musculus
tatagcctcctcacagggatttggc

SEQ ID NO: 466078 - DNA, 25 bp, Mus musculus
tatagcctggccatgaaccaactgg

SEQ ID NO: 466079 - DNA, 25 bp, Mus musculus
tatagcctgtaatggtcccatagcc

SEQ ID NO: 466080 - DNA, 25 bp, Mus musculus
tatagccttggataggtaccgcgcc

SEQ ID NO: 466081 - DNA, 25 bp, Mus musculus
tatagcgtgcatctgtgtatctgca

SEQ ID NO: 466082 - DNA, 25 bp, Mus musculus
tatagctcactataggatccatggc

SEQ ID NO: 466083 - DNA, 25 bp, Mus musculus
tatagctcaggaggcttcagcggtg

SEQ ID NO: 466084 - DNA, 25 bp, Mus musculus
tatagctcagtttagagagaggaca

SEQ ID NO: 466085 - DNA, 25 bp, Mus musculus
tatagctctcttctctcagtgaaac

SEQ ID NO: 466086 - DNA, 25 bp, Mus musculus
tatagctcttcaagcagtcgaggcc

SEQ ID NO: 466087 - DNA, 25 bp, Mus musculus
tatagctgcaattctggctcgcacc

SEQ ID NO: 466088 - DNA, 25 bp, Mus musculus
tatagctgcgtgaaagagatggcct

SEQ ID NO: 466089 - DNA, 25 bp, Mus musculus
tatagctgctatctatcctgtgccc

SEQ ID NO: 466090 - DNA, 25 bp, Mus musculus
tatagctgctattggacctgagagc

SEQ ID NO: 466091 - DNA, 25 bp, Mus musculus
tatagctggctgacaccattgggca

SEQ ID NO: 466092 - DNA, 25 bp, Mus musculus
tatagctgggtcagtgttaggtctc

SEQ ID NO: 466093 - DNA, 25 bp, Mus musculus
tatagctgtagaccggtacctagcc

SEQ ID NO: 466094 - DNA, 25 bp, Mus musculus
tatagcttcttgtgcgcatctgagg

SEQ ID NO: 466095 - DNA, 25 bp, Mus musculus
tatagcttggatatgagcagcctgc

SEQ ID NO: 466096 - DNA, 25 bp, Mus musculus
tataggaactctgcatcacagctgc

SEQ ID NO: 466097 - DNA, 25 bp, Mus musculus
tataggaactgccaaatgtgccagg

SEQ ID NO: 466098 - DNA, 25 bp, Mus musculus
tataggaagtttcacgcaagccagg

SEQ ID NO: 466099 - DNA, 25 bp, Mus musculus
tataggacccattcgcctgaagagg

SEQ ID NO: 466100 - DNA, 25 bp, Mus musculus
tataggacgcgtgtctcccatggag

SEQ ID NO: 466101 - DNA, 25 bp, Mus musculus
tataggactgcatctaacaggtaaa

SEQ ID NO: 466102 - DNA, 25 bp, Mus musculus
tataggactgcccatactgagagca

SEQ ID NO: 466103 - DNA, 25 bp, Mus musculus
tataggaggctctctggtacagagc

SEQ ID NO: 466104 - DNA, 25 bp, Mus musculus
tataggagttaagagcaagcggagc

SEQ ID NO: 466105 - DNA, 25 bp, Mus musculus
tataggataacaactttccatgtgg

SEQ ID NO: 466106 - DNA, 25 bp, Mus musculus
tataggcaaacggtaaagaggtcac

SEQ ID NO: 466107 - DNA, 25 bp, Mus musculus
tataggcagtggaccaggcgatgct

SEQ ID NO: 466108 - DNA, 25 bp, Mus musculus
tataggccacttgcttacaggaacc

SEQ ID NO: 466109 - DNA, 25 bp, Mus musculus
tataggcgacctgtgcaaccaacag

SEQ ID NO: 466110 - DNA, 25 bp, Mus musculus
tataggctgaaactgtgtggccacc

SEQ ID NO: 466111 - DNA, 25 bp, Mus musculus
tataggctggacctagggccactgc

SEQ ID NO: 466112 - DNA, 25 bp, Mus musculus
tataggctgggattctcaagaggac

SEQ ID NO: 466113 - DNA, 25 bp, Mus musculus
tataggcttagtggttccatggact

SEQ ID NO: 466114 - DNA, 25 bp, Mus musculus
tataggcttatagcaccagacctgg

SEQ ID NO: 466115 - DNA, 25 bp, Mus musculus
tatagggcaggatagaatgcatgtc

SEQ ID NO: 466116 - DNA, 25 bp, Mus musculus
tatagggctacatcttggtaactgc

SEQ ID NO: 466117 - DNA, 25 bp, Mus musculus
tatagggctccgaattgctttggcc

SEQ ID NO: 466118 - DNA, 25 bp, Mus musculus
tatagggtcaagtacaccagccacc

SEQ ID NO: 466119 - DNA, 25 bp, Mus musculus
tatagggtcagcacttccagcctgg

SEQ ID NO: 466120 - DNA, 25 bp, Mus musculus
tatagggtcccctctctgataccta

SEQ ID NO: 466121 - DNA, 25 bp, Mus musculus
tatagggtggttctagttccccagg

SEQ ID NO: 466122 - DNA, 25 bp, Mus musculus
tataggtgagcaagtcttggcttgg

SEQ ID NO: 466123 - DNA, 25 bp, Mus musculus
tataggtgatctcctctcgagcagc

SEQ ID NO: 466124 - DNA, 25 bp, Mus musculus
tataggtgcatggacagcaactcgc

SEQ ID NO: 466125 - DNA, 25 bp, Mus musculus
tataggtgctttgctgcttacttaa

SEQ ID NO: 466126 - DNA, 25 bp, Mus musculus
tataggttctagacaacgccctacc

SEQ ID NO: 466127 - DNA, 25 bp, Mus musculus
tataggtttcatccccagctctgca

SEQ ID NO: 466128 - DNA, 25 bp, Mus musculus
tatagtaacaagcaagatccccgag

SEQ ID NO: 466129 - DNA, 25 bp, Mus musculus
tatagtaaccagatgagcaccacca

SEQ ID NO: 466130 - DNA, 25 bp, Mus musculus
tatagtaagactgcaactggctcct

SEQ ID NO: 466131 - DNA, 25 bp, Mus musculus
tatagtaagagtctagaaccttggg

SEQ ID NO: 466132 - DNA, 25 bp, Mus musculus
tatagtacaatagaaaagggctggc

SEQ ID NO: 466133 - DNA, 25 bp, Mus musculus
tatagtacccagaagaacaccggca

SEQ ID NO: 466134 - DNA, 25 bp, Mus musculus
tatagtagagggtttccattgcacc

SEQ ID NO: 466135 - DNA, 25 bp, Mus musculus
tatagtcaataaatgacacgtcgct

SEQ ID NO: 466136 - DNA, 25 bp, Mus musculus
tatagtccaaggtgaagattcggtg

SEQ ID NO: 466137 - DNA, 25 bp, Mus musculus
tatagtccagcccatacagaggaag

SEQ ID NO: 466138 - DNA, 25 bp, Mus musculus
tatagtccatggataatgcacctct

SEQ ID NO: 466139 - DNA, 25 bp, Mus musculus
tatagtcctgaaggccacgtggcca

SEQ ID NO: 466140 - DNA, 25 bp, Mus musculus
tatagtcctgatgagcacttctggg

SEQ ID NO: 466141 - DNA, 25 bp, Mus musculus
tatagtcgagccaagcagacactcc

SEQ ID NO: 466142 - DNA, 25 bp, Mus musculus
tatagtcgataagctgaaggaggct

SEQ ID NO: 466143 - DNA, 25 bp, Mus musculus
tatagtctcaagacccgagagggca

SEQ ID NO: 466144 - DNA, 25 bp, Mus musculus
tatagtctcactagggatggcctgg

SEQ ID NO: 466145 - DNA, 25 bp, Mus musculus
tatagtctttaaccaccttgagcaa

SEQ ID NO: 466146 - DNA, 25 bp, Mus musculus
tatagtgaaaaaagaaatgcctggc

SEQ ID NO: 466147 - DNA, 25 bp, Mus musculus
tatagtgataaactgaggccctgcc

SEQ ID NO: 466148 - DNA, 25 bp, Mus musculus
tatagtgatccagcgccaaagtgcc

SEQ ID NO: 466149 - DNA, 25 bp, Mus musculus
tatagtgcaacactcgcctggctgg

SEQ ID NO: 466150 - DNA, 25 bp, Mus musculus
tatagtgccaataaactcaggagga

SEQ ID NO: 466151 - DNA, 25 bp, Mus musculus
tatagtgctcatgtttcgataccca

SEQ ID NO: 466152 - DNA, 25 bp, Mus musculus
tatagtggcacaagtcagaatgctc

SEQ ID NO: 466153 - DNA, 25 bp, Mus musculus
tatagtggccgtgccatgtgcatcc

SEQ ID NO: 466154 - DNA, 25 bp, Mus musculus
tatagtggctatgctctgtggtcta

SEQ ID NO: 466155 - DNA, 25 bp, Mus musculus
tatagtggtcatcgcctagagtcag

SEQ ID NO: 466156 - DNA, 25 bp, Mus musculus
tatagtggtgtgctggaattccctg

SEQ ID NO: 466157 - DNA, 25 bp, Mus musculus
tatagtgtccaggaagaggcccagt

SEQ ID NO: 466158 - DNA, 25 bp, Mus musculus
tatagtgtggaatggtgctacagcc

SEQ ID NO: 466159 - DNA, 25 bp, Mus musculus
tatagtgttgagcatgaaaagcctc

SEQ ID NO: 466160 - DNA, 25 bp, Mus musculus
tatagttcaccgtgggtctgggagc

SEQ ID NO: 466161 - DNA, 25 bp, Mus musculus
tatagttgcaagtgcctggagggcc

SEQ ID NO: 466162 - DNA, 25 bp, Mus musculus
tatagttggtgctggtctttcaggc

SEQ ID NO: 466163 - DNA, 25 bp, Mus musculus
tatataaagacagaggacaccacgg

SEQ ID NO: 466164 - DNA, 25 bp, Mus musculus
tatataacaggcaatctctctgctc

SEQ ID NO: 466165 - DNA, 25 bp, Mus musculus
tatataaccttagctggcctacaac

SEQ ID NO: 466166 - DNA, 25 bp, Mus musculus
tatataagcacaaactagagccggc

SEQ ID NO: 466167 - DNA, 25 bp, Mus musculus
tatataaggaccaagacaaagcccc

SEQ ID NO: 466168 - DNA, 25 bp, Mus musculus
tatataaggagaggactaccaccgt

SEQ ID NO: 466169 - DNA, 25 bp, Mus musculus
tatataatacgaagaactcccagcc

SEQ ID NO: 466170 - DNA, 25 bp, Mus musculus
tatataatagattgagcctgtttcc

SEQ ID NO: 466171 - DNA, 25 bp, Mus musculus
tatataatgaagaagttcgagacct

SEQ ID NO: 466172 - DNA, 25 bp, Mus musculus
tatataatgagcagagcccggtggc

SEQ ID NO: 466173 - DNA, 25 bp, Mus musculus
tatatacaatgaggactggattcag

SEQ ID NO: 466174 - DNA, 25 bp, Mus musculus
tatatacacactgacacggcctctg

SEQ ID NO: 466175 - DNA, 25 bp, Mus musculus
tatatacagctctacgtggcctgct

SEQ ID NO: 466176 - DNA, 25 bp, Mus musculus
tatatacctcagatccacatgggac

SEQ ID NO: 466177 - DNA, 25 bp, Mus musculus
tatatacgccatggaaattaatgtg

SEQ ID NO: 466178 - DNA, 25 bp, Mus musculus
tatatactgagtacctgtcacatgc

SEQ ID NO: 466179 - DNA, 25 bp, Mus musculus
tatatagagaagctaccctgatggg

SEQ ID NO: 466180 - DNA, 25 bp, Mus musculus
tatatagagtctgcaggtgcacgag

SEQ ID NO: 466181 - DNA, 25 bp, Mus musculus
tatatagcacgcgtgggagcatcgg

SEQ ID NO: 466182 - DNA, 25 bp, Mus musculus
tatatagcctggcacagagggcaca

SEQ ID NO: 466183 - DNA, 25 bp, Mus musculus
tatatagctgagtccttggtgtgcg

SEQ ID NO: 466184 - DNA, 25 bp, Mus musculus
tatatagggcaaactcaggcctctg

SEQ ID NO: 466185 - DNA, 25 bp, Mus musculus
tatatagtaggcagaatggcagcca

SEQ ID NO: 466186 - DNA, 25 bp, Mus musculus
tatatatacacaaattagctgcacg

SEQ ID NO: 466187 - DNA, 25 bp, Mus musculus
tatatatgagatgctcgtcggcgag

SEQ ID NO: 466188 - DNA, 25 bp, Mus musculus
tatatatgccttcttcaaccgggac

SEQ ID NO: 466189 - DNA, 25 bp, Mus musculus
tatatatggcccaagaacattttcc

SEQ ID NO: 466190 - DNA, 25 bp, Mus musculus
tatatatggtaagtttgactcacag

SEQ ID NO: 466191 - DNA, 25 bp, Mus musculus
tatatatgtacacgtatgtacacca

SEQ ID NO: 466192 - DNA, 25 bp, Mus musculus
tatatatgtcttgagctagcaccca

SEQ ID NO: 466193 - DNA, 25 bp, Mus musculus
tatatatgttcacttcccgccgagg

SEQ ID NO: 466194 - DNA, 25 bp, Mus musculus
tatatatttttcttgctgtacgacg

SEQ ID NO: 466195 - DNA, 25 bp, Mus musculus
tatatcaaagaacagaagctgggcc

SEQ ID NO: 466196 - DNA, 25 bp, Mus musculus
tatatcaaccttggagattggccct

SEQ ID NO: 466197 - DNA, 25 bp, Mus musculus
tatatcaactgatccttaaccaagg

SEQ ID NO: 466198 - DNA, 25 bp, Mus musculus
tatatcaccgataacagcttggacc

SEQ ID NO: 466199 - DNA, 25 bp, Mus musculus
tatatcatctataactagggagaca

SEQ ID NO: 466200 - DNA, 25 bp, Mus musculus
tatatcatggaagggcttgcgtcca

SEQ ID NO: 466201 - DNA, 25 bp, Mus musculus
tatatcattggccatcctgagggag

SEQ ID NO: 466202 - DNA, 25 bp, Mus musculus
tatatccacccggatgacgagctgg

SEQ ID NO: 466203 - DNA, 25 bp, Mus musculus
tatatccaccgagacttgagggcag

SEQ ID NO: 466204 - DNA, 25 bp, Mus musculus
tatatccacctgaaatctgcacggg

SEQ ID NO: 466205 - DNA, 25 bp, Mus musculus
tatatccatagcaacccagtgatgt

SEQ ID NO: 466206 - DNA, 25 bp, Mus musculus
tatatccatgccctgtacactgtga

SEQ ID NO: 466207 - DNA, 25 bp, Mus musculus
tatatccccatcgatgaggaccggc

SEQ ID NO: 466208 - DNA, 25 bp, Mus musculus
tatatcccgccctgtaagagagaaa

SEQ ID NO: 466209 - DNA, 25 bp, Mus musculus
tatatccctaagattggcaagaagg

SEQ ID NO: 466210 - DNA, 25 bp, Mus musculus
tatatccctgataagaccggacgct

SEQ ID NO: 466211 - DNA, 25 bp, Mus musculus
tatatcctctttcgccggtctgtgc

SEQ ID NO: 466212 - DNA, 25 bp, Mus musculus
tatatcgaagcttgtgctcgccgca

SEQ ID NO: 466213 - DNA, 25 bp, Mus musculus
tatatcgatgaaaaccaggaccgct

SEQ ID NO: 466214 - DNA, 25 bp, Mus musculus
tatatcgcggagtttcaccagacag

SEQ ID NO: 466215 - DNA, 25 bp, Mus musculus
tatatcgctctgcttaaaacccgtg

SEQ ID NO: 466216 - DNA, 25 bp, Mus musculus
tatatcggcggcttcaaaaaggtgg

SEQ ID NO: 466217 - DNA, 25 bp, Mus musculus
tatatcgtatgcagtccaagctagg

SEQ ID NO: 466218 - DNA, 25 bp, Mus musculus
tatatcgtctggaacagctggcacc

SEQ ID NO: 466219 - DNA, 25 bp, Mus musculus
tatatctacgacaaccaaggcatcg

SEQ ID NO: 466220 - DNA, 25 bp, Mus musculus
tatatctacgacaaggacccggaag

SEQ ID NO: 466221 - DNA, 25 bp, Mus musculus
tatatctacgtgaaatcgtggagcc

SEQ ID NO: 466222 - DNA, 25 bp, Mus musculus
tatatctacgttggaccagaggctg

SEQ ID NO: 466223 - DNA, 25 bp, Mus musculus
tatatctactccttgtcctgacagg

SEQ ID NO: 466224 - DNA, 25 bp, Mus musculus
tatatctccagatgctgctaagcca

SEQ ID NO: 466225 - DNA, 25 bp, Mus musculus
tatatctgaagtctagcatgggccc

SEQ ID NO: 466226 - DNA, 25 bp, Mus musculus
tatatctgaatgctggaatcctgcc

SEQ ID NO: 466227 - DNA, 25 bp, Mus musculus
tatatctgacttggaacaccagcca

SEQ ID NO: 466228 - DNA, 25 bp, Mus musculus
tatatctggcagaatcagcctttca

SEQ ID NO: 466229 - DNA, 25 bp, Mus musculus
tatatcttgaatacctgaatatggt

SEQ ID NO: 466230 - DNA, 25 bp, Mus musculus
tatatcttggctaccttttatgcgg

SEQ ID NO: 466231 - DNA, 25 bp, Mus musculus
tatatcttggtggtgcctatggaca

SEQ ID NO: 466232 - DNA, 25 bp, Mus musculus
tatatgaaaaccatggtgggcctcc

SEQ ID NO: 466233 - DNA, 25 bp, Mus musculus
tatatgaaaatgaccgtgcagctcg

SEQ ID NO: 466234 - DNA, 25 bp, Mus musculus
tatatgaagattgccaaagaccagg

SEQ ID NO: 466235 - DNA, 25 bp, Mus musculus
tatatgaagcgctatcgggagccgc

SEQ ID NO: 466236 - DNA, 25 bp, Mus musculus
tatatgaataaagtgccacgaagct

SEQ ID NO: 466237 - DNA, 25 bp, Mus musculus
tatatgacaggcaagaaactccctc

SEQ ID NO: 466238 - DNA, 25 bp, Mus musculus
tatatgagccaatcccacagcaagc

SEQ ID NO: 466239 - DNA, 25 bp, Mus musculus
tatatgagtctgaatctatgctcac

SEQ ID NO: 466240 - DNA, 25 bp, Mus musculus
tatatgagtgctacaattgcccgca

SEQ ID NO: 466241 - DNA, 25 bp, Mus musculus
tatatgataactggatctgcctgga

SEQ ID NO: 466242 - DNA, 25 bp, Mus musculus
tatatgatccaaaagtacccaggga

SEQ ID NO: 466243 - DNA, 25 bp, Mus musculus
tatatgatccaagcgtgagccagtc

SEQ ID NO: 466244 - DNA, 25 bp, Mus musculus
tatatgatttgcaaacgtcttcggg

SEQ ID NO: 466245 - DNA, 25 bp, Mus musculus
tatatgcaaggcgtgagatgggact

SEQ ID NO: 466246 - DNA, 25 bp, Mus musculus
tatatgcacggctccatggttcagg

SEQ ID NO: 466247 - DNA, 25 bp, Mus musculus
tatatgcagctcatgtcggtgcctc

SEQ ID NO: 466248 - DNA, 25 bp, Mus musculus
tatatgcatgctccaaaacgaggac

SEQ ID NO: 466249 - DNA, 25 bp, Mus musculus
tatatgcccggcgtaatctccagag

SEQ ID NO: 466250 - DNA, 25 bp, Mus musculus
tatatgccggccgatatcgtggagc

SEQ ID NO: 466251 - DNA, 25 bp, Mus musculus
tatatgcggtgctactcagcgaggg

SEQ ID NO: 466252 - DNA, 25 bp, Mus musculus
tatatgctaattgcagcatgatggc

SEQ ID NO: 466253 - DNA, 25 bp, Mus musculus
tatatgctagatctgtaccgcaggc

SEQ ID NO: 466254 - DNA, 25 bp, Mus musculus
tatatgctatagctcatggcctgga

SEQ ID NO: 466255 - DNA, 25 bp, Mus musculus
tatatgctggactctgccgtcctgg

SEQ ID NO: 466256 - DNA, 25 bp, Mus musculus
tatatggaaagtcagatggccgcac

SEQ ID NO: 466257 - DNA, 25 bp, Mus musculus
tatatggaccaaagcagagtttccg

SEQ ID NO: 466258 - DNA, 25 bp, Mus musculus
tatatggaccaacttcagatgagag

SEQ ID NO: 466259 - DNA, 25 bp, Mus musculus
tatatggaggacacacacctgcagg

SEQ ID NO: 466260 - DNA, 25 bp, Mus musculus
tatatggccccggaaatcatcgacc

SEQ ID NO: 466261 - DNA, 25 bp, Mus musculus
tatatgggcccgttcagtttctcag

SEQ ID NO: 466262 - DNA, 25 bp, Mus musculus
tatatggtagttcccagcaactggg

SEQ ID NO: 466263 - DNA, 25 bp, Mus musculus
tatatggtgtgttcagcattgccga

SEQ ID NO: 466264 - DNA, 25 bp, Mus musculus
tatatggttcagttagtgcttccca

SEQ ID NO: 466265 - DNA, 25 bp, Mus musculus
tatatgtaaatagggccactggatc

SEQ ID NO: 466266 - DNA, 25 bp, Mus musculus
tatatgtacctaagccccttatggt

SEQ ID NO: 466267 - DNA, 25 bp, Mus musculus
tatatgtagaataagcaggtgttcc

SEQ ID NO: 466268 - DNA, 25 bp, Mus musculus
tatatgtcaccacccacttgagtct

SEQ ID NO: 466269 - DNA, 25 bp, Mus musculus
tatatgtcaccagctttgggcccgt

SEQ ID NO: 466270 - DNA, 25 bp, Mus musculus
tatatgtgcctgtatccagactccc

SEQ ID NO: 466271 - DNA, 25 bp, Mus musculus
tatatgtgtgaatcctcgtgccaaa

SEQ ID NO: 466272 - DNA, 25 bp, Mus musculus
tatattaatctctgcggtgctgcca

SEQ ID NO: 466273 - DNA, 25 bp, Mus musculus
tatattacatgagcatttgaagtgt

SEQ ID NO: 466274 - DNA, 25 bp, Mus musculus
tatattacgccatggagcatctggg

SEQ ID NO: 466275 - DNA, 25 bp, Mus musculus
tatattagtcatttaagagagccag

SEQ ID NO: 466276 - DNA, 25 bp, Mus musculus
tatattatcccatcagactgggagg

SEQ ID NO: 466277 - DNA, 25 bp, Mus musculus
tatattatcgaactgcccatggcct

SEQ ID NO: 466278 - DNA, 25 bp, Mus musculus
tatattcaggagattaaggcagtgg

SEQ ID NO: 466279 - DNA, 25 bp, Mus musculus
tatattcatatctcgctggccagcc

SEQ ID NO: 466280 - DNA, 25 bp, Mus musculus
tatattcatgggtaaggaggcctac

SEQ ID NO: 466281 - DNA, 25 bp, Mus musculus
tatattccaagggaagactgccctg

SEQ ID NO: 466282 - DNA, 25 bp, Mus musculus
tatattccaccagattgtacccgaa

SEQ ID NO: 466283 - DNA, 25 bp, Mus musculus
tatattccagaggtgtgtgcaggac

SEQ ID NO: 466284 - DNA, 25 bp, Mus musculus
tatattccaggagctacaacttgtc

SEQ ID NO: 466285 - DNA, 25 bp, Mus musculus
tatattcccaaaatgcgggacctgc

SEQ ID NO: 466286 - DNA, 25 bp, Mus musculus
tatattcccttgcaagtcctgtggc

SEQ ID NO: 466287 - DNA, 25 bp, Mus musculus
tatattccgctgctgctcatgctgg

SEQ ID NO: 466288 - DNA, 25 bp, Mus musculus
tatattcgggacaagcttttaaagg

SEQ ID NO: 466289 - DNA, 25 bp, Mus musculus
tatattctgctacggaaggctgtcc

SEQ ID NO: 466290 - DNA, 25 bp, Mus musculus
tatattgacaagactcgggtagctg

SEQ ID NO: 466291 - DNA, 25 bp, Mus musculus
tatattgcaagctctgtcgtccctc

SEQ ID NO: 466292 - DNA, 25 bp, Mus musculus
tatattgtcagagactgccaagcag

SEQ ID NO: 466293 - DNA, 25 bp, Mus musculus
tatattgtgacatcgggctaccatg

SEQ ID NO: 466294 - DNA, 25 bp, Mus musculus
tatatttcacccgaaagcctagttg

SEQ ID NO: 466295 - DNA, 25 bp, Mus musculus
tatatttcagtaacaatcctcgccc

SEQ ID NO: 466296 - DNA, 25 bp, Mus musculus
tatatttccagattccacagaggca

SEQ ID NO: 466297 - DNA, 25 bp, Mus musculus
tatatttccccatgggatcgggcca

SEQ ID NO: 466298 - DNA, 25 bp, Mus musculus
tatatttgacacaacccagcagtgc

SEQ ID NO: 466299 - DNA, 25 bp, Mus musculus
tatatttggaactacggcgccatcc

SEQ ID NO: 466300 - DNA, 25 bp, Mus musculus
tatcaaaaaactgctaccacctggc

SEQ ID NO: 466301 - DNA, 25 bp, Mus musculus
tatcaaacccaagggcatccaggtt

SEQ ID NO: 466302 - DNA, 25 bp, Mus musculus
tatcaaactatggaggtgcagaaca

SEQ ID NO: 466303 - DNA, 25 bp, Mus musculus
tatcaaacttgacctggaaatctta

SEQ ID NO: 466304 - DNA, 25 bp, Mus musculus
tatcaaagccgtcatttcccatggg

SEQ ID NO: 466305 - DNA, 25 bp, Mus musculus
tatcaaaggatgctggtccatcggg

SEQ ID NO: 466306 - DNA, 25 bp, Mus musculus
tatcaaaggccgaagccattgaggc

SEQ ID NO: 466307 - DNA, 25 bp, Mus musculus
tatcaaagggcgctacaacctgctt

SEQ ID NO: 466308 - DNA, 25 bp, Mus musculus
tatcaaatcatgtagatggcggcac

SEQ ID NO: 466309 - DNA, 25 bp, Mus musculus
tatcaaatgggacacatgcgacgct

SEQ ID NO: 466310 - DNA, 25 bp, Mus musculus
tatcaaatgtgaaggacgttgccca

SEQ ID NO: 466311 - DNA, 25 bp, Mus musculus
tatcaaattacatctctggccaggc

SEQ ID NO: 466312 - DNA, 25 bp, Mus musculus
tatcaaattctgaccgacgagccct

SEQ ID NO: 466313 - DNA, 25 bp, Mus musculus
tatcaacaaacagtaccggcgcctg

SEQ ID NO: 466314 - DNA, 25 bp, Mus musculus
tatcaacaagctgcagccgggttct

SEQ ID NO: 466315 - DNA, 25 bp, Mus musculus
tatcaacaatccaataacatgcatg

SEQ ID NO: 466316 - DNA, 25 bp, Mus musculus
tatcaacaggtgtaggccagcagca

SEQ ID NO: 466317 - DNA, 25 bp, Mus musculus
tatcaaccatcacgctacagcaggg

SEQ ID NO: 466318 - DNA, 25 bp, Mus musculus
tatcaaccattcgagacactctgga

SEQ ID NO: 466319 - DNA, 25 bp, Mus musculus
tatcaacggcgtcggaggtcaagtc

SEQ ID NO: 466320 - DNA, 25 bp, Mus musculus
tatcaacgtagataaggtcgtggcc

SEQ ID NO: 466321 - DNA, 25 bp, Mus musculus
tatcaacgttccttaagcaccaatg

SEQ ID NO: 466322 - DNA, 25 bp, Mus musculus
tatcaactacgacgacgagagtggg

SEQ ID NO: 466323 - DNA, 25 bp, Mus musculus
tatcaactccaggtttgcgcaggca

SEQ ID NO: 466324 - DNA, 25 bp, Mus musculus
tatcaactggatggctgacagcagc

SEQ ID NO: 466325 - DNA, 25 bp, Mus musculus
tatcaagactgactttagcctacgg

SEQ ID NO: 466326 - DNA, 25 bp, Mus musculus
tatcaagatactgaaaaggaggtca

SEQ ID NO: 466327 - DNA, 25 bp, Mus musculus
tatcaagatcaaaccagaccagtgg

SEQ ID NO: 466328 - DNA, 25 bp, Mus musculus
tatcaagctcaaccgagtgttgggc

SEQ ID NO: 466329 - DNA, 25 bp, Mus musculus
tatcaagctccgaaagatccgggcc

SEQ ID NO: 466330 - DNA, 25 bp, Mus musculus
tatcaaggagatgcctatgtgccgc

SEQ ID NO: 466331 - DNA, 25 bp, Mus musculus
tatcaaggagcaacgtggagagcct

SEQ ID NO: 466332 - DNA, 25 bp, Mus musculus
tatcaaggcacaataccagcagagg

SEQ ID NO: 466333 - DNA, 25 bp, Mus musculus
tatcaagggcatcaagggtactgct

SEQ ID NO: 466334 - DNA, 25 bp, Mus musculus
tatcaagggctggaaacacgatccc

SEQ ID NO: 466335 - DNA, 25 bp, Mus musculus
tatcaaggtgaagctagagggccac

SEQ ID NO: 466336 - DNA, 25 bp, Mus musculus
tatcaaggtgagaaggacagaggcc

SEQ ID NO: 466337 - DNA, 25 bp, Mus musculus
tatcaagtatgtgcatcatcaatcc

SEQ ID NO: 466338 - DNA, 25 bp, Mus musculus
tatcaagtggcttaaagacgggagc

SEQ ID NO: 466339 - DNA, 25 bp, Mus musculus
tatcaatcacatgagagccgtgtcc

SEQ ID NO: 466340 - DNA, 25 bp, Mus musculus
tatcaatcccgatgaggcagtcgcc

SEQ ID NO: 466341 - DNA, 25 bp, Mus musculus
tatcaatcgcatcaccttaccctgt

SEQ ID NO: 466342 - DNA, 25 bp, Mus musculus
tatcaatgctaatggcaatgaccat

SEQ ID NO: 466343 - DNA, 25 bp, Mus musculus
tatcaatggattcggtctgcttgca

SEQ ID NO: 466344 - DNA, 25 bp, Mus musculus
tatcaatggccaatgggaaggcgag

SEQ ID NO: 466345 - DNA, 25 bp, Mus musculus
tatcaattctgcgtagctcggaggc

SEQ ID NO: 466346 - DNA, 25 bp, Mus musculus
tatcaattgcatgggaagatccgta

SEQ ID NO: 466347 - DNA, 25 bp, Mus musculus
tatcacaaaagaaaggactcctagc

SEQ ID NO: 466348 - DNA, 25 bp, Mus musculus
tatcacaaagccctgctattgctgg

SEQ ID NO: 466349 - DNA, 25 bp, Mus musculus
tatcacaacagcgtcgtgaggaggg

SEQ ID NO: 466350 - DNA, 25 bp, Mus musculus
tatcacaacggtcccattgtgcgtg

SEQ ID NO: 466351 - DNA, 25 bp, Mus musculus
tatcacaagaactgtaacccgggtc

SEQ ID NO: 466352 - DNA, 25 bp, Mus musculus
tatcacacggtggaaaactctcgag

SEQ ID NO: 466353 - DNA, 25 bp, Mus musculus
tatcacagaagatcgctgtactggg

SEQ ID NO: 466354 - DNA, 25 bp, Mus musculus
tatcacagatgacccgcagaagttc

SEQ ID NO: 466355 - DNA, 25 bp, Mus musculus
tatcacagccagtggttcagacagg

SEQ ID NO: 466356 - DNA, 25 bp, Mus musculus
tatcacaggctttgagtttatccca

SEQ ID NO: 466357 - DNA, 25 bp, Mus musculus
tatcacagtccctgaactcggcttg

SEQ ID NO: 466358 - DNA, 25 bp, Mus musculus
tatcacagtgtaccgcaacgggagg

SEQ ID NO: 466359 - DNA, 25 bp, Mus musculus
tatcacagttggctctcgggactcg

SEQ ID NO: 466360 - DNA, 25 bp, Mus musculus
tatcacatgtgacctagactggcct

SEQ ID NO: 466361 - DNA, 25 bp, Mus musculus
tatcacattgaaacgggcaggccct

SEQ ID NO: 466362 - DNA, 25 bp, Mus musculus
tatcacattgtgtaggtcagagcgg

SEQ ID NO: 466363 - DNA, 25 bp, Mus musculus
tatcaccagacttcggaggtcgtgg

SEQ ID NO: 466364 - DNA, 25 bp, Mus musculus
tatcaccagccttggcaagtgcatg

SEQ ID NO: 466365 - DNA, 25 bp, Mus musculus
tatcaccataaacttgccccaggaa

SEQ ID NO: 466366 - DNA, 25 bp, Mus musculus
tatcaccatagggacagtgctacaa

SEQ ID NO: 466367 - DNA, 25 bp, Mus musculus
tatcaccatgatgaagcacacagcg

SEQ ID NO: 466368 - DNA, 25 bp, Mus musculus
tatcaccatgcaggcgttgtcggaa

SEQ ID NO: 466369 - DNA, 25 bp, Mus musculus
tatcaccatggttatgagctggcca

SEQ ID NO: 466370 - DNA, 25 bp, Mus musculus
tatcacccttgctctatgaaagcgg

SEQ ID NO: 466371 - DNA, 25 bp, Mus musculus
tatcaccgaagctatggctaccggg

SEQ ID NO: 466372 - DNA, 25 bp, Mus musculus
tatcaccgcattctctgagtaccca

SEQ ID NO: 466373 - DNA, 25 bp, Mus musculus
tatcaccgtcatctgcccttgggag

SEQ ID NO: 466374 - DNA, 25 bp, Mus musculus
tatcaccgttgtctgaggattctga

SEQ ID NO: 466375 - DNA, 25 bp, Mus musculus
tatcacctctagaaagggctgctgc

SEQ ID NO: 466376 - DNA, 25 bp, Mus musculus
tatcacctgaatctcaccgtgggcg

SEQ ID NO: 466377 - DNA, 25 bp, Mus musculus
tatcacctgcaacaacttgacaaga

SEQ ID NO: 466378 - DNA, 25 bp, Mus musculus
tatcacctgctgaagtccccagtgg

SEQ ID NO: 466379 - DNA, 25 bp, Mus musculus
tatcacctgctggagtactggccat

SEQ ID NO: 466380 - DNA, 25 bp, Mus musculus
tatcacctgggaccactgaaactgc

SEQ ID NO: 466381 - DNA, 25 bp, Mus musculus
tatcacctgtgctgtagtgggcaac

SEQ ID NO: 466382 - DNA, 25 bp, Mus musculus
tatcaccttgagcacccatgaatgt

SEQ ID NO: 466383 - DNA, 25 bp, Mus musculus
tatcacgacgactcttacgcagcgg

SEQ ID NO: 466384 - DNA, 25 bp, Mus musculus
tatcacgaggcacacgaacatctag

SEQ ID NO: 466385 - DNA, 25 bp, Mus musculus
tatcacgcatggttcagggccaggc

SEQ ID NO: 466386 - DNA, 25 bp, Mus musculus
tatcacgctgctcaacggtgtggcc

SEQ ID NO: 466387 - DNA, 25 bp, Mus musculus
tatcacgctgtgaccacgaggaaga

SEQ ID NO: 466388 - DNA, 25 bp, Mus musculus
tatcacggaggactccttagaccct

SEQ ID NO: 466389 - DNA, 25 bp, Mus musculus
tatcacggccgcaaagtggaacctg

SEQ ID NO: 466390 - DNA, 25 bp, Mus musculus
tatcacggtcatctgtccctgggaa

SEQ ID NO: 466391 - DNA, 25 bp, Mus musculus
tatcacgttgactttgggacacaga

SEQ ID NO: 466392 - DNA, 25 bp, Mus musculus
tatcactaaggacaagaggcgcaag

SEQ ID NO: 466393 - DNA, 25 bp, Mus musculus
tatcactagggttcctgctaaaagg

SEQ ID NO: 466394 - DNA, 25 bp, Mus musculus
tatcactcagagtgcccactgggtc

SEQ ID NO: 466395 - DNA, 25 bp, Mus musculus
tatcactgagtctacaaaaccacag

SEQ ID NO: 466396 - DNA, 25 bp, Mus musculus
tatcactgatattgttgggacagaa

SEQ ID NO: 466397 - DNA, 25 bp, Mus musculus
tatcactgtcaagactgggctttac

SEQ ID NO: 466398 - DNA, 25 bp, Mus musculus
tatcactgtggtagagcctgcatag

SEQ ID NO: 466399 - DNA, 25 bp, Mus musculus
tatcacttaaaggatatggttgtct

SEQ ID NO: 466400 - DNA, 25 bp, Mus musculus
tatcacttatacacttctccatgga

SEQ ID NO: 466401 - DNA, 25 bp, Mus musculus
tatcacttcagcgaggactacctgg

SEQ ID NO: 466402 - DNA, 25 bp, Mus musculus
tatcacttgggagtatgagggacca

SEQ ID NO: 466403 - DNA, 25 bp, Mus musculus
tatcactttccgctgcctggaggag

SEQ ID NO: 466404 - DNA, 25 bp, Mus musculus
tatcagaaaagcaactgagaagcta

SEQ ID NO: 466405 - DNA, 25 bp, Mus musculus
tatcagaaattgaaggaacccgttc

SEQ ID NO: 466406 - DNA, 25 bp, Mus musculus
tatcagaagaccgaggcctacaagg

SEQ ID NO: 466407 - DNA, 25 bp, Mus musculus
tatcagaagcgacaagaatagatgc

SEQ ID NO: 466408 - DNA, 25 bp, Mus musculus
tatcagaagcgagatcgttcccagc

SEQ ID NO: 466409 - DNA, 25 bp, Mus musculus
tatcagaagtgcaaactaactccag

SEQ ID NO: 466410 - DNA, 25 bp, Mus musculus
tatcagacatgaaggatagcctggg

SEQ ID NO: 466411 - DNA, 25 bp, Mus musculus
tatcagaccctcagtgttcacctta

SEQ ID NO: 466412 - DNA, 25 bp, Mus musculus
tatcagacgatagaccccaggaatt

SEQ ID NO: 466413 - DNA, 25 bp, Mus musculus
tatcagacggccatgtatccaatca

SEQ ID NO: 466414 - DNA, 25 bp, Mus musculus
tatcagacggtgatgctgagacacg

SEQ ID NO: 466415 - DNA, 25 bp, Mus musculus
tatcagagaagatggaaccctccag

SEQ ID NO: 466416 - DNA, 25 bp, Mus musculus
tatcagagcaccaggagcaaactgg

SEQ ID NO: 466417 - DNA, 25 bp, Mus musculus
tatcagaggacactagctggtcaca

SEQ ID NO: 466418 - DNA, 25 bp, Mus musculus
tatcagagtcccagctcaggttctc

SEQ ID NO: 466419 - DNA, 25 bp, Mus musculus
tatcagataaggtggagacagctca

SEQ ID NO: 466420 - DNA, 25 bp, Mus musculus
tatcagatcattgagcctgttcaca

SEQ ID NO: 466421 - DNA, 25 bp, Mus musculus
tatcagatcccgcaaagaaggcgcc

SEQ ID NO: 466422 - DNA, 25 bp, Mus musculus
tatcagatctgccatgggaaggtgc

SEQ ID NO: 466423 - DNA, 25 bp, Mus musculus
tatcagatctgtaagcattgtgggt

SEQ ID NO: 466424 - DNA, 25 bp, Mus musculus
tatcagatttacaaggccgccagga

SEQ ID NO: 466425 - DNA, 25 bp, Mus musculus
tatcagatttcaatggacatccgac

SEQ ID NO: 466426 - DNA, 25 bp, Mus musculus
tatcagcaagttacccaagggcaag

SEQ ID NO: 466427 - DNA, 25 bp, Mus musculus
tatcagcagagacagagctaacgct

SEQ ID NO: 466428 - DNA, 25 bp, Mus musculus
tatcagcagctatatccccaatgga

SEQ ID NO: 466429 - DNA, 25 bp, Mus musculus
tatcagccaggctgagcccatccag

SEQ ID NO: 466430 - DNA, 25 bp, Mus musculus
tatcagccagtatgctcgggttgcc

SEQ ID NO: 466431 - DNA, 25 bp, Mus musculus
tatcagccgtgtctgcattggagcc

SEQ ID NO: 466432 - DNA, 25 bp, Mus musculus
tatcagcctgctggtgacacttgag

SEQ ID NO: 466433 - DNA, 25 bp, Mus musculus
tatcagcggaaggagagaagcacag

SEQ ID NO: 466434 - DNA, 25 bp, Mus musculus
tatcagcggttaggtttgggaacca

SEQ ID NO: 466435 - DNA, 25 bp, Mus musculus
tatcagctaagcagaagaccaagca

SEQ ID NO: 466436 - DNA, 25 bp, Mus musculus
tatcagctgaatgaggctggactgg

SEQ ID NO: 466437 - DNA, 25 bp, Mus musculus
tatcagcttcggcatggagctgccc

SEQ ID NO: 466438 - DNA, 25 bp, Mus musculus
tatcagcttgaacatggacctcgaa

SEQ ID NO: 466439 - DNA, 25 bp, Mus musculus
tatcagcttgtctggtagagcaccc

SEQ ID NO: 466440 - DNA, 25 bp, Mus musculus
tatcaggaaactccaaatccctggg

SEQ ID NO: 466441 - DNA, 25 bp, Mus musculus
tatcaggaaggaactagccaaactc

SEQ ID NO: 466442 - DNA, 25 bp, Mus musculus
tatcaggactgcttcctgaacggtc

SEQ ID NO: 466443 - DNA, 25 bp, Mus musculus
tatcaggaggaaggcctatgctccg

SEQ ID NO: 466444 - DNA, 25 bp, Mus musculus
tatcaggataaagggatggccagcc

SEQ ID NO: 466445 - DNA, 25 bp, Mus musculus
tatcaggcctgtagagtaactgggc

SEQ ID NO: 466446 - DNA, 25 bp, Mus musculus
tatcaggctttgtcagagttggcag

SEQ ID NO: 466447 - DNA, 25 bp, Mus musculus
tatcagggattcagagggataggaa

SEQ ID NO: 466448 - DNA, 25 bp, Mus musculus
tatcagggctttgcatctggagacc

SEQ ID NO: 466449 - DNA, 25 bp, Mus musculus
tatcagggtgaaccatgccttggac

SEQ ID NO: 466450 - DNA, 25 bp, Mus musculus
tatcaggtacctcaacctctacgac

SEQ ID NO: 466451 - DNA, 25 bp, Mus musculus
tatcaggtcactgctgagaagattt

SEQ ID NO: 466452 - DNA, 25 bp, Mus musculus
tatcaggtcattaggatgctgcccg

SEQ ID NO: 466453 - DNA, 25 bp, Mus musculus
tatcaggtgaaagtaaaggcgtcca

SEQ ID NO: 466454 - DNA, 25 bp, Mus musculus
tatcaggtgacaaaaacggtgccac

SEQ ID NO: 466455 - DNA, 25 bp, Mus musculus
tatcaggtgtatgtccaagccaagg

SEQ ID NO: 466456 - DNA, 25 bp, Mus musculus
tatcaggttttcctatgtacataca

SEQ ID NO: 466457 - DNA, 25 bp, Mus musculus
tatcagtaataaagtccctaagacg

SEQ ID NO: 466458 - DNA, 25 bp, Mus musculus
tatcagtacatctggtttcccctct

SEQ ID NO: 466459 - DNA, 25 bp, Mus musculus
tatcagtacctggttcacggcagca

SEQ ID NO: 466460 - DNA, 25 bp, Mus musculus
tatcagtagcatcgtgaaccgggcc

SEQ ID NO: 466461 - DNA, 25 bp, Mus musculus
tatcagtcagtacagctctacagat

SEQ ID NO: 466462 - DNA, 25 bp, Mus musculus
tatcagtctaagagccacggatggg

SEQ ID NO: 466463 - DNA, 25 bp, Mus musculus
tatcagtctgtctaatcaagccagt

SEQ ID NO: 466464 - DNA, 25 bp, Mus musculus
tatcagtgagcgatatcctggatct

SEQ ID NO: 466465 - DNA, 25 bp, Mus musculus
tatcagtgcagcgtatgagagacga

SEQ ID NO: 466466 - DNA, 25 bp, Mus musculus
tatcagtgtactactccagagagag

SEQ ID NO: 466467 - DNA, 25 bp, Mus musculus
tatcagtgtgtaaaaacagtgtgct

SEQ ID NO: 466468 - DNA, 25 bp, Mus musculus
tatcagttcaggatgtgacccggga

SEQ ID NO: 466469 - DNA, 25 bp, Mus musculus
tatcagtttccggattgggcctaca

SEQ ID NO: 466470 - DNA, 25 bp, Mus musculus
tatcagtttctggaagggttggccc

SEQ ID NO: 466471 - DNA, 25 bp, Mus musculus
tatcagttttcaatgcacaccgcag

SEQ ID NO: 466472 - DNA, 25 bp, Mus musculus
tatcagttttgggtactggagccat

SEQ ID NO: 466473 - DNA, 25 bp, Mus musculus
tatcataaagcggaggcaaggagag

SEQ ID NO: 466474 - DNA, 25 bp, Mus musculus
tatcataagagtccaaccttttgtc

SEQ ID NO: 466475 - DNA, 25 bp, Mus musculus
tatcataagctaagggcaagtcctg

SEQ ID NO: 466476 - DNA, 25 bp, Mus musculus
tatcatagaataagacctgtgccac

SEQ ID NO: 466477 - DNA, 25 bp, Mus musculus
tatcatcaagggtgaggcagagacc

SEQ ID NO: 466478 - DNA, 25 bp, Mus musculus
tatcatcactggcttctgggcagac

SEQ ID NO: 466479 - DNA, 25 bp, Mus musculus
tatcatcagaggcacttttctgggt

SEQ ID NO: 466480 - DNA, 25 bp, Mus musculus
tatcatcatcgcctgggcagttggc

SEQ ID NO: 466481 - DNA, 25 bp, Mus musculus
tatcatcatgatacatggagctcaa

SEQ ID NO: 466482 - DNA, 25 bp, Mus musculus
tatcatccacgtacaagggcttgcc

SEQ ID NO: 466483 - DNA, 25 bp, Mus musculus
tatcatccagtttaacccagggcct

SEQ ID NO: 466484 - DNA, 25 bp, Mus musculus
tatcatccggacacggaagtccctg

SEQ ID NO: 466485 - DNA, 25 bp, Mus musculus
tatcatcctgagagatgacctggac

SEQ ID NO: 466486 - DNA, 25 bp, Mus musculus
tatcatcctggagatcgcggccatc

SEQ ID NO: 466487 - DNA, 25 bp, Mus musculus
tatcatcctttcttgttaaaaccag

SEQ ID NO: 466488 - DNA, 25 bp, Mus musculus
tatcatcgagcagcgtagccttaag

SEQ ID NO: 466489 - DNA, 25 bp, Mus musculus
tatcatcgccaggatgtcacgagca

SEQ ID NO: 466490 - DNA, 25 bp, Mus musculus
tatcatcgccgtcatgtcacaagga

SEQ ID NO: 466491 - DNA, 25 bp, Mus musculus
tatcatcggcaagtcatccgtggcc

SEQ ID NO: 466492 - DNA, 25 bp, Mus musculus
tatcatcgtcatcatcctgtggagg

SEQ ID NO: 466493 - DNA, 25 bp, Mus musculus
tatcatcgtggtgaagcagggacac

SEQ ID NO: 466494 - DNA, 25 bp, Mus musculus
tatcatctacctcttgggccctggc

SEQ ID NO: 466495 - DNA, 25 bp, Mus musculus
tatcatctacgtcatggctggccag

SEQ ID NO: 466496 - DNA, 25 bp, Mus musculus
tatcatctgcaagtctgagacgccc

SEQ ID NO: 466497 - DNA, 25 bp, Mus musculus
tatcatctgccaaaccaacgaggag

SEQ ID NO: 466498 - DNA, 25 bp, Mus musculus
tatcatctgccgatgtgtgcctgta

SEQ ID NO: 466499 - DNA, 25 bp, Mus musculus
tatcatctgcctgttattgcccagc

SEQ ID NO: 466500 - DNA, 25 bp, Mus musculus
tatcatctgtccatgtccagtggtt

SEQ ID NO: 466501 - DNA, 25 bp, Mus musculus
tatcatcttctgctccacacacaag

SEQ ID NO: 466502 - DNA, 25 bp, Mus musculus
tatcatgaaagccattgttccgggc

SEQ ID NO: 466503 - DNA, 25 bp, Mus musculus
tatcatgaccagtaagaagatcccc

SEQ ID NO: 466504 - DNA, 25 bp, Mus musculus
tatcatgcgcaatttgaggatcgcc

SEQ ID NO: 466505 - DNA, 25 bp, Mus musculus
tatcatggaccagaaccgcgatggc

SEQ ID NO: 466506 - DNA, 25 bp, Mus musculus
tatcatggagactacctttcaaggc

SEQ ID NO: 466507 - DNA, 25 bp, Mus musculus
tatcatggcacttcaccctgtgtag

SEQ ID NO: 466508 - DNA, 25 bp, Mus musculus
tatcatggcattacagaggaggaca

SEQ ID NO: 466509 - DNA, 25 bp, Mus musculus
tatcatggcggtgatgaccacagcc

SEQ ID NO: 466510 - DNA, 25 bp, Mus musculus
tatcatgggagttccagggatctac

SEQ ID NO: 466511 - DNA, 25 bp, Mus musculus
tatcatgggtaagatcacagcaccg

SEQ ID NO: 466512 - DNA, 25 bp, Mus musculus
tatcatgtagttgagtggccattgg

SEQ ID NO: 466513 - DNA, 25 bp, Mus musculus
tatcatgttcactgcaagggaggca

SEQ ID NO: 466514 - DNA, 25 bp, Mus musculus
tatcattaataactggtgtcctcgt

SEQ ID NO: 466515 - DNA, 25 bp, Mus musculus
tatcattactctccattcaagtcct

SEQ ID NO: 466516 - DNA, 25 bp, Mus musculus
tatcattcacggagggaaaacacca

SEQ ID NO: 466517 - DNA, 25 bp, Mus musculus
tatcattcagacacccagtcgaggc

SEQ ID NO: 466518 - DNA, 25 bp, Mus musculus
tatcattccaggttaaaagagaggc

SEQ ID NO: 466519 - DNA, 25 bp, Mus musculus
tatcattcccacgtagtaaagctgg

SEQ ID NO: 466520 - DNA, 25 bp, Mus musculus
tatcattggcaaggagggtgccacc

SEQ ID NO: 466521 - DNA, 25 bp, Mus musculus
tatcatttctctctcttcacttctg

SEQ ID NO: 466522 - DNA, 25 bp, Mus musculus
tatcatttctgctacgacgtggccc

SEQ ID NO: 466523 - DNA, 25 bp, Mus musculus
tatcatttgaatacatgggagcagg

SEQ ID NO: 466524 - DNA, 25 bp, Mus musculus
tatccaaaacctttcaggcaagtta

SEQ ID NO: 466525 - DNA, 25 bp, Mus musculus
tatccaaacatatgatgggcccagc

SEQ ID NO: 466526 - DNA, 25 bp, Mus musculus
tatccaaacctgctggctccggtag

SEQ ID NO: 466527 - DNA, 25 bp, Mus musculus
tatccaaagacgaaagccagactgc

SEQ ID NO: 466528 - DNA, 25 bp, Mus musculus
tatccaaagtggaagctgcctgcag

SEQ ID NO: 466529 - DNA, 25 bp, Mus musculus
tatccaaattggacctcgaggctgg

SEQ ID NO: 466530 - DNA, 25 bp, Mus musculus
tatccaacttgggaagggacactgg

SEQ ID NO: 466531 - DNA, 25 bp, Mus musculus
tatccaagaagacgcacgtggttgc

SEQ ID NO: 466532 - DNA, 25 bp, Mus musculus
tatccaagaggatatggcccgctgc

SEQ ID NO: 466533 - DNA, 25 bp, Mus musculus
tatccaagagttaacctgacccggt

SEQ ID NO: 466534 - DNA, 25 bp, Mus musculus
tatccaagatcttcgggaacaagga

SEQ ID NO: 466535 - DNA, 25 bp, Mus musculus
tatccaagcacgaatcagcagaagc

SEQ ID NO: 466536 - DNA, 25 bp, Mus musculus
tatccaagctgcagagagacctctc

SEQ ID NO: 466537 - DNA, 25 bp, Mus musculus
tatccaaggaaaatcggtgctgtcg

SEQ ID NO: 466538 - DNA, 25 bp, Mus musculus
tatccaaggaaagggtactcgtcaa

SEQ ID NO: 466539 - DNA, 25 bp, Mus musculus
tatccaaggccagatgaatcaggtg

SEQ ID NO: 466540 - DNA, 25 bp, Mus musculus
tatccaaggctctgggaacagtgat

SEQ ID NO: 466541 - DNA, 25 bp, Mus musculus
tatccaagggacaagaagggacatc

SEQ ID NO: 466542 - DNA, 25 bp, Mus musculus
tatccaagtaaggaaagccaagctc

SEQ ID NO: 466543 - DNA, 25 bp, Mus musculus
tatccaagttagtcagaaggcggtg

SEQ ID NO: 466544 - DNA, 25 bp, Mus musculus
tatccaataaaccagacactcctag

SEQ ID NO: 466545 - DNA, 25 bp, Mus musculus
tatccaatcacagctgaggctggga

SEQ ID NO: 466546 - DNA, 25 bp, Mus musculus
tatccacacagatgcaggacagtct

SEQ ID NO: 466547 - DNA, 25 bp, Mus musculus
tatccacacttcacacaaggctagc

SEQ ID NO: 466548 - DNA, 25 bp, Mus musculus
tatccacactttggaggcccagagt

SEQ ID NO: 466549 - DNA, 25 bp, Mus musculus
tatccacaggtaaatttcatcagac

SEQ ID NO: 466550 - DNA, 25 bp, Mus musculus
tatccacagttcatgcaaccacggg

SEQ ID NO: 466551 - DNA, 25 bp, Mus musculus
tatccacatgttcctcttcgccagg

SEQ ID NO: 466552 - DNA, 25 bp, Mus musculus
tatccaccaagtcctgcagacctga

SEQ ID NO: 466553 - DNA, 25 bp, Mus musculus
tatccacctgtctttggcttgggaa

SEQ ID NO: 466554 - DNA, 25 bp, Mus musculus
tatccacgaggcacatgcagggttg

SEQ ID NO: 466555 - DNA, 25 bp, Mus musculus
tatccacggccgcaatgacaagttc

SEQ ID NO: 466556 - DNA, 25 bp, Mus musculus
tatccacgggtacctcccgctggaa

SEQ ID NO: 466557 - DNA, 25 bp, Mus musculus
tatccacgttttgatgcagccggga

SEQ ID NO: 466558 - DNA, 25 bp, Mus musculus
tatccactctggtcatccattcggc

SEQ ID NO: 466559 - DNA, 25 bp, Mus musculus
tatccacttgggtggctctgctgct

SEQ ID NO: 466560 - DNA, 25 bp, Mus musculus
tatccagaagtcgaagagtccaagt

SEQ ID NO: 466561 - DNA, 25 bp, Mus musculus
tatccagacctgctatgaattcaca

SEQ ID NO: 466562 - DNA, 25 bp, Mus musculus
tatccagactccctgaaactcagag

SEQ ID NO: 466563 - DNA, 25 bp, Mus musculus
tatccagaggtcgaagcagcaatcc

SEQ ID NO: 466564 - DNA, 25 bp, Mus musculus
tatccagagttgctgtatcgcccag

SEQ ID NO: 466565 - DNA, 25 bp, Mus musculus
tatccagataaacccatctgagagg

SEQ ID NO: 466566 - DNA, 25 bp, Mus musculus
tatccagccaggattagccttcggg

SEQ ID NO: 466567 - DNA, 25 bp, Mus musculus
tatccagcgggacttggccagagat

SEQ ID NO: 466568 - DNA, 25 bp, Mus musculus
tatccagctgagtgtcgtggccgaa

SEQ ID NO: 466569 - DNA, 25 bp, Mus musculus
tatccagctggagtactctgaagcc

SEQ ID NO: 466570 - DNA, 25 bp, Mus musculus
tatccaggagacagtgaccatcgac

SEQ ID NO: 466571 - DNA, 25 bp, Mus musculus
tatccaggagctgtatgacaccacc

SEQ ID NO: 466572 - DNA, 25 bp, Mus musculus
tatccaggaggtctgtgcagccatc

SEQ ID NO: 466573 - DNA, 25 bp, Mus musculus
tatccaggcagagaagaaccgtgcc

SEQ ID NO: 466574 - DNA, 25 bp, Mus musculus
tatccaggctgcatttgaccaagac

SEQ ID NO: 466575 - DNA, 25 bp, Mus musculus
tatccagggacttgcttcgagcacc

SEQ ID NO: 466576 - DNA, 25 bp, Mus musculus
tatccagggtccgaggaaatcgaat

SEQ ID NO: 466577 - DNA, 25 bp, Mus musculus
tatccaggtgatgctaagtggctcc

SEQ ID NO: 466578 - DNA, 25 bp, Mus musculus
tatccaggtgattgtgaaagccaga

SEQ ID NO: 466579 - DNA, 25 bp, Mus musculus
tatccaggtggaaagtcagccccaa

SEQ ID NO: 466580 - DNA, 25 bp, Mus musculus
tatccagtacgtgctgaaggtcacc

SEQ ID NO: 466581 - DNA, 25 bp, Mus musculus
tatccagtgagaagagaccagggtg

SEQ ID NO: 466582 - DNA, 25 bp, Mus musculus
tatccagtggacttgcctaccagca

SEQ ID NO: 466583 - DNA, 25 bp, Mus musculus
tatccagtggcctgcatcctgtgag

SEQ ID NO: 466584 - DNA, 25 bp, Mus musculus
tatccagtgtaaaggtgtcagacca

SEQ ID NO: 466585 - DNA, 25 bp, Mus musculus
tatccagtgtatgctgtccagtggc

SEQ ID NO: 466586 - DNA, 25 bp, Mus musculus
tatccagtgtattgtgttcggccct

SEQ ID NO: 466587 - DNA, 25 bp, Mus musculus
tatccagtgtgaagaactccccagg

SEQ ID NO: 466588 - DNA, 25 bp, Mus musculus
tatccatagtcaaagtgatttcaca

SEQ ID NO: 466589 - DNA, 25 bp, Mus musculus
tatccatatgcaaagccacactgtg

SEQ ID NO: 466590 - DNA, 25 bp, Mus musculus
tatccatgacggagatgggagctca

SEQ ID NO: 466591 - DNA, 25 bp, Mus musculus
tatccatgcggtgagatactccacg

SEQ ID NO: 466592 - DNA, 25 bp, Mus musculus
tatccatggcaacaagagcaacatc

SEQ ID NO: 466593 - DNA, 25 bp, Mus musculus
tatccatgggaagaacctagtggcc

SEQ ID NO: 466594 - DNA, 25 bp, Mus musculus
tatccatgggccgaaaatttttcaa

SEQ ID NO: 466595 - DNA, 25 bp, Mus musculus
tatccatgtagggtgtttgccagct

SEQ ID NO: 466596 - DNA, 25 bp, Mus musculus
tatccatgtgaagcagacgactccc

SEQ ID NO: 466597 - DNA, 25 bp, Mus musculus
tatccatgtgggtgctttattccca

SEQ ID NO: 466598 - DNA, 25 bp, Mus musculus
tatcccacctgttggacgaggcagc

SEQ ID NO: 466599 - DNA, 25 bp, Mus musculus
tatcccactggccagaagtctgagc

SEQ ID NO: 466600 - DNA, 25 bp, Mus musculus
tatcccagaggcgtgaggtcagctg

SEQ ID NO: 466601 - DNA, 25 bp, Mus musculus
tatcccagagggagaacattcagag

SEQ ID NO: 466602 - DNA, 25 bp, Mus musculus
tatcccagcagttcagatccagtgc

SEQ ID NO: 466603 - DNA, 25 bp, Mus musculus
tatcccagctgtttcgatgccaacg

SEQ ID NO: 466604 - DNA, 25 bp, Mus musculus
tatcccaggatgagcgtgaatgcac

SEQ ID NO: 466605 - DNA, 25 bp, Mus musculus
tatcccagggaaatgcttgggccgg

SEQ ID NO: 466606 - DNA, 25 bp, Mus musculus
tatcccagggacacttccaagtgca

SEQ ID NO: 466607 - DNA, 25 bp, Mus musculus
tatcccagggtccaagacactgtgg

SEQ ID NO: 466608 - DNA, 25 bp, Mus musculus
tatcccagtgccaagctgcagatgc

SEQ ID NO: 466609 - DNA, 25 bp, Mus musculus
tatcccatatagacgaaggaagaac

SEQ ID NO: 466610 - DNA, 25 bp, Mus musculus
tatcccatggaagccctaacttttc

SEQ ID NO: 466611 - DNA, 25 bp, Mus musculus
tatcccatggccagaaggcgaagaa

SEQ ID NO: 466612 - DNA, 25 bp, Mus musculus
tatcccatgtctctcgctttttaga

SEQ ID NO: 466613 - DNA, 25 bp, Mus musculus
tatcccatttcacaacgaaggttgg

SEQ ID NO: 466614 - DNA, 25 bp, Mus musculus
tatccccagaccgtttgtagctcag

SEQ ID NO: 466615 - DNA, 25 bp, Mus musculus
tatccccataaggagcgcttgcatg

SEQ ID NO: 466616 - DNA, 25 bp, Mus musculus
tatccccgccagtgcctagtgtggg

SEQ ID NO: 466617 - DNA, 25 bp, Mus musculus
tatcccctatcaaagtagtggaggc

SEQ ID NO: 466618 - DNA, 25 bp, Mus musculus
tatccccttaggtaatatccttgtt

SEQ ID NO: 466619 - DNA, 25 bp, Mus musculus
tatcccctttgtgaggaggaccagc

SEQ ID NO: 466620 - DNA, 25 bp, Mus musculus
tatcccggcttatgctttactctca

SEQ ID NO: 466621 - DNA, 25 bp, Mus musculus
tatcccgggaaaacgtgggctatgc

SEQ ID NO: 466622 - DNA, 25 bp, Mus musculus
tatccctccaacaagcctggtgtgg

SEQ ID NO: 466623 - DNA, 25 bp, Mus musculus
tatccctcgaattagccgagtcagg

SEQ ID NO: 466624 - DNA, 25 bp, Mus musculus
tatccctctcattgtggaaagctgc

SEQ ID NO: 466625 - DNA, 25 bp, Mus musculus
tatccctctggacacttggacatgg

SEQ ID NO: 466626 - DNA, 25 bp, Mus musculus
tatccctgaccccaagaatgagagc

SEQ ID NO: 466627 - DNA, 25 bp, Mus musculus
tatccctgaggaatatgtgctgacc

SEQ ID NO: 466628 - DNA, 25 bp, Mus musculus
tatccctgcttcagctaagagggcc

SEQ ID NO: 466629 - DNA, 25 bp, Mus musculus
tatccctggcacaccacagggagag

SEQ ID NO: 466630 - DNA, 25 bp, Mus musculus
tatccctggtctcacgcagcagttg

SEQ ID NO: 466631 - DNA, 25 bp, Mus musculus
tatccctggtctgggatttctttcc

SEQ ID NO: 466632 - DNA, 25 bp, Mus musculus
tatcccttcaggactaggtgcagaa

SEQ ID NO: 466633 - DNA, 25 bp, Mus musculus
tatcccttggaaaacataaccctgg

SEQ ID NO: 466634 - DNA, 25 bp, Mus musculus
tatcccttggagcagaatttgcctg

SEQ ID NO: 466635 - DNA, 25 bp, Mus musculus
tatccctttaagtaataccatcctc

SEQ ID NO: 466636 - DNA, 25 bp, Mus musculus
tatccgaaaaccaaatgaaggcgcc

SEQ ID NO: 466637 - DNA, 25 bp, Mus musculus
tatccgaaaataccagggcagcgac

SEQ ID NO: 466638 - DNA, 25 bp, Mus musculus
tatccgacagtttttcatggatata

SEQ ID NO: 466639 - DNA, 25 bp, Mus musculus
tatccgactagtagagctttaccgt

SEQ ID NO: 466640 - DNA, 25 bp, Mus musculus
tatccgacttcgacaatgccaaggg

SEQ ID NO: 466641 - DNA, 25 bp, Mus musculus
tatccgagccagatacgattgacga

SEQ ID NO: 466642 - DNA, 25 bp, Mus musculus
tatccgatacgaatacctgagcagc

SEQ ID NO: 466643 - DNA, 25 bp, Mus musculus
tatccgatcgggacaaacgccattg

SEQ ID NO: 466644 - DNA, 25 bp, Mus musculus
tatccgatggaaaggctacggcagc

SEQ ID NO: 466645 - DNA, 25 bp, Mus musculus
tatccgcagggcgtacctagatggc

SEQ ID NO: 466646 - DNA, 25 bp, Mus musculus
tatccgcatgaactacctgaagacg

SEQ ID NO: 466647 - DNA, 25 bp, Mus musculus
tatccgccaaagtcactcgcatggg

SEQ ID NO: 466648 - DNA, 25 bp, Mus musculus
tatccgccagtatgcagtggtccgg

SEQ ID NO: 466649 - DNA, 25 bp, Mus musculus
tatccgcggtacactatgaggagcc

SEQ ID NO: 466650 - DNA, 25 bp, Mus musculus
tatccgctctaggttacacattctg

SEQ ID NO: 466651 - DNA, 25 bp, Mus musculus
tatccggacagctaaggaggacttc

SEQ ID NO: 466652 - DNA, 25 bp, Mus musculus
tatccggaggatcctgaccagagtg

SEQ ID NO: 466653 - DNA, 25 bp, Mus musculus
tatccggagtggaaaacatggcttc

SEQ ID NO: 466654 - DNA, 25 bp, Mus musculus
tatccggatcccatagtgctcatga

SEQ ID NO: 466655 - DNA, 25 bp, Mus musculus
tatccggccgaagcgcaaatatgaa

SEQ ID NO: 466656 - DNA, 25 bp, Mus musculus
tatccggctcctagtggagggctct

SEQ ID NO: 466657 - DNA, 25 bp, Mus musculus
tatccggctgtttgtttgagtacct

SEQ ID NO: 466658 - DNA, 25 bp, Mus musculus
tatccgggaaaaggaagtcaccatg

SEQ ID NO: 466659 - DNA, 25 bp, Mus musculus
tatccgggaatatgctaaaaagcca

SEQ ID NO: 466660 - DNA, 25 bp, Mus musculus
tatccgggatcatttaagcccatgg

SEQ ID NO: 466661 - DNA, 25 bp, Mus musculus
tatccgggcattgagattgagtcgc

SEQ ID NO: 466662 - DNA, 25 bp, Mus musculus
tatccgggctacacgaactatggct

SEQ ID NO: 466663 - DNA, 25 bp, Mus musculus
tatccggtcacgaatgtggaactga

SEQ ID NO: 466664 - DNA, 25 bp, Mus musculus
tatccggttcctggtagtgggtaga

SEQ ID NO: 466665 - DNA, 25 bp, Mus musculus
tatccgtattgtgggagactggacg

SEQ ID NO: 466666 - DNA, 25 bp, Mus musculus
tatccgtctggatgagcttctccgt

SEQ ID NO: 466667 - DNA, 25 bp, Mus musculus
tatccgtctggtagaacctggctcg

SEQ ID NO: 466668 - DNA, 25 bp, Mus musculus
tatccgtgaggatgacaacattgcc

SEQ ID NO: 466669 - DNA, 25 bp, Mus musculus
tatccgtgcattccggagtacgaag

SEQ ID NO: 466670 - DNA, 25 bp, Mus musculus
tatccgtgccagaaccagggtgtct

SEQ ID NO: 466671 - DNA, 25 bp, Mus musculus
tatccgtgcctgtggaccattagca

SEQ ID NO: 466672 - DNA, 25 bp, Mus musculus
tatccgtgggctccaaagcttcctg

SEQ ID NO: 466673 - DNA, 25 bp, Mus musculus
tatccgttcagagaaaactccaggg

SEQ ID NO: 466674 - DNA, 25 bp, Mus musculus
tatccgttcagggtccgtgttgtgt

SEQ ID NO: 466675 - DNA, 25 bp, Mus musculus
tatccgttcccaaagtaccgtgagc

SEQ ID NO: 466676 - DNA, 25 bp, Mus musculus
tatccgttgtcagtgtcagctcagc

SEQ ID NO: 466677 - DNA, 25 bp, Mus musculus
tatccgtttggcacagggcatctgg

SEQ ID NO: 466678 - DNA, 25 bp, Mus musculus
tatcctaaagatgaagcacatgtct

SEQ ID NO: 466679 - DNA, 25 bp, Mus musculus
tatcctaaaggagaccataaatggt

SEQ ID NO: 466680 - DNA, 25 bp, Mus musculus
tatcctaagactcggaaaggcccac

SEQ ID NO: 466681 - DNA, 25 bp, Mus musculus
tatcctacaagactaacccgggctt

SEQ ID NO: 466682 - DNA, 25 bp, Mus musculus
tatcctactctttcagatagtaaag

SEQ ID NO: 466683 - DNA, 25 bp, Mus musculus
tatcctagcaacttgtagacgtggc

SEQ ID NO: 466684 - DNA, 25 bp, Mus musculus
tatcctatctatcctatctgggaag

SEQ ID NO: 466685 - DNA, 25 bp, Mus musculus
tatcctcaatgtgaacccagttggg

SEQ ID NO: 466686 - DNA, 25 bp, Mus musculus
tatcctcactgcttaaggtgcccag

SEQ ID NO: 466687 - DNA, 25 bp, Mus musculus
tatcctccttcagtgtacgaccaga

SEQ ID NO: 466688 - DNA, 25 bp, Mus musculus
tatcctcggatgttgctgccttgca

SEQ ID NO: 466689 - DNA, 25 bp, Mus musculus
tatcctcgtggaagccgtgcagtat

SEQ ID NO: 466690 - DNA, 25 bp, Mus musculus
tatcctcgttcagtgggccttgcca

SEQ ID NO: 466691 - DNA, 25 bp, Mus musculus
tatcctctaggactgggacatagtt

SEQ ID NO: 466692 - DNA, 25 bp, Mus musculus
tatcctctgagggtagacttgccac

SEQ ID NO: 466693 - DNA, 25 bp, Mus musculus
tatcctctgccttagaagaaatggg

SEQ ID NO: 466694 - DNA, 25 bp, Mus musculus
tatcctgaaggtcatcgtgtctggg

SEQ ID NO: 466695 - DNA, 25 bp, Mus musculus
tatcctgacagtgacaaacgccatg

SEQ ID NO: 466696 - DNA, 25 bp, Mus musculus
tatcctgacatcagcacccgtgagc

SEQ ID NO: 466697 - DNA, 25 bp, Mus musculus
tatcctgacccgtgctggtgagcag

SEQ ID NO: 466698 - DNA, 25 bp, Mus musculus
tatcctgagaaagaactagggccac

SEQ ID NO: 466699 - DNA, 25 bp, Mus musculus
tatcctgagagaccaaattgtgcct

SEQ ID NO: 466700 - DNA, 25 bp, Mus musculus
tatcctgagcgatttctggacagca

SEQ ID NO: 466701 - DNA, 25 bp, Mus musculus
tatcctgaggatcgaccctgagtgg

SEQ ID NO: 466702 - DNA, 25 bp, Mus musculus
tatcctgagggatcgaagccagtga

SEQ ID NO: 466703 - DNA, 25 bp, Mus musculus
tatcctgatgccaagaaagtcctgg

SEQ ID NO: 466704 - DNA, 25 bp, Mus musculus
tatcctgcacccttggtaatccgag

SEQ ID NO: 466705 - DNA, 25 bp, Mus musculus
tatcctgcagaatcgatggagtccc

SEQ ID NO: 466706 - DNA, 25 bp, Mus musculus
tatcctgcatgttctaggttgtgct

SEQ ID NO: 466707 - DNA, 25 bp, Mus musculus
tatcctgcctcacttaaatgattcc

SEQ ID NO: 466708 - DNA, 25 bp, Mus musculus
tatcctgcgacaccagaatctgctg

SEQ ID NO: 466709 - DNA, 25 bp, Mus musculus
tatcctgcgccctcctaagggctaa

SEQ ID NO: 466710 - DNA, 25 bp, Mus musculus
tatcctgctcggagagccaggtacc

SEQ ID NO: 466711 - DNA, 25 bp, Mus musculus
tatcctgcttatgagtcccattgcc

SEQ ID NO: 466712 - DNA, 25 bp, Mus musculus
tatcctggactggaagtttgaccgg

SEQ ID NO: 466713 - DNA, 25 bp, Mus musculus
tatcctggagagtcatttgcacaca

SEQ ID NO: 466714 - DNA, 25 bp, Mus musculus
tatcctggaggcatgaactagcctg

SEQ ID NO: 466715 - DNA, 25 bp, Mus musculus
tatcctgggcaagctgatcctgctg

SEQ ID NO: 466716 - DNA, 25 bp, Mus musculus
tatcctgggcgaaatactattgtcg

SEQ ID NO: 466717 - DNA, 25 bp, Mus musculus
tatcctggtaaggataccgggccag

SEQ ID NO: 466718 - DNA, 25 bp, Mus musculus
tatcctggttggagtgtcaatctac

SEQ ID NO: 466719 - DNA, 25 bp, Mus musculus
tatcctgtaaatgcatccaccctgg

SEQ ID NO: 466720 - DNA, 25 bp, Mus musculus
tatcctgtcattgtcagtagccggc

SEQ ID NO: 466721 - DNA, 25 bp, Mus musculus
tatcctgtgagttagtgagcccaag

SEQ ID NO: 466722 - DNA, 25 bp, Mus musculus
tatcctgtgggttggaggctctgct

SEQ ID NO: 466723 - DNA, 25 bp, Mus musculus
tatcctgttcatggtgtcctcgagc

SEQ ID NO: 466724 - DNA, 25 bp, Mus musculus
tatccttaaaggttctatagtccac

SEQ ID NO: 466725 - DNA, 25 bp, Mus musculus
tatccttaagctccatgccagatgg

SEQ ID NO: 466726 - DNA, 25 bp, Mus musculus
tatccttagtggaggttctcagcca

SEQ ID NO: 466727 - DNA, 25 bp, Mus musculus
tatccttatggagatggcaaccgcg

SEQ ID NO: 466728 - DNA, 25 bp, Mus musculus
tatccttattcagatagaaagccgg

SEQ ID NO: 466729 - DNA, 25 bp, Mus musculus
tatccttcacaacaggcagactgtg

SEQ ID NO: 466730 - DNA, 25 bp, Mus musculus
tatccttccactttccaggctggga

SEQ ID NO: 466731 - DNA, 25 bp, Mus musculus
tatccttcggagcatgtacaggtgc

SEQ ID NO: 466732 - DNA, 25 bp, Mus musculus
tatccttctggtagatggaacagca

SEQ ID NO: 466733 - DNA, 25 bp, Mus musculus
tatccttgctacaagtgtcctggcg

SEQ ID NO: 466734 - DNA, 25 bp, Mus musculus
tatccttggtgatgctagggcctaa

SEQ ID NO: 466735 - DNA, 25 bp, Mus musculus
tatccttgtaagtcccacgtgcaga

SEQ ID NO: 466736 - DNA, 25 bp, Mus musculus
tatcctttatttgcagccaggaggc

SEQ ID NO: 466737 - DNA, 25 bp, Mus musculus
tatcctttcggagctgttgcgcctc

SEQ ID NO: 466738 - DNA, 25 bp, Mus musculus
tatcctttctacctccatttctgag

SEQ ID NO: 466739 - DNA, 25 bp, Mus musculus
tatcctttgctatgtccggtggccg

SEQ ID NO: 466740 - DNA, 25 bp, Mus musculus
tatcctttggttgctgcttggctcc

SEQ ID NO: 466741 - DNA, 25 bp, Mus musculus
tatcgaaaagctgggctgcctaggc

SEQ ID NO: 466742 - DNA, 25 bp, Mus musculus
tatcgaaataaagacgccatgagcc

SEQ ID NO: 466743 - DNA, 25 bp, Mus musculus
tatcgaacctttgagctcggagaac

SEQ ID NO: 466744 - DNA, 25 bp, Mus musculus
tatcgaactcatgcagaccggctgc

SEQ ID NO: 466745 - DNA, 25 bp, Mus musculus
tatcgaagaacctctgaagcaccac

SEQ ID NO: 466746 - DNA, 25 bp, Mus musculus
tatcgaagtgttgcaaaaatgtccc

SEQ ID NO: 466747 - DNA, 25 bp, Mus musculus
tatcgaatacacaaggaactggacc

SEQ ID NO: 466748 - DNA, 25 bp, Mus musculus
tatcgacaacaataacggctgggac

SEQ ID NO: 466749 - DNA, 25 bp, Mus musculus
tatcgacatgtacgccatgggcctg

SEQ ID NO: 466750 - DNA, 25 bp, Mus musculus
tatcgaccggatggtagacctcacc

SEQ ID NO: 466751 - DNA, 25 bp, Mus musculus
tatcgacgaggagactagaatagag

SEQ ID NO: 466752 - DNA, 25 bp, Mus musculus
tatcgactgcgcgtatgcctattgc

SEQ ID NO: 466753 - DNA, 25 bp, Mus musculus
tatcgagaaacacccattgtcagag

SEQ ID NO: 466754 - DNA, 25 bp, Mus musculus
tatcgagaactaccaagatgctgct

SEQ ID NO: 466755 - DNA, 25 bp, Mus musculus
tatcgagaagagtcagagaacagcg

SEQ ID NO: 466756 - DNA, 25 bp, Mus musculus
tatcgagaccctacagcatttggct

SEQ ID NO: 466757 - DNA, 25 bp, Mus musculus
tatcgagcaggaacatgtgtacgga

SEQ ID NO: 466758 - DNA, 25 bp, Mus musculus
tatcgagccaaaaaactctccaggt

SEQ ID NO: 466759 - DNA, 25 bp, Mus musculus
tatcgatacaatggagaccaggcag

SEQ ID NO: 466760 - DNA, 25 bp, Mus musculus
tatcgatcaatagaccccgaggaag

SEQ ID NO: 466761 - DNA, 25 bp, Mus musculus
tatcgcagaaaacatccgccttggt

SEQ ID NO: 466762 - DNA, 25 bp, Mus musculus
tatcgcagacatcctaggtccgagc

SEQ ID NO: 466763 - DNA, 25 bp, Mus musculus
tatcgcagctctcaaatttccgggc

SEQ ID NO: 466764 - DNA, 25 bp, Mus musculus
tatcgcaggtaagaaagacccgcag

SEQ ID NO: 466765 - DNA, 25 bp, Mus musculus
tatcgcagttaccatagccatcgtg

SEQ ID NO: 466766 - DNA, 25 bp, Mus musculus
tatcgccaggaggacaagcatctat

SEQ ID NO: 466767 - DNA, 25 bp, Mus musculus
tatcgccctggatgtgctgtgctgc

SEQ ID NO: 466768 - DNA, 25 bp, Mus musculus
tatcgccgagtcctgccactcagga

SEQ ID NO: 466769 - DNA, 25 bp, Mus musculus
tatcgccgggcaggtgtccatagat

SEQ ID NO: 466770 - DNA, 25 bp, Mus musculus
tatcgcgagcgcaaggagaacgtgt

SEQ ID NO: 466771 - DNA, 25 bp, Mus musculus
tatcgcggatgaggtagaaattgcc

SEQ ID NO: 466772 - DNA, 25 bp, Mus musculus
tatcgctccctgttcaagaggacgc

SEQ ID NO: 466773 - DNA, 25 bp, Mus musculus
tatcgctgcagcttccggtttcgga

SEQ ID NO: 466774 - DNA, 25 bp, Mus musculus
tatcgctgtaggagatagcatccca

SEQ ID NO: 466775 - DNA, 25 bp, Mus musculus
tatcgctgttacaggtgccgggcac

SEQ ID NO: 466776 - DNA, 25 bp, Mus musculus
tatcggaagcctgaaaactattgac

SEQ ID NO: 466777 - DNA, 25 bp, Mus musculus
tatcggaagggtggaatcaggcttc

SEQ ID NO: 466778 - DNA, 25 bp, Mus musculus
tatcggaagtttgcagacgccatcc

SEQ ID NO: 466779 - DNA, 25 bp, Mus musculus
tatcggagcacactcagactgggca

SEQ ID NO: 466780 - DNA, 25 bp, Mus musculus
tatcggagccaggtatgtggcccaa

SEQ ID NO: 466781 - DNA, 25 bp, Mus musculus
tatcggatcaactttgctgtggcca

SEQ ID NO: 466782 - DNA, 25 bp, Mus musculus
tatcggatttggagggacactgcca

SEQ ID NO: 466783 - DNA, 25 bp, Mus musculus
tatcggcagcagagtgccgcagaga

SEQ ID NO: 466784 - DNA, 25 bp, Mus musculus
tatcggcagcgctcaatggaactgg

SEQ ID NO: 466785 - DNA, 25 bp, Mus musculus
tatcggcatctgcaagttcacggac

SEQ ID NO: 466786 - DNA, 25 bp, Mus musculus
tatcggcctcaaggtcagtggtcag

SEQ ID NO: 466787 - DNA, 25 bp, Mus musculus
tatcggccttgggacagcttaaacc

SEQ ID NO: 466788 - DNA, 25 bp, Mus musculus
tatcggctccacgtgaccttgagga

SEQ ID NO: 466789 - DNA, 25 bp, Mus musculus
tatcggctccttcgatgaggaagac

SEQ ID NO: 466790 - DNA, 25 bp, Mus musculus
tatcggctgacaaaaatttctctgt

SEQ ID NO: 466791 - DNA, 25 bp, Mus musculus
tatcgggacaataagcagggctggc

SEQ ID NO: 466792 - DNA, 25 bp, Mus musculus
tatcgggataatgccaaccaacagc

SEQ ID NO: 466793 - DNA, 25 bp, Mus musculus
tatcgggatgacctagggcgcttca

SEQ ID NO: 466794 - DNA, 25 bp, Mus musculus
tatcgggccctaagaagggactccg

SEQ ID NO: 466795 - DNA, 25 bp, Mus musculus
tatcgggctaatcaaactcaagcag

SEQ ID NO: 466796 - DNA, 25 bp, Mus musculus
tatcgggctccagaagtcatcctgg

SEQ ID NO: 466797 - DNA, 25 bp, Mus musculus
tatcgggctctaggtggctgcatcc

SEQ ID NO: 466798 - DNA, 25 bp, Mus musculus
tatcgggtacttcattcttcagacg

SEQ ID NO: 466799 - DNA, 25 bp, Mus musculus
tatcgggtcacagtctatcagacag

SEQ ID NO: 466800 - DNA, 25 bp, Mus musculus
tatcgggtgcctaagaacttcctgc

SEQ ID NO: 466801 - DNA, 25 bp, Mus musculus
tatcgggttttgctcctcactcaga

SEQ ID NO: 466802 - DNA, 25 bp, Mus musculus
tatcggtcattccacacacctaaaa

SEQ ID NO: 466803 - DNA, 25 bp, Mus musculus
tatcggtgccactgatacccaggct

SEQ ID NO: 466804 - DNA, 25 bp, Mus musculus
tatcggtgccatagccatgacagag

SEQ ID NO: 466805 - DNA, 25 bp, Mus musculus
tatcggtgggaattacactccggcc

SEQ ID NO: 466806 - DNA, 25 bp, Mus musculus
tatcggttttctacacagtggtcac

SEQ ID NO: 466807 - DNA, 25 bp, Mus musculus
tatcgtacctcagaccaaacgtggg

SEQ ID NO: 466808 - DNA, 25 bp, Mus musculus
tatcgtcgggctgatgatcaacgcc

SEQ ID NO: 466809 - DNA, 25 bp, Mus musculus
tatcgtctggaagcgaaggcaggat

SEQ ID NO: 466810 - DNA, 25 bp, Mus musculus
tatcgtgaagtctgtccgcagctgc

SEQ ID NO: 466811 - DNA, 25 bp, Mus musculus
tatcgtgatgtcaatggcaagaatt

SEQ ID NO: 466812 - DNA, 25 bp, Mus musculus
tatcgtgcagttcgtgcccttccga

SEQ ID NO: 466813 - DNA, 25 bp, Mus musculus
tatcgtggcagagtggagtgaccac

SEQ ID NO: 466814 - DNA, 25 bp, Mus musculus
tatcgtgggctaaagatatggtgca

SEQ ID NO: 466815 - DNA, 25 bp, Mus musculus
tatcgtgtgagtgtccctgaaaacc

SEQ ID NO: 466816 - DNA, 25 bp, Mus musculus
tatcgttactcttctcactcctttg

SEQ ID NO: 466817 - DNA, 25 bp, Mus musculus
tatcgttgaacctccaagtgttggc

SEQ ID NO: 466818 - DNA, 25 bp, Mus musculus
tatcgtttaaagagaaggaagcaca

SEQ ID NO: 466819 - DNA, 25 bp, Mus musculus
tatctaaaaccatcagctcttggct

SEQ ID NO: 466820 - DNA, 25 bp, Mus musculus
tatctaaacttgctttgcccggccg

SEQ ID NO: 466821 - DNA, 25 bp, Mus musculus
tatctaaatgagacaagagaaggtt

SEQ ID NO: 466822 - DNA, 25 bp, Mus musculus
tatctaacccaagaaggcgtggctt

SEQ ID NO: 466823 - DNA, 25 bp, Mus musculus
tatctaacttgcagaacagaggcca

SEQ ID NO: 466824 - DNA, 25 bp, Mus musculus
tatctaagcacttccctgaggatgg

SEQ ID NO: 466825 - DNA, 25 bp, Mus musculus
tatctaaggacgtggttttcctgag

SEQ ID NO: 466826 - DNA, 25 bp, Mus musculus
tatctaaggccaccctcagaagagg

SEQ ID NO: 466827 - DNA, 25 bp, Mus musculus
tatctaagtggatgcctcctaggcc

SEQ ID NO: 466828 - DNA, 25 bp, Mus musculus
tatctaattttgtttcatccatagg

SEQ ID NO: 466829 - DNA, 25 bp, Mus musculus
tatctacaatatctacctggaagcc

SEQ ID NO: 466830 - DNA, 25 bp, Mus musculus
tatctacagaaaacccatgagtgcg

SEQ ID NO: 466831 - DNA, 25 bp, Mus musculus
tatctacagagaggagaccctgcag

SEQ ID NO: 466832 - DNA, 25 bp, Mus musculus
tatctacaggacctagggttcccaa

SEQ ID NO: 466833 - DNA, 25 bp, Mus musculus
tatctaccgtaagttatggcagcac

SEQ ID NO: 466834 - DNA, 25 bp, Mus musculus
tatctacctgcggagtgaagccgtg

SEQ ID NO: 466835 - DNA, 25 bp, Mus musculus
tatctacgatgaaaaatgggccctt

SEQ ID NO: 466836 - DNA, 25 bp, Mus musculus
tatctacgcctaggagccatggcca

SEQ ID NO: 466837 - DNA, 25 bp, Mus musculus
tatctactccatgacagctgtggcc

SEQ ID NO: 466838 - DNA, 25 bp, Mus musculus
tatctactctgcagggatcatggca

SEQ ID NO: 466839 - DNA, 25 bp, Mus musculus
tatctactgaaaaatgaaccaacct

SEQ ID NO: 466840 - DNA, 25 bp, Mus musculus
tatctactgcagaggtgccgcgata

SEQ ID NO: 466841 - DNA, 25 bp, Mus musculus
tatctactggtggaaggcttgtgcc

SEQ ID NO: 466842 - DNA, 25 bp, Mus musculus
tatctacttccggaggcaggtggag

SEQ ID NO: 466843 - DNA, 25 bp, Mus musculus
tatctagagcctgcgcataactgga

SEQ ID NO: 466844 - DNA, 25 bp, Mus musculus
tatctagaggtcagtcttgaggtca

SEQ ID NO: 466845 - DNA, 25 bp, Mus musculus
tatctagcagagcaggtagaccagg

SEQ ID NO: 466846 - DNA, 25 bp, Mus musculus
tatctaggagcagttggccagtccg

SEQ ID NO: 466847 - DNA, 25 bp, Mus musculus
tatctagggccaaaacaggccaggg

SEQ ID NO: 466848 - DNA, 25 bp, Mus musculus
tatctaggtctgaaaacgtttgcgc

SEQ ID NO: 466849 - DNA, 25 bp, Mus musculus
tatctaggttttcctacatgccacc

SEQ ID NO: 466850 - DNA, 25 bp, Mus musculus
tatctagtgttgttcccgtggccag

SEQ ID NO: 466851 - DNA, 25 bp, Mus musculus
tatctagtttgaaccaggctgctgg

SEQ ID NO: 466852 - DNA, 25 bp, Mus musculus
tatctatgaatctcggccgctgggc

SEQ ID NO: 466853 - DNA, 25 bp, Mus musculus
tatctatgccgaaacgagtcttgac

SEQ ID NO: 466854 - DNA, 25 bp, Mus musculus
tatctatggttacaagtgatagcca

SEQ ID NO: 466855 - DNA, 25 bp, Mus musculus
tatctatgtacgtccaagctccagc

SEQ ID NO: 466856 - DNA, 25 bp, Mus musculus
tatctatgtcctagggtaattctat

SEQ ID NO: 466857 - DNA, 25 bp, Mus musculus
tatctattgcatgggaagatgctca

SEQ ID NO: 466858 - DNA, 25 bp, Mus musculus
tatctcaaaaacagagggagtctgg

SEQ ID NO: 466859 - DNA, 25 bp, Mus musculus
tatctcaaagttaaaggaatcctgg

SEQ ID NO: 466860 - DNA, 25 bp, Mus musculus
tatctcaacaatttctctacaccgg

SEQ ID NO: 466861 - DNA, 25 bp, Mus musculus
tatctcaacagcgaggccaacatcg

SEQ ID NO: 466862 - DNA, 25 bp, Mus musculus
tatctcaagccgtggtggatgcagg

SEQ ID NO: 466863 - DNA, 25 bp, Mus musculus
tatctcaagtctcaactgaactgcc

SEQ ID NO: 466864 - DNA, 25 bp, Mus musculus
tatctcaattgcagccggactcgac

SEQ ID NO: 466865 - DNA, 25 bp, Mus musculus
tatctcaccacttaggagactgagg

SEQ ID NO: 466866 - DNA, 25 bp, Mus musculus
tatctcacgaggattccagggctgg

SEQ ID NO: 466867 - DNA, 25 bp, Mus musculus
tatctcacgtgtgggaaagcgcagg

SEQ ID NO: 466868 - DNA, 25 bp, Mus musculus
tatctcagaaggatgcacgaggcac

SEQ ID NO: 466869 - DNA, 25 bp, Mus musculus
tatctcagagtggtggaactggcca

SEQ ID NO: 466870 - DNA, 25 bp, Mus musculus
tatctcagagttgtggctcaccggg

SEQ ID NO: 466871 - DNA, 25 bp, Mus musculus
tatctcagccagtaggtgccgagct

SEQ ID NO: 466872 - DNA, 25 bp, Mus musculus
tatctcagcgcaatgcaggtggccg

SEQ ID NO: 466873 - DNA, 25 bp, Mus musculus
tatctcagggacttgcgcatcgtgg

SEQ ID NO: 466874 - DNA, 25 bp, Mus musculus
tatctcagggcaagaaggctagaca

SEQ ID NO: 466875 - DNA, 25 bp, Mus musculus
tatctcaggggagctcctagtgtgg

SEQ ID NO: 466876 - DNA, 25 bp, Mus musculus
tatctcagttgcaatatttgctggg

SEQ ID NO: 466877 - DNA, 25 bp, Mus musculus
tatctcatcaggcatcagagggtcc

SEQ ID NO: 466878 - DNA, 25 bp, Mus musculus
tatctcatcccgttctgcaagacag

SEQ ID NO: 466879 - DNA, 25 bp, Mus musculus
tatctcatcggctccttggcggtca

SEQ ID NO: 466880 - DNA, 25 bp, Mus musculus
tatctcatgacgctgattgtgggca

SEQ ID NO: 466881 - DNA, 25 bp, Mus musculus
tatctcatggaagtggtagctcagg

SEQ ID NO: 466882 - DNA, 25 bp, Mus musculus
tatctccactcaacagcgtgtaggg

SEQ ID NO: 466883 - DNA, 25 bp, Mus musculus
tatctccagagtcttgtctgtactg

SEQ ID NO: 466884 - DNA, 25 bp, Mus musculus
tatctccaggaccaacggagcagaa

SEQ ID NO: 466885 - DNA, 25 bp, Mus musculus
tatctccattcgagaaccaagtgtt

SEQ ID NO: 466886 - DNA, 25 bp, Mus musculus
tatctcccatttgactgataactgg

SEQ ID NO: 466887 - DNA, 25 bp, Mus musculus
tatctcctattcctgtggctatctt

SEQ ID NO: 466888 - DNA, 25 bp, Mus musculus
tatctcctggcgaaggaaccttctc

SEQ ID NO: 466889 - DNA, 25 bp, Mus musculus
tatctccttccaagagctgggctgg

SEQ ID NO: 466890 - DNA, 25 bp, Mus musculus
tatctcgaaatgttagcgggtgttc

SEQ ID NO: 466891 - DNA, 25 bp, Mus musculus
tatctcgagaatcctggccagagga

SEQ ID NO: 466892 - DNA, 25 bp, Mus musculus
tatctcgcacctttagccattctag

SEQ ID NO: 466893 - DNA, 25 bp, Mus musculus
tatctcggtatgtaatcatggctca

SEQ ID NO: 466894 - DNA, 25 bp, Mus musculus
tatctcgtcagcaggagtggtccac

SEQ ID NO: 466895 - DNA, 25 bp, Mus musculus
tatctcgtgaggatttttggaggga

SEQ ID NO: 466896 - DNA, 25 bp, Mus musculus
tatctctaaaggaaccagtgcaccc

SEQ ID NO: 466897 - DNA, 25 bp, Mus musculus
tatctctaacacctagaaagaaaca

SEQ ID NO: 466898 - DNA, 25 bp, Mus musculus
tatctctaaggatacctgggctgcg

SEQ ID NO: 466899 - DNA, 25 bp, Mus musculus
tatctctacttttccagtctctgct

SEQ ID NO: 466900 - DNA, 25 bp, Mus musculus
tatctctcaacagaacccaggcttg

SEQ ID NO: 466901 - DNA, 25 bp, Mus musculus
tatctctctgagctgaaatcagccc

SEQ ID NO: 466902 - DNA, 25 bp, Mus musculus
tatctctgattgtgagagcatacag

SEQ ID NO: 466903 - DNA, 25 bp, Mus musculus
tatctctgctccataatgtgtgcaa

SEQ ID NO: 466904 - DNA, 25 bp, Mus musculus
tatctctgctggtgcttctccaaga

SEQ ID NO: 466905 - DNA, 25 bp, Mus musculus
tatctctgctgtcctcgctctgatg

SEQ ID NO: 466906 - DNA, 25 bp, Mus musculus
tatctctggtggaaagcagtccgat

SEQ ID NO: 466907 - DNA, 25 bp, Mus musculus
tatctctgtcaaaatgggcgctgca

SEQ ID NO: 466908 - DNA, 25 bp, Mus musculus
tatctcttcacagcgatggaatcca

SEQ ID NO: 466909 - DNA, 25 bp, Mus musculus
tatctcttcggttgggaccgacttc

SEQ ID NO: 466910 - DNA, 25 bp, Mus musculus
tatctctttctcaggtcacaggcag

SEQ ID NO: 466911 - DNA, 25 bp, Mus musculus
tatctcttttatcttttagcacgca

SEQ ID NO: 466912 - DNA, 25 bp, Mus musculus
tatctgaaaagccatgcaaagccaa

SEQ ID NO: 466913 - DNA, 25 bp, Mus musculus
tatctgaacctgtccgagaagcagg

SEQ ID NO: 466914 - DNA, 25 bp, Mus musculus
tatctgaagatttggagtgggccac

SEQ ID NO: 466915 - DNA, 25 bp, Mus musculus
tatctgaatcgaccaaggcctacct

SEQ ID NO: 466916 - DNA, 25 bp, Mus musculus
tatctgacatctctgggaagccggg

SEQ ID NO: 466917 - DNA, 25 bp, Mus musculus
tatctgacccagttcgaaagcctgg

SEQ ID NO: 466918 - DNA, 25 bp, Mus musculus
tatctgacctacaccaatggcggag

SEQ ID NO: 466919 - DNA, 25 bp, Mus musculus
tatctgacctacaccgccagtgtgg

SEQ ID NO: 466920 - DNA, 25 bp, Mus musculus
tatctgactccactgcaacagaagg

SEQ ID NO: 466921 - DNA, 25 bp, Mus musculus
tatctgagatggagaggtgtacacc

SEQ ID NO: 466922 - DNA, 25 bp, Mus musculus
tatctgagatgggtttgcacttaag

SEQ ID NO: 466923 - DNA, 25 bp, Mus musculus
tatctgagcaccctgtggaagaccc

SEQ ID NO: 466924 - DNA, 25 bp, Mus musculus
tatctgagcctaggttctctgggcc

SEQ ID NO: 466925 - DNA, 25 bp, Mus musculus
tatctgagcgactcattcatcagga

SEQ ID NO: 466926 - DNA, 25 bp, Mus musculus
tatctgagctgcaagacagaggccg

SEQ ID NO: 466927 - DNA, 25 bp, Mus musculus
tatctgaggtgctggtaaaagtcca

SEQ ID NO: 466928 - DNA, 25 bp, Mus musculus
tatctgagtgaataggcttcttccc

SEQ ID NO: 466929 - DNA, 25 bp, Mus musculus
tatctgagttccctcaagaacaagt

SEQ ID NO: 466930 - DNA, 25 bp, Mus musculus
tatctgatagctttggccattggag

SEQ ID NO: 466931 - DNA, 25 bp, Mus musculus
tatctgataggcgaggtgagacccc

SEQ ID NO: 466932 - DNA, 25 bp, Mus musculus
tatctgatcatctgtagaggctgag

SEQ ID NO: 466933 - DNA, 25 bp, Mus musculus
tatctgatcctgtccaactgtgaga

SEQ ID NO: 466934 - DNA, 25 bp, Mus musculus
tatctgatggcggttcagaaccacc

SEQ ID NO: 466935 - DNA, 25 bp, Mus musculus
tatctgattataaatgccttctgcc

SEQ ID NO: 466936 - DNA, 25 bp, Mus musculus
tatctgcacaaggactgtggcttcc

SEQ ID NO: 466937 - DNA, 25 bp, Mus musculus
tatctgcaccccatgttgaggcggc

SEQ ID NO: 466938 - DNA, 25 bp, Mus musculus
tatctgcagacattggttcccaggg

SEQ ID NO: 466939 - DNA, 25 bp, Mus musculus
tatctgcagaggtggtctcgctcaa

SEQ ID NO: 466940 - DNA, 25 bp, Mus musculus
tatctgcaggagaggtgtaaagcct

SEQ ID NO: 466941 - DNA, 25 bp, Mus musculus
tatctgcatcgcacatgagggcctg

SEQ ID NO: 466942 - DNA, 25 bp, Mus musculus
tatctgccagtctaacatcatgttc

SEQ ID NO: 466943 - DNA, 25 bp, Mus musculus
tatctgccatggagggaagcagtct

SEQ ID NO: 466944 - DNA, 25 bp, Mus musculus
tatctgccgaaatccagtgtgtgcc

SEQ ID NO: 466945 - DNA, 25 bp, Mus musculus
tatctgccgcacatactggtgggcc

SEQ ID NO: 466946 - DNA, 25 bp, Mus musculus
tatctgcctgtgagaaaaaccccac

SEQ ID NO: 466947 - DNA, 25 bp, Mus musculus
tatctgcgtggtaagtgggatgccc

SEQ ID NO: 466948 - DNA, 25 bp, Mus musculus
tatctgctaaagagccacatggacc

SEQ ID NO: 466949 - DNA, 25 bp, Mus musculus
tatctgctcaacatcgtcaatgtgg

SEQ ID NO: 466950 - DNA, 25 bp, Mus musculus
tatctgctcattgggctgcggctgc

SEQ ID NO: 466951 - DNA, 25 bp, Mus musculus
tatctgctgagcatttctgtactct

SEQ ID NO: 466952 - DNA, 25 bp, Mus musculus
tatctgctgaggactacctggtcca

SEQ ID NO: 466953 - DNA, 25 bp, Mus musculus
tatctgctgcattctcccgagctgg

SEQ ID NO: 466954 - DNA, 25 bp, Mus musculus
tatctgctgccagacaagcggaggc

SEQ ID NO: 466955 - DNA, 25 bp, Mus musculus
tatctgctggctacatcgttctgga

SEQ ID NO: 466956 - DNA, 25 bp, Mus musculus
tatctgctgtctgcccttgtagcct

SEQ ID NO: 466957 - DNA, 25 bp, Mus musculus
tatctgcttccctatgagtcgcggg

SEQ ID NO: 466958 - DNA, 25 bp, Mus musculus
tatctggaacagtcgagtaagctgc

SEQ ID NO: 466959 - DNA, 25 bp, Mus musculus
tatctggaagacagtccggctctca

SEQ ID NO: 466960 - DNA, 25 bp, Mus musculus
tatctggacactcttgagacgaaca

SEQ ID NO: 466961 - DNA, 25 bp, Mus musculus
tatctggaccgatacagggacagtc

SEQ ID NO: 466962 - DNA, 25 bp, Mus musculus
tatctggacctgagcacaaatggca

SEQ ID NO: 466963 - DNA, 25 bp, Mus musculus
tatctggagatttttctaatgctgg

SEQ ID NO: 466964 - DNA, 25 bp, Mus musculus
tatctggagctggtcggcaattccc

SEQ ID NO: 466965 - DNA, 25 bp, Mus musculus
tatctggaggccagtaagggacctc

SEQ ID NO: 466966 - DNA, 25 bp, Mus musculus
tatctggagtcgtatggcttggagc

SEQ ID NO: 466967 - DNA, 25 bp, Mus musculus
tatctggccagtaccggatgctagc

SEQ ID NO: 466968 - DNA, 25 bp, Mus musculus
tatctggccgtagttctgctggagc

SEQ ID NO: 466969 - DNA, 25 bp, Mus musculus
tatctggccgtgctgtctaaccgct

SEQ ID NO: 466970 - DNA, 25 bp, Mus musculus
tatctggcgctgactgaggctgtga

SEQ ID NO: 466971 - DNA, 25 bp, Mus musculus
tatctggctcatggcagctggagga

SEQ ID NO: 466972 - DNA, 25 bp, Mus musculus
tatctggctctactccttggcatgg

SEQ ID NO: 466973 - DNA, 25 bp, Mus musculus
tatctgggcaagttggagctatccc

SEQ ID NO: 466974 - DNA, 25 bp, Mus musculus
tatctgggccacgtgctacacatcg

SEQ ID NO: 466975 - DNA, 25 bp, Mus musculus
tatctgggccattgacagggcagga

SEQ ID NO: 466976 - DNA, 25 bp, Mus musculus
tatctgggttcgttttcctcttgga

SEQ ID NO: 466977 - DNA, 25 bp, Mus musculus
tatctggtctttgcccaaggacagc

SEQ ID NO: 466978 - DNA, 25 bp, Mus musculus
tatctggtgatcacacgtccactgg

SEQ ID NO: 466979 - DNA, 25 bp, Mus musculus
tatctggttatttcccaaacgtagt

SEQ ID NO: 466980 - DNA, 25 bp, Mus musculus
tatctgtaaagtactggtgcccgtg

SEQ ID NO: 466981 - DNA, 25 bp, Mus musculus
tatctgtaattgacacctgctagca

SEQ ID NO: 466982 - DNA, 25 bp, Mus musculus
tatctgtacagtggccacacggtca

SEQ ID NO: 466983 - DNA, 25 bp, Mus musculus
tatctgtcaccgctgggaggtcact

SEQ ID NO: 466984 - DNA, 25 bp, Mus musculus
tatctgtcacgtgtcaggaaccctg

SEQ ID NO: 466985 - DNA, 25 bp, Mus musculus
tatctgtcaggcaagagctgctgtg

SEQ ID NO: 466986 - DNA, 25 bp, Mus musculus
tatctgtccctgtgtcagcagagga

SEQ ID NO: 466987 - DNA, 25 bp, Mus musculus
tatctgtcctgcctgcggatggcga

SEQ ID NO: 466988 - DNA, 25 bp, Mus musculus
tatctgtcggtgtgcgaacgcctga

SEQ ID NO: 466989 - DNA, 25 bp, Mus musculus
tatctgtgaatactgagcctcgccc

SEQ ID NO: 466990 - DNA, 25 bp, Mus musculus
tatctgtgacaagacggacgaagac

SEQ ID NO: 466991 - DNA, 25 bp, Mus musculus
tatctgtgaggctaccctctcgacg

SEQ ID NO: 466992 - DNA, 25 bp, Mus musculus
tatctgtgagtcgagagctcagctc

SEQ ID NO: 466993 - DNA, 25 bp, Mus musculus
tatctgtgcaaactgagccattggg

SEQ ID NO: 466994 - DNA, 25 bp, Mus musculus
tatctgtgcctgtacatggagaaag

SEQ ID NO: 466995 - DNA, 25 bp, Mus musculus
tatctgtgggtcgtttgtgtatccc

SEQ ID NO: 466996 - DNA, 25 bp, Mus musculus
tatctgtgtcagaacgggtgctcgg

SEQ ID NO: 466997 - DNA, 25 bp, Mus musculus
tatctgtgttccttcgtgggtggca

SEQ ID NO: 466998 - DNA, 25 bp, Mus musculus
tatctgtttctgatagaatctttga

SEQ ID NO: 466999 - DNA, 25 bp, Mus musculus
tatcttaaaattatacgaccttggt

SEQ ID NO: 467000 - DNA, 25 bp, Mus musculus
tatcttaaactgacctctggcagag

SEQ ID NO: 467001 - DNA, 25 bp, Mus musculus
tatcttaaccgaagctcaggtcccc

SEQ ID NO: 467002 - DNA, 25 bp, Mus musculus
tatcttactaatgactcgggaggag

SEQ ID NO: 467003 - DNA, 25 bp, Mus musculus
tatcttagaccatcttggtgtccct

SEQ ID NO: 467004 - DNA, 25 bp, Mus musculus
tatcttagagatgggaccaaatgcc

SEQ ID NO: 467005 - DNA, 25 bp, Mus musculus
tatcttagataacccttcctccagg

SEQ ID NO: 467006 - DNA, 25 bp, Mus musculus
tatcttaggcggttcagatcccgga

SEQ ID NO: 467007 - DNA, 25 bp, Mus musculus
tatcttatgatgctgtcaccctgag

SEQ ID NO: 467008 - DNA, 25 bp, Mus musculus
tatcttcaggctgttcctcgggtgg

SEQ ID NO: 467009 - DNA, 25 bp, Mus musculus
tatcttccagaacctgaatcgccgg

SEQ ID NO: 467010 - DNA, 25 bp, Mus musculus
tatcttccagcaagaggtgggctct

SEQ ID NO: 467011 - DNA, 25 bp, Mus musculus
tatcttccatattaatgaggtagtg

SEQ ID NO: 467012 - DNA, 25 bp, Mus musculus
tatcttcggcatgttcggcatcgtg

SEQ ID NO: 467013 - DNA, 25 bp, Mus musculus
tatcttctaccagacaccaaggcgt

SEQ ID NO: 467014 - DNA, 25 bp, Mus musculus
tatcttctggtgtccgtgtccggca

SEQ ID NO: 467015 - DNA, 25 bp, Mus musculus
tatcttgctgctcaagggtgcgcgc

SEQ ID NO: 467016 - DNA, 25 bp, Mus musculus
tatcttgctgctcaggtagcggcct

SEQ ID NO: 467017 - DNA, 25 bp, Mus musculus
tatcttggaataagaaactgccctg

SEQ ID NO: 467018 - DNA, 25 bp, Mus musculus
tatcttggaccctgcataggacaaa

SEQ ID NO: 467019 - DNA, 25 bp, Mus musculus
tatcttggatttgcgaggaacactg

SEQ ID NO: 467020 - DNA, 25 bp, Mus musculus
tatcttggcattggcccggcaggga

SEQ ID NO: 467021 - DNA, 25 bp, Mus musculus
tatcttggcccaccaggagcagatg

SEQ ID NO: 467022 - DNA, 25 bp, Mus musculus
tatcttggccgtcggatgcacgttg

SEQ ID NO: 467023 - DNA, 25 bp, Mus musculus
tatcttggcgggatccggtacctct

SEQ ID NO: 467024 - DNA, 25 bp, Mus musculus
tatcttggctcactgatgcagaagg

SEQ ID NO: 467025 - DNA, 25 bp, Mus musculus
tatcttgggaattggagaccggcac

SEQ ID NO: 467026 - DNA, 25 bp, Mus musculus
tatcttggtcggcaatgaggaacag

SEQ ID NO: 467027 - DNA, 25 bp, Mus musculus
tatcttggtggagctactggtggac

SEQ ID NO: 467028 - DNA, 25 bp, Mus musculus
tatcttgtcaagctgccaggaggga

SEQ ID NO: 467029 - DNA, 25 bp, Mus musculus
tatcttgtctgtcccaggcacctct

SEQ ID NO: 467030 - DNA, 25 bp, Mus musculus
tatcttgtgagtactgggccatcca

SEQ ID NO: 467031 - DNA, 25 bp, Mus musculus
tatctttacataggacaccagcggg

SEQ ID NO: 467032 - DNA, 25 bp, Mus musculus
tatctttagaggaggccggagaaag

SEQ ID NO: 467033 - DNA, 25 bp, Mus musculus
tatctttatgcttcaatgctttccc

SEQ ID NO: 467034 - DNA, 25 bp, Mus musculus
tatctttctgaatgatgaatcttcc

SEQ ID NO: 467035 - DNA, 25 bp, Mus musculus
tatctttctgctcgtgcctggaaca

SEQ ID NO: 467036 - DNA, 25 bp, Mus musculus
tatctttgcaaccacgcagtaggag

SEQ ID NO: 467037 - DNA, 25 bp, Mus musculus
tatctttgcagctttagtcggtgcc

SEQ ID NO: 467038 - DNA, 25 bp, Mus musculus
tatctttgcattctttccaaccaac

SEQ ID NO: 467039 - DNA, 25 bp, Mus musculus
tatctttgcctggagaacgggctgc

SEQ ID NO: 467040 - DNA, 25 bp, Mus musculus
tatctttggacatagcttaggcagc

SEQ ID NO: 467041 - DNA, 25 bp, Mus musculus
tatctttggtcttcctgatcagcgg

SEQ ID NO: 467042 - DNA, 25 bp, Mus musculus
tatctttgtcaaggaacgttgccgg

SEQ ID NO: 467043 - DNA, 25 bp, Mus musculus
tatctttgtctggtaatcatgcaca

SEQ ID NO: 467044 - DNA, 25 bp, Mus musculus
tatcttttcaaggaccccaggaaag

SEQ ID NO: 467045 - DNA, 25 bp, Mus musculus
tatcttttcacgtgataccattctg

SEQ ID NO: 467046 - DNA, 25 bp, Mus musculus
tatctttttccctaacgactgacaa

SEQ ID NO: 467047 - DNA, 25 bp, Mus musculus
tatctttttctatggttgcacatgc

SEQ ID NO: 467048 - DNA, 25 bp, Mus musculus
tatgaaaaaacttgtgaacaacttc

SEQ ID NO: 467049 - DNA, 25 bp, Mus musculus
tatgaaaacgatcccaaacagctgg

SEQ ID NO: 467050 - DNA, 25 bp, Mus musculus
tatgaaaactcattagctccacagc

SEQ ID NO: 467051 - DNA, 25 bp, Mus musculus
tatgaaaagggacgatcaagtagtc

SEQ ID NO: 467052 - DNA, 25 bp, Mus musculus
tatgaaaagtgccaagaccctctag

SEQ ID NO: 467053 - DNA, 25 bp, Mus musculus
tatgaaaatctctcaggcttacggc

SEQ ID NO: 467054 - DNA, 25 bp, Mus musculus
tatgaaacacttggagaacctgtcc

SEQ ID NO: 467055 - DNA, 25 bp, Mus musculus
tatgaaacccctgagagattgtacc

SEQ ID NO: 467056 - DNA, 25 bp, Mus musculus
tatgaaacgaaagcagcagcggacc

SEQ ID NO: 467057 - DNA, 25 bp, Mus musculus
tatgaaacgtttggaatccggccac

SEQ ID NO: 467058 - DNA, 25 bp, Mus musculus
tatgaaactcagctccgcagataca

SEQ ID NO: 467059 - DNA, 25 bp, Mus musculus
tatgaaagcaagttgggctcctcgg

SEQ ID NO: 467060 - DNA, 25 bp, Mus musculus
tatgaaagccatcttacctccaaga

SEQ ID NO: 467061 - DNA, 25 bp, Mus musculus
tatgaaaggcccaacttctccgggc

SEQ ID NO: 467062 - DNA, 25 bp, Mus musculus
tatgaaagtacctcccctgagtgtg

SEQ ID NO: 467063 - DNA, 25 bp, Mus musculus
tatgaaatagaagtgctggccacgg

SEQ ID NO: 467064 - DNA, 25 bp, Mus musculus
tatgaaatcaagtaccgacgtctgg

SEQ ID NO: 467065 - DNA, 25 bp, Mus musculus
tatgaaatccaaagctagggtagca

SEQ ID NO: 467066 - DNA, 25 bp, Mus musculus
tatgaaatgcacaagatgacccggg

SEQ ID NO: 467067 - DNA, 25 bp, Mus musculus
tatgaaattaagttcagggccccgg

SEQ ID NO: 467068 - DNA, 25 bp, Mus musculus
tatgaaattgtgatccgagaagacg

SEQ ID NO: 467069 - DNA, 25 bp, Mus musculus
tatgaacaaatcgtgaccggagtgg

SEQ ID NO: 467070 - DNA, 25 bp, Mus musculus
tatgaacaacgtggaacaatgggca

SEQ ID NO: 467071 - DNA, 25 bp, Mus musculus
tatgaacaactgtcccaacgcgaga

SEQ ID NO: 467072 - DNA, 25 bp, Mus musculus
tatgaacaagttgggacagcccagt

SEQ ID NO: 467073 - DNA, 25 bp, Mus musculus
tatgaacacgaacatcagctaagga

SEQ ID NO: 467074 - DNA, 25 bp, Mus musculus
tatgaacagcccgtcctggagggaa

SEQ ID NO: 467075 - DNA, 25 bp, Mus musculus
tatgaacagttccaagcagccagtg

SEQ ID NO: 467076 - DNA, 25 bp, Mus musculus
tatgaaccaggagatcacgaaagcc

SEQ ID NO: 467077 - DNA, 25 bp, Mus musculus
tatgaacctaccaaagcggacagct

SEQ ID NO: 467078 - DNA, 25 bp, Mus musculus
tatgaacctgcaggccacgttgaac

SEQ ID NO: 467079 - DNA, 25 bp, Mus musculus
tatgaacgcactgtgctacgcagct

SEQ ID NO: 467080 - DNA, 25 bp, Mus musculus
tatgaacggtgagggccatctccta

SEQ ID NO: 467081 - DNA, 25 bp, Mus musculus
tatgaactatgggtccacatcaggg

SEQ ID NO: 467082 - DNA, 25 bp, Mus musculus
tatgaactccatccatttgcactgt

SEQ ID NO: 467083 - DNA, 25 bp, Mus musculus
tatgaactgcttggaaactcccagc

SEQ ID NO: 467084 - DNA, 25 bp, Mus musculus
tatgaactgtcatgtgccacctgag

SEQ ID NO: 467085 - DNA, 25 bp, Mus musculus
tatgaagaaaattggtaccctgtac

SEQ ID NO: 467086 - DNA, 25 bp, Mus musculus
tatgaagaacatgctgccacagaag

SEQ ID NO: 467087 - DNA, 25 bp, Mus musculus
tatgaagaacgagtgcccggtgcta

SEQ ID NO: 467088 - DNA, 25 bp, Mus musculus
tatgaagaattctaccaaggagttt

SEQ ID NO: 467089 - DNA, 25 bp, Mus musculus
tatgaagacaggcacagagccgtct

SEQ ID NO: 467090 - DNA, 25 bp, Mus musculus
tatgaagacaggtccactgactgga

SEQ ID NO: 467091 - DNA, 25 bp, Mus musculus
tatgaagactatagtgtccttgaac

SEQ ID NO: 467092 - DNA, 25 bp, Mus musculus
tatgaagagatatatccgcccgacg

SEQ ID NO: 467093 - DNA, 25 bp, Mus musculus
tatgaagagtttcaagtaatcacca

SEQ ID NO: 467094 - DNA, 25 bp, Mus musculus
tatgaagatgcccaccatggtgccc

SEQ ID NO: 467095 - DNA, 25 bp, Mus musculus
tatgaagcaagcaataacagccctg

SEQ ID NO: 467096 - DNA, 25 bp, Mus musculus
tatgaagcagtacaagggcgtccct

SEQ ID NO: 467097 - DNA, 25 bp, Mus musculus
tatgaagccaggtatgtagaagcta

SEQ ID NO: 467098 - DNA, 25 bp, Mus musculus
tatgaagcccaggatcccgagattg

SEQ ID NO: 467099 - DNA, 25 bp, Mus musculus
tatgaagccctcttgaacatcaagg

SEQ ID NO: 467100 - DNA, 25 bp, Mus musculus
tatgaagccgctacctatgatgtcc

SEQ ID NO: 467101 - DNA, 25 bp, Mus musculus
tatgaagcgcagtatctaggaatcg

SEQ ID NO: 467102 - DNA, 25 bp, Mus musculus
tatgaagctaaaatacagtggttac

SEQ ID NO: 467103 - DNA, 25 bp, Mus musculus
tatgaagctctaatcgggccagtct

SEQ ID NO: 467104 - DNA, 25 bp, Mus musculus
tatgaagcttgattgcccctgggaa

SEQ ID NO: 467105 - DNA, 25 bp, Mus musculus
tatgaaggcaaaggctccatggctg

SEQ ID NO: 467106 - DNA, 25 bp, Mus musculus
tatgaaggccacttcgaggacgatc

SEQ ID NO: 467107 - DNA, 25 bp, Mus musculus
tatgaaggccttgagagccgtgacg

SEQ ID NO: 467108 - DNA, 25 bp, Mus musculus
tatgaaggctacaaccccactgtga

SEQ ID NO: 467109 - DNA, 25 bp, Mus musculus
tatgaagggccagatgctccagtct

SEQ ID NO: 467110 - DNA, 25 bp, Mus musculus
tatgaaggtagctaaccgagccagc

SEQ ID NO: 467111 - DNA, 25 bp, Mus musculus
tatgaaggtagtctttgctctgtcc

SEQ ID NO: 467112 - DNA, 25 bp, Mus musculus
tatgaaggtctgaaggtcaatacac

SEQ ID NO: 467113 - DNA, 25 bp, Mus musculus
tatgaaggtggacttgaagctgccc

SEQ ID NO: 467114 - DNA, 25 bp, Mus musculus
tatgaaggttactccctgcctcacg

SEQ ID NO: 467115 - DNA, 25 bp, Mus musculus
tatgaagtccaaggtggagaacccc

SEQ ID NO: 467116 - DNA, 25 bp, Mus musculus
tatgaagtccagcacatccgtggtg

SEQ ID NO: 467117 - DNA, 25 bp, Mus musculus
tatgaagtctgtctacctccagccc

SEQ ID NO: 467118 - DNA, 25 bp, Mus musculus
tatgaagtgcacagggaaactaagc

SEQ ID NO: 467119 - DNA, 25 bp, Mus musculus
tatgaataactgtgtggcccctctg

SEQ ID NO: 467120 - DNA, 25 bp, Mus musculus
tatgaatacttatggaggtcagccg

SEQ ID NO: 467121 - DNA, 25 bp, Mus musculus
tatgaatagcaaagtggaatctccc

SEQ ID NO: 467122 - DNA, 25 bp, Mus musculus
tatgaatatacatgttggaaaaggg

SEQ ID NO: 467123 - DNA, 25 bp, Mus musculus
tatgaatatatccacccggctgacc

SEQ ID NO: 467124 - DNA, 25 bp, Mus musculus
tatgaatccggtactgctgctcagt

SEQ ID NO: 467125 - DNA, 25 bp, Mus musculus
tatgaatcgatactctgcccagaag

SEQ ID NO: 467126 - DNA, 25 bp, Mus musculus
tatgaatcgcacaacaaccctgcag

SEQ ID NO: 467127 - DNA, 25 bp, Mus musculus
tatgaatgagtacctgttgtccagg

SEQ ID NO: 467128 - DNA, 25 bp, Mus musculus
tatgaatgggcatgtaacagaggaa

SEQ ID NO: 467129 - DNA, 25 bp, Mus musculus
tatgaatgggcgaatgaaacaactg

SEQ ID NO: 467130 - DNA, 25 bp, Mus musculus
tatgaatggtgaaggttggatctgt

SEQ ID NO: 467131 - DNA, 25 bp, Mus musculus
tatgaatgtgcaccagcgaaaccct

SEQ ID NO: 467132 - DNA, 25 bp, Mus musculus
tatgaattacagcagagtgcctgcc

SEQ ID NO: 467133 - DNA, 25 bp, Mus musculus
tatgaattcacaatcctgcctcggt

SEQ ID NO: 467134 - DNA, 25 bp, Mus musculus
tatgaattcagcacagaacttggaa

SEQ ID NO: 467135 - DNA, 25 bp, Mus musculus
tatgaattcctgcactacctgctag

SEQ ID NO: 467136 - DNA, 25 bp, Mus musculus
tatgaatttcctctggccccagtgc

SEQ ID NO: 467137 - DNA, 25 bp, Mus musculus
tatgaatttcgagtggtggcgacca

SEQ ID NO: 467138 - DNA, 25 bp, Mus musculus
tatgaatttgcagagacccgatggt

SEQ ID NO: 467139 - DNA, 25 bp, Mus musculus
tatgacaaactatgatgaggcggcc

SEQ ID NO: 467140 - DNA, 25 bp, Mus musculus
tatgacaactggtgagtcccctcag

SEQ ID NO: 467141 - DNA, 25 bp, Mus musculus
tatgacaacttccagtgtccccgga

SEQ ID NO: 467142 - DNA, 25 bp, Mus musculus
tatgacaaggcccatggagcactga

SEQ ID NO: 467143 - DNA, 25 bp, Mus musculus
tatgacaatcatgtgccgacaccgc

SEQ ID NO: 467144 - DNA, 25 bp, Mus musculus
tatgacaattcaaacactgcacggt

SEQ ID NO: 467145 - DNA, 25 bp, Mus musculus
tatgacacacctgagcttcggacgt

SEQ ID NO: 467146 - DNA, 25 bp, Mus musculus
tatgacacccggatactggtagcac

SEQ ID NO: 467147 - DNA, 25 bp, Mus musculus
tatgacacctggacaagaagctgac

SEQ ID NO: 467148 - DNA, 25 bp, Mus musculus
tatgacacggctatcagccttttgg

SEQ ID NO: 467149 - DNA, 25 bp, Mus musculus
tatgacagaagggtgatccgaggca

SEQ ID NO: 467150 - DNA, 25 bp, Mus musculus
tatgacagagaccagcaaaagtgcc

SEQ ID NO: 467151 - DNA, 25 bp, Mus musculus
tatgacagagcagtagaagcctttg

SEQ ID NO: 467152 - DNA, 25 bp, Mus musculus
tatgacagagccaaggaactggacc

SEQ ID NO: 467153 - DNA, 25 bp, Mus musculus
tatgacagatatggagaacaaggcc

SEQ ID NO: 467154 - DNA, 25 bp, Mus musculus
tatgacagccccagacatggtaggt

SEQ ID NO: 467155 - DNA, 25 bp, Mus musculus
tatgacagtaaaagagtcaatcact

SEQ ID NO: 467156 - DNA, 25 bp, Mus musculus
tatgacagtaccaaagaagagccct

SEQ ID NO: 467157 - DNA, 25 bp, Mus musculus
tatgacataaaagagggacagatgc

SEQ ID NO: 467158 - DNA, 25 bp, Mus musculus
tatgacatctccgtactgcccagaa

SEQ ID NO: 467159 - DNA, 25 bp, Mus musculus
tatgacatggagacagagagtggcc

SEQ ID NO: 467160 - DNA, 25 bp, Mus musculus
tatgacatgtgaggtgaagttgccc

SEQ ID NO: 467161 - DNA, 25 bp, Mus musculus
tatgacattcgcttgcggccggact

SEQ ID NO: 467162 - DNA, 25 bp, Mus musculus
tatgaccaagcacagttcggcaggg

SEQ ID NO: 467163 - DNA, 25 bp, Mus musculus
tatgaccacgtgttcgctgagaaga

SEQ ID NO: 467164 - DNA, 25 bp, Mus musculus
tatgaccactagagatgttgaggga

SEQ ID NO: 467165 - DNA, 25 bp, Mus musculus
tatgaccagagcacacgagatgcca

SEQ ID NO: 467166 - DNA, 25 bp, Mus musculus
tatgaccagagctcacttcaggccg

SEQ ID NO: 467167 - DNA, 25 bp, Mus musculus
tatgaccagcttgggactgagcctt

SEQ ID NO: 467168 - DNA, 25 bp, Mus musculus
tatgaccagtgcctagaggagaacg

SEQ ID NO: 467169 - DNA, 25 bp, Mus musculus
tatgacccagaagaaggctggcctt

SEQ ID NO: 467170 - DNA, 25 bp, Mus musculus
tatgacccctgaggtaccagaggat

SEQ ID NO: 467171 - DNA, 25 bp, Mus musculus
tatgacccggtatgaaaggactctg

SEQ ID NO: 467172 - DNA, 25 bp, Mus musculus
tatgaccctgagcacggagatgtcc

SEQ ID NO: 467173 - DNA, 25 bp, Mus musculus
tatgaccgactcctgaaagaacact

SEQ ID NO: 467174 - DNA, 25 bp, Mus musculus
tatgaccgcgcgctgaaaattgaga

SEQ ID NO: 467175 - DNA, 25 bp, Mus musculus
tatgaccgcttgctggagacctgct

SEQ ID NO: 467176 - DNA, 25 bp, Mus musculus
tatgaccggcacctatgcaggacag

SEQ ID NO: 467177 - DNA, 25 bp, Mus musculus
tatgaccgggagttcctactggaca

SEQ ID NO: 467178 - DNA, 25 bp, Mus musculus
tatgaccgggatgtggcttctgcaa

SEQ ID NO: 467179 - DNA, 25 bp, Mus musculus
tatgacctagtggagggccagactt

SEQ ID NO: 467180 - DNA, 25 bp, Mus musculus
tatgacctgaacatgaacggaccct

SEQ ID NO: 467181 - DNA, 25 bp, Mus musculus
tatgacctgcaagtggctcagagac

SEQ ID NO: 467182 - DNA, 25 bp, Mus musculus
tatgacctgcgtgtcgatgctatcc

SEQ ID NO: 467183 - DNA, 25 bp, Mus musculus
tatgacctgtcttcactttcaatac

SEQ ID NO: 467184 - DNA, 25 bp, Mus musculus
tatgaccttaagtgggagttcccga

SEQ ID NO: 467185 - DNA, 25 bp, Mus musculus
tatgacgaggatgccagtgcaatgc

SEQ ID NO: 467186 - DNA, 25 bp, Mus musculus
tatgacgcccatgttttcagccagc

SEQ ID NO: 467187 - DNA, 25 bp, Mus musculus
tatgacgccgtcaatgctgatactg

SEQ ID NO: 467188 - DNA, 25 bp, Mus musculus
tatgacgcctctggcaggatcagga

SEQ ID NO: 467189 - DNA, 25 bp, Mus musculus
tatgacggcgagttttctgcagaca

SEQ ID NO: 467190 - DNA, 25 bp, Mus musculus
tatgacggctctatatgtgcttcca

SEQ ID NO: 467191 - DNA, 25 bp, Mus musculus
tatgacggtgtgataacctggaccc

SEQ ID NO: 467192 - DNA, 25 bp, Mus musculus
tatgacgtgattgtgactgcccggg

SEQ ID NO: 467193 - DNA, 25 bp, Mus musculus
tatgacgtgtgcagcatcttgctcg

SEQ ID NO: 467194 - DNA, 25 bp, Mus musculus
tatgacgttgtggaactgccctacc

SEQ ID NO: 467195 - DNA, 25 bp, Mus musculus
tatgactacgaacccccctattacg

SEQ ID NO: 467196 - DNA, 25 bp, Mus musculus
tatgactactatgggcagcaaaggg

SEQ ID NO: 467197 - DNA, 25 bp, Mus musculus
tatgactactgtgggctgcgtgcca

SEQ ID NO: 467198 - DNA, 25 bp, Mus musculus
tatgactagggctcgggaagagtta

SEQ ID NO: 467199 - DNA, 25 bp, Mus musculus
tatgactatgactccagtggaaagc

SEQ ID NO: 467200 - DNA, 25 bp, Mus musculus
tatgactatgcgtggctggaaccac

SEQ ID NO: 467201 - DNA, 25 bp, Mus musculus
tatgactcctgtgtgctgacgctgt

SEQ ID NO: 467202 - DNA, 25 bp, Mus musculus
tatgactcgggctatgtgacctggc

SEQ ID NO: 467203 - DNA, 25 bp, Mus musculus
tatgactcggtgcaaagtagtggcc

SEQ ID NO: 467204 - DNA, 25 bp, Mus musculus
tatgactgaacactttacaccctgg

SEQ ID NO: 467205 - DNA, 25 bp, Mus musculus
tatgactgaactctatgaaaaacga

SEQ ID NO: 467206 - DNA, 25 bp, Mus musculus
tatgactgacaagacacgggcttca

SEQ ID NO: 467207 - DNA, 25 bp, Mus musculus
tatgactgatccttatgggccaccg

SEQ ID NO: 467208 - DNA, 25 bp, Mus musculus
tatgactgcaaagatggaaacgacc

SEQ ID NO: 467209 - DNA, 25 bp, Mus musculus
tatgactgcaacatcgaagcccgag

SEQ ID NO: 467210 - DNA, 25 bp, Mus musculus
tatgactgcacttacggtggtggag

SEQ ID NO: 467211 - DNA, 25 bp, Mus musculus
tatgactgcgacttggaacagctca

SEQ ID NO: 467212 - DNA, 25 bp, Mus musculus
tatgactgcgcactgaaggtggcta

SEQ ID NO: 467213 - DNA, 25 bp, Mus musculus
tatgactgcggccacgtgcaaaaga

SEQ ID NO: 467214 - DNA, 25 bp, Mus musculus
tatgactgcggtggaggccccagca

SEQ ID NO: 467215 - DNA, 25 bp, Mus musculus
tatgactggcccctctagtaagcag

SEQ ID NO: 467216 - DNA, 25 bp, Mus musculus
tatgactggccctaagaccttgata

SEQ ID NO: 467217 - DNA, 25 bp, Mus musculus
tatgactgggctcttctccccacaa

SEQ ID NO: 467218 - DNA, 25 bp, Mus musculus
tatgactgtggacagaaacccgccg

SEQ ID NO: 467219 - DNA, 25 bp, Mus musculus
tatgacttagttgcacagtacttgc

SEQ ID NO: 467220 - DNA, 25 bp, Mus musculus
tatgacttggccatcagtgttgcca

SEQ ID NO: 467221 - DNA, 25 bp, Mus musculus
tatgactttcgacctgagatctctg

SEQ ID NO: 467222 - DNA, 25 bp, Mus musculus
tatgactttgacaggttctctcgcc

SEQ ID NO: 467223 - DNA, 25 bp, Mus musculus
tatgactttgtggacagaggccgag

SEQ ID NO: 467224 - DNA, 25 bp, Mus musculus
tatgagaaaaactctgagggcaccg

SEQ ID NO: 467225 - DNA, 25 bp, Mus musculus
tatgagaaagcatctgcacacccac

SEQ ID NO: 467226 - DNA, 25 bp, Mus musculus
tatgagaacgacaaggactgtgccc

SEQ ID NO: 467227 - DNA, 25 bp, Mus musculus
tatgagaacgactccaaccttgggc

SEQ ID NO: 467228 - DNA, 25 bp, Mus musculus
tatgagaactatgggtccacggccg

SEQ ID NO: 467229 - DNA, 25 bp, Mus musculus
tatgagaactgttgtatccctcccc

SEQ ID NO: 467230 - DNA, 25 bp, Mus musculus
tatgagaagccagcactgacactgt

SEQ ID NO: 467231 - DNA, 25 bp, Mus musculus
tatgagaaggcctccaaacgcatga

SEQ ID NO: 467232 - DNA, 25 bp, Mus musculus
tatgagaatatgcaggagtcccagg

SEQ ID NO: 467233 - DNA, 25 bp, Mus musculus
tatgagaatctgcaggagcttaact

SEQ ID NO: 467234 - DNA, 25 bp, Mus musculus
tatgagacaaacaaagtcacccgga

SEQ ID NO: 467235 - DNA, 25 bp, Mus musculus
tatgagacagaactagccatgcgcc

SEQ ID NO: 467236 - DNA, 25 bp, Mus musculus
tatgagaccaaaggagaacgagacc

SEQ ID NO: 467237 - DNA, 25 bp, Mus musculus
tatgagaccctacagatggcccaga

SEQ ID NO: 467238 - DNA, 25 bp, Mus musculus
tatgagacctcgctcaaggtgggca

SEQ ID NO: 467239 - DNA, 25 bp, Mus musculus
tatgagacggtggacatcagcagca

SEQ ID NO: 467240 - DNA, 25 bp, Mus musculus
tatgagagcacactgaaggcactgg

SEQ ID NO: 467241 - DNA, 25 bp, Mus musculus
tatgagagccactacaacactacag

SEQ ID NO: 467242 - DNA, 25 bp, Mus musculus
tatgagaggcacaatgcggagatcg

SEQ ID NO: 467243 - DNA, 25 bp, Mus musculus
tatgagaggtcctaaaggctggagt

SEQ ID NO: 467244 - DNA, 25 bp, Mus musculus
tatgagagtcctggcatctaccgag

SEQ ID NO: 467245 - DNA, 25 bp, Mus musculus
tatgagataccttcgcagcctgttc

SEQ ID NO: 467246 - DNA, 25 bp, Mus musculus
tatgagatagtgatgctctgcgggc

SEQ ID NO: 467247 - DNA, 25 bp, Mus musculus
tatgagatgaaagaccgggtgacct

SEQ ID NO: 467248 - DNA, 25 bp, Mus musculus
tatgagatgcctgcgtttactgccg

SEQ ID NO: 467249 - DNA, 25 bp, Mus musculus
tatgagattcggagtgaccacagcc

SEQ ID NO: 467250 - DNA, 25 bp, Mus musculus
tatgagcaacaagttcaccattggc

SEQ ID NO: 467251 - DNA, 25 bp, Mus musculus
tatgagcaacgtcttccaggaggtg

SEQ ID NO: 467252 - DNA, 25 bp, Mus musculus
tatgagcaactcgtgtggaaatgtc

SEQ ID NO: 467253 - DNA, 25 bp, Mus musculus
tatgagcacataggatacacaacct

SEQ ID NO: 467254 - DNA, 25 bp, Mus musculus
tatgagcaccgaaccagctgtctgc

SEQ ID NO: 467255 - DNA, 25 bp, Mus musculus
tatgagcacggaagcgggaagatcc

SEQ ID NO: 467256 - DNA, 25 bp, Mus musculus
tatgagcactttcgcaaggagctgg

SEQ ID NO: 467257 - DNA, 25 bp, Mus musculus
tatgagcaggtcctagagaatctcc

SEQ ID NO: 467258 - DNA, 25 bp, Mus musculus
tatgagcatgagatggagcgccttg

SEQ ID NO: 467259 - DNA, 25 bp, Mus musculus
tatgagccacgcaacggcaagttca

SEQ ID NO: 467260 - DNA, 25 bp, Mus musculus
tatgagccacgggaagagaaccgac

SEQ ID NO: 467261 - DNA, 25 bp, Mus musculus
tatgagccatcaaagaagcccagcc

SEQ ID NO: 467262 - DNA, 25 bp, Mus musculus
tatgagccatccagttgtgtcccca

SEQ ID NO: 467263 - DNA, 25 bp, Mus musculus
tatgagcctcggatggaaagacaga

SEQ ID NO: 467264 - DNA, 25 bp, Mus musculus
tatgagcctctcaaaatgggttcca

SEQ ID NO: 467265 - DNA, 25 bp, Mus musculus
tatgagcctgcagagggcatttcac

SEQ ID NO: 467266 - DNA, 25 bp, Mus musculus
tatgagcgaggagacttcccaatcg

SEQ ID NO: 467267 - DNA, 25 bp, Mus musculus
tatgagcgcagaagaaacggagcat

SEQ ID NO: 467268 - DNA, 25 bp, Mus musculus
tatgagcgtaccagtgaccacaaga

SEQ ID NO: 467269 - DNA, 25 bp, Mus musculus
tatgagcgtttccagttggcgccac

SEQ ID NO: 467270 - DNA, 25 bp, Mus musculus
tatgagctacaacagcaaggcacga

SEQ ID NO: 467271 - DNA, 25 bp, Mus musculus
tatgagctacccaactaccgtggca

SEQ ID NO: 467272 - DNA, 25 bp, Mus musculus
tatgagctatatctcttgctgtggt

SEQ ID NO: 467273 - DNA, 25 bp, Mus musculus
tatgagctcatgcttggatgctggc

SEQ ID NO: 467274 - DNA, 25 bp, Mus musculus
tatgagctccgggttgccctaagca

SEQ ID NO: 467275 - DNA, 25 bp, Mus musculus
tatgagctctcttcagatctgcaag

SEQ ID NO: 467276 - DNA, 25 bp, Mus musculus
tatgagctgacgaagatgtgcacga

SEQ ID NO: 467277 - DNA, 25 bp, Mus musculus
tatgagctgcaatcgtcagaaggca

SEQ ID NO: 467278 - DNA, 25 bp, Mus musculus
tatgagctgccccattgacaaaagg

SEQ ID NO: 467279 - DNA, 25 bp, Mus musculus
tatgagctgctctcatggccaggca

SEQ ID NO: 467280 - DNA, 25 bp, Mus musculus
tatgagctttcctatgcccgggagc

SEQ ID NO: 467281 - DNA, 25 bp, Mus musculus
tatgaggaaacttctgctaggccag

SEQ ID NO: 467282 - DNA, 25 bp, Mus musculus
tatgaggaaagaatggctcgccgcc

SEQ ID NO: 467283 - DNA, 25 bp, Mus musculus
tatgaggacacaagaccccttcctg

SEQ ID NO: 467284 - DNA, 25 bp, Mus musculus
tatgaggacactcacctgtgatcgc

SEQ ID NO: 467285 - DNA, 25 bp, Mus musculus
tatgaggaccagtatggtgtctccc

SEQ ID NO: 467286 - DNA, 25 bp, Mus musculus
tatgaggacggctgcaagactgttg

SEQ ID NO: 467287 - DNA, 25 bp, Mus musculus
tatgaggagcacctagagcgcatga

SEQ ID NO: 467288 - DNA, 25 bp, Mus musculus
tatgaggagttcaagaaggccctgg

SEQ ID NO: 467289 - DNA, 25 bp, Mus musculus
tatgaggattccaatggccgcgctg

SEQ ID NO: 467290 - DNA, 25 bp, Mus musculus
tatgaggcactgagctccgtgcagc

SEQ ID NO: 467291 - DNA, 25 bp, Mus musculus
tatgaggccaaagccaaatgcaccc

SEQ ID NO: 467292 - DNA, 25 bp, Mus musculus
tatgaggccaagagtgcacgtgcac

SEQ ID NO: 467293 - DNA, 25 bp, Mus musculus
tatgaggcctcagagtacaggcgca

SEQ ID NO: 467294 - DNA, 25 bp, Mus musculus
tatgaggccttacctgagagtgtca

SEQ ID NO: 467295 - DNA, 25 bp, Mus musculus
tatgaggccttgacccaaattccgg

SEQ ID NO: 467296 - DNA, 25 bp, Mus musculus
tatgaggctcacaacacggacagtg

SEQ ID NO: 467297 - DNA, 25 bp, Mus musculus
tatgaggctgcatctccgggagaac

SEQ ID NO: 467298 - DNA, 25 bp, Mus musculus
tatgaggctgctgggacactggtaa

SEQ ID NO: 467299 - DNA, 25 bp, Mus musculus
tatgaggctgtgcagagaaccatcc

SEQ ID NO: 467300 - DNA, 25 bp, Mus musculus
tatgaggcttcagctttcagcctgc

SEQ ID NO: 467301 - DNA, 25 bp, Mus musculus
tatgagggcatcaccttcgaggact

SEQ ID NO: 467302 - DNA, 25 bp, Mus musculus
tatgagggccatcttcacacgctat

SEQ ID NO: 467303 - DNA, 25 bp, Mus musculus
tatgagggctggaaggactccatcc

SEQ ID NO: 467304 - DNA, 25 bp, Mus musculus
tatgagggtcttgagtgtcctggac

SEQ ID NO: 467305 - DNA, 25 bp, Mus musculus
tatgaggtcttagcaaacggatccc

SEQ ID NO: 467306 - DNA, 25 bp, Mus musculus
tatgaggtgaccgtgcagcctactg

SEQ ID NO: 467307 - DNA, 25 bp, Mus musculus
tatgaggtgagacactgagaagcct

SEQ ID NO: 467308 - DNA, 25 bp, Mus musculus
tatgaggtgctacccaatggctgcg

SEQ ID NO: 467309 - DNA, 25 bp, Mus musculus
tatgaggtgctccaagcttcagaca

SEQ ID NO: 467310 - DNA, 25 bp, Mus musculus
tatgaggtgcttacagtcagggcca

SEQ ID NO: 467311 - DNA, 25 bp, Mus musculus
tatgaggtggacatcaatgggcctg

SEQ ID NO: 467312 - DNA, 25 bp, Mus musculus
tatgaggtgggtcaactcagctgtc

SEQ ID NO: 467313 - DNA, 25 bp, Mus musculus
tatgagtaccttatcagttatgtct

SEQ ID NO: 467314 - DNA, 25 bp, Mus musculus
tatgagtacgatgacctgaagcaga

SEQ ID NO: 467315 - DNA, 25 bp, Mus musculus
tatgagtatttgctctggacctgag

SEQ ID NO: 467316 - DNA, 25 bp, Mus musculus
tatgagtccctgatgcactacgggc

SEQ ID NO: 467317 - DNA, 25 bp, Mus musculus
tatgagtctccctgtcctgcaagtc

SEQ ID NO: 467318 - DNA, 25 bp, Mus musculus
tatgagtctggctacagccggcagc

SEQ ID NO: 467319 - DNA, 25 bp, Mus musculus
tatgagtgcctgatgcaagccatcg

SEQ ID NO: 467320 - DNA, 25 bp, Mus musculus
tatgagtgtaaagccaagaagttcc

SEQ ID NO: 467321 - DNA, 25 bp, Mus musculus
tatgagtgtgcagcgaccaatgcgc

SEQ ID NO: 467322 - DNA, 25 bp, Mus musculus
tatgagttgacaccatgttgcatgc

SEQ ID NO: 467323 - DNA, 25 bp, Mus musculus
tatgagtttacacaggacgtacggc

SEQ ID NO: 467324 - DNA, 25 bp, Mus musculus
tatgataaactcagccgagccctgc

SEQ ID NO: 467325 - DNA, 25 bp, Mus musculus
tatgataaccggcttcgacctggac

SEQ ID NO: 467326 - DNA, 25 bp, Mus musculus
tatgataagacgatcgcggctgtgt

SEQ ID NO: 467327 - DNA, 25 bp, Mus musculus
tatgatacatccagcaagcctaggc

SEQ ID NO: 467328 - DNA, 25 bp, Mus musculus
tatgataccctgctacagatggagt

SEQ ID NO: 467329 - DNA, 25 bp, Mus musculus
tatgataggcagtataggccggtcc

SEQ ID NO: 467330 - DNA, 25 bp, Mus musculus
tatgatatcaaacacagcgacctgg

SEQ ID NO: 467331 - DNA, 25 bp, Mus musculus
tatgatatgcggactgacaggaaca

SEQ ID NO: 467332 - DNA, 25 bp, Mus musculus
tatgatatttgctcttgttgatcag

SEQ ID NO: 467333 - DNA, 25 bp, Mus musculus
tatgatcaaaaagatgcctgggtcc

SEQ ID NO: 467334 - DNA, 25 bp, Mus musculus
tatgatcaccgttgttccagagcac

SEQ ID NO: 467335 - DNA, 25 bp, Mus musculus
tatgatcagacagctggctccagga

SEQ ID NO: 467336 - DNA, 25 bp, Mus musculus
tatgatcagcaagactggcgaggct

SEQ ID NO: 467337 - DNA, 25 bp, Mus musculus
tatgatcaggcactcggagagcacg

SEQ ID NO: 467338 - DNA, 25 bp, Mus musculus
tatgatcataacgtccagaagtctg

SEQ ID NO: 467339 - DNA, 25 bp, Mus musculus
tatgatccgggttgccaatatgcgg

SEQ ID NO: 467340 - DNA, 25 bp, Mus musculus
tatgatccgtctgaggaacccctgg

SEQ ID NO: 467341 - DNA, 25 bp, Mus musculus
tatgatcgaccccttgggaacttcg

SEQ ID NO: 467342 - DNA, 25 bp, Mus musculus
tatgatcgccataggaaaattgtgt

SEQ ID NO: 467343 - DNA, 25 bp, Mus musculus
tatgatcggatgaaggctgctcaga

SEQ ID NO: 467344 - DNA, 25 bp, Mus musculus
tatgatcggttcctcaacccggatg

SEQ ID NO: 467345 - DNA, 25 bp, Mus musculus
tatgatctagggaatagcggcacct

SEQ ID NO: 467346 - DNA, 25 bp, Mus musculus
tatgatctcaagtccaagagtggcc

SEQ ID NO: 467347 - DNA, 25 bp, Mus musculus
tatgatctcagcactcgaggagcag

SEQ ID NO: 467348 - DNA, 25 bp, Mus musculus
tatgatctccatctccctaggttac

SEQ ID NO: 467349 - DNA, 25 bp, Mus musculus
tatgatctctcaaacctcggaaggt

SEQ ID NO: 467350 - DNA, 25 bp, Mus musculus
tatgatctggtgtcatgctggccaa

SEQ ID NO: 467351 - DNA, 25 bp, Mus musculus
tatgatcttgcctcgctgaaagcag

SEQ ID NO: 467352 - DNA, 25 bp, Mus musculus
tatgatcttggtgctgcggacagcc

SEQ ID NO: 467353 - DNA, 25 bp, Mus musculus
tatgatgaagatgcggccattggtc

SEQ ID NO: 467354 - DNA, 25 bp, Mus musculus
tatgatgaaggaagccagtgggccc

SEQ ID NO: 467355 - DNA, 25 bp, Mus musculus
tatgatgaagttccgtgaagaccgc

SEQ ID NO: 467356 - DNA, 25 bp, Mus musculus
tatgatgacatagacttccgagatg

SEQ ID NO: 467357 - DNA, 25 bp, Mus musculus
tatgatgagacgttccgaccactcg

SEQ ID NO: 467358 - DNA, 25 bp, Mus musculus
tatgatgagcagacactttaacgac

SEQ ID NO: 467359 - DNA, 25 bp, Mus musculus
tatgatgagtacagcaaaggctacc

SEQ ID NO: 467360 - DNA, 25 bp, Mus musculus
tatgatgatgaaagaactctagagg

SEQ ID NO: 467361 - DNA, 25 bp, Mus musculus
tatgatgattgccaaagacaggaac

SEQ ID NO: 467362 - DNA, 25 bp, Mus musculus
tatgatgcatcaagaacggcggttc

SEQ ID NO: 467363 - DNA, 25 bp, Mus musculus
tatgatgccaacaagaagcaccgcg

SEQ ID NO: 467364 - DNA, 25 bp, Mus musculus
tatgatgccgcgtcctgcagatacc

SEQ ID NO: 467365 - DNA, 25 bp, Mus musculus
tatgatgcgagccaactgcctggtc

SEQ ID NO: 467366 - DNA, 25 bp, Mus musculus
tatgatgctcggctgcagcgttgcc

SEQ ID NO: 467367 - DNA, 25 bp, Mus musculus
tatgatgctggaagggacggcttta

SEQ ID NO: 467368 - DNA, 25 bp, Mus musculus
tatgatgctggaggatgtggtccca

SEQ ID NO: 467369 - DNA, 25 bp, Mus musculus
tatgatgggattgacgggctcccgc

SEQ ID NO: 467370 - DNA, 25 bp, Mus musculus
tatgatgggcccagtactagcagtg

SEQ ID NO: 467371 - DNA, 25 bp, Mus musculus
tatgatgggcgatctcctgttaaac

SEQ ID NO: 467372 - DNA, 25 bp, Mus musculus
tatgatgggtacgacagctcggcac

SEQ ID NO: 467373 - DNA, 25 bp, Mus musculus
tatgatgtcccatgttgtccaccag

SEQ ID NO: 467374 - DNA, 25 bp, Mus musculus
tatgatgtcctcattaggcccaggc

SEQ ID NO: 467375 - DNA, 25 bp, Mus musculus
tatgatgtctgaagacccactcgga

SEQ ID NO: 467376 - DNA, 25 bp, Mus musculus
tatgatgtgatcgagcaccccatgg

SEQ ID NO: 467377 - DNA, 25 bp, Mus musculus
tatgatgtgattgtgaccgctcgcg

SEQ ID NO: 467378 - DNA, 25 bp, Mus musculus
tatgatgtgcttgccagagatccga

SEQ ID NO: 467379 - DNA, 25 bp, Mus musculus
tatgatgtggtgtccctagagcacg

SEQ ID NO: 467380 - DNA, 25 bp, Mus musculus
tatgatgtgtctcctctggtggcca

SEQ ID NO: 467381 - DNA, 25 bp, Mus musculus
tatgatgttagcaacctggaccagg

SEQ ID NO: 467382 - DNA, 25 bp, Mus musculus
tatgatgttgagttcacccaggccc

SEQ ID NO: 467383 - DNA, 25 bp, Mus musculus
tatgattaacgggacagacggagac

SEQ ID NO: 467384 - DNA, 25 bp, Mus musculus
tatgattacccatttgtcagccagg

SEQ ID NO: 467385 - DNA, 25 bp, Mus musculus
tatgattagccaaggcccactgggc

SEQ ID NO: 467386 - DNA, 25 bp, Mus musculus
tatgattgccccagagtccaacgtg

SEQ ID NO: 467387 - DNA, 25 bp, Mus musculus
tatgattggatacactgggctccag

SEQ ID NO: 467388 - DNA, 25 bp, Mus musculus
tatgattgtatttgacacagtgtcc

SEQ ID NO: 467389 - DNA, 25 bp, Mus musculus
tatgatttcccaactagagcaaggg

SEQ ID NO: 467390 - DNA, 25 bp, Mus musculus
tatgatttctcttgattcaggcgag

SEQ ID NO: 467391 - DNA, 25 bp, Mus musculus
tatgatttgccacatctgaggaaca

SEQ ID NO: 467392 - DNA, 25 bp, Mus musculus
tatgcaaaacttggaactgtctttc

SEQ ID NO: 467393 - DNA, 25 bp, Mus musculus
tatgcaaacccaggcaagaacgcgt

SEQ ID NO: 467394 - DNA, 25 bp, Mus musculus
tatgcaaagcacacatcccgtgttc

SEQ ID NO: 467395 - DNA, 25 bp, Mus musculus
tatgcaaatcggagaccctggtgca

SEQ ID NO: 467396 - DNA, 25 bp, Mus musculus
tatgcaaattcaacgaggctagctg

SEQ ID NO: 467397 - DNA, 25 bp, Mus musculus
tatgcaacagcttcgtgatacaagg

SEQ ID NO: 467398 - DNA, 25 bp, Mus musculus
tatgcaacggccaagtgcttcccga

SEQ ID NO: 467399 - DNA, 25 bp, Mus musculus
tatgcaactactcgagtcttaccgg

SEQ ID NO: 467400 - DNA, 25 bp, Mus musculus
tatgcaactagaaaccttgagcacg

SEQ ID NO: 467401 - DNA, 25 bp, Mus musculus
tatgcaactcgagaagatgccccag

SEQ ID NO: 467402 - DNA, 25 bp, Mus musculus
tatgcaagaaagtgagcgaacccca

SEQ ID NO: 467403 - DNA, 25 bp, Mus musculus
tatgcaagatcggttgcgccttggg

SEQ ID NO: 467404 - DNA, 25 bp, Mus musculus
tatgcaagcattcgccaaggagcct

SEQ ID NO: 467405 - DNA, 25 bp, Mus musculus
tatgcaagcgagaagaggactctgg

SEQ ID NO: 467406 - DNA, 25 bp, Mus musculus
tatgcaagtaagagaggacggtcac

SEQ ID NO: 467407 - DNA, 25 bp, Mus musculus
tatgcaagtgggtacatgccctccc

SEQ ID NO: 467408 - DNA, 25 bp, Mus musculus
tatgcaatctgaacatggaaagacc

SEQ ID NO: 467409 - DNA, 25 bp, Mus musculus
tatgcacaaatacagccgggagctt

SEQ ID NO: 467410 - DNA, 25 bp, Mus musculus
tatgcacaatgaccaaaggccatgc

SEQ ID NO: 467411 - DNA, 25 bp, Mus musculus
tatgcacacactcagaaatggttcc

SEQ ID NO: 467412 - DNA, 25 bp, Mus musculus
tatgcacacagatgaatccaaggga

SEQ ID NO: 467413 - DNA, 25 bp, Mus musculus
tatgcacacctgtcttcagcctttg

SEQ ID NO: 467414 - DNA, 25 bp, Mus musculus
tatgcacagctacttggtcaccaga

SEQ ID NO: 467415 - DNA, 25 bp, Mus musculus
tatgcacaggcattggaccatccac

SEQ ID NO: 467416 - DNA, 25 bp, Mus musculus
tatgcacaggttccatgcacctgcg

SEQ ID NO: 467417 - DNA, 25 bp, Mus musculus
tatgcacaggttttggctcaacagc

SEQ ID NO: 467418 - DNA, 25 bp, Mus musculus
tatgcacagtgctgctctgcggagg

SEQ ID NO: 467419 - DNA, 25 bp, Mus musculus
tatgcacagttcatccgactgctcg

SEQ ID NO: 467420 - DNA, 25 bp, Mus musculus
tatgcacagttgatgacaaacaatg

SEQ ID NO: 467421 - DNA, 25 bp, Mus musculus
tatgcacatgagcacgtaggacacg

SEQ ID NO: 467422 - DNA, 25 bp, Mus musculus
tatgcacattcgctgagtactgcgc

SEQ ID NO: 467423 - DNA, 25 bp, Mus musculus
tatgcacatttcaacagacactctg

SEQ ID NO: 467424 - DNA, 25 bp, Mus musculus
tatgcaccattattgatcctagcgc

SEQ ID NO: 467425 - DNA, 25 bp, Mus musculus
tatgcaccgggttcacattcaccag

SEQ ID NO: 467426 - DNA, 25 bp, Mus musculus
tatgcactcgggagagagacgactc

SEQ ID NO: 467427 - DNA, 25 bp, Mus musculus
tatgcactctgctcctggattttcc

SEQ ID NO: 467428 - DNA, 25 bp, Mus musculus
tatgcactctggtgccacgtcggca

SEQ ID NO: 467429 - DNA, 25 bp, Mus musculus
tatgcactggccctgccaagcttgg

SEQ ID NO: 467430 - DNA, 25 bp, Mus musculus
tatgcagaacataagagtcaccgag

SEQ ID NO: 467431 - DNA, 25 bp, Mus musculus
tatgcagaactgtgccagggcatcg

SEQ ID NO: 467432 - DNA, 25 bp, Mus musculus
tatgcagaatgggacttaagagaca

SEQ ID NO: 467433 - DNA, 25 bp, Mus musculus
tatgcagacgtggagaaccgcgtac

SEQ ID NO: 467434 - DNA, 25 bp, Mus musculus
tatgcagacgttgaaagactttgga

SEQ ID NO: 467435 - DNA, 25 bp, Mus musculus
tatgcagagcttctcgatgacggct

SEQ ID NO: 467436 - DNA, 25 bp, Mus musculus
tatgcagagcttgggtctgatatct

SEQ ID NO: 467437 - DNA, 25 bp, Mus musculus
tatgcagaggtagcacacctaagcg

SEQ ID NO: 467438 - DNA, 25 bp, Mus musculus
tatgcagatactggaagagatagag

SEQ ID NO: 467439 - DNA, 25 bp, Mus musculus
tatgcagatgaccatgctatcggct

SEQ ID NO: 467440 - DNA, 25 bp, Mus musculus
tatgcagatgagatacacatttccc

SEQ ID NO: 467441 - DNA, 25 bp, Mus musculus
tatgcagattctgtataatcccaat

SEQ ID NO: 467442 - DNA, 25 bp, Mus musculus
tatgcagcaggtaggccaaggtctt

SEQ ID NO: 467443 - DNA, 25 bp, Mus musculus
tatgcagcagttttacgggatccca

SEQ ID NO: 467444 - DNA, 25 bp, Mus musculus
tatgcagcatattcctcaggaggca

SEQ ID NO: 467445 - DNA, 25 bp, Mus musculus
tatgcagccaaggaaggcgatccgg

SEQ ID NO: 467446 - DNA, 25 bp, Mus musculus
tatgcagccagtgggtgaaaatgat

SEQ ID NO: 467447 - DNA, 25 bp, Mus musculus
tatgcagccatgaaccgccagtttc

SEQ ID NO: 467448 - DNA, 25 bp, Mus musculus
tatgcagcccaaaaagccaggcttt

SEQ ID NO: 467449 - DNA, 25 bp, Mus musculus
tatgcagcccctgaagtcttcgagg

SEQ ID NO: 467450 - DNA, 25 bp, Mus musculus
tatgcagcgacagagaaaacttcct

SEQ ID NO: 467451 - DNA, 25 bp, Mus musculus
tatgcagcttgcgaacagcgactgg

SEQ ID NO: 467452 - DNA, 25 bp, Mus musculus
tatgcaggaaagaatgactcaccgt

SEQ ID NO: 467453 - DNA, 25 bp, Mus musculus
tatgcaggaacagactctccaaagg

SEQ ID NO: 467454 - DNA, 25 bp, Mus musculus
tatgcaggacaggtgggctttctga

SEQ ID NO: 467455 - DNA, 25 bp, Mus musculus
tatgcaggcagcagcactgggatct

SEQ ID NO: 467456 - DNA, 25 bp, Mus musculus
tatgcaggcctggtcaatgggtccg

SEQ ID NO: 467457 - DNA, 25 bp, Mus musculus
tatgcaggcttcttctataacggct

SEQ ID NO: 467458 - DNA, 25 bp, Mus musculus
tatgcagggacaagagaaccacagc

SEQ ID NO: 467459 - DNA, 25 bp, Mus musculus
tatgcagggcatgacaacacaaagc

SEQ ID NO: 467460 - DNA, 25 bp, Mus musculus
tatgcagggccttcttcacagccac

SEQ ID NO: 467461 - DNA, 25 bp, Mus musculus
tatgcagggtgtgcaggaaacagcc

SEQ ID NO: 467462 - DNA, 25 bp, Mus musculus
tatgcaggttgactgcccacaggca

SEQ ID NO: 467463 - DNA, 25 bp, Mus musculus
tatgcagtcctgaaggtgagcctca

SEQ ID NO: 467464 - DNA, 25 bp, Mus musculus
tatgcagtcgtagcctatcgccaag

SEQ ID NO: 467465 - DNA, 25 bp, Mus musculus
tatgcagtgaagtgcacctcgctgg

SEQ ID NO: 467466 - DNA, 25 bp, Mus musculus
tatgcagtgatgtccacccagctga

SEQ ID NO: 467467 - DNA, 25 bp, Mus musculus
tatgcagtgcgctctaacatcagtg

SEQ ID NO: 467468 - DNA, 25 bp, Mus musculus
tatgcagttgtctttgtgctgggcc

SEQ ID NO: 467469 - DNA, 25 bp, Mus musculus
tatgcatcagctaaatggacacaca

SEQ ID NO: 467470 - DNA, 25 bp, Mus musculus
tatgcatcattaatctccaggctag

SEQ ID NO: 467471 - DNA, 25 bp, Mus musculus
tatgcatgagccaaactgttgcgat

SEQ ID NO: 467472 - DNA, 25 bp, Mus musculus
tatgcatgctgtcagccaatgcgac

SEQ ID NO: 467473 - DNA, 25 bp, Mus musculus
tatgcatggcattcagaaacaggga

SEQ ID NO: 467474 - DNA, 25 bp, Mus musculus
tatgcatgtattggatggttccccg

SEQ ID NO: 467475 - DNA, 25 bp, Mus musculus
tatgcattttaggagaacggagccc

SEQ ID NO: 467476 - DNA, 25 bp, Mus musculus
tatgccaaatgagaaagctgtcagg

SEQ ID NO: 467477 - DNA, 25 bp, Mus musculus
tatgccaagagaaactggtgctgcg

SEQ ID NO: 467478 - DNA, 25 bp, Mus musculus
tatgccaagcctgcgagcaaacagg

SEQ ID NO: 467479 - DNA, 25 bp, Mus musculus
tatgccaagtatggctccctgcggg

SEQ ID NO: 467480 - DNA, 25 bp, Mus musculus
tatgccaatgcaatgaaaaacctcg

SEQ ID NO: 467481 - DNA, 25 bp, Mus musculus
tatgccacagaacagtacccagagt

SEQ ID NO: 467482 - DNA, 25 bp, Mus musculus
tatgccaccatgtctaccaactgga

SEQ ID NO: 467483 - DNA, 25 bp, Mus musculus
tatgccaccgtatggacagggacca

SEQ ID NO: 467484 - DNA, 25 bp, Mus musculus
tatgccacgaatgctcagagaggcg

SEQ ID NO: 467485 - DNA, 25 bp, Mus musculus
tatgccactacgtggtgtcccggga

SEQ ID NO: 467486 - DNA, 25 bp, Mus musculus
tatgccactgagaaatactcccggg

SEQ ID NO: 467487 - DNA, 25 bp, Mus musculus
tatgccagaccagagaggtgagaca

SEQ ID NO: 467488 - DNA, 25 bp, Mus musculus
tatgccagaggccactacaccatcg

SEQ ID NO: 467489 - DNA, 25 bp, Mus musculus
tatgccagcaacagcgtgatcctgc

SEQ ID NO: 467490 - DNA, 25 bp, Mus musculus
tatgccagcagcgacgatagtgagc

SEQ ID NO: 467491 - DNA, 25 bp, Mus musculus
tatgccagggcccactttaggaggc

SEQ ID NO: 467492 - DNA, 25 bp, Mus musculus
tatgccagtagctgagaagcggctc

SEQ ID NO: 467493 - DNA, 25 bp, Mus musculus
tatgccagtcaaaagaaaacgttcg

SEQ ID NO: 467494 - DNA, 25 bp, Mus musculus
tatgccagtctcatgtgctgctctc

SEQ ID NO: 467495 - DNA, 25 bp, Mus musculus
tatgccatatgtccagatcttcgaa

SEQ ID NO: 467496 - DNA, 25 bp, Mus musculus
tatgccatgaccaccacactgagtg

SEQ ID NO: 467497 - DNA, 25 bp, Mus musculus
tatgccatgcgttggaaacagcacc

SEQ ID NO: 467498 - DNA, 25 bp, Mus musculus
tatgccatgctggaactaacgcccg

SEQ ID NO: 467499 - DNA, 25 bp, Mus musculus
tatgccatggcaggaactgagacgt

SEQ ID NO: 467500 - DNA, 25 bp, Mus musculus
tatgccatgggtatcactgagtgtg

SEQ ID NO: 467501 - DNA, 25 bp, Mus musculus
tatgcccacagtgtcaaagaataaa

SEQ ID NO: 467502 - DNA, 25 bp, Mus musculus
tatgcccactttaggcgagggtgcg

SEQ ID NO: 467503 - DNA, 25 bp, Mus musculus
tatgcccagaagcaacttatgatgg

SEQ ID NO: 467504 - DNA, 25 bp, Mus musculus
tatgcccagcactgaaaagacctgg

SEQ ID NO: 467505 - DNA, 25 bp, Mus musculus
tatgcccagggattaaccttcggtc

SEQ ID NO: 467506 - DNA, 25 bp, Mus musculus
tatgcccattttgacggaccctgga

SEQ ID NO: 467507 - DNA, 25 bp, Mus musculus
tatgccccaatgtagatctcggccc

SEQ ID NO: 467508 - DNA, 25 bp, Mus musculus
tatgccccagagtgtgctagaagag

SEQ ID NO: 467509 - DNA, 25 bp, Mus musculus
tatgcccctgaaaagtcacatgggc

SEQ ID NO: 467510 - DNA, 25 bp, Mus musculus
tatgcccgctcgagctgtgctgctg

SEQ ID NO: 467511 - DNA, 25 bp, Mus musculus
tatgcccggcagaaggttgttgtca

SEQ ID NO: 467512 - DNA, 25 bp, Mus musculus
tatgcccgtgatgccctggctaaaa

SEQ ID NO: 467513 - DNA, 25 bp, Mus musculus
tatgccctaatatcacagtcccact

SEQ ID NO: 467514 - DNA, 25 bp, Mus musculus
tatgccctacgttcactgccagagg

SEQ ID NO: 467515 - DNA, 25 bp, Mus musculus
tatgccctcaacgtccgagtggtca

SEQ ID NO: 467516 - DNA, 25 bp, Mus musculus
tatgccctgggtcgtctatctggag

SEQ ID NO: 467517 - DNA, 25 bp, Mus musculus
tatgcccttcccaactggaggtggc

SEQ ID NO: 467518 - DNA, 25 bp, Mus musculus
tatgccgaagctagaacacagctgc

SEQ ID NO: 467519 - DNA, 25 bp, Mus musculus
tatgccgacaagttcacctgcaggg

SEQ ID NO: 467520 - DNA, 25 bp, Mus musculus
tatgccgacgtgacagacgaagagg

SEQ ID NO: 467521 - DNA, 25 bp, Mus musculus
tatgccgatgtggacttcttcaaac

SEQ ID NO: 467522 - DNA, 25 bp, Mus musculus
tatgccgcatgatgggtgaagcttc

SEQ ID NO: 467523 - DNA, 25 bp, Mus musculus
tatgccgcccaaaaacctgctggag

SEQ ID NO: 467524 - DNA, 25 bp, Mus musculus
tatgccgcgggagtcatgcatcaga

SEQ ID NO: 467525 - DNA, 25 bp, Mus musculus
tatgccggaagtccttaatggctcc

SEQ ID NO: 467526 - DNA, 25 bp, Mus musculus
tatgccggtcgctcttcgaattgga

SEQ ID NO: 467527 - DNA, 25 bp, Mus musculus
tatgccgtcggacatttgtgagcaa

SEQ ID NO: 467528 - DNA, 25 bp, Mus musculus
tatgccgtgagtacctagatgacag

SEQ ID NO: 467529 - DNA, 25 bp, Mus musculus
tatgccgtggacctgcaagatcaga

SEQ ID NO: 467530 - DNA, 25 bp, Mus musculus
tatgccgttggtttgcggcgcacgc

SEQ ID NO: 467531 - DNA, 25 bp, Mus musculus
tatgcctaagacttctggagcagcc

SEQ ID NO: 467532 - DNA, 25 bp, Mus musculus
tatgcctatactgccagctcctagg

SEQ ID NO: 467533 - DNA, 25 bp, Mus musculus
tatgcctatctgaaagggaccgtgc

SEQ ID NO: 467534 - DNA, 25 bp, Mus musculus
tatgcctcctcaactgtgccattgg

SEQ ID NO: 467535 - DNA, 25 bp, Mus musculus
tatgcctcggagaagaccgctgatg

SEQ ID NO: 467536 - DNA, 25 bp, Mus musculus
tatgcctcggaggagaaggtcatct

SEQ ID NO: 467537 - DNA, 25 bp, Mus musculus
tatgcctgattagaggtacccaagg

SEQ ID NO: 467538 - DNA, 25 bp, Mus musculus
tatgcctgcgtaacaatgctgcggt

SEQ ID NO: 467539 - DNA, 25 bp, Mus musculus
tatgcctggaatgcctgggaagcca

SEQ ID NO: 467540 - DNA, 25 bp, Mus musculus
tatgcctggcagtgcttagtgggcc

SEQ ID NO: 467541 - DNA, 25 bp, Mus musculus
tatgcctgggcaagaaatgctcccc

SEQ ID NO: 467542 - DNA, 25 bp, Mus musculus
tatgcctggtactgaaaacctatcc

SEQ ID NO: 467543 - DNA, 25 bp, Mus musculus
tatgcctgtggtgcagagcttacgc

SEQ ID NO: 467544 - DNA, 25 bp, Mus musculus
tatgccttatggttatgcagcccag

SEQ ID NO: 467545 - DNA, 25 bp, Mus musculus
tatgccttcacctgtaatcgagagc

SEQ ID NO: 467546 - DNA, 25 bp, Mus musculus
tatgccttgatacctttatgctgtt

SEQ ID NO: 467547 - DNA, 25 bp, Mus musculus
tatgccttgcggaagttccctcggg

SEQ ID NO: 467548 - DNA, 25 bp, Mus musculus
tatgccttgttaatgcccgctggtg

SEQ ID NO: 467549 - DNA, 25 bp, Mus musculus
tatgccttttgaccccatggagcgc

SEQ ID NO: 467550 - DNA, 25 bp, Mus musculus
tatgccttttggactcggaacaagc

SEQ ID NO: 467551 - DNA, 25 bp, Mus musculus
tatgcgaagccatagcaggtacatg

SEQ ID NO: 467552 - DNA, 25 bp, Mus musculus
tatgcgacaaggatgccaagggctt

SEQ ID NO: 467553 - DNA, 25 bp, Mus musculus
tatgcgaggagcaacaaccactttc

SEQ ID NO: 467554 - DNA, 25 bp, Mus musculus
tatgcgaggtgtctgtgacgcccaa

SEQ ID NO: 467555 - DNA, 25 bp, Mus musculus
tatgcgatgctatacgtctggacgg

SEQ ID NO: 467556 - DNA, 25 bp, Mus musculus
tatgcgccaccacctaaaaatggga

SEQ ID NO: 467557 - DNA, 25 bp, Mus musculus
tatgcgctttgtaggtgatcagccc

SEQ ID NO: 467558 - DNA, 25 bp, Mus musculus
tatgcggaggccttgattaacccca

SEQ ID NO: 467559 - DNA, 25 bp, Mus musculus
tatgcggatgtactgaacccactgc

SEQ ID NO: 467560 - DNA, 25 bp, Mus musculus
tatgcggctgcaacgagacagggat

SEQ ID NO: 467561 - DNA, 25 bp, Mus musculus
tatgcggcttcgacagctcaaacgg

SEQ ID NO: 467562 - DNA, 25 bp, Mus musculus
tatgcgggagacagtccaacttgac

SEQ ID NO: 467563 - DNA, 25 bp, Mus musculus
tatgcgggccttccacgtacacttt

SEQ ID NO: 467564 - DNA, 25 bp, Mus musculus
tatgcgggctatgagtctgtacacc

SEQ ID NO: 467565 - DNA, 25 bp, Mus musculus
tatgcggtgtagtcgataatagcca

SEQ ID NO: 467566 - DNA, 25 bp, Mus musculus
tatgcggtttattccactacaaaga

SEQ ID NO: 467567 - DNA, 25 bp, Mus musculus
tatgcgtctcgatggaaggctcttg

SEQ ID NO: 467568 - DNA, 25 bp, Mus musculus
tatgcgtgcacaagtgcttttctgt

SEQ ID NO: 467569 - DNA, 25 bp, Mus musculus
tatgcgtgccctggaattagggtac

SEQ ID NO: 467570 - DNA, 25 bp, Mus musculus
tatgcgtgcctgcagtttagggccc

SEQ ID NO: 467571 - DNA, 25 bp, Mus musculus
tatgcgtgctatgccatcggtaagg

SEQ ID NO: 467572 - DNA, 25 bp, Mus musculus
tatgcgtggatcgtacagccagcct

SEQ ID NO: 467573 - DNA, 25 bp, Mus musculus
tatgcgttcgagaccaagacggacc

SEQ ID NO: 467574 - DNA, 25 bp, Mus musculus
tatgcgttgcacagggagatggtct

SEQ ID NO: 467575 - DNA, 25 bp, Mus musculus
tatgcgttgcttaggaaactcctgg

SEQ ID NO: 467576 - DNA, 25 bp, Mus musculus
tatgcgtttccaggtacgtcaggac

SEQ ID NO: 467577 - DNA, 25 bp, Mus musculus
tatgctaaagctaatggccactgtg

SEQ ID NO: 467578 - DNA, 25 bp, Mus musculus
tatgctaaaggtccaaagtcgcctc

SEQ ID NO: 467579 - DNA, 25 bp, Mus musculus
tatgctaaatcacccgatgtgcgcc

SEQ ID NO: 467580 - DNA, 25 bp, Mus musculus
tatgctaagcaaccacaacctggga

SEQ ID NO: 467581 - DNA, 25 bp, Mus musculus
tatgctacactacaaaggagctttg

SEQ ID NO: 467582 - DNA, 25 bp, Mus musculus
tatgctaccgacctcctgaatgtgg

SEQ ID NO: 467583 - DNA, 25 bp, Mus musculus
tatgctactagatggcctcctcctg

SEQ ID NO: 467584 - DNA, 25 bp, Mus musculus
tatgctactcaagcggaagccagcg

SEQ ID NO: 467585 - DNA, 25 bp, Mus musculus
tatgctaggcacagttcatgagacc

SEQ ID NO: 467586 - DNA, 25 bp, Mus musculus
tatgctattagtacacctgggaggt

SEQ ID NO: 467587 - DNA, 25 bp, Mus musculus
tatgctcactctcgccatgctttga

SEQ ID NO: 467588 - DNA, 25 bp, Mus musculus
tatgctcagggtgtaactatgtggc

SEQ ID NO: 467589 - DNA, 25 bp, Mus musculus
tatgctcagtaataaccctggacac

SEQ ID NO: 467590 - DNA, 25 bp, Mus musculus
tatgctcattcgagtaccccagttg

SEQ ID NO: 467591 - DNA, 25 bp, Mus musculus
tatgctcattttcctgcgccagagg

SEQ ID NO: 467592 - DNA, 25 bp, Mus musculus
tatgctccgagcaggaacggttgag

SEQ ID NO: 467593 - DNA, 25 bp, Mus musculus
tatgctcctgtcattaatccgctgc

SEQ ID NO: 467594 - DNA, 25 bp, Mus musculus
tatgctcggctggtgcatcagacca

SEQ ID NO: 467595 - DNA, 25 bp, Mus musculus
tatgctcgtgggaactacgaggccc

SEQ ID NO: 467596 - DNA, 25 bp, Mus musculus
tatgctctatgacctaggcatgcac

SEQ ID NO: 467597 - DNA, 25 bp, Mus musculus
tatgctctatgtacgcacccgtgtg

SEQ ID NO: 467598 - DNA, 25 bp, Mus musculus
tatgctctgagaactgtaaagtgcc

SEQ ID NO: 467599 - DNA, 25 bp, Mus musculus
tatgctctgctgattcccgtggtcg

SEQ ID NO: 467600 - DNA, 25 bp, Mus musculus
tatgctctggaaacgggtgcctctg

SEQ ID NO: 467601 - DNA, 25 bp, Mus musculus
tatgctgaacgatgtggatcctgcc

SEQ ID NO: 467602 - DNA, 25 bp, Mus musculus
tatgctgaattgaatgcactgcagc

SEQ ID NO: 467603 - DNA, 25 bp, Mus musculus
tatgctgaccaaagccatggccatg

SEQ ID NO: 467604 - DNA, 25 bp, Mus musculus
tatgctgagaggacactgctaaggg

SEQ ID NO: 467605 - DNA, 25 bp, Mus musculus
tatgctgagcggactggaaactgtc

SEQ ID NO: 467606 - DNA, 25 bp, Mus musculus
tatgctgagtactggaagaacgtgc

SEQ ID NO: 467607 - DNA, 25 bp, Mus musculus
tatgctgatcagtctcgcctagggt

SEQ ID NO: 467608 - DNA, 25 bp, Mus musculus
tatgctgatgccctacactggtaca

SEQ ID NO: 467609 - DNA, 25 bp, Mus musculus
tatgctgcacagagtaccaagtcac

SEQ ID NO: 467610 - DNA, 25 bp, Mus musculus
tatgctgcaccgtggatatgggagt

SEQ ID NO: 467611 - DNA, 25 bp, Mus musculus
tatgctgcatacagtgtcacatgct

SEQ ID NO: 467612 - DNA, 25 bp, Mus musculus
tatgctgccagagacaagggtcgtc

SEQ ID NO: 467613 - DNA, 25 bp, Mus musculus
tatgctgccatgtacgacaacggtc

SEQ ID NO: 467614 - DNA, 25 bp, Mus musculus
tatgctgcctgctcttactgactgg

SEQ ID NO: 467615 - DNA, 25 bp, Mus musculus
tatgctgcgtctgagggctctttac

SEQ ID NO: 467616 - DNA, 25 bp, Mus musculus
tatgctgcttggatccctgctgtga

SEQ ID NO: 467617 - DNA, 25 bp, Mus musculus
tatgctggacccctaatgttgggac

SEQ ID NO: 467618 - DNA, 25 bp, Mus musculus
tatgctggcaaaacaccagtgaccc

SEQ ID NO: 467619 - DNA, 25 bp, Mus musculus
tatgctggcataccgccatggaggt

SEQ ID NO: 467620 - DNA, 25 bp, Mus musculus
tatgctggccaacgatatagctcgg

SEQ ID NO: 467621 - DNA, 25 bp, Mus musculus
tatgctgggaagaacaattactgcc

SEQ ID NO: 467622 - DNA, 25 bp, Mus musculus
tatgctgggatggtaagggtggctc

SEQ ID NO: 467623 - DNA, 25 bp, Mus musculus
tatgctgggcaaacaagcacatggc

SEQ ID NO: 467624 - DNA, 25 bp, Mus musculus
tatgctgggccatgtcatccacgga

SEQ ID NO: 467625 - DNA, 25 bp, Mus musculus
tatgctggtagcaagagtgccatgg

SEQ ID NO: 467626 - DNA, 25 bp, Mus musculus
tatgctgtaaggctgaccctgcaga

SEQ ID NO: 467627 - DNA, 25 bp, Mus musculus
tatgctgtcgggtgcaacagcagcc

SEQ ID NO: 467628 - DNA, 25 bp, Mus musculus
tatgctgtgaccaaaggaccaagga

SEQ ID NO: 467629 - DNA, 25 bp, Mus musculus
tatgctgtgcagaacaacatggcct

SEQ ID NO: 467630 - DNA, 25 bp, Mus musculus
tatgctgtgcaggaatccactgagc

SEQ ID NO: 467631 - DNA, 25 bp, Mus musculus
tatgctgtgctgagagaaaacctga

SEQ ID NO: 467632 - DNA, 25 bp, Mus musculus
tatgctgtggccaaactaggaccag

SEQ ID NO: 467633 - DNA, 25 bp, Mus musculus
tatgcttagaaccagcgtagaccgg

SEQ ID NO: 467634 - DNA, 25 bp, Mus musculus
tatgcttagcttagggagtggactt

SEQ ID NO: 467635 - DNA, 25 bp, Mus musculus
tatgcttatgatcaatacagggacc

SEQ ID NO: 467636 - DNA, 25 bp, Mus musculus
tatgcttctcagcttgtggccacac

SEQ ID NO: 467637 - DNA, 25 bp, Mus musculus
tatgcttgaatctccagtgtctcgg

SEQ ID NO: 467638 - DNA, 25 bp, Mus musculus
tatgcttggtcagaaaggccgtctc

SEQ ID NO: 467639 - DNA, 25 bp, Mus musculus
tatgcttgtagaagaagggacgctc

SEQ ID NO: 467640 - DNA, 25 bp, Mus musculus
tatgctttaaacagctactgggtgc

SEQ ID NO: 467641 - DNA, 25 bp, Mus musculus
tatgctttgagaaaggatcgcctcc

SEQ ID NO: 467642 - DNA, 25 bp, Mus musculus
tatgctttggatcctggagcccagc

SEQ ID NO: 467643 - DNA, 25 bp, Mus musculus
tatgcttttgtgcacaccggtgaca

SEQ ID NO: 467644 - DNA, 25 bp, Mus musculus
tatggaaaacgatggcgctttgccc

SEQ ID NO: 467645 - DNA, 25 bp, Mus musculus
tatggaaaagcatctgcctgacaat

SEQ ID NO: 467646 - DNA, 25 bp, Mus musculus
tatggaaagcagagaaagtatacta

SEQ ID NO: 467647 - DNA, 25 bp, Mus musculus
tatggaaaggatctgccctggctgc

SEQ ID NO: 467648 - DNA, 25 bp, Mus musculus
tatggaaagtccagggctgtgtgac

SEQ ID NO: 467649 - DNA, 25 bp, Mus musculus
tatggaaagtgtgtgttaacacctc

SEQ ID NO: 467650 - DNA, 25 bp, Mus musculus
tatggaaatcacaaaaggaatgaac

SEQ ID NO: 467651 - DNA, 25 bp, Mus musculus
tatggaacaaggtcctcacgggtct

SEQ ID NO: 467652 - DNA, 25 bp, Mus musculus
tatggaacagaagcacagattggcg

SEQ ID NO: 467653 - DNA, 25 bp, Mus musculus
tatggaaccatcaagatcggcacgt

SEQ ID NO: 467654 - DNA, 25 bp, Mus musculus
tatggaacgccatcccttttaggac

SEQ ID NO: 467655 - DNA, 25 bp, Mus musculus
tatggaacgtctttaaccgaatgcc

SEQ ID NO: 467656 - DNA, 25 bp, Mus musculus
tatggaactgggacttgcagagcct

SEQ ID NO: 467657 - DNA, 25 bp, Mus musculus
tatggaagaacaagtcctacaggct

SEQ ID NO: 467658 - DNA, 25 bp, Mus musculus
tatggaagaagaagcgctgcgtgct

SEQ ID NO: 467659 - DNA, 25 bp, Mus musculus
tatggaagaccagtcctgacccgac

SEQ ID NO: 467660 - DNA, 25 bp, Mus musculus
tatggaagcaacaatggtaaccctc

SEQ ID NO: 467661 - DNA, 25 bp, Mus musculus
tatggaagccctgcgtgacgaaatt

SEQ ID NO: 467662 - DNA, 25 bp, Mus musculus
tatggaagccctttttgacatggtt

SEQ ID NO: 467663 - DNA, 25 bp, Mus musculus
tatggaagctgagggttccagccgc

SEQ ID NO: 467664 - DNA, 25 bp, Mus musculus
tatggaaggatcactctgcggtcag

SEQ ID NO: 467665 - DNA, 25 bp, Mus musculus
tatggaagggtatccgccaacacag

SEQ ID NO: 467666 - DNA, 25 bp, Mus musculus
tatggaagtgaagagttggaccacc

SEQ ID NO: 467667 - DNA, 25 bp, Mus musculus
tatggaatacagatgtggcagcaca

SEQ ID NO: 467668 - DNA, 25 bp, Mus musculus
tatggaatcgaaaatagaactgccc

SEQ ID NO: 467669 - DNA, 25 bp, Mus musculus
tatggaatgtcacccacagagaacc

SEQ ID NO: 467670 - DNA, 25 bp, Mus musculus
tatggaattcgttgaaactaacctc

SEQ ID NO: 467671 - DNA, 25 bp, Mus musculus
tatggacacacagaggagatcaccg

SEQ ID NO: 467672 - DNA, 25 bp, Mus musculus
tatggacagaacaccagtaccggct

SEQ ID NO: 467673 - DNA, 25 bp, Mus musculus
tatggacaggcacatccagcagacc

SEQ ID NO: 467674 - DNA, 25 bp, Mus musculus
tatggacatcagtgagagccagggc

SEQ ID NO: 467675 - DNA, 25 bp, Mus musculus
tatggacattgcttcaaacctgaca

SEQ ID NO: 467676 - DNA, 25 bp, Mus musculus
tatggaccagcccagtagaagacta

SEQ ID NO: 467677 - DNA, 25 bp, Mus musculus
tatggacccaaggttgacatctggt

SEQ ID NO: 467678 - DNA, 25 bp, Mus musculus
tatggacccgtattgccactgtcgg

SEQ ID NO: 467679 - DNA, 25 bp, Mus musculus
tatggacctccacttcagactcgga

SEQ ID NO: 467680 - DNA, 25 bp, Mus musculus
tatggacctcgggatgacagcttcc

SEQ ID NO: 467681 - DNA, 25 bp, Mus musculus
tatggaccttgggatgacactaacc

SEQ ID NO: 467682 - DNA, 25 bp, Mus musculus
tatggacctttcactcagcttgacg

SEQ ID NO: 467683 - DNA, 25 bp, Mus musculus
tatggacctttccagggaacagcca

SEQ ID NO: 467684 - DNA, 25 bp, Mus musculus
tatggacgaacacctctatgtggcc

SEQ ID NO: 467685 - DNA, 25 bp, Mus musculus
tatggacgaagaagccagcaagtcg

SEQ ID NO: 467686 - DNA, 25 bp, Mus musculus
tatggacgaagatcactgcccgagt

SEQ ID NO: 467687 - DNA, 25 bp, Mus musculus
tatggacgacgggtttctgagcctg

SEQ ID NO: 467688 - DNA, 25 bp, Mus musculus
tatggacgagctaccgaatggcaac

SEQ ID NO: 467689 - DNA, 25 bp, Mus musculus
tatggacgctgcgagaatcctcaga

SEQ ID NO: 467690 - DNA, 25 bp, Mus musculus
tatggacggcatccagaacagcttc

SEQ ID NO: 467691 - DNA, 25 bp, Mus musculus
tatggacggcgataaatgtggaacc

SEQ ID NO: 467692 - DNA, 25 bp, Mus musculus
tatggacgtcgaccacaagaatgtg

SEQ ID NO: 467693 - DNA, 25 bp, Mus musculus
tatggactataggaaccaactctag

SEQ ID NO: 467694 - DNA, 25 bp, Mus musculus
tatggactcccacaatgaggtctgg

SEQ ID NO: 467695 - DNA, 25 bp, Mus musculus
tatggactcttatgcactacaggcg

SEQ ID NO: 467696 - DNA, 25 bp, Mus musculus
tatggactctttgcccttctgaccg

SEQ ID NO: 467697 - DNA, 25 bp, Mus musculus
tatggactgtctgccctgggcaaaa

SEQ ID NO: 467698 - DNA, 25 bp, Mus musculus
tatggactgttaatgcagtttctgc

SEQ ID NO: 467699 - DNA, 25 bp, Mus musculus
tatggagaacctactctatgccagg

SEQ ID NO: 467700 - DNA, 25 bp, Mus musculus
tatggagaagcagattgccagcctc

SEQ ID NO: 467701 - DNA, 25 bp, Mus musculus
tatggagaagcgactggtgagaaac

SEQ ID NO: 467702 - DNA, 25 bp, Mus musculus
tatggagaccggcaacactaagaac

SEQ ID NO: 467703 - DNA, 25 bp, Mus musculus
tatggagacgaaaccaaacagctgc

SEQ ID NO: 467704 - DNA, 25 bp, Mus musculus
tatggagagcttgctacacgcaggg

SEQ ID NO: 467705 - DNA, 25 bp, Mus musculus
tatggagatattttccaacgggcaa

SEQ ID NO: 467706 - DNA, 25 bp, Mus musculus
tatggagcactacgccagtcaggaa

SEQ ID NO: 467707 - DNA, 25 bp, Mus musculus
tatggagccaagtcctacaggagac

SEQ ID NO: 467708 - DNA, 25 bp, Mus musculus
tatggagccatttctgtaagtctgc

SEQ ID NO: 467709 - DNA, 25 bp, Mus musculus
tatggagcccgcgaaccttgatctc

SEQ ID NO: 467710 - DNA, 25 bp, Mus musculus
tatggaggaacttgcaaatctggcc

SEQ ID NO: 467711 - DNA, 25 bp, Mus musculus
tatggaggaccacgattatgagcag

SEQ ID NO: 467712 - DNA, 25 bp, Mus musculus
tatggaggcaagttgaagcacaccc

SEQ ID NO: 467713 - DNA, 25 bp, Mus musculus
tatggaggccgcagtacaagctgag

SEQ ID NO: 467714 - DNA, 25 bp, Mus musculus
tatggaggccgttcactgccacctt

SEQ ID NO: 467715 - DNA, 25 bp, Mus musculus
tatggaggcctacgagcaagtccag

SEQ ID NO: 467716 - DNA, 25 bp, Mus musculus
tatggagggccatgttttcggagac

SEQ ID NO: 467717 - DNA, 25 bp, Mus musculus
tatggaggtccctggaatgagcgtc

SEQ ID NO: 467718 - DNA, 25 bp, Mus musculus
tatggagtaaagtaggctgacttcg

SEQ ID NO: 467719 - DNA, 25 bp, Mus musculus
tatggagtaacagtcaaaaggcacc

SEQ ID NO: 467720 - DNA, 25 bp, Mus musculus
tatggagtacgtttctcgacacgca

SEQ ID NO: 467721 - DNA, 25 bp, Mus musculus
tatggagtaggtggttaaagtcaga

SEQ ID NO: 467722 - DNA, 25 bp, Mus musculus
tatggagtgatgtgctgaagccacc

SEQ ID NO: 467723 - DNA, 25 bp, Mus musculus
tatggagtggttgcccattggccac

SEQ ID NO: 467724 - DNA, 25 bp, Mus musculus
tatggagtgtccacagatcgtgcag

SEQ ID NO: 467725 - DNA, 25 bp, Mus musculus
tatggagttcctttgggcccctctc

SEQ ID NO: 467726 - DNA, 25 bp, Mus musculus
tatggagtttccagaccacagcaga

SEQ ID NO: 467727 - DNA, 25 bp, Mus musculus
tatggataaggctctgcaaggccag

SEQ ID NO: 467728 - DNA, 25 bp, Mus musculus
tatggatacacaagtggttcaccac

SEQ ID NO: 467729 - DNA, 25 bp, Mus musculus
tatggatacgtgtccaagcttggca

SEQ ID NO: 467730 - DNA, 25 bp, Mus musculus
tatggatatcctcaggcagatgcca

SEQ ID NO: 467731 - DNA, 25 bp, Mus musculus
tatggatcacataggcggagacatt

SEQ ID NO: 467732 - DNA, 25 bp, Mus musculus
tatggatccttcagtactgtggccc

SEQ ID NO: 467733 - DNA, 25 bp, Mus musculus
tatggatgcatctaactcaacactc

SEQ ID NO: 467734 - DNA, 25 bp, Mus musculus
tatggatgcctcattacgccgagca

SEQ ID NO: 467735 - DNA, 25 bp, Mus musculus
tatggattcagtgatcaccagctgg

SEQ ID NO: 467736 - DNA, 25 bp, Mus musculus
tatggattgcccttgtgacctgaca

SEQ ID NO: 467737 - DNA, 25 bp, Mus musculus
tatggattgtttcgcgacgcactgc

SEQ ID NO: 467738 - DNA, 25 bp, Mus musculus
tatggcaaaaaagtagatgggcagc

SEQ ID NO: 467739 - DNA, 25 bp, Mus musculus
tatggcaaacagaggtaatacgtta

SEQ ID NO: 467740 - DNA, 25 bp, Mus musculus
tatggcaaccaaaacccagcagctg

SEQ ID NO: 467741 - DNA, 25 bp, Mus musculus
tatggcaactacgtgacctatggct

SEQ ID NO: 467742 - DNA, 25 bp, Mus musculus
tatggcaagaagaaacgcagatacc

SEQ ID NO: 467743 - DNA, 25 bp, Mus musculus
tatggcaagagatccagccctgaga

SEQ ID NO: 467744 - DNA, 25 bp, Mus musculus
tatggcaagccttaactgcatccgg

SEQ ID NO: 467745 - DNA, 25 bp, Mus musculus
tatggcaagctggtcaacacggttc

SEQ ID NO: 467746 - DNA, 25 bp, Mus musculus
tatggcaatggtagtcagcacgtgg

SEQ ID NO: 467747 - DNA, 25 bp, Mus musculus
tatggcaattagatatattccgaag

SEQ ID NO: 467748 - DNA, 25 bp, Mus musculus
tatggcacaactggagtacattggc

SEQ ID NO: 467749 - DNA, 25 bp, Mus musculus
tatggcacatagaaacatgcagaag

SEQ ID NO: 467750 - DNA, 25 bp, Mus musculus
tatggcacccacagaagatgagttt

SEQ ID NO: 467751 - DNA, 25 bp, Mus musculus
tatggcacgacaagtataccctgag

SEQ ID NO: 467752 - DNA, 25 bp, Mus musculus
tatggcacgcactttatcacggctg

SEQ ID NO: 467753 - DNA, 25 bp, Mus musculus
tatggcacgtataccttggagaacg

SEQ ID NO: 467754 - DNA, 25 bp, Mus musculus
tatggcagaaaaccttgacggtgct

SEQ ID NO: 467755 - DNA, 25 bp, Mus musculus
tatggcagcagctccttgcatcggg

SEQ ID NO: 467756 - DNA, 25 bp, Mus musculus
tatggcagccactcttctaagggca

SEQ ID NO: 467757 - DNA, 25 bp, Mus musculus
tatggcagcctctccaaagatggcc

SEQ ID NO: 467758 - DNA, 25 bp, Mus musculus
tatggcagcctggatatgcgcagca

SEQ ID NO: 467759 - DNA, 25 bp, Mus musculus
tatggcagctatgagagaaccttgg

SEQ ID NO: 467760 - DNA, 25 bp, Mus musculus
tatggcagctcttcctagttatcta

SEQ ID NO: 467761 - DNA, 25 bp, Mus musculus
tatggcagtccgacggagaagagcc

SEQ ID NO: 467762 - DNA, 25 bp, Mus musculus
tatggcatagctcctttatcccgcg

SEQ ID NO: 467763 - DNA, 25 bp, Mus musculus
tatggcatccaagacagtgtcacag

SEQ ID NO: 467764 - DNA, 25 bp, Mus musculus
tatggcatcctgaaagagcccctga

SEQ ID NO: 467765 - DNA, 25 bp, Mus musculus
tatggcatctacacaaaggtcacga

SEQ ID NO: 467766 - DNA, 25 bp, Mus musculus
tatggcatgagggtgtttacaactg

SEQ ID NO: 467767 - DNA, 25 bp, Mus musculus
tatggcattcaaggcaaagcacagc

SEQ ID NO: 467768 - DNA, 25 bp, Mus musculus
tatggccaactccttcgtgggcacg

SEQ ID NO: 467769 - DNA, 25 bp, Mus musculus
tatggccaaggagaacttccacagt

SEQ ID NO: 467770 - DNA, 25 bp, Mus musculus
tatggccaccattgtgtaggcatgc

SEQ ID NO: 467771 - DNA, 25 bp, Mus musculus
tatggccacgtgcattaggctgagc

SEQ ID NO: 467772 - DNA, 25 bp, Mus musculus
tatggccagaagactcttgacagca

SEQ ID NO: 467773 - DNA, 25 bp, Mus musculus
tatggccagcattaccgtgtctaca

SEQ ID NO: 467774 - DNA, 25 bp, Mus musculus
tatggccatcgacgtgtgtcccggc

SEQ ID NO: 467775 - DNA, 25 bp, Mus musculus
tatggccatgatgtaggcaaacgcc

SEQ ID NO: 467776 - DNA, 25 bp, Mus musculus
tatggccattccagcggtgatcgga

SEQ ID NO: 467777 - DNA, 25 bp, Mus musculus
tatggccattgcagcctccagggtg

SEQ ID NO: 467778 - DNA, 25 bp, Mus musculus
tatggccattgctgctcctaggcga

SEQ ID NO: 467779 - DNA, 25 bp, Mus musculus
tatggcccaatgtccaccttgctct

SEQ ID NO: 467780 - DNA, 25 bp, Mus musculus
tatggccccaatgaaccaagagcag

SEQ ID NO: 467781 - DNA, 25 bp, Mus musculus
tatggccccagaagaaaggcgggac

SEQ ID NO: 467782 - DNA, 25 bp, Mus musculus
tatggcccgtctcatgtgcactggg

SEQ ID NO: 467783 - DNA, 25 bp, Mus musculus
tatggccgagatgcaaatttcaccc

SEQ ID NO: 467784 - DNA, 25 bp, Mus musculus
tatggccggcccaagattgacggtg

SEQ ID NO: 467785 - DNA, 25 bp, Mus musculus
tatggccggcctttgctatgctgaa

SEQ ID NO: 467786 - DNA, 25 bp, Mus musculus
tatggcctatacctacccaacggga

SEQ ID NO: 467787 - DNA, 25 bp, Mus musculus
tatggcctgatgttaagcccctgcc

SEQ ID NO: 467788 - DNA, 25 bp, Mus musculus
tatggcctggctgtagaaacctcag

SEQ ID NO: 467789 - DNA, 25 bp, Mus musculus
tatggccttaccagttctacccagg

SEQ ID NO: 467790 - DNA, 25 bp, Mus musculus
tatggccttgtcaagacctcatcgg

SEQ ID NO: 467791 - DNA, 25 bp, Mus musculus
tatggcctttactgcttccaccgcg

SEQ ID NO: 467792 - DNA, 25 bp, Mus musculus
tatggcgctggcaactctatgctgc

SEQ ID NO: 467793 - DNA, 25 bp, Mus musculus
tatggcggaccctagtactcggcat

SEQ ID NO: 467794 - DNA, 25 bp, Mus musculus
tatggcggcatcagagtcagtcagg

SEQ ID NO: 467795 - DNA, 25 bp, Mus musculus
tatggcgtcaagcaaggaggattcc

SEQ ID NO: 467796 - DNA, 25 bp, Mus musculus
tatggctaaaacaaaccaatttggt

SEQ ID NO: 467797 - DNA, 25 bp, Mus musculus
tatggctaccacttcggcaacggtt

SEQ ID NO: 467798 - DNA, 25 bp, Mus musculus
tatggctactctaaacaggactgct

SEQ ID NO: 467799 - DNA, 25 bp, Mus musculus
tatggctactttggaggcgggtact

SEQ ID NO: 467800 - DNA, 25 bp, Mus musculus
tatggctagcagaattccagctccc

SEQ ID NO: 467801 - DNA, 25 bp, Mus musculus
tatggctaggtaaatgttgcttcag

SEQ ID NO: 467802 - DNA, 25 bp, Mus musculus
tatggctatgctcgtctcttccgct

SEQ ID NO: 467803 - DNA, 25 bp, Mus musculus
tatggctatggcttagaacggtccc

SEQ ID NO: 467804 - DNA, 25 bp, Mus musculus
tatggctcagggtccaactctgtgc

SEQ ID NO: 467805 - DNA, 25 bp, Mus musculus
tatggctcataggacagggatttct

SEQ ID NO: 467806 - DNA, 25 bp, Mus musculus
tatggctcattccaaagcactgttg

SEQ ID NO: 467807 - DNA, 25 bp, Mus musculus
tatggctccagcattcggagggcac

SEQ ID NO: 467808 - DNA, 25 bp, Mus musculus
tatggctcccactacattgccgagg

SEQ ID NO: 467809 - DNA, 25 bp, Mus musculus
tatggctccgggtagctagacctgc

SEQ ID NO: 467810 - DNA, 25 bp, Mus musculus
tatggctcctgacaccaaagggcac

SEQ ID NO: 467811 - DNA, 25 bp, Mus musculus
tatggctctcatgaagtatggcagg

SEQ ID NO: 467812 - DNA, 25 bp, Mus musculus
tatggctctcggatcagtccacagg

SEQ ID NO: 467813 - DNA, 25 bp, Mus musculus
tatggctgcacaaggctggagatcg

SEQ ID NO: 467814 - DNA, 25 bp, Mus musculus
tatggctgcggcgatagccagctcc

SEQ ID NO: 467815 - DNA, 25 bp, Mus musculus
tatggctggatagaaggagcctaat

SEQ ID NO: 467816 - DNA, 25 bp, Mus musculus
tatggctggtgtttctccctctcgg

SEQ ID NO: 467817 - DNA, 25 bp, Mus musculus
tatggctgtcagaacgaacggtttg

SEQ ID NO: 467818 - DNA, 25 bp, Mus musculus
tatggctgtttctcaaggatcccag

SEQ ID NO: 467819 - DNA, 25 bp, Mus musculus
tatggcttaccagacctcccagttg

SEQ ID NO: 467820 - DNA, 25 bp, Mus musculus
tatggcttcacacagtttgcactag

SEQ ID NO: 467821 - DNA, 25 bp, Mus musculus
tatggcttcacacgcttggtaactc

SEQ ID NO: 467822 - DNA, 25 bp, Mus musculus
tatggcttccctaaggctgtgagcg

SEQ ID NO: 467823 - DNA, 25 bp, Mus musculus
tatggcttccgctacatcagtgagg

SEQ ID NO: 467824 - DNA, 25 bp, Mus musculus
tatggcttctgtcacggacctggag

SEQ ID NO: 467825 - DNA, 25 bp, Mus musculus
tatggcttgccctatgttcctgaca

SEQ ID NO: 467826 - DNA, 25 bp, Mus musculus
tatggcttgctagtgacagtggctc

SEQ ID NO: 467827 - DNA, 25 bp, Mus musculus
tatggcttgctggacccaaaggcac

SEQ ID NO: 467828 - DNA, 25 bp, Mus musculus
tatggcttgtctcttacatggcaca

SEQ ID NO: 467829 - DNA, 25 bp, Mus musculus
tatgggaaagcgcaaaagctccact

SEQ ID NO: 467830 - DNA, 25 bp, Mus musculus
tatgggacaacagacttgctccgcc

SEQ ID NO: 467831 - DNA, 25 bp, Mus musculus
tatgggacagattcaaaccgtagca

SEQ ID NO: 467832 - DNA, 25 bp, Mus musculus
tatgggacccgactataagctggag

SEQ ID NO: 467833 - DNA, 25 bp, Mus musculus
tatgggacctaggaaaaggcctggc

SEQ ID NO: 467834 - DNA, 25 bp, Mus musculus
tatgggacctgtacacatggacttt

SEQ ID NO: 467835 - DNA, 25 bp, Mus musculus
tatgggacgtttcaacagagacttg

SEQ ID NO: 467836 - DNA, 25 bp, Mus musculus
tatgggagacattctacttcctgcc

SEQ ID NO: 467837 - DNA, 25 bp, Mus musculus
tatgggagccacagtcatgacacag

SEQ ID NO: 467838 - DNA, 25 bp, Mus musculus
tatgggagcccacatcagtcaagtt

SEQ ID NO: 467839 - DNA, 25 bp, Mus musculus
tatgggagccctcaggatggtatcc

SEQ ID NO: 467840 - DNA, 25 bp, Mus musculus
tatgggagcctctggagttgacatc

SEQ ID NO: 467841 - DNA, 25 bp, Mus musculus
tatgggagctaccttttctgcctgg

SEQ ID NO: 467842 - DNA, 25 bp, Mus musculus
tatgggagctcaaaagctgaggcag

SEQ ID NO: 467843 - DNA, 25 bp, Mus musculus
tatgggaggatcatcaacgaccggc

SEQ ID NO: 467844 - DNA, 25 bp, Mus musculus
tatgggagggctcagaaaaacccac

SEQ ID NO: 467845 - DNA, 25 bp, Mus musculus
tatgggaggtgagacagaacgaccc

SEQ ID NO: 467846 - DNA, 25 bp, Mus musculus
tatgggatccagaaatcacggccct

SEQ ID NO: 467847 - DNA, 25 bp, Mus musculus
tatgggatgctcaggtaacagaagg

SEQ ID NO: 467848 - DNA, 25 bp, Mus musculus
tatgggatggctccaagctggtcac

SEQ ID NO: 467849 - DNA, 25 bp, Mus musculus
tatgggcaaccagctagcacgtctg

SEQ ID NO: 467850 - DNA, 25 bp, Mus musculus
tatgggcacccgcaaacacttggtg

SEQ ID NO: 467851 - DNA, 25 bp, Mus musculus
tatgggcagaactgtcagaaggtcc

SEQ ID NO: 467852 - DNA, 25 bp, Mus musculus
tatgggcagaggctcttcggcttcc

SEQ ID NO: 467853 - DNA, 25 bp, Mus musculus
tatgggcagattcgctacccggtcc

SEQ ID NO: 467854 - DNA, 25 bp, Mus musculus
tatgggcagcctccttaccaaagga

SEQ ID NO: 467855 - DNA, 25 bp, Mus musculus
tatgggcagctcgactgggagactg

SEQ ID NO: 467856 - DNA, 25 bp, Mus musculus
tatgggcataccacaacagtcctta

SEQ ID NO: 467857 - DNA, 25 bp, Mus musculus
tatgggcatctctttactttcactg

SEQ ID NO: 467858 - DNA, 25 bp, Mus musculus
tatgggcatctgtccgaggctctac

SEQ ID NO: 467859 - DNA, 25 bp, Mus musculus
tatgggccaaaaggctacggctacg

SEQ ID NO: 467860 - DNA, 25 bp, Mus musculus
tatgggccaccggatattactcact

SEQ ID NO: 467861 - DNA, 25 bp, Mus musculus
tatgggccactaactgcttgctggg

SEQ ID NO: 467862 - DNA, 25 bp, Mus musculus
tatgggccattaatcccctcttgaa

SEQ ID NO: 467863 - DNA, 25 bp, Mus musculus
tatgggcccatgttcattcgaataa

SEQ ID NO: 467864 - DNA, 25 bp, Mus musculus
tatgggccctcttatctttgttgca

SEQ ID NO: 467865 - DNA, 25 bp, Mus musculus
tatgggccttgggtagacgataatc

SEQ ID NO: 467866 - DNA, 25 bp, Mus musculus
tatgggcgcatcattacttctcgga

SEQ ID NO: 467867 - DNA, 25 bp, Mus musculus
tatgggcgtcgtctacaagaggcca

SEQ ID NO: 467868 - DNA, 25 bp, Mus musculus
tatgggctcagacccaagcacccga

SEQ ID NO: 467869 - DNA, 25 bp, Mus musculus
tatgggctcccaaaagaccttgact

SEQ ID NO: 467870 - DNA, 25 bp, Mus musculus
tatgggctccctgaatgtatccgtg

SEQ ID NO: 467871 - DNA, 25 bp, Mus musculus
tatgggctcctgacccgagagcttg

SEQ ID NO: 467872 - DNA, 25 bp, Mus musculus
tatgggctgctctcctgcttcaaga

SEQ ID NO: 467873 - DNA, 25 bp, Mus musculus
tatgggctgttgcttctccagggca

SEQ ID NO: 467874 - DNA, 25 bp, Mus musculus
tatgggcttcagactcagacctaca

SEQ ID NO: 467875 - DNA, 25 bp, Mus musculus
tatgggcttccctatgatcacacag

SEQ ID NO: 467876 - DNA, 25 bp, Mus musculus
tatgggcttctaagcatcttgggtg

SEQ ID NO: 467877 - DNA, 25 bp, Mus musculus
tatgggtaatctcaaagaagccgca

SEQ ID NO: 467878 - DNA, 25 bp, Mus musculus
tatgggtaccacaggcgctttgcgt

SEQ ID NO: 467879 - DNA, 25 bp, Mus musculus
tatgggtcaaagagcgcgagctacg

SEQ ID NO: 467880 - DNA, 25 bp, Mus musculus
tatgggtcggtgttcacggtgtacc

SEQ ID NO: 467881 - DNA, 25 bp, Mus musculus
tatgggtgcactaaccagggatacc

SEQ ID NO: 467882 - DNA, 25 bp, Mus musculus
tatgggtgcttacaaagctaagaca

SEQ ID NO: 467883 - DNA, 25 bp, Mus musculus
tatgggtgcttcgtctctcaaagga

SEQ ID NO: 467884 - DNA, 25 bp, Mus musculus
tatgggtggaacagctgcttggccc

SEQ ID NO: 467885 - DNA, 25 bp, Mus musculus
tatgggttactgagatcaattccac

SEQ ID NO: 467886 - DNA, 25 bp, Mus musculus
tatgggttcccgttgtgagtatgct

SEQ ID NO: 467887 - DNA, 25 bp, Mus musculus
tatgggttgaccatgaagcccggga

SEQ ID NO: 467888 - DNA, 25 bp, Mus musculus
tatggtaaagttctccctggcgtcc

SEQ ID NO: 467889 - DNA, 25 bp, Mus musculus
tatggtaaccccatccgtgggcagc

SEQ ID NO: 467890 - DNA, 25 bp, Mus musculus
tatggtaagaacctggagttagtca

SEQ ID NO: 467891 - DNA, 25 bp, Mus musculus
tatggtacccaagactcctaatctg

SEQ ID NO: 467892 - DNA, 25 bp, Mus musculus
tatggtacccaagggaagcctgcaa

SEQ ID NO: 467893 - DNA, 25 bp, Mus musculus
tatggtactgaagtcataggcacct

SEQ ID NO: 467894 - DNA, 25 bp, Mus musculus
tatggtagaagagaacggccctttc

SEQ ID NO: 467895 - DNA, 25 bp, Mus musculus
tatggtagattggacctggttggct

SEQ ID NO: 467896 - DNA, 25 bp, Mus musculus
tatggtagctttggacttccttcag

SEQ ID NO: 467897 - DNA, 25 bp, Mus musculus
tatggtatacattcccgcagaggag

SEQ ID NO: 467898 - DNA, 25 bp, Mus musculus
tatggtatcaacaacacagacagaa

SEQ ID NO: 467899 - DNA, 25 bp, Mus musculus
tatggtatcaccacaagaaacccag

SEQ ID NO: 467900 - DNA, 25 bp, Mus musculus
tatggtcaaacgtcagcaacctcca

SEQ ID NO: 467901 - DNA, 25 bp, Mus musculus
tatggtcaagagagcagtaggccgt

SEQ ID NO: 467902 - DNA, 25 bp, Mus musculus
tatggtcacaaccttccggctgtcg

SEQ ID NO: 467903 - DNA, 25 bp, Mus musculus
tatggtcacctgagtttgaaatgtc

SEQ ID NO: 467904 - DNA, 25 bp, Mus musculus
tatggtcactttcctagtcgggcca

SEQ ID NO: 467905 - DNA, 25 bp, Mus musculus
tatggtcagcctcggacaagaagac

SEQ ID NO: 467906 - DNA, 25 bp, Mus musculus
tatggtcatgggtgtgcccgaaaac

SEQ ID NO: 467907 - DNA, 25 bp, Mus musculus
tatggtccagtgcttgggcttccac

SEQ ID NO: 467908 - DNA, 25 bp, Mus musculus
tatggtcgcaccagtttatgcctgg

SEQ ID NO: 467909 - DNA, 25 bp, Mus musculus
tatggtcgctagcagcgcaggacca

SEQ ID NO: 467910 - DNA, 25 bp, Mus musculus
tatggtcggacctgtagcccagaaa

SEQ ID NO: 467911 - DNA, 25 bp, Mus musculus
tatggtctcgaagccgacactaacc

SEQ ID NO: 467912 - DNA, 25 bp, Mus musculus
tatggtctcggctcgtgcattgctc

SEQ ID NO: 467913 - DNA, 25 bp, Mus musculus
tatggtctggccctaatgcctgcag

SEQ ID NO: 467914 - DNA, 25 bp, Mus musculus
tatggtcttcagctccgaaaggtgg

SEQ ID NO: 467915 - DNA, 25 bp, Mus musculus
tatggtcttccaatggcggtggcac

SEQ ID NO: 467916 - DNA, 25 bp, Mus musculus
tatggtgaaattaggtagtggcttc

SEQ ID NO: 467917 - DNA, 25 bp, Mus musculus
tatggtgaaattcccggcgctcacg

SEQ ID NO: 467918 - DNA, 25 bp, Mus musculus
tatggtgaacaaatcagccatgttt

SEQ ID NO: 467919 - DNA, 25 bp, Mus musculus
tatggtgaatgtgtcctacaaagaa

SEQ ID NO: 467920 - DNA, 25 bp, Mus musculus
tatggtgaccatacgacccacagaa

SEQ ID NO: 467921 - DNA, 25 bp, Mus musculus
tatggtgactgtatacaaggagccc

SEQ ID NO: 467922 - DNA, 25 bp, Mus musculus
tatggtgagatcagcatcgggactc

SEQ ID NO: 467923 - DNA, 25 bp, Mus musculus
tatggtgaggcatctctagatggcc

SEQ ID NO: 467924 - DNA, 25 bp, Mus musculus
tatggtgcaaggttaaacatggtca

SEQ ID NO: 467925 - DNA, 25 bp, Mus musculus
tatggtgccaaagcccaactggagt

SEQ ID NO: 467926 - DNA, 25 bp, Mus musculus
tatggtgcctcttccaaaacacatg

SEQ ID NO: 467927 - DNA, 25 bp, Mus musculus
tatggtggaaatcgccaagcagctc

SEQ ID NO: 467928 - DNA, 25 bp, Mus musculus
tatggtggaacaccctacggtggtc

SEQ ID NO: 467929 - DNA, 25 bp, Mus musculus
tatggtggccacttcaaactcagag

SEQ ID NO: 467930 - DNA, 25 bp, Mus musculus
tatggtggcctcgacatgatgcccg

SEQ ID NO: 467931 - DNA, 25 bp, Mus musculus
tatggtggctccacagtagctgccg

SEQ ID NO: 467932 - DNA, 25 bp, Mus musculus
tatggtgggtctcttgttatgatac

SEQ ID NO: 467933 - DNA, 25 bp, Mus musculus
tatggtggtcatcatcaaggcatgc

SEQ ID NO: 467934 - DNA, 25 bp, Mus musculus
tatggtggtccttgcagccagagtg

SEQ ID NO: 467935 - DNA, 25 bp, Mus musculus
tatggtgtacagtgagggaacccca

SEQ ID NO: 467936 - DNA, 25 bp, Mus musculus
tatggtgtccgaaactggagactcc

SEQ ID NO: 467937 - DNA, 25 bp, Mus musculus
tatggtgtgcagtgatgtgtctgct

SEQ ID NO: 467938 - DNA, 25 bp, Mus musculus
tatggtgtggcaacccctaaaggct

SEQ ID NO: 467939 - DNA, 25 bp, Mus musculus
tatggtgtggtttgagttctgcagt

SEQ ID NO: 467940 - DNA, 25 bp, Mus musculus
tatggtgttcacagagacccttcct

SEQ ID NO: 467941 - DNA, 25 bp, Mus musculus
tatggttacaaagggctgctgctgc

SEQ ID NO: 467942 - DNA, 25 bp, Mus musculus
tatggttagcgatcggacagaggcc

SEQ ID NO: 467943 - DNA, 25 bp, Mus musculus
tatggttcctacgtgtgggtcagca

SEQ ID NO: 467944 - DNA, 25 bp, Mus musculus
tatggttcctgcaatgctcaccggc

SEQ ID NO: 467945 - DNA, 25 bp, Mus musculus
tatggttctctgagagctcccctgg

SEQ ID NO: 467946 - DNA, 25 bp, Mus musculus
tatggttgctccaacaaaactggaa

SEQ ID NO: 467947 - DNA, 25 bp, Mus musculus
tatggttgtctaatcggtaatctcc

SEQ ID NO: 467948 - DNA, 25 bp, Mus musculus
tatggttgttttgctcctcggcttc

SEQ ID NO: 467949 - DNA, 25 bp, Mus musculus
tatggtttccaagtgctccagggaa

SEQ ID NO: 467950 - DNA, 25 bp, Mus musculus
tatggttttatggatgggaccccag

SEQ ID NO: 467951 - DNA, 25 bp, Mus musculus
tatgtaaaactatgcctgtatccgc

SEQ ID NO: 467952 - DNA, 25 bp, Mus musculus
tatgtaaaacttgtgtccctcccgg

SEQ ID NO: 467953 - DNA, 25 bp, Mus musculus
tatgtaaaagcaccccaattccagg

SEQ ID NO: 467954 - DNA, 25 bp, Mus musculus
tatgtaaacagcaactatggagtgc

SEQ ID NO: 467955 - DNA, 25 bp, Mus musculus
tatgtaaagcgtctccacgaggtgg

SEQ ID NO: 467956 - DNA, 25 bp, Mus musculus
tatgtaaagctcagggcaggacagc

SEQ ID NO: 467957 - DNA, 25 bp, Mus musculus
tatgtaaaggccttagcgtacgcca

SEQ ID NO: 467958 - DNA, 25 bp, Mus musculus
tatgtaaagtagaacctgaacctgg

SEQ ID NO: 467959 - DNA, 25 bp, Mus musculus
tatgtaaatcccacgagtaccagcc

SEQ ID NO: 467960 - DNA, 25 bp, Mus musculus
tatgtaacatataaggagactttcc

SEQ ID NO: 467961 - DNA, 25 bp, Mus musculus
tatgtaactgtttccacggaagggt

SEQ ID NO: 467962 - DNA, 25 bp, Mus musculus
tatgtaagacctaaagtcaagggag

SEQ ID NO: 467963 - DNA, 25 bp, Mus musculus
tatgtaagagagtcagctgggtttg

SEQ ID NO: 467964 - DNA, 25 bp, Mus musculus
tatgtaatagcagcagcgcagtgtg

SEQ ID NO: 467965 - DNA, 25 bp, Mus musculus
tatgtaatagcatccaggaagcccc

SEQ ID NO: 467966 - DNA, 25 bp, Mus musculus
tatgtaatgatggaaccctggtgct

SEQ ID NO: 467967 - DNA, 25 bp, Mus musculus
tatgtaatgattaagacccagtcca

SEQ ID NO: 467968 - DNA, 25 bp, Mus musculus
tatgtacaaaaagccagacttccgc

SEQ ID NO: 467969 - DNA, 25 bp, Mus musculus
tatgtacaacctgagatgcgctgcg

SEQ ID NO: 467970 - DNA, 25 bp, Mus musculus
tatgtacaccaggaacgcaaaggca

SEQ ID NO: 467971 - DNA, 25 bp, Mus musculus
tatgtacaggtgttcttcactctga

SEQ ID NO: 467972 - DNA, 25 bp, Mus musculus
tatgtacatacatccctaggctgat

SEQ ID NO: 467973 - DNA, 25 bp, Mus musculus
tatgtacatctttgcccggaaaacc

SEQ ID NO: 467974 - DNA, 25 bp, Mus musculus
tatgtacccctgaaatggaacttgg

SEQ ID NO: 467975 - DNA, 25 bp, Mus musculus
tatgtaccggaattgactgcacagt

SEQ ID NO: 467976 - DNA, 25 bp, Mus musculus
tatgtacctgccagaaccaggagag

SEQ ID NO: 467977 - DNA, 25 bp, Mus musculus
tatgtacgtgacctatgcactctgc

SEQ ID NO: 467978 - DNA, 25 bp, Mus musculus
tatgtactaagcttggcctggagga

SEQ ID NO: 467979 - DNA, 25 bp, Mus musculus
tatgtactaccgaggatctgctgca

SEQ ID NO: 467980 - DNA, 25 bp, Mus musculus
tatgtactcctaagtggcgctggtg

SEQ ID NO: 467981 - DNA, 25 bp, Mus musculus
tatgtactgactgaagctcggatgg

SEQ ID NO: 467982 - DNA, 25 bp, Mus musculus
tatgtactggatgcagcgcagaccc

SEQ ID NO: 467983 - DNA, 25 bp, Mus musculus
tatgtagaaccgctgcagaaaccct

SEQ ID NO: 467984 - DNA, 25 bp, Mus musculus
tatgtagaagctaagtgagctctaa

SEQ ID NO: 467985 - DNA, 25 bp, Mus musculus
tatgtagatctctccctgttaccag

SEQ ID NO: 467986 - DNA, 25 bp, Mus musculus
tatgtagcacattcacaaggctgag

SEQ ID NO: 467987 - DNA, 25 bp, Mus musculus
tatgtagccaagcagaccaagggca

SEQ ID NO: 467988 - DNA, 25 bp, Mus musculus
tatgtagctcgtgtctgcctcagag

SEQ ID NO: 467989 - DNA, 25 bp, Mus musculus
tatgtaggagggttcaaagcttcac

SEQ ID NO: 467990 - DNA, 25 bp, Mus musculus
tatgtagggacccatcttgaggcca

SEQ ID NO: 467991 - DNA, 25 bp, Mus musculus
tatgtagggctaaccgtgaactcga

SEQ ID NO: 467992 - DNA, 25 bp, Mus musculus
tatgtagggctcttgatcagtgtgc

SEQ ID NO: 467993 - DNA, 25 bp, Mus musculus
tatgtagtcacacgctagctgctag

SEQ ID NO: 467994 - DNA, 25 bp, Mus musculus
tatgtagtgtatctagcccttgggc

SEQ ID NO: 467995 - DNA, 25 bp, Mus musculus
tatgtagttagggtgtgctacagcc

SEQ ID NO: 467996 - DNA, 25 bp, Mus musculus
tatgtataaaccaaccgcgtcctgc

SEQ ID NO: 467997 - DNA, 25 bp, Mus musculus
tatgtatatggcagccgtggcccca

SEQ ID NO: 467998 - DNA, 25 bp, Mus musculus
tatgtatctgtaccagaggagaacc

SEQ ID NO: 467999 - DNA, 25 bp, Mus musculus
tatgtatgaacttcgctccggaacc

SEQ ID NO: 468000 - DNA, 25 bp, Mus musculus
tatgtatgacatgaaaaggcttttc

SEQ ID NO: 468001 - DNA, 25 bp, Mus musculus
tatgtatgtataggagacggcggca

SEQ ID NO: 468002 - DNA, 25 bp, Mus musculus
tatgtatgtctcttcattgtaggcc

SEQ ID NO: 468003 - DNA, 25 bp, Mus musculus
tatgtattctcagctggcctcaaac

SEQ ID NO: 468004 - DNA, 25 bp, Mus musculus
tatgtatttaaccagggaccgtcgg

SEQ ID NO: 468005 - DNA, 25 bp, Mus musculus
tatgtatttaggtcagtccccagaa

SEQ ID NO: 468006 - DNA, 25 bp, Mus musculus
tatgtatttcctatgacgtcatact

SEQ ID NO: 468007 - DNA, 25 bp, Mus musculus
tatgtcaaacccagtcacagtggca

SEQ ID NO: 468008 - DNA, 25 bp, Mus musculus
tatgtcaaaggctcccgcaaaagaa

SEQ ID NO: 468009 - DNA, 25 bp, Mus musculus
tatgtcaacgacacgggtgaggtgc

SEQ ID NO: 468010 - DNA, 25 bp, Mus musculus
tatgtcaactgatcctaccctctgg

SEQ ID NO: 468011 - DNA, 25 bp, Mus musculus
tatgtcaagacctacctgctgcctg

SEQ ID NO: 468012 - DNA, 25 bp, Mus musculus
tatgtcaagcccgtaaactccgagc

SEQ ID NO: 468013 - DNA, 25 bp, Mus musculus
tatgtcaaggactcacgagccagca

SEQ ID NO: 468014 - DNA, 25 bp, Mus musculus
tatgtcacaagaagccgaatcagcc

SEQ ID NO: 468015 - DNA, 25 bp, Mus musculus
tatgtcacaagtaagaggccttcct

SEQ ID NO: 468016 - DNA, 25 bp, Mus musculus
tatgtcacaatcaggaagaaacacc

SEQ ID NO: 468017 - DNA, 25 bp, Mus musculus
tatgtcactcagcacatcagcagcc

SEQ ID NO: 468018 - DNA, 25 bp, Mus musculus
tatgtcagaagccagatcatttccc

SEQ ID NO: 468019 - DNA, 25 bp, Mus musculus
tatgtcagccatggaaacggagtcc

SEQ ID NO: 468020 - DNA, 25 bp, Mus musculus
tatgtcagctcaagggtcaaaagga

SEQ ID NO: 468021 - DNA, 25 bp, Mus musculus
tatgtcaggccgagggttatccaga

SEQ ID NO: 468022 - DNA, 25 bp, Mus musculus
tatgtcagggtcaggtttcttggga

SEQ ID NO: 468023 - DNA, 25 bp, Mus musculus
tatgtcagtcagactcaagtgtgac

SEQ ID NO: 468024 - DNA, 25 bp, Mus musculus
tatgtcatcacttctgcaggccagc

SEQ ID NO: 468025 - DNA, 25 bp, Mus musculus
tatgtcatggctaaggtttattcct

SEQ ID NO: 468026 - DNA, 25 bp, Mus musculus
tatgtcattgccctgaggtcggtca

SEQ ID NO: 468027 - DNA, 25 bp, Mus musculus
tatgtcatttaaaatgtctgccaac

SEQ ID NO: 468028 - DNA, 25 bp, Mus musculus
tatgtcatttgctccccaacctgag

SEQ ID NO: 468029 - DNA, 25 bp, Mus musculus
tatgtccaacatggatcctcacggg

SEQ ID NO: 468030 - DNA, 25 bp, Mus musculus
tatgtccaatctggccatcgatgca

SEQ ID NO: 468031 - DNA, 25 bp, Mus musculus
tatgtccaatgccatgcggctgaaa

SEQ ID NO: 468032 - DNA, 25 bp, Mus musculus
tatgtccagatcttcgaattgacct

SEQ ID NO: 468033 - DNA, 25 bp, Mus musculus
tatgtccagcccaatcagaaggaga

SEQ ID NO: 468034 - DNA, 25 bp, Mus musculus
tatgtccagttacctgttcatcatc

SEQ ID NO: 468035 - DNA, 25 bp, Mus musculus
tatgtcccaaagtcctaagctaaat

SEQ ID NO: 468036 - DNA, 25 bp, Mus musculus
tatgtccctcgagctatcttggtgg

SEQ ID NO: 468037 - DNA, 25 bp, Mus musculus
tatgtccctgtgtatccggtgggca

SEQ ID NO: 468038 - DNA, 25 bp, Mus musculus
tatgtccggcaggaagacgttcagt

SEQ ID NO: 468039 - DNA, 25 bp, Mus musculus
tatgtccggcagtgtgtcccttaga

SEQ ID NO: 468040 - DNA, 25 bp, Mus musculus
tatgtccgggccacctggtcgaggt

SEQ ID NO: 468041 - DNA, 25 bp, Mus musculus
tatgtcctagagaagagaactgcag

SEQ ID NO: 468042 - DNA, 25 bp, Mus musculus
tatgtccttgagaaccagccttgag

SEQ ID NO: 468043 - DNA, 25 bp, Mus musculus
tatgtcctttttcaagctgccacag

SEQ ID NO: 468044 - DNA, 25 bp, Mus musculus
tatgtcgagggagggtgttggatcc

SEQ ID NO: 468045 - DNA, 25 bp, Mus musculus
tatgtcgagtggaatcacggcccag

SEQ ID NO: 468046 - DNA, 25 bp, Mus musculus
tatgtcgccctgtcgagagagtttg

SEQ ID NO: 468047 - DNA, 25 bp, Mus musculus
tatgtcgggcccaggctgagatgct

SEQ ID NO: 468048 - DNA, 25 bp, Mus musculus
tatgtcgtacatgtgccctgggagt

SEQ ID NO: 468049 - DNA, 25 bp, Mus musculus
tatgtctaggctgttgccacgtgct

SEQ ID NO: 468050 - DNA, 25 bp, Mus musculus
tatgtctctaaagcactggtccacg

SEQ ID NO: 468051 - DNA, 25 bp, Mus musculus
tatgtctgaaaagcaaagccccaag

SEQ ID NO: 468052 - DNA, 25 bp, Mus musculus
tatgtctgacaaacggcagtccagc

SEQ ID NO: 468053 - DNA, 25 bp, Mus musculus
tatgtctgactctagaacagggagg

SEQ ID NO: 468054 - DNA, 25 bp, Mus musculus
tatgtctgcagaaccctgtaggaag

SEQ ID NO: 468055 - DNA, 25 bp, Mus musculus
tatgtctggaccctatcaagaagca

SEQ ID NO: 468056 - DNA, 25 bp, Mus musculus
tatgtctggcctagaaatgggttgc

SEQ ID NO: 468057 - DNA, 25 bp, Mus musculus
tatgtctgtccaagaccttctgcag

SEQ ID NO: 468058 - DNA, 25 bp, Mus musculus
tatgtctgtctggtaagaggccacc

SEQ ID NO: 468059 - DNA, 25 bp, Mus musculus
tatgtcttagaaagggaccggcaca

SEQ ID NO: 468060 - DNA, 25 bp, Mus musculus
tatgtcttgcacatgaagcctttga

SEQ ID NO: 468061 - DNA, 25 bp, Mus musculus
tatgtcttgctcagggattaaaccc

SEQ ID NO: 468062 - DNA, 25 bp, Mus musculus
tatgtcttttacagatattgtcccc

SEQ ID NO: 468063 - DNA, 25 bp, Mus musculus
tatgtgaaaaacttcgaccgggcgg

SEQ ID NO: 468064 - DNA, 25 bp, Mus musculus
tatgtgaaagccttggagtgcgcca

SEQ ID NO: 468065 - DNA, 25 bp, Mus musculus
tatgtgaaagtgatccagggaccag

SEQ ID NO: 468066 - DNA, 25 bp, Mus musculus
tatgtgaacctctatggcagtcccc

SEQ ID NO: 468067 - DNA, 25 bp, Mus musculus
tatgtgaacgctcccaactgcagga

SEQ ID NO: 468068 - DNA, 25 bp, Mus musculus
tatgtgacatgcaggagaaacttcg

SEQ ID NO: 468069 - DNA, 25 bp, Mus musculus
tatgtgacccgatctcattcaggag

SEQ ID NO: 468070 - DNA, 25 bp, Mus musculus
tatgtgaccttctgcctgatgccga

SEQ ID NO: 468071 - DNA, 25 bp, Mus musculus
tatgtgacgacgatcttccggagcc

SEQ ID NO: 468072 - DNA, 25 bp, Mus musculus
tatgtgagaccacctaggagcttta

SEQ ID NO: 468073 - DNA, 25 bp, Mus musculus
tatgtgagacccgagatgaggctgt

SEQ ID NO: 468074 - DNA, 25 bp, Mus musculus
tatgtgagagcaataaggagcctac

SEQ ID NO: 468075 - DNA, 25 bp, Mus musculus
tatgtgagagtgctacctctgggca

SEQ ID NO: 468076 - DNA, 25 bp, Mus musculus
tatgtgaggccaaatagacgaactg

SEQ ID NO: 468077 - DNA, 25 bp, Mus musculus
tatgtgagtctttgagcccacgccg

SEQ ID NO: 468078 - DNA, 25 bp, Mus musculus
tatgtgatctttgtatccggtacac

SEQ ID NO: 468079 - DNA, 25 bp, Mus musculus
tatgtgatgccagcagattcagtct

SEQ ID NO: 468080 - DNA, 25 bp, Mus musculus
tatgtgatgtacaagttcctgaccg

SEQ ID NO: 468081 - DNA, 25 bp, Mus musculus
tatgtgattcccgtgtcctgtgctg

SEQ ID NO: 468082 - DNA, 25 bp, Mus musculus
tatgtgcaacatttgggagcccagt

SEQ ID NO: 468083 - DNA, 25 bp, Mus musculus
tatgtgcaactgaaaacacccttgt

SEQ ID NO: 468084 - DNA, 25 bp, Mus musculus
tatgtgcaataaccacaatagtacc

SEQ ID NO: 468085 - DNA, 25 bp, Mus musculus
tatgtgcacagagacctacttgggc

SEQ ID NO: 468086 - DNA, 25 bp, Mus musculus
tatgtgcaccacttgtgttcaggag

SEQ ID NO: 468087 - DNA, 25 bp, Mus musculus
tatgtgcacttatccagactgagga

SEQ ID NO: 468088 - DNA, 25 bp, Mus musculus
tatgtgcacttcaattcaggagcca

SEQ ID NO: 468089 - DNA, 25 bp, Mus musculus
tatgtgcatatcagaaccctcggtg

SEQ ID NO: 468090 - DNA, 25 bp, Mus musculus
tatgtgccaaactgtgacctcagag

SEQ ID NO: 468091 - DNA, 25 bp, Mus musculus
tatgtgccacttaaggacatcgtgg

SEQ ID NO: 468092 - DNA, 25 bp, Mus musculus
tatgtgccagcagaaacgattgtac

SEQ ID NO: 468093 - DNA, 25 bp, Mus musculus
tatgtgcccgggactgacctgagtc

SEQ ID NO: 468094 - DNA, 25 bp, Mus musculus
tatgtgcgcatcctgagtaccatcg

SEQ ID NO: 468095 - DNA, 25 bp, Mus musculus
tatgtgcgctcacgataaggcagtt

SEQ ID NO: 468096 - DNA, 25 bp, Mus musculus
tatgtgcgctcccagaagctaagga

SEQ ID NO: 468097 - DNA, 25 bp, Mus musculus
tatgtgcggaacagcggaacctgaa

SEQ ID NO: 468098 - DNA, 25 bp, Mus musculus
tatgtgcgggcctctcatcaaggag

SEQ ID NO: 468099 - DNA, 25 bp, Mus musculus
tatgtgcgtccctagcatgtcggct

SEQ ID NO: 468100 - DNA, 25 bp, Mus musculus
tatgtgctaaccaggaactgtcggg

SEQ ID NO: 468101 - DNA, 25 bp, Mus musculus
tatgtgctaaggtccggaaagtggt

SEQ ID NO: 468102 - DNA, 25 bp, Mus musculus
tatgtgctacagtctgcggaacgga

SEQ ID NO: 468103 - DNA, 25 bp, Mus musculus
tatgtgctacgatgcagccctaagg

SEQ ID NO: 468104 - DNA, 25 bp, Mus musculus
tatgtgctgctacgtccctttgaga

SEQ ID NO: 468105 - DNA, 25 bp, Mus musculus
tatgtgcttcaggtgtgaagctccg

SEQ ID NO: 468106 - DNA, 25 bp, Mus musculus
tatgtgcttccacactgagcctggg

SEQ ID NO: 468107 - DNA, 25 bp, Mus musculus
tatgtgcttgccagccaagtgcacc

SEQ ID NO: 468108 - DNA, 25 bp, Mus musculus
tatgtggacaataaccggagctggt

SEQ ID NO: 468109 - DNA, 25 bp, Mus musculus
tatgtggacaatggcagggtcctcc

SEQ ID NO: 468110 - DNA, 25 bp, Mus musculus
tatgtggaccaagctgggctctaat

SEQ ID NO: 468111 - DNA, 25 bp, Mus musculus
tatgtggagactcaccttgccctgg

SEQ ID NO: 468112 - DNA, 25 bp, Mus musculus
tatgtggagagcttaattccgccgc

SEQ ID NO: 468113 - DNA, 25 bp, Mus musculus
tatgtggagatcatcgaacagccga

SEQ ID NO: 468114 - DNA, 25 bp, Mus musculus
tatgtggagatgaccgtaggcagcc

SEQ ID NO: 468115 - DNA, 25 bp, Mus musculus
tatgtggagcactgtctgaaagggt

SEQ ID NO: 468116 - DNA, 25 bp, Mus musculus
tatgtggatacctcaccagtggccc

SEQ ID NO: 468117 - DNA, 25 bp, Mus musculus
tatgtggatatgagcatgggaatcc

SEQ ID NO: 468118 - DNA, 25 bp, Mus musculus
tatgtggatcctaaccaacgcgcaa

SEQ ID NO: 468119 - DNA, 25 bp, Mus musculus
tatgtggcagtttgtcggcccctgc

SEQ ID NO: 468120 - DNA, 25 bp, Mus musculus
tatgtggcatcagcttgtgacctgc

SEQ ID NO: 468121 - DNA, 25 bp, Mus musculus
tatgtggcatccctgaagcctttca

SEQ ID NO: 468122 - DNA, 25 bp, Mus musculus
tatgtggccctgaataaagacggct

SEQ ID NO: 468123 - DNA, 25 bp, Mus musculus
tatgtggcccttgacaactgcgtgg

SEQ ID NO: 468124 - DNA, 25 bp, Mus musculus
tatgtggcctagcaggttaccgtct

SEQ ID NO: 468125 - DNA, 25 bp, Mus musculus
tatgtggcctctgtgttgactagaa

SEQ ID NO: 468126 - DNA, 25 bp, Mus musculus
tatgtggcctgctcctaggactcca

SEQ ID NO: 468127 - DNA, 25 bp, Mus musculus
tatgtggccttgcatggagcacctg

SEQ ID NO: 468128 - DNA, 25 bp, Mus musculus
tatgtggcgcaaccttgctcaaccg

SEQ ID NO: 468129 - DNA, 25 bp, Mus musculus
tatgtggcgcttcccaatgttgcaa

SEQ ID NO: 468130 - DNA, 25 bp, Mus musculus
tatgtggcgtcccaacctaagctgg

SEQ ID NO: 468131 - DNA, 25 bp, Mus musculus
tatgtggcttctcagctggaacgct

SEQ ID NO: 468132 - DNA, 25 bp, Mus musculus
tatgtgggaaaaccaccgaggctgc

SEQ ID NO: 468133 - DNA, 25 bp, Mus musculus
tatgtgggcgatgcattactctacg

SEQ ID NO: 468134 - DNA, 25 bp, Mus musculus
tatgtgggcttagcacccaggagcc

SEQ ID NO: 468135 - DNA, 25 bp, Mus musculus
tatgtggtctactcgtccgtctgct

SEQ ID NO: 468136 - DNA, 25 bp, Mus musculus
tatgtggtgaatatgcccaaattgc

SEQ ID NO: 468137 - DNA, 25 bp, Mus musculus
tatgtggtggccagttacctgcgcg

SEQ ID NO: 468138 - DNA, 25 bp, Mus musculus
tatgtggtgggatcttcctccgaga

SEQ ID NO: 468139 - DNA, 25 bp, Mus musculus
tatgtggtggttcttcagcccgacg

SEQ ID NO: 468140 - DNA, 25 bp, Mus musculus
tatgtggttcaccaactgtgtagac

SEQ ID NO: 468141 - DNA, 25 bp, Mus musculus
tatgtggttgttggactggtcagac

SEQ ID NO: 468142 - DNA, 25 bp, Mus musculus
tatgtgtaagacaaggacggattcc

SEQ ID NO: 468143 - DNA, 25 bp, Mus musculus
tatgtgtacagtttccgcagcgagc

SEQ ID NO: 468144 - DNA, 25 bp, Mus musculus
tatgtgtaccttatgcacaacggca

SEQ ID NO: 468145 - DNA, 25 bp, Mus musculus
tatgtgtcaacactggcttccgagg

SEQ ID NO: 468146 - DNA, 25 bp, Mus musculus
tatgtgtcaccttactgagccaggg

SEQ ID NO: 468147 - DNA, 25 bp, Mus musculus
tatgtgtcaggaccattctagaggc

SEQ ID NO: 468148 - DNA, 25 bp, Mus musculus
tatgtgtcagggatgaaagcttgcc

SEQ ID NO: 468149 - DNA, 25 bp, Mus musculus
tatgtgtccctgcccggcgactggc

SEQ ID NO: 468150 - DNA, 25 bp, Mus musculus
tatgtgtcctttgtcgacgagccgc

SEQ ID NO: 468151 - DNA, 25 bp, Mus musculus
tatgtgtctagacctaccgagaaga

SEQ ID NO: 468152 - DNA, 25 bp, Mus musculus
tatgtgtgacacaagtcttcttggc

SEQ ID NO: 468153 - DNA, 25 bp, Mus musculus
tatgtgtgagcccaggtgcaagttc

SEQ ID NO: 468154 - DNA, 25 bp, Mus musculus
tatgtgtgatccaatgccgctggct

SEQ ID NO: 468155 - DNA, 25 bp, Mus musculus
tatgtgtgatctaaaagtctgaccc

SEQ ID NO: 468156 - DNA, 25 bp, Mus musculus
tatgtgtgatgaagtccgaagcggc

SEQ ID NO: 468157 - DNA, 25 bp, Mus musculus
tatgtgtgcctatcactcgatagct

SEQ ID NO: 468158 - DNA, 25 bp, Mus musculus
tatgtgtgctgagaaccagacctgg

SEQ ID NO: 468159 - DNA, 25 bp, Mus musculus
tatgtgtggtctagaacccttggca

SEQ ID NO: 468160 - DNA, 25 bp, Mus musculus
tatgtgtgtctctcaatcgatgatg

SEQ ID NO: 468161 - DNA, 25 bp, Mus musculus
tatgtgtgttgagccatgcttgtac

SEQ ID NO: 468162 - DNA, 25 bp, Mus musculus
tatgtgttcaagtagccgcaaggga

SEQ ID NO: 468163 - DNA, 25 bp, Mus musculus
tatgtgtttacaccatcgctgcctc

SEQ ID NO: 468164 - DNA, 25 bp, Mus musculus
tatgtgtttgactcagcacccagcc

SEQ ID NO: 468165 - DNA, 25 bp, Mus musculus
tatgtgttttccaaagagttcttcc

SEQ ID NO: 468166 - DNA, 25 bp, Mus musculus
tatgttaaccaaagagacgccagag

SEQ ID NO: 468167 - DNA, 25 bp, Mus musculus
tatgttaaggccaaggtcgtgtccc

SEQ ID NO: 468168 - DNA, 25 bp, Mus musculus
tatgttacagaaaatgcggccatcg

SEQ ID NO: 468169 - DNA, 25 bp, Mus musculus
tatgttacagatggcgcttgctccg

SEQ ID NO: 468170 - DNA, 25 bp, Mus musculus
tatgttacatgctcaaaggactctg

SEQ ID NO: 468171 - DNA, 25 bp, Mus musculus
tatgttaccaatgtgaaggcccgac

SEQ ID NO: 468172 - DNA, 25 bp, Mus musculus
tatgttaccgaaagcgaccaaggaa

SEQ ID NO: 468173 - DNA, 25 bp, Mus musculus
tatgttacttccattgagagccgtc

SEQ ID NO: 468174 - DNA, 25 bp, Mus musculus
tatgttagtgtgagcagaaacccgg

SEQ ID NO: 468175 - DNA, 25 bp, Mus musculus
tatgttatctcgctgaatcaccggg

SEQ ID NO: 468176 - DNA, 25 bp, Mus musculus
tatgttatcttcatctgtaacccag

SEQ ID NO: 468177 - DNA, 25 bp, Mus musculus
tatgttcacctttaccagggcgggc

SEQ ID NO: 468178 - DNA, 25 bp, Mus musculus
tatgttcagtacctagaaaggccag

SEQ ID NO: 468179 - DNA, 25 bp, Mus musculus
tatgttcatcgagatcttgccgcga

SEQ ID NO: 468180 - DNA, 25 bp, Mus musculus
tatgttcccagatgagcgatgtcga

SEQ ID NO: 468181 - DNA, 25 bp, Mus musculus
tatgttccccagtgagaatgagctc

SEQ ID NO: 468182 - DNA, 25 bp, Mus musculus
tatgttcccttcactcaggcttgct

SEQ ID NO: 468183 - DNA, 25 bp, Mus musculus
tatgttcctgacagaatggactggg

SEQ ID NO: 468184 - DNA, 25 bp, Mus musculus
tatgttcgaggagggctcgttccgc

SEQ ID NO: 468185 - DNA, 25 bp, Mus musculus
tatgttctacgcagagaagggctct

SEQ ID NO: 468186 - DNA, 25 bp, Mus musculus
tatgttctctgcttggtatattgcc

SEQ ID NO: 468187 - DNA, 25 bp, Mus musculus
tatgttctgctaggtgtagctcagt

SEQ ID NO: 468188 - DNA, 25 bp, Mus musculus
tatgttgaaattgagcgtgctcggc

SEQ ID NO: 468189 - DNA, 25 bp, Mus musculus
tatgttgaacggcacgatcctatgg

SEQ ID NO: 468190 - DNA, 25 bp, Mus musculus
tatgttgacaaatcctacctaggca

SEQ ID NO: 468191 - DNA, 25 bp, Mus musculus
tatgttgacgccactgtgaccttgg

SEQ ID NO: 468192 - DNA, 25 bp, Mus musculus
tatgttgactcgagtcacgaccggg

SEQ ID NO: 468193 - DNA, 25 bp, Mus musculus
tatgttgcagagtaagagacatctg

SEQ ID NO: 468194 - DNA, 25 bp, Mus musculus
tatgttgcaggactaactacgacca

SEQ ID NO: 468195 - DNA, 25 bp, Mus musculus
tatgttgcccctgcagaagtcgctc

SEQ ID NO: 468196 - DNA, 25 bp, Mus musculus
tatgttggacctgtaccgtgccatg

SEQ ID NO: 468197 - DNA, 25 bp, Mus musculus
tatgttggcagctacggatcttggc

SEQ ID NO: 468198 - DNA, 25 bp, Mus musculus
tatgttggcccacagccgggtgtaa

SEQ ID NO: 468199 - DNA, 25 bp, Mus musculus
tatgttggccctgaaacagaagcaa

SEQ ID NO: 468200 - DNA, 25 bp, Mus musculus
tatgttgggagaagtagcacacagc

SEQ ID NO: 468201 - DNA, 25 bp, Mus musculus
tatgttggtgggacactcagcccca

SEQ ID NO: 468202 - DNA, 25 bp, Mus musculus
tatgttgtaggctcaaggctccagc

SEQ ID NO: 468203 - DNA, 25 bp, Mus musculus
tatgtttctctaagacgtttcctgg

SEQ ID NO: 468204 - DNA, 25 bp, Mus musculus
tatgtttgactttgacggcgatgag

SEQ ID NO: 468205 - DNA, 25 bp, Mus musculus
tatgtttgcaacagctggcacactg

SEQ ID NO: 468206 - DNA, 25 bp, Mus musculus
tatgtttgcgggatgtgcatgccac

SEQ ID NO: 468207 - DNA, 25 bp, Mus musculus
tatgtttgtccgatggagctaggcc

SEQ ID NO: 468208 - DNA, 25 bp, Mus musculus
tatgttttcaagagtggccacacca

SEQ ID NO: 468209 - DNA, 25 bp, Mus musculus
tatgttttcttctcctgctgctatg

SEQ ID NO: 468210 - DNA, 25 bp, Mus musculus
tatgttttggctactcgggaacagc

SEQ ID NO: 468211 - DNA, 25 bp, Mus musculus
tattaaaaagtggttgcacaggccc

SEQ ID NO: 468212 - DNA, 25 bp, Mus musculus
tattaaaaccatagtcggagcgtgc

SEQ ID NO: 468213 - DNA, 25 bp, Mus musculus
tattaaaacttgcaagaagatgggc

SEQ ID NO: 468214 - DNA, 25 bp, Mus musculus
tattaaaagatcagtccctcgtccc

SEQ ID NO: 468215 - DNA, 25 bp, Mus musculus
tattaaaagcacacaatctgaaggg

SEQ ID NO: 468216 - DNA, 25 bp, Mus musculus
tattaaacaaggtagaggcataagc

SEQ ID NO: 468217 - DNA, 25 bp, Mus musculus
tattaaacccgcactgccatgtctg

SEQ ID NO: 468218 - DNA, 25 bp, Mus musculus
tattaaacctataatgtgtggaccc

SEQ ID NO: 468219 - DNA, 25 bp, Mus musculus
tattaaagccttcgccactcagtcg

SEQ ID NO: 468220 - DNA, 25 bp, Mus musculus
tattaaaggtgctatccagctggga

SEQ ID NO: 468221 - DNA, 25 bp, Mus musculus
tattaaatatgccagagacaggagc

SEQ ID NO: 468222 - DNA, 25 bp, Mus musculus
tattaaatgctaccgaaatgccctc

SEQ ID NO: 468223 - DNA, 25 bp, Mus musculus
tattaacactctgccctagaccaag

SEQ ID NO: 468224 - DNA, 25 bp, Mus musculus
tattaacagctgtaaaggatgccac

SEQ ID NO: 468225 - DNA, 25 bp, Mus musculus
tattaacaggatctgcctacgggag

SEQ ID NO: 468226 - DNA, 25 bp, Mus musculus
tattaacatggccagtccattccct

SEQ ID NO: 468227 - DNA, 25 bp, Mus musculus
tattaaccgggaacgtgccaacaat

SEQ ID NO: 468228 - DNA, 25 bp, Mus musculus
tattaaccgtgaggccaacctacag

SEQ ID NO: 468229 - DNA, 25 bp, Mus musculus
tattaacctctctcatcctgggtca

SEQ ID NO: 468230 - DNA, 25 bp, Mus musculus
tattaaccttgaaaccgctctttgt

SEQ ID NO: 468231 - DNA, 25 bp, Mus musculus
tattaacgaaggctggacctcgctg

SEQ ID NO: 468232 - DNA, 25 bp, Mus musculus
tattaactgccagtaggcgcaggcg

SEQ ID NO: 468233 - DNA, 25 bp, Mus musculus
tattaagagccaactgactgagcag

SEQ ID NO: 468234 - DNA, 25 bp, Mus musculus
tattaagattgtcaccccggactgg

SEQ ID NO: 468235 - DNA, 25 bp, Mus musculus
tattaagtagctgaacctggactgg

SEQ ID NO: 468236 - DNA, 25 bp, Mus musculus
tattaagtcacgatccagagaccca

SEQ ID NO: 468237 - DNA, 25 bp, Mus musculus
tattaagtcctataggtcaaggaag

SEQ ID NO: 468238 - DNA, 25 bp, Mus musculus
tattaagtgactggctgaggtccct

SEQ ID NO: 468239 - DNA, 25 bp, Mus musculus
tattaagtgggccaacccagcctgt

SEQ ID NO: 468240 - DNA, 25 bp, Mus musculus
tattaagtgtcctgggacgaggtcc

SEQ ID NO: 468241 - DNA, 25 bp, Mus musculus
tattaataacactccgggcgagccc

SEQ ID NO: 468242 - DNA, 25 bp, Mus musculus
tattaatgacatgtgggaccgtgac

SEQ ID NO: 468243 - DNA, 25 bp, Mus musculus
tattaatttgggatgcggcacacac

SEQ ID NO: 468244 - DNA, 25 bp, Mus musculus
tattacaaatctagtcccagtgggc

SEQ ID NO: 468245 - DNA, 25 bp, Mus musculus
tattacaacaacacgtacggagcgc

SEQ ID NO: 468246 - DNA, 25 bp, Mus musculus
tattacaacatggtgcccagtgacc

SEQ ID NO: 468247 - DNA, 25 bp, Mus musculus
tattacaaggctgacagagcgtccc

SEQ ID NO: 468248 - DNA, 25 bp, Mus musculus
tattacacggaaagcctgaactggt

SEQ ID NO: 468249 - DNA, 25 bp, Mus musculus
tattacactcacctgggatctggcc

SEQ ID NO: 468250 - DNA, 25 bp, Mus musculus
tattacagactaactgcggatgcgc

SEQ ID NO: 468251 - DNA, 25 bp, Mus musculus
tattacagagaaaccatggaccccg

SEQ ID NO: 468252 - DNA, 25 bp, Mus musculus
tattacagcagcacagcgcagagaa

SEQ ID NO: 468253 - DNA, 25 bp, Mus musculus
tattacaggatatcccaggagtact

SEQ ID NO: 468254 - DNA, 25 bp, Mus musculus
tattacaggtaagtccgatcccgta

SEQ ID NO: 468255 - DNA, 25 bp, Mus musculus
tattacaggtcccatgttggctgga

SEQ ID NO: 468256 - DNA, 25 bp, Mus musculus
tattacaggttggtcacagcacgaa

SEQ ID NO: 468257 - DNA, 25 bp, Mus musculus
tattaccagactttcagcccgagct

SEQ ID NO: 468258 - DNA, 25 bp, Mus musculus
tattaccagttgttgatcacccgga

SEQ ID NO: 468259 - DNA, 25 bp, Mus musculus
tattacccatccaagaacaggctgc

SEQ ID NO: 468260 - DNA, 25 bp, Mus musculus
tattacccgacggtctggtgctggg

SEQ ID NO: 468261 - DNA, 25 bp, Mus musculus
tattacccggaaaatgaaacttctg

SEQ ID NO: 468262 - DNA, 25 bp, Mus musculus
tattaccgctcagaattccccgggt

SEQ ID NO: 468263 - DNA, 25 bp, Mus musculus
tattaccgtcggaatattggatggg

SEQ ID NO: 468264 - DNA, 25 bp, Mus musculus
tattacctctactgccacgtcgggt

SEQ ID NO: 468265 - DNA, 25 bp, Mus musculus
tattacctctagatgaaattgggca

SEQ ID NO: 468266 - DNA, 25 bp, Mus musculus
tattacctgaagacagtgggccatc

SEQ ID NO: 468267 - DNA, 25 bp, Mus musculus
tattacctgagcagggcatctggag

SEQ ID NO: 468268 - DNA, 25 bp, Mus musculus
tattacctgctaagtcacacacctg

SEQ ID NO: 468269 - DNA, 25 bp, Mus musculus
tattacctggccttgtacagcgaga

SEQ ID NO: 468270 - DNA, 25 bp, Mus musculus
tattacctgtccaaaagtgtgccca

SEQ ID NO: 468271 - DNA, 25 bp, Mus musculus
tattacgacgggagaagatccagca

SEQ ID NO: 468272 - DNA, 25 bp, Mus musculus
tattacggacatcttcggagccagc

SEQ ID NO: 468273 - DNA, 25 bp, Mus musculus
tattacgtgctctatgagaccgtgg

SEQ ID NO: 468274 - DNA, 25 bp, Mus musculus
tattactacaccaggaaaaggacac

SEQ ID NO: 468275 - DNA, 25 bp, Mus musculus
tattactacattgcatggcctcatc

SEQ ID NO: 468276 - DNA, 25 bp, Mus musculus
tattactactgatgagcactccagg

SEQ ID NO: 468277 - DNA, 25 bp, Mus musculus
tattactatcaatctggaggtcgcc

SEQ ID NO: 468278 - DNA, 25 bp, Mus musculus
tattactatgatgggcttgggcgac

SEQ ID NO: 468279 - DNA, 25 bp, Mus musculus
tattactatgctggcaccttcaacg

SEQ ID NO: 468280 - DNA, 25 bp, Mus musculus
tattactcctctcagcagaccagtc

SEQ ID NO: 468281 - DNA, 25 bp, Mus musculus
tattactcctggtgcgagtccggcg

SEQ ID NO: 468282 - DNA, 25 bp, Mus musculus
tattactgaaaagctcttcccggca

SEQ ID NO: 468283 - DNA, 25 bp, Mus musculus
tattactgctgcttaccctccagga

SEQ ID NO: 468284 - DNA, 25 bp, Mus musculus
tattactggagggtgcaaaggtacc

SEQ ID NO: 468285 - DNA, 25 bp, Mus musculus
tattacttagggtagataacactaa

SEQ ID NO: 468286 - DNA, 25 bp, Mus musculus
tattacttggctgtggaccccgtga

SEQ ID NO: 468287 - DNA, 25 bp, Mus musculus
tattagaaccccagagagagactgc

SEQ ID NO: 468288 - DNA, 25 bp, Mus musculus
tattagaagactgggctctgggctg

SEQ ID NO: 468289 - DNA, 25 bp, Mus musculus
tattagacagtgcacaatgggcaga

SEQ ID NO: 468290 - DNA, 25 bp, Mus musculus
tattagacatttacaagactttacc

SEQ ID NO: 468291 - DNA, 25 bp, Mus musculus
tattagaccggttgcagttcggagc

SEQ ID NO: 468292 - DNA, 25 bp, Mus musculus
tattagacgttctctgccagcaaca

SEQ ID NO: 468293 - DNA, 25 bp, Mus musculus
tattagacgttctgttcctgttggc

SEQ ID NO: 468294 - DNA, 25 bp, Mus musculus
tattagactcctttgggccagtgcg

SEQ ID NO: 468295 - DNA, 25 bp, Mus musculus
tattagagatgacatgggaccaacc

SEQ ID NO: 468296 - DNA, 25 bp, Mus musculus
tattagagcacaagatggagcgtcc

SEQ ID NO: 468297 - DNA, 25 bp, Mus musculus
tattagaggatcttcagggctggat

SEQ ID NO: 468298 - DNA, 25 bp, Mus musculus
tattagaggcaggaatatcttctgc

SEQ ID NO: 468299 - DNA, 25 bp, Mus musculus
tattagagtgtgagtccaataggag

SEQ ID NO: 468300 - DNA, 25 bp, Mus musculus
tattagagtttccttccgcacttgg

SEQ ID NO: 468301 - DNA, 25 bp, Mus musculus
tattagataaaccacttgccctaga

SEQ ID NO: 468302 - DNA, 25 bp, Mus musculus
tattagataatacgcgccctgatgg

SEQ ID NO: 468303 - DNA, 25 bp, Mus musculus
tattagatagtagcatagaccagcc

SEQ ID NO: 468304 - DNA, 25 bp, Mus musculus
tattagatagtccaaagggagcagc

SEQ ID NO: 468305 - DNA, 25 bp, Mus musculus
tattagatgagcagacgcagcaggc

SEQ ID NO: 468306 - DNA, 25 bp, Mus musculus
tattagatgtctgctcctccagcag

SEQ ID NO: 468307 - DNA, 25 bp, Mus musculus
tattagcaaagcctgcactggtgtc

SEQ ID NO: 468308 - DNA, 25 bp, Mus musculus
tattagcacacctgctcgaagaccc

SEQ ID NO: 468309 - DNA, 25 bp, Mus musculus
tattagcagctactcatgtggaagc

SEQ ID NO: 468310 - DNA, 25 bp, Mus musculus
tattagcctctatctttctgaaagg

SEQ ID NO: 468311 - DNA, 25 bp, Mus musculus
tattagcgtgaaaccgagaaagctg

SEQ ID NO: 468312 - DNA, 25 bp, Mus musculus
tattagctactgtacaaccttcggg

SEQ ID NO: 468313 - DNA, 25 bp, Mus musculus
tattaggaaacgaggcctgagcttg

SEQ ID NO: 468314 - DNA, 25 bp, Mus musculus
tattaggagcgaagagaactggact

SEQ ID NO: 468315 - DNA, 25 bp, Mus musculus
tattaggagctattctagggtgagg

SEQ ID NO: 468316 - DNA, 25 bp, Mus musculus
tattaggcagggagttagaaccaca

SEQ ID NO: 468317 - DNA, 25 bp, Mus musculus
tattaggctccatgcaggagtccag

SEQ ID NO: 468318 - DNA, 25 bp, Mus musculus
tattaggcttattaccgcagcacca

SEQ ID NO: 468319 - DNA, 25 bp, Mus musculus
tattaggtgacaaactaggctgttg

SEQ ID NO: 468320 - DNA, 25 bp, Mus musculus
tattagtaactctgccgaagaccca

SEQ ID NO: 468321 - DNA, 25 bp, Mus musculus
tattagtaggtgttaggctccggcc

SEQ ID NO: 468322 - DNA, 25 bp, Mus musculus
tattagtcaattacagagagaaggg

SEQ ID NO: 468323 - DNA, 25 bp, Mus musculus
tattagtccccaggaaatacgcttg

SEQ ID NO: 468324 - DNA, 25 bp, Mus musculus
tattagtgacctctcagtttgggaa

SEQ ID NO: 468325 - DNA, 25 bp, Mus musculus
tattagtgactatgctcctttaggg

SEQ ID NO: 468326 - DNA, 25 bp, Mus musculus
tattagttcagaaggctgtgttggg

SEQ ID NO: 468327 - DNA, 25 bp, Mus musculus
tattataaacacaaggcacattctg

SEQ ID NO: 468328 - DNA, 25 bp, Mus musculus
tattatagaccagacagcttgggcc

SEQ ID NO: 468329 - DNA, 25 bp, Mus musculus
tattatagatgatgcactggtccgg

SEQ ID NO: 468330 - DNA, 25 bp, Mus musculus
tattatccagctacaaagtgagcag

SEQ ID NO: 468331 - DNA, 25 bp, Mus musculus
tattatccaggaaaccagaccctcc

SEQ ID NO: 468332 - DNA, 25 bp, Mus musculus
tattatccatgactctcacaggtgg

SEQ ID NO: 468333 - DNA, 25 bp, Mus musculus
tattatccatggagtggcgctccca

SEQ ID NO: 468334 - DNA, 25 bp, Mus musculus
tattatcccagcgatgcgtctgtgc

SEQ ID NO: 468335 - DNA, 25 bp, Mus musculus
tattatccccaacacaacagttctc

SEQ ID NO: 468336 - DNA, 25 bp, Mus musculus
tattatcccgcatgttccagcctca

SEQ ID NO: 468337 - DNA, 25 bp, Mus musculus
tattatcctggccatcgtgggactg

SEQ ID NO: 468338 - DNA, 25 bp, Mus musculus
tattatctcaaagattgagactgcc

SEQ ID NO: 468339 - DNA, 25 bp, Mus musculus
tattatctgtgaagaagtgatgtag

SEQ ID NO: 468340 - DNA, 25 bp, Mus musculus
tattatctttctgcattagtgcggc

SEQ ID NO: 468341 - DNA, 25 bp, Mus musculus
tattatgcataataccctggattct

SEQ ID NO: 468342 - DNA, 25 bp, Mus musculus
tattatgcccaggaaatgtgacact

SEQ ID NO: 468343 - DNA, 25 bp, Mus musculus
tattatgcctcccttaatgtttttg

SEQ ID NO: 468344 - DNA, 25 bp, Mus musculus
tattatggaacacagcagcacgcaa

SEQ ID NO: 468345 - DNA, 25 bp, Mus musculus
tattatggatcgttgacccaggcgg

SEQ ID NO: 468346 - DNA, 25 bp, Mus musculus
tattatgggcatccggagcctgagc

SEQ ID NO: 468347 - DNA, 25 bp, Mus musculus
tattatggtcatcactctggcgtcg

SEQ ID NO: 468348 - DNA, 25 bp, Mus musculus
tattatgtaggaactggagctggac

SEQ ID NO: 468349 - DNA, 25 bp, Mus musculus
tattatgtctcccagcgtgggtacc

SEQ ID NO: 468350 - DNA, 25 bp, Mus musculus
tattatgtgcctccagaaatctggg

SEQ ID NO: 468351 - DNA, 25 bp, Mus musculus
tattatgtggactaccggagcgaca

SEQ ID NO: 468352 - DNA, 25 bp, Mus musculus
tattatgttactcaaaactctgtcc

SEQ ID NO: 468353 - DNA, 25 bp, Mus musculus
tattatgttccagtcgacaggccgg

SEQ ID NO: 468354 - DNA, 25 bp, Mus musculus
tattattaccagtcaggaggccgcc

SEQ ID NO: 468355 - DNA, 25 bp, Mus musculus
tattattacccaaatgacgcagccg

SEQ ID NO: 468356 - DNA, 25 bp, Mus musculus
tattattccaggaacagaggcggca

SEQ ID NO: 468357 - DNA, 25 bp, Mus musculus
tattattccggccatctagccacag

SEQ ID NO: 468358 - DNA, 25 bp, Mus musculus
tattattccgtatctcagtaacaat

SEQ ID NO: 468359 - DNA, 25 bp, Mus musculus
tattattctgggacaaggagaccca

SEQ ID NO: 468360 - DNA, 25 bp, Mus musculus
tattcaaaaagactgcaccaaggtg

SEQ ID NO: 468361 - DNA, 25 bp, Mus musculus
tattcaaacataagctgcactgtcg

SEQ ID NO: 468362 - DNA, 25 bp, Mus musculus
tattcaaaggcggataggcatcctg

SEQ ID NO: 468363 - DNA, 25 bp, Mus musculus
tattcaaattcctctggactatgaa

SEQ ID NO: 468364 - DNA, 25 bp, Mus musculus
tattcaacacatcccattggaagcc

SEQ ID NO: 468365 - DNA, 25 bp, Mus musculus
tattcaacaccctgtgctcatgaga

SEQ ID NO: 468366 - DNA, 25 bp, Mus musculus
tattcaacactagagctgccggagg

SEQ ID NO: 468367 - DNA, 25 bp, Mus musculus
tattcaacaggtggcaattcccaag

SEQ ID NO: 468368 - DNA, 25 bp, Mus musculus
tattcaacccagagtacagcacagc

SEQ ID NO: 468369 - DNA, 25 bp, Mus musculus
tattcaacgctagtgggctgcaggc

SEQ ID NO: 468370 - DNA, 25 bp, Mus musculus
tattcaagatcgcaatcatggaggg

SEQ ID NO: 468371 - DNA, 25 bp, Mus musculus
tattcaagcaataatgcccgccgga

SEQ ID NO: 468372 - DNA, 25 bp, Mus musculus
tattcaaggaaaataagcgtccgtc

SEQ ID NO: 468373 - DNA, 25 bp, Mus musculus
tattcaaggcgcacagaatgcgcac

SEQ ID NO: 468374 - DNA, 25 bp, Mus musculus
tattcaaggtcgtggaaggtcagac

SEQ ID NO: 468375 - DNA, 25 bp, Mus musculus
tattcaagtggatgtggccccagcc

SEQ ID NO: 468376 - DNA, 25 bp, Mus musculus
tattcaagtgtcacaagaagcccct

SEQ ID NO: 468377 - DNA, 25 bp, Mus musculus
tattcaatctgcacaaagtccaagg

SEQ ID NO: 468378 - DNA, 25 bp, Mus musculus
tattcaatgactatacagccacgct

SEQ ID NO: 468379 - DNA, 25 bp, Mus musculus
tattcaatgactatgcggccaccct

SEQ ID NO: 468380 - DNA, 25 bp, Mus musculus
tattcaatgagcgtctgctgacagg

SEQ ID NO: 468381 - DNA, 25 bp, Mus musculus
tattcacaacaacagtgtcagacgc

SEQ ID NO: 468382 - DNA, 25 bp, Mus musculus
tattcacaacacaaggaaccatggg

SEQ ID NO: 468383 - DNA, 25 bp, Mus musculus
tattcacacagagccggcgatggaa

SEQ ID NO: 468384 - DNA, 25 bp, Mus musculus
tattcacagagatttggcagccagg

SEQ ID NO: 468385 - DNA, 25 bp, Mus musculus
tattcacagcccaggtaagtccaag

SEQ ID NO: 468386 - DNA, 25 bp, Mus musculus
tattcaccaggctccgaaaagagtt

SEQ ID NO: 468387 - DNA, 25 bp, Mus musculus
tattcaccgaggtggccccagcctg

SEQ ID NO: 468388 - DNA, 25 bp, Mus musculus
tattcaccggactccttcaggagag

SEQ ID NO: 468389 - DNA, 25 bp, Mus musculus
tattcacctaggatggaacagcaga

SEQ ID NO: 468390 - DNA, 25 bp, Mus musculus
tattcacgagtgcatctggagagct

SEQ ID NO: 468391 - DNA, 25 bp, Mus musculus
tattcacggagagatcacctatgcc

SEQ ID NO: 468392 - DNA, 25 bp, Mus musculus
tattcacgggagtctttagagcgcc

SEQ ID NO: 468393 - DNA, 25 bp, Mus musculus
tattcactcaccaaagaaggagcca

SEQ ID NO: 468394 - DNA, 25 bp, Mus musculus
tattcactcatcttgcggaaaggca

SEQ ID NO: 468395 - DNA, 25 bp, Mus musculus
tattcactgtatgaccctgggcaag

SEQ ID NO: 468396 - DNA, 25 bp, Mus musculus
tattcacttggaagttaggccctgc

SEQ ID NO: 468397 - DNA, 25 bp, Mus musculus
tattcagaagatgacgtggccacct

SEQ ID NO: 468398 - DNA, 25 bp, Mus musculus
tattcagaaggtgcaagaccaggac

SEQ ID NO: 468399 - DNA, 25 bp, Mus musculus
tattcagaagtaaagaccgtgacgg

SEQ ID NO: 468400 - DNA, 25 bp, Mus musculus
tattcagatagaaagccggttcatc

SEQ ID NO: 468401 - DNA, 25 bp, Mus musculus
tattcagatcataggtacggcccac

SEQ ID NO: 468402 - DNA, 25 bp, Mus musculus
tattcagatgaatggctcgcttgga

SEQ ID NO: 468403 - DNA, 25 bp, Mus musculus
tattcagcaacaggtaatggctcag

SEQ ID NO: 468404 - DNA, 25 bp, Mus musculus
tattcagcacaatgattggcaagca

SEQ ID NO: 468405 - DNA, 25 bp, Mus musculus
tattcagcattaattcactgagcag

SEQ ID NO: 468406 - DNA, 25 bp, Mus musculus
tattcagcctgtatccggaccaagg

SEQ ID NO: 468407 - DNA, 25 bp, Mus musculus
tattcaggagaactatggccaggac

SEQ ID NO: 468408 - DNA, 25 bp, Mus musculus
tattcaggagcgtgctgggacttcc

SEQ ID NO: 468409 - DNA, 25 bp, Mus musculus
tattcaggcaaaatgttcatgcact

SEQ ID NO: 468410 - DNA, 25 bp, Mus musculus
tattcaggccacagcttggagaacc

SEQ ID NO: 468411 - DNA, 25 bp, Mus musculus
tattcaggtatcagggtcactggag

SEQ ID NO: 468412 - DNA, 25 bp, Mus musculus
tattcaggtccccaaagaactggag

SEQ ID NO: 468413 - DNA, 25 bp, Mus musculus
tattcaggttttatcttagataacc

SEQ ID NO: 468414 - DNA, 25 bp, Mus musculus
tattcagtacatcttcccgaggcga

SEQ ID NO: 468415 - DNA, 25 bp, Mus musculus
tattcagtagagctttttccgtggc

SEQ ID NO: 468416 - DNA, 25 bp, Mus musculus
tattcagtagccacggggccatcct

SEQ ID NO: 468417 - DNA, 25 bp, Mus musculus
tattcagtcccagagtcaaagcgtc

SEQ ID NO: 468418 - DNA, 25 bp, Mus musculus
tattcagtccgagtcttcccgaacg

SEQ ID NO: 468419 - DNA, 25 bp, Mus musculus
tattcagtggctccgtcagtattcc

SEQ ID NO: 468420 - DNA, 25 bp, Mus musculus
tattcagtgggttcatctccgaccg

SEQ ID NO: 468421 - DNA, 25 bp, Mus musculus
tattcagtgggttgacaaagccaga

SEQ ID NO: 468422 - DNA, 25 bp, Mus musculus
tattcagtgtgccaaggatatcgcc

SEQ ID NO: 468423 - DNA, 25 bp, Mus musculus
tattcagttaagagtactcctctgg

SEQ ID NO: 468424 - DNA, 25 bp, Mus musculus
tattcataactgaccccacaggagc

SEQ ID NO: 468425 - DNA, 25 bp, Mus musculus
tattcataagtattagactgccaga

SEQ ID NO: 468426 - DNA, 25 bp, Mus musculus
tattcatccgcagtggaaaggcaga

SEQ ID NO: 468427 - DNA, 25 bp, Mus musculus
tattcatcgtcagaaataaggaagc

SEQ ID NO: 468428 - DNA, 25 bp, Mus musculus
tattcatcgtggatgtgtggcaccc

SEQ ID NO: 468429 - DNA, 25 bp, Mus musculus
tattcatgatcactactggcccagc

SEQ ID NO: 468430 - DNA, 25 bp, Mus musculus
tattcatgcatcatgggtggccagg

SEQ ID NO: 468431 - DNA, 25 bp, Mus musculus
tattcatgccaacccatttgctcag

SEQ ID NO: 468432 - DNA, 25 bp, Mus musculus
tattcatgccagtaggctccctgca

SEQ ID NO: 468433 - DNA, 25 bp, Mus musculus
tattcatgttggaagactacagagg

SEQ ID NO: 468434 - DNA, 25 bp, Mus musculus
tattcattgaaaagggctgggtcca

SEQ ID NO: 468435 - DNA, 25 bp, Mus musculus
tattcattttactacacagcagagc

SEQ ID NO: 468436 - DNA, 25 bp, Mus musculus
tattccaaacttccaagcgtctaag

SEQ ID NO: 468437 - DNA, 25 bp, Mus musculus
tattccaacaacaaagctgcatcct

SEQ ID NO: 468438 - DNA, 25 bp, Mus musculus
tattccaactgctcaacgaaggcca

SEQ ID NO: 468439 - DNA, 25 bp, Mus musculus
tattccaagacattgctattgcgca

SEQ ID NO: 468440 - DNA, 25 bp, Mus musculus
tattccaagcaaacgtcagcgagga

SEQ ID NO: 468441 - DNA, 25 bp, Mus musculus
tattccaaggcacagtttagtacta

SEQ ID NO: 468442 - DNA, 25 bp, Mus musculus
tattccaatgtaaaccccaatacgg

SEQ ID NO: 468443 - DNA, 25 bp, Mus musculus
tattccacacacgtggcgctgtgat

SEQ ID NO: 468444 - DNA, 25 bp, Mus musculus
tattccacagctgaatgcaggagca

SEQ ID NO: 468445 - DNA, 25 bp, Mus musculus
tattccacatggaccccacggtagt

SEQ ID NO: 468446 - DNA, 25 bp, Mus musculus
tattccacctgaggaagcaaactgc

SEQ ID NO: 468447 - DNA, 25 bp, Mus musculus
tattccactgagagcataacctttc

SEQ ID NO: 468448 - DNA, 25 bp, Mus musculus
tattccagaggctcaggacgctgta

SEQ ID NO: 468449 - DNA, 25 bp, Mus musculus
tattccaggagcactgacaacttct

SEQ ID NO: 468450 - DNA, 25 bp, Mus musculus
tattccaggaggagaatgccacaac

SEQ ID NO: 468451 - DNA, 25 bp, Mus musculus
tattccaggagtgagatgaacgccc

SEQ ID NO: 468452 - DNA, 25 bp, Mus musculus
tattccaggcaactatcgctgcacc

SEQ ID NO: 468453 - DNA, 25 bp, Mus musculus
tattccagggtagcgagttccccac

SEQ ID NO: 468454 - DNA, 25 bp, Mus musculus
tattccaggtcaagatcaaggtccc

SEQ ID NO: 468455 - DNA, 25 bp, Mus musculus
tattccagtatcacccaggagcagc

SEQ ID NO: 468456 - DNA, 25 bp, Mus musculus
tattccagtgatgaccagagccctt

SEQ ID NO: 468457 - DNA, 25 bp, Mus musculus
tattccagtgtgatgtgcccaggcg

SEQ ID NO: 468458 - DNA, 25 bp, Mus musculus
tattccataaggctgcagattaact

SEQ ID NO: 468459 - DNA, 25 bp, Mus musculus
tattccatgcaaaggagcggcagct

SEQ ID NO: 468460 - DNA, 25 bp, Mus musculus
tattccattgtactcaagctgccgg

SEQ ID NO: 468461 - DNA, 25 bp, Mus musculus
tattcccaagcctcaacatggcggt

SEQ ID NO: 468462 - DNA, 25 bp, Mus musculus
tattcccaccgatttcgagggctgg

SEQ ID NO: 468463 - DNA, 25 bp, Mus musculus
tattcccagagcagagagctcctca

SEQ ID NO: 468464 - DNA, 25 bp, Mus musculus
tattcccagctgtcggatgagcagg

SEQ ID NO: 468465 - DNA, 25 bp, Mus musculus
tattcccatcatgcaacaggcagtg

SEQ ID NO: 468466 - DNA, 25 bp, Mus musculus
tattccccaaagatgaccaaggcag

SEQ ID NO: 468467 - DNA, 25 bp, Mus musculus
tattccccgagttctcctcagtgga

SEQ ID NO: 468468 - DNA, 25 bp, Mus musculus
tattcccgagaaagatcttcaagga

SEQ ID NO: 468469 - DNA, 25 bp, Mus musculus
tattcccgatcaactatcgagggcc

SEQ ID NO: 468470 - DNA, 25 bp, Mus musculus
tattcccgccgacaggaagaggctg

SEQ ID NO: 468471 - DNA, 25 bp, Mus musculus
tattcccgtttgctcaggctcctgg

SEQ ID NO: 468472 - DNA, 25 bp, Mus musculus
tattccctcggagcactgagagtgg

SEQ ID NO: 468473 - DNA, 25 bp, Mus musculus
tattccgacgttcttctggagtggg

SEQ ID NO: 468474 - DNA, 25 bp, Mus musculus
tattccgagatgagattaacctgca

SEQ ID NO: 468475 - DNA, 25 bp, Mus musculus
tattccgagggcttccaagagagcc

SEQ ID NO: 468476 - DNA, 25 bp, Mus musculus
tattccggcgacctgagtcagaacc

SEQ ID NO: 468477 - DNA, 25 bp, Mus musculus
tattccgggatacaaggctctacag

SEQ ID NO: 468478 - DNA, 25 bp, Mus musculus
tattccggtcgctcacaggatggca

SEQ ID NO: 468479 - DNA, 25 bp, Mus musculus
tattccgtggacaggtccaccagga

SEQ ID NO: 468480 - DNA, 25 bp, Mus musculus
tattcctaaagccaagagccatgtg

SEQ ID NO: 468481 - DNA, 25 bp, Mus musculus
tattcctaaggcaagatgggcatat

SEQ ID NO: 468482 - DNA, 25 bp, Mus musculus
tattcctagaacctacacggttgac

SEQ ID NO: 468483 - DNA, 25 bp, Mus musculus
tattcctagagacgagcaagttgtc

SEQ ID NO: 468484 - DNA, 25 bp, Mus musculus
tattcctcaccacaggcatcgtcgt

SEQ ID NO: 468485 - DNA, 25 bp, Mus musculus
tattcctcccctcaagtcacaggga

SEQ ID NO: 468486 - DNA, 25 bp, Mus musculus
tattcctctaatagcttggcttcag

SEQ ID NO: 468487 - DNA, 25 bp, Mus musculus
tattcctgctcctgacatacgtgtc

SEQ ID NO: 468488 - DNA, 25 bp, Mus musculus
tattcctgctgtgagggcacttctc

SEQ ID NO: 468489 - DNA, 25 bp, Mus musculus
tattcctgcttttgccactgtttgt

SEQ ID NO: 468490 - DNA, 25 bp, Mus musculus
tattcctggacctagaagccactgg

SEQ ID NO: 468491 - DNA, 25 bp, Mus musculus
tattcctggagaaaacagtagccca

SEQ ID NO: 468492 - DNA, 25 bp, Mus musculus
tattcctggcacttctggagtacgc

SEQ ID NO: 468493 - DNA, 25 bp, Mus musculus
tattcctggcgagagaagcacagat

SEQ ID NO: 468494 - DNA, 25 bp, Mus musculus
tattcctgggtctctggccgctgag

SEQ ID NO: 468495 - DNA, 25 bp, Mus musculus
tattcctggttctgggtgttctaga

SEQ ID NO: 468496 - DNA, 25 bp, Mus musculus
tattcctgtagtgaccaattccccg

SEQ ID NO: 468497 - DNA, 25 bp, Mus musculus
tattcctgtgcgagtgagccctact

SEQ ID NO: 468498 - DNA, 25 bp, Mus musculus
tattcctgtggttagaagacccgac

SEQ ID NO: 468499 - DNA, 25 bp, Mus musculus
tattccttaggcaaggcagcgaggc

SEQ ID NO: 468500 - DNA, 25 bp, Mus musculus
tattccttccggtacgtggacgaca

SEQ ID NO: 468501 - DNA, 25 bp, Mus musculus
tattccttcgaacgcagacagcagc

SEQ ID NO: 468502 - DNA, 25 bp, Mus musculus
tattccttctggctgtgctgccgga

SEQ ID NO: 468503 - DNA, 25 bp, Mus musculus
tattccttttgcctggaaatgccct

SEQ ID NO: 468504 - DNA, 25 bp, Mus musculus
tattcgaaacattgtaccaaccgga

SEQ ID NO: 468505 - DNA, 25 bp, Mus musculus
tattcgaaactggttcaggcccgtc

SEQ ID NO: 468506 - DNA, 25 bp, Mus musculus
tattcgaacggcaagaaacgtggtc

SEQ ID NO: 468507 - DNA, 25 bp, Mus musculus
tattcgaagctcacaactcagccgc

SEQ ID NO: 468508 - DNA, 25 bp, Mus musculus
tattcgacagctatgcaagcacatg

SEQ ID NO: 468509 - DNA, 25 bp, Mus musculus
tattcgagaagatggaccacaaggc

SEQ ID NO: 468510 - DNA, 25 bp, Mus musculus
tattcgagactcactgatgcaggcc

SEQ ID NO: 468511 - DNA, 25 bp, Mus musculus
tattcgagagatacgccagttccag

SEQ ID NO: 468512 - DNA, 25 bp, Mus musculus
tattcgattcggtgggcaagtgatc

SEQ ID NO: 468513 - DNA, 25 bp, Mus musculus
tattcgcaaaatagctacatccctg

SEQ ID NO: 468514 - DNA, 25 bp, Mus musculus
tattcgcacacggtgaaaacagacg

SEQ ID NO: 468515 - DNA, 25 bp, Mus musculus
tattcgcagcgtgcttcaagggccc

SEQ ID NO: 468516 - DNA, 25 bp, Mus musculus
tattcgctcggcagtacctggctaa

SEQ ID NO: 468517 - DNA, 25 bp, Mus musculus
tattcgctgcacgtggacatcactg

SEQ ID NO: 468518 - DNA, 25 bp, Mus musculus
tattcgctgcgacagcccgcagagt

SEQ ID NO: 468519 - DNA, 25 bp, Mus musculus
tattcgcttggtgtcacagtggcca

SEQ ID NO: 468520 - DNA, 25 bp, Mus musculus
tattcggaagctttaaaggatgctc

SEQ ID NO: 468521 - DNA, 25 bp, Mus musculus
tattcggcctttgtgtacagctatg

SEQ ID NO: 468522 - DNA, 25 bp, Mus musculus
tattcggcgagatatctggctgggc

SEQ ID NO: 468523 - DNA, 25 bp, Mus musculus
tattcggctgactgtgagcccctga

SEQ ID NO: 468524 - DNA, 25 bp, Mus musculus
tattcgggcccttggccacactgag

SEQ ID NO: 468525 - DNA, 25 bp, Mus musculus
tattcgggcttagcctgcagccgga

SEQ ID NO: 468526 - DNA, 25 bp, Mus musculus
tattcgtccgacttgagcagcattg

SEQ ID NO: 468527 - DNA, 25 bp, Mus musculus
tattcgtcgctaatgtccttggcct

SEQ ID NO: 468528 - DNA, 25 bp, Mus musculus
tattcgtgatctttggcggagtacc

SEQ ID NO: 468529 - DNA, 25 bp, Mus musculus
tattcgtggactgcaaactaggcgc

SEQ ID NO: 468530 - DNA, 25 bp, Mus musculus
tattctaaccacgtatggcgtccag

SEQ ID NO: 468531 - DNA, 25 bp, Mus musculus
tattctaagaagtgataggcgtggg

SEQ ID NO: 468532 - DNA, 25 bp, Mus musculus
tattctacacaagggacagcagcct

SEQ ID NO: 468533 - DNA, 25 bp, Mus musculus
tattctacattttcccacagggccc

SEQ ID NO: 468534 - DNA, 25 bp, Mus musculus
tattctacgttctctgggctggcca

SEQ ID NO: 468535 - DNA, 25 bp, Mus musculus
tattctagaaaggattaaagctgcc

SEQ ID NO: 468536 - DNA, 25 bp, Mus musculus
tattctagataaccaggcggtggca

SEQ ID NO: 468537 - DNA, 25 bp, Mus musculus
tattctagatgaggacaaacggact

SEQ ID NO: 468538 - DNA, 25 bp, Mus musculus
tattctagggtgagggaaattcgga

SEQ ID NO: 468539 - DNA, 25 bp, Mus musculus
tattctatcaaaccctgtaacaagt

SEQ ID NO: 468540 - DNA, 25 bp, Mus musculus
tattctatctggctccggtcacgag

SEQ ID NO: 468541 - DNA, 25 bp, Mus musculus
tattctcaaggtaccagttcctggg

SEQ ID NO: 468542 - DNA, 25 bp, Mus musculus
tattctcaatcttcatcagtgttct

SEQ ID NO: 468543 - DNA, 25 bp, Mus musculus
tattctcagcgggtggatgtaggac

SEQ ID NO: 468544 - DNA, 25 bp, Mus musculus
tattctccaaagaacttccagctgg

SEQ ID NO: 468545 - DNA, 25 bp, Mus musculus
tattctccacggtcattagtgttcc

SEQ ID NO: 468546 - DNA, 25 bp, Mus musculus
tattctccatctcagcagcggtggc

SEQ ID NO: 468547 - DNA, 25 bp, Mus musculus
tattctcctgttcaatccctggtgc

SEQ ID NO: 468548 - DNA, 25 bp, Mus musculus
tattctcctgttgcaccacaatgag

SEQ ID NO: 468549 - DNA, 25 bp, Mus musculus
tattctccttgaattgttgggccag

SEQ ID NO: 468550 - DNA, 25 bp, Mus musculus
tattctcgactgtaatggcattgca

SEQ ID NO: 468551 - DNA, 25 bp, Mus musculus
tattctcgtccttggccgtacaggg

SEQ ID NO: 468552 - DNA, 25 bp, Mus musculus
tattctctaaacttctcctgctgcc

SEQ ID NO: 468553 - DNA, 25 bp, Mus musculus
tattctctgtgttcgggaggcaacc

SEQ ID NO: 468554 - DNA, 25 bp, Mus musculus
tattctctttttggtggacagcccc

SEQ ID NO: 468555 - DNA, 25 bp, Mus musculus
tattctgaaggttgtcttggctcac

SEQ ID NO: 468556 - DNA, 25 bp, Mus musculus
tattctgaatgggtcccggcagggc

SEQ ID NO: 468557 - DNA, 25 bp, Mus musculus
tattctgactctagagaagactcca

SEQ ID NO: 468558 - DNA, 25 bp, Mus musculus
tattctgagagagaacttccggcgc

SEQ ID NO: 468559 - DNA, 25 bp, Mus musculus
tattctgaggcctaaaacttgttct

SEQ ID NO: 468560 - DNA, 25 bp, Mus musculus
tattctgagtactttgaactattaa

SEQ ID NO: 468561 - DNA, 25 bp, Mus musculus
tattctgcacgcctcgctgtctgag

SEQ ID NO: 468562 - DNA, 25 bp, Mus musculus
tattctgcatgtctttaagtgtaca

SEQ ID NO: 468563 - DNA, 25 bp, Mus musculus
tattctgcggtcactgaagctgctc

SEQ ID NO: 468564 - DNA, 25 bp, Mus musculus
tattctgctccattttactaacccg

SEQ ID NO: 468565 - DNA, 25 bp, Mus musculus
tattctggagatattcgacagttgc

SEQ ID NO: 468566 - DNA, 25 bp, Mus musculus
tattctggaggattagctgctgcac

SEQ ID NO: 468567 - DNA, 25 bp, Mus musculus
tattctggctcgagctggaaacctc

SEQ ID NO: 468568 - DNA, 25 bp, Mus musculus
tattctgggacatacagctgcacgg

SEQ ID NO: 468569 - DNA, 25 bp, Mus musculus
tattctgggcatgctcgttccttgg

SEQ ID NO: 468570 - DNA, 25 bp, Mus musculus
tattctgggtcatatcctgaagaca

SEQ ID NO: 468571 - DNA, 25 bp, Mus musculus
tattctgtatgcacttctgagcccc

SEQ ID NO: 468572 - DNA, 25 bp, Mus musculus
tattctgtccaccacgtggatgcag

SEQ ID NO: 468573 - DNA, 25 bp, Mus musculus
tattctgtcctcagggcagatggct

SEQ ID NO: 468574 - DNA, 25 bp, Mus musculus
tattctgtggagtgatcccgcggct

SEQ ID NO: 468575 - DNA, 25 bp, Mus musculus
tattctgttaattatgggagcctgc

SEQ ID NO: 468576 - DNA, 25 bp, Mus musculus
tattctgttccacatttgccctcag

SEQ ID NO: 468577 - DNA, 25 bp, Mus musculus
tattcttagacaaggatggcccagc

SEQ ID NO: 468578 - DNA, 25 bp, Mus musculus
tattcttagcatgttaggctcttcc

SEQ ID NO: 468579 - DNA, 25 bp, Mus musculus
tattcttagtcagccaaagtcagcc

SEQ ID NO: 468580 - DNA, 25 bp, Mus musculus
tattcttagtggaggtgaggcttcc

SEQ ID NO: 468581 - DNA, 25 bp, Mus musculus
tattcttccctaacagaggaggagg

SEQ ID NO: 468582 - DNA, 25 bp, Mus musculus
tattcttccgcgaaggtcctgcagc

SEQ ID NO: 468583 - DNA, 25 bp, Mus musculus
tattcttgcagattaaaggaccgct

SEQ ID NO: 468584 - DNA, 25 bp, Mus musculus
tattcttggaggtcaccgagatgct

SEQ ID NO: 468585 - DNA, 25 bp, Mus musculus
tattcttggcaggtggcattctaga

SEQ ID NO: 468586 - DNA, 25 bp, Mus musculus
tattcttggcgtctctggaaacctg

SEQ ID NO: 468587 - DNA, 25 bp, Mus musculus
tattctttctccaactttacagatg

SEQ ID NO: 468588 - DNA, 25 bp, Mus musculus
tattcttttagcagatggctcctcc

SEQ ID NO: 468589 - DNA, 25 bp, Mus musculus
tattgaaaaggccagcacccgttac

SEQ ID NO: 468590 - DNA, 25 bp, Mus musculus
tattgaaaatcatcaaacatcagcg

SEQ ID NO: 468591 - DNA, 25 bp, Mus musculus
tattgaaactctgggcaggaggccc

SEQ ID NO: 468592 - DNA, 25 bp, Mus musculus
tattgaaagctactgcgaacgcctt

SEQ ID NO: 468593 - DNA, 25 bp, Mus musculus
tattgaaagtgagcatgcgcgtagt

SEQ ID NO: 468594 - DNA, 25 bp, Mus musculus
tattgaaagtttactaacgtccttg

SEQ ID NO: 468595 - DNA, 25 bp, Mus musculus
tattgaaatggagatgttttgcctg

SEQ ID NO: 468596 - DNA, 25 bp, Mus musculus
tattgaacaactgaagcaaccaggc

SEQ ID NO: 468597 - DNA, 25 bp, Mus musculus
tattgaacagaccttgtacaaggcc

SEQ ID NO: 468598 - DNA, 25 bp, Mus musculus
tattgaacggtggtatggagaaccc

SEQ ID NO: 468599 - DNA, 25 bp, Mus musculus
tattgaacttgccaagggagagcct

SEQ ID NO: 468600 - DNA, 25 bp, Mus musculus
tattgaagcagaaaggctccagagc

SEQ ID NO: 468601 - DNA, 25 bp, Mus musculus
tattgaagctgctctagacagcctg

SEQ ID NO: 468602 - DNA, 25 bp, Mus musculus
tattgaaggccgaagatgctggtac

SEQ ID NO: 468603 - DNA, 25 bp, Mus musculus
tattgaatactctacagcaggcctc

SEQ ID NO: 468604 - DNA, 25 bp, Mus musculus
tattgaatctgcacaaaccccacca

SEQ ID NO: 468605 - DNA, 25 bp, Mus musculus
tattgaatgtgccaagacctacctc

SEQ ID NO: 468606 - DNA, 25 bp, Mus musculus
tattgacacctattcgttctcagcg

SEQ ID NO: 468607 - DNA, 25 bp, Mus musculus
tattgacagcatcccttcaggcaca

SEQ ID NO: 468608 - DNA, 25 bp, Mus musculus
tattgacatgtctgcacttgcccac

SEQ ID NO: 468609 - DNA, 25 bp, Mus musculus
tattgaccagacagaagaacccgag

SEQ ID NO: 468610 - DNA, 25 bp, Mus musculus
tattgaccgttgtgtgctgggccag

SEQ ID NO: 468611 - DNA, 25 bp, Mus musculus
tattgacctaccctggaagtatgcc

SEQ ID NO: 468612 - DNA, 25 bp, Mus musculus
tattgacgacagaagagaccaacct

SEQ ID NO: 468613 - DNA, 25 bp, Mus musculus
tattgacgtaagatctccagagcct

SEQ ID NO: 468614 - DNA, 25 bp, Mus musculus
tattgactacgacctcaaggatgcc

SEQ ID NO: 468615 - DNA, 25 bp, Mus musculus
tattgactacgagctgattgaccag

SEQ ID NO: 468616 - DNA, 25 bp, Mus musculus
tattgactgagctaccttcctagcc

SEQ ID NO: 468617 - DNA, 25 bp, Mus musculus
tattgagaagagcacggatttcccg

SEQ ID NO: 468618 - DNA, 25 bp, Mus musculus
tattgagaagtcgtgccgggtcagc

SEQ ID NO: 468619 - DNA, 25 bp, Mus musculus
tattgagacattgccgtcctggacc

SEQ ID NO: 468620 - DNA, 25 bp, Mus musculus
tattgagactcaacttgccgtggag

SEQ ID NO: 468621 - DNA, 25 bp, Mus musculus
tattgagagagtatccatgacacgc

SEQ ID NO: 468622 - DNA, 25 bp, Mus musculus
tattgagagcaacaggcccagactg

SEQ ID NO: 468623 - DNA, 25 bp, Mus musculus
tattgagatctgagccttggacggg

SEQ ID NO: 468624 - DNA, 25 bp, Mus musculus
tattgagcaagcatcagaacctcag

SEQ ID NO: 468625 - DNA, 25 bp, Mus musculus
tattgagcccatgtacgtgccacct

SEQ ID NO: 468626 - DNA, 25 bp, Mus musculus
tattgagccgcggttatcgcttcga

SEQ ID NO: 468627 - DNA, 25 bp, Mus musculus
tattgagcggcttacggcacttcac

SEQ ID NO: 468628 - DNA, 25 bp, Mus musculus
tattgagcggtttcatatccagatc

SEQ ID NO: 468629 - DNA, 25 bp, Mus musculus
tattgagcgtaacacaggacttagg

SEQ ID NO: 468630 - DNA, 25 bp, Mus musculus
tattgaggacaacacggagatcatc

SEQ ID NO: 468631 - DNA, 25 bp, Mus musculus
tattgaggagctgagcaacatcaca

SEQ ID NO: 468632 - DNA, 25 bp, Mus musculus
tattgaggcacagtcttgtgtagcc

SEQ ID NO: 468633 - DNA, 25 bp, Mus musculus
tattgaggcgtggaaatgtaacatg

SEQ ID NO: 468634 - DNA, 25 bp, Mus musculus
tattgaggctcaggatggcccaggc

SEQ ID NO: 468635 - DNA, 25 bp, Mus musculus
tattgagggcacaccttgaatcctg

SEQ ID NO: 468636 - DNA, 25 bp, Mus musculus
tattgagtcagcatgaaacacttcc

SEQ ID NO: 468637 - DNA, 25 bp, Mus musculus
tattgagttgacatgtgaccagcga

SEQ ID NO: 468638 - DNA, 25 bp, Mus musculus
tattgataaaggtgacattcccgac

SEQ ID NO: 468639 - DNA, 25 bp, Mus musculus
tattgatatgccagacctactagat

SEQ ID NO: 468640 - DNA, 25 bp, Mus musculus
tattgatcattggtagtggctgtcc

SEQ ID NO: 468641 - DNA, 25 bp, Mus musculus
tattgatcctagcaacccgatggta

SEQ ID NO: 468642 - DNA, 25 bp, Mus musculus
tattgatctactccccaaggtggaa

SEQ ID NO: 468643 - DNA, 25 bp, Mus musculus
tattgatctgcatgcactgactggg

SEQ ID NO: 468644 - DNA, 25 bp, Mus musculus
tattgatgaacgatgactctacccg

SEQ ID NO: 468645 - DNA, 25 bp, Mus musculus
tattgatgatatgactcagcctggg

SEQ ID NO: 468646 - DNA, 25 bp, Mus musculus
tattgatgcagtggacagaagcgca

SEQ ID NO: 468647 - DNA, 25 bp, Mus musculus
tattgatgccaagctgaccacagag

SEQ ID NO: 468648 - DNA, 25 bp, Mus musculus
tattgatgccataacaggcgaggcc

SEQ ID NO: 468649 - DNA, 25 bp, Mus musculus
tattgatggaggctgaaacacccca

SEQ ID NO: 468650 - DNA, 25 bp, Mus musculus
tattgatggcactcagatcgcggga

SEQ ID NO: 468651 - DNA, 25 bp, Mus musculus
tattgattgaattccgctggcgcag

SEQ ID NO: 468652 - DNA, 25 bp, Mus musculus
tattgattttacatgtgtgcgtaca

SEQ ID NO: 468653 - DNA, 25 bp, Mus musculus
tattgcaaaagggaatgtggtctgg

SEQ ID NO: 468654 - DNA, 25 bp, Mus musculus
tattgcaaatccagctgtcaaaggg

SEQ ID NO: 468655 - DNA, 25 bp, Mus musculus
tattgcaagcactgagaactccaca

SEQ ID NO: 468656 - DNA, 25 bp, Mus musculus
tattgcaaggacttgaacgcctcgg

SEQ ID NO: 468657 - DNA, 25 bp, Mus musculus
tattgcagattcagatgagagacct

SEQ ID NO: 468658 - DNA, 25 bp, Mus musculus
tattgcagattcctctccggaaggc

SEQ ID NO: 468659 - DNA, 25 bp, Mus musculus
tattgcagctgaacgaaaggaggcc

SEQ ID NO: 468660 - DNA, 25 bp, Mus musculus
tattgcagtcaggtggagtcagcca

SEQ ID NO: 468661 - DNA, 25 bp, Mus musculus
tattgcatgagacgcaaagggcgcc

SEQ ID NO: 468662 - DNA, 25 bp, Mus musculus
tattgcatgcatagaaagccatcag

SEQ ID NO: 468663 - DNA, 25 bp, Mus musculus
tattgcatgtctccaaatctccagg

SEQ ID NO: 468664 - DNA, 25 bp, Mus musculus
tattgcatgttctccaactgtgagg

SEQ ID NO: 468665 - DNA, 25 bp, Mus musculus
tattgcattcatcgttcagcacggg

SEQ ID NO: 468666 - DNA, 25 bp, Mus musculus
tattgccaatttcagcctcctgggc

SEQ ID NO: 468667 - DNA, 25 bp, Mus musculus
tattgccacagatgtagagaaactg

SEQ ID NO: 468668 - DNA, 25 bp, Mus musculus
tattgccaccggaagtagccattgg

SEQ ID NO: 468669 - DNA, 25 bp, Mus musculus
tattgccatgaagaaccccaaggag

SEQ ID NO: 468670 - DNA, 25 bp, Mus musculus
tattgccatggctgtggcgtggccc

SEQ ID NO: 468671 - DNA, 25 bp, Mus musculus
tattgcccaaggaggagttgcaact

SEQ ID NO: 468672 - DNA, 25 bp, Mus musculus
tattgcccaggaacagcagtacggc

SEQ ID NO: 468673 - DNA, 25 bp, Mus musculus
tattgcccattatcacggaggactc

SEQ ID NO: 468674 - DNA, 25 bp, Mus musculus
tattgccccgagtttggtggctctc

SEQ ID NO: 468675 - DNA, 25 bp, Mus musculus
tattgccctcaggtaatgaacggcc

SEQ ID NO: 468676 - DNA, 25 bp, Mus musculus
tattgccggaggaaggatgactcgt

SEQ ID NO: 468677 - DNA, 25 bp, Mus musculus
tattgccggcaatgtcactgtctgc

SEQ ID NO: 468678 - DNA, 25 bp, Mus musculus
tattgcctcctaagtgcaagggcca

SEQ ID NO: 468679 - DNA, 25 bp, Mus musculus
tattgcctcgcatcctacaaggtgg

SEQ ID NO: 468680 - DNA, 25 bp, Mus musculus
tattgccttcgaaactgaaccggga

SEQ ID NO: 468681 - DNA, 25 bp, Mus musculus
tattgcgagctggagccttcgacga

SEQ ID NO: 468682 - DNA, 25 bp, Mus musculus
tattgcgaggaaatcacgaaagccg

SEQ ID NO: 468683 - DNA, 25 bp, Mus musculus
tattgcgagtctaggtccaagccat

SEQ ID NO: 468684 - DNA, 25 bp, Mus musculus
tattgcgcaggcttaagataactct

SEQ ID NO: 468685 - DNA, 25 bp, Mus musculus
tattgcgcccaggacatcttgtatg

SEQ ID NO: 468686 - DNA, 25 bp, Mus musculus
tattgcgtcaggatgtgtagcttct

SEQ ID NO: 468687 - DNA, 25 bp, Mus musculus
tattgcgtgtgaacctccggagatc

SEQ ID NO: 468688 - DNA, 25 bp, Mus musculus
tattgctacgcctccgaggtcaggg

SEQ ID NO: 468689 - DNA, 25 bp, Mus musculus
tattgctctgaagcgttagaccagc

SEQ ID NO: 468690 - DNA, 25 bp, Mus musculus
tattgctgaagaggatccaggccga

SEQ ID NO: 468691 - DNA, 25 bp, Mus musculus
tattgctgcaagtgccgggaactga

SEQ ID NO: 468692 - DNA, 25 bp, Mus musculus
tattgctgcacgagcttcagatggc

SEQ ID NO: 468693 - DNA, 25 bp, Mus musculus
tattgctgcttgagctgtgggagcc

SEQ ID NO: 468694 - DNA, 25 bp, Mus musculus
tattgctgtcaattccaagctgctc

SEQ ID NO: 468695 - DNA, 25 bp, Mus musculus
tattgctgtggattgggaccctaca

SEQ ID NO: 468696 - DNA, 25 bp, Mus musculus
tattgcttaacagaaatggttccca

SEQ ID NO: 468697 - DNA, 25 bp, Mus musculus
tattgcttccctggacgagactggg

SEQ ID NO: 468698 - DNA, 25 bp, Mus musculus
tattgcttttccctcgagccagtga

SEQ ID NO: 468699 - DNA, 25 bp, Mus musculus
tattggaaaccacccagcaagattt

SEQ ID NO: 468700 - DNA, 25 bp, Mus musculus
tattggaaagtctggcgacagtggc

SEQ ID NO: 468701 - DNA, 25 bp, Mus musculus
tattggaagaacaatggagccccag

SEQ ID NO: 468702 - DNA, 25 bp, Mus musculus
tattggaagccacatgcagcaaggc

SEQ ID NO: 468703 - DNA, 25 bp, Mus musculus
tattggaaggaccacaacatcctgg

SEQ ID NO: 468704 - DNA, 25 bp, Mus musculus
tattggaagggtgtcaaacatacag

SEQ ID NO: 468705 - DNA, 25 bp, Mus musculus
tattggaatctctgacgtgtccacc

SEQ ID NO: 468706 - DNA, 25 bp, Mus musculus
tattggacaattgacacctgccctg

SEQ ID NO: 468707 - DNA, 25 bp, Mus musculus
tattggacacatccccagagacctg

SEQ ID NO: 468708 - DNA, 25 bp, Mus musculus
tattggagagtttgaccctgacggc

SEQ ID NO: 468709 - DNA, 25 bp, Mus musculus
tattggagatgagtccctcaccgac

SEQ ID NO: 468710 - DNA, 25 bp, Mus musculus
tattggagattatatttgggagagg

SEQ ID NO: 468711 - DNA, 25 bp, Mus musculus
tattggagctctcttctcggtccac

SEQ ID NO: 468712 - DNA, 25 bp, Mus musculus
tattggagctgcagaatttttgccc

SEQ ID NO: 468713 - DNA, 25 bp, Mus musculus
tattggagtcctactgccgtgcctg

SEQ ID NO: 468714 - DNA, 25 bp, Mus musculus
tattggagtgctcttatgccacagc

SEQ ID NO: 468715 - DNA, 25 bp, Mus musculus
tattggagttcatgtgcccctgggt

SEQ ID NO: 468716 - DNA, 25 bp, Mus musculus
tattggataagtggttgctgccccg

SEQ ID NO: 468717 - DNA, 25 bp, Mus musculus
tattggatacgaagcagaacttgac

SEQ ID NO: 468718 - DNA, 25 bp, Mus musculus
tattggatagatggcgacatggacc

SEQ ID NO: 468719 - DNA, 25 bp, Mus musculus
tattggatattgtggacacaaggcg

SEQ ID NO: 468720 - DNA, 25 bp, Mus musculus
tattggatgagaggcacgattccca

SEQ ID NO: 468721 - DNA, 25 bp, Mus musculus
tattggcaaccaggcctctggctgg

SEQ ID NO: 468722 - DNA, 25 bp, Mus musculus
tattggcaagtcaacctcgacaggt

SEQ ID NO: 468723 - DNA, 25 bp, Mus musculus
tattggcaatgcacgcaaatgtgga

SEQ ID NO: 468724 - DNA, 25 bp, Mus musculus
tattggcaccgagaagctaggcttc

SEQ ID NO: 468725 - DNA, 25 bp, Mus musculus
tattggcacctactactgtgtccag

SEQ ID NO: 468726 - DNA, 25 bp, Mus musculus
tattggcaccttactcctgagcgta

SEQ ID NO: 468727 - DNA, 25 bp, Mus musculus
tattggcagccagatatgtgagcag

SEQ ID NO: 468728 - DNA, 25 bp, Mus musculus
tattggcaggtggttctcacccatc

SEQ ID NO: 468729 - DNA, 25 bp, Mus musculus
tattggcaggttctcgatacatagc

SEQ ID NO: 468730 - DNA, 25 bp, Mus musculus
tattggcatccgtcatgtggagagc

SEQ ID NO: 468731 - DNA, 25 bp, Mus musculus
tattggcatgatggagtgacaggaa

SEQ ID NO: 468732 - DNA, 25 bp, Mus musculus
tattggcattacgactataacctcc

SEQ ID NO: 468733 - DNA, 25 bp, Mus musculus
tattggccaacggagaacactgagg

SEQ ID NO: 468734 - DNA, 25 bp, Mus musculus
tattggcccacagacacaacgtgtc

SEQ ID NO: 468735 - DNA, 25 bp, Mus musculus
tattggccctgtttgtccctggacc

SEQ ID NO: 468736 - DNA, 25 bp, Mus musculus
tattggccggaatctctttacatgt

SEQ ID NO: 468737 - DNA, 25 bp, Mus musculus
tattggccggcagactttgcggacg

SEQ ID NO: 468738 - DNA, 25 bp, Mus musculus
tattggcctagcaactgtgggcaac

SEQ ID NO: 468739 - DNA, 25 bp, Mus musculus
tattggcctgcctggaagctttttg

SEQ ID NO: 468740 - DNA, 25 bp, Mus musculus
tattggctaaggtgaggaaacgtct

SEQ ID NO: 468741 - DNA, 25 bp, Mus musculus
tattggctcaaagttggactcctgg

SEQ ID NO: 468742 - DNA, 25 bp, Mus musculus
tattggctcctgactctctctacca

SEQ ID NO: 468743 - DNA, 25 bp, Mus musculus
tattggctcttctacggtgtgcgca

SEQ ID NO: 468744 - DNA, 25 bp, Mus musculus
tattggctgcaccaactacagagct

SEQ ID NO: 468745 - DNA, 25 bp, Mus musculus
tattggctgcgctcggccatacagg

SEQ ID NO: 468746 - DNA, 25 bp, Mus musculus
tattgggacactgaatctgcaggca

SEQ ID NO: 468747 - DNA, 25 bp, Mus musculus
tattgggagagtcacggctacatct

SEQ ID NO: 468748 - DNA, 25 bp, Mus musculus
tattgggagcccagattagcacgat

SEQ ID NO: 468749 - DNA, 25 bp, Mus musculus
tattgggagcctaaagccacaggcc

SEQ ID NO: 468750 - DNA, 25 bp, Mus musculus
tattgggagctatgaatgtcgctgc

SEQ ID NO: 468751 - DNA, 25 bp, Mus musculus
tattgggagcttgatacagagatcc

SEQ ID NO: 468752 - DNA, 25 bp, Mus musculus
tattgggccacgtatttaaacagag

SEQ ID NO: 468753 - DNA, 25 bp, Mus musculus
tattgggccctgtactccaactggg

SEQ ID NO: 468754 - DNA, 25 bp, Mus musculus
tattgggcctctgcgcaatcgttcc

SEQ ID NO: 468755 - DNA, 25 bp, Mus musculus
tattgggctggcttaccattgggca

SEQ ID NO: 468756 - DNA, 25 bp, Mus musculus
tattgggtcacggatgtggctctcc

SEQ ID NO: 468757 - DNA, 25 bp, Mus musculus
tattgggtccaagaccagaagccca

SEQ ID NO: 468758 - DNA, 25 bp, Mus musculus
tattgggtccaggaagtagaatgtg

SEQ ID NO: 468759 - DNA, 25 bp, Mus musculus
tattgggtcctttgttctgttttag

SEQ ID NO: 468760 - DNA, 25 bp, Mus musculus
tattggtacaagtagcatccttggc

SEQ ID NO: 468761 - DNA, 25 bp, Mus musculus
tattggtagaactcagaatcgccag

SEQ ID NO: 468762 - DNA, 25 bp, Mus musculus
tattggtcacatgtgcccactttgg

SEQ ID NO: 468763 - DNA, 25 bp, Mus musculus
tattggtcattatcgacgtgaagcc

SEQ ID NO: 468764 - DNA, 25 bp, Mus musculus
tattggtccccggtggcgatctttg

SEQ ID NO: 468765 - DNA, 25 bp, Mus musculus
tattggtcttcaagatgtgctcaca

SEQ ID NO: 468766 - DNA, 25 bp, Mus musculus
tattggtgaccgcacatggcgactc

SEQ ID NO: 468767 - DNA, 25 bp, Mus musculus
tattggtgccagaaaatgaatccac

SEQ ID NO: 468768 - DNA, 25 bp, Mus musculus
tattggtgcctttcccacagagcaa

SEQ ID NO: 468769 - DNA, 25 bp, Mus musculus
tattggtgctaggaatacacactgt

SEQ ID NO: 468770 - DNA, 25 bp, Mus musculus
tattggtggcattcgtaaggccgta

SEQ ID NO: 468771 - DNA, 25 bp, Mus musculus
tattggtgggatcaactgcctccag

SEQ ID NO: 468772 - DNA, 25 bp, Mus musculus
tattggtgggtaagaacaggcagca

SEQ ID NO: 468773 - DNA, 25 bp, Mus musculus
tattggtgggtcagattcagggctt

SEQ ID NO: 468774 - DNA, 25 bp, Mus musculus
tattggttacacgaggaaagcccct

SEQ ID NO: 468775 - DNA, 25 bp, Mus musculus
tattggttattagacgttctgttcc

SEQ ID NO: 468776 - DNA, 25 bp, Mus musculus
tattggttcttctgccccagtcgct

SEQ ID NO: 468777 - DNA, 25 bp, Mus musculus
tattgtaaagagctctatagctgct

SEQ ID NO: 468778 - DNA, 25 bp, Mus musculus
tattgtaacgttatgtcagacatgg

SEQ ID NO: 468779 - DNA, 25 bp, Mus musculus
tattgtaagcatgcaccgtactgat

SEQ ID NO: 468780 - DNA, 25 bp, Mus musculus
tattgtaagctggagagctgcccct

SEQ ID NO: 468781 - DNA, 25 bp, Mus musculus
tattgtacccatcttggagccttgt

SEQ ID NO: 468782 - DNA, 25 bp, Mus musculus
tattgtacccgaagcattgaccgtg

SEQ ID NO: 468783 - DNA, 25 bp, Mus musculus
tattgtacgagaaagtggacacatt

SEQ ID NO: 468784 - DNA, 25 bp, Mus musculus
tattgtacggaatagtcactgtatc

SEQ ID NO: 468785 - DNA, 25 bp, Mus musculus
tattgtacgttacttggagaccagc

SEQ ID NO: 468786 - DNA, 25 bp, Mus musculus
tattgtagactggtagccgcaccga

SEQ ID NO: 468787 - DNA, 25 bp, Mus musculus
tattgtagtccagccagtacccgaa

SEQ ID NO: 468788 - DNA, 25 bp, Mus musculus
tattgtatctgaacagtctctagag

SEQ ID NO: 468789 - DNA, 25 bp, Mus musculus
tattgtatggtcaacacgcacgtgt

SEQ ID NO: 468790 - DNA, 25 bp, Mus musculus
tattgtattcgttagcagcagtgcc

SEQ ID NO: 468791 - DNA, 25 bp, Mus musculus
tattgtcacacagaagaaagtaccc

SEQ ID NO: 468792 - DNA, 25 bp, Mus musculus
tattgtcacttttcatccccaggga

SEQ ID NO: 468793 - DNA, 25 bp, Mus musculus
tattgtcaggaagataggcagctca

SEQ ID NO: 468794 - DNA, 25 bp, Mus musculus
tattgtcatagccaagatggatgcc

SEQ ID NO: 468795 - DNA, 25 bp, Mus musculus
tattgtccaccaatgcagagcggca

SEQ ID NO: 468796 - DNA, 25 bp, Mus musculus
tattgtccagaggtaccttgggcca

SEQ ID NO: 468797 - DNA, 25 bp, Mus musculus
tattgtcggtatgagaaagagacca

SEQ ID NO: 468798 - DNA, 25 bp, Mus musculus
tattgtctcctcaccaaattcttga

SEQ ID NO: 468799 - DNA, 25 bp, Mus musculus
tattgtctctgacagaaggccctcc

SEQ ID NO: 468800 - DNA, 25 bp, Mus musculus
tattgtctgaccgagctgtatctga

SEQ ID NO: 468801 - DNA, 25 bp, Mus musculus
tattgtgaaaccaaacgcagcctgc

SEQ ID NO: 468802 - DNA, 25 bp, Mus musculus
tattgtgaaccagactcgacggtca

SEQ ID NO: 468803 - DNA, 25 bp, Mus musculus
tattgtgaccctttcctggccaaat

SEQ ID NO: 468804 - DNA, 25 bp, Mus musculus
tattgtgactaggactgctctgaac

SEQ ID NO: 468805 - DNA, 25 bp, Mus musculus
tattgtgattctgaaagtcccacca

SEQ ID NO: 468806 - DNA, 25 bp, Mus musculus
tattgtgcaagtcatagaacctggg

SEQ ID NO: 468807 - DNA, 25 bp, Mus musculus
tattgtgcaagtcgcgcaaggagca

SEQ ID NO: 468808 - DNA, 25 bp, Mus musculus
tattgtgccgaaacatctgccctgc

SEQ ID NO: 468809 - DNA, 25 bp, Mus musculus
tattgtgcggctgtacgtgcgcaga

SEQ ID NO: 468810 - DNA, 25 bp, Mus musculus
tattgtgcgttatctgggctcagcc

SEQ ID NO: 468811 - DNA, 25 bp, Mus musculus
tattgtggatattgcctctcgtttc

SEQ ID NO: 468812 - DNA, 25 bp, Mus musculus
tattgtgggaggaacaaacgcttct

SEQ ID NO: 468813 - DNA, 25 bp, Mus musculus
tattgtgggcagaaaactcctggcc

SEQ ID NO: 468814 - DNA, 25 bp, Mus musculus
tattgtggttggtgagcacagcccc

SEQ ID NO: 468815 - DNA, 25 bp, Mus musculus
tattgtgtatgccacgcagcctgtg

SEQ ID NO: 468816 - DNA, 25 bp, Mus musculus
tattgtgtgcccctttcctggcgct

SEQ ID NO: 468817 - DNA, 25 bp, Mus musculus
tattgtgtgtgcgatcaccggcgca

SEQ ID NO: 468818 - DNA, 25 bp, Mus musculus
tattgttacgactctggacctggct

SEQ ID NO: 468819 - DNA, 25 bp, Mus musculus
tattgttactaccaagaaacgggag

SEQ ID NO: 468820 - DNA, 25 bp, Mus musculus
tattgttccaagtctttagctgtgg

SEQ ID NO: 468821 - DNA, 25 bp, Mus musculus
tattgttcctaaaatgactgggagg

SEQ ID NO: 468822 - DNA, 25 bp, Mus musculus
tattgttcctgagaagccgtgcacc

SEQ ID NO: 468823 - DNA, 25 bp, Mus musculus
tattgttgcatcagaggagctcggc

SEQ ID NO: 468824 - DNA, 25 bp, Mus musculus
tattgttggagttgagccccacctg

SEQ ID NO: 468825 - DNA, 25 bp, Mus musculus
tattgttggtctcaccggagctgag

SEQ ID NO: 468826 - DNA, 25 bp, Mus musculus
tattgttgtcctagccagacctctg

SEQ ID NO: 468827 - DNA, 25 bp, Mus musculus
tattgtttggtaaccacttggagca

SEQ ID NO: 468828 - DNA, 25 bp, Mus musculus
tatttaaaaattgtgattgccctgt

SEQ ID NO: 468829 - DNA, 25 bp, Mus musculus
tatttaaacgtggtctgtggcagca

SEQ ID NO: 468830 - DNA, 25 bp, Mus musculus
tatttaaatgtaatggtcctattcc

SEQ ID NO: 468831 - DNA, 25 bp, Mus musculus
tatttaaccggtgcatccctcagac

SEQ ID NO: 468832 - DNA, 25 bp, Mus musculus
tatttaagaaaacaccacggagatg

SEQ ID NO: 468833 - DNA, 25 bp, Mus musculus
tatttaagaagccagaaatcgtgcc

SEQ ID NO: 468834 - DNA, 25 bp, Mus musculus
tatttaagactaatctggccgggcg

SEQ ID NO: 468835 - DNA, 25 bp, Mus musculus
tatttaagatcgcagagagtggcct

SEQ ID NO: 468836 - DNA, 25 bp, Mus musculus
tatttaagcagacaggcaccagcat

SEQ ID NO: 468837 - DNA, 25 bp, Mus musculus
tatttaagccgacattcctgataga

SEQ ID NO: 468838 - DNA, 25 bp, Mus musculus
tatttaataaccgaggatgccgagg

SEQ ID NO: 468839 - DNA, 25 bp, Mus musculus
tatttaatgaaacagccctttagag

SEQ ID NO: 468840 - DNA, 25 bp, Mus musculus
tatttaattaattccctgggtggca

SEQ ID NO: 468841 - DNA, 25 bp, Mus musculus
tatttacaatgtagggcagcacagc

SEQ ID NO: 468842 - DNA, 25 bp, Mus musculus
tatttacacatagaccagaggcaag

SEQ ID NO: 468843 - DNA, 25 bp, Mus musculus
tatttacagaggaaatggcagtctc

SEQ ID NO: 468844 - DNA, 25 bp, Mus musculus
tatttacatgtccagccgtgtccag

SEQ ID NO: 468845 - DNA, 25 bp, Mus musculus
tatttacccaagttacgctctacac

SEQ ID NO: 468846 - DNA, 25 bp, Mus musculus
tatttagatctagcagtctgcggcc

SEQ ID NO: 468847 - DNA, 25 bp, Mus musculus
tatttagcagtcctgagcgcgccaa

SEQ ID NO: 468848 - DNA, 25 bp, Mus musculus
tatttagcatggaaaggtggtgacc

SEQ ID NO: 468849 - DNA, 25 bp, Mus musculus
tatttaggaacacacttatggtact

SEQ ID NO: 468850 - DNA, 25 bp, Mus musculus
tatttaggcattacaaggatagcct

SEQ ID NO: 468851 - DNA, 25 bp, Mus musculus
tatttagtaacttgcccatggccac

SEQ ID NO: 468852 - DNA, 25 bp, Mus musculus
tatttagttatatgcgtccatcgac

SEQ ID NO: 468853 - DNA, 25 bp, Mus musculus
tatttatcaaaagcactgggctccc

SEQ ID NO: 468854 - DNA, 25 bp, Mus musculus
tatttatccacttgcgttcgccgag

SEQ ID NO: 468855 - DNA, 25 bp, Mus musculus
tatttatccagaagctcttgggcca

SEQ ID NO: 468856 - DNA, 25 bp, Mus musculus
tatttatcctgtgctgccgagcatc

SEQ ID NO: 468857 - DNA, 25 bp, Mus musculus
tatttatctcgaactctcagggcag

SEQ ID NO: 468858 - DNA, 25 bp, Mus musculus
tatttatgactgagtccagggaagg

SEQ ID NO: 468859 - DNA, 25 bp, Mus musculus
tatttattaactgaccaccatggcc

SEQ ID NO: 468860 - DNA, 25 bp, Mus musculus
tatttattcatcagtgagcatcctc

SEQ ID NO: 468861 - DNA, 25 bp, Mus musculus
tatttattgcttggcctcacctggc

SEQ ID NO: 468862 - DNA, 25 bp, Mus musculus
tatttcaaagaacgccctggagcgg

SEQ ID NO: 468863 - DNA, 25 bp, Mus musculus
tatttcaaagggaagtggaaggctc

SEQ ID NO: 468864 - DNA, 25 bp, Mus musculus
tatttcaaagggatgtgggcttgcc

SEQ ID NO: 468865 - DNA, 25 bp, Mus musculus
tatttcaacaactgctgccgttgcc

SEQ ID NO: 468866 - DNA, 25 bp, Mus musculus
tatttcaaggagaggaaatgccggg

SEQ ID NO: 468867 - DNA, 25 bp, Mus musculus
tatttcacaacactacaggaggcac

SEQ ID NO: 468868 - DNA, 25 bp, Mus musculus
tatttcacagatagcagagtccact

SEQ ID NO: 468869 - DNA, 25 bp, Mus musculus
tatttcaccaagagagggtatgcgt

SEQ ID NO: 468870 - DNA, 25 bp, Mus musculus
tatttcacctcaaaggccttggagt

SEQ ID NO: 468871 - DNA, 25 bp, Mus musculus
tatttcacgtcaacaacggtgccgg

SEQ ID NO: 468872 - DNA, 25 bp, Mus musculus
tatttcactgaacgagacgcctgga

SEQ ID NO: 468873 - DNA, 25 bp, Mus musculus
tatttcagaagctagcagcctcgct

SEQ ID NO: 468874 - DNA, 25 bp, Mus musculus
tatttcagcatagataacgagctag

SEQ ID NO: 468875 - DNA, 25 bp, Mus musculus
tatttcagccaaagatggtttcaag

SEQ ID NO: 468876 - DNA, 25 bp, Mus musculus
tatttcatacagaatcccagacatt

SEQ ID NO: 468877 - DNA, 25 bp, Mus musculus
tatttcatagatattacccgtcatg

SEQ ID NO: 468878 - DNA, 25 bp, Mus musculus
tatttcataggactggacagactat

SEQ ID NO: 468879 - DNA, 25 bp, Mus musculus
tatttcatcatcaacctggccttgg

SEQ ID NO: 468880 - DNA, 25 bp, Mus musculus
tatttcatccttgccttcagacagg

SEQ ID NO: 468881 - DNA, 25 bp, Mus musculus
tatttcatgctcaaggcaaatgctg

SEQ ID NO: 468882 - DNA, 25 bp, Mus musculus
tatttcatggcaagtgacctgaggg

SEQ ID NO: 468883 - DNA, 25 bp, Mus musculus
tatttcatggttctatcaaagcagc

SEQ ID NO: 468884 - DNA, 25 bp, Mus musculus
tatttcattaccctgggcacggaga

SEQ ID NO: 468885 - DNA, 25 bp, Mus musculus
tatttccaaggaaccaccatcggca

SEQ ID NO: 468886 - DNA, 25 bp, Mus musculus
tatttccacactgcggtgtcacggc

SEQ ID NO: 468887 - DNA, 25 bp, Mus musculus
tatttccagaataaatagtgctgcc

SEQ ID NO: 468888 - DNA, 25 bp, Mus musculus
tatttccagaggagtgccatccact

SEQ ID NO: 468889 - DNA, 25 bp, Mus musculus
tatttccaggatgatcgatcgcggc

SEQ ID NO: 468890 - DNA, 25 bp, Mus musculus
tatttccaggcattcggaggacgcc

SEQ ID NO: 468891 - DNA, 25 bp, Mus musculus
tatttccagggagacattgggtcag

SEQ ID NO: 468892 - DNA, 25 bp, Mus musculus
tatttccatgccatgtgccaggtgg

SEQ ID NO: 468893 - DNA, 25 bp, Mus musculus
tatttccatgctggagagcgagagg

SEQ ID NO: 468894 - DNA, 25 bp, Mus musculus
tatttccatgtgtaccagagcgtcc

SEQ ID NO: 468895 - DNA, 25 bp, Mus musculus
tatttcccgaaagaaggtcgtagag

SEQ ID NO: 468896 - DNA, 25 bp, Mus musculus
tatttcccgggacaagatcaccagg

SEQ ID NO: 468897 - DNA, 25 bp, Mus musculus
tatttccctgaagtggctctacaag

SEQ ID NO: 468898 - DNA, 25 bp, Mus musculus
tatttccgaagactgcgcaaccaca

SEQ ID NO: 468899 - DNA, 25 bp, Mus musculus
tatttccgatacagaacaaccgcga

SEQ ID NO: 468900 - DNA, 25 bp, Mus musculus
tatttccggcactagtggcgggcgt

SEQ ID NO: 468901 - DNA, 25 bp, Mus musculus
tatttccgtgttcaggaccatgcag

SEQ ID NO: 468902 - DNA, 25 bp, Mus musculus
tatttcctaggacaagcgttctcag

SEQ ID NO: 468903 - DNA, 25 bp, Mus musculus
tatttcctgagcgatgtcacagcgg

SEQ ID NO: 468904 - DNA, 25 bp, Mus musculus
tatttcctgggagcttgaggttccc

SEQ ID NO: 468905 - DNA, 25 bp, Mus musculus
tatttcgacagaggtgcagaggcca

SEQ ID NO: 468906 - DNA, 25 bp, Mus musculus
tatttcgacagctgcaatggtgacc

SEQ ID NO: 468907 - DNA, 25 bp, Mus musculus
tatttcgcaggaaggcgctggtgct

SEQ ID NO: 468908 - DNA, 25 bp, Mus musculus
tatttcggagccatgtcccgtggag

SEQ ID NO: 468909 - DNA, 25 bp, Mus musculus
tatttcggcatgaagactcgcagcc

SEQ ID NO: 468910 - DNA, 25 bp, Mus musculus
tatttcgggctatgcaacattgcga

SEQ ID NO: 468911 - DNA, 25 bp, Mus musculus
tatttctagcttccaggcaagggcc

SEQ ID NO: 468912 - DNA, 25 bp, Mus musculus
tatttctatactgtccagggtgaag

SEQ ID NO: 468913 - DNA, 25 bp, Mus musculus
tatttctcagcagccggcctgtgaa

SEQ ID NO: 468914 - DNA, 25 bp, Mus musculus
tatttctcgaccaagaaggcgctgc

SEQ ID NO: 468915 - DNA, 25 bp, Mus musculus
tatttctgaggaagcaaccctggag

SEQ ID NO: 468916 - DNA, 25 bp, Mus musculus
tatttctgcaaaaggcataccccag

SEQ ID NO: 468917 - DNA, 25 bp, Mus musculus
tatttctgcacataggaggcgaggg

SEQ ID NO: 468918 - DNA, 25 bp, Mus musculus
tatttctgcaggacaggtaaccgag

SEQ ID NO: 468919 - DNA, 25 bp, Mus musculus
tatttctgcgcctagcacggtgcct

SEQ ID NO: 468920 - DNA, 25 bp, Mus musculus
tatttctgctctagcacatcctgga

SEQ ID NO: 468921 - DNA, 25 bp, Mus musculus
tatttctggtccatcccggaggagg

SEQ ID NO: 468922 - DNA, 25 bp, Mus musculus
tatttctggttttgagtcagcctca

SEQ ID NO: 468923 - DNA, 25 bp, Mus musculus
tatttctgtgaagcgactccctgtc

SEQ ID NO: 468924 - DNA, 25 bp, Mus musculus
tatttctgtgggtggacagtcgcac

SEQ ID NO: 468925 - DNA, 25 bp, Mus musculus
tatttcttagatggaagacacccag

SEQ ID NO: 468926 - DNA, 25 bp, Mus musculus
tatttcttgtctctctacaggcagg

SEQ ID NO: 468927 - DNA, 25 bp, Mus musculus
tatttcttgtgaattctcatgtgca

SEQ ID NO: 468928 - DNA, 25 bp, Mus musculus
tatttgaaaagctggccacccacga

SEQ ID NO: 468929 - DNA, 25 bp, Mus musculus
tatttgaaatggactctgcaggcca

SEQ ID NO: 468930 - DNA, 25 bp, Mus musculus
tatttgaacagacagcacacggacc

SEQ ID NO: 468931 - DNA, 25 bp, Mus musculus
tatttgaaccaacagcagactgcga

SEQ ID NO: 468932 - DNA, 25 bp, Mus musculus
tatttgaagaacgaagagctctgct

SEQ ID NO: 468933 - DNA, 25 bp, Mus musculus
tatttgaagcacaaggccctcctta

SEQ ID NO: 468934 - DNA, 25 bp, Mus musculus
tatttgaagtccagcagtgtccaag

SEQ ID NO: 468935 - DNA, 25 bp, Mus musculus
tatttgaattgatgcagcccctcct

SEQ ID NO: 468936 - DNA, 25 bp, Mus musculus
tatttgacagatgtctgaggcaggt

SEQ ID NO: 468937 - DNA, 25 bp, Mus musculus
tatttgacagttccaggagttacag

SEQ ID NO: 468938 - DNA, 25 bp, Mus musculus
tatttgaccaggctctagatccagt

SEQ ID NO: 468939 - DNA, 25 bp, Mus musculus
tatttgaccagtgagaaccgagatg

SEQ ID NO: 468940 - DNA, 25 bp, Mus musculus
tatttgacctgggaatggacggagc

SEQ ID NO: 468941 - DNA, 25 bp, Mus musculus
tatttgacttttctaggccggccct

SEQ ID NO: 468942 - DNA, 25 bp, Mus musculus
tatttgagaggaacggaccacatgc

SEQ ID NO: 468943 - DNA, 25 bp, Mus musculus
tatttgagatgagtgacgaagaccc

SEQ ID NO: 468944 - DNA, 25 bp, Mus musculus
tatttgagccccactctggagaaga

SEQ ID NO: 468945 - DNA, 25 bp, Mus musculus
tatttgagcctccattcctaagcgg

SEQ ID NO: 468946 - DNA, 25 bp, Mus musculus
tatttgaggaattcagtctgaggcc

SEQ ID NO: 468947 - DNA, 25 bp, Mus musculus
tatttgaggaccaccatcccagaag

SEQ ID NO: 468948 - DNA, 25 bp, Mus musculus
tatttgaggcactactggaaggacg

SEQ ID NO: 468949 - DNA, 25 bp, Mus musculus
tatttgatcatgtttccccttcccc

SEQ ID NO: 468950 - DNA, 25 bp, Mus musculus
tatttgatccttcagcaaccctgga

SEQ ID NO: 468951 - DNA, 25 bp, Mus musculus
tatttgatcgggtctctacagggcc

SEQ ID NO: 468952 - DNA, 25 bp, Mus musculus
tatttgatgactacctaggtcccag

SEQ ID NO: 468953 - DNA, 25 bp, Mus musculus
tatttgatgataagtgggccccact

SEQ ID NO: 468954 - DNA, 25 bp, Mus musculus
tatttgcaacctctggaacccagtg

SEQ ID NO: 468955 - DNA, 25 bp, Mus musculus
tatttgcaccctagttaatgtccgg

SEQ ID NO: 468956 - DNA, 25 bp, Mus musculus
tatttgcaggagacagagtacatgg

SEQ ID NO: 468957 - DNA, 25 bp, Mus musculus
tatttgcatagggaaatgaacaagc

SEQ ID NO: 468958 - DNA, 25 bp, Mus musculus
tatttgccactttggtgcccaacgg

SEQ ID NO: 468959 - DNA, 25 bp, Mus musculus
tatttgccatgcacttggagcattg

SEQ ID NO: 468960 - DNA, 25 bp, Mus musculus
tatttgccccaaagataccccatgg

SEQ ID NO: 468961 - DNA, 25 bp, Mus musculus
tatttgcccttcgatgacctgaaaa

SEQ ID NO: 468962 - DNA, 25 bp, Mus musculus
tatttgcctgtgagtattcataaca

SEQ ID NO: 468963 - DNA, 25 bp, Mus musculus
tatttgcgctcccagaggtcaagtt

SEQ ID NO: 468964 - DNA, 25 bp, Mus musculus
tatttgctctgtaacccatcggtag

SEQ ID NO: 468965 - DNA, 25 bp, Mus musculus
tatttgctgcgcataaggcttccaa

SEQ ID NO: 468966 - DNA, 25 bp, Mus musculus
tatttgctgcttcaggattccctac

SEQ ID NO: 468967 - DNA, 25 bp, Mus musculus
tatttgctggtgacgaccctgaacc

SEQ ID NO: 468968 - DNA, 25 bp, Mus musculus
tatttgcttgcagggctcttggcca

SEQ ID NO: 468969 - DNA, 25 bp, Mus musculus
tatttggaacttcagttctggagag

SEQ ID NO: 468970 - DNA, 25 bp, Mus musculus
tatttggaagcctccagtgggacag

SEQ ID NO: 468971 - DNA, 25 bp, Mus musculus
tatttggaccactgcactgaagaga

SEQ ID NO: 468972 - DNA, 25 bp, Mus musculus
tatttggactggaaggcataccacc

SEQ ID NO: 468973 - DNA, 25 bp, Mus musculus
tatttggagtgcagaaacgaagacc

SEQ ID NO: 468974 - DNA, 25 bp, Mus musculus
tatttggatacttcgtcacaggcgg

SEQ ID NO: 468975 - DNA, 25 bp, Mus musculus
tatttggcctcagagaatggccgtg

SEQ ID NO: 468976 - DNA, 25 bp, Mus musculus
tatttggcctgcttgcaagagtcca

SEQ ID NO: 468977 - DNA, 25 bp, Mus musculus
tatttggcgtggttctcccgtgctc

SEQ ID NO: 468978 - DNA, 25 bp, Mus musculus
tatttgggaacagacacgatgcggt

SEQ ID NO: 468979 - DNA, 25 bp, Mus musculus
tatttgggaccaagatacacagttc

SEQ ID NO: 468980 - DNA, 25 bp, Mus musculus
tatttgggctcaaagcctactgtca

SEQ ID NO: 468981 - DNA, 25 bp, Mus musculus
tatttgggtcccagatggagcccac

SEQ ID NO: 468982 - DNA, 25 bp, Mus musculus
tatttggtaaagttgtctgccgcac

SEQ ID NO: 468983 - DNA, 25 bp, Mus musculus
tatttggtctcaagctgttccgtaa

SEQ ID NO: 468984 - DNA, 25 bp, Mus musculus
tatttggtgctaaccgtggacttcc

SEQ ID NO: 468985 - DNA, 25 bp, Mus musculus
tatttggtggaatctgcctgtctga

SEQ ID NO: 468986 - DNA, 25 bp, Mus musculus
tatttggttggcattcatagctctc

SEQ ID NO: 468987 - DNA, 25 bp, Mus musculus
tatttggttgttatctccaggctga

SEQ ID NO: 468988 - DNA, 25 bp, Mus musculus
tatttgtcacatctactgtaggagg

SEQ ID NO: 468989 - DNA, 25 bp, Mus musculus
tatttgtcagccaagcctggaacgg

SEQ ID NO: 468990 - DNA, 25 bp, Mus musculus
tatttgtgacctgcaataccagcgt

SEQ ID NO: 468991 - DNA, 25 bp, Mus musculus
tatttgtgcaaacacagtcccggta

SEQ ID NO: 468992 - DNA, 25 bp, Mus musculus
tatttgttcagctgccgggcagcag

SEQ ID NO: 468993 - DNA, 25 bp, Mus musculus
tatttgttgctgtgagctggaacca

SEQ ID NO: 468994 - DNA, 25 bp, Mus musculus
tatttgttggtaggtgaaaagagcc

SEQ ID NO: 468995 - DNA, 25 bp, Mus musculus
tatttgttgtgtgcctcatgacagg

SEQ ID NO: 468996 - DNA, 25 bp, Mus musculus
tattttaaccaaagctgccagcgta

SEQ ID NO: 468997 - DNA, 25 bp, Mus musculus
tattttaaccgcaggacgactaggc

SEQ ID NO: 468998 - DNA, 25 bp, Mus musculus
tattttaagactaagttgctggccc

SEQ ID NO: 468999 - DNA, 25 bp, Mus musculus
tattttaagtccaaacagaaggtct

SEQ ID NO: 469000 - DNA, 25 bp, Mus musculus
tattttaatagaactccgcagccga

SEQ ID NO: 469001 - DNA, 25 bp, Mus musculus
tattttacaaagtaatcttatgtca

SEQ ID NO: 469002 - DNA, 25 bp, Mus musculus
tattttacggcaccaaaacataaat

SEQ ID NO: 469003 - DNA, 25 bp, Mus musculus
tattttactcgcgagcagctggaga

SEQ ID NO: 469004 - DNA, 25 bp, Mus musculus
tattttagaatattgtcctctcagc

SEQ ID NO: 469005 - DNA, 25 bp, Mus musculus
tattttagagggagacacttgtacc

SEQ ID NO: 469006 - DNA, 25 bp, Mus musculus
tattttagctggttcatgtcagagg

SEQ ID NO: 469007 - DNA, 25 bp, Mus musculus
tattttatccaagtgagactcaacc

SEQ ID NO: 469008 - DNA, 25 bp, Mus musculus
tattttcaaagttccgtctggctcc

SEQ ID NO: 469009 - DNA, 25 bp, Mus musculus
tattttcagggcctttaccagggag

SEQ ID NO: 469010 - DNA, 25 bp, Mus musculus
tattttccaagtatcgtcaccgagc

SEQ ID NO: 469011 - DNA, 25 bp, Mus musculus
tattttcccacttacgagacgacca

SEQ ID NO: 469012 - DNA, 25 bp, Mus musculus
tattttccctacatcttgagcagaa

SEQ ID NO: 469013 - DNA, 25 bp, Mus musculus
tattttccggaacattaggttgaag

SEQ ID NO: 469014 - DNA, 25 bp, Mus musculus
tattttcctctgcaggttcccgagg

SEQ ID NO: 469015 - DNA, 25 bp, Mus musculus
tattttcgccttgtgagagtctctt

SEQ ID NO: 469016 - DNA, 25 bp, Mus musculus
tattttctcaaatgtagtccttata

SEQ ID NO: 469017 - DNA, 25 bp, Mus musculus
tattttctcacagtctcacacaggg

SEQ ID NO: 469018 - DNA, 25 bp, Mus musculus
tattttctcagacttggcgacacgt

SEQ ID NO: 469019 - DNA, 25 bp, Mus musculus
tattttctgaaggtccattggccga

SEQ ID NO: 469020 - DNA, 25 bp, Mus musculus
tattttctgaccaacacatatgctc

SEQ ID NO: 469021 - DNA, 25 bp, Mus musculus
tattttctggaccacagggcacctg

SEQ ID NO: 469022 - DNA, 25 bp, Mus musculus
tattttctgggcagcacaccaagca

SEQ ID NO: 469023 - DNA, 25 bp, Mus musculus
tattttcttcactgcccttgtgcaa

SEQ ID NO: 469024 - DNA, 25 bp, Mus musculus
tattttcttcccatgtcgcccagag

SEQ ID NO: 469025 - DNA, 25 bp, Mus musculus
tattttgaacagagttaaccccagc

SEQ ID NO: 469026 - DNA, 25 bp, Mus musculus
tattttgagatcacggatgaatccc

SEQ ID NO: 469027 - DNA, 25 bp, Mus musculus
tattttgagcagtaaccaggctttt

SEQ ID NO: 469028 - DNA, 25 bp, Mus musculus
tattttgaggagatccagcgacgct

SEQ ID NO: 469029 - DNA, 25 bp, Mus musculus
tattttgatgcactgatgtccttgg

SEQ ID NO: 469030 - DNA, 25 bp, Mus musculus
tattttgccggcattgtaggcggag

SEQ ID NO: 469031 - DNA, 25 bp, Mus musculus
tattttgctcaaccacatcaggctg

SEQ ID NO: 469032 - DNA, 25 bp, Mus musculus
tattttggaagcatctgaaagcata

SEQ ID NO: 469033 - DNA, 25 bp, Mus musculus
tattttggaccggaaacctctgcca

SEQ ID NO: 469034 - DNA, 25 bp, Mus musculus
tattttgggaggacactcacttgcc

SEQ ID NO: 469035 - DNA, 25 bp, Mus musculus
tattttgtcagcaaccggaagccaa

SEQ ID NO: 469036 - DNA, 25 bp, Mus musculus
tattttgtgtcctagccggtgggga

SEQ ID NO: 469037 - DNA, 25 bp, Mus musculus
tattttgttcctcagaggtttagac

SEQ ID NO: 469038 - DNA, 25 bp, Mus musculus
tattttgttgcgagaagaggctgcc

SEQ ID NO: 469039 - DNA, 25 bp, Mus musculus
tatttttaagccaacatctctaacg

SEQ ID NO: 469040 - DNA, 25 bp, Mus musculus
tatttttacatgaaggctgacctcc

SEQ ID NO: 469041 - DNA, 25 bp, Mus musculus
tatttttatatcgatactaaccctc

SEQ ID NO: 469042 - DNA, 25 bp, Mus musculus
tatttttcaagctacttcatctggg

SEQ ID NO: 469043 - DNA, 25 bp, Mus musculus
tatttttgacgattggagcccttaa

SEQ ID NO: 469044 - DNA, 25 bp, Mus musculus
tatttttgggttcagcagctcgtca

SEQ ID NO: 469045 - DNA, 25 bp, Mus musculus
tattttttgtgcatgagtactcgac

SEQ ID NO: 469046 - DNA, 25 bp, Mus musculus
tcaaaaaagtggagtgcccaagcgg

SEQ ID NO: 469047 - DNA, 25 bp, Mus musculus
tcaaaaaatggagactctgagactg

SEQ ID NO: 469048 - DNA, 25 bp, Mus musculus
tcaaaaacaagcagccggaggagca

SEQ ID NO: 469049 - DNA, 25 bp, Mus musculus
tcaaaaacccaattctagtatactg

SEQ ID NO: 469050 - DNA, 25 bp, Mus musculus
tcaaaaacgggaagagtgccctggg

SEQ ID NO: 469051 - DNA, 25 bp, Mus musculus
tcaaaaactgaaagccaggacagtc

SEQ ID NO: 469052 - DNA, 25 bp, Mus musculus
tcaaaaagaaccctcctggcatgga

SEQ ID NO: 469053 - DNA, 25 bp, Mus musculus
tcaaaaagagctcctcacacacaca

SEQ ID NO: 469054 - DNA, 25 bp, Mus musculus
tcaaaaaggagagtccgagttgcca

SEQ ID NO: 469055 - DNA, 25 bp, Mus musculus
tcaaaaatcacgaggacaagatccg

SEQ ID NO: 469056 - DNA, 25 bp, Mus musculus
tcaaaaatggctggttactatccct

SEQ ID NO: 469057 - DNA, 25 bp, Mus musculus
tcaaaaattgtgcaagtggccctca

SEQ ID NO: 469058 - DNA, 25 bp, Mus musculus
tcaaaacaaacttgggggagcccat

SEQ ID NO: 469059 - DNA, 25 bp, Mus musculus
tcaaaacactaaaatccagataagc

SEQ ID NO: 469060 - DNA, 25 bp, Mus musculus
tcaaaacagtcgtcgtgagcgcgga

SEQ ID NO: 469061 - DNA, 25 bp, Mus musculus
tcaaaacatgagaaagagcctctgc

SEQ ID NO: 469062 - DNA, 25 bp, Mus musculus
tcaaaaccatataggaaggccaagc

SEQ ID NO: 469063 - DNA, 25 bp, Mus musculus
tcaaaactatcgtcgtagggtcctg

SEQ ID NO: 469064 - DNA, 25 bp, Mus musculus
tcaaaactgatgagccttctcccta

SEQ ID NO: 469065 - DNA, 25 bp, Mus musculus
tcaaaactgattctggtccccacga

SEQ ID NO: 469066 - DNA, 25 bp, Mus musculus
tcaaaactgcatgcatacattgggt

SEQ ID NO: 469067 - DNA, 25 bp, Mus musculus
tcaaaactgggcaggtaggtctcca

SEQ ID NO: 469068 - DNA, 25 bp, Mus musculus
tcaaaactgggttcggagtctccgc

SEQ ID NO: 469069 - DNA, 25 bp, Mus musculus
tcaaaacttttgaggtgggttggct

SEQ ID NO: 469070 - DNA, 25 bp, Mus musculus
tcaaaagatcccactaagagggtgt

SEQ ID NO: 469071 - DNA, 25 bp, Mus musculus
tcaaaagatggctggaggacctacc

SEQ ID NO: 469072 - DNA, 25 bp, Mus musculus
tcaaaagatgttgtggatcccagca

SEQ ID NO: 469073 - DNA, 25 bp, Mus musculus
tcaaaagcatcagctatcccaggga

SEQ ID NO: 469074 - DNA, 25 bp, Mus musculus
tcaaaagctcagaaagttacaaggc

SEQ ID NO: 469075 - DNA, 25 bp, Mus musculus
tcaaaagcttgaacaggcagcccag

SEQ ID NO: 469076 - DNA, 25 bp, Mus musculus
tcaaaaggatcgtaacaaggagaaa

SEQ ID NO: 469077 - DNA, 25 bp, Mus musculus
tcaaaaggatggtgaggactggcct

SEQ ID NO: 469078 - DNA, 25 bp, Mus musculus
tcaaaaggtaaagagaaagattctc

SEQ ID NO: 469079 - DNA, 25 bp, Mus musculus
tcaaaaggtagtcgcacaagagcag

SEQ ID NO: 469080 - DNA, 25 bp, Mus musculus
tcaaaaggtcagacgggagtacgtc

SEQ ID NO: 469081 - DNA, 25 bp, Mus musculus
tcaaaagtctcttcgcaggaggttc

SEQ ID NO: 469082 - DNA, 25 bp, Mus musculus
tcaaaagtgtgagcaccagcagcag

SEQ ID NO: 469083 - DNA, 25 bp, Mus musculus
tcaaaagttaagtaggatgggaaat

SEQ ID NO: 469084 - DNA, 25 bp, Mus musculus
tcaaaagttacacagcaggcatcga

SEQ ID NO: 469085 - DNA, 25 bp, Mus musculus
tcaaaagttgaagcaaaggaacttg

SEQ ID NO: 469086 - DNA, 25 bp, Mus musculus
tcaaaagttgagttagcacgaggca

SEQ ID NO: 469087 - DNA, 25 bp, Mus musculus
tcaaaatactgtggctatcgggaag

SEQ ID NO: 469088 - DNA, 25 bp, Mus musculus
tcaaaatatcagagcaacccgaagg

SEQ ID NO: 469089 - DNA, 25 bp, Mus musculus
tcaaaatcagctttcgacatggact

SEQ ID NO: 469090 - DNA, 25 bp, Mus musculus
tcaaaatctgcgaggcggtgagctt

SEQ ID NO: 469091 - DNA, 25 bp, Mus musculus
tcaaaatgcaggaggcttaaaagcc

SEQ ID NO: 469092 - DNA, 25 bp, Mus musculus
tcaaaatgcggatggagcggctcca

SEQ ID NO: 469093 - DNA, 25 bp, Mus musculus
tcaaaatgcggtaaggtcttctgct

SEQ ID NO: 469094 - DNA, 25 bp, Mus musculus
tcaaaatggaagatggaaagcccgt

SEQ ID NO: 469095 - DNA, 25 bp, Mus musculus
tcaaaatggattgagcagtgggtca

SEQ ID NO: 469096 - DNA, 25 bp, Mus musculus
tcaaaatgtagaatcctcggctcct

SEQ ID NO: 469097 - DNA, 25 bp, Mus musculus
tcaaacaactactcagggcagctct

SEQ ID NO: 469098 - DNA, 25 bp, Mus musculus
tcaaacaagatgagcgggtgtccat

SEQ ID NO: 469099 - DNA, 25 bp, Mus musculus
tcaaacaagtaagcatcccagatcc

SEQ ID NO: 469100 - DNA, 25 bp, Mus musculus
tcaaacacacagtccagagagccat

SEQ ID NO: 469101 - DNA, 25 bp, Mus musculus
tcaaacaggaacaaggcaaagccca

SEQ ID NO: 469102 - DNA, 25 bp, Mus musculus
tcaaacaggactccaaccacactat

SEQ ID NO: 469103 - DNA, 25 bp, Mus musculus
tcaaacagggcattcagggagacgg

SEQ ID NO: 469104 - DNA, 25 bp, Mus musculus
tcaaacaggtgtgtcgcaggagact

SEQ ID NO: 469105 - DNA, 25 bp, Mus musculus
tcaaacatcactgctggcaacaggg

SEQ ID NO: 469106 - DNA, 25 bp, Mus musculus
tcaaacatcagcgaagaaggaggaa

SEQ ID NO: 469107 - DNA, 25 bp, Mus musculus
tcaaacatcttggagcgttcagaag

SEQ ID NO: 469108 - DNA, 25 bp, Mus musculus
tcaaacatgttgagagggcctccaa

SEQ ID NO: 469109 - DNA, 25 bp, Mus musculus
tcaaaccacataggagtcaatcttt

SEQ ID NO: 469110 - DNA, 25 bp, Mus musculus
tcaaacccaacaacaggagtaactg

SEQ ID NO: 469111 - DNA, 25 bp, Mus musculus
tcaaacccatgcacaggaggtggca

SEQ ID NO: 469112 - DNA, 25 bp, Mus musculus
tcaaaccgaatgtaccatggacaga

SEQ ID NO: 469113 - DNA, 25 bp, Mus musculus
tcaaaccgtgagcaatttcctgtgt

SEQ ID NO: 469114 - DNA, 25 bp, Mus musculus
tcaaacctacttgtctgggagaagg

SEQ ID NO: 469115 - DNA, 25 bp, Mus musculus
tcaaacctcacgcaggctgcaggga

SEQ ID NO: 469116 - DNA, 25 bp, Mus musculus
tcaaacctgacactgaatcccattt

SEQ ID NO: 469117 - DNA, 25 bp, Mus musculus
tcaaacctgggaacatcatgcgcct

SEQ ID NO: 469118 - DNA, 25 bp, Mus musculus
tcaaacgaagtctcaaaaaacccag

SEQ ID NO: 469119 - DNA, 25 bp, Mus musculus
tcaaacgcaagttcccctaaaagtg

SEQ ID NO: 469120 - DNA, 25 bp, Mus musculus
tcaaacgcatggagagcctgaagct

SEQ ID NO: 469121 - DNA, 25 bp, Mus musculus
tcaaacgcggcttctcggcccattt

SEQ ID NO: 469122 - DNA, 25 bp, Mus musculus
tcaaacggcggtgagatctcctcgg

SEQ ID NO: 469123 - DNA, 25 bp, Mus musculus
tcaaacggctccaggcaaatatggg

SEQ ID NO: 469124 - DNA, 25 bp, Mus musculus
tcaaacgggaaaggcaaggaaatgt

SEQ ID NO: 469125 - DNA, 25 bp, Mus musculus
tcaaacgggttttcctctcaggtag

SEQ ID NO: 469126 - DNA, 25 bp, Mus musculus
tcaaacgtcagtataaagagatgct

SEQ ID NO: 469127 - DNA, 25 bp, Mus musculus
tcaaacgtgaaagaaggtacctaag

SEQ ID NO: 469128 - DNA, 25 bp, Mus musculus
tcaaacgtgtattatcaggaagatg

SEQ ID NO: 469129 - DNA, 25 bp, Mus musculus
tcaaactaagcgatgggcggaagcg

SEQ ID NO: 469130 - DNA, 25 bp, Mus musculus
tcaaactcagtgtgcctagggcgct

SEQ ID NO: 469131 - DNA, 25 bp, Mus musculus
tcaaactcatcgacttcgggtcggg

SEQ ID NO: 469132 - DNA, 25 bp, Mus musculus
tcaaactcgggaagtcgaatcgtgg

SEQ ID NO: 469133 - DNA, 25 bp, Mus musculus
tcaaactgcaagatgaagccagcat

SEQ ID NO: 469134 - DNA, 25 bp, Mus musculus
tcaaactgccctaccaaggaaatgc

SEQ ID NO: 469135 - DNA, 25 bp, Mus musculus
tcaaactgtttgcacgattccgtca

SEQ ID NO: 469136 - DNA, 25 bp, Mus musculus
tcaaacttgttaggatgcacccagc

SEQ ID NO: 469137 - DNA, 25 bp, Mus musculus
tcaaagaaattgtcctgcccgaact

SEQ ID NO: 469138 - DNA, 25 bp, Mus musculus
tcaaagaacgagaatgtatgctggt

SEQ ID NO: 469139 - DNA, 25 bp, Mus musculus
tcaaagaacgcctgggaaccaaacg

SEQ ID NO: 469140 - DNA, 25 bp, Mus musculus
tcaaagaagaattgctaaagtgctg

SEQ ID NO: 469141 - DNA, 25 bp, Mus musculus
tcaaagaagagctgtgtccccaggg

SEQ ID NO: 469142 - DNA, 25 bp, Mus musculus
tcaaagaagatccatggacccaggt

SEQ ID NO: 469143 - DNA, 25 bp, Mus musculus
tcaaagaagccgttgtgtacccaat

SEQ ID NO: 469144 - DNA, 25 bp, Mus musculus
tcaaagaagctgcaaaaagcgaccc

SEQ ID NO: 469145 - DNA, 25 bp, Mus musculus
tcaaagaaggcattaactagagccc

SEQ ID NO: 469146 - DNA, 25 bp, Mus musculus
tcaaagaagtcaaggaagtcacgag

SEQ ID NO: 469147 - DNA, 25 bp, Mus musculus
tcaaagaccagagagacggtacctc

SEQ ID NO: 469148 - DNA, 25 bp, Mus musculus
tcaaagacccggatacttcagggtt

SEQ ID NO: 469149 - DNA, 25 bp, Mus musculus
tcaaagactgaaagactcctgggca

SEQ ID NO: 469150 - DNA, 25 bp, Mus musculus
tcaaagactgggatcatggaccgag

SEQ ID NO: 469151 - DNA, 25 bp, Mus musculus
tcaaagactgtgtcaaaggcttgtc

SEQ ID NO: 469152 - DNA, 25 bp, Mus musculus
tcaaagagaagtgagcgcatcccag

SEQ ID NO: 469153 - DNA, 25 bp, Mus musculus
tcaaagagatcctgacagccctggg

SEQ ID NO: 469154 - DNA, 25 bp, Mus musculus
tcaaagaggatagctgtccgatgcc

SEQ ID NO: 469155 - DNA, 25 bp, Mus musculus
tcaaagaggatctgtggccaaaccc

SEQ ID NO: 469156 - DNA, 25 bp, Mus musculus
tcaaagaggatgctgtctcggcttc

SEQ ID NO: 469157 - DNA, 25 bp, Mus musculus
tcaaagaggcaagggaacatggagc

SEQ ID NO: 469158 - DNA, 25 bp, Mus musculus
tcaaagaggcagagtctccattgct

SEQ ID NO: 469159 - DNA, 25 bp, Mus musculus
tcaaagagggctccaactgccagtc

SEQ ID NO: 469160 - DNA, 25 bp, Mus musculus
tcaaagagtacttcgattccgttgc

SEQ ID NO: 469161 - DNA, 25 bp, Mus musculus
tcaaagatatcaaaccagcggcact

SEQ ID NO: 469162 - DNA, 25 bp, Mus musculus
tcaaagatcgattccagctgacgga

SEQ ID NO: 469163 - DNA, 25 bp, Mus musculus
tcaaagatgagaggcgccttgaacc

SEQ ID NO: 469164 - DNA, 25 bp, Mus musculus
tcaaagatgctacagtccgagcggt

SEQ ID NO: 469165 - DNA, 25 bp, Mus musculus
tcaaagatgggatcacgaatggcgc

SEQ ID NO: 469166 - DNA, 25 bp, Mus musculus
tcaaagatgtgaccctgaccgtgga

SEQ ID NO: 469167 - DNA, 25 bp, Mus musculus
tcaaagcaacatgacgggtttatgc

SEQ ID NO: 469168 - DNA, 25 bp, Mus musculus
tcaaagcagcaagtcacgagtgacc

SEQ ID NO: 469169 - DNA, 25 bp, Mus musculus
tcaaagcagtcaccatggagacaag

SEQ ID NO: 469170 - DNA, 25 bp, Mus musculus
tcaaagcagttctagtgggcgggac

SEQ ID NO: 469171 - DNA, 25 bp, Mus musculus
tcaaagcatcatacggccagggact

SEQ ID NO: 469172 - DNA, 25 bp, Mus musculus
tcaaagcatcggaaaggagtcaccc

SEQ ID NO: 469173 - DNA, 25 bp, Mus musculus
tcaaagcatgaaagttaggaccacg

SEQ ID NO: 469174 - DNA, 25 bp, Mus musculus
tcaaagccaaatcctccaaagtttt

SEQ ID NO: 469175 - DNA, 25 bp, Mus musculus
tcaaagccactgctgaaagacgccg

SEQ ID NO: 469176 - DNA, 25 bp, Mus musculus
tcaaagcccacccaagagaggaaac

SEQ ID NO: 469177 - DNA, 25 bp, Mus musculus
tcaaagcccggcaggagaagaggct

SEQ ID NO: 469178 - DNA, 25 bp, Mus musculus
tcaaagccctgaaagaagtacctgg

SEQ ID NO: 469179 - DNA, 25 bp, Mus musculus
tcaaagccgtatatgacaccgaccc

SEQ ID NO: 469180 - DNA, 25 bp, Mus musculus
tcaaagcctgttgcacgggactcag

SEQ ID NO: 469181 - DNA, 25 bp, Mus musculus
tcaaagcctttcttgccaatcggag

SEQ ID NO: 469182 - DNA, 25 bp, Mus musculus
tcaaagcgcagaaggatgacccatt

SEQ ID NO: 469183 - DNA, 25 bp, Mus musculus
tcaaagcgggcacattcagcctgtc

SEQ ID NO: 469184 - DNA, 25 bp, Mus musculus
tcaaagcggtgcagtctgggaccaa

SEQ ID NO: 469185 - DNA, 25 bp, Mus musculus
tcaaagcggtggcaatctgacttcc

SEQ ID NO: 469186 - DNA, 25 bp, Mus musculus
tcaaagctacgagagtggcagacag

SEQ ID NO: 469187 - DNA, 25 bp, Mus musculus
tcaaagctagaggtatgggccgtct

SEQ ID NO: 469188 - DNA, 25 bp, Mus musculus
tcaaagctcaccttcttctgagaag

SEQ ID NO: 469189 - DNA, 25 bp, Mus musculus
tcaaagctcagcctcaaaccctgtg

SEQ ID NO: 469190 - DNA, 25 bp, Mus musculus
tcaaagctgcaagtggacgtggtag

SEQ ID NO: 469191 - DNA, 25 bp, Mus musculus
tcaaagctggctacacggagagaca

SEQ ID NO: 469192 - DNA, 25 bp, Mus musculus
tcaaagcttccgagcagatcctcag

SEQ ID NO: 469193 - DNA, 25 bp, Mus musculus
tcaaagcttctttttcctacggagc

SEQ ID NO: 469194 - DNA, 25 bp, Mus musculus
tcaaaggacaagtaccctacagttc

SEQ ID NO: 469195 - DNA, 25 bp, Mus musculus
tcaaaggagcatgcggagttggacc

SEQ ID NO: 469196 - DNA, 25 bp, Mus musculus
tcaaaggagcggttctaagggcgta

SEQ ID NO: 469197 - DNA, 25 bp, Mus musculus
tcaaaggaggcgctatactcggtgt

SEQ ID NO: 469198 - DNA, 25 bp, Mus musculus
tcaaaggagtccgtagggtggccaa

SEQ ID NO: 469199 - DNA, 25 bp, Mus musculus
tcaaaggatgatgcacgtgagtcac

SEQ ID NO: 469200 - DNA, 25 bp, Mus musculus
tcaaaggatgcctcaaggactacgg

SEQ ID NO: 469201 - DNA, 25 bp, Mus musculus
tcaaaggcacgtggcactagggaca

SEQ ID NO: 469202 - DNA, 25 bp, Mus musculus
tcaaaggcccagtccgatattctag

SEQ ID NO: 469203 - DNA, 25 bp, Mus musculus
tcaaaggcgataaggaacagaagtt

SEQ ID NO: 469204 - DNA, 25 bp, Mus musculus
tcaaaggctcaaaggctctgggcac

SEQ ID NO: 469205 - DNA, 25 bp, Mus musculus
tcaaaggctgaaaagctaccccagg

SEQ ID NO: 469206 - DNA, 25 bp, Mus musculus
tcaaagggcagaccttggactccag

SEQ ID NO: 469207 - DNA, 25 bp, Mus musculus
tcaaagggcaggaccaaatggttca

SEQ ID NO: 469208 - DNA, 25 bp, Mus musculus
tcaaagggcccatagcagtgataca

SEQ ID NO: 469209 - DNA, 25 bp, Mus musculus
tcaaagggctcttttctgggcggta

SEQ ID NO: 469210 - DNA, 25 bp, Mus musculus
tcaaagggtgcacctattggcaggt

SEQ ID NO: 469211 - DNA, 25 bp, Mus musculus
tcaaagggttcagacccaggacagt

SEQ ID NO: 469212 - DNA, 25 bp, Mus musculus
tcaaaggtactgagcccatcgtggt

SEQ ID NO: 469213 - DNA, 25 bp, Mus musculus
tcaaaggtcacgaatgagtcatcag

SEQ ID NO: 469214 - DNA, 25 bp, Mus musculus
tcaaaggtcttacacatggctatcc

SEQ ID NO: 469215 - DNA, 25 bp, Mus musculus
tcaaaggtgcaagggactttctcac

SEQ ID NO: 469216 - DNA, 25 bp, Mus musculus
tcaaaggtggtgctacgctgatcca

SEQ ID NO: 469217 - DNA, 25 bp, Mus musculus
tcaaaggtggttcctgagcaggtca

SEQ ID NO: 469218 - DNA, 25 bp, Mus musculus
tcaaaggttatctacggagctgccg

SEQ ID NO: 469219 - DNA, 25 bp, Mus musculus
tcaaaggtttgattagattcatggc

SEQ ID NO: 469220 - DNA, 25 bp, Mus musculus
tcaaagtaaacaatggccgagggac

SEQ ID NO: 469221 - DNA, 25 bp, Mus musculus
tcaaagtaagatgctctccaagggt

SEQ ID NO: 469222 - DNA, 25 bp, Mus musculus
tcaaagtacgcagtggacggccata

SEQ ID NO: 469223 - DNA, 25 bp, Mus musculus
tcaaagtacgggaacagctgtgcaa

SEQ ID NO: 469224 - DNA, 25 bp, Mus musculus
tcaaagtactgaggatccaacccag

SEQ ID NO: 469225 - DNA, 25 bp, Mus musculus
tcaaagtatccaagttccaagagtt

SEQ ID NO: 469226 - DNA, 25 bp, Mus musculus
tcaaagtatcgaagcccaagtggcc

SEQ ID NO: 469227 - DNA, 25 bp, Mus musculus
tcaaagtcaatatcaagaacgaggg

SEQ ID NO: 469228 - DNA, 25 bp, Mus musculus
tcaaagtcctggatgctgtccgagg

SEQ ID NO: 469229 - DNA, 25 bp, Mus musculus
tcaaagtcgagatagcaaggagcct

SEQ ID NO: 469230 - DNA, 25 bp, Mus musculus
tcaaagtctatgatgacggtaccaa

SEQ ID NO: 469231 - DNA, 25 bp, Mus musculus
tcaaagtctgctgtccgggatgcct

SEQ ID NO: 469232 - DNA, 25 bp, Mus musculus
tcaaagtgaccgatgatgatgcccc

SEQ ID NO: 469233 - DNA, 25 bp, Mus musculus
tcaaagtgagctccgtctagaaaat

SEQ ID NO: 469234 - DNA, 25 bp, Mus musculus
tcaaagtgatgtgccggttccggcc

SEQ ID NO: 469235 - DNA, 25 bp, Mus musculus
tcaaagtgcctcgatgacctgctgc

SEQ ID NO: 469236 - DNA, 25 bp, Mus musculus
tcaaagtgcgattgagacctcggca

SEQ ID NO: 469237 - DNA, 25 bp, Mus musculus
tcaaagtggacttccagcggaccca

SEQ ID NO: 469238 - DNA, 25 bp, Mus musculus
tcaaagttcaggagctagaggcgcc

SEQ ID NO: 469239 - DNA, 25 bp, Mus musculus
tcaaagttctccaggcaggtgccct

SEQ ID NO: 469240 - DNA, 25 bp, Mus musculus
tcaaagttggagaagagtttgagga

SEQ ID NO: 469241 - DNA, 25 bp, Mus musculus
tcaaagtttacaagtggaagcggtc

SEQ ID NO: 469242 - DNA, 25 bp, Mus musculus
tcaaataagatatcccaagtggcct

SEQ ID NO: 469243 - DNA, 25 bp, Mus musculus
tcaaataccagcttaggaaaacagg

SEQ ID NO: 469244 - DNA, 25 bp, Mus musculus
tcaaatagtaggatgcagagatgcc

SEQ ID NO: 469245 - DNA, 25 bp, Mus musculus
tcaaatatgatgacaaagcccctca

SEQ ID NO: 469246 - DNA, 25 bp, Mus musculus
tcaaatatggatgcgggttgggcaa

SEQ ID NO: 469247 - DNA, 25 bp, Mus musculus
tcaaatccaatggtgacagttcatc

SEQ ID NO: 469248 - DNA, 25 bp, Mus musculus
tcaaatccagagaagcgagagctgt

SEQ ID NO: 469249 - DNA, 25 bp, Mus musculus
tcaaatccagtgaccggctagacga

SEQ ID NO: 469250 - DNA, 25 bp, Mus musculus
tcaaatcccaaaacagagtgtcagg

SEQ ID NO: 469251 - DNA, 25 bp, Mus musculus
tcaaatccccgctgtaccaagagtg

SEQ ID NO: 469252 - DNA, 25 bp, Mus musculus
tcaaatccgggacagtatagctgcg

SEQ ID NO: 469253 - DNA, 25 bp, Mus musculus
tcaaatcctgcacacggcgaaagac

SEQ ID NO: 469254 - DNA, 25 bp, Mus musculus
tcaaatcggattcctggactagcgg

SEQ ID NO: 469255 - DNA, 25 bp, Mus musculus
tcaaatctgaacgtgaggcactgct

SEQ ID NO: 469256 - DNA, 25 bp, Mus musculus
tcaaatctggtttaaactcgccggg

SEQ ID NO: 469257 - DNA, 25 bp, Mus musculus
tcaaatctgttctgacctggcagcg

SEQ ID NO: 469258 - DNA, 25 bp, Mus musculus
tcaaatgcaggaacggtcaaaccca

SEQ ID NO: 469259 - DNA, 25 bp, Mus musculus
tcaaatgcaggaactctcggaagcc

SEQ ID NO: 469260 - DNA, 25 bp, Mus musculus
tcaaatgcatgagcctttgggcccg

SEQ ID NO: 469261 - DNA, 25 bp, Mus musculus
tcaaatgccgcacggcaggcatccg

SEQ ID NO: 469262 - DNA, 25 bp, Mus musculus
tcaaatgccgtaccagagaagaccc

SEQ ID NO: 469263 - DNA, 25 bp, Mus musculus
tcaaatgcctttatcctggggatgg

SEQ ID NO: 469264 - DNA, 25 bp, Mus musculus
tcaaatgcgagaactgcgggaagaa

SEQ ID NO: 469265 - DNA, 25 bp, Mus musculus
tcaaatggagaacacagactgctac

SEQ ID NO: 469266 - DNA, 25 bp, Mus musculus
tcaaatggaggtggagcaataccgc

SEQ ID NO: 469267 - DNA, 25 bp, Mus musculus
tcaaatgggtgatgaaaaggactct

SEQ ID NO: 469268 - DNA, 25 bp, Mus musculus
tcaaatgggttccagcctgcaagga

SEQ ID NO: 469269 - DNA, 25 bp, Mus musculus
tcaaatgtgacaagttccccgaggg

SEQ ID NO: 469270 - DNA, 25 bp, Mus musculus
tcaaatgtgagaattctgaaggccc

SEQ ID NO: 469271 - DNA, 25 bp, Mus musculus
tcaaatgtgcaagaggtccgctgtc

SEQ ID NO: 469272 - DNA, 25 bp, Mus musculus
tcaaatgtggaaccctaggccttca

SEQ ID NO: 469273 - DNA, 25 bp, Mus musculus
tcaaatgtggcatagcagtggctcc

SEQ ID NO: 469274 - DNA, 25 bp, Mus musculus
tcaaatgtgtgggtacacaagccct

SEQ ID NO: 469275 - DNA, 25 bp, Mus musculus
tcaaattcagatatggctcctaggg

SEQ ID NO: 469276 - DNA, 25 bp, Mus musculus
tcaaattcccagcttgcttccatgg

SEQ ID NO: 469277 - DNA, 25 bp, Mus musculus
tcaaattccttctggactcgcatca

SEQ ID NO: 469278 - DNA, 25 bp, Mus musculus
tcaaattcgtgagtcaccggcaggc

SEQ ID NO: 469279 - DNA, 25 bp, Mus musculus
tcaaattctcgtttcgccagccagg

SEQ ID NO: 469280 - DNA, 25 bp, Mus musculus
tcaaattctctgaagccggcccttg

SEQ ID NO: 469281 - DNA, 25 bp, Mus musculus
tcaaattctggtataggcctgctct

SEQ ID NO: 469282 - DNA, 25 bp, Mus musculus
tcaaattctgtaagaagcgtgtggg

SEQ ID NO: 469283 - DNA, 25 bp, Mus musculus
tcaaatttcaactgcatcaaaacaa

SEQ ID NO: 469284 - DNA, 25 bp, Mus musculus
tcaaatttgccaatgaccttggctc

SEQ ID NO: 469285 - DNA, 25 bp, Mus musculus
tcaacaaaacatattctgcaggaag

SEQ ID NO: 469286 - DNA, 25 bp, Mus musculus
tcaacaaaatggacttggcagatct

SEQ ID NO: 469287 - DNA, 25 bp, Mus musculus
tcaacaaaatgggagaccgagacct

SEQ ID NO: 469288 - DNA, 25 bp, Mus musculus
tcaacaacaagatgtgaagcctgga

SEQ ID NO: 469289 - DNA, 25 bp, Mus musculus
tcaacaacacagactccgggaggtg

SEQ ID NO: 469290 - DNA, 25 bp, Mus musculus
tcaacaacaggtggcccaggctgtg

SEQ ID NO: 469291 - DNA, 25 bp, Mus musculus
tcaacaaccacatcgaggtgcgggc

SEQ ID NO: 469292 - DNA, 25 bp, Mus musculus
tcaacaacccagtaccgaaatcgtg

SEQ ID NO: 469293 - DNA, 25 bp, Mus musculus
tcaacaaccctgacagagctgtgga

SEQ ID NO: 469294 - DNA, 25 bp, Mus musculus
tcaacaacggtgtgctgagcaggcc

SEQ ID NO: 469295 - DNA, 25 bp, Mus musculus
tcaacaacgtagagagcgagcctgg

SEQ ID NO: 469296 - DNA, 25 bp, Mus musculus
tcaacaacgttggaatgctccccag

SEQ ID NO: 469297 - DNA, 25 bp, Mus musculus
tcaacaagaaggagctgtgggacag

SEQ ID NO: 469298 - DNA, 25 bp, Mus musculus
tcaacaagcaagaatgtggctggct

SEQ ID NO: 469299 - DNA, 25 bp, Mus musculus
tcaacaagcagatcgactgggagcg

SEQ ID NO: 469300 - DNA, 25 bp, Mus musculus
tcaacaagcggctcaaggatgctct

SEQ ID NO: 469301 - DNA, 25 bp, Mus musculus
tcaacaaggatacggtgtgcacacc

SEQ ID NO: 469302 - DNA, 25 bp, Mus musculus
tcaacaaggatgctctagggcctct

SEQ ID NO: 469303 - DNA, 25 bp, Mus musculus
tcaacaagggaggtctctctgccag

SEQ ID NO: 469304 - DNA, 25 bp, Mus musculus
tcaacaaggtcttccatgggccact

SEQ ID NO: 469305 - DNA, 25 bp, Mus musculus
tcaacaagtaccttacacgagcgcg

SEQ ID NO: 469306 - DNA, 25 bp, Mus musculus
tcaacaagtatggtcgccggtccaa

SEQ ID NO: 469307 - DNA, 25 bp, Mus musculus
tcaacaagtgctccgccgaggagac

SEQ ID NO: 469308 - DNA, 25 bp, Mus musculus
tcaacaagtggctggaggagaccga

SEQ ID NO: 469309 - DNA, 25 bp, Mus musculus
tcaacaagttcctgcctcgagagct

SEQ ID NO: 469310 - DNA, 25 bp, Mus musculus
tcaacaatggtagggatgtctaggc

SEQ ID NO: 469311 - DNA, 25 bp, Mus musculus
tcaacacaacggaagtctagcagat

SEQ ID NO: 469312 - DNA, 25 bp, Mus musculus
tcaacacacagaggcaatattacag

SEQ ID NO: 469313 - DNA, 25 bp, Mus musculus
tcaacacaggcgtgcaaaccagagt

SEQ ID NO: 469314 - DNA, 25 bp, Mus musculus
tcaacacaggtctcatgaattagcc

SEQ ID NO: 469315 - DNA, 25 bp, Mus musculus
tcaacaccagctagtcagaaggaag

SEQ ID NO: 469316 - DNA, 25 bp, Mus musculus
tcaacaccagttccagcaggagcag

SEQ ID NO: 469317 - DNA, 25 bp, Mus musculus
tcaacaccatgtcgaaaatccgcgg

SEQ ID NO: 469318 - DNA, 25 bp, Mus musculus
tcaacacgggattcactggcacact

SEQ ID NO: 469319 - DNA, 25 bp, Mus musculus
tcaacacgtcctgactgcatgcgag

SEQ ID NO: 469320 - DNA, 25 bp, Mus musculus
tcaacactctggaggactggtacca

SEQ ID NO: 469321 - DNA, 25 bp, Mus musculus
tcaacactgccttctgggtaaagtg

SEQ ID NO: 469322 - DNA, 25 bp, Mus musculus
tcaacactgtagaaatgagacagct

SEQ ID NO: 469323 - DNA, 25 bp, Mus musculus
tcaacactgtcgtggagaacctgca

SEQ ID NO: 469324 - DNA, 25 bp, Mus musculus
tcaacagaggcatggtgcacgcaga

SEQ ID NO: 469325 - DNA, 25 bp, Mus musculus
tcaacagatcgcagagagaagcctt

SEQ ID NO: 469326 - DNA, 25 bp, Mus musculus
tcaacagcaaggagctgtgcggcga

SEQ ID NO: 469327 - DNA, 25 bp, Mus musculus
tcaacagcagcctttggaaccggga

SEQ ID NO: 469328 - DNA, 25 bp, Mus musculus
tcaacagcagggactgagacctttc

SEQ ID NO: 469329 - DNA, 25 bp, Mus musculus
tcaacagcatcttggaggtcctcag

SEQ ID NO: 469330 - DNA, 25 bp, Mus musculus
tcaacagcatttggacgtgaacctg

SEQ ID NO: 469331 - DNA, 25 bp, Mus musculus
tcaacagcctttcagagcagccagt

SEQ ID NO: 469332 - DNA, 25 bp, Mus musculus
tcaacagctatcagagccaggctac

SEQ ID NO: 469333 - DNA, 25 bp, Mus musculus
tcaacagctccagcgaaaggacgtc

SEQ ID NO: 469334 - DNA, 25 bp, Mus musculus
tcaacagctgggtcggatgaagcac

SEQ ID NO: 469335 - DNA, 25 bp, Mus musculus
tcaacagctggttggccaaagggct

SEQ ID NO: 469336 - DNA, 25 bp, Mus musculus
tcaacaggatagttcacattgggct

SEQ ID NO: 469337 - DNA, 25 bp, Mus musculus
tcaacaggccgtggaaatgaaggtg

SEQ ID NO: 469338 - DNA, 25 bp, Mus musculus
tcaacagggagctagctaaggagca

SEQ ID NO: 469339 - DNA, 25 bp, Mus musculus
tcaacagggaggagaatttaaggcc

SEQ ID NO: 469340 - DNA, 25 bp, Mus musculus
tcaacagtatatgcgggactccagg

SEQ ID NO: 469341 - DNA, 25 bp, Mus musculus
tcaacagtggaggagacaaagaccc

SEQ ID NO: 469342 - DNA, 25 bp, Mus musculus
tcaacagtggcttgcaagggtccag

SEQ ID NO: 469343 - DNA, 25 bp, Mus musculus
tcaacagttgagtggctaaaaagcc

SEQ ID NO: 469344 - DNA, 25 bp, Mus musculus
tcaacagttggatgttagccctgaa

SEQ ID NO: 469345 - DNA, 25 bp, Mus musculus
tcaacatcaacttcctcaggccaag

SEQ ID NO: 469346 - DNA, 25 bp, Mus musculus
tcaacatcagtcagtcaggaacaca

SEQ ID NO: 469347 - DNA, 25 bp, Mus musculus
tcaacatccaaaacttccacatcag

SEQ ID NO: 469348 - DNA, 25 bp, Mus musculus
tcaacatccgatggagggacagtgt

SEQ ID NO: 469349 - DNA, 25 bp, Mus musculus
tcaacatcgcagagaaacatggcgg

SEQ ID NO: 469350 - DNA, 25 bp, Mus musculus
tcaacatctccacagccatctggga

SEQ ID NO: 469351 - DNA, 25 bp, Mus musculus
tcaacatctggagcgagctgcaagc

SEQ ID NO: 469352 - DNA, 25 bp, Mus musculus
tcaacatgaagatctacgcagtgct

SEQ ID NO: 469353 - DNA, 25 bp, Mus musculus
tcaacatgaccaaggagatccggga

SEQ ID NO: 469354 - DNA, 25 bp, Mus musculus
tcaacatggaggaagaactttgccc

SEQ ID NO: 469355 - DNA, 25 bp, Mus musculus
tcaacatggtcgaagttctacattc

SEQ ID NO: 469356 - DNA, 25 bp, Mus musculus
tcaacattaagaccaaggatccgtg

SEQ ID NO: 469357 - DNA, 25 bp, Mus musculus
tcaacattcctgcagtggcccttgg

SEQ ID NO: 469358 - DNA, 25 bp, Mus musculus
tcaacattcgcaaatccagtggaca

SEQ ID NO: 469359 - DNA, 25 bp, Mus musculus
tcaacattgagaagggccgcctggt

SEQ ID NO: 469360 - DNA, 25 bp, Mus musculus
tcaacatttgaagggcctgtggctc

SEQ ID NO: 469361 - DNA, 25 bp, Mus musculus
tcaaccaagggcctgggtccggtat

SEQ ID NO: 469362 - DNA, 25 bp, Mus musculus
tcaaccaatgagatggcagagcacc

SEQ ID NO: 469363 - DNA, 25 bp, Mus musculus
tcaaccacacagtgctgtgtgcaga

SEQ ID NO: 469364 - DNA, 25 bp, Mus musculus
tcaaccacgagttcgacctgctgga

SEQ ID NO: 469365 - DNA, 25 bp, Mus musculus
tcaaccagatgaagacagccgaggg

SEQ ID NO: 469366 - DNA, 25 bp, Mus musculus
tcaaccaggcttcggcgatgacaga

SEQ ID NO: 469367 - DNA, 25 bp, Mus musculus
tcaaccatccaaatcatgagtacct

SEQ ID NO: 469368 - DNA, 25 bp, Mus musculus
tcaacccaaggttgctacagcaaca

SEQ ID NO: 469369 - DNA, 25 bp, Mus musculus
tcaacccagggaaaggaggaacaga

SEQ ID NO: 469370 - DNA, 25 bp, Mus musculus
tcaacccctggatgagaatctggaa

SEQ ID NO: 469371 - DNA, 25 bp, Mus musculus
tcaacccggaagagtcaggcggtgt

SEQ ID NO: 469372 - DNA, 25 bp, Mus musculus
tcaaccctcggttcgacttccgaag

SEQ ID NO: 469373 - DNA, 25 bp, Mus musculus
tcaaccctctggtgggaagcaccct

SEQ ID NO: 469374 - DNA, 25 bp, Mus musculus
tcaaccctgctgtaatatctcaggg

SEQ ID NO: 469375 - DNA, 25 bp, Mus musculus
tcaaccctgtgtgggacgaggaacc

SEQ ID NO: 469376 - DNA, 25 bp, Mus musculus
tcaaccgcagcctagaagagctgag

SEQ ID NO: 469377 - DNA, 25 bp, Mus musculus
tcaaccgccatgcaaaggactagga

SEQ ID NO: 469378 - DNA, 25 bp, Mus musculus
tcaaccggagttactggaacccagc

SEQ ID NO: 469379 - DNA, 25 bp, Mus musculus
tcaacctacgagatgattggcggcc

SEQ ID NO: 469380 - DNA, 25 bp, Mus musculus
tcaacctatgatggagtgcccctcg

SEQ ID NO: 469381 - DNA, 25 bp, Mus musculus
tcaacctatgttctatgaagaactg

SEQ ID NO: 469382 - DNA, 25 bp, Mus musculus
tcaacctgacggaggaagaccgcat

SEQ ID NO: 469383 - DNA, 25 bp, Mus musculus
tcaacctgatatcaagagcagttct

SEQ ID NO: 469384 - DNA, 25 bp, Mus musculus
tcaacctgcaagatgggaatcccaa

SEQ ID NO: 469385 - DNA, 25 bp, Mus musculus
tcaacctgcggatggaaatgagccc

SEQ ID NO: 469386 - DNA, 25 bp, Mus musculus
tcaacctggaggatgtaacttacga

SEQ ID NO: 469387 - DNA, 25 bp, Mus musculus
tcaacctggatgaaaatgtgcgcac

SEQ ID NO: 469388 - DNA, 25 bp, Mus musculus
tcaacctggcttacttgtacggcgc

SEQ ID NO: 469389 - DNA, 25 bp, Mus musculus
tcaacctggtgcagtgcgagacgct

SEQ ID NO: 469390 - DNA, 25 bp, Mus musculus
tcaaccttccaattgatacgatgga

SEQ ID NO: 469391 - DNA, 25 bp, Mus musculus
tcaaccttcttaatgctgaaacctt

SEQ ID NO: 469392 - DNA, 25 bp, Mus musculus
tcaaccttcttgttatagatcagtc

SEQ ID NO: 469393 - DNA, 25 bp, Mus musculus
tcaacgaaacaataccgggacctgg

SEQ ID NO: 469394 - DNA, 25 bp, Mus musculus
tcaacgaaaccaaccataagctggg

SEQ ID NO: 469395 - DNA, 25 bp, Mus musculus
tcaacgaattcagcttcagcagcag

SEQ ID NO: 469396 - DNA, 25 bp, Mus musculus
tcaacgactgcgtgtgcgatgggct

SEQ ID NO: 469397 - DNA, 25 bp, Mus musculus
tcaacgactgtatcttgcgggtgaa

SEQ ID NO: 469398 - DNA, 25 bp, Mus musculus
tcaacgagcactggcagacggtcta

SEQ ID NO: 469399 - DNA, 25 bp, Mus musculus
tcaacgagttctccccagcctgtgt

SEQ ID NO: 469400 - DNA, 25 bp, Mus musculus
tcaacgatcggcagtttgtccacga

SEQ ID NO: 469401 - DNA, 25 bp, Mus musculus
tcaacgatgaaaaggtggcggtccc

SEQ ID NO: 469402 - DNA, 25 bp, Mus musculus
tcaacgcaactctggccgcagagaa

SEQ ID NO: 469403 - DNA, 25 bp, Mus musculus
tcaacgcactgaaggagctactctc

SEQ ID NO: 469404 - DNA, 25 bp, Mus musculus
tcaacgcagcagaggaaccataagt

SEQ ID NO: 469405 - DNA, 25 bp, Mus musculus
tcaacgcccagttgcacgagtgcag

SEQ ID NO: 469406 - DNA, 25 bp, Mus musculus
tcaacgccgcgctggacctgctggg

SEQ ID NO: 469407 - DNA, 25 bp, Mus musculus
tcaacgcgatttagctgatgagcca

SEQ ID NO: 469408 - DNA, 25 bp, Mus musculus
tcaacgcggagatcgagaaacagct

SEQ ID NO: 469409 - DNA, 25 bp, Mus musculus
tcaacgctccgtatctggtcatggg

SEQ ID NO: 469410 - DNA, 25 bp, Mus musculus
tcaacgctgaatcgtcaaaaagcca

SEQ ID NO: 469411 - DNA, 25 bp, Mus musculus
tcaacgctgatgattgggctaccaa

SEQ ID NO: 469412 - DNA, 25 bp, Mus musculus
tcaacgcttcgctggtcttcgacgc

SEQ ID NO: 469413 - DNA, 25 bp, Mus musculus
tcaacgcttttggagggagcagact

SEQ ID NO: 469414 - DNA, 25 bp, Mus musculus
tcaacggagtttccacgccgaaaag

SEQ ID NO: 469415 - DNA, 25 bp, Mus musculus
tcaacggatggtacgtcctggtcac

SEQ ID NO: 469416 - DNA, 25 bp, Mus musculus
tcaacggcacggtgatggtcagccc

SEQ ID NO: 469417 - DNA, 25 bp, Mus musculus
tcaacggcaggagaggtttgttccc

SEQ ID NO: 469418 - DNA, 25 bp, Mus musculus
tcaacggcctgcgaaggatcttgga

SEQ ID NO: 469419 - DNA, 25 bp, Mus musculus
tcaacggctgcggtttaagactgca

SEQ ID NO: 469420 - DNA, 25 bp, Mus musculus
tcaacgggaaggatttggacgccag

SEQ ID NO: 469421 - DNA, 25 bp, Mus musculus
tcaacgggcctgctaaatgcaaaga

SEQ ID NO: 469422 - DNA, 25 bp, Mus musculus
tcaacggtaacacaatggcctgctg

SEQ ID NO: 469423 - DNA, 25 bp, Mus musculus
tcaacggtcaacaaacagggaacag

SEQ ID NO: 469424 - DNA, 25 bp, Mus musculus
tcaacggttctcctggcaagcagct

SEQ ID NO: 469425 - DNA, 25 bp, Mus musculus
tcaacgtagatcagaagcttccagc

SEQ ID NO: 469426 - DNA, 25 bp, Mus musculus
tcaacgtcatggattggctgggccg

SEQ ID NO: 469427 - DNA, 25 bp, Mus musculus
tcaacgtccccaagaacatgcaagt

SEQ ID NO: 469428 - DNA, 25 bp, Mus musculus
tcaacgtgcctgtcattggcggcca

SEQ ID NO: 469429 - DNA, 25 bp, Mus musculus
tcaacgtgctgctgtcagggactcg

SEQ ID NO: 469430 - DNA, 25 bp, Mus musculus
tcaacgtggagacggtgacttacaa

SEQ ID NO: 469431 - DNA, 25 bp, Mus musculus
tcaacgtggccgaggttacgcagtc

SEQ ID NO: 469432 - DNA, 25 bp, Mus musculus
tcaacgtggcggtcaagatcatcga

SEQ ID NO: 469433 - DNA, 25 bp, Mus musculus
tcaacgtgggcttcctagaggcact

SEQ ID NO: 469434 - DNA, 25 bp, Mus musculus
tcaacgtgtgttccctaggcgtcgg

SEQ ID NO: 469435 - DNA, 25 bp, Mus musculus
tcaactacagttatgagagccccgt

SEQ ID NO: 469436 - DNA, 25 bp, Mus musculus
tcaactacattacgctgggctctgc

SEQ ID NO: 469437 - DNA, 25 bp, Mus musculus
tcaactaccgtgttggacccttggg

SEQ ID NO: 469438 - DNA, 25 bp, Mus musculus
tcaactacgccatgaaggaggctgc

SEQ ID NO: 469439 - DNA, 25 bp, Mus musculus
tcaactacggtgcagattcgaactg

SEQ ID NO: 469440 - DNA, 25 bp, Mus musculus
tcaactactagagagtagtacaaca

SEQ ID NO: 469441 - DNA, 25 bp, Mus musculus
tcaactaggcctgtgggcctacaca

SEQ ID NO: 469442 - DNA, 25 bp, Mus musculus
tcaactatagcgagggcactctacc

SEQ ID NO: 469443 - DNA, 25 bp, Mus musculus
tcaactatgtacaaacccgctgcct

SEQ ID NO: 469444 - DNA, 25 bp, Mus musculus
tcaactcaagagacttcggagactc

SEQ ID NO: 469445 - DNA, 25 bp, Mus musculus
tcaactcaatgaaaccagaaaaact

SEQ ID NO: 469446 - DNA, 25 bp, Mus musculus
tcaactcagttatcaattgggcagg

SEQ ID NO: 469447 - DNA, 25 bp, Mus musculus
tcaactccatagctcaaacattgtg

SEQ ID NO: 469448 - DNA, 25 bp, Mus musculus
tcaactccgacatagtgtgtgaaca

SEQ ID NO: 469449 - DNA, 25 bp, Mus musculus
tcaactccgggaaggctttctgcca

SEQ ID NO: 469450 - DNA, 25 bp, Mus musculus
tcaactcctttagacgtggccgcag

SEQ ID NO: 469451 - DNA, 25 bp, Mus musculus
tcaactcgggtctgattgggcctct

SEQ ID NO: 469452 - DNA, 25 bp, Mus musculus
tcaactctaaggtcatctccgtgac

SEQ ID NO: 469453 - DNA, 25 bp, Mus musculus
tcaactctcagaagggaaccaagca

SEQ ID NO: 469454 - DNA, 25 bp, Mus musculus
tcaactctgaactctggacaacggg

SEQ ID NO: 469455 - DNA, 25 bp, Mus musculus
tcaactcttgggagaacagaagctg

SEQ ID NO: 469456 - DNA, 25 bp, Mus musculus
tcaactgaatgtcctgcacaagccg

SEQ ID NO: 469457 - DNA, 25 bp, Mus musculus
tcaactgacacagcagtctgacagt

SEQ ID NO: 469458 - DNA, 25 bp, Mus musculus
tcaactgcggaaagtgctcggtctc

SEQ ID NO: 469459 - DNA, 25 bp, Mus musculus
tcaactgctggacagaaaggcgctg

SEQ ID NO: 469460 - DNA, 25 bp, Mus musculus
tcaactggaagatgaaatcgcggct

SEQ ID NO: 469461 - DNA, 25 bp, Mus musculus
tcaactgggatcttctcggagagct

SEQ ID NO: 469462 - DNA, 25 bp, Mus musculus
tcaactgtagttccgtagaatcaca

SEQ ID NO: 469463 - DNA, 25 bp, Mus musculus
tcaacttaacttagtgtttccttgc

SEQ ID NO: 469464 - DNA, 25 bp, Mus musculus
tcaacttcaaaatgtttctcggaga

SEQ ID NO: 469465 - DNA, 25 bp, Mus musculus
tcaacttctatagcgctttgccggg

SEQ ID NO: 469466 - DNA, 25 bp, Mus musculus
tcaacttctgtcatgagaaataagc

SEQ ID NO: 469467 - DNA, 25 bp, Mus musculus
tcaacttgagctttccgaggagact

SEQ ID NO: 469468 - DNA, 25 bp, Mus musculus
tcaacttggaaaaatgccagacgag

SEQ ID NO: 469469 - DNA, 25 bp, Mus musculus
tcaacttgttcaggccggttctcca

SEQ ID NO: 469470 - DNA, 25 bp, Mus musculus
tcaactttcaccaataaggaggccc

SEQ ID NO: 469471 - DNA, 25 bp, Mus musculus
tcaactttgctgtagctagccgtaa

SEQ ID NO: 469472 - DNA, 25 bp, Mus musculus
tcaacttttctgacagtctgtctga

SEQ ID NO: 469473 - DNA, 25 bp, Mus musculus
tcaagaaaacggaggacaggaagca

SEQ ID NO: 469474 - DNA, 25 bp, Mus musculus
tcaagaaaagagcaccagaggatcc

SEQ ID NO: 469475 - DNA, 25 bp, Mus musculus
tcaagaaaaggtactagcagcgcac

SEQ ID NO: 469476 - DNA, 25 bp, Mus musculus
tcaagaaacagtgtaatcaacagcc

SEQ ID NO: 469477 - DNA, 25 bp, Mus musculus
tcaagaaacccgtctctagtgctgg

SEQ ID NO: 469478 - DNA, 25 bp, Mus musculus
tcaagaaagcttcgagcaagggtcc

SEQ ID NO: 469479 - DNA, 25 bp, Mus musculus
tcaagaaagtagctgaggccaaggc

SEQ ID NO: 469480 - DNA, 25 bp, Mus musculus
tcaagaaatccagcgtaagaataac

SEQ ID NO: 469481 - DNA, 25 bp, Mus musculus
tcaagaaatcgtaggaaaaggtcgg

SEQ ID NO: 469482 - DNA, 25 bp, Mus musculus
tcaagaacacgaaaggcaacacatt

SEQ ID NO: 469483 - DNA, 25 bp, Mus musculus
tcaagaacatggaccaagtggcccc

SEQ ID NO: 469484 - DNA, 25 bp, Mus musculus
tcaagaacatgtgggcagccttccc

SEQ ID NO: 469485 - DNA, 25 bp, Mus musculus
tcaagaaccctgactggcgataccg

SEQ ID NO: 469486 - DNA, 25 bp, Mus musculus
tcaagaaccgagatggcgagacgct

SEQ ID NO: 469487 - DNA, 25 bp, Mus musculus
tcaagaacgaggaattggaagccat

SEQ ID NO: 469488 - DNA, 25 bp, Mus musculus
tcaagaacgggagcatgggcacatt

SEQ ID NO: 469489 - DNA, 25 bp, Mus musculus
tcaagaacggtatcatagcttagca

SEQ ID NO: 469490 - DNA, 25 bp, Mus musculus
tcaagaacgtgtcccgtgctggcgt

SEQ ID NO: 469491 - DNA, 25 bp, Mus musculus
tcaagaagaagcgtatgtcaccatg

SEQ ID NO: 469492 - DNA, 25 bp, Mus musculus
tcaagaagacaactgcagaccgagc

SEQ ID NO: 469493 - DNA, 25 bp, Mus musculus
tcaagaagaccgacgtgaaagagga

SEQ ID NO: 469494 - DNA, 25 bp, Mus musculus
tcaagaagagtacctgcgagtcctt

SEQ ID NO: 469495 - DNA, 25 bp, Mus musculus
tcaagaagattttagagccaggaaa

SEQ ID NO: 469496 - DNA, 25 bp, Mus musculus
tcaagaagcacggtgtgtacaaccc

SEQ ID NO: 469497 - DNA, 25 bp, Mus musculus
tcaagaagcagctgtcggagcagga

SEQ ID NO: 469498 - DNA, 25 bp, Mus musculus
tcaagaagcatacaatgctgcccgc

SEQ ID NO: 469499 - DNA, 25 bp, Mus musculus
tcaagaagcctgagctggagcgtcc

SEQ ID NO: 469500 - DNA, 25 bp, Mus musculus
tcaagaaggaggagttacttttagt

SEQ ID NO: 469501 - DNA, 25 bp, Mus musculus
tcaagaaggatatcaaggctctggt

SEQ ID NO: 469502 - DNA, 25 bp, Mus musculus
tcaagaaggcagtttcaccatggcc

SEQ ID NO: 469503 - DNA, 25 bp, Mus musculus
tcaagaaggtctctcgggacaagtc

SEQ ID NO: 469504 - DNA, 25 bp, Mus musculus
tcaagaatcgagagtcggcctgcca

SEQ ID NO: 469505 - DNA, 25 bp, Mus musculus
tcaagaatgccgaccctgaggaact

SEQ ID NO: 469506 - DNA, 25 bp, Mus musculus
tcaagaatggctgtgcactgagaca

SEQ ID NO: 469507 - DNA, 25 bp, Mus musculus
tcaagaatgtgctgggacagcctcc

SEQ ID NO: 469508 - DNA, 25 bp, Mus musculus
tcaagacaaagtggtgctcgcaggc

SEQ ID NO: 469509 - DNA, 25 bp, Mus musculus
tcaagacaacgtcccagaaggtggc

SEQ ID NO: 469510 - DNA, 25 bp, Mus musculus
tcaagacaatgataatcctcttgcc

SEQ ID NO: 469511 - DNA, 25 bp, Mus musculus
tcaagacaattgcagatgagtcatc

SEQ ID NO: 469512 - DNA, 25 bp, Mus musculus
tcaagacactgaaagcgggctacac

SEQ ID NO: 469513 - DNA, 25 bp, Mus musculus
tcaagacactgttgggagcacagcc

SEQ ID NO: 469514 - DNA, 25 bp, Mus musculus
tcaagacagagcgtagggaaggaac

SEQ ID NO: 469515 - DNA, 25 bp, Mus musculus
tcaagacagatcataagcgaggacc

SEQ ID NO: 469516 - DNA, 25 bp, Mus musculus
tcaagacagttcctagacatgtggg

SEQ ID NO: 469517 - DNA, 25 bp, Mus musculus
tcaagacatccaccagtctgaagga

SEQ ID NO: 469518 - DNA, 25 bp, Mus musculus
tcaagacatgaagaacaaaggactg

SEQ ID NO: 469519 - DNA, 25 bp, Mus musculus
tcaagaccagagtgagtgcacaagc

SEQ ID NO: 469520 - DNA, 25 bp, Mus musculus
tcaagaccagctatttcctgtctgt

SEQ ID NO: 469521 - DNA, 25 bp, Mus musculus
tcaagaccagcttcctccgccaagt

SEQ ID NO: 469522 - DNA, 25 bp, Mus musculus
tcaagaccaggttgggcaaagagat

SEQ ID NO: 469523 - DNA, 25 bp, Mus musculus
tcaagaccatatttacccgagctgt

SEQ ID NO: 469524 - DNA, 25 bp, Mus musculus
tcaagaccatcggtaccaccgtggg

SEQ ID NO: 469525 - DNA, 25 bp, Mus musculus
tcaagaccatttggaagcgggagag

SEQ ID NO: 469526 - DNA, 25 bp, Mus musculus
tcaagacccacgagaagcgggagat

SEQ ID NO: 469527 - DNA, 25 bp, Mus musculus
tcaagaccccaaagcctatgaagaa

SEQ ID NO: 469528 - DNA, 25 bp, Mus musculus
tcaagacccgactggagaacgagat

SEQ ID NO: 469529 - DNA, 25 bp, Mus musculus
tcaagacctatatcatctgggaggg

SEQ ID NO: 469530 - DNA, 25 bp, Mus musculus
tcaagacgacttgtgacgccagggt

SEQ ID NO: 469531 - DNA, 25 bp, Mus musculus
tcaagacgatgaacttcccggcggt

SEQ ID NO: 469532 - DNA, 25 bp, Mus musculus
tcaagacgctgacggaaatcaacat

SEQ ID NO: 469533 - DNA, 25 bp, Mus musculus
tcaagacggagaacggtacgtgtcc

SEQ ID NO: 469534 - DNA, 25 bp, Mus musculus
tcaagacggtgataacttcaagacg

SEQ ID NO: 469535 - DNA, 25 bp, Mus musculus
tcaagacgtctttgccggtgcagcg

SEQ ID NO: 469536 - DNA, 25 bp, Mus musculus
tcaagactcctcctcgtgggctgtg

SEQ ID NO: 469537 - DNA, 25 bp, Mus musculus
tcaagactgaagcagaagttctggc

SEQ ID NO: 469538 - DNA, 25 bp, Mus musculus
tcaagactgcaacggagacatgtgc

SEQ ID NO: 469539 - DNA, 25 bp, Mus musculus
tcaagactgtcatgggcattgcttc

SEQ ID NO: 469540 - DNA, 25 bp, Mus musculus
tcaagagaacaagtagctttcgcgt

SEQ ID NO: 469541 - DNA, 25 bp, Mus musculus
tcaagagaagaagccctgggaccat

SEQ ID NO: 469542 - DNA, 25 bp, Mus musculus
tcaagagaccaaacagcgtaggcag

SEQ ID NO: 469543 - DNA, 25 bp, Mus musculus
tcaagagacgcgagagtcagaccgc

SEQ ID NO: 469544 - DNA, 25 bp, Mus musculus
tcaagagagagtttgaggctcagga

SEQ ID NO: 469545 - DNA, 25 bp, Mus musculus
tcaagagagcttttataacaccacc

SEQ ID NO: 469546 - DNA, 25 bp, Mus musculus
tcaagagagtctccaggaggcaact

SEQ ID NO: 469547 - DNA, 25 bp, Mus musculus
tcaagagagtgattaccagccggtg

SEQ ID NO: 469548 - DNA, 25 bp, Mus musculus
tcaagagattgaacatcccgtggct

SEQ ID NO: 469549 - DNA, 25 bp, Mus musculus
tcaagagcaagacattgtgccagct

SEQ ID NO: 469550 - DNA, 25 bp, Mus musculus
tcaagagcaaggagggactgaagct

SEQ ID NO: 469551 - DNA, 25 bp, Mus musculus
tcaagagcacaaggtgggcagtccc

SEQ ID NO: 469552 - DNA, 25 bp, Mus musculus
tcaagagcagtagtcgccaggaagc

SEQ ID NO: 469553 - DNA, 25 bp, Mus musculus
tcaagagccctagagaacctgccat

SEQ ID NO: 469554 - DNA, 25 bp, Mus musculus
tcaagagcctattctgtgggtgcag

SEQ ID NO: 469555 - DNA, 25 bp, Mus musculus
tcaagagcctgggatgtgtccacac

SEQ ID NO: 469556 - DNA, 25 bp, Mus musculus
tcaagagcgagctgagttccggagc

SEQ ID NO: 469557 - DNA, 25 bp, Mus musculus
tcaagagctttggtgcctggtcagg

SEQ ID NO: 469558 - DNA, 25 bp, Mus musculus
tcaagaggacggtctttttgtttgt

SEQ ID NO: 469559 - DNA, 25 bp, Mus musculus
tcaagaggagtccacctcacctcat

SEQ ID NO: 469560 - DNA, 25 bp, Mus musculus
tcaagaggatcctgcggcttcagtg

SEQ ID NO: 469561 - DNA, 25 bp, Mus musculus
tcaagaggatgtttcctggacagat

SEQ ID NO: 469562 - DNA, 25 bp, Mus musculus
tcaagaggcaacaggagagagagct

SEQ ID NO: 469563 - DNA, 25 bp, Mus musculus
tcaagaggcaggaattgaagctgcc

SEQ ID NO: 469564 - DNA, 25 bp, Mus musculus
tcaagaggccgggaagttaaacttg

SEQ ID NO: 469565 - DNA, 25 bp, Mus musculus
tcaagaggcctcatggagggaatcc

SEQ ID NO: 469566 - DNA, 25 bp, Mus musculus
tcaagaggcggttactaaaaactgc

SEQ ID NO: 469567 - DNA, 25 bp, Mus musculus
tcaagagggaaagctatgccggcgt

SEQ ID NO: 469568 - DNA, 25 bp, Mus musculus
tcaagagggaccagctagaaggttc

SEQ ID NO: 469569 - DNA, 25 bp, Mus musculus
tcaagagtcagatacaagaaaccat

SEQ ID NO: 469570 - DNA, 25 bp, Mus musculus
tcaagagtccaagaaacgagatgct

SEQ ID NO: 469571 - DNA, 25 bp, Mus musculus
tcaagagtcgtcctgagctgaccgc

SEQ ID NO: 469572 - DNA, 25 bp, Mus musculus
tcaagagtgaccaggtgggacgcct

SEQ ID NO: 469573 - DNA, 25 bp, Mus musculus
tcaagagtgactggtgcaagacgca

SEQ ID NO: 469574 - DNA, 25 bp, Mus musculus
tcaagagttgtgagcgcagggcttc

SEQ ID NO: 469575 - DNA, 25 bp, Mus musculus
tcaagagtttcctacagtcacaggc

SEQ ID NO: 469576 - DNA, 25 bp, Mus musculus
tcaagatacacgtggagacaaccgt

SEQ ID NO: 469577 - DNA, 25 bp, Mus musculus
tcaagatacgctaggaagaggacca

SEQ ID NO: 469578 - DNA, 25 bp, Mus musculus
tcaagatactgccttttgaagaaga

SEQ ID NO: 469579 - DNA, 25 bp, Mus musculus
tcaagatcctgacaaagactctggg

SEQ ID NO: 469580 - DNA, 25 bp, Mus musculus
tcaagatcgacatcgacccggagga

SEQ ID NO: 469581 - DNA, 25 bp, Mus musculus
tcaagatctaagaagcccaaagggt

SEQ ID NO: 469582 - DNA, 25 bp, Mus musculus
tcaagatctttgtctccgtgagaag

SEQ ID NO: 469583 - DNA, 25 bp, Mus musculus
tcaagatgaaggaagagaccctcct

SEQ ID NO: 469584 - DNA, 25 bp, Mus musculus
tcaagatgcacagccagtctgggag

SEQ ID NO: 469585 - DNA, 25 bp, Mus musculus
tcaagatgcctgtcatgtaccggat

SEQ ID NO: 469586 - DNA, 25 bp, Mus musculus
tcaagatggatgaagcggtacctca

SEQ ID NO: 469587 - DNA, 25 bp, Mus musculus
tcaagatgggtccaagccctgagaa

SEQ ID NO: 469588 - DNA, 25 bp, Mus musculus
tcaagatggtcaaagatgtcctgca

SEQ ID NO: 469589 - DNA, 25 bp, Mus musculus
tcaagatgtaggcaccctggtcact

SEQ ID NO: 469590 - DNA, 25 bp, Mus musculus
tcaagatgttgcttccgacagtggg

SEQ ID NO: 469591 - DNA, 25 bp, Mus musculus
tcaagattaccagatactccgtcct

SEQ ID NO: 469592 - DNA, 25 bp, Mus musculus
tcaagattccctggcaagattttcc

SEQ ID NO: 469593 - DNA, 25 bp, Mus musculus
tcaagatttaccaacagcactgtgg

SEQ ID NO: 469594 - DNA, 25 bp, Mus musculus
tcaagcaacacagccagtgctcagt

SEQ ID NO: 469595 - DNA, 25 bp, Mus musculus
tcaagcagagaacgtacttcagtca

SEQ ID NO: 469596 - DNA, 25 bp, Mus musculus
tcaagcagatgactgggcagcgacc

SEQ ID NO: 469597 - DNA, 25 bp, Mus musculus
tcaagcagatggaaagtgggacccc

SEQ ID NO: 469598 - DNA, 25 bp, Mus musculus
tcaagcagcaatctagggagagtgt

SEQ ID NO: 469599 - DNA, 25 bp, Mus musculus
tcaagcagctactgactgcaagagg

SEQ ID NO: 469600 - DNA, 25 bp, Mus musculus
tcaagcagctgcaccagaggttcag

SEQ ID NO: 469601 - DNA, 25 bp, Mus musculus
tcaagcagggctttcgcaggatcct

SEQ ID NO: 469602 - DNA, 25 bp, Mus musculus
tcaagcagttgtccgtggtccacac

SEQ ID NO: 469603 - DNA, 25 bp, Mus musculus
tcaagcagtttacccatacgcgggc

SEQ ID NO: 469604 - DNA, 25 bp, Mus musculus
tcaagcatacccacaaatagagtcc

SEQ ID NO: 469605 - DNA, 25 bp, Mus musculus
tcaagcatccaggtacaaatgttct

SEQ ID NO: 469606 - DNA, 25 bp, Mus musculus
tcaagcatcggccatgggaacttct

SEQ ID NO: 469607 - DNA, 25 bp, Mus musculus
tcaagccaagtggaatggagccggc

SEQ ID NO: 469608 - DNA, 25 bp, Mus musculus
tcaagccagaggttctcagaccaga

SEQ ID NO: 469609 - DNA, 25 bp, Mus musculus
tcaagccaggcaacatcatgcgcgt

SEQ ID NO: 469610 - DNA, 25 bp, Mus musculus
tcaagccccagactcgggaagagat

SEQ ID NO: 469611 - DNA, 25 bp, Mus musculus
tcaagcccctgggattggagactcc

SEQ ID NO: 469612 - DNA, 25 bp, Mus musculus
tcaagcccgggacttcatcaatcag

SEQ ID NO: 469613 - DNA, 25 bp, Mus musculus
tcaagccgaatctggtcaagggacc

SEQ ID NO: 469614 - DNA, 25 bp, Mus musculus
tcaagccgcacaaggccggcgtgca

SEQ ID NO: 469615 - DNA, 25 bp, Mus musculus
tcaagcctaacaccgaggctggagt

SEQ ID NO: 469616 - DNA, 25 bp, Mus musculus
tcaagcctagctcctgtgtccagct

SEQ ID NO: 469617 - DNA, 25 bp, Mus musculus
tcaagcctatctctgactcagtcgg

SEQ ID NO: 469618 - DNA, 25 bp, Mus musculus
tcaagcctcgtgtaaagcagaacca

SEQ ID NO: 469619 - DNA, 25 bp, Mus musculus
tcaagcctgaaagattaccaccagt

SEQ ID NO: 469620 - DNA, 25 bp, Mus musculus
tcaagcctgaggaaattagcgggcc

SEQ ID NO: 469621 - DNA, 25 bp, Mus musculus
tcaagcctgaggatgtgaaactcct

SEQ ID NO: 469622 - DNA, 25 bp, Mus musculus
tcaagcctgaggtggaagaagtccc

SEQ ID NO: 469623 - DNA, 25 bp, Mus musculus
tcaagcctgttccatgggagagctc

SEQ ID NO: 469624 - DNA, 25 bp, Mus musculus
tcaagccttacaatctacctggtgg

SEQ ID NO: 469625 - DNA, 25 bp, Mus musculus
tcaagccttactcgaaaggaggtcc

SEQ ID NO: 469626 - DNA, 25 bp, Mus musculus
tcaagcgaccatcactgcctgaaga

SEQ ID NO: 469627 - DNA, 25 bp, Mus musculus
tcaagcgcctgaatcctcgatggaa

SEQ ID NO: 469628 - DNA, 25 bp, Mus musculus
tcaagcgcgagttgagcgagaacac

SEQ ID NO: 469629 - DNA, 25 bp, Mus musculus
tcaagcggacggacatcctgaagca

SEQ ID NO: 469630 - DNA, 25 bp, Mus musculus
tcaagcgggtcagcgtgctcaactt

SEQ ID NO: 469631 - DNA, 25 bp, Mus musculus
tcaagcgttcccctgtcaaaagcct

SEQ ID NO: 469632 - DNA, 25 bp, Mus musculus
tcaagctacagatagtaagtggtct

SEQ ID NO: 469633 - DNA, 25 bp, Mus musculus
tcaagctactggagggcactggctc

SEQ ID NO: 469634 - DNA, 25 bp, Mus musculus
tcaagctagtccagagagttccagt

SEQ ID NO: 469635 - DNA, 25 bp, Mus musculus
tcaagctcacaattactcggcacga

SEQ ID NO: 469636 - DNA, 25 bp, Mus musculus
tcaagctcagtaagaaggcggcttc

SEQ ID NO: 469637 - DNA, 25 bp, Mus musculus
tcaagctcatgcaggtatggtacag

SEQ ID NO: 469638 - DNA, 25 bp, Mus musculus
tcaagctcccttcggagtcagcgtc

SEQ ID NO: 469639 - DNA, 25 bp, Mus musculus
tcaagctcgagtgcagccagagagc

SEQ ID NO: 469640 - DNA, 25 bp, Mus musculus
tcaagctctacagcggaagcacagc

SEQ ID NO: 469641 - DNA, 25 bp, Mus musculus
tcaagctctggctcctgaacaacag

SEQ ID NO: 469642 - DNA, 25 bp, Mus musculus
tcaagctcttgtggagtcgggactc

SEQ ID NO: 469643 - DNA, 25 bp, Mus musculus
tcaagctgaagaggaacatggtttc

SEQ ID NO: 469644 - DNA, 25 bp, Mus musculus
tcaagctgatgtgcaccggcagatc

SEQ ID NO: 469645 - DNA, 25 bp, Mus musculus
tcaagctgcacacatataaacaaag

SEQ ID NO: 469646 - DNA, 25 bp, Mus musculus
tcaagctgcgttctggacaaccaat

SEQ ID NO: 469647 - DNA, 25 bp, Mus musculus
tcaagctgctccctaacagtattag

SEQ ID NO: 469648 - DNA, 25 bp, Mus musculus
tcaagctgggcgtcaagtgcatgag

SEQ ID NO: 469649 - DNA, 25 bp, Mus musculus
tcaagctgtgaagcaccggaaggca

SEQ ID NO: 469650 - DNA, 25 bp, Mus musculus
tcaagctgtgcatcatagagcccgg

SEQ ID NO: 469651 - DNA, 25 bp, Mus musculus
tcaagcttggcatgtggtgttctcc

SEQ ID NO: 469652 - DNA, 25 bp, Mus musculus
tcaagctttcagactccgagatcag

SEQ ID NO: 469653 - DNA, 25 bp, Mus musculus
tcaaggaaagctagcgtcagcaacg

SEQ ID NO: 469654 - DNA, 25 bp, Mus musculus
tcaaggaacccaagactcagtgact

SEQ ID NO: 469655 - DNA, 25 bp, Mus musculus
tcaaggaagaaactaccttcacaag

SEQ ID NO: 469656 - DNA, 25 bp, Mus musculus
tcaaggaagaccagaataagcagct

SEQ ID NO: 469657 - DNA, 25 bp, Mus musculus
tcaaggaattcctgggcgagcagcg

SEQ ID NO: 469658 - DNA, 25 bp, Mus musculus
tcaaggacaaatacaacgaggccgt

SEQ ID NO: 469659 - DNA, 25 bp, Mus musculus
tcaaggacatcacccatttgcaggg

SEQ ID NO: 469660 - DNA, 25 bp, Mus musculus
tcaaggaccgcttggagagcctcga

SEQ ID NO: 469661 - DNA, 25 bp, Mus musculus
tcaaggacgggaagtcgctcatcag

SEQ ID NO: 469662 - DNA, 25 bp, Mus musculus
tcaaggactagtactgacttatagg

SEQ ID NO: 469663 - DNA, 25 bp, Mus musculus
tcaaggactgactgggaatgttcaa

SEQ ID NO: 469664 - DNA, 25 bp, Mus musculus
tcaaggagaagtacaacgcagcggt

SEQ ID NO: 469665 - DNA, 25 bp, Mus musculus
tcaaggagagaggatccaaccacat

SEQ ID NO: 469666 - DNA, 25 bp, Mus musculus
tcaaggagattatagggaagctccc

SEQ ID NO: 469667 - DNA, 25 bp, Mus musculus
tcaaggagcacatgtaggagctgtc

SEQ ID NO: 469668 - DNA, 25 bp, Mus musculus
tcaaggagccacagaattatcaaga

SEQ ID NO: 469669 - DNA, 25 bp, Mus musculus
tcaaggagccacttaacgatgtgct

SEQ ID NO: 469670 - DNA, 25 bp, Mus musculus
tcaaggagctgtacggcaagatcgc

SEQ ID NO: 469671 - DNA, 25 bp, Mus musculus
tcaaggagctgtttggtcacctgag

SEQ ID NO: 469672 - DNA, 25 bp, Mus musculus
tcaaggaggacagtcgcgtacacat

SEQ ID NO: 469673 - DNA, 25 bp, Mus musculus
tcaaggaggagtatggtatatcgcg

SEQ ID NO: 469674 - DNA, 25 bp, Mus musculus
tcaaggagtcccatgtcagcaaagc

SEQ ID NO: 469675 - DNA, 25 bp, Mus musculus
tcaaggagtttgtccagagcgtccc

SEQ ID NO: 469676 - DNA, 25 bp, Mus musculus
tcaaggatgtggtcgtgaacttcac

SEQ ID NO: 469677 - DNA, 25 bp, Mus musculus
tcaaggattgctcagtattctactt

SEQ ID NO: 469678 - DNA, 25 bp, Mus musculus
tcaaggcaaacaagtgaggcaggag

SEQ ID NO: 469679 - DNA, 25 bp, Mus musculus
tcaaggcaacacaagaatcaaagta

SEQ ID NO: 469680 - DNA, 25 bp, Mus musculus
tcaaggcaacagctttagtgtctcc

SEQ ID NO: 469681 - DNA, 25 bp, Mus musculus
tcaaggcaacgagagcgagactttc

SEQ ID NO: 469682 - DNA, 25 bp, Mus musculus
tcaaggcaatagaggctgtcgttgg

SEQ ID NO: 469683 - DNA, 25 bp, Mus musculus
tcaaggcacaaacagcttgtcaggg

SEQ ID NO: 469684 - DNA, 25 bp, Mus musculus
tcaaggcacggtcctctaggttctc

SEQ ID NO: 469685 - DNA, 25 bp, Mus musculus
tcaaggcagagatcaataccagggc

SEQ ID NO: 469686 - DNA, 25 bp, Mus musculus
tcaaggcagatcagagcgagagttc

SEQ ID NO: 469687 - DNA, 25 bp, Mus musculus
tcaaggccaatgctagagaacggac

SEQ ID NO: 469688 - DNA, 25 bp, Mus musculus
tcaaggccaccactgcacgatgtgg

SEQ ID NO: 469689 - DNA, 25 bp, Mus musculus
tcaaggccattgtgcagatgagaaa

SEQ ID NO: 469690 - DNA, 25 bp, Mus musculus
tcaaggccgaagtcccagccttggc

SEQ ID NO: 469691 - DNA, 25 bp, Mus musculus
tcaaggccgcaatcgtagaggagca

SEQ ID NO: 469692 - DNA, 25 bp, Mus musculus
tcaaggccgcgtacttacaggagaa

SEQ ID NO: 469693 - DNA, 25 bp, Mus musculus
tcaaggccggccgtgataagtacaa

SEQ ID NO: 469694 - DNA, 25 bp, Mus musculus
tcaaggccgtgtccaagttcagtct

SEQ ID NO: 469695 - DNA, 25 bp, Mus musculus
tcaaggcgctgcaagagacaaaggc

SEQ ID NO: 469696 - DNA, 25 bp, Mus musculus
tcaaggcgtccactgaaaggctcct

SEQ ID NO: 469697 - DNA, 25 bp, Mus musculus
tcaaggctaataagaatcaccgtgg

SEQ ID NO: 469698 - DNA, 25 bp, Mus musculus
tcaaggctatcactgctggcagcaa

SEQ ID NO: 469699 - DNA, 25 bp, Mus musculus
tcaaggctccggatacagagggcag

SEQ ID NO: 469700 - DNA, 25 bp, Mus musculus
tcaaggctctgaactctgagtatag

SEQ ID NO: 469701 - DNA, 25 bp, Mus musculus
tcaaggctgaccatcttcgagcagg

SEQ ID NO: 469702 - DNA, 25 bp, Mus musculus
tcaaggcttggtttctcgtcagaca

SEQ ID NO: 469703 - DNA, 25 bp, Mus musculus
tcaagggacacaattcactccaagt

SEQ ID NO: 469704 - DNA, 25 bp, Mus musculus
tcaagggacagaatttagggctagt

SEQ ID NO: 469705 - DNA, 25 bp, Mus musculus
tcaagggaccattctctgtggaagc

SEQ ID NO: 469706 - DNA, 25 bp, Mus musculus
tcaagggagaggacggacatcccat

SEQ ID NO: 469707 - DNA, 25 bp, Mus musculus
tcaagggatctcttcgcaggacggg

SEQ ID NO: 469708 - DNA, 25 bp, Mus musculus
tcaagggcaactgttgcaaagccgc

SEQ ID NO: 469709 - DNA, 25 bp, Mus musculus
tcaagggcacaaaaggtgacaagcc

SEQ ID NO: 469710 - DNA, 25 bp, Mus musculus
tcaagggcagaaaggaattttaggg

SEQ ID NO: 469711 - DNA, 25 bp, Mus musculus
tcaagggcatggaagtagtgaccac

SEQ ID NO: 469712 - DNA, 25 bp, Mus musculus
tcaagggcatggtcaaaagtgagtc

SEQ ID NO: 469713 - DNA, 25 bp, Mus musculus
tcaagggcattgactggcagcatgt

SEQ ID NO: 469714 - DNA, 25 bp, Mus musculus
tcaagggccaccttgggatgagatg

SEQ ID NO: 469715 - DNA, 25 bp, Mus musculus
tcaagggccagcaagatgatccagc

SEQ ID NO: 469716 - DNA, 25 bp, Mus musculus
tcaagggccccaagagagactgtaa

SEQ ID NO: 469717 - DNA, 25 bp, Mus musculus
tcaagggcgtcctgcataaagcacc

SEQ ID NO: 469718 - DNA, 25 bp, Mus musculus
tcaagggctgcgttgtgtgaaatct

SEQ ID NO: 469719 - DNA, 25 bp, Mus musculus
tcaagggctggctctgctgtcaagc

SEQ ID NO: 469720 - DNA, 25 bp, Mus musculus
tcaagggcttcttccagagtgccaa

SEQ ID NO: 469721 - DNA, 25 bp, Mus musculus
tcaagggtactactggccacaagca

SEQ ID NO: 469722 - DNA, 25 bp, Mus musculus
tcaagggtcaactactcacactgcg

SEQ ID NO: 469723 - DNA, 25 bp, Mus musculus
tcaagggtccaagctaaaaggcaac

SEQ ID NO: 469724 - DNA, 25 bp, Mus musculus
tcaagggtcccgcaggcctctagca

SEQ ID NO: 469725 - DNA, 25 bp, Mus musculus
tcaagggttttggaagacaccagcc

SEQ ID NO: 469726 - DNA, 25 bp, Mus musculus
tcaaggtaagaaggtggcctgagtc

SEQ ID NO: 469727 - DNA, 25 bp, Mus musculus
tcaaggtagtattcggccagccaga

SEQ ID NO: 469728 - DNA, 25 bp, Mus musculus
tcaaggtcaacggagagctcaggca

SEQ ID NO: 469729 - DNA, 25 bp, Mus musculus
tcaaggtcaattcggaggtccagct

SEQ ID NO: 469730 - DNA, 25 bp, Mus musculus
tcaaggtcacaaagcactgagtgcc

SEQ ID NO: 469731 - DNA, 25 bp, Mus musculus
tcaaggtcacactaagccatcatgg

SEQ ID NO: 469732 - DNA, 25 bp, Mus musculus
tcaaggtcacttaggcaaggaaaag

SEQ ID NO: 469733 - DNA, 25 bp, Mus musculus
tcaaggtcagtcttaacggcagtgt

SEQ ID NO: 469734 - DNA, 25 bp, Mus musculus
tcaaggtcagtggtcagaagtagga

SEQ ID NO: 469735 - DNA, 25 bp, Mus musculus
tcaaggtcattgtctaacgcacaag

SEQ ID NO: 469736 - DNA, 25 bp, Mus musculus
tcaaggtccaggtcgcgatcgagaa

SEQ ID NO: 469737 - DNA, 25 bp, Mus musculus
tcaaggtgaacgcatccgctagtag

SEQ ID NO: 469738 - DNA, 25 bp, Mus musculus
tcaaggtgccagcactgagccatgg

SEQ ID NO: 469739 - DNA, 25 bp, Mus musculus
tcaaggtggactgcgtggagcacac

SEQ ID NO: 469740 - DNA, 25 bp, Mus musculus
tcaaggtggccgagtaaaacccaag

SEQ ID NO: 469741 - DNA, 25 bp, Mus musculus
tcaaggtgggccctcagtatccagt

SEQ ID NO: 469742 - DNA, 25 bp, Mus musculus
tcaaggtggtggtgacatctttgcc

SEQ ID NO: 469743 - DNA, 25 bp, Mus musculus
tcaaggtgtccatcttgactggtgc

SEQ ID NO: 469744 - DNA, 25 bp, Mus musculus
tcaaggtgttgtcagaagtttaact

SEQ ID NO: 469745 - DNA, 25 bp, Mus musculus
tcaaggttaagctgagtctctccag

SEQ ID NO: 469746 - DNA, 25 bp, Mus musculus
tcaaggttacccagcacgtcatagg

SEQ ID NO: 469747 - DNA, 25 bp, Mus musculus
tcaaggttcccaaggtgtcgaaggt

SEQ ID NO: 469748 - DNA, 25 bp, Mus musculus
tcaaggttctatagtgcccagcgcg

SEQ ID NO: 469749 - DNA, 25 bp, Mus musculus
tcaaggttgtaggagtggcagcccc

SEQ ID NO: 469750 - DNA, 25 bp, Mus musculus
tcaaggtttaatatgctagaaatgt

SEQ ID NO: 469751 - DNA, 25 bp, Mus musculus
tcaagtacctaacaatggaagctgg

SEQ ID NO: 469752 - DNA, 25 bp, Mus musculus
tcaagtacctgcagatggtgggcat

SEQ ID NO: 469753 - DNA, 25 bp, Mus musculus
tcaagtacgaccgacgggagctgca

SEQ ID NO: 469754 - DNA, 25 bp, Mus musculus
tcaagtacgtccgacctggtggcgg

SEQ ID NO: 469755 - DNA, 25 bp, Mus musculus
tcaagtactaccgacgactgcggct

SEQ ID NO: 469756 - DNA, 25 bp, Mus musculus
tcaagtagacagttggacagacccg

SEQ ID NO: 469757 - DNA, 25 bp, Mus musculus
tcaagtagttaactcagagggcggc

SEQ ID NO: 469758 - DNA, 25 bp, Mus musculus
tcaagtcaacgagaccagcgtcgtg

SEQ ID NO: 469759 - DNA, 25 bp, Mus musculus
tcaagtcacacgaagcggagctgga

SEQ ID NO: 469760 - DNA, 25 bp, Mus musculus
tcaagtcaccctggaagggatcaat

SEQ ID NO: 469761 - DNA, 25 bp, Mus musculus
tcaagtcagaacaactggagccagg

SEQ ID NO: 469762 - DNA, 25 bp, Mus musculus
tcaagtcatcatcagcaagtcagcc

SEQ ID NO: 469763 - DNA, 25 bp, Mus musculus
tcaagtccagagtaaagcagcggct

SEQ ID NO: 469764 - DNA, 25 bp, Mus musculus
tcaagtccagcagccatgtccatgg

SEQ ID NO: 469765 - DNA, 25 bp, Mus musculus
tcaagtccatgtcggtctgcacgtg

SEQ ID NO: 469766 - DNA, 25 bp, Mus musculus
tcaagtcccagcagaagaggaaact

SEQ ID NO: 469767 - DNA, 25 bp, Mus musculus
tcaagtcccatgtaatgtccagtgg

SEQ ID NO: 469768 - DNA, 25 bp, Mus musculus
tcaagtccctggaagtctgcagaga

SEQ ID NO: 469769 - DNA, 25 bp, Mus musculus
tcaagtccgagagcaagagcgtgct

SEQ ID NO: 469770 - DNA, 25 bp, Mus musculus
tcaagtccgggacaatctttgacaa

SEQ ID NO: 469771 - DNA, 25 bp, Mus musculus
tcaagtccgtaagttccagctccag

SEQ ID NO: 469772 - DNA, 25 bp, Mus musculus
tcaagtcctgcaggcatgtacagca

SEQ ID NO: 469773 - DNA, 25 bp, Mus musculus
tcaagtcctttcagtgagtctacca

SEQ ID NO: 469774 - DNA, 25 bp, Mus musculus
tcaagtcgagaagacaacgtgaccc

SEQ ID NO: 469775 - DNA, 25 bp, Mus musculus
tcaagtcgaggtcagaggtttaccc

SEQ ID NO: 469776 - DNA, 25 bp, Mus musculus
tcaagtcgctggcagatggcatcct

SEQ ID NO: 469777 - DNA, 25 bp, Mus musculus
tcaagtcgtatttgagggccagcga

SEQ ID NO: 469778 - DNA, 25 bp, Mus musculus
tcaagtctcagggtcagagttcgct

SEQ ID NO: 469779 - DNA, 25 bp, Mus musculus
tcaagtctcgggatctggagcgcct

SEQ ID NO: 469780 - DNA, 25 bp, Mus musculus
tcaagtcttgccagaaagtgccgct

SEQ ID NO: 469781 - DNA, 25 bp, Mus musculus
tcaagtgaacgtcaccaacccggtg

SEQ ID NO: 469782 - DNA, 25 bp, Mus musculus
tcaagtgaactcagaccacctgcct

SEQ ID NO: 469783 - DNA, 25 bp, Mus musculus
tcaagtgaccgtggcagtgaaccta

SEQ ID NO: 469784 - DNA, 25 bp, Mus musculus
tcaagtgagagaccaggctgtaacc

SEQ ID NO: 469785 - DNA, 25 bp, Mus musculus
tcaagtgaggctatcaatcgcatca

SEQ ID NO: 469786 - DNA, 25 bp, Mus musculus
tcaagtgagtacaccagagatgtcg

SEQ ID NO: 469787 - DNA, 25 bp, Mus musculus
tcaagtgcctacagttctgcatgta

SEQ ID NO: 469788 - DNA, 25 bp, Mus musculus
tcaagtgcctgaagcctgacgtgct

SEQ ID NO: 469789 - DNA, 25 bp, Mus musculus
tcaagtgcgagaagttcccggtgca

SEQ ID NO: 469790 - DNA, 25 bp, Mus musculus
tcaagtgcgatgagcgtgtggacca

SEQ ID NO: 469791 - DNA, 25 bp, Mus musculus
tcaagtgctaggactgcagcctgcg

SEQ ID NO: 469792 - DNA, 25 bp, Mus musculus
tcaagtgctaggagtccaggtgcca

SEQ ID NO: 469793 - DNA, 25 bp, Mus musculus
tcaagtgctcagaactcaacgggcg

SEQ ID NO: 469794 - DNA, 25 bp, Mus musculus
tcaagtgctccaacctcgaagtagg

SEQ ID NO: 469795 - DNA, 25 bp, Mus musculus
tcaagtggaacggtgagtcgtgcct

SEQ ID NO: 469796 - DNA, 25 bp, Mus musculus
tcaagtggaaggagcaggaaaagcc

SEQ ID NO: 469797 - DNA, 25 bp, Mus musculus
tcaagtggcaagaacaggcgaagtc

SEQ ID NO: 469798 - DNA, 25 bp, Mus musculus
tcaagtggccatcaggatgccttct

SEQ ID NO: 469799 - DNA, 25 bp, Mus musculus
tcaagtggcccagtatgagacggtc

SEQ ID NO: 469800 - DNA, 25 bp, Mus musculus
tcaagtggcctctctggtaatggac

SEQ ID NO: 469801 - DNA, 25 bp, Mus musculus
tcaagtgggtctttgcctagatgca

SEQ ID NO: 469802 - DNA, 25 bp, Mus musculus
tcaagtggtcgtgccaaggagcttc

SEQ ID NO: 469803 - DNA, 25 bp, Mus musculus
tcaagtggtgcttcaccggcagaga

SEQ ID NO: 469804 - DNA, 25 bp, Mus musculus
tcaagtgtaagttatgccgtcggac

SEQ ID NO: 469805 - DNA, 25 bp, Mus musculus
tcaagtgtctgaagagcggcaaggc

SEQ ID NO: 469806 - DNA, 25 bp, Mus musculus
tcaagtgtgactggtggctacggcc

SEQ ID NO: 469807 - DNA, 25 bp, Mus musculus
tcaagttcacctgcatggcctggac

SEQ ID NO: 469808 - DNA, 25 bp, Mus musculus
tcaagttcctgacggatgcgtgcgc

SEQ ID NO: 469809 - DNA, 25 bp, Mus musculus
tcaagttcgccctgtttgaccagga

SEQ ID NO: 469810 - DNA, 25 bp, Mus musculus
tcaagttgccctgctctgtatcgga

SEQ ID NO: 469811 - DNA, 25 bp, Mus musculus
tcaagttggcagagactcatcagca

SEQ ID NO: 469812 - DNA, 25 bp, Mus musculus
tcaagttggtttcccgtgtctcggc

SEQ ID NO: 469813 - DNA, 25 bp, Mus musculus
tcaagttgtccccttctctgtggtg

SEQ ID NO: 469814 - DNA, 25 bp, Mus musculus
tcaagttgtgttgggaaatttttca

SEQ ID NO: 469815 - DNA, 25 bp, Mus musculus
tcaagtttccacagacgacagtgaa

SEQ ID NO: 469816 - DNA, 25 bp, Mus musculus
tcaagtttctgctgctacccatggt

SEQ ID NO: 469817 - DNA, 25 bp, Mus musculus
tcaagtttgttgacgtgggaggcca

SEQ ID NO: 469818 - DNA, 25 bp, Mus musculus
tcaagttttacagcctacagcagag

SEQ ID NO: 469819 - DNA, 25 bp, Mus musculus
tcaagttttgggagatcaccgcagg

SEQ ID NO: 469820 - DNA, 25 bp, Mus musculus
tcaataaaagctgtctggatgtctc

SEQ ID NO: 469821 - DNA, 25 bp, Mus musculus
tcaataaatgctggttggcagggca

SEQ ID NO: 469822 - DNA, 25 bp, Mus musculus
tcaataagaaacttcctgccggtca

SEQ ID NO: 469823 - DNA, 25 bp, Mus musculus
tcaataagaagggacagcaaggctg

SEQ ID NO: 469824 - DNA, 25 bp, Mus musculus
tcaataagaataacaggcggcttgc

SEQ ID NO: 469825 - DNA, 25 bp, Mus musculus
tcaataaggctgagacggctgcaaa

SEQ ID NO: 469826 - DNA, 25 bp, Mus musculus
tcaataatgattttcacagctgggc

SEQ ID NO: 469827 - DNA, 25 bp, Mus musculus
tcaataatgttgtgtcgggcggcgt

SEQ ID NO: 469828 - DNA, 25 bp, Mus musculus
tcaatacctcatgggacagcgtgtc

SEQ ID NO: 469829 - DNA, 25 bp, Mus musculus
tcaatacctccatttaaactgtgga

SEQ ID NO: 469830 - DNA, 25 bp, Mus musculus
tcaatagaatgcttcgacttccgaa

SEQ ID NO: 469831 - DNA, 25 bp, Mus musculus
tcaatagagttagagcttaaaaagt

SEQ ID NO: 469832 - DNA, 25 bp, Mus musculus
tcaatatcacgtacggaggcgtcca

SEQ ID NO: 469833 - DNA, 25 bp, Mus musculus
tcaatatccaagatgaggtgactca

SEQ ID NO: 469834 - DNA, 25 bp, Mus musculus
tcaatatccacgagctggcagagcg

SEQ ID NO: 469835 - DNA, 25 bp, Mus musculus
tcaatatctacaaacagcagttggg

SEQ ID NO: 469836 - DNA, 25 bp, Mus musculus
tcaatatgaaacaccaccagatggc

SEQ ID NO: 469837 - DNA, 25 bp, Mus musculus
tcaatatgcttgcaaaagggaacca

SEQ ID NO: 469838 - DNA, 25 bp, Mus musculus
tcaatcaagcgggtcagagggcgcc

SEQ ID NO: 469839 - DNA, 25 bp, Mus musculus
tcaatcaagcgtgaacaaagaggcc

SEQ ID NO: 469840 - DNA, 25 bp, Mus musculus
tcaatcaagtttcggcgttctcaca

SEQ ID NO: 469841 - DNA, 25 bp, Mus musculus
tcaatcagatgagcaagctgcctgc

SEQ ID NO: 469842 - DNA, 25 bp, Mus musculus
tcaatcaggagctggtgtccgggtc

SEQ ID NO: 469843 - DNA, 25 bp, Mus musculus
tcaatcagggcgacagagaaagcga

SEQ ID NO: 469844 - DNA, 25 bp, Mus musculus
tcaatccaggaagggactggtaacc

SEQ ID NO: 469845 - DNA, 25 bp, Mus musculus
tcaatccccggtgtctaagagagaa

SEQ ID NO: 469846 - DNA, 25 bp, Mus musculus
tcaatccctctaatgtggtcagcga

SEQ ID NO: 469847 - DNA, 25 bp, Mus musculus
tcaatccctgttgggcctggagcaa

SEQ ID NO: 469848 - DNA, 25 bp, Mus musculus
tcaatccgccatctttgagtcaggc

SEQ ID NO: 469849 - DNA, 25 bp, Mus musculus
tcaatcctcgcttcaatgcccatgg

SEQ ID NO: 469850 - DNA, 25 bp, Mus musculus
tcaatcctggctccgaagtctctgg

SEQ ID NO: 469851 - DNA, 25 bp, Mus musculus
tcaatcctgggcatgctggtcgggc

SEQ ID NO: 469852 - DNA, 25 bp, Mus musculus
tcaatccttcggctaaaatgctggc

SEQ ID NO: 469853 - DNA, 25 bp, Mus musculus
tcaatcgtccgcatcgccatggaga

SEQ ID NO: 469854 - DNA, 25 bp, Mus musculus
tcaatcgtctgacaccagtgggaca

SEQ ID NO: 469855 - DNA, 25 bp, Mus musculus
tcaatctacgaggagtgggaccctt

SEQ ID NO: 469856 - DNA, 25 bp, Mus musculus
tcaatctcagcagatgaagtccttc

SEQ ID NO: 469857 - DNA, 25 bp, Mus musculus
tcaatctcctttcggactgctcaga

SEQ ID NO: 469858 - DNA, 25 bp, Mus musculus
tcaatctgaatggaggtctgggcct

SEQ ID NO: 469859 - DNA, 25 bp, Mus musculus
tcaatctgatacatattctgtggtc

SEQ ID NO: 469860 - DNA, 25 bp, Mus musculus
tcaatctggcagactcccagtgcac

SEQ ID NO: 469861 - DNA, 25 bp, Mus musculus
tcaatcttgaagaaggcctggctcc

SEQ ID NO: 469862 - DNA, 25 bp, Mus musculus
tcaatgaacagcaccggcagatggg

SEQ ID NO: 469863 - DNA, 25 bp, Mus musculus
tcaatgaaggagagaagagccagcc

SEQ ID NO: 469864 - DNA, 25 bp, Mus musculus
tcaatgacaaaagggagcaagccag

SEQ ID NO: 469865 - DNA, 25 bp, Mus musculus
tcaatgactgggttggaccaccaaa

SEQ ID NO: 469866 - DNA, 25 bp, Mus musculus
tcaatgacttcgcagaccagcacgt

SEQ ID NO: 469867 - DNA, 25 bp, Mus musculus
tcaatgacttgtccaccagacccag

SEQ ID NO: 469868 - DNA, 25 bp, Mus musculus
tcaatgagatggacaaccgctacga

SEQ ID NO: 469869 - DNA, 25 bp, Mus musculus
tcaatgaggagccaggatacgtgct

SEQ ID NO: 469870 - DNA, 25 bp, Mus musculus
tcaatgagtccccacagatggcctg

SEQ ID NO: 469871 - DNA, 25 bp, Mus musculus
tcaatgagtgtggattaggaatact

SEQ ID NO: 469872 - DNA, 25 bp, Mus musculus
tcaatgatgagaatgtcccacagag

SEQ ID NO: 469873 - DNA, 25 bp, Mus musculus
tcaatgatggcttcaaggacgaggc

SEQ ID NO: 469874 - DNA, 25 bp, Mus musculus
tcaatgattctgtggtgggtgaaaa

SEQ ID NO: 469875 - DNA, 25 bp, Mus musculus
tcaatgcagatctacgcaagctggc

SEQ ID NO: 469876 - DNA, 25 bp, Mus musculus
tcaatgcaggagaagacagttacgt

SEQ ID NO: 469877 - DNA, 25 bp, Mus musculus
tcaatgcagggattatagcagcgcc

SEQ ID NO: 469878 - DNA, 25 bp, Mus musculus
tcaatgccacggaggagatgtcaac

SEQ ID NO: 469879 - DNA, 25 bp, Mus musculus
tcaatgccagaggttttaggacacc

SEQ ID NO: 469880 - DNA, 25 bp, Mus musculus
tcaatgcccgcaagtagacagtggt

SEQ ID NO: 469881 - DNA, 25 bp, Mus musculus
tcaatgcccttacccacagaaaaca

SEQ ID NO: 469882 - DNA, 25 bp, Mus musculus
tcaatgcggagggaaagctggacca

SEQ ID NO: 469883 - DNA, 25 bp, Mus musculus
tcaatgcgtgctttaaaactcggcg

SEQ ID NO: 469884 - DNA, 25 bp, Mus musculus
tcaatgcttgggtggagtctctccc

SEQ ID NO: 469885 - DNA, 25 bp, Mus musculus
tcaatggaaccacaaagggtgagcg

SEQ ID NO: 469886 - DNA, 25 bp, Mus musculus
tcaatggacaggctgaactcaggtg

SEQ ID NO: 469887 - DNA, 25 bp, Mus musculus
tcaatggacccgagagacagagaat

SEQ ID NO: 469888 - DNA, 25 bp, Mus musculus
tcaatggcaaatctctcaagggcgc

SEQ ID NO: 469889 - DNA, 25 bp, Mus musculus
tcaatggcagtgtggtgccggcacc

SEQ ID NO: 469890 - DNA, 25 bp, Mus musculus
tcaatggcattgaggacgagagcgt

SEQ ID NO: 469891 - DNA, 25 bp, Mus musculus
tcaatggcgctgtggtaaggacact

SEQ ID NO: 469892 - DNA, 25 bp, Mus musculus
tcaatggctacgagatgaacggcga

SEQ ID NO: 469893 - DNA, 25 bp, Mus musculus
tcaatgggagaaataaggatgcaag

SEQ ID NO: 469894 - DNA, 25 bp, Mus musculus
tcaatgggagcaccttgcaggagct

SEQ ID NO: 469895 - DNA, 25 bp, Mus musculus
tcaatgggaggagttaccaggccag

SEQ ID NO: 469896 - DNA, 25 bp, Mus musculus
tcaatgggcaaatgcgcctagggct

SEQ ID NO: 469897 - DNA, 25 bp, Mus musculus
tcaatgggcaagtaactaaatgact

SEQ ID NO: 469898 - DNA, 25 bp, Mus musculus
tcaatgggctatgcgggagcttctc

SEQ ID NO: 469899 - DNA, 25 bp, Mus musculus
tcaatggtgaaagtggagaatctca

SEQ ID NO: 469900 - DNA, 25 bp, Mus musculus
tcaatggtggcttccggaactggct

SEQ ID NO: 469901 - DNA, 25 bp, Mus musculus
tcaatggtgtgcacaacgtggccaa

SEQ ID NO: 469902 - DNA, 25 bp, Mus musculus
tcaatgtaaaggaagcccatgtcca

SEQ ID NO: 469903 - DNA, 25 bp, Mus musculus
tcaatgtagaaatggacgcggcccc

SEQ ID NO: 469904 - DNA, 25 bp, Mus musculus
tcaatgtatctaaagggctctagaa

SEQ ID NO: 469905 - DNA, 25 bp, Mus musculus
tcaatgtcatcatgcggcctccaga

SEQ ID NO: 469906 - DNA, 25 bp, Mus musculus
tcaatgtcccagaagagggttaacc

SEQ ID NO: 469907 - DNA, 25 bp, Mus musculus
tcaatgtctcactcaggggcgtcct

SEQ ID NO: 469908 - DNA, 25 bp, Mus musculus
tcaatgtctggaagctcctgtcctc

SEQ ID NO: 469909 - DNA, 25 bp, Mus musculus
tcaatgtgacttctcccagcaactg

SEQ ID NO: 469910 - DNA, 25 bp, Mus musculus
tcaatgtggcgcagatcatcgagct

SEQ ID NO: 469911 - DNA, 25 bp, Mus musculus
tcaatgtggtgaacctcctaggcgc

SEQ ID NO: 469912 - DNA, 25 bp, Mus musculus
tcaatgtggtgtgcttcatccagcc

SEQ ID NO: 469913 - DNA, 25 bp, Mus musculus
tcaatgtgtactcgcagccaggctt

SEQ ID NO: 469914 - DNA, 25 bp, Mus musculus
tcaatgttgcctacctggacgtacg

SEQ ID NO: 469915 - DNA, 25 bp, Mus musculus
tcaatgttgtcaccatgggtccctc

SEQ ID NO: 469916 - DNA, 25 bp, Mus musculus
tcaattaaaaagctaggacatggcc

SEQ ID NO: 469917 - DNA, 25 bp, Mus musculus
tcaattacgccaatgtggacggact

SEQ ID NO: 469918 - DNA, 25 bp, Mus musculus
tcaattcagcatcaggtcggcctgt

SEQ ID NO: 469919 - DNA, 25 bp, Mus musculus
tcaattccaagctcagcgggtgccc

SEQ ID NO: 469920 - DNA, 25 bp, Mus musculus
tcaattcgccaaggagctagatgcc

SEQ ID NO: 469921 - DNA, 25 bp, Mus musculus
tcaattctacaatcagttcatctga

SEQ ID NO: 469922 - DNA, 25 bp, Mus musculus
tcaattctagatcaagggagggcaa

SEQ ID NO: 469923 - DNA, 25 bp, Mus musculus
tcaattctagcacctaatgtaggcc

SEQ ID NO: 469924 - DNA, 25 bp, Mus musculus
tcaattctgtgagcaggaccctccg

SEQ ID NO: 469925 - DNA, 25 bp, Mus musculus
tcaattctttgagtggaggaaccaa

SEQ ID NO: 469926 - DNA, 25 bp, Mus musculus
tcaattgagactgtccagagctgtg

SEQ ID NO: 469927 - DNA, 25 bp, Mus musculus
tcaattgccatgacgagtacctcag

SEQ ID NO: 469928 - DNA, 25 bp, Mus musculus
tcaattggacatggtggcatacatc

SEQ ID NO: 469929 - DNA, 25 bp, Mus musculus
tcaattggattgttctgcagatgcc

SEQ ID NO: 469930 - DNA, 25 bp, Mus musculus
tcaattggccgagcaggacagcggc

SEQ ID NO: 469931 - DNA, 25 bp, Mus musculus
tcaatttgacggacttcctgagggt

SEQ ID NO: 469932 - DNA, 25 bp, Mus musculus
tcaatttggcctgtgggtcctgcgt

SEQ ID NO: 469933 - DNA, 25 bp, Mus musculus
tcaattttggagacttaggccgccc

SEQ ID NO: 469934 - DNA, 25 bp, Mus musculus
tcacaaaacttgaaagggctctgcc

SEQ ID NO: 469935 - DNA, 25 bp, Mus musculus
tcacaaaagtggtagcagaggatgc

SEQ ID NO: 469936 - DNA, 25 bp, Mus musculus
tcacaaaatgaagaagggtatcagc

SEQ ID NO: 469937 - DNA, 25 bp, Mus musculus
tcacaaaccactccgtgatggaaga

SEQ ID NO: 469938 - DNA, 25 bp, Mus musculus
tcacaaaccatctccatcagtgttc

SEQ ID NO: 469939 - DNA, 25 bp, Mus musculus
tcacaaacctggtgcacgtggcagc

SEQ ID NO: 469940 - DNA, 25 bp, Mus musculus
tcacaaagaaggttcccgcctggct

SEQ ID NO: 469941 - DNA, 25 bp, Mus musculus
tcacaaagcgttcctgctgagggca

SEQ ID NO: 469942 - DNA, 25 bp, Mus musculus
tcacaaagggttgccagggcttccc

SEQ ID NO: 469943 - DNA, 25 bp, Mus musculus
tcacaaaggttctgtcggacacaaa

SEQ ID NO: 469944 - DNA, 25 bp, Mus musculus
tcacaaagtaaagggaatcccacca

SEQ ID NO: 469945 - DNA, 25 bp, Mus musculus
tcacaacagatgtatgcatgctgtc

SEQ ID NO: 469946 - DNA, 25 bp, Mus musculus
tcacaacagcatctgggatgggtcc

SEQ ID NO: 469947 - DNA, 25 bp, Mus musculus
tcacaaccctgcttaccagataatg

SEQ ID NO: 469948 - DNA, 25 bp, Mus musculus
tcacaacggcctggagaacggagat

SEQ ID NO: 469949 - DNA, 25 bp, Mus musculus
tcacaactcttcagtccaggtggcg

SEQ ID NO: 469950 - DNA, 25 bp, Mus musculus
tcacaactggacagattggacagat

SEQ ID NO: 469951 - DNA, 25 bp, Mus musculus
tcacaacttgaatgcgggaccgagt

SEQ ID NO: 469952 - DNA, 25 bp, Mus musculus
tcacaacttgtagaagaagggctgc

SEQ ID NO: 469953 - DNA, 25 bp, Mus musculus
tcacaagaagcatcctgacttctcc

SEQ ID NO: 469954 - DNA, 25 bp, Mus musculus
tcacaagaggaggtcaggcatcacc

SEQ ID NO: 469955 - DNA, 25 bp, Mus musculus
tcacaagccacgttgcctacactgg

SEQ ID NO: 469956 - DNA, 25 bp, Mus musculus
tcacaagcgcgcagctcaaagagtt

SEQ ID NO: 469957 - DNA, 25 bp, Mus musculus
tcacaaggaacaagaagaagggctc

SEQ ID NO: 469958 - DNA, 25 bp, Mus musculus
tcacaaggatgtggaacagtctaag

SEQ ID NO: 469959 - DNA, 25 bp, Mus musculus
tcacaaggcgaagtcaatggcacag

SEQ ID NO: 469960 - DNA, 25 bp, Mus musculus
tcacaagggaactgcacaatacaaa

SEQ ID NO: 469961 - DNA, 25 bp, Mus musculus
tcacaagtgacttgagcctggccct

SEQ ID NO: 469962 - DNA, 25 bp, Mus musculus
tcacaagtgcctgagccaagaggtt

SEQ ID NO: 469963 - DNA, 25 bp, Mus musculus
tcacaatccaggctgtggaaaccag

SEQ ID NO: 469964 - DNA, 25 bp, Mus musculus
tcacaatggacatacacctgaaact

SEQ ID NO: 469965 - DNA, 25 bp, Mus musculus
tcacaatggctgaagctctgcaggg

SEQ ID NO: 469966 - DNA, 25 bp, Mus musculus
tcacaatgggtacagcagtagccgg

SEQ ID NO: 469967 - DNA, 25 bp, Mus musculus
tcacacaacaatagggtatacccag

SEQ ID NO: 469968 - DNA, 25 bp, Mus musculus
tcacacagagctaaaggctacgtcc

SEQ ID NO: 469969 - DNA, 25 bp, Mus musculus
tcacacagcggatgcccaaggcctt

SEQ ID NO: 469970 - DNA, 25 bp, Mus musculus
tcacacaggcagagtatacacacgc

SEQ ID NO: 469971 - DNA, 25 bp, Mus musculus
tcacacaggctatccagtggtacca

SEQ ID NO: 469972 - DNA, 25 bp, Mus musculus
tcacacagtgtcgatgaagcgcctc

SEQ ID NO: 469973 - DNA, 25 bp, Mus musculus
tcacacattgtgaacccaggaaaag

SEQ ID NO: 469974 - DNA, 25 bp, Mus musculus
tcacaccccgggagattgctgaggt

SEQ ID NO: 469975 - DNA, 25 bp, Mus musculus
tcacacccttggagatcgagtttgc

SEQ ID NO: 469976 - DNA, 25 bp, Mus musculus
tcacaccggaaagggttgccacatg

SEQ ID NO: 469977 - DNA, 25 bp, Mus musculus
tcacaccgggattgaagtcgctcaa

SEQ ID NO: 469978 - DNA, 25 bp, Mus musculus
tcacacctgagttaagagacagcca

SEQ ID NO: 469979 - DNA, 25 bp, Mus musculus
tcacacgaaagaaaacgcaatgcgg

SEQ ID NO: 469980 - DNA, 25 bp, Mus musculus
tcacacgaatctagcccgggaacta

SEQ ID NO: 469981 - DNA, 25 bp, Mus musculus
tcacacgaggatatagagcgcctgg

SEQ ID NO: 469982 - DNA, 25 bp, Mus musculus
tcacacgctggtggaggacatcctt

SEQ ID NO: 469983 - DNA, 25 bp, Mus musculus
tcacacgcttcgagggtacaagtcc

SEQ ID NO: 469984 - DNA, 25 bp, Mus musculus
tcacacgcttgggaaaagactgaag

SEQ ID NO: 469985 - DNA, 25 bp, Mus musculus
tcacacgggagaaagaccatatgcg

SEQ ID NO: 469986 - DNA, 25 bp, Mus musculus
tcacacggtgttctgctggagcatt

SEQ ID NO: 469987 - DNA, 25 bp, Mus musculus
tcacacgtcggtatcagagtcccag

SEQ ID NO: 469988 - DNA, 25 bp, Mus musculus
tcacacgtgagaatgcagcaggaac

SEQ ID NO: 469989 - DNA, 25 bp, Mus musculus
tcacactaacatgggactctgggaa

SEQ ID NO: 469990 - DNA, 25 bp, Mus musculus
tcacactatcaggagcaaagaagct

SEQ ID NO: 469991 - DNA, 25 bp, Mus musculus
tcacactcaaggatccacaggtggt

SEQ ID NO: 469992 - DNA, 25 bp, Mus musculus
tcacactgagtgtaataaatgacag

SEQ ID NO: 469993 - DNA, 25 bp, Mus musculus
tcacactgtgggaggcaaagcttgg

SEQ ID NO: 469994 - DNA, 25 bp, Mus musculus
tcacactgtgtacaggtgagaaatg

SEQ ID NO: 469995 - DNA, 25 bp, Mus musculus
tcacacttcctcgagatgaacaaca

SEQ ID NO: 469996 - DNA, 25 bp, Mus musculus
tcacacttttgttgggagcctaagc

SEQ ID NO: 469997 - DNA, 25 bp, Mus musculus
tcacagaaccttggaggtagcccag

SEQ ID NO: 469998 - DNA, 25 bp, Mus musculus
tcacagaagaactcgaagcatcatc

SEQ ID NO: 469999 - DNA, 25 bp, Mus musculus
tcacagacaaggttggcattgaacg

SEQ ID NO: 470000 - DNA, 25 bp, Mus musculus
tcacagaccttctctaggccacaga

SEQ ID NO: 470001 - DNA, 25 bp, Mus musculus
tcacagaccttgttggctgcagcag

SEQ ID NO: 470002 - DNA, 25 bp, Mus musculus
tcacagacggggaataggaacctaa

SEQ ID NO: 470003 - DNA, 25 bp, Mus musculus
tcacagactagaggacagcaggcta

SEQ ID NO: 470004 - DNA, 25 bp, Mus musculus
tcacagactagtccaagaagttcct

SEQ ID NO: 470005 - DNA, 25 bp, Mus musculus
tcacagactgtaggaaagccaagat

SEQ ID NO: 470006 - DNA, 25 bp, Mus musculus
tcacagagaccattgacgagagcaa

SEQ ID NO: 470007 - DNA, 25 bp, Mus musculus
tcacagagatggtactgaggcttcc

SEQ ID NO: 470008 - DNA, 25 bp, Mus musculus
tcacagagctctgcggtcttgagac

SEQ ID NO: 470009 - DNA, 25 bp, Mus musculus
tcacagaggtcgaggcaattttcag

SEQ ID NO: 470010 - DNA, 25 bp, Mus musculus
tcacagagtgcatgcaagacaagca

SEQ ID NO: 470011 - DNA, 25 bp, Mus musculus
tcacagagtgtggtacgttcattct

SEQ ID NO: 470012 - DNA, 25 bp, Mus musculus
tcacagataaggtcgaccggtggca

SEQ ID NO: 470013 - DNA, 25 bp, Mus musculus
tcacagatatggtaaagagccgcct

SEQ ID NO: 470014 - DNA, 25 bp, Mus musculus
tcacagatgaaggagatgagttatt

SEQ ID NO: 470015 - DNA, 25 bp, Mus musculus
tcacagatgcctacgcagggaagga

SEQ ID NO: 470016 - DNA, 25 bp, Mus musculus
tcacagatgtgactaaacggagcca

SEQ ID NO: 470017 - DNA, 25 bp, Mus musculus
tcacagatgtggctgatagagaccg

SEQ ID NO: 470018 - DNA, 25 bp, Mus musculus
tcacagattcattgcgcagccgagg

SEQ ID NO: 470019 - DNA, 25 bp, Mus musculus
tcacagcacatttttagagaccagc

SEQ ID NO: 470020 - DNA, 25 bp, Mus musculus
tcacagcactcatcaggactgcaga

SEQ ID NO: 470021 - DNA, 25 bp, Mus musculus
tcacagcagcagtcattggcagcct

SEQ ID NO: 470022 - DNA, 25 bp, Mus musculus
tcacagcagcgggttacaactcact

SEQ ID NO: 470023 - DNA, 25 bp, Mus musculus
tcacagcaggtgctatgcaacggct

SEQ ID NO: 470024 - DNA, 25 bp, Mus musculus
tcacagcatggtctatacacagagc

SEQ ID NO: 470025 - DNA, 25 bp, Mus musculus
tcacagccacaacactcatgctatg

SEQ ID NO: 470026 - DNA, 25 bp, Mus musculus
tcacagccagccagaggtacatagt

SEQ ID NO: 470027 - DNA, 25 bp, Mus musculus
tcacagcccgaacattcatgaacag

SEQ ID NO: 470028 - DNA, 25 bp, Mus musculus
tcacagccttagtgctgactatgct

SEQ ID NO: 470029 - DNA, 25 bp, Mus musculus
tcacagcgctgatgtaaacacaaag

SEQ ID NO: 470030 - DNA, 25 bp, Mus musculus
tcacagcggccctgagagagattcg

SEQ ID NO: 470031 - DNA, 25 bp, Mus musculus
tcacagcgggtcatggtggctcaag

SEQ ID NO: 470032 - DNA, 25 bp, Mus musculus
tcacagcgggtctagggatactcca

SEQ ID NO: 470033 - DNA, 25 bp, Mus musculus
tcacagcgtaccaataaaccacggt

SEQ ID NO: 470034 - DNA, 25 bp, Mus musculus
tcacagcgttgaaggatgctcctgc

SEQ ID NO: 470035 - DNA, 25 bp, Mus musculus
tcacagctccagagatgaccacaga

SEQ ID NO: 470036 - DNA, 25 bp, Mus musculus
tcacagctcgttggttggtaaaggc

SEQ ID NO: 470037 - DNA, 25 bp, Mus musculus
tcacagctgtttcgtaaggaggagt

SEQ ID NO: 470038 - DNA, 25 bp, Mus musculus
tcacagcttgttgggtaaacagcga

SEQ ID NO: 470039 - DNA, 25 bp, Mus musculus
tcacagctttggatggcggaaaccc

SEQ ID NO: 470040 - DNA, 25 bp, Mus musculus
tcacaggaacataaagtcagattgc

SEQ ID NO: 470041 - DNA, 25 bp, Mus musculus
tcacaggagttattaagtgttctgc

SEQ ID NO: 470042 - DNA, 25 bp, Mus musculus
tcacaggatgctatcatggacgcca

SEQ ID NO: 470043 - DNA, 25 bp, Mus musculus
tcacaggcaagagggagttacaact

SEQ ID NO: 470044 - DNA, 25 bp, Mus musculus
tcacaggcaggaactacaggcagct

SEQ ID NO: 470045 - DNA, 25 bp, Mus musculus
tcacaggcagttggcaggttcatgc

SEQ ID NO: 470046 - DNA, 25 bp, Mus musculus
tcacaggcatgagtggtaggcccct

SEQ ID NO: 470047 - DNA, 25 bp, Mus musculus
tcacaggcttcccagaagtctaagg

SEQ ID NO: 470048 - DNA, 25 bp, Mus musculus
tcacaggcttgtgccgggaagaaca

SEQ ID NO: 470049 - DNA, 25 bp, Mus musculus
tcacagggaaattggccatggagcc

SEQ ID NO: 470050 - DNA, 25 bp, Mus musculus
tcacagggctggagctgtatgacga

SEQ ID NO: 470051 - DNA, 25 bp, Mus musculus
tcacagggtcctttgaccacacagt

SEQ ID NO: 470052 - DNA, 25 bp, Mus musculus
tcacagggtgggtaggtttgctcaa

SEQ ID NO: 470053 - DNA, 25 bp, Mus musculus
tcacaggtagagagacaagttcttc

SEQ ID NO: 470054 - DNA, 25 bp, Mus musculus
tcacaggtatccgttcagggtccgt

SEQ ID NO: 470055 - DNA, 25 bp, Mus musculus
tcacaggtcagcaggatccgaggaa

SEQ ID NO: 470056 - DNA, 25 bp, Mus musculus
tcacaggtgaatgcctgccagagct

SEQ ID NO: 470057 - DNA, 25 bp, Mus musculus
tcacaggtggcagctatcattgaat

SEQ ID NO: 470058 - DNA, 25 bp, Mus musculus
tcacagtaaccttaacacgggagct

SEQ ID NO: 470059 - DNA, 25 bp, Mus musculus
tcacagtagtagcagccgaggtagt

SEQ ID NO: 470060 - DNA, 25 bp, Mus musculus
tcacagtatgaagagaggctgcccg

SEQ ID NO: 470061 - DNA, 25 bp, Mus musculus
tcacagtatgtctcaggaaccgcca

SEQ ID NO: 470062 - DNA, 25 bp, Mus musculus
tcacagtcatcagggcagaaatcag

SEQ ID NO: 470063 - DNA, 25 bp, Mus musculus
tcacagtccacacaatctaaatcct

SEQ ID NO: 470064 - DNA, 25 bp, Mus musculus
tcacagtgaatgaagagggtaccca

SEQ ID NO: 470065 - DNA, 25 bp, Mus musculus
tcacagtgcattgcgaaattccaag

SEQ ID NO: 470066 - DNA, 25 bp, Mus musculus
tcacagtgcctacctgggtagctgg

SEQ ID NO: 470067 - DNA, 25 bp, Mus musculus
tcacagtgctgatctgacgggagct

SEQ ID NO: 470068 - DNA, 25 bp, Mus musculus
tcacagtgggtagtatcatccctag

SEQ ID NO: 470069 - DNA, 25 bp, Mus musculus
tcacagtgtaccacagcactgctgg

SEQ ID NO: 470070 - DNA, 25 bp, Mus musculus
tcacagttcaaatccaagtcccaaa

SEQ ID NO: 470071 - DNA, 25 bp, Mus musculus
tcacataaaggaggaacgcacgggt

SEQ ID NO: 470072 - DNA, 25 bp, Mus musculus
tcacatagacgcagccttgggtcgg

SEQ ID NO: 470073 - DNA, 25 bp, Mus musculus
tcacatcaaaagacttgtctgctac

SEQ ID NO: 470074 - DNA, 25 bp, Mus musculus
tcacatcaatagaaacccaacgaga

SEQ ID NO: 470075 - DNA, 25 bp, Mus musculus
tcacatcagttctcctgtgagtctg

SEQ ID NO: 470076 - DNA, 25 bp, Mus musculus
tcacatcattggagagcaagccaga

SEQ ID NO: 470077 - DNA, 25 bp, Mus musculus
tcacatccgtaagctgggacaaagc

SEQ ID NO: 470078 - DNA, 25 bp, Mus musculus
tcacatccttgagcgagaaggcggc

SEQ ID NO: 470079 - DNA, 25 bp, Mus musculus
tcacatcgaggtggcacggtggttc

SEQ ID NO: 470080 - DNA, 25 bp, Mus musculus
tcacatcgctgctaaccggtgggcg

SEQ ID NO: 470081 - DNA, 25 bp, Mus musculus
tcacatctagaaggtgtaggagcca

SEQ ID NO: 470082 - DNA, 25 bp, Mus musculus
tcacatctggcggaaattgacaggc

SEQ ID NO: 470083 - DNA, 25 bp, Mus musculus
tcacatctttcggagcatcagcggc

SEQ ID NO: 470084 - DNA, 25 bp, Mus musculus
tcacatgaccgcatcaggcacgtgt

SEQ ID NO: 470085 - DNA, 25 bp, Mus musculus
tcacatgagtgtgggaaatgcggta

SEQ ID NO: 470086 - DNA, 25 bp, Mus musculus
tcacatgcagactacagtacccggc

SEQ ID NO: 470087 - DNA, 25 bp, Mus musculus
tcacatgctggcaggccaagacagg

SEQ ID NO: 470088 - DNA, 25 bp, Mus musculus
tcacatgcttgccaacggttgggac

SEQ ID NO: 470089 - DNA, 25 bp, Mus musculus
tcacatggctcatccgggtgcaaga

SEQ ID NO: 470090 - DNA, 25 bp, Mus musculus
tcacatgggaaagacctcgggtcgt

SEQ ID NO: 470091 - DNA, 25 bp, Mus musculus
tcacatgggcacagagaatcgaggc

SEQ ID NO: 470092 - DNA, 25 bp, Mus musculus
tcacatgtctgcagggaaggagcta

SEQ ID NO: 470093 - DNA, 25 bp, Mus musculus
tcacatgtggcctggcgcccacagg

SEQ ID NO: 470094 - DNA, 25 bp, Mus musculus
tcacatgtgtgtgccgagacctcat

SEQ ID NO: 470095 - DNA, 25 bp, Mus musculus
tcacatgtttgagagagtgatccag

SEQ ID NO: 470096 - DNA, 25 bp, Mus musculus
tcacattactgggatcactcggaga

SEQ ID NO: 470097 - DNA, 25 bp, Mus musculus
tcacattctacgactatggcagggt

SEQ ID NO: 470098 - DNA, 25 bp, Mus musculus
tcacattgaacttgcagggcagacc

SEQ ID NO: 470099 - DNA, 25 bp, Mus musculus
tcacattgaaggaggcgaggtcagc

SEQ ID NO: 470100 - DNA, 25 bp, Mus musculus
tcacattgctggtggtagttcccaa

SEQ ID NO: 470101 - DNA, 25 bp, Mus musculus
tcacattggataggaagaggaccgt

SEQ ID NO: 470102 - DNA, 25 bp, Mus musculus
tcacattgtccttttctcgggaggg

SEQ ID NO: 470103 - DNA, 25 bp, Mus musculus
tcacatttgtgaagaatgaccaaaa

SEQ ID NO: 470104 - DNA, 25 bp, Mus musculus
tcacattttaatggcagtgctcata

SEQ ID NO: 470105 - DNA, 25 bp, Mus musculus
tcacattttgttgaacccagcaagc

SEQ ID NO: 470106 - DNA, 25 bp, Mus musculus
tcaccaaaaagctccttcaaactga

SEQ ID NO: 470107 - DNA, 25 bp, Mus musculus
tcaccaaacagttttggagtaacag

SEQ ID NO: 470108 - DNA, 25 bp, Mus musculus
tcaccaaactgatgcttaaaacaga

SEQ ID NO: 470109 - DNA, 25 bp, Mus musculus
tcaccaaaggcgagaagttccacat

SEQ ID NO: 470110 - DNA, 25 bp, Mus musculus
tcaccaaattcttgagctacaaact

SEQ ID NO: 470111 - DNA, 25 bp, Mus musculus
tcaccaacgtggaagtctcagcttg

SEQ ID NO: 470112 - DNA, 25 bp, Mus musculus
tcaccaagaagtacgccaagggcat

SEQ ID NO: 470113 - DNA, 25 bp, Mus musculus
tcaccaagagagtcaaggaggtcct

SEQ ID NO: 470114 - DNA, 25 bp, Mus musculus
tcaccaagctcaagagagaggtctg

SEQ ID NO: 470115 - DNA, 25 bp, Mus musculus
tcaccaagggataccaggagaccat

SEQ ID NO: 470116 - DNA, 25 bp, Mus musculus
tcaccaaggtggctagaagacatcg

SEQ ID NO: 470117 - DNA, 25 bp, Mus musculus
tcaccaagtgagtacagaaaagatg

SEQ ID NO: 470118 - DNA, 25 bp, Mus musculus
tcaccacacagcagcgaagagcttt

SEQ ID NO: 470119 - DNA, 25 bp, Mus musculus
tcaccacatgctctttaaggcctaa

SEQ ID NO: 470120 - DNA, 25 bp, Mus musculus
tcaccaccagaaagaaatgcggcgt

SEQ ID NO: 470121 - DNA, 25 bp, Mus musculus
tcaccaccatcgaggagaggtccag

SEQ ID NO: 470122 - DNA, 25 bp, Mus musculus
tcaccacccgccaaatagagttgtg

SEQ ID NO: 470123 - DNA, 25 bp, Mus musculus
tcaccaccgaggatgagcacatgtg

SEQ ID NO: 470124 - DNA, 25 bp, Mus musculus
tcaccacggagctgatgaacttcaa

SEQ ID NO: 470125 - DNA, 25 bp, Mus musculus
tcaccacggaggaaacgctatgcag

SEQ ID NO: 470126 - DNA, 25 bp, Mus musculus
tcaccactatatgctgtgccttagg

SEQ ID NO: 470127 - DNA, 25 bp, Mus musculus
tcaccactatcgagaagcgctttgg

SEQ ID NO: 470128 - DNA, 25 bp, Mus musculus
tcaccactccgacccaagtgggaag

SEQ ID NO: 470129 - DNA, 25 bp, Mus musculus
tcaccacttatgttgagaatggctc

SEQ ID NO: 470130 - DNA, 25 bp, Mus musculus
tcaccacttggagcgactgtttcta

SEQ ID NO: 470131 - DNA, 25 bp, Mus musculus
tcaccagagggtattcggaggccca

SEQ ID NO: 470132 - DNA, 25 bp, Mus musculus
tcaccagatgagagagacacagatc

SEQ ID NO: 470133 - DNA, 25 bp, Mus musculus
tcaccagatggtacaaggctcgcct

SEQ ID NO: 470134 - DNA, 25 bp, Mus musculus
tcaccagcagcctgtctgaaggtag

SEQ ID NO: 470135 - DNA, 25 bp, Mus musculus
tcaccagctggctttaactcggagc

SEQ ID NO: 470136 - DNA, 25 bp, Mus musculus
tcaccaggactggaggaaaagagcg

SEQ ID NO: 470137 - DNA, 25 bp, Mus musculus
tcaccaggatgtctagatcacagct

SEQ ID NO: 470138 - DNA, 25 bp, Mus musculus
tcaccagtcagtggcactggtcact

SEQ ID NO: 470139 - DNA, 25 bp, Mus musculus
tcaccagtgaaaagagcagaagccc

SEQ ID NO: 470140 - DNA, 25 bp, Mus musculus
tcaccagttgactccgggaacacag

SEQ ID NO: 470141 - DNA, 25 bp, Mus musculus
tcaccatccggtcagagagtacttt

SEQ ID NO: 470142 - DNA, 25 bp, Mus musculus
tcaccatcctggacacactcgtttg

SEQ ID NO: 470143 - DNA, 25 bp, Mus musculus
tcaccatctcagctgaaggagggcg

SEQ ID NO: 470144 - DNA, 25 bp, Mus musculus
tcaccatgacggagttgaacgccat

SEQ ID NO: 470145 - DNA, 25 bp, Mus musculus
tcaccatgagtgatgtatgtgggta

SEQ ID NO: 470146 - DNA, 25 bp, Mus musculus
tcaccatgatgatgccaagagccgc

SEQ ID NO: 470147 - DNA, 25 bp, Mus musculus
tcaccatgccagttgatgactgctg

SEQ ID NO: 470148 - DNA, 25 bp, Mus musculus
tcaccatgcgcttgggaagggagaa

SEQ ID NO: 470149 - DNA, 25 bp, Mus musculus
tcaccatggataatctgtccccaga

SEQ ID NO: 470150 - DNA, 25 bp, Mus musculus
tcacccaagcccagcatttcaaggg

SEQ ID NO: 470151 - DNA, 25 bp, Mus musculus
tcacccaatcggagacgtagaggcg

SEQ ID NO: 470152 - DNA, 25 bp, Mus musculus
tcacccaggaagagaaattgtaagc

SEQ ID NO: 470153 - DNA, 25 bp, Mus musculus
tcacccaggatagtgattaacatca

SEQ ID NO: 470154 - DNA, 25 bp, Mus musculus
tcacccagggaggaaaacagctaga

SEQ ID NO: 470155 - DNA, 25 bp, Mus musculus
tcacccataacactggaatgacaga

SEQ ID NO: 470156 - DNA, 25 bp, Mus musculus
tcacccatatctagtgcctatggct

SEQ ID NO: 470157 - DNA, 25 bp, Mus musculus
tcacccatgaagcaaagaaggccct

SEQ ID NO: 470158 - DNA, 25 bp, Mus musculus
tcacccatgatgctaggacttgctt

SEQ ID NO: 470159 - DNA, 25 bp, Mus musculus
tcaccccaccagctgagtttgcatt

SEQ ID NO: 470160 - DNA, 25 bp, Mus musculus
tcaccccagatgagcagaaacggag

SEQ ID NO: 470161 - DNA, 25 bp, Mus musculus
tcaccccaggctacatgttcaaaag

SEQ ID NO: 470162 - DNA, 25 bp, Mus musculus
tcaccccagggagagtatctgccag

SEQ ID NO: 470163 - DNA, 25 bp, Mus musculus
tcaccccagttagacaggtatgtca

SEQ ID NO: 470164 - DNA, 25 bp, Mus musculus
tcaccccatgggaaagcaagcgaag

SEQ ID NO: 470165 - DNA, 25 bp, Mus musculus
tcaccccggactgctttaagaggga

SEQ ID NO: 470166 - DNA, 25 bp, Mus musculus
tcacccctctgtatggaaacttgtt

SEQ ID NO: 470167 - DNA, 25 bp, Mus musculus
tcacccctctttggtttggctaggt

SEQ ID NO: 470168 - DNA, 25 bp, Mus musculus
tcacccctgattgaggtcgttctct

SEQ ID NO: 470169 - DNA, 25 bp, Mus musculus
tcacccctgctttaacttcgcggat

SEQ ID NO: 470170 - DNA, 25 bp, Mus musculus
tcacccgagccaaggagatcattgc

SEQ ID NO: 470171 - DNA, 25 bp, Mus musculus
tcacccgagtcagagactagtaagg

SEQ ID NO: 470172 - DNA, 25 bp, Mus musculus
tcacccgggagcgagctgagaatag

SEQ ID NO: 470173 - DNA, 25 bp, Mus musculus
tcacccgggatgttaggcaaagaaa

SEQ ID NO: 470174 - DNA, 25 bp, Mus musculus
tcacccgggccttgcatataaataa

SEQ ID NO: 470175 - DNA, 25 bp, Mus musculus
tcacccgggcttctggatgtaatcg

SEQ ID NO: 470176 - DNA, 25 bp, Mus musculus
tcacccgtgaagagaagcctgctgt

SEQ ID NO: 470177 - DNA, 25 bp, Mus musculus
tcacccgtgagccatcgcaggatgg

SEQ ID NO: 470178 - DNA, 25 bp, Mus musculus
tcacccgtggttgaaaagcaggccc

SEQ ID NO: 470179 - DNA, 25 bp, Mus musculus
tcaccctagtgggatgctatctgcc

SEQ ID NO: 470180 - DNA, 25 bp, Mus musculus
tcaccctagtgtggttaagggcccg

SEQ ID NO: 470181 - DNA, 25 bp, Mus musculus
tcaccctatatgcagttgaggacac

SEQ ID NO: 470182 - DNA, 25 bp, Mus musculus
tcaccctgatttccagttgcactgg

SEQ ID NO: 470183 - DNA, 25 bp, Mus musculus
tcaccctgctggaagtgccacatgc

SEQ ID NO: 470184 - DNA, 25 bp, Mus musculus
tcaccctggagttgaacgaggacca

SEQ ID NO: 470185 - DNA, 25 bp, Mus musculus
tcaccctgggttgtaggtcttcact

SEQ ID NO: 470186 - DNA, 25 bp, Mus musculus
tcacccttactgacagatgatcgtg

SEQ ID NO: 470187 - DNA, 25 bp, Mus musculus
tcacccttgatcttggcccttcatg

SEQ ID NO: 470188 - DNA, 25 bp, Mus musculus
tcaccctttggagagagcagcttca

SEQ ID NO: 470189 - DNA, 25 bp, Mus musculus
tcaccctttgggagctactcgttgg

SEQ ID NO: 470190 - DNA, 25 bp, Mus musculus
tcaccgaaggcgtgtcagagacagt

SEQ ID NO: 470191 - DNA, 25 bp, Mus musculus
tcaccgaatggagatcacaatcagg

SEQ ID NO: 470192 - DNA, 25 bp, Mus musculus
tcaccgacagcctgttggagaaggt

SEQ ID NO: 470193 - DNA, 25 bp, Mus musculus
tcaccgacgaggaactgaatgctct

SEQ ID NO: 470194 - DNA, 25 bp, Mus musculus
tcaccgacggaagggtgatcccgca

SEQ ID NO: 470195 - DNA, 25 bp, Mus musculus
tcaccgaggctgagcagagaatgct

SEQ ID NO: 470196 - DNA, 25 bp, Mus musculus
tcaccgagttggtgtgctccggcca

SEQ ID NO: 470197 - DNA, 25 bp, Mus musculus
tcaccgatgaagaagctggcattcc

SEQ ID NO: 470198 - DNA, 25 bp, Mus musculus
tcaccgcaggaaaaaagtgtcccaa

SEQ ID NO: 470199 - DNA, 25 bp, Mus musculus
tcaccgcaggaagctgaaaacgggt

SEQ ID NO: 470200 - DNA, 25 bp, Mus musculus
tcaccgcatcaagggaggatctagc

SEQ ID NO: 470201 - DNA, 25 bp, Mus musculus
tcaccgccgtgatgtcaattagaat

SEQ ID NO: 470202 - DNA, 25 bp, Mus musculus
tcaccggaaatcttacgggcagacg

SEQ ID NO: 470203 - DNA, 25 bp, Mus musculus
tcaccggccctgaaagcatgttgca

SEQ ID NO: 470204 - DNA, 25 bp, Mus musculus
tcaccgggaggcgtttcctgagacc

SEQ ID NO: 470205 - DNA, 25 bp, Mus musculus
tcaccgtagcaggaagacgctttct

SEQ ID NO: 470206 - DNA, 25 bp, Mus musculus
tcaccgtcagtacctgctcagtggt

SEQ ID NO: 470207 - DNA, 25 bp, Mus musculus
tcaccgtgaccttgcttggcttagg

SEQ ID NO: 470208 - DNA, 25 bp, Mus musculus
tcaccgtggactcgaagcgcttctt

SEQ ID NO: 470209 - DNA, 25 bp, Mus musculus
tcaccgtgggagtaaacaggccttc

SEQ ID NO: 470210 - DNA, 25 bp, Mus musculus
tcaccgtggtgaagacgtggctgtc

SEQ ID NO: 470211 - DNA, 25 bp, Mus musculus
tcaccgtgtggttctaccgagacag

SEQ ID NO: 470212 - DNA, 25 bp, Mus musculus
tcaccgttgaggaggacagctatct

SEQ ID NO: 470213 - DNA, 25 bp, Mus musculus
tcacctaaagagcatgagcagacat

SEQ ID NO: 470214 - DNA, 25 bp, Mus musculus
tcacctaaggacgacatggagtccc

SEQ ID NO: 470215 - DNA, 25 bp, Mus musculus
tcacctacggtgaggggaagctact

SEQ ID NO: 470216 - DNA, 25 bp, Mus musculus
tcacctagagaacatcttcagcctg

SEQ ID NO: 470217 - DNA, 25 bp, Mus musculus
tcacctatggcccactgaagagggc

SEQ ID NO: 470218 - DNA, 25 bp, Mus musculus
tcacctatggcgtcagtcagctgtt

SEQ ID NO: 470219 - DNA, 25 bp, Mus musculus
tcacctatgtcttgcaaaggcctaa

SEQ ID NO: 470220 - DNA, 25 bp, Mus musculus
tcacctcagagcagaaggccaaagc

SEQ ID NO: 470221 - DNA, 25 bp, Mus musculus
tcacctccaaggagatgtccgctgg

SEQ ID NO: 470222 - DNA, 25 bp, Mus musculus
tcacctccggtctcaagtgtcatgg

SEQ ID NO: 470223 - DNA, 25 bp, Mus musculus
tcacctctgactgtgggtttcaagg

SEQ ID NO: 470224 - DNA, 25 bp, Mus musculus
tcacctctgcatccttcggaaggga

SEQ ID NO: 470225 - DNA, 25 bp, Mus musculus
tcacctctggcctaaagacatcagg

SEQ ID NO: 470226 - DNA, 25 bp, Mus musculus
tcacctgaacagaggatacgctggg

SEQ ID NO: 470227 - DNA, 25 bp, Mus musculus
tcacctgaagaaggcaatgcagact

SEQ ID NO: 470228 - DNA, 25 bp, Mus musculus
tcacctgaagggaaaagcggctgct

SEQ ID NO: 470229 - DNA, 25 bp, Mus musculus
tcacctgaatcctgagggaatccag

SEQ ID NO: 470230 - DNA, 25 bp, Mus musculus
tcacctgaattgttgccagcatatc

SEQ ID NO: 470231 - DNA, 25 bp, Mus musculus
tcacctgagagcctgctcgtgccag

SEQ ID NO: 470232 - DNA, 25 bp, Mus musculus
tcacctgcagtagcgtatcgttctg

SEQ ID NO: 470233 - DNA, 25 bp, Mus musculus
tcacctgcccagagcttcagggaca

SEQ ID NO: 470234 - DNA, 25 bp, Mus musculus
tcacctgccggccaaaagagagtgg

SEQ ID NO: 470235 - DNA, 25 bp, Mus musculus
tcacctgcctgaagccaagatccag

SEQ ID NO: 470236 - DNA, 25 bp, Mus musculus
tcacctgctagtccaagtgggaagg

SEQ ID NO: 470237 - DNA, 25 bp, Mus musculus
tcacctgctgctctaaagatggaaa

SEQ ID NO: 470238 - DNA, 25 bp, Mus musculus
tcacctgctggaatttgcagagccg

SEQ ID NO: 470239 - DNA, 25 bp, Mus musculus
tcacctggatcattaagaagcagcc

SEQ ID NO: 470240 - DNA, 25 bp, Mus musculus
tcacctggattgtgcagaagacgcc

SEQ ID NO: 470241 - DNA, 25 bp, Mus musculus
tcacctgggcagtggacagccacag

SEQ ID NO: 470242 - DNA, 25 bp, Mus musculus
tcacctggtgacaggcagggctcct

SEQ ID NO: 470243 - DNA, 25 bp, Mus musculus
tcacctggttatagaagcacgcttt

SEQ ID NO: 470244 - DNA, 25 bp, Mus musculus
tcacctgtgaatgctgatgctctac

SEQ ID NO: 470245 - DNA, 25 bp, Mus musculus
tcacctgtgatgctgtacgaaacaa

SEQ ID NO: 470246 - DNA, 25 bp, Mus musculus
tcacctgtgcaagagggactgcgaa

SEQ ID NO: 470247 - DNA, 25 bp, Mus musculus
tcacctgtgctctcaaccgtgtggg

SEQ ID NO: 470248 - DNA, 25 bp, Mus musculus
tcacctgtgctgagagctgtagcct

SEQ ID NO: 470249 - DNA, 25 bp, Mus musculus
tcacctgtgggaaccaagatagtcc

SEQ ID NO: 470250 - DNA, 25 bp, Mus musculus
tcaccttaagtgtgtcagggcagag

SEQ ID NO: 470251 - DNA, 25 bp, Mus musculus
tcaccttagaggagaagtggcaccg

SEQ ID NO: 470252 - DNA, 25 bp, Mus musculus
tcaccttcttcacttttctgggagc

SEQ ID NO: 470253 - DNA, 25 bp, Mus musculus
tcaccttgaatgaggaaatcctggc

SEQ ID NO: 470254 - DNA, 25 bp, Mus musculus
tcaccttgcgatttgtgacatcagc

SEQ ID NO: 470255 - DNA, 25 bp, Mus musculus
tcaccttgctcaggaatgtgtgtcc

SEQ ID NO: 470256 - DNA, 25 bp, Mus musculus
tcaccttgctctgggcgtactatgt

SEQ ID NO: 470257 - DNA, 25 bp, Mus musculus
tcaccttggatagaagccctcttcg

SEQ ID NO: 470258 - DNA, 25 bp, Mus musculus
tcaccttggccatgaagaagttgtc

SEQ ID NO: 470259 - DNA, 25 bp, Mus musculus
tcaccttgggaacatggccttgcca

SEQ ID NO: 470260 - DNA, 25 bp, Mus musculus
tcacctttgtatgcacacctgtctt

SEQ ID NO: 470261 - DNA, 25 bp, Mus musculus
tcacgaaagcgcttgggagcactcg

SEQ ID NO: 470262 - DNA, 25 bp, Mus musculus
tcacgaaaggcaaagagtcccaagc

SEQ ID NO: 470263 - DNA, 25 bp, Mus musculus
tcacgaagacgtacctttccaggcg

SEQ ID NO: 470264 - DNA, 25 bp, Mus musculus
tcacgaagcagagcatgtggcatgt

SEQ ID NO: 470265 - DNA, 25 bp, Mus musculus
tcacgacaaaatctgcgggaccggt

SEQ ID NO: 470266 - DNA, 25 bp, Mus musculus
tcacgacaagctgcagaaggccttc

SEQ ID NO: 470267 - DNA, 25 bp, Mus musculus
tcacgacaatgaagacctcctagcg

SEQ ID NO: 470268 - DNA, 25 bp, Mus musculus
tcacgactcccttgctgcttacatt

SEQ ID NO: 470269 - DNA, 25 bp, Mus musculus
tcacgagaagtcaagatgacaacat

SEQ ID NO: 470270 - DNA, 25 bp, Mus musculus
tcacgagacactggtgcattgcagg

SEQ ID NO: 470271 - DNA, 25 bp, Mus musculus
tcacgagatcgaggaaaagagggtc

SEQ ID NO: 470272 - DNA, 25 bp, Mus musculus
tcacgagatgaaaggacagacggcc

SEQ ID NO: 470273 - DNA, 25 bp, Mus musculus
tcacgaggaacatgtggcaggccta

SEQ ID NO: 470274 - DNA, 25 bp, Mus musculus
tcacgaggcagcagagctaaaccgt

SEQ ID NO: 470275 - DNA, 25 bp, Mus musculus
tcacgaggccgagagctatcacaat

SEQ ID NO: 470276 - DNA, 25 bp, Mus musculus
tcacgagtgaccatgagccctggtt

SEQ ID NO: 470277 - DNA, 25 bp, Mus musculus
tcacgagtgggtagagagtccctcc

SEQ ID NO: 470278 - DNA, 25 bp, Mus musculus
tcacgataaggcagttcaaagccca

SEQ ID NO: 470279 - DNA, 25 bp, Mus musculus
tcacgatgatactcgcccaggagag

SEQ ID NO: 470280 - DNA, 25 bp, Mus musculus
tcacgatggctatggcgcctacagc

SEQ ID NO: 470281 - DNA, 25 bp, Mus musculus
tcacgattcatgcaggtgcgctcgc

SEQ ID NO: 470282 - DNA, 25 bp, Mus musculus
tcacgcaaactccaatgtggccatg

SEQ ID NO: 470283 - DNA, 25 bp, Mus musculus
tcacgcacagaagagccacggaaat

SEQ ID NO: 470284 - DNA, 25 bp, Mus musculus
tcacgcagaaaggttaaaggctcac

SEQ ID NO: 470285 - DNA, 25 bp, Mus musculus
tcacgcagggaggttcaagtagttc

SEQ ID NO: 470286 - DNA, 25 bp, Mus musculus
tcacgcagggtgacttaggcctcat

SEQ ID NO: 470287 - DNA, 25 bp, Mus musculus
tcacgcatacctgggctgtgtcctt

SEQ ID NO: 470288 - DNA, 25 bp, Mus musculus
tcacgcatactgaggaacggccttt

SEQ ID NO: 470289 - DNA, 25 bp, Mus musculus
tcacgccgagcacatggtccgggat

SEQ ID NO: 470290 - DNA, 25 bp, Mus musculus
tcacgcctggatagttggccacaag

SEQ ID NO: 470291 - DNA, 25 bp, Mus musculus
tcacgcgggacggaagaacttgccc

SEQ ID NO: 470292 - DNA, 25 bp, Mus musculus
tcacgctcgtgaggcaaaaacgcga

SEQ ID NO: 470293 - DNA, 25 bp, Mus musculus
tcacgctgcttctgccgggttgggc

SEQ ID NO: 470294 - DNA, 25 bp, Mus musculus
tcacgctggagaccgatatggacag

SEQ ID NO: 470295 - DNA, 25 bp, Mus musculus
tcacgctggccaagaactatatcaa

SEQ ID NO: 470296 - DNA, 25 bp, Mus musculus
tcacgctgggcattgtctgtctgtc

SEQ ID NO: 470297 - DNA, 25 bp, Mus musculus
tcacggacccttttaggagtctcgg

SEQ ID NO: 470298 - DNA, 25 bp, Mus musculus
tcacggacctaatcaagctcacggg

SEQ ID NO: 470299 - DNA, 25 bp, Mus musculus
tcacggagaacaatactgctgccag

SEQ ID NO: 470300 - DNA, 25 bp, Mus musculus
tcacggagacgcagagaccttgggt

SEQ ID NO: 470301 - DNA, 25 bp, Mus musculus
tcacggagatcacagagcacagtct

SEQ ID NO: 470302 - DNA, 25 bp, Mus musculus
tcacggagctgatccaagtgtctcg

SEQ ID NO: 470303 - DNA, 25 bp, Mus musculus
tcacggaggtgaaggctacgatgtc

SEQ ID NO: 470304 - DNA, 25 bp, Mus musculus
tcacggagttttgcctcagcgctgg

SEQ ID NO: 470305 - DNA, 25 bp, Mus musculus
tcacggcagttaccagagctgaccc

SEQ ID NO: 470306 - DNA, 25 bp, Mus musculus
tcacggccaaacagggcaagacagg

SEQ ID NO: 470307 - DNA, 25 bp, Mus musculus
tcacggccctcaaaaggatggtgag

SEQ ID NO: 470308 - DNA, 25 bp, Mus musculus
tcacggccgagttcaaggaaacgag

SEQ ID NO: 470309 - DNA, 25 bp, Mus musculus
tcacggccgcaactgcagtttctgg

SEQ ID NO: 470310 - DNA, 25 bp, Mus musculus
tcacggcctgggtgaacttcgccaa

SEQ ID NO: 470311 - DNA, 25 bp, Mus musculus
tcacggcgctgagaagatggcaaga

SEQ ID NO: 470312 - DNA, 25 bp, Mus musculus
tcacggctactatgttcggcctcgg

SEQ ID NO: 470313 - DNA, 25 bp, Mus musculus
tcacggctcagggatgtctacagca

SEQ ID NO: 470314 - DNA, 25 bp, Mus musculus
tcacgggaactctccggaagactag

SEQ ID NO: 470315 - DNA, 25 bp, Mus musculus
tcacgggaagaaaactggcaagagt

SEQ ID NO: 470316 - DNA, 25 bp, Mus musculus
tcacgggacctttgcagagaaacgc

SEQ ID NO: 470317 - DNA, 25 bp, Mus musculus
tcacgggactggatgcaactttaaa

SEQ ID NO: 470318 - DNA, 25 bp, Mus musculus
tcacgggcactttcgacggattcca

SEQ ID NO: 470319 - DNA, 25 bp, Mus musculus
tcacgggcggatcacaaagatttgc

SEQ ID NO: 470320 - DNA, 25 bp, Mus musculus
tcacgggcgtccagaatttcagcag

SEQ ID NO: 470321 - DNA, 25 bp, Mus musculus
tcacgggctctgctactctataagg

SEQ ID NO: 470322 - DNA, 25 bp, Mus musculus
tcacgggctgccacctgagtgtgga

SEQ ID NO: 470323 - DNA, 25 bp, Mus musculus
tcacgggctgcttttcacaatgcgg

SEQ ID NO: 470324 - DNA, 25 bp, Mus musculus
tcacgggtacagttcagctttgggt

SEQ ID NO: 470325 - DNA, 25 bp, Mus musculus
tcacggtaaatggtcaagagtatca

SEQ ID NO: 470326 - DNA, 25 bp, Mus musculus
tcacggtagtgacttctccacgcct

SEQ ID NO: 470327 - DNA, 25 bp, Mus musculus
tcacggtatagaatccagacattgc

SEQ ID NO: 470328 - DNA, 25 bp, Mus musculus
tcacggtcgaggagctgtatagcca

SEQ ID NO: 470329 - DNA, 25 bp, Mus musculus
tcacggtgaacatactcaccatggg

SEQ ID NO: 470330 - DNA, 25 bp, Mus musculus
tcacggtgataagtaacatcagact

SEQ ID NO: 470331 - DNA, 25 bp, Mus musculus
tcacggtgccttggtgtcagcagca

SEQ ID NO: 470332 - DNA, 25 bp, Mus musculus
tcacggtggaacaggacgacatcct

SEQ ID NO: 470333 - DNA, 25 bp, Mus musculus
tcacggtgggcttcatgtggcatca

SEQ ID NO: 470334 - DNA, 25 bp, Mus musculus
tcacggtgttcacccccgagtacag

SEQ ID NO: 470335 - DNA, 25 bp, Mus musculus
tcacggtgtttgtagaagagcccct

SEQ ID NO: 470336 - DNA, 25 bp, Mus musculus
tcacggtttagatcccaacacttgg

SEQ ID NO: 470337 - DNA, 25 bp, Mus musculus
tcacgtacaacatctagggtcaggc

SEQ ID NO: 470338 - DNA, 25 bp, Mus musculus
tcacgtatgtgatttggctctggac

SEQ ID NO: 470339 - DNA, 25 bp, Mus musculus
tcacgtattgagaggcgcagggctc

SEQ ID NO: 470340 - DNA, 25 bp, Mus musculus
tcacgtcacagatcgatccacagcg

SEQ ID NO: 470341 - DNA, 25 bp, Mus musculus
tcacgtcctctgacagattgggtgg

SEQ ID NO: 470342 - DNA, 25 bp, Mus musculus
tcacgtcctgaaaaacaaacctgtt

SEQ ID NO: 470343 - DNA, 25 bp, Mus musculus
tcacgtctgataatggtgcggccct

SEQ ID NO: 470344 - DNA, 25 bp, Mus musculus
tcacgtctggagtgtagcatcgccc

SEQ ID NO: 470345 - DNA, 25 bp, Mus musculus
tcacgtgaactcaggattgatcagg

SEQ ID NO: 470346 - DNA, 25 bp, Mus musculus
tcacgtgacacggaagtgactccga

SEQ ID NO: 470347 - DNA, 25 bp, Mus musculus
tcacgtgagcgagagcattggcatc

SEQ ID NO: 470348 - DNA, 25 bp, Mus musculus
tcacgtgagcttcattgcagccgcc

SEQ ID NO: 470349 - DNA, 25 bp, Mus musculus
tcacgtgcgcacactaaagatcatg

SEQ ID NO: 470350 - DNA, 25 bp, Mus musculus
tcacgtgctcggacttggaaggcct

SEQ ID NO: 470351 - DNA, 25 bp, Mus musculus
tcacgtggaggagagcgtaaagcca

SEQ ID NO: 470352 - DNA, 25 bp, Mus musculus
tcacgtggcaaaactccactgaaga

SEQ ID NO: 470353 - DNA, 25 bp, Mus musculus
tcacgtggcgtttgcatttcctgca

SEQ ID NO: 470354 - DNA, 25 bp, Mus musculus
tcacgtgtagggagacaagcagctt

SEQ ID NO: 470355 - DNA, 25 bp, Mus musculus
tcacgtgtccccactgagactctag

SEQ ID NO: 470356 - DNA, 25 bp, Mus musculus
tcacgtgtgggcttcagtgcatgtg

SEQ ID NO: 470357 - DNA, 25 bp, Mus musculus
tcacgtgtgtcgctaagtaaaatgc

SEQ ID NO: 470358 - DNA, 25 bp, Mus musculus
tcacgttagttcatccagcagcagg

SEQ ID NO: 470359 - DNA, 25 bp, Mus musculus
tcacgttccagtatcacctcatcat

SEQ ID NO: 470360 - DNA, 25 bp, Mus musculus
tcacgttcggtctggtgggaaatct

SEQ ID NO: 470361 - DNA, 25 bp, Mus musculus
tcactaaagcaagggatgatcccga

SEQ ID NO: 470362 - DNA, 25 bp, Mus musculus
tcactaacagcatgagggccatcct

SEQ ID NO: 470363 - DNA, 25 bp, Mus musculus
tcactaaggcaaagagtttaaagcc

SEQ ID NO: 470364 - DNA, 25 bp, Mus musculus
tcactaaggctgaccaagatctggg

SEQ ID NO: 470365 - DNA, 25 bp, Mus musculus
tcactaatgtaggaggcacagcacc

SEQ ID NO: 470366 - DNA, 25 bp, Mus musculus
tcactacatgtcagtgtaacagagc

SEQ ID NO: 470367 - DNA, 25 bp, Mus musculus
tcactacgagctggtcactggcaaa

SEQ ID NO: 470368 - DNA, 25 bp, Mus musculus
tcactacgtggaacaggtgctacgc

SEQ ID NO: 470369 - DNA, 25 bp, Mus musculus
tcactactacttgaacgaggcaggg

SEQ ID NO: 470370 - DNA, 25 bp, Mus musculus
tcactactcgggaatgtctcggcga

SEQ ID NO: 470371 - DNA, 25 bp, Mus musculus
tcactactgcattgcacacctcagg

SEQ ID NO: 470372 - DNA, 25 bp, Mus musculus
tcactactgtaggagccttcgcagc

SEQ ID NO: 470373 - DNA, 25 bp, Mus musculus
tcactagacgggaatcagagcggct

SEQ ID NO: 470374 - DNA, 25 bp, Mus musculus
tcactagactgaagctcacaagaat

SEQ ID NO: 470375 - DNA, 25 bp, Mus musculus
tcactaggagagatgctgttcacac

SEQ ID NO: 470376 - DNA, 25 bp, Mus musculus
tcactaggtcctcaagatctacagc

SEQ ID NO: 470377 - DNA, 25 bp, Mus musculus
tcactagtagacagtacgacgtggc

SEQ ID NO: 470378 - DNA, 25 bp, Mus musculus
tcactagtgggcgaagcgactgtgc

SEQ ID NO: 470379 - DNA, 25 bp, Mus musculus
tcactatcagtgagaagctgctcaa

SEQ ID NO: 470380 - DNA, 25 bp, Mus musculus
tcactatccttacttgagacaaccc

SEQ ID NO: 470381 - DNA, 25 bp, Mus musculus
tcactatgtggaccaagctgggctc

SEQ ID NO: 470382 - DNA, 25 bp, Mus musculus
tcactcacttgacagaatcttggaa

SEQ ID NO: 470383 - DNA, 25 bp, Mus musculus
tcactcagaacacagctgggcaagg

SEQ ID NO: 470384 - DNA, 25 bp, Mus musculus
tcactcagagacactcggatgctgg

SEQ ID NO: 470385 - DNA, 25 bp, Mus musculus
tcactcaggagaaaggaactgaaag

SEQ ID NO: 470386 - DNA, 25 bp, Mus musculus
tcactcaggtatgtggtccgaagca

SEQ ID NO: 470387 - DNA, 25 bp, Mus musculus
tcactcaggttcaggagccagctct

SEQ ID NO: 470388 - DNA, 25 bp, Mus musculus
tcactcagtgacagatggacaatgc

SEQ ID NO: 470389 - DNA, 25 bp, Mus musculus
tcactcatcggaccgagttgtggcc

SEQ ID NO: 470390 - DNA, 25 bp, Mus musculus
tcactcatctgcgaaagtgtgagag

SEQ ID NO: 470391 - DNA, 25 bp, Mus musculus
tcactcatgccctggcaataaaacc

SEQ ID NO: 470392 - DNA, 25 bp, Mus musculus
tcactcccagagcaagaggtgtccc

SEQ ID NO: 470393 - DNA, 25 bp, Mus musculus
tcactccctggatgaaaatgggctg

SEQ ID NO: 470394 - DNA, 25 bp, Mus musculus
tcactcctagagctgcctgttgacc

SEQ ID NO: 470395 - DNA, 25 bp, Mus musculus
tcactcctagcacagcggatggaag

SEQ ID NO: 470396 - DNA, 25 bp, Mus musculus
tcactcctgtgcattcattgaagcc

SEQ ID NO: 470397 - DNA, 25 bp, Mus musculus
tcactccttggtccttaatgatagt

SEQ ID NO: 470398 - DNA, 25 bp, Mus musculus
tcactcgacctgcagtgttgtgggc

SEQ ID NO: 470399 - DNA, 25 bp, Mus musculus
tcactcgagtagatggacactccag

SEQ ID NO: 470400 - DNA, 25 bp, Mus musculus
tcactcgccttgacacactgagtca

SEQ ID NO: 470401 - DNA, 25 bp, Mus musculus
tcactcgctcggctatcaggagagc

SEQ ID NO: 470402 - DNA, 25 bp, Mus musculus
tcactcggagcttgagtcccgggct

SEQ ID NO: 470403 - DNA, 25 bp, Mus musculus
tcactcgggaactactactgctgtc

SEQ ID NO: 470404 - DNA, 25 bp, Mus musculus
tcactcgggtgacatcctgcagggt

SEQ ID NO: 470405 - DNA, 25 bp, Mus musculus
tcactctactccacagaggtggtgg

SEQ ID NO: 470406 - DNA, 25 bp, Mus musculus
tcactctccggacgtcgcagaggct

SEQ ID NO: 470407 - DNA, 25 bp, Mus musculus
tcactctctcctaagtccgttcaaa

SEQ ID NO: 470408 - DNA, 25 bp, Mus musculus
tcactctggaacaaagctactgggc

SEQ ID NO: 470409 - DNA, 25 bp, Mus musculus
tcactctgggcaggttcatctccat

SEQ ID NO: 470410 - DNA, 25 bp, Mus musculus
tcactctgggtgcatacctgggcca

SEQ ID NO: 470411 - DNA, 25 bp, Mus musculus
tcactctgtggtagactgtgccgag

SEQ ID NO: 470412 - DNA, 25 bp, Mus musculus
tcactcttgttagctgggaccatgc

SEQ ID NO: 470413 - DNA, 25 bp, Mus musculus
tcactctttggaggtcgaccttgac

SEQ ID NO: 470414 - DNA, 25 bp, Mus musculus
tcactgaaaacgatggcgacaaagc

SEQ ID NO: 470415 - DNA, 25 bp, Mus musculus
tcactgaaacactgactgtggggta

SEQ ID NO: 470416 - DNA, 25 bp, Mus musculus
tcactgaaacttgcgcctggactag

SEQ ID NO: 470417 - DNA, 25 bp, Mus musculus
tcactgacaatgaactacatgaaca

SEQ ID NO: 470418 - DNA, 25 bp, Mus musculus
tcactgacgtgagacagagcatccc

SEQ ID NO: 470419 - DNA, 25 bp, Mus musculus
tcactgactccttgaataaccaaag

SEQ ID NO: 470420 - DNA, 25 bp, Mus musculus
tcactgactctgaagaaagggtaat

SEQ ID NO: 470421 - DNA, 25 bp, Mus musculus
tcactgagaagagccaatctaagag

SEQ ID NO: 470422 - DNA, 25 bp, Mus musculus
tcactgagagaaaagaaagtcggcc

SEQ ID NO: 470423 - DNA, 25 bp, Mus musculus
tcactgagatgacaggagcgagcac

SEQ ID NO: 470424 - DNA, 25 bp, Mus musculus
tcactgagatgaggagggactgtcc

SEQ ID NO: 470425 - DNA, 25 bp, Mus musculus
tcactgaggagcatctgactggcca

SEQ ID NO: 470426 - DNA, 25 bp, Mus musculus
tcactgaggctctgatatgacggca

SEQ ID NO: 470427 - DNA, 25 bp, Mus musculus
tcactgatagagaaaagccggaggc

SEQ ID NO: 470428 - DNA, 25 bp, Mus musculus
tcactgatagccactagagtgctaa

SEQ ID NO: 470429 - DNA, 25 bp, Mus musculus
tcactgatgacgacaggctgaacca

SEQ ID NO: 470430 - DNA, 25 bp, Mus musculus
tcactgatgggacacttcgggagca

SEQ ID NO: 470431 - DNA, 25 bp, Mus musculus
tcactgatggtgaagaagacgcaga

SEQ ID NO: 470432 - DNA, 25 bp, Mus musculus
tcactgcaaggaggagctcggctcc

SEQ ID NO: 470433 - DNA, 25 bp, Mus musculus
tcactgcaatcctttcttatctggg

SEQ ID NO: 470434 - DNA, 25 bp, Mus musculus
tcactgcagtgttaccggagcttcc

SEQ ID NO: 470435 - DNA, 25 bp, Mus musculus
tcactgccagcggtgccagaagcag

SEQ ID NO: 470436 - DNA, 25 bp, Mus musculus
tcactgccggtgacaagctgcgtct

SEQ ID NO: 470437 - DNA, 25 bp, Mus musculus
tcactgcctttttagagcttcctaa

SEQ ID NO: 470438 - DNA, 25 bp, Mus musculus
tcactgcgaggtagacgaatgtcac

SEQ ID NO: 470439 - DNA, 25 bp, Mus musculus
tcactgcgtgaacacagaaggtggc

SEQ ID NO: 470440 - DNA, 25 bp, Mus musculus
tcactgctacaccagagacaacggg

SEQ ID NO: 470441 - DNA, 25 bp, Mus musculus
tcactgctctggataggaaaggaca

SEQ ID NO: 470442 - DNA, 25 bp, Mus musculus
tcactgctgaaagaggtgctcctca

SEQ ID NO: 470443 - DNA, 25 bp, Mus musculus
tcactgctgcacaagtttggaatgc

SEQ ID NO: 470444 - DNA, 25 bp, Mus musculus
tcactgctgtgaggatccaggtcct

SEQ ID NO: 470445 - DNA, 25 bp, Mus musculus
tcactgctgttcgacagggtctttg

SEQ ID NO: 470446 - DNA, 25 bp, Mus musculus
tcactgcttcactcaccagaatggg

SEQ ID NO: 470447 - DNA, 25 bp, Mus musculus
tcactggaaagttcgtctgggcctc

SEQ ID NO: 470448 - DNA, 25 bp, Mus musculus
tcactggaccgtgccaagcataggg

SEQ ID NO: 470449 - DNA, 25 bp, Mus musculus
tcactggatggatagcttactgctc

SEQ ID NO: 470450 - DNA, 25 bp, Mus musculus
tcactggcaacttcccgtgggaggc

SEQ ID NO: 470451 - DNA, 25 bp, Mus musculus
tcactggcaagctggagagaacgct

SEQ ID NO: 470452 - DNA, 25 bp, Mus musculus
tcactggcaggaaggagccgctgat

SEQ ID NO: 470453 - DNA, 25 bp, Mus musculus
tcactggccacgagactctgggcag

SEQ ID NO: 470454 - DNA, 25 bp, Mus musculus
tcactggccttacgtgcctattagt

SEQ ID NO: 470455 - DNA, 25 bp, Mus musculus
tcactggcgcttagggacagaagtt

SEQ ID NO: 470456 - DNA, 25 bp, Mus musculus
tcactgggacctgggctttaccacg

SEQ ID NO: 470457 - DNA, 25 bp, Mus musculus
tcactgggataaacacgctaggcgg

SEQ ID NO: 470458 - DNA, 25 bp, Mus musculus
tcactgggtaggaacaaaactgggc

SEQ ID NO: 470459 - DNA, 25 bp, Mus musculus
tcactgggttcagaaagagacactg

SEQ ID NO: 470460 - DNA, 25 bp, Mus musculus
tcactggtagatagacggacacctg

SEQ ID NO: 470461 - DNA, 25 bp, Mus musculus
tcactggtgcttctcacccaaactt

SEQ ID NO: 470462 - DNA, 25 bp, Mus musculus
tcactgtaccgagatatagcaaagc

SEQ ID NO: 470463 - DNA, 25 bp, Mus musculus
tcactgtcaagagggcaaactgcag

SEQ ID NO: 470464 - DNA, 25 bp, Mus musculus
tcactgtcacgtttgttagagctcc

SEQ ID NO: 470465 - DNA, 25 bp, Mus musculus
tcactgtcaggctatatccgaaacg

SEQ ID NO: 470466 - DNA, 25 bp, Mus musculus
tcactgtcattttgccagtggcagc

SEQ ID NO: 470467 - DNA, 25 bp, Mus musculus
tcactgtccccatacacactggaga

SEQ ID NO: 470468 - DNA, 25 bp, Mus musculus
tcactgtctacccattattaaaaag

SEQ ID NO: 470469 - DNA, 25 bp, Mus musculus
tcactgtctactgcctcctgggaga

SEQ ID NO: 470470 - DNA, 25 bp, Mus musculus
tcactgtgactatgggtggtccccg

SEQ ID NO: 470471 - DNA, 25 bp, Mus musculus
tcactgtggaagcttagggacagac

SEQ ID NO: 470472 - DNA, 25 bp, Mus musculus
tcactgtggccgtgtgcagagaaca

SEQ ID NO: 470473 - DNA, 25 bp, Mus musculus
tcactgtgggaggaatgagcacctc

SEQ ID NO: 470474 - DNA, 25 bp, Mus musculus
tcactgtggtccagaatgggagaca

SEQ ID NO: 470475 - DNA, 25 bp, Mus musculus
tcactgtggtcctgctcgtagctgg

SEQ ID NO: 470476 - DNA, 25 bp, Mus musculus
tcactgtggtcttgaagacgagcca

SEQ ID NO: 470477 - DNA, 25 bp, Mus musculus
tcactgtggtggtcgtctacattcc

SEQ ID NO: 470478 - DNA, 25 bp, Mus musculus
tcactgtgtcaagagacgtcccttc

SEQ ID NO: 470479 - DNA, 25 bp, Mus musculus
tcactgttcgggagcgtggaaacgt

SEQ ID NO: 470480 - DNA, 25 bp, Mus musculus
tcactgttgaagcagaggcgaaagc

SEQ ID NO: 470481 - DNA, 25 bp, Mus musculus
tcactgttgggcacgttggctaagg

SEQ ID NO: 470482 - DNA, 25 bp, Mus musculus
tcacttaaggaccagtgggtgttgc

SEQ ID NO: 470483 - DNA, 25 bp, Mus musculus
tcacttagtggccatgacatctcaa

SEQ ID NO: 470484 - DNA, 25 bp, Mus musculus
tcacttatgaacctgtcgagagaac

SEQ ID NO: 470485 - DNA, 25 bp, Mus musculus
tcacttcaaaaaacagcccggtggc

SEQ ID NO: 470486 - DNA, 25 bp, Mus musculus
tcacttcaatcccaagggaaggcag

SEQ ID NO: 470487 - DNA, 25 bp, Mus musculus
tcacttcgaggacgactcgggctcg

SEQ ID NO: 470488 - DNA, 25 bp, Mus musculus
tcacttcgcgtgatagcccagaaac

SEQ ID NO: 470489 - DNA, 25 bp, Mus musculus
tcacttctgagcatcaagatttggc

SEQ ID NO: 470490 - DNA, 25 bp, Mus musculus
tcacttctgaggagatgagtacctc

SEQ ID NO: 470491 - DNA, 25 bp, Mus musculus
tcacttctggatccaaatcattggt

SEQ ID NO: 470492 - DNA, 25 bp, Mus musculus
tcacttgataagaaagccagcagag

SEQ ID NO: 470493 - DNA, 25 bp, Mus musculus
tcacttgcacagaatcaggatggtc

SEQ ID NO: 470494 - DNA, 25 bp, Mus musculus
tcacttgctagaactcgaagggcgg

SEQ ID NO: 470495 - DNA, 25 bp, Mus musculus
tcacttggagactgtgcaggcaact

SEQ ID NO: 470496 - DNA, 25 bp, Mus musculus
tcacttgggtttgagcctttagtaa

SEQ ID NO: 470497 - DNA, 25 bp, Mus musculus
tcacttggtggttcccaggcgagag

SEQ ID NO: 470498 - DNA, 25 bp, Mus musculus
tcacttggtttctgctccctctcta

SEQ ID NO: 470499 - DNA, 25 bp, Mus musculus
tcacttgtggaggttgatccgagca

SEQ ID NO: 470500 - DNA, 25 bp, Mus musculus
tcactttacgtctctactgggaaac

SEQ ID NO: 470501 - DNA, 25 bp, Mus musculus
tcactttgagaagaggaccgcacat

SEQ ID NO: 470502 - DNA, 25 bp, Mus musculus
tcactttgatcctgaggcctgcagc

SEQ ID NO: 470503 - DNA, 25 bp, Mus musculus
tcactttgatgtaagccacggctct

SEQ ID NO: 470504 - DNA, 25 bp, Mus musculus
tcacttttggtcttgactgggttcc

SEQ ID NO: 470505 - DNA, 25 bp, Mus musculus
tcagaaaaaggatggcaagaaacgc

SEQ ID NO: 470506 - DNA, 25 bp, Mus musculus
tcagaaaacaagctcagtcgccggc

SEQ ID NO: 470507 - DNA, 25 bp, Mus musculus
tcagaaaacacaaaggtaagtaagg

SEQ ID NO: 470508 - DNA, 25 bp, Mus musculus
tcagaaaagaacaggcacaaaggct

SEQ ID NO: 470509 - DNA, 25 bp, Mus musculus
tcagaaaagcagtgaggtagcatgt

SEQ ID NO: 470510 - DNA, 25 bp, Mus musculus
tcagaaaagccaaaatccgacgacg

SEQ ID NO: 470511 - DNA, 25 bp, Mus musculus
tcagaaaaggctgacacagagcagt

SEQ ID NO: 470512 - DNA, 25 bp, Mus musculus
tcagaaaataacagaactccggccc

SEQ ID NO: 470513 - DNA, 25 bp, Mus musculus
tcagaaaatatctagaagacccaag

SEQ ID NO: 470514 - DNA, 25 bp, Mus musculus
tcagaaaatgcagatgtcccagtgg

SEQ ID NO: 470515 - DNA, 25 bp, Mus musculus
tcagaaaatggagttcccgctactc

SEQ ID NO: 470516 - DNA, 25 bp, Mus musculus
tcagaaaatggcagtaatcagctgc

SEQ ID NO: 470517 - DNA, 25 bp, Mus musculus
tcagaaaatttcagcctcgtggata

SEQ ID NO: 470518 - DNA, 25 bp, Mus musculus
tcagaaacaacaaaagccgcgctgg

SEQ ID NO: 470519 - DNA, 25 bp, Mus musculus
tcagaaacacgtacacacgggagag

SEQ ID NO: 470520 - DNA, 25 bp, Mus musculus
tcagaaacagacacggagaccatcg

SEQ ID NO: 470521 - DNA, 25 bp, Mus musculus
tcagaaacagggttagccatgggct

SEQ ID NO: 470522 - DNA, 25 bp, Mus musculus
tcagaaacgggatgatggagagcca

SEQ ID NO: 470523 - DNA, 25 bp, Mus musculus
tcagaaactgggacatgccctgctc

SEQ ID NO: 470524 - DNA, 25 bp, Mus musculus
tcagaaagagattagccagctggcc

SEQ ID NO: 470525 - DNA, 25 bp, Mus musculus
tcagaaagatccaccaggctgcaag

SEQ ID NO: 470526 - DNA, 25 bp, Mus musculus
tcagaaaggcagtatgatgctacct

SEQ ID NO: 470527 - DNA, 25 bp, Mus musculus
tcagaaagtgacgtaagggcctacc

SEQ ID NO: 470528 - DNA, 25 bp, Mus musculus
tcagaaagttacagctcaggcccag

SEQ ID NO: 470529 - DNA, 25 bp, Mus musculus
tcagaaatactagggacctggagcc

SEQ ID NO: 470530 - DNA, 25 bp, Mus musculus
tcagaaataggcttgggaatcatcc

SEQ ID NO: 470531 - DNA, 25 bp, Mus musculus
tcagaaatcaccgatccagagagct

SEQ ID NO: 470532 - DNA, 25 bp, Mus musculus
tcagaaatctccaacattgcacggg

SEQ ID NO: 470533 - DNA, 25 bp, Mus musculus
tcagaaatgctttgccttgggacaa

SEQ ID NO: 470534 - DNA, 25 bp, Mus musculus
tcagaaatggagcaaagagttaacc

SEQ ID NO: 470535 - DNA, 25 bp, Mus musculus
tcagaacaacttgacggactggctc

SEQ ID NO: 470536 - DNA, 25 bp, Mus musculus
tcagaacaccaccaaggacaggaag

SEQ ID NO: 470537 - DNA, 25 bp, Mus musculus
tcagaacacttctgtgcacagaaag

SEQ ID NO: 470538 - DNA, 25 bp, Mus musculus
tcagaaccactatctgaggaaaggc

SEQ ID NO: 470539 - DNA, 25 bp, Mus musculus
tcagaaccagttcccctgactctgg

SEQ ID NO: 470540 - DNA, 25 bp, Mus musculus
tcagaaccatgtgcagggtgttccc

SEQ ID NO: 470541 - DNA, 25 bp, Mus musculus
tcagaaccattgcttcaggaaacgg

SEQ ID NO: 470542 - DNA, 25 bp, Mus musculus
tcagaaccccgatgacaacgagtga

SEQ ID NO: 470543 - DNA, 25 bp, Mus musculus
tcagaaccctgaaggcaagagagca

SEQ ID NO: 470544 - DNA, 25 bp, Mus musculus
tcagaacctggtacccgactggaga

SEQ ID NO: 470545 - DNA, 25 bp, Mus musculus
tcagaacgctgacaatgtgggcacc

SEQ ID NO: 470546 - DNA, 25 bp, Mus musculus
tcagaacggagccatgtgtcaccat

SEQ ID NO: 470547 - DNA, 25 bp, Mus musculus
tcagaactaccttgtgtaatacagc

SEQ ID NO: 470548 - DNA, 25 bp, Mus musculus
tcagaactcactggtctacaaccag

SEQ ID NO: 470549 - DNA, 25 bp, Mus musculus
tcagaactcctagctaggttgtcgg

SEQ ID NO: 470550 - DNA, 25 bp, Mus musculus
tcagaactgaaagcttagagctcag

SEQ ID NO: 470551 - DNA, 25 bp, Mus musculus
tcagaactgcaacctggcgctggtg

SEQ ID NO: 470552 - DNA, 25 bp, Mus musculus
tcagaagaagagcatcacgcagatg

SEQ ID NO: 470553 - DNA, 25 bp, Mus musculus
tcagaagaatgaacccctgccgcat

SEQ ID NO: 470554 - DNA, 25 bp, Mus musculus
tcagaagacaactcaggtgccagct

SEQ ID NO: 470555 - DNA, 25 bp, Mus musculus
tcagaagacagacagtaggaggatt

SEQ ID NO: 470556 - DNA, 25 bp, Mus musculus
tcagaagacccagctcttggtgcgg

SEQ ID NO: 470557 - DNA, 25 bp, Mus musculus
tcagaagacggatgtcactcagcag

SEQ ID NO: 470558 - DNA, 25 bp, Mus musculus
tcagaagactctgacatggaggtcc

SEQ ID NO: 470559 - DNA, 25 bp, Mus musculus
tcagaagagcgaagttctgcgatgc

SEQ ID NO: 470560 - DNA, 25 bp, Mus musculus
tcagaagagcttcgaaccaacgggt

SEQ ID NO: 470561 - DNA, 25 bp, Mus musculus
tcagaagaggctctcaacggctcac

SEQ ID NO: 470562 - DNA, 25 bp, Mus musculus
tcagaagagttcatagaccctaaat

SEQ ID NO: 470563 - DNA, 25 bp, Mus musculus
tcagaagatcaaagaggccctgggc

SEQ ID NO: 470564 - DNA, 25 bp, Mus musculus
tcagaagcaagagtaccacgaagga

SEQ ID NO: 470565 - DNA, 25 bp, Mus musculus
tcagaagcaaggaagcttggttaat

SEQ ID NO: 470566 - DNA, 25 bp, Mus musculus
tcagaagcacaccttggtatgggcc

SEQ ID NO: 470567 - DNA, 25 bp, Mus musculus
tcagaagcagcacttggcagagtaa

SEQ ID NO: 470568 - DNA, 25 bp, Mus musculus
tcagaagccaactcaggcacagtgg

SEQ ID NO: 470569 - DNA, 25 bp, Mus musculus
tcagaagccgattctcaacttgagc

SEQ ID NO: 470570 - DNA, 25 bp, Mus musculus
tcagaagcgcgatgtgtctagtccg

SEQ ID NO: 470571 - DNA, 25 bp, Mus musculus
tcagaagctcttgtgaaacagcagg

SEQ ID NO: 470572 - DNA, 25 bp, Mus musculus
tcagaagcttagatgggaccacagt

SEQ ID NO: 470573 - DNA, 25 bp, Mus musculus
tcagaaggatgaagtcaggcactgc

SEQ ID NO: 470574 - DNA, 25 bp, Mus musculus
tcagaaggattgagacaacgtaccc

SEQ ID NO: 470575 - DNA, 25 bp, Mus musculus
tcagaaggcaaagcggtgtctgcgc

SEQ ID NO: 470576 - DNA, 25 bp, Mus musculus
tcagaaggccctttaggaaagaaag

SEQ ID NO: 470577 - DNA, 25 bp, Mus musculus
tcagaaggcggtagaccagacgatc

SEQ ID NO: 470578 - DNA, 25 bp, Mus musculus
tcagaaggctgtcaagaagtgtccc

SEQ ID NO: 470579 - DNA, 25 bp, Mus musculus
tcagaaggctgttgttcaccccaat

SEQ ID NO: 470580 - DNA, 25 bp, Mus musculus
tcagaaggtactccctctggctggc

SEQ ID NO: 470581 - DNA, 25 bp, Mus musculus
tcagaaggtctgacgcagtctccag

SEQ ID NO: 470582 - DNA, 25 bp, Mus musculus
tcagaaggtggtctccaacaagcgt

SEQ ID NO: 470583 - DNA, 25 bp, Mus musculus
tcagaagtcacctctgtgagcccca

SEQ ID NO: 470584 - DNA, 25 bp, Mus musculus
tcagaagtgcctctttgaagaccgt

SEQ ID NO: 470585 - DNA, 25 bp, Mus musculus
tcagaagtgtgaggtaccggcagct

SEQ ID NO: 470586 - DNA, 25 bp, Mus musculus
tcagaagttcggtgtttgacgccaa

SEQ ID NO: 470587 - DNA, 25 bp, Mus musculus
tcagaagttcttgggacaacagccc

SEQ ID NO: 470588 - DNA, 25 bp, Mus musculus
tcagaataactgcacttttaaggtt

SEQ ID NO: 470589 - DNA, 25 bp, Mus musculus
tcagaataataaaaggaggccgggc

SEQ ID NO: 470590 - DNA, 25 bp, Mus musculus
tcagaatagcttgctggctcaggag

SEQ ID NO: 470591 - DNA, 25 bp, Mus musculus
tcagaatcaacaacgtagcagtggc

SEQ ID NO: 470592 - DNA, 25 bp, Mus musculus
tcagaatcagtcagtcttaggcaca

SEQ ID NO: 470593 - DNA, 25 bp, Mus musculus
tcagaatcctgatacatgttatata

SEQ ID NO: 470594 - DNA, 25 bp, Mus musculus
tcagaatcctgcaaacctggaggag

SEQ ID NO: 470595 - DNA, 25 bp, Mus musculus
tcagaatccttatagcacctcacaa

SEQ ID NO: 470596 - DNA, 25 bp, Mus musculus
tcagaatcgactcagccagctatgg

SEQ ID NO: 470597 - DNA, 25 bp, Mus musculus
tcagaatcggagagaacttgctttt

SEQ ID NO: 470598 - DNA, 25 bp, Mus musculus
tcagaatctcgctcgtggtggtgct

SEQ ID NO: 470599 - DNA, 25 bp, Mus musculus
tcagaatcttaagcgggctgtggcc

SEQ ID NO: 470600 - DNA, 25 bp, Mus musculus
tcagaatcttctcagttacatccag

SEQ ID NO: 470601 - DNA, 25 bp, Mus musculus
tcagaatgagagagccaggtaacct

SEQ ID NO: 470602 - DNA, 25 bp, Mus musculus
tcagaatggacggacaccggaagac

SEQ ID NO: 470603 - DNA, 25 bp, Mus musculus
tcagaattcatgttggagccgctcc

SEQ ID NO: 470604 - DNA, 25 bp, Mus musculus
tcagaattctcggtgcgggtccaaa

SEQ ID NO: 470605 - DNA, 25 bp, Mus musculus
tcagaattgccgagatgtcacagct

SEQ ID NO: 470606 - DNA, 25 bp, Mus musculus
tcagacaagagaaggaggacacatt

SEQ ID NO: 470607 - DNA, 25 bp, Mus musculus
tcagacaaggaaatcagcacataac

SEQ ID NO: 470608 - DNA, 25 bp, Mus musculus
tcagacaaggcagttcaggctcatg

SEQ ID NO: 470609 - DNA, 25 bp, Mus musculus
tcagacaatcggtacacacgcaggt

SEQ ID NO: 470610 - DNA, 25 bp, Mus musculus
tcagacacctcagacataacagctt

SEQ ID NO: 470611 - DNA, 25 bp, Mus musculus
tcagacagacagaaagtgtagaggc

SEQ ID NO: 470612 - DNA, 25 bp, Mus musculus
tcagacagatatgcccaggacatgg

SEQ ID NO: 470613 - DNA, 25 bp, Mus musculus
tcagacaggagcgatcacaccttgc

SEQ ID NO: 470614 - DNA, 25 bp, Mus musculus
tcagacagtgaccatagtgcagcag

SEQ ID NO: 470615 - DNA, 25 bp, Mus musculus
tcagacagtggcaagtgagagcgac

SEQ ID NO: 470616 - DNA, 25 bp, Mus musculus
tcagacatcttttccttcagcgggc

SEQ ID NO: 470617 - DNA, 25 bp, Mus musculus
tcagaccaacgcaaccattaatggt

SEQ ID NO: 470618 - DNA, 25 bp, Mus musculus
tcagaccacctatggtgagagccac

SEQ ID NO: 470619 - DNA, 25 bp, Mus musculus
tcagacccagggattggccaaggat

SEQ ID NO: 470620 - DNA, 25 bp, Mus musculus
tcagaccgcccgaaacattaatgga

SEQ ID NO: 470621 - DNA, 25 bp, Mus musculus
tcagaccgcgaagagtgcagtttat

SEQ ID NO: 470622 - DNA, 25 bp, Mus musculus
tcagaccgttgggtgaagctggacc

SEQ ID NO: 470623 - DNA, 25 bp, Mus musculus
tcagacctattattccaacttttgg

SEQ ID NO: 470624 - DNA, 25 bp, Mus musculus
tcagacctggacgtataagtgctca

SEQ ID NO: 470625 - DNA, 25 bp, Mus musculus
tcagacctgggcagggactctggtg

SEQ ID NO: 470626 - DNA, 25 bp, Mus musculus
tcagacctgggtgcggttgatgcac

SEQ ID NO: 470627 - DNA, 25 bp, Mus musculus
tcagacctggtcagccttgccaaag

SEQ ID NO: 470628 - DNA, 25 bp, Mus musculus
tcagacgacggttcttggtgggacc

SEQ ID NO: 470629 - DNA, 25 bp, Mus musculus
tcagacgcaaaagtcggttacaact

SEQ ID NO: 470630 - DNA, 25 bp, Mus musculus
tcagacgctgggtccagacccagga

SEQ ID NO: 470631 - DNA, 25 bp, Mus musculus
tcagacgctttgagcagcagatctg

SEQ ID NO: 470632 - DNA, 25 bp, Mus musculus
tcagacggactcgaaagaaggaatc

SEQ ID NO: 470633 - DNA, 25 bp, Mus musculus
tcagacgtgccgcttcagggaatgc

SEQ ID NO: 470634 - DNA, 25 bp, Mus musculus
tcagactacagaaccaggacgaagt

SEQ ID NO: 470635 - DNA, 25 bp, Mus musculus
tcagactagtctgaagggaatcccc

SEQ ID NO: 470636 - DNA, 25 bp, Mus musculus
tcagactatgaacagtgacccgggt

SEQ ID NO: 470637 - DNA, 25 bp, Mus musculus
tcagactcaaggcaatccctgtgcc

SEQ ID NO: 470638 - DNA, 25 bp, Mus musculus
tcagactggatcttcgccatttcct

SEQ ID NO: 470639 - DNA, 25 bp, Mus musculus
tcagactggccgtttcatatagaaa

SEQ ID NO: 470640 - DNA, 25 bp, Mus musculus
tcagactggctcaagggcacaaggt

SEQ ID NO: 470641 - DNA, 25 bp, Mus musculus
tcagactgggagaacatcgagcgtc

SEQ ID NO: 470642 - DNA, 25 bp, Mus musculus
tcagactgtacgagagggaagagta

SEQ ID NO: 470643 - DNA, 25 bp, Mus musculus
tcagactgtggagtgcacggtcacc

SEQ ID NO: 470644 - DNA, 25 bp, Mus musculus
tcagacttccacaggcagattggcc

SEQ ID NO: 470645 - DNA, 25 bp, Mus musculus
tcagacttctctggcaaggcattat

SEQ ID NO: 470646 - DNA, 25 bp, Mus musculus
tcagacttgagcatttaaacctaac

SEQ ID NO: 470647 - DNA, 25 bp, Mus musculus
tcagacttttgagaggcttttgctc

SEQ ID NO: 470648 - DNA, 25 bp, Mus musculus
tcagagaaaaggtcgtgtggctcca

SEQ ID NO: 470649 - DNA, 25 bp, Mus musculus
tcagagaaagcaagcgaatgccgcc

SEQ ID NO: 470650 - DNA, 25 bp, Mus musculus
tcagagaacaacatcccacagtatg

SEQ ID NO: 470651 - DNA, 25 bp, Mus musculus
tcagagaacacaccttgaagagcag

SEQ ID NO: 470652 - DNA, 25 bp, Mus musculus
tcagagaacatacaaagggctttgg

SEQ ID NO: 470653 - DNA, 25 bp, Mus musculus
tcagagaaccagagtggaaagggcc

SEQ ID NO: 470654 - DNA, 25 bp, Mus musculus
tcagagaacctcagtccttggcggg

SEQ ID NO: 470655 - DNA, 25 bp, Mus musculus
tcagagaacttcagtagcccaggct

SEQ ID NO: 470656 - DNA, 25 bp, Mus musculus
tcagagaagatgatgtgaactcccc

SEQ ID NO: 470657 - DNA, 25 bp, Mus musculus
tcagagaagcctggaaatggccgcc

SEQ ID NO: 470658 - DNA, 25 bp, Mus musculus
tcagagaagcttgcgcaggtaacgt

SEQ ID NO: 470659 - DNA, 25 bp, Mus musculus
tcagagaaggcccaaggccaagatt

SEQ ID NO: 470660 - DNA, 25 bp, Mus musculus
tcagagaatcagcaaccagggccat

SEQ ID NO: 470661 - DNA, 25 bp, Mus musculus
tcagagacaaatacgagctgctggc

SEQ ID NO: 470662 - DNA, 25 bp, Mus musculus
tcagagacactacccataggtgtgc

SEQ ID NO: 470663 - DNA, 25 bp, Mus musculus
tcagagacacttcgataagggatcc

SEQ ID NO: 470664 - DNA, 25 bp, Mus musculus
tcagagaccaaaagagccctttggc

SEQ ID NO: 470665 - DNA, 25 bp, Mus musculus
tcagagaccctaataaaaccagaga

SEQ ID NO: 470666 - DNA, 25 bp, Mus musculus
tcagagacctcaacataagacctgg

SEQ ID NO: 470667 - DNA, 25 bp, Mus musculus
tcagagacctgaagagaatcagaca

SEQ ID NO: 470668 - DNA, 25 bp, Mus musculus
tcagagacggtgtgacgatgccact

SEQ ID NO: 470669 - DNA, 25 bp, Mus musculus
tcagagactcgggagcctgaggtac

SEQ ID NO: 470670 - DNA, 25 bp, Mus musculus
tcagagacttaagcccagcacggat

SEQ ID NO: 470671 - DNA, 25 bp, Mus musculus
tcagagagaagcaaccccatttgct

SEQ ID NO: 470672 - DNA, 25 bp, Mus musculus
tcagagagaagccttcaaagtagga

SEQ ID NO: 470673 - DNA, 25 bp, Mus musculus
tcagagagacagcagcatccagcat

SEQ ID NO: 470674 - DNA, 25 bp, Mus musculus
tcagagagacatactacacccgggt

SEQ ID NO: 470675 - DNA, 25 bp, Mus musculus
tcagagagctcaaaagggcaaggat

SEQ ID NO: 470676 - DNA, 25 bp, Mus musculus
tcagagagctgtgccgctggtgtca

SEQ ID NO: 470677 - DNA, 25 bp, Mus musculus
tcagagagcttggagaccgacccag

SEQ ID NO: 470678 - DNA, 25 bp, Mus musculus
tcagagaggttcagacacttgcccc

SEQ ID NO: 470679 - DNA, 25 bp, Mus musculus
tcagagagtctggtaggccctactg

SEQ ID NO: 470680 - DNA, 25 bp, Mus musculus
tcagagagtgagtcccctatggcct

SEQ ID NO: 470681 - DNA, 25 bp, Mus musculus
tcagagagttgactgttcatcaaaa

SEQ ID NO: 470682 - DNA, 25 bp, Mus musculus
tcagagatcagcaacgagcactgtt

SEQ ID NO: 470683 - DNA, 25 bp, Mus musculus
tcagagatcctatcagaagctgccc

SEQ ID NO: 470684 - DNA, 25 bp, Mus musculus
tcagagatgggacagagcagacaat

SEQ ID NO: 470685 - DNA, 25 bp, Mus musculus
tcagagattactatgtgcacttcaa

SEQ ID NO: 470686 - DNA, 25 bp, Mus musculus
tcagagattcctaccagggcagcgt

SEQ ID NO: 470687 - DNA, 25 bp, Mus musculus
tcagagattctaggacgttcacact

SEQ ID NO: 470688 - DNA, 25 bp, Mus musculus
tcagagatttaccaagctgcaagct

SEQ ID NO: 470689 - DNA, 25 bp, Mus musculus
tcagagcaagcgtgggatcctaact

SEQ ID NO: 470690 - DNA, 25 bp, Mus musculus
tcagagcacacggataagagttctt

SEQ ID NO: 470691 - DNA, 25 bp, Mus musculus
tcagagcacagctcatagctaccaa

SEQ ID NO: 470692 - DNA, 25 bp, Mus musculus
tcagagcagcgcagtgactgcacgg

SEQ ID NO: 470693 - DNA, 25 bp, Mus musculus
tcagagcaggcggtgcaggatctaa

SEQ ID NO: 470694 - DNA, 25 bp, Mus musculus
tcagagcagtgcttgcagagcaagg

SEQ ID NO: 470695 - DNA, 25 bp, Mus musculus
tcagagcatcatgaggagcccttgg

SEQ ID NO: 470696 - DNA, 25 bp, Mus musculus
tcagagcatgagcaacaagtagagg

SEQ ID NO: 470697 - DNA, 25 bp, Mus musculus
tcagagccaatgactatatgcgggc

SEQ ID NO: 470698 - DNA, 25 bp, Mus musculus
tcagagccgatactggacatggaca

SEQ ID NO: 470699 - DNA, 25 bp, Mus musculus
tcagagcctgatttcaaaaggatcg

SEQ ID NO: 470700 - DNA, 25 bp, Mus musculus
tcagagcctgggaagcagccggcac

SEQ ID NO: 470701 - DNA, 25 bp, Mus musculus
tcagagcgcactggtaagcggacac

SEQ ID NO: 470702 - DNA, 25 bp, Mus musculus
tcagagcgcctcaagttcaatgtgg

SEQ ID NO: 470703 - DNA, 25 bp, Mus musculus
tcagagcgggaactgaatgagcttt

SEQ ID NO: 470704 - DNA, 25 bp, Mus musculus
tcagagcggtactggcttttaaagg

SEQ ID NO: 470705 - DNA, 25 bp, Mus musculus
tcagagctaggttgagcaggacagc

SEQ ID NO: 470706 - DNA, 25 bp, Mus musculus
tcagagctatccatcacagagtggc

SEQ ID NO: 470707 - DNA, 25 bp, Mus musculus
tcagagctcagacccgtgcgggtgg

SEQ ID NO: 470708 - DNA, 25 bp, Mus musculus
tcagagctccagagagtttgccgaa

SEQ ID NO: 470709 - DNA, 25 bp, Mus musculus
tcagagctctttgggtggaccagca

SEQ ID NO: 470710 - DNA, 25 bp, Mus musculus
tcagagctgaagaatcgtgctgcca

SEQ ID NO: 470711 - DNA, 25 bp, Mus musculus
tcagagctgacagtggacggagaca

SEQ ID NO: 470712 - DNA, 25 bp, Mus musculus
tcagagctggcagttaacctgggcc

SEQ ID NO: 470713 - DNA, 25 bp, Mus musculus
tcagagcttccacatggccatgggc

SEQ ID NO: 470714 - DNA, 25 bp, Mus musculus
tcagagcttcgttccagaaggttag

SEQ ID NO: 470715 - DNA, 25 bp, Mus musculus
tcagaggaggtaacttaagatcagt

SEQ ID NO: 470716 - DNA, 25 bp, Mus musculus
tcagaggataaaagtggccccaatt

SEQ ID NO: 470717 - DNA, 25 bp, Mus musculus
tcagaggatctatcctgtccccagg

SEQ ID NO: 470718 - DNA, 25 bp, Mus musculus
tcagaggattcgcttggactcacca

SEQ ID NO: 470719 - DNA, 25 bp, Mus musculus
tcagaggcaacggacaacctagtgc

SEQ ID NO: 470720 - DNA, 25 bp, Mus musculus
tcagaggccccgagagagttatcaa

SEQ ID NO: 470721 - DNA, 25 bp, Mus musculus
tcagaggcgtggtgtgtactactaa

SEQ ID NO: 470722 - DNA, 25 bp, Mus musculus
tcagaggcttgaaccgttactccca

SEQ ID NO: 470723 - DNA, 25 bp, Mus musculus
tcagagggaaatttcatcagtagct

SEQ ID NO: 470724 - DNA, 25 bp, Mus musculus
tcagagggacacaaatacaggcagg

SEQ ID NO: 470725 - DNA, 25 bp, Mus musculus
tcagagggacttaaggcctcccagg

SEQ ID NO: 470726 - DNA, 25 bp, Mus musculus
tcagagggccgatttccagggaaag

SEQ ID NO: 470727 - DNA, 25 bp, Mus musculus
tcagagggtaaatattcacaggcac

SEQ ID NO: 470728 - DNA, 25 bp, Mus musculus
tcagaggtccttcagtcagagcagc

SEQ ID NO: 470729 - DNA, 25 bp, Mus musculus
tcagaggttgagaaggccagtccct

SEQ ID NO: 470730 - DNA, 25 bp, Mus musculus
tcagaggtttagctggtattccaat

SEQ ID NO: 470731 - DNA, 25 bp, Mus musculus
tcagaggtttcccaagcggtcactg

SEQ ID NO: 470732 - DNA, 25 bp, Mus musculus
tcagagtaaggctgcctgcctgctc

SEQ ID NO: 470733 - DNA, 25 bp, Mus musculus
tcagagtacagctccgtaagcagta

SEQ ID NO: 470734 - DNA, 25 bp, Mus musculus
tcagagtaccatatagcaagggcgg

SEQ ID NO: 470735 - DNA, 25 bp, Mus musculus
tcagagtacccctttgctcagtcag

SEQ ID NO: 470736 - DNA, 25 bp, Mus musculus
tcagagtagcattgggcatgaggat

SEQ ID NO: 470737 - DNA, 25 bp, Mus musculus
tcagagtcaactgcctagtgccagg

SEQ ID NO: 470738 - DNA, 25 bp, Mus musculus
tcagagtcagaaaaggctataagca

SEQ ID NO: 470739 - DNA, 25 bp, Mus musculus
tcagagtcctggtggaaagcgaacg

SEQ ID NO: 470740 - DNA, 25 bp, Mus musculus
tcagagtgaagagtcatccttggcc

SEQ ID NO: 470741 - DNA, 25 bp, Mus musculus
tcagagtgagaataaggagggacat

SEQ ID NO: 470742 - DNA, 25 bp, Mus musculus
tcagagtgattaacagtggcaaagt

SEQ ID NO: 470743 - DNA, 25 bp, Mus musculus
tcagagtgcagttggcccatcaggc

SEQ ID NO: 470744 - DNA, 25 bp, Mus musculus
tcagagtgccagcagagagattcac

SEQ ID NO: 470745 - DNA, 25 bp, Mus musculus
tcagagtgctctgctccaggagaac

SEQ ID NO: 470746 - DNA, 25 bp, Mus musculus
tcagagtgctgaatccctgggagcc

SEQ ID NO: 470747 - DNA, 25 bp, Mus musculus
tcagagtgggcctttagtggagcaa

SEQ ID NO: 470748 - DNA, 25 bp, Mus musculus
tcagagtgtagagaaggacgtcctt

SEQ ID NO: 470749 - DNA, 25 bp, Mus musculus
tcagagttagagagggaacgagaaa

SEQ ID NO: 470750 - DNA, 25 bp, Mus musculus
tcagagttctggactggcattcccc

SEQ ID NO: 470751 - DNA, 25 bp, Mus musculus
tcagagttgaaaggaaacaagttcc

SEQ ID NO: 470752 - DNA, 25 bp, Mus musculus
tcagagttgcttgccagagtggtca

SEQ ID NO: 470753 - DNA, 25 bp, Mus musculus
tcagagtttcctcctcatgccctaa

SEQ ID NO: 470754 - DNA, 25 bp, Mus musculus
tcagataactatgtggaaccccttg

SEQ ID NO: 470755 - DNA, 25 bp, Mus musculus
tcagataatctttacgaccaaccag

SEQ ID NO: 470756 - DNA, 25 bp, Mus musculus
tcagatagtgacagagcccaagtcc

SEQ ID NO: 470757 - DNA, 25 bp, Mus musculus
tcagatagtggtccgatttgaagac

SEQ ID NO: 470758 - DNA, 25 bp, Mus musculus
tcagatcagtagttatagtaaaagc

SEQ ID NO: 470759 - DNA, 25 bp, Mus musculus
tcagatcccaagagagtccatagcc

SEQ ID NO: 470760 - DNA, 25 bp, Mus musculus
tcagatcccagcaacacagaaaggg

SEQ ID NO: 470761 - DNA, 25 bp, Mus musculus
tcagatcccaggtgagtctctatgg

SEQ ID NO: 470762 - DNA, 25 bp, Mus musculus
tcagatccgtcttttctccaaggca

SEQ ID NO: 470763 - DNA, 25 bp, Mus musculus
tcagatcctagtgatgcacagcagg

SEQ ID NO: 470764 - DNA, 25 bp, Mus musculus
tcagatcctgggtcctgcctaacag

SEQ ID NO: 470765 - DNA, 25 bp, Mus musculus
tcagatcgcactacagttgggccgc

SEQ ID NO: 470766 - DNA, 25 bp, Mus musculus
tcagatcgggttatgagaccgccca

SEQ ID NO: 470767 - DNA, 25 bp, Mus musculus
tcagatcggttgcaagctcccggat

SEQ ID NO: 470768 - DNA, 25 bp, Mus musculus
tcagatctacaaggtcaggccctag

SEQ ID NO: 470769 - DNA, 25 bp, Mus musculus
tcagatctacgtgcatcccaagtgc

SEQ ID NO: 470770 - DNA, 25 bp, Mus musculus
tcagatctcagcttcctcaatagcc

SEQ ID NO: 470771 - DNA, 25 bp, Mus musculus
tcagatctcgacagggtggaggccc

SEQ ID NO: 470772 - DNA, 25 bp, Mus musculus
tcagatctggtcctgcgttgcggcc

SEQ ID NO: 470773 - DNA, 25 bp, Mus musculus
tcagatctgtcagccagcgataggc

SEQ ID NO: 470774 - DNA, 25 bp, Mus musculus
tcagatgaagatcccatcgaccccg

SEQ ID NO: 470775 - DNA, 25 bp, Mus musculus
tcagatgaatgagaaaaagcccacc

SEQ ID NO: 470776 - DNA, 25 bp, Mus musculus
tcagatgacctggacatgatgggag

SEQ ID NO: 470777 - DNA, 25 bp, Mus musculus
tcagatgagatttccaagaccccgg

SEQ ID NO: 470778 - DNA, 25 bp, Mus musculus
tcagatgagtgagtgactttctgct

SEQ ID NO: 470779 - DNA, 25 bp, Mus musculus
tcagatgcacaacacacacgagtgt

SEQ ID NO: 470780 - DNA, 25 bp, Mus musculus
tcagatgcattgactctcaccccag

SEQ ID NO: 470781 - DNA, 25 bp, Mus musculus
tcagatgcgcagtgtgatgactcca

SEQ ID NO: 470782 - DNA, 25 bp, Mus musculus
tcagatggagacaaagcgaaaaggt

SEQ ID NO: 470783 - DNA, 25 bp, Mus musculus
tcagatggcaacctcctgggagatc

SEQ ID NO: 470784 - DNA, 25 bp, Mus musculus
tcagatggccaagatctcggtggca

SEQ ID NO: 470785 - DNA, 25 bp, Mus musculus
tcagatggcccagcatttaccaggc

SEQ ID NO: 470786 - DNA, 25 bp, Mus musculus
tcagatggtacctagcaacgggcga

SEQ ID NO: 470787 - DNA, 25 bp, Mus musculus
tcagatggtatctagcgtactgggc

SEQ ID NO: 470788 - DNA, 25 bp, Mus musculus
tcagatggtcacgtcagcttccgag

SEQ ID NO: 470789 - DNA, 25 bp, Mus musculus
tcagatggtcggaaatgcccacacc

SEQ ID NO: 470790 - DNA, 25 bp, Mus musculus
tcagatgtaagcagcccatgtctcc

SEQ ID NO: 470791 - DNA, 25 bp, Mus musculus
tcagatgtccaaacagaatgtgtcc

SEQ ID NO: 470792 - DNA, 25 bp, Mus musculus
tcagattagctcgaggaagacaacc

SEQ ID NO: 470793 - DNA, 25 bp, Mus musculus
tcagattcaggcagctcagactcag

SEQ ID NO: 470794 - DNA, 25 bp, Mus musculus
tcagattcagggatccatgccacaa

SEQ ID NO: 470795 - DNA, 25 bp, Mus musculus
tcagattcatgattccagagcgtcc

SEQ ID NO: 470796 - DNA, 25 bp, Mus musculus
tcagattccatcaacctcgtgtttc

SEQ ID NO: 470797 - DNA, 25 bp, Mus musculus
tcagattcgagtgcactggccagac

SEQ ID NO: 470798 - DNA, 25 bp, Mus musculus
tcagattgccaaccccaagtgtgag

SEQ ID NO: 470799 - DNA, 25 bp, Mus musculus
tcagattggcctcacacgagagagt

SEQ ID NO: 470800 - DNA, 25 bp, Mus musculus
tcagcaaaaaggcataaacgacagt

SEQ ID NO: 470801 - DNA, 25 bp, Mus musculus
tcagcaaacactccaacttagtgag

SEQ ID NO: 470802 - DNA, 25 bp, Mus musculus
tcagcaaaccattcatgcgactgga

SEQ ID NO: 470803 - DNA, 25 bp, Mus musculus
tcagcaaacgcacgtgtctcgggaa

SEQ ID NO: 470804 - DNA, 25 bp, Mus musculus
tcagcaaacttcctatgggccagat

SEQ ID NO: 470805 - DNA, 25 bp, Mus musculus
tcagcaaagaagtccattatgatgc

SEQ ID NO: 470806 - DNA, 25 bp, Mus musculus
tcagcaaagatgaggcagcggtcca

SEQ ID NO: 470807 - DNA, 25 bp, Mus musculus
tcagcaaagcgagggagtaagcaca

SEQ ID NO: 470808 - DNA, 25 bp, Mus musculus
tcagcaaagtggagaccctcagagc

SEQ ID NO: 470809 - DNA, 25 bp, Mus musculus
tcagcaaagttgatagagtctcaag

SEQ ID NO: 470810 - DNA, 25 bp, Mus musculus
tcagcaaatcgcagcaggtatggtc

SEQ ID NO: 470811 - DNA, 25 bp, Mus musculus
tcagcaacagcagtttttagcccag

SEQ ID NO: 470812 - DNA, 25 bp, Mus musculus
tcagcaaccaggtagtaggccaggt

SEQ ID NO: 470813 - DNA, 25 bp, Mus musculus
tcagcaaccgctccaaggtggtgat

SEQ ID NO: 470814 - DNA, 25 bp, Mus musculus
tcagcaacgaggttccacacgtggt

SEQ ID NO: 470815 - DNA, 25 bp, Mus musculus
tcagcaacgcagtagtcgacagact

SEQ ID NO: 470816 - DNA, 25 bp, Mus musculus
tcagcaacgctaccacgaggacatt

SEQ ID NO: 470817 - DNA, 25 bp, Mus musculus
tcagcaacttgactgggtatacacc

SEQ ID NO: 470818 - DNA, 25 bp, Mus musculus
tcagcaagaggaaagcaacatcggg

SEQ ID NO: 470819 - DNA, 25 bp, Mus musculus
tcagcaagcacgtcagaatctccag

SEQ ID NO: 470820 - DNA, 25 bp, Mus musculus
tcagcaagcatagacaggagtgccc

SEQ ID NO: 470821 - DNA, 25 bp, Mus musculus
tcagcaagctgtgaagacggacaat

SEQ ID NO: 470822 - DNA, 25 bp, Mus musculus
tcagcaagcttcaggacgagctgca

SEQ ID NO: 470823 - DNA, 25 bp, Mus musculus
tcagcaagctttacgtggccggcaa

SEQ ID NO: 470824 - DNA, 25 bp, Mus musculus
tcagcaaggcctagacattcagagc

SEQ ID NO: 470825 - DNA, 25 bp, Mus musculus
tcagcaaggtgaagtcagtccgtct

SEQ ID NO: 470826 - DNA, 25 bp, Mus musculus
tcagcaagtaacctagggagcctag

SEQ ID NO: 470827 - DNA, 25 bp, Mus musculus
tcagcaagtcggtaaaggtgagcct

SEQ ID NO: 470828 - DNA, 25 bp, Mus musculus
tcagcaagtgatgactgcagcatcc

SEQ ID NO: 470829 - DNA, 25 bp, Mus musculus
tcagcaatagtgatcctaagacacc

SEQ ID NO: 470830 - DNA, 25 bp, Mus musculus
tcagcaatatcctccagcactgtgg

SEQ ID NO: 470831 - DNA, 25 bp, Mus musculus
tcagcaatgtggagaagcctagggc

SEQ ID NO: 470832 - DNA, 25 bp, Mus musculus
tcagcaatttccaggagcggcagca

SEQ ID NO: 470833 - DNA, 25 bp, Mus musculus
tcagcaatttgctatcggaagcagc

SEQ ID NO: 470834 - DNA, 25 bp, Mus musculus
tcagcacacatggagctcagtgaag

SEQ ID NO: 470835 - DNA, 25 bp, Mus musculus
tcagcacagataacaggtcagcgtc

SEQ ID NO: 470836 - DNA, 25 bp, Mus musculus
tcagcacagcatccgcctgctaaga

SEQ ID NO: 470837 - DNA, 25 bp, Mus musculus
tcagcacatgtagtcagacgccagt

SEQ ID NO: 470838 - DNA, 25 bp, Mus musculus
tcagcaccacgaagatggcctcaaa

SEQ ID NO: 470839 - DNA, 25 bp, Mus musculus
tcagcaccagatgcgagcagttcct

SEQ ID NO: 470840 - DNA, 25 bp, Mus musculus
tcagcacccacaaaagtggctgcat

SEQ ID NO: 470841 - DNA, 25 bp, Mus musculus
tcagcacctagaggtgttagggttg

SEQ ID NO: 470842 - DNA, 25 bp, Mus musculus
tcagcacctatagcagcatgcgggc

SEQ ID NO: 470843 - DNA, 25 bp, Mus musculus
tcagcacggagctgggcatcaggca

SEQ ID NO: 470844 - DNA, 25 bp, Mus musculus
tcagcacgggtaagtatcagaaggc

SEQ ID NO: 470845 - DNA, 25 bp, Mus musculus
tcagcacggtctaaacctgccaggg

SEQ ID NO: 470846 - DNA, 25 bp, Mus musculus
tcagcactaggatctacgaaagggt

SEQ ID NO: 470847 - DNA, 25 bp, Mus musculus
tcagcactattttatgggaagagcc

SEQ ID NO: 470848 - DNA, 25 bp, Mus musculus
tcagcactgccaaaagtgcatcttt

SEQ ID NO: 470849 - DNA, 25 bp, Mus musculus
tcagcactgccctgggtgaagcctg

SEQ ID NO: 470850 - DNA, 25 bp, Mus musculus
tcagcactgcctcaatctaaaaggc

SEQ ID NO: 470851 - DNA, 25 bp, Mus musculus
tcagcactggcctactacagagaag

SEQ ID NO: 470852 - DNA, 25 bp, Mus musculus
tcagcacttctatgcaccggacaag

SEQ ID NO: 470853 - DNA, 25 bp, Mus musculus
tcagcacttgttcgccatcagagga

SEQ ID NO: 470854 - DNA, 25 bp, Mus musculus
tcagcagaacctatgcttcaggcat

SEQ ID NO: 470855 - DNA, 25 bp, Mus musculus
tcagcagaaggtcaagaagacggcc

SEQ ID NO: 470856 - DNA, 25 bp, Mus musculus
tcagcagacgtcagaaaactaagag

SEQ ID NO: 470857 - DNA, 25 bp, Mus musculus
tcagcagagaccttgttccgagaaa

SEQ ID NO: 470858 - DNA, 25 bp, Mus musculus
tcagcagagactaggtcacggcctc

SEQ ID NO: 470859 - DNA, 25 bp, Mus musculus
tcagcagagagaacatccgggaggt

SEQ ID NO: 470860 - DNA, 25 bp, Mus musculus
tcagcagagcagtggaagacaatgg

SEQ ID NO: 470861 - DNA, 25 bp, Mus musculus
tcagcagagctcttcgcataaggag

SEQ ID NO: 470862 - DNA, 25 bp, Mus musculus
tcagcagagggcttggtttcccact

SEQ ID NO: 470863 - DNA, 25 bp, Mus musculus
tcagcagatgaaagcaacttaccag

SEQ ID NO: 470864 - DNA, 25 bp, Mus musculus
tcagcagcaacggagtcctccaagg

SEQ ID NO: 470865 - DNA, 25 bp, Mus musculus
tcagcagcacaagacatagcccatg

SEQ ID NO: 470866 - DNA, 25 bp, Mus musculus
tcagcagcactgacgcgggcttgtt

SEQ ID NO: 470867 - DNA, 25 bp, Mus musculus
tcagcagcagagatgcagaggacca

SEQ ID NO: 470868 - DNA, 25 bp, Mus musculus
tcagcagcagccgattccattaaga

SEQ ID NO: 470869 - DNA, 25 bp, Mus musculus
tcagcagcagctggttaaagccgtc

SEQ ID NO: 470870 - DNA, 25 bp, Mus musculus
tcagcagcagtatctgagacctgtt

SEQ ID NO: 470871 - DNA, 25 bp, Mus musculus
tcagcagcccttggatgttacagcc

SEQ ID NO: 470872 - DNA, 25 bp, Mus musculus
tcagcagccgattatcagcgaaagc

SEQ ID NO: 470873 - DNA, 25 bp, Mus musculus
tcagcagcgttcaaggaggttcaga

SEQ ID NO: 470874 - DNA, 25 bp, Mus musculus
tcagcagctccaaggataatgtggc

SEQ ID NO: 470875 - DNA, 25 bp, Mus musculus
tcagcagctgcctagtacaatcttc

SEQ ID NO: 470876 - DNA, 25 bp, Mus musculus
tcagcagctgctcggaattccctgt

SEQ ID NO: 470877 - DNA, 25 bp, Mus musculus
tcagcagcttcacaggacgagttag

SEQ ID NO: 470878 - DNA, 25 bp, Mus musculus
tcagcaggaccaaggatcatgggcc

SEQ ID NO: 470879 - DNA, 25 bp, Mus musculus
tcagcaggaggagagttgccagaac

SEQ ID NO: 470880 - DNA, 25 bp, Mus musculus
tcagcaggagtcaaggtggagacca

SEQ ID NO: 470881 - DNA, 25 bp, Mus musculus
tcagcaggctcggtgcactggagaa

SEQ ID NO: 470882 - DNA, 25 bp, Mus musculus
tcagcagggacattggagaactcca

SEQ ID NO: 470883 - DNA, 25 bp, Mus musculus
tcagcagggtggttactggacacat

SEQ ID NO: 470884 - DNA, 25 bp, Mus musculus
tcagcagtaactacccttgaggact

SEQ ID NO: 470885 - DNA, 25 bp, Mus musculus
tcagcagtaagcaatgggtgtggcc

SEQ ID NO: 470886 - DNA, 25 bp, Mus musculus
tcagcagtaggctttcagagagacc

SEQ ID NO: 470887 - DNA, 25 bp, Mus musculus
tcagcagtcacgagtcatctccagg

SEQ ID NO: 470888 - DNA, 25 bp, Mus musculus
tcagcagtcactgaggcggaagact

SEQ ID NO: 470889 - DNA, 25 bp, Mus musculus
tcagcagtgcaagccacaagatggt

SEQ ID NO: 470890 - DNA, 25 bp, Mus musculus
tcagcagtgcccttcggagttcgag

SEQ ID NO: 470891 - DNA, 25 bp, Mus musculus
tcagcatacagatgaatcagagctt

SEQ ID NO: 470892 - DNA, 25 bp, Mus musculus
tcagcatagaacagcagccctgtgg

SEQ ID NO: 470893 - DNA, 25 bp, Mus musculus
tcagcatagcagatggtctaaggcc

SEQ ID NO: 470894 - DNA, 25 bp, Mus musculus
tcagcatcaggtggaaggcttcccc

SEQ ID NO: 470895 - DNA, 25 bp, Mus musculus
tcagcatcctgatagcagaggccct

SEQ ID NO: 470896 - DNA, 25 bp, Mus musculus
tcagcatcgtggagagaggcctttc

SEQ ID NO: 470897 - DNA, 25 bp, Mus musculus
tcagcatcttaagctttcgagaggg

SEQ ID NO: 470898 - DNA, 25 bp, Mus musculus
tcagcatgacaagagagaggccaag

SEQ ID NO: 470899 - DNA, 25 bp, Mus musculus
tcagcatgaccaacacattaattct

SEQ ID NO: 470900 - DNA, 25 bp, Mus musculus
tcagcatgagcgactacagagcctt

SEQ ID NO: 470901 - DNA, 25 bp, Mus musculus
tcagcatgatgcagatatctcaggg

SEQ ID NO: 470902 - DNA, 25 bp, Mus musculus
tcagcatgccccaggactcgatgct

SEQ ID NO: 470903 - DNA, 25 bp, Mus musculus
tcagcatggatatcagacagaaagc

SEQ ID NO: 470904 - DNA, 25 bp, Mus musculus
tcagcatggcccagtcttcatttgt

SEQ ID NO: 470905 - DNA, 25 bp, Mus musculus
tcagcatgtcttcttagtggagtcc

SEQ ID NO: 470906 - DNA, 25 bp, Mus musculus
tcagcatgtgtcacttctacctggg

SEQ ID NO: 470907 - DNA, 25 bp, Mus musculus
tcagcattacagtcgcatctttggg

SEQ ID NO: 470908 - DNA, 25 bp, Mus musculus
tcagcattagacactttggcgggcc

SEQ ID NO: 470909 - DNA, 25 bp, Mus musculus
tcagcattccagtgaacgaattctg

SEQ ID NO: 470910 - DNA, 25 bp, Mus musculus
tcagcattcctgataccgggctgga

SEQ ID NO: 470911 - DNA, 25 bp, Mus musculus
tcagcattgatccagtgccacggca

SEQ ID NO: 470912 - DNA, 25 bp, Mus musculus
tcagcatttgcccttccagacatgt

SEQ ID NO: 470913 - DNA, 25 bp, Mus musculus
tcagcatttggaatcccttaggaag

SEQ ID NO: 470914 - DNA, 25 bp, Mus musculus
tcagccaaagtcaaatgggtgccgc

SEQ ID NO: 470915 - DNA, 25 bp, Mus musculus
tcagccaactaaaatcccaaggtgc

SEQ ID NO: 470916 - DNA, 25 bp, Mus musculus
tcagccaagacgtgtacagagtccg

SEQ ID NO: 470917 - DNA, 25 bp, Mus musculus
tcagccaagactagcgtgagcagtg

SEQ ID NO: 470918 - DNA, 25 bp, Mus musculus
tcagccaagctgatgggacaggcca

SEQ ID NO: 470919 - DNA, 25 bp, Mus musculus
tcagccaatcgagatacagcaggtc

SEQ ID NO: 470920 - DNA, 25 bp, Mus musculus
tcagccaatgcgactgtgaatctag

SEQ ID NO: 470921 - DNA, 25 bp, Mus musculus
tcagccacagtcttttcctaaaagc

SEQ ID NO: 470922 - DNA, 25 bp, Mus musculus
tcagccaccgtaaaaagcagtaatg

SEQ ID NO: 470923 - DNA, 25 bp, Mus musculus
tcagccacgacctatgcaaggacgg

SEQ ID NO: 470924 - DNA, 25 bp, Mus musculus
tcagccagcctgtgtatgcaaccat

SEQ ID NO: 470925 - DNA, 25 bp, Mus musculus
tcagccagctccatgacgtaaccaa

SEQ ID NO: 470926 - DNA, 25 bp, Mus musculus
tcagccagctgttccagaatcaaga

SEQ ID NO: 470927 - DNA, 25 bp, Mus musculus
tcagccaggaacgaacttacagaga

SEQ ID NO: 470928 - DNA, 25 bp, Mus musculus
tcagccaggagaatggtcaaaaagc

SEQ ID NO: 470929 - DNA, 25 bp, Mus musculus
tcagccagggcgtttgtgtccccag

SEQ ID NO: 470930 - DNA, 25 bp, Mus musculus
tcagccagggtaactgaaaggttgg

SEQ ID NO: 470931 - DNA, 25 bp, Mus musculus
tcagccaggtggtagaactttcctc

SEQ ID NO: 470932 - DNA, 25 bp, Mus musculus
tcagccagtctgtttgttaccaaag

SEQ ID NO: 470933 - DNA, 25 bp, Mus musculus
tcagccatacgaagctggagcatct

SEQ ID NO: 470934 - DNA, 25 bp, Mus musculus
tcagccatcagaccgagtgcctttg

SEQ ID NO: 470935 - DNA, 25 bp, Mus musculus
tcagccatctggagctgcatgagct

SEQ ID NO: 470936 - DNA, 25 bp, Mus musculus
tcagccatggcgttcaaggcacggt

SEQ ID NO: 470937 - DNA, 25 bp, Mus musculus
tcagccatgggcaaaaagcacaaga

SEQ ID NO: 470938 - DNA, 25 bp, Mus musculus
tcagcccaagagaagaaagttcgat

SEQ ID NO: 470939 - DNA, 25 bp, Mus musculus
tcagcccaagctcctccagatggag

SEQ ID NO: 470940 - DNA, 25 bp, Mus musculus
tcagcccagtgaagatattgtgcgc

SEQ ID NO: 470941 - DNA, 25 bp, Mus musculus
tcagccccagtgaagaatgtgtcag

SEQ ID NO: 470942 - DNA, 25 bp, Mus musculus
tcagccccggatggttttggaggat

SEQ ID NO: 470943 - DNA, 25 bp, Mus musculus
tcagcccctgatgaaaacgagtttc

SEQ ID NO: 470944 - DNA, 25 bp, Mus musculus
tcagcccgacacatacttaacaatt

SEQ ID NO: 470945 - DNA, 25 bp, Mus musculus
tcagcccggaagtaaagatgcagag

SEQ ID NO: 470946 - DNA, 25 bp, Mus musculus
tcagcccgggagcatttgctttttg

SEQ ID NO: 470947 - DNA, 25 bp, Mus musculus
tcagccctcttggaacacattatgg

SEQ ID NO: 470948 - DNA, 25 bp, Mus musculus
tcagccctgaaaggtgcagcacaca

SEQ ID NO: 470949 - DNA, 25 bp, Mus musculus
tcagccctgagcgaagagaacgagg

SEQ ID NO: 470950 - DNA, 25 bp, Mus musculus
tcagccctgattgagtccaagacag

SEQ ID NO: 470951 - DNA, 25 bp, Mus musculus
tcagccctgctcgatggcaagaacg

SEQ ID NO: 470952 - DNA, 25 bp, Mus musculus
tcagccctgcttgtgtgggaggcac

SEQ ID NO: 470953 - DNA, 25 bp, Mus musculus
tcagccctttcacaggccggctgaa

SEQ ID NO: 470954 - DNA, 25 bp, Mus musculus
tcagccgcgtctgggtcctggtgtt

SEQ ID NO: 470955 - DNA, 25 bp, Mus musculus
tcagccgggaaagtagctctggttc

SEQ ID NO: 470956 - DNA, 25 bp, Mus musculus
tcagccgggcactggaaagggtgga

SEQ ID NO: 470957 - DNA, 25 bp, Mus musculus
tcagccgtagcccttccgttaggca

SEQ ID NO: 470958 - DNA, 25 bp, Mus musculus
tcagccgtgctggtgttcgacatcc

SEQ ID NO: 470959 - DNA, 25 bp, Mus musculus
tcagccgtgggccatgagtaccagt

SEQ ID NO: 470960 - DNA, 25 bp, Mus musculus
tcagcctagttcaggcagccttcgg

SEQ ID NO: 470961 - DNA, 25 bp, Mus musculus
tcagcctatatgcaccagctcctgg

SEQ ID NO: 470962 - DNA, 25 bp, Mus musculus
tcagcctcattaccaggaaaaggtc

SEQ ID NO: 470963 - DNA, 25 bp, Mus musculus
tcagcctcccggtgttgcatagcga

SEQ ID NO: 470964 - DNA, 25 bp, Mus musculus
tcagcctcggcttcatcattgtggg

SEQ ID NO: 470965 - DNA, 25 bp, Mus musculus
tcagcctcgtggtcaatgtgaagaa

SEQ ID NO: 470966 - DNA, 25 bp, Mus musculus
tcagcctctacatgttattcaggtt

SEQ ID NO: 470967 - DNA, 25 bp, Mus musculus
tcagcctctgaaggattagagccag

SEQ ID NO: 470968 - DNA, 25 bp, Mus musculus
tcagcctgaggagtagtgctttgtc

SEQ ID NO: 470969 - DNA, 25 bp, Mus musculus
tcagcctgcctaggaaacgcaagga

SEQ ID NO: 470970 - DNA, 25 bp, Mus musculus
tcagcctgcctttgtgtaaccccaa

SEQ ID NO: 470971 - DNA, 25 bp, Mus musculus
tcagcctggaacattgtgcacatgg

SEQ ID NO: 470972 - DNA, 25 bp, Mus musculus
tcagcctggatgagcgaatttatgt

SEQ ID NO: 470973 - DNA, 25 bp, Mus musculus
tcagcctgggcgctctgaagatgca

SEQ ID NO: 470974 - DNA, 25 bp, Mus musculus
tcagcctgtataaccctcattccag

SEQ ID NO: 470975 - DNA, 25 bp, Mus musculus
tcagccttgagacgccaaagtcctg

SEQ ID NO: 470976 - DNA, 25 bp, Mus musculus
tcagccttggagattagcagagcct

SEQ ID NO: 470977 - DNA, 25 bp, Mus musculus
tcagcctttcaatctcaaatacaag

SEQ ID NO: 470978 - DNA, 25 bp, Mus musculus
tcagcctttccctgaagtgacacat

SEQ ID NO: 470979 - DNA, 25 bp, Mus musculus
tcagcgaaatgccaaggaagtgcca

SEQ ID NO: 470980 - DNA, 25 bp, Mus musculus
tcagcgaagaccacgagaagagagt

SEQ ID NO: 470981 - DNA, 25 bp, Mus musculus
tcagcgaagcgacacggccattatt

SEQ ID NO: 470982 - DNA, 25 bp, Mus musculus
tcagcgaagggttttctccggtctc

SEQ ID NO: 470983 - DNA, 25 bp, Mus musculus
tcagcgaagttgatccagcagcagc

SEQ ID NO: 470984 - DNA, 25 bp, Mus musculus
tcagcgaccaagtcaaaatcatctg

SEQ ID NO: 470985 - DNA, 25 bp, Mus musculus
tcagcgaccctgtggaggttatagt

SEQ ID NO: 470986 - DNA, 25 bp, Mus musculus
tcagcgagaaggacttggaacaggc

SEQ ID NO: 470987 - DNA, 25 bp, Mus musculus
tcagcgaggctatttgttgtgtgcc

SEQ ID NO: 470988 - DNA, 25 bp, Mus musculus
tcagcgagtagtgcaggctgccgcc

SEQ ID NO: 470989 - DNA, 25 bp, Mus musculus
tcagcgatgcaaagaaaaccaggag

SEQ ID NO: 470990 - DNA, 25 bp, Mus musculus
tcagcgatgttgtgagcagccagaa

SEQ ID NO: 470991 - DNA, 25 bp, Mus musculus
tcagcgcaaccctgggatactaaga

SEQ ID NO: 470992 - DNA, 25 bp, Mus musculus
tcagcgcaccgttaggaaagtggcc

SEQ ID NO: 470993 - DNA, 25 bp, Mus musculus
tcagcgcaggtttgctacacttcag

SEQ ID NO: 470994 - DNA, 25 bp, Mus musculus
tcagcgccacagaaaccgtaggtgt

SEQ ID NO: 470995 - DNA, 25 bp, Mus musculus
tcagcgcccttgagaacagaatgct

SEQ ID NO: 470996 - DNA, 25 bp, Mus musculus
tcagcgcctccaagttggccaagag

SEQ ID NO: 470997 - DNA, 25 bp, Mus musculus
tcagcgctatggtactacgacaggc

SEQ ID NO: 470998 - DNA, 25 bp, Mus musculus
tcagcgctcacaagatccactaagt

SEQ ID NO: 470999 - DNA, 25 bp, Mus musculus
tcagcgctcactcaacaccagagag

SEQ ID NO: 471000 - DNA, 25 bp, Mus musculus
tcagcgctctcactggatacattgg

SEQ ID NO: 471001 - DNA, 25 bp, Mus musculus
tcagcggaaaccgtccctggttgct

SEQ ID NO: 471002 - DNA, 25 bp, Mus musculus
tcagcggacagtacctttagatgcc

SEQ ID NO: 471003 - DNA, 25 bp, Mus musculus
tcagcggatgagactttcgagcacc

SEQ ID NO: 471004 - DNA, 25 bp, Mus musculus
tcagcggcagccagtttacagttct

SEQ ID NO: 471005 - DNA, 25 bp, Mus musculus
tcagcggcctctttggaacatgaac

SEQ ID NO: 471006 - DNA, 25 bp, Mus musculus
tcagcggctaaaggcgcttgcggcc

SEQ ID NO: 471007 - DNA, 25 bp, Mus musculus
tcagcggcttcaggagaaaagtctc

SEQ ID NO: 471008 - DNA, 25 bp, Mus musculus
tcagcgggaagtcaagacgaagctc

SEQ ID NO: 471009 - DNA, 25 bp, Mus musculus
tcagcgggaccaagaatgaagactg

SEQ ID NO: 471010 - DNA, 25 bp, Mus musculus
tcagcgggactttgacctcaggagg

SEQ ID NO: 471011 - DNA, 25 bp, Mus musculus
tcagcgggccaaccagtgtctgaaa

SEQ ID NO: 471012 - DNA, 25 bp, Mus musculus
tcagcgggcccaagctgcaaaggct

SEQ ID NO: 471013 - DNA, 25 bp, Mus musculus
tcagcgggccctagattttcgaaac

SEQ ID NO: 471014 - DNA, 25 bp, Mus musculus
tcagcgggctattagggagacacta

SEQ ID NO: 471015 - DNA, 25 bp, Mus musculus
tcagcgggttcgtaaggagaagcct

SEQ ID NO: 471016 - DNA, 25 bp, Mus musculus
tcagcggtgggctttgactacaaag

SEQ ID NO: 471017 - DNA, 25 bp, Mus musculus
tcagcgtagaggagcagaaatggcc

SEQ ID NO: 471018 - DNA, 25 bp, Mus musculus
tcagcgtcaacgtgaagaccgtgcg

SEQ ID NO: 471019 - DNA, 25 bp, Mus musculus
tcagcgtcaccgatgagttgggcca

SEQ ID NO: 471020 - DNA, 25 bp, Mus musculus
tcagcgtcgctatgtaaccaagagt

SEQ ID NO: 471021 - DNA, 25 bp, Mus musculus
tcagcgtctttatttgtggcccaac

SEQ ID NO: 471022 - DNA, 25 bp, Mus musculus
tcagcgtgaagatggcttcgggccc

SEQ ID NO: 471023 - DNA, 25 bp, Mus musculus
tcagcgtgatatggaagagagtcac

SEQ ID NO: 471024 - DNA, 25 bp, Mus musculus
tcagcgtgcgtgtgctagatgccaa

SEQ ID NO: 471025 - DNA, 25 bp, Mus musculus
tcagcgtgctgtgccattggacgac

SEQ ID NO: 471026 - DNA, 25 bp, Mus musculus
tcagcgtggtgaacaactatgccct

SEQ ID NO: 471027 - DNA, 25 bp, Mus musculus
tcagcgtgtccaaacactgaggcca

SEQ ID NO: 471028 - DNA, 25 bp, Mus musculus
tcagcgttaccagtttcaggccctg

SEQ ID NO: 471029 - DNA, 25 bp, Mus musculus
tcagcgtttcagaagccggatcaag

SEQ ID NO: 471030 - DNA, 25 bp, Mus musculus
tcagctaaagatatgtggccacaag

SEQ ID NO: 471031 - DNA, 25 bp, Mus musculus
tcagctacaagagaggaatgaccct

SEQ ID NO: 471032 - DNA, 25 bp, Mus musculus
tcagctacatatagcagaacgggcc

SEQ ID NO: 471033 - DNA, 25 bp, Mus musculus
tcagctacggctccagcagaacatg

SEQ ID NO: 471034 - DNA, 25 bp, Mus musculus
tcagctactgcatgacaagggcaag

SEQ ID NO: 471035 - DNA, 25 bp, Mus musculus
tcagctactgggtcagggactcctg

SEQ ID NO: 471036 - DNA, 25 bp, Mus musculus
tcagctagaggtaggagatctccaa

SEQ ID NO: 471037 - DNA, 25 bp, Mus musculus
tcagctaggaaagagtgctcccagc

SEQ ID NO: 471038 - DNA, 25 bp, Mus musculus
tcagctatggaggaggaaccaagca

SEQ ID NO: 471039 - DNA, 25 bp, Mus musculus
tcagctcaagggaactcaagggcag

SEQ ID NO: 471040 - DNA, 25 bp, Mus musculus
tcagctcaagtgctgtgtccagagg

SEQ ID NO: 471041 - DNA, 25 bp, Mus musculus
tcagctcacctctggaataaagggc

SEQ ID NO: 471042 - DNA, 25 bp, Mus musculus
tcagctcagaaggtggacatcttgg

SEQ ID NO: 471043 - DNA, 25 bp, Mus musculus
tcagctcagaccagccgtgtgtgga

SEQ ID NO: 471044 - DNA, 25 bp, Mus musculus
tcagctcagaccagtgatacaggca

SEQ ID NO: 471045 - DNA, 25 bp, Mus musculus
tcagctcaggatggctacagttggc

SEQ ID NO: 471046 - DNA, 25 bp, Mus musculus
tcagctcagtgaccagaggcatgcc

SEQ ID NO: 471047 - DNA, 25 bp, Mus musculus
tcagctcatcctcagccaaggtcgt

SEQ ID NO: 471048 - DNA, 25 bp, Mus musculus
tcagctccaatgagggcaggtccaa

SEQ ID NO: 471049 - DNA, 25 bp, Mus musculus
tcagctccagaggaaaccgatttat

SEQ ID NO: 471050 - DNA, 25 bp, Mus musculus
tcagctccatttggcctgcagggag

SEQ ID NO: 471051 - DNA, 25 bp, Mus musculus
tcagctcccagcaggattgtagtcg

SEQ ID NO: 471052 - DNA, 25 bp, Mus musculus
tcagctccgggaaaagttacctttg

SEQ ID NO: 471053 - DNA, 25 bp, Mus musculus
tcagctccggtgacaagttcggccc

SEQ ID NO: 471054 - DNA, 25 bp, Mus musculus
tcagctcctcagagaacctgttggg

SEQ ID NO: 471055 - DNA, 25 bp, Mus musculus
tcagctcgaggaacgaggattaccc

SEQ ID NO: 471056 - DNA, 25 bp, Mus musculus
tcagctcgcaggctttctgattagc

SEQ ID NO: 471057 - DNA, 25 bp, Mus musculus
tcagctcggctccatgacaacgtgg

SEQ ID NO: 471058 - DNA, 25 bp, Mus musculus
tcagctcggctctctaatggcagct

SEQ ID NO: 471059 - DNA, 25 bp, Mus musculus
tcagctctaactcagccagcggagg

SEQ ID NO: 471060 - DNA, 25 bp, Mus musculus
tcagctctcaagcaaagcatcccga

SEQ ID NO: 471061 - DNA, 25 bp, Mus musculus
tcagctctccagacatgttgctaag

SEQ ID NO: 471062 - DNA, 25 bp, Mus musculus
tcagctctgaatgtttagggcctag

SEQ ID NO: 471063 - DNA, 25 bp, Mus musculus
tcagctctgagtgaaacatttaaca

SEQ ID NO: 471064 - DNA, 25 bp, Mus musculus
tcagctctggtggtgagaatcccca

SEQ ID NO: 471065 - DNA, 25 bp, Mus musculus
tcagctctgtacgatgggcactacg

SEQ ID NO: 471066 - DNA, 25 bp, Mus musculus
tcagctgaaaccctgggaggagtac

SEQ ID NO: 471067 - DNA, 25 bp, Mus musculus
tcagctgaagttagcagggactccc

SEQ ID NO: 471068 - DNA, 25 bp, Mus musculus
tcagctgacacgagcagaagttggc

SEQ ID NO: 471069 - DNA, 25 bp, Mus musculus
tcagctgacagcatatgggaccaca

SEQ ID NO: 471070 - DNA, 25 bp, Mus musculus
tcagctgagagcactgcaggacatt

SEQ ID NO: 471071 - DNA, 25 bp, Mus musculus
tcagctgagattggcaggcactgtt

SEQ ID NO: 471072 - DNA, 25 bp, Mus musculus
tcagctgatcctttcacccaaacaa

SEQ ID NO: 471073 - DNA, 25 bp, Mus musculus
tcagctgcaaaaatgcctaagggct

SEQ ID NO: 471074 - DNA, 25 bp, Mus musculus
tcagctgcaggacgctgtgaactcg

SEQ ID NO: 471075 - DNA, 25 bp, Mus musculus
tcagctgccgagacagggaactttt

SEQ ID NO: 471076 - DNA, 25 bp, Mus musculus
tcagctgcctccaaaagccttggct

SEQ ID NO: 471077 - DNA, 25 bp, Mus musculus
tcagctgcgtagaaccatatgcaag

SEQ ID NO: 471078 - DNA, 25 bp, Mus musculus
tcagctgcgtatcagtgatcacaaa

SEQ ID NO: 471079 - DNA, 25 bp, Mus musculus
tcagctgctctatcgaatgcatggg

SEQ ID NO: 471080 - DNA, 25 bp, Mus musculus
tcagctgcttcaaggcccatggaaa

SEQ ID NO: 471081 - DNA, 25 bp, Mus musculus
tcagctggatgatctccttcccggt

SEQ ID NO: 471082 - DNA, 25 bp, Mus musculus
tcagctggcatcactcggtcaatca

SEQ ID NO: 471083 - DNA, 25 bp, Mus musculus
tcagctggccaaagaaaactgcaaa

SEQ ID NO: 471084 - DNA, 25 bp, Mus musculus
tcagctggccagagaagtgctcgtg

SEQ ID NO: 471085 - DNA, 25 bp, Mus musculus
tcagctggcctagggtcagggtaac

SEQ ID NO: 471086 - DNA, 25 bp, Mus musculus
tcagctggctggagcagaaacatcc

SEQ ID NO: 471087 - DNA, 25 bp, Mus musculus
tcagctgggccgtgaatggagtccc

SEQ ID NO: 471088 - DNA, 25 bp, Mus musculus
tcagctgggctacaagatggccaac

SEQ ID NO: 471089 - DNA, 25 bp, Mus musculus
tcagctggtcctcgtgaacggagaa

SEQ ID NO: 471090 - DNA, 25 bp, Mus musculus
tcagctgtaattaatttaagctggg

SEQ ID NO: 471091 - DNA, 25 bp, Mus musculus
tcagctgtagccgacctgggaaagc

SEQ ID NO: 471092 - DNA, 25 bp, Mus musculus
tcagctgtatgtgggtgcctacagg

SEQ ID NO: 471093 - DNA, 25 bp, Mus musculus
tcagctgtcattaccctctgcgtag

SEQ ID NO: 471094 - DNA, 25 bp, Mus musculus
tcagctgtccggtgctaatagagcc

SEQ ID NO: 471095 - DNA, 25 bp, Mus musculus
tcagctgtcctgaaatgggagagcg

SEQ ID NO: 471096 - DNA, 25 bp, Mus musculus
tcagctgtgctacccacacctaaag

SEQ ID NO: 471097 - DNA, 25 bp, Mus musculus
tcagctgtggtgaacttgggccaca

SEQ ID NO: 471098 - DNA, 25 bp, Mus musculus
tcagctgtgtcttcacgcatacctg

SEQ ID NO: 471099 - DNA, 25 bp, Mus musculus
tcagctgttggtaacctgggcagac

SEQ ID NO: 471100 - DNA, 25 bp, Mus musculus
tcagcttacaatggagttctctaca

SEQ ID NO: 471101 - DNA, 25 bp, Mus musculus
tcagcttcacataacagtatctaac

SEQ ID NO: 471102 - DNA, 25 bp, Mus musculus
tcagcttcagaacaagcatggctcc

SEQ ID NO: 471103 - DNA, 25 bp, Mus musculus
tcagcttcatagactcggcgtccag

SEQ ID NO: 471104 - DNA, 25 bp, Mus musculus
tcagcttcatgtgcagggcaaagac

SEQ ID NO: 471105 - DNA, 25 bp, Mus musculus
tcagcttcattctgagctgcctggc

SEQ ID NO: 471106 - DNA, 25 bp, Mus musculus
tcagcttcccaagtaacgtggatta

SEQ ID NO: 471107 - DNA, 25 bp, Mus musculus
tcagcttcgcgtacgtgggcaagga

SEQ ID NO: 471108 - DNA, 25 bp, Mus musculus
tcagcttctaggacaggtgtgccca

SEQ ID NO: 471109 - DNA, 25 bp, Mus musculus
tcagcttctgaccaagggattccaa

SEQ ID NO: 471110 - DNA, 25 bp, Mus musculus
tcagcttgaaggatccgttggcgcc

SEQ ID NO: 471111 - DNA, 25 bp, Mus musculus
tcagcttggattctcttgggccccg

SEQ ID NO: 471112 - DNA, 25 bp, Mus musculus
tcagcttggctttaaccgggaccgg

SEQ ID NO: 471113 - DNA, 25 bp, Mus musculus
tcagcttgtctgtctcctaggaaag

SEQ ID NO: 471114 - DNA, 25 bp, Mus musculus
tcagctttatcactgctcgggagca

SEQ ID NO: 471115 - DNA, 25 bp, Mus musculus
tcagctttccttcactccttgggag

SEQ ID NO: 471116 - DNA, 25 bp, Mus musculus
tcagctttctagagtaggtacctag

SEQ ID NO: 471117 - DNA, 25 bp, Mus musculus
tcagctttctgcaaggtcagagccc

SEQ ID NO: 471118 - DNA, 25 bp, Mus musculus
tcagctttggaagcctagtggcgcc

SEQ ID NO: 471119 - DNA, 25 bp, Mus musculus
tcagctttgtggatacgcggactct

SEQ ID NO: 471120 - DNA, 25 bp, Mus musculus
tcaggaaaaatagaggacccaaggt

SEQ ID NO: 471121 - DNA, 25 bp, Mus musculus
tcaggaaaatccaggatgggccgcc

SEQ ID NO: 471122 - DNA, 25 bp, Mus musculus
tcaggaaacaggcatcagggcatat

SEQ ID NO: 471123 - DNA, 25 bp, Mus musculus
tcaggaaacatggaagaggctcgga

SEQ ID NO: 471124 - DNA, 25 bp, Mus musculus
tcaggaaagtttcatgggtaacctt

SEQ ID NO: 471125 - DNA, 25 bp, Mus musculus
tcaggaaattccaatgcaggtagca

SEQ ID NO: 471126 - DNA, 25 bp, Mus musculus
tcaggaacaggagggatgaccaact

SEQ ID NO: 471127 - DNA, 25 bp, Mus musculus
tcaggaacaggcaacgacagagggc

SEQ ID NO: 471128 - DNA, 25 bp, Mus musculus
tcaggaacgaggagtcaatagagca

SEQ ID NO: 471129 - DNA, 25 bp, Mus musculus
tcaggaacgtggtaactggtccaaa

SEQ ID NO: 471130 - DNA, 25 bp, Mus musculus
tcaggaactaccttgtaaaattcaa

SEQ ID NO: 471131 - DNA, 25 bp, Mus musculus
tcaggaagaatacagcatcggcgtg

SEQ ID NO: 471132 - DNA, 25 bp, Mus musculus
tcaggaagacatgtttaagctcgcc

SEQ ID NO: 471133 - DNA, 25 bp, Mus musculus
tcaggaagactgtactgggcccaac

SEQ ID NO: 471134 - DNA, 25 bp, Mus musculus
tcaggaagaggaagcatgacacctt

SEQ ID NO: 471135 - DNA, 25 bp, Mus musculus
tcaggaagatctgccgagtgagatt

SEQ ID NO: 471136 - DNA, 25 bp, Mus musculus
tcaggaagattctggcaagggcccg

SEQ ID NO: 471137 - DNA, 25 bp, Mus musculus
tcaggaagcctcagctctcttatgg

SEQ ID NO: 471138 - DNA, 25 bp, Mus musculus
tcaggaatagacctctgacagtgtc

SEQ ID NO: 471139 - DNA, 25 bp, Mus musculus
tcaggaatcaaggtcagtctcggct

SEQ ID NO: 471140 - DNA, 25 bp, Mus musculus
tcaggaatcaccaaaaaggtaaggg

SEQ ID NO: 471141 - DNA, 25 bp, Mus musculus
tcaggaatctttacctcccgaaatt

SEQ ID NO: 471142 - DNA, 25 bp, Mus musculus
tcaggaatgagcttacccaaaacac

SEQ ID NO: 471143 - DNA, 25 bp, Mus musculus
tcaggaattctgtgtcgccaagggt

SEQ ID NO: 471144 - DNA, 25 bp, Mus musculus
tcaggaatttgagatccgcatcagc

SEQ ID NO: 471145 - DNA, 25 bp, Mus musculus
tcaggaatttgatagcactcgaggc

SEQ ID NO: 471146 - DNA, 25 bp, Mus musculus
tcaggacagaagaccggaagaaatg

SEQ ID NO: 471147 - DNA, 25 bp, Mus musculus
tcaggacagcaggtaactggcatac

SEQ ID NO: 471148 - DNA, 25 bp, Mus musculus
tcaggacagttcatcaatccccgga

SEQ ID NO: 471149 - DNA, 25 bp, Mus musculus
tcaggacatggatgaccccagaagg

SEQ ID NO: 471150 - DNA, 25 bp, Mus musculus
tcaggacatggtgtcacaggaggcc

SEQ ID NO: 471151 - DNA, 25 bp, Mus musculus
tcaggaccaggtctttttgatgccc

SEQ ID NO: 471152 - DNA, 25 bp, Mus musculus
tcaggaccatctttgagcgggcagt

SEQ ID NO: 471153 - DNA, 25 bp, Mus musculus
tcaggaccccgtcagctgagattgg

SEQ ID NO: 471154 - DNA, 25 bp, Mus musculus
tcaggacctattgggcacagtgggc

SEQ ID NO: 471155 - DNA, 25 bp, Mus musculus
tcaggacgagtcaatccagcggatc

SEQ ID NO: 471156 - DNA, 25 bp, Mus musculus
tcaggacgtgagtgttcacaagaca

SEQ ID NO: 471157 - DNA, 25 bp, Mus musculus
tcaggactggatctccgcggcccga

SEQ ID NO: 471158 - DNA, 25 bp, Mus musculus
tcaggacttactgttcaccgaaaag

SEQ ID NO: 471159 - DNA, 25 bp, Mus musculus
tcaggacttgaattctcacaggagt

SEQ ID NO: 471160 - DNA, 25 bp, Mus musculus
tcaggagaaagatgctgttttgcgc

SEQ ID NO: 471161 - DNA, 25 bp, Mus musculus
tcaggagaacttgctggccagcgga

SEQ ID NO: 471162 - DNA, 25 bp, Mus musculus
tcaggagaagcttcggccactgtgg

SEQ ID NO: 471163 - DNA, 25 bp, Mus musculus
tcaggagaagtatcagggctgcccc

SEQ ID NO: 471164 - DNA, 25 bp, Mus musculus
tcaggagacaggaagctaatgcgcg

SEQ ID NO: 471165 - DNA, 25 bp, Mus musculus
tcaggagaggccatcttttgtccca

SEQ ID NO: 471166 - DNA, 25 bp, Mus musculus
tcaggagcaagtgccacagggagaa

SEQ ID NO: 471167 - DNA, 25 bp, Mus musculus
tcaggagcactcttagcagctaggc

SEQ ID NO: 471168 - DNA, 25 bp, Mus musculus
tcaggagcaggatgacccagagttg

SEQ ID NO: 471169 - DNA, 25 bp, Mus musculus
tcaggagccaaactgaaaacattct

SEQ ID NO: 471170 - DNA, 25 bp, Mus musculus
tcaggagccagtcaaagctgaccca

SEQ ID NO: 471171 - DNA, 25 bp, Mus musculus
tcaggagcccggagggattgcctca

SEQ ID NO: 471172 - DNA, 25 bp, Mus musculus
tcaggagccctcaatggtggtgtct

SEQ ID NO: 471173 - DNA, 25 bp, Mus musculus
tcaggagcctgccaagtaaagccag

SEQ ID NO: 471174 - DNA, 25 bp, Mus musculus
tcaggagccttgaagtgaccagtta

SEQ ID NO: 471175 - DNA, 25 bp, Mus musculus
tcaggagcgaggatagccagtacac

SEQ ID NO: 471176 - DNA, 25 bp, Mus musculus
tcaggagcgcgttacagatttgcca

SEQ ID NO: 471177 - DNA, 25 bp, Mus musculus
tcaggaggacgtttccgatgcccat

SEQ ID NO: 471178 - DNA, 25 bp, Mus musculus
tcaggaggagtacgctctgctcaca

SEQ ID NO: 471179 - DNA, 25 bp, Mus musculus
tcaggaggcagtctcttgagccaga

SEQ ID NO: 471180 - DNA, 25 bp, Mus musculus
tcaggaggccatagctcaagaccag

SEQ ID NO: 471181 - DNA, 25 bp, Mus musculus
tcaggaggctcacctagagccgtca

SEQ ID NO: 471182 - DNA, 25 bp, Mus musculus
tcaggagggctgaatgctttgacaa

SEQ ID NO: 471183 - DNA, 25 bp, Mus musculus
tcaggagtccagaaggtatgaaaaa

SEQ ID NO: 471184 - DNA, 25 bp, Mus musculus
tcaggagtgaaaagcaggcggtccc

SEQ ID NO: 471185 - DNA, 25 bp, Mus musculus
tcaggagtgcctgctcaagaggagc

SEQ ID NO: 471186 - DNA, 25 bp, Mus musculus
tcaggagtgggctttagaactgctc

SEQ ID NO: 471187 - DNA, 25 bp, Mus musculus
tcaggagtggtgtcacacgtgtcac

SEQ ID NO: 471188 - DNA, 25 bp, Mus musculus
tcaggataacccagtgaccttagcc

SEQ ID NO: 471189 - DNA, 25 bp, Mus musculus
tcaggatagttgaaagggcaggccc

SEQ ID NO: 471190 - DNA, 25 bp, Mus musculus
tcaggatcaatcaatgacagtggcc

SEQ ID NO: 471191 - DNA, 25 bp, Mus musculus
tcaggatcagacatgcaagaggcca

SEQ ID NO: 471192 - DNA, 25 bp, Mus musculus
tcaggatcctgcttggctggcttgc

SEQ ID NO: 471193 - DNA, 25 bp, Mus musculus
tcaggatctagctcgaagtttcaac

SEQ ID NO: 471194 - DNA, 25 bp, Mus musculus
tcaggatgagcggtaaagattggcc

SEQ ID NO: 471195 - DNA, 25 bp, Mus musculus
tcaggatgattgaagagcgtcccac

SEQ ID NO: 471196 - DNA, 25 bp, Mus musculus
tcaggatgcccgatgcataaagggc

SEQ ID NO: 471197 - DNA, 25 bp, Mus musculus
tcaggattgctgaaaggcatttgat

SEQ ID NO: 471198 - DNA, 25 bp, Mus musculus
tcaggatttacatctgactgtcagt

SEQ ID NO: 471199 - DNA, 25 bp, Mus musculus
tcaggatttgagagcccatcacggg

SEQ ID NO: 471200 - DNA, 25 bp, Mus musculus
tcaggcaaaaggatggtagaactag

SEQ ID NO: 471201 - DNA, 25 bp, Mus musculus
tcaggcaaggcagctctgagtccag

SEQ ID NO: 471202 - DNA, 25 bp, Mus musculus
tcaggcacagggttgtcaggcatag

SEQ ID NO: 471203 - DNA, 25 bp, Mus musculus
tcaggcacaggttacagagaatgga

SEQ ID NO: 471204 - DNA, 25 bp, Mus musculus
tcaggcacccctatgttaaattctg

SEQ ID NO: 471205 - DNA, 25 bp, Mus musculus
tcaggcacgctgcactttctgggca

SEQ ID NO: 471206 - DNA, 25 bp, Mus musculus
tcaggcagaactcacaagcaggtac

SEQ ID NO: 471207 - DNA, 25 bp, Mus musculus
tcaggcagagtacaaacacggactc

SEQ ID NO: 471208 - DNA, 25 bp, Mus musculus
tcaggcagcgctatggttctctttc

SEQ ID NO: 471209 - DNA, 25 bp, Mus musculus
tcaggcagctattgcctggagtggt

SEQ ID NO: 471210 - DNA, 25 bp, Mus musculus
tcaggcagctttgagattcggcaag

SEQ ID NO: 471211 - DNA, 25 bp, Mus musculus
tcaggcaggcctgcgaaagagcact

SEQ ID NO: 471212 - DNA, 25 bp, Mus musculus
tcaggcaggctaggttctttaacag

SEQ ID NO: 471213 - DNA, 25 bp, Mus musculus
tcaggcaggctccaagtctacacaa

SEQ ID NO: 471214 - DNA, 25 bp, Mus musculus
tcaggcagttgaagatcagctaaag

SEQ ID NO: 471215 - DNA, 25 bp, Mus musculus
tcaggccagaagatatcagttaaga

SEQ ID NO: 471216 - DNA, 25 bp, Mus musculus
tcaggccagctacaggttgatgtca

SEQ ID NO: 471217 - DNA, 25 bp, Mus musculus
tcaggccagtgaaagtgcatatccg

SEQ ID NO: 471218 - DNA, 25 bp, Mus musculus
tcaggccatcccaacagctgtaagt

SEQ ID NO: 471219 - DNA, 25 bp, Mus musculus
tcaggcccaaggtagatctcagagc

SEQ ID NO: 471220 - DNA, 25 bp, Mus musculus
tcaggccccgacagagaaagctctg

SEQ ID NO: 471221 - DNA, 25 bp, Mus musculus
tcaggcccctgtcatggtggtaaca

SEQ ID NO: 471222 - DNA, 25 bp, Mus musculus
tcaggcccgcttggaaaaggagtac

SEQ ID NO: 471223 - DNA, 25 bp, Mus musculus
tcaggcccttatgattacaatgcaa

SEQ ID NO: 471224 - DNA, 25 bp, Mus musculus
tcaggccgccttttaactcagagat

SEQ ID NO: 471225 - DNA, 25 bp, Mus musculus
tcaggccgcggcttcggtcgagact

SEQ ID NO: 471226 - DNA, 25 bp, Mus musculus
tcaggccgtgcgacattacaggatc

SEQ ID NO: 471227 - DNA, 25 bp, Mus musculus
tcaggcctcacacggatagccactg

SEQ ID NO: 471228 - DNA, 25 bp, Mus musculus
tcaggcctccgtttgacctagtggg

SEQ ID NO: 471229 - DNA, 25 bp, Mus musculus
tcaggcctgacttgccaagggtctt

SEQ ID NO: 471230 - DNA, 25 bp, Mus musculus
tcaggcctggataagctttaaagac

SEQ ID NO: 471231 - DNA, 25 bp, Mus musculus
tcaggcctggttcgctacaacaatg

SEQ ID NO: 471232 - DNA, 25 bp, Mus musculus
tcaggcgaaatacgcacagctcggg

SEQ ID NO: 471233 - DNA, 25 bp, Mus musculus
tcaggcgacacatggccaagagtct

SEQ ID NO: 471234 - DNA, 25 bp, Mus musculus
tcaggcgcagaactcgaggttaacc

SEQ ID NO: 471235 - DNA, 25 bp, Mus musculus
tcaggcgcagctccatatcagggac

SEQ ID NO: 471236 - DNA, 25 bp, Mus musculus
tcaggcggccctccaactcagttat

SEQ ID NO: 471237 - DNA, 25 bp, Mus musculus
tcaggcgtcacccagtaacacggtg

SEQ ID NO: 471238 - DNA, 25 bp, Mus musculus
tcaggcgtcgaaatctcatagtggg

SEQ ID NO: 471239 - DNA, 25 bp, Mus musculus
tcaggctactggtggcacgtggcca

SEQ ID NO: 471240 - DNA, 25 bp, Mus musculus
tcaggctaggtcagtgctgtactac

SEQ ID NO: 471241 - DNA, 25 bp, Mus musculus
tcaggctcagtgaaggcaagttcca

SEQ ID NO: 471242 - DNA, 25 bp, Mus musculus
tcaggctcatcttcaccgtcgtggt

SEQ ID NO: 471243 - DNA, 25 bp, Mus musculus
tcaggctcctcagtacgctgtatgc

SEQ ID NO: 471244 - DNA, 25 bp, Mus musculus
tcaggctcttgagttacagattcgg

SEQ ID NO: 471245 - DNA, 25 bp, Mus musculus
tcaggctctttattcggctacgcgg

SEQ ID NO: 471246 - DNA, 25 bp, Mus musculus
tcaggctgaggtcttttcatgccca

SEQ ID NO: 471247 - DNA, 25 bp, Mus musculus
tcaggctgccccttttctgtgtgct

SEQ ID NO: 471248 - DNA, 25 bp, Mus musculus
tcaggctgctgagaatcgaggagac

SEQ ID NO: 471249 - DNA, 25 bp, Mus musculus
tcaggctggacccatcgatgcagtc

SEQ ID NO: 471250 - DNA, 25 bp, Mus musculus
tcaggctgttactcacgatcctagt

SEQ ID NO: 471251 - DNA, 25 bp, Mus musculus
tcaggctgttctgagcacctgctga

SEQ ID NO: 471252 - DNA, 25 bp, Mus musculus
tcaggcttcaaaacaacgcagagag

SEQ ID NO: 471253 - DNA, 25 bp, Mus musculus
tcaggcttcagggagtgcaatcatg

SEQ ID NO: 471254 - DNA, 25 bp, Mus musculus
tcaggcttcgtcatcgctattggta

SEQ ID NO: 471255 - DNA, 25 bp, Mus musculus
tcaggcttgcagaccccattcattg

SEQ ID NO: 471256 - DNA, 25 bp, Mus musculus
tcaggcttttggtaacggagtgcac

SEQ ID NO: 471257 - DNA, 25 bp, Mus musculus
tcagggaaaacgcaagacacgagtc

SEQ ID NO: 471258 - DNA, 25 bp, Mus musculus
tcagggaacacaagcactttatggc

SEQ ID NO: 471259 - DNA, 25 bp, Mus musculus
tcagggaagactgctccaagggagc

SEQ ID NO: 471260 - DNA, 25 bp, Mus musculus
tcagggaatctgcacgatgggccca

SEQ ID NO: 471261 - DNA, 25 bp, Mus musculus
tcagggaccaccagttctacttgca

SEQ ID NO: 471262 - DNA, 25 bp, Mus musculus
tcagggacctagcaagcctgttcgg

SEQ ID NO: 471263 - DNA, 25 bp, Mus musculus
tcagggacgtcagctccctagcgga

SEQ ID NO: 471264 - DNA, 25 bp, Mus musculus
tcagggagacagaaatgcaagtggc

SEQ ID NO: 471265 - DNA, 25 bp, Mus musculus
tcagggagacttaagcacattggcc

SEQ ID NO: 471266 - DNA, 25 bp, Mus musculus
tcagggagcagattaccagcacttc

SEQ ID NO: 471267 - DNA, 25 bp, Mus musculus
tcagggagccacttgaacagactgc

SEQ ID NO: 471268 - DNA, 25 bp, Mus musculus
tcagggagcgctacgtggtgcaaat

SEQ ID NO: 471269 - DNA, 25 bp, Mus musculus
tcagggagctgaggccataaaacgc

SEQ ID NO: 471270 - DNA, 25 bp, Mus musculus
tcagggaggcaagcacattgacaga

SEQ ID NO: 471271 - DNA, 25 bp, Mus musculus
tcagggatcatcacagcaggaggat

SEQ ID NO: 471272 - DNA, 25 bp, Mus musculus
tcagggatcctaacatcagggagag

SEQ ID NO: 471273 - DNA, 25 bp, Mus musculus
tcagggatctcagcacagcggtttt

SEQ ID NO: 471274 - DNA, 25 bp, Mus musculus
tcagggatttccagcagccaaggag

SEQ ID NO: 471275 - DNA, 25 bp, Mus musculus
tcagggatttcgcacaggtatacaa

SEQ ID NO: 471276 - DNA, 25 bp, Mus musculus
tcagggcaaaattgaatcttccgct

SEQ ID NO: 471277 - DNA, 25 bp, Mus musculus
tcagggcaaactctacgtgggtgca

SEQ ID NO: 471278 - DNA, 25 bp, Mus musculus
tcagggcaaatcttcgtcagtatgg

SEQ ID NO: 471279 - DNA, 25 bp, Mus musculus
tcagggcaaccagctgacagacttc

SEQ ID NO: 471280 - DNA, 25 bp, Mus musculus
tcagggcaagctcaccaaactggct

SEQ ID NO: 471281 - DNA, 25 bp, Mus musculus
tcagggcacacaccaagagttcagg

SEQ ID NO: 471282 - DNA, 25 bp, Mus musculus
tcagggcaggatgctggaacctatt

SEQ ID NO: 471283 - DNA, 25 bp, Mus musculus
tcagggcagtatgagaaagccacac

SEQ ID NO: 471284 - DNA, 25 bp, Mus musculus
tcagggcatcctactgcgggacaat

SEQ ID NO: 471285 - DNA, 25 bp, Mus musculus
tcagggccacgtgcagaatattgct

SEQ ID NO: 471286 - DNA, 25 bp, Mus musculus
tcagggcctctgtgtgaaggctgtc

SEQ ID NO: 471287 - DNA, 25 bp, Mus musculus
tcagggcggcacctctagtttccag

SEQ ID NO: 471288 - DNA, 25 bp, Mus musculus
tcagggcgtcgatctgttggtcaca

SEQ ID NO: 471289 - DNA, 25 bp, Mus musculus
tcagggcgtgcttctgagctatggc

SEQ ID NO: 471290 - DNA, 25 bp, Mus musculus
tcagggctcaccatgcgttgggatc

SEQ ID NO: 471291 - DNA, 25 bp, Mus musculus
tcagggctcactagaaggctgcaca

SEQ ID NO: 471292 - DNA, 25 bp, Mus musculus
tcagggctcgaagagtcaaggccaa

SEQ ID NO: 471293 - DNA, 25 bp, Mus musculus
tcagggctggaatctaggaagtacc

SEQ ID NO: 471294 - DNA, 25 bp, Mus musculus
tcagggctggcttggaaaaactact

SEQ ID NO: 471295 - DNA, 25 bp, Mus musculus
tcagggctggtctagattctacccc

SEQ ID NO: 471296 - DNA, 25 bp, Mus musculus
tcagggctggtgacgacaggatctt

SEQ ID NO: 471297 - DNA, 25 bp, Mus musculus
tcagggctgtctggctttctgttgg

SEQ ID NO: 471298 - DNA, 25 bp, Mus musculus
tcagggcttctcatatggcaagggc

SEQ ID NO: 471299 - DNA, 25 bp, Mus musculus
tcagggcttgctaactaccagggca

SEQ ID NO: 471300 - DNA, 25 bp, Mus musculus
tcaggggcagcacggtcttgactaa

SEQ ID NO: 471301 - DNA, 25 bp, Mus musculus
tcagggtaaagcttccttggagtgc

SEQ ID NO: 471302 - DNA, 25 bp, Mus musculus
tcagggtaactgaggctccggaagc

SEQ ID NO: 471303 - DNA, 25 bp, Mus musculus
tcagggtaagtactgcaggctactc

SEQ ID NO: 471304 - DNA, 25 bp, Mus musculus
tcagggtacagggtgacttcagctc

SEQ ID NO: 471305 - DNA, 25 bp, Mus musculus
tcagggtagatttaagggctctgcc

SEQ ID NO: 471306 - DNA, 25 bp, Mus musculus
tcagggtattcagctgctgcactcc

SEQ ID NO: 471307 - DNA, 25 bp, Mus musculus
tcagggtcaccatagcacattccag

SEQ ID NO: 471308 - DNA, 25 bp, Mus musculus
tcagggtcactctacgggaactaag

SEQ ID NO: 471309 - DNA, 25 bp, Mus musculus
tcagggtcatctccagcctttaggg

SEQ ID NO: 471310 - DNA, 25 bp, Mus musculus
tcagggtcccagctctacagataac

SEQ ID NO: 471311 - DNA, 25 bp, Mus musculus
tcagggtccccaggaatgcttggtc

SEQ ID NO: 471312 - DNA, 25 bp, Mus musculus
tcagggtctctgttaaggcttgcct

SEQ ID NO: 471313 - DNA, 25 bp, Mus musculus
tcagggtctgcgaaccatgagcaaa

SEQ ID NO: 471314 - DNA, 25 bp, Mus musculus
tcagggtcttcttccatcttagctc

SEQ ID NO: 471315 - DNA, 25 bp, Mus musculus
tcagggtgcactggctaatatagct

SEQ ID NO: 471316 - DNA, 25 bp, Mus musculus
tcagggtgcagtgcagcaccctacg

SEQ ID NO: 471317 - DNA, 25 bp, Mus musculus
tcagggtttggtccgactgcttcca

SEQ ID NO: 471318 - DNA, 25 bp, Mus musculus
tcagggtttgtctatttccaaatcc

SEQ ID NO: 471319 - DNA, 25 bp, Mus musculus
tcaggtaacaatgcagcaagctcag

SEQ ID NO: 471320 - DNA, 25 bp, Mus musculus
tcaggtaaccagcagattgtaggac

SEQ ID NO: 471321 - DNA, 25 bp, Mus musculus
tcaggtaactctggagtccttgctc

SEQ ID NO: 471322 - DNA, 25 bp, Mus musculus
tcaggtaacttagatcagctctggc

SEQ ID NO: 471323 - DNA, 25 bp, Mus musculus
tcaggtaattacagggtagccagca

SEQ ID NO: 471324 - DNA, 25 bp, Mus musculus
tcaggtacttatcagggctccaact

SEQ ID NO: 471325 - DNA, 25 bp, Mus musculus
tcaggtatgagctagacacggagac

SEQ ID NO: 471326 - DNA, 25 bp, Mus musculus
tcaggtatggacaccgaccttccag

SEQ ID NO: 471327 - DNA, 25 bp, Mus musculus
tcaggtcacattgcaggtttcgaac

SEQ ID NO: 471328 - DNA, 25 bp, Mus musculus
tcaggtcacggattgagagcaaagg

SEQ ID NO: 471329 - DNA, 25 bp, Mus musculus
tcaggtcacgtttgcctcaggcagc

SEQ ID NO: 471330 - DNA, 25 bp, Mus musculus
tcaggtcacgtttggaagaaccatc

SEQ ID NO: 471331 - DNA, 25 bp, Mus musculus
tcaggtccaggcagatctacaaggt

SEQ ID NO: 471332 - DNA, 25 bp, Mus musculus
tcaggtctcggaatgcgcgctaaag

SEQ ID NO: 471333 - DNA, 25 bp, Mus musculus
tcaggtctgatcaggctctgtcatc

SEQ ID NO: 471334 - DNA, 25 bp, Mus musculus
tcaggtcttaccatcgggttccagc

SEQ ID NO: 471335 - DNA, 25 bp, Mus musculus
tcaggtcttcaggttgccactgcgc

SEQ ID NO: 471336 - DNA, 25 bp, Mus musculus
tcaggtcttgcccaggaacaatggt

SEQ ID NO: 471337 - DNA, 25 bp, Mus musculus
tcaggtgaccttggagtgagtagtt

SEQ ID NO: 471338 - DNA, 25 bp, Mus musculus
tcaggtgagatgcatggaactgcac

SEQ ID NO: 471339 - DNA, 25 bp, Mus musculus
tcaggtgatgctggacacagcgcag

SEQ ID NO: 471340 - DNA, 25 bp, Mus musculus
tcaggtgccaccaagaagagagtgc

SEQ ID NO: 471341 - DNA, 25 bp, Mus musculus
tcaggtgccctagaaaacgtcatag

SEQ ID NO: 471342 - DNA, 25 bp, Mus musculus
tcaggtgctcgaagcctggattcca

SEQ ID NO: 471343 - DNA, 25 bp, Mus musculus
tcaggtgggctgatagaggtctatc

SEQ ID NO: 471344 - DNA, 25 bp, Mus musculus
tcaggtgtctgatagtccacaggta

SEQ ID NO: 471345 - DNA, 25 bp, Mus musculus
tcaggttacattcgcaagagttgcg

SEQ ID NO: 471346 - DNA, 25 bp, Mus musculus
tcaggttactggctatggccccaaa

SEQ ID NO: 471347 - DNA, 25 bp, Mus musculus
tcaggttagtccgtgatcaccatgg

SEQ ID NO: 471348 - DNA, 25 bp, Mus musculus
tcaggttatgggacagacgctatca

SEQ ID NO: 471349 - DNA, 25 bp, Mus musculus
tcaggttcacagtccaagcttcagt

SEQ ID NO: 471350 - DNA, 25 bp, Mus musculus
tcaggttcatcattgggttcagcac

SEQ ID NO: 471351 - DNA, 25 bp, Mus musculus
tcaggttcatgctgcctcgggagac

SEQ ID NO: 471352 - DNA, 25 bp, Mus musculus
tcaggttccttctgcagctggccga

SEQ ID NO: 471353 - DNA, 25 bp, Mus musculus
tcaggttctgatgctgggagctcac

SEQ ID NO: 471354 - DNA, 25 bp, Mus musculus
tcaggttggacttgttctcctgtgt

SEQ ID NO: 471355 - DNA, 25 bp, Mus musculus
tcaggttggccagcaatcagagaca

SEQ ID NO: 471356 - DNA, 25 bp, Mus musculus
tcaggtttcgttacactgggaaggg

SEQ ID NO: 471357 - DNA, 25 bp, Mus musculus
tcaggtttgctatcctcagtccggg

SEQ ID NO: 471358 - DNA, 25 bp, Mus musculus
tcagtaaagccaaacataggctggg

SEQ ID NO: 471359 - DNA, 25 bp, Mus musculus
tcagtaaatctcttgggaccaccag

SEQ ID NO: 471360 - DNA, 25 bp, Mus musculus
tcagtaaatgacacgaagaggagct

SEQ ID NO: 471361 - DNA, 25 bp, Mus musculus
tcagtaacagcccaagaaccgggaa

SEQ ID NO: 471362 - DNA, 25 bp, Mus musculus
tcagtaacagctccgataagggcgt

SEQ ID NO: 471363 - DNA, 25 bp, Mus musculus
tcagtaacattcagaagcgacaggg

SEQ ID NO: 471364 - DNA, 25 bp, Mus musculus
tcagtaagaactgtggcagggcagc

SEQ ID NO: 471365 - DNA, 25 bp, Mus musculus
tcagtaagcttcacctggatagcag

SEQ ID NO: 471366 - DNA, 25 bp, Mus musculus
tcagtaagtgatggacaggcatccg

SEQ ID NO: 471367 - DNA, 25 bp, Mus musculus
tcagtaagtttctaccaaagctggg

SEQ ID NO: 471368 - DNA, 25 bp, Mus musculus
tcagtaatgtgaggctcgaggaccg

SEQ ID NO: 471369 - DNA, 25 bp, Mus musculus
tcagtacagcttaagtggacaccat

SEQ ID NO: 471370 - DNA, 25 bp, Mus musculus
tcagtacagtgtgggatggactcct

SEQ ID NO: 471371 - DNA, 25 bp, Mus musculus
tcagtaccaccttgggagtgccaag

SEQ ID NO: 471372 - DNA, 25 bp, Mus musculus
tcagtaccagcgaaaaagacaccat

SEQ ID NO: 471373 - DNA, 25 bp, Mus musculus
tcagtaccaggatgtgcagtcgcgg

SEQ ID NO: 471374 - DNA, 25 bp, Mus musculus
tcagtaccatcgtcaggaacctggc

SEQ ID NO: 471375 - DNA, 25 bp, Mus musculus
tcagtaccttcatggagggctaccc

SEQ ID NO: 471376 - DNA, 25 bp, Mus musculus
tcagtactaggacatacactaacca

SEQ ID NO: 471377 - DNA, 25 bp, Mus musculus
tcagtactcagtccaatgcgcagca

SEQ ID NO: 471378 - DNA, 25 bp, Mus musculus
tcagtactctgggatgcagcagccg

SEQ ID NO: 471379 - DNA, 25 bp, Mus musculus
tcagtacttagtggaaaaggaagct

SEQ ID NO: 471380 - DNA, 25 bp, Mus musculus
tcagtacttgcagacttccaggact

SEQ ID NO: 471381 - DNA, 25 bp, Mus musculus
tcagtagaaaagatccggctaagtc

SEQ ID NO: 471382 - DNA, 25 bp, Mus musculus
tcagtagaaccaccacaatgtcagg

SEQ ID NO: 471383 - DNA, 25 bp, Mus musculus
tcagtagagacctttttggcacggg

SEQ ID NO: 471384 - DNA, 25 bp, Mus musculus
tcagtagagagcgacttacggctct

SEQ ID NO: 471385 - DNA, 25 bp, Mus musculus
tcagtagcggagcacaccttgattg

SEQ ID NO: 471386 - DNA, 25 bp, Mus musculus
tcagtagctttgttgctcggaccaa

SEQ ID NO: 471387 - DNA, 25 bp, Mus musculus
tcagtaggatctcagactcacgggc

SEQ ID NO: 471388 - DNA, 25 bp, Mus musculus
tcagtaggccatcatgatctcttaa

SEQ ID NO: 471389 - DNA, 25 bp, Mus musculus
tcagtagtactcagaggcagcgctc

SEQ ID NO: 471390 - DNA, 25 bp, Mus musculus
tcagtagtcacatttcacccagggc

SEQ ID NO: 471391 - DNA, 25 bp, Mus musculus
tcagtagtcagccaatgaagtgcca

SEQ ID NO: 471392 - DNA, 25 bp, Mus musculus
tcagtagtcaggagtacccaaggat

SEQ ID NO: 471393 - DNA, 25 bp, Mus musculus
tcagtataagactctcccaggatgg

SEQ ID NO: 471394 - DNA, 25 bp, Mus musculus
tcagtatactcctttgcctgttcca

SEQ ID NO: 471395 - DNA, 25 bp, Mus musculus
tcagtatcgagagaggcttccggcc

SEQ ID NO: 471396 - DNA, 25 bp, Mus musculus
tcagtatcggaaggaattgggtacc

SEQ ID NO: 471397 - DNA, 25 bp, Mus musculus
tcagtatgacaagccactgggtcgc

SEQ ID NO: 471398 - DNA, 25 bp, Mus musculus
tcagtatgacggagcatgccctggg

SEQ ID NO: 471399 - DNA, 25 bp, Mus musculus
tcagtatgatttgctgggccagtca

SEQ ID NO: 471400 - DNA, 25 bp, Mus musculus
tcagtatggaaaggcacagttaccc

SEQ ID NO: 471401 - DNA, 25 bp, Mus musculus
tcagtatggccaacctgatcagggc

SEQ ID NO: 471402 - DNA, 25 bp, Mus musculus
tcagtatggtgcaagtgaccatccc

SEQ ID NO: 471403 - DNA, 25 bp, Mus musculus
tcagtatgtcagctcagtaggaacc

SEQ ID NO: 471404 - DNA, 25 bp, Mus musculus
tcagtatgttgcaacgtgggtccct

SEQ ID NO: 471405 - DNA, 25 bp, Mus musculus
tcagtattattctgtgggtcagtcg

SEQ ID NO: 471406 - DNA, 25 bp, Mus musculus
tcagtatttgcaaaaccacgagggt

SEQ ID NO: 471407 - DNA, 25 bp, Mus musculus
tcagtatttgtcctagccatggtgg

SEQ ID NO: 471408 - DNA, 25 bp, Mus musculus
tcagtcacaagctataaggaggtcc

SEQ ID NO: 471409 - DNA, 25 bp, Mus musculus
tcagtcacagtattgaaaggtggtt

SEQ ID NO: 471410 - DNA, 25 bp, Mus musculus
tcagtcacatcctcattgtgcccat

SEQ ID NO: 471411 - DNA, 25 bp, Mus musculus
tcagtcagaagccaccaagctggtc

SEQ ID NO: 471412 - DNA, 25 bp, Mus musculus
tcagtcagggtagaagcgaaaggct

SEQ ID NO: 471413 - DNA, 25 bp, Mus musculus
tcagtcaggtacaggcaggagttat

SEQ ID NO: 471414 - DNA, 25 bp, Mus musculus
tcagtcatccagacgagacggcttt

SEQ ID NO: 471415 - DNA, 25 bp, Mus musculus
tcagtcatctagaggacctgcggct

SEQ ID NO: 471416 - DNA, 25 bp, Mus musculus
tcagtcattagaaccagagcgattg

SEQ ID NO: 471417 - DNA, 25 bp, Mus musculus
tcagtccaagggtcgatacacagcc

SEQ ID NO: 471418 - DNA, 25 bp, Mus musculus
tcagtccatgtgaatctcacggtgg

SEQ ID NO: 471419 - DNA, 25 bp, Mus musculus
tcagtccatgttcccaaaagccagc

SEQ ID NO: 471420 - DNA, 25 bp, Mus musculus
tcagtccctagtatagccccaaatc

SEQ ID NO: 471421 - DNA, 25 bp, Mus musculus
tcagtccctggccaggaagtaggca

SEQ ID NO: 471422 - DNA, 25 bp, Mus musculus
tcagtccgaactgggtggtcacggc

SEQ ID NO: 471423 - DNA, 25 bp, Mus musculus
tcagtcctaagcagtggcaaaagca

SEQ ID NO: 471424 - DNA, 25 bp, Mus musculus
tcagtctaaggaagcaatggtcttg

SEQ ID NO: 471425 - DNA, 25 bp, Mus musculus
tcagtctaccaggttgaggtctagc

SEQ ID NO: 471426 - DNA, 25 bp, Mus musculus
tcagtctaccatggagctcagcgag

SEQ ID NO: 471427 - DNA, 25 bp, Mus musculus
tcagtctcgcaccatggtttccggg

SEQ ID NO: 471428 - DNA, 25 bp, Mus musculus
tcagtctcgttcttctggtctctct

SEQ ID NO: 471429 - DNA, 25 bp, Mus musculus
tcagtctgcgtctccagggaaaggg

SEQ ID NO: 471430 - DNA, 25 bp, Mus musculus
tcagtctggacctgagagtgtgaag

SEQ ID NO: 471431 - DNA, 25 bp, Mus musculus
tcagtctgtgggtcatgggcaagca

SEQ ID NO: 471432 - DNA, 25 bp, Mus musculus
tcagtcttgtccagggtctagcagg

SEQ ID NO: 471433 - DNA, 25 bp, Mus musculus
tcagtcttgttatttgggtaatggt

SEQ ID NO: 471434 - DNA, 25 bp, Mus musculus
tcagtcttgtttactcttgccccgg

SEQ ID NO: 471435 - DNA, 25 bp, Mus musculus
tcagtcttttgctcgaagtgaacat

SEQ ID NO: 471436 - DNA, 25 bp, Mus musculus
tcagtgaaagacacgtgcttccagc

SEQ ID NO: 471437 - DNA, 25 bp, Mus musculus
tcagtgaactattccccagcagggc

SEQ ID NO: 471438 - DNA, 25 bp, Mus musculus
tcagtgaagagcgtatctgttccca

SEQ ID NO: 471439 - DNA, 25 bp, Mus musculus
tcagtgaaggagcaaagtggcacca

SEQ ID NO: 471440 - DNA, 25 bp, Mus musculus
tcagtgaagggtacctgcagcctgc

SEQ ID NO: 471441 - DNA, 25 bp, Mus musculus
tcagtgaattcggacgggatcggtc

SEQ ID NO: 471442 - DNA, 25 bp, Mus musculus
tcagtgacacacaagcagcgtcgtc

SEQ ID NO: 471443 - DNA, 25 bp, Mus musculus
tcagtgacacacaaggaaacaagct

SEQ ID NO: 471444 - DNA, 25 bp, Mus musculus
tcagtgacctaagtacaaaagccag

SEQ ID NO: 471445 - DNA, 25 bp, Mus musculus
tcagtgacctagaacagctgtggaa

SEQ ID NO: 471446 - DNA, 25 bp, Mus musculus
tcagtgacgaggagaagacccttcg

SEQ ID NO: 471447 - DNA, 25 bp, Mus musculus
tcagtgactactcggatggccagga

SEQ ID NO: 471448 - DNA, 25 bp, Mus musculus
tcagtgactcaaagacgggaaaccc

SEQ ID NO: 471449 - DNA, 25 bp, Mus musculus
tcagtgactggacaggaagcctctc

SEQ ID NO: 471450 - DNA, 25 bp, Mus musculus
tcagtgacttctcaggcttgcgcca

SEQ ID NO: 471451 - DNA, 25 bp, Mus musculus
tcagtgagaacagcacgagtggccc

SEQ ID NO: 471452 - DNA, 25 bp, Mus musculus
tcagtgagaacgagtacgacgccag

SEQ ID NO: 471453 - DNA, 25 bp, Mus musculus
tcagtgagatctagataacaagtac

SEQ ID NO: 471454 - DNA, 25 bp, Mus musculus
tcagtgagatgacagacaagctagg

SEQ ID NO: 471455 - DNA, 25 bp, Mus musculus
tcagtgagcagagaggatttaaccg

SEQ ID NO: 471456 - DNA, 25 bp, Mus musculus
tcagtgagccactacaggttgtacg

SEQ ID NO: 471457 - DNA, 25 bp, Mus musculus
tcagtgagcggacagaggaatcctc

SEQ ID NO: 471458 - DNA, 25 bp, Mus musculus
tcagtgagcttgaccggttgactct

SEQ ID NO: 471459 - DNA, 25 bp, Mus musculus
tcagtgaggcaaggagaggaggcgt

SEQ ID NO: 471460 - DNA, 25 bp, Mus musculus
tcagtgaggctgagggcttagctaa

SEQ ID NO: 471461 - DNA, 25 bp, Mus musculus
tcagtgagtagacacctcttctttc

SEQ ID NO: 471462 - DNA, 25 bp, Mus musculus
tcagtgagtatctgagctgggtgcc

SEQ ID NO: 471463 - DNA, 25 bp, Mus musculus
tcagtgatagagcttgaaaccgttc

SEQ ID NO: 471464 - DNA, 25 bp, Mus musculus
tcagtgatcttgtagagatgtgcac

SEQ ID NO: 471465 - DNA, 25 bp, Mus musculus
tcagtgatgacctctaataagtaat

SEQ ID NO: 471466 - DNA, 25 bp, Mus musculus
tcagtgcaaggaaggatgggcccct

SEQ ID NO: 471467 - DNA, 25 bp, Mus musculus
tcagtgcactgtatatgggagccct

SEQ ID NO: 471468 - DNA, 25 bp, Mus musculus
tcagtgcagagctcttgcctaaggc

SEQ ID NO: 471469 - DNA, 25 bp, Mus musculus
tcagtgcagtgccagagttcctgcc

SEQ ID NO: 471470 - DNA, 25 bp, Mus musculus
tcagtgcatggcaagtacgcagcaa

SEQ ID NO: 471471 - DNA, 25 bp, Mus musculus
tcagtgccagtgagccctagaggca

SEQ ID NO: 471472 - DNA, 25 bp, Mus musculus
tcagtgccagtggagtctgaaccca

SEQ ID NO: 471473 - DNA, 25 bp, Mus musculus
tcagtgcccagccaagtgcctttct

SEQ ID NO: 471474 - DNA, 25 bp, Mus musculus
tcagtgccgagagtcaagatgccga

SEQ ID NO: 471475 - DNA, 25 bp, Mus musculus
tcagtgccgtcgtagccagtatcat

SEQ ID NO: 471476 - DNA, 25 bp, Mus musculus
tcagtgcgagttcagatgacacgct

SEQ ID NO: 471477 - DNA, 25 bp, Mus musculus
tcagtgcggaagctctccaaaatcg

SEQ ID NO: 471478 - DNA, 25 bp, Mus musculus
tcagtgcggttggaaaaatagtcat

SEQ ID NO: 471479 - DNA, 25 bp, Mus musculus
tcagtgctacacaacaagactctgt

SEQ ID NO: 471480 - DNA, 25 bp, Mus musculus
tcagtgctagcatcagaaaaaggaa

SEQ ID NO: 471481 - DNA, 25 bp, Mus musculus
tcagtgctagccaggaaattactcc

SEQ ID NO: 471482 - DNA, 25 bp, Mus musculus
tcagtgctgcaaagtattagttgct

SEQ ID NO: 471483 - DNA, 25 bp, Mus musculus
tcagtgctgcggatgtcgacctgca

SEQ ID NO: 471484 - DNA, 25 bp, Mus musculus
tcagtgctggtcaaaggctgccaac

SEQ ID NO: 471485 - DNA, 25 bp, Mus musculus
tcagtgctgtgataaactgacatct

SEQ ID NO: 471486 - DNA, 25 bp, Mus musculus
tcagtggacaccagcgaaagcggat

SEQ ID NO: 471487 - DNA, 25 bp, Mus musculus
tcagtggacctgactcattaggcag

SEQ ID NO: 471488 - DNA, 25 bp, Mus musculus
tcagtggagcaagcccttggctcgc

SEQ ID NO: 471489 - DNA, 25 bp, Mus musculus
tcagtggagtgttccagggatgcca

SEQ ID NO: 471490 - DNA, 25 bp, Mus musculus
tcagtggagttcctcaggacctctc

SEQ ID NO: 471491 - DNA, 25 bp, Mus musculus
tcagtggcaacgaacaacgccaggg

SEQ ID NO: 471492 - DNA, 25 bp, Mus musculus
tcagtggcccagcttttatacagaa

SEQ ID NO: 471493 - DNA, 25 bp, Mus musculus
tcagtggcccataacatgacaatgc

SEQ ID NO: 471494 - DNA, 25 bp, Mus musculus
tcagtggctctcagtcctagtaggg

SEQ ID NO: 471495 - DNA, 25 bp, Mus musculus
tcagtgggaaatgagtgagacattc

SEQ ID NO: 471496 - DNA, 25 bp, Mus musculus
tcagtgggagaacctttaagccacg

SEQ ID NO: 471497 - DNA, 25 bp, Mus musculus
tcagtgggagagcttcgacgtcacc

SEQ ID NO: 471498 - DNA, 25 bp, Mus musculus
tcagtgggctctaccttgaaaagac

SEQ ID NO: 471499 - DNA, 25 bp, Mus musculus
tcagtgggtagaggcacctactgca

SEQ ID NO: 471500 - DNA, 25 bp, Mus musculus
tcagtgggtgtggaaataggacctt

SEQ ID NO: 471501 - DNA, 25 bp, Mus musculus
tcagtgggttggatacaagagagat

SEQ ID NO: 471502 - DNA, 25 bp, Mus musculus
tcagtggtggctgggtcctttgatc

SEQ ID NO: 471503 - DNA, 25 bp, Mus musculus
tcagtgtaaccagtgtggaaaggcc

SEQ ID NO: 471504 - DNA, 25 bp, Mus musculus
tcagtgtcaaagaagccccgcttag

SEQ ID NO: 471505 - DNA, 25 bp, Mus musculus
tcagtgtcactccttaaagcttgtc

SEQ ID NO: 471506 - DNA, 25 bp, Mus musculus
tcagtgtctgtgagtggtcactctc

SEQ ID NO: 471507 - DNA, 25 bp, Mus musculus
tcagtgtgaccgaagatacctggct

SEQ ID NO: 471508 - DNA, 25 bp, Mus musculus
tcagtgtgatatttatatgcatgca

SEQ ID NO: 471509 - DNA, 25 bp, Mus musculus
tcagtgtgcatgagtgtccgaccgg

SEQ ID NO: 471510 - DNA, 25 bp, Mus musculus
tcagtgtgcgctcaacagtgtctaa

SEQ ID NO: 471511 - DNA, 25 bp, Mus musculus
tcagtgtggctgaataaaggcttcc

SEQ ID NO: 471512 - DNA, 25 bp, Mus musculus
tcagtgtgggatgcaagacgtgcct

SEQ ID NO: 471513 - DNA, 25 bp, Mus musculus
tcagtgtggttttcagaggcagccc

SEQ ID NO: 471514 - DNA, 25 bp, Mus musculus
tcagtgtgtaatccagactggcctt

SEQ ID NO: 471515 - DNA, 25 bp, Mus musculus
tcagtgtgtgctacagcgctgctgt

SEQ ID NO: 471516 - DNA, 25 bp, Mus musculus
tcagtgtgtgtacccgagtgttccg

SEQ ID NO: 471517 - DNA, 25 bp, Mus musculus
tcagtgtgtttgagctctgctttga

SEQ ID NO: 471518 - DNA, 25 bp, Mus musculus
tcagtgttccatcttccgactaggg

SEQ ID NO: 471519 - DNA, 25 bp, Mus musculus
tcagtgtttctagccaagaatgcac

SEQ ID NO: 471520 - DNA, 25 bp, Mus musculus
tcagttaaagctgccctggagccgg

SEQ ID NO: 471521 - DNA, 25 bp, Mus musculus
tcagttaagctaaagttgtagacca

SEQ ID NO: 471522 - DNA, 25 bp, Mus musculus
tcagttacaacgacgaaggtggcgg

SEQ ID NO: 471523 - DNA, 25 bp, Mus musculus
tcagttacacccatcatgctgaggg

SEQ ID NO: 471524 - DNA, 25 bp, Mus musculus
tcagttacatccagcataagttaca

SEQ ID NO: 471525 - DNA, 25 bp, Mus musculus
tcagttaccggaacaaggaccttcg

SEQ ID NO: 471526 - DNA, 25 bp, Mus musculus
tcagttagacctccagaagacatcc

SEQ ID NO: 471527 - DNA, 25 bp, Mus musculus
tcagttagattttagcttggcagct

SEQ ID NO: 471528 - DNA, 25 bp, Mus musculus
tcagttatcacaccgaggacgcctg

SEQ ID NO: 471529 - DNA, 25 bp, Mus musculus
tcagttcaaagatgtaggtactaca

SEQ ID NO: 471530 - DNA, 25 bp, Mus musculus
tcagttcaaggcgagccccaggagt

SEQ ID NO: 471531 - DNA, 25 bp, Mus musculus
tcagttcaaggtggtgacgcggtcc

SEQ ID NO: 471532 - DNA, 25 bp, Mus musculus
tcagttcaatgaggtgctggccgcc

SEQ ID NO: 471533 - DNA, 25 bp, Mus musculus
tcagttcacctttgagtagcagaac

SEQ ID NO: 471534 - DNA, 25 bp, Mus musculus
tcagttcatccaatcacagtgcgag

SEQ ID NO: 471535 - DNA, 25 bp, Mus musculus
tcagttccacggctgcatgcattag

SEQ ID NO: 471536 - DNA, 25 bp, Mus musculus
tcagttccagaatgagccacagcag

SEQ ID NO: 471537 - DNA, 25 bp, Mus musculus
tcagttccgctggttatggtgccca

SEQ ID NO: 471538 - DNA, 25 bp, Mus musculus
tcagttccggaaagttggcagccac

SEQ ID NO: 471539 - DNA, 25 bp, Mus musculus
tcagttccgggtggtcaaggagccc

SEQ ID NO: 471540 - DNA, 25 bp, Mus musculus
tcagttcctgaagattgccaagccc

SEQ ID NO: 471541 - DNA, 25 bp, Mus musculus
tcagttcgctgagtatggagcccgc

SEQ ID NO: 471542 - DNA, 25 bp, Mus musculus
tcagttctagtattaatgctgttaa

SEQ ID NO: 471543 - DNA, 25 bp, Mus musculus
tcagttctcacgagacatggatctg

SEQ ID NO: 471544 - DNA, 25 bp, Mus musculus
tcagttctgatgaagctaccaaccc

SEQ ID NO: 471545 - DNA, 25 bp, Mus musculus
tcagttctgctgatgggaggcgcaa

SEQ ID NO: 471546 - DNA, 25 bp, Mus musculus
tcagttctgggctatacgagggcac

SEQ ID NO: 471547 - DNA, 25 bp, Mus musculus
tcagttctgtatagcaagaggtggg

SEQ ID NO: 471548 - DNA, 25 bp, Mus musculus
tcagttgccacaagcatggctacag

SEQ ID NO: 471549 - DNA, 25 bp, Mus musculus
tcagttgccaggaaagctccagcga

SEQ ID NO: 471550 - DNA, 25 bp, Mus musculus
tcagttgccgatggacaccgagtgt

SEQ ID NO: 471551 - DNA, 25 bp, Mus musculus
tcagttgctcggaggtcgctcggaa

SEQ ID NO: 471552 - DNA, 25 bp, Mus musculus
tcagttggatgagctcatggcccac

SEQ ID NO: 471553 - DNA, 25 bp, Mus musculus
tcagttgggcagacatccagctcct

SEQ ID NO: 471554 - DNA, 25 bp, Mus musculus
tcagttgggctctctgggagtcagc

SEQ ID NO: 471555 - DNA, 25 bp, Mus musculus
tcagttggtagtccaagctgttgga

SEQ ID NO: 471556 - DNA, 25 bp, Mus musculus
tcagttggtgacagctaaccccagc

SEQ ID NO: 471557 - DNA, 25 bp, Mus musculus
tcagttgtccaaagcgaagaagggc

SEQ ID NO: 471558 - DNA, 25 bp, Mus musculus
tcagttgtgaaagcaattagggctc

SEQ ID NO: 471559 - DNA, 25 bp, Mus musculus
tcagttgtttaacatggaaaggcat

SEQ ID NO: 471560 - DNA, 25 bp, Mus musculus
tcagtttaaccctgagagcccagag

SEQ ID NO: 471561 - DNA, 25 bp, Mus musculus
tcagtttaccaaacagacatggcta

SEQ ID NO: 471562 - DNA, 25 bp, Mus musculus
tcagtttaccacatggcgacagcca

SEQ ID NO: 471563 - DNA, 25 bp, Mus musculus
tcagtttagacagggtgagagtgaa

SEQ ID NO: 471564 - DNA, 25 bp, Mus musculus
tcagtttagagagaggacacccctc

SEQ ID NO: 471565 - DNA, 25 bp, Mus musculus
tcagtttccaaatgaggaactctgt

SEQ ID NO: 471566 - DNA, 25 bp, Mus musculus
tcagtttcccaggttgcattgcaga

SEQ ID NO: 471567 - DNA, 25 bp, Mus musculus
tcagtttcccctctgagataaggaa

SEQ ID NO: 471568 - DNA, 25 bp, Mus musculus
tcagtttccgaagcctgctaggtgt

SEQ ID NO: 471569 - DNA, 25 bp, Mus musculus
tcagtttccgtgttcgggaggccct

SEQ ID NO: 471570 - DNA, 25 bp, Mus musculus
tcagtttgaccgaaagtacacgaga

SEQ ID NO: 471571 - DNA, 25 bp, Mus musculus
tcagtttgacgaagacatggacagt

SEQ ID NO: 471572 - DNA, 25 bp, Mus musculus
tcagtttgacttcatgggcctcaga

SEQ ID NO: 471573 - DNA, 25 bp, Mus musculus
tcagtttgaggagaagatcggcaca

SEQ ID NO: 471574 - DNA, 25 bp, Mus musculus
tcagtttggaagatagctggacccc

SEQ ID NO: 471575 - DNA, 25 bp, Mus musculus
tcagtttgtcgtgctcctctccatt

SEQ ID NO: 471576 - DNA, 25 bp, Mus musculus
tcagttttacagtgtgcaggtggcg

SEQ ID NO: 471577 - DNA, 25 bp, Mus musculus
tcagttttatgttcagcccgacgct

SEQ ID NO: 471578 - DNA, 25 bp, Mus musculus
tcagttttgataccggcaggcagca

SEQ ID NO: 471579 - DNA, 25 bp, Mus musculus
tcagttttgcgaagagaagagtagg

SEQ ID NO: 471580 - DNA, 25 bp, Mus musculus
tcagttttgttagagccttccaggc

SEQ ID NO: 471581 - DNA, 25 bp, Mus musculus
tcataaacgacaaaggtgcctggac

SEQ ID NO: 471582 - DNA, 25 bp, Mus musculus
tcataaacggacaaagctgtgatcc

SEQ ID NO: 471583 - DNA, 25 bp, Mus musculus
tcataaagcaggtaagaggagaggt

SEQ ID NO: 471584 - DNA, 25 bp, Mus musculus
tcataaagctatttaatcccggagc

SEQ ID NO: 471585 - DNA, 25 bp, Mus musculus
tcataaataacgtgaacagcccggc

SEQ ID NO: 471586 - DNA, 25 bp, Mus musculus
tcataaattagtgccgggtgctgaa

SEQ ID NO: 471587 - DNA, 25 bp, Mus musculus
tcataacctgaggtgagcagcccac

SEQ ID NO: 471588 - DNA, 25 bp, Mus musculus
tcataagaacagagcatcacccgtc

SEQ ID NO: 471589 - DNA, 25 bp, Mus musculus
tcataagaaccacagccttgaaggt

SEQ ID NO: 471590 - DNA, 25 bp, Mus musculus
tcataagagtcattaggagaaagca

SEQ ID NO: 471591 - DNA, 25 bp, Mus musculus
tcataagcttgcaaggaggtgacct

SEQ ID NO: 471592 - DNA, 25 bp, Mus musculus
tcataagtggcagatgctgctcgcc

SEQ ID NO: 471593 - DNA, 25 bp, Mus musculus
tcataatctgactgctggtttctgg

SEQ ID NO: 471594 - DNA, 25 bp, Mus musculus
tcataatgaaagcttcaggtgggct

SEQ ID NO: 471595 - DNA, 25 bp, Mus musculus
tcataatgacagaagcaggcacgtg

SEQ ID NO: 471596 - DNA, 25 bp, Mus musculus
tcataatgcctgatagtgccgtggt

SEQ ID NO: 471597 - DNA, 25 bp, Mus musculus
tcataatggagattggcctgtgctt

SEQ ID NO: 471598 - DNA, 25 bp, Mus musculus
tcataatggtaagtttgtaagagtt

SEQ ID NO: 471599 - DNA, 25 bp, Mus musculus
tcataatgtactacccgagggcatg

SEQ ID NO: 471600 - DNA, 25 bp, Mus musculus
tcatacaaaaggaagcagggcccat

SEQ ID NO: 471601 - DNA, 25 bp, Mus musculus
tcatacacatggtttcgaggacaca

SEQ ID NO: 471602 - DNA, 25 bp, Mus musculus
tcatacagcatgatggccggaacca

SEQ ID NO: 471603 - DNA, 25 bp, Mus musculus
tcatacagggcccagaaactaggcg

SEQ ID NO: 471604 - DNA, 25 bp, Mus musculus
tcatacaggtttggaccaacagggc

SEQ ID NO: 471605 - DNA, 25 bp, Mus musculus
tcatacatcgcgctcattgccatgg

SEQ ID NO: 471606 - DNA, 25 bp, Mus musculus
tcatacattccatccttggctggct

SEQ ID NO: 471607 - DNA, 25 bp, Mus musculus
tcataccccaggatctaaagcgtgg

SEQ ID NO: 471608 - DNA, 25 bp, Mus musculus
tcataccgagaagagtatttaaccg

SEQ ID NO: 471609 - DNA, 25 bp, Mus musculus
tcataccgggtatggtcagacacgc

SEQ ID NO: 471610 - DNA, 25 bp, Mus musculus
tcatacctcgagtggactgccagag

SEQ ID NO: 471611 - DNA, 25 bp, Mus musculus
tcatacgacagaacgaagcagcatc

SEQ ID NO: 471612 - DNA, 25 bp, Mus musculus
tcatacgagtaataatagccgctgt

SEQ ID NO: 471613 - DNA, 25 bp, Mus musculus
tcatacgcaagatgcaggagcacca

SEQ ID NO: 471614 - DNA, 25 bp, Mus musculus
tcatacgtcagagaaaccaagggta

SEQ ID NO: 471615 - DNA, 25 bp, Mus musculus
tcatactggcctgtgaaacactcgc

SEQ ID NO: 471616 - DNA, 25 bp, Mus musculus
tcatacttacttagagaccagaata

SEQ ID NO: 471617 - DNA, 25 bp, Mus musculus
tcatacttgctactgcctgagcggc

SEQ ID NO: 471618 - DNA, 25 bp, Mus musculus
tcatactttgtaccgtgccccggga

SEQ ID NO: 471619 - DNA, 25 bp, Mus musculus
tcatagaaaaaaggcgtcgggatcg

SEQ ID NO: 471620 - DNA, 25 bp, Mus musculus
tcatagaccagagcgagggcaagtt

SEQ ID NO: 471621 - DNA, 25 bp, Mus musculus
tcatagacccgaactgtagtggcca

SEQ ID NO: 471622 - DNA, 25 bp, Mus musculus
tcatagagaatgcagggtcactggt

SEQ ID NO: 471623 - DNA, 25 bp, Mus musculus
tcatagagacctactcagacgtggg

SEQ ID NO: 471624 - DNA, 25 bp, Mus musculus
tcatagagcccgtgagtgacagcat

SEQ ID NO: 471625 - DNA, 25 bp, Mus musculus
tcatagagttgttgtagcctagact

SEQ ID NO: 471626 - DNA, 25 bp, Mus musculus
tcatagatgacatggtggcccaagc

SEQ ID NO: 471627 - DNA, 25 bp, Mus musculus
tcatagcaattctcatcggcctggt

SEQ ID NO: 471628 - DNA, 25 bp, Mus musculus
tcatagcaggagtcgacgtcgacgt

SEQ ID NO: 471629 - DNA, 25 bp, Mus musculus
tcatagcagttgtggtacccgacgt

SEQ ID NO: 471630 - DNA, 25 bp, Mus musculus
tcatagcccttgacagcaacacagg

SEQ ID NO: 471631 - DNA, 25 bp, Mus musculus
tcatagcctttgatgagctgcggac

SEQ ID NO: 471632 - DNA, 25 bp, Mus musculus
tcatagctccagtgccaggaggttt

SEQ ID NO: 471633 - DNA, 25 bp, Mus musculus
tcatagctgcagagacactctccat

SEQ ID NO: 471634 - DNA, 25 bp, Mus musculus
tcatagctgcctgaatggtatctgg

SEQ ID NO: 471635 - DNA, 25 bp, Mus musculus
tcatagctggaaaccaacacacggg

SEQ ID NO: 471636 - DNA, 25 bp, Mus musculus
tcatagctggcaacaaggcccatgg

SEQ ID NO: 471637 - DNA, 25 bp, Mus musculus
tcataggctgcaccgaagtaacaag

SEQ ID NO: 471638 - DNA, 25 bp, Mus musculus
tcatagggacaggttgtgtccacca

SEQ ID NO: 471639 - DNA, 25 bp, Mus musculus
tcataggtcatctctttggaaactc

SEQ ID NO: 471640 - DNA, 25 bp, Mus musculus
tcataggtcgcagatatcctgagct

SEQ ID NO: 471641 - DNA, 25 bp, Mus musculus
tcatagtagaaagagacttcggcgg

SEQ ID NO: 471642 - DNA, 25 bp, Mus musculus
tcatagtctgcatgcttaagttcca

SEQ ID NO: 471643 - DNA, 25 bp, Mus musculus
tcatagtcttctcgcccgacactga

SEQ ID NO: 471644 - DNA, 25 bp, Mus musculus
tcatagtgacccgagactgctgtct

SEQ ID NO: 471645 - DNA, 25 bp, Mus musculus
tcatagtgttaaacatgtaacgacc

SEQ ID NO: 471646 - DNA, 25 bp, Mus musculus
tcatagttcctgtgggtccgaagct

SEQ ID NO: 471647 - DNA, 25 bp, Mus musculus
tcatagttttgaatgccaggaagtc

SEQ ID NO: 471648 - DNA, 25 bp, Mus musculus
tcatataaaacaggcatgctgctgg

SEQ ID NO: 471649 - DNA, 25 bp, Mus musculus
tcatataaacgacggaggtacccca

SEQ ID NO: 471650 - DNA, 25 bp, Mus musculus
tcatatacagggacaacagcattgg

SEQ ID NO: 471651 - DNA, 25 bp, Mus musculus
tcatatacatatagggcacatcacc

SEQ ID NO: 471652 - DNA, 25 bp, Mus musculus
tcatatacgcagttagatcaagctg

SEQ ID NO: 471653 - DNA, 25 bp, Mus musculus
tcatatactgtgaaagccatccgtt

SEQ ID NO: 471654 - DNA, 25 bp, Mus musculus
tcatatattttcctggtcccgaggg

SEQ ID NO: 471655 - DNA, 25 bp, Mus musculus
tcatatcatcgaccagaggaccagg

SEQ ID NO: 471656 - DNA, 25 bp, Mus musculus
tcatatccctggtagcatgggcgcc

SEQ ID NO: 471657 - DNA, 25 bp, Mus musculus
tcatatcgccaagtacctgggaagc

SEQ ID NO: 471658 - DNA, 25 bp, Mus musculus
tcatatctgccgaggaatgcctgag

SEQ ID NO: 471659 - DNA, 25 bp, Mus musculus
tcatatgagcgcatcaaggtcccac

SEQ ID NO: 471660 - DNA, 25 bp, Mus musculus
tcatatggacaagagcagcagactc

SEQ ID NO: 471661 - DNA, 25 bp, Mus musculus
tcatatggaggtggaatcagcagcg

SEQ ID NO: 471662 - DNA, 25 bp, Mus musculus
tcatatgtctcctctcgtcctttag

SEQ ID NO: 471663 - DNA, 25 bp, Mus musculus
tcatatgttcaccacagcggaagga

SEQ ID NO: 471664 - DNA, 25 bp, Mus musculus
tcatatgtttctactgagacacaga

SEQ ID NO: 471665 - DNA, 25 bp, Mus musculus
tcatattaaaagtggcgcagctgtc

SEQ ID NO: 471666 - DNA, 25 bp, Mus musculus
tcatattgctccagggacagtcggg

SEQ ID NO: 471667 - DNA, 25 bp, Mus musculus
tcatattggcaaccctaaagctggg

SEQ ID NO: 471668 - DNA, 25 bp, Mus musculus
tcatcaaaacagaggtcaacggctt

SEQ ID NO: 471669 - DNA, 25 bp, Mus musculus
tcatcaaaagcgtcacacggaacgg

SEQ ID NO: 471670 - DNA, 25 bp, Mus musculus
tcatcaaaagcttcgtgggcctggc

SEQ ID NO: 471671 - DNA, 25 bp, Mus musculus
tcatcaaacgcagcaagggtggcaa

SEQ ID NO: 471672 - DNA, 25 bp, Mus musculus
tcatcaaccgtgtggctgaaccagc

SEQ ID NO: 471673 - DNA, 25 bp, Mus musculus
tcatcaacgggtcctcagcttagag

SEQ ID NO: 471674 - DNA, 25 bp, Mus musculus
tcatcaactacctctgctacggagt

SEQ ID NO: 471675 - DNA, 25 bp, Mus musculus
tcatcaagaaaaagtggagccagct

SEQ ID NO: 471676 - DNA, 25 bp, Mus musculus
tcatcaagaagtacaggctgcagtt

SEQ ID NO: 471677 - DNA, 25 bp, Mus musculus
tcatcaagacagtgggaggcaccca

SEQ ID NO: 471678 - DNA, 25 bp, Mus musculus
tcatcaagacgacataggacacctc

SEQ ID NO: 471679 - DNA, 25 bp, Mus musculus
tcatcaagagagagggtacaggcac

SEQ ID NO: 471680 - DNA, 25 bp, Mus musculus
tcatcaagatgagtaagtcctcagg

SEQ ID NO: 471681 - DNA, 25 bp, Mus musculus
tcatcaagccgagagggcgtcaaag

SEQ ID NO: 471682 - DNA, 25 bp, Mus musculus
tcatcaagcctggagcagatctctc

SEQ ID NO: 471683 - DNA, 25 bp, Mus musculus
tcatcaagggcaaaaatggagtccc

SEQ ID NO: 471684 - DNA, 25 bp, Mus musculus
tcatcaagtcctggaagaagctctt

SEQ ID NO: 471685 - DNA, 25 bp, Mus musculus
tcatcaagtgtgacagttgggcagg

SEQ ID NO: 471686 - DNA, 25 bp, Mus musculus
tcatcaataagtgtggcaggcggaa

SEQ ID NO: 471687 - DNA, 25 bp, Mus musculus
tcatcaatgagagtggaaaccccag

SEQ ID NO: 471688 - DNA, 25 bp, Mus musculus
tcatcacagcaagagaacagtcatg

SEQ ID NO: 471689 - DNA, 25 bp, Mus musculus
tcatcacagcaagagcgcgaggcag

SEQ ID NO: 471690 - DNA, 25 bp, Mus musculus
tcatcacagctaacctcggaaagga

SEQ ID NO: 471691 - DNA, 25 bp, Mus musculus
tcatcacaggtagtgagaccgacct

SEQ ID NO: 471692 - DNA, 25 bp, Mus musculus
tcatcaccaaggagagcttactaga

SEQ ID NO: 471693 - DNA, 25 bp, Mus musculus
tcatcactcctaaaggtggcggcgg

SEQ ID NO: 471694 - DNA, 25 bp, Mus musculus
tcatcactggagagaacaaagagac

SEQ ID NO: 471695 - DNA, 25 bp, Mus musculus
tcatcactgggattgtggtcaccgc

SEQ ID NO: 471696 - DNA, 25 bp, Mus musculus
tcatcagaaaaggtgagtgccgatc

SEQ ID NO: 471697 - DNA, 25 bp, Mus musculus
tcatcagaccctagtgtcattagct

SEQ ID NO: 471698 - DNA, 25 bp, Mus musculus
tcatcagacctgctgggttcatcag

SEQ ID NO: 471699 - DNA, 25 bp, Mus musculus
tcatcagactgcaaggagggtgtca

SEQ ID NO: 471700 - DNA, 25 bp, Mus musculus
tcatcagaggatggaagctcaccct

SEQ ID NO: 471701 - DNA, 25 bp, Mus musculus
tcatcagatgtgatcactgctggcc

SEQ ID NO: 471702 - DNA, 25 bp, Mus musculus
tcatcagcaagaagcaggattcggc

SEQ ID NO: 471703 - DNA, 25 bp, Mus musculus
tcatcagcaatgagaactggaagcc

SEQ ID NO: 471704 - DNA, 25 bp, Mus musculus
tcatcagcagagacgagatcacggc

SEQ ID NO: 471705 - DNA, 25 bp, Mus musculus
tcatcagcagtatagggaaactcaa

SEQ ID NO: 471706 - DNA, 25 bp, Mus musculus
tcatcagcatcttcctggtggtggc

SEQ ID NO: 471707 - DNA, 25 bp, Mus musculus
tcatcagcgctatatcaaggagctc

SEQ ID NO: 471708 - DNA, 25 bp, Mus musculus
tcatcagcgggaaagccatcatcgt

SEQ ID NO: 471709 - DNA, 25 bp, Mus musculus
tcatcagctctcattatttgcagga

SEQ ID NO: 471710 - DNA, 25 bp, Mus musculus
tcatcagcttgtgccaggcagagga

SEQ ID NO: 471711 - DNA, 25 bp, Mus musculus
tcatcaggaatatcatgtgccagag

SEQ ID NO: 471712 - DNA, 25 bp, Mus musculus
tcatcaggaccatgttggcaggact

SEQ ID NO: 471713 - DNA, 25 bp, Mus musculus
tcatcaggattggagaggctagcat

SEQ ID NO: 471714 - DNA, 25 bp, Mus musculus
tcatcaggccccataggtgtgaagg

SEQ ID NO: 471715 - DNA, 25 bp, Mus musculus
tcatcaggtaggagaagaacgcagg

SEQ ID NO: 471716 - DNA, 25 bp, Mus musculus
tcatcaggttctggcgtagagccct

SEQ ID NO: 471717 - DNA, 25 bp, Mus musculus
tcatcaggttttccggagttcccat

SEQ ID NO: 471718 - DNA, 25 bp, Mus musculus
tcatcagtgttagcaaaggaagccc

SEQ ID NO: 471719 - DNA, 25 bp, Mus musculus
tcatcataaaggacatggccgcagc

SEQ ID NO: 471720 - DNA, 25 bp, Mus musculus
tcatcatagcaaggctcctgagcca

SEQ ID NO: 471721 - DNA, 25 bp, Mus musculus
tcatcatcaccacactggtctgcag

SEQ ID NO: 471722 - DNA, 25 bp, Mus musculus
tcatcatcagcatcaacggacagtc

SEQ ID NO: 471723 - DNA, 25 bp, Mus musculus
tcatcatccagaccttcgagggctg

SEQ ID NO: 471724 - DNA, 25 bp, Mus musculus
tcatcatcccgaccttgaaagagag

SEQ ID NO: 471725 - DNA, 25 bp, Mus musculus
tcatcatcctgttttgtgtcacacg

SEQ ID NO: 471726 - DNA, 25 bp, Mus musculus
tcatcatctgacgtgggctgctgca

SEQ ID NO: 471727 - DNA, 25 bp, Mus musculus
tcatcatctgcaggaggactaccgg

SEQ ID NO: 471728 - DNA, 25 bp, Mus musculus
tcatcatgagcaaggaggtcactct

SEQ ID NO: 471729 - DNA, 25 bp, Mus musculus
tcatcatgatcctggtctacgtgcg

SEQ ID NO: 471730 - DNA, 25 bp, Mus musculus
tcatcatgccttgcaactggtgggt

SEQ ID NO: 471731 - DNA, 25 bp, Mus musculus
tcatcatgctcgtgggtgacacata

SEQ ID NO: 471732 - DNA, 25 bp, Mus musculus
tcatcatgggcaacagcgcaaagga

SEQ ID NO: 471733 - DNA, 25 bp, Mus musculus
tcatcatgggcctggtctatgcgcg

SEQ ID NO: 471734 - DNA, 25 bp, Mus musculus
tcatcatgggctctagggcagtgtc

SEQ ID NO: 471735 - DNA, 25 bp, Mus musculus
tcatcattaagagaacgaaaagggc

SEQ ID NO: 471736 - DNA, 25 bp, Mus musculus
tcatcattcagatgccggagctccg

SEQ ID NO: 471737 - DNA, 25 bp, Mus musculus
tcatcattcagggagacttcacaga

SEQ ID NO: 471738 - DNA, 25 bp, Mus musculus
tcatcattccacagaggaaccgaag

SEQ ID NO: 471739 - DNA, 25 bp, Mus musculus
tcatcattgagagggagacaggctg

SEQ ID NO: 471740 - DNA, 25 bp, Mus musculus
tcatcattggcagcagcatcggagg

SEQ ID NO: 471741 - DNA, 25 bp, Mus musculus
tcatcattggctcgctgtgggacaa

SEQ ID NO: 471742 - DNA, 25 bp, Mus musculus
tcatcattggtcaggtcgataagcg

SEQ ID NO: 471743 - DNA, 25 bp, Mus musculus
tcatcatttggagtgaccacagtct

SEQ ID NO: 471744 - DNA, 25 bp, Mus musculus
tcatccaactcaagagacagggtct

SEQ ID NO: 471745 - DNA, 25 bp, Mus musculus
tcatccaagcgcctggagagatggc

SEQ ID NO: 471746 - DNA, 25 bp, Mus musculus
tcatccaccggcaagtgaagcgtgc

SEQ ID NO: 471747 - DNA, 25 bp, Mus musculus
tcatccacgcagatgagctggccca

SEQ ID NO: 471748 - DNA, 25 bp, Mus musculus
tcatccagagtgagcatcatccaag

SEQ ID NO: 471749 - DNA, 25 bp, Mus musculus
tcatccagcaggtcagggcttcgtg

SEQ ID NO: 471750 - DNA, 25 bp, Mus musculus
tcatccagctgaagcctgacgtggt

SEQ ID NO: 471751 - DNA, 25 bp, Mus musculus
tcatccaggagcttgtagacacaga

SEQ ID NO: 471752 - DNA, 25 bp, Mus musculus
tcatccaggcaggtaggaagcggcc

SEQ ID NO: 471753 - DNA, 25 bp, Mus musculus
tcatccagggccgaaatcaagggta

SEQ ID NO: 471754 - DNA, 25 bp, Mus musculus
tcatccagggtcaaaagcaaggctt

SEQ ID NO: 471755 - DNA, 25 bp, Mus musculus
tcatccagtggaacccttgcctggg

SEQ ID NO: 471756 - DNA, 25 bp, Mus musculus
tcatccatacctttggagaagctcg

SEQ ID NO: 471757 - DNA, 25 bp, Mus musculus
tcatccatgatgtgctttccaaggc

SEQ ID NO: 471758 - DNA, 25 bp, Mus musculus
tcatccatgccttcctagggctgga

SEQ ID NO: 471759 - DNA, 25 bp, Mus musculus
tcatcccaagctgttttcagtcaac

SEQ ID NO: 471760 - DNA, 25 bp, Mus musculus
tcatcccagtaggaaagaggagctg

SEQ ID NO: 471761 - DNA, 25 bp, Mus musculus
tcatcccatcaaccaggccaagtgt

SEQ ID NO: 471762 - DNA, 25 bp, Mus musculus
tcatccccaggagcactagaatggc

SEQ ID NO: 471763 - DNA, 25 bp, Mus musculus
tcatccccatctacaaagcaaatag

SEQ ID NO: 471764 - DNA, 25 bp, Mus musculus
tcatccccgggtacatggcttacat

SEQ ID NO: 471765 - DNA, 25 bp, Mus musculus
tcatcccggcggagcaggaacccga

SEQ ID NO: 471766 - DNA, 25 bp, Mus musculus
tcatcccggtgaagcaatgtctgct

SEQ ID NO: 471767 - DNA, 25 bp, Mus musculus
tcatccctgaaagagctggtggcca

SEQ ID NO: 471768 - DNA, 25 bp, Mus musculus
tcatccctgagtggccggtaaggac

SEQ ID NO: 471769 - DNA, 25 bp, Mus musculus
tcatccctggcgtcacatgagaaca

SEQ ID NO: 471770 - DNA, 25 bp, Mus musculus
tcatccgaaaagtggccaagcagtg

SEQ ID NO: 471771 - DNA, 25 bp, Mus musculus
tcatccgaaagcagacactggtctt

SEQ ID NO: 471772 - DNA, 25 bp, Mus musculus
tcatccgaggagtcaagtcttcagg

SEQ ID NO: 471773 - DNA, 25 bp, Mus musculus
tcatccggacactacggcaggaact

SEQ ID NO: 471774 - DNA, 25 bp, Mus musculus
tcatccggcaaaagagacaagcccg

SEQ ID NO: 471775 - DNA, 25 bp, Mus musculus
tcatccggccggtggagaatgtctc

SEQ ID NO: 471776 - DNA, 25 bp, Mus musculus
tcatccggctgctgaagtgcaagcg

SEQ ID NO: 471777 - DNA, 25 bp, Mus musculus
tcatccgggaggtcaatgccatgca

SEQ ID NO: 471778 - DNA, 25 bp, Mus musculus
tcatccgggtgcaaagaggaatttc

SEQ ID NO: 471779 - DNA, 25 bp, Mus musculus
tcatccgtaggtggtggaatcacac

SEQ ID NO: 471780 - DNA, 25 bp, Mus musculus
tcatccgtcacaggagtcagaaagg

SEQ ID NO: 471781 - DNA, 25 bp, Mus musculus
tcatccgtgtacgagtgcctggcag

SEQ ID NO: 471782 - DNA, 25 bp, Mus musculus
tcatcctaagagaaggtgtgcgcac

SEQ ID NO: 471783 - DNA, 25 bp, Mus musculus
tcatcctcaacctgggtgtggccga

SEQ ID NO: 471784 - DNA, 25 bp, Mus musculus
tcatcctcagtcaggaggccgagat

SEQ ID NO: 471785 - DNA, 25 bp, Mus musculus
tcatcctcatgaaggtgagactcct

SEQ ID NO: 471786 - DNA, 25 bp, Mus musculus
tcatcctcggctcatccaaagtggg

SEQ ID NO: 471787 - DNA, 25 bp, Mus musculus
tcatcctctgcatacccagtgtggg

SEQ ID NO: 471788 - DNA, 25 bp, Mus musculus
tcatcctctggttcgtattgtttgg

SEQ ID NO: 471789 - DNA, 25 bp, Mus musculus
tcatcctcttgaagtccgctctggg

SEQ ID NO: 471790 - DNA, 25 bp, Mus musculus
tcatcctgaaagagaaggcgctgcg

SEQ ID NO: 471791 - DNA, 25 bp, Mus musculus
tcatcctgacggtgaaggacgtcgg

SEQ ID NO: 471792 - DNA, 25 bp, Mus musculus
tcatcctggagacaaagagcaagac

SEQ ID NO: 471793 - DNA, 25 bp, Mus musculus
tcatcctggagtaggaaaagcttag

SEQ ID NO: 471794 - DNA, 25 bp, Mus musculus
tcatcctgtcaatcaccctggaagg

SEQ ID NO: 471795 - DNA, 25 bp, Mus musculus
tcatcctgtccaagacgacggaggg

SEQ ID NO: 471796 - DNA, 25 bp, Mus musculus
tcatcctgtgaagggcgaatgcctc

SEQ ID NO: 471797 - DNA, 25 bp, Mus musculus
tcatcctgtgcggtctgggagcagc

SEQ ID NO: 471798 - DNA, 25 bp, Mus musculus
tcatcctgtgtgcagggaactccca

SEQ ID NO: 471799 - DNA, 25 bp, Mus musculus
tcatcctgttgggactgcggcagaa

SEQ ID NO: 471800 - DNA, 25 bp, Mus musculus
tcatccttcctagatgaggatgagg

SEQ ID NO: 471801 - DNA, 25 bp, Mus musculus
tcatccttcggaagccagctcggga

SEQ ID NO: 471802 - DNA, 25 bp, Mus musculus
tcatccttctggtgcaggacctcca

SEQ ID NO: 471803 - DNA, 25 bp, Mus musculus
tcatccttgaggaattctagtcccg

SEQ ID NO: 471804 - DNA, 25 bp, Mus musculus
tcatccttggccatgggacagtgat

SEQ ID NO: 471805 - DNA, 25 bp, Mus musculus
tcatcctttgcgtttgggctaacag

SEQ ID NO: 471806 - DNA, 25 bp, Mus musculus
tcatcgaagctcaagatatggcagg

SEQ ID NO: 471807 - DNA, 25 bp, Mus musculus
tcatcgaccacgaagtgcacgaggg

SEQ ID NO: 471808 - DNA, 25 bp, Mus musculus
tcatcgacggatccaagagcgtgcg

SEQ ID NO: 471809 - DNA, 25 bp, Mus musculus
tcatcgacggcttgtactgggactc

SEQ ID NO: 471810 - DNA, 25 bp, Mus musculus
tcatcgacgggaaaagccggttcct

SEQ ID NO: 471811 - DNA, 25 bp, Mus musculus
tcatcgaggagaagctgcgtctgaa

SEQ ID NO: 471812 - DNA, 25 bp, Mus musculus
tcatcgatgtcaagaaagggcagca

SEQ ID NO: 471813 - DNA, 25 bp, Mus musculus
tcatcgcaaggagcatcaggactca

SEQ ID NO: 471814 - DNA, 25 bp, Mus musculus
tcatcgcagcagagggactgtgtcc

SEQ ID NO: 471815 - DNA, 25 bp, Mus musculus
tcatcgcaggcctgccgggcttgtg

SEQ ID NO: 471816 - DNA, 25 bp, Mus musculus
tcatcgccagagatggaaggctcct

SEQ ID NO: 471817 - DNA, 25 bp, Mus musculus
tcatcgcctcagaggtaggacgtga

SEQ ID NO: 471818 - DNA, 25 bp, Mus musculus
tcatcgcgcacaagaagtattactg

SEQ ID NO: 471819 - DNA, 25 bp, Mus musculus
tcatcgcgggctctgcaaagcccag

SEQ ID NO: 471820 - DNA, 25 bp, Mus musculus
tcatcgcgggtgtgaagaagctcga

SEQ ID NO: 471821 - DNA, 25 bp, Mus musculus
tcatcgcttgcggatctggaccagg

SEQ ID NO: 471822 - DNA, 25 bp, Mus musculus
tcatcggacactattcgggagaaga

SEQ ID NO: 471823 - DNA, 25 bp, Mus musculus
tcatcggagatgagaaaacccgcct

SEQ ID NO: 471824 - DNA, 25 bp, Mus musculus
tcatcggatccgtaggcaaaaaagt

SEQ ID NO: 471825 - DNA, 25 bp, Mus musculus
tcatcggcccaaaacctggagttgt

SEQ ID NO: 471826 - DNA, 25 bp, Mus musculus
tcatcggcttgttgcctctcagcac

SEQ ID NO: 471827 - DNA, 25 bp, Mus musculus
tcatcgggcaatatggtaacgggct

SEQ ID NO: 471828 - DNA, 25 bp, Mus musculus
tcatcgggcttagagcagtcaccct

SEQ ID NO: 471829 - DNA, 25 bp, Mus musculus
tcatcggtctgcactgaaaacaact

SEQ ID NO: 471830 - DNA, 25 bp, Mus musculus
tcatcgtagagctcgaatgcccggg

SEQ ID NO: 471831 - DNA, 25 bp, Mus musculus
tcatcgtcggctggagatgcagccc

SEQ ID NO: 471832 - DNA, 25 bp, Mus musculus
tcatcgtgaacgtgaccagtgcagc

SEQ ID NO: 471833 - DNA, 25 bp, Mus musculus
tcatcgtgagcaaacggaggttcca

SEQ ID NO: 471834 - DNA, 25 bp, Mus musculus
tcatcgtgggcctctcagtggtcgt

SEQ ID NO: 471835 - DNA, 25 bp, Mus musculus
tcatcgtggtgcacgttctgcgttc

SEQ ID NO: 471836 - DNA, 25 bp, Mus musculus
tcatcgtgtgatggagtggcttcgc

SEQ ID NO: 471837 - DNA, 25 bp, Mus musculus
tcatcgtgttcatcccggagtggcg

SEQ ID NO: 471838 - DNA, 25 bp, Mus musculus
tcatcgttctgctcatcgtggtggg

SEQ ID NO: 471839 - DNA, 25 bp, Mus musculus
tcatcgttgtctgtcctccttgtaa

SEQ ID NO: 471840 - DNA, 25 bp, Mus musculus
tcatcgttttcaccgtggtaggcaa

SEQ ID NO: 471841 - DNA, 25 bp, Mus musculus
tcatctaaatccaagcgtgtcgtca

SEQ ID NO: 471842 - DNA, 25 bp, Mus musculus
tcatctacagcacggaggaagccaa

SEQ ID NO: 471843 - DNA, 25 bp, Mus musculus
tcatctactcggagacagagcctgt

SEQ ID NO: 471844 - DNA, 25 bp, Mus musculus
tcatctataccaacccaagcgaggg

SEQ ID NO: 471845 - DNA, 25 bp, Mus musculus
tcatctatgccaagctcaaccctgg

SEQ ID NO: 471846 - DNA, 25 bp, Mus musculus
tcatctcagccttttcagtagcaag

SEQ ID NO: 471847 - DNA, 25 bp, Mus musculus
tcatctcagttcagccaaggtcagt

SEQ ID NO: 471848 - DNA, 25 bp, Mus musculus
tcatctcatccacgtgcgggttgcc

SEQ ID NO: 471849 - DNA, 25 bp, Mus musculus
tcatctccctacttcctggtgtgct

SEQ ID NO: 471850 - DNA, 25 bp, Mus musculus
tcatctccctggcatcagcttcgaa

SEQ ID NO: 471851 - DNA, 25 bp, Mus musculus
tcatctccggagttagcactgggct

SEQ ID NO: 471852 - DNA, 25 bp, Mus musculus
tcatctccgggaagtgtgcttgccg

SEQ ID NO: 471853 - DNA, 25 bp, Mus musculus
tcatctccgggcttctggctaggga

SEQ ID NO: 471854 - DNA, 25 bp, Mus musculus
tcatctcgggatcaggagcaaggct

SEQ ID NO: 471855 - DNA, 25 bp, Mus musculus
tcatctctaccagcagatgcgtagg

SEQ ID NO: 471856 - DNA, 25 bp, Mus musculus
tcatctctcagacgtgcgaccctgg

SEQ ID NO: 471857 - DNA, 25 bp, Mus musculus
tcatctctctctgaggcttctggac

SEQ ID NO: 471858 - DNA, 25 bp, Mus musculus
tcatctctgcagaaaatggccctgg

SEQ ID NO: 471859 - DNA, 25 bp, Mus musculus
tcatctctggaagaacaatttggat

SEQ ID NO: 471860 - DNA, 25 bp, Mus musculus
tcatctctggagatttacattcagg

SEQ ID NO: 471861 - DNA, 25 bp, Mus musculus
tcatctctggatgggacctgaccca

SEQ ID NO: 471862 - DNA, 25 bp, Mus musculus
tcatctgaaaatggaccgtgtcgcc

SEQ ID NO: 471863 - DNA, 25 bp, Mus musculus
tcatctgaacacattggcggctgcg

SEQ ID NO: 471864 - DNA, 25 bp, Mus musculus
tcatctgacatctaagttcatagcg

SEQ ID NO: 471865 - DNA, 25 bp, Mus musculus
tcatctgacgatgagctaatcggcc

SEQ ID NO: 471866 - DNA, 25 bp, Mus musculus
tcatctgacgggtggagactacgtc

SEQ ID NO: 471867 - DNA, 25 bp, Mus musculus
tcatctgaggtacaagttgttttaa

SEQ ID NO: 471868 - DNA, 25 bp, Mus musculus
tcatctgcagaggatgggcagcctt

SEQ ID NO: 471869 - DNA, 25 bp, Mus musculus
tcatctgccacgtgattgacaagcg

SEQ ID NO: 471870 - DNA, 25 bp, Mus musculus
tcatctgccgacaacagcggaagga

SEQ ID NO: 471871 - DNA, 25 bp, Mus musculus
tcatctgcgcccttctatgcttggg

SEQ ID NO: 471872 - DNA, 25 bp, Mus musculus
tcatctgcgttagcagtccccagtt

SEQ ID NO: 471873 - DNA, 25 bp, Mus musculus
tcatctgctctaagctgaaggcccg

SEQ ID NO: 471874 - DNA, 25 bp, Mus musculus
tcatctgctgcacacgccgcgggct

SEQ ID NO: 471875 - DNA, 25 bp, Mus musculus
tcatctggagccgaaagagcagtca

SEQ ID NO: 471876 - DNA, 25 bp, Mus musculus
tcatctggattacctcacgtttttg

SEQ ID NO: 471877 - DNA, 25 bp, Mus musculus
tcatctggattgaactggaacggcc

SEQ ID NO: 471878 - DNA, 25 bp, Mus musculus
tcatctggcaaaaggaaaggtgtct

SEQ ID NO: 471879 - DNA, 25 bp, Mus musculus
tcatctgggccaactagttgaaaag

SEQ ID NO: 471880 - DNA, 25 bp, Mus musculus
tcatctggtcaaagtaaaagacatg

SEQ ID NO: 471881 - DNA, 25 bp, Mus musculus
tcatctgtaaaaaacctgcgccggg

SEQ ID NO: 471882 - DNA, 25 bp, Mus musculus
tcatctgtaaaacgaggactattgc

SEQ ID NO: 471883 - DNA, 25 bp, Mus musculus
tcatctgtaaccaaagccctgtgcc

SEQ ID NO: 471884 - DNA, 25 bp, Mus musculus
tcatctgtgcatgggctctgagccg

SEQ ID NO: 471885 - DNA, 25 bp, Mus musculus
tcatctgtggaacccgttgtggcca

SEQ ID NO: 471886 - DNA, 25 bp, Mus musculus
tcatctgtggctccatggtgtccag

SEQ ID NO: 471887 - DNA, 25 bp, Mus musculus
tcatcttcagagagggtgacggagt

SEQ ID NO: 471888 - DNA, 25 bp, Mus musculus
tcatcttcagaggtgttggctagct

SEQ ID NO: 471889 - DNA, 25 bp, Mus musculus
tcatcttcccgctggcaggacggat

SEQ ID NO: 471890 - DNA, 25 bp, Mus musculus
tcatcttccgatactgtgctggcag

SEQ ID NO: 471891 - DNA, 25 bp, Mus musculus
tcatcttcgactgacctaatggaga

SEQ ID NO: 471892 - DNA, 25 bp, Mus musculus
tcatcttcggtgtgcctggagaacc

SEQ ID NO: 471893 - DNA, 25 bp, Mus musculus
tcatcttcgtacagagctgagaggt

SEQ ID NO: 471894 - DNA, 25 bp, Mus musculus
tcatcttctaccagatgggccttgg

SEQ ID NO: 471895 - DNA, 25 bp, Mus musculus
tcatcttggacatgtatgcgcgcgt

SEQ ID NO: 471896 - DNA, 25 bp, Mus musculus
tcatcttggatgtgctgctgcccga

SEQ ID NO: 471897 - DNA, 25 bp, Mus musculus
tcatcttgggagtctgtgaccgaca

SEQ ID NO: 471898 - DNA, 25 bp, Mus musculus
tcatcttgtagacatggcctgtggc

SEQ ID NO: 471899 - DNA, 25 bp, Mus musculus
tcatctttgaactgggaacttcctg

SEQ ID NO: 471900 - DNA, 25 bp, Mus musculus
tcatctttgaggactgccggatccc

SEQ ID NO: 471901 - DNA, 25 bp, Mus musculus
tcatctttgtgctgtaccgggacac

SEQ ID NO: 471902 - DNA, 25 bp, Mus musculus
tcatgaaacccagcatccagtatgc

SEQ ID NO: 471903 - DNA, 25 bp, Mus musculus
tcatgaaacgggaagctggcagtat

SEQ ID NO: 471904 - DNA, 25 bp, Mus musculus
tcatgaaagcttgtcatgtgacctc

SEQ ID NO: 471905 - DNA, 25 bp, Mus musculus
tcatgaagatgtacgggctgggcct

SEQ ID NO: 471906 - DNA, 25 bp, Mus musculus
tcatgaagcagagtaaggcgcagct

SEQ ID NO: 471907 - DNA, 25 bp, Mus musculus
tcatgaagcaggtaaatggctctgt

SEQ ID NO: 471908 - DNA, 25 bp, Mus musculus
tcatgaagcgatgctgatagacgtc

SEQ ID NO: 471909 - DNA, 25 bp, Mus musculus
tcatgaagctgctgaggcacgacaa

SEQ ID NO: 471910 - DNA, 25 bp, Mus musculus
tcatgaaggccgacacagtgatcgt

SEQ ID NO: 471911 - DNA, 25 bp, Mus musculus
tcatgaagtatgacagctacagccg

SEQ ID NO: 471912 - DNA, 25 bp, Mus musculus
tcatgaagtatgtgggtggcaccaa

SEQ ID NO: 471913 - DNA, 25 bp, Mus musculus
tcatgaatcagcacttcgagccaag

SEQ ID NO: 471914 - DNA, 25 bp, Mus musculus
tcatgaatgagagcgagcggaacac

SEQ ID NO: 471915 - DNA, 25 bp, Mus musculus
tcatgacaactctgagggactcggc

SEQ ID NO: 471916 - DNA, 25 bp, Mus musculus
tcatgacaatgactactgcctgggc

SEQ ID NO: 471917 - DNA, 25 bp, Mus musculus
tcatgacagagaaaatggccccaca

SEQ ID NO: 471918 - DNA, 25 bp, Mus musculus
tcatgaccccagtgcccaagtgttt

SEQ ID NO: 471919 - DNA, 25 bp, Mus musculus
tcatgacctgggtgagccgacagaa

SEQ ID NO: 471920 - DNA, 25 bp, Mus musculus
tcatgacgttgacgctgttccccat

SEQ ID NO: 471921 - DNA, 25 bp, Mus musculus
tcatgactgactaagatggaaggcc

SEQ ID NO: 471922 - DNA, 25 bp, Mus musculus
tcatgacttacatcgtggagccgct

SEQ ID NO: 471923 - DNA, 25 bp, Mus musculus
tcatgacttccaatgtagccagtga

SEQ ID NO: 471924 - DNA, 25 bp, Mus musculus
tcatgagaaacacggtacaggagca

SEQ ID NO: 471925 - DNA, 25 bp, Mus musculus
tcatgagaattaatgggaccacgct

SEQ ID NO: 471926 - DNA, 25 bp, Mus musculus
tcatgagagaccgacatttggacca

SEQ ID NO: 471927 - DNA, 25 bp, Mus musculus
tcatgagataacaagccgagacagc

SEQ ID NO: 471928 - DNA, 25 bp, Mus musculus
tcatgagcatgtggagcgcaacagc

SEQ ID NO: 471929 - DNA, 25 bp, Mus musculus
tcatgagcctccatggtcgtgagag

SEQ ID NO: 471930 - DNA, 25 bp, Mus musculus
tcatgagcttgaaaaacaaatagcg

SEQ ID NO: 471931 - DNA, 25 bp, Mus musculus
tcatgaggacttgccagagaagaga

SEQ ID NO: 471932 - DNA, 25 bp, Mus musculus
tcatgaggcacataatagcccagtc

SEQ ID NO: 471933 - DNA, 25 bp, Mus musculus
tcatgaggctagttttcttggagag

SEQ ID NO: 471934 - DNA, 25 bp, Mus musculus
tcatgaggctggtgctccccagcag

SEQ ID NO: 471935 - DNA, 25 bp, Mus musculus
tcatgagtccgatgggctggctgtc

SEQ ID NO: 471936 - DNA, 25 bp, Mus musculus
tcatgagtcggccagagatcaaggc

SEQ ID NO: 471937 - DNA, 25 bp, Mus musculus
tcatgagtggaagcaatgggccgac

SEQ ID NO: 471938 - DNA, 25 bp, Mus musculus
tcatgagtggagaaaagacgaggcc

SEQ ID NO: 471939 - DNA, 25 bp, Mus musculus
tcatgatagagcaacaagcaggctc

SEQ ID NO: 471940 - DNA, 25 bp, Mus musculus
tcatgatataatagccagccggcag

SEQ ID NO: 471941 - DNA, 25 bp, Mus musculus
tcatgatccgggacagtgagaccac

SEQ ID NO: 471942 - DNA, 25 bp, Mus musculus
tcatgatccttgtgagcgagaccca

SEQ ID NO: 471943 - DNA, 25 bp, Mus musculus
tcatgatcgtcaaactgggcctgga

SEQ ID NO: 471944 - DNA, 25 bp, Mus musculus
tcatgatgaaactctagcacacggg

SEQ ID NO: 471945 - DNA, 25 bp, Mus musculus
tcatgatgccatcacaggaaccgcg

SEQ ID NO: 471946 - DNA, 25 bp, Mus musculus
tcatgatggcactaagctgtggacc

SEQ ID NO: 471947 - DNA, 25 bp, Mus musculus
tcatgattccagagcgtccctctaa

SEQ ID NO: 471948 - DNA, 25 bp, Mus musculus
tcatgattcggagcaaggagccctc

SEQ ID NO: 471949 - DNA, 25 bp, Mus musculus
tcatgattggttgccacctggagca

SEQ ID NO: 471950 - DNA, 25 bp, Mus musculus
tcatgattttgagcagggtcaccgg

SEQ ID NO: 471951 - DNA, 25 bp, Mus musculus
tcatgcacacttgaagggttggccc

SEQ ID NO: 471952 - DNA, 25 bp, Mus musculus
tcatgcactgcaactgtaggccgag

SEQ ID NO: 471953 - DNA, 25 bp, Mus musculus
tcatgcagactgttccttacttgtg

SEQ ID NO: 471954 - DNA, 25 bp, Mus musculus
tcatgcaggccaaagagcagtaccg

SEQ ID NO: 471955 - DNA, 25 bp, Mus musculus
tcatgcccagcgtagcagaaggtgt

SEQ ID NO: 471956 - DNA, 25 bp, Mus musculus
tcatgcccagtctaagcctaggagg

SEQ ID NO: 471957 - DNA, 25 bp, Mus musculus
tcatgccccatagtgcctgagatgc

SEQ ID NO: 471958 - DNA, 25 bp, Mus musculus
tcatgccccggtactcacaatagtg

SEQ ID NO: 471959 - DNA, 25 bp, Mus musculus
tcatgccctatacagtgcgtgccgt

SEQ ID NO: 471960 - DNA, 25 bp, Mus musculus
tcatgccggcacagctggtactgaa

SEQ ID NO: 471961 - DNA, 25 bp, Mus musculus
tcatgcctcaggtggtccgtgatgc

SEQ ID NO: 471962 - DNA, 25 bp, Mus musculus
tcatgcctgactgcgattgccctta

SEQ ID NO: 471963 - DNA, 25 bp, Mus musculus
tcatgcctgccagtaagaaggccga

SEQ ID NO: 471964 - DNA, 25 bp, Mus musculus
tcatgcctgtgatgtctgcctgaag

SEQ ID NO: 471965 - DNA, 25 bp, Mus musculus
tcatgcctgtgggtacacaggccac

SEQ ID NO: 471966 - DNA, 25 bp, Mus musculus
tcatgccttttggagcgggcgtcac

SEQ ID NO: 471967 - DNA, 25 bp, Mus musculus
tcatgcgacgcacttttggaggaaa

SEQ ID NO: 471968 - DNA, 25 bp, Mus musculus
tcatgcgaggtatcgagagccacaa

SEQ ID NO: 471969 - DNA, 25 bp, Mus musculus
tcatgcgcctggatctagctggtcg

SEQ ID NO: 471970 - DNA, 25 bp, Mus musculus
tcatgcggcagggtataagagacaa

SEQ ID NO: 471971 - DNA, 25 bp, Mus musculus
tcatgcgtctatgggcaacaggccc

SEQ ID NO: 471972 - DNA, 25 bp, Mus musculus
tcatgcgtgagcagatgcaggagca

SEQ ID NO: 471973 - DNA, 25 bp, Mus musculus
tcatgctactcagggtgtcgtccag

SEQ ID NO: 471974 - DNA, 25 bp, Mus musculus
tcatgctactgctttactgggccac

SEQ ID NO: 471975 - DNA, 25 bp, Mus musculus
tcatgctatgtgcaaaccaaacaat

SEQ ID NO: 471976 - DNA, 25 bp, Mus musculus
tcatgctcaagaacgacaaggccgc

SEQ ID NO: 471977 - DNA, 25 bp, Mus musculus
tcatgctgggcttacatgggagcca

SEQ ID NO: 471978 - DNA, 25 bp, Mus musculus
tcatgctggtcaacacttctgggaa

SEQ ID NO: 471979 - DNA, 25 bp, Mus musculus
tcatgctgttgagctggcctgcagg

SEQ ID NO: 471980 - DNA, 25 bp, Mus musculus
tcatgcttgcttgtggcttcccagt

SEQ ID NO: 471981 - DNA, 25 bp, Mus musculus
tcatggaaaagagctagccgggacc

SEQ ID NO: 471982 - DNA, 25 bp, Mus musculus
tcatggaaatgtcaggcccgtacaa

SEQ ID NO: 471983 - DNA, 25 bp, Mus musculus
tcatggaacagcacgtgtgggacgt

SEQ ID NO: 471984 - DNA, 25 bp, Mus musculus
tcatggaagtgaacccaactcttgg

SEQ ID NO: 471985 - DNA, 25 bp, Mus musculus
tcatggacaagctacgggatgcaca

SEQ ID NO: 471986 - DNA, 25 bp, Mus musculus
tcatggacacagagatacccactgc

SEQ ID NO: 471987 - DNA, 25 bp, Mus musculus
tcatggacattcacgctcagtagct

SEQ ID NO: 471988 - DNA, 25 bp, Mus musculus
tcatggacctaagaggacaaggccc

SEQ ID NO: 471989 - DNA, 25 bp, Mus musculus
tcatggacctgttagcactgtatca

SEQ ID NO: 471990 - DNA, 25 bp, Mus musculus
tcatggacgcctttgatcgctcgcc

SEQ ID NO: 471991 - DNA, 25 bp, Mus musculus
tcatggacgggaactgctactacaa

SEQ ID NO: 471992 - DNA, 25 bp, Mus musculus
tcatggagaaaattggaccccggaa

SEQ ID NO: 471993 - DNA, 25 bp, Mus musculus
tcatggagagatacgcacctgttgc

SEQ ID NO: 471994 - DNA, 25 bp, Mus musculus
tcatggagatgccaagcatggaccg

SEQ ID NO: 471995 - DNA, 25 bp, Mus musculus
tcatggaggcttcaggatcttcttc

SEQ ID NO: 471996 - DNA, 25 bp, Mus musculus
tcatggagggtagctacaacaaggt

SEQ ID NO: 471997 - DNA, 25 bp, Mus musculus
tcatggagtaaacgaggatgcctac

SEQ ID NO: 471998 - DNA, 25 bp, Mus musculus
tcatggagtcacagccacataaggg

SEQ ID NO: 471999 - DNA, 25 bp, Mus musculus
tcatggagtctggatgtcatacttt

SEQ ID NO: 472000 - DNA, 25 bp, Mus musculus
tcatggatatcaatggctgtgccgc

SEQ ID NO: 472001 - DNA, 25 bp, Mus musculus
tcatggatcgggaaggagactgtcc

SEQ ID NO: 472002 - DNA, 25 bp, Mus musculus
tcatggatctgctggccaaggacga

SEQ ID NO: 472003 - DNA, 25 bp, Mus musculus
tcatggatgacagcaagcgcaaggc

SEQ ID NO: 472004 - DNA, 25 bp, Mus musculus
tcatggatgatgctgccgagtgctt

SEQ ID NO: 472005 - DNA, 25 bp, Mus musculus
tcatggatgccaactacttcggacc

SEQ ID NO: 472006 - DNA, 25 bp, Mus musculus
tcatggatgccaagaaacccctgta

SEQ ID NO: 472007 - DNA, 25 bp, Mus musculus
tcatggatggcctcaaagacgggat

SEQ ID NO: 472008 - DNA, 25 bp, Mus musculus
tcatggcaacttcttctgaacagaa

SEQ ID NO: 472009 - DNA, 25 bp, Mus musculus
tcatggcaatgaagtgactccgacc

SEQ ID NO: 472010 - DNA, 25 bp, Mus musculus
tcatggcagtgcactaaggagagtc

SEQ ID NO: 472011 - DNA, 25 bp, Mus musculus
tcatggcatctcgtacctggccggg

SEQ ID NO: 472012 - DNA, 25 bp, Mus musculus
tcatggcatggatggagacagtcgc

SEQ ID NO: 472013 - DNA, 25 bp, Mus musculus
tcatggcattttcggcccaagggac

SEQ ID NO: 472014 - DNA, 25 bp, Mus musculus
tcatggccacctatctagcagatcg

SEQ ID NO: 472015 - DNA, 25 bp, Mus musculus
tcatggccctcagtaagaacgggcg

SEQ ID NO: 472016 - DNA, 25 bp, Mus musculus
tcatggccgtggaccaagaagaaac

SEQ ID NO: 472017 - DNA, 25 bp, Mus musculus
tcatggcctcgacatctggagctgc

SEQ ID NO: 472018 - DNA, 25 bp, Mus musculus
tcatggcctcgtatctctctagaca

SEQ ID NO: 472019 - DNA, 25 bp, Mus musculus
tcatggcctgtgcatttcttggagc

SEQ ID NO: 472020 - DNA, 25 bp, Mus musculus
tcatggccttcgtgtacctgcgggt

SEQ ID NO: 472021 - DNA, 25 bp, Mus musculus
tcatggccttgaccccagaactgag

SEQ ID NO: 472022 - DNA, 25 bp, Mus musculus
tcatggcgaaccttggctactggct

SEQ ID NO: 472023 - DNA, 25 bp, Mus musculus
tcatggcgatgagcattaccgacgt

SEQ ID NO: 472024 - DNA, 25 bp, Mus musculus
tcatggcggtctgatcacaacaggg

SEQ ID NO: 472025 - DNA, 25 bp, Mus musculus
tcatggcgtccaatccgtgcagaga

SEQ ID NO: 472026 - DNA, 25 bp, Mus musculus
tcatggcgtccccatctcggaggct

SEQ ID NO: 472027 - DNA, 25 bp, Mus musculus
tcatggctgaactgcggttgtacac

SEQ ID NO: 472028 - DNA, 25 bp, Mus musculus
tcatggctgataagctgctggcgac

SEQ ID NO: 472029 - DNA, 25 bp, Mus musculus
tcatggctggtatgcacaggcttct

SEQ ID NO: 472030 - DNA, 25 bp, Mus musculus
tcatggctggtgagtgtcccctgta

SEQ ID NO: 472031 - DNA, 25 bp, Mus musculus
tcatggcttcaatttccgggtgcag

SEQ ID NO: 472032 - DNA, 25 bp, Mus musculus
tcatggcttcagctaatcaaagaac

SEQ ID NO: 472033 - DNA, 25 bp, Mus musculus
tcatggcttctgctacacgcgagga

SEQ ID NO: 472034 - DNA, 25 bp, Mus musculus
tcatgggaagaatgccacgagtgga

SEQ ID NO: 472035 - DNA, 25 bp, Mus musculus
tcatgggaaggagcttcaggcctcc

SEQ ID NO: 472036 - DNA, 25 bp, Mus musculus
tcatgggaaggcagatgtaaggccc

SEQ ID NO: 472037 - DNA, 25 bp, Mus musculus
tcatgggatcctccctgagcctgtc

SEQ ID NO: 472038 - DNA, 25 bp, Mus musculus
tcatgggcaagagttacacagcgtg

SEQ ID NO: 472039 - DNA, 25 bp, Mus musculus
tcatgggcaagatcaggacagaggc

SEQ ID NO: 472040 - DNA, 25 bp, Mus musculus
tcatgggcacagaccacgtactaag

SEQ ID NO: 472041 - DNA, 25 bp, Mus musculus
tcatgggcacaggtccagactctct

SEQ ID NO: 472042 - DNA, 25 bp, Mus musculus
tcatgggcactgtggtgacaagctg

SEQ ID NO: 472043 - DNA, 25 bp, Mus musculus
tcatgggcctccacaaggtttctgg

SEQ ID NO: 472044 - DNA, 25 bp, Mus musculus
tcatgggctggacactggacttcct

SEQ ID NO: 472045 - DNA, 25 bp, Mus musculus
tcatggggagcagcattttcttggg

SEQ ID NO: 472046 - DNA, 25 bp, Mus musculus
tcatggggtgggatcagtacctacc

SEQ ID NO: 472047 - DNA, 25 bp, Mus musculus
tcatgggtgccaggacttcaagctt

SEQ ID NO: 472048 - DNA, 25 bp, Mus musculus
tcatgggtgctcctggcaacttgct

SEQ ID NO: 472049 - DNA, 25 bp, Mus musculus
tcatgggttccatgccacaggcgat

SEQ ID NO: 472050 - DNA, 25 bp, Mus musculus
tcatggtaaccatacttccgtttaa

SEQ ID NO: 472051 - DNA, 25 bp, Mus musculus
tcatggtagtcctgggagcccgttt

SEQ ID NO: 472052 - DNA, 25 bp, Mus musculus
tcatggtctgaaggctgcggtgaca

SEQ ID NO: 472053 - DNA, 25 bp, Mus musculus
tcatggtgagtctcgccctcctatg

SEQ ID NO: 472054 - DNA, 25 bp, Mus musculus
tcatggtggacttcgcccaggaaag

SEQ ID NO: 472055 - DNA, 25 bp, Mus musculus
tcatggtggccatgaaggctgcacc

SEQ ID NO: 472056 - DNA, 25 bp, Mus musculus
tcatggtggcctgcaagcagcttca

SEQ ID NO: 472057 - DNA, 25 bp, Mus musculus
tcatggttatgtagagggagccctt

SEQ ID NO: 472058 - DNA, 25 bp, Mus musculus
tcatggttcatcacaaagtcatccc

SEQ ID NO: 472059 - DNA, 25 bp, Mus musculus
tcatggttcgaatcaaggagctggc

SEQ ID NO: 472060 - DNA, 25 bp, Mus musculus
tcatggttgaaagtgcagccttact

SEQ ID NO: 472061 - DNA, 25 bp, Mus musculus
tcatggttgcaagtaaatagtagac

SEQ ID NO: 472062 - DNA, 25 bp, Mus musculus
tcatggttgtcagtgtgaacgcctt

SEQ ID NO: 472063 - DNA, 25 bp, Mus musculus
tcatgtaaaacctcttcagaccaag

SEQ ID NO: 472064 - DNA, 25 bp, Mus musculus
tcatgtaacagggaatgcacaaata

SEQ ID NO: 472065 - DNA, 25 bp, Mus musculus
tcatgtaagacattcagagcagaca

SEQ ID NO: 472066 - DNA, 25 bp, Mus musculus
tcatgtaagcatgggctgagctgag

SEQ ID NO: 472067 - DNA, 25 bp, Mus musculus
tcatgtaagtagcaaacagggcttc

SEQ ID NO: 472068 - DNA, 25 bp, Mus musculus
tcatgtaccatgtcaagtatgatga

SEQ ID NO: 472069 - DNA, 25 bp, Mus musculus
tcatgtacgggagaagcaagaggct

SEQ ID NO: 472070 - DNA, 25 bp, Mus musculus
tcatgtactaaagctgaagatcccc

SEQ ID NO: 472071 - DNA, 25 bp, Mus musculus
tcatgtagattggagggatcagccc

SEQ ID NO: 472072 - DNA, 25 bp, Mus musculus
tcatgtagccatgggcactggttcc

SEQ ID NO: 472073 - DNA, 25 bp, Mus musculus
tcatgtagcctaagcagagtgcact

SEQ ID NO: 472074 - DNA, 25 bp, Mus musculus
tcatgtagccttccttagctccagg

SEQ ID NO: 472075 - DNA, 25 bp, Mus musculus
tcatgtagctgatcccagaggacta

SEQ ID NO: 472076 - DNA, 25 bp, Mus musculus
tcatgtagtgaccaggccaggcgtt

SEQ ID NO: 472077 - DNA, 25 bp, Mus musculus
tcatgtatgatgcaaagatcctcca

SEQ ID NO: 472078 - DNA, 25 bp, Mus musculus
tcatgtcaatgcctacgaggaggac

SEQ ID NO: 472079 - DNA, 25 bp, Mus musculus
tcatgtcacactgtgcatttcagag

SEQ ID NO: 472080 - DNA, 25 bp, Mus musculus
tcatgtcacatagctgaaggcccgc

SEQ ID NO: 472081 - DNA, 25 bp, Mus musculus
tcatgtcagaggtatcgggcttccc

SEQ ID NO: 472082 - DNA, 25 bp, Mus musculus
tcatgtcagaggttaatggcgtaac

SEQ ID NO: 472083 - DNA, 25 bp, Mus musculus
tcatgtccaagtaacatcgggtgac

SEQ ID NO: 472084 - DNA, 25 bp, Mus musculus
tcatgtcctatgtcgctgccgtgtg

SEQ ID NO: 472085 - DNA, 25 bp, Mus musculus
tcatgtctatgaaggccgaggctgg

SEQ ID NO: 472086 - DNA, 25 bp, Mus musculus
tcatgtctctcacaggaacaggcgg

SEQ ID NO: 472087 - DNA, 25 bp, Mus musculus
tcatgtctgggcctttgaatccggg

SEQ ID NO: 472088 - DNA, 25 bp, Mus musculus
tcatgtgactgagatattggcggac

SEQ ID NO: 472089 - DNA, 25 bp, Mus musculus
tcatgtgaggcatcagggcaacgcc

SEQ ID NO: 472090 - DNA, 25 bp, Mus musculus
tcatgtgcaagactcattgaacgct

SEQ ID NO: 472091 - DNA, 25 bp, Mus musculus
tcatgtgcccgggtttaacgtctcc

SEQ ID NO: 472092 - DNA, 25 bp, Mus musculus
tcatgtgcgtgaaggatggacaaca

SEQ ID NO: 472093 - DNA, 25 bp, Mus musculus
tcatgtggaaagactcagaggaggc

SEQ ID NO: 472094 - DNA, 25 bp, Mus musculus
tcatgtggacccaagaagagtggct

SEQ ID NO: 472095 - DNA, 25 bp, Mus musculus
tcatgtggcatcacacacggtccat

SEQ ID NO: 472096 - DNA, 25 bp, Mus musculus
tcatgtggcccatctggtaccgctg

SEQ ID NO: 472097 - DNA, 25 bp, Mus musculus
tcatgtggttctctcaatctcatgt

SEQ ID NO: 472098 - DNA, 25 bp, Mus musculus
tcatgtgtagtaaatctggagccca

SEQ ID NO: 472099 - DNA, 25 bp, Mus musculus
tcatgtgtcagcctgcccggaaagt

SEQ ID NO: 472100 - DNA, 25 bp, Mus musculus
tcatgtgtcctcgactagagagctc

SEQ ID NO: 472101 - DNA, 25 bp, Mus musculus
tcatgttagcgagagcctgctgcca

SEQ ID NO: 472102 - DNA, 25 bp, Mus musculus
tcatgttatgccttcaggctaataa

SEQ ID NO: 472103 - DNA, 25 bp, Mus musculus
tcatgttcccaaggactacggatga

SEQ ID NO: 472104 - DNA, 25 bp, Mus musculus
tcatgttctggttggactcctttct

SEQ ID NO: 472105 - DNA, 25 bp, Mus musculus
tcatgttctgtccagccccgggaaa

SEQ ID NO: 472106 - DNA, 25 bp, Mus musculus
tcatgtttcactgggtggcctccta

SEQ ID NO: 472107 - DNA, 25 bp, Mus musculus
tcatgtttcctaaaggcgaggcgcg

SEQ ID NO: 472108 - DNA, 25 bp, Mus musculus
tcatgtttgatctcggcaagggccg

SEQ ID NO: 472109 - DNA, 25 bp, Mus musculus
tcatgtttgtacaggaagaggccct

SEQ ID NO: 472110 - DNA, 25 bp, Mus musculus
tcatgttttcttgccgggactgcgg

SEQ ID NO: 472111 - DNA, 25 bp, Mus musculus
tcatgttttgacctgaagggtgacc

SEQ ID NO: 472112 - DNA, 25 bp, Mus musculus
tcattaaaaaggagagcaaccggca

SEQ ID NO: 472113 - DNA, 25 bp, Mus musculus
tcattaaaactgcagacggaggaca

SEQ ID NO: 472114 - DNA, 25 bp, Mus musculus
tcattaaacccgtaagaaaagcatc

SEQ ID NO: 472115 - DNA, 25 bp, Mus musculus
tcattaaaggtaggtgcagctgtcg

SEQ ID NO: 472116 - DNA, 25 bp, Mus musculus
tcattaactggaagggaccggacct

SEQ ID NO: 472117 - DNA, 25 bp, Mus musculus
tcattaagaagacgaacctggccct

SEQ ID NO: 472118 - DNA, 25 bp, Mus musculus
tcattaagacgggttacctagggag

SEQ ID NO: 472119 - DNA, 25 bp, Mus musculus
tcattaagcatccaaatgaaacaga

SEQ ID NO: 472120 - DNA, 25 bp, Mus musculus
tcattaaggtagacacccacccttc

SEQ ID NO: 472121 - DNA, 25 bp, Mus musculus
tcattaatcccgaggcgtcgacgtc

SEQ ID NO: 472122 - DNA, 25 bp, Mus musculus
tcattaatccgctgctgcgctcggt

SEQ ID NO: 472123 - DNA, 25 bp, Mus musculus
tcattacaggagaaacacaggcttc

SEQ ID NO: 472124 - DNA, 25 bp, Mus musculus
tcattaccaaagagggcagcctgcc

SEQ ID NO: 472125 - DNA, 25 bp, Mus musculus
tcattaccaagaagcgaggcgacca

SEQ ID NO: 472126 - DNA, 25 bp, Mus musculus
tcattaccctctgcgtagtcctgtg

SEQ ID NO: 472127 - DNA, 25 bp, Mus musculus
tcattacgatggaccagtctaggaa

SEQ ID NO: 472128 - DNA, 25 bp, Mus musculus
tcattacggaagatcgggttactaa

SEQ ID NO: 472129 - DNA, 25 bp, Mus musculus
tcattactgtgtgccgcccattgct

SEQ ID NO: 472130 - DNA, 25 bp, Mus musculus
tcattacttcaagggtgtgctgagc

SEQ ID NO: 472131 - DNA, 25 bp, Mus musculus
tcattagaacgacttgcattgccaa

SEQ ID NO: 472132 - DNA, 25 bp, Mus musculus
tcattagaatcaataaaagctctca

SEQ ID NO: 472133 - DNA, 25 bp, Mus musculus
tcattagacggtgcatccgcagggc

SEQ ID NO: 472134 - DNA, 25 bp, Mus musculus
tcattagagcaggtatgctcagacc

SEQ ID NO: 472135 - DNA, 25 bp, Mus musculus
tcattagatgggtccttcacctacc

SEQ ID NO: 472136 - DNA, 25 bp, Mus musculus
tcattagcaagaaggaaagctccgg

SEQ ID NO: 472137 - DNA, 25 bp, Mus musculus
tcattagcactaagaatcaagacta

SEQ ID NO: 472138 - DNA, 25 bp, Mus musculus
tcattagccacaagaagagacgggc

SEQ ID NO: 472139 - DNA, 25 bp, Mus musculus
tcattagctatctaggttttcctac

SEQ ID NO: 472140 - DNA, 25 bp, Mus musculus
tcattagtgtgaaaaaacgcccgga

SEQ ID NO: 472141 - DNA, 25 bp, Mus musculus
tcattatgattttaccaggagctgg

SEQ ID NO: 472142 - DNA, 25 bp, Mus musculus
tcattcacaaatggagtcagctccc

SEQ ID NO: 472143 - DNA, 25 bp, Mus musculus
tcattcacactgttgcacacacgca

SEQ ID NO: 472144 - DNA, 25 bp, Mus musculus
tcattcacatgtaaggctgccaggg

SEQ ID NO: 472145 - DNA, 25 bp, Mus musculus
tcattcagaggtggcaagcgtccga

SEQ ID NO: 472146 - DNA, 25 bp, Mus musculus
tcattcagatggttgggtacgtgct

SEQ ID NO: 472147 - DNA, 25 bp, Mus musculus
tcattcaggaagtctaccgggacgg

SEQ ID NO: 472148 - DNA, 25 bp, Mus musculus
tcattcaggcgccacagacagtagt

SEQ ID NO: 472149 - DNA, 25 bp, Mus musculus
tcattcaggctcaggatcttttgta

SEQ ID NO: 472150 - DNA, 25 bp, Mus musculus
tcattcataggaaaccagcccggta

SEQ ID NO: 472151 - DNA, 25 bp, Mus musculus
tcattcatctgaaaggccctctggg

SEQ ID NO: 472152 - DNA, 25 bp, Mus musculus
tcattcatgatgctgccagagcagg

SEQ ID NO: 472153 - DNA, 25 bp, Mus musculus
tcattcatgccaaggagagctacat

SEQ ID NO: 472154 - DNA, 25 bp, Mus musculus
tcattcattgagcacacattccagg

SEQ ID NO: 472155 - DNA, 25 bp, Mus musculus
tcattccagttgtgacccgagcgtc

SEQ ID NO: 472156 - DNA, 25 bp, Mus musculus
tcattcccaggtgcgtggtcaggcg

SEQ ID NO: 472157 - DNA, 25 bp, Mus musculus
tcattcccgtcttgtgataaagtgg

SEQ ID NO: 472158 - DNA, 25 bp, Mus musculus
tcattccctgaggttgggacaaccc

SEQ ID NO: 472159 - DNA, 25 bp, Mus musculus
tcattcccttgggacctgacctcaa

SEQ ID NO: 472160 - DNA, 25 bp, Mus musculus
tcattcctgaggaggcagcgttttc

SEQ ID NO: 472161 - DNA, 25 bp, Mus musculus
tcattccttcatactctatctcaga

SEQ ID NO: 472162 - DNA, 25 bp, Mus musculus
tcattccttcttgtgagcttggtgg

SEQ ID NO: 472163 - DNA, 25 bp, Mus musculus
tcattcgaagaggtgcaaaggctca

SEQ ID NO: 472164 - DNA, 25 bp, Mus musculus
tcattcggagtagggaaagaaaaca

SEQ ID NO: 472165 - DNA, 25 bp, Mus musculus
tcattcgggaaagcgagaccaccaa

SEQ ID NO: 472166 - DNA, 25 bp, Mus musculus
tcattcgggagctgcggccgcactg

SEQ ID NO: 472167 - DNA, 25 bp, Mus musculus
tcattcgtagagacacgcctcctga

SEQ ID NO: 472168 - DNA, 25 bp, Mus musculus
tcattctagagaagggagactatcc

SEQ ID NO: 472169 - DNA, 25 bp, Mus musculus
tcattctaggccaagtgagagctcg

SEQ ID NO: 472170 - DNA, 25 bp, Mus musculus
tcattctcaggagccatctaccttg

SEQ ID NO: 472171 - DNA, 25 bp, Mus musculus
tcattctcggaggtcatcgtgactc

SEQ ID NO: 472172 - DNA, 25 bp, Mus musculus
tcattctctgcagtaagcattacca

SEQ ID NO: 472173 - DNA, 25 bp, Mus musculus
tcattctgattggacggcggttgac

SEQ ID NO: 472174 - DNA, 25 bp, Mus musculus
tcattctgcagaagggtgctggcac

SEQ ID NO: 472175 - DNA, 25 bp, Mus musculus
tcattctggagtattcttaggcacc

SEQ ID NO: 472176 - DNA, 25 bp, Mus musculus
tcattcttagttaaaagtggctccg

SEQ ID NO: 472177 - DNA, 25 bp, Mus musculus
tcattcttggtggaggaacgcagcc

SEQ ID NO: 472178 - DNA, 25 bp, Mus musculus
tcattgaaacctgcagagaggccgg

SEQ ID NO: 472179 - DNA, 25 bp, Mus musculus
tcattgaaacctggagagagcagct

SEQ ID NO: 472180 - DNA, 25 bp, Mus musculus
tcattgaagcagagtcgtggatcga

SEQ ID NO: 472181 - DNA, 25 bp, Mus musculus
tcattgaagtgggagcctgcaacag

SEQ ID NO: 472182 - DNA, 25 bp, Mus musculus
tcattgaataggaagaacattgatc

SEQ ID NO: 472183 - DNA, 25 bp, Mus musculus
tcattgaattcataagggatgttcc

SEQ ID NO: 472184 - DNA, 25 bp, Mus musculus
tcattgacgtgaagcctcttggtgt

SEQ ID NO: 472185 - DNA, 25 bp, Mus musculus
tcattgagaaattagacgcccagtc

SEQ ID NO: 472186 - DNA, 25 bp, Mus musculus
tcattgagacagagggtgaccaccc

SEQ ID NO: 472187 - DNA, 25 bp, Mus musculus
tcattgagagcctgaaaaggaaccc

SEQ ID NO: 472188 - DNA, 25 bp, Mus musculus
tcattgagctttgcccaggagacca

SEQ ID NO: 472189 - DNA, 25 bp, Mus musculus
tcattgagggctccatgagtgactg

SEQ ID NO: 472190 - DNA, 25 bp, Mus musculus
tcattgagtgcactgactttgaagg

SEQ ID NO: 472191 - DNA, 25 bp, Mus musculus
tcattgatcacattgcggagggcac

SEQ ID NO: 472192 - DNA, 25 bp, Mus musculus
tcattgcagcccagggcacatacac

SEQ ID NO: 472193 - DNA, 25 bp, Mus musculus
tcattgccaagcatggcgctgccct

SEQ ID NO: 472194 - DNA, 25 bp, Mus musculus
tcattgcccttgtgttttctcagag

SEQ ID NO: 472195 - DNA, 25 bp, Mus musculus
tcattgccgtcctcaagcagttcgg

SEQ ID NO: 472196 - DNA, 25 bp, Mus musculus
tcattgctaagacggacacagagac

SEQ ID NO: 472197 - DNA, 25 bp, Mus musculus
tcattgctgtcttccctcagatact

SEQ ID NO: 472198 - DNA, 25 bp, Mus musculus
tcattggaaaccttccaggagaaaa

SEQ ID NO: 472199 - DNA, 25 bp, Mus musculus
tcattggactgctcagaggactctg

SEQ ID NO: 472200 - DNA, 25 bp, Mus musculus
tcattggaggaaggaaccatcaagt

SEQ ID NO: 472201 - DNA, 25 bp, Mus musculus
tcattggcaacgtacggatcgacag

SEQ ID NO: 472202 - DNA, 25 bp, Mus musculus
tcattggcacaggaaaaacactttc

SEQ ID NO: 472203 - DNA, 25 bp, Mus musculus
tcattggcaccataagtaaggacta

SEQ ID NO: 472204 - DNA, 25 bp, Mus musculus
tcattggccacatcagcaggcttgc

SEQ ID NO: 472205 - DNA, 25 bp, Mus musculus
tcattggccagaactcagtcagatg

SEQ ID NO: 472206 - DNA, 25 bp, Mus musculus
tcattggccttggagttgctgccct

SEQ ID NO: 472207 - DNA, 25 bp, Mus musculus
tcattggctttcaggtggtaatacc

SEQ ID NO: 472208 - DNA, 25 bp, Mus musculus
tcattgggaccatcctggctgtagg

SEQ ID NO: 472209 - DNA, 25 bp, Mus musculus
tcattgggtgaaagaaagtagaagc

SEQ ID NO: 472210 - DNA, 25 bp, Mus musculus
tcattgtcaccgaggcaggcggagt

SEQ ID NO: 472211 - DNA, 25 bp, Mus musculus
tcattgtcccgtaccaggcttcaca

SEQ ID NO: 472212 - DNA, 25 bp, Mus musculus
tcattgtcttcagcccttagacgac

SEQ ID NO: 472213 - DNA, 25 bp, Mus musculus
tcattgtgacattttcatacatgtc

SEQ ID NO: 472214 - DNA, 25 bp, Mus musculus
tcattgtgcagcgatgcctctcggc

SEQ ID NO: 472215 - DNA, 25 bp, Mus musculus
tcattgtgcccaagatgttgagtac

SEQ ID NO: 472216 - DNA, 25 bp, Mus musculus
tcattgtgctgacaaagactggccg

SEQ ID NO: 472217 - DNA, 25 bp, Mus musculus
tcattgtgttggaaacaggcccaca

SEQ ID NO: 472218 - DNA, 25 bp, Mus musculus
tcattgttagcgcataggtcgccct

SEQ ID NO: 472219 - DNA, 25 bp, Mus musculus
tcattgttcactgcatgcgccagaa

SEQ ID NO: 472220 - DNA, 25 bp, Mus musculus
tcattgttttgtaccctccccaggg

SEQ ID NO: 472221 - DNA, 25 bp, Mus musculus
tcatttaagcaccactgacctgcgg

SEQ ID NO: 472222 - DNA, 25 bp, Mus musculus
tcatttacttagacaggccctctgg

SEQ ID NO: 472223 - DNA, 25 bp, Mus musculus
tcatttagattttcctctggcagag

SEQ ID NO: 472224 - DNA, 25 bp, Mus musculus
tcatttagtacgtccaatggaaagc

SEQ ID NO: 472225 - DNA, 25 bp, Mus musculus
tcatttatagcatttgagggtatct

SEQ ID NO: 472226 - DNA, 25 bp, Mus musculus
tcatttatgagctcagtggcatgcc

SEQ ID NO: 472227 - DNA, 25 bp, Mus musculus
tcatttcaaagcgtagccaggttcc

SEQ ID NO: 472228 - DNA, 25 bp, Mus musculus
tcatttcaaaggtggtcagtctggg

SEQ ID NO: 472229 - DNA, 25 bp, Mus musculus
tcatttcaggatcttttgagtcaga

SEQ ID NO: 472230 - DNA, 25 bp, Mus musculus
tcatttcatggctgatgagcagaca

SEQ ID NO: 472231 - DNA, 25 bp, Mus musculus
tcatttccaagctcgatgggcgtct

SEQ ID NO: 472232 - DNA, 25 bp, Mus musculus
tcatttccaggagggtgtgcacaac

SEQ ID NO: 472233 - DNA, 25 bp, Mus musculus
tcatttccatagaagacgcctgcgg

SEQ ID NO: 472234 - DNA, 25 bp, Mus musculus
tcatttcctaatgcaagacattgct

SEQ ID NO: 472235 - DNA, 25 bp, Mus musculus
tcatttctatcatcgccccaggtag

SEQ ID NO: 472236 - DNA, 25 bp, Mus musculus
tcatttctgctgtcgagctccaggt

SEQ ID NO: 472237 - DNA, 25 bp, Mus musculus
tcatttgagaccctggaagcccaag

SEQ ID NO: 472238 - DNA, 25 bp, Mus musculus
tcatttgaggaagacgcatgagctc

SEQ ID NO: 472239 - DNA, 25 bp, Mus musculus
tcatttgagtgtgaggccaggaaac

SEQ ID NO: 472240 - DNA, 25 bp, Mus musculus
tcatttgatgagacctgtacccggt

SEQ ID NO: 472241 - DNA, 25 bp, Mus musculus
tcatttgatgcaaggaagcagcccg

SEQ ID NO: 472242 - DNA, 25 bp, Mus musculus
tcatttgcaacaggtgggagctctc

SEQ ID NO: 472243 - DNA, 25 bp, Mus musculus
tcatttgccttttgagcaaggtgtg

SEQ ID NO: 472244 - DNA, 25 bp, Mus musculus
tcatttgctcacatatttggtcaca

SEQ ID NO: 472245 - DNA, 25 bp, Mus musculus
tcatttgctttgcaaggcaagacaa

SEQ ID NO: 472246 - DNA, 25 bp, Mus musculus
tcatttgggagacctgagaacaaga

SEQ ID NO: 472247 - DNA, 25 bp, Mus musculus
tcattttccacaaggctgctgctgg

SEQ ID NO: 472248 - DNA, 25 bp, Mus musculus
tcattttgccaaggaattcacccca

SEQ ID NO: 472249 - DNA, 25 bp, Mus musculus
tcattttgccagtgagtaactaact

SEQ ID NO: 472250 - DNA, 25 bp, Mus musculus
tcattttgcttatccctgggcctgg

SEQ ID NO: 472251 - DNA, 25 bp, Mus musculus
tcattttgggtagacgaggcttcca

SEQ ID NO: 472252 - DNA, 25 bp, Mus musculus
tcatttttgaagcagagcgtggcaa

SEQ ID NO: 472253 - DNA, 25 bp, Mus musculus
tccaaaaagttgttgccagggcctg

SEQ ID NO: 472254 - DNA, 25 bp, Mus musculus
tccaaaacaagtacacacccggacg

SEQ ID NO: 472255 - DNA, 25 bp, Mus musculus
tccaaaacagttaagtataaggtca

SEQ ID NO: 472256 - DNA, 25 bp, Mus musculus
tccaaaacgtcaactggcaggtgcc

SEQ ID NO: 472257 - DNA, 25 bp, Mus musculus
tccaaaagaagaaagcagtgccgac

SEQ ID NO: 472258 - DNA, 25 bp, Mus musculus
tccaaaagagcacatacattggcct

SEQ ID NO: 472259 - DNA, 25 bp, Mus musculus
tccaaaagctaacaatgcagacatt

SEQ ID NO: 472260 - DNA, 25 bp, Mus musculus
tccaaaagctatacagagaggcacg

SEQ ID NO: 472261 - DNA, 25 bp, Mus musculus
tccaaaaggaacttcgagggcaagg

SEQ ID NO: 472262 - DNA, 25 bp, Mus musculus
tccaaaaggactgagtgctccgcgg

SEQ ID NO: 472263 - DNA, 25 bp, Mus musculus
tccaaaagtcatgagggtgagtgtc

SEQ ID NO: 472264 - DNA, 25 bp, Mus musculus
tccaaaagtgagctacaggcaacca

SEQ ID NO: 472265 - DNA, 25 bp, Mus musculus
tccaaaatcctcaggacgactacag

SEQ ID NO: 472266 - DNA, 25 bp, Mus musculus
tccaaaatcgcccttggtggcctgt

SEQ ID NO: 472267 - DNA, 25 bp, Mus musculus
tccaaaattgagagcgaggcgttct

SEQ ID NO: 472268 - DNA, 25 bp, Mus musculus
tccaaacaagatgtgctgcgggccc

SEQ ID NO: 472269 - DNA, 25 bp, Mus musculus
tccaaaccagtgctagaaaactagc

SEQ ID NO: 472270 - DNA, 25 bp, Mus musculus
tccaaaccgagagcgcagtgacttc

SEQ ID NO: 472271 - DNA, 25 bp, Mus musculus
tccaaacctctaactggagcagagg

SEQ ID NO: 472272 - DNA, 25 bp, Mus musculus
tccaaacgaccacgtgaagcagcag

SEQ ID NO: 472273 - DNA, 25 bp, Mus musculus
tccaaacgcagataggacatttccg

SEQ ID NO: 472274 - DNA, 25 bp, Mus musculus
tccaaacggaggcacgagtgacttc

SEQ ID NO: 472275 - DNA, 25 bp, Mus musculus
tccaaacggctgtggaaagagctcc

SEQ ID NO: 472276 - DNA, 25 bp, Mus musculus
tccaaacgtgtgcaggagctcagca

SEQ ID NO: 472277 - DNA, 25 bp, Mus musculus
tccaaactaccaggcggagctgagg

SEQ ID NO: 472278 - DNA, 25 bp, Mus musculus
tccaaactgcggtggtgacctgcga

SEQ ID NO: 472279 - DNA, 25 bp, Mus musculus
tccaaactggatcgaaggcgtagag

SEQ ID NO: 472280 - DNA, 25 bp, Mus musculus
tccaaacttgataggtcgctctccg

SEQ ID NO: 472281 - DNA, 25 bp, Mus musculus
tccaaacttgattgagaattcctgg

SEQ ID NO: 472282 - DNA, 25 bp, Mus musculus
tccaaagacgctagatgttaagggc

SEQ ID NO: 472283 - DNA, 25 bp, Mus musculus
tccaaagacttataacggccctgcc

SEQ ID NO: 472284 - DNA, 25 bp, Mus musculus
tccaaagagcaatggcctagagttg

SEQ ID NO: 472285 - DNA, 25 bp, Mus musculus
tccaaagaggttcactgactggcgc

SEQ ID NO: 472286 - DNA, 25 bp, Mus musculus
tccaaagcagaagccgtaaccgggc

SEQ ID NO: 472287 - DNA, 25 bp, Mus musculus
tccaaagcgcattacatgcccgacg

SEQ ID NO: 472288 - DNA, 25 bp, Mus musculus
tccaaaggaaagcagcgaagccctg

SEQ ID NO: 472289 - DNA, 25 bp, Mus musculus
tccaaaggaggagatcagcaacaac

SEQ ID NO: 472290 - DNA, 25 bp, Mus musculus
tccaaaggcaactatgacgagggct

SEQ ID NO: 472291 - DNA, 25 bp, Mus musculus
tccaaaggcatgagaggctgcacgc

SEQ ID NO: 472292 - DNA, 25 bp, Mus musculus
tccaaaggcgtccactactgggagc

SEQ ID NO: 472293 - DNA, 25 bp, Mus musculus
tccaaagggtcaattgttcacagcg

SEQ ID NO: 472294 - DNA, 25 bp, Mus musculus
tccaaagtaaagagacctgtgcggg

SEQ ID NO: 472295 - DNA, 25 bp, Mus musculus
tccaaagtaagagaggtgagacctc

SEQ ID NO: 472296 - DNA, 25 bp, Mus musculus
tccaaagtcccaacagctgtggcag

SEQ ID NO: 472297 - DNA, 25 bp, Mus musculus
tccaaagtggaacaaggcgtgaaaa

SEQ ID NO: 472298 - DNA, 25 bp, Mus musculus
tccaaataaagttgggacgtcccag

SEQ ID NO: 472299 - DNA, 25 bp, Mus musculus
tccaaatagctaggcggaaggactg

SEQ ID NO: 472300 - DNA, 25 bp, Mus musculus
tccaaatagcttaacagatctccca

SEQ ID NO: 472301 - DNA, 25 bp, Mus musculus
tccaaatcaaaagtggtggcccatt

SEQ ID NO: 472302 - DNA, 25 bp, Mus musculus
tccaaatcatctggctggaagattc

SEQ ID NO: 472303 - DNA, 25 bp, Mus musculus
tccaaatctagcctgtgaagcgaga

SEQ ID NO: 472304 - DNA, 25 bp, Mus musculus
tccaaatctggagttcacactcgag

SEQ ID NO: 472305 - DNA, 25 bp, Mus musculus
tccaaatgaggaactctgtgtcagt

SEQ ID NO: 472306 - DNA, 25 bp, Mus musculus
tccaaatgcgagaaaggacccagca

SEQ ID NO: 472307 - DNA, 25 bp, Mus musculus
tccaaatggatgtccagtccaggga

SEQ ID NO: 472308 - DNA, 25 bp, Mus musculus
tccaaattcatcataccctgtcggt

SEQ ID NO: 472309 - DNA, 25 bp, Mus musculus
tccaacaaagcaccgctcttggtgt

SEQ ID NO: 472310 - DNA, 25 bp, Mus musculus
tccaacaacgtggtgaccgtcacag

SEQ ID NO: 472311 - DNA, 25 bp, Mus musculus
tccaacaaggcaggatggcagttat

SEQ ID NO: 472312 - DNA, 25 bp, Mus musculus
tccaacaatttagtgtgcctgtggg

SEQ ID NO: 472313 - DNA, 25 bp, Mus musculus
tccaacacagtcttgaaaaggagtg

SEQ ID NO: 472314 - DNA, 25 bp, Mus musculus
tccaacagccctcagacatatggga

SEQ ID NO: 472315 - DNA, 25 bp, Mus musculus
tccaacaggagcatgtgcaagggct

SEQ ID NO: 472316 - DNA, 25 bp, Mus musculus
tccaacagttcacaaacggctcagt

SEQ ID NO: 472317 - DNA, 25 bp, Mus musculus
tccaacatgaggatgcagttctcct

SEQ ID NO: 472318 - DNA, 25 bp, Mus musculus
tccaacatgtatgttcacttggtgt

SEQ ID NO: 472319 - DNA, 25 bp, Mus musculus
tccaaccccaggtaggagggactgg

SEQ ID NO: 472320 - DNA, 25 bp, Mus musculus
tccaacccgagatgatggccagcaa

SEQ ID NO: 472321 - DNA, 25 bp, Mus musculus
tccaaccggagctatgtgaccacgt

SEQ ID NO: 472322 - DNA, 25 bp, Mus musculus
tccaaccggcagaaagaggtacaag

SEQ ID NO: 472323 - DNA, 25 bp, Mus musculus
tccaaccgggctgtggatgaacctg

SEQ ID NO: 472324 - DNA, 25 bp, Mus musculus
tccaacctatgaaacagcatctttg

SEQ ID NO: 472325 - DNA, 25 bp, Mus musculus
tccaaccttggagtgaaggatcgca

SEQ ID NO: 472326 - DNA, 25 bp, Mus musculus
tccaacgaaagagccagtgaaccct

SEQ ID NO: 472327 - DNA, 25 bp, Mus musculus
tccaacgcagctccgaggctgaact

SEQ ID NO: 472328 - DNA, 25 bp, Mus musculus
tccaacgcttggtgctcagctcaga

SEQ ID NO: 472329 - DNA, 25 bp, Mus musculus
tccaacgggcaactcaactttgaag

SEQ ID NO: 472330 - DNA, 25 bp, Mus musculus
tccaacgggccagtgaagaaatcca

SEQ ID NO: 472331 - DNA, 25 bp, Mus musculus
tccaacggtgtgaagagctctccag

SEQ ID NO: 472332 - DNA, 25 bp, Mus musculus
tccaactagctgtggcccagtgagc

SEQ ID NO: 472333 - DNA, 25 bp, Mus musculus
tccaactcagggtgggcctgcctca

SEQ ID NO: 472334 - DNA, 25 bp, Mus musculus
tccaactcctggagatctgagaccc

SEQ ID NO: 472335 - DNA, 25 bp, Mus musculus
tccaactcggaacatgggactgagg

SEQ ID NO: 472336 - DNA, 25 bp, Mus musculus
tccaactgaaaaatcagggcaaagc

SEQ ID NO: 472337 - DNA, 25 bp, Mus musculus
tccaactggccaaggagatgcgcag

SEQ ID NO: 472338 - DNA, 25 bp, Mus musculus
tccaactgtgagtgaagcctgaagc

SEQ ID NO: 472339 - DNA, 25 bp, Mus musculus
tccaactgtttgacaagagcggaaa

SEQ ID NO: 472340 - DNA, 25 bp, Mus musculus
tccaacttaggagcggacaacagca

SEQ ID NO: 472341 - DNA, 25 bp, Mus musculus
tccaactttcactgtgaaggacaga

SEQ ID NO: 472342 - DNA, 25 bp, Mus musculus
tccaactttgactgtgggacctgcc

SEQ ID NO: 472343 - DNA, 25 bp, Mus musculus
tccaagaaaaagtggctccggacgc

SEQ ID NO: 472344 - DNA, 25 bp, Mus musculus
tccaagaaggcacaactgatgggct

SEQ ID NO: 472345 - DNA, 25 bp, Mus musculus
tccaagaagtttccgggcagtctcc

SEQ ID NO: 472346 - DNA, 25 bp, Mus musculus
tccaagaatgcactcgagcctaatc

SEQ ID NO: 472347 - DNA, 25 bp, Mus musculus
tccaagaccatttgtagtgagcggg

SEQ ID NO: 472348 - DNA, 25 bp, Mus musculus
tccaagacctatcgaggagcgttcc

SEQ ID NO: 472349 - DNA, 25 bp, Mus musculus
tccaagacctgcacgtacgagggct

SEQ ID NO: 472350 - DNA, 25 bp, Mus musculus
tccaagacctggaacggaagcttcg

SEQ ID NO: 472351 - DNA, 25 bp, Mus musculus
tccaagacctggagtaaagggtgcc

SEQ ID NO: 472352 - DNA, 25 bp, Mus musculus
tccaagagatgaaacagcaggcggc

SEQ ID NO: 472353 - DNA, 25 bp, Mus musculus
tccaagagcactgggctcacatgtg

SEQ ID NO: 472354 - DNA, 25 bp, Mus musculus
tccaagagcccaacatgctggattg

SEQ ID NO: 472355 - DNA, 25 bp, Mus musculus
tccaagagctgatgctccaggcaga

SEQ ID NO: 472356 - DNA, 25 bp, Mus musculus
tccaagagctggatttaagattgct

SEQ ID NO: 472357 - DNA, 25 bp, Mus musculus
tccaagagctggttctgcgtgacaa

SEQ ID NO: 472358 - DNA, 25 bp, Mus musculus
tccaagaggcgggagaagaagtcca

SEQ ID NO: 472359 - DNA, 25 bp, Mus musculus
tccaagagtgaagggctgtatccag

SEQ ID NO: 472360 - DNA, 25 bp, Mus musculus
tccaagataccaggcagacgtgaag

SEQ ID NO: 472361 - DNA, 25 bp, Mus musculus
tccaagatcactgacttcactagtt

SEQ ID NO: 472362 - DNA, 25 bp, Mus musculus
tccaagatcggctctcggaggtcct

SEQ ID NO: 472363 - DNA, 25 bp, Mus musculus
tccaagatctacatggccgacctgg

SEQ ID NO: 472364 - DNA, 25 bp, Mus musculus
tccaagatgccatcgatcactcggg

SEQ ID NO: 472365 - DNA, 25 bp, Mus musculus
tccaagatgcctatttccacacaca

SEQ ID NO: 472366 - DNA, 25 bp, Mus musculus
tccaagatggacgaactagaaggcc

SEQ ID NO: 472367 - DNA, 25 bp, Mus musculus
tccaagatgggaaaagacgcagcca

SEQ ID NO: 472368 - DNA, 25 bp, Mus musculus
tccaagcagagtttcccatgggccc

SEQ ID NO: 472369 - DNA, 25 bp, Mus musculus
tccaagcagggcaaagaaggatcga

SEQ ID NO: 472370 - DNA, 25 bp, Mus musculus
tccaagcaggtggtggccattgtcc

SEQ ID NO: 472371 - DNA, 25 bp, Mus musculus
tccaagcagttgtgtttagtctgca

SEQ ID NO: 472372 - DNA, 25 bp, Mus musculus
tccaagcatagcatgaaggcacacg

SEQ ID NO: 472373 - DNA, 25 bp, Mus musculus
tccaagcatggccaggtaacttcag

SEQ ID NO: 472374 - DNA, 25 bp, Mus musculus
tccaagccagcaccttattgggaag

SEQ ID NO: 472375 - DNA, 25 bp, Mus musculus
tccaagccggacaatccgggcgagg

SEQ ID NO: 472376 - DNA, 25 bp, Mus musculus
tccaagccgggtcgcgatgtacgac

SEQ ID NO: 472377 - DNA, 25 bp, Mus musculus
tccaagctcaaaaaaggagcgtgct

SEQ ID NO: 472378 - DNA, 25 bp, Mus musculus
tccaagctgtcctgccgtaatagag

SEQ ID NO: 472379 - DNA, 25 bp, Mus musculus
tccaagctgttggtgctccagggcc

SEQ ID NO: 472380 - DNA, 25 bp, Mus musculus
tccaaggaacagagccacagagcat

SEQ ID NO: 472381 - DNA, 25 bp, Mus musculus
tccaaggaacgagcatgcccagaat

SEQ ID NO: 472382 - DNA, 25 bp, Mus musculus
tccaaggacccatacgaagcgtgtg

SEQ ID NO: 472383 - DNA, 25 bp, Mus musculus
tccaaggactggactaaagccggcg

SEQ ID NO: 472384 - DNA, 25 bp, Mus musculus
tccaaggaggagcttatggccgtcc

SEQ ID NO: 472385 - DNA, 25 bp, Mus musculus
tccaaggatggacgctcaggctatc

SEQ ID NO: 472386 - DNA, 25 bp, Mus musculus
tccaaggcaccatgggaagattccc

SEQ ID NO: 472387 - DNA, 25 bp, Mus musculus
tccaaggcaggtgtgctgtgcatgc

SEQ ID NO: 472388 - DNA, 25 bp, Mus musculus
tccaaggcataccaatacgaacagg

SEQ ID NO: 472389 - DNA, 25 bp, Mus musculus
tccaaggccagaagaaagggctccg

SEQ ID NO: 472390 - DNA, 25 bp, Mus musculus
tccaaggcctgctgctagagatgct

SEQ ID NO: 472391 - DNA, 25 bp, Mus musculus
tccaaggcgatgcaagagagcagct

SEQ ID NO: 472392 - DNA, 25 bp, Mus musculus
tccaaggcttcgtgttgaggacaag

SEQ ID NO: 472393 - DNA, 25 bp, Mus musculus
tccaaggctttaagccccaggaggc

SEQ ID NO: 472394 - DNA, 25 bp, Mus musculus
tccaagggcggaaatagccgtgagc

SEQ ID NO: 472395 - DNA, 25 bp, Mus musculus
tccaagggtccagctaatggcccaa

SEQ ID NO: 472396 - DNA, 25 bp, Mus musculus
tccaaggtaccatttgctcaggctg

SEQ ID NO: 472397 - DNA, 25 bp, Mus musculus
tccaaggtaggaacgcaaatctcag

SEQ ID NO: 472398 - DNA, 25 bp, Mus musculus
tccaaggtcgtggactaggccgctt

SEQ ID NO: 472399 - DNA, 25 bp, Mus musculus
tccaaggtgacacatatctcaagct

SEQ ID NO: 472400 - DNA, 25 bp, Mus musculus
tccaaggtgatagacaaatacatgc

SEQ ID NO: 472401 - DNA, 25 bp, Mus musculus
tccaaggtgcctgaaagccaactag

SEQ ID NO: 472402 - DNA, 25 bp, Mus musculus
tccaaggtgggaatagcaagatctt

SEQ ID NO: 472403 - DNA, 25 bp, Mus musculus
tccaaggtgggcaccgagatggcca

SEQ ID NO: 472404 - DNA, 25 bp, Mus musculus
tccaagtagaactgataccaacggg

SEQ ID NO: 472405 - DNA, 25 bp, Mus musculus
tccaagtagccattcagagtttacg

SEQ ID NO: 472406 - DNA, 25 bp, Mus musculus
tccaagtaggaactggaaccaggta

SEQ ID NO: 472407 - DNA, 25 bp, Mus musculus
tccaagtcggtcaggtactgggctc

SEQ ID NO: 472408 - DNA, 25 bp, Mus musculus
tccaagtcttttgaccagaaagtga

SEQ ID NO: 472409 - DNA, 25 bp, Mus musculus
tccaagtgaagaccagagcagtggc

SEQ ID NO: 472410 - DNA, 25 bp, Mus musculus
tccaagtgacagaggaagtgccgtc

SEQ ID NO: 472411 - DNA, 25 bp, Mus musculus
tccaagtgcaggaggcttcagagcc

SEQ ID NO: 472412 - DNA, 25 bp, Mus musculus
tccaagtggataaggaaaggcacaa

SEQ ID NO: 472413 - DNA, 25 bp, Mus musculus
tccaagtgtgaaaccatacgaatgg

SEQ ID NO: 472414 - DNA, 25 bp, Mus musculus
tccaagtgttagaagccccagggag

SEQ ID NO: 472415 - DNA, 25 bp, Mus musculus
tccaagttctagactagcctggtct

SEQ ID NO: 472416 - DNA, 25 bp, Mus musculus
tccaagtttggaccttagtgggccg

SEQ ID NO: 472417 - DNA, 25 bp, Mus musculus
tccaatacgtgcagcagaacggagg

SEQ ID NO: 472418 - DNA, 25 bp, Mus musculus
tccaatagaacaggtaaggtgcaca

SEQ ID NO: 472419 - DNA, 25 bp, Mus musculus
tccaatagggcagcaaacagtgtgc

SEQ ID NO: 472420 - DNA, 25 bp, Mus musculus
tccaatcagcctgtgacaccaaggt

SEQ ID NO: 472421 - DNA, 25 bp, Mus musculus
tccaatcatcacctataagcctggg

SEQ ID NO: 472422 - DNA, 25 bp, Mus musculus
tccaatccgggaggtgagccttacg

SEQ ID NO: 472423 - DNA, 25 bp, Mus musculus
tccaatcctgttgagagtgggtgcc

SEQ ID NO: 472424 - DNA, 25 bp, Mus musculus
tccaatcgaagatgcgtgaacacgt

SEQ ID NO: 472425 - DNA, 25 bp, Mus musculus
tccaatgaatctgctacaatggccg

SEQ ID NO: 472426 - DNA, 25 bp, Mus musculus
tccaatgactcaagcacaggctgtt

SEQ ID NO: 472427 - DNA, 25 bp, Mus musculus
tccaatgaggctggtggtatctacc

SEQ ID NO: 472428 - DNA, 25 bp, Mus musculus
tccaatgagggacgttcctggcagt

SEQ ID NO: 472429 - DNA, 25 bp, Mus musculus
tccaatgatagtcacaagaaagctg

SEQ ID NO: 472430 - DNA, 25 bp, Mus musculus
tccaatgcctgggagactgtcacca

SEQ ID NO: 472431 - DNA, 25 bp, Mus musculus
tccaatgcggaaaagacaggcccgt

SEQ ID NO: 472432 - DNA, 25 bp, Mus musculus
tccaatggcatgaagtacgaaggcg

SEQ ID NO: 472433 - DNA, 25 bp, Mus musculus
tccaatggccgatatgagggcagca

SEQ ID NO: 472434 - DNA, 25 bp, Mus musculus
tccaatgggtatgggtggcttcacc

SEQ ID NO: 472435 - DNA, 25 bp, Mus musculus
tccaatggtgttgcacaaagtggct

SEQ ID NO: 472436 - DNA, 25 bp, Mus musculus
tccaatgtattgttctcaagaagca

SEQ ID NO: 472437 - DNA, 25 bp, Mus musculus
tccaattacgtactgcagctggccg

SEQ ID NO: 472438 - DNA, 25 bp, Mus musculus
tccaattccaagtgtcagggtcaag

SEQ ID NO: 472439 - DNA, 25 bp, Mus musculus
tccaattcggaaatggaggctgcca

SEQ ID NO: 472440 - DNA, 25 bp, Mus musculus
tccaattcgggagacctctagacac

SEQ ID NO: 472441 - DNA, 25 bp, Mus musculus
tccaattgaggcgaggaggtctgcc

SEQ ID NO: 472442 - DNA, 25 bp, Mus musculus
tccaattgggtgatggcacgaggct

SEQ ID NO: 472443 - DNA, 25 bp, Mus musculus
tccaatttagacttgattccaggtc

SEQ ID NO: 472444 - DNA, 25 bp, Mus musculus
tccaatttgcacagatgcagggctt

SEQ ID NO: 472445 - DNA, 25 bp, Mus musculus
tccacaaagtgcaaaagagggcatc

SEQ ID NO: 472446 - DNA, 25 bp, Mus musculus
tccacaaagtttggtccgcggagga

SEQ ID NO: 472447 - DNA, 25 bp, Mus musculus
tccacaacaacagggtgggacgcca

SEQ ID NO: 472448 - DNA, 25 bp, Mus musculus
tccacaagaatgtagtgataccgct

SEQ ID NO: 472449 - DNA, 25 bp, Mus musculus
tccacaagagaccaaaagctagagg

SEQ ID NO: 472450 - DNA, 25 bp, Mus musculus
tccacaagagagagaacattctggt

SEQ ID NO: 472451 - DNA, 25 bp, Mus musculus
tccacaagaggacaaaatgaaacac

SEQ ID NO: 472452 - DNA, 25 bp, Mus musculus
tccacaagatagacacgtacctcaa

SEQ ID NO: 472453 - DNA, 25 bp, Mus musculus
tccacaaggtttggaagaaggtcga

SEQ ID NO: 472454 - DNA, 25 bp, Mus musculus
tccacaagtactctggcaaggaagg

SEQ ID NO: 472455 - DNA, 25 bp, Mus musculus
tccacaataaaggaggtgcgcggct

SEQ ID NO: 472456 - DNA, 25 bp, Mus musculus
tccacaatccaagtccgtgaacggt

SEQ ID NO: 472457 - DNA, 25 bp, Mus musculus
tccacacaaggatctggacctgggc

SEQ ID NO: 472458 - DNA, 25 bp, Mus musculus
tccacacaataacgcgaaaaaccgg

SEQ ID NO: 472459 - DNA, 25 bp, Mus musculus
tccacacatggacagaggcctctgg

SEQ ID NO: 472460 - DNA, 25 bp, Mus musculus
tccacacctgatagtaggcaggaaa

SEQ ID NO: 472461 - DNA, 25 bp, Mus musculus
tccacacctgtgagaggaagcaaag

SEQ ID NO: 472462 - DNA, 25 bp, Mus musculus
tccacacgggtttcaagccagaagc

SEQ ID NO: 472463 - DNA, 25 bp, Mus musculus
tccacacggttcgaagaagtcctag

SEQ ID NO: 472464 - DNA, 25 bp, Mus musculus
tccacagaacaggaagcagtacctt

SEQ ID NO: 472465 - DNA, 25 bp, Mus musculus
tccacagaacagtggctttggtgcc

SEQ ID NO: 472466 - DNA, 25 bp, Mus musculus
tccacagactgagcctgcgctagtt

SEQ ID NO: 472467 - DNA, 25 bp, Mus musculus
tccacagaggaaggccgcaagattt

SEQ ID NO: 472468 - DNA, 25 bp, Mus musculus
tccacagagtgaagtggaggcccag

SEQ ID NO: 472469 - DNA, 25 bp, Mus musculus
tccacagatgttgggtcatcacaga

SEQ ID NO: 472470 - DNA, 25 bp, Mus musculus
tccacagcggtgtaaaaatgtgaca

SEQ ID NO: 472471 - DNA, 25 bp, Mus musculus
tccacagggatcatggaaacgctcc

SEQ ID NO: 472472 - DNA, 25 bp, Mus musculus
tccacagtgaacgtagggtatccct

SEQ ID NO: 472473 - DNA, 25 bp, Mus musculus
tccacagtgagaacttgttgaaggt

SEQ ID NO: 472474 - DNA, 25 bp, Mus musculus
tccacagtggaaggaagtcacacaa

SEQ ID NO: 472475 - DNA, 25 bp, Mus musculus
tccacagtgttctgcttagctaaca

SEQ ID NO: 472476 - DNA, 25 bp, Mus musculus
tccacagttgacaggctccgagaaa

SEQ ID NO: 472477 - DNA, 25 bp, Mus musculus
tccacatccagcagattgggccggg

SEQ ID NO: 472478 - DNA, 25 bp, Mus musculus
tccacatgaatcagaaggcagctct

SEQ ID NO: 472479 - DNA, 25 bp, Mus musculus
tccacatgacatgagaggaggaccc

SEQ ID NO: 472480 - DNA, 25 bp, Mus musculus
tccacatgaggagatactgaaagca

SEQ ID NO: 472481 - DNA, 25 bp, Mus musculus
tccacatgctcactcagcaaatgca

SEQ ID NO: 472482 - DNA, 25 bp, Mus musculus
tccacatgggacaggcaggaatgaa

SEQ ID NO: 472483 - DNA, 25 bp, Mus musculus
tccacatgtagaggatatgacccgt

SEQ ID NO: 472484 - DNA, 25 bp, Mus musculus
tccacattactaggaaatacagaca

SEQ ID NO: 472485 - DNA, 25 bp, Mus musculus
tccaccaagaagctgagcgagtgtc

SEQ ID NO: 472486 - DNA, 25 bp, Mus musculus
tccaccaagggagcgatgactatgc

SEQ ID NO: 472487 - DNA, 25 bp, Mus musculus
tccaccacagaactagacttgtttt

SEQ ID NO: 472488 - DNA, 25 bp, Mus musculus
tccaccacggaagagttggcaactt

SEQ ID NO: 472489 - DNA, 25 bp, Mus musculus
tccaccagccacttgaatgtttaca

SEQ ID NO: 472490 - DNA, 25 bp, Mus musculus
tccaccaggcgtttcagtagagtct

SEQ ID NO: 472491 - DNA, 25 bp, Mus musculus
tccaccatgccgatgaagggtcgct

SEQ ID NO: 472492 - DNA, 25 bp, Mus musculus
tccaccatgtaagggtcatgcccag

SEQ ID NO: 472493 - DNA, 25 bp, Mus musculus
tccacccagggataacagttgttga

SEQ ID NO: 472494 - DNA, 25 bp, Mus musculus
tccaccccaggaaagagggcacttt

SEQ ID NO: 472495 - DNA, 25 bp, Mus musculus
tccaccccgagcagagtaaactatt

SEQ ID NO: 472496 - DNA, 25 bp, Mus musculus
tccaccccgcagaaacaaatgtgca

SEQ ID NO: 472497 - DNA, 25 bp, Mus musculus
tccacccgaggatatgcataagcat

SEQ ID NO: 472498 - DNA, 25 bp, Mus musculus
tccaccctcttactaaaacatcgag

SEQ ID NO: 472499 - DNA, 25 bp, Mus musculus
tccaccctctttcttgttttgcaca

SEQ ID NO: 472500 - DNA, 25 bp, Mus musculus
tccaccctggcaggaatttcttgct

SEQ ID NO: 472501 - DNA, 25 bp, Mus musculus
tccaccggcaggtttcattgcattt

SEQ ID NO: 472502 - DNA, 25 bp, Mus musculus
tccacctgaagtcacactgtgtgct

SEQ ID NO: 472503 - DNA, 25 bp, Mus musculus
tccacctgacagatgcagactatag

SEQ ID NO: 472504 - DNA, 25 bp, Mus musculus
tccacctgagaagacattgctaagc

SEQ ID NO: 472505 - DNA, 25 bp, Mus musculus
tccacctgagcagaatggcagcatc

SEQ ID NO: 472506 - DNA, 25 bp, Mus musculus
tccacctgcggaaacgtgaatgagc

SEQ ID NO: 472507 - DNA, 25 bp, Mus musculus
tccacctggacgttacaaatgtcag

SEQ ID NO: 472508 - DNA, 25 bp, Mus musculus
tccacctggtgatgtttaccagaat

SEQ ID NO: 472509 - DNA, 25 bp, Mus musculus
tccacctggtggcttggagccctgc

SEQ ID NO: 472510 - DNA, 25 bp, Mus musculus
tccacctgtggctgtcagaggacca

SEQ ID NO: 472511 - DNA, 25 bp, Mus musculus
tccaccttcgagcacctgtggagtt

SEQ ID NO: 472512 - DNA, 25 bp, Mus musculus
tccaccttgtaggaggagccggtga

SEQ ID NO: 472513 - DNA, 25 bp, Mus musculus
tccacctttgtgctccgtcttacgg

SEQ ID NO: 472514 - DNA, 25 bp, Mus musculus
tccacgacgcagagaacattcaaag

SEQ ID NO: 472515 - DNA, 25 bp, Mus musculus
tccacgactttgttgctagttcaag

SEQ ID NO: 472516 - DNA, 25 bp, Mus musculus
tccacgagaaagtgacggaggctct

SEQ ID NO: 472517 - DNA, 25 bp, Mus musculus
tccacgagcctctgcacgtgcagaa

SEQ ID NO: 472518 - DNA, 25 bp, Mus musculus
tccacgaggtctttgagattacaat

SEQ ID NO: 472519 - DNA, 25 bp, Mus musculus
tccacgagttcccagtagagcatga

SEQ ID NO: 472520 - DNA, 25 bp, Mus musculus
tccacgatgacttgatacccagcaa

SEQ ID NO: 472521 - DNA, 25 bp, Mus musculus
tccacgccgcgatgggaatggctgt

SEQ ID NO: 472522 - DNA, 25 bp, Mus musculus
tccacgcctttgctggagtgaagga

SEQ ID NO: 472523 - DNA, 25 bp, Mus musculus
tccacgcgcgcaggaagtttgcaag

SEQ ID NO: 472524 - DNA, 25 bp, Mus musculus
tccacgcggaggtggaaagtcctac

SEQ ID NO: 472525 - DNA, 25 bp, Mus musculus
tccacgcgtgtcttcttcgagcagc

SEQ ID NO: 472526 - DNA, 25 bp, Mus musculus
tccacgctgctgaaggcaacaatgt

SEQ ID NO: 472527 - DNA, 25 bp, Mus musculus
tccacgcttaatccggaagagtttt

SEQ ID NO: 472528 - DNA, 25 bp, Mus musculus
tccacggaaaaagaaggacatccgc

SEQ ID NO: 472529 - DNA, 25 bp, Mus musculus
tccacggaatgttgaaagcttttac

SEQ ID NO: 472530 - DNA, 25 bp, Mus musculus
tccacggacaagaagactggtgact

SEQ ID NO: 472531 - DNA, 25 bp, Mus musculus
tccacggagaggtagtgaccaggct

SEQ ID NO: 472532 - DNA, 25 bp, Mus musculus
tccacggagcaagcttcaaaggtct

SEQ ID NO: 472533 - DNA, 25 bp, Mus musculus
tccacggcgtgaaggtaatctcgct

SEQ ID NO: 472534 - DNA, 25 bp, Mus musculus
tccacgggatgatgacttcggcaaa

SEQ ID NO: 472535 - DNA, 25 bp, Mus musculus
tccacgggcgagtctacgatatcac

SEQ ID NO: 472536 - DNA, 25 bp, Mus musculus
tccacgggctcattgtgtccagtgc

SEQ ID NO: 472537 - DNA, 25 bp, Mus musculus
tccacgggtgggaaagacacaagca

SEQ ID NO: 472538 - DNA, 25 bp, Mus musculus
tccacggtaggcaagggatcatcca

SEQ ID NO: 472539 - DNA, 25 bp, Mus musculus
tccacggtcattagtgttcccagag

SEQ ID NO: 472540 - DNA, 25 bp, Mus musculus
tccacggtgtgaccagctttgtgtc

SEQ ID NO: 472541 - DNA, 25 bp, Mus musculus
tccacgtgtgtgagagtgaccaaga

SEQ ID NO: 472542 - DNA, 25 bp, Mus musculus
tccacgttcaagtagccagagccaa

SEQ ID NO: 472543 - DNA, 25 bp, Mus musculus
tccacgttcgcttgtttccttcaaa

SEQ ID NO: 472544 - DNA, 25 bp, Mus musculus
tccactaagaaagagggtgagcgcc

SEQ ID NO: 472545 - DNA, 25 bp, Mus musculus
tccactatcagaaccgtgacctcag

SEQ ID NO: 472546 - DNA, 25 bp, Mus musculus
tccactcagattgaagaaacactca

SEQ ID NO: 472547 - DNA, 25 bp, Mus musculus
tccactccactgtaaagatattgca

SEQ ID NO: 472548 - DNA, 25 bp, Mus musculus
tccactccagtgtgcgacaggaaag

SEQ ID NO: 472549 - DNA, 25 bp, Mus musculus
tccactcccggatcgtggcagctga

SEQ ID NO: 472550 - DNA, 25 bp, Mus musculus
tccactccgggaactgatcgatcag

SEQ ID NO: 472551 - DNA, 25 bp, Mus musculus
tccactctagggtgttgcagacaaa

SEQ ID NO: 472552 - DNA, 25 bp, Mus musculus
tccactctggtgacaaaccttttcg

SEQ ID NO: 472553 - DNA, 25 bp, Mus musculus
tccactgaacactgggcatggcatt

SEQ ID NO: 472554 - DNA, 25 bp, Mus musculus
tccactgagaacaacggatgggccc

SEQ ID NO: 472555 - DNA, 25 bp, Mus musculus
tccactgagtgaagagatgttgcct

SEQ ID NO: 472556 - DNA, 25 bp, Mus musculus
tccactgatagacatttggttcact

SEQ ID NO: 472557 - DNA, 25 bp, Mus musculus
tccactgccagaagcatttctcagg

SEQ ID NO: 472558 - DNA, 25 bp, Mus musculus
tccactggagaacaggatacttttg

SEQ ID NO: 472559 - DNA, 25 bp, Mus musculus
tccactggatgaccggaaagctgcc

SEQ ID NO: 472560 - DNA, 25 bp, Mus musculus
tccactggtatcttccagttagact

SEQ ID NO: 472561 - DNA, 25 bp, Mus musculus
tccactggtcggtcatatgggagac

SEQ ID NO: 472562 - DNA, 25 bp, Mus musculus
tccactgtcattggatggtgcatcg

SEQ ID NO: 472563 - DNA, 25 bp, Mus musculus
tccactgtgaaaccggtaagcactg

SEQ ID NO: 472564 - DNA, 25 bp, Mus musculus
tccactgtgatgtttgagcagcaga

SEQ ID NO: 472565 - DNA, 25 bp, Mus musculus
tccactgtgcactcgagactttcta

SEQ ID NO: 472566 - DNA, 25 bp, Mus musculus
tccactgtgggatgcaggtcgtcat

SEQ ID NO: 472567 - DNA, 25 bp, Mus musculus
tccacttactccagaggccgaagaa

SEQ ID NO: 472568 - DNA, 25 bp, Mus musculus
tccacttactccttgcagttccggg

SEQ ID NO: 472569 - DNA, 25 bp, Mus musculus
tccacttgaagaccacaagaaggca

SEQ ID NO: 472570 - DNA, 25 bp, Mus musculus
tccacttgcatgagatatttggcgt

SEQ ID NO: 472571 - DNA, 25 bp, Mus musculus
tccacttgctcggtgaataaaacaa

SEQ ID NO: 472572 - DNA, 25 bp, Mus musculus
tccacttgctgtttatgaaagaaag

SEQ ID NO: 472573 - DNA, 25 bp, Mus musculus
tccacttggaagctggcagacaacc

SEQ ID NO: 472574 - DNA, 25 bp, Mus musculus
tccacttggaaggacgtgtggctgt

SEQ ID NO: 472575 - DNA, 25 bp, Mus musculus
tccacttgtgctcaagagggtccag

SEQ ID NO: 472576 - DNA, 25 bp, Mus musculus
tccactttgcagacatgaagtaccc

SEQ ID NO: 472577 - DNA, 25 bp, Mus musculus
tccagaaaaatacagggtcaagcct

SEQ ID NO: 472578 - DNA, 25 bp, Mus musculus
tccagaaaagacagatgcaacagcc

SEQ ID NO: 472579 - DNA, 25 bp, Mus musculus
tccagaaaatctgccgcagcagggc

SEQ ID NO: 472580 - DNA, 25 bp, Mus musculus
tccagaaaccttgcggcgggcagga

SEQ ID NO: 472581 - DNA, 25 bp, Mus musculus
tccagaaactcagtggcaaagccga

SEQ ID NO: 472582 - DNA, 25 bp, Mus musculus
tccagaaacttgcatctgaagatac

SEQ ID NO: 472583 - DNA, 25 bp, Mus musculus
tccagaaactttgtaaaaggtcaat

SEQ ID NO: 472584 - DNA, 25 bp, Mus musculus
tccagaaagaatgtcgtggctacga

SEQ ID NO: 472585 - DNA, 25 bp, Mus musculus
tccagaaaggcatccctagtaggca

SEQ ID NO: 472586 - DNA, 25 bp, Mus musculus
tccagaaagtgaacggagcagccct

SEQ ID NO: 472587 - DNA, 25 bp, Mus musculus
tccagaacaacacgctaaagggcgc

SEQ ID NO: 472588 - DNA, 25 bp, Mus musculus
tccagaacactgtaggcatcccatt

SEQ ID NO: 472589 - DNA, 25 bp, Mus musculus
tccagaacagaactaggatctcatt

SEQ ID NO: 472590 - DNA, 25 bp, Mus musculus
tccagaaccgaagggctaaggcgaa

SEQ ID NO: 472591 - DNA, 25 bp, Mus musculus
tccagaaccgatgactagaccacga

SEQ ID NO: 472592 - DNA, 25 bp, Mus musculus
tccagaacgacatgtaagtagcacc

SEQ ID NO: 472593 - DNA, 25 bp, Mus musculus
tccagaacgcgccagagaagaagat

SEQ ID NO: 472594 - DNA, 25 bp, Mus musculus
tccagaactgaatgctgagaccttg

SEQ ID NO: 472595 - DNA, 25 bp, Mus musculus
tccagaactgtaggaacacccagga

SEQ ID NO: 472596 - DNA, 25 bp, Mus musculus
tccagaagacggcagacaagaatcg

SEQ ID NO: 472597 - DNA, 25 bp, Mus musculus
tccagaagagttgccagtgcagcgc

SEQ ID NO: 472598 - DNA, 25 bp, Mus musculus
tccagaagatctgggttctatccca

SEQ ID NO: 472599 - DNA, 25 bp, Mus musculus
tccagaagcatctcacagggaggaa

SEQ ID NO: 472600 - DNA, 25 bp, Mus musculus
tccagaagcgcaggcagcagcagga

SEQ ID NO: 472601 - DNA, 25 bp, Mus musculus
tccagaaggcatcaagactacagtc

SEQ ID NO: 472602 - DNA, 25 bp, Mus musculus
tccagaagggacgagcaattgacac

SEQ ID NO: 472603 - DNA, 25 bp, Mus musculus
tccagaaggttcttacaagtcacag

SEQ ID NO: 472604 - DNA, 25 bp, Mus musculus
tccagaagtacctaggtgacgggcc

SEQ ID NO: 472605 - DNA, 25 bp, Mus musculus
tccagaagttagaaacagggcaccc

SEQ ID NO: 472606 - DNA, 25 bp, Mus musculus
tccagaatatcctccttggccaggg

SEQ ID NO: 472607 - DNA, 25 bp, Mus musculus
tccagaatatgtagccccagagatc

SEQ ID NO: 472608 - DNA, 25 bp, Mus musculus
tccagaatccgagcttgcagggacc

SEQ ID NO: 472609 - DNA, 25 bp, Mus musculus
tccagaatctaattggtgccaaggc

SEQ ID NO: 472610 - DNA, 25 bp, Mus musculus
tccagaatgagagcttgcaactacg

SEQ ID NO: 472611 - DNA, 25 bp, Mus musculus
tccagaattgttgtcaagtggctcg

SEQ ID NO: 472612 - DNA, 25 bp, Mus musculus
tccagacaacgtgggagactggctc

SEQ ID NO: 472613 - DNA, 25 bp, Mus musculus
tccagacagacagttctccgagctt

SEQ ID NO: 472614 - DNA, 25 bp, Mus musculus
tccagacagcataggtgggagttgc

SEQ ID NO: 472615 - DNA, 25 bp, Mus musculus
tccagacaggcctatagggtcagca

SEQ ID NO: 472616 - DNA, 25 bp, Mus musculus
tccagacagtcaaggtgcacatacc

SEQ ID NO: 472617 - DNA, 25 bp, Mus musculus
tccagacatatattgggagtttccc

SEQ ID NO: 472618 - DNA, 25 bp, Mus musculus
tccagacatgtatgaagagcagtca

SEQ ID NO: 472619 - DNA, 25 bp, Mus musculus
tccagaccagtatccctgagtcaaa

SEQ ID NO: 472620 - DNA, 25 bp, Mus musculus
tccagaccgtacaagatggcagcca

SEQ ID NO: 472621 - DNA, 25 bp, Mus musculus
tccagacggaagcatcagtcttggg

SEQ ID NO: 472622 - DNA, 25 bp, Mus musculus
tccagacggtcaagcggaagatcag

SEQ ID NO: 472623 - DNA, 25 bp, Mus musculus
tccagactcatccagtgctggagga

SEQ ID NO: 472624 - DNA, 25 bp, Mus musculus
tccagactgactgcgaggaactcgt

SEQ ID NO: 472625 - DNA, 25 bp, Mus musculus
tccagactgcagtgacgatgggcaa

SEQ ID NO: 472626 - DNA, 25 bp, Mus musculus
tccagactgctttgggcttccggca

SEQ ID NO: 472627 - DNA, 25 bp, Mus musculus
tccagactgttgatgggcagcagct

SEQ ID NO: 472628 - DNA, 25 bp, Mus musculus
tccagagaaagaggccatgagccag

SEQ ID NO: 472629 - DNA, 25 bp, Mus musculus
tccagagaacatggttgccacagcc

SEQ ID NO: 472630 - DNA, 25 bp, Mus musculus
tccagagaactgtgagggctgtcac

SEQ ID NO: 472631 - DNA, 25 bp, Mus musculus
tccagagaatgccaagtgagtcagc

SEQ ID NO: 472632 - DNA, 25 bp, Mus musculus
tccagagaatgctaccaggcctgag

SEQ ID NO: 472633 - DNA, 25 bp, Mus musculus
tccagagacacagggttgcgatttt

SEQ ID NO: 472634 - DNA, 25 bp, Mus musculus
tccagagacacttaggctggccgca

SEQ ID NO: 472635 - DNA, 25 bp, Mus musculus
tccagagaccatcagggaacgtgca

SEQ ID NO: 472636 - DNA, 25 bp, Mus musculus
tccagagacggacttactagtgcat

SEQ ID NO: 472637 - DNA, 25 bp, Mus musculus
tccagagatgagtgggaaaacggcc

SEQ ID NO: 472638 - DNA, 25 bp, Mus musculus
tccagagcagagcaaaaggagcacc

SEQ ID NO: 472639 - DNA, 25 bp, Mus musculus
tccagagcagtggaagcagatcgct

SEQ ID NO: 472640 - DNA, 25 bp, Mus musculus
tccagagccgatagcagtgttaatg

SEQ ID NO: 472641 - DNA, 25 bp, Mus musculus
tccagagccgtctgtctgcaatgtc

SEQ ID NO: 472642 - DNA, 25 bp, Mus musculus
tccagagctgctaatggaaccctgg

SEQ ID NO: 472643 - DNA, 25 bp, Mus musculus
tccagagcttagagacggtatgata

SEQ ID NO: 472644 - DNA, 25 bp, Mus musculus
tccagaggagcaacatcctttggcc

SEQ ID NO: 472645 - DNA, 25 bp, Mus musculus
tccagaggataccacatggagcagg

SEQ ID NO: 472646 - DNA, 25 bp, Mus musculus
tccagaggcaagctgtcaggacctg

SEQ ID NO: 472647 - DNA, 25 bp, Mus musculus
tccagaggcattgttcgaccgcgtg

SEQ ID NO: 472648 - DNA, 25 bp, Mus musculus
tccagaggccctttgagcagagcct

SEQ ID NO: 472649 - DNA, 25 bp, Mus musculus
tccagaggctggacaagttcgctgc

SEQ ID NO: 472650 - DNA, 25 bp, Mus musculus
tccagaggctgtacatgcgggacct

SEQ ID NO: 472651 - DNA, 25 bp, Mus musculus
tccagagggaccaatgcaacagtgt

SEQ ID NO: 472652 - DNA, 25 bp, Mus musculus
tccagagggagttagaagacactag

SEQ ID NO: 472653 - DNA, 25 bp, Mus musculus
tccagagggtgtcaaaagtgttctc

SEQ ID NO: 472654 - DNA, 25 bp, Mus musculus
tccagaggtggagtacagcagcatg

SEQ ID NO: 472655 - DNA, 25 bp, Mus musculus
tccagagtagaaaacacgggcacct

SEQ ID NO: 472656 - DNA, 25 bp, Mus musculus
tccagagtaggaagtgtaccaaggc

SEQ ID NO: 472657 - DNA, 25 bp, Mus musculus
tccagagtcacaaaggggtcatcgg

SEQ ID NO: 472658 - DNA, 25 bp, Mus musculus
tccagagtccatcctgctggtacca

SEQ ID NO: 472659 - DNA, 25 bp, Mus musculus
tccagagtcctcaacaagctgggag

SEQ ID NO: 472660 - DNA, 25 bp, Mus musculus
tccagagtcgggacagggtgtaacc

SEQ ID NO: 472661 - DNA, 25 bp, Mus musculus
tccagagtcttcgagagtatgagct

SEQ ID NO: 472662 - DNA, 25 bp, Mus musculus
tccagagtgagacagaacaagttgc

SEQ ID NO: 472663 - DNA, 25 bp, Mus musculus
tccagagtgagggaaagtgacccgc

SEQ ID NO: 472664 - DNA, 25 bp, Mus musculus
tccagagtgagtgatgtgccagagc

SEQ ID NO: 472665 - DNA, 25 bp, Mus musculus
tccagagtgtatcattcgtagagac

SEQ ID NO: 472666 - DNA, 25 bp, Mus musculus
tccagagtgttaggtccaccagggc

SEQ ID NO: 472667 - DNA, 25 bp, Mus musculus
tccagataagcaagaccgaagtcac

SEQ ID NO: 472668 - DNA, 25 bp, Mus musculus
tccagataccatcaaagtggccgct

SEQ ID NO: 472669 - DNA, 25 bp, Mus musculus
tccagatcagaagccacgtcgaaag

SEQ ID NO: 472670 - DNA, 25 bp, Mus musculus
tccagatcatcctggccgaagccag

SEQ ID NO: 472671 - DNA, 25 bp, Mus musculus
tccagatcccacgaagcgggtgatg

SEQ ID NO: 472672 - DNA, 25 bp, Mus musculus
tccagatcgccaaaggaccagaaat

SEQ ID NO: 472673 - DNA, 25 bp, Mus musculus
tccagatcgccttcgggacattgct

SEQ ID NO: 472674 - DNA, 25 bp, Mus musculus
tccagatctggatacagaatagcca

SEQ ID NO: 472675 - DNA, 25 bp, Mus musculus
tccagatgctatctctaagaaggaa

SEQ ID NO: 472676 - DNA, 25 bp, Mus musculus
tccagatggagaagtatgcgcgtca

SEQ ID NO: 472677 - DNA, 25 bp, Mus musculus
tccagatggcaaagtctgtagcaac

SEQ ID NO: 472678 - DNA, 25 bp, Mus musculus
tccagatggccagtcagctcaagag

SEQ ID NO: 472679 - DNA, 25 bp, Mus musculus
tccagatgggcgtggctccactgaa

SEQ ID NO: 472680 - DNA, 25 bp, Mus musculus
tccagatgtgagaatcagatcctct

SEQ ID NO: 472681 - DNA, 25 bp, Mus musculus
tccagatgtgtttgcagcagcaccc

SEQ ID NO: 472682 - DNA, 25 bp, Mus musculus
tccagattaaagaatcgcgagagct

SEQ ID NO: 472683 - DNA, 25 bp, Mus musculus
tccagattgcccgtgtggtgccaag

SEQ ID NO: 472684 - DNA, 25 bp, Mus musculus
tccagattggcatgaagcgcctcaa

SEQ ID NO: 472685 - DNA, 25 bp, Mus musculus
tccagattggtcacgggaatgtcat

SEQ ID NO: 472686 - DNA, 25 bp, Mus musculus
tccagcaaaactcgtttacccaggg

SEQ ID NO: 472687 - DNA, 25 bp, Mus musculus
tccagcaagcaaagaggcaacaggg

SEQ ID NO: 472688 - DNA, 25 bp, Mus musculus
tccagcaaggattcagagaagcccc

SEQ ID NO: 472689 - DNA, 25 bp, Mus musculus
tccagcaagggagcgagatgatgtc

SEQ ID NO: 472690 - DNA, 25 bp, Mus musculus
tccagcaagttgagactgggtccca

SEQ ID NO: 472691 - DNA, 25 bp, Mus musculus
tccagcaccgatagaggaagtcacg

SEQ ID NO: 472692 - DNA, 25 bp, Mus musculus
tccagcactgggtacatggctctgc

SEQ ID NO: 472693 - DNA, 25 bp, Mus musculus
tccagcactggtacgaaggttctct

SEQ ID NO: 472694 - DNA, 25 bp, Mus musculus
tccagcacttttgcaaacttttctg

SEQ ID NO: 472695 - DNA, 25 bp, Mus musculus
tccagcagaagggaagctaatgcag

SEQ ID NO: 472696 - DNA, 25 bp, Mus musculus
tccagcagaatcagggacaatgccc

SEQ ID NO: 472697 - DNA, 25 bp, Mus musculus
tccagcagccgacgtagtgacattc

SEQ ID NO: 472698 - DNA, 25 bp, Mus musculus
tccagcagctcgtgtttgtcctcaa

SEQ ID NO: 472699 - DNA, 25 bp, Mus musculus
tccagcaggacggacaggacttcac

SEQ ID NO: 472700 - DNA, 25 bp, Mus musculus
tccagcaggcctatgcaggaatgca

SEQ ID NO: 472701 - DNA, 25 bp, Mus musculus
tccagcaggctctggtctactggct

SEQ ID NO: 472702 - DNA, 25 bp, Mus musculus
tccagcagggccagtgagaatcagt

SEQ ID NO: 472703 - DNA, 25 bp, Mus musculus
tccagcaggttttagaggcacaaca

SEQ ID NO: 472704 - DNA, 25 bp, Mus musculus
tccagcagtctgtggcaaagaaggc

SEQ ID NO: 472705 - DNA, 25 bp, Mus musculus
tccagcagtggagcggttaaccgag

SEQ ID NO: 472706 - DNA, 25 bp, Mus musculus
tccagcagtgtgtacaagccgtgtc

SEQ ID NO: 472707 - DNA, 25 bp, Mus musculus
tccagcatagggtgctagcctacca

SEQ ID NO: 472708 - DNA, 25 bp, Mus musculus
tccagcatgagcgaggtgcataccg

SEQ ID NO: 472709 - DNA, 25 bp, Mus musculus
tccagcatgcctgtaattgggaggc

SEQ ID NO: 472710 - DNA, 25 bp, Mus musculus
tccagcattgaagcagtgggctctg

SEQ ID NO: 472711 - DNA, 25 bp, Mus musculus
tccagccaagacactgatgtccaga

SEQ ID NO: 472712 - DNA, 25 bp, Mus musculus
tccagccaggatgagagaacagctc

SEQ ID NO: 472713 - DNA, 25 bp, Mus musculus
tccagccagggagaacagtacatga

SEQ ID NO: 472714 - DNA, 25 bp, Mus musculus
tccagccaggtctgtgtgactccaa

SEQ ID NO: 472715 - DNA, 25 bp, Mus musculus
tccagcccaggtcatgtatttaaag

SEQ ID NO: 472716 - DNA, 25 bp, Mus musculus
tccagccccaaactaccccgaggag

SEQ ID NO: 472717 - DNA, 25 bp, Mus musculus
tccagccccacaactgtctttttaa

SEQ ID NO: 472718 - DNA, 25 bp, Mus musculus
tccagcccgagactacaagaagaaa

SEQ ID NO: 472719 - DNA, 25 bp, Mus musculus
tccagcccggcatgcactctataat

SEQ ID NO: 472720 - DNA, 25 bp, Mus musculus
tccagccctagctctgttaatagga

SEQ ID NO: 472721 - DNA, 25 bp, Mus musculus
tccagccctggtgttttgagaagcc

SEQ ID NO: 472722 - DNA, 25 bp, Mus musculus
tccagcctcagtcgggggatgctca

SEQ ID NO: 472723 - DNA, 25 bp, Mus musculus
tccagcctctggacacaaggctact

SEQ ID NO: 472724 - DNA, 25 bp, Mus musculus
tccagcctgccgtttagcgtgatgt

SEQ ID NO: 472725 - DNA, 25 bp, Mus musculus
tccagcctgggtatgaagaaattct

SEQ ID NO: 472726 - DNA, 25 bp, Mus musculus
tccagcctggtggttcagagctcct

SEQ ID NO: 472727 - DNA, 25 bp, Mus musculus
tccagcctggtgtgcttcctgcaag

SEQ ID NO: 472728 - DNA, 25 bp, Mus musculus
tccagccttggtcaggaagtcgaaa

SEQ ID NO: 472729 - DNA, 25 bp, Mus musculus
tccagcgagcatggcgagagtactt

SEQ ID NO: 472730 - DNA, 25 bp, Mus musculus
tccagcgaggaggaagccagtctcg

SEQ ID NO: 472731 - DNA, 25 bp, Mus musculus
tccagcggccgaatcatctgagagt

SEQ ID NO: 472732 - DNA, 25 bp, Mus musculus
tccagcgggctttgcatcacatcac

SEQ ID NO: 472733 - DNA, 25 bp, Mus musculus
tccagcgggtgaaagaagatgcaag

SEQ ID NO: 472734 - DNA, 25 bp, Mus musculus
tccagcgtaagaataacagtggtct

SEQ ID NO: 472735 - DNA, 25 bp, Mus musculus
tccagctactgttgcagttacgtag

SEQ ID NO: 472736 - DNA, 25 bp, Mus musculus
tccagctagctgaccaaaagtgctt

SEQ ID NO: 472737 - DNA, 25 bp, Mus musculus
tccagctaggttctttactgccggt

SEQ ID NO: 472738 - DNA, 25 bp, Mus musculus
tccagctatgacacgagaaggcatt

SEQ ID NO: 472739 - DNA, 25 bp, Mus musculus
tccagctccagatgaaccagggtag

SEQ ID NO: 472740 - DNA, 25 bp, Mus musculus
tccagctccgtagatccgggatctg

SEQ ID NO: 472741 - DNA, 25 bp, Mus musculus
tccagctcgctgtcgctgaaccgag

SEQ ID NO: 472742 - DNA, 25 bp, Mus musculus
tccagctcgggtaaggagtctcaag

SEQ ID NO: 472743 - DNA, 25 bp, Mus musculus
tccagctgacagtgagtatgcagtc

SEQ ID NO: 472744 - DNA, 25 bp, Mus musculus
tccagctgattgacgcgggtccttc

SEQ ID NO: 472745 - DNA, 25 bp, Mus musculus
tccagctgccccaaagaagcgtaag

SEQ ID NO: 472746 - DNA, 25 bp, Mus musculus
tccagctggaccacaggatttgcat

SEQ ID NO: 472747 - DNA, 25 bp, Mus musculus
tccagctggacgacgtcatcggtct

SEQ ID NO: 472748 - DNA, 25 bp, Mus musculus
tccagctggaggaattcagccacat

SEQ ID NO: 472749 - DNA, 25 bp, Mus musculus
tccagctggcagtgcattcaatccc

SEQ ID NO: 472750 - DNA, 25 bp, Mus musculus
tccagctggtagaggaagcctggct

SEQ ID NO: 472751 - DNA, 25 bp, Mus musculus
tccagctggttagagccgtggcctg

SEQ ID NO: 472752 - DNA, 25 bp, Mus musculus
tccagctgtctagtggctccttggg

SEQ ID NO: 472753 - DNA, 25 bp, Mus musculus
tccagcttcagagcaatgggcgtgc

SEQ ID NO: 472754 - DNA, 25 bp, Mus musculus
tccagcttcggaacaagagactctg

SEQ ID NO: 472755 - DNA, 25 bp, Mus musculus
tccagcttcggcagaggttttcagg

SEQ ID NO: 472756 - DNA, 25 bp, Mus musculus
tccagcttgagtgacgacagtgacc

SEQ ID NO: 472757 - DNA, 25 bp, Mus musculus
tccagcttgattgatgcggaggcaa

SEQ ID NO: 472758 - DNA, 25 bp, Mus musculus
tccagcttgccttcgggaaatgagc

SEQ ID NO: 472759 - DNA, 25 bp, Mus musculus
tccagcttggcgcacggtattccat

SEQ ID NO: 472760 - DNA, 25 bp, Mus musculus
tccagctttagttcgggaccgacga

SEQ ID NO: 472761 - DNA, 25 bp, Mus musculus
tccaggaaagcaaacatccgagaga

SEQ ID NO: 472762 - DNA, 25 bp, Mus musculus
tccaggaaatgagaaaacagcaccc

SEQ ID NO: 472763 - DNA, 25 bp, Mus musculus
tccaggaaattgagtggaacaccca

SEQ ID NO: 472764 - DNA, 25 bp, Mus musculus
tccaggaactaagaaaggctgcagc

SEQ ID NO: 472765 - DNA, 25 bp, Mus musculus
tccaggaaggaaccggacaagctaa

SEQ ID NO: 472766 - DNA, 25 bp, Mus musculus
tccaggaagtcacgcacagaagagc

SEQ ID NO: 472767 - DNA, 25 bp, Mus musculus
tccaggaatagaagcactgtgtgcc

SEQ ID NO: 472768 - DNA, 25 bp, Mus musculus
tccaggaatgttgtcttcgccacag

SEQ ID NO: 472769 - DNA, 25 bp, Mus musculus
tccaggacacaaggtagacattcag

SEQ ID NO: 472770 - DNA, 25 bp, Mus musculus
tccaggacaggtgaagataagtatc

SEQ ID NO: 472771 - DNA, 25 bp, Mus musculus
tccaggaccgggtgttaagccctag

SEQ ID NO: 472772 - DNA, 25 bp, Mus musculus
tccaggacgctgttggtgcacaaag

SEQ ID NO: 472773 - DNA, 25 bp, Mus musculus
tccaggacgtgtgccagactaaact

SEQ ID NO: 472774 - DNA, 25 bp, Mus musculus
tccaggagagaacgcagagatacaa

SEQ ID NO: 472775 - DNA, 25 bp, Mus musculus
tccaggagatgcgagatgccttcaa

SEQ ID NO: 472776 - DNA, 25 bp, Mus musculus
tccaggagatggtgtcactgacgag

SEQ ID NO: 472777 - DNA, 25 bp, Mus musculus
tccaggagccgaggaaaccatgtgc

SEQ ID NO: 472778 - DNA, 25 bp, Mus musculus
tccaggagcgacagagggataagct

SEQ ID NO: 472779 - DNA, 25 bp, Mus musculus
tccaggagcgatccaactgaacagc

SEQ ID NO: 472780 - DNA, 25 bp, Mus musculus
tccaggaggaccaaaaagagatgcc

SEQ ID NO: 472781 - DNA, 25 bp, Mus musculus
tccaggaggactagcccattttgag

SEQ ID NO: 472782 - DNA, 25 bp, Mus musculus
tccaggaggccaaagaagtgtacag

SEQ ID NO: 472783 - DNA, 25 bp, Mus musculus
tccaggaggccgaggaatggtacaa

SEQ ID NO: 472784 - DNA, 25 bp, Mus musculus
tccaggagtacaaggacacgtgctc

SEQ ID NO: 472785 - DNA, 25 bp, Mus musculus
tccaggagtgatgctgaagcgaagc

SEQ ID NO: 472786 - DNA, 25 bp, Mus musculus
tccaggatcagtgtacagaagagac

SEQ ID NO: 472787 - DNA, 25 bp, Mus musculus
tccaggatccctgaatttgtgactc

SEQ ID NO: 472788 - DNA, 25 bp, Mus musculus
tccaggatcctgctgaaagtgagcg

SEQ ID NO: 472789 - DNA, 25 bp, Mus musculus
tccaggatctgatgcgacgcaagga

SEQ ID NO: 472790 - DNA, 25 bp, Mus musculus
tccaggatgatcaagacaagcagtc

SEQ ID NO: 472791 - DNA, 25 bp, Mus musculus
tccaggatggcttccctagaacata

SEQ ID NO: 472792 - DNA, 25 bp, Mus musculus
tccaggattcggctcagaatgacgt

SEQ ID NO: 472793 - DNA, 25 bp, Mus musculus
tccaggcaagaacagggacctcaag

SEQ ID NO: 472794 - DNA, 25 bp, Mus musculus
tccaggcaagaactacagacgggtc

SEQ ID NO: 472795 - DNA, 25 bp, Mus musculus
tccaggcacccagttctgtggcagt

SEQ ID NO: 472796 - DNA, 25 bp, Mus musculus
tccaggcaggtcttcatcgtgcagg

SEQ ID NO: 472797 - DNA, 25 bp, Mus musculus
tccaggccaccatatctaaatgaga

SEQ ID NO: 472798 - DNA, 25 bp, Mus musculus
tccaggccaggaatgagggtcacct

SEQ ID NO: 472799 - DNA, 25 bp, Mus musculus
tccaggccccgatcatcaaagatgt

SEQ ID NO: 472800 - DNA, 25 bp, Mus musculus
tccaggccggaggttcatagatcct

SEQ ID NO: 472801 - DNA, 25 bp, Mus musculus
tccaggcctagctggccagggacaa

SEQ ID NO: 472802 - DNA, 25 bp, Mus musculus
tccaggccttagtctgcgatgcgct

SEQ ID NO: 472803 - DNA, 25 bp, Mus musculus
tccaggcgagaatgcggatccacaa

SEQ ID NO: 472804 - DNA, 25 bp, Mus musculus
tccaggcgccagagtgggaagtcat

SEQ ID NO: 472805 - DNA, 25 bp, Mus musculus
tccaggcgctcgatcttcagaatga

SEQ ID NO: 472806 - DNA, 25 bp, Mus musculus
tccaggcggctctcaactgaggttc

SEQ ID NO: 472807 - DNA, 25 bp, Mus musculus
tccaggctcgccagggtcagttgat

SEQ ID NO: 472808 - DNA, 25 bp, Mus musculus
tccaggctgcggttgtgcgcctcga

SEQ ID NO: 472809 - DNA, 25 bp, Mus musculus
tccaggcttatgtggaagctcaagc

SEQ ID NO: 472810 - DNA, 25 bp, Mus musculus
tccaggctttcggcggctgctcgga

SEQ ID NO: 472811 - DNA, 25 bp, Mus musculus
tccagggaaagcataattcggcgcc

SEQ ID NO: 472812 - DNA, 25 bp, Mus musculus
tccagggaaggaaacgtgcgttatc

SEQ ID NO: 472813 - DNA, 25 bp, Mus musculus
tccagggaaggcaaagatttgggcc

SEQ ID NO: 472814 - DNA, 25 bp, Mus musculus
tccagggaatatggccacagggtcc

SEQ ID NO: 472815 - DNA, 25 bp, Mus musculus
tccagggacgcatctcagtagagaa

SEQ ID NO: 472816 - DNA, 25 bp, Mus musculus
tccagggagatctgccatctctggt

SEQ ID NO: 472817 - DNA, 25 bp, Mus musculus
tccagggaggctgggcacatacagt

SEQ ID NO: 472818 - DNA, 25 bp, Mus musculus
tccagggagggtgtccaagtagcac

SEQ ID NO: 472819 - DNA, 25 bp, Mus musculus
tccagggcaactacgaggacacagt

SEQ ID NO: 472820 - DNA, 25 bp, Mus musculus
tccagggcatgggagaactcagttt

SEQ ID NO: 472821 - DNA, 25 bp, Mus musculus
tccagggccaaacctagatcagtag

SEQ ID NO: 472822 - DNA, 25 bp, Mus musculus
tccagggcctcaacaaaggattgac

SEQ ID NO: 472823 - DNA, 25 bp, Mus musculus
tccagggcctggtaactctgctgct

SEQ ID NO: 472824 - DNA, 25 bp, Mus musculus
tccagggccttaggagcctagagcc

SEQ ID NO: 472825 - DNA, 25 bp, Mus musculus
tccagggcggacttactgggaagct

SEQ ID NO: 472826 - DNA, 25 bp, Mus musculus
tccagggctctggttttattcatcc

SEQ ID NO: 472827 - DNA, 25 bp, Mus musculus
tccagggctgcaatttctcagagaa

SEQ ID NO: 472828 - DNA, 25 bp, Mus musculus
tccagggctggcacagatggcatct

SEQ ID NO: 472829 - DNA, 25 bp, Mus musculus
tccagggtacttcgatggccacgtg

SEQ ID NO: 472830 - DNA, 25 bp, Mus musculus
tccagggtagaaacggactgcagag

SEQ ID NO: 472831 - DNA, 25 bp, Mus musculus
tccagggtcaagagaagcaaatcag

SEQ ID NO: 472832 - DNA, 25 bp, Mus musculus
tccagggtcagagaactacaaggtt

SEQ ID NO: 472833 - DNA, 25 bp, Mus musculus
tccagggtccaaactagaatgccag

SEQ ID NO: 472834 - DNA, 25 bp, Mus musculus
tccagggtccagtggaggtgacatc

SEQ ID NO: 472835 - DNA, 25 bp, Mus musculus
tccagggtccttaatggcaaccagc

SEQ ID NO: 472836 - DNA, 25 bp, Mus musculus
tccagggtgcaacgctgccctgcag

SEQ ID NO: 472837 - DNA, 25 bp, Mus musculus
tccaggtaaaggaaagccgcatccg

SEQ ID NO: 472838 - DNA, 25 bp, Mus musculus
tccaggtaagcctgggagcagctct

SEQ ID NO: 472839 - DNA, 25 bp, Mus musculus
tccaggtcaggaaagtacagcagtg

SEQ ID NO: 472840 - DNA, 25 bp, Mus musculus
tccaggtccatggtgttcacaggag

SEQ ID NO: 472841 - DNA, 25 bp, Mus musculus
tccaggtccctaaccaggagttcgg

SEQ ID NO: 472842 - DNA, 25 bp, Mus musculus
tccaggtccgtcagcgaagttgcag

SEQ ID NO: 472843 - DNA, 25 bp, Mus musculus
tccaggtctaattacaggatacaag

SEQ ID NO: 472844 - DNA, 25 bp, Mus musculus
tccaggtctaggattacaagagtgc

SEQ ID NO: 472845 - DNA, 25 bp, Mus musculus
tccaggtctctcttcggacaaagca

SEQ ID NO: 472846 - DNA, 25 bp, Mus musculus
tccaggtgagcacttcaggcattac

SEQ ID NO: 472847 - DNA, 25 bp, Mus musculus
tccaggtgcagctggcgatgagccc

SEQ ID NO: 472848 - DNA, 25 bp, Mus musculus
tccaggtgccatcacagcttgcttt

SEQ ID NO: 472849 - DNA, 25 bp, Mus musculus
tccaggtgtaaagtccttttttgag

SEQ ID NO: 472850 - DNA, 25 bp, Mus musculus
tccaggtgtaacttggtggccagaa

SEQ ID NO: 472851 - DNA, 25 bp, Mus musculus
tccaggttacagcaggcatggtgtt

SEQ ID NO: 472852 - DNA, 25 bp, Mus musculus
tccaggttcctgctgtgattgactt

SEQ ID NO: 472853 - DNA, 25 bp, Mus musculus
tccaggttctccgtatctgtggcac

SEQ ID NO: 472854 - DNA, 25 bp, Mus musculus
tccaggttgctgtgaagtgagcact

SEQ ID NO: 472855 - DNA, 25 bp, Mus musculus
tccaggttggccgtactcaggagca

SEQ ID NO: 472856 - DNA, 25 bp, Mus musculus
tccaggttggttgcaggtggccaga

SEQ ID NO: 472857 - DNA, 25 bp, Mus musculus
tccagtaagacaacagaggcccaga

SEQ ID NO: 472858 - DNA, 25 bp, Mus musculus
tccagtacattgagcgcctacaggc

SEQ ID NO: 472859 - DNA, 25 bp, Mus musculus
tccagtacctggagatgagacccac

SEQ ID NO: 472860 - DNA, 25 bp, Mus musculus
tccagtagacaagccctgaagcctg

SEQ ID NO: 472861 - DNA, 25 bp, Mus musculus
tccagtatactgagggtcaaggcag

SEQ ID NO: 472862 - DNA, 25 bp, Mus musculus
tccagtataggaaacagagcatgcc

SEQ ID NO: 472863 - DNA, 25 bp, Mus musculus
tccagtatgaagtgtcagcggtcca

SEQ ID NO: 472864 - DNA, 25 bp, Mus musculus
tccagtatgagagtttgcaaatgcc

SEQ ID NO: 472865 - DNA, 25 bp, Mus musculus
tccagtatggtaccgggagcctgac

SEQ ID NO: 472866 - DNA, 25 bp, Mus musculus
tccagtcactcgtctgaggaaacag

SEQ ID NO: 472867 - DNA, 25 bp, Mus musculus
tccagtcagagcgtacagacctcgg

SEQ ID NO: 472868 - DNA, 25 bp, Mus musculus
tccagtcatccggacattggtcgtg

SEQ ID NO: 472869 - DNA, 25 bp, Mus musculus
tccagtccaacttggcctgagagaa

SEQ ID NO: 472870 - DNA, 25 bp, Mus musculus
tccagtccaccaagaaagtaatttc

SEQ ID NO: 472871 - DNA, 25 bp, Mus musculus
tccagtccagatgcacacagaggct

SEQ ID NO: 472872 - DNA, 25 bp, Mus musculus
tccagtccaggcaggaagaagtttc

SEQ ID NO: 472873 - DNA, 25 bp, Mus musculus
tccagtcctcctgaagtggctacag

SEQ ID NO: 472874 - DNA, 25 bp, Mus musculus
tccagtcctgccattgctttttgag

SEQ ID NO: 472875 - DNA, 25 bp, Mus musculus
tccagtccttgctgggaatggcaga

SEQ ID NO: 472876 - DNA, 25 bp, Mus musculus
tccagtcggctggtgtaaagagcac

SEQ ID NO: 472877 - DNA, 25 bp, Mus musculus
tccagtctcacctgcttcagtgaag

SEQ ID NO: 472878 - DNA, 25 bp, Mus musculus
tccagtctcttgttgtcctctcttt

SEQ ID NO: 472879 - DNA, 25 bp, Mus musculus
tccagtctgtatggttacgcctaaa

SEQ ID NO: 472880 - DNA, 25 bp, Mus musculus
tccagtcttccaggattcatggtgc

SEQ ID NO: 472881 - DNA, 25 bp, Mus musculus
tccagtgaaaggctggactccttgg

SEQ ID NO: 472882 - DNA, 25 bp, Mus musculus
tccagtgaatgggtctcagatgaca

SEQ ID NO: 472883 - DNA, 25 bp, Mus musculus
tccagtgagagagaggtctgaacaa

SEQ ID NO: 472884 - DNA, 25 bp, Mus musculus
tccagtgagcagtgtagcacttgcc

SEQ ID NO: 472885 - DNA, 25 bp, Mus musculus
tccagtgagtaagagaagagctgcc

SEQ ID NO: 472886 - DNA, 25 bp, Mus musculus
tccagtgatgccaggaatgccgcct

SEQ ID NO: 472887 - DNA, 25 bp, Mus musculus
tccagtgatttccatggtagctatc

SEQ ID NO: 472888 - DNA, 25 bp, Mus musculus
tccagtgccaggaggttttactatg

SEQ ID NO: 472889 - DNA, 25 bp, Mus musculus
tccagtgcctgggtccggagagttc

SEQ ID NO: 472890 - DNA, 25 bp, Mus musculus
tccagtgcttggtcaaggattcacg

SEQ ID NO: 472891 - DNA, 25 bp, Mus musculus
tccagtggaaatctggccgccaaac

SEQ ID NO: 472892 - DNA, 25 bp, Mus musculus
tccagtggacatatatgtggtcaac

SEQ ID NO: 472893 - DNA, 25 bp, Mus musculus
tccagtggactgagtcagcgttacc

SEQ ID NO: 472894 - DNA, 25 bp, Mus musculus
tccagtggagcaagggatgaagccc

SEQ ID NO: 472895 - DNA, 25 bp, Mus musculus
tccagtggatttcggagcatgtctc

SEQ ID NO: 472896 - DNA, 25 bp, Mus musculus
tccagtggcaaagagggatggtccc

SEQ ID NO: 472897 - DNA, 25 bp, Mus musculus
tccagtggcatggtggagaacctgt

SEQ ID NO: 472898 - DNA, 25 bp, Mus musculus
tccagtggctcccttgcacaagtga

SEQ ID NO: 472899 - DNA, 25 bp, Mus musculus
tccagtggctgacacatgataggcc

SEQ ID NO: 472900 - DNA, 25 bp, Mus musculus
tccagtgggcattcgggctgctgct

SEQ ID NO: 472901 - DNA, 25 bp, Mus musculus
tccagtgtacctatgggaaccacag

SEQ ID NO: 472902 - DNA, 25 bp, Mus musculus
tccagtgtccaggtcaagttgtaca

SEQ ID NO: 472903 - DNA, 25 bp, Mus musculus
tccagtgtctggtgctaggtatacc

SEQ ID NO: 472904 - DNA, 25 bp, Mus musculus
tccagtgtcttccacagttttgctc

SEQ ID NO: 472905 - DNA, 25 bp, Mus musculus
tccagtgtgtcagtaaatcacccgt

SEQ ID NO: 472906 - DNA, 25 bp, Mus musculus
tccagttacccgtgataaagcctat

SEQ ID NO: 472907 - DNA, 25 bp, Mus musculus
tccagttagactgtagtcaggtggc

SEQ ID NO: 472908 - DNA, 25 bp, Mus musculus
tccagttcaaggtccacggaggcct

SEQ ID NO: 472909 - DNA, 25 bp, Mus musculus
tccagttcagagtcggaagaccagt

SEQ ID NO: 472910 - DNA, 25 bp, Mus musculus
tccagttcaggagtatgcccgggat

SEQ ID NO: 472911 - DNA, 25 bp, Mus musculus
tccagttccagagtatctgacgcct

SEQ ID NO: 472912 - DNA, 25 bp, Mus musculus
tccagttccctttaggcagagtctg

SEQ ID NO: 472913 - DNA, 25 bp, Mus musculus
tccagttccggaacagtacctcgta

SEQ ID NO: 472914 - DNA, 25 bp, Mus musculus
tccagttctgtgcaggagaagccct

SEQ ID NO: 472915 - DNA, 25 bp, Mus musculus
tccagttgcacttccgcgcgatgga

SEQ ID NO: 472916 - DNA, 25 bp, Mus musculus
tccagttgcagtccaaaagcgtgtg

SEQ ID NO: 472917 - DNA, 25 bp, Mus musculus
tccagttggactccaggaggtccag

SEQ ID NO: 472918 - DNA, 25 bp, Mus musculus
tccagttggtgaaggcgccagattc

SEQ ID NO: 472919 - DNA, 25 bp, Mus musculus
tccagttgtcacacattctggagca

SEQ ID NO: 472920 - DNA, 25 bp, Mus musculus
tccagtttcaccagaggctgaggct

SEQ ID NO: 472921 - DNA, 25 bp, Mus musculus
tccagtttgccggagaaagacggtg

SEQ ID NO: 472922 - DNA, 25 bp, Mus musculus
tccagtttgggatccgtgcatctaa

SEQ ID NO: 472923 - DNA, 25 bp, Mus musculus
tccagtttggtagtgacagctcgca

SEQ ID NO: 472924 - DNA, 25 bp, Mus musculus
tccagttttgatccggagtacatca

SEQ ID NO: 472925 - DNA, 25 bp, Mus musculus
tccataagaaagcacaccaagcaag

SEQ ID NO: 472926 - DNA, 25 bp, Mus musculus
tccataagacatgggaggaggcccg

SEQ ID NO: 472927 - DNA, 25 bp, Mus musculus
tccataagagtagcatagggcctcc

SEQ ID NO: 472928 - DNA, 25 bp, Mus musculus
tccataagatcatcgcgggcagcgt

SEQ ID NO: 472929 - DNA, 25 bp, Mus musculus
tccataagcagaggcagagtaggca

SEQ ID NO: 472930 - DNA, 25 bp, Mus musculus
tccataaggtggtaatagcagaagc

SEQ ID NO: 472931 - DNA, 25 bp, Mus musculus
tccataatgagagccgatcctctct

SEQ ID NO: 472932 - DNA, 25 bp, Mus musculus
tccataatggcctggacagagggtg

SEQ ID NO: 472933 - DNA, 25 bp, Mus musculus
tccataattactgagcaacccagtg

SEQ ID NO: 472934 - DNA, 25 bp, Mus musculus
tccataccggactgagctgtatcgc

SEQ ID NO: 472935 - DNA, 25 bp, Mus musculus
tccatacctggaaaaacatcgtggg

SEQ ID NO: 472936 - DNA, 25 bp, Mus musculus
tccatactgaaatttgaggccaagg

SEQ ID NO: 472937 - DNA, 25 bp, Mus musculus
tccatactgcagtgtagggctcaca

SEQ ID NO: 472938 - DNA, 25 bp, Mus musculus
tccatagaagaatagagtgtaacac

SEQ ID NO: 472939 - DNA, 25 bp, Mus musculus
tccatagacactgctggcttctcgg

SEQ ID NO: 472940 - DNA, 25 bp, Mus musculus
tccatagagcagagaaaagcgaccg

SEQ ID NO: 472941 - DNA, 25 bp, Mus musculus
tccatagcgagtggtctggctcacc

SEQ ID NO: 472942 - DNA, 25 bp, Mus musculus
tccataggaccttgactaaaaactc

SEQ ID NO: 472943 - DNA, 25 bp, Mus musculus
tccatagtctatgctacggagaaga

SEQ ID NO: 472944 - DNA, 25 bp, Mus musculus
tccatagtggacaattgccggcagc

SEQ ID NO: 472945 - DNA, 25 bp, Mus musculus
tccatagttggcgatcggtgagacg

SEQ ID NO: 472946 - DNA, 25 bp, Mus musculus
tccatatcgatgacgggccagtgag

SEQ ID NO: 472947 - DNA, 25 bp, Mus musculus
tccatatcgggcagccacagggaac

SEQ ID NO: 472948 - DNA, 25 bp, Mus musculus
tccatatgtgcgacggaaggagccc

SEQ ID NO: 472949 - DNA, 25 bp, Mus musculus
tccatattccaaacttgataggtcg

SEQ ID NO: 472950 - DNA, 25 bp, Mus musculus
tccatcaacgaggtagggcagtcct

SEQ ID NO: 472951 - DNA, 25 bp, Mus musculus
tccatcaaggagacagcaaactgct

SEQ ID NO: 472952 - DNA, 25 bp, Mus musculus
tccatcaagtgtacaatgagattgc

SEQ ID NO: 472953 - DNA, 25 bp, Mus musculus
tccatcagagaggagtcaaagtcta

SEQ ID NO: 472954 - DNA, 25 bp, Mus musculus
tccatcagagagtggttcgctagcc

SEQ ID NO: 472955 - DNA, 25 bp, Mus musculus
tccatcagagcgtcggttttaccag

SEQ ID NO: 472956 - DNA, 25 bp, Mus musculus
tccatcagctggtactaggtgtctt

SEQ ID NO: 472957 - DNA, 25 bp, Mus musculus
tccatcagtaagtttccatcccgga

SEQ ID NO: 472958 - DNA, 25 bp, Mus musculus
tccatcagttcacgagcaaggagcc

SEQ ID NO: 472959 - DNA, 25 bp, Mus musculus
tccatcagttggttgagaacacgga

SEQ ID NO: 472960 - DNA, 25 bp, Mus musculus
tccatcatcccacgacaaagctggt

SEQ ID NO: 472961 - DNA, 25 bp, Mus musculus
tccatcatcgatgcgggtgcctgca

SEQ ID NO: 472962 - DNA, 25 bp, Mus musculus
tccatcatgagacacacctcctggg

SEQ ID NO: 472963 - DNA, 25 bp, Mus musculus
tccatcattttagggaatggtaccc

SEQ ID NO: 472964 - DNA, 25 bp, Mus musculus
tccatccacatcatttgccgagggc

SEQ ID NO: 472965 - DNA, 25 bp, Mus musculus
tccatccagtgcagtgagtccctag

SEQ ID NO: 472966 - DNA, 25 bp, Mus musculus
tccatccgtcatcccattcggtagt

SEQ ID NO: 472967 - DNA, 25 bp, Mus musculus
tccatcctaggaggatccgattctg

SEQ ID NO: 472968 - DNA, 25 bp, Mus musculus
tccatcgacatgtggtcagccggct

SEQ ID NO: 472969 - DNA, 25 bp, Mus musculus
tccatcgagatcctagaagtcaacg

SEQ ID NO: 472970 - DNA, 25 bp, Mus musculus
tccatcgccgtggtctcggcagttg

SEQ ID NO: 472971 - DNA, 25 bp, Mus musculus
tccatcggtgccaagacaagacagg

SEQ ID NO: 472972 - DNA, 25 bp, Mus musculus
tccatcgtgaggtggccagaacagg

SEQ ID NO: 472973 - DNA, 25 bp, Mus musculus
tccatcgttggtaccggcaatggcc

SEQ ID NO: 472974 - DNA, 25 bp, Mus musculus
tccatctattgcatgagcttccagg

SEQ ID NO: 472975 - DNA, 25 bp, Mus musculus
tccatctccaaaggtgggcgccaaa

SEQ ID NO: 472976 - DNA, 25 bp, Mus musculus
tccatctcgtccatgggagctaaat

SEQ ID NO: 472977 - DNA, 25 bp, Mus musculus
tccatctgaaagcttgcaagccagc

SEQ ID NO: 472978 - DNA, 25 bp, Mus musculus
tccatcttaagggaactggctctgt

SEQ ID NO: 472979 - DNA, 25 bp, Mus musculus
tccatcttgactggtgctcactggc

SEQ ID NO: 472980 - DNA, 25 bp, Mus musculus
tccatcttgagaaagggaccctgag

SEQ ID NO: 472981 - DNA, 25 bp, Mus musculus
tccatgaagcagaccaagattacag

SEQ ID NO: 472982 - DNA, 25 bp, Mus musculus
tccatgaagcgtaagagcgagcggc

SEQ ID NO: 472983 - DNA, 25 bp, Mus musculus
tccatgaaggaaaggcaggcatgct

SEQ ID NO: 472984 - DNA, 25 bp, Mus musculus
tccatgaataccaggaaagcaccat

SEQ ID NO: 472985 - DNA, 25 bp, Mus musculus
tccatgaattgagatgatttacaca

SEQ ID NO: 472986 - DNA, 25 bp, Mus musculus
tccatgaggagctctgagggccaga

SEQ ID NO: 472987 - DNA, 25 bp, Mus musculus
tccatgaggtacagcgtcgaatccg

SEQ ID NO: 472988 - DNA, 25 bp, Mus musculus
tccatgagtattagagtgtgagtcc

SEQ ID NO: 472989 - DNA, 25 bp, Mus musculus
tccatgagtgcaggaaactttgagg

SEQ ID NO: 472990 - DNA, 25 bp, Mus musculus
tccatgatcgatgagggcgagaccg

SEQ ID NO: 472991 - DNA, 25 bp, Mus musculus
tccatgatgatgcagcccggtctct

SEQ ID NO: 472992 - DNA, 25 bp, Mus musculus
tccatgatgcagtgaaggcagcgcg

SEQ ID NO: 472993 - DNA, 25 bp, Mus musculus
tccatgatgcataacagaagtcagt

SEQ ID NO: 472994 - DNA, 25 bp, Mus musculus
tccatgatggcctgagatccctgag

SEQ ID NO: 472995 - DNA, 25 bp, Mus musculus
tccatgatgggtggcaaagacttcg

SEQ ID NO: 472996 - DNA, 25 bp, Mus musculus
tccatgatttagactccgggcagaa

SEQ ID NO: 472997 - DNA, 25 bp, Mus musculus
tccatgcaaagcctaagcctgcggg

SEQ ID NO: 472998 - DNA, 25 bp, Mus musculus
tccatgcagagtttgcagctgagcg

SEQ ID NO: 472999 - DNA, 25 bp, Mus musculus
tccatgcagcgctctcagagccgga

SEQ ID NO: 473000 - DNA, 25 bp, Mus musculus
tccatgcaggagtagtgtcaaacgt

SEQ ID NO: 473001 - DNA, 25 bp, Mus musculus
tccatgcaggagtccagacggaagc

SEQ ID NO: 473002 - DNA, 25 bp, Mus musculus
tccatgccgtggaggaagtcagcct

SEQ ID NO: 473003 - DNA, 25 bp, Mus musculus
tccatgcggaagaaggttggcctaa

SEQ ID NO: 473004 - DNA, 25 bp, Mus musculus
tccatgcgggtgcttctgtgaacca

SEQ ID NO: 473005 - DNA, 25 bp, Mus musculus
tccatgctggatacagcttaaagaa

SEQ ID NO: 473006 - DNA, 25 bp, Mus musculus
tccatgctgtcaagcacgacttgca

SEQ ID NO: 473007 - DNA, 25 bp, Mus musculus
tccatgcttaggatttgggccctgg

SEQ ID NO: 473008 - DNA, 25 bp, Mus musculus
tccatggacatgctagtgctagagg

SEQ ID NO: 473009 - DNA, 25 bp, Mus musculus
tccatggacatttaaggaggcctcc

SEQ ID NO: 473010 - DNA, 25 bp, Mus musculus
tccatggacgtgatttctgcccggg

SEQ ID NO: 473011 - DNA, 25 bp, Mus musculus
tccatggacttgattgaccttatct

SEQ ID NO: 473012 - DNA, 25 bp, Mus musculus
tccatggagacaactgtcagtttcg

SEQ ID NO: 473013 - DNA, 25 bp, Mus musculus
tccatggagagactcaagccagtag

SEQ ID NO: 473014 - DNA, 25 bp, Mus musculus
tccatggagcaaaccgaaggcgtga

SEQ ID NO: 473015 - DNA, 25 bp, Mus musculus
tccatggatcccaagagtggtgcag

SEQ ID NO: 473016 - DNA, 25 bp, Mus musculus
tccatggcaacagaggctcaggctt

SEQ ID NO: 473017 - DNA, 25 bp, Mus musculus
tccatggcactccaggtgcagctgg

SEQ ID NO: 473018 - DNA, 25 bp, Mus musculus
tccatggcccagaagtagaagagga

SEQ ID NO: 473019 - DNA, 25 bp, Mus musculus
tccatggcgggtaaccttaagaagc

SEQ ID NO: 473020 - DNA, 25 bp, Mus musculus
tccatgggaactagcacaggagcga

SEQ ID NO: 473021 - DNA, 25 bp, Mus musculus
tccatgggaggcagtcgtccttctt

SEQ ID NO: 473022 - DNA, 25 bp, Mus musculus
tccatgggctttagggaaaaactgg

SEQ ID NO: 473023 - DNA, 25 bp, Mus musculus
tccatgggtgcatccaagtatcgct

SEQ ID NO: 473024 - DNA, 25 bp, Mus musculus
tccatggtgctgaggtttgctaaca

SEQ ID NO: 473025 - DNA, 25 bp, Mus musculus
tccatggtggctgatgtgcatcgca

SEQ ID NO: 473026 - DNA, 25 bp, Mus musculus
tccatggtgtggaggtgatgcccct

SEQ ID NO: 473027 - DNA, 25 bp, Mus musculus
tccatgtacaaacgctgtgcctaag

SEQ ID NO: 473028 - DNA, 25 bp, Mus musculus
tccatgtatagtggcttaacaagct

SEQ ID NO: 473029 - DNA, 25 bp, Mus musculus
tccatgtatcgacccaaggaagccc

SEQ ID NO: 473030 - DNA, 25 bp, Mus musculus
tccatgtcagaacggaggtacctgc

SEQ ID NO: 473031 - DNA, 25 bp, Mus musculus
tccatgtcgatgtctgagccctgag

SEQ ID NO: 473032 - DNA, 25 bp, Mus musculus
tccatgtgaccctctcgggtgggac

SEQ ID NO: 473033 - DNA, 25 bp, Mus musculus
tccatgtgagcctgaggaccctgct

SEQ ID NO: 473034 - DNA, 25 bp, Mus musculus
tccatgtggccgaggtttctagtgc

SEQ ID NO: 473035 - DNA, 25 bp, Mus musculus
tccatgtgggtcaagccggagttca

SEQ ID NO: 473036 - DNA, 25 bp, Mus musculus
tccatgtgtcatgatgcatctgcca

SEQ ID NO: 473037 - DNA, 25 bp, Mus musculus
tccatgttcatagtggctttccaac

SEQ ID NO: 473038 - DNA, 25 bp, Mus musculus
tccatgttgcacagcgagggtcgtc

SEQ ID NO: 473039 - DNA, 25 bp, Mus musculus
tccatgttggcgctgagaagcaaac

SEQ ID NO: 473040 - DNA, 25 bp, Mus musculus
tccatgtttagaaccagaagtccta

SEQ ID NO: 473041 - DNA, 25 bp, Mus musculus
tccattaaggcacacgagccctgct

SEQ ID NO: 473042 - DNA, 25 bp, Mus musculus
tccattaattggagacacacacggg

SEQ ID NO: 473043 - DNA, 25 bp, Mus musculus
tccattactaatgccaagaagaggg

SEQ ID NO: 473044 - DNA, 25 bp, Mus musculus
tccattagaggcacgtgataagggc

SEQ ID NO: 473045 - DNA, 25 bp, Mus musculus
tccattagagtagagggaggcacct

SEQ ID NO: 473046 - DNA, 25 bp, Mus musculus
tccattagctttgcgggcctttcca

SEQ ID NO: 473047 - DNA, 25 bp, Mus musculus
tccattaggcaaaatagagagagcg

SEQ ID NO: 473048 - DNA, 25 bp, Mus musculus
tccattatggacctttccagggaac

SEQ ID NO: 473049 - DNA, 25 bp, Mus musculus
tccattatggtagcctatgacgccc

SEQ ID NO: 473050 - DNA, 25 bp, Mus musculus
tccattcaggaagtgacggtcgagt

SEQ ID NO: 473051 - DNA, 25 bp, Mus musculus
tccattcccaagctaggcttccggt

SEQ ID NO: 473052 - DNA, 25 bp, Mus musculus
tccattcccagttgaaagaacagag

SEQ ID NO: 473053 - DNA, 25 bp, Mus musculus
tccattccgccatggatggcagcca

SEQ ID NO: 473054 - DNA, 25 bp, Mus musculus
tccattcctatgacctcaggaactc

SEQ ID NO: 473055 - DNA, 25 bp, Mus musculus
tccattcgaaggtgtgcagcgggtc

SEQ ID NO: 473056 - DNA, 25 bp, Mus musculus
tccattctgcagacattaagagggc

SEQ ID NO: 473057 - DNA, 25 bp, Mus musculus
tccattctggaaagcagcgtttgca

SEQ ID NO: 473058 - DNA, 25 bp, Mus musculus
tccattgaaataggccatgaagtta

SEQ ID NO: 473059 - DNA, 25 bp, Mus musculus
tccattgactgaactacgtccccaa

SEQ ID NO: 473060 - DNA, 25 bp, Mus musculus
tccattgagtcggaatgaagttgtc

SEQ ID NO: 473061 - DNA, 25 bp, Mus musculus
tccattgcacaagaagaatcagaca

SEQ ID NO: 473062 - DNA, 25 bp, Mus musculus
tccattggcgggactggacttaccg

SEQ ID NO: 473063 - DNA, 25 bp, Mus musculus
tccattgggaacagttgagggcctc

SEQ ID NO: 473064 - DNA, 25 bp, Mus musculus
tccattgggaagatcaagggccgct

SEQ ID NO: 473065 - DNA, 25 bp, Mus musculus
tccattgggtccgtaaagactgctc

SEQ ID NO: 473066 - DNA, 25 bp, Mus musculus
tccattgtggagtcaggtgtcttgc

SEQ ID NO: 473067 - DNA, 25 bp, Mus musculus
tccattgtggtatcaacctgccggg

SEQ ID NO: 473068 - DNA, 25 bp, Mus musculus
tccatttcagagagagtgatccgag

SEQ ID NO: 473069 - DNA, 25 bp, Mus musculus
tccatttcagggtagcagccagcct

SEQ ID NO: 473070 - DNA, 25 bp, Mus musculus
tccatttgagccctggacgacgaag

SEQ ID NO: 473071 - DNA, 25 bp, Mus musculus
tccatttgtaaactcccggattgcg

SEQ ID NO: 473072 - DNA, 25 bp, Mus musculus
tccattttatgttggaacccaagtt

SEQ ID NO: 473073 - DNA, 25 bp, Mus musculus
tccattttcactccgcagagaagtt

SEQ ID NO: 473074 - DNA, 25 bp, Mus musculus
tccattttgacagtgccagcagaag

SEQ ID NO: 473075 - DNA, 25 bp, Mus musculus
tccattttgccctcgcagccaaggg

SEQ ID NO: 473076 - DNA, 25 bp, Mus musculus
tccattttttggatgtcgtcggcga

SEQ ID NO: 473077 - DNA, 25 bp, Mus musculus
tcccaaaaacaaacggtccagcgca

SEQ ID NO: 473078 - DNA, 25 bp, Mus musculus
tcccaaaacaggactctcagctcgg

SEQ ID NO: 473079 - DNA, 25 bp, Mus musculus
tcccaaacgtagtccaaagtctggt

SEQ ID NO: 473080 - DNA, 25 bp, Mus musculus
tcccaaagctggcaagtgagtcctc

SEQ ID NO: 473081 - DNA, 25 bp, Mus musculus
tcccaaaggagaaaagctgtccgtc

SEQ ID NO: 473082 - DNA, 25 bp, Mus musculus
tcccaaagggtacagcacagcagta

SEQ ID NO: 473083 - DNA, 25 bp, Mus musculus
tcccaaagtctaaagtcgatccgcg

SEQ ID NO: 473084 - DNA, 25 bp, Mus musculus
tcccaaagtttcctttacaggcgag

SEQ ID NO: 473085 - DNA, 25 bp, Mus musculus
tcccaaatggaaagggtgacactct

SEQ ID NO: 473086 - DNA, 25 bp, Mus musculus
tcccaacaggaatcagataatgacc

SEQ ID NO: 473087 - DNA, 25 bp, Mus musculus
tcccaacagtatcagtgccagagct

SEQ ID NO: 473088 - DNA, 25 bp, Mus musculus
tcccaacgacagacttgagcagtgc

SEQ ID NO: 473089 - DNA, 25 bp, Mus musculus
tcccaacgggaagtctgaagacagc

SEQ ID NO: 473090 - DNA, 25 bp, Mus musculus
tcccaactaccctggacaaaggatg

SEQ ID NO: 473091 - DNA, 25 bp, Mus musculus
tcccaactggatcggaggaggctat

SEQ ID NO: 473092 - DNA, 25 bp, Mus musculus
tcccaactgggtggtgctcaatcag

SEQ ID NO: 473093 - DNA, 25 bp, Mus musculus
tcccaagaaggaagctacggcctgt

SEQ ID NO: 473094 - DNA, 25 bp, Mus musculus
tcccaagagcagagctaaatccggc

SEQ ID NO: 473095 - DNA, 25 bp, Mus musculus
tcccaagaggcatgagacactcaag

SEQ ID NO: 473096 - DNA, 25 bp, Mus musculus
tcccaagatgcacacgtaacaagcg

SEQ ID NO: 473097 - DNA, 25 bp, Mus musculus
tcccaagcaaagttaggcccttcct

SEQ ID NO: 473098 - DNA, 25 bp, Mus musculus
tcccaagcagccagcctaggttaga

SEQ ID NO: 473099 - DNA, 25 bp, Mus musculus
tcccaagccatcagagacatgcatg

SEQ ID NO: 473100 - DNA, 25 bp, Mus musculus
tcccaagccttgagtcacagagagt

SEQ ID NO: 473101 - DNA, 25 bp, Mus musculus
tcccaagcgaaagtaatctgtcggc

SEQ ID NO: 473102 - DNA, 25 bp, Mus musculus
tcccaagctttccaataggatctga

SEQ ID NO: 473103 - DNA, 25 bp, Mus musculus
tcccaaggcatgcaaggtctgtgag

SEQ ID NO: 473104 - DNA, 25 bp, Mus musculus
tcccaaggccttgaacgaagtggca

SEQ ID NO: 473105 - DNA, 25 bp, Mus musculus
tcccaaggcttccatagaggagact

SEQ ID NO: 473106 - DNA, 25 bp, Mus musculus
tcccaagggagagcaaaaatacagt

SEQ ID NO: 473107 - DNA, 25 bp, Mus musculus
tcccaagggctctggatgctattgt

SEQ ID NO: 473108 - DNA, 25 bp, Mus musculus
tcccaaggtatctaggcgggcatcg

SEQ ID NO: 473109 - DNA, 25 bp, Mus musculus
tcccaagtagagagcaaaagtgccc

SEQ ID NO: 473110 - DNA, 25 bp, Mus musculus
tcccaagtatatgagttgtatgcac

SEQ ID NO: 473111 - DNA, 25 bp, Mus musculus
tcccaagtctcccatggaaagttgg

SEQ ID NO: 473112 - DNA, 25 bp, Mus musculus
tcccaagtgctcagcgtggagcggt

SEQ ID NO: 473113 - DNA, 25 bp, Mus musculus
tcccaagtgctctaatatgccagaa

SEQ ID NO: 473114 - DNA, 25 bp, Mus musculus
tcccaagtgggtgttacatgtttgc

SEQ ID NO: 473115 - DNA, 25 bp, Mus musculus
tcccaagtgttgtatagaccatgcc

SEQ ID NO: 473116 - DNA, 25 bp, Mus musculus
tcccaagttcatctgcccgggttgt

SEQ ID NO: 473117 - DNA, 25 bp, Mus musculus
tcccaatcagggaggcagcatcatt

SEQ ID NO: 473118 - DNA, 25 bp, Mus musculus
tcccaatgctggtgacacgacagtc

SEQ ID NO: 473119 - DNA, 25 bp, Mus musculus
tcccacaatgagtgagccggaggtc

SEQ ID NO: 473120 - DNA, 25 bp, Mus musculus
tcccacacagcctatgtaaatagtg

SEQ ID NO: 473121 - DNA, 25 bp, Mus musculus
tcccacacttgtaaggctgaatcag

SEQ ID NO: 473122 - DNA, 25 bp, Mus musculus
tcccacagacagagcagtgacacct

SEQ ID NO: 473123 - DNA, 25 bp, Mus musculus
tcccacagaccggaggtaggctgac

SEQ ID NO: 473124 - DNA, 25 bp, Mus musculus
tcccacagagtttggatgccttgct

SEQ ID NO: 473125 - DNA, 25 bp, Mus musculus
tcccacaggacacggaagcctggtc

SEQ ID NO: 473126 - DNA, 25 bp, Mus musculus
tcccacatccgtggccagagggaag

SEQ ID NO: 473127 - DNA, 25 bp, Mus musculus
tcccaccgccctaggttggaagtga

SEQ ID NO: 473128 - DNA, 25 bp, Mus musculus
tcccaccgtggttttaggagcacat

SEQ ID NO: 473129 - DNA, 25 bp, Mus musculus
tcccacctcgtcaagacggctgtct

SEQ ID NO: 473130 - DNA, 25 bp, Mus musculus
tcccacggtgatcggcgtttcggaa

SEQ ID NO: 473131 - DNA, 25 bp, Mus musculus
tcccacgtggtgctaaaggagcgtc

SEQ ID NO: 473132 - DNA, 25 bp, Mus musculus
tcccactcatcatccaagggcggtg

SEQ ID NO: 473133 - DNA, 25 bp, Mus musculus
tcccactctccttgacaagtgcaag

SEQ ID NO: 473134 - DNA, 25 bp, Mus musculus
tcccactgaagagcaagagcagggt

SEQ ID NO: 473135 - DNA, 25 bp, Mus musculus
tcccactggacaaactaggcctctg

SEQ ID NO: 473136 - DNA, 25 bp, Mus musculus
tcccactggagcaggtatgttctca

SEQ ID NO: 473137 - DNA, 25 bp, Mus musculus
tcccactgggtgatgcttttgctgc

SEQ ID NO: 473138 - DNA, 25 bp, Mus musculus
tcccagaagccagtaaagagaccag

SEQ ID NO: 473139 - DNA, 25 bp, Mus musculus
tcccagaagctcaaacggaaggcgg

SEQ ID NO: 473140 - DNA, 25 bp, Mus musculus
tcccagaatgcaaagctaagggctg

SEQ ID NO: 473141 - DNA, 25 bp, Mus musculus
tcccagacctaaaaccacagcaagt

SEQ ID NO: 473142 - DNA, 25 bp, Mus musculus
tcccagactcttgcaggaataagcg

SEQ ID NO: 473143 - DNA, 25 bp, Mus musculus
tcccagagaagaacccctgttgcaa

SEQ ID NO: 473144 - DNA, 25 bp, Mus musculus
tcccagagagacgtaatgcagaggc

SEQ ID NO: 473145 - DNA, 25 bp, Mus musculus
tcccagagctctgctgtgaacatgg

SEQ ID NO: 473146 - DNA, 25 bp, Mus musculus
tcccagaggaaggaactcatatttc

SEQ ID NO: 473147 - DNA, 25 bp, Mus musculus
tcccagaggatgatacagggcgcgc

SEQ ID NO: 473148 - DNA, 25 bp, Mus musculus
tcccagagggtatagcagcagctca

SEQ ID NO: 473149 - DNA, 25 bp, Mus musculus
tcccagaggtacaaggagtgatcct

SEQ ID NO: 473150 - DNA, 25 bp, Mus musculus
tcccagagtagcaggaaagagtcct

SEQ ID NO: 473151 - DNA, 25 bp, Mus musculus
tcccagagtcggaaaagcagctgca

SEQ ID NO: 473152 - DNA, 25 bp, Mus musculus
tcccagatacagattgaacaaatga

SEQ ID NO: 473153 - DNA, 25 bp, Mus musculus
tcccagataggtgacgacaaagtga

SEQ ID NO: 473154 - DNA, 25 bp, Mus musculus
tcccagatgagagtgcagccaatgc

SEQ ID NO: 473155 - DNA, 25 bp, Mus musculus
tcccagatgcagtattgtcttacaa

SEQ ID NO: 473156 - DNA, 25 bp, Mus musculus
tcccagatgctaaaaggcttcccca

SEQ ID NO: 473157 - DNA, 25 bp, Mus musculus
tcccagatggcaaatgtcagacacc

SEQ ID NO: 473158 - DNA, 25 bp, Mus musculus
tcccagatggcatcaaggagccact

SEQ ID NO: 473159 - DNA, 25 bp, Mus musculus
tcccagatgtagtccgccaaaggat

SEQ ID NO: 473160 - DNA, 25 bp, Mus musculus
tcccagattctttaggccggttgct

SEQ ID NO: 473161 - DNA, 25 bp, Mus musculus
tcccagattggcagtaaatacggtc

SEQ ID NO: 473162 - DNA, 25 bp, Mus musculus
tcccagcagacggtgtcattccaaa

SEQ ID NO: 473163 - DNA, 25 bp, Mus musculus
tcccagcagcaaagcattactacaa

SEQ ID NO: 473164 - DNA, 25 bp, Mus musculus
tcccagcagcggtgaacaatataaa

SEQ ID NO: 473165 - DNA, 25 bp, Mus musculus
tcccagcagggacttggagattgcc

SEQ ID NO: 473166 - DNA, 25 bp, Mus musculus
tcccagcagggtgaagagcctcaaa

SEQ ID NO: 473167 - DNA, 25 bp, Mus musculus
tcccagcccgaggaaagagttcagc

SEQ ID NO: 473168 - DNA, 25 bp, Mus musculus
tcccagcccggagatttttcagaag

SEQ ID NO: 473169 - DNA, 25 bp, Mus musculus
tcccagcgatgtgtagcagccttct

SEQ ID NO: 473170 - DNA, 25 bp, Mus musculus
tcccagcgcagcatgaggattgcac

SEQ ID NO: 473171 - DNA, 25 bp, Mus musculus
tcccagcgccgcgtttgaattcggg

SEQ ID NO: 473172 - DNA, 25 bp, Mus musculus
tcccagcgtggtgtgtgtatccagc

SEQ ID NO: 473173 - DNA, 25 bp, Mus musculus
tcccagctacatagaaagtttcagg

SEQ ID NO: 473174 - DNA, 25 bp, Mus musculus
tcccagctagaagtacatagaatct

SEQ ID NO: 473175 - DNA, 25 bp, Mus musculus
tcccagctcgttgcggaagcacatg

SEQ ID NO: 473176 - DNA, 25 bp, Mus musculus
tcccagctgagagggtgtgtccaca

SEQ ID NO: 473177 - DNA, 25 bp, Mus musculus
tcccagctgatggagcgtaagcgcc

SEQ ID NO: 473178 - DNA, 25 bp, Mus musculus
tcccagctgccatgggaaaccgtcg

SEQ ID NO: 473179 - DNA, 25 bp, Mus musculus
tcccagctgttgcagagcgatgatg

SEQ ID NO: 473180 - DNA, 25 bp, Mus musculus
tcccaggaagaagcagggtccttaa

SEQ ID NO: 473181 - DNA, 25 bp, Mus musculus
tcccaggaattcaggccagtggcca

SEQ ID NO: 473182 - DNA, 25 bp, Mus musculus
tcccaggacaaagagtgaagccagg

SEQ ID NO: 473183 - DNA, 25 bp, Mus musculus
tcccaggacggaaagctcatcattt

SEQ ID NO: 473184 - DNA, 25 bp, Mus musculus
tcccaggactggaagcagctcatca

SEQ ID NO: 473185 - DNA, 25 bp, Mus musculus
tcccaggagggattagacccaggct

SEQ ID NO: 473186 - DNA, 25 bp, Mus musculus
tcccaggatacctctagagtctaag

SEQ ID NO: 473187 - DNA, 25 bp, Mus musculus
tcccaggatgcgactgaagaagctg

SEQ ID NO: 473188 - DNA, 25 bp, Mus musculus
tcccaggcgagagacatgtccctgt

SEQ ID NO: 473189 - DNA, 25 bp, Mus musculus
tcccaggctgggtaatggtgagccc

SEQ ID NO: 473190 - DNA, 25 bp, Mus musculus
tcccagggaacgacaaacttatcag

SEQ ID NO: 473191 - DNA, 25 bp, Mus musculus
tcccagggaagtagcaatggatacc

SEQ ID NO: 473192 - DNA, 25 bp, Mus musculus
tcccagggagagtcaaacagagcat

SEQ ID NO: 473193 - DNA, 25 bp, Mus musculus
tcccagggatttggctgcacagcaa

SEQ ID NO: 473194 - DNA, 25 bp, Mus musculus
tcccagggccaaagatcaagaatgt

SEQ ID NO: 473195 - DNA, 25 bp, Mus musculus
tcccagggccaattcaaggaagaag

SEQ ID NO: 473196 - DNA, 25 bp, Mus musculus
tcccagggccagtatgatgaagact

SEQ ID NO: 473197 - DNA, 25 bp, Mus musculus
tcccagggtctttgagtggactagt

SEQ ID NO: 473198 - DNA, 25 bp, Mus musculus
tcccagggtgaagaaggacgcacat

SEQ ID NO: 473199 - DNA, 25 bp, Mus musculus
tcccagggtgcacttcccgggaaag

SEQ ID NO: 473200 - DNA, 25 bp, Mus musculus
tcccaggtcaccctacagtggatag

SEQ ID NO: 473201 - DNA, 25 bp, Mus musculus
tcccaggtctggaagtgtaatggac

SEQ ID NO: 473202 - DNA, 25 bp, Mus musculus
tcccaggtgggcttccgtggcttct

SEQ ID NO: 473203 - DNA, 25 bp, Mus musculus
tcccaggttactacagtgcagggct

SEQ ID NO: 473204 - DNA, 25 bp, Mus musculus
tcccaggttgcattgcagaggctga

SEQ ID NO: 473205 - DNA, 25 bp, Mus musculus
tcccaggttgccattagctagctag

SEQ ID NO: 473206 - DNA, 25 bp, Mus musculus
tcccagtaacgatgaggcagcaatg

SEQ ID NO: 473207 - DNA, 25 bp, Mus musculus
tcccagtaagagaggatgcccagcc

SEQ ID NO: 473208 - DNA, 25 bp, Mus musculus
tcccagtactagaaggcaagtgccc

SEQ ID NO: 473209 - DNA, 25 bp, Mus musculus
tcccagtaggccatcaagaggaggt

SEQ ID NO: 473210 - DNA, 25 bp, Mus musculus
tcccagtaggtttgttcagcaagct

SEQ ID NO: 473211 - DNA, 25 bp, Mus musculus
tcccagtcaggtaacttttcagtag

SEQ ID NO: 473212 - DNA, 25 bp, Mus musculus
tcccagtccgccttccggctctttt

SEQ ID NO: 473213 - DNA, 25 bp, Mus musculus
tcccagtgaaaggtacagagcaata

SEQ ID NO: 473214 - DNA, 25 bp, Mus musculus
tcccagtgacagctatagtttgcgc

SEQ ID NO: 473215 - DNA, 25 bp, Mus musculus
tcccagtgactttggaggaccaaga

SEQ ID NO: 473216 - DNA, 25 bp, Mus musculus
tcccagtgaggagatgagggccaca

SEQ ID NO: 473217 - DNA, 25 bp, Mus musculus
tcccagtgcacaatcagaagaatga

SEQ ID NO: 473218 - DNA, 25 bp, Mus musculus
tcccagtgcatgctgagactacaga

SEQ ID NO: 473219 - DNA, 25 bp, Mus musculus
tcccagtgcctgtgcgactgtttgt

SEQ ID NO: 473220 - DNA, 25 bp, Mus musculus
tcccagtggaaagctctagatacag

SEQ ID NO: 473221 - DNA, 25 bp, Mus musculus
tcccagtttacggatgtggtcgtgg

SEQ ID NO: 473222 - DNA, 25 bp, Mus musculus
tcccagtttggaccaccaaaagagt

SEQ ID NO: 473223 - DNA, 25 bp, Mus musculus
tcccatacatctggattggactcca

SEQ ID NO: 473224 - DNA, 25 bp, Mus musculus
tcccataggaaggataaatctggcc

SEQ ID NO: 473225 - DNA, 25 bp, Mus musculus
tcccatcaaggcacaaacagcttgt

SEQ ID NO: 473226 - DNA, 25 bp, Mus musculus
tcccatcaatttttgcataagtaag

SEQ ID NO: 473227 - DNA, 25 bp, Mus musculus
tcccatcccatgttcgctacaggaa

SEQ ID NO: 473228 - DNA, 25 bp, Mus musculus
tcccatcccggcaagatgcaggagg

SEQ ID NO: 473229 - DNA, 25 bp, Mus musculus
tcccatcctttcagggaaagagagt

SEQ ID NO: 473230 - DNA, 25 bp, Mus musculus
tcccatctgcatcaacatcatctat

SEQ ID NO: 473231 - DNA, 25 bp, Mus musculus
tcccatctgttgagactgagaaggc

SEQ ID NO: 473232 - DNA, 25 bp, Mus musculus
tcccatcttaggacagtttccagac

SEQ ID NO: 473233 - DNA, 25 bp, Mus musculus
tcccatgacggtgccagtattacag

SEQ ID NO: 473234 - DNA, 25 bp, Mus musculus
tcccatgagctgagccagaaagcca

SEQ ID NO: 473235 - DNA, 25 bp, Mus musculus
tcccatgagggcagatagtatatcc

SEQ ID NO: 473236 - DNA, 25 bp, Mus musculus
tcccatgagttctggatgtcctatg

SEQ ID NO: 473237 - DNA, 25 bp, Mus musculus
tcccatgccgaaaggctatgagcag

SEQ ID NO: 473238 - DNA, 25 bp, Mus musculus
tcccatgcttcagcgtcacggtgga

SEQ ID NO: 473239 - DNA, 25 bp, Mus musculus
tcccatggaagcttgaacagatcac

SEQ ID NO: 473240 - DNA, 25 bp, Mus musculus
tcccatggagctagggtaagtgtcc

SEQ ID NO: 473241 - DNA, 25 bp, Mus musculus
tcccatggcctctagagtggtaaca

SEQ ID NO: 473242 - DNA, 25 bp, Mus musculus
tcccatgggcagagaaagatcaaga

SEQ ID NO: 473243 - DNA, 25 bp, Mus musculus
tcccatggtgggaaacccgtggagt

SEQ ID NO: 473244 - DNA, 25 bp, Mus musculus
tcccatggtgtagttcaagaacgcc

SEQ ID NO: 473245 - DNA, 25 bp, Mus musculus
tcccatgtagaagcctttccatagg

SEQ ID NO: 473246 - DNA, 25 bp, Mus musculus
tcccatgtcctcaaagagatgctat

SEQ ID NO: 473247 - DNA, 25 bp, Mus musculus
tcccatgttggcagctaatggagct

SEQ ID NO: 473248 - DNA, 25 bp, Mus musculus
tcccattaaaattgtaaccacaact

SEQ ID NO: 473249 - DNA, 25 bp, Mus musculus
tcccattcgggaaatgtcactccca

SEQ ID NO: 473250 - DNA, 25 bp, Mus musculus
tcccattctggctgtgaagctttca

SEQ ID NO: 473251 - DNA, 25 bp, Mus musculus
tcccattgctttatgtgactaccgt

SEQ ID NO: 473252 - DNA, 25 bp, Mus musculus
tcccatttcatccaagacttcgaga

SEQ ID NO: 473253 - DNA, 25 bp, Mus musculus
tccccaaaggcggatgcttcataaa

SEQ ID NO: 473254 - DNA, 25 bp, Mus musculus
tccccaaagtggatgaacaatcaat

SEQ ID NO: 473255 - DNA, 25 bp, Mus musculus
tccccaaagttgtatgtcgatgagg

SEQ ID NO: 473256 - DNA, 25 bp, Mus musculus
tccccaaatactgtgaacctgtagt

SEQ ID NO: 473257 - DNA, 25 bp, Mus musculus
tccccaagagagagtacagcgtgaa

SEQ ID NO: 473258 - DNA, 25 bp, Mus musculus
tccccaaggaaactaataaatgagg

SEQ ID NO: 473259 - DNA, 25 bp, Mus musculus
tccccaaggcaattcagacagagag

SEQ ID NO: 473260 - DNA, 25 bp, Mus musculus
tccccaagggaagagaggctaagcc

SEQ ID NO: 473261 - DNA, 25 bp, Mus musculus
tccccaaggttgatagatggtcccg

SEQ ID NO: 473262 - DNA, 25 bp, Mus musculus
tccccacaatgacatcacaggtagg

SEQ ID NO: 473263 - DNA, 25 bp, Mus musculus
tccccacacgatgtctcttgagtta

SEQ ID NO: 473264 - DNA, 25 bp, Mus musculus
tccccacaggaatagaagacgaaga

SEQ ID NO: 473265 - DNA, 25 bp, Mus musculus
tccccacctggctgaagttgatcgt

SEQ ID NO: 473266 - DNA, 25 bp, Mus musculus
tccccacgggacatctattaaaagc

SEQ ID NO: 473267 - DNA, 25 bp, Mus musculus
tccccacttaatgtgtgtcctgtgt

SEQ ID NO: 473268 - DNA, 25 bp, Mus musculus
tccccagaagatagactgagtatgc

SEQ ID NO: 473269 - DNA, 25 bp, Mus musculus
tccccagacctgtcaaggatttaga

SEQ ID NO: 473270 - DNA, 25 bp, Mus musculus
tccccagagaggatggaagcggcat

SEQ ID NO: 473271 - DNA, 25 bp, Mus musculus
tccccagagcatccaggtttgttct

SEQ ID NO: 473272 - DNA, 25 bp, Mus musculus
tccccagaggcccaggtagaatttg

SEQ ID NO: 473273 - DNA, 25 bp, Mus musculus
tccccagagggaatgcaggtgttaa

SEQ ID NO: 473274 - DNA, 25 bp, Mus musculus
tccccagagggtggtttatccagaa

SEQ ID NO: 473275 - DNA, 25 bp, Mus musculus
tccccagattgccactgaggtgggc

SEQ ID NO: 473276 - DNA, 25 bp, Mus musculus
tccccagcctgtagcgacagggttt

SEQ ID NO: 473277 - DNA, 25 bp, Mus musculus
tccccagcgggaacgttttctacag

SEQ ID NO: 473278 - DNA, 25 bp, Mus musculus
tccccagcgtggcaatacctttcag

SEQ ID NO: 473279 - DNA, 25 bp, Mus musculus
tccccaggacgcttggctctacgag

SEQ ID NO: 473280 - DNA, 25 bp, Mus musculus
tccccaggaggatatggagcccaat

SEQ ID NO: 473281 - DNA, 25 bp, Mus musculus
tccccagggatatcagtctcttgag

SEQ ID NO: 473282 - DNA, 25 bp, Mus musculus
tccccaggtctagtgcagtgctaag

SEQ ID NO: 473283 - DNA, 25 bp, Mus musculus
tccccagtacagagaagagccgatg

SEQ ID NO: 473284 - DNA, 25 bp, Mus musculus
tccccagtataagtgtcattattag

SEQ ID NO: 473285 - DNA, 25 bp, Mus musculus
tccccagtggaaggcttgcagctgt

SEQ ID NO: 473286 - DNA, 25 bp, Mus musculus
tccccagtggacagagcgaatatat

SEQ ID NO: 473287 - DNA, 25 bp, Mus musculus
tccccatggactactcggagggctt

SEQ ID NO: 473288 - DNA, 25 bp, Mus musculus
tccccatgggaagtgcaagagccag

SEQ ID NO: 473289 - DNA, 25 bp, Mus musculus
tccccatggtgctggtaggcaacaa

SEQ ID NO: 473290 - DNA, 25 bp, Mus musculus
tccccattacagcacagcagagagg

SEQ ID NO: 473291 - DNA, 25 bp, Mus musculus
tccccattacctcttagatgagcag

SEQ ID NO: 473292 - DNA, 25 bp, Mus musculus
tccccattctgagacgaggaggcag

SEQ ID NO: 473293 - DNA, 25 bp, Mus musculus
tccccctggtgggagcggtacttga

SEQ ID NO: 473294 - DNA, 25 bp, Mus musculus
tccccgaagcctggagtatacagtg

SEQ ID NO: 473295 - DNA, 25 bp, Mus musculus
tccccgacctgtgaagtagctaata

SEQ ID NO: 473296 - DNA, 25 bp, Mus musculus
tccccgagtgatggtagtaggtcct

SEQ ID NO: 473297 - DNA, 25 bp, Mus musculus
tccccgagtgcgagatgacattgct

SEQ ID NO: 473298 - DNA, 25 bp, Mus musculus
tccccgagttgctgttatagagtac

SEQ ID NO: 473299 - DNA, 25 bp, Mus musculus
tccccgagttgttgagctacccaaa

SEQ ID NO: 473300 - DNA, 25 bp, Mus musculus
tccccgcaggagaaatgtgaacctt

SEQ ID NO: 473301 - DNA, 25 bp, Mus musculus
tccccgccaataccgtcaggtagtt

SEQ ID NO: 473302 - DNA, 25 bp, Mus musculus
tccccgccagacaggagtcctagat

SEQ ID NO: 473303 - DNA, 25 bp, Mus musculus
tccccgcgggagctattgttggtct

SEQ ID NO: 473304 - DNA, 25 bp, Mus musculus
tccccgctggttactggaggagcgc

SEQ ID NO: 473305 - DNA, 25 bp, Mus musculus
tccccggactgagactgagtaaggc

SEQ ID NO: 473306 - DNA, 25 bp, Mus musculus
tccccggagacttgatggccacgga

SEQ ID NO: 473307 - DNA, 25 bp, Mus musculus
tccccggattaggaaggagctctcc

SEQ ID NO: 473308 - DNA, 25 bp, Mus musculus
tccccgggacatccaggcgagaatg

SEQ ID NO: 473309 - DNA, 25 bp, Mus musculus
tccccgggagttttggatcctatga

SEQ ID NO: 473310 - DNA, 25 bp, Mus musculus
tccccggtgattatgcaagagagcc

SEQ ID NO: 473311 - DNA, 25 bp, Mus musculus
tccccggtggtttgttctctcgtca

SEQ ID NO: 473312 - DNA, 25 bp, Mus musculus
tccccgtaagcatccacatcaatat

SEQ ID NO: 473313 - DNA, 25 bp, Mus musculus
tccccgtggaggctgtaaagatgca

SEQ ID NO: 473314 - DNA, 25 bp, Mus musculus
tccccgtggctttctggctttggaa

SEQ ID NO: 473315 - DNA, 25 bp, Mus musculus
tccccgtggttgatttgaacatgat

SEQ ID NO: 473316 - DNA, 25 bp, Mus musculus
tccccgtgtgacagatgttggcagg

SEQ ID NO: 473317 - DNA, 25 bp, Mus musculus
tcccctacaagagcctgaagcagtg

SEQ ID NO: 473318 - DNA, 25 bp, Mus musculus
tcccctaggcaggtagcatgctttt

SEQ ID NO: 473319 - DNA, 25 bp, Mus musculus
tcccctcgagcttacatggtcatct

SEQ ID NO: 473320 - DNA, 25 bp, Mus musculus
tcccctcggtgagagagcactttag

SEQ ID NO: 473321 - DNA, 25 bp, Mus musculus
tcccctcgtccttgctggttatcag

SEQ ID NO: 473322 - DNA, 25 bp, Mus musculus
tcccctctgagataaggaaagcagc

SEQ ID NO: 473323 - DNA, 25 bp, Mus musculus
tcccctctgttaggtgcagtcagtg

SEQ ID NO: 473324 - DNA, 25 bp, Mus musculus
tcccctgagctgagagactgactgg

SEQ ID NO: 473325 - DNA, 25 bp, Mus musculus
tcccctgaggatgtgcaagagtatc

SEQ ID NO: 473326 - DNA, 25 bp, Mus musculus
tcccctgcagccgttcacacagcag

SEQ ID NO: 473327 - DNA, 25 bp, Mus musculus
tcccctgcaggtaacaaggacgagg

SEQ ID NO: 473328 - DNA, 25 bp, Mus musculus
tcccctgcgacctgaaaggcattgg

SEQ ID NO: 473329 - DNA, 25 bp, Mus musculus
tcccctgcgtataagcatgcatggg

SEQ ID NO: 473330 - DNA, 25 bp, Mus musculus
tcccctgcgtgtacagggaactccg

SEQ ID NO: 473331 - DNA, 25 bp, Mus musculus
tcccctgctaggtggcaatggcaag

SEQ ID NO: 473332 - DNA, 25 bp, Mus musculus
tcccctggcgacaatggttggctaa

SEQ ID NO: 473333 - DNA, 25 bp, Mus musculus
tcccctgtatcgcttaattgagaag

SEQ ID NO: 473334 - DNA, 25 bp, Mus musculus
tcccctgtgcaacggcagcatggta

SEQ ID NO: 473335 - DNA, 25 bp, Mus musculus
tcccctgtggcctgggcatggcgtt

SEQ ID NO: 473336 - DNA, 25 bp, Mus musculus
tccccttagagagcaagtgttacca

SEQ ID NO: 473337 - DNA, 25 bp, Mus musculus
tccccttcttggcagagagcactag

SEQ ID NO: 473338 - DNA, 25 bp, Mus musculus
tccccttgaaagctatgaaaactgt

SEQ ID NO: 473339 - DNA, 25 bp, Mus musculus
tcccctttataatagcatctttggc

SEQ ID NO: 473340 - DNA, 25 bp, Mus musculus
tcccctttgggatgggcatggtaaa

SEQ ID NO: 473341 - DNA, 25 bp, Mus musculus
tcccctttgtggagactgcaatggg

SEQ ID NO: 473342 - DNA, 25 bp, Mus musculus
tcccctttgtgtggaaacggccagg

SEQ ID NO: 473343 - DNA, 25 bp, Mus musculus
tcccgaaacaggctcaggctatgct

SEQ ID NO: 473344 - DNA, 25 bp, Mus musculus
tcccgaaaccagctgtaaacacaga

SEQ ID NO: 473345 - DNA, 25 bp, Mus musculus
tcccgaagaagacctgcctatgaag

SEQ ID NO: 473346 - DNA, 25 bp, Mus musculus
tcccgaagaatcgaggtcagcatgt

SEQ ID NO: 473347 - DNA, 25 bp, Mus musculus
tcccgaagacatagaagaagcccaa

SEQ ID NO: 473348 - DNA, 25 bp, Mus musculus
tcccgaaggaggtctccgcagtctt

SEQ ID NO: 473349 - DNA, 25 bp, Mus musculus
tcccgaaggtggcttatgcaacagc

SEQ ID NO: 473350 - DNA, 25 bp, Mus musculus
tcccgaatctgccatttcaaaaagc

SEQ ID NO: 473351 - DNA, 25 bp, Mus musculus
tcccgacatctgcactagtgagagt

SEQ ID NO: 473352 - DNA, 25 bp, Mus musculus
tcccgagaagaagttgaggcgctat

SEQ ID NO: 473353 - DNA, 25 bp, Mus musculus
tcccgagatgatgcagaagggctcc

SEQ ID NO: 473354 - DNA, 25 bp, Mus musculus
tcccgagcagccaaagtcatcaaga

SEQ ID NO: 473355 - DNA, 25 bp, Mus musculus
tcccgagctcatttcaggccagtgc

SEQ ID NO: 473356 - DNA, 25 bp, Mus musculus
tcccgaggacctatgactatgaaag

SEQ ID NO: 473357 - DNA, 25 bp, Mus musculus
tcccgaggactgatgtgtgctgcgt

SEQ ID NO: 473358 - DNA, 25 bp, Mus musculus
tcccgaggctgaagtttctgaacta

SEQ ID NO: 473359 - DNA, 25 bp, Mus musculus
tcccgagggttcgtgtccagactcg

SEQ ID NO: 473360 - DNA, 25 bp, Mus musculus
tcccgagtgactttcaattgttcca

SEQ ID NO: 473361 - DNA, 25 bp, Mus musculus
tcccgagtgctcaaacccttgtgct

SEQ ID NO: 473362 - DNA, 25 bp, Mus musculus
tcccgagtgtccaatgaggaggtca

SEQ ID NO: 473363 - DNA, 25 bp, Mus musculus
tcccgagttgggatatgctacttga

SEQ ID NO: 473364 - DNA, 25 bp, Mus musculus
tcccgatagtgctttgtcttttaag

SEQ ID NO: 473365 - DNA, 25 bp, Mus musculus
tcccgcaaaggtatgagctccgagc

SEQ ID NO: 473366 - DNA, 25 bp, Mus musculus
tcccgcacggcgagtgctggagcac

SEQ ID NO: 473367 - DNA, 25 bp, Mus musculus
tcccgcagcaaagtccatgattgaa

SEQ ID NO: 473368 - DNA, 25 bp, Mus musculus
tcccgcaggatgatcagggatggcc

SEQ ID NO: 473369 - DNA, 25 bp, Mus musculus
tcccgcaggccttctgtgcgctgtg

SEQ ID NO: 473370 - DNA, 25 bp, Mus musculus
tcccgccaggtccaagaagacaatg

SEQ ID NO: 473371 - DNA, 25 bp, Mus musculus
tcccgcccttgcacacaggagagga

SEQ ID NO: 473372 - DNA, 25 bp, Mus musculus
tcccgccgcaagaagaaagagtacc

SEQ ID NO: 473373 - DNA, 25 bp, Mus musculus
tcccgccgtcgctgatgatgatgca

SEQ ID NO: 473374 - DNA, 25 bp, Mus musculus
tcccgcgctgtgtctccaagatcgg

SEQ ID NO: 473375 - DNA, 25 bp, Mus musculus
tcccgcgtgcttcctgtgattgaca

SEQ ID NO: 473376 - DNA, 25 bp, Mus musculus
tcccgctaaagagtgtccagagtcc

SEQ ID NO: 473377 - DNA, 25 bp, Mus musculus
tcccgctggaagagaaatcgcactt

SEQ ID NO: 473378 - DNA, 25 bp, Mus musculus
tcccgctgttgaagaagtgccatgt

SEQ ID NO: 473379 - DNA, 25 bp, Mus musculus
tcccggaaaacgagagtgcagatgt

SEQ ID NO: 473380 - DNA, 25 bp, Mus musculus
tcccggaagccagaatgttcatgtc

SEQ ID NO: 473381 - DNA, 25 bp, Mus musculus
tcccggaaggaaggtgagccttcct

SEQ ID NO: 473382 - DNA, 25 bp, Mus musculus
tcccggaatggctcagaaagtgccc

SEQ ID NO: 473383 - DNA, 25 bp, Mus musculus
tcccggacagtctagagacccagac

SEQ ID NO: 473384 - DNA, 25 bp, Mus musculus
tcccggaccggatggtttagcagcg

SEQ ID NO: 473385 - DNA, 25 bp, Mus musculus
tcccggagctcctccggttgtgaca

SEQ ID NO: 473386 - DNA, 25 bp, Mus musculus
tcccggaggacttgattttctgtgg

SEQ ID NO: 473387 - DNA, 25 bp, Mus musculus
tcccggatgatggtgtggaactcag

SEQ ID NO: 473388 - DNA, 25 bp, Mus musculus
tcccggatgtaggaatcagacttca

SEQ ID NO: 473389 - DNA, 25 bp, Mus musculus
tcccggcagccgcaagttactcttg

SEQ ID NO: 473390 - DNA, 25 bp, Mus musculus
tcccggcccggattatagtctcgct

SEQ ID NO: 473391 - DNA, 25 bp, Mus musculus
tcccggctgtgtgagcggcaattca

SEQ ID NO: 473392 - DNA, 25 bp, Mus musculus
tcccgggaaatgagctgaggccgca

SEQ ID NO: 473393 - DNA, 25 bp, Mus musculus
tcccgggacaaggatacatgggccc

SEQ ID NO: 473394 - DNA, 25 bp, Mus musculus
tcccgggagagaaagaaacgtgtct

SEQ ID NO: 473395 - DNA, 25 bp, Mus musculus
tcccgggaggcactctagcgtagaa

SEQ ID NO: 473396 - DNA, 25 bp, Mus musculus
tcccgggatatgtgcaagaccttgc

SEQ ID NO: 473397 - DNA, 25 bp, Mus musculus
tcccgggatggattcagatacttga

SEQ ID NO: 473398 - DNA, 25 bp, Mus musculus
tcccgggcggaagtgcctgtccagt

SEQ ID NO: 473399 - DNA, 25 bp, Mus musculus
tcccgggtgggtgtgcagaacctta

SEQ ID NO: 473400 - DNA, 25 bp, Mus musculus
tcccgggttggagcctggaggagga

SEQ ID NO: 473401 - DNA, 25 bp, Mus musculus
tcccggtagctgaagcagtgccctt

SEQ ID NO: 473402 - DNA, 25 bp, Mus musculus
tcccggtgccttcttgcgaatgagc

SEQ ID NO: 473403 - DNA, 25 bp, Mus musculus
tcccggtgctcatcgcagctagtag

SEQ ID NO: 473404 - DNA, 25 bp, Mus musculus
tcccggtgctgaaggtaaatgtgtc

SEQ ID NO: 473405 - DNA, 25 bp, Mus musculus
tcccggtggtgcgagaacagagttc

SEQ ID NO: 473406 - DNA, 25 bp, Mus musculus
tcccggtggtgtgtggtgatccacc

SEQ ID NO: 473407 - DNA, 25 bp, Mus musculus
tcccggttcacttcctctgtacagg

SEQ ID NO: 473408 - DNA, 25 bp, Mus musculus
tcccgtacaatgattaccagcactg

SEQ ID NO: 473409 - DNA, 25 bp, Mus musculus
tcccgtagagacctgaaatgccaag

SEQ ID NO: 473410 - DNA, 25 bp, Mus musculus
tcccgtcagacggaagcatgatcag

SEQ ID NO: 473411 - DNA, 25 bp, Mus musculus
tcccgtccaaggtgggcaccgagat

SEQ ID NO: 473412 - DNA, 25 bp, Mus musculus
tcccgtccggctgtgagtagaggca

SEQ ID NO: 473413 - DNA, 25 bp, Mus musculus
tcccgtccgtttgatggcagctgct

SEQ ID NO: 473414 - DNA, 25 bp, Mus musculus
tcccgtcggacttccatttcagtgc

SEQ ID NO: 473415 - DNA, 25 bp, Mus musculus
tcccgtctagggaggacatgtcaca

SEQ ID NO: 473416 - DNA, 25 bp, Mus musculus
tcccgtgactgcagatccttggttg

SEQ ID NO: 473417 - DNA, 25 bp, Mus musculus
tcccgtgcctaaggaagtgaaccga

SEQ ID NO: 473418 - DNA, 25 bp, Mus musculus
tcccgtgcggctgcggaagaatgtc

SEQ ID NO: 473419 - DNA, 25 bp, Mus musculus
tcccgtggaaggcaatatacatgtc

SEQ ID NO: 473420 - DNA, 25 bp, Mus musculus
tcccgttaagtggaggagcaaggcc

SEQ ID NO: 473421 - DNA, 25 bp, Mus musculus
tcccgttctttaggttcaacactag

SEQ ID NO: 473422 - DNA, 25 bp, Mus musculus
tcccgttggctggaaacaagtagaa

SEQ ID NO: 473423 - DNA, 25 bp, Mus musculus
tcccgtttcaacacagtgaggtagg

SEQ ID NO: 473424 - DNA, 25 bp, Mus musculus
tcccgtttccgggtggtgaagctgc

SEQ ID NO: 473425 - DNA, 25 bp, Mus musculus
tcccgtttttatggagaaagagcca

SEQ ID NO: 473426 - DNA, 25 bp, Mus musculus
tccctaaagggagtggagcacacca

SEQ ID NO: 473427 - DNA, 25 bp, Mus musculus
tccctaaccgtctgcagaaggagct

SEQ ID NO: 473428 - DNA, 25 bp, Mus musculus
tccctaaggagaagacgcagatata

SEQ ID NO: 473429 - DNA, 25 bp, Mus musculus
tccctaagtatcctccgtgactggg

SEQ ID NO: 473430 - DNA, 25 bp, Mus musculus
tccctaagtctgagacctgcagagg

SEQ ID NO: 473431 - DNA, 25 bp, Mus musculus
tccctaataggaactgctcgcgtta

SEQ ID NO: 473432 - DNA, 25 bp, Mus musculus
tccctacagaggtgcgacatgtggt

SEQ ID NO: 473433 - DNA, 25 bp, Mus musculus
tccctacagtgagtgagttcaaact

SEQ ID NO: 473434 - DNA, 25 bp, Mus musculus
tccctacgtgtctgggaaagccagt

SEQ ID NO: 473435 - DNA, 25 bp, Mus musculus
tccctacgttgctggtgtacaaagg

SEQ ID NO: 473436 - DNA, 25 bp, Mus musculus
tccctagaaaagtcagaaaacctgt

SEQ ID NO: 473437 - DNA, 25 bp, Mus musculus
tccctagatgaggtcgccgtcagtc

SEQ ID NO: 473438 - DNA, 25 bp, Mus musculus
tccctagcagagtgaatgaatgcag

SEQ ID NO: 473439 - DNA, 25 bp, Mus musculus
tccctagcctgtgaaatggaagctc

SEQ ID NO: 473440 - DNA, 25 bp, Mus musculus
tccctaggcaatggtgagccagacc

SEQ ID NO: 473441 - DNA, 25 bp, Mus musculus
tccctaggcctgagtgaactttacc

SEQ ID NO: 473442 - DNA, 25 bp, Mus musculus
tccctagggtgtcgagatgaaatca

SEQ ID NO: 473443 - DNA, 25 bp, Mus musculus
tccctaggtctttctctgccttaaa

SEQ ID NO: 473444 - DNA, 25 bp, Mus musculus
tccctatggaagaggaccaactgtc

SEQ ID NO: 473445 - DNA, 25 bp, Mus musculus
tccctatgggaaaggtgataccagc

SEQ ID NO: 473446 - DNA, 25 bp, Mus musculus
tccctattcttgttgcatctcaggt

SEQ ID NO: 473447 - DNA, 25 bp, Mus musculus
tccctcaaccggaagtaaggcggcg

SEQ ID NO: 473448 - DNA, 25 bp, Mus musculus
tccctcaaggttgacgtccgggtgg

SEQ ID NO: 473449 - DNA, 25 bp, Mus musculus
tccctcacaggtagacaaacacatt

SEQ ID NO: 473450 - DNA, 25 bp, Mus musculus
tccctcacaggtatggatgtattgt

SEQ ID NO: 473451 - DNA, 25 bp, Mus musculus
tccctcactctctctgtgtgaaagt

SEQ ID NO: 473452 - DNA, 25 bp, Mus musculus
tccctcagaatggaagctgtgctgc

SEQ ID NO: 473453 - DNA, 25 bp, Mus musculus
tccctcagcgttccgctttgctttt

SEQ ID NO: 473454 - DNA, 25 bp, Mus musculus
tccctcatgtagtacgggctggtgc

SEQ ID NO: 473455 - DNA, 25 bp, Mus musculus
tccctcattttcaaggtctcccaag

SEQ ID NO: 473456 - DNA, 25 bp, Mus musculus
tccctccaacattttctcatgaaga

SEQ ID NO: 473457 - DNA, 25 bp, Mus musculus
tccctccagcgataaggatagcaag

SEQ ID NO: 473458 - DNA, 25 bp, Mus musculus
tccctccagggcatgagtactctct

SEQ ID NO: 473459 - DNA, 25 bp, Mus musculus
tccctccagggccttaggagcctag

SEQ ID NO: 473460 - DNA, 25 bp, Mus musculus
tccctccggaaatgaacgagagaag

SEQ ID NO: 473461 - DNA, 25 bp, Mus musculus
tccctccggagaagactagaaactg

SEQ ID NO: 473462 - DNA, 25 bp, Mus musculus
tccctcctcaccgtgcgatcgtggg

SEQ ID NO: 473463 - DNA, 25 bp, Mus musculus
tccctcctcttttctgtacttgtgt

SEQ ID NO: 473464 - DNA, 25 bp, Mus musculus
tccctcctgggaaatgctggtgcag

SEQ ID NO: 473465 - DNA, 25 bp, Mus musculus
tccctcctgtgtggcttagaatggc

SEQ ID NO: 473466 - DNA, 25 bp, Mus musculus
tccctcgaacgtggacaaactggtt

SEQ ID NO: 473467 - DNA, 25 bp, Mus musculus
tccctcgagaactccaggcggagga

SEQ ID NO: 473468 - DNA, 25 bp, Mus musculus
tccctcgctcccttttagaggaggt

SEQ ID NO: 473469 - DNA, 25 bp, Mus musculus
tccctcgggagatgatgtgaagccc

SEQ ID NO: 473470 - DNA, 25 bp, Mus musculus
tccctctagctgagatggaggctct

SEQ ID NO: 473471 - DNA, 25 bp, Mus musculus
tccctctcaagcagttaagcctact

SEQ ID NO: 473472 - DNA, 25 bp, Mus musculus
tccctctctcattcttcaagacagg

SEQ ID NO: 473473 - DNA, 25 bp, Mus musculus
tccctctcttgtagctggttcgatg

SEQ ID NO: 473474 - DNA, 25 bp, Mus musculus
tccctctgggatgtccaaggataat

SEQ ID NO: 473475 - DNA, 25 bp, Mus musculus
tccctgaaactgaagaaacggtggt

SEQ ID NO: 473476 - DNA, 25 bp, Mus musculus
tccctgaaatccaaagaagtgagcc

SEQ ID NO: 473477 - DNA, 25 bp, Mus musculus
tccctgaaatggacacaggctgtgc

SEQ ID NO: 473478 - DNA, 25 bp, Mus musculus
tccctgaagatgacgtgttcctgag

SEQ ID NO: 473479 - DNA, 25 bp, Mus musculus
tccctgacatgaggcgaattggagc

SEQ ID NO: 473480 - DNA, 25 bp, Mus musculus
tccctgacatggatgcgtaatcacg

SEQ ID NO: 473481 - DNA, 25 bp, Mus musculus
tccctgacattgctggtgacactgg

SEQ ID NO: 473482 - DNA, 25 bp, Mus musculus
tccctgaccagctgaaggacacaac

SEQ ID NO: 473483 - DNA, 25 bp, Mus musculus
tccctgacctgtccaaagctcaagg

SEQ ID NO: 473484 - DNA, 25 bp, Mus musculus
tccctgactattacacagcactgtg

SEQ ID NO: 473485 - DNA, 25 bp, Mus musculus
tccctgagatccgagatgtgacaag

SEQ ID NO: 473486 - DNA, 25 bp, Mus musculus
tccctgagattgtggccccgctgct

SEQ ID NO: 473487 - DNA, 25 bp, Mus musculus
tccctgagcagagaggatcccagtc

SEQ ID NO: 473488 - DNA, 25 bp, Mus musculus
tccctgagcatgctaagcaggatct

SEQ ID NO: 473489 - DNA, 25 bp, Mus musculus
tccctgagcggaggataagcagcat

SEQ ID NO: 473490 - DNA, 25 bp, Mus musculus
tccctgaggagtaagctgattgccc

SEQ ID NO: 473491 - DNA, 25 bp, Mus musculus
tccctgaggataaaatcggctccag

SEQ ID NO: 473492 - DNA, 25 bp, Mus musculus
tccctgaggattcggccagcaagga

SEQ ID NO: 473493 - DNA, 25 bp, Mus musculus
tccctgaggatttcagtagacattc

SEQ ID NO: 473494 - DNA, 25 bp, Mus musculus
tccctgagggatgaactgtgtcttg

SEQ ID NO: 473495 - DNA, 25 bp, Mus musculus
tccctgagtatgagggagtaccgtg

SEQ ID NO: 473496 - DNA, 25 bp, Mus musculus
tccctgagtcaaaacgcatgcgtta

SEQ ID NO: 473497 - DNA, 25 bp, Mus musculus
tccctgataattaatggcaaagagc

SEQ ID NO: 473498 - DNA, 25 bp, Mus musculus
tccctgattggtgacagaaatggcg

SEQ ID NO: 473499 - DNA, 25 bp, Mus musculus
tccctgcaaggccagttgctgtaga

SEQ ID NO: 473500 - DNA, 25 bp, Mus musculus
tccctgcaagtgaggatacagtgga

SEQ ID NO: 473501 - DNA, 25 bp, Mus musculus
tccctgcatccggagaggctgggaa

SEQ ID NO: 473502 - DNA, 25 bp, Mus musculus
tccctgccctgaagtgaatgaataa

SEQ ID NO: 473503 - DNA, 25 bp, Mus musculus
tccctgcctgaagtgtgagaaatgt

SEQ ID NO: 473504 - DNA, 25 bp, Mus musculus
tccctgcgccacgaggatggagcag

SEQ ID NO: 473505 - DNA, 25 bp, Mus musculus
tccctgcggacagttttgcgggcga

SEQ ID NO: 473506 - DNA, 25 bp, Mus musculus
tccctgcggctttggaagatcatcg

SEQ ID NO: 473507 - DNA, 25 bp, Mus musculus
tccctgcgggatctcaatgttcgaa

SEQ ID NO: 473508 - DNA, 25 bp, Mus musculus
tccctgcgtggttggtgcggtccat

SEQ ID NO: 473509 - DNA, 25 bp, Mus musculus
tccctgctagtcagagatactccgt

SEQ ID NO: 473510 - DNA, 25 bp, Mus musculus
tccctgctcggatggctacctgtac

SEQ ID NO: 473511 - DNA, 25 bp, Mus musculus
tccctgctgaggaaagacgacacgc

SEQ ID NO: 473512 - DNA, 25 bp, Mus musculus
tccctgctgcaaagagcggatttct

SEQ ID NO: 473513 - DNA, 25 bp, Mus musculus
tccctgcttatatccactctggtca

SEQ ID NO: 473514 - DNA, 25 bp, Mus musculus
tccctggaaatagctgatggcagcg

SEQ ID NO: 473515 - DNA, 25 bp, Mus musculus
tccctggaagtggtaagaatcttcc

SEQ ID NO: 473516 - DNA, 25 bp, Mus musculus
tccctggaatactgtgctgagctgc

SEQ ID NO: 473517 - DNA, 25 bp, Mus musculus
tccctggacagcacagtagatctgg

SEQ ID NO: 473518 - DNA, 25 bp, Mus musculus
tccctggagcaacagagaaaattgg

SEQ ID NO: 473519 - DNA, 25 bp, Mus musculus
tccctggagcagtggcattgaatca

SEQ ID NO: 473520 - DNA, 25 bp, Mus musculus
tccctggatgtcattggagcctgaa

SEQ ID NO: 473521 - DNA, 25 bp, Mus musculus
tccctggcacttaccgaggaggagc

SEQ ID NO: 473522 - DNA, 25 bp, Mus musculus
tccctggcacttagatgagtatgca

SEQ ID NO: 473523 - DNA, 25 bp, Mus musculus
tccctggcagctgtgtagtcgcgtg

SEQ ID NO: 473524 - DNA, 25 bp, Mus musculus
tccctggcagtcatcgagagtggcg

SEQ ID NO: 473525 - DNA, 25 bp, Mus musculus
tccctggcccagaggttcttgctca

SEQ ID NO: 473526 - DNA, 25 bp, Mus musculus
tccctggcccagatgtagtgttaaa

SEQ ID NO: 473527 - DNA, 25 bp, Mus musculus
tccctggcgttggtaaatgcaccgt

SEQ ID NO: 473528 - DNA, 25 bp, Mus musculus
tccctggcgttgttcctagtaataa

SEQ ID NO: 473529 - DNA, 25 bp, Mus musculus
tccctggctgggaaccattgaatca

SEQ ID NO: 473530 - DNA, 25 bp, Mus musculus
tccctgggaccacgcataactgatg

SEQ ID NO: 473531 - DNA, 25 bp, Mus musculus
tccctgggagctatggtgtatcaca

SEQ ID NO: 473532 - DNA, 25 bp, Mus musculus
tccctgggagtcactaggaaggcag

SEQ ID NO: 473533 - DNA, 25 bp, Mus musculus
tccctgggcaagtagaaagtgcacc

SEQ ID NO: 473534 - DNA, 25 bp, Mus musculus
tccctgggcaatagaatttagactc

SEQ ID NO: 473535 - DNA, 25 bp, Mus musculus
tccctgggcaggaggattcttctga

SEQ ID NO: 473536 - DNA, 25 bp, Mus musculus
tccctgggctaaagtgtagattcct

SEQ ID NO: 473537 - DNA, 25 bp, Mus musculus
tccctgggctgttatggagacaagc

SEQ ID NO: 473538 - DNA, 25 bp, Mus musculus
tccctgggtaggtcagggacccaca

SEQ ID NO: 473539 - DNA, 25 bp, Mus musculus
tccctgggtgagtatagcacgtcta

SEQ ID NO: 473540 - DNA, 25 bp, Mus musculus
tccctggtaaaggataaaggctctc

SEQ ID NO: 473541 - DNA, 25 bp, Mus musculus
tccctggtagcatgggcgcctgaag

SEQ ID NO: 473542 - DNA, 25 bp, Mus musculus
tccctggtcagacgcctggtactgg

SEQ ID NO: 473543 - DNA, 25 bp, Mus musculus
tccctggtcttgatccagtgtctca

SEQ ID NO: 473544 - DNA, 25 bp, Mus musculus
tccctggtggactgtgatagccgca

SEQ ID NO: 473545 - DNA, 25 bp, Mus musculus
tccctggtgggataggctgccaatc

SEQ ID NO: 473546 - DNA, 25 bp, Mus musculus
tccctggtggtgaacgtagctagcg

SEQ ID NO: 473547 - DNA, 25 bp, Mus musculus
tccctggtggtggaaggatagaacc

SEQ ID NO: 473548 - DNA, 25 bp, Mus musculus
tccctggttggcaaccctgagttct

SEQ ID NO: 473549 - DNA, 25 bp, Mus musculus
tccctgtcaggaacttttcatcctg

SEQ ID NO: 473550 - DNA, 25 bp, Mus musculus
tccctgtcgccataagctgcaagtg

SEQ ID NO: 473551 - DNA, 25 bp, Mus musculus
tccctgtcgtggagaggaatggcaa

SEQ ID NO: 473552 - DNA, 25 bp, Mus musculus
tccctgtgaagagtggaggtcccca

SEQ ID NO: 473553 - DNA, 25 bp, Mus musculus
tccctgtgctgctggtcgtagagaa

SEQ ID NO: 473554 - DNA, 25 bp, Mus musculus
tccctgtggagacgcagaaagcctg

SEQ ID NO: 473555 - DNA, 25 bp, Mus musculus
tccctgtggagatgcgcaagctgct

SEQ ID NO: 473556 - DNA, 25 bp, Mus musculus
tccctgtgtgagaggcacgtcctcg

SEQ ID NO: 473557 - DNA, 25 bp, Mus musculus
tccctgtgtggaggcagacgatgcc

SEQ ID NO: 473558 - DNA, 25 bp, Mus musculus
tccctgttagaagcctgtcactgtg

SEQ ID NO: 473559 - DNA, 25 bp, Mus musculus
tccctgttatcccttcgggatcctg

SEQ ID NO: 473560 - DNA, 25 bp, Mus musculus
tccctgttgggcagcccctctgatg

SEQ ID NO: 473561 - DNA, 25 bp, Mus musculus
tcccttaaagggacggaagatgcct

SEQ ID NO: 473562 - DNA, 25 bp, Mus musculus
tcccttagatgagagagcaaacgct

SEQ ID NO: 473563 - DNA, 25 bp, Mus musculus
tcccttaggaaggagagaaactgac

SEQ ID NO: 473564 - DNA, 25 bp, Mus musculus
tcccttaggaatgacagcagtagca

SEQ ID NO: 473565 - DNA, 25 bp, Mus musculus
tcccttagtgggaaacattctctgc

SEQ ID NO: 473566 - DNA, 25 bp, Mus musculus
tcccttcaaggagagtgagctcgtc

SEQ ID NO: 473567 - DNA, 25 bp, Mus musculus
tcccttcaatggtgtgcttctggtt

SEQ ID NO: 473568 - DNA, 25 bp, Mus musculus
tcccttcagccgagggggacgtgca

SEQ ID NO: 473569 - DNA, 25 bp, Mus musculus
tcccttccaataaagcggttgtgct

SEQ ID NO: 473570 - DNA, 25 bp, Mus musculus
tcccttccctttccagaaggagaag

SEQ ID NO: 473571 - DNA, 25 bp, Mus musculus
tcccttcctaccctgtcatggagaa

SEQ ID NO: 473572 - DNA, 25 bp, Mus musculus
tcccttcctcctggccggagtcagt

SEQ ID NO: 473573 - DNA, 25 bp, Mus musculus
tcccttcgggttggccacagtagta

SEQ ID NO: 473574 - DNA, 25 bp, Mus musculus
tcccttctagggatttctattcttg

SEQ ID NO: 473575 - DNA, 25 bp, Mus musculus
tcccttctggcctaatgcaaggcct

SEQ ID NO: 473576 - DNA, 25 bp, Mus musculus
tcccttcttctagcacggagtatag

SEQ ID NO: 473577 - DNA, 25 bp, Mus musculus
tcccttgcttggaaaatagagtcag

SEQ ID NO: 473578 - DNA, 25 bp, Mus musculus
tcccttgggccgtgcttgcctggct

SEQ ID NO: 473579 - DNA, 25 bp, Mus musculus
tcccttgtagatccttccatcatga

SEQ ID NO: 473580 - DNA, 25 bp, Mus musculus
tcccttgtatcctcgtctgacctta

SEQ ID NO: 473581 - DNA, 25 bp, Mus musculus
tcccttgtcaatgtggctgtcactg

SEQ ID NO: 473582 - DNA, 25 bp, Mus musculus
tcccttgtcccaagactgatcacag

SEQ ID NO: 473583 - DNA, 25 bp, Mus musculus
tcccttgtgtgggaggaacctgcac

SEQ ID NO: 473584 - DNA, 25 bp, Mus musculus
tccctttaaaggtgtacagactcca

SEQ ID NO: 473585 - DNA, 25 bp, Mus musculus
tccctttaacctctgtattagagcc

SEQ ID NO: 473586 - DNA, 25 bp, Mus musculus
tccctttactgtggaatgtagtcgc

SEQ ID NO: 473587 - DNA, 25 bp, Mus musculus
tccctttccctttggtcatcctggg

SEQ ID NO: 473588 - DNA, 25 bp, Mus musculus
tccctttccgagtggcagggcagcc

SEQ ID NO: 473589 - DNA, 25 bp, Mus musculus
tccctttgggctggaaggccgcggg

SEQ ID NO: 473590 - DNA, 25 bp, Mus musculus
tccctttgtcccttagctgctgtgg

SEQ ID NO: 473591 - DNA, 25 bp, Mus musculus
tcccttttatagagatggccttcaa

SEQ ID NO: 473592 - DNA, 25 bp, Mus musculus
tcccttttcaaagctgggatgtggc

SEQ ID NO: 473593 - DNA, 25 bp, Mus musculus
tccgaaaactgcagaaacgaggtct

SEQ ID NO: 473594 - DNA, 25 bp, Mus musculus
tccgaaagatgagccggaaagccta

SEQ ID NO: 473595 - DNA, 25 bp, Mus musculus
tccgaaagcccatgttttctgaaag

SEQ ID NO: 473596 - DNA, 25 bp, Mus musculus
tccgaaaggccagaagtgacatgct

SEQ ID NO: 473597 - DNA, 25 bp, Mus musculus
tccgaaaggcgagcgtggtttccct

SEQ ID NO: 473598 - DNA, 25 bp, Mus musculus
tccgaaagggacctgaagaaatccg

SEQ ID NO: 473599 - DNA, 25 bp, Mus musculus
tccgaagacagaaagagcatcaacg

SEQ ID NO: 473600 - DNA, 25 bp, Mus musculus
tccgaagagaagagacatttaaagg

SEQ ID NO: 473601 - DNA, 25 bp, Mus musculus
tccgaagccagttcaaaggacccgc

SEQ ID NO: 473602 - DNA, 25 bp, Mus musculus
tccgaagcggcagaatgattcatgt

SEQ ID NO: 473603 - DNA, 25 bp, Mus musculus
tccgaatataaagaactggcctgcc

SEQ ID NO: 473604 - DNA, 25 bp, Mus musculus
tccgaatctgcgatggagccctgga

SEQ ID NO: 473605 - DNA, 25 bp, Mus musculus
tccgaatgcccaagatgccgatgag

SEQ ID NO: 473606 - DNA, 25 bp, Mus musculus
tccgaattccgagtgtgcagaaccg

SEQ ID NO: 473607 - DNA, 25 bp, Mus musculus
tccgacagacagtggcaactttagc

SEQ ID NO: 473608 - DNA, 25 bp, Mus musculus
tccgacagtcctggtacagaggcag

SEQ ID NO: 473609 - DNA, 25 bp, Mus musculus
tccgacatggtggtgaaagcgatca

SEQ ID NO: 473610 - DNA, 25 bp, Mus musculus
tccgacccaagtgggaagggcctag

SEQ ID NO: 473611 - DNA, 25 bp, Mus musculus
tccgacgcttatacgatgaaaatat

SEQ ID NO: 473612 - DNA, 25 bp, Mus musculus
tccgacggctggaaacccaagtgtt

SEQ ID NO: 473613 - DNA, 25 bp, Mus musculus
tccgagaagccttgacacagtggcg

SEQ ID NO: 473614 - DNA, 25 bp, Mus musculus
tccgagaaggagacaatgccgtgat

SEQ ID NO: 473615 - DNA, 25 bp, Mus musculus
tccgagaaggtgagactcggccacc

SEQ ID NO: 473616 - DNA, 25 bp, Mus musculus
tccgagaagtctgcaaggtagtgtc

SEQ ID NO: 473617 - DNA, 25 bp, Mus musculus
tccgagacagttatacagaccatgg

SEQ ID NO: 473618 - DNA, 25 bp, Mus musculus
tccgagaccgagctgaaacaagtgg

SEQ ID NO: 473619 - DNA, 25 bp, Mus musculus
tccgagacctgttccagatgaagct

SEQ ID NO: 473620 - DNA, 25 bp, Mus musculus
tccgagaccttaacttttgagagcc

SEQ ID NO: 473621 - DNA, 25 bp, Mus musculus
tccgagagaagttgtctaagaccca

SEQ ID NO: 473622 - DNA, 25 bp, Mus musculus
tccgagagcgctgacatgtgaagca

SEQ ID NO: 473623 - DNA, 25 bp, Mus musculus
tccgagaggcctgcggagcttcaag

SEQ ID NO: 473624 - DNA, 25 bp, Mus musculus
tccgagaggttcatccgtgggtcca

SEQ ID NO: 473625 - DNA, 25 bp, Mus musculus
tccgagatattcgtaagtatgagtt

SEQ ID NO: 473626 - DNA, 25 bp, Mus musculus
tccgagatcgcagaagggctaaacc

SEQ ID NO: 473627 - DNA, 25 bp, Mus musculus
tccgagatggctgaagagacctact

SEQ ID NO: 473628 - DNA, 25 bp, Mus musculus
tccgagccaattggctgcgccgtgg

SEQ ID NO: 473629 - DNA, 25 bp, Mus musculus
tccgagccggagatagacgaggtca

SEQ ID NO: 473630 - DNA, 25 bp, Mus musculus
tccgagccggtgaccttagagacac

SEQ ID NO: 473631 - DNA, 25 bp, Mus musculus
tccgagcctgggttttccacagagt

SEQ ID NO: 473632 - DNA, 25 bp, Mus musculus
tccgagcctggtagggaaagagccc

SEQ ID NO: 473633 - DNA, 25 bp, Mus musculus
tccgagcgatcgatcgggcacgatt

SEQ ID NO: 473634 - DNA, 25 bp, Mus musculus
tccgagcggagctgaacaagcactt

SEQ ID NO: 473635 - DNA, 25 bp, Mus musculus
tccgagctgggaataagataccttc

SEQ ID NO: 473636 - DNA, 25 bp, Mus musculus
tccgagcttcccctggagttgtgtc

SEQ ID NO: 473637 - DNA, 25 bp, Mus musculus
tccgaggaactttcggcggccacgt

SEQ ID NO: 473638 - DNA, 25 bp, Mus musculus
tccgaggaaggtggtaattgtatcc

SEQ ID NO: 473639 - DNA, 25 bp, Mus musculus
tccgaggagaaaagggataaagatt

SEQ ID NO: 473640 - DNA, 25 bp, Mus musculus
tccgaggagatctcccaccagcaat

SEQ ID NO: 473641 - DNA, 25 bp, Mus musculus
tccgaggcctcgaaactgcatactg

SEQ ID NO: 473642 - DNA, 25 bp, Mus musculus
tccgaggcgttagaagagacgcgac

SEQ ID NO: 473643 - DNA, 25 bp, Mus musculus
tccgagggaatcacgagagcagaca

SEQ ID NO: 473644 - DNA, 25 bp, Mus musculus
tccgagggaccatgaagcagcggct

SEQ ID NO: 473645 - DNA, 25 bp, Mus musculus
tccgagggacccgttccaataatgc

SEQ ID NO: 473646 - DNA, 25 bp, Mus musculus
tccgagggaggaaccaatggacgat

SEQ ID NO: 473647 - DNA, 25 bp, Mus musculus
tccgagggcaacagaaaagacgacg

SEQ ID NO: 473648 - DNA, 25 bp, Mus musculus
tccgagggtcctccttgaagagcac

SEQ ID NO: 473649 - DNA, 25 bp, Mus musculus
tccgaggtcagcgtcatgaggagcc

SEQ ID NO: 473650 - DNA, 25 bp, Mus musculus
tccgaggtgataagcatgcatcgca

SEQ ID NO: 473651 - DNA, 25 bp, Mus musculus
tccgaggtgccgtccagatttaaag

SEQ ID NO: 473652 - DNA, 25 bp, Mus musculus
tccgagtagaaatgctgaccatgcc

SEQ ID NO: 473653 - DNA, 25 bp, Mus musculus
tccgagtagagagcctgaagcagcg

SEQ ID NO: 473654 - DNA, 25 bp, Mus musculus
tccgagtatacacggagagtgtgct

SEQ ID NO: 473655 - DNA, 25 bp, Mus musculus
tccgagtatggacacaagcccttgc

SEQ ID NO: 473656 - DNA, 25 bp, Mus musculus
tccgagtcagagagccaaaggcgat

SEQ ID NO: 473657 - DNA, 25 bp, Mus musculus
tccgagtcagggaggtagtcctttt

SEQ ID NO: 473658 - DNA, 25 bp, Mus musculus
tccgagtcttttgcaagtagttgaa

SEQ ID NO: 473659 - DNA, 25 bp, Mus musculus
tccgagtgacccaaccagatgcgtt

SEQ ID NO: 473660 - DNA, 25 bp, Mus musculus
tccgagtgcggcattacggagtaag

SEQ ID NO: 473661 - DNA, 25 bp, Mus musculus
tccgagttactgtcacaacggcggc

SEQ ID NO: 473662 - DNA, 25 bp, Mus musculus
tccgagttctacaaggagcagaagc

SEQ ID NO: 473663 - DNA, 25 bp, Mus musculus
tccgagtttcgaaccactggtggcg

SEQ ID NO: 473664 - DNA, 25 bp, Mus musculus
tccgataaagggatcctggagccac

SEQ ID NO: 473665 - DNA, 25 bp, Mus musculus
tccgatcgtgggacacaaacctgat

SEQ ID NO: 473666 - DNA, 25 bp, Mus musculus
tccgatgaaggaaaacagagttggc

SEQ ID NO: 473667 - DNA, 25 bp, Mus musculus
tccgatgagcagcagaagtttcccc

SEQ ID NO: 473668 - DNA, 25 bp, Mus musculus
tccgatgctccagaaacagcggctg

SEQ ID NO: 473669 - DNA, 25 bp, Mus musculus
tccgatgtgtaccaggagatgcccg

SEQ ID NO: 473670 - DNA, 25 bp, Mus musculus
tccgattcgtccaacccggagagca

SEQ ID NO: 473671 - DNA, 25 bp, Mus musculus
tccgatttgaagactagagaagctt

SEQ ID NO: 473672 - DNA, 25 bp, Mus musculus
tccgcaaacctggaagctgagcttt

SEQ ID NO: 473673 - DNA, 25 bp, Mus musculus
tccgcaaccgtgtagacctgacagg

SEQ ID NO: 473674 - DNA, 25 bp, Mus musculus
tccgcaacggcatccacaagataga

SEQ ID NO: 473675 - DNA, 25 bp, Mus musculus
tccgcaattacatgagtgagcacct

SEQ ID NO: 473676 - DNA, 25 bp, Mus musculus
tccgcaattatggtcccgaggtgtg

SEQ ID NO: 473677 - DNA, 25 bp, Mus musculus
tccgcaccacaggttgttattgctt

SEQ ID NO: 473678 - DNA, 25 bp, Mus musculus
tccgcacgcattagttgccccaagg

SEQ ID NO: 473679 - DNA, 25 bp, Mus musculus
tccgcacgccgacttgtttatctgg

SEQ ID NO: 473680 - DNA, 25 bp, Mus musculus
tccgcactataatggagtttctcag

SEQ ID NO: 473681 - DNA, 25 bp, Mus musculus
tccgcagccatacagtaagtcacct

SEQ ID NO: 473682 - DNA, 25 bp, Mus musculus
tccgcagccatgaaccgcttcaatg

SEQ ID NO: 473683 - DNA, 25 bp, Mus musculus
tccgcagtccaaccagaaatcggcg

SEQ ID NO: 473684 - DNA, 25 bp, Mus musculus
tccgcagtcttgtctgtgcgcccag

SEQ ID NO: 473685 - DNA, 25 bp, Mus musculus
tccgcagtgagtgaagtggctacat

SEQ ID NO: 473686 - DNA, 25 bp, Mus musculus
tccgcagttaattctgtgcagatgc

SEQ ID NO: 473687 - DNA, 25 bp, Mus musculus
tccgcatcaatgtgggtggcttcaa

SEQ ID NO: 473688 - DNA, 25 bp, Mus musculus
tccgcatcacatcaaatgctatgat

SEQ ID NO: 473689 - DNA, 25 bp, Mus musculus
tccgcatcagctatacagaacctat

SEQ ID NO: 473690 - DNA, 25 bp, Mus musculus
tccgcatccagaggtaggaactaga

SEQ ID NO: 473691 - DNA, 25 bp, Mus musculus
tccgcatcgccatggagaacttctt

SEQ ID NO: 473692 - DNA, 25 bp, Mus musculus
tccgcatctagaaattctggtctga

SEQ ID NO: 473693 - DNA, 25 bp, Mus musculus
tccgcatgacactcaaggaggtgct

SEQ ID NO: 473694 - DNA, 25 bp, Mus musculus
tccgcatgatgaacctgcagggaga

SEQ ID NO: 473695 - DNA, 25 bp, Mus musculus
tccgcatgcagagtggagcctgagc

SEQ ID NO: 473696 - DNA, 25 bp, Mus musculus
tccgcatggaagcagaggtacctag

SEQ ID NO: 473697 - DNA, 25 bp, Mus musculus
tccgcattgaggagaagcatgtccg

SEQ ID NO: 473698 - DNA, 25 bp, Mus musculus
tccgccaacttggatgccgctaggg

SEQ ID NO: 473699 - DNA, 25 bp, Mus musculus
tccgccaagggtgtgcgtgtctgct

SEQ ID NO: 473700 - DNA, 25 bp, Mus musculus
tccgccaatgcagggtttactttga

SEQ ID NO: 473701 - DNA, 25 bp, Mus musculus
tccgccacctagagtcaggatcagg

SEQ ID NO: 473702 - DNA, 25 bp, Mus musculus
tccgccacgggtttgtgctcgcgag

SEQ ID NO: 473703 - DNA, 25 bp, Mus musculus
tccgccatttgcatgtggtgggcac

SEQ ID NO: 473704 - DNA, 25 bp, Mus musculus
tccgcccacagtcgttatgagatag

SEQ ID NO: 473705 - DNA, 25 bp, Mus musculus
tccgccgagtgtatgtggtcaacaa

SEQ ID NO: 473706 - DNA, 25 bp, Mus musculus
tccgcctcaacgtctgcggtgattg

SEQ ID NO: 473707 - DNA, 25 bp, Mus musculus
tccgcctgatccgagagactggaga

SEQ ID NO: 473708 - DNA, 25 bp, Mus musculus
tccgcctgggaatgagacactactg

SEQ ID NO: 473709 - DNA, 25 bp, Mus musculus
tccgcctgtgcctagagaagctaaa

SEQ ID NO: 473710 - DNA, 25 bp, Mus musculus
tccgccttgtctctgaaatgctgag

SEQ ID NO: 473711 - DNA, 25 bp, Mus musculus
tccgcgagaatctgcagactatgct

SEQ ID NO: 473712 - DNA, 25 bp, Mus musculus
tccgcgagccgcatatttgggcgcc

SEQ ID NO: 473713 - DNA, 25 bp, Mus musculus
tccgcgagtggaattgccttcagta

SEQ ID NO: 473714 - DNA, 25 bp, Mus musculus
tccgcgattggatagtgaagcacgt

SEQ ID NO: 473715 - DNA, 25 bp, Mus musculus
tccgcgcacaggtcagtgcttcgcg

SEQ ID NO: 473716 - DNA, 25 bp, Mus musculus
tccgcgccgggcttagagaaattgc

SEQ ID NO: 473717 - DNA, 25 bp, Mus musculus
tccgcgctcgcttctgacgaggcag

SEQ ID NO: 473718 - DNA, 25 bp, Mus musculus
tccgcgctgctgataccaatgaagt

SEQ ID NO: 473719 - DNA, 25 bp, Mus musculus
tccgcggatgagctttctgagagcc

SEQ ID NO: 473720 - DNA, 25 bp, Mus musculus
tccgcggcatctgagcagggccgtt

SEQ ID NO: 473721 - DNA, 25 bp, Mus musculus
tccgcggcgccctgagggcttcgat

SEQ ID NO: 473722 - DNA, 25 bp, Mus musculus
tccgcggctgcaccatcaaggttgt

SEQ ID NO: 473723 - DNA, 25 bp, Mus musculus
tccgcgtctcttgcttgtatttatc

SEQ ID NO: 473724 - DNA, 25 bp, Mus musculus
tccgcgtgatttgcccgccgccttt

SEQ ID NO: 473725 - DNA, 25 bp, Mus musculus
tccgcgtggtggtcatgaacaatgt

SEQ ID NO: 473726 - DNA, 25 bp, Mus musculus
tccgctacccagaaatagtgacagg

SEQ ID NO: 473727 - DNA, 25 bp, Mus musculus
tccgctatgctccatcaggtgtggg

SEQ ID NO: 473728 - DNA, 25 bp, Mus musculus
tccgctatggccaggaggacattga

SEQ ID NO: 473729 - DNA, 25 bp, Mus musculus
tccgctcatttctctaagccttgaa

SEQ ID NO: 473730 - DNA, 25 bp, Mus musculus
tccgctcggagatgattcagcgcag

SEQ ID NO: 473731 - DNA, 25 bp, Mus musculus
tccgctctgtggagggacgtcgaaa

SEQ ID NO: 473732 - DNA, 25 bp, Mus musculus
tccgctcttggaggacaagataggc

SEQ ID NO: 473733 - DNA, 25 bp, Mus musculus
tccgctgcagggtcttgaaaacccc

SEQ ID NO: 473734 - DNA, 25 bp, Mus musculus
tccgctgcctgaggaatgtgatcca

SEQ ID NO: 473735 - DNA, 25 bp, Mus musculus
tccgctgcggcatggatcgattcaa

SEQ ID NO: 473736 - DNA, 25 bp, Mus musculus
tccgctgcggtcgtggtctctgatg

SEQ ID NO: 473737 - DNA, 25 bp, Mus musculus
tccgctgctgcctcttaggaaatcg

SEQ ID NO: 473738 - DNA, 25 bp, Mus musculus
tccgctggacctgctgtggccatgt

SEQ ID NO: 473739 - DNA, 25 bp, Mus musculus
tccgctggagagactactgacgttc

SEQ ID NO: 473740 - DNA, 25 bp, Mus musculus
tccgctgggcaattcttttcatggc

SEQ ID NO: 473741 - DNA, 25 bp, Mus musculus
tccgctgtagctcgcaatgtgacac

SEQ ID NO: 473742 - DNA, 25 bp, Mus musculus
tccgctgtcatgaagaaccaagtgg

SEQ ID NO: 473743 - DNA, 25 bp, Mus musculus
tccgctgtgacaggaagccagaagg

SEQ ID NO: 473744 - DNA, 25 bp, Mus musculus
tccgcttccaaacagaaggcatggg

SEQ ID NO: 473745 - DNA, 25 bp, Mus musculus
tccgcttgtttcctgagcctgctgg

SEQ ID NO: 473746 - DNA, 25 bp, Mus musculus
tccgctttgcagtatgacacgctca

SEQ ID NO: 473747 - DNA, 25 bp, Mus musculus
tccggaaagacgtgaaagagcacct

SEQ ID NO: 473748 - DNA, 25 bp, Mus musculus
tccggaacagggaaaatgcattcgt

SEQ ID NO: 473749 - DNA, 25 bp, Mus musculus
tccggaacccgaagctggagaaagc

SEQ ID NO: 473750 - DNA, 25 bp, Mus musculus
tccggaaccttaactgagctgagca

SEQ ID NO: 473751 - DNA, 25 bp, Mus musculus
tccggaaggcgtacaagcaagtgtt

SEQ ID NO: 473752 - DNA, 25 bp, Mus musculus
tccggaaggcttgcgagtattttat

SEQ ID NO: 473753 - DNA, 25 bp, Mus musculus
tccggaagggctcagcaaagaaagc

SEQ ID NO: 473754 - DNA, 25 bp, Mus musculus
tccggaagttcctctcgaaagggct

SEQ ID NO: 473755 - DNA, 25 bp, Mus musculus
tccggaatgttctactgcctggtga

SEQ ID NO: 473756 - DNA, 25 bp, Mus musculus
tccggacaatgtgcagaatgacctc

SEQ ID NO: 473757 - DNA, 25 bp, Mus musculus
tccggacgacattactatgaggcct

SEQ ID NO: 473758 - DNA, 25 bp, Mus musculus
tccggacgctttaaacataatgacg

SEQ ID NO: 473759 - DNA, 25 bp, Mus musculus
tccggactcggcaaatgtgaagaag

SEQ ID NO: 473760 - DNA, 25 bp, Mus musculus
tccggactgactgcattgaagacca

SEQ ID NO: 473761 - DNA, 25 bp, Mus musculus
tccggagaaagcttagggagctaca

SEQ ID NO: 473762 - DNA, 25 bp, Mus musculus
tccggagaacgcgagccctggagac

SEQ ID NO: 473763 - DNA, 25 bp, Mus musculus
tccggagacagtgtacagagtcgcc

SEQ ID NO: 473764 - DNA, 25 bp, Mus musculus
tccggagactcctgaaagaagcaaa

SEQ ID NO: 473765 - DNA, 25 bp, Mus musculus
tccggagagaatcagcgtgatgcta

SEQ ID NO: 473766 - DNA, 25 bp, Mus musculus
tccggagaggataccttgagcgact

SEQ ID NO: 473767 - DNA, 25 bp, Mus musculus
tccggagagttctgctgatcctaat

SEQ ID NO: 473768 - DNA, 25 bp, Mus musculus
tccggagcgagttccaatgcagggc

SEQ ID NO: 473769 - DNA, 25 bp, Mus musculus
tccggagctgtgatctgaggagact

SEQ ID NO: 473770 - DNA, 25 bp, Mus musculus
tccggaggaaatgctggacacccag

SEQ ID NO: 473771 - DNA, 25 bp, Mus musculus
tccggaggcgactgatctgataggc

SEQ ID NO: 473772 - DNA, 25 bp, Mus musculus
tccggaggtagtgcccagtgactct

SEQ ID NO: 473773 - DNA, 25 bp, Mus musculus
tccggagtacgaagggaaggatcac

SEQ ID NO: 473774 - DNA, 25 bp, Mus musculus
tccggagtcatctcctcggtgggag

SEQ ID NO: 473775 - DNA, 25 bp, Mus musculus
tccggagtgcttcatgtgcagcgac

SEQ ID NO: 473776 - DNA, 25 bp, Mus musculus
tccggatcagacacgaaagaggcgt

SEQ ID NO: 473777 - DNA, 25 bp, Mus musculus
tccggatcatttaagtatagggctg

SEQ ID NO: 473778 - DNA, 25 bp, Mus musculus
tccggatgagcgcagcagatgtctt

SEQ ID NO: 473779 - DNA, 25 bp, Mus musculus
tccggatgatgcagagagagtacca

SEQ ID NO: 473780 - DNA, 25 bp, Mus musculus
tccggatgcgctcaggtcaaggttc

SEQ ID NO: 473781 - DNA, 25 bp, Mus musculus
tccggcaaaccactgctatgtactg

SEQ ID NO: 473782 - DNA, 25 bp, Mus musculus
tccggcacgattgcgagatcgcagt

SEQ ID NO: 473783 - DNA, 25 bp, Mus musculus
tccggcagcgaggagtcctagaaca

SEQ ID NO: 473784 - DNA, 25 bp, Mus musculus
tccggcatccatggagatgaagctc

SEQ ID NO: 473785 - DNA, 25 bp, Mus musculus
tccggcatctcgaaaagggaacgct

SEQ ID NO: 473786 - DNA, 25 bp, Mus musculus
tccggcattctatctcgcagaggtg

SEQ ID NO: 473787 - DNA, 25 bp, Mus musculus
tccggccagccaagatgtcttagag

SEQ ID NO: 473788 - DNA, 25 bp, Mus musculus
tccggcctcatccaccgagtttgtg

SEQ ID NO: 473789 - DNA, 25 bp, Mus musculus
tccggcctgaggtgacatggtactt

SEQ ID NO: 473790 - DNA, 25 bp, Mus musculus
tccggcctgggatcacaaatgcagt

SEQ ID NO: 473791 - DNA, 25 bp, Mus musculus
tccggctcgcgtggttgatcatctc

SEQ ID NO: 473792 - DNA, 25 bp, Mus musculus
tccggctcttgttcacctgtattgg

SEQ ID NO: 473793 - DNA, 25 bp, Mus musculus
tccggctgcagggtatgatcgcatt

SEQ ID NO: 473794 - DNA, 25 bp, Mus musculus
tccggcttccaaggcggcttgcgtg

SEQ ID NO: 473795 - DNA, 25 bp, Mus musculus
tccggcttctgtaaaggcgggaaga

SEQ ID NO: 473796 - DNA, 25 bp, Mus musculus
tccggctttatcttcgctgaggtca

SEQ ID NO: 473797 - DNA, 25 bp, Mus musculus
tccgggaaaaaccttagcctagcag

SEQ ID NO: 473798 - DNA, 25 bp, Mus musculus
tccgggaaacaaagagctgggctct

SEQ ID NO: 473799 - DNA, 25 bp, Mus musculus
tccgggaacttcagaggcatggcta

SEQ ID NO: 473800 - DNA, 25 bp, Mus musculus
tccgggaagcgatgcccaagatcat

SEQ ID NO: 473801 - DNA, 25 bp, Mus musculus
tccgggacactcgaaggcactgtga

SEQ ID NO: 473802 - DNA, 25 bp, Mus musculus
tccgggaccttcgtcgagggctcaa

SEQ ID NO: 473803 - DNA, 25 bp, Mus musculus
tccgggacttaagcgaagggcacag

SEQ ID NO: 473804 - DNA, 25 bp, Mus musculus
tccgggagaagcacctggatcccat

SEQ ID NO: 473805 - DNA, 25 bp, Mus musculus
tccgggagcagtgaacaatgacaac

SEQ ID NO: 473806 - DNA, 25 bp, Mus musculus
tccgggagctggacatgggagccgc

SEQ ID NO: 473807 - DNA, 25 bp, Mus musculus
tccgggatagcactcggtagcagct

SEQ ID NO: 473808 - DNA, 25 bp, Mus musculus
tccgggatccggtagaagctactac

SEQ ID NO: 473809 - DNA, 25 bp, Mus musculus
tccgggatgggatgagtcttcaaac

SEQ ID NO: 473810 - DNA, 25 bp, Mus musculus
tccgggattctcatagtcagccaat

SEQ ID NO: 473811 - DNA, 25 bp, Mus musculus
tccgggcaggcagttcgtgtgaatc

SEQ ID NO: 473812 - DNA, 25 bp, Mus musculus
tccgggcatcgcagaagaaattggc

SEQ ID NO: 473813 - DNA, 25 bp, Mus musculus
tccgggcgcaggagatcatcaacat

SEQ ID NO: 473814 - DNA, 25 bp, Mus musculus
tccgggcgctgttgaagaatgcgtc

SEQ ID NO: 473815 - DNA, 25 bp, Mus musculus
tccgggctcccagttatctttagag

SEQ ID NO: 473816 - DNA, 25 bp, Mus musculus
tccgggctccggacgtagttgccgt

SEQ ID NO: 473817 - DNA, 25 bp, Mus musculus
tccgggctgcactacttacacgtct

SEQ ID NO: 473818 - DNA, 25 bp, Mus musculus
tccgggctgctcaacgacattcaga

SEQ ID NO: 473819 - DNA, 25 bp, Mus musculus
tccgggctttagatgcaagatgaaa

SEQ ID NO: 473820 - DNA, 25 bp, Mus musculus
tccgggtcggctcgtctgaaaatgt

SEQ ID NO: 473821 - DNA, 25 bp, Mus musculus
tccgggtgaccgcaagacacttact

SEQ ID NO: 473822 - DNA, 25 bp, Mus musculus
tccgggtggacaagagctgtgccta

SEQ ID NO: 473823 - DNA, 25 bp, Mus musculus
tccgggttaaagttgatgggcccag

SEQ ID NO: 473824 - DNA, 25 bp, Mus musculus
tccgggttccggctgagctgggcat

SEQ ID NO: 473825 - DNA, 25 bp, Mus musculus
tccggtacctagaggcagaaccagt

SEQ ID NO: 473826 - DNA, 25 bp, Mus musculus
tccggtagctcagaagtcaagaaac

SEQ ID NO: 473827 - DNA, 25 bp, Mus musculus
tccggtatctactccagggctgtgc

SEQ ID NO: 473828 - DNA, 25 bp, Mus musculus
tccggtatgctcaatgtcaaatggg

SEQ ID NO: 473829 - DNA, 25 bp, Mus musculus
tccggtatgtgcagagtctcaagga

SEQ ID NO: 473830 - DNA, 25 bp, Mus musculus
tccggtcagggaagcatacctagac

SEQ ID NO: 473831 - DNA, 25 bp, Mus musculus
tccggtcctgatgatgagcctctgc

SEQ ID NO: 473832 - DNA, 25 bp, Mus musculus
tccggtcggtctgcagtatggcggc

SEQ ID NO: 473833 - DNA, 25 bp, Mus musculus
tccggtcgtgctttgctagtggtcc

SEQ ID NO: 473834 - DNA, 25 bp, Mus musculus
tccggtctcttgatgaacttgaaca

SEQ ID NO: 473835 - DNA, 25 bp, Mus musculus
tccggtctgcctacaagatgtctgc

SEQ ID NO: 473836 - DNA, 25 bp, Mus musculus
tccggtgagggaacacatagtactg

SEQ ID NO: 473837 - DNA, 25 bp, Mus musculus
tccggtgctgctaaaagggctgcct

SEQ ID NO: 473838 - DNA, 25 bp, Mus musculus
tccggtgctttgtctgagggccagt

SEQ ID NO: 473839 - DNA, 25 bp, Mus musculus
tccggtgggtgtcagggttggcata

SEQ ID NO: 473840 - DNA, 25 bp, Mus musculus
tccggtggtttacgatcagctaagc

SEQ ID NO: 473841 - DNA, 25 bp, Mus musculus
tccggttcggatttggttcgcgtgc

SEQ ID NO: 473842 - DNA, 25 bp, Mus musculus
tccggttgtatgttccgggtcatca

SEQ ID NO: 473843 - DNA, 25 bp, Mus musculus
tccgtaaagtggttggattggatca

SEQ ID NO: 473844 - DNA, 25 bp, Mus musculus
tccgtacgagctgcagaagatgcct

SEQ ID NO: 473845 - DNA, 25 bp, Mus musculus
tccgtagaggacgatcaagcccctt

SEQ ID NO: 473846 - DNA, 25 bp, Mus musculus
tccgtagatcttcagagcgctgcag

SEQ ID NO: 473847 - DNA, 25 bp, Mus musculus
tccgtagcggaacaaaagatcttgg

SEQ ID NO: 473848 - DNA, 25 bp, Mus musculus
tccgtagtcaccgagtgcgaagtta

SEQ ID NO: 473849 - DNA, 25 bp, Mus musculus
tccgtatagcacttttgttcagaga

SEQ ID NO: 473850 - DNA, 25 bp, Mus musculus
tccgtcacaggtatacggccaggct

SEQ ID NO: 473851 - DNA, 25 bp, Mus musculus
tccgtcaggtcacaggtttcaggcc

SEQ ID NO: 473852 - DNA, 25 bp, Mus musculus
tccgtcatctctgcagagcttcaga

SEQ ID NO: 473853 - DNA, 25 bp, Mus musculus
tccgtcattcgggaggatccgtcca

SEQ ID NO: 473854 - DNA, 25 bp, Mus musculus
tccgtccgcacttgccgtgaagtgt

SEQ ID NO: 473855 - DNA, 25 bp, Mus musculus
tccgtccggagcaggaagtacgaaa

SEQ ID NO: 473856 - DNA, 25 bp, Mus musculus
tccgtcctggatggagaggtcatct

SEQ ID NO: 473857 - DNA, 25 bp, Mus musculus
tccgtcctggctcattaactgggca

SEQ ID NO: 473858 - DNA, 25 bp, Mus musculus
tccgtccttggagttgcacagctgg

SEQ ID NO: 473859 - DNA, 25 bp, Mus musculus
tccgtcgagctacggagcccagcta

SEQ ID NO: 473860 - DNA, 25 bp, Mus musculus
tccgtcgcggagataaggtggctct

SEQ ID NO: 473861 - DNA, 25 bp, Mus musculus
tccgtctagggaaaggtgatgcatg

SEQ ID NO: 473862 - DNA, 25 bp, Mus musculus
tccgtctgcacaaggtgcacgtgtg

SEQ ID NO: 473863 - DNA, 25 bp, Mus musculus
tccgtctggagacctgtgatgagcc

SEQ ID NO: 473864 - DNA, 25 bp, Mus musculus
tccgtgaaatggttcccgagttggg

SEQ ID NO: 473865 - DNA, 25 bp, Mus musculus
tccgtgacaatggagagccacctct

SEQ ID NO: 473866 - DNA, 25 bp, Mus musculus
tccgtgacagaacgcggttcggcct

SEQ ID NO: 473867 - DNA, 25 bp, Mus musculus
tccgtgacagtcaaaatgccccagt

SEQ ID NO: 473868 - DNA, 25 bp, Mus musculus
tccgtgactgaactcaatggagaca

SEQ ID NO: 473869 - DNA, 25 bp, Mus musculus
tccgtgagcccaaagaaatcgctgt

SEQ ID NO: 473870 - DNA, 25 bp, Mus musculus
tccgtgaggaagtgaacgtagacca

SEQ ID NO: 473871 - DNA, 25 bp, Mus musculus
tccgtgaggcggaaatttatcagac

SEQ ID NO: 473872 - DNA, 25 bp, Mus musculus
tccgtgatacagaaggcggtacgcc

SEQ ID NO: 473873 - DNA, 25 bp, Mus musculus
tccgtgatgacagggaacacctcca

SEQ ID NO: 473874 - DNA, 25 bp, Mus musculus
tccgtgattctgaggaggccagtag

SEQ ID NO: 473875 - DNA, 25 bp, Mus musculus
tccgtgattggatgttgttgcacag

SEQ ID NO: 473876 - DNA, 25 bp, Mus musculus
tccgtgcacttcgatggcgagacca

SEQ ID NO: 473877 - DNA, 25 bp, Mus musculus
tccgtgcagacacaggacgtcgaag

SEQ ID NO: 473878 - DNA, 25 bp, Mus musculus
tccgtgcaggctctttacagaagtc

SEQ ID NO: 473879 - DNA, 25 bp, Mus musculus
tccgtgcagtaaaccccaggatcag

SEQ ID NO: 473880 - DNA, 25 bp, Mus musculus
tccgtgcatgctacgagcgaaggcg

SEQ ID NO: 473881 - DNA, 25 bp, Mus musculus
tccgtgccgttgctttaatctagaa

SEQ ID NO: 473882 - DNA, 25 bp, Mus musculus
tccgtgcctgccaagggaggcagca

SEQ ID NO: 473883 - DNA, 25 bp, Mus musculus
tccgtgcctttttctgcgggaacct

SEQ ID NO: 473884 - DNA, 25 bp, Mus musculus
tccgtgctgtcccaggacgtcacag

SEQ ID NO: 473885 - DNA, 25 bp, Mus musculus
tccgtggacaaggagagcgacagct

SEQ ID NO: 473886 - DNA, 25 bp, Mus musculus
tccgtggacatgacctgtgagggct

SEQ ID NO: 473887 - DNA, 25 bp, Mus musculus
tccgtggaggccaaagagtatgcca

SEQ ID NO: 473888 - DNA, 25 bp, Mus musculus
tccgtggcactgagatgcagaaggc

SEQ ID NO: 473889 - DNA, 25 bp, Mus musculus
tccgtggcattgtatagacatagct

SEQ ID NO: 473890 - DNA, 25 bp, Mus musculus
tccgtgggaactgggcaatacttag

SEQ ID NO: 473891 - DNA, 25 bp, Mus musculus
tccgtggtattacgcggcggcactc

SEQ ID NO: 473892 - DNA, 25 bp, Mus musculus
tccgtggtgaagtcggagcccagct

SEQ ID NO: 473893 - DNA, 25 bp, Mus musculus
tccgtggtgccattgaacaaagtca

SEQ ID NO: 473894 - DNA, 25 bp, Mus musculus
tccgtgtccaaacgtcaagcatggg

SEQ ID NO: 473895 - DNA, 25 bp, Mus musculus
tccgtgtcctcttcccagattgcga

SEQ ID NO: 473896 - DNA, 25 bp, Mus musculus
tccgtgtcctgctaggcaagagccg

SEQ ID NO: 473897 - DNA, 25 bp, Mus musculus
tccgtgtcctgtgggtccctcgtaa

SEQ ID NO: 473898 - DNA, 25 bp, Mus musculus
tccgtgtgccctaccctgctgaagt

SEQ ID NO: 473899 - DNA, 25 bp, Mus musculus
tccgtgtggccagcataaacagcaa

SEQ ID NO: 473900 - DNA, 25 bp, Mus musculus
tccgtgtgtcatcagccaaactcga

SEQ ID NO: 473901 - DNA, 25 bp, Mus musculus
tccgtgttccaaagtgatgagcgag

SEQ ID NO: 473902 - DNA, 25 bp, Mus musculus
tccgtgttgatcgtgagggttctcc

SEQ ID NO: 473903 - DNA, 25 bp, Mus musculus
tccgttaaagaacatgagtactact

SEQ ID NO: 473904 - DNA, 25 bp, Mus musculus
tccgttaaggccaggactccagtgg

SEQ ID NO: 473905 - DNA, 25 bp, Mus musculus
tccgttaggcagagactgtgtcact

SEQ ID NO: 473906 - DNA, 25 bp, Mus musculus
tccgttcaaacagcataagtatcgc

SEQ ID NO: 473907 - DNA, 25 bp, Mus musculus
tccgttcatcgctctgtacacagaa

SEQ ID NO: 473908 - DNA, 25 bp, Mus musculus
tccgttcccggttgggcgatgagct

SEQ ID NO: 473909 - DNA, 25 bp, Mus musculus
tccgttccgagcaagagaggacagt

SEQ ID NO: 473910 - DNA, 25 bp, Mus musculus
tccgttcggagctgcgcgaagacga

SEQ ID NO: 473911 - DNA, 25 bp, Mus musculus
tccgttgctcagaaaggtaccagac

SEQ ID NO: 473912 - DNA, 25 bp, Mus musculus
tccgttgggctgaaataagagtggc

SEQ ID NO: 473913 - DNA, 25 bp, Mus musculus
tccgttggtctgtttaaccgacgag

SEQ ID NO: 473914 - DNA, 25 bp, Mus musculus
tccgtttagtgggaaatgacatcag

SEQ ID NO: 473915 - DNA, 25 bp, Mus musculus
tccgtttcccacgtgaagggccgtg

SEQ ID NO: 473916 - DNA, 25 bp, Mus musculus
tccgtttggcaaagagtggtaccac

SEQ ID NO: 473917 - DNA, 25 bp, Mus musculus
tcctaaaagtggctctgctttctgc

SEQ ID NO: 473918 - DNA, 25 bp, Mus musculus
tcctaaaatgaagcactatcaagag

SEQ ID NO: 473919 - DNA, 25 bp, Mus musculus
tcctaaaccaagaggtgatggcgcc

SEQ ID NO: 473920 - DNA, 25 bp, Mus musculus
tcctaaaggacccagtgcctggagt

SEQ ID NO: 473921 - DNA, 25 bp, Mus musculus
tcctaaaggagagaacagccacgtg

SEQ ID NO: 473922 - DNA, 25 bp, Mus musculus
tcctaaaggtcaactctgggcccgt

SEQ ID NO: 473923 - DNA, 25 bp, Mus musculus
tcctaaaggtgctggagatccggcc

SEQ ID NO: 473924 - DNA, 25 bp, Mus musculus
tcctaaatagaagaagggaaacgag

SEQ ID NO: 473925 - DNA, 25 bp, Mus musculus
tcctaacaaggagataatgagccac

SEQ ID NO: 473926 - DNA, 25 bp, Mus musculus
tcctaaccgtggaaccgtggaatgt

SEQ ID NO: 473927 - DNA, 25 bp, Mus musculus
tcctaacggaaaactaaagtgtgat

SEQ ID NO: 473928 - DNA, 25 bp, Mus musculus
tcctaacggattccagatcctggct

SEQ ID NO: 473929 - DNA, 25 bp, Mus musculus
tcctaactgaaatggccgagaactg

SEQ ID NO: 473930 - DNA, 25 bp, Mus musculus
tcctaagaccttccacggaactggg

SEQ ID NO: 473931 - DNA, 25 bp, Mus musculus
tcctaagatcacgtgcaggctcagt

SEQ ID NO: 473932 - DNA, 25 bp, Mus musculus
tcctaagccagaaagcagccctgag

SEQ ID NO: 473933 - DNA, 25 bp, Mus musculus
tcctaagctaagtcaccctggtgtc

SEQ ID NO: 473934 - DNA, 25 bp, Mus musculus
tcctaaggaggcaaacatcgctgaa

SEQ ID NO: 473935 - DNA, 25 bp, Mus musculus
tcctaaggcttacaggaccaacttc

SEQ ID NO: 473936 - DNA, 25 bp, Mus musculus
tcctaagggaggatcgtatttgcct

SEQ ID NO: 473937 - DNA, 25 bp, Mus musculus
tcctaaggttttgtgcccagcatac

SEQ ID NO: 473938 - DNA, 25 bp, Mus musculus
tcctaatattgtacagctgggcctc

SEQ ID NO: 473939 - DNA, 25 bp, Mus musculus
tcctaatgagccgtttctaatcttc

SEQ ID NO: 473940 - DNA, 25 bp, Mus musculus
tcctaatgatatggcagtggtgccc

SEQ ID NO: 473941 - DNA, 25 bp, Mus musculus
tcctaatgctacagaaatctcccag

SEQ ID NO: 473942 - DNA, 25 bp, Mus musculus
tcctaatggagatgccggtcgacct

SEQ ID NO: 473943 - DNA, 25 bp, Mus musculus
tcctaatgtacagcggacacgccgt

SEQ ID NO: 473944 - DNA, 25 bp, Mus musculus
tcctaattgggaacagctctgtgct

SEQ ID NO: 473945 - DNA, 25 bp, Mus musculus
tcctacaaccaagagactttccaaa

SEQ ID NO: 473946 - DNA, 25 bp, Mus musculus
tcctacaatgaagaggtgatccctc

SEQ ID NO: 473947 - DNA, 25 bp, Mus musculus
tcctacaggacacattcagagggtg

SEQ ID NO: 473948 - DNA, 25 bp, Mus musculus
tcctacaggagttggagtacggccc

SEQ ID NO: 473949 - DNA, 25 bp, Mus musculus
tcctacagggtcctggcaaaacagg

SEQ ID NO: 473950 - DNA, 25 bp, Mus musculus
tcctacagtgtcaagggcagagaca

SEQ ID NO: 473951 - DNA, 25 bp, Mus musculus
tcctacatagctgggaggagcaggc

SEQ ID NO: 473952 - DNA, 25 bp, Mus musculus
tcctacattagggtgctggctagcc

SEQ ID NO: 473953 - DNA, 25 bp, Mus musculus
tcctacatttgtggcaggtgagtgc

SEQ ID NO: 473954 - DNA, 25 bp, Mus musculus
tcctaccaggactgtacagatgaag

SEQ ID NO: 473955 - DNA, 25 bp, Mus musculus
tcctacccggtggagactctgctag

SEQ ID NO: 473956 - DNA, 25 bp, Mus musculus
tcctaccgggatattagccacctca

SEQ ID NO: 473957 - DNA, 25 bp, Mus musculus
tcctacctatcccagacgggagatt

SEQ ID NO: 473958 - DNA, 25 bp, Mus musculus
tcctacgaggagagcagagtggtcc

SEQ ID NO: 473959 - DNA, 25 bp, Mus musculus
tcctacgatccaaagactcaggtgt

SEQ ID NO: 473960 - DNA, 25 bp, Mus musculus
tcctacgctgtcataagagtgttgt

SEQ ID NO: 473961 - DNA, 25 bp, Mus musculus
tcctacggaaacagacggtgacatg

SEQ ID NO: 473962 - DNA, 25 bp, Mus musculus
tcctacggcagctcggcgtgacgga

SEQ ID NO: 473963 - DNA, 25 bp, Mus musculus
tcctacggccagctcaaggagcctt

SEQ ID NO: 473964 - DNA, 25 bp, Mus musculus
tcctacgggacgtgcagacagactg

SEQ ID NO: 473965 - DNA, 25 bp, Mus musculus
tcctacgggcaaactgatggatcag

SEQ ID NO: 473966 - DNA, 25 bp, Mus musculus
tcctacgtgagtgtgagcagcaacc

SEQ ID NO: 473967 - DNA, 25 bp, Mus musculus
tcctactacaccagagagggaggcc

SEQ ID NO: 473968 - DNA, 25 bp, Mus musculus
tcctactcatgggttcggctaacgg

SEQ ID NO: 473969 - DNA, 25 bp, Mus musculus
tcctactctgatactgggctgctgg

SEQ ID NO: 473970 - DNA, 25 bp, Mus musculus
tcctactgagacacttcggagagtc

SEQ ID NO: 473971 - DNA, 25 bp, Mus musculus
tcctactgataacttggagacctcc

SEQ ID NO: 473972 - DNA, 25 bp, Mus musculus
tcctactggcgatgtgcaaccgggt

SEQ ID NO: 473973 - DNA, 25 bp, Mus musculus
tcctacttggatgaggcagcttccg

SEQ ID NO: 473974 - DNA, 25 bp, Mus musculus
tcctagaagagaagattgccagcct

SEQ ID NO: 473975 - DNA, 25 bp, Mus musculus
tcctagaagatgagatatgattgcc

SEQ ID NO: 473976 - DNA, 25 bp, Mus musculus
tcctagacaggatgcagacgatggg

SEQ ID NO: 473977 - DNA, 25 bp, Mus musculus
tcctagagaatccttgtgggagaaa

SEQ ID NO: 473978 - DNA, 25 bp, Mus musculus
tcctagaggagtatataatgtgaca

SEQ ID NO: 473979 - DNA, 25 bp, Mus musculus
tcctagaggcttgagtgacagcagg

SEQ ID NO: 473980 - DNA, 25 bp, Mus musculus
tcctagagtctagagagaggctctt

SEQ ID NO: 473981 - DNA, 25 bp, Mus musculus
tcctagattccacttaccaaagcta

SEQ ID NO: 473982 - DNA, 25 bp, Mus musculus
tcctagcagcgcaattgggaacgcc

SEQ ID NO: 473983 - DNA, 25 bp, Mus musculus
tcctagccaagggatcagaaggccc

SEQ ID NO: 473984 - DNA, 25 bp, Mus musculus
tcctagcctgggatcagccatgagt

SEQ ID NO: 473985 - DNA, 25 bp, Mus musculus
tcctagcgggagtcactgtctgaag

SEQ ID NO: 473986 - DNA, 25 bp, Mus musculus
tcctagctgtagaagcaaatgccgt

SEQ ID NO: 473987 - DNA, 25 bp, Mus musculus
tcctagctgtatatgttgcccaggg

SEQ ID NO: 473988 - DNA, 25 bp, Mus musculus
tcctaggaacaccaacaagggagca

SEQ ID NO: 473989 - DNA, 25 bp, Mus musculus
tcctaggaagttgcaaggccagcag

SEQ ID NO: 473990 - DNA, 25 bp, Mus musculus
tcctaggaatggaagacagagcttg

SEQ ID NO: 473991 - DNA, 25 bp, Mus musculus
tcctaggacagacgctgaaggcttc

SEQ ID NO: 473992 - DNA, 25 bp, Mus musculus
tcctaggacagggagttcaattgcc

SEQ ID NO: 473993 - DNA, 25 bp, Mus musculus
tcctaggagatgagatttgctgctg

SEQ ID NO: 473994 - DNA, 25 bp, Mus musculus
tcctaggagtggtttgcacctgccc

SEQ ID NO: 473995 - DNA, 25 bp, Mus musculus
tcctaggatgatatcagagacctca

SEQ ID NO: 473996 - DNA, 25 bp, Mus musculus
tcctaggccactgggttgtgtgtac

SEQ ID NO: 473997 - DNA, 25 bp, Mus musculus
tcctagggaacgtagggcacctgca

SEQ ID NO: 473998 - DNA, 25 bp, Mus musculus
tcctagggcttctcggtgagcgaag

SEQ ID NO: 473999 - DNA, 25 bp, Mus musculus
tcctaggtaagcgtcagtctatgcc

SEQ ID NO: 474000 - DNA, 25 bp, Mus musculus
tcctaggtggccagagttgtgactc

SEQ ID NO: 474001 - DNA, 25 bp, Mus musculus
tcctagtagagtcccctttgccggg

SEQ ID NO: 474002 - DNA, 25 bp, Mus musculus
tcctagtatgtataattgtcttagt

SEQ ID NO: 474003 - DNA, 25 bp, Mus musculus
tcctagtcaaagacggcaaaccctg

SEQ ID NO: 474004 - DNA, 25 bp, Mus musculus
tcctagtcaggtgtgaggtgtcccg

SEQ ID NO: 474005 - DNA, 25 bp, Mus musculus
tcctagtgccttagagatgacctta

SEQ ID NO: 474006 - DNA, 25 bp, Mus musculus
tcctagtggacgacaaagtgctgtt

SEQ ID NO: 474007 - DNA, 25 bp, Mus musculus
tcctagtgggatcaaacacctcgca

SEQ ID NO: 474008 - DNA, 25 bp, Mus musculus
tcctagtttctgtaaccacgggatt

SEQ ID NO: 474009 - DNA, 25 bp, Mus musculus
tcctatactagaggagggcagtcct

SEQ ID NO: 474010 - DNA, 25 bp, Mus musculus
tcctatagattagaggactcacagt

SEQ ID NO: 474011 - DNA, 25 bp, Mus musculus
tcctataggcagtacggagcgtacc

SEQ ID NO: 474012 - DNA, 25 bp, Mus musculus
tcctatatgtcaagagcagtgctcc

SEQ ID NO: 474013 - DNA, 25 bp, Mus musculus
tcctatccctttgccgctgtgtgga

SEQ ID NO: 474014 - DNA, 25 bp, Mus musculus
tcctatcctcagctatgtcagtcag

SEQ ID NO: 474015 - DNA, 25 bp, Mus musculus
tcctatcctcatatccctggtagca

SEQ ID NO: 474016 - DNA, 25 bp, Mus musculus
tcctatcctggttccccttggtcgg

SEQ ID NO: 474017 - DNA, 25 bp, Mus musculus
tcctatgaaaatagtcatcagaagg

SEQ ID NO: 474018 - DNA, 25 bp, Mus musculus
tcctatgagggtcaacagcatggcc

SEQ ID NO: 474019 - DNA, 25 bp, Mus musculus
tcctatgattacagcgcgggctaca

SEQ ID NO: 474020 - DNA, 25 bp, Mus musculus
tcctatgcacagtagggcattctat

SEQ ID NO: 474021 - DNA, 25 bp, Mus musculus
tcctatggaggtggttccagctgcg

SEQ ID NO: 474022 - DNA, 25 bp, Mus musculus
tcctatggatggtcatgcctgccct

SEQ ID NO: 474023 - DNA, 25 bp, Mus musculus
tcctatggccaagtgaaatccagtg

SEQ ID NO: 474024 - DNA, 25 bp, Mus musculus
tcctatggtctccagactgtaaact

SEQ ID NO: 474025 - DNA, 25 bp, Mus musculus
tcctatggtgtgagcttctctgctg

SEQ ID NO: 474026 - DNA, 25 bp, Mus musculus
tcctattaaaatgtcagccagatgc

SEQ ID NO: 474027 - DNA, 25 bp, Mus musculus
tcctattaagctcgttggcgagttc

SEQ ID NO: 474028 - DNA, 25 bp, Mus musculus
tcctattcaaggaagagacctcggg

SEQ ID NO: 474029 - DNA, 25 bp, Mus musculus
tcctattggactcagtatgggcgcc

SEQ ID NO: 474030 - DNA, 25 bp, Mus musculus
tcctattggttctgaaagctctgca

SEQ ID NO: 474031 - DNA, 25 bp, Mus musculus
tcctcaaaaggacagagatgcacct

SEQ ID NO: 474032 - DNA, 25 bp, Mus musculus
tcctcaaaatgagtagctgtcctca

SEQ ID NO: 474033 - DNA, 25 bp, Mus musculus
tcctcaaagtttactgcacctcaag

SEQ ID NO: 474034 - DNA, 25 bp, Mus musculus
tcctcaaatgctgcaagagaaaata

SEQ ID NO: 474035 - DNA, 25 bp, Mus musculus
tcctcaacaaggaggtaggtgaagc

SEQ ID NO: 474036 - DNA, 25 bp, Mus musculus
tcctcaacgcacataggaagtgtgt

SEQ ID NO: 474037 - DNA, 25 bp, Mus musculus
tcctcaagagatggagcaaatcaaa

SEQ ID NO: 474038 - DNA, 25 bp, Mus musculus
tcctcaagccagagaaccagtgacg

SEQ ID NO: 474039 - DNA, 25 bp, Mus musculus
tcctcaagcgtctgctcacagggac

SEQ ID NO: 474040 - DNA, 25 bp, Mus musculus
tcctcaaggaaaagagacgcacgca

SEQ ID NO: 474041 - DNA, 25 bp, Mus musculus
tcctcaaggcagagaagactacttt

SEQ ID NO: 474042 - DNA, 25 bp, Mus musculus
tcctcaatggttgtgaaaacggccg

SEQ ID NO: 474043 - DNA, 25 bp, Mus musculus
tcctcacacaagaaagttcctgctg

SEQ ID NO: 474044 - DNA, 25 bp, Mus musculus
tcctcaccgaggaagggctactgct

SEQ ID NO: 474045 - DNA, 25 bp, Mus musculus
tcctcaccgaggttcctgggttgta

SEQ ID NO: 474046 - DNA, 25 bp, Mus musculus
tcctcacgaaggcaagtctgcggag

SEQ ID NO: 474047 - DNA, 25 bp, Mus musculus
tcctcactacgaggactgtcatgca

SEQ ID NO: 474048 - DNA, 25 bp, Mus musculus
tcctcactcacacagatgcaaacgt

SEQ ID NO: 474049 - DNA, 25 bp, Mus musculus
tcctcactgcccagtgggcacaatg

SEQ ID NO: 474050 - DNA, 25 bp, Mus musculus
tcctcactggagaatgcagtcagcg

SEQ ID NO: 474051 - DNA, 25 bp, Mus musculus
tcctcactgtgcaagaacagggctt

SEQ ID NO: 474052 - DNA, 25 bp, Mus musculus
tcctcactgttcagactccctgtga

SEQ ID NO: 474053 - DNA, 25 bp, Mus musculus
tcctcagaagacctagagaagtcct

SEQ ID NO: 474054 - DNA, 25 bp, Mus musculus
tcctcagaccaagccattggaaggt

SEQ ID NO: 474055 - DNA, 25 bp, Mus musculus
tcctcagacctgcaagggacaaggg

SEQ ID NO: 474056 - DNA, 25 bp, Mus musculus
tcctcagacgacaagagtggacccg

SEQ ID NO: 474057 - DNA, 25 bp, Mus musculus
tcctcagagtgcctcttctccctgt

SEQ ID NO: 474058 - DNA, 25 bp, Mus musculus
tcctcagatgggtagacagacctcc

SEQ ID NO: 474059 - DNA, 25 bp, Mus musculus
tcctcagcagggatggacaagaccc

SEQ ID NO: 474060 - DNA, 25 bp, Mus musculus
tcctcagccttgtgggtaacagcct

SEQ ID NO: 474061 - DNA, 25 bp, Mus musculus
tcctcagcttagagaccaggcttcg

SEQ ID NO: 474062 - DNA, 25 bp, Mus musculus
tcctcaggaagaaataacagtgggc

SEQ ID NO: 474063 - DNA, 25 bp, Mus musculus
tcctcaggacgactacagctatgac

SEQ ID NO: 474064 - DNA, 25 bp, Mus musculus
tcctcaggatcccatgagttcaagg

SEQ ID NO: 474065 - DNA, 25 bp, Mus musculus
tcctcaggatggagatccggctccg

SEQ ID NO: 474066 - DNA, 25 bp, Mus musculus
tcctcagggaaaacgcataccatgg

SEQ ID NO: 474067 - DNA, 25 bp, Mus musculus
tcctcaggtacaggatggccgcgtt

SEQ ID NO: 474068 - DNA, 25 bp, Mus musculus
tcctcaggtcctgtgtagacgcagt

SEQ ID NO: 474069 - DNA, 25 bp, Mus musculus
tcctcaggtctgcaagctgctggga

SEQ ID NO: 474070 - DNA, 25 bp, Mus musculus
tcctcagtatgaaaccgaatgtagt

SEQ ID NO: 474071 - DNA, 25 bp, Mus musculus
tcctcagtccagaaacattcaaggg

SEQ ID NO: 474072 - DNA, 25 bp, Mus musculus
tcctcagtgacaaaagtgctgctgc

SEQ ID NO: 474073 - DNA, 25 bp, Mus musculus
tcctcagtgacctaaaaagccggct

SEQ ID NO: 474074 - DNA, 25 bp, Mus musculus
tcctcagtgattggagaaagctata

SEQ ID NO: 474075 - DNA, 25 bp, Mus musculus
tcctcagttggaaaaagatcagccc

SEQ ID NO: 474076 - DNA, 25 bp, Mus musculus
tcctcatacaaaaggacaccagaag

SEQ ID NO: 474077 - DNA, 25 bp, Mus musculus
tcctcatccccgttgttgcgcggtg

SEQ ID NO: 474078 - DNA, 25 bp, Mus musculus
tcctcatgacccgaatgctgctgta

SEQ ID NO: 474079 - DNA, 25 bp, Mus musculus
tcctcatgagacatgtggccagtta

SEQ ID NO: 474080 - DNA, 25 bp, Mus musculus
tcctcatgaggtctgctaccaacca

SEQ ID NO: 474081 - DNA, 25 bp, Mus musculus
tcctcatgcgatttctcttttctgt

SEQ ID NO: 474082 - DNA, 25 bp, Mus musculus
tcctcatggatgagcagcacagttt

SEQ ID NO: 474083 - DNA, 25 bp, Mus musculus
tcctcatggcacgagaaggcatctg

SEQ ID NO: 474084 - DNA, 25 bp, Mus musculus
tcctccaaaccttactagtaacagg

SEQ ID NO: 474085 - DNA, 25 bp, Mus musculus
tcctccaactgggaatgctaaaacg

SEQ ID NO: 474086 - DNA, 25 bp, Mus musculus
tcctccaagggaaacatggtggctt

SEQ ID NO: 474087 - DNA, 25 bp, Mus musculus
tcctccaattctgaaccaagaacaa

SEQ ID NO: 474088 - DNA, 25 bp, Mus musculus
tcctccacccttaaacagcaccaaa

SEQ ID NO: 474089 - DNA, 25 bp, Mus musculus
tcctccacgtcagtcttgagatgtc

SEQ ID NO: 474090 - DNA, 25 bp, Mus musculus
tcctccagaaaacgtggtggcccgg

SEQ ID NO: 474091 - DNA, 25 bp, Mus musculus
tcctccagatcgctcagaagtaaag

SEQ ID NO: 474092 - DNA, 25 bp, Mus musculus
tcctccagccgtgagaatttgtcag

SEQ ID NO: 474093 - DNA, 25 bp, Mus musculus
tcctccagcgaatgggcagatctca

SEQ ID NO: 474094 - DNA, 25 bp, Mus musculus
tcctccagctggacttcctagagat

SEQ ID NO: 474095 - DNA, 25 bp, Mus musculus
tcctccaggagacgcggtgatagat

SEQ ID NO: 474096 - DNA, 25 bp, Mus musculus
tcctccaggagctcaaaaggtgtca

SEQ ID NO: 474097 - DNA, 25 bp, Mus musculus
tcctccaggcggtgatattctagaa

SEQ ID NO: 474098 - DNA, 25 bp, Mus musculus
tcctccagtgacaatgtgttcaagt

SEQ ID NO: 474099 - DNA, 25 bp, Mus musculus
tcctccagtgcagaaagtacagata

SEQ ID NO: 474100 - DNA, 25 bp, Mus musculus
tcctccagtggtgactctcctgtga

SEQ ID NO: 474101 - DNA, 25 bp, Mus musculus
tcctccatgaagaagctcgtggcct

SEQ ID NO: 474102 - DNA, 25 bp, Mus musculus
tcctcccacttggaaggtgcgatcg

SEQ ID NO: 474103 - DNA, 25 bp, Mus musculus
tcctcccagaagcagtgcagtggat

SEQ ID NO: 474104 - DNA, 25 bp, Mus musculus
tcctcccaggatctcacgaaggatg

SEQ ID NO: 474105 - DNA, 25 bp, Mus musculus
tcctccccaagaagattttcattaa

SEQ ID NO: 474106 - DNA, 25 bp, Mus musculus
tcctccccgttacgctccaggcttt

SEQ ID NO: 474107 - DNA, 25 bp, Mus musculus
tcctcccctgtgtgcaaatatgcca

SEQ ID NO: 474108 - DNA, 25 bp, Mus musculus
tcctcccgagatctgcgattcggtc

SEQ ID NO: 474109 - DNA, 25 bp, Mus musculus
tcctcccgggaggaggctaacctga

SEQ ID NO: 474110 - DNA, 25 bp, Mus musculus
tcctccctggtcatcttctcgtgtg

SEQ ID NO: 474111 - DNA, 25 bp, Mus musculus
tcctccgacaagaaatgggctggtt

SEQ ID NO: 474112 - DNA, 25 bp, Mus musculus
tcctccgagaaccaggtagaatgct

SEQ ID NO: 474113 - DNA, 25 bp, Mus musculus
tcctccgagatggaagcaaggcctc

SEQ ID NO: 474114 - DNA, 25 bp, Mus musculus
tcctccgagcaagaagtgtgttact

SEQ ID NO: 474115 - DNA, 25 bp, Mus musculus
tcctccgaggttcctaaatctgtct

SEQ ID NO: 474116 - DNA, 25 bp, Mus musculus
tcctccgagtggaaagtacagcagc

SEQ ID NO: 474117 - DNA, 25 bp, Mus musculus
tcctccgccggatgaagaagcagta

SEQ ID NO: 474118 - DNA, 25 bp, Mus musculus
tcctccgcggctctgattgcttacg

SEQ ID NO: 474119 - DNA, 25 bp, Mus musculus
tcctccggacagagttcggtgctcc

SEQ ID NO: 474120 - DNA, 25 bp, Mus musculus
tcctccgggaagaagtctgactcct

SEQ ID NO: 474121 - DNA, 25 bp, Mus musculus
tcctccgggaggtgtctgctgtcta

SEQ ID NO: 474122 - DNA, 25 bp, Mus musculus
tcctccgtaagggtaagaagtgctc

SEQ ID NO: 474123 - DNA, 25 bp, Mus musculus
tcctccgtgacttgaagggctgcag

SEQ ID NO: 474124 - DNA, 25 bp, Mus musculus
tcctccgtttttggtggctgggaag

SEQ ID NO: 474125 - DNA, 25 bp, Mus musculus
tcctcctagttccacctatgaggag

SEQ ID NO: 474126 - DNA, 25 bp, Mus musculus
tcctcctgaaggaagtcgagccgtg

SEQ ID NO: 474127 - DNA, 25 bp, Mus musculus
tcctcctgaatctgggcagaaagca

SEQ ID NO: 474128 - DNA, 25 bp, Mus musculus
tcctcctgcgtagggacggttcggt

SEQ ID NO: 474129 - DNA, 25 bp, Mus musculus
tcctcctggagatgcacttgtgagt

SEQ ID NO: 474130 - DNA, 25 bp, Mus musculus
tcctcctggcaagaagatgcgcacg

SEQ ID NO: 474131 - DNA, 25 bp, Mus musculus
tcctcctggcaatcatcctggtgct

SEQ ID NO: 474132 - DNA, 25 bp, Mus musculus
tcctcctgggagattgcctgcacaa

SEQ ID NO: 474133 - DNA, 25 bp, Mus musculus
tcctcctgggtacaagctggtcact

SEQ ID NO: 474134 - DNA, 25 bp, Mus musculus
tcctcctggtgatgtacgtgtcctg

SEQ ID NO: 474135 - DNA, 25 bp, Mus musculus
tcctccttagaacctgggctcttag

SEQ ID NO: 474136 - DNA, 25 bp, Mus musculus
tcctccttgagctgcatactatact

SEQ ID NO: 474137 - DNA, 25 bp, Mus musculus
tcctccttgggagtgacaaaccagg

SEQ ID NO: 474138 - DNA, 25 bp, Mus musculus
tcctcctttgtgattctggacagga

SEQ ID NO: 474139 - DNA, 25 bp, Mus musculus
tcctcgaatttcttaaactgtttct

SEQ ID NO: 474140 - DNA, 25 bp, Mus musculus
tcctcgagaagggtactctggatgc

SEQ ID NO: 474141 - DNA, 25 bp, Mus musculus
tcctcgagtgaagtcaggacgcttc

SEQ ID NO: 474142 - DNA, 25 bp, Mus musculus
tcctcgccagtttgcttttagtcaa

SEQ ID NO: 474143 - DNA, 25 bp, Mus musculus
tcctcgccttcctgaaacagtcaga

SEQ ID NO: 474144 - DNA, 25 bp, Mus musculus
tcctcgcggatcgaagagactctag

SEQ ID NO: 474145 - DNA, 25 bp, Mus musculus
tcctcggaatcatggcggtagccct

SEQ ID NO: 474146 - DNA, 25 bp, Mus musculus
tcctcggaatgtcctgtgtgcccca

SEQ ID NO: 474147 - DNA, 25 bp, Mus musculus
tcctcggaggagtcagaaaacgccg

SEQ ID NO: 474148 - DNA, 25 bp, Mus musculus
tcctcggatctttgcacctctgtat

SEQ ID NO: 474149 - DNA, 25 bp, Mus musculus
tcctcggatggcataggttggagct

SEQ ID NO: 474150 - DNA, 25 bp, Mus musculus
tcctcggattcacctcggtcgctgt

SEQ ID NO: 474151 - DNA, 25 bp, Mus musculus
tcctcggccatcgaaaggaagagcc

SEQ ID NO: 474152 - DNA, 25 bp, Mus musculus
tcctcggccttctaaatgattggag

SEQ ID NO: 474153 - DNA, 25 bp, Mus musculus
tcctcgggacatcatgcggagtgcc

SEQ ID NO: 474154 - DNA, 25 bp, Mus musculus
tcctcggtttaagaggcaacacaac

SEQ ID NO: 474155 - DNA, 25 bp, Mus musculus
tcctcggtttccatggagaccaaag

SEQ ID NO: 474156 - DNA, 25 bp, Mus musculus
tcctcgtcctccaaaataatcagat

SEQ ID NO: 474157 - DNA, 25 bp, Mus musculus
tcctcgtcctggtgattcacgcgca

SEQ ID NO: 474158 - DNA, 25 bp, Mus musculus
tcctcgtcgcatgcatgtgctgctg

SEQ ID NO: 474159 - DNA, 25 bp, Mus musculus
tcctcgtggaaggttcgcagctctc

SEQ ID NO: 474160 - DNA, 25 bp, Mus musculus
tcctcgtggagggtggtcgcaccca

SEQ ID NO: 474161 - DNA, 25 bp, Mus musculus
tcctcgtgggccgtggataacctac

SEQ ID NO: 474162 - DNA, 25 bp, Mus musculus
tcctcgtgggctgcaagaaactgag

SEQ ID NO: 474163 - DNA, 25 bp, Mus musculus
tcctcgttgatactggtggaaccca

SEQ ID NO: 474164 - DNA, 25 bp, Mus musculus
tcctctaacctccaggcaggaaaag

SEQ ID NO: 474165 - DNA, 25 bp, Mus musculus
tcctctaatacagggcatccggaca

SEQ ID NO: 474166 - DNA, 25 bp, Mus musculus
tcctctaattgagacgtttctgtgg

SEQ ID NO: 474167 - DNA, 25 bp, Mus musculus
tcctctacccagaaactgtctgctg

SEQ ID NO: 474168 - DNA, 25 bp, Mus musculus
tcctctacccgaaggtggcagctag

SEQ ID NO: 474169 - DNA, 25 bp, Mus musculus
tcctctaggaaaaaagggctgctgc

SEQ ID NO: 474170 - DNA, 25 bp, Mus musculus
tcctctagtaatagggttaggccgg

SEQ ID NO: 474171 - DNA, 25 bp, Mus musculus
tcctctagtccagaaggagtcctca

SEQ ID NO: 474172 - DNA, 25 bp, Mus musculus
tcctctatgaggagcggcacagtgg

SEQ ID NO: 474173 - DNA, 25 bp, Mus musculus
tcctctcacatggtgtggaaggtgg

SEQ ID NO: 474174 - DNA, 25 bp, Mus musculus
tcctctcacggaggcatctctgggt

SEQ ID NO: 474175 - DNA, 25 bp, Mus musculus
tcctctcagagcaaaatagacatgc

SEQ ID NO: 474176 - DNA, 25 bp, Mus musculus
tcctctcagtaagctgcatctatga

SEQ ID NO: 474177 - DNA, 25 bp, Mus musculus
tcctctccagcgtgcaggaagacta

SEQ ID NO: 474178 - DNA, 25 bp, Mus musculus
tcctctcctctagccggctgggcat

SEQ ID NO: 474179 - DNA, 25 bp, Mus musculus
tcctctcgggagtaggctggagcca

SEQ ID NO: 474180 - DNA, 25 bp, Mus musculus
tcctctcgggcattttggtgctcat

SEQ ID NO: 474181 - DNA, 25 bp, Mus musculus
tcctctcggtggacagagcacagag

SEQ ID NO: 474182 - DNA, 25 bp, Mus musculus
tcctctcggtggcagccgtcgcttg

SEQ ID NO: 474183 - DNA, 25 bp, Mus musculus
tcctctctaagctgcgatcgccgtg

SEQ ID NO: 474184 - DNA, 25 bp, Mus musculus
tcctctctctgacccgggtcaggta

SEQ ID NO: 474185 - DNA, 25 bp, Mus musculus
tcctctctgcaacagcacagggcga

SEQ ID NO: 474186 - DNA, 25 bp, Mus musculus
tcctctctttgcaggcgaggtccaa

SEQ ID NO: 474187 - DNA, 25 bp, Mus musculus
tcctctctttgctttcggagaatga

SEQ ID NO: 474188 - DNA, 25 bp, Mus musculus
tcctctgaacgaggcgttggcccag

SEQ ID NO: 474189 - DNA, 25 bp, Mus musculus
tcctctgacaaggtctgcggcgctg

SEQ ID NO: 474190 - DNA, 25 bp, Mus musculus
tcctctgagaagattacttggaacc

SEQ ID NO: 474191 - DNA, 25 bp, Mus musculus
tcctctgagagcaaccgggatcgga

SEQ ID NO: 474192 - DNA, 25 bp, Mus musculus
tcctctgagagctgcctgattgtag

SEQ ID NO: 474193 - DNA, 25 bp, Mus musculus
tcctctgagctaagtgagggttcca

SEQ ID NO: 474194 - DNA, 25 bp, Mus musculus
tcctctgaggatcgtttcctgctgg

SEQ ID NO: 474195 - DNA, 25 bp, Mus musculus
tcctctgaggatgggaccactgtct

SEQ ID NO: 474196 - DNA, 25 bp, Mus musculus
tcctctgagggagattgacaagacc

SEQ ID NO: 474197 - DNA, 25 bp, Mus musculus
tcctctgcaggtaaaatgacatcta

SEQ ID NO: 474198 - DNA, 25 bp, Mus musculus
tcctctgccagatcccaatcatgta

SEQ ID NO: 474199 - DNA, 25 bp, Mus musculus
tcctctgcgatgaagttgaaacctg

SEQ ID NO: 474200 - DNA, 25 bp, Mus musculus
tcctctgctcgggatctcatgaagg

SEQ ID NO: 474201 - DNA, 25 bp, Mus musculus
tcctctggaggaaaagtagttagta

SEQ ID NO: 474202 - DNA, 25 bp, Mus musculus
tcctctggctttagtgtagcgacaa

SEQ ID NO: 474203 - DNA, 25 bp, Mus musculus
tcctctggttcatgggtcaccacga

SEQ ID NO: 474204 - DNA, 25 bp, Mus musculus
tcctctgtaaagtgagaggcgttgg

SEQ ID NO: 474205 - DNA, 25 bp, Mus musculus
tcctctgtagctttggttggtccca

SEQ ID NO: 474206 - DNA, 25 bp, Mus musculus
tcctctgtcaacgatgggctctgca

SEQ ID NO: 474207 - DNA, 25 bp, Mus musculus
tcctctgtcaggagaatgatctatc

SEQ ID NO: 474208 - DNA, 25 bp, Mus musculus
tcctctgtcatttaacaaaagagaa

SEQ ID NO: 474209 - DNA, 25 bp, Mus musculus
tcctctgtgatgtgagcggctgtgt

SEQ ID NO: 474210 - DNA, 25 bp, Mus musculus
tcctctgtgcttaaacagcgcccat

SEQ ID NO: 474211 - DNA, 25 bp, Mus musculus
tcctctgtgggccacttcagaaagc

SEQ ID NO: 474212 - DNA, 25 bp, Mus musculus
tcctcttacagcagggagtctggag

SEQ ID NO: 474213 - DNA, 25 bp, Mus musculus
tcctcttactctggtgggtctaaag

SEQ ID NO: 474214 - DNA, 25 bp, Mus musculus
tcctcttaggagctggcatatcatc

SEQ ID NO: 474215 - DNA, 25 bp, Mus musculus
tcctcttgaaaaagccgaagacccg

SEQ ID NO: 474216 - DNA, 25 bp, Mus musculus
tcctcttgatttgccggtttctttg

SEQ ID NO: 474217 - DNA, 25 bp, Mus musculus
tcctcttgctgttagcggagcgctt

SEQ ID NO: 474218 - DNA, 25 bp, Mus musculus
tcctcttggactcgcctcttctgga

SEQ ID NO: 474219 - DNA, 25 bp, Mus musculus
tcctcttgtcttgttccctgtgaac

SEQ ID NO: 474220 - DNA, 25 bp, Mus musculus
tcctcttgtgctaaagctgagccgc

SEQ ID NO: 474221 - DNA, 25 bp, Mus musculus
tcctctttagtgatggcgaggctga

SEQ ID NO: 474222 - DNA, 25 bp, Mus musculus
tcctctttgcaataaactgcgagca

SEQ ID NO: 474223 - DNA, 25 bp, Mus musculus
tcctgaaacacctcgcggagaaacg

SEQ ID NO: 474224 - DNA, 25 bp, Mus musculus
tcctgaaacaggttgcccgggacaa

SEQ ID NO: 474225 - DNA, 25 bp, Mus musculus
tcctgaaagccatcgaccagtactg

SEQ ID NO: 474226 - DNA, 25 bp, Mus musculus
tcctgaaaggagagattgccacgcc

SEQ ID NO: 474227 - DNA, 25 bp, Mus musculus
tcctgaaatgaacgaggcagccgtg

SEQ ID NO: 474228 - DNA, 25 bp, Mus musculus
tcctgaacagctaatatctaaataa

SEQ ID NO: 474229 - DNA, 25 bp, Mus musculus
tcctgaacggtagaggccaagcgag

SEQ ID NO: 474230 - DNA, 25 bp, Mus musculus
tcctgaactgctttcctacactggg

SEQ ID NO: 474231 - DNA, 25 bp, Mus musculus
tcctgaagaatactccctgtatcta

SEQ ID NO: 474232 - DNA, 25 bp, Mus musculus
tcctgaagatgctggaggtacccta

SEQ ID NO: 474233 - DNA, 25 bp, Mus musculus
tcctgaagcatgctgaccgtgagca

SEQ ID NO: 474234 - DNA, 25 bp, Mus musculus
tcctgaagcgacaccggaaactctt

SEQ ID NO: 474235 - DNA, 25 bp, Mus musculus
tcctgaagcgtcactgaatgcatcg

SEQ ID NO: 474236 - DNA, 25 bp, Mus musculus
tcctgaaggagtgccctatcggccg

SEQ ID NO: 474237 - DNA, 25 bp, Mus musculus
tcctgaaggatcatgacaaacacca

SEQ ID NO: 474238 - DNA, 25 bp, Mus musculus
tcctgaaggcgctgaaagatgaaaa

SEQ ID NO: 474239 - DNA, 25 bp, Mus musculus
tcctgaaggctcgtgtgaatgactc

SEQ ID NO: 474240 - DNA, 25 bp, Mus musculus
tcctgaaggtgctggtctgagtttg

SEQ ID NO: 474241 - DNA, 25 bp, Mus musculus
tcctgaagtctctgcaatggagggc

SEQ ID NO: 474242 - DNA, 25 bp, Mus musculus
tcctgaagtgcccatggagatgccc

SEQ ID NO: 474243 - DNA, 25 bp, Mus musculus
tcctgaatctatccacctgtctttg

SEQ ID NO: 474244 - DNA, 25 bp, Mus musculus
tcctgaatgacgaaagggccattgc

SEQ ID NO: 474245 - DNA, 25 bp, Mus musculus
tcctgaatgcccgttgctggacaca

SEQ ID NO: 474246 - DNA, 25 bp, Mus musculus
tcctgaatgccctgtgtaagctggc

SEQ ID NO: 474247 - DNA, 25 bp, Mus musculus
tcctgaatgtgttacgaagctggct

SEQ ID NO: 474248 - DNA, 25 bp, Mus musculus
tcctgaatttcagaggcttctggaa

SEQ ID NO: 474249 - DNA, 25 bp, Mus musculus
tcctgacaacacaaccttgctgaag

SEQ ID NO: 474250 - DNA, 25 bp, Mus musculus
tcctgacaccgctattttagctggt

SEQ ID NO: 474251 - DNA, 25 bp, Mus musculus
tcctgacacctttccggacgttaag

SEQ ID NO: 474252 - DNA, 25 bp, Mus musculus
tcctgacacgagagcttgggactga

SEQ ID NO: 474253 - DNA, 25 bp, Mus musculus
tcctgacactattgagcagactgct

SEQ ID NO: 474254 - DNA, 25 bp, Mus musculus
tcctgacagacatgggaagccacag

SEQ ID NO: 474255 - DNA, 25 bp, Mus musculus
tcctgacagcagtgttaggcagcgg

SEQ ID NO: 474256 - DNA, 25 bp, Mus musculus
tcctgaccagtcacgagggccgtga

SEQ ID NO: 474257 - DNA, 25 bp, Mus musculus
tcctgaccgtggtgcctccaacgtt

SEQ ID NO: 474258 - DNA, 25 bp, Mus musculus
tcctgacctgacttggttggatgac

SEQ ID NO: 474259 - DNA, 25 bp, Mus musculus
tcctgacgggtgaagactggaactc

SEQ ID NO: 474260 - DNA, 25 bp, Mus musculus
tcctgactatggtgcgcacagaggg

SEQ ID NO: 474261 - DNA, 25 bp, Mus musculus
tcctgactcgcatgagataacactg

SEQ ID NO: 474262 - DNA, 25 bp, Mus musculus
tcctgactgcaatgagagaaagtgg

SEQ ID NO: 474263 - DNA, 25 bp, Mus musculus
tcctgactgcttgggttaaagccct

SEQ ID NO: 474264 - DNA, 25 bp, Mus musculus
tcctgacttgaggtgtggagagccc

SEQ ID NO: 474265 - DNA, 25 bp, Mus musculus
tcctgagaaactactggcagtggtt

SEQ ID NO: 474266 - DNA, 25 bp, Mus musculus
tcctgagaacaactctagcacatag

SEQ ID NO: 474267 - DNA, 25 bp, Mus musculus
tcctgagacagaagagcaccagggt

SEQ ID NO: 474268 - DNA, 25 bp, Mus musculus
tcctgagacccaactacaagctgtg

SEQ ID NO: 474269 - DNA, 25 bp, Mus musculus
tcctgagacggttctcagggaccct

SEQ ID NO: 474270 - DNA, 25 bp, Mus musculus
tcctgagagtcatccgcctagtaag

SEQ ID NO: 474271 - DNA, 25 bp, Mus musculus
tcctgagagtgagcagcagtggcct

SEQ ID NO: 474272 - DNA, 25 bp, Mus musculus
tcctgagagttctgtgagccaagca

SEQ ID NO: 474273 - DNA, 25 bp, Mus musculus
tcctgagatagttaacttgcattca

SEQ ID NO: 474274 - DNA, 25 bp, Mus musculus
tcctgagatatctgtaatgacacca

SEQ ID NO: 474275 - DNA, 25 bp, Mus musculus
tcctgagcaagcttactgggcagcc

SEQ ID NO: 474276 - DNA, 25 bp, Mus musculus
tcctgagcacggaaagaaagcagct

SEQ ID NO: 474277 - DNA, 25 bp, Mus musculus
tcctgagcactgaagaatgaccctt

SEQ ID NO: 474278 - DNA, 25 bp, Mus musculus
tcctgagcagaagataccgctggag

SEQ ID NO: 474279 - DNA, 25 bp, Mus musculus
tcctgagcctagagagagagttcag

SEQ ID NO: 474280 - DNA, 25 bp, Mus musculus
tcctgagctcagcatccagctggtc

SEQ ID NO: 474281 - DNA, 25 bp, Mus musculus
tcctgagctgtagtagtgagacact

SEQ ID NO: 474282 - DNA, 25 bp, Mus musculus
tcctgagctgtcatgccagcggtgg

SEQ ID NO: 474283 - DNA, 25 bp, Mus musculus
tcctgagctgtgacggtgagagccc

SEQ ID NO: 474284 - DNA, 25 bp, Mus musculus
tcctgaggaacacccgcgtttgaag

SEQ ID NO: 474285 - DNA, 25 bp, Mus musculus
tcctgaggactgtgatctcctggcc

SEQ ID NO: 474286 - DNA, 25 bp, Mus musculus
tcctgaggagtgcaacgctgtcttc

SEQ ID NO: 474287 - DNA, 25 bp, Mus musculus
tcctgaggcgtccacagatcttgaa

SEQ ID NO: 474288 - DNA, 25 bp, Mus musculus
tcctgaggcttcagcaacaatgtct

SEQ ID NO: 474289 - DNA, 25 bp, Mus musculus
tcctgagggagacttcggctttgaa

SEQ ID NO: 474290 - DNA, 25 bp, Mus musculus
tcctgaggtagaaaacgaccgactg

SEQ ID NO: 474291 - DNA, 25 bp, Mus musculus
tcctgagtatgtccaaaggcgggaa

SEQ ID NO: 474292 - DNA, 25 bp, Mus musculus
tcctgagtgcttgtacaacgggtgt

SEQ ID NO: 474293 - DNA, 25 bp, Mus musculus
tcctgagtggcgtctggttttaact

SEQ ID NO: 474294 - DNA, 25 bp, Mus musculus
tcctgataaggacggtaggccagtc

SEQ ID NO: 474295 - DNA, 25 bp, Mus musculus
tcctgatagatgaacgtgctggcct

SEQ ID NO: 474296 - DNA, 25 bp, Mus musculus
tcctgatcatcgaggtgttgcgaca

SEQ ID NO: 474297 - DNA, 25 bp, Mus musculus
tcctgatccttctgggccatggcca

SEQ ID NO: 474298 - DNA, 25 bp, Mus musculus
tcctgatctgagtggcatgctacaa

SEQ ID NO: 474299 - DNA, 25 bp, Mus musculus
tcctgatgaaaaatccatgaatgag

SEQ ID NO: 474300 - DNA, 25 bp, Mus musculus
tcctgatgactgagagacaatccgg

SEQ ID NO: 474301 - DNA, 25 bp, Mus musculus
tcctgatgagcgaagctgtgcagcc

SEQ ID NO: 474302 - DNA, 25 bp, Mus musculus
tcctgatgaggaagcgcagagtact

SEQ ID NO: 474303 - DNA, 25 bp, Mus musculus
tcctgatgcaggttgaacgacatgt

SEQ ID NO: 474304 - DNA, 25 bp, Mus musculus
tcctgatgcgagtcaacgagtcgtc

SEQ ID NO: 474305 - DNA, 25 bp, Mus musculus
tcctgatgctactgccggaggagtg

SEQ ID NO: 474306 - DNA, 25 bp, Mus musculus
tcctgatgctcgaggtgtttcccga

SEQ ID NO: 474307 - DNA, 25 bp, Mus musculus
tcctgatgctcgtggacctgggaag

SEQ ID NO: 474308 - DNA, 25 bp, Mus musculus
tcctgatggaagcacgtgtggacct

SEQ ID NO: 474309 - DNA, 25 bp, Mus musculus
tcctgatggacaggcttcttcctgc

SEQ ID NO: 474310 - DNA, 25 bp, Mus musculus
tcctgatggcaacgaagtgatgaca

SEQ ID NO: 474311 - DNA, 25 bp, Mus musculus
tcctgatggctccaaagaagaggga

SEQ ID NO: 474312 - DNA, 25 bp, Mus musculus
tcctgatgggaagctgtacctgtct

SEQ ID NO: 474313 - DNA, 25 bp, Mus musculus
tcctgatggtggtatcatttctctc

SEQ ID NO: 474314 - DNA, 25 bp, Mus musculus
tcctgatgtagatgacccagaggcc

SEQ ID NO: 474315 - DNA, 25 bp, Mus musculus
tcctgatgtctaaggtgaaggtgcc

SEQ ID NO: 474316 - DNA, 25 bp, Mus musculus
tcctgatgtctatgggaaagatgcc

SEQ ID NO: 474317 - DNA, 25 bp, Mus musculus
tcctgattgatgaagacgatgaaaa

SEQ ID NO: 474318 - DNA, 25 bp, Mus musculus
tcctgattgccttggtggggctaat

SEQ ID NO: 474319 - DNA, 25 bp, Mus musculus
tcctgcaaagggtccagaacatgct

SEQ ID NO: 474320 - DNA, 25 bp, Mus musculus
tcctgcaagcagacagtgatcactt

SEQ ID NO: 474321 - DNA, 25 bp, Mus musculus
tcctgcaagccgagcaggtgtccca

SEQ ID NO: 474322 - DNA, 25 bp, Mus musculus
tcctgcactttcaggctagttagtg

SEQ ID NO: 474323 - DNA, 25 bp, Mus musculus
tcctgcagaacagaccagagactcg

SEQ ID NO: 474324 - DNA, 25 bp, Mus musculus
tcctgcagaagcaacaactggagct

SEQ ID NO: 474325 - DNA, 25 bp, Mus musculus
tcctgcagaggaacgtgctagccgt

SEQ ID NO: 474326 - DNA, 25 bp, Mus musculus
tcctgcagagtgcacagggtgtcta

SEQ ID NO: 474327 - DNA, 25 bp, Mus musculus
tcctgcagatgagtttgcatgcctg

SEQ ID NO: 474328 - DNA, 25 bp, Mus musculus
tcctgcagcaagagctccaggctgt

SEQ ID NO: 474329 - DNA, 25 bp, Mus musculus
tcctgcagcgcttcatcatcttcag

SEQ ID NO: 474330 - DNA, 25 bp, Mus musculus
tcctgcagctgacgagatctttcct

SEQ ID NO: 474331 - DNA, 25 bp, Mus musculus
tcctgcaggagcctcagaatgagca

SEQ ID NO: 474332 - DNA, 25 bp, Mus musculus
tcctgcaggatgatggtcaagccat

SEQ ID NO: 474333 - DNA, 25 bp, Mus musculus
tcctgcaggatgctcgagaacactt

SEQ ID NO: 474334 - DNA, 25 bp, Mus musculus
tcctgcagggaagatagccaatatc

SEQ ID NO: 474335 - DNA, 25 bp, Mus musculus
tcctgcagttgacaccgagagtgcg

SEQ ID NO: 474336 - DNA, 25 bp, Mus musculus
tcctgcatagaaatggtggaatcaa

SEQ ID NO: 474337 - DNA, 25 bp, Mus musculus
tcctgcatgaggagcacatcgaact

SEQ ID NO: 474338 - DNA, 25 bp, Mus musculus
tcctgccaaccgtttgtggcctggc

SEQ ID NO: 474339 - DNA, 25 bp, Mus musculus
tcctgccagcttagcaggcaaggct

SEQ ID NO: 474340 - DNA, 25 bp, Mus musculus
tcctgccatcgaggcgaggttatgc

SEQ ID NO: 474341 - DNA, 25 bp, Mus musculus
tcctgcccacggtaatggcggcggt

SEQ ID NO: 474342 - DNA, 25 bp, Mus musculus
tcctgcccagaaaccggtggaagtc

SEQ ID NO: 474343 - DNA, 25 bp, Mus musculus
tcctgcccagagtgatgtcctacca

SEQ ID NO: 474344 - DNA, 25 bp, Mus musculus
tcctgcccagggagcacatcattga

SEQ ID NO: 474345 - DNA, 25 bp, Mus musculus
tcctgcccctgctaaggtttttatc

SEQ ID NO: 474346 - DNA, 25 bp, Mus musculus
tcctgcccggatggtctttggagaa

SEQ ID NO: 474347 - DNA, 25 bp, Mus musculus
tcctgcccgtttgatattgtagtcc

SEQ ID NO: 474348 - DNA, 25 bp, Mus musculus
tcctgccctctcaaaagcctggtgt

SEQ ID NO: 474349 - DNA, 25 bp, Mus musculus
tcctgccctggagccgttctagatg

SEQ ID NO: 474350 - DNA, 25 bp, Mus musculus
tcctgccgactactagccttgaaga

SEQ ID NO: 474351 - DNA, 25 bp, Mus musculus
tcctgccgtgtgtgtttgctcgtcg

SEQ ID NO: 474352 - DNA, 25 bp, Mus musculus
tcctgcctcaatgggagatgacatc

SEQ ID NO: 474353 - DNA, 25 bp, Mus musculus
tcctgcctcaggcttttcctggtat

SEQ ID NO: 474354 - DNA, 25 bp, Mus musculus
tcctgcctctgctgataaacctaag

SEQ ID NO: 474355 - DNA, 25 bp, Mus musculus
tcctgcctgaggacgaaaaccttcg

SEQ ID NO: 474356 - DNA, 25 bp, Mus musculus
tcctgcctgccttatgggcctgttg

SEQ ID NO: 474357 - DNA, 25 bp, Mus musculus
tcctgcgacactacgaagacatggt

SEQ ID NO: 474358 - DNA, 25 bp, Mus musculus
tcctgcgacttcgttaagcggcact

SEQ ID NO: 474359 - DNA, 25 bp, Mus musculus
tcctgcgagtgacacaagtgacaca

SEQ ID NO: 474360 - DNA, 25 bp, Mus musculus
tcctgcgatcaatgggacaatgggc

SEQ ID NO: 474361 - DNA, 25 bp, Mus musculus
tcctgcggcatgtgcctctgagcag

SEQ ID NO: 474362 - DNA, 25 bp, Mus musculus
tcctgcggcgggagtattacctcac

SEQ ID NO: 474363 - DNA, 25 bp, Mus musculus
tcctgcggtgcgtacgcgctgttcg

SEQ ID NO: 474364 - DNA, 25 bp, Mus musculus
tcctgctacagatttgaaccctcat

SEQ ID NO: 474365 - DNA, 25 bp, Mus musculus
tcctgctatactggagcacttgaag

SEQ ID NO: 474366 - DNA, 25 bp, Mus musculus
tcctgctcccttgcaactgagtgga

SEQ ID NO: 474367 - DNA, 25 bp, Mus musculus
tcctgctcctacctgggatgggtac

SEQ ID NO: 474368 - DNA, 25 bp, Mus musculus
tcctgctctagttgtcttagacccc

SEQ ID NO: 474369 - DNA, 25 bp, Mus musculus
tcctgctctgtatggattttcgtcc

SEQ ID NO: 474370 - DNA, 25 bp, Mus musculus
tcctgctgaagtgacggacaagcct

SEQ ID NO: 474371 - DNA, 25 bp, Mus musculus
tcctgctgaccttacgggaccgtct

SEQ ID NO: 474372 - DNA, 25 bp, Mus musculus
tcctgctgcaaaagctcgctcggct

SEQ ID NO: 474373 - DNA, 25 bp, Mus musculus
tcctgctgcagaagtcagattcctg

SEQ ID NO: 474374 - DNA, 25 bp, Mus musculus
tcctgctgcccgcaatcctgattta

SEQ ID NO: 474375 - DNA, 25 bp, Mus musculus
tcctgctgccgatactgaacctgag

SEQ ID NO: 474376 - DNA, 25 bp, Mus musculus
tcctgctgcctgttgcggcacactg

SEQ ID NO: 474377 - DNA, 25 bp, Mus musculus
tcctgctgcttagctggtgaatgaa

SEQ ID NO: 474378 - DNA, 25 bp, Mus musculus
tcctgctggatttacggctccggag

SEQ ID NO: 474379 - DNA, 25 bp, Mus musculus
tcctgctgggaaacatggaaaccga

SEQ ID NO: 474380 - DNA, 25 bp, Mus musculus
tcctgctgggtctgagtgggactca

SEQ ID NO: 474381 - DNA, 25 bp, Mus musculus
tcctgctgggttaatacggcactca

SEQ ID NO: 474382 - DNA, 25 bp, Mus musculus
tcctgctgtccaaggtgcgactgtg

SEQ ID NO: 474383 - DNA, 25 bp, Mus musculus
tcctgctgtgcgcacacctttagct

SEQ ID NO: 474384 - DNA, 25 bp, Mus musculus
tcctgctgtgttagagtaggtgccc

SEQ ID NO: 474385 - DNA, 25 bp, Mus musculus
tcctgcttctcaagactggagggcc

SEQ ID NO: 474386 - DNA, 25 bp, Mus musculus
tcctgcttgggacccaggtctacat

SEQ ID NO: 474387 - DNA, 25 bp, Mus musculus
tcctgcttggtatctgggacagtct

SEQ ID NO: 474388 - DNA, 25 bp, Mus musculus
tcctgcttgtcgcaaaaaagaaaag

SEQ ID NO: 474389 - DNA, 25 bp, Mus musculus
tcctggaaacaactggaggtgctga

SEQ ID NO: 474390 - DNA, 25 bp, Mus musculus
tcctggaaacatgctgagaacaccc

SEQ ID NO: 474391 - DNA, 25 bp, Mus musculus
tcctggaaacctagatgctgccgtt

SEQ ID NO: 474392 - DNA, 25 bp, Mus musculus
tcctggaaagcctaaagagcatcat

SEQ ID NO: 474393 - DNA, 25 bp, Mus musculus
tcctggaaaggcatcagagcaaagc

SEQ ID NO: 474394 - DNA, 25 bp, Mus musculus
tcctggaaatagtgtgacgcttgcc

SEQ ID NO: 474395 - DNA, 25 bp, Mus musculus
tcctggaaatgaagtctgggctcac

SEQ ID NO: 474396 - DNA, 25 bp, Mus musculus
tcctggaacacaagatgggccacct

SEQ ID NO: 474397 - DNA, 25 bp, Mus musculus
tcctggaacatgagctgacagtggc

SEQ ID NO: 474398 - DNA, 25 bp, Mus musculus
tcctggaagactagagggctgatcc

SEQ ID NO: 474399 - DNA, 25 bp, Mus musculus
tcctggaagccaacgggacacagtt

SEQ ID NO: 474400 - DNA, 25 bp, Mus musculus
tcctggaagccgagaaaagatgctc

SEQ ID NO: 474401 - DNA, 25 bp, Mus musculus
tcctggaaggaatgggcagctgcct

SEQ ID NO: 474402 - DNA, 25 bp, Mus musculus
tcctggaaggcatatgaatgcatac

SEQ ID NO: 474403 - DNA, 25 bp, Mus musculus
tcctggaagtaaaacttactggctc

SEQ ID NO: 474404 - DNA, 25 bp, Mus musculus
tcctggaagtagaaagcgcgggttt

SEQ ID NO: 474405 - DNA, 25 bp, Mus musculus
tcctggaatatataaatgtgttgtc

SEQ ID NO: 474406 - DNA, 25 bp, Mus musculus
tcctggacaatcaaaagcaagccgt

SEQ ID NO: 474407 - DNA, 25 bp, Mus musculus
tcctggacagggaaaactctgttca

SEQ ID NO: 474408 - DNA, 25 bp, Mus musculus
tcctggaccacatgtacggaacaca

SEQ ID NO: 474409 - DNA, 25 bp, Mus musculus
tcctggacccagaagggaagggcac

SEQ ID NO: 474410 - DNA, 25 bp, Mus musculus
tcctggacctggacgggaaggactc

SEQ ID NO: 474411 - DNA, 25 bp, Mus musculus
tcctggacgagaacttcaagcgctg

SEQ ID NO: 474412 - DNA, 25 bp, Mus musculus
tcctggacgagcagaacacaactgg

SEQ ID NO: 474413 - DNA, 25 bp, Mus musculus
tcctggacgtccagcgcgctgataa

SEQ ID NO: 474414 - DNA, 25 bp, Mus musculus
tcctggactgtagattcgaaatcct

SEQ ID NO: 474415 - DNA, 25 bp, Mus musculus
tcctggagacacctgaaaccttgct

SEQ ID NO: 474416 - DNA, 25 bp, Mus musculus
tcctggagaccatagagaagattgc

SEQ ID NO: 474417 - DNA, 25 bp, Mus musculus
tcctggagaccctaactgatgtggc

SEQ ID NO: 474418 - DNA, 25 bp, Mus musculus
tcctggagataagaaaaacctaggg

SEQ ID NO: 474419 - DNA, 25 bp, Mus musculus
tcctggagatcatcagtatagggcc

SEQ ID NO: 474420 - DNA, 25 bp, Mus musculus
tcctggagatgagagttgaggccac

SEQ ID NO: 474421 - DNA, 25 bp, Mus musculus
tcctggagatgttggatgcccaccg

SEQ ID NO: 474422 - DNA, 25 bp, Mus musculus
tcctggagccacttacaagcctaag

SEQ ID NO: 474423 - DNA, 25 bp, Mus musculus
tcctggagctacagaaggacctggt

SEQ ID NO: 474424 - DNA, 25 bp, Mus musculus
tcctggagctccagagacaaagaca

SEQ ID NO: 474425 - DNA, 25 bp, Mus musculus
tcctggaggaagtgatgcctatgct

SEQ ID NO: 474426 - DNA, 25 bp, Mus musculus
tcctggaggagtgagcaacattcat

SEQ ID NO: 474427 - DNA, 25 bp, Mus musculus
tcctggaggatctattcttaaagtc

SEQ ID NO: 474428 - DNA, 25 bp, Mus musculus
tcctggaggcacacagagatttccg

SEQ ID NO: 474429 - DNA, 25 bp, Mus musculus
tcctggaggcgcagcgcaggtccat

SEQ ID NO: 474430 - DNA, 25 bp, Mus musculus
tcctggaggctacgttgcagtccct

SEQ ID NO: 474431 - DNA, 25 bp, Mus musculus
tcctggagggagaagcactcactta

SEQ ID NO: 474432 - DNA, 25 bp, Mus musculus
tcctggagggatacctggcattgac

SEQ ID NO: 474433 - DNA, 25 bp, Mus musculus
tcctggagggttttggagcctctct

SEQ ID NO: 474434 - DNA, 25 bp, Mus musculus
tcctggagttacaaactgaggccgc

SEQ ID NO: 474435 - DNA, 25 bp, Mus musculus
tcctggatcctccattctgctggct

SEQ ID NO: 474436 - DNA, 25 bp, Mus musculus
tcctggatcggaaagctggcactct

SEQ ID NO: 474437 - DNA, 25 bp, Mus musculus
tcctggatgaatgcagaggcctcaa

SEQ ID NO: 474438 - DNA, 25 bp, Mus musculus
tcctggatgagattgacgctgcctt

SEQ ID NO: 474439 - DNA, 25 bp, Mus musculus
tcctggatggacaaaggtctgagct

SEQ ID NO: 474440 - DNA, 25 bp, Mus musculus
tcctggcaaaaggttaaaatgcaac

SEQ ID NO: 474441 - DNA, 25 bp, Mus musculus
tcctggcagcgatgagaaaacggaa

SEQ ID NO: 474442 - DNA, 25 bp, Mus musculus
tcctggcgtttagcaccttcactgt

SEQ ID NO: 474443 - DNA, 25 bp, Mus musculus
tcctggctaaaggatgggaagctcg

SEQ ID NO: 474444 - DNA, 25 bp, Mus musculus
tcctggctcagtaagagacttgtct

SEQ ID NO: 474445 - DNA, 25 bp, Mus musculus
tcctggctcttggtctgcagcatgg

SEQ ID NO: 474446 - DNA, 25 bp, Mus musculus
tcctggctgggaacgagtagagtca

SEQ ID NO: 474447 - DNA, 25 bp, Mus musculus
tcctggctgggatgaacgtctaccc

SEQ ID NO: 474448 - DNA, 25 bp, Mus musculus
tcctggctgtagaaaagcaccgtcc

SEQ ID NO: 474449 - DNA, 25 bp, Mus musculus
tcctgggaaaggcatgcagctgcct

SEQ ID NO: 474450 - DNA, 25 bp, Mus musculus
tcctgggaacagagacttagcaagg

SEQ ID NO: 474451 - DNA, 25 bp, Mus musculus
tcctgggaacccagaagtgggagct

SEQ ID NO: 474452 - DNA, 25 bp, Mus musculus
tcctgggaagctggtgcaatgccat

SEQ ID NO: 474453 - DNA, 25 bp, Mus musculus
tcctgggaagtactgggagccattt

SEQ ID NO: 474454 - DNA, 25 bp, Mus musculus
tcctgggaatacagaggtgtacaag

SEQ ID NO: 474455 - DNA, 25 bp, Mus musculus
tcctgggaatccctacctttgaggt

SEQ ID NO: 474456 - DNA, 25 bp, Mus musculus
tcctgggaattacatctgacatcat

SEQ ID NO: 474457 - DNA, 25 bp, Mus musculus
tcctgggacctgaagctcaagctgc

SEQ ID NO: 474458 - DNA, 25 bp, Mus musculus
tcctgggacgaggtcccagctttgg

SEQ ID NO: 474459 - DNA, 25 bp, Mus musculus
tcctgggagactatgtggtgaacct

SEQ ID NO: 474460 - DNA, 25 bp, Mus musculus
tcctgggagcaaccctgtctggtgc

SEQ ID NO: 474461 - DNA, 25 bp, Mus musculus
tcctgggaggtcatcgaaggctacc

SEQ ID NO: 474462 - DNA, 25 bp, Mus musculus
tcctgggagtcgtagtggctgcact

SEQ ID NO: 474463 - DNA, 25 bp, Mus musculus
tcctgggattcctgtactgctattc

SEQ ID NO: 474464 - DNA, 25 bp, Mus musculus
tcctgggattctgtgatcctgggcg

SEQ ID NO: 474465 - DNA, 25 bp, Mus musculus
tcctgggcagagcttcgagatccac

SEQ ID NO: 474466 - DNA, 25 bp, Mus musculus
tcctgggcaggcacgtttcttctgg

SEQ ID NO: 474467 - DNA, 25 bp, Mus musculus
tcctgggccacaaacaagtgtctga

SEQ ID NO: 474468 - DNA, 25 bp, Mus musculus
tcctgggccagaggcactcagtcat

SEQ ID NO: 474469 - DNA, 25 bp, Mus musculus
tcctgggccctcaggcgtaaggcct

SEQ ID NO: 474470 - DNA, 25 bp, Mus musculus
tcctgggcctgagacttagtgtcac

SEQ ID NO: 474471 - DNA, 25 bp, Mus musculus
tcctgggctaagaaacctggagaaa

SEQ ID NO: 474472 - DNA, 25 bp, Mus musculus
tcctgggctacaaagcggtggaccc

SEQ ID NO: 474473 - DNA, 25 bp, Mus musculus
tcctgggctattgcctggtgtacag

SEQ ID NO: 474474 - DNA, 25 bp, Mus musculus
tcctgggctcacttgggaaaacgtg

SEQ ID NO: 474475 - DNA, 25 bp, Mus musculus
tcctgggctgaactgcagagactca

SEQ ID NO: 474476 - DNA, 25 bp, Mus musculus
tcctgggtcatgaagagagcatgcc

SEQ ID NO: 474477 - DNA, 25 bp, Mus musculus
tcctgggtcctgactgaacctagct

SEQ ID NO: 474478 - DNA, 25 bp, Mus musculus
tcctgggtctcgatcaagaagctgt

SEQ ID NO: 474479 - DNA, 25 bp, Mus musculus
tcctgggtctggagcagcagttgaa

SEQ ID NO: 474480 - DNA, 25 bp, Mus musculus
tcctgggtgacaatgcaaagtgcag

SEQ ID NO: 474481 - DNA, 25 bp, Mus musculus
tcctgggtgccaacctgctgttctg

SEQ ID NO: 474482 - DNA, 25 bp, Mus musculus
tcctgggtggcaaatgtggccaacc

SEQ ID NO: 474483 - DNA, 25 bp, Mus musculus
tcctgggttgtaggcgaatgatcag

SEQ ID NO: 474484 - DNA, 25 bp, Mus musculus
tcctggtaaagaatgacggcgcgtg

SEQ ID NO: 474485 - DNA, 25 bp, Mus musculus
tcctggtaagacacttcagtcacag

SEQ ID NO: 474486 - DNA, 25 bp, Mus musculus
tcctggtacctccttctgtgttaga

SEQ ID NO: 474487 - DNA, 25 bp, Mus musculus
tcctggtagaaaacatggtgacctg

SEQ ID NO: 474488 - DNA, 25 bp, Mus musculus
tcctggtagatactgtctgggccct

SEQ ID NO: 474489 - DNA, 25 bp, Mus musculus
tcctggtcaacagtagcgaggcgct

SEQ ID NO: 474490 - DNA, 25 bp, Mus musculus
tcctggtcaactccagggtctctgt

SEQ ID NO: 474491 - DNA, 25 bp, Mus musculus
tcctggtcacacgaacaatgggtct

SEQ ID NO: 474492 - DNA, 25 bp, Mus musculus
tcctggtcagagttcggcgttcacg

SEQ ID NO: 474493 - DNA, 25 bp, Mus musculus
tcctggtcaggaatccggcaaatcc

SEQ ID NO: 474494 - DNA, 25 bp, Mus musculus
tcctggtcagggaaacaatgcctat

SEQ ID NO: 474495 - DNA, 25 bp, Mus musculus
tcctggtcatcctgatgttgggaaa

SEQ ID NO: 474496 - DNA, 25 bp, Mus musculus
tcctggtccagggtggtatgcatgc

SEQ ID NO: 474497 - DNA, 25 bp, Mus musculus
tcctggtccaggtgagagtgatcca

SEQ ID NO: 474498 - DNA, 25 bp, Mus musculus
tcctggtcgaggcaacggtgaaact

SEQ ID NO: 474499 - DNA, 25 bp, Mus musculus
tcctggtcgagtgggccaagtacat

SEQ ID NO: 474500 - DNA, 25 bp, Mus musculus
tcctggtgaagaaagctagcgacag

SEQ ID NO: 474501 - DNA, 25 bp, Mus musculus
tcctggtgaagaagccatgcgtctc

SEQ ID NO: 474502 - DNA, 25 bp, Mus musculus
tcctggtgaagcgaaccaagcgctc

SEQ ID NO: 474503 - DNA, 25 bp, Mus musculus
tcctggtgacacaaaatggcggtag

SEQ ID NO: 474504 - DNA, 25 bp, Mus musculus
tcctggtgactgactggaacccact

SEQ ID NO: 474505 - DNA, 25 bp, Mus musculus
tcctggtgagacaacgagagcaagt

SEQ ID NO: 474506 - DNA, 25 bp, Mus musculus
tcctggtgagcaactgggtgatcct

SEQ ID NO: 474507 - DNA, 25 bp, Mus musculus
tcctggtgctttagggcttgtgcaa

SEQ ID NO: 474508 - DNA, 25 bp, Mus musculus
tcctggtggcaagagacatcgtaat

SEQ ID NO: 474509 - DNA, 25 bp, Mus musculus
tcctggtggccaacaaaaaagacct

SEQ ID NO: 474510 - DNA, 25 bp, Mus musculus
tcctggtggtctccaaagggacctc

SEQ ID NO: 474511 - DNA, 25 bp, Mus musculus
tcctggtgtggctccttggactcaa

SEQ ID NO: 474512 - DNA, 25 bp, Mus musculus
tcctggttagtggagagaacttact

SEQ ID NO: 474513 - DNA, 25 bp, Mus musculus
tcctggttcaggtcatgcctagccc

SEQ ID NO: 474514 - DNA, 25 bp, Mus musculus
tcctggttcccgagtgactttcaat

SEQ ID NO: 474515 - DNA, 25 bp, Mus musculus
tcctgtaaaatagacaagggctggg

SEQ ID NO: 474516 - DNA, 25 bp, Mus musculus
tcctgtaactgtgatggagccccac

SEQ ID NO: 474517 - DNA, 25 bp, Mus musculus
tcctgtaagccctcgtgagaagtca

SEQ ID NO: 474518 - DNA, 25 bp, Mus musculus
tcctgtacctgcagcaagaggctcc

SEQ ID NO: 474519 - DNA, 25 bp, Mus musculus
tcctgtagcccaactgtaccttcat

SEQ ID NO: 474520 - DNA, 25 bp, Mus musculus
tcctgtagccgagacaaaatggcgt

SEQ ID NO: 474521 - DNA, 25 bp, Mus musculus
tcctgtagctagaggctcgaaccta

SEQ ID NO: 474522 - DNA, 25 bp, Mus musculus
tcctgtagctgtcaagtggtctcca

SEQ ID NO: 474523 - DNA, 25 bp, Mus musculus
tcctgtaggatttgggctagcccct

SEQ ID NO: 474524 - DNA, 25 bp, Mus musculus
tcctgtaggctgttccgggacagaa

SEQ ID NO: 474525 - DNA, 25 bp, Mus musculus
tcctgtagggaaggcaaagactctt

SEQ ID NO: 474526 - DNA, 25 bp, Mus musculus
tcctgtagggtaccggaagagcatt

SEQ ID NO: 474527 - DNA, 25 bp, Mus musculus
tcctgtagtatgtgttccatccagt

SEQ ID NO: 474528 - DNA, 25 bp, Mus musculus
tcctgtatccaattccgtgcctggg

SEQ ID NO: 474529 - DNA, 25 bp, Mus musculus
tcctgtatgatcactgggtagttcc

SEQ ID NO: 474530 - DNA, 25 bp, Mus musculus
tcctgtcaaatacaaaaagcaccgg

SEQ ID NO: 474531 - DNA, 25 bp, Mus musculus
tcctgtcacatggatctttgagcct

SEQ ID NO: 474532 - DNA, 25 bp, Mus musculus
tcctgtcatcactggacgcatggcg

SEQ ID NO: 474533 - DNA, 25 bp, Mus musculus
tcctgtcatcagaagttgggccaac

SEQ ID NO: 474534 - DNA, 25 bp, Mus musculus
tcctgtcattaatccgctgctgcgc

SEQ ID NO: 474535 - DNA, 25 bp, Mus musculus
tcctgtccagaaagaagccttgaaa

SEQ ID NO: 474536 - DNA, 25 bp, Mus musculus
tcctgtccccagtgcaatgaaaatg

SEQ ID NO: 474537 - DNA, 25 bp, Mus musculus
tcctgtcccctgcagggacgatctg

SEQ ID NO: 474538 - DNA, 25 bp, Mus musculus
tcctgtcccttctacaaagttaggc

SEQ ID NO: 474539 - DNA, 25 bp, Mus musculus
tcctgtcccttcttctagcacggag

SEQ ID NO: 474540 - DNA, 25 bp, Mus musculus
tcctgtccgtagaaagggtagaaca

SEQ ID NO: 474541 - DNA, 25 bp, Mus musculus
tcctgtcgaggatccaaagactgcg

SEQ ID NO: 474542 - DNA, 25 bp, Mus musculus
tcctgtcggaggagacctgtttcca

SEQ ID NO: 474543 - DNA, 25 bp, Mus musculus
tcctgtctacagcataaggtcagcg

SEQ ID NO: 474544 - DNA, 25 bp, Mus musculus
tcctgtctcgaaggccaataaagaa

SEQ ID NO: 474545 - DNA, 25 bp, Mus musculus
tcctgtctctgtcccatgtgttgga

SEQ ID NO: 474546 - DNA, 25 bp, Mus musculus
tcctgtctggtcttcggtgactgtt

SEQ ID NO: 474547 - DNA, 25 bp, Mus musculus
tcctgtctgtgatgaacagtgaaag

SEQ ID NO: 474548 - DNA, 25 bp, Mus musculus
tcctgtcttgtccttaattcaattc

SEQ ID NO: 474549 - DNA, 25 bp, Mus musculus
tcctgtgaactgaagccagatggct

SEQ ID NO: 474550 - DNA, 25 bp, Mus musculus
tcctgtgaactgcaaagatacctcc

SEQ ID NO: 474551 - DNA, 25 bp, Mus musculus
tcctgtgacgagcaaaatgtctccc

SEQ ID NO: 474552 - DNA, 25 bp, Mus musculus
tcctgtgaggtagggccagacatgc

SEQ ID NO: 474553 - DNA, 25 bp, Mus musculus
tcctgtgatcttggttggtcagaat

SEQ ID NO: 474554 - DNA, 25 bp, Mus musculus
tcctgtgattggaaactggtgactg

SEQ ID NO: 474555 - DNA, 25 bp, Mus musculus
tcctgtgcagcggtactctgaggct

SEQ ID NO: 474556 - DNA, 25 bp, Mus musculus
tcctgtgccaggatggaggtctgct

SEQ ID NO: 474557 - DNA, 25 bp, Mus musculus
tcctgtgccaggtgcttgaaagaca

SEQ ID NO: 474558 - DNA, 25 bp, Mus musculus
tcctgtgccattgtacctacctggt

SEQ ID NO: 474559 - DNA, 25 bp, Mus musculus
tcctgtgcggtacaagacgaactac

SEQ ID NO: 474560 - DNA, 25 bp, Mus musculus
tcctgtggaaacgtgtggagtccca

SEQ ID NO: 474561 - DNA, 25 bp, Mus musculus
tcctgtggacgccagtgtatgctgc

SEQ ID NO: 474562 - DNA, 25 bp, Mus musculus
tcctgtggagcatcagagacattat

SEQ ID NO: 474563 - DNA, 25 bp, Mus musculus
tcctgtggaggagacacttcgtgcc

SEQ ID NO: 474564 - DNA, 25 bp, Mus musculus
tcctgtggattgttacatatctatg

SEQ ID NO: 474565 - DNA, 25 bp, Mus musculus
tcctgtggctatcttcaggctgttc

SEQ ID NO: 474566 - DNA, 25 bp, Mus musculus
tcctgtgggactccgtgtggtcacc

SEQ ID NO: 474567 - DNA, 25 bp, Mus musculus
tcctgtgggagtgaagagctaagac

SEQ ID NO: 474568 - DNA, 25 bp, Mus musculus
tcctgtgggttctactcgggaggta

SEQ ID NO: 474569 - DNA, 25 bp, Mus musculus
tcctgtggtaacataggaccagtgg

SEQ ID NO: 474570 - DNA, 25 bp, Mus musculus
tcctgtggtagagcgacgaacttgt

SEQ ID NO: 474571 - DNA, 25 bp, Mus musculus
tcctgtgtacctatagaagcagtca

SEQ ID NO: 474572 - DNA, 25 bp, Mus musculus
tcctgtgtcccagaggtctgaggag

SEQ ID NO: 474573 - DNA, 25 bp, Mus musculus
tcctgtgtctgtggcgtcgtctgct

SEQ ID NO: 474574 - DNA, 25 bp, Mus musculus
tcctgtgtgagcgtcaagggccaaa

SEQ ID NO: 474575 - DNA, 25 bp, Mus musculus
tcctgtgtgcagtagcatcacccag

SEQ ID NO: 474576 - DNA, 25 bp, Mus musculus
tcctgttcggttttctattttagct

SEQ ID NO: 474577 - DNA, 25 bp, Mus musculus
tcctgttgacccagagcatggtgcc

SEQ ID NO: 474578 - DNA, 25 bp, Mus musculus
tcctgttgagcaaattgtcagccac

SEQ ID NO: 474579 - DNA, 25 bp, Mus musculus
tcctgttgaggtaagtctgagccct

SEQ ID NO: 474580 - DNA, 25 bp, Mus musculus
tcctgttgccttccccgcatcagat

SEQ ID NO: 474581 - DNA, 25 bp, Mus musculus
tcctgttggactattataaagcccc

SEQ ID NO: 474582 - DNA, 25 bp, Mus musculus
tcctgttggcacaagctcgggacaa

SEQ ID NO: 474583 - DNA, 25 bp, Mus musculus
tcctgttgttcctctagaatgctat

SEQ ID NO: 474584 - DNA, 25 bp, Mus musculus
tcctgtttaggccatgatttccggg

SEQ ID NO: 474585 - DNA, 25 bp, Mus musculus
tcctgtttcagatcgggccagggat

SEQ ID NO: 474586 - DNA, 25 bp, Mus musculus
tcctgtttctcacggccagctgtgg

SEQ ID NO: 474587 - DNA, 25 bp, Mus musculus
tcctgtttgccttcggatcaaaatg

SEQ ID NO: 474588 - DNA, 25 bp, Mus musculus
tcctgtttttgtgaagcagctaaga

SEQ ID NO: 474589 - DNA, 25 bp, Mus musculus
tccttaaaagtatgattgcttcgtc

SEQ ID NO: 474590 - DNA, 25 bp, Mus musculus
tccttaaacctagcaggcagcactg

SEQ ID NO: 474591 - DNA, 25 bp, Mus musculus
tccttaaagccaagtccaaggcatg

SEQ ID NO: 474592 - DNA, 25 bp, Mus musculus
tccttaaaggactgcatgcggcgct

SEQ ID NO: 474593 - DNA, 25 bp, Mus musculus
tccttaaatgcttggacttcagcct

SEQ ID NO: 474594 - DNA, 25 bp, Mus musculus
tccttaactctgaaactgtgctccg

SEQ ID NO: 474595 - DNA, 25 bp, Mus musculus
tccttaagagggagctagcgctgac

SEQ ID NO: 474596 - DNA, 25 bp, Mus musculus
tccttaagctgaacagtggcctgtg

SEQ ID NO: 474597 - DNA, 25 bp, Mus musculus
tccttaaggactgggaaatgcacgt

SEQ ID NO: 474598 - DNA, 25 bp, Mus musculus
tccttacggaggaatgacgtgtccc

SEQ ID NO: 474599 - DNA, 25 bp, Mus musculus
tccttactaaggagagccacctcac

SEQ ID NO: 474600 - DNA, 25 bp, Mus musculus
tccttagaaaaaccgagcttgaagc

SEQ ID NO: 474601 - DNA, 25 bp, Mus musculus
tccttagagatacaaccctgggctt

SEQ ID NO: 474602 - DNA, 25 bp, Mus musculus
tccttagagattatcggagcgcctt

SEQ ID NO: 474603 - DNA, 25 bp, Mus musculus
tccttagagcattccgctgggcgcg

SEQ ID NO: 474604 - DNA, 25 bp, Mus musculus
tccttagagggagaacactggcttt

SEQ ID NO: 474605 - DNA, 25 bp, Mus musculus
tccttagagtaataagaagcaaaca

SEQ ID NO: 474606 - DNA, 25 bp, Mus musculus
tccttagcaaggcaatgtggatgca

SEQ ID NO: 474607 - DNA, 25 bp, Mus musculus
tccttagcgccgattccacgggaag

SEQ ID NO: 474608 - DNA, 25 bp, Mus musculus
tccttagctggcctgatagacatct

SEQ ID NO: 474609 - DNA, 25 bp, Mus musculus
tccttaggatgttctttgacggccg

SEQ ID NO: 474610 - DNA, 25 bp, Mus musculus
tccttaggcaggagatatggtcccc

SEQ ID NO: 474611 - DNA, 25 bp, Mus musculus
tccttagggaagcaagcgtgcgtct

SEQ ID NO: 474612 - DNA, 25 bp, Mus musculus
tccttagggcctatgaatactcatg

SEQ ID NO: 474613 - DNA, 25 bp, Mus musculus
tccttagtatggtggtcttggcccc

SEQ ID NO: 474614 - DNA, 25 bp, Mus musculus
tccttagtgggtcatgcagcttcgg

SEQ ID NO: 474615 - DNA, 25 bp, Mus musculus
tccttagttcagtggataatccagg

SEQ ID NO: 474616 - DNA, 25 bp, Mus musculus
tccttatacaactggcggcacaggt

SEQ ID NO: 474617 - DNA, 25 bp, Mus musculus
tccttataggttctagacaacgccc

SEQ ID NO: 474618 - DNA, 25 bp, Mus musculus
tccttatcataggagtgcggcccgc

SEQ ID NO: 474619 - DNA, 25 bp, Mus musculus
tccttatgtgcttctcggtggacag

SEQ ID NO: 474620 - DNA, 25 bp, Mus musculus
tccttcaagaatctctccagctaga

SEQ ID NO: 474621 - DNA, 25 bp, Mus musculus
tccttcaagcggagacaagcaactg

SEQ ID NO: 474622 - DNA, 25 bp, Mus musculus
tccttcaaggaagagtctgtttaca

SEQ ID NO: 474623 - DNA, 25 bp, Mus musculus
tccttcaaggtagggatgcccatgc

SEQ ID NO: 474624 - DNA, 25 bp, Mus musculus
tccttcacacagaggcggtttccca

SEQ ID NO: 474625 - DNA, 25 bp, Mus musculus
tccttcactccgaactgcgtctatg

SEQ ID NO: 474626 - DNA, 25 bp, Mus musculus
tccttcagaacagacagtgtgagcc

SEQ ID NO: 474627 - DNA, 25 bp, Mus musculus
tccttcagatccagacagaatgtca

SEQ ID NO: 474628 - DNA, 25 bp, Mus musculus
tccttcaggtgcaccgatgcggaga

SEQ ID NO: 474629 - DNA, 25 bp, Mus musculus
tccttcagttagtgtgcccgtgtca

SEQ ID NO: 474630 - DNA, 25 bp, Mus musculus
tccttcatcaggtttagggactcaa

SEQ ID NO: 474631 - DNA, 25 bp, Mus musculus
tccttcatcttcattgtgtagaact

SEQ ID NO: 474632 - DNA, 25 bp, Mus musculus
tccttccaaagacatcgagaattga

SEQ ID NO: 474633 - DNA, 25 bp, Mus musculus
tccttccaagctaggtcggctcgtg

SEQ ID NO: 474634 - DNA, 25 bp, Mus musculus
tccttccagcagagaaataaagcct

SEQ ID NO: 474635 - DNA, 25 bp, Mus musculus
tccttccatgaagacaagcaggtga

SEQ ID NO: 474636 - DNA, 25 bp, Mus musculus
tccttccatgatgccctaaagggat

SEQ ID NO: 474637 - DNA, 25 bp, Mus musculus
tccttccattggatgtgccgggcaa

SEQ ID NO: 474638 - DNA, 25 bp, Mus musculus
tccttcccagcacgtcaggaacagg

SEQ ID NO: 474639 - DNA, 25 bp, Mus musculus
tccttcccctctcagggaatctgga

SEQ ID NO: 474640 - DNA, 25 bp, Mus musculus
tccttcccgagaagttgtgatcgga

SEQ ID NO: 474641 - DNA, 25 bp, Mus musculus
tccttcccgagctgcggaccggaaa

SEQ ID NO: 474642 - DNA, 25 bp, Mus musculus
tccttcccgggtgtggcatctgatg

SEQ ID NO: 474643 - DNA, 25 bp, Mus musculus
tccttccctcccatgtgagctgagt

SEQ ID NO: 474644 - DNA, 25 bp, Mus musculus
tccttcccttctaactggcagcagc

SEQ ID NO: 474645 - DNA, 25 bp, Mus musculus
tccttccggcacgattgcgagatcg

SEQ ID NO: 474646 - DNA, 25 bp, Mus musculus
tccttcctagttgcagggaataaat

SEQ ID NO: 474647 - DNA, 25 bp, Mus musculus
tccttcctatgactggatgaggaga

SEQ ID NO: 474648 - DNA, 25 bp, Mus musculus
tccttcctcaggatcgaaacatgat

SEQ ID NO: 474649 - DNA, 25 bp, Mus musculus
tccttcctccatgagaatgcccgtc

SEQ ID NO: 474650 - DNA, 25 bp, Mus musculus
tccttcctccctgaaacttatttga

SEQ ID NO: 474651 - DNA, 25 bp, Mus musculus
tccttcctgtgtgtatccgtaggct

SEQ ID NO: 474652 - DNA, 25 bp, Mus musculus
tccttcgccgccactggagagagct

SEQ ID NO: 474653 - DNA, 25 bp, Mus musculus
tccttcgcggtggaacaagacatcc

SEQ ID NO: 474654 - DNA, 25 bp, Mus musculus
tccttcgctggagtgctggcacaga

SEQ ID NO: 474655 - DNA, 25 bp, Mus musculus
tccttcgggagattgtgcacaagcc

SEQ ID NO: 474656 - DNA, 25 bp, Mus musculus
tccttcggttcagggacggaactgg

SEQ ID NO: 474657 - DNA, 25 bp, Mus musculus
tccttcgtcgaggtaggacgtgctt

SEQ ID NO: 474658 - DNA, 25 bp, Mus musculus
tccttcgtggagtataacagctgcc

SEQ ID NO: 474659 - DNA, 25 bp, Mus musculus
tccttctactagtaatggtggccaa

SEQ ID NO: 474660 - DNA, 25 bp, Mus musculus
tccttctaggcatcgggaaagacca

SEQ ID NO: 474661 - DNA, 25 bp, Mus musculus
tccttctatgaatacgggcaccggt

SEQ ID NO: 474662 - DNA, 25 bp, Mus musculus
tccttctctcgtcagaagaaagagg

SEQ ID NO: 474663 - DNA, 25 bp, Mus musculus
tccttctgaccttgcagaggagcca

SEQ ID NO: 474664 - DNA, 25 bp, Mus musculus
tccttctgagacctttaccacatga

SEQ ID NO: 474665 - DNA, 25 bp, Mus musculus
tccttctgcaggagaccaaacatgt

SEQ ID NO: 474666 - DNA, 25 bp, Mus musculus
tccttctgcagtatcaagtgggctg

SEQ ID NO: 474667 - DNA, 25 bp, Mus musculus
tccttctggcatgaagagttccaag

SEQ ID NO: 474668 - DNA, 25 bp, Mus musculus
tccttctgggatccttgctgcacaa

SEQ ID NO: 474669 - DNA, 25 bp, Mus musculus
tccttctggttgcttagatgggcct

SEQ ID NO: 474670 - DNA, 25 bp, Mus musculus
tccttctgtcgagggaaggcctcct

SEQ ID NO: 474671 - DNA, 25 bp, Mus musculus
tccttcttaaagctgacacactctg

SEQ ID NO: 474672 - DNA, 25 bp, Mus musculus
tccttcttgtgagcttggtggtggt

SEQ ID NO: 474673 - DNA, 25 bp, Mus musculus
tccttgaacagcagtgaaaaccctt

SEQ ID NO: 474674 - DNA, 25 bp, Mus musculus
tccttgaagtcctaaccgagggcct

SEQ ID NO: 474675 - DNA, 25 bp, Mus musculus
tccttgacctcacctatgatgggcg

SEQ ID NO: 474676 - DNA, 25 bp, Mus musculus
tccttgacctcctgtaaagttacag

SEQ ID NO: 474677 - DNA, 25 bp, Mus musculus
tccttgacgtggaagacctcagctt

SEQ ID NO: 474678 - DNA, 25 bp, Mus musculus
tccttgagagagaaatgtactagtg

SEQ ID NO: 474679 - DNA, 25 bp, Mus musculus
tccttgagatgagcatcggagcacc

SEQ ID NO: 474680 - DNA, 25 bp, Mus musculus
tccttgagcagaagagtacgcggtg

SEQ ID NO: 474681 - DNA, 25 bp, Mus musculus
tccttgaggagaggccagatggcca

SEQ ID NO: 474682 - DNA, 25 bp, Mus musculus
tccttgagggtgagaactgtgtgtc

SEQ ID NO: 474683 - DNA, 25 bp, Mus musculus
tccttgagggtttcagatagccagc

SEQ ID NO: 474684 - DNA, 25 bp, Mus musculus
tccttgagtgggtgttagtctcaca

SEQ ID NO: 474685 - DNA, 25 bp, Mus musculus
tccttgataagagaagctgcaaact

SEQ ID NO: 474686 - DNA, 25 bp, Mus musculus
tccttgatcggaaggaggacgtgaa

SEQ ID NO: 474687 - DNA, 25 bp, Mus musculus
tccttgatctgagggttgattgaca

SEQ ID NO: 474688 - DNA, 25 bp, Mus musculus
tccttgattggatacctgggccaca

SEQ ID NO: 474689 - DNA, 25 bp, Mus musculus
tccttgcagacaaaagccttgcttt

SEQ ID NO: 474690 - DNA, 25 bp, Mus musculus
tccttgcatatctacctggtgtggc

SEQ ID NO: 474691 - DNA, 25 bp, Mus musculus
tccttgccaagtgaaacagaaatgc

SEQ ID NO: 474692 - DNA, 25 bp, Mus musculus
tccttgccaggactaaatgagctgt

SEQ ID NO: 474693 - DNA, 25 bp, Mus musculus
tccttgcccgacttgaaggcagaag

SEQ ID NO: 474694 - DNA, 25 bp, Mus musculus
tccttgccgccccttttgcggagag

SEQ ID NO: 474695 - DNA, 25 bp, Mus musculus
tccttgctctgcgtgtgttgcggct

SEQ ID NO: 474696 - DNA, 25 bp, Mus musculus
tccttgctggtgacgtagagactca

SEQ ID NO: 474697 - DNA, 25 bp, Mus musculus
tccttggaagagacccctgtgtgcc

SEQ ID NO: 474698 - DNA, 25 bp, Mus musculus
tccttggacctgaccgatgctcata

SEQ ID NO: 474699 - DNA, 25 bp, Mus musculus
tccttggagagcgaagtcaatgcct

SEQ ID NO: 474700 - DNA, 25 bp, Mus musculus
tccttggaggatcacagaccatggg

SEQ ID NO: 474701 - DNA, 25 bp, Mus musculus
tccttggatccagctttctcaggct

SEQ ID NO: 474702 - DNA, 25 bp, Mus musculus
tccttggcagagtcggatggagcca

SEQ ID NO: 474703 - DNA, 25 bp, Mus musculus
tccttggcctgggtgatccgggcct

SEQ ID NO: 474704 - DNA, 25 bp, Mus musculus
tccttggctcgtggattcaggctcg

SEQ ID NO: 474705 - DNA, 25 bp, Mus musculus
tccttggctggagtgagtacccgcg

SEQ ID NO: 474706 - DNA, 25 bp, Mus musculus
tccttgggacctgtgaacctactca

SEQ ID NO: 474707 - DNA, 25 bp, Mus musculus
tccttgggatttctttgaaagaaca

SEQ ID NO: 474708 - DNA, 25 bp, Mus musculus
tccttgggcacaaggcatacaactt

SEQ ID NO: 474709 - DNA, 25 bp, Mus musculus
tccttgggcccctacttagttcagc

SEQ ID NO: 474710 - DNA, 25 bp, Mus musculus
tccttgggcttgaaaagtctttctg

SEQ ID NO: 474711 - DNA, 25 bp, Mus musculus
tccttgggtgcttgccacggagtcg

SEQ ID NO: 474712 - DNA, 25 bp, Mus musculus
tccttgggttgacaggtgcagccat

SEQ ID NO: 474713 - DNA, 25 bp, Mus musculus
tccttggtgggttggggcaaactca

SEQ ID NO: 474714 - DNA, 25 bp, Mus musculus
tccttggtggtctttgctttagttc

SEQ ID NO: 474715 - DNA, 25 bp, Mus musculus
tccttggtgtagagggactgtcagc

SEQ ID NO: 474716 - DNA, 25 bp, Mus musculus
tccttgtaatctgagtgacctcttc

SEQ ID NO: 474717 - DNA, 25 bp, Mus musculus
tccttgtacatcgagagtggccaga

SEQ ID NO: 474718 - DNA, 25 bp, Mus musculus
tccttgtacgagacggagcggctga

SEQ ID NO: 474719 - DNA, 25 bp, Mus musculus
tccttgtagacttgtgagggcacag

SEQ ID NO: 474720 - DNA, 25 bp, Mus musculus
tccttgtagcgatgctgcaggccat

SEQ ID NO: 474721 - DNA, 25 bp, Mus musculus
tccttgtcccttgcgaggcatggag

SEQ ID NO: 474722 - DNA, 25 bp, Mus musculus
tccttgtcgtttgacacctcaggag

SEQ ID NO: 474723 - DNA, 25 bp, Mus musculus
tccttgtgaaggtggcaaacagggc

SEQ ID NO: 474724 - DNA, 25 bp, Mus musculus
tccttgtggcaaagacctgggcaat

SEQ ID NO: 474725 - DNA, 25 bp, Mus musculus
tccttgtggcaaagcggacaccaat

SEQ ID NO: 474726 - DNA, 25 bp, Mus musculus
tccttgtggcaatgaaaccggcaga

SEQ ID NO: 474727 - DNA, 25 bp, Mus musculus
tccttgtggccgatcgaagccagaa

SEQ ID NO: 474728 - DNA, 25 bp, Mus musculus
tccttgtgtagaacagctaggcagc

SEQ ID NO: 474729 - DNA, 25 bp, Mus musculus
tccttgtgtggaagaacatccagcc

SEQ ID NO: 474730 - DNA, 25 bp, Mus musculus
tccttgtgttgagctggaggcagcc

SEQ ID NO: 474731 - DNA, 25 bp, Mus musculus
tccttgttaacttctgagactgggc

SEQ ID NO: 474732 - DNA, 25 bp, Mus musculus
tccttgttatcggaggcggagccac

SEQ ID NO: 474733 - DNA, 25 bp, Mus musculus
tccttgttgccggtgggacccatta

SEQ ID NO: 474734 - DNA, 25 bp, Mus musculus
tccttgtttggttgtctctgcatag

SEQ ID NO: 474735 - DNA, 25 bp, Mus musculus
tcctttaccctgacgtgtacccgtg

SEQ ID NO: 474736 - DNA, 25 bp, Mus musculus
tcctttactgtatttctgggagaaa

SEQ ID NO: 474737 - DNA, 25 bp, Mus musculus
tcctttagatgatgtctcaggtgct

SEQ ID NO: 474738 - DNA, 25 bp, Mus musculus
tcctttagtggcatgaacaatctgc

SEQ ID NO: 474739 - DNA, 25 bp, Mus musculus
tcctttatgggaagacagccctgag

SEQ ID NO: 474740 - DNA, 25 bp, Mus musculus
tcctttcaacgttccatgctgcctg

SEQ ID NO: 474741 - DNA, 25 bp, Mus musculus
tcctttccctgatcctggccggttg

SEQ ID NO: 474742 - DNA, 25 bp, Mus musculus
tcctttcgatgtgtgcggcttaact

SEQ ID NO: 474743 - DNA, 25 bp, Mus musculus
tcctttctcaggtcttgttgcagca

SEQ ID NO: 474744 - DNA, 25 bp, Mus musculus
tcctttctcgaagagggaggtgcca

SEQ ID NO: 474745 - DNA, 25 bp, Mus musculus
tcctttctcgttcgcgcactctgtg

SEQ ID NO: 474746 - DNA, 25 bp, Mus musculus
tcctttctctgctgagctgtgcgtg

SEQ ID NO: 474747 - DNA, 25 bp, Mus musculus
tcctttgaaggaggtgcaagttccc

SEQ ID NO: 474748 - DNA, 25 bp, Mus musculus
tcctttgaatgtgcctgtccccggg

SEQ ID NO: 474749 - DNA, 25 bp, Mus musculus
tcctttgaggcatgcatgacacagc

SEQ ID NO: 474750 - DNA, 25 bp, Mus musculus
tcctttgaggctggcagacgctgtc

SEQ ID NO: 474751 - DNA, 25 bp, Mus musculus
tcctttgagttaagcccaacctggg

SEQ ID NO: 474752 - DNA, 25 bp, Mus musculus
tcctttgcagaggtgggccacacca

SEQ ID NO: 474753 - DNA, 25 bp, Mus musculus
tcctttgcagagtggtttcgtagaa

SEQ ID NO: 474754 - DNA, 25 bp, Mus musculus
tcctttgccaggtcagatgaccaca

SEQ ID NO: 474755 - DNA, 25 bp, Mus musculus
tcctttgcgatagcagtaagcacgc

SEQ ID NO: 474756 - DNA, 25 bp, Mus musculus
tcctttgcgtttgggctaacagtgg

SEQ ID NO: 474757 - DNA, 25 bp, Mus musculus
tcctttgctgaaggccagcgctgaa

SEQ ID NO: 474758 - DNA, 25 bp, Mus musculus
tcctttgggaaatcactagcctggc

SEQ ID NO: 474759 - DNA, 25 bp, Mus musculus
tcctttggtgtgtctaagaagaacc

SEQ ID NO: 474760 - DNA, 25 bp, Mus musculus
tcctttgtggccttctcactggcct

SEQ ID NO: 474761 - DNA, 25 bp, Mus musculus
tcctttgtgggctacggctgctact

SEQ ID NO: 474762 - DNA, 25 bp, Mus musculus
tccttttaggcgactagatagacag

SEQ ID NO: 474763 - DNA, 25 bp, Mus musculus
tcctttttcgcgtgggtgtgagcca

SEQ ID NO: 474764 - DNA, 25 bp, Mus musculus
tcgaaaaaagacaagccctcagcag

SEQ ID NO: 474765 - DNA, 25 bp, Mus musculus
tcgaaaaccgtgaagacctccgacg

SEQ ID NO: 474766 - DNA, 25 bp, Mus musculus
tcgaaaacgtttaggctcgccgcgt

SEQ ID NO: 474767 - DNA, 25 bp, Mus musculus
tcgaaaaggttgacgcgctgcacta

SEQ ID NO: 474768 - DNA, 25 bp, Mus musculus
tcgaaaatagatgcagggaaaactg

SEQ ID NO: 474769 - DNA, 25 bp, Mus musculus
tcgaaaatccctgctcatctgagag

SEQ ID NO: 474770 - DNA, 25 bp, Mus musculus
tcgaaacaatagatagagcaccatt

SEQ ID NO: 474771 - DNA, 25 bp, Mus musculus
tcgaaacctcaacaagctatggcgg

SEQ ID NO: 474772 - DNA, 25 bp, Mus musculus
tcgaaacctgcttttggctacccgg

SEQ ID NO: 474773 - DNA, 25 bp, Mus musculus
tcgaaacggcgaagaagctgctgga

SEQ ID NO: 474774 - DNA, 25 bp, Mus musculus
tcgaaagacaggacaagcaccagga

SEQ ID NO: 474775 - DNA, 25 bp, Mus musculus
tcgaaagcaacagcatctagccagg

SEQ ID NO: 474776 - DNA, 25 bp, Mus musculus
tcgaaaggtacaagagctacagccc

SEQ ID NO: 474777 - DNA, 25 bp, Mus musculus
tcgaaagttgaatgagcagtcccct

SEQ ID NO: 474778 - DNA, 25 bp, Mus musculus
tcgaaatgacgtgtacagagcggcc

SEQ ID NO: 474779 - DNA, 25 bp, Mus musculus
tcgaaatgtcgtgacctccgtggct

SEQ ID NO: 474780 - DNA, 25 bp, Mus musculus
tcgaaattcaggttcatgacgggct

SEQ ID NO: 474781 - DNA, 25 bp, Mus musculus
tcgaaattgccgtctccagggtgga

SEQ ID NO: 474782 - DNA, 25 bp, Mus musculus
tcgaacaggcgacaaagaatgccct

SEQ ID NO: 474783 - DNA, 25 bp, Mus musculus
tcgaacatgtcgctgaagccaaccg

SEQ ID NO: 474784 - DNA, 25 bp, Mus musculus
tcgaaccttccgtacagcatggcgg

SEQ ID NO: 474785 - DNA, 25 bp, Mus musculus
tcgaacgagggtgccaaatgtctgc

SEQ ID NO: 474786 - DNA, 25 bp, Mus musculus
tcgaactacaaatgccagagaagac

SEQ ID NO: 474787 - DNA, 25 bp, Mus musculus
tcgaactcagttgccctcagaatag

SEQ ID NO: 474788 - DNA, 25 bp, Mus musculus
tcgaactcgagaaggacagctacca

SEQ ID NO: 474789 - DNA, 25 bp, Mus musculus
tcgaactcgaggctgtgagacaagc

SEQ ID NO: 474790 - DNA, 25 bp, Mus musculus
tcgaactcttgaaacctgccacgga

SEQ ID NO: 474791 - DNA, 25 bp, Mus musculus
tcgaactgaagtaagtaagagctct

SEQ ID NO: 474792 - DNA, 25 bp, Mus musculus
tcgaactgtgagagccaaggcctag

SEQ ID NO: 474793 - DNA, 25 bp, Mus musculus
tcgaacttgcaatgattatcctgct

SEQ ID NO: 474794 - DNA, 25 bp, Mus musculus
tcgaagaagcagaagcacatcacag

SEQ ID NO: 474795 - DNA, 25 bp, Mus musculus
tcgaagaagggacggaccatcatct

SEQ ID NO: 474796 - DNA, 25 bp, Mus musculus
tcgaagaagttagttggcacccatg

SEQ ID NO: 474797 - DNA, 25 bp, Mus musculus
tcgaagaatgcaagggaggaagctg

SEQ ID NO: 474798 - DNA, 25 bp, Mus musculus
tcgaagaattctggccacggaagat

SEQ ID NO: 474799 - DNA, 25 bp, Mus musculus
tcgaagagaataggactgaggcccc

SEQ ID NO: 474800 - DNA, 25 bp, Mus musculus
tcgaagcagcccaatgtccagatgt

SEQ ID NO: 474801 - DNA, 25 bp, Mus musculus
tcgaagcgcattaccaggaggcaga

SEQ ID NO: 474802 - DNA, 25 bp, Mus musculus
tcgaagcgccgctctggaagtacgt

SEQ ID NO: 474803 - DNA, 25 bp, Mus musculus
tcgaagctcaaaaccgactggagaa

SEQ ID NO: 474804 - DNA, 25 bp, Mus musculus
tcgaagctgtcggaggaggaacctc

SEQ ID NO: 474805 - DNA, 25 bp, Mus musculus
tcgaaggatcctttgccggcagtgg

SEQ ID NO: 474806 - DNA, 25 bp, Mus musculus
tcgaaggcccatcgccagactttat

SEQ ID NO: 474807 - DNA, 25 bp, Mus musculus
tcgaaggtgttgtctgatgttctgg

SEQ ID NO: 474808 - DNA, 25 bp, Mus musculus
tcgaagtataccacccgtgtttctt

SEQ ID NO: 474809 - DNA, 25 bp, Mus musculus
tcgaagtattcttctaaggactggg

SEQ ID NO: 474810 - DNA, 25 bp, Mus musculus
tcgaataccttacatgacactgctt

SEQ ID NO: 474811 - DNA, 25 bp, Mus musculus
tcgaatagaactccagatgaccctg

SEQ ID NO: 474812 - DNA, 25 bp, Mus musculus
tcgaataggacaagcgcacacagtg

SEQ ID NO: 474813 - DNA, 25 bp, Mus musculus
tcgaatcagtgaacgccaaggctgg

SEQ ID NO: 474814 - DNA, 25 bp, Mus musculus
tcgaatccggtcacagttagcactg

SEQ ID NO: 474815 - DNA, 25 bp, Mus musculus
tcgaatcgtgggagggcatgctgcc

SEQ ID NO: 474816 - DNA, 25 bp, Mus musculus
tcgaatggcagagcactagactagc

SEQ ID NO: 474817 - DNA, 25 bp, Mus musculus
tcgaatgtctgctgtttatacggac

SEQ ID NO: 474818 - DNA, 25 bp, Mus musculus
tcgaatgtttcccaagccactgaga

SEQ ID NO: 474819 - DNA, 25 bp, Mus musculus
tcgaattgggctacggagatgctgc

SEQ ID NO: 474820 - DNA, 25 bp, Mus musculus
tcgaattttttcactgggcgcagat

SEQ ID NO: 474821 - DNA, 25 bp, Mus musculus
tcgacaaatggctgacatcctgggc

SEQ ID NO: 474822 - DNA, 25 bp, Mus musculus
tcgacaactggagggtcatctgagc

SEQ ID NO: 474823 - DNA, 25 bp, Mus musculus
tcgacaaggtgtacgtgaacatcgg

SEQ ID NO: 474824 - DNA, 25 bp, Mus musculus
tcgacaccctgagatgaagcactgg

SEQ ID NO: 474825 - DNA, 25 bp, Mus musculus
tcgacactcgtccagcaaaatgctg

SEQ ID NO: 474826 - DNA, 25 bp, Mus musculus
tcgacagcatcttggccgtgagacc

SEQ ID NO: 474827 - DNA, 25 bp, Mus musculus
tcgacagctctctaaaactgtggtg

SEQ ID NO: 474828 - DNA, 25 bp, Mus musculus
tcgacaggaagcagtgtaggctacc

SEQ ID NO: 474829 - DNA, 25 bp, Mus musculus
tcgacagtggaacagagatagcagc

SEQ ID NO: 474830 - DNA, 25 bp, Mus musculus
tcgacataaagacagacagcgcggg

SEQ ID NO: 474831 - DNA, 25 bp, Mus musculus
tcgaccatattgatgagaaggcctt

SEQ ID NO: 474832 - DNA, 25 bp, Mus musculus
tcgaccccggaaaagaggactgaga

SEQ ID NO: 474833 - DNA, 25 bp, Mus musculus
tcgaccctgtgaaactgaaagacgg

SEQ ID NO: 474834 - DNA, 25 bp, Mus musculus
tcgacctatatctgctagtgccaaa

SEQ ID NO: 474835 - DNA, 25 bp, Mus musculus
tcgaccttgactaggaacccgtgag

SEQ ID NO: 474836 - DNA, 25 bp, Mus musculus
tcgaccttgggtacaacctgctgga

SEQ ID NO: 474837 - DNA, 25 bp, Mus musculus
tcgacctttgatcgaagccaccgga

SEQ ID NO: 474838 - DNA, 25 bp, Mus musculus
tcgacgagctgaagatgaagcccag

SEQ ID NO: 474839 - DNA, 25 bp, Mus musculus
tcgacgagggtctttaccagatcag

SEQ ID NO: 474840 - DNA, 25 bp, Mus musculus
tcgacgattccgaaagaccgcaggt

SEQ ID NO: 474841 - DNA, 25 bp, Mus musculus
tcgacgcgattgtcttcaagcagca

SEQ ID NO: 474842 - DNA, 25 bp, Mus musculus
tcgacgctgctttctcccatattga

SEQ ID NO: 474843 - DNA, 25 bp, Mus musculus
tcgacggagccggtttacctgaagt

SEQ ID NO: 474844 - DNA, 25 bp, Mus musculus
tcgacgtaggttccggaggttcatt

SEQ ID NO: 474845 - DNA, 25 bp, Mus musculus
tcgacgtccatgagcccttcagtag

SEQ ID NO: 474846 - DNA, 25 bp, Mus musculus
tcgacgtcggctgcaacaagtacgg

SEQ ID NO: 474847 - DNA, 25 bp, Mus musculus
tcgacgtgcttaccgccaaagtgga

SEQ ID NO: 474848 - DNA, 25 bp, Mus musculus
tcgacgtggacgattgagctgcgcc

SEQ ID NO: 474849 - DNA, 25 bp, Mus musculus
tcgactctcgtagcggatcagggac

SEQ ID NO: 474850 - DNA, 25 bp, Mus musculus
tcgactctgacggacagcttggcct

SEQ ID NO: 474851 - DNA, 25 bp, Mus musculus
tcgactgagatggtgaacggccgta

SEQ ID NO: 474852 - DNA, 25 bp, Mus musculus
tcgactggaaacctgacaaagcgcg

SEQ ID NO: 474853 - DNA, 25 bp, Mus musculus
tcgactggcatgtgtcagcatcaag

SEQ ID NO: 474854 - DNA, 25 bp, Mus musculus
tcgactgggaagacaagaatttgac

SEQ ID NO: 474855 - DNA, 25 bp, Mus musculus
tcgactgggtggacaacatgtggcc

SEQ ID NO: 474856 - DNA, 25 bp, Mus musculus
tcgactggtacaaaaggcaaaacgg

SEQ ID NO: 474857 - DNA, 25 bp, Mus musculus
tcgactgtgtactcaagctggtgca

SEQ ID NO: 474858 - DNA, 25 bp, Mus musculus
tcgacttagccatcgagagggccag

SEQ ID NO: 474859 - DNA, 25 bp, Mus musculus
tcgacttcaagccacatagatgccg

SEQ ID NO: 474860 - DNA, 25 bp, Mus musculus
tcgacttccgctgcacggtggagag

SEQ ID NO: 474861 - DNA, 25 bp, Mus musculus
tcgacttcggaaagagaaccagatc

SEQ ID NO: 474862 - DNA, 25 bp, Mus musculus
tcgacttgctgttgcggctgcttca

SEQ ID NO: 474863 - DNA, 25 bp, Mus musculus
tcgacttggccaggttctatggaag

SEQ ID NO: 474864 - DNA, 25 bp, Mus musculus
tcgacttggtgattggtggaagccc

SEQ ID NO: 474865 - DNA, 25 bp, Mus musculus
tcgactttaacaatgccagggatgc

SEQ ID NO: 474866 - DNA, 25 bp, Mus musculus
tcgactttgagcatcgccagggcct

SEQ ID NO: 474867 - DNA, 25 bp, Mus musculus
tcgagaaaataagattacctacatc

SEQ ID NO: 474868 - DNA, 25 bp, Mus musculus
tcgagaaagcaacgaggagctagct

SEQ ID NO: 474869 - DNA, 25 bp, Mus musculus
tcgagaaccattgggagtgctggcc

SEQ ID NO: 474870 - DNA, 25 bp, Mus musculus
tcgagaacgtggacaacctgggctt

SEQ ID NO: 474871 - DNA, 25 bp, Mus musculus
tcgagaagagtaaaagtccacccgt

SEQ ID NO: 474872 - DNA, 25 bp, Mus musculus
tcgagaagcattccacattgtaggg

SEQ ID NO: 474873 - DNA, 25 bp, Mus musculus
tcgagaagcctcaagagcaaacgaa

SEQ ID NO: 474874 - DNA, 25 bp, Mus musculus
tcgagaatagatgaccccaaaggag

SEQ ID NO: 474875 - DNA, 25 bp, Mus musculus
tcgagacacactttatattgctggc

SEQ ID NO: 474876 - DNA, 25 bp, Mus musculus
tcgagaccctcgttttctactggcc

SEQ ID NO: 474877 - DNA, 25 bp, Mus musculus
tcgagactcatccaaggactccagg

SEQ ID NO: 474878 - DNA, 25 bp, Mus musculus
tcgagactgctaagatctatgatca

SEQ ID NO: 474879 - DNA, 25 bp, Mus musculus
tcgagagccactatgactacacggt

SEQ ID NO: 474880 - DNA, 25 bp, Mus musculus
tcgagagcctgggagtagagcctac

SEQ ID NO: 474881 - DNA, 25 bp, Mus musculus
tcgagaggaccacatagaactgctg

SEQ ID NO: 474882 - DNA, 25 bp, Mus musculus
tcgagaggcatatggtgacgcacaa

SEQ ID NO: 474883 - DNA, 25 bp, Mus musculus
tcgagaggccatcgagacatctctg

SEQ ID NO: 474884 - DNA, 25 bp, Mus musculus
tcgagagtggtaccttcaggaccca

SEQ ID NO: 474885 - DNA, 25 bp, Mus musculus
tcgagatcaaaggtacgggcgctct

SEQ ID NO: 474886 - DNA, 25 bp, Mus musculus
tcgagatgatcgaatccacggagcc

SEQ ID NO: 474887 - DNA, 25 bp, Mus musculus
tcgagcacacagtctccatgagctt

SEQ ID NO: 474888 - DNA, 25 bp, Mus musculus
tcgagcagcctactaaccggattgg

SEQ ID NO: 474889 - DNA, 25 bp, Mus musculus
tcgagccaagaatagaagacaggtg

SEQ ID NO: 474890 - DNA, 25 bp, Mus musculus
tcgagccacaacacgagctcaagtt

SEQ ID NO: 474891 - DNA, 25 bp, Mus musculus
tcgagcccacgtgaagaaaaccatt

SEQ ID NO: 474892 - DNA, 25 bp, Mus musculus
tcgagcccgcagaaaacaagtgtct

SEQ ID NO: 474893 - DNA, 25 bp, Mus musculus
tcgagccgagctcaaccaagggatg

SEQ ID NO: 474894 - DNA, 25 bp, Mus musculus
tcgagccgccaatatcctagtaggg

SEQ ID NO: 474895 - DNA, 25 bp, Mus musculus
tcgagcctgggaacagatacagctt

SEQ ID NO: 474896 - DNA, 25 bp, Mus musculus
tcgagcgcagaaaaaagatgaccgt

SEQ ID NO: 474897 - DNA, 25 bp, Mus musculus
tcgagcggcgcaagatcatggagca

SEQ ID NO: 474898 - DNA, 25 bp, Mus musculus
tcgagcgtgggcagccctttgaagt

SEQ ID NO: 474899 - DNA, 25 bp, Mus musculus
tcgagcgtgtctgcaaaggatgccc

SEQ ID NO: 474900 - DNA, 25 bp, Mus musculus
tcgagctgccccagtatgcgagact

SEQ ID NO: 474901 - DNA, 25 bp, Mus musculus
tcgagctgctggagcactacgtggc

SEQ ID NO: 474902 - DNA, 25 bp, Mus musculus
tcgaggaaccagtacagtcctgcca

SEQ ID NO: 474903 - DNA, 25 bp, Mus musculus
tcgaggaagacaacatgctgagcat

SEQ ID NO: 474904 - DNA, 25 bp, Mus musculus
tcgaggaagggctctctgaggtctg

SEQ ID NO: 474905 - DNA, 25 bp, Mus musculus
tcgaggaataaatgaccactgcttt

SEQ ID NO: 474906 - DNA, 25 bp, Mus musculus
tcgaggaattcctggaggccatgct

SEQ ID NO: 474907 - DNA, 25 bp, Mus musculus
tcgaggacagtcagctccactaagc

SEQ ID NO: 474908 - DNA, 25 bp, Mus musculus
tcgaggactcattccccagggagga

SEQ ID NO: 474909 - DNA, 25 bp, Mus musculus
tcgaggagctgaacaaaacgaggga

SEQ ID NO: 474910 - DNA, 25 bp, Mus musculus
tcgaggatactggtaacctggctcc

SEQ ID NO: 474911 - DNA, 25 bp, Mus musculus
tcgaggatcagacagtgcagccact

SEQ ID NO: 474912 - DNA, 25 bp, Mus musculus
tcgaggatcgcattcaagaggaagc

SEQ ID NO: 474913 - DNA, 25 bp, Mus musculus
tcgaggcatacttcagcaacgtggc

SEQ ID NO: 474914 - DNA, 25 bp, Mus musculus
tcgaggcccaccagtgatagagaat

SEQ ID NO: 474915 - DNA, 25 bp, Mus musculus
tcgaggccctggaaaattcgcagca

SEQ ID NO: 474916 - DNA, 25 bp, Mus musculus
tcgaggctggaaaggctgacatgta

SEQ ID NO: 474917 - DNA, 25 bp, Mus musculus
tcgagggaccccaagtgaagatgag

SEQ ID NO: 474918 - DNA, 25 bp, Mus musculus
tcgagggccagttcagcatcaacaa

SEQ ID NO: 474919 - DNA, 25 bp, Mus musculus
tcgagggcctggagtacaacatgtt

SEQ ID NO: 474920 - DNA, 25 bp, Mus musculus
tcgagggtagcttttgcacgggctc

SEQ ID NO: 474921 - DNA, 25 bp, Mus musculus
tcgagggtccagataccagtgcaca

SEQ ID NO: 474922 - DNA, 25 bp, Mus musculus
tcgaggtagagccaaagcagaacat

SEQ ID NO: 474923 - DNA, 25 bp, Mus musculus
tcgaggtggagcttaaccctgggcc

SEQ ID NO: 474924 - DNA, 25 bp, Mus musculus
tcgaggttgaagctagcaaaagttg

SEQ ID NO: 474925 - DNA, 25 bp, Mus musculus
tcgaggtttttgaatggtggtccaa

SEQ ID NO: 474926 - DNA, 25 bp, Mus musculus
tcgagtacaatgtggagcacgccgt

SEQ ID NO: 474927 - DNA, 25 bp, Mus musculus
tcgagtacccgtttgacctggagaa

SEQ ID NO: 474928 - DNA, 25 bp, Mus musculus
tcgagtactacatctctggtggacc

SEQ ID NO: 474929 - DNA, 25 bp, Mus musculus
tcgagtagccgaggataaccatata

SEQ ID NO: 474930 - DNA, 25 bp, Mus musculus
tcgagtataatgacggaaggcccac

SEQ ID NO: 474931 - DNA, 25 bp, Mus musculus
tcgagtattacacgcagcagcaggg

SEQ ID NO: 474932 - DNA, 25 bp, Mus musculus
tcgagtcaatcaggaggagctgccc

SEQ ID NO: 474933 - DNA, 25 bp, Mus musculus
tcgagtccgatgaagccgacattgg

SEQ ID NO: 474934 - DNA, 25 bp, Mus musculus
tcgagtccgtgttttgcaccttgtt

SEQ ID NO: 474935 - DNA, 25 bp, Mus musculus
tcgagtctgggacgatggctaccct

SEQ ID NO: 474936 - DNA, 25 bp, Mus musculus
tcgagtgaacagacgtcagatgcct

SEQ ID NO: 474937 - DNA, 25 bp, Mus musculus
tcgagtgacacagaatgtaggctgc

SEQ ID NO: 474938 - DNA, 25 bp, Mus musculus
tcgagtggagaagccagcgactcct

SEQ ID NO: 474939 - DNA, 25 bp, Mus musculus
tcgagtgggcaactccaaagggcac

SEQ ID NO: 474940 - DNA, 25 bp, Mus musculus
tcgagtgtcccagacagaaacaggt

SEQ ID NO: 474941 - DNA, 25 bp, Mus musculus
tcgagtgtcccgtcccaagggacgt

SEQ ID NO: 474942 - DNA, 25 bp, Mus musculus
tcgagttaaattgaggcgttccttc

SEQ ID NO: 474943 - DNA, 25 bp, Mus musculus
tcgagttggaggtgaacccttgagt

SEQ ID NO: 474944 - DNA, 25 bp, Mus musculus
tcgagttttagctcaggcgagtgcc

SEQ ID NO: 474945 - DNA, 25 bp, Mus musculus
tcgataaagaatccagggagctgct

SEQ ID NO: 474946 - DNA, 25 bp, Mus musculus
tcgataaggtgcacagagaaggcgc

SEQ ID NO: 474947 - DNA, 25 bp, Mus musculus
tcgatacctatctgctgaggatgga

SEQ ID NO: 474948 - DNA, 25 bp, Mus musculus
tcgatactcaacagaaggtgaagct

SEQ ID NO: 474949 - DNA, 25 bp, Mus musculus
tcgatagatcgatagctccgcctct

SEQ ID NO: 474950 - DNA, 25 bp, Mus musculus
tcgatagctccgcattatgtcaaag

SEQ ID NO: 474951 - DNA, 25 bp, Mus musculus
tcgatatcatcaaggcgtctggcaa

SEQ ID NO: 474952 - DNA, 25 bp, Mus musculus
tcgatatgggtatgtgggctcctcc

SEQ ID NO: 474953 - DNA, 25 bp, Mus musculus
tcgatcaagcgggtcagaggagctc

SEQ ID NO: 474954 - DNA, 25 bp, Mus musculus
tcgatcagaatgctctagtcaagcg

SEQ ID NO: 474955 - DNA, 25 bp, Mus musculus
tcgatccccaagcacagatgagagc

SEQ ID NO: 474956 - DNA, 25 bp, Mus musculus
tcgatcctcacactcaagccaggaa

SEQ ID NO: 474957 - DNA, 25 bp, Mus musculus
tcgatcgatttaagagatggaaggc

SEQ ID NO: 474958 - DNA, 25 bp, Mus musculus
tcgatcgcaggctgaactcgtctcc

SEQ ID NO: 474959 - DNA, 25 bp, Mus musculus
tcgatctagtgatggcacagcagct

SEQ ID NO: 474960 - DNA, 25 bp, Mus musculus
tcgatctccaacgatgccttcaggg

SEQ ID NO: 474961 - DNA, 25 bp, Mus musculus
tcgatgagctcctggatagcagcct

SEQ ID NO: 474962 - DNA, 25 bp, Mus musculus
tcgatgagtcaaagcgccattgcct

SEQ ID NO: 474963 - DNA, 25 bp, Mus musculus
tcgatgcagacctttcgggcagggc

SEQ ID NO: 474964 - DNA, 25 bp, Mus musculus
tcgatgcccttaaggacagtccagc

SEQ ID NO: 474965 - DNA, 25 bp, Mus musculus
tcgatgctcagattcttcccgcggc

SEQ ID NO: 474966 - DNA, 25 bp, Mus musculus
tcgatgctgcgctacgaggacgtgc

SEQ ID NO: 474967 - DNA, 25 bp, Mus musculus
tcgatggtcctacatgcctgaggcc

SEQ ID NO: 474968 - DNA, 25 bp, Mus musculus
tcgatgtcacgtgtgcaccaacagt

SEQ ID NO: 474969 - DNA, 25 bp, Mus musculus
tcgattataaatggaaggcgacggg

SEQ ID NO: 474970 - DNA, 25 bp, Mus musculus
tcgattatcggcagcagagtgccgc

SEQ ID NO: 474971 - DNA, 25 bp, Mus musculus
tcgattatgacttcccactgctgtg

SEQ ID NO: 474972 - DNA, 25 bp, Mus musculus
tcgattcagaaggtaccggagctac

SEQ ID NO: 474973 - DNA, 25 bp, Mus musculus
tcgatttccaaaccagggcaggcaa

SEQ ID NO: 474974 - DNA, 25 bp, Mus musculus
tcgatttcgcctgcagtgtgcgcgg

SEQ ID NO: 474975 - DNA, 25 bp, Mus musculus
tcgatttgaaactccctagccaggg

SEQ ID NO: 474976 - DNA, 25 bp, Mus musculus
tcgcaaaagcatctgtggaccacat

SEQ ID NO: 474977 - DNA, 25 bp, Mus musculus
tcgcaacactttcaggtaatgtggc

SEQ ID NO: 474978 - DNA, 25 bp, Mus musculus
tcgcaaccgtggtgtgcaacctggg

SEQ ID NO: 474979 - DNA, 25 bp, Mus musculus
tcgcaactgggaactggcaaaactg

SEQ ID NO: 474980 - DNA, 25 bp, Mus musculus
tcgcaacttgctcggcaccagaaag

SEQ ID NO: 474981 - DNA, 25 bp, Mus musculus
tcgcaagaattgtgggtacccgggc

SEQ ID NO: 474982 - DNA, 25 bp, Mus musculus
tcgcaattaagatccgggtggaaac

SEQ ID NO: 474983 - DNA, 25 bp, Mus musculus
tcgcaccacaggcagaatattaagt

SEQ ID NO: 474984 - DNA, 25 bp, Mus musculus
tcgcacccaggttgttgaaaagtct

SEQ ID NO: 474985 - DNA, 25 bp, Mus musculus
tcgcacctaccaggttgtacttggg

SEQ ID NO: 474986 - DNA, 25 bp, Mus musculus
tcgcacctggacgtgtgtaagaccg

SEQ ID NO: 474987 - DNA, 25 bp, Mus musculus
tcgcagaaagctgacggcagaagca

SEQ ID NO: 474988 - DNA, 25 bp, Mus musculus
tcgcagaagctaagaatggcacagt

SEQ ID NO: 474989 - DNA, 25 bp, Mus musculus
tcgcagacccacaggcctatcagaa

SEQ ID NO: 474990 - DNA, 25 bp, Mus musculus
tcgcagacctacatgaacggctcgc

SEQ ID NO: 474991 - DNA, 25 bp, Mus musculus
tcgcagacggtgtttatgagaccag

SEQ ID NO: 474992 - DNA, 25 bp, Mus musculus
tcgcagagcaggaaaaagtggcacc

SEQ ID NO: 474993 - DNA, 25 bp, Mus musculus
tcgcagcagcacagaagacatggag

SEQ ID NO: 474994 - DNA, 25 bp, Mus musculus
tcgcagccgagaaaaagaaccagtt

SEQ ID NO: 474995 - DNA, 25 bp, Mus musculus
tcgcagccgtgttatatggagagtc

SEQ ID NO: 474996 - DNA, 25 bp, Mus musculus
tcgcagcctcttgctggaaccaagg

SEQ ID NO: 474997 - DNA, 25 bp, Mus musculus
tcgcagctcaactcaggaagatcgg

SEQ ID NO: 474998 - DNA, 25 bp, Mus musculus
tcgcagctccgggaggacacgtcgt

SEQ ID NO: 474999 - DNA, 25 bp, Mus musculus
tcgcagctgacacctacaggatcgg

SEQ ID NO: 475000 - DNA, 25 bp, Mus musculus
tcgcagtggcatcgtcagaaacaac

SEQ ID NO: 475001 - DNA, 25 bp, Mus musculus
tcgcagtttctctagaattcaacca

SEQ ID NO: 475002 - DNA, 25 bp, Mus musculus
tcgcatacaggatgagcttcggccc

SEQ ID NO: 475003 - DNA, 25 bp, Mus musculus
tcgcatacccggatgatgtcctgga

SEQ ID NO: 475004 - DNA, 25 bp, Mus musculus
tcgcatccagagacaggacgaggag

SEQ ID NO: 475005 - DNA, 25 bp, Mus musculus
tcgcatgaggctccgcaaatacctg

SEQ ID NO: 475006 - DNA, 25 bp, Mus musculus
tcgcatgagtgcaaacccgagggct

SEQ ID NO: 475007 - DNA, 25 bp, Mus musculus
tcgcattggccgtacaggtcgtgtt

SEQ ID NO: 475008 - DNA, 25 bp, Mus musculus
tcgcattggttcatgagtgagtttc

SEQ ID NO: 475009 - DNA, 25 bp, Mus musculus
tcgccaaaggaccagaaatcaagtc

SEQ ID NO: 475010 - DNA, 25 bp, Mus musculus
tcgccaaattcgaggcgcacgaggt

SEQ ID NO: 475011 - DNA, 25 bp, Mus musculus
tcgccaacagaaagagatggctcct

SEQ ID NO: 475012 - DNA, 25 bp, Mus musculus
tcgccaagaagtgagcacagcaagc

SEQ ID NO: 475013 - DNA, 25 bp, Mus musculus
tcgccaagcagttcaagcaacgacg

SEQ ID NO: 475014 - DNA, 25 bp, Mus musculus
tcgccaagggtatgagagccatact

SEQ ID NO: 475015 - DNA, 25 bp, Mus musculus
tcgccaatgagacggagaagaaatc

SEQ ID NO: 475016 - DNA, 25 bp, Mus musculus
tcgccaccgacgaatgtgaactgtg

SEQ ID NO: 475017 - DNA, 25 bp, Mus musculus
tcgccagacggcactagggtataca

SEQ ID NO: 475018 - DNA, 25 bp, Mus musculus
tcgccagacggcagagcataagtag

SEQ ID NO: 475019 - DNA, 25 bp, Mus musculus
tcgccagcggcttgatccgtcagaa

SEQ ID NO: 475020 - DNA, 25 bp, Mus musculus
tcgccaggatgctcaacactacgct

SEQ ID NO: 475021 - DNA, 25 bp, Mus musculus
tcgccagggagagcagtcacttgat

SEQ ID NO: 475022 - DNA, 25 bp, Mus musculus
tcgccaggttagcacgaaggactgt

SEQ ID NO: 475023 - DNA, 25 bp, Mus musculus
tcgccatccctagcagtagtgaaag

SEQ ID NO: 475024 - DNA, 25 bp, Mus musculus
tcgccatctacgagcaggactcagg

SEQ ID NO: 475025 - DNA, 25 bp, Mus musculus
tcgccatgctttgagcccacagttt

SEQ ID NO: 475026 - DNA, 25 bp, Mus musculus
tcgccatgggagacgtactgtccac

SEQ ID NO: 475027 - DNA, 25 bp, Mus musculus
tcgccattgagatagccgccgccgt

SEQ ID NO: 475028 - DNA, 25 bp, Mus musculus
tcgcccaagtcggaatatacctacg

SEQ ID NO: 475029 - DNA, 25 bp, Mus musculus
tcgccccagcctttgtaagcagtgg

SEQ ID NO: 475030 - DNA, 25 bp, Mus musculus
tcgcccctcgatgacacagaagtaa

SEQ ID NO: 475031 - DNA, 25 bp, Mus musculus
tcgccctacgggtcattgagagaaa

SEQ ID NO: 475032 - DNA, 25 bp, Mus musculus
tcgccctcctatggtgtgagcttct

SEQ ID NO: 475033 - DNA, 25 bp, Mus musculus
tcgcccttttacctgcggaggcagg

SEQ ID NO: 475034 - DNA, 25 bp, Mus musculus
tcgccgaagctacgttatcctaggg

SEQ ID NO: 475035 - DNA, 25 bp, Mus musculus
tcgccgaaggagcaagaaagacgtc

SEQ ID NO: 475036 - DNA, 25 bp, Mus musculus
tcgccgagcaaagatgaaaaggtcc

SEQ ID NO: 475037 - DNA, 25 bp, Mus musculus
tcgccgagctaaatggagaagactg

SEQ ID NO: 475038 - DNA, 25 bp, Mus musculus
tcgccgaggaccttgccaaagtgca

SEQ ID NO: 475039 - DNA, 25 bp, Mus musculus
tcgccgatccgaagaggaaatccag

SEQ ID NO: 475040 - DNA, 25 bp, Mus musculus
tcgccgcagcccctaagaagtagat

SEQ ID NO: 475041 - DNA, 25 bp, Mus musculus
tcgccgcaggcgcatagagattgcc

SEQ ID NO: 475042 - DNA, 25 bp, Mus musculus
tcgccgctcggcagttcatgttgaa

SEQ ID NO: 475043 - DNA, 25 bp, Mus musculus
tcgccggactatggaatacagatgt

SEQ ID NO: 475044 - DNA, 25 bp, Mus musculus
tcgccggcggcctcatgcaggctga

SEQ ID NO: 475045 - DNA, 25 bp, Mus musculus
tcgcctacaaatctagagcttccag

SEQ ID NO: 475046 - DNA, 25 bp, Mus musculus
tcgcctacagatagagcagacctca

SEQ ID NO: 475047 - DNA, 25 bp, Mus musculus
tcgcctacatagagccggtggagca

SEQ ID NO: 475048 - DNA, 25 bp, Mus musculus
tcgcctaccatgaaggtaacccact

SEQ ID NO: 475049 - DNA, 25 bp, Mus musculus
tcgcctacttcagcggttctaagga

SEQ ID NO: 475050 - DNA, 25 bp, Mus musculus
tcgcctagagcactgaaaaggagcc

SEQ ID NO: 475051 - DNA, 25 bp, Mus musculus
tcgcctgagggatactggatcagca

SEQ ID NO: 475052 - DNA, 25 bp, Mus musculus
tcgcctgcaaatccgggacctaagt

SEQ ID NO: 475053 - DNA, 25 bp, Mus musculus
tcgcctgcgggcatgcgaagagcaa

SEQ ID NO: 475054 - DNA, 25 bp, Mus musculus
tcgcctgcggttatgtaatgtggca

SEQ ID NO: 475055 - DNA, 25 bp, Mus musculus
tcgcctgctccctggcgtgactcgg

SEQ ID NO: 475056 - DNA, 25 bp, Mus musculus
tcgcctgggtaccacaactgcagtg

SEQ ID NO: 475057 - DNA, 25 bp, Mus musculus
tcgccttatgagatgatgctgccca

SEQ ID NO: 475058 - DNA, 25 bp, Mus musculus
tcgccttcaactcggtcaacgtggg

SEQ ID NO: 475059 - DNA, 25 bp, Mus musculus
tcgccttcccttgacctagtttgtg

SEQ ID NO: 475060 - DNA, 25 bp, Mus musculus
tcgccttggagataggtgcaaagcc

SEQ ID NO: 475061 - DNA, 25 bp, Mus musculus
tcgcctttccattatggcccagtac

SEQ ID NO: 475062 - DNA, 25 bp, Mus musculus
tcgcgaacaaaggagcccgcgtgtg

SEQ ID NO: 475063 - DNA, 25 bp, Mus musculus
tcgcgatggcattcgcaagttggtg

SEQ ID NO: 475064 - DNA, 25 bp, Mus musculus
tcgcgatgtacgactgcatggaatc

SEQ ID NO: 475065 - DNA, 25 bp, Mus musculus
tcgcgcatccaggtaggcacagatc

SEQ ID NO: 475066 - DNA, 25 bp, Mus musculus
tcgcgctaactcgtgcgggcgactg

SEQ ID NO: 475067 - DNA, 25 bp, Mus musculus
tcgcggagcccgcttggttgcacat

SEQ ID NO: 475068 - DNA, 25 bp, Mus musculus
tcgcggcaaagaggttagggttaca

SEQ ID NO: 475069 - DNA, 25 bp, Mus musculus
tcgcggcctcaaagtcacaccagta

SEQ ID NO: 475070 - DNA, 25 bp, Mus musculus
tcgcggcgagcgagttctacaagac

SEQ ID NO: 475071 - DNA, 25 bp, Mus musculus
tcgcgggcagcgatcctgacgtccg

SEQ ID NO: 475072 - DNA, 25 bp, Mus musculus
tcgcgttttccgcaaccgtagcggg

SEQ ID NO: 475073 - DNA, 25 bp, Mus musculus
tcgctaaaggaggagcatctctggg

SEQ ID NO: 475074 - DNA, 25 bp, Mus musculus
tcgctaagagagaagacagtgacgg

SEQ ID NO: 475075 - DNA, 25 bp, Mus musculus
tcgctacactggtgcagaggattca

SEQ ID NO: 475076 - DNA, 25 bp, Mus musculus
tcgctactggaggataacaaacgct

SEQ ID NO: 475077 - DNA, 25 bp, Mus musculus
tcgctagaggctgtatcagaggata

SEQ ID NO: 475078 - DNA, 25 bp, Mus musculus
tcgctagcgggagaacgaactgacc

SEQ ID NO: 475079 - DNA, 25 bp, Mus musculus
tcgctagctatctggatcactccct

SEQ ID NO: 475080 - DNA, 25 bp, Mus musculus
tcgctagtgatcgttgccaaatgac

SEQ ID NO: 475081 - DNA, 25 bp, Mus musculus
tcgctataccataaagaggaggccc

SEQ ID NO: 475082 - DNA, 25 bp, Mus musculus
tcgctataggtgagcaagtcttggc

SEQ ID NO: 475083 - DNA, 25 bp, Mus musculus
tcgctatcgggtggcttacaagaca

SEQ ID NO: 475084 - DNA, 25 bp, Mus musculus
tcgctattggtaacttttgagccta

SEQ ID NO: 475085 - DNA, 25 bp, Mus musculus
tcgctccagctcagacatcttgtgt

SEQ ID NO: 475086 - DNA, 25 bp, Mus musculus
tcgctcggctcacggaatggagaaa

SEQ ID NO: 475087 - DNA, 25 bp, Mus musculus
tcgctctactgcctttcatggaact

SEQ ID NO: 475088 - DNA, 25 bp, Mus musculus
tcgctctcctttgcctagggagtgg

SEQ ID NO: 475089 - DNA, 25 bp, Mus musculus
tcgctctctgaaaagccacaggtgt

SEQ ID NO: 475090 - DNA, 25 bp, Mus musculus
tcgctctgaagttaactttatgtcc

SEQ ID NO: 475091 - DNA, 25 bp, Mus musculus
tcgctgaggagcatgcgccgtccat

SEQ ID NO: 475092 - DNA, 25 bp, Mus musculus
tcgctgcaagtgtcgaggagcttgc

SEQ ID NO: 475093 - DNA, 25 bp, Mus musculus
tcgctgcagtaagaccgtagatcca

SEQ ID NO: 475094 - DNA, 25 bp, Mus musculus
tcgctgcagtcatggctgctgacgg

SEQ ID NO: 475095 - DNA, 25 bp, Mus musculus
tcgctgcggctttgtttagtttggt

SEQ ID NO: 475096 - DNA, 25 bp, Mus musculus
tcgctgctaagtgaggaaatggtcc

SEQ ID NO: 475097 - DNA, 25 bp, Mus musculus
tcgctgctcagggaaacattctggg

SEQ ID NO: 475098 - DNA, 25 bp, Mus musculus
tcgctgctgcagactgggctgaaag

SEQ ID NO: 475099 - DNA, 25 bp, Mus musculus
tcgctgctgtagtgtcagtctgaga

SEQ ID NO: 475100 - DNA, 25 bp, Mus musculus
tcgctggacagcattgacaaaggag

SEQ ID NO: 475101 - DNA, 25 bp, Mus musculus
tcgctggagcagagttcaagctctt

SEQ ID NO: 475102 - DNA, 25 bp, Mus musculus
tcgctggattcaggcttgactctcg

SEQ ID NO: 475103 - DNA, 25 bp, Mus musculus
tcgctgggatatacgggctggacaa

SEQ ID NO: 475104 - DNA, 25 bp, Mus musculus
tcgctgggtggctcaaaggcatatc

SEQ ID NO: 475105 - DNA, 25 bp, Mus musculus
tcgctgtcagacatccacctgggtg

SEQ ID NO: 475106 - DNA, 25 bp, Mus musculus
tcgctgtgatctcaggccgaaatcg

SEQ ID NO: 475107 - DNA, 25 bp, Mus musculus
tcgcttacctggagcaccgaagggt

SEQ ID NO: 475108 - DNA, 25 bp, Mus musculus
tcgcttactctgaggaaccctttca

SEQ ID NO: 475109 - DNA, 25 bp, Mus musculus
tcgcttagaaggaacaaacgtgact

SEQ ID NO: 475110 - DNA, 25 bp, Mus musculus
tcgcttcaagcagtagaacacggca

SEQ ID NO: 475111 - DNA, 25 bp, Mus musculus
tcgcttcacacagccaataggattt

SEQ ID NO: 475112 - DNA, 25 bp, Mus musculus
tcgcttccaacttcctggcaggaga

SEQ ID NO: 475113 - DNA, 25 bp, Mus musculus
tcgcttctccggaacctgggatagg

SEQ ID NO: 475114 - DNA, 25 bp, Mus musculus
tcgcttggtgaagaataaggagccc

SEQ ID NO: 475115 - DNA, 25 bp, Mus musculus
tcgctttcaggtgcggttgaccatc

SEQ ID NO: 475116 - DNA, 25 bp, Mus musculus
tcgctttcctccagggcatgtgtgg

SEQ ID NO: 475117 - DNA, 25 bp, Mus musculus
tcgctttgagcgcactaacgtggcc

SEQ ID NO: 475118 - DNA, 25 bp, Mus musculus
tcgctttggaggcaaaacagttcct

SEQ ID NO: 475119 - DNA, 25 bp, Mus musculus
tcgctttggatcgtggaagtcggct

SEQ ID NO: 475120 - DNA, 25 bp, Mus musculus
tcgcttttcgtggtggctcggatcc

SEQ ID NO: 475121 - DNA, 25 bp, Mus musculus
tcggaaacccagctgggtacttgaa

SEQ ID NO: 475122 - DNA, 25 bp, Mus musculus
tcggaaagcaaggatgaagaaacat

SEQ ID NO: 475123 - DNA, 25 bp, Mus musculus
tcggaaatcccgagtgctgaagact

SEQ ID NO: 475124 - DNA, 25 bp, Mus musculus
tcggaaatgacggaagctacagact

SEQ ID NO: 475125 - DNA, 25 bp, Mus musculus
tcggaaatgagaagcctggaaccag

SEQ ID NO: 475126 - DNA, 25 bp, Mus musculus
tcggaaatgtctcacagcccaagtg

SEQ ID NO: 475127 - DNA, 25 bp, Mus musculus
tcggaacaaagtaaggacctgagcg

SEQ ID NO: 475128 - DNA, 25 bp, Mus musculus
tcggaacacgaaagagccaacactg

SEQ ID NO: 475129 - DNA, 25 bp, Mus musculus
tcggaaccccagcaagtgatcaagt

SEQ ID NO: 475130 - DNA, 25 bp, Mus musculus
tcggaaccgatgctccaaagactgg

SEQ ID NO: 475131 - DNA, 25 bp, Mus musculus
tcggaaccgggatggtccttacaga

SEQ ID NO: 475132 - DNA, 25 bp, Mus musculus
tcggaacgcatctccttggcggtgg

SEQ ID NO: 475133 - DNA, 25 bp, Mus musculus
tcggaactggacaaggtgccgtttg

SEQ ID NO: 475134 - DNA, 25 bp, Mus musculus
tcggaactgtcgaggtcaccaaggc

SEQ ID NO: 475135 - DNA, 25 bp, Mus musculus
tcggaagataaaactgttcctttat

SEQ ID NO: 475136 - DNA, 25 bp, Mus musculus
tcggaagcaaaatgtctctcaagct

SEQ ID NO: 475137 - DNA, 25 bp, Mus musculus
tcggaaggaccagatggctgacact

SEQ ID NO: 475138 - DNA, 25 bp, Mus musculus
tcggaagtctatgtctaagctgctc

SEQ ID NO: 475139 - DNA, 25 bp, Mus musculus
tcggaagtgggtattgacagctgcc

SEQ ID NO: 475140 - DNA, 25 bp, Mus musculus
tcggaagtgtcctgccaaagcaagt

SEQ ID NO: 475141 - DNA, 25 bp, Mus musculus
tcggaataagaacaacgcctgcggc

SEQ ID NO: 475142 - DNA, 25 bp, Mus musculus
tcggaatgccatctagtctgagtct

SEQ ID NO: 475143 - DNA, 25 bp, Mus musculus
tcggaatgcgcgctaaagctgcaag

SEQ ID NO: 475144 - DNA, 25 bp, Mus musculus
tcggacaaatgcaagtgcaagggct

SEQ ID NO: 475145 - DNA, 25 bp, Mus musculus
tcggacagagcacgcagaaaacatg

SEQ ID NO: 475146 - DNA, 25 bp, Mus musculus
tcggacagtttacagtgttcttgag

SEQ ID NO: 475147 - DNA, 25 bp, Mus musculus
tcggacatcttcaggctcgcttcaa

SEQ ID NO: 475148 - DNA, 25 bp, Mus musculus
tcggacatgacggaaggacctcctt

SEQ ID NO: 475149 - DNA, 25 bp, Mus musculus
tcggacatgcaagagttgcctacat

SEQ ID NO: 475150 - DNA, 25 bp, Mus musculus
tcggacattatgagtgccagccaga

SEQ ID NO: 475151 - DNA, 25 bp, Mus musculus
tcggaccacgaatcagagcagggct

SEQ ID NO: 475152 - DNA, 25 bp, Mus musculus
tcggacccgggacactacagtttct

SEQ ID NO: 475153 - DNA, 25 bp, Mus musculus
tcggaccctgtggaaatcaagacgc

SEQ ID NO: 475154 - DNA, 25 bp, Mus musculus
tcggacctaggtttctccacaaagt

SEQ ID NO: 475155 - DNA, 25 bp, Mus musculus
tcggacgagtaccagcaagtcaggc

SEQ ID NO: 475156 - DNA, 25 bp, Mus musculus
tcggacgccgataagaggaagcact

SEQ ID NO: 475157 - DNA, 25 bp, Mus musculus
tcggacggactatgcttcagaactg

SEQ ID NO: 475158 - DNA, 25 bp, Mus musculus
tcggacggtgaaagcagaggactct

SEQ ID NO: 475159 - DNA, 25 bp, Mus musculus
tcggactcaagcagaaacagtggct

SEQ ID NO: 475160 - DNA, 25 bp, Mus musculus
tcggactcagaagaacaaagccaca

SEQ ID NO: 475161 - DNA, 25 bp, Mus musculus
tcggacttccatttcagtgcccgcg

SEQ ID NO: 475162 - DNA, 25 bp, Mus musculus
tcggacttgaaaaggcacatgcgtg

SEQ ID NO: 475163 - DNA, 25 bp, Mus musculus
tcggacttgtatcaagaaaaaagac

SEQ ID NO: 475164 - DNA, 25 bp, Mus musculus
tcggagaacatgtcacttgccaggg

SEQ ID NO: 475165 - DNA, 25 bp, Mus musculus
tcggagaacccaagcttagaacagc

SEQ ID NO: 475166 - DNA, 25 bp, Mus musculus
tcggagaatgatgaaaacagtgttt

SEQ ID NO: 475167 - DNA, 25 bp, Mus musculus
tcggagacatctacagcactggcct

SEQ ID NO: 475168 - DNA, 25 bp, Mus musculus
tcggagagaagtgcttaagataagg

SEQ ID NO: 475169 - DNA, 25 bp, Mus musculus
tcggagagcgtcatgaactggcagc

SEQ ID NO: 475170 - DNA, 25 bp, Mus musculus
tcggagagtcttacccaaagtcaga

SEQ ID NO: 475171 - DNA, 25 bp, Mus musculus
tcggagagttcagaggtgcctaagc

SEQ ID NO: 475172 - DNA, 25 bp, Mus musculus
tcggagatccccaaggtaggtgttt

SEQ ID NO: 475173 - DNA, 25 bp, Mus musculus
tcggagattcaggactgtacaccag

SEQ ID NO: 475174 - DNA, 25 bp, Mus musculus
tcggagcaatgctaatggagtcact

SEQ ID NO: 475175 - DNA, 25 bp, Mus musculus
tcggagcagaaggttttcatctgac

SEQ ID NO: 475176 - DNA, 25 bp, Mus musculus
tcggagcaggacaagacacatcact

SEQ ID NO: 475177 - DNA, 25 bp, Mus musculus
tcggagcagtgtaacaaccgtggct

SEQ ID NO: 475178 - DNA, 25 bp, Mus musculus
tcggagccaggcttggacctcttcc

SEQ ID NO: 475179 - DNA, 25 bp, Mus musculus
tcggagccggctacgctgggctctg

SEQ ID NO: 475180 - DNA, 25 bp, Mus musculus
tcggagctgagagaccaggcttcca

SEQ ID NO: 475181 - DNA, 25 bp, Mus musculus
tcggagctggcattgatgtacaacg

SEQ ID NO: 475182 - DNA, 25 bp, Mus musculus
tcggaggacggcactgtgcagcaaa

SEQ ID NO: 475183 - DNA, 25 bp, Mus musculus
tcggaggactcagttggcagaccac

SEQ ID NO: 475184 - DNA, 25 bp, Mus musculus
tcggaggaggaaacggaaatccgca

SEQ ID NO: 475185 - DNA, 25 bp, Mus musculus
tcggaggcccgtagggaccccactg

SEQ ID NO: 475186 - DNA, 25 bp, Mus musculus
tcggaggctcagagtgcaagtccca

SEQ ID NO: 475187 - DNA, 25 bp, Mus musculus
tcggagggcaaatcagcagaaggct

SEQ ID NO: 475188 - DNA, 25 bp, Mus musculus
tcggagggtccctttgtcagtatga

SEQ ID NO: 475189 - DNA, 25 bp, Mus musculus
tcggaggtggccagtcttgtgcaca

SEQ ID NO: 475190 - DNA, 25 bp, Mus musculus
tcggagtcagacctcagtgattagt

SEQ ID NO: 475191 - DNA, 25 bp, Mus musculus
tcggagtcagcgtcccgatccttgg

SEQ ID NO: 475192 - DNA, 25 bp, Mus musculus
tcggagttgcacctggagcagatcc

SEQ ID NO: 475193 - DNA, 25 bp, Mus musculus
tcggataatgtgagacctggaatgc

SEQ ID NO: 475194 - DNA, 25 bp, Mus musculus
tcggatcagaaaagaacaagcaccc

SEQ ID NO: 475195 - DNA, 25 bp, Mus musculus
tcggatccagtgtatgcagaagcct

SEQ ID NO: 475196 - DNA, 25 bp, Mus musculus
tcggatccattcagcacacagtgtg

SEQ ID NO: 475197 - DNA, 25 bp, Mus musculus
tcggatgagatcagcccaacacttc

SEQ ID NO: 475198 - DNA, 25 bp, Mus musculus
tcggatgatgagagccctagcacca

SEQ ID NO: 475199 - DNA, 25 bp, Mus musculus
tcggatgctcaacctcactgaccgg

SEQ ID NO: 475200 - DNA, 25 bp, Mus musculus
tcggatggaacaatactgcaagtgc

SEQ ID NO: 475201 - DNA, 25 bp, Mus musculus
tcggatggcatctccctctgcaact

SEQ ID NO: 475202 - DNA, 25 bp, Mus musculus
tcggatgtcctctgcgctggagtca

SEQ ID NO: 475203 - DNA, 25 bp, Mus musculus
tcggatgtttttagtgcctcttggg

SEQ ID NO: 475204 - DNA, 25 bp, Mus musculus
tcggattctattcggagccctgcgt

SEQ ID NO: 475205 - DNA, 25 bp, Mus musculus
tcggatttactcaagcagacgtggg

SEQ ID NO: 475206 - DNA, 25 bp, Mus musculus
tcggcaagaaaattgagagctcggc

SEQ ID NO: 475207 - DNA, 25 bp, Mus musculus
tcggcaagcaaacaatgaaggagca

SEQ ID NO: 475208 - DNA, 25 bp, Mus musculus
tcggcaaggtaagttggacaaggac

SEQ ID NO: 475209 - DNA, 25 bp, Mus musculus
tcggcaatgcgctggtaattctggc

SEQ ID NO: 475210 - DNA, 25 bp, Mus musculus
tcggcacaatcccacatctaatgtg

SEQ ID NO: 475211 - DNA, 25 bp, Mus musculus
tcggcacagtatcagtacatctggt

SEQ ID NO: 475212 - DNA, 25 bp, Mus musculus
tcggcacagtgagcatctaagacgt

SEQ ID NO: 475213 - DNA, 25 bp, Mus musculus
tcggcacgagaacattcacactgaa

SEQ ID NO: 475214 - DNA, 25 bp, Mus musculus
tcggcactgagcgtggagtccttct

SEQ ID NO: 475215 - DNA, 25 bp, Mus musculus
tcggcagacggagatatctaaagtg

SEQ ID NO: 475216 - DNA, 25 bp, Mus musculus
tcggcagcagaaacaggcacagttg

SEQ ID NO: 475217 - DNA, 25 bp, Mus musculus
tcggcaggaggcatatctaggcact

SEQ ID NO: 475218 - DNA, 25 bp, Mus musculus
tcggcagtgacaagagaacgcagtg

SEQ ID NO: 475219 - DNA, 25 bp, Mus musculus
tcggcatcaccatggtacgtctggg

SEQ ID NO: 475220 - DNA, 25 bp, Mus musculus
tcggcatcagcaccaggagctctgg

SEQ ID NO: 475221 - DNA, 25 bp, Mus musculus
tcggcatcctacgaaggcctagaaa

SEQ ID NO: 475222 - DNA, 25 bp, Mus musculus
tcggcatgaattattcaaaagaagg

SEQ ID NO: 475223 - DNA, 25 bp, Mus musculus
tcggcatgactactcactttctgtg

SEQ ID NO: 475224 - DNA, 25 bp, Mus musculus
tcggcattggcgtggagaacttcat

SEQ ID NO: 475225 - DNA, 25 bp, Mus musculus
tcggccacatcaagaagaagagggt

SEQ ID NO: 475226 - DNA, 25 bp, Mus musculus
tcggccaccaccagggctgggaata

SEQ ID NO: 475227 - DNA, 25 bp, Mus musculus
tcggccagagccaaccctgtgtttg

SEQ ID NO: 475228 - DNA, 25 bp, Mus musculus
tcggccaggccatcgaggaggttaa

SEQ ID NO: 475229 - DNA, 25 bp, Mus musculus
tcggccatggcgtctctccgcgaag

SEQ ID NO: 475230 - DNA, 25 bp, Mus musculus
tcggcccagctctgtaagcagcagt

SEQ ID NO: 475231 - DNA, 25 bp, Mus musculus
tcggcccctgcctagtttgtaaaca

SEQ ID NO: 475232 - DNA, 25 bp, Mus musculus
tcggcccgagcgatggcgctgttcc

SEQ ID NO: 475233 - DNA, 25 bp, Mus musculus
tcggccgacttctacgaggtggagc

SEQ ID NO: 475234 - DNA, 25 bp, Mus musculus
tcggccgcatctacgagctgacggt

SEQ ID NO: 475235 - DNA, 25 bp, Mus musculus
tcggccgtgggctacaggaatacca

SEQ ID NO: 475236 - DNA, 25 bp, Mus musculus
tcggccgtttattacacaagctcca

SEQ ID NO: 475237 - DNA, 25 bp, Mus musculus
tcggcctattatcagcaaccaaacg

SEQ ID NO: 475238 - DNA, 25 bp, Mus musculus
tcggcctcagcgatcacagaagtga

SEQ ID NO: 475239 - DNA, 25 bp, Mus musculus
tcggcctccgcttcggattcagacg

SEQ ID NO: 475240 - DNA, 25 bp, Mus musculus
tcggcctgagaaatgagaattctct

SEQ ID NO: 475241 - DNA, 25 bp, Mus musculus
tcggcctgtgttcaggaccagagac

SEQ ID NO: 475242 - DNA, 25 bp, Mus musculus
tcggccttggaaaacgctgctaaac

SEQ ID NO: 475243 - DNA, 25 bp, Mus musculus
tcggcgagaagcgtatcatcacagt

SEQ ID NO: 475244 - DNA, 25 bp, Mus musculus
tcggcgagaccgtaaccgaagagca

SEQ ID NO: 475245 - DNA, 25 bp, Mus musculus
tcggcgagccaagagaatcaaggac

SEQ ID NO: 475246 - DNA, 25 bp, Mus musculus
tcggcgcccgctctaaggaaaggct

SEQ ID NO: 475247 - DNA, 25 bp, Mus musculus
tcggcgctttgagacctggaaaaac

SEQ ID NO: 475248 - DNA, 25 bp, Mus musculus
tcggcggaatcactaatgggaaacc

SEQ ID NO: 475249 - DNA, 25 bp, Mus musculus
tcggcggcagggtcacgcatatttg

SEQ ID NO: 475250 - DNA, 25 bp, Mus musculus
tcggcggcccagaaaatcataatag

SEQ ID NO: 475251 - DNA, 25 bp, Mus musculus
tcggcggccctttactcagaatttg

SEQ ID NO: 475252 - DNA, 25 bp, Mus musculus
tcggcggcgttaggcttgctgtctc

SEQ ID NO: 475253 - DNA, 25 bp, Mus musculus
tcggcgggttaatcaggatcttcac

SEQ ID NO: 475254 - DNA, 25 bp, Mus musculus
tcggcgtacacccacatggaacttc

SEQ ID NO: 475255 - DNA, 25 bp, Mus musculus
tcggctacactcctctgtcaagagt

SEQ ID NO: 475256 - DNA, 25 bp, Mus musculus
tcggctacagtgtcttgagaaagta

SEQ ID NO: 475257 - DNA, 25 bp, Mus musculus
tcggctagaacgaggcaagagctcc

SEQ ID NO: 475258 - DNA, 25 bp, Mus musculus
tcggctagttaaagcgccggcctct

SEQ ID NO: 475259 - DNA, 25 bp, Mus musculus
tcggctatgaatgccagctctgttc

SEQ ID NO: 475260 - DNA, 25 bp, Mus musculus
tcggctcaacaaggtagcatgctgc

SEQ ID NO: 475261 - DNA, 25 bp, Mus musculus
tcggctcaaccccaggatataattc

SEQ ID NO: 475262 - DNA, 25 bp, Mus musculus
tcggctccagctctatgcagtctat

SEQ ID NO: 475263 - DNA, 25 bp, Mus musculus
tcggctctggctacaggagaacgac

SEQ ID NO: 475264 - DNA, 25 bp, Mus musculus
tcggctggagatgcagccctttgcg

SEQ ID NO: 475265 - DNA, 25 bp, Mus musculus
tcggctgtgacaacgacgaatgccc

SEQ ID NO: 475266 - DNA, 25 bp, Mus musculus
tcggctgtgtaccatacaggcatct

SEQ ID NO: 475267 - DNA, 25 bp, Mus musculus
tcggcttctcgctctaaggctgtga

SEQ ID NO: 475268 - DNA, 25 bp, Mus musculus
tcggcttctgtttgcttgaaagaca

SEQ ID NO: 475269 - DNA, 25 bp, Mus musculus
tcggcttgaacctgtactgcggcgg

SEQ ID NO: 475270 - DNA, 25 bp, Mus musculus
tcggcttggactacggactgattac

SEQ ID NO: 475271 - DNA, 25 bp, Mus musculus
tcggcttggttctgtttaaattgac

SEQ ID NO: 475272 - DNA, 25 bp, Mus musculus
tcggctttaactcaggatttcctct

SEQ ID NO: 475273 - DNA, 25 bp, Mus musculus
tcgggaaacagcttcagatacgcag

SEQ ID NO: 475274 - DNA, 25 bp, Mus musculus
tcgggaaattgtcttgcccaagggc

SEQ ID NO: 475275 - DNA, 25 bp, Mus musculus
tcgggaagaattgatgctctggccc

SEQ ID NO: 475276 - DNA, 25 bp, Mus musculus
tcgggaagaattgggtcgccacacc

SEQ ID NO: 475277 - DNA, 25 bp, Mus musculus
tcgggaagccaagatgagcgcccta

SEQ ID NO: 475278 - DNA, 25 bp, Mus musculus
tcgggaaggaaagggagacttacat

SEQ ID NO: 475279 - DNA, 25 bp, Mus musculus
tcgggaatatcagatcattgagcct

SEQ ID NO: 475280 - DNA, 25 bp, Mus musculus
tcgggacaagcgagacagtgactcg

SEQ ID NO: 475281 - DNA, 25 bp, Mus musculus
tcgggacagagacgttcaaaggact

SEQ ID NO: 475282 - DNA, 25 bp, Mus musculus
tcgggaccacctaggaaaacgtcag

SEQ ID NO: 475283 - DNA, 25 bp, Mus musculus
tcgggaccaggttttgcaccaaggc

SEQ ID NO: 475284 - DNA, 25 bp, Mus musculus
tcgggaccatccaagtaatgctgct

SEQ ID NO: 475285 - DNA, 25 bp, Mus musculus
tcgggaccgcaatttattaccaatt

SEQ ID NO: 475286 - DNA, 25 bp, Mus musculus
tcgggaccgcgagggtcaatttctt

SEQ ID NO: 475287 - DNA, 25 bp, Mus musculus
tcgggaccgctcgttcagcgagaac

SEQ ID NO: 475288 - DNA, 25 bp, Mus musculus
tcgggacctgtgttaaccatcgggc

SEQ ID NO: 475289 - DNA, 25 bp, Mus musculus
tcgggagaaaactggtgagagcaac

SEQ ID NO: 475290 - DNA, 25 bp, Mus musculus
tcgggagaccacgaagcagatctac

SEQ ID NO: 475291 - DNA, 25 bp, Mus musculus
tcgggagacgcagtttggtcaaccc

SEQ ID NO: 475292 - DNA, 25 bp, Mus musculus
tcgggagccacactacagaagctgt

SEQ ID NO: 475293 - DNA, 25 bp, Mus musculus
tcgggagcgatccagatttccagcc

SEQ ID NO: 475294 - DNA, 25 bp, Mus musculus
tcgggaggaaacaggcatagaagca

SEQ ID NO: 475295 - DNA, 25 bp, Mus musculus
tcgggaggagacgactctaaatatc

SEQ ID NO: 475296 - DNA, 25 bp, Mus musculus
tcgggagtgtggctctctctgtcct

SEQ ID NO: 475297 - DNA, 25 bp, Mus musculus
tcgggatcaagcgagcgactgaagc

SEQ ID NO: 475298 - DNA, 25 bp, Mus musculus
tcgggatccgtctctcatatggcag

SEQ ID NO: 475299 - DNA, 25 bp, Mus musculus
tcgggatcctgccagtccaagagtg

SEQ ID NO: 475300 - DNA, 25 bp, Mus musculus
tcgggatctgcatcagaagcttctg

SEQ ID NO: 475301 - DNA, 25 bp, Mus musculus
tcgggatgaaggaactgcccctgac

SEQ ID NO: 475302 - DNA, 25 bp, Mus musculus
tcgggcaatggccagaacagcctag

SEQ ID NO: 475303 - DNA, 25 bp, Mus musculus
tcgggcagagcttgtgtgcctcagc

SEQ ID NO: 475304 - DNA, 25 bp, Mus musculus
tcgggcccagcaacattatccagtg

SEQ ID NO: 475305 - DNA, 25 bp, Mus musculus
tcgggccccggattaaaatagatgc

SEQ ID NO: 475306 - DNA, 25 bp, Mus musculus
tcgggcctctgctgtaagacgagac

SEQ ID NO: 475307 - DNA, 25 bp, Mus musculus
tcgggcctgcttatgatagtcctgg

SEQ ID NO: 475308 - DNA, 25 bp, Mus musculus
tcgggcgacagcacgattctggcac

SEQ ID NO: 475309 - DNA, 25 bp, Mus musculus
tcgggctaccacagaggcgtgaact

SEQ ID NO: 475310 - DNA, 25 bp, Mus musculus
tcgggctaccctacaaaagatgaag

SEQ ID NO: 475311 - DNA, 25 bp, Mus musculus
tcgggctcacagttctacggtcgga

SEQ ID NO: 475312 - DNA, 25 bp, Mus musculus
tcgggctcccaggacttaaaggctc

SEQ ID NO: 475313 - DNA, 25 bp, Mus musculus
tcgggctcggactatggcgccatgt

SEQ ID NO: 475314 - DNA, 25 bp, Mus musculus
tcgggcttacgtgtacccaagggag

SEQ ID NO: 475315 - DNA, 25 bp, Mus musculus
tcggggtgacagttgctcctccaaa

SEQ ID NO: 475316 - DNA, 25 bp, Mus musculus
tcgggtacagttcccaaactatgcc

SEQ ID NO: 475317 - DNA, 25 bp, Mus musculus
tcgggtaccatcctgaaagcgctgt

SEQ ID NO: 475318 - DNA, 25 bp, Mus musculus
tcgggtatcacctgtacagaaaggc

SEQ ID NO: 475319 - DNA, 25 bp, Mus musculus
tcgggtatccctcgctcttggtcag

SEQ ID NO: 475320 - DNA, 25 bp, Mus musculus
tcgggtcatcgctacagatctggca

SEQ ID NO: 475321 - DNA, 25 bp, Mus musculus
tcgggtcctaacctggatcccagcg

SEQ ID NO: 475322 - DNA, 25 bp, Mus musculus
tcgggtcgctggatctctaggctgc

SEQ ID NO: 475323 - DNA, 25 bp, Mus musculus
tcgggtcttgtacttaagctttgaa

SEQ ID NO: 475324 - DNA, 25 bp, Mus musculus
tcgggtgctccccataacaatggat

SEQ ID NO: 475325 - DNA, 25 bp, Mus musculus
tcgggtgtcaattttggatctcccc

SEQ ID NO: 475326 - DNA, 25 bp, Mus musculus
tcgggttgccgtgcacaacaaagac

SEQ ID NO: 475327 - DNA, 25 bp, Mus musculus
tcggtaactacaatggcacggcagg

SEQ ID NO: 475328 - DNA, 25 bp, Mus musculus
tcggtaagagtgagacttggcccca

SEQ ID NO: 475329 - DNA, 25 bp, Mus musculus
tcggtacaattacatagggcgtggt

SEQ ID NO: 475330 - DNA, 25 bp, Mus musculus
tcggtaccgacacagcaacgggaaa

SEQ ID NO: 475331 - DNA, 25 bp, Mus musculus
tcggtaccgcagacttcagcatttg

SEQ ID NO: 475332 - DNA, 25 bp, Mus musculus
tcggtagagcataaagaatcctgtg

SEQ ID NO: 475333 - DNA, 25 bp, Mus musculus
tcggtagctgtggagaccttcggct

SEQ ID NO: 475334 - DNA, 25 bp, Mus musculus
tcggtatccgccaagcagagggtca

SEQ ID NO: 475335 - DNA, 25 bp, Mus musculus
tcggtatcgatgaagagcaaggccc

SEQ ID NO: 475336 - DNA, 25 bp, Mus musculus
tcggtatgagcgtttccagttggcg

SEQ ID NO: 475337 - DNA, 25 bp, Mus musculus
tcggtattcacagtcacccggcaga

SEQ ID NO: 475338 - DNA, 25 bp, Mus musculus
tcggtcacaggagggcaagtctgtc

SEQ ID NO: 475339 - DNA, 25 bp, Mus musculus
tcggtcagtagtacagtagcagctc

SEQ ID NO: 475340 - DNA, 25 bp, Mus musculus
tcggtcatacttgcgccggaggatg

SEQ ID NO: 475341 - DNA, 25 bp, Mus musculus
tcggtcatcatagcacatctggaga

SEQ ID NO: 475342 - DNA, 25 bp, Mus musculus
tcggtcatcatcaccaacggcaggt

SEQ ID NO: 475343 - DNA, 25 bp, Mus musculus
tcggtccggcctcttccagcaggtg

SEQ ID NO: 475344 - DNA, 25 bp, Mus musculus
tcggtcctgagatctttgcggttgc

SEQ ID NO: 475345 - DNA, 25 bp, Mus musculus
tcggtcgccatgtcgtccgaggcgt

SEQ ID NO: 475346 - DNA, 25 bp, Mus musculus
tcggtctatacaacaaagaagggca

SEQ ID NO: 475347 - DNA, 25 bp, Mus musculus
tcggtctgtaaacattacctgtgaa

SEQ ID NO: 475348 - DNA, 25 bp, Mus musculus
tcggtcttggcaccagagtatctgt

SEQ ID NO: 475349 - DNA, 25 bp, Mus musculus
tcggtgaacctgctagtgacgtcct

SEQ ID NO: 475350 - DNA, 25 bp, Mus musculus
tcggtgacgcggagttattaccgag

SEQ ID NO: 475351 - DNA, 25 bp, Mus musculus
tcggtgactgttcctgcagttccac

SEQ ID NO: 475352 - DNA, 25 bp, Mus musculus
tcggtgagtcttccacttatactgg

SEQ ID NO: 475353 - DNA, 25 bp, Mus musculus
tcggtgatctaaagcgacggctaca

SEQ ID NO: 475354 - DNA, 25 bp, Mus musculus
tcggtgattacaggtaaccaaggct

SEQ ID NO: 475355 - DNA, 25 bp, Mus musculus
tcggtgcaggcttctggccgcgttc

SEQ ID NO: 475356 - DNA, 25 bp, Mus musculus
tcggtgccccaagcagtacaagcat

SEQ ID NO: 475357 - DNA, 25 bp, Mus musculus
tcggtgcctttgctgacgtcctagt

SEQ ID NO: 475358 - DNA, 25 bp, Mus musculus
tcggtgcgcacacatgtaaaggtcg

SEQ ID NO: 475359 - DNA, 25 bp, Mus musculus
tcggtgcggatcctaaaacctggga

SEQ ID NO: 475360 - DNA, 25 bp, Mus musculus
tcggtgctaactctgtggtcctagg

SEQ ID NO: 475361 - DNA, 25 bp, Mus musculus
tcggtgctcaggactctgtgttcac

SEQ ID NO: 475362 - DNA, 25 bp, Mus musculus
tcggtggacgccttgacctatggtc

SEQ ID NO: 475363 - DNA, 25 bp, Mus musculus
tcggtggcgagttatatcctacagc

SEQ ID NO: 475364 - DNA, 25 bp, Mus musculus
tcggtgggtcctaacgcagtgtcac

SEQ ID NO: 475365 - DNA, 25 bp, Mus musculus
tcggtgtcaaagtggaggactccgc

SEQ ID NO: 475366 - DNA, 25 bp, Mus musculus
tcggtgtcagcaggcaacctcatga

SEQ ID NO: 475367 - DNA, 25 bp, Mus musculus
tcggttaaggacagcaagccctttc

SEQ ID NO: 475368 - DNA, 25 bp, Mus musculus
tcggttacaattccagagagggcac

SEQ ID NO: 475369 - DNA, 25 bp, Mus musculus
tcggttatggagtacagtgtcgcct

SEQ ID NO: 475370 - DNA, 25 bp, Mus musculus
tcggttcacaagaaagcaaggttgc

SEQ ID NO: 475371 - DNA, 25 bp, Mus musculus
tcggttctccaggaaactcgggcct

SEQ ID NO: 475372 - DNA, 25 bp, Mus musculus
tcggttgccgctaaccttatggaag

SEQ ID NO: 475373 - DNA, 25 bp, Mus musculus
tcggttgtgatactgccctgaatgt

SEQ ID NO: 475374 - DNA, 25 bp, Mus musculus
tcggtttgctcaaagcccggcagga

SEQ ID NO: 475375 - DNA, 25 bp, Mus musculus
tcggttttccccatcagagaaaggg

SEQ ID NO: 475376 - DNA, 25 bp, Mus musculus
tcgtaaaagtgtcgtccctgtcgcg

SEQ ID NO: 475377 - DNA, 25 bp, Mus musculus
tcgtaaccctgtcacctgtaatgcg

SEQ ID NO: 475378 - DNA, 25 bp, Mus musculus
tcgtaacttcctcacggagcagggc

SEQ ID NO: 475379 - DNA, 25 bp, Mus musculus
tcgtaagtggtcgtcgttcccgagg

SEQ ID NO: 475380 - DNA, 25 bp, Mus musculus
tcgtaccaagtgaacagtctctagg

SEQ ID NO: 475381 - DNA, 25 bp, Mus musculus
tcgtacgattcgtgcgtggcggcca

SEQ ID NO: 475382 - DNA, 25 bp, Mus musculus
tcgtagagaagcgtcgaggaccgca

SEQ ID NO: 475383 - DNA, 25 bp, Mus musculus
tcgtagaggcgagccacatgtcact

SEQ ID NO: 475384 - DNA, 25 bp, Mus musculus
tcgtagcaaggcgagtcaaagccca

SEQ ID NO: 475385 - DNA, 25 bp, Mus musculus
tcgtagccgcccctgtgcgttgcta

SEQ ID NO: 475386 - DNA, 25 bp, Mus musculus
tcgtaggctacaaggactcgccctc

SEQ ID NO: 475387 - DNA, 25 bp, Mus musculus
tcgtaggttccggacagcatcggtc

SEQ ID NO: 475388 - DNA, 25 bp, Mus musculus
tcgtagtaggcctatgggttccagc

SEQ ID NO: 475389 - DNA, 25 bp, Mus musculus
tcgtagtctccatctcgggctgggt

SEQ ID NO: 475390 - DNA, 25 bp, Mus musculus
tcgtagttcgtaccaataggcaagg

SEQ ID NO: 475391 - DNA, 25 bp, Mus musculus
tcgtataggacaacaggactgccac

SEQ ID NO: 475392 - DNA, 25 bp, Mus musculus
tcgtatccgggatcatttaagccca

SEQ ID NO: 475393 - DNA, 25 bp, Mus musculus
tcgtatcttgtaccgcgggaaaagc

SEQ ID NO: 475394 - DNA, 25 bp, Mus musculus
tcgtatgtaagatccacagcccctg

SEQ ID NO: 475395 - DNA, 25 bp, Mus musculus
tcgtattgggagtacaacgaaccca

SEQ ID NO: 475396 - DNA, 25 bp, Mus musculus
tcgtatttatggaggctgaacattg

SEQ ID NO: 475397 - DNA, 25 bp, Mus musculus
tcgtcaaacctgaattgtgctgagg

SEQ ID NO: 475398 - DNA, 25 bp, Mus musculus
tcgtcaacaagatggcgtaccctca

SEQ ID NO: 475399 - DNA, 25 bp, Mus musculus
tcgtcaatgtgcaaaccatgttccg

SEQ ID NO: 475400 - DNA, 25 bp, Mus musculus
tcgtcacagagatgccaagttcagc

SEQ ID NO: 475401 - DNA, 25 bp, Mus musculus
tcgtcacctcctactgagaacaagg

SEQ ID NO: 475402 - DNA, 25 bp, Mus musculus
tcgtcactttcatggaccaggcggg

SEQ ID NO: 475403 - DNA, 25 bp, Mus musculus
tcgtcagcaaacaagaggccatcag

SEQ ID NO: 475404 - DNA, 25 bp, Mus musculus
tcgtcagctgtgatgcctgcatgca

SEQ ID NO: 475405 - DNA, 25 bp, Mus musculus
tcgtcagggacaagaatagcggcag

SEQ ID NO: 475406 - DNA, 25 bp, Mus musculus
tcgtcagtgcaactacaaatgtggc

SEQ ID NO: 475407 - DNA, 25 bp, Mus musculus
tcgtcatctgtacccagcagtaaca

SEQ ID NO: 475408 - DNA, 25 bp, Mus musculus
tcgtcatgccttgtggagggctcac

SEQ ID NO: 475409 - DNA, 25 bp, Mus musculus
tcgtccagcagtggcaagaggctct

SEQ ID NO: 475410 - DNA, 25 bp, Mus musculus
tcgtccagcgtctatgacaaataca

SEQ ID NO: 475411 - DNA, 25 bp, Mus musculus
tcgtccatgctctgaaccaaggctt

SEQ ID NO: 475412 - DNA, 25 bp, Mus musculus
tcgtccatgtttttgagggcagtgc

SEQ ID NO: 475413 - DNA, 25 bp, Mus musculus
tcgtcccagatcttaggaggcagca

SEQ ID NO: 475414 - DNA, 25 bp, Mus musculus
tcgtccccagaacccgatgatcttt

SEQ ID NO: 475415 - DNA, 25 bp, Mus musculus
tcgtccccagtgcagaagtcagtac

SEQ ID NO: 475416 - DNA, 25 bp, Mus musculus
tcgtcccgattcagcgtgcgatcct

SEQ ID NO: 475417 - DNA, 25 bp, Mus musculus
tcgtccgacgctacatcaaggactg

SEQ ID NO: 475418 - DNA, 25 bp, Mus musculus
tcgtccgagtgtctggccaagtaca

SEQ ID NO: 475419 - DNA, 25 bp, Mus musculus
tcgtccgcatccagaggaacaaggc

SEQ ID NO: 475420 - DNA, 25 bp, Mus musculus
tcgtccgcttatgggcccctttaag

SEQ ID NO: 475421 - DNA, 25 bp, Mus musculus
tcgtccggctgcaaagagctatggt

SEQ ID NO: 475422 - DNA, 25 bp, Mus musculus
tcgtccgtcagggtctcagaaaagt

SEQ ID NO: 475423 - DNA, 25 bp, Mus musculus
tcgtccgtgatgaaaatgcccgagg

SEQ ID NO: 475424 - DNA, 25 bp, Mus musculus
tcgtcctcatctgtgtaaaggcaga

SEQ ID NO: 475425 - DNA, 25 bp, Mus musculus
tcgtcctgagagaagctgtacctgt

SEQ ID NO: 475426 - DNA, 25 bp, Mus musculus
tcgtcctggccaaggtgaaggctct

SEQ ID NO: 475427 - DNA, 25 bp, Mus musculus
tcgtcctggctttgggcggtgtcac

SEQ ID NO: 475428 - DNA, 25 bp, Mus musculus
tcgtcctttcggagacacagctgga

SEQ ID NO: 475429 - DNA, 25 bp, Mus musculus
tcgtcgaaattgagcgcaaagttgc

SEQ ID NO: 475430 - DNA, 25 bp, Mus musculus
tcgtcgccatgaaaggacccatagt

SEQ ID NO: 475431 - DNA, 25 bp, Mus musculus
tcgtcggactccatttgctattctt

SEQ ID NO: 475432 - DNA, 25 bp, Mus musculus
tcgtcggctgactggaatcatcctg

SEQ ID NO: 475433 - DNA, 25 bp, Mus musculus
tcgtcgtggagagcctcatgtgacc

SEQ ID NO: 475434 - DNA, 25 bp, Mus musculus
tcgtctacaaaagcgactacagtgg

SEQ ID NO: 475435 - DNA, 25 bp, Mus musculus
tcgtctacaagaaggtgatggctgc

SEQ ID NO: 475436 - DNA, 25 bp, Mus musculus
tcgtctcctgtctgtttatgaagcc

SEQ ID NO: 475437 - DNA, 25 bp, Mus musculus
tcgtctgaggaggacagaaaggtct

SEQ ID NO: 475438 - DNA, 25 bp, Mus musculus
tcgtctggaagtacaccgctttggg

SEQ ID NO: 475439 - DNA, 25 bp, Mus musculus
tcgtctggccagagaggcattcaag

SEQ ID NO: 475440 - DNA, 25 bp, Mus musculus
tcgtctgtcttggaaggttcagttc

SEQ ID NO: 475441 - DNA, 25 bp, Mus musculus
tcgtctgtgaaagccattcatggaa

SEQ ID NO: 475442 - DNA, 25 bp, Mus musculus
tcgtctgtgccggatacaatgccag

SEQ ID NO: 475443 - DNA, 25 bp, Mus musculus
tcgtcttgatgaccacggtggccat

SEQ ID NO: 475444 - DNA, 25 bp, Mus musculus
tcgtcttggaagaacatggaatacc

SEQ ID NO: 475445 - DNA, 25 bp, Mus musculus
tcgtgaagccacttgagcgacagcc

SEQ ID NO: 475446 - DNA, 25 bp, Mus musculus
tcgtgaagccgtttcctcaaaggag

SEQ ID NO: 475447 - DNA, 25 bp, Mus musculus
tcgtgaaggaatccgtagaccccga

SEQ ID NO: 475448 - DNA, 25 bp, Mus musculus
tcgtgaaggtcagaatgcaagccca

SEQ ID NO: 475449 - DNA, 25 bp, Mus musculus
tcgtgaagtcaggaagctcgtggct

SEQ ID NO: 475450 - DNA, 25 bp, Mus musculus
tcgtgaataacaagctggaggtcca

SEQ ID NO: 475451 - DNA, 25 bp, Mus musculus
tcgtgaatgtcagctgcccctggta

SEQ ID NO: 475452 - DNA, 25 bp, Mus musculus
tcgtgacacaaaccacagagaccgg

SEQ ID NO: 475453 - DNA, 25 bp, Mus musculus
tcgtgacagctctgaacgtgcgggc

SEQ ID NO: 475454 - DNA, 25 bp, Mus musculus
tcgtgacaggatgctgaaagagctg

SEQ ID NO: 475455 - DNA, 25 bp, Mus musculus
tcgtgacagtgaaggcacaccattc

SEQ ID NO: 475456 - DNA, 25 bp, Mus musculus
tcgtgacggccatgctgagcaagct

SEQ ID NO: 475457 - DNA, 25 bp, Mus musculus
tcgtgactccacagagcatgtactg

SEQ ID NO: 475458 - DNA, 25 bp, Mus musculus
tcgtgactgagaccatacgtggcct

SEQ ID NO: 475459 - DNA, 25 bp, Mus musculus
tcgtgagaagtcataccccatgcag

SEQ ID NO: 475460 - DNA, 25 bp, Mus musculus
tcgtgagcctccatgttggcgctga

SEQ ID NO: 475461 - DNA, 25 bp, Mus musculus
tcgtgaggcagatgaactacgcggc

SEQ ID NO: 475462 - DNA, 25 bp, Mus musculus
tcgtgagtatgcagagcttgggtct

SEQ ID NO: 475463 - DNA, 25 bp, Mus musculus
tcgtgagtcagctctggcatacctg

SEQ ID NO: 475464 - DNA, 25 bp, Mus musculus
tcgtgagtctgaaaagcgaagggaa

SEQ ID NO: 475465 - DNA, 25 bp, Mus musculus
tcgtgagtgcgtagacagcaggcat

SEQ ID NO: 475466 - DNA, 25 bp, Mus musculus
tcgtgagtttttggaagcacagtat

SEQ ID NO: 475467 - DNA, 25 bp, Mus musculus
tcgtgatgccaccaatgaccaggtc

SEQ ID NO: 475468 - DNA, 25 bp, Mus musculus
tcgtgcagaagtacattgagcggcc

SEQ ID NO: 475469 - DNA, 25 bp, Mus musculus
tcgtgcagactttccgagacctggt

SEQ ID NO: 475470 - DNA, 25 bp, Mus musculus
tcgtgcagcataaccagtggcccat

SEQ ID NO: 475471 - DNA, 25 bp, Mus musculus
tcgtgcagcattcagtagacaaggc

SEQ ID NO: 475472 - DNA, 25 bp, Mus musculus
tcgtgcagccttaactctcagagag

SEQ ID NO: 475473 - DNA, 25 bp, Mus musculus
tcgtgcagccttcatgcatagtggc

SEQ ID NO: 475474 - DNA, 25 bp, Mus musculus
tcgtgcatctcgtcaagaatacggg

SEQ ID NO: 475475 - DNA, 25 bp, Mus musculus
tcgtgccaactatgagcgcttcgtg

SEQ ID NO: 475476 - DNA, 25 bp, Mus musculus
tcgtgccaaggtgcccgtgggccaa

SEQ ID NO: 475477 - DNA, 25 bp, Mus musculus
tcgtgccagacacattactcagcct

SEQ ID NO: 475478 - DNA, 25 bp, Mus musculus
tcgtgccagatgactttcccctact

SEQ ID NO: 475479 - DNA, 25 bp, Mus musculus
tcgtgccagccaggcttctcgatgg

SEQ ID NO: 475480 - DNA, 25 bp, Mus musculus
tcgtgccaggctatgactgggctct

SEQ ID NO: 475481 - DNA, 25 bp, Mus musculus
tcgtgccatgcagaagtaccttcgc

SEQ ID NO: 475482 - DNA, 25 bp, Mus musculus
tcgtgcccacgtcaaggagtatttc

SEQ ID NO: 475483 - DNA, 25 bp, Mus musculus
tcgtgcccaggaggaatcatgctga

SEQ ID NO: 475484 - DNA, 25 bp, Mus musculus
tcgtgcggacgttttggctaaagac

SEQ ID NO: 475485 - DNA, 25 bp, Mus musculus
tcgtgcggagcgagccatgagctct

SEQ ID NO: 475486 - DNA, 25 bp, Mus musculus
tcgtgcggagcgtgacattctagtg

SEQ ID NO: 475487 - DNA, 25 bp, Mus musculus
tcgtgctcgtcacatctgctacttc

SEQ ID NO: 475488 - DNA, 25 bp, Mus musculus
tcgtgctgaccgtggccaagtgttg

SEQ ID NO: 475489 - DNA, 25 bp, Mus musculus
tcgtgctggagctgagggtaggaac

SEQ ID NO: 475490 - DNA, 25 bp, Mus musculus
tcgtgcttagtgtacagatgctgtg

SEQ ID NO: 475491 - DNA, 25 bp, Mus musculus
tcgtgcttgctagaatgtgggacca

SEQ ID NO: 475492 - DNA, 25 bp, Mus musculus
tcgtggaaaaccctgtctgcctgtg

SEQ ID NO: 475493 - DNA, 25 bp, Mus musculus
tcgtggacttttctgtgcggctcgc

SEQ ID NO: 475494 - DNA, 25 bp, Mus musculus
tcgtggagaataaggtcaaggaact

SEQ ID NO: 475495 - DNA, 25 bp, Mus musculus
tcgtggagccggttgcgttcctcag

SEQ ID NO: 475496 - DNA, 25 bp, Mus musculus
tcgtggcccctgacagagaagttgt

SEQ ID NO: 475497 - DNA, 25 bp, Mus musculus
tcgtggctgccactcttccctagaa

SEQ ID NO: 475498 - DNA, 25 bp, Mus musculus
tcgtgggcacgagatcctacatgtc

SEQ ID NO: 475499 - DNA, 25 bp, Mus musculus
tcgtgggcagcatcatcaccaagtg

SEQ ID NO: 475500 - DNA, 25 bp, Mus musculus
tcgtgggctgttagatccgtgcatc

SEQ ID NO: 475501 - DNA, 25 bp, Mus musculus
tcgtggtgaaaacccagctcaagca

SEQ ID NO: 475502 - DNA, 25 bp, Mus musculus
tcgtggtgaacaggaacaggctact

SEQ ID NO: 475503 - DNA, 25 bp, Mus musculus
tcgtggtgcactttgaaaaccgagg

SEQ ID NO: 475504 - DNA, 25 bp, Mus musculus
tcgtggtgtctaagccggagcacaa

SEQ ID NO: 475505 - DNA, 25 bp, Mus musculus
tcgtgtatttcttcctgggcacctc

SEQ ID NO: 475506 - DNA, 25 bp, Mus musculus
tcgtgtccaagaaaggcaactgcaa

SEQ ID NO: 475507 - DNA, 25 bp, Mus musculus
tcgtgtcccgcagggaaaagctgtg

SEQ ID NO: 475508 - DNA, 25 bp, Mus musculus
tcgtgtgcccgtgcctgtaaaagct

SEQ ID NO: 475509 - DNA, 25 bp, Mus musculus
tcgtgtgccctgatgctaagaccca

SEQ ID NO: 475510 - DNA, 25 bp, Mus musculus
tcgtgtgcggctccaatgcgttcaa

SEQ ID NO: 475511 - DNA, 25 bp, Mus musculus
tcgtgtggacctacatctcgctggc

SEQ ID NO: 475512 - DNA, 25 bp, Mus musculus
tcgtgttcaaggacaccgtccaaga

SEQ ID NO: 475513 - DNA, 25 bp, Mus musculus
tcgtgttccgaaagcccaaggtgct

SEQ ID NO: 475514 - DNA, 25 bp, Mus musculus
tcgtgttcgagagcgatttgcactc

SEQ ID NO: 475515 - DNA, 25 bp, Mus musculus
tcgtgttgcagatgagatcgcctcg

SEQ ID NO: 475516 - DNA, 25 bp, Mus musculus
tcgtgttggaaaccttggccttgcc

SEQ ID NO: 475517 - DNA, 25 bp, Mus musculus
tcgtgtttgcaatcaccgcagctgg

SEQ ID NO: 475518 - DNA, 25 bp, Mus musculus
tcgtgttttgcgtctgcgtggtgcc

SEQ ID NO: 475519 - DNA, 25 bp, Mus musculus
tcgttaaggctttccgagcacatcg

SEQ ID NO: 475520 - DNA, 25 bp, Mus musculus
tcgttacatagtctgtagcgcctgg

SEQ ID NO: 475521 - DNA, 25 bp, Mus musculus
tcgttagacccgaggcggaagctgc

SEQ ID NO: 475522 - DNA, 25 bp, Mus musculus
tcgttaggagaggaggctagcaccc

SEQ ID NO: 475523 - DNA, 25 bp, Mus musculus
tcgttaggctgatttccggaacagg

SEQ ID NO: 475524 - DNA, 25 bp, Mus musculus
tcgttccaatagacagcccgaaggc

SEQ ID NO: 475525 - DNA, 25 bp, Mus musculus
tcgttccaggctgtcgattgccggt

SEQ ID NO: 475526 - DNA, 25 bp, Mus musculus
tcgttcccgagggacaggacacgta

SEQ ID NO: 475527 - DNA, 25 bp, Mus musculus
tcgttccctacgcatgccaagcgtt

SEQ ID NO: 475528 - DNA, 25 bp, Mus musculus
tcgttccggctttgctcatttagtg

SEQ ID NO: 475529 - DNA, 25 bp, Mus musculus
tcgttcctggaagaaattcatggcc

SEQ ID NO: 475530 - DNA, 25 bp, Mus musculus
tcgttcctgtctccaagggcggcaa

SEQ ID NO: 475531 - DNA, 25 bp, Mus musculus
tcgttcgtgctataaactggaagct

SEQ ID NO: 475532 - DNA, 25 bp, Mus musculus
tcgttgaagaggtaatagaagctcc

SEQ ID NO: 475533 - DNA, 25 bp, Mus musculus
tcgttgcattgtctaccacctggag

SEQ ID NO: 475534 - DNA, 25 bp, Mus musculus
tcgttgcccggtcctttccatgaat

SEQ ID NO: 475535 - DNA, 25 bp, Mus musculus
tcgttgccttgacgacggcagcatg

SEQ ID NO: 475536 - DNA, 25 bp, Mus musculus
tcgttgccttgccttgatcataagt

SEQ ID NO: 475537 - DNA, 25 bp, Mus musculus
tcgttgctcaggcattcctcatctg

SEQ ID NO: 475538 - DNA, 25 bp, Mus musculus
tcgttggcaaccagctcagttgggc

SEQ ID NO: 475539 - DNA, 25 bp, Mus musculus
tcgttgtatattgaaggcaggcccg

SEQ ID NO: 475540 - DNA, 25 bp, Mus musculus
tcgttgtccgcataggtgcgtgtcc

SEQ ID NO: 475541 - DNA, 25 bp, Mus musculus
tcgtttaacccacatggcattagca

SEQ ID NO: 475542 - DNA, 25 bp, Mus musculus
tcgtttattcaggtttcgccccaca

SEQ ID NO: 475543 - DNA, 25 bp, Mus musculus
tcgtttcaagagtgacgggcacagc

SEQ ID NO: 475544 - DNA, 25 bp, Mus musculus
tcgtttcagccagatgttgcatcca

SEQ ID NO: 475545 - DNA, 25 bp, Mus musculus
tcgtttccctgcaagcagacgagcc

SEQ ID NO: 475546 - DNA, 25 bp, Mus musculus
tcgtttctacgcgacacatttggtg

SEQ ID NO: 475547 - DNA, 25 bp, Mus musculus
tcgtttcttctatcccgagccgggc

SEQ ID NO: 475548 - DNA, 25 bp, Mus musculus
tcgtttcttttcattcggttgaatt

SEQ ID NO: 475549 - DNA, 25 bp, Mus musculus
tcgtttgcctagttttgtttgaatt

SEQ ID NO: 475550 - DNA, 25 bp, Mus musculus
tcgtttgtaacacagttgcgcgcgt

SEQ ID NO: 475551 - DNA, 25 bp, Mus musculus
tcgttttgcattaaacctcgggctc

SEQ ID NO: 475552 - DNA, 25 bp, Mus musculus
tctaaaaactaaacctagggtgctg

SEQ ID NO: 475553 - DNA, 25 bp, Mus musculus
tctaaaaatacatgaacacaggcca

SEQ ID NO: 475554 - DNA, 25 bp, Mus musculus
tctaaaaatgctgcccgaacgagga

SEQ ID NO: 475555 - DNA, 25 bp, Mus musculus
tctaaaactgttaccggcccacagg

SEQ ID NO: 475556 - DNA, 25 bp, Mus musculus
tctaaaagaccagctagagcagcgg

SEQ ID NO: 475557 - DNA, 25 bp, Mus musculus
tctaaaagcagagggtgacatcgaa

SEQ ID NO: 475558 - DNA, 25 bp, Mus musculus
tctaaaaggctgtaggcaggctgga

SEQ ID NO: 475559 - DNA, 25 bp, Mus musculus
tctaaaatagcctggaccttgagcc

SEQ ID NO: 475560 - DNA, 25 bp, Mus musculus
tctaaaatcttactggtgccagaga

SEQ ID NO: 475561 - DNA, 25 bp, Mus musculus
tctaaaatgtcacttcccgtggtcc

SEQ ID NO: 475562 - DNA, 25 bp, Mus musculus
tctaaaattcggataacagtagggc

SEQ ID NO: 475563 - DNA, 25 bp, Mus musculus
tctaaacaaggtggagtacgctcag

SEQ ID NO: 475564 - DNA, 25 bp, Mus musculus
tctaaacagatggatggtgggcaca

SEQ ID NO: 475565 - DNA, 25 bp, Mus musculus
tctaaacagattacgccaggaagct

SEQ ID NO: 475566 - DNA, 25 bp, Mus musculus
tctaaacagggtcgaacaatcatct

SEQ ID NO: 475567 - DNA, 25 bp, Mus musculus
tctaaacagtattggcgcatgaacc

SEQ ID NO: 475568 - DNA, 25 bp, Mus musculus
tctaaaccaaaatcatagtatcgag

SEQ ID NO: 475569 - DNA, 25 bp, Mus musculus
tctaaaccccttgagcttttctgct

SEQ ID NO: 475570 - DNA, 25 bp, Mus musculus
tctaaactaaacagagagaagaagc

SEQ ID NO: 475571 - DNA, 25 bp, Mus musculus
tctaaactcatctgcgaggccacga

SEQ ID NO: 475572 - DNA, 25 bp, Mus musculus
tctaaactctcatggaagatgtgcc

SEQ ID NO: 475573 - DNA, 25 bp, Mus musculus
tctaaacttgaacatcgcagaagct

SEQ ID NO: 475574 - DNA, 25 bp, Mus musculus
tctaaagactcttccacaagccttc

SEQ ID NO: 475575 - DNA, 25 bp, Mus musculus
tctaaagccgttctcatgggaaaca

SEQ ID NO: 475576 - DNA, 25 bp, Mus musculus
tctaaagcgagtagactacgcccgc

SEQ ID NO: 475577 - DNA, 25 bp, Mus musculus
tctaaagctagaaccatgtgcctgg

SEQ ID NO: 475578 - DNA, 25 bp, Mus musculus
tctaaagctcccaagaatcaagctg

SEQ ID NO: 475579 - DNA, 25 bp, Mus musculus
tctaaaggacgctatcgtggaagct

SEQ ID NO: 475580 - DNA, 25 bp, Mus musculus
tctaaaggagactaagcacgatcac

SEQ ID NO: 475581 - DNA, 25 bp, Mus musculus
tctaaaggtaagcagagtggctgca

SEQ ID NO: 475582 - DNA, 25 bp, Mus musculus
tctaaaggtagagtccgacccatcc

SEQ ID NO: 475583 - DNA, 25 bp, Mus musculus
tctaaaggtcctgagccggagcatg

SEQ ID NO: 475584 - DNA, 25 bp, Mus musculus
tctaaagtgcagacaagtgtggcca

SEQ ID NO: 475585 - DNA, 25 bp, Mus musculus
tctaaagtgccaagggaccaatcat

SEQ ID NO: 475586 - DNA, 25 bp, Mus musculus
tctaaagtgccaggtgcggtgtcca

SEQ ID NO: 475587 - DNA, 25 bp, Mus musculus
tctaaagtggctgatactgacctgt

SEQ ID NO: 475588 - DNA, 25 bp, Mus musculus
tctaaagttcccgttgaggaggagg

SEQ ID NO: 475589 - DNA, 25 bp, Mus musculus
tctaaagttctatctcagatctcag

SEQ ID NO: 475590 - DNA, 25 bp, Mus musculus
tctaaatctaagcacggacgttcgt

SEQ ID NO: 475591 - DNA, 25 bp, Mus musculus
tctaaatgaaactgtggccactggc

SEQ ID NO: 475592 - DNA, 25 bp, Mus musculus
tctaaatgaacatctcagggctgag

SEQ ID NO: 475593 - DNA, 25 bp, Mus musculus
tctaaatgagcggtgaggcagccaa

SEQ ID NO: 475594 - DNA, 25 bp, Mus musculus
tctaaatgccaccataggatgcggg

SEQ ID NO: 475595 - DNA, 25 bp, Mus musculus
tctaaatggaatactccaggcctca

SEQ ID NO: 475596 - DNA, 25 bp, Mus musculus
tctaaattcagagatgcgctgctct

SEQ ID NO: 475597 - DNA, 25 bp, Mus musculus
tctaacacccatggcgatgaagcgg

SEQ ID NO: 475598 - DNA, 25 bp, Mus musculus
tctaacagaaccattgaggaggcct

SEQ ID NO: 475599 - DNA, 25 bp, Mus musculus
tctaacagccagctaaagcaagcct

SEQ ID NO: 475600 - DNA, 25 bp, Mus musculus
tctaacagggctcgagtgtcccgtc

SEQ ID NO: 475601 - DNA, 25 bp, Mus musculus
tctaacatcatgttcccaaggacta

SEQ ID NO: 475602 - DNA, 25 bp, Mus musculus
tctaacatgggaggcgtcccacgtg

SEQ ID NO: 475603 - DNA, 25 bp, Mus musculus
tctaaccagtgtaagaaataaacct

SEQ ID NO: 475604 - DNA, 25 bp, Mus musculus
tctaacccagggaatgaggtcacca

SEQ ID NO: 475605 - DNA, 25 bp, Mus musculus
tctaacccggagtagctgcctgagt

SEQ ID NO: 475606 - DNA, 25 bp, Mus musculus
tctaacctcaagctggtgaacccca

SEQ ID NO: 475607 - DNA, 25 bp, Mus musculus
tctaacgcattgtgttggccaccag

SEQ ID NO: 475608 - DNA, 25 bp, Mus musculus
tctaacgctgcaggtgtcaaatctt

SEQ ID NO: 475609 - DNA, 25 bp, Mus musculus
tctaactcctaagctataccttgaa

SEQ ID NO: 475610 - DNA, 25 bp, Mus musculus
tctaactcggacagacttagcccca

SEQ ID NO: 475611 - DNA, 25 bp, Mus musculus
tctaactgaccagagtgtattccct

SEQ ID NO: 475612 - DNA, 25 bp, Mus musculus
tctaacttcagaactccagggcctc

SEQ ID NO: 475613 - DNA, 25 bp, Mus musculus
tctaacttcatcagcagcacagggc

SEQ ID NO: 475614 - DNA, 25 bp, Mus musculus
tctaacttgttgctagttttgaacg

SEQ ID NO: 475615 - DNA, 25 bp, Mus musculus
tctaactttggtggacagctcggcc

SEQ ID NO: 475616 - DNA, 25 bp, Mus musculus
tctaactttgtcaccatgatgggca

SEQ ID NO: 475617 - DNA, 25 bp, Mus musculus
tctaagaacccacggctgagagact

SEQ ID NO: 475618 - DNA, 25 bp, Mus musculus
tctaagaaccctggcagctgactgc

SEQ ID NO: 475619 - DNA, 25 bp, Mus musculus
tctaagaaggaatagaagaacttac

SEQ ID NO: 475620 - DNA, 25 bp, Mus musculus
tctaagactcccaaggtgcctggac

SEQ ID NO: 475621 - DNA, 25 bp, Mus musculus
tctaagacttcgtacctgaggacca

SEQ ID NO: 475622 - DNA, 25 bp, Mus musculus
tctaagacttgccattttaaggcgt

SEQ ID NO: 475623 - DNA, 25 bp, Mus musculus
tctaagagagctagtgccaccagtc

SEQ ID NO: 475624 - DNA, 25 bp, Mus musculus
tctaagaggctctggaaacacgaag

SEQ ID NO: 475625 - DNA, 25 bp, Mus musculus
tctaagatacctcttcatgggtgcc

SEQ ID NO: 475626 - DNA, 25 bp, Mus musculus
tctaagatagatgtacctggctcca

SEQ ID NO: 475627 - DNA, 25 bp, Mus musculus
tctaagattccggacgctggtcgct

SEQ ID NO: 475628 - DNA, 25 bp, Mus musculus
tctaagcaaacaagaggcgcgaggg

SEQ ID NO: 475629 - DNA, 25 bp, Mus musculus
tctaagcagcttgatcaagagcatc

SEQ ID NO: 475630 - DNA, 25 bp, Mus musculus
tctaagcatagatctttatcgtttg

SEQ ID NO: 475631 - DNA, 25 bp, Mus musculus
tctaagcatggtgcaggcgatgact

SEQ ID NO: 475632 - DNA, 25 bp, Mus musculus
tctaagccagcccagagtgcaatgc

SEQ ID NO: 475633 - DNA, 25 bp, Mus musculus
tctaagctctactgggaacatgccc

SEQ ID NO: 475634 - DNA, 25 bp, Mus musculus
tctaagctgagaaactaccggaagg

SEQ ID NO: 475635 - DNA, 25 bp, Mus musculus
tctaagcttggtgtaatcatgcgca

SEQ ID NO: 475636 - DNA, 25 bp, Mus musculus
tctaaggaaaaccacggaggagcag

SEQ ID NO: 475637 - DNA, 25 bp, Mus musculus
tctaaggactacaacagtctcaaag

SEQ ID NO: 475638 - DNA, 25 bp, Mus musculus
tctaaggagagtcaaagccccatgg

SEQ ID NO: 475639 - DNA, 25 bp, Mus musculus
tctaaggataccgaagggaagagct

SEQ ID NO: 475640 - DNA, 25 bp, Mus musculus
tctaaggattggaagaccacggaga

SEQ ID NO: 475641 - DNA, 25 bp, Mus musculus
tctaaggccatggtgaagatgtagc

SEQ ID NO: 475642 - DNA, 25 bp, Mus musculus
tctaaggctttcattctgtggacac

SEQ ID NO: 475643 - DNA, 25 bp, Mus musculus
tctaagggctttttaccagtcttca

SEQ ID NO: 475644 - DNA, 25 bp, Mus musculus
tctaagggtgttcacatgggagctc

SEQ ID NO: 475645 - DNA, 25 bp, Mus musculus
tctaaggtaccagagccatgccagt

SEQ ID NO: 475646 - DNA, 25 bp, Mus musculus
tctaaggtcaattaagtgcagcatc

SEQ ID NO: 475647 - DNA, 25 bp, Mus musculus
tctaaggtcatctgcgaggtagccc

SEQ ID NO: 475648 - DNA, 25 bp, Mus musculus
tctaaggtggaaagctaccgtcgag

SEQ ID NO: 475649 - DNA, 25 bp, Mus musculus
tctaaggtgtcagctggagcctcca

SEQ ID NO: 475650 - DNA, 25 bp, Mus musculus
tctaaggttcattgaggagagtaac

SEQ ID NO: 475651 - DNA, 25 bp, Mus musculus
tctaagtcagttccagcagaagagc

SEQ ID NO: 475652 - DNA, 25 bp, Mus musculus
tctaagtcatatttgtggcagcagc

SEQ ID NO: 475653 - DNA, 25 bp, Mus musculus
tctaagtccctcgagtaaacgacaa

SEQ ID NO: 475654 - DNA, 25 bp, Mus musculus
tctaagtctcacaaaaggcgtaatg

SEQ ID NO: 475655 - DNA, 25 bp, Mus musculus
tctaagtctcattgtgatgggagtt

SEQ ID NO: 475656 - DNA, 25 bp, Mus musculus
tctaagtctgaatggcctcaagaag

SEQ ID NO: 475657 - DNA, 25 bp, Mus musculus
tctaagtgccaaacagaccatgccc

SEQ ID NO: 475658 - DNA, 25 bp, Mus musculus
tctaagtggactggtgctcaatgcc

SEQ ID NO: 475659 - DNA, 25 bp, Mus musculus
tctaagtgggtggaacaagacgccg

SEQ ID NO: 475660 - DNA, 25 bp, Mus musculus
tctaagtggtatggccgtcggagcc

SEQ ID NO: 475661 - DNA, 25 bp, Mus musculus
tctaagtggtcaagaagtgctcagc

SEQ ID NO: 475662 - DNA, 25 bp, Mus musculus
tctaagtgtagcacatctccagcag

SEQ ID NO: 475663 - DNA, 25 bp, Mus musculus
tctaagttcatagcgtcaagtaaag

SEQ ID NO: 475664 - DNA, 25 bp, Mus musculus
tctaataccaaactacagggaacct

SEQ ID NO: 475665 - DNA, 25 bp, Mus musculus
tctaatacccgtgaacacgcctggg

SEQ ID NO: 475666 - DNA, 25 bp, Mus musculus
tctaatagactagaccaggccatgc

SEQ ID NO: 475667 - DNA, 25 bp, Mus musculus
tctaatatgaaggtatcaagactgc

SEQ ID NO: 475668 - DNA, 25 bp, Mus musculus
tctaatattccgttaaggagcctct

SEQ ID NO: 475669 - DNA, 25 bp, Mus musculus
tctaatcagcgtgagactggaggtc

SEQ ID NO: 475670 - DNA, 25 bp, Mus musculus
tctaatcatattacagtaggcctga

SEQ ID NO: 475671 - DNA, 25 bp, Mus musculus
tctaatccaggttagtccttcattg

SEQ ID NO: 475672 - DNA, 25 bp, Mus musculus
tctaatcctctgtggcaatcccggg

SEQ ID NO: 475673 - DNA, 25 bp, Mus musculus
tctaatgagaggatatgcaccgaac

SEQ ID NO: 475674 - DNA, 25 bp, Mus musculus
tctaatgcaggctgtgtggccgccc

SEQ ID NO: 475675 - DNA, 25 bp, Mus musculus
tctaatgccaaagctcacccgtgag

SEQ ID NO: 475676 - DNA, 25 bp, Mus musculus
tctaatggagggaactgaaccagcc

SEQ ID NO: 475677 - DNA, 25 bp, Mus musculus
tctaatgggaggaatgtacaggccc

SEQ ID NO: 475678 - DNA, 25 bp, Mus musculus
tctaatgtgctcttccttggcaggg

SEQ ID NO: 475679 - DNA, 25 bp, Mus musculus
tctaatgttcagcttcccgggaagg

SEQ ID NO: 475680 - DNA, 25 bp, Mus musculus
tctaattagaagcttgggtaagtca

SEQ ID NO: 475681 - DNA, 25 bp, Mus musculus
tctaattgttgccatcatgacggag

SEQ ID NO: 475682 - DNA, 25 bp, Mus musculus
tctacaaagggaggcgaagtcaggt

SEQ ID NO: 475683 - DNA, 25 bp, Mus musculus
tctacaaagtcattcccaagtggtg

SEQ ID NO: 475684 - DNA, 25 bp, Mus musculus
tctacaaccgggaggagtacgtgcg

SEQ ID NO: 475685 - DNA, 25 bp, Mus musculus
tctacaactcggaatacagcatgcc

SEQ ID NO: 475686 - DNA, 25 bp, Mus musculus
tctacaagaagatcaggttcacaga

SEQ ID NO: 475687 - DNA, 25 bp, Mus musculus
tctacaagaaggtgatggctgctct

SEQ ID NO: 475688 - DNA, 25 bp, Mus musculus
tctacaagagcctgacatgggactg

SEQ ID NO: 475689 - DNA, 25 bp, Mus musculus
tctacaagagtgtcaagaggagccg

SEQ ID NO: 475690 - DNA, 25 bp, Mus musculus
tctacaagccagtgcaatgccatcc

SEQ ID NO: 475691 - DNA, 25 bp, Mus musculus
tctacaagcgtggagagggcaaacc

SEQ ID NO: 475692 - DNA, 25 bp, Mus musculus
tctacaatcctacactctccagagg

SEQ ID NO: 475693 - DNA, 25 bp, Mus musculus
tctacaatcggatgacagaactgtg

SEQ ID NO: 475694 - DNA, 25 bp, Mus musculus
tctacaatgggaccctcaagcggga

SEQ ID NO: 475695 - DNA, 25 bp, Mus musculus
tctacacaaatagagaaatcctgcc

SEQ ID NO: 475696 - DNA, 25 bp, Mus musculus
tctacacaagctgacaagagaggga

SEQ ID NO: 475697 - DNA, 25 bp, Mus musculus
tctacacaagttccttggatcaaat

SEQ ID NO: 475698 - DNA, 25 bp, Mus musculus
tctacacacttggactgcttcaggg

SEQ ID NO: 475699 - DNA, 25 bp, Mus musculus
tctacacagatccacagcttcagag

SEQ ID NO: 475700 - DNA, 25 bp, Mus musculus
tctacacattgaggacagagacccc

SEQ ID NO: 475701 - DNA, 25 bp, Mus musculus
tctacaccaagatccggaagaaggc

SEQ ID NO: 475702 - DNA, 25 bp, Mus musculus
tctacaccaccgagatgaacggcaa

SEQ ID NO: 475703 - DNA, 25 bp, Mus musculus
tctacaccagggaagagctagcact

SEQ ID NO: 475704 - DNA, 25 bp, Mus musculus
tctacaccatcctcactcaggtatg

SEQ ID NO: 475705 - DNA, 25 bp, Mus musculus
tctacacccagatgatgaacccagg

SEQ ID NO: 475706 - DNA, 25 bp, Mus musculus
tctacaccgcagtgagaacgagcct

SEQ ID NO: 475707 - DNA, 25 bp, Mus musculus
tctacaccggttccccttgctaggg

SEQ ID NO: 475708 - DNA, 25 bp, Mus musculus
tctacacgagggaaaagctgctgga

SEQ ID NO: 475709 - DNA, 25 bp, Mus musculus
tctacacggtctactccacggtggg

SEQ ID NO: 475710 - DNA, 25 bp, Mus musculus
tctacacggtgcagaaaataaaggc

SEQ ID NO: 475711 - DNA, 25 bp, Mus musculus
tctacactagctgaaaatgctggcc

SEQ ID NO: 475712 - DNA, 25 bp, Mus musculus
tctacactctgaggaacaagcaggt

SEQ ID NO: 475713 - DNA, 25 bp, Mus musculus
tctacactgcgggacaaaatcatgg

SEQ ID NO: 475714 - DNA, 25 bp, Mus musculus
tctacactggactaagagaagttgt

SEQ ID NO: 475715 - DNA, 25 bp, Mus musculus
tctacactggatatgcttttggaca

SEQ ID NO: 475716 - DNA, 25 bp, Mus musculus
tctacagaagagaccatgcggctac

SEQ ID NO: 475717 - DNA, 25 bp, Mus musculus
tctacagaagatgcgcctaaaaggc

SEQ ID NO: 475718 - DNA, 25 bp, Mus musculus
tctacagaatcctccaaacacaagg

SEQ ID NO: 475719 - DNA, 25 bp, Mus musculus
tctacagagaaagtttagggctagc

SEQ ID NO: 475720 - DNA, 25 bp, Mus musculus
tctacagagagtatatatgagccaa

SEQ ID NO: 475721 - DNA, 25 bp, Mus musculus
tctacagagcaaggaatgtgacttc

SEQ ID NO: 475722 - DNA, 25 bp, Mus musculus
tctacagagtctttgagtccggcag

SEQ ID NO: 475723 - DNA, 25 bp, Mus musculus
tctacagagtgcagaagtaggctgg

SEQ ID NO: 475724 - DNA, 25 bp, Mus musculus
tctacagatcgaaccccagggaatg

SEQ ID NO: 475725 - DNA, 25 bp, Mus musculus
tctacagcactcacctgggaaaggt

SEQ ID NO: 475726 - DNA, 25 bp, Mus musculus
tctacagcggatgctcttggcacgg

SEQ ID NO: 475727 - DNA, 25 bp, Mus musculus
tctacagctaaaggccctggcagga

SEQ ID NO: 475728 - DNA, 25 bp, Mus musculus
tctacagctgctggtagcctgggct

SEQ ID NO: 475729 - DNA, 25 bp, Mus musculus
tctacagcttcctgcacgagatgga

SEQ ID NO: 475730 - DNA, 25 bp, Mus musculus
tctacaggaccatctgagcgggcag

SEQ ID NO: 475731 - DNA, 25 bp, Mus musculus
tctacaggaccatgagtgaggcagc

SEQ ID NO: 475732 - DNA, 25 bp, Mus musculus
tctacaggatgctcccacagatggt

SEQ ID NO: 475733 - DNA, 25 bp, Mus musculus
tctacaggctagtcagtggacacac

SEQ ID NO: 475734 - DNA, 25 bp, Mus musculus
tctacagggactggtcagcaaagcg

SEQ ID NO: 475735 - DNA, 25 bp, Mus musculus
tctacagtaagaaccctgagcgtcc

SEQ ID NO: 475736 - DNA, 25 bp, Mus musculus
tctacagtcagaggattcgagggcc

SEQ ID NO: 475737 - DNA, 25 bp, Mus musculus
tctacagtgacaagcgcatggtcca

SEQ ID NO: 475738 - DNA, 25 bp, Mus musculus
tctacagttattcggcagcagctgc

SEQ ID NO: 475739 - DNA, 25 bp, Mus musculus
tctacatagagaccaaggctgctga

SEQ ID NO: 475740 - DNA, 25 bp, Mus musculus
tctacatcatcgagagggagccgct

SEQ ID NO: 475741 - DNA, 25 bp, Mus musculus
tctacatcgagagcctcatcgggcg

SEQ ID NO: 475742 - DNA, 25 bp, Mus musculus
tctacatggtcctgaggcaaaggcg

SEQ ID NO: 475743 - DNA, 25 bp, Mus musculus
tctacattacatggagagccggaag

SEQ ID NO: 475744 - DNA, 25 bp, Mus musculus
tctacattgacgaggacgctttggc

SEQ ID NO: 475745 - DNA, 25 bp, Mus musculus
tctacattggtggaatcaactgcca

SEQ ID NO: 475746 - DNA, 25 bp, Mus musculus
tctaccaaggagacatggatgccgt

SEQ ID NO: 475747 - DNA, 25 bp, Mus musculus
tctaccacatgcaccgtgaacgagg

SEQ ID NO: 475748 - DNA, 25 bp, Mus musculus
tctaccacctgtgcaacgggaagga

SEQ ID NO: 475749 - DNA, 25 bp, Mus musculus
tctaccactggtctttaattacgcc

SEQ ID NO: 475750 - DNA, 25 bp, Mus musculus
tctaccagaagatcgagcgggagca

SEQ ID NO: 475751 - DNA, 25 bp, Mus musculus
tctaccagcagatgcgtaggaaggg

SEQ ID NO: 475752 - DNA, 25 bp, Mus musculus
tctaccagcagcacgtaaagtttgg

SEQ ID NO: 475753 - DNA, 25 bp, Mus musculus
tctaccagcgaaggtgtgatgacgg

SEQ ID NO: 475754 - DNA, 25 bp, Mus musculus
tctaccagggtggagcttgtaccag

SEQ ID NO: 475755 - DNA, 25 bp, Mus musculus
tctaccatgttctctaggagtcccc

SEQ ID NO: 475756 - DNA, 25 bp, Mus musculus
tctaccattcaagggagttactgct

SEQ ID NO: 475757 - DNA, 25 bp, Mus musculus
tctacccagaggatgaggctgccaa

SEQ ID NO: 475758 - DNA, 25 bp, Mus musculus
tctacccagatcagttgcagtgtga

SEQ ID NO: 475759 - DNA, 25 bp, Mus musculus
tctacccaggccttagtacttagca

SEQ ID NO: 475760 - DNA, 25 bp, Mus musculus
tctacccattgctaaggacatcagg

SEQ ID NO: 475761 - DNA, 25 bp, Mus musculus
tctaccccagagtgtaaactgcctg

SEQ ID NO: 475762 - DNA, 25 bp, Mus musculus
tctaccccagggagcttgagaccca

SEQ ID NO: 475763 - DNA, 25 bp, Mus musculus
tctacccctattggaagccagtagg

SEQ ID NO: 475764 - DNA, 25 bp, Mus musculus
tctacccctttctcacgggcgtggg

SEQ ID NO: 475765 - DNA, 25 bp, Mus musculus
tctacccggctgtggatgagcagga

SEQ ID NO: 475766 - DNA, 25 bp, Mus musculus
tctacccgggattgtcactgagagc

SEQ ID NO: 475767 - DNA, 25 bp, Mus musculus
tctaccctagcggaaatcttccagt

SEQ ID NO: 475768 - DNA, 25 bp, Mus musculus
tctaccgaaacttgggcagcttcct

SEQ ID NO: 475769 - DNA, 25 bp, Mus musculus
tctaccgaagtccaatgcaaaggcg

SEQ ID NO: 475770 - DNA, 25 bp, Mus musculus
tctaccgatgtatgtgggccctggc

SEQ ID NO: 475771 - DNA, 25 bp, Mus musculus
tctaccgcaacagaacaggctgggc

SEQ ID NO: 475772 - DNA, 25 bp, Mus musculus
tctaccgcaacgacaagaggatcaa

SEQ ID NO: 475773 - DNA, 25 bp, Mus musculus
tctaccgcagcgagtacatggaagg

SEQ ID NO: 475774 - DNA, 25 bp, Mus musculus
tctaccgcggatgcatgactctgga

SEQ ID NO: 475775 - DNA, 25 bp, Mus musculus
tctaccggaaacacagctctgaagc

SEQ ID NO: 475776 - DNA, 25 bp, Mus musculus
tctaccggccatgggcatacgaagg

SEQ ID NO: 475777 - DNA, 25 bp, Mus musculus
tctaccgggaaatcgatgtggacag

SEQ ID NO: 475778 - DNA, 25 bp, Mus musculus
tctaccgggacaagaagctctactg

SEQ ID NO: 475779 - DNA, 25 bp, Mus musculus
tctaccgggcaggacctttctgggc

SEQ ID NO: 475780 - DNA, 25 bp, Mus musculus
tctacctagaccacatgaaacaggt

SEQ ID NO: 475781 - DNA, 25 bp, Mus musculus
tctacctcaaagatgggcgactgca

SEQ ID NO: 475782 - DNA, 25 bp, Mus musculus
tctacctccaagacaaagattcggg

SEQ ID NO: 475783 - DNA, 25 bp, Mus musculus
tctacctcggctcagagtgggacct

SEQ ID NO: 475784 - DNA, 25 bp, Mus musculus
tctacctgcactcttatgaagggcg

SEQ ID NO: 475785 - DNA, 25 bp, Mus musculus
tctacctgctgttctacagaaaggg

SEQ ID NO: 475786 - DNA, 25 bp, Mus musculus
tctacctggagcagcaagtgcagtt

SEQ ID NO: 475787 - DNA, 25 bp, Mus musculus
tctacctgggcaagaaccgaattcg

SEQ ID NO: 475788 - DNA, 25 bp, Mus musculus
tctacctgggcagtagctacagagc

SEQ ID NO: 475789 - DNA, 25 bp, Mus musculus
tctacctggtagactccgaagtgct

SEQ ID NO: 475790 - DNA, 25 bp, Mus musculus
tctacctgtttggaagcctgggcgc

SEQ ID NO: 475791 - DNA, 25 bp, Mus musculus
tctaccttttcgagaacggccagcg

SEQ ID NO: 475792 - DNA, 25 bp, Mus musculus
tctacgacaacacactcgagagaag

SEQ ID NO: 475793 - DNA, 25 bp, Mus musculus
tctacgacatgacattgagagaagg

SEQ ID NO: 475794 - DNA, 25 bp, Mus musculus
tctacgacccggagtgtgacgacaa

SEQ ID NO: 475795 - DNA, 25 bp, Mus musculus
tctacgactgccacagcatgaaggg

SEQ ID NO: 475796 - DNA, 25 bp, Mus musculus
tctacgagaagtacagcgggtgcct

SEQ ID NO: 475797 - DNA, 25 bp, Mus musculus
tctacgagatggaggtgcaagctac

SEQ ID NO: 475798 - DNA, 25 bp, Mus musculus
tctacgagcactgtatccggagcac

SEQ ID NO: 475799 - DNA, 25 bp, Mus musculus
tctacgatgcagtgaagaccggcta

SEQ ID NO: 475800 - DNA, 25 bp, Mus musculus
tctacgatgcctacgagctgaagca

SEQ ID NO: 475801 - DNA, 25 bp, Mus musculus
tctacgatggctggacagagccctt

SEQ ID NO: 475802 - DNA, 25 bp, Mus musculus
tctacgatgtgaacagagagtctcc

SEQ ID NO: 475803 - DNA, 25 bp, Mus musculus
tctacgcaaggtgacccacgagtct

SEQ ID NO: 475804 - DNA, 25 bp, Mus musculus
tctacgcatgagaaagcgggcagac

SEQ ID NO: 475805 - DNA, 25 bp, Mus musculus
tctacgccaaagaaatcaagtcccg

SEQ ID NO: 475806 - DNA, 25 bp, Mus musculus
tctacgccttcactgcctgcatgtg

SEQ ID NO: 475807 - DNA, 25 bp, Mus musculus
tctacgcggtctaccattaagaaac

SEQ ID NO: 475808 - DNA, 25 bp, Mus musculus
tctacggagctgtggtgcaagccat

SEQ ID NO: 475809 - DNA, 25 bp, Mus musculus
tctacggatgcacgagaactgtcca

SEQ ID NO: 475810 - DNA, 25 bp, Mus musculus
tctacggcagagaagccagaagctg

SEQ ID NO: 475811 - DNA, 25 bp, Mus musculus
tctacgggacctattgacctggctc

SEQ ID NO: 475812 - DNA, 25 bp, Mus musculus
tctacgtccagtttgtgccaaggcc

SEQ ID NO: 475813 - DNA, 25 bp, Mus musculus
tctacgtgatacaggagggcaggat

SEQ ID NO: 475814 - DNA, 25 bp, Mus musculus
tctacgtgcgcaagtacctggctgt

SEQ ID NO: 475815 - DNA, 25 bp, Mus musculus
tctacgtgtggaagagcgagctgcc

SEQ ID NO: 475816 - DNA, 25 bp, Mus musculus
tctacgttacgtgtggcttcacgag

SEQ ID NO: 475817 - DNA, 25 bp, Mus musculus
tctactaattaagaagatttcccca

SEQ ID NO: 475818 - DNA, 25 bp, Mus musculus
tctactacaacttccatccaggagg

SEQ ID NO: 475819 - DNA, 25 bp, Mus musculus
tctactacaagctgggacggaaatt

SEQ ID NO: 475820 - DNA, 25 bp, Mus musculus
tctactagcgctgggatggtacaca

SEQ ID NO: 475821 - DNA, 25 bp, Mus musculus
tctactagtgctggcaggcaaccac

SEQ ID NO: 475822 - DNA, 25 bp, Mus musculus
tctactagtggtgaaggaacgcaac

SEQ ID NO: 475823 - DNA, 25 bp, Mus musculus
tctactcaagggaataggccaggcc

SEQ ID NO: 475824 - DNA, 25 bp, Mus musculus
tctactcagaagtgagcaagggcca

SEQ ID NO: 475825 - DNA, 25 bp, Mus musculus
tctactcatgaatttgagaagaagg

SEQ ID NO: 475826 - DNA, 25 bp, Mus musculus
tctactcatgagtcgcagcaaagca

SEQ ID NO: 475827 - DNA, 25 bp, Mus musculus
tctactcccggaagacaaagccagt

SEQ ID NO: 475828 - DNA, 25 bp, Mus musculus
tctactccgtggtggcctttgtcaa

SEQ ID NO: 475829 - DNA, 25 bp, Mus musculus
tctactcgtgcagattaagatcaca

SEQ ID NO: 475830 - DNA, 25 bp, Mus musculus
tctactctaacctcatgggcactgt

SEQ ID NO: 475831 - DNA, 25 bp, Mus musculus
tctactctgagttgcacagcgtggt

SEQ ID NO: 475832 - DNA, 25 bp, Mus musculus
tctactctgcttcttgggacataag

SEQ ID NO: 475833 - DNA, 25 bp, Mus musculus
tctactcttattggacagggctctc

SEQ ID NO: 475834 - DNA, 25 bp, Mus musculus
tctactcttgagctgcagggacagg

SEQ ID NO: 475835 - DNA, 25 bp, Mus musculus
tctactgaaaatgcccttctctctg

SEQ ID NO: 475836 - DNA, 25 bp, Mus musculus
tctactgaaggtcacactggaggcc

SEQ ID NO: 475837 - DNA, 25 bp, Mus musculus
tctactgaaggtcgccagaaggcct

SEQ ID NO: 475838 - DNA, 25 bp, Mus musculus
tctactgagagccaacatggacggg

SEQ ID NO: 475839 - DNA, 25 bp, Mus musculus
tctactgagaggtctgccatggcct

SEQ ID NO: 475840 - DNA, 25 bp, Mus musculus
tctactgagtttggccacaaggccc

SEQ ID NO: 475841 - DNA, 25 bp, Mus musculus
tctactgcaaagaatgggccccagg

SEQ ID NO: 475842 - DNA, 25 bp, Mus musculus
tctactgcagaggtgccgcgataag

SEQ ID NO: 475843 - DNA, 25 bp, Mus musculus
tctactgccaactcccaggagaggc

SEQ ID NO: 475844 - DNA, 25 bp, Mus musculus
tctactgccagatggagaccttggg

SEQ ID NO: 475845 - DNA, 25 bp, Mus musculus
tctactgccttgactccacatctgg

SEQ ID NO: 475846 - DNA, 25 bp, Mus musculus
tctactgcgggtcaagcaagtcgcg

SEQ ID NO: 475847 - DNA, 25 bp, Mus musculus
tctactggcaaaactgggaggtggt

SEQ ID NO: 475848 - DNA, 25 bp, Mus musculus
tctactggcttctggtggagggtct

SEQ ID NO: 475849 - DNA, 25 bp, Mus musculus
tctactgggaggaccggctgctgaa

SEQ ID NO: 475850 - DNA, 25 bp, Mus musculus
tctactgggtaatgcagggcagacg

SEQ ID NO: 475851 - DNA, 25 bp, Mus musculus
tctactgtctggtaacaatggcaca

SEQ ID NO: 475852 - DNA, 25 bp, Mus musculus
tctactgtgaaaagcatgcccggga

SEQ ID NO: 475853 - DNA, 25 bp, Mus musculus
tctactgtgccaaagccagatgtgg

SEQ ID NO: 475854 - DNA, 25 bp, Mus musculus
tctacttcagagatgacaatgcctc

SEQ ID NO: 475855 - DNA, 25 bp, Mus musculus
tctacttcatattacgggcgggatc

SEQ ID NO: 475856 - DNA, 25 bp, Mus musculus
tctacttcgtctatgtggcgcccgg

SEQ ID NO: 475857 - DNA, 25 bp, Mus musculus
tctacttgagtgtcagagggactcc

SEQ ID NO: 475858 - DNA, 25 bp, Mus musculus
tctacttgtacgagcccatgtggca

SEQ ID NO: 475859 - DNA, 25 bp, Mus musculus
tctactttgggatgcaggatggctc

SEQ ID NO: 475860 - DNA, 25 bp, Mus musculus
tctacttttgtacccctgatgctgg

SEQ ID NO: 475861 - DNA, 25 bp, Mus musculus
tctagaaagagaagggcaaaccatt

SEQ ID NO: 475862 - DNA, 25 bp, Mus musculus
tctagaacctgctaggagacttggc

SEQ ID NO: 475863 - DNA, 25 bp, Mus musculus
tctagaactgcacgttgagcccagg

SEQ ID NO: 475864 - DNA, 25 bp, Mus musculus
tctagaagagactcaggtagtagct

SEQ ID NO: 475865 - DNA, 25 bp, Mus musculus
tctagaagccttggagcacaacgac

SEQ ID NO: 475866 - DNA, 25 bp, Mus musculus
tctagaagggtacatactggcttgc

SEQ ID NO: 475867 - DNA, 25 bp, Mus musculus
tctagaatcaaaaagggtagagggt

SEQ ID NO: 475868 - DNA, 25 bp, Mus musculus
tctagaatgaaaagctcccaaaggg

SEQ ID NO: 475869 - DNA, 25 bp, Mus musculus
tctagacaccgttgcaggaagctga

SEQ ID NO: 475870 - DNA, 25 bp, Mus musculus
tctagacagtacacctcggaaacgc

SEQ ID NO: 475871 - DNA, 25 bp, Mus musculus
tctagaccatctttgggcggacagg

SEQ ID NO: 475872 - DNA, 25 bp, Mus musculus
tctagacccaaagaccggtgagctc

SEQ ID NO: 475873 - DNA, 25 bp, Mus musculus
tctagacctgtgacggtcgcttcaa

SEQ ID NO: 475874 - DNA, 25 bp, Mus musculus
tctagactagaacctgctgaagtgc

SEQ ID NO: 475875 - DNA, 25 bp, Mus musculus
tctagactcaggtatcaacgggcag

SEQ ID NO: 475876 - DNA, 25 bp, Mus musculus
tctagactgaatgcccagggtgacc

SEQ ID NO: 475877 - DNA, 25 bp, Mus musculus
tctagactgacctttaacttgtggg

SEQ ID NO: 475878 - DNA, 25 bp, Mus musculus
tctagactgggtcttactctttggg

SEQ ID NO: 475879 - DNA, 25 bp, Mus musculus
tctagacttgaagggaatttcggct

SEQ ID NO: 475880 - DNA, 25 bp, Mus musculus
tctagactttccaataagcaggtgt

SEQ ID NO: 475881 - DNA, 25 bp, Mus musculus
tctagagaagagactgaccagctcc

SEQ ID NO: 475882 - DNA, 25 bp, Mus musculus
tctagagaagccataggcgaggcac

SEQ ID NO: 475883 - DNA, 25 bp, Mus musculus
tctagagaatctaaccctgttttaa

SEQ ID NO: 475884 - DNA, 25 bp, Mus musculus
tctagagactcggaaacatgggaag

SEQ ID NO: 475885 - DNA, 25 bp, Mus musculus
tctagagatcccgttggagcgtgca

SEQ ID NO: 475886 - DNA, 25 bp, Mus musculus
tctagagatctcagcaaagagggcc

SEQ ID NO: 475887 - DNA, 25 bp, Mus musculus
tctagagccatgtagcgtcctcatc

SEQ ID NO: 475888 - DNA, 25 bp, Mus musculus
tctagagcgtattctgggacgaggc

SEQ ID NO: 475889 - DNA, 25 bp, Mus musculus
tctagagctccatcctcagggaggg

SEQ ID NO: 475890 - DNA, 25 bp, Mus musculus
tctagagctgccttgaggtgaaaca

SEQ ID NO: 475891 - DNA, 25 bp, Mus musculus
tctagagcttcagcgacagcagcag

SEQ ID NO: 475892 - DNA, 25 bp, Mus musculus
tctagagcttcctgtagcccagtgg

SEQ ID NO: 475893 - DNA, 25 bp, Mus musculus
tctagaggaagttctgatgcgcgca

SEQ ID NO: 475894 - DNA, 25 bp, Mus musculus
tctagaggcaccaggagttgtcgca

SEQ ID NO: 475895 - DNA, 25 bp, Mus musculus
tctagagtgcagataaggctggcgt

SEQ ID NO: 475896 - DNA, 25 bp, Mus musculus
tctagagtgggtgctgtcttccgac

SEQ ID NO: 475897 - DNA, 25 bp, Mus musculus
tctagagtggtaacagtacttgagc

SEQ ID NO: 475898 - DNA, 25 bp, Mus musculus
tctagagttaggtctgtattcgctc

SEQ ID NO: 475899 - DNA, 25 bp, Mus musculus
tctagagttgctactggccgagggc

SEQ ID NO: 475900 - DNA, 25 bp, Mus musculus
tctagagttgttcagagctgcttct

SEQ ID NO: 475901 - DNA, 25 bp, Mus musculus
tctagagtttgtacgtgcctgccca

SEQ ID NO: 475902 - DNA, 25 bp, Mus musculus
tctagatcgtgagcagaacccggaa

SEQ ID NO: 475903 - DNA, 25 bp, Mus musculus
tctagatctggtcgacctgctcagc

SEQ ID NO: 475904 - DNA, 25 bp, Mus musculus
tctagcaacagttgaatcaaggtgc

SEQ ID NO: 475905 - DNA, 25 bp, Mus musculus
tctagcaagcgagtgacagaggcat

SEQ ID NO: 475906 - DNA, 25 bp, Mus musculus
tctagcacggagtatagaggctgcc

SEQ ID NO: 475907 - DNA, 25 bp, Mus musculus
tctagcacgttaacaacgcgcggtc

SEQ ID NO: 475908 - DNA, 25 bp, Mus musculus
tctagcagaattacgggcggcacag

SEQ ID NO: 475909 - DNA, 25 bp, Mus musculus
tctagcagagccctcatggacgcta

SEQ ID NO: 475910 - DNA, 25 bp, Mus musculus
tctagcaggcaattccatcccaagg

SEQ ID NO: 475911 - DNA, 25 bp, Mus musculus
tctagcatcccagggctctgcaaaa

SEQ ID NO: 475912 - DNA, 25 bp, Mus musculus
tctagcatgtccaaggtgttctgag

SEQ ID NO: 475913 - DNA, 25 bp, Mus musculus
tctagccagctatgtgcagacaacc

SEQ ID NO: 475914 - DNA, 25 bp, Mus musculus
tctagccaggaaagcaatggaatcc

SEQ ID NO: 475915 - DNA, 25 bp, Mus musculus
tctagccaggacagacacttggatc

SEQ ID NO: 475916 - DNA, 25 bp, Mus musculus
tctagccaggcaacaaatgagcttc

SEQ ID NO: 475917 - DNA, 25 bp, Mus musculus
tctagcccctttggaattgagaaga

SEQ ID NO: 475918 - DNA, 25 bp, Mus musculus
tctagccgccgggaactggaaagcg

SEQ ID NO: 475919 - DNA, 25 bp, Mus musculus
tctagccgtacttgggatcccagtg

SEQ ID NO: 475920 - DNA, 25 bp, Mus musculus
tctagcctggttctatgggcaacag

SEQ ID NO: 475921 - DNA, 25 bp, Mus musculus
tctagcctgttcaaagatgggacca

SEQ ID NO: 475922 - DNA, 25 bp, Mus musculus
tctagcgaacatgttaaagcctcca

SEQ ID NO: 475923 - DNA, 25 bp, Mus musculus
tctagcgagagatatgcaacttagc

SEQ ID NO: 475924 - DNA, 25 bp, Mus musculus
tctagcgcctggatgaaagcaactg

SEQ ID NO: 475925 - DNA, 25 bp, Mus musculus
tctagcgggcaggtgatgaacttca

SEQ ID NO: 475926 - DNA, 25 bp, Mus musculus
tctagcggggcttattcagaaggcc

SEQ ID NO: 475927 - DNA, 25 bp, Mus musculus
tctagctatggaagtcccagaaggg

SEQ ID NO: 475928 - DNA, 25 bp, Mus musculus
tctagctccaggctagagcctccaa

SEQ ID NO: 475929 - DNA, 25 bp, Mus musculus
tctagctcccacagtggccacagat

SEQ ID NO: 475930 - DNA, 25 bp, Mus musculus
tctagctcgagaaggtaagggtcac

SEQ ID NO: 475931 - DNA, 25 bp, Mus musculus
tctagctggataggaaagagcacag

SEQ ID NO: 475932 - DNA, 25 bp, Mus musculus
tctagctggcagagtgtcgtgaccc

SEQ ID NO: 475933 - DNA, 25 bp, Mus musculus
tctagcttggtgctgaaaagaccct

SEQ ID NO: 475934 - DNA, 25 bp, Mus musculus
tctaggaaagcccagatcggtctcg

SEQ ID NO: 475935 - DNA, 25 bp, Mus musculus
tctaggaacaacagctaagccatgc

SEQ ID NO: 475936 - DNA, 25 bp, Mus musculus
tctaggaagacattgctgactgctc

SEQ ID NO: 475937 - DNA, 25 bp, Mus musculus
tctaggaagattgcctgacacaggg

SEQ ID NO: 475938 - DNA, 25 bp, Mus musculus
tctaggaagccaaagccccagatgg

SEQ ID NO: 475939 - DNA, 25 bp, Mus musculus
tctaggaagtcaactcatgcaagcg

SEQ ID NO: 475940 - DNA, 25 bp, Mus musculus
tctaggaatacctcccggcaagggt

SEQ ID NO: 475941 - DNA, 25 bp, Mus musculus
tctaggacaaagagccatcgggacg

SEQ ID NO: 475942 - DNA, 25 bp, Mus musculus
tctaggacaccatctattctgccgt

SEQ ID NO: 475943 - DNA, 25 bp, Mus musculus
tctaggactgcatcttacaggtaca

SEQ ID NO: 475944 - DNA, 25 bp, Mus musculus
tctaggagaaatagccaaggtagcc

SEQ ID NO: 475945 - DNA, 25 bp, Mus musculus
tctaggagcggactccaggacaacc

SEQ ID NO: 475946 - DNA, 25 bp, Mus musculus
tctaggagcgggtcgtcgtgacact

SEQ ID NO: 475947 - DNA, 25 bp, Mus musculus
tctaggagtttaccaactgagacat

SEQ ID NO: 475948 - DNA, 25 bp, Mus musculus
tctaggataatactgtggagcccaa

SEQ ID NO: 475949 - DNA, 25 bp, Mus musculus
tctaggatcactcggtggagactga

SEQ ID NO: 475950 - DNA, 25 bp, Mus musculus
tctaggatgcagaaatgcctgggcc

SEQ ID NO: 475951 - DNA, 25 bp, Mus musculus
tctaggcccagtggctcagagacct

SEQ ID NO: 475952 - DNA, 25 bp, Mus musculus
tctaggctctattcttcaaagtaca

SEQ ID NO: 475953 - DNA, 25 bp, Mus musculus
tctaggcttctattctgctgcttga

SEQ ID NO: 475954 - DNA, 25 bp, Mus musculus
tctagggaaaagaagtagaaattgt

SEQ ID NO: 475955 - DNA, 25 bp, Mus musculus
tctagggaaggatcccagccgagtt

SEQ ID NO: 475956 - DNA, 25 bp, Mus musculus
tctagggagcttgaagaaacatctc

SEQ ID NO: 475957 - DNA, 25 bp, Mus musculus
tctagggagtagtaaaggatggtcc

SEQ ID NO: 475958 - DNA, 25 bp, Mus musculus
tctagggccgcgagaaacaatgcaa

SEQ ID NO: 475959 - DNA, 25 bp, Mus musculus
tctagggctcagctgaaactgcatg

SEQ ID NO: 475960 - DNA, 25 bp, Mus musculus
tctagggctctgatgagcatcttca

SEQ ID NO: 475961 - DNA, 25 bp, Mus musculus
tctaggtacctgtctcatactgctg

SEQ ID NO: 475962 - DNA, 25 bp, Mus musculus
tctaggtcagaagtccagctgcctc

SEQ ID NO: 475963 - DNA, 25 bp, Mus musculus
tctaggtccctgtgcccatgatgag

SEQ ID NO: 475964 - DNA, 25 bp, Mus musculus
tctaggtcctttgcagaattccagg

SEQ ID NO: 475965 - DNA, 25 bp, Mus musculus
tctaggtctcggaccgtagctgtcg

SEQ ID NO: 475966 - DNA, 25 bp, Mus musculus
tctaggtgctttgatccacagcgac

SEQ ID NO: 475967 - DNA, 25 bp, Mus musculus
tctaggtgtcgcctcgtttcgaggt

SEQ ID NO: 475968 - DNA, 25 bp, Mus musculus
tctaggttaagagccggacaagcgg

SEQ ID NO: 475969 - DNA, 25 bp, Mus musculus
tctaggttcgcccagcatcgactga

SEQ ID NO: 475970 - DNA, 25 bp, Mus musculus
tctagtaaaaggaactagggccagc

SEQ ID NO: 475971 - DNA, 25 bp, Mus musculus
tctagtaattgttcccagtcccagg

SEQ ID NO: 475972 - DNA, 25 bp, Mus musculus
tctagtacaaaaaagagagttcctg

SEQ ID NO: 475973 - DNA, 25 bp, Mus musculus
tctagtagaaagaacactgggctct

SEQ ID NO: 475974 - DNA, 25 bp, Mus musculus
tctagtagggtatcaggagacggcc

SEQ ID NO: 475975 - DNA, 25 bp, Mus musculus
tctagtatttctactgggaaaagga

SEQ ID NO: 475976 - DNA, 25 bp, Mus musculus
tctagtcattagtggaagaacgagt

SEQ ID NO: 475977 - DNA, 25 bp, Mus musculus
tctagtcattgttctccctctctct

SEQ ID NO: 475978 - DNA, 25 bp, Mus musculus
tctagtccggatgaaagtaacggcc

SEQ ID NO: 475979 - DNA, 25 bp, Mus musculus
tctagtcctaactggaggctgcagg

SEQ ID NO: 475980 - DNA, 25 bp, Mus musculus
tctagtcgcctggttgggagacaca

SEQ ID NO: 475981 - DNA, 25 bp, Mus musculus
tctagtctatgagggaggctatgtg

SEQ ID NO: 475982 - DNA, 25 bp, Mus musculus
tctagtctcaaggatgcctgcctgg

SEQ ID NO: 475983 - DNA, 25 bp, Mus musculus
tctagtctggccaatgcacgaggta

SEQ ID NO: 475984 - DNA, 25 bp, Mus musculus
tctagtgaaagtttgccaactcccg

SEQ ID NO: 475985 - DNA, 25 bp, Mus musculus
tctagtgaagtggacacaaagtgtc

SEQ ID NO: 475986 - DNA, 25 bp, Mus musculus
tctagtgacttatggtggcgatccc

SEQ ID NO: 475987 - DNA, 25 bp, Mus musculus
tctagtgagtttcaggtatcagatc

SEQ ID NO: 475988 - DNA, 25 bp, Mus musculus
tctagtgccctgtgatgccaaagcc

SEQ ID NO: 475989 - DNA, 25 bp, Mus musculus
tctagtgcgctccatgagcggctgc

SEQ ID NO: 475990 - DNA, 25 bp, Mus musculus
tctagtgcgtgtgtgtgaaaacatc

SEQ ID NO: 475991 - DNA, 25 bp, Mus musculus
tctagtggacacaaccatgggcagg

SEQ ID NO: 475992 - DNA, 25 bp, Mus musculus
tctagtggaggttcagacactgtcc

SEQ ID NO: 475993 - DNA, 25 bp, Mus musculus
tctagttctcgtttttgcactgaaa

SEQ ID NO: 475994 - DNA, 25 bp, Mus musculus
tctagttgacaacggctaagcagct

SEQ ID NO: 475995 - DNA, 25 bp, Mus musculus
tctagttgagtggatagatacccca

SEQ ID NO: 475996 - DNA, 25 bp, Mus musculus
tctagttggcttgagtccgagggtc

SEQ ID NO: 475997 - DNA, 25 bp, Mus musculus
tctagttggtcaggagcactctgcc

SEQ ID NO: 475998 - DNA, 25 bp, Mus musculus
tctataaaaacctgtgggcagctgt

SEQ ID NO: 475999 - DNA, 25 bp, Mus musculus
tctataaacactggaaatgctgggt

SEQ ID NO: 476000 - DNA, 25 bp, Mus musculus
tctataaattaccagagggatcgcc

SEQ ID NO: 476001 - DNA, 25 bp, Mus musculus
tctataacccgttggtgcccgaggc

SEQ ID NO: 476002 - DNA, 25 bp, Mus musculus
tctataagatagaggagactggccc

SEQ ID NO: 476003 - DNA, 25 bp, Mus musculus
tctataagcgatcaacaggccacgt

SEQ ID NO: 476004 - DNA, 25 bp, Mus musculus
tctataagcggttgtgagtcagctg

SEQ ID NO: 476005 - DNA, 25 bp, Mus musculus
tctataaggactacatccgggagcg

SEQ ID NO: 476006 - DNA, 25 bp, Mus musculus
tctataaggaggacgcgggaatatc

SEQ ID NO: 476007 - DNA, 25 bp, Mus musculus
tctataagtggagtcgatgctgcag

SEQ ID NO: 476008 - DNA, 25 bp, Mus musculus
tctataataaggcagggaaggttca

SEQ ID NO: 476009 - DNA, 25 bp, Mus musculus
tctataatatagtctgggtgggcca

SEQ ID NO: 476010 - DNA, 25 bp, Mus musculus
tctataatcgagctaaatctccagc

SEQ ID NO: 476011 - DNA, 25 bp, Mus musculus
tctatacacagagcgcagccttggg

SEQ ID NO: 476012 - DNA, 25 bp, Mus musculus
tctatacaggaaccaaccaggagaa

SEQ ID NO: 476013 - DNA, 25 bp, Mus musculus
tctatacaggctagcagatgctctg

SEQ ID NO: 476014 - DNA, 25 bp, Mus musculus
tctatacatacattcagtgagcggg

SEQ ID NO: 476015 - DNA, 25 bp, Mus musculus
tctatagatcctggattacacaacg

SEQ ID NO: 476016 - DNA, 25 bp, Mus musculus
tctatagccggagaacagggttcct

SEQ ID NO: 476017 - DNA, 25 bp, Mus musculus
tctatagcggttctactcaagcagc

SEQ ID NO: 476018 - DNA, 25 bp, Mus musculus
tctatagctgcaaccagagtccagg

SEQ ID NO: 476019 - DNA, 25 bp, Mus musculus
tctataggctttgctcctagcgggc

SEQ ID NO: 476020 - DNA, 25 bp, Mus musculus
tctatagggcaggtcactgcagtgt

SEQ ID NO: 476021 - DNA, 25 bp, Mus musculus
tctatagtgataggaccagtggcac

SEQ ID NO: 476022 - DNA, 25 bp, Mus musculus
tctatatccggagcctacatggtgg

SEQ ID NO: 476023 - DNA, 25 bp, Mus musculus
tctatatctccccttggctccaggt

SEQ ID NO: 476024 - DNA, 25 bp, Mus musculus
tctatatctgacctaaagtttctcc

SEQ ID NO: 476025 - DNA, 25 bp, Mus musculus
tctatatggaagaagatctgcccga

SEQ ID NO: 476026 - DNA, 25 bp, Mus musculus
tctatattgaaaccaaggcagcaga

SEQ ID NO: 476027 - DNA, 25 bp, Mus musculus
tctatattggagagaatccacacca

SEQ ID NO: 476028 - DNA, 25 bp, Mus musculus
tctatcaagatgctcaagacgtggg

SEQ ID NO: 476029 - DNA, 25 bp, Mus musculus
tctatcaagcttctctgggacctgg

SEQ ID NO: 476030 - DNA, 25 bp, Mus musculus
tctatcaagggacagagagctgcct

SEQ ID NO: 476031 - DNA, 25 bp, Mus musculus
tctatcaagggctcctctggcctgg

SEQ ID NO: 476032 - DNA, 25 bp, Mus musculus
tctatcaagtgcagggaaggcttcc

SEQ ID NO: 476033 - DNA, 25 bp, Mus musculus
tctatcacagagatggagtccttcg

SEQ ID NO: 476034 - DNA, 25 bp, Mus musculus
tctatcacctgaatactttggagta

SEQ ID NO: 476035 - DNA, 25 bp, Mus musculus
tctatcactagtggcagggctcacc

SEQ ID NO: 476036 - DNA, 25 bp, Mus musculus
tctatcagaaggagttggccaccct

SEQ ID NO: 476037 - DNA, 25 bp, Mus musculus
tctatcagaggagggaagtgtccag

SEQ ID NO: 476038 - DNA, 25 bp, Mus musculus
tctatcaggtcatccaaagctggga

SEQ ID NO: 476039 - DNA, 25 bp, Mus musculus
tctatcagtgggtcagtctcaagct

SEQ ID NO: 476040 - DNA, 25 bp, Mus musculus
tctatcatcgggagacagaccacga

SEQ ID NO: 476041 - DNA, 25 bp, Mus musculus
tctatccagggaggaattccagctc

SEQ ID NO: 476042 - DNA, 25 bp, Mus musculus
tctatcccagatcacacaagagtct

SEQ ID NO: 476043 - DNA, 25 bp, Mus musculus
tctatcctggtagtgcaggccagcc

SEQ ID NO: 476044 - DNA, 25 bp, Mus musculus
tctatcctgtttggtgagacacacg

SEQ ID NO: 476045 - DNA, 25 bp, Mus musculus
tctatcgaagctggtggcctatgaa

SEQ ID NO: 476046 - DNA, 25 bp, Mus musculus
tctatcggcgccaaaagcaacttga

SEQ ID NO: 476047 - DNA, 25 bp, Mus musculus
tctatcggttgaaaaaggcttgggc

SEQ ID NO: 476048 - DNA, 25 bp, Mus musculus
tctatctgcaggagggccaactctt

SEQ ID NO: 476049 - DNA, 25 bp, Mus musculus
tctatctggtgcagtgaccctgggc

SEQ ID NO: 476050 - DNA, 25 bp, Mus musculus
tctatctgttggacagggagcccct

SEQ ID NO: 476051 - DNA, 25 bp, Mus musculus
tctatctgttttgaacctggctggc

SEQ ID NO: 476052 - DNA, 25 bp, Mus musculus
tctatcttatggagcaccttagggt

SEQ ID NO: 476053 - DNA, 25 bp, Mus musculus
tctatgaaaagctggtgggcggccc

SEQ ID NO: 476054 - DNA, 25 bp, Mus musculus
tctatgaaggctacggacagaccga

SEQ ID NO: 476055 - DNA, 25 bp, Mus musculus
tctatgaagtgtcaaggaggaaccc

SEQ ID NO: 476056 - DNA, 25 bp, Mus musculus
tctatgacaacagaccagctgcttg

SEQ ID NO: 476057 - DNA, 25 bp, Mus musculus
tctatgacacactggagtccgtgcg

SEQ ID NO: 476058 - DNA, 25 bp, Mus musculus
tctatgacatcagcgagaaggctcg

SEQ ID NO: 476059 - DNA, 25 bp, Mus musculus
tctatgacgtcatcgcagaacagct

SEQ ID NO: 476060 - DNA, 25 bp, Mus musculus
tctatgactgtgtgtacggcgagga

SEQ ID NO: 476061 - DNA, 25 bp, Mus musculus
tctatgagaatgagggcttcaggcc

SEQ ID NO: 476062 - DNA, 25 bp, Mus musculus
tctatgagcctttgctatttctgga

SEQ ID NO: 476063 - DNA, 25 bp, Mus musculus
tctatgatacgttctgcgccccagt

SEQ ID NO: 476064 - DNA, 25 bp, Mus musculus
tctatgatggaactgaaggcaactc

SEQ ID NO: 476065 - DNA, 25 bp, Mus musculus
tctatgcaaatacgaggcagctgtg

SEQ ID NO: 476066 - DNA, 25 bp, Mus musculus
tctatgcagacaaggccctcagagc

SEQ ID NO: 476067 - DNA, 25 bp, Mus musculus
tctatgcagcactgtatagtgcaac

SEQ ID NO: 476068 - DNA, 25 bp, Mus musculus
tctatgcagcagactgggagcctct

SEQ ID NO: 476069 - DNA, 25 bp, Mus musculus
tctatgcaggaaaaagtggcccagc

SEQ ID NO: 476070 - DNA, 25 bp, Mus musculus
tctatgcatcgaatgaagagagccg

SEQ ID NO: 476071 - DNA, 25 bp, Mus musculus
tctatgccacccacatgcacttggg

SEQ ID NO: 476072 - DNA, 25 bp, Mus musculus
tctatgccatccacaccgaggagat

SEQ ID NO: 476073 - DNA, 25 bp, Mus musculus
tctatgcgcagtctctgtggcaggc

SEQ ID NO: 476074 - DNA, 25 bp, Mus musculus
tctatgcggttccaatcaaggcccc

SEQ ID NO: 476075 - DNA, 25 bp, Mus musculus
tctatgctcaagaggctggctcggg

SEQ ID NO: 476076 - DNA, 25 bp, Mus musculus
tctatgctgtgaagacagccgtgtc

SEQ ID NO: 476077 - DNA, 25 bp, Mus musculus
tctatggaagagcaacggagcctat

SEQ ID NO: 476078 - DNA, 25 bp, Mus musculus
tctatggaagagtaaggcgatggcc

SEQ ID NO: 476079 - DNA, 25 bp, Mus musculus
tctatggagcagtgaaacacatttg

SEQ ID NO: 476080 - DNA, 25 bp, Mus musculus
tctatggcaatgaagactccccggt

SEQ ID NO: 476081 - DNA, 25 bp, Mus musculus
tctatggcctccctgtctacaaaca

SEQ ID NO: 476082 - DNA, 25 bp, Mus musculus
tctatggcgaaaatgctgcttgtcc

SEQ ID NO: 476083 - DNA, 25 bp, Mus musculus
tctatggctctggtagaaacagcta

SEQ ID NO: 476084 - DNA, 25 bp, Mus musculus
tctatgggccctcagaaagctctgg

SEQ ID NO: 476085 - DNA, 25 bp, Mus musculus
tctatgggtattgactcgctccgct

SEQ ID NO: 476086 - DNA, 25 bp, Mus musculus
tctatggtagtcgtccaaggagcca

SEQ ID NO: 476087 - DNA, 25 bp, Mus musculus
tctatggtcctgctatcagagatgc

SEQ ID NO: 476088 - DNA, 25 bp, Mus musculus
tctatggtgcaaaaattgtctctgc

SEQ ID NO: 476089 - DNA, 25 bp, Mus musculus
tctatggtgccactgggacactgct

SEQ ID NO: 476090 - DNA, 25 bp, Mus musculus
tctatgtaattgacagtgccgacag

SEQ ID NO: 476091 - DNA, 25 bp, Mus musculus
tctatgtcaacactacagaggtcgc

SEQ ID NO: 476092 - DNA, 25 bp, Mus musculus
tctatgtcactgagcctgaggcctg

SEQ ID NO: 476093 - DNA, 25 bp, Mus musculus
tctatgtctgcaacgggaaacggaa

SEQ ID NO: 476094 - DNA, 25 bp, Mus musculus
tctatgtggaagtgcgctatagccc

SEQ ID NO: 476095 - DNA, 25 bp, Mus musculus
tctatgtggcagcttatcaccctcc

SEQ ID NO: 476096 - DNA, 25 bp, Mus musculus
tctatgttgggaatatggtagccac

SEQ ID NO: 476097 - DNA, 25 bp, Mus musculus
tctatgtttgtgatctcagcagtgt

SEQ ID NO: 476098 - DNA, 25 bp, Mus musculus
tctattaccagcttcagcaggggaa

SEQ ID NO: 476099 - DNA, 25 bp, Mus musculus
tctattcaaggagcggcaacggaac

SEQ ID NO: 476100 - DNA, 25 bp, Mus musculus
tctattcagcgatggtcgaccgcgc

SEQ ID NO: 476101 - DNA, 25 bp, Mus musculus
tctattccaagaatcgggtgcccag

SEQ ID NO: 476102 - DNA, 25 bp, Mus musculus
tctattcccaggaggtccgagacct

SEQ ID NO: 476103 - DNA, 25 bp, Mus musculus
tctattccggaagaaatggccatgg

SEQ ID NO: 476104 - DNA, 25 bp, Mus musculus
tctattctgggaagacacatcctgg

SEQ ID NO: 476105 - DNA, 25 bp, Mus musculus
tctattgagccttcttgagggtcca

SEQ ID NO: 476106 - DNA, 25 bp, Mus musculus
tctattgcaagaagagacaacggaa

SEQ ID NO: 476107 - DNA, 25 bp, Mus musculus
tctattgtgacaaacatgagtgggt

SEQ ID NO: 476108 - DNA, 25 bp, Mus musculus
tctatttattctccccagcgagggc

SEQ ID NO: 476109 - DNA, 25 bp, Mus musculus
tctatttcagcagcagaagcaccca

SEQ ID NO: 476110 - DNA, 25 bp, Mus musculus
tctatttcatagagtaatgtatacc

SEQ ID NO: 476111 - DNA, 25 bp, Mus musculus
tctattttgcacacgggcaggagga

SEQ ID NO: 476112 - DNA, 25 bp, Mus musculus
tctattttggccggacggcaggccg

SEQ ID NO: 476113 - DNA, 25 bp, Mus musculus
tctatttttaggagtagctgtgaaa

SEQ ID NO: 476114 - DNA, 25 bp, Mus musculus
tctcaaaaacattcaggctggtggc

SEQ ID NO: 476115 - DNA, 25 bp, Mus musculus
tctcaaaaagcaccgccaacaagag

SEQ ID NO: 476116 - DNA, 25 bp, Mus musculus
tctcaaaaccgggagctcactgctg

SEQ ID NO: 476117 - DNA, 25 bp, Mus musculus
tctcaaaagagggactaaattcctt

SEQ ID NO: 476118 - DNA, 25 bp, Mus musculus
tctcaaaaggcgaggaaggcatcat

SEQ ID NO: 476119 - DNA, 25 bp, Mus musculus
tctcaaaatgctacatcttgcctat

SEQ ID NO: 476120 - DNA, 25 bp, Mus musculus
tctcaaaccgcctgctggttggatg

SEQ ID NO: 476121 - DNA, 25 bp, Mus musculus
tctcaaagaccccaaaggatgcgct

SEQ ID NO: 476122 - DNA, 25 bp, Mus musculus
tctcaaagagtgtagggacctggtc

SEQ ID NO: 476123 - DNA, 25 bp, Mus musculus
tctcaaataggctcaggaactcagg

SEQ ID NO: 476124 - DNA, 25 bp, Mus musculus
tctcaaatgacaccagaagcccagg

SEQ ID NO: 476125 - DNA, 25 bp, Mus musculus
tctcaaatgcgtggatggatcgcgc

SEQ ID NO: 476126 - DNA, 25 bp, Mus musculus
tctcaacaaaaccagggcagcagct

SEQ ID NO: 476127 - DNA, 25 bp, Mus musculus
tctcaacactagcagctgagctgag

SEQ ID NO: 476128 - DNA, 25 bp, Mus musculus
tctcaacgagagacagatcaagatc

SEQ ID NO: 476129 - DNA, 25 bp, Mus musculus
tctcaactaccgaaagggactgggt

SEQ ID NO: 476130 - DNA, 25 bp, Mus musculus
tctcaactggctgtgcagtgggtga

SEQ ID NO: 476131 - DNA, 25 bp, Mus musculus
tctcaagaaagaagtgggatcagct

SEQ ID NO: 476132 - DNA, 25 bp, Mus musculus
tctcaagaagctgggcgtctcgatc

SEQ ID NO: 476133 - DNA, 25 bp, Mus musculus
tctcaagaagggaaaggacatcatc

SEQ ID NO: 476134 - DNA, 25 bp, Mus musculus
tctcaagacagcaaccctgggaagg

SEQ ID NO: 476135 - DNA, 25 bp, Mus musculus
tctcaagacagtggtggagtccaca

SEQ ID NO: 476136 - DNA, 25 bp, Mus musculus
tctcaagacgggaagagaacatgcg

SEQ ID NO: 476137 - DNA, 25 bp, Mus musculus
tctcaagagctacagaaggatcacc

SEQ ID NO: 476138 - DNA, 25 bp, Mus musculus
tctcaagagctttgggccaagccaa

SEQ ID NO: 476139 - DNA, 25 bp, Mus musculus
tctcaagattcgaactccggtcctg

SEQ ID NO: 476140 - DNA, 25 bp, Mus musculus
tctcaagattcggagttgcacgtgc

SEQ ID NO: 476141 - DNA, 25 bp, Mus musculus
tctcaagattgctggtgcttgctgg

SEQ ID NO: 476142 - DNA, 25 bp, Mus musculus
tctcaagcagttaagcctacttaaa

SEQ ID NO: 476143 - DNA, 25 bp, Mus musculus
tctcaagcatacaaccacaggtgga

SEQ ID NO: 476144 - DNA, 25 bp, Mus musculus
tctcaagccatgtggaaggccggcc

SEQ ID NO: 476145 - DNA, 25 bp, Mus musculus
tctcaagcctgagtatagccgggtc

SEQ ID NO: 476146 - DNA, 25 bp, Mus musculus
tctcaagcggaaagtcctgtcacag

SEQ ID NO: 476147 - DNA, 25 bp, Mus musculus
tctcaagctcatcgaggaaggcagc

SEQ ID NO: 476148 - DNA, 25 bp, Mus musculus
tctcaaggcaatgaagcagagtgct

SEQ ID NO: 476149 - DNA, 25 bp, Mus musculus
tctcaaggcattccccattgttgcg

SEQ ID NO: 476150 - DNA, 25 bp, Mus musculus
tctcaaggcctgatgaaagctccca

SEQ ID NO: 476151 - DNA, 25 bp, Mus musculus
tctcaagggaacatgaggaccagag

SEQ ID NO: 476152 - DNA, 25 bp, Mus musculus
tctcaagggcagataacctggcagc

SEQ ID NO: 476153 - DNA, 25 bp, Mus musculus
tctcaagggcggtcaaaaagtttgc

SEQ ID NO: 476154 - DNA, 25 bp, Mus musculus
tctcaagtccggttgtcggccagga

SEQ ID NO: 476155 - DNA, 25 bp, Mus musculus
tctcaagtctacacacagaacgctg

SEQ ID NO: 476156 - DNA, 25 bp, Mus musculus
tctcaagtgagacggttggccgcct

SEQ ID NO: 476157 - DNA, 25 bp, Mus musculus
tctcaagtgcgtctggatccggtgt

SEQ ID NO: 476158 - DNA, 25 bp, Mus musculus
tctcaataagcccagcaagagctct

SEQ ID NO: 476159 - DNA, 25 bp, Mus musculus
tctcaatatgagtctgtgccacagc

SEQ ID NO: 476160 - DNA, 25 bp, Mus musculus
tctcaatcagtgacggtcctccggg

SEQ ID NO: 476161 - DNA, 25 bp, Mus musculus
tctcaatggtcaacatccaggccgg

SEQ ID NO: 476162 - DNA, 25 bp, Mus musculus
tctcacacactccagcagatgtctg

SEQ ID NO: 476163 - DNA, 25 bp, Mus musculus
tctcacagaaacgaacaagactggc

SEQ ID NO: 476164 - DNA, 25 bp, Mus musculus
tctcacagaatgtgacctcacagga

SEQ ID NO: 476165 - DNA, 25 bp, Mus musculus
tctcacagagtgcaaaatcaacgct

SEQ ID NO: 476166 - DNA, 25 bp, Mus musculus
tctcacagcaaaaatgaatagaacc

SEQ ID NO: 476167 - DNA, 25 bp, Mus musculus
tctcacaggccttgaagtcactatg

SEQ ID NO: 476168 - DNA, 25 bp, Mus musculus
tctcacagtatgtcaggcagtcctc

SEQ ID NO: 476169 - DNA, 25 bp, Mus musculus
tctcacagtccttggctgccttttc

SEQ ID NO: 476170 - DNA, 25 bp, Mus musculus
tctcacagtggctgatgagctgctt

SEQ ID NO: 476171 - DNA, 25 bp, Mus musculus
tctcacataagagcatgcgggaccg

SEQ ID NO: 476172 - DNA, 25 bp, Mus musculus
tctcacatacaaggaagtagtgctg

SEQ ID NO: 476173 - DNA, 25 bp, Mus musculus
tctcaccagagccagctgacttagg

SEQ ID NO: 476174 - DNA, 25 bp, Mus musculus
tctcacccagcttctagagcagtgc

SEQ ID NO: 476175 - DNA, 25 bp, Mus musculus
tctcaccctgggtcctgatatggag

SEQ ID NO: 476176 - DNA, 25 bp, Mus musculus
tctcaccggtgaggatctagagcgg

SEQ ID NO: 476177 - DNA, 25 bp, Mus musculus
tctcacctcggctgcgtgagaggct

SEQ ID NO: 476178 - DNA, 25 bp, Mus musculus
tctcacctgggcttccaaatgaagg

SEQ ID NO: 476179 - DNA, 25 bp, Mus musculus
tctcacctgtttggaaatggctctg

SEQ ID NO: 476180 - DNA, 25 bp, Mus musculus
tctcaccttaggtgtgcagcacaga

SEQ ID NO: 476181 - DNA, 25 bp, Mus musculus
tctcacgaaagcatggagtcctatg

SEQ ID NO: 476182 - DNA, 25 bp, Mus musculus
tctcactaatgaaaggcctgtccct

SEQ ID NO: 476183 - DNA, 25 bp, Mus musculus
tctcactctagctctctctggcaag

SEQ ID NO: 476184 - DNA, 25 bp, Mus musculus
tctcactcttttctacattctctct

SEQ ID NO: 476185 - DNA, 25 bp, Mus musculus
tctcactggaggtgcagaacggagc

SEQ ID NO: 476186 - DNA, 25 bp, Mus musculus
tctcactggcacagtttactgccat

SEQ ID NO: 476187 - DNA, 25 bp, Mus musculus
tctcactggcgacatgaaggaatgc

SEQ ID NO: 476188 - DNA, 25 bp, Mus musculus
tctcactgggaactacaggttgcgg

SEQ ID NO: 476189 - DNA, 25 bp, Mus musculus
tctcacttctgaatgccaccttctt

SEQ ID NO: 476190 - DNA, 25 bp, Mus musculus
tctcacttgaacacagaaacttgtg

SEQ ID NO: 476191 - DNA, 25 bp, Mus musculus
tctcacttgagataattatagtaag

SEQ ID NO: 476192 - DNA, 25 bp, Mus musculus
tctcacttgctagctggacaaaagg

SEQ ID NO: 476193 - DNA, 25 bp, Mus musculus
tctcactttggcagctagccggtgc

SEQ ID NO: 476194 - DNA, 25 bp, Mus musculus
tctcagaactaaaggctcagctcgc

SEQ ID NO: 476195 - DNA, 25 bp, Mus musculus
tctcagaagaaggtgaagatcgagc

SEQ ID NO: 476196 - DNA, 25 bp, Mus musculus
tctcagaagaggatggtaccctgtc

SEQ ID NO: 476197 - DNA, 25 bp, Mus musculus
tctcagaagagggacgcattgtgca

SEQ ID NO: 476198 - DNA, 25 bp, Mus musculus
tctcagaagcattaggaacgtaggc

SEQ ID NO: 476199 - DNA, 25 bp, Mus musculus
tctcagaaggtgcatgctaagtagg

SEQ ID NO: 476200 - DNA, 25 bp, Mus musculus
tctcagaatgcgaccctggacaggg

SEQ ID NO: 476201 - DNA, 25 bp, Mus musculus
tctcagacaaaatctaccagatcag

SEQ ID NO: 476202 - DNA, 25 bp, Mus musculus
tctcagacagtcaagggaagcagcc

SEQ ID NO: 476203 - DNA, 25 bp, Mus musculus
tctcagactggagtcagggtgtctc

SEQ ID NO: 476204 - DNA, 25 bp, Mus musculus
tctcagagaaagctctgcgcgctgc

SEQ ID NO: 476205 - DNA, 25 bp, Mus musculus
tctcagagaactatgggtgccgcag

SEQ ID NO: 476206 - DNA, 25 bp, Mus musculus
tctcagagaagaacatgtatgcccg

SEQ ID NO: 476207 - DNA, 25 bp, Mus musculus
tctcagagaaggcaaagtctagttt

SEQ ID NO: 476208 - DNA, 25 bp, Mus musculus
tctcagagaccagtgaagaatttca

SEQ ID NO: 476209 - DNA, 25 bp, Mus musculus
tctcagagacccactgtggcacttc

SEQ ID NO: 476210 - DNA, 25 bp, Mus musculus
tctcagagagcagagacacgatgcc

SEQ ID NO: 476211 - DNA, 25 bp, Mus musculus
tctcagagcactcccatcgggctgg

SEQ ID NO: 476212 - DNA, 25 bp, Mus musculus
tctcagagcaggataccaagcaggc

SEQ ID NO: 476213 - DNA, 25 bp, Mus musculus
tctcagagccggagcagcctctctg

SEQ ID NO: 476214 - DNA, 25 bp, Mus musculus
tctcagagcctatggcccaatgtcc

SEQ ID NO: 476215 - DNA, 25 bp, Mus musculus
tctcagagcgtcactcatgctgggc

SEQ ID NO: 476216 - DNA, 25 bp, Mus musculus
tctcagagcttaacctggtggccca

SEQ ID NO: 476217 - DNA, 25 bp, Mus musculus
tctcagaggacaccacgtacaagtg

SEQ ID NO: 476218 - DNA, 25 bp, Mus musculus
tctcagaggacggttatcgcacggt

SEQ ID NO: 476219 - DNA, 25 bp, Mus musculus
tctcagaggatgtcgagggcttcca

SEQ ID NO: 476220 - DNA, 25 bp, Mus musculus
tctcagaggattccgaccaggaggt

SEQ ID NO: 476221 - DNA, 25 bp, Mus musculus
tctcagagggtgaagagctcgtcgc

SEQ ID NO: 476222 - DNA, 25 bp, Mus musculus
tctcagagtccgagtaggtgataca

SEQ ID NO: 476223 - DNA, 25 bp, Mus musculus
tctcagatacaatgtggcacacaag

SEQ ID NO: 476224 - DNA, 25 bp, Mus musculus
tctcagatcaccgaggacttcaggg

SEQ ID NO: 476225 - DNA, 25 bp, Mus musculus
tctcagatccgaagccagattggtc

SEQ ID NO: 476226 - DNA, 25 bp, Mus musculus
tctcagatcctgacggtgcagcagc

SEQ ID NO: 476227 - DNA, 25 bp, Mus musculus
tctcagatctcggtgaacatggagg

SEQ ID NO: 476228 - DNA, 25 bp, Mus musculus
tctcagatgagatacacgagcggcg

SEQ ID NO: 476229 - DNA, 25 bp, Mus musculus
tctcagcacatggagggaatctgct

SEQ ID NO: 476230 - DNA, 25 bp, Mus musculus
tctcagcagaggaggccttgcagca

SEQ ID NO: 476231 - DNA, 25 bp, Mus musculus
tctcagcagagtgccctgggaggaa

SEQ ID NO: 476232 - DNA, 25 bp, Mus musculus
tctcagcatcctagagccacagggt

SEQ ID NO: 476233 - DNA, 25 bp, Mus musculus
tctcagccacctggaaagaatgaaa

SEQ ID NO: 476234 - DNA, 25 bp, Mus musculus
tctcagccgcaaattgtgtggaagg

SEQ ID NO: 476235 - DNA, 25 bp, Mus musculus
tctcagccgggttgtaatgcccacg

SEQ ID NO: 476236 - DNA, 25 bp, Mus musculus
tctcagcctcgggtgatgcattgaa

SEQ ID NO: 476237 - DNA, 25 bp, Mus musculus
tctcagcggagagcactgcggagct

SEQ ID NO: 476238 - DNA, 25 bp, Mus musculus
tctcagcgtagcagctcgagggagc

SEQ ID NO: 476239 - DNA, 25 bp, Mus musculus
tctcagctccccatcaattatggat

SEQ ID NO: 476240 - DNA, 25 bp, Mus musculus
tctcagcttgtacgaggctcttgct

SEQ ID NO: 476241 - DNA, 25 bp, Mus musculus
tctcaggaaaaggtttgacgtgtgg

SEQ ID NO: 476242 - DNA, 25 bp, Mus musculus
tctcaggaacggaagccgtgctcat

SEQ ID NO: 476243 - DNA, 25 bp, Mus musculus
tctcaggacaggataaagagctgcg

SEQ ID NO: 476244 - DNA, 25 bp, Mus musculus
tctcaggacatagttcctgtgttgc

SEQ ID NO: 476245 - DNA, 25 bp, Mus musculus
tctcaggaccctgtgaacactgggc

SEQ ID NO: 476246 - DNA, 25 bp, Mus musculus
tctcaggagatgtggcagagccatt

SEQ ID NO: 476247 - DNA, 25 bp, Mus musculus
tctcaggagcagaggatcaggccat

SEQ ID NO: 476248 - DNA, 25 bp, Mus musculus
tctcaggaggctacaacaggactac

SEQ ID NO: 476249 - DNA, 25 bp, Mus musculus
tctcaggatgaatataacggtgccc

SEQ ID NO: 476250 - DNA, 25 bp, Mus musculus
tctcaggcacggaagctagctcagt

SEQ ID NO: 476251 - DNA, 25 bp, Mus musculus
tctcaggcagagacgaatttgctca

SEQ ID NO: 476252 - DNA, 25 bp, Mus musculus
tctcaggcaggcactatcagcagct

SEQ ID NO: 476253 - DNA, 25 bp, Mus musculus
tctcaggccatagggcagaagtgct

SEQ ID NO: 476254 - DNA, 25 bp, Mus musculus
tctcaggccgtagtcctgcagggct

SEQ ID NO: 476255 - DNA, 25 bp, Mus musculus
tctcaggcctgatatggtctggccc

SEQ ID NO: 476256 - DNA, 25 bp, Mus musculus
tctcaggcgcctcagatgtatccat

SEQ ID NO: 476257 - DNA, 25 bp, Mus musculus
tctcaggcggaagctcgatgtctct

SEQ ID NO: 476258 - DNA, 25 bp, Mus musculus
tctcaggctagtggcagaggcgttt

SEQ ID NO: 476259 - DNA, 25 bp, Mus musculus
tctcaggctcccatgcatgggtggg

SEQ ID NO: 476260 - DNA, 25 bp, Mus musculus
tctcaggcttggacccatggagccc

SEQ ID NO: 476261 - DNA, 25 bp, Mus musculus
tctcagggaatctggaaagatgtta

SEQ ID NO: 476262 - DNA, 25 bp, Mus musculus
tctcagggacaaagtaataaagtgc

SEQ ID NO: 476263 - DNA, 25 bp, Mus musculus
tctcagggccctgaaaaactgcagg

SEQ ID NO: 476264 - DNA, 25 bp, Mus musculus
tctcagggcctcgattggaataacc

SEQ ID NO: 476265 - DNA, 25 bp, Mus musculus
tctcagggctataaatgtggcatcg

SEQ ID NO: 476266 - DNA, 25 bp, Mus musculus
tctcagggtgagcttctaaccataa

SEQ ID NO: 476267 - DNA, 25 bp, Mus musculus
tctcagggtgtctaagctgctgggt

SEQ ID NO: 476268 - DNA, 25 bp, Mus musculus
tctcaggtcctaaacagcatgtggc

SEQ ID NO: 476269 - DNA, 25 bp, Mus musculus
tctcaggtctcttttcccgagccag

SEQ ID NO: 476270 - DNA, 25 bp, Mus musculus
tctcaggtgctgtaaaggcctgctg

SEQ ID NO: 476271 - DNA, 25 bp, Mus musculus
tctcaggttgttgagtccagaggag

SEQ ID NO: 476272 - DNA, 25 bp, Mus musculus
tctcagtaatctggatgcagcagtg

SEQ ID NO: 476273 - DNA, 25 bp, Mus musculus
tctcagtactattctcagggaccca

SEQ ID NO: 476274 - DNA, 25 bp, Mus musculus
tctcagtaggaggtgaatgggtcct

SEQ ID NO: 476275 - DNA, 25 bp, Mus musculus
tctcagtattttaggagtccccagg

SEQ ID NO: 476276 - DNA, 25 bp, Mus musculus
tctcagtccatcctcggtttccatg

SEQ ID NO: 476277 - DNA, 25 bp, Mus musculus
tctcagtctgagagtggcacttggt

SEQ ID NO: 476278 - DNA, 25 bp, Mus musculus
tctcagtctggtacgggtaaaacag

SEQ ID NO: 476279 - DNA, 25 bp, Mus musculus
tctcagtgccatttcagaggggaca

SEQ ID NO: 476280 - DNA, 25 bp, Mus musculus
tctcagtgcctaaagcgtagatcag

SEQ ID NO: 476281 - DNA, 25 bp, Mus musculus
tctcagtgcgagagcagatgcttcc

SEQ ID NO: 476282 - DNA, 25 bp, Mus musculus
tctcagtgctcagccgggagcagtc

SEQ ID NO: 476283 - DNA, 25 bp, Mus musculus
tctcagtggcacctttcggacaaaa

SEQ ID NO: 476284 - DNA, 25 bp, Mus musculus
tctcagtgggtgtggaaataggacc

SEQ ID NO: 476285 - DNA, 25 bp, Mus musculus
tctcagttggcgtgttgactgtgca

SEQ ID NO: 476286 - DNA, 25 bp, Mus musculus
tctcagttgtagttcccggtcagcg

SEQ ID NO: 476287 - DNA, 25 bp, Mus musculus
tctcagtttcgggatcaaaggagga

SEQ ID NO: 476288 - DNA, 25 bp, Mus musculus
tctcatagctgtaacttacatgcag

SEQ ID NO: 476289 - DNA, 25 bp, Mus musculus
tctcataggatggttggaatgtaaa

SEQ ID NO: 476290 - DNA, 25 bp, Mus musculus
tctcatcaggccacaaaaaggaagc

SEQ ID NO: 476291 - DNA, 25 bp, Mus musculus
tctcatcaggtggagcacggtccaa

SEQ ID NO: 476292 - DNA, 25 bp, Mus musculus
tctcatccccggtgaagaagacaga

SEQ ID NO: 476293 - DNA, 25 bp, Mus musculus
tctcatcgggaggacctggcttact

SEQ ID NO: 476294 - DNA, 25 bp, Mus musculus
tctcatcgggtggtatgctgacaac

SEQ ID NO: 476295 - DNA, 25 bp, Mus musculus
tctcatcgtcagtgatccttcagga

SEQ ID NO: 476296 - DNA, 25 bp, Mus musculus
tctcatctaggtagtcgcagcgact

SEQ ID NO: 476297 - DNA, 25 bp, Mus musculus
tctcatctccaggtcgacaaagggt

SEQ ID NO: 476298 - DNA, 25 bp, Mus musculus
tctcatctggaaaagagggtccacg

SEQ ID NO: 476299 - DNA, 25 bp, Mus musculus
tctcatcttgaatttgccggcacga

SEQ ID NO: 476300 - DNA, 25 bp, Mus musculus
tctcatgaagtatggcaggccttaa

SEQ ID NO: 476301 - DNA, 25 bp, Mus musculus
tctcatgagagctcgggaaaccctc

SEQ ID NO: 476302 - DNA, 25 bp, Mus musculus
tctcatgaggaatgctggtccccag

SEQ ID NO: 476303 - DNA, 25 bp, Mus musculus
tctcatgagggagcagagcgagtcc

SEQ ID NO: 476304 - DNA, 25 bp, Mus musculus
tctcatgatggtgctctgcgcctct

SEQ ID NO: 476305 - DNA, 25 bp, Mus musculus
tctcatgccagcactggactcctgg

SEQ ID NO: 476306 - DNA, 25 bp, Mus musculus
tctcatgctgagtcccggctgcttt

SEQ ID NO: 476307 - DNA, 25 bp, Mus musculus
tctcatggacatccggagggactgc

SEQ ID NO: 476308 - DNA, 25 bp, Mus musculus
tctcatggagctatagtggacggtc

SEQ ID NO: 476309 - DNA, 25 bp, Mus musculus
tctcatggagctgggcggtttccag

SEQ ID NO: 476310 - DNA, 25 bp, Mus musculus
tctcatggcccctgggttaaaggtg

SEQ ID NO: 476311 - DNA, 25 bp, Mus musculus
tctcatgtgagaaaggcaggaaggc

SEQ ID NO: 476312 - DNA, 25 bp, Mus musculus
tctcatgtgggcgtgctacaaaggc

SEQ ID NO: 476313 - DNA, 25 bp, Mus musculus
tctcatgtgtctgaggatatgaaac

SEQ ID NO: 476314 - DNA, 25 bp, Mus musculus
tctcatgttaagcagggctccagca

SEQ ID NO: 476315 - DNA, 25 bp, Mus musculus
tctcattatgcctaacttgctgcca

SEQ ID NO: 476316 - DNA, 25 bp, Mus musculus
tctcattctgagaccatcctcaaac

SEQ ID NO: 476317 - DNA, 25 bp, Mus musculus
tctcattgaagaggtggcccaggag

SEQ ID NO: 476318 - DNA, 25 bp, Mus musculus
tctcattgatattggctccggcccc

SEQ ID NO: 476319 - DNA, 25 bp, Mus musculus
tctcattgctgtggctgactcagac

SEQ ID NO: 476320 - DNA, 25 bp, Mus musculus
tctcattggaagctgaagaactact

SEQ ID NO: 476321 - DNA, 25 bp, Mus musculus
tctcattgggcgcacacagtagtcg

SEQ ID NO: 476322 - DNA, 25 bp, Mus musculus
tctcattgtatctggtgggtcaaga

SEQ ID NO: 476323 - DNA, 25 bp, Mus musculus
tctcattgtgcagaatatcgtcggg

SEQ ID NO: 476324 - DNA, 25 bp, Mus musculus
tctcatttggaaaagcttggctggt

SEQ ID NO: 476325 - DNA, 25 bp, Mus musculus
tctccaaacgcttggaggaagaaag

SEQ ID NO: 476326 - DNA, 25 bp, Mus musculus
tctccaaagcgactgaacaatgcag

SEQ ID NO: 476327 - DNA, 25 bp, Mus musculus
tctccaacacacaagacccaagagg

SEQ ID NO: 476328 - DNA, 25 bp, Mus musculus
tctccaacaccaaaagtgagtattc

SEQ ID NO: 476329 - DNA, 25 bp, Mus musculus
tctccaacatgaaggcgctgagccc

SEQ ID NO: 476330 - DNA, 25 bp, Mus musculus
tctccaaccagttctatagaggaaa

SEQ ID NO: 476331 - DNA, 25 bp, Mus musculus
tctccaagaaaaaatcggtgtgcct

SEQ ID NO: 476332 - DNA, 25 bp, Mus musculus
tctccaagaagaggatatgacagta

SEQ ID NO: 476333 - DNA, 25 bp, Mus musculus
tctccaagatcctgggtggccgagg

SEQ ID NO: 476334 - DNA, 25 bp, Mus musculus
tctccaagcgtgagctaagctggct

SEQ ID NO: 476335 - DNA, 25 bp, Mus musculus
tctccaaggagtaaatgaaggtggg

SEQ ID NO: 476336 - DNA, 25 bp, Mus musculus
tctccaaggctaaccagaaggccag

SEQ ID NO: 476337 - DNA, 25 bp, Mus musculus
tctccaaggtggacaggactgtcga

SEQ ID NO: 476338 - DNA, 25 bp, Mus musculus
tctccaagttgctttagttccaaga

SEQ ID NO: 476339 - DNA, 25 bp, Mus musculus
tctccaatctcacagacagggaagt

SEQ ID NO: 476340 - DNA, 25 bp, Mus musculus
tctccaatgaagatagagcccgtct

SEQ ID NO: 476341 - DNA, 25 bp, Mus musculus
tctccaatggaaaggaccaacttgt

SEQ ID NO: 476342 - DNA, 25 bp, Mus musculus
tctccacaatgaggtgaaccgggtg

SEQ ID NO: 476343 - DNA, 25 bp, Mus musculus
tctccacagggtgacgcaatgggtc

SEQ ID NO: 476344 - DNA, 25 bp, Mus musculus
tctccaccacctatatacagatcag

SEQ ID NO: 476345 - DNA, 25 bp, Mus musculus
tctccaccaggtatttgatttcacc

SEQ ID NO: 476346 - DNA, 25 bp, Mus musculus
tctccacctcctgactgttgatgga

SEQ ID NO: 476347 - DNA, 25 bp, Mus musculus
tctccaccttttcaacctgtttggg

SEQ ID NO: 476348 - DNA, 25 bp, Mus musculus
tctccacgggtcacgatgaactctg

SEQ ID NO: 476349 - DNA, 25 bp, Mus musculus
tctccacgtgaggaagactgcctgt

SEQ ID NO: 476350 - DNA, 25 bp, Mus musculus
tctccactggtactgctgctagcga

SEQ ID NO: 476351 - DNA, 25 bp, Mus musculus
tctccagaacctggaaatacaggaa

SEQ ID NO: 476352 - DNA, 25 bp, Mus musculus
tctccagaagccactggaaacacag

SEQ ID NO: 476353 - DNA, 25 bp, Mus musculus
tctccagacagctgctgattcgaga

SEQ ID NO: 476354 - DNA, 25 bp, Mus musculus
tctccagactgcgaggatcacggct

SEQ ID NO: 476355 - DNA, 25 bp, Mus musculus
tctccagagacctgtagggacccaa

SEQ ID NO: 476356 - DNA, 25 bp, Mus musculus
tctccagagagcgttaatcaatagc

SEQ ID NO: 476357 - DNA, 25 bp, Mus musculus
tctccagagatttggccacttgctt

SEQ ID NO: 476358 - DNA, 25 bp, Mus musculus
tctccagagccctttgcatcgcttg

SEQ ID NO: 476359 - DNA, 25 bp, Mus musculus
tctccagagtgaaggagtattcaca

SEQ ID NO: 476360 - DNA, 25 bp, Mus musculus
tctccagatgtgtaaggcccatggc

SEQ ID NO: 476361 - DNA, 25 bp, Mus musculus
tctccagatgtgtgcgtacaggctg

SEQ ID NO: 476362 - DNA, 25 bp, Mus musculus
tctccagcattatcgaggtgcctcg

SEQ ID NO: 476363 - DNA, 25 bp, Mus musculus
tctccagccagaggaacgactacag

SEQ ID NO: 476364 - DNA, 25 bp, Mus musculus
tctccagccatggtgagcagtctga

SEQ ID NO: 476365 - DNA, 25 bp, Mus musculus
tctccagccccttcgatttgataaa

SEQ ID NO: 476366 - DNA, 25 bp, Mus musculus
tctccagcccttaaaagtactattt

SEQ ID NO: 476367 - DNA, 25 bp, Mus musculus
tctccagcctcctttgtgaataagt

SEQ ID NO: 476368 - DNA, 25 bp, Mus musculus
tctccagcgtttgcaaaacgggctt

SEQ ID NO: 476369 - DNA, 25 bp, Mus musculus
tctccagctctgttgctaagcaagg

SEQ ID NO: 476370 - DNA, 25 bp, Mus musculus
tctccaggaagaaccagctgctgct

SEQ ID NO: 476371 - DNA, 25 bp, Mus musculus
tctccaggaagaagccgtgtggaca

SEQ ID NO: 476372 - DNA, 25 bp, Mus musculus
tctccaggacccagcattatgtgaa

SEQ ID NO: 476373 - DNA, 25 bp, Mus musculus
tctccaggactcacagtatgacccg

SEQ ID NO: 476374 - DNA, 25 bp, Mus musculus
tctccaggagccacttgcgattggg

SEQ ID NO: 476375 - DNA, 25 bp, Mus musculus
tctccaggagccatcgaatgtttct

SEQ ID NO: 476376 - DNA, 25 bp, Mus musculus
tctccaggataaggatgccgtcgtc

SEQ ID NO: 476377 - DNA, 25 bp, Mus musculus
tctccaggatgaagcagcctctgta

SEQ ID NO: 476378 - DNA, 25 bp, Mus musculus
tctccaggcattcgaagggtctaca

SEQ ID NO: 476379 - DNA, 25 bp, Mus musculus
tctccaggcgggagggtgataccca

SEQ ID NO: 476380 - DNA, 25 bp, Mus musculus
tctccagggaaaagaaagcagccaa

SEQ ID NO: 476381 - DNA, 25 bp, Mus musculus
tctccagggacacggattggaccac

SEQ ID NO: 476382 - DNA, 25 bp, Mus musculus
tctccagggctacaaatctgcctct

SEQ ID NO: 476383 - DNA, 25 bp, Mus musculus
tctccagggtaaaacaggcgaggcc

SEQ ID NO: 476384 - DNA, 25 bp, Mus musculus
tctccagggtcatgttcccaggcaa

SEQ ID NO: 476385 - DNA, 25 bp, Mus musculus
tctccagtacacacttaggctcctt

SEQ ID NO: 476386 - DNA, 25 bp, Mus musculus
tctccagtcacagaaggctgaaagg

SEQ ID NO: 476387 - DNA, 25 bp, Mus musculus
tctccagtcctggttaagaacaaaa

SEQ ID NO: 476388 - DNA, 25 bp, Mus musculus
tctccagtctccgagtggtgggtgt

SEQ ID NO: 476389 - DNA, 25 bp, Mus musculus
tctccagtgggcaaaagaacctgtg

SEQ ID NO: 476390 - DNA, 25 bp, Mus musculus
tctccagtgggcacctgaagtgggt

SEQ ID NO: 476391 - DNA, 25 bp, Mus musculus
tctccagttgcggaagacagctgtt

SEQ ID NO: 476392 - DNA, 25 bp, Mus musculus
tctccatagacagagggcatcgtgg

SEQ ID NO: 476393 - DNA, 25 bp, Mus musculus
tctccatatggaaaggccggtcaaa

SEQ ID NO: 476394 - DNA, 25 bp, Mus musculus
tctccatccccacagggctagtggt

SEQ ID NO: 476395 - DNA, 25 bp, Mus musculus
tctccatcgacaaggtggtatcggt

SEQ ID NO: 476396 - DNA, 25 bp, Mus musculus
tctccatgactagtggcgactacag

SEQ ID NO: 476397 - DNA, 25 bp, Mus musculus
tctccatgagggacggaaaactcac

SEQ ID NO: 476398 - DNA, 25 bp, Mus musculus
tctccatggatccagggcaggcgac

SEQ ID NO: 476399 - DNA, 25 bp, Mus musculus
tctccatggctgagaccagcatgat

SEQ ID NO: 476400 - DNA, 25 bp, Mus musculus
tctccatgggagaggcggtacccta

SEQ ID NO: 476401 - DNA, 25 bp, Mus musculus
tctccatggtaccttttgaggaagg

SEQ ID NO: 476402 - DNA, 25 bp, Mus musculus
tctccatgtaaattgtggaacactg

SEQ ID NO: 476403 - DNA, 25 bp, Mus musculus
tctccattaacagtgccagcggcag

SEQ ID NO: 476404 - DNA, 25 bp, Mus musculus
tctccattaatataaaaggcaaata

SEQ ID NO: 476405 - DNA, 25 bp, Mus musculus
tctccattgacttacagaagggcca

SEQ ID NO: 476406 - DNA, 25 bp, Mus musculus
tctccattgatgaagtaaccagtga

SEQ ID NO: 476407 - DNA, 25 bp, Mus musculus
tctccattggacacgggtgatgtcg

SEQ ID NO: 476408 - DNA, 25 bp, Mus musculus
tctccatttaaaccgaaactctaca

SEQ ID NO: 476409 - DNA, 25 bp, Mus musculus
tctccatttcgcattagaatcaaga

SEQ ID NO: 476410 - DNA, 25 bp, Mus musculus
tctccatttggacgctaataaaata

SEQ ID NO: 476411 - DNA, 25 bp, Mus musculus
tctcccaagagacagactagctgaa

SEQ ID NO: 476412 - DNA, 25 bp, Mus musculus
tctcccaagagtagcaagaccaagg

SEQ ID NO: 476413 - DNA, 25 bp, Mus musculus
tctcccaagtactgatatgataagc

SEQ ID NO: 476414 - DNA, 25 bp, Mus musculus
tctcccaatgggtatgcgcatcgtc

SEQ ID NO: 476415 - DNA, 25 bp, Mus musculus
tctcccaccggtgcacagttattgg

SEQ ID NO: 476416 - DNA, 25 bp, Mus musculus
tctcccactatggtctttcatttgg

SEQ ID NO: 476417 - DNA, 25 bp, Mus musculus
tctcccagcgcttcttgaggtcttt

SEQ ID NO: 476418 - DNA, 25 bp, Mus musculus
tctcccagggaaggatgactgagta

SEQ ID NO: 476419 - DNA, 25 bp, Mus musculus
tctcccagggaagtcgagccaatgt

SEQ ID NO: 476420 - DNA, 25 bp, Mus musculus
tctcccagggagtcataacaaagta

SEQ ID NO: 476421 - DNA, 25 bp, Mus musculus
tctcccagtttggagaggcccgggc

SEQ ID NO: 476422 - DNA, 25 bp, Mus musculus
tctcccatgaagaaagtgagttggc

SEQ ID NO: 476423 - DNA, 25 bp, Mus musculus
tctccccaaatattctcagacgtag

SEQ ID NO: 476424 - DNA, 25 bp, Mus musculus
tctccccaaatggataacaaactgg

SEQ ID NO: 476425 - DNA, 25 bp, Mus musculus
tctccccaagagaagataaatattg

SEQ ID NO: 476426 - DNA, 25 bp, Mus musculus
tctccccaagctgtgggatgcgaga

SEQ ID NO: 476427 - DNA, 25 bp, Mus musculus
tctccccagggatttgtacagcagc

SEQ ID NO: 476428 - DNA, 25 bp, Mus musculus
tctccccagtcgaaagaacagcagg

SEQ ID NO: 476429 - DNA, 25 bp, Mus musculus
tctccccgagccagacttatgaagg

SEQ ID NO: 476430 - DNA, 25 bp, Mus musculus
tctccccggtgcatttagcagggca

SEQ ID NO: 476431 - DNA, 25 bp, Mus musculus
tctcccctgactttgacggcatttg

SEQ ID NO: 476432 - DNA, 25 bp, Mus musculus
tctcccctgaggagggcggcatgct

SEQ ID NO: 476433 - DNA, 25 bp, Mus musculus
tctcccctttgaagagtgaccagga

SEQ ID NO: 476434 - DNA, 25 bp, Mus musculus
tctcccgagagatgcttcctccgag

SEQ ID NO: 476435 - DNA, 25 bp, Mus musculus
tctcccgaggtcaagggacagcgga

SEQ ID NO: 476436 - DNA, 25 bp, Mus musculus
tctcccgcattgaaacagtctgttt

SEQ ID NO: 476437 - DNA, 25 bp, Mus musculus
tctcccgcggaggatgaacagtttg

SEQ ID NO: 476438 - DNA, 25 bp, Mus musculus
tctcccgctgcatgaaggacatcgt

SEQ ID NO: 476439 - DNA, 25 bp, Mus musculus
tctcccgggatggtggcttgcttta

SEQ ID NO: 476440 - DNA, 25 bp, Mus musculus
tctcccggtgtgataagcagtgtct

SEQ ID NO: 476441 - DNA, 25 bp, Mus musculus
tctcccggttttaatggcggatcca

SEQ ID NO: 476442 - DNA, 25 bp, Mus musculus
tctcccgtgattccttgggtgcaca

SEQ ID NO: 476443 - DNA, 25 bp, Mus musculus
tctcccgttgtgtctgaagtgtccg

SEQ ID NO: 476444 - DNA, 25 bp, Mus musculus
tctccctaaggaagaaatgtgaccc

SEQ ID NO: 476445 - DNA, 25 bp, Mus musculus
tctccctaccgttgggcccaggaat

SEQ ID NO: 476446 - DNA, 25 bp, Mus musculus
tctccctcagtaaagccaaacatag

SEQ ID NO: 476447 - DNA, 25 bp, Mus musculus
tctccctccatgaagaactggaaac

SEQ ID NO: 476448 - DNA, 25 bp, Mus musculus
tctccctgagattcgggcacactga

SEQ ID NO: 476449 - DNA, 25 bp, Mus musculus
tctccctgcaggtgaaccagaacag

SEQ ID NO: 476450 - DNA, 25 bp, Mus musculus
tctccctggacctctgtgtttagcg

SEQ ID NO: 476451 - DNA, 25 bp, Mus musculus
tctccctggagcttgttgctgttct

SEQ ID NO: 476452 - DNA, 25 bp, Mus musculus
tctccctgggagtcaaatgttttgg

SEQ ID NO: 476453 - DNA, 25 bp, Mus musculus
tctccctggtttcaacagagttcag

SEQ ID NO: 476454 - DNA, 25 bp, Mus musculus
tctccctgtagcttgagcagctggg

SEQ ID NO: 476455 - DNA, 25 bp, Mus musculus
tctcccttctggaggagcgattccg

SEQ ID NO: 476456 - DNA, 25 bp, Mus musculus
tctcccttggaggtggaacagtttc

SEQ ID NO: 476457 - DNA, 25 bp, Mus musculus
tctccgaaacgatgtagtgccaacc

SEQ ID NO: 476458 - DNA, 25 bp, Mus musculus
tctccgaaagacagaatgccattgc

SEQ ID NO: 476459 - DNA, 25 bp, Mus musculus
tctccgaagagaataaagaggcggt

SEQ ID NO: 476460 - DNA, 25 bp, Mus musculus
tctccgaagcgagggtgtcagctct

SEQ ID NO: 476461 - DNA, 25 bp, Mus musculus
tctccgaaggaaaaagctgagggca

SEQ ID NO: 476462 - DNA, 25 bp, Mus musculus
tctccgacaagaaaggctgatgggc

SEQ ID NO: 476463 - DNA, 25 bp, Mus musculus
tctccgacgccatcctggagtgtaa

SEQ ID NO: 476464 - DNA, 25 bp, Mus musculus
tctccgagaaactagggctgacaag

SEQ ID NO: 476465 - DNA, 25 bp, Mus musculus
tctccgagagaacggcatagtgcac

SEQ ID NO: 476466 - DNA, 25 bp, Mus musculus
tctccgaggatgcagagtggtcact

SEQ ID NO: 476467 - DNA, 25 bp, Mus musculus
tctccgagtactggttctgagggca

SEQ ID NO: 476468 - DNA, 25 bp, Mus musculus
tctccgccaggaacatcagaaggtt

SEQ ID NO: 476469 - DNA, 25 bp, Mus musculus
tctccgcgaggactggaatggctac

SEQ ID NO: 476470 - DNA, 25 bp, Mus musculus
tctccgcgctttggaacgagcatgc

SEQ ID NO: 476471 - DNA, 25 bp, Mus musculus
tctccgcggcccgagtgctggtaga

SEQ ID NO: 476472 - DNA, 25 bp, Mus musculus
tctccgcgtcgctgtgtaaggctgc

SEQ ID NO: 476473 - DNA, 25 bp, Mus musculus
tctccgctatgggaattgtcagcct

SEQ ID NO: 476474 - DNA, 25 bp, Mus musculus
tctccgcttgggatcctggaacgta

SEQ ID NO: 476475 - DNA, 25 bp, Mus musculus
tctccggaactcaggacagagacta

SEQ ID NO: 476476 - DNA, 25 bp, Mus musculus
tctccggaactgatgcgctgcaaac

SEQ ID NO: 476477 - DNA, 25 bp, Mus musculus
tctccggacacttttttcctgaggg

SEQ ID NO: 476478 - DNA, 25 bp, Mus musculus
tctccggagacgatctgaaacacgc

SEQ ID NO: 476479 - DNA, 25 bp, Mus musculus
tctccggagagaaactggtgcacgc

SEQ ID NO: 476480 - DNA, 25 bp, Mus musculus
tctccggagcaggaacagaaagcta

SEQ ID NO: 476481 - DNA, 25 bp, Mus musculus
tctccggaggaactcaaagtcaagg

SEQ ID NO: 476482 - DNA, 25 bp, Mus musculus
tctccggaggcaaaagaggctgtcc

SEQ ID NO: 476483 - DNA, 25 bp, Mus musculus
tctccggatctctcccttcttcagg

SEQ ID NO: 476484 - DNA, 25 bp, Mus musculus
tctccggcaagctccaaaagtctgt

SEQ ID NO: 476485 - DNA, 25 bp, Mus musculus
tctccggcagtgagtacaagaagtg

SEQ ID NO: 476486 - DNA, 25 bp, Mus musculus
tctccggcccggtgtaattgaggaa

SEQ ID NO: 476487 - DNA, 25 bp, Mus musculus
tctccggcctggatcaatgcgacgg

SEQ ID NO: 476488 - DNA, 25 bp, Mus musculus
tctccggcgctaacagaaagcctgt

SEQ ID NO: 476489 - DNA, 25 bp, Mus musculus
tctccgggactagctgcaaaactta

SEQ ID NO: 476490 - DNA, 25 bp, Mus musculus
tctccgggctatgagggcaagacct

SEQ ID NO: 476491 - DNA, 25 bp, Mus musculus
tctccgggctcgagggaactaacgg

SEQ ID NO: 476492 - DNA, 25 bp, Mus musculus
tctccgggcttatggaattcctgaa

SEQ ID NO: 476493 - DNA, 25 bp, Mus musculus
tctccgggtcgtaggttccggacag

SEQ ID NO: 476494 - DNA, 25 bp, Mus musculus
tctccggttccgacagatttgataa

SEQ ID NO: 476495 - DNA, 25 bp, Mus musculus
tctccgtaaacagggtgagtatgga

SEQ ID NO: 476496 - DNA, 25 bp, Mus musculus
tctccgtgcccagaagacatgtcag

SEQ ID NO: 476497 - DNA, 25 bp, Mus musculus
tctccgtgctgaagatgccttgttt

SEQ ID NO: 476498 - DNA, 25 bp, Mus musculus
tctccgtggagctaaacaagttcta

SEQ ID NO: 476499 - DNA, 25 bp, Mus musculus
tctccgtgggtaaactgtgccgcct

SEQ ID NO: 476500 - DNA, 25 bp, Mus musculus
tctccgttacgtcaaggcagtcaga

SEQ ID NO: 476501 - DNA, 25 bp, Mus musculus
tctcctaagaaaagtccgctgtggg

SEQ ID NO: 476502 - DNA, 25 bp, Mus musculus
tctcctaaggagtacactgacctag

SEQ ID NO: 476503 - DNA, 25 bp, Mus musculus
tctcctacacctggcttcttctggg

SEQ ID NO: 476504 - DNA, 25 bp, Mus musculus
tctcctaccaatagttgggtgagtg

SEQ ID NO: 476505 - DNA, 25 bp, Mus musculus
tctcctagcacttggaaagtcctgg

SEQ ID NO: 476506 - DNA, 25 bp, Mus musculus
tctcctagcctgcaaatggcaatgg

SEQ ID NO: 476507 - DNA, 25 bp, Mus musculus
tctcctagtggttagtgtgtcctct

SEQ ID NO: 476508 - DNA, 25 bp, Mus musculus
tctcctatgaactaccaacagtaag

SEQ ID NO: 476509 - DNA, 25 bp, Mus musculus
tctcctatgaggaaagagcctgtga

SEQ ID NO: 476510 - DNA, 25 bp, Mus musculus
tctcctatggcgagggtaaggccct

SEQ ID NO: 476511 - DNA, 25 bp, Mus musculus
tctcctcaagaagagtgcggacaca

SEQ ID NO: 476512 - DNA, 25 bp, Mus musculus
tctcctcaagtagtaagacgggtgg

SEQ ID NO: 476513 - DNA, 25 bp, Mus musculus
tctcctcagaagatccggattaaag

SEQ ID NO: 476514 - DNA, 25 bp, Mus musculus
tctcctcagagaaaaagtgtcccga

SEQ ID NO: 476515 - DNA, 25 bp, Mus musculus
tctcctcagaggtgctaatcccaat

SEQ ID NO: 476516 - DNA, 25 bp, Mus musculus
tctcctcataagaacatgtccagct

SEQ ID NO: 476517 - DNA, 25 bp, Mus musculus
tctcctcccgagagctcattataca

SEQ ID NO: 476518 - DNA, 25 bp, Mus musculus
tctcctcgagatccatagagcagag

SEQ ID NO: 476519 - DNA, 25 bp, Mus musculus
tctcctcgcctgatctctggtgttg

SEQ ID NO: 476520 - DNA, 25 bp, Mus musculus
tctcctcggacctggggtctgctgc

SEQ ID NO: 476521 - DNA, 25 bp, Mus musculus
tctcctcgtggtgtggtctcgtacc

SEQ ID NO: 476522 - DNA, 25 bp, Mus musculus
tctcctctgaatgacaagctccttg

SEQ ID NO: 476523 - DNA, 25 bp, Mus musculus
tctcctctgatttttaagaagtgag

SEQ ID NO: 476524 - DNA, 25 bp, Mus musculus
tctcctcttaggaactctgctgagg

SEQ ID NO: 476525 - DNA, 25 bp, Mus musculus
tctcctgaaatgttgaggcccctgg

SEQ ID NO: 476526 - DNA, 25 bp, Mus musculus
tctcctgaacctctgcctgtcatgg

SEQ ID NO: 476527 - DNA, 25 bp, Mus musculus
tctcctgaagaaaggtagccatgga

SEQ ID NO: 476528 - DNA, 25 bp, Mus musculus
tctcctgacaggagcaagggcttgg

SEQ ID NO: 476529 - DNA, 25 bp, Mus musculus
tctcctgacgcagagtggacgaacg

SEQ ID NO: 476530 - DNA, 25 bp, Mus musculus
tctcctgacttgaggcaccagggct

SEQ ID NO: 476531 - DNA, 25 bp, Mus musculus
tctcctgactttaccaggaagctca

SEQ ID NO: 476532 - DNA, 25 bp, Mus musculus
tctcctgagacctggtgggcaggcc

SEQ ID NO: 476533 - DNA, 25 bp, Mus musculus
tctcctgaggaaaaacatgaacatc

SEQ ID NO: 476534 - DNA, 25 bp, Mus musculus
tctcctgagtaaatccacattcttg

SEQ ID NO: 476535 - DNA, 25 bp, Mus musculus
tctcctgatggatgccgtctcgtga

SEQ ID NO: 476536 - DNA, 25 bp, Mus musculus
tctcctgattttgggctgaagccag

SEQ ID NO: 476537 - DNA, 25 bp, Mus musculus
tctcctgcaagagaggaacctggga

SEQ ID NO: 476538 - DNA, 25 bp, Mus musculus
tctcctgcatggttgagggacttca

SEQ ID NO: 476539 - DNA, 25 bp, Mus musculus
tctcctgccgcagagcagaggagcg

SEQ ID NO: 476540 - DNA, 25 bp, Mus musculus
tctcctgcgttcatgactagctgag

SEQ ID NO: 476541 - DNA, 25 bp, Mus musculus
tctcctggaaagctgtggttgtgcc

SEQ ID NO: 476542 - DNA, 25 bp, Mus musculus
tctcctggagctcaaagccttgaag

SEQ ID NO: 476543 - DNA, 25 bp, Mus musculus
tctcctggagtactgtgggaaccgc

SEQ ID NO: 476544 - DNA, 25 bp, Mus musculus
tctcctggctttgggatcattgtca

SEQ ID NO: 476545 - DNA, 25 bp, Mus musculus
tctcctgggcccttggacagtaaag

SEQ ID NO: 476546 - DNA, 25 bp, Mus musculus
tctcctgggcgtggaagggagtggc

SEQ ID NO: 476547 - DNA, 25 bp, Mus musculus
tctcctgggtgcctgatgaagcagc

SEQ ID NO: 476548 - DNA, 25 bp, Mus musculus
tctcctgggtggactaccagggaca

SEQ ID NO: 476549 - DNA, 25 bp, Mus musculus
tctcctggtaactgctagaagccgc

SEQ ID NO: 476550 - DNA, 25 bp, Mus musculus
tctcctggtgtttgcaggaatgggc

SEQ ID NO: 476551 - DNA, 25 bp, Mus musculus
tctcctgtatgggaggaagcgtcac

SEQ ID NO: 476552 - DNA, 25 bp, Mus musculus
tctcctgtgcaagcaaagtcccggg

SEQ ID NO: 476553 - DNA, 25 bp, Mus musculus
tctcctgtggtataaaaccagggca

SEQ ID NO: 476554 - DNA, 25 bp, Mus musculus
tctcctgtgtccagttagctccatg

SEQ ID NO: 476555 - DNA, 25 bp, Mus musculus
tctccttatgagattgaagttccag

SEQ ID NO: 476556 - DNA, 25 bp, Mus musculus
tctccttcatgtggaaatgcccagg

SEQ ID NO: 476557 - DNA, 25 bp, Mus musculus
tctccttctgtgattccaaataaaa

SEQ ID NO: 476558 - DNA, 25 bp, Mus musculus
tctccttgaagggatattaggaccc

SEQ ID NO: 476559 - DNA, 25 bp, Mus musculus
tctccttgaattcagcccactttga

SEQ ID NO: 476560 - DNA, 25 bp, Mus musculus
tctccttgcaccacctaaaaagttg

SEQ ID NO: 476561 - DNA, 25 bp, Mus musculus
tctccttgcaggaaacgttttggca

SEQ ID NO: 476562 - DNA, 25 bp, Mus musculus
tctcctttaaggacaggctctgatg

SEQ ID NO: 476563 - DNA, 25 bp, Mus musculus
tctcctttaatcttactgtgtgtcg

SEQ ID NO: 476564 - DNA, 25 bp, Mus musculus
tctcctttacgtggcggcatgacag

SEQ ID NO: 476565 - DNA, 25 bp, Mus musculus
tctcctttagagtcagactgctctc

SEQ ID NO: 476566 - DNA, 25 bp, Mus musculus
tctcctttcacaaatggcacctggg

SEQ ID NO: 476567 - DNA, 25 bp, Mus musculus
tctcctttcctcctgtggcattgct

SEQ ID NO: 476568 - DNA, 25 bp, Mus musculus
tctcctttgacatggccgacggtgt

SEQ ID NO: 476569 - DNA, 25 bp, Mus musculus
tctcctttgggtgacttaaatctct

SEQ ID NO: 476570 - DNA, 25 bp, Mus musculus
tctcgaaagtcccaaagtgtcgcgc

SEQ ID NO: 476571 - DNA, 25 bp, Mus musculus
tctcgaacgtgccagtgagtaagat

SEQ ID NO: 476572 - DNA, 25 bp, Mus musculus
tctcgaagaaagtacagatgggctc

SEQ ID NO: 476573 - DNA, 25 bp, Mus musculus
tctcgaagaacagtcccaaagttag

SEQ ID NO: 476574 - DNA, 25 bp, Mus musculus
tctcgaagagcccacagtagcgaag

SEQ ID NO: 476575 - DNA, 25 bp, Mus musculus
tctcgaagagtcgaagacgagcggc

SEQ ID NO: 476576 - DNA, 25 bp, Mus musculus
tctcgaaggaaaacaaccacgtgat

SEQ ID NO: 476577 - DNA, 25 bp, Mus musculus
tctcgaagggtcaatcgcagagcca

SEQ ID NO: 476578 - DNA, 25 bp, Mus musculus
tctcgaatagcgaacacggagcaca

SEQ ID NO: 476579 - DNA, 25 bp, Mus musculus
tctcgacaggacgtagacacatcgg

SEQ ID NO: 476580 - DNA, 25 bp, Mus musculus
tctcgacgatgagcgtgagtaccgc

SEQ ID NO: 476581 - DNA, 25 bp, Mus musculus
tctcgactgcagacattgccatgcc

SEQ ID NO: 476582 - DNA, 25 bp, Mus musculus
tctcgacttggaagaaacacgtaca

SEQ ID NO: 476583 - DNA, 25 bp, Mus musculus
tctcgagaaactggaactgacttgg

SEQ ID NO: 476584 - DNA, 25 bp, Mus musculus
tctcgagaagccgatgaacagttgg

SEQ ID NO: 476585 - DNA, 25 bp, Mus musculus
tctcgagaatgagctgaagcgccgc

SEQ ID NO: 476586 - DNA, 25 bp, Mus musculus
tctcgagctcaaatatgggacatgc

SEQ ID NO: 476587 - DNA, 25 bp, Mus musculus
tctcgaggagaatacagttgggccg

SEQ ID NO: 476588 - DNA, 25 bp, Mus musculus
tctcgaggctgaggcagtacctgct

SEQ ID NO: 476589 - DNA, 25 bp, Mus musculus
tctcgaggtcccttctgactacgga

SEQ ID NO: 476590 - DNA, 25 bp, Mus musculus
tctcgatgagaaggtggcactggca

SEQ ID NO: 476591 - DNA, 25 bp, Mus musculus
tctcgattctgcttcctcctgaggg

SEQ ID NO: 476592 - DNA, 25 bp, Mus musculus
tctcgatttaggtacaggtggctgt

SEQ ID NO: 476593 - DNA, 25 bp, Mus musculus
tctcgcactgaggagatctcggacg

SEQ ID NO: 476594 - DNA, 25 bp, Mus musculus
tctcgcagagaactctcagggctgc

SEQ ID NO: 476595 - DNA, 25 bp, Mus musculus
tctcgcagaggtgaagaatctctct

SEQ ID NO: 476596 - DNA, 25 bp, Mus musculus
tctcgcagcttattctccatagaag

SEQ ID NO: 476597 - DNA, 25 bp, Mus musculus
tctcgccaggagttgacagctcttc

SEQ ID NO: 476598 - DNA, 25 bp, Mus musculus
tctcgccccgtgtttgactggaagg

SEQ ID NO: 476599 - DNA, 25 bp, Mus musculus
tctcgccgggacttctgctaaacca

SEQ ID NO: 476600 - DNA, 25 bp, Mus musculus
tctcgcctgcttaacgtggtggaaa

SEQ ID NO: 476601 - DNA, 25 bp, Mus musculus
tctcgcgatcgttccttcagactct

SEQ ID NO: 476602 - DNA, 25 bp, Mus musculus
tctcgcgcctgttcggcaagaagca

SEQ ID NO: 476603 - DNA, 25 bp, Mus musculus
tctcgctattacaagggtgacacca

SEQ ID NO: 476604 - DNA, 25 bp, Mus musculus
tctcgctattcaggttagtctataa

SEQ ID NO: 476605 - DNA, 25 bp, Mus musculus
tctcgctgagggacttgtggaaact

SEQ ID NO: 476606 - DNA, 25 bp, Mus musculus
tctcgctttggccatggaacgcgac

SEQ ID NO: 476607 - DNA, 25 bp, Mus musculus
tctcggaaatgctcgcagaaaggct

SEQ ID NO: 476608 - DNA, 25 bp, Mus musculus
tctcggaagcctggaagcgaggcac

SEQ ID NO: 476609 - DNA, 25 bp, Mus musculus
tctcggaagtagaatggcccagcct

SEQ ID NO: 476610 - DNA, 25 bp, Mus musculus
tctcggaatagaagacgggacagtg

SEQ ID NO: 476611 - DNA, 25 bp, Mus musculus
tctcggacagacagaagatctcact

SEQ ID NO: 476612 - DNA, 25 bp, Mus musculus
tctcggacctattagcaggcgtggc

SEQ ID NO: 476613 - DNA, 25 bp, Mus musculus
tctcggacgtgctgggctatgtaaa

SEQ ID NO: 476614 - DNA, 25 bp, Mus musculus
tctcggagactgagacagttagcca

SEQ ID NO: 476615 - DNA, 25 bp, Mus musculus
tctcggagatctttcatttaaccct

SEQ ID NO: 476616 - DNA, 25 bp, Mus musculus
tctcggagcccctaaaagtctgact

SEQ ID NO: 476617 - DNA, 25 bp, Mus musculus
tctcggaggcacaattgccgtccct

SEQ ID NO: 476618 - DNA, 25 bp, Mus musculus
tctcggagtcaaaggaattgcccca

SEQ ID NO: 476619 - DNA, 25 bp, Mus musculus
tctcggcagtcagtgaaagcatcgc

SEQ ID NO: 476620 - DNA, 25 bp, Mus musculus
tctcggcccattgctatttgctgtt

SEQ ID NO: 476621 - DNA, 25 bp, Mus musculus
tctcggcccgaagctctgaggcgag

SEQ ID NO: 476622 - DNA, 25 bp, Mus musculus
tctcggcctcctgggaatgagtgca

SEQ ID NO: 476623 - DNA, 25 bp, Mus musculus
tctcggcctggaaaagaagtggtca

SEQ ID NO: 476624 - DNA, 25 bp, Mus musculus
tctcggccttgggaaaaaccagaca

SEQ ID NO: 476625 - DNA, 25 bp, Mus musculus
tctcggcgaggctgaacgtaatatc

SEQ ID NO: 476626 - DNA, 25 bp, Mus musculus
tctcggcgcgcttagactgtgtaca

SEQ ID NO: 476627 - DNA, 25 bp, Mus musculus
tctcggcggcgttaggcttgctgtc

SEQ ID NO: 476628 - DNA, 25 bp, Mus musculus
tctcggcgggcagtttacgtgtgac

SEQ ID NO: 476629 - DNA, 25 bp, Mus musculus
tctcggctgcggattagaaaccttg

SEQ ID NO: 476630 - DNA, 25 bp, Mus musculus
tctcgggaaagatactctgagcctg

SEQ ID NO: 476631 - DNA, 25 bp, Mus musculus
tctcgggaagccttcagagcctgtg

SEQ ID NO: 476632 - DNA, 25 bp, Mus musculus
tctcgggagcactgaattttggagc

SEQ ID NO: 476633 - DNA, 25 bp, Mus musculus
tctcgggaggcagcatcaagtgtct

SEQ ID NO: 476634 - DNA, 25 bp, Mus musculus
tctcgggagggatcttgcaggaacc

SEQ ID NO: 476635 - DNA, 25 bp, Mus musculus
tctcgggccccagaagtgggtcaag

SEQ ID NO: 476636 - DNA, 25 bp, Mus musculus
tctcggtagacacaaggcctgtagg

SEQ ID NO: 476637 - DNA, 25 bp, Mus musculus
tctcggtcgggcaactacagtgtca

SEQ ID NO: 476638 - DNA, 25 bp, Mus musculus
tctcggtgatggtgaacaatggctc

SEQ ID NO: 476639 - DNA, 25 bp, Mus musculus
tctcggtgtatgaaccaaaggtcac

SEQ ID NO: 476640 - DNA, 25 bp, Mus musculus
tctcggttcgcgtggagcgatgctt

SEQ ID NO: 476641 - DNA, 25 bp, Mus musculus
tctcgtaagaaagaagccaaagctg

SEQ ID NO: 476642 - DNA, 25 bp, Mus musculus
tctcgtacatcggagaaggcgccta

SEQ ID NO: 476643 - DNA, 25 bp, Mus musculus
tctcgtagaggaacagatgatgacc

SEQ ID NO: 476644 - DNA, 25 bp, Mus musculus
tctcgtattttgttgtggaccccat

SEQ ID NO: 476645 - DNA, 25 bp, Mus musculus
tctcgtcctttagcctgtccaaggt

SEQ ID NO: 476646 - DNA, 25 bp, Mus musculus
tctcgtctgtcagcttgatgtctgg

SEQ ID NO: 476647 - DNA, 25 bp, Mus musculus
tctcgtctgtcttggtattggaggg

SEQ ID NO: 476648 - DNA, 25 bp, Mus musculus
tctcgtgctggacaggccatcctgt

SEQ ID NO: 476649 - DNA, 25 bp, Mus musculus
tctcgtggaggctgctaaggactac

SEQ ID NO: 476650 - DNA, 25 bp, Mus musculus
tctcgtgggtgcacaaagaaatgca

SEQ ID NO: 476651 - DNA, 25 bp, Mus musculus
tctcgtgtcgtagctggctctgcga

SEQ ID NO: 476652 - DNA, 25 bp, Mus musculus
tctcgtgtggtagggatggctcatc

SEQ ID NO: 476653 - DNA, 25 bp, Mus musculus
tctcgttagaggtgagcactgcggc

SEQ ID NO: 476654 - DNA, 25 bp, Mus musculus
tctcgttggaatatattgggacact

SEQ ID NO: 476655 - DNA, 25 bp, Mus musculus
tctcgttggccccaggtgacttagg

SEQ ID NO: 476656 - DNA, 25 bp, Mus musculus
tctcgtttccttcagagtcagtcac

SEQ ID NO: 476657 - DNA, 25 bp, Mus musculus
tctcgtttcgccagccaggcattgg

SEQ ID NO: 476658 - DNA, 25 bp, Mus musculus
tctctaaaacccttgccggcatgga

SEQ ID NO: 476659 - DNA, 25 bp, Mus musculus
tctctaacaccgaggtgaccatcgg

SEQ ID NO: 476660 - DNA, 25 bp, Mus musculus
tctctaaccacaaagccattatggg

SEQ ID NO: 476661 - DNA, 25 bp, Mus musculus
tctctaaccgtgcatgtgaggagcc

SEQ ID NO: 476662 - DNA, 25 bp, Mus musculus
tctctaagccacagaagcaattgaa

SEQ ID NO: 476663 - DNA, 25 bp, Mus musculus
tctctaagtgtcaagaagcctagat

SEQ ID NO: 476664 - DNA, 25 bp, Mus musculus
tctctaagttggagagccagactga

SEQ ID NO: 476665 - DNA, 25 bp, Mus musculus
tctctacagatgtgagtattctgac

SEQ ID NO: 476666 - DNA, 25 bp, Mus musculus
tctctaccaccaacggaaagctgcg

SEQ ID NO: 476667 - DNA, 25 bp, Mus musculus
tctctaccagcaaaatgagattaga

SEQ ID NO: 476668 - DNA, 25 bp, Mus musculus
tctctacctatactgtgctgcggcc

SEQ ID NO: 476669 - DNA, 25 bp, Mus musculus
tctctacctgtgagctaggcattgc

SEQ ID NO: 476670 - DNA, 25 bp, Mus musculus
tctctactacagcatgggcttccag

SEQ ID NO: 476671 - DNA, 25 bp, Mus musculus
tctctactcgatacggctgtggagc

SEQ ID NO: 476672 - DNA, 25 bp, Mus musculus
tctctactgatagtttccagcttag

SEQ ID NO: 476673 - DNA, 25 bp, Mus musculus
tctctactgggcttgtggacttcac

SEQ ID NO: 476674 - DNA, 25 bp, Mus musculus
tctctagacactccagacctgatgg

SEQ ID NO: 476675 - DNA, 25 bp, Mus musculus
tctctagacctagattatttggtgt

SEQ ID NO: 476676 - DNA, 25 bp, Mus musculus
tctctagagaagaaatagcgcagct

SEQ ID NO: 476677 - DNA, 25 bp, Mus musculus
tctctagagaccaggtggcagccat

SEQ ID NO: 476678 - DNA, 25 bp, Mus musculus
tctctagagagatcgcgagagcgtc

SEQ ID NO: 476679 - DNA, 25 bp, Mus musculus
tctctagagagcttactgtggccag

SEQ ID NO: 476680 - DNA, 25 bp, Mus musculus
tctctagagtcttagtgaggtcccc

SEQ ID NO: 476681 - DNA, 25 bp, Mus musculus
tctctagcatataaggaaggacgcc

SEQ ID NO: 476682 - DNA, 25 bp, Mus musculus
tctctagccagggaaggaatcgtct

SEQ ID NO: 476683 - DNA, 25 bp, Mus musculus
tctctagcccttaagcaggtttttg

SEQ ID NO: 476684 - DNA, 25 bp, Mus musculus
tctctagctggagggaataccatca

SEQ ID NO: 476685 - DNA, 25 bp, Mus musculus
tctctagcttcgagtcggaaatacc

SEQ ID NO: 476686 - DNA, 25 bp, Mus musculus
tctctaggaacacgtgccgatggcc

SEQ ID NO: 476687 - DNA, 25 bp, Mus musculus
tctctaggataaagagagcctgctg

SEQ ID NO: 476688 - DNA, 25 bp, Mus musculus
tctctaggcctagtactacgtattt

SEQ ID NO: 476689 - DNA, 25 bp, Mus musculus
tctctagggagaaaataaattcgtt

SEQ ID NO: 476690 - DNA, 25 bp, Mus musculus
tctctaggtccatagcggagcaggc

SEQ ID NO: 476691 - DNA, 25 bp, Mus musculus
tctctagtgattgtaattggtcaca

SEQ ID NO: 476692 - DNA, 25 bp, Mus musculus
tctctagtgcctggaccggcttcgg

SEQ ID NO: 476693 - DNA, 25 bp, Mus musculus
tctctagtggaaagtggccaggctc

SEQ ID NO: 476694 - DNA, 25 bp, Mus musculus
tctctagttgcagcttgggcggctc

SEQ ID NO: 476695 - DNA, 25 bp, Mus musculus
tctctataaaatggtgctgtgcggg

SEQ ID NO: 476696 - DNA, 25 bp, Mus musculus
tctctataaatttgaccgctctggc

SEQ ID NO: 476697 - DNA, 25 bp, Mus musculus
tctctatactgtcctctgaagcata

SEQ ID NO: 476698 - DNA, 25 bp, Mus musculus
tctctatcaaaacataattggagtg

SEQ ID NO: 476699 - DNA, 25 bp, Mus musculus
tctctatcctgaaaaccctgcgtga

SEQ ID NO: 476700 - DNA, 25 bp, Mus musculus
tctctatctgcacagcgatgctggg

SEQ ID NO: 476701 - DNA, 25 bp, Mus musculus
tctctatgctgggtccatggcagga

SEQ ID NO: 476702 - DNA, 25 bp, Mus musculus
tctctatggagaaaggcggcaacat

SEQ ID NO: 476703 - DNA, 25 bp, Mus musculus
tctctatggagcctatgtgcccagc

SEQ ID NO: 476704 - DNA, 25 bp, Mus musculus
tctctcactaaacatagccacaaag

SEQ ID NO: 476705 - DNA, 25 bp, Mus musculus
tctctcagcgagtataaaattcttc

SEQ ID NO: 476706 - DNA, 25 bp, Mus musculus
tctctcagtagtgcgggaatcaacc

SEQ ID NO: 476707 - DNA, 25 bp, Mus musculus
tctctcataggcttcaatggcagct

SEQ ID NO: 476708 - DNA, 25 bp, Mus musculus
tctctcatcagtgttggaaggcccg

SEQ ID NO: 476709 - DNA, 25 bp, Mus musculus
tctctcatgcatagtggagctcact

SEQ ID NO: 476710 - DNA, 25 bp, Mus musculus
tctctcattgaagcaaagatcagag

SEQ ID NO: 476711 - DNA, 25 bp, Mus musculus
tctctccatatgctgggagctctcc

SEQ ID NO: 476712 - DNA, 25 bp, Mus musculus
tctctccattgcagccattcccatt

SEQ ID NO: 476713 - DNA, 25 bp, Mus musculus
tctctcccagctggtggcgcgggta

SEQ ID NO: 476714 - DNA, 25 bp, Mus musculus
tctctccctctaagggtggtcccgt

SEQ ID NO: 476715 - DNA, 25 bp, Mus musculus
tctctccctggtaagaaaaatatgg

SEQ ID NO: 476716 - DNA, 25 bp, Mus musculus
tctctccgacgactgctatttgaag

SEQ ID NO: 476717 - DNA, 25 bp, Mus musculus
tctctccgatttagacatctcaggg

SEQ ID NO: 476718 - DNA, 25 bp, Mus musculus
tctctccgtggttctgggcgaggct

SEQ ID NO: 476719 - DNA, 25 bp, Mus musculus
tctctcctgcgagggctatgctgct

SEQ ID NO: 476720 - DNA, 25 bp, Mus musculus
tctctcggaatcagcggtttgttct

SEQ ID NO: 476721 - DNA, 25 bp, Mus musculus
tctctcggaggaagcaagcggatgc

SEQ ID NO: 476722 - DNA, 25 bp, Mus musculus
tctctcggctgatcgtggagctgcg

SEQ ID NO: 476723 - DNA, 25 bp, Mus musculus
tctctcgggcagtcagagcagccta

SEQ ID NO: 476724 - DNA, 25 bp, Mus musculus
tctctctagccaggcaactgtattt

SEQ ID NO: 476725 - DNA, 25 bp, Mus musculus
tctctctattggtggaaatcgcagc

SEQ ID NO: 476726 - DNA, 25 bp, Mus musculus
tctctctcgctactttgcaccaaag

SEQ ID NO: 476727 - DNA, 25 bp, Mus musculus
tctctctctagaaaagcagacccgg

SEQ ID NO: 476728 - DNA, 25 bp, Mus musculus
tctctctctgtgttagggttaaagg

SEQ ID NO: 476729 - DNA, 25 bp, Mus musculus
tctctctcttcacttctgatttcct

SEQ ID NO: 476730 - DNA, 25 bp, Mus musculus
tctctctgaatgagataaagcctgg

SEQ ID NO: 476731 - DNA, 25 bp, Mus musculus
tctctctgagggacagcgtgactgt

SEQ ID NO: 476732 - DNA, 25 bp, Mus musculus
tctctctgcttggacatgaagcgct

SEQ ID NO: 476733 - DNA, 25 bp, Mus musculus
tctctctggacgtgcgaactggagc

SEQ ID NO: 476734 - DNA, 25 bp, Mus musculus
tctctctgggatgggcttacagcaa

SEQ ID NO: 476735 - DNA, 25 bp, Mus musculus
tctctctgggtgtagacttgggaag

SEQ ID NO: 476736 - DNA, 25 bp, Mus musculus
tctctctggtggtaaaggacaacac

SEQ ID NO: 476737 - DNA, 25 bp, Mus musculus
tctctcttaagctggattactgtgc

SEQ ID NO: 476738 - DNA, 25 bp, Mus musculus
tctctgaaaggtcaaatacatggcc

SEQ ID NO: 476739 - DNA, 25 bp, Mus musculus
tctctgaaagttgtgcggctgctcc

SEQ ID NO: 476740 - DNA, 25 bp, Mus musculus
tctctgaagaaaggagtgcatatgc

SEQ ID NO: 476741 - DNA, 25 bp, Mus musculus
tctctgaaggaaacggacttaatta

SEQ ID NO: 476742 - DNA, 25 bp, Mus musculus
tctctgaataatgaacttgaaagtg

SEQ ID NO: 476743 - DNA, 25 bp, Mus musculus
tctctgaatacataccggaagggct

SEQ ID NO: 476744 - DNA, 25 bp, Mus musculus
tctctgaatgggtattctgcctggg

SEQ ID NO: 476745 - DNA, 25 bp, Mus musculus
tctctgacagctcaacatcctggtg

SEQ ID NO: 476746 - DNA, 25 bp, Mus musculus
tctctgacaggattgctgcggaggt

SEQ ID NO: 476747 - DNA, 25 bp, Mus musculus
tctctgacaggtttgagcatggcag

SEQ ID NO: 476748 - DNA, 25 bp, Mus musculus
tctctgacgctaattgatgccctgg

SEQ ID NO: 476749 - DNA, 25 bp, Mus musculus
tctctgactaccacagttaacaggg

SEQ ID NO: 476750 - DNA, 25 bp, Mus musculus
tctctgagaataaccctaagggcgt

SEQ ID NO: 476751 - DNA, 25 bp, Mus musculus
tctctgagaataagaaccaagttag

SEQ ID NO: 476752 - DNA, 25 bp, Mus musculus
tctctgagagagactggagtgccac

SEQ ID NO: 476753 - DNA, 25 bp, Mus musculus
tctctgagagggagctttcgcgccg

SEQ ID NO: 476754 - DNA, 25 bp, Mus musculus
tctctgagatgtagaaagattccat

SEQ ID NO: 476755 - DNA, 25 bp, Mus musculus
tctctgagcaatgacacgatagcaa

SEQ ID NO: 476756 - DNA, 25 bp, Mus musculus
tctctgagctcactgagagccgcct

SEQ ID NO: 476757 - DNA, 25 bp, Mus musculus
tctctgaggaactgtggccgtgatc

SEQ ID NO: 476758 - DNA, 25 bp, Mus musculus
tctctgaggacaggatacgtgagca

SEQ ID NO: 476759 - DNA, 25 bp, Mus musculus
tctctgagggtttactgtgaagtgt

SEQ ID NO: 476760 - DNA, 25 bp, Mus musculus
tctctgagtagtggttcctggccca

SEQ ID NO: 476761 - DNA, 25 bp, Mus musculus
tctctgataaaacgaaaccaaatgc

SEQ ID NO: 476762 - DNA, 25 bp, Mus musculus
tctctgatagactgcaggtgccatc

SEQ ID NO: 476763 - DNA, 25 bp, Mus musculus
tctctgatcctcttgactcccggag

SEQ ID NO: 476764 - DNA, 25 bp, Mus musculus
tctctgatttctccagtggctctgg

SEQ ID NO: 476765 - DNA, 25 bp, Mus musculus
tctctgcagcaatactgggatctca

SEQ ID NO: 476766 - DNA, 25 bp, Mus musculus
tctctgcaggaccaaggcgactatg

SEQ ID NO: 476767 - DNA, 25 bp, Mus musculus
tctctgcagggttgatgactattga

SEQ ID NO: 476768 - DNA, 25 bp, Mus musculus
tctctgcatttagcatgaaatgcct

SEQ ID NO: 476769 - DNA, 25 bp, Mus musculus
tctctgccagacacttgtagaaagg

SEQ ID NO: 476770 - DNA, 25 bp, Mus musculus
tctctgccaggaagcaaaatggagg

SEQ ID NO: 476771 - DNA, 25 bp, Mus musculus
tctctgccctgattctgtttccacg

SEQ ID NO: 476772 - DNA, 25 bp, Mus musculus
tctctgccgaaaagaaagcgtctgg

SEQ ID NO: 476773 - DNA, 25 bp, Mus musculus
tctctgccgagtaatgccacgggcc

SEQ ID NO: 476774 - DNA, 25 bp, Mus musculus
tctctgcctccaaagcggcgtgaag

SEQ ID NO: 476775 - DNA, 25 bp, Mus musculus
tctctgcctctaagggccagagtct

SEQ ID NO: 476776 - DNA, 25 bp, Mus musculus
tctctgcctgcaggttcggaccatg

SEQ ID NO: 476777 - DNA, 25 bp, Mus musculus
tctctgcgcgctggtttcgatgtgg

SEQ ID NO: 476778 - DNA, 25 bp, Mus musculus
tctctgctcagaagccgtcagctgt

SEQ ID NO: 476779 - DNA, 25 bp, Mus musculus
tctctgctcagtcccagaatggctt

SEQ ID NO: 476780 - DNA, 25 bp, Mus musculus
tctctgctctgttgcctcaagatgg

SEQ ID NO: 476781 - DNA, 25 bp, Mus musculus
tctctgctgacaaactggtggctct

SEQ ID NO: 476782 - DNA, 25 bp, Mus musculus
tctctgctgtcccagaagtaggcga

SEQ ID NO: 476783 - DNA, 25 bp, Mus musculus
tctctgcttaggtggtggcccatca

SEQ ID NO: 476784 - DNA, 25 bp, Mus musculus
tctctgcttcccagaagatccgttc

SEQ ID NO: 476785 - DNA, 25 bp, Mus musculus
tctctggaaagcacaaggagaatcc

SEQ ID NO: 476786 - DNA, 25 bp, Mus musculus
tctctggaaagtactatctagaacg

SEQ ID NO: 476787 - DNA, 25 bp, Mus musculus
tctctggaactgtgttaccaaagtg

SEQ ID NO: 476788 - DNA, 25 bp, Mus musculus
tctctggaaggattgctgaaagtgc

SEQ ID NO: 476789 - DNA, 25 bp, Mus musculus
tctctggaatgcaaggaggcagctt

SEQ ID NO: 476790 - DNA, 25 bp, Mus musculus
tctctggacaatatgaataaccctg

SEQ ID NO: 476791 - DNA, 25 bp, Mus musculus
tctctggaccacattcatagaaggc

SEQ ID NO: 476792 - DNA, 25 bp, Mus musculus
tctctggacccaaagccgaaatgcg

SEQ ID NO: 476793 - DNA, 25 bp, Mus musculus
tctctggacgagtaggtgtgcccta

SEQ ID NO: 476794 - DNA, 25 bp, Mus musculus
tctctggactcggaagattacagcc

SEQ ID NO: 476795 - DNA, 25 bp, Mus musculus
tctctggagacttcaccctgctgta

SEQ ID NO: 476796 - DNA, 25 bp, Mus musculus
tctctggagagcgatgtggattaca

SEQ ID NO: 476797 - DNA, 25 bp, Mus musculus
tctctggagggcagagctagcgacc

SEQ ID NO: 476798 - DNA, 25 bp, Mus musculus
tctctggaggtaaaaggaaccttga

SEQ ID NO: 476799 - DNA, 25 bp, Mus musculus
tctctggagtatcaagccctggaac

SEQ ID NO: 476800 - DNA, 25 bp, Mus musculus
tctctggccgcacaatacaggaagg

SEQ ID NO: 476801 - DNA, 25 bp, Mus musculus
tctctggcggtgctaagatcaaccg

SEQ ID NO: 476802 - DNA, 25 bp, Mus musculus
tctctggcgtccttgtgctatctca

SEQ ID NO: 476803 - DNA, 25 bp, Mus musculus
tctctggctacttccctggcaaaac

SEQ ID NO: 476804 - DNA, 25 bp, Mus musculus
tctctggctgtaagggaagacttcc

SEQ ID NO: 476805 - DNA, 25 bp, Mus musculus
tctctgggaaatcctgaggcgttgc

SEQ ID NO: 476806 - DNA, 25 bp, Mus musculus
tctctgggacacgtcgcataggcca

SEQ ID NO: 476807 - DNA, 25 bp, Mus musculus
tctctgggagttctgacgggaccat

SEQ ID NO: 476808 - DNA, 25 bp, Mus musculus
tctctgggcactggatggccacatg

SEQ ID NO: 476809 - DNA, 25 bp, Mus musculus
tctctgggcaggaatggtaccagca

SEQ ID NO: 476810 - DNA, 25 bp, Mus musculus
tctctgggcagtagataggactgta

SEQ ID NO: 476811 - DNA, 25 bp, Mus musculus
tctctgggtgggaactgtaggacca

SEQ ID NO: 476812 - DNA, 25 bp, Mus musculus
tctctggtagagaatggcccggtac

SEQ ID NO: 476813 - DNA, 25 bp, Mus musculus
tctctggtggagaatggccaagcac

SEQ ID NO: 476814 - DNA, 25 bp, Mus musculus
tctctggtgtcagcggaaaacagca

SEQ ID NO: 476815 - DNA, 25 bp, Mus musculus
tctctgtaacaatcaggactctcca

SEQ ID NO: 476816 - DNA, 25 bp, Mus musculus
tctctgtagtaggtaataggaacta

SEQ ID NO: 476817 - DNA, 25 bp, Mus musculus
tctctgtcacacatgaagccgggag

SEQ ID NO: 476818 - DNA, 25 bp, Mus musculus
tctctgtcacagtaagtcacatgtg

SEQ ID NO: 476819 - DNA, 25 bp, Mus musculus
tctctgtcccaagctcagtatgctg

SEQ ID NO: 476820 - DNA, 25 bp, Mus musculus
tctctgtccgcccaaagcaaattct

SEQ ID NO: 476821 - DNA, 25 bp, Mus musculus
tctctgtcctagaaaatggcctggt

SEQ ID NO: 476822 - DNA, 25 bp, Mus musculus
tctctgtctgtaggcgcaagcggcg

SEQ ID NO: 476823 - DNA, 25 bp, Mus musculus
tctctgtgacaaaactgtcattcct

SEQ ID NO: 476824 - DNA, 25 bp, Mus musculus
tctctgtgatcttctgcatgtgctc

SEQ ID NO: 476825 - DNA, 25 bp, Mus musculus
tctctgtgcatcctgtgacaagcgg

SEQ ID NO: 476826 - DNA, 25 bp, Mus musculus
tctctgtgctttcgtccagggcgca

SEQ ID NO: 476827 - DNA, 25 bp, Mus musculus
tctctgtggcccaggtaagcatcat

SEQ ID NO: 476828 - DNA, 25 bp, Mus musculus
tctctgtggttcttagggctggcct

SEQ ID NO: 476829 - DNA, 25 bp, Mus musculus
tctctgtgtcattagtagcaaatca

SEQ ID NO: 476830 - DNA, 25 bp, Mus musculus
tctctgtgtccaaggcgaagcttcg

SEQ ID NO: 476831 - DNA, 25 bp, Mus musculus
tctctgtgtcctgcgtgtatctgtc

SEQ ID NO: 476832 - DNA, 25 bp, Mus musculus
tctctgtgtgttcgcctctttcttc

SEQ ID NO: 476833 - DNA, 25 bp, Mus musculus
tctctgttacctgaagctgggccag

SEQ ID NO: 476834 - DNA, 25 bp, Mus musculus
tctctgttagttcacagcgctgtgt

SEQ ID NO: 476835 - DNA, 25 bp, Mus musculus
tctctgttatcgtgatgtcaatggc

SEQ ID NO: 476836 - DNA, 25 bp, Mus musculus
tctctgttgaactgccctgtgggtg

SEQ ID NO: 476837 - DNA, 25 bp, Mus musculus
tctctgttttatgctgttatgggtg

SEQ ID NO: 476838 - DNA, 25 bp, Mus musculus
tctcttaagagtgaagctcatgcac

SEQ ID NO: 476839 - DNA, 25 bp, Mus musculus
tctcttaagcaggagaagccaactg

SEQ ID NO: 476840 - DNA, 25 bp, Mus musculus
tctcttatgggcttaagaataccca

SEQ ID NO: 476841 - DNA, 25 bp, Mus musculus
tctcttcaaaatcctacacctgggc

SEQ ID NO: 476842 - DNA, 25 bp, Mus musculus
tctcttcagctctgggctagcctgg

SEQ ID NO: 476843 - DNA, 25 bp, Mus musculus
tctcttcaggcttccgtgggcagtg

SEQ ID NO: 476844 - DNA, 25 bp, Mus musculus
tctcttcagggagaaggcacactgc

SEQ ID NO: 476845 - DNA, 25 bp, Mus musculus
tctcttccagcaacaacattttttc

SEQ ID NO: 476846 - DNA, 25 bp, Mus musculus
tctcttcccatcaggcacgattaat

SEQ ID NO: 476847 - DNA, 25 bp, Mus musculus
tctcttccttgttgggcgccgagcc

SEQ ID NO: 476848 - DNA, 25 bp, Mus musculus
tctcttcgggatgagaaccgggccc

SEQ ID NO: 476849 - DNA, 25 bp, Mus musculus
tctcttctggacaaggtgcctggac

SEQ ID NO: 476850 - DNA, 25 bp, Mus musculus
tctcttctgtggctcattaaagtac

SEQ ID NO: 476851 - DNA, 25 bp, Mus musculus
tctcttgaagaaacctctatagtca

SEQ ID NO: 476852 - DNA, 25 bp, Mus musculus
tctcttgaagatttgctgggcgcgg

SEQ ID NO: 476853 - DNA, 25 bp, Mus musculus
tctcttgaagccatacaggaaccca

SEQ ID NO: 476854 - DNA, 25 bp, Mus musculus
tctcttgagcccttctgaacctgca

SEQ ID NO: 476855 - DNA, 25 bp, Mus musculus
tctcttgattcaggcgagttctggc

SEQ ID NO: 476856 - DNA, 25 bp, Mus musculus
tctcttgcctgtagcaagggctaca

SEQ ID NO: 476857 - DNA, 25 bp, Mus musculus
tctcttgcctgttgacttccacttg

SEQ ID NO: 476858 - DNA, 25 bp, Mus musculus
tctcttgcttgtatgaaactgtctt

SEQ ID NO: 476859 - DNA, 25 bp, Mus musculus
tctcttggaactaagatggctgagg

SEQ ID NO: 476860 - DNA, 25 bp, Mus musculus
tctcttggcacctggcagcaaaggc

SEQ ID NO: 476861 - DNA, 25 bp, Mus musculus
tctcttgtagctggttcgatgccca

SEQ ID NO: 476862 - DNA, 25 bp, Mus musculus
tctcttgtaggctaacgaggacgtc

SEQ ID NO: 476863 - DNA, 25 bp, Mus musculus
tctcttgtcaaagaaggccggtgtg

SEQ ID NO: 476864 - DNA, 25 bp, Mus musculus
tctcttgtggaaagcggccaagctc

SEQ ID NO: 476865 - DNA, 25 bp, Mus musculus
tctcttgtgtggcaaccactatagt

SEQ ID NO: 476866 - DNA, 25 bp, Mus musculus
tctcttgttttcttgtcaggctgga

SEQ ID NO: 476867 - DNA, 25 bp, Mus musculus
tctctttaaaggagtcagggtccca

SEQ ID NO: 476868 - DNA, 25 bp, Mus musculus
tctctttacgaaccccgagggatgc

SEQ ID NO: 476869 - DNA, 25 bp, Mus musculus
tctctttcagctgggaagatgccga

SEQ ID NO: 476870 - DNA, 25 bp, Mus musculus
tctctttccagagttcagtcaacag

SEQ ID NO: 476871 - DNA, 25 bp, Mus musculus
tctctttctggcaaaagcaaacgag

SEQ ID NO: 476872 - DNA, 25 bp, Mus musculus
tctctttgaaggatactttggaaca

SEQ ID NO: 476873 - DNA, 25 bp, Mus musculus
tctctttgcaaaatacaccttcttc

SEQ ID NO: 476874 - DNA, 25 bp, Mus musculus
tctctttgccgatggctctagccat

SEQ ID NO: 476875 - DNA, 25 bp, Mus musculus
tctctttgctgaggtgacacggcga

SEQ ID NO: 476876 - DNA, 25 bp, Mus musculus
tctctttgcttctaggtttcctttg

SEQ ID NO: 476877 - DNA, 25 bp, Mus musculus
tctctttggcagatgaaaaacgact

SEQ ID NO: 476878 - DNA, 25 bp, Mus musculus
tctcttttgcaggagtgcggctgta

SEQ ID NO: 476879 - DNA, 25 bp, Mus musculus
tctctttttggcagccgctggacgt

SEQ ID NO: 476880 - DNA, 25 bp, Mus musculus
tctgaaaaagctggaaggccgacgc

SEQ ID NO: 476881 - DNA, 25 bp, Mus musculus
tctgaaaacaacatcatgcagtgga

SEQ ID NO: 476882 - DNA, 25 bp, Mus musculus
tctgaaaacacgcaacagcagcagg

SEQ ID NO: 476883 - DNA, 25 bp, Mus musculus
tctgaaaacatactgcattgtaccc

SEQ ID NO: 476884 - DNA, 25 bp, Mus musculus
tctgaaaatgagactccctgtggcc

SEQ ID NO: 476885 - DNA, 25 bp, Mus musculus
tctgaaaatggctggacggtggaca

SEQ ID NO: 476886 - DNA, 25 bp, Mus musculus
tctgaaaatgtatgaaggcctgagg

SEQ ID NO: 476887 - DNA, 25 bp, Mus musculus
tctgaaacacatggtggcagcagtg

SEQ ID NO: 476888 - DNA, 25 bp, Mus musculus
tctgaaactctgtcgggactgcagc

SEQ ID NO: 476889 - DNA, 25 bp, Mus musculus
tctgaaagacaagtcgctgggtgcc

SEQ ID NO: 476890 - DNA, 25 bp, Mus musculus
tctgaaagacatcggcagaggaccc

SEQ ID NO: 476891 - DNA, 25 bp, Mus musculus
tctgaaagagaagaccatggtgggc

SEQ ID NO: 476892 - DNA, 25 bp, Mus musculus
tctgaaagatgacctgcacgcaggc

SEQ ID NO: 476893 - DNA, 25 bp, Mus musculus
tctgaaagatggatatgccgtagcc

SEQ ID NO: 476894 - DNA, 25 bp, Mus musculus
tctgaaagatgtgtatccccatgcc

SEQ ID NO: 476895 - DNA, 25 bp, Mus musculus
tctgaaagccctgtgatgtcctctg

SEQ ID NO: 476896 - DNA, 25 bp, Mus musculus
tctgaaagcctcagtgatctctcag

SEQ ID NO: 476897 - DNA, 25 bp, Mus musculus
tctgaaagccttggcacataacggc

SEQ ID NO: 476898 - DNA, 25 bp, Mus musculus
tctgaaagcttgcaagccagcatct

SEQ ID NO: 476899 - DNA, 25 bp, Mus musculus
tctgaaaggagaaatcagccctggc

SEQ ID NO: 476900 - DNA, 25 bp, Mus musculus
tctgaaaggatgtctgctgcgcacc

SEQ ID NO: 476901 - DNA, 25 bp, Mus musculus
tctgaaaggattccaagcctgctgg

SEQ ID NO: 476902 - DNA, 25 bp, Mus musculus
tctgaaagggttcgcaacatgtcac

SEQ ID NO: 476903 - DNA, 25 bp, Mus musculus
tctgaaaggtaacactagcacgcgg

SEQ ID NO: 476904 - DNA, 25 bp, Mus musculus
tctgaaagtctttgtggcctcaagc

SEQ ID NO: 476905 - DNA, 25 bp, Mus musculus
tctgaaatcctaaccgatcctggga

SEQ ID NO: 476906 - DNA, 25 bp, Mus musculus
tctgaaatcgactggctgaacctga

SEQ ID NO: 476907 - DNA, 25 bp, Mus musculus
tctgaaatgaagacccgaacatggg

SEQ ID NO: 476908 - DNA, 25 bp, Mus musculus
tctgaaatgatggttcacctagaga

SEQ ID NO: 476909 - DNA, 25 bp, Mus musculus
tctgaaatggagcacacaacagctg

SEQ ID NO: 476910 - DNA, 25 bp, Mus musculus
tctgaaatgtttggtggcctggaca

SEQ ID NO: 476911 - DNA, 25 bp, Mus musculus
tctgaaattacaacctagagagaac

SEQ ID NO: 476912 - DNA, 25 bp, Mus musculus
tctgaaattgtgagcaagagagaga

SEQ ID NO: 476913 - DNA, 25 bp, Mus musculus
tctgaacaacaagaggtcaccagtg

SEQ ID NO: 476914 - DNA, 25 bp, Mus musculus
tctgaacacctctgtgctgggccag

SEQ ID NO: 476915 - DNA, 25 bp, Mus musculus
tctgaacagagatctcacgtgctcc

SEQ ID NO: 476916 - DNA, 25 bp, Mus musculus
tctgaacaggtcttcttcatacctg

SEQ ID NO: 476917 - DNA, 25 bp, Mus musculus
tctgaaccccagtagtggacagtgg

SEQ ID NO: 476918 - DNA, 25 bp, Mus musculus
tctgaaccctggaactgctttggag

SEQ ID NO: 476919 - DNA, 25 bp, Mus musculus
tctgaacctcacagacaggcgacca

SEQ ID NO: 476920 - DNA, 25 bp, Mus musculus
tctgaacgaagactacaccaaggag

SEQ ID NO: 476921 - DNA, 25 bp, Mus musculus
tctgaacgggtttcagcagacaacc

SEQ ID NO: 476922 - DNA, 25 bp, Mus musculus
tctgaacggtgcaacgtaacggcta

SEQ ID NO: 476923 - DNA, 25 bp, Mus musculus
tctgaactaaacagggcaggagccc

SEQ ID NO: 476924 - DNA, 25 bp, Mus musculus
tctgaactgagaagcatgtgcccag

SEQ ID NO: 476925 - DNA, 25 bp, Mus musculus
tctgaactgagtatcccggccaaga

SEQ ID NO: 476926 - DNA, 25 bp, Mus musculus
tctgaactgagttggtctgcctggg

SEQ ID NO: 476927 - DNA, 25 bp, Mus musculus
tctgaactgccgatccttggtgaaa

SEQ ID NO: 476928 - DNA, 25 bp, Mus musculus
tctgaagaaagaggcatcggatggc

SEQ ID NO: 476929 - DNA, 25 bp, Mus musculus
tctgaagaaccacaagtatgaccct

SEQ ID NO: 476930 - DNA, 25 bp, Mus musculus
tctgaagaagattacctggtcatga

SEQ ID NO: 476931 - DNA, 25 bp, Mus musculus
tctgaagaagccaatcagaagacag

SEQ ID NO: 476932 - DNA, 25 bp, Mus musculus
tctgaagaagccatgggtagctgtt

SEQ ID NO: 476933 - DNA, 25 bp, Mus musculus
tctgaagaagtcgacctggcaatgg

SEQ ID NO: 476934 - DNA, 25 bp, Mus musculus
tctgaagacaaaaaggcctgcgaag

SEQ ID NO: 476935 - DNA, 25 bp, Mus musculus
tctgaagacagttgccccgtctacc

SEQ ID NO: 476936 - DNA, 25 bp, Mus musculus
tctgaagacctgtgcaaaagctggt

SEQ ID NO: 476937 - DNA, 25 bp, Mus musculus
tctgaagactttggctgacaagcgg

SEQ ID NO: 476938 - DNA, 25 bp, Mus musculus
tctgaagagctgactagaaccgtct

SEQ ID NO: 476939 - DNA, 25 bp, Mus musculus
tctgaagaggtcacagtaaatgatt

SEQ ID NO: 476940 - DNA, 25 bp, Mus musculus
tctgaagagtcatccataagtgatc

SEQ ID NO: 476941 - DNA, 25 bp, Mus musculus
tctgaagataaacagctggcggtct

SEQ ID NO: 476942 - DNA, 25 bp, Mus musculus
tctgaagatattaaagctgtagggt

SEQ ID NO: 476943 - DNA, 25 bp, Mus musculus
tctgaagatgcaaagggaaatgtct

SEQ ID NO: 476944 - DNA, 25 bp, Mus musculus
tctgaagcaggagtcatggcagcca

SEQ ID NO: 476945 - DNA, 25 bp, Mus musculus
tctgaagcataaggcaggaccagtt

SEQ ID NO: 476946 - DNA, 25 bp, Mus musculus
tctgaagccagtgcaaaagctcctt

SEQ ID NO: 476947 - DNA, 25 bp, Mus musculus
tctgaagcctactctagagggagga

SEQ ID NO: 476948 - DNA, 25 bp, Mus musculus
tctgaagcctgcatattaaactgag

SEQ ID NO: 476949 - DNA, 25 bp, Mus musculus
tctgaagccttagaaacaatgcctt

SEQ ID NO: 476950 - DNA, 25 bp, Mus musculus
tctgaagctgatgaagacgtccgtc

SEQ ID NO: 476951 - DNA, 25 bp, Mus musculus
tctgaagctggagcactagaattaa

SEQ ID NO: 476952 - DNA, 25 bp, Mus musculus
tctgaagctgtactgcgagcaggac

SEQ ID NO: 476953 - DNA, 25 bp, Mus musculus
tctgaagctgtcagaggcacgcctg

SEQ ID NO: 476954 - DNA, 25 bp, Mus musculus
tctgaaggaacaggagcgcttggct

SEQ ID NO: 476955 - DNA, 25 bp, Mus musculus
tctgaaggatagctgcagcactgcc

SEQ ID NO: 476956 - DNA, 25 bp, Mus musculus
tctgaaggatgtgagaccatccatg

SEQ ID NO: 476957 - DNA, 25 bp, Mus musculus
tctgaaggcctgtgcagagattgcc

SEQ ID NO: 476958 - DNA, 25 bp, Mus musculus
tctgaagggagcgttgaatagcagc

SEQ ID NO: 476959 - DNA, 25 bp, Mus musculus
tctgaagggagtacagagcccacac

SEQ ID NO: 476960 - DNA, 25 bp, Mus musculus
tctgaaggtacaccaggaatagacg

SEQ ID NO: 476961 - DNA, 25 bp, Mus musculus
tctgaaggtagtcacctaaccctac

SEQ ID NO: 476962 - DNA, 25 bp, Mus musculus
tctgaagtcgctgagaaccataaaa

SEQ ID NO: 476963 - DNA, 25 bp, Mus musculus
tctgaagtcggtggattgtgttatc

SEQ ID NO: 476964 - DNA, 25 bp, Mus musculus
tctgaagtctgtagagggtcgctcc

SEQ ID NO: 476965 - DNA, 25 bp, Mus musculus
tctgaagtgctccaggattgaaacc

SEQ ID NO: 476966 - DNA, 25 bp, Mus musculus
tctgaagttacggatgctgaaacac

SEQ ID NO: 476967 - DNA, 25 bp, Mus musculus
tctgaagttagaccaaaagccaaag

SEQ ID NO: 476968 - DNA, 25 bp, Mus musculus
tctgaagttcagattaggcatcacc

SEQ ID NO: 476969 - DNA, 25 bp, Mus musculus
tctgaagttgcagccagcgagcagt

SEQ ID NO: 476970 - DNA, 25 bp, Mus musculus
tctgaagtttgaaccgaactgaaac

SEQ ID NO: 476971 - DNA, 25 bp, Mus musculus
tctgaataaaatgcatatagcggac

SEQ ID NO: 476972 - DNA, 25 bp, Mus musculus
tctgaataacaacaacggaggcttt

SEQ ID NO: 476973 - DNA, 25 bp, Mus musculus
tctgaataacccttcggccttggcc

SEQ ID NO: 476974 - DNA, 25 bp, Mus musculus
tctgaatacagctatgcacacacgc

SEQ ID NO: 476975 - DNA, 25 bp, Mus musculus
tctgaatatctttattgggtagcct

SEQ ID NO: 476976 - DNA, 25 bp, Mus musculus
tctgaatatgcgtgccctggaatta

SEQ ID NO: 476977 - DNA, 25 bp, Mus musculus
tctgaatatgctggcagagaggctg

SEQ ID NO: 476978 - DNA, 25 bp, Mus musculus
tctgaatccaaccaagaagagcttg

SEQ ID NO: 476979 - DNA, 25 bp, Mus musculus
tctgaatctcatgtctaaagactcc

SEQ ID NO: 476980 - DNA, 25 bp, Mus musculus
tctgaatctgatgtccagacagtca

SEQ ID NO: 476981 - DNA, 25 bp, Mus musculus
tctgaatctgctgaagatggcggga

SEQ ID NO: 476982 - DNA, 25 bp, Mus musculus
tctgaatctggctcaggcgctgtaa

SEQ ID NO: 476983 - DNA, 25 bp, Mus musculus
tctgaatgaggagccaaggagtctt

SEQ ID NO: 476984 - DNA, 25 bp, Mus musculus
tctgaatgcgtgtgtggacatcccc

SEQ ID NO: 476985 - DNA, 25 bp, Mus musculus
tctgaattagggagcacctgaggcc

SEQ ID NO: 476986 - DNA, 25 bp, Mus musculus
tctgaattatgacactgaacatcct

SEQ ID NO: 476987 - DNA, 25 bp, Mus musculus
tctgacaaatgttcggcaccgccta

SEQ ID NO: 476988 - DNA, 25 bp, Mus musculus
tctgacaagggacaacaggatggct

SEQ ID NO: 476989 - DNA, 25 bp, Mus musculus
tctgacaagggtgtagaggtcgcct

SEQ ID NO: 476990 - DNA, 25 bp, Mus musculus
tctgacacaaatgagggcttagcct

SEQ ID NO: 476991 - DNA, 25 bp, Mus musculus
tctgacacattgaggctaactgggc

SEQ ID NO: 476992 - DNA, 25 bp, Mus musculus
tctgacaccttagcgaagaaactcg

SEQ ID NO: 476993 - DNA, 25 bp, Mus musculus
tctgacacgcacctgcaaatcctgg

SEQ ID NO: 476994 - DNA, 25 bp, Mus musculus
tctgacactatcaccgaaacctttg

SEQ ID NO: 476995 - DNA, 25 bp, Mus musculus
tctgacagacaatggaactatgcct

SEQ ID NO: 476996 - DNA, 25 bp, Mus musculus
tctgacagagaagtgcgggctgcaa

SEQ ID NO: 476997 - DNA, 25 bp, Mus musculus
tctgacagataggagagacatcgcc

SEQ ID NO: 476998 - DNA, 25 bp, Mus musculus
tctgacagcgttgctctctgacagg

SEQ ID NO: 476999 - DNA, 25 bp, Mus musculus
tctgacagctatcgcagtggaccgc

SEQ ID NO: 477000 - DNA, 25 bp, Mus musculus
tctgacagtgagttgcctccaaggg

SEQ ID NO: 477001 - DNA, 25 bp, Mus musculus
tctgacagtggcacaacagcggtgg

SEQ ID NO: 477002 - DNA, 25 bp, Mus musculus
tctgacatcttgagtcccctggagg

SEQ ID NO: 477003 - DNA, 25 bp, Mus musculus
tctgacatgagactaaccctgaagg

SEQ ID NO: 477004 - DNA, 25 bp, Mus musculus
tctgacatggaggtcccaggaattg

SEQ ID NO: 477005 - DNA, 25 bp, Mus musculus
tctgacatgttggataattgctggg

SEQ ID NO: 477006 - DNA, 25 bp, Mus musculus
tctgaccaaacccaagtttcattaa

SEQ ID NO: 477007 - DNA, 25 bp, Mus musculus
tctgaccacacgttgtgttgggaaa

SEQ ID NO: 477008 - DNA, 25 bp, Mus musculus
tctgaccacatcagcgtagctctgg

SEQ ID NO: 477009 - DNA, 25 bp, Mus musculus
tctgaccagcagaaggctggctttg

SEQ ID NO: 477010 - DNA, 25 bp, Mus musculus
tctgaccagctgagtacaagtttag

SEQ ID NO: 477011 - DNA, 25 bp, Mus musculus
tctgaccagcttgagccatgtgcta

SEQ ID NO: 477012 - DNA, 25 bp, Mus musculus
tctgaccagggttgcctcaatgagt

SEQ ID NO: 477013 - DNA, 25 bp, Mus musculus
tctgaccaggtactagcaacaaata

SEQ ID NO: 477014 - DNA, 25 bp, Mus musculus
tctgacccaaacaagcaagttacaa

SEQ ID NO: 477015 - DNA, 25 bp, Mus musculus
tctgaccccagacacaactgtatgg

SEQ ID NO: 477016 - DNA, 25 bp, Mus musculus
tctgacctatggagaattgagccag

SEQ ID NO: 477017 - DNA, 25 bp, Mus musculus
tctgacctcatgagacaagagccgg

SEQ ID NO: 477018 - DNA, 25 bp, Mus musculus
tctgacctcgcagggctagatgtgg

SEQ ID NO: 477019 - DNA, 25 bp, Mus musculus
tctgacctggcgctattctttccct

SEQ ID NO: 477020 - DNA, 25 bp, Mus musculus
tctgacgaaccactactatatggcg

SEQ ID NO: 477021 - DNA, 25 bp, Mus musculus
tctgacgacctagaaccagcatggg

SEQ ID NO: 477022 - DNA, 25 bp, Mus musculus
tctgacgatgacgagcaggaagacc

SEQ ID NO: 477023 - DNA, 25 bp, Mus musculus
tctgacgccgggtgggaagaatact

SEQ ID NO: 477024 - DNA, 25 bp, Mus musculus
tctgacgcctatggagaagatgact

SEQ ID NO: 477025 - DNA, 25 bp, Mus musculus
tctgacgctggcaggtaaggtgtcc

SEQ ID NO: 477026 - DNA, 25 bp, Mus musculus
tctgacggacccaaaatcctgtgag

SEQ ID NO: 477027 - DNA, 25 bp, Mus musculus
tctgacggagaccaagagcatgatc

SEQ ID NO: 477028 - DNA, 25 bp, Mus musculus
tctgacggagcacgagaagattcac

SEQ ID NO: 477029 - DNA, 25 bp, Mus musculus
tctgacgtcagagattgtgtctgaa

SEQ ID NO: 477030 - DNA, 25 bp, Mus musculus
tctgacgtgcgaagcttgagctgcc

SEQ ID NO: 477031 - DNA, 25 bp, Mus musculus
tctgactacatgacacccttggttg

SEQ ID NO: 477032 - DNA, 25 bp, Mus musculus
tctgactagggccaggcaaagctct

SEQ ID NO: 477033 - DNA, 25 bp, Mus musculus
tctgactcaggatgttccggcgcca

SEQ ID NO: 477034 - DNA, 25 bp, Mus musculus
tctgactccgaaggaaaactggtgg

SEQ ID NO: 477035 - DNA, 25 bp, Mus musculus
tctgactctagcctctgggacacgt

SEQ ID NO: 477036 - DNA, 25 bp, Mus musculus
tctgactctagggacagaaagggta

SEQ ID NO: 477037 - DNA, 25 bp, Mus musculus
tctgactgagaaaggtgtggcatgc

SEQ ID NO: 477038 - DNA, 25 bp, Mus musculus
tctgactgagacatgtttgtacaaa

SEQ ID NO: 477039 - DNA, 25 bp, Mus musculus
tctgactgcgctgagaaacaaaggc

SEQ ID NO: 477040 - DNA, 25 bp, Mus musculus
tctgactgctaattgggaaggcact

SEQ ID NO: 477041 - DNA, 25 bp, Mus musculus
tctgactggaaagccgaaactcttc

SEQ ID NO: 477042 - DNA, 25 bp, Mus musculus
tctgactgtccagggcaagctcatc

SEQ ID NO: 477043 - DNA, 25 bp, Mus musculus
tctgacttccgagttctctgaggac

SEQ ID NO: 477044 - DNA, 25 bp, Mus musculus
tctgactttatcgaccctgggaaga

SEQ ID NO: 477045 - DNA, 25 bp, Mus musculus
tctgactttgctttgagagacttag

SEQ ID NO: 477046 - DNA, 25 bp, Mus musculus
tctgagaaacctccatagggcactg

SEQ ID NO: 477047 - DNA, 25 bp, Mus musculus
tctgagaaatcctgggtcccgagca

SEQ ID NO: 477048 - DNA, 25 bp, Mus musculus
tctgagaaccccatgagtgagcctg

SEQ ID NO: 477049 - DNA, 25 bp, Mus musculus
tctgagaaccgtgagatgcacactg

SEQ ID NO: 477050 - DNA, 25 bp, Mus musculus
tctgagaacgaggaatatggcacct

SEQ ID NO: 477051 - DNA, 25 bp, Mus musculus
tctgagaagaaaggagccctgcgtt

SEQ ID NO: 477052 - DNA, 25 bp, Mus musculus
tctgagaagcaaggacacgtctacg

SEQ ID NO: 477053 - DNA, 25 bp, Mus musculus
tctgagaagccattagcccagcact

SEQ ID NO: 477054 - DNA, 25 bp, Mus musculus
tctgagaagcctcagcagtcacgca

SEQ ID NO: 477055 - DNA, 25 bp, Mus musculus
tctgagaaggaccaaggctgccagt

SEQ ID NO: 477056 - DNA, 25 bp, Mus musculus
tctgagaatgcaccacagtgccgct

SEQ ID NO: 477057 - DNA, 25 bp, Mus musculus
tctgagacacaggaagcaaccagcc

SEQ ID NO: 477058 - DNA, 25 bp, Mus musculus
tctgagacatcaacccaccatgaga

SEQ ID NO: 477059 - DNA, 25 bp, Mus musculus
tctgagacctttaccacatgatttc

SEQ ID NO: 477060 - DNA, 25 bp, Mus musculus
tctgagactgcccatgacgagtgtc

SEQ ID NO: 477061 - DNA, 25 bp, Mus musculus
tctgagagaaaggtcgcccctctgt

SEQ ID NO: 477062 - DNA, 25 bp, Mus musculus
tctgagagagaaaggagtacgagcc

SEQ ID NO: 477063 - DNA, 25 bp, Mus musculus
tctgagagagggtaccatagtttaa

SEQ ID NO: 477064 - DNA, 25 bp, Mus musculus
tctgagagagtgagatacccacttg

SEQ ID NO: 477065 - DNA, 25 bp, Mus musculus
tctgagagccagacagacagggcga

SEQ ID NO: 477066 - DNA, 25 bp, Mus musculus
tctgagagccgcagagccagtgttg

SEQ ID NO: 477067 - DNA, 25 bp, Mus musculus
tctgagagcggcttctgtaggaccc

SEQ ID NO: 477068 - DNA, 25 bp, Mus musculus
tctgagagctggtcttcttgacacc

SEQ ID NO: 477069 - DNA, 25 bp, Mus musculus
tctgagaggatgtccaagttctgtg

SEQ ID NO: 477070 - DNA, 25 bp, Mus musculus
tctgagagtctgaatgctgcctgtg

SEQ ID NO: 477071 - DNA, 25 bp, Mus musculus
tctgagatcacggacgactgtggcc

SEQ ID NO: 477072 - DNA, 25 bp, Mus musculus
tctgagatcgaggaaaccaagcctg

SEQ ID NO: 477073 - DNA, 25 bp, Mus musculus
tctgagatctacttcctggccgtgg

SEQ ID NO: 477074 - DNA, 25 bp, Mus musculus
tctgagattgttgtagcagggcgcc

SEQ ID NO: 477075 - DNA, 25 bp, Mus musculus
tctgagcaacaagaggtctcccggg

SEQ ID NO: 477076 - DNA, 25 bp, Mus musculus
tctgagcaaggagacgcatgaggcc

SEQ ID NO: 477077 - DNA, 25 bp, Mus musculus
tctgagcacagcagtctgcaccatt

SEQ ID NO: 477078 - DNA, 25 bp, Mus musculus
tctgagcagcgcgagaagatcaagc

SEQ ID NO: 477079 - DNA, 25 bp, Mus musculus
tctgagcagtacagcgtggacctgg

SEQ ID NO: 477080 - DNA, 25 bp, Mus musculus
tctgagcatgcagggatgcaccgca

SEQ ID NO: 477081 - DNA, 25 bp, Mus musculus
tctgagccaagagtgcaggaccctt

SEQ ID NO: 477082 - DNA, 25 bp, Mus musculus
tctgagccacctgggatgatgggta

SEQ ID NO: 477083 - DNA, 25 bp, Mus musculus
tctgagccagaggatcaacactgaa

SEQ ID NO: 477084 - DNA, 25 bp, Mus musculus
tctgagccatctacctttgagggaa

SEQ ID NO: 477085 - DNA, 25 bp, Mus musculus
tctgagccatgtcggaagcacgtct

SEQ ID NO: 477086 - DNA, 25 bp, Mus musculus
tctgagcccacgacaaggaagaatg

SEQ ID NO: 477087 - DNA, 25 bp, Mus musculus
tctgagcccagctgttgaaagcctt

SEQ ID NO: 477088 - DNA, 25 bp, Mus musculus
tctgagccctctgtccatagagaca

SEQ ID NO: 477089 - DNA, 25 bp, Mus musculus
tctgagccctcttgctcctgcatga

SEQ ID NO: 477090 - DNA, 25 bp, Mus musculus
tctgagccgctgcagcgcagctgct

SEQ ID NO: 477091 - DNA, 25 bp, Mus musculus
tctgagcctagtgtggaagccaaca

SEQ ID NO: 477092 - DNA, 25 bp, Mus musculus
tctgagcctttatgcaaagcacgga

SEQ ID NO: 477093 - DNA, 25 bp, Mus musculus
tctgagcgatcaggccagctgttgg

SEQ ID NO: 477094 - DNA, 25 bp, Mus musculus
tctgagcgcaaacattaaggcacgg

SEQ ID NO: 477095 - DNA, 25 bp, Mus musculus
tctgagcgcacagcagatcagggct

SEQ ID NO: 477096 - DNA, 25 bp, Mus musculus
tctgagcgcctaaagttcaacgtgg

SEQ ID NO: 477097 - DNA, 25 bp, Mus musculus
tctgagcggccaaagtactgagcag

SEQ ID NO: 477098 - DNA, 25 bp, Mus musculus
tctgagcggctcttacagggatccc

SEQ ID NO: 477099 - DNA, 25 bp, Mus musculus
tctgagcggtcgactgaggcagctt

SEQ ID NO: 477100 - DNA, 25 bp, Mus musculus
tctgagctaagctttagggatgaga

SEQ ID NO: 477101 - DNA, 25 bp, Mus musculus
tctgagctcataccgagaagagtat

SEQ ID NO: 477102 - DNA, 25 bp, Mus musculus
tctgagctcatggacgactgttcct

SEQ ID NO: 477103 - DNA, 25 bp, Mus musculus
tctgagctctgggatcacagctgtc

SEQ ID NO: 477104 - DNA, 25 bp, Mus musculus
tctgagctgactgagccatcaatat

SEQ ID NO: 477105 - DNA, 25 bp, Mus musculus
tctgagctggacactttaagtttga

SEQ ID NO: 477106 - DNA, 25 bp, Mus musculus
tctgagcttcctttgatcccttgca

SEQ ID NO: 477107 - DNA, 25 bp, Mus musculus
tctgagcttgatgaatctgacgggc

SEQ ID NO: 477108 - DNA, 25 bp, Mus musculus
tctgaggaaagattcgggatagcgc

SEQ ID NO: 477109 - DNA, 25 bp, Mus musculus
tctgaggacactatacagggagtgc

SEQ ID NO: 477110 - DNA, 25 bp, Mus musculus
tctgaggaccagttacgggagtccg

SEQ ID NO: 477111 - DNA, 25 bp, Mus musculus
tctgaggacccaagcctttaaacgg

SEQ ID NO: 477112 - DNA, 25 bp, Mus musculus
tctgaggactcctccgtgagcagcc

SEQ ID NO: 477113 - DNA, 25 bp, Mus musculus
tctgaggagaccataccagggagct

SEQ ID NO: 477114 - DNA, 25 bp, Mus musculus
tctgaggagatgagtacctcacctc

SEQ ID NO: 477115 - DNA, 25 bp, Mus musculus
tctgaggagcctgtattcagggcca

SEQ ID NO: 477116 - DNA, 25 bp, Mus musculus
tctgaggcaagtttccaggaagctc

SEQ ID NO: 477117 - DNA, 25 bp, Mus musculus
tctgaggcccggtctgagtcaaaac

SEQ ID NO: 477118 - DNA, 25 bp, Mus musculus
tctgaggccctattttaacgataat

SEQ ID NO: 477119 - DNA, 25 bp, Mus musculus
tctgaggcgagcagccaaagacctt

SEQ ID NO: 477120 - DNA, 25 bp, Mus musculus
tctgaggcgcatgttcacaaagtgg

SEQ ID NO: 477121 - DNA, 25 bp, Mus musculus
tctgaggctcttagcaaattaagca

SEQ ID NO: 477122 - DNA, 25 bp, Mus musculus
tctgaggctgtcttttccagcagca

SEQ ID NO: 477123 - DNA, 25 bp, Mus musculus
tctgagggagccctcctcatgagga

SEQ ID NO: 477124 - DNA, 25 bp, Mus musculus
tctgagggcaccctttgtccgctgg

SEQ ID NO: 477125 - DNA, 25 bp, Mus musculus
tctgagggtcaggatccaggcatgc

SEQ ID NO: 477126 - DNA, 25 bp, Mus musculus
tctgaggtaactggcctagataagg

SEQ ID NO: 477127 - DNA, 25 bp, Mus musculus
tctgaggtactgtgatccgcgctgc

SEQ ID NO: 477128 - DNA, 25 bp, Mus musculus
tctgaggtagatcccgaacatctat

SEQ ID NO: 477129 - DNA, 25 bp, Mus musculus
tctgaggtccccaagcatcgaggaa

SEQ ID NO: 477130 - DNA, 25 bp, Mus musculus
tctgaggtctctgcgagtctggaaa

SEQ ID NO: 477131 - DNA, 25 bp, Mus musculus
tctgaggtgcagaacagatggcgcc

SEQ ID NO: 477132 - DNA, 25 bp, Mus musculus
tctgaggtgccatcggaagcagcat

SEQ ID NO: 477133 - DNA, 25 bp, Mus musculus
tctgaggtgggttcctcactaggta

SEQ ID NO: 477134 - DNA, 25 bp, Mus musculus
tctgaggttctctcacgtggcttgc

SEQ ID NO: 477135 - DNA, 25 bp, Mus musculus
tctgaggttcttagccaggtccttg

SEQ ID NO: 477136 - DNA, 25 bp, Mus musculus
tctgaggttgagatgcctttggcat

SEQ ID NO: 477137 - DNA, 25 bp, Mus musculus
tctgaggtttttgagactatctgca

SEQ ID NO: 477138 - DNA, 25 bp, Mus musculus
tctgagtaccctgcaaagaagtgtc

SEQ ID NO: 477139 - DNA, 25 bp, Mus musculus
tctgagtacctgcatgctgggcacg

SEQ ID NO: 477140 - DNA, 25 bp, Mus musculus
tctgagtactgagcaaagccacctg

SEQ ID NO: 477141 - DNA, 25 bp, Mus musculus
tctgagtatagccaagtgccaccag

SEQ ID NO: 477142 - DNA, 25 bp, Mus musculus
tctgagtatctcaaggccactgtgg

SEQ ID NO: 477143 - DNA, 25 bp, Mus musculus
tctgagtcctcgctcaagtggctgg

SEQ ID NO: 477144 - DNA, 25 bp, Mus musculus
tctgagtcctggaacagtctgccca

SEQ ID NO: 477145 - DNA, 25 bp, Mus musculus
tctgagtctagaacctgtcccaggc

SEQ ID NO: 477146 - DNA, 25 bp, Mus musculus
tctgagtctcccaaagtccccttta

SEQ ID NO: 477147 - DNA, 25 bp, Mus musculus
tctgagtgacatggcaccgaatgcc

SEQ ID NO: 477148 - DNA, 25 bp, Mus musculus
tctgagtgaccaaaggcagtagcgc

SEQ ID NO: 477149 - DNA, 25 bp, Mus musculus
tctgagtgactcgtgtttcccgggt

SEQ ID NO: 477150 - DNA, 25 bp, Mus musculus
tctgagtgagcacaacgtagcgtcc

SEQ ID NO: 477151 - DNA, 25 bp, Mus musculus
tctgagtgattcagccaatggcaaa

SEQ ID NO: 477152 - DNA, 25 bp, Mus musculus
tctgagtgccatcaccttttaggat

SEQ ID NO: 477153 - DNA, 25 bp, Mus musculus
tctgagtgccatttcccaaaggtac

SEQ ID NO: 477154 - DNA, 25 bp, Mus musculus
tctgagtgcctgacaaagtgaacgc

SEQ ID NO: 477155 - DNA, 25 bp, Mus musculus
tctgagttcacaacggacagcctgg

SEQ ID NO: 477156 - DNA, 25 bp, Mus musculus
tctgagttccaattcggatgctggc

SEQ ID NO: 477157 - DNA, 25 bp, Mus musculus
tctgagttctgaaaacaggccccgc

SEQ ID NO: 477158 - DNA, 25 bp, Mus musculus
tctgagttgctgtttggtacatcca

SEQ ID NO: 477159 - DNA, 25 bp, Mus musculus
tctgagttggaacaggacctctgtt

SEQ ID NO: 477160 - DNA, 25 bp, Mus musculus
tctgagtttaacatttagcatgggt

SEQ ID NO: 477161 - DNA, 25 bp, Mus musculus
tctgagtttcctccatcatgatgtc

SEQ ID NO: 477162 - DNA, 25 bp, Mus musculus
tctgagtttgacaagcgcacactgc

SEQ ID NO: 477163 - DNA, 25 bp, Mus musculus
tctgataacagagctgactgcccct

SEQ ID NO: 477164 - DNA, 25 bp, Mus musculus
tctgataacgtgttattaacagggc

SEQ ID NO: 477165 - DNA, 25 bp, Mus musculus
tctgataagagctggagcccaatcc

SEQ ID NO: 477166 - DNA, 25 bp, Mus musculus
tctgataagtgagctgcaacctggg

SEQ ID NO: 477167 - DNA, 25 bp, Mus musculus
tctgatacatctggccaaactctgg

SEQ ID NO: 477168 - DNA, 25 bp, Mus musculus
tctgataccagctgtccgcaggagg

SEQ ID NO: 477169 - DNA, 25 bp, Mus musculus
tctgataccctgagagaagtcactg

SEQ ID NO: 477170 - DNA, 25 bp, Mus musculus
tctgatagagaaagaatgcacggct

SEQ ID NO: 477171 - DNA, 25 bp, Mus musculus
tctgatagcgtgcagcttgttgcct

SEQ ID NO: 477172 - DNA, 25 bp, Mus musculus
tctgatagctgcagtaggtagggct

SEQ ID NO: 477173 - DNA, 25 bp, Mus musculus
tctgataggattgcaccaggtccct

SEQ ID NO: 477174 - DNA, 25 bp, Mus musculus
tctgatagggatgtatgggcctcca

SEQ ID NO: 477175 - DNA, 25 bp, Mus musculus
tctgatagtgtgagagtctggacca

SEQ ID NO: 477176 - DNA, 25 bp, Mus musculus
tctgatcagagatttcactgttcct

SEQ ID NO: 477177 - DNA, 25 bp, Mus musculus
tctgatcagttttacctctgggaat

SEQ ID NO: 477178 - DNA, 25 bp, Mus musculus
tctgatcatgtgctttggacctggg

SEQ ID NO: 477179 - DNA, 25 bp, Mus musculus
tctgatccaagcagtttagtccagc

SEQ ID NO: 477180 - DNA, 25 bp, Mus musculus
tctgatccagagtccagaagggctg

SEQ ID NO: 477181 - DNA, 25 bp, Mus musculus
tctgatccatggagaagtggtgcat

SEQ ID NO: 477182 - DNA, 25 bp, Mus musculus
tctgatccattccaggtaagctgtc

SEQ ID NO: 477183 - DNA, 25 bp, Mus musculus
tctgatcccagcacaacgagtcgtg

SEQ ID NO: 477184 - DNA, 25 bp, Mus musculus
tctgatccccttaaactgaatgatc

SEQ ID NO: 477185 - DNA, 25 bp, Mus musculus
tctgatcgagacaggccctagagga

SEQ ID NO: 477186 - DNA, 25 bp, Mus musculus
tctgatcggaaggaggctgagaatc

SEQ ID NO: 477187 - DNA, 25 bp, Mus musculus
tctgatcggactcatacaggtcggc

SEQ ID NO: 477188 - DNA, 25 bp, Mus musculus
tctgatcgtaaagtggtgcttttgc

SEQ ID NO: 477189 - DNA, 25 bp, Mus musculus
tctgatctctaagaatgtctgggag

SEQ ID NO: 477190 - DNA, 25 bp, Mus musculus
tctgatctgccggaaaggaacactt

SEQ ID NO: 477191 - DNA, 25 bp, Mus musculus
tctgatctggaccaagtcggaacag

SEQ ID NO: 477192 - DNA, 25 bp, Mus musculus
tctgatctggtgtttgtgctgggcc

SEQ ID NO: 477193 - DNA, 25 bp, Mus musculus
tctgatctgtccctgtgacgcagtc

SEQ ID NO: 477194 - DNA, 25 bp, Mus musculus
tctgatcttcacatttgtccccact

SEQ ID NO: 477195 - DNA, 25 bp, Mus musculus
tctgatgaaacaggaaatcatattc

SEQ ID NO: 477196 - DNA, 25 bp, Mus musculus
tctgatgaaaggactggcccagggt

SEQ ID NO: 477197 - DNA, 25 bp, Mus musculus
tctgatgaaaggagcactgtggaac

SEQ ID NO: 477198 - DNA, 25 bp, Mus musculus
tctgatgacacagtaatagaggaca

SEQ ID NO: 477199 - DNA, 25 bp, Mus musculus
tctgatgacacggtagagggcactc

SEQ ID NO: 477200 - DNA, 25 bp, Mus musculus
tctgatgagcctgtagagaagccta

SEQ ID NO: 477201 - DNA, 25 bp, Mus musculus
tctgatgagcgcctctgctgctttc

SEQ ID NO: 477202 - DNA, 25 bp, Mus musculus
tctgatgcagaggtgcaacctggca

SEQ ID NO: 477203 - DNA, 25 bp, Mus musculus
tctgatgcatatggctgaccccaag

SEQ ID NO: 477204 - DNA, 25 bp, Mus musculus
tctgatgctgaacacatggccggtc

SEQ ID NO: 477205 - DNA, 25 bp, Mus musculus
tctgatgctgctggagaccggcttg

SEQ ID NO: 477206 - DNA, 25 bp, Mus musculus
tctgatggatgccagtgtagtgcac

SEQ ID NO: 477207 - DNA, 25 bp, Mus musculus
tctgatggcaaatccaggaatcaag

SEQ ID NO: 477208 - DNA, 25 bp, Mus musculus
tctgatggcgccacctaccgggacg

SEQ ID NO: 477209 - DNA, 25 bp, Mus musculus
tctgatgggctttcacggctggacc

SEQ ID NO: 477210 - DNA, 25 bp, Mus musculus
tctgatggtctgagactgaccctca

SEQ ID NO: 477211 - DNA, 25 bp, Mus musculus
tctgatgtctgtcaggtgatgacgc

SEQ ID NO: 477212 - DNA, 25 bp, Mus musculus
tctgatgtgaccctgaggtttcttt

SEQ ID NO: 477213 - DNA, 25 bp, Mus musculus
tctgatgtgcttaacctaaattgct

SEQ ID NO: 477214 - DNA, 25 bp, Mus musculus
tctgatgtggaccttctttagccgg

SEQ ID NO: 477215 - DNA, 25 bp, Mus musculus
tctgattacttgcacctaccgaggt

SEQ ID NO: 477216 - DNA, 25 bp, Mus musculus
tctgattagcccagctagcaatggt

SEQ ID NO: 477217 - DNA, 25 bp, Mus musculus
tctgattcagaatgggcatgccctg

SEQ ID NO: 477218 - DNA, 25 bp, Mus musculus
tctgattcaggagggaacgacggaa

SEQ ID NO: 477219 - DNA, 25 bp, Mus musculus
tctgattctaagtggcaccccggct

SEQ ID NO: 477220 - DNA, 25 bp, Mus musculus
tctgattctgggtcccggaggaaga

SEQ ID NO: 477221 - DNA, 25 bp, Mus musculus
tctgattgacagactgcatggctgc

SEQ ID NO: 477222 - DNA, 25 bp, Mus musculus
tctgattgaggatcaaggcgcccag

SEQ ID NO: 477223 - DNA, 25 bp, Mus musculus
tctgattgccagcagccctcatgag

SEQ ID NO: 477224 - DNA, 25 bp, Mus musculus
tctgattttaccatggctcctgtag

SEQ ID NO: 477225 - DNA, 25 bp, Mus musculus
tctgcaaaaggagcgatggagtaag

SEQ ID NO: 477226 - DNA, 25 bp, Mus musculus
tctgcaaaccaccagtgaccaattg

SEQ ID NO: 477227 - DNA, 25 bp, Mus musculus
tctgcaaaccagagttcaccttctt

SEQ ID NO: 477228 - DNA, 25 bp, Mus musculus
tctgcaaagaaatatccatacctga

SEQ ID NO: 477229 - DNA, 25 bp, Mus musculus
tctgcaaagagttcagtctgccgcc

SEQ ID NO: 477230 - DNA, 25 bp, Mus musculus
tctgcaaaggcagctagggaattcc

SEQ ID NO: 477231 - DNA, 25 bp, Mus musculus
tctgcaaagggcagagcggtcccct

SEQ ID NO: 477232 - DNA, 25 bp, Mus musculus
tctgcaaatatatctgagggttcgt

SEQ ID NO: 477233 - DNA, 25 bp, Mus musculus
tctgcaaatcgaaaagtgtaagccc

SEQ ID NO: 477234 - DNA, 25 bp, Mus musculus
tctgcaaatgatctatttggtaacc

SEQ ID NO: 477235 - DNA, 25 bp, Mus musculus
tctgcaacaacgaagccaaggacgt

SEQ ID NO: 477236 - DNA, 25 bp, Mus musculus
tctgcaacaagattcctggcctggc

SEQ ID NO: 477237 - DNA, 25 bp, Mus musculus
tctgcaacaaggtctagatgcccgt

SEQ ID NO: 477238 - DNA, 25 bp, Mus musculus
tctgcaacagcagtacctgaattta

SEQ ID NO: 477239 - DNA, 25 bp, Mus musculus
tctgcaacagtatggccaagacgct

SEQ ID NO: 477240 - DNA, 25 bp, Mus musculus
tctgcaaccgaagagatggtcgtcc

SEQ ID NO: 477241 - DNA, 25 bp, Mus musculus
tctgcaacggccgaggctactgtga

SEQ ID NO: 477242 - DNA, 25 bp, Mus musculus
tctgcaagagcaacggctggatcct

SEQ ID NO: 477243 - DNA, 25 bp, Mus musculus
tctgcaagcaaccaaagaaatcggg

SEQ ID NO: 477244 - DNA, 25 bp, Mus musculus
tctgcaagcggagggttcacatgta

SEQ ID NO: 477245 - DNA, 25 bp, Mus musculus
tctgcaaggcagtctcaagtgcaaa

SEQ ID NO: 477246 - DNA, 25 bp, Mus musculus
tctgcaagggtagcaatcgaggaaa

SEQ ID NO: 477247 - DNA, 25 bp, Mus musculus
tctgcaaggtagaagacacctggct

SEQ ID NO: 477248 - DNA, 25 bp, Mus musculus
tctgcaatacctggtaagaaatggg

SEQ ID NO: 477249 - DNA, 25 bp, Mus musculus
tctgcaatctgaggaggcctccagc

SEQ ID NO: 477250 - DNA, 25 bp, Mus musculus
tctgcaatggatctcactgggctac

SEQ ID NO: 477251 - DNA, 25 bp, Mus musculus
tctgcaatgggaagagagcccactg

SEQ ID NO: 477252 - DNA, 25 bp, Mus musculus
tctgcacaatgggaagctgccgtcc

SEQ ID NO: 477253 - DNA, 25 bp, Mus musculus
tctgcacactgataagagcgtcttc

SEQ ID NO: 477254 - DNA, 25 bp, Mus musculus
tctgcacactgccagcctagcaatg

SEQ ID NO: 477255 - DNA, 25 bp, Mus musculus
tctgcacagaccacaagcagtgttg

SEQ ID NO: 477256 - DNA, 25 bp, Mus musculus
tctgcacagcaaacccaagaaatca

SEQ ID NO: 477257 - DNA, 25 bp, Mus musculus
tctgcacagttctacgttacgtttg

SEQ ID NO: 477258 - DNA, 25 bp, Mus musculus
tctgcacatggtgatgatattatgc

SEQ ID NO: 477259 - DNA, 25 bp, Mus musculus
tctgcacattagagacccagtaggg

SEQ ID NO: 477260 - DNA, 25 bp, Mus musculus
tctgcaccacagcacacatagcttt

SEQ ID NO: 477261 - DNA, 25 bp, Mus musculus
tctgcaccattcaagatgataaacg

SEQ ID NO: 477262 - DNA, 25 bp, Mus musculus
tctgcacctcgaagacggacgatgg

SEQ ID NO: 477263 - DNA, 25 bp, Mus musculus
tctgcacctggcagtagaagcccag

SEQ ID NO: 477264 - DNA, 25 bp, Mus musculus
tctgcacctggctcatggccaagct

SEQ ID NO: 477265 - DNA, 25 bp, Mus musculus
tctgcacgattggaaacttggacct

SEQ ID NO: 477266 - DNA, 25 bp, Mus musculus
tctgcacgtcaccatgtaaaggcca

SEQ ID NO: 477267 - DNA, 25 bp, Mus musculus
tctgcactctccatgctggctggga

SEQ ID NO: 477268 - DNA, 25 bp, Mus musculus
tctgcactctgatgggagcgtccac

SEQ ID NO: 477269 - DNA, 25 bp, Mus musculus
tctgcactgcacatccaaatgggct

SEQ ID NO: 477270 - DNA, 25 bp, Mus musculus
tctgcactggccaaaacctgtacgt

SEQ ID NO: 477271 - DNA, 25 bp, Mus musculus
tctgcactgttttgaaagcgagtac

SEQ ID NO: 477272 - DNA, 25 bp, Mus musculus
tctgcagaaaaattgtaaagatccc

SEQ ID NO: 477273 - DNA, 25 bp, Mus musculus
tctgcagaacagaccgtgtgacgct

SEQ ID NO: 477274 - DNA, 25 bp, Mus musculus
tctgcagaagaagacctacgtgacc

SEQ ID NO: 477275 - DNA, 25 bp, Mus musculus
tctgcagaagactggcagagaagag

SEQ ID NO: 477276 - DNA, 25 bp, Mus musculus
tctgcagaagcaaattgaacgccat

SEQ ID NO: 477277 - DNA, 25 bp, Mus musculus
tctgcagaagcgtctgggacctcgt

SEQ ID NO: 477278 - DNA, 25 bp, Mus musculus
tctgcagaagcttcttgaggaccag

SEQ ID NO: 477279 - DNA, 25 bp, Mus musculus
tctgcagaaggtcgtcggaaagccc

SEQ ID NO: 477280 - DNA, 25 bp, Mus musculus
tctgcagacactaaaaggattacct

SEQ ID NO: 477281 - DNA, 25 bp, Mus musculus
tctgcagacactctggtggagtttc

SEQ ID NO: 477282 - DNA, 25 bp, Mus musculus
tctgcagagacatggacggccaggt

SEQ ID NO: 477283 - DNA, 25 bp, Mus musculus
tctgcagagagacagatatcacatg

SEQ ID NO: 477284 - DNA, 25 bp, Mus musculus
tctgcagagatactatggacacagg

SEQ ID NO: 477285 - DNA, 25 bp, Mus musculus
tctgcagagctattacgatcaaggg

SEQ ID NO: 477286 - DNA, 25 bp, Mus musculus
tctgcagagcttaagaggcgccctt

SEQ ID NO: 477287 - DNA, 25 bp, Mus musculus
tctgcagaggagagccaatgcattc

SEQ ID NO: 477288 - DNA, 25 bp, Mus musculus
tctgcagaggagagctgcatagccg

SEQ ID NO: 477289 - DNA, 25 bp, Mus musculus
tctgcagaggtttgctccagcaagc

SEQ ID NO: 477290 - DNA, 25 bp, Mus musculus
tctgcagatccctggcaaacaggcc

SEQ ID NO: 477291 - DNA, 25 bp, Mus musculus
tctgcagatcctgccctgtaagggt

SEQ ID NO: 477292 - DNA, 25 bp, Mus musculus
tctgcagatctccatagcctttggc

SEQ ID NO: 477293 - DNA, 25 bp, Mus musculus
tctgcagatggttggaacctgcctg

SEQ ID NO: 477294 - DNA, 25 bp, Mus musculus
tctgcagcagtcatgttgaaaacct

SEQ ID NO: 477295 - DNA, 25 bp, Mus musculus
tctgcagcagttgatccgataaggc

SEQ ID NO: 477296 - DNA, 25 bp, Mus musculus
tctgcagccagagtacttgcaagca

SEQ ID NO: 477297 - DNA, 25 bp, Mus musculus
tctgcagcccgagaaaggaaagcca

SEQ ID NO: 477298 - DNA, 25 bp, Mus musculus
tctgcagccgaagcacagggcatga

SEQ ID NO: 477299 - DNA, 25 bp, Mus musculus
tctgcagcctgagaactggaggtcc

SEQ ID NO: 477300 - DNA, 25 bp, Mus musculus
tctgcagcctgctaatgcctctctg

SEQ ID NO: 477301 - DNA, 25 bp, Mus musculus
tctgcagcctgcttgataacatggg

SEQ ID NO: 477302 - DNA, 25 bp, Mus musculus
tctgcagcggctgtgcgttcgggtc

SEQ ID NO: 477303 - DNA, 25 bp, Mus musculus
tctgcagcgtccactttcagggcgg

SEQ ID NO: 477304 - DNA, 25 bp, Mus musculus
tctgcagctgatcatggtgtccacg

SEQ ID NO: 477305 - DNA, 25 bp, Mus musculus
tctgcaggaaagactagggaaggcc

SEQ ID NO: 477306 - DNA, 25 bp, Mus musculus
tctgcaggaagctagcctatggcgt

SEQ ID NO: 477307 - DNA, 25 bp, Mus musculus
tctgcaggacagcttcgaatacatt

SEQ ID NO: 477308 - DNA, 25 bp, Mus musculus
tctgcaggctcagacgagggtaccg

SEQ ID NO: 477309 - DNA, 25 bp, Mus musculus
tctgcagggaaggagctaaagtatt

SEQ ID NO: 477310 - DNA, 25 bp, Mus musculus
tctgcagggcaagtagaaccttctc

SEQ ID NO: 477311 - DNA, 25 bp, Mus musculus
tctgcaggtgtaccgagagaagcct

SEQ ID NO: 477312 - DNA, 25 bp, Mus musculus
tctgcagtcttcacaccttattagg

SEQ ID NO: 477313 - DNA, 25 bp, Mus musculus
tctgcagtgacttcaagaccatttg

SEQ ID NO: 477314 - DNA, 25 bp, Mus musculus
tctgcagttcagcattgatgggccg

SEQ ID NO: 477315 - DNA, 25 bp, Mus musculus
tctgcataaaatctgggaacaggcc

SEQ ID NO: 477316 - DNA, 25 bp, Mus musculus
tctgcataaccatctacgggaaggt

SEQ ID NO: 477317 - DNA, 25 bp, Mus musculus
tctgcataatctgccgggcttctgg

SEQ ID NO: 477318 - DNA, 25 bp, Mus musculus
tctgcatacccataagaatggctgg

SEQ ID NO: 477319 - DNA, 25 bp, Mus musculus
tctgcatcacccagtatgataaact

SEQ ID NO: 477320 - DNA, 25 bp, Mus musculus
tctgcatcagaagcaaacgtaagca

SEQ ID NO: 477321 - DNA, 25 bp, Mus musculus
tctgcatccaccattggcccagagg

SEQ ID NO: 477322 - DNA, 25 bp, Mus musculus
tctgcatcgagttcagggtagtgct

SEQ ID NO: 477323 - DNA, 25 bp, Mus musculus
tctgcatcgcggtcaatagtaggag

SEQ ID NO: 477324 - DNA, 25 bp, Mus musculus
tctgcatcgctgtggtagctgtgac

SEQ ID NO: 477325 - DNA, 25 bp, Mus musculus
tctgcatctacagggaacgttcctc

SEQ ID NO: 477326 - DNA, 25 bp, Mus musculus
tctgcatgaaagaacaactgggtgg

SEQ ID NO: 477327 - DNA, 25 bp, Mus musculus
tctgcatgcgtctacaaatggcgtg

SEQ ID NO: 477328 - DNA, 25 bp, Mus musculus
tctgcatgcgtgtgcaaccgggtcc

SEQ ID NO: 477329 - DNA, 25 bp, Mus musculus
tctgcatggaacaggtcaagcactc

SEQ ID NO: 477330 - DNA, 25 bp, Mus musculus
tctgcatggcatacaattagggtaa

SEQ ID NO: 477331 - DNA, 25 bp, Mus musculus
tctgcatggtcacgaaggagtgctc

SEQ ID NO: 477332 - DNA, 25 bp, Mus musculus
tctgcatgtagggttaaggcctcag

SEQ ID NO: 477333 - DNA, 25 bp, Mus musculus
tctgcattctggaagtgaagcccca

SEQ ID NO: 477334 - DNA, 25 bp, Mus musculus
tctgcattctgttcaggtgataaca

SEQ ID NO: 477335 - DNA, 25 bp, Mus musculus
tctgcattggatctgaactgaacgc

SEQ ID NO: 477336 - DNA, 25 bp, Mus musculus
tctgcatttttcacggccataaccc

SEQ ID NO: 477337 - DNA, 25 bp, Mus musculus
tctgccaaagcatgagcggctggtc

SEQ ID NO: 477338 - DNA, 25 bp, Mus musculus
tctgccaaatgctaggacttcctga

SEQ ID NO: 477339 - DNA, 25 bp, Mus musculus
tctgccaacatgtgaaatcctaggt

SEQ ID NO: 477340 - DNA, 25 bp, Mus musculus
tctgccaagaaatgggtgagtggtc

SEQ ID NO: 477341 - DNA, 25 bp, Mus musculus
tctgccaagatctgtgtgggtaagg

SEQ ID NO: 477342 - DNA, 25 bp, Mus musculus
tctgccaagcccgtttttactgagg

SEQ ID NO: 477343 - DNA, 25 bp, Mus musculus
tctgccaaggctaagaagatgggct

SEQ ID NO: 477344 - DNA, 25 bp, Mus musculus
tctgccaagtgttagggactcccaa

SEQ ID NO: 477345 - DNA, 25 bp, Mus musculus
tctgccaatgatccctttcctgttg

SEQ ID NO: 477346 - DNA, 25 bp, Mus musculus
tctgccaattctgtaccatgtaagg

SEQ ID NO: 477347 - DNA, 25 bp, Mus musculus
tctgccaccatggaaaaccgaaaag

SEQ ID NO: 477348 - DNA, 25 bp, Mus musculus
tctgccaccccaaaatgaactagga

SEQ ID NO: 477349 - DNA, 25 bp, Mus musculus
tctgccactcctatgactctgcggg

SEQ ID NO: 477350 - DNA, 25 bp, Mus musculus
tctgccagaattagcaagacttgga

SEQ ID NO: 477351 - DNA, 25 bp, Mus musculus
tctgccagagagaaaagagacttct

SEQ ID NO: 477352 - DNA, 25 bp, Mus musculus
tctgccagcaatggaattggaggct

SEQ ID NO: 477353 - DNA, 25 bp, Mus musculus
tctgccagcaggtggtccgtaaagt

SEQ ID NO: 477354 - DNA, 25 bp, Mus musculus
tctgccaggaggaaaaggccaacca

SEQ ID NO: 477355 - DNA, 25 bp, Mus musculus
tctgccaggtcaacaaggactgctt

SEQ ID NO: 477356 - DNA, 25 bp, Mus musculus
tctgccagtaaaacgaggaccacca

SEQ ID NO: 477357 - DNA, 25 bp, Mus musculus
tctgccagtgcggaaggaagacttc

SEQ ID NO: 477358 - DNA, 25 bp, Mus musculus
tctgccatgaacttgagagataccg

SEQ ID NO: 477359 - DNA, 25 bp, Mus musculus
tctgccatgatagggaatctgaggc

SEQ ID NO: 477360 - DNA, 25 bp, Mus musculus
tctgccatggatcacttagtttctg

SEQ ID NO: 477361 - DNA, 25 bp, Mus musculus
tctgccattccgttgcttcttaggg

SEQ ID NO: 477362 - DNA, 25 bp, Mus musculus
tctgcccaagaagagggacatggaa

SEQ ID NO: 477363 - DNA, 25 bp, Mus musculus
tctgcccacataccttcgcaaggag

SEQ ID NO: 477364 - DNA, 25 bp, Mus musculus
tctgcccacattatgaaagcccagg

SEQ ID NO: 477365 - DNA, 25 bp, Mus musculus
tctgcccaccgaagggtctggtttc

SEQ ID NO: 477366 - DNA, 25 bp, Mus musculus
tctgcccagcagagacctatgggac

SEQ ID NO: 477367 - DNA, 25 bp, Mus musculus
tctgcccatagggagcctgctggga

SEQ ID NO: 477368 - DNA, 25 bp, Mus musculus
tctgcccatggaaagagcatctaag

SEQ ID NO: 477369 - DNA, 25 bp, Mus musculus
tctgccccaacatatgaactgcctg

SEQ ID NO: 477370 - DNA, 25 bp, Mus musculus
tctgccccagggtaggtgacatgtg

SEQ ID NO: 477371 - DNA, 25 bp, Mus musculus
tctgccccggcactggaagagttgt

SEQ ID NO: 477372 - DNA, 25 bp, Mus musculus
tctgccccgttgaatggagtttgct

SEQ ID NO: 477373 - DNA, 25 bp, Mus musculus
tctgcccgacatccgattagaagag

SEQ ID NO: 477374 - DNA, 25 bp, Mus musculus
tctgccctaaggacactcgttgcta

SEQ ID NO: 477375 - DNA, 25 bp, Mus musculus
tctgccctcctaggatggtggtgaa

SEQ ID NO: 477376 - DNA, 25 bp, Mus musculus
tctgccctctggcaaagtaactggg

SEQ ID NO: 477377 - DNA, 25 bp, Mus musculus
tctgccctctgtaccttcagcagga

SEQ ID NO: 477378 - DNA, 25 bp, Mus musculus
tctgccctgagcctctgcagagatg

SEQ ID NO: 477379 - DNA, 25 bp, Mus musculus
tctgccctgggtggaaagtatgagt

SEQ ID NO: 477380 - DNA, 25 bp, Mus musculus
tctgccctgtgggaggaaagttcta

SEQ ID NO: 477381 - DNA, 25 bp, Mus musculus
tctgcccttcaggatgagctttctc

SEQ ID NO: 477382 - DNA, 25 bp, Mus musculus
tctgcccttctatggctggacagga

SEQ ID NO: 477383 - DNA, 25 bp, Mus musculus
tctgcccttgaagaatgactgctct

SEQ ID NO: 477384 - DNA, 25 bp, Mus musculus
tctgccgaagcgcagagccgccttg

SEQ ID NO: 477385 - DNA, 25 bp, Mus musculus
tctgccgacccctacttaactctgg

SEQ ID NO: 477386 - DNA, 25 bp, Mus musculus
tctgccgacgatcaaatggaagccc

SEQ ID NO: 477387 - DNA, 25 bp, Mus musculus
tctgccgaggtaccgagaggaactt

SEQ ID NO: 477388 - DNA, 25 bp, Mus musculus
tctgccgagtacagctgcctcaaag

SEQ ID NO: 477389 - DNA, 25 bp, Mus musculus
tctgccgagtcgtctgtgtaaaagc

SEQ ID NO: 477390 - DNA, 25 bp, Mus musculus
tctgccgcagactttgtggtgctcg

SEQ ID NO: 477391 - DNA, 25 bp, Mus musculus
tctgccgcgggtttaggatctcctt

SEQ ID NO: 477392 - DNA, 25 bp, Mus musculus
tctgccgctggaacctgaagcacaa

SEQ ID NO: 477393 - DNA, 25 bp, Mus musculus
tctgccgggctgtcaaatatctaca

SEQ ID NO: 477394 - DNA, 25 bp, Mus musculus
tctgccgggctgtcagtcactgaat

SEQ ID NO: 477395 - DNA, 25 bp, Mus musculus
tctgccgggttctggaaaggccgct

SEQ ID NO: 477396 - DNA, 25 bp, Mus musculus
tctgccggtctggaggtagatagct

SEQ ID NO: 477397 - DNA, 25 bp, Mus musculus
tctgccggtttaagttgtgtgctcg

SEQ ID NO: 477398 - DNA, 25 bp, Mus musculus
tctgccgtcaggacaaagccaatgc

SEQ ID NO: 477399 - DNA, 25 bp, Mus musculus
tctgccgtgtttattggcttgtgca

SEQ ID NO: 477400 - DNA, 25 bp, Mus musculus
tctgcctaaggcacaccgtaggacc

SEQ ID NO: 477401 - DNA, 25 bp, Mus musculus
tctgcctaagtgagttcaaagaaac

SEQ ID NO: 477402 - DNA, 25 bp, Mus musculus
tctgcctacaataaccactgaaacg

SEQ ID NO: 477403 - DNA, 25 bp, Mus musculus
tctgcctagtataacagaaatggcc

SEQ ID NO: 477404 - DNA, 25 bp, Mus musculus
tctgcctcagaagtcagtgcgaccg

SEQ ID NO: 477405 - DNA, 25 bp, Mus musculus
tctgcctccatgctcacacgaatgt

SEQ ID NO: 477406 - DNA, 25 bp, Mus musculus
tctgcctcgaagacatgccgttggg

SEQ ID NO: 477407 - DNA, 25 bp, Mus musculus
tctgcctcgtgagatgattattttc

SEQ ID NO: 477408 - DNA, 25 bp, Mus musculus
tctgcctctaaagaccttgcaagaa

SEQ ID NO: 477409 - DNA, 25 bp, Mus musculus
tctgcctctgtgactccagtgtgga

SEQ ID NO: 477410 - DNA, 25 bp, Mus musculus
tctgcctgaagactattacacgcgg

SEQ ID NO: 477411 - DNA, 25 bp, Mus musculus
tctgcctgaaggatgacgtcatgct

SEQ ID NO: 477412 - DNA, 25 bp, Mus musculus
tctgcctgaccgtgagggagcctgt

SEQ ID NO: 477413 - DNA, 25 bp, Mus musculus
tctgcctgagaggactctatccaga

SEQ ID NO: 477414 - DNA, 25 bp, Mus musculus
tctgcctgagtaggtagctgcccgg

SEQ ID NO: 477415 - DNA, 25 bp, Mus musculus
tctgcctgatgagggacaaagctca

SEQ ID NO: 477416 - DNA, 25 bp, Mus musculus
tctgcctgccgagaggactagactg

SEQ ID NO: 477417 - DNA, 25 bp, Mus musculus
tctgcctgccgatgagattcccaag

SEQ ID NO: 477418 - DNA, 25 bp, Mus musculus
tctgcctgctatggagcctgggccg

SEQ ID NO: 477419 - DNA, 25 bp, Mus musculus
tctgcctggatactaaagaggccac

SEQ ID NO: 477420 - DNA, 25 bp, Mus musculus
tctgcctggattacctgagggaccc

SEQ ID NO: 477421 - DNA, 25 bp, Mus musculus
tctgcctggcaaagcttttaattgg

SEQ ID NO: 477422 - DNA, 25 bp, Mus musculus
tctgcctgtcagctctacccaaagg

SEQ ID NO: 477423 - DNA, 25 bp, Mus musculus
tctgcctgtggctcgtgggacattc

SEQ ID NO: 477424 - DNA, 25 bp, Mus musculus
tctgccttaggaattagagtgggtg

SEQ ID NO: 477425 - DNA, 25 bp, Mus musculus
tctgccttaggtaaagctgcgctgc

SEQ ID NO: 477426 - DNA, 25 bp, Mus musculus
tctgccttccaactttctatttgag

SEQ ID NO: 477427 - DNA, 25 bp, Mus musculus
tctgccttctcggaaacggctgcag

SEQ ID NO: 477428 - DNA, 25 bp, Mus musculus
tctgccttctctactgtgggctcat

SEQ ID NO: 477429 - DNA, 25 bp, Mus musculus
tctgcctttttgattctgggaagtc

SEQ ID NO: 477430 - DNA, 25 bp, Mus musculus
tctgcgaacagagcatcgagacgct

SEQ ID NO: 477431 - DNA, 25 bp, Mus musculus
tctgcgaatcgctcctgcagcaaag

SEQ ID NO: 477432 - DNA, 25 bp, Mus musculus
tctgcgacatcattgggtgttgtcc

SEQ ID NO: 477433 - DNA, 25 bp, Mus musculus
tctgcgacatctaaataatcaaggc

SEQ ID NO: 477434 - DNA, 25 bp, Mus musculus
tctgcgaccggcttgaagctggctg

SEQ ID NO: 477435 - DNA, 25 bp, Mus musculus
tctgcgagacactttggccacttgg

SEQ ID NO: 477436 - DNA, 25 bp, Mus musculus
tctgcgaggccctcgaaagggacca

SEQ ID NO: 477437 - DNA, 25 bp, Mus musculus
tctgcgatgcagacccctttcaaat

SEQ ID NO: 477438 - DNA, 25 bp, Mus musculus
tctgcgatgtcccaaggaaaaacct

SEQ ID NO: 477439 - DNA, 25 bp, Mus musculus
tctgcgcaagaagaaaccctatggg

SEQ ID NO: 477440 - DNA, 25 bp, Mus musculus
tctgcgccaccacaaactaggtttg

SEQ ID NO: 477441 - DNA, 25 bp, Mus musculus
tctgcgccagacatggtgtacttgg

SEQ ID NO: 477442 - DNA, 25 bp, Mus musculus
tctgcgccatatcgctggaccggta

SEQ ID NO: 477443 - DNA, 25 bp, Mus musculus
tctgcgcccctgctagatcttctgg

SEQ ID NO: 477444 - DNA, 25 bp, Mus musculus
tctgcgccttgagatgagtctgcca

SEQ ID NO: 477445 - DNA, 25 bp, Mus musculus
tctgcgccttggtggtgaaaaactc

SEQ ID NO: 477446 - DNA, 25 bp, Mus musculus
tctgcgctccccagcgtacaattta

SEQ ID NO: 477447 - DNA, 25 bp, Mus musculus
tctgcgctgcagcttgtccgtagga

SEQ ID NO: 477448 - DNA, 25 bp, Mus musculus
tctgcgctgttggactttgtagaac

SEQ ID NO: 477449 - DNA, 25 bp, Mus musculus
tctgcggagcttggagaaggtaccc

SEQ ID NO: 477450 - DNA, 25 bp, Mus musculus
tctgcggaggcaacatgtaccggct

SEQ ID NO: 477451 - DNA, 25 bp, Mus musculus
tctgcggattatatcgctggaatgc

SEQ ID NO: 477452 - DNA, 25 bp, Mus musculus
tctgcggccctcctggtgaatgctg

SEQ ID NO: 477453 - DNA, 25 bp, Mus musculus
tctgcggccgcgagcaaagtttgca

SEQ ID NO: 477454 - DNA, 25 bp, Mus musculus
tctgcggctgatgtggataaaaggc

SEQ ID NO: 477455 - DNA, 25 bp, Mus musculus
tctgcggctgtttgaactgcttttc

SEQ ID NO: 477456 - DNA, 25 bp, Mus musculus
tctgcgggcgcagagtctctgagtc

SEQ ID NO: 477457 - DNA, 25 bp, Mus musculus
tctgcgtcaacggatacggctggca

SEQ ID NO: 477458 - DNA, 25 bp, Mus musculus
tctgcgtcagtcagccaggacatga

SEQ ID NO: 477459 - DNA, 25 bp, Mus musculus
tctgcgtccctcaagaacgttgccg

SEQ ID NO: 477460 - DNA, 25 bp, Mus musculus
tctgcgtctgttttggatgtaccac

SEQ ID NO: 477461 - DNA, 25 bp, Mus musculus
tctgcgtgacagagctcggcgcttt

SEQ ID NO: 477462 - DNA, 25 bp, Mus musculus
tctgcgtggctttgacgagcttctg

SEQ ID NO: 477463 - DNA, 25 bp, Mus musculus
tctgcgtggtcagggacgagttctc

SEQ ID NO: 477464 - DNA, 25 bp, Mus musculus
tctgcgttgcagactgagattgcca

SEQ ID NO: 477465 - DNA, 25 bp, Mus musculus
tctgctaaagcatccgagagtccgg

SEQ ID NO: 477466 - DNA, 25 bp, Mus musculus
tctgctaacccggattcaaaaggtg

SEQ ID NO: 477467 - DNA, 25 bp, Mus musculus
tctgctaactattggcccctctgca

SEQ ID NO: 477468 - DNA, 25 bp, Mus musculus
tctgctaaggcagcggatgaccctg

SEQ ID NO: 477469 - DNA, 25 bp, Mus musculus
tctgctaagtacagggttaccgggc

SEQ ID NO: 477470 - DNA, 25 bp, Mus musculus
tctgctaagtccacccctctgtact

SEQ ID NO: 477471 - DNA, 25 bp, Mus musculus
tctgctaattatcctgttggtctgg

SEQ ID NO: 477472 - DNA, 25 bp, Mus musculus
tctgctacagcgactcagatgcggt

SEQ ID NO: 477473 - DNA, 25 bp, Mus musculus
tctgctacgcgtcaaacgcctggag

SEQ ID NO: 477474 - DNA, 25 bp, Mus musculus
tctgctactgaagacaatatggcca

SEQ ID NO: 477475 - DNA, 25 bp, Mus musculus
tctgctagcccaaaggattcgaaag

SEQ ID NO: 477476 - DNA, 25 bp, Mus musculus
tctgctagccggtgatcgagccttc

SEQ ID NO: 477477 - DNA, 25 bp, Mus musculus
tctgctagcgagatgcatatcacct

SEQ ID NO: 477478 - DNA, 25 bp, Mus musculus
tctgctagtctgttggcgagcccgt

SEQ ID NO: 477479 - DNA, 25 bp, Mus musculus
tctgctatagcacagtcccttagac

SEQ ID NO: 477480 - DNA, 25 bp, Mus musculus
tctgctcaaagtcacggatggctct

SEQ ID NO: 477481 - DNA, 25 bp, Mus musculus
tctgctcaaagtccaagaggaatac

SEQ ID NO: 477482 - DNA, 25 bp, Mus musculus
tctgctcaaggaatacggaggcctg

SEQ ID NO: 477483 - DNA, 25 bp, Mus musculus
tctgctcacccgtttggagctggtg

SEQ ID NO: 477484 - DNA, 25 bp, Mus musculus
tctgctcacttatggtgaaattatc

SEQ ID NO: 477485 - DNA, 25 bp, Mus musculus
tctgctcagagacaatgttgccggg

SEQ ID NO: 477486 - DNA, 25 bp, Mus musculus
tctgctcagagcattactggccctt

SEQ ID NO: 477487 - DNA, 25 bp, Mus musculus
tctgctcagctaagtgccgaaagga

SEQ ID NO: 477488 - DNA, 25 bp, Mus musculus
tctgctcagctctcgccaggagttg

SEQ ID NO: 477489 - DNA, 25 bp, Mus musculus
tctgctcagggtagaggaccacgac

SEQ ID NO: 477490 - DNA, 25 bp, Mus musculus
tctgctcatgtcagaacagaggctg

SEQ ID NO: 477491 - DNA, 25 bp, Mus musculus
tctgctccgagccatcttctacgtg

SEQ ID NO: 477492 - DNA, 25 bp, Mus musculus
tctgctcctctgtcgttggaggcag

SEQ ID NO: 477493 - DNA, 25 bp, Mus musculus
tctgctcgcgttttccgcaaccgta

SEQ ID NO: 477494 - DNA, 25 bp, Mus musculus
tctgctcgggatctcatgaaggtgc

SEQ ID NO: 477495 - DNA, 25 bp, Mus musculus
tctgctcgtcgagtgccgggacatt

SEQ ID NO: 477496 - DNA, 25 bp, Mus musculus
tctgctctcagttcaagagcactgg

SEQ ID NO: 477497 - DNA, 25 bp, Mus musculus
tctgctctccttggcactctgtgga

SEQ ID NO: 477498 - DNA, 25 bp, Mus musculus
tctgctctgccttgcctacacagtg

SEQ ID NO: 477499 - DNA, 25 bp, Mus musculus
tctgctctgcgatgctactgggaga

SEQ ID NO: 477500 - DNA, 25 bp, Mus musculus
tctgctctggatcaagagggtcacc

SEQ ID NO: 477501 - DNA, 25 bp, Mus musculus
tctgctctgggagggtctctccgct

SEQ ID NO: 477502 - DNA, 25 bp, Mus musculus
tctgctctgtcctgaccagcatggg

SEQ ID NO: 477503 - DNA, 25 bp, Mus musculus
tctgctctgttaaaggccgaaaggg

SEQ ID NO: 477504 - DNA, 25 bp, Mus musculus
tctgctcttgccatggtaagtagta

SEQ ID NO: 477505 - DNA, 25 bp, Mus musculus
tctgctgaaaataggactgacattt

SEQ ID NO: 477506 - DNA, 25 bp, Mus musculus
tctgctgaagtttatggcccctggg

SEQ ID NO: 477507 - DNA, 25 bp, Mus musculus
tctgctgaccaataggatttcctac

SEQ ID NO: 477508 - DNA, 25 bp, Mus musculus
tctgctgacccagcaaggctctggg

SEQ ID NO: 477509 - DNA, 25 bp, Mus musculus
tctgctgacctacccaatactggaa

SEQ ID NO: 477510 - DNA, 25 bp, Mus musculus
tctgctgactttgggcattaaagag

SEQ ID NO: 477511 - DNA, 25 bp, Mus musculus
tctgctgagagatggagccacggct

SEQ ID NO: 477512 - DNA, 25 bp, Mus musculus
tctgctgaggcagcttatccagtgt

SEQ ID NO: 477513 - DNA, 25 bp, Mus musculus
tctgctgagggtagaaacatcttct

SEQ ID NO: 477514 - DNA, 25 bp, Mus musculus
tctgctgaggtgaactttagtacca

SEQ ID NO: 477515 - DNA, 25 bp, Mus musculus
tctgctgatgagacccagcgctaat

SEQ ID NO: 477516 - DNA, 25 bp, Mus musculus
tctgctgcacttagcagccagggaa

SEQ ID NO: 477517 - DNA, 25 bp, Mus musculus
tctgctgcagacatggtagtgttcc

SEQ ID NO: 477518 - DNA, 25 bp, Mus musculus
tctgctgcagactagggctgagtga

SEQ ID NO: 477519 - DNA, 25 bp, Mus musculus
tctgctgcagccgtcatcgtctatg

SEQ ID NO: 477520 - DNA, 25 bp, Mus musculus
tctgctgcagtaaaacactgaaggc

SEQ ID NO: 477521 - DNA, 25 bp, Mus musculus
tctgctgccgtttaggatccggttc

SEQ ID NO: 477522 - DNA, 25 bp, Mus musculus
tctgctgcttctaaaacatgaatgg

SEQ ID NO: 477523 - DNA, 25 bp, Mus musculus
tctgctgcttgagttgcctgatgct

SEQ ID NO: 477524 - DNA, 25 bp, Mus musculus
tctgctgcttggaactcattggcca

SEQ ID NO: 477525 - DNA, 25 bp, Mus musculus
tctgctgctttgcactgaggaagcg

SEQ ID NO: 477526 - DNA, 25 bp, Mus musculus
tctgctggatgtcttctgggcttgc

SEQ ID NO: 477527 - DNA, 25 bp, Mus musculus
tctgctggcacgcaagaagactgct

SEQ ID NO: 477528 - DNA, 25 bp, Mus musculus
tctgctggcagacaccctgtacttt

SEQ ID NO: 477529 - DNA, 25 bp, Mus musculus
tctgctggccgtagacaaacagtgg

SEQ ID NO: 477530 - DNA, 25 bp, Mus musculus
tctgctggcgtgaagatccaagagc

SEQ ID NO: 477531 - DNA, 25 bp, Mus musculus
tctgctggctggtctattgaacaca

SEQ ID NO: 477532 - DNA, 25 bp, Mus musculus
tctgctgggcaaactaagcttccta

SEQ ID NO: 477533 - DNA, 25 bp, Mus musculus
tctgctgggcttacggttgtgtacc

SEQ ID NO: 477534 - DNA, 25 bp, Mus musculus
tctgctgggtactatgagcttgcac

SEQ ID NO: 477535 - DNA, 25 bp, Mus musculus
tctgctgtaagccaaaggactgcca

SEQ ID NO: 477536 - DNA, 25 bp, Mus musculus
tctgctgtacatcaaccctgaggcc

SEQ ID NO: 477537 - DNA, 25 bp, Mus musculus
tctgctgtcagcatcccattcggga

SEQ ID NO: 477538 - DNA, 25 bp, Mus musculus
tctgctgtcagtgcttacatgttgc

SEQ ID NO: 477539 - DNA, 25 bp, Mus musculus
tctgctgtcctcaccgaggttcctg

SEQ ID NO: 477540 - DNA, 25 bp, Mus musculus
tctgctgtgtcgtgggcacatcttt

SEQ ID NO: 477541 - DNA, 25 bp, Mus musculus
tctgctgtttatacggactgaaatg

SEQ ID NO: 477542 - DNA, 25 bp, Mus musculus
tctgcttaatgctgtgaagtagagg

SEQ ID NO: 477543 - DNA, 25 bp, Mus musculus
tctgcttacgcaatagaagagcaac

SEQ ID NO: 477544 - DNA, 25 bp, Mus musculus
tctgcttagcagatggatatcaccg

SEQ ID NO: 477545 - DNA, 25 bp, Mus musculus
tctgcttatcgctacgacggtggca

SEQ ID NO: 477546 - DNA, 25 bp, Mus musculus
tctgcttcaagctcattaggaacgg

SEQ ID NO: 477547 - DNA, 25 bp, Mus musculus
tctgcttgaggatgaaactgtccac

SEQ ID NO: 477548 - DNA, 25 bp, Mus musculus
tctgcttgcaaaggatccgccaagg

SEQ ID NO: 477549 - DNA, 25 bp, Mus musculus
tctgcttgctgtctgccggtttaag

SEQ ID NO: 477550 - DNA, 25 bp, Mus musculus
tctgcttgcttagagatggctccca

SEQ ID NO: 477551 - DNA, 25 bp, Mus musculus
tctgcttgggatgggcccctgcttt

SEQ ID NO: 477552 - DNA, 25 bp, Mus musculus
tctgctttcaagaccgccagtggca

SEQ ID NO: 477553 - DNA, 25 bp, Mus musculus
tctgctttcagacgcgtagcctggt

SEQ ID NO: 477554 - DNA, 25 bp, Mus musculus
tctgctttctaactgactgccttgg

SEQ ID NO: 477555 - DNA, 25 bp, Mus musculus
tctgctttctcctttagagtttaaa

SEQ ID NO: 477556 - DNA, 25 bp, Mus musculus
tctgctttctgtgagatctgctggg

SEQ ID NO: 477557 - DNA, 25 bp, Mus musculus
tctgctttgccatcgtcaatgtggt

SEQ ID NO: 477558 - DNA, 25 bp, Mus musculus
tctgctttgggaaaatagtaccaca

SEQ ID NO: 477559 - DNA, 25 bp, Mus musculus
tctgctttgtagagagagaagctag

SEQ ID NO: 477560 - DNA, 25 bp, Mus musculus
tctgctttgtggagccccgagatgg

SEQ ID NO: 477561 - DNA, 25 bp, Mus musculus
tctggaaaagagctgcccgagtacc

SEQ ID NO: 477562 - DNA, 25 bp, Mus musculus
tctggaaaatcgctgcaaggttggc

SEQ ID NO: 477563 - DNA, 25 bp, Mus musculus
tctggaaaatgagacaaccgggctg

SEQ ID NO: 477564 - DNA, 25 bp, Mus musculus
tctggaaacctcacttggcgtctag

SEQ ID NO: 477565 - DNA, 25 bp, Mus musculus
tctggaaacgatcaagcaagctgtg

SEQ ID NO: 477566 - DNA, 25 bp, Mus musculus
tctggaaagattgtgtaccgtgatc

SEQ ID NO: 477567 - DNA, 25 bp, Mus musculus
tctggaaagcttacttcggccgcgg

SEQ ID NO: 477568 - DNA, 25 bp, Mus musculus
tctggaaaggagtcaaaacgtctgg

SEQ ID NO: 477569 - DNA, 25 bp, Mus musculus
tctggaaataggatgtctgggcaca

SEQ ID NO: 477570 - DNA, 25 bp, Mus musculus
tctggaaatctcagcgagcttggga

SEQ ID NO: 477571 - DNA, 25 bp, Mus musculus
tctggaacaaactgcaaggagaacg

SEQ ID NO: 477572 - DNA, 25 bp, Mus musculus
tctggaacagagattgagtacggta

SEQ ID NO: 477573 - DNA, 25 bp, Mus musculus
tctggaacagagcaactcggccttg

SEQ ID NO: 477574 - DNA, 25 bp, Mus musculus
tctggaacatccaacacgacgtttg

SEQ ID NO: 477575 - DNA, 25 bp, Mus musculus
tctggaaccactggttggtggtcct

SEQ ID NO: 477576 - DNA, 25 bp, Mus musculus
tctggaacccaagtataaagagctg

SEQ ID NO: 477577 - DNA, 25 bp, Mus musculus
tctggaacctcaaggcagtggcaaa

SEQ ID NO: 477578 - DNA, 25 bp, Mus musculus
tctggaacgacagtatcacctgcgg

SEQ ID NO: 477579 - DNA, 25 bp, Mus musculus
tctggaacgcatcgagcaggcttgc

SEQ ID NO: 477580 - DNA, 25 bp, Mus musculus
tctggaactggacaaccgtatggac

SEQ ID NO: 477581 - DNA, 25 bp, Mus musculus
tctggaagaagaaaaacgacgccgg

SEQ ID NO: 477582 - DNA, 25 bp, Mus musculus
tctggaagagcttccgtcactctgg

SEQ ID NO: 477583 - DNA, 25 bp, Mus musculus
tctggaagagtcaaactacgagctg

SEQ ID NO: 477584 - DNA, 25 bp, Mus musculus
tctggaagagtccttaaagcgagcc

SEQ ID NO: 477585 - DNA, 25 bp, Mus musculus
tctggaagccgcgattgaatgtgcc

SEQ ID NO: 477586 - DNA, 25 bp, Mus musculus
tctggaagcctcgaaacctgaatat

SEQ ID NO: 477587 - DNA, 25 bp, Mus musculus
tctggaagcggaagacaacagggct

SEQ ID NO: 477588 - DNA, 25 bp, Mus musculus
tctggaagcttctgcgtgctcagcg

SEQ ID NO: 477589 - DNA, 25 bp, Mus musculus
tctggaaggaacaccactttgaggc

SEQ ID NO: 477590 - DNA, 25 bp, Mus musculus
tctggaaggatcaacgaagggtaaa

SEQ ID NO: 477591 - DNA, 25 bp, Mus musculus
tctggaaggccgagtcaacatgtct

SEQ ID NO: 477592 - DNA, 25 bp, Mus musculus
tctggaagtaaaccaagagacttag

SEQ ID NO: 477593 - DNA, 25 bp, Mus musculus
tctggaagtccatgtagacaaaggc

SEQ ID NO: 477594 - DNA, 25 bp, Mus musculus
tctggaagtccctcgtgtggtctta

SEQ ID NO: 477595 - DNA, 25 bp, Mus musculus
tctggaagtgtaatggacgctaggt

SEQ ID NO: 477596 - DNA, 25 bp, Mus musculus
tctggaataaacgatccccgtctgt

SEQ ID NO: 477597 - DNA, 25 bp, Mus musculus
tctggaataagcaaggaatatctaa

SEQ ID NO: 477598 - DNA, 25 bp, Mus musculus
tctggaatacttttccttcggtgcc

SEQ ID NO: 477599 - DNA, 25 bp, Mus musculus
tctggaatcggcatgcacttggctg

SEQ ID NO: 477600 - DNA, 25 bp, Mus musculus
tctggaatctcgacccctttgtggg

SEQ ID NO: 477601 - DNA, 25 bp, Mus musculus
tctggaatctgggatgaaatcggcc

SEQ ID NO: 477602 - DNA, 25 bp, Mus musculus
tctggaatgggtgaacaaacactgc

SEQ ID NO: 477603 - DNA, 25 bp, Mus musculus
tctggaatgtgtactctcacttggg

SEQ ID NO: 477604 - DNA, 25 bp, Mus musculus
tctggacaaacctgagccctaaggg

SEQ ID NO: 477605 - DNA, 25 bp, Mus musculus
tctggacaacaaacgaaggagcctc

SEQ ID NO: 477606 - DNA, 25 bp, Mus musculus
tctggacaagcgagaagtgcatcac

SEQ ID NO: 477607 - DNA, 25 bp, Mus musculus
tctggacaagtcatcaacacaagtg

SEQ ID NO: 477608 - DNA, 25 bp, Mus musculus
tctggacaagttcctgaggcaccgc

SEQ ID NO: 477609 - DNA, 25 bp, Mus musculus
tctggacaccaccacttcacagaag

SEQ ID NO: 477610 - DNA, 25 bp, Mus musculus
tctggacacggagcacactgagttg

SEQ ID NO: 477611 - DNA, 25 bp, Mus musculus
tctggacagcgcaatggacacggtc

SEQ ID NO: 477612 - DNA, 25 bp, Mus musculus
tctggacagttctcttggaggagcg

SEQ ID NO: 477613 - DNA, 25 bp, Mus musculus
tctggacatccaggccacaataaaa

SEQ ID NO: 477614 - DNA, 25 bp, Mus musculus
tctggacatcgatatctgtgggcca

SEQ ID NO: 477615 - DNA, 25 bp, Mus musculus
tctggacatcttggtggaacgctcc

SEQ ID NO: 477616 - DNA, 25 bp, Mus musculus
tctggacatttggaggcaccctact

SEQ ID NO: 477617 - DNA, 25 bp, Mus musculus
tctggaccaagcatctggaagcgca

SEQ ID NO: 477618 - DNA, 25 bp, Mus musculus
tctggaccacaggaaacgggaactc

SEQ ID NO: 477619 - DNA, 25 bp, Mus musculus
tctggaccagcaggtggattggaac

SEQ ID NO: 477620 - DNA, 25 bp, Mus musculus
tctggaccaggacgcagtgattgct

SEQ ID NO: 477621 - DNA, 25 bp, Mus musculus
tctggacccacgagggatatatctg

SEQ ID NO: 477622 - DNA, 25 bp, Mus musculus
tctggaccccagtgtggctgagacc

SEQ ID NO: 477623 - DNA, 25 bp, Mus musculus
tctggaccgagaggcgaaaactctt

SEQ ID NO: 477624 - DNA, 25 bp, Mus musculus
tctggaccgagcaagttaagagtcg

SEQ ID NO: 477625 - DNA, 25 bp, Mus musculus
tctggaccgagctgagcaagctgaa

SEQ ID NO: 477626 - DNA, 25 bp, Mus musculus
tctggaccgcgagagagtgtcaact

SEQ ID NO: 477627 - DNA, 25 bp, Mus musculus
tctggaccgctctgcctaaagctgc

SEQ ID NO: 477628 - DNA, 25 bp, Mus musculus
tctggaccgggagaaagaggcatct

SEQ ID NO: 477629 - DNA, 25 bp, Mus musculus
tctggaccttctgcataagctgcgg

SEQ ID NO: 477630 - DNA, 25 bp, Mus musculus
tctggacgattttgtggagctcacc

SEQ ID NO: 477631 - DNA, 25 bp, Mus musculus
tctggacgccgtacaacgtggtgct

SEQ ID NO: 477632 - DNA, 25 bp, Mus musculus
tctggacgtttagccacgtagtgcg

SEQ ID NO: 477633 - DNA, 25 bp, Mus musculus
tctggactctgctgattgttcaaag

SEQ ID NO: 477634 - DNA, 25 bp, Mus musculus
tctggactggaactgtagcctgcgc

SEQ ID NO: 477635 - DNA, 25 bp, Mus musculus
tctggacttgttggacctgctggac

SEQ ID NO: 477636 - DNA, 25 bp, Mus musculus
tctggactttaagaagcgatgcgaa

SEQ ID NO: 477637 - DNA, 25 bp, Mus musculus
tctggagaaactcgccttgacctgc

SEQ ID NO: 477638 - DNA, 25 bp, Mus musculus
tctggagaacaagggctcaagggct

SEQ ID NO: 477639 - DNA, 25 bp, Mus musculus
tctggagaacatggtcctgaaggcc

SEQ ID NO: 477640 - DNA, 25 bp, Mus musculus
tctggagaacgcagtgacaaccctg

SEQ ID NO: 477641 - DNA, 25 bp, Mus musculus
tctggagaagaagcaacactgtcct

SEQ ID NO: 477642 - DNA, 25 bp, Mus musculus
tctggagaagaagtacaacgatatc

SEQ ID NO: 477643 - DNA, 25 bp, Mus musculus
tctggagaagatcgccctggagtac

SEQ ID NO: 477644 - DNA, 25 bp, Mus musculus
tctggagaatatgaccgagggagca

SEQ ID NO: 477645 - DNA, 25 bp, Mus musculus
tctggagaatcccaagagagaggaa

SEQ ID NO: 477646 - DNA, 25 bp, Mus musculus
tctggagaatgatagagcggacacc

SEQ ID NO: 477647 - DNA, 25 bp, Mus musculus
tctggagacccacgatgtgagcaca

SEQ ID NO: 477648 - DNA, 25 bp, Mus musculus
tctggagacccttcgcctgaagctg

SEQ ID NO: 477649 - DNA, 25 bp, Mus musculus
tctggagacctggaagacctagagc

SEQ ID NO: 477650 - DNA, 25 bp, Mus musculus
tctggagactataagaaggccctgc

SEQ ID NO: 477651 - DNA, 25 bp, Mus musculus
tctggagactccacggcaagaatct

SEQ ID NO: 477652 - DNA, 25 bp, Mus musculus
tctggagagacactactcacatcag

SEQ ID NO: 477653 - DNA, 25 bp, Mus musculus
tctggagagcaaggaaccgaggcta

SEQ ID NO: 477654 - DNA, 25 bp, Mus musculus
tctggagagcttgaccgagtactgc

SEQ ID NO: 477655 - DNA, 25 bp, Mus musculus
tctggagaggcatcagttaactcac

SEQ ID NO: 477656 - DNA, 25 bp, Mus musculus
tctggagatgttgtgatggagccca

SEQ ID NO: 477657 - DNA, 25 bp, Mus musculus
tctggagcaagaactagaaagcctg

SEQ ID NO: 477658 - DNA, 25 bp, Mus musculus
tctggagcaatacgaaggcgaaagc

SEQ ID NO: 477659 - DNA, 25 bp, Mus musculus
tctggagcagtcttgaggaggccat

SEQ ID NO: 477660 - DNA, 25 bp, Mus musculus
tctggagccctaaaactgtcactga

SEQ ID NO: 477661 - DNA, 25 bp, Mus musculus
tctggagcgagctctccacaggcag

SEQ ID NO: 477662 - DNA, 25 bp, Mus musculus
tctggagcggccaaagaagagaagc

SEQ ID NO: 477663 - DNA, 25 bp, Mus musculus
tctggagctctctccggtgcagcga

SEQ ID NO: 477664 - DNA, 25 bp, Mus musculus
tctggaggaagcaatacgtgggtca

SEQ ID NO: 477665 - DNA, 25 bp, Mus musculus
tctggaggaccctgagctagccatg

SEQ ID NO: 477666 - DNA, 25 bp, Mus musculus
tctggaggcaatcagctgcgaacca

SEQ ID NO: 477667 - DNA, 25 bp, Mus musculus
tctggaggcatcacagtcaatgggc

SEQ ID NO: 477668 - DNA, 25 bp, Mus musculus
tctggaggccaacaagaatggtcct

SEQ ID NO: 477669 - DNA, 25 bp, Mus musculus
tctggagggacgagacacctctggc

SEQ ID NO: 477670 - DNA, 25 bp, Mus musculus
tctggagggagagaatcggctttct

SEQ ID NO: 477671 - DNA, 25 bp, Mus musculus
tctggagggcagcatggcttcacat

SEQ ID NO: 477672 - DNA, 25 bp, Mus musculus
tctggagggccaggtctctactgcc

SEQ ID NO: 477673 - DNA, 25 bp, Mus musculus
tctggagggtgaggacattgcctac

SEQ ID NO: 477674 - DNA, 25 bp, Mus musculus
tctggaggtagatagctgtgtctgg

SEQ ID NO: 477675 - DNA, 25 bp, Mus musculus
tctggagtaccatagctacctggag

SEQ ID NO: 477676 - DNA, 25 bp, Mus musculus
tctggagtactaatcaccgtgccgc

SEQ ID NO: 477677 - DNA, 25 bp, Mus musculus
tctggagtcacacaagagtcccctg

SEQ ID NO: 477678 - DNA, 25 bp, Mus musculus
tctggagtcagttcaaggcgagccc

SEQ ID NO: 477679 - DNA, 25 bp, Mus musculus
tctggagtcctactctgaggtcgca

SEQ ID NO: 477680 - DNA, 25 bp, Mus musculus
tctggagtccttctggaagcagctc

SEQ ID NO: 477681 - DNA, 25 bp, Mus musculus
tctggagtctccagaaagaccaaat

SEQ ID NO: 477682 - DNA, 25 bp, Mus musculus
tctggagtctgggttagtgttcact

SEQ ID NO: 477683 - DNA, 25 bp, Mus musculus
tctggataaaagcagtcttcaaatc

SEQ ID NO: 477684 - DNA, 25 bp, Mus musculus
tctggataaaatcatcggcgccgtt

SEQ ID NO: 477685 - DNA, 25 bp, Mus musculus
tctggataatgatgccctgacttgc

SEQ ID NO: 477686 - DNA, 25 bp, Mus musculus
tctggatacaacactgtcctcctgg

SEQ ID NO: 477687 - DNA, 25 bp, Mus musculus
tctggatacagttacacccaagagg

SEQ ID NO: 477688 - DNA, 25 bp, Mus musculus
tctggataccactgaggagatgaca

SEQ ID NO: 477689 - DNA, 25 bp, Mus musculus
tctggatatgaagagtggcccgctg

SEQ ID NO: 477690 - DNA, 25 bp, Mus musculus
tctggatcaagatagaagctgctgc

SEQ ID NO: 477691 - DNA, 25 bp, Mus musculus
tctggatcagagcagccacgctaaa

SEQ ID NO: 477692 - DNA, 25 bp, Mus musculus
tctggatcatgaagatgccaaggcg

SEQ ID NO: 477693 - DNA, 25 bp, Mus musculus
tctggatcgacatctccaataggct

SEQ ID NO: 477694 - DNA, 25 bp, Mus musculus
tctggatcgccacggcttcgtgtcc

SEQ ID NO: 477695 - DNA, 25 bp, Mus musculus
tctggatctgtgttgtagaatctgc

SEQ ID NO: 477696 - DNA, 25 bp, Mus musculus
tctggatgccaatttaccctctgtg

SEQ ID NO: 477697 - DNA, 25 bp, Mus musculus
tctggatgcctggagtcagtgactg

SEQ ID NO: 477698 - DNA, 25 bp, Mus musculus
tctggatgtagatctgctaggcagc

SEQ ID NO: 477699 - DNA, 25 bp, Mus musculus
tctggatgtatagacagcatgctgt

SEQ ID NO: 477700 - DNA, 25 bp, Mus musculus
tctggatgtgagcacctgacagtga

SEQ ID NO: 477701 - DNA, 25 bp, Mus musculus
tctggatgttcaccgcaagacctca

SEQ ID NO: 477702 - DNA, 25 bp, Mus musculus
tctggattacagagacccaaggtcc

SEQ ID NO: 477703 - DNA, 25 bp, Mus musculus
tctggattccttgtcctgttcggtt

SEQ ID NO: 477704 - DNA, 25 bp, Mus musculus
tctggattgtaagagagacattctg

SEQ ID NO: 477705 - DNA, 25 bp, Mus musculus
tctggcaaaaagagatccggtggcc

SEQ ID NO: 477706 - DNA, 25 bp, Mus musculus
tctggcaaaagcaaacgagaaaagg

SEQ ID NO: 477707 - DNA, 25 bp, Mus musculus
tctggcaactatgaccgtgaatgac

SEQ ID NO: 477708 - DNA, 25 bp, Mus musculus
tctggcaagcagcagtcctgggatc

SEQ ID NO: 477709 - DNA, 25 bp, Mus musculus
tctggcaagtactgaaaatgttctc

SEQ ID NO: 477710 - DNA, 25 bp, Mus musculus
tctggcacatcgctgagtgagagca

SEQ ID NO: 477711 - DNA, 25 bp, Mus musculus
tctggcacatgatgctcagtaactg

SEQ ID NO: 477712 - DNA, 25 bp, Mus musculus
tctggcacatttggaccggtgaacc

SEQ ID NO: 477713 - DNA, 25 bp, Mus musculus
tctggcaccctgactaataaccttc

SEQ ID NO: 477714 - DNA, 25 bp, Mus musculus
tctggcactgggactcggaaaaaca

SEQ ID NO: 477715 - DNA, 25 bp, Mus musculus
tctggcagagaagtcagttcatcgc

SEQ ID NO: 477716 - DNA, 25 bp, Mus musculus
tctggcagagtcctgattactcagg

SEQ ID NO: 477717 - DNA, 25 bp, Mus musculus
tctggcagcagatttcagcaggagc

SEQ ID NO: 477718 - DNA, 25 bp, Mus musculus
tctggcagcgacctatgattgacaa

SEQ ID NO: 477719 - DNA, 25 bp, Mus musculus
tctggcagggtgaccttcaatgact

SEQ ID NO: 477720 - DNA, 25 bp, Mus musculus
tctggcaggtcaccacaggagtgct

SEQ ID NO: 477721 - DNA, 25 bp, Mus musculus
tctggcagttctggttcctcagctg

SEQ ID NO: 477722 - DNA, 25 bp, Mus musculus
tctggcagttgtttcggaggcatac

SEQ ID NO: 477723 - DNA, 25 bp, Mus musculus
tctggcataaaattctcaaggacaa

SEQ ID NO: 477724 - DNA, 25 bp, Mus musculus
tctggcatatgtgaagggcggcctc

SEQ ID NO: 477725 - DNA, 25 bp, Mus musculus
tctggcatattaagataatgtgcat

SEQ ID NO: 477726 - DNA, 25 bp, Mus musculus
tctggcatccgaggctttgggaacc

SEQ ID NO: 477727 - DNA, 25 bp, Mus musculus
tctggcatctgggataacgagacgc

SEQ ID NO: 477728 - DNA, 25 bp, Mus musculus
tctggcatgcaggaagactagggct

SEQ ID NO: 477729 - DNA, 25 bp, Mus musculus
tctggccaacatgctccaggtagag

SEQ ID NO: 477730 - DNA, 25 bp, Mus musculus
tctggccaagatccgcaaggtcatg

SEQ ID NO: 477731 - DNA, 25 bp, Mus musculus
tctggccaagatctgagcattacta

SEQ ID NO: 477732 - DNA, 25 bp, Mus musculus
tctggccagactccacagaaatgga

SEQ ID NO: 477733 - DNA, 25 bp, Mus musculus
tctggccagcggaagagggaaggca

SEQ ID NO: 477734 - DNA, 25 bp, Mus musculus
tctggccagctatgaggaggagcac

SEQ ID NO: 477735 - DNA, 25 bp, Mus musculus
tctggccagggaaggcatgagtgac

SEQ ID NO: 477736 - DNA, 25 bp, Mus musculus
tctggccagggcttgggcatctgaa

SEQ ID NO: 477737 - DNA, 25 bp, Mus musculus
tctggccatagaagacgctgcggac

SEQ ID NO: 477738 - DNA, 25 bp, Mus musculus
tctggccatattgctacatatctct

SEQ ID NO: 477739 - DNA, 25 bp, Mus musculus
tctggccatgatagggtttgagacc

SEQ ID NO: 477740 - DNA, 25 bp, Mus musculus
tctggccatttaccaaaaggacttt

SEQ ID NO: 477741 - DNA, 25 bp, Mus musculus
tctggcccagacgattgagaagcgg

SEQ ID NO: 477742 - DNA, 25 bp, Mus musculus
tctggccccggctgcattgaaggca

SEQ ID NO: 477743 - DNA, 25 bp, Mus musculus
tctggcccgcactgcaaatgaactg

SEQ ID NO: 477744 - DNA, 25 bp, Mus musculus
tctggccctcagagagtacggtgtc

SEQ ID NO: 477745 - DNA, 25 bp, Mus musculus
tctggccctgacaaacgactggtga

SEQ ID NO: 477746 - DNA, 25 bp, Mus musculus
tctggccgaatggtaaaacgcttgc

SEQ ID NO: 477747 - DNA, 25 bp, Mus musculus
tctggccgagcacacaatcctctgt

SEQ ID NO: 477748 - DNA, 25 bp, Mus musculus
tctggccgaggagactcagtcagtg

SEQ ID NO: 477749 - DNA, 25 bp, Mus musculus
tctggccgcaaaattgagagaaccg

SEQ ID NO: 477750 - DNA, 25 bp, Mus musculus
tctggccgccaaacaaagtaaaatg

SEQ ID NO: 477751 - DNA, 25 bp, Mus musculus
tctggccgctgaggtatgcactgct

SEQ ID NO: 477752 - DNA, 25 bp, Mus musculus
tctggccggaatctaggaagccctt

SEQ ID NO: 477753 - DNA, 25 bp, Mus musculus
tctggcctgaacagaaaagagccgg

SEQ ID NO: 477754 - DNA, 25 bp, Mus musculus
tctggcctgggtggaggttcatctc

SEQ ID NO: 477755 - DNA, 25 bp, Mus musculus
tctggcctgtagatcaggtgagcgc

SEQ ID NO: 477756 - DNA, 25 bp, Mus musculus
tctggcctgtcttattctgcagtgt

SEQ ID NO: 477757 - DNA, 25 bp, Mus musculus
tctggccttcaacatctactgtgag

SEQ ID NO: 477758 - DNA, 25 bp, Mus musculus
tctggccttgatgcttaccgtgtgg

SEQ ID NO: 477759 - DNA, 25 bp, Mus musculus
tctggccttgattctacctgctaag

SEQ ID NO: 477760 - DNA, 25 bp, Mus musculus
tctggccttgctgaagacggtgatc

SEQ ID NO: 477761 - DNA, 25 bp, Mus musculus
tctggccttggatggtactgggaac

SEQ ID NO: 477762 - DNA, 25 bp, Mus musculus
tctggccttggtatatgtcaatata

SEQ ID NO: 477763 - DNA, 25 bp, Mus musculus
tctggcctttaatcttcgtagaaag

SEQ ID NO: 477764 - DNA, 25 bp, Mus musculus
tctggcctttgcaggtacctgtgct

SEQ ID NO: 477765 - DNA, 25 bp, Mus musculus
tctggcgcaatgtccgagggaagac

SEQ ID NO: 477766 - DNA, 25 bp, Mus musculus
tctggcggcattactacaccgggac

SEQ ID NO: 477767 - DNA, 25 bp, Mus musculus
tctggcggccgtacctggagcccga

SEQ ID NO: 477768 - DNA, 25 bp, Mus musculus
tctggcgtcacaagtcaggcggtca

SEQ ID NO: 477769 - DNA, 25 bp, Mus musculus
tctggcgtctgtcccctttggtgtc

SEQ ID NO: 477770 - DNA, 25 bp, Mus musculus
tctggcgtgttaacagcggtggccc

SEQ ID NO: 477771 - DNA, 25 bp, Mus musculus
tctggcgtttccacgcttaatccgg

SEQ ID NO: 477772 - DNA, 25 bp, Mus musculus
tctggctaactgctgggctgatgaa

SEQ ID NO: 477773 - DNA, 25 bp, Mus musculus
tctggctaagaatgggcaacggtgc

SEQ ID NO: 477774 - DNA, 25 bp, Mus musculus
tctggctaagactgacctggaaatg

SEQ ID NO: 477775 - DNA, 25 bp, Mus musculus
tctggctcagaaaagctcactgcct

SEQ ID NO: 477776 - DNA, 25 bp, Mus musculus
tctggctcaggttgctcaaagcaca

SEQ ID NO: 477777 - DNA, 25 bp, Mus musculus
tctggctcatgggatcaaactgtca

SEQ ID NO: 477778 - DNA, 25 bp, Mus musculus
tctggctcatggtgtggcagcaaaa

SEQ ID NO: 477779 - DNA, 25 bp, Mus musculus
tctggctcccgttgttgtgtctggc

SEQ ID NO: 477780 - DNA, 25 bp, Mus musculus
tctggctcccttccaaaatgtgggc

SEQ ID NO: 477781 - DNA, 25 bp, Mus musculus
tctggctcgagtacgaatcaacccg

SEQ ID NO: 477782 - DNA, 25 bp, Mus musculus
tctggctcgagtccgtgttttgcac

SEQ ID NO: 477783 - DNA, 25 bp, Mus musculus
tctggctgagccataaattgcccgg

SEQ ID NO: 477784 - DNA, 25 bp, Mus musculus
tctggctgcaactcaagggcacgtc

SEQ ID NO: 477785 - DNA, 25 bp, Mus musculus
tctggctgcacactgtcttcagcgt

SEQ ID NO: 477786 - DNA, 25 bp, Mus musculus
tctggctgctctgaatgatgacggg

SEQ ID NO: 477787 - DNA, 25 bp, Mus musculus
tctggctggagaatggaaacgtatc

SEQ ID NO: 477788 - DNA, 25 bp, Mus musculus
tctggctgggaggtgttcgacatct

SEQ ID NO: 477789 - DNA, 25 bp, Mus musculus
tctggctgtgtagagagctgactct

SEQ ID NO: 477790 - DNA, 25 bp, Mus musculus
tctggctgttggttgcctggctgac

SEQ ID NO: 477791 - DNA, 25 bp, Mus musculus
tctggcttaacggatatcctttgac

SEQ ID NO: 477792 - DNA, 25 bp, Mus musculus
tctggcttcagctgaggttggaccc

SEQ ID NO: 477793 - DNA, 25 bp, Mus musculus
tctggcttctattagaacacccggg

SEQ ID NO: 477794 - DNA, 25 bp, Mus musculus
tctggcttggacgaaggtggccctt

SEQ ID NO: 477795 - DNA, 25 bp, Mus musculus
tctgggaaactggacttgaacgtct

SEQ ID NO: 477796 - DNA, 25 bp, Mus musculus
tctgggaaaggcctagaaacatttc

SEQ ID NO: 477797 - DNA, 25 bp, Mus musculus
tctgggaaccaagagcacagctttc

SEQ ID NO: 477798 - DNA, 25 bp, Mus musculus
tctgggaacccctgtggattaaagg

SEQ ID NO: 477799 - DNA, 25 bp, Mus musculus
tctgggaagaaaagttatcaggcac

SEQ ID NO: 477800 - DNA, 25 bp, Mus musculus
tctgggaagacgtacatgcttggct

SEQ ID NO: 477801 - DNA, 25 bp, Mus musculus
tctgggaagatactgggacccattt

SEQ ID NO: 477802 - DNA, 25 bp, Mus musculus
tctgggaagtaggacgtacatctcg

SEQ ID NO: 477803 - DNA, 25 bp, Mus musculus
tctgggaataaaacacgaggctggc

SEQ ID NO: 477804 - DNA, 25 bp, Mus musculus
tctgggaatctttacctgcgctcgg

SEQ ID NO: 477805 - DNA, 25 bp, Mus musculus
tctgggaattcacatcactaaagca

SEQ ID NO: 477806 - DNA, 25 bp, Mus musculus
tctgggacaccgactggagcatgta

SEQ ID NO: 477807 - DNA, 25 bp, Mus musculus
tctgggacacggatcaagaatacct

SEQ ID NO: 477808 - DNA, 25 bp, Mus musculus
tctgggacagactttctctgggtgc

SEQ ID NO: 477809 - DNA, 25 bp, Mus musculus
tctgggacagcatacagaacaggtt

SEQ ID NO: 477810 - DNA, 25 bp, Mus musculus
tctgggacaggaacttgagccatct

SEQ ID NO: 477811 - DNA, 25 bp, Mus musculus
tctgggacatgctgcctgatggcct

SEQ ID NO: 477812 - DNA, 25 bp, Mus musculus
tctgggacccactgctaggaaaggg

SEQ ID NO: 477813 - DNA, 25 bp, Mus musculus
tctgggacgggagaattcctctgct

SEQ ID NO: 477814 - DNA, 25 bp, Mus musculus
tctgggactctagagcagtagcagt

SEQ ID NO: 477815 - DNA, 25 bp, Mus musculus
tctgggactgatttgctgctgtgca

SEQ ID NO: 477816 - DNA, 25 bp, Mus musculus
tctgggactggaaggaatgaatgcc

SEQ ID NO: 477817 - DNA, 25 bp, Mus musculus
tctgggactgtctcaaagcacgtga

SEQ ID NO: 477818 - DNA, 25 bp, Mus musculus
tctgggactgtgaggagtacaacac

SEQ ID NO: 477819 - DNA, 25 bp, Mus musculus
tctgggagatgcgtataacctgagg

SEQ ID NO: 477820 - DNA, 25 bp, Mus musculus
tctgggagcaatacatcagcctgcg

SEQ ID NO: 477821 - DNA, 25 bp, Mus musculus
tctgggagcacgttggatgagcact

SEQ ID NO: 477822 - DNA, 25 bp, Mus musculus
tctgggagcagaaaggacagcaagc

SEQ ID NO: 477823 - DNA, 25 bp, Mus musculus
tctgggagcagaaatgaagagcctc

SEQ ID NO: 477824 - DNA, 25 bp, Mus musculus
tctgggagccaatgggaatgcaaac

SEQ ID NO: 477825 - DNA, 25 bp, Mus musculus
tctgggagcccgagtgatctgtgac

SEQ ID NO: 477826 - DNA, 25 bp, Mus musculus
tctgggagctcctcatgaacgtgaa

SEQ ID NO: 477827 - DNA, 25 bp, Mus musculus
tctgggagtccctacagaggatacc

SEQ ID NO: 477828 - DNA, 25 bp, Mus musculus
tctgggagttccatgtaagcccttc

SEQ ID NO: 477829 - DNA, 25 bp, Mus musculus
tctgggagttgctctggattgtaca

SEQ ID NO: 477830 - DNA, 25 bp, Mus musculus
tctgggagttgtaggaccctttcct

SEQ ID NO: 477831 - DNA, 25 bp, Mus musculus
tctgggataacagttcgtaaagctc

SEQ ID NO: 477832 - DNA, 25 bp, Mus musculus
tctgggatacaggtagacaggaccc

SEQ ID NO: 477833 - DNA, 25 bp, Mus musculus
tctgggatactagagccctggagcc

SEQ ID NO: 477834 - DNA, 25 bp, Mus musculus
tctgggatatttaattgtaggcttc

SEQ ID NO: 477835 - DNA, 25 bp, Mus musculus
tctgggatccagtgaagggtcctgc

SEQ ID NO: 477836 - DNA, 25 bp, Mus musculus
tctgggatccatcttaagcacatca

SEQ ID NO: 477837 - DNA, 25 bp, Mus musculus
tctgggatcccagcggagtggaaca

SEQ ID NO: 477838 - DNA, 25 bp, Mus musculus
tctgggatctaagtcaatgtgagcc

SEQ ID NO: 477839 - DNA, 25 bp, Mus musculus
tctgggatctcaccacggcaatgga

SEQ ID NO: 477840 - DNA, 25 bp, Mus musculus
tctgggatctttgttggaccgccta

SEQ ID NO: 477841 - DNA, 25 bp, Mus musculus
tctgggatgatgagcagtccgcctt

SEQ ID NO: 477842 - DNA, 25 bp, Mus musculus
tctgggattagagaaagcgccttca

SEQ ID NO: 477843 - DNA, 25 bp, Mus musculus
tctgggcaagaagaatgaggcacct

SEQ ID NO: 477844 - DNA, 25 bp, Mus musculus
tctgggcaatggtacacttctctac

SEQ ID NO: 477845 - DNA, 25 bp, Mus musculus
tctgggcacggtaaaggattgtctg

SEQ ID NO: 477846 - DNA, 25 bp, Mus musculus
tctgggcacgtgatgcctctaccag

SEQ ID NO: 477847 - DNA, 25 bp, Mus musculus
tctgggcagactggaccctcacatt

SEQ ID NO: 477848 - DNA, 25 bp, Mus musculus
tctgggcagcatccataatgacctc

SEQ ID NO: 477849 - DNA, 25 bp, Mus musculus
tctgggcagcattagatggatctcc

SEQ ID NO: 477850 - DNA, 25 bp, Mus musculus
tctgggcagctggacgaaaaggaaa

SEQ ID NO: 477851 - DNA, 25 bp, Mus musculus
tctgggcaggtctctgtcatagcct

SEQ ID NO: 477852 - DNA, 25 bp, Mus musculus
tctgggcatcgccacggacatagtc

SEQ ID NO: 477853 - DNA, 25 bp, Mus musculus
tctgggcattcctactggtcttcag

SEQ ID NO: 477854 - DNA, 25 bp, Mus musculus
tctgggccacaactcagatgcagag

SEQ ID NO: 477855 - DNA, 25 bp, Mus musculus
tctgggccagaaattgatctgctga

SEQ ID NO: 477856 - DNA, 25 bp, Mus musculus
tctgggccagtctacaccgtgattc

SEQ ID NO: 477857 - DNA, 25 bp, Mus musculus
tctgggccatgggacttgcttaagg

SEQ ID NO: 477858 - DNA, 25 bp, Mus musculus
tctgggccccacagaaatgagatag

SEQ ID NO: 477859 - DNA, 25 bp, Mus musculus
tctgggcctaaggaattctgctact

SEQ ID NO: 477860 - DNA, 25 bp, Mus musculus
tctgggcctagatgtgcacgacgtg

SEQ ID NO: 477861 - DNA, 25 bp, Mus musculus
tctgggcctaggtgcaaattatgac

SEQ ID NO: 477862 - DNA, 25 bp, Mus musculus
tctgggcctcaagatggtgtctcct

SEQ ID NO: 477863 - DNA, 25 bp, Mus musculus
tctgggcctcacagtcatcatttat

SEQ ID NO: 477864 - DNA, 25 bp, Mus musculus
tctgggcctctgaaccaagactcta

SEQ ID NO: 477865 - DNA, 25 bp, Mus musculus
tctgggcctgaactttggagacacg

SEQ ID NO: 477866 - DNA, 25 bp, Mus musculus
tctgggcctggcaattcttgtatgt

SEQ ID NO: 477867 - DNA, 25 bp, Mus musculus
tctgggccttctattgggagcataa

SEQ ID NO: 477868 - DNA, 25 bp, Mus musculus
tctgggcctttctggacatctttcc

SEQ ID NO: 477869 - DNA, 25 bp, Mus musculus
tctgggcggccatactcaggagtac

SEQ ID NO: 477870 - DNA, 25 bp, Mus musculus
tctgggctacacagctcttagaaag

SEQ ID NO: 477871 - DNA, 25 bp, Mus musculus
tctgggctccatcgccaacactgta

SEQ ID NO: 477872 - DNA, 25 bp, Mus musculus
tctgggctccgaacatgagacgcgt

SEQ ID NO: 477873 - DNA, 25 bp, Mus musculus
tctgggctccgtggcaaggatgact

SEQ ID NO: 477874 - DNA, 25 bp, Mus musculus
tctgggctcctagtgtcaggccgga

SEQ ID NO: 477875 - DNA, 25 bp, Mus musculus
tctgggctctcagaaacgacgacgt

SEQ ID NO: 477876 - DNA, 25 bp, Mus musculus
tctgggctctgatgacgtcgtgtga

SEQ ID NO: 477877 - DNA, 25 bp, Mus musculus
tctgggctggcattgatgacaacca

SEQ ID NO: 477878 - DNA, 25 bp, Mus musculus
tctgggcttacggagtccctggtgc

SEQ ID NO: 477879 - DNA, 25 bp, Mus musculus
tctgggcttatgacctaggctctgg

SEQ ID NO: 477880 - DNA, 25 bp, Mus musculus
tctgggcttgcttcaggaaagtgaa

SEQ ID NO: 477881 - DNA, 25 bp, Mus musculus
tctgggtaaagtgcacctaggctgg

SEQ ID NO: 477882 - DNA, 25 bp, Mus musculus
tctgggtacagcaccagggtgactg

SEQ ID NO: 477883 - DNA, 25 bp, Mus musculus
tctgggtagggacaaacaaccacga

SEQ ID NO: 477884 - DNA, 25 bp, Mus musculus
tctgggtcaaccaacctagcaggtg

SEQ ID NO: 477885 - DNA, 25 bp, Mus musculus
tctgggtcagccaagaaccgtttgc

SEQ ID NO: 477886 - DNA, 25 bp, Mus musculus
tctgggtcaggaagccatctttcga

SEQ ID NO: 477887 - DNA, 25 bp, Mus musculus
tctgggtcaggtaagaaaagcatcc

SEQ ID NO: 477888 - DNA, 25 bp, Mus musculus
tctgggtcccctgacataaaccttt

SEQ ID NO: 477889 - DNA, 25 bp, Mus musculus
tctgggtctcagtcttcacatctgt

SEQ ID NO: 477890 - DNA, 25 bp, Mus musculus
tctgggtctgtttatgaatgagccc

SEQ ID NO: 477891 - DNA, 25 bp, Mus musculus
tctgggtcttctctgtccggctgca

SEQ ID NO: 477892 - DNA, 25 bp, Mus musculus
tctgggtgacaggaaaggctacgat

SEQ ID NO: 477893 - DNA, 25 bp, Mus musculus
tctgggtgacccacgaagagatgga

SEQ ID NO: 477894 - DNA, 25 bp, Mus musculus
tctgggtgcaggtacaaacagtgcc

SEQ ID NO: 477895 - DNA, 25 bp, Mus musculus
tctgggtgctatgggggatcattcc

SEQ ID NO: 477896 - DNA, 25 bp, Mus musculus
tctgggtggcaccaagaagctctgc

SEQ ID NO: 477897 - DNA, 25 bp, Mus musculus
tctgggttcccatgaaagcgctgga

SEQ ID NO: 477898 - DNA, 25 bp, Mus musculus
tctgggttcgggagcatttggcaca

SEQ ID NO: 477899 - DNA, 25 bp, Mus musculus
tctgggtttgttctttccaaggtgg

SEQ ID NO: 477900 - DNA, 25 bp, Mus musculus
tctgggtttttccagtggctgacac

SEQ ID NO: 477901 - DNA, 25 bp, Mus musculus
tctggtaaccagtgaaggaagcccc

SEQ ID NO: 477902 - DNA, 25 bp, Mus musculus
tctggtaagggcttcctagacaagt

SEQ ID NO: 477903 - DNA, 25 bp, Mus musculus
tctggtacaagttcctgcagcgcga

SEQ ID NO: 477904 - DNA, 25 bp, Mus musculus
tctggtacacatttgcggcttagcc

SEQ ID NO: 477905 - DNA, 25 bp, Mus musculus
tctggtacggatgtggacgcagcca

SEQ ID NO: 477906 - DNA, 25 bp, Mus musculus
tctggtagagaaagcatattaggac

SEQ ID NO: 477907 - DNA, 25 bp, Mus musculus
tctggtagagcctgcctagcgtgtg

SEQ ID NO: 477908 - DNA, 25 bp, Mus musculus
tctggtagctactaactttaaggga

SEQ ID NO: 477909 - DNA, 25 bp, Mus musculus
tctggtagtgtgaaggtagttctgt

SEQ ID NO: 477910 - DNA, 25 bp, Mus musculus
tctggtataccaatgagccaagtgg

SEQ ID NO: 477911 - DNA, 25 bp, Mus musculus
tctggtatcgaacccaccttctctg

SEQ ID NO: 477912 - DNA, 25 bp, Mus musculus
tctggtcaaggtgcaggtggcttta

SEQ ID NO: 477913 - DNA, 25 bp, Mus musculus
tctggtcagccatgtcggagaggaa

SEQ ID NO: 477914 - DNA, 25 bp, Mus musculus
tctggtcagcggcactgtctacatc

SEQ ID NO: 477915 - DNA, 25 bp, Mus musculus
tctggtcagctctagttacattgtg

SEQ ID NO: 477916 - DNA, 25 bp, Mus musculus
tctggtcatacatgtgcagtatcct

SEQ ID NO: 477917 - DNA, 25 bp, Mus musculus
tctggtcatcaagtggaattccccg

SEQ ID NO: 477918 - DNA, 25 bp, Mus musculus
tctggtcatccattcggcacatatt

SEQ ID NO: 477919 - DNA, 25 bp, Mus musculus
tctggtccacaaactggaggaggca

SEQ ID NO: 477920 - DNA, 25 bp, Mus musculus
tctggtccagtgaagtccctcgctg

SEQ ID NO: 477921 - DNA, 25 bp, Mus musculus
tctggtccccacatcaaggtaaacg

SEQ ID NO: 477922 - DNA, 25 bp, Mus musculus
tctggtcccccactagcagatgcta

SEQ ID NO: 477923 - DNA, 25 bp, Mus musculus
tctggtccctgtaggcacaagggca

SEQ ID NO: 477924 - DNA, 25 bp, Mus musculus
tctggtcctccgtaagggtaagaag

SEQ ID NO: 477925 - DNA, 25 bp, Mus musculus
tctggtcctggagctagccaagcag

SEQ ID NO: 477926 - DNA, 25 bp, Mus musculus
tctggtcctgtaggactgaagcttg

SEQ ID NO: 477927 - DNA, 25 bp, Mus musculus
tctggtcgtcactgtctggagtccc

SEQ ID NO: 477928 - DNA, 25 bp, Mus musculus
tctggtctagaagagagggcactgt

SEQ ID NO: 477929 - DNA, 25 bp, Mus musculus
tctggtctatgagctcctaacgggc

SEQ ID NO: 477930 - DNA, 25 bp, Mus musculus
tctggtctcaggtcaagggcccttt

SEQ ID NO: 477931 - DNA, 25 bp, Mus musculus
tctggtctccaggatctaggtgtaa

SEQ ID NO: 477932 - DNA, 25 bp, Mus musculus
tctggtctccccactataaggagct

SEQ ID NO: 477933 - DNA, 25 bp, Mus musculus
tctggtctccggtgcacagacatgc

SEQ ID NO: 477934 - DNA, 25 bp, Mus musculus
tctggtgaaatgcaacgcttggccc

SEQ ID NO: 477935 - DNA, 25 bp, Mus musculus
tctggtgaacctggcgcgaaagcca

SEQ ID NO: 477936 - DNA, 25 bp, Mus musculus
tctggtgacagagattaactgggac

SEQ ID NO: 477937 - DNA, 25 bp, Mus musculus
tctggtgagagatcggagctgcctt

SEQ ID NO: 477938 - DNA, 25 bp, Mus musculus
tctggtgagggtcttgtaacatcgc

SEQ ID NO: 477939 - DNA, 25 bp, Mus musculus
tctggtgaggtctacgacttcttgc

SEQ ID NO: 477940 - DNA, 25 bp, Mus musculus
tctggtgatgtctgcctgtgaacgc

SEQ ID NO: 477941 - DNA, 25 bp, Mus musculus
tctggtgcaagctagacaagccttc

SEQ ID NO: 477942 - DNA, 25 bp, Mus musculus
tctggtgccttacagttcctgacag

SEQ ID NO: 477943 - DNA, 25 bp, Mus musculus
tctggtgctagagggaagactacaa

SEQ ID NO: 477944 - DNA, 25 bp, Mus musculus
tctggtgctcagctgatcctgtggc

SEQ ID NO: 477945 - DNA, 25 bp, Mus musculus
tctggtgctcaggtagaaaatgtcc

SEQ ID NO: 477946 - DNA, 25 bp, Mus musculus
tctggtggaagaaggtctgaaaccc

SEQ ID NO: 477947 - DNA, 25 bp, Mus musculus
tctggtggacaaatggaacggactc

SEQ ID NO: 477948 - DNA, 25 bp, Mus musculus
tctggtggacaagataaaggctccc

SEQ ID NO: 477949 - DNA, 25 bp, Mus musculus
tctggtggcaagaacatccgcgtgg

SEQ ID NO: 477950 - DNA, 25 bp, Mus musculus
tctggtggcatccaaagacgatctc

SEQ ID NO: 477951 - DNA, 25 bp, Mus musculus
tctggtggtcaaagccgaatcttca

SEQ ID NO: 477952 - DNA, 25 bp, Mus musculus
tctggtggtgatggacagtccgaac

SEQ ID NO: 477953 - DNA, 25 bp, Mus musculus
tctggtgtgcagacagagtactcat

SEQ ID NO: 477954 - DNA, 25 bp, Mus musculus
tctggtgtgcgagaaagcagcttcc

SEQ ID NO: 477955 - DNA, 25 bp, Mus musculus
tctggtgtgctttgaataggcaggc

SEQ ID NO: 477956 - DNA, 25 bp, Mus musculus
tctggtgtgggacaagaccctgctc

SEQ ID NO: 477957 - DNA, 25 bp, Mus musculus
tctggtgtggtactgaacggcccta

SEQ ID NO: 477958 - DNA, 25 bp, Mus musculus
tctggtgttcgcctatgatttccat

SEQ ID NO: 477959 - DNA, 25 bp, Mus musculus
tctggttcaagcgaaagcatgctgc

SEQ ID NO: 477960 - DNA, 25 bp, Mus musculus
tctggttcaatgagtgggtttgtcc

SEQ ID NO: 477961 - DNA, 25 bp, Mus musculus
tctggttcgacttgagagacttctg

SEQ ID NO: 477962 - DNA, 25 bp, Mus musculus
tctggttgatccaatgggaatcact

SEQ ID NO: 477963 - DNA, 25 bp, Mus musculus
tctggttggaaagggagtgacatta

SEQ ID NO: 477964 - DNA, 25 bp, Mus musculus
tctggtttttccatggcccagcaga

SEQ ID NO: 477965 - DNA, 25 bp, Mus musculus
tctgtaaacacagtggacggtggca

SEQ ID NO: 477966 - DNA, 25 bp, Mus musculus
tctgtaaacagtgtgggtagccttc

SEQ ID NO: 477967 - DNA, 25 bp, Mus musculus
tctgtaaactgagatagcttagggt

SEQ ID NO: 477968 - DNA, 25 bp, Mus musculus
tctgtaaagcactggaccctcgtgg

SEQ ID NO: 477969 - DNA, 25 bp, Mus musculus
tctgtaaatggatcgagccggagca

SEQ ID NO: 477970 - DNA, 25 bp, Mus musculus
tctgtaaattagaaggcggtgctcc

SEQ ID NO: 477971 - DNA, 25 bp, Mus musculus
tctgtaacaagatcccaggcctggc

SEQ ID NO: 477972 - DNA, 25 bp, Mus musculus
tctgtaacaaggcttagacatgact

SEQ ID NO: 477973 - DNA, 25 bp, Mus musculus
tctgtaacgggctggtgctgctgac

SEQ ID NO: 477974 - DNA, 25 bp, Mus musculus
tctgtaagaagctcctcaagggcct

SEQ ID NO: 477975 - DNA, 25 bp, Mus musculus
tctgtaagatgtacgaagagcacct

SEQ ID NO: 477976 - DNA, 25 bp, Mus musculus
tctgtaagctctccgtgcggcagga

SEQ ID NO: 477977 - DNA, 25 bp, Mus musculus
tctgtaagtgcaaaagaggagtcac

SEQ ID NO: 477978 - DNA, 25 bp, Mus musculus
tctgtaagttttcgccctgagcaac

SEQ ID NO: 477979 - DNA, 25 bp, Mus musculus
tctgtaataaagtccccacccaggc

SEQ ID NO: 477980 - DNA, 25 bp, Mus musculus
tctgtaatctctactccacgcctgg

SEQ ID NO: 477981 - DNA, 25 bp, Mus musculus
tctgtacaaaaaactcaaagggctg

SEQ ID NO: 477982 - DNA, 25 bp, Mus musculus
tctgtacaatataaaacggtatcac

SEQ ID NO: 477983 - DNA, 25 bp, Mus musculus
tctgtacacactgaggactgggact

SEQ ID NO: 477984 - DNA, 25 bp, Mus musculus
tctgtacacccggaaacgggactcg

SEQ ID NO: 477985 - DNA, 25 bp, Mus musculus
tctgtacagatgagttcatgatgcc

SEQ ID NO: 477986 - DNA, 25 bp, Mus musculus
tctgtacagatttcaacaagcagga

SEQ ID NO: 477987 - DNA, 25 bp, Mus musculus
tctgtacaggacagcgctggcgtcc

SEQ ID NO: 477988 - DNA, 25 bp, Mus musculus
tctgtacatactagtttataacaac

SEQ ID NO: 477989 - DNA, 25 bp, Mus musculus
tctgtaccaaacaacgcaagaaggg

SEQ ID NO: 477990 - DNA, 25 bp, Mus musculus
tctgtaccaagaacctggccagtga

SEQ ID NO: 477991 - DNA, 25 bp, Mus musculus
tctgtaccattcacttacttgggaa

SEQ ID NO: 477992 - DNA, 25 bp, Mus musculus
tctgtaccattggaacctggctggg

SEQ ID NO: 477993 - DNA, 25 bp, Mus musculus
tctgtaccgagtcccattcttagtg

SEQ ID NO: 477994 - DNA, 25 bp, Mus musculus
tctgtaccgtggagggcttcatcac

SEQ ID NO: 477995 - DNA, 25 bp, Mus musculus
tctgtaccttctgcaaactacttct

SEQ ID NO: 477996 - DNA, 25 bp, Mus musculus
tctgtacgactgagagagcacactc

SEQ ID NO: 477997 - DNA, 25 bp, Mus musculus
tctgtactctgttgggtgggaccac

SEQ ID NO: 477998 - DNA, 25 bp, Mus musculus
tctgtactgagcatgaatggaccat

SEQ ID NO: 477999 - DNA, 25 bp, Mus musculus
tctgtactgttccaaaaatgtgttc

SEQ ID NO: 478000 - DNA, 25 bp, Mus musculus
tctgtactgttgacctcatgaggca

SEQ ID NO: 478001 - DNA, 25 bp, Mus musculus
tctgtacttaccgtatacccagtgc

SEQ ID NO: 478002 - DNA, 25 bp, Mus musculus
tctgtagaggaacctggcagtgtct

SEQ ID NO: 478003 - DNA, 25 bp, Mus musculus
tctgtagaggttgatgagcttccca

SEQ ID NO: 478004 - DNA, 25 bp, Mus musculus
tctgtagatcagaaggagccgactt

SEQ ID NO: 478005 - DNA, 25 bp, Mus musculus
tctgtagcaataacggtgtgccgcc

SEQ ID NO: 478006 - DNA, 25 bp, Mus musculus
tctgtagcagcaaccaagagccggt

SEQ ID NO: 478007 - DNA, 25 bp, Mus musculus
tctgtagccatggtaacgccctagc

SEQ ID NO: 478008 - DNA, 25 bp, Mus musculus
tctgtagcgcactcccaagaggtgg

SEQ ID NO: 478009 - DNA, 25 bp, Mus musculus
tctgtaggctggttgccacagaggt

SEQ ID NO: 478010 - DNA, 25 bp, Mus musculus
tctgtagggctttggaagaactgca

SEQ ID NO: 478011 - DNA, 25 bp, Mus musculus
tctgtagtaaaatataggttgccgt

SEQ ID NO: 478012 - DNA, 25 bp, Mus musculus
tctgtagtatcacaaaaaggactgg

SEQ ID NO: 478013 - DNA, 25 bp, Mus musculus
tctgtagtccagatcactgaatatt

SEQ ID NO: 478014 - DNA, 25 bp, Mus musculus
tctgtagtcccagtgcttaggtcct

SEQ ID NO: 478015 - DNA, 25 bp, Mus musculus
tctgtagtctaccttctttggaagc

SEQ ID NO: 478016 - DNA, 25 bp, Mus musculus
tctgtatcttttgtaaaaggatggg

SEQ ID NO: 478017 - DNA, 25 bp, Mus musculus
tctgtatgcacggtctctgggcgct

SEQ ID NO: 478018 - DNA, 25 bp, Mus musculus
tctgtatgccgcagagaccgctgtg

SEQ ID NO: 478019 - DNA, 25 bp, Mus musculus
tctgtatgcctctcctggttattgt

SEQ ID NO: 478020 - DNA, 25 bp, Mus musculus
tctgtatgctgaagcctcccataat

SEQ ID NO: 478021 - DNA, 25 bp, Mus musculus
tctgtatgggaagggtgacacgaac

SEQ ID NO: 478022 - DNA, 25 bp, Mus musculus
tctgtatgggaagttaagggcctct

SEQ ID NO: 478023 - DNA, 25 bp, Mus musculus
tctgtatgtccctgaatgtccatgt

SEQ ID NO: 478024 - DNA, 25 bp, Mus musculus
tctgtatgtctctggaggccggtct

SEQ ID NO: 478025 - DNA, 25 bp, Mus musculus
tctgtatgtggagagaacgtggccc

SEQ ID NO: 478026 - DNA, 25 bp, Mus musculus
tctgtattgaaactattcccagtgt

SEQ ID NO: 478027 - DNA, 25 bp, Mus musculus
tctgtcaaaacaggacgcggacctt

SEQ ID NO: 478028 - DNA, 25 bp, Mus musculus
tctgtcaagaaacccagtaagcctg

SEQ ID NO: 478029 - DNA, 25 bp, Mus musculus
tctgtcaagaaggagcacaagctgc

SEQ ID NO: 478030 - DNA, 25 bp, Mus musculus
tctgtcaagagtagcctcacccatt

SEQ ID NO: 478031 - DNA, 25 bp, Mus musculus
tctgtcaatgcatttgaaagtcctc

SEQ ID NO: 478032 - DNA, 25 bp, Mus musculus
tctgtcacacgaaagctaagctggt

SEQ ID NO: 478033 - DNA, 25 bp, Mus musculus
tctgtcaccacaatgctctcctggg

SEQ ID NO: 478034 - DNA, 25 bp, Mus musculus
tctgtcagaagctccagagactggg

SEQ ID NO: 478035 - DNA, 25 bp, Mus musculus
tctgtcagacagtagtcccgtcacc

SEQ ID NO: 478036 - DNA, 25 bp, Mus musculus
tctgtcagacgtggacaacatggaa

SEQ ID NO: 478037 - DNA, 25 bp, Mus musculus
tctgtcagactatgtggcaagtact

SEQ ID NO: 478038 - DNA, 25 bp, Mus musculus
tctgtcagactcattcaggccggtg

SEQ ID NO: 478039 - DNA, 25 bp, Mus musculus
tctgtcagcgctgtgtcaggaggcc

SEQ ID NO: 478040 - DNA, 25 bp, Mus musculus
tctgtcagctcacttttgaactttc

SEQ ID NO: 478041 - DNA, 25 bp, Mus musculus
tctgtcaggaaaacaatttaggttc

SEQ ID NO: 478042 - DNA, 25 bp, Mus musculus
tctgtcaggaggtgctcaagacgcc

SEQ ID NO: 478043 - DNA, 25 bp, Mus musculus
tctgtcaggcatcacaagcatggcc

SEQ ID NO: 478044 - DNA, 25 bp, Mus musculus
tctgtcaggcatcaggtgaggctcc

SEQ ID NO: 478045 - DNA, 25 bp, Mus musculus
tctgtcagtgagtagacacctcttc

SEQ ID NO: 478046 - DNA, 25 bp, Mus musculus
tctgtcatctgtgttgctacggtaa

SEQ ID NO: 478047 - DNA, 25 bp, Mus musculus
tctgtcatgagaaataagctgaaac

SEQ ID NO: 478048 - DNA, 25 bp, Mus musculus
tctgtcatgtgatgccaacaggaac

SEQ ID NO: 478049 - DNA, 25 bp, Mus musculus
tctgtcattgggaactgctgcaccc

SEQ ID NO: 478050 - DNA, 25 bp, Mus musculus
tctgtccaacagtgccaaagatgaa

SEQ ID NO: 478051 - DNA, 25 bp, Mus musculus
tctgtccaagaccaacacgatgggc

SEQ ID NO: 478052 - DNA, 25 bp, Mus musculus
tctgtccacctcatcatagcaaggc

SEQ ID NO: 478053 - DNA, 25 bp, Mus musculus
tctgtccactgtctagggcatccta

SEQ ID NO: 478054 - DNA, 25 bp, Mus musculus
tctgtccagaaggaactgtggttgc

SEQ ID NO: 478055 - DNA, 25 bp, Mus musculus
tctgtccagagcatcgagcttgtcc

SEQ ID NO: 478056 - DNA, 25 bp, Mus musculus
tctgtccagccaccatgataagcgc

SEQ ID NO: 478057 - DNA, 25 bp, Mus musculus
tctgtccagtcagagatgagcatct

SEQ ID NO: 478058 - DNA, 25 bp, Mus musculus
tctgtccattggtcagcttagggcc

SEQ ID NO: 478059 - DNA, 25 bp, Mus musculus
tctgtcccaaacctagcaagtaggg

SEQ ID NO: 478060 - DNA, 25 bp, Mus musculus
tctgtccgtgtgcataagttaaagg

SEQ ID NO: 478061 - DNA, 25 bp, Mus musculus
tctgtcctagggagcacaggcagtg

SEQ ID NO: 478062 - DNA, 25 bp, Mus musculus
tctgtcctggacctgctagtctttg

SEQ ID NO: 478063 - DNA, 25 bp, Mus musculus
tctgtcctgggaatggtgaactcct

SEQ ID NO: 478064 - DNA, 25 bp, Mus musculus
tctgtcctgtgtcagcgaagaccac

SEQ ID NO: 478065 - DNA, 25 bp, Mus musculus
tctgtcctgttcatgagctggcgca

SEQ ID NO: 478066 - DNA, 25 bp, Mus musculus
tctgtccttaagaaagagctggctg

SEQ ID NO: 478067 - DNA, 25 bp, Mus musculus
tctgtccttcgggaataagcgtgat

SEQ ID NO: 478068 - DNA, 25 bp, Mus musculus
tctgtcgagagaggctgtgctgctt

SEQ ID NO: 478069 - DNA, 25 bp, Mus musculus
tctgtcgatgagtcggagaagtccc

SEQ ID NO: 478070 - DNA, 25 bp, Mus musculus
tctgtcgcacggcatcccgattttg

SEQ ID NO: 478071 - DNA, 25 bp, Mus musculus
tctgtcgctcagatgtgatccgcca

SEQ ID NO: 478072 - DNA, 25 bp, Mus musculus
tctgtcggaaatggagcctgtccca

SEQ ID NO: 478073 - DNA, 25 bp, Mus musculus
tctgtcggagcatggaagtttcaac

SEQ ID NO: 478074 - DNA, 25 bp, Mus musculus
tctgtcggagcggtcggatccctct

SEQ ID NO: 478075 - DNA, 25 bp, Mus musculus
tctgtcggccaagctaaccatgatg

SEQ ID NO: 478076 - DNA, 25 bp, Mus musculus
tctgtcgggtgctgaggtctctcaa

SEQ ID NO: 478077 - DNA, 25 bp, Mus musculus
tctgtcgtcgtaatagcaatggcca

SEQ ID NO: 478078 - DNA, 25 bp, Mus musculus
tctgtcgtgttgtcttacctgaagc

SEQ ID NO: 478079 - DNA, 25 bp, Mus musculus
tctgtctaactatgcctcctgggaa

SEQ ID NO: 478080 - DNA, 25 bp, Mus musculus
tctgtctacaaaaggcaaactcgaa

SEQ ID NO: 478081 - DNA, 25 bp, Mus musculus
tctgtctcaagcatggttccagggc

SEQ ID NO: 478082 - DNA, 25 bp, Mus musculus
tctgtctcagctggcatcactcggt

SEQ ID NO: 478083 - DNA, 25 bp, Mus musculus
tctgtctccccaacaacaggatgac

SEQ ID NO: 478084 - DNA, 25 bp, Mus musculus
tctgtctcccctgtctactaggtgt

SEQ ID NO: 478085 - DNA, 25 bp, Mus musculus
tctgtctcgaataaggttctccttg

SEQ ID NO: 478086 - DNA, 25 bp, Mus musculus
tctgtctctcaggaacaagtgaagc

SEQ ID NO: 478087 - DNA, 25 bp, Mus musculus
tctgtctctgcaatgatccggctct

SEQ ID NO: 478088 - DNA, 25 bp, Mus musculus
tctgtctctgtgtattggcaggttc

SEQ ID NO: 478089 - DNA, 25 bp, Mus musculus
tctgtctgactgtatgaatgaccaa

SEQ ID NO: 478090 - DNA, 25 bp, Mus musculus
tctgtctgatcagggacccacattg

SEQ ID NO: 478091 - DNA, 25 bp, Mus musculus
tctgtctgatgccacacgtgggtac

SEQ ID NO: 478092 - DNA, 25 bp, Mus musculus
tctgtctgcaactgcggcaagggag

SEQ ID NO: 478093 - DNA, 25 bp, Mus musculus
tctgtctgcacagtgaaaactgaac

SEQ ID NO: 478094 - DNA, 25 bp, Mus musculus
tctgtctggcggagagtatgtctgc

SEQ ID NO: 478095 - DNA, 25 bp, Mus musculus
tctgtctgggaaaccatccggatca

SEQ ID NO: 478096 - DNA, 25 bp, Mus musculus
tctgtctgtatgagtgggtatgcct

SEQ ID NO: 478097 - DNA, 25 bp, Mus musculus
tctgtctgtgattcttcccgggatt

SEQ ID NO: 478098 - DNA, 25 bp, Mus musculus
tctgtctgtgtggacctctgcagaa

SEQ ID NO: 478099 - DNA, 25 bp, Mus musculus
tctgtcttaagaagctttggccaaa

SEQ ID NO: 478100 - DNA, 25 bp, Mus musculus
tctgtcttacctatgcaatgattgt

SEQ ID NO: 478101 - DNA, 25 bp, Mus musculus
tctgtcttcagcacgatgtacctga

SEQ ID NO: 478102 - DNA, 25 bp, Mus musculus
tctgtcttgacctaagcaacctggg

SEQ ID NO: 478103 - DNA, 25 bp, Mus musculus
tctgtcttgagggaacacgtctact

SEQ ID NO: 478104 - DNA, 25 bp, Mus musculus
tctgtctttgctaggaggttctccc

SEQ ID NO: 478105 - DNA, 25 bp, Mus musculus
tctgtgaaaacggaaggctggcttc

SEQ ID NO: 478106 - DNA, 25 bp, Mus musculus
tctgtgaaagaaaccctgcagccct

SEQ ID NO: 478107 - DNA, 25 bp, Mus musculus
tctgtgaaagaaagggcccatggga

SEQ ID NO: 478108 - DNA, 25 bp, Mus musculus
tctgtgaaagcagcgtgcagcggca

SEQ ID NO: 478109 - DNA, 25 bp, Mus musculus
tctgtgaacatgtccatgggcggca

SEQ ID NO: 478110 - DNA, 25 bp, Mus musculus
tctgtgaacctaagcctactgatgt

SEQ ID NO: 478111 - DNA, 25 bp, Mus musculus
tctgtgaagaacttggtgcccctgc

SEQ ID NO: 478112 - DNA, 25 bp, Mus musculus
tctgtgaagcagactcgaaccttgc

SEQ ID NO: 478113 - DNA, 25 bp, Mus musculus
tctgtgaagcatagagcatctcgcc

SEQ ID NO: 478114 - DNA, 25 bp, Mus musculus
tctgtgaagctatttgagattaccc

SEQ ID NO: 478115 - DNA, 25 bp, Mus musculus
tctgtgaagctctgtgactgcccgg

SEQ ID NO: 478116 - DNA, 25 bp, Mus musculus
tctgtgaagtactcccgagaggatt

SEQ ID NO: 478117 - DNA, 25 bp, Mus musculus
tctgtgacaagaacctggcggacct

SEQ ID NO: 478118 - DNA, 25 bp, Mus musculus
tctgtgacaatctggcaacctctga

SEQ ID NO: 478119 - DNA, 25 bp, Mus musculus
tctgtgacagatccccaaagtgtac

SEQ ID NO: 478120 - DNA, 25 bp, Mus musculus
tctgtgacatgagattgctacggac

SEQ ID NO: 478121 - DNA, 25 bp, Mus musculus
tctgtgacatggacccattgatggc

SEQ ID NO: 478122 - DNA, 25 bp, Mus musculus
tctgtgacctcaagcatgcaagggc

SEQ ID NO: 478123 - DNA, 25 bp, Mus musculus
tctgtgacggaaacaaagaacccag

SEQ ID NO: 478124 - DNA, 25 bp, Mus musculus
tctgtgactagtgagtgacctggcc

SEQ ID NO: 478125 - DNA, 25 bp, Mus musculus
tctgtgactatgagaccaacgtggc

SEQ ID NO: 478126 - DNA, 25 bp, Mus musculus
tctgtgacttcggaggtttgaacca

SEQ ID NO: 478127 - DNA, 25 bp, Mus musculus
tctgtgacttgactccgggtacctg

SEQ ID NO: 478128 - DNA, 25 bp, Mus musculus
tctgtgagcagtttgaggccgagac

SEQ ID NO: 478129 - DNA, 25 bp, Mus musculus
tctgtgagcattgaggtaagaccgt

SEQ ID NO: 478130 - DNA, 25 bp, Mus musculus
tctgtgagccacaaacctaggtgtt

SEQ ID NO: 478131 - DNA, 25 bp, Mus musculus
tctgtgagccctggaaaggcgtgcc

SEQ ID NO: 478132 - DNA, 25 bp, Mus musculus
tctgtgagctctagacaacggtcgt

SEQ ID NO: 478133 - DNA, 25 bp, Mus musculus
tctgtgaggaaaaacaaacgtcggt

SEQ ID NO: 478134 - DNA, 25 bp, Mus musculus
tctgtgaggaatttcaggtgcccgg

SEQ ID NO: 478135 - DNA, 25 bp, Mus musculus
tctgtgaggatccttgctctgtgca

SEQ ID NO: 478136 - DNA, 25 bp, Mus musculus
tctgtgaggatgtaagatggacccg

SEQ ID NO: 478137 - DNA, 25 bp, Mus musculus
tctgtgaggcttgaggtcagtgaca

SEQ ID NO: 478138 - DNA, 25 bp, Mus musculus
tctgtgagtggatgcagggcaaccc

SEQ ID NO: 478139 - DNA, 25 bp, Mus musculus
tctgtgatcaaaaccgggcgactgt

SEQ ID NO: 478140 - DNA, 25 bp, Mus musculus
tctgtgatcgcagagaggcccagct

SEQ ID NO: 478141 - DNA, 25 bp, Mus musculus
tctgtgatctgggaagctcagtgcc

SEQ ID NO: 478142 - DNA, 25 bp, Mus musculus
tctgtgatgtcaagctccgagggca

SEQ ID NO: 478143 - DNA, 25 bp, Mus musculus
tctgtgatttgagctgaatccagtt

SEQ ID NO: 478144 - DNA, 25 bp, Mus musculus
tctgtgcaacaagtaccgtgtgggc

SEQ ID NO: 478145 - DNA, 25 bp, Mus musculus
tctgtgcaagagcagtgacctttct

SEQ ID NO: 478146 - DNA, 25 bp, Mus musculus
tctgtgcacaaagagaacttcctgt

SEQ ID NO: 478147 - DNA, 25 bp, Mus musculus
tctgtgcacatcgacaagggcttca

SEQ ID NO: 478148 - DNA, 25 bp, Mus musculus
tctgtgcaccaaggctgagaatgca

SEQ ID NO: 478149 - DNA, 25 bp, Mus musculus
tctgtgcacccctgtagaatctcgg

SEQ ID NO: 478150 - DNA, 25 bp, Mus musculus
tctgtgcacgtatagagactagctt

SEQ ID NO: 478151 - DNA, 25 bp, Mus musculus
tctgtgcagaaagaggaccatgctc

SEQ ID NO: 478152 - DNA, 25 bp, Mus musculus
tctgtgcagattccataagggctgt

SEQ ID NO: 478153 - DNA, 25 bp, Mus musculus
tctgtgcagcagtctccatggagcc

SEQ ID NO: 478154 - DNA, 25 bp, Mus musculus
tctgtgcagcatcaaatcaggcgtc

SEQ ID NO: 478155 - DNA, 25 bp, Mus musculus
tctgtgcaggaagattgcagcttgc

SEQ ID NO: 478156 - DNA, 25 bp, Mus musculus
tctgtgcagggacagcattgtttcc

SEQ ID NO: 478157 - DNA, 25 bp, Mus musculus
tctgtgcagtcagggagaagcccct

SEQ ID NO: 478158 - DNA, 25 bp, Mus musculus
tctgtgcatcaaagtgggaaagcca

SEQ ID NO: 478159 - DNA, 25 bp, Mus musculus
tctgtgcccagcagctgtcgaggga

SEQ ID NO: 478160 - DNA, 25 bp, Mus musculus
tctgtgccccgaggaagtcctcctt

SEQ ID NO: 478161 - DNA, 25 bp, Mus musculus
tctgtgcccgtgtatgccgacgaga

SEQ ID NO: 478162 - DNA, 25 bp, Mus musculus
tctgtgccggacctcagctgtgaag

SEQ ID NO: 478163 - DNA, 25 bp, Mus musculus
tctgtgccggctactgtcctagcat

SEQ ID NO: 478164 - DNA, 25 bp, Mus musculus
tctgtgcctatgtcaaaccttggaa

SEQ ID NO: 478165 - DNA, 25 bp, Mus musculus
tctgtgcctgaagctgaggtgaccc

SEQ ID NO: 478166 - DNA, 25 bp, Mus musculus
tctgtgccttggttggttgcctttc

SEQ ID NO: 478167 - DNA, 25 bp, Mus musculus
tctgtgcgagtctatcaccctaata

SEQ ID NO: 478168 - DNA, 25 bp, Mus musculus
tctgtgcgcatgttccgagaagagc

SEQ ID NO: 478169 - DNA, 25 bp, Mus musculus
tctgtgcgcctaacagaggaggttg

SEQ ID NO: 478170 - DNA, 25 bp, Mus musculus
tctgtgcgcgctaggatacccttta

SEQ ID NO: 478171 - DNA, 25 bp, Mus musculus
tctgtgcggaggaagagctactagc

SEQ ID NO: 478172 - DNA, 25 bp, Mus musculus
tctgtgctcaatagcgctgaggctt

SEQ ID NO: 478173 - DNA, 25 bp, Mus musculus
tctgtgctcagtagcttaaaggctc

SEQ ID NO: 478174 - DNA, 25 bp, Mus musculus
tctgtgctccagattgccgtggcct

SEQ ID NO: 478175 - DNA, 25 bp, Mus musculus
tctgtgctcgttcctgggtggtaca

SEQ ID NO: 478176 - DNA, 25 bp, Mus musculus
tctgtgctgacatcttctgagtggc

SEQ ID NO: 478177 - DNA, 25 bp, Mus musculus
tctgtgctgcagatgagcgaggctc

SEQ ID NO: 478178 - DNA, 25 bp, Mus musculus
tctgtgctgcagtctggccgctgct

SEQ ID NO: 478179 - DNA, 25 bp, Mus musculus
tctgtgctggccataacacctggag

SEQ ID NO: 478180 - DNA, 25 bp, Mus musculus
tctgtgctgtaaactccaagggcag

SEQ ID NO: 478181 - DNA, 25 bp, Mus musculus
tctgtgctgtaagtgaataggctga

SEQ ID NO: 478182 - DNA, 25 bp, Mus musculus
tctgtgctgtctaaagttctatctc

SEQ ID NO: 478183 - DNA, 25 bp, Mus musculus
tctgtggaaatagacgctgccagcc

SEQ ID NO: 478184 - DNA, 25 bp, Mus musculus
tctgtggaagaggatttcgggcagg

SEQ ID NO: 478185 - DNA, 25 bp, Mus musculus
tctgtggaagcgtcgggtccaacct

SEQ ID NO: 478186 - DNA, 25 bp, Mus musculus
tctgtggacaatggcggctgagtca

SEQ ID NO: 478187 - DNA, 25 bp, Mus musculus
tctgtggacaggttaatatagagtc

SEQ ID NO: 478188 - DNA, 25 bp, Mus musculus
tctgtggacatctggccagcggaag

SEQ ID NO: 478189 - DNA, 25 bp, Mus musculus
tctgtggaccaactagaaaggacca

SEQ ID NO: 478190 - DNA, 25 bp, Mus musculus
tctgtggaccacgtgttgcaggacc

SEQ ID NO: 478191 - DNA, 25 bp, Mus musculus
tctgtggaccaggaaaagggcatca

SEQ ID NO: 478192 - DNA, 25 bp, Mus musculus
tctgtggaccgcctcaaggagatga

SEQ ID NO: 478193 - DNA, 25 bp, Mus musculus
tctgtggagacacgcatggcagctt

SEQ ID NO: 478194 - DNA, 25 bp, Mus musculus
tctgtggagcaaaggttgccacttt

SEQ ID NO: 478195 - DNA, 25 bp, Mus musculus
tctgtggagcacgactgcagtgtcc

SEQ ID NO: 478196 - DNA, 25 bp, Mus musculus
tctgtggaggcgtgtaatagcagca

SEQ ID NO: 478197 - DNA, 25 bp, Mus musculus
tctgtggatagtgggttcgtagcaa

SEQ ID NO: 478198 - DNA, 25 bp, Mus musculus
tctgtggatgagaagcctggctccc

SEQ ID NO: 478199 - DNA, 25 bp, Mus musculus
tctgtggcactgcttcaatactgtg

SEQ ID NO: 478200 - DNA, 25 bp, Mus musculus
tctgtggcagcctgaagcaagcctc

SEQ ID NO: 478201 - DNA, 25 bp, Mus musculus
tctgtggcaggattgcttcccagcc

SEQ ID NO: 478202 - DNA, 25 bp, Mus musculus
tctgtggcaggcactgtatccgggc

SEQ ID NO: 478203 - DNA, 25 bp, Mus musculus
tctgtggcaggcagaaaaaattgac

SEQ ID NO: 478204 - DNA, 25 bp, Mus musculus
tctgtggccacactgaacagtgaag

SEQ ID NO: 478205 - DNA, 25 bp, Mus musculus
tctgtggccacctgtaactcggaag

SEQ ID NO: 478206 - DNA, 25 bp, Mus musculus
tctgtggccccaagtaggtgatagg

SEQ ID NO: 478207 - DNA, 25 bp, Mus musculus
tctgtggccgagcttcaagcacgct

SEQ ID NO: 478208 - DNA, 25 bp, Mus musculus
tctgtggcttccaagaatatttccc

SEQ ID NO: 478209 - DNA, 25 bp, Mus musculus
tctgtgggaaccaaatctctgtgag

SEQ ID NO: 478210 - DNA, 25 bp, Mus musculus
tctgtgggcaaagcacgtgtctgat

SEQ ID NO: 478211 - DNA, 25 bp, Mus musculus
tctgtgggccacttcagaaagcaca

SEQ ID NO: 478212 - DNA, 25 bp, Mus musculus
tctgtgggccagtcctgctgcgctg

SEQ ID NO: 478213 - DNA, 25 bp, Mus musculus
tctgtgggccgagctattgtctgcg

SEQ ID NO: 478214 - DNA, 25 bp, Mus musculus
tctgtgggccgcaagactggcttgc

SEQ ID NO: 478215 - DNA, 25 bp, Mus musculus
tctgtgggctatgttgacgacgtgc

SEQ ID NO: 478216 - DNA, 25 bp, Mus musculus
tctgtgggtcaacaaataggatgca

SEQ ID NO: 478217 - DNA, 25 bp, Mus musculus
tctgtggtagagatcgccagcctgc

SEQ ID NO: 478218 - DNA, 25 bp, Mus musculus
tctgtggtatgcgaggtccagctcc

SEQ ID NO: 478219 - DNA, 25 bp, Mus musculus
tctgtggtcaccaagcatgcacgtg

SEQ ID NO: 478220 - DNA, 25 bp, Mus musculus
tctgtggtcatgatacgtgtgtttc

SEQ ID NO: 478221 - DNA, 25 bp, Mus musculus
tctgtggtcctgtggtaaaaagccc

SEQ ID NO: 478222 - DNA, 25 bp, Mus musculus
tctgtggtctccacgatgacttgat

SEQ ID NO: 478223 - DNA, 25 bp, Mus musculus
tctgtggtgaaaggagtcaacctgg

SEQ ID NO: 478224 - DNA, 25 bp, Mus musculus
tctgtggtgagaatagccctggacg

SEQ ID NO: 478225 - DNA, 25 bp, Mus musculus
tctgtggtgcagtcaggaatctgac

SEQ ID NO: 478226 - DNA, 25 bp, Mus musculus
tctgtgtacagttagtgattggccc

SEQ ID NO: 478227 - DNA, 25 bp, Mus musculus
tctgtgtagcctcggacagtcacta

SEQ ID NO: 478228 - DNA, 25 bp, Mus musculus
tctgtgtcactgtatgactatgccc

SEQ ID NO: 478229 - DNA, 25 bp, Mus musculus
tctgtgtcagactgctattgctaca

SEQ ID NO: 478230 - DNA, 25 bp, Mus musculus
tctgtgtcagagtaggccatgtgtc

SEQ ID NO: 478231 - DNA, 25 bp, Mus musculus
tctgtgtcaggctctcgggtgtctt

SEQ ID NO: 478232 - DNA, 25 bp, Mus musculus
tctgtgtcatcatcgcgaggtggcc

SEQ ID NO: 478233 - DNA, 25 bp, Mus musculus
tctgtgtccaaagtgcatgttacct

SEQ ID NO: 478234 - DNA, 25 bp, Mus musculus
tctgtgtccgtcagttgtgtataca

SEQ ID NO: 478235 - DNA, 25 bp, Mus musculus
tctgtgtgaaagtgtgtgcgtgccc

SEQ ID NO: 478236 - DNA, 25 bp, Mus musculus
tctgtgtgaacaccctgggatcctt

SEQ ID NO: 478237 - DNA, 25 bp, Mus musculus
tctgtgtgaagcaacaggcgccgat

SEQ ID NO: 478238 - DNA, 25 bp, Mus musculus
tctgtgtgaatcgatggacgctgcc

SEQ ID NO: 478239 - DNA, 25 bp, Mus musculus
tctgtgtgatgaactgggagctcca

SEQ ID NO: 478240 - DNA, 25 bp, Mus musculus
tctgtgtggcagaagagctcagctt

SEQ ID NO: 478241 - DNA, 25 bp, Mus musculus
tctgtgtgggacgagaatgccccta

SEQ ID NO: 478242 - DNA, 25 bp, Mus musculus
tctgtgtgtacattcccgcccaaaa

SEQ ID NO: 478243 - DNA, 25 bp, Mus musculus
tctgtgtgtaccaaggtctgaagcc

SEQ ID NO: 478244 - DNA, 25 bp, Mus musculus
tctgtgttaaaggaggaacaattcc

SEQ ID NO: 478245 - DNA, 25 bp, Mus musculus
tctgtgttaacaccaagggcggctt

SEQ ID NO: 478246 - DNA, 25 bp, Mus musculus
tctgtgttcaagtacctcatgggcc

SEQ ID NO: 478247 - DNA, 25 bp, Mus musculus
tctgtgttcccagcggttgcacgaa

SEQ ID NO: 478248 - DNA, 25 bp, Mus musculus
tctgtgttcctgaccacgctgtgca

SEQ ID NO: 478249 - DNA, 25 bp, Mus musculus
tctgtgttcctgcaggtgaccatgg

SEQ ID NO: 478250 - DNA, 25 bp, Mus musculus
tctgtgttcgaggacagctatacag

SEQ ID NO: 478251 - DNA, 25 bp, Mus musculus
tctgtgttgactagaaatagatcac

SEQ ID NO: 478252 - DNA, 25 bp, Mus musculus
tctgtgtttcacgttcaagcctgtg

SEQ ID NO: 478253 - DNA, 25 bp, Mus musculus
tctgttaaactaaagccaccgggca

SEQ ID NO: 478254 - DNA, 25 bp, Mus musculus
tctgttaaagtccacagaaaggacg

SEQ ID NO: 478255 - DNA, 25 bp, Mus musculus
tctgttaagctgagtgagtccacct

SEQ ID NO: 478256 - DNA, 25 bp, Mus musculus
tctgttaatgcctgggattagaccc

SEQ ID NO: 478257 - DNA, 25 bp, Mus musculus
tctgttacagccagcttgagggctt

SEQ ID NO: 478258 - DNA, 25 bp, Mus musculus
tctgttacctggtgaaggcgcagct

SEQ ID NO: 478259 - DNA, 25 bp, Mus musculus
tctgttactgggaggaatgccttcc

SEQ ID NO: 478260 - DNA, 25 bp, Mus musculus
tctgttagataaagccctggcgcag

SEQ ID NO: 478261 - DNA, 25 bp, Mus musculus
tctgttatcacatcccagaggctgg

SEQ ID NO: 478262 - DNA, 25 bp, Mus musculus
tctgttatggttgacctgggctccc

SEQ ID NO: 478263 - DNA, 25 bp, Mus musculus
tctgttcaatgtctagctggagggt

SEQ ID NO: 478264 - DNA, 25 bp, Mus musculus
tctgttcacagattcaggctgaaca

SEQ ID NO: 478265 - DNA, 25 bp, Mus musculus
tctgttcaccatctggacgcaggag

SEQ ID NO: 478266 - DNA, 25 bp, Mus musculus
tctgttcacgttttcagcttcgtaa

SEQ ID NO: 478267 - DNA, 25 bp, Mus musculus
tctgttcagacagggctgcaggcca

SEQ ID NO: 478268 - DNA, 25 bp, Mus musculus
tctgttcagcgtgaccgatcgggac

SEQ ID NO: 478269 - DNA, 25 bp, Mus musculus
tctgttcaggtgataacaatgtccc

SEQ ID NO: 478270 - DNA, 25 bp, Mus musculus
tctgttcattttgggtgaccgtggg

SEQ ID NO: 478271 - DNA, 25 bp, Mus musculus
tctgttcccaaagagatggctagca

SEQ ID NO: 478272 - DNA, 25 bp, Mus musculus
tctgttccccttcttggcagagagc

SEQ ID NO: 478273 - DNA, 25 bp, Mus musculus
tctgttcctgtcatgtaactgtgtc

SEQ ID NO: 478274 - DNA, 25 bp, Mus musculus
tctgttcggcaagatctcaggctgg

SEQ ID NO: 478275 - DNA, 25 bp, Mus musculus
tctgttcgggcatgcaaaggtggca

SEQ ID NO: 478276 - DNA, 25 bp, Mus musculus
tctgttcgtgagagaagacggcagc

SEQ ID NO: 478277 - DNA, 25 bp, Mus musculus
tctgttcgtggaacccaggaacaaa

SEQ ID NO: 478278 - DNA, 25 bp, Mus musculus
tctgttctgctgacaagctcaccct

SEQ ID NO: 478279 - DNA, 25 bp, Mus musculus
tctgttctggacactgctcatttgg

SEQ ID NO: 478280 - DNA, 25 bp, Mus musculus
tctgttcttggagccaggtcttcag

SEQ ID NO: 478281 - DNA, 25 bp, Mus musculus
tctgttgaacaggagcaatcatttc

SEQ ID NO: 478282 - DNA, 25 bp, Mus musculus
tctgttgaactgtgaagccctctca

SEQ ID NO: 478283 - DNA, 25 bp, Mus musculus
tctgttgacacttccgggtgggacg

SEQ ID NO: 478284 - DNA, 25 bp, Mus musculus
tctgttgacgtatctggcggccctg

SEQ ID NO: 478285 - DNA, 25 bp, Mus musculus
tctgttgatgaaccaagacttgcag

SEQ ID NO: 478286 - DNA, 25 bp, Mus musculus
tctgttgccctttgtccttgcagga

SEQ ID NO: 478287 - DNA, 25 bp, Mus musculus
tctgttgcctgaacatggctgttac

SEQ ID NO: 478288 - DNA, 25 bp, Mus musculus
tctgttgcggagtcagaacccgagc

SEQ ID NO: 478289 - DNA, 25 bp, Mus musculus
tctgttgcggcatgggccagttcga

SEQ ID NO: 478290 - DNA, 25 bp, Mus musculus
tctgttgcggcctgcgttgtgtctc

SEQ ID NO: 478291 - DNA, 25 bp, Mus musculus
tctgttgctaaagcggtgagttcac

SEQ ID NO: 478292 - DNA, 25 bp, Mus musculus
tctgttgctctatcacctcctgtct

SEQ ID NO: 478293 - DNA, 25 bp, Mus musculus
tctgttgctggagacctgaatcacc

SEQ ID NO: 478294 - DNA, 25 bp, Mus musculus
tctgttgctgttcacgctgccgcag

SEQ ID NO: 478295 - DNA, 25 bp, Mus musculus
tctgttggaatctggaacattggaa

SEQ ID NO: 478296 - DNA, 25 bp, Mus musculus
tctgttggacaaccggaatgaccta

SEQ ID NO: 478297 - DNA, 25 bp, Mus musculus
tctgttggacaagaaagcatctacc

SEQ ID NO: 478298 - DNA, 25 bp, Mus musculus
tctgttggacacctggcatatgggc

SEQ ID NO: 478299 - DNA, 25 bp, Mus musculus
tctgttggagcagaaacaaggcctc

SEQ ID NO: 478300 - DNA, 25 bp, Mus musculus
tctgttggagggagacgtcgttata

SEQ ID NO: 478301 - DNA, 25 bp, Mus musculus
tctgttgggaccactaacatctaag

SEQ ID NO: 478302 - DNA, 25 bp, Mus musculus
tctgttggtgttgcaaactagtgaa

SEQ ID NO: 478303 - DNA, 25 bp, Mus musculus
tctgttgtcatctcttttgctcctc

SEQ ID NO: 478304 - DNA, 25 bp, Mus musculus
tctgttgtgacctgtgactccctgg

SEQ ID NO: 478305 - DNA, 25 bp, Mus musculus
tctgtttacgaaattagcttccctt

SEQ ID NO: 478306 - DNA, 25 bp, Mus musculus
tctgtttatgaatgagcccaatggc

SEQ ID NO: 478307 - DNA, 25 bp, Mus musculus
tctgtttcaggaatcacccacttgc

SEQ ID NO: 478308 - DNA, 25 bp, Mus musculus
tctgtttcaggtgtttggagctcga

SEQ ID NO: 478309 - DNA, 25 bp, Mus musculus
tctgtttctcttgagtgacttccca

SEQ ID NO: 478310 - DNA, 25 bp, Mus musculus
tctgtttgagatggacgatgaagcc

SEQ ID NO: 478311 - DNA, 25 bp, Mus musculus
tctgtttgccacacaacgtttgaaa

SEQ ID NO: 478312 - DNA, 25 bp, Mus musculus
tctgtttgccagatccgggaggaga

SEQ ID NO: 478313 - DNA, 25 bp, Mus musculus
tctgtttgttcccacgccaggtgcg

SEQ ID NO: 478314 - DNA, 25 bp, Mus musculus
tctgttttccgcatggtcaagcagg

SEQ ID NO: 478315 - DNA, 25 bp, Mus musculus
tctgtttttcctctaatggccttga

SEQ ID NO: 478316 - DNA, 25 bp, Mus musculus
tctgtttttctaatagtaacttgaa

SEQ ID NO: 478317 - DNA, 25 bp, Mus musculus
tctgtttttctacatgttctctgta

SEQ ID NO: 478318 - DNA, 25 bp, Mus musculus
tcttaaaaggtgtatgagacacact

SEQ ID NO: 478319 - DNA, 25 bp, Mus musculus
tcttaaaagtaggagagcctgcggt

SEQ ID NO: 478320 - DNA, 25 bp, Mus musculus
tcttaaaataggagaacccagtcgg

SEQ ID NO: 478321 - DNA, 25 bp, Mus musculus
tcttaaaatcacagggcaaacatta

SEQ ID NO: 478322 - DNA, 25 bp, Mus musculus
tcttaaacggtacagggaactgcaa

SEQ ID NO: 478323 - DNA, 25 bp, Mus musculus
tcttaaactatgaaagaggactctg

SEQ ID NO: 478324 - DNA, 25 bp, Mus musculus
tcttaaagtcacagcgctctagccc

SEQ ID NO: 478325 - DNA, 25 bp, Mus musculus
tcttaaatctgaagcctcttactag

SEQ ID NO: 478326 - DNA, 25 bp, Mus musculus
tcttaacagccctagtcagtcagtg

SEQ ID NO: 478327 - DNA, 25 bp, Mus musculus
tcttaacatgcattgtggagaagcc

SEQ ID NO: 478328 - DNA, 25 bp, Mus musculus
tcttaacatggctagtggcagcggg

SEQ ID NO: 478329 - DNA, 25 bp, Mus musculus
tcttaaccgttactgagcaacctct

SEQ ID NO: 478330 - DNA, 25 bp, Mus musculus
tcttaactcagggtggagttcacag

SEQ ID NO: 478331 - DNA, 25 bp, Mus musculus
tcttaactcggaagtgggacgcaga

SEQ ID NO: 478332 - DNA, 25 bp, Mus musculus
tcttaactgcctctcttggaagcct

SEQ ID NO: 478333 - DNA, 25 bp, Mus musculus
tcttaactttcacgaggcacgccag

SEQ ID NO: 478334 - DNA, 25 bp, Mus musculus
tcttaagagctgttacctgagccct

SEQ ID NO: 478335 - DNA, 25 bp, Mus musculus
tcttaagagggagcacagctggcca

SEQ ID NO: 478336 - DNA, 25 bp, Mus musculus
tcttaagccataggtcaagggaaac

SEQ ID NO: 478337 - DNA, 25 bp, Mus musculus
tcttaagctgtgaatgatcgcgaca

SEQ ID NO: 478338 - DNA, 25 bp, Mus musculus
tcttaaggatcaggcttgaagagaa

SEQ ID NO: 478339 - DNA, 25 bp, Mus musculus
tcttaaggcagaggccactgtgccc

SEQ ID NO: 478340 - DNA, 25 bp, Mus musculus
tcttaagtgaatatgcgtctctccc

SEQ ID NO: 478341 - DNA, 25 bp, Mus musculus
tcttaagtgccagatgagaacccag

SEQ ID NO: 478342 - DNA, 25 bp, Mus musculus
tcttaagtgccctgtacatattgta

SEQ ID NO: 478343 - DNA, 25 bp, Mus musculus
tcttaatcactcaacttctgtcatg

SEQ ID NO: 478344 - DNA, 25 bp, Mus musculus
tcttaatcgacttctgttctgtggc

SEQ ID NO: 478345 - DNA, 25 bp, Mus musculus
tcttaatcgaggcaagggactcctg

SEQ ID NO: 478346 - DNA, 25 bp, Mus musculus
tcttaatgctagatgagaagcgcgt

SEQ ID NO: 478347 - DNA, 25 bp, Mus musculus
tcttaatggcagtggtctgggcacc

SEQ ID NO: 478348 - DNA, 25 bp, Mus musculus
tcttaatggctgagctatcgcttca

SEQ ID NO: 478349 - DNA, 25 bp, Mus musculus
tcttaatggtgcaggtgacccgctc

SEQ ID NO: 478350 - DNA, 25 bp, Mus musculus
tcttaatgtacataccgtaaggcgt

SEQ ID NO: 478351 - DNA, 25 bp, Mus musculus
tcttacaaaggacgacattgcaggc

SEQ ID NO: 478352 - DNA, 25 bp, Mus musculus
tcttacaaggaggtggatcgctacg

SEQ ID NO: 478353 - DNA, 25 bp, Mus musculus
tcttacaaggccatgctactcgggt

SEQ ID NO: 478354 - DNA, 25 bp, Mus musculus
tcttacacatcactggtcctgggca

SEQ ID NO: 478355 - DNA, 25 bp, Mus musculus
tcttacacgtgaagcagcaggttaa

SEQ ID NO: 478356 - DNA, 25 bp, Mus musculus
tcttacacgtgtggcagtcaggacc

SEQ ID NO: 478357 - DNA, 25 bp, Mus musculus
tcttacagggacttgagaggctcag

SEQ ID NO: 478358 - DNA, 25 bp, Mus musculus
tcttacaggtcctagctgggttggc

SEQ ID NO: 478359 - DNA, 25 bp, Mus musculus
tcttacaggttcagggtaacccgag

SEQ ID NO: 478360 - DNA, 25 bp, Mus musculus
tcttacatgcatggaggcagtccgt

SEQ ID NO: 478361 - DNA, 25 bp, Mus musculus
tcttacattttacccttcgattcga

SEQ ID NO: 478362 - DNA, 25 bp, Mus musculus
tcttaccaaagtgcgttcgagcgaa

SEQ ID NO: 478363 - DNA, 25 bp, Mus musculus
tcttaccacggacaagatcttggcc

SEQ ID NO: 478364 - DNA, 25 bp, Mus musculus
tcttaccagcgagtcagtagccagt

SEQ ID NO: 478365 - DNA, 25 bp, Mus musculus
tcttaccatggaaggcaagcaaagc

SEQ ID NO: 478366 - DNA, 25 bp, Mus musculus
tcttaccattgtggcatctaagtgc

SEQ ID NO: 478367 - DNA, 25 bp, Mus musculus
tcttacccatggaaaaaggaagcaa

SEQ ID NO: 478368 - DNA, 25 bp, Mus musculus
tcttaccctggagcgaaggtacagg

SEQ ID NO: 478369 - DNA, 25 bp, Mus musculus
tcttacctggagtacgtgtcgtgcg

SEQ ID NO: 478370 - DNA, 25 bp, Mus musculus
tcttacctgggagccctgcagggag

SEQ ID NO: 478371 - DNA, 25 bp, Mus musculus
tcttaccttacggatgctggcaatg

SEQ ID NO: 478372 - DNA, 25 bp, Mus musculus
tcttaccttaggcagctccagtggc

SEQ ID NO: 478373 - DNA, 25 bp, Mus musculus
tcttacgccaggatatgactccagg

SEQ ID NO: 478374 - DNA, 25 bp, Mus musculus
tcttacgtagtaaaggcagggtcgc

SEQ ID NO: 478375 - DNA, 25 bp, Mus musculus
tcttactcacttcagagacgacctg

SEQ ID NO: 478376 - DNA, 25 bp, Mus musculus
tcttactgctaggagactgcatggc

SEQ ID NO: 478377 - DNA, 25 bp, Mus musculus
tcttactgtagccattgtagtgggt

SEQ ID NO: 478378 - DNA, 25 bp, Mus musculus
tcttactgtatcagccgaatgacaa

SEQ ID NO: 478379 - DNA, 25 bp, Mus musculus
tcttacttcaggagactgctgggtt

SEQ ID NO: 478380 - DNA, 25 bp, Mus musculus
tcttagaaagacaagggccacattt

SEQ ID NO: 478381 - DNA, 25 bp, Mus musculus
tcttagaaataatcatgggacaggg

SEQ ID NO: 478382 - DNA, 25 bp, Mus musculus
tcttagaagctatcagtccccacct

SEQ ID NO: 478383 - DNA, 25 bp, Mus musculus
tcttagaatttgaaaagcaggacgc

SEQ ID NO: 478384 - DNA, 25 bp, Mus musculus
tcttagaccatccagagccatctac

SEQ ID NO: 478385 - DNA, 25 bp, Mus musculus
tcttagacggccttgcagataccac

SEQ ID NO: 478386 - DNA, 25 bp, Mus musculus
tcttagactctagacccggctgtag

SEQ ID NO: 478387 - DNA, 25 bp, Mus musculus
tcttagagatgtattcagcgggcgg

SEQ ID NO: 478388 - DNA, 25 bp, Mus musculus
tcttagagcccagaaaccgagacgt

SEQ ID NO: 478389 - DNA, 25 bp, Mus musculus
tcttagaggctaagaccagacactt

SEQ ID NO: 478390 - DNA, 25 bp, Mus musculus
tcttagagggcttgacgccaggtcc

SEQ ID NO: 478391 - DNA, 25 bp, Mus musculus
tcttagaggtttcagaaccttctgc

SEQ ID NO: 478392 - DNA, 25 bp, Mus musculus
tcttagagtttgttagactaggcac

SEQ ID NO: 478393 - DNA, 25 bp, Mus musculus
tcttagataatgacgggcgaaggct

SEQ ID NO: 478394 - DNA, 25 bp, Mus musculus
tcttagatctatctgccagtctaac

SEQ ID NO: 478395 - DNA, 25 bp, Mus musculus
tcttagatgaaagcagtgtcccgcc

SEQ ID NO: 478396 - DNA, 25 bp, Mus musculus
tcttagcagagggtctcggttcccg

SEQ ID NO: 478397 - DNA, 25 bp, Mus musculus
tcttagcagggcgaggcttattaag

SEQ ID NO: 478398 - DNA, 25 bp, Mus musculus
tcttagccaaggagggaaggccttc

SEQ ID NO: 478399 - DNA, 25 bp, Mus musculus
tcttagcccagaggaacaagagctg

SEQ ID NO: 478400 - DNA, 25 bp, Mus musculus
tcttagcctgttatgaaagttgaga

SEQ ID NO: 478401 - DNA, 25 bp, Mus musculus
tcttagctattggaacaagaacagg

SEQ ID NO: 478402 - DNA, 25 bp, Mus musculus
tcttagctgcaaggagagatccgcg

SEQ ID NO: 478403 - DNA, 25 bp, Mus musculus
tcttagctgggaactgacagtcgat

SEQ ID NO: 478404 - DNA, 25 bp, Mus musculus
tcttagctgttgactactgacaggg

SEQ ID NO: 478405 - DNA, 25 bp, Mus musculus
tcttaggaatcctggaacccggagt

SEQ ID NO: 478406 - DNA, 25 bp, Mus musculus
tcttaggactctagttggcagcggc

SEQ ID NO: 478407 - DNA, 25 bp, Mus musculus
tcttaggacttggtggacgctccgt

SEQ ID NO: 478408 - DNA, 25 bp, Mus musculus
tcttaggagaccaaatggagaagtt

SEQ ID NO: 478409 - DNA, 25 bp, Mus musculus
tcttaggagccctgggactgaagcc

SEQ ID NO: 478410 - DNA, 25 bp, Mus musculus
tcttaggaggcacattcagcattcc

SEQ ID NO: 478411 - DNA, 25 bp, Mus musculus
tcttaggcaccttgtcttccgggaa

SEQ ID NO: 478412 - DNA, 25 bp, Mus musculus
tcttaggctgcttcataatgcttga

SEQ ID NO: 478413 - DNA, 25 bp, Mus musculus
tcttagggcccaatgctctgggatt

SEQ ID NO: 478414 - DNA, 25 bp, Mus musculus
tcttagggcgatggtacaatggtac

SEQ ID NO: 478415 - DNA, 25 bp, Mus musculus
tcttaggtgacattgccattgcttt

SEQ ID NO: 478416 - DNA, 25 bp, Mus musculus
tcttaggttcccgagctgcttagcc

SEQ ID NO: 478417 - DNA, 25 bp, Mus musculus
tcttaggttcttaagtatctgagac

SEQ ID NO: 478418 - DNA, 25 bp, Mus musculus
tcttagtagaagaaccagtctgtgg

SEQ ID NO: 478419 - DNA, 25 bp, Mus musculus
tcttagtagcagagacaccaggctc

SEQ ID NO: 478420 - DNA, 25 bp, Mus musculus
tcttagtcacgagaaagctgctggt

SEQ ID NO: 478421 - DNA, 25 bp, Mus musculus
tcttagtgacgctatcccaggactc

SEQ ID NO: 478422 - DNA, 25 bp, Mus musculus
tcttagtgagaagtgagatgactcg

SEQ ID NO: 478423 - DNA, 25 bp, Mus musculus
tcttagtgagcaggccggaagttgc

SEQ ID NO: 478424 - DNA, 25 bp, Mus musculus
tcttagtgaggtcccctgctgatgg

SEQ ID NO: 478425 - DNA, 25 bp, Mus musculus
tcttagtgcttaccggacagccgag

SEQ ID NO: 478426 - DNA, 25 bp, Mus musculus
tcttagttaaaagtggctccgccag

SEQ ID NO: 478427 - DNA, 25 bp, Mus musculus
tcttagttagtttcaggccctttgc

SEQ ID NO: 478428 - DNA, 25 bp, Mus musculus
tcttagttcgtcagtgcctgccggg

SEQ ID NO: 478429 - DNA, 25 bp, Mus musculus
tcttataaaacacaggcatgtcggg

SEQ ID NO: 478430 - DNA, 25 bp, Mus musculus
tcttatacatttcattccaactgca

SEQ ID NO: 478431 - DNA, 25 bp, Mus musculus
tcttataccaccaaccaggaacggt

SEQ ID NO: 478432 - DNA, 25 bp, Mus musculus
tcttatacgttgatcctccaggctg

SEQ ID NO: 478433 - DNA, 25 bp, Mus musculus
tcttatagaaaacatgccagagaag

SEQ ID NO: 478434 - DNA, 25 bp, Mus musculus
tcttatagccatggcgatccaggat

SEQ ID NO: 478435 - DNA, 25 bp, Mus musculus
tcttatagttccttctcacggcaaa

SEQ ID NO: 478436 - DNA, 25 bp, Mus musculus
tcttatcagaaagtgcccagtgacc

SEQ ID NO: 478437 - DNA, 25 bp, Mus musculus
tcttatcatatgtgtcccgtgggcc

SEQ ID NO: 478438 - DNA, 25 bp, Mus musculus
tcttatcattctgggcaaacattca

SEQ ID NO: 478439 - DNA, 25 bp, Mus musculus
tcttatccaatccagaccagaaggg

SEQ ID NO: 478440 - DNA, 25 bp, Mus musculus
tcttatccagatagtcaggacagcg

SEQ ID NO: 478441 - DNA, 25 bp, Mus musculus
tcttatcctcaatgtcgagtgggcc

SEQ ID NO: 478442 - DNA, 25 bp, Mus musculus
tcttatcgggagcacagccagagtg

SEQ ID NO: 478443 - DNA, 25 bp, Mus musculus
tcttatctgaggctaaacggatggc

SEQ ID NO: 478444 - DNA, 25 bp, Mus musculus
tcttatcttagctaaccgcgtcggg

SEQ ID NO: 478445 - DNA, 25 bp, Mus musculus
tcttatgaagcaaaggcccctgcag

SEQ ID NO: 478446 - DNA, 25 bp, Mus musculus
tcttatgaggcttccgagccaccgt

SEQ ID NO: 478447 - DNA, 25 bp, Mus musculus
tcttatgccgcaagtgtggctccgg

SEQ ID NO: 478448 - DNA, 25 bp, Mus musculus
tcttatgctgaactggaaccgcctg

SEQ ID NO: 478449 - DNA, 25 bp, Mus musculus
tcttatggaacagaacaaacggtgg

SEQ ID NO: 478450 - DNA, 25 bp, Mus musculus
tcttatggacagaagcactttcgca

SEQ ID NO: 478451 - DNA, 25 bp, Mus musculus
tcttatggcacaaagtggaacccct

SEQ ID NO: 478452 - DNA, 25 bp, Mus musculus
tcttatggttgctctagggatgaca

SEQ ID NO: 478453 - DNA, 25 bp, Mus musculus
tcttatgtaagaagtcccctgctca

SEQ ID NO: 478454 - DNA, 25 bp, Mus musculus
tcttattagacggaatgctgagcac

SEQ ID NO: 478455 - DNA, 25 bp, Mus musculus
tcttattagtatagtacttttgccg

SEQ ID NO: 478456 - DNA, 25 bp, Mus musculus
tcttattggacagggctctcccgca

SEQ ID NO: 478457 - DNA, 25 bp, Mus musculus
tcttcaaaacgccagttcgggtcgc

SEQ ID NO: 478458 - DNA, 25 bp, Mus musculus
tcttcaaaccttgcgtctggcgcgg

SEQ ID NO: 478459 - DNA, 25 bp, Mus musculus
tcttcaaagcctagtcgggacgtct

SEQ ID NO: 478460 - DNA, 25 bp, Mus musculus
tcttcaaaggcaacatggtgacact

SEQ ID NO: 478461 - DNA, 25 bp, Mus musculus
tcttcaaaggcgaacgatactggcg

SEQ ID NO: 478462 - DNA, 25 bp, Mus musculus
tcttcaacaccgtcactatggcaac

SEQ ID NO: 478463 - DNA, 25 bp, Mus musculus
tcttcaacatgtacctcacccggga

SEQ ID NO: 478464 - DNA, 25 bp, Mus musculus
tcttcaaccacagagactgatggcc

SEQ ID NO: 478465 - DNA, 25 bp, Mus musculus
tcttcaacggaaatgcgggagcctg

SEQ ID NO: 478466 - DNA, 25 bp, Mus musculus
tcttcaactgggttctttgagctca

SEQ ID NO: 478467 - DNA, 25 bp, Mus musculus
tcttcaagaaagatccccaggcgtg

SEQ ID NO: 478468 - DNA, 25 bp, Mus musculus
tcttcaagaactgtccacgagggcc

SEQ ID NO: 478469 - DNA, 25 bp, Mus musculus
tcttcaagattgagaagcctggagc

SEQ ID NO: 478470 - DNA, 25 bp, Mus musculus
tcttcaagccatagagccagttgct

SEQ ID NO: 478471 - DNA, 25 bp, Mus musculus
tcttcaagcccagctgttcagggca

SEQ ID NO: 478472 - DNA, 25 bp, Mus musculus
tcttcaaggacactttctcatatca

SEQ ID NO: 478473 - DNA, 25 bp, Mus musculus
tcttcaaggacgaggagaacacggg

SEQ ID NO: 478474 - DNA, 25 bp, Mus musculus
tcttcaaggagacaaagacccgggc

SEQ ID NO: 478475 - DNA, 25 bp, Mus musculus
tcttcaaggcaagcgaggtacttct

SEQ ID NO: 478476 - DNA, 25 bp, Mus musculus
tcttcaagggcataggagactctat

SEQ ID NO: 478477 - DNA, 25 bp, Mus musculus
tcttcaagtaaggaccacgatggct

SEQ ID NO: 478478 - DNA, 25 bp, Mus musculus
tcttcaagtactcggccaaaacagg

SEQ ID NO: 478479 - DNA, 25 bp, Mus musculus
tcttcaagtggctcaggacctcagg

SEQ ID NO: 478480 - DNA, 25 bp, Mus musculus
tcttcaagtttgacggcaggcaggg

SEQ ID NO: 478481 - DNA, 25 bp, Mus musculus
tcttcaatcaggacttcaggcgctc

SEQ ID NO: 478482 - DNA, 25 bp, Mus musculus
tcttcaatgccctgtggaacctgga

SEQ ID NO: 478483 - DNA, 25 bp, Mus musculus
tcttcacaaacatggtttccccggg

SEQ ID NO: 478484 - DNA, 25 bp, Mus musculus
tcttcacaacggcaaggagtggaaa

SEQ ID NO: 478485 - DNA, 25 bp, Mus musculus
tcttcacacatccaacagggatcct

SEQ ID NO: 478486 - DNA, 25 bp, Mus musculus
tcttcacaggcaacagatgaggtag

SEQ ID NO: 478487 - DNA, 25 bp, Mus musculus
tcttcacagtacagggctggagttt

SEQ ID NO: 478488 - DNA, 25 bp, Mus musculus
tcttcacagtgggtgccaggaaacc

SEQ ID NO: 478489 - DNA, 25 bp, Mus musculus
tcttcaccagagcagccaacatggg

SEQ ID NO: 478490 - DNA, 25 bp, Mus musculus
tcttcacctactcttgtctccaggg

SEQ ID NO: 478491 - DNA, 25 bp, Mus musculus
tcttcacctttaagcacaaacataa

SEQ ID NO: 478492 - DNA, 25 bp, Mus musculus
tcttcacgaagcctgcaagggttgt

SEQ ID NO: 478493 - DNA, 25 bp, Mus musculus
tcttcacgagctgagtggacctgcc

SEQ ID NO: 478494 - DNA, 25 bp, Mus musculus
tcttcacgcgcgacatgatcgagga

SEQ ID NO: 478495 - DNA, 25 bp, Mus musculus
tcttcacggcaatgatagactttta

SEQ ID NO: 478496 - DNA, 25 bp, Mus musculus
tcttcacgggtgttgggtccagcag

SEQ ID NO: 478497 - DNA, 25 bp, Mus musculus
tcttcacggtgcttggctacatggc

SEQ ID NO: 478498 - DNA, 25 bp, Mus musculus
tcttcacgtaggagtgaggaccaag

SEQ ID NO: 478499 - DNA, 25 bp, Mus musculus
tcttcactgcgactggtgagtctag

SEQ ID NO: 478500 - DNA, 25 bp, Mus musculus
tcttcacttcgcagagggaggtcct

SEQ ID NO: 478501 - DNA, 25 bp, Mus musculus
tcttcagacatcacttatgccccag

SEQ ID NO: 478502 - DNA, 25 bp, Mus musculus
tcttcagacggacgcactgggcttg

SEQ ID NO: 478503 - DNA, 25 bp, Mus musculus
tcttcagagcccatcaagaactgtc

SEQ ID NO: 478504 - DNA, 25 bp, Mus musculus
tcttcagaggaacgcaaactcccca

SEQ ID NO: 478505 - DNA, 25 bp, Mus musculus
tcttcagagtgtcccgcaggtgtca

SEQ ID NO: 478506 - DNA, 25 bp, Mus musculus
tcttcagatggatgattagtgaggg

SEQ ID NO: 478507 - DNA, 25 bp, Mus musculus
tcttcagcaagagagcagaaaccgt

SEQ ID NO: 478508 - DNA, 25 bp, Mus musculus
tcttcagcagcacatcctaggcagg

SEQ ID NO: 478509 - DNA, 25 bp, Mus musculus
tcttcagcagcgatagttctttcgc

SEQ ID NO: 478510 - DNA, 25 bp, Mus musculus
tcttcagcatggagaggacaccgtg

SEQ ID NO: 478511 - DNA, 25 bp, Mus musculus
tcttcagccataccattggtctgga

SEQ ID NO: 478512 - DNA, 25 bp, Mus musculus
tcttcagccgaggagctccgaaaag

SEQ ID NO: 478513 - DNA, 25 bp, Mus musculus
tcttcagcgacaccatccacgttgg

SEQ ID NO: 478514 - DNA, 25 bp, Mus musculus
tcttcagctgcacatggcgagaaca

SEQ ID NO: 478515 - DNA, 25 bp, Mus musculus
tcttcagctgctgtgcgggacatta

SEQ ID NO: 478516 - DNA, 25 bp, Mus musculus
tcttcaggatgaattatagctgctg

SEQ ID NO: 478517 - DNA, 25 bp, Mus musculus
tcttcaggcacttttggctggccag

SEQ ID NO: 478518 - DNA, 25 bp, Mus musculus
tcttcaggcagtacttcagggccct

SEQ ID NO: 478519 - DNA, 25 bp, Mus musculus
tcttcaggcgtgaccaagggaacgt

SEQ ID NO: 478520 - DNA, 25 bp, Mus musculus
tcttcagggaatgtctgggtgaccc

SEQ ID NO: 478521 - DNA, 25 bp, Mus musculus
tcttcagggaattgcaggaatgccg

SEQ ID NO: 478522 - DNA, 25 bp, Mus musculus
tcttcagggcactaattattttgct

SEQ ID NO: 478523 - DNA, 25 bp, Mus musculus
tcttcagggcacttccggaagcggc

SEQ ID NO: 478524 - DNA, 25 bp, Mus musculus
tcttcagggccctcaaggctctgct

SEQ ID NO: 478525 - DNA, 25 bp, Mus musculus
tcttcaggtgaagtccgagccatcc

SEQ ID NO: 478526 - DNA, 25 bp, Mus musculus
tcttcagtaggaaaacacaggaccg

SEQ ID NO: 478527 - DNA, 25 bp, Mus musculus
tcttcagtatggtggtagtagctca

SEQ ID NO: 478528 - DNA, 25 bp, Mus musculus
tcttcagtcagccaaggaacagatt

SEQ ID NO: 478529 - DNA, 25 bp, Mus musculus
tcttcagtcctgtgtaaaacccctg

SEQ ID NO: 478530 - DNA, 25 bp, Mus musculus
tcttcagtgaacgaggagcatccat

SEQ ID NO: 478531 - DNA, 25 bp, Mus musculus
tcttcataaaataggtctagggctc

SEQ ID NO: 478532 - DNA, 25 bp, Mus musculus
tcttcataggcctgggagagctcgt

SEQ ID NO: 478533 - DNA, 25 bp, Mus musculus
tcttcatcaacagaatgggtcaagg

SEQ ID NO: 478534 - DNA, 25 bp, Mus musculus
tcttcatcacccttgtggacaggcg

SEQ ID NO: 478535 - DNA, 25 bp, Mus musculus
tcttcatcctgtgatggctgcgaca

SEQ ID NO: 478536 - DNA, 25 bp, Mus musculus
tcttcatcggcctcgggtttagtgc

SEQ ID NO: 478537 - DNA, 25 bp, Mus musculus
tcttcatctctaacctggcggctgg

SEQ ID NO: 478538 - DNA, 25 bp, Mus musculus
tcttcatgacattctgagcccacag

SEQ ID NO: 478539 - DNA, 25 bp, Mus musculus
tcttcatgagaaactgcctttattg

SEQ ID NO: 478540 - DNA, 25 bp, Mus musculus
tcttcatgcgtcaacttaagctcag

SEQ ID NO: 478541 - DNA, 25 bp, Mus musculus
tcttcatggccatggtgggacccct

SEQ ID NO: 478542 - DNA, 25 bp, Mus musculus
tcttcatgggcaatgagccggccta

SEQ ID NO: 478543 - DNA, 25 bp, Mus musculus
tcttcatgtatgtccggtctggcaa

SEQ ID NO: 478544 - DNA, 25 bp, Mus musculus
tcttcatgtgcacaagtggacggcg

SEQ ID NO: 478545 - DNA, 25 bp, Mus musculus
tcttcatgttcctgtgatcttcggg

SEQ ID NO: 478546 - DNA, 25 bp, Mus musculus
tcttcattcaaaagagagtcctgtt

SEQ ID NO: 478547 - DNA, 25 bp, Mus musculus
tcttcattctactgctggcccttgc

SEQ ID NO: 478548 - DNA, 25 bp, Mus musculus
tcttcattgaagacagagctgaaat

SEQ ID NO: 478549 - DNA, 25 bp, Mus musculus
tcttcattggaaaagtcagacggac

SEQ ID NO: 478550 - DNA, 25 bp, Mus musculus
tcttcattggaggagtacctgacca

SEQ ID NO: 478551 - DNA, 25 bp, Mus musculus
tcttcattgttgtcggtcctctgcc

SEQ ID NO: 478552 - DNA, 25 bp, Mus musculus
tcttcatttgggaggaaagctgaga

SEQ ID NO: 478553 - DNA, 25 bp, Mus musculus
tcttccaagagggagcaatagccgg

SEQ ID NO: 478554 - DNA, 25 bp, Mus musculus
tcttccaaggactgctgcgcttcgg

SEQ ID NO: 478555 - DNA, 25 bp, Mus musculus
tcttccaataaacaacggcagtggt

SEQ ID NO: 478556 - DNA, 25 bp, Mus musculus
tcttccaatgctgaacctgtgcagg

SEQ ID NO: 478557 - DNA, 25 bp, Mus musculus
tcttccaatggtgaagtgattcccc

SEQ ID NO: 478558 - DNA, 25 bp, Mus musculus
tcttccacacactgatgtgttcctg

SEQ ID NO: 478559 - DNA, 25 bp, Mus musculus
tcttccacaggatcatgcgaggcat

SEQ ID NO: 478560 - DNA, 25 bp, Mus musculus
tcttccacatgcgtctggagagcaa

SEQ ID NO: 478561 - DNA, 25 bp, Mus musculus
tcttccacgacgaagtctgcaggtg

SEQ ID NO: 478562 - DNA, 25 bp, Mus musculus
tcttccacggtgacagctgctgtgt

SEQ ID NO: 478563 - DNA, 25 bp, Mus musculus
tcttccacgtcttcagcaatgccgg

SEQ ID NO: 478564 - DNA, 25 bp, Mus musculus
tcttccactacaacagcaacagcgg

SEQ ID NO: 478565 - DNA, 25 bp, Mus musculus
tcttccactgtgttcttttctctgt

SEQ ID NO: 478566 - DNA, 25 bp, Mus musculus
tcttccagagaaagccacaccgttg

SEQ ID NO: 478567 - DNA, 25 bp, Mus musculus
tcttccagctgaatgcccgagtgtt

SEQ ID NO: 478568 - DNA, 25 bp, Mus musculus
tcttccaggaatatgcacagctcac

SEQ ID NO: 478569 - DNA, 25 bp, Mus musculus
tcttccaggagacgtgattgaaagg

SEQ ID NO: 478570 - DNA, 25 bp, Mus musculus
tcttccagggtcctgtttcatttgg

SEQ ID NO: 478571 - DNA, 25 bp, Mus musculus
tcttccagtacaatggccgccagtt

SEQ ID NO: 478572 - DNA, 25 bp, Mus musculus
tcttcccaagaaccaacagtgatgt

SEQ ID NO: 478573 - DNA, 25 bp, Mus musculus
tcttcccagaaaagccgatgatctc

SEQ ID NO: 478574 - DNA, 25 bp, Mus musculus
tcttcccaggagaatagcagccagg

SEQ ID NO: 478575 - DNA, 25 bp, Mus musculus
tcttcccaggtcgtcgttagcgtcg

SEQ ID NO: 478576 - DNA, 25 bp, Mus musculus
tcttcccattgttgaccaagtgtgg

SEQ ID NO: 478577 - DNA, 25 bp, Mus musculus
tcttccccaggacgttggagtcaca

SEQ ID NO: 478578 - DNA, 25 bp, Mus musculus
tcttccccaggtacctggccagtgg

SEQ ID NO: 478579 - DNA, 25 bp, Mus musculus
tcttcccgcaggaaacacagtgacc

SEQ ID NO: 478580 - DNA, 25 bp, Mus musculus
tcttcccggagtagatgaaactggc

SEQ ID NO: 478581 - DNA, 25 bp, Mus musculus
tcttcccggcattggatgcagggtc

SEQ ID NO: 478582 - DNA, 25 bp, Mus musculus
tcttcccgggattaaatgtgcagca

SEQ ID NO: 478583 - DNA, 25 bp, Mus musculus
tcttccctaaggctgcacttcgtgg

SEQ ID NO: 478584 - DNA, 25 bp, Mus musculus
tcttccctgaggtcctaagagaagc

SEQ ID NO: 478585 - DNA, 25 bp, Mus musculus
tcttccctgtcctcggtggtctggc

SEQ ID NO: 478586 - DNA, 25 bp, Mus musculus
tcttcccttatgtgagataagaccg

SEQ ID NO: 478587 - DNA, 25 bp, Mus musculus
tcttcccttgtggagatgtctctga

SEQ ID NO: 478588 - DNA, 25 bp, Mus musculus
tcttccgagagctcaagcgcgactt

SEQ ID NO: 478589 - DNA, 25 bp, Mus musculus
tcttccgcctggacagcctgttggg

SEQ ID NO: 478590 - DNA, 25 bp, Mus musculus
tcttccgcgcttatgagcagcatgg

SEQ ID NO: 478591 - DNA, 25 bp, Mus musculus
tcttccggaaagagatgagatgcta

SEQ ID NO: 478592 - DNA, 25 bp, Mus musculus
tcttccggacgagaaaagagctgta

SEQ ID NO: 478593 - DNA, 25 bp, Mus musculus
tcttccggtgtggaggctgctgcaa

SEQ ID NO: 478594 - DNA, 25 bp, Mus musculus
tcttccgtcaagcatcaagcctgag

SEQ ID NO: 478595 - DNA, 25 bp, Mus musculus
tcttccgtcttcctgagtatgaggg

SEQ ID NO: 478596 - DNA, 25 bp, Mus musculus
tcttccgtgtgtcgtgtcttgaaag

SEQ ID NO: 478597 - DNA, 25 bp, Mus musculus
tcttccgttacaagcacagcatgtg

SEQ ID NO: 478598 - DNA, 25 bp, Mus musculus
tcttccgttgcaaagcatttctggg

SEQ ID NO: 478599 - DNA, 25 bp, Mus musculus
tcttcctaacaacagcaaacaattc

SEQ ID NO: 478600 - DNA, 25 bp, Mus musculus
tcttcctatggtcaaacgtcagcaa

SEQ ID NO: 478601 - DNA, 25 bp, Mus musculus
tcttcctcaaaggaccaaaggtgtg

SEQ ID NO: 478602 - DNA, 25 bp, Mus musculus
tcttcctcctcttgggacctgaatc

SEQ ID NO: 478603 - DNA, 25 bp, Mus musculus
tcttcctctgcaagggacacgaggg

SEQ ID NO: 478604 - DNA, 25 bp, Mus musculus
tcttcctgaagggagcctacgctga

SEQ ID NO: 478605 - DNA, 25 bp, Mus musculus
tcttcctgaggctgaggactcagca

SEQ ID NO: 478606 - DNA, 25 bp, Mus musculus
tcttcctgatagtgactgaacgcag

SEQ ID NO: 478607 - DNA, 25 bp, Mus musculus
tcttcctgccgaaaagccagttggg

SEQ ID NO: 478608 - DNA, 25 bp, Mus musculus
tcttcctgcttctgtgaattctgaa

SEQ ID NO: 478609 - DNA, 25 bp, Mus musculus
tcttcctggaaagtcgcaagcctgt

SEQ ID NO: 478610 - DNA, 25 bp, Mus musculus
tcttcctggagcaaatacaaaatgg

SEQ ID NO: 478611 - DNA, 25 bp, Mus musculus
tcttcctggctctattcctggtcat

SEQ ID NO: 478612 - DNA, 25 bp, Mus musculus
tcttcctgggtgtagtctgagagcc

SEQ ID NO: 478613 - DNA, 25 bp, Mus musculus
tcttcctggtctgcgaaagcctctg

SEQ ID NO: 478614 - DNA, 25 bp, Mus musculus
tcttcctgtagagacagccagtcgg

SEQ ID NO: 478615 - DNA, 25 bp, Mus musculus
tcttccttaggtccagctgctcagt

SEQ ID NO: 478616 - DNA, 25 bp, Mus musculus
tcttccttgggagtggcttgcacag

SEQ ID NO: 478617 - DNA, 25 bp, Mus musculus
tcttccttgtggcttgaattctggt

SEQ ID NO: 478618 - DNA, 25 bp, Mus musculus
tcttcgaaaagacatgcaaggagct

SEQ ID NO: 478619 - DNA, 25 bp, Mus musculus
tcttcgaaacgtcacacagtaactg

SEQ ID NO: 478620 - DNA, 25 bp, Mus musculus
tcttcgaagtgaactgcagtaggct

SEQ ID NO: 478621 - DNA, 25 bp, Mus musculus
tcttcgacaatgaaggtggctgtca

SEQ ID NO: 478622 - DNA, 25 bp, Mus musculus
tcttcgacagacagagaaccgtgcc

SEQ ID NO: 478623 - DNA, 25 bp, Mus musculus
tcttcgagaccgaggagtgctatgt

SEQ ID NO: 478624 - DNA, 25 bp, Mus musculus
tcttcgagcatacccgcttgataaa

SEQ ID NO: 478625 - DNA, 25 bp, Mus musculus
tcttcgaggagttcgtgcgctggca

SEQ ID NO: 478626 - DNA, 25 bp, Mus musculus
tcttcgagtcgcaggaacaatggct

SEQ ID NO: 478627 - DNA, 25 bp, Mus musculus
tcttcgagtcttctatttcttctcc

SEQ ID NO: 478628 - DNA, 25 bp, Mus musculus
tcttcgagttcgatcagagcggcgg

SEQ ID NO: 478629 - DNA, 25 bp, Mus musculus
tcttcgatgtcctcacatggctggg

SEQ ID NO: 478630 - DNA, 25 bp, Mus musculus
tcttcgattctgatgggagcgggac

SEQ ID NO: 478631 - DNA, 25 bp, Mus musculus
tcttcgattgttcttccagggctca

SEQ ID NO: 478632 - DNA, 25 bp, Mus musculus
tcttcgcaggaggttctgaacataa

SEQ ID NO: 478633 - DNA, 25 bp, Mus musculus
tcttcgcaggagtgaaatcggaacc

SEQ ID NO: 478634 - DNA, 25 bp, Mus musculus
tcttcgcataaggagcgagcgcatt

SEQ ID NO: 478635 - DNA, 25 bp, Mus musculus
tcttcgccacatggaaagcatggaa

SEQ ID NO: 478636 - DNA, 25 bp, Mus musculus
tcttcgcggtcctggtggtcgtgct
